United States Patent 7,888,497 (BIOINFORMATICALLY DETECTABLE GROUP OF NOVEL REGULATORY OLIGONUCLEOTIDES AND USES THEREOF) - sequence listing, part 38

SEQ ID NO: 1584246 - DNA, 16 bp, Homo sapiens
ctctagattcataaat

SEQ ID NO: 1584247 - DNA, 17 bp, Homo sapiens
ctctagcagcacctcct

SEQ ID NO: 1584248 - DNA, 13 bp, Homo sapiens
ctctagccaggag

SEQ ID NO: 1584249 - DNA, 20 bp, Homo sapiens
ctctagccaggagtctgtgc

SEQ ID NO: 1584250 - DNA, 20 bp, Homo sapiens
ctctagcccactccctgcct

SEQ ID NO: 1584251 - DNA, 12 bp, Homo sapiens
ctctagctggca

SEQ ID NO: 1584252 - DNA, 16 bp, Homo sapiens
ctctagctggcaggac

SEQ ID NO: 1584253 - DNA, 17 bp, Homo sapiens
ctctagctggcaggaca

SEQ ID NO: 1584254 - DNA, 21 bp, Homo sapiens
ctctaggaagacatttttccg

SEQ ID NO: 1584255 - DNA, 18 bp, Homo sapiens
ctctaggagggagccttg

SEQ ID NO: 1584256 - DNA, 16 bp, Homo sapiens
ctctaggcctctccag

SEQ ID NO: 1584257 - DNA, 14 bp, Homo sapiens
ctctaggctgcccc

SEQ ID NO: 1584258 - DNA, 20 bp, Homo sapiens
ctctaggggtcaggctccat

SEQ ID NO: 1584259 - DNA, 19 bp, Homo sapiens
ctctagtccccaaggcctc

SEQ ID NO: 1584260 - DNA, 21 bp, Homo sapiens
ctctagtgccctccacagccg

SEQ ID NO: 1584261 - DNA, 20 bp, Homo sapiens
ctctagtgggacagcccaga

SEQ ID NO: 1584262 - DNA, 22 bp, Homo sapiens
ctctagtgggacagcccagagc

SEQ ID NO: 1584263 - DNA, 12 bp, Homo sapiens
ctctagttcaaa

SEQ ID NO: 1584264 - DNA, 15 bp, Homo sapiens
ctctagttctagatg

SEQ ID NO: 1584265 - DNA, 21 bp, Homo sapiens
ctctagttttcagccttggga

SEQ ID NO: 1584266 - DNA, 22 bp, Homo sapiens
ctctataagcaaattgcttttt

SEQ ID NO: 1584267 - DNA, 14 bp, Homo sapiens
ctctataattgttt

SEQ ID NO: 1584268 - DNA, 17 bp, Homo sapiens
ctctataccaataaagt

SEQ ID NO: 1584269 - DNA, 19 bp, Homo sapiens
ctctataccaataaagtga

SEQ ID NO: 1584270 - DNA, 14 bp, Homo sapiens
ctctatactttgtt

SEQ ID NO: 1584271 - DNA, 19 bp, Homo sapiens
ctctatactttgttctgtt

SEQ ID NO: 1584272 - DNA, 11 bp, Homo sapiens
ctctatattta

SEQ ID NO: 1584273 - DNA, 19 bp, Homo sapiens
ctctatcagaaatacaaaa

SEQ ID NO: 1584274 - DNA, 18 bp, Homo sapiens
ctctatcctctcttcctc

SEQ ID NO: 1584275 - DNA, 15 bp, Homo sapiens
ctctatgagtctaga

SEQ ID NO: 1584276 - DNA, 21 bp, Homo sapiens
ctctatgccagctcagtccca

SEQ ID NO: 1584277 - DNA, 19 bp, Homo sapiens
ctctattgggcacagccta

SEQ ID NO: 1584278 - DNA, 14 bp, Homo sapiens
ctctatttaagatt

SEQ ID NO: 1584279 - DNA, 19 bp, Homo sapiens
ctctatttattagccaact

SEQ ID NO: 1584280 - DNA, 20 bp, Homo sapiens
ctctatttattagccaactg

SEQ ID NO: 1584281 - DNA, 20 bp, Homo sapiens
ctctatttgagaagttctca

SEQ ID NO: 1584282 - DNA, 23 bp, Homo sapiens
ctctcaaaacaatattactttgt

SEQ ID NO: 1584283 - DNA, 23 bp, Homo sapiens
ctctcaaaagagaaaaacaaaac

SEQ ID NO: 1584284 - DNA, 15 bp, Homo sapiens
ctctcaagaccagag

SEQ ID NO: 1584285 - DNA, 14 bp, Homo sapiens
ctctcaagtaatat

SEQ ID NO: 1584286 - DNA, 12 bp, Homo sapiens
ctctcacacaca

SEQ ID NO: 1584287 - DNA, 13 bp, Homo sapiens
ctctcacacacac

SEQ ID NO: 1584288 - DNA, 19 bp, Homo sapiens
ctctcaccatgatgtgaag

SEQ ID NO: 1584289 - DNA, 22 bp, Homo sapiens
ctctcaccatgatgtgaagagt

SEQ ID NO: 1584290 - DNA, 16 bp, Homo sapiens
ctctcaccatttggat

SEQ ID NO: 1584291 - DNA, 16 bp, Homo sapiens
ctctcacccccatccc

SEQ ID NO: 1584292 - DNA, 14 bp, Homo sapiens
ctctcactccccag

SEQ ID NO: 1584293 - DNA, 19 bp, Homo sapiens
ctctcactccccagcccca

SEQ ID NO: 1584294 - DNA, 19 bp, Homo sapiens
ctctcactgtgttactgct

SEQ ID NO: 1584295 - DNA, 20 bp, Homo sapiens
ctctcactgtgttactgctt

SEQ ID NO: 1584296 - DNA, 13 bp, Homo sapiens
ctctcagaacata

SEQ ID NO: 1584297 - DNA, 20 bp, Homo sapiens
ctctcagaactcctgtgtgt

SEQ ID NO: 1584298 - DNA, 22 bp, Homo sapiens
ctctcagaggcctgctgccagt

SEQ ID NO: 1584299 - DNA, 19 bp, Homo sapiens
ctctcagcaagtgcccagt

SEQ ID NO: 1584300 - DNA, 20 bp, Homo sapiens
ctctcagcatagcctgcctg

SEQ ID NO: 1584301 - DNA, 11 bp, Homo sapiens
ctctcagccaa

SEQ ID NO: 1584302 - DNA, 23 bp, Homo sapiens
ctctcagccaacgagtaatttat

SEQ ID NO: 1584303 - DNA, 15 bp, Homo sapiens
ctctcagcctcccac

SEQ ID NO: 1584304 - DNA, 12 bp, Homo sapiens
ctctcagctcca

SEQ ID NO: 1584305 - DNA, 14 bp, Homo sapiens
ctctcagctcccag

SEQ ID NO: 1584306 - DNA, 16 bp, Homo sapiens
ctctcagctcccaggc

SEQ ID NO: 1584307 - DNA, 15 bp, Homo sapiens
ctctcagctggcagt

SEQ ID NO: 1584308 - DNA, 21 bp, Homo sapiens
ctctcaggagcacaggcagct

SEQ ID NO: 1584309 - DNA, 16 bp, Homo sapiens
ctctcaggatccaagc

SEQ ID NO: 1584310 - DNA, 17 bp, Homo sapiens
ctctcagtgccttctct

SEQ ID NO: 1584311 - DNA, 18 bp, Homo sapiens
ctctcagtgccttctctc

SEQ ID NO: 1584312 - DNA, 20 bp, Homo sapiens
ctctcagtgccttctctcag

SEQ ID NO: 1584313 - DNA, 22 bp, Homo sapiens
ctctcagtgccttctctcagct

SEQ ID NO: 1584314 - DNA, 17 bp, Homo sapiens
ctctcagttctctccct

SEQ ID NO: 1584315 - DNA, 12 bp, Homo sapiens
ctctcagttttt

SEQ ID NO: 1584316 - DNA, 17 bp, Homo sapiens
ctctcatcaactgaatg

SEQ ID NO: 1584317 - DNA, 18 bp, Homo sapiens
ctctcatcaactgaatga

SEQ ID NO: 1584318 - DNA, 19 bp, Homo sapiens
ctctcatcctccagtacct

SEQ ID NO: 1584319 - DNA, 18 bp, Homo sapiens
ctctcatcgccagacaac

SEQ ID NO: 1584320 - DNA, 16 bp, Homo sapiens
ctctcattccccaggt

SEQ ID NO: 1584321 - DNA, 20 bp, Homo sapiens
ctctcattccccaggtggct

SEQ ID NO: 1584322 - DNA, 20 bp, Homo sapiens
ctctccaaaggggctgctgg

SEQ ID NO: 1584323 - DNA, 21 bp, Homo sapiens
ctctccaaaggggctgctggg

SEQ ID NO: 1584324 - DNA, 22 bp, Homo sapiens
ctctccaaatattattcaagtg

SEQ ID NO: 1584325 - DNA, 23 bp, Homo sapiens
ctctccaaatattattcaagtgc

SEQ ID NO: 1584326 - DNA, 22 bp, Homo sapiens
ctctccaaccactgtgccactg

SEQ ID NO: 1584327 - DNA, 23 bp, Homo sapiens
ctctccaaccactgtgccactga

SEQ ID NO: 1584328 - DNA, 14 bp, Homo sapiens
ctctccaacctgga

SEQ ID NO: 1584329 - DNA, 21 bp, Homo sapiens
ctctccaactgcctaaggccc

SEQ ID NO: 1584330 - DNA, 12 bp, Homo sapiens
ctctccaagggc

SEQ ID NO: 1584331 - DNA, 13 bp, Homo sapiens
ctctccaagggct

SEQ ID NO: 1584332 - DNA, 17 bp, Homo sapiens
ctctccaagggcttctg

SEQ ID NO: 1584333 - DNA, 15 bp, Homo sapiens
ctctccaagtgccag

SEQ ID NO: 1584334 - DNA, 14 bp, Homo sapiens
ctctccacccccca

SEQ ID NO: 1584335 - DNA, 16 bp, Homo sapiens
ctctccaccccccacg

SEQ ID NO: 1584336 - DNA, 12 bp, Homo sapiens
ctctccacctca

SEQ ID NO: 1584337 - DNA, 18 bp, Homo sapiens
ctctccaccttagtactt

SEQ ID NO: 1584338 - DNA, 20 bp, Homo sapiens
ctctccaccttagtacttta

SEQ ID NO: 1584339 - DNA, 21 bp, Homo sapiens
ctctccaccttagtactttag

SEQ ID NO: 1584340 - DNA, 14 bp, Homo sapiens
ctctccactcaatg

SEQ ID NO: 1584341 - DNA, 16 bp, Homo sapiens
ctctccactgccttcg

SEQ ID NO: 1584342 - DNA, 13 bp, Homo sapiens
ctctccactgctg

SEQ ID NO: 1584343 - DNA, 21 bp, Homo sapiens
ctctccaggaaggtagcccag

SEQ ID NO: 1584344 - DNA, 14 bp, Homo sapiens
ctctccaggccagg

SEQ ID NO: 1584345 - DNA, 12 bp, Homo sapiens
ctctccaggccc

SEQ ID NO: 1584346 - DNA, 13 bp, Homo sapiens
ctctccaggcccc

SEQ ID NO: 1584347 - DNA, 12 bp, Homo sapiens
ctctccagggtg

SEQ ID NO: 1584348 - DNA, 14 bp, Homo sapiens
ctctccaggtcagc

SEQ ID NO: 1584349 - DNA, 17 bp, Homo sapiens
ctctccagtttgcacct

SEQ ID NO: 1584350 - DNA, 20 bp, Homo sapiens
ctctccagtttgcacctgtc

SEQ ID NO: 1584351 - DNA, 15 bp, Homo sapiens
ctctcccaagtccac

SEQ ID NO: 1584352 - DNA, 15 bp, Homo sapiens
ctctcccaccccggc

SEQ ID NO: 1584353 - DNA, 19 bp, Homo sapiens
ctctcccacccggccacag

SEQ ID NO: 1584354 - DNA, 13 bp, Homo sapiens
ctctcccatcact

SEQ ID NO: 1584355 - DNA, 14 bp, Homo sapiens
ctctcccatcactt

SEQ ID NO: 1584356 - DNA, 16 bp, Homo sapiens
ctctcccatcctgggg

SEQ ID NO: 1584357 - DNA, 17 bp, Homo sapiens
ctctcccatttcaggaa

SEQ ID NO: 1584358 - DNA, 14 bp, Homo sapiens
ctctcccatttcct

SEQ ID NO: 1584359 - DNA, 13 bp, Homo sapiens
ctctccccacact

SEQ ID NO: 1584360 - DNA, 20 bp, Homo sapiens
ctctccccaggtccagctct

SEQ ID NO: 1584361 - DNA, 12 bp, Homo sapiens
ctctccccagtg

SEQ ID NO: 1584362 - DNA, 13 bp, Homo sapiens
ctctccccagtgc

SEQ ID NO: 1584363 - DNA, 22 bp, Homo sapiens
ctctccccagtgcctgccactc

SEQ ID NO: 1584364 - DNA, 17 bp, Homo sapiens
ctctccccctatttatt

SEQ ID NO: 1584365 - DNA, 14 bp, Homo sapiens
ctctccccctttca

SEQ ID NO: 1584366 - DNA, 21 bp, Homo sapiens
ctctccccggcaggcctgaga

SEQ ID NO: 1584367 - DNA, 14 bp, Homo sapiens
ctctcccctcctgc

SEQ ID NO: 1584368 - DNA, 19 bp, Homo sapiens
ctctcccggttcttccagt

SEQ ID NO: 1584369 - DNA, 17 bp, Homo sapiens
ctctcccgtcagggccc

SEQ ID NO: 1584370 - DNA, 16 bp, Homo sapiens
ctctccctctctctgg

SEQ ID NO: 1584371 - DNA, 19 bp, Homo sapiens
ctctccctctggccctgcc

SEQ ID NO: 1584372 - DNA, 21 bp, Homo sapiens
ctctccctctggccctgcctt

SEQ ID NO: 1584373 - DNA, 22 bp, Homo sapiens
ctctccctgcactccctcctgg

SEQ ID NO: 1584374 - DNA, 21 bp, Homo sapiens
ctctccctgccaagtctcaga

SEQ ID NO: 1584375 - DNA, 17 bp, Homo sapiens
ctctccgactctgcacc

SEQ ID NO: 1584376 - DNA, 20 bp, Homo sapiens
ctctccgagctctggtgctt

SEQ ID NO: 1584377 - DNA, 16 bp, Homo sapiens
ctctccgaggggtgga

SEQ ID NO: 1584378 - DNA, 22 bp, Homo sapiens
ctctcctaactgccagccccct

SEQ ID NO: 1584379 - DNA, 23 bp, Homo sapiens
ctctcctatgtggcagctgggga

SEQ ID NO: 1584380 - DNA, 11 bp, Homo sapiens
ctctcctcccc

SEQ ID NO: 1584381 - DNA, 18 bp, Homo sapiens
ctctcctcccgccccgcc

SEQ ID NO: 1584382 - DNA, 14 bp, Homo sapiens
ctctcctcctcccc

SEQ ID NO: 1584383 - DNA, 20 bp, Homo sapiens
ctctcctcggccccctccat

SEQ ID NO: 1584384 - DNA, 13 bp, Homo sapiens
ctctcctgccctg

SEQ ID NO: 1584385 - DNA, 12 bp, Homo sapiens
ctctcctgccta

SEQ ID NO: 1584386 - DNA, 16 bp, Homo sapiens
ctctcctgcttcctct

SEQ ID NO: 1584387 - DNA, 21 bp, Homo sapiens
ctctcctggcctatccgctgc

SEQ ID NO: 1584388 - DNA, 20 bp, Homo sapiens
ctctcctgtctgccctctgg

SEQ ID NO: 1584389 - DNA, 18 bp, Homo sapiens
ctctccttcctcttggct

SEQ ID NO: 1584390 - DNA, 21 bp, Homo sapiens
ctctccttcctcttggctgag

SEQ ID NO: 1584391 - DNA, 16 bp, Homo sapiens
ctctccttcctggagc

SEQ ID NO: 1584392 - DNA, 17 bp, Homo sapiens
ctctccttccttaccca

SEQ ID NO: 1584393 - DNA, 18 bp, Homo sapiens
ctctccttggccacagac

SEQ ID NO: 1584394 - DNA, 13 bp, Homo sapiens
ctctccttgggct

SEQ ID NO: 1584395 - DNA, 15 bp, Homo sapiens
ctctccttgggctcc

SEQ ID NO: 1584396 - DNA, 20 bp, Homo sapiens
ctctccttgggctcctggct

SEQ ID NO: 1584397 - DNA, 21 bp, Homo sapiens
ctctccttgggctcctggctg

SEQ ID NO: 1584398 - DNA, 22 bp, Homo sapiens
ctctccttgggctcctggctgc

SEQ ID NO: 1584399 - DNA, 14 bp, Homo sapiens
ctctcctttctttt

SEQ ID NO: 1584400 - DNA, 20 bp, Homo sapiens
ctctcctttgtgtggctgcc

SEQ ID NO: 1584401 - DNA, 16 bp, Homo sapiens
ctctcgacggcacgca

SEQ ID NO: 1584402 - DNA, 22 bp, Homo sapiens
ctctcgactgtcagtggggcag

SEQ ID NO: 1584403 - DNA, 14 bp, Homo sapiens
ctctcggccaggca

SEQ ID NO: 1584404 - DNA, 15 bp, Homo sapiens
ctctcggccaggcat

SEQ ID NO: 1584405 - DNA, 17 bp, Homo sapiens
ctctcggctccccatgt

SEQ ID NO: 1584406 - DNA, 19 bp, Homo sapiens
ctctcgggttgtgtgtctg

SEQ ID NO: 1584407 - DNA, 14 bp, Homo sapiens
ctctcggtgctcca

SEQ ID NO: 1584408 - DNA, 21 bp, Homo sapiens
ctctctaaatcttccttgtga

SEQ ID NO: 1584409 - DNA, 22 bp, Homo sapiens
ctctctaaatcttccttgtgag

SEQ ID NO: 1584410 - DNA, 18 bp, Homo sapiens
ctctctacagagaggaaa

SEQ ID NO: 1584411 - DNA, 19 bp, Homo sapiens
ctctctacagagaggaaat

SEQ ID NO: 1584412 - DNA, 15 bp, Homo sapiens
ctctctaccagtcta

SEQ ID NO: 1584413 - DNA, 16 bp, Homo sapiens
ctctctacctccaccc

SEQ ID NO: 1584414 - DNA, 17 bp, Homo sapiens
ctctctacctccaccct

SEQ ID NO: 1584415 - DNA, 19 bp, Homo sapiens
ctctctactcctacctcag

SEQ ID NO: 1584416 - DNA, 14 bp, Homo sapiens
ctctctaggcctct

SEQ ID NO: 1584417 - DNA, 24 bp, Homo sapiens
ctctctatcctctcttcctcttcc

SEQ ID NO: 1584418 - DNA, 14 bp, Homo sapiens
ctctctattgtcat

SEQ ID NO: 1584419 - DNA, 19 bp, Homo sapiens
ctctctcagttatgtagtt

SEQ ID NO: 1584420 - DNA, 14 bp, Homo sapiens
ctctctccagatgt

SEQ ID NO: 1584421 - DNA, 13 bp, Homo sapiens
ctctctccagggt

SEQ ID NO: 1584422 - DNA, 13 bp, Homo sapiens
ctctctcccagga

SEQ ID NO: 1584423 - DNA, 14 bp, Homo sapiens
ctctctcccatttc

SEQ ID NO: 1584424 - DNA, 18 bp, Homo sapiens
ctctctcccctctgcaac

SEQ ID NO: 1584425 - DNA, 16 bp, Homo sapiens
ctctctccttggccac

SEQ ID NO: 1584426 - DNA, 12 bp, Homo sapiens
ctctctctctca

SEQ ID NO: 1584427 - DNA, 13 bp, Homo sapiens
ctctctctctcac

SEQ ID NO: 1584428 - DNA, 15 bp, Homo sapiens
ctctctctctcgctc

SEQ ID NO: 1584429 - DNA, 15 bp, Homo sapiens
ctctctctgaggaca

SEQ ID NO: 1584430 - DNA, 12 bp, Homo sapiens
ctctctctgcct

SEQ ID NO: 1584431 - DNA, 12 bp, Homo sapiens
ctctctctgggt

SEQ ID NO: 1584432 - DNA, 12 bp, Homo sapiens
ctctctcttctg

SEQ ID NO: 1584433 - DNA, 18 bp, Homo sapiens
ctctctctttctagaggt

SEQ ID NO: 1584434 - DNA, 23 bp, Homo sapiens
ctctctgacgcttgtgacagtgc

SEQ ID NO: 1584435 - DNA, 13 bp, Homo sapiens
ctctctgagactg

SEQ ID NO: 1584436 - DNA, 17 bp, Homo sapiens
ctctctgagtcaaatcc

SEQ ID NO: 1584437 - DNA, 19 bp, Homo sapiens
ctctctgagtcaaatccag

SEQ ID NO: 1584438 - DNA, 23 bp, Homo sapiens
ctctctgatcttgtgctcagcat

SEQ ID NO: 1584439 - DNA, 19 bp, Homo sapiens
ctctctgcagccagcccag

SEQ ID NO: 1584440 - DNA, 12 bp, Homo sapiens
ctctctgccctg

SEQ ID NO: 1584441 - DNA, 15 bp, Homo sapiens
ctctctgccctgtgt

SEQ ID NO: 1584442 - DNA, 16 bp, Homo sapiens
ctctctgccctgtgta

SEQ ID NO: 1584443 - DNA, 17 bp, Homo sapiens
ctctctgcccttgatca

SEQ ID NO: 1584444 - DNA, 12 bp, Homo sapiens
ctctctgcctga

SEQ ID NO: 1584445 - DNA, 14 bp, Homo sapiens
ctctctgcctgtga

SEQ ID NO: 1584446 - DNA, 15 bp, Homo sapiens
ctctctgcctgtgag

SEQ ID NO: 1584447 - DNA, 18 bp, Homo sapiens
ctctctgcctgtgagcca

SEQ ID NO: 1584448 - DNA, 20 bp, Homo sapiens
ctctctgcctgtgagccagt

SEQ ID NO: 1584449 - DNA, 14 bp, Homo sapiens
ctctctgctccttc

SEQ ID NO: 1584450 - DNA, 18 bp, Homo sapiens
ctctctgctccttcactg

SEQ ID NO: 1584451 - DNA, 14 bp, Homo sapiens
ctctctgctctagc

SEQ ID NO: 1584452 - DNA, 13 bp, Homo sapiens
ctctctgctggca

SEQ ID NO: 1584453 - DNA, 12 bp, Homo sapiens
ctctctggagcc

SEQ ID NO: 1584454 - DNA, 20 bp, Homo sapiens
ctctctggagcccctcctcc

SEQ ID NO: 1584455 - DNA, 14 bp, Homo sapiens
ctctctggcttctc

SEQ ID NO: 1584456 - DNA, 15 bp, Homo sapiens
ctctctggcttctct

SEQ ID NO: 1584457 - DNA, 16 bp, Homo sapiens
ctctctggcttctctc

SEQ ID NO: 1584458 - DNA, 20 bp, Homo sapiens
ctctctggcttctctctttt

SEQ ID NO: 1584459 - DNA, 23 bp, Homo sapiens
ctctctggcttctctcttttcct

SEQ ID NO: 1584460 - DNA, 17 bp, Homo sapiens
ctctctgggacctcctt

SEQ ID NO: 1584461 - DNA, 21 bp, Homo sapiens
ctctctgggactctcctcctc

SEQ ID NO: 1584462 - DNA, 12 bp, Homo sapiens
ctctctgggcct

SEQ ID NO: 1584463 - DNA, 12 bp, Homo sapiens
ctctctgggctg

SEQ ID NO: 1584464 - DNA, 21 bp, Homo sapiens
ctctctgggtcagaaccagag

SEQ ID NO: 1584465 - DNA, 23 bp, Homo sapiens
ctctctgtcccttgctgtatgct

SEQ ID NO: 1584466 - DNA, 13 bp, Homo sapiens
ctctctgtggggc

SEQ ID NO: 1584467 - DNA, 18 bp, Homo sapiens
ctctcttcaatctctgga

SEQ ID NO: 1584468 - DNA, 23 bp, Homo sapiens
ctctcttcaggaggccctggtgt

SEQ ID NO: 1584469 - DNA, 14 bp, Homo sapiens
ctctcttccccttc

SEQ ID NO: 1584470 - DNA, 19 bp, Homo sapiens
ctctcttccccttccctta

SEQ ID NO: 1584471 - DNA, 12 bp, Homo sapiens
ctctcttcctgt

SEQ ID NO: 1584472 - DNA, 16 bp, Homo sapiens
ctctcttctctccagc

SEQ ID NO: 1584473 - DNA, 14 bp, Homo sapiens
ctctcttctgctcc

SEQ ID NO: 1584474 - DNA, 18 bp, Homo sapiens
ctctcttctgctccaccc

SEQ ID NO: 1584475 - DNA, 13 bp, Homo sapiens
ctctcttgcaccc

SEQ ID NO: 1584476 - DNA, 20 bp, Homo sapiens
ctctcttgtgacgtgcactg

SEQ ID NO: 1584477 - DNA, 21 bp, Homo sapiens
ctctcttgtgacgtgcactgt

SEQ ID NO: 1584478 - DNA, 22 bp, Homo sapiens
ctctcttgtgacgtgcactgtg

SEQ ID NO: 1584479 - DNA, 11 bp, Homo sapiens
ctctctttcct

SEQ ID NO: 1584480 - DNA, 17 bp, Homo sapiens
ctctctttcctccaccc

SEQ ID NO: 1584481 - DNA, 18 bp, Homo sapiens
ctctctttccttgagctg

SEQ ID NO: 1584482 - DNA, 12 bp, Homo sapiens
ctctcttttcct

SEQ ID NO: 1584483 - DNA, 14 bp, Homo sapiens
ctctcttttcctcc

SEQ ID NO: 1584484 - DNA, 20 bp, Homo sapiens
ctctcttttcctcctccacc

SEQ ID NO: 1584485 - DNA, 12 bp, Homo sapiens
ctctcttttgtt

SEQ ID NO: 1584486 - DNA, 22 bp, Homo sapiens
ctctgaaaagcaattgccctgt

SEQ ID NO: 1584487 - DNA, 23 bp, Homo sapiens
ctctgaaaagcaattgccctgta

SEQ ID NO: 1584488 - DNA, 22 bp, Homo sapiens
ctctgaaatctgaagacctcga

SEQ ID NO: 1584489 - DNA, 23 bp, Homo sapiens
ctctgaaatcttcccatgcattc

SEQ ID NO: 1584490 - DNA, 15 bp, Homo sapiens
ctctgaacttgcctt

SEQ ID NO: 1584491 - DNA, 21 bp, Homo sapiens
ctctgaagagtgggtttcaca

SEQ ID NO: 1584492 - DNA, 22 bp, Homo sapiens
ctctgaataaatacccattgaa

SEQ ID NO: 1584493 - DNA, 15 bp, Homo sapiens
ctctgaatattttgt

SEQ ID NO: 1584494 - DNA, 22 bp, Homo sapiens
ctctgaatttatctttgataac

SEQ ID NO: 1584495 - DNA, 16 bp, Homo sapiens
ctctgacaagggctga

SEQ ID NO: 1584496 - DNA, 22 bp, Homo sapiens
ctctgacagtccacaggggcca

SEQ ID NO: 1584497 - DNA, 16 bp, Homo sapiens
ctctgacatcccttcc

SEQ ID NO: 1584498 - DNA, 14 bp, Homo sapiens
ctctgacctttcat

SEQ ID NO: 1584499 - DNA, 18 bp, Homo sapiens
ctctgacgcttgtgacag

SEQ ID NO: 1584500 - DNA, 19 bp, Homo sapiens
ctctgacttaagcaaaaga

SEQ ID NO: 1584501 - DNA, 20 bp, Homo sapiens
ctctgacttaagcaaaagaa

SEQ ID NO: 1584502 - DNA, 14 bp, Homo sapiens
ctctgacttctgcc

SEQ ID NO: 1584503 - DNA, 15 bp, Homo sapiens
ctctgacttctgcct

SEQ ID NO: 1584504 - DNA, 17 bp, Homo sapiens
ctctgacttctgcctgg

SEQ ID NO: 1584505 - DNA, 13 bp, Homo sapiens
ctctgagaatcac

SEQ ID NO: 1584506 - DNA, 16 bp, Homo sapiens
ctctgagccacagtgg

SEQ ID NO: 1584507 - DNA, 17 bp, Homo sapiens
ctctgagcccaggccgt

SEQ ID NO: 1584508 - DNA, 19 bp, Homo sapiens
ctctgagcccatacttttg

SEQ ID NO: 1584509 - DNA, 13 bp, Homo sapiens
ctctgagcgcctc

SEQ ID NO: 1584510 - DNA, 18 bp, Homo sapiens
ctctgaggacagagcttg

SEQ ID NO: 1584511 - DNA, 15 bp, Homo sapiens
ctctgaggtgcctgt

SEQ ID NO: 1584512 - DNA, 16 bp, Homo sapiens
ctctgagtcaaatcca

SEQ ID NO: 1584513 - DNA, 20 bp, Homo sapiens
ctctgagtcaaatccagtgg

SEQ ID NO: 1584514 - DNA, 21 bp, Homo sapiens
ctctgagtttaccatttgtaa

SEQ ID NO: 1584515 - DNA, 17 bp, Homo sapiens
ctctgagtttatctgtg

SEQ ID NO: 1584516 - DNA, 21 bp, Homo sapiens
ctctgatatgggactgagcct

SEQ ID NO: 1584517 - DNA, 19 bp, Homo sapiens
ctctgatattccatgaatg

SEQ ID NO: 1584518 - DNA, 23 bp, Homo sapiens
ctctgatattccatgaatgtatc

SEQ ID NO: 1584519 - DNA, 17 bp, Homo sapiens
ctctgatcacatcccct

SEQ ID NO: 1584520 - DNA, 21 bp, Homo sapiens
ctctgatcacattcttcaaag

SEQ ID NO: 1584521 - DNA, 13 bp, Homo sapiens
ctctgatcttgtg

SEQ ID NO: 1584522 - DNA, 17 bp, Homo sapiens
ctctgatcttgtgctca

SEQ ID NO: 1584523 - DNA, 22 bp, Homo sapiens
ctctgatggttcttcacctcct

SEQ ID NO: 1584524 - DNA, 13 bp, Homo sapiens
ctctgattcacct

SEQ ID NO: 1584525 - DNA, 16 bp, Homo sapiens
ctctgattcacctctt

SEQ ID NO: 1584526 - DNA, 19 bp, Homo sapiens
ctctgattcacctcttcct

SEQ ID NO: 1584527 - DNA, 18 bp, Homo sapiens
ctctgcaagacagaaacc

SEQ ID NO: 1584528 - DNA, 15 bp, Homo sapiens
ctctgcaattcccct

SEQ ID NO: 1584529 - DNA, 17 bp, Homo sapiens
ctctgcaattcccctct

SEQ ID NO: 1584530 - DNA, 18 bp, Homo sapiens
ctctgcaattcccctctg

SEQ ID NO: 1584531 - DNA, 20 bp, Homo sapiens
ctctgcaattcccctctgct

SEQ ID NO: 1584532 - DNA, 10 bp, Homo sapiens
ctctgcacag

SEQ ID NO: 1584533 - DNA, 17 bp, Homo sapiens
ctctgcacagacaagca

SEQ ID NO: 1584534 - DNA, 14 bp, Homo sapiens
ctctgcacagatgg

SEQ ID NO: 1584535 - DNA, 14 bp, Homo sapiens
ctctgcacatgtct

SEQ ID NO: 1584536 - DNA, 14 bp, Homo sapiens
ctctgcacccagaa

SEQ ID NO: 1584537 - DNA, 15 bp, Homo sapiens
ctctgcacccagaac

SEQ ID NO: 1584538 - DNA, 14 bp, Homo sapiens
ctctgcacccagtg

SEQ ID NO: 1584539 - DNA, 16 bp, Homo sapiens
ctctgcacccgcctcg

SEQ ID NO: 1584540 - DNA, 20 bp, Homo sapiens
ctctgcacccttatcatggg

SEQ ID NO: 1584541 - DNA, 13 bp, Homo sapiens
ctctgcactactc

SEQ ID NO: 1584542 - DNA, 23 bp, Homo sapiens
ctctgcactactcctctgcagtg

SEQ ID NO: 1584543 - DNA, 16 bp, Homo sapiens
ctctgcactactgaca

SEQ ID NO: 1584544 - DNA, 18 bp, Homo sapiens
ctctgcactactgacatg

SEQ ID NO: 1584545 - DNA, 20 bp, Homo sapiens
ctctgcactactgacatgtg

SEQ ID NO: 1584546 - DNA, 19 bp, Homo sapiens
ctctgcactccatggccac

SEQ ID NO: 1584547 - DNA, 21 bp, Homo sapiens
ctctgcactccatggccaccc

SEQ ID NO: 1584548 - DNA, 19 bp, Homo sapiens
ctctgcactcccacctgac

SEQ ID NO: 1584549 - DNA, 17 bp, Homo sapiens
ctctgcagacttcccag

SEQ ID NO: 1584550 - DNA, 18 bp, Homo sapiens
ctctgcagacttcccagc

SEQ ID NO: 1584551 - DNA, 13 bp, Homo sapiens
ctctgcagccagc

SEQ ID NO: 1584552 - DNA, 19 bp, Homo sapiens
ctctgcagccagcccagcc

SEQ ID NO: 1584553 - DNA, 14 bp, Homo sapiens
ctctgcagctgacc

SEQ ID NO: 1584554 - DNA, 16 bp, Homo sapiens
ctctgcagctgacctc

SEQ ID NO: 1584555 - DNA, 18 bp, Homo sapiens
ctctgcagctgacctctg

SEQ ID NO: 1584556 - DNA, 14 bp, Homo sapiens
ctctgcagctgccg

SEQ ID NO: 1584557 - DNA, 19 bp, Homo sapiens
ctctgcagtacttgatgta

SEQ ID NO: 1584558 - DNA, 17 bp, Homo sapiens
ctctgcagtctcatttc

SEQ ID NO: 1584559 - DNA, 19 bp, Homo sapiens
ctctgcagtctcatttctc

SEQ ID NO: 1584560 - DNA, 14 bp, Homo sapiens
ctctgcattctagt

SEQ ID NO: 1584561 - DNA, 18 bp, Homo sapiens
ctctgccaccctacctgt

SEQ ID NO: 1584562 - DNA, 14 bp, Homo sapiens
ctctgccacctccc

SEQ ID NO: 1584563 - DNA, 18 bp, Homo sapiens
ctctgccacctcccctat

SEQ ID NO: 1584564 - DNA, 14 bp, Homo sapiens
ctctgccagtgaca

SEQ ID NO: 1584565 - DNA, 15 bp, Homo sapiens
ctctgccagtgacag

SEQ ID NO: 1584566 - DNA, 16 bp, Homo sapiens
ctctgccatgtggcag

SEQ ID NO: 1584567 - DNA, 17 bp, Homo sapiens
ctctgcccagccgggca

SEQ ID NO: 1584568 - DNA, 13 bp, Homo sapiens
ctctgcccagctt

SEQ ID NO: 1584569 - DNA, 14 bp, Homo sapiens
ctctgcccagcttg

SEQ ID NO: 1584570 - DNA, 20 bp, Homo sapiens
ctctgccccaagcagccagc

SEQ ID NO: 1584571 - DNA, 22 bp, Homo sapiens
ctctgccccaagcagccagcca

SEQ ID NO: 1584572 - DNA, 14 bp, Homo sapiens
ctctgccccaagcc

SEQ ID NO: 1584573 - DNA, 22 bp, Homo sapiens
ctctgccccaatcgggtccaga

SEQ ID NO: 1584574 - DNA, 23 bp, Homo sapiens
ctctgccccaatcgggtccagag

SEQ ID NO: 1584575 - DNA, 11 bp, Homo sapiens
ctctgccccag

SEQ ID NO: 1584576 - DNA, 15 bp, Homo sapiens
ctctgccccagcctg

SEQ ID NO: 1584577 - DNA, 17 bp, Homo sapiens
ctctgccccagctctgg

SEQ ID NO: 1584578 - DNA, 15 bp, Homo sapiens
ctctgccccaggccc

SEQ ID NO: 1584579 - DNA, 23 bp, Homo sapiens
ctctgcccccgcgggttctagac

SEQ ID NO: 1584580 - DNA, 12 bp, Homo sapiens
ctctgccctctg

SEQ ID NO: 1584581 - DNA, 17 bp, Homo sapiens
ctctgccctctgctgct

SEQ ID NO: 1584582 - DNA, 15 bp, Homo sapiens
ctctgccctgcccta

SEQ ID NO: 1584583 - DNA, 16 bp, Homo sapiens
ctctgccctgccctag

SEQ ID NO: 1584584 - DNA, 23 bp, Homo sapiens
ctctgccctgccctagctccaca

SEQ ID NO: 1584585 - DNA, 14 bp, Homo sapiens
ctctgccctggatt

SEQ ID NO: 1584586 - DNA, 16 bp, Homo sapiens
ctctgccctggattgg

SEQ ID NO: 1584587 - DNA, 19 bp, Homo sapiens
ctctgcccttgttccctag

SEQ ID NO: 1584588 - DNA, 14 bp, Homo sapiens
ctctgccgctacct

SEQ ID NO: 1584589 - DNA, 21 bp, Homo sapiens
ctctgccgctacctccctccc

SEQ ID NO: 1584590 - DNA, 21 bp, Homo sapiens
ctgaactcctgccatagtctt

SEQ ID NO: 1584591 - DNA, 23 bp, Homo sapiens
ctgaactcttcagaacacacaga

SEQ ID NO: 1584592 - DNA, 13 bp, Homo sapiens
ctgaactgaacac

SEQ ID NO: 1584593 - DNA, 12 bp, Homo sapiens
ctgaactgagcc

SEQ ID NO: 1584594 - DNA, 13 bp, Homo sapiens
ctgaactgagcct

SEQ ID NO: 1584595 - DNA, 17 bp, Homo sapiens
ctgaactgaggccttgt

SEQ ID NO: 1584596 - DNA, 18 bp, Homo sapiens
ctgaactgaggccttgtg

SEQ ID NO: 1584597 - DNA, 13 bp, Homo sapiens
ctgaactgtgcat

SEQ ID NO: 1584598 - DNA, 13 bp, Homo sapiens
ctgaactgttaca

SEQ ID NO: 1584599 - DNA, 15 bp, Homo sapiens
ctgaagaaccagtcc

SEQ ID NO: 1584600 - DNA, 22 bp, Homo sapiens
ctgaagaaccagtccccccacc

SEQ ID NO: 1584601 - DNA, 21 bp, Homo sapiens
ctgaagaagtcactgaacaaa

SEQ ID NO: 1584602 - DNA, 17 bp, Homo sapiens
ctgaagaattaagatac

SEQ ID NO: 1584603 - DNA, 18 bp, Homo sapiens
ctgaagaattgaaaagtt

SEQ ID NO: 1584604 - DNA, 16 bp, Homo sapiens
ctgaagacctcgagca

SEQ ID NO: 1584605 - DNA, 21 bp, Homo sapiens
ctgaagagaagggcagggctg

SEQ ID NO: 1584606 - DNA, 20 bp, Homo sapiens
ctgaagagctattatataaa

SEQ ID NO: 1584607 - DNA, 14 bp, Homo sapiens
ctgaagaggcgggc

SEQ ID NO: 1584608 - DNA, 23 bp, Homo sapiens
ctgaagaggcgggccagccaggc

SEQ ID NO: 1584609 - DNA, 20 bp, Homo sapiens
ctgaagagtatccttccttc

SEQ ID NO: 1584610 - DNA, 19 bp, Homo sapiens
ctgaagatctaaacttttg

SEQ ID NO: 1584611 - DNA, 16 bp, Homo sapiens
ctgaagattaggcaca

SEQ ID NO: 1584612 - DNA, 22 bp, Homo sapiens
ctgaagattcttaaaaattgaa

SEQ ID NO: 1584613 - DNA, 14 bp, Homo sapiens
ctgaagcagcctct

SEQ ID NO: 1584614 - DNA, 15 bp, Homo sapiens
ctgaagccctcccag

SEQ ID NO: 1584615 - DNA, 22 bp, Homo sapiens
ctgaagcctggattccagcagt

SEQ ID NO: 1584616 - DNA, 12 bp, Homo sapiens
ctgaagctgctg

SEQ ID NO: 1584617 - DNA, 19 bp, Homo sapiens
ctgaagctgctgcagccct

SEQ ID NO: 1584618 - DNA, 22 bp, Homo sapiens
ctgaagctgctgcagccctgcc

SEQ ID NO: 1584619 - DNA, 17 bp, Homo sapiens
ctgaagctggagcagcg

SEQ ID NO: 1584620 - DNA, 15 bp, Homo sapiens
ctgaagcttgactcc

SEQ ID NO: 1584621 - DNA, 16 bp, Homo sapiens
ctgaaggaaaaacaca

SEQ ID NO: 1584622 - DNA, 17 bp, Homo sapiens
ctgaaggaaaagcaaga

SEQ ID NO: 1584623 - DNA, 23 bp, Homo sapiens
ctgaaggaaaagcaagaaacagt

SEQ ID NO: 1584624 - DNA, 17 bp, Homo sapiens
ctgaaggaatagccaga

SEQ ID NO: 1584625 - DNA, 23 bp, Homo sapiens
ctgaaggaatagccagagaggag

SEQ ID NO: 1584626 - DNA, 18 bp, Homo sapiens
ctgaaggacacttcctgc

SEQ ID NO: 1584627 - DNA, 16 bp, Homo sapiens
ctgaaggcaacctgga

SEQ ID NO: 1584628 - DNA, 18 bp, Homo sapiens
ctgaaggcaacctggaag

SEQ ID NO: 1584629 - DNA, 11 bp, Homo sapiens
ctgaaggcagt

SEQ ID NO: 1584630 - DNA, 16 bp, Homo sapiens
ctgaaggcagtggcag

SEQ ID NO: 1584631 - DNA, 17 bp, Homo sapiens
ctgaaggcagtggcagg

SEQ ID NO: 1584632 - DNA, 21 bp, Homo sapiens
ctgaaggcagtggcaggggag

SEQ ID NO: 1584633 - DNA, 15 bp, Homo sapiens
ctgaagggaactaga

SEQ ID NO: 1584634 - DNA, 14 bp, Homo sapiens
ctgaagggaccccc

SEQ ID NO: 1584635 - DNA, 21 bp, Homo sapiens
ctgaaggggcacaccactgcc

SEQ ID NO: 1584636 - DNA, 15 bp, Homo sapiens
ctgaaggggccatga

SEQ ID NO: 1584637 - DNA, 19 bp, Homo sapiens
ctgaaggggccatgatggc

SEQ ID NO: 1584638 - DNA, 18 bp, Homo sapiens
ctgaaggggtgcacccac

SEQ ID NO: 1584639 - DNA, 22 bp, Homo sapiens
ctgaaggggtgcacccacctgt

SEQ ID NO: 1584640 - DNA, 19 bp, Homo sapiens
ctgaaggtaaaattgaaag

SEQ ID NO: 1584641 - DNA, 20 bp, Homo sapiens
ctgaaggtcaataaattatt

SEQ ID NO: 1584642 - DNA, 17 bp, Homo sapiens
ctgaaggtcccctggca

SEQ ID NO: 1584643 - DNA, 19 bp, Homo sapiens
ctgaaggtcccctggcagt

SEQ ID NO: 1584644 - DNA, 17 bp, Homo sapiens
ctgaagtagtgtgcagt

SEQ ID NO: 1584645 - DNA, 22 bp, Homo sapiens
ctgaagtcactgcacagtgcat

SEQ ID NO: 1584646 - DNA, 18 bp, Homo sapiens
ctgaagtcttctcctcca

SEQ ID NO: 1584647 - DNA, 18 bp, Homo sapiens
ctgaagtcttttctgtca

SEQ ID NO: 1584648 - DNA, 18 bp, Homo sapiens
ctgaagtgagcacagcct

SEQ ID NO: 1584649 - DNA, 21 bp, Homo sapiens
ctgaagtgagcacagcctagg

SEQ ID NO: 1584650 - DNA, 20 bp, Homo sapiens
ctgaagtggctggtagaaaa

SEQ ID NO: 1584651 - DNA, 16 bp, Homo sapiens
ctgaagttaacagaga

SEQ ID NO: 1584652 - DNA, 14 bp, Homo sapiens
ctgaagttatgtgt

SEQ ID NO: 1584653 - DNA, 13 bp, Homo sapiens
ctgaataaagcaa

SEQ ID NO: 1584654 - DNA, 14 bp, Homo sapiens
ctgaataaatggta

SEQ ID NO: 1584655 - DNA, 17 bp, Homo sapiens
ctgaataaatggtagta

SEQ ID NO: 1584656 - DNA, 17 bp, Homo sapiens
ctgaatacaagcctatg

SEQ ID NO: 1584657 - DNA, 18 bp, Homo sapiens
ctgaatacattctgcttt

SEQ ID NO: 1584658 - DNA, 15 bp, Homo sapiens
ctgaatagatatgaa

SEQ ID NO: 1584659 - DNA, 14 bp, Homo sapiens
ctgaatattctaga

SEQ ID NO: 1584660 - DNA, 16 bp, Homo sapiens
ctgaatatttatattt

SEQ ID NO: 1584661 - DNA, 21 bp, Homo sapiens
ctgaatatttatatttcacta

SEQ ID NO: 1584662 - DNA, 14 bp, Homo sapiens
ctgaatattttgta

SEQ ID NO: 1584663 - DNA, 14 bp, Homo sapiens
ctgaatcagctgct

SEQ ID NO: 1584664 - DNA, 19 bp, Homo sapiens
ctgaatccaaactaatcca

SEQ ID NO: 1584665 - DNA, 17 bp, Homo sapiens
ctgaatgaaatatcaga

SEQ ID NO: 1584666 - DNA, 18 bp, Homo sapiens
ctgaatgaagctgccatc

SEQ ID NO: 1584667 - DNA, 19 bp, Homo sapiens
ctgaatgaatccattggag

SEQ ID NO: 1584668 - DNA, 21 bp, Homo sapiens
ctgaatgccccctgcttactt

SEQ ID NO: 1584669 - DNA, 18 bp, Homo sapiens
ctgaatgcctcgctccct

SEQ ID NO: 1584670 - DNA, 14 bp, Homo sapiens
ctgaatgctgccac

SEQ ID NO: 1584671 - DNA, 17 bp, Homo sapiens
ctgaatgcttctgagag

SEQ ID NO: 1584672 - DNA, 19 bp, Homo sapiens
ctgaatgggaccctgttga

SEQ ID NO: 1584673 - DNA, 21 bp, Homo sapiens
ctgaatgggagccagaattca

SEQ ID NO: 1584674 - DNA, 14 bp, Homo sapiens
ctgaattaaataaa

SEQ ID NO: 1584675 - DNA, 15 bp, Homo sapiens
ctgaattaaataaat

SEQ ID NO: 1584676 - DNA, 20 bp, Homo sapiens
ctgaattaatgacagagcca

SEQ ID NO: 1584677 - DNA, 14 bp, Homo sapiens
ctgaattacagtga

SEQ ID NO: 1584678 - DNA, 23 bp, Homo sapiens
ctgaattacagtgaaattttggt

SEQ ID NO: 1584679 - DNA, 17 bp, Homo sapiens
ctgaattatctatttca

SEQ ID NO: 1584680 - DNA, 22 bp, Homo sapiens
ctgaattcacttaagtttttcc

SEQ ID NO: 1584681 - DNA, 23 bp, Homo sapiens
ctgaattctatttgctgggcttt

SEQ ID NO: 1584682 - DNA, 18 bp, Homo sapiens
ctgaattgctatgtgaaa

SEQ ID NO: 1584683 - DNA, 13 bp, Homo sapiens
ctgaattggaagg

SEQ ID NO: 1584684 - DNA, 14 bp, Homo sapiens
ctgaattggaaggg

SEQ ID NO: 1584685 - DNA, 15 bp, Homo sapiens
ctgaattgtccccag

SEQ ID NO: 1584686 - DNA, 15 bp, Homo sapiens
ctgaatttaactact

SEQ ID NO: 1584687 - DNA, 17 bp, Homo sapiens
ctgaatttatctttgat

SEQ ID NO: 1584688 - DNA, 18 bp, Homo sapiens
ctgaatttatctttgata

SEQ ID NO: 1584689 - DNA, 13 bp, Homo sapiens
ctgaatttccctc

SEQ ID NO: 1584690 - DNA, 17 bp, Homo sapiens
ctgaattttgcaatgta

SEQ ID NO: 1584691 - DNA, 20 bp, Homo sapiens
ctgaattttgcaatgtattt

SEQ ID NO: 1584692 - DNA, 16 bp, Homo sapiens
ctgaattttgggactt

SEQ ID NO: 1584693 - DNA, 19 bp, Homo sapiens
ctgaatttttttgtaataa

SEQ ID NO: 1584694 - DNA, 20 bp, Homo sapiens
ctgaatttttttgtaataag

SEQ ID NO: 1584695 - DNA, 18 bp, Homo sapiens
ctgacaaaaagtttccat

SEQ ID NO: 1584696 - DNA, 21 bp, Homo sapiens
ctgacaaaggtggtaaattca

SEQ ID NO: 1584697 - DNA, 20 bp, Homo sapiens
ctgacaaccactggtctgta

SEQ ID NO: 1584698 - DNA, 18 bp, Homo sapiens
ctgacaacttagctcagg

SEQ ID NO: 1584699 - DNA, 21 bp, Homo sapiens
ctgacaacttagctcaggtgc

SEQ ID NO: 1584700 - DNA, 13 bp, Homo sapiens
ctgacaacttgaa

SEQ ID NO: 1584701 - DNA, 14 bp, Homo sapiens
ctgacaagccatct

SEQ ID NO: 1584702 - DNA, 13 bp, Homo sapiens
ctgacaagggctg

SEQ ID NO: 1584703 - DNA, 14 bp, Homo sapiens
ctgacaataaagat

SEQ ID NO: 1584704 - DNA, 18 bp, Homo sapiens
ctgacaatggcagctaga

SEQ ID NO: 1584705 - DNA, 22 bp, Homo sapiens
ctgacaatggcagctagactgg

SEQ ID NO: 1584706 - DNA, 18 bp, Homo sapiens
ctgacacaaaaagtagat

SEQ ID NO: 1584707 - DNA, 17 bp, Homo sapiens
ctgacacaccaggcgct

SEQ ID NO: 1584708 - DNA, 19 bp, Homo sapiens
ctgacacaccaggcgctaa

SEQ ID NO: 1584709 - DNA, 16 bp, Homo sapiens
ctgacacactaaccaa

SEQ ID NO: 1584710 - DNA, 10 bp, Homo sapiens
ctgacacagg

SEQ ID NO: 1584711 - DNA, 21 bp, Homo sapiens
ctgacacaggaaaccaacacc

SEQ ID NO: 1584712 - DNA, 13 bp, Homo sapiens
ctgacaccccctc

SEQ ID NO: 1584713 - DNA, 14 bp, Homo sapiens
ctgacaccccctcc

SEQ ID NO: 1584714 - DNA, 17 bp, Homo sapiens
ctgacaccctggtcctg

SEQ ID NO: 1584715 - DNA, 18 bp, Homo sapiens
ctgacaccgtccctcagt

SEQ ID NO: 1584716 - DNA, 16 bp, Homo sapiens
ctgacacgcagcctgc

SEQ ID NO: 1584717 - DNA, 19 bp, Homo sapiens
ctgacacgcagcctgctct

SEQ ID NO: 1584718 - DNA, 20 bp, Homo sapiens
ctgacactaccttatcaggc

SEQ ID NO: 1584719 - DNA, 19 bp, Homo sapiens
ctgacagaaagattttcct

SEQ ID NO: 1584720 - DNA, 12 bp, Homo sapiens
ctgacagaggag

SEQ ID NO: 1584721 - DNA, 18 bp, Homo sapiens
ctgacagattgacaggga

SEQ ID NO: 1584722 - DNA, 11 bp, Homo sapiens
ctgacagattt

SEQ ID NO: 1584723 - DNA, 21 bp, Homo sapiens
ctgacagggacatgccctgtg

SEQ ID NO: 1584724 - DNA, 16 bp, Homo sapiens
ctgacagggagcagcc

SEQ ID NO: 1584725 - DNA, 16 bp, Homo sapiens
ctgacagtcagctgtg

SEQ ID NO: 1584726 - DNA, 17 bp, Homo sapiens
ctgacagtcagctgtgg

SEQ ID NO: 1584727 - DNA, 19 bp, Homo sapiens
ctgacagtcagctgtgggg

SEQ ID NO: 1584728 - DNA, 13 bp, Homo sapiens
ctgacagtccaca

SEQ ID NO: 1584729 - DNA, 19 bp, Homo sapiens
ctgacagtccacaggggcc

SEQ ID NO: 1584730 - DNA, 14 bp, Homo sapiens
ctgacatagagaaa

SEQ ID NO: 1584731 - DNA, 20 bp, Homo sapiens
ctgacatcaattttaccctg

SEQ ID NO: 1584732 - DNA, 13 bp, Homo sapiens
ctgacatcccttc

SEQ ID NO: 1584733 - DNA, 18 bp, Homo sapiens
ctgacatcccttcctgga

SEQ ID NO: 1584734 - DNA, 23 bp, Homo sapiens
ctgacatgaagctgttgtgtgag

SEQ ID NO: 1584735 - DNA, 15 bp, Homo sapiens
ctgacatgctcacac

SEQ ID NO: 1584736 - DNA, 14 bp, Homo sapiens
ctgacatttcttct

SEQ ID NO: 1584737 - DNA, 18 bp, Homo sapiens
ctgacatttcttctagtg

SEQ ID NO: 1584738 - DNA, 20 bp, Homo sapiens
ctgacatttgtttatttttt

SEQ ID NO: 1584739 - DNA, 19 bp, Homo sapiens
ctgaccaaagactgcagaa

SEQ ID NO: 1584740 - DNA, 13 bp, Homo sapiens
ctgaccaacaggc

SEQ ID NO: 1584741 - DNA, 16 bp, Homo sapiens
ctgaccaacatggaga

SEQ ID NO: 1584742 - DNA, 21 bp, Homo sapiens
ctgaccaagtgctggcccacc

SEQ ID NO: 1584743 - DNA, 14 bp, Homo sapiens
ctgaccaattgtgc

SEQ ID NO: 1584744 - DNA, 17 bp, Homo sapiens
ctgaccaattgtgctgc

SEQ ID NO: 1584745 - DNA, 18 bp, Homo sapiens
ctgaccaattgtgctgcc

SEQ ID NO: 1584746 - DNA, 21 bp, Homo sapiens
ctgaccaattgtgctgccatt

SEQ ID NO: 1584747 - DNA, 22 bp, Homo sapiens
ctgaccaattgtgctgccattt

SEQ ID NO: 1584748 - DNA, 21 bp, Homo sapiens
ctgaccacaccaaccaggcct

SEQ ID NO: 1584749 - DNA, 14 bp, Homo sapiens
ctgaccaccctccc

SEQ ID NO: 1584750 - DNA, 17 bp, Homo sapiens
ctgaccaccctcccctc

SEQ ID NO: 1584751 - DNA, 23 bp, Homo sapiens
ctgaccacggacgtttccatcag

SEQ ID NO: 1584752 - DNA, 13 bp, Homo sapiens
ctgaccagaacta

SEQ ID NO: 1584753 - DNA, 17 bp, Homo sapiens
ctgaccagcggctgctc

SEQ ID NO: 1584754 - DNA, 13 bp, Homo sapiens
ctgaccagctgct

SEQ ID NO: 1584755 - DNA, 16 bp, Homo sapiens
ctgaccagctgctccg

SEQ ID NO: 1584756 - DNA, 19 bp, Homo sapiens
ctgaccataatcctagccc

SEQ ID NO: 1584757 - DNA, 15 bp, Homo sapiens
ctgaccatccactct

SEQ ID NO: 1584758 - DNA, 13 bp, Homo sapiens
ctgaccatctgtg

SEQ ID NO: 1584759 - DNA, 18 bp, Homo sapiens
ctgaccatctgtgactat

SEQ ID NO: 1584760 - DNA, 23 bp, Homo sapiens
ctgacccaactgatcctgctcca

SEQ ID NO: 1584761 - DNA, 21 bp, Homo sapiens
ctgacccaagtggggcctcct

SEQ ID NO: 1584762 - DNA, 20 bp, Homo sapiens
ctgacccagagtggagtctg

SEQ ID NO: 1584763 - DNA, 22 bp, Homo sapiens
ctgacccagagtggagtctgag

SEQ ID NO: 1584764 - DNA, 23 bp, Homo sapiens
ctgacccagagtggagtctgagt

SEQ ID NO: 1584765 - DNA, 18 bp, Homo sapiens
ctgacccagcatctccca

SEQ ID NO: 1584766 - DNA, 21 bp, Homo sapiens
ctgacccagcatctcccagca

SEQ ID NO: 1584767 - DNA, 18 bp, Homo sapiens
ctgacccaggaccatcct

SEQ ID NO: 1584768 - DNA, 19 bp, Homo sapiens
ctgacccaggccgcagctc

SEQ ID NO: 1584769 - DNA, 23 bp, Homo sapiens
ctgacccaggccgcagctcttgc

SEQ ID NO: 1584770 - DNA, 10 bp, Homo sapiens
ctgacccagt

SEQ ID NO: 1584771 - DNA, 11 bp, Homo sapiens
ctgacccagtc

SEQ ID NO: 1584772 - DNA, 15 bp, Homo sapiens
ctgacccagtccctg

SEQ ID NO: 1584773 - DNA, 17 bp, Homo sapiens
ctgacccagtccctggg

SEQ ID NO: 1584774 - DNA, 18 bp, Homo sapiens
ctgacccagtgcccccac

SEQ ID NO: 1584775 - DNA, 17 bp, Homo sapiens
ctgaccccattcctgat

SEQ ID NO: 1584776 - DNA, 16 bp, Homo sapiens
ctgaccccctcccctg

SEQ ID NO: 1584777 - DNA, 20 bp, Homo sapiens
ctgaccccgagaagtgctct

SEQ ID NO: 1584778 - DNA, 22 bp, Homo sapiens
ctgaccccgagaagtgctcttg

SEQ ID NO: 1584779 - DNA, 20 bp, Homo sapiens
ctgaccccggtggcggcccc

SEQ ID NO: 1584780 - DNA, 19 bp, Homo sapiens
ctgacccctgcctgttggc

SEQ ID NO: 1584781 - DNA, 23 bp, Homo sapiens
ctgacccctgcctgttggcaggc

SEQ ID NO: 1584782 - DNA, 14 bp, Homo sapiens
ctgacccctgctca

SEQ ID NO: 1584783 - DNA, 17 bp, Homo sapiens
ctgaccctatgggtcta

SEQ ID NO: 1584784 - DNA, 13 bp, Homo sapiens
ctgaccctgggcc

SEQ ID NO: 1584785 - DNA, 18 bp, Homo sapiens
ctgaccctgggcctggag

SEQ ID NO: 1584786 - DNA, 19 bp, Homo sapiens
ctgaccctgggcctggagg

SEQ ID NO: 1584787 - DNA, 14 bp, Homo sapiens
ctgacccttccaga

SEQ ID NO: 1584788 - DNA, 21 bp, Homo sapiens
ctgaccgttaaaaaattcttg

SEQ ID NO: 1584789 - DNA, 20 bp, Homo sapiens
ctgacctaaaagttgaaaag

SEQ ID NO: 1584790 - DNA, 18 bp, Homo sapiens
ctgacctaccccagccag

SEQ ID NO: 1584791 - DNA, 20 bp, Homo sapiens
ctgacctaccccagccaggc

SEQ ID NO: 1584792 - DNA, 24 bp, Homo sapiens
ctgacctaccccagccaggctcct

SEQ ID NO: 1584793 - DNA, 17 bp, Homo sapiens
ctgacctcacctggtcc

SEQ ID NO: 1584794 - DNA, 12 bp, Homo sapiens
ctgacctcactg

SEQ ID NO: 1584795 - DNA, 18 bp, Homo sapiens
ctgacctcactgtcctgt

SEQ ID NO: 1584796 - DNA, 17 bp, Homo sapiens
ctgacctccgccatcca

SEQ ID NO: 1584797 - DNA, 19 bp, Homo sapiens
ctgacctccgccatccacc

SEQ ID NO: 1584798 - DNA, 19 bp, Homo sapiens
ctgacctgaccccattcct

SEQ ID NO: 1584799 - DNA, 19 bp, Homo sapiens
ctgacctgtcatgcccccc

SEQ ID NO: 1584800 - DNA, 20 bp, Homo sapiens
ctgacctgtcatgcccccct

SEQ ID NO: 1584801 - DNA, 22 bp, Homo sapiens
ctgaccttagcgttctggactc

SEQ ID NO: 1584802 - DNA, 21 bp, Homo sapiens
ctgaccttggagagacacagc

SEQ ID NO: 1584803 - DNA, 21 bp, Homo sapiens
ctgacctttgtcatctttctt

SEQ ID NO: 1584804 - DNA, 16 bp, Homo sapiens
ctgacgcaacccacgt

SEQ ID NO: 1584805 - DNA, 13 bp, Homo sapiens
ctgacgcttgtga

SEQ ID NO: 1584806 - DNA, 15 bp, Homo sapiens
ctgacgcttgtgaca

SEQ ID NO: 1584807 - DNA, 19 bp, Homo sapiens
ctgacgcttgtgacagtgc

SEQ ID NO: 1584808 - DNA, 21 bp, Homo sapiens
ctgacgcttgtgacagtgcct

SEQ ID NO: 1584809 - DNA, 22 bp, Homo sapiens
ctgacgcttgtgacagtgcctc

SEQ ID NO: 1584810 - DNA, 15 bp, Homo sapiens
ctgacggccagggag

SEQ ID NO: 1584811 - DNA, 20 bp, Homo sapiens
ctgacggcgcccccagtgtg

SEQ ID NO: 1584812 - DNA, 24 bp, Homo sapiens
ctgacgtcagtagtttgagaccag

SEQ ID NO: 1584813 - DNA, 22 bp, Homo sapiens
ctgacgtctgaagcttgactcc

SEQ ID NO: 1584814 - DNA, 14 bp, Homo sapiens
ctgacgtgcctttt

SEQ ID NO: 1584815 - DNA, 20 bp, Homo sapiens
ctgacgtgccttttgcaccc

SEQ ID NO: 1584816 - DNA, 14 bp, Homo sapiens
ctgactaaactttt

SEQ ID NO: 1584817 - DNA, 15 bp, Homo sapiens
ctgactaaacttttt

SEQ ID NO: 1584818 - DNA, 22 bp, Homo sapiens
ctgactaaactttttttctgta

SEQ ID NO: 1584819 - DNA, 18 bp, Homo sapiens
ctgactcaacatgttact

SEQ ID NO: 1584820 - DNA, 17 bp, Homo sapiens
ctgactcaattatttgc

SEQ ID NO: 1584821 - DNA, 21 bp, Homo sapiens
ctgactcaattatttgcatat

SEQ ID NO: 1584822 - DNA, 22 bp, Homo sapiens
ctgactcacacctgaactgaac

SEQ ID NO: 1584823 - DNA, 19 bp, Homo sapiens
ctgactcatccccacagct

SEQ ID NO: 1584824 - DNA, 13 bp, Homo sapiens
ctgactccagagt

SEQ ID NO: 1584825 - DNA, 14 bp, Homo sapiens
ctgactccagagtc

SEQ ID NO: 1584826 - DNA, 22 bp, Homo sapiens
ctgactccagagtctgagcccc

SEQ ID NO: 1584827 - DNA, 13 bp, Homo sapiens
ctgactccttaga

SEQ ID NO: 1584828 - DNA, 16 bp, Homo sapiens
ctgactcggtttctcc

SEQ ID NO: 1584829 - DNA, 17 bp, Homo sapiens
ctgactcggtttctcca

SEQ ID NO: 1584830 - DNA, 22 bp, Homo sapiens
ctgactctcgtgcatttcaact

SEQ ID NO: 1584831 - DNA, 14 bp, Homo sapiens
ctgactctctgtga

SEQ ID NO: 1584832 - DNA, 14 bp, Homo sapiens
ctgactctgaaatc

SEQ ID NO: 1584833 - DNA, 15 bp, Homo sapiens
ctgactcttattttt

SEQ ID NO: 1584834 - DNA, 22 bp, Homo sapiens
ctgactgaacattagttgcact

SEQ ID NO: 1584835 - DNA, 14 bp, Homo sapiens
ctgactgaaggaaa

SEQ ID NO: 1584836 - DNA, 12 bp, Homo sapiens
ctgactgagata

SEQ ID NO: 1584837 - DNA, 12 bp, Homo sapiens
ctgactgaggcc

SEQ ID NO: 1584838 - DNA, 13 bp, Homo sapiens
ctgactgaggcct

SEQ ID NO: 1584839 - DNA, 19 bp, Homo sapiens
ctgactgaggcctgcttcc

SEQ ID NO: 1584840 - DNA, 24 bp, Homo sapiens
ctgactgatagcttacactgagga

SEQ ID NO: 1584841 - DNA, 17 bp, Homo sapiens
ctgactgccaagccaga

SEQ ID NO: 1584842 - DNA, 16 bp, Homo sapiens
ctgactggtgctgcag

SEQ ID NO: 1584843 - DNA, 20 bp, Homo sapiens
ctgactggttaacagcagtc

SEQ ID NO: 1584844 - DNA, 13 bp, Homo sapiens
ctgactgtggccc

SEQ ID NO: 1584845 - DNA, 19 bp, Homo sapiens
ctgactgtggccccctccg

SEQ ID NO: 1584846 - DNA, 15 bp, Homo sapiens
ctgactgttcttggt

SEQ ID NO: 1584847 - DNA, 23 bp, Homo sapiens
ctgactgtttatttaaggatgga

SEQ ID NO: 1584848 - DNA, 18 bp, Homo sapiens
ctgacttaactttaactt

SEQ ID NO: 1584849 - DNA, 18 bp, Homo sapiens
ctgacttaagcaaaagaa

SEQ ID NO: 1584850 - DNA, 24 bp, Homo sapiens
ctgacttaagcaaaagaaaaagat

SEQ ID NO: 1584851 - DNA, 23 bp, Homo sapiens
ctgacttcagtgaatatttttgt

SEQ ID NO: 1584852 - DNA, 14 bp, Homo sapiens
ctgacttctgcctg

SEQ ID NO: 1584853 - DNA, 19 bp, Homo sapiens
ctgacttctgcctggagac

SEQ ID NO: 1584854 - DNA, 15 bp, Homo sapiens
ctgacttgagtgttc

SEQ ID NO: 1584855 - DNA, 22 bp, Homo sapiens
ctgacttgagtgttccttttta

SEQ ID NO: 1584856 - DNA, 23 bp, Homo sapiens
ctgacttggatcccaaagcaagg

SEQ ID NO: 1584857 - DNA, 14 bp, Homo sapiens
ctgacttggcactt

SEQ ID NO: 1584858 - DNA, 20 bp, Homo sapiens
ctgacttggggagatggagt

SEQ ID NO: 1584859 - DNA, 21 bp, Homo sapiens
ctgacttggggagatggagtt

SEQ ID NO: 1584860 - DNA, 21 bp, Homo sapiens
ctgactttctgattactgtcc

SEQ ID NO: 1584861 - DNA, 17 bp, Homo sapiens
ctgactttgcttgcttt

SEQ ID NO: 1584862 - DNA, 18 bp, Homo sapiens
ctgactttgcttgctttg

SEQ ID NO: 1584863 - DNA, 19 bp, Homo sapiens
ctgactttgcttgctttga

SEQ ID NO: 1584864 - DNA, 18 bp, Homo sapiens
ctgacttttccaaataaa

SEQ ID NO: 1584865 - DNA, 12 bp, Homo sapiens
ctgagaaagact

SEQ ID NO: 1584866 - DNA, 23 bp, Homo sapiens
ctgagaaagactattcaaacagt

SEQ ID NO: 1584867 - DNA, 23 bp, Homo sapiens
ctgagaacacgttgccaggggct

SEQ ID NO: 1584868 - DNA, 15 bp, Homo sapiens
ctgagaactgaattt

SEQ ID NO: 1584869 - DNA, 20 bp, Homo sapiens
ctgagaagaatgaaaatgca

SEQ ID NO: 1584870 - DNA, 23 bp, Homo sapiens
ctgagaaggtttggtccagcctg

SEQ ID NO: 1584871 - DNA, 22 bp, Homo sapiens
ctgagaatcacggtggtaaaga

SEQ ID NO: 1584872 - DNA, 20 bp, Homo sapiens
ctgagacaaatggaggcctg

SEQ ID NO: 1584873 - DNA, 14 bp, Homo sapiens
ctgagaccagttgg

SEQ ID NO: 1584874 - DNA, 19 bp, Homo sapiens
ctgagaccagttgggagca

SEQ ID NO: 1584875 - DNA, 22 bp, Homo sapiens
ctgagaccagttgggagcactg

SEQ ID NO: 1584876 - DNA, 21 bp, Homo sapiens
ctgagacccttttctcaggac

SEQ ID NO: 1584877 - DNA, 13 bp, Homo sapiens
ctgagacctcaat

SEQ ID NO: 1584878 - DNA, 19 bp, Homo sapiens
ctgagacctctagagaaaa

SEQ ID NO: 1584879 - DNA, 16 bp, Homo sapiens
ctgagactgctaagta

SEQ ID NO: 1584880 - DNA, 20 bp, Homo sapiens
ctgagactggcacttagccc

SEQ ID NO: 1584881 - DNA, 20 bp, Homo sapiens
ctgagactgggtaatttata

SEQ ID NO: 1584882 - DNA, 22 bp, Homo sapiens
ctgagactgggtaatttataaa

SEQ ID NO: 1584883 - DNA, 17 bp, Homo sapiens
ctgagactttcccctct

SEQ ID NO: 1584884 - DNA, 15 bp, Homo sapiens
ctgagagacccaagg

SEQ ID NO: 1584885 - DNA, 19 bp, Homo sapiens
ctgagagacccaaggagga

SEQ ID NO: 1584886 - DNA, 20 bp, Homo sapiens
ctgagagacccaaggaggaa

SEQ ID NO: 1584887 - DNA, 22 bp, Homo sapiens
ctgagagacctgccctctctgc

SEQ ID NO: 1584888 - DNA, 18 bp, Homo sapiens
ctgagagagaatagagct

SEQ ID NO: 1584889 - DNA, 23 bp, Homo sapiens
ctgagagagaatagagctgccac

SEQ ID NO: 1584890 - DNA, 15 bp, Homo sapiens
ctgagagcatctcag

SEQ ID NO: 1584891 - DNA, 17 bp, Homo sapiens
ctgagagcatctcagga

SEQ ID NO: 1584892 - DNA, 19 bp, Homo sapiens
ctgagagcatctcaggagg

SEQ ID NO: 1584893 - DNA, 20 bp, Homo sapiens
ctgagagccagatgcctccc

SEQ ID NO: 1584894 - DNA, 16 bp, Homo sapiens
ctgagagccccagctg

SEQ ID NO: 1584895 - DNA, 17 bp, Homo sapiens
ctgagagccccagctga

SEQ ID NO: 1584896 - DNA, 15 bp, Homo sapiens
ctgagaggcaggcat

SEQ ID NO: 1584897 - DNA, 17 bp, Homo sapiens
ctgagaggcaggcatag

SEQ ID NO: 1584898 - DNA, 14 bp, Homo sapiens
ctgagaggcctgga

SEQ ID NO: 1584899 - DNA, 15 bp, Homo sapiens
ctgagaggcctggag

SEQ ID NO: 1584900 - DNA, 14 bp, Homo sapiens
ctgagaggctctcc

SEQ ID NO: 1584901 - DNA, 18 bp, Homo sapiens
ctgagagtcagctctctg

SEQ ID NO: 1584902 - DNA, 14 bp, Homo sapiens
ctgagagtctagat

SEQ ID NO: 1584903 - DNA, 15 bp, Homo sapiens
ctgagagtctagatt

SEQ ID NO: 1584904 - DNA, 22 bp, Homo sapiens
ctgagagtggtgccctggaaca

SEQ ID NO: 1584905 - DNA, 15 bp, Homo sapiens
ctgagataagaaaag

SEQ ID NO: 1584906 - DNA, 20 bp, Homo sapiens
ctgagataagaaaagcctga

SEQ ID NO: 1584907 - DNA, 12 bp, Homo sapiens
ctgagatatgaa

SEQ ID NO: 1584908 - DNA, 15 bp, Homo sapiens
ctgagatatgaacat

SEQ ID NO: 1584909 - DNA, 21 bp, Homo sapiens
ctgagatatgaacatattgtt

SEQ ID NO: 1584910 - DNA, 14 bp, Homo sapiens
ctgagatcgtgccg

SEQ ID NO: 1584911 - DNA, 15 bp, Homo sapiens
ctgagatgagcccca

SEQ ID NO: 1584912 - DNA, 17 bp, Homo sapiens
ctgagattctttaagga

SEQ ID NO: 1584913 - DNA, 16 bp, Homo sapiens
ctgagattgtgtttgt

SEQ ID NO: 1584914 - DNA, 14 bp, Homo sapiens
ctgagatttcatct

SEQ ID NO: 1584915 - DNA, 20 bp, Homo sapiens
ctgagatttcatctgctctc

SEQ ID NO: 1584916 - DNA, 22 bp, Homo sapiens
ctgagcaaactatttgcgactc

SEQ ID NO: 1584917 - DNA, 16 bp, Homo sapiens
ctgagcaacagagtga

SEQ ID NO: 1584918 - DNA, 23 bp, Homo sapiens
ctgagcaacagagtgagaccctg

SEQ ID NO: 1584919 - DNA, 24 bp, Homo sapiens
ctgagcaacagagtgagaccctgt

SEQ ID NO: 1584920 - DNA, 18 bp, Homo sapiens
ctgagcaacatctcggga

SEQ ID NO: 1584921 - DNA, 13 bp, Homo sapiens
ctgagcacccgct

SEQ ID NO: 1584922 - DNA, 16 bp, Homo sapiens
ctgagcaccctctgga

SEQ ID NO: 1584923 - DNA, 20 bp, Homo sapiens
ctgagcaccgtgtcaagctg

SEQ ID NO: 1584924 - DNA, 13 bp, Homo sapiens
ctgagcacctccc

SEQ ID NO: 1584925 - DNA, 12 bp, Homo sapiens
ctgagcactgtt

SEQ ID NO: 1584926 - DNA, 12 bp, Homo sapiens
ctgagcacttag

SEQ ID NO: 1584927 - DNA, 15 bp, Homo sapiens
ctgagcacttagcag

SEQ ID NO: 1584928 - DNA, 19 bp, Homo sapiens
ctgagcagcctctgccagg

SEQ ID NO: 1584929 - DNA, 20 bp, Homo sapiens
ctgagcagcctctgccaggc

SEQ ID NO: 1584930 - DNA, 24 bp, Homo sapiens
ctgagcagcctctgccaggcctgt

SEQ ID NO: 1584931 - DNA, 16 bp, Homo sapiens
ctgagcagctggatct

SEQ ID NO: 1584932 - DNA, 16 bp, Homo sapiens
ctgagcaggattttaa

SEQ ID NO: 1584933 - DNA, 21 bp, Homo sapiens
ctgagcaggggaacaaaataa

SEQ ID NO: 1584934 - DNA, 23 bp, Homo sapiens
ctgagcaggggaacaaaataagg

SEQ ID NO: 1584935 - DNA, 15 bp, Homo sapiens
ctgagcagggtccac

SEQ ID NO: 1584936 - DNA, 17 bp, Homo sapiens
ctgagcagggtccacag

SEQ ID NO: 1584937 - DNA, 18 bp, Homo sapiens
ctgagcagggtccacagc

SEQ ID NO: 1584938 - DNA, 23 bp, Homo sapiens
ctgagcagggtccacagctggaa

SEQ ID NO: 1584939 - DNA, 18 bp, Homo sapiens
ctgagcatggggcgctcc

SEQ ID NO: 1584940 - DNA, 22 bp, Homo sapiens
ctgagccagggaacagccccag

SEQ ID NO: 1584941 - DNA, 23 bp, Homo sapiens
ctgagccagggaacagccccagg

SEQ ID NO: 1584942 - DNA, 15 bp, Homo sapiens
ctgagccatgaggag

SEQ ID NO: 1584943 - DNA, 16 bp, Homo sapiens
ctgagccatgaggagc

SEQ ID NO: 1584944 - DNA, 22 bp, Homo sapiens
ctgagcccaccagggacacctc

SEQ ID NO: 1584945 - DNA, 14 bp, Homo sapiens
ctgagcccaggccg

SEQ ID NO: 1584946 - DNA, 19 bp, Homo sapiens
ctgagcccaggccgttccc

SEQ ID NO: 1584947 - DNA, 15 bp, Homo sapiens
ctgagccccccatgc

SEQ ID NO: 1584948 - DNA, 20 bp, Homo sapiens
ctgagccccctgcacccacc

SEQ ID NO: 1584949 - DNA, 14 bp, Homo sapiens
ctgagcccctaccc

SEQ ID NO: 1584950 - DNA, 15 bp, Homo sapiens
ctgagcccctacccc

SEQ ID NO: 1584951 - DNA, 14 bp, Homo sapiens
ctgagcccctgggg

SEQ ID NO: 1584952 - DNA, 22 bp, Homo sapiens
ctgagcccgggctgcctgggct

SEQ ID NO: 1584953 - DNA, 23 bp, Homo sapiens
ctgagcccgggctgcctgggctg

SEQ ID NO: 1584954 - DNA, 13 bp, Homo sapiens
ctgagccctggca

SEQ ID NO: 1584955 - DNA, 14 bp, Homo sapiens
ctgagccctggcag

SEQ ID NO: 1584956 - DNA, 15 bp, Homo sapiens
ctgagccctggcagg

SEQ ID NO: 1584957 - DNA, 13 bp, Homo sapiens
ctgagccctggtg

SEQ ID NO: 1584958 - DNA, 18 bp, Homo sapiens
ctgagccctggtgtgttt

SEQ ID NO: 1584959 - DNA, 23 bp, Homo sapiens
ctgagccggccccaggctcgtgg

SEQ ID NO: 1584960 - DNA, 14 bp, Homo sapiens
ctgagcctcacttg

SEQ ID NO: 1584961 - DNA, 18 bp, Homo sapiens
ctgagcctgcagggaagc

SEQ ID NO: 1584962 - DNA, 11 bp, Homo sapiens
ctgagcctggc

SEQ ID NO: 1584963 - DNA, 19 bp, Homo sapiens
ctgagcctggcccatagaa

SEQ ID NO: 1584964 - DNA, 22 bp, Homo sapiens
ctgagcctggcccatagaaaca

SEQ ID NO: 1584965 - DNA, 16 bp, Homo sapiens
ctgagccttgtaattc

SEQ ID NO: 1584966 - DNA, 17 bp, Homo sapiens
ctgagcgagtgctctca

SEQ ID NO: 1584967 - DNA, 20 bp, Homo sapiens
ctgagcgctgtggactgtcc

SEQ ID NO: 1584968 - DNA, 22 bp, Homo sapiens
ctgagcggcgcagagccctcca

SEQ ID NO: 1584969 - DNA, 22 bp, Homo sapiens
ctgagcggtgggggaggagggt

SEQ ID NO: 1584970 - DNA, 16 bp, Homo sapiens
ctgagctatttcatct

SEQ ID NO: 1584971 - DNA, 11 bp, Homo sapiens
ctgagctcaaa

SEQ ID NO: 1584972 - DNA, 13 bp, Homo sapiens
ctgagctccacct

SEQ ID NO: 1584973 - DNA, 18 bp, Homo sapiens
ctgagctccacctctggt

SEQ ID NO: 1584974 - DNA, 14 bp, Homo sapiens
ctgagctcccacct

SEQ ID NO: 1584975 - DNA, 20 bp, Homo sapiens
ctgagctcccacctcccttc

SEQ ID NO: 1584976 - DNA, 22 bp, Homo sapiens
ctgagctcccacctcccttccc

SEQ ID NO: 1584977 - DNA, 23 bp, Homo sapiens
ctgagctcccacctcccttccca

SEQ ID NO: 1584978 - DNA, 18 bp, Homo sapiens
ctgagctcctgctgcgga

SEQ ID NO: 1584979 - DNA, 22 bp, Homo sapiens
ctgagctcctgctgcggaggag

SEQ ID NO: 1584980 - DNA, 22 bp, Homo sapiens
ctgagctcggggggctctgcct

SEQ ID NO: 1584981 - DNA, 18 bp, Homo sapiens
ctgagctcggtggaccca

SEQ ID NO: 1584982 - DNA, 22 bp, Homo sapiens
ctgagctcggtggacccaggga

SEQ ID NO: 1584983 - DNA, 14 bp, Homo sapiens
ctgagctctccagg

SEQ ID NO: 1584984 - DNA, 16 bp, Homo sapiens
ctgagctctccaggcc

SEQ ID NO: 1584985 - DNA, 22 bp, Homo sapiens
ctgagctctccaggccaggtgg

SEQ ID NO: 1584986 - DNA, 14 bp, Homo sapiens
ctgagctggaaggg

SEQ ID NO: 1584987 - DNA, 17 bp, Homo sapiens
ctgagctggaaggggcc

SEQ ID NO: 1584988 - DNA, 18 bp, Homo sapiens
ctgagctggaaggggcca

SEQ ID NO: 1584989 - DNA, 13 bp, Homo sapiens
ctgagctggggcc

SEQ ID NO: 1584990 - DNA, 21 bp, Homo sapiens
ctgagctgtaatttcgcctta

SEQ ID NO: 1584991 - DNA, 21 bp, Homo sapiens
ctgagctgtcgctgcctccat

SEQ ID NO: 1584992 - DNA, 16 bp, Homo sapiens
ctgagcttaaataaca

SEQ ID NO: 1584993 - DNA, 15 bp, Homo sapiens
ctgagcttagccttg

SEQ ID NO: 1584994 - DNA, 17 bp, Homo sapiens
ctgagcttagccttgtg

SEQ ID NO: 1584995 - DNA, 21 bp, Homo sapiens
ctgagcttagccttgtgccct

SEQ ID NO: 1584996 - DNA, 16 bp, Homo sapiens
ctgagcttctctgtga

SEQ ID NO: 1584997 - DNA, 20 bp, Homo sapiens
ctgagcttgagctcccctgg

SEQ ID NO: 1584998 - DNA, 17 bp, Homo sapiens
ctgagctttggggacag

SEQ ID NO: 1584999 - DNA, 19 bp, Homo sapiens
ctgagcttttcatggaagt

SEQ ID NO: 1585000 - DNA, 16 bp, Homo sapiens
ctgaggaaacaaaaag

SEQ ID NO: 1585001 - DNA, 16 bp, Homo sapiens
ctgaggaactgtctcg

SEQ ID NO: 1585002 - DNA, 21 bp, Homo sapiens
ctgaggaatcaacagggcagc

SEQ ID NO: 1585003 - DNA, 16 bp, Homo sapiens
ctgaggaatttcacct

SEQ ID NO: 1585004 - DNA, 13 bp, Homo sapiens
ctgaggacagagc

SEQ ID NO: 1585005 - DNA, 16 bp, Homo sapiens
ctgaggacaggccccc

SEQ ID NO: 1585006 - DNA, 19 bp, Homo sapiens
ctgaggaccgctgataagc

SEQ ID NO: 1585007 - DNA, 16 bp, Homo sapiens
ctgaggacctctcagc

SEQ ID NO: 1585008 - DNA, 9 bp, Homo sapiens
ctgaggacg

SEQ ID NO: 1585009 - DNA, 16 bp, Homo sapiens
ctgaggacgagacccc

SEQ ID NO: 1585010 - DNA, 18 bp, Homo sapiens
ctgaggacgagaccccca

SEQ ID NO: 1585011 - DNA, 14 bp, Homo sapiens
ctgaggactgattt

SEQ ID NO: 1585012 - DNA, 14 bp, Homo sapiens
ctgaggactggaga

SEQ ID NO: 1585013 - DNA, 21 bp, Homo sapiens
ctgaggagaagctgatccagt

SEQ ID NO: 1585014 - DNA, 18 bp, Homo sapiens
ctgaggagacagaaagcc

SEQ ID NO: 1585015 - DNA, 20 bp, Homo sapiens
ctgaggagacagaaagcctc

SEQ ID NO: 1585016 - DNA, 17 bp, Homo sapiens
ctgaggagatgaccagg

SEQ ID NO: 1585017 - DNA, 19 bp, Homo sapiens
ctgaggagatgaccaggga

SEQ ID NO: 1585018 - DNA, 22 bp, Homo sapiens
ctgaggagatgaccagggatgc

SEQ ID NO: 1585019 - DNA, 13 bp, Homo sapiens
ctgaggagccctg

SEQ ID NO: 1585020 - DNA, 23 bp, Homo sapiens
ctgaggagccctgaggacctctc

SEQ ID NO: 1585021 - DNA, 21 bp, Homo sapiens
ctgaggaggaggacacagcac

SEQ ID NO: 1585022 - DNA, 23 bp, Homo sapiens
ctgaggaggaggacacagcacaa

SEQ ID NO: 1585023 - DNA, 21 bp, Homo sapiens
ctgaggagtattaagaatgca

SEQ ID NO: 1585024 - DNA, 16 bp, Homo sapiens
ctgaggatacagctct

SEQ ID NO: 1585025 - DNA, 21 bp, Homo sapiens
ctgaggatatggacactggtg

SEQ ID NO: 1585026 - DNA, 16 bp, Homo sapiens
ctgaggatgaccagaa

SEQ ID NO: 1585027 - DNA, 18 bp, Homo sapiens
ctgaggatttcaagcctg

SEQ ID NO: 1585028 - DNA, 12 bp, Homo sapiens
ctgaggcaagag

SEQ ID NO: 1585029 - DNA, 15 bp, Homo sapiens
ctgaggcagacagca

SEQ ID NO: 1585030 - DNA, 20 bp, Homo sapiens
ctgaggcaggtgagaaccca

SEQ ID NO: 1585031 - DNA, 21 bp, Homo sapiens
ctgaggcaggtgagaacccag

SEQ ID NO: 1585032 - DNA, 22 bp, Homo sapiens
ctgaggcaggtgagaacccaga

SEQ ID NO: 1585033 - DNA, 19 bp, Homo sapiens
ctgaggccacccactgacc

SEQ ID NO: 1585034 - DNA, 21 bp, Homo sapiens
ctgaggccaggacgtctgggg

SEQ ID NO: 1585035 - DNA, 16 bp, Homo sapiens
ctgaggcccagtgcat

SEQ ID NO: 1585036 - DNA, 14 bp, Homo sapiens
ctgaggcccctagg

SEQ ID NO: 1585037 - DNA, 21 bp, Homo sapiens
ctgaggcccctaggtgcccag

SEQ ID NO: 1585038 - DNA, 23 bp, Homo sapiens
ctgaggcccctaggtgcccaggg

SEQ ID NO: 1585039 - DNA, 19 bp, Homo sapiens
ctgaggcctagactctgtc

SEQ ID NO: 1585040 - DNA, 11 bp, Homo sapiens
ctgaggcctca

SEQ ID NO: 1585041 - DNA, 17 bp, Homo sapiens
ctgaggcctgagcgctc

SEQ ID NO: 1585042 - DNA, 18 bp, Homo sapiens
ctgaggcctgagcgctcc

SEQ ID NO: 1585043 - DNA, 16 bp, Homo sapiens
ctgaggcctgcagcac

SEQ ID NO: 1585044 - DNA, 14 bp, Homo sapiens
ctgaggcctgcttc

SEQ ID NO: 1585045 - DNA, 20 bp, Homo sapiens
ctgaggcctgcttccccctc

SEQ ID NO: 1585046 - DNA, 22 bp, Homo sapiens
ctgaggcctggactttcctgca

SEQ ID NO: 1585047 - DNA, 15 bp, Homo sapiens
ctgaggcctgggccg

SEQ ID NO: 1585048 - DNA, 23 bp, Homo sapiens
ctgaggcctgggccgctgccacg

SEQ ID NO: 1585049 - DNA, 15 bp, Homo sapiens
ctgaggccttccaga

SEQ ID NO: 1585050 - DNA, 15 bp, Homo sapiens
ctgaggctgagactg

SEQ ID NO: 1585051 - DNA, 14 bp, Homo sapiens
ctgaggctgtggtc

SEQ ID NO: 1585052 - DNA, 20 bp, Homo sapiens
ctgaggctgtggtcacagcg

SEQ ID NO: 1585053 - DNA, 18 bp, Homo sapiens
ctgagggaccaactgggc

SEQ ID NO: 1585054 - DNA, 21 bp, Homo sapiens
ctgagggaccaactgggccca

SEQ ID NO: 1585055 - DNA, 16 bp, Homo sapiens
ctgagggaccgagccc

SEQ ID NO: 1585056 - DNA, 19 bp, Homo sapiens
ctgagggaccttggagagc

SEQ ID NO: 1585057 - DNA, 23 bp, Homo sapiens
ctgagggaccttggagagctcag

SEQ ID NO: 1585058 - DNA, 20 bp, Homo sapiens
ctgagggaggaggccacctc

SEQ ID NO: 1585059 - DNA, 21 bp, Homo sapiens
ctgagggaggaggccacctct

SEQ ID NO: 1585060 - DNA, 20 bp, Homo sapiens
ctgagggcagactggggcat

SEQ ID NO: 1585061 - DNA, 11 bp, Homo sapiens
ctgagggcagt

SEQ ID NO: 1585062 - DNA, 16 bp, Homo sapiens
ctgagggcagtgccct

SEQ ID NO: 1585063 - DNA, 17 bp, Homo sapiens
ctgagggcagtgccctt

SEQ ID NO: 1585064 - DNA, 19 bp, Homo sapiens
ctgagggcagtgccctttg

SEQ ID NO: 1585065 - DNA, 16 bp, Homo sapiens
ctgagggccacactat

SEQ ID NO: 1585066 - DNA, 12 bp, Homo sapiens
ctgagggccagg

SEQ ID NO: 1585067 - DNA, 15 bp, Homo sapiens
ctgagggccagggac

SEQ ID NO: 1585068 - DNA, 19 bp, Homo sapiens
ctgagggccagggacccag

SEQ ID NO: 1585069 - DNA, 16 bp, Homo sapiens
ctgagggcccctctgc

SEQ ID NO: 1585070 - DNA, 20 bp, Homo sapiens
ctgagggcccctctgcccag

SEQ ID NO: 1585071 - DNA, 22 bp, Homo sapiens
ctgagggcccctctgcccagct

SEQ ID NO: 1585072 - DNA, 14 bp, Homo sapiens
ctgagggccctgtg

SEQ ID NO: 1585073 - DNA, 16 bp, Homo sapiens
ctgagggccctgtgga

SEQ ID NO: 1585074 - DNA, 19 bp, Homo sapiens
ctgagggcctgctggaggc

SEQ ID NO: 1585075 - DNA, 22 bp, Homo sapiens
ctgaggggaggatcactggagc

SEQ ID NO: 1585076 - DNA, 16 bp, Homo sapiens
ctgaggggaggcacct

SEQ ID NO: 1585077 - DNA, 19 bp, Homo sapiens
ctgaggggaggcacctcca

SEQ ID NO: 1585078 - DNA, 23 bp, Homo sapiens
ctgaggggaggcacctccaggca

SEQ ID NO: 1585079 - DNA, 19 bp, Homo sapiens
ctgaggggcatctgcccct

SEQ ID NO: 1585080 - DNA, 21 bp, Homo sapiens
ctgagggggtgggggtgccgc

SEQ ID NO: 1585081 - DNA, 21 bp, Homo sapiens
ctgagggggtgggggtgctgc

SEQ ID NO: 1585082 - DNA, 17 bp, Homo sapiens
ctgaggggtgggggtgc

SEQ ID NO: 1585083 - DNA, 18 bp, Homo sapiens
ctgagggtctgggcggcg

SEQ ID NO: 1585084 - DNA, 19 bp, Homo sapiens
ctgagggtggagactaagc

SEQ ID NO: 1585085 - DNA, 20 bp, Homo sapiens
ctgagggtggagactaagcc

SEQ ID NO: 1585086 - DNA, 14 bp, Homo sapiens
ctgaggtataaaga

SEQ ID NO: 1585087 - DNA, 16 bp, Homo sapiens
ctgaggtataaagaca

SEQ ID NO: 1585088 - DNA, 20 bp, Homo sapiens
ctgaggtccttatgtcctgt

SEQ ID NO: 1585089 - DNA, 16 bp, Homo sapiens
ctgaggtctcttgagg

SEQ ID NO: 1585090 - DNA, 17 bp, Homo sapiens
ctgaggtgaaagggagc

SEQ ID NO: 1585091 - DNA, 14 bp, Homo sapiens
ctgaggtgggcaga

SEQ ID NO: 1585092 - DNA, 14 bp, Homo sapiens
ctgaggtgggccca

SEQ ID NO: 1585093 - DNA, 16 bp, Homo sapiens
ctgaggtgggcccagg

SEQ ID NO: 1585094 - DNA, 22 bp, Homo sapiens
ctgaggtgggctggggctgctc

SEQ ID NO: 1585095 - DNA, 21 bp, Homo sapiens
ctgaggtggtaggatcacctg

SEQ ID NO: 1585096 - DNA, 14 bp, Homo sapiens
ctgaggtgtggggg

SEQ ID NO: 1585097 - DNA, 18 bp, Homo sapiens
ctgaggtgtgggggctgc

SEQ ID NO: 1585098 - DNA, 22 bp, Homo sapiens
ctgaggtgtgggggctgcagca

SEQ ID NO: 1585099 - DNA, 17 bp, Homo sapiens
ctgaggttcctctgcct

SEQ ID NO: 1585100 - DNA, 22 bp, Homo sapiens
ctgagtaactggttgctgtgtc

SEQ ID NO: 1585101 - DNA, 22 bp, Homo sapiens
ctgagtaatcgcttaaagatgt

SEQ ID NO: 1585102 - DNA, 20 bp, Homo sapiens
ctgagtagatgggactacag

SEQ ID NO: 1585103 - DNA, 20 bp, Homo sapiens
ctgagtagctgggactacag

SEQ ID NO: 1585104 - DNA, 21 bp, Homo sapiens
ctgagtattaatatctgagga

SEQ ID NO: 1585105 - DNA, 13 bp, Homo sapiens
ctgagtatttttt

SEQ ID NO: 1585106 - DNA, 12 bp, Homo sapiens
ctgagtcaaatc

SEQ ID NO: 1585107 - DNA, 20 bp, Homo sapiens
ctgagtcaaatccagtggtg

SEQ ID NO: 1585108 - DNA, 21 bp, Homo sapiens
ctgagtcaaatccagtggtgg

SEQ ID NO: 1585109 - DNA, 22 bp, Homo sapiens
ctgagtcaaatccagtggtggg

SEQ ID NO: 1585110 - DNA, 14 bp, Homo sapiens
ctgagtcaccagga

SEQ ID NO: 1585111 - DNA, 15 bp, Homo sapiens
ctgagtcaccaggaa

SEQ ID NO: 1585112 - DNA, 20 bp, Homo sapiens
ctgagtcacccatgaagaca

SEQ ID NO: 1585113 - DNA, 22 bp, Homo sapiens
ctgagtcaccctacctgtgcct

SEQ ID NO: 1585114 - DNA, 17 bp, Homo sapiens
ctgagtcacctcctcca

SEQ ID NO: 1585115 - DNA, 19 bp, Homo sapiens
ctgagtcacctcctccact

SEQ ID NO: 1585116 - DNA, 23 bp, Homo sapiens
ctgagtcacctcctccactcact

SEQ ID NO: 1585117 - DNA, 13 bp, Homo sapiens
ctgagtcagtgct

SEQ ID NO: 1585118 - DNA, 19 bp, Homo sapiens
ctgagtcagtgctctcagc

SEQ ID NO: 1585119 - DNA, 22 bp, Homo sapiens
ctgagtcatctgttagggcctt

SEQ ID NO: 1585120 - DNA, 18 bp, Homo sapiens
ctgagtcatgatctccct

SEQ ID NO: 1585121 - DNA, 20 bp, Homo sapiens
ctgagtcatgatctccctgc

SEQ ID NO: 1585122 - DNA, 21 bp, Homo sapiens
ctgagtcatgatctccctgcc

SEQ ID NO: 1585123 - DNA, 16 bp, Homo sapiens
ctgagtccagagcttg

SEQ ID NO: 1585124 - DNA, 20 bp, Homo sapiens
ctgagtccagagcttgtgct

SEQ ID NO: 1585125 - DNA, 16 bp, Homo sapiens
ctgagtcccaggagct

SEQ ID NO: 1585126 - DNA, 17 bp, Homo sapiens
ctgagtcccaggagctg

SEQ ID NO: 1585127 - DNA, 20 bp, Homo sapiens
ctgagtcccctccaggaaga

SEQ ID NO: 1585128 - DNA, 22 bp, Homo sapiens
ctgagtcctggtttcctggcag

SEQ ID NO: 1585129 - DNA, 20 bp, Homo sapiens
ctgagtcctgtctctgcctg

SEQ ID NO: 1585130 - DNA, 21 bp, Homo sapiens
ctgagtcctgtctctgcctgc

SEQ ID NO: 1585131 - DNA, 14 bp, Homo sapiens
ctgagtctatgttc

SEQ ID NO: 1585132 - DNA, 18 bp, Homo sapiens
ctgagtctatgttcaaag

SEQ ID NO: 1585133 - DNA, 14 bp, Homo sapiens
ctgagtctccaggg

SEQ ID NO: 1585134 - DNA, 14 bp, Homo sapiens
ctgagtctcctgtg

SEQ ID NO: 1585135 - DNA, 14 bp, Homo sapiens
ctgagtctgagtcc

SEQ ID NO: 1585136 - DNA, 18 bp, Homo sapiens
ctgagtctgagtcctgtc

SEQ ID NO: 1585137 - DNA, 19 bp, Homo sapiens
ctgagtctgagtcctgtct

SEQ ID NO: 1585138 - DNA, 20 bp, Homo sapiens
ctgagtgagttattgggagt

SEQ ID NO: 1585139 - DNA, 13 bp, Homo sapiens
ctgagtggcagca

SEQ ID NO: 1585140 - DNA, 15 bp, Homo sapiens
ctgagtggcagcagc

SEQ ID NO: 1585141 - DNA, 18 bp, Homo sapiens
ctgagtggcagcagcccc

SEQ ID NO: 1585142 - DNA, 17 bp, Homo sapiens
ctgagtgggaagcccat

SEQ ID NO: 1585143 - DNA, 13 bp, Homo sapiens
ctgagtgggctgg

SEQ ID NO: 1585144 - DNA, 16 bp, Homo sapiens
ctgagtgtcccaagcc

SEQ ID NO: 1585145 - DNA, 15 bp, Homo sapiens
ctgagtgtttggaaa

SEQ ID NO: 1585146 - DNA, 15 bp, Homo sapiens
ctgagttacttgtct

SEQ ID NO: 1585147 - DNA, 18 bp, Homo sapiens
ctgagttacttgtctgag

SEQ ID NO: 1585148 - DNA, 20 bp, Homo sapiens
ctgagttacttgtctgaggc

SEQ ID NO: 1585149 - DNA, 17 bp, Homo sapiens
ctgagttatcaggtgca

SEQ ID NO: 1585150 - DNA, 18 bp, Homo sapiens
ctgagttatcaggtgcag

SEQ ID NO: 1585151 - DNA, 20 bp, Homo sapiens
ctgagttctggttcatgcag

SEQ ID NO: 1585152 - DNA, 17 bp, Homo sapiens
ctgagttgaagagggga

SEQ ID NO: 1585153 - DNA, 15 bp, Homo sapiens
ctgagttgttctaac

SEQ ID NO: 1585154 - DNA, 20 bp, Homo sapiens
ctgagtttaccatttgtaat

SEQ ID NO: 1585155 - DNA, 22 bp, Homo sapiens
ctgagtttaccatttgtaataa

SEQ ID NO: 1585156 - DNA, 20 bp, Homo sapiens
ctgagtttcctatgggaaca

SEQ ID NO: 1585157 - DNA, 14 bp, Homo sapiens
ctgagttttgtgtt

SEQ ID NO: 1585158 - DNA, 19 bp, Homo sapiens
ctgagttttgtgtttgttg

SEQ ID NO: 1585159 - DNA, 18 bp, Homo sapiens
ctgataaaagatggccat

SEQ ID NO: 1585160 - DNA, 15 bp, Homo sapiens
ctgataaacctaata

SEQ ID NO: 1585161 - DNA, 16 bp, Homo sapiens
ctgataaagcacagct

SEQ ID NO: 1585162 - DNA, 17 bp, Homo sapiens
ctgataacttggggagg

SEQ ID NO: 1585163 - DNA, 20 bp, Homo sapiens
ctgataacttggggaggcaa

SEQ ID NO: 1585164 - DNA, 18 bp, Homo sapiens
ctgatactttagccatca

SEQ ID NO: 1585165 - DNA, 20 bp, Homo sapiens
ctgatactttgacagtgttt

SEQ ID NO: 1585166 - DNA, 18 bp, Homo sapiens
ctgatagaatgatgtttt

SEQ ID NO: 1585167 - DNA, 17 bp, Homo sapiens
ctgatagcttacactga

SEQ ID NO: 1585168 - DNA, 20 bp, Homo sapiens
ctgatagcttacactgagga

SEQ ID NO: 1585169 - DNA, 14 bp, Homo sapiens
ctgatatactgtgt

SEQ ID NO: 1585170 - DNA, 22 bp, Homo sapiens
ctgatatatgtgtttttcacat

SEQ ID NO: 1585171 - DNA, 16 bp, Homo sapiens
ctgatatattttacaa

SEQ ID NO: 1585172 - DNA, 14 bp, Homo sapiens
ctgatatcaacagc

SEQ ID NO: 1585173 - DNA, 16 bp, Homo sapiens
ctgatatcaacagctt

SEQ ID NO: 1585174 - DNA, 18 bp, Homo sapiens
ctgatatcaacagcttcc

SEQ ID NO: 1585175 - DNA, 16 bp, Homo sapiens
ctgatatgatttaaaa

SEQ ID NO: 1585176 - DNA, 17 bp, Homo sapiens
ctgatattaatcaaaat

SEQ ID NO: 1585177 - DNA, 18 bp, Homo sapiens
ctgatattatttcttctc

SEQ ID NO: 1585178 - DNA, 20 bp, Homo sapiens
ctgatattatttcttctctt

SEQ ID NO: 1585179 - DNA, 21 bp, Homo sapiens
ctgatattatttcttctctta

SEQ ID NO: 1585180 - DNA, 17 bp, Homo sapiens
ctgatcaaaaataaact

SEQ ID NO: 1585181 - DNA, 23 bp, Homo sapiens
ctgatcaaaaataaactagtttc

SEQ ID NO: 1585182 - DNA, 21 bp, Homo sapiens
ctgatcacccaatgcatcacg

SEQ ID NO: 1585183 - DNA, 18 bp, Homo sapiens
ctgatcaggcttcctggt

SEQ ID NO: 1585184 - DNA, 13 bp, Homo sapiens
ctgatccagagca

SEQ ID NO: 1585185 - DNA, 17 bp, Homo sapiens
ctgatcccatggccagg

SEQ ID NO: 1585186 - DNA, 23 bp, Homo sapiens
ctgatccccaagacatgtggagg

SEQ ID NO: 1585187 - DNA, 11 bp, Homo sapiens
ctgatccctgc

SEQ ID NO: 1585188 - DNA, 14 bp, Homo sapiens
ctgatccctgctct

SEQ ID NO: 1585189 - DNA, 15 bp, Homo sapiens
ctgatccctgctctc

SEQ ID NO: 1585190 - DNA, 19 bp, Homo sapiens
ctgatccctgctctctgag

SEQ ID NO: 1585191 - DNA, 20 bp, Homo sapiens
ctgatccctgctctctgagt

SEQ ID NO: 1585192 - DNA, 21 bp, Homo sapiens
ctgatcctgctccagcagcac

SEQ ID NO: 1585193 - DNA, 12 bp, Homo sapiens
ctgatcctggag

SEQ ID NO: 1585194 - DNA, 15 bp, Homo sapiens
ctgatcctggaggcc

SEQ ID NO: 1585195 - DNA, 19 bp, Homo sapiens
ctgatcctggaggcccagt

SEQ ID NO: 1585196 - DNA, 19 bp, Homo sapiens
ctgatcgtgctaaattttc

SEQ ID NO: 1585197 - DNA, 14 bp, Homo sapiens
ctgatctaacaaaa

SEQ ID NO: 1585198 - DNA, 15 bp, Homo sapiens
ctgatctaacaaaat

SEQ ID NO: 1585199 - DNA, 21 bp, Homo sapiens
ctgatctcaagtatatgtcat

SEQ ID NO: 1585200 - DNA, 12 bp, Homo sapiens
ctgatctcaggg

SEQ ID NO: 1585201 - DNA, 22 bp, Homo sapiens
ctgatctcagggaagcccagct

SEQ ID NO: 1585202 - DNA, 23 bp, Homo sapiens
ctgatctcagggaagcccagctc

SEQ ID NO: 1585203 - DNA, 13 bp, Homo sapiens
ctgatctgcccat

SEQ ID NO: 1585204 - DNA, 12 bp, Homo sapiens
ctgatctgcgga

SEQ ID NO: 1585205 - DNA, 20 bp, Homo sapiens
ctgatctgcggatctcagct

SEQ ID NO: 1585206 - DNA, 13 bp, Homo sapiens
ctgatctgttata

SEQ ID NO: 1585207 - DNA, 16 bp, Homo sapiens
ctgatcttgcctgtct

SEQ ID NO: 1585208 - DNA, 14 bp, Homo sapiens
ctgatctttctaga

SEQ ID NO: 1585209 - DNA, 20 bp, Homo sapiens
ctgatgaaatctgctagaaa

SEQ ID NO: 1585210 - DNA, 23 bp, Homo sapiens
ctgatgaaatctgctagaaagtt

SEQ ID NO: 1585211 - DNA, 20 bp, Homo sapiens
ctgatgaacttattctgtag

SEQ ID NO: 1585212 - DNA, 13 bp, Homo sapiens
ctgatgacccagg

SEQ ID NO: 1585213 - DNA, 23 bp, Homo sapiens
ctgatgacccaggctgcctgagc

SEQ ID NO: 1585214 - DNA, 14 bp, Homo sapiens
ctgatgacttgctt

SEQ ID NO: 1585215 - DNA, 19 bp, Homo sapiens
ctgatgagtgattgacaca

SEQ ID NO: 1585216 - DNA, 21 bp, Homo sapiens
ctgatgagtgattgacacaca

SEQ ID NO: 1585217 - DNA, 20 bp, Homo sapiens
ctgatgagtttcactgtact

SEQ ID NO: 1585218 - DNA, 14 bp, Homo sapiens
ctgatgatatattc

SEQ ID NO: 1585219 - DNA, 14 bp, Homo sapiens
ctgatgatcaaaac

SEQ ID NO: 1585220 - DNA, 19 bp, Homo sapiens
ctgatgatcaaaacctgtg

SEQ ID NO: 1585221 - DNA, 14 bp, Homo sapiens
ctgatgatccagaa

SEQ ID NO: 1585222 - DNA, 21 bp, Homo sapiens
ctgatgatgtctcttgtagaa

SEQ ID NO: 1585223 - DNA, 22 bp, Homo sapiens
ctgatgatgtctcttgtagaag

SEQ ID NO: 1585224 - DNA, 15 bp, Homo sapiens
ctgatgattttcctt

SEQ ID NO: 1585225 - DNA, 17 bp, Homo sapiens
ctgatgattttcctttt

SEQ ID NO: 1585226 - DNA, 15 bp, Homo sapiens
ctgatgcagacacag

SEQ ID NO: 1585227 - DNA, 16 bp, Homo sapiens
ctgatgcagcctgtgg

SEQ ID NO: 1585228 - DNA, 20 bp, Homo sapiens
ctgatgcagcctgtggcttg

SEQ ID NO: 1585229 - DNA, 23 bp, Homo sapiens
ctgatgcatacggctatattggt

SEQ ID NO: 1585230 - DNA, 17 bp, Homo sapiens
ctgatgcctccttggcc

SEQ ID NO: 1585231 - DNA, 15 bp, Homo sapiens
ctgatgctccctccc

SEQ ID NO: 1585232 - DNA, 21 bp, Homo sapiens
ctgatgctccctcccctgccc

SEQ ID NO: 1585233 - DNA, 22 bp, Homo sapiens
ctgatgctccctcccctgccct

SEQ ID NO: 1585234 - DNA, 15 bp, Homo sapiens
ctgatgctgggcaat

SEQ ID NO: 1585235 - DNA, 22 bp, Homo sapiens
ctgatgctgggcaatgaggcag

SEQ ID NO: 1585236 - DNA, 15 bp, Homo sapiens
ctgatggaagatggt

SEQ ID NO: 1585237 - DNA, 21 bp, Homo sapiens
ctgatggaccgggtgggcctg

SEQ ID NO: 1585238 - DNA, 12 bp, Homo sapiens
ctgatggagccc

SEQ ID NO: 1585239 - DNA, 15 bp, Homo sapiens
ctgatggagccccac

SEQ ID NO: 1585240 - DNA, 16 bp, Homo sapiens
ctgatggagccccacc

SEQ ID NO: 1585241 - DNA, 17 bp, Homo sapiens
ctgatggaggaaaaagg

SEQ ID NO: 1585242 - DNA, 16 bp, Homo sapiens
ctgatggagtgtgcag

SEQ ID NO: 1585243 - DNA, 22 bp, Homo sapiens
ctgatggagtgtgcagacagcc

SEQ ID NO: 1585244 - DNA, 17 bp, Homo sapiens
ctgatggcacagaagga

SEQ ID NO: 1585245 - DNA, 14 bp, Homo sapiens
ctgatggcagctgg

SEQ ID NO: 1585246 - DNA, 17 bp, Homo sapiens
ctgatggccaagggggt

SEQ ID NO: 1585247 - DNA, 17 bp, Homo sapiens
ctgatggcccctccagc

SEQ ID NO: 1585248 - DNA, 21 bp, Homo sapiens
ctgatggccttaatttccttt

SEQ ID NO: 1585249 - DNA, 19 bp, Homo sapiens
ctgatggctgctagatttt

SEQ ID NO: 1585250 - DNA, 15 bp, Homo sapiens
ctgatggtgagctgg

SEQ ID NO: 1585251 - DNA, 16 bp, Homo sapiens
ctgatggtgagctggg

SEQ ID NO: 1585252 - DNA, 14 bp, Homo sapiens
ctgatgtcaaagtg

SEQ ID NO: 1585253 - DNA, 18 bp, Homo sapiens
ctgatgtcaatttctgtg

SEQ ID NO: 1585254 - DNA, 20 bp, Homo sapiens
ctgatgtcaatttctgtgtt

SEQ ID NO: 1585255 - DNA, 11 bp, Homo sapiens
ctgatgtcatc

SEQ ID NO: 1585256 - DNA, 13 bp, Homo sapiens
ctgatgtcatctt

SEQ ID NO: 1585257 - DNA, 14 bp, Homo sapiens
ctgatgtcatcttg

SEQ ID NO: 1585258 - DNA, 23 bp, Homo sapiens
ctgatgtcttaacgaataaaggt

SEQ ID NO: 1585259 - DNA, 15 bp, Homo sapiens
ctgatgtgatattct

SEQ ID NO: 1585260 - DNA, 15 bp, Homo sapiens
ctgatgtggactgtc

SEQ ID NO: 1585261 - DNA, 13 bp, Homo sapiens
ctgatgttcctag

SEQ ID NO: 1585262 - DNA, 21 bp, Homo sapiens
ctgatgttcctagtgaaagag

SEQ ID NO: 1585263 - DNA, 22 bp, Homo sapiens
ctgatgttcctttggaagaaaa

SEQ ID NO: 1585264 - DNA, 22 bp, Homo sapiens
ctgatgttgagggaacagacag

SEQ ID NO: 1585265 - DNA, 17 bp, Homo sapiens
ctgatgtttctgtgaaa

SEQ ID NO: 1585266 - DNA, 23 bp, Homo sapiens
ctgatgtttctgtgaaattctca

SEQ ID NO: 1585267 - DNA, 17 bp, Homo sapiens
ctgattaaatatttgaa

SEQ ID NO: 1585268 - DNA, 22 bp, Homo sapiens
ctgattaaatttaatatactgc

SEQ ID NO: 1585269 - DNA, 21 bp, Homo sapiens
ctgattaagttgtctaaacaa

SEQ ID NO: 1585270 - DNA, 13 bp, Homo sapiens
ctgattactgtca

SEQ ID NO: 1585271 - DNA, 22 bp, Homo sapiens
ctgattagtaagtcttgcctat

SEQ ID NO: 1585272 - DNA, 18 bp, Homo sapiens
ctgattatttatgacctg

SEQ ID NO: 1585273 - DNA, 16 bp, Homo sapiens
ctgattcaagaacaag

SEQ ID NO: 1585274 - DNA, 18 bp, Homo sapiens
ctgattcacctcttcctc

SEQ ID NO: 1585275 - DNA, 19 bp, Homo sapiens
ctgattcacctcttcctct

SEQ ID NO: 1585276 - DNA, 22 bp, Homo sapiens
ctgattcacctcttcctctggt

SEQ ID NO: 1585277 - DNA, 13 bp, Homo sapiens
ctgattcactgca

SEQ ID NO: 1585278 - DNA, 20 bp, Homo sapiens
ctgattcatagtaaaatacc

SEQ ID NO: 1585279 - DNA, 19 bp, Homo sapiens
ctgattctatgcctgtatt

SEQ ID NO: 1585280 - DNA, 21 bp, Homo sapiens
ctgattctatgcctgtatttc

SEQ ID NO: 1585281 - DNA, 15 bp, Homo sapiens
ctgattctggcttta

SEQ ID NO: 1585282 - DNA, 18 bp, Homo sapiens
ctgattctggctttaagc

SEQ ID NO: 1585283 - DNA, 19 bp, Homo sapiens
ctgattctggctttaagcc

SEQ ID NO: 1585284 - DNA, 16 bp, Homo sapiens
ctgattctgggatgct

SEQ ID NO: 1585285 - DNA, 13 bp, Homo sapiens
ctgattctgtggc

SEQ ID NO: 1585286 - DNA, 19 bp, Homo sapiens
ctgattcttgattcctggc

SEQ ID NO: 1585287 - DNA, 14 bp, Homo sapiens
ctgattggctgctt

SEQ ID NO: 1585288 - DNA, 16 bp, Homo sapiens
ctgattggctgcttaa

SEQ ID NO: 1585289 - DNA, 19 bp, Homo sapiens
ctgattgggaggtgcgtgt

SEQ ID NO: 1585290 - DNA, 15 bp, Homo sapiens
ctgattggtgattca

SEQ ID NO: 1585291 - DNA, 22 bp, Homo sapiens
ctgattgtgccagtgcactccg

SEQ ID NO: 1585292 - DNA, 14 bp, Homo sapiens
ctgattgtttacag

SEQ ID NO: 1585293 - DNA, 17 bp, Homo sapiens
ctgattgtttcattgcg

SEQ ID NO: 1585294 - DNA, 16 bp, Homo sapiens
ctgatttagatatgca

SEQ ID NO: 1585295 - DNA, 17 bp, Homo sapiens
ctgatttaggagaagcc

SEQ ID NO: 1585296 - DNA, 19 bp, Homo sapiens
ctgatttattgaaattttt

SEQ ID NO: 1585297 - DNA, 18 bp, Homo sapiens
ctgatttcagtttttcat

SEQ ID NO: 1585298 - DNA, 21 bp, Homo sapiens
ctgatttcagtttttcatttg

SEQ ID NO: 1585299 - DNA, 18 bp, Homo sapiens
ctgatttccaggcccctg

SEQ ID NO: 1585300 - DNA, 22 bp, Homo sapiens
ctgatttgcaataaaaatgata

SEQ ID NO: 1585301 - DNA, 14 bp, Homo sapiens
ctgatttggtactt

SEQ ID NO: 1585302 - DNA, 12 bp, Homo sapiens
ctgattttaatg

SEQ ID NO: 1585303 - DNA, 16 bp, Homo sapiens
ctgattttaatgaaat

SEQ ID NO: 1585304 - DNA, 17 bp, Homo sapiens
ctgattttattcttgat

SEQ ID NO: 1585305 - DNA, 21 bp, Homo sapiens
ctgattttcaaagctttttcc

SEQ ID NO: 1585306 - DNA, 15 bp, Homo sapiens
ctgattttctcactg

SEQ ID NO: 1585307 - DNA, 16 bp, Homo sapiens
ctgatttttctctttt

SEQ ID NO: 1585308 - DNA, 15 bp, Homo sapiens
ctgattttttttcct

SEQ ID NO: 1585309 - DNA, 19 bp, Homo sapiens
ctgattttttttcctttta

SEQ ID NO: 1585310 - DNA, 14 bp, Homo sapiens
ctgcaaaaagaaaa

SEQ ID NO: 1585311 - DNA, 12 bp, Homo sapiens
ctgcaaaaatga

SEQ ID NO: 1585312 - DNA, 13 bp, Homo sapiens
ctgcaaaaatgag

SEQ ID NO: 1585313 - DNA, 13 bp, Homo sapiens
ctgcaaaatttta

SEQ ID NO: 1585314 - DNA, 22 bp, Homo sapiens
ctgcaaacaccaacatgttggg

SEQ ID NO: 1585315 - DNA, 20 bp, Homo sapiens
ctgcaaacattgtacatcca

SEQ ID NO: 1585316 - DNA, 16 bp, Homo sapiens
ctgcaaactcactgct

SEQ ID NO: 1585317 - DNA, 20 bp, Homo sapiens
ctgcaaactcactgctcaag

SEQ ID NO: 1585318 - DNA, 19 bp, Homo sapiens
ctgcaaaggacagtgggca

SEQ ID NO: 1585319 - DNA, 15 bp, Homo sapiens
ctgcaaaggagaagc

SEQ ID NO: 1585320 - DNA, 16 bp, Homo sapiens
ctgcaaagtcgccagt

SEQ ID NO: 1585321 - DNA, 20 bp, Homo sapiens
ctgcaaataaggacagcagc

SEQ ID NO: 1585322 - DNA, 21 bp, Homo sapiens
ctgcaaataaggacagcagct

SEQ ID NO: 1585323 - DNA, 22 bp, Homo sapiens
ctgcaaataaggacagcagctg

SEQ ID NO: 1585324 - DNA, 23 bp, Homo sapiens
ctgcaaataaggacagcagctgg

SEQ ID NO: 1585325 - DNA, 18 bp, Homo sapiens
ctgcaaatcaggcttttg

SEQ ID NO: 1585326 - DNA, 20 bp, Homo sapiens
ctgcaaatcaggcttttgtt

SEQ ID NO: 1585327 - DNA, 20 bp, Homo sapiens
ctgcaaatctgatggcctta

SEQ ID NO: 1585328 - DNA, 22 bp, Homo sapiens
ctgcaaccaattgaaaagtgtt

SEQ ID NO: 1585329 - DNA, 23 bp, Homo sapiens
ctgcaacctcacctcccgggttc

SEQ ID NO: 1585330 - DNA, 15 bp, Homo sapiens
ctgcaacctctgcct

SEQ ID NO: 1585331 - DNA, 17 bp, Homo sapiens
ctgcaacggcttagact

SEQ ID NO: 1585332 - DNA, 18 bp, Homo sapiens
ctgcaactagccaaggct

SEQ ID NO: 1585333 - DNA, 19 bp, Homo sapiens
ctgcaacttccgcctcctg

SEQ ID NO: 1585334 - DNA, 16 bp, Homo sapiens
ctgcaacttccgctga

SEQ ID NO: 1585335 - DNA, 18 bp, Homo sapiens
ctgcaacttccgctgagg

SEQ ID NO: 1585336 - DNA, 13 bp, Homo sapiens
ctgcaagaccacg

SEQ ID NO: 1585337 - DNA, 19 bp, Homo sapiens
ctgcaagaccacggaggga

SEQ ID NO: 1585338 - DNA, 15 bp, Homo sapiens
ctgcaagagccaagt

SEQ ID NO: 1585339 - DNA, 13 bp, Homo sapiens
ctgcaagagcctt

SEQ ID NO: 1585340 - DNA, 18 bp, Homo sapiens
ctgcaagagccttggtgt

SEQ ID NO: 1585341 - DNA, 19 bp, Homo sapiens
ctgcaagagccttggtgtc

SEQ ID NO: 1585342 - DNA, 21 bp, Homo sapiens
ctgcaagagccttggtgtcca

SEQ ID NO: 1585343 - DNA, 20 bp, Homo sapiens
ctgcaagcacatctgcattt

SEQ ID NO: 1585344 - DNA, 20 bp, Homo sapiens
ctgcaagccccagggcctgg

SEQ ID NO: 1585345 - DNA, 21 bp, Homo sapiens
ctgcaagccccagggcctggg

SEQ ID NO: 1585346 - DNA, 22 bp, Homo sapiens
ctgcaagctctgcctcccgggt

SEQ ID NO: 1585347 - DNA, 14 bp, Homo sapiens
ctgcaagggcccag

SEQ ID NO: 1585348 - DNA, 15 bp, Homo sapiens
ctgcaagggcccaga

SEQ ID NO: 1585349 - DNA, 17 bp, Homo sapiens
ctgcaaggtactctggt

SEQ ID NO: 1585350 - DNA, 21 bp, Homo sapiens
ctgcaaggtggcctctgcctg

SEQ ID NO: 1585351 - DNA, 23 bp, Homo sapiens
ctgcaaggtggcctctgcctggg

SEQ ID NO: 1585352 - DNA, 15 bp, Homo sapiens
ctgcaatagagactg

SEQ ID NO: 1585353 - DNA, 12 bp, Homo sapiens
ctgcaatatttg

SEQ ID NO: 1585354 - DNA, 19 bp, Homo sapiens
ctgcaatatttgaatttta

SEQ ID NO: 1585355 - DNA, 15 bp, Homo sapiens
ctgcaatcctgtctt

SEQ ID NO: 1585356 - DNA, 13 bp, Homo sapiens
ctgcaatgaaagg

SEQ ID NO: 1585357 - DNA, 14 bp, Homo sapiens
ctgcaatgccctca

SEQ ID NO: 1585358 - DNA, 22 bp, Homo sapiens
ctgcaattcaaaagttccaaga

SEQ ID NO: 1585359 - DNA, 20 bp, Homo sapiens
ctgcaattcccctctgctgc

SEQ ID NO: 1585360 - DNA, 19 bp, Homo sapiens
ctgcaattctacagtttct

SEQ ID NO: 1585361 - DNA, 20 bp, Homo sapiens
ctgcaattgcagctcactgc

SEQ ID NO: 1585362 - DNA, 15 bp, Homo sapiens
ctgcacaagccaggg

SEQ ID NO: 1585363 - DNA, 14 bp, Homo sapiens
ctgcacacacagct

SEQ ID NO: 1585364 - DNA, 16 bp, Homo sapiens
ctgcacacacctgcct

SEQ ID NO: 1585365 - DNA, 20 bp, Homo sapiens
ctgcacacacctgcctgcag

SEQ ID NO: 1585366 - DNA, 20 bp, Homo sapiens
ctgcacacagaatgctcagg

SEQ ID NO: 1585367 - DNA, 16 bp, Homo sapiens
ctgcacacaggacagc

SEQ ID NO: 1585368 - DNA, 15 bp, Homo sapiens
ctgcacacagtgact

SEQ ID NO: 1585369 - DNA, 22 bp, Homo sapiens
ctgcacagatatttccatttct

SEQ ID NO: 1585370 - DNA, 12 bp, Homo sapiens
ctgcacagatgg

SEQ ID NO: 1585371 - DNA, 13 bp, Homo sapiens
ctgcacagatgga

SEQ ID NO: 1585372 - DNA, 20 bp, Homo sapiens
ctgcacagatggatttgcct

SEQ ID NO: 1585373 - DNA, 19 bp, Homo sapiens
ctgcacagcatttgctttc

SEQ ID NO: 1585374 - DNA, 18 bp, Homo sapiens
ctgcacaggccctgggga

SEQ ID NO: 1585375 - DNA, 18 bp, Homo sapiens
ctgcacagtcagaaggac

SEQ ID NO: 1585376 - DNA, 22 bp, Homo sapiens
ctgcacagtcagaaggacggca

SEQ ID NO: 1585377 - DNA, 23 bp, Homo sapiens
ctgcacagtcagaaggacggcag

SEQ ID NO: 1585378 - DNA, 20 bp, Homo sapiens
ctgcacagtgacttctgaga

SEQ ID NO: 1585379 - DNA, 18 bp, Homo sapiens
ctgcacagtgcatctcag

SEQ ID NO: 1585380 - DNA, 21 bp, Homo sapiens
ctgcacagtgcatctcagccc

SEQ ID NO: 1585381 - DNA, 17 bp, Homo sapiens
ctgcacagtggcacaaa

SEQ ID NO: 1585382 - DNA, 12 bp, Homo sapiens
ctgcacattcct

SEQ ID NO: 1585383 - DNA, 18 bp, Homo sapiens
ctgcacattcctggcccc

SEQ ID NO: 1585384 - DNA, 21 bp, Homo sapiens
ctgcacattcctggccccggg

SEQ ID NO: 1585385 - DNA, 15 bp, Homo sapiens
ctgcacattgcctgt

SEQ ID NO: 1585386 - DNA, 20 bp, Homo sapiens
ctgcacattgcctgttctgc

SEQ ID NO: 1585387 - DNA, 23 bp, Homo sapiens
ctgcacattgcctgttctgcttc

SEQ ID NO: 1585388 - DNA, 18 bp, Homo sapiens
ctgcaccagcgcccccag

SEQ ID NO: 1585389 - DNA, 11 bp, Homo sapiens
ctgcaccagga

SEQ ID NO: 1585390 - DNA, 13 bp, Homo sapiens
ctgcaccaggaga

SEQ ID NO: 1585391 - DNA, 20 bp, Homo sapiens
ctgcaccatgctgctgggga

SEQ ID NO: 1585392 - DNA, 16 bp, Homo sapiens
ctgcacccacccctgc

SEQ ID NO: 1585393 - DNA, 18 bp, Homo sapiens
ctgcacccacccctgccc

SEQ ID NO: 1585394 - DNA, 16 bp, Homo sapiens
ctgcaccccagcattc

SEQ ID NO: 1585395 - DNA, 21 bp, Homo sapiens
ctgcaccccagcattccagct

SEQ ID NO: 1585396 - DNA, 19 bp, Homo sapiens
ctgcaccccttctctcctc

SEQ ID NO: 1585397 - DNA, 20 bp, Homo sapiens
ctgcaccccttctctcctcc

SEQ ID NO: 1585398 - DNA, 21 bp, Homo sapiens
ctgcaccccttctctcctccc

SEQ ID NO: 1585399 - DNA, 16 bp, Homo sapiens
ctgcaccctgcgcctc

SEQ ID NO: 1585400 - DNA, 22 bp, Homo sapiens
ctgcaccctgcgcctccagagg

SEQ ID NO: 1585401 - DNA, 12 bp, Homo sapiens
ctgcaccctgga

SEQ ID NO: 1585402 - DNA, 23 bp, Homo sapiens
ctgcaccctggggcctggacctg

SEQ ID NO: 1585403 - DNA, 17 bp, Homo sapiens
ctgcacctctggctaga

SEQ ID NO: 1585404 - DNA, 21 bp, Homo sapiens
ctgcacctgattagttgaaag

SEQ ID NO: 1585405 - DNA, 18 bp, Homo sapiens
ctgcacctggcctgggcc

SEQ ID NO: 1585406 - DNA, 20 bp, Homo sapiens
ctgcacgaagtggctgatgg

SEQ ID NO: 1585407 - DNA, 16 bp, Homo sapiens
ctgcactaatttgatg

SEQ ID NO: 1585408 - DNA, 18 bp, Homo sapiens
ctgcactactcctctgca

SEQ ID NO: 1585409 - DNA, 20 bp, Homo sapiens
ctgcactactcctctgcagt

SEQ ID NO: 1585410 - DNA, 16 bp, Homo sapiens
ctgcactccatggcca

SEQ ID NO: 1585411 - DNA, 19 bp, Homo sapiens
ctgcactccatggccaccc

SEQ ID NO: 1585412 - DNA, 22 bp, Homo sapiens
ctgcactccatggccaccccgt

SEQ ID NO: 1585413 - DNA, 22 bp, Homo sapiens
ctgcactcccacctgacacacc

SEQ ID NO: 1585414 - DNA, 14 bp, Homo sapiens
ctgcactcctcagg

SEQ ID NO: 1585415 - DNA, 22 bp, Homo sapiens
ctgcactcctcagggcagcctc

SEQ ID NO: 1585416 - DNA, 12 bp, Homo sapiens
ctgcactgaaaa

SEQ ID NO: 1585417 - DNA, 18 bp, Homo sapiens
ctgcactgaaaaggttct

SEQ ID NO: 1585418 - DNA, 14 bp, Homo sapiens
ctgcactgagaggg

SEQ ID NO: 1585419 - DNA, 19 bp, Homo sapiens
ctgcactgatgctgcccct

SEQ ID NO: 1585420 - DNA, 16 bp, Homo sapiens
ctgcactggagtccag

SEQ ID NO: 1585421 - DNA, 14 bp, Homo sapiens
ctgcactgtaaaat

SEQ ID NO: 1585422 - DNA, 15 bp, Homo sapiens
ctgcactgtaaaatg

SEQ ID NO: 1585423 - DNA, 12 bp, Homo sapiens
ctgcactgtcaa

SEQ ID NO: 1585424 - DNA, 11 bp, Homo sapiens
ctgcactgtga

SEQ ID NO: 1585425 - DNA, 21 bp, Homo sapiens
ctgcactgtgtcatcttttca

SEQ ID NO: 1585426 - DNA, 16 bp, Homo sapiens
ctgcacttacttgctt

SEQ ID NO: 1585427 - DNA, 14 bp, Homo sapiens
ctgcacttcctgtt

SEQ ID NO: 1585428 - DNA, 19 bp, Homo sapiens
ctgcactttcccccttccc

SEQ ID NO: 1585429 - DNA, 20 bp, Homo sapiens
ctgcactttcccccttcccg

SEQ ID NO: 1585430 - DNA, 12 bp, Homo sapiens
ctgcagaaccca

SEQ ID NO: 1585431 - DNA, 20 bp, Homo sapiens
ctgcagaacccccaggtggc

SEQ ID NO: 1585432 - DNA, 23 bp, Homo sapiens
ctgcagaacgtattggtccagct

SEQ ID NO: 1585433 - DNA, 21 bp, Homo sapiens
ctgcagaagaagctggtgccc

SEQ ID NO: 1585434 - DNA, 23 bp, Homo sapiens
ctgcagaagccaagggaagacag

SEQ ID NO: 1585435 - DNA, 20 bp, Homo sapiens
ctgcagaaggaaagaagggg

SEQ ID NO: 1585436 - DNA, 22 bp, Homo sapiens
ctgcagaaggaaagaagggggc

SEQ ID NO: 1585437 - DNA, 14 bp, Homo sapiens
ctgcagacacgcct

SEQ ID NO: 1585438 - DNA, 18 bp, Homo sapiens
ctgcagacgtctgccttg

SEQ ID NO: 1585439 - DNA, 23 bp, Homo sapiens
ctgcagacgtctgccttggcatc

SEQ ID NO: 1585440 - DNA, 22 bp, Homo sapiens
ctgcagagaaacttaagcaaag

SEQ ID NO: 1585441 - DNA, 23 bp, Homo sapiens
ctgcagagaaacttaagcaaagg

SEQ ID NO: 1585442 - DNA, 17 bp, Homo sapiens
ctgcagagctgacccag

SEQ ID NO: 1585443 - DNA, 14 bp, Homo sapiens
ctgcagaggaccac

SEQ ID NO: 1585444 - DNA, 16 bp, Homo sapiens
ctgcagaggaccacag

SEQ ID NO: 1585445 - DNA, 21 bp, Homo sapiens
ctgcagaggaccacagtgggt

SEQ ID NO: 1585446 - DNA, 20 bp, Homo sapiens
ctgcagaggccagaggcccc

SEQ ID NO: 1585447 - DNA, 21 bp, Homo sapiens
ctgcagaggggaaagacttcc

SEQ ID NO: 1585448 - DNA, 19 bp, Homo sapiens
ctgcagaggggctttctgg

SEQ ID NO: 1585449 - DNA, 20 bp, Homo sapiens
ctgcagaggggctttctgga

SEQ ID NO: 1585450 - DNA, 17 bp, Homo sapiens
ctgcagaggtctgtgct

SEQ ID NO: 1585451 - DNA, 22 bp, Homo sapiens
ctgcagaggtctgtgctgaggc

SEQ ID NO: 1585452 - DNA, 18 bp, Homo sapiens
ctgcagagtctgccccac

SEQ ID NO: 1585453 - DNA, 17 bp, Homo sapiens
ctgcagagtttccaaaa

SEQ ID NO: 1585454 - DNA, 18 bp, Homo sapiens
ctgcagatagaaagcatt

SEQ ID NO: 1585455 - DNA, 16 bp, Homo sapiens
ctgcagatgccaccct

SEQ ID NO: 1585456 - DNA, 22 bp, Homo sapiens
ctgcagatgccaccctagccaa

SEQ ID NO: 1585457 - DNA, 20 bp, Homo sapiens
ctgcagattagttctttttg

SEQ ID NO: 1585458 - DNA, 24 bp, Homo sapiens
ctgcagattagttctttttgccag

SEQ ID NO: 1585459 - DNA, 20 bp, Homo sapiens
ctgcagcaaacactccaccc

SEQ ID NO: 1585460 - DNA, 13 bp, Homo sapiens
ctgcagcacatgc

SEQ ID NO: 1585461 - DNA, 15 bp, Homo sapiens
ctgcagcacctcacc

SEQ ID NO: 1585462 - DNA, 20 bp, Homo sapiens
ctgcagcacctccaggcctg

SEQ ID NO: 1585463 - DNA, 17 bp, Homo sapiens
ctgcagcaggtgctggg

SEQ ID NO: 1585464 - DNA, 18 bp, Homo sapiens
ctgcagcaggtgctgggc

SEQ ID NO: 1585465 - DNA, 19 bp, Homo sapiens
ctgcagcaggtgctgggct

SEQ ID NO: 1585466 - DNA, 19 bp, Homo sapiens
ctgcagcatgacctgtgac

SEQ ID NO: 1585467 - DNA, 18 bp, Homo sapiens
ctgcagcatgttgctgag

SEQ ID NO: 1585468 - DNA, 15 bp, Homo sapiens
ctgcagccagcccag

SEQ ID NO: 1585469 - DNA, 23 bp, Homo sapiens
ctgcagccagcccagcccagctg

SEQ ID NO: 1585470 - DNA, 22 bp, Homo sapiens
ctgcagccagctcacgtccagg

SEQ ID NO: 1585471 - DNA, 15 bp, Homo sapiens
ctgcagccctgccag

SEQ ID NO: 1585472 - DNA, 16 bp, Homo sapiens
ctgcagccgtggtcca

SEQ ID NO: 1585473 - DNA, 14 bp, Homo sapiens
ctgcagcctccgcc

SEQ ID NO: 1585474 - DNA, 13 bp, Homo sapiens
ctgcagcctcctc

SEQ ID NO: 1585475 - DNA, 17 bp, Homo sapiens
ctgcagcgcccggtgct

SEQ ID NO: 1585476 - DNA, 16 bp, Homo sapiens
ctgcagcggcaggacc

SEQ ID NO: 1585477 - DNA, 12 bp, Homo sapiens
ctgcagctgacc

SEQ ID NO: 1585478 - DNA, 13 bp, Homo sapiens
ctgcagctgacct

SEQ ID NO: 1585479 - DNA, 11 bp, Homo sapiens
ctgcagctgcc

SEQ ID NO: 1585480 - DNA, 12 bp, Homo sapiens
ctgcagctgccg

SEQ ID NO: 1585481 - DNA, 22 bp, Homo sapiens
ctgcagctgccgggcctgattt

SEQ ID NO: 1585482 - DNA, 15 bp, Homo sapiens
ctgcagctgctgaag

SEQ ID NO: 1585483 - DNA, 14 bp, Homo sapiens
ctgcagctgggccc

SEQ ID NO: 1585484 - DNA, 19 bp, Homo sapiens
ctgcagctgggccccatgc

SEQ ID NO: 1585485 - DNA, 21 bp, Homo sapiens
ctgcaggaacgagcactggcc

SEQ ID NO: 1585486 - DNA, 24 bp, Homo sapiens
ctgcaggaacgagcactggccaga

SEQ ID NO: 1585487 - DNA, 16 bp, Homo sapiens
ctgcaggagttaaaaa

SEQ ID NO: 1585488 - DNA, 14 bp, Homo sapiens
ctgcaggcaggaac

SEQ ID NO: 1585489 - DNA, 15 bp, Homo sapiens
ctgcaggcaggaaca

SEQ ID NO: 1585490 - DNA, 15 bp, Homo sapiens
ctgcaggccaagagc

SEQ ID NO: 1585491 - DNA, 20 bp, Homo sapiens
ctgcaggccactgtgagcgc

SEQ ID NO: 1585492 - DNA, 16 bp, Homo sapiens
ctgcaggccctggcct

SEQ ID NO: 1585493 - DNA, 19 bp, Homo sapiens
ctgcaggccctggcctccc

SEQ ID NO: 1585494 - DNA, 21 bp, Homo sapiens
ctgcaggccctggcctcccct

SEQ ID NO: 1585495 - DNA, 21 bp, Homo sapiens
ctgcaggcctgactactgccc

SEQ ID NO: 1585496 - DNA, 17 bp, Homo sapiens
ctgcaggctccatgcac

SEQ ID NO: 1585497 - DNA, 10 bp, Homo sapiens
ctgcaggctg

SEQ ID NO: 1585498 - DNA, 15 bp, Homo sapiens
ctgcaggctgcacct

SEQ ID NO: 1585499 - DNA, 23 bp, Homo sapiens
ctgcaggctgcacctctggctag

SEQ ID NO: 1585500 - DNA, 18 bp, Homo sapiens
ctgcaggctggagactgg

SEQ ID NO: 1585501 - DNA, 14 bp, Homo sapiens
ctgcaggctggctg

SEQ ID NO: 1585502 - DNA, 11 bp, Homo sapiens
ctgcagggcca

SEQ ID NO: 1585503 - DNA, 22 bp, Homo sapiens
ctgcagggccatctgactgcca

SEQ ID NO: 1585504 - DNA, 23 bp, Homo sapiens
ctgcagggccatctgactgccaa

SEQ ID NO: 1585505 - DNA, 19 bp, Homo sapiens
ctgcagggccatggctcag

SEQ ID NO: 1585506 - DNA, 20 bp, Homo sapiens
ctgcagggccatggctcagg

SEQ ID NO: 1585507 - DNA, 21 bp, Homo sapiens
ctgcagggccatggctcaggg

SEQ ID NO: 1585508 - DNA, 22 bp, Homo sapiens
ctgcagggccctcccttttccc

SEQ ID NO: 1585509 - DNA, 19 bp, Homo sapiens
ctgcagggccgcgagaggc

SEQ ID NO: 1585510 - DNA, 14 bp, Homo sapiens
ctgcagggctccca

SEQ ID NO: 1585511 - DNA, 16 bp, Homo sapiens
ctgcagggctcccatg

SEQ ID NO: 1585512 - DNA, 19 bp, Homo sapiens
ctgcagggctcccatgggc

SEQ ID NO: 1585513 - DNA, 12 bp, Homo sapiens
ctgcaggggagc

SEQ ID NO: 1585514 - DNA, 15 bp, Homo sapiens
ctgcaggggcctctg

SEQ ID NO: 1585515 - DNA, 23 bp, Homo sapiens
ctgcagggggtgtgtctgctcag

SEQ ID NO: 1585516 - DNA, 15 bp, Homo sapiens
ctgcaggtacttcct

SEQ ID NO: 1585517 - DNA, 15 bp, Homo sapiens
ctgcaggtcagttgt

SEQ ID NO: 1585518 - DNA, 19 bp, Homo sapiens
ctgcaggtcagttgtaata

SEQ ID NO: 1585519 - DNA, 21 bp, Homo sapiens
ctgcaggtcagttgtaataaa

SEQ ID NO: 1585520 - DNA, 21 bp, Homo sapiens
ctgcaggtcagtttggaatga

SEQ ID NO: 1585521 - DNA, 18 bp, Homo sapiens
ctgcaggtgagcaggcag

SEQ ID NO: 1585522 - DNA, 14 bp, Homo sapiens
ctgcagtcacagct

SEQ ID NO: 1585523 - DNA, 18 bp, Homo sapiens
ctgcagtcacattgatgt

SEQ ID NO: 1585524 - DNA, 12 bp, Homo sapiens
ctgcagtcctgg

SEQ ID NO: 1585525 - DNA, 19 bp, Homo sapiens
ctgcagtcggcatgccagg

SEQ ID NO: 1585526 - DNA, 20 bp, Homo sapiens
ctgcagtcggcatgccagga

SEQ ID NO: 1585527 - DNA, 16 bp, Homo sapiens
ctgcagtctcatttct

SEQ ID NO: 1585528 - DNA, 16 bp, Homo sapiens
ctgcagtgattcagca

SEQ ID NO: 1585529 - DNA, 17 bp, Homo sapiens
ctgcagtgattcagcag

SEQ ID NO: 1585530 - DNA, 16 bp, Homo sapiens
ctgcagtgccagctcc

SEQ ID NO: 1585531 - DNA, 16 bp, Homo sapiens
ctgcagtgcctggaaa

SEQ ID NO: 1585532 - DNA, 15 bp, Homo sapiens
ctgcagtgtgccccc

SEQ ID NO: 1585533 - DNA, 15 bp, Homo sapiens
ctgcagtttcctgga

SEQ ID NO: 1585534 - DNA, 17 bp, Homo sapiens
ctgcagtttggccctgg

SEQ ID NO: 1585535 - DNA, 23 bp, Homo sapiens
ctgcagtttggccctggagccag

SEQ ID NO: 1585536 - DNA, 21 bp, Homo sapiens
ctgcagttttgctatctgggc

SEQ ID NO: 1585537 - DNA, 14 bp, Homo sapiens
ctgcataatgtccc

SEQ ID NO: 1585538 - DNA, 14 bp, Homo sapiens
ctgcatacaatctg

SEQ ID NO: 1585539 - DNA, 21 bp, Homo sapiens
ctgcatactttgacaaggaaa

SEQ ID NO: 1585540 - DNA, 16 bp, Homo sapiens
ctgcatagctctattt

SEQ ID NO: 1585541 - DNA, 19 bp, Homo sapiens
ctgcatagctctattttaa

SEQ ID NO: 1585542 - DNA, 15 bp, Homo sapiens
ctgcatatgaaagga

SEQ ID NO: 1585543 - DNA, 22 bp, Homo sapiens
ctgcatatttgtgccgtaatta

SEQ ID NO: 1585544 - DNA, 12 bp, Homo sapiens
ctgcatcactca

SEQ ID NO: 1585545 - DNA, 15 bp, Homo sapiens
ctgcatcactcatgg

SEQ ID NO: 1585546 - DNA, 20 bp, Homo sapiens
ctgcatcagctgctgaaaca

SEQ ID NO: 1585547 - DNA, 23 bp, Homo sapiens
ctgcatcccgatacctcagccct

SEQ ID NO: 1585548 - DNA, 13 bp, Homo sapiens
ctgcatccctgtg

SEQ ID NO: 1585549 - DNA, 23 bp, Homo sapiens
ctgcatccctgtgtccactgaga

SEQ ID NO: 1585550 - DNA, 19 bp, Homo sapiens
ctgcatccgtagttccctg

SEQ ID NO: 1585551 - DNA, 21 bp, Homo sapiens
ctgcatccgtagttccctgaa

SEQ ID NO: 1585552 - DNA, 17 bp, Homo sapiens
ctgcatcctccaagaat

SEQ ID NO: 1585553 - DNA, 23 bp, Homo sapiens
ctgcatcctccaagaatctatct

SEQ ID NO: 1585554 - DNA, 15 bp, Homo sapiens
ctgcatccttcctgg

SEQ ID NO: 1585555 - DNA, 17 bp, Homo sapiens
ctgcatccttcctgggg

SEQ ID NO: 1585556 - DNA, 22 bp, Homo sapiens
ctgcatctattctttgtaccat

SEQ ID NO: 1585557 - DNA, 18 bp, Homo sapiens
ctgcatcttggttatttc

SEQ ID NO: 1585558 - DNA, 22 bp, Homo sapiens
ctgcatgaccaaagtgataaat

SEQ ID NO: 1585559 - DNA, 21 bp, Homo sapiens
ctgcatgagctggcaaccagc

SEQ ID NO: 1585560 - DNA, 12 bp, Homo sapiens
ctgcatgctctg

SEQ ID NO: 1585561 - DNA, 13 bp, Homo sapiens
ctgcatgctctgg

SEQ ID NO: 1585562 - DNA, 18 bp, Homo sapiens
ctgcatgctctggaagcc

SEQ ID NO: 1585563 - DNA, 21 bp, Homo sapiens
ctgcatgctctggaagcctgg

SEQ ID NO: 1585564 - DNA, 18 bp, Homo sapiens
ctgcatggacctaacatt

SEQ ID NO: 1585565 - DNA, 13 bp, Homo sapiens
ctgcatggagaag

SEQ ID NO: 1585566 - DNA, 15 bp, Homo sapiens
ctgcatggattcagc

SEQ ID NO: 1585567 - DNA, 15 bp, Homo sapiens
ctgcatggcttctga

SEQ ID NO: 1585568 - DNA, 17 bp, Homo sapiens
ctgcatggcttctgaaa

SEQ ID NO: 1585569 - DNA, 20 bp, Homo sapiens
ctgcatggcttctgaaagca

SEQ ID NO: 1585570 - DNA, 12 bp, Homo sapiens
ctgcatggggag

SEQ ID NO: 1585571 - DNA, 14 bp, Homo sapiens
ctgcatggggaggc

SEQ ID NO: 1585572 - DNA, 22 bp, Homo sapiens
ctgcatggggaggcagcagagc

SEQ ID NO: 1585573 - DNA, 22 bp, Homo sapiens
ctgcatgtgacttctcccctgc

SEQ ID NO: 1585574 - DNA, 22 bp, Homo sapiens
ctgcatgtgtcatgaagaatgt

SEQ ID NO: 1585575 - DNA, 21 bp, Homo sapiens
ctgcattcacccagacagctc

SEQ ID NO: 1585576 - DNA, 12 bp, Homo sapiens
ctgcattccgca

SEQ ID NO: 1585577 - DNA, 21 bp, Homo sapiens
ctgcattctctcccatcctgg

SEQ ID NO: 1585578 - DNA, 14 bp, Homo sapiens
ctgcattcttaaca

SEQ ID NO: 1585579 - DNA, 17 bp, Homo sapiens
ctgcattgagaactgca

SEQ ID NO: 1585580 - DNA, 18 bp, Homo sapiens
ctgcattgctagataaaa

SEQ ID NO: 1585581 - DNA, 19 bp, Homo sapiens
ctgcattgctagataaaag

SEQ ID NO: 1585582 - DNA, 13 bp, Homo sapiens
ctgcattggcctg

SEQ ID NO: 1585583 - DNA, 19 bp, Homo sapiens
ctgcattggcctggcctcc

SEQ ID NO: 1585584 - DNA, 20 bp, Homo sapiens
ctgcattggcctggcctcca

SEQ ID NO: 1585585 - DNA, 22 bp, Homo sapiens
ctgcattggcctggcctccagc

SEQ ID NO: 1585586 - DNA, 18 bp, Homo sapiens
ctgcatttaaatttgatt

SEQ ID NO: 1585587 - DNA, 17 bp, Homo sapiens
ctgcatttcacatgcct

SEQ ID NO: 1585588 - DNA, 18 bp, Homo sapiens
ctgcatttcacatgcctt

SEQ ID NO: 1585589 - DNA, 21 bp, Homo sapiens
ctgcattttaacaagcacccc

SEQ ID NO: 1585590 - DNA, 20 bp, Homo sapiens
ctgcattttaattttaacca

SEQ ID NO: 1585591 - DNA, 22 bp, Homo sapiens
ctgcattttaattttaaccaaa

SEQ ID NO: 1585592 - DNA, 23 bp, Homo sapiens
ctgccaaccataccttccttccc

SEQ ID NO: 1585593 - DNA, 19 bp, Homo sapiens
ctgccaactgatctgttat

SEQ ID NO: 1585594 - DNA, 17 bp, Homo sapiens
ctgccaagccagattct

SEQ ID NO: 1585595 - DNA, 21 bp, Homo sapiens
ctgccaaggtggagggaagga

SEQ ID NO: 1585596 - DNA, 12 bp, Homo sapiens
ctgccacacagg

SEQ ID NO: 1585597 - DNA, 17 bp, Homo sapiens
ctgccacaccctcccca

SEQ ID NO: 1585598 - DNA, 23 bp, Homo sapiens
ctgccacactcagtcccccacca

SEQ ID NO: 1585599 - DNA, 17 bp, Homo sapiens
ctgccacactgatggct

SEQ ID NO: 1585600 - DNA, 14 bp, Homo sapiens
ctgccacatggagc

SEQ ID NO: 1585601 - DNA, 19 bp, Homo sapiens
ctgccaccacgtctgccag

SEQ ID NO: 1585602 - DNA, 21 bp, Homo sapiens
ctgccaccacgtctgccaggc

SEQ ID NO: 1585603 - DNA, 22 bp, Homo sapiens
ctgccaccacgtctgccaggcc

SEQ ID NO: 1585604 - DNA, 23 bp, Homo sapiens
ctgccaccacgtctgccaggccc

SEQ ID NO: 1585605 - DNA, 14 bp, Homo sapiens
ctgccaccaggcca

SEQ ID NO: 1585606 - DNA, 15 bp, Homo sapiens
ctgccaccaggccac

SEQ ID NO: 1585607 - DNA, 22 bp, Homo sapiens
ctgccacccccttccctgggag

SEQ ID NO: 1585608 - DNA, 13 bp, Homo sapiens
ctgccaccccttc

SEQ ID NO: 1585609 - DNA, 14 bp, Homo sapiens
ctgccaccccttcc

SEQ ID NO: 1585610 - DNA, 20 bp, Homo sapiens
ctgccaccccttcctcccca

SEQ ID NO: 1585611 - DNA, 15 bp, Homo sapiens
ctgccaccctacctg

SEQ ID NO: 1585612 - DNA, 13 bp, Homo sapiens
ctgccacctcccc

SEQ ID NO: 1585613 - DNA, 13 bp, Homo sapiens
ctgccacctccct

SEQ ID NO: 1585614 - DNA, 15 bp, Homo sapiens
ctgccacctccctga

SEQ ID NO: 1585615 - DNA, 16 bp, Homo sapiens
ctgccacctccctgac

SEQ ID NO: 1585616 - DNA, 16 bp, Homo sapiens
ctgccactctctggga

SEQ ID NO: 1585617 - DNA, 20 bp, Homo sapiens
ctgccactctctgggactct

SEQ ID NO: 1585618 - DNA, 23 bp, Homo sapiens
ctgccactctctgggactctcct

SEQ ID NO: 1585619 - DNA, 20 bp, Homo sapiens
ctgccactgactgcagggac

SEQ ID NO: 1585620 - DNA, 21 bp, Homo sapiens
ctgccactgactgcagggaca

SEQ ID NO: 1585621 - DNA, 15 bp, Homo sapiens
ctgccactgaggaga

SEQ ID NO: 1585622 - DNA, 16 bp, Homo sapiens
ctgccactgaggagac

SEQ ID NO: 1585623 - DNA, 21 bp, Homo sapiens
ctgccacttcaacccccagct

SEQ ID NO: 1585624 - DNA, 21 bp, Homo sapiens
ctgccactttcacgtggcctc

SEQ ID NO: 1585625 - DNA, 14 bp, Homo sapiens
ctgccagcacagag

SEQ ID NO: 1585626 - DNA, 13 bp, Homo sapiens
ctgccagcacagt

SEQ ID NO: 1585627 - DNA, 15 bp, Homo sapiens
ctgccagcagcagca

SEQ ID NO: 1585628 - DNA, 19 bp, Homo sapiens
ctgccagcagcagcaggtg

SEQ ID NO: 1585629 - DNA, 21 bp, Homo sapiens
ctgccagcagcagcaggtgat

SEQ ID NO: 1585630 - DNA, 15 bp, Homo sapiens
ctgccagccagcagc

SEQ ID NO: 1585631 - DNA, 19 bp, Homo sapiens
ctgccagccagcagccagc

SEQ ID NO: 1585632 - DNA, 12 bp, Homo sapiens
ctgccagcctgg

SEQ ID NO: 1585633 - DNA, 13 bp, Homo sapiens
ctgccagcctggc

SEQ ID NO: 1585634 - DNA, 14 bp, Homo sapiens
ctgccagcctggct

SEQ ID NO: 1585635 - DNA, 20 bp, Homo sapiens
ctgccagcctggcttctgga

SEQ ID NO: 1585636 - DNA, 21 bp, Homo sapiens
ctgccagccttgagccctggc

SEQ ID NO: 1585637 - DNA, 22 bp, Homo sapiens
ctgccagccttgagccctggct

SEQ ID NO: 1585638 - DNA, 14 bp, Homo sapiens
ctgccagcgtctgt

SEQ ID NO: 1585639 - DNA, 12 bp, Homo sapiens
ctgccagctgca

SEQ ID NO: 1585640 - DNA, 12 bp, Homo sapiens
ctgccagctgcc

SEQ ID NO: 1585641 - DNA, 14 bp, Homo sapiens
ctgccagctgcctt

SEQ ID NO: 1585642 - DNA, 16 bp, Homo sapiens
ctgccagctgccttcc

SEQ ID NO: 1585643 - DNA, 22 bp, Homo sapiens
ctgccaggcacctggcctgctg

SEQ ID NO: 1585644 - DNA, 23 bp, Homo sapiens
ctgccaggcacctggcctgctgg

SEQ ID NO: 1585645 - DNA, 23 bp, Homo sapiens
ctgccaggcactgttcatctcag

SEQ ID NO: 1585646 - DNA, 13 bp, Homo sapiens
ctgccaggcaggg

SEQ ID NO: 1585647 - DNA, 15 bp, Homo sapiens
ctgccaggccagcct

SEQ ID NO: 1585648 - DNA, 17 bp, Homo sapiens
ctgccaggccagcctcc

SEQ ID NO: 1585649 - DNA, 13 bp, Homo sapiens
ctgccaggcccat

SEQ ID NO: 1585650 - DNA, 16 bp, Homo sapiens
ctgccaggcccatctc

SEQ ID NO: 1585651 - DNA, 14 bp, Homo sapiens
ctgccaggcgttgg

SEQ ID NO: 1585652 - DNA, 14 bp, Homo sapiens
ctgccaggctgcct

SEQ ID NO: 1585653 - DNA, 19 bp, Homo sapiens
ctgccaggggttcttgagc

SEQ ID NO: 1585654 - DNA, 12 bp, Homo sapiens
ctgccagtgaca

SEQ ID NO: 1585655 - DNA, 16 bp, Homo sapiens
ctgccagtgacagaca

SEQ ID NO: 1585656 - DNA, 23 bp, Homo sapiens
ctgccagtgacagacaggctctt

SEQ ID NO: 1585657 - DNA, 17 bp, Homo sapiens
ctgccagtgcagccact

SEQ ID NO: 1585658 - DNA, 19 bp, Homo sapiens
ctgccagtgcagccactgg

SEQ ID NO: 1585659 - DNA, 12 bp, Homo sapiens
ctgccagtgcct

SEQ ID NO: 1585660 - DNA, 13 bp, Homo sapiens
ctgccagtgcctt

SEQ ID NO: 1585661 - DNA, 14 bp, Homo sapiens
ctgccagtgcctta

SEQ ID NO: 1585662 - DNA, 21 bp, Homo sapiens
ctgccagtgccttacctcctg

SEQ ID NO: 1585663 - DNA, 22 bp, Homo sapiens
ctgccagtgccttacctcctgc

SEQ ID NO: 1585664 - DNA, 23 bp, Homo sapiens
ctgccagtgccttacctcctgcc

SEQ ID NO: 1585665 - DNA, 16 bp, Homo sapiens
ctgccatattgtgtaa

SEQ ID NO: 1585666 - DNA, 22 bp, Homo sapiens
ctgccatcatgtttacagagga

SEQ ID NO: 1585667 - DNA, 15 bp, Homo sapiens
ctgccatcctcccaa

SEQ ID NO: 1585668 - DNA, 15 bp, Homo sapiens
ctgccatccttgctg

SEQ ID NO: 1585669 - DNA, 20 bp, Homo sapiens
ctgccatctagccagcccct

SEQ ID NO: 1585670 - DNA, 23 bp, Homo sapiens
ctgccatcttagtttggattctt

SEQ ID NO: 1585671 - DNA, 17 bp, Homo sapiens
ctgccatcttctccccg

SEQ ID NO: 1585672 - DNA, 16 bp, Homo sapiens
ctgccatgatagctgg

SEQ ID NO: 1585673 - DNA, 15 bp, Homo sapiens
ctgccatgccactgc

SEQ ID NO: 1585674 - DNA, 24 bp, Homo sapiens
ctgccatgccactgccaggcacct

SEQ ID NO: 1585675 - DNA, 18 bp, Homo sapiens
ctgccatgccaggaacct

SEQ ID NO: 1585676 - DNA, 14 bp, Homo sapiens
ctgccatggcgtgt

SEQ ID NO: 1585677 - DNA, 22 bp, Homo sapiens
ctgccatgtaaggttgtgcagg

SEQ ID NO: 1585678 - DNA, 23 bp, Homo sapiens
ctgccatgtttagtgaatgactt

SEQ ID NO: 1585679 - DNA, 22 bp, Homo sapiens
ctgccattacagaggtattaaa

SEQ ID NO: 1585680 - DNA, 16 bp, Homo sapiens
ctgccattacccagtg

SEQ ID NO: 1585681 - DNA, 17 bp, Homo sapiens
ctgccattcacttcata

SEQ ID NO: 1585682 - DNA, 16 bp, Homo sapiens
ctgccattcttctggt

SEQ ID NO: 1585683 - DNA, 17 bp, Homo sapiens
ctgccattcttctggtg

SEQ ID NO: 1585684 - DNA, 21 bp, Homo sapiens
ctgccatttcccttctggaca

SEQ ID NO: 1585685 - DNA, 17 bp, Homo sapiens
ctgcccaacccttccct

SEQ ID NO: 1585686 - DNA, 22 bp, Homo sapiens
ctgcccaatgctttgggaggcc

SEQ ID NO: 1585687 - DNA, 15 bp, Homo sapiens
ctgcccaccccctca

SEQ ID NO: 1585688 - DNA, 19 bp, Homo sapiens
ctgcccacttagccgtcca

SEQ ID NO: 1585689 - DNA, 13 bp, Homo sapiens
ctgcccagacaca

SEQ ID NO: 1585690 - DNA, 14 bp, Homo sapiens
ctgcccagacacat

SEQ ID NO: 1585691 - DNA, 17 bp, Homo sapiens
ctgcccagacacatggg

SEQ ID NO: 1585692 - DNA, 23 bp, Homo sapiens
ctgcccagacacatgggcttgtg

SEQ ID NO: 1585693 - DNA, 23 bp, Homo sapiens
ctgcccagacccctctggccagg

SEQ ID NO: 1585694 - DNA, 23 bp, Homo sapiens
ctgcccagcccatttgggctctg

SEQ ID NO: 1585695 - DNA, 15 bp, Homo sapiens
ctgcccagccgggca

SEQ ID NO: 1585696 - DNA, 16 bp, Homo sapiens
ctgcccagccgggcac

SEQ ID NO: 1585697 - DNA, 15 bp, Homo sapiens
ctgcccagcttgggc

SEQ ID NO: 1585698 - DNA, 16 bp, Homo sapiens
ctgcccagcttgggcc

SEQ ID NO: 1585699 - DNA, 23 bp, Homo sapiens
ctgcccagcttgggcccagctgg

SEQ ID NO: 1585700 - DNA, 12 bp, Homo sapiens
ctgcccaggaga

SEQ ID NO: 1585701 - DNA, 13 bp, Homo sapiens
ctgcccaggagac

SEQ ID NO: 1585702 - DNA, 22 bp, Homo sapiens
ctgcccaggagagccagccctc

SEQ ID NO: 1585703 - DNA, 14 bp, Homo sapiens
ctgcccaggggtgc

SEQ ID NO: 1585704 - DNA, 17 bp, Homo sapiens
ctgcccaggggtgcccc

SEQ ID NO: 1585705 - DNA, 19 bp, Homo sapiens
ctgcccagtcgaccccaaa

SEQ ID NO: 1585706 - DNA, 11 bp, Homo sapiens
ctgcccagtgt

SEQ ID NO: 1585707 - DNA, 20 bp, Homo sapiens
ctgcccagtgttgtttgtaa

SEQ ID NO: 1585708 - DNA, 23 bp, Homo sapiens
ctgcccagtgttgtttgtaaata

SEQ ID NO: 1585709 - DNA, 15 bp, Homo sapiens
ctgcccatcacaggg

SEQ ID NO: 1585710 - DNA, 18 bp, Homo sapiens
ctgcccatcacagggttg

SEQ ID NO: 1585711 - DNA, 22 bp, Homo sapiens
ctgcccatcacagggttgggcc

SEQ ID NO: 1585712 - DNA, 18 bp, Homo sapiens
ctgcccatcatgtggccc

SEQ ID NO: 1585713 - DNA, 13 bp, Homo sapiens
ctgcccatcccag

SEQ ID NO: 1585714 - DNA, 22 bp, Homo sapiens
ctgcccatcgtgaagaagcctg

SEQ ID NO: 1585715 - DNA, 19 bp, Homo sapiens
ctgcccatgagcaagccta

SEQ ID NO: 1585716 - DNA, 20 bp, Homo sapiens
ctgcccatgagcaagcctag

SEQ ID NO: 1585717 - DNA, 17 bp, Homo sapiens
ctgccccaacctgctga

SEQ ID NO: 1585718 - DNA, 18 bp, Homo sapiens
ctgccccaactcctggaa

SEQ ID NO: 1585719 - DNA, 20 bp, Homo sapiens
ctgccccaagcagccagcca

SEQ ID NO: 1585720 - DNA, 19 bp, Homo sapiens
ctgccccaagggcccagac

SEQ ID NO: 1585721 - DNA, 20 bp, Homo sapiens
ctgccccaagggcccagacc

SEQ ID NO: 1585722 - DNA, 22 bp, Homo sapiens
ctgccccaccccatccagccag

SEQ ID NO: 1585723 - DNA, 23 bp, Homo sapiens
ctgccccaccccatccagccaga

SEQ ID NO: 1585724 - DNA, 14 bp, Homo sapiens
ctgccccacctgcc

SEQ ID NO: 1585725 - DNA, 12 bp, Homo sapiens
ctgccccagagg

SEQ ID NO: 1585726 - DNA, 13 bp, Homo sapiens
ctgccccagaggt

SEQ ID NO: 1585727 - DNA, 14 bp, Homo sapiens
ctgccccagagtgg

SEQ ID NO: 1585728 - DNA, 19 bp, Homo sapiens
ctgccccagagtgggtctt

SEQ ID NO: 1585729 - DNA, 15 bp, Homo sapiens
ctgccccagcccaga

SEQ ID NO: 1585730 - DNA, 18 bp, Homo sapiens
ctgccccagctctggctt

SEQ ID NO: 1585731 - DNA, 22 bp, Homo sapiens
ctgccccaggccggagcccaga

SEQ ID NO: 1585732 - DNA, 14 bp, Homo sapiens
ctgccccaggcctg

SEQ ID NO: 1585733 - DNA, 18 bp, Homo sapiens
ctgccccagtagtcagaa

SEQ ID NO: 1585734 - DNA, 19 bp, Homo sapiens
ctgccccagtagtcagaag

SEQ ID NO: 1585735 - DNA, 17 bp, Homo sapiens
ctgcccccaggactggg

SEQ ID NO: 1585736 - DNA, 23 bp, Homo sapiens
ctgccccccaaggttctggttcc

SEQ ID NO: 1585737 - DNA, 12 bp, Homo sapiens
ctgccccccagc

SEQ ID NO: 1585738 - DNA, 13 bp, Homo sapiens
ctgccccccgagg

SEQ ID NO: 1585739 - DNA, 18 bp, Homo sapiens
ctgccccccgaggctgct

SEQ ID NO: 1585740 - DNA, 19 bp, Homo sapiens
ctgccccccgaggctgcta

SEQ ID NO: 1585741 - DNA, 13 bp, Homo sapiens
ctgcccccgctga

SEQ ID NO: 1585742 - DNA, 19 bp, Homo sapiens
ctgcccccgttccagctga

SEQ ID NO: 1585743 - DNA, 20 bp, Homo sapiens
ctgcccccgttccagctgac

SEQ ID NO: 1585744 - DNA, 21 bp, Homo sapiens
ctgcccccgttccagctgaca

SEQ ID NO: 1585745 - DNA, 12 bp, Homo sapiens
ctgccccctccc

SEQ ID NO: 1585746 - DNA, 22 bp, Homo sapiens
ctgccccctctttgtagctcct

SEQ ID NO: 1585747 - DNA, 13 bp, Homo sapiens
ctgccccctgctg

SEQ ID NO: 1585748 - DNA, 22 bp, Homo sapiens
ctgccccctggtggacagtcct

SEQ ID NO: 1585749 - DNA, 15 bp, Homo sapiens
ctgccccgcccagct

SEQ ID NO: 1585750 - DNA, 16 bp, Homo sapiens
ctgccccgcccagctg

SEQ ID NO: 1585751 - DNA, 17 bp, Homo sapiens
ctgccccgcccagctgc

SEQ ID NO: 1585752 - DNA, 14 bp, Homo sapiens
ctgccccgccccca

SEQ ID NO: 1585753 - DNA, 17 bp, Homo sapiens
ctgccccgcccccagtc

SEQ ID NO: 1585754 - DNA, 23 bp, Homo sapiens
ctgccccgcccccagtccccacc

SEQ ID NO: 1585755 - DNA, 19 bp, Homo sapiens
ctgccccgcttccccacag

SEQ ID NO: 1585756 - DNA, 20 bp, Homo sapiens
ctgccccgcttccccacaga

SEQ ID NO: 1585757 - DNA, 17 bp, Homo sapiens
ctgccccgggtccccag

SEQ ID NO: 1585758 - DNA, 19 bp, Homo sapiens
ctgccccgggtccccagct

SEQ ID NO: 1585759 - DNA, 22 bp, Homo sapiens
ctgccccgggtccccagctccc

SEQ ID NO: 1585760 - DNA, 15 bp, Homo sapiens
ctgccccgttccctg

SEQ ID NO: 1585761 - DNA, 19 bp, Homo sapiens
ctgccccgttccctgtcag

SEQ ID NO: 1585762 - DNA, 22 bp, Homo sapiens
ctgcccctacgggcgctgcagc

SEQ ID NO: 1585763 - DNA, 24 bp, Homo sapiens
ctgcccctacgggcgctgcagcct

SEQ ID NO: 1585764 - DNA, 20 bp, Homo sapiens
ctgcccctaggatgctgcag

SEQ ID NO: 1585765 - DNA, 15 bp, Homo sapiens
ctgcccctcagagac

SEQ ID NO: 1585766 - DNA, 22 bp, Homo sapiens
ctgcccctcccccaacccccac

SEQ ID NO: 1585767 - DNA, 17 bp, Homo sapiens
ctgcccctcccttcaac

SEQ ID NO: 1585768 - DNA, 17 bp, Homo sapiens
ctgcccctctcaccaaa

SEQ ID NO: 1585769 - DNA, 16 bp, Homo sapiens
ctgcccctgcagttgg

SEQ ID NO: 1585770 - DNA, 12 bp, Homo sapiens
ctgcccctggca

SEQ ID NO: 1585771 - DNA, 21 bp, Homo sapiens
ctgccccttaaacacaggctg

SEQ ID NO: 1585772 - DNA, 18 bp, Homo sapiens
ctgccccttaaccccaag

SEQ ID NO: 1585773 - DNA, 18 bp, Homo sapiens
ctgccccttgggcatcca

SEQ ID NO: 1585774 - DNA, 14 bp, Homo sapiens
ctgcccgagagagc

SEQ ID NO: 1585775 - DNA, 16 bp, Homo sapiens
ctgcccgcaccctggc

SEQ ID NO: 1585776 - DNA, 18 bp, Homo sapiens
ctgcccgcaccctggcct

SEQ ID NO: 1585777 - DNA, 14 bp, Homo sapiens
ctgcccgctcccaa

SEQ ID NO: 1585778 - DNA, 18 bp, Homo sapiens
ctgcccggctacatcagc

SEQ ID NO: 1585779 - DNA, 21 bp, Homo sapiens
ctgcccggtggtttgccatgt

SEQ ID NO: 1585780 - DNA, 15 bp, Homo sapiens
ctgcccgtcttcagc

SEQ ID NO: 1585781 - DNA, 21 bp, Homo sapiens
ctgcccgtcttcagcctagcc

SEQ ID NO: 1585782 - DNA, 13 bp, Homo sapiens
ctgccctaacctg

SEQ ID NO: 1585783 - DNA, 16 bp, Homo sapiens
ctgccctactcactct

SEQ ID NO: 1585784 - DNA, 12 bp, Homo sapiens
ctgccctagctg

SEQ ID NO: 1585785 - DNA, 17 bp, Homo sapiens
ctgccctatgggcctgc

SEQ ID NO: 1585786 - DNA, 21 bp, Homo sapiens
ctgccctatgggcctgccggg

SEQ ID NO: 1585787 - DNA, 19 bp, Homo sapiens
ctgccctcactccctctgc

SEQ ID NO: 1585788 - DNA, 22 bp, Homo sapiens
ctgccctcactccctctgcaga

SEQ ID NO: 1585789 - DNA, 19 bp, Homo sapiens
ctgccctcatggcccctct

SEQ ID NO: 1585790 - DNA, 14 bp, Homo sapiens
ctgccctcccaagt

SEQ ID NO: 1585791 - DNA, 18 bp, Homo sapiens
ctgccctcccaagtccca

SEQ ID NO: 1585792 - DNA, 13 bp, Homo sapiens
ctgccctcccctg

SEQ ID NO: 1585793 - DNA, 19 bp, Homo sapiens
ctgccctcccctgctccca

SEQ ID NO: 1585794 - DNA, 21 bp, Homo sapiens
ctgccctcccctgctcccagg

SEQ ID NO: 1585795 - DNA, 15 bp, Homo sapiens
ctgccctcccgcacc

SEQ ID NO: 1585796 - DNA, 17 bp, Homo sapiens
ctgccctcccgcacctt

SEQ ID NO: 1585797 - DNA, 17 bp, Homo sapiens
ctgccctccctccttcc

SEQ ID NO: 1585798 - DNA, 18 bp, Homo sapiens
ctgccctccctccttcct

SEQ ID NO: 1585799 - DNA, 17 bp, Homo sapiens
ctgccctcgtggccagc

SEQ ID NO: 1585800 - DNA, 21 bp, Homo sapiens
ctgccctcgtggccagcccgg

SEQ ID NO: 1585801 - DNA, 23 bp, Homo sapiens
ctgccctcgtggccagcccggct

SEQ ID NO: 1585802 - DNA, 15 bp, Homo sapiens
ctgccctctatttat

SEQ ID NO: 1585803 - DNA, 20 bp, Homo sapiens
ctgccctctatttattagcc

SEQ ID NO: 1585804 - DNA, 22 bp, Homo sapiens
ctgccctctcccaaaaaactac

SEQ ID NO: 1585805 - DNA, 17 bp, Homo sapiens
ctgccctctccttcctt

SEQ ID NO: 1585806 - DNA, 13 bp, Homo sapiens
ctgccctctctgc

SEQ ID NO: 1585807 - DNA, 11 bp, Homo sapiens
ctgccctctgc

SEQ ID NO: 1585808 - DNA, 15 bp, Homo sapiens
ctgccctctgcccca

SEQ ID NO: 1585809 - DNA, 19 bp, Homo sapiens
ctgccctctgctctgcctg

SEQ ID NO: 1585810 - DNA, 21 bp, Homo sapiens
ctgccctctgctctgcctgga

SEQ ID NO: 1585811 - DNA, 22 bp, Homo sapiens
ctgccctctgctctgcctggag

SEQ ID NO: 1585812 - DNA, 13 bp, Homo sapiens
ctgccctctgctg

SEQ ID NO: 1585813 - DNA, 14 bp, Homo sapiens
ctgccctctgctgc

SEQ ID NO: 1585814 - DNA, 17 bp, Homo sapiens
ctgccctctgctgctgc

SEQ ID NO: 1585815 - DNA, 18 bp, Homo sapiens
ctgccctctgctgctgcc

SEQ ID NO: 1585816 - DNA, 19 bp, Homo sapiens
ctgccctctgctgctgccc

SEQ ID NO: 1585817 - DNA, 21 bp, Homo sapiens
ctgccctctgctgctgcccgg

SEQ ID NO: 1585818 - DNA, 13 bp, Homo sapiens
ctgccctgccact

SEQ ID NO: 1585819 - DNA, 11 bp, Homo sapiens
ctgccctgccc

SEQ ID NO: 1585820 - DNA, 13 bp, Homo sapiens
ctgccctgccccc

SEQ ID NO: 1585821 - DNA, 18 bp, Homo sapiens
ctgccctgccctagctcc

SEQ ID NO: 1585822 - DNA, 12 bp, Homo sapiens
ctgccctgcctg

SEQ ID NO: 1585823 - DNA, 14 bp, Homo sapiens
ctgccctgcctgag

SEQ ID NO: 1585824 - DNA, 14 bp, Homo sapiens
ctgccctgcctgcc

SEQ ID NO: 1585825 - DNA, 17 bp, Homo sapiens
ctgccctgcctgcccac

SEQ ID NO: 1585826 - DNA, 14 bp, Homo sapiens
ctgccctgctgttt

SEQ ID NO: 1585827 - DNA, 16 bp, Homo sapiens
ctgccctggctgctgc

SEQ ID NO: 1585828 - DNA, 18 bp, Homo sapiens
ctgccctggctgctgccc

SEQ ID NO: 1585829 - DNA, 21 bp, Homo sapiens
ctgccctggctgctgccccca

SEQ ID NO: 1585830 - DNA, 17 bp, Homo sapiens
ctgccctggctgtgatg

SEQ ID NO: 1585831 - DNA, 21 bp, Homo sapiens
ctgccctgggatgtccacaga

SEQ ID NO: 1585832 - DNA, 23 bp, Homo sapiens
ctgccctggtccagggaagctgg

SEQ ID NO: 1585833 - DNA, 18 bp, Homo sapiens
ctgccctggtgctgccac

SEQ ID NO: 1585834 - DNA, 19 bp, Homo sapiens
ctgccctggtgctgccaca

SEQ ID NO: 1585835 - DNA, 23 bp, Homo sapiens
ctgccctggtgctgccacacttc

SEQ ID NO: 1585836 - DNA, 13 bp, Homo sapiens
ctgccctgtaccc

SEQ ID NO: 1585837 - DNA, 21 bp, Homo sapiens
ctgccctgtaccccagcactt

SEQ ID NO: 1585838 - DNA, 14 bp, Homo sapiens
ctgccctgtggaca

SEQ ID NO: 1585839 - DNA, 15 bp, Homo sapiens
ctgccctgtggacag

SEQ ID NO: 1585840 - DNA, 22 bp, Homo sapiens
ctgccctgtgtacttcccgggc

SEQ ID NO: 1585841 - DNA, 15 bp, Homo sapiens
ctgccctgtttctgt

SEQ ID NO: 1585842 - DNA, 20 bp, Homo sapiens
ctgcccttccaggtgggtgt

SEQ ID NO: 1585843 - DNA, 12 bp, Homo sapiens
ctgcccttcctc

SEQ ID NO: 1585844 - DNA, 15 bp, Homo sapiens
ctgcccttcctcagt

SEQ ID NO: 1585845 - DNA, 20 bp, Homo sapiens
ctgcccttcctcctgatgga

SEQ ID NO: 1585846 - DNA, 16 bp, Homo sapiens
ctgcccttctcaagac

SEQ ID NO: 1585847 - DNA, 21 bp, Homo sapiens
ctgcccttgaaccccctccct

SEQ ID NO: 1585848 - DNA, 17 bp, Homo sapiens
ctgcccttgatcagccc

SEQ ID NO: 1585849 - DNA, 12 bp, Homo sapiens
ctgcccttgggc

SEQ ID NO: 1585850 - DNA, 17 bp, Homo sapiens
ctgcccttgttgcctgc

SEQ ID NO: 1585851 - DNA, 17 bp, Homo sapiens
ctgcccttttcaggaag

SEQ ID NO: 1585852 - DNA, 22 bp, Homo sapiens
ctgccgaacacacatcccagga

SEQ ID NO: 1585853 - DNA, 13 bp, Homo sapiens
ctgccgaccagag

SEQ ID NO: 1585854 - DNA, 15 bp, Homo sapiens
ctgccgaccagagcc

SEQ ID NO: 1585855 - DNA, 15 bp, Homo sapiens
ctgccgacctcgtcc

SEQ ID NO: 1585856 - DNA, 17 bp, Homo sapiens
ctgccgacttggagact

SEQ ID NO: 1585857 - DNA, 22 bp, Homo sapiens
ctgccgacttggagactcctgg

SEQ ID NO: 1585858 - DNA, 22 bp, Homo sapiens
ctgccgagtaatgacgtgtgtg

SEQ ID NO: 1585859 - DNA, 15 bp, Homo sapiens
ctgccgcaccccaga

SEQ ID NO: 1585860 - DNA, 18 bp, Homo sapiens
ctgccgcagacgggcaca

SEQ ID NO: 1585861 - DNA, 13 bp, Homo sapiens
ctgccgcagagct

SEQ ID NO: 1585862 - DNA, 17 bp, Homo sapiens
ctgccgcccccgcctgg

SEQ ID NO: 1585863 - DNA, 20 bp, Homo sapiens
ctgccgcccccgcctgggca

SEQ ID NO: 1585864 - DNA, 22 bp, Homo sapiens
ctgccgcccccgcctgggcacc

SEQ ID NO: 1585865 - DNA, 18 bp, Homo sapiens
ctgccgccccctcctgaa

SEQ ID NO: 1585866 - DNA, 22 bp, Homo sapiens
ctgccgctgcttccaggctggg

SEQ ID NO: 1585867 - DNA, 18 bp, Homo sapiens
ctgccggatctgggctgt

SEQ ID NO: 1585868 - DNA, 15 bp, Homo sapiens
ctgccgggctgaggg

SEQ ID NO: 1585869 - DNA, 19 bp, Homo sapiens
ctgccgggctgagggcctg

SEQ ID NO: 1585870 - DNA, 22 bp, Homo sapiens
ctgccgggctgagggcctgctg

SEQ ID NO: 1585871 - DNA, 21 bp, Homo sapiens
ctgccgggttctagtctcctt

SEQ ID NO: 1585872 - DNA, 18 bp, Homo sapiens
ctgccggtcccccatgcc

SEQ ID NO: 1585873 - DNA, 22 bp, Homo sapiens
ctgccggtcccccatgccacca

SEQ ID NO: 1585874 - DNA, 23 bp, Homo sapiens
ctgccggtcgggcagccagcaga

SEQ ID NO: 1585875 - DNA, 14 bp, Homo sapiens
ctgccggtgggacc

SEQ ID NO: 1585876 - DNA, 18 bp, Homo sapiens
ctgccggtgggaccctgt

SEQ ID NO: 1585877 - DNA, 22 bp, Homo sapiens
ctgccggtgggaccctgtccgg

SEQ ID NO: 1585878 - DNA, 20 bp, Homo sapiens
ctgccggtttgaaaatatgc

SEQ ID NO: 1585879 - DNA, 14 bp, Homo sapiens
ctgccgtgcatggc

SEQ ID NO: 1585880 - DNA, 16 bp, Homo sapiens
ctgccgtgcatggctc

SEQ ID NO: 1585881 - DNA, 14 bp, Homo sapiens
ctgccgtgcctgtg

SEQ ID NO: 1585882 - DNA, 20 bp, Homo sapiens
ctgccgtggggccgccgcct

SEQ ID NO: 1585883 - DNA, 18 bp, Homo sapiens
ctgcctaagtggctgctg

SEQ ID NO: 1585884 - DNA, 20 bp, Homo sapiens
ctgcctaagtggctgctgac

SEQ ID NO: 1585885 - DNA, 17 bp, Homo sapiens
ctgcctacacacacagc

SEQ ID NO: 1585886 - DNA, 20 bp, Homo sapiens
ctgcctacagaacttcagaa

SEQ ID NO: 1585887 - DNA, 17 bp, Homo sapiens
ctgcctacggagggtgg

SEQ ID NO: 1585888 - DNA, 23 bp, Homo sapiens
ctgcctagagtgtagcctaaagg

SEQ ID NO: 1585889 - DNA, 23 bp, Homo sapiens
ctgcctaggtttttcctactgtc

SEQ ID NO: 1585890 - DNA, 23 bp, Homo sapiens
ctgcctattcacgccgtaattct

SEQ ID NO: 1585891 - DNA, 20 bp, Homo sapiens
ctgcctcagccagtggcaca

SEQ ID NO: 1585892 - DNA, 22 bp, Homo sapiens
ctgcctcagccagtggcacagg

SEQ ID NO: 1585893 - DNA, 14 bp, Homo sapiens
ctgcctcagcccgc

SEQ ID NO: 1585894 - DNA, 16 bp, Homo sapiens
ctgcctcagcctcctg

SEQ ID NO: 1585895 - DNA, 13 bp, Homo sapiens
ctgcctccaccag

SEQ ID NO: 1585896 - DNA, 16 bp, Homo sapiens
ctgcctccaccgagcc

SEQ ID NO: 1585897 - DNA, 19 bp, Homo sapiens
ctgcctccaccgagccagc

SEQ ID NO: 1585898 - DNA, 22 bp, Homo sapiens
ctgcctccaccgagccagcttg

SEQ ID NO: 1585899 - DNA, 19 bp, Homo sapiens
ctgcctccagggctggact

SEQ ID NO: 1585900 - DNA, 19 bp, Homo sapiens
ctgcctccatggcagcagc

SEQ ID NO: 1585901 - DNA, 20 bp, Homo sapiens
ctgcctccatggcagcagcc

SEQ ID NO: 1585902 - DNA, 21 bp, Homo sapiens
ctgcctccatggcagcagcca

SEQ ID NO: 1585903 - DNA, 14 bp, Homo sapiens
ctgcctcccacttc

SEQ ID NO: 1585904 - DNA, 16 bp, Homo sapiens
ctgcctcccctccgca

SEQ ID NO: 1585905 - DNA, 23 bp, Homo sapiens
ctgcctccctctccatatctcct

SEQ ID NO: 1585906 - DNA, 22 bp, Homo sapiens
ctgcctccctggggaccaggag

SEQ ID NO: 1585907 - DNA, 14 bp, Homo sapiens
ctgcctcctgccac

SEQ ID NO: 1585908 - DNA, 14 bp, Homo sapiens
ctgcctcctgccct

SEQ ID NO: 1585909 - DNA, 13 bp, Homo sapiens
ctgcctcctgcct

SEQ ID NO: 1585910 - DNA, 15 bp, Homo sapiens
ctgcctcctggctca

SEQ ID NO: 1585911 - DNA, 18 bp, Homo sapiens
ctgcctcctttgcacctg

SEQ ID NO: 1585912 - DNA, 14 bp, Homo sapiens
ctgcctcggactcc

SEQ ID NO: 1585913 - DNA, 16 bp, Homo sapiens
ctgcctcggactccat

SEQ ID NO: 1585914 - DNA, 19 bp, Homo sapiens
ctgcctcggactccatggc

SEQ ID NO: 1585915 - DNA, 20 bp, Homo sapiens
ctgcctcggactccatggct

SEQ ID NO: 1585916 - DNA, 15 bp, Homo sapiens
ctgcctctagtcccc

SEQ ID NO: 1585917 - DNA, 20 bp, Homo sapiens
ctgcctctagtccccaaggc

SEQ ID NO: 1585918 - DNA, 13 bp, Homo sapiens
ctgcctctcacac

SEQ ID NO: 1585919 - DNA, 16 bp, Homo sapiens
ctgcctctcacacaca

SEQ ID NO: 1585920 - DNA, 21 bp, Homo sapiens
ctgcctctcacacacatagat

SEQ ID NO: 1585921 - DNA, 22 bp, Homo sapiens
ctgcctctcccatcacttccct

SEQ ID NO: 1585922 - DNA, 13 bp, Homo sapiens
ctgcctctgaaaa

SEQ ID NO: 1585923 - DNA, 18 bp, Homo sapiens
ctgcctctgaaaatattt

SEQ ID NO: 1585924 - DNA, 17 bp, Homo sapiens
ctgcctctgcctgcatt

SEQ ID NO: 1585925 - DNA, 14 bp, Homo sapiens
ctgcctctgctccc

SEQ ID NO: 1585926 - DNA, 17 bp, Homo sapiens
ctgcctctgctccctct

SEQ ID NO: 1585927 - DNA, 14 bp, Homo sapiens
ctgcctctgggcca

SEQ ID NO: 1585928 - DNA, 18 bp, Homo sapiens
ctgcctctttccctagga

SEQ ID NO: 1585929 - DNA, 19 bp, Homo sapiens
ctgcctctttccctaggaa

SEQ ID NO: 1585930 - DNA, 19 bp, Homo sapiens
ctgcctgaacctggggtca

SEQ ID NO: 1585931 - DNA, 17 bp, Homo sapiens
ctgcctgagattcttta

SEQ ID NO: 1585932 - DNA, 14 bp, Homo sapiens
ctgcctgagcccag

SEQ ID NO: 1585933 - DNA, 14 bp, Homo sapiens
ctgcctgaggagga

SEQ ID NO: 1585934 - DNA, 22 bp, Homo sapiens
ctgcctgaggaggaggacacag

SEQ ID NO: 1585935 - DNA, 21 bp, Homo sapiens
ctgcctgagggcccctctgcc

SEQ ID NO: 1585936 - DNA, 23 bp, Homo sapiens
ctgcctgagggcccctctgccca

SEQ ID NO: 1585937 - DNA, 18 bp, Homo sapiens
ctgcctgcaatatttgaa

SEQ ID NO: 1585938 - DNA, 13 bp, Homo sapiens
ctgcctgcactcc

SEQ ID NO: 1585939 - DNA, 23 bp, Homo sapiens
ctgcctgcactccctggccttgc

SEQ ID NO: 1585940 - DNA, 15 bp, Homo sapiens
ctgcctgcagagcag

SEQ ID NO: 1585941 - DNA, 21 bp, Homo sapiens
ctgcctgcagaggtctgtgct

SEQ ID NO: 1585942 - DNA, 23 bp, Homo sapiens
ctgcctgcatgagctggcaacca

SEQ ID NO: 1585943 - DNA, 15 bp, Homo sapiens
ctgcctgccagctgc

SEQ ID NO: 1585944 - DNA, 20 bp, Homo sapiens
ctgcctgccagctgcactga

SEQ ID NO: 1585945 - DNA, 11 bp, Homo sapiens
ctgcctgccat

SEQ ID NO: 1585946 - DNA, 13 bp, Homo sapiens
ctgcctgcctccc

SEQ ID NO: 1585947 - DNA, 16 bp, Homo sapiens
ctgcctgcctgtctgt

SEQ ID NO: 1585948 - DNA, 16 bp, Homo sapiens
ctgcctgctcatggcc

SEQ ID NO: 1585949 - DNA, 19 bp, Homo sapiens
ctgcctgctcatggccctc

SEQ ID NO: 1585950 - DNA, 18 bp, Homo sapiens
ctgcctggaacaccagca

SEQ ID NO: 1585951 - DNA, 23 bp, Homo sapiens
ctgcctggagacaaggtgctaac

SEQ ID NO: 1585952 - DNA, 22 bp, Homo sapiens
ctgcctggagacttagggcacc

SEQ ID NO: 1585953 - DNA, 16 bp, Homo sapiens
ctgcctggccaggccc

SEQ ID NO: 1585954 - DNA, 22 bp, Homo sapiens
ctgcctggccaggccctgggtc

SEQ ID NO: 1585955 - DNA, 11 bp, Homo sapiens
ctgcctggcct

SEQ ID NO: 1585956 - DNA, 15 bp, Homo sapiens
ctgcctggcctggct

SEQ ID NO: 1585957 - DNA, 19 bp, Homo sapiens
ctgcctggcctggctcccc

SEQ ID NO: 1585958 - DNA, 11 bp, Homo sapiens
ctgcctgggcc

SEQ ID NO: 1585959 - DNA, 12 bp, Homo sapiens
ctgcctgggcct

SEQ ID NO: 1585960 - DNA, 14 bp, Homo sapiens
ctgcctgggcctgt

SEQ ID NO: 1585961 - DNA, 23 bp, Homo sapiens
ctgcctgggcctgtgcagcagcc

SEQ ID NO: 1585962 - DNA, 19 bp, Homo sapiens
ctgcctgggctgttggcac

SEQ ID NO: 1585963 - DNA, 20 bp, Homo sapiens
ctgcctgggctgttggcact

SEQ ID NO: 1585964 - DNA, 21 bp, Homo sapiens
ctgcctgggctgttggcactc

SEQ ID NO: 1585965 - DNA, 22 bp, Homo sapiens
ctgcctggggcctccagaagct

SEQ ID NO: 1585966 - DNA, 21 bp, Homo sapiens
ctgcctggtcctccctcccaa

SEQ ID NO: 1585967 - DNA, 19 bp, Homo sapiens
ctgcctggtctgtctggat

SEQ ID NO: 1585968 - DNA, 18 bp, Homo sapiens
ctgcctggtgcattgctg

SEQ ID NO: 1585969 - DNA, 21 bp, Homo sapiens
ctgcctggtgcattgctgtgt

SEQ ID NO: 1585970 - DNA, 23 bp, Homo sapiens
ctgcctggtgcattgctgtgtga

SEQ ID NO: 1585971 - DNA, 17 bp, Homo sapiens
ctgcctgtatttgagag

SEQ ID NO: 1585972 - DNA, 18 bp, Homo sapiens
ctgcctgtatttgagaga

SEQ ID NO: 1585973 - DNA, 12 bp, Homo sapiens
ctgcctgtctcc

SEQ ID NO: 1585974 - DNA, 15 bp, Homo sapiens
ctgcctgtctccatg

SEQ ID NO: 1585975 - DNA, 15 bp, Homo sapiens
ctgcctgtctgtctc

SEQ ID NO: 1585976 - DNA, 17 bp, Homo sapiens
ctgcctgtgagccagtc

SEQ ID NO: 1585977 - DNA, 13 bp, Homo sapiens
ctgcctgtggcct

SEQ ID NO: 1585978 - DNA, 23 bp, Homo sapiens
ctgcctgtggccttgcccgccag

SEQ ID NO: 1585979 - DNA, 22 bp, Homo sapiens
ctgcctgtggcgccgtctccag

SEQ ID NO: 1585980 - DNA, 18 bp, Homo sapiens
ctgcctgttataactctg

SEQ ID NO: 1585981 - DNA, 19 bp, Homo sapiens
ctgcctgttggcaggccca

SEQ ID NO: 1585982 - DNA, 16 bp, Homo sapiens
ctgccttaaaaccaaa

SEQ ID NO: 1585983 - DNA, 17 bp, Homo sapiens
ctgccttaaaaccaaag

SEQ ID NO: 1585984 - DNA, 18 bp, Homo sapiens
ctgccttaaaaccaaaga

SEQ ID NO: 1585985 - DNA, 22 bp, Homo sapiens
ctgccttaatgacattcccctc

SEQ ID NO: 1585986 - DNA, 16 bp, Homo sapiens
ctgccttcacaaatgt

SEQ ID NO: 1585987 - DNA, 12 bp, Homo sapiens
ctgccttcctca

SEQ ID NO: 1585988 - DNA, 23 bp, Homo sapiens
ctgccttcgcttcttgcctctgt

SEQ ID NO: 1585989 - DNA, 13 bp, Homo sapiens
ctgccttcgttaa

SEQ ID NO: 1585990 - DNA, 19 bp, Homo sapiens
ctgccttcgttaactgtgt

SEQ ID NO: 1585991 - DNA, 17 bp, Homo sapiens
ctgccttctcaggcccc

SEQ ID NO: 1585992 - DNA, 24 bp, Homo sapiens
ctgccttcttcggggaactcctgg

SEQ ID NO: 1585993 - DNA, 17 bp, Homo sapiens
ctgccttctttccatca

SEQ ID NO: 1585994 - DNA, 16 bp, Homo sapiens
ctgccttgaagccact

SEQ ID NO: 1585995 - DNA, 22 bp, Homo sapiens
ctgccttggctcagacatgttt

SEQ ID NO: 1585996 - DNA, 15 bp, Homo sapiens
ctgccttgtccctct

SEQ ID NO: 1585997 - DNA, 19 bp, Homo sapiens
ctgccttgtccctctcact

SEQ ID NO: 1585998 - DNA, 15 bp, Homo sapiens
ctgcctttaagccaa

SEQ ID NO: 1585999 - DNA, 17 bp, Homo sapiens
ctgcctttaagccaaag

SEQ ID NO: 1586000 - DNA, 20 bp, Homo sapiens
ctgcctttaagccaaagaaa

SEQ ID NO: 1586001 - DNA, 23 bp, Homo sapiens
ctgcctttaagccaaagaaacaa

SEQ ID NO: 1586002 - DNA, 19 bp, Homo sapiens
ctgcctttagcctggacca

SEQ ID NO: 1586003 - DNA, 23 bp, Homo sapiens
ctgcctttagcctggaccaaagg

SEQ ID NO: 1586004 - DNA, 19 bp, Homo sapiens
ctgcctttatgatgctaag

SEQ ID NO: 1586005 - DNA, 14 bp, Homo sapiens
ctgcctttgcacca

SEQ ID NO: 1586006 - DNA, 23 bp, Homo sapiens
ctgcctttgcagttggactctca

SEQ ID NO: 1586007 - DNA, 21 bp, Homo sapiens
ctgcctttggcactctgactt

SEQ ID NO: 1586008 - DNA, 20 bp, Homo sapiens
ctgcgaagaccctcttgccc

SEQ ID NO: 1586009 - DNA, 22 bp, Homo sapiens
ctgcgaagaccctcttgcccat

SEQ ID NO: 1586010 - DNA, 19 bp, Homo sapiens
ctgcgaaggggccctggtc

SEQ ID NO: 1586011 - DNA, 14 bp, Homo sapiens
ctgcgactttctgc

SEQ ID NO: 1586012 - DNA, 19 bp, Homo sapiens
ctgcgactttctgcctgga

SEQ ID NO: 1586013 - DNA, 22 bp, Homo sapiens
ctgcgagacgcacacagctgag

SEQ ID NO: 1586014 - DNA, 23 bp, Homo sapiens
ctgcgagtagatgaacctgcagc

SEQ ID NO: 1586015 - DNA, 16 bp, Homo sapiens
ctgcgcaggtctcttc

SEQ ID NO: 1586016 - DNA, 18 bp, Homo sapiens
ctgcgcaggtctcttctg

SEQ ID NO: 1586017 - DNA, 18 bp, Homo sapiens
ctgcgccaggcagagctg

SEQ ID NO: 1586018 - DNA, 16 bp, Homo sapiens
ctgcgccagtcctgct

SEQ ID NO: 1586019 - DNA, 20 bp, Homo sapiens
ctgcgcctccagaggtcctc

SEQ ID NO: 1586020 - DNA, 15 bp, Homo sapiens
ctgcgcctgaaaagg

SEQ ID NO: 1586021 - DNA, 13 bp, Homo sapiens
ctgcggaagccaa

SEQ ID NO: 1586022 - DNA, 16 bp, Homo sapiens
ctgcggaagccaaagg

SEQ ID NO: 1586023 - DNA, 15 bp, Homo sapiens
ctgcggagccggcac

SEQ ID NO: 1586024 - DNA, 21 bp, Homo sapiens
ctgcggagtgaagaggggcag

SEQ ID NO: 1586025 - DNA, 23 bp, Homo sapiens
ctgcggagtgaagaggggcagcc

SEQ ID NO: 1586026 - DNA, 15 bp, Homo sapiens
ctgcggatctcagct

SEQ ID NO: 1586027 - DNA, 23 bp, Homo sapiens
ctgcggcgcgggcccctcacctg

SEQ ID NO: 1586028 - DNA, 15 bp, Homo sapiens
ctgcggctgtgggcg

SEQ ID NO: 1586029 - DNA, 18 bp, Homo sapiens
ctgcgggacagaggacca

SEQ ID NO: 1586030 - DNA, 18 bp, Homo sapiens
ctgcgggatggtcctggg

SEQ ID NO: 1586031 - DNA, 16 bp, Homo sapiens
ctgcgtccccactccc

SEQ ID NO: 1586032 - DNA, 13 bp, Homo sapiens
ctgcgtcctcatt

SEQ ID NO: 1586033 - DNA, 13 bp, Homo sapiens
ctgcgtcctcctc

SEQ ID NO: 1586034 - DNA, 14 bp, Homo sapiens
ctgcgtcctcctca

SEQ ID NO: 1586035 - DNA, 15 bp, Homo sapiens
ctgcgtcctcctcac

SEQ ID NO: 1586036 - DNA, 18 bp, Homo sapiens
ctgcgtcctcctcacctc

SEQ ID NO: 1586037 - DNA, 19 bp, Homo sapiens
ctgcgtcctcctcacctca

SEQ ID NO: 1586038 - DNA, 24 bp, Homo sapiens
ctgcgtcctcctcacctcatgccc

SEQ ID NO: 1586039 - DNA, 15 bp, Homo sapiens
ctgcgtgcacttccc

SEQ ID NO: 1586040 - DNA, 20 bp, Homo sapiens
ctgcgtgcagggacaaagag

SEQ ID NO: 1586041 - DNA, 13 bp, Homo sapiens
ctgcgttctgcaa

SEQ ID NO: 1586042 - DNA, 16 bp, Homo sapiens
ctgcgttggagccact

SEQ ID NO: 1586043 - DNA, 23 bp, Homo sapiens
ctgcgttggagccactcctgtcc

SEQ ID NO: 1586044 - DNA, 17 bp, Homo sapiens
ctgcgtttggaggcccc

SEQ ID NO: 1586045 - DNA, 20 bp, Homo sapiens
ctgcgttttggaagctctga

SEQ ID NO: 1586046 - DNA, 14 bp, Homo sapiens
ctgctaaatcctca

SEQ ID NO: 1586047 - DNA, 13 bp, Homo sapiens
ctgctaagaagct

SEQ ID NO: 1586048 - DNA, 16 bp, Homo sapiens
ctgctaaggctcctcc

SEQ ID NO: 1586049 - DNA, 14 bp, Homo sapiens
ctgctaagtagggg

SEQ ID NO: 1586050 - DNA, 21 bp, Homo sapiens
ctgctaagtatttcccagcac

SEQ ID NO: 1586051 - DNA, 23 bp, Homo sapiens
ctgctaagtatttcccagcacat

SEQ ID NO: 1586052 - DNA, 18 bp, Homo sapiens
ctgctaagttctcccaac

SEQ ID NO: 1586053 - DNA, 16 bp, Homo sapiens
ctgctaataaaaccca

SEQ ID NO: 1586054 - DNA, 15 bp, Homo sapiens
ctgctaattctttgc

SEQ ID NO: 1586055 - DNA, 23 bp, Homo sapiens
ctgctacaaatactcttaggaag

SEQ ID NO: 1586056 - DNA, 16 bp, Homo sapiens
ctgctacatcagactc

SEQ ID NO: 1586057 - DNA, 17 bp, Homo sapiens
ctgctacatcagactct

SEQ ID NO: 1586058 - DNA, 21 bp, Homo sapiens
ctgctacattataatgtacag

SEQ ID NO: 1586059 - DNA, 16 bp, Homo sapiens
ctgctacctctgagaa

SEQ ID NO: 1586060 - DNA, 17 bp, Homo sapiens
ctgctacctctgagaag

SEQ ID NO: 1586061 - DNA, 13 bp, Homo sapiens
ctgctacctgttc

SEQ ID NO: 1586062 - DNA, 18 bp, Homo sapiens
ctgctacctttcaaagct

SEQ ID NO: 1586063 - DNA, 16 bp, Homo sapiens
ctgctactacccgagc

SEQ ID NO: 1586064 - DNA, 20 bp, Homo sapiens
ctgctactacccgagcccag

SEQ ID NO: 1586065 - DNA, 22 bp, Homo sapiens
ctgctactacccgagcccagct

SEQ ID NO: 1586066 - DNA, 17 bp, Homo sapiens
ctgctactctgttcctt

SEQ ID NO: 1586067 - DNA, 16 bp, Homo sapiens
ctgctactgtcttact

SEQ ID NO: 1586068 - DNA, 15 bp, Homo sapiens
ctgctacttccccag

SEQ ID NO: 1586069 - DNA, 12 bp, Homo sapiens
ctgctagaacct

SEQ ID NO: 1586070 - DNA, 19 bp, Homo sapiens
ctgctagagcaacccctgt

SEQ ID NO: 1586071 - DNA, 16 bp, Homo sapiens
ctgctagagccagcaa

SEQ ID NO: 1586072 - DNA, 22 bp, Homo sapiens
ctgctagattttaatttatttg

SEQ ID NO: 1586073 - DNA, 16 bp, Homo sapiens
ctgctagctgtagaaa

SEQ ID NO: 1586074 - DNA, 20 bp, Homo sapiens
ctgctagtgaaatggctggg

SEQ ID NO: 1586075 - DNA, 22 bp, Homo sapiens
ctgctatgaaaatgagcatcag

SEQ ID NO: 1586076 - DNA, 17 bp, Homo sapiens
ctgctatttacactatt

SEQ ID NO: 1586077 - DNA, 22 bp, Homo sapiens
ctgctcaactctacccctgctc

SEQ ID NO: 1586078 - DNA, 18 bp, Homo sapiens
ctgctcaagccgcaagct

SEQ ID NO: 1586079 - DNA, 20 bp, Homo sapiens
ctgctcaagccgcaagctct

SEQ ID NO: 1586080 - DNA, 22 bp, Homo sapiens
ctgctcaagccgcaagctctca

SEQ ID NO: 1586081 - DNA, 20 bp, Homo sapiens
ctgctcaccgcccatcaggg

SEQ ID NO: 1586082 - DNA, 20 bp, Homo sapiens
ctgctcacctgtgtgcccag

SEQ ID NO: 1586083 - DNA, 18 bp, Homo sapiens
ctgctcacgtcaaatgca

SEQ ID NO: 1586084 - DNA, 18 bp, Homo sapiens
ctgctcacgtctctgccg

SEQ ID NO: 1586085 - DNA, 18 bp, Homo sapiens
ctgctcactttaaacctg

SEQ ID NO: 1586086 - DNA, 22 bp, Homo sapiens
ctgctcagaacttgctgctgtc

SEQ ID NO: 1586087 - DNA, 14 bp, Homo sapiens
ctgctcagcagcca

SEQ ID NO: 1586088 - DNA, 20 bp, Homo sapiens
ctgctcagcagccagtctca

SEQ ID NO: 1586089 - DNA, 21 bp, Homo sapiens
ctgctcagcctcatcctgaga

SEQ ID NO: 1586090 - DNA, 23 bp, Homo sapiens
ctgctcagctctggtccaggccc

SEQ ID NO: 1586091 - DNA, 19 bp, Homo sapiens
ctgctcagtaaagcacttg

SEQ ID NO: 1586092 - DNA, 15 bp, Homo sapiens
ctgctcataggacct

SEQ ID NO: 1586093 - DNA, 16 bp, Homo sapiens
ctgctcataggacctg

SEQ ID NO: 1586094 - DNA, 17 bp, Homo sapiens
ctgctcataggacctgc

SEQ ID NO: 1586095 - DNA, 20 bp, Homo sapiens
ctgctcataggacctgcatc

SEQ ID NO: 1586096 - DNA, 19 bp, Homo sapiens
ctgctcatattgtgattct

SEQ ID NO: 1586097 - DNA, 21 bp, Homo sapiens
ctgctcattacagttctttcc

SEQ ID NO: 1586098 - DNA, 20 bp, Homo sapiens
ctgctccaccagcagcatgg

SEQ ID NO: 1586099 - DNA, 11 bp, Homo sapiens
ctgctccaccc

SEQ ID NO: 1586100 - DNA, 16 bp, Homo sapiens
ctgctccacccttggc

SEQ ID NO: 1586101 - DNA, 13 bp, Homo sapiens
ctgctccagaaga

SEQ ID NO: 1586102 - DNA, 15 bp, Homo sapiens
ctgctccagacctga

SEQ ID NO: 1586103 - DNA, 22 bp, Homo sapiens
ctgctccagcaactgcccttcc

SEQ ID NO: 1586104 - DNA, 13 bp, Homo sapiens
ctgctccagcagc

SEQ ID NO: 1586105 - DNA, 19 bp, Homo sapiens
ctgctccagcagcacacct

SEQ ID NO: 1586106 - DNA, 20 bp, Homo sapiens
ctgctccataccttttctct

SEQ ID NO: 1586107 - DNA, 21 bp, Homo sapiens
ctgctccataccttttctctt

SEQ ID NO: 1586108 - DNA, 19 bp, Homo sapiens
ctgctccatgactggctgt

SEQ ID NO: 1586109 - DNA, 19 bp, Homo sapiens
ctgctcccagatgccttct

SEQ ID NO: 1586110 - DNA, 23 bp, Homo sapiens
ctgctcccagatgccttctagat

SEQ ID NO: 1586111 - DNA, 16 bp, Homo sapiens
ctgctcccagcagccc

SEQ ID NO: 1586112 - DNA, 17 bp, Homo sapiens
ctgctcccagcagccct

SEQ ID NO: 1586113 - DNA, 21 bp, Homo sapiens
ctgctcccagcagccctaagg

SEQ ID NO: 1586114 - DNA, 13 bp, Homo sapiens
ctgctcccagtgg

SEQ ID NO: 1586115 - DNA, 14 bp, Homo sapiens
ctgctcccattcct

SEQ ID NO: 1586116 - DNA, 23 bp, Homo sapiens
ctgctcccccaccccctccccag

SEQ ID NO: 1586117 - DNA, 13 bp, Homo sapiens
ctgctcccctaac

SEQ ID NO: 1586118 - DNA, 15 bp, Homo sapiens
ctgctccgctgcctg

SEQ ID NO: 1586119 - DNA, 16 bp, Homo sapiens
ctgctccgctgcctgg

SEQ ID NO: 1586120 - DNA, 18 bp, Homo sapiens
ctgctccgctgcctggaa

SEQ ID NO: 1586121 - DNA, 13 bp, Homo sapiens
ctgctcctcaccc

SEQ ID NO: 1586122 - DNA, 12 bp, Homo sapiens
ctgctcctccag

SEQ ID NO: 1586123 - DNA, 16 bp, Homo sapiens
ctgctcctccagggcc

SEQ ID NO: 1586124 - DNA, 11 bp, Homo sapiens
ctgctcctccc

SEQ ID NO: 1586125 - DNA, 12 bp, Homo sapiens
ctgctcctccct

SEQ ID NO: 1586126 - DNA, 13 bp, Homo sapiens
ctgctcctccctg

SEQ ID NO: 1586127 - DNA, 18 bp, Homo sapiens
ctgctcctccctgccccc

SEQ ID NO: 1586128 - DNA, 20 bp, Homo sapiens
ctgctcctccctgcccccca

SEQ ID NO: 1586129 - DNA, 18 bp, Homo sapiens
ctgctcctccctggctgc

SEQ ID NO: 1586130 - DNA, 21 bp, Homo sapiens
ctgctcctccctggctgccct

SEQ ID NO: 1586131 - DNA, 12 bp, Homo sapiens
ctgctcctgctt

SEQ ID NO: 1586132 - DNA, 14 bp, Homo sapiens
ctgctcctgctttt

SEQ ID NO: 1586133 - DNA, 22 bp, Homo sapiens
ctgctcctgcttttctgtcctg

SEQ ID NO: 1586134 - DNA, 16 bp, Homo sapiens
ctgctcctgtggcagg

SEQ ID NO: 1586135 - DNA, 12 bp, Homo sapiens
ctgctccttcac

SEQ ID NO: 1586136 - DNA, 21 bp, Homo sapiens
ctgctccttcactgttccctc

SEQ ID NO: 1586137 - DNA, 22 bp, Homo sapiens
ctgctccttcactgttccctct

SEQ ID NO: 1586138 - DNA, 18 bp, Homo sapiens
ctgctcggcttcttggac

SEQ ID NO: 1586139 - DNA, 22 bp, Homo sapiens
ctgctcggcttcttggaccttg

SEQ ID NO: 1586140 - DNA, 19 bp, Homo sapiens
ctgctcgtggactgtgctg

SEQ ID NO: 1586141 - DNA, 18 bp, Homo sapiens
ctgctctagattcataaa

SEQ ID NO: 1586142 - DNA, 19 bp, Homo sapiens
ctgctctagattcataaat

SEQ ID NO: 1586143 - DNA, 16 bp, Homo sapiens
ctgctctagccaggag

SEQ ID NO: 1586144 - DNA, 17 bp, Homo sapiens
ctgctctagccaggagt

SEQ ID NO: 1586145 - DNA, 22 bp, Homo sapiens
ctgctctagggaatctggatta

SEQ ID NO: 1586146 - DNA, 23 bp, Homo sapiens
ctgctctattgtagcatttcttg

SEQ ID NO: 1586147 - DNA, 17 bp, Homo sapiens
ctgctctcagcctccca

SEQ ID NO: 1586148 - DNA, 15 bp, Homo sapiens
ctgctctcttcagga

SEQ ID NO: 1586149 - DNA, 19 bp, Homo sapiens
ctgctctcttcaggaggcc

SEQ ID NO: 1586150 - DNA, 22 bp, Homo sapiens
ctgctctgagaattgttgagat

SEQ ID NO: 1586151 - DNA, 11 bp, Homo sapiens
ctgctctgccc

SEQ ID NO: 1586152 - DNA, 13 bp, Homo sapiens
ctgctctgcccct

SEQ ID NO: 1586153 - DNA, 16 bp, Homo sapiens
ctgctctgcctggagt

SEQ ID NO: 1586154 - DNA, 23 bp, Homo sapiens
ctgctctgcgtggcgcaggtgcc

SEQ ID NO: 1586155 - DNA, 12 bp, Homo sapiens
ctgctctgggac

SEQ ID NO: 1586156 - DNA, 14 bp, Homo sapiens
ctgctctgggacgt

SEQ ID NO: 1586157 - DNA, 18 bp, Homo sapiens
ctgctctgggacgtggac

SEQ ID NO: 1586158 - DNA, 13 bp, Homo sapiens
ctgctctggtggc

SEQ ID NO: 1586159 - DNA, 19 bp, Homo sapiens
ctgctcttagtgcccgcct

SEQ ID NO: 1586160 - DNA, 15 bp, Homo sapiens
ctgctcttcatccca

SEQ ID NO: 1586161 - DNA, 19 bp, Homo sapiens
ctgctcttgcagttgctct

SEQ ID NO: 1586162 - DNA, 14 bp, Homo sapiens
ctgctcttgtttct

SEQ ID NO: 1586163 - DNA, 15 bp, Homo sapiens
ctgctctttctctgc

SEQ ID NO: 1586164 - DNA, 18 bp, Homo sapiens
ctgctctttctctgccag

SEQ ID NO: 1586165 - DNA, 21 bp, Homo sapiens
ctgctctttctctgccagtga

SEQ ID NO: 1586166 - DNA, 16 bp, Homo sapiens
ctgctgaaatttggaa

SEQ ID NO: 1586167 - DNA, 17 bp, Homo sapiens
ctgctgaacacagtgtc

SEQ ID NO: 1586168 - DNA, 12 bp, Homo sapiens
ctgctgaagctg

SEQ ID NO: 1586169 - DNA, 17 bp, Homo sapiens
ctgctgaagctgctgca

SEQ ID NO: 1586170 - DNA, 16 bp, Homo sapiens
ctgctgaagttctgag

SEQ ID NO: 1586171 - DNA, 18 bp, Homo sapiens
ctgctgaagttctgagcc

SEQ ID NO: 1586172 - DNA, 22 bp, Homo sapiens
ctgctgaatgatttccaaagag

SEQ ID NO: 1586173 - DNA, 19 bp, Homo sapiens
ctgctgaatgcagggaatg

SEQ ID NO: 1586174 - DNA, 22 bp, Homo sapiens
ctgctgacacgcagcctgctct

SEQ ID NO: 1586175 - DNA, 17 bp, Homo sapiens
ctgctgacagacactaa

SEQ ID NO: 1586176 - DNA, 9 bp, Homo sapiens
ctgctgacc

SEQ ID NO: 1586177 - DNA, 22 bp, Homo sapiens
ctgctgaccaaatggccagttt

SEQ ID NO: 1586178 - DNA, 20 bp, Homo sapiens
ctgctgaccaattgtgctgc

SEQ ID NO: 1586179 - DNA, 21 bp, Homo sapiens
ctgctgaccaattgtgctgcc

SEQ ID NO: 1586180 - DNA, 15 bp, Homo sapiens
ctgctgacctcactg

SEQ ID NO: 1586181 - DNA, 23 bp, Homo sapiens
ctgctgacctcactgtcctgtga

SEQ ID NO: 1586182 - DNA, 21 bp, Homo sapiens
ctgctgagagacccaaggagg

SEQ ID NO: 1586183 - DNA, 22 bp, Homo sapiens
ctgctgagagacccaaggagga

SEQ ID NO: 1586184 - DNA, 14 bp, Homo sapiens
ctgctgaggcagtg

SEQ ID NO: 1586185 - DNA, 13 bp, Homo sapiens
ctgctgaggccca

SEQ ID NO: 1586186 - DNA, 14 bp, Homo sapiens
ctgctgaggcccag

SEQ ID NO: 1586187 - DNA, 17 bp, Homo sapiens
ctgctgaggcccagtgc

SEQ ID NO: 1586188 - DNA, 19 bp, Homo sapiens
ctgctgaggcccagtgcat

SEQ ID NO: 1586189 - DNA, 20 bp, Homo sapiens
ctgctgaggcccagtgcata

SEQ ID NO: 1586190 - DNA, 22 bp, Homo sapiens
ctgctgaggcccagtgcatatg

SEQ ID NO: 1586191 - DNA, 17 bp, Homo sapiens
ctgctgagggaccagcc

SEQ ID NO: 1586192 - DNA, 23 bp, Homo sapiens
ctgctgagggaccttggagagct

SEQ ID NO: 1586193 - DNA, 20 bp, Homo sapiens
ctgctgagtcagactgtcag

SEQ ID NO: 1586194 - DNA, 13 bp, Homo sapiens
ctgctgagtgaca

SEQ ID NO: 1586195 - DNA, 14 bp, Homo sapiens
ctgctgagtgacag

SEQ ID NO: 1586196 - DNA, 21 bp, Homo sapiens
ctgctgagttggcctggccat

SEQ ID NO: 1586197 - DNA, 22 bp, Homo sapiens
ctgctgagttggcctggccatt

SEQ ID NO: 1586198 - DNA, 23 bp, Homo sapiens
ctgctgatatcaacagcttccct

SEQ ID NO: 1586199 - DNA, 14 bp, Homo sapiens
ctgctgattcttgt

SEQ ID NO: 1586200 - DNA, 15 bp, Homo sapiens
ctgctgattcttgta

SEQ ID NO: 1586201 - DNA, 19 bp, Homo sapiens
ctgctgattcttgtaaatc

SEQ ID NO: 1586202 - DNA, 21 bp, Homo sapiens
ctgctgattcttgtaaatctt

SEQ ID NO: 1586203 - DNA, 21 bp, Homo sapiens
ctgctgcaaaggacagtgggc

SEQ ID NO: 1586204 - DNA, 21 bp, Homo sapiens
ctgctgcaaggtggcctctgc

SEQ ID NO: 1586205 - DNA, 14 bp, Homo sapiens
ctgctgcaccagag

SEQ ID NO: 1586206 - DNA, 15 bp, Homo sapiens
ctgctgcaccagagt

SEQ ID NO: 1586207 - DNA, 16 bp, Homo sapiens
ctgctgcaccagagtg

SEQ ID NO: 1586208 - DNA, 13 bp, Homo sapiens
ctgctgcagccct

SEQ ID NO: 1586209 - DNA, 14 bp, Homo sapiens
ctgctgcagccctg

SEQ ID NO: 1586210 - DNA, 13 bp, Homo sapiens
ctgctgcaggaca

SEQ ID NO: 1586211 - DNA, 18 bp, Homo sapiens
ctgctgcaggacattaat

SEQ ID NO: 1586212 - DNA, 22 bp, Homo sapiens
ctgctgcaggccgtgtgtctgt

SEQ ID NO: 1586213 - DNA, 13 bp, Homo sapiens
ctgctgcatactt

SEQ ID NO: 1586214 - DNA, 16 bp, Homo sapiens
ctgctgcatggggtgg

SEQ ID NO: 1586215 - DNA, 20 bp, Homo sapiens
ctgctgccagcacagtaggt

SEQ ID NO: 1586216 - DNA, 21 bp, Homo sapiens
ctgctgcccccaccccgggga

SEQ ID NO: 1586217 - DNA, 16 bp, Homo sapiens
ctgctgccccgcttcc

SEQ ID NO: 1586218 - DNA, 19 bp, Homo sapiens
ctgctgccccgcttcccca

SEQ ID NO: 1586219 - DNA, 23 bp, Homo sapiens
ctgctgccccgcttccccacaga

SEQ ID NO: 1586220 - DNA, 14 bp, Homo sapiens
ctgctgcccctgca

SEQ ID NO: 1586221 - DNA, 14 bp, Homo sapiens
ctgctgccctccca

SEQ ID NO: 1586222 - DNA, 15 bp, Homo sapiens
ctggacttcctgtca

SEQ ID NO: 1586223 - DNA, 23 bp, Homo sapiens
ctggacttcctgtcattttcaca

SEQ ID NO: 1586224 - DNA, 23 bp, Homo sapiens
ctggacttctacctgccctcaag

SEQ ID NO: 1586225 - DNA, 14 bp, Homo sapiens
ctggactttcctgc

SEQ ID NO: 1586226 - DNA, 16 bp, Homo sapiens
ctggactttcctgcaa

SEQ ID NO: 1586227 - DNA, 18 bp, Homo sapiens
ctggactttcctgcaact

SEQ ID NO: 1586228 - DNA, 18 bp, Homo sapiens
ctggagaaaaaggtgcca

SEQ ID NO: 1586229 - DNA, 14 bp, Homo sapiens
ctggagaaagagct

SEQ ID NO: 1586230 - DNA, 19 bp, Homo sapiens
ctggagaaagagctgcctg

SEQ ID NO: 1586231 - DNA, 15 bp, Homo sapiens
ctggagaactagaga

SEQ ID NO: 1586232 - DNA, 14 bp, Homo sapiens
ctggagaattgact

SEQ ID NO: 1586233 - DNA, 16 bp, Homo sapiens
ctggagacaaggtgct

SEQ ID NO: 1586234 - DNA, 18 bp, Homo sapiens
ctggagaccagggagcct

SEQ ID NO: 1586235 - DNA, 19 bp, Homo sapiens
ctggagaccagggagcctt

SEQ ID NO: 1586236 - DNA, 23 bp, Homo sapiens
ctggagatattataagggagagc

SEQ ID NO: 1586237 - DNA, 15 bp, Homo sapiens
ctggagatgcagcta

SEQ ID NO: 1586238 - DNA, 15 bp, Homo sapiens
ctggagatggatcct

SEQ ID NO: 1586239 - DNA, 19 bp, Homo sapiens
ctggagcaacctactgtct

SEQ ID NO: 1586240 - DNA, 20 bp, Homo sapiens
ctggagcaagaaggaaggag

SEQ ID NO: 1586241 - DNA, 15 bp, Homo sapiens
ctggagcaccaggca

SEQ ID NO: 1586242 - DNA, 13 bp, Homo sapiens
ctggagcagacca

SEQ ID NO: 1586243 - DNA, 13 bp, Homo sapiens
ctggagcagccaa

SEQ ID NO: 1586244 - DNA, 18 bp, Homo sapiens
ctggagcagccaaggccg

SEQ ID NO: 1586245 - DNA, 23 bp, Homo sapiens
ctggagcagcggattgctctgga

SEQ ID NO: 1586246 - DNA, 13 bp, Homo sapiens
ctggagcaggagc

SEQ ID NO: 1586247 - DNA, 16 bp, Homo sapiens
ctggagcaggagcccc

SEQ ID NO: 1586248 - DNA, 16 bp, Homo sapiens
ctggagcatggacagt

SEQ ID NO: 1586249 - DNA, 12 bp, Homo sapiens
ctggagccaggg

SEQ ID NO: 1586250 - DNA, 16 bp, Homo sapiens
ctggagccagggcaga

SEQ ID NO: 1586251 - DNA, 19 bp, Homo sapiens
ctggagccagggcagagga

SEQ ID NO: 1586252 - DNA, 22 bp, Homo sapiens
ctggagccatcccttcggagcc

SEQ ID NO: 1586253 - DNA, 17 bp, Homo sapiens
ctggagcccagaggagg

SEQ ID NO: 1586254 - DNA, 12 bp, Homo sapiens
ctggagcccctg

SEQ ID NO: 1586255 - DNA, 18 bp, Homo sapiens
ctggagcccctgggtggg

SEQ ID NO: 1586256 - DNA, 14 bp, Homo sapiens
ctggagccctaacc

SEQ ID NO: 1586257 - DNA, 24 bp, Homo sapiens
ctggagcctccgacgctgcctctc

SEQ ID NO: 1586258 - DNA, 17 bp, Homo sapiens
ctggagcctgcagatga

SEQ ID NO: 1586259 - DNA, 16 bp, Homo sapiens
ctggagctctgtgggt

SEQ ID NO: 1586260 - DNA, 23 bp, Homo sapiens
ctggagctctgtgggtctctgga

SEQ ID NO: 1586261 - DNA, 21 bp, Homo sapiens
ctggagctcttggaagagctc

SEQ ID NO: 1586262 - DNA, 17 bp, Homo sapiens
ctggagctgggagacaa

SEQ ID NO: 1586263 - DNA, 16 bp, Homo sapiens
ctggagctgtccttca

SEQ ID NO: 1586264 - DNA, 20 bp, Homo sapiens
ctggagcttttaaaaatgtt

SEQ ID NO: 1586265 - DNA, 20 bp, Homo sapiens
ctggaggaaagggaggagtg

SEQ ID NO: 1586266 - DNA, 18 bp, Homo sapiens
ctggaggaacacttgatg

SEQ ID NO: 1586267 - DNA, 19 bp, Homo sapiens
ctggaggaagccagtgggg

SEQ ID NO: 1586268 - DNA, 18 bp, Homo sapiens
ctggaggagcagcttcct

SEQ ID NO: 1586269 - DNA, 16 bp, Homo sapiens
ctggaggagctggcct

SEQ ID NO: 1586270 - DNA, 17 bp, Homo sapiens
ctggaggagctggcctg

SEQ ID NO: 1586271 - DNA, 19 bp, Homo sapiens
ctggaggagctggcctgtg

SEQ ID NO: 1586272 - DNA, 20 bp, Homo sapiens
ctggaggagctggcctgtgg

SEQ ID NO: 1586273 - DNA, 20 bp, Homo sapiens
ctggaggcacgcaccactgc

SEQ ID NO: 1586274 - DNA, 20 bp, Homo sapiens
ctggaggcagggccttgccc

SEQ ID NO: 1586275 - DNA, 22 bp, Homo sapiens
ctggaggcagggccttgcccag

SEQ ID NO: 1586276 - DNA, 21 bp, Homo sapiens
ctggaggcagggggtgagggg

SEQ ID NO: 1586277 - DNA, 18 bp, Homo sapiens
ctggaggcccaggctggg

SEQ ID NO: 1586278 - DNA, 19 bp, Homo sapiens
ctggaggcccaggctggga

SEQ ID NO: 1586279 - DNA, 21 bp, Homo sapiens
ctggaggcccagttcaccctg

SEQ ID NO: 1586280 - DNA, 19 bp, Homo sapiens
ctggaggcccctggagcca

SEQ ID NO: 1586281 - DNA, 12 bp, Homo sapiens
ctggaggccgag

SEQ ID NO: 1586282 - DNA, 14 bp, Homo sapiens
ctggaggcctcagg

SEQ ID NO: 1586283 - DNA, 17 bp, Homo sapiens
ctggaggggagagcttt

SEQ ID NO: 1586284 - DNA, 18 bp, Homo sapiens
ctggaggggagagctttg

SEQ ID NO: 1586285 - DNA, 16 bp, Homo sapiens
ctggaggggcaccagg

SEQ ID NO: 1586286 - DNA, 14 bp, Homo sapiens
ctggaggggcccac

SEQ ID NO: 1586287 - DNA, 12 bp, Homo sapiens
ctggaggggtgg

SEQ ID NO: 1586288 - DNA, 15 bp, Homo sapiens
ctggaggggtgggga

SEQ ID NO: 1586289 - DNA, 16 bp, Homo sapiens
ctggaggggtggggag

SEQ ID NO: 1586290 - DNA, 14 bp, Homo sapiens
ctggaggtcatctg

SEQ ID NO: 1586291 - DNA, 16 bp, Homo sapiens
ctggaggtctggctga

SEQ ID NO: 1586292 - DNA, 17 bp, Homo sapiens
ctggaggtctggctgag

SEQ ID NO: 1586293 - DNA, 18 bp, Homo sapiens
ctggaggtctggctgagc

SEQ ID NO: 1586294 - DNA, 20 bp, Homo sapiens
ctggaggtctggctgagccc

SEQ ID NO: 1586295 - DNA, 15 bp, Homo sapiens
ctggaggtggggttg

SEQ ID NO: 1586296 - DNA, 22 bp, Homo sapiens
ctggaggtggggttgggattgg

SEQ ID NO: 1586297 - DNA, 15 bp, Homo sapiens
ctggagtcagggtga

SEQ ID NO: 1586298 - DNA, 14 bp, Homo sapiens
ctggagtccctgtg

SEQ ID NO: 1586299 - DNA, 18 bp, Homo sapiens
ctggagtctcagagcaca

SEQ ID NO: 1586300 - DNA, 16 bp, Homo sapiens
ctggagtgaggcttcc

SEQ ID NO: 1586301 - DNA, 20 bp, Homo sapiens
ctggagtgaggcttccaggc

SEQ ID NO: 1586302 - DNA, 19 bp, Homo sapiens
ctggagtgcccccagccca

SEQ ID NO: 1586303 - DNA, 19 bp, Homo sapiens
ctggagtgcgctcttggtc

SEQ ID NO: 1586304 - DNA, 20 bp, Homo sapiens
ctggagtgtcggatcctgtg

SEQ ID NO: 1586305 - DNA, 21 bp, Homo sapiens
ctggagtgtcggatcctgtga

SEQ ID NO: 1586306 - DNA, 20 bp, Homo sapiens
ctggagttccttatccctct

SEQ ID NO: 1586307 - DNA, 21 bp, Homo sapiens
ctggagttccttatccctctc

SEQ ID NO: 1586308 - DNA, 20 bp, Homo sapiens
ctggagttgatctggaaccc

SEQ ID NO: 1586309 - DNA, 22 bp, Homo sapiens
ctggagttgatctggaacccag

SEQ ID NO: 1586310 - DNA, 16 bp, Homo sapiens
ctggataaagccactg

SEQ ID NO: 1586311 - DNA, 13 bp, Homo sapiens
ctggatagacttg

SEQ ID NO: 1586312 - DNA, 19 bp, Homo sapiens
ctggattaatgttttgtac

SEQ ID NO: 1586313 - DNA, 21 bp, Homo sapiens
ctggattataagttctatttt

SEQ ID NO: 1586314 - DNA, 23 bp, Homo sapiens
ctggattataagttctattttac

SEQ ID NO: 1586315 - DNA, 16 bp, Homo sapiens
ctggattcatttcctg

SEQ ID NO: 1586316 - DNA, 18 bp, Homo sapiens
ctggattcatttcctgcc

SEQ ID NO: 1586317 - DNA, 19 bp, Homo sapiens
ctggattcatttcctgccc

SEQ ID NO: 1586318 - DNA, 22 bp, Homo sapiens
ctggattccagcagtgaatgct

SEQ ID NO: 1586319 - DNA, 18 bp, Homo sapiens
ctggatttgggagctctg

SEQ ID NO: 1586320 - DNA, 19 bp, Homo sapiens
ctggatttgggagctctgc

SEQ ID NO: 1586321 - DNA, 22 bp, Homo sapiens
ctggatttttttttctttatat

SEQ ID NO: 1586322 - DNA, 18 bp, Homo sapiens
ctggcaaaccctcccaga

SEQ ID NO: 1586323 - DNA, 19 bp, Homo sapiens
ctggcaaagggagcagaac

SEQ ID NO: 1586324 - DNA, 23 bp, Homo sapiens
ctggcaacaacagcttcagtcca

SEQ ID NO: 1586325 - DNA, 22 bp, Homo sapiens
ctggcaacatagtgagatccca

SEQ ID NO: 1586326 - DNA, 19 bp, Homo sapiens
ctggcaatgtttatttcat

SEQ ID NO: 1586327 - DNA, 12 bp, Homo sapiens
ctggcacacatc

SEQ ID NO: 1586328 - DNA, 14 bp, Homo sapiens
ctggcacaggactg

SEQ ID NO: 1586329 - DNA, 15 bp, Homo sapiens
ctggcacaggactga

SEQ ID NO: 1586330 - DNA, 18 bp, Homo sapiens
ctggcacagttttctgag

SEQ ID NO: 1586331 - DNA, 12 bp, Homo sapiens
ctggcacattgt

SEQ ID NO: 1586332 - DNA, 14 bp, Homo sapiens
ctggcaccatcagc

SEQ ID NO: 1586333 - DNA, 17 bp, Homo sapiens
ctggcaccatcagcctg

SEQ ID NO: 1586334 - DNA, 23 bp, Homo sapiens
ctggcacgccctactccactgcc

SEQ ID NO: 1586335 - DNA, 15 bp, Homo sapiens
ctggcactataatgt

SEQ ID NO: 1586336 - DNA, 23 bp, Homo sapiens
ctggcactataatgtaagctcta

SEQ ID NO: 1586337 - DNA, 18 bp, Homo sapiens
ctggcacttagcccaaga

SEQ ID NO: 1586338 - DNA, 23 bp, Homo sapiens
ctggcacttagcccaagaggtct

SEQ ID NO: 1586339 - DNA, 21 bp, Homo sapiens
ctggcagaaagcaaatgtgac

SEQ ID NO: 1586340 - DNA, 12 bp, Homo sapiens
ctggcagaagca

SEQ ID NO: 1586341 - DNA, 20 bp, Homo sapiens
ctggcagacacaacccaata

SEQ ID NO: 1586342 - DNA, 13 bp, Homo sapiens
ctggcagcagcag

SEQ ID NO: 1586343 - DNA, 13 bp, Homo sapiens
ctggcagccgtgc

SEQ ID NO: 1586344 - DNA, 19 bp, Homo sapiens
ctggcagccgtgccttcag

SEQ ID NO: 1586345 - DNA, 12 bp, Homo sapiens
ctggcagcctgc

SEQ ID NO: 1586346 - DNA, 17 bp, Homo sapiens
ctggcagcctgcacctg

SEQ ID NO: 1586347 - DNA, 19 bp, Homo sapiens
ctggcagctcctctccttg

SEQ ID NO: 1586348 - DNA, 21 bp, Homo sapiens
ctggcagctcctctccttggg

SEQ ID NO: 1586349 - DNA, 17 bp, Homo sapiens
ctggcagctctggacag

SEQ ID NO: 1586350 - DNA, 18 bp, Homo sapiens
ctggcagctctggacagc

SEQ ID NO: 1586351 - DNA, 12 bp, Homo sapiens
ctggcagctgag

SEQ ID NO: 1586352 - DNA, 15 bp, Homo sapiens
ctggcagctgagagc

SEQ ID NO: 1586353 - DNA, 20 bp, Homo sapiens
ctggcagggacctgagagca

SEQ ID NO: 1586354 - DNA, 19 bp, Homo sapiens
ctggcaggggagacaggag

SEQ ID NO: 1586355 - DNA, 20 bp, Homo sapiens
ctggcaggggagacaggagc

SEQ ID NO: 1586356 - DNA, 17 bp, Homo sapiens
ctggcagggtgggatgg

SEQ ID NO: 1586357 - DNA, 22 bp, Homo sapiens
ctggcaggtgcagatgggctgt

SEQ ID NO: 1586358 - DNA, 20 bp, Homo sapiens
ctggcaggtggccaggcagg

SEQ ID NO: 1586359 - DNA, 23 bp, Homo sapiens
ctggcaggtgttgggacctgctg

SEQ ID NO: 1586360 - DNA, 15 bp, Homo sapiens
ctggcataactaaaa

SEQ ID NO: 1586361 - DNA, 22 bp, Homo sapiens
ctggcatcaagaggtgggaggg

SEQ ID NO: 1586362 - DNA, 18 bp, Homo sapiens
ctggcatcgcaccattct

SEQ ID NO: 1586363 - DNA, 20 bp, Homo sapiens
ctggcatcgcaccattctga

SEQ ID NO: 1586364 - DNA, 22 bp, Homo sapiens
ctggcatcgcaccattctgact

SEQ ID NO: 1586365 - DNA, 14 bp, Homo sapiens
ctggcatctgctct

SEQ ID NO: 1586366 - DNA, 16 bp, Homo sapiens
ctggcatcttctggag

SEQ ID NO: 1586367 - DNA, 23 bp, Homo sapiens
ctggcattacaggtgtgagccac

SEQ ID NO: 1586368 - DNA, 18 bp, Homo sapiens
ctggcattagaattattt

SEQ ID NO: 1586369 - DNA, 18 bp, Homo sapiens
ctggccaaacccttgctt

SEQ ID NO: 1586370 - DNA, 20 bp, Homo sapiens
ctggccaaagagcctttcca

SEQ ID NO: 1586371 - DNA, 13 bp, Homo sapiens
ctggccaacatgg

SEQ ID NO: 1586372 - DNA, 18 bp, Homo sapiens
ctggccaaggtgtccagg

SEQ ID NO: 1586373 - DNA, 21 bp, Homo sapiens
ctggccacaaggaaaaggagg

SEQ ID NO: 1586374 - DNA, 24 bp, Homo sapiens
ctggccacaaggaaaaggaggagg

SEQ ID NO: 1586375 - DNA, 20 bp, Homo sapiens
ctggccacaaggacgctggc

SEQ ID NO: 1586376 - DNA, 13 bp, Homo sapiens
ctggccaccaggc

SEQ ID NO: 1586377 - DNA, 17 bp, Homo sapiens
ctggccaccatggtcat

SEQ ID NO: 1586378 - DNA, 21 bp, Homo sapiens
ctggccacctagaagtctccc

SEQ ID NO: 1586379 - DNA, 16 bp, Homo sapiens
ctggccacctctctcc

SEQ ID NO: 1586380 - DNA, 18 bp, Homo sapiens
ctggccacgcagccagga

SEQ ID NO: 1586381 - DNA, 20 bp, Homo sapiens
ctggccacgcagccaggaca

SEQ ID NO: 1586382 - DNA, 17 bp, Homo sapiens
ctggccactaaagcttc

SEQ ID NO: 1586383 - DNA, 18 bp, Homo sapiens
ctggccactaaagcttca

SEQ ID NO: 1586384 - DNA, 20 bp, Homo sapiens
ctggccactaaagcttcaga

SEQ ID NO: 1586385 - DNA, 13 bp, Homo sapiens
ctggccagaatgc

SEQ ID NO: 1586386 - DNA, 17 bp, Homo sapiens
ctggccagacacaggcc

SEQ ID NO: 1586387 - DNA, 19 bp, Homo sapiens
ctggccagacacaggccct

SEQ ID NO: 1586388 - DNA, 11 bp, Homo sapiens
ctggccagaga

SEQ ID NO: 1586389 - DNA, 23 bp, Homo sapiens
ctggccagagagggcccagctgt

SEQ ID NO: 1586390 - DNA, 14 bp, Homo sapiens
ctggccaggagcag

SEQ ID NO: 1586391 - DNA, 13 bp, Homo sapiens
ctggccaggagct

SEQ ID NO: 1586392 - DNA, 20 bp, Homo sapiens
ctggccaggagctcttcagg

SEQ ID NO: 1586393 - DNA, 11 bp, Homo sapiens
ctggccaggca

SEQ ID NO: 1586394 - DNA, 14 bp, Homo sapiens
ctggccaggccctg

SEQ ID NO: 1586395 - DNA, 14 bp, Homo sapiens
ctggccagggccac

SEQ ID NO: 1586396 - DNA, 17 bp, Homo sapiens
ctggccagggccacgct

SEQ ID NO: 1586397 - DNA, 18 bp, Homo sapiens
ctggccagggccacgctc

SEQ ID NO: 1586398 - DNA, 23 bp, Homo sapiens
ctggccagggccacgctccagct

SEQ ID NO: 1586399 - DNA, 13 bp, Homo sapiens
ctggccaggggtc

SEQ ID NO: 1586400 - DNA, 18 bp, Homo sapiens
ctggccagtccaggctgc

SEQ ID NO: 1586401 - DNA, 19 bp, Homo sapiens
ctggccagtccaggctgcc

SEQ ID NO: 1586402 - DNA, 22 bp, Homo sapiens
ctggccagtccaggctgccgtg

SEQ ID NO: 1586403 - DNA, 18 bp, Homo sapiens
ctggccagtcctggtcct

SEQ ID NO: 1586404 - DNA, 16 bp, Homo sapiens
ctggccagtcttcctc

SEQ ID NO: 1586405 - DNA, 13 bp, Homo sapiens
ctggctctccaag

SEQ ID NO: 1586406 - DNA, 18 bp, Homo sapiens
ctggctctgccccctccc

SEQ ID NO: 1586407 - DNA, 20 bp, Homo sapiens
ctggctctgccccctccccc

SEQ ID NO: 1586408 - DNA, 21 bp, Homo sapiens
ctggctctgccccctccccca

SEQ ID NO: 1586409 - DNA, 12 bp, Homo sapiens
ctggctctgtga

SEQ ID NO: 1586410 - DNA, 21 bp, Homo sapiens
ctggctcttgatacccccctc

SEQ ID NO: 1586411 - DNA, 23 bp, Homo sapiens
ctggctcttgatacccccctctg

SEQ ID NO: 1586412 - DNA, 17 bp, Homo sapiens
ctggctgaaccctgtgc

SEQ ID NO: 1586413 - DNA, 23 bp, Homo sapiens
ctggctgaaccctgtgctggtgt

SEQ ID NO: 1586414 - DNA, 20 bp, Homo sapiens
ctggctgagcccctggggaa

SEQ ID NO: 1586415 - DNA, 21 bp, Homo sapiens
ctggctgagtggaatgcaggg

SEQ ID NO: 1586416 - DNA, 24 bp, Homo sapiens
ctggctgagtggaatgcagggaag

SEQ ID NO: 1586417 - DNA, 18 bp, Homo sapiens
ctggctgatgatccagaa

SEQ ID NO: 1586418 - DNA, 14 bp, Homo sapiens
ctggctgcactctt

SEQ ID NO: 1586419 - DNA, 13 bp, Homo sapiens
ctggctgcagtga

SEQ ID NO: 1586420 - DNA, 17 bp, Homo sapiens
ctggctgccaggcgttg

SEQ ID NO: 1586421 - DNA, 23 bp, Homo sapiens
ctggctgccaggcgttggtgcca

SEQ ID NO: 1586422 - DNA, 20 bp, Homo sapiens
ctggctgccccaacctgctg

SEQ ID NO: 1586423 - DNA, 14 bp, Homo sapiens
ctggctgccctggc

SEQ ID NO: 1586424 - DNA, 16 bp, Homo sapiens
ctggctgccctggccc

SEQ ID NO: 1586425 - DNA, 17 bp, Homo sapiens
ctggctgccctggccct

SEQ ID NO: 1586426 - DNA, 18 bp, Homo sapiens
ctggctgccctggccctg

SEQ ID NO: 1586427 - DNA, 20 bp, Homo sapiens
ctggctgccctggccctgag

SEQ ID NO: 1586428 - DNA, 19 bp, Homo sapiens
ctggctgccttagaacctt

SEQ ID NO: 1586429 - DNA, 13 bp, Homo sapiens
ctggctgctgccc

SEQ ID NO: 1586430 - DNA, 17 bp, Homo sapiens
ctggctggagagctgct

SEQ ID NO: 1586431 - DNA, 20 bp, Homo sapiens
ctggctggagtctcagagca

SEQ ID NO: 1586432 - DNA, 15 bp, Homo sapiens
ctggctggcaggtgt

SEQ ID NO: 1586433 - DNA, 17 bp, Homo sapiens
ctggctggcctcaccca

SEQ ID NO: 1586434 - DNA, 14 bp, Homo sapiens
ctggctgggcatgg

SEQ ID NO: 1586435 - DNA, 17 bp, Homo sapiens
ctggctgggcatggacg

SEQ ID NO: 1586436 - DNA, 15 bp, Homo sapiens
ctggctgggccttca

SEQ ID NO: 1586437 - DNA, 20 bp, Homo sapiens
ctggctgggctggctgaaga

SEQ ID NO: 1586438 - DNA, 13 bp, Homo sapiens
ctggctggggcag

SEQ ID NO: 1586439 - DNA, 22 bp, Homo sapiens
ctggctggggcagaggggcagc

SEQ ID NO: 1586440 - DNA, 23 bp, Homo sapiens
ctggctggtgggaaggccggcag

SEQ ID NO: 1586441 - DNA, 15 bp, Homo sapiens
ctggctgtaaggctc

SEQ ID NO: 1586442 - DNA, 19 bp, Homo sapiens
ctggctgtcagtatgacat

SEQ ID NO: 1586443 - DNA, 16 bp, Homo sapiens
ctggctgtctagaatg

SEQ ID NO: 1586444 - DNA, 17 bp, Homo sapiens
ctggctgtctagaatgt

SEQ ID NO: 1586445 - DNA, 19 bp, Homo sapiens
ctggctgtgacacctggtg

SEQ ID NO: 1586446 - DNA, 13 bp, Homo sapiens
ctggctgtgagca

SEQ ID NO: 1586447 - DNA, 16 bp, Homo sapiens
ctggctgtgagcagcc

SEQ ID NO: 1586448 - DNA, 14 bp, Homo sapiens
ctggctgtgcccag

SEQ ID NO: 1586449 - DNA, 20 bp, Homo sapiens
ctggctgtgcccagcaggcc

SEQ ID NO: 1586450 - DNA, 21 bp, Homo sapiens
ctggctgtgcccagcaggccc

SEQ ID NO: 1586451 - DNA, 18 bp, Homo sapiens
ctggctgtggaggcctga

SEQ ID NO: 1586452 - DNA, 21 bp, Homo sapiens
ctggctgtggaggcctgatgc

SEQ ID NO: 1586453 - DNA, 22 bp, Homo sapiens
ctggctgtggaggcctgatgct

SEQ ID NO: 1586454 - DNA, 23 bp, Homo sapiens
ctggctgttctgtggttcctctg

SEQ ID NO: 1586455 - DNA, 12 bp, Homo sapiens
ctggctgtttga

SEQ ID NO: 1586456 - DNA, 20 bp, Homo sapiens
ctggcttacctatctgtgga

SEQ ID NO: 1586457 - DNA, 21 bp, Homo sapiens
ctggcttcagcccccaccagg

SEQ ID NO: 1586458 - DNA, 14 bp, Homo sapiens
ctggcttccctgga

SEQ ID NO: 1586459 - DNA, 15 bp, Homo sapiens
ctggcttccctggaa

SEQ ID NO: 1586460 - DNA, 20 bp, Homo sapiens
ctggcttctctcttttcctc

SEQ ID NO: 1586461 - DNA, 18 bp, Homo sapiens
ctggcttctgcttgtcat

SEQ ID NO: 1586462 - DNA, 15 bp, Homo sapiens
ctggcttctggagcc

SEQ ID NO: 1586463 - DNA, 16 bp, Homo sapiens
ctggcttctggagccc

SEQ ID NO: 1586464 - DNA, 20 bp, Homo sapiens
ctggcttctggagcccttgg

SEQ ID NO: 1586465 - DNA, 14 bp, Homo sapiens
ctggcttctgtgca

SEQ ID NO: 1586466 - DNA, 21 bp, Homo sapiens
ctggcttgaaggactgcagac

SEQ ID NO: 1586467 - DNA, 22 bp, Homo sapiens
ctggcttgaaggactgcagaca

SEQ ID NO: 1586468 - DNA, 22 bp, Homo sapiens
ctggcttgctccagggtcttgg

SEQ ID NO: 1586469 - DNA, 19 bp, Homo sapiens
ctggcttgtaactccacca

SEQ ID NO: 1586470 - DNA, 13 bp, Homo sapiens
ctggcttgtacat

SEQ ID NO: 1586471 - DNA, 15 bp, Homo sapiens
ctggctttctctctg

SEQ ID NO: 1586472 - DNA, 15 bp, Homo sapiens
ctggctttgcctctt

SEQ ID NO: 1586473 - DNA, 20 bp, Homo sapiens
ctggctttggtgaactgttg

SEQ ID NO: 1586474 - DNA, 19 bp, Homo sapiens
ctggcttttgcctgtaaga

SEQ ID NO: 1586475 - DNA, 20 bp, Homo sapiens
ctggctttttctgccactga

SEQ ID NO: 1586476 - DNA, 23 bp, Homo sapiens
ctgggaaaaaagttttgatgaaa

SEQ ID NO: 1586477 - DNA, 22 bp, Homo sapiens
ctgggaaaaactttggaaccag

SEQ ID NO: 1586478 - DNA, 9 bp, Homo sapiens
ctgggaaac

SEQ ID NO: 1586479 - DNA, 20 bp, Homo sapiens
ctgggaaaggacccacccat

SEQ ID NO: 1586480 - DNA, 14 bp, Homo sapiens
ctgggaaccactcc

SEQ ID NO: 1586481 - DNA, 20 bp, Homo sapiens
ctgggaaccactcccaccac

SEQ ID NO: 1586482 - DNA, 13 bp, Homo sapiens
ctgggaaccccgc

SEQ ID NO: 1586483 - DNA, 17 bp, Homo sapiens
ctgggaactcatctggt

SEQ ID NO: 1586484 - DNA, 22 bp, Homo sapiens
ctgggaagataggctctgcaca

SEQ ID NO: 1586485 - DNA, 20 bp, Homo sapiens
ctgggaagcctgtgccagca

SEQ ID NO: 1586486 - DNA, 23 bp, Homo sapiens
ctgggaagctgtactcagagcag

SEQ ID NO: 1586487 - DNA, 19 bp, Homo sapiens
ctgggaagcttgagcctcc

SEQ ID NO: 1586488 - DNA, 20 bp, Homo sapiens
ctgggaagcttgagcctccc

SEQ ID NO: 1586489 - DNA, 23 bp, Homo sapiens
ctgggaagcttgagcctccccca

SEQ ID NO: 1586490 - DNA, 17 bp, Homo sapiens
ctgggaaggagggagct

SEQ ID NO: 1586491 - DNA, 22 bp, Homo sapiens
ctgggaaggagggagctgctca

SEQ ID NO: 1586492 - DNA, 23 bp, Homo sapiens
ctgggaaggagggagctgctcag

SEQ ID NO: 1586493 - DNA, 17 bp, Homo sapiens
ctgggaaggccacctcc

SEQ ID NO: 1586494 - DNA, 16 bp, Homo sapiens
ctgggaatgggagagg

SEQ ID NO: 1586495 - DNA, 18 bp, Homo sapiens
ctgggaatgggagagggg

SEQ ID NO: 1586496 - DNA, 15 bp, Homo sapiens
ctgggaatggggaca

SEQ ID NO: 1586497 - DNA, 18 bp, Homo sapiens
ctgggaatggggacacgg

SEQ ID NO: 1586498 - DNA, 23 bp, Homo sapiens
ctgggaatgggggagagaaggga

SEQ ID NO: 1586499 - DNA, 19 bp, Homo sapiens
ctgggaatgtattattctg

SEQ ID NO: 1586500 - DNA, 19 bp, Homo sapiens
ctgggacacttaacagatg

SEQ ID NO: 1586501 - DNA, 14 bp, Homo sapiens
ctgggacagctggc

SEQ ID NO: 1586502 - DNA, 16 bp, Homo sapiens
ctgggacagctggctg

SEQ ID NO: 1586503 - DNA, 12 bp, Homo sapiens
ctgggaccagag

SEQ ID NO: 1586504 - DNA, 15 bp, Homo sapiens
ctgggacccacctcc

SEQ ID NO: 1586505 - DNA, 17 bp, Homo sapiens
ctgggacccagctactc

SEQ ID NO: 1586506 - DNA, 21 bp, Homo sapiens
ctgggacccgaggatttctgg

SEQ ID NO: 1586507 - DNA, 12 bp, Homo sapiens
ctggccccagcc

SEQ ID NO: 1586508 - DNA, 20 bp, Homo sapiens
ctggccccaggtagaaactt

SEQ ID NO: 1586509 - DNA, 16 bp, Homo sapiens
ctggccccatgtctct

SEQ ID NO: 1586510 - DNA, 23 bp, Homo sapiens
ctggcccccaacctcagggctcc

SEQ ID NO: 1586511 - DNA, 11 bp, Homo sapiens
ctggcccccag

SEQ ID NO: 1586512 - DNA, 16 bp, Homo sapiens
ctggccccgcctgcct

SEQ ID NO: 1586513 - DNA, 20 bp, Homo sapiens
ctggccccgcctgcctgcca

SEQ ID NO: 1586514 - DNA, 21 bp, Homo sapiens
ctggccccgggctctggccac

SEQ ID NO: 1586515 - DNA, 18 bp, Homo sapiens
ctggcccgtcatgttcct

SEQ ID NO: 1586516 - DNA, 22 bp, Homo sapiens
ctggcccgtcatgttcctcaaa

SEQ ID NO: 1586517 - DNA, 17 bp, Homo sapiens
ctggccctcacccctgc

SEQ ID NO: 1586518 - DNA, 16 bp, Homo sapiens
ctggccctcagtttcc

SEQ ID NO: 1586519 - DNA, 21 bp, Homo sapiens
ctggccctccactcctcatcc

SEQ ID NO: 1586520 - DNA, 11 bp, Homo sapiens
ctggccctgcc

SEQ ID NO: 1586521 - DNA, 21 bp, Homo sapiens
ctggccctgcttcctgcttgc

SEQ ID NO: 1586522 - DNA, 22 bp, Homo sapiens
ctggccctgcttcctgcttgcc

SEQ ID NO: 1586523 - DNA, 14 bp, Homo sapiens
ctggccctggggat

SEQ ID NO: 1586524 - DNA, 15 bp, Homo sapiens
ctggccctgttctcc

SEQ ID NO: 1586525 - DNA, 14 bp, Homo sapiens
ctggcccttcagtc

SEQ ID NO: 1586526 - DNA, 17 bp, Homo sapiens
ctggcccttcagtctgc

SEQ ID NO: 1586527 - DNA, 18 bp, Homo sapiens
ctggcccttcagtctgct

SEQ ID NO: 1586528 - DNA, 19 bp, Homo sapiens
ctggcccttcagtctgctc

SEQ ID NO: 1586529 - DNA, 21 bp, Homo sapiens
ctggcccttcagtctgctcca

SEQ ID NO: 1586530 - DNA, 23 bp, Homo sapiens
ctggcccttcagtctgctccacc

SEQ ID NO: 1586531 - DNA, 21 bp, Homo sapiens
ctggccgagggtcctggctcc

SEQ ID NO: 1586532 - DNA, 13 bp, Homo sapiens
ctggccgccaccc

SEQ ID NO: 1586533 - DNA, 13 bp, Homo sapiens
ctggccgccccct

SEQ ID NO: 1586534 - DNA, 16 bp, Homo sapiens
ctggccgctaagttgc

SEQ ID NO: 1586535 - DNA, 23 bp, Homo sapiens
ctggccggctccagtttccccat

SEQ ID NO: 1586536 - DNA, 14 bp, Homo sapiens
ctggccggtgctgg

SEQ ID NO: 1586537 - DNA, 21 bp, Homo sapiens
ctggccggtgctgggttccca

SEQ ID NO: 1586538 - DNA, 16 bp, Homo sapiens
ctggccgttcagcctg

SEQ ID NO: 1586539 - DNA, 19 bp, Homo sapiens
ctggccgttcagcctgtct

SEQ ID NO: 1586540 - DNA, 19 bp, Homo sapiens
ctggcctagaccagcagac

SEQ ID NO: 1586541 - DNA, 22 bp, Homo sapiens
ctggcctagaccagcagacaga

SEQ ID NO: 1586542 - DNA, 19 bp, Homo sapiens
ctggcctaggggccagggc

SEQ ID NO: 1586543 - DNA, 14 bp, Homo sapiens
ctggcctcactggc

SEQ ID NO: 1586544 - DNA, 14 bp, Homo sapiens
ctggcctccagctc

SEQ ID NO: 1586545 - DNA, 18 bp, Homo sapiens
ctggcctccagctcccac

SEQ ID NO: 1586546 - DNA, 20 bp, Homo sapiens
ctggcctccagctcccactc

SEQ ID NO: 1586547 - DNA, 17 bp, Homo sapiens
ctggcctcccacccgat

SEQ ID NO: 1586548 - DNA, 16 bp, Homo sapiens
ctggcctcccctgcca

SEQ ID NO: 1586549 - DNA, 14 bp, Homo sapiens
ctggcctctgcttt

SEQ ID NO: 1586550 - DNA, 21 bp, Homo sapiens
ctggcctctgggcagtgtggc

SEQ ID NO: 1586551 - DNA, 11 bp, Homo sapiens
ctggcctctgt

SEQ ID NO: 1586552 - DNA, 18 bp, Homo sapiens
ctggcctgaactgaggag

SEQ ID NO: 1586553 - DNA, 12 bp, Homo sapiens
ctggcctgagct

SEQ ID NO: 1586554 - DNA, 14 bp, Homo sapiens
ctggcctgagctgg

SEQ ID NO: 1586555 - DNA, 14 bp, Homo sapiens
ctggcctgctggga

SEQ ID NO: 1586556 - DNA, 17 bp, Homo sapiens
ctggcctgctgggaacc

SEQ ID NO: 1586557 - DNA, 23 bp, Homo sapiens
ctggcctgctgggaaccccgcag

SEQ ID NO: 1586558 - DNA, 19 bp, Homo sapiens
ctggcctgctgggctctcc

SEQ ID NO: 1586559 - DNA, 20 bp, Homo sapiens
ctggcctgctgggctctcca

SEQ ID NO: 1586560 - DNA, 22 bp, Homo sapiens
ctggcctggactgttttctctc

SEQ ID NO: 1586561 - DNA, 12 bp, Homo sapiens
ctggcctggatc

SEQ ID NO: 1586562 - DNA, 21 bp, Homo sapiens
ctggcctggatctccccactc

SEQ ID NO: 1586563 - DNA, 13 bp, Homo sapiens
ctggcctggcaca

SEQ ID NO: 1586564 - DNA, 16 bp, Homo sapiens
ctggcctggcacacat

SEQ ID NO: 1586565 - DNA, 18 bp, Homo sapiens
ctggcctggcacacatca

SEQ ID NO: 1586566 - DNA, 22 bp, Homo sapiens
ctggcctggcacacatcaggag

SEQ ID NO: 1586567 - DNA, 19 bp, Homo sapiens
ctggcctggctccccacga

SEQ ID NO: 1586568 - DNA, 17 bp, Homo sapiens
ctggcctgggccacacc

SEQ ID NO: 1586569 - DNA, 21 bp, Homo sapiens
ctggcctggtccctggtcctt

SEQ ID NO: 1586570 - DNA, 16 bp, Homo sapiens
ctggcctgtggcacag

SEQ ID NO: 1586571 - DNA, 22 bp, Homo sapiens
ctggccttaaaaggggcccaag

SEQ ID NO: 1586572 - DNA, 19 bp, Homo sapiens
ctggcctttttcatttatc

SEQ ID NO: 1586573 - DNA, 13 bp, Homo sapiens
ctggcgcagccaa

SEQ ID NO: 1586574 - DNA, 16 bp, Homo sapiens
ctggcgcagccaaggc

SEQ ID NO: 1586575 - DNA, 15 bp, Homo sapiens
ctggcgcctccgagg

SEQ ID NO: 1586576 - DNA, 13 bp, Homo sapiens
ctggcgccttctc

SEQ ID NO: 1586577 - DNA, 16 bp, Homo sapiens
ctggcgccttctcgga

SEQ ID NO: 1586578 - DNA, 19 bp, Homo sapiens
ctggcggagatgggtcctg

SEQ ID NO: 1586579 - DNA, 22 bp, Homo sapiens
ctggcggcccttctgactgttt

SEQ ID NO: 1586580 - DNA, 23 bp, Homo sapiens
ctggcggcccttctgactgttta

SEQ ID NO: 1586581 - DNA, 16 bp, Homo sapiens
ctggcggctactcagc

SEQ ID NO: 1586582 - DNA, 23 bp, Homo sapiens
ctggcggctactcagcagccctc

SEQ ID NO: 1586583 - DNA, 18 bp, Homo sapiens
ctggcggcttcctgtcca

SEQ ID NO: 1586584 - DNA, 19 bp, Homo sapiens
ctggcggcttcctgtccac

SEQ ID NO: 1586585 - DNA, 13 bp, Homo sapiens
ctggcgtgctcag

SEQ ID NO: 1586586 - DNA, 16 bp, Homo sapiens
ctggcgtgctcagacc

SEQ ID NO: 1586587 - DNA, 16 bp, Homo sapiens
ctggcgttctcaagaa

SEQ ID NO: 1586588 - DNA, 21 bp, Homo sapiens
ctggctacagtaccatgcctc

SEQ ID NO: 1586589 - DNA, 12 bp, Homo sapiens
ctggctacatcc

SEQ ID NO: 1586590 - DNA, 14 bp, Homo sapiens
ctggctactgtcta

SEQ ID NO: 1586591 - DNA, 21 bp, Homo sapiens
ctggctactgtctattaaaat

SEQ ID NO: 1586592 - DNA, 17 bp, Homo sapiens
ctggctacttcccttcc

SEQ ID NO: 1586593 - DNA, 18 bp, Homo sapiens
ctggctacttcccttcct

SEQ ID NO: 1586594 - DNA, 14 bp, Homo sapiens
ctggctagagccga

SEQ ID NO: 1586595 - DNA, 17 bp, Homo sapiens
ctggctagagccgaggg

SEQ ID NO: 1586596 - DNA, 17 bp, Homo sapiens
ctggctagagtcctcac

SEQ ID NO: 1586597 - DNA, 20 bp, Homo sapiens
ctggctagagtcctcactcc

SEQ ID NO: 1586598 - DNA, 21 bp, Homo sapiens
ctggctagagtcctcactccc

SEQ ID NO: 1586599 - DNA, 19 bp, Homo sapiens
ctggctcactggcaggtgt

SEQ ID NO: 1586600 - DNA, 15 bp, Homo sapiens
ctggctcaggcccag

SEQ ID NO: 1586601 - DNA, 20 bp, Homo sapiens
ctggctcagggtcaaagaca

SEQ ID NO: 1586602 - DNA, 14 bp, Homo sapiens
ctggctccactctt

SEQ ID NO: 1586603 - DNA, 23 bp, Homo sapiens
ctggctccactcttgatctctct

SEQ ID NO: 1586604 - DNA, 18 bp, Homo sapiens
ctggctccaggcagaagg

SEQ ID NO: 1586605 - DNA, 14 bp, Homo sapiens
ctgggacctcctta

SEQ ID NO: 1586606 - DNA, 19 bp, Homo sapiens
ctgggacctgccaggcagg

SEQ ID NO: 1586607 - DNA, 20 bp, Homo sapiens
ctgggacctgccaggcaggg

SEQ ID NO: 1586608 - DNA, 23 bp, Homo sapiens
ctgggaccttctttattctgtgt

SEQ ID NO: 1586609 - DNA, 20 bp, Homo sapiens
ctgggacgtggacatgcctc

SEQ ID NO: 1586610 - DNA, 17 bp, Homo sapiens
ctgggactacaggcgcc

SEQ ID NO: 1586611 - DNA, 22 bp, Homo sapiens
ctgggactacaggctcatgcca

SEQ ID NO: 1586612 - DNA, 21 bp, Homo sapiens
ctgggactcagccttcagaca

SEQ ID NO: 1586613 - DNA, 13 bp, Homo sapiens
ctgggactctcct

SEQ ID NO: 1586614 - DNA, 16 bp, Homo sapiens
ctgggactctcctcct

SEQ ID NO: 1586615 - DNA, 19 bp, Homo sapiens
ctgggactctcctcctccc

SEQ ID NO: 1586616 - DNA, 20 bp, Homo sapiens
ctgggactctcctcctcccc

SEQ ID NO: 1586617 - DNA, 23 bp, Homo sapiens
ctgggactctcctcctcccctcc

SEQ ID NO: 1586618 - DNA, 14 bp, Homo sapiens
ctgggactgagcca

SEQ ID NO: 1586619 - DNA, 16 bp, Homo sapiens
ctgggactgagccagt

SEQ ID NO: 1586620 - DNA, 14 bp, Homo sapiens
ctgggacttccatg

SEQ ID NO: 1586621 - DNA, 17 bp, Homo sapiens
ctgggacttccatgcct

SEQ ID NO: 1586622 - DNA, 15 bp, Homo sapiens
ctgggagaaaatcat

SEQ ID NO: 1586623 - DNA, 19 bp, Homo sapiens
ctgggagaaaatcatcaag

SEQ ID NO: 1586624 - DNA, 14 bp, Homo sapiens
ctgggagaacctca

SEQ ID NO: 1586625 - DNA, 15 bp, Homo sapiens
ctgggagaacctcag

SEQ ID NO: 1586626 - DNA, 12 bp, Homo sapiens
ctgggagaccct

SEQ ID NO: 1586627 - DNA, 22 bp, Homo sapiens
ctgggagccacttctccccaga

SEQ ID NO: 1586628 - DNA, 12 bp, Homo sapiens
ctgggagcccag

SEQ ID NO: 1586629 - DNA, 13 bp, Homo sapiens
ctgggagcccaga

SEQ ID NO: 1586630 - DNA, 17 bp, Homo sapiens
ctgggagctccactctg

SEQ ID NO: 1586631 - DNA, 14 bp, Homo sapiens
ctgggaggaagcag

SEQ ID NO: 1586632 - DNA, 21 bp, Homo sapiens
ctgggaggaagcaggttgagg

SEQ ID NO: 1586633 - DNA, 14 bp, Homo sapiens
ctgggaggaaggac

SEQ ID NO: 1586634 - DNA, 17 bp, Homo sapiens
ctgggaggagggagagg

SEQ ID NO: 1586635 - DNA, 19 bp, Homo sapiens
ctgggaggagggagaggga

SEQ ID NO: 1586636 - DNA, 18 bp, Homo sapiens
ctgggaggcaagaaaagg

SEQ ID NO: 1586637 - DNA, 23 bp, Homo sapiens
ctgggaggcaagaggggtggaga

SEQ ID NO: 1586638 - DNA, 13 bp, Homo sapiens
ctgggaggcagag

SEQ ID NO: 1586639 - DNA, 20 bp, Homo sapiens
ctgggagggttcccctggcc

SEQ ID NO: 1586640 - DNA, 12 bp, Homo sapiens
ctgggaggtaga

SEQ ID NO: 1586641 - DNA, 23 bp, Homo sapiens
ctgggagtagttgtctttcctgg

SEQ ID NO: 1586642 - DNA, 16 bp, Homo sapiens
ctgggagtcacacagt

SEQ ID NO: 1586643 - DNA, 17 bp, Homo sapiens
ctgggagtcacacagtg

SEQ ID NO: 1586644 - DNA, 22 bp, Homo sapiens
ctgggatatatggaggattctt

SEQ ID NO: 1586645 - DNA, 18 bp, Homo sapiens
ctgggatatggctgccca

SEQ ID NO: 1586646 - DNA, 22 bp, Homo sapiens
ctgggatatggctgcccaggag

SEQ ID NO: 1586647 - DNA, 21 bp, Homo sapiens
ctgggatctggcacactccct

SEQ ID NO: 1586648 - DNA, 19 bp, Homo sapiens
ctgggatctgttttctgga

SEQ ID NO: 1586649 - DNA, 18 bp, Homo sapiens
ctgggatgggctcccacc

SEQ ID NO: 1586650 - DNA, 14 bp, Homo sapiens
ctgggatgtaaacc

SEQ ID NO: 1586651 - DNA, 17 bp, Homo sapiens
ctgggatgtagaacttc

SEQ ID NO: 1586652 - DNA, 21 bp, Homo sapiens
ctgggatgtccacagatgcct

SEQ ID NO: 1586653 - DNA, 19 bp, Homo sapiens
ctgggattaagaaaccttg

SEQ ID NO: 1586654 - DNA, 20 bp, Homo sapiens
ctgggattaagaaaccttgc

SEQ ID NO: 1586655 - DNA, 14 bp, Homo sapiens
ctgggatttgagat

SEQ ID NO: 1586656 - DNA, 15 bp, Homo sapiens
ctgggcaaacagagc

SEQ ID NO: 1586657 - DNA, 17 bp, Homo sapiens
ctgggcaaacagagcta

SEQ ID NO: 1586658 - DNA, 22 bp, Homo sapiens
ctgggcaaacagagctactgag

SEQ ID NO: 1586659 - DNA, 23 bp, Homo sapiens
ctgggcaaacagagctactgaga

SEQ ID NO: 1586660 - DNA, 22 bp, Homo sapiens
ctgggcaccacctctgtgggca

SEQ ID NO: 1586661 - DNA, 18 bp, Homo sapiens
ctgggcacccacctccac

SEQ ID NO: 1586662 - DNA, 16 bp, Homo sapiens
ctgggcaccctcccac

SEQ ID NO: 1586663 - DNA, 17 bp, Homo sapiens
ctgggcaccgggacccc

SEQ ID NO: 1586664 - DNA, 18 bp, Homo sapiens
ctgggcacctgcgcacag

SEQ ID NO: 1586665 - DNA, 19 bp, Homo sapiens
ctgggcacctgcgcacagg

SEQ ID NO: 1586666 - DNA, 21 bp, Homo sapiens
ctgggcacctgcgcacaggtg

SEQ ID NO: 1586667 - DNA, 14 bp, Homo sapiens
ctgggcagcaaggc

SEQ ID NO: 1586668 - DNA, 17 bp, Homo sapiens
ctgggcagcatagcaag

SEQ ID NO: 1586669 - DNA, 16 bp, Homo sapiens
ctgggcagccaggctg

SEQ ID NO: 1586670 - DNA, 13 bp, Homo sapiens
ctgggcagggtga

SEQ ID NO: 1586671 - DNA, 15 bp, Homo sapiens
ctgggcaggtgggag

SEQ ID NO: 1586672 - DNA, 18 bp, Homo sapiens
ctgggcaggtgggagctg

SEQ ID NO: 1586673 - DNA, 14 bp, Homo sapiens
ctgggcagtgtggc

SEQ ID NO: 1586674 - DNA, 15 bp, Homo sapiens
ctgggcagtgtggcc

SEQ ID NO: 1586675 - DNA, 20 bp, Homo sapiens
ctgggcatactttctctcta

SEQ ID NO: 1586676 - DNA, 16 bp, Homo sapiens
ctgggcatcttctggc

SEQ ID NO: 1586677 - DNA, 21 bp, Homo sapiens
ctgggcatgccatgtctgagc

SEQ ID NO: 1586678 - DNA, 16 bp, Homo sapiens
ctgggcatgggtccag

SEQ ID NO: 1586679 - DNA, 17 bp, Homo sapiens
ctgggcatgggtccagg

SEQ ID NO: 1586680 - DNA, 22 bp, Homo sapiens
ctgggcatgggtccagggcctg

SEQ ID NO: 1586681 - DNA, 12 bp, Homo sapiens
ctgggcattgct

SEQ ID NO: 1586682 - DNA, 16 bp, Homo sapiens
ctgggcattgctttcc

SEQ ID NO: 1586683 - DNA, 14 bp, Homo sapiens
ctgggcatttcaat

SEQ ID NO: 1586684 - DNA, 22 bp, Homo sapiens
ctgggcatttcaatccattttt

SEQ ID NO: 1586685 - DNA, 20 bp, Homo sapiens
ctgggccaagttcctctagt

SEQ ID NO: 1586686 - DNA, 13 bp, Homo sapiens
ctgggccacacct

SEQ ID NO: 1586687 - DNA, 15 bp, Homo sapiens
ctgggccacacctga

SEQ ID NO: 1586688 - DNA, 16 bp, Homo sapiens
ctgggccacacctgag

SEQ ID NO: 1586689 - DNA, 17 bp, Homo sapiens
ctgggccacacctgagc

SEQ ID NO: 1586690 - DNA, 21 bp, Homo sapiens
ctgggccacacctgagcgctg

SEQ ID NO: 1586691 - DNA, 23 bp, Homo sapiens
ctgggccacacctgagcgctgtg

SEQ ID NO: 1586692 - DNA, 17 bp, Homo sapiens
ctgggccactggggact

SEQ ID NO: 1586693 - DNA, 18 bp, Homo sapiens
ctgggccacttctgggtg

SEQ ID NO: 1586694 - DNA, 19 bp, Homo sapiens
ctgggccagccctgcagcc

SEQ ID NO: 1586695 - DNA, 11 bp, Homo sapiens
ctgggccaggg

SEQ ID NO: 1586696 - DNA, 21 bp, Homo sapiens
ctgggccagggaaacaaagtt

SEQ ID NO: 1586697 - DNA, 16 bp, Homo sapiens
ctgggccaggtctccg

SEQ ID NO: 1586698 - DNA, 14 bp, Homo sapiens
ctgggccagtggct

SEQ ID NO: 1586699 - DNA, 17 bp, Homo sapiens
ctgggccagtggctggg

SEQ ID NO: 1586700 - DNA, 22 bp, Homo sapiens
ctgggccatgtccaaagaggct

SEQ ID NO: 1586701 - DNA, 23 bp, Homo sapiens
ctgggccatgtccaaagaggctg

SEQ ID NO: 1586702 - DNA, 23 bp, Homo sapiens
ctgggcccagcaggggccctcac

SEQ ID NO: 1586703 - DNA, 13 bp, Homo sapiens
ctgggcccaggca

SEQ ID NO: 1586704 - DNA, 16 bp, Homo sapiens
ctgggcccaggcaggt

SEQ ID NO: 1586705 - DNA, 24 bp, Homo sapiens
ctgggccccaaacgggctgccctg

SEQ ID NO: 1586706 - DNA, 14 bp, Homo sapiens
ctgggccccaccac

SEQ ID NO: 1586707 - DNA, 15 bp, Homo sapiens
ctgggccccacctac

SEQ ID NO: 1586708 - DNA, 13 bp, Homo sapiens
ctgggccccagct

SEQ ID NO: 1586709 - DNA, 14 bp, Homo sapiens
ctgggccccatgct

SEQ ID NO: 1586710 - DNA, 17 bp, Homo sapiens
ctgggccccatgctctg

SEQ ID NO: 1586711 - DNA, 12 bp, Homo sapiens
ctgggcccctgc

SEQ ID NO: 1586712 - DNA, 19 bp, Homo sapiens
ctgggccctctttccctgc

SEQ ID NO: 1586713 - DNA, 20 bp, Homo sapiens
ctgggccctctttccctgcg

SEQ ID NO: 1586714 - DNA, 23 bp, Homo sapiens
ctgggccctctttccctgcgaga

SEQ ID NO: 1586715 - DNA, 11 bp, Homo sapiens
ctgggccctgg

SEQ ID NO: 1586716 - DNA, 16 bp, Homo sapiens
ctgggccctgggctga

SEQ ID NO: 1586717 - DNA, 23 bp, Homo sapiens
ctgggccgaggcgcgtttgtgca

SEQ ID NO: 1586718 - DNA, 16 bp, Homo sapiens
ctgggccgctgccacg

SEQ ID NO: 1586719 - DNA, 14 bp, Homo sapiens
ctgggccggctgag

SEQ ID NO: 1586720 - DNA, 15 bp, Homo sapiens
ctgggccggctgagt

SEQ ID NO: 1586721 - DNA, 22 bp, Homo sapiens
ctgggcctgaactcattctctt

SEQ ID NO: 1586722 - DNA, 13 bp, Homo sapiens
ctgggcctgaggg

SEQ ID NO: 1586723 - DNA, 17 bp, Homo sapiens
ctgggcctgagggtcca

SEQ ID NO: 1586724 - DNA, 18 bp, Homo sapiens
ctgggcctgagggtccac

SEQ ID NO: 1586725 - DNA, 19 bp, Homo sapiens
ctgggcctgcttttccagg

SEQ ID NO: 1586726 - DNA, 21 bp, Homo sapiens
ctgggcctgcttttccaggat

SEQ ID NO: 1586727 - DNA, 23 bp, Homo sapiens
ctgggcctggagggggagcacca

SEQ ID NO: 1586728 - DNA, 14 bp, Homo sapiens
ctgggcctgtcccc

SEQ ID NO: 1586729 - DNA, 20 bp, Homo sapiens
ctgggcctgtgcagcagccc

SEQ ID NO: 1586730 - DNA, 13 bp, Homo sapiens
ctgggcgacagag

SEQ ID NO: 1586731 - DNA, 21 bp, Homo sapiens
ctgggcgacagagcgagactc

SEQ ID NO: 1586732 - DNA, 20 bp, Homo sapiens
ctgggcgagcccctccttct

SEQ ID NO: 1586733 - DNA, 18 bp, Homo sapiens
ctgggcgccctggaagcc

SEQ ID NO: 1586734 - DNA, 19 bp, Homo sapiens
ctgggcggcatccctgcag

SEQ ID NO: 1586735 - DNA, 16 bp, Homo sapiens
ctgggcgtctgagctg

SEQ ID NO: 1586736 - DNA, 19 bp, Homo sapiens
ctgggcgtctgagctgggg

SEQ ID NO: 1586737 - DNA, 16 bp, Homo sapiens
ctgggcgtgtgtgaca

SEQ ID NO: 1586738 - DNA, 21 bp, Homo sapiens
ctgggcgtgtgtgacactgat

SEQ ID NO: 1586739 - DNA, 12 bp, Homo sapiens
ctgggctcagcc

SEQ ID NO: 1586740 - DNA, 16 bp, Homo sapiens
ctgggctcagggctgg

SEQ ID NO: 1586741 - DNA, 17 bp, Homo sapiens
ctgggctcagggctgga

SEQ ID NO: 1586742 - DNA, 14 bp, Homo sapiens
ctgggctcctggaa

SEQ ID NO: 1586743 - DNA, 15 bp, Homo sapiens
ctgggctctccacct

SEQ ID NO: 1586744 - DNA, 18 bp, Homo sapiens
ctgggctctccacctcag

SEQ ID NO: 1586745 - DNA, 19 bp, Homo sapiens
ctgggctctccacctcagc

SEQ ID NO: 1586746 - DNA, 23 bp, Homo sapiens
ctgggctctgcaattcccctctg

SEQ ID NO: 1586747 - DNA, 13 bp, Homo sapiens
ctgggctctgcca

SEQ ID NO: 1586748 - DNA, 20 bp, Homo sapiens
ctgggctctgccaccctacc

SEQ ID NO: 1586749 - DNA, 23 bp, Homo sapiens
ctgggctctgccccagctctggc

SEQ ID NO: 1586750 - DNA, 15 bp, Homo sapiens
ctgggctctggctct

SEQ ID NO: 1586751 - DNA, 14 bp, Homo sapiens
ctgggctgagcccc

SEQ ID NO: 1586752 - DNA, 15 bp, Homo sapiens
ctgggctgagcccct

SEQ ID NO: 1586753 - DNA, 17 bp, Homo sapiens
ctgggctgcagagtctg

SEQ ID NO: 1586754 - DNA, 17 bp, Homo sapiens
ctgggctggaacgtgaa

SEQ ID NO: 1586755 - DNA, 16 bp, Homo sapiens
ctgggctggctgaaga

SEQ ID NO: 1586756 - DNA, 17 bp, Homo sapiens
ctgggctggctgaagaa

SEQ ID NO: 1586757 - DNA, 12 bp, Homo sapiens
ctgggctgggaa

SEQ ID NO: 1586758 - DNA, 16 bp, Homo sapiens
ctgggctgggccctct

SEQ ID NO: 1586759 - DNA, 15 bp, Homo sapiens
ctgggctggggagga

SEQ ID NO: 1586760 - DNA, 22 bp, Homo sapiens
ctgggctgtaacgtggcactgg

SEQ ID NO: 1586761 - DNA, 23 bp, Homo sapiens
ctgggctgtaacgtggcactggt

SEQ ID NO: 1586762 - DNA, 12 bp, Homo sapiens
ctgggctgtgct

SEQ ID NO: 1586763 - DNA, 12 bp, Homo sapiens
ctgggctgttgt

SEQ ID NO: 1586764 - DNA, 19 bp, Homo sapiens
ctgggcttatatgtacttt

SEQ ID NO: 1586765 - DNA, 15 bp, Homo sapiens
ctgggcttcatctgg

SEQ ID NO: 1586766 - DNA, 19 bp, Homo sapiens
ctgggcttcatctggcaac

SEQ ID NO: 1586767 - DNA, 19 bp, Homo sapiens
ctgggcttcattccggact

SEQ ID NO: 1586768 - DNA, 16 bp, Homo sapiens
ctgggcttcattctgg

SEQ ID NO: 1586769 - DNA, 20 bp, Homo sapiens
ctgggcttcattctggaaac

SEQ ID NO: 1586770 - DNA, 13 bp, Homo sapiens
ctgggcttggcct

SEQ ID NO: 1586771 - DNA, 15 bp, Homo sapiens
ctgggcttggcctgc

SEQ ID NO: 1586772 - DNA, 16 bp, Homo sapiens
ctgggcttggcctgct

SEQ ID NO: 1586773 - DNA, 20 bp, Homo sapiens
ctgggcttggggcttcctaa

SEQ ID NO: 1586774 - DNA, 22 bp, Homo sapiens
ctgggcttttggtttgggggcg

SEQ ID NO: 1586775 - DNA, 20 bp, Homo sapiens
ctggggaaacaacatttata

SEQ ID NO: 1586776 - DNA, 22 bp, Homo sapiens
ctggggaaagacactgcctggg

SEQ ID NO: 1586777 - DNA, 23 bp, Homo sapiens
ctggggaaagacactgcctgggc

SEQ ID NO: 1586778 - DNA, 16 bp, Homo sapiens
ctggggaaagggctgg

SEQ ID NO: 1586779 - DNA, 15 bp, Homo sapiens
ctggggaaaggggac

SEQ ID NO: 1586780 - DNA, 16 bp, Homo sapiens
ctggggaaaggggaca

SEQ ID NO: 1586781 - DNA, 16 bp, Homo sapiens
ctggggaagacagtgg

SEQ ID NO: 1586782 - DNA, 18 bp, Homo sapiens
ctggggaagacagtggcc

SEQ ID NO: 1586783 - DNA, 16 bp, Homo sapiens
ctggggaagaggatga

SEQ ID NO: 1586784 - DNA, 17 bp, Homo sapiens
ctggggaaggagccagt

SEQ ID NO: 1586785 - DNA, 14 bp, Homo sapiens
ctggggaccaggag

SEQ ID NO: 1586786 - DNA, 17 bp, Homo sapiens
ctggggaccaggagcta

SEQ ID NO: 1586787 - DNA, 19 bp, Homo sapiens
ctggggacgctccgctgcc

SEQ ID NO: 1586788 - DNA, 15 bp, Homo sapiens
ctggggactcaggga

SEQ ID NO: 1586789 - DNA, 13 bp, Homo sapiens
ctggggacttgtg

SEQ ID NO: 1586790 - DNA, 18 bp, Homo sapiens
ctggggagagcggctgga

SEQ ID NO: 1586791 - DNA, 18 bp, Homo sapiens
ctggggaggaggagagag

SEQ ID NO: 1586792 - DNA, 19 bp, Homo sapiens
ctggggaggaggagagagt

SEQ ID NO: 1586793 - DNA, 20 bp, Homo sapiens
ctggggaggaggagagagtc

SEQ ID NO: 1586794 - DNA, 14 bp, Homo sapiens
ctggggaggcaggc

SEQ ID NO: 1586795 - DNA, 12 bp, Homo sapiens
ctggggagtccc

SEQ ID NO: 1586796 - DNA, 13 bp, Homo sapiens
ctggggagtcctc

SEQ ID NO: 1586797 - DNA, 19 bp, Homo sapiens
ctggggatgtcatagccaa

SEQ ID NO: 1586798 - DNA, 17 bp, Homo sapiens
ctggggatgtctctcat

SEQ ID NO: 1586799 - DNA, 22 bp, Homo sapiens
ctggggatgtctctcatgacca

SEQ ID NO: 1586800 - DNA, 16 bp, Homo sapiens
ctggggcaagtccctg

SEQ ID NO: 1586801 - DNA, 14 bp, Homo sapiens
ctggggcacggcgg

SEQ ID NO: 1586802 - DNA, 13 bp, Homo sapiens
ctggggcagaggg

SEQ ID NO: 1586803 - DNA, 24 bp, Homo sapiens
ctggggcagaggggcagccgctag

SEQ ID NO: 1586804 - DNA, 14 bp, Homo sapiens
ctggggcagcactc

SEQ ID NO: 1586805 - DNA, 19 bp, Homo sapiens
ctggggcagcactccccag

SEQ ID NO: 1586806 - DNA, 12 bp, Homo sapiens
ctggggcaggct

SEQ ID NO: 1586807 - DNA, 18 bp, Homo sapiens
ctggggcatcctgtgcca

SEQ ID NO: 1586808 - DNA, 18 bp, Homo sapiens
ctggggcatgtgtgcctg

SEQ ID NO: 1586809 - DNA, 20 bp, Homo sapiens
ctggggcatgtgtgcctgtg

SEQ ID NO: 1586810 - DNA, 21 bp, Homo sapiens
ctggggccacaaatcaaagca

SEQ ID NO: 1586811 - DNA, 18 bp, Homo sapiens
ctggggccccgctgggat

SEQ ID NO: 1586812 - DNA, 16 bp, Homo sapiens
ctggggccggggctga

SEQ ID NO: 1586813 - DNA, 22 bp, Homo sapiens
ctggggcctagcgatctctcct

SEQ ID NO: 1586814 - DNA, 23 bp, Homo sapiens
ctggggcctagcgatctctcctg

SEQ ID NO: 1586815 - DNA, 22 bp, Homo sapiens
ctggggcctccagaagctgctc

SEQ ID NO: 1586816 - DNA, 24 bp, Homo sapiens
ctggggcctccagaagctgctcct

SEQ ID NO: 1586817 - DNA, 12 bp, Homo sapiens
ctggggcctctt

SEQ ID NO: 1586818 - DNA, 15 bp, Homo sapiens
ctggggcctgactgc

SEQ ID NO: 1586819 - DNA, 16 bp, Homo sapiens
ctggggcctggacctg

SEQ ID NO: 1586820 - DNA, 16 bp, Homo sapiens
ctggggcgtggggagg

SEQ ID NO: 1586821 - DNA, 12 bp, Homo sapiens
ctggggctccct

SEQ ID NO: 1586822 - DNA, 16 bp, Homo sapiens
ctggggctccgaaatt

SEQ ID NO: 1586823 - DNA, 23 bp, Homo sapiens
ctggggctcctttctccagccag

SEQ ID NO: 1586824 - DNA, 14 bp, Homo sapiens
ctggggctctggga

SEQ ID NO: 1586825 - DNA, 13 bp, Homo sapiens
ctggggctgagtc

SEQ ID NO: 1586826 - DNA, 16 bp, Homo sapiens
ctggggctgatctcag

SEQ ID NO: 1586827 - DNA, 21 bp, Homo sapiens
ctggggctgatctcagggaag

SEQ ID NO: 1586828 - DNA, 16 bp, Homo sapiens
ctggggctgctcccct

SEQ ID NO: 1586829 - DNA, 18 bp, Homo sapiens
ctggggcttcaccagtct

SEQ ID NO: 1586830 - DNA, 20 bp, Homo sapiens
ctggggcttcaccagtctgt

SEQ ID NO: 1586831 - DNA, 22 bp, Homo sapiens
ctggggcttcaccagtctgtct

SEQ ID NO: 1586832 - DNA, 18 bp, Homo sapiens
ctggtccctggtccttca

SEQ ID NO: 1586833 - DNA, 23 bp, Homo sapiens
ctggtccctgttttcccacgagg

SEQ ID NO: 1586834 - DNA, 21 bp, Homo sapiens
ctggtcccttgcagctagttt

SEQ ID NO: 1586835 - DNA, 20 bp, Homo sapiens
ctggtcctccgcctactgtc

SEQ ID NO: 1586836 - DNA, 15 bp, Homo sapiens
ctggtcctggcctcc

SEQ ID NO: 1586837 - DNA, 16 bp, Homo sapiens
ctggtcctggctgcac

SEQ ID NO: 1586838 - DNA, 13 bp, Homo sapiens
ctggtccttattt

SEQ ID NO: 1586839 - DNA, 15 bp, Homo sapiens
ctggtccttcactgg

SEQ ID NO: 1586840 - DNA, 16 bp, Homo sapiens
ctggtccttccaggcc

SEQ ID NO: 1586841 - DNA, 18 bp, Homo sapiens
ctggtcgctcctgcccac

SEQ ID NO: 1586842 - DNA, 17 bp, Homo sapiens
ctggtctactctagaag

SEQ ID NO: 1586843 - DNA, 18 bp, Homo sapiens
ctggtctcaaactcctga

SEQ ID NO: 1586844 - DNA, 13 bp, Homo sapiens
ctggtctgtctgg

SEQ ID NO: 1586845 - DNA, 17 bp, Homo sapiens
ctggtctgtgaagagcc

SEQ ID NO: 1586846 - DNA, 18 bp, Homo sapiens
ctggtcttgaactcctgg

SEQ ID NO: 1586847 - DNA, 14 bp, Homo sapiens
ctggtcttgagatg

SEQ ID NO: 1586848 - DNA, 15 bp, Homo sapiens
ctggtgaacactgtg

SEQ ID NO: 1586849 - DNA, 17 bp, Homo sapiens
ctggtgaacactgtgac

SEQ ID NO: 1586850 - DNA, 18 bp, Homo sapiens
ctggtgaacactgtgacc

SEQ ID NO: 1586851 - DNA, 18 bp, Homo sapiens
ctggtgaactgagctggg

SEQ ID NO: 1586852 - DNA, 13 bp, Homo sapiens
ctggtgatgccta

SEQ ID NO: 1586853 - DNA, 16 bp, Homo sapiens
ctggtgcaaattcaga

SEQ ID NO: 1586854 - DNA, 19 bp, Homo sapiens
ctggtgcacagccactccc

SEQ ID NO: 1586855 - DNA, 13 bp, Homo sapiens
ctggtgcagggcc

SEQ ID NO: 1586856 - DNA, 14 bp, Homo sapiens
ctggtgcagggcct

SEQ ID NO: 1586857 - DNA, 15 bp, Homo sapiens
ctggtgcattgctgt

SEQ ID NO: 1586858 - DNA, 20 bp, Homo sapiens
ctggtgccaaatagccccag

SEQ ID NO: 1586859 - DNA, 22 bp, Homo sapiens
ctggtgccaaatagccccagac

SEQ ID NO: 1586860 - DNA, 23 bp, Homo sapiens
ctggtgccaaatagccccagact

SEQ ID NO: 1586861 - DNA, 14 bp, Homo sapiens
ctggtgccagcctt

SEQ ID NO: 1586862 - DNA, 17 bp, Homo sapiens
ctggtgccagccttcct

SEQ ID NO: 1586863 - DNA, 15 bp, Homo sapiens
ctggtgccatttctg

SEQ ID NO: 1586864 - DNA, 18 bp, Homo sapiens
ctggtgccccacctgcct

SEQ ID NO: 1586865 - DNA, 19 bp, Homo sapiens
ctggtgccccacctgcctg

SEQ ID NO: 1586866 - DNA, 22 bp, Homo sapiens
ctggtgccccacctgcctggtg

SEQ ID NO: 1586867 - DNA, 21 bp, Homo sapiens
ctggtgccccccacccctgga

SEQ ID NO: 1586868 - DNA, 14 bp, Homo sapiens
ctggtgcctccaga

SEQ ID NO: 1586869 - DNA, 13 bp, Homo sapiens
ctggtgcctctgt

SEQ ID NO: 1586870 - DNA, 17 bp, Homo sapiens
ctggtgcctctgtgcac

SEQ ID NO: 1586871 - DNA, 15 bp, Homo sapiens
ctggtgcgacccccc

SEQ ID NO: 1586872 - DNA, 17 bp, Homo sapiens
ctggtgcgaccccccac

SEQ ID NO: 1586873 - DNA, 22 bp, Homo sapiens
ctggtgcgaccccccacccccg

SEQ ID NO: 1586874 - DNA, 16 bp, Homo sapiens
ctggtgcgggcctggc

SEQ ID NO: 1586875 - DNA, 17 bp, Homo sapiens
ctggtgcgggcctggcc

SEQ ID NO: 1586876 - DNA, 17 bp, Homo sapiens
ctggtgctgcagtatgt

SEQ ID NO: 1586877 - DNA, 12 bp, Homo sapiens
ctggtgctgcca

SEQ ID NO: 1586878 - DNA, 13 bp, Homo sapiens
ctggtgctgccac

SEQ ID NO: 1586879 - DNA, 15 bp, Homo sapiens
ctggtggacagtcct

SEQ ID NO: 1586880 - DNA, 18 bp, Homo sapiens
ctggtggacagtcctggg

SEQ ID NO: 1586881 - DNA, 21 bp, Homo sapiens
ctggtggacagtcctgggaga

SEQ ID NO: 1586882 - DNA, 15 bp, Homo sapiens
ctggtggaccacagg

SEQ ID NO: 1586883 - DNA, 15 bp, Homo sapiens
ctggtggagaaagca

SEQ ID NO: 1586884 - DNA, 23 bp, Homo sapiens
ctggtggagaaagcactgacctg

SEQ ID NO: 1586885 - DNA, 21 bp, Homo sapiens
ctggtggccccgtttctggtg

SEQ ID NO: 1586886 - DNA, 15 bp, Homo sapiens
ctggtggcccctgcc

SEQ ID NO: 1586887 - DNA, 16 bp, Homo sapiens
ctggtggccctgtgcc

SEQ ID NO: 1586888 - DNA, 19 bp, Homo sapiens
ctggtggccctgtgcctgg

SEQ ID NO: 1586889 - DNA, 15 bp, Homo sapiens
ctggtggccttgggc

SEQ ID NO: 1586890 - DNA, 17 bp, Homo sapiens
ctggtggccttgggcct

SEQ ID NO: 1586891 - DNA, 18 bp, Homo sapiens
ctggtggccttgggcctt

SEQ ID NO: 1586892 - DNA, 19 bp, Homo sapiens
ctggtggcttaagtgagca

SEQ ID NO: 1586893 - DNA, 17 bp, Homo sapiens
ctggtgggacagtggtg

SEQ ID NO: 1586894 - DNA, 13 bp, Homo sapiens
ctggtgggccaac

SEQ ID NO: 1586895 - DNA, 14 bp, Homo sapiens
ctggtgggccccca

SEQ ID NO: 1586896 - DNA, 12 bp, Homo sapiens
ctggtgggcctc

SEQ ID NO: 1586897 - DNA, 12 bp, Homo sapiens
ctggtggggctg

SEQ ID NO: 1586898 - DNA, 20 bp, Homo sapiens
ctggtggggctgtcctgctg

SEQ ID NO: 1586899 - DNA, 21 bp, Homo sapiens
ctggtggggtgtgcatgccac

SEQ ID NO: 1586900 - DNA, 19 bp, Homo sapiens
ctggtgggtcagcccagca

SEQ ID NO: 1586901 - DNA, 20 bp, Homo sapiens
ctggtgggtcagcccagcac

SEQ ID NO: 1586902 - DNA, 21 bp, Homo sapiens
ctggtgggtcagcccagcacc

SEQ ID NO: 1586903 - DNA, 15 bp, Homo sapiens
ctggtgggtggagtc

SEQ ID NO: 1586904 - DNA, 17 bp, Homo sapiens
ctggtgggtggagtcag

SEQ ID NO: 1586905 - DNA, 15 bp, Homo sapiens
ctggtggtacctgtg

SEQ ID NO: 1586906 - DNA, 12 bp, Homo sapiens
ctggtgtatgca

SEQ ID NO: 1586907 - DNA, 16 bp, Homo sapiens
ctggtgtccagctgag

SEQ ID NO: 1586908 - DNA, 12 bp, Homo sapiens
ctggtgtcctga

SEQ ID NO: 1586909 - DNA, 13 bp, Homo sapiens
ctggtgtcctgac

SEQ ID NO: 1586910 - DNA, 13 bp, Homo sapiens
ctggtgtctagtt

SEQ ID NO: 1586911 - DNA, 23 bp, Homo sapiens
ctggttaaattaacattgcataa

SEQ ID NO: 1586912 - DNA, 17 bp, Homo sapiens
ctggttaccactctttt

SEQ ID NO: 1586913 - DNA, 15 bp, Homo sapiens
ctggttagctgacag

SEQ ID NO: 1586914 - DNA, 16 bp, Homo sapiens
ctggttatttttctct

SEQ ID NO: 1586915 - DNA, 13 bp, Homo sapiens
ctggttccagggt

SEQ ID NO: 1586916 - DNA, 14 bp, Homo sapiens
ctggttccagggtc

SEQ ID NO: 1586917 - DNA, 16 bp, Homo sapiens
ctggttccagggtccc

SEQ ID NO: 1586918 - DNA, 23 bp, Homo sapiens
ctggttccagggtccctctgtgt

SEQ ID NO: 1586919 - DNA, 19 bp, Homo sapiens
ctggttccgccaggcgctg

SEQ ID NO: 1586920 - DNA, 18 bp, Homo sapiens
ctggttcctagatgtgtt

SEQ ID NO: 1586921 - DNA, 15 bp, Homo sapiens
ctggttcctgctgtc

SEQ ID NO: 1586922 - DNA, 23 bp, Homo sapiens
ctggttcggatttggggtggatt

SEQ ID NO: 1586923 - DNA, 18 bp, Homo sapiens
ctggttctatttaatgga

SEQ ID NO: 1586924 - DNA, 12 bp, Homo sapiens
ctggttctcatc

SEQ ID NO: 1586925 - DNA, 15 bp, Homo sapiens
ctggttctcatcttt

SEQ ID NO: 1586926 - DNA, 17 bp, Homo sapiens
ctggttgagtgtgtggt

SEQ ID NO: 1586927 - DNA, 13 bp, Homo sapiens
ctggttgctgtag

SEQ ID NO: 1586928 - DNA, 16 bp, Homo sapiens
ctggttgctgtagaaa

SEQ ID NO: 1586929 - DNA, 19 bp, Homo sapiens
ctggttgcttcagacctga

SEQ ID NO: 1586930 - DNA, 13 bp, Homo sapiens
ctggttgggcagc

SEQ ID NO: 1586931 - DNA, 22 bp, Homo sapiens
ctggttgtatttctatatttat

SEQ ID NO: 1586932 - DNA, 13 bp, Homo sapiens
ctggttgttcctg

SEQ ID NO: 1586933 - DNA, 15 bp, Homo sapiens
ctggttgttcctgca

SEQ ID NO: 1586934 - DNA, 16 bp, Homo sapiens
ctggttgttcctgcat

SEQ ID NO: 1586935 - DNA, 22 bp, Homo sapiens
ctggttgttgcaccatctgctt

SEQ ID NO: 1586936 - DNA, 17 bp, Homo sapiens
ctggttgttgccaggtt

SEQ ID NO: 1586937 - DNA, 22 bp, Homo sapiens
ctggttgttgccaggttgcagc

SEQ ID NO: 1586938 - DNA, 23 bp, Homo sapiens
ctggtttcctatttgcagttact

SEQ ID NO: 1586939 - DNA, 19 bp, Homo sapiens
ctggtttctcagaatccaa

SEQ ID NO: 1586940 - DNA, 23 bp, Homo sapiens
ctggtttctcagaatccaaagat

SEQ ID NO: 1586941 - DNA, 23 bp, Homo sapiens
ctggtttcttttaatgtgaggaa

SEQ ID NO: 1586942 - DNA, 21 bp, Homo sapiens
ctggtttgaaagatgcagtgg

SEQ ID NO: 1586943 - DNA, 16 bp, Homo sapiens
ctggtttgaaagatta

SEQ ID NO: 1586944 - DNA, 15 bp, Homo sapiens
ctgtatatgtattcc

SEQ ID NO: 1586945 - DNA, 19 bp, Homo sapiens
ctgtatatgttgtaataaa

SEQ ID NO: 1586946 - DNA, 14 bp, Homo sapiens
ctgtatattcagga

SEQ ID NO: 1586947 - DNA, 19 bp, Homo sapiens
ctgtatatttgtaaagcta

SEQ ID NO: 1586948 - DNA, 20 bp, Homo sapiens
ctgtatatttgtaaagctat

SEQ ID NO: 1586949 - DNA, 20 bp, Homo sapiens
ctgtatccgtgaattgcttt

SEQ ID NO: 1586950 - DNA, 20 bp, Homo sapiens
ctgtatcctccctggcagac

SEQ ID NO: 1586951 - DNA, 20 bp, Homo sapiens
ctgtatctaaaaaataactg

SEQ ID NO: 1586952 - DNA, 21 bp, Homo sapiens
ctgtatctactaaaaatacaa

SEQ ID NO: 1586953 - DNA, 14 bp, Homo sapiens
ctgtatctgtgtag

SEQ ID NO: 1586954 - DNA, 18 bp, Homo sapiens
ctgtatctgtgtagacta

SEQ ID NO: 1586955 - DNA, 20 bp, Homo sapiens
ctgtatgatttaggcttcta

SEQ ID NO: 1586956 - DNA, 13 bp, Homo sapiens
ctgtatgatttgt

SEQ ID NO: 1586957 - DNA, 17 bp, Homo sapiens
ctgtatggcactctgta

SEQ ID NO: 1586958 - DNA, 16 bp, Homo sapiens
ctgtatggtggaagct

SEQ ID NO: 1586959 - DNA, 18 bp, Homo sapiens
ctgtatgtgctgtaattt

SEQ ID NO: 1586960 - DNA, 14 bp, Homo sapiens
ctgtattaaatctt

SEQ ID NO: 1586961 - DNA, 21 bp, Homo sapiens
ctgtattagagcgccagctcc

SEQ ID NO: 1586962 - DNA, 20 bp, Homo sapiens
ctgtattccgatacaaagtg

SEQ ID NO: 1586963 - DNA, 21 bp, Homo sapiens
ctgtattctcaaacacagtta

SEQ ID NO: 1586964 - DNA, 16 bp, Homo sapiens
ctgtattcttgtttga

SEQ ID NO: 1586965 - DNA, 18 bp, Homo sapiens
ctgtattgggccttttgg

SEQ ID NO: 1586966 - DNA, 13 bp, Homo sapiens
ctgtattgtctga

SEQ ID NO: 1586967 - DNA, 14 bp, Homo sapiens
ctgtattgtctgaa

SEQ ID NO: 1586968 - DNA, 12 bp, Homo sapiens
ctgtatttccaa

SEQ ID NO: 1586969 - DNA, 13 bp, Homo sapiens
ctgtatttcctgc

SEQ ID NO: 1586970 - DNA, 21 bp, Homo sapiens
ctgtattttatttagacaaga

SEQ ID NO: 1586971 - DNA, 22 bp, Homo sapiens
ctgtattttatttagacaagag

SEQ ID NO: 1586972 - DNA, 20 bp, Homo sapiens
ctgtattttcttttatatct

SEQ ID NO: 1586973 - DNA, 22 bp, Homo sapiens
ctgtattttcttttatatctgt

SEQ ID NO: 1586974 - DNA, 21 bp, Homo sapiens
ctgtatttttacctttttcct

SEQ ID NO: 1586975 - DNA, 14 bp, Homo sapiens
ctgtcaaaactact

SEQ ID NO: 1586976 - DNA, 17 bp, Homo sapiens
ctgtcaaaataatttta

SEQ ID NO: 1586977 - DNA, 13 bp, Homo sapiens
ctgtcaaatgttt

SEQ ID NO: 1586978 - DNA, 19 bp, Homo sapiens
ctgtcaaatgtttccttaa

SEQ ID NO: 1586979 - DNA, 19 bp, Homo sapiens
ctgtcaagttaacaaggaa

SEQ ID NO: 1586980 - DNA, 23 bp, Homo sapiens
ctgtcaatatcgtacctgtccct

SEQ ID NO: 1586981 - DNA, 23 bp, Homo sapiens
ctgtcaatttcattatcatcaag

SEQ ID NO: 1586982 - DNA, 13 bp, Homo sapiens
ctgtcaccaaatt

SEQ ID NO: 1586983 - DNA, 16 bp, Homo sapiens
ctgtcaccaaggaaac

SEQ ID NO: 1586984 - DNA, 23 bp, Homo sapiens
ctgtcaccagagcttctctgggc

SEQ ID NO: 1586985 - DNA, 22 bp, Homo sapiens
ctgtcacccaggttggagtgca

SEQ ID NO: 1586986 - DNA, 14 bp, Homo sapiens
ctgtcaccctgcag

SEQ ID NO: 1586987 - DNA, 23 bp, Homo sapiens
ctgtcacgctcatgtcctgtcct

SEQ ID NO: 1586988 - DNA, 19 bp, Homo sapiens
ctgtcacgctctggtgcag

SEQ ID NO: 1586989 - DNA, 19 bp, Homo sapiens
ctgtcacgtgaaatattta

SEQ ID NO: 1586990 - DNA, 17 bp, Homo sapiens
ctgtcactcagctgaga

SEQ ID NO: 1586991 - DNA, 14 bp, Homo sapiens
ctgtcactcattgc

SEQ ID NO: 1586992 - DNA, 17 bp, Homo sapiens
ctgtcactgctctggac

SEQ ID NO: 1586993 - DNA, 24 bp, Homo sapiens
ctgtcactgctctggactgtgtgg

SEQ ID NO: 1586994 - DNA, 21 bp, Homo sapiens
ctgtcagatgggaagacatga

SEQ ID NO: 1586995 - DNA, 23 bp, Homo sapiens
ctgtcagccgggccctgagtaat

SEQ ID NO: 1586996 - DNA, 14 bp, Homo sapiens
ctgtcagctgagct

SEQ ID NO: 1586997 - DNA, 12 bp, Homo sapiens
ctgtcagctgca

SEQ ID NO: 1586998 - DNA, 21 bp, Homo sapiens
ctgtcaggacaccagcctggt

SEQ ID NO: 1586999 - DNA, 16 bp, Homo sapiens
ctgtcagtatgacatt

SEQ ID NO: 1587000 - DNA, 20 bp, Homo sapiens
ctgtcagtgtacacgtctgg

SEQ ID NO: 1587001 - DNA, 17 bp, Homo sapiens
ctgtcagtgttaaagat

SEQ ID NO: 1587002 - DNA, 22 bp, Homo sapiens
ctgtcagtgttaaagattttgt

SEQ ID NO: 1587003 - DNA, 15 bp, Homo sapiens
ctgtcataggtttta

SEQ ID NO: 1587004 - DNA, 22 bp, Homo sapiens
ctgtcataggttttaaatctgc

SEQ ID NO: 1587005 - DNA, 20 bp, Homo sapiens
ctgtcatcctcaaagaaagt

SEQ ID NO: 1587006 - DNA, 21 bp, Homo sapiens
ctgtcatcctcaaagaaagtg

SEQ ID NO: 1587007 - DNA, 23 bp, Homo sapiens
ctgtcatctaaagtcctggccct

SEQ ID NO: 1587008 - DNA, 16 bp, Homo sapiens
ctgtcatctttttcca

SEQ ID NO: 1587009 - DNA, 13 bp, Homo sapiens
ctgtcatgccccc

SEQ ID NO: 1587010 - DNA, 19 bp, Homo sapiens
ctgtcatggtcctttctgg

SEQ ID NO: 1587011 - DNA, 20 bp, Homo sapiens
ctgtcatggtcctttctgga

SEQ ID NO: 1587012 - DNA, 23 bp, Homo sapiens
ctgtcatggtcctttctggaagt

SEQ ID NO: 1587013 - DNA, 15 bp, Homo sapiens
ctgtcattgcccctc

SEQ ID NO: 1587014 - DNA, 16 bp, Homo sapiens
ctgtcattgcccctcc

SEQ ID NO: 1587015 - DNA, 17 bp, Homo sapiens
ctgtcatttgaacctgg

SEQ ID NO: 1587016 - DNA, 17 bp, Homo sapiens
ctgtcatttttaacagc

SEQ ID NO: 1587017 - DNA, 18 bp, Homo sapiens
ctgtccaaaggaggctgg

SEQ ID NO: 1587018 - DNA, 16 bp, Homo sapiens
ctgtccaacatggtga

SEQ ID NO: 1587019 - DNA, 18 bp, Homo sapiens
ctgtccacatccccagag

SEQ ID NO: 1587020 - DNA, 21 bp, Homo sapiens
ctgtccacatccccagagccc

SEQ ID NO: 1587021 - DNA, 22 bp, Homo sapiens
ctgtccacatccccagagccca

SEQ ID NO: 1587022 - DNA, 23 bp, Homo sapiens
ctgtccaccctcatttctgccag

SEQ ID NO: 1587023 - DNA, 14 bp, Homo sapiens
ctgtccaccctgcc

SEQ ID NO: 1587024 - DNA, 12 bp, Homo sapiens
ctgtccactctc

SEQ ID NO: 1587025 - DNA, 23 bp, Homo sapiens
ctgtccactctcggggcccttgg

SEQ ID NO: 1587026 - DNA, 18 bp, Homo sapiens
ctgtccagcctgggcagc

SEQ ID NO: 1587027 - DNA, 18 bp, Homo sapiens
ctgtccagctccaacctg

SEQ ID NO: 1587028 - DNA, 21 bp, Homo sapiens
ctgtccagctccaacctgcaa

SEQ ID NO: 1587029 - DNA, 13 bp, Homo sapiens
ctgtccaggcagc

SEQ ID NO: 1587030 - DNA, 18 bp, Homo sapiens
ctgtccaggcagctccct

SEQ ID NO: 1587031 - DNA, 16 bp, Homo sapiens
ctgtccaggccactgt

SEQ ID NO: 1587032 - DNA, 17 bp, Homo sapiens
ctgtccaggccactgtg

SEQ ID NO: 1587033 - DNA, 20 bp, Homo sapiens
ctgtccaggccactgtggcc

SEQ ID NO: 1587034 - DNA, 18 bp, Homo sapiens
ctgtccagggccctgagc

SEQ ID NO: 1587035 - DNA, 22 bp, Homo sapiens
ctgtccagggccctgagctcgg

SEQ ID NO: 1587036 - DNA, 17 bp, Homo sapiens
ctgtcccacaaaatatt

SEQ ID NO: 1587037 - DNA, 14 bp, Homo sapiens
ctgtcccaccaact

SEQ ID NO: 1587038 - DNA, 19 bp, Homo sapiens
ctgtcccaccaactctgca

SEQ ID NO: 1587039 - DNA, 20 bp, Homo sapiens
ctgtcccaccaactctgcac

SEQ ID NO: 1587040 - DNA, 23 bp, Homo sapiens
ctgtcccacccacacagctgccc

SEQ ID NO: 1587041 - DNA, 16 bp, Homo sapiens
ctgtcccacccccacc

SEQ ID NO: 1587042 - DNA, 11 bp, Homo sapiens
ctgtcccagag

SEQ ID NO: 1587043 - DNA, 23 bp, Homo sapiens
ctgtcccagaggttatctgcctg

SEQ ID NO: 1587044 - DNA, 12 bp, Homo sapiens
ctgtcccagcta

SEQ ID NO: 1587045 - DNA, 22 bp, Homo sapiens
ctgtcccagctaccaagtcaga

SEQ ID NO: 1587046 - DNA, 22 bp, Homo sapiens
ctgtcccagggccctcccagcc

SEQ ID NO: 1587047 - DNA, 14 bp, Homo sapiens
ctgtcccattctag

SEQ ID NO: 1587048 - DNA, 21 bp, Homo sapiens
ctgtcccattctagatcctgc

SEQ ID NO: 1587049 - DNA, 22 bp, Homo sapiens
ctgtcccattctagatcctgca

SEQ ID NO: 1587050 - DNA, 18 bp, Homo sapiens
ctgtccccaccctccact

SEQ ID NO: 1587051 - DNA, 13 bp, Homo sapiens
ctgtcccccagct

SEQ ID NO: 1587052 - DNA, 15 bp, Homo sapiens
ctgtcccccagctct

SEQ ID NO: 1587053 - DNA, 15 bp, Homo sapiens
ctgtccccgcagccc

SEQ ID NO: 1587054 - DNA, 17 bp, Homo sapiens
ctgtccccgcagccctg

SEQ ID NO: 1587055 - DNA, 14 bp, Homo sapiens
ctgtcccctcagcg

SEQ ID NO: 1587056 - DNA, 15 bp, Homo sapiens
ctgtcccctctgtca

SEQ ID NO: 1587057 - DNA, 16 bp, Homo sapiens
ctgtcccctctgtcat

SEQ ID NO: 1587058 - DNA, 20 bp, Homo sapiens
ctgtcccctgaaaaactgat

SEQ ID NO: 1587059 - DNA, 16 bp, Homo sapiens
ctgtctgtctctccat

SEQ ID NO: 1587060 - DNA, 14 bp, Homo sapiens
ctgtctgtgggccg

SEQ ID NO: 1587061 - DNA, 19 bp, Homo sapiens
ctgtcttatggtccagaaa

SEQ ID NO: 1587062 - DNA, 21 bp, Homo sapiens
ctgtcttatggtccagaaact

SEQ ID NO: 1587063 - DNA, 18 bp, Homo sapiens
ctgtcttcagtctcacag

SEQ ID NO: 1587064 - DNA, 23 bp, Homo sapiens
ctgtcttcagtctcacagagaag

SEQ ID NO: 1587065 - DNA, 17 bp, Homo sapiens
ctgtcttctcaggctct

SEQ ID NO: 1587066 - DNA, 23 bp, Homo sapiens
ctgtcttctccctgcacaagcca

SEQ ID NO: 1587067 - DNA, 13 bp, Homo sapiens
ctgtcttctggac

SEQ ID NO: 1587068 - DNA, 19 bp, Homo sapiens
ctgtcttgaataagagtga

SEQ ID NO: 1587069 - DNA, 13 bp, Homo sapiens
ctgtcttgccagc

SEQ ID NO: 1587070 - DNA, 17 bp, Homo sapiens
ctgtcttgccagccaga

SEQ ID NO: 1587071 - DNA, 19 bp, Homo sapiens
ctgtcttgccagccagaag

SEQ ID NO: 1587072 - DNA, 19 bp, Homo sapiens
ctgtcttgttaatgctttt

SEQ ID NO: 1587073 - DNA, 15 bp, Homo sapiens
ctgtcttgtttcagt

SEQ ID NO: 1587074 - DNA, 15 bp, Homo sapiens
ctgtctttcagatac

SEQ ID NO: 1587075 - DNA, 20 bp, Homo sapiens
ctgtctttcagatacatggt

SEQ ID NO: 1587076 - DNA, 15 bp, Homo sapiens
ctgtctttcagcatt

SEQ ID NO: 1587077 - DNA, 16 bp, Homo sapiens
ctgtctttgactgtga

SEQ ID NO: 1587078 - DNA, 18 bp, Homo sapiens
ctgtctttgttgtctccc

SEQ ID NO: 1587079 - DNA, 17 bp, Homo sapiens
ctgtgaaaaatcagatg

SEQ ID NO: 1587080 - DNA, 17 bp, Homo sapiens
ctgtgaaaactctggta

SEQ ID NO: 1587081 - DNA, 22 bp, Homo sapiens
ctgtgaaaatagtgtaagaact

SEQ ID NO: 1587082 - DNA, 23 bp, Homo sapiens
ctgtgaaactggcactgaattaa

SEQ ID NO: 1587083 - DNA, 24 bp, Homo sapiens
ctgtgaaataccacaagcctgaga

SEQ ID NO: 1587084 - DNA, 21 bp, Homo sapiens
ctgtgaacagcttgctgtcac

SEQ ID NO: 1587085 - DNA, 16 bp, Homo sapiens
ctgtgaacgatttaga

SEQ ID NO: 1587086 - DNA, 18 bp, Homo sapiens
ctgtgaacgatttagaaa

SEQ ID NO: 1587087 - DNA, 19 bp, Homo sapiens
ctgtgaactcaatctccag

SEQ ID NO: 1587088 - DNA, 20 bp, Homo sapiens
ctgtgaactcaatctccagg

SEQ ID NO: 1587089 - DNA, 23 bp, Homo sapiens
ctgtgaactcaatctccagggct

SEQ ID NO: 1587090 - DNA, 21 bp, Homo sapiens
ctgtgaagagaatgtattctg

SEQ ID NO: 1587091 - DNA, 19 bp, Homo sapiens
ctgtgaagcagtcagccct

SEQ ID NO: 1587092 - DNA, 18 bp, Homo sapiens
ctgtgaagggtacagatt

SEQ ID NO: 1587093 - DNA, 22 bp, Homo sapiens
ctgtgaagtaacccctcctggc

SEQ ID NO: 1587094 - DNA, 20 bp, Homo sapiens
ctgtgaatgccactgccttc

SEQ ID NO: 1587095 - DNA, 21 bp, Homo sapiens
ctgtgaatgccactgccttcg

SEQ ID NO: 1587096 - DNA, 20 bp, Homo sapiens
ctgtgaatgtaaaacagagc

SEQ ID NO: 1587097 - DNA, 22 bp, Homo sapiens
ctgtgaatgtaaaacagagcca

SEQ ID NO: 1587098 - DNA, 13 bp, Homo sapiens
ctgtgacaaaatg

SEQ ID NO: 1587099 - DNA, 15 bp, Homo sapiens
ctgtgacacatcgtt

SEQ ID NO: 1587100 - DNA, 14 bp, Homo sapiens
ctgtgacacctggt

SEQ ID NO: 1587101 - DNA, 22 bp, Homo sapiens
ctgtgacacctggtgcgggcct

SEQ ID NO: 1587102 - DNA, 20 bp, Homo sapiens
ctgtgacatggtgcctgaga

SEQ ID NO: 1587103 - DNA, 14 bp, Homo sapiens
ctgtgaccagcact

SEQ ID NO: 1587104 - DNA, 19 bp, Homo sapiens
ctgtgacgtcggccgacca

SEQ ID NO: 1587105 - DNA, 16 bp, Homo sapiens
ctgtgactataaagct

SEQ ID NO: 1587106 - DNA, 17 bp, Homo sapiens
ctgtgactataaagctg

SEQ ID NO: 1587107 - DNA, 19 bp, Homo sapiens
ctgtgactataaagctgtt

SEQ ID NO: 1587108 - DNA, 17 bp, Homo sapiens
ctgtgactctgggcagg

SEQ ID NO: 1587109 - DNA, 19 bp, Homo sapiens
ctgtgactctgggcaggga

SEQ ID NO: 1587110 - DNA, 18 bp, Homo sapiens
ctgtgacttaagaagcct

SEQ ID NO: 1587111 - DNA, 19 bp, Homo sapiens
ctgtgagaaggtttattgt

SEQ ID NO: 1587112 - DNA, 22 bp, Homo sapiens
ctgtgagaaggtttattgttaa

SEQ ID NO: 1587113 - DNA, 14 bp, Homo sapiens
ctgtgagaccccca

SEQ ID NO: 1587114 - DNA, 15 bp, Homo sapiens
ctgtgagacccccac

SEQ ID NO: 1587115 - DNA, 18 bp, Homo sapiens
ctgtgagacgaggcaggg

SEQ ID NO: 1587116 - DNA, 21 bp, Homo sapiens
ctgtgagacgaggcaggggct

SEQ ID NO: 1587117 - DNA, 20 bp, Homo sapiens
ctgtgagactcgagaacttt

SEQ ID NO: 1587118 - DNA, 23 bp, Homo sapiens
ctgtgagcaaggagcacaagcca

SEQ ID NO: 1587119 - DNA, 15 bp, Homo sapiens
ctgtgagcagcctcc

SEQ ID NO: 1587120 - DNA, 19 bp, Homo sapiens
ctgtgagcatccttcccag

SEQ ID NO: 1587121 - DNA, 23 bp, Homo sapiens
ctgtgagcatccttcccagcaga

SEQ ID NO: 1587122 - DNA, 17 bp, Homo sapiens
ctgtgagcttacattga

SEQ ID NO: 1587123 - DNA, 13 bp, Homo sapiens
ctgtgaggcaggg

SEQ ID NO: 1587124 - DNA, 14 bp, Homo sapiens
ctgtgaggcagggg

SEQ ID NO: 1587125 - DNA, 12 bp, Homo sapiens
ctgtgaggctgt

SEQ ID NO: 1587126 - DNA, 17 bp, Homo sapiens
ctgtgaggctgtcctgt

SEQ ID NO: 1587127 - DNA, 15 bp, Homo sapiens
ctgtgagggagggga

SEQ ID NO: 1587128 - DNA, 16 bp, Homo sapiens
ctgtgaggggaaggcc

SEQ ID NO: 1587129 - DNA, 19 bp, Homo sapiens
ctgtgaggggctctctcat

SEQ ID NO: 1587130 - DNA, 17 bp, Homo sapiens
ctgtgaggtgctgatga

SEQ ID NO: 1587131 - DNA, 19 bp, Homo sapiens
ctgtgagtgtaagtgtgag

SEQ ID NO: 1587132 - DNA, 20 bp, Homo sapiens
ctgtgagtgtaagtgtgagt

SEQ ID NO: 1587133 - DNA, 14 bp, Homo sapiens
ctgtgataaaaaga

SEQ ID NO: 1587134 - DNA, 18 bp, Homo sapiens
ctgtgatccttggtgctg

SEQ ID NO: 1587135 - DNA, 21 bp, Homo sapiens
ctgtgatccttggtgctgtgt

SEQ ID NO: 1587136 - DNA, 20 bp, Homo sapiens
ctgtgatctagtccttgtct

SEQ ID NO: 1587137 - DNA, 17 bp, Homo sapiens
ctgtgatcttttaaagt

SEQ ID NO: 1587138 - DNA, 13 bp, Homo sapiens
ctgtgatgagctg

SEQ ID NO: 1587139 - DNA, 17 bp, Homo sapiens
ctgtgatgatcctcata

SEQ ID NO: 1587140 - DNA, 13 bp, Homo sapiens
ctgtgatgcatga

SEQ ID NO: 1587141 - DNA, 14 bp, Homo sapiens
ctgtgatgcatgag

SEQ ID NO: 1587142 - DNA, 14 bp, Homo sapiens
ctgtgatgccacac

SEQ ID NO: 1587143 - DNA, 23 bp, Homo sapiens
ctgtgatggccaggccaggggac

SEQ ID NO: 1587144 - DNA, 16 bp, Homo sapiens
ctgtgattagatcaca

SEQ ID NO: 1587145 - DNA, 19 bp, Homo sapiens
ctgtgattagatcacatct

SEQ ID NO: 1587146 - DNA, 13 bp, Homo sapiens
ctgtgattgctgc

SEQ ID NO: 1587147 - DNA, 12 bp, Homo sapiens
ctgtgattggct

SEQ ID NO: 1587148 - DNA, 15 bp, Homo sapiens
ctgtgattggctggt

SEQ ID NO: 1587149 - DNA, 16 bp, Homo sapiens
ctgtgatttatttgga

SEQ ID NO: 1587150 - DNA, 13 bp, Homo sapiens
ctgtgatttctgg

SEQ ID NO: 1587151 - DNA, 16 bp, Homo sapiens
ctgtgcaaatccttga

SEQ ID NO: 1587152 - DNA, 18 bp, Homo sapiens
ctgtgcaacggtctcctg

SEQ ID NO: 1587153 - DNA, 18 bp, Homo sapiens
ctgtgcacagtggcttct

SEQ ID NO: 1587154 - DNA, 13 bp, Homo sapiens
ctgtgcacctacc

SEQ ID NO: 1587155 - DNA, 19 bp, Homo sapiens
ctgtgcacctaccccttgg

SEQ ID NO: 1587156 - DNA, 22 bp, Homo sapiens
ctgtgcacctaccccttggaaa

SEQ ID NO: 1587157 - DNA, 15 bp, Homo sapiens
ctgtgcacggtggac

SEQ ID NO: 1587158 - DNA, 16 bp, Homo sapiens
ctgtgcactagcctgt

SEQ ID NO: 1587159 - DNA, 20 bp, Homo sapiens
ctgtgcactagcctgtgatt

SEQ ID NO: 1587160 - DNA, 21 bp, Homo sapiens
ctgtgcactagcctgtgatta

SEQ ID NO: 1587161 - DNA, 11 bp, Homo sapiens
ctgtgcagaag

SEQ ID NO: 1587162 - DNA, 15 bp, Homo sapiens
ctgtgcagatgagca

SEQ ID NO: 1587163 - DNA, 18 bp, Homo sapiens
ctgtgcagatgagcagtc

SEQ ID NO: 1587164 - DNA, 17 bp, Homo sapiens
ctgtgcagcagcccagc

SEQ ID NO: 1587165 - DNA, 22 bp, Homo sapiens
ctgtgcagcagcccagcttcct

SEQ ID NO: 1587166 - DNA, 23 bp, Homo sapiens
ctgtgcagcagcccagcttcctg

SEQ ID NO: 1587167 - DNA, 12 bp, Homo sapiens
ctgtgcaggtgc

SEQ ID NO: 1587168 - DNA, 13 bp, Homo sapiens
ctgtgcaggtgct

SEQ ID NO: 1587169 - DNA, 16 bp, Homo sapiens
ctgtgcagtcactgga

SEQ ID NO: 1587170 - DNA, 20 bp, Homo sapiens
ctgtgcatcaaccaggaaga

SEQ ID NO: 1587171 - DNA, 20 bp, Homo sapiens
ctgtgcatgggtgaagggag

SEQ ID NO: 1587172 - DNA, 15 bp, Homo sapiens
ctgtgcatgtatgtc

SEQ ID NO: 1587173 - DNA, 16 bp, Homo sapiens
ctgtgcatgtatgtct

SEQ ID NO: 1587174 - DNA, 19 bp, Homo sapiens
ctgtgcattcatgcaagag

SEQ ID NO: 1587175 - DNA, 12 bp, Homo sapiens
ctgtgccaacct

SEQ ID NO: 1587176 - DNA, 21 bp, Homo sapiens
ctgtgccactcaccgaagcca

SEQ ID NO: 1587177 - DNA, 20 bp, Homo sapiens
ctgtgccactgacttgctgt

SEQ ID NO: 1587178 - DNA, 22 bp, Homo sapiens
ctgtgccactgacttgctgtgt

SEQ ID NO: 1587179 - DNA, 11 bp, Homo sapiens
ctgtgccagca

SEQ ID NO: 1587180 - DNA, 13 bp, Homo sapiens
ctgtgccagcagg

SEQ ID NO: 1587181 - DNA, 20 bp, Homo sapiens
ctgtgccatgctgggccact

SEQ ID NO: 1587182 - DNA, 23 bp, Homo sapiens
ctgtgccattttaaaaatagaat

SEQ ID NO: 1587183 - DNA, 15 bp, Homo sapiens
ctgtgcccagcaggc

SEQ ID NO: 1587184 - DNA, 16 bp, Homo sapiens
ctgtgcccagcaggcc

SEQ ID NO: 1587185 - DNA, 11 bp, Homo sapiens
ctgtgccccac

SEQ ID NO: 1587186 - DNA, 14 bp, Homo sapiens
ctgtgccccaccac

SEQ ID NO: 1587187 - DNA, 21 bp, Homo sapiens
ctgtgccccatgcctgtccag

SEQ ID NO: 1587188 - DNA, 21 bp, Homo sapiens
ctgtgcccctgatgcagcctg

SEQ ID NO: 1587189 - DNA, 17 bp, Homo sapiens
ctgtgccctggtggaga

SEQ ID NO: 1587190 - DNA, 15 bp, Homo sapiens
ctgtgcctcagagac

SEQ ID NO: 1587191 - DNA, 16 bp, Homo sapiens
ctgtgcctcagagacc

SEQ ID NO: 1587192 - DNA, 19 bp, Homo sapiens
ctgtgcctcagagaccagg

SEQ ID NO: 1587193 - DNA, 22 bp, Homo sapiens
ctgtgcctcagagaccagggct

SEQ ID NO: 1587194 - DNA, 15 bp, Homo sapiens
ctgtgcctcaggcca

SEQ ID NO: 1587195 - DNA, 20 bp, Homo sapiens
ctgtgcctcaggccagggct

SEQ ID NO: 1587196 - DNA, 14 bp, Homo sapiens
ctgtgcctcccaaa

SEQ ID NO: 1587197 - DNA, 14 bp, Homo sapiens
ctgtgcctcccccc

SEQ ID NO: 1587198 - DNA, 17 bp, Homo sapiens
ctgtgcctccccccaga

SEQ ID NO: 1587199 - DNA, 21 bp, Homo sapiens
ctgtgcctccccccagacccc

SEQ ID NO: 1587200 - DNA, 16 bp, Homo sapiens
ctgtgcctcctcaccc

SEQ ID NO: 1587201 - DNA, 18 bp, Homo sapiens
ctgtgcctctgggactgg

SEQ ID NO: 1587202 - DNA, 17 bp, Homo sapiens
ctgtgcctgctagagca

SEQ ID NO: 1587203 - DNA, 19 bp, Homo sapiens
ctgtgcctgctagagcaac

SEQ ID NO: 1587204 - DNA, 21 bp, Homo sapiens
ctgtgcctgctagagcaaccc

SEQ ID NO: 1587205 - DNA, 20 bp, Homo sapiens
ctgtgcctgctcagcagcca

SEQ ID NO: 1587206 - DNA, 17 bp, Homo sapiens
ctgtgcctgggccctgg

SEQ ID NO: 1587207 - DNA, 18 bp, Homo sapiens
ctgtgcctgggccctggg

SEQ ID NO: 1587208 - DNA, 21 bp, Homo sapiens
ctgtgcctgggccctgggctg

SEQ ID NO: 1587209 - DNA, 19 bp, Homo sapiens
ctgtgccttcttttgatta

SEQ ID NO: 1587210 - DNA, 17 bp, Homo sapiens
ctgtgcgcccagggctg

SEQ ID NO: 1587211 - DNA, 15 bp, Homo sapiens
ctgtgcgccttgtag

SEQ ID NO: 1587212 - DNA, 23 bp, Homo sapiens
ctgtgcgtcccagctgaaggcag

SEQ ID NO: 1587213 - DNA, 19 bp, Homo sapiens
ctgtgcgtcttggtgtaat

SEQ ID NO: 1587214 - DNA, 20 bp, Homo sapiens
ctgtgctagttttacagatt

SEQ ID NO: 1587215 - DNA, 13 bp, Homo sapiens
ctgtgctatgaat

SEQ ID NO: 1587216 - DNA, 16 bp, Homo sapiens
ctgtgctatgaatttt

SEQ ID NO: 1587217 - DNA, 16 bp, Homo sapiens
ctgtgctatttgtaca

SEQ ID NO: 1587218 - DNA, 12 bp, Homo sapiens
ctgtgctcagcc

SEQ ID NO: 1587219 - DNA, 17 bp, Homo sapiens
ctgtgctcatcggagac

SEQ ID NO: 1587220 - DNA, 21 bp, Homo sapiens
ctgtgctcatcggagactgcc

SEQ ID NO: 1587221 - DNA, 15 bp, Homo sapiens
ctgtgctccaacctg

SEQ ID NO: 1587222 - DNA, 23 bp, Homo sapiens
ctgtgctcccctgccacactgat

SEQ ID NO: 1587223 - DNA, 19 bp, Homo sapiens
ctgtgctccgtgcctccac

SEQ ID NO: 1587224 - DNA, 20 bp, Homo sapiens
ctgtgctccgtgcctccacc

SEQ ID NO: 1587225 - DNA, 15 bp, Homo sapiens
ctgtgctcctgccca

SEQ ID NO: 1587226 - DNA, 16 bp, Homo sapiens
ctgtgctcctgcccag

SEQ ID NO: 1587227 - DNA, 19 bp, Homo sapiens
ctgtgctcctgcccaggag

SEQ ID NO: 1587228 - DNA, 21 bp, Homo sapiens
ctgtgctcctgcccaggagca

SEQ ID NO: 1587229 - DNA, 22 bp, Homo sapiens
ctgtgctcctgcccaggagcag

SEQ ID NO: 1587230 - DNA, 20 bp, Homo sapiens
ctgtgctctggaggctgcag

SEQ ID NO: 1587231 - DNA, 13 bp, Homo sapiens
ctgtgctctggca

SEQ ID NO: 1587232 - DNA, 15 bp, Homo sapiens
ctgtgctctggcacc

SEQ ID NO: 1587233 - DNA, 16 bp, Homo sapiens
ctgtgctcttttggtg

SEQ ID NO: 1587234 - DNA, 22 bp, Homo sapiens
ctgtgctcttttggtggggagc

SEQ ID NO: 1587235 - DNA, 14 bp, Homo sapiens
ctgtgctgcatgcg

SEQ ID NO: 1587236 - DNA, 22 bp, Homo sapiens
ctgtgctgcccgtcttcagcct

SEQ ID NO: 1587237 - DNA, 21 bp, Homo sapiens
ctgtgctgggccagtggctgg

SEQ ID NO: 1587238 - DNA, 19 bp, Homo sapiens
ctgtgctggtgtcctgacc

SEQ ID NO: 1587239 - DNA, 23 bp, Homo sapiens
ctgtgctggtgtcctgaccaccc

SEQ ID NO: 1587240 - DNA, 18 bp, Homo sapiens
ctgtgctgtgcctgctag

SEQ ID NO: 1587241 - DNA, 21 bp, Homo sapiens
ctgtgctgtgcctgctagagc

SEQ ID NO: 1587242 - DNA, 11 bp, Homo sapiens
ctgtgctgtgt

SEQ ID NO: 1587243 - DNA, 18 bp, Homo sapiens
ctgtgctgtgtgtgacgt

SEQ ID NO: 1587244 - DNA, 17 bp, Homo sapiens
ctgtgcttcgactactg

SEQ ID NO: 1587245 - DNA, 22 bp, Homo sapiens
ctgtgctttcccagaggacacc

SEQ ID NO: 1587246 - DNA, 14 bp, Homo sapiens
ctgtggaagcaagg

SEQ ID NO: 1587247 - DNA, 18 bp, Homo sapiens
ctgtggacaggatgagga

SEQ ID NO: 1587248 - DNA, 16 bp, Homo sapiens
ctgtggacatgtgggt

SEQ ID NO: 1587249 - DNA, 20 bp, Homo sapiens
ctgtggaccgtggacaggcc

SEQ ID NO: 1587250 - DNA, 15 bp, Homo sapiens
ctgtggagactttct

SEQ ID NO: 1587251 - DNA, 14 bp, Homo sapiens
ctgtggagctgcca

SEQ ID NO: 1587252 - DNA, 17 bp, Homo sapiens
ctgtggagctgccacag

SEQ ID NO: 1587253 - DNA, 19 bp, Homo sapiens
ctgtggagctgccacagag

SEQ ID NO: 1587254 - DNA, 22 bp, Homo sapiens
ctgtggagctgccacagagaag

SEQ ID NO: 1587255 - DNA, 13 bp, Homo sapiens
ctgtggaggcctg

SEQ ID NO: 1587256 - DNA, 14 bp, Homo sapiens
ctgtggaggcctga

SEQ ID NO: 1587257 - DNA, 16 bp, Homo sapiens
ctgtggaggcctgatg

SEQ ID NO: 1587258 - DNA, 18 bp, Homo sapiens
ctgtggaggcctgatgct

SEQ ID NO: 1587259 - DNA, 22 bp, Homo sapiens
ctgtggaggcctgatgctgccc

SEQ ID NO: 1587260 - DNA, 16 bp, Homo sapiens
ctgtggagtccagctc

SEQ ID NO: 1587261 - DNA, 15 bp, Homo sapiens
ctgtggcacagactt

SEQ ID NO: 1587262 - DNA, 18 bp, Homo sapiens
ctgtggcacagccctgag

SEQ ID NO: 1587263 - DNA, 19 bp, Homo sapiens
ctgtggcacagccctgagt

SEQ ID NO: 1587264 - DNA, 21 bp, Homo sapiens
ctgtggcacttgcctgggtca

SEQ ID NO: 1587265 - DNA, 16 bp, Homo sapiens
ctgtggcagaaaagag

SEQ ID NO: 1587266 - DNA, 19 bp, Homo sapiens
ctgtggcagaaaagaggag

SEQ ID NO: 1587267 - DNA, 18 bp, Homo sapiens
ctgtggcagagttacagt

SEQ ID NO: 1587268 - DNA, 19 bp, Homo sapiens
ctgtggcagccgtcccagg

SEQ ID NO: 1587269 - DNA, 16 bp, Homo sapiens
ctgtggcagctgcccc

SEQ ID NO: 1587270 - DNA, 15 bp, Homo sapiens
ctgtggcataaattg

SEQ ID NO: 1587271 - DNA, 13 bp, Homo sapiens
ctgtggcatttcc

SEQ ID NO: 1587272 - DNA, 17 bp, Homo sapiens
ctgtggcatttccaaac

SEQ ID NO: 1587273 - DNA, 14 bp, Homo sapiens
ctgtggccacagcc

SEQ ID NO: 1587274 - DNA, 12 bp, Homo sapiens
ctgtggccagag

SEQ ID NO: 1587275 - DNA, 18 bp, Homo sapiens
ctgtggccagagctggaa

SEQ ID NO: 1587276 - DNA, 19 bp, Homo sapiens
ctgtggccagagctggaag

SEQ ID NO: 1587277 - DNA, 22 bp, Homo sapiens
ctgtggccagcttgttatttat

SEQ ID NO: 1587278 - DNA, 16 bp, Homo sapiens
ctgtggccctggccac

SEQ ID NO: 1587279 - DNA, 19 bp, Homo sapiens
ctgtggccgttatctggaa

SEQ ID NO: 1587280 - DNA, 20 bp, Homo sapiens
ctgtggccgttatctggaag

SEQ ID NO: 1587281 - DNA, 11 bp, Homo sapiens
ctgtggcctgg

SEQ ID NO: 1587282 - DNA, 16 bp, Homo sapiens
ctgtggcctgggcaag

SEQ ID NO: 1587283 - DNA, 14 bp, Homo sapiens
ctgtggcctgtgtc

SEQ ID NO: 1587284 - DNA, 20 bp, Homo sapiens
ctgtggcctgtgtcccatga

SEQ ID NO: 1587285 - DNA, 23 bp, Homo sapiens
ctgtggcctgtgtcccatgaccc

SEQ ID NO: 1587286 - DNA, 14 bp, Homo sapiens
ctgtggccttgccc

SEQ ID NO: 1587287 - DNA, 21 bp, Homo sapiens
ctgtggcgccgtctccagggg

SEQ ID NO: 1587288 - DNA, 16 bp, Homo sapiens
ctgtggcggccttccg

SEQ ID NO: 1587289 - DNA, 18 bp, Homo sapiens
ctgtggcgttctgctgcc

SEQ ID NO: 1587290 - DNA, 19 bp, Homo sapiens
ctgtggcgttctgctgccc

SEQ ID NO: 1587291 - DNA, 23 bp, Homo sapiens
ctgtggcgttctgctgcccctgc

SEQ ID NO: 1587292 - DNA, 20 bp, Homo sapiens
ctgtggctaaacagatgtaa

SEQ ID NO: 1587293 - DNA, 15 bp, Homo sapiens
ctgtggctagtgaca

SEQ ID NO: 1587294 - DNA, 11 bp, Homo sapiens
ctgtggctcca

SEQ ID NO: 1587295 - DNA, 16 bp, Homo sapiens
ctgtggctccctcctc

SEQ ID NO: 1587296 - DNA, 17 bp, Homo sapiens
ctgtggctgctagcact

SEQ ID NO: 1587297 - DNA, 20 bp, Homo sapiens
ctgtggctggaggagctggc

SEQ ID NO: 1587298 - DNA, 16 bp, Homo sapiens
ctgtggcttggagtgg

SEQ ID NO: 1587299 - DNA, 21 bp, Homo sapiens
ctgtggctttttgttcagaat

SEQ ID NO: 1587300 - DNA, 14 bp, Homo sapiens
ctgtgggagcctgc

SEQ ID NO: 1587301 - DNA, 20 bp, Homo sapiens
ctgtgggagggactttgctg

SEQ ID NO: 1587302 - DNA, 21 bp, Homo sapiens
ctgtgggcaattgttacaagt

SEQ ID NO: 1587303 - DNA, 16 bp, Homo sapiens
ctgtgggcactggtgg

SEQ ID NO: 1587304 - DNA, 22 bp, Homo sapiens
ctgtgggcttatgtctctgcct

SEQ ID NO: 1587305 - DNA, 15 bp, Homo sapiens
ctgtgggcttcccca

SEQ ID NO: 1587306 - DNA, 13 bp, Homo sapiens
cttaatgttactc

SEQ ID NO: 1587307 - DNA, 15 bp, Homo sapiens
cttaatgtttattcc

SEQ ID NO: 1587308 - DNA, 16 bp, Homo sapiens
cttaatgtttattcct

SEQ ID NO: 1587309 - DNA, 15 bp, Homo sapiens
cttaattctctgcaa

SEQ ID NO: 1587310 - DNA, 20 bp, Homo sapiens
cttaattctttgttctgttt

SEQ ID NO: 1587311 - DNA, 16 bp, Homo sapiens
cttaattgttcatttt

SEQ ID NO: 1587312 - DNA, 14 bp, Homo sapiens
cttaatttcctttt

SEQ ID NO: 1587313 - DNA, 21 bp, Homo sapiens
cttaatttcctttttgacact

SEQ ID NO: 1587314 - DNA, 23 bp, Homo sapiens
cttaatttcctttttgacactga

SEQ ID NO: 1587315 - DNA, 13 bp, Homo sapiens
cttacaaaatgcc

SEQ ID NO: 1587316 - DNA, 15 bp, Homo sapiens
cttacaaaatgccaa

SEQ ID NO: 1587317 - DNA, 11 bp, Homo sapiens
cttacaaactt

SEQ ID NO: 1587318 - DNA, 23 bp, Homo sapiens
cttacaaagggaaagcctctggc

SEQ ID NO: 1587319 - DNA, 22 bp, Homo sapiens
cttacaaggccctttcctttgg

SEQ ID NO: 1587320 - DNA, 21 bp, Homo sapiens
cttacaatattgattgggaaa

SEQ ID NO: 1587321 - DNA, 16 bp, Homo sapiens
cttacaattgcactgc

SEQ ID NO: 1587322 - DNA, 20 bp, Homo sapiens
cttacaattgcactgctgtt

SEQ ID NO: 1587323 - DNA, 17 bp, Homo sapiens
cttacacttggagcccg

SEQ ID NO: 1587324 - DNA, 23 bp, Homo sapiens
cttacacttggagcccgtgcagt

SEQ ID NO: 1587325 - DNA, 12 bp, Homo sapiens
cttacagagcct

SEQ ID NO: 1587326 - DNA, 20 bp, Homo sapiens
cttacaggaaaacctgcaga

SEQ ID NO: 1587327 - DNA, 17 bp, Homo sapiens
cttacagtaactaattt

SEQ ID NO: 1587328 - DNA, 15 bp, Homo sapiens
cttacatgtgtaaag

SEQ ID NO: 1587329 - DNA, 21 bp, Homo sapiens
cttacattagcagtttgcttt

SEQ ID NO: 1587330 - DNA, 15 bp, Homo sapiens
cttacattgaaaaca

SEQ ID NO: 1587331 - DNA, 15 bp, Homo sapiens
cttacattgtgaaac

SEQ ID NO: 1587332 - DNA, 20 bp, Homo sapiens
cttacattttcctgagacct

SEQ ID NO: 1587333 - DNA, 14 bp, Homo sapiens
cttacatttttaca

SEQ ID NO: 1587334 - DNA, 23 bp, Homo sapiens
cttaccaagttgtgcttttctgt

SEQ ID NO: 1587335 - DNA, 15 bp, Homo sapiens
cttacccaagctgtg

SEQ ID NO: 1587336 - DNA, 22 bp, Homo sapiens
cttacccaagctgtggcagccg

SEQ ID NO: 1587337 - DNA, 21 bp, Homo sapiens
cttacccggagaaggccgctg

SEQ ID NO: 1587338 - DNA, 23 bp, Homo sapiens
cttacccggagaaggccgctgcc

SEQ ID NO: 1587339 - DNA, 18 bp, Homo sapiens
cttacctaaacagatata

SEQ ID NO: 1587340 - DNA, 19 bp, Homo sapiens
cttacctaaacagatataa

SEQ ID NO: 1587341 - DNA, 21 bp, Homo sapiens
cttacctaaacagatataaat

SEQ ID NO: 1587342 - DNA, 15 bp, Homo sapiens
cttacctaacatctg

SEQ ID NO: 1587343 - DNA, 18 bp, Homo sapiens
cttacctaacttgaacat

SEQ ID NO: 1587344 - DNA, 15 bp, Homo sapiens
cttacctcctgccca

SEQ ID NO: 1587345 - DNA, 16 bp, Homo sapiens
cttacctcctgcccag

SEQ ID NO: 1587346 - DNA, 18 bp, Homo sapiens
cttacctcctgcccagga

SEQ ID NO: 1587347 - DNA, 13 bp, Homo sapiens
cttacctgacaca

SEQ ID NO: 1587348 - DNA, 19 bp, Homo sapiens
cttacctgacacaagagga

SEQ ID NO: 1587349 - DNA, 13 bp, Homo sapiens
cttatccctctct

SEQ ID NO: 1587350 - DNA, 17 bp, Homo sapiens
cttatccctctcttccc

SEQ ID NO: 1587351 - DNA, 16 bp, Homo sapiens
cttatcccttcttttt

SEQ ID NO: 1587352 - DNA, 20 bp, Homo sapiens
cttatcctctctctcttcta

SEQ ID NO: 1587353 - DNA, 15 bp, Homo sapiens
cttatctcagatatt

SEQ ID NO: 1587354 - DNA, 19 bp, Homo sapiens
cttatctcagatatttgca

SEQ ID NO: 1587355 - DNA, 20 bp, Homo sapiens
cttatctcagatatttgcac

SEQ ID NO: 1587356 - DNA, 18 bp, Homo sapiens
cttatctctcaaaacaat

SEQ ID NO: 1587357 - DNA, 14 bp, Homo sapiens
cttatcttatgcca

SEQ ID NO: 1587358 - DNA, 13 bp, Homo sapiens
cttatcttctgga

SEQ ID NO: 1587359 - DNA, 16 bp, Homo sapiens
cttatcttctggatta

SEQ ID NO: 1587360 - DNA, 21 bp, Homo sapiens
cttatctttctaaaactgcct

SEQ ID NO: 1587361 - DNA, 13 bp, Homo sapiens
cttatgagatggg

SEQ ID NO: 1587362 - DNA, 15 bp, Homo sapiens
cttatgaggagggga

SEQ ID NO: 1587363 - DNA, 15 bp, Homo sapiens
cttatgcatgaaatg

SEQ ID NO: 1587364 - DNA, 18 bp, Homo sapiens
cttatgcatgaaatgaat

SEQ ID NO: 1587365 - DNA, 19 bp, Homo sapiens
cttatgcatgaaatgaatg

SEQ ID NO: 1587366 - DNA, 21 bp, Homo sapiens
cttatgctagtttattggaag

SEQ ID NO: 1587367 - DNA, 21 bp, Homo sapiens
cttatgggtccccctcagcaa

SEQ ID NO: 1587368 - DNA, 19 bp, Homo sapiens
cttatgtagcaggaaataa

SEQ ID NO: 1587369 - DNA, 14 bp, Homo sapiens
cttatgtctctgcc

SEQ ID NO: 1587370 - DNA, 13 bp, Homo sapiens
cttatgttccaga

SEQ ID NO: 1587371 - DNA, 16 bp, Homo sapiens
cttattacattttatt

SEQ ID NO: 1587372 - DNA, 22 bp, Homo sapiens
cttattaccctgattgaatgtg

SEQ ID NO: 1587373 - DNA, 14 bp, Homo sapiens
cttattactattat

SEQ ID NO: 1587374 - DNA, 15 bp, Homo sapiens
cttattcaccttttt

SEQ ID NO: 1587375 - DNA, 18 bp, Homo sapiens
cttattccgagcattcca

SEQ ID NO: 1587376 - DNA, 20 bp, Homo sapiens
cttattccgagcattccagt

SEQ ID NO: 1587377 - DNA, 14 bp, Homo sapiens
cttattctgtagat

SEQ ID NO: 1587378 - DNA, 17 bp, Homo sapiens
cttattcttgtggttaa

SEQ ID NO: 1587379 - DNA, 14 bp, Homo sapiens
cttattgcgctgct

SEQ ID NO: 1587380 - DNA, 15 bp, Homo sapiens
cttattggaactctg

SEQ ID NO: 1587381 - DNA, 13 bp, Homo sapiens
cttattggccact

SEQ ID NO: 1587382 - DNA, 21 bp, Homo sapiens
cttattgtgtgcgctgcctgg

SEQ ID NO: 1587383 - DNA, 12 bp, Homo sapiens
cttattgtttaa

SEQ ID NO: 1587384 - DNA, 18 bp, Homo sapiens
cttattgtttctctgaaa

SEQ ID NO: 1587385 - DNA, 18 bp, Homo sapiens
cttatttaaaaatatttc

SEQ ID NO: 1587386 - DNA, 21 bp, Homo sapiens
cttatttaaaaatatttcaga

SEQ ID NO: 1587387 - DNA, 22 bp, Homo sapiens
cttatttaaaaatatttcagat

SEQ ID NO: 1587388 - DNA, 22 bp, Homo sapiens
cttatttaatcttttcttattt

SEQ ID NO: 1587389 - DNA, 15 bp, Homo sapiens
cttatttaatgaaag

SEQ ID NO: 1587390 - DNA, 15 bp, Homo sapiens
cttatttaccctttt

SEQ ID NO: 1587391 - DNA, 21 bp, Homo sapiens
cttatttatcctagtattcct

SEQ ID NO: 1587392 - DNA, 16 bp, Homo sapiens
cttatttctaactatt

SEQ ID NO: 1587393 - DNA, 16 bp, Homo sapiens
cttatttctatgacaa

SEQ ID NO: 1587394 - DNA, 22 bp, Homo sapiens
cttatttgccttctactcccct

SEQ ID NO: 1587395 - DNA, 21 bp, Homo sapiens
cttatttgtctgtaaaaaatg

SEQ ID NO: 1587396 - DNA, 14 bp, Homo sapiens
cttattttagacaa

SEQ ID NO: 1587397 - DNA, 18 bp, Homo sapiens
cttattttattatgagct

SEQ ID NO: 1587398 - DNA, 18 bp, Homo sapiens
cttattttcaagaaactg

SEQ ID NO: 1587399 - DNA, 11 bp, Homo sapiens
cttattttctg

SEQ ID NO: 1587400 - DNA, 13 bp, Homo sapiens
cttattttctgaa

SEQ ID NO: 1587401 - DNA, 23 bp, Homo sapiens
cttattttctgttcagattaaaa

SEQ ID NO: 1587402 - DNA, 20 bp, Homo sapiens
cttattttgcattccagaat

SEQ ID NO: 1587403 - DNA, 13 bp, Homo sapiens
cttattttgtaag

SEQ ID NO: 1587404 - DNA, 22 bp, Homo sapiens
cttatttttctgaggtccttat

SEQ ID NO: 1587405 - DNA, 17 bp, Homo sapiens
cttatttttgacagtgt

SEQ ID NO: 1587406 - DNA, 18 bp, Homo sapiens
cttcaaaatgttctattt

SEQ ID NO: 1587407 - DNA, 20 bp, Homo sapiens
cttcaaaatgttctatttaa

SEQ ID NO: 1587408 - DNA, 13 bp, Homo sapiens
cttcaaagccttc

SEQ ID NO: 1587409 - DNA, 20 bp, Homo sapiens
cttcaaaggccaagagaatt

SEQ ID NO: 1587410 - DNA, 14 bp, Homo sapiens
cttcaaatgcaaat

SEQ ID NO: 1587411 - DNA, 19 bp, Homo sapiens
cttcaaattagaagacatt

SEQ ID NO: 1587412 - DNA, 22 bp, Homo sapiens
cttcaacaacgtgagagaaaga

SEQ ID NO: 1587413 - DNA, 15 bp, Homo sapiens
cttcaacatttacat

SEQ ID NO: 1587414 - DNA, 15 bp, Homo sapiens
cttcaacccagtggg

SEQ ID NO: 1587415 - DNA, 18 bp, Homo sapiens
cttcagtctgctccacca

SEQ ID NO: 1587416 - DNA, 18 bp, Homo sapiens
cttcagtgaagaacccta

SEQ ID NO: 1587417 - DNA, 19 bp, Homo sapiens
cttcagtgaatatttttgt

SEQ ID NO: 1587418 - DNA, 23 bp, Homo sapiens
cttcagtgaatatttttgtattt

SEQ ID NO: 1587419 - DNA, 14 bp, Homo sapiens
cttcagtgactcct

SEQ ID NO: 1587420 - DNA, 15 bp, Homo sapiens
cttcagtgactcctg

SEQ ID NO: 1587421 - DNA, 21 bp, Homo sapiens
cttcagtgactcctgctggta

SEQ ID NO: 1587422 - DNA, 23 bp, Homo sapiens
cttcagtgactcctgctggtacc

SEQ ID NO: 1587423 - DNA, 13 bp, Homo sapiens
cttcagtgcccac

SEQ ID NO: 1587424 - DNA, 23 bp, Homo sapiens
cttcagtggaccgaaatctgtat

SEQ ID NO: 1587425 - DNA, 18 bp, Homo sapiens
cttcagtgtaatgtgact

SEQ ID NO: 1587426 - DNA, 14 bp, Homo sapiens
cttcagttgcttgt

SEQ ID NO: 1587427 - DNA, 14 bp, Homo sapiens
cttcagtttatttc

SEQ ID NO: 1587428 - DNA, 20 bp, Homo sapiens
cttcagtttccgaatctctt

SEQ ID NO: 1587429 - DNA, 14 bp, Homo sapiens
cttcagtttgtaaa

SEQ ID NO: 1587430 - DNA, 19 bp, Homo sapiens
cttcataacaattttagga

SEQ ID NO: 1587431 - DNA, 12 bp, Homo sapiens
cttcataatcca

SEQ ID NO: 1587432 - DNA, 18 bp, Homo sapiens
cttcataccgcctcgtgc

SEQ ID NO: 1587433 - DNA, 21 bp, Homo sapiens
cttcataccgcctcgtgccag

SEQ ID NO: 1587434 - DNA, 15 bp, Homo sapiens
cttcatagaaacctc

SEQ ID NO: 1587435 - DNA, 18 bp, Homo sapiens
cttcatagcagattttaa

SEQ ID NO: 1587436 - DNA, 21 bp, Homo sapiens
cttcataggcggtcatgtgtg

SEQ ID NO: 1587437 - DNA, 23 bp, Homo sapiens
cttcataggcggtcatgtgtgca

SEQ ID NO: 1587438 - DNA, 20 bp, Homo sapiens
cttcatatgtcacctttgct

SEQ ID NO: 1587439 - DNA, 16 bp, Homo sapiens
cttcatccaatgtgaa

SEQ ID NO: 1587440 - DNA, 18 bp, Homo sapiens
cttcatccaatgtgaagt

SEQ ID NO: 1587441 - DNA, 17 bp, Homo sapiens
cttcatcccattccagg

SEQ ID NO: 1587442 - DNA, 13 bp, Homo sapiens
cttcatctccagg

SEQ ID NO: 1587443 - DNA, 12 bp, Homo sapiens
cttcatctgact

SEQ ID NO: 1587444 - DNA, 13 bp, Homo sapiens
cttcatctggcaa

SEQ ID NO: 1587445 - DNA, 20 bp, Homo sapiens
cttcatcttcctgtgtcctg

SEQ ID NO: 1587446 - DNA, 17 bp, Homo sapiens
cttcatgcctttgtaag

SEQ ID NO: 1587447 - DNA, 16 bp, Homo sapiens
cttcatgtaattttat

SEQ ID NO: 1587448 - DNA, 21 bp, Homo sapiens
cttcatgtaattttattttaa

SEQ ID NO: 1587449 - DNA, 20 bp, Homo sapiens
cttcattaccttttttgata

SEQ ID NO: 1587450 - DNA, 17 bp, Homo sapiens
cttcattattcaagaat

SEQ ID NO: 1587451 - DNA, 21 bp, Homo sapiens
cttcattattcaagaatgaaa

SEQ ID NO: 1587452 - DNA, 14 bp, Homo sapiens
cttcattcagatct

SEQ ID NO: 1587453 - DNA, 20 bp, Homo sapiens
cttcattccggactggcaga

SEQ ID NO: 1587454 - DNA, 22 bp, Homo sapiens
cttcattccggactggcagaag

SEQ ID NO: 1587455 - DNA, 23 bp, Homo sapiens
cttcattccggactggcagaagc

SEQ ID NO: 1587456 - DNA, 19 bp, Homo sapiens
cttcattccgttaggaata

SEQ ID NO: 1587457 - DNA, 22 bp, Homo sapiens
cttcattctccttgttgttggt

SEQ ID NO: 1587458 - DNA, 18 bp, Homo sapiens
cttcattctgagaccaaa

SEQ ID NO: 1587459 - DNA, 15 bp, Homo sapiens
cttcattctggaaac

SEQ ID NO: 1587460 - DNA, 21 bp, Homo sapiens
cttcattctttactgcactca

SEQ ID NO: 1587461 - DNA, 13 bp, Homo sapiens
cttcattgaaagc

SEQ ID NO: 1587462 - DNA, 14 bp, Homo sapiens
cttcattgagagtt

SEQ ID NO: 1587463 - DNA, 14 bp, Homo sapiens
cttcattgttttaa

SEQ ID NO: 1587464 - DNA, 15 bp, Homo sapiens
cttcatttattttga

SEQ ID NO: 1587465 - DNA, 13 bp, Homo sapiens
cttcatttctctg

SEQ ID NO: 1587466 - DNA, 14 bp, Homo sapiens
cttcatttctctgc

SEQ ID NO: 1587467 - DNA, 11 bp, Homo sapiens
cttcatttgta

SEQ ID NO: 1587468 - DNA, 18 bp, Homo sapiens
cttccaaaacctgcttcc

SEQ ID NO: 1587469 - DNA, 18 bp, Homo sapiens
cttcctcacacccctgtc

SEQ ID NO: 1587470 - DNA, 19 bp, Homo sapiens
cttcctcactatgacactg

SEQ ID NO: 1587471 - DNA, 16 bp, Homo sapiens
cttcctcactgcccaa

SEQ ID NO: 1587472 - DNA, 14 bp, Homo sapiens
cttcctcagcctcc

SEQ ID NO: 1587473 - DNA, 18 bp, Homo sapiens
cttcctcagcctccaaag

SEQ ID NO: 1587474 - DNA, 20 bp, Homo sapiens
cttcctcagtttaatccttc

SEQ ID NO: 1587475 - DNA, 18 bp, Homo sapiens
cttcctcatccaccccat

SEQ ID NO: 1587476 - DNA, 23 bp, Homo sapiens
cttcctccccacactccactctg

SEQ ID NO: 1587477 - DNA, 16 bp, Homo sapiens
cttcctcccggggcct

SEQ ID NO: 1587478 - DNA, 22 bp, Homo sapiens
cttcctcccggggccttccttt

SEQ ID NO: 1587479 - DNA, 14 bp, Homo sapiens
cttcctccctgggg

SEQ ID NO: 1587480 - DNA, 16 bp, Homo sapiens
cttcctccgtccaccc

SEQ ID NO: 1587481 - DNA, 19 bp, Homo sapiens
cttcctccgtccacccagg

SEQ ID NO: 1587482 - DNA, 21 bp, Homo sapiens
cttcctccgtccacccaggct

SEQ ID NO: 1587483 - DNA, 13 bp, Homo sapiens
cttcctcctccac

SEQ ID NO: 1587484 - DNA, 17 bp, Homo sapiens
cttcctcctccccactt

SEQ ID NO: 1587485 - DNA, 11 bp, Homo sapiens
cttcctcctga

SEQ ID NO: 1587486 - DNA, 12 bp, Homo sapiens
cttcctcctgat

SEQ ID NO: 1587487 - DNA, 13 bp, Homo sapiens
cttcctcctgatg

SEQ ID NO: 1587488 - DNA, 14 bp, Homo sapiens
cttcctcctggaaa

SEQ ID NO: 1587489 - DNA, 14 bp, Homo sapiens
cttcctctccactg

SEQ ID NO: 1587490 - DNA, 21 bp, Homo sapiens
cttcctctccactgccttcga

SEQ ID NO: 1587491 - DNA, 15 bp, Homo sapiens
cttcctctctccaga

SEQ ID NO: 1587492 - DNA, 16 bp, Homo sapiens
cttcctctctccagat

SEQ ID NO: 1587493 - DNA, 21 bp, Homo sapiens
cttcctctctctaccagtcta

SEQ ID NO: 1587494 - DNA, 19 bp, Homo sapiens
cttcctctgcagctgacct

SEQ ID NO: 1587495 - DNA, 11 bp, Homo sapiens
cttcctctggt

SEQ ID NO: 1587496 - DNA, 14 bp, Homo sapiens
cttcctcttagcct

SEQ ID NO: 1587497 - DNA, 17 bp, Homo sapiens
cttcctcttagcctctg

SEQ ID NO: 1587498 - DNA, 15 bp, Homo sapiens
cttcctcttcctgcc

SEQ ID NO: 1587499 - DNA, 19 bp, Homo sapiens
cttcctcttcctgcccttg

SEQ ID NO: 1587500 - DNA, 16 bp, Homo sapiens
cttcctcttggctgag

SEQ ID NO: 1587501 - DNA, 14 bp, Homo sapiens
cttcctcttgtctg

SEQ ID NO: 1587502 - DNA, 20 bp, Homo sapiens
cttcctctttggtggcatgg

SEQ ID NO: 1587503 - DNA, 18 bp, Homo sapiens
cttcctgacactttaatt

SEQ ID NO: 1587504 - DNA, 12 bp, Homo sapiens
cttcctgactct

SEQ ID NO: 1587505 - DNA, 20 bp, Homo sapiens
cttcctgcattcacccagac

SEQ ID NO: 1587506 - DNA, 12 bp, Homo sapiens
cttcctgccagc

SEQ ID NO: 1587507 - DNA, 14 bp, Homo sapiens
cttcctgctgcacc

SEQ ID NO: 1587508 - DNA, 23 bp, Homo sapiens
cttcctgctgcaccctgcgcctc

SEQ ID NO: 1587509 - DNA, 17 bp, Homo sapiens
cttcctgctgctgctac

SEQ ID NO: 1587510 - DNA, 22 bp, Homo sapiens
cttcctgctgctgtaactgctg

SEQ ID NO: 1587511 - DNA, 18 bp, Homo sapiens
cttcctgcttcctcagag

SEQ ID NO: 1587512 - DNA, 14 bp, Homo sapiens
cttcctggaaacag

SEQ ID NO: 1587513 - DNA, 19 bp, Homo sapiens
cttcctggaaacagcatga

SEQ ID NO: 1587514 - DNA, 13 bp, Homo sapiens
cttcctggacctg

SEQ ID NO: 1587515 - DNA, 17 bp, Homo sapiens
cttcctggacctgagtc

SEQ ID NO: 1587516 - DNA, 21 bp, Homo sapiens
cttcctggcctcactggctgg

SEQ ID NO: 1587517 - DNA, 22 bp, Homo sapiens
cttcctggcctcccttctcctt

SEQ ID NO: 1587518 - DNA, 21 bp, Homo sapiens
cttcctggggacgaattccac

SEQ ID NO: 1587519 - DNA, 17 bp, Homo sapiens
cttcctggggccccgct

SEQ ID NO: 1587520 - DNA, 22 bp, Homo sapiens
cttcctgggtcctgcctggtcc

SEQ ID NO: 1587521 - DNA, 18 bp, Homo sapiens
cttcctgtccagctccaa

SEQ ID NO: 1587522 - DNA, 20 bp, Homo sapiens
cttcctgtgtacctctagaa

SEQ ID NO: 1587523 - DNA, 15 bp, Homo sapiens
cttcctgtgtcctga

SEQ ID NO: 1587524 - DNA, 23 bp, Homo sapiens
cttcctgtgtgtccaaaactgcc

SEQ ID NO: 1587525 - DNA, 14 bp, Homo sapiens
cttccttcagggtt

SEQ ID NO: 1587526 - DNA, 18 bp, Homo sapiens
cttccttcagggtttaat

SEQ ID NO: 1587527 - DNA, 23 bp, Homo sapiens
cttccttcagggtttaatagact

SEQ ID NO: 1587528 - DNA, 18 bp, Homo sapiens
cttccttccctgggctgt

SEQ ID NO: 1587529 - DNA, 14 bp, Homo sapiens
cttccttcctgctt

SEQ ID NO: 1587530 - DNA, 15 bp, Homo sapiens
cttccttctacccca

SEQ ID NO: 1587531 - DNA, 21 bp, Homo sapiens
cttccttctaccccaaggcca

SEQ ID NO: 1587532 - DNA, 13 bp, Homo sapiens
cttccttctggga

SEQ ID NO: 1587533 - DNA, 22 bp, Homo sapiens
cttccttgaagaactgcaggcc

SEQ ID NO: 1587534 - DNA, 15 bp, Homo sapiens
cttccttgaccagca

SEQ ID NO: 1587535 - DNA, 16 bp, Homo sapiens
cttccttgaccagcag

SEQ ID NO: 1587536 - DNA, 22 bp, Homo sapiens
cttccttgaccagcagatccca

SEQ ID NO: 1587537 - DNA, 20 bp, Homo sapiens
cttccttgagacacggagcc

SEQ ID NO: 1587538 - DNA, 19 bp, Homo sapiens
cttccttggactcatttta

SEQ ID NO: 1587539 - DNA, 16 bp, Homo sapiens
cttcctttaaaaaact

SEQ ID NO: 1587540 - DNA, 17 bp, Homo sapiens
cttcctttcaggccaag

SEQ ID NO: 1587541 - DNA, 19 bp, Homo sapiens
cttcctttcccaagccttc

SEQ ID NO: 1587542 - DNA, 18 bp, Homo sapiens
cttcctttctcctgcccc

SEQ ID NO: 1587543 - DNA, 19 bp, Homo sapiens
cttcctttctcctgcccca

SEQ ID NO: 1587544 - DNA, 20 bp, Homo sapiens
cttcctttctcctgccccaa

SEQ ID NO: 1587545 - DNA, 18 bp, Homo sapiens
cttcctttctctcctggc

SEQ ID NO: 1587546 - DNA, 19 bp, Homo sapiens
cttcctttctctcctggct

SEQ ID NO: 1587547 - DNA, 15 bp, Homo sapiens
cttcgaaacctggga

SEQ ID NO: 1587548 - DNA, 20 bp, Homo sapiens
cttcgaaagcatcattattt

SEQ ID NO: 1587549 - DNA, 16 bp, Homo sapiens
cttcgaaaggccttca

SEQ ID NO: 1587550 - DNA, 18 bp, Homo sapiens
cttcgaaaggccttcaga

SEQ ID NO: 1587551 - DNA, 19 bp, Homo sapiens
cttcgacagctgggctgga

SEQ ID NO: 1587552 - DNA, 13 bp, Homo sapiens
cttcgactactgc

SEQ ID NO: 1587553 - DNA, 18 bp, Homo sapiens
cttcgactactgctcctg

SEQ ID NO: 1587554 - DNA, 16 bp, Homo sapiens
cttcgactcaggatcc

SEQ ID NO: 1587555 - DNA, 18 bp, Homo sapiens
cttcgactcaggatccag

SEQ ID NO: 1587556 - DNA, 16 bp, Homo sapiens
cttcgatacaccgggc

SEQ ID NO: 1587557 - DNA, 13 bp, Homo sapiens
cttcgcctgcagc

SEQ ID NO: 1587558 - DNA, 19 bp, Homo sapiens
cttcgcgtgccctcgctgc

SEQ ID NO: 1587559 - DNA, 15 bp, Homo sapiens
cttcgctgctctagc

SEQ ID NO: 1587560 - DNA, 17 bp, Homo sapiens
cttcgctgctctagctg

SEQ ID NO: 1587561 - DNA, 19 bp, Homo sapiens
cttcgctgctctagctggc

SEQ ID NO: 1587562 - DNA, 15 bp, Homo sapiens
cttcgcttcttgcct

SEQ ID NO: 1587563 - DNA, 16 bp, Homo sapiens
cttcgcttcttgcctc

SEQ ID NO: 1587564 - DNA, 18 bp, Homo sapiens
cttcgcttcttgcctctg

SEQ ID NO: 1587565 - DNA, 18 bp, Homo sapiens
cttcggagggcccctgcg

SEQ ID NO: 1587566 - DNA, 14 bp, Homo sapiens
cttcggcagggagg

SEQ ID NO: 1587567 - DNA, 14 bp, Homo sapiens
cttcggggcctcct

SEQ ID NO: 1587568 - DNA, 14 bp, Homo sapiens
cttcgtctttccca

SEQ ID NO: 1587569 - DNA, 22 bp, Homo sapiens
cttcgtctttcccatggggagg

SEQ ID NO: 1587570 - DNA, 13 bp, Homo sapiens
cttcgtgaacata

SEQ ID NO: 1587571 - DNA, 22 bp, Homo sapiens
cttcgtggttgtgtttctcgtg

SEQ ID NO: 1587572 - DNA, 16 bp, Homo sapiens
cttcgtgtctctccca

SEQ ID NO: 1587573 - DNA, 17 bp, Homo sapiens
cttcgtgtctctcccac

SEQ ID NO: 1587574 - DNA, 15 bp, Homo sapiens
cttcgtttattttca

SEQ ID NO: 1587575 - DNA, 14 bp, Homo sapiens
cttctaaaaatgaa

SEQ ID NO: 1587576 - DNA, 16 bp, Homo sapiens
cttctaaaagccatta

SEQ ID NO: 1587577 - DNA, 14 bp, Homo sapiens
cttctaaacatttt

SEQ ID NO: 1587578 - DNA, 15 bp, Homo sapiens
cttctaaacattttt

SEQ ID NO: 1587579 - DNA, 20 bp, Homo sapiens
cttctaagaagacattttgt

SEQ ID NO: 1587580 - DNA, 12 bp, Homo sapiens
cttctaagagcg

SEQ ID NO: 1587581 - DNA, 22 bp, Homo sapiens
cttctaaggaaatggagaagct

SEQ ID NO: 1587582 - DNA, 14 bp, Homo sapiens
ctgtaaaatgcaaa

SEQ ID NO: 1587583 - DNA, 18 bp, Homo sapiens
ctgtaaaatgcaaaaaat

SEQ ID NO: 1587584 - DNA, 13 bp, Homo sapiens
ctgtaaactgtgt

SEQ ID NO: 1587585 - DNA, 20 bp, Homo sapiens
ctgtaaactgtgtattccaa

SEQ ID NO: 1587586 - DNA, 19 bp, Homo sapiens
ctgtaaagaaacatttcct

SEQ ID NO: 1587587 - DNA, 12 bp, Homo sapiens
ctgtaaagatgt

SEQ ID NO: 1587588 - DNA, 17 bp, Homo sapiens
ctgtaaataaaatgtgt

SEQ ID NO: 1587589 - DNA, 13 bp, Homo sapiens
ctgtaaatatatc

SEQ ID NO: 1587590 - DNA, 19 bp, Homo sapiens
ctgtaaatatgtttgtgcc

SEQ ID NO: 1587591 - DNA, 22 bp, Homo sapiens
ctgtaaatatgtttgtgcctta

SEQ ID NO: 1587592 - DNA, 16 bp, Homo sapiens
ctgtaaatttaactgc

SEQ ID NO: 1587593 - DNA, 17 bp, Homo sapiens
ctgtaaatttaactgca

SEQ ID NO: 1587594 - DNA, 19 bp, Homo sapiens
ctgtaaatttaactgcata

SEQ ID NO: 1587595 - DNA, 21 bp, Homo sapiens
ctgtaaatttttgttctttta

SEQ ID NO: 1587596 - DNA, 16 bp, Homo sapiens
ctgtaacactcctctg

SEQ ID NO: 1587597 - DNA, 13 bp, Homo sapiens
ctgtaacctgatt

SEQ ID NO: 1587598 - DNA, 19 bp, Homo sapiens
ctgtaactactttataact

SEQ ID NO: 1587599 - DNA, 15 bp, Homo sapiens
ctgtaacttaaaata

SEQ ID NO: 1587600 - DNA, 18 bp, Homo sapiens
ctgtaagaaaaaaaatgt

SEQ ID NO: 1587601 - DNA, 20 bp, Homo sapiens
ctgtaagaagagactgggaa

SEQ ID NO: 1587602 - DNA, 22 bp, Homo sapiens
ctgtaagaagagactgggaaga

SEQ ID NO: 1587603 - DNA, 16 bp, Homo sapiens
ctgtaagagaaaatat

SEQ ID NO: 1587604 - DNA, 17 bp, Homo sapiens
ctgtaagcctatatata

SEQ ID NO: 1587605 - DNA, 14 bp, Homo sapiens
ctgtaaggctctag

SEQ ID NO: 1587606 - DNA, 12 bp, Homo sapiens
ctgtaagggcag

SEQ ID NO: 1587607 - DNA, 14 bp, Homo sapiens
ctgtaagggcagtg

SEQ ID NO: 1587608 - DNA, 17 bp, Homo sapiens
ctgtaagtgtagctcaa

SEQ ID NO: 1587609 - DNA, 23 bp, Homo sapiens
ctgtaagtttattttttctacac

SEQ ID NO: 1587610 - DNA, 21 bp, Homo sapiens
ctgtaatacgtagctctctta

SEQ ID NO: 1587611 - DNA, 22 bp, Homo sapiens
ctgtaatagttcagtagaatta

SEQ ID NO: 1587612 - DNA, 20 bp, Homo sapiens
ctgtaatataaagtattcaa

SEQ ID NO: 1587613 - DNA, 15 bp, Homo sapiens
ctgtaatcaagaaaa

SEQ ID NO: 1587614 - DNA, 19 bp, Homo sapiens
ctgtaatcatataataaat

SEQ ID NO: 1587615 - DNA, 17 bp, Homo sapiens
ctgtaatgtaaataaac

SEQ ID NO: 1587616 - DNA, 15 bp, Homo sapiens
ctgtaattcaggttt

SEQ ID NO: 1587617 - DNA, 12 bp, Homo sapiens
ctgtaattgtgt

SEQ ID NO: 1587618 - DNA, 21 bp, Homo sapiens
ctgtaatttcgccttaaactc

SEQ ID NO: 1587619 - DNA, 15 bp, Homo sapiens
ctgtacaaagtagaa

SEQ ID NO: 1587620 - DNA, 18 bp, Homo sapiens
ctgtacacgtgtcctgta

SEQ ID NO: 1587621 - DNA, 19 bp, Homo sapiens
ctgtacactgaatatttat

SEQ ID NO: 1587622 - DNA, 15 bp, Homo sapiens
ctgtacactgacttg

SEQ ID NO: 1587623 - DNA, 18 bp, Homo sapiens
ctgtacagaatgctattt

SEQ ID NO: 1587624 - DNA, 21 bp, Homo sapiens
ctgtacagaatgctatttcac

SEQ ID NO: 1587625 - DNA, 21 bp, Homo sapiens
ctgtacattgtgagctctggt

SEQ ID NO: 1587626 - DNA, 13 bp, Homo sapiens
ctgtacatttaaa

SEQ ID NO: 1587627 - DNA, 19 bp, Homo sapiens
ctgtaccacatctgctcta

SEQ ID NO: 1587628 - DNA, 16 bp, Homo sapiens
ctgtaccagttaattt

SEQ ID NO: 1587629 - DNA, 23 bp, Homo sapiens
ctgtacccagctccttttgtccc

SEQ ID NO: 1587630 - DNA, 23 bp, Homo sapiens
ctgtaccctcgcatgactgttac

SEQ ID NO: 1587631 - DNA, 15 bp, Homo sapiens
ctgtaccctttaaga

SEQ ID NO: 1587632 - DNA, 19 bp, Homo sapiens
ctgtaccgcccggcagccc

SEQ ID NO: 1587633 - DNA, 21 bp, Homo sapiens
ctgtaccgcccggcagcccct

SEQ ID NO: 1587634 - DNA, 21 bp, Homo sapiens
ctgtacctgttccttagacct

SEQ ID NO: 1587635 - DNA, 23 bp, Homo sapiens
ctgtaccttttgaggagccccag

SEQ ID NO: 1587636 - DNA, 13 bp, Homo sapiens
ctgtacgaaaaag

SEQ ID NO: 1587637 - DNA, 17 bp, Homo sapiens
ctgtacgaaaaagagca

SEQ ID NO: 1587638 - DNA, 17 bp, Homo sapiens
ctgtactactgccttgt

SEQ ID NO: 1587639 - DNA, 14 bp, Homo sapiens
ctgtactcagagca

SEQ ID NO: 1587640 - DNA, 16 bp, Homo sapiens
ctgtactcctcccagg

SEQ ID NO: 1587641 - DNA, 21 bp, Homo sapiens
ctgtactcctcccaggcgccc

SEQ ID NO: 1587642 - DNA, 16 bp, Homo sapiens
ctgtactcttgctgat

SEQ ID NO: 1587643 - DNA, 20 bp, Homo sapiens
ctgtactgatttttgtaaga

SEQ ID NO: 1587644 - DNA, 22 bp, Homo sapiens
ctgtactgttactgggccctga

SEQ ID NO: 1587645 - DNA, 20 bp, Homo sapiens
ctgtactgttctgtgtcttt

SEQ ID NO: 1587646 - DNA, 14 bp, Homo sapiens
ctgtactgttttct

SEQ ID NO: 1587647 - DNA, 16 bp, Homo sapiens
ctgtacttaataaatt

SEQ ID NO: 1587648 - DNA, 18 bp, Homo sapiens
ctgtacttaataaattca

SEQ ID NO: 1587649 - DNA, 17 bp, Homo sapiens
ctgtacttcactgtcag

SEQ ID NO: 1587650 - DNA, 17 bp, Homo sapiens
ctgtacttcttgaatat

SEQ ID NO: 1587651 - DNA, 19 bp, Homo sapiens
ctgtactttgccatttttc

SEQ ID NO: 1587652 - DNA, 18 bp, Homo sapiens
ctgtacttttcattctct

SEQ ID NO: 1587653 - DNA, 22 bp, Homo sapiens
ctgtagaaaggggagaatgtca

SEQ ID NO: 1587654 - DNA, 15 bp, Homo sapiens
ctgtagactagtgcc

SEQ ID NO: 1587655 - DNA, 23 bp, Homo sapiens
ctgtagacttctggttgtatttc

SEQ ID NO: 1587656 - DNA, 16 bp, Homo sapiens
ctgtagatcaggtttg

SEQ ID NO: 1587657 - DNA, 18 bp, Homo sapiens
ctgtagatggtgacctgg

SEQ ID NO: 1587658 - DNA, 19 bp, Homo sapiens
ctgtagatggtgacctggg

SEQ ID NO: 1587659 - DNA, 22 bp, Homo sapiens
ctgtagatggtgacctgggtat

SEQ ID NO: 1587660 - DNA, 15 bp, Homo sapiens
ctgtagattctgtgg

SEQ ID NO: 1587661 - DNA, 18 bp, Homo sapiens
ctgtagcattacagtggg

SEQ ID NO: 1587662 - DNA, 14 bp, Homo sapiens
ctgtagccactggc

SEQ ID NO: 1587663 - DNA, 14 bp, Homo sapiens
ctgtagccatggct

SEQ ID NO: 1587664 - DNA, 16 bp, Homo sapiens
ctgtagccatggctca

SEQ ID NO: 1587665 - DNA, 19 bp, Homo sapiens
ctgtagccatggctcaggc

SEQ ID NO: 1587666 - DNA, 20 bp, Homo sapiens
ctgtagccatggctcaggca

SEQ ID NO: 1587667 - DNA, 23 bp, Homo sapiens
ctgtagcctaaaacgaatggtct

SEQ ID NO: 1587668 - DNA, 21 bp, Homo sapiens
ctgtagctataatgagcatgt

SEQ ID NO: 1587669 - DNA, 14 bp, Homo sapiens
ctgtagctcagtca

SEQ ID NO: 1587670 - DNA, 21 bp, Homo sapiens
ctgtagctgcagcctgcatcc

SEQ ID NO: 1587671 - DNA, 18 bp, Homo sapiens
ctgtagctgtaagcaagt

SEQ ID NO: 1587672 - DNA, 12 bp, Homo sapiens
ctgtaggaacaa

SEQ ID NO: 1587673 - DNA, 16 bp, Homo sapiens
ctgtaggcacagagct

SEQ ID NO: 1587674 - DNA, 12 bp, Homo sapiens
ctgtaggcagca

SEQ ID NO: 1587675 - DNA, 15 bp, Homo sapiens
ctgtagggctggacc

SEQ ID NO: 1587676 - DNA, 21 bp, Homo sapiens
ctgtagggctggacctatgtc

SEQ ID NO: 1587677 - DNA, 20 bp, Homo sapiens
ctgtaggtttctctcttccc

SEQ ID NO: 1587678 - DNA, 22 bp, Homo sapiens
ctgtagtcctagccactcagga

SEQ ID NO: 1587679 - DNA, 23 bp, Homo sapiens
ctgtagtcctagccactcaggag

SEQ ID NO: 1587680 - DNA, 18 bp, Homo sapiens
ctgtagtgagaaactgat

SEQ ID NO: 1587681 - DNA, 13 bp, Homo sapiens
ctgtagttgcagc

SEQ ID NO: 1587682 - DNA, 20 bp, Homo sapiens
ctgtagtttatgatgcaaat

SEQ ID NO: 1587683 - DNA, 21 bp, Homo sapiens
ctgtagtttatggcagaaggg

SEQ ID NO: 1587684 - DNA, 22 bp, Homo sapiens
ctgtagttttccctgcactgtg

SEQ ID NO: 1587685 - DNA, 21 bp, Homo sapiens
ctgtagtttttgaaaattatg

SEQ ID NO: 1587686 - DNA, 15 bp, Homo sapiens
ctgtataagttattt

SEQ ID NO: 1587687 - DNA, 22 bp, Homo sapiens
ctgtataagttatttttgtaca

SEQ ID NO: 1587688 - DNA, 19 bp, Homo sapiens
ctgtatacaaccctggcat

SEQ ID NO: 1587689 - DNA, 15 bp, Homo sapiens
cttgatcttaaagat

SEQ ID NO: 1587690 - DNA, 16 bp, Homo sapiens
cttgatcttaaagatc

SEQ ID NO: 1587691 - DNA, 19 bp, Homo sapiens
cttgatgccagagggccag

SEQ ID NO: 1587692 - DNA, 20 bp, Homo sapiens
cttgatgccagagggccagc

SEQ ID NO: 1587693 - DNA, 13 bp, Homo sapiens
cttgatgtaaaat

SEQ ID NO: 1587694 - DNA, 17 bp, Homo sapiens
cttgatgtaaaatcttg

SEQ ID NO: 1587695 - DNA, 16 bp, Homo sapiens
cttgatgtgtcatcta

SEQ ID NO: 1587696 - DNA, 21 bp, Homo sapiens
cttgatgttccacctgccaca

SEQ ID NO: 1587697 - DNA, 15 bp, Homo sapiens
cttgattaacatctt

SEQ ID NO: 1587698 - DNA, 16 bp, Homo sapiens
cttgattcagtcacat

SEQ ID NO: 1587699 - DNA, 15 bp, Homo sapiens
cttgattcctggctc

SEQ ID NO: 1587700 - DNA, 23 bp, Homo sapiens
cttgattcctggctctaccctgt

SEQ ID NO: 1587701 - DNA, 15 bp, Homo sapiens
cttgattgagaaaga

SEQ ID NO: 1587702 - DNA, 12 bp, Homo sapiens
cttgattggaag

SEQ ID NO: 1587703 - DNA, 12 bp, Homo sapiens
cttgatttttgc

SEQ ID NO: 1587704 - DNA, 19 bp, Homo sapiens
cttgcacactcccctgcac

SEQ ID NO: 1587705 - DNA, 23 bp, Homo sapiens
cttgcacactcccctgcactgga

SEQ ID NO: 1587706 - DNA, 20 bp, Homo sapiens
cttgcacagccaacgagaca

SEQ ID NO: 1587707 - DNA, 15 bp, Homo sapiens
cttgcacagtcactg

SEQ ID NO: 1587708 - DNA, 14 bp, Homo sapiens
cttgcacctgcatc

SEQ ID NO: 1587709 - DNA, 19 bp, Homo sapiens
cttgcacgaccgccccagt

SEQ ID NO: 1587710 - DNA, 13 bp, Homo sapiens
cttgcagagcttg

SEQ ID NO: 1587711 - DNA, 18 bp, Homo sapiens
cttgcagatatctgcatg

SEQ ID NO: 1587712 - DNA, 16 bp, Homo sapiens
cttgcagattctattt

SEQ ID NO: 1587713 - DNA, 15 bp, Homo sapiens
cttgcagctggccca

SEQ ID NO: 1587714 - DNA, 19 bp, Homo sapiens
cttgcaggggtcccccctc

SEQ ID NO: 1587715 - DNA, 17 bp, Homo sapiens
cttgcagtggcttttca

SEQ ID NO: 1587716 - DNA, 18 bp, Homo sapiens
cttgcagttcagcaccac

SEQ ID NO: 1587717 - DNA, 22 bp, Homo sapiens
cttgcagttcagcaccacccta

SEQ ID NO: 1587718 - DNA, 22 bp, Homo sapiens
cttgcataataagctaaagagg

SEQ ID NO: 1587719 - DNA, 15 bp, Homo sapiens
cttgcatacatatat

SEQ ID NO: 1587720 - DNA, 23 bp, Homo sapiens
cttgcatcaatttttcttatttc

SEQ ID NO: 1587721 - DNA, 16 bp, Homo sapiens
cttgctgtcctaggcc

SEQ ID NO: 1587722 - DNA, 17 bp, Homo sapiens
cttgcttcctgcatggt

SEQ ID NO: 1587723 - DNA, 19 bp, Homo sapiens
cttgcttctctagctctct

SEQ ID NO: 1587724 - DNA, 19 bp, Homo sapiens
cttgcttctttctagaaag

SEQ ID NO: 1587725 - DNA, 23 bp, Homo sapiens
cttgcttgaggaatgaagacctt

SEQ ID NO: 1587726 - DNA, 17 bp, Homo sapiens
cttgcttgcctgcaggg

SEQ ID NO: 1587727 - DNA, 19 bp, Homo sapiens
cttgcttggaagccaggta

SEQ ID NO: 1587728 - DNA, 18 bp, Homo sapiens
cttgcttggggaacttgt

SEQ ID NO: 1587729 - DNA, 22 bp, Homo sapiens
cttgcttgttgggattcctgac

SEQ ID NO: 1587730 - DNA, 16 bp, Homo sapiens
cttgctttcacaaata

SEQ ID NO: 1587731 - DNA, 18 bp, Homo sapiens
cttgctttcacaaatata

SEQ ID NO: 1587732 - DNA, 23 bp, Homo sapiens
cttgctttcacaaatatagttga

SEQ ID NO: 1587733 - DNA, 17 bp, Homo sapiens
cttgctttcctgcatct

SEQ ID NO: 1587734 - DNA, 16 bp, Homo sapiens
cttgctttcctgggcc

SEQ ID NO: 1587735 - DNA, 18 bp, Homo sapiens
cttgctttcctgggcctt

SEQ ID NO: 1587736 - DNA, 24 bp, Homo sapiens
cttgctttcggagctcctgtccaa

SEQ ID NO: 1587737 - DNA, 15 bp, Homo sapiens
cttgctttgggcttt

SEQ ID NO: 1587738 - DNA, 23 bp, Homo sapiens
cttgctttgggctttgcaggctc

SEQ ID NO: 1587739 - DNA, 21 bp, Homo sapiens
cttgctttggggggtgtgctg

SEQ ID NO: 1587740 - DNA, 16 bp, Homo sapiens
cttggaaacctgccct

SEQ ID NO: 1587741 - DNA, 20 bp, Homo sapiens
cttggaaacctgccctgcct

SEQ ID NO: 1587742 - DNA, 21 bp, Homo sapiens
cttggaaacctgccctgcctg

SEQ ID NO: 1587743 - DNA, 22 bp, Homo sapiens
cttggaaagcatcacctcaggc

SEQ ID NO: 1587744 - DNA, 23 bp, Homo sapiens
cttggaaagcatcacctcaggcc

SEQ ID NO: 1587745 - DNA, 24 bp, Homo sapiens
cttggaaagctgatgatgtctctt

SEQ ID NO: 1587746 - DNA, 22 bp, Homo sapiens
cttgtgaggattatgggtcctg

SEQ ID NO: 1587747 - DNA, 19 bp, Homo sapiens
cttgtgagtggataatcag

SEQ ID NO: 1587748 - DNA, 23 bp, Homo sapiens
cttgtgatccactcgcctcagcc

SEQ ID NO: 1587749 - DNA, 15 bp, Homo sapiens
cttgtgattatttat

SEQ ID NO: 1587750 - DNA, 16 bp, Homo sapiens
cttgtgattgctgcca

SEQ ID NO: 1587751 - DNA, 18 bp, Homo sapiens
cttgtgattgctgccata

SEQ ID NO: 1587752 - DNA, 14 bp, Homo sapiens
cttgtgattggctg

SEQ ID NO: 1587753 - DNA, 13 bp, Homo sapiens
cttgtgccctgcc

SEQ ID NO: 1587754 - DNA, 23 bp, Homo sapiens
cttgtgctcacgctcccccgcag

SEQ ID NO: 1587755 - DNA, 23 bp, Homo sapiens
cttgtgcttggtggggctcgtgg

SEQ ID NO: 1587756 - DNA, 16 bp, Homo sapiens
cttgtggactggctgt

SEQ ID NO: 1587757 - DNA, 21 bp, Homo sapiens
cttgtggactggctgtgcccc

SEQ ID NO: 1587758 - DNA, 18 bp, Homo sapiens
cttgtgggaccagtccca

SEQ ID NO: 1587759 - DNA, 20 bp, Homo sapiens
cttgtgggaccagtcccaca

SEQ ID NO: 1587760 - DNA, 20 bp, Homo sapiens
cttgtgggagacagcagcct

SEQ ID NO: 1587761 - DNA, 22 bp, Homo sapiens
cttgtgggagacagcagcctgt

SEQ ID NO: 1587762 - DNA, 15 bp, Homo sapiens
cttgtggggccagga

SEQ ID NO: 1587763 - DNA, 22 bp, Homo sapiens
cttgtggtgtgaccatgttcat

SEQ ID NO: 1587764 - DNA, 15 bp, Homo sapiens
cttgtggttaaaaac

SEQ ID NO: 1587765 - DNA, 20 bp, Homo sapiens
cttgtgtactgataaaatac

SEQ ID NO: 1587766 - DNA, 13 bp, Homo sapiens
cttgtgtcctggt

SEQ ID NO: 1587767 - DNA, 13 bp, Homo sapiens
cttgtgtctgcgt

SEQ ID NO: 1587768 - DNA, 17 bp, Homo sapiens
cttgtgtgtcaggccct

SEQ ID NO: 1587769 - DNA, 23 bp, Homo sapiens
cttgtgtgtcaggccctctgcct

SEQ ID NO: 1587770 - DNA, 20 bp, Homo sapiens
cttgtgtgtgggctgtgagt

SEQ ID NO: 1587771 - DNA, 22 bp, Homo sapiens
cttgtgttcagctctttccaaa

SEQ ID NO: 1587772 - DNA, 16 bp, Homo sapiens
cttgttaaagatttca

SEQ ID NO: 1587773 - DNA, 17 bp, Homo sapiens
cttgttaatgctttctg

SEQ ID NO: 1587774 - DNA, 14 bp, Homo sapiens
cttgttactgctga

SEQ ID NO: 1587775 - DNA, 18 bp, Homo sapiens
cttgttactgctgattct

SEQ ID NO: 1587776 - DNA, 15 bp, Homo sapiens
cttgttacttctgag

SEQ ID NO: 1587777 - DNA, 20 bp, Homo sapiens
cttgttatattaagcagaaa

SEQ ID NO: 1587778 - DNA, 12 bp, Homo sapiens
cttgttctctgc

SEQ ID NO: 1587779 - DNA, 17 bp, Homo sapiens
cttgttcttgcagcatt

SEQ ID NO: 1587780 - DNA, 21 bp, Homo sapiens
cttgttgatagtgatgtattt

SEQ ID NO: 1587781 - DNA, 22 bp, Homo sapiens
cttgttgcctgcacccttccct

SEQ ID NO: 1587782 - DNA, 20 bp, Homo sapiens
cttgttgctcaaaaaatgag

SEQ ID NO: 1587783 - DNA, 18 bp, Homo sapiens
cttgttggagcctgcagg

SEQ ID NO: 1587784 - DNA, 19 bp, Homo sapiens
cttgttggtagcatgtact

SEQ ID NO: 1587785 - DNA, 15 bp, Homo sapiens
cttgttgtttcttgc

SEQ ID NO: 1587786 - DNA, 22 bp, Homo sapiens
cttgttgtttgttgacagcttg

SEQ ID NO: 1587787 - DNA, 16 bp, Homo sapiens
cttgttgttttactaa

SEQ ID NO: 1587788 - DNA, 19 bp, Homo sapiens
cttgttgttttactaaaga

SEQ ID NO: 1587789 - DNA, 21 bp, Homo sapiens
cttgtttaccaaagaagagtt

SEQ ID NO: 1587790 - DNA, 19 bp, Homo sapiens
cttgtttacctttctctct

SEQ ID NO: 1587791 - DNA, 22 bp, Homo sapiens
cttgtttacctttctctctcta

SEQ ID NO: 1587792 - DNA, 16 bp, Homo sapiens
cttgtttagagagcct

SEQ ID NO: 1587793 - DNA, 23 bp, Homo sapiens
cttgtttatgatatttcttgctt

SEQ ID NO: 1587794 - DNA, 13 bp, Homo sapiens
cttgtttccttgt

SEQ ID NO: 1587795 - DNA, 16 bp, Homo sapiens
cttgtttctatactgt

SEQ ID NO: 1587796 - DNA, 17 bp, Homo sapiens
cttgtttctatactgtt

SEQ ID NO: 1587797 - DNA, 18 bp, Homo sapiens
cttgtttgatttcaacat

SEQ ID NO: 1587798 - DNA, 14 bp, Homo sapiens
cttgtttgcactgt

SEQ ID NO: 1587799 - DNA, 17 bp, Homo sapiens
cttgtttgctatgacta

SEQ ID NO: 1587800 - DNA, 22 bp, Homo sapiens
cttgtttgctatgactacattt

SEQ ID NO: 1587801 - DNA, 14 bp, Homo sapiens
cttgtttgtcagca

SEQ ID NO: 1587802 - DNA, 17 bp, Homo sapiens
cttgtttgtcagcatct

SEQ ID NO: 1587803 - DNA, 13 bp, Homo sapiens
cttgttttataaa

SEQ ID NO: 1587804 - DNA, 14 bp, Homo sapiens
cttgttttatatac

SEQ ID NO: 1587805 - DNA, 21 bp, Homo sapiens
cttgttttggatggcttgtct

SEQ ID NO: 1587806 - DNA, 12 bp, Homo sapiens
cttgtttttaag

SEQ ID NO: 1587807 - DNA, 20 bp, Homo sapiens
cttgtttttattaatttata

SEQ ID NO: 1587808 - DNA, 18 bp, Homo sapiens
cttgtttttccactactg

SEQ ID NO: 1587809 - DNA, 20 bp, Homo sapiens
cttgtttttgtaaagaaaaa

SEQ ID NO: 1587810 - DNA, 14 bp, Homo sapiens
ctttaaaaaaataa

SEQ ID NO: 1587811 - DNA, 15 bp, Homo sapiens
ctttaaaaaaataat

SEQ ID NO: 1587812 - DNA, 21 bp, Homo sapiens
ctttaaaaaagactgaacatg

SEQ ID NO: 1587813 - DNA, 13 bp, Homo sapiens
ctttaaaaacaaa

SEQ ID NO: 1587814 - DNA, 16 bp, Homo sapiens
ctttaaaaccacagct

SEQ ID NO: 1587815 - DNA, 17 bp, Homo sapiens
ctttaaaaccacagctg

SEQ ID NO: 1587816 - DNA, 18 bp, Homo sapiens
ctttaaaagcgacctctc

SEQ ID NO: 1587817 - DNA, 18 bp, Homo sapiens
ctttaaaaggaaagaaaa

SEQ ID NO: 1587818 - DNA, 14 bp, Homo sapiens
ctttaaaagtgatc

SEQ ID NO: 1587819 - DNA, 22 bp, Homo sapiens
ctttaaaatatttgtctttaaa

SEQ ID NO: 1587820 - DNA, 10 bp, Homo sapiens
ctttaaagaa

SEQ ID NO: 1587821 - DNA, 21 bp, Homo sapiens
ctttaaaggcatctacacaat

SEQ ID NO: 1587822 - DNA, 18 bp, Homo sapiens
ctttaaagggatggcaag

SEQ ID NO: 1587823 - DNA, 20 bp, Homo sapiens
ctttaaagggatggcaagat

SEQ ID NO: 1587824 - DNA, 18 bp, Homo sapiens
ctttaaagtacctgtagt

SEQ ID NO: 1587825 - DNA, 13 bp, Homo sapiens
ctttaaagttctt

SEQ ID NO: 1587826 - DNA, 18 bp, Homo sapiens
ctttaaatcttttcttca

SEQ ID NO: 1587827 - DNA, 14 bp, Homo sapiens
ctttaaatggaaac

SEQ ID NO: 1587828 - DNA, 12 bp, Homo sapiens
ctttaaattatg

SEQ ID NO: 1587829 - DNA, 13 bp, Homo sapiens
ctttaaattgtgt

SEQ ID NO: 1587830 - DNA, 18 bp, Homo sapiens
ctttaacatacaagaaaa

SEQ ID NO: 1587831 - DNA, 17 bp, Homo sapiens
ctttaacatagtcctgt

SEQ ID NO: 1587832 - DNA, 16 bp, Homo sapiens
ctttaacctgaacctt

SEQ ID NO: 1587833 - DNA, 17 bp, Homo sapiens
ctttaacctgaaccttg

SEQ ID NO: 1587834 - DNA, 18 bp, Homo sapiens
ctttaactgacaagccat

SEQ ID NO: 1587835 - DNA, 19 bp, Homo sapiens
ctttaacttttttttctct

SEQ ID NO: 1587836 - DNA, 20 bp, Homo sapiens
ctttaacttttttttctctc

SEQ ID NO: 1587837 - DNA, 22 bp, Homo sapiens
ctttaacttttttttctctctt

SEQ ID NO: 1587838 - DNA, 21 bp, Homo sapiens
ctttaagaatgtcctcttgga

SEQ ID NO: 1587839 - DNA, 14 bp, Homo sapiens
ctttaagacatact

SEQ ID NO: 1587840 - DNA, 16 bp, Homo sapiens
ctttaagccaaagaaa

SEQ ID NO: 1587841 - DNA, 15 bp, Homo sapiens
ctttaaggagataga

SEQ ID NO: 1587842 - DNA, 17 bp, Homo sapiens
ctttaagttaaatatgt

SEQ ID NO: 1587843 - DNA, 20 bp, Homo sapiens
ctttaataacaaggagattt

SEQ ID NO: 1587844 - DNA, 12 bp, Homo sapiens
ctttaatacagc

SEQ ID NO: 1587845 - DNA, 14 bp, Homo sapiens
ctttaatcttcagt

SEQ ID NO: 1587846 - DNA, 22 bp, Homo sapiens
ctttaatgagtgcacctgcctc

SEQ ID NO: 1587847 - DNA, 23 bp, Homo sapiens
ctttaatgagtgcacctgcctcc

SEQ ID NO: 1587848 - DNA, 17 bp, Homo sapiens
ctttaatggcctggagg

SEQ ID NO: 1587849 - DNA, 18 bp, Homo sapiens
ctttaatgttttaactct

SEQ ID NO: 1587850 - DNA, 13 bp, Homo sapiens
ctttaatgttttt

SEQ ID NO: 1587851 - DNA, 21 bp, Homo sapiens
ctttaatgttttttgccacag

SEQ ID NO: 1587852 - DNA, 18 bp, Homo sapiens
ctttaattaccaacctgt

SEQ ID NO: 1587853 - DNA, 19 bp, Homo sapiens
ctttaattaccaacctgtt

SEQ ID NO: 1587854 - DNA, 23 bp, Homo sapiens
ctttaattccatgaatgttcctg

SEQ ID NO: 1587855 - DNA, 14 bp, Homo sapiens
ctttaattgtataa

SEQ ID NO: 1587856 - DNA, 21 bp, Homo sapiens
ctttacaaaccattacctgta

SEQ ID NO: 1587857 - DNA, 15 bp, Homo sapiens
ctttacacaagaatc

SEQ ID NO: 1587858 - DNA, 21 bp, Homo sapiens
ctttacagtttttttctttgt

SEQ ID NO: 1587859 - DNA, 20 bp, Homo sapiens
ctttacatgctgtgctcttt

SEQ ID NO: 1587860 - DNA, 22 bp, Homo sapiens
ctttacatgctgtgctctttga

SEQ ID NO: 1587861 - DNA, 17 bp, Homo sapiens
ctttacattcaactttt

SEQ ID NO: 1587862 - DNA, 20 bp, Homo sapiens
ctttaccaaaaaccatgttg

SEQ ID NO: 1587863 - DNA, 18 bp, Homo sapiens
ctttacccacctagaaca

SEQ ID NO: 1587864 - DNA, 14 bp, Homo sapiens
ctttaccctctttg

SEQ ID NO: 1587865 - DNA, 15 bp, Homo sapiens
ctttacctatggaag

SEQ ID NO: 1587866 - DNA, 16 bp, Homo sapiens
ctttacctgagaccag

SEQ ID NO: 1587867 - DNA, 18 bp, Homo sapiens
ctttacgctcatcaccta

SEQ ID NO: 1587868 - DNA, 21 bp, Homo sapiens
ctttacgtgtttaaaaaaaag

SEQ ID NO: 1587869 - DNA, 13 bp, Homo sapiens
ctttactcagccc

SEQ ID NO: 1587870 - DNA, 20 bp, Homo sapiens
ctttactcagcccagctggc

SEQ ID NO: 1587871 - DNA, 23 bp, Homo sapiens
ctttactcagcccagctggccac

SEQ ID NO: 1587872 - DNA, 18 bp, Homo sapiens
ctttactcccttcctggc

SEQ ID NO: 1587873 - DNA, 21 bp, Homo sapiens
ctttactcccttcctggcctc

SEQ ID NO: 1587874 - DNA, 15 bp, Homo sapiens
ctttactcgtgcatt

SEQ ID NO: 1587875 - DNA, 15 bp, Homo sapiens
ctttactgtttgtta

SEQ ID NO: 1587876 - DNA, 22 bp, Homo sapiens
ctttacttatctctcaaaacaa

SEQ ID NO: 1587877 - DNA, 23 bp, Homo sapiens
ctttacttgtggtgtgaccatgt

SEQ ID NO: 1587878 - DNA, 18 bp, Homo sapiens
ctttagaaacacataatt

SEQ ID NO: 1587879 - DNA, 18 bp, Homo sapiens
ctttagaatttttaccca

SEQ ID NO: 1587880 - DNA, 20 bp, Homo sapiens
ctttagaccctcgggcccca

SEQ ID NO: 1587881 - DNA, 14 bp, Homo sapiens
ctttagaccctggg

SEQ ID NO: 1587882 - DNA, 16 bp, Homo sapiens
ctttagaccctgggtg

SEQ ID NO: 1587883 - DNA, 17 bp, Homo sapiens
ctttagatgctgatgat

SEQ ID NO: 1587884 - DNA, 19 bp, Homo sapiens
ctttagcatttttatgcag

SEQ ID NO: 1587885 - DNA, 21 bp, Homo sapiens
ctttagcatttttatgcagac

SEQ ID NO: 1587886 - DNA, 23 bp, Homo sapiens
ctttagcatttttatgcagacag

SEQ ID NO: 1587887 - DNA, 17 bp, Homo sapiens
ctttagccatcataact

SEQ ID NO: 1587888 - DNA, 20 bp, Homo sapiens
ctttagcgggactcagtgag

SEQ ID NO: 1587889 - DNA, 17 bp, Homo sapiens
ctttagtacctgaaaag

SEQ ID NO: 1587890 - DNA, 19 bp, Homo sapiens
ctttagtacctgaaaagta

SEQ ID NO: 1587891 - DNA, 15 bp, Homo sapiens
ctttagtgttctgtt

SEQ ID NO: 1587892 - DNA, 21 bp, Homo sapiens
ctttagtttttggttgggaat

SEQ ID NO: 1587893 - DNA, 13 bp, Homo sapiens
ctttataaacttt

SEQ ID NO: 1587894 - DNA, 16 bp, Homo sapiens
ctttataatatttcag

SEQ ID NO: 1587895 - DNA, 23 bp, Homo sapiens
ctttatacagctgtattgtctga

SEQ ID NO: 1587896 - DNA, 12 bp, Homo sapiens
ctttatcacctc

SEQ ID NO: 1587897 - DNA, 17 bp, Homo sapiens
ctttatcacctcattct

SEQ ID NO: 1587898 - DNA, 18 bp, Homo sapiens
ctttatctgttcttgcta

SEQ ID NO: 1587899 - DNA, 15 bp, Homo sapiens
ctttatgcaaataca

SEQ ID NO: 1587900 - DNA, 21 bp, Homo sapiens
ctttatgctgtattttaacac

SEQ ID NO: 1587901 - DNA, 20 bp, Homo sapiens
ctttatgggggggagggagg

SEQ ID NO: 1587902 - DNA, 13 bp, Homo sapiens
ctttatgtgaatt

SEQ ID NO: 1587903 - DNA, 18 bp, Homo sapiens
ctttatgttgtatgattc

SEQ ID NO: 1587904 - DNA, 17 bp, Homo sapiens
ctttattaaaacaaaag

SEQ ID NO: 1587905 - DNA, 13 bp, Homo sapiens
ctttattaaaatc

SEQ ID NO: 1587906 - DNA, 14 bp, Homo sapiens
ctttattaatgttt

SEQ ID NO: 1587907 - DNA, 15 bp, Homo sapiens
ctttattaatgtttt

SEQ ID NO: 1587908 - DNA, 21 bp, Homo sapiens
ctttattcaataaaaaaaaga

SEQ ID NO: 1587909 - DNA, 19 bp, Homo sapiens
ctttattcacccctgcccc

SEQ ID NO: 1587910 - DNA, 15 bp, Homo sapiens
ctttattcttgctgg

SEQ ID NO: 1587911 - DNA, 14 bp, Homo sapiens
ctttattgaaattc

SEQ ID NO: 1587912 - DNA, 16 bp, Homo sapiens
ctttattgcagaatgt

SEQ ID NO: 1587913 - DNA, 15 bp, Homo sapiens
ctttattgccctaac

SEQ ID NO: 1587914 - DNA, 19 bp, Homo sapiens
ctttattgcttttttgtat

SEQ ID NO: 1587915 - DNA, 18 bp, Homo sapiens
ctttattgtacagactgt

SEQ ID NO: 1587916 - DNA, 14 bp, Homo sapiens
ctttatttatttct

SEQ ID NO: 1587917 - DNA, 11 bp, Homo sapiens
ctttatttctg

SEQ ID NO: 1587918 - DNA, 18 bp, Homo sapiens
ctttattttttaagtatt

SEQ ID NO: 1587919 - DNA, 15 bp, Homo sapiens
ctttcaaaagggaag

SEQ ID NO: 1587920 - DNA, 12 bp, Homo sapiens
ctttcaaagctt

SEQ ID NO: 1587921 - DNA, 20 bp, Homo sapiens
ctttcaagcagtcgtgcctg

SEQ ID NO: 1587922 - DNA, 23 bp, Homo sapiens
ctttcaagcagtcgtgcctgtgt

SEQ ID NO: 1587923 - DNA, 16 bp, Homo sapiens
ctttcacaaaaaagaa

SEQ ID NO: 1587924 - DNA, 14 bp, Homo sapiens
ctttcacaaccttc

SEQ ID NO: 1587925 - DNA, 19 bp, Homo sapiens
ctttcacaaggtacaaaat

SEQ ID NO: 1587926 - DNA, 18 bp, Homo sapiens
ctttcacacatctgggtg

SEQ ID NO: 1587927 - DNA, 19 bp, Homo sapiens
ctttcacagtgaagtgcct

SEQ ID NO: 1587928 - DNA, 16 bp, Homo sapiens
ctttcacatagatgtc

SEQ ID NO: 1587929 - DNA, 24 bp, Homo sapiens
ctttcacattgtttgctgctattg

SEQ ID NO: 1587930 - DNA, 14 bp, Homo sapiens
ctttcacatttaaa

SEQ ID NO: 1587931 - DNA, 20 bp, Homo sapiens
ctttcactaaaacacacagg

SEQ ID NO: 1587932 - DNA, 15 bp, Homo sapiens
ctttcactatttcct

SEQ ID NO: 1587933 - DNA, 17 bp, Homo sapiens
ctttcacttacctgaaa

SEQ ID NO: 1587934 - DNA, 14 bp, Homo sapiens
ctttcacttcttcc

SEQ ID NO: 1587935 - DNA, 17 bp, Homo sapiens
ctttcacttcttcctat

SEQ ID NO: 1587936 - DNA, 21 bp, Homo sapiens
ctttcagaatattttcaaaat

SEQ ID NO: 1587937 - DNA, 18 bp, Homo sapiens
ctttcagagccagcctgg

SEQ ID NO: 1587938 - DNA, 18 bp, Homo sapiens
ctttcagagccagtgaag

SEQ ID NO: 1587939 - DNA, 19 bp, Homo sapiens
ctttcagctgtgtctgaca

SEQ ID NO: 1587940 - DNA, 14 bp, Homo sapiens
ctttcagttagcct

SEQ ID NO: 1587941 - DNA, 15 bp, Homo sapiens
ctttcatagtataac

SEQ ID NO: 1587942 - DNA, 22 bp, Homo sapiens
ctttcatagtataactttaaat

SEQ ID NO: 1587943 - DNA, 16 bp, Homo sapiens
ctttcatcacactggg

SEQ ID NO: 1587944 - DNA, 18 bp, Homo sapiens
ctttcatcacactgggtg

SEQ ID NO: 1587945 - DNA, 20 bp, Homo sapiens
ctttcatctctctacctcca

SEQ ID NO: 1587946 - DNA, 16 bp, Homo sapiens
ctttcatgctacagaa

SEQ ID NO: 1587947 - DNA, 14 bp, Homo sapiens
ctttcatttgctat

SEQ ID NO: 1587948 - DNA, 14 bp, Homo sapiens
ctttcattttgctt

SEQ ID NO: 1587949 - DNA, 19 bp, Homo sapiens
ctttcattttgctttaatt

SEQ ID NO: 1587950 - DNA, 15 bp, Homo sapiens
ctttcatttttttcc

SEQ ID NO: 1587951 - DNA, 19 bp, Homo sapiens
ctttcatttttttccaggc

SEQ ID NO: 1587952 - DNA, 14 bp, Homo sapiens
ctttccaaattaaa

SEQ ID NO: 1587953 - DNA, 18 bp, Homo sapiens
ctttccaaattaaaacaa

SEQ ID NO: 1587954 - DNA, 15 bp, Homo sapiens
ctttccaacctcact

SEQ ID NO: 1587955 - DNA, 15 bp, Homo sapiens
ctttccaaggcttct

SEQ ID NO: 1587956 - DNA, 19 bp, Homo sapiens
ctttccacatttgtcacag

SEQ ID NO: 1587957 - DNA, 17 bp, Homo sapiens
ctttccactccctgctt

SEQ ID NO: 1587958 - DNA, 16 bp, Homo sapiens
ctttccagcttagaat

SEQ ID NO: 1587959 - DNA, 21 bp, Homo sapiens
ctttccaggcttccctgactt

SEQ ID NO: 1587960 - DNA, 13 bp, Homo sapiens
ctttccagttaag

SEQ ID NO: 1587961 - DNA, 23 bp, Homo sapiens
ctttccatatccatagtgacttt

SEQ ID NO: 1587962 - DNA, 15 bp, Homo sapiens
ctttccatcacccca

SEQ ID NO: 1587963 - DNA, 22 bp, Homo sapiens
ctttccatccattacctccatc

SEQ ID NO: 1587964 - DNA, 21 bp, Homo sapiens
gaaaattgaggtttggaagag

SEQ ID NO: 1587965 - DNA, 12 bp, Homo sapiens
gaaaattgcccc

SEQ ID NO: 1587966 - DNA, 15 bp, Homo sapiens
gaaaattgctgtgcc

SEQ ID NO: 1587967 - DNA, 12 bp, Homo sapiens
gaaaattgtctg

SEQ ID NO: 1587968 - DNA, 21 bp, Homo sapiens
gaaaattgtttagtgatatta

SEQ ID NO: 1587969 - DNA, 14 bp, Homo sapiens
gaaaattttaaaaa

SEQ ID NO: 1587970 - DNA, 14 bp, Homo sapiens
gaaaattttctcct

SEQ ID NO: 1587971 - DNA, 17 bp, Homo sapiens
gaaaattttctccttgg

SEQ ID NO: 1587972 - DNA, 17 bp, Homo sapiens
gaaaattttgtaaaaca

SEQ ID NO: 1587973 - DNA, 23 bp, Homo sapiens
gaaaattttgtaaaacaatgcca

SEQ ID NO: 1587974 - DNA, 19 bp, Homo sapiens
gaaacaaaaacactaaaaa

SEQ ID NO: 1587975 - DNA, 15 bp, Homo sapiens
gaaacaaaaagagct

SEQ ID NO: 1587976 - DNA, 13 bp, Homo sapiens
gaaacaaagaagt

SEQ ID NO: 1587977 - DNA, 19 bp, Homo sapiens
gaaacaaataatcacattg

SEQ ID NO: 1587978 - DNA, 20 bp, Homo sapiens
gaaacaaatcataatgtatt

SEQ ID NO: 1587979 - DNA, 18 bp, Homo sapiens
gaaacaacatttatatgt

SEQ ID NO: 1587980 - DNA, 16 bp, Homo sapiens
gaaacaaccatgtcat

SEQ ID NO: 1587981 - DNA, 14 bp, Homo sapiens
gaaacaacttggaa

SEQ ID NO: 1587982 - DNA, 13 bp, Homo sapiens
gaaacaagctgtg

SEQ ID NO: 1587983 - DNA, 14 bp, Homo sapiens
gaaacaatcctgtt

SEQ ID NO: 1587984 - DNA, 14 bp, Homo sapiens
gaaacacaatattt

SEQ ID NO: 1587985 - DNA, 18 bp, Homo sapiens
gaaacacacaagcaacaa

SEQ ID NO: 1587986 - DNA, 11 bp, Homo sapiens
gaaacacacga

SEQ ID NO: 1587987 - DNA, 14 bp, Homo sapiens
gaaacacagctgtt

SEQ ID NO: 1587988 - DNA, 23 bp, Homo sapiens
gaaacacagctgttcttctgttc

SEQ ID NO: 1587989 - DNA, 14 bp, Homo sapiens
gaaacacagggttt

SEQ ID NO: 1587990 - DNA, 22 bp, Homo sapiens
gaaacacccctctgtctaggac

SEQ ID NO: 1587991 - DNA, 20 bp, Homo sapiens
gaaacactaagctctctggg

SEQ ID NO: 1587992 - DNA, 16 bp, Homo sapiens
gaaacactgaaaagaa

SEQ ID NO: 1587993 - DNA, 13 bp, Homo sapiens
gaaacactgcctt

SEQ ID NO: 1587994 - DNA, 13 bp, Homo sapiens
gaaacagaaatag

SEQ ID NO: 1587995 - DNA, 19 bp, Homo sapiens
gaaacagaggagagtccca

SEQ ID NO: 1587996 - DNA, 22 bp, Homo sapiens
gaaacagattcaggccagccca

SEQ ID NO: 1587997 - DNA, 16 bp, Homo sapiens
gaaacagatttcatac

SEQ ID NO: 1587998 - DNA, 14 bp, Homo sapiens
gaaacagcatgaat

SEQ ID NO: 1587999 - DNA, 15 bp, Homo sapiens
gaaacagcatgaata

SEQ ID NO: 1588000 - DNA, 16 bp, Homo sapiens
gaaacagcatgaataa

SEQ ID NO: 1588001 - DNA, 12 bp, Homo sapiens
gaaacagccagc

SEQ ID NO: 1588002 - DNA, 15 bp, Homo sapiens
gaaacagccagcaag

SEQ ID NO: 1588003 - DNA, 20 bp, Homo sapiens
gaaacagctttcaagtgcct

SEQ ID NO: 1588004 - DNA, 15 bp, Homo sapiens
gaaacagttctcact

SEQ ID NO: 1588005 - DNA, 18 bp, Homo sapiens
gaaacagttctcactggg

SEQ ID NO: 1588006 - DNA, 20 bp, Homo sapiens
gaaacagttgcatgtagtaa

SEQ ID NO: 1588007 - DNA, 17 bp, Homo sapiens
gaaacagttgctgtgaa

SEQ ID NO: 1588008 - DNA, 18 bp, Homo sapiens
gaaacagttggtaacttt

SEQ ID NO: 1588009 - DNA, 23 bp, Homo sapiens
gaaacagttggtaacttttgtga

SEQ ID NO: 1588010 - DNA, 19 bp, Homo sapiens
gaaacatcagttactctga

SEQ ID NO: 1588011 - DNA, 23 bp, Homo sapiens
gaaacatcagttactctgaaggg

SEQ ID NO: 1588012 - DNA, 19 bp, Homo sapiens
gaaacattccgaagaggga

SEQ ID NO: 1588013 - DNA, 11 bp, Homo sapiens
gaaacatttac

SEQ ID NO: 1588014 - DNA, 20 bp, Homo sapiens
gaaaccaagccaatgttata

SEQ ID NO: 1588015 - DNA, 13 bp, Homo sapiens
gaaaccagaaaag

SEQ ID NO: 1588016 - DNA, 16 bp, Homo sapiens
gaaaccagaaaagcaa

SEQ ID NO: 1588017 - DNA, 15 bp, Homo sapiens
gaaaccagctcgtgg

SEQ ID NO: 1588018 - DNA, 21 bp, Homo sapiens
gaaaccagctcgtgggctggg

SEQ ID NO: 1588019 - DNA, 23 bp, Homo sapiens
gaaaccattttcccatcatcctt

SEQ ID NO: 1588020 - DNA, 15 bp, Homo sapiens
gaaacccaccagcct

SEQ ID NO: 1588021 - DNA, 18 bp, Homo sapiens
gaaacccttgctgcttta

SEQ ID NO: 1588022 - DNA, 21 bp, Homo sapiens
gaaaccgggagaaggcatgag

SEQ ID NO: 1588023 - DNA, 15 bp, Homo sapiens
gaaacctaactgcaa

SEQ ID NO: 1588024 - DNA, 19 bp, Homo sapiens
gaaacctcacccttgcacc

SEQ ID NO: 1588025 - DNA, 14 bp, Homo sapiens
gaaacctgccctgc

SEQ ID NO: 1588026 - DNA, 17 bp, Homo sapiens
gaaacctgccctgcctg

SEQ ID NO: 1588027 - DNA, 22 bp, Homo sapiens
gaaaccttattttttcccaaag

SEQ ID NO: 1588028 - DNA, 14 bp, Homo sapiens
gaaaccttccaccc

SEQ ID NO: 1588029 - DNA, 15 bp, Homo sapiens
gaaaccttccaccca

SEQ ID NO: 1588030 - DNA, 15 bp, Homo sapiens
gaaaccttgctctcc

SEQ ID NO: 1588031 - DNA, 17 bp, Homo sapiens
gaaacctttagggcagc

SEQ ID NO: 1588032 - DNA, 18 bp, Homo sapiens
gaaacctttagggcagct

SEQ ID NO: 1588033 - DNA, 13 bp, Homo sapiens
gaaaccttttatt

SEQ ID NO: 1588034 - DNA, 20 bp, Homo sapiens
gaaacgaagccatctttctt

SEQ ID NO: 1588035 - DNA, 18 bp, Homo sapiens
gaaacgagatttgccaaa

SEQ ID NO: 1588036 - DNA, 21 bp, Homo sapiens
gaaacgctacctctctgtccc

SEQ ID NO: 1588037 - DNA, 17 bp, Homo sapiens
gaaacgggctccttccc

SEQ ID NO: 1588038 - DNA, 13 bp, Homo sapiens
gaaacgtgttaaa

SEQ ID NO: 1588039 - DNA, 19 bp, Homo sapiens
gaaacgtgttaaaggtttt

SEQ ID NO: 1588040 - DNA, 15 bp, Homo sapiens
gaaactagtgtacat

SEQ ID NO: 1588041 - DNA, 19 bp, Homo sapiens
gaaactattataaggccat

SEQ ID NO: 1588042 - DNA, 12 bp, Homo sapiens
gaaactcagccg

SEQ ID NO: 1588043 - DNA, 17 bp, Homo sapiens
gaaactccacatctgcc

SEQ ID NO: 1588044 - DNA, 20 bp, Homo sapiens
gaaactccatctcaaaacaa

SEQ ID NO: 1588045 - DNA, 21 bp, Homo sapiens
gaaactccatctcaaaacaaa

SEQ ID NO: 1588046 - DNA, 22 bp, Homo sapiens
gaaactccgtcttagaagtgga

SEQ ID NO: 1588047 - DNA, 15 bp, Homo sapiens
gaaactcctgtttct

SEQ ID NO: 1588048 - DNA, 18 bp, Homo sapiens
gaaactccttttgctgtc

SEQ ID NO: 1588049 - DNA, 21 bp, Homo sapiens
gaaactctcatttatattgca

SEQ ID NO: 1588050 - DNA, 13 bp, Homo sapiens
gaaactgaatgaa

SEQ ID NO: 1588051 - DNA, 22 bp, Homo sapiens
gaaactgaggaattttctttgt

SEQ ID NO: 1588052 - DNA, 15 bp, Homo sapiens
gaaactgccagcaac

SEQ ID NO: 1588053 - DNA, 17 bp, Homo sapiens
gaaactgctgcagatta

SEQ ID NO: 1588054 - DNA, 22 bp, Homo sapiens
gaaactggaaatactagatttg

SEQ ID NO: 1588055 - DNA, 17 bp, Homo sapiens
gaaactggcactgaatt

SEQ ID NO: 1588056 - DNA, 19 bp, Homo sapiens
gaaactgggtttctcatta

SEQ ID NO: 1588057 - DNA, 21 bp, Homo sapiens
gaaacttaaatgttattatct

SEQ ID NO: 1588058 - DNA, 17 bp, Homo sapiens
gaaactttgggaaaaca

SEQ ID NO: 1588059 - DNA, 14 bp, Homo sapiens
gaaacttttaactg

SEQ ID NO: 1588060 - DNA, 12 bp, Homo sapiens
gaaacttttatc

SEQ ID NO: 1588061 - DNA, 23 bp, Homo sapiens
gaaacttttttattttttaaatc

SEQ ID NO: 1588062 - DNA, 13 bp, Homo sapiens
gaaatactcatgt

SEQ ID NO: 1588063 - DNA, 15 bp, Homo sapiens
gaaatactcatgtgc

SEQ ID NO: 1588064 - DNA, 16 bp, Homo sapiens
gaaatactgctctgaa

SEQ ID NO: 1588065 - DNA, 19 bp, Homo sapiens
gaaatagacaaaaagtata

SEQ ID NO: 1588066 - DNA, 21 bp, Homo sapiens
gaaatagacaaaaagtatatt

SEQ ID NO: 1588067 - DNA, 21 bp, Homo sapiens
gaaatagctgaaaagggcact

SEQ ID NO: 1588068 - DNA, 22 bp, Homo sapiens
gaaatagtctgattttaatgaa

SEQ ID NO: 1588069 - DNA, 13 bp, Homo sapiens
gaaatagttctgt

SEQ ID NO: 1588070 - DNA, 23 bp, Homo sapiens
gaaatagttctgtgactaggaaa

SEQ ID NO: 1588071 - DNA, 18 bp, Homo sapiens
gaaatataacacattttt

SEQ ID NO: 1588072 - DNA, 13 bp, Homo sapiens
gaaatataattga

SEQ ID NO: 1588073 - DNA, 20 bp, Homo sapiens
gaaatatcagttactcagcc

SEQ ID NO: 1588074 - DNA, 22 bp, Homo sapiens
gaaatatcagttactcagccct

SEQ ID NO: 1588075 - DNA, 13 bp, Homo sapiens
gaaatatcattta

SEQ ID NO: 1588076 - DNA, 14 bp, Homo sapiens
gaaatatcatttat

SEQ ID NO: 1588077 - DNA, 18 bp, Homo sapiens
gaaatatctgaaaatgta

SEQ ID NO: 1588078 - DNA, 13 bp, Homo sapiens
gaaatatctttct

SEQ ID NO: 1588079 - DNA, 14 bp, Homo sapiens
gaaatatctttctc

SEQ ID NO: 1588080 - DNA, 22 bp, Homo sapiens
gaaatatttaagtatatagtat

SEQ ID NO: 1588081 - DNA, 13 bp, Homo sapiens
gaaatattttaaa

SEQ ID NO: 1588082 - DNA, 16 bp, Homo sapiens
gaaatcaaatatgcaa

SEQ ID NO: 1588083 - DNA, 20 bp, Homo sapiens
gaaatcaaatatgcaaagca

SEQ ID NO: 1588084 - DNA, 13 bp, Homo sapiens
gaaatcaaatgta

SEQ ID NO: 1588085 - DNA, 18 bp, Homo sapiens
gaacaatggggactttgt

SEQ ID NO: 1588086 - DNA, 20 bp, Homo sapiens
gaacacaagggatataaaat

SEQ ID NO: 1588087 - DNA, 24 bp, Homo sapiens
gaacacaattgatacttcaggtgc

SEQ ID NO: 1588088 - DNA, 22 bp, Homo sapiens
gaacacacacgctccctggaag

SEQ ID NO: 1588089 - DNA, 21 bp, Homo sapiens
gaacacacagactttctgtga

SEQ ID NO: 1588090 - DNA, 10 bp, Homo sapiens
gaacacacat

SEQ ID NO: 1588091 - DNA, 18 bp, Homo sapiens
gaacacacatcccaggag

SEQ ID NO: 1588092 - DNA, 14 bp, Homo sapiens
gaacacactgtgtc

SEQ ID NO: 1588093 - DNA, 16 bp, Homo sapiens
gaacacactgtgtcct

SEQ ID NO: 1588094 - DNA, 22 bp, Homo sapiens
gaacacactgtgtcctggtgct

SEQ ID NO: 1588095 - DNA, 15 bp, Homo sapiens
gaacacagcatgtgc

SEQ ID NO: 1588096 - DNA, 20 bp, Homo sapiens
gaacacagtttagtgcttta

SEQ ID NO: 1588097 - DNA, 17 bp, Homo sapiens
gaacacatgtgtatgat

SEQ ID NO: 1588098 - DNA, 22 bp, Homo sapiens
gaacacatttctttttaaaaaa

SEQ ID NO: 1588099 - DNA, 22 bp, Homo sapiens
gaacaccccgctctggcagtag

SEQ ID NO: 1588100 - DNA, 21 bp, Homo sapiens
gaacaccctggatgctgttga

SEQ ID NO: 1588101 - DNA, 21 bp, Homo sapiens
gaacacctatgcaaagatgaa

SEQ ID NO: 1588102 - DNA, 23 bp, Homo sapiens
gaacaccttggggtccctccacc

SEQ ID NO: 1588103 - DNA, 14 bp, Homo sapiens
gaacacgattttca

SEQ ID NO: 1588104 - DNA, 22 bp, Homo sapiens
gaacactaactcaccagcccca

SEQ ID NO: 1588105 - DNA, 15 bp, Homo sapiens
gaacactaattcata

SEQ ID NO: 1588106 - DNA, 18 bp, Homo sapiens
gaacactcatgtctggag

SEQ ID NO: 1588107 - DNA, 11 bp, Homo sapiens
gaacactgaca

SEQ ID NO: 1588108 - DNA, 14 bp, Homo sapiens
gaacactggacaac

SEQ ID NO: 1588109 - DNA, 18 bp, Homo sapiens
gaacactgggggagggga

SEQ ID NO: 1588110 - DNA, 19 bp, Homo sapiens
gaacactgtgaccaggctt

SEQ ID NO: 1588111 - DNA, 23 bp, Homo sapiens
gaacactgtgaccaggcttttgt

SEQ ID NO: 1588112 - DNA, 14 bp, Homo sapiens
gaacagaaggatga

SEQ ID NO: 1588113 - DNA, 16 bp, Homo sapiens
gaacagacaggagaaa

SEQ ID NO: 1588114 - DNA, 19 bp, Homo sapiens
gaacagagtgcaacccagt

SEQ ID NO: 1588115 - DNA, 22 bp, Homo sapiens
gaacagatcttttactttggcc

SEQ ID NO: 1588116 - DNA, 14 bp, Homo sapiens
gaacagccccaggg

SEQ ID NO: 1588117 - DNA, 16 bp, Homo sapiens
gaacagcctgcctgtc

SEQ ID NO: 1588118 - DNA, 22 bp, Homo sapiens
gaacagcgggagacctgtgcta

SEQ ID NO: 1588119 - DNA, 15 bp, Homo sapiens
gaacagctgtgtctg

SEQ ID NO: 1588120 - DNA, 16 bp, Homo sapiens
gaacagctgtgtctgc

SEQ ID NO: 1588121 - DNA, 21 bp, Homo sapiens
gaacagggaaaataggcagga

SEQ ID NO: 1588122 - DNA, 20 bp, Homo sapiens
gaacagggacttgtttagag

SEQ ID NO: 1588123 - DNA, 22 bp, Homo sapiens
gaacagggacttgtttagagag

SEQ ID NO: 1588124 - DNA, 16 bp, Homo sapiens
gaacaggtggatgtat

SEQ ID NO: 1588125 - DNA, 21 bp, Homo sapiens
gaacaggttcttaaaaaggaa

SEQ ID NO: 1588126 - DNA, 12 bp, Homo sapiens
gaacagtaaaca

SEQ ID NO: 1588127 - DNA, 21 bp, Homo sapiens
gaacagtaaagaaagcagaat

SEQ ID NO: 1588128 - DNA, 14 bp, Homo sapiens
gaacagtaactgcc

SEQ ID NO: 1588129 - DNA, 19 bp, Homo sapiens
gaacagtggttgcctgggg

SEQ ID NO: 1588130 - DNA, 21 bp, Homo sapiens
gaacagtgtttcccataattt

SEQ ID NO: 1588131 - DNA, 23 bp, Homo sapiens
gaacagtttggggactcaggacc

SEQ ID NO: 1588132 - DNA, 15 bp, Homo sapiens
gaacataaaatacaa

SEQ ID NO: 1588133 - DNA, 14 bp, Homo sapiens
gaacatattcatga

SEQ ID NO: 1588134 - DNA, 12 bp, Homo sapiens
gaacatccaagg

SEQ ID NO: 1588135 - DNA, 20 bp, Homo sapiens
gaacatccaagtctttcttc

SEQ ID NO: 1588136 - DNA, 19 bp, Homo sapiens
gaacatctaacccactaga

SEQ ID NO: 1588137 - DNA, 15 bp, Homo sapiens
gaacatctcttgaaa

SEQ ID NO: 1588138 - DNA, 20 bp, Homo sapiens
gaacatgaactatgcctatg

SEQ ID NO: 1588139 - DNA, 22 bp, Homo sapiens
gaacatgctggaaataaaacag

SEQ ID NO: 1588140 - DNA, 19 bp, Homo sapiens
gaacatggacttgtatatt

SEQ ID NO: 1588141 - DNA, 24 bp, Homo sapiens
gaacatgtcctaattcttctgtcc

SEQ ID NO: 1588142 - DNA, 22 bp, Homo sapiens
gaacatgtttacaggtttgaat

SEQ ID NO: 1588143 - DNA, 18 bp, Homo sapiens
gaacattcagctctggag

SEQ ID NO: 1588144 - DNA, 20 bp, Homo sapiens
gaacattcagctctggagaa

SEQ ID NO: 1588145 - DNA, 19 bp, Homo sapiens
gaacattggagctgactgt

SEQ ID NO: 1588146 - DNA, 21 bp, Homo sapiens
gaacattgtactgttgcttta

SEQ ID NO: 1588147 - DNA, 19 bp, Homo sapiens
gaacatttgatatttttcc

SEQ ID NO: 1588148 - DNA, 23 bp, Homo sapiens
gaacatttgatatttttccattt

SEQ ID NO: 1588149 - DNA, 16 bp, Homo sapiens
gaaccaaaaatagaaa

SEQ ID NO: 1588150 - DNA, 13 bp, Homo sapiens
gaaccaaaacttc

SEQ ID NO: 1588151 - DNA, 15 bp, Homo sapiens
gaaccaaagcctctt

SEQ ID NO: 1588152 - DNA, 14 bp, Homo sapiens
gaaccaagcttcag

SEQ ID NO: 1588153 - DNA, 19 bp, Homo sapiens
gaaccaagcttcagagcct

SEQ ID NO: 1588154 - DNA, 13 bp, Homo sapiens
gaaccaaggcagc

SEQ ID NO: 1588155 - DNA, 16 bp, Homo sapiens
gaaccaaggcagcctc

SEQ ID NO: 1588156 - DNA, 19 bp, Homo sapiens
gaaccactacatctggctt

SEQ ID NO: 1588157 - DNA, 15 bp, Homo sapiens
gaaccagagggcatg

SEQ ID NO: 1588158 - DNA, 23 bp, Homo sapiens
gaaccagatgagtaaaggagtaa

SEQ ID NO: 1588159 - DNA, 17 bp, Homo sapiens
gaaccaggagaagggct

SEQ ID NO: 1588160 - DNA, 23 bp, Homo sapiens
gaaccaggagaagggctggggcc

SEQ ID NO: 1588161 - DNA, 18 bp, Homo sapiens
gaaccagggctcttctca

SEQ ID NO: 1588162 - DNA, 19 bp, Homo sapiens
gaaccagtttcaggtgttt

SEQ ID NO: 1588163 - DNA, 13 bp, Homo sapiens
gaaccataaattc

SEQ ID NO: 1588164 - DNA, 15 bp, Homo sapiens
gaaccataaattcaa

SEQ ID NO: 1588165 - DNA, 20 bp, Homo sapiens
gaaccatagttactgtaaaa

SEQ ID NO: 1588166 - DNA, 23 bp, Homo sapiens
gaaccatagttactgtaaaatgc

SEQ ID NO: 1588167 - DNA, 16 bp, Homo sapiens
gaacccaagtccaagc

SEQ ID NO: 1588168 - DNA, 17 bp, Homo sapiens
gaacccaagtccaagca

SEQ ID NO: 1588169 - DNA, 19 bp, Homo sapiens
gaacccacataaaagcccc

SEQ ID NO: 1588170 - DNA, 20 bp, Homo sapiens
gaacccacataaaagcccca

SEQ ID NO: 1588171 - DNA, 21 bp, Homo sapiens
gaacccacataaaagccccag

SEQ ID NO: 1588172 - DNA, 22 bp, Homo sapiens
gaacccacccggctggccggga

SEQ ID NO: 1588173 - DNA, 19 bp, Homo sapiens
gaacccacctgctgagaga

SEQ ID NO: 1588174 - DNA, 16 bp, Homo sapiens
gaacccagactcagac

SEQ ID NO: 1588175 - DNA, 19 bp, Homo sapiens
gaacccagactcagacatt

SEQ ID NO: 1588176 - DNA, 17 bp, Homo sapiens
gaaccccatgggcttgg

SEQ ID NO: 1588177 - DNA, 12 bp, Homo sapiens
gaacccccaggt

SEQ ID NO: 1588178 - DNA, 19 bp, Homo sapiens
gaaccccctccctgtccca

SEQ ID NO: 1588179 - DNA, 13 bp, Homo sapiens
gaaccccgcagcc

SEQ ID NO: 1588180 - DNA, 21 bp, Homo sapiens
gaacccctacatgaaacagaa

SEQ ID NO: 1588181 - DNA, 13 bp, Homo sapiens
gaacccctggcca

SEQ ID NO: 1588182 - DNA, 18 bp, Homo sapiens
gaacccctggccagctct

SEQ ID NO: 1588183 - DNA, 20 bp, Homo sapiens
gaacccctggccagctctga

SEQ ID NO: 1588184 - DNA, 19 bp, Homo sapiens
gaacccctgtgtccctttt

SEQ ID NO: 1588185 - DNA, 17 bp, Homo sapiens
gaaccccttcatcctct

SEQ ID NO: 1588186 - DNA, 20 bp, Homo sapiens
gaaccctaaataataaaaat

SEQ ID NO: 1588187 - DNA, 18 bp, Homo sapiens
gaaccctatttaaaactg

SEQ ID NO: 1588188 - DNA, 15 bp, Homo sapiens
gaaccctgcagggcc

SEQ ID NO: 1588189 - DNA, 17 bp, Homo sapiens
gaaccctggggcctgac

SEQ ID NO: 1588190 - DNA, 20 bp, Homo sapiens
gaaccctggggcctgactgc

SEQ ID NO: 1588191 - DNA, 14 bp, Homo sapiens
gaaccctgtgctgg

SEQ ID NO: 1588192 - DNA, 17 bp, Homo sapiens
gaaccgcacagctcagg

SEQ ID NO: 1588193 - DNA, 21 bp, Homo sapiens
gaaccgcacagctcaggaggc

SEQ ID NO: 1588194 - DNA, 15 bp, Homo sapiens
gaaccgtgtccagca

SEQ ID NO: 1588195 - DNA, 18 bp, Homo sapiens
gaaccgtgtccagcacag

SEQ ID NO: 1588196 - DNA, 22 bp, Homo sapiens
gaacggggctcttctcatttca

SEQ ID NO: 1588197 - DNA, 16 bp, Homo sapiens
gaacggggtccttcaa

SEQ ID NO: 1588198 - DNA, 14 bp, Homo sapiens
gaacgtgactgccc

SEQ ID NO: 1588199 - DNA, 13 bp, Homo sapiens
gaacgtgcatcct

SEQ ID NO: 1588200 - DNA, 15 bp, Homo sapiens
gaacgtgcttctttg

SEQ ID NO: 1588201 - DNA, 14 bp, Homo sapiens
gaacgttaaactat

SEQ ID NO: 1588202 - DNA, 13 bp, Homo sapiens
gaacgttttcttc

SEQ ID NO: 1588203 - DNA, 22 bp, Homo sapiens
gaacgttttcttctttccctgg

SEQ ID NO: 1588204 - DNA, 22 bp, Homo sapiens
gaactacaaacaaaatttctat

SEQ ID NO: 1588205 - DNA, 13 bp, Homo sapiens
gaactactgtact

SEQ ID NO: 1588206 - DNA, 15 bp, Homo sapiens
gaactactgtacttt

SEQ ID NO: 1588207 - DNA, 21 bp, Homo sapiens
gaactactgtactttgccatt

SEQ ID NO: 1588208 - DNA, 23 bp, Homo sapiens
gaactagaggtgttacagaggac

SEQ ID NO: 1588209 - DNA, 15 bp, Homo sapiens
gaactaggctgagca

SEQ ID NO: 1588210 - DNA, 17 bp, Homo sapiens
gaactaggctgagcaat

SEQ ID NO: 1588211 - DNA, 16 bp, Homo sapiens
gaactagggcacccct

SEQ ID NO: 1588212 - DNA, 15 bp, Homo sapiens
gaactataaagaagt

SEQ ID NO: 1588213 - DNA, 13 bp, Homo sapiens
gaactattagagc

SEQ ID NO: 1588214 - DNA, 16 bp, Homo sapiens
gaactatttattaaaa

SEQ ID NO: 1588215 - DNA, 19 bp, Homo sapiens
gaactattttcaaagactt

SEQ ID NO: 1588216 - DNA, 17 bp, Homo sapiens
gaactcaccctgggagc

SEQ ID NO: 1588217 - DNA, 21 bp, Homo sapiens
gaactcaccctgggagccagt

SEQ ID NO: 1588218 - DNA, 13 bp, Homo sapiens
gaactcactctgg

SEQ ID NO: 1588219 - DNA, 14 bp, Homo sapiens
gaactcactctggg

SEQ ID NO: 1588220 - DNA, 16 bp, Homo sapiens
gaactcactggggcct

SEQ ID NO: 1588221 - DNA, 13 bp, Homo sapiens
gaactcagatcca

SEQ ID NO: 1588222 - DNA, 18 bp, Homo sapiens
gaactcagatccagggac

SEQ ID NO: 1588223 - DNA, 17 bp, Homo sapiens
gaactcagcagttgaca

SEQ ID NO: 1588224 - DNA, 16 bp, Homo sapiens
gaactcattcctgcct

SEQ ID NO: 1588225 - DNA, 16 bp, Homo sapiens
gaactccatacagcct

SEQ ID NO: 1588226 - DNA, 11 bp, Homo sapiens
gaactccattt

SEQ ID NO: 1588227 - DNA, 12 bp, Homo sapiens
gaactcctggcc

SEQ ID NO: 1588228 - DNA, 23 bp, Homo sapiens
gaactcgcagggaatgcagcagg

SEQ ID NO: 1588229 - DNA, 14 bp, Homo sapiens
gaactcgcctcagc

SEQ ID NO: 1588230 - DNA, 18 bp, Homo sapiens
gaactcgcctcagcctga

SEQ ID NO: 1588231 - DNA, 15 bp, Homo sapiens
gaactctaaccagtg

SEQ ID NO: 1588232 - DNA, 17 bp, Homo sapiens
gaactctctccacccta

SEQ ID NO: 1588233 - DNA, 14 bp, Homo sapiens
gaactctctccctg

SEQ ID NO: 1588234 - DNA, 18 bp, Homo sapiens
gaactctctccctggtct

SEQ ID NO: 1588235 - DNA, 14 bp, Homo sapiens
gaactctgacaagg

SEQ ID NO: 1588236 - DNA, 15 bp, Homo sapiens
gaactctgacaaggg

SEQ ID NO: 1588237 - DNA, 14 bp, Homo sapiens
gaactctgtgcagg

SEQ ID NO: 1588238 - DNA, 19 bp, Homo sapiens
gaactctgttcccccaccc

SEQ ID NO: 1588239 - DNA, 20 bp, Homo sapiens
gaactcttaatcaaatagca

SEQ ID NO: 1588240 - DNA, 21 bp, Homo sapiens
gaactgaacaccattgaaggc

SEQ ID NO: 1588241 - DNA, 17 bp, Homo sapiens
gaactgaccccctcccc

SEQ ID NO: 1588242 - DNA, 16 bp, Homo sapiens
gaactgactgaaggaa

SEQ ID NO: 1588243 - DNA, 14 bp, Homo sapiens
gaactgagcctagc

SEQ ID NO: 1588244 - DNA, 21 bp, Homo sapiens
gaactgaggagcggactcact

SEQ ID NO: 1588245 - DNA, 22 bp, Homo sapiens
gaactgaggagcggactcactt

SEQ ID NO: 1588246 - DNA, 22 bp, Homo sapiens
gaactgaggccttgtgtgtcag

SEQ ID NO: 1588247 - DNA, 15 bp, Homo sapiens
gaactgcaaagcttt

SEQ ID NO: 1588248 - DNA, 23 bp, Homo sapiens
gaactgcaaagctttggctgaga

SEQ ID NO: 1588249 - DNA, 14 bp, Homo sapiens
gaactgcaggccct

SEQ ID NO: 1588250 - DNA, 17 bp, Homo sapiens
gaactgcctctttcctg

SEQ ID NO: 1588251 - DNA, 16 bp, Homo sapiens
gaactggaagaaagca

SEQ ID NO: 1588252 - DNA, 17 bp, Homo sapiens
gaactggaagaaagcaa

SEQ ID NO: 1588253 - DNA, 15 bp, Homo sapiens
gaactggactcagga

SEQ ID NO: 1588254 - DNA, 21 bp, Homo sapiens
gaactggactcaggatgccca

SEQ ID NO: 1588255 - DNA, 15 bp, Homo sapiens
gaactggctacagta

SEQ ID NO: 1588256 - DNA, 15 bp, Homo sapiens
gaactggcttgtaca

SEQ ID NO: 1588257 - DNA, 18 bp, Homo sapiens
gaactgggatttgaaccc

SEQ ID NO: 1588258 - DNA, 14 bp, Homo sapiens
gaactgggctgggc

SEQ ID NO: 1588259 - DNA, 15 bp, Homo sapiens
gaactgggctgggcc

SEQ ID NO: 1588260 - DNA, 17 bp, Homo sapiens
gaactgggctgggcctc

SEQ ID NO: 1588261 - DNA, 18 bp, Homo sapiens
gaactgggttctttggaa

SEQ ID NO: 1588262 - DNA, 23 bp, Homo sapiens
gaactgtacattgtgagctctgg

SEQ ID NO: 1588263 - DNA, 17 bp, Homo sapiens
gaactgtcccacaaaat

SEQ ID NO: 1588264 - DNA, 17 bp, Homo sapiens
gaactgtcccagctacc

SEQ ID NO: 1588265 - DNA, 18 bp, Homo sapiens
gaactgtcccagctacca

SEQ ID NO: 1588266 - DNA, 13 bp, Homo sapiens
gaactgtccgtga

SEQ ID NO: 1588267 - DNA, 11 bp, Homo sapiens
gaactgttaca

SEQ ID NO: 1588268 - DNA, 15 bp, Homo sapiens
gaacttattctgtag

SEQ ID NO: 1588269 - DNA, 17 bp, Homo sapiens
gaacttgaatgtgtcag

SEQ ID NO: 1588270 - DNA, 15 bp, Homo sapiens
gaacttgactgggtg

SEQ ID NO: 1588271 - DNA, 13 bp, Homo sapiens
gaacttgattgcc

SEQ ID NO: 1588272 - DNA, 12 bp, Homo sapiens
gaacttgcatgg

SEQ ID NO: 1588273 - DNA, 16 bp, Homo sapiens
gaacttgctgctgcct

SEQ ID NO: 1588274 - DNA, 18 bp, Homo sapiens
gaacttgctgctgtcttg

SEQ ID NO: 1588275 - DNA, 16 bp, Homo sapiens
gaactttctggactcc

SEQ ID NO: 1588276 - DNA, 16 bp, Homo sapiens
gaactttgcagcatac

SEQ ID NO: 1588277 - DNA, 18 bp, Homo sapiens
gaactttgcagcatacca

SEQ ID NO: 1588278 - DNA, 12 bp, Homo sapiens
gaagaattccag

SEQ ID NO: 1588279 - DNA, 18 bp, Homo sapiens
gaagaattgaaaagtttt

SEQ ID NO: 1588280 - DNA, 13 bp, Homo sapiens
gaagaattttatt

SEQ ID NO: 1588281 - DNA, 17 bp, Homo sapiens
gaagaattttcagaccc

SEQ ID NO: 1588282 - DNA, 18 bp, Homo sapiens
gaagacaaagtctaagga

SEQ ID NO: 1588283 - DNA, 13 bp, Homo sapiens
gaagacaacagaa

SEQ ID NO: 1588284 - DNA, 20 bp, Homo sapiens
gaagacaacagaaagaggga

SEQ ID NO: 1588285 - DNA, 19 bp, Homo sapiens
gaagacaatttgatacata

SEQ ID NO: 1588286 - DNA, 12 bp, Homo sapiens
gaagacacagac

SEQ ID NO: 1588287 - DNA, 17 bp, Homo sapiens
gaagacacagcctcccc

SEQ ID NO: 1588288 - DNA, 13 bp, Homo sapiens
gaagacagagcaa

SEQ ID NO: 1588289 - DNA, 20 bp, Homo sapiens
gaagacagagcaaagcgccc

SEQ ID NO: 1588290 - DNA, 15 bp, Homo sapiens
gaagacagtggcccc

SEQ ID NO: 1588291 - DNA, 15 bp, Homo sapiens
gaagacatggagact

SEQ ID NO: 1588292 - DNA, 20 bp, Homo sapiens
gaagacatggagactcctgc

SEQ ID NO: 1588293 - DNA, 14 bp, Homo sapiens
gaagacattttgtt

SEQ ID NO: 1588294 - DNA, 18 bp, Homo sapiens
gaagacattttgttacat

SEQ ID NO: 1588295 - DNA, 15 bp, Homo sapiens
gaagacattttttgc

SEQ ID NO: 1588296 - DNA, 22 bp, Homo sapiens
gaagaccagaattcccttgaat

SEQ ID NO: 1588297 - DNA, 20 bp, Homo sapiens
gaagaccagctttgcagtga

SEQ ID NO: 1588298 - DNA, 14 bp, Homo sapiens
gaagacccagcagg

SEQ ID NO: 1588299 - DNA, 14 bp, Homo sapiens
gaagaccccaccca

SEQ ID NO: 1588300 - DNA, 14 bp, Homo sapiens
gaagaccctccccg

SEQ ID NO: 1588301 - DNA, 19 bp, Homo sapiens
gaagacctcacctagaaat

SEQ ID NO: 1588302 - DNA, 23 bp, Homo sapiens
gaagacgcccattcggactgctg

SEQ ID NO: 1588303 - DNA, 15 bp, Homo sapiens
gaagacggaaaacaa

SEQ ID NO: 1588304 - DNA, 21 bp, Homo sapiens
gaagactcaggagtctgccac

SEQ ID NO: 1588305 - DNA, 19 bp, Homo sapiens
gaagactccctgatcccag

SEQ ID NO: 1588306 - DNA, 23 bp, Homo sapiens
gaagactccctgatcccagacct

SEQ ID NO: 1588307 - DNA, 21 bp, Homo sapiens
gaagactgacaaagtcatcct

SEQ ID NO: 1588308 - DNA, 17 bp, Homo sapiens
gaagactgtgcagaaga

SEQ ID NO: 1588309 - DNA, 12 bp, Homo sapiens
gaagactgtggc

SEQ ID NO: 1588310 - DNA, 15 bp, Homo sapiens
gaagacttcccagct

SEQ ID NO: 1588311 - DNA, 20 bp, Homo sapiens
gaagactttaaaccacctag

SEQ ID NO: 1588312 - DNA, 19 bp, Homo sapiens
gaagagaagagggcccagc

SEQ ID NO: 1588313 - DNA, 16 bp, Homo sapiens
gaagagaagctgctga

SEQ ID NO: 1588314 - DNA, 20 bp, Homo sapiens
gaagagaagctgctgaccaa

SEQ ID NO: 1588315 - DNA, 17 bp, Homo sapiens
gaagagaagggcagggc

SEQ ID NO: 1588316 - DNA, 14 bp, Homo sapiens
gaagagaaggggag

SEQ ID NO: 1588317 - DNA, 15 bp, Homo sapiens
gaagagaaggggaga

SEQ ID NO: 1588318 - DNA, 16 bp, Homo sapiens
gaagagaaggggagaa

SEQ ID NO: 1588319 - DNA, 22 bp, Homo sapiens
gaagagaggaaataacagagag

SEQ ID NO: 1588320 - DNA, 23 bp, Homo sapiens
gaagagaggaaataacagagaga

SEQ ID NO: 1588321 - DNA, 20 bp, Homo sapiens
gaagagagttccgggaaaca

SEQ ID NO: 1588322 - DNA, 18 bp, Homo sapiens
gaagagatgggcttgttt

SEQ ID NO: 1588323 - DNA, 15 bp, Homo sapiens
gaagagatgtttaca

SEQ ID NO: 1588324 - DNA, 18 bp, Homo sapiens
gaagagcaggactccagg

SEQ ID NO: 1588325 - DNA, 19 bp, Homo sapiens
gaagagcaggccagcccgg

SEQ ID NO: 1588326 - DNA, 11 bp, Homo sapiens
gaagagccacc

SEQ ID NO: 1588327 - DNA, 12 bp, Homo sapiens
gaagagccacct

SEQ ID NO: 1588328 - DNA, 14 bp, Homo sapiens
gaagagccacctgc

SEQ ID NO: 1588329 - DNA, 18 bp, Homo sapiens
gaagagccacctgcaaga

SEQ ID NO: 1588330 - DNA, 14 bp, Homo sapiens
gaagagcccagtct

SEQ ID NO: 1588331 - DNA, 17 bp, Homo sapiens
gaagagcccagtctgtt

SEQ ID NO: 1588332 - DNA, 20 bp, Homo sapiens
gaagagctcccctccacagc

SEQ ID NO: 1588333 - DNA, 15 bp, Homo sapiens
gaagagctgttcaca

SEQ ID NO: 1588334 - DNA, 14 bp, Homo sapiens
gaagagcttagaaa

SEQ ID NO: 1588335 - DNA, 14 bp, Homo sapiens
gaagaggaacagtg

SEQ ID NO: 1588336 - DNA, 21 bp, Homo sapiens
gaagaggagcctcagaagaaa

SEQ ID NO: 1588337 - DNA, 18 bp, Homo sapiens
gaagaggaggggaagagg

SEQ ID NO: 1588338 - DNA, 23 bp, Homo sapiens
gaagaggcccactagagggccca

SEQ ID NO: 1588339 - DNA, 20 bp, Homo sapiens
gaagaggcctgtttggcctc

SEQ ID NO: 1588340 - DNA, 18 bp, Homo sapiens
gaagaggcgggccagcca

SEQ ID NO: 1588341 - DNA, 15 bp, Homo sapiens
gaagagggcccagcc

SEQ ID NO: 1588342 - DNA, 17 bp, Homo sapiens
gaagagggcccagccca

SEQ ID NO: 1588343 - DNA, 18 bp, Homo sapiens
gaagagggcccagcccag

SEQ ID NO: 1588344 - DNA, 16 bp, Homo sapiens
gaagaggggaggggcc

SEQ ID NO: 1588345 - DNA, 23 bp, Homo sapiens
gaagaggggaggggcctagggag

SEQ ID NO: 1588346 - DNA, 11 bp, Homo sapiens
gaagaggggca

SEQ ID NO: 1588347 - DNA, 13 bp, Homo sapiens
gaagaggggcagc

SEQ ID NO: 1588348 - DNA, 17 bp, Homo sapiens
gaagaggggcagccctt

SEQ ID NO: 1588349 - DNA, 23 bp, Homo sapiens
gaagaggggtggtggggggcagg

SEQ ID NO: 1588350 - DNA, 17 bp, Homo sapiens
gaagagggttttaggta

SEQ ID NO: 1588351 - DNA, 21 bp, Homo sapiens
gaagaggtagtgtgaatatta

SEQ ID NO: 1588352 - DNA, 17 bp, Homo sapiens
gaagaggtctgattggc

SEQ ID NO: 1588353 - DNA, 13 bp, Homo sapiens
gaagagtgaaata

SEQ ID NO: 1588354 - DNA, 14 bp, Homo sapiens
gaagagtgagaggg

SEQ ID NO: 1588355 - DNA, 13 bp, Homo sapiens
gaaggaaaaattc

SEQ ID NO: 1588356 - DNA, 11 bp, Homo sapiens
gaaggaagagg

SEQ ID NO: 1588357 - DNA, 23 bp, Homo sapiens
gaaggaaggagactcacctctgc

SEQ ID NO: 1588358 - DNA, 16 bp, Homo sapiens
gaaggaaggaggcaga

SEQ ID NO: 1588359 - DNA, 18 bp, Homo sapiens
gaaggaaggaggcagact

SEQ ID NO: 1588360 - DNA, 15 bp, Homo sapiens
gaaggaaggagggca

SEQ ID NO: 1588361 - DNA, 14 bp, Homo sapiens
gaaggaaggctctc

SEQ ID NO: 1588362 - DNA, 13 bp, Homo sapiens
gaaggaagggcag

SEQ ID NO: 1588363 - DNA, 16 bp, Homo sapiens
gaaggaagtgaagagg

SEQ ID NO: 1588364 - DNA, 17 bp, Homo sapiens
gaaggaatagccagaga

SEQ ID NO: 1588365 - DNA, 19 bp, Homo sapiens
gaaggaatagccagagagg

SEQ ID NO: 1588366 - DNA, 18 bp, Homo sapiens
gaaggaatcctggatttt

SEQ ID NO: 1588367 - DNA, 16 bp, Homo sapiens
gaaggaatctgtgcag

SEQ ID NO: 1588368 - DNA, 18 bp, Homo sapiens
gaaggacacttcctgcct

SEQ ID NO: 1588369 - DNA, 20 bp, Homo sapiens
gaaggacaggaccctcagga

SEQ ID NO: 1588370 - DNA, 17 bp, Homo sapiens
gaaggacggtgccaagg

SEQ ID NO: 1588371 - DNA, 20 bp, Homo sapiens
gaaggactggattggccaaa

SEQ ID NO: 1588372 - DNA, 12 bp, Homo sapiens
gaaggactggtg

SEQ ID NO: 1588373 - DNA, 15 bp, Homo sapiens
gaaggactggtgcga

SEQ ID NO: 1588374 - DNA, 23 bp, Homo sapiens
gaaggactggtgcgaccccccac

SEQ ID NO: 1588375 - DNA, 19 bp, Homo sapiens
gaaggagagcaagaaggaa

SEQ ID NO: 1588376 - DNA, 15 bp, Homo sapiens
gaaggagagcctgct

SEQ ID NO: 1588377 - DNA, 16 bp, Homo sapiens
gaaggagagcctgctg

SEQ ID NO: 1588378 - DNA, 17 bp, Homo sapiens
gaaggagatagggaaaa

SEQ ID NO: 1588379 - DNA, 19 bp, Homo sapiens
gaaggagcccagccagaaa

SEQ ID NO: 1588380 - DNA, 14 bp, Homo sapiens
gaaggagggcagag

SEQ ID NO: 1588381 - DNA, 17 bp, Homo sapiens
gaaggagggcagagcca

SEQ ID NO: 1588382 - DNA, 19 bp, Homo sapiens
gaaggagggttagggaggg

SEQ ID NO: 1588383 - DNA, 18 bp, Homo sapiens
gaaggagtacaaaacaat

SEQ ID NO: 1588384 - DNA, 21 bp, Homo sapiens
gaaggataagagaaacaggcc

SEQ ID NO: 1588385 - DNA, 14 bp, Homo sapiens
gaaggatccaggaa

SEQ ID NO: 1588386 - DNA, 14 bp, Homo sapiens
gaaggatctgctga

SEQ ID NO: 1588387 - DNA, 22 bp, Homo sapiens
gaaggatctgctgaggcccagt

SEQ ID NO: 1588388 - DNA, 15 bp, Homo sapiens
gaaggatgtacattt

SEQ ID NO: 1588389 - DNA, 16 bp, Homo sapiens
gaaggatgtacatttc

SEQ ID NO: 1588390 - DNA, 20 bp, Homo sapiens
gaaggatgtacatttccaaa

SEQ ID NO: 1588391 - DNA, 16 bp, Homo sapiens
gaaggcaagagggggt

SEQ ID NO: 1588392 - DNA, 17 bp, Homo sapiens
gaaggcaagagggggtg

SEQ ID NO: 1588393 - DNA, 22 bp, Homo sapiens
gaaggcaagagggggtggaggg

SEQ ID NO: 1588394 - DNA, 14 bp, Homo sapiens
gaaggcaagccagg

SEQ ID NO: 1588395 - DNA, 16 bp, Homo sapiens
gaaggcaagccaggct

SEQ ID NO: 1588396 - DNA, 14 bp, Homo sapiens
gaaggcagagaaat

SEQ ID NO: 1588397 - DNA, 15 bp, Homo sapiens
gaaggcagctgctct

SEQ ID NO: 1588398 - DNA, 21 bp, Homo sapiens
gaaggcaggagccttcctttc

SEQ ID NO: 1588399 - DNA, 15 bp, Homo sapiens
gacagggcagagcag

SEQ ID NO: 1588400 - DNA, 18 bp, Homo sapiens
gacagggcccccggccac

SEQ ID NO: 1588401 - DNA, 17 bp, Homo sapiens
gacagggtaggaaaggg

SEQ ID NO: 1588402 - DNA, 17 bp, Homo sapiens
gacagggtttcaccatg

SEQ ID NO: 1588403 - DNA, 17 bp, Homo sapiens
gacagggtttcaccgtg

SEQ ID NO: 1588404 - DNA, 13 bp, Homo sapiens
gacagtccacagg

SEQ ID NO: 1588405 - DNA, 14 bp, Homo sapiens
gacagtcctgggag

SEQ ID NO: 1588406 - DNA, 22 bp, Homo sapiens
gacagtccttggggttaagtct

SEQ ID NO: 1588407 - DNA, 20 bp, Homo sapiens
gacagtcctttcccaccatt

SEQ ID NO: 1588408 - DNA, 13 bp, Homo sapiens
gacagtctggaga

SEQ ID NO: 1588409 - DNA, 15 bp, Homo sapiens
gacagtgaagcagca

SEQ ID NO: 1588410 - DNA, 19 bp, Homo sapiens
gacagtgaagcagcactgt

SEQ ID NO: 1588411 - DNA, 15 bp, Homo sapiens
gacagtgaatttggg

SEQ ID NO: 1588412 - DNA, 15 bp, Homo sapiens
gacagtgatctccat

SEQ ID NO: 1588413 - DNA, 16 bp, Homo sapiens
gacagtgatctccata

SEQ ID NO: 1588414 - DNA, 15 bp, Homo sapiens
gacagtgatgcctgc

SEQ ID NO: 1588415 - DNA, 20 bp, Homo sapiens
gacagtgccatccccacctt

SEQ ID NO: 1588416 - DNA, 16 bp, Homo sapiens
gacagtgcctatactg

SEQ ID NO: 1588417 - DNA, 17 bp, Homo sapiens
gacagtgcctgggaatg

SEQ ID NO: 1588418 - DNA, 16 bp, Homo sapiens
gacagtgcttcagcct

SEQ ID NO: 1588419 - DNA, 12 bp, Homo sapiens
gacagtgtacaa

SEQ ID NO: 1588420 - DNA, 21 bp, Homo sapiens
gacagtgttccccgataccat

SEQ ID NO: 1588421 - DNA, 21 bp, Homo sapiens
gacagttatactgtcggtttt

SEQ ID NO: 1588422 - DNA, 14 bp, Homo sapiens
gacagttcaagaaa

SEQ ID NO: 1588423 - DNA, 17 bp, Homo sapiens
gacagttcatatgtacc

SEQ ID NO: 1588424 - DNA, 13 bp, Homo sapiens
gacagttctctgt

SEQ ID NO: 1588425 - DNA, 14 bp, Homo sapiens
gacagttctgaaga

SEQ ID NO: 1588426 - DNA, 15 bp, Homo sapiens
gacagttggcagaga

SEQ ID NO: 1588427 - DNA, 19 bp, Homo sapiens
gacataaaatttacattta

SEQ ID NO: 1588428 - DNA, 16 bp, Homo sapiens
gacataatttcactga

SEQ ID NO: 1588429 - DNA, 22 bp, Homo sapiens
gacatactccttccatcaaata

SEQ ID NO: 1588430 - DNA, 19 bp, Homo sapiens
gacatagaagagccaagag

SEQ ID NO: 1588431 - DNA, 14 bp, Homo sapiens
gacatagagaaaag

SEQ ID NO: 1588432 - DNA, 13 bp, Homo sapiens
gacatagcctcat

SEQ ID NO: 1588433 - DNA, 23 bp, Homo sapiens
gacataggcttcaattggtggaa

SEQ ID NO: 1588434 - DNA, 18 bp, Homo sapiens
gacatcaaagcctggcct

SEQ ID NO: 1588435 - DNA, 23 bp, Homo sapiens
gacatcaaagtggtaaatactgt

SEQ ID NO: 1588436 - DNA, 19 bp, Homo sapiens
gacatcatcattcttgtgg

SEQ ID NO: 1588437 - DNA, 22 bp, Homo sapiens
gacatccagcagatttccagcc

SEQ ID NO: 1588438 - DNA, 17 bp, Homo sapiens
gacatcccagaccagcc

SEQ ID NO: 1588439 - DNA, 18 bp, Homo sapiens
gacatccctcccccagca

SEQ ID NO: 1588440 - DNA, 13 bp, Homo sapiens
gacatcccttcct

SEQ ID NO: 1588441 - DNA, 14 bp, Homo sapiens
gacatcccttcctg

SEQ ID NO: 1588442 - DNA, 15 bp, Homo sapiens
gacatcccttcctgg

SEQ ID NO: 1588443 - DNA, 20 bp, Homo sapiens
gacatccgtcattgctgctg

SEQ ID NO: 1588444 - DNA, 21 bp, Homo sapiens
gacatccgtcattgctgctgc

SEQ ID NO: 1588445 - DNA, 18 bp, Homo sapiens
gacatcctcctcccaccc

SEQ ID NO: 1588446 - DNA, 16 bp, Homo sapiens
gacatcgtaggcagcc

SEQ ID NO: 1588447 - DNA, 15 bp, Homo sapiens
gacatctcaggattt

SEQ ID NO: 1588448 - DNA, 15 bp, Homo sapiens
gacatctctgcaccc

SEQ ID NO: 1588449 - DNA, 16 bp, Homo sapiens
gacatgaatgcacact

SEQ ID NO: 1588450 - DNA, 14 bp, Homo sapiens
gacatgcactgacc

SEQ ID NO: 1588451 - DNA, 12 bp, Homo sapiens
gacatgctcaca

SEQ ID NO: 1588452 - DNA, 14 bp, Homo sapiens
gacatggaaatgaa

SEQ ID NO: 1588453 - DNA, 19 bp, Homo sapiens
gacatggagactcctgccc

SEQ ID NO: 1588454 - DNA, 20 bp, Homo sapiens
gacatggctccggcctctgc

SEQ ID NO: 1588455 - DNA, 21 bp, Homo sapiens
gacatgggcctcccactcctg

SEQ ID NO: 1588456 - DNA, 18 bp, Homo sapiens
gacatggtgcctgagagg

SEQ ID NO: 1588457 - DNA, 20 bp, Homo sapiens
gacatggtgcctgagaggca

SEQ ID NO: 1588458 - DNA, 18 bp, Homo sapiens
gacatgtaagaaaatgtt

SEQ ID NO: 1588459 - DNA, 15 bp, Homo sapiens
gacatgtctgttcta

SEQ ID NO: 1588460 - DNA, 20 bp, Homo sapiens
gacatgtgaggaggaaaagg

SEQ ID NO: 1588461 - DNA, 24 bp, Homo sapiens
gacatgtggaggggcagcctgtgc

SEQ ID NO: 1588462 - DNA, 17 bp, Homo sapiens
gacatgtgggtggagaa

SEQ ID NO: 1588463 - DNA, 23 bp, Homo sapiens
gacatgtgggtggagaagggagg

SEQ ID NO: 1588464 - DNA, 17 bp, Homo sapiens
gacatgttttccgtgaa

SEQ ID NO: 1588465 - DNA, 23 bp, Homo sapiens
gacattatgtggttttagatttt

SEQ ID NO: 1588466 - DNA, 15 bp, Homo sapiens
gacattctctttgat

SEQ ID NO: 1588467 - DNA, 16 bp, Homo sapiens
gacattctctttgata

SEQ ID NO: 1588468 - DNA, 21 bp, Homo sapiens
gacattctctttgataacaaa

SEQ ID NO: 1588469 - DNA, 22 bp, Homo sapiens
gacattgctctatgtctgcctt

SEQ ID NO: 1588470 - DNA, 19 bp, Homo sapiens
gacattgctctcagtgctt

SEQ ID NO: 1588471 - DNA, 16 bp, Homo sapiens
gacattgctctctggg

SEQ ID NO: 1588472 - DNA, 14 bp, Homo sapiens
gacatttagaactt

SEQ ID NO: 1588473 - DNA, 15 bp, Homo sapiens
gacatttagaacttt

SEQ ID NO: 1588474 - DNA, 15 bp, Homo sapiens
gacatttagaagaaa

SEQ ID NO: 1588475 - DNA, 18 bp, Homo sapiens
gacatttatactcttttt

SEQ ID NO: 1588476 - DNA, 16 bp, Homo sapiens
gacatttggagagggg

SEQ ID NO: 1588477 - DNA, 23 bp, Homo sapiens
gacatttttccgtttgcttttgt

SEQ ID NO: 1588478 - DNA, 21 bp, Homo sapiens
gaccaaaatgacaatgatgat

SEQ ID NO: 1588479 - DNA, 18 bp, Homo sapiens
gaccaaactcagttcaaa

SEQ ID NO: 1588480 - DNA, 16 bp, Homo sapiens
gaccaaagactgcaga

SEQ ID NO: 1588481 - DNA, 19 bp, Homo sapiens
gaccaaagactgcagaacc

SEQ ID NO: 1588482 - DNA, 22 bp, Homo sapiens
gaccaaagggaagtgaggccca

SEQ ID NO: 1588483 - DNA, 23 bp, Homo sapiens
gaccaaagggaagtgaggcccaa

SEQ ID NO: 1588484 - DNA, 16 bp, Homo sapiens
gaccaaagtttgcaac

SEQ ID NO: 1588485 - DNA, 20 bp, Homo sapiens
gaccaacagaacttcacagt

SEQ ID NO: 1588486 - DNA, 17 bp, Homo sapiens
gaccaacatggagaaac

SEQ ID NO: 1588487 - DNA, 13 bp, Homo sapiens
gaccaacctgacc

SEQ ID NO: 1588488 - DNA, 13 bp, Homo sapiens
gaccaactgccct

SEQ ID NO: 1588489 - DNA, 14 bp, Homo sapiens
gaccaactgcccta

SEQ ID NO: 1588490 - DNA, 12 bp, Homo sapiens
gaccaactggct

SEQ ID NO: 1588491 - DNA, 15 bp, Homo sapiens
gaccaactggcttct

SEQ ID NO: 1588492 - DNA, 13 bp, Homo sapiens
gaccaactgggcc

SEQ ID NO: 1588493 - DNA, 14 bp, Homo sapiens
gaccaactgggccc

SEQ ID NO: 1588494 - DNA, 20 bp, Homo sapiens
gaccaagcatcttggggggg

SEQ ID NO: 1588495 - DNA, 17 bp, Homo sapiens
gaccaaggcaaggcagg

SEQ ID NO: 1588496 - DNA, 19 bp, Homo sapiens
gaccaaggcaaggcaggtg

SEQ ID NO: 1588497 - DNA, 18 bp, Homo sapiens
gaccaaggggtgggccac

SEQ ID NO: 1588498 - DNA, 17 bp, Homo sapiens
gaccaagtgctggccca

SEQ ID NO: 1588499 - DNA, 18 bp, Homo sapiens
gaccaataaacagctccc

SEQ ID NO: 1588500 - DNA, 12 bp, Homo sapiens
gaccaatatata

SEQ ID NO: 1588501 - DNA, 20 bp, Homo sapiens
gaccaatatatagtgggtac

SEQ ID NO: 1588502 - DNA, 15 bp, Homo sapiens
gaccaattctggaca

SEQ ID NO: 1588503 - DNA, 12 bp, Homo sapiens
gaccacacctcc

SEQ ID NO: 1588504 - DNA, 12 bp, Homo sapiens
gaccacacctgc

SEQ ID NO: 1588505 - DNA, 20 bp, Homo sapiens
gaccacagctgctggccagg

SEQ ID NO: 1588506 - DNA, 21 bp, Homo sapiens
gaccacagggttcaaaatgtc

SEQ ID NO: 1588507 - DNA, 17 bp, Homo sapiens
gaccacagtgggtggca

SEQ ID NO: 1588508 - DNA, 21 bp, Homo sapiens
gaccacagtgggtggcacctc

SEQ ID NO: 1588509 - DNA, 17 bp, Homo sapiens
gaccacatctttatctg

SEQ ID NO: 1588510 - DNA, 22 bp, Homo sapiens
gaccaccaccccaacaaaccat

SEQ ID NO: 1588511 - DNA, 13 bp, Homo sapiens
gaccaccagcagg

SEQ ID NO: 1588512 - DNA, 14 bp, Homo sapiens
gaccaccctcccct

SEQ ID NO: 1588513 - DNA, 15 bp, Homo sapiens
gaccaccctcccctc

SEQ ID NO: 1588514 - DNA, 19 bp, Homo sapiens
gaccaccctcccctctctt

SEQ ID NO: 1588515 - DNA, 14 bp, Homo sapiens
gaccaccctgagcc

SEQ ID NO: 1588516 - DNA, 16 bp, Homo sapiens
gaattttttttaacat

SEQ ID NO: 1588517 - DNA, 16 bp, Homo sapiens
gacaaaaagtatatta

SEQ ID NO: 1588518 - DNA, 21 bp, Homo sapiens
gacaaaacattttgaaggaaa

SEQ ID NO: 1588519 - DNA, 13 bp, Homo sapiens
gacaaacactgcc

SEQ ID NO: 1588520 - DNA, 21 bp, Homo sapiens
gacaaacactgccatattgtg

SEQ ID NO: 1588521 - DNA, 18 bp, Homo sapiens
gacaaaccttatggaaaa

SEQ ID NO: 1588522 - DNA, 13 bp, Homo sapiens
gacaaagccctgt

SEQ ID NO: 1588523 - DNA, 14 bp, Homo sapiens
gacaaagccctgtc

SEQ ID NO: 1588524 - DNA, 18 bp, Homo sapiens
gacaaaggttttcctctt

SEQ ID NO: 1588525 - DNA, 17 bp, Homo sapiens
gacaaagtctccagccc

SEQ ID NO: 1588526 - DNA, 21 bp, Homo sapiens
gacaaagtgtgtaattatgta

SEQ ID NO: 1588527 - DNA, 23 bp, Homo sapiens
gacaaagttactgattcactgca

SEQ ID NO: 1588528 - DNA, 15 bp, Homo sapiens
gacaaataaggaagg

SEQ ID NO: 1588529 - DNA, 17 bp, Homo sapiens
gacaaatagaaaatggt

SEQ ID NO: 1588530 - DNA, 13 bp, Homo sapiens
gacaaatattctc

SEQ ID NO: 1588531 - DNA, 18 bp, Homo sapiens
gacaaatcacatatttta

SEQ ID NO: 1588532 - DNA, 14 bp, Homo sapiens
gacaaatgggactg

SEQ ID NO: 1588533 - DNA, 15 bp, Homo sapiens
gacaaatgggactga

SEQ ID NO: 1588534 - DNA, 17 bp, Homo sapiens
gacaaatgggactgatg

SEQ ID NO: 1588535 - DNA, 22 bp, Homo sapiens
gacaaatgtgtatcggatgctt

SEQ ID NO: 1588536 - DNA, 14 bp, Homo sapiens
gacaaatgtttcta

SEQ ID NO: 1588537 - DNA, 17 bp, Homo sapiens
gacaaattctgtttctt

SEQ ID NO: 1588538 - DNA, 20 bp, Homo sapiens
gacaaattctgtttcttgag

SEQ ID NO: 1588539 - DNA, 14 bp, Homo sapiens
gacaacagaaaaac

SEQ ID NO: 1588540 - DNA, 18 bp, Homo sapiens
gacaacagaaagagggac

SEQ ID NO: 1588541 - DNA, 12 bp, Homo sapiens
gacaacagaagt

SEQ ID NO: 1588542 - DNA, 20 bp, Homo sapiens
gacaacatgtttaataaata

SEQ ID NO: 1588543 - DNA, 17 bp, Homo sapiens
gacaacattatgatcta

SEQ ID NO: 1588544 - DNA, 19 bp, Homo sapiens
gacaacattatgatctaat

SEQ ID NO: 1588545 - DNA, 15 bp, Homo sapiens
gacaaccactggtct

SEQ ID NO: 1588546 - DNA, 19 bp, Homo sapiens
gacaaccactggtctgtag

SEQ ID NO: 1588547 - DNA, 12 bp, Homo sapiens
gacaaccatgac

SEQ ID NO: 1588548 - DNA, 15 bp, Homo sapiens
gacaaccattaaagt

SEQ ID NO: 1588549 - DNA, 16 bp, Homo sapiens
gacaaccattaaagtc

SEQ ID NO: 1588550 - DNA, 19 bp, Homo sapiens
gacaaccattaaagtcaga

SEQ ID NO: 1588551 - DNA, 17 bp, Homo sapiens
gacaacgtttcagcgac

SEQ ID NO: 1588552 - DNA, 20 bp, Homo sapiens
gacaactgttttaataaaag

SEQ ID NO: 1588553 - DNA, 15 bp, Homo sapiens
gacaacttatttaaa

SEQ ID NO: 1588554 - DNA, 18 bp, Homo sapiens
gacaagaaaggcagacac

SEQ ID NO: 1588555 - DNA, 19 bp, Homo sapiens
gacaagaagcaaatttttt

SEQ ID NO: 1588556 - DNA, 18 bp, Homo sapiens
gacaagaatggaatagaa

SEQ ID NO: 1588557 - DNA, 16 bp, Homo sapiens
gacaagacccccagca

SEQ ID NO: 1588558 - DNA, 13 bp, Homo sapiens
gacaagagctgct

SEQ ID NO: 1588559 - DNA, 19 bp, Homo sapiens
gacaagatattgtacataa

SEQ ID NO: 1588560 - DNA, 17 bp, Homo sapiens
gacaagatgggacagca

SEQ ID NO: 1588561 - DNA, 14 bp, Homo sapiens
gacaagcagccctt

SEQ ID NO: 1588562 - DNA, 14 bp, Homo sapiens
gacaagcagtccct

SEQ ID NO: 1588563 - DNA, 17 bp, Homo sapiens
gacaagccctggcaaca

SEQ ID NO: 1588564 - DNA, 14 bp, Homo sapiens
gacaaggaaaatct

SEQ ID NO: 1588565 - DNA, 20 bp, Homo sapiens
gacaaggaaaatctatattt

SEQ ID NO: 1588566 - DNA, 21 bp, Homo sapiens
gacagagacacctgcacctcc

SEQ ID NO: 1588567 - DNA, 18 bp, Homo sapiens
gacagagacccagatctc

SEQ ID NO: 1588568 - DNA, 17 bp, Homo sapiens
gacagagcaaagcgccc

SEQ ID NO: 1588569 - DNA, 19 bp, Homo sapiens
gacagagcaaagcgcccac

SEQ ID NO: 1588570 - DNA, 16 bp, Homo sapiens
gacagagccaagcact

SEQ ID NO: 1588571 - DNA, 15 bp, Homo sapiens
gacagagccaggaga

SEQ ID NO: 1588572 - DNA, 16 bp, Homo sapiens
gacagagccaggagaa

SEQ ID NO: 1588573 - DNA, 13 bp, Homo sapiens
gacagaggcccca

SEQ ID NO: 1588574 - DNA, 19 bp, Homo sapiens
gacagaggccggggtccag

SEQ ID NO: 1588575 - DNA, 12 bp, Homo sapiens
gacagagggcac

SEQ ID NO: 1588576 - DNA, 19 bp, Homo sapiens
gacagagggcacatgaaca

SEQ ID NO: 1588577 - DNA, 22 bp, Homo sapiens
gacagaggggatggggatagag

SEQ ID NO: 1588578 - DNA, 13 bp, Homo sapiens
gacagagtaaaag

SEQ ID NO: 1588579 - DNA, 15 bp, Homo sapiens
gacagagtaaaagta

SEQ ID NO: 1588580 - DNA, 15 bp, Homo sapiens
gacagatatttcaaa

SEQ ID NO: 1588581 - DNA, 18 bp, Homo sapiens
gacagatgccccagagct

SEQ ID NO: 1588582 - DNA, 20 bp, Homo sapiens
gacagatgccccagagctgt

SEQ ID NO: 1588583 - DNA, 17 bp, Homo sapiens
gacagatgtcagccgag

SEQ ID NO: 1588584 - DNA, 18 bp, Homo sapiens
gacagatgtcagccgagc

SEQ ID NO: 1588585 - DNA, 15 bp, Homo sapiens
gacagcaaaaactat

SEQ ID NO: 1588586 - DNA, 15 bp, Homo sapiens
gacagcacacacagt

SEQ ID NO: 1588587 - DNA, 16 bp, Homo sapiens
gacagcacacacagtg

SEQ ID NO: 1588588 - DNA, 19 bp, Homo sapiens
gacagcagcctccctgtca

SEQ ID NO: 1588589 - DNA, 20 bp, Homo sapiens
gacagcagcctccctgtcac

SEQ ID NO: 1588590 - DNA, 15 bp, Homo sapiens
gacagcagcctgtat

SEQ ID NO: 1588591 - DNA, 13 bp, Homo sapiens
gacagcagctcag

SEQ ID NO: 1588592 - DNA, 14 bp, Homo sapiens
gacagcagctggtg

SEQ ID NO: 1588593 - DNA, 20 bp, Homo sapiens
gacagcagctggtgccccac

SEQ ID NO: 1588594 - DNA, 12 bp, Homo sapiens
gacagccagagc

SEQ ID NO: 1588595 - DNA, 14 bp, Homo sapiens
gacagccagagcct

SEQ ID NO: 1588596 - DNA, 17 bp, Homo sapiens
gacagccagagcctgtc

SEQ ID NO: 1588597 - DNA, 15 bp, Homo sapiens
gacagccatgcgtgg

SEQ ID NO: 1588598 - DNA, 21 bp, Homo sapiens
gacagcccacggtctggaggc

SEQ ID NO: 1588599 - DNA, 17 bp, Homo sapiens
gacagcccactgagaag

SEQ ID NO: 1588600 - DNA, 15 bp, Homo sapiens
gacagcccagagcct

SEQ ID NO: 1588601 - DNA, 23 bp, Homo sapiens
gacagcctgtggcggtgcctggg

SEQ ID NO: 1588602 - DNA, 10 bp, Homo sapiens
gacagccttc

SEQ ID NO: 1588603 - DNA, 12 bp, Homo sapiens
gacagccttcag

SEQ ID NO: 1588604 - DNA, 14 bp, Homo sapiens
gacagccttcagca

SEQ ID NO: 1588605 - DNA, 13 bp, Homo sapiens
gacagcggccttg

SEQ ID NO: 1588606 - DNA, 18 bp, Homo sapiens
gacagctacacagagctt

SEQ ID NO: 1588607 - DNA, 17 bp, Homo sapiens
gacagctacttctggga

SEQ ID NO: 1588608 - DNA, 16 bp, Homo sapiens
gacagctccctctgcc

SEQ ID NO: 1588609 - DNA, 13 bp, Homo sapiens
gacagctgctggg

SEQ ID NO: 1588610 - DNA, 14 bp, Homo sapiens
gacagctgctggga

SEQ ID NO: 1588611 - DNA, 15 bp, Homo sapiens
gacagctgctgggac

SEQ ID NO: 1588612 - DNA, 22 bp, Homo sapiens
gacagctggctgggccttcacc

SEQ ID NO: 1588613 - DNA, 14 bp, Homo sapiens
gacagctgtccctg

SEQ ID NO: 1588614 - DNA, 18 bp, Homo sapiens
gacagctgtccctgtcac

SEQ ID NO: 1588615 - DNA, 22 bp, Homo sapiens
gacagctgtccctgtcaccaag

SEQ ID NO: 1588616 - DNA, 13 bp, Homo sapiens
gacagcttcctca

SEQ ID NO: 1588617 - DNA, 14 bp, Homo sapiens
gacagcttcctcac

SEQ ID NO: 1588618 - DNA, 16 bp, Homo sapiens
gacagcttcctcacac

SEQ ID NO: 1588619 - DNA, 17 bp, Homo sapiens
gacagcttcctcacacc

SEQ ID NO: 1588620 - DNA, 14 bp, Homo sapiens
gacagctttctggg

SEQ ID NO: 1588621 - DNA, 17 bp, Homo sapiens
gacagctttgctccgct

SEQ ID NO: 1588622 - DNA, 22 bp, Homo sapiens
gacaggaaccttaagtaatcat

SEQ ID NO: 1588623 - DNA, 14 bp, Homo sapiens
gacaggacagtgct

SEQ ID NO: 1588624 - DNA, 13 bp, Homo sapiens
gacaggacctgac

SEQ ID NO: 1588625 - DNA, 18 bp, Homo sapiens
gacaggagaatcacctga

SEQ ID NO: 1588626 - DNA, 23 bp, Homo sapiens
gacaggagcctagcggagcccag

SEQ ID NO: 1588627 - DNA, 22 bp, Homo sapiens
gacaggaggcggcccggccagc

SEQ ID NO: 1588628 - DNA, 19 bp, Homo sapiens
gacaggatgaggacagagg

SEQ ID NO: 1588629 - DNA, 21 bp, Homo sapiens
gacaggatggggttctggaaa

SEQ ID NO: 1588630 - DNA, 22 bp, Homo sapiens
gacaggcactccaaacctgtct

SEQ ID NO: 1588631 - DNA, 18 bp, Homo sapiens
gacaggccatgtgagcca

SEQ ID NO: 1588632 - DNA, 19 bp, Homo sapiens
gacaggccatgtgagccac

SEQ ID NO: 1588633 - DNA, 11 bp, Homo sapiens
gacaggcccaa

SEQ ID NO: 1588634 - DNA, 19 bp, Homo sapiens
gacaggctcttagcagctt

SEQ ID NO: 1588635 - DNA, 14 bp, Homo sapiens
gacaggctggtgct

SEQ ID NO: 1588636 - DNA, 21 bp, Homo sapiens
gacagggacatgccctgtgtg

SEQ ID NO: 1588637 - DNA, 12 bp, Homo sapiens
gacagggcagag

SEQ ID NO: 1588638 - DNA, 23 bp, Homo sapiens
gaccaggcatcctccacaatagc

SEQ ID NO: 1588639 - DNA, 19 bp, Homo sapiens
gaccaggccattctgccgc

SEQ ID NO: 1588640 - DNA, 19 bp, Homo sapiens
gaccaggctgcagcctcca

SEQ ID NO: 1588641 - DNA, 15 bp, Homo sapiens
gaccaggctgcctcc

SEQ ID NO: 1588642 - DNA, 16 bp, Homo sapiens
gaccaggcttggcctt

SEQ ID NO: 1588643 - DNA, 22 bp, Homo sapiens
gaccagggagcctttggttctg

SEQ ID NO: 1588644 - DNA, 17 bp, Homo sapiens
gaccagggatgctgggc

SEQ ID NO: 1588645 - DNA, 20 bp, Homo sapiens
gaccagggatgctgggctgg

SEQ ID NO: 1588646 - DNA, 22 bp, Homo sapiens
gaccagggatgctgggctgggc

SEQ ID NO: 1588647 - DNA, 12 bp, Homo sapiens
gaccagggccac

SEQ ID NO: 1588648 - DNA, 14 bp, Homo sapiens
gaccagggccaccg

SEQ ID NO: 1588649 - DNA, 14 bp, Homo sapiens
gaccagggcctttt

SEQ ID NO: 1588650 - DNA, 18 bp, Homo sapiens
gaccagggctccagcccc

SEQ ID NO: 1588651 - DNA, 23 bp, Homo sapiens
gaccagggcttttcccaggaata

SEQ ID NO: 1588652 - DNA, 14 bp, Homo sapiens
gaccaggtcctgct

SEQ ID NO: 1588653 - DNA, 20 bp, Homo sapiens
gaccagtcccacaccgctgg

SEQ ID NO: 1588654 - DNA, 14 bp, Homo sapiens
gaccagtggctggt

SEQ ID NO: 1588655 - DNA, 17 bp, Homo sapiens
gaccagtggctggtctc

SEQ ID NO: 1588656 - DNA, 22 bp, Homo sapiens
gaccagttgaataaaagtgcac

SEQ ID NO: 1588657 - DNA, 17 bp, Homo sapiens
gaccagttgggagcact

SEQ ID NO: 1588658 - DNA, 22 bp, Homo sapiens
gaccataaagggtgtaggggcc

SEQ ID NO: 1588659 - DNA, 20 bp, Homo sapiens
gaccataatgttacattatt

SEQ ID NO: 1588660 - DNA, 13 bp, Homo sapiens
gaccatactcaga

SEQ ID NO: 1588661 - DNA, 17 bp, Homo sapiens
gaccatattacctggat

SEQ ID NO: 1588662 - DNA, 19 bp, Homo sapiens
gaccatatttactctttct

SEQ ID NO: 1588663 - DNA, 21 bp, Homo sapiens
gaccatccactctaccctccc

SEQ ID NO: 1588664 - DNA, 12 bp, Homo sapiens
gaccatcctggc

SEQ ID NO: 1588665 - DNA, 15 bp, Homo sapiens
gaccatcctggcccc

SEQ ID NO: 1588666 - DNA, 22 bp, Homo sapiens
gaccatgctcatctgctggtcc

SEQ ID NO: 1588667 - DNA, 14 bp, Homo sapiens
gaccatgttcatta

SEQ ID NO: 1588668 - DNA, 17 bp, Homo sapiens
gaccatgttcattataa

SEQ ID NO: 1588669 - DNA, 21 bp, Homo sapiens
gaccattcagaatatcatctt

SEQ ID NO: 1588670 - DNA, 20 bp, Homo sapiens
gaccattctcaccctgtgaa

SEQ ID NO: 1588671 - DNA, 16 bp, Homo sapiens
gaccattgacctcagc

SEQ ID NO: 1588672 - DNA, 18 bp, Homo sapiens
gaccattgacctcagctg

SEQ ID NO: 1588673 - DNA, 20 bp, Homo sapiens
gaccattgacctcagctgca

SEQ ID NO: 1588674 - DNA, 13 bp, Homo sapiens
gaccatttataat

SEQ ID NO: 1588675 - DNA, 21 bp, Homo sapiens
gaccatttataatgttagtag

SEQ ID NO: 1588676 - DNA, 20 bp, Homo sapiens
gacccaactgatcctgctcc

SEQ ID NO: 1588677 - DNA, 21 bp, Homo sapiens
gacccaactgatcctgctcca

SEQ ID NO: 1588678 - DNA, 18 bp, Homo sapiens
gacccaatgtaggagctg

SEQ ID NO: 1588679 - DNA, 19 bp, Homo sapiens
gacccaatgtaggagctgc

SEQ ID NO: 1588680 - DNA, 12 bp, Homo sapiens
gacccacactgc

SEQ ID NO: 1588681 - DNA, 12 bp, Homo sapiens
gacccacatgct

SEQ ID NO: 1588682 - DNA, 13 bp, Homo sapiens
gacccaccagtgc

SEQ ID NO: 1588683 - DNA, 16 bp, Homo sapiens
gacccaccagtgcctt

SEQ ID NO: 1588684 - DNA, 22 bp, Homo sapiens
gacccacccatcttcctgctgc

SEQ ID NO: 1588685 - DNA, 14 bp, Homo sapiens
gacccaccccaact

SEQ ID NO: 1588686 - DNA, 15 bp, Homo sapiens
gacccacccctgtgc

SEQ ID NO: 1588687 - DNA, 16 bp, Homo sapiens
gacccacccctgtgct

SEQ ID NO: 1588688 - DNA, 14 bp, Homo sapiens
gacccacctccccc

SEQ ID NO: 1588689 - DNA, 14 bp, Homo sapiens
gacccactaaagag

SEQ ID NO: 1588690 - DNA, 14 bp, Homo sapiens
gacccactaccctt

SEQ ID NO: 1588691 - DNA, 17 bp, Homo sapiens
gacccactacccttctc

SEQ ID NO: 1588692 - DNA, 23 bp, Homo sapiens
gacccactacccttctcctttcc

SEQ ID NO: 1588693 - DNA, 16 bp, Homo sapiens
gacccactgatctcta

SEQ ID NO: 1588694 - DNA, 17 bp, Homo sapiens
gacccagaatggagcct

SEQ ID NO: 1588695 - DNA, 17 bp, Homo sapiens
gacccagacacatcgca

SEQ ID NO: 1588696 - DNA, 19 bp, Homo sapiens
gacccagagtggagtctga

SEQ ID NO: 1588697 - DNA, 23 bp, Homo sapiens
gacccagcaggaagccaggctga

SEQ ID NO: 1588698 - DNA, 17 bp, Homo sapiens
gacccagcatctcccag

SEQ ID NO: 1588699 - DNA, 22 bp, Homo sapiens
gacccagccccttgagaaacct

SEQ ID NO: 1588700 - DNA, 23 bp, Homo sapiens
gacccagccccttgagaaacctt

SEQ ID NO: 1588701 - DNA, 18 bp, Homo sapiens
gacccagctactctgtcc

SEQ ID NO: 1588702 - DNA, 18 bp, Homo sapiens
gacccagcttagagttct

SEQ ID NO: 1588703 - DNA, 12 bp, Homo sapiens
gacccaggccct

SEQ ID NO: 1588704 - DNA, 11 bp, Homo sapiens
gacccaggccg

SEQ ID NO: 1588705 - DNA, 17 bp, Homo sapiens
gacccaggccgcagctc

SEQ ID NO: 1588706 - DNA, 13 bp, Homo sapiens
gacccagggggag

SEQ ID NO: 1588707 - DNA, 20 bp, Homo sapiens
gacccaggtggagggcacag

SEQ ID NO: 1588708 - DNA, 22 bp, Homo sapiens
gacccaggtggagggcacagcc

SEQ ID NO: 1588709 - DNA, 23 bp, Homo sapiens
gacccaggtggagggcacagccc

SEQ ID NO: 1588710 - DNA, 16 bp, Homo sapiens
gacccaggtgtgcctg

SEQ ID NO: 1588711 - DNA, 22 bp, Homo sapiens
gacccaggtgtgcctgtgctcc

SEQ ID NO: 1588712 - DNA, 14 bp, Homo sapiens
gacccagtccctgg

SEQ ID NO: 1588713 - DNA, 19 bp, Homo sapiens
gacccagtgcactccggtc

SEQ ID NO: 1588714 - DNA, 12 bp, Homo sapiens
gacccagtgcag

SEQ ID NO: 1588715 - DNA, 13 bp, Homo sapiens
gacccagtgcaga

SEQ ID NO: 1588716 - DNA, 14 bp, Homo sapiens
gacccagtgcagaa

SEQ ID NO: 1588717 - DNA, 15 bp, Homo sapiens
gacccagtgccccca

SEQ ID NO: 1588718 - DNA, 17 bp, Homo sapiens
gacccagtgcccccact

SEQ ID NO: 1588719 - DNA, 23 bp, Homo sapiens
gacccatagcagctttgtctctg

SEQ ID NO: 1588720 - DNA, 19 bp, Homo sapiens
gaccccaaagactctggag

SEQ ID NO: 1588721 - DNA, 17 bp, Homo sapiens
gaccccaaaggaacact

SEQ ID NO: 1588722 - DNA, 23 bp, Homo sapiens
gaccccacgtgcgacagagagag

SEQ ID NO: 1588723 - DNA, 19 bp, Homo sapiens
gaccccagcggctgagtca

SEQ ID NO: 1588724 - DNA, 12 bp, Homo sapiens
gaccccagctgg

SEQ ID NO: 1588725 - DNA, 20 bp, Homo sapiens
gactaaactttttttctgta

SEQ ID NO: 1588726 - DNA, 22 bp, Homo sapiens
gactaaactttttttctgtacc

SEQ ID NO: 1588727 - DNA, 22 bp, Homo sapiens
gactaacataaaatctgtgaat

SEQ ID NO: 1588728 - DNA, 23 bp, Homo sapiens
gactaactagacaccaaagttct

SEQ ID NO: 1588729 - DNA, 18 bp, Homo sapiens
gactaactatcaaataga

SEQ ID NO: 1588730 - DNA, 16 bp, Homo sapiens
gactaagagaagttgt

SEQ ID NO: 1588731 - DNA, 22 bp, Homo sapiens
gactaagccctgtcgagacact

SEQ ID NO: 1588732 - DNA, 13 bp, Homo sapiens
gactaatgctttt

SEQ ID NO: 1588733 - DNA, 23 bp, Homo sapiens
gactaatgctttttagaaagcat

SEQ ID NO: 1588734 - DNA, 15 bp, Homo sapiens
gactaattttacatg

SEQ ID NO: 1588735 - DNA, 23 bp, Homo sapiens
gactaattttacatgtttataaa

SEQ ID NO: 1588736 - DNA, 16 bp, Homo sapiens
gactacacaatacagt

SEQ ID NO: 1588737 - DNA, 19 bp, Homo sapiens
gactacacaatacagtatt

SEQ ID NO: 1588738 - DNA, 22 bp, Homo sapiens
gactacacaatacagtattata

SEQ ID NO: 1588739 - DNA, 16 bp, Homo sapiens
gaatgtagcatctgag

SEQ ID NO: 1588740 - DNA, 16 bp, Homo sapiens
gaatgtatcaggaaat

SEQ ID NO: 1588741 - DNA, 14 bp, Homo sapiens
gaatgtattctgta

SEQ ID NO: 1588742 - DNA, 14 bp, Homo sapiens
gaatgtatttgatt

SEQ ID NO: 1588743 - DNA, 23 bp, Homo sapiens
gaatgtattttaactatttttgt

SEQ ID NO: 1588744 - DNA, 16 bp, Homo sapiens
gaatgtcagatttctg

SEQ ID NO: 1588745 - DNA, 13 bp, Homo sapiens
gaatgtcagtatg

SEQ ID NO: 1588746 - DNA, 16 bp, Homo sapiens
gaatgtcagtatgtgg

SEQ ID NO: 1588747 - DNA, 16 bp, Homo sapiens
gaatgtgaaaaaggaa

SEQ ID NO: 1588748 - DNA, 19 bp, Homo sapiens
gaatgtgctggtgaacact

SEQ ID NO: 1588749 - DNA, 23 bp, Homo sapiens
gaatgtgtgtgtgtggcaggggg

SEQ ID NO: 1588750 - DNA, 14 bp, Homo sapiens
gaatgtgtttcaaa

SEQ ID NO: 1588751 - DNA, 22 bp, Homo sapiens
gaatgtgtttcaaaaccatgcc

SEQ ID NO: 1588752 - DNA, 13 bp, Homo sapiens
gaatgttaaaggg

SEQ ID NO: 1588753 - DNA, 16 bp, Homo sapiens
gaatgttaaagtcagt

SEQ ID NO: 1588754 - DNA, 15 bp, Homo sapiens
gaatgttaagcagat

SEQ ID NO: 1588755 - DNA, 17 bp, Homo sapiens
gaatgttatatcatcaa

SEQ ID NO: 1588756 - DNA, 23 bp, Homo sapiens
gaatgttatcggattactgaatt

SEQ ID NO: 1588757 - DNA, 20 bp, Homo sapiens
gaatgttcccaagtaggcat

SEQ ID NO: 1588758 - DNA, 20 bp, Homo sapiens
gaatgttggtgtgaaacaaa

SEQ ID NO: 1588759 - DNA, 21 bp, Homo sapiens
gaatgtttaaagatcatgaca

SEQ ID NO: 1588760 - DNA, 20 bp, Homo sapiens
gaattaaattaggaataaat

SEQ ID NO: 1588761 - DNA, 21 bp, Homo sapiens
gaattaaattaggaataaata

SEQ ID NO: 1588762 - DNA, 22 bp, Homo sapiens
gaattaactgcatacgttttgg

SEQ ID NO: 1588763 - DNA, 20 bp, Homo sapiens
gaattaagttatctttaaaa

SEQ ID NO: 1588764 - DNA, 13 bp, Homo sapiens
gaattaagtttta

SEQ ID NO: 1588765 - DNA, 11 bp, Homo sapiens
gaattacagta

SEQ ID NO: 1588766 - DNA, 13 bp, Homo sapiens
gaattacagtgaa

SEQ ID NO: 1588767 - DNA, 15 bp, Homo sapiens
gaattactgtatata

SEQ ID NO: 1588768 - DNA, 18 bp, Homo sapiens
gaattaggctgtaactac

SEQ ID NO: 1588769 - DNA, 19 bp, Homo sapiens
gaattaggctgtaactact

SEQ ID NO: 1588770 - DNA, 23 bp, Homo sapiens
gaattaggctgtaactactttat

SEQ ID NO: 1588771 - DNA, 18 bp, Homo sapiens
gaattagtatgtctgttt

SEQ ID NO: 1588772 - DNA, 20 bp, Homo sapiens
gaattagtatttcagtgttt

SEQ ID NO: 1588773 - DNA, 22 bp, Homo sapiens
gaattagtatttcagtgttttc

SEQ ID NO: 1588774 - DNA, 19 bp, Homo sapiens
gaattataacagttatatt

SEQ ID NO: 1588775 - DNA, 14 bp, Homo sapiens
gaattatatatttc

SEQ ID NO: 1588776 - DNA, 20 bp, Homo sapiens
gaattatcagcaaagaaaaa

SEQ ID NO: 1588777 - DNA, 13 bp, Homo sapiens
gaattatgcttcc

SEQ ID NO: 1588778 - DNA, 21 bp, Homo sapiens
gaattatgctttgtagagttt

SEQ ID NO: 1588779 - DNA, 16 bp, Homo sapiens
gaattatgtaatatat

SEQ ID NO: 1588780 - DNA, 23 bp, Homo sapiens
gaattatgtaatatattgtacaa

SEQ ID NO: 1588781 - DNA, 16 bp, Homo sapiens
gaattatgtataacaa

SEQ ID NO: 1588782 - DNA, 14 bp, Homo sapiens
gaattattgacact

SEQ ID NO: 1588783 - DNA, 15 bp, Homo sapiens
gaattattgacactg

SEQ ID NO: 1588784 - DNA, 17 bp, Homo sapiens
gaattattgacactgaa

SEQ ID NO: 1588785 - DNA, 14 bp, Homo sapiens
gaattatttttgtg

SEQ ID NO: 1588786 - DNA, 21 bp, Homo sapiens
gaattcaaactggggcctcca

SEQ ID NO: 1588787 - DNA, 22 bp, Homo sapiens
gaattcactccagtcaacagat

SEQ ID NO: 1588788 - DNA, 16 bp, Homo sapiens
gaattcagcaccctgg

SEQ ID NO: 1588789 - DNA, 15 bp, Homo sapiens
gaattcataaaaata

SEQ ID NO: 1588790 - DNA, 16 bp, Homo sapiens
gaattccacagggacc

SEQ ID NO: 1588791 - DNA, 18 bp, Homo sapiens
gaattccacagggaccag

SEQ ID NO: 1588792 - DNA, 12 bp, Homo sapiens
gaattccctccc

SEQ ID NO: 1588793 - DNA, 16 bp, Homo sapiens
gaattccctccccctc

SEQ ID NO: 1588794 - DNA, 11 bp, Homo sapiens
gactcttgcct

SEQ ID NO: 1588795 - DNA, 23 bp, Homo sapiens
gactctttgggtccattcagatg

SEQ ID NO: 1588796 - DNA, 16 bp, Homo sapiens
gactctttttttgagt

SEQ ID NO: 1588797 - DNA, 22 bp, Homo sapiens
gactgaaaaaaaaaaagaagaa

SEQ ID NO: 1588798 - DNA, 14 bp, Homo sapiens
gactgaaaccattt

SEQ ID NO: 1588799 - DNA, 20 bp, Homo sapiens
gactgaaagaagaaaacagt

SEQ ID NO: 1588800 - DNA, 12 bp, Homo sapiens
gactgaaagcag

SEQ ID NO: 1588801 - DNA, 15 bp, Homo sapiens
gactgaaagcagcag

SEQ ID NO: 1588802 - DNA, 21 bp, Homo sapiens
gactgaacattagttgcacta

SEQ ID NO: 1588803 - DNA, 19 bp, Homo sapiens
gactgaagaagatgagcct

SEQ ID NO: 1588804 - DNA, 15 bp, Homo sapiens
gactgaagcacagca

SEQ ID NO: 1588805 - DNA, 16 bp, Homo sapiens
gactgaagcctgcagg

SEQ ID NO: 1588806 - DNA, 15 bp, Homo sapiens
gactgaaggggcaca

SEQ ID NO: 1588807 - DNA, 24 bp, Homo sapiens
gactgaaggggcacaccactgccc

SEQ ID NO: 1588808 - DNA, 18 bp, Homo sapiens
gactgaattgtccccagt

SEQ ID NO: 1588809 - DNA, 22 bp, Homo sapiens
gactgaatttaactactaagaa

SEQ ID NO: 1588810 - DNA, 13 bp, Homo sapiens
gactgacgagaga

SEQ ID NO: 1588811 - DNA, 12 bp, Homo sapiens
gactgactgtgt

SEQ ID NO: 1588812 - DNA, 15 bp, Homo sapiens
gactgactgtgttgg

SEQ ID NO: 1588813 - DNA, 21 bp, Homo sapiens
gactgagcaagaccctgtctc

SEQ ID NO: 1588814 - DNA, 16 bp, Homo sapiens
gactgagcaccctctg

SEQ ID NO: 1588815 - DNA, 13 bp, Homo sapiens
gactgagcagccg

SEQ ID NO: 1588816 - DNA, 20 bp, Homo sapiens
gactgagcagccgccagctg

SEQ ID NO: 1588817 - DNA, 23 bp, Homo sapiens
gactgagcctggcccatagaaac

SEQ ID NO: 1588818 - DNA, 19 bp, Homo sapiens
gactgagctctccaggcca

SEQ ID NO: 1588819 - DNA, 15 bp, Homo sapiens
gactgagctggggga

SEQ ID NO: 1588820 - DNA, 14 bp, Homo sapiens
gactgaggacaggc

SEQ ID NO: 1588821 - DNA, 13 bp, Homo sapiens
gactgaggcctga

SEQ ID NO: 1588822 - DNA, 14 bp, Homo sapiens
gactgaggcctgag

SEQ ID NO: 1588823 - DNA, 20 bp, Homo sapiens
gactgaggtataaagacaag

SEQ ID NO: 1588824 - DNA, 17 bp, Homo sapiens
gactgagtgggaagccc

SEQ ID NO: 1588825 - DNA, 23 bp, Homo sapiens
gactgataacaaccttttacatt

SEQ ID NO: 1588826 - DNA, 12 bp, Homo sapiens
gactgatctcag

SEQ ID NO: 1588827 - DNA, 16 bp, Homo sapiens
gactgattctgtggct

SEQ ID NO: 1588828 - DNA, 16 bp, Homo sapiens
gactgcacaggagaat

SEQ ID NO: 1588829 - DNA, 16 bp, Homo sapiens
gactgcaccagcgccc

SEQ ID NO: 1588830 - DNA, 13 bp, Homo sapiens
gactgcagaaccc

SEQ ID NO: 1588831 - DNA, 20 bp, Homo sapiens
gactgcagaacccccaggtg

SEQ ID NO: 1588832 - DNA, 23 bp, Homo sapiens
gactgcagaacccccaggtggcc

SEQ ID NO: 1588833 - DNA, 22 bp, Homo sapiens
gactgcagacaggctctgaggg

SEQ ID NO: 1588834 - DNA, 14 bp, Homo sapiens
gactgcagccccct

SEQ ID NO: 1588835 - DNA, 22 bp, Homo sapiens
gactgcagggacacgggcagcc

SEQ ID NO: 1588836 - DNA, 15 bp, Homo sapiens
gactgcagtgtggag

SEQ ID NO: 1588837 - DNA, 20 bp, Homo sapiens
gactgcatggggaggcagca

SEQ ID NO: 1588838 - DNA, 23 bp, Homo sapiens
gactgcatgtaccatttgcatgg

SEQ ID NO: 1588839 - DNA, 18 bp, Homo sapiens
gactgcatttaaatttga

SEQ ID NO: 1588840 - DNA, 20 bp, Homo sapiens
gactgcatttaaatttgatt

SEQ ID NO: 1588841 - DNA, 22 bp, Homo sapiens
gactgccccacggccctgtcag

SEQ ID NO: 1588842 - DNA, 10 bp, Homo sapiens
gactgcctgt

SEQ ID NO: 1588843 - DNA, 11 bp, Homo sapiens
gactgcctgtc

SEQ ID NO: 1588844 - DNA, 21 bp, Homo sapiens
gactgcgggatggtcctgggg

SEQ ID NO: 1588845 - DNA, 22 bp, Homo sapiens
gactgcgggatggtcctggggc

SEQ ID NO: 1588846 - DNA, 15 bp, Homo sapiens
gactgcgttctgcaa

SEQ ID NO: 1588847 - DNA, 16 bp, Homo sapiens
gactgctacctctgag

SEQ ID NO: 1588848 - DNA, 18 bp, Homo sapiens
gactgctacctctgagaa

SEQ ID NO: 1588849 - DNA, 21 bp, Homo sapiens
gactgctacctctgagaagac

SEQ ID NO: 1588850 - DNA, 23 bp, Homo sapiens
gactgctacctctgagaagacac

SEQ ID NO: 1588851 - DNA, 19 bp, Homo sapiens
gactgctcagaacttgctg

SEQ ID NO: 1588852 - DNA, 12 bp, Homo sapiens
gactgctgggac

SEQ ID NO: 1588853 - DNA, 12 bp, Homo sapiens
gactgcttccca

SEQ ID NO: 1588854 - DNA, 13 bp, Homo sapiens
gactgcttcccat

SEQ ID NO: 1588855 - DNA, 22 bp, Homo sapiens
gactgcttcccatcctaccctc

SEQ ID NO: 1588856 - DNA, 21 bp, Homo sapiens
gactgctttggacctaaatgg

SEQ ID NO: 1588857 - DNA, 17 bp, Homo sapiens
gactggaccgctgactg

SEQ ID NO: 1588858 - DNA, 21 bp, Homo sapiens
gactggagaaaacccctccca

SEQ ID NO: 1588859 - DNA, 15 bp, Homo sapiens
gactggagtgaggct

SEQ ID NO: 1588860 - DNA, 20 bp, Homo sapiens
gactggagtgaggcttccag

SEQ ID NO: 1588861 - DNA, 17 bp, Homo sapiens
gactggatcttctatca

SEQ ID NO: 1588862 - DNA, 23 bp, Homo sapiens
gactggcaggtgcagatgggctg

SEQ ID NO: 1588863 - DNA, 12 bp, Homo sapiens
gactggccaggg

SEQ ID NO: 1588864 - DNA, 17 bp, Homo sapiens
gactggccatttttctg

SEQ ID NO: 1588865 - DNA, 19 bp, Homo sapiens
gactggccatttttctggg

SEQ ID NO: 1588866 - DNA, 20 bp, Homo sapiens
gactggctagagtcctcact

SEQ ID NO: 1588867 - DNA, 23 bp, Homo sapiens
gactggctagagtcctcactccc

SEQ ID NO: 1588868 - DNA, 20 bp, Homo sapiens
gactgggaagataggctctg

SEQ ID NO: 1588869 - DNA, 23 bp, Homo sapiens
gactgggaagataggctctgcac

SEQ ID NO: 1588870 - DNA, 19 bp, Homo sapiens
gactgggagccacttctcc

SEQ ID NO: 1588871 - DNA, 12 bp, Homo sapiens
gactgggcccag

SEQ ID NO: 1588872 - DNA, 12 bp, Homo sapiens
gactgggctctg

SEQ ID NO: 1588873 - DNA, 17 bp, Homo sapiens
gactgggctctggctct

SEQ ID NO: 1588874 - DNA, 23 bp, Homo sapiens
gactgggtctcgctttgttgccc

SEQ ID NO: 1588875 - DNA, 15 bp, Homo sapiens
gactgggtctgacct

SEQ ID NO: 1588876 - DNA, 16 bp, Homo sapiens
gactggtaagtaactg

SEQ ID NO: 1588877 - DNA, 11 bp, Homo sapiens
gactggtccag

SEQ ID NO: 1588878 - DNA, 16 bp, Homo sapiens
gactggtccagctctg

SEQ ID NO: 1588879 - DNA, 17 bp, Homo sapiens
gactggtccagctctga

SEQ ID NO: 1588880 - DNA, 22 bp, Homo sapiens
gactggtctcgaactcctggcc

SEQ ID NO: 1588881 - DNA, 10 bp, Homo sapiens
gactggtgcc

SEQ ID NO: 1588882 - DNA, 16 bp, Homo sapiens
gactggtgccctcctc

SEQ ID NO: 1588883 - DNA, 22 bp, Homo sapiens
gactgtaaacatcagcaagact

SEQ ID NO: 1588884 - DNA, 23 bp, Homo sapiens
gactgtactcctcccaggcgccc

SEQ ID NO: 1588885 - DNA, 14 bp, Homo sapiens
gactgtatctgtgt

SEQ ID NO: 1588886 - DNA, 16 bp, Homo sapiens
gactgtatctgtgtag

SEQ ID NO: 1588887 - DNA, 16 bp, Homo sapiens
gactgtccaggagcta

SEQ ID NO: 1588888 - DNA, 19 bp, Homo sapiens
gactgtcctgaggagccct

SEQ ID NO: 1588889 - DNA, 20 bp, Homo sapiens
gactgtcctgaggagccctg

SEQ ID NO: 1588890 - DNA, 13 bp, Homo sapiens
gactgtctttcag

SEQ ID NO: 1588891 - DNA, 21 bp, Homo sapiens
gactgtgaacttgactgggtg

SEQ ID NO: 1588892 - DNA, 23 bp, Homo sapiens
gactgtgaggcggcagctggggc

SEQ ID NO: 1588893 - DNA, 23 bp, Homo sapiens
gactgtgatttatttggagtgga

SEQ ID NO: 1588894 - DNA, 12 bp, Homo sapiens
gactgtggctgc

SEQ ID NO: 1588895 - DNA, 18 bp, Homo sapiens
gactgtggtaggggcagg

SEQ ID NO: 1588896 - DNA, 21 bp, Homo sapiens
gactgtgtttccaaaggttcc

SEQ ID NO: 1588897 - DNA, 21 bp, Homo sapiens
gactgtgtttgcattgtctaa

SEQ ID NO: 1588898 - DNA, 15 bp, Homo sapiens
gactgtttatttaag

SEQ ID NO: 1588899 - DNA, 17 bp, Homo sapiens
gactgtttatttaagga

SEQ ID NO: 1588900 - DNA, 20 bp, Homo sapiens
gactgtttatttaaggatgg

SEQ ID NO: 1588901 - DNA, 21 bp, Homo sapiens
gactgtttatttaaggatgga

SEQ ID NO: 1588902 - DNA, 12 bp, Homo sapiens
gacttaaaacat

SEQ ID NO: 1588903 - DNA, 19 bp, Homo sapiens
gacttaacggctccaggat

SEQ ID NO: 1588904 - DNA, 15 bp, Homo sapiens
gacttaagacaaatg

SEQ ID NO: 1588905 - DNA, 19 bp, Homo sapiens
gacttaagacaaatgggac

SEQ ID NO: 1588906 - DNA, 20 bp, Homo sapiens
gacttaagcaaaagaaaaag

SEQ ID NO: 1588907 - DNA, 14 bp, Homo sapiens
gacttaattctgat

SEQ ID NO: 1588908 - DNA, 15 bp, Homo sapiens
gacttactctaagat

SEQ ID NO: 1588909 - DNA, 13 bp, Homo sapiens
gacttagaaactg

SEQ ID NO: 1588910 - DNA, 13 bp, Homo sapiens
gagaccagggctc

SEQ ID NO: 1588911 - DNA, 20 bp, Homo sapiens
gagaccagttgggagcactg

SEQ ID NO: 1588912 - DNA, 17 bp, Homo sapiens
gagaccatcctggcccc

SEQ ID NO: 1588913 - DNA, 14 bp, Homo sapiens
gagacccaaggagg

SEQ ID NO: 1588914 - DNA, 22 bp, Homo sapiens
gagacccagatctcatggaaac

SEQ ID NO: 1588915 - DNA, 12 bp, Homo sapiens
gagacccccaca

SEQ ID NO: 1588916 - DNA, 13 bp, Homo sapiens
gagacccccacac

SEQ ID NO: 1588917 - DNA, 16 bp, Homo sapiens
gagacccccaggcctg

SEQ ID NO: 1588918 - DNA, 16 bp, Homo sapiens
gagacccccatccagc

SEQ ID NO: 1588919 - DNA, 22 bp, Homo sapiens
gagacccccatccagcctccag

SEQ ID NO: 1588920 - DNA, 19 bp, Homo sapiens
gagaccccgcacccggctc

SEQ ID NO: 1588921 - DNA, 19 bp, Homo sapiens
gagacccctcccctcccac

SEQ ID NO: 1588922 - DNA, 14 bp, Homo sapiens
gagacccgggaagg

SEQ ID NO: 1588923 - DNA, 17 bp, Homo sapiens
gagaccctacaggagag

SEQ ID NO: 1588924 - DNA, 20 bp, Homo sapiens
gagaccctactgaagtggct

SEQ ID NO: 1588925 - DNA, 17 bp, Homo sapiens
gagaccctcgcagacct

SEQ ID NO: 1588926 - DNA, 13 bp, Homo sapiens
gagaccctggaat

SEQ ID NO: 1588927 - DNA, 17 bp, Homo sapiens
gagaccgcttcacccct

SEQ ID NO: 1588928 - DNA, 19 bp, Homo sapiens
gagaccgcttcacccctgc

SEQ ID NO: 1588929 - DNA, 21 bp, Homo sapiens
gagaccgcttcacccctgcac

SEQ ID NO: 1588930 - DNA, 20 bp, Homo sapiens
gagaccgtcgggggctgagg

SEQ ID NO: 1588931 - DNA, 16 bp, Homo sapiens
gagacctatgtaagaa

SEQ ID NO: 1588932 - DNA, 13 bp, Homo sapiens
gagacctcagcca

SEQ ID NO: 1588933 - DNA, 14 bp, Homo sapiens
gagacctcagccat

SEQ ID NO: 1588934 - DNA, 15 bp, Homo sapiens
gagacctcagccatg

SEQ ID NO: 1588935 - DNA, 13 bp, Homo sapiens
gagacctcatcct

SEQ ID NO: 1588936 - DNA, 15 bp, Homo sapiens
gagacctgccctctc

SEQ ID NO: 1588937 - DNA, 16 bp, Homo sapiens
gagacctggaaccaga

SEQ ID NO: 1588938 - DNA, 12 bp, Homo sapiens
gagacctgtgct

SEQ ID NO: 1588939 - DNA, 13 bp, Homo sapiens
gagacctgtgtga

SEQ ID NO: 1588940 - DNA, 18 bp, Homo sapiens
gagacggtgttttgccat

SEQ ID NO: 1588941 - DNA, 17 bp, Homo sapiens
gagacggtttccaggga

SEQ ID NO: 1588942 - DNA, 22 bp, Homo sapiens
gagactatggagcctggcacag

SEQ ID NO: 1588943 - DNA, 19 bp, Homo sapiens
gagactcacctctgcctca

SEQ ID NO: 1588944 - DNA, 23 bp, Homo sapiens
gagactcacctctgcctcaatgt

SEQ ID NO: 1588945 - DNA, 21 bp, Homo sapiens
gagactcagggccccagcact

SEQ ID NO: 1588946 - DNA, 15 bp, Homo sapiens
gagactcagtgcaga

SEQ ID NO: 1588947 - DNA, 13 bp, Homo sapiens
gagactccaagga

SEQ ID NO: 1588948 - DNA, 19 bp, Homo sapiens
gagactccagaatctgctg

SEQ ID NO: 1588949 - DNA, 13 bp, Homo sapiens
gagactccatctt

SEQ ID NO: 1588950 - DNA, 15 bp, Homo sapiens
gagactcgagaactt

SEQ ID NO: 1588951 - DNA, 14 bp, Homo sapiens
gagactctgtctca

SEQ ID NO: 1588952 - DNA, 17 bp, Homo sapiens
gagactgaaagcagcag

SEQ ID NO: 1588953 - DNA, 18 bp, Homo sapiens
gagactgaaagcagcagc

SEQ ID NO: 1588954 - DNA, 19 bp, Homo sapiens
gagactgaaagcagcagct

SEQ ID NO: 1588955 - DNA, 19 bp, Homo sapiens
gagactgccatacataata

SEQ ID NO: 1588956 - DNA, 13 bp, Homo sapiens
gagactgccccac

SEQ ID NO: 1588957 - DNA, 14 bp, Homo sapiens
gagactgcttccca

SEQ ID NO: 1588958 - DNA, 22 bp, Homo sapiens
gagactgcttcccatcctaccc

SEQ ID NO: 1588959 - DNA, 17 bp, Homo sapiens
gagactgggctctggct

SEQ ID NO: 1588960 - DNA, 15 bp, Homo sapiens
gagactgggtaggaa

SEQ ID NO: 1588961 - DNA, 22 bp, Homo sapiens
gagactggtctcgaactcctgg

SEQ ID NO: 1588962 - DNA, 23 bp, Homo sapiens
gagactgtagattgcttctgtag

SEQ ID NO: 1588963 - DNA, 23 bp, Homo sapiens
gagactgtctcaagagggcactg

SEQ ID NO: 1588964 - DNA, 22 bp, Homo sapiens
gagactgtggtaggggcaggga

SEQ ID NO: 1588965 - DNA, 23 bp, Homo sapiens
gagactgtggtaggggcagggag

SEQ ID NO: 1588966 - DNA, 15 bp, Homo sapiens
gagacttaaaacatg

SEQ ID NO: 1588967 - DNA, 18 bp, Homo sapiens
gagacttagggcaccagg

SEQ ID NO: 1588968 - DNA, 11 bp, Homo sapiens
gagacttgttt

SEQ ID NO: 1588969 - DNA, 17 bp, Homo sapiens
gagactttcccctctcg

SEQ ID NO: 1588970 - DNA, 13 bp, Homo sapiens
gagactttctgaa

SEQ ID NO: 1588971 - DNA, 14 bp, Homo sapiens
gagactttctgaag

SEQ ID NO: 1588972 - DNA, 14 bp, Homo sapiens
gagactttgcccag

SEQ ID NO: 1588973 - DNA, 11 bp, Homo sapiens
gagagaaagaa

SEQ ID NO: 1588974 - DNA, 13 bp, Homo sapiens
gagagaaagagag

SEQ ID NO: 1588975 - DNA, 12 bp, Homo sapiens
gagagaagccag

SEQ ID NO: 1588976 - DNA, 14 bp, Homo sapiens
gagagaagccagcc

SEQ ID NO: 1588977 - DNA, 18 bp, Homo sapiens
gagagaatagagctgcca

SEQ ID NO: 1588978 - DNA, 19 bp, Homo sapiens
gagagaatagagctgccac

SEQ ID NO: 1588979 - DNA, 22 bp, Homo sapiens
gagagaatagagctgccactgg

SEQ ID NO: 1588980 - DNA, 22 bp, Homo sapiens
gagagaatgtgtgtgtgtggca

SEQ ID NO: 1588981 - DNA, 18 bp, Homo sapiens
gagagacacagcgtccct

SEQ ID NO: 1588982 - DNA, 20 bp, Homo sapiens
gagagacccaaggaggaaaa

SEQ ID NO: 1588983 - DNA, 19 bp, Homo sapiens
gagagaccccgcacccggc

SEQ ID NO: 1588984 - DNA, 15 bp, Homo sapiens
gagagacctgtgtga

SEQ ID NO: 1588985 - DNA, 16 bp, Homo sapiens
gagagactgaaagcag

SEQ ID NO: 1588986 - DNA, 17 bp, Homo sapiens
gagagactgaaagcagc

SEQ ID NO: 1588987 - DNA, 20 bp, Homo sapiens
gagagacttgttttggatgc

SEQ ID NO: 1588988 - DNA, 13 bp, Homo sapiens
gagagagaaaaaa

SEQ ID NO: 1588989 - DNA, 15 bp, Homo sapiens
gagagagaagcaggc

SEQ ID NO: 1588990 - DNA, 16 bp, Homo sapiens
gagagagaagcaggca

SEQ ID NO: 1588991 - DNA, 14 bp, Homo sapiens
gagagagagagagg

SEQ ID NO: 1588992 - DNA, 12 bp, Homo sapiens
gagagagaggac

SEQ ID NO: 1588993 - DNA, 14 bp, Homo sapiens
gagagagccaagac

SEQ ID NO: 1588994 - DNA, 12 bp, Homo sapiens
gagagaggggaa

SEQ ID NO: 1588995 - DNA, 14 bp, Homo sapiens
gagagagtttcaaa

SEQ ID NO: 1588996 - DNA, 15 bp, Homo sapiens
gagagcaagaaggaa

SEQ ID NO: 1588997 - DNA, 14 bp, Homo sapiens
gagagcaaggaagc

SEQ ID NO: 1588998 - DNA, 16 bp, Homo sapiens
gagagcagcaggtgct

SEQ ID NO: 1588999 - DNA, 20 bp, Homo sapiens
gagagcagcaggtgctgtgc

SEQ ID NO: 1589000 - DNA, 18 bp, Homo sapiens
gagagcagtgggcaggtg

SEQ ID NO: 1589001 - DNA, 15 bp, Homo sapiens
gagagcatctcagga

SEQ ID NO: 1589002 - DNA, 16 bp, Homo sapiens
gagagccaagacggag

SEQ ID NO: 1589003 - DNA, 12 bp, Homo sapiens
gagagccagccc

SEQ ID NO: 1589004 - DNA, 13 bp, Homo sapiens
gagagccagccct

SEQ ID NO: 1589005 - DNA, 14 bp, Homo sapiens
gagagccaggatgc

SEQ ID NO: 1589006 - DNA, 18 bp, Homo sapiens
gagagccaggatgcccag

SEQ ID NO: 1589007 - DNA, 13 bp, Homo sapiens
gagagcccagcca

SEQ ID NO: 1589008 - DNA, 13 bp, Homo sapiens
gagagccccagct

SEQ ID NO: 1589009 - DNA, 20 bp, Homo sapiens
gagagcccggcgcccctgcc

SEQ ID NO: 1589010 - DNA, 14 bp, Homo sapiens
gagagccctgctgt

SEQ ID NO: 1589011 - DNA, 19 bp, Homo sapiens
gagagccctgctgtgggag

SEQ ID NO: 1589012 - DNA, 17 bp, Homo sapiens
gagagccgtggtccctg

SEQ ID NO: 1589013 - DNA, 21 bp, Homo sapiens
gagagccgtggtccctgagga

SEQ ID NO: 1589014 - DNA, 14 bp, Homo sapiens
gagagcctcttagt

SEQ ID NO: 1589015 - DNA, 19 bp, Homo sapiens
gagagcctcttagtgattg

SEQ ID NO: 1589016 - DNA, 22 bp, Homo sapiens
gagagcctgctcccccaccccc

SEQ ID NO: 1589017 - DNA, 13 bp, Homo sapiens
gagagcctgctgc

SEQ ID NO: 1589018 - DNA, 15 bp, Homo sapiens
gagagcctgctggca

SEQ ID NO: 1589019 - DNA, 14 bp, Homo sapiens
gagagcgacacaga

SEQ ID NO: 1589020 - DNA, 15 bp, Homo sapiens
gagagcggctggaga

SEQ ID NO: 1589021 - DNA, 19 bp, Homo sapiens
gagagctgctgagggacct

SEQ ID NO: 1589022 - DNA, 17 bp, Homo sapiens
gagagcttggactacac

SEQ ID NO: 1589023 - DNA, 23 bp, Homo sapiens
gagagctttctgtccttttggca

SEQ ID NO: 1589024 - DNA, 18 bp, Homo sapiens
gagaggaaattctccact

SEQ ID NO: 1589025 - DNA, 18 bp, Homo sapiens
gagaggaccaacatccag

SEQ ID NO: 1589026 - DNA, 20 bp, Homo sapiens
gagaggactgtagggagggc

SEQ ID NO: 1589027 - DNA, 19 bp, Homo sapiens
gagaggagcacctgaaccc

SEQ ID NO: 1589028 - DNA, 12 bp, Homo sapiens
gagcaaggaagc

SEQ ID NO: 1589029 - DNA, 17 bp, Homo sapiens
gagcaaggccttctctc

SEQ ID NO: 1589030 - DNA, 15 bp, Homo sapiens
gagcaatgtctgtgc

SEQ ID NO: 1589031 - DNA, 23 bp, Homo sapiens
gagcaatgttggttttttataaa

SEQ ID NO: 1589032 - DNA, 14 bp, Homo sapiens
gagcaattccaggc

SEQ ID NO: 1589033 - DNA, 16 bp, Homo sapiens
gagcaattccaggctg

SEQ ID NO: 1589034 - DNA, 16 bp, Homo sapiens
gagcacaaaattcaaa

SEQ ID NO: 1589035 - DNA, 22 bp, Homo sapiens
gagcacaaaattcaaagcatgg

SEQ ID NO: 1589036 - DNA, 18 bp, Homo sapiens
gagcacacccgtgtgcac

SEQ ID NO: 1589037 - DNA, 20 bp, Homo sapiens
gagcacactttagtggccga

SEQ ID NO: 1589038 - DNA, 13 bp, Homo sapiens
gagcacagccctg

SEQ ID NO: 1589039 - DNA, 15 bp, Homo sapiens
gagcacagccctggg

SEQ ID NO: 1589040 - DNA, 13 bp, Homo sapiens
gagcacaggcagc

SEQ ID NO: 1589041 - DNA, 20 bp, Homo sapiens
gacttatttctgctctggaa

SEQ ID NO: 1589042 - DNA, 18 bp, Homo sapiens
gacttcacagcgtctgct

SEQ ID NO: 1589043 - DNA, 20 bp, Homo sapiens
gacttcacagcgtctgctca

SEQ ID NO: 1589044 - DNA, 17 bp, Homo sapiens
gacttcacataagctca

SEQ ID NO: 1589045 - DNA, 21 bp, Homo sapiens
gacttcacataagctcagaat

SEQ ID NO: 1589046 - DNA, 12 bp, Homo sapiens
gacttcactgta

SEQ ID NO: 1589047 - DNA, 16 bp, Homo sapiens
gacttcactgtatata

SEQ ID NO: 1589048 - DNA, 17 bp, Homo sapiens
gacttcactgtatataa

SEQ ID NO: 1589049 - DNA, 19 bp, Homo sapiens
gacttcactgtatataaac

SEQ ID NO: 1589050 - DNA, 22 bp, Homo sapiens
gacttcagggcagggctctgat

SEQ ID NO: 1589051 - DNA, 16 bp, Homo sapiens
gacttcagtcttgcct

SEQ ID NO: 1589052 - DNA, 14 bp, Homo sapiens
gacttccatctagt

SEQ ID NO: 1589053 - DNA, 13 bp, Homo sapiens
gacttcccagcta

SEQ ID NO: 1589054 - DNA, 13 bp, Homo sapiens
gacttcccagctt

SEQ ID NO: 1589055 - DNA, 15 bp, Homo sapiens
gacttcccctgggca

SEQ ID NO: 1589056 - DNA, 17 bp, Homo sapiens
gacttcccctgggcaag

SEQ ID NO: 1589057 - DNA, 22 bp, Homo sapiens
gacttccctggaggagaagtat

SEQ ID NO: 1589058 - DNA, 18 bp, Homo sapiens
gacttcctggggccccgc

SEQ ID NO: 1589059 - DNA, 18 bp, Homo sapiens
gacttcctgtccagctcc

SEQ ID NO: 1589060 - DNA, 21 bp, Homo sapiens
gacttcctgtccagctccaac

SEQ ID NO: 1589061 - DNA, 22 bp, Homo sapiens
gacttcctgtccagctccaacc

SEQ ID NO: 1589062 - DNA, 20 bp, Homo sapiens
gacttccttgagacacggag

SEQ ID NO: 1589063 - DNA, 18 bp, Homo sapiens
gacttcctttataatatt

SEQ ID NO: 1589064 - DNA, 23 bp, Homo sapiens
gacttctaagtaaaaccacagca

SEQ ID NO: 1589065 - DNA, 16 bp, Homo sapiens
gacttctgcctggaga

SEQ ID NO: 1589066 - DNA, 19 bp, Homo sapiens
gacttctggaaggctggct

SEQ ID NO: 1589067 - DNA, 22 bp, Homo sapiens
gacttcttggtttggggagaaa

SEQ ID NO: 1589068 - DNA, 13 bp, Homo sapiens
gacttgaaagaaa

SEQ ID NO: 1589069 - DNA, 20 bp, Homo sapiens
gacttgaagcacagagggct

SEQ ID NO: 1589070 - DNA, 22 bp, Homo sapiens
gacttgaatattcctggactta

SEQ ID NO: 1589071 - DNA, 13 bp, Homo sapiens
gacttgagccatc

SEQ ID NO: 1589072 - DNA, 16 bp, Homo sapiens
gacttgatgttccttc

SEQ ID NO: 1589073 - DNA, 16 bp, Homo sapiens
gacttgcactgaagcc

SEQ ID NO: 1589074 - DNA, 14 bp, Homo sapiens
gacttgctaaagca

SEQ ID NO: 1589075 - DNA, 14 bp, Homo sapiens
gacttgctgtccag

SEQ ID NO: 1589076 - DNA, 18 bp, Homo sapiens
gacttgctgtccaggcag

SEQ ID NO: 1589077 - DNA, 22 bp, Homo sapiens
gacttgctgtgtgaccctgggc

SEQ ID NO: 1589078 - DNA, 13 bp, Homo sapiens
gacttgcttcctg

SEQ ID NO: 1589079 - DNA, 14 bp, Homo sapiens
gacttgcttcctgc

SEQ ID NO: 1589080 - DNA, 20 bp, Homo sapiens
gacttggagactcctggtct

SEQ ID NO: 1589081 - DNA, 19 bp, Homo sapiens
gacttggatcccaaagcaa

SEQ ID NO: 1589082 - DNA, 20 bp, Homo sapiens
gacttggatcccaaagcaag

SEQ ID NO: 1589083 - DNA, 17 bp, Homo sapiens
gacttggatcccagggg

SEQ ID NO: 1589084 - DNA, 22 bp, Homo sapiens
gacttggcacttaagtgcactt

SEQ ID NO: 1589085 - DNA, 18 bp, Homo sapiens
gacttggcaggtgcctgt

SEQ ID NO: 1589086 - DNA, 15 bp, Homo sapiens
gacttggttggtagg

SEQ ID NO: 1589087 - DNA, 17 bp, Homo sapiens
gacttggttggtagggt

SEQ ID NO: 1589088 - DNA, 17 bp, Homo sapiens
gacttgtacaaacagta

SEQ ID NO: 1589089 - DNA, 22 bp, Homo sapiens
gacttgtacaaacagtatttct

SEQ ID NO: 1589090 - DNA, 16 bp, Homo sapiens
gacttgtatatttgta

SEQ ID NO: 1589091 - DNA, 15 bp, Homo sapiens
gacttgtgattggct

SEQ ID NO: 1589092 - DNA, 17 bp, Homo sapiens
gacttgtgattggctgc

SEQ ID NO: 1589093 - DNA, 13 bp, Homo sapiens
gacttgtgtccca

SEQ ID NO: 1589094 - DNA, 13 bp, Homo sapiens
gacttgtgtctct

SEQ ID NO: 1589095 - DNA, 20 bp, Homo sapiens
gacttgttttaattttagag

SEQ ID NO: 1589096 - DNA, 18 bp, Homo sapiens
gactttagaaataaatgt

SEQ ID NO: 1589097 - DNA, 19 bp, Homo sapiens
gactttataattccttctg

SEQ ID NO: 1589098 - DNA, 16 bp, Homo sapiens
gactttatttatttct

SEQ ID NO: 1589099 - DNA, 14 bp, Homo sapiens
gactttcaggtact

SEQ ID NO: 1589100 - DNA, 12 bp, Homo sapiens
gactttcctgca

SEQ ID NO: 1589101 - DNA, 23 bp, Homo sapiens
gactttccttagacccgccaggt

SEQ ID NO: 1589102 - DNA, 19 bp, Homo sapiens
gactttccttccctctcct

SEQ ID NO: 1589103 - DNA, 23 bp, Homo sapiens
gactttccttccctctcctgctt

SEQ ID NO: 1589104 - DNA, 12 bp, Homo sapiens
gactttctgaag

SEQ ID NO: 1589105 - DNA, 19 bp, Homo sapiens
gactttctgattactgtcc

SEQ ID NO: 1589106 - DNA, 12 bp, Homo sapiens
gactttctgcct

SEQ ID NO: 1589107 - DNA, 15 bp, Homo sapiens
gactttctgcctgga

SEQ ID NO: 1589108 - DNA, 18 bp, Homo sapiens
gactttctgcctggagtg

SEQ ID NO: 1589109 - DNA, 22 bp, Homo sapiens
gactttctgtgacgcagacaga

SEQ ID NO: 1589110 - DNA, 15 bp, Homo sapiens
gactttgcttagtat

SEQ ID NO: 1589111 - DNA, 18 bp, Homo sapiens
gactttggttctctccag

SEQ ID NO: 1589112 - DNA, 14 bp, Homo sapiens
gacttttcaagtat

SEQ ID NO: 1589113 - DNA, 19 bp, Homo sapiens
gacttttcaagtatttaag

SEQ ID NO: 1589114 - DNA, 14 bp, Homo sapiens
gacttttcagactg

SEQ ID NO: 1589115 - DNA, 19 bp, Homo sapiens
gacttttcgaccaattcaa

SEQ ID NO: 1589116 - DNA, 17 bp, Homo sapiens
gacttttcgttaacatt

SEQ ID NO: 1589117 - DNA, 12 bp, Homo sapiens
gacttttctgta

SEQ ID NO: 1589118 - DNA, 15 bp, Homo sapiens
gacttttgaaaaaaa

SEQ ID NO: 1589119 - DNA, 23 bp, Homo sapiens
gacttttgatagttctataagaa

SEQ ID NO: 1589120 - DNA, 15 bp, Homo sapiens
gacttttgctttaat

SEQ ID NO: 1589121 - DNA, 17 bp, Homo sapiens
gacttttgctttaattc

SEQ ID NO: 1589122 - DNA, 16 bp, Homo sapiens
gacttttgttaaattc

SEQ ID NO: 1589123 - DNA, 13 bp, Homo sapiens
gactttttataaa

SEQ ID NO: 1589124 - DNA, 20 bp, Homo sapiens
gacttttttttttcttttct

SEQ ID NO: 1589125 - DNA, 18 bp, Homo sapiens
gagaaaaaaaaccttgta

SEQ ID NO: 1589126 - DNA, 19 bp, Homo sapiens
gagaaaaaaaaccttgtaa

SEQ ID NO: 1589127 - DNA, 22 bp, Homo sapiens
gagaaaaaaaaccttgtaaaaa

SEQ ID NO: 1589128 - DNA, 13 bp, Homo sapiens
gagaaaaaaacaa

SEQ ID NO: 1589129 - DNA, 21 bp, Homo sapiens
gagaaaaaggctgaaaagaag

SEQ ID NO: 1589130 - DNA, 18 bp, Homo sapiens
gagaaaatcatcaagaag

SEQ ID NO: 1589131 - DNA, 15 bp, Homo sapiens
gagaaaatccaggtc

SEQ ID NO: 1589132 - DNA, 15 bp, Homo sapiens
gagaaaatgcctcaa

SEQ ID NO: 1589133 - DNA, 22 bp, Homo sapiens
gagaaaattggaactctactca

SEQ ID NO: 1589134 - DNA, 19 bp, Homo sapiens
gagaaacagagacaggccc

SEQ ID NO: 1589135 - DNA, 18 bp, Homo sapiens
gagaaacagttggtaact

SEQ ID NO: 1589136 - DNA, 19 bp, Homo sapiens
gagaaaccctaaaaagaga

SEQ ID NO: 1589137 - DNA, 15 bp, Homo sapiens
gagaaaccgggagaa

SEQ ID NO: 1589138 - DNA, 18 bp, Homo sapiens
gagaaactgctgcagatt

SEQ ID NO: 1589139 - DNA, 18 bp, Homo sapiens
gagaaacttaagcaaagg

SEQ ID NO: 1589140 - DNA, 22 bp, Homo sapiens
gagaaactttgagtacagatac

SEQ ID NO: 1589141 - DNA, 18 bp, Homo sapiens
gagaaagaagtaggcatg

SEQ ID NO: 1589142 - DNA, 15 bp, Homo sapiens
gagaaagaatttagt

SEQ ID NO: 1589143 - DNA, 13 bp, Homo sapiens
gagaaagagagaa

SEQ ID NO: 1589144 - DNA, 19 bp, Homo sapiens
gagaaagagagaagccagc

SEQ ID NO: 1589145 - DNA, 18 bp, Homo sapiens
gagaaagagctgcctgga

SEQ ID NO: 1589146 - DNA, 12 bp, Homo sapiens
gagaaaggacag

SEQ ID NO: 1589147 - DNA, 19 bp, Homo sapiens
gagaaagggattgctgagg

SEQ ID NO: 1589148 - DNA, 18 bp, Homo sapiens
gagaaaggggagcccact

SEQ ID NO: 1589149 - DNA, 17 bp, Homo sapiens
gagaaagtaggccgctg

SEQ ID NO: 1589150 - DNA, 18 bp, Homo sapiens
gagaaagtgtgagcaaac

SEQ ID NO: 1589151 - DNA, 13 bp, Homo sapiens
gagaaatagctga

SEQ ID NO: 1589152 - DNA, 14 bp, Homo sapiens
gagaaatattttaa

SEQ ID NO: 1589153 - DNA, 17 bp, Homo sapiens
gagaaatattttaattt

SEQ ID NO: 1589154 - DNA, 23 bp, Homo sapiens
gagcacatactacctagaagtaa

SEQ ID NO: 1589155 - DNA, 15 bp, Homo sapiens
gagcaccaggcacga

SEQ ID NO: 1589156 - DNA, 17 bp, Homo sapiens
gagcacccagagcaccc

SEQ ID NO: 1589157 - DNA, 14 bp, Homo sapiens
gagcaccccctgct

SEQ ID NO: 1589158 - DNA, 22 bp, Homo sapiens
gagcacctcacctcccgaagcc

SEQ ID NO: 1589159 - DNA, 16 bp, Homo sapiens
gagcacctcccagccc

SEQ ID NO: 1589160 - DNA, 23 bp, Homo sapiens
gagcacctgaaccccatgggctt

SEQ ID NO: 1589161 - DNA, 11 bp, Homo sapiens
gagcacctgtc

SEQ ID NO: 1589162 - DNA, 15 bp, Homo sapiens
gagcacgcctgccat

SEQ ID NO: 1589163 - DNA, 16 bp, Homo sapiens
gagcacgcctgccatc

SEQ ID NO: 1589164 - DNA, 14 bp, Homo sapiens
gagcactggagtgc

SEQ ID NO: 1589165 - DNA, 12 bp, Homo sapiens
gagcactggcca

SEQ ID NO: 1589166 - DNA, 14 bp, Homo sapiens
gagcactggccaga

SEQ ID NO: 1589167 - DNA, 23 bp, Homo sapiens
gagcactggggtgggggtggaat

SEQ ID NO: 1589168 - DNA, 17 bp, Homo sapiens
gagcactgggttgactt

SEQ ID NO: 1589169 - DNA, 14 bp, Homo sapiens
gagcacttagcagg

SEQ ID NO: 1589170 - DNA, 18 bp, Homo sapiens
gagcacttgcgtcctgca

SEQ ID NO: 1589171 - DNA, 23 bp, Homo sapiens
gagcagaaaacccttgggccaga

SEQ ID NO: 1589172 - DNA, 22 bp, Homo sapiens
gagcagaaatttatctttcaaa

SEQ ID NO: 1589173 - DNA, 12 bp, Homo sapiens
gagcagaacagg

SEQ ID NO: 1589174 - DNA, 17 bp, Homo sapiens
gagcagaagtggagctg

SEQ ID NO: 1589175 - DNA, 21 bp, Homo sapiens
gagcagaatgttgtacttgaa

SEQ ID NO: 1589176 - DNA, 22 bp, Homo sapiens
gagcagaccaccccgcctgccc

SEQ ID NO: 1589177 - DNA, 15 bp, Homo sapiens
gagcagagcaggcaa

SEQ ID NO: 1589178 - DNA, 13 bp, Homo sapiens
gagcagagctctc

SEQ ID NO: 1589179 - DNA, 14 bp, Homo sapiens
gagcagagggcagg

SEQ ID NO: 1589180 - DNA, 14 bp, Homo sapiens
gagcagaggtctcc

SEQ ID NO: 1589181 - DNA, 12 bp, Homo sapiens
gagcagcagcca

SEQ ID NO: 1589182 - DNA, 16 bp, Homo sapiens
gagcagcagccagcac

SEQ ID NO: 1589183 - DNA, 17 bp, Homo sapiens
gagcagcagccagcacc

SEQ ID NO: 1589184 - DNA, 11 bp, Homo sapiens
gagcagccaga

SEQ ID NO: 1589185 - DNA, 12 bp, Homo sapiens
gagcagccagag

SEQ ID NO: 1589186 - DNA, 14 bp, Homo sapiens
gagcagccagagct

SEQ ID NO: 1589187 - DNA, 18 bp, Homo sapiens
gagcagccagcacccacc

SEQ ID NO: 1589188 - DNA, 13 bp, Homo sapiens
gagcagcccaggg

SEQ ID NO: 1589189 - DNA, 14 bp, Homo sapiens
gagcagcccagggc

SEQ ID NO: 1589190 - DNA, 23 bp, Homo sapiens
gagcagcccccgggccgctggct

SEQ ID NO: 1589191 - DNA, 22 bp, Homo sapiens
gagcagcctctgccaggcctgt

SEQ ID NO: 1589192 - DNA, 13 bp, Homo sapiens
gagcagcctgatg

SEQ ID NO: 1589193 - DNA, 16 bp, Homo sapiens
gagcagcctgatggcc

SEQ ID NO: 1589194 - DNA, 21 bp, Homo sapiens
gagcagcggattgctctggag

SEQ ID NO: 1589195 - DNA, 20 bp, Homo sapiens
gagcaggagccccgccacag

SEQ ID NO: 1589196 - DNA, 14 bp, Homo sapiens
gagcaggagcccct

SEQ ID NO: 1589197 - DNA, 21 bp, Homo sapiens
gagcaggaggcccctggccca

SEQ ID NO: 1589198 - DNA, 19 bp, Homo sapiens
gagcaggcacatggaggag

SEQ ID NO: 1589199 - DNA, 15 bp, Homo sapiens
gagcaggcagggctg

SEQ ID NO: 1589200 - DNA, 16 bp, Homo sapiens
gagcaggcagggctgg

SEQ ID NO: 1589201 - DNA, 13 bp, Homo sapiens
gagcagggaaggc

SEQ ID NO: 1589202 - DNA, 21 bp, Homo sapiens
gagcagggccaaagcacagct

SEQ ID NO: 1589203 - DNA, 14 bp, Homo sapiens
gagcagggctgact

SEQ ID NO: 1589204 - DNA, 16 bp, Homo sapiens
gagcagggtcaagcct

SEQ ID NO: 1589205 - DNA, 17 bp, Homo sapiens
gagcagggtcaagcctc

SEQ ID NO: 1589206 - DNA, 17 bp, Homo sapiens
gagcagggtccacagct

SEQ ID NO: 1589207 - DNA, 21 bp, Homo sapiens
gagcaggttccccaagggccc

SEQ ID NO: 1589208 - DNA, 14 bp, Homo sapiens
gagcagtcacactg

SEQ ID NO: 1589209 - DNA, 16 bp, Homo sapiens
gagcagtcctgcctca

SEQ ID NO: 1589210 - DNA, 18 bp, Homo sapiens
gagcagtgggcaggtggc

SEQ ID NO: 1589211 - DNA, 18 bp, Homo sapiens
gagcagtgtcttccataa

SEQ ID NO: 1589212 - DNA, 17 bp, Homo sapiens
gagcagttttcccctgg

SEQ ID NO: 1589213 - DNA, 16 bp, Homo sapiens
gagcatcaatcttgtt

SEQ ID NO: 1589214 - DNA, 17 bp, Homo sapiens
gagcatcactagtgaca

SEQ ID NO: 1589215 - DNA, 14 bp, Homo sapiens
gagcatcagagggc

SEQ ID NO: 1589216 - DNA, 21 bp, Homo sapiens
gagcatcaggctaagaccctg

SEQ ID NO: 1589217 - DNA, 14 bp, Homo sapiens
gagcatcctggcag

SEQ ID NO: 1589218 - DNA, 15 bp, Homo sapiens
gagcatcgtgaccct

SEQ ID NO: 1589219 - DNA, 19 bp, Homo sapiens
gagcatcgtgacccttcag

SEQ ID NO: 1589220 - DNA, 20 bp, Homo sapiens
gagcatctcaggaggggcag

SEQ ID NO: 1589221 - DNA, 16 bp, Homo sapiens
gagcatgcacagctgc

SEQ ID NO: 1589222 - DNA, 18 bp, Homo sapiens
gagcatgcacagctgctt

SEQ ID NO: 1589223 - DNA, 14 bp, Homo sapiens
gagcatgcacatgc

SEQ ID NO: 1589224 - DNA, 20 bp, Homo sapiens
gagcatgggggctgccagcg

SEQ ID NO: 1589225 - DNA, 14 bp, Homo sapiens
gagcattagctggc

SEQ ID NO: 1589226 - DNA, 13 bp, Homo sapiens
gagcattggcccc

SEQ ID NO: 1589227 - DNA, 22 bp, Homo sapiens
gagcatttaatggcagctagtg

SEQ ID NO: 1589228 - DNA, 22 bp, Homo sapiens
gagccaaaatggttaatttttc

SEQ ID NO: 1589229 - DNA, 13 bp, Homo sapiens
gagccaacctgga

SEQ ID NO: 1589230 - DNA, 15 bp, Homo sapiens
gagccaacctggact

SEQ ID NO: 1589231 - DNA, 18 bp, Homo sapiens
gagccaagacggaggagg

SEQ ID NO: 1589232 - DNA, 22 bp, Homo sapiens
gagccaagacggaggaggggaa

SEQ ID NO: 1589233 - DNA, 14 bp, Homo sapiens
gagccaagtggtcc

SEQ ID NO: 1589234 - DNA, 16 bp, Homo sapiens
gagccaagtggtccag

SEQ ID NO: 1589235 - DNA, 15 bp, Homo sapiens
gagccaatgaacagc

SEQ ID NO: 1589236 - DNA, 18 bp, Homo sapiens
gagccaatgaacagctcc

SEQ ID NO: 1589237 - DNA, 13 bp, Homo sapiens
gagccacaagctg

SEQ ID NO: 1589238 - DNA, 23 bp, Homo sapiens
gagccacaagctgcactgtgaac

SEQ ID NO: 1589239 - DNA, 16 bp, Homo sapiens
gagccacagaccacct

SEQ ID NO: 1589240 - DNA, 19 bp, Homo sapiens
gagccacagaccacctgct

SEQ ID NO: 1589241 - DNA, 14 bp, Homo sapiens
gagccacagtggga

SEQ ID NO: 1589242 - DNA, 13 bp, Homo sapiens
gagccaccagttc

SEQ ID NO: 1589243 - DNA, 18 bp, Homo sapiens
gagccacctgcaagatgg

SEQ ID NO: 1589244 - DNA, 19 bp, Homo sapiens
gagccacctgcaagatgga

SEQ ID NO: 1589245 - DNA, 20 bp, Homo sapiens
gagccacctgcaagatggac

SEQ ID NO: 1589246 - DNA, 23 bp, Homo sapiens
gagccacctggatctatccctgc

SEQ ID NO: 1589247 - DNA, 17 bp, Homo sapiens
gagccactcctgtcccg

SEQ ID NO: 1589248 - DNA, 21 bp, Homo sapiens
gagccactctatgagttggac

SEQ ID NO: 1589249 - DNA, 17 bp, Homo sapiens
gagccactgagcctggc

SEQ ID NO: 1589250 - DNA, 14 bp, Homo sapiens
gagccacttctccc

SEQ ID NO: 1589251 - DNA, 19 bp, Homo sapiens
gagccacttctccccagaa

SEQ ID NO: 1589252 - DNA, 18 bp, Homo sapiens
gagccagatgcaggacag

SEQ ID NO: 1589253 - DNA, 15 bp, Homo sapiens
gagccatgaggagcg

SEQ ID NO: 1589254 - DNA, 20 bp, Homo sapiens
gagccatgaggagcgtggac

SEQ ID NO: 1589255 - DNA, 20 bp, Homo sapiens
gagccatgatttcccactgc

SEQ ID NO: 1589256 - DNA, 14 bp, Homo sapiens
gagccatgggcctg

SEQ ID NO: 1589257 - DNA, 16 bp, Homo sapiens
gagccatgggcctggg

SEQ ID NO: 1589258 - DNA, 17 bp, Homo sapiens
gagccatgggcctgggc

SEQ ID NO: 1589259 - DNA, 19 bp, Homo sapiens
gagccatgggcctgggcct

SEQ ID NO: 1589260 - DNA, 19 bp, Homo sapiens
gagcccactgcccaccccc

SEQ ID NO: 1589261 - DNA, 21 bp, Homo sapiens
gagcccactgcccaccccctc

SEQ ID NO: 1589262 - DNA, 23 bp, Homo sapiens
gagcccactgcccaccccctcaa

SEQ ID NO: 1589263 - DNA, 11 bp, Homo sapiens
gagcccactgt

SEQ ID NO: 1589264 - DNA, 17 bp, Homo sapiens
gagcccagaaaacctcc

SEQ ID NO: 1589265 - DNA, 22 bp, Homo sapiens
gagcccagaggagggcagcaga

SEQ ID NO: 1589266 - DNA, 17 bp, Homo sapiens
gagcccagcctgggagc

SEQ ID NO: 1589267 - DNA, 23 bp, Homo sapiens
gagcccagcctgggagcccagag

SEQ ID NO: 1589268 - DNA, 12 bp, Homo sapiens
gagcccagctct

SEQ ID NO: 1589269 - DNA, 24 bp, Homo sapiens
gagcccaggagctgagtcacctcc

SEQ ID NO: 1589270 - DNA, 19 bp, Homo sapiens
gagcccagtgaagcctctg

SEQ ID NO: 1589271 - DNA, 11 bp, Homo sapiens
gagccccaagt

SEQ ID NO: 1589272 - DNA, 20 bp, Homo sapiens
gagccccaccttgtctgcta

SEQ ID NO: 1589273 - DNA, 11 bp, Homo sapiens
gagccccagct

SEQ ID NO: 1589274 - DNA, 16 bp, Homo sapiens
gagccccagctaccct

SEQ ID NO: 1589275 - DNA, 13 bp, Homo sapiens
gagccccagctga

SEQ ID NO: 1589276 - DNA, 14 bp, Homo sapiens
gagccccagctgac

SEQ ID NO: 1589277 - DNA, 17 bp, Homo sapiens
gagccccagcttcctgt

SEQ ID NO: 1589278 - DNA, 14 bp, Homo sapiens
gagccccagtgctg

SEQ ID NO: 1589279 - DNA, 16 bp, Homo sapiens
gagccccagtgctgga

SEQ ID NO: 1589280 - DNA, 18 bp, Homo sapiens
gagccccagtgctggaag

SEQ ID NO: 1589281 - DNA, 14 bp, Homo sapiens
gagcccccagccct

SEQ ID NO: 1589282 - DNA, 18 bp, Homo sapiens
gagcccccagccctggga

SEQ ID NO: 1589283 - DNA, 18 bp, Homo sapiens
gagccccccatgcccctc

SEQ ID NO: 1589284 - DNA, 13 bp, Homo sapiens
gagcccccccaac

SEQ ID NO: 1589285 - DNA, 14 bp, Homo sapiens
gagccccctgcacc

SEQ ID NO: 1589286 - DNA, 21 bp, Homo sapiens
gagccccctgcacccacccct

SEQ ID NO: 1589287 - DNA, 22 bp, Homo sapiens
gagccccctgcacccacccctg

SEQ ID NO: 1589288 - DNA, 20 bp, Homo sapiens
gagcccctcctccagcccct

SEQ ID NO: 1589289 - DNA, 19 bp, Homo sapiens
gagcccctcctctgagcag

SEQ ID NO: 1589290 - DNA, 22 bp, Homo sapiens
gagcccctccttctcccctgcc

SEQ ID NO: 1589291 - DNA, 13 bp, Homo sapiens
gagcccctgaaag

SEQ ID NO: 1589292 - DNA, 14 bp, Homo sapiens
gagcccctggggaa

SEQ ID NO: 1589293 - DNA, 12 bp, Homo sapiens
gagcccctgggt

SEQ ID NO: 1589294 - DNA, 19 bp, Homo sapiens
gagcccctgggtgggtggt

SEQ ID NO: 1589295 - DNA, 20 bp, Homo sapiens
gagcccgcagggccatgcag

SEQ ID NO: 1589296 - DNA, 19 bp, Homo sapiens
gagcccgcttttgttcttc

SEQ ID NO: 1589297 - DNA, 17 bp, Homo sapiens
gagcccggcgcccctgc

SEQ ID NO: 1589298 - DNA, 15 bp, Homo sapiens
gagcccgggctgcct

SEQ ID NO: 1589299 - DNA, 20 bp, Homo sapiens
gagcccgtcgcgctggacag

SEQ ID NO: 1589300 - DNA, 20 bp, Homo sapiens
gagcccgtgcagtacaggca

SEQ ID NO: 1589301 - DNA, 17 bp, Homo sapiens
gagccctactccctgca

SEQ ID NO: 1589302 - DNA, 19 bp, Homo sapiens
gagccctactccctgcaga

SEQ ID NO: 1589303 - DNA, 14 bp, Homo sapiens
gagccctccaggcc

SEQ ID NO: 1589304 - DNA, 15 bp, Homo sapiens
gagccctccaggcct

SEQ ID NO: 1589305 - DNA, 17 bp, Homo sapiens
gagccctgaggcctaga

SEQ ID NO: 1589306 - DNA, 16 bp, Homo sapiens
gagccctggagagccc

SEQ ID NO: 1589307 - DNA, 23 bp, Homo sapiens
gagccctggcaggatgaccctgc

SEQ ID NO: 1589308 - DNA, 13 bp, Homo sapiens
gagccctgggcgg

SEQ ID NO: 1589309 - DNA, 20 bp, Homo sapiens
gagccctgtggccgccacct

SEQ ID NO: 1589310 - DNA, 22 bp, Homo sapiens
gagccctgtggccgccacctga

SEQ ID NO: 1589311 - DNA, 12 bp, Homo sapiens
gagcccttcact

SEQ ID NO: 1589312 - DNA, 18 bp, Homo sapiens
gagcccttcactgccatg

SEQ ID NO: 1589313 - DNA, 20 bp, Homo sapiens
gagcccttcactgccatgat

SEQ ID NO: 1589314 - DNA, 21 bp, Homo sapiens
gagcccttctatacccaccca

SEQ ID NO: 1589315 - DNA, 20 bp, Homo sapiens
gagccgagatcacgccactg

SEQ ID NO: 1589316 - DNA, 22 bp, Homo sapiens
gagccgagattgcgccactgca

SEQ ID NO: 1589317 - DNA, 14 bp, Homo sapiens
gagccgaggggaga

SEQ ID NO: 1589318 - DNA, 22 bp, Homo sapiens
gagccgcatcttctccatctgg

SEQ ID NO: 1589319 - DNA, 22 bp, Homo sapiens
gagccgcgggcgctcgctcagg

SEQ ID NO: 1589320 - DNA, 16 bp, Homo sapiens
gagccggccccaggct

SEQ ID NO: 1589321 - DNA, 14 bp, Homo sapiens
gagccggcggcctc

SEQ ID NO: 1589322 - DNA, 16 bp, Homo sapiens
gagccggcggcctctc

SEQ ID NO: 1589323 - DNA, 17 bp, Homo sapiens
gagccggcggcctctcg

SEQ ID NO: 1589324 - DNA, 18 bp, Homo sapiens
gagccggcggcctctcga

SEQ ID NO: 1589325 - DNA, 15 bp, Homo sapiens
gagccgggcccctgg

SEQ ID NO: 1589326 - DNA, 14 bp, Homo sapiens
gagccgggcctccc

SEQ ID NO: 1589327 - DNA, 15 bp, Homo sapiens
gagccgggcctccca

SEQ ID NO: 1589328 - DNA, 16 bp, Homo sapiens
gagccgggcctcccac

SEQ ID NO: 1589329 - DNA, 19 bp, Homo sapiens
gagccggtaactgtcctgt

SEQ ID NO: 1589330 - DNA, 16 bp, Homo sapiens
gagcctaccccctgaa

SEQ ID NO: 1589331 - DNA, 16 bp, Homo sapiens
gagcctagccacctcc

SEQ ID NO: 1589332 - DNA, 20 bp, Homo sapiens
gagcctagcggagcccagcc

SEQ ID NO: 1589333 - DNA, 14 bp, Homo sapiens
gagcctagctcctg

SEQ ID NO: 1589334 - DNA, 16 bp, Homo sapiens
gagcctagctcctgcc

SEQ ID NO: 1589335 - DNA, 18 bp, Homo sapiens
gagcctcatccgaggcag

SEQ ID NO: 1589336 - DNA, 19 bp, Homo sapiens
gagcctcatccgaggcagg

SEQ ID NO: 1589337 - DNA, 20 bp, Homo sapiens
gagcctcatccgaggcaggg

SEQ ID NO: 1589338 - DNA, 12 bp, Homo sapiens
gagcctcccacc

SEQ ID NO: 1589339 - DNA, 13 bp, Homo sapiens
gagcctcccacca

SEQ ID NO: 1589340 - DNA, 12 bp, Homo sapiens
gagcctccccca

SEQ ID NO: 1589341 - DNA, 22 bp, Homo sapiens
gagcctcctctctcaaactggg

SEQ ID NO: 1589342 - DNA, 20 bp, Homo sapiens
gagcctcggccctagcattg

SEQ ID NO: 1589343 - DNA, 17 bp, Homo sapiens
gagcctctgctccccag

SEQ ID NO: 1589344 - DNA, 13 bp, Homo sapiens
gagcctgcaggga

SEQ ID NO: 1589345 - DNA, 15 bp, Homo sapiens
gagcctgcagggtgg

SEQ ID NO: 1589346 - DNA, 13 bp, Homo sapiens
gagcgcaagatag

SEQ ID NO: 1589347 - DNA, 21 bp, Homo sapiens
gagcgccccgcccccacccct

SEQ ID NO: 1589348 - DNA, 19 bp, Homo sapiens
gagcgcctccatccaaggc

SEQ ID NO: 1589349 - DNA, 23 bp, Homo sapiens
gagcgcctccatccaaggccagg

SEQ ID NO: 1589350 - DNA, 15 bp, Homo sapiens
gagcgctcctgccgc

SEQ ID NO: 1589351 - DNA, 21 bp, Homo sapiens
gagcgctcctgccgcagagct

SEQ ID NO: 1589352 - DNA, 18 bp, Homo sapiens
gagcggactcacttgatg

SEQ ID NO: 1589353 - DNA, 20 bp, Homo sapiens
gagcggcgcagagccctcca

SEQ ID NO: 1589354 - DNA, 21 bp, Homo sapiens
gagcggcgcagagccctccag

SEQ ID NO: 1589355 - DNA, 14 bp, Homo sapiens
gagcggctggagaa

SEQ ID NO: 1589356 - DNA, 15 bp, Homo sapiens
gagcggctggagaaa

SEQ ID NO: 1589357 - DNA, 18 bp, Homo sapiens
gagcggggtcccctctgt

SEQ ID NO: 1589358 - DNA, 13 bp, Homo sapiens
gagcggtggggga

SEQ ID NO: 1589359 - DNA, 17 bp, Homo sapiens
gagcgtaaatgggtcat

SEQ ID NO: 1589360 - DNA, 12 bp, Homo sapiens
gagcgtggactc

SEQ ID NO: 1589361 - DNA, 19 bp, Homo sapiens
gagctaaattacaattgtc

SEQ ID NO: 1589362 - DNA, 19 bp, Homo sapiens
gagctaaccccaagctgcc

SEQ ID NO: 1589363 - DNA, 23 bp, Homo sapiens
gagctaaccccaagctgcctctg

SEQ ID NO: 1589364 - DNA, 11 bp, Homo sapiens
gagctaaggct

SEQ ID NO: 1589365 - DNA, 14 bp, Homo sapiens
gagctaaggctcta

SEQ ID NO: 1589366 - DNA, 15 bp, Homo sapiens
gagctaagttctaag

SEQ ID NO: 1589367 - DNA, 18 bp, Homo sapiens
gagctactgatgaaatct

SEQ ID NO: 1589368 - DNA, 12 bp, Homo sapiens
gagctagaggcc

SEQ ID NO: 1589369 - DNA, 14 bp, Homo sapiens
gagctagctgccac

SEQ ID NO: 1589370 - DNA, 18 bp, Homo sapiens
gagctcaccctgcccgct

SEQ ID NO: 1589371 - DNA, 22 bp, Homo sapiens
gagctcaccctgcccgctccca

SEQ ID NO: 1589372 - DNA, 21 bp, Homo sapiens
gagctcagacattttcttttt

SEQ ID NO: 1589373 - DNA, 23 bp, Homo sapiens
gagctcaggagtttgagaccagg

SEQ ID NO: 1589374 - DNA, 15 bp, Homo sapiens
gagctcaggatggct

SEQ ID NO: 1589375 - DNA, 18 bp, Homo sapiens
gagctcaggatggctcag

SEQ ID NO: 1589376 - DNA, 12 bp, Homo sapiens
gagctcattctg

SEQ ID NO: 1589377 - DNA, 23 bp, Homo sapiens
gagctccacctctggtggctcct

SEQ ID NO: 1589378 - DNA, 12 bp, Homo sapiens
gagctccactct

SEQ ID NO: 1589379 - DNA, 16 bp, Homo sapiens
gagctccactctgctt

SEQ ID NO: 1589380 - DNA, 18 bp, Homo sapiens
gagctccactctgcttct

SEQ ID NO: 1589381 - DNA, 23 bp, Homo sapiens
gagctcccacctcccttcccacc

SEQ ID NO: 1589382 - DNA, 21 bp, Homo sapiens
gagctcccctccacagctgca

SEQ ID NO: 1589383 - DNA, 17 bp, Homo sapiens
gagctcctccgcagaag

SEQ ID NO: 1589384 - DNA, 13 bp, Homo sapiens
gagctcctcttcc

SEQ ID NO: 1589385 - DNA, 23 bp, Homo sapiens
gagctcctgctgcggaggagctg

SEQ ID NO: 1589386 - DNA, 19 bp, Homo sapiens
gagctcggggggctctgcc

SEQ ID NO: 1589387 - DNA, 15 bp, Homo sapiens
gagctcggtggaccc

SEQ ID NO: 1589388 - DNA, 19 bp, Homo sapiens
gagctcgtgtatcctgggg

SEQ ID NO: 1589389 - DNA, 21 bp, Homo sapiens
gagctcgtgtatcctggggct

SEQ ID NO: 1589390 - DNA, 21 bp, Homo sapiens
gagctctcaaatccctctcca

SEQ ID NO: 1589391 - DNA, 23 bp, Homo sapiens
gagctctcaaatccctctccaac

SEQ ID NO: 1589392 - DNA, 12 bp, Homo sapiens
gagctctccagg

SEQ ID NO: 1589393 - DNA, 14 bp, Homo sapiens
gagctctccaggcc

SEQ ID NO: 1589394 - DNA, 19 bp, Homo sapiens
gagctctccaggccaggtg

SEQ ID NO: 1589395 - DNA, 15 bp, Homo sapiens
gagctctcccccttg

SEQ ID NO: 1589396 - DNA, 21 bp, Homo sapiens
gagctctcccctcctgctggg

SEQ ID NO: 1589397 - DNA, 15 bp, Homo sapiens
gagctctctgccctt

SEQ ID NO: 1589398 - DNA, 17 bp, Homo sapiens
gagctctctgcccttga

SEQ ID NO: 1589399 - DNA, 23 bp, Homo sapiens
gagctctgcgccaggcagagctg

SEQ ID NO: 1589400 - DNA, 20 bp, Homo sapiens
gagctctggccccgctagcg

SEQ ID NO: 1589401 - DNA, 18 bp, Homo sapiens
gagctctggggacagctt

SEQ ID NO: 1589402 - DNA, 20 bp, Homo sapiens
gagctctggggacagcttcc

SEQ ID NO: 1589403 - DNA, 13 bp, Homo sapiens
gagctctggtgct

SEQ ID NO: 1589404 - DNA, 20 bp, Homo sapiens
gagctctgtgggtctctgga

SEQ ID NO: 1589405 - DNA, 21 bp, Homo sapiens
gagctcttcaagctgtcccct

SEQ ID NO: 1589406 - DNA, 22 bp, Homo sapiens
gagctcttcaggcctccctctc

SEQ ID NO: 1589407 - DNA, 22 bp, Homo sapiens
gagctcttcccttattcctaat

SEQ ID NO: 1589408 - DNA, 17 bp, Homo sapiens
gagctcttggaagagct

SEQ ID NO: 1589409 - DNA, 21 bp, Homo sapiens
gagctcttgggtcagagaaaa

SEQ ID NO: 1589410 - DNA, 20 bp, Homo sapiens
gagctgaaaaatcacatcct

SEQ ID NO: 1589411 - DNA, 18 bp, Homo sapiens
gagctgaaagggagcccc

SEQ ID NO: 1589412 - DNA, 19 bp, Homo sapiens
gagctgaaagggagcccct

SEQ ID NO: 1589413 - DNA, 21 bp, Homo sapiens
gagctgagatcgtgctactgc

SEQ ID NO: 1589414 - DNA, 14 bp, Homo sapiens
gagctgagggccct

SEQ ID NO: 1589415 - DNA, 17 bp, Homo sapiens
gagctgagggccctgtg

SEQ ID NO: 1589416 - DNA, 15 bp, Homo sapiens
gagctgagtcacctc

SEQ ID NO: 1589417 - DNA, 15 bp, Homo sapiens
gagctgatttccagg

SEQ ID NO: 1589418 - DNA, 17 bp, Homo sapiens
gagctgatttccaggcc

SEQ ID NO: 1589419 - DNA, 16 bp, Homo sapiens
gagctgccacagagaa

SEQ ID NO: 1589420 - DNA, 11 bp, Homo sapiens
gagctgccact

SEQ ID NO: 1589421 - DNA, 12 bp, Homo sapiens
gagctgccactg

SEQ ID NO: 1589422 - DNA, 13 bp, Homo sapiens
gagctgccactgg

SEQ ID NO: 1589423 - DNA, 17 bp, Homo sapiens
gagctgccactgggcac

SEQ ID NO: 1589424 - DNA, 11 bp, Homo sapiens
gagctgcctgc

SEQ ID NO: 1589425 - DNA, 20 bp, Homo sapiens
gagctgcctgcagcacatgc

SEQ ID NO: 1589426 - DNA, 19 bp, Homo sapiens
gagctgccttccctagctt

SEQ ID NO: 1589427 - DNA, 15 bp, Homo sapiens
gagctgcgccggaca

SEQ ID NO: 1589428 - DNA, 14 bp, Homo sapiens
gagctgctgaggga

SEQ ID NO: 1589429 - DNA, 16 bp, Homo sapiens
gagctgctggcttgca

SEQ ID NO: 1589430 - DNA, 21 bp, Homo sapiens
gagctgctggcttgcagtgcg

SEQ ID NO: 1589431 - DNA, 22 bp, Homo sapiens
gagcttaatgctacatgtgagt

SEQ ID NO: 1589432 - DNA, 16 bp, Homo sapiens
gagcttacccaagctg

SEQ ID NO: 1589433 - DNA, 12 bp, Homo sapiens
gagcttagaaac

SEQ ID NO: 1589434 - DNA, 14 bp, Homo sapiens
gagcttagccttgt

SEQ ID NO: 1589435 - DNA, 21 bp, Homo sapiens
gagcttagccttgtgccctgc

SEQ ID NO: 1589436 - DNA, 16 bp, Homo sapiens
gagcttattggccact

SEQ ID NO: 1589437 - DNA, 17 bp, Homo sapiens
gagcttattggccactg

SEQ ID NO: 1589438 - DNA, 20 bp, Homo sapiens
gagcttcaatataagaagca

SEQ ID NO: 1589439 - DNA, 12 bp, Homo sapiens
gagcttccaaat

SEQ ID NO: 1589440 - DNA, 21 bp, Homo sapiens
gagcttccgctttgaaagaag

SEQ ID NO: 1589441 - DNA, 23 bp, Homo sapiens
gagcttctcccagtgtgagaccc

SEQ ID NO: 1589442 - DNA, 10 bp, Homo sapiens
gagcttctct

SEQ ID NO: 1589443 - DNA, 19 bp, Homo sapiens
gagcttctctgggctgaat

SEQ ID NO: 1589444 - DNA, 16 bp, Homo sapiens
gagcttctctgtgaac

SEQ ID NO: 1589445 - DNA, 15 bp, Homo sapiens
gagcttgattaaatc

SEQ ID NO: 1589446 - DNA, 21 bp, Homo sapiens
gagcttgcaagaagcaggaag

SEQ ID NO: 1589447 - DNA, 23 bp, Homo sapiens
gagcttgcacagccaacgagaca

SEQ ID NO: 1589448 - DNA, 15 bp, Homo sapiens
gagcttgctccagat

SEQ ID NO: 1589449 - DNA, 20 bp, Homo sapiens
gagcttgggggatgactaga

SEQ ID NO: 1589450 - DNA, 14 bp, Homo sapiens
gagcttgtgtcctg

SEQ ID NO: 1589451 - DNA, 18 bp, Homo sapiens
gagctttccatgttgctg

SEQ ID NO: 1589452 - DNA, 19 bp, Homo sapiens
gagctttccatgttgctgc

SEQ ID NO: 1589453 - DNA, 17 bp, Homo sapiens
gagctttccttctccag

SEQ ID NO: 1589454 - DNA, 14 bp, Homo sapiens
gagctttctcaatg

SEQ ID NO: 1589455 - DNA, 18 bp, Homo sapiens
gagctttctcaatgtctt

SEQ ID NO: 1589456 - DNA, 21 bp, Homo sapiens
gagctttctgtccttttggca

SEQ ID NO: 1589457 - DNA, 14 bp, Homo sapiens
gagctttgggtgac

SEQ ID NO: 1589458 - DNA, 13 bp, Homo sapiens
gagctttgtgctt

SEQ ID NO: 1589459 - DNA, 22 bp, Homo sapiens
gagctttgttttatatatttat

SEQ ID NO: 1589460 - DNA, 16 bp, Homo sapiens
gagcttttaaaaatgt

SEQ ID NO: 1589461 - DNA, 17 bp, Homo sapiens
gagcttttaaaaatgtt

SEQ ID NO: 1589462 - DNA, 17 bp, Homo sapiens
gagcttttgcccacaca

SEQ ID NO: 1589463 - DNA, 19 bp, Homo sapiens
gagctttttaatagcacta

SEQ ID NO: 1589464 - DNA, 13 bp, Homo sapiens
gaggaaaaaagaa

SEQ ID NO: 1589465 - DNA, 23 bp, Homo sapiens
gaggaaaaaagaaccaaaacttc

SEQ ID NO: 1589466 - DNA, 20 bp, Homo sapiens
gaggaaaaaatggtataaaa

SEQ ID NO: 1589467 - DNA, 20 bp, Homo sapiens
gaggaaaaatgggagccagg

SEQ ID NO: 1589468 - DNA, 15 bp, Homo sapiens
gaggaaaaggaaaaa

SEQ ID NO: 1589469 - DNA, 12 bp, Homo sapiens
gaggaaaatatt

SEQ ID NO: 1589470 - DNA, 12 bp, Homo sapiens
gaggaaaattct

SEQ ID NO: 1589471 - DNA, 14 bp, Homo sapiens
gaggaaaggatttt

SEQ ID NO: 1589472 - DNA, 21 bp, Homo sapiens
gaggaaagggaggagtggagg

SEQ ID NO: 1589473 - DNA, 22 bp, Homo sapiens
gaggaaccaggagaagggctgg

SEQ ID NO: 1589474 - DNA, 17 bp, Homo sapiens
gaggaactcgcctcagc

SEQ ID NO: 1589475 - DNA, 19 bp, Homo sapiens
gaggaagaacggggctctt

SEQ ID NO: 1589476 - DNA, 19 bp, Homo sapiens
gaggaagagcaggcacatg

SEQ ID NO: 1589477 - DNA, 18 bp, Homo sapiens
gaggaagagccacctgca

SEQ ID NO: 1589478 - DNA, 21 bp, Homo sapiens
gaggaagagccacctgcaaga

SEQ ID NO: 1589479 - DNA, 23 bp, Homo sapiens
gaggaagagccacctgcaagatg

SEQ ID NO: 1589480 - DNA, 15 bp, Homo sapiens
gaggaagcaagacgt

SEQ ID NO: 1589481 - DNA, 20 bp, Homo sapiens
gaggaagcccaggctcggag

SEQ ID NO: 1589482 - DNA, 19 bp, Homo sapiens
gaggaaggaacagcaatgg

SEQ ID NO: 1589483 - DNA, 21 bp, Homo sapiens
gaggaaggcaagagggggtgg

SEQ ID NO: 1589484 - DNA, 18 bp, Homo sapiens
gaggaaggcctttcttct

SEQ ID NO: 1589485 - DNA, 20 bp, Homo sapiens
gaggaaggcctttcttctgt

SEQ ID NO: 1589486 - DNA, 12 bp, Homo sapiens
gaggaaggctga

SEQ ID NO: 1589487 - DNA, 15 bp, Homo sapiens
gaggaaggtgctgag

SEQ ID NO: 1589488 - DNA, 13 bp, Homo sapiens
gaggaagttctcc

SEQ ID NO: 1589489 - DNA, 22 bp, Homo sapiens
gaggaataagaatggagcagta

SEQ ID NO: 1589490 - DNA, 22 bp, Homo sapiens
gaggaatctgtgggtctgggag

SEQ ID NO: 1589491 - DNA, 18 bp, Homo sapiens
gaggaatgctggactgga

SEQ ID NO: 1589492 - DNA, 21 bp, Homo sapiens
gaggaatgtagggcctgcatg

SEQ ID NO: 1589493 - DNA, 14 bp, Homo sapiens
gaggacacagcaca

SEQ ID NO: 1589494 - DNA, 15 bp, Homo sapiens
gaggacacagcacaa

SEQ ID NO: 1589495 - DNA, 16 bp, Homo sapiens
gaggacacagcacaag

SEQ ID NO: 1589496 - DNA, 18 bp, Homo sapiens
gaggacagcttgagccgg

SEQ ID NO: 1589497 - DNA, 14 bp, Homo sapiens
gaggacaggcggga

SEQ ID NO: 1589498 - DNA, 20 bp, Homo sapiens
gaggacaggcgggaggaggt

SEQ ID NO: 1589499 - DNA, 18 bp, Homo sapiens
gaggaccacagtgggtgg

SEQ ID NO: 1589500 - DNA, 14 bp, Homo sapiens
gaggaccaccagca

SEQ ID NO: 1589501 - DNA, 13 bp, Homo sapiens
gaggaccagggcc

SEQ ID NO: 1589502 - DNA, 20 bp, Homo sapiens
gaggacccaggaaaggcagg

SEQ ID NO: 1589503 - DNA, 23 bp, Homo sapiens
gaggacccgggaccacagctgct

SEQ ID NO: 1589504 - DNA, 14 bp, Homo sapiens
gaggacctccctgt

SEQ ID NO: 1589505 - DNA, 13 bp, Homo sapiens
gaggactgagact

SEQ ID NO: 1589506 - DNA, 14 bp, Homo sapiens
gaggacttgtgtct

SEQ ID NO: 1589507 - DNA, 20 bp, Homo sapiens
gaggagaagtattcctgttg

SEQ ID NO: 1589508 - DNA, 15 bp, Homo sapiens
gaggagacattggct

SEQ ID NO: 1589509 - DNA, 15 bp, Homo sapiens
gaggagaccagctca

SEQ ID NO: 1589510 - DNA, 13 bp, Homo sapiens
gaggagagacggt

SEQ ID NO: 1589511 - DNA, 15 bp, Homo sapiens
gaggagagagacccc

SEQ ID NO: 1589512 - DNA, 17 bp, Homo sapiens
gaggagagagaccccgc

SEQ ID NO: 1589513 - DNA, 15 bp, Homo sapiens
gccgaggcctggcca

SEQ ID NO: 1589514 - DNA, 23 bp, Homo sapiens
gccgaggcctggccaatgcggcc

SEQ ID NO: 1589515 - DNA, 17 bp, Homo sapiens
gccgagggcgtcagaga

SEQ ID NO: 1589516 - DNA, 18 bp, Homo sapiens
gccgagggcgtcagagag

SEQ ID NO: 1589517 - DNA, 15 bp, Homo sapiens
gccgaggggagagag

SEQ ID NO: 1589518 - DNA, 18 bp, Homo sapiens
gccgagggtcctggctcc

SEQ ID NO: 1589519 - DNA, 14 bp, Homo sapiens
gccgagtggctgcc

SEQ ID NO: 1589520 - DNA, 22 bp, Homo sapiens
gccgatagagggacggccaaga

SEQ ID NO: 1589521 - DNA, 13 bp, Homo sapiens
gccgatgccaccg

SEQ ID NO: 1589522 - DNA, 13 bp, Homo sapiens
gccgatggaaaat

SEQ ID NO: 1589523 - DNA, 15 bp, Homo sapiens
gccgcaagctctcag

SEQ ID NO: 1589524 - DNA, 12 bp, Homo sapiens
gccgcaccagcc

SEQ ID NO: 1589525 - DNA, 18 bp, Homo sapiens
gccgcaccatttctgtca

SEQ ID NO: 1589526 - DNA, 15 bp, Homo sapiens
gccgcaccccagagt

SEQ ID NO: 1589527 - DNA, 16 bp, Homo sapiens
gccgcaccccagagtg

SEQ ID NO: 1589528 - DNA, 21 bp, Homo sapiens
gccgcacctaaagcagccagc

SEQ ID NO: 1589529 - DNA, 14 bp, Homo sapiens
gccgcacgcctctc

SEQ ID NO: 1589530 - DNA, 15 bp, Homo sapiens
gccgcacgcctctcc

SEQ ID NO: 1589531 - DNA, 21 bp, Homo sapiens
gccgcagacgggcacagacac

SEQ ID NO: 1589532 - DNA, 23 bp, Homo sapiens
gccgcagacgggcacagacacgc

SEQ ID NO: 1589533 - DNA, 13 bp, Homo sapiens
gccgcagctcttg

SEQ ID NO: 1589534 - DNA, 18 bp, Homo sapiens
gccgcatcttctccatct

SEQ ID NO: 1589535 - DNA, 17 bp, Homo sapiens
gccgccactaggtgtcc

SEQ ID NO: 1589536 - DNA, 19 bp, Homo sapiens
gccgccagcgtgtggagca

SEQ ID NO: 1589537 - DNA, 17 bp, Homo sapiens
gccgccagctgccgcac

SEQ ID NO: 1589538 - DNA, 15 bp, Homo sapiens
gccgccagctgggag

SEQ ID NO: 1589539 - DNA, 14 bp, Homo sapiens
gccgccaggactgt

SEQ ID NO: 1589540 - DNA, 17 bp, Homo sapiens
gccgccattgccaccag

SEQ ID NO: 1589541 - DNA, 18 bp, Homo sapiens
gccgccattgccaccagg

SEQ ID NO: 1589542 - DNA, 21 bp, Homo sapiens
gccgccattgccaccaggaga

SEQ ID NO: 1589543 - DNA, 17 bp, Homo sapiens
gccgcccccgcctgggc

SEQ ID NO: 1589544 - DNA, 18 bp, Homo sapiens
gccgcccgggcccagagg

SEQ ID NO: 1589545 - DNA, 13 bp, Homo sapiens
gccgccctgagag

SEQ ID NO: 1589546 - DNA, 17 bp, Homo sapiens
gccgccctgtaccctct

SEQ ID NO: 1589547 - DNA, 15 bp, Homo sapiens
gccgccgccaggact

SEQ ID NO: 1589548 - DNA, 15 bp, Homo sapiens
gccgccgccgccgcc

SEQ ID NO: 1589549 - DNA, 18 bp, Homo sapiens
gccgccgttgagggctga

SEQ ID NO: 1589550 - DNA, 19 bp, Homo sapiens
gccgcctgcactcctcagg

SEQ ID NO: 1589551 - DNA, 22 bp, Homo sapiens
gccgcctgcactcctcagggca

SEQ ID NO: 1589552 - DNA, 14 bp, Homo sapiens
gccgcctgctcctc

SEQ ID NO: 1589553 - DNA, 13 bp, Homo sapiens
gccgcgagaggcc

SEQ ID NO: 1589554 - DNA, 14 bp, Homo sapiens
gccgcgccagtccc

SEQ ID NO: 1589555 - DNA, 22 bp, Homo sapiens
gccgcgccagtccccgctagtg

SEQ ID NO: 1589556 - DNA, 14 bp, Homo sapiens
gccgcgcccagcag

SEQ ID NO: 1589557 - DNA, 13 bp, Homo sapiens
gccgcgccgccgc

SEQ ID NO: 1589558 - DNA, 15 bp, Homo sapiens
gccgcgcctggctta

SEQ ID NO: 1589559 - DNA, 16 bp, Homo sapiens
gccgcgcgcccctgcc

SEQ ID NO: 1589560 - DNA, 21 bp, Homo sapiens
gccgcggccgcccgcacgtcc

SEQ ID NO: 1589561 - DNA, 15 bp, Homo sapiens
gccgcgggacagcca

SEQ ID NO: 1589562 - DNA, 16 bp, Homo sapiens
gccgcgtggtgccatc

SEQ ID NO: 1589563 - DNA, 20 bp, Homo sapiens
gccgcgtggtgccatcccca

SEQ ID NO: 1589564 - DNA, 11 bp, Homo sapiens
gccgctacctc

SEQ ID NO: 1589565 - DNA, 15 bp, Homo sapiens
gccgctacctccctc

SEQ ID NO: 1589566 - DNA, 17 bp, Homo sapiens
gccgctacctccctccc

SEQ ID NO: 1589567 - DNA, 16 bp, Homo sapiens
gccgctagaggcctga

SEQ ID NO: 1589568 - DNA, 17 bp, Homo sapiens
gccgctagaggcctgag

SEQ ID NO: 1589569 - DNA, 13 bp, Homo sapiens
gccgctaggagag

SEQ ID NO: 1589570 - DNA, 17 bp, Homo sapiens
gccgctaggagagactg

SEQ ID NO: 1589571 - DNA, 19 bp, Homo sapiens
gccgctcctgtctgccagc

SEQ ID NO: 1589572 - DNA, 22 bp, Homo sapiens
gccgctcctgtctgccagccag

SEQ ID NO: 1589573 - DNA, 22 bp, Homo sapiens
gccgctgaccctgggcctggag

SEQ ID NO: 1589574 - DNA, 16 bp, Homo sapiens
gccgctgagtggcagg

SEQ ID NO: 1589575 - DNA, 14 bp, Homo sapiens
gccgctgcccgctc

SEQ ID NO: 1589576 - DNA, 23 bp, Homo sapiens
gccgctgcccttgggtccccccg

SEQ ID NO: 1589577 - DNA, 17 bp, Homo sapiens
gccgctggctggtgggc

SEQ ID NO: 1589578 - DNA, 14 bp, Homo sapiens
gccgctgtctctga

SEQ ID NO: 1589579 - DNA, 21 bp, Homo sapiens
gccgctgtctctgaggggtgg

SEQ ID NO: 1589580 - DNA, 15 bp, Homo sapiens
gccgctgttcaccca

SEQ ID NO: 1589581 - DNA, 16 bp, Homo sapiens
gccgctgttcacccac

SEQ ID NO: 1589582 - DNA, 22 bp, Homo sapiens
gccggacagctgcccagacaca

SEQ ID NO: 1589583 - DNA, 16 bp, Homo sapiens
gccggatgtgcttttc

SEQ ID NO: 1589584 - DNA, 21 bp, Homo sapiens
gccggcacctacatccccagg

SEQ ID NO: 1589585 - DNA, 13 bp, Homo sapiens
gccggcatctccc

SEQ ID NO: 1589586 - DNA, 18 bp, Homo sapiens
gccggcatctcccctagc

SEQ ID NO: 1589587 - DNA, 12 bp, Homo sapiens
gccggccccagg

SEQ ID NO: 1589588 - DNA, 14 bp, Homo sapiens
gccggccccaggct

SEQ ID NO: 1589589 - DNA, 15 bp, Homo sapiens
gccggccctggcttg

SEQ ID NO: 1589590 - DNA, 13 bp, Homo sapiens
gccggccctgtgt

SEQ ID NO: 1589591 - DNA, 22 bp, Homo sapiens
gccggctatgaaagggagcgag

SEQ ID NO: 1589592 - DNA, 16 bp, Homo sapiens
gccggctgagtggcag

SEQ ID NO: 1589593 - DNA, 22 bp, Homo sapiens
gccggctgagtggcagcagccc

SEQ ID NO: 1589594 - DNA, 16 bp, Homo sapiens
gcctccgaggctcccc

SEQ ID NO: 1589595 - DNA, 17 bp, Homo sapiens
gcctccgaggctccccg

SEQ ID NO: 1589596 - DNA, 18 bp, Homo sapiens
gcctccgaggctccccgc

SEQ ID NO: 1589597 - DNA, 21 bp, Homo sapiens
gcctccgagggacgcggctcc

SEQ ID NO: 1589598 - DNA, 17 bp, Homo sapiens
gcctccgcagtgtctcc

SEQ ID NO: 1589599 - DNA, 16 bp, Homo sapiens
gcctccgctgggcttc

SEQ ID NO: 1589600 - DNA, 18 bp, Homo sapiens
gcctccgctgggcttcat

SEQ ID NO: 1589601 - DNA, 14 bp, Homo sapiens
gcctccggaagctg

SEQ ID NO: 1589602 - DNA, 14 bp, Homo sapiens
gcctccggcgtctt

SEQ ID NO: 1589603 - DNA, 22 bp, Homo sapiens
gcctccggcgtcttgcccagca

SEQ ID NO: 1589604 - DNA, 20 bp, Homo sapiens
gcctccgtttatgggccttg

SEQ ID NO: 1589605 - DNA, 14 bp, Homo sapiens
gcctcctcaccccc

SEQ ID NO: 1589606 - DNA, 17 bp, Homo sapiens
gcctcctcacccccagc

SEQ ID NO: 1589607 - DNA, 15 bp, Homo sapiens
gcctcctcctgacca

SEQ ID NO: 1589608 - DNA, 22 bp, Homo sapiens
gcctcctcggagagcagcagca

SEQ ID NO: 1589609 - DNA, 20 bp, Homo sapiens
gcctcctctggacggcaggc

SEQ ID NO: 1589610 - DNA, 22 bp, Homo sapiens
gcctcctgccaccccttcctcc

SEQ ID NO: 1589611 - DNA, 17 bp, Homo sapiens
gcctcctgttctgccca

SEQ ID NO: 1589612 - DNA, 17 bp, Homo sapiens
gcctccttcccatgcct

SEQ ID NO: 1589613 - DNA, 19 bp, Homo sapiens
gcctccttcccatgcctgt

SEQ ID NO: 1589614 - DNA, 20 bp, Homo sapiens
gcctccttcccatgcctgtc

SEQ ID NO: 1589615 - DNA, 20 bp, Homo sapiens
gcctccttccttgctgtcct

SEQ ID NO: 1589616 - DNA, 22 bp, Homo sapiens
gcctccttcttccacttctcca

SEQ ID NO: 1589617 - DNA, 19 bp, Homo sapiens
gcctccttggtaaatacaa

SEQ ID NO: 1589618 - DNA, 22 bp, Homo sapiens
gcctccttgtgcaattgtcttt

SEQ ID NO: 1589619 - DNA, 13 bp, Homo sapiens
gcctgaggccttc

SEQ ID NO: 1589620 - DNA, 15 bp, Homo sapiens
gcctgaggctgagac

SEQ ID NO: 1589621 - DNA, 18 bp, Homo sapiens
gcctgaggctgagactgc

SEQ ID NO: 1589622 - DNA, 17 bp, Homo sapiens
gcctgagggcccctctg

SEQ ID NO: 1589623 - DNA, 18 bp, Homo sapiens
gcctgagggcccctctgc

SEQ ID NO: 1589624 - DNA, 22 bp, Homo sapiens
gcctgagggcccctctgcccag

SEQ ID NO: 1589625 - DNA, 12 bp, Homo sapiens
gcctgagggtgg

SEQ ID NO: 1589626 - DNA, 17 bp, Homo sapiens
gcctgagggtggagact

SEQ ID NO: 1589627 - DNA, 13 bp, Homo sapiens
gcctgagtcacct

SEQ ID NO: 1589628 - DNA, 20 bp, Homo sapiens
gcctgagtcagtgctctcag

SEQ ID NO: 1589629 - DNA, 13 bp, Homo sapiens
gcctgagtctcct

SEQ ID NO: 1589630 - DNA, 20 bp, Homo sapiens
gcctgataagcttcaaagct

SEQ ID NO: 1589631 - DNA, 17 bp, Homo sapiens
gcctgatactttagcca

SEQ ID NO: 1589632 - DNA, 20 bp, Homo sapiens
gcctgatcaggcttcctggt

SEQ ID NO: 1589633 - DNA, 13 bp, Homo sapiens
gcctgatctgccc

SEQ ID NO: 1589634 - DNA, 14 bp, Homo sapiens
gcctgatgctccct

SEQ ID NO: 1589635 - DNA, 19 bp, Homo sapiens
gcctgatgctccctcccct

SEQ ID NO: 1589636 - DNA, 17 bp, Homo sapiens
gcctgatggtgctgctc

SEQ ID NO: 1589637 - DNA, 20 bp, Homo sapiens
gcctgatggtgctgctcagg

SEQ ID NO: 1589638 - DNA, 23 bp, Homo sapiens
gcctgatgtcttaacgaataaag

SEQ ID NO: 1589639 - DNA, 18 bp, Homo sapiens
gcctgcaagagaatctga

SEQ ID NO: 1589640 - DNA, 18 bp, Homo sapiens
gcctgcaatctgagccag

SEQ ID NO: 1589641 - DNA, 15 bp, Homo sapiens
gcctgcaatttcata

SEQ ID NO: 1589642 - DNA, 12 bp, Homo sapiens
gcctgcacacac

SEQ ID NO: 1589643 - DNA, 17 bp, Homo sapiens
gcctgcacacacctgcc

SEQ ID NO: 1589644 - DNA, 15 bp, Homo sapiens
gcctgcaccaggaga

SEQ ID NO: 1589645 - DNA, 16 bp, Homo sapiens
gcctgcaccaggagac

SEQ ID NO: 1589646 - DNA, 21 bp, Homo sapiens
gcctgcaccaggagacagaca

SEQ ID NO: 1589647 - DNA, 18 bp, Homo sapiens
gcctgcactccctggcct

SEQ ID NO: 1589648 - DNA, 17 bp, Homo sapiens
gcctgcactcctcaggg

SEQ ID NO: 1589649 - DNA, 11 bp, Homo sapiens
gcctgcagaag

SEQ ID NO: 1589650 - DNA, 20 bp, Homo sapiens
gcctgcagaggtctgtgctg

SEQ ID NO: 1589651 - DNA, 13 bp, Homo sapiens
gcctgcaggagaa

SEQ ID NO: 1589652 - DNA, 15 bp, Homo sapiens
gcctgcaggctggag

SEQ ID NO: 1589653 - DNA, 19 bp, Homo sapiens
gcctgcaggctggagactg

SEQ ID NO: 1589654 - DNA, 20 bp, Homo sapiens
gcctgcagggaagccccaca

SEQ ID NO: 1589655 - DNA, 13 bp, Homo sapiens
gcctgcagggcca

SEQ ID NO: 1589656 - DNA, 16 bp, Homo sapiens
gcctgcagggccatgg

SEQ ID NO: 1589657 - DNA, 19 bp, Homo sapiens
gcctgcagggtggtgctgg

SEQ ID NO: 1589658 - DNA, 22 bp, Homo sapiens
gcctgcagggtggtgctgggac

SEQ ID NO: 1589659 - DNA, 23 bp, Homo sapiens
gcctgcagggtggtgctgggact

SEQ ID NO: 1589660 - DNA, 24 bp, Homo sapiens
gcctgcagggtggtgctgggactg

SEQ ID NO: 1589661 - DNA, 18 bp, Homo sapiens
gcctgcaggtcagttgta

SEQ ID NO: 1589662 - DNA, 17 bp, Homo sapiens
gcctgcagtcctggaag

SEQ ID NO: 1589663 - DNA, 15 bp, Homo sapiens
gcctgcatgagctgg

SEQ ID NO: 1589664 - DNA, 20 bp, Homo sapiens
gcctgcatgagctggcaacc

SEQ ID NO: 1589665 - DNA, 19 bp, Homo sapiens
gcctgcccagctgccgccc

SEQ ID NO: 1589666 - DNA, 20 bp, Homo sapiens
gcctgcccagtcgaccccaa

SEQ ID NO: 1589667 - DNA, 19 bp, Homo sapiens
gcctgcccagttgcactca

SEQ ID NO: 1589668 - DNA, 21 bp, Homo sapiens
gcctgcccctaccctggactt

SEQ ID NO: 1589669 - DNA, 22 bp, Homo sapiens
gcctgcccctaccctggacttg

SEQ ID NO: 1589670 - DNA, 14 bp, Homo sapiens
gcctgcccctctcc

SEQ ID NO: 1589671 - DNA, 17 bp, Homo sapiens
gcctgcccctctcccgc

SEQ ID NO: 1589672 - DNA, 17 bp, Homo sapiens
gcctgcccgcaccctgg

SEQ ID NO: 1589673 - DNA, 22 bp, Homo sapiens
gcctgcccgcaccctggcctgg

SEQ ID NO: 1589674 - DNA, 14 bp, Homo sapiens
gcctgccctcactc

SEQ ID NO: 1589675 - DNA, 22 bp, Homo sapiens
gcctgccctcactccctctgca

SEQ ID NO: 1589676 - DNA, 21 bp, Homo sapiens
gcctgccctcatggcccctct

SEQ ID NO: 1589677 - DNA, 17 bp, Homo sapiens
gcctgccctcccgcacc

SEQ ID NO: 1589678 - DNA, 19 bp, Homo sapiens
gcctgccctcccgcacctt

SEQ ID NO: 1589679 - DNA, 20 bp, Homo sapiens
gcctgccctcccgcaccttc

SEQ ID NO: 1589680 - DNA, 15 bp, Homo sapiens
gcctgccctctgccc

SEQ ID NO: 1589681 - DNA, 15 bp, Homo sapiens
gcctgccgcccccgc

SEQ ID NO: 1589682 - DNA, 22 bp, Homo sapiens
gcctgccgtgcatggctcctgt

SEQ ID NO: 1589683 - DNA, 10 bp, Homo sapiens
gcctgcctcc

SEQ ID NO: 1589684 - DNA, 16 bp, Homo sapiens
gcctgcctccagggct

SEQ ID NO: 1589685 - DNA, 22 bp, Homo sapiens
gcctgcctccagggctggactg

SEQ ID NO: 1589686 - DNA, 13 bp, Homo sapiens
gcctgcctgcatg

SEQ ID NO: 1589687 - DNA, 14 bp, Homo sapiens
gcctgcgaccctgg

SEQ ID NO: 1589688 - DNA, 14 bp, Homo sapiens
gcctgcgtgcgctg

SEQ ID NO: 1589689 - DNA, 16 bp, Homo sapiens
gcctgcgtttggaggc

SEQ ID NO: 1589690 - DNA, 21 bp, Homo sapiens
gcctgcgtttggaggcccctg

SEQ ID NO: 1589691 - DNA, 22 bp, Homo sapiens
gcctgcgtttggaggcccctgg

SEQ ID NO: 1589692 - DNA, 19 bp, Homo sapiens
gcctgctaaggctcctcct

SEQ ID NO: 1589693 - DNA, 19 bp, Homo sapiens
gcctgctcagcagccagtc

SEQ ID NO: 1589694 - DNA, 20 bp, Homo sapiens
gcctgctcagcagccagtct

SEQ ID NO: 1589695 - DNA, 12 bp, Homo sapiens
gcctgctccaga

SEQ ID NO: 1589696 - DNA, 17 bp, Homo sapiens
gcctgctcccagcagcc

SEQ ID NO: 1589697 - DNA, 15 bp, Homo sapiens
gcctgctccctgtct

SEQ ID NO: 1589698 - DNA, 20 bp, Homo sapiens
gcctgctccctgtctgtgtc

SEQ ID NO: 1589699 - DNA, 15 bp, Homo sapiens
gcctgctcctcactg

SEQ ID NO: 1589700 - DNA, 16 bp, Homo sapiens
gcctgctcctcactgg

SEQ ID NO: 1589701 - DNA, 14 bp, Homo sapiens
gcctgctcctgctt

SEQ ID NO: 1589702 - DNA, 22 bp, Homo sapiens
gcctgctcctgcttaaacacaa

SEQ ID NO: 1589703 - DNA, 23 bp, Homo sapiens
gcctgctgaatgatttccaaaga

SEQ ID NO: 1589704 - DNA, 19 bp, Homo sapiens
gcctgctgccagtgcagcc

SEQ ID NO: 1589705 - DNA, 18 bp, Homo sapiens
gcctgctggaagcccagc

SEQ ID NO: 1589706 - DNA, 15 bp, Homo sapiens
gcctgctggaggcct

SEQ ID NO: 1589707 - DNA, 17 bp, Homo sapiens
gcctgctggcacccacc

SEQ ID NO: 1589708 - DNA, 22 bp, Homo sapiens
gcctgctggcacccaccgtgga

SEQ ID NO: 1589709 - DNA, 13 bp, Homo sapiens
gcctgctggctgc

SEQ ID NO: 1589710 - DNA, 14 bp, Homo sapiens
gcctgctggctgcg

SEQ ID NO: 1589711 - DNA, 18 bp, Homo sapiens
gcctgctggctgcggccc

SEQ ID NO: 1589712 - DNA, 19 bp, Homo sapiens
gcctgctggctgcggcccc

SEQ ID NO: 1589713 - DNA, 13 bp, Homo sapiens
gcctgctgggctc

SEQ ID NO: 1589714 - DNA, 14 bp, Homo sapiens
gcggagcccagcct

SEQ ID NO: 1589715 - DNA, 16 bp, Homo sapiens
gcggagctgctgagtg

SEQ ID NO: 1589716 - DNA, 21 bp, Homo sapiens
gcggagctgctgagtgacagc

SEQ ID NO: 1589717 - DNA, 19 bp, Homo sapiens
gcggagcttgcagtgagcc

SEQ ID NO: 1589718 - DNA, 20 bp, Homo sapiens
gcggagcttgcagtgagccg

SEQ ID NO: 1589719 - DNA, 17 bp, Homo sapiens
gcggaggagaccagctc

SEQ ID NO: 1589720 - DNA, 13 bp, Homo sapiens
gcggaggagctgc

SEQ ID NO: 1589721 - DNA, 13 bp, Homo sapiens
gcggaggaggagg

SEQ ID NO: 1589722 - DNA, 22 bp, Homo sapiens
gcggaggcgctcctccctgcct

SEQ ID NO: 1589723 - DNA, 17 bp, Homo sapiens
gcggaggggatccagcc

SEQ ID NO: 1589724 - DNA, 15 bp, Homo sapiens
gcggaggtctctggg

SEQ ID NO: 1589725 - DNA, 17 bp, Homo sapiens
gcggaggtctctgggag

SEQ ID NO: 1589726 - DNA, 19 bp, Homo sapiens
gcggaggtctctgggagcc

SEQ ID NO: 1589727 - DNA, 16 bp, Homo sapiens
gcggaggttgcaggga

SEQ ID NO: 1589728 - DNA, 21 bp, Homo sapiens
gcggagtgaagaggggcagcc

SEQ ID NO: 1589729 - DNA, 15 bp, Homo sapiens
gcggatggatggaag

SEQ ID NO: 1589730 - DNA, 21 bp, Homo sapiens
gcggatggatggaaggttgga

SEQ ID NO: 1589731 - DNA, 15 bp, Homo sapiens
gcggattgctctgga

SEQ ID NO: 1589732 - DNA, 20 bp, Homo sapiens
gcggattgctctggagcagc

SEQ ID NO: 1589733 - DNA, 21 bp, Homo sapiens
gcggattgctctggagcagcc

SEQ ID NO: 1589734 - DNA, 14 bp, Homo sapiens
gcggcaaaggcccg

SEQ ID NO: 1589735 - DNA, 17 bp, Homo sapiens
gcggcagcagccatcat

SEQ ID NO: 1589736 - DNA, 14 bp, Homo sapiens
gcggcaggagggag

SEQ ID NO: 1589737 - DNA, 15 bp, Homo sapiens
gcggcaggggcctgg

SEQ ID NO: 1589738 - DNA, 19 bp, Homo sapiens
gcggcaggggcctggagat

SEQ ID NO: 1589739 - DNA, 18 bp, Homo sapiens
gcggccacgcactgggcc

SEQ ID NO: 1589740 - DNA, 20 bp, Homo sapiens
gcggccacgcactgggccac

SEQ ID NO: 1589741 - DNA, 12 bp, Homo sapiens
gcggccaggcac

SEQ ID NO: 1589742 - DNA, 15 bp, Homo sapiens
gcggccaggcacagg

SEQ ID NO: 1589743 - DNA, 23 bp, Homo sapiens
gcggccaggcacagggcccgcag

SEQ ID NO: 1589744 - DNA, 14 bp, Homo sapiens
gcggccaggcaccc

SEQ ID NO: 1589745 - DNA, 17 bp, Homo sapiens
gcggccaggcacccatg

SEQ ID NO: 1589746 - DNA, 14 bp, Homo sapiens
gcggcccctcccac

SEQ ID NO: 1589747 - DNA, 12 bp, Homo sapiens
gcggcccggcca

SEQ ID NO: 1589748 - DNA, 14 bp, Homo sapiens
gcggcccggccagc

SEQ ID NO: 1589749 - DNA, 23 bp, Homo sapiens
gcggcccggccagcgggcacagg

SEQ ID NO: 1589750 - DNA, 13 bp, Homo sapiens
gcggccctgctga

SEQ ID NO: 1589751 - DNA, 14 bp, Homo sapiens
gcggcccttctgac

SEQ ID NO: 1589752 - DNA, 16 bp, Homo sapiens
gcggccgcattccctg

SEQ ID NO: 1589753 - DNA, 15 bp, Homo sapiens
gcggccgcccgcacg

SEQ ID NO: 1589754 - DNA, 12 bp, Homo sapiens
gcggcctccaca

SEQ ID NO: 1589755 - DNA, 22 bp, Homo sapiens
gcggcctccggcgtcttgccca

SEQ ID NO: 1589756 - DNA, 23 bp, Homo sapiens
gcggccttccgggtctcgcagcc

SEQ ID NO: 1589757 - DNA, 15 bp, Homo sapiens
gcggcgcagagccct

SEQ ID NO: 1589758 - DNA, 21 bp, Homo sapiens
gcggctactcagcagccctcc

SEQ ID NO: 1589759 - DNA, 12 bp, Homo sapiens
gcggctgagagc

SEQ ID NO: 1589760 - DNA, 22 bp, Homo sapiens
gcggctgagtcatgatctccct

SEQ ID NO: 1589761 - DNA, 15 bp, Homo sapiens
gcggctgctcaagcc

SEQ ID NO: 1589762 - DNA, 12 bp, Homo sapiens
gcggctggagaa

SEQ ID NO: 1589763 - DNA, 21 bp, Homo sapiens
gcggctgtgggcgagcatggg

SEQ ID NO: 1589764 - DNA, 19 bp, Homo sapiens
gcggcttcctgtccactct

SEQ ID NO: 1589765 - DNA, 13 bp, Homo sapiens
gcgggaaggaggg

SEQ ID NO: 1589766 - DNA, 14 bp, Homo sapiens
gcgggaaggagggt

SEQ ID NO: 1589767 - DNA, 21 bp, Homo sapiens
gcgggacagagggtggctgga

SEQ ID NO: 1589768 - DNA, 14 bp, Homo sapiens
gcgggactcagtga

SEQ ID NO: 1589769 - DNA, 18 bp, Homo sapiens
gcgggactcagtgagctg

SEQ ID NO: 1589770 - DNA, 17 bp, Homo sapiens
gcgggaggcaccagctc

SEQ ID NO: 1589771 - DNA, 18 bp, Homo sapiens
gcgggaggcaccagctct

SEQ ID NO: 1589772 - DNA, 19 bp, Homo sapiens
gcgggaggcaccagctctg

SEQ ID NO: 1589773 - DNA, 15 bp, Homo sapiens
gcgggagggcctgca

SEQ ID NO: 1589774 - DNA, 17 bp, Homo sapiens
gcgggatcctccacaga

SEQ ID NO: 1589775 - DNA, 18 bp, Homo sapiens
gcgggatcctccacagag

SEQ ID NO: 1589776 - DNA, 17 bp, Homo sapiens
gcgggatggtcctgggg

SEQ ID NO: 1589777 - DNA, 9 bp, Homo sapiens
gcgggcaca

SEQ ID NO: 1589778 - DNA, 15 bp, Homo sapiens
gcgggcacaataaat

SEQ ID NO: 1589779 - DNA, 13 bp, Homo sapiens
gcgggcacagggc

SEQ ID NO: 1589780 - DNA, 15 bp, Homo sapiens
gcgggcacagggcac

SEQ ID NO: 1589781 - DNA, 16 bp, Homo sapiens
gcgggcagagggctgg

SEQ ID NO: 1589782 - DNA, 19 bp, Homo sapiens
gcgggcagcgggccaggcc

SEQ ID NO: 1589783 - DNA, 16 bp, Homo sapiens
gcgggccagccaggcg

SEQ ID NO: 1589784 - DNA, 19 bp, Homo sapiens
gcgggccagccaggcgggc

SEQ ID NO: 1589785 - DNA, 11 bp, Homo sapiens
gcgggccaggc

SEQ ID NO: 1589786 - DNA, 18 bp, Homo sapiens
gcgggccaggcccgcacc

SEQ ID NO: 1589787 - DNA, 12 bp, Homo sapiens
gcgggccagggt

SEQ ID NO: 1589788 - DNA, 23 bp, Homo sapiens
gcgggcccctcacctggtacctg

SEQ ID NO: 1589789 - DNA, 12 bp, Homo sapiens
gcgggcctggcc

SEQ ID NO: 1589790 - DNA, 13 bp, Homo sapiens
gcgggctcgccca

SEQ ID NO: 1589791 - DNA, 16 bp, Homo sapiens
gcggggcccacgcacg

SEQ ID NO: 1589792 - DNA, 22 bp, Homo sapiens
gcgggggccttgaagactccct

SEQ ID NO: 1589793 - DNA, 18 bp, Homo sapiens
gcgggtcccggccgcgcc

SEQ ID NO: 1589794 - DNA, 21 bp, Homo sapiens
gcgggtctcctcccagcggcc

SEQ ID NO: 1589795 - DNA, 21 bp, Homo sapiens
gcgggtgctctgaggcctcac

SEQ ID NO: 1589796 - DNA, 20 bp, Homo sapiens
gcgggtggatcacaaggtca

SEQ ID NO: 1589797 - DNA, 19 bp, Homo sapiens
gcgggtggatcacgaggtc

SEQ ID NO: 1589798 - DNA, 13 bp, Homo sapiens
gcgggttctagac

SEQ ID NO: 1589799 - DNA, 23 bp, Homo sapiens
gcgggttctagacgcccctccca

SEQ ID NO: 1589800 - DNA, 22 bp, Homo sapiens
gcggtcatgtgtgcatgtgagc

SEQ ID NO: 1589801 - DNA, 21 bp, Homo sapiens
gcggtgctctggcggcttcct

SEQ ID NO: 1589802 - DNA, 22 bp, Homo sapiens
gcggtgctctggcggcttcctg

SEQ ID NO: 1589803 - DNA, 14 bp, Homo sapiens
gcggtgctgactga

SEQ ID NO: 1589804 - DNA, 18 bp, Homo sapiens
gcggtggctcacgcctgt

SEQ ID NO: 1589805 - DNA, 17 bp, Homo sapiens
gcggtggctgccccggc

SEQ ID NO: 1589806 - DNA, 21 bp, Homo sapiens
gcggtggctgccccggcctcc

SEQ ID NO: 1589807 - DNA, 14 bp, Homo sapiens
gcggtgggggagga

SEQ ID NO: 1589808 - DNA, 14 bp, Homo sapiens
gcggtttggggagc

SEQ ID NO: 1589809 - DNA, 17 bp, Homo sapiens
gcgtaatgggcctgccc

SEQ ID NO: 1589810 - DNA, 17 bp, Homo sapiens
gcgtcactccagtgctc

SEQ ID NO: 1589811 - DNA, 14 bp, Homo sapiens
gcgtcagctgctcc

SEQ ID NO: 1589812 - DNA, 14 bp, Homo sapiens
gcgtcccaagatgt

SEQ ID NO: 1589813 - DNA, 19 bp, Homo sapiens
gcgtcccagtctctggcag

SEQ ID NO: 1589814 - DNA, 14 bp, Homo sapiens
gcgtccccctgccg

SEQ ID NO: 1589815 - DNA, 20 bp, Homo sapiens
gcgtcccctgctactcctgt

SEQ ID NO: 1589816 - DNA, 19 bp, Homo sapiens
gcgtccctagcagtgaact

SEQ ID NO: 1589817 - DNA, 11 bp, Homo sapiens
gcgtccctggc

SEQ ID NO: 1589818 - DNA, 14 bp, Homo sapiens
gcgtccctggcgca

SEQ ID NO: 1589819 - DNA, 16 bp, Homo sapiens
gcgtccgcgcgccagc

SEQ ID NO: 1589820 - DNA, 17 bp, Homo sapiens
gcgtcctcatttcccct

SEQ ID NO: 1589821 - DNA, 14 bp, Homo sapiens
gcgtcctgccctgc

SEQ ID NO: 1589822 - DNA, 21 bp, Homo sapiens
gcgtcctgccctgccccctcg

SEQ ID NO: 1589823 - DNA, 13 bp, Homo sapiens
gcgtctccagtca

SEQ ID NO: 1589824 - DNA, 22 bp, Homo sapiens
gcgtctctcctccctcctgggg

SEQ ID NO: 1589825 - DNA, 22 bp, Homo sapiens
gcgtctctctttctccctcacc

SEQ ID NO: 1589826 - DNA, 12 bp, Homo sapiens
gcgtctgagctg

SEQ ID NO: 1589827 - DNA, 17 bp, Homo sapiens
gcgtctgagctggggtg

SEQ ID NO: 1589828 - DNA, 14 bp, Homo sapiens
gcgtctgttttgtg

SEQ ID NO: 1589829 - DNA, 18 bp, Homo sapiens
gcgtcttttttctcttcc

SEQ ID NO: 1589830 - DNA, 19 bp, Homo sapiens
gcgtcttttttctcttccc

SEQ ID NO: 1589831 - DNA, 22 bp, Homo sapiens
gctactcaggaggctgagacag

SEQ ID NO: 1589832 - DNA, 23 bp, Homo sapiens
gctactcaggaggctgaggcagg

SEQ ID NO: 1589833 - DNA, 20 bp, Homo sapiens
gctactcataagttggacca

SEQ ID NO: 1589834 - DNA, 17 bp, Homo sapiens
gctactctgtccaggcc

SEQ ID NO: 1589835 - DNA, 15 bp, Homo sapiens
gctcagtgccttcct

SEQ ID NO: 1589836 - DNA, 18 bp, Homo sapiens
gctcagtgtccagcttcc

SEQ ID NO: 1589837 - DNA, 22 bp, Homo sapiens
gctcagtgtccagcttccaaag

SEQ ID NO: 1589838 - DNA, 23 bp, Homo sapiens
gctcagtgtccagcttccaaagc

SEQ ID NO: 1589839 - DNA, 19 bp, Homo sapiens
gctcatagaggtgagaaaa

SEQ ID NO: 1589840 - DNA, 23 bp, Homo sapiens
gctcatagaggtgagaaaactca

SEQ ID NO: 1589841 - DNA, 19 bp, Homo sapiens
gctcatatggggctgggag

SEQ ID NO: 1589842 - DNA, 18 bp, Homo sapiens
gctcatcccccctgctgc

SEQ ID NO: 1589843 - DNA, 21 bp, Homo sapiens
gctcatcccccctgctgccca

SEQ ID NO: 1589844 - DNA, 22 bp, Homo sapiens
gctcatcccccctgctgcccag

SEQ ID NO: 1589845 - DNA, 23 bp, Homo sapiens
gctcatctgctggtccgtgggac

SEQ ID NO: 1589846 - DNA, 18 bp, Homo sapiens
gctcatggcgtaatgggc

SEQ ID NO: 1589847 - DNA, 17 bp, Homo sapiens
gctcatgtcctgtcctg

SEQ ID NO: 1589848 - DNA, 19 bp, Homo sapiens
gctcatgtcctgtcctggt

SEQ ID NO: 1589849 - DNA, 22 bp, Homo sapiens
gctcatgtgtgcaacagggtat

SEQ ID NO: 1589850 - DNA, 18 bp, Homo sapiens
gctcatgttgagccagtg

SEQ ID NO: 1589851 - DNA, 14 bp, Homo sapiens
gctcattaaacttt

SEQ ID NO: 1589852 - DNA, 21 bp, Homo sapiens
gctcattataatgtcattaaa

SEQ ID NO: 1589853 - DNA, 15 bp, Homo sapiens
gctcatttaaaacag

SEQ ID NO: 1589854 - DNA, 12 bp, Homo sapiens
gctcatttaagt

SEQ ID NO: 1589855 - DNA, 16 bp, Homo sapiens
gctccaaaccccaggg

SEQ ID NO: 1589856 - DNA, 21 bp, Homo sapiens
gctccaacccccgccacctca

SEQ ID NO: 1589857 - DNA, 18 bp, Homo sapiens
gctccaacctgcaaagat

SEQ ID NO: 1589858 - DNA, 21 bp, Homo sapiens
gctccaacctgcaaagatctg

SEQ ID NO: 1589859 - DNA, 20 bp, Homo sapiens
gctccaactcctttcagcca

SEQ ID NO: 1589860 - DNA, 20 bp, Homo sapiens
gctccaaggggaatcagaac

SEQ ID NO: 1589861 - DNA, 16 bp, Homo sapiens
gctccaatttccccac

SEQ ID NO: 1589862 - DNA, 24 bp, Homo sapiens
gctccacacagcagtgtcccctgc

SEQ ID NO: 1589863 - DNA, 16 bp, Homo sapiens
gctccacaccctctcc

SEQ ID NO: 1589864 - DNA, 19 bp, Homo sapiens
gctccacaccctctcccag

SEQ ID NO: 1589865 - DNA, 22 bp, Homo sapiens
gctccacaccctctcccaggac

SEQ ID NO: 1589866 - DNA, 12 bp, Homo sapiens
gctccaccacat

SEQ ID NO: 1589867 - DNA, 15 bp, Homo sapiens
gctccaccagcagca

SEQ ID NO: 1589868 - DNA, 11 bp, Homo sapiens
gctccaccctt

SEQ ID NO: 1589869 - DNA, 14 bp, Homo sapiens
gctccacccttggc

SEQ ID NO: 1589870 - DNA, 20 bp, Homo sapiens
gctccacctctggtggctcc

SEQ ID NO: 1589871 - DNA, 20 bp, Homo sapiens
gctccacggtgcgtggctgt

SEQ ID NO: 1589872 - DNA, 16 bp, Homo sapiens
gctccactattttatt

SEQ ID NO: 1589873 - DNA, 19 bp, Homo sapiens
gctccactctgcttctctg

SEQ ID NO: 1589874 - DNA, 19 bp, Homo sapiens
gctccactcttgatctctc

SEQ ID NO: 1589875 - DNA, 15 bp, Homo sapiens
gctccagaagatgcc

SEQ ID NO: 1589876 - DNA, 22 bp, Homo sapiens
gctccagacctgatcctggagg

SEQ ID NO: 1589877 - DNA, 19 bp, Homo sapiens
gctccagataactctcttt

SEQ ID NO: 1589878 - DNA, 20 bp, Homo sapiens
gctccagataactctctttc

SEQ ID NO: 1589879 - DNA, 15 bp, Homo sapiens
gctccagattctgat

SEQ ID NO: 1589880 - DNA, 19 bp, Homo sapiens
gctccagcaacacagcctg

SEQ ID NO: 1589881 - DNA, 12 bp, Homo sapiens
gctccagcagca

SEQ ID NO: 1589882 - DNA, 15 bp, Homo sapiens
gctccagcagcacac

SEQ ID NO: 1589883 - DNA, 22 bp, Homo sapiens
gctccagcagcacacctcagcc

SEQ ID NO: 1589884 - DNA, 16 bp, Homo sapiens
gctccagcatccagcc

SEQ ID NO: 1589885 - DNA, 20 bp, Homo sapiens
gctccagcatccagcctgtg

SEQ ID NO: 1589886 - DNA, 21 bp, Homo sapiens
gctccagcatccagcctgtgt

SEQ ID NO: 1589887 - DNA, 22 bp, Homo sapiens
gctccagcatccagcctgtgtg

SEQ ID NO: 1589888 - DNA, 13 bp, Homo sapiens
gctccagccatct

SEQ ID NO: 1589889 - DNA, 20 bp, Homo sapiens
gctccagctgctctgtcttc

SEQ ID NO: 1589890 - DNA, 21 bp, Homo sapiens
gctccagctgctctgtcttct

SEQ ID NO: 1589891 - DNA, 15 bp, Homo sapiens
gctccaggcacccag

SEQ ID NO: 1589892 - DNA, 15 bp, Homo sapiens
gctccaggcagaagg

SEQ ID NO: 1589893 - DNA, 23 bp, Homo sapiens
gctccagggcagcctccaccttg

SEQ ID NO: 1589894 - DNA, 13 bp, Homo sapiens
gctccagggccag

SEQ ID NO: 1589895 - DNA, 15 bp, Homo sapiens
gctccagggccagat

SEQ ID NO: 1589896 - DNA, 14 bp, Homo sapiens
gctccagggtcttg

SEQ ID NO: 1589897 - DNA, 23 bp, Homo sapiens
gctccagggtcttgggctactgg

SEQ ID NO: 1589898 - DNA, 24 bp, Homo sapiens
gctccagggtcttgggctactggc

SEQ ID NO: 1589899 - DNA, 19 bp, Homo sapiens
gctccatatttgatttcta

SEQ ID NO: 1589900 - DNA, 19 bp, Homo sapiens
gctccatctccgcctccac

SEQ ID NO: 1589901 - DNA, 20 bp, Homo sapiens
gctccatctccgcctccaca

SEQ ID NO: 1589902 - DNA, 20 bp, Homo sapiens
gctccatgactggctgtctg

SEQ ID NO: 1589903 - DNA, 20 bp, Homo sapiens
gctccatggatgcatgccct

SEQ ID NO: 1589904 - DNA, 14 bp, Homo sapiens
gctcccaacccccc

SEQ ID NO: 1589905 - DNA, 19 bp, Homo sapiens
gctcccaacccccctcctg

SEQ ID NO: 1589906 - DNA, 12 bp, Homo sapiens
gctcccaagggt

SEQ ID NO: 1589907 - DNA, 17 bp, Homo sapiens
gctcccaatcagctttt

SEQ ID NO: 1589908 - DNA, 17 bp, Homo sapiens
gctcccacaggcccttc

SEQ ID NO: 1589909 - DNA, 22 bp, Homo sapiens
gctcccacaggcccttcctctc

SEQ ID NO: 1589910 - DNA, 21 bp, Homo sapiens
gctcccaccccacccccttca

SEQ ID NO: 1589911 - DNA, 16 bp, Homo sapiens
gctcccaccgccccca

SEQ ID NO: 1589912 - DNA, 18 bp, Homo sapiens
gctcccaccgcccccacc

SEQ ID NO: 1589913 - DNA, 19 bp, Homo sapiens
gctcccaccgcccccaccc

SEQ ID NO: 1589914 - DNA, 15 bp, Homo sapiens
gctcccacctagtgc

SEQ ID NO: 1589915 - DNA, 23 bp, Homo sapiens
gctcccacctagtgccccagact

SEQ ID NO: 1589916 - DNA, 12 bp, Homo sapiens
gctcccacctcc

SEQ ID NO: 1589917 - DNA, 16 bp, Homo sapiens
gctcccacctcccttc

SEQ ID NO: 1589918 - DNA, 12 bp, Homo sapiens
gctcccaggaca

SEQ ID NO: 1589919 - DNA, 20 bp, Homo sapiens
gctcccaggggtctccctgg

SEQ ID NO: 1589920 - DNA, 21 bp, Homo sapiens
gctcccaggggtctccctggc

SEQ ID NO: 1589921 - DNA, 22 bp, Homo sapiens
gctcccaggggtctccctggct

SEQ ID NO: 1589922 - DNA, 21 bp, Homo sapiens
gctcccaggttcccccagcaa

SEQ ID NO: 1589923 - DNA, 21 bp, Homo sapiens
gctcccagtgggagcttcccg

SEQ ID NO: 1589924 - DNA, 15 bp, Homo sapiens
gctcccatcattcct

SEQ ID NO: 1589925 - DNA, 13 bp, Homo sapiens
gctcccatctcct

SEQ ID NO: 1589926 - DNA, 16 bp, Homo sapiens
gctcccatctcctgat

SEQ ID NO: 1589927 - DNA, 20 bp, Homo sapiens
gctcccattcactcttccag

SEQ ID NO: 1589928 - DNA, 15 bp, Homo sapiens
gctccccacctaccc

SEQ ID NO: 1589929 - DNA, 16 bp, Homo sapiens
gctccccacctaccca

SEQ ID NO: 1589930 - DNA, 12 bp, Homo sapiens
gctccccacgag

SEQ ID NO: 1589931 - DNA, 24 bp, Homo sapiens
gctccccacgagtcacctgcaagc

SEQ ID NO: 1589932 - DNA, 12 bp, Homo sapiens
gctccccatgtg

SEQ ID NO: 1589933 - DNA, 14 bp, Homo sapiens
gctcccccaccccc

SEQ ID NO: 1589934 - DNA, 18 bp, Homo sapiens
gctccccccgcccaccca

SEQ ID NO: 1589935 - DNA, 16 bp, Homo sapiens
gctcccccgcagtccc

SEQ ID NO: 1589936 - DNA, 19 bp, Homo sapiens
gctcccccgcagtccccag

SEQ ID NO: 1589937 - DNA, 14 bp, Homo sapiens
gctccccctctgct

SEQ ID NO: 1589938 - DNA, 15 bp, Homo sapiens
gctccccctctgctt

SEQ ID NO: 1589939 - DNA, 17 bp, Homo sapiens
gctccccgcctccactc

SEQ ID NO: 1589940 - DNA, 15 bp, Homo sapiens
gctcccctcccaggg

SEQ ID NO: 1589941 - DNA, 22 bp, Homo sapiens
gctcccctcccaggggagccag

SEQ ID NO: 1589942 - DNA, 13 bp, Homo sapiens
gctcccctctgcc

SEQ ID NO: 1589943 - DNA, 17 bp, Homo sapiens
gctcccctgccacactg

SEQ ID NO: 1589944 - DNA, 18 bp, Homo sapiens
gctcccctgctgaggcag

SEQ ID NO: 1589945 - DNA, 14 bp, Homo sapiens
gctcccgctgtggc

SEQ ID NO: 1589946 - DNA, 23 bp, Homo sapiens
gctcccggccttgtgtgatttta

SEQ ID NO: 1589947 - DNA, 19 bp, Homo sapiens
gctcccggggcagggcagc

SEQ ID NO: 1589948 - DNA, 23 bp, Homo sapiens
gctccctcccctgccctggtcca

SEQ ID NO: 1589949 - DNA, 13 bp, Homo sapiens
gctccctcctccc

SEQ ID NO: 1589950 - DNA, 19 bp, Homo sapiens
gctccctcctcccatctcc

SEQ ID NO: 1589951 - DNA, 22 bp, Homo sapiens
gctcgtggccttccccttttgc

SEQ ID NO: 1589952 - DNA, 19 bp, Homo sapiens
gctcgtgtatcctggggct

SEQ ID NO: 1589953 - DNA, 23 bp, Homo sapiens
gctctaaaaggtaatgtgtggat

SEQ ID NO: 1589954 - DNA, 19 bp, Homo sapiens
gctctaaaatatttatgaa

SEQ ID NO: 1589955 - DNA, 15 bp, Homo sapiens
gctctaaagtagcaa

SEQ ID NO: 1589956 - DNA, 20 bp, Homo sapiens
gctctaaagtagcaactgct

SEQ ID NO: 1589957 - DNA, 18 bp, Homo sapiens
gctctaacacctgcctag

SEQ ID NO: 1589958 - DNA, 15 bp, Homo sapiens
gctctaacagccctc

SEQ ID NO: 1589959 - DNA, 19 bp, Homo sapiens
gctctaactggacatgaag

SEQ ID NO: 1589960 - DNA, 16 bp, Homo sapiens
gctctacatcttctgc

SEQ ID NO: 1589961 - DNA, 12 bp, Homo sapiens
gctctaccctgt

SEQ ID NO: 1589962 - DNA, 16 bp, Homo sapiens
gctctaccctgtctgt

SEQ ID NO: 1589963 - DNA, 22 bp, Homo sapiens
gctctagatcataaggcttcaa

SEQ ID NO: 1589964 - DNA, 23 bp, Homo sapiens
gctctagattgagagaagagaca

SEQ ID NO: 1589965 - DNA, 14 bp, Homo sapiens
gctctagccaggag

SEQ ID NO: 1589966 - DNA, 15 bp, Homo sapiens
gctctagccaggagt

SEQ ID NO: 1589967 - DNA, 19 bp, Homo sapiens
gctctagccaggagtctgt

SEQ ID NO: 1589968 - DNA, 24 bp, Homo sapiens
gctctagccaggagtctgtgctct

SEQ ID NO: 1589969 - DNA, 15 bp, Homo sapiens
gctctagctggcagg

SEQ ID NO: 1589970 - DNA, 20 bp, Homo sapiens
gctctagctggcaggacaca

SEQ ID NO: 1589971 - DNA, 14 bp, Homo sapiens
gcctcaaccttctg

SEQ ID NO: 1589972 - DNA, 16 bp, Homo sapiens
gcctcaaccttctggg

SEQ ID NO: 1589973 - DNA, 22 bp, Homo sapiens
gcctcaaggttttaggttctaa

SEQ ID NO: 1589974 - DNA, 21 bp, Homo sapiens
gcctcaatgtggttgcaaggc

SEQ ID NO: 1589975 - DNA, 14 bp, Homo sapiens
gcctcaccagcccc

SEQ ID NO: 1589976 - DNA, 16 bp, Homo sapiens
gcctcaccagcccccc

SEQ ID NO: 1589977 - DNA, 24 bp, Homo sapiens
gcctcaccagccccccgcgcgccc

SEQ ID NO: 1589978 - DNA, 23 bp, Homo sapiens
gcctcacggggttggctgttcca

SEQ ID NO: 1589979 - DNA, 16 bp, Homo sapiens
gcctcacttgaatgtg

SEQ ID NO: 1589980 - DNA, 17 bp, Homo sapiens
gcctcagaaggccccag

SEQ ID NO: 1589981 - DNA, 21 bp, Homo sapiens
gcctcagaaggccccagagag

SEQ ID NO: 1589982 - DNA, 19 bp, Homo sapiens
gcctcagactccgccctcc

SEQ ID NO: 1589983 - DNA, 15 bp, Homo sapiens
gcctcagccagtggc

SEQ ID NO: 1589984 - DNA, 21 bp, Homo sapiens
gcctcagccagtggcacagga

SEQ ID NO: 1589985 - DNA, 14 bp, Homo sapiens
gcctcagcctactc

SEQ ID NO: 1589986 - DNA, 13 bp, Homo sapiens
gcctcagcctcct

SEQ ID NO: 1589987 - DNA, 14 bp, Homo sapiens
gcctcagcctcctg

SEQ ID NO: 1589988 - DNA, 16 bp, Homo sapiens
gcctcagcctcctgag

SEQ ID NO: 1589989 - DNA, 18 bp, Homo sapiens
gcctcagcctcctgagta

SEQ ID NO: 1589990 - DNA, 16 bp, Homo sapiens
gcctcagctgcctcac

SEQ ID NO: 1589991 - DNA, 17 bp, Homo sapiens
gcctcaggccagggctc

SEQ ID NO: 1589992 - DNA, 21 bp, Homo sapiens
gcctcaggctctgcacagaca

SEQ ID NO: 1589993 - DNA, 21 bp, Homo sapiens
gcctcagggcgctcagacggc

SEQ ID NO: 1589994 - DNA, 15 bp, Homo sapiens
gcctcaggtgctgtc

SEQ ID NO: 1589995 - DNA, 17 bp, Homo sapiens
gcctcaggtgctgtcca

SEQ ID NO: 1589996 - DNA, 20 bp, Homo sapiens
gcctcaggtgctgtccatgg

SEQ ID NO: 1589997 - DNA, 14 bp, Homo sapiens
gcctcagtgccact

SEQ ID NO: 1589998 - DNA, 18 bp, Homo sapiens
gcctcagttcccagctcc

SEQ ID NO: 1589999 - DNA, 22 bp, Homo sapiens
gcctcagtttctccatcagctt

SEQ ID NO: 1590000 - DNA, 17 bp, Homo sapiens
gctctgttacccaggct

SEQ ID NO: 1590001 - DNA, 21 bp, Homo sapiens
gctctgttcacagtctctgga

SEQ ID NO: 1590002 - DNA, 14 bp, Homo sapiens
gctctgttctgcct

SEQ ID NO: 1590003 - DNA, 22 bp, Homo sapiens
gctctgttgcccaggctggagt

SEQ ID NO: 1590004 - DNA, 15 bp, Homo sapiens
gctctgtttcttcct

SEQ ID NO: 1590005 - DNA, 20 bp, Homo sapiens
gctctgtttcttcctttctg

SEQ ID NO: 1590006 - DNA, 14 bp, Homo sapiens
gctcttactctttc

SEQ ID NO: 1590007 - DNA, 17 bp, Homo sapiens
gctcttagcagcttcca

SEQ ID NO: 1590008 - DNA, 19 bp, Homo sapiens
gctcttagcagcttccaga

SEQ ID NO: 1590009 - DNA, 18 bp, Homo sapiens
gctcttagtctctttggt

SEQ ID NO: 1590010 - DNA, 22 bp, Homo sapiens
gctcttagtgcccgcctaggag

SEQ ID NO: 1590011 - DNA, 20 bp, Homo sapiens
gctcttcctatccctctcct

SEQ ID NO: 1590012 - DNA, 19 bp, Homo sapiens
gctcttccttgaatcttct

SEQ ID NO: 1590013 - DNA, 13 bp, Homo sapiens
gctcttctaagga

SEQ ID NO: 1590014 - DNA, 13 bp, Homo sapiens
gctcttctcagtg

SEQ ID NO: 1590015 - DNA, 15 bp, Homo sapiens
gctcttctcatttca

SEQ ID NO: 1590016 - DNA, 16 bp, Homo sapiens
gctcttctcatttcac

SEQ ID NO: 1590017 - DNA, 22 bp, Homo sapiens
gctcttctcatttcacccctcc

SEQ ID NO: 1590018 - DNA, 23 bp, Homo sapiens
gctcttctcatttcacccctccc

SEQ ID NO: 1590019 - DNA, 13 bp, Homo sapiens
gctcttctccttt

SEQ ID NO: 1590020 - DNA, 17 bp, Homo sapiens
gctcttctcctttcaca

SEQ ID NO: 1590021 - DNA, 21 bp, Homo sapiens
gctcttctcctttcacaacct

SEQ ID NO: 1590022 - DNA, 12 bp, Homo sapiens
gctcttctttct

SEQ ID NO: 1590023 - DNA, 15 bp, Homo sapiens
gctcttctttctgag

SEQ ID NO: 1590024 - DNA, 21 bp, Homo sapiens
gctcttgaaatattcagaaat

SEQ ID NO: 1590025 - DNA, 19 bp, Homo sapiens
gctcttgaggaagcccagg

SEQ ID NO: 1590026 - DNA, 17 bp, Homo sapiens
gctcttgatacccccct

SEQ ID NO: 1590027 - DNA, 19 bp, Homo sapiens
gctcttgatacccccctct

SEQ ID NO: 1590028 - DNA, 20 bp, Homo sapiens
gctcttgatacccccctctg

SEQ ID NO: 1590029 - DNA, 17 bp, Homo sapiens
gctcttgcccttccctg

SEQ ID NO: 1590030 - DNA, 18 bp, Homo sapiens
gctcttgcccttccctgt

SEQ ID NO: 1590031 - DNA, 17 bp, Homo sapiens
gctcttggaagagctct

SEQ ID NO: 1590032 - DNA, 14 bp, Homo sapiens
gctcttggcccctg

SEQ ID NO: 1590033 - DNA, 15 bp, Homo sapiens
gctcttggtccctgg

SEQ ID NO: 1590034 - DNA, 19 bp, Homo sapiens
gctcttggtccctggtccc

SEQ ID NO: 1590035 - DNA, 20 bp, Homo sapiens
gctctttccaaattaaaaca

SEQ ID NO: 1590036 - DNA, 14 bp, Homo sapiens
gctctttcccagga

SEQ ID NO: 1590037 - DNA, 15 bp, Homo sapiens
gctctttcccaggac

SEQ ID NO: 1590038 - DNA, 18 bp, Homo sapiens
gctctttctctgccagtg

SEQ ID NO: 1590039 - DNA, 23 bp, Homo sapiens
gctctttgaaatagtctgtgtga

SEQ ID NO: 1590040 - DNA, 23 bp, Homo sapiens
gctctttgagaactgcttctaag

SEQ ID NO: 1590041 - DNA, 14 bp, Homo sapiens
gctctttgtggcag

SEQ ID NO: 1590042 - DNA, 13 bp, Homo sapiens
gctcttttcctgg

SEQ ID NO: 1590043 - DNA, 19 bp, Homo sapiens
gctcttttcctggtgctct

SEQ ID NO: 1590044 - DNA, 13 bp, Homo sapiens
gctcttttgcaca

SEQ ID NO: 1590045 - DNA, 14 bp, Homo sapiens
gctcttttgtgatg

SEQ ID NO: 1590046 - DNA, 15 bp, Homo sapiens
gctcttttgtgatga

SEQ ID NO: 1590047 - DNA, 12 bp, Homo sapiens
gctctttttgtg

SEQ ID NO: 1590048 - DNA, 15 bp, Homo sapiens
gctgaaaagggcact

SEQ ID NO: 1590049 - DNA, 19 bp, Homo sapiens
gctgaaaatcaaagtaaaa

SEQ ID NO: 1590050 - DNA, 20 bp, Homo sapiens
gctgaaaatgcaaagctgaa

SEQ ID NO: 1590051 - DNA, 21 bp, Homo sapiens
gctgaaaatgcaaagctgaag

SEQ ID NO: 1590052 - DNA, 22 bp, Homo sapiens
gctgaaaattgcctttctgtgt

SEQ ID NO: 1590053 - DNA, 20 bp, Homo sapiens
gctgaaacattccgaagagg

SEQ ID NO: 1590054 - DNA, 11 bp, Homo sapiens
gctgaaattga

SEQ ID NO: 1590055 - DNA, 17 bp, Homo sapiens
gctgaaattttagaaat

SEQ ID NO: 1590056 - DNA, 19 bp, Homo sapiens
gctgaaattttagaaatat

SEQ ID NO: 1590057 - DNA, 17 bp, Homo sapiens
gctgaaattttatatgc

SEQ ID NO: 1590058 - DNA, 19 bp, Homo sapiens
gctgaacacagtgtctgtt

SEQ ID NO: 1590059 - DNA, 22 bp, Homo sapiens
gctgaacacagtgtctgttcag

SEQ ID NO: 1590060 - DNA, 22 bp, Homo sapiens
gctgaacagtggaggaagaggg

SEQ ID NO: 1590061 - DNA, 13 bp, Homo sapiens
gctgaaccctgtg

SEQ ID NO: 1590062 - DNA, 16 bp, Homo sapiens
gctgaaccctgtgctg

SEQ ID NO: 1590063 - DNA, 20 bp, Homo sapiens
gctgaaccctgtgctggtgt

SEQ ID NO: 1590064 - DNA, 19 bp, Homo sapiens
gctgaactcagcacattcg

SEQ ID NO: 1590065 - DNA, 15 bp, Homo sapiens
gctgaactccttgtt

SEQ ID NO: 1590066 - DNA, 15 bp, Homo sapiens
gctgaactcttcaga

SEQ ID NO: 1590067 - DNA, 16 bp, Homo sapiens
gctgaagaatgaagac

SEQ ID NO: 1590068 - DNA, 19 bp, Homo sapiens
gctgaagacatgtttcaag

SEQ ID NO: 1590069 - DNA, 19 bp, Homo sapiens
gctgaagaccatggatttc

SEQ ID NO: 1590070 - DNA, 18 bp, Homo sapiens
gctgaagatgaatcaatg

SEQ ID NO: 1590071 - DNA, 14 bp, Homo sapiens
gctgaagctgctgc

SEQ ID NO: 1590072 - DNA, 16 bp, Homo sapiens
gctgaagctggagcag

SEQ ID NO: 1590073 - DNA, 19 bp, Homo sapiens
gctgaagtgttctctagaa

SEQ ID NO: 1590074 - DNA, 14 bp, Homo sapiens
gctgaagttctgag

SEQ ID NO: 1590075 - DNA, 20 bp, Homo sapiens
gctgaatgtatgtcagtgct

SEQ ID NO: 1590076 - DNA, 24 bp, Homo sapiens
gctgaatttccctctctcataccc

SEQ ID NO: 1590077 - DNA, 19 bp, Homo sapiens
gctgacacctaccatgctg

SEQ ID NO: 1590078 - DNA, 22 bp, Homo sapiens
gctgacatcttgaatccttcca

SEQ ID NO: 1590079 - DNA, 14 bp, Homo sapiens
gctgacatcttgca

SEQ ID NO: 1590080 - DNA, 17 bp, Homo sapiens
gctgacatgaagctgtt

SEQ ID NO: 1590081 - DNA, 20 bp, Homo sapiens
gctgaccaagagagaaagaa

SEQ ID NO: 1590082 - DNA, 16 bp, Homo sapiens
gctgaccaattgtgct

SEQ ID NO: 1590083 - DNA, 20 bp, Homo sapiens
gctgaccaattgtgctgcca

SEQ ID NO: 1590084 - DNA, 22 bp, Homo sapiens
gctgacccagccccttgagaaa

SEQ ID NO: 1590085 - DNA, 13 bp, Homo sapiens
gctgacccagtcc

SEQ ID NO: 1590086 - DNA, 21 bp, Homo sapiens
gctgacccctctggtgtgtgg

SEQ ID NO: 1590087 - DNA, 20 bp, Homo sapiens
gctgagagccccagctgaca

SEQ ID NO: 1590088 - DNA, 17 bp, Homo sapiens
gctgagagccctgctgt

SEQ ID NO: 1590089 - DNA, 22 bp, Homo sapiens
gctgagaggcagacttccctga

SEQ ID NO: 1590090 - DNA, 21 bp, Homo sapiens
gctgagcaaatattaaaattg

SEQ ID NO: 1590091 - DNA, 20 bp, Homo sapiens
gctgagcacttagcaggcac

SEQ ID NO: 1590092 - DNA, 19 bp, Homo sapiens
gctgagcatggggcgctcc

SEQ ID NO: 1590093 - DNA, 22 bp, Homo sapiens
gctgagcatggggcgctcccac

SEQ ID NO: 1590094 - DNA, 12 bp, Homo sapiens
gctgagccactc

SEQ ID NO: 1590095 - DNA, 16 bp, Homo sapiens
gctgagccactcgcag

SEQ ID NO: 1590096 - DNA, 22 bp, Homo sapiens
gctgagccccccatgcccctcc

SEQ ID NO: 1590097 - DNA, 21 bp, Homo sapiens
gctgagcccctaccccacacc

SEQ ID NO: 1590098 - DNA, 11 bp, Homo sapiens
gctgagccctg

SEQ ID NO: 1590099 - DNA, 13 bp, Homo sapiens
gctgagccctggc

SEQ ID NO: 1590100 - DNA, 14 bp, Homo sapiens
gctgagccctggca

SEQ ID NO: 1590101 - DNA, 19 bp, Homo sapiens
gctgagcctctgctcccca

SEQ ID NO: 1590102 - DNA, 17 bp, Homo sapiens
gctgagcctgaggcctt

SEQ ID NO: 1590103 - DNA, 21 bp, Homo sapiens
gctgagcctgaggccttccag

SEQ ID NO: 1590104 - DNA, 15 bp, Homo sapiens
gctgagcctggctgg

SEQ ID NO: 1590105 - DNA, 14 bp, Homo sapiens
gctgagctggggaa

SEQ ID NO: 1590106 - DNA, 18 bp, Homo sapiens
gctgagcttgagctcccc

SEQ ID NO: 1590107 - DNA, 13 bp, Homo sapiens
gctgaggacgaga

SEQ ID NO: 1590108 - DNA, 14 bp, Homo sapiens
gctgaggacgagac

SEQ ID NO: 1590109 - DNA, 18 bp, Homo sapiens
gctgaggagtgaggaata

SEQ ID NO: 1590110 - DNA, 19 bp, Homo sapiens
gctgaggatttcaagcctg

SEQ ID NO: 1590111 - DNA, 12 bp, Homo sapiens
gctgaggcagga

SEQ ID NO: 1590112 - DNA, 15 bp, Homo sapiens
gctgaggccacccac

SEQ ID NO: 1590113 - DNA, 19 bp, Homo sapiens
gctgaggccagggctgatg

SEQ ID NO: 1590114 - DNA, 17 bp, Homo sapiens
gctgaggcccagcccct

SEQ ID NO: 1590115 - DNA, 21 bp, Homo sapiens
gctgaggcccagcccctccag

SEQ ID NO: 1590116 - DNA, 13 bp, Homo sapiens
gctgaggccccta

SEQ ID NO: 1590117 - DNA, 13 bp, Homo sapiens
gctgaggcctggg

SEQ ID NO: 1590118 - DNA, 23 bp, Homo sapiens
gctgaggcctgggccgctgccac

SEQ ID NO: 1590119 - DNA, 21 bp, Homo sapiens
gctgaggccttatcattcatt

SEQ ID NO: 1590120 - DNA, 16 bp, Homo sapiens
gctgagggaccagcca

SEQ ID NO: 1590121 - DNA, 21 bp, Homo sapiens
gctgagggccctgtggagtcc

SEQ ID NO: 1590122 - DNA, 12 bp, Homo sapiens
gctgagggcctg

SEQ ID NO: 1590123 - DNA, 13 bp, Homo sapiens
gctgagggcctgc

SEQ ID NO: 1590124 - DNA, 16 bp, Homo sapiens
gctgagggcctgctgg

SEQ ID NO: 1590125 - DNA, 18 bp, Homo sapiens
gctgagggcctgctggag

SEQ ID NO: 1590126 - DNA, 22 bp, Homo sapiens
gctgaggggaggatcactggag

SEQ ID NO: 1590127 - DNA, 19 bp, Homo sapiens
gctgagggtgtttcttcct

SEQ ID NO: 1590128 - DNA, 17 bp, Homo sapiens
gctgaggtctcttgagg

SEQ ID NO: 1590129 - DNA, 22 bp, Homo sapiens
gctgaggtggtaggatcacctg

SEQ ID NO: 1590130 - DNA, 23 bp, Homo sapiens
gctgaggtggtaggatcacctga

SEQ ID NO: 1590131 - DNA, 18 bp, Homo sapiens
gctgaggttcctctgcct

SEQ ID NO: 1590132 - DNA, 19 bp, Homo sapiens
gctgaggttcctctgcctg

SEQ ID NO: 1590133 - DNA, 21 bp, Homo sapiens
gctgaggttcctctgcctgcc

SEQ ID NO: 1590134 - DNA, 23 bp, Homo sapiens
gctgaggttcctctgcctgcccc

SEQ ID NO: 1590135 - DNA, 21 bp, Homo sapiens
gctgagtatgttaagctcttt

SEQ ID NO: 1590136 - DNA, 17 bp, Homo sapiens
gctgagtcacctcctcc

SEQ ID NO: 1590137 - DNA, 18 bp, Homo sapiens
gctgagtcacctcctcca

SEQ ID NO: 1590138 - DNA, 22 bp, Homo sapiens
gctgagtcacctcctccactca

SEQ ID NO: 1590139 - DNA, 15 bp, Homo sapiens
gctgagtcatctgtt

SEQ ID NO: 1590140 - DNA, 17 bp, Homo sapiens
gctgagtccagagcttg

SEQ ID NO: 1590141 - DNA, 18 bp, Homo sapiens
gctgagtctccagggccc

SEQ ID NO: 1590142 - DNA, 19 bp, Homo sapiens
gctgagtggaatgcaggga

SEQ ID NO: 1590143 - DNA, 15 bp, Homo sapiens
gctgagtggcagcag

SEQ ID NO: 1590144 - DNA, 14 bp, Homo sapiens
gctgagttggcctg

SEQ ID NO: 1590145 - DNA, 23 bp, Homo sapiens
gctgagttggcctggccatttcc

SEQ ID NO: 1590146 - DNA, 13 bp, Homo sapiens
gctgagtttccta

SEQ ID NO: 1590147 - DNA, 16 bp, Homo sapiens
gctgatatcaacagct

SEQ ID NO: 1590148 - DNA, 18 bp, Homo sapiens
gctgatattatttcttct

SEQ ID NO: 1590149 - DNA, 22 bp, Homo sapiens
gctgatcatcgccagaggtgct

SEQ ID NO: 1590150 - DNA, 24 bp, Homo sapiens
gctgatccataggactaccgcagg

SEQ ID NO: 1590151 - DNA, 23 bp, Homo sapiens
gctgatcccggccggccctggct

SEQ ID NO: 1590152 - DNA, 20 bp, Homo sapiens
gctgatccctgctctctgag

SEQ ID NO: 1590153 - DNA, 13 bp, Homo sapiens
gctgatcctgctg

SEQ ID NO: 1590154 - DNA, 14 bp, Homo sapiens
gctgatcctgctga

SEQ ID NO: 1590155 - DNA, 15 bp, Homo sapiens
gctgatcctgctgac

SEQ ID NO: 1590156 - DNA, 14 bp, Homo sapiens
gctgatctcaggga

SEQ ID NO: 1590157 - DNA, 16 bp, Homo sapiens
gctgatctcagggaag

SEQ ID NO: 1590158 - DNA, 13 bp, Homo sapiens
gctgatgaagaag

SEQ ID NO: 1590159 - DNA, 15 bp, Homo sapiens
gctgatgaagaaggg

SEQ ID NO: 1590160 - DNA, 14 bp, Homo sapiens
gctgatgatatatt

SEQ ID NO: 1590161 - DNA, 14 bp, Homo sapiens
gctgatgatccaga

SEQ ID NO: 1590162 - DNA, 17 bp, Homo sapiens
gctgatggagccccacc

SEQ ID NO: 1590163 - DNA, 13 bp, Homo sapiens
gctgatggaggaa

SEQ ID NO: 1590164 - DNA, 13 bp, Homo sapiens
gctgatggcccct

SEQ ID NO: 1590165 - DNA, 20 bp, Homo sapiens
gctgatggcccctccagcac

SEQ ID NO: 1590166 - DNA, 21 bp, Homo sapiens
gctgatggcccctccagcaca

SEQ ID NO: 1590167 - DNA, 20 bp, Homo sapiens
gctgatgtcaatttctgtgt

SEQ ID NO: 1590168 - DNA, 23 bp, Homo sapiens
gctgatgtcaatttctgtgttgc

SEQ ID NO: 1590169 - DNA, 19 bp, Homo sapiens
gctgattcttgtaaatctt

SEQ ID NO: 1590170 - DNA, 15 bp, Homo sapiens
gctgatttccaggcc

SEQ ID NO: 1590171 - DNA, 16 bp, Homo sapiens
gctgatttccaggccc

SEQ ID NO: 1590172 - DNA, 18 bp, Homo sapiens
gctgatttccaggcccct

SEQ ID NO: 1590173 - DNA, 20 bp, Homo sapiens
gctgatttccaggcccctga

SEQ ID NO: 1590174 - DNA, 17 bp, Homo sapiens
gctgattttattcttga

SEQ ID NO: 1590175 - DNA, 18 bp, Homo sapiens
gctgattttattcttgat

SEQ ID NO: 1590176 - DNA, 18 bp, Homo sapiens
gctgcaaaggagaagcac

SEQ ID NO: 1590177 - DNA, 18 bp, Homo sapiens
gctgcaaggtggcctctg

SEQ ID NO: 1590178 - DNA, 19 bp, Homo sapiens
gctgcaaggtggcctctgc

SEQ ID NO: 1590179 - DNA, 23 bp, Homo sapiens
gctgcaaggtggcctctgcctgg

SEQ ID NO: 1590180 - DNA, 16 bp, Homo sapiens
gctgcaatgagccatg

SEQ ID NO: 1590181 - DNA, 17 bp, Homo sapiens
gctgcacaaaagcagat

SEQ ID NO: 1590182 - DNA, 17 bp, Homo sapiens
gctgcacaggccctggg

SEQ ID NO: 1590183 - DNA, 14 bp, Homo sapiens
gctgcacattcctg

SEQ ID NO: 1590184 - DNA, 19 bp, Homo sapiens
gctgcacattcctggcccc

SEQ ID NO: 1590185 - DNA, 13 bp, Homo sapiens
gctgcaccagagt

SEQ ID NO: 1590186 - DNA, 15 bp, Homo sapiens
gctgcaccctgcgcc

SEQ ID NO: 1590187 - DNA, 20 bp, Homo sapiens
gctgcaccctgcgcctccag

SEQ ID NO: 1590188 - DNA, 23 bp, Homo sapiens
gctgcaccctgcgcctccagagg

SEQ ID NO: 1590189 - DNA, 18 bp, Homo sapiens
gctgcacctctggctaga

SEQ ID NO: 1590190 - DNA, 21 bp, Homo sapiens
gctgcacctctggctagagcc

SEQ ID NO: 1590191 - DNA, 15 bp, Homo sapiens
gctgcactgcagtga

SEQ ID NO: 1590192 - DNA, 11 bp, Homo sapiens
gctgcactgtg

SEQ ID NO: 1590193 - DNA, 15 bp, Homo sapiens
gctgcactgtgaacc

SEQ ID NO: 1590194 - DNA, 21 bp, Homo sapiens
gctgcactgtgaacctgggca

SEQ ID NO: 1590195 - DNA, 20 bp, Homo sapiens
gctgcagagaaacttaagca

SEQ ID NO: 1590196 - DNA, 18 bp, Homo sapiens
gctgcagagatttctcat

SEQ ID NO: 1590197 - DNA, 20 bp, Homo sapiens
gctgcagataagtggccttg

SEQ ID NO: 1590198 - DNA, 22 bp, Homo sapiens
gctgcagcatgttgctgaggag

SEQ ID NO: 1590199 - DNA, 21 bp, Homo sapiens
gctgcagcctgcgccaccgcc

SEQ ID NO: 1590200 - DNA, 22 bp, Homo sapiens
gctgcagcgcccggtgctctgt

SEQ ID NO: 1590201 - DNA, 22 bp, Homo sapiens
gctgcagctgggccccatgctc

SEQ ID NO: 1590202 - DNA, 14 bp, Homo sapiens
gctgcaggaagaaa

SEQ ID NO: 1590203 - DNA, 18 bp, Homo sapiens
gcttcattcaatattgac

SEQ ID NO: 1590204 - DNA, 22 bp, Homo sapiens
gcttcattccaaatgctttcag

SEQ ID NO: 1590205 - DNA, 22 bp, Homo sapiens
gcttcattccggactggcagaa

SEQ ID NO: 1590206 - DNA, 13 bp, Homo sapiens
gcttccaaagcct

SEQ ID NO: 1590207 - DNA, 15 bp, Homo sapiens
gcttccaaatattgt

SEQ ID NO: 1590208 - DNA, 19 bp, Homo sapiens
gcttccagaaaaccccagc

SEQ ID NO: 1590209 - DNA, 23 bp, Homo sapiens
gcttccagattgacgacaagtgc

SEQ ID NO: 1590210 - DNA, 12 bp, Homo sapiens
gcttccaggctg

SEQ ID NO: 1590211 - DNA, 15 bp, Homo sapiens
gcttccaggctgggc

SEQ ID NO: 1590212 - DNA, 17 bp, Homo sapiens
gcttccatgagaacagc

SEQ ID NO: 1590213 - DNA, 11 bp, Homo sapiens
gcttccatgcc

SEQ ID NO: 1590214 - DNA, 12 bp, Homo sapiens
gcttccattcca

SEQ ID NO: 1590215 - DNA, 17 bp, Homo sapiens
gcttcccacacctgcct

SEQ ID NO: 1590216 - DNA, 22 bp, Homo sapiens
gcttcccacacctgcctgcgtt

SEQ ID NO: 1590217 - DNA, 13 bp, Homo sapiens
gcttcccactggg

SEQ ID NO: 1590218 - DNA, 16 bp, Homo sapiens
gcttcccactggggcc

SEQ ID NO: 1590219 - DNA, 17 bp, Homo sapiens
gcttcccatcctaccct

SEQ ID NO: 1590220 - DNA, 22 bp, Homo sapiens
gcttcccatcctaccctcgggc

SEQ ID NO: 1590221 - DNA, 17 bp, Homo sapiens
gcttcccccacccctcc

SEQ ID NO: 1590222 - DNA, 18 bp, Homo sapiens
gcttcccccacccctcca

SEQ ID NO: 1590223 - DNA, 19 bp, Homo sapiens
gcttcccccacccctccac

SEQ ID NO: 1590224 - DNA, 19 bp, Homo sapiens
gcttccccctccccctcct

SEQ ID NO: 1590225 - DNA, 21 bp, Homo sapiens
gcttccccctccccctcctgc

SEQ ID NO: 1590226 - DNA, 23 bp, Homo sapiens
gcttccccctccccctcctgctg

SEQ ID NO: 1590227 - DNA, 23 bp, Homo sapiens
gcttcccgctcagccctccctgc

SEQ ID NO: 1590228 - DNA, 15 bp, Homo sapiens
gcttccctccatccc

SEQ ID NO: 1590229 - DNA, 14 bp, Homo sapiens
gcttccctgtccca

SEQ ID NO: 1590230 - DNA, 15 bp, Homo sapiens
gcttccctgtcccag

SEQ ID NO: 1590231 - DNA, 21 bp, Homo sapiens
gcttcccttctccccagccag

SEQ ID NO: 1590232 - DNA, 22 bp, Homo sapiens
gcttcccttctccccagccaga

SEQ ID NO: 1590233 - DNA, 23 bp, Homo sapiens
gcttcccttctccccagccagag

SEQ ID NO: 1590234 - DNA, 22 bp, Homo sapiens
gcttccgagatccccagggcag

SEQ ID NO: 1590235 - DNA, 14 bp, Homo sapiens
gcttccgccactca

SEQ ID NO: 1590236 - DNA, 15 bp, Homo sapiens
gcttccgccactcag

SEQ ID NO: 1590237 - DNA, 17 bp, Homo sapiens
gcttccgccactcagcc

SEQ ID NO: 1590238 - DNA, 18 bp, Homo sapiens
gcttccgctttgaaagaa

SEQ ID NO: 1590239 - DNA, 18 bp, Homo sapiens
gcttcctagaagttactg

SEQ ID NO: 1590240 - DNA, 18 bp, Homo sapiens
gcttcctccgtccaccca

SEQ ID NO: 1590241 - DNA, 20 bp, Homo sapiens
gcttcctccgtccacccagg

SEQ ID NO: 1590242 - DNA, 23 bp, Homo sapiens
gcttcctccgtccacccaggctg

SEQ ID NO: 1590243 - DNA, 12 bp, Homo sapiens
gcttcctcctgg

SEQ ID NO: 1590244 - DNA, 15 bp, Homo sapiens
gcttcctctagaagc

SEQ ID NO: 1590245 - DNA, 17 bp, Homo sapiens
gcttcctctagaagcca

SEQ ID NO: 1590246 - DNA, 22 bp, Homo sapiens
gcttcctctagaagccaaggga

SEQ ID NO: 1590247 - DNA, 21 bp, Homo sapiens
gcttcctcttttcctgctccc

SEQ ID NO: 1590248 - DNA, 18 bp, Homo sapiens
gcttcctgacaatcaact

SEQ ID NO: 1590249 - DNA, 11 bp, Homo sapiens
gcttcctgggt

SEQ ID NO: 1590250 - DNA, 13 bp, Homo sapiens
gcttcctgggtcc

SEQ ID NO: 1590251 - DNA, 20 bp, Homo sapiens
gcttcctgggtcctgcctgg

SEQ ID NO: 1590252 - DNA, 16 bp, Homo sapiens
gcttcctggtgagaac

SEQ ID NO: 1590253 - DNA, 17 bp, Homo sapiens
gcttccttcagtttgta

SEQ ID NO: 1590254 - DNA, 15 bp, Homo sapiens
gcttccttctgggac

SEQ ID NO: 1590255 - DNA, 16 bp, Homo sapiens
gcttcctttcaggcca

SEQ ID NO: 1590256 - DNA, 13 bp, Homo sapiens
gcttcctttctct

SEQ ID NO: 1590257 - DNA, 20 bp, Homo sapiens
gcttcctttctctcctggct

SEQ ID NO: 1590258 - DNA, 19 bp, Homo sapiens
gcttcggagggcccctgcg

SEQ ID NO: 1590259 - DNA, 18 bp, Homo sapiens
gcttgccaaggcagaggc

SEQ ID NO: 1590260 - DNA, 20 bp, Homo sapiens
gcttgccaaggcagaggcct

SEQ ID NO: 1590261 - DNA, 20 bp, Homo sapiens
gcttgccgagcctaatgaaa

SEQ ID NO: 1590262 - DNA, 16 bp, Homo sapiens
gcttgccgggcctggg

SEQ ID NO: 1590263 - DNA, 22 bp, Homo sapiens
gcttgcctgcagggccatggct

SEQ ID NO: 1590264 - DNA, 18 bp, Homo sapiens
gcttgcggcaaaaggaaa

SEQ ID NO: 1590265 - DNA, 21 bp, Homo sapiens
gcttgctccagattctgatgc

SEQ ID NO: 1590266 - DNA, 23 bp, Homo sapiens
gcttgctcttcagtgggagaaaa

SEQ ID NO: 1590267 - DNA, 12 bp, Homo sapiens
gcttgcttgccg

SEQ ID NO: 1590268 - DNA, 21 bp, Homo sapiens
gcttggaaagcatcacctcag

SEQ ID NO: 1590269 - DNA, 14 bp, Homo sapiens
gcttggactacaca

SEQ ID NO: 1590270 - DNA, 11 bp, Homo sapiens
gcttggagcaa

SEQ ID NO: 1590271 - DNA, 15 bp, Homo sapiens
gcttggatcctgggc

SEQ ID NO: 1590272 - DNA, 20 bp, Homo sapiens
gcttggcaattcatggggca

SEQ ID NO: 1590273 - DNA, 23 bp, Homo sapiens
gcttggccctctttcctctgtgg

SEQ ID NO: 1590274 - DNA, 15 bp, Homo sapiens
gcttggccctttcct

SEQ ID NO: 1590275 - DNA, 15 bp, Homo sapiens
gcttggcctgctgtg

SEQ ID NO: 1590276 - DNA, 18 bp, Homo sapiens
gcttggctggtgtatgca

SEQ ID NO: 1590277 - DNA, 14 bp, Homo sapiens
gcttggctgtagga

SEQ ID NO: 1590278 - DNA, 15 bp, Homo sapiens
gcttgggcccagctg

SEQ ID NO: 1590279 - DNA, 17 bp, Homo sapiens
gcttgggcccagctggg

SEQ ID NO: 1590280 - DNA, 18 bp, Homo sapiens
gcttgggcccagctgggc

SEQ ID NO: 1590281 - DNA, 20 bp, Homo sapiens
gcttgggcccagctgggctc

SEQ ID NO: 1590282 - DNA, 13 bp, Homo sapiens
gcttgggccctgc

SEQ ID NO: 1590283 - DNA, 15 bp, Homo sapiens
gcttgggccctgcac

SEQ ID NO: 1590284 - DNA, 16 bp, Homo sapiens
gcttgggccctgcaca

SEQ ID NO: 1590285 - DNA, 17 bp, Homo sapiens
gcttgggccctgcattg

SEQ ID NO: 1590286 - DNA, 17 bp, Homo sapiens
gcttgggctgacccagc

SEQ ID NO: 1590287 - DNA, 18 bp, Homo sapiens
gcttgggctgacccagca

SEQ ID NO: 1590288 - DNA, 23 bp, Homo sapiens
gcttggggccaccaaagctgccc

SEQ ID NO: 1590289 - DNA, 16 bp, Homo sapiens
gcttggggctatttgt

SEQ ID NO: 1590290 - DNA, 20 bp, Homo sapiens
gcttggggctcacacacctg

SEQ ID NO: 1590291 - DNA, 20 bp, Homo sapiens
gcttggggtgtggggtgggg

SEQ ID NO: 1590292 - DNA, 23 bp, Homo sapiens
gcttgggtgtaacaggtctcctc

SEQ ID NO: 1590293 - DNA, 24 bp, Homo sapiens
gcttggtagttaacacatcaaata

SEQ ID NO: 1590294 - DNA, 21 bp, Homo sapiens
gcttggtccctatgggcttcc

SEQ ID NO: 1590295 - DNA, 22 bp, Homo sapiens
gcttggtccctatgggcttccg

SEQ ID NO: 1590296 - DNA, 13 bp, Homo sapiens
gcttggtctgttt

SEQ ID NO: 1590297 - DNA, 15 bp, Homo sapiens
gcttggtctgtttga

SEQ ID NO: 1590298 - DNA, 17 bp, Homo sapiens
gcttggttccaggaatt

SEQ ID NO: 1590299 - DNA, 17 bp, Homo sapiens
gcttgtaacaagaaaac

SEQ ID NO: 1590300 - DNA, 18 bp, Homo sapiens
gcttgtaacaagaaaaca

SEQ ID NO: 1590301 - DNA, 15 bp, Homo sapiens
gcttgtaactccacc

SEQ ID NO: 1590302 - DNA, 22 bp, Homo sapiens
gcttgtaactccaccaacccat

SEQ ID NO: 1590303 - DNA, 15 bp, Homo sapiens
gcttgtactgggaca

SEQ ID NO: 1590304 - DNA, 19 bp, Homo sapiens
gcttgtagaactcactctg

SEQ ID NO: 1590305 - DNA, 22 bp, Homo sapiens
gcttgtcatccacacaacacca

SEQ ID NO: 1590306 - DNA, 15 bp, Homo sapiens
gcttgtcctgctctc

SEQ ID NO: 1590307 - DNA, 21 bp, Homo sapiens
gcttgtcctgctctcttcagg

SEQ ID NO: 1590308 - DNA, 18 bp, Homo sapiens
gcttgtcctgggcctgcc

SEQ ID NO: 1590309 - DNA, 18 bp, Homo sapiens
gcttgtgaaaatgtgttc

SEQ ID NO: 1590310 - DNA, 16 bp, Homo sapiens
gcttgtgacagtgcct

SEQ ID NO: 1590311 - DNA, 13 bp, Homo sapiens
gctttctcttcat

SEQ ID NO: 1590312 - DNA, 17 bp, Homo sapiens
gctttctgcctctcctc

SEQ ID NO: 1590313 - DNA, 21 bp, Homo sapiens
gctttctgggatgtcacagtc

SEQ ID NO: 1590314 - DNA, 17 bp, Homo sapiens
gctttctgggtgtgtcc

SEQ ID NO: 1590315 - DNA, 20 bp, Homo sapiens
gctttctgggtgtgtccagg

SEQ ID NO: 1590316 - DNA, 21 bp, Homo sapiens
gctttctttcacaaaaaagaa

SEQ ID NO: 1590317 - DNA, 23 bp, Homo sapiens
gctttctttggtaggtaaatcta

SEQ ID NO: 1590318 - DNA, 15 bp, Homo sapiens
gctttgaaaatattt

SEQ ID NO: 1590319 - DNA, 16 bp, Homo sapiens
gctttgaaagaagcaa

SEQ ID NO: 1590320 - DNA, 14 bp, Homo sapiens
gctttgagttgact

SEQ ID NO: 1590321 - DNA, 15 bp, Homo sapiens
gctttgatccctgac

SEQ ID NO: 1590322 - DNA, 12 bp, Homo sapiens
gctttgcaaaga

SEQ ID NO: 1590323 - DNA, 14 bp, Homo sapiens
gctttgcaaagacc

SEQ ID NO: 1590324 - DNA, 22 bp, Homo sapiens
gctttgcaatatttattacaca

SEQ ID NO: 1590325 - DNA, 22 bp, Homo sapiens
gctttgcaccgtggtcagaggg

SEQ ID NO: 1590326 - DNA, 15 bp, Homo sapiens
gctttgcaggctctg

SEQ ID NO: 1590327 - DNA, 19 bp, Homo sapiens
gctttgcaggctctgggct

SEQ ID NO: 1590328 - DNA, 21 bp, Homo sapiens
gctttgcaggctctgggctca

SEQ ID NO: 1590329 - DNA, 22 bp, Homo sapiens
gctttgcaggctctgggctcag

SEQ ID NO: 1590330 - DNA, 12 bp, Homo sapiens
gctttgcagtga

SEQ ID NO: 1590331 - DNA, 22 bp, Homo sapiens
gctttgcattcctacaaagatg

SEQ ID NO: 1590332 - DNA, 12 bp, Homo sapiens
gctttgccaaaa

SEQ ID NO: 1590333 - DNA, 17 bp, Homo sapiens
gctttgccaaaatacca

SEQ ID NO: 1590334 - DNA, 18 bp, Homo sapiens
gctttgccaaaataccag

SEQ ID NO: 1590335 - DNA, 13 bp, Homo sapiens
gctttgccagagc

SEQ ID NO: 1590336 - DNA, 14 bp, Homo sapiens
gctttgccagagca

SEQ ID NO: 1590337 - DNA, 15 bp, Homo sapiens
gctttgccagagcag

SEQ ID NO: 1590338 - DNA, 18 bp, Homo sapiens
gctttgcccacccctcac

SEQ ID NO: 1590339 - DNA, 11 bp, Homo sapiens
gctttgcctct

SEQ ID NO: 1590340 - DNA, 19 bp, Homo sapiens
gctttgcgctggtggacca

SEQ ID NO: 1590341 - DNA, 23 bp, Homo sapiens
gctttgctacaaatttatgcatt

SEQ ID NO: 1590342 - DNA, 18 bp, Homo sapiens
gctttgctccgctcccac

SEQ ID NO: 1590343 - DNA, 23 bp, Homo sapiens
gctttgctccgctcccaccgccc

SEQ ID NO: 1590344 - DNA, 16 bp, Homo sapiens
gctttgctgctacagg

SEQ ID NO: 1590345 - DNA, 22 bp, Homo sapiens
gctttggacctaaatggcctca

SEQ ID NO: 1590346 - DNA, 17 bp, Homo sapiens
gctttggacctaatcca

SEQ ID NO: 1590347 - DNA, 15 bp, Homo sapiens
gctttggcagtgcca

SEQ ID NO: 1590348 - DNA, 16 bp, Homo sapiens
gctttggcagtgccat

SEQ ID NO: 1590349 - DNA, 19 bp, Homo sapiens
gctttgggaacactggcct

SEQ ID NO: 1590350 - DNA, 22 bp, Homo sapiens
gctttgggaatgtttttagctg

SEQ ID NO: 1590351 - DNA, 19 bp, Homo sapiens
gctttgggctgccctggtg

SEQ ID NO: 1590352 - DNA, 20 bp, Homo sapiens
gctttggggacagttggcag

SEQ ID NO: 1590353 - DNA, 21 bp, Homo sapiens
gctttggggggtgtgctgaca

SEQ ID NO: 1590354 - DNA, 23 bp, Homo sapiens
gctttgggtggctcactactgaa

SEQ ID NO: 1590355 - DNA, 15 bp, Homo sapiens
gctttggtttatatt

SEQ ID NO: 1590356 - DNA, 19 bp, Homo sapiens
gctttgtcgtatttggcac

SEQ ID NO: 1590357 - DNA, 14 bp, Homo sapiens
gctttgtctgtcgt

SEQ ID NO: 1590358 - DNA, 22 bp, Homo sapiens
ggaaagggctggctgcaattgc

SEQ ID NO: 1590359 - DNA, 19 bp, Homo sapiens
ggaaaggggacaaggaagg

SEQ ID NO: 1590360 - DNA, 14 bp, Homo sapiens
ggaaaggggagagc

SEQ ID NO: 1590361 - DNA, 20 bp, Homo sapiens
ggaaaggggtcggctgacca

SEQ ID NO: 1590362 - DNA, 21 bp, Homo sapiens
ggaaagtacattttttgaaat

SEQ ID NO: 1590363 - DNA, 22 bp, Homo sapiens
ggaaagtcacccaaacacttct

SEQ ID NO: 1590364 - DNA, 21 bp, Homo sapiens
ggaaagtgtgagctcttccct

SEQ ID NO: 1590365 - DNA, 17 bp, Homo sapiens
ggaaagttactgtaaat

SEQ ID NO: 1590366 - DNA, 15 bp, Homo sapiens
ggaaatagcatgaca

SEQ ID NO: 1590367 - DNA, 14 bp, Homo sapiens
ggaaatatatatgt

SEQ ID NO: 1590368 - DNA, 13 bp, Homo sapiens
ggaaatccagata

SEQ ID NO: 1590369 - DNA, 16 bp, Homo sapiens
ggaaatgggaaaaaac

SEQ ID NO: 1590370 - DNA, 23 bp, Homo sapiens
ggaaatgggaaaaaacttaaaaa

SEQ ID NO: 1590371 - DNA, 16 bp, Homo sapiens
ggaaattcctgtactg

SEQ ID NO: 1590372 - DNA, 17 bp, Homo sapiens
ggaaattgtttatgtgt

SEQ ID NO: 1590373 - DNA, 11 bp, Homo sapiens
ggaaatttttc

SEQ ID NO: 1590374 - DNA, 14 bp, Homo sapiens
ggaacaaacagggc

SEQ ID NO: 1590375 - DNA, 16 bp, Homo sapiens
ggaacaatctttgctg

SEQ ID NO: 1590376 - DNA, 15 bp, Homo sapiens
ggaacaattgaagta

SEQ ID NO: 1590377 - DNA, 19 bp, Homo sapiens
ggaacaattgaagtaaact

SEQ ID NO: 1590378 - DNA, 13 bp, Homo sapiens
ggaacaccctgga

SEQ ID NO: 1590379 - DNA, 14 bp, Homo sapiens
ggaacaccctggat

SEQ ID NO: 1590380 - DNA, 16 bp, Homo sapiens
ggaacaccctggatgc

SEQ ID NO: 1590381 - DNA, 19 bp, Homo sapiens
ggaacaccctggatgctgt

SEQ ID NO: 1590382 - DNA, 21 bp, Homo sapiens
ggaacagacaacagaagtcat

SEQ ID NO: 1590383 - DNA, 15 bp, Homo sapiens
ggaacagacaggaga

SEQ ID NO: 1590384 - DNA, 17 bp, Homo sapiens
ggaacagacaggagaaa

SEQ ID NO: 1590385 - DNA, 17 bp, Homo sapiens
ggaacagcactggggag

SEQ ID NO: 1590386 - DNA, 19 bp, Homo sapiens
ggaacagctatgggagccc

SEQ ID NO: 1590387 - DNA, 20 bp, Homo sapiens
ggaacagctatgggagcccc

SEQ ID NO: 1590388 - DNA, 21 bp, Homo sapiens
ggaacagtaaagaaagcagaa

SEQ ID NO: 1590389 - DNA, 18 bp, Homo sapiens
ggaacagtgtttcccata

SEQ ID NO: 1590390 - DNA, 18 bp, Homo sapiens
ggaacatggctggcctgg

SEQ ID NO: 1590391 - DNA, 11 bp, Homo sapiens
ggaacatttct

SEQ ID NO: 1590392 - DNA, 12 bp, Homo sapiens
ggaacatttctt

SEQ ID NO: 1590393 - DNA, 14 bp, Homo sapiens
ggaaccacctggac

SEQ ID NO: 1590394 - DNA, 22 bp, Homo sapiens
ggaaccactcccaccacaggca

SEQ ID NO: 1590395 - DNA, 23 bp, Homo sapiens
ggaaccaggagaagggctggggc

SEQ ID NO: 1590396 - DNA, 16 bp, Homo sapiens
ggaaccagggaggaga

SEQ ID NO: 1590397 - DNA, 17 bp, Homo sapiens
ggaaccccgcagcccgt

SEQ ID NO: 1590398 - DNA, 18 bp, Homo sapiens
ggaaccgtgtccagcaca

SEQ ID NO: 1590399 - DNA, 23 bp, Homo sapiens
ggaacctagtactctctgctcta

SEQ ID NO: 1590400 - DNA, 12 bp, Homo sapiens
ggaacctcagcc

SEQ ID NO: 1590401 - DNA, 20 bp, Homo sapiens
ggaacctcattgctaccaca

SEQ ID NO: 1590402 - DNA, 16 bp, Homo sapiens
ggaaccttccttcctg

SEQ ID NO: 1590403 - DNA, 21 bp, Homo sapiens
ggaacgagcactggccagaga

SEQ ID NO: 1590404 - DNA, 20 bp, Homo sapiens
ggaacggctgatgtggactg

SEQ ID NO: 1590405 - DNA, 18 bp, Homo sapiens
ggaacggggtccttcaag

SEQ ID NO: 1590406 - DNA, 14 bp, Homo sapiens
ggaactaaagcaaa

SEQ ID NO: 1590407 - DNA, 13 bp, Homo sapiens
ggaactactgtac

SEQ ID NO: 1590408 - DNA, 18 bp, Homo sapiens
ggaactagataacatact

SEQ ID NO: 1590409 - DNA, 23 bp, Homo sapiens
ggaactaggctcttatgtgtgcc

SEQ ID NO: 1590410 - DNA, 13 bp, Homo sapiens
ggaactatgaaga

SEQ ID NO: 1590411 - DNA, 15 bp, Homo sapiens
ggaactcagatccag

SEQ ID NO: 1590412 - DNA, 16 bp, Homo sapiens
ggaactcagatccagg

SEQ ID NO: 1590413 - DNA, 17 bp, Homo sapiens
ggaactcatctggttga

SEQ ID NO: 1590414 - DNA, 22 bp, Homo sapiens
ggaactcattcctgcctgtctc

SEQ ID NO: 1590415 - DNA, 16 bp, Homo sapiens
ggaactcctggccttt

SEQ ID NO: 1590416 - DNA, 14 bp, Homo sapiens
ggaactcgcctcag

SEQ ID NO: 1590417 - DNA, 16 bp, Homo sapiens
ggaactcgcctcagcc

SEQ ID NO: 1590418 - DNA, 21 bp, Homo sapiens
ggaactctgacaagggctgac

SEQ ID NO: 1590419 - DNA, 15 bp, Homo sapiens
ggaactgaccccctc

SEQ ID NO: 1590420 - DNA, 15 bp, Homo sapiens
ggaactgtcccagct

SEQ ID NO: 1590421 - DNA, 16 bp, Homo sapiens
ggaactgtcctttcct

SEQ ID NO: 1590422 - DNA, 14 bp, Homo sapiens
ggaacttcagagat

SEQ ID NO: 1590423 - DNA, 18 bp, Homo sapiens
ggaagaaacactcttatt

SEQ ID NO: 1590424 - DNA, 17 bp, Homo sapiens
ggaagaaactttctggt

SEQ ID NO: 1590425 - DNA, 14 bp, Homo sapiens
ggaagaaagatttg

SEQ ID NO: 1590426 - DNA, 22 bp, Homo sapiens
ggaagaaattcaggtacagaaa

SEQ ID NO: 1590427 - DNA, 19 bp, Homo sapiens
ggaagaacaacaaagacat

SEQ ID NO: 1590428 - DNA, 14 bp, Homo sapiens
ggaagaacatagaa

SEQ ID NO: 1590429 - DNA, 16 bp, Homo sapiens
ggaagaacatagaact

SEQ ID NO: 1590430 - DNA, 19 bp, Homo sapiens
ggaagaagcaagggcaaga

SEQ ID NO: 1590431 - DNA, 23 bp, Homo sapiens
ggaagcccagcccctactgctgt

SEQ ID NO: 1590432 - DNA, 13 bp, Homo sapiens
ggaagcccaggct

SEQ ID NO: 1590433 - DNA, 14 bp, Homo sapiens
ggaagcccaggctc

SEQ ID NO: 1590434 - DNA, 20 bp, Homo sapiens
ggaagcccatcctgaccagc

SEQ ID NO: 1590435 - DNA, 15 bp, Homo sapiens
ggaagccctccttcc

SEQ ID NO: 1590436 - DNA, 15 bp, Homo sapiens
ggaagccgtctgact

SEQ ID NO: 1590437 - DNA, 18 bp, Homo sapiens
ggaagccgtctgactcca

SEQ ID NO: 1590438 - DNA, 21 bp, Homo sapiens
ggaagccgtctgactccagag

SEQ ID NO: 1590439 - DNA, 22 bp, Homo sapiens
ggaagccgtctgactccagagt

SEQ ID NO: 1590440 - DNA, 22 bp, Homo sapiens
ggaagcctgaactgaggccttg

SEQ ID NO: 1590441 - DNA, 20 bp, Homo sapiens
ggaagcggaggttgcaggga

SEQ ID NO: 1590442 - DNA, 22 bp, Homo sapiens
ggaagcggaggttgcagggagc

SEQ ID NO: 1590443 - DNA, 21 bp, Homo sapiens
ggaagcggccctaagggagtg

SEQ ID NO: 1590444 - DNA, 18 bp, Homo sapiens
ggaagctagacacatgaa

SEQ ID NO: 1590445 - DNA, 22 bp, Homo sapiens
ggaagctagacacatgaaggta

SEQ ID NO: 1590446 - DNA, 13 bp, Homo sapiens
ggaagctcagcct

SEQ ID NO: 1590447 - DNA, 21 bp, Homo sapiens
ggaagctctccgagctctggt

SEQ ID NO: 1590448 - DNA, 23 bp, Homo sapiens
ggaagctctccgagctctggtgc

SEQ ID NO: 1590449 - DNA, 21 bp, Homo sapiens
ggaagctcttttctcctgcag

SEQ ID NO: 1590450 - DNA, 14 bp, Homo sapiens
ggaagctggaagac

SEQ ID NO: 1590451 - DNA, 17 bp, Homo sapiens
ggaagctggcagaacgg

SEQ ID NO: 1590452 - DNA, 18 bp, Homo sapiens
ggaagctggcagaacgga

SEQ ID NO: 1590453 - DNA, 15 bp, Homo sapiens
ggaagctggcctgag

SEQ ID NO: 1590454 - DNA, 13 bp, Homo sapiens
ggaagctgggtga

SEQ ID NO: 1590455 - DNA, 17 bp, Homo sapiens
ggaagctgtactcagag

SEQ ID NO: 1590456 - DNA, 21 bp, Homo sapiens
ggaagctgtgtccttgcacct

SEQ ID NO: 1590457 - DNA, 16 bp, Homo sapiens
ggaagcttgagcctcc

SEQ ID NO: 1590458 - DNA, 17 bp, Homo sapiens
ggaagcttgagcctccc

SEQ ID NO: 1590459 - DNA, 22 bp, Homo sapiens
ggaagcttgttgaaaacccaga

SEQ ID NO: 1590460 - DNA, 11 bp, Homo sapiens
ggaaggacaca

SEQ ID NO: 1590461 - DNA, 19 bp, Homo sapiens
ggaaggacaggaccctcag

SEQ ID NO: 1590462 - DNA, 16 bp, Homo sapiens
ggaaggagaagtaaga

SEQ ID NO: 1590463 - DNA, 12 bp, Homo sapiens
ggaaggagccag

SEQ ID NO: 1590464 - DNA, 13 bp, Homo sapiens
ggaaggagccagt

SEQ ID NO: 1590465 - DNA, 16 bp, Homo sapiens
ggaaggagggagctgc

SEQ ID NO: 1590466 - DNA, 20 bp, Homo sapiens
ggaaggagggttagggaggg

SEQ ID NO: 1590467 - DNA, 14 bp, Homo sapiens
ggaaggatctgctg

SEQ ID NO: 1590468 - DNA, 19 bp, Homo sapiens
ggaaggatctgctgaggcc

SEQ ID NO: 1590469 - DNA, 20 bp, Homo sapiens
ggaaggatgggatctttctg

SEQ ID NO: 1590470 - DNA, 21 bp, Homo sapiens
ggaaggcacccgccctttcct

SEQ ID NO: 1590471 - DNA, 12 bp, Homo sapiens
ggaaggcagctg

SEQ ID NO: 1590472 - DNA, 18 bp, Homo sapiens
ggaaggcagggcagaggg

SEQ ID NO: 1590473 - DNA, 16 bp, Homo sapiens
ggaaggccttccactg

SEQ ID NO: 1590474 - DNA, 21 bp, Homo sapiens
ggaaggctaagttcagttctg

SEQ ID NO: 1590475 - DNA, 14 bp, Homo sapiens
ggaaggctggctga

SEQ ID NO: 1590476 - DNA, 15 bp, Homo sapiens
ggaaggctggctgag

SEQ ID NO: 1590477 - DNA, 23 bp, Homo sapiens
ggaagggacaccaagccttggct

SEQ ID NO: 1590478 - DNA, 16 bp, Homo sapiens
ggaagggaccaaggca

SEQ ID NO: 1590479 - DNA, 20 bp, Homo sapiens
ggaagggaccaaggcaaggc

SEQ ID NO: 1590480 - DNA, 15 bp, Homo sapiens
ggaagggcaggaagg

SEQ ID NO: 1590481 - DNA, 21 bp, Homo sapiens
ggaagggcatgcacgggcatg

SEQ ID NO: 1590482 - DNA, 14 bp, Homo sapiens
ggaagggttttctt

SEQ ID NO: 1590483 - DNA, 20 bp, Homo sapiens
ggaaggtgatgggggcatgg

SEQ ID NO: 1590484 - DNA, 15 bp, Homo sapiens
ggaaggtgctgagct

SEQ ID NO: 1590485 - DNA, 16 bp, Homo sapiens
ggaaggtgctgagctt

SEQ ID NO: 1590486 - DNA, 21 bp, Homo sapiens
ggaaggtggggccctgcccct

SEQ ID NO: 1590487 - DNA, 14 bp, Homo sapiens
ggaagtaacttttt

SEQ ID NO: 1590488 - DNA, 17 bp, Homo sapiens
ggaagtcgaggctgcag

SEQ ID NO: 1590489 - DNA, 14 bp, Homo sapiens
ggaagtctaggagc

SEQ ID NO: 1590490 - DNA, 17 bp, Homo sapiens
ggaagtctaggagctgg

SEQ ID NO: 1590491 - DNA, 16 bp, Homo sapiens
ggaagtctccatgaag

SEQ ID NO: 1590492 - DNA, 19 bp, Homo sapiens
ggaagtgaggcccaaggag

SEQ ID NO: 1590493 - DNA, 13 bp, Homo sapiens
ggaagtgcccagc

SEQ ID NO: 1590494 - DNA, 16 bp, Homo sapiens
ggaagtgtaacagctg

SEQ ID NO: 1590495 - DNA, 19 bp, Homo sapiens
ggaagtgtaacagctgagg

SEQ ID NO: 1590496 - DNA, 21 bp, Homo sapiens
ggaagtgtaacagctgaggtc

SEQ ID NO: 1590497 - DNA, 12 bp, Homo sapiens
ggaagtgtgggt

SEQ ID NO: 1590498 - DNA, 21 bp, Homo sapiens
ggaagtgtgggtctgtgtgtg

SEQ ID NO: 1590499 - DNA, 22 bp, Homo sapiens
ggaagttaaagggaagaaaaca

SEQ ID NO: 1590500 - DNA, 14 bp, Homo sapiens
ggaagttctccagc

SEQ ID NO: 1590501 - DNA, 13 bp, Homo sapiens
ggaagttgtggat

SEQ ID NO: 1590502 - DNA, 17 bp, Homo sapiens
ggaagttttacagcaag

SEQ ID NO: 1590503 - DNA, 18 bp, Homo sapiens
ggaagttttacagcaagg

SEQ ID NO: 1590504 - DNA, 18 bp, Homo sapiens
ggaagtttttttttcctc

SEQ ID NO: 1590505 - DNA, 14 bp, Homo sapiens
ggaataaaaggctt

SEQ ID NO: 1590506 - DNA, 18 bp, Homo sapiens
ggaataaaaggcttgaag

SEQ ID NO: 1590507 - DNA, 13 bp, Homo sapiens
ggaataaacatta

SEQ ID NO: 1590508 - DNA, 21 bp, Homo sapiens
ggaataaagttgcagatgatt

SEQ ID NO: 1590509 - DNA, 13 bp, Homo sapiens
ggaataacactgc

SEQ ID NO: 1590510 - DNA, 21 bp, Homo sapiens
ggaataacttttacacgacca

SEQ ID NO: 1590511 - DNA, 13 bp, Homo sapiens
ggaataataccta

SEQ ID NO: 1590512 - DNA, 15 bp, Homo sapiens
ggaataatagaagaa

SEQ ID NO: 1590513 - DNA, 15 bp, Homo sapiens
ggagcgcacctgccc

SEQ ID NO: 1590514 - DNA, 21 bp, Homo sapiens
ggagcgcacctgccccctggt

SEQ ID NO: 1590515 - DNA, 19 bp, Homo sapiens
ggagcggccgcctgcgggc

SEQ ID NO: 1590516 - DNA, 12 bp, Homo sapiens
ggagctaaggct

SEQ ID NO: 1590517 - DNA, 14 bp, Homo sapiens
ggagctactgatga

SEQ ID NO: 1590518 - DNA, 17 bp, Homo sapiens
ggagctagcccagtccc

SEQ ID NO: 1590519 - DNA, 16 bp, Homo sapiens
ggagctcaccctgccc

SEQ ID NO: 1590520 - DNA, 17 bp, Homo sapiens
ggagctcaccctgcccg

SEQ ID NO: 1590521 - DNA, 21 bp, Homo sapiens
ggagctcaccctgcccgctcc

SEQ ID NO: 1590522 - DNA, 17 bp, Homo sapiens
ggagctccactctgctt

SEQ ID NO: 1590523 - DNA, 11 bp, Homo sapiens
ggagctctgcg

SEQ ID NO: 1590524 - DNA, 19 bp, Homo sapiens
ggagctctgcgccaggcag

SEQ ID NO: 1590525 - DNA, 20 bp, Homo sapiens
ggagctctgcgccaggcaga

SEQ ID NO: 1590526 - DNA, 12 bp, Homo sapiens
ggagctcttgga

SEQ ID NO: 1590527 - DNA, 13 bp, Homo sapiens
ggaggctgcagag

SEQ ID NO: 1590528 - DNA, 18 bp, Homo sapiens
ggaggctgcatgctctgg

SEQ ID NO: 1590529 - DNA, 13 bp, Homo sapiens
ggaggctgctgtg

SEQ ID NO: 1590530 - DNA, 13 bp, Homo sapiens
ggaggctggcagg

SEQ ID NO: 1590531 - DNA, 21 bp, Homo sapiens
ggagggaaggataaagccact

SEQ ID NO: 1590532 - DNA, 14 bp, Homo sapiens
ggagggagaagaga

SEQ ID NO: 1590533 - DNA, 15 bp, Homo sapiens
ggagggagaagagaa

SEQ ID NO: 1590534 - DNA, 13 bp, Homo sapiens
ggagggagaggga

SEQ ID NO: 1590535 - DNA, 12 bp, Homo sapiens
ggagggagctgc

SEQ ID NO: 1590536 - DNA, 17 bp, Homo sapiens
ggagggagctgctcaga

SEQ ID NO: 1590537 - DNA, 15 bp, Homo sapiens
ggagggaggccaggc

SEQ ID NO: 1590538 - DNA, 18 bp, Homo sapiens
ggagggaggccgggcggt

SEQ ID NO: 1590539 - DNA, 15 bp, Homo sapiens
ggagggatgctgctc

SEQ ID NO: 1590540 - DNA, 22 bp, Homo sapiens
ggagggatgtgggtaagaggag

SEQ ID NO: 1590541 - DNA, 12 bp, Homo sapiens
ggagggatttgg

SEQ ID NO: 1590542 - DNA, 12 bp, Homo sapiens
ggagggcacagc

SEQ ID NO: 1590543 - DNA, 14 bp, Homo sapiens
ggagggcacagccc

SEQ ID NO: 1590544 - DNA, 14 bp, Homo sapiens
ggagggcagagcca

SEQ ID NO: 1590545 - DNA, 22 bp, Homo sapiens
ggagggcagagccatgggcctg

SEQ ID NO: 1590546 - DNA, 21 bp, Homo sapiens
ggagggcccctgcgtgggggc

SEQ ID NO: 1590547 - DNA, 21 bp, Homo sapiens
ggagggccgtaccccaccctc

SEQ ID NO: 1590548 - DNA, 15 bp, Homo sapiens
ggagggcctgcagtg

SEQ ID NO: 1590549 - DNA, 19 bp, Homo sapiens
ggagggcttggcccagcgc

SEQ ID NO: 1590550 - DNA, 23 bp, Homo sapiens
ggagggctttctgggtgtgtcca

SEQ ID NO: 1590551 - DNA, 16 bp, Homo sapiens
ggaggggaagaggcct

SEQ ID NO: 1590552 - DNA, 12 bp, Homo sapiens
ggaggggaaggg

SEQ ID NO: 1590553 - DNA, 17 bp, Homo sapiens
ggaggggaaggggctga

SEQ ID NO: 1590554 - DNA, 20 bp, Homo sapiens
ggaggggactatttatgaag

SEQ ID NO: 1590555 - DNA, 13 bp, Homo sapiens
ggaggggaggggg

SEQ ID NO: 1590556 - DNA, 13 bp, Homo sapiens
ggaggggcaggct

SEQ ID NO: 1590557 - DNA, 15 bp, Homo sapiens
ggaggggcctaggga

SEQ ID NO: 1590558 - DNA, 18 bp, Homo sapiens
ggaggggcctagggagcc

SEQ ID NO: 1590559 - DNA, 19 bp, Homo sapiens
ggaggggcgctggcccagc

SEQ ID NO: 1590560 - DNA, 16 bp, Homo sapiens
ggagggggcgctcagg

SEQ ID NO: 1590561 - DNA, 18 bp, Homo sapiens
ggagggggcgctcaggac

SEQ ID NO: 1590562 - DNA, 21 bp, Homo sapiens
ggagggggcttgaagccaaag

SEQ ID NO: 1590563 - DNA, 16 bp, Homo sapiens
ggagggggttacaaac

SEQ ID NO: 1590564 - DNA, 13 bp, Homo sapiens
ggagggtaaataa

SEQ ID NO: 1590565 - DNA, 16 bp, Homo sapiens
ggagggtgacgcccag

SEQ ID NO: 1590566 - DNA, 19 bp, Homo sapiens
ggagggtgggagagcccag

SEQ ID NO: 1590567 - DNA, 15 bp, Homo sapiens
ggagggttcccctgg

SEQ ID NO: 1590568 - DNA, 17 bp, Homo sapiens
ggagggttcccctggcc

SEQ ID NO: 1590569 - DNA, 13 bp, Homo sapiens
ggaggtcactgga

SEQ ID NO: 1590570 - DNA, 15 bp, Homo sapiens
ggaggtccagctggg

SEQ ID NO: 1590571 - DNA, 18 bp, Homo sapiens
ggaggtcggtaggttcag

SEQ ID NO: 1590572 - DNA, 16 bp, Homo sapiens
ggaggtctccaggggc

SEQ ID NO: 1590573 - DNA, 15 bp, Homo sapiens
ggaggtctctgggag

SEQ ID NO: 1590574 - DNA, 20 bp, Homo sapiens
ggaggtggagattgcagtga

SEQ ID NO: 1590575 - DNA, 19 bp, Homo sapiens
ggaggtggaggttgcagtg

SEQ ID NO: 1590576 - DNA, 15 bp, Homo sapiens
ggaggtggcagccct

SEQ ID NO: 1590577 - DNA, 14 bp, Homo sapiens
ggaggtgtctgggg

SEQ ID NO: 1590578 - DNA, 12 bp, Homo sapiens
ggaggtgtgagg

SEQ ID NO: 1590579 - DNA, 23 bp, Homo sapiens
ggaggttctaaggcctaggattc

SEQ ID NO: 1590580 - DNA, 18 bp, Homo sapiens
ggaggttctgggcctctg

SEQ ID NO: 1590581 - DNA, 14 bp, Homo sapiens
ggaggttgaagcca

SEQ ID NO: 1590582 - DNA, 12 bp, Homo sapiens
ggaggttgcagg

SEQ ID NO: 1590583 - DNA, 14 bp, Homo sapiens
ggaggttgcagtga

SEQ ID NO: 1590584 - DNA, 20 bp, Homo sapiens
ggaggttgcagtgagctgag

SEQ ID NO: 1590585 - DNA, 21 bp, Homo sapiens
ggaggttgcagtgagctgaga

SEQ ID NO: 1590586 - DNA, 16 bp, Homo sapiens
ggaggttggtgactga

SEQ ID NO: 1590587 - DNA, 14 bp, Homo sapiens
ggaggtttgtcggg

SEQ ID NO: 1590588 - DNA, 22 bp, Homo sapiens
ggagtaaatatatatgtcaata

SEQ ID NO: 1590589 - DNA, 22 bp, Homo sapiens
ggagtaacaatacaaatggatt

SEQ ID NO: 1590590 - DNA, 20 bp, Homo sapiens
ggagtaagacaagtgggatt

SEQ ID NO: 1590591 - DNA, 16 bp, Homo sapiens
ggagtaatcaggcagc

SEQ ID NO: 1590592 - DNA, 17 bp, Homo sapiens
ggagtatttgaacacag

SEQ ID NO: 1590593 - DNA, 23 bp, Homo sapiens
ggagtcagtaggtccaagggcca

SEQ ID NO: 1590594 - DNA, 16 bp, Homo sapiens
ggagtccactttgttt

SEQ ID NO: 1590595 - DNA, 14 bp, Homo sapiens
ggagtcccctcctc

SEQ ID NO: 1590596 - DNA, 15 bp, Homo sapiens
ggagtcccgtcagga

SEQ ID NO: 1590597 - DNA, 16 bp, Homo sapiens
ggagtcccgtcaggac

SEQ ID NO: 1590598 - DNA, 24 bp, Homo sapiens
ggagtcgtggggtgtgctgggagc

SEQ ID NO: 1590599 - DNA, 22 bp, Homo sapiens
ggagtctgagtctgagtcctgt

SEQ ID NO: 1590600 - DNA, 18 bp, Homo sapiens
ggagtctgtcctgtgacg

SEQ ID NO: 1590601 - DNA, 16 bp, Homo sapiens
ggagtcttcagaccca

SEQ ID NO: 1590602 - DNA, 17 bp, Homo sapiens
ggagtcttcagacccag

SEQ ID NO: 1590603 - DNA, 20 bp, Homo sapiens
ggagtcttcagacccagaga

SEQ ID NO: 1590604 - DNA, 21 bp, Homo sapiens
ggagtcttcagacccagagaa

SEQ ID NO: 1590605 - DNA, 12 bp, Homo sapiens
ggagtgaagagg

SEQ ID NO: 1590606 - DNA, 17 bp, Homo sapiens
ggagtgaagaggggcag

SEQ ID NO: 1590607 - DNA, 18 bp, Homo sapiens
ggagtgaagaggggcagc

SEQ ID NO: 1590608 - DNA, 19 bp, Homo sapiens
ggagtgaagaggggcagcc

SEQ ID NO: 1590609 - DNA, 19 bp, Homo sapiens
ggagtgagaggtctctctt

SEQ ID NO: 1590610 - DNA, 19 bp, Homo sapiens
ggagtgaggcttccaggct

SEQ ID NO: 1590611 - DNA, 21 bp, Homo sapiens
ggagtgaggcttccaggctct

SEQ ID NO: 1590612 - DNA, 21 bp, Homo sapiens
ggagtgagtcacctgctccag

SEQ ID NO: 1590613 - DNA, 14 bp, Homo sapiens
ggagtgattctaga

SEQ ID NO: 1590614 - DNA, 20 bp, Homo sapiens
ggagtgcaatgacacagtct

SEQ ID NO: 1590615 - DNA, 18 bp, Homo sapiens
ggagtgccaggaccagcc

SEQ ID NO: 1590616 - DNA, 21 bp, Homo sapiens
ggagtgcccccagcccagagc

SEQ ID NO: 1590617 - DNA, 14 bp, Homo sapiens
ggagtgcctggagt

SEQ ID NO: 1590618 - DNA, 22 bp, Homo sapiens
ggagtgcttatcccttcttttt

SEQ ID NO: 1590619 - DNA, 17 bp, Homo sapiens
ggagtggaggcattgtt

SEQ ID NO: 1590620 - DNA, 21 bp, Homo sapiens
ggagtggccaaataggaggga

SEQ ID NO: 1590621 - DNA, 18 bp, Homo sapiens
ggagtggtgatttgaaaa

SEQ ID NO: 1590622 - DNA, 17 bp, Homo sapiens
ggagtgtcctgcccatg

SEQ ID NO: 1590623 - DNA, 15 bp, Homo sapiens
ggagtgtcctggctg

SEQ ID NO: 1590624 - DNA, 13 bp, Homo sapiens
ggagtgtgcagac

SEQ ID NO: 1590625 - DNA, 17 bp, Homo sapiens
ggagtgtgcagacagcc

SEQ ID NO: 1590626 - DNA, 13 bp, Homo sapiens
ggagtgtgggctg

SEQ ID NO: 1590627 - DNA, 19 bp, Homo sapiens
ggagtgtttctaataaact

SEQ ID NO: 1590628 - DNA, 19 bp, Homo sapiens
ggagttcaagaccagcctg

SEQ ID NO: 1590629 - DNA, 21 bp, Homo sapiens
ggagttcctgctccgtggact

SEQ ID NO: 1590630 - DNA, 22 bp, Homo sapiens
ggagttcctgctccgtggactg

SEQ ID NO: 1590631 - DNA, 12 bp, Homo sapiens
ggagttccttat

SEQ ID NO: 1590632 - DNA, 24 bp, Homo sapiens
ggagttccttatccctctcttccc

SEQ ID NO: 1590633 - DNA, 20 bp, Homo sapiens
ggagttcgaggctgcagtca

SEQ ID NO: 1590634 - DNA, 22 bp, Homo sapiens
ggagttctaacaaaacaagttg

SEQ ID NO: 1590635 - DNA, 17 bp, Homo sapiens
ggcacactttctggcaa

SEQ ID NO: 1590636 - DNA, 21 bp, Homo sapiens
ggcacagaaacacaatatttt

SEQ ID NO: 1590637 - DNA, 21 bp, Homo sapiens
ggcacagacactacatatcta

SEQ ID NO: 1590638 - DNA, 16 bp, Homo sapiens
ggcacagacgactgtc

SEQ ID NO: 1590639 - DNA, 18 bp, Homo sapiens
ggcacagacttctggaag

SEQ ID NO: 1590640 - DNA, 14 bp, Homo sapiens
ggcacagccctccg

SEQ ID NO: 1590641 - DNA, 12 bp, Homo sapiens
ggcacagccctg

SEQ ID NO: 1590642 - DNA, 18 bp, Homo sapiens
ggcacagccctgagtgtc

SEQ ID NO: 1590643 - DNA, 22 bp, Homo sapiens
ggcacagcggagtctgtcctgt

SEQ ID NO: 1590644 - DNA, 13 bp, Homo sapiens
ggcacaggactga

SEQ ID NO: 1590645 - DNA, 12 bp, Homo sapiens
ggcacaggaggc

SEQ ID NO: 1590646 - DNA, 14 bp, Homo sapiens
ggcacaggccccct

SEQ ID NO: 1590647 - DNA, 14 bp, Homo sapiens
ggcacagggcacca

SEQ ID NO: 1590648 - DNA, 16 bp, Homo sapiens
ggcacagggcagtggg

SEQ ID NO: 1590649 - DNA, 13 bp, Homo sapiens
ggcacagggcccg

SEQ ID NO: 1590650 - DNA, 18 bp, Homo sapiens
ggcacagggtctgctctt

SEQ ID NO: 1590651 - DNA, 21 bp, Homo sapiens
ggcacagtgggcctgtgtgtg

SEQ ID NO: 1590652 - DNA, 21 bp, Homo sapiens
ggcacagttttctgagaaaga

SEQ ID NO: 1590653 - DNA, 12 bp, Homo sapiens
ggcacatagaga

SEQ ID NO: 1590654 - DNA, 17 bp, Homo sapiens
ggcacatgaacagcttg

SEQ ID NO: 1590655 - DNA, 15 bp, Homo sapiens
ggcacatgctggccg

SEQ ID NO: 1590656 - DNA, 19 bp, Homo sapiens
ggcacattgcccatggctg

SEQ ID NO: 1590657 - DNA, 14 bp, Homo sapiens
ggcaccaccaggag

SEQ ID NO: 1590658 - DNA, 15 bp, Homo sapiens
ggcaccaccaggagc

SEQ ID NO: 1590659 - DNA, 13 bp, Homo sapiens
ggcaccagacacc

SEQ ID NO: 1590660 - DNA, 18 bp, Homo sapiens
ggcaccagacacccagga

SEQ ID NO: 1590661 - DNA, 15 bp, Homo sapiens
ggcaccagaggccga

SEQ ID NO: 1590662 - DNA, 13 bp, Homo sapiens
ggcaccagccagc

SEQ ID NO: 1590663 - DNA, 15 bp, Homo sapiens
ggcaccagccccctg

SEQ ID NO: 1590664 - DNA, 13 bp, Homo sapiens
ggcaccagctctg

SEQ ID NO: 1590665 - DNA, 21 bp, Homo sapiens
ggcaccagtgtcctcccctca

SEQ ID NO: 1590666 - DNA, 15 bp, Homo sapiens
ggcaccatcagcctg

SEQ ID NO: 1590667 - DNA, 16 bp, Homo sapiens
ggcaccatcagcctgt

SEQ ID NO: 1590668 - DNA, 20 bp, Homo sapiens
ggcacccaccgtggaggagg

SEQ ID NO: 1590669 - DNA, 13 bp, Homo sapiens
ggcacccaggcct

SEQ ID NO: 1590670 - DNA, 18 bp, Homo sapiens
ggcacccaggcctccctg

SEQ ID NO: 1590671 - DNA, 17 bp, Homo sapiens
ggcacccccacaagctg

SEQ ID NO: 1590672 - DNA, 20 bp, Homo sapiens
ggcaccccttgtttctgttg

SEQ ID NO: 1590673 - DNA, 15 bp, Homo sapiens
ggcaccgagaatgtt

SEQ ID NO: 1590674 - DNA, 15 bp, Homo sapiens
ggcaccggcgctgca

SEQ ID NO: 1590675 - DNA, 18 bp, Homo sapiens
ggcaccgtccaggcccca

SEQ ID NO: 1590676 - DNA, 16 bp, Homo sapiens
ggcacctaatccaggc

SEQ ID NO: 1590677 - DNA, 17 bp, Homo sapiens
ggcacctaatccaggca

SEQ ID NO: 1590678 - DNA, 19 bp, Homo sapiens
ggcacctaatccaggcaga

SEQ ID NO: 1590679 - DNA, 18 bp, Homo sapiens
ggcacctcggggacacca

SEQ ID NO: 1590680 - DNA, 22 bp, Homo sapiens
ggcacctcggggacaccagagc

SEQ ID NO: 1590681 - DNA, 14 bp, Homo sapiens
ggcacctggcctgc

SEQ ID NO: 1590682 - DNA, 16 bp, Homo sapiens
ggcacctggcctgctg

SEQ ID NO: 1590683 - DNA, 17 bp, Homo sapiens
ggcacctggcctgctgg

SEQ ID NO: 1590684 - DNA, 17 bp, Homo sapiens
ggcacgaacccacctgc

SEQ ID NO: 1590685 - DNA, 15 bp, Homo sapiens
ggcacgcacttgcct

SEQ ID NO: 1590686 - DNA, 19 bp, Homo sapiens
ggcacgcacttgcctgttg

SEQ ID NO: 1590687 - DNA, 20 bp, Homo sapiens
ggcacgccctactccactgc

SEQ ID NO: 1590688 - DNA, 15 bp, Homo sapiens
ggcacgggcccgtga

SEQ ID NO: 1590689 - DNA, 14 bp, Homo sapiens
ggcacgggtggtcc

SEQ ID NO: 1590690 - DNA, 17 bp, Homo sapiens
ggcacgggtggtccccg

SEQ ID NO: 1590691 - DNA, 22 bp, Homo sapiens
ggcacgtattgctgtgtctcct

SEQ ID NO: 1590692 - DNA, 16 bp, Homo sapiens
ggcactagccaaagcg

SEQ ID NO: 1590693 - DNA, 17 bp, Homo sapiens
ggcactcacagacctgg

SEQ ID NO: 1590694 - DNA, 23 bp, Homo sapiens
ggcactcacagacctggagcccc

SEQ ID NO: 1590695 - DNA, 16 bp, Homo sapiens
ggcactcccaaccctg

SEQ ID NO: 1590696 - DNA, 21 bp, Homo sapiens
ggcactccgcgccgatgccac

SEQ ID NO: 1590697 - DNA, 22 bp, Homo sapiens
ggcactctgttatttagactca

SEQ ID NO: 1590698 - DNA, 12 bp, Homo sapiens
ggcactgagccc

SEQ ID NO: 1590699 - DNA, 13 bp, Homo sapiens
ggcactgagcccc

SEQ ID NO: 1590700 - DNA, 22 bp, Homo sapiens
ggcactgggagggggtggggga

SEQ ID NO: 1590701 - DNA, 13 bp, Homo sapiens
ggcactgggctgt

SEQ ID NO: 1590702 - DNA, 12 bp, Homo sapiens
ggcactggtggg

SEQ ID NO: 1590703 - DNA, 19 bp, Homo sapiens
ggcacttggaggacctggc

SEQ ID NO: 1590704 - DNA, 16 bp, Homo sapiens
ggcagaaaagaggaga

SEQ ID NO: 1590705 - DNA, 22 bp, Homo sapiens
ggcagaaaagaggagaccctgg

SEQ ID NO: 1590706 - DNA, 23 bp, Homo sapiens
ggcagaaaagaggagaccctgga

SEQ ID NO: 1590707 - DNA, 18 bp, Homo sapiens
ggcagaacagccgctcct

SEQ ID NO: 1590708 - DNA, 17 bp, Homo sapiens
ggcagaagaattgaacc

SEQ ID NO: 1590709 - DNA, 21 bp, Homo sapiens
ggcagaagactagaggccagg

SEQ ID NO: 1590710 - DNA, 11 bp, Homo sapiens
ggcagaagaga

SEQ ID NO: 1590711 - DNA, 21 bp, Homo sapiens
ggcagaagcattgcctggact

SEQ ID NO: 1590712 - DNA, 14 bp, Homo sapiens
ggcagaagggaatt

SEQ ID NO: 1590713 - DNA, 15 bp, Homo sapiens
ggcagacaagagctg

SEQ ID NO: 1590714 - DNA, 18 bp, Homo sapiens
ggcagacaagagctgctg

SEQ ID NO: 1590715 - DNA, 14 bp, Homo sapiens
ggcagacacaaccc

SEQ ID NO: 1590716 - DNA, 23 bp, Homo sapiens
ggcagacacaccgcggccaggca

SEQ ID NO: 1590717 - DNA, 15 bp, Homo sapiens
ggcagacagcagctc

SEQ ID NO: 1590718 - DNA, 18 bp, Homo sapiens
ggcagacagcagctcagg

SEQ ID NO: 1590719 - DNA, 19 bp, Homo sapiens
ggcagaccctgagcagaat

SEQ ID NO: 1590720 - DNA, 14 bp, Homo sapiens
ggcagactgtgaac

SEQ ID NO: 1590721 - DNA, 16 bp, Homo sapiens
ggcagagaaggcctct

SEQ ID NO: 1590722 - DNA, 21 bp, Homo sapiens
ggcagagaatggctgggtcag

SEQ ID NO: 1590723 - DNA, 17 bp, Homo sapiens
ggcagagcaattccagg

SEQ ID NO: 1590724 - DNA, 20 bp, Homo sapiens
ggcagagcaattccaggctg

SEQ ID NO: 1590725 - DNA, 22 bp, Homo sapiens
ggcagagcaattccaggctgag

SEQ ID NO: 1590726 - DNA, 23 bp, Homo sapiens
ggcagagcaattccaggctgagc

SEQ ID NO: 1590727 - DNA, 15 bp, Homo sapiens
ggcagagccaggctg

SEQ ID NO: 1590728 - DNA, 18 bp, Homo sapiens
ggcagagccatgggcctg

SEQ ID NO: 1590729 - DNA, 16 bp, Homo sapiens
ggcagagccgggaagc

SEQ ID NO: 1590730 - DNA, 14 bp, Homo sapiens
ggcagagctgcatc

SEQ ID NO: 1590731 - DNA, 17 bp, Homo sapiens
ggcagagctggctctga

SEQ ID NO: 1590732 - DNA, 21 bp, Homo sapiens
ggcagaggaatgtagggcctg

SEQ ID NO: 1590733 - DNA, 23 bp, Homo sapiens
ggcagaggaatgtagggcctgca

SEQ ID NO: 1590734 - DNA, 22 bp, Homo sapiens
ggcagaggcctgggctgggaaa

SEQ ID NO: 1590735 - DNA, 12 bp, Homo sapiens
ggcagaggctgg

SEQ ID NO: 1590736 - DNA, 22 bp, Homo sapiens
ggcagagggaatgttccctgca

SEQ ID NO: 1590737 - DNA, 23 bp, Homo sapiens
ggcagagggaatgttccctgcac

SEQ ID NO: 1590738 - DNA, 12 bp, Homo sapiens
ggcagagggctg

SEQ ID NO: 1590739 - DNA, 16 bp, Homo sapiens
ggcagaggggcagccg

SEQ ID NO: 1590740 - DNA, 19 bp, Homo sapiens
ggcagaggttgcagtgagc

SEQ ID NO: 1590741 - DNA, 21 bp, Homo sapiens
ggcagaggttttaatgtctgt

SEQ ID NO: 1590742 - DNA, 18 bp, Homo sapiens
ggcagagttacagttctg

SEQ ID NO: 1590743 - DNA, 13 bp, Homo sapiens
ggcagagttactt

SEQ ID NO: 1590744 - DNA, 20 bp, Homo sapiens
ggcagataagttggagcagg

SEQ ID NO: 1590745 - DNA, 21 bp, Homo sapiens
ggcagataagttggagcaggg

SEQ ID NO: 1590746 - DNA, 17 bp, Homo sapiens
ggcagggcccacgtgta

SEQ ID NO: 1590747 - DNA, 22 bp, Homo sapiens
ggcagggccgcccgggcccaga

SEQ ID NO: 1590748 - DNA, 15 bp, Homo sapiens
ggcagggcctgggcc

SEQ ID NO: 1590749 - DNA, 17 bp, Homo sapiens
ggcagggcctgggcctc

SEQ ID NO: 1590750 - DNA, 19 bp, Homo sapiens
ggcagggcctgggcctcat

SEQ ID NO: 1590751 - DNA, 16 bp, Homo sapiens
ggcagggccttgccca

SEQ ID NO: 1590752 - DNA, 21 bp, Homo sapiens
ggcagggccttgcccagagat

SEQ ID NO: 1590753 - DNA, 19 bp, Homo sapiens
ggcagggcgggcagagggc

SEQ ID NO: 1590754 - DNA, 23 bp, Homo sapiens
ggcagggcgggcagagggctgga

SEQ ID NO: 1590755 - DNA, 13 bp, Homo sapiens
ggcagggctctga

SEQ ID NO: 1590756 - DNA, 15 bp, Homo sapiens
ggcagggctgaggcc

SEQ ID NO: 1590757 - DNA, 19 bp, Homo sapiens
ggccaggctggtctaaaac

SEQ ID NO: 1590758 - DNA, 18 bp, Homo sapiens
ggccaggcttgtctcgaa

SEQ ID NO: 1590759 - DNA, 22 bp, Homo sapiens
ggccagggacccaggtgtgcct

SEQ ID NO: 1590760 - DNA, 15 bp, Homo sapiens
ggccagggagaagct

SEQ ID NO: 1590761 - DNA, 16 bp, Homo sapiens
ggccagggagaagctc

SEQ ID NO: 1590762 - DNA, 18 bp, Homo sapiens
ggccagggagaagctcct

SEQ ID NO: 1590763 - DNA, 21 bp, Homo sapiens
ggccagggccacgctccagct

SEQ ID NO: 1590764 - DNA, 16 bp, Homo sapiens
ggccagggccctgcag

SEQ ID NO: 1590765 - DNA, 17 bp, Homo sapiens
ggccagggccctgcaga

SEQ ID NO: 1590766 - DNA, 14 bp, Homo sapiens
ggccagggcctctc

SEQ ID NO: 1590767 - DNA, 17 bp, Homo sapiens
ggccagggcctctccaa

SEQ ID NO: 1590768 - DNA, 22 bp, Homo sapiens
ggccagggcctctccaaccact

SEQ ID NO: 1590769 - DNA, 19 bp, Homo sapiens
ggccagggctcctgtggca

SEQ ID NO: 1590770 - DNA, 21 bp, Homo sapiens
ggccagggtagacttggagct

SEQ ID NO: 1590771 - DNA, 16 bp, Homo sapiens
ggccagggtgggaaga

SEQ ID NO: 1590772 - DNA, 19 bp, Homo sapiens
ggccagggtgggaagagaa

SEQ ID NO: 1590773 - DNA, 21 bp, Homo sapiens
ggccaggtcccagcttgagct

SEQ ID NO: 1590774 - DNA, 17 bp, Homo sapiens
ggccaggtctccgggga

SEQ ID NO: 1590775 - DNA, 14 bp, Homo sapiens
ggccaggtgcagtg

SEQ ID NO: 1590776 - DNA, 19 bp, Homo sapiens
ggccaggtggccactccag

SEQ ID NO: 1590777 - DNA, 17 bp, Homo sapiens
ggccccatcctcatccc

SEQ ID NO: 1590778 - DNA, 12 bp, Homo sapiens
ggccccatgctc

SEQ ID NO: 1590779 - DNA, 15 bp, Homo sapiens
ggccccatgctctgc

SEQ ID NO: 1590780 - DNA, 18 bp, Homo sapiens
ggccccatgctctgcccc

SEQ ID NO: 1590781 - DNA, 19 bp, Homo sapiens
ggccccatgctctgcccca

SEQ ID NO: 1590782 - DNA, 13 bp, Homo sapiens
ggcccccaataaa

SEQ ID NO: 1590783 - DNA, 15 bp, Homo sapiens
ggcccccaataaagg

SEQ ID NO: 1590784 - DNA, 20 bp, Homo sapiens
ggcccccaataaaggcagct

SEQ ID NO: 1590785 - DNA, 23 bp, Homo sapiens
ggcccccagcccagggctcctgc

SEQ ID NO: 1590786 - DNA, 12 bp, Homo sapiens
ggcccccagctg

SEQ ID NO: 1590787 - DNA, 19 bp, Homo sapiens
ggcccccaggattccccca

SEQ ID NO: 1590788 - DNA, 14 bp, Homo sapiens
ggcccccaggggca

SEQ ID NO: 1590789 - DNA, 17 bp, Homo sapiens
ggcccccaggggcagga

SEQ ID NO: 1590790 - DNA, 18 bp, Homo sapiens
ggcccccaggggcaggac

SEQ ID NO: 1590791 - DNA, 22 bp, Homo sapiens
ggccccccgcgctcgcccagca

SEQ ID NO: 1590792 - DNA, 20 bp, Homo sapiens
ggcccccggccacgctccct

SEQ ID NO: 1590793 - DNA, 19 bp, Homo sapiens
ggccccctccccccagact

SEQ ID NO: 1590794 - DNA, 15 bp, Homo sapiens
ggccccgccagggct

SEQ ID NO: 1590795 - DNA, 19 bp, Homo sapiens
ggccccgcttgtccagcgc

SEQ ID NO: 1590796 - DNA, 14 bp, Homo sapiens
ggccccggccccag

SEQ ID NO: 1590797 - DNA, 17 bp, Homo sapiens
ggccccgggctctggcc

SEQ ID NO: 1590798 - DNA, 21 bp, Homo sapiens
ggccccgggctctggccaccc

SEQ ID NO: 1590799 - DNA, 16 bp, Homo sapiens
ggccccgggctggaga

SEQ ID NO: 1590800 - DNA, 15 bp, Homo sapiens
ggccccggggctggc

SEQ ID NO: 1590801 - DNA, 16 bp, Homo sapiens
ggccccggggctggca

SEQ ID NO: 1590802 - DNA, 20 bp, Homo sapiens
ggcccctaggtgcccagggc

SEQ ID NO: 1590803 - DNA, 17 bp, Homo sapiens
ggcccctcacctggtac

SEQ ID NO: 1590804 - DNA, 19 bp, Homo sapiens
ggcccctccagaccctgcc

SEQ ID NO: 1590805 - DNA, 13 bp, Homo sapiens
ggcccctccagca

SEQ ID NO: 1590806 - DNA, 22 bp, Homo sapiens
ggcccctcccacacccaaagct

SEQ ID NO: 1590807 - DNA, 16 bp, Homo sapiens
ggcccctccctctgcc

SEQ ID NO: 1590808 - DNA, 19 bp, Homo sapiens
ggcccctccctctgcccca

SEQ ID NO: 1590809 - DNA, 19 bp, Homo sapiens
ggcccctcctagacccagg

SEQ ID NO: 1590810 - DNA, 23 bp, Homo sapiens
ggcccctcctagacccaggtgga

SEQ ID NO: 1590811 - DNA, 19 bp, Homo sapiens
ggcccctcgaccctgtgca

SEQ ID NO: 1590812 - DNA, 16 bp, Homo sapiens
ggcccctctgcccagc

SEQ ID NO: 1590813 - DNA, 19 bp, Homo sapiens
ggcccctctgcccagcttg

SEQ ID NO: 1590814 - DNA, 22 bp, Homo sapiens
ggcccctctgctgtcctgcagt

SEQ ID NO: 1590815 - DNA, 16 bp, Homo sapiens
ggcccctgaggactgg

SEQ ID NO: 1590816 - DNA, 19 bp, Homo sapiens
ggcccctgaggactggaga

SEQ ID NO: 1590817 - DNA, 17 bp, Homo sapiens
ggcccctgcgtgggggc

SEQ ID NO: 1590818 - DNA, 18 bp, Homo sapiens
ggcccctgctgtctctct

SEQ ID NO: 1590819 - DNA, 13 bp, Homo sapiens
ggcccctggagcc

SEQ ID NO: 1590820 - DNA, 13 bp, Homo sapiens
ggcccctggcccc

SEQ ID NO: 1590821 - DNA, 22 bp, Homo sapiens
ggcccctgggctctcacccagt

SEQ ID NO: 1590822 - DNA, 17 bp, Homo sapiens
ggccccttccctggcag

SEQ ID NO: 1590823 - DNA, 15 bp, Homo sapiens
ggcccgacagcctgg

SEQ ID NO: 1590824 - DNA, 20 bp, Homo sapiens
ggcccgcaccccggcctcag

SEQ ID NO: 1590825 - DNA, 21 bp, Homo sapiens
ggcccgcaccccggcctcagg

SEQ ID NO: 1590826 - DNA, 22 bp, Homo sapiens
ggcccggagaaacctgatgaac

SEQ ID NO: 1590827 - DNA, 13 bp, Homo sapiens
ggcccggcagggc

SEQ ID NO: 1590828 - DNA, 15 bp, Homo sapiens
ggcccggccacaccc

SEQ ID NO: 1590829 - DNA, 21 bp, Homo sapiens
ggcccggccagcgggcacagg

SEQ ID NO: 1590830 - DNA, 22 bp, Homo sapiens
ggcccggccagcgggcacaggg

SEQ ID NO: 1590831 - DNA, 23 bp, Homo sapiens
ggcccggccagcgggcacagggc

SEQ ID NO: 1590832 - DNA, 13 bp, Homo sapiens
ggcccggccggcc

SEQ ID NO: 1590833 - DNA, 21 bp, Homo sapiens
ggcccggccggcctggcaccg

SEQ ID NO: 1590834 - DNA, 18 bp, Homo sapiens
ggcccggctgagcccccc

SEQ ID NO: 1590835 - DNA, 20 bp, Homo sapiens
ggcccggctgagccccccat

SEQ ID NO: 1590836 - DNA, 22 bp, Homo sapiens
ggcccggggctggcggctactc

SEQ ID NO: 1590837 - DNA, 21 bp, Homo sapiens
ggcccggggggaccaggatga

SEQ ID NO: 1590838 - DNA, 20 bp, Homo sapiens
ggcccgtcggagctgcctgc

SEQ ID NO: 1590839 - DNA, 16 bp, Homo sapiens
ggccctaccagcgccc

SEQ ID NO: 1590840 - DNA, 13 bp, Homo sapiens
ggccctagcattg

SEQ ID NO: 1590841 - DNA, 18 bp, Homo sapiens
ggccctatgtctcaggag

SEQ ID NO: 1590842 - DNA, 21 bp, Homo sapiens
ggccctcacccctgccctggg

SEQ ID NO: 1590843 - DNA, 22 bp, Homo sapiens
ggccctcacccctgccctggga

SEQ ID NO: 1590844 - DNA, 14 bp, Homo sapiens
ggccctcactcttg

SEQ ID NO: 1590845 - DNA, 14 bp, Homo sapiens
ggccctccatgggc

SEQ ID NO: 1590846 - DNA, 16 bp, Homo sapiens
ggccctccatgggcta

SEQ ID NO: 1590847 - DNA, 17 bp, Homo sapiens
ggccctccatgggctag

SEQ ID NO: 1590848 - DNA, 21 bp, Homo sapiens
ggccctcccagcccattgctg

SEQ ID NO: 1590849 - DNA, 22 bp, Homo sapiens
ggccctccctgttccccagaga

SEQ ID NO: 1590850 - DNA, 14 bp, Homo sapiens
ggccctctctctgg

SEQ ID NO: 1590851 - DNA, 16 bp, Homo sapiens
ggccctctctctgggc

SEQ ID NO: 1590852 - DNA, 12 bp, Homo sapiens
ggccctctcttc

SEQ ID NO: 1590853 - DNA, 18 bp, Homo sapiens
ggccctctcttctcacct

SEQ ID NO: 1590854 - DNA, 13 bp, Homo sapiens
ggccctctgcctg

SEQ ID NO: 1590855 - DNA, 14 bp, Homo sapiens
ggccctctgtagct

SEQ ID NO: 1590856 - DNA, 15 bp, Homo sapiens
ggccctctgtccaca

SEQ ID NO: 1590857 - DNA, 18 bp, Homo sapiens
ggccctcttgcgggcctg

SEQ ID NO: 1590858 - DNA, 14 bp, Homo sapiens
ggccctctttccct

SEQ ID NO: 1590859 - DNA, 20 bp, Homo sapiens
ggccctctttccctgcgaga

SEQ ID NO: 1590860 - DNA, 16 bp, Homo sapiens
ggccctgaggtgtggg

SEQ ID NO: 1590861 - DNA, 18 bp, Homo sapiens
ggccctgagtctgggcag

SEQ ID NO: 1590862 - DNA, 19 bp, Homo sapiens
ggccctgcattggcctggc

SEQ ID NO: 1590863 - DNA, 22 bp, Homo sapiens
ggccctgcattggcctggcctc

SEQ ID NO: 1590864 - DNA, 23 bp, Homo sapiens
ggccctgcattggcctggcctcc

SEQ ID NO: 1590865 - DNA, 18 bp, Homo sapiens
ggccctgccatcttccca

SEQ ID NO: 1590866 - DNA, 16 bp, Homo sapiens
gggcagggcccacgtg

SEQ ID NO: 1590867 - DNA, 14 bp, Homo sapiens
gggcagggccgccc

SEQ ID NO: 1590868 - DNA, 22 bp, Homo sapiens
gggcagggccgcccgggcccag

SEQ ID NO: 1590869 - DNA, 13 bp, Homo sapiens
gggcagggcctgg

SEQ ID NO: 1590870 - DNA, 15 bp, Homo sapiens
gggcagggctcccac

SEQ ID NO: 1590871 - DNA, 16 bp, Homo sapiens
gggcagggctgtgctt

SEQ ID NO: 1590872 - DNA, 11 bp, Homo sapiens
gggcagggtga

SEQ ID NO: 1590873 - DNA, 23 bp, Homo sapiens
gggcagggttaggaatctcttca

SEQ ID NO: 1590874 - DNA, 18 bp, Homo sapiens
gggcagggttatttaata

SEQ ID NO: 1590875 - DNA, 21 bp, Homo sapiens
gggcaggtggccacagcagga

SEQ ID NO: 1590876 - DNA, 15 bp, Homo sapiens
gggcaggtggccgcc

SEQ ID NO: 1590877 - DNA, 19 bp, Homo sapiens
gggcaggtggccgcccctg

SEQ ID NO: 1590878 - DNA, 19 bp, Homo sapiens
gggcaggtgtttctttcct

SEQ ID NO: 1590879 - DNA, 21 bp, Homo sapiens
gggcaggttctgcctgctttg

SEQ ID NO: 1590880 - DNA, 22 bp, Homo sapiens
gggcagtacctgggaaaggacc

SEQ ID NO: 1590881 - DNA, 15 bp, Homo sapiens
gggcagtgactggca

SEQ ID NO: 1590882 - DNA, 15 bp, Homo sapiens
gggcagtgccctttg

SEQ ID NO: 1590883 - DNA, 21 bp, Homo sapiens
gggcagtgggacccatagatc

SEQ ID NO: 1590884 - DNA, 11 bp, Homo sapiens
gggcagtgggt

SEQ ID NO: 1590885 - DNA, 20 bp, Homo sapiens
gggcagtggtgtggagaagc

SEQ ID NO: 1590886 - DNA, 16 bp, Homo sapiens
gggcagtgtggcctct

SEQ ID NO: 1590887 - DNA, 12 bp, Homo sapiens
gggcatcaggca

SEQ ID NO: 1590888 - DNA, 14 bp, Homo sapiens
gggcatcaggcact

SEQ ID NO: 1590889 - DNA, 21 bp, Homo sapiens
gggcatcaggcactggtggca

SEQ ID NO: 1590890 - DNA, 17 bp, Homo sapiens
gggcatcctggatgatt

SEQ ID NO: 1590891 - DNA, 22 bp, Homo sapiens
gggcatctgaagctttaccagg

SEQ ID NO: 1590892 - DNA, 14 bp, Homo sapiens
gggcatctgcccct

SEQ ID NO: 1590893 - DNA, 22 bp, Homo sapiens
gggcatgataagccgaggaggc

SEQ ID NO: 1590894 - DNA, 20 bp, Homo sapiens
gggcatggacgttcggggca

SEQ ID NO: 1590895 - DNA, 18 bp, Homo sapiens
gggcatgggtccagggcc

SEQ ID NO: 1590896 - DNA, 21 bp, Homo sapiens
gggcatggtggctcatgcctg

SEQ ID NO: 1590897 - DNA, 19 bp, Homo sapiens
gggcatggttccttccctg

SEQ ID NO: 1590898 - DNA, 19 bp, Homo sapiens
gggcatgtattggcctgga

SEQ ID NO: 1590899 - DNA, 20 bp, Homo sapiens
gggcatgtattggcctggag

SEQ ID NO: 1590900 - DNA, 15 bp, Homo sapiens
gggcatgtgtgcctg

SEQ ID NO: 1590901 - DNA, 20 bp, Homo sapiens
gggcatgtgtgcctgtggca

SEQ ID NO: 1590902 - DNA, 16 bp, Homo sapiens
gggcattgctcagccc

SEQ ID NO: 1590903 - DNA, 19 bp, Homo sapiens
gggcattgctcagcccgct

SEQ ID NO: 1590904 - DNA, 14 bp, Homo sapiens
gggcattgctttcc

SEQ ID NO: 1590905 - DNA, 16 bp, Homo sapiens
gggccaaagcacagct

SEQ ID NO: 1590906 - DNA, 15 bp, Homo sapiens
gggccaagagatctg

SEQ ID NO: 1590907 - DNA, 16 bp, Homo sapiens
gggccacgctccagct

SEQ ID NO: 1590908 - DNA, 20 bp, Homo sapiens
gggccacgctcttgaggaag

SEQ ID NO: 1590909 - DNA, 15 bp, Homo sapiens
gggccactctgcctc

SEQ ID NO: 1590910 - DNA, 16 bp, Homo sapiens
gggccactctgcctct

SEQ ID NO: 1590911 - DNA, 22 bp, Homo sapiens
gggccacttctgggtggggcag

SEQ ID NO: 1590912 - DNA, 18 bp, Homo sapiens
gggccagaaggagggcag

SEQ ID NO: 1590913 - DNA, 16 bp, Homo sapiens
gggccagactggaaga

SEQ ID NO: 1590914 - DNA, 13 bp, Homo sapiens
gggccagagctga

SEQ ID NO: 1590915 - DNA, 21 bp, Homo sapiens
ggagtttgagacaagccctgg

SEQ ID NO: 1590916 - DNA, 20 bp, Homo sapiens
ggagtttgaggctgcaatga

SEQ ID NO: 1590917 - DNA, 22 bp, Homo sapiens
ggagtttgctgttgaggtggct

SEQ ID NO: 1590918 - DNA, 17 bp, Homo sapiens
ggagttttgtttcctct

SEQ ID NO: 1590919 - DNA, 18 bp, Homo sapiens
ggagtttttatgagaaac

SEQ ID NO: 1590920 - DNA, 16 bp, Homo sapiens
ggagtttttttataca

SEQ ID NO: 1590921 - DNA, 14 bp, Homo sapiens
ggataaaatgaggt

SEQ ID NO: 1590922 - DNA, 15 bp, Homo sapiens
ggataaaatgaggtt

SEQ ID NO: 1590923 - DNA, 19 bp, Homo sapiens
ggataaagaaaagacattt

SEQ ID NO: 1590924 - DNA, 15 bp, Homo sapiens
ggataaagccactga

SEQ ID NO: 1590925 - DNA, 14 bp, Homo sapiens
ggataaagccactt

SEQ ID NO: 1590926 - DNA, 17 bp, Homo sapiens
ggataaagccacttctg

SEQ ID NO: 1590927 - DNA, 21 bp, Homo sapiens
ggataagaaagcctaaaattg

SEQ ID NO: 1590928 - DNA, 14 bp, Homo sapiens
ggataatgaaataa

SEQ ID NO: 1590929 - DNA, 17 bp, Homo sapiens
ggatactggcacagagg

SEQ ID NO: 1590930 - DNA, 14 bp, Homo sapiens
ggatagatgctggc

SEQ ID NO: 1590931 - DNA, 19 bp, Homo sapiens
ggatagatgctggcccagg

SEQ ID NO: 1590932 - DNA, 18 bp, Homo sapiens
ggatagctaactgtaaat

SEQ ID NO: 1590933 - DNA, 16 bp, Homo sapiens
ggataggtattttata

SEQ ID NO: 1590934 - DNA, 23 bp, Homo sapiens
ggatagtagttaaataactgtgt

SEQ ID NO: 1590935 - DNA, 17 bp, Homo sapiens
ggatagtgttctgctcc

SEQ ID NO: 1590936 - DNA, 19 bp, Homo sapiens
ggatagtgttctgctcctg

SEQ ID NO: 1590937 - DNA, 16 bp, Homo sapiens
ggatatatttgaaata

SEQ ID NO: 1590938 - DNA, 18 bp, Homo sapiens
ggatatgacccacactgc

SEQ ID NO: 1590939 - DNA, 18 bp, Homo sapiens
ggatattgaatgttaaag

SEQ ID NO: 1590940 - DNA, 12 bp, Homo sapiens
ggatattgcctt

SEQ ID NO: 1590941 - DNA, 23 bp, Homo sapiens
ggatattgccttatttgtctgta

SEQ ID NO: 1590942 - DNA, 13 bp, Homo sapiens
ggatcaatacaca

SEQ ID NO: 1590943 - DNA, 13 bp, Homo sapiens
ggatcacagggcc

SEQ ID NO: 1590944 - DNA, 14 bp, Homo sapiens
ggatcacagggccc

SEQ ID NO: 1590945 - DNA, 17 bp, Homo sapiens
ggatcacagggccccag

SEQ ID NO: 1590946 - DNA, 18 bp, Homo sapiens
ggatcactctctgctggc

SEQ ID NO: 1590947 - DNA, 20 bp, Homo sapiens
ggatcactctctgctggcag

SEQ ID NO: 1590948 - DNA, 21 bp, Homo sapiens
ggatcactctctgctggcagg

SEQ ID NO: 1590949 - DNA, 23 bp, Homo sapiens
ggatcagcaacccttcctgctgc

SEQ ID NO: 1590950 - DNA, 12 bp, Homo sapiens
ggatcagttttt

SEQ ID NO: 1590951 - DNA, 13 bp, Homo sapiens
ggatccagccact

SEQ ID NO: 1590952 - DNA, 23 bp, Homo sapiens
ggatccagccacttccccctctt

SEQ ID NO: 1590953 - DNA, 19 bp, Homo sapiens
ggatccgactgctttggac

SEQ ID NO: 1590954 - DNA, 15 bp, Homo sapiens
ggatccgctgccacc

SEQ ID NO: 1590955 - DNA, 12 bp, Homo sapiens
ggatcctcagaa

SEQ ID NO: 1590956 - DNA, 13 bp, Homo sapiens
ggatcctccacag

SEQ ID NO: 1590957 - DNA, 14 bp, Homo sapiens
ggatcctccacaga

SEQ ID NO: 1590958 - DNA, 17 bp, Homo sapiens
ggatcctccacagagag

SEQ ID NO: 1590959 - DNA, 17 bp, Homo sapiens
ggatcctccctcatggc

SEQ ID NO: 1590960 - DNA, 12 bp, Homo sapiens
ggatcctgcagg

SEQ ID NO: 1590961 - DNA, 13 bp, Homo sapiens
ggatcctgcagga

SEQ ID NO: 1590962 - DNA, 18 bp, Homo sapiens
ggatcctgggctgggtgg

SEQ ID NO: 1590963 - DNA, 14 bp, Homo sapiens
ggatcgaggcatgg

SEQ ID NO: 1590964 - DNA, 20 bp, Homo sapiens
ggatcgagtgtagctgtgaa

SEQ ID NO: 1590965 - DNA, 13 bp, Homo sapiens
ggatctaccagca

SEQ ID NO: 1590966 - DNA, 13 bp, Homo sapiens
ggatctagaaggg

SEQ ID NO: 1590967 - DNA, 14 bp, Homo sapiens
ggatctatttcatg

SEQ ID NO: 1590968 - DNA, 14 bp, Homo sapiens
ggatctcaagccag

SEQ ID NO: 1590969 - DNA, 17 bp, Homo sapiens
ggatctcaagccagccc

SEQ ID NO: 1590970 - DNA, 11 bp, Homo sapiens
ggatctcacag

SEQ ID NO: 1590971 - DNA, 17 bp, Homo sapiens
ggatctcacaggctgag

SEQ ID NO: 1590972 - DNA, 16 bp, Homo sapiens
ggatctcagctttgag

SEQ ID NO: 1590973 - DNA, 18 bp, Homo sapiens
ggatctccttcccttctc

SEQ ID NO: 1590974 - DNA, 19 bp, Homo sapiens
ggatctccttcccttctct

SEQ ID NO: 1590975 - DNA, 22 bp, Homo sapiens
ggatctctcaggagcacaggca

SEQ ID NO: 1590976 - DNA, 15 bp, Homo sapiens
ggatctgatctgtac

SEQ ID NO: 1590977 - DNA, 13 bp, Homo sapiens
ggatctgctccaa

SEQ ID NO: 1590978 - DNA, 17 bp, Homo sapiens
ggatctggagaacctca

SEQ ID NO: 1590979 - DNA, 12 bp, Homo sapiens
ggatctgggcaa

SEQ ID NO: 1590980 - DNA, 18 bp, Homo sapiens
ggatctggggctctggga

SEQ ID NO: 1590981 - DNA, 16 bp, Homo sapiens
ggatcttcccacagga

SEQ ID NO: 1590982 - DNA, 20 bp, Homo sapiens
ggatgaagacgaagaagcaa

SEQ ID NO: 1590983 - DNA, 23 bp, Homo sapiens
ggatgaaggcaaaaactgtactg

SEQ ID NO: 1590984 - DNA, 14 bp, Homo sapiens
ggatgaatgaggtc

SEQ ID NO: 1590985 - DNA, 19 bp, Homo sapiens
ggatgaattttctgcagct

SEQ ID NO: 1590986 - DNA, 16 bp, Homo sapiens
ggatgacaccctggcc

SEQ ID NO: 1590987 - DNA, 18 bp, Homo sapiens
ggatgacaccctggcctg

SEQ ID NO: 1590988 - DNA, 19 bp, Homo sapiens
ggatgacaccctggcctga

SEQ ID NO: 1590989 - DNA, 23 bp, Homo sapiens
ggatgacagggcagagcaggaag

SEQ ID NO: 1590990 - DNA, 16 bp, Homo sapiens
ggatgacatgtcccta

SEQ ID NO: 1590991 - DNA, 19 bp, Homo sapiens
ggatgagaaacagctcagc

SEQ ID NO: 1590992 - DNA, 23 bp, Homo sapiens
ggatgagaaacagctcagccagt

SEQ ID NO: 1590993 - DNA, 20 bp, Homo sapiens
ggatgaggggcttcctgggt

SEQ ID NO: 1590994 - DNA, 19 bp, Homo sapiens
ggatgaggtcaccagggga

SEQ ID NO: 1590995 - DNA, 17 bp, Homo sapiens
ggatgatggcagagcca

SEQ ID NO: 1590996 - DNA, 21 bp, Homo sapiens
ggatgattgcttgagctcagg

SEQ ID NO: 1590997 - DNA, 22 bp, Homo sapiens
ggatgattgcttgagctcagga

SEQ ID NO: 1590998 - DNA, 19 bp, Homo sapiens
ggatgatttcatcttctgg

SEQ ID NO: 1590999 - DNA, 23 bp, Homo sapiens
ggatgatttcatcttctggaata

SEQ ID NO: 1591000 - DNA, 15 bp, Homo sapiens
ggatgcacatttctg

SEQ ID NO: 1591001 - DNA, 20 bp, Homo sapiens
ggatgcacatttctggattg

SEQ ID NO: 1591002 - DNA, 17 bp, Homo sapiens
ggatgcattcgagatgg

SEQ ID NO: 1591003 - DNA, 17 bp, Homo sapiens
ggatgccaaggagcccc

SEQ ID NO: 1591004 - DNA, 19 bp, Homo sapiens
ggatgccaaggagcccctg

SEQ ID NO: 1591005 - DNA, 18 bp, Homo sapiens
ggatgccacgcctggaag

SEQ ID NO: 1591006 - DNA, 18 bp, Homo sapiens
ggatgccactcctccctc

SEQ ID NO: 1591007 - DNA, 19 bp, Homo sapiens
ggatgccactcctccctcc

SEQ ID NO: 1591008 - DNA, 11 bp, Homo sapiens
ggatgcctcct

SEQ ID NO: 1591009 - DNA, 17 bp, Homo sapiens
ggatgctccagggcagc

SEQ ID NO: 1591010 - DNA, 18 bp, Homo sapiens
ggatgctccagggcagcc

SEQ ID NO: 1591011 - DNA, 14 bp, Homo sapiens
ggatgctgcagcag

SEQ ID NO: 1591012 - DNA, 18 bp, Homo sapiens
ggatgctgggctgggccc

SEQ ID NO: 1591013 - DNA, 10 bp, Homo sapiens
ggatgcttat

SEQ ID NO: 1591014 - DNA, 19 bp, Homo sapiens
ggatggaaaaggaagacta

SEQ ID NO: 1591015 - DNA, 19 bp, Homo sapiens
ggatggaaggttggatgga

SEQ ID NO: 1591016 - DNA, 16 bp, Homo sapiens
ggatggagagagggga

SEQ ID NO: 1591017 - DNA, 14 bp, Homo sapiens
ggatggagagcagc

SEQ ID NO: 1591018 - DNA, 14 bp, Homo sapiens
ggatggaggagaag

SEQ ID NO: 1591019 - DNA, 19 bp, Homo sapiens
ggatggaggggtggtcctg

SEQ ID NO: 1591020 - DNA, 12 bp, Homo sapiens
ggatggcaccct

SEQ ID NO: 1591021 - DNA, 18 bp, Homo sapiens
ggatggcaccctggaacc

SEQ ID NO: 1591022 - DNA, 13 bp, Homo sapiens
ggatggccccagc

SEQ ID NO: 1591023 - DNA, 12 bp, Homo sapiens
ggatggccgtgg

SEQ ID NO: 1591024 - DNA, 18 bp, Homo sapiens
ggatggccgtggatggcc

SEQ ID NO: 1591025 - DNA, 15 bp, Homo sapiens
ggatggcctggaacc

SEQ ID NO: 1591026 - DNA, 18 bp, Homo sapiens
ggatgggaatttgtcagc

SEQ ID NO: 1591027 - DNA, 21 bp, Homo sapiens
gggccgccacggcctggctgg

SEQ ID NO: 1591028 - DNA, 20 bp, Homo sapiens
gggccgcccgctcccttcct

SEQ ID NO: 1591029 - DNA, 21 bp, Homo sapiens
gggccgcccgctcccttcctg

SEQ ID NO: 1591030 - DNA, 22 bp, Homo sapiens
gggccgccgctgaccctgggcc

SEQ ID NO: 1591031 - DNA, 21 bp, Homo sapiens
gggccggctgagtggcagcag

SEQ ID NO: 1591032 - DNA, 16 bp, Homo sapiens
gggccgtaccccaccc

SEQ ID NO: 1591033 - DNA, 22 bp, Homo sapiens
gggccgtgtcccgcggtgctga

SEQ ID NO: 1591034 - DNA, 23 bp, Homo sapiens
gggcctagatccacacacagagg

SEQ ID NO: 1591035 - DNA, 20 bp, Homo sapiens
gggcctcaccgagtgggggc

SEQ ID NO: 1591036 - DNA, 16 bp, Homo sapiens
gggcctcaggctctgc

SEQ ID NO: 1591037 - DNA, 17 bp, Homo sapiens
gggcctcaggctctgca

SEQ ID NO: 1591038 - DNA, 14 bp, Homo sapiens
gggcctccagaact

SEQ ID NO: 1591039 - DNA, 19 bp, Homo sapiens
gggcctccagaagctgctc

SEQ ID NO: 1591040 - DNA, 13 bp, Homo sapiens
gggcctccagggc

SEQ ID NO: 1591041 - DNA, 19 bp, Homo sapiens
gggcctccattcctggagc

SEQ ID NO: 1591042 - DNA, 22 bp, Homo sapiens
gggcctccattcctggagcccg

SEQ ID NO: 1591043 - DNA, 21 bp, Homo sapiens
gggcctcccactcctgttcct

SEQ ID NO: 1591044 - DNA, 18 bp, Homo sapiens
gggcctcccataattgct

SEQ ID NO: 1591045 - DNA, 14 bp, Homo sapiens
gggcctcctgcctc

SEQ ID NO: 1591046 - DNA, 22 bp, Homo sapiens
gggcctcctgcctccgggcagg

SEQ ID NO: 1591047 - DNA, 15 bp, Homo sapiens
gggcctcggagcctc

SEQ ID NO: 1591048 - DNA, 16 bp, Homo sapiens
gggcctctcctgccct

SEQ ID NO: 1591049 - DNA, 20 bp, Homo sapiens
gggcctctcctgccctctgc

SEQ ID NO: 1591050 - DNA, 14 bp, Homo sapiens
gggcctctgcctgg

SEQ ID NO: 1591051 - DNA, 17 bp, Homo sapiens
gggcctctgcctgggac

SEQ ID NO: 1591052 - DNA, 22 bp, Homo sapiens
gggcctctgttcctttctctgg

SEQ ID NO: 1591053 - DNA, 22 bp, Homo sapiens
gggcctgagggtccacctggag

SEQ ID NO: 1591054 - DNA, 16 bp, Homo sapiens
gggcctgcagaaggaa

SEQ ID NO: 1591055 - DNA, 15 bp, Homo sapiens
gggcctgcatggaga

SEQ ID NO: 1591056 - DNA, 12 bp, Homo sapiens
gggcctgcccaa

SEQ ID NO: 1591057 - DNA, 20 bp, Homo sapiens
gggcctgccctctgccccat

SEQ ID NO: 1591058 - DNA, 15 bp, Homo sapiens
gggcctgccgggctg

SEQ ID NO: 1591059 - DNA, 20 bp, Homo sapiens
gggcctgccgggctgagggc

SEQ ID NO: 1591060 - DNA, 14 bp, Homo sapiens
gggcctgctccaga

SEQ ID NO: 1591061 - DNA, 21 bp, Homo sapiens
gggcctgctggaggcctcagg

SEQ ID NO: 1591062 - DNA, 20 bp, Homo sapiens
gggcctggacaaggtctctt

SEQ ID NO: 1591063 - DNA, 12 bp, Homo sapiens
gggcctggagat

SEQ ID NO: 1591064 - DNA, 14 bp, Homo sapiens
gggcctggccctca

SEQ ID NO: 1591065 - DNA, 14 bp, Homo sapiens
gggcctggcctgag

SEQ ID NO: 1591066 - DNA, 15 bp, Homo sapiens
gggcctggcctgagc

SEQ ID NO: 1591067 - DNA, 18 bp, Homo sapiens
gggctctgatctaacaaa

SEQ ID NO: 1591068 - DNA, 23 bp, Homo sapiens
gggctctgcaattcccctctgct

SEQ ID NO: 1591069 - DNA, 11 bp, Homo sapiens
gggctctgcag

SEQ ID NO: 1591070 - DNA, 11 bp, Homo sapiens
gggctctgccc

SEQ ID NO: 1591071 - DNA, 19 bp, Homo sapiens
gggctctgccccagctctg

SEQ ID NO: 1591072 - DNA, 18 bp, Homo sapiens
gggctctgccccaggccc

SEQ ID NO: 1591073 - DNA, 20 bp, Homo sapiens
gggctctgccttctcaggcc

SEQ ID NO: 1591074 - DNA, 13 bp, Homo sapiens
gggctctggccac

SEQ ID NO: 1591075 - DNA, 16 bp, Homo sapiens
gggctctggccaccct

SEQ ID NO: 1591076 - DNA, 13 bp, Homo sapiens
gggctctggctct

SEQ ID NO: 1591077 - DNA, 12 bp, Homo sapiens
gggctcttctca

SEQ ID NO: 1591078 - DNA, 15 bp, Homo sapiens
gggctgaatgtatgt

SEQ ID NO: 1591079 - DNA, 16 bp, Homo sapiens
gggctgaatgtatgtc

SEQ ID NO: 1591080 - DNA, 20 bp, Homo sapiens
gggctgacacctaccatgct

SEQ ID NO: 1591081 - DNA, 22 bp, Homo sapiens
gggctgacacctaccatgctgc

SEQ ID NO: 1591082 - DNA, 23 bp, Homo sapiens
gggctgacacctaccatgctgct

SEQ ID NO: 1591083 - DNA, 19 bp, Homo sapiens
gggctgagaggaagcaaga

SEQ ID NO: 1591084 - DNA, 15 bp, Homo sapiens
gggctgagccctggc

SEQ ID NO: 1591085 - DNA, 12 bp, Homo sapiens
gggctgagcctg

SEQ ID NO: 1591086 - DNA, 22 bp, Homo sapiens
gggctgagcctgaggccttcca

SEQ ID NO: 1591087 - DNA, 13 bp, Homo sapiens
gggctgagggcct

SEQ ID NO: 1591088 - DNA, 14 bp, Homo sapiens
gggctgagggcctg

SEQ ID NO: 1591089 - DNA, 17 bp, Homo sapiens
gggctgagggcctgctg

SEQ ID NO: 1591090 - DNA, 21 bp, Homo sapiens
gggctgatggattccaaacca

SEQ ID NO: 1591091 - DNA, 12 bp, Homo sapiens
gggctgcaggct

SEQ ID NO: 1591092 - DNA, 13 bp, Homo sapiens
gggctgccctggt

SEQ ID NO: 1591093 - DNA, 14 bp, Homo sapiens
gggctgccctggtg

SEQ ID NO: 1591094 - DNA, 19 bp, Homo sapiens
gggctgcccttgttgcctg

SEQ ID NO: 1591095 - DNA, 21 bp, Homo sapiens
gggctgcccttgttgcctgca

SEQ ID NO: 1591096 - DNA, 19 bp, Homo sapiens
gggctgccgggccaggcgc

SEQ ID NO: 1591097 - DNA, 15 bp, Homo sapiens
gggctgctcctccag

SEQ ID NO: 1591098 - DNA, 16 bp, Homo sapiens
gggctgctcctccagg

SEQ ID NO: 1591099 - DNA, 11 bp, Homo sapiens
gggctgctggg

SEQ ID NO: 1591100 - DNA, 12 bp, Homo sapiens
gggctgcttcct

SEQ ID NO: 1591101 - DNA, 19 bp, Homo sapiens
gggctgcttcctcctggaa

SEQ ID NO: 1591102 - DNA, 20 bp, Homo sapiens
gggctgcttcctcctggaaa

SEQ ID NO: 1591103 - DNA, 14 bp, Homo sapiens
gggctggagaaaga

SEQ ID NO: 1591104 - DNA, 16 bp, Homo sapiens
gggctggagaaagagc

SEQ ID NO: 1591105 - DNA, 20 bp, Homo sapiens
gggctggagaaagagctgcc

SEQ ID NO: 1591106 - DNA, 21 bp, Homo sapiens
gggctggagaaagagctgcct

SEQ ID NO: 1591107 - DNA, 23 bp, Homo sapiens
gggctggagaaagagctgcctgg

SEQ ID NO: 1591108 - DNA, 20 bp, Homo sapiens
gggctggagggaagggcaca

SEQ ID NO: 1591109 - DNA, 13 bp, Homo sapiens
gggctggcaagca

SEQ ID NO: 1591110 - DNA, 22 bp, Homo sapiens
gggctggctgaagaatgaagac

SEQ ID NO: 1591111 - DNA, 22 bp, Homo sapiens
gggctgggaatggggacacggt

SEQ ID NO: 1591112 - DNA, 20 bp, Homo sapiens
gggctgggagaagaaataga

SEQ ID NO: 1591113 - DNA, 18 bp, Homo sapiens
gggctgggccaggtctcc

SEQ ID NO: 1591114 - DNA, 23 bp, Homo sapiens
gggctgggccctctttccctgcg

SEQ ID NO: 1591115 - DNA, 18 bp, Homo sapiens
gggctggggaaagggctg

SEQ ID NO: 1591116 - DNA, 13 bp, Homo sapiens
gggctggggctgc

SEQ ID NO: 1591117 - DNA, 17 bp, Homo sapiens
gggctggggctgctccc

SEQ ID NO: 1591118 - DNA, 20 bp, Homo sapiens
gggctggggtcctcctgtgc

SEQ ID NO: 1591119 - DNA, 16 bp, Homo sapiens
gggctggtgccagcct

SEQ ID NO: 1591120 - DNA, 17 bp, Homo sapiens
gggctggtgccagcctt

SEQ ID NO: 1591121 - DNA, 20 bp, Homo sapiens
gggctggtgccagccttcct

SEQ ID NO: 1591122 - DNA, 15 bp, Homo sapiens
gggctggtgggacag

SEQ ID NO: 1591123 - DNA, 19 bp, Homo sapiens
gggctgtaacgtggcactg

SEQ ID NO: 1591124 - DNA, 11 bp, Homo sapiens
gggctgtcctg

SEQ ID NO: 1591125 - DNA, 15 bp, Homo sapiens
gggctgtcctgctca

SEQ ID NO: 1591126 - DNA, 14 bp, Homo sapiens
gggctgtcctgctg

SEQ ID NO: 1591127 - DNA, 19 bp, Homo sapiens
gggctgtgactctgggcag

SEQ ID NO: 1591128 - DNA, 12 bp, Homo sapiens
gggctgtgatcg

SEQ ID NO: 1591129 - DNA, 11 bp, Homo sapiens
gggctgtgcta

SEQ ID NO: 1591130 - DNA, 19 bp, Homo sapiens
gggctgttggacagctgct

SEQ ID NO: 1591131 - DNA, 22 bp, Homo sapiens
gggcttacctgtacactgactt

SEQ ID NO: 1591132 - DNA, 18 bp, Homo sapiens
gggcttagtatttctcag

SEQ ID NO: 1591133 - DNA, 14 bp, Homo sapiens
gggcttatatctgg

SEQ ID NO: 1591134 - DNA, 21 bp, Homo sapiens
gggcttatatgtacttttatt

SEQ ID NO: 1591135 - DNA, 14 bp, Homo sapiens
gggcttatctcttc

SEQ ID NO: 1591136 - DNA, 22 bp, Homo sapiens
gggcttcaccagtctgtctact

SEQ ID NO: 1591137 - DNA, 24 bp, Homo sapiens
gggcttcattccggactggcagaa

SEQ ID NO: 1591138 - DNA, 15 bp, Homo sapiens
gggcttcctgggtcc

SEQ ID NO: 1591139 - DNA, 14 bp, Homo sapiens
gggcttctcctcct

SEQ ID NO: 1591140 - DNA, 14 bp, Homo sapiens
gggcttctgcaccc

SEQ ID NO: 1591141 - DNA, 15 bp, Homo sapiens
gggcttctgcaccct

SEQ ID NO: 1591142 - DNA, 16 bp, Homo sapiens
gggcttctgcaccctc

SEQ ID NO: 1591143 - DNA, 18 bp, Homo sapiens
gggcttctgcaccctcca

SEQ ID NO: 1591144 - DNA, 16 bp, Homo sapiens
gggcttgagtgagaag

SEQ ID NO: 1591145 - DNA, 12 bp, Homo sapiens
gggcttggccca

SEQ ID NO: 1591146 - DNA, 13 bp, Homo sapiens
gggcttggcctgc

SEQ ID NO: 1591147 - DNA, 15 bp, Homo sapiens
gggctttcccaggag

SEQ ID NO: 1591148 - DNA, 12 bp, Homo sapiens
gggctttctctt

SEQ ID NO: 1591149 - DNA, 19 bp, Homo sapiens
gggctttctcttccccttc

SEQ ID NO: 1591150 - DNA, 14 bp, Homo sapiens
gggctttgcaggct

SEQ ID NO: 1591151 - DNA, 16 bp, Homo sapiens
gggctttgcaggctct

SEQ ID NO: 1591152 - DNA, 18 bp, Homo sapiens
gggctttgcaggctctgg

SEQ ID NO: 1591153 - DNA, 19 bp, Homo sapiens
gggctttgcaggctctggg

SEQ ID NO: 1591154 - DNA, 14 bp, Homo sapiens
gggcttttttcttt

SEQ ID NO: 1591155 - DNA, 17 bp, Homo sapiens
ggggaaaccctggagcc

SEQ ID NO: 1591156 - DNA, 13 bp, Homo sapiens
ggggaacacagct

SEQ ID NO: 1591157 - DNA, 21 bp, Homo sapiens
ggggaacctgccatgccagga

SEQ ID NO: 1591158 - DNA, 18 bp, Homo sapiens
ggggaagagggagaagga

SEQ ID NO: 1591159 - DNA, 21 bp, Homo sapiens
ggggaaggagccagtttgccg

SEQ ID NO: 1591160 - DNA, 13 bp, Homo sapiens
ggggaagggccag

SEQ ID NO: 1591161 - DNA, 23 bp, Homo sapiens
ggggaagggccagtctgggctgc

SEQ ID NO: 1591162 - DNA, 18 bp, Homo sapiens
ggggaattccctccccct

SEQ ID NO: 1591163 - DNA, 14 bp, Homo sapiens
ggggacagccttca

SEQ ID NO: 1591164 - DNA, 23 bp, Homo sapiens
ggggacagcttcctcacacccct

SEQ ID NO: 1591165 - DNA, 21 bp, Homo sapiens
ggggacccaatgtaggagctg

SEQ ID NO: 1591166 - DNA, 15 bp, Homo sapiens
ggggacccagtgcag

SEQ ID NO: 1591167 - DNA, 21 bp, Homo sapiens
ggggacccagtgcagaatgta

SEQ ID NO: 1591168 - DNA, 16 bp, Homo sapiens
ggggactcaggaccag

SEQ ID NO: 1591169 - DNA, 14 bp, Homo sapiens
ggggactgtctttc

SEQ ID NO: 1591170 - DNA, 14 bp, Homo sapiens
ggggactttattta

SEQ ID NO: 1591171 - DNA, 19 bp, Homo sapiens
ggggagaacttacattgtg

SEQ ID NO: 1591172 - DNA, 11 bp, Homo sapiens
ggggagagaag

SEQ ID NO: 1591173 - DNA, 14 bp, Homo sapiens
ggggagatggggag

SEQ ID NO: 1591174 - DNA, 12 bp, Homo sapiens
ggggagccagct

SEQ ID NO: 1591175 - DNA, 14 bp, Homo sapiens
ggggagccagctgc

SEQ ID NO: 1591176 - DNA, 16 bp, Homo sapiens
ggggagccagctgctt

SEQ ID NO: 1591177 - DNA, 17 bp, Homo sapiens
ggggagctagaggccac

SEQ ID NO: 1591178 - DNA, 12 bp, Homo sapiens
ggggaggagcct

SEQ ID NO: 1591179 - DNA, 13 bp, Homo sapiens
ggggaggcacact

SEQ ID NO: 1591180 - DNA, 13 bp, Homo sapiens
ggggaggcagcag

SEQ ID NO: 1591181 - DNA, 15 bp, Homo sapiens
ggggaggcagcagag

SEQ ID NO: 1591182 - DNA, 17 bp, Homo sapiens
ggggaggcccaaatgat

SEQ ID NO: 1591183 - DNA, 12 bp, Homo sapiens
ggggagggcagg

SEQ ID NO: 1591184 - DNA, 21 bp, Homo sapiens
ggggagggccgtaccccaccc

SEQ ID NO: 1591185 - DNA, 15 bp, Homo sapiens
ggggaggggcctagg

SEQ ID NO: 1591186 - DNA, 20 bp, Homo sapiens
ggggaggggcgctggcccag

SEQ ID NO: 1591187 - DNA, 14 bp, Homo sapiens
ggggagtagagaag

SEQ ID NO: 1591188 - DNA, 13 bp, Homo sapiens
ggggatagatgtg

SEQ ID NO: 1591189 - DNA, 13 bp, Homo sapiens
ggggatccccgcc

SEQ ID NO: 1591190 - DNA, 22 bp, Homo sapiens
ggggatccccgcctggccagga

SEQ ID NO: 1591191 - DNA, 20 bp, Homo sapiens
ggggatcttcccacaggagg

SEQ ID NO: 1591192 - DNA, 15 bp, Homo sapiens
ggggattgcccctgg

SEQ ID NO: 1591193 - DNA, 15 bp, Homo sapiens
ggggcaactgtatga

SEQ ID NO: 1591194 - DNA, 13 bp, Homo sapiens
ggggcaagctagg

SEQ ID NO: 1591195 - DNA, 16 bp, Homo sapiens
ggggcagaggggcagc

SEQ ID NO: 1591196 - DNA, 20 bp, Homo sapiens
ggggcagaggggcagccgct

SEQ ID NO: 1591197 - DNA, 24 bp, Homo sapiens
ggggcagcaaggccttggtggagc

SEQ ID NO: 1591198 - DNA, 13 bp, Homo sapiens
ggggcagcactcc

SEQ ID NO: 1591199 - DNA, 13 bp, Homo sapiens
ggggcagccacac

SEQ ID NO: 1591200 - DNA, 18 bp, Homo sapiens
ggggcaggagtgccagga

SEQ ID NO: 1591201 - DNA, 19 bp, Homo sapiens
ggggcaggagtgccaggac

SEQ ID NO: 1591202 - DNA, 20 bp, Homo sapiens
ggggcaggagtgccaggacc

SEQ ID NO: 1591203 - DNA, 11 bp, Homo sapiens
ggggcaggcct

SEQ ID NO: 1591204 - DNA, 13 bp, Homo sapiens
ggggcaggctggg

SEQ ID NO: 1591205 - DNA, 16 bp, Homo sapiens
ggggcaggctgggcca

SEQ ID NO: 1591206 - DNA, 19 bp, Homo sapiens
ggggcagggagctgggccc

SEQ ID NO: 1591207 - DNA, 13 bp, Homo sapiens
ggggcagtggcaa

SEQ ID NO: 1591208 - DNA, 15 bp, Homo sapiens
ggggcagtgtgagga

SEQ ID NO: 1591209 - DNA, 16 bp, Homo sapiens
ggggcatgctggggca

SEQ ID NO: 1591210 - DNA, 23 bp, Homo sapiens
ggggcatgtattggcctggaggt

SEQ ID NO: 1591211 - DNA, 20 bp, Homo sapiens
ggggcatgtgtgcctgtggc

SEQ ID NO: 1591212 - DNA, 16 bp, Homo sapiens
ggggccacccaaatgt

SEQ ID NO: 1591213 - DNA, 19 bp, Homo sapiens
ggggccacctcctccccct

SEQ ID NO: 1591214 - DNA, 19 bp, Homo sapiens
ggggccacttttgactagg

SEQ ID NO: 1591215 - DNA, 14 bp, Homo sapiens
ggggccagatccag

SEQ ID NO: 1591216 - DNA, 12 bp, Homo sapiens
ggggccagcact

SEQ ID NO: 1591217 - DNA, 23 bp, Homo sapiens
ggggcccacaggaagctcagcct

SEQ ID NO: 1591218 - DNA, 14 bp, Homo sapiens
ggggcccagtgcat

SEQ ID NO: 1591219 - DNA, 17 bp, Homo sapiens
ggggccccagatctgcc

SEQ ID NO: 1591220 - DNA, 18 bp, Homo sapiens
ggggccccagatctgcct

SEQ ID NO: 1591221 - DNA, 21 bp, Homo sapiens
ggggccccagatctgcctggg

SEQ ID NO: 1591222 - DNA, 23 bp, Homo sapiens
ggggccccagatctgcctgggcc

SEQ ID NO: 1591223 - DNA, 20 bp, Homo sapiens
ggggccccgccagggctggg

SEQ ID NO: 1591224 - DNA, 21 bp, Homo sapiens
ggggccccgccagggctgggg

SEQ ID NO: 1591225 - DNA, 16 bp, Homo sapiens
ggggccccggggctgg

SEQ ID NO: 1591226 - DNA, 10 bp, Homo sapiens
ggggccctgc

SEQ ID NO: 1591227 - DNA, 13 bp, Homo sapiens
ggggccctgctac

SEQ ID NO: 1591228 - DNA, 12 bp, Homo sapiens
ggggccctggtc

SEQ ID NO: 1591229 - DNA, 18 bp, Homo sapiens
ggggcccttggggcctgg

SEQ ID NO: 1591230 - DNA, 20 bp, Homo sapiens
ggggcccttggggcctggct

SEQ ID NO: 1591231 - DNA, 20 bp, Homo sapiens
ggggccgccgctgaccctgg

SEQ ID NO: 1591232 - DNA, 18 bp, Homo sapiens
ggggccggagcctttgga

SEQ ID NO: 1591233 - DNA, 21 bp, Homo sapiens
ggggccgggcgcggtggctca

SEQ ID NO: 1591234 - DNA, 13 bp, Homo sapiens
ggggccgtgtccc

SEQ ID NO: 1591235 - DNA, 22 bp, Homo sapiens
ggggccgtgtcccgcggtgctg

SEQ ID NO: 1591236 - DNA, 23 bp, Homo sapiens
ggggccgtgtcccgcggtgctga

SEQ ID NO: 1591237 - DNA, 23 bp, Homo sapiens
ggggcctacagctttgatccctg

SEQ ID NO: 1591238 - DNA, 20 bp, Homo sapiens
ggggcctccagaagctgctc

SEQ ID NO: 1591239 - DNA, 22 bp, Homo sapiens
ggggcctccttgtccaggtctc

SEQ ID NO: 1591240 - DNA, 14 bp, Homo sapiens
ggggcctggacctg

SEQ ID NO: 1591241 - DNA, 16 bp, Homo sapiens
ggggcctggacctgcc

SEQ ID NO: 1591242 - DNA, 21 bp, Homo sapiens
ggggcctggaggtctggctga

SEQ ID NO: 1591243 - DNA, 11 bp, Homo sapiens
ggggcctggca

SEQ ID NO: 1591244 - DNA, 19 bp, Homo sapiens
ggggcctggcttgctccag

SEQ ID NO: 1591245 - DNA, 23 bp, Homo sapiens
ggggcctgggacttccatgcctt

SEQ ID NO: 1591246 - DNA, 22 bp, Homo sapiens
ggggcctgggagggttcccctg

SEQ ID NO: 1591247 - DNA, 13 bp, Homo sapiens
ggggcctgtggtg

SEQ ID NO: 1591248 - DNA, 21 bp, Homo sapiens
ggggccttccttttgaggagc

SEQ ID NO: 1591249 - DNA, 22 bp, Homo sapiens
ggggccttccttttgaggagct

SEQ ID NO: 1591250 - DNA, 22 bp, Homo sapiens
ggggcgctcaggacccaggccc

SEQ ID NO: 1591251 - DNA, 14 bp, Homo sapiens
ggggcggggcagga

SEQ ID NO: 1591252 - DNA, 15 bp, Homo sapiens
ggggcgtggggaggg

SEQ ID NO: 1591253 - DNA, 21 bp, Homo sapiens
ggggctcctttctccagccag

SEQ ID NO: 1591254 - DNA, 15 bp, Homo sapiens
ggggctcgccatgcc

SEQ ID NO: 1591255 - DNA, 18 bp, Homo sapiens
ggggctcgtggccttccc

SEQ ID NO: 1591256 - DNA, 18 bp, Homo sapiens
ggggctctccaaaggggc

SEQ ID NO: 1591257 - DNA, 23 bp, Homo sapiens
ggggctctgccctccctccttcc

SEQ ID NO: 1591258 - DNA, 22 bp, Homo sapiens
ggggctctgccttctcaggccc

SEQ ID NO: 1591259 - DNA, 11 bp, Homo sapiens
ggggctgctgg

SEQ ID NO: 1591260 - DNA, 12 bp, Homo sapiens
ggggctgctggg

SEQ ID NO: 1591261 - DNA, 21 bp, Homo sapiens
ggggctgcttctccacctccc

SEQ ID NO: 1591262 - DNA, 12 bp, Homo sapiens
ggggctggccta

SEQ ID NO: 1591263 - DNA, 21 bp, Homo sapiens
ggggctgtcctgctgccctcc

SEQ ID NO: 1591264 - DNA, 12 bp, Homo sapiens
ggggctgtgcca

SEQ ID NO: 1591265 - DNA, 22 bp, Homo sapiens
ggggctgtggccgtctcctccc

SEQ ID NO: 1591266 - DNA, 17 bp, Homo sapiens
ggggcttgaagccaaag

SEQ ID NO: 1591267 - DNA, 11 bp, Homo sapiens
gggggacagag

SEQ ID NO: 1591268 - DNA, 15 bp, Homo sapiens
gggggacccagtgca

SEQ ID NO: 1591269 - DNA, 10 bp, Homo sapiens
gggggagccc

SEQ ID NO: 1591270 - DNA, 11 bp, Homo sapiens
gggggagctga

SEQ ID NO: 1591271 - DNA, 12 bp, Homo sapiens
gggggagggaag

SEQ ID NO: 1591272 - DNA, 13 bp, Homo sapiens
gggggcagagggc

SEQ ID NO: 1591273 - DNA, 17 bp, Homo sapiens
gggggccaaggtcctgc

SEQ ID NO: 1591274 - DNA, 11 bp, Homo sapiens
gggggccctgc

SEQ ID NO: 1591275 - DNA, 17 bp, Homo sapiens
gggggccttgaagactc

SEQ ID NO: 1591276 - DNA, 16 bp, Homo sapiens
gggggcgactggggag

SEQ ID NO: 1591277 - DNA, 22 bp, Homo sapiens
gggggcgctcaggacccaggcc

SEQ ID NO: 1591278 - DNA, 23 bp, Homo sapiens
gggggcgctcaggacccaggccc

SEQ ID NO: 1591279 - DNA, 19 bp, Homo sapiens
gggggcggggctgtcacca

SEQ ID NO: 1591280 - DNA, 13 bp, Homo sapiens
gggggctctgcct

SEQ ID NO: 1591281 - DNA, 16 bp, Homo sapiens
gggggctgcttctcca

SEQ ID NO: 1591282 - DNA, 19 bp, Homo sapiens
gggggctggtgccagcctt

SEQ ID NO: 1591283 - DNA, 12 bp, Homo sapiens
gggggctgtgcc

SEQ ID NO: 1591284 - DNA, 12 bp, Homo sapiens
gggggctttctg

SEQ ID NO: 1591285 - DNA, 13 bp, Homo sapiens
ggggggctctgcc

SEQ ID NO: 1591286 - DNA, 14 bp, Homo sapiens
gggggtagagctga

SEQ ID NO: 1591287 - DNA, 15 bp, Homo sapiens
gggggtagagctgat

SEQ ID NO: 1591288 - DNA, 14 bp, Homo sapiens
gggggtccagtctg

SEQ ID NO: 1591289 - DNA, 23 bp, Homo sapiens
gggggtcctctctgagtcaaatc

SEQ ID NO: 1591290 - DNA, 12 bp, Homo sapiens
gggggtgactgg

SEQ ID NO: 1591291 - DNA, 13 bp, Homo sapiens
gggggtggaggct

SEQ ID NO: 1591292 - DNA, 19 bp, Homo sapiens
ggggtaagccagagcctgg

SEQ ID NO: 1591293 - DNA, 14 bp, Homo sapiens
ggggtacaggcagt

SEQ ID NO: 1591294 - DNA, 19 bp, Homo sapiens
ggggtacatttctctgagc

SEQ ID NO: 1591295 - DNA, 14 bp, Homo sapiens
ggggtcaaaggaag

SEQ ID NO: 1591296 - DNA, 13 bp, Homo sapiens
ggggtcccctctg

SEQ ID NO: 1591297 - DNA, 22 bp, Homo sapiens
ggggtccctagcagcccaccct

SEQ ID NO: 1591298 - DNA, 22 bp, Homo sapiens
ggggtcctcctgtgctatttgt

SEQ ID NO: 1591299 - DNA, 18 bp, Homo sapiens
ggggtcctctctgagtca

SEQ ID NO: 1591300 - DNA, 24 bp, Homo sapiens
ggggtcctctctgagtcaaatcca

SEQ ID NO: 1591301 - DNA, 23 bp, Homo sapiens
ggggtctcttctgaataaagcaa

SEQ ID NO: 1591302 - DNA, 12 bp, Homo sapiens
ggtagcagctgg

SEQ ID NO: 1591303 - DNA, 14 bp, Homo sapiens
ggtagcagctggac

SEQ ID NO: 1591304 - DNA, 18 bp, Homo sapiens
ggtagccatcaagcactt

SEQ ID NO: 1591305 - DNA, 22 bp, Homo sapiens
ggtagccatcaagcacttccca

SEQ ID NO: 1591306 - DNA, 13 bp, Homo sapiens
ggtagcccagcac

SEQ ID NO: 1591307 - DNA, 12 bp, Homo sapiens
ggtagctccagc

SEQ ID NO: 1591308 - DNA, 13 bp, Homo sapiens
ggtagctccagcg

SEQ ID NO: 1591309 - DNA, 17 bp, Homo sapiens
ggtaggagggtgggaag

SEQ ID NO: 1591310 - DNA, 11 bp, Homo sapiens
ggtaggccctt

SEQ ID NO: 1591311 - DNA, 12 bp, Homo sapiens
ggtaggcccttg

SEQ ID NO: 1591312 - DNA, 16 bp, Homo sapiens
ggtaggcccttgtcct

SEQ ID NO: 1591313 - DNA, 20 bp, Homo sapiens
ggtaggcccttgtcctgcca

SEQ ID NO: 1591314 - DNA, 21 bp, Homo sapiens
ggtaggcccttgtcctgccag

SEQ ID NO: 1591315 - DNA, 14 bp, Homo sapiens
ggtaggggagggca

SEQ ID NO: 1591316 - DNA, 16 bp, Homo sapiens
ggtaggttcagccaag

SEQ ID NO: 1591317 - DNA, 18 bp, Homo sapiens
ggtaggttcagccaaggt

SEQ ID NO: 1591318 - DNA, 15 bp, Homo sapiens
ggtaggttgggacac

SEQ ID NO: 1591319 - DNA, 17 bp, Homo sapiens
ggtaggttgggacacca

SEQ ID NO: 1591320 - DNA, 20 bp, Homo sapiens
ggtagtctcactgcttgaac

SEQ ID NO: 1591321 - DNA, 22 bp, Homo sapiens
ggtataaaactttcctcgcctg

SEQ ID NO: 1591322 - DNA, 22 bp, Homo sapiens
ggtataggtctcatctcttcag

SEQ ID NO: 1591323 - DNA, 13 bp, Homo sapiens
ggtatatactttg

SEQ ID NO: 1591324 - DNA, 18 bp, Homo sapiens
ggtatcctgcccagtgtt

SEQ ID NO: 1591325 - DNA, 14 bp, Homo sapiens
ggtatctggcttcc

SEQ ID NO: 1591326 - DNA, 16 bp, Homo sapiens
ggtatgtagccagctg

SEQ ID NO: 1591327 - DNA, 12 bp, Homo sapiens
ggtatgtttaat

SEQ ID NO: 1591328 - DNA, 21 bp, Homo sapiens
ggtattaatcttattgtttaa

SEQ ID NO: 1591329 - DNA, 18 bp, Homo sapiens
ggtattattctgttttgc

SEQ ID NO: 1591330 - DNA, 18 bp, Homo sapiens
ggtattccttttgtgtac

SEQ ID NO: 1591331 - DNA, 14 bp, Homo sapiens
ggtatttaaagtat

SEQ ID NO: 1591332 - DNA, 19 bp, Homo sapiens
ggtatttaaagtattttct

SEQ ID NO: 1591333 - DNA, 14 bp, Homo sapiens
ggtcaagaaacagc

SEQ ID NO: 1591334 - DNA, 21 bp, Homo sapiens
ggtcaagaaacagccagcaag

SEQ ID NO: 1591335 - DNA, 11 bp, Homo sapiens
ggtcaagcctc

SEQ ID NO: 1591336 - DNA, 18 bp, Homo sapiens
ggtcaagttcccaactga

SEQ ID NO: 1591337 - DNA, 23 bp, Homo sapiens
ggtcaataaacttagaggaaaat

SEQ ID NO: 1591338 - DNA, 22 bp, Homo sapiens
ggtcacaaatcctaaaagaagc

SEQ ID NO: 1591339 - DNA, 11 bp, Homo sapiens
ggtcaccagct

SEQ ID NO: 1591340 - DNA, 17 bp, Homo sapiens
ggtcactccaccatccc

SEQ ID NO: 1591341 - DNA, 13 bp, Homo sapiens
ggtcactcctggg

SEQ ID NO: 1591342 - DNA, 13 bp, Homo sapiens
ggtcactctgccc

SEQ ID NO: 1591343 - DNA, 14 bp, Homo sapiens
ggtcactctgccct

SEQ ID NO: 1591344 - DNA, 15 bp, Homo sapiens
ggtcactctgccctc

SEQ ID NO: 1591345 - DNA, 22 bp, Homo sapiens
ggtcactctgccctctgctgct

SEQ ID NO: 1591346 - DNA, 15 bp, Homo sapiens
ggtcactggaaaggg

SEQ ID NO: 1591347 - DNA, 13 bp, Homo sapiens
ggtcactggctct

SEQ ID NO: 1591348 - DNA, 14 bp, Homo sapiens
ggtcactgtcactg

SEQ ID NO: 1591349 - DNA, 16 bp, Homo sapiens
ggtcactgtcactgcc

SEQ ID NO: 1591350 - DNA, 17 bp, Homo sapiens
ggtcactgtcactgccg

SEQ ID NO: 1591351 - DNA, 14 bp, Homo sapiens
ggtcagagccactc

SEQ ID NO: 1591352 - DNA, 15 bp, Homo sapiens
ggtcagagccactct

SEQ ID NO: 1591353 - DNA, 14 bp, Homo sapiens
ggtcagagggactg

SEQ ID NO: 1591354 - DNA, 17 bp, Homo sapiens
ggtcagagggactgtca

SEQ ID NO: 1591355 - DNA, 22 bp, Homo sapiens
ggtcagagggactgtcagctga

SEQ ID NO: 1591356 - DNA, 17 bp, Homo sapiens
ggtcagagtgccactgc

SEQ ID NO: 1591357 - DNA, 14 bp, Homo sapiens
ggtcagccattttt

SEQ ID NO: 1591358 - DNA, 18 bp, Homo sapiens
ggtcagccatttttaatg

SEQ ID NO: 1591359 - DNA, 12 bp, Homo sapiens
ggtcagcccagc

SEQ ID NO: 1591360 - DNA, 15 bp, Homo sapiens
ggtcagcccagcacc

SEQ ID NO: 1591361 - DNA, 17 bp, Homo sapiens
ggtcagcccagcacctg

SEQ ID NO: 1591362 - DNA, 19 bp, Homo sapiens
ggtcagcccagcacctgct

SEQ ID NO: 1591363 - DNA, 21 bp, Homo sapiens
ggtcagcccagcacctgctcc

SEQ ID NO: 1591364 - DNA, 22 bp, Homo sapiens
ggtcaggagttagaggccagcc

SEQ ID NO: 1591365 - DNA, 21 bp, Homo sapiens
ggtcaggcggggtgctgtggt

SEQ ID NO: 1591366 - DNA, 13 bp, Homo sapiens
ggtcaggctccat

SEQ ID NO: 1591367 - DNA, 14 bp, Homo sapiens
ggtcagggccagac

SEQ ID NO: 1591368 - DNA, 15 bp, Homo sapiens
ggtcagtgtggagag

SEQ ID NO: 1591369 - DNA, 11 bp, Homo sapiens
ggtcataaaat

SEQ ID NO: 1591370 - DNA, 21 bp, Homo sapiens
ggtcatattaatatatttcca

SEQ ID NO: 1591371 - DNA, 15 bp, Homo sapiens
ggtcatcagatgcct

SEQ ID NO: 1591372 - DNA, 19 bp, Homo sapiens
ggtcatcagatgcctgctt

SEQ ID NO: 1591373 - DNA, 21 bp, Homo sapiens
ggtcatcagatgcctgcttga

SEQ ID NO: 1591374 - DNA, 21 bp, Homo sapiens
ggtcatcgattcaaactgctc

SEQ ID NO: 1591375 - DNA, 23 bp, Homo sapiens
ggtcatcgattcaaactgctcca

SEQ ID NO: 1591376 - DNA, 21 bp, Homo sapiens
ggtcatgacaagatgggacag

SEQ ID NO: 1591377 - DNA, 13 bp, Homo sapiens
ggtcatgctcagc

SEQ ID NO: 1591378 - DNA, 17 bp, Homo sapiens
ggtcattggtctccgag

SEQ ID NO: 1591379 - DNA, 19 bp, Homo sapiens
ggtcatttcagagccctcg

SEQ ID NO: 1591380 - DNA, 19 bp, Homo sapiens
ggtccaaaaaaaggaaaaa

SEQ ID NO: 1591381 - DNA, 13 bp, Homo sapiens
ggtccaaatgttt

SEQ ID NO: 1591382 - DNA, 17 bp, Homo sapiens
ggtccaacaagaatgca

SEQ ID NO: 1591383 - DNA, 20 bp, Homo sapiens
ggtccaaccagacctggaag

SEQ ID NO: 1591384 - DNA, 16 bp, Homo sapiens
ggtccacagctggaaa

SEQ ID NO: 1591385 - DNA, 22 bp, Homo sapiens
ggtccacgcctctgctgtagct

SEQ ID NO: 1591386 - DNA, 21 bp, Homo sapiens
ggtccagaaactcctgtttct

SEQ ID NO: 1591387 - DNA, 20 bp, Homo sapiens
ggtccagcgtcactccagtg

SEQ ID NO: 1591388 - DNA, 12 bp, Homo sapiens
ggtccagctctg

SEQ ID NO: 1591389 - DNA, 14 bp, Homo sapiens
ggtccagctctgac

SEQ ID NO: 1591390 - DNA, 15 bp, Homo sapiens
ggtccagctctgaca

SEQ ID NO: 1591391 - DNA, 14 bp, Homo sapiens
ggtccagctctgga

SEQ ID NO: 1591392 - DNA, 16 bp, Homo sapiens
ggtccagctctggagg

SEQ ID NO: 1591393 - DNA, 14 bp, Homo sapiens
ggtccagctcttgg

SEQ ID NO: 1591394 - DNA, 19 bp, Homo sapiens
ggtccagctcttggcccct

SEQ ID NO: 1591395 - DNA, 21 bp, Homo sapiens
ggtccagctcttggcccctgt

SEQ ID NO: 1591396 - DNA, 18 bp, Homo sapiens
ggtccagctggcctggac

SEQ ID NO: 1591397 - DNA, 18 bp, Homo sapiens
ggtccagcttgctcttca

SEQ ID NO: 1591398 - DNA, 20 bp, Homo sapiens
ggtccaggaaggcagctgct

SEQ ID NO: 1591399 - DNA, 18 bp, Homo sapiens
ggtccaggagaagtgctc

SEQ ID NO: 1591400 - DNA, 23 bp, Homo sapiens
ggtccaggagaagtgctccctgg

SEQ ID NO: 1591401 - DNA, 13 bp, Homo sapiens
ggtccaggcccgt

SEQ ID NO: 1591402 - DNA, 21 bp, Homo sapiens
ggtccagggaagctggccgag

SEQ ID NO: 1591403 - DNA, 15 bp, Homo sapiens
ggtccagggcctgac

SEQ ID NO: 1591404 - DNA, 18 bp, Homo sapiens
ggtccagtcgggaggagc

SEQ ID NO: 1591405 - DNA, 11 bp, Homo sapiens
ggtccagtctg

SEQ ID NO: 1591406 - DNA, 18 bp, Homo sapiens
ggtccagtggatgccaca

SEQ ID NO: 1591407 - DNA, 16 bp, Homo sapiens
ggtccatttgttcctg

SEQ ID NO: 1591408 - DNA, 15 bp, Homo sapiens
ggtcccagccacccc

SEQ ID NO: 1591409 - DNA, 18 bp, Homo sapiens
ggtcccagtgggaggggc

SEQ ID NO: 1591410 - DNA, 12 bp, Homo sapiens
ggtcccatccag

SEQ ID NO: 1591411 - DNA, 14 bp, Homo sapiens
ggtccccagctccc

SEQ ID NO: 1591412 - DNA, 17 bp, Homo sapiens
ggtcccccgactgcctg

SEQ ID NO: 1591413 - DNA, 18 bp, Homo sapiens
ggtcccccgactgcctgt

SEQ ID NO: 1591414 - DNA, 12 bp, Homo sapiens
ggtcccctctgt

SEQ ID NO: 1591415 - DNA, 14 bp, Homo sapiens
ggtcccctctgtgc

SEQ ID NO: 1591416 - DNA, 19 bp, Homo sapiens
ggtccctcaggttcctttt

SEQ ID NO: 1591417 - DNA, 17 bp, Homo sapiens
ggtccctccaccccaca

SEQ ID NO: 1591418 - DNA, 15 bp, Homo sapiens
ggtccctgccctccc

SEQ ID NO: 1591419 - DNA, 23 bp, Homo sapiens
ggtccctgggaggaaatttgaat

SEQ ID NO: 1591420 - DNA, 20 bp, Homo sapiens
ggtcctcctatctccctggc

SEQ ID NO: 1591421 - DNA, 19 bp, Homo sapiens
ggtcctcctgtgctatttg

SEQ ID NO: 1591422 - DNA, 12 bp, Homo sapiens
ggtcctctctct

SEQ ID NO: 1591423 - DNA, 19 bp, Homo sapiens
ggtcctcttctgggcctga

SEQ ID NO: 1591424 - DNA, 20 bp, Homo sapiens
ggtcctgatttctagaaccc

SEQ ID NO: 1591425 - DNA, 15 bp, Homo sapiens
ggtcctgcctggtcc

SEQ ID NO: 1591426 - DNA, 21 bp, Homo sapiens
ggtcctgctccgctgcctgga

SEQ ID NO: 1591427 - DNA, 23 bp, Homo sapiens
ggtcctgctccgctgcctggaac

SEQ ID NO: 1591428 - DNA, 13 bp, Homo sapiens
ggtcctggcctcc

SEQ ID NO: 1591429 - DNA, 12 bp, Homo sapiens
ggtcctggctcc

SEQ ID NO: 1591430 - DNA, 14 bp, Homo sapiens
ggtcctggctcctg

SEQ ID NO: 1591431 - DNA, 15 bp, Homo sapiens
ggtcctggctcctga

SEQ ID NO: 1591432 - DNA, 16 bp, Homo sapiens
ggtcctggctcctgag

SEQ ID NO: 1591433 - DNA, 14 bp, Homo sapiens
ggtcctggctgcac

SEQ ID NO: 1591434 - DNA, 12 bp, Homo sapiens
ggtcctgggcag

SEQ ID NO: 1591435 - DNA, 12 bp, Homo sapiens
ggtcctggggct

SEQ ID NO: 1591436 - DNA, 15 bp, Homo sapiens
ggtcctggggctctg

SEQ ID NO: 1591437 - DNA, 23 bp, Homo sapiens
ggtcctggggctctgtgcaggga

SEQ ID NO: 1591438 - DNA, 12 bp, Homo sapiens
ggtcctgtcccc

SEQ ID NO: 1591439 - DNA, 21 bp, Homo sapiens
ggtccttcaagttagctcagg

SEQ ID NO: 1591440 - DNA, 14 bp, Homo sapiens
ggtccttgatgcca

SEQ ID NO: 1591441 - DNA, 16 bp, Homo sapiens
ggtccttgatgccaga

SEQ ID NO: 1591442 - DNA, 21 bp, Homo sapiens
ggtccttgatgccagagggcc

SEQ ID NO: 1591443 - DNA, 14 bp, Homo sapiens
ggtccttgggcctg

SEQ ID NO: 1591444 - DNA, 23 bp, Homo sapiens
ggtcctttctggaagtttctggt

SEQ ID NO: 1591445 - DNA, 16 bp, Homo sapiens
ggtccttttgacactg

SEQ ID NO: 1591446 - DNA, 22 bp, Homo sapiens
ggtcgcagctaccctcagcctc

SEQ ID NO: 1591447 - DNA, 22 bp, Homo sapiens
ggtcgcttactttgagtgatcc

SEQ ID NO: 1591448 - DNA, 16 bp, Homo sapiens
ggtcggagtgcctgga

SEQ ID NO: 1591449 - DNA, 18 bp, Homo sapiens
ggtcggagtgcctggagt

SEQ ID NO: 1591450 - DNA, 14 bp, Homo sapiens
ggtcgggcagccag

SEQ ID NO: 1591451 - DNA, 22 bp, Homo sapiens
ggtcgggcagtggaggctgctg

SEQ ID NO: 1591452 - DNA, 14 bp, Homo sapiens
ggtcgtgggccagt

SEQ ID NO: 1591453 - DNA, 14 bp, Homo sapiens
ggtctaggacacag

SEQ ID NO: 1591454 - DNA, 19 bp, Homo sapiens
ggtctatgtcgagagctgg

SEQ ID NO: 1591455 - DNA, 20 bp, Homo sapiens
ggtctatgtcgagagctggc

SEQ ID NO: 1591456 - DNA, 23 bp, Homo sapiens
ggtctcaaactcctgacctcagg

SEQ ID NO: 1591457 - DNA, 23 bp, Homo sapiens
ggtctcaaactcctgggctcagg

SEQ ID NO: 1591458 - DNA, 20 bp, Homo sapiens
ggtctcacagtgttgcccag

SEQ ID NO: 1591459 - DNA, 23 bp, Homo sapiens
ggtctcacccatgcaagcagagg

SEQ ID NO: 1591460 - DNA, 23 bp, Homo sapiens
ggtctcactcctgagtggggcca

SEQ ID NO: 1591461 - DNA, 15 bp, Homo sapiens
ggtctcactgctttg

SEQ ID NO: 1591462 - DNA, 15 bp, Homo sapiens
ggtctcaggttcttt

SEQ ID NO: 1591463 - DNA, 16 bp, Homo sapiens
ggtctcatctcttcag

SEQ ID NO: 1591464 - DNA, 12 bp, Homo sapiens
ggtctccaaggg

SEQ ID NO: 1591465 - DNA, 13 bp, Homo sapiens
ggtctccaggggc

SEQ ID NO: 1591466 - DNA, 15 bp, Homo sapiens
ggtctccccaattct

SEQ ID NO: 1591467 - DNA, 18 bp, Homo sapiens
ggtctccctctcctgcct

SEQ ID NO: 1591468 - DNA, 11 bp, Homo sapiens
ggtctccctgg

SEQ ID NO: 1591469 - DNA, 14 bp, Homo sapiens
ggtctccctggctc

SEQ ID NO: 1591470 - DNA, 21 bp, Homo sapiens
ggtctcccttctctacactct

SEQ ID NO: 1591471 - DNA, 15 bp, Homo sapiens
ggtctccgagagagg

SEQ ID NO: 1591472 - DNA, 14 bp, Homo sapiens
ggtctcctcccagc

SEQ ID NO: 1591473 - DNA, 17 bp, Homo sapiens
ggtctcctcccagcggc

SEQ ID NO: 1591474 - DNA, 23 bp, Homo sapiens
ggtctcctggaccttgacagagc

SEQ ID NO: 1591475 - DNA, 17 bp, Homo sapiens
ggtctcgaactcctggc

SEQ ID NO: 1591476 - DNA, 18 bp, Homo sapiens
ggtctcgaactcctggcc

SEQ ID NO: 1591477 - DNA, 14 bp, Homo sapiens
ggtctcgcagcctg

SEQ ID NO: 1591478 - DNA, 20 bp, Homo sapiens
ggtctcgcagcctgaagcct

SEQ ID NO: 1591479 - DNA, 20 bp, Homo sapiens
ggtctcgctttgttgcccag

SEQ ID NO: 1591480 - DNA, 15 bp, Homo sapiens
ggtctctccactgct

SEQ ID NO: 1591481 - DNA, 18 bp, Homo sapiens
ggtctctgccccagcctg

SEQ ID NO: 1591482 - DNA, 12 bp, Homo sapiens
ggtctctgctgg

SEQ ID NO: 1591483 - DNA, 20 bp, Homo sapiens
ggtctctgggagcccagaac

SEQ ID NO: 1591484 - DNA, 10 bp, Homo sapiens
ggtctctgtt

SEQ ID NO: 1591485 - DNA, 21 bp, Homo sapiens
ggtctcttctgaataaagcaa

SEQ ID NO: 1591486 - DNA, 15 bp, Homo sapiens
ggtctcttgagggag

SEQ ID NO: 1591487 - DNA, 21 bp, Homo sapiens
ggtctcttgagggagcttagc

SEQ ID NO: 1591488 - DNA, 19 bp, Homo sapiens
ggtctgagtctatgttcaa

SEQ ID NO: 1591489 - DNA, 15 bp, Homo sapiens
ggtctgattggctgc

SEQ ID NO: 1591490 - DNA, 19 bp, Homo sapiens
ggtctgcaagggcccagag

SEQ ID NO: 1591491 - DNA, 16 bp, Homo sapiens
ggtctgctctttctct

SEQ ID NO: 1591492 - DNA, 22 bp, Homo sapiens
ggtctggagaagcagtgagccg

SEQ ID NO: 1591493 - DNA, 19 bp, Homo sapiens
ggtctgggagtcacacagt

SEQ ID NO: 1591494 - DNA, 20 bp, Homo sapiens
ggtctgggatatggctgccc

SEQ ID NO: 1591495 - DNA, 18 bp, Homo sapiens
ggtctggggaagaggatg

SEQ ID NO: 1591496 - DNA, 15 bp, Homo sapiens
ggtctggttgggcag

SEQ ID NO: 1591497 - DNA, 14 bp, Homo sapiens
ggtctgtctggatc

SEQ ID NO: 1591498 - DNA, 16 bp, Homo sapiens
ggtctgtgcatttctg

SEQ ID NO: 1591499 - DNA, 15 bp, Homo sapiens
ggtctgtgctgtgcc

SEQ ID NO: 1591500 - DNA, 21 bp, Homo sapiens
ggtctgtgctgtgcctgctag

SEQ ID NO: 1591501 - DNA, 21 bp, Homo sapiens
ggtctgtgtgtgtgtatgtgg

SEQ ID NO: 1591502 - DNA, 22 bp, Homo sapiens
ggtctgtgtgtgtgtgtgtgcg

SEQ ID NO: 1591503 - DNA, 16 bp, Homo sapiens
ggtctgttggcaggct

SEQ ID NO: 1591504 - DNA, 19 bp, Homo sapiens
ggtctgttggcaggctggc

SEQ ID NO: 1591505 - DNA, 20 bp, Homo sapiens
ggtctgtttgtctgaacaaa

SEQ ID NO: 1591506 - DNA, 10 bp, Homo sapiens
ggtcttcctt

SEQ ID NO: 1591507 - DNA, 22 bp, Homo sapiens
ggtcttcttacatgcatttgag

SEQ ID NO: 1591508 - DNA, 19 bp, Homo sapiens
ggtcttgactcatggcagc

SEQ ID NO: 1591509 - DNA, 20 bp, Homo sapiens
ggtcttgactcatggcagct

SEQ ID NO: 1591510 - DNA, 21 bp, Homo sapiens
ggtcttgggggtcagggggga

SEQ ID NO: 1591511 - DNA, 15 bp, Homo sapiens
ggtctttgctccaga

SEQ ID NO: 1591512 - DNA, 16 bp, Homo sapiens
ggtcttttataattct

SEQ ID NO: 1591513 - DNA, 13 bp, Homo sapiens
ggtgaaaattatt

SEQ ID NO: 1591514 - DNA, 14 bp, Homo sapiens
ggtgaaaattattt

SEQ ID NO: 1591515 - DNA, 14 bp, Homo sapiens
ggtgaaacccccat

SEQ ID NO: 1591516 - DNA, 14 bp, Homo sapiens
ggtgaaagggagct

SEQ ID NO: 1591517 - DNA, 18 bp, Homo sapiens
ggtgaacagctggtgcca

SEQ ID NO: 1591518 - DNA, 18 bp, Homo sapiens
ggtgaagctatttatctg

SEQ ID NO: 1591519 - DNA, 21 bp, Homo sapiens
ggtgaagctcacttctgggct

SEQ ID NO: 1591520 - DNA, 16 bp, Homo sapiens
ggtgaaggatccagga

SEQ ID NO: 1591521 - DNA, 14 bp, Homo sapiens
ggtggagcagccag

SEQ ID NO: 1591522 - DNA, 16 bp, Homo sapiens
ggtggagcagccagag

SEQ ID NO: 1591523 - DNA, 21 bp, Homo sapiens
ggtggagccaagtggtccagc

SEQ ID NO: 1591524 - DNA, 12 bp, Homo sapiens
ggtggagccagg

SEQ ID NO: 1591525 - DNA, 22 bp, Homo sapiens
ggtggaggaaggtgctgagctt

SEQ ID NO: 1591526 - DNA, 14 bp, Homo sapiens
ggtggagggcacag

SEQ ID NO: 1591527 - DNA, 17 bp, Homo sapiens
ggtggagggcacagccc

SEQ ID NO: 1591528 - DNA, 18 bp, Homo sapiens
ggtggagggcacagccct

SEQ ID NO: 1591529 - DNA, 20 bp, Homo sapiens
ggtggagggtggggggcgct

SEQ ID NO: 1591530 - DNA, 17 bp, Homo sapiens
ggtgttttaaaaaatct

SEQ ID NO: 1591531 - DNA, 14 bp, Homo sapiens
ggtgttttaaacac

SEQ ID NO: 1591532 - DNA, 14 bp, Homo sapiens
ggttaaggcctgaa

SEQ ID NO: 1591533 - DNA, 14 bp, Homo sapiens
ggttacaaactgca

SEQ ID NO: 1591534 - DNA, 18 bp, Homo sapiens
ggttacagtgcagacagg

SEQ ID NO: 1591535 - DNA, 18 bp, Homo sapiens
ggttagaaaggcagccct

SEQ ID NO: 1591536 - DNA, 19 bp, Homo sapiens
ggttagaaaggcagccctc

SEQ ID NO: 1591537 - DNA, 17 bp, Homo sapiens
ggttaggaatctcttca

SEQ ID NO: 1591538 - DNA, 12 bp, Homo sapiens
ggttataatttt

SEQ ID NO: 1591539 - DNA, 15 bp, Homo sapiens
ggttatagtaacatc

SEQ ID NO: 1591540 - DNA, 23 bp, Homo sapiens
ggttatatgagtagatactctca

SEQ ID NO: 1591541 - DNA, 13 bp, Homo sapiens
ggttatctgcctg

SEQ ID NO: 1591542 - DNA, 20 bp, Homo sapiens
ggttatgtcagcagctctga

SEQ ID NO: 1591543 - DNA, 18 bp, Homo sapiens
ggttatttggtattaaac

SEQ ID NO: 1591544 - DNA, 11 bp, Homo sapiens
ggttattttaa

SEQ ID NO: 1591545 - DNA, 20 bp, Homo sapiens
ggttattttaaatataaata

SEQ ID NO: 1591546 - DNA, 17 bp, Homo sapiens
ggttatttttattaaat

SEQ ID NO: 1591547 - DNA, 20 bp, Homo sapiens
ggttatttttattaaatgta

SEQ ID NO: 1591548 - DNA, 18 bp, Homo sapiens
ggttcaagcccaggcttc

SEQ ID NO: 1591549 - DNA, 15 bp, Homo sapiens
ggttcacacagccca

SEQ ID NO: 1591550 - DNA, 16 bp, Homo sapiens
ggttcacacagcccag

SEQ ID NO: 1591551 - DNA, 13 bp, Homo sapiens
ggttcaccagcct

SEQ ID NO: 1591552 - DNA, 14 bp, Homo sapiens
ggttcacctgtgac

SEQ ID NO: 1591553 - DNA, 19 bp, Homo sapiens
ggttcagaaatgctgcctg

SEQ ID NO: 1591554 - DNA, 22 bp, Homo sapiens
ggttcagaaatgctgcctgcct

SEQ ID NO: 1591555 - DNA, 16 bp, Homo sapiens
ggttcagacccctgcc

SEQ ID NO: 1591556 - DNA, 14 bp, Homo sapiens
ggttcagcccctcc

SEQ ID NO: 1591557 - DNA, 21 bp, Homo sapiens
ggttcagcccctcctctgcca

SEQ ID NO: 1591558 - DNA, 13 bp, Homo sapiens
ggttcaggcccgg

SEQ ID NO: 1591559 - DNA, 13 bp, Homo sapiens
ggttcagtgcctt

SEQ ID NO: 1591560 - DNA, 19 bp, Homo sapiens
ggttcatcagtgttaaaaa

SEQ ID NO: 1591561 - DNA, 17 bp, Homo sapiens
ggttcattctcccgctt

SEQ ID NO: 1591562 - DNA, 20 bp, Homo sapiens
ggttccagcaattctcctgc

SEQ ID NO: 1591563 - DNA, 16 bp, Homo sapiens
ggttccatgcctgagg

SEQ ID NO: 1591564 - DNA, 21 bp, Homo sapiens
ggttccccgcaacccacagct

SEQ ID NO: 1591565 - DNA, 22 bp, Homo sapiens
ggttccccgcaacccacagctc

SEQ ID NO: 1591566 - DNA, 18 bp, Homo sapiens
ggttcccgacaccagaag

SEQ ID NO: 1591567 - DNA, 17 bp, Homo sapiens
ggttcccgtttctccac

SEQ ID NO: 1591568 - DNA, 22 bp, Homo sapiens
ggttcctagatgtgttctaagc

SEQ ID NO: 1591569 - DNA, 14 bp, Homo sapiens
ggttcctctgcctg

SEQ ID NO: 1591570 - DNA, 18 bp, Homo sapiens
ggttcctctgcctgcccc

SEQ ID NO: 1591571 - DNA, 15 bp, Homo sapiens
ggttccttttattag

SEQ ID NO: 1591572 - DNA, 17 bp, Homo sapiens
ggttcgagacccaaacc

SEQ ID NO: 1591573 - DNA, 13 bp, Homo sapiens
ggttcgagactcc

SEQ ID NO: 1591574 - DNA, 20 bp, Homo sapiens
ggttcggatttggggtggat

SEQ ID NO: 1591575 - DNA, 16 bp, Homo sapiens
ggttctaaaggtacca

SEQ ID NO: 1591576 - DNA, 12 bp, Homo sapiens
ggttctaaagtt

SEQ ID NO: 1591577 - DNA, 14 bp, Homo sapiens
ggttctaaagttct

SEQ ID NO: 1591578 - DNA, 12 bp, Homo sapiens
ggttctaaggcc

SEQ ID NO: 1591579 - DNA, 23 bp, Homo sapiens
ggttctaaggcctaggattctaa

SEQ ID NO: 1591580 - DNA, 16 bp, Homo sapiens
ggttctaagtgggaga

SEQ ID NO: 1591581 - DNA, 10 bp, Homo sapiens
ggttctagac

SEQ ID NO: 1591582 - DNA, 20 bp, Homo sapiens
ggttctagacgcccctccca

SEQ ID NO: 1591583 - DNA, 20 bp, Homo sapiens
ggttctatgctaaactgtga

SEQ ID NO: 1591584 - DNA, 23 bp, Homo sapiens
ggttctcacagtgggagccaggg

SEQ ID NO: 1591585 - DNA, 19 bp, Homo sapiens
ggttctccgttagctcctg

SEQ ID NO: 1591586 - DNA, 20 bp, Homo sapiens
ggttctccgttagctcctgt

SEQ ID NO: 1591587 - DNA, 21 bp, Homo sapiens
ggttctccgttagctcctgtg

SEQ ID NO: 1591588 - DNA, 16 bp, Homo sapiens
ggttctgccctgcctg

SEQ ID NO: 1591589 - DNA, 20 bp, Homo sapiens
ggttctgccctgcctgagga

SEQ ID NO: 1591590 - DNA, 21 bp, Homo sapiens
ggttctgcccttatggagctc

SEQ ID NO: 1591591 - DNA, 19 bp, Homo sapiens
ggttctgcctgccagctgc

SEQ ID NO: 1591592 - DNA, 13 bp, Homo sapiens
ggttctgcctgct

SEQ ID NO: 1591593 - DNA, 16 bp, Homo sapiens
ggttctgggcctctga

SEQ ID NO: 1591594 - DNA, 20 bp, Homo sapiens
ggttctgtctagactggcct

SEQ ID NO: 1591595 - DNA, 20 bp, Homo sapiens
ggttctgtgctaatcaaaac

SEQ ID NO: 1591596 - DNA, 14 bp, Homo sapiens
ggttcttacagcac

SEQ ID NO: 1591597 - DNA, 23 bp, Homo sapiens
ggttcttattttgcattccagaa

SEQ ID NO: 1591598 - DNA, 13 bp, Homo sapiens
ggttcttcccttt

SEQ ID NO: 1591599 - DNA, 13 bp, Homo sapiens
ggttcttcttatt

SEQ ID NO: 1591600 - DNA, 22 bp, Homo sapiens
ggttcttgagccagccaggccc

SEQ ID NO: 1591601 - DNA, 19 bp, Homo sapiens
ggttgaaaaccacagtcag

SEQ ID NO: 1591602 - DNA, 12 bp, Homo sapiens
ggttgaaagaca

SEQ ID NO: 1591603 - DNA, 16 bp, Homo sapiens
ggttgaaggcagtctg

SEQ ID NO: 1591604 - DNA, 21 bp, Homo sapiens
ggttgacaccattctcctgcc

SEQ ID NO: 1591605 - DNA, 19 bp, Homo sapiens
ggttgaggggctcctggaa

SEQ ID NO: 1591606 - DNA, 19 bp, Homo sapiens
ggttgaggtggaagccctc

SEQ ID NO: 1591607 - DNA, 21 bp, Homo sapiens
ggttgagtgtgtggtctctgc

SEQ ID NO: 1591608 - DNA, 19 bp, Homo sapiens
ggttgatggaaaataaaca

SEQ ID NO: 1591609 - DNA, 14 bp, Homo sapiens
ggttgcaaccactg

SEQ ID NO: 1591610 - DNA, 20 bp, Homo sapiens
ggttgcagcatgagactttc

SEQ ID NO: 1591611 - DNA, 13 bp, Homo sapiens
ggttgcagggagc

SEQ ID NO: 1591612 - DNA, 11 bp, Homo sapiens
ggttgcagtgc

SEQ ID NO: 1591613 - DNA, 14 bp, Homo sapiens
ggttgcctgggggc

SEQ ID NO: 1591614 - DNA, 16 bp, Homo sapiens
ggttgctcacagctgt

SEQ ID NO: 1591615 - DNA, 15 bp, Homo sapiens
ggttgcttaattcct

SEQ ID NO: 1591616 - DNA, 14 bp, Homo sapiens
ggttggagcccagg

SEQ ID NO: 1591617 - DNA, 21 bp, Homo sapiens
ggttggagcccagggcatctt

SEQ ID NO: 1591618 - DNA, 23 bp, Homo sapiens
ggttgggattgggggctggtgcc

SEQ ID NO: 1591619 - DNA, 17 bp, Homo sapiens
ggttgggcccagatctg

SEQ ID NO: 1591620 - DNA, 18 bp, Homo sapiens
ggttgggggacagccttc

SEQ ID NO: 1591621 - DNA, 19 bp, Homo sapiens
ggttggtcaaggccacctc

SEQ ID NO: 1591622 - DNA, 19 bp, Homo sapiens
ggttgtaattaaattctga

SEQ ID NO: 1591623 - DNA, 16 bp, Homo sapiens
ggttgtatttctatat

SEQ ID NO: 1591624 - DNA, 13 bp, Homo sapiens
ggttgtctccagg

SEQ ID NO: 1591625 - DNA, 16 bp, Homo sapiens
ggttgtgcacatttct

SEQ ID NO: 1591626 - DNA, 15 bp, Homo sapiens
ggttgttgccaggtt

SEQ ID NO: 1591627 - DNA, 18 bp, Homo sapiens
ggtttaaagaaagtgtat

SEQ ID NO: 1591628 - DNA, 20 bp, Homo sapiens
ggtttaaagagtctagattc

SEQ ID NO: 1591629 - DNA, 17 bp, Homo sapiens
ggtttaaatatgaatga

SEQ ID NO: 1591630 - DNA, 17 bp, Homo sapiens
ggtttaattctgtcttg

SEQ ID NO: 1591631 - DNA, 23 bp, Homo sapiens
ggtttacactgcggaagccaaag

SEQ ID NO: 1591632 - DNA, 22 bp, Homo sapiens
ggtttacattcatctcattcca

SEQ ID NO: 1591633 - DNA, 17 bp, Homo sapiens
ggtttactgtgaagaga

SEQ ID NO: 1591634 - DNA, 16 bp, Homo sapiens
ggtttcaaagatgctg

SEQ ID NO: 1591635 - DNA, 18 bp, Homo sapiens
ggtttcaaagatgctgtg

SEQ ID NO: 1591636 - DNA, 19 bp, Homo sapiens
ggtttcaccatgttggcca

SEQ ID NO: 1591637 - DNA, 13 bp, Homo sapiens
ggtttcatgttca

SEQ ID NO: 1591638 - DNA, 17 bp, Homo sapiens
ggtttcgactggtccag

SEQ ID NO: 1591639 - DNA, 15 bp, Homo sapiens
ggtttctcattaaag

SEQ ID NO: 1591640 - DNA, 21 bp, Homo sapiens
ggtttcttgtttaccaaagaa

SEQ ID NO: 1591641 - DNA, 18 bp, Homo sapiens
ggtttctttttttttcct

SEQ ID NO: 1591642 - DNA, 20 bp, Homo sapiens
ggtttgccagtgaagacttc

SEQ ID NO: 1591643 - DNA, 20 bp, Homo sapiens
gtaactactttttatactcc

SEQ ID NO: 1591644 - DNA, 20 bp, Homo sapiens
gtaactaggtttttgcttct

SEQ ID NO: 1591645 - DNA, 19 bp, Homo sapiens
gtaactattgggtgaatat

SEQ ID NO: 1591646 - DNA, 12 bp, Homo sapiens
gtaactccacca

SEQ ID NO: 1591647 - DNA, 23 bp, Homo sapiens
gtaactctaattcccattttgca

SEQ ID NO: 1591648 - DNA, 19 bp, Homo sapiens
gtaactgattacctgccaa

SEQ ID NO: 1591649 - DNA, 15 bp, Homo sapiens
gtaactgctgaaaac

SEQ ID NO: 1591650 - DNA, 14 bp, Homo sapiens
gtaactgctgagcc

SEQ ID NO: 1591651 - DNA, 13 bp, Homo sapiens
gtaactgtcctgt

SEQ ID NO: 1591652 - DNA, 16 bp, Homo sapiens
gtaactgttttttaag

SEQ ID NO: 1591653 - DNA, 15 bp, Homo sapiens
gtaacttatattgaa

SEQ ID NO: 1591654 - DNA, 15 bp, Homo sapiens
gtaacttcctgctgc

SEQ ID NO: 1591655 - DNA, 20 bp, Homo sapiens
gtaacttcctgctgcaccct

SEQ ID NO: 1591656 - DNA, 21 bp, Homo sapiens
gtaacttgcttaaatttctta

SEQ ID NO: 1591657 - DNA, 19 bp, Homo sapiens
gtaacttttgtaaatacac

SEQ ID NO: 1591658 - DNA, 14 bp, Homo sapiens
gtaacttttgtgaa

SEQ ID NO: 1591659 - DNA, 17 bp, Homo sapiens
gtaacttttttgtgtat

SEQ ID NO: 1591660 - DNA, 19 bp, Homo sapiens
gtaacttttttgtgtatgt

SEQ ID NO: 1591661 - DNA, 20 bp, Homo sapiens
gtaagaaagtgaagcaaatc

SEQ ID NO: 1591662 - DNA, 15 bp, Homo sapiens
gtaagaaccttgcct

SEQ ID NO: 1591663 - DNA, 19 bp, Homo sapiens
gtaagaactgtacattgtg

SEQ ID NO: 1591664 - DNA, 14 bp, Homo sapiens
gtaagaagaaagca

SEQ ID NO: 1591665 - DNA, 16 bp, Homo sapiens
gtaagaagaggagcct

SEQ ID NO: 1591666 - DNA, 20 bp, Homo sapiens
gtaagaagaggagcctcaga

SEQ ID NO: 1591667 - DNA, 17 bp, Homo sapiens
gtaagaattcagaagac

SEQ ID NO: 1591668 - DNA, 13 bp, Homo sapiens
gtaagaattctga

SEQ ID NO: 1591669 - DNA, 15 bp, Homo sapiens
gtaagacaagtggga

SEQ ID NO: 1591670 - DNA, 16 bp, Homo sapiens
gtaagacaagtgggat

SEQ ID NO: 1591671 - DNA, 16 bp, Homo sapiens
gtaagacaatccatgt

SEQ ID NO: 1591672 - DNA, 20 bp, Homo sapiens
gtaagacttttattaataaa

SEQ ID NO: 1591673 - DNA, 17 bp, Homo sapiens
gtaagagcttgctccag

SEQ ID NO: 1591674 - DNA, 18 bp, Homo sapiens
gtaagagcttgctccaga

SEQ ID NO: 1591675 - DNA, 22 bp, Homo sapiens
gtaagatatctcaatgaaccat

SEQ ID NO: 1591676 - DNA, 19 bp, Homo sapiens
gtaagatcgttctctgcct

SEQ ID NO: 1591677 - DNA, 15 bp, Homo sapiens
gtaagatgcactgaa

SEQ ID NO: 1591678 - DNA, 22 bp, Homo sapiens
gtaagattatagattctaaaga

SEQ ID NO: 1591679 - DNA, 12 bp, Homo sapiens
gtaagccagagc

SEQ ID NO: 1591680 - DNA, 23 bp, Homo sapiens
gtaagctcacatccagccttgga

SEQ ID NO: 1591681 - DNA, 20 bp, Homo sapiens
gtaagcttattgcttcatct

SEQ ID NO: 1591682 - DNA, 14 bp, Homo sapiens
gtaaggactgtaaa

SEQ ID NO: 1591683 - DNA, 18 bp, Homo sapiens
gtaaggatccggaaagaa

SEQ ID NO: 1591684 - DNA, 13 bp, Homo sapiens
gtaaggctctaga

SEQ ID NO: 1591685 - DNA, 19 bp, Homo sapiens
gtaaggtatatcattctaa

SEQ ID NO: 1591686 - DNA, 17 bp, Homo sapiens
gtaaggtgcttggagtt

SEQ ID NO: 1591687 - DNA, 23 bp, Homo sapiens
gtaaggtgtcttaatactgtcct

SEQ ID NO: 1591688 - DNA, 14 bp, Homo sapiens
gtaagtaacacagt

SEQ ID NO: 1591689 - DNA, 15 bp, Homo sapiens
gtaagtaacacagta

SEQ ID NO: 1591690 - DNA, 13 bp, Homo sapiens
gtaagtaattatc

SEQ ID NO: 1591691 - DNA, 23 bp, Homo sapiens
gtaagtaattatcgggaacagtg

SEQ ID NO: 1591692 - DNA, 16 bp, Homo sapiens
gtaagtatgtttttta

SEQ ID NO: 1591693 - DNA, 22 bp, Homo sapiens
gtaagtattcttatttaatgaa

SEQ ID NO: 1591694 - DNA, 20 bp, Homo sapiens
gtaagtatttccatagtcaa

SEQ ID NO: 1591695 - DNA, 14 bp, Homo sapiens
gtaagtgggcccac

SEQ ID NO: 1591696 - DNA, 17 bp, Homo sapiens
gtaagtgggcccacccg

SEQ ID NO: 1591697 - DNA, 14 bp, Homo sapiens
gtaagtgtaaaaaa

SEQ ID NO: 1591698 - DNA, 20 bp, Homo sapiens
gtaagtgtgagtaagagctg

SEQ ID NO: 1591699 - DNA, 21 bp, Homo sapiens
gtaagtttaaaggatgttggt

SEQ ID NO: 1591700 - DNA, 16 bp, Homo sapiens
gtaataaactgtgttt

SEQ ID NO: 1591701 - DNA, 17 bp, Homo sapiens
gtaataaagtatataat

SEQ ID NO: 1591702 - DNA, 22 bp, Homo sapiens
gtaataagaaagtataaagtca

SEQ ID NO: 1591703 - DNA, 13 bp, Homo sapiens
gtaataagcactg

SEQ ID NO: 1591704 - DNA, 21 bp, Homo sapiens
gtaataagcactgtaaacttc

SEQ ID NO: 1591705 - DNA, 18 bp, Homo sapiens
gtaataagggaaaaatca

SEQ ID NO: 1591706 - DNA, 14 bp, Homo sapiens
gtaatacttttgta

SEQ ID NO: 1591707 - DNA, 15 bp, Homo sapiens
gtaatagagcaaaat

SEQ ID NO: 1591708 - DNA, 17 bp, Homo sapiens
gtaatagcttctgtgtg

SEQ ID NO: 1591709 - DNA, 22 bp, Homo sapiens
gtaatagttcagtagaattacc

SEQ ID NO: 1591710 - DNA, 19 bp, Homo sapiens
gtaatataaatttaagcaa

SEQ ID NO: 1591711 - DNA, 20 bp, Homo sapiens
gtaatataaatttaagcaaa

SEQ ID NO: 1591712 - DNA, 14 bp, Homo sapiens
gtaatataatacac

SEQ ID NO: 1591713 - DNA, 22 bp, Homo sapiens
gtaatataatgtattttctttt

SEQ ID NO: 1591714 - DNA, 12 bp, Homo sapiens
gtaatatattgt

SEQ ID NO: 1591715 - DNA, 20 bp, Homo sapiens
gtaatatatttcagacattt

SEQ ID NO: 1591716 - DNA, 12 bp, Homo sapiens
gtaatatgaaat

SEQ ID NO: 1591717 - DNA, 19 bp, Homo sapiens
gtaatattgtaaatactgg

SEQ ID NO: 1591718 - DNA, 18 bp, Homo sapiens
gtaatattttactttgag

SEQ ID NO: 1591719 - DNA, 17 bp, Homo sapiens
gtaatattttccataaa

SEQ ID NO: 1591720 - DNA, 15 bp, Homo sapiens
gtaatcaggcagcct

SEQ ID NO: 1591721 - DNA, 15 bp, Homo sapiens
gtaatcatctaagtc

SEQ ID NO: 1591722 - DNA, 20 bp, Homo sapiens
gtaatccaggcacagctgag

SEQ ID NO: 1591723 - DNA, 15 bp, Homo sapiens
gtaatccaggggtgt

SEQ ID NO: 1591724 - DNA, 15 bp, Homo sapiens
gtaatcccagcactt

SEQ ID NO: 1591725 - DNA, 13 bp, Homo sapiens
gtaatcccagcta

SEQ ID NO: 1591726 - DNA, 16 bp, Homo sapiens
gtaatcccagctactt

SEQ ID NO: 1591727 - DNA, 13 bp, Homo sapiens
gtaatccctgctt

SEQ ID NO: 1591728 - DNA, 14 bp, Homo sapiens
gtaatctacaccaa

SEQ ID NO: 1591729 - DNA, 17 bp, Homo sapiens
gtaatctataactagga

SEQ ID NO: 1591730 - DNA, 20 bp, Homo sapiens
gtaatctctctgcagctgcc

SEQ ID NO: 1591731 - DNA, 22 bp, Homo sapiens
gtaatctctctgcagctgccgg

SEQ ID NO: 1591732 - DNA, 19 bp, Homo sapiens
gtaatctttacctgtatac

SEQ ID NO: 1591733 - DNA, 17 bp, Homo sapiens
gtaatgaaaatgaatat

SEQ ID NO: 1591734 - DNA, 21 bp, Homo sapiens
gtaatgaatttttatgatatt

SEQ ID NO: 1591735 - DNA, 21 bp, Homo sapiens
gtaatgacaaaagatacaaaa

SEQ ID NO: 1591736 - DNA, 17 bp, Homo sapiens
gtaatgcattgcctgta

SEQ ID NO: 1591737 - DNA, 12 bp, Homo sapiens
gtaatgctgcac

SEQ ID NO: 1591738 - DNA, 16 bp, Homo sapiens
gtaatggaactgaccc

SEQ ID NO: 1591739 - DNA, 22 bp, Homo sapiens
gtaatggggcagaaatctgagg

SEQ ID NO: 1591740 - DNA, 17 bp, Homo sapiens
gtaatgggtaattctga

SEQ ID NO: 1591741 - DNA, 17 bp, Homo sapiens
gtaatggtgtagaacac

SEQ ID NO: 1591742 - DNA, 14 bp, Homo sapiens
gtaatgtaaataaa

SEQ ID NO: 1591743 - DNA, 13 bp, Homo sapiens
gtaatgtaataaa

SEQ ID NO: 1591744 - DNA, 15 bp, Homo sapiens
gtaatgtaataaaaa

SEQ ID NO: 1591745 - DNA, 14 bp, Homo sapiens
gtaatgtgaataaa

SEQ ID NO: 1591746 - DNA, 14 bp, Homo sapiens
gtaatgttgtgaat

SEQ ID NO: 1591747 - DNA, 21 bp, Homo sapiens
gtaattaaaagcaaatcattt

SEQ ID NO: 1591748 - DNA, 16 bp, Homo sapiens
gtaattacctggagaa

SEQ ID NO: 1591749 - DNA, 17 bp, Homo sapiens
gtaattacctggagaag

SEQ ID NO: 1591750 - DNA, 20 bp, Homo sapiens
gtaattagtgccacttaatg

SEQ ID NO: 1591751 - DNA, 13 bp, Homo sapiens
gtaattatgtacc

SEQ ID NO: 1591752 - DNA, 14 bp, Homo sapiens
gtaattatttgaat

SEQ ID NO: 1591753 - DNA, 13 bp, Homo sapiens
gtaattcaagaaa

SEQ ID NO: 1591754 - DNA, 21 bp, Homo sapiens
gggtggccgctgagtggcagg

SEQ ID NO: 1591755 - DNA, 18 bp, Homo sapiens
gggtggctagtcagagag

SEQ ID NO: 1591756 - DNA, 22 bp, Homo sapiens
gggtggctcactactgaacaca

SEQ ID NO: 1591757 - DNA, 14 bp, Homo sapiens
gggtgggggagcca

SEQ ID NO: 1591758 - DNA, 13 bp, Homo sapiens
gggtggggggagt

SEQ ID NO: 1591759 - DNA, 18 bp, Homo sapiens
gggtgggggtgctgctct

SEQ ID NO: 1591760 - DNA, 17 bp, Homo sapiens
gggtggggtagggctga

SEQ ID NO: 1591761 - DNA, 17 bp, Homo sapiens
gggtgggttggggaggg

SEQ ID NO: 1591762 - DNA, 17 bp, Homo sapiens
gggtggtaactgccagc

SEQ ID NO: 1591763 - DNA, 13 bp, Homo sapiens
gggtggtcctgac

SEQ ID NO: 1591764 - DNA, 22 bp, Homo sapiens
gggtggtctcttcttggggccc

SEQ ID NO: 1591765 - DNA, 13 bp, Homo sapiens
gggtggtggggag

SEQ ID NO: 1591766 - DNA, 21 bp, Homo sapiens
gggtggttattggactccagg

SEQ ID NO: 1591767 - DNA, 22 bp, Homo sapiens
gggtggttattggactccaggc

SEQ ID NO: 1591768 - DNA, 19 bp, Homo sapiens
gggtgtaacaggtctcctc

SEQ ID NO: 1591769 - DNA, 21 bp, Homo sapiens
gggtgtaggggccacctcctc

SEQ ID NO: 1591770 - DNA, 17 bp, Homo sapiens
gggtgtcatctgaggag

SEQ ID NO: 1591771 - DNA, 17 bp, Homo sapiens
gggtgtcctgcctgtct

SEQ ID NO: 1591772 - DNA, 23 bp, Homo sapiens
gggtgtcttgggcagagctggct

SEQ ID NO: 1591773 - DNA, 14 bp, Homo sapiens
gggtgtgcatgcca

SEQ ID NO: 1591774 - DNA, 15 bp, Homo sapiens
gggtgtggccagcac

SEQ ID NO: 1591775 - DNA, 19 bp, Homo sapiens
gggtgtgggacacctggga

SEQ ID NO: 1591776 - DNA, 18 bp, Homo sapiens
gggtgttgtatggggagg

SEQ ID NO: 1591777 - DNA, 11 bp, Homo sapiens
gtatctcagaa

SEQ ID NO: 1591778 - DNA, 20 bp, Homo sapiens
gtatctcagaaagtgcctga

SEQ ID NO: 1591779 - DNA, 23 bp, Homo sapiens
gtatctcatactgtctgggatta

SEQ ID NO: 1591780 - DNA, 18 bp, Homo sapiens
gtatctcgtaatagcttc

SEQ ID NO: 1591781 - DNA, 21 bp, Homo sapiens
gtatctcgtaatagcttctgt

SEQ ID NO: 1591782 - DNA, 13 bp, Homo sapiens
gtatctcttcagt

SEQ ID NO: 1591783 - DNA, 20 bp, Homo sapiens
gtatctctttcacattgttt

SEQ ID NO: 1591784 - DNA, 12 bp, Homo sapiens
gtatctgagcag

SEQ ID NO: 1591785 - DNA, 17 bp, Homo sapiens
gtatctggcttccctgg

SEQ ID NO: 1591786 - DNA, 15 bp, Homo sapiens
gtatcttctattttt

SEQ ID NO: 1591787 - DNA, 22 bp, Homo sapiens
gtatcttctatttttatcatga

SEQ ID NO: 1591788 - DNA, 21 bp, Homo sapiens
gtatctttaaaaagcagtcct

SEQ ID NO: 1591789 - DNA, 17 bp, Homo sapiens
gtatctttattaaaaca

SEQ ID NO: 1591790 - DNA, 13 bp, Homo sapiens
gtatcttttgata

SEQ ID NO: 1591791 - DNA, 18 bp, Homo sapiens
gtatgaataaagacacct

SEQ ID NO: 1591792 - DNA, 17 bp, Homo sapiens
gtatgaataatgaaaat

SEQ ID NO: 1591793 - DNA, 22 bp, Homo sapiens
gtatgaataatgaaaataaaac

SEQ ID NO: 1591794 - DNA, 21 bp, Homo sapiens
gtatgaatctatgccaaagat

SEQ ID NO: 1591795 - DNA, 14 bp, Homo sapiens
gtatgagatggtta

SEQ ID NO: 1591796 - DNA, 15 bp, Homo sapiens
gtatgatactaaaga

SEQ ID NO: 1591797 - DNA, 22 bp, Homo sapiens
gtatgatgaaaataattttcca

SEQ ID NO: 1591798 - DNA, 23 bp, Homo sapiens
gtatgatttgttttgaattttgt

SEQ ID NO: 1591799 - DNA, 16 bp, Homo sapiens
gtatgcacaattccat

SEQ ID NO: 1591800 - DNA, 22 bp, Homo sapiens
gtatgcacagggtgtggtatga

SEQ ID NO: 1591801 - DNA, 18 bp, Homo sapiens
gtatgcactcccttgagg

SEQ ID NO: 1591802 - DNA, 23 bp, Homo sapiens
gtatgcagggagcactgttcaca

SEQ ID NO: 1591803 - DNA, 17 bp, Homo sapiens
gtatgcagttgataaga

SEQ ID NO: 1591804 - DNA, 19 bp, Homo sapiens
gtatgcagttgataagagg

SEQ ID NO: 1591805 - DNA, 22 bp, Homo sapiens
gtatgctttccctgaggaatga

SEQ ID NO: 1591806 - DNA, 14 bp, Homo sapiens
gtatggcagaggtg

SEQ ID NO: 1591807 - DNA, 19 bp, Homo sapiens
gtatgggtagggtaaatca

SEQ ID NO: 1591808 - DNA, 19 bp, Homo sapiens
gtatgggttaaatcaaaga

SEQ ID NO: 1591809 - DNA, 14 bp, Homo sapiens
gtatggtaatcttt

SEQ ID NO: 1591810 - DNA, 16 bp, Homo sapiens
gtatggtatctttaga

SEQ ID NO: 1591811 - DNA, 13 bp, Homo sapiens
gtatggtggaagc

SEQ ID NO: 1591812 - DNA, 14 bp, Homo sapiens
gtatggtggaagct

SEQ ID NO: 1591813 - DNA, 17 bp, Homo sapiens
gtatggttcaagattgt

SEQ ID NO: 1591814 - DNA, 15 bp, Homo sapiens
gtatggttctcagat

SEQ ID NO: 1591815 - DNA, 16 bp, Homo sapiens
gtatgtaatttatgca

SEQ ID NO: 1591816 - DNA, 18 bp, Homo sapiens
gtatgtacaatacaatgt

SEQ ID NO: 1591817 - DNA, 19 bp, Homo sapiens
gtatgtacaatacaatgta

SEQ ID NO: 1591818 - DNA, 22 bp, Homo sapiens
gtatgtcaataaacaacagctg

SEQ ID NO: 1591819 - DNA, 17 bp, Homo sapiens
gtatgtcagtgctataa

SEQ ID NO: 1591820 - DNA, 23 bp, Homo sapiens
gtatgtcagtgctataaatgcca

SEQ ID NO: 1591821 - DNA, 23 bp, Homo sapiens
gtatgtccccataagacaaacac

SEQ ID NO: 1591822 - DNA, 14 bp, Homo sapiens
gtatgtctctttaa

SEQ ID NO: 1591823 - DNA, 22 bp, Homo sapiens
gtatgtctctttaagttttgat

SEQ ID NO: 1591824 - DNA, 11 bp, Homo sapiens
gtatgtctgcc

SEQ ID NO: 1591825 - DNA, 13 bp, Homo sapiens
gtatgtctgccat

SEQ ID NO: 1591826 - DNA, 15 bp, Homo sapiens
gtatgtggaagtgtg

SEQ ID NO: 1591827 - DNA, 18 bp, Homo sapiens
gtatgttaaagagaatga

SEQ ID NO: 1591828 - DNA, 19 bp, Homo sapiens
gtatgtttaatctgttatg

SEQ ID NO: 1591829 - DNA, 18 bp, Homo sapiens
gtattaaaactaaatttc

SEQ ID NO: 1591830 - DNA, 22 bp, Homo sapiens
gtattaaattacatttgtaatt

SEQ ID NO: 1591831 - DNA, 12 bp, Homo sapiens
gtattaagaaag

SEQ ID NO: 1591832 - DNA, 14 bp, Homo sapiens
gtattaagaaagga

SEQ ID NO: 1591833 - DNA, 15 bp, Homo sapiens
gtattaagaaaggaa

SEQ ID NO: 1591834 - DNA, 18 bp, Homo sapiens
gtattaagtcaagaatat

SEQ ID NO: 1591835 - DNA, 14 bp, Homo sapiens
gtattaataaagca

SEQ ID NO: 1591836 - DNA, 15 bp, Homo sapiens
gtattaataaagcat

SEQ ID NO: 1591837 - DNA, 16 bp, Homo sapiens
gtattacacaagccaa

SEQ ID NO: 1591838 - DNA, 18 bp, Homo sapiens
gtattacttaggttattt

SEQ ID NO: 1591839 - DNA, 21 bp, Homo sapiens
gtattagctcactgaatcttc

SEQ ID NO: 1591840 - DNA, 20 bp, Homo sapiens
gtattagtatggttcaagat

SEQ ID NO: 1591841 - DNA, 20 bp, Homo sapiens
gtattatacatgtgatacat

SEQ ID NO: 1591842 - DNA, 22 bp, Homo sapiens
gtattatcaaagggataaagaa

SEQ ID NO: 1591843 - DNA, 20 bp, Homo sapiens
gtattatcttgttcaggaaa

SEQ ID NO: 1591844 - DNA, 16 bp, Homo sapiens
gtattatgtctcttct

SEQ ID NO: 1591845 - DNA, 17 bp, Homo sapiens
gtattattatgttctta

SEQ ID NO: 1591846 - DNA, 15 bp, Homo sapiens
gtattattctgtttt

SEQ ID NO: 1591847 - DNA, 17 bp, Homo sapiens
gtattattctgttttgc

SEQ ID NO: 1591848 - DNA, 16 bp, Homo sapiens
gtattatttcaccagc

SEQ ID NO: 1591849 - DNA, 19 bp, Homo sapiens
gtattatttcaccagcagc

SEQ ID NO: 1591850 - DNA, 22 bp, Homo sapiens
gtattcaataccgctcagtatt

SEQ ID NO: 1591851 - DNA, 23 bp, Homo sapiens
gtattcaataccgctcagtattt

SEQ ID NO: 1591852 - DNA, 22 bp, Homo sapiens
gtattcagtgagggtcttctta

SEQ ID NO: 1591853 - DNA, 14 bp, Homo sapiens
gtattcatatttgt

SEQ ID NO: 1591854 - DNA, 17 bp, Homo sapiens
gtattcatatttgtact

SEQ ID NO: 1591855 - DNA, 18 bp, Homo sapiens
gtattccatgagctgctc

SEQ ID NO: 1591856 - DNA, 20 bp, Homo sapiens
gtattcccactcaccagccc

SEQ ID NO: 1591857 - DNA, 17 bp, Homo sapiens
gtattcccttgtatttt

SEQ ID NO: 1591858 - DNA, 12 bp, Homo sapiens
gtattcctgttg

SEQ ID NO: 1591859 - DNA, 13 bp, Homo sapiens
gtattcctgttgc

SEQ ID NO: 1591860 - DNA, 18 bp, Homo sapiens
gtattccttaaataaact

SEQ ID NO: 1591861 - DNA, 21 bp, Homo sapiens
gtattctaaattttatatctt

SEQ ID NO: 1591862 - DNA, 14 bp, Homo sapiens
gtattctcttttca

SEQ ID NO: 1591863 - DNA, 18 bp, Homo sapiens
gtattctcttttcaagaa

SEQ ID NO: 1591864 - DNA, 15 bp, Homo sapiens
gtattctgacatgta

SEQ ID NO: 1591865 - DNA, 16 bp, Homo sapiens
gtattctgacatgtaa

SEQ ID NO: 1591866 - DNA, 16 bp, Homo sapiens
gtattcttgtttgaat

SEQ ID NO: 1591867 - DNA, 18 bp, Homo sapiens
gtattgactttatgttgt

SEQ ID NO: 1591868 - DNA, 21 bp, Homo sapiens
gtattgctgtgtctcctctca

SEQ ID NO: 1591869 - DNA, 17 bp, Homo sapiens
gtattgcttattttatt

SEQ ID NO: 1591870 - DNA, 17 bp, Homo sapiens
gtattggctatgatggt

SEQ ID NO: 1591871 - DNA, 20 bp, Homo sapiens
gtattggttgggggctcctg

SEQ ID NO: 1591872 - DNA, 13 bp, Homo sapiens
gtattgtgaccac

SEQ ID NO: 1591873 - DNA, 19 bp, Homo sapiens
gtattgtgaccactgaatt

SEQ ID NO: 1591874 - DNA, 20 bp, Homo sapiens
gtatttgtattaataaagca

SEQ ID NO: 1591875 - DNA, 22 bp, Homo sapiens
gtatttgtattaataaagcatt

SEQ ID NO: 1591876 - DNA, 13 bp, Homo sapiens
gtattttaacact

SEQ ID NO: 1591877 - DNA, 22 bp, Homo sapiens
gtattttatcttattttctcaa

SEQ ID NO: 1591878 - DNA, 14 bp, Homo sapiens
gtattttcatacaa

SEQ ID NO: 1591879 - DNA, 16 bp, Homo sapiens
gtattttcatgaaaat

SEQ ID NO: 1591880 - DNA, 15 bp, Homo sapiens
gtattttcttctctg

SEQ ID NO: 1591881 - DNA, 11 bp, Homo sapiens
gtattttgaat

SEQ ID NO: 1591882 - DNA, 16 bp, Homo sapiens
gtattttgtgatgaat

SEQ ID NO: 1591883 - DNA, 16 bp, Homo sapiens
gtattttgttaaagct

SEQ ID NO: 1591884 - DNA, 14 bp, Homo sapiens
gtatttttaatggg

SEQ ID NO: 1591885 - DNA, 18 bp, Homo sapiens
gtatttttaatgggggta

SEQ ID NO: 1591886 - DNA, 15 bp, Homo sapiens
gtatttttattcatg

SEQ ID NO: 1591887 - DNA, 16 bp, Homo sapiens
gtatttttattcatgt

SEQ ID NO: 1591888 - DNA, 20 bp, Homo sapiens
gtatttttcaggtaggccct

SEQ ID NO: 1591889 - DNA, 20 bp, Homo sapiens
gtatttttcatctttaagaa

SEQ ID NO: 1591890 - DNA, 12 bp, Homo sapiens
gtatttttgaca

SEQ ID NO: 1591891 - DNA, 15 bp, Homo sapiens
gtatttttgacagaa

SEQ ID NO: 1591892 - DNA, 16 bp, Homo sapiens
gtatttttgacagaat

SEQ ID NO: 1591893 - DNA, 20 bp, Homo sapiens
gtatttttgacagaatatgt

SEQ ID NO: 1591894 - DNA, 19 bp, Homo sapiens
gtatttttgattaacaatg

SEQ ID NO: 1591895 - DNA, 21 bp, Homo sapiens
gtatttttgggctattgcata

SEQ ID NO: 1591896 - DNA, 15 bp, Homo sapiens
gtattttttaaagct

SEQ ID NO: 1591897 - DNA, 23 bp, Homo sapiens
gtattttttacttttcacactgt

SEQ ID NO: 1591898 - DNA, 21 bp, Homo sapiens
gtattttttatttacatttta

SEQ ID NO: 1591899 - DNA, 21 bp, Homo sapiens
gtattttttcaagttgtaaat

SEQ ID NO: 1591900 - DNA, 22 bp, Homo sapiens
gtattttttttttaaataaaag

SEQ ID NO: 1591901 - DNA, 20 bp, Homo sapiens
gtcaaaaaattatttgctat

SEQ ID NO: 1591902 - DNA, 13 bp, Homo sapiens
gtcaaaaattaaa

SEQ ID NO: 1591903 - DNA, 14 bp, Homo sapiens
gtcaaaaattaaac

SEQ ID NO: 1591904 - DNA, 23 bp, Homo sapiens
gtcaaaaattaaaccggaccatc

SEQ ID NO: 1591905 - DNA, 15 bp, Homo sapiens
gtcaaaaggtgcctg

SEQ ID NO: 1591906 - DNA, 16 bp, Homo sapiens
gtcaaactgtagaaat

SEQ ID NO: 1591907 - DNA, 13 bp, Homo sapiens
gtcaaagaagctt

SEQ ID NO: 1591908 - DNA, 19 bp, Homo sapiens
gtcaaagacagaatggtgg

SEQ ID NO: 1591909 - DNA, 13 bp, Homo sapiens
gtcaaagtaaaac

SEQ ID NO: 1591910 - DNA, 19 bp, Homo sapiens
gtcaaagtgttgctgtggc

SEQ ID NO: 1591911 - DNA, 22 bp, Homo sapiens
gtcaaagtgttgctgtggctcc

SEQ ID NO: 1591912 - DNA, 15 bp, Homo sapiens
gtcaaagttgaaaat

SEQ ID NO: 1591913 - DNA, 12 bp, Homo sapiens
gtcaaatccagt

SEQ ID NO: 1591914 - DNA, 16 bp, Homo sapiens
gtcaaatccagtggtg

SEQ ID NO: 1591915 - DNA, 18 bp, Homo sapiens
gtcaaatccagtggtggg

SEQ ID NO: 1591916 - DNA, 21 bp, Homo sapiens
gtcaaatccagtggtgggtaa

SEQ ID NO: 1591917 - DNA, 16 bp, Homo sapiens
gtcaaatctgggctca

SEQ ID NO: 1591918 - DNA, 22 bp, Homo sapiens
gtcaaatgcatacaagtttcat

SEQ ID NO: 1591919 - DNA, 16 bp, Homo sapiens
gtcaaatgctagaaaa

SEQ ID NO: 1591920 - DNA, 14 bp, Homo sapiens
gtcaaatgtttcct

SEQ ID NO: 1591921 - DNA, 16 bp, Homo sapiens
gtcaaatgtttcctta

SEQ ID NO: 1591922 - DNA, 18 bp, Homo sapiens
gtcaacaaactatttctt

SEQ ID NO: 1591923 - DNA, 22 bp, Homo sapiens
gtcaacacttaagggttttaga

SEQ ID NO: 1591924 - DNA, 19 bp, Homo sapiens
gtcaacagagaaggcagga

SEQ ID NO: 1591925 - DNA, 22 bp, Homo sapiens
gtcaacagagaaggcaggaatg

SEQ ID NO: 1591926 - DNA, 13 bp, Homo sapiens
gtcaacagattca

SEQ ID NO: 1591927 - DNA, 18 bp, Homo sapiens
gtcaacagattcagaatg

SEQ ID NO: 1591928 - DNA, 18 bp, Homo sapiens
gtcaacagcaaagcttgg

SEQ ID NO: 1591929 - DNA, 13 bp, Homo sapiens
gtcaacagtaaac

SEQ ID NO: 1591930 - DNA, 21 bp, Homo sapiens
gtcaacctgcttttttctgtt

SEQ ID NO: 1591931 - DNA, 19 bp, Homo sapiens
gtcaactgctgttttatgt

SEQ ID NO: 1591932 - DNA, 12 bp, Homo sapiens
gtcaagaagaaa

SEQ ID NO: 1591933 - DNA, 12 bp, Homo sapiens
gtcaagacattt

SEQ ID NO: 1591934 - DNA, 19 bp, Homo sapiens
gtcaagagatcgagaccat

SEQ ID NO: 1591935 - DNA, 13 bp, Homo sapiens
gtcaaggccacct

SEQ ID NO: 1591936 - DNA, 15 bp, Homo sapiens
gtcaaggccacctct

SEQ ID NO: 1591937 - DNA, 22 bp, Homo sapiens
gtcaaggccacctctgcctcta

SEQ ID NO: 1591938 - DNA, 20 bp, Homo sapiens
gtcaagggcttactatttct

SEQ ID NO: 1591939 - DNA, 15 bp, Homo sapiens
gtcaagtaagaagac

SEQ ID NO: 1591940 - DNA, 14 bp, Homo sapiens
gtcaagtctctgct

SEQ ID NO: 1591941 - DNA, 13 bp, Homo sapiens
gtcaagttcccaa

SEQ ID NO: 1591942 - DNA, 22 bp, Homo sapiens
gtcaagttggacttgttttaac

SEQ ID NO: 1591943 - DNA, 16 bp, Homo sapiens
gtcaagttgtgcttgt

SEQ ID NO: 1591944 - DNA, 18 bp, Homo sapiens
gtcaataaacaacagctg

SEQ ID NO: 1591945 - DNA, 20 bp, Homo sapiens
gtcaataaacaacagctgaa

SEQ ID NO: 1591946 - DNA, 22 bp, Homo sapiens
gtcaataaacaacagctgaagc

SEQ ID NO: 1591947 - DNA, 13 bp, Homo sapiens
gtcaataaacagc

SEQ ID NO: 1591948 - DNA, 22 bp, Homo sapiens
gtcaataaacttagaggaaaat

SEQ ID NO: 1591949 - DNA, 19 bp, Homo sapiens
gtcaatatcgtacctgtcc

SEQ ID NO: 1591950 - DNA, 21 bp, Homo sapiens
gtcaatatcgtacctgtccct

SEQ ID NO: 1591951 - DNA, 14 bp, Homo sapiens
gtcaatattaaata

SEQ ID NO: 1591952 - DNA, 15 bp, Homo sapiens
gtcaatattaaatac

SEQ ID NO: 1591953 - DNA, 18 bp, Homo sapiens
gtcaatattaaatacaga

SEQ ID NO: 1591954 - DNA, 11 bp, Homo sapiens
gtcacaataaa

SEQ ID NO: 1591955 - DNA, 12 bp, Homo sapiens
gtcacaataaat

SEQ ID NO: 1591956 - DNA, 20 bp, Homo sapiens
gtcacacagtgttggaggtt

SEQ ID NO: 1591957 - DNA, 18 bp, Homo sapiens
gtcacactcttcagtgac

SEQ ID NO: 1591958 - DNA, 12 bp, Homo sapiens
gtcacagagtga

SEQ ID NO: 1591959 - DNA, 13 bp, Homo sapiens
gtcacagctgcag

SEQ ID NO: 1591960 - DNA, 16 bp, Homo sapiens
gtcacagctgcagctg

SEQ ID NO: 1591961 - DNA, 19 bp, Homo sapiens
gtcacagctgcagctgggc

SEQ ID NO: 1591962 - DNA, 15 bp, Homo sapiens
gtcacaggaaaaagt

SEQ ID NO: 1591963 - DNA, 14 bp, Homo sapiens
gtcacatacaatta

SEQ ID NO: 1591964 - DNA, 17 bp, Homo sapiens
gtcacattccacatctg

SEQ ID NO: 1591965 - DNA, 22 bp, Homo sapiens
gtcaccaaatagtgtgaaatat

SEQ ID NO: 1591966 - DNA, 15 bp, Homo sapiens
gtcaccaaatttgta

SEQ ID NO: 1591967 - DNA, 17 bp, Homo sapiens
gtcaccaagctcacagt

SEQ ID NO: 1591968 - DNA, 16 bp, Homo sapiens
gtcatctggtagattt

SEQ ID NO: 1591969 - DNA, 13 bp, Homo sapiens
gtcatcttgagct

SEQ ID NO: 1591970 - DNA, 14 bp, Homo sapiens
gtcatcttgctacc

SEQ ID NO: 1591971 - DNA, 15 bp, Homo sapiens
gtcatcttgctacca

SEQ ID NO: 1591972 - DNA, 22 bp, Homo sapiens
gtcatcttgctaccagtattta

SEQ ID NO: 1591973 - DNA, 21 bp, Homo sapiens
gtcatgaagtgcacaggagcc

SEQ ID NO: 1591974 - DNA, 19 bp, Homo sapiens
gtcatgatctccctgccgc

SEQ ID NO: 1591975 - DNA, 19 bp, Homo sapiens
gtcatgcagttcctggccc

SEQ ID NO: 1591976 - DNA, 13 bp, Homo sapiens
gtcatgcattggt

SEQ ID NO: 1591977 - DNA, 15 bp, Homo sapiens
gtcatgcccccctca

SEQ ID NO: 1591978 - DNA, 16 bp, Homo sapiens
gtcatgcccccctcaa

SEQ ID NO: 1591979 - DNA, 14 bp, Homo sapiens
gtcatgctcagcct

SEQ ID NO: 1591980 - DNA, 16 bp, Homo sapiens
gtcatgctcagccttg

SEQ ID NO: 1591981 - DNA, 12 bp, Homo sapiens
gtcatgcttcat

SEQ ID NO: 1591982 - DNA, 13 bp, Homo sapiens
gtcatgcttttgc

SEQ ID NO: 1591983 - DNA, 14 bp, Homo sapiens
gtcatggcctgaga

SEQ ID NO: 1591984 - DNA, 14 bp, Homo sapiens
gtcatgtaccatca

SEQ ID NO: 1591985 - DNA, 17 bp, Homo sapiens
gtcatgtacttcctgtg

SEQ ID NO: 1591986 - DNA, 17 bp, Homo sapiens
gtcatgtgcatctggtg

SEQ ID NO: 1591987 - DNA, 14 bp, Homo sapiens
gtcatgtgtataaa

SEQ ID NO: 1591988 - DNA, 12 bp, Homo sapiens
gtcatgtgtgca

SEQ ID NO: 1591989 - DNA, 13 bp, Homo sapiens
gtcatgtgtgcat

SEQ ID NO: 1591990 - DNA, 21 bp, Homo sapiens
gtcattatgggttaggcatta

SEQ ID NO: 1591991 - DNA, 21 bp, Homo sapiens
gtcattctaggatgtggagct

SEQ ID NO: 1591992 - DNA, 19 bp, Homo sapiens
gtcattgcacataagcttc

SEQ ID NO: 1591993 - DNA, 12 bp, Homo sapiens
gtcattgcccct

SEQ ID NO: 1591994 - DNA, 13 bp, Homo sapiens
gtcattgcccctc

SEQ ID NO: 1591995 - DNA, 23 bp, Homo sapiens
gtcattgtaatgttgtgaataat

SEQ ID NO: 1591996 - DNA, 13 bp, Homo sapiens
gtcattgtctact

SEQ ID NO: 1591997 - DNA, 20 bp, Homo sapiens
gtcatttactcaaaatctgt

SEQ ID NO: 1591998 - DNA, 23 bp, Homo sapiens
gtcatttatatagattataactt

SEQ ID NO: 1591999 - DNA, 21 bp, Homo sapiens
gtcatttgctgagcatgtact

SEQ ID NO: 1592000 - DNA, 22 bp, Homo sapiens
gtcatttgctgagcatgtactg

SEQ ID NO: 1592001 - DNA, 21 bp, Homo sapiens
gtcattttaactttatcacat

SEQ ID NO: 1592002 - DNA, 16 bp, Homo sapiens
gtcattttgcactgta

SEQ ID NO: 1592003 - DNA, 17 bp, Homo sapiens
gtcatttttaatgtatc

SEQ ID NO: 1592004 - DNA, 18 bp, Homo sapiens
gtcatttttaatgtatct

SEQ ID NO: 1592005 - DNA, 22 bp, Homo sapiens
gtcatttttaatgtatctattt

SEQ ID NO: 1592006 - DNA, 16 bp, Homo sapiens
gtcatttttgtatttt

SEQ ID NO: 1592007 - DNA, 15 bp, Homo sapiens
gtccaaaaaaaggaa

SEQ ID NO: 1592008 - DNA, 20 bp, Homo sapiens
gtccaaaaaaaggaaaaata

SEQ ID NO: 1592009 - DNA, 20 bp, Homo sapiens
gtccaaaaagctcctggggc

SEQ ID NO: 1592010 - DNA, 20 bp, Homo sapiens
gtccaaaggaggctggcagg

SEQ ID NO: 1592011 - DNA, 20 bp, Homo sapiens
gtccaaagtgcgtgtgtgta

SEQ ID NO: 1592012 - DNA, 22 bp, Homo sapiens
gtccaaatgtcctccagaagcc

SEQ ID NO: 1592013 - DNA, 19 bp, Homo sapiens
gtccaaatgtgatcaactg

SEQ ID NO: 1592014 - DNA, 14 bp, Homo sapiens
gtccaacaagaatg

SEQ ID NO: 1592015 - DNA, 23 bp, Homo sapiens
gtccaacaataaacaggaatttt

SEQ ID NO: 1592016 - DNA, 23 bp, Homo sapiens
gtccaacatggtgaaacccccat

SEQ ID NO: 1592017 - DNA, 20 bp, Homo sapiens
gtccaacccgaggcccgcat

SEQ ID NO: 1592018 - DNA, 20 bp, Homo sapiens
gtccaagaactctaaccagt

SEQ ID NO: 1592019 - DNA, 12 bp, Homo sapiens
gtccaagcagag

SEQ ID NO: 1592020 - DNA, 14 bp, Homo sapiens
gtccaagcagagtg

SEQ ID NO: 1592021 - DNA, 16 bp, Homo sapiens
gtccaagggacagccc

SEQ ID NO: 1592022 - DNA, 20 bp, Homo sapiens
gtccaaggtttaaagagtct

SEQ ID NO: 1592023 - DNA, 23 bp, Homo sapiens
gtccaatgtacaggaagtagttc

SEQ ID NO: 1592024 - DNA, 23 bp, Homo sapiens
gtccaatttgtaagtaacacagt

SEQ ID NO: 1592025 - DNA, 15 bp, Homo sapiens
gtccacagatgcctc

SEQ ID NO: 1592026 - DNA, 17 bp, Homo sapiens
gtccacagatgcctcca

SEQ ID NO: 1592027 - DNA, 16 bp, Homo sapiens
gtccacagctggaaag

SEQ ID NO: 1592028 - DNA, 13 bp, Homo sapiens
gtccacaggggca

SEQ ID NO: 1592029 - DNA, 15 bp, Homo sapiens
gtccacaggggcagg

SEQ ID NO: 1592030 - DNA, 21 bp, Homo sapiens
gtccacaggggcaggcctggg

SEQ ID NO: 1592031 - DNA, 22 bp, Homo sapiens
gtccacaggggcaggcctggga

SEQ ID NO: 1592032 - DNA, 19 bp, Homo sapiens
gtccacaggggccaccacc

SEQ ID NO: 1592033 - DNA, 19 bp, Homo sapiens
gtccacatccccagagccc

SEQ ID NO: 1592034 - DNA, 23 bp, Homo sapiens
gtccacatccccagagcccagct

SEQ ID NO: 1592035 - DNA, 12 bp, Homo sapiens
gtccaccatgaa

SEQ ID NO: 1592036 - DNA, 14 bp, Homo sapiens
gtccaccctgccaa

SEQ ID NO: 1592037 - DNA, 21 bp, Homo sapiens
gtccacctggccccatgtctc

SEQ ID NO: 1592038 - DNA, 17 bp, Homo sapiens
gtccactctcggggccc

SEQ ID NO: 1592039 - DNA, 19 bp, Homo sapiens
gtccactctcggggccctt

SEQ ID NO: 1592040 - DNA, 20 bp, Homo sapiens
gtccactctcggggcccttg

SEQ ID NO: 1592041 - DNA, 21 bp, Homo sapiens
gtccactctcggggcccttgg

SEQ ID NO: 1592042 - DNA, 19 bp, Homo sapiens
gtccactgttgagccccag

SEQ ID NO: 1592043 - DNA, 18 bp, Homo sapiens
gtccagaaactcctgttt

SEQ ID NO: 1592044 - DNA, 17 bp, Homo sapiens
gtccagaagaatattca

SEQ ID NO: 1592045 - DNA, 19 bp, Homo sapiens
gtccagaagaatattcagg

SEQ ID NO: 1592046 - DNA, 21 bp, Homo sapiens
gtccagaagaatattcaggac

SEQ ID NO: 1592047 - DNA, 23 bp, Homo sapiens
gtccagacagcttgactgctttt

SEQ ID NO: 1592048 - DNA, 13 bp, Homo sapiens
gtccagagcttgt

SEQ ID NO: 1592049 - DNA, 15 bp, Homo sapiens
gtccagagtagtttc

SEQ ID NO: 1592050 - DNA, 12 bp, Homo sapiens
gtccagcagctg

SEQ ID NO: 1592051 - DNA, 14 bp, Homo sapiens
gtccagccagctcc

SEQ ID NO: 1592052 - DNA, 16 bp, Homo sapiens
gtccagcgtcactcca

SEQ ID NO: 1592053 - DNA, 17 bp, Homo sapiens
gtccataatgttctgct

SEQ ID NO: 1592054 - DNA, 12 bp, Homo sapiens
gtccatggcacc

SEQ ID NO: 1592055 - DNA, 14 bp, Homo sapiens
gtccatggcaccag

SEQ ID NO: 1592056 - DNA, 21 bp, Homo sapiens
gtccatggcaccagccccctg

SEQ ID NO: 1592057 - DNA, 14 bp, Homo sapiens
gtccatgtaaatac

SEQ ID NO: 1592058 - DNA, 16 bp, Homo sapiens
gtccatgtaaatactt

SEQ ID NO: 1592059 - DNA, 18 bp, Homo sapiens
gtccatgtattcacacac

SEQ ID NO: 1592060 - DNA, 20 bp, Homo sapiens
gtccatgtttattgtttttt

SEQ ID NO: 1592061 - DNA, 19 bp, Homo sapiens
gtccatttcccacatcttt

SEQ ID NO: 1592062 - DNA, 15 bp, Homo sapiens
gtcccaagcctgata

SEQ ID NO: 1592063 - DNA, 14 bp, Homo sapiens
gtcccaaggagctg

SEQ ID NO: 1592064 - DNA, 13 bp, Homo sapiens
gtcccacaccgct

SEQ ID NO: 1592065 - DNA, 16 bp, Homo sapiens
gtcccacactttgaag

SEQ ID NO: 1592066 - DNA, 21 bp, Homo sapiens
gtcccaccaactctgcactcc

SEQ ID NO: 1592067 - DNA, 22 bp, Homo sapiens
gtcccaccaactctgcactcca

SEQ ID NO: 1592068 - DNA, 17 bp, Homo sapiens
gtcccacccacacagct

SEQ ID NO: 1592069 - DNA, 19 bp, Homo sapiens
gtcccacccacacagctgc

SEQ ID NO: 1592070 - DNA, 13 bp, Homo sapiens
gtcccacccaccc

SEQ ID NO: 1592071 - DNA, 14 bp, Homo sapiens
gtcccacccccacc

SEQ ID NO: 1592072 - DNA, 16 bp, Homo sapiens
gtcccaccctcttccc

SEQ ID NO: 1592073 - DNA, 18 bp, Homo sapiens
gtcccagagcaggaggcc

SEQ ID NO: 1592074 - DNA, 19 bp, Homo sapiens
gtcccagagcaggaggccc

SEQ ID NO: 1592075 - DNA, 22 bp, Homo sapiens
gtcccagagcaggaggcccctg

SEQ ID NO: 1592076 - DNA, 22 bp, Homo sapiens
gtcccagaggttatctgcctgg

SEQ ID NO: 1592077 - DNA, 15 bp, Homo sapiens
gtcccagagtggctg

SEQ ID NO: 1592078 - DNA, 17 bp, Homo sapiens
gtcccagattggctcac

SEQ ID NO: 1592079 - DNA, 22 bp, Homo sapiens
gtcccagattggctcacactga

SEQ ID NO: 1592080 - DNA, 17 bp, Homo sapiens
gtcccagcatccctgga

SEQ ID NO: 1592081 - DNA, 20 bp, Homo sapiens
gtcccagcatccctggagca

SEQ ID NO: 1592082 - DNA, 18 bp, Homo sapiens
gtcccagccaccccgggc

SEQ ID NO: 1592083 - DNA, 23 bp, Homo sapiens
gtcccagccaccccgggctctct

SEQ ID NO: 1592084 - DNA, 16 bp, Homo sapiens
gtcccagcctggggct

SEQ ID NO: 1592085 - DNA, 22 bp, Homo sapiens
gtcccagcctggggctccctct

SEQ ID NO: 1592086 - DNA, 12 bp, Homo sapiens
gtcccagctgaa

SEQ ID NO: 1592087 - DNA, 16 bp, Homo sapiens
gtcccagctgaaggca

SEQ ID NO: 1592088 - DNA, 22 bp, Homo sapiens
gtcccagctgaaggcagtggca

SEQ ID NO: 1592089 - DNA, 20 bp, Homo sapiens
gtcccagggaaggtggggcc

SEQ ID NO: 1592090 - DNA, 12 bp, Homo sapiens
gtcccagggccc

SEQ ID NO: 1592091 - DNA, 15 bp, Homo sapiens
gtcccagggccctcc

SEQ ID NO: 1592092 - DNA, 18 bp, Homo sapiens
gtcccagggctctgcagg

SEQ ID NO: 1592093 - DNA, 19 bp, Homo sapiens
gtcccagggctctgcaggc

SEQ ID NO: 1592094 - DNA, 22 bp, Homo sapiens
gtcccagggctctgcaggccac

SEQ ID NO: 1592095 - DNA, 14 bp, Homo sapiens
gtcccaggggcagc

SEQ ID NO: 1592096 - DNA, 10 bp, Homo sapiens
gtcccagtgg

SEQ ID NO: 1592097 - DNA, 18 bp, Homo sapiens
gtcccagtgggaggggca

SEQ ID NO: 1592098 - DNA, 22 bp, Homo sapiens
gtcccagtgggaggggcaggct

SEQ ID NO: 1592099 - DNA, 23 bp, Homo sapiens
gtcccagtgggaggggcaggctg

SEQ ID NO: 1592100 - DNA, 13 bp, Homo sapiens
gtcccatccaggc

SEQ ID NO: 1592101 - DNA, 15 bp, Homo sapiens
gtcccatccaggcag

SEQ ID NO: 1592102 - DNA, 19 bp, Homo sapiens
gtcccatgacccacccctg

SEQ ID NO: 1592103 - DNA, 18 bp, Homo sapiens
gtcccatggctgaagctg

SEQ ID NO: 1592104 - DNA, 21 bp, Homo sapiens
gtcccatggggaaaccctgga

SEQ ID NO: 1592105 - DNA, 15 bp, Homo sapiens
gtcccattctagatc

SEQ ID NO: 1592106 - DNA, 20 bp, Homo sapiens
gtcccattctagatcctgca

SEQ ID NO: 1592107 - DNA, 17 bp, Homo sapiens
gtcccatttccttggag

SEQ ID NO: 1592108 - DNA, 16 bp, Homo sapiens
gtccccaaggcctctc

SEQ ID NO: 1592109 - DNA, 15 bp, Homo sapiens
gtccccacccgcctg

SEQ ID NO: 1592110 - DNA, 18 bp, Homo sapiens
gtccccagagaccaggct

SEQ ID NO: 1592111 - DNA, 12 bp, Homo sapiens
gtccccagccct

SEQ ID NO: 1592112 - DNA, 13 bp, Homo sapiens
gtccccagccctt

SEQ ID NO: 1592113 - DNA, 12 bp, Homo sapiens
gtccccagctcc

SEQ ID NO: 1592114 - DNA, 16 bp, Homo sapiens
gtccccagggcccctc

SEQ ID NO: 1592115 - DNA, 14 bp, Homo sapiens
gtccccagttgccg

SEQ ID NO: 1592116 - DNA, 19 bp, Homo sapiens
gtccccagtttgcagaaaa

SEQ ID NO: 1592117 - DNA, 20 bp, Homo sapiens
gtccccataagacaaacact

SEQ ID NO: 1592118 - DNA, 17 bp, Homo sapiens
gtccccattctataaat

SEQ ID NO: 1592119 - DNA, 15 bp, Homo sapiens
gtcccccaacttgag

SEQ ID NO: 1592120 - DNA, 22 bp, Homo sapiens
gtcccccaaggttttggagtca

SEQ ID NO: 1592121 - DNA, 12 bp, Homo sapiens
gtcccccagctc

SEQ ID NO: 1592122 - DNA, 16 bp, Homo sapiens
gtcccccagctctggt

SEQ ID NO: 1592123 - DNA, 18 bp, Homo sapiens
gtcccccgactgcctgtc

SEQ ID NO: 1592124 - DNA, 19 bp, Homo sapiens
gtcccccgactgcctgtct

SEQ ID NO: 1592125 - DNA, 13 bp, Homo sapiens
gtcccccgccgcg

SEQ ID NO: 1592126 - DNA, 21 bp, Homo sapiens
gtcccccgccgcgccagtccc

SEQ ID NO: 1592127 - DNA, 16 bp, Homo sapiens
gtccccgaggagctgg

SEQ ID NO: 1592128 - DNA, 17 bp, Homo sapiens
gtccccgaggagctggg

SEQ ID NO: 1592129 - DNA, 19 bp, Homo sapiens
gtccccgaggagctgggcc

SEQ ID NO: 1592130 - DNA, 23 bp, Homo sapiens
gtccccgaggagctgggcccctg

SEQ ID NO: 1592131 - DNA, 17 bp, Homo sapiens
gtccccgatgctgacct

SEQ ID NO: 1592132 - DNA, 16 bp, Homo sapiens
gtccccgctgctgtgc

SEQ ID NO: 1592133 - DNA, 11 bp, Homo sapiens
gtcccctactc

SEQ ID NO: 1592134 - DNA, 12 bp, Homo sapiens
gtcccctcagcg

SEQ ID NO: 1592135 - DNA, 20 bp, Homo sapiens
gtccctctcctatgtggcag

SEQ ID NO: 1592136 - DNA, 23 bp, Homo sapiens
gtccctctcctatgtggcagctg

SEQ ID NO: 1592137 - DNA, 11 bp, Homo sapiens
gtccctctgtg

SEQ ID NO: 1592138 - DNA, 12 bp, Homo sapiens
gtccctctgtgg

SEQ ID NO: 1592139 - DNA, 12 bp, Homo sapiens
gtccctctgtgt

SEQ ID NO: 1592140 - DNA, 14 bp, Homo sapiens
gtccctctgtgtat

SEQ ID NO: 1592141 - DNA, 18 bp, Homo sapiens
gtccctgactctctgtga

SEQ ID NO: 1592142 - DNA, 21 bp, Homo sapiens
gtccctgcacagtgacttctg

SEQ ID NO: 1592143 - DNA, 12 bp, Homo sapiens
gtccctgcaggg

SEQ ID NO: 1592144 - DNA, 14 bp, Homo sapiens
gtccctgcagggcc

SEQ ID NO: 1592145 - DNA, 18 bp, Homo sapiens
gtccctgcagggccatct

SEQ ID NO: 1592146 - DNA, 17 bp, Homo sapiens
gtccctgccacactcag

SEQ ID NO: 1592147 - DNA, 18 bp, Homo sapiens
gtccctgccacactcagt

SEQ ID NO: 1592148 - DNA, 24 bp, Homo sapiens
gtccctgccacactcagtccccca

SEQ ID NO: 1592149 - DNA, 16 bp, Homo sapiens
gtccctgccccgaccc

SEQ ID NO: 1592150 - DNA, 21 bp, Homo sapiens
gtccctgccctcccctgctcc

SEQ ID NO: 1592151 - DNA, 18 bp, Homo sapiens
gtccctggacacagctct

SEQ ID NO: 1592152 - DNA, 23 bp, Homo sapiens
gtccctggacacagctcttcatt

SEQ ID NO: 1592153 - DNA, 14 bp, Homo sapiens
gtccctggagctgt

SEQ ID NO: 1592154 - DNA, 19 bp, Homo sapiens
gtccctgggggaagccctg

SEQ ID NO: 1592155 - DNA, 21 bp, Homo sapiens
gtccctgggggaagccctgga

SEQ ID NO: 1592156 - DNA, 15 bp, Homo sapiens
gtccctggtaataag

SEQ ID NO: 1592157 - DNA, 19 bp, Homo sapiens
gtccctggtccctcgtcca

SEQ ID NO: 1592158 - DNA, 24 bp, Homo sapiens
gtccctggtccctcgtccacaggg

SEQ ID NO: 1592159 - DNA, 20 bp, Homo sapiens
gtccctggttcctagatgtg

SEQ ID NO: 1592160 - DNA, 16 bp, Homo sapiens
gtccctgtagctcagt

SEQ ID NO: 1592161 - DNA, 17 bp, Homo sapiens
gtccctgttttctgagc

SEQ ID NO: 1592162 - DNA, 19 bp, Homo sapiens
gtccctgttttctgagccc

SEQ ID NO: 1592163 - DNA, 19 bp, Homo sapiens
gtcccttcagactggccct

SEQ ID NO: 1592164 - DNA, 13 bp, Homo sapiens
gtcccttcccctc

SEQ ID NO: 1592165 - DNA, 20 bp, Homo sapiens
gtcccttcccctccctggct

SEQ ID NO: 1592166 - DNA, 17 bp, Homo sapiens
gtcccttgagacctcag

SEQ ID NO: 1592167 - DNA, 21 bp, Homo sapiens
gtcccttgagacctcagccat

SEQ ID NO: 1592168 - DNA, 13 bp, Homo sapiens
gtcccttgcagct

SEQ ID NO: 1592169 - DNA, 13 bp, Homo sapiens
gtcccttgcctca

SEQ ID NO: 1592170 - DNA, 14 bp, Homo sapiens
gtcccttgcctctg

SEQ ID NO: 1592171 - DNA, 16 bp, Homo sapiens
gtcccttgcctctgcc

SEQ ID NO: 1592172 - DNA, 22 bp, Homo sapiens
gtcccttgcctctgccctggat

SEQ ID NO: 1592173 - DNA, 11 bp, Homo sapiens
gtcccttgctg

SEQ ID NO: 1592174 - DNA, 16 bp, Homo sapiens
gtccctttccctacct

SEQ ID NO: 1592175 - DNA, 17 bp, Homo sapiens
gtccctttccctacctt

SEQ ID NO: 1592176 - DNA, 15 bp, Homo sapiens
gtccctttcttggcc

SEQ ID NO: 1592177 - DNA, 22 bp, Homo sapiens
gtccctttcttggccagttatc

SEQ ID NO: 1592178 - DNA, 14 bp, Homo sapiens
gtccctttgctccc

SEQ ID NO: 1592179 - DNA, 15 bp, Homo sapiens
gtccctttgctcccg

SEQ ID NO: 1592180 - DNA, 15 bp, Homo sapiens
gtcccttttctttga

SEQ ID NO: 1592181 - DNA, 13 bp, Homo sapiens
gtcccttttgcta

SEQ ID NO: 1592182 - DNA, 22 bp, Homo sapiens
gtccctttttctccacactcca

SEQ ID NO: 1592183 - DNA, 15 bp, Homo sapiens
gtccgcaccagctgc

SEQ ID NO: 1592184 - DNA, 18 bp, Homo sapiens
gtccgcatccctgcttct

SEQ ID NO: 1592185 - DNA, 20 bp, Homo sapiens
gtccgcatccctgcttctgg

SEQ ID NO: 1592186 - DNA, 18 bp, Homo sapiens
gtccgccctgctcctccc

SEQ ID NO: 1592187 - DNA, 20 bp, Homo sapiens
gtccgccctgctcctccctg

SEQ ID NO: 1592188 - DNA, 16 bp, Homo sapiens
gtccgcgggtcccggc

SEQ ID NO: 1592189 - DNA, 22 bp, Homo sapiens
gtccgctgggtggtaccctctg

SEQ ID NO: 1592190 - DNA, 14 bp, Homo sapiens
gtccggtgttctaa

SEQ ID NO: 1592191 - DNA, 15 bp, Homo sapiens
gtccggtgttctaag

SEQ ID NO: 1592192 - DNA, 18 bp, Homo sapiens
gtccgtccacccttccat

SEQ ID NO: 1592193 - DNA, 23 bp, Homo sapiens
gtccgtctgtctcgatgcctgat

SEQ ID NO: 1592194 - DNA, 15 bp, Homo sapiens
gtccgtgcccaggcc

SEQ ID NO: 1592195 - DNA, 22 bp, Homo sapiens
gtccgtgcccaggcccttggct

SEQ ID NO: 1592196 - DNA, 14 bp, Homo sapiens
gtcctaagaaagag

SEQ ID NO: 1592197 - DNA, 15 bp, Homo sapiens
gtcctaaggaacctt

SEQ ID NO: 1592198 - DNA, 18 bp, Homo sapiens
gtcctaaggaaccttcct

SEQ ID NO: 1592199 - DNA, 14 bp, Homo sapiens
gtcctaaggcccat

SEQ ID NO: 1592200 - DNA, 19 bp, Homo sapiens
gtcctaattcttctgtcct

SEQ ID NO: 1592201 - DNA, 18 bp, Homo sapiens
gtcctagccactcaggag

SEQ ID NO: 1592202 - DNA, 19 bp, Homo sapiens
gtcctagccactcaggagg

SEQ ID NO: 1592203 - DNA, 14 bp, Homo sapiens
gtcctatagtttgt

SEQ ID NO: 1592204 - DNA, 15 bp, Homo sapiens
gtcctatggaaaaaa

SEQ ID NO: 1592205 - DNA, 22 bp, Homo sapiens
gtcctattgtgactcttctaaa

SEQ ID NO: 1592206 - DNA, 14 bp, Homo sapiens
gtcctcactcccag

SEQ ID NO: 1592207 - DNA, 18 bp, Homo sapiens
gtcctcactcccagtcca

SEQ ID NO: 1592208 - DNA, 17 bp, Homo sapiens
gtcctcacttctgtctc

SEQ ID NO: 1592209 - DNA, 18 bp, Homo sapiens
gtcctcacttctgtctcc

SEQ ID NO: 1592210 - DNA, 13 bp, Homo sapiens
gtcctcaggaagg

SEQ ID NO: 1592211 - DNA, 13 bp, Homo sapiens
gtcctcagggagc

SEQ ID NO: 1592212 - DNA, 21 bp, Homo sapiens
gtcctctttactcccttcctg

SEQ ID NO: 1592213 - DNA, 12 bp, Homo sapiens
gtcctgaagctg

SEQ ID NO: 1592214 - DNA, 12 bp, Homo sapiens
gtcctgaccacc

SEQ ID NO: 1592215 - DNA, 17 bp, Homo sapiens
gtcctgaccaccctccc

SEQ ID NO: 1592216 - DNA, 23 bp, Homo sapiens
gtcctgaccaccctcccctctct

SEQ ID NO: 1592217 - DNA, 21 bp, Homo sapiens
gtcctgacggcgcccccagtg

SEQ ID NO: 1592218 - DNA, 13 bp, Homo sapiens
gtcctgactcaac

SEQ ID NO: 1592219 - DNA, 13 bp, Homo sapiens
gtcctgacttccc

SEQ ID NO: 1592220 - DNA, 19 bp, Homo sapiens
gtcctgagccccctgcacc

SEQ ID NO: 1592221 - DNA, 21 bp, Homo sapiens
gtcctgagccccctgcaccca

SEQ ID NO: 1592222 - DNA, 12 bp, Homo sapiens
gtcctgaggagc

SEQ ID NO: 1592223 - DNA, 17 bp, Homo sapiens
gtcctgaggagccctga

SEQ ID NO: 1592224 - DNA, 18 bp, Homo sapiens
gtcctgaggagccctgag

SEQ ID NO: 1592225 - DNA, 18 bp, Homo sapiens
gtcctgatgcccgttgtc

SEQ ID NO: 1592226 - DNA, 12 bp, Homo sapiens
gtcctgcagagg

SEQ ID NO: 1592227 - DNA, 10 bp, Homo sapiens
gtcctgcagg

SEQ ID NO: 1592228 - DNA, 11 bp, Homo sapiens
gtcctgccagc

SEQ ID NO: 1592229 - DNA, 14 bp, Homo sapiens
gtcctgccagctgc

SEQ ID NO: 1592230 - DNA, 16 bp, Homo sapiens
gtcctgccagctgcct

SEQ ID NO: 1592231 - DNA, 13 bp, Homo sapiens
gtcctgccctgcc

SEQ ID NO: 1592232 - DNA, 14 bp, Homo sapiens
gtcctgccctgccc

SEQ ID NO: 1592233 - DNA, 15 bp, Homo sapiens
gtcctgcctcagcct

SEQ ID NO: 1592234 - DNA, 14 bp, Homo sapiens
gtcctgcctggcca

SEQ ID NO: 1592235 - DNA, 15 bp, Homo sapiens
gtcctgcctggccag

SEQ ID NO: 1592236 - DNA, 19 bp, Homo sapiens
gtcctgcctggccaggcag

SEQ ID NO: 1592237 - DNA, 12 bp, Homo sapiens
gtcctgcctgtc

SEQ ID NO: 1592238 - DNA, 16 bp, Homo sapiens
gtcctgcctgtctgcc

SEQ ID NO: 1592239 - DNA, 13 bp, Homo sapiens
gtcctgcctgtgg

SEQ ID NO: 1592240 - DNA, 14 bp, Homo sapiens
gtcctgctcacctg

SEQ ID NO: 1592241 - DNA, 17 bp, Homo sapiens
gtcctgctccgctgcct

SEQ ID NO: 1592242 - DNA, 18 bp, Homo sapiens
gtcctgctccgctgcctg

SEQ ID NO: 1592243 - DNA, 11 bp, Homo sapiens
gtcctgctgcc

SEQ ID NO: 1592244 - DNA, 13 bp, Homo sapiens
gtcctgctgccct

SEQ ID NO: 1592245 - DNA, 14 bp, Homo sapiens
gtcctgctgtggaa

SEQ ID NO: 1592246 - DNA, 22 bp, Homo sapiens
gtcctggaatttggacaagtgc

SEQ ID NO: 1592247 - DNA, 14 bp, Homo sapiens
gtcctggaggcagg

SEQ ID NO: 1592248 - DNA, 13 bp, Homo sapiens
gtcctggaggggc

SEQ ID NO: 1592249 - DNA, 20 bp, Homo sapiens
gtcctggaggggctggggac

SEQ ID NO: 1592250 - DNA, 17 bp, Homo sapiens
gtcctggatgttgtgtg

SEQ ID NO: 1592251 - DNA, 11 bp, Homo sapiens
gtcctggccct

SEQ ID NO: 1592252 - DNA, 22 bp, Homo sapiens
gtcctggcccttcagtctgctc

SEQ ID NO: 1592253 - DNA, 15 bp, Homo sapiens
gtcctggctacatcc

SEQ ID NO: 1592254 - DNA, 20 bp, Homo sapiens
gtcctggctgcactcttgaa

SEQ ID NO: 1592255 - DNA, 21 bp, Homo sapiens
gtcctgggagaacctcaggct

SEQ ID NO: 1592256 - DNA, 11 bp, Homo sapiens
gtcctgggcag

SEQ ID NO: 1592257 - DNA, 12 bp, Homo sapiens
gtcctgggcagg

SEQ ID NO: 1592258 - DNA, 22 bp, Homo sapiens
gtcctgggcaggtgggagctga

SEQ ID NO: 1592259 - DNA, 20 bp, Homo sapiens
gtcctgggcatgggtccagg

SEQ ID NO: 1592260 - DNA, 23 bp, Homo sapiens
gtcctgggcatgggtccagggcc

SEQ ID NO: 1592261 - DNA, 14 bp, Homo sapiens
gtcctgggcctgca

SEQ ID NO: 1592262 - DNA, 14 bp, Homo sapiens
gtcctgggcgccct

SEQ ID NO: 1592263 - DNA, 20 bp, Homo sapiens
gtcctgggcgccctggaagc

SEQ ID NO: 1592264 - DNA, 15 bp, Homo sapiens
gtcctggggctctgt

SEQ ID NO: 1592265 - DNA, 23 bp, Homo sapiens
gtcctggtaattcctctccaggc

SEQ ID NO: 1592266 - DNA, 15 bp, Homo sapiens
gtcctggtcctgatg

SEQ ID NO: 1592267 - DNA, 16 bp, Homo sapiens
gtcctggtcctggctg

SEQ ID NO: 1592268 - DNA, 14 bp, Homo sapiens
gtcctggtgctctc

SEQ ID NO: 1592269 - DNA, 12 bp, Homo sapiens
gtcctggtggct

SEQ ID NO: 1592270 - DNA, 23 bp, Homo sapiens
gtcctggtggctgggcccagcag

SEQ ID NO: 1592271 - DNA, 17 bp, Homo sapiens
gtcctggtggggctgag

SEQ ID NO: 1592272 - DNA, 21 bp, Homo sapiens
gtcctggtgggtcagcccagc

SEQ ID NO: 1592273 - DNA, 16 bp, Homo sapiens
gtcctggtttcctggc

SEQ ID NO: 1592274 - DNA, 17 bp, Homo sapiens
gtcctggtttcctggca

SEQ ID NO: 1592275 - DNA, 15 bp, Homo sapiens
gtcctgtacattgtg

SEQ ID NO: 1592276 - DNA, 18 bp, Homo sapiens
gtcctgtaggagttctat

SEQ ID NO: 1592277 - DNA, 11 bp, Homo sapiens
gtcctgtccca

SEQ ID NO: 1592278 - DNA, 18 bp, Homo sapiens
gtcctgtcctggtcctga

SEQ ID NO: 1592279 - DNA, 15 bp, Homo sapiens
gtcctgttccctacc

SEQ ID NO: 1592280 - DNA, 19 bp, Homo sapiens
gtccttaacccacctctcc

SEQ ID NO: 1592281 - DNA, 20 bp, Homo sapiens
gtccttaagacggaagtaaa

SEQ ID NO: 1592282 - DNA, 17 bp, Homo sapiens
gtccttaggcctctgag

SEQ ID NO: 1592283 - DNA, 15 bp, Homo sapiens
gtccttatgtcctgt

SEQ ID NO: 1592284 - DNA, 14 bp, Homo sapiens
gtccttatttattt

SEQ ID NO: 1592285 - DNA, 14 bp, Homo sapiens
gtccttccaggccc

SEQ ID NO: 1592286 - DNA, 19 bp, Homo sapiens
gtctgtgccctccaaagag

SEQ ID NO: 1592287 - DNA, 12 bp, Homo sapiens
gtctgtgctagg

SEQ ID NO: 1592288 - DNA, 13 bp, Homo sapiens
gtctgtgctgagg

SEQ ID NO: 1592289 - DNA, 14 bp, Homo sapiens
gtctgtgctgaggc

SEQ ID NO: 1592290 - DNA, 15 bp, Homo sapiens
gtctgtgctgtgcct

SEQ ID NO: 1592291 - DNA, 23 bp, Homo sapiens
gtctgtggggaggggttgttttg

SEQ ID NO: 1592292 - DNA, 13 bp, Homo sapiens
gtctgtgtcccag

SEQ ID NO: 1592293 - DNA, 17 bp, Homo sapiens
gtctgtgtcccagccac

SEQ ID NO: 1592294 - DNA, 18 bp, Homo sapiens
gtctgtgtcccagccacg

SEQ ID NO: 1592295 - DNA, 20 bp, Homo sapiens
gtctgtgtcccagccacgca

SEQ ID NO: 1592296 - DNA, 20 bp, Homo sapiens
gtctgtgtgcgctctgtgga

SEQ ID NO: 1592297 - DNA, 20 bp, Homo sapiens
gtctgtgtggtggagccagg

SEQ ID NO: 1592298 - DNA, 11 bp, Homo sapiens
gtctgtgtgtg

SEQ ID NO: 1592299 - DNA, 12 bp, Homo sapiens
gtctgtgtgtgt

SEQ ID NO: 1592300 - DNA, 11 bp, Homo sapiens
gtctgtgtgtt

SEQ ID NO: 1592301 - DNA, 22 bp, Homo sapiens
gtctgtgtgtttatgtgtgtgt

SEQ ID NO: 1592302 - DNA, 21 bp, Homo sapiens
gtctgttcagcaaactaacca

SEQ ID NO: 1592303 - DNA, 18 bp, Homo sapiens
gtctgttctgtttcaagg

SEQ ID NO: 1592304 - DNA, 14 bp, Homo sapiens
gtctgttcttgaat

SEQ ID NO: 1592305 - DNA, 11 bp, Homo sapiens
gtctgttgagt

SEQ ID NO: 1592306 - DNA, 20 bp, Homo sapiens
gtctgttggcaggctggcca

SEQ ID NO: 1592307 - DNA, 20 bp, Homo sapiens
gtctgttgtgtgtcatgcca

SEQ ID NO: 1592308 - DNA, 22 bp, Homo sapiens
gtctgtttattaactactgaat

SEQ ID NO: 1592309 - DNA, 21 bp, Homo sapiens
gtctgtttggactgcagaagc

SEQ ID NO: 1592310 - DNA, 19 bp, Homo sapiens
gtctgtttgtctgaacaaa

SEQ ID NO: 1592311 - DNA, 14 bp, Homo sapiens
gtctgtttgtttca

SEQ ID NO: 1592312 - DNA, 18 bp, Homo sapiens
gtcttaaattttcttcct

SEQ ID NO: 1592313 - DNA, 22 bp, Homo sapiens
gtcttaacaaaccaacatcttt

SEQ ID NO: 1592314 - DNA, 14 bp, Homo sapiens
gtcttaagtgtttc

SEQ ID NO: 1592315 - DNA, 17 bp, Homo sapiens
gtcttaagtgtttctca

SEQ ID NO: 1592316 - DNA, 21 bp, Homo sapiens
gtcttaataaaataaactaga

SEQ ID NO: 1592317 - DNA, 14 bp, Homo sapiens
gtcttaattaaaag

SEQ ID NO: 1592318 - DNA, 20 bp, Homo sapiens
gtcttagaagtggaccagga

SEQ ID NO: 1592319 - DNA, 14 bp, Homo sapiens
gtcttaggtcagga

SEQ ID NO: 1592320 - DNA, 19 bp, Homo sapiens
gtcttatggtccagaaact

SEQ ID NO: 1592321 - DNA, 19 bp, Homo sapiens
gtcttatgtgaaaaattaa

SEQ ID NO: 1592322 - DNA, 22 bp, Homo sapiens
gtcttatgtgaaaaattaactt

SEQ ID NO: 1592323 - DNA, 20 bp, Homo sapiens
gtcttcaatctctgttctgc

SEQ ID NO: 1592324 - DNA, 13 bp, Homo sapiens
gtcttcacaacag

SEQ ID NO: 1592325 - DNA, 17 bp, Homo sapiens
gtcttcacaactttgac

SEQ ID NO: 1592326 - DNA, 19 bp, Homo sapiens
gtcttcagacccagagaag

SEQ ID NO: 1592327 - DNA, 15 bp, Homo sapiens
gtcttcagcctagcc

SEQ ID NO: 1592328 - DNA, 22 bp, Homo sapiens
gtcttcagtctcacagagaagc

SEQ ID NO: 1592329 - DNA, 23 bp, Homo sapiens
gtcttcagtttcattttcctgtg

SEQ ID NO: 1592330 - DNA, 14 bp, Homo sapiens
gtcttcattttcat

SEQ ID NO: 1592331 - DNA, 13 bp, Homo sapiens
gtcttccaaggag

SEQ ID NO: 1592332 - DNA, 13 bp, Homo sapiens
gtcttccataatg

SEQ ID NO: 1592333 - DNA, 20 bp, Homo sapiens
gtcttcctatttcagaagtt

SEQ ID NO: 1592334 - DNA, 23 bp, Homo sapiens
gtcttcctatttcagaagtttaa

SEQ ID NO: 1592335 - DNA, 13 bp, Homo sapiens
gtcttcctcttag

SEQ ID NO: 1592336 - DNA, 18 bp, Homo sapiens
gtcttcctgaaatgcagt

SEQ ID NO: 1592337 - DNA, 19 bp, Homo sapiens
gtcttcctgacactttaat

SEQ ID NO: 1592338 - DNA, 15 bp, Homo sapiens
gtcttccttaaatga

SEQ ID NO: 1592339 - DNA, 13 bp, Homo sapiens
gtcttctaatttc

SEQ ID NO: 1592340 - DNA, 23 bp, Homo sapiens
gtcttctaatttcaaaaatataa

SEQ ID NO: 1592341 - DNA, 21 bp, Homo sapiens
gtcttctagaaacagagacaa

SEQ ID NO: 1592342 - DNA, 16 bp, Homo sapiens
gtgaatgctagacaga

SEQ ID NO: 1592343 - DNA, 20 bp, Homo sapiens
gtgaatgctgggactcagcc

SEQ ID NO: 1592344 - DNA, 21 bp, Homo sapiens
gtgaatgctgggactcagcct

SEQ ID NO: 1592345 - DNA, 19 bp, Homo sapiens
gtgaatggccctagaactg

SEQ ID NO: 1592346 - DNA, 17 bp, Homo sapiens
gtgaattattgacactg

SEQ ID NO: 1592347 - DNA, 18 bp, Homo sapiens
gtgaattattgacactga

SEQ ID NO: 1592348 - DNA, 22 bp, Homo sapiens
gtgaattcttgaaggaaaatga

SEQ ID NO: 1592349 - DNA, 15 bp, Homo sapiens
gtgaattgtctttta

SEQ ID NO: 1592350 - DNA, 19 bp, Homo sapiens
gtgaatttctgaaagatga

SEQ ID NO: 1592351 - DNA, 12 bp, Homo sapiens
gtgaattttcaa

SEQ ID NO: 1592352 - DNA, 13 bp, Homo sapiens
gtgaatttttaag

SEQ ID NO: 1592353 - DNA, 17 bp, Homo sapiens
gtgaatttttaagctgc

SEQ ID NO: 1592354 - DNA, 12 bp, Homo sapiens
gtgaatttttat

SEQ ID NO: 1592355 - DNA, 13 bp, Homo sapiens
gtgaatttttatt

SEQ ID NO: 1592356 - DNA, 16 bp, Homo sapiens
gtgaatttttattgtt

SEQ ID NO: 1592357 - DNA, 15 bp, Homo sapiens
gtgaatttttctcta

SEQ ID NO: 1592358 - DNA, 16 bp, Homo sapiens
gtgaatttttctctaa

SEQ ID NO: 1592359 - DNA, 17 bp, Homo sapiens
gtgaatttttttttcct

SEQ ID NO: 1592360 - DNA, 23 bp, Homo sapiens
gtgacaaaccatccagtggaggt

SEQ ID NO: 1592361 - DNA, 18 bp, Homo sapiens
gtgacaaaggatgaagaa

SEQ ID NO: 1592362 - DNA, 16 bp, Homo sapiens
gtgacaattctgtttt

SEQ ID NO: 1592363 - DNA, 12 bp, Homo sapiens
gtgacacagcag

SEQ ID NO: 1592364 - DNA, 22 bp, Homo sapiens
gtgacacagcagcttcaccaga

SEQ ID NO: 1592365 - DNA, 19 bp, Homo sapiens
gtgacaccaataaatgttt

SEQ ID NO: 1592366 - DNA, 14 bp, Homo sapiens
gtgacacctccccc

SEQ ID NO: 1592367 - DNA, 12 bp, Homo sapiens
gtgacagagacc

SEQ ID NO: 1592368 - DNA, 18 bp, Homo sapiens
gtgacagagcgagactcc

SEQ ID NO: 1592369 - DNA, 14 bp, Homo sapiens
gtgacagcttcctt

SEQ ID NO: 1592370 - DNA, 15 bp, Homo sapiens
gtgacagtgcctggg

SEQ ID NO: 1592371 - DNA, 16 bp, Homo sapiens
gtgacagtttccaaat

SEQ ID NO: 1592372 - DNA, 23 bp, Homo sapiens
gtgacataatatattctattttt

SEQ ID NO: 1592373 - DNA, 13 bp, Homo sapiens
gtgacatgtaaca

SEQ ID NO: 1592374 - DNA, 18 bp, Homo sapiens
gtgaccaatacatttgta

SEQ ID NO: 1592375 - DNA, 16 bp, Homo sapiens
gtgaccactgaattca

SEQ ID NO: 1592376 - DNA, 18 bp, Homo sapiens
gtgaccactgaattcact

SEQ ID NO: 1592377 - DNA, 21 bp, Homo sapiens
gtgaccactgaattcactcca

SEQ ID NO: 1592378 - DNA, 15 bp, Homo sapiens
gtgacccatctgtag

SEQ ID NO: 1592379 - DNA, 16 bp, Homo sapiens
gtgacccttcagggcc

SEQ ID NO: 1592380 - DNA, 17 bp, Homo sapiens
gtgacccttcagggcca

SEQ ID NO: 1592381 - DNA, 12 bp, Homo sapiens
gtgacccttccc

SEQ ID NO: 1592382 - DNA, 15 bp, Homo sapiens
gtgaccggacttttc

SEQ ID NO: 1592383 - DNA, 20 bp, Homo sapiens
gtgacctattcaccctccac

SEQ ID NO: 1592384 - DNA, 14 bp, Homo sapiens
gtgacctccatact

SEQ ID NO: 1592385 - DNA, 19 bp, Homo sapiens
gtgacctccatactgggct

SEQ ID NO: 1592386 - DNA, 20 bp, Homo sapiens
gtgacctgggtatcccctgc

SEQ ID NO: 1592387 - DNA, 13 bp, Homo sapiens
gtgacctgtttat

SEQ ID NO: 1592388 - DNA, 17 bp, Homo sapiens
gtgaccttacagccatt

SEQ ID NO: 1592389 - DNA, 13 bp, Homo sapiens
gtgacgcccagct

SEQ ID NO: 1592390 - DNA, 16 bp, Homo sapiens
gtgacgcccagctccg

SEQ ID NO: 1592391 - DNA, 20 bp, Homo sapiens
gtgactaggcatacactgta

SEQ ID NO: 1592392 - DNA, 16 bp, Homo sapiens
gtgactataaagctgt

SEQ ID NO: 1592393 - DNA, 15 bp, Homo sapiens
gtgactcctgctggt

SEQ ID NO: 1592394 - DNA, 20 bp, Homo sapiens
gtgactcgagtcacactcaa

SEQ ID NO: 1592395 - DNA, 15 bp, Homo sapiens
gtgactctgggcagg

SEQ ID NO: 1592396 - DNA, 19 bp, Homo sapiens
gtgactgaagaagatgagc

SEQ ID NO: 1592397 - DNA, 23 bp, Homo sapiens
gtgactgagcaagaccctgtctc

SEQ ID NO: 1592398 - DNA, 21 bp, Homo sapiens
gtgactgccccaactcctgga

SEQ ID NO: 1592399 - DNA, 19 bp, Homo sapiens
gtgactggaagttgtggat

SEQ ID NO: 1592400 - DNA, 21 bp, Homo sapiens
gtgactggaagttgtggatat

SEQ ID NO: 1592401 - DNA, 24 bp, Homo sapiens
gtgactggcaggtgcagatgggct

SEQ ID NO: 1592402 - DNA, 15 bp, Homo sapiens
gtgactgggaaagtt

SEQ ID NO: 1592403 - DNA, 14 bp, Homo sapiens
gtgactgtgctgtg

SEQ ID NO: 1592404 - DNA, 22 bp, Homo sapiens
gtgactgtgctgtgcagctctc

SEQ ID NO: 1592405 - DNA, 18 bp, Homo sapiens
gtgactgtggcacacgcc

SEQ ID NO: 1592406 - DNA, 12 bp, Homo sapiens
gtgacttcactg

SEQ ID NO: 1592407 - DNA, 20 bp, Homo sapiens
gtgagtcttggcggcagcag

SEQ ID NO: 1592408 - DNA, 19 bp, Homo sapiens
gtgagtctttggttctaag

SEQ ID NO: 1592409 - DNA, 18 bp, Homo sapiens
gtgagtgacgatgatgta

SEQ ID NO: 1592410 - DNA, 13 bp, Homo sapiens
gtgagtgcctttt

SEQ ID NO: 1592411 - DNA, 13 bp, Homo sapiens
gtgagtggataat

SEQ ID NO: 1592412 - DNA, 12 bp, Homo sapiens
gtgagtggcagc

SEQ ID NO: 1592413 - DNA, 15 bp, Homo sapiens
gtgagtggcagccat

SEQ ID NO: 1592414 - DNA, 20 bp, Homo sapiens
gtgagtggcagccatgcctc

SEQ ID NO: 1592415 - DNA, 15 bp, Homo sapiens
gtgagtggcctgcta

SEQ ID NO: 1592416 - DNA, 16 bp, Homo sapiens
gtgagtgtaagtgtga

SEQ ID NO: 1592417 - DNA, 17 bp, Homo sapiens
gtgagttgagtctcctc

SEQ ID NO: 1592418 - DNA, 12 bp, Homo sapiens
gtgataaaatca

SEQ ID NO: 1592419 - DNA, 13 bp, Homo sapiens
gtgataaaatcat

SEQ ID NO: 1592420 - DNA, 14 bp, Homo sapiens
gtgataaactttgc

SEQ ID NO: 1592421 - DNA, 19 bp, Homo sapiens
gtgataagggaaaagataa

SEQ ID NO: 1592422 - DNA, 21 bp, Homo sapiens
gtgataagggaaaagataaag

SEQ ID NO: 1592423 - DNA, 22 bp, Homo sapiens
gtgataattttatttataaact

SEQ ID NO: 1592424 - DNA, 15 bp, Homo sapiens
gtgatacatttttta

SEQ ID NO: 1592425 - DNA, 20 bp, Homo sapiens
gtgatacccatagcttccat

SEQ ID NO: 1592426 - DNA, 16 bp, Homo sapiens
gtgatacgtacagcca

SEQ ID NO: 1592427 - DNA, 12 bp, Homo sapiens
gtgatagcattg

SEQ ID NO: 1592428 - DNA, 19 bp, Homo sapiens
gtgatagcattgctttcgt

SEQ ID NO: 1592429 - DNA, 18 bp, Homo sapiens
gtgatatttcagaaatac

SEQ ID NO: 1592430 - DNA, 15 bp, Homo sapiens
gtgatcaactgttca

SEQ ID NO: 1592431 - DNA, 17 bp, Homo sapiens
gtgatcaactgttcagg

SEQ ID NO: 1592432 - DNA, 16 bp, Homo sapiens
gtgatcaataaaatgt

SEQ ID NO: 1592433 - DNA, 20 bp, Homo sapiens
gtgatcagaccataatgtta

SEQ ID NO: 1592434 - DNA, 17 bp, Homo sapiens
gtgatcatgtgtggaag

SEQ ID NO: 1592435 - DNA, 18 bp, Homo sapiens
gtgatcatgtgtggaagt

SEQ ID NO: 1592436 - DNA, 23 bp, Homo sapiens
gtgatccacccaaccctatctcc

SEQ ID NO: 1592437 - DNA, 21 bp, Homo sapiens
gtgatccaccggcctcggcct

SEQ ID NO: 1592438 - DNA, 13 bp, Homo sapiens
gtgatccatccat

SEQ ID NO: 1592439 - DNA, 20 bp, Homo sapiens
gtgatccatccatctccagg

SEQ ID NO: 1592440 - DNA, 22 bp, Homo sapiens
gtgatccgcctacctcagcctc

SEQ ID NO: 1592441 - DNA, 21 bp, Homo sapiens
gtgatccgcctgcctctgcct

SEQ ID NO: 1592442 - DNA, 18 bp, Homo sapiens
gtgatccttggtgctgtg

SEQ ID NO: 1592443 - DNA, 21 bp, Homo sapiens
gtgatccttggtgctgtgtgc

SEQ ID NO: 1592444 - DNA, 12 bp, Homo sapiens
gtgatctatgtt

SEQ ID NO: 1592445 - DNA, 18 bp, Homo sapiens
gtgatctatgtttgtgtg

SEQ ID NO: 1592446 - DNA, 16 bp, Homo sapiens
gtgatctcagggcaga

SEQ ID NO: 1592447 - DNA, 13 bp, Homo sapiens
gtgatctccatat

SEQ ID NO: 1592448 - DNA, 19 bp, Homo sapiens
gtgatctgtttgaggagag

SEQ ID NO: 1592449 - DNA, 17 bp, Homo sapiens
gtgatgaacatattcat

SEQ ID NO: 1592450 - DNA, 16 bp, Homo sapiens
gtgatgaatctacatt

SEQ ID NO: 1592451 - DNA, 20 bp, Homo sapiens
gtgatgaatctacatttgtt

SEQ ID NO: 1592452 - DNA, 17 bp, Homo sapiens
gtgatgccacacagagt

SEQ ID NO: 1592453 - DNA, 21 bp, Homo sapiens
gtgatgccatatcaagtccat

SEQ ID NO: 1592454 - DNA, 19 bp, Homo sapiens
gtgatgcctaattatgaat

SEQ ID NO: 1592455 - DNA, 16 bp, Homo sapiens
gtgatgctcaggcttg

SEQ ID NO: 1592456 - DNA, 20 bp, Homo sapiens
gtgatggcgcgggaggcacc

SEQ ID NO: 1592457 - DNA, 19 bp, Homo sapiens
gtgatgggaaggtttttaa

SEQ ID NO: 1592458 - DNA, 23 bp, Homo sapiens
gtgatggttcccctgttcactct

SEQ ID NO: 1592459 - DNA, 21 bp, Homo sapiens
gtgatgtgaactgactttaag

SEQ ID NO: 1592460 - DNA, 14 bp, Homo sapiens
gtgatgtgccacta

SEQ ID NO: 1592461 - DNA, 10 bp, Homo sapiens
gtgatgtgga

SEQ ID NO: 1592462 - DNA, 15 bp, Homo sapiens
gtgatgtggaggaag

SEQ ID NO: 1592463 - DNA, 10 bp, Homo sapiens
gtgatgtgtc

SEQ ID NO: 1592464 - DNA, 15 bp, Homo sapiens
gtgatgtttccagct

SEQ ID NO: 1592465 - DNA, 21 bp, Homo sapiens
gtgatgtttccagctgccaag

SEQ ID NO: 1592466 - DNA, 14 bp, Homo sapiens
gtgattaaacgtgc

SEQ ID NO: 1592467 - DNA, 15 bp, Homo sapiens
gtgattaacttgctt

SEQ ID NO: 1592468 - DNA, 19 bp, Homo sapiens
gtgattagaggcagatctg

SEQ ID NO: 1592469 - DNA, 22 bp, Homo sapiens
gtgattagagggaggagaatga

SEQ ID NO: 1592470 - DNA, 14 bp, Homo sapiens
gtgattagatcaca

SEQ ID NO: 1592471 - DNA, 16 bp, Homo sapiens
gtgattatttcacttt

SEQ ID NO: 1592472 - DNA, 15 bp, Homo sapiens
gtgattcagcaggcc

SEQ ID NO: 1592473 - DNA, 13 bp, Homo sapiens
gtgattccatgga

SEQ ID NO: 1592474 - DNA, 12 bp, Homo sapiens
gtgattcctccc

SEQ ID NO: 1592475 - DNA, 14 bp, Homo sapiens
gtgattcctcccag

SEQ ID NO: 1592476 - DNA, 15 bp, Homo sapiens
gtgattcctcccagg

SEQ ID NO: 1592477 - DNA, 18 bp, Homo sapiens
gtgattcctcccaggagg

SEQ ID NO: 1592478 - DNA, 22 bp, Homo sapiens
gtgattccttttgatggggaga

SEQ ID NO: 1592479 - DNA, 18 bp, Homo sapiens
gtgattctagttgggaga

SEQ ID NO: 1592480 - DNA, 13 bp, Homo sapiens
gtgattctcctgc

SEQ ID NO: 1592481 - DNA, 16 bp, Homo sapiens
gtgattgacacacagc

SEQ ID NO: 1592482 - DNA, 10 bp, Homo sapiens
gtgattgctg

SEQ ID NO: 1592483 - DNA, 16 bp, Homo sapiens
gtgatttatttggagt

SEQ ID NO: 1592484 - DNA, 21 bp, Homo sapiens
gtgatttatttggagtggagg

SEQ ID NO: 1592485 - DNA, 17 bp, Homo sapiens
gtgatttgaaaaatata

SEQ ID NO: 1592486 - DNA, 22 bp, Homo sapiens
gtgatttgaaaaatataaaatt

SEQ ID NO: 1592487 - DNA, 14 bp, Homo sapiens
gtgatttgaattct

SEQ ID NO: 1592488 - DNA, 17 bp, Homo sapiens
gtgattttatgtttaaa

SEQ ID NO: 1592489 - DNA, 17 bp, Homo sapiens
gtgattttcaagcagca

SEQ ID NO: 1592490 - DNA, 14 bp, Homo sapiens
gtgatttttttgtc

SEQ ID NO: 1592491 - DNA, 21 bp, Homo sapiens
gtgcaaacatggagaaatcta

SEQ ID NO: 1592492 - DNA, 21 bp, Homo sapiens
gtgcaaaccacttctccatgc

SEQ ID NO: 1592493 - DNA, 17 bp, Homo sapiens
gtgcaaagatagatggc

SEQ ID NO: 1592494 - DNA, 19 bp, Homo sapiens
gtgcaaatgtcagatacaa

SEQ ID NO: 1592495 - DNA, 18 bp, Homo sapiens
gtgcaaattcagaactga

SEQ ID NO: 1592496 - DNA, 14 bp, Homo sapiens
gtgcaacagacaag

SEQ ID NO: 1592497 - DNA, 14 bp, Homo sapiens
gtgcaacccttacc

SEQ ID NO: 1592498 - DNA, 17 bp, Homo sapiens
gtgcaagacctagtccc

SEQ ID NO: 1592499 - DNA, 17 bp, Homo sapiens
gtgcaagtagcacatgg

SEQ ID NO: 1592500 - DNA, 21 bp, Homo sapiens
gtgcaataaatctgacccagt

SEQ ID NO: 1592501 - DNA, 12 bp, Homo sapiens
gtgcaatagaag

SEQ ID NO: 1592502 - DNA, 20 bp, Homo sapiens
gtgcaatttcaaggttctaa

SEQ ID NO: 1592503 - DNA, 20 bp, Homo sapiens
gtgcacaaatatttattttc

SEQ ID NO: 1592504 - DNA, 17 bp, Homo sapiens
gtgcacaagtctttcca

SEQ ID NO: 1592505 - DNA, 13 bp, Homo sapiens
gtgcacagccact

SEQ ID NO: 1592506 - DNA, 11 bp, Homo sapiens
gtgcacagctg

SEQ ID NO: 1592507 - DNA, 14 bp, Homo sapiens
gtgcacaggcctct

SEQ ID NO: 1592508 - DNA, 13 bp, Homo sapiens
gtgcacagtgatt

SEQ ID NO: 1592509 - DNA, 22 bp, Homo sapiens
gtgcacatatccaggcaccagg

SEQ ID NO: 1592510 - DNA, 21 bp, Homo sapiens
gtgcacatccgcgtgtgcctg

SEQ ID NO: 1592511 - DNA, 13 bp, Homo sapiens
gtgcacatttctt

SEQ ID NO: 1592512 - DNA, 23 bp, Homo sapiens
gtgcacctaccccttggaaatgt

SEQ ID NO: 1592513 - DNA, 18 bp, Homo sapiens
gtgcacctgtactcagga

SEQ ID NO: 1592514 - DNA, 14 bp, Homo sapiens
gtgcactgcctgca

SEQ ID NO: 1592515 - DNA, 19 bp, Homo sapiens
gtgcactttctaatgtttc

SEQ ID NO: 1592516 - DNA, 18 bp, Homo sapiens
gtgcacttttttatgaag

SEQ ID NO: 1592517 - DNA, 21 bp, Homo sapiens
gtgcagaatatgacaatctac

SEQ ID NO: 1592518 - DNA, 22 bp, Homo sapiens
gtgcagacaggccatgtgagcc

SEQ ID NO: 1592519 - DNA, 19 bp, Homo sapiens
gtgccccagactgagctct

SEQ ID NO: 1592520 - DNA, 15 bp, Homo sapiens
gtgccccaggaccag

SEQ ID NO: 1592521 - DNA, 18 bp, Homo sapiens
gtgccccatgcctgtcca

SEQ ID NO: 1592522 - DNA, 19 bp, Homo sapiens
gtgcccccctcctccagta

SEQ ID NO: 1592523 - DNA, 13 bp, Homo sapiens
gtgccccctcctc

SEQ ID NO: 1592524 - DNA, 21 bp, Homo sapiens
gtgcccccttcaagcctgtgc

SEQ ID NO: 1592525 - DNA, 16 bp, Homo sapiens
gtgccccgcctccccg

SEQ ID NO: 1592526 - DNA, 17 bp, Homo sapiens
gtgccccgcctccccga

SEQ ID NO: 1592527 - DNA, 23 bp, Homo sapiens
gtgcccctgatgcagcctgtggc

SEQ ID NO: 1592528 - DNA, 12 bp, Homo sapiens
gtgccccttcac

SEQ ID NO: 1592529 - DNA, 17 bp, Homo sapiens
gtgcccgcaggaactgg

SEQ ID NO: 1592530 - DNA, 20 bp, Homo sapiens
gtgcccgcctaggagttgag

SEQ ID NO: 1592531 - DNA, 19 bp, Homo sapiens
gtgcccgtaatcccagcta

SEQ ID NO: 1592532 - DNA, 22 bp, Homo sapiens
gtgccctgcccccatctcccca

SEQ ID NO: 1592533 - DNA, 23 bp, Homo sapiens
gtgccctgtggtagttggaaaca

SEQ ID NO: 1592534 - DNA, 22 bp, Homo sapiens
gtgcccttcctcacagagttaa

SEQ ID NO: 1592535 - DNA, 12 bp, Homo sapiens
gtgcccttgggg

SEQ ID NO: 1592536 - DNA, 21 bp, Homo sapiens
gtgccgcctgcactcctcagg

SEQ ID NO: 1592537 - DNA, 17 bp, Homo sapiens
gtgccgcctgctcctca

SEQ ID NO: 1592538 - DNA, 16 bp, Homo sapiens
gtgccgctgtctctga

SEQ ID NO: 1592539 - DNA, 20 bp, Homo sapiens
gtgccggcatctcccctagc

SEQ ID NO: 1592540 - DNA, 22 bp, Homo sapiens
gtgccggcggcagccccacttc

SEQ ID NO: 1592541 - DNA, 15 bp, Homo sapiens
gtgccgtgagcaggc

SEQ ID NO: 1592542 - DNA, 15 bp, Homo sapiens
gtgccgttactctcc

SEQ ID NO: 1592543 - DNA, 18 bp, Homo sapiens
gtgcctagactgttactt

SEQ ID NO: 1592544 - DNA, 22 bp, Homo sapiens
gtgcctagattaggtagacttt

SEQ ID NO: 1592545 - DNA, 19 bp, Homo sapiens
gtgcctagttcctgtggcc

SEQ ID NO: 1592546 - DNA, 17 bp, Homo sapiens
gtgcctatatctgagag

SEQ ID NO: 1592547 - DNA, 14 bp, Homo sapiens
gtgcctcagactcc

SEQ ID NO: 1592548 - DNA, 13 bp, Homo sapiens
gtgcctcagagac

SEQ ID NO: 1592549 - DNA, 21 bp, Homo sapiens
gtgcctcatagcatagccagc

SEQ ID NO: 1592550 - DNA, 23 bp, Homo sapiens
gtgcctcatagcatagccagcat

SEQ ID NO: 1592551 - DNA, 23 bp, Homo sapiens
gtgcctccagaggggctcaggtc

SEQ ID NO: 1592552 - DNA, 16 bp, Homo sapiens
gtgcctccccccagac

SEQ ID NO: 1592553 - DNA, 21 bp, Homo sapiens
gtgcctccccccagaccccgc

SEQ ID NO: 1592554 - DNA, 19 bp, Homo sapiens
gtgcctcctcagaggacag

SEQ ID NO: 1592555 - DNA, 15 bp, Homo sapiens
gtgcctcgaggcacc

SEQ ID NO: 1592556 - DNA, 12 bp, Homo sapiens
gtggagagggaa

SEQ ID NO: 1592557 - DNA, 20 bp, Homo sapiens
gtggagatcgcttttctcag

SEQ ID NO: 1592558 - DNA, 14 bp, Homo sapiens
gtggagcagagctc

SEQ ID NO: 1592559 - DNA, 15 bp, Homo sapiens
gtggagccagggcct

SEQ ID NO: 1592560 - DNA, 22 bp, Homo sapiens
gtggagccaggttgtcgggccc

SEQ ID NO: 1592561 - DNA, 18 bp, Homo sapiens
gtggagctgccacagaga

SEQ ID NO: 1592562 - DNA, 19 bp, Homo sapiens
gtggaggaaatgttggaac

SEQ ID NO: 1592563 - DNA, 20 bp, Homo sapiens
gtggaggaagagccacctgc

SEQ ID NO: 1592564 - DNA, 21 bp, Homo sapiens
gtggaggaagagccacctgca

SEQ ID NO: 1592565 - DNA, 21 bp, Homo sapiens
gtggaggaggaggaggagcct

SEQ ID NO: 1592566 - DNA, 13 bp, Homo sapiens
gtggaggcagcca

SEQ ID NO: 1592567 - DNA, 15 bp, Homo sapiens
gtggaggcattgttt

SEQ ID NO: 1592568 - DNA, 11 bp, Homo sapiens
gtggaggcctg

SEQ ID NO: 1592569 - DNA, 15 bp, Homo sapiens
gtggaggctgctgtg

SEQ ID NO: 1592570 - DNA, 14 bp, Homo sapiens
gtggagggaaggat

SEQ ID NO: 1592571 - DNA, 16 bp, Homo sapiens
gtggagggcacagccc

SEQ ID NO: 1592572 - DNA, 12 bp, Homo sapiens
gtggaggggtgt

SEQ ID NO: 1592573 - DNA, 16 bp, Homo sapiens
gtggaggttgcagtga

SEQ ID NO: 1592574 - DNA, 23 bp, Homo sapiens
gtggaggttgcagtgagccaaga

SEQ ID NO: 1592575 - DNA, 15 bp, Homo sapiens
gtggagtccagctct

SEQ ID NO: 1592576 - DNA, 18 bp, Homo sapiens
gtggagtccagctctact

SEQ ID NO: 1592577 - DNA, 12 bp, Homo sapiens
gtggagttcacc

SEQ ID NO: 1592578 - DNA, 19 bp, Homo sapiens
gtggagttcaccttggaag

SEQ ID NO: 1592579 - DNA, 15 bp, Homo sapiens
gtggagtttgtattt

SEQ ID NO: 1592580 - DNA, 21 bp, Homo sapiens
gtggataatcaggaaaaatga

SEQ ID NO: 1592581 - DNA, 18 bp, Homo sapiens
gtggatcacaaggtcaag

SEQ ID NO: 1592582 - DNA, 13 bp, Homo sapiens
gtggatcacagag

SEQ ID NO: 1592583 - DNA, 22 bp, Homo sapiens
gtggatcgagtgtagctgtgaa

SEQ ID NO: 1592584 - DNA, 21 bp, Homo sapiens
gtggatgccacagcccagctt

SEQ ID NO: 1592585 - DNA, 14 bp, Homo sapiens
taacacagtattat

SEQ ID NO: 1592586 - DNA, 11 bp, Homo sapiens
taacacattat

SEQ ID NO: 1592587 - DNA, 12 bp, Homo sapiens
taacacattttt

SEQ ID NO: 1592588 - DNA, 19 bp, Homo sapiens
taacacatttttttgcatg

SEQ ID NO: 1592589 - DNA, 21 bp, Homo sapiens
taacacatttttttgcatgca

SEQ ID NO: 1592590 - DNA, 21 bp, Homo sapiens
taacaccaggtttatggaaaa

SEQ ID NO: 1592591 - DNA, 17 bp, Homo sapiens
taacaccgtcccagggc

SEQ ID NO: 1592592 - DNA, 14 bp, Homo sapiens
taacaccttggact

SEQ ID NO: 1592593 - DNA, 19 bp, Homo sapiens
taacacgctgcctggtctg

SEQ ID NO: 1592594 - DNA, 14 bp, Homo sapiens
taacactcctctgc

SEQ ID NO: 1592595 - DNA, 19 bp, Homo sapiens
taacactgcagccctctcc

SEQ ID NO: 1592596 - DNA, 18 bp, Homo sapiens
taacactggttaaattaa

SEQ ID NO: 1592597 - DNA, 14 bp, Homo sapiens
taacactgtatttt

SEQ ID NO: 1592598 - DNA, 16 bp, Homo sapiens
taacactgtgaagagc

SEQ ID NO: 1592599 - DNA, 12 bp, Homo sapiens
taacactttgta

SEQ ID NO: 1592600 - DNA, 18 bp, Homo sapiens
taacagataagcaagaga

SEQ ID NO: 1592601 - DNA, 12 bp, Homo sapiens
taacagatgcaa

SEQ ID NO: 1592602 - DNA, 21 bp, Homo sapiens
taacagatgcaatgtgctact

SEQ ID NO: 1592603 - DNA, 15 bp, Homo sapiens
taacagcatgctgct

SEQ ID NO: 1592604 - DNA, 23 bp, Homo sapiens
taacagcattcttgtcacaataa

SEQ ID NO: 1592605 - DNA, 15 bp, Homo sapiens
taacagccaagaagc

SEQ ID NO: 1592606 - DNA, 16 bp, Homo sapiens
taacagccaagaagcc

SEQ ID NO: 1592607 - DNA, 17 bp, Homo sapiens
taacagccctcctctgc

SEQ ID NO: 1592608 - DNA, 20 bp, Homo sapiens
taacagccctcctctgcact

SEQ ID NO: 1592609 - DNA, 15 bp, Homo sapiens
taacagctgaggtct

SEQ ID NO: 1592610 - DNA, 14 bp, Homo sapiens
taacaggatgaaag

SEQ ID NO: 1592611 - DNA, 15 bp, Homo sapiens
taacaggatgaaagt

SEQ ID NO: 1592612 - DNA, 22 bp, Homo sapiens
taacaggctcaatattcctgaa

SEQ ID NO: 1592613 - DNA, 20 bp, Homo sapiens
taacagggagaagtagctag

SEQ ID NO: 1592614 - DNA, 16 bp, Homo sapiens
taacaggtctcctctt

SEQ ID NO: 1592615 - DNA, 19 bp, Homo sapiens
taacaggtctcctcttaaa

SEQ ID NO: 1592616 - DNA, 14 bp, Homo sapiens
taacagtcatttaa

SEQ ID NO: 1592617 - DNA, 15 bp, Homo sapiens
taacagtcatttaaa

SEQ ID NO: 1592618 - DNA, 14 bp, Homo sapiens
taacagtccttgct

SEQ ID NO: 1592619 - DNA, 19 bp, Homo sapiens
taacagtcttactgcaggc

SEQ ID NO: 1592620 - DNA, 15 bp, Homo sapiens
taacagttatatttt

SEQ ID NO: 1592621 - DNA, 17 bp, Homo sapiens
taacagttatatttttg

SEQ ID NO: 1592622 - DNA, 20 bp, Homo sapiens
taacagttggtgattttaga

SEQ ID NO: 1592623 - DNA, 15 bp, Homo sapiens
taacataaaatctgt

SEQ ID NO: 1592624 - DNA, 16 bp, Homo sapiens
taacataactgcttct

SEQ ID NO: 1592625 - DNA, 19 bp, Homo sapiens
taacataactgcttcttgg

SEQ ID NO: 1592626 - DNA, 19 bp, Homo sapiens
taacataatttgtacatat

SEQ ID NO: 1592627 - DNA, 20 bp, Homo sapiens
taacatacaagaaaatgtat

SEQ ID NO: 1592628 - DNA, 20 bp, Homo sapiens
taacatacatctaagtcagt

SEQ ID NO: 1592629 - DNA, 15 bp, Homo sapiens
taacatattcttgct

SEQ ID NO: 1592630 - DNA, 22 bp, Homo sapiens
taacatattcttgctttcacaa

SEQ ID NO: 1592631 - DNA, 16 bp, Homo sapiens
taacatcataattaca

SEQ ID NO: 1592632 - DNA, 18 bp, Homo sapiens
taacatcataattacatt

SEQ ID NO: 1592633 - DNA, 13 bp, Homo sapiens
taacatcattgca

SEQ ID NO: 1592634 - DNA, 15 bp, Homo sapiens
taacatccaagccag

SEQ ID NO: 1592635 - DNA, 14 bp, Homo sapiens
taacatctgaaaag

SEQ ID NO: 1592636 - DNA, 15 bp, Homo sapiens
taacatctgaaaaga

SEQ ID NO: 1592637 - DNA, 18 bp, Homo sapiens
taacatgggctcttcact

SEQ ID NO: 1592638 - DNA, 17 bp, Homo sapiens
taacatgtaattaagta

SEQ ID NO: 1592639 - DNA, 19 bp, Homo sapiens
taacatgtaattaagtact

SEQ ID NO: 1592640 - DNA, 22 bp, Homo sapiens
taacatgtcctgcctattatct

SEQ ID NO: 1592641 - DNA, 20 bp, Homo sapiens
gtgctcagccaaatttcctg

SEQ ID NO: 1592642 - DNA, 13 bp, Homo sapiens
gtgctcagctgtg

SEQ ID NO: 1592643 - DNA, 20 bp, Homo sapiens
gtgctccatctccgcctcca

SEQ ID NO: 1592644 - DNA, 15 bp, Homo sapiens
gtgctcccctgccac

SEQ ID NO: 1592645 - DNA, 17 bp, Homo sapiens
gtgctcccctgccacac

SEQ ID NO: 1592646 - DNA, 16 bp, Homo sapiens
gtgctccgtgcctcca

SEQ ID NO: 1592647 - DNA, 17 bp, Homo sapiens
gtgctccgtgcctccac

SEQ ID NO: 1592648 - DNA, 22 bp, Homo sapiens
gtgctccgtgcctccaccacca

SEQ ID NO: 1592649 - DNA, 19 bp, Homo sapiens
gtgctcctcttgattcctg

SEQ ID NO: 1592650 - DNA, 18 bp, Homo sapiens
gtgctctccccggcaggc

SEQ ID NO: 1592651 - DNA, 13 bp, Homo sapiens
gtgctctctgcca

SEQ ID NO: 1592652 - DNA, 20 bp, Homo sapiens
gtgctctctgccactggaag

SEQ ID NO: 1592653 - DNA, 20 bp, Homo sapiens
gtgctctgctaaccatttat

SEQ ID NO: 1592654 - DNA, 20 bp, Homo sapiens
gtgctctggcaccatcagcc

SEQ ID NO: 1592655 - DNA, 19 bp, Homo sapiens
gtgctctggcggcttcctg

SEQ ID NO: 1592656 - DNA, 22 bp, Homo sapiens
gtgctctggcggcttcctgtcc

SEQ ID NO: 1592657 - DNA, 22 bp, Homo sapiens
gtgctcttggctgacccctctg

SEQ ID NO: 1592658 - DNA, 21 bp, Homo sapiens
gtgctgaacagtggaggaaga

SEQ ID NO: 1592659 - DNA, 18 bp, Homo sapiens
gtgctgacaacttagctc

SEQ ID NO: 1592660 - DNA, 15 bp, Homo sapiens
gtgctgactgaggcc

SEQ ID NO: 1592661 - DNA, 16 bp, Homo sapiens
gtgctgactgaggcct

SEQ ID NO: 1592662 - DNA, 18 bp, Homo sapiens
gtgctgactgaggcctgc

SEQ ID NO: 1592663 - DNA, 19 bp, Homo sapiens
gtgctgaggatacagctct

SEQ ID NO: 1592664 - DNA, 17 bp, Homo sapiens
gtgctgagtaaacataa

SEQ ID NO: 1592665 - DNA, 16 bp, Homo sapiens
gtgctgatagggtaag

SEQ ID NO: 1592666 - DNA, 12 bp, Homo sapiens
gtgctgcaggag

SEQ ID NO: 1592667 - DNA, 22 bp, Homo sapiens
gtgctgcagggctttaaaattc

SEQ ID NO: 1592668 - DNA, 20 bp, Homo sapiens
gtgctgcatccctgtgtcca

SEQ ID NO: 1592669 - DNA, 13 bp, Homo sapiens
gtgctgccatgcc

SEQ ID NO: 1592670 - DNA, 17 bp, Homo sapiens
gtgctgccatgccactg

SEQ ID NO: 1592671 - DNA, 18 bp, Homo sapiens
gtgctgcccgtcttcagc

SEQ ID NO: 1592672 - DNA, 19 bp, Homo sapiens
gtgctgcccgtcttcagcc

SEQ ID NO: 1592673 - DNA, 16 bp, Homo sapiens
gtgctgccttgcttct

SEQ ID NO: 1592674 - DNA, 13 bp, Homo sapiens
taactagaattag

SEQ ID NO: 1592675 - DNA, 22 bp, Homo sapiens
taactagacaccaaagttctaa

SEQ ID NO: 1592676 - DNA, 15 bp, Homo sapiens
taactagtaatacca

SEQ ID NO: 1592677 - DNA, 23 bp, Homo sapiens
taactagtaataccaaagactat

SEQ ID NO: 1592678 - DNA, 17 bp, Homo sapiens
taactagtgttgcttgg

SEQ ID NO: 1592679 - DNA, 15 bp, Homo sapiens
taactataacaatca

SEQ ID NO: 1592680 - DNA, 16 bp, Homo sapiens
taactataaggtgcct

SEQ ID NO: 1592681 - DNA, 19 bp, Homo sapiens
taactataaggtgcctcag

SEQ ID NO: 1592682 - DNA, 21 bp, Homo sapiens
taactatctttttgaaagcaa

SEQ ID NO: 1592683 - DNA, 22 bp, Homo sapiens
taactatctttttgaaagcaat

SEQ ID NO: 1592684 - DNA, 18 bp, Homo sapiens
taactattgggtgaatat

SEQ ID NO: 1592685 - DNA, 18 bp, Homo sapiens
taactatttttcctcatt

SEQ ID NO: 1592686 - DNA, 15 bp, Homo sapiens
taactcaaatacaca

SEQ ID NO: 1592687 - DNA, 20 bp, Homo sapiens
taactcaaatacacatttgc

SEQ ID NO: 1592688 - DNA, 12 bp, Homo sapiens
taactccctcca

SEQ ID NO: 1592689 - DNA, 14 bp, Homo sapiens
taactccctccacc

SEQ ID NO: 1592690 - DNA, 18 bp, Homo sapiens
taactccctccaccagcc

SEQ ID NO: 1592691 - DNA, 19 bp, Homo sapiens
taactccctccaccagcct

SEQ ID NO: 1592692 - DNA, 20 bp, Homo sapiens
taactccctccaccagcctg

SEQ ID NO: 1592693 - DNA, 21 bp, Homo sapiens
taactccctccaccagcctgc

SEQ ID NO: 1592694 - DNA, 14 bp, Homo sapiens
taactcctgtccct

SEQ ID NO: 1592695 - DNA, 14 bp, Homo sapiens
taactctaaaagat

SEQ ID NO: 1592696 - DNA, 23 bp, Homo sapiens
taactctaaaagatcctttttaa

SEQ ID NO: 1592697 - DNA, 17 bp, Homo sapiens
taactctctttccttga

SEQ ID NO: 1592698 - DNA, 14 bp, Homo sapiens
taactgaaggagaa

SEQ ID NO: 1592699 - DNA, 15 bp, Homo sapiens
taactgaaggagaag

SEQ ID NO: 1592700 - DNA, 16 bp, Homo sapiens
taactgacaagccatc

SEQ ID NO: 1592701 - DNA, 21 bp, Homo sapiens
taactgactattcttgatgta

SEQ ID NO: 1592702 - DNA, 19 bp, Homo sapiens
taactgagttatattggaa

SEQ ID NO: 1592703 - DNA, 17 bp, Homo sapiens
taactgatctcaagtat

SEQ ID NO: 1592704 - DNA, 21 bp, Homo sapiens
taactgatttgcaataaaaat

SEQ ID NO: 1592705 - DNA, 14 bp, Homo sapiens
taactgcatataga

SEQ ID NO: 1592706 - DNA, 18 bp, Homo sapiens
taactgccagccttggag

SEQ ID NO: 1592707 - DNA, 19 bp, Homo sapiens
taactggaaaacagaacac

SEQ ID NO: 1592708 - DNA, 22 bp, Homo sapiens
taactggaaaacagaacactta

SEQ ID NO: 1592709 - DNA, 24 bp, Homo sapiens
taactggcagttttccattggttt

SEQ ID NO: 1592710 - DNA, 21 bp, Homo sapiens
taactggcttctgcttgtcat

SEQ ID NO: 1592711 - DNA, 13 bp, Homo sapiens
taactgggttaaa

SEQ ID NO: 1592712 - DNA, 21 bp, Homo sapiens
taactggtaagcgatttgaaa

SEQ ID NO: 1592713 - DNA, 20 bp, Homo sapiens
taactggtagtgttcagtaa

SEQ ID NO: 1592714 - DNA, 22 bp, Homo sapiens
taactggttaaaaaacaaatgt

SEQ ID NO: 1592715 - DNA, 13 bp, Homo sapiens
taactggttaaac

SEQ ID NO: 1592716 - DNA, 19 bp, Homo sapiens
taactggttgctgtgtcat

SEQ ID NO: 1592717 - DNA, 23 bp, Homo sapiens
taactgtaaagatgtttatttca

SEQ ID NO: 1592718 - DNA, 13 bp, Homo sapiens
taactgtaaatca

SEQ ID NO: 1592719 - DNA, 18 bp, Homo sapiens
taactgtaattatttgaa

SEQ ID NO: 1592720 - DNA, 12 bp, Homo sapiens
taactgtatttg

SEQ ID NO: 1592721 - DNA, 14 bp, Homo sapiens
taactgtatttgaa

SEQ ID NO: 1592722 - DNA, 22 bp, Homo sapiens
taactgtatttgaaataagaat

SEQ ID NO: 1592723 - DNA, 14 bp, Homo sapiens
taactgtcctgtcc

SEQ ID NO: 1592724 - DNA, 15 bp, Homo sapiens
taactgtcctgtcct

SEQ ID NO: 1592725 - DNA, 15 bp, Homo sapiens
taactgtcttctgga

SEQ ID NO: 1592726 - DNA, 20 bp, Homo sapiens
taactgtcttgtttcagtga

SEQ ID NO: 1592727 - DNA, 17 bp, Homo sapiens
taactgtgaagtttaca

SEQ ID NO: 1592728 - DNA, 15 bp, Homo sapiens
taactgtgcactata

SEQ ID NO: 1592729 - DNA, 18 bp, Homo sapiens
taactgtgccagttcttt

SEQ ID NO: 1592730 - DNA, 15 bp, Homo sapiens
taactgtgtactgtt

SEQ ID NO: 1592731 - DNA, 11 bp, Homo sapiens
taactgtgtat

SEQ ID NO: 1592732 - DNA, 15 bp, Homo sapiens
taactgtgtatgtac

SEQ ID NO: 1592733 - DNA, 18 bp, Homo sapiens
taagaatgagtttcttag

SEQ ID NO: 1592734 - DNA, 13 bp, Homo sapiens
taagaatggccaa

SEQ ID NO: 1592735 - DNA, 13 bp, Homo sapiens
taagaatgtcctt

SEQ ID NO: 1592736 - DNA, 16 bp, Homo sapiens
taagaattcagacatc

SEQ ID NO: 1592737 - DNA, 19 bp, Homo sapiens
taagaattctgattgattt

SEQ ID NO: 1592738 - DNA, 20 bp, Homo sapiens
taagaattctgattgatttg

SEQ ID NO: 1592739 - DNA, 20 bp, Homo sapiens
taagaattgagtaatggtgt

SEQ ID NO: 1592740 - DNA, 21 bp, Homo sapiens
taagaattgtttttgaattta

SEQ ID NO: 1592741 - DNA, 15 bp, Homo sapiens
taagacaaacactgc

SEQ ID NO: 1592742 - DNA, 20 bp, Homo sapiens
taagacaaatgggactgatg

SEQ ID NO: 1592743 - DNA, 16 bp, Homo sapiens
taagacaagagatcta

SEQ ID NO: 1592744 - DNA, 13 bp, Homo sapiens
taagacagagaag

SEQ ID NO: 1592745 - DNA, 16 bp, Homo sapiens
taagacagagaaggtt

SEQ ID NO: 1592746 - DNA, 19 bp, Homo sapiens
taagacagtcccatcaaaa

SEQ ID NO: 1592747 - DNA, 20 bp, Homo sapiens
taagacatactccttccatc

SEQ ID NO: 1592748 - DNA, 12 bp, Homo sapiens
taagacatgtga

SEQ ID NO: 1592749 - DNA, 14 bp, Homo sapiens
taagacatttgtat

SEQ ID NO: 1592750 - DNA, 13 bp, Homo sapiens
taagaccctgtgt

SEQ ID NO: 1592751 - DNA, 22 bp, Homo sapiens
taagacccttattgctgtcctg

SEQ ID NO: 1592752 - DNA, 23 bp, Homo sapiens
taagaccgtgtcccaaggagctg

SEQ ID NO: 1592753 - DNA, 20 bp, Homo sapiens
taagacctactgttctaaag

SEQ ID NO: 1592754 - DNA, 21 bp, Homo sapiens
taagacctactgttctaaagc

SEQ ID NO: 1592755 - DNA, 22 bp, Homo sapiens
taagacctactgttctaaagct

SEQ ID NO: 1592756 - DNA, 15 bp, Homo sapiens
taagactcaaatgtt

SEQ ID NO: 1592757 - DNA, 18 bp, Homo sapiens
taagactcaaatgttcta

SEQ ID NO: 1592758 - DNA, 22 bp, Homo sapiens
taagactcaaatgttctaagtt

SEQ ID NO: 1592759 - DNA, 20 bp, Homo sapiens
taagacttactctaagatct

SEQ ID NO: 1592760 - DNA, 20 bp, Homo sapiens
taagagaaaagagagaaaca

SEQ ID NO: 1592761 - DNA, 17 bp, Homo sapiens
taagagaaaatattact

SEQ ID NO: 1592762 - DNA, 17 bp, Homo sapiens
taagagaaaatgtaaat

SEQ ID NO: 1592763 - DNA, 17 bp, Homo sapiens
taagagaaactgtgtat

SEQ ID NO: 1592764 - DNA, 13 bp, Homo sapiens
taagagaaagaaa

SEQ ID NO: 1592765 - DNA, 13 bp, Homo sapiens
taagagaaatgga

SEQ ID NO: 1592766 - DNA, 15 bp, Homo sapiens
taagagcgaacttca

SEQ ID NO: 1592767 - DNA, 18 bp, Homo sapiens
taagagctagcgctgccg

SEQ ID NO: 1592768 - DNA, 17 bp, Homo sapiens
taagagcttgctccaga

SEQ ID NO: 1592769 - DNA, 18 bp, Homo sapiens
taagaggaaagtacattt

SEQ ID NO: 1592770 - DNA, 22 bp, Homo sapiens
taagaggaatttggtataatta

SEQ ID NO: 1592771 - DNA, 13 bp, Homo sapiens
taagaggagcaga

SEQ ID NO: 1592772 - DNA, 23 bp, Homo sapiens
taagaggcagaaaattgcacaat

SEQ ID NO: 1592773 - DNA, 16 bp, Homo sapiens
taagagggcatataca

SEQ ID NO: 1592774 - DNA, 18 bp, Homo sapiens
taagaggtgttatttgga

SEQ ID NO: 1592775 - DNA, 18 bp, Homo sapiens
taagagtccaagaatcca

SEQ ID NO: 1592776 - DNA, 21 bp, Homo sapiens
taagagtgagctctggtggag

SEQ ID NO: 1592777 - DNA, 14 bp, Homo sapiens
taagataaatgtgc

SEQ ID NO: 1592778 - DNA, 16 bp, Homo sapiens
taagataaatgtgctg

SEQ ID NO: 1592779 - DNA, 17 bp, Homo sapiens
taagataacttactgta

SEQ ID NO: 1592780 - DNA, 12 bp, Homo sapiens
taagataataat

SEQ ID NO: 1592781 - DNA, 15 bp, Homo sapiens
taagataataatata

SEQ ID NO: 1592782 - DNA, 12 bp, Homo sapiens
taagataattat

SEQ ID NO: 1592783 - DNA, 14 bp, Homo sapiens
taagatacaaatta

SEQ ID NO: 1592784 - DNA, 12 bp, Homo sapiens
taagatagaaca

SEQ ID NO: 1592785 - DNA, 23 bp, Homo sapiens
taagatatacttgtttttgtaaa

SEQ ID NO: 1592786 - DNA, 14 bp, Homo sapiens
taagatatatacat

SEQ ID NO: 1592787 - DNA, 17 bp, Homo sapiens
taagatatctcaatgaa

SEQ ID NO: 1592788 - DNA, 18 bp, Homo sapiens
taagatcgttctctgcct

SEQ ID NO: 1592789 - DNA, 14 bp, Homo sapiens
taagatcttagatt

SEQ ID NO: 1592790 - DNA, 17 bp, Homo sapiens
taagatcttagattctc

SEQ ID NO: 1592791 - DNA, 13 bp, Homo sapiens
taagatcttgtta

SEQ ID NO: 1592792 - DNA, 17 bp, Homo sapiens
taagatgagatttgcca

SEQ ID NO: 1592793 - DNA, 19 bp, Homo sapiens
taagatgagatttgccagc

SEQ ID NO: 1592794 - DNA, 20 bp, Homo sapiens
taagatgagatttgccagca

SEQ ID NO: 1592795 - DNA, 11 bp, Homo sapiens
taagatgctgg

SEQ ID NO: 1592796 - DNA, 20 bp, Homo sapiens
taagccctgtcgagacactt

SEQ ID NO: 1592797 - DNA, 17 bp, Homo sapiens
taagccctgttctcctg

SEQ ID NO: 1592798 - DNA, 22 bp, Homo sapiens
taagcctatatatatagtcaaa

SEQ ID NO: 1592799 - DNA, 22 bp, Homo sapiens
taagcgaagtctttgccttctc

SEQ ID NO: 1592800 - DNA, 17 bp, Homo sapiens
taagcgatttgaaacac

SEQ ID NO: 1592801 - DNA, 15 bp, Homo sapiens
taagctaaaatgtta

SEQ ID NO: 1592802 - DNA, 21 bp, Homo sapiens
taagctattcagtaataactc

SEQ ID NO: 1592803 - DNA, 19 bp, Homo sapiens
taagctcacgtcctgagaa

SEQ ID NO: 1592804 - DNA, 14 bp, Homo sapiens
taagctctctgggc

SEQ ID NO: 1592805 - DNA, 15 bp, Homo sapiens
taagctctctgggcc

SEQ ID NO: 1592806 - DNA, 16 bp, Homo sapiens
taagctctctgggcct

SEQ ID NO: 1592807 - DNA, 15 bp, Homo sapiens
taagctctttgagaa

SEQ ID NO: 1592808 - DNA, 17 bp, Homo sapiens
taagctctttgagaact

SEQ ID NO: 1592809 - DNA, 18 bp, Homo sapiens
taagctgatcctgcggag

SEQ ID NO: 1592810 - DNA, 16 bp, Homo sapiens
taagctgctctattgt

SEQ ID NO: 1592811 - DNA, 16 bp, Homo sapiens
taagctggagctcttg

SEQ ID NO: 1592812 - DNA, 19 bp, Homo sapiens
taagctggagctcttggaa

SEQ ID NO: 1592813 - DNA, 12 bp, Homo sapiens
taagctggctct

SEQ ID NO: 1592814 - DNA, 21 bp, Homo sapiens
taagctgggaaaaaagttttg

SEQ ID NO: 1592815 - DNA, 16 bp, Homo sapiens
taagcttatgtcagac

SEQ ID NO: 1592816 - DNA, 19 bp, Homo sapiens
taaggaaccttccttcctg

SEQ ID NO: 1592817 - DNA, 19 bp, Homo sapiens
taaggaagtatcagcacta

SEQ ID NO: 1592818 - DNA, 16 bp, Homo sapiens
taaggacagcagctgg

SEQ ID NO: 1592819 - DNA, 23 bp, Homo sapiens
taaggaccgtggccctgccctct

SEQ ID NO: 1592820 - DNA, 15 bp, Homo sapiens
taaggacctgaaatt

SEQ ID NO: 1592821 - DNA, 22 bp, Homo sapiens
taaggagaatcatgtttctttg

SEQ ID NO: 1592822 - DNA, 22 bp, Homo sapiens
taaggagagttcaagcctgtgg

SEQ ID NO: 1592823 - DNA, 22 bp, Homo sapiens
taaggaggaggagggagaagag

SEQ ID NO: 1592824 - DNA, 23 bp, Homo sapiens
taaggaggaggagggagaagaga

SEQ ID NO: 1592825 - DNA, 22 bp, Homo sapiens
taaggataaatcataaagtcag

SEQ ID NO: 1592826 - DNA, 17 bp, Homo sapiens
taaggataatgaaataa

SEQ ID NO: 1592827 - DNA, 19 bp, Homo sapiens
taaggatcagaacagcaga

SEQ ID NO: 1592828 - DNA, 18 bp, Homo sapiens
taaggatgacttttttat

SEQ ID NO: 1592829 - DNA, 17 bp, Homo sapiens
taaggatgctaaacctt

SEQ ID NO: 1592830 - DNA, 20 bp, Homo sapiens
taaggatggagccagctctg

SEQ ID NO: 1592831 - DNA, 16 bp, Homo sapiens
taaggatggatggcac

SEQ ID NO: 1592832 - DNA, 20 bp, Homo sapiens
taaggccagaaactcctttt

SEQ ID NO: 1592833 - DNA, 16 bp, Homo sapiens
taaggcccactgtaat

SEQ ID NO: 1592834 - DNA, 18 bp, Homo sapiens
taaggcctaggattctaa

SEQ ID NO: 1592835 - DNA, 13 bp, Homo sapiens
taaggctcctcct

SEQ ID NO: 1592836 - DNA, 15 bp, Homo sapiens
taaggctctgagagt

SEQ ID NO: 1592837 - DNA, 19 bp, Homo sapiens
taaggctctgagagtctag

SEQ ID NO: 1592838 - DNA, 17 bp, Homo sapiens
taaggctctgtgccttg

SEQ ID NO: 1592839 - DNA, 15 bp, Homo sapiens
taagggaaaaatcaa

SEQ ID NO: 1592840 - DNA, 15 bp, Homo sapiens
taagggactgatgtt

SEQ ID NO: 1592841 - DNA, 19 bp, Homo sapiens
taagggacttaacttgttt

SEQ ID NO: 1592842 - DNA, 18 bp, Homo sapiens
taagggagagctgagcca

SEQ ID NO: 1592843 - DNA, 22 bp, Homo sapiens
taagggcaaggagtttattaca

SEQ ID NO: 1592844 - DNA, 20 bp, Homo sapiens
taagggcagtgcccatgtgt

SEQ ID NO: 1592845 - DNA, 22 bp, Homo sapiens
taagggctggtctctgctgaag

SEQ ID NO: 1592846 - DNA, 15 bp, Homo sapiens
taaggggaagaatga

SEQ ID NO: 1592847 - DNA, 18 bp, Homo sapiens
taaggggaggctgctttc

SEQ ID NO: 1592848 - DNA, 18 bp, Homo sapiens
taagggttgaaggcagtc

SEQ ID NO: 1592849 - DNA, 21 bp, Homo sapiens
taaggtatatcattctaaaga

SEQ ID NO: 1592850 - DNA, 22 bp, Homo sapiens
taaggtctcatgctgttgctgc

SEQ ID NO: 1592851 - DNA, 13 bp, Homo sapiens
taaggtctgtttg

SEQ ID NO: 1592852 - DNA, 21 bp, Homo sapiens
taaggtgctctctttctgtct

SEQ ID NO: 1592853 - DNA, 23 bp, Homo sapiens
taaggtgggagaattgcttgagc

SEQ ID NO: 1592854 - DNA, 18 bp, Homo sapiens
taaggttctcagacctcc

SEQ ID NO: 1592855 - DNA, 19 bp, Homo sapiens
taaggtttcgtttctgtat

SEQ ID NO: 1592856 - DNA, 20 bp, Homo sapiens
taaggtttcgtttctgtata

SEQ ID NO: 1592857 - DNA, 16 bp, Homo sapiens
taagtaaaaccacagc

SEQ ID NO: 1592858 - DNA, 18 bp, Homo sapiens
taagtaaaaccacagcag

SEQ ID NO: 1592859 - DNA, 19 bp, Homo sapiens
taagtaaaaccacagcagt

SEQ ID NO: 1592860 - DNA, 14 bp, Homo sapiens
taagtaacacagta

SEQ ID NO: 1592861 - DNA, 16 bp, Homo sapiens
taagtaacacagtatt

SEQ ID NO: 1592862 - DNA, 15 bp, Homo sapiens
taagtgtatcttaat

SEQ ID NO: 1592863 - DNA, 21 bp, Homo sapiens
taagtgtgagtaagagctggt

SEQ ID NO: 1592864 - DNA, 14 bp, Homo sapiens
taagtgtgccaaat

SEQ ID NO: 1592865 - DNA, 18 bp, Homo sapiens
taagtgtgccaaatcagt

SEQ ID NO: 1592866 - DNA, 15 bp, Homo sapiens
taagtgtggttttgt

SEQ ID NO: 1592867 - DNA, 16 bp, Homo sapiens
taagtgtgtcttccta

SEQ ID NO: 1592868 - DNA, 22 bp, Homo sapiens
taagtgttcgtctttagttttg

SEQ ID NO: 1592869 - DNA, 13 bp, Homo sapiens
taagtgtttctca

SEQ ID NO: 1592870 - DNA, 14 bp, Homo sapiens
taagttatagtata

SEQ ID NO: 1592871 - DNA, 17 bp, Homo sapiens
taagttatttttgtaca

SEQ ID NO: 1592872 - DNA, 20 bp, Homo sapiens
taagttcaaattcttctgaa

SEQ ID NO: 1592873 - DNA, 16 bp, Homo sapiens
taagttcacattagaa

SEQ ID NO: 1592874 - DNA, 18 bp, Homo sapiens
taagttctaagttcatgt

SEQ ID NO: 1592875 - DNA, 21 bp, Homo sapiens
taagttcttatgaggagggga

SEQ ID NO: 1592876 - DNA, 15 bp, Homo sapiens
taagttgaaaaagga

SEQ ID NO: 1592877 - DNA, 19 bp, Homo sapiens
taagttgtcaaagaagctt

SEQ ID NO: 1592878 - DNA, 17 bp, Homo sapiens
taagtttcagttgattt

SEQ ID NO: 1592879 - DNA, 14 bp, Homo sapiens
taagtttctaagat

SEQ ID NO: 1592880 - DNA, 19 bp, Homo sapiens
taagtttctaagattctaa

SEQ ID NO: 1592881 - DNA, 20 bp, Homo sapiens
taagtttctaagattctaaa

SEQ ID NO: 1592882 - DNA, 12 bp, Homo sapiens
taagtttgtagt

SEQ ID NO: 1592883 - DNA, 23 bp, Homo sapiens
taagttttaaataaacctataat

SEQ ID NO: 1592884 - DNA, 21 bp, Homo sapiens
taagttttgattaatgtttct

SEQ ID NO: 1592885 - DNA, 14 bp, Homo sapiens
taagtttttccaaa

SEQ ID NO: 1592886 - DNA, 15 bp, Homo sapiens
taagttttttatgcc

SEQ ID NO: 1592887 - DNA, 14 bp, Homo sapiens
taataaaaaatgga

SEQ ID NO: 1592888 - DNA, 21 bp, Homo sapiens
taataaaaaatggaaagaatc

SEQ ID NO: 1592889 - DNA, 13 bp, Homo sapiens
taataaaaataca

SEQ ID NO: 1592890 - DNA, 15 bp, Homo sapiens
taataaaagatttac

SEQ ID NO: 1592891 - DNA, 13 bp, Homo sapiens
taataaaataagt

SEQ ID NO: 1592892 - DNA, 23 bp, Homo sapiens
taataaaataagtggattttgta

SEQ ID NO: 1592893 - DNA, 12 bp, Homo sapiens
taataaacactg

SEQ ID NO: 1592894 - DNA, 16 bp, Homo sapiens
taataaactgtattaa

SEQ ID NO: 1592895 - DNA, 13 bp, Homo sapiens
taataaactttat

SEQ ID NO: 1592896 - DNA, 16 bp, Homo sapiens
taataaagatgctctt

SEQ ID NO: 1592897 - DNA, 17 bp, Homo sapiens
taataaagatgctcttt

SEQ ID NO: 1592898 - DNA, 19 bp, Homo sapiens
taataaagatgtgaaaact

SEQ ID NO: 1592899 - DNA, 14 bp, Homo sapiens
taataaagcattct

SEQ ID NO: 1592900 - DNA, 11 bp, Homo sapiens
taataaaggct

SEQ ID NO: 1592901 - DNA, 14 bp, Homo sapiens
taataaagtatata

SEQ ID NO: 1592902 - DNA, 16 bp, Homo sapiens
taataaatatttatgt

SEQ ID NO: 1592903 - DNA, 18 bp, Homo sapiens
taataaatcatgttttga

SEQ ID NO: 1592904 - DNA, 14 bp, Homo sapiens
taataaatgccctc

SEQ ID NO: 1592905 - DNA, 17 bp, Homo sapiens
taataaatgtacattaa

SEQ ID NO: 1592906 - DNA, 15 bp, Homo sapiens
taataaattcaaaac

SEQ ID NO: 1592907 - DNA, 15 bp, Homo sapiens
taataaattcagata

SEQ ID NO: 1592908 - DNA, 15 bp, Homo sapiens
taataactgtgaagt

SEQ ID NO: 1592909 - DNA, 21 bp, Homo sapiens
taataactgtgaagtttacat

SEQ ID NO: 1592910 - DNA, 12 bp, Homo sapiens
taataagaaagt

SEQ ID NO: 1592911 - DNA, 17 bp, Homo sapiens
taataagagaatgttcc

SEQ ID NO: 1592912 - DNA, 17 bp, Homo sapiens
taataagggaaaaatca

SEQ ID NO: 1592913 - DNA, 18 bp, Homo sapiens
taataagggaaaaatcaa

SEQ ID NO: 1592914 - DNA, 14 bp, Homo sapiens
taataataatgttt

SEQ ID NO: 1592915 - DNA, 13 bp, Homo sapiens
taataatatatgt

SEQ ID NO: 1592916 - DNA, 19 bp, Homo sapiens
taataatttttacctaatc

SEQ ID NO: 1592917 - DNA, 20 bp, Homo sapiens
taatacaaaagggtcttgac

SEQ ID NO: 1592918 - DNA, 18 bp, Homo sapiens
taatacaaagaaaaagcc

SEQ ID NO: 1592919 - DNA, 14 bp, Homo sapiens
taatacaaggtata

SEQ ID NO: 1592920 - DNA, 19 bp, Homo sapiens
taatacaaggtataataaa

SEQ ID NO: 1592921 - DNA, 20 bp, Homo sapiens
taatacaaggtataataaaa

SEQ ID NO: 1592922 - DNA, 18 bp, Homo sapiens
taatacagcaacaattta

SEQ ID NO: 1592923 - DNA, 19 bp, Homo sapiens
taatacagcagtgtcatca

SEQ ID NO: 1592924 - DNA, 18 bp, Homo sapiens
taataccaaagactattt

SEQ ID NO: 1592925 - DNA, 20 bp, Homo sapiens
taataccaaagactatttca

SEQ ID NO: 1592926 - DNA, 22 bp, Homo sapiens
taataccaaagactatttcaaa

SEQ ID NO: 1592927 - DNA, 18 bp, Homo sapiens
taatacctgattgatcac

SEQ ID NO: 1592928 - DNA, 21 bp, Homo sapiens
taatacgtgccagatataact

SEQ ID NO: 1592929 - DNA, 14 bp, Homo sapiens
taatactcattcct

SEQ ID NO: 1592930 - DNA, 13 bp, Homo sapiens
taatactgttatt

SEQ ID NO: 1592931 - DNA, 20 bp, Homo sapiens
taatacttttttattttgtt

SEQ ID NO: 1592932 - DNA, 21 bp, Homo sapiens
taatagaagaacatccaagga

SEQ ID NO: 1592933 - DNA, 21 bp, Homo sapiens
taatctcaaagagattcgaat

SEQ ID NO: 1592934 - DNA, 20 bp, Homo sapiens
taatctcggaaggctgaggc

SEQ ID NO: 1592935 - DNA, 13 bp, Homo sapiens
taatctctaaaat

SEQ ID NO: 1592936 - DNA, 15 bp, Homo sapiens
taatctctaaaattc

SEQ ID NO: 1592937 - DNA, 21 bp, Homo sapiens
taatctctaaaattctagtct

SEQ ID NO: 1592938 - DNA, 23 bp, Homo sapiens
taatctctctgccgaaagtcaaa

SEQ ID NO: 1592939 - DNA, 23 bp, Homo sapiens
taatctctgattaaatttaatat

SEQ ID NO: 1592940 - DNA, 21 bp, Homo sapiens
taatctgaaaggatgtggaag

SEQ ID NO: 1592941 - DNA, 23 bp, Homo sapiens
taatctgaataaagtgtaacaat

SEQ ID NO: 1592942 - DNA, 16 bp, Homo sapiens
taatctgtagggctgg

SEQ ID NO: 1592943 - DNA, 20 bp, Homo sapiens
taatctgttatgtactagtg

SEQ ID NO: 1592944 - DNA, 13 bp, Homo sapiens
taatcttaagatt

SEQ ID NO: 1592945 - DNA, 13 bp, Homo sapiens
taatcttagcttt

SEQ ID NO: 1592946 - DNA, 16 bp, Homo sapiens
taatcttagcttttaa

SEQ ID NO: 1592947 - DNA, 18 bp, Homo sapiens
taatcttagcttttaata

SEQ ID NO: 1592948 - DNA, 19 bp, Homo sapiens
taatcttagcttttaatag

SEQ ID NO: 1592949 - DNA, 19 bp, Homo sapiens
taatcttaggggagagctt

SEQ ID NO: 1592950 - DNA, 15 bp, Homo sapiens
taatcttagtgtatg

SEQ ID NO: 1592951 - DNA, 18 bp, Homo sapiens
taatcttataattgttct

SEQ ID NO: 1592952 - DNA, 21 bp, Homo sapiens
taatcttattgtttaatcttt

SEQ ID NO: 1592953 - DNA, 16 bp, Homo sapiens
taatcttcaaagcctt

SEQ ID NO: 1592954 - DNA, 13 bp, Homo sapiens
taatcttcagttt

SEQ ID NO: 1592955 - DNA, 20 bp, Homo sapiens
taatcttcagttttatcttt

SEQ ID NO: 1592956 - DNA, 15 bp, Homo sapiens
taatcttgaatgttt

SEQ ID NO: 1592957 - DNA, 16 bp, Homo sapiens
taatcttgaatgtttg

SEQ ID NO: 1592958 - DNA, 14 bp, Homo sapiens
taatcttgctctgc

SEQ ID NO: 1592959 - DNA, 15 bp, Homo sapiens
taatcttgctctgct

SEQ ID NO: 1592960 - DNA, 15 bp, Homo sapiens
taatcttgctttctt

SEQ ID NO: 1592961 - DNA, 15 bp, Homo sapiens
taatcttgggtttct

SEQ ID NO: 1592962 - DNA, 15 bp, Homo sapiens
taatctttaaactgg

SEQ ID NO: 1592963 - DNA, 23 bp, Homo sapiens
taatctttcacttgaaagatttt

SEQ ID NO: 1592964 - DNA, 14 bp, Homo sapiens
taatctttctacct

SEQ ID NO: 1592965 - DNA, 21 bp, Homo sapiens
taatgaaaaggaagttaatac

SEQ ID NO: 1592966 - DNA, 17 bp, Homo sapiens
taatgaaaataaaacac

SEQ ID NO: 1592967 - DNA, 18 bp, Homo sapiens
taatgaaaatgaatatct

SEQ ID NO: 1592968 - DNA, 13 bp, Homo sapiens
taatgaaaatgtc

SEQ ID NO: 1592969 - DNA, 14 bp, Homo sapiens
taatgaaagactgt

SEQ ID NO: 1592970 - DNA, 18 bp, Homo sapiens
taatgaaagactgtacaa

SEQ ID NO: 1592971 - DNA, 18 bp, Homo sapiens
taattcccattttgcaaa

SEQ ID NO: 1592972 - DNA, 20 bp, Homo sapiens
taattcccattttgcaaaat

SEQ ID NO: 1592973 - DNA, 20 bp, Homo sapiens
taattccctatcttttagtt

SEQ ID NO: 1592974 - DNA, 21 bp, Homo sapiens
taattcctatatcctgtgact

SEQ ID NO: 1592975 - DNA, 20 bp, Homo sapiens
taattccttctcttttttca

SEQ ID NO: 1592976 - DNA, 11 bp, Homo sapiens
taattctaaat

SEQ ID NO: 1592977 - DNA, 18 bp, Homo sapiens
taattctaaatgaatgtt

SEQ ID NO: 1592978 - DNA, 21 bp, Homo sapiens
taattctaagttatttacttt

SEQ ID NO: 1592979 - DNA, 14 bp, Homo sapiens
taattctcatttgt

SEQ ID NO: 1592980 - DNA, 13 bp, Homo sapiens
taattctctgcaa

SEQ ID NO: 1592981 - DNA, 17 bp, Homo sapiens
taattctgtactgattt

SEQ ID NO: 1592982 - DNA, 23 bp, Homo sapiens
taattctgtactgatttttgtaa

SEQ ID NO: 1592983 - DNA, 18 bp, Homo sapiens
taattctgttactttgct

SEQ ID NO: 1592984 - DNA, 15 bp, Homo sapiens
taattcttgtatatt

SEQ ID NO: 1592985 - DNA, 16 bp, Homo sapiens
taattcttgtatatta

SEQ ID NO: 1592986 - DNA, 17 bp, Homo sapiens
taattctttctgtctcc

SEQ ID NO: 1592987 - DNA, 18 bp, Homo sapiens
taattctttctgtctccc

SEQ ID NO: 1592988 - DNA, 16 bp, Homo sapiens
taattctttgcaaaaa

SEQ ID NO: 1592989 - DNA, 21 bp, Homo sapiens
taattctttgcaaaaatccaa

SEQ ID NO: 1592990 - DNA, 18 bp, Homo sapiens
taattgaaattaactttt

SEQ ID NO: 1592991 - DNA, 22 bp, Homo sapiens
taattgaagtgtataatataaa

SEQ ID NO: 1592992 - DNA, 20 bp, Homo sapiens
taattgacaggattattgga

SEQ ID NO: 1592993 - DNA, 18 bp, Homo sapiens
taattgatcaaattcatt

SEQ ID NO: 1592994 - DNA, 19 bp, Homo sapiens
taattgatcaaattcattt

SEQ ID NO: 1592995 - DNA, 15 bp, Homo sapiens
taattgcacttttta

SEQ ID NO: 1592996 - DNA, 19 bp, Homo sapiens
taattgcactttttaagtt

SEQ ID NO: 1592997 - DNA, 20 bp, Homo sapiens
taattgcatcagttcattga

SEQ ID NO: 1592998 - DNA, 12 bp, Homo sapiens
taattgcattca

SEQ ID NO: 1592999 - DNA, 22 bp, Homo sapiens
taattgcattcatcttgtgttt

SEQ ID NO: 1593000 - DNA, 18 bp, Homo sapiens
taattgcatttctgctct

SEQ ID NO: 1593001 - DNA, 17 bp, Homo sapiens
taattgcctagaaatat

SEQ ID NO: 1593002 - DNA, 23 bp, Homo sapiens
taattgcctagaaatatctttct

SEQ ID NO: 1593003 - DNA, 14 bp, Homo sapiens
taattgctttgcca

SEQ ID NO: 1593004 - DNA, 21 bp, Homo sapiens
taattggaatcttcacctcag

SEQ ID NO: 1593005 - DNA, 16 bp, Homo sapiens
taattggatttcctaa

SEQ ID NO: 1593006 - DNA, 17 bp, Homo sapiens
taattggatttcctaat

SEQ ID NO: 1593007 - DNA, 18 bp, Homo sapiens
taattggtccgatctttg

SEQ ID NO: 1593008 - DNA, 18 bp, Homo sapiens
taattggtttagttctta

SEQ ID NO: 1593009 - DNA, 16 bp, Homo sapiens
taattgtaagtgaaat

SEQ ID NO: 1593010 - DNA, 17 bp, Homo sapiens
taattgtacaaaattaa

SEQ ID NO: 1593011 - DNA, 22 bp, Homo sapiens
taattgtacaaaattaagcaaa

SEQ ID NO: 1593012 - DNA, 23 bp, Homo sapiens
taattgtacaaaattaagcaaat

SEQ ID NO: 1593013 - DNA, 15 bp, Homo sapiens
taattgtacaataaa

SEQ ID NO: 1593014 - DNA, 16 bp, Homo sapiens
taattgtacaataaat

SEQ ID NO: 1593015 - DNA, 21 bp, Homo sapiens
taattgtacaataaatttttt

SEQ ID NO: 1593016 - DNA, 13 bp, Homo sapiens
taattgtagttct

SEQ ID NO: 1593017 - DNA, 17 bp, Homo sapiens
taattgtagttctgtgt

SEQ ID NO: 1593018 - DNA, 12 bp, Homo sapiens
taattgtataag

SEQ ID NO: 1593019 - DNA, 13 bp, Homo sapiens
taattgtataagt

SEQ ID NO: 1593020 - DNA, 23 bp, Homo sapiens
taattgtataagtcaagcacatg

SEQ ID NO: 1593021 - DNA, 19 bp, Homo sapiens
taattgtggattaatgtca

SEQ ID NO: 1593022 - DNA, 14 bp, Homo sapiens
taattgtggcttta

SEQ ID NO: 1593023 - DNA, 16 bp, Homo sapiens
taattgtgtatatgtt

SEQ ID NO: 1593024 - DNA, 15 bp, Homo sapiens
taattgtgtgatatt

SEQ ID NO: 1593025 - DNA, 22 bp, Homo sapiens
taattgtgtgatatttcagaaa

SEQ ID NO: 1593026 - DNA, 22 bp, Homo sapiens
taattgttcattttgagctgaa

SEQ ID NO: 1593027 - DNA, 21 bp, Homo sapiens
taattgtttccaacttgtctg

SEQ ID NO: 1593028 - DNA, 12 bp, Homo sapiens
taattgttttgc

SEQ ID NO: 1593029 - DNA, 16 bp, Homo sapiens
taattgttttgcactt

SEQ ID NO: 1593030 - DNA, 16 bp, Homo sapiens
taattgttttggaata

SEQ ID NO: 1593031 - DNA, 18 bp, Homo sapiens
taattgttttttaaagca

SEQ ID NO: 1593032 - DNA, 17 bp, Homo sapiens
taatttaaaaagtgcta

SEQ ID NO: 1593033 - DNA, 15 bp, Homo sapiens
taatttaaaattgtg

SEQ ID NO: 1593034 - DNA, 20 bp, Homo sapiens
taatttaaaattgtgatgtg

SEQ ID NO: 1593035 - DNA, 14 bp, Homo sapiens
taatttaaacaggc

SEQ ID NO: 1593036 - DNA, 17 bp, Homo sapiens
taatttaaacaggccca

SEQ ID NO: 1593037 - DNA, 16 bp, Homo sapiens
taatttaaatgaaaga

SEQ ID NO: 1593038 - DNA, 19 bp, Homo sapiens
taatttaacaccctttaga

SEQ ID NO: 1593039 - DNA, 18 bp, Homo sapiens
taatttaataaaaaggaa

SEQ ID NO: 1593040 - DNA, 21 bp, Homo sapiens
taatttaatgcatgttaggaa

SEQ ID NO: 1593041 - DNA, 21 bp, Homo sapiens
taatttacaggttcttaggct

SEQ ID NO: 1593042 - DNA, 12 bp, Homo sapiens
taatttaccaag

SEQ ID NO: 1593043 - DNA, 16 bp, Homo sapiens
taatttacttgttttg

SEQ ID NO: 1593044 - DNA, 22 bp, Homo sapiens
taatttagagataggaaactga

SEQ ID NO: 1593045 - DNA, 21 bp, Homo sapiens
taatttataaaagaataaaat

SEQ ID NO: 1593046 - DNA, 15 bp, Homo sapiens
taatttataaataca

SEQ ID NO: 1593047 - DNA, 22 bp, Homo sapiens
taatttatattccatttacata

SEQ ID NO: 1593048 - DNA, 20 bp, Homo sapiens
taatttatgagtttttgata

SEQ ID NO: 1593049 - DNA, 19 bp, Homo sapiens
taatttatttagtttttaa

SEQ ID NO: 1593050 - DNA, 14 bp, Homo sapiens
taatttcaaaatac

SEQ ID NO: 1593051 - DNA, 16 bp, Homo sapiens
taatttcaaaatacat

SEQ ID NO: 1593052 - DNA, 21 bp, Homo sapiens
taatttcaaaatacatttgta

SEQ ID NO: 1593053 - DNA, 14 bp, Homo sapiens
tacagcattgtctt

SEQ ID NO: 1593054 - DNA, 23 bp, Homo sapiens
tacagccgtcccgcgttcaagac

SEQ ID NO: 1593055 - DNA, 15 bp, Homo sapiens
tacagcctgcacaca

SEQ ID NO: 1593056 - DNA, 19 bp, Homo sapiens
tacagcctgcacacacctg

SEQ ID NO: 1593057 - DNA, 21 bp, Homo sapiens
tacagcctgcacacacctgcc

SEQ ID NO: 1593058 - DNA, 20 bp, Homo sapiens
tacagcgcggaggaggaggg

SEQ ID NO: 1593059 - DNA, 16 bp, Homo sapiens
tacagctatatttgat

SEQ ID NO: 1593060 - DNA, 20 bp, Homo sapiens
tacagctctggccacaacag

SEQ ID NO: 1593061 - DNA, 14 bp, Homo sapiens
tacagctgtattgt

SEQ ID NO: 1593062 - DNA, 18 bp, Homo sapiens
tacagctgtattgtctga

SEQ ID NO: 1593063 - DNA, 19 bp, Homo sapiens
tacagctgtattgtctgaa

SEQ ID NO: 1593064 - DNA, 14 bp, Homo sapiens
tacagcttcaccct

SEQ ID NO: 1593065 - DNA, 17 bp, Homo sapiens
tacagcttctggagcag

SEQ ID NO: 1593066 - DNA, 23 bp, Homo sapiens
tacagcttgtttaacggcagtgt

SEQ ID NO: 1593067 - DNA, 21 bp, Homo sapiens
tacaggaaaaaaaattctgtt

SEQ ID NO: 1593068 - DNA, 15 bp, Homo sapiens
tacaggaaacagttg

SEQ ID NO: 1593069 - DNA, 21 bp, Homo sapiens
tacaggaagctttttgtatta

SEQ ID NO: 1593070 - DNA, 15 bp, Homo sapiens
tacaggagaggcagc

SEQ ID NO: 1593071 - DNA, 14 bp, Homo sapiens
tacaggcaccgaga

SEQ ID NO: 1593072 - DNA, 16 bp, Homo sapiens
tacagggagctgggac

SEQ ID NO: 1593073 - DNA, 18 bp, Homo sapiens
tacaggggttagcctgga

SEQ ID NO: 1593074 - DNA, 19 bp, Homo sapiens
tacaggtcacccatcagga

SEQ ID NO: 1593075 - DNA, 14 bp, Homo sapiens
tacagtaagcatag

SEQ ID NO: 1593076 - DNA, 18 bp, Homo sapiens
tacagtaagctgctctat

SEQ ID NO: 1593077 - DNA, 21 bp, Homo sapiens
tacagtaatcccatttcccaa

SEQ ID NO: 1593078 - DNA, 18 bp, Homo sapiens
tacagtacacagatacct

SEQ ID NO: 1593079 - DNA, 15 bp, Homo sapiens
tacagtacttccaga

SEQ ID NO: 1593080 - DNA, 21 bp, Homo sapiens
tacagtagattttccaaatgt

SEQ ID NO: 1593081 - DNA, 14 bp, Homo sapiens
tacagtagccttat

SEQ ID NO: 1593082 - DNA, 17 bp, Homo sapiens
tacagtagctgctacct

SEQ ID NO: 1593083 - DNA, 18 bp, Homo sapiens
tacagtattatagacaaa

SEQ ID NO: 1593084 - DNA, 22 bp, Homo sapiens
tacagtattatagacaaaagaa

SEQ ID NO: 1593085 - DNA, 17 bp, Homo sapiens
tacagtattcttttaaa

SEQ ID NO: 1593086 - DNA, 19 bp, Homo sapiens
tacagtccaaaatactgtt

SEQ ID NO: 1593087 - DNA, 14 bp, Homo sapiens
tacagtctgtcatg

SEQ ID NO: 1593088 - DNA, 15 bp, Homo sapiens
tacagtgcagacagg

SEQ ID NO: 1593089 - DNA, 22 bp, Homo sapiens
tacagtgcatagttgtagacaa

SEQ ID NO: 1593090 - DNA, 13 bp, Homo sapiens
tacagtgtacatg

SEQ ID NO: 1593091 - DNA, 15 bp, Homo sapiens
tacagtgttttatcc

SEQ ID NO: 1593092 - DNA, 16 bp, Homo sapiens
tacagttacagttgat

SEQ ID NO: 1593093 - DNA, 13 bp, Homo sapiens
tacagttctttcc

SEQ ID NO: 1593094 - DNA, 18 bp, Homo sapiens
tacagttctttcctcttt

SEQ ID NO: 1593095 - DNA, 17 bp, Homo sapiens
tacagttgaaataactg

SEQ ID NO: 1593096 - DNA, 19 bp, Homo sapiens
tacagttgaaataactgga

SEQ ID NO: 1593097 - DNA, 15 bp, Homo sapiens
tacagttgaatttta

SEQ ID NO: 1593098 - DNA, 16 bp, Homo sapiens
tacagttgttggcctc

SEQ ID NO: 1593099 - DNA, 20 bp, Homo sapiens
tacagttgttttttgaaaac

SEQ ID NO: 1593100 - DNA, 14 bp, Homo sapiens
tacagtttgcacaa

SEQ ID NO: 1593101 - DNA, 17 bp, Homo sapiens
tacagttttaactgtgg

SEQ ID NO: 1593102 - DNA, 19 bp, Homo sapiens
tacagttttaactgtggat

SEQ ID NO: 1593103 - DNA, 16 bp, Homo sapiens
tacataaaaaagtgtt

SEQ ID NO: 1593104 - DNA, 16 bp, Homo sapiens
tacataaaagaatttt

SEQ ID NO: 1593105 - DNA, 16 bp, Homo sapiens
tacataaacttttgca

SEQ ID NO: 1593106 - DNA, 16 bp, Homo sapiens
tacataacattcaatt

SEQ ID NO: 1593107 - DNA, 16 bp, Homo sapiens
tacataactcctgtcc

SEQ ID NO: 1593108 - DNA, 20 bp, Homo sapiens
tacataactcctgtcccttt

SEQ ID NO: 1593109 - DNA, 22 bp, Homo sapiens
tacataactcctgtcccttttc

SEQ ID NO: 1593110 - DNA, 21 bp, Homo sapiens
tacataactgaaaatgtgcta

SEQ ID NO: 1593111 - DNA, 18 bp, Homo sapiens
tacataacttgatataga

SEQ ID NO: 1593112 - DNA, 22 bp, Homo sapiens
tacataagcggcgtaagtttaa

SEQ ID NO: 1593113 - DNA, 19 bp, Homo sapiens
tacatacgatttaaggtat

SEQ ID NO: 1593114 - DNA, 15 bp, Homo sapiens
tacatactgcatctt

SEQ ID NO: 1593115 - DNA, 20 bp, Homo sapiens
tacatagaccctctttcttg

SEQ ID NO: 1593116 - DNA, 13 bp, Homo sapiens
tacatagagcaat

SEQ ID NO: 1593117 - DNA, 15 bp, Homo sapiens
tacatagagcaatgt

SEQ ID NO: 1593118 - DNA, 17 bp, Homo sapiens
tacatagagcaatgttg

SEQ ID NO: 1593119 - DNA, 22 bp, Homo sapiens
tacatagagcaatgttggtttt

SEQ ID NO: 1593120 - DNA, 14 bp, Homo sapiens
tacatagatgctta

SEQ ID NO: 1593121 - DNA, 13 bp, Homo sapiens
tacataggtctgt

SEQ ID NO: 1593122 - DNA, 16 bp, Homo sapiens
tacataggtctgtatg

SEQ ID NO: 1593123 - DNA, 18 bp, Homo sapiens
tacataggtctgtatggc

SEQ ID NO: 1593124 - DNA, 18 bp, Homo sapiens
tacatagtaaagtatttt

SEQ ID NO: 1593125 - DNA, 14 bp, Homo sapiens
tacatatatgtata

SEQ ID NO: 1593126 - DNA, 18 bp, Homo sapiens
tacatatcacctcatggc

SEQ ID NO: 1593127 - DNA, 19 bp, Homo sapiens
tacatatcccttccagatg

SEQ ID NO: 1593128 - DNA, 16 bp, Homo sapiens
tacatatgtaaaataa

SEQ ID NO: 1593129 - DNA, 17 bp, Homo sapiens
tacatatgtatacatgt

SEQ ID NO: 1593130 - DNA, 23 bp, Homo sapiens
tacatattaggaaaatatgggtt

SEQ ID NO: 1593131 - DNA, 18 bp, Homo sapiens
tacatatttttgtagcac

SEQ ID NO: 1593132 - DNA, 17 bp, Homo sapiens
tacatcaagtccatctg

SEQ ID NO: 1593133 - DNA, 15 bp, Homo sapiens
tacatcagaaaataa

SEQ ID NO: 1593134 - DNA, 23 bp, Homo sapiens
tacatcagaaaataaaatattca

SEQ ID NO: 1593135 - DNA, 18 bp, Homo sapiens
tacatcagactctagaaa

SEQ ID NO: 1593136 - DNA, 14 bp, Homo sapiens
tacatcatgttatt

SEQ ID NO: 1593137 - DNA, 20 bp, Homo sapiens
tacatcatttctttttggga

SEQ ID NO: 1593138 - DNA, 22 bp, Homo sapiens
tacatcctcatgcagccgtgat

SEQ ID NO: 1593139 - DNA, 15 bp, Homo sapiens
tacatctaatgcttc

SEQ ID NO: 1593140 - DNA, 13 bp, Homo sapiens
tacatctgtgtat

SEQ ID NO: 1593141 - DNA, 14 bp, Homo sapiens
tacatctgtgtatt

SEQ ID NO: 1593142 - DNA, 19 bp, Homo sapiens
tacatctgtgtatttgagt

SEQ ID NO: 1593143 - DNA, 16 bp, Homo sapiens
tacatcttatttcctc

SEQ ID NO: 1593144 - DNA, 14 bp, Homo sapiens
tacatcttctgcct

SEQ ID NO: 1593145 - DNA, 17 bp, Homo sapiens
tacatcttctgccttag

SEQ ID NO: 1593146 - DNA, 15 bp, Homo sapiens
tacatctttcacatt

SEQ ID NO: 1593147 - DNA, 12 bp, Homo sapiens
tacatgtgtaca

SEQ ID NO: 1593148 - DNA, 14 bp, Homo sapiens
tacatgtgtacata

SEQ ID NO: 1593149 - DNA, 19 bp, Homo sapiens
tacatgtgtagcctgtgca

SEQ ID NO: 1593150 - DNA, 19 bp, Homo sapiens
tacatgtgtagggaaagtt

SEQ ID NO: 1593151 - DNA, 12 bp, Homo sapiens
tacatgttcttt

SEQ ID NO: 1593152 - DNA, 16 bp, Homo sapiens
tacatgttctttgtac

SEQ ID NO: 1593153 - DNA, 20 bp, Homo sapiens
tacatgttctttgtaccttt

SEQ ID NO: 1593154 - DNA, 22 bp, Homo sapiens
tacatgttctttgtaccttttg

SEQ ID NO: 1593155 - DNA, 15 bp, Homo sapiens
tacatgtttataaat

SEQ ID NO: 1593156 - DNA, 14 bp, Homo sapiens
tacatgtttatgta

SEQ ID NO: 1593157 - DNA, 21 bp, Homo sapiens
tacatgtttatgtaaacaaat

SEQ ID NO: 1593158 - DNA, 19 bp, Homo sapiens
tacattaacggtgctaaaa

SEQ ID NO: 1593159 - DNA, 20 bp, Homo sapiens
tacattagcagtttgctttg

SEQ ID NO: 1593160 - DNA, 21 bp, Homo sapiens
tacattattaaacgatttcta

SEQ ID NO: 1593161 - DNA, 16 bp, Homo sapiens
tacattatttcttccc

SEQ ID NO: 1593162 - DNA, 23 bp, Homo sapiens
tacattcaacttttctaagaaaa

SEQ ID NO: 1593163 - DNA, 16 bp, Homo sapiens
tacattccattgtttt

SEQ ID NO: 1593164 - DNA, 21 bp, Homo sapiens
tacattccattgttttagtaa

SEQ ID NO: 1593165 - DNA, 15 bp, Homo sapiens
tacattccatttcat

SEQ ID NO: 1593166 - DNA, 15 bp, Homo sapiens
tacattcctaactag

SEQ ID NO: 1593167 - DNA, 19 bp, Homo sapiens
tacattcctaactagaatt

SEQ ID NO: 1593168 - DNA, 13 bp, Homo sapiens
tacattcctcagc

SEQ ID NO: 1593169 - DNA, 13 bp, Homo sapiens
tacattctttgct

SEQ ID NO: 1593170 - DNA, 14 bp, Homo sapiens
tacattctttgcta

SEQ ID NO: 1593171 - DNA, 15 bp, Homo sapiens
tacattctttttgct

SEQ ID NO: 1593172 - DNA, 16 bp, Homo sapiens
tacattctttttgctc

SEQ ID NO: 1593173 - DNA, 18 bp, Homo sapiens
tacattctttttgctcta

SEQ ID NO: 1593174 - DNA, 18 bp, Homo sapiens
tacattgaaaacagatat

SEQ ID NO: 1593175 - DNA, 19 bp, Homo sapiens
tacattgaaaacagatatt

SEQ ID NO: 1593176 - DNA, 17 bp, Homo sapiens
tacattgtaaatagtat

SEQ ID NO: 1593177 - DNA, 15 bp, Homo sapiens
tacattgtatatatg

SEQ ID NO: 1593178 - DNA, 13 bp, Homo sapiens
tacattgtcctgt

SEQ ID NO: 1593179 - DNA, 14 bp, Homo sapiens
tacattgtcctgta

SEQ ID NO: 1593180 - DNA, 21 bp, Homo sapiens
tacattgtgagctctggttat

SEQ ID NO: 1593181 - DNA, 20 bp, Homo sapiens
tacattgtgtgaaaaaagaa

SEQ ID NO: 1593182 - DNA, 19 bp, Homo sapiens
tacattgtttgtctgtctt

SEQ ID NO: 1593183 - DNA, 13 bp, Homo sapiens
tacatttaaaatt

SEQ ID NO: 1593184 - DNA, 20 bp, Homo sapiens
tacatttatttatccagaaa

SEQ ID NO: 1593185 - DNA, 23 bp, Homo sapiens
tacatttatttatccagaaaact

SEQ ID NO: 1593186 - DNA, 19 bp, Homo sapiens
tacatttctaagtcaaaca

SEQ ID NO: 1593187 - DNA, 18 bp, Homo sapiens
tacatttctcctttgata

SEQ ID NO: 1593188 - DNA, 15 bp, Homo sapiens
tacatttctgcagat

SEQ ID NO: 1593189 - DNA, 23 bp, Homo sapiens
tacatttgcagatgttcaaatat

SEQ ID NO: 1593190 - DNA, 23 bp, Homo sapiens
tacatttgtaagtgtaaaaaatg

SEQ ID NO: 1593191 - DNA, 19 bp, Homo sapiens
tacatttgtaatttaaggt

SEQ ID NO: 1593192 - DNA, 13 bp, Homo sapiens
tacatttgtattt

SEQ ID NO: 1593193 - DNA, 18 bp, Homo sapiens
tacatttgtattttgtga

SEQ ID NO: 1593194 - DNA, 14 bp, Homo sapiens
tacatttgtttgta

SEQ ID NO: 1593195 - DNA, 18 bp, Homo sapiens
tacatttgtttgtattca

SEQ ID NO: 1593196 - DNA, 22 bp, Homo sapiens
tacatttgtttgtattcatgtt

SEQ ID NO: 1593197 - DNA, 14 bp, Homo sapiens
tacattttctaaat

SEQ ID NO: 1593198 - DNA, 15 bp, Homo sapiens
tacattttctaaata

SEQ ID NO: 1593199 - DNA, 16 bp, Homo sapiens
tacattttctaaataa

SEQ ID NO: 1593200 - DNA, 19 bp, Homo sapiens
tacattttgtatattaact

SEQ ID NO: 1593201 - DNA, 18 bp, Homo sapiens
tacattttgtggcttttt

SEQ ID NO: 1593202 - DNA, 16 bp, Homo sapiens
tacatttttacaataa

SEQ ID NO: 1593203 - DNA, 19 bp, Homo sapiens
tacatttttacaataaata

SEQ ID NO: 1593204 - DNA, 21 bp, Homo sapiens
tacattttttaggacatctta

SEQ ID NO: 1593205 - DNA, 15 bp, Homo sapiens
tacattttttgaaat

SEQ ID NO: 1593206 - DNA, 22 bp, Homo sapiens
taccaaaaaccatgttgcgttc

SEQ ID NO: 1593207 - DNA, 13 bp, Homo sapiens
taccaaaatttta

SEQ ID NO: 1593208 - DNA, 14 bp, Homo sapiens
taccaaaattttaa

SEQ ID NO: 1593209 - DNA, 16 bp, Homo sapiens
taccaaacaaggaagc

SEQ ID NO: 1593210 - DNA, 20 bp, Homo sapiens
taccaaacaaggaagccaaa

SEQ ID NO: 1593211 - DNA, 23 bp, Homo sapiens
taccaaacaaggaagccaaagtt

SEQ ID NO: 1593212 - DNA, 15 bp, Homo sapiens
taccaaacactcagt

SEQ ID NO: 1593213 - DNA, 17 bp, Homo sapiens
taccaaacactcagtcc

SEQ ID NO: 1593214 - DNA, 23 bp, Homo sapiens
taccaaagactatttcaaaatgt

SEQ ID NO: 1593215 - DNA, 13 bp, Homo sapiens
taccaaaggatag

SEQ ID NO: 1593216 - DNA, 12 bp, Homo sapiens
taccaacctgtt

SEQ ID NO: 1593217 - DNA, 12 bp, Homo sapiens
taccaaggattt

SEQ ID NO: 1593218 - DNA, 22 bp, Homo sapiens
taccaaggtacaactgtattta

SEQ ID NO: 1593219 - DNA, 20 bp, Homo sapiens
taccaagttgtgcttttctg

SEQ ID NO: 1593220 - DNA, 12 bp, Homo sapiens
taccaataaagt

SEQ ID NO: 1593221 - DNA, 22 bp, Homo sapiens
taccaatcattttaattattat

SEQ ID NO: 1593222 - DNA, 14 bp, Homo sapiens
taccaatgctgttg

SEQ ID NO: 1593223 - DNA, 22 bp, Homo sapiens
taccacaaaccctgctgaacac

SEQ ID NO: 1593224 - DNA, 13 bp, Homo sapiens
taccacaaggaaa

SEQ ID NO: 1593225 - DNA, 14 bp, Homo sapiens
taccacaaggaaaa

SEQ ID NO: 1593226 - DNA, 14 bp, Homo sapiens
taccacagtgtctg

SEQ ID NO: 1593227 - DNA, 15 bp, Homo sapiens
taccacctttactgt

SEQ ID NO: 1593228 - DNA, 15 bp, Homo sapiens
taccactatttaagt

SEQ ID NO: 1593229 - DNA, 18 bp, Homo sapiens
taccactatttaagttat

SEQ ID NO: 1593230 - DNA, 18 bp, Homo sapiens
taccactgtaattgacag

SEQ ID NO: 1593231 - DNA, 17 bp, Homo sapiens
taccacttcctgaggcc

SEQ ID NO: 1593232 - DNA, 15 bp, Homo sapiens
taccactttcttatt

SEQ ID NO: 1593233 - DNA, 13 bp, Homo sapiens
taccagaagggaa

SEQ ID NO: 1593234 - DNA, 14 bp, Homo sapiens
taccagctgcgctt

SEQ ID NO: 1593235 - DNA, 22 bp, Homo sapiens
taccagctgcgcttgcttttct

SEQ ID NO: 1593236 - DNA, 16 bp, Homo sapiens
taccaggaactataaa

SEQ ID NO: 1593237 - DNA, 19 bp, Homo sapiens
taccaggcaacctcccatc

SEQ ID NO: 1593238 - DNA, 12 bp, Homo sapiens
taccagggaagt

SEQ ID NO: 1593239 - DNA, 12 bp, Homo sapiens
taccagtattta

SEQ ID NO: 1593240 - DNA, 20 bp, Homo sapiens
taccagtatttagaagccaa

SEQ ID NO: 1593241 - DNA, 16 bp, Homo sapiens
taccagtctatttcca

SEQ ID NO: 1593242 - DNA, 11 bp, Homo sapiens
taccagtgtgg

SEQ ID NO: 1593243 - DNA, 19 bp, Homo sapiens
taccagttaatttttccaa

SEQ ID NO: 1593244 - DNA, 12 bp, Homo sapiens
taccagttgttc

SEQ ID NO: 1593245 - DNA, 15 bp, Homo sapiens
taccagtttctttgt

SEQ ID NO: 1593246 - DNA, 17 bp, Homo sapiens
taccatagaaaaatgta

SEQ ID NO: 1593247 - DNA, 13 bp, Homo sapiens
taccatcatctct

SEQ ID NO: 1593248 - DNA, 17 bp, Homo sapiens
taccatcatctctgaag

SEQ ID NO: 1593249 - DNA, 13 bp, Homo sapiens
tacccaaccactc

SEQ ID NO: 1593250 - DNA, 22 bp, Homo sapiens
tacccaaccctgccctgcccca

SEQ ID NO: 1593251 - DNA, 12 bp, Homo sapiens
tacccacctaga

SEQ ID NO: 1593252 - DNA, 22 bp, Homo sapiens
tacccacctagaacactaactc

SEQ ID NO: 1593253 - DNA, 14 bp, Homo sapiens
tacccactgccatg

SEQ ID NO: 1593254 - DNA, 21 bp, Homo sapiens
tacccacttctaaatagcaat

SEQ ID NO: 1593255 - DNA, 14 bp, Homo sapiens
tacccagaaagtta

SEQ ID NO: 1593256 - DNA, 20 bp, Homo sapiens
tacccagagaatatatacat

SEQ ID NO: 1593257 - DNA, 21 bp, Homo sapiens
tacccagattgtgtacataga

SEQ ID NO: 1593258 - DNA, 16 bp, Homo sapiens
tacccagctgatgggg

SEQ ID NO: 1593259 - DNA, 16 bp, Homo sapiens
tacccaggaccaagcc

SEQ ID NO: 1593260 - DNA, 22 bp, Homo sapiens
tacccaggtattacacaagcca

SEQ ID NO: 1593261 - DNA, 13 bp, Homo sapiens
tacccataaacag

SEQ ID NO: 1593262 - DNA, 14 bp, Homo sapiens
tacccataaacagc

SEQ ID NO: 1593263 - DNA, 16 bp, Homo sapiens
tacccataaacagcac

SEQ ID NO: 1593264 - DNA, 15 bp, Homo sapiens
tacccatagacatga

SEQ ID NO: 1593265 - DNA, 17 bp, Homo sapiens
tacccatagacatgaaa

SEQ ID NO: 1593266 - DNA, 18 bp, Homo sapiens
tacccatagacatgaaag

SEQ ID NO: 1593267 - DNA, 11 bp, Homo sapiens
tacccatgcac

SEQ ID NO: 1593268 - DNA, 16 bp, Homo sapiens
tacccattctgttttc

SEQ ID NO: 1593269 - DNA, 18 bp, Homo sapiens
tacccattgttcccttcc

SEQ ID NO: 1593270 - DNA, 22 bp, Homo sapiens
tacccattttttaaaaaagcaa

SEQ ID NO: 1593271 - DNA, 15 bp, Homo sapiens
taccccaaggccagt

SEQ ID NO: 1593272 - DNA, 12 bp, Homo sapiens
taccccaccctc

SEQ ID NO: 1593273 - DNA, 13 bp, Homo sapiens
taccccaccctca

SEQ ID NO: 1593274 - DNA, 23 bp, Homo sapiens
taccccaccctcagcaccccttc

SEQ ID NO: 1593275 - DNA, 21 bp, Homo sapiens
taccccactgggccagccctg

SEQ ID NO: 1593276 - DNA, 15 bp, Homo sapiens
taccccagccaggct

SEQ ID NO: 1593277 - DNA, 23 bp, Homo sapiens
taccccagcctcgttggagagca

SEQ ID NO: 1593278 - DNA, 22 bp, Homo sapiens
tacccccaggaaactagctttt

SEQ ID NO: 1593279 - DNA, 17 bp, Homo sapiens
taccccgcagacacctt

SEQ ID NO: 1593280 - DNA, 13 bp, Homo sapiens
tacccgagcccag

SEQ ID NO: 1593281 - DNA, 14 bp, Homo sapiens
taccctaaccaagt

SEQ ID NO: 1593282 - DNA, 17 bp, Homo sapiens
taccctaaccaagttcc

SEQ ID NO: 1593283 - DNA, 11 bp, Homo sapiens
taccctcagcc

SEQ ID NO: 1593284 - DNA, 12 bp, Homo sapiens
taccctcagcct

SEQ ID NO: 1593285 - DNA, 18 bp, Homo sapiens
taccctcagcctccaatg

SEQ ID NO: 1593286 - DNA, 11 bp, Homo sapiens
taccctccccc

SEQ ID NO: 1593287 - DNA, 17 bp, Homo sapiens
taccctcgggcccacct

SEQ ID NO: 1593288 - DNA, 20 bp, Homo sapiens
taccctcgggcccacctggc

SEQ ID NO: 1593289 - DNA, 22 bp, Homo sapiens
taccctcgggcccacctggcca

SEQ ID NO: 1593290 - DNA, 20 bp, Homo sapiens
taccctctcagctccaggtg

SEQ ID NO: 1593291 - DNA, 19 bp, Homo sapiens
taccctctttgctgcagag

SEQ ID NO: 1593292 - DNA, 16 bp, Homo sapiens
taccctgagcccacca

SEQ ID NO: 1593293 - DNA, 17 bp, Homo sapiens
taccctgaggtcactgc

SEQ ID NO: 1593294 - DNA, 22 bp, Homo sapiens
taccctggcactataatgtaag

SEQ ID NO: 1593295 - DNA, 22 bp, Homo sapiens
taccctggcagggacctgagag

SEQ ID NO: 1593296 - DNA, 22 bp, Homo sapiens
taccctggtccagtcgggagga

SEQ ID NO: 1593297 - DNA, 15 bp, Homo sapiens
taccctgtctgtccc

SEQ ID NO: 1593298 - DNA, 17 bp, Homo sapiens
taccctgtctgtccctt

SEQ ID NO: 1593299 - DNA, 19 bp, Homo sapiens
tacccttccacctcctaga

SEQ ID NO: 1593300 - DNA, 14 bp, Homo sapiens
tacccttctccttt

SEQ ID NO: 1593301 - DNA, 18 bp, Homo sapiens
tacccttgagacctggaa

SEQ ID NO: 1593302 - DNA, 16 bp, Homo sapiens
tacccttttccccctt

SEQ ID NO: 1593303 - DNA, 19 bp, Homo sapiens
tacccttttcccccttccc

SEQ ID NO: 1593304 - DNA, 16 bp, Homo sapiens
taccctttttcttgaa

SEQ ID NO: 1593305 - DNA, 18 bp, Homo sapiens
taccgagtctcttctcca

SEQ ID NO: 1593306 - DNA, 13 bp, Homo sapiens
taccgatttctgc

SEQ ID NO: 1593307 - DNA, 14 bp, Homo sapiens
taccgatttctgct

SEQ ID NO: 1593308 - DNA, 15 bp, Homo sapiens
taccgcaggcccgga

SEQ ID NO: 1593309 - DNA, 17 bp, Homo sapiens
taccgcccggcagcccc

SEQ ID NO: 1593310 - DNA, 21 bp, Homo sapiens
taccgcctcgtgccagcagcc

SEQ ID NO: 1593311 - DNA, 22 bp, Homo sapiens
taccgcctcgtgccagcagcct

SEQ ID NO: 1593312 - DNA, 19 bp, Homo sapiens
taccgtggatctccttccc

SEQ ID NO: 1593313 - DNA, 21 bp, Homo sapiens
taccgtggatctccttccctt

SEQ ID NO: 1593314 - DNA, 22 bp, Homo sapiens
taccgtggatctccttcccttc

SEQ ID NO: 1593315 - DNA, 13 bp, Homo sapiens
tacctaaaaaaag

SEQ ID NO: 1593316 - DNA, 19 bp, Homo sapiens
tacctaaaaggaaatctca

SEQ ID NO: 1593317 - DNA, 19 bp, Homo sapiens
tacctaaacagatataaat

SEQ ID NO: 1593318 - DNA, 16 bp, Homo sapiens
tacctaagatttctgt

SEQ ID NO: 1593319 - DNA, 12 bp, Homo sapiens
tacctaatctcc

SEQ ID NO: 1593320 - DNA, 18 bp, Homo sapiens
tacctaatttttttcctg

SEQ ID NO: 1593321 - DNA, 14 bp, Homo sapiens
tacctaccagtatt

SEQ ID NO: 1593322 - DNA, 15 bp, Homo sapiens
tacctagctggctct

SEQ ID NO: 1593323 - DNA, 21 bp, Homo sapiens
tacctatcccacctccatccc

SEQ ID NO: 1593324 - DNA, 15 bp, Homo sapiens
tacctatctgtggaa

SEQ ID NO: 1593325 - DNA, 19 bp, Homo sapiens
tacctcaaccatcctggct

SEQ ID NO: 1593326 - DNA, 21 bp, Homo sapiens
tacctcaagccccatttcctc

SEQ ID NO: 1593327 - DNA, 18 bp, Homo sapiens
tacctcaatttttgtttt

SEQ ID NO: 1593328 - DNA, 17 bp, Homo sapiens
tacctcaggcagctcaa

SEQ ID NO: 1593329 - DNA, 13 bp, Homo sapiens
tacctccaccctg

SEQ ID NO: 1593330 - DNA, 14 bp, Homo sapiens
tacctcccacactc

SEQ ID NO: 1593331 - DNA, 15 bp, Homo sapiens
tacctcccacactcc

SEQ ID NO: 1593332 - DNA, 20 bp, Homo sapiens
tacctcccacactcccaagg

SEQ ID NO: 1593333 - DNA, 22 bp, Homo sapiens
tacctcctcacttggctgtctg

SEQ ID NO: 1593334 - DNA, 11 bp, Homo sapiens
tacctcctcct

SEQ ID NO: 1593335 - DNA, 15 bp, Homo sapiens
tacctcctctcagtg

SEQ ID NO: 1593336 - DNA, 19 bp, Homo sapiens
tacctcctctcagtgtttt

SEQ ID NO: 1593337 - DNA, 15 bp, Homo sapiens
tacctcctgcccagg

SEQ ID NO: 1593338 - DNA, 20 bp, Homo sapiens
tacctctaataaacactgtt

SEQ ID NO: 1593339 - DNA, 17 bp, Homo sapiens
tacctctcttatagaat

SEQ ID NO: 1593340 - DNA, 23 bp, Homo sapiens
tacctctcttatagaatatttat

SEQ ID NO: 1593341 - DNA, 17 bp, Homo sapiens
tacctctgaccaacagg

SEQ ID NO: 1593342 - DNA, 13 bp, Homo sapiens
tacctctgagaag

SEQ ID NO: 1593343 - DNA, 17 bp, Homo sapiens
tacctctgagaagacac

SEQ ID NO: 1593344 - DNA, 12 bp, Homo sapiens
tacctcttttgc

SEQ ID NO: 1593345 - DNA, 14 bp, Homo sapiens
tacctgattgtatt

SEQ ID NO: 1593346 - DNA, 12 bp, Homo sapiens
tacctgccctct

SEQ ID NO: 1593347 - DNA, 17 bp, Homo sapiens
tacctgctcagccctgc

SEQ ID NO: 1593348 - DNA, 18 bp, Homo sapiens
tacctgctgccccagctg

SEQ ID NO: 1593349 - DNA, 18 bp, Homo sapiens
tacctggggacttgatgt

SEQ ID NO: 1593350 - DNA, 21 bp, Homo sapiens
tacctgggtccttttcagaag

SEQ ID NO: 1593351 - DNA, 14 bp, Homo sapiens
tacctgtacactga

SEQ ID NO: 1593352 - DNA, 16 bp, Homo sapiens
tacctgtagtgagaaa

SEQ ID NO: 1593353 - DNA, 20 bp, Homo sapiens
tacctgtagtgagaaactga

SEQ ID NO: 1593354 - DNA, 18 bp, Homo sapiens
tacctgtcattttgcact

SEQ ID NO: 1593355 - DNA, 19 bp, Homo sapiens
tactccattactgtgattt

SEQ ID NO: 1593356 - DNA, 21 bp, Homo sapiens
tactccattactgtgatttct

SEQ ID NO: 1593357 - DNA, 14 bp, Homo sapiens
tactcccctgggca

SEQ ID NO: 1593358 - DNA, 21 bp, Homo sapiens
tactcccctgggcatcttctg

SEQ ID NO: 1593359 - DNA, 16 bp, Homo sapiens
tactccctgcagatgc

SEQ ID NO: 1593360 - DNA, 14 bp, Homo sapiens
tactccctgtttta

SEQ ID NO: 1593361 - DNA, 16 bp, Homo sapiens
tactcccttcctggcc

SEQ ID NO: 1593362 - DNA, 18 bp, Homo sapiens
tactcccttcctggcctc

SEQ ID NO: 1593363 - DNA, 23 bp, Homo sapiens
tactccgtgaggctgctgccatc

SEQ ID NO: 1593364 - DNA, 15 bp, Homo sapiens
tactcctagaagaac

SEQ ID NO: 1593365 - DNA, 13 bp, Homo sapiens
tactcctctgcag

SEQ ID NO: 1593366 - DNA, 14 bp, Homo sapiens
tactcctctgcagt

SEQ ID NO: 1593367 - DNA, 16 bp, Homo sapiens
tactcctctgcagtgc

SEQ ID NO: 1593368 - DNA, 16 bp, Homo sapiens
tactcctgcaaaattt

SEQ ID NO: 1593369 - DNA, 19 bp, Homo sapiens
tactcctgtaattcctacc

SEQ ID NO: 1593370 - DNA, 22 bp, Homo sapiens
tactcctgtaattcctacctcc

SEQ ID NO: 1593371 - DNA, 19 bp, Homo sapiens
tactcctgtgctctggagg

SEQ ID NO: 1593372 - DNA, 21 bp, Homo sapiens
tactccttaagaacacaaagc

SEQ ID NO: 1593373 - DNA, 15 bp, Homo sapiens
tactccttgcttcct

SEQ ID NO: 1593374 - DNA, 17 bp, Homo sapiens
tactccttgcttcctga

SEQ ID NO: 1593375 - DNA, 19 bp, Homo sapiens
tactcgagcccacccagca

SEQ ID NO: 1593376 - DNA, 21 bp, Homo sapiens
tactcgatcaaaaccttcctt

SEQ ID NO: 1593377 - DNA, 22 bp, Homo sapiens
tactctaagatcttagattctc

SEQ ID NO: 1593378 - DNA, 16 bp, Homo sapiens
tactctacttacagtt

SEQ ID NO: 1593379 - DNA, 14 bp, Homo sapiens
tactctagaacatg

SEQ ID NO: 1593380 - DNA, 22 bp, Homo sapiens
tactctagaacatgcacattta

SEQ ID NO: 1593381 - DNA, 13 bp, Homo sapiens
tactctccatatc

SEQ ID NO: 1593382 - DNA, 12 bp, Homo sapiens
tactctcccaga

SEQ ID NO: 1593383 - DNA, 13 bp, Homo sapiens
tactctcccagat

SEQ ID NO: 1593384 - DNA, 20 bp, Homo sapiens
tactctcctcggccccctcc

SEQ ID NO: 1593385 - DNA, 22 bp, Homo sapiens
tactctcctggaaatattaaga

SEQ ID NO: 1593386 - DNA, 12 bp, Homo sapiens
tactctgaaggg

SEQ ID NO: 1593387 - DNA, 11 bp, Homo sapiens
tactctgagcc

SEQ ID NO: 1593388 - DNA, 15 bp, Homo sapiens
tactctgctatttct

SEQ ID NO: 1593389 - DNA, 15 bp, Homo sapiens
tactctgtcagatgg

SEQ ID NO: 1593390 - DNA, 15 bp, Homo sapiens
tactctgtgtaatct

SEQ ID NO: 1593391 - DNA, 18 bp, Homo sapiens
tactcttaggaagagaaa

SEQ ID NO: 1593392 - DNA, 21 bp, Homo sapiens
tactcttatgatcaattgtta

SEQ ID NO: 1593393 - DNA, 16 bp, Homo sapiens
tactcttccgatgttt

SEQ ID NO: 1593394 - DNA, 14 bp, Homo sapiens
tactcttcttgaaa

SEQ ID NO: 1593395 - DNA, 17 bp, Homo sapiens
tactcttcttgaaattt

SEQ ID NO: 1593396 - DNA, 16 bp, Homo sapiens
tactcttgaaaggcca

SEQ ID NO: 1593397 - DNA, 16 bp, Homo sapiens
tactcttggtttttat

SEQ ID NO: 1593398 - DNA, 22 bp, Homo sapiens
tactcttgtcatttttaatatt

SEQ ID NO: 1593399 - DNA, 21 bp, Homo sapiens
tactctttatttctagcagag

SEQ ID NO: 1593400 - DNA, 14 bp, Homo sapiens
tactctttttgttt

SEQ ID NO: 1593401 - DNA, 23 bp, Homo sapiens
tactgaaggaaaaacacaagcaa

SEQ ID NO: 1593402 - DNA, 20 bp, Homo sapiens
tactgaagtcttttctgtca

SEQ ID NO: 1593403 - DNA, 16 bp, Homo sapiens
tactgaagtggctggt

SEQ ID NO: 1593404 - DNA, 19 bp, Homo sapiens
tactgaataatatcaaata

SEQ ID NO: 1593405 - DNA, 13 bp, Homo sapiens
tactgaatattaa

SEQ ID NO: 1593406 - DNA, 13 bp, Homo sapiens
tactgaatctgct

SEQ ID NO: 1593407 - DNA, 13 bp, Homo sapiens
tactgaattgtat

SEQ ID NO: 1593408 - DNA, 18 bp, Homo sapiens
tactgaatttttttgtaa

SEQ ID NO: 1593409 - DNA, 19 bp, Homo sapiens
tactgaatttttttgtaat

SEQ ID NO: 1593410 - DNA, 20 bp, Homo sapiens
tactgacatgtggggccagg

SEQ ID NO: 1593411 - DNA, 22 bp, Homo sapiens
tactgacctacctcaaagggca

SEQ ID NO: 1593412 - DNA, 16 bp, Homo sapiens
tactgactttgcttgc

SEQ ID NO: 1593413 - DNA, 17 bp, Homo sapiens
tactgactttgcttgct

SEQ ID NO: 1593414 - DNA, 22 bp, Homo sapiens
tactgactttgcttgctttgaa

SEQ ID NO: 1593415 - DNA, 15 bp, Homo sapiens
tactgagacttggaa

SEQ ID NO: 1593416 - DNA, 18 bp, Homo sapiens
tactgagccttgtaattc

SEQ ID NO: 1593417 - DNA, 22 bp, Homo sapiens
tactgaggatatggacactggt

SEQ ID NO: 1593418 - DNA, 22 bp, Homo sapiens
tactgaggcctaaaagtaaaca

SEQ ID NO: 1593419 - DNA, 15 bp, Homo sapiens
tactgaggtgctatg

SEQ ID NO: 1593420 - DNA, 21 bp, Homo sapiens
tactgatatttatagaacagt

SEQ ID NO: 1593421 - DNA, 12 bp, Homo sapiens
tactgatgaaat

SEQ ID NO: 1593422 - DNA, 14 bp, Homo sapiens
tactgatggaggct

SEQ ID NO: 1593423 - DNA, 16 bp, Homo sapiens
tactgattgggaggtg

SEQ ID NO: 1593424 - DNA, 17 bp, Homo sapiens
tactgattgggaggtgc

SEQ ID NO: 1593425 - DNA, 14 bp, Homo sapiens
tactgattgtttca

SEQ ID NO: 1593426 - DNA, 14 bp, Homo sapiens
tactgatttcagta

SEQ ID NO: 1593427 - DNA, 17 bp, Homo sapiens
tactgatttttgtaaga

SEQ ID NO: 1593428 - DNA, 14 bp, Homo sapiens
tactgcaaatcagg

SEQ ID NO: 1593429 - DNA, 22 bp, Homo sapiens
tactgcaaatcaggcttttgtt

SEQ ID NO: 1593430 - DNA, 13 bp, Homo sapiens
tactgcactcaga

SEQ ID NO: 1593431 - DNA, 16 bp, Homo sapiens
tactgcactcagattt

SEQ ID NO: 1593432 - DNA, 18 bp, Homo sapiens
tactgcactccagcctgg

SEQ ID NO: 1593433 - DNA, 17 bp, Homo sapiens
tactgcactttccccct

SEQ ID NO: 1593434 - DNA, 22 bp, Homo sapiens
tactgcagcctttgcctccccg

SEQ ID NO: 1593435 - DNA, 17 bp, Homo sapiens
tactgcatactttttaa

SEQ ID NO: 1593436 - DNA, 21 bp, Homo sapiens
tactgcatactttttaaatgt

SEQ ID NO: 1593437 - DNA, 19 bp, Homo sapiens
tactgcattttttactttt

SEQ ID NO: 1593438 - DNA, 21 bp, Homo sapiens
tactgccatgtactagtttta

SEQ ID NO: 1593439 - DNA, 20 bp, Homo sapiens
tactgccattcacttcataa

SEQ ID NO: 1593440 - DNA, 15 bp, Homo sapiens
tactgcccacatttg

SEQ ID NO: 1593441 - DNA, 19 bp, Homo sapiens
tactgcccacatttgggct

SEQ ID NO: 1593442 - DNA, 14 bp, Homo sapiens
tactgccctcccct

SEQ ID NO: 1593443 - DNA, 20 bp, Homo sapiens
tactgcgactttctgcctgg

SEQ ID NO: 1593444 - DNA, 22 bp, Homo sapiens
tactgcgactttctgcctggag

SEQ ID NO: 1593445 - DNA, 19 bp, Homo sapiens
tactgctaagtatttccca

SEQ ID NO: 1593446 - DNA, 22 bp, Homo sapiens
tactgctaagtatttcccagca

SEQ ID NO: 1593447 - DNA, 20 bp, Homo sapiens
tactgctacagcaatttcta

SEQ ID NO: 1593448 - DNA, 15 bp, Homo sapiens
tactgctcctgtggc

SEQ ID NO: 1593449 - DNA, 19 bp, Homo sapiens
tactgctcctgtggcagga

SEQ ID NO: 1593450 - DNA, 15 bp, Homo sapiens
tactgctctcctcca

SEQ ID NO: 1593451 - DNA, 13 bp, Homo sapiens
tactgctctgaga

SEQ ID NO: 1593452 - DNA, 22 bp, Homo sapiens
tactgctctttattgcagaatg

SEQ ID NO: 1593453 - DNA, 21 bp, Homo sapiens
tactgcttcccattgagtaat

SEQ ID NO: 1593454 - DNA, 17 bp, Homo sapiens
tactgctttaatcagaa

SEQ ID NO: 1593455 - DNA, 17 bp, Homo sapiens
tactgcttttcattagc

SEQ ID NO: 1593456 - DNA, 19 bp, Homo sapiens
tactggaaaagttagtatt

SEQ ID NO: 1593457 - DNA, 19 bp, Homo sapiens
tactggaaatgtagcactt

SEQ ID NO: 1593458 - DNA, 18 bp, Homo sapiens
tactggaagttttgcatt

SEQ ID NO: 1593459 - DNA, 17 bp, Homo sapiens
tactggaattcttctgc

SEQ ID NO: 1593460 - DNA, 18 bp, Homo sapiens
tactggactcaggaactt

SEQ ID NO: 1593461 - DNA, 11 bp, Homo sapiens
tactggcagct

SEQ ID NO: 1593462 - DNA, 18 bp, Homo sapiens
tactggcttacctcctca

SEQ ID NO: 1593463 - DNA, 17 bp, Homo sapiens
tactgggagtgtgggct

SEQ ID NO: 1593464 - DNA, 17 bp, Homo sapiens
tactggggaggctgagg

SEQ ID NO: 1593465 - DNA, 19 bp, Homo sapiens
tactggggaggctgaggca

SEQ ID NO: 1593466 - DNA, 22 bp, Homo sapiens
tactggggaggctgaggcagga

SEQ ID NO: 1593467 - DNA, 15 bp, Homo sapiens
tactgggttcttgtt

SEQ ID NO: 1593468 - DNA, 18 bp, Homo sapiens
tactggtcttgtggaatt

SEQ ID NO: 1593469 - DNA, 13 bp, Homo sapiens
tactggttatagt

SEQ ID NO: 1593470 - DNA, 23 bp, Homo sapiens
tactggtttccccagggaaggaa

SEQ ID NO: 1593471 - DNA, 11 bp, Homo sapiens
tactgtaaatt

SEQ ID NO: 1593472 - DNA, 13 bp, Homo sapiens
tactgtaaatttt

SEQ ID NO: 1593473 - DNA, 21 bp, Homo sapiens
tactgtaatgggtaattctga

SEQ ID NO: 1593474 - DNA, 14 bp, Homo sapiens
tactgtagtattct

SEQ ID NO: 1593475 - DNA, 13 bp, Homo sapiens
tactgtatatgta

SEQ ID NO: 1593476 - DNA, 12 bp, Homo sapiens
tactgtcctcag

SEQ ID NO: 1593477 - DNA, 19 bp, Homo sapiens
tactgtctattaatattca

SEQ ID NO: 1593478 - DNA, 14 bp, Homo sapiens
tactgtctcactga

SEQ ID NO: 1593479 - DNA, 22 bp, Homo sapiens
tactgtctcactgaaacattta

SEQ ID NO: 1593480 - DNA, 20 bp, Homo sapiens
tactgtctgcttctctctct

SEQ ID NO: 1593481 - DNA, 13 bp, Homo sapiens
tactgtgaaatac

SEQ ID NO: 1593482 - DNA, 16 bp, Homo sapiens
tactgtgaagagaatg

SEQ ID NO: 1593483 - DNA, 22 bp, Homo sapiens
tactgtgaagagaatgtattct

SEQ ID NO: 1593484 - DNA, 14 bp, Homo sapiens
tactgtgatttctg

SEQ ID NO: 1593485 - DNA, 13 bp, Homo sapiens
tactgtgtaatta

SEQ ID NO: 1593486 - DNA, 13 bp, Homo sapiens
tactgtgtgccag

SEQ ID NO: 1593487 - DNA, 13 bp, Homo sapiens
tactgtgttccaa

SEQ ID NO: 1593488 - DNA, 17 bp, Homo sapiens
tactgttactgggccct

SEQ ID NO: 1593489 - DNA, 16 bp, Homo sapiens
tactgttatctatctg

SEQ ID NO: 1593490 - DNA, 16 bp, Homo sapiens
tactgttattctttgc

SEQ ID NO: 1593491 - DNA, 17 bp, Homo sapiens
tactgttattctttgca

SEQ ID NO: 1593492 - DNA, 13 bp, Homo sapiens
tactgttctaaag

SEQ ID NO: 1593493 - DNA, 16 bp, Homo sapiens
tactgttctgtgtctt

SEQ ID NO: 1593494 - DNA, 11 bp, Homo sapiens
tactgttgaac

SEQ ID NO: 1593495 - DNA, 16 bp, Homo sapiens
tactgttgtaagaatt

SEQ ID NO: 1593496 - DNA, 15 bp, Homo sapiens
tactgtttgtaatat

SEQ ID NO: 1593497 - DNA, 22 bp, Homo sapiens
tactgtttgtaatatacagttt

SEQ ID NO: 1593498 - DNA, 16 bp, Homo sapiens
tactgttttaattgta

SEQ ID NO: 1593499 - DNA, 19 bp, Homo sapiens
tactgttttaattgtagtt

SEQ ID NO: 1593500 - DNA, 23 bp, Homo sapiens
tacttaaaaatagtcttccacaa

SEQ ID NO: 1593501 - DNA, 14 bp, Homo sapiens
tacttaaaatatct

SEQ ID NO: 1593502 - DNA, 18 bp, Homo sapiens
tacttaaatgaaagcatg

SEQ ID NO: 1593503 - DNA, 20 bp, Homo sapiens
tacttaaatggaaaaaatga

SEQ ID NO: 1593504 - DNA, 18 bp, Homo sapiens
tacttaaatgttatgtat

SEQ ID NO: 1593505 - DNA, 19 bp, Homo sapiens
tacttaacacgtgaatatt

SEQ ID NO: 1593506 - DNA, 13 bp, Homo sapiens
tacttaactattc

SEQ ID NO: 1593507 - DNA, 22 bp, Homo sapiens
tacttaagtttgtaagacagtg

SEQ ID NO: 1593508 - DNA, 17 bp, Homo sapiens
tacttaataaattcaga

SEQ ID NO: 1593509 - DNA, 18 bp, Homo sapiens
tacttaattcagtctcag

SEQ ID NO: 1593510 - DNA, 17 bp, Homo sapiens
tacttagattgtgttcc

SEQ ID NO: 1593511 - DNA, 19 bp, Homo sapiens
tacttagccagttcaaagt

SEQ ID NO: 1593512 - DNA, 21 bp, Homo sapiens
tacttagccagttcaaagtgt

SEQ ID NO: 1593513 - DNA, 21 bp, Homo sapiens
tacttaggttattttgctttg

SEQ ID NO: 1593514 - DNA, 14 bp, Homo sapiens
tacttataaagaag

SEQ ID NO: 1593515 - DNA, 20 bp, Homo sapiens
tacttatcatccacattgtt

SEQ ID NO: 1593516 - DNA, 13 bp, Homo sapiens
tacttatccctgc

SEQ ID NO: 1593517 - DNA, 15 bp, Homo sapiens
tacttatctctcaaa

SEQ ID NO: 1593518 - DNA, 21 bp, Homo sapiens
tacttatgatttaaaaacaac

SEQ ID NO: 1593519 - DNA, 18 bp, Homo sapiens
tacttatgcaagatattt

SEQ ID NO: 1593520 - DNA, 14 bp, Homo sapiens
tacttattactgct

SEQ ID NO: 1593521 - DNA, 18 bp, Homo sapiens
tacttatttgtatatggt

SEQ ID NO: 1593522 - DNA, 21 bp, Homo sapiens
tacttattttattttttacca

SEQ ID NO: 1593523 - DNA, 13 bp, Homo sapiens
tacttattttctg

SEQ ID NO: 1593524 - DNA, 21 bp, Homo sapiens
tacttattttctgttcagatt

SEQ ID NO: 1593525 - DNA, 19 bp, Homo sapiens
tacttcaggtgcttttgat

SEQ ID NO: 1593526 - DNA, 23 bp, Homo sapiens
tacttccataggacatactgcat

SEQ ID NO: 1593527 - DNA, 17 bp, Homo sapiens
tacttcccaaagccctt

SEQ ID NO: 1593528 - DNA, 19 bp, Homo sapiens
tacttcccgggccagggct

SEQ ID NO: 1593529 - DNA, 14 bp, Homo sapiens
tacttcccttcctc

SEQ ID NO: 1593530 - DNA, 14 bp, Homo sapiens
tacttcctcctccc

SEQ ID NO: 1593531 - DNA, 14 bp, Homo sapiens
tacttcctggattt

SEQ ID NO: 1593532 - DNA, 16 bp, Homo sapiens
tacttcgatgatgatg

SEQ ID NO: 1593533 - DNA, 18 bp, Homo sapiens
tacttctcccctgggtcc

SEQ ID NO: 1593534 - DNA, 16 bp, Homo sapiens
tacttctgactttact

SEQ ID NO: 1593535 - DNA, 18 bp, Homo sapiens
tacttctgactttacttg

SEQ ID NO: 1593536 - DNA, 20 bp, Homo sapiens
tacttctgactttacttgtg

SEQ ID NO: 1593537 - DNA, 13 bp, Homo sapiens
tacttctgaggta

SEQ ID NO: 1593538 - DNA, 18 bp, Homo sapiens
tacttctgggaaaaacaa

SEQ ID NO: 1593539 - DNA, 17 bp, Homo sapiens
tacttctgtaattgtgt

SEQ ID NO: 1593540 - DNA, 16 bp, Homo sapiens
tacttctgtgttcatt

SEQ ID NO: 1593541 - DNA, 14 bp, Homo sapiens
tacttcttatacat

SEQ ID NO: 1593542 - DNA, 15 bp, Homo sapiens
tacttcttatacatt

SEQ ID NO: 1593543 - DNA, 14 bp, Homo sapiens
tacttcttattgca

SEQ ID NO: 1593544 - DNA, 18 bp, Homo sapiens
tacttcttcattcaatac

SEQ ID NO: 1593545 - DNA, 14 bp, Homo sapiens
tacttcttgaaggt

SEQ ID NO: 1593546 - DNA, 13 bp, Homo sapiens
tacttcttgaata

SEQ ID NO: 1593547 - DNA, 20 bp, Homo sapiens
tacttcttgaatataaaaaa

SEQ ID NO: 1593548 - DNA, 21 bp, Homo sapiens
tacttcttgaatataaaaaat

SEQ ID NO: 1593549 - DNA, 22 bp, Homo sapiens
tacttcttttttcaaaagaaag

SEQ ID NO: 1593550 - DNA, 14 bp, Homo sapiens
tacttgaagggcca

SEQ ID NO: 1593551 - DNA, 21 bp, Homo sapiens
tacttgaagggccagagccag

SEQ ID NO: 1593552 - DNA, 22 bp, Homo sapiens
tacttgaagggccagagccagg

SEQ ID NO: 1593553 - DNA, 15 bp, Homo sapiens
tacttgactcattta

SEQ ID NO: 1593554 - DNA, 17 bp, Homo sapiens
tacttgactcatttaaa

SEQ ID NO: 1593555 - DNA, 21 bp, Homo sapiens
tacttgaggaaaacactattt

SEQ ID NO: 1593556 - DNA, 16 bp, Homo sapiens
tacttgataagggact

SEQ ID NO: 1593557 - DNA, 14 bp, Homo sapiens
tacttgcactcttc

SEQ ID NO: 1593558 - DNA, 15 bp, Homo sapiens
tacttgccaagcagt

SEQ ID NO: 1593559 - DNA, 14 bp, Homo sapiens
tacttgcctcattt

SEQ ID NO: 1593560 - DNA, 15 bp, Homo sapiens
tacttgcgatttttt

SEQ ID NO: 1593561 - DNA, 17 bp, Homo sapiens
tacttgcttcagtggac

SEQ ID NO: 1593562 - DNA, 16 bp, Homo sapiens
tacttggaactaggct

SEQ ID NO: 1593563 - DNA, 20 bp, Homo sapiens
tacttggctgcttcctgtga

SEQ ID NO: 1593564 - DNA, 14 bp, Homo sapiens
tacttggtttgtgt

SEQ ID NO: 1593565 - DNA, 14 bp, Homo sapiens
tacttgtctgaggc

SEQ ID NO: 1593566 - DNA, 15 bp, Homo sapiens
tacttgtctgaggcc

SEQ ID NO: 1593567 - DNA, 20 bp, Homo sapiens
tacttgtgaaacacagctgt

SEQ ID NO: 1593568 - DNA, 21 bp, Homo sapiens
tacttgtgaaacacagctgtt

SEQ ID NO: 1593569 - DNA, 17 bp, Homo sapiens
tacttgtgactgaaggg

SEQ ID NO: 1593570 - DNA, 14 bp, Homo sapiens
tacttgtggtgtga

SEQ ID NO: 1593571 - DNA, 18 bp, Homo sapiens
tacttgtggtgtgaccat

SEQ ID NO: 1593572 - DNA, 15 bp, Homo sapiens
tacttgtttttgtaa

SEQ ID NO: 1593573 - DNA, 17 bp, Homo sapiens
tactttaaaaaggaaat

SEQ ID NO: 1593574 - DNA, 23 bp, Homo sapiens
tactttaaaaaggaaatttgttt

SEQ ID NO: 1593575 - DNA, 23 bp, Homo sapiens
tactttaacttagttttgcatag

SEQ ID NO: 1593576 - DNA, 14 bp, Homo sapiens
tactttaagtgata

SEQ ID NO: 1593577 - DNA, 22 bp, Homo sapiens
tactttaattactggaattctt

SEQ ID NO: 1593578 - DNA, 17 bp, Homo sapiens
tactttaattcatgaag

SEQ ID NO: 1593579 - DNA, 21 bp, Homo sapiens
tactttagaagcctgcataat

SEQ ID NO: 1593580 - DNA, 19 bp, Homo sapiens
tactttagccatcataact

SEQ ID NO: 1593581 - DNA, 23 bp, Homo sapiens
tactttagttagcatgcgcgctg

SEQ ID NO: 1593582 - DNA, 19 bp, Homo sapiens
tactttataactaacatgt

SEQ ID NO: 1593583 - DNA, 16 bp, Homo sapiens
tagaatctagaaatgt

SEQ ID NO: 1593584 - DNA, 12 bp, Homo sapiens
tagaatgatcta

SEQ ID NO: 1593585 - DNA, 17 bp, Homo sapiens
tagaatgatctattgct

SEQ ID NO: 1593586 - DNA, 18 bp, Homo sapiens
tagaatgatctattgctc

SEQ ID NO: 1593587 - DNA, 17 bp, Homo sapiens
tagaatgatgttttaaa

SEQ ID NO: 1593588 - DNA, 18 bp, Homo sapiens
tagaatgatgttttaaaa

SEQ ID NO: 1593589 - DNA, 15 bp, Homo sapiens
tagaatgattaatca

SEQ ID NO: 1593590 - DNA, 16 bp, Homo sapiens
tagaatgatttcatgc

SEQ ID NO: 1593591 - DNA, 19 bp, Homo sapiens
tagaatgcatctcatcaac

SEQ ID NO: 1593592 - DNA, 23 bp, Homo sapiens
tagaatggagggcaacattccac

SEQ ID NO: 1593593 - DNA, 15 bp, Homo sapiens
tagaatggtgatttt

SEQ ID NO: 1593594 - DNA, 16 bp, Homo sapiens
tagaatggtgatttta

SEQ ID NO: 1593595 - DNA, 20 bp, Homo sapiens
tagaatggtgattttaaatg

SEQ ID NO: 1593596 - DNA, 15 bp, Homo sapiens
tagaatgtaaagtta

SEQ ID NO: 1593597 - DNA, 21 bp, Homo sapiens
tagaatgtagtttgaggaaat

SEQ ID NO: 1593598 - DNA, 15 bp, Homo sapiens
tagaatgtcagattt

SEQ ID NO: 1593599 - DNA, 19 bp, Homo sapiens
tagaatgtcagatttctgg

SEQ ID NO: 1593600 - DNA, 13 bp, Homo sapiens
tagaattaccatt

SEQ ID NO: 1593601 - DNA, 16 bp, Homo sapiens
tagaattagtatgtct

SEQ ID NO: 1593602 - DNA, 15 bp, Homo sapiens
tagaattatttaaac

SEQ ID NO: 1593603 - DNA, 17 bp, Homo sapiens
tagaattccttcgaaag

SEQ ID NO: 1593604 - DNA, 18 bp, Homo sapiens
tagaattctagtgctgct

SEQ ID NO: 1593605 - DNA, 16 bp, Homo sapiens
tagaattgaaaatgca

SEQ ID NO: 1593606 - DNA, 23 bp, Homo sapiens
tagaattgctggatgcattttta

SEQ ID NO: 1593607 - DNA, 20 bp, Homo sapiens
tagaatttattcaattcctc

SEQ ID NO: 1593608 - DNA, 23 bp, Homo sapiens
tagaatttattcaattcctctgg

SEQ ID NO: 1593609 - DNA, 22 bp, Homo sapiens
tagaattttatatcattggatg

SEQ ID NO: 1593610 - DNA, 15 bp, Homo sapiens
tagaatttttaccca

SEQ ID NO: 1593611 - DNA, 13 bp, Homo sapiens
tagacaaaatcaa

SEQ ID NO: 1593612 - DNA, 18 bp, Homo sapiens
tagacaactagatttgtc

SEQ ID NO: 1593613 - DNA, 17 bp, Homo sapiens
tagacaagatattgtac

SEQ ID NO: 1593614 - DNA, 21 bp, Homo sapiens
tagacacaatttcatttccag

SEQ ID NO: 1593615 - DNA, 17 bp, Homo sapiens
tagacaccaaagttcta

SEQ ID NO: 1593616 - DNA, 15 bp, Homo sapiens
tagacactttggaag

SEQ ID NO: 1593617 - DNA, 18 bp, Homo sapiens
tagacagaaaccaagcca

SEQ ID NO: 1593618 - DNA, 18 bp, Homo sapiens
tagacagatatttcaaac

SEQ ID NO: 1593619 - DNA, 12 bp, Homo sapiens
tagacatgaaag

SEQ ID NO: 1593620 - DNA, 20 bp, Homo sapiens
tagacatggaggttctaagg

SEQ ID NO: 1593621 - DNA, 22 bp, Homo sapiens
tagacatggaggttctaaggcc

SEQ ID NO: 1593622 - DNA, 21 bp, Homo sapiens
tagacatttgctatgagctgg

SEQ ID NO: 1593623 - DNA, 23 bp, Homo sapiens
tagacatttgtgtggaaatcata

SEQ ID NO: 1593624 - DNA, 20 bp, Homo sapiens
tagacattttggggttttat

SEQ ID NO: 1593625 - DNA, 20 bp, Homo sapiens
tagaccaaagcaaagaaaat

SEQ ID NO: 1593626 - DNA, 14 bp, Homo sapiens
tagaccaagcttgt

SEQ ID NO: 1593627 - DNA, 20 bp, Homo sapiens
tagacccaggtggagggcac

SEQ ID NO: 1593628 - DNA, 21 bp, Homo sapiens
tagacccaggtggagggcaca

SEQ ID NO: 1593629 - DNA, 22 bp, Homo sapiens
tagacccaggtggagggcacag

SEQ ID NO: 1593630 - DNA, 18 bp, Homo sapiens
tagaccctctttcttgtt

SEQ ID NO: 1593631 - DNA, 16 bp, Homo sapiens
tagaccctgggtgggc

SEQ ID NO: 1593632 - DNA, 11 bp, Homo sapiens
tagacctcagc

SEQ ID NO: 1593633 - DNA, 15 bp, Homo sapiens
tagacgcccctccca

SEQ ID NO: 1593634 - DNA, 20 bp, Homo sapiens
tagacgcccctcccaagcgt

SEQ ID NO: 1593635 - DNA, 13 bp, Homo sapiens
tagacgggttgaa

SEQ ID NO: 1593636 - DNA, 17 bp, Homo sapiens
tagacgggttgaaagac

SEQ ID NO: 1593637 - DNA, 19 bp, Homo sapiens
tagacgggttgaaagacat

SEQ ID NO: 1593638 - DNA, 21 bp, Homo sapiens
tagacgggttgaaagacatca

SEQ ID NO: 1593639 - DNA, 22 bp, Homo sapiens
tagacgggttgaaagacatcaa

SEQ ID NO: 1593640 - DNA, 13 bp, Homo sapiens
tagacggtgctca

SEQ ID NO: 1593641 - DNA, 21 bp, Homo sapiens
tagactagcaatctcttcatt

SEQ ID NO: 1593642 - DNA, 19 bp, Homo sapiens
tagactcatcttactgtac

SEQ ID NO: 1593643 - DNA, 14 bp, Homo sapiens
tagactcctcagga

SEQ ID NO: 1593644 - DNA, 16 bp, Homo sapiens
tagactgaatttaact

SEQ ID NO: 1593645 - DNA, 20 bp, Homo sapiens
tagactgaggtataaagaca

SEQ ID NO: 1593646 - DNA, 17 bp, Homo sapiens
tagactggagtgaggct

SEQ ID NO: 1593647 - DNA, 23 bp, Homo sapiens
tagactggagtgaggcttccagg

SEQ ID NO: 1593648 - DNA, 13 bp, Homo sapiens
tagactggcctag

SEQ ID NO: 1593649 - DNA, 15 bp, Homo sapiens
tagacttatagtcct

SEQ ID NO: 1593650 - DNA, 16 bp, Homo sapiens
tagacttcctttataa

SEQ ID NO: 1593651 - DNA, 19 bp, Homo sapiens
tagacttcctttataatat

SEQ ID NO: 1593652 - DNA, 20 bp, Homo sapiens
tagacttcctttataatatt

SEQ ID NO: 1593653 - DNA, 21 bp, Homo sapiens
tagacttcctttataatattt

SEQ ID NO: 1593654 - DNA, 20 bp, Homo sapiens
tagacttcgactcaggatcc

SEQ ID NO: 1593655 - DNA, 22 bp, Homo sapiens
tagacttcgactcaggatccag

SEQ ID NO: 1593656 - DNA, 19 bp, Homo sapiens
tagacttgcaccttatgtc

SEQ ID NO: 1593657 - DNA, 19 bp, Homo sapiens
tagactttagaaataaatg

SEQ ID NO: 1593658 - DNA, 12 bp, Homo sapiens
tagactttgctt

SEQ ID NO: 1593659 - DNA, 20 bp, Homo sapiens
tagacttttccaatatgtga

SEQ ID NO: 1593660 - DNA, 16 bp, Homo sapiens
tagagaagcaagtaaa

SEQ ID NO: 1593661 - DNA, 22 bp, Homo sapiens
tagagaaggacccggaggggcc

SEQ ID NO: 1593662 - DNA, 18 bp, Homo sapiens
tagagaatgtgtttcaaa

SEQ ID NO: 1593663 - DNA, 15 bp, Homo sapiens
tagagacccccaggc

SEQ ID NO: 1593664 - DNA, 16 bp, Homo sapiens
tagagacggagatcct

SEQ ID NO: 1593665 - DNA, 12 bp, Homo sapiens
tagagagcctgt

SEQ ID NO: 1593666 - DNA, 14 bp, Homo sapiens
tagagagcctgtca

SEQ ID NO: 1593667 - DNA, 19 bp, Homo sapiens
tagagagcctgtcaccaga

SEQ ID NO: 1593668 - DNA, 16 bp, Homo sapiens
tagagagccttaactt

SEQ ID NO: 1593669 - DNA, 19 bp, Homo sapiens
tagagagccttaacttctt

SEQ ID NO: 1593670 - DNA, 13 bp, Homo sapiens
tagagaggcccgc

SEQ ID NO: 1593671 - DNA, 23 bp, Homo sapiens
tagagaggcgttagtgggcaggt

SEQ ID NO: 1593672 - DNA, 16 bp, Homo sapiens
tagagatcatgaatta

SEQ ID NO: 1593673 - DNA, 17 bp, Homo sapiens
tagagatggagtttgct

SEQ ID NO: 1593674 - DNA, 20 bp, Homo sapiens
tagagattgcatttttatta

SEQ ID NO: 1593675 - DNA, 13 bp, Homo sapiens
tagagcaatgttg

SEQ ID NO: 1593676 - DNA, 12 bp, Homo sapiens
tagagcagaaat

SEQ ID NO: 1593677 - DNA, 13 bp, Homo sapiens
tagagcatatttg

SEQ ID NO: 1593678 - DNA, 17 bp, Homo sapiens
tagagccgaggggagag

SEQ ID NO: 1593679 - DNA, 21 bp, Homo sapiens
tagagccgaggggagagaggg

SEQ ID NO: 1593680 - DNA, 22 bp, Homo sapiens
tagagccgaggggagagaggga

SEQ ID NO: 1593681 - DNA, 14 bp, Homo sapiens
tagagctgatccag

SEQ ID NO: 1593682 - DNA, 12 bp, Homo sapiens
tagagctgccac

SEQ ID NO: 1593683 - DNA, 18 bp, Homo sapiens
tagagctgccactgggca

SEQ ID NO: 1593684 - DNA, 20 bp, Homo sapiens
tagagctttttaatagcact

SEQ ID NO: 1593685 - DNA, 17 bp, Homo sapiens
tagaggaaaaaaatgac

SEQ ID NO: 1593686 - DNA, 18 bp, Homo sapiens
tagaggaaaaaaatgact

SEQ ID NO: 1593687 - DNA, 12 bp, Homo sapiens
tagaggaaaatg

SEQ ID NO: 1593688 - DNA, 18 bp, Homo sapiens
tatactgggttcttgttt

SEQ ID NO: 1593689 - DNA, 16 bp, Homo sapiens
tatactgtacttaata

SEQ ID NO: 1593690 - DNA, 22 bp, Homo sapiens
tatactgtgtgggatacttagt

SEQ ID NO: 1593691 - DNA, 22 bp, Homo sapiens
tatacttaaatggaaaaaatga

SEQ ID NO: 1593692 - DNA, 17 bp, Homo sapiens
tatacttatcacatttt

SEQ ID NO: 1593693 - DNA, 21 bp, Homo sapiens
tatacttccttacttttaagg

SEQ ID NO: 1593694 - DNA, 22 bp, Homo sapiens
tatacttgtttttgtaaagaaa

SEQ ID NO: 1593695 - DNA, 19 bp, Homo sapiens
tatactttagtagacattt

SEQ ID NO: 1593696 - DNA, 23 bp, Homo sapiens
tatactttggttggcagcattcc

SEQ ID NO: 1593697 - DNA, 18 bp, Homo sapiens
tatactttgttctgttgt

SEQ ID NO: 1593698 - DNA, 22 bp, Homo sapiens
tatagaaaaataaaaatctctt

SEQ ID NO: 1593699 - DNA, 12 bp, Homo sapiens
tatagaaagata

SEQ ID NO: 1593700 - DNA, 14 bp, Homo sapiens
tatagaaagctgtt

SEQ ID NO: 1593701 - DNA, 19 bp, Homo sapiens
tatagaaagctgtttattt

SEQ ID NO: 1593702 - DNA, 18 bp, Homo sapiens
tatagaacacaagggata

SEQ ID NO: 1593703 - DNA, 19 bp, Homo sapiens
tatagaataaaagctataa

SEQ ID NO: 1593704 - DNA, 13 bp, Homo sapiens
tatagacaaaaga

SEQ ID NO: 1593705 - DNA, 11 bp, Homo sapiens
tatagactcta

SEQ ID NO: 1593706 - DNA, 23 bp, Homo sapiens
tatagagagggggctctccaaag

SEQ ID NO: 1593707 - DNA, 21 bp, Homo sapiens
tatagagataagataaatgaa

SEQ ID NO: 1593708 - DNA, 15 bp, Homo sapiens
tatagagcagaaatt

SEQ ID NO: 1593709 - DNA, 18 bp, Homo sapiens
tatagatacaaaaccttg

SEQ ID NO: 1593710 - DNA, 23 bp, Homo sapiens
tatagatcactgccctttttgaa

SEQ ID NO: 1593711 - DNA, 16 bp, Homo sapiens
tatagattataacttg

SEQ ID NO: 1593712 - DNA, 13 bp, Homo sapiens
tatagattctaaa

SEQ ID NO: 1593713 - DNA, 15 bp, Homo sapiens
tatagattctaaaga

SEQ ID NO: 1593714 - DNA, 17 bp, Homo sapiens
tatagatttagctattt

SEQ ID NO: 1593715 - DNA, 19 bp, Homo sapiens
tatagatttagctatttat

SEQ ID NO: 1593716 - DNA, 21 bp, Homo sapiens
tatagcctatggcagaaaaaa

SEQ ID NO: 1593717 - DNA, 14 bp, Homo sapiens
tatagcctggactg

SEQ ID NO: 1593718 - DNA, 15 bp, Homo sapiens
tatagcttgcagaac

SEQ ID NO: 1593719 - DNA, 18 bp, Homo sapiens
tataggatattgctaatt

SEQ ID NO: 1593720 - DNA, 15 bp, Homo sapiens
tataggcagttgcat

SEQ ID NO: 1593721 - DNA, 21 bp, Homo sapiens
tataggcctgtcccttgcctc

SEQ ID NO: 1593722 - DNA, 14 bp, Homo sapiens
tataggtcactcct

SEQ ID NO: 1593723 - DNA, 23 bp, Homo sapiens
tataggtcctgtgttaaacacta

SEQ ID NO: 1593724 - DNA, 17 bp, Homo sapiens
tataggtgatgtttgct

SEQ ID NO: 1593725 - DNA, 23 bp, Homo sapiens
tagaggcttctccgccagcctcc

SEQ ID NO: 1593726 - DNA, 22 bp, Homo sapiens
tagaggggaaggaaatctcctc

SEQ ID NO: 1593727 - DNA, 15 bp, Homo sapiens
tagaggtataattgt

SEQ ID NO: 1593728 - DNA, 16 bp, Homo sapiens
tagaggtataattgtg

SEQ ID NO: 1593729 - DNA, 19 bp, Homo sapiens
tagaggtcctctggagccc

SEQ ID NO: 1593730 - DNA, 23 bp, Homo sapiens
tagaggtgttacagaggaccctt

SEQ ID NO: 1593731 - DNA, 19 bp, Homo sapiens
tagaggttttaaagtgatt

SEQ ID NO: 1593732 - DNA, 16 bp, Homo sapiens
tagagtatttcccttc

SEQ ID NO: 1593733 - DNA, 22 bp, Homo sapiens
tagagtcatctccatcagctgt

SEQ ID NO: 1593734 - DNA, 16 bp, Homo sapiens
tagagtcattgtaatg

SEQ ID NO: 1593735 - DNA, 21 bp, Homo sapiens
tagagtcattgtaatgttgtg

SEQ ID NO: 1593736 - DNA, 13 bp, Homo sapiens
tagagtccaaggt

SEQ ID NO: 1593737 - DNA, 13 bp, Homo sapiens
tagagtcctcact

SEQ ID NO: 1593738 - DNA, 20 bp, Homo sapiens
tagagtcctcactcccagtc

SEQ ID NO: 1593739 - DNA, 11 bp, Homo sapiens
tagagtgtagc

SEQ ID NO: 1593740 - DNA, 13 bp, Homo sapiens
tagagtgtagcct

SEQ ID NO: 1593741 - DNA, 23 bp, Homo sapiens
tagagtgtagcctaaagggcagg

SEQ ID NO: 1593742 - DNA, 15 bp, Homo sapiens
tagagtgtagctgta

SEQ ID NO: 1593743 - DNA, 21 bp, Homo sapiens
tagagtgtagctgtaagggca

SEQ ID NO: 1593744 - DNA, 17 bp, Homo sapiens
tagagttcttctttctt

SEQ ID NO: 1593745 - DNA, 23 bp, Homo sapiens
tagagttgattgtctagtgagga

SEQ ID NO: 1593746 - DNA, 12 bp, Homo sapiens
tagagttgctga

SEQ ID NO: 1593747 - DNA, 17 bp, Homo sapiens
tagataaacacaggcag

SEQ ID NO: 1593748 - DNA, 15 bp, Homo sapiens
tagataaactcagaa

SEQ ID NO: 1593749 - DNA, 15 bp, Homo sapiens
tagataatttacaag

SEQ ID NO: 1593750 - DNA, 16 bp, Homo sapiens
tagatacaaaaccttg

SEQ ID NO: 1593751 - DNA, 16 bp, Homo sapiens
tagatacgaaatcagt

SEQ ID NO: 1593752 - DNA, 14 bp, Homo sapiens
tagatactggaaac

SEQ ID NO: 1593753 - DNA, 19 bp, Homo sapiens
tagatatagagtcattgta

SEQ ID NO: 1593754 - DNA, 15 bp, Homo sapiens
tagatatataaataa

SEQ ID NO: 1593755 - DNA, 23 bp, Homo sapiens
tagatatcgacttgtttttgcac

SEQ ID NO: 1593756 - DNA, 21 bp, Homo sapiens
tagatatttttcataaacaag

SEQ ID NO: 1593757 - DNA, 18 bp, Homo sapiens
tagatcaaatagttgcat

SEQ ID NO: 1593758 - DNA, 16 bp, Homo sapiens
tagatcacatcttaaa

SEQ ID NO: 1593759 - DNA, 23 bp, Homo sapiens
tagatcacctcctcgaacccact

SEQ ID NO: 1593760 - DNA, 19 bp, Homo sapiens
tagatcccatgtcacctca

SEQ ID NO: 1593761 - DNA, 22 bp, Homo sapiens
tagatcccatgtcacctcagct

SEQ ID NO: 1593762 - DNA, 17 bp, Homo sapiens
tagatcctaagatgtgt

SEQ ID NO: 1593763 - DNA, 21 bp, Homo sapiens
tagatcctaagatgtgttctt

SEQ ID NO: 1593764 - DNA, 18 bp, Homo sapiens
tagatcgcttgagcccag

SEQ ID NO: 1593765 - DNA, 13 bp, Homo sapiens
tagatctccagcg

SEQ ID NO: 1593766 - DNA, 21 bp, Homo sapiens
tagatgacataaaatttacat

SEQ ID NO: 1593767 - DNA, 22 bp, Homo sapiens
tagatgacataaaatttacatt

SEQ ID NO: 1593768 - DNA, 22 bp, Homo sapiens
tagatgagtgggaggcgtgccc

SEQ ID NO: 1593769 - DNA, 19 bp, Homo sapiens
tagatgattaaataagatt

SEQ ID NO: 1593770 - DNA, 18 bp, Homo sapiens
tagatgattttttgaaag

SEQ ID NO: 1593771 - DNA, 22 bp, Homo sapiens
tagatgattttttgaaagttaa

SEQ ID NO: 1593772 - DNA, 20 bp, Homo sapiens
tagatgcacgtggggcccac

SEQ ID NO: 1593773 - DNA, 10 bp, Homo sapiens
tagatgctga

SEQ ID NO: 1593774 - DNA, 14 bp, Homo sapiens
tagatgctgactgt

SEQ ID NO: 1593775 - DNA, 17 bp, Homo sapiens
tagatgctgaggcccct

SEQ ID NO: 1593776 - DNA, 23 bp, Homo sapiens
tagatggaatggaaaagcaactt

SEQ ID NO: 1593777 - DNA, 19 bp, Homo sapiens
tagatggtttgagcctgag

SEQ ID NO: 1593778 - DNA, 23 bp, Homo sapiens
tagatgtatttttgatgtatata

SEQ ID NO: 1593779 - DNA, 18 bp, Homo sapiens
tagatgtccctttcttgg

SEQ ID NO: 1593780 - DNA, 23 bp, Homo sapiens
tagatgtccctttcttggccagt

SEQ ID NO: 1593781 - DNA, 21 bp, Homo sapiens
tagatgtctttaggcagcagc

SEQ ID NO: 1593782 - DNA, 12 bp, Homo sapiens
tagatgtgatta

SEQ ID NO: 1593783 - DNA, 16 bp, Homo sapiens
tagatgtgattaacat

SEQ ID NO: 1593784 - DNA, 11 bp, Homo sapiens
tagatgtgtgg

SEQ ID NO: 1593785 - DNA, 15 bp, Homo sapiens
tagatgttcttttct

SEQ ID NO: 1593786 - DNA, 20 bp, Homo sapiens
tagatgtttattcttctaga

SEQ ID NO: 1593787 - DNA, 16 bp, Homo sapiens
tagattaatggcactg

SEQ ID NO: 1593788 - DNA, 18 bp, Homo sapiens
tagattaatggcactgat

SEQ ID NO: 1593789 - DNA, 14 bp, Homo sapiens
tagattatgtcttt

SEQ ID NO: 1593790 - DNA, 14 bp, Homo sapiens
tagattattataaa

SEQ ID NO: 1593791 - DNA, 18 bp, Homo sapiens
tagattattataaactat

SEQ ID NO: 1593792 - DNA, 17 bp, Homo sapiens
tagattcaaaggttcta

SEQ ID NO: 1593793 - DNA, 21 bp, Homo sapiens
tagattccattggtccaagat

SEQ ID NO: 1593794 - DNA, 15 bp, Homo sapiens
tagattcgctgtccc

SEQ ID NO: 1593795 - DNA, 18 bp, Homo sapiens
tagattcgctgtcccctc

SEQ ID NO: 1593796 - DNA, 21 bp, Homo sapiens
tagattcgctgtcccctcagc

SEQ ID NO: 1593797 - DNA, 12 bp, Homo sapiens
tagattctaaag

SEQ ID NO: 1593798 - DNA, 13 bp, Homo sapiens
tagattctaaaga

SEQ ID NO: 1593799 - DNA, 14 bp, Homo sapiens
tagattctaaagat

SEQ ID NO: 1593800 - DNA, 22 bp, Homo sapiens
tagattctctgtgtctaagatt

SEQ ID NO: 1593801 - DNA, 20 bp, Homo sapiens
tagattgaaaacttttctca

SEQ ID NO: 1593802 - DNA, 13 bp, Homo sapiens
tagattgcaaagc

SEQ ID NO: 1593803 - DNA, 13 bp, Homo sapiens
tagatttggaata

SEQ ID NO: 1593804 - DNA, 13 bp, Homo sapiens
tagatttgggaga

SEQ ID NO: 1593805 - DNA, 13 bp, Homo sapiens
tagatttgtcctt

SEQ ID NO: 1593806 - DNA, 23 bp, Homo sapiens
tagatttgtccttttatttctcc

SEQ ID NO: 1593807 - DNA, 17 bp, Homo sapiens
tagattttattttacta

SEQ ID NO: 1593808 - DNA, 13 bp, Homo sapiens
tagattttccaaa

SEQ ID NO: 1593809 - DNA, 14 bp, Homo sapiens
tagattttctggtt

SEQ ID NO: 1593810 - DNA, 22 bp, Homo sapiens
tagattttctggttctaacatt

SEQ ID NO: 1593811 - DNA, 21 bp, Homo sapiens
tagattttgtgtttattcttg

SEQ ID NO: 1593812 - DNA, 22 bp, Homo sapiens
tagattttgtgtttattcttga

SEQ ID NO: 1593813 - DNA, 16 bp, Homo sapiens
tagcaaaattcctgtg

SEQ ID NO: 1593814 - DNA, 23 bp, Homo sapiens
tagcaaagaggttggagcaacaa

SEQ ID NO: 1593815 - DNA, 11 bp, Homo sapiens
tagcaaagatt

SEQ ID NO: 1593816 - DNA, 15 bp, Homo sapiens
tagcaaagcaaaagg

SEQ ID NO: 1593817 - DNA, 23 bp, Homo sapiens
tagcaaatgacagatttctgtaa

SEQ ID NO: 1593818 - DNA, 21 bp, Homo sapiens
tagcaaatgttttgacatgaa

SEQ ID NO: 1593819 - DNA, 20 bp, Homo sapiens
tagcaagattgcttaaaata

SEQ ID NO: 1593820 - DNA, 18 bp, Homo sapiens
tagcaagtgaatttttct

SEQ ID NO: 1593821 - DNA, 19 bp, Homo sapiens
tagcaagttctagaaggtc

SEQ ID NO: 1593822 - DNA, 22 bp, Homo sapiens
tagcaataaatgcttttctaat

SEQ ID NO: 1593823 - DNA, 18 bp, Homo sapiens
tagcacacttttccacat

SEQ ID NO: 1593824 - DNA, 23 bp, Homo sapiens
tagcacagccagacttgcttcct

SEQ ID NO: 1593825 - DNA, 15 bp, Homo sapiens
tagcacatcattcct

SEQ ID NO: 1593826 - DNA, 23 bp, Homo sapiens
tagcacatggtttaaatatgaat

SEQ ID NO: 1593827 - DNA, 11 bp, Homo sapiens
tagcactgagg

SEQ ID NO: 1593828 - DNA, 21 bp, Homo sapiens
tagcagacccagcttagagtt

SEQ ID NO: 1593829 - DNA, 23 bp, Homo sapiens
tagcagacgtatattgtatcatt

SEQ ID NO: 1593830 - DNA, 15 bp, Homo sapiens
tagcagagagccaaa

SEQ ID NO: 1593831 - DNA, 12 bp, Homo sapiens
tagcagagccta

SEQ ID NO: 1593832 - DNA, 13 bp, Homo sapiens
tagcagagcctat

SEQ ID NO: 1593833 - DNA, 16 bp, Homo sapiens
tagcagagttaaatct

SEQ ID NO: 1593834 - DNA, 12 bp, Homo sapiens
tagcagatggtt

SEQ ID NO: 1593835 - DNA, 23 bp, Homo sapiens
tagcagattgtttcctcttccaa

SEQ ID NO: 1593836 - DNA, 18 bp, Homo sapiens
tagcagattttaattttg

SEQ ID NO: 1593837 - DNA, 11 bp, Homo sapiens
tagcagctgca

SEQ ID NO: 1593838 - DNA, 11 bp, Homo sapiens
tagcagctgga

SEQ ID NO: 1593839 - DNA, 22 bp, Homo sapiens
tagcaggactgaattgtcccca

SEQ ID NO: 1593840 - DNA, 15 bp, Homo sapiens
tagcaggcacaggac

SEQ ID NO: 1593841 - DNA, 16 bp, Homo sapiens
tataggtgctacaaaa

SEQ ID NO: 1593842 - DNA, 20 bp, Homo sapiens
tataggtgctacaaaaacac

SEQ ID NO: 1593843 - DNA, 21 bp, Homo sapiens
tataggtgctacaaaaacaca

SEQ ID NO: 1593844 - DNA, 23 bp, Homo sapiens
tataggtgctacaaaaacacagc

SEQ ID NO: 1593845 - DNA, 18 bp, Homo sapiens
tatagtatatctggacaa

SEQ ID NO: 1593846 - DNA, 18 bp, Homo sapiens
tatagtatatttatactc

SEQ ID NO: 1593847 - DNA, 13 bp, Homo sapiens
tatagtcaaatcg

SEQ ID NO: 1593848 - DNA, 18 bp, Homo sapiens
tatagtctaagactatat

SEQ ID NO: 1593849 - DNA, 16 bp, Homo sapiens
tatagtgttcacaaac

SEQ ID NO: 1593850 - DNA, 17 bp, Homo sapiens
tatagtgttcacaaact

SEQ ID NO: 1593851 - DNA, 18 bp, Homo sapiens
tatagtgttcacaaactg

SEQ ID NO: 1593852 - DNA, 19 bp, Homo sapiens
tatagtgttcacaaactgt

SEQ ID NO: 1593853 - DNA, 22 bp, Homo sapiens
tatagttaattgtggctttatg

SEQ ID NO: 1593854 - DNA, 15 bp, Homo sapiens
tatagttactgtgta

SEQ ID NO: 1593855 - DNA, 18 bp, Homo sapiens
tatagttactgtgtaatt

SEQ ID NO: 1593856 - DNA, 12 bp, Homo sapiens
tatagttattat

SEQ ID NO: 1593857 - DNA, 12 bp, Homo sapiens
tatagttctaga

SEQ ID NO: 1593858 - DNA, 13 bp, Homo sapiens
tatagttctaggc

SEQ ID NO: 1593859 - DNA, 22 bp, Homo sapiens
tatagttgcttgcctgatataa

SEQ ID NO: 1593860 - DNA, 14 bp, Homo sapiens
tatagtttgtcatc

SEQ ID NO: 1593861 - DNA, 22 bp, Homo sapiens
tatagttttacttttaaactgt

SEQ ID NO: 1593862 - DNA, 17 bp, Homo sapiens
tatataaaacttaaaaa

SEQ ID NO: 1593863 - DNA, 23 bp, Homo sapiens
tatataaacaataaaaacaactt

SEQ ID NO: 1593864 - DNA, 11 bp, Homo sapiens
tatataaacat

SEQ ID NO: 1593865 - DNA, 15 bp, Homo sapiens
tatataataaatact

SEQ ID NO: 1593866 - DNA, 15 bp, Homo sapiens
tatatacattgctta

SEQ ID NO: 1593867 - DNA, 18 bp, Homo sapiens
tatatacgcatctataaa

SEQ ID NO: 1593868 - DNA, 19 bp, Homo sapiens
tatatactgggttcttgtt

SEQ ID NO: 1593869 - DNA, 16 bp, Homo sapiens
tatataggatattgct

SEQ ID NO: 1593870 - DNA, 17 bp, Homo sapiens
tatataggatattgcta

SEQ ID NO: 1593871 - DNA, 18 bp, Homo sapiens
tatataggatattgctaa

SEQ ID NO: 1593872 - DNA, 22 bp, Homo sapiens
tatatagtttattgacaataat

SEQ ID NO: 1593873 - DNA, 14 bp, Homo sapiens
tatatataaagaca

SEQ ID NO: 1593874 - DNA, 16 bp, Homo sapiens
tatatataaagacaac

SEQ ID NO: 1593875 - DNA, 13 bp, Homo sapiens
tatatataaatgt

SEQ ID NO: 1593876 - DNA, 16 bp, Homo sapiens
tatatataacatatat

SEQ ID NO: 1593877 - DNA, 16 bp, Homo sapiens
tatatataataaatac

SEQ ID NO: 1593878 - DNA, 12 bp, Homo sapiens
tatatatacata

SEQ ID NO: 1593879 - DNA, 14 bp, Homo sapiens
tatatatataaaca

SEQ ID NO: 1593880 - DNA, 16 bp, Homo sapiens
tatatatataaatgta

SEQ ID NO: 1593881 - DNA, 14 bp, Homo sapiens
tatatatatagtaa

SEQ ID NO: 1593882 - DNA, 13 bp, Homo sapiens
tatatatatataa

SEQ ID NO: 1593883 - DNA, 15 bp, Homo sapiens
tatatatatatgcac

SEQ ID NO: 1593884 - DNA, 14 bp, Homo sapiens
tatatatatgcata

SEQ ID NO: 1593885 - DNA, 13 bp, Homo sapiens
tatatatctatat

SEQ ID NO: 1593886 - DNA, 16 bp, Homo sapiens
tatatatctattattc

SEQ ID NO: 1593887 - DNA, 17 bp, Homo sapiens
tatatatctattattca

SEQ ID NO: 1593888 - DNA, 18 bp, Homo sapiens
tatatatgcacacatata

SEQ ID NO: 1593889 - DNA, 14 bp, Homo sapiens
tatatatgtatatg

SEQ ID NO: 1593890 - DNA, 14 bp, Homo sapiens
tatatattatatat

SEQ ID NO: 1593891 - DNA, 20 bp, Homo sapiens
tatatatttaggaaattcaa

SEQ ID NO: 1593892 - DNA, 13 bp, Homo sapiens
tatatatttataa

SEQ ID NO: 1593893 - DNA, 15 bp, Homo sapiens
tatatatttataact

SEQ ID NO: 1593894 - DNA, 17 bp, Homo sapiens
tatatattttgttgttc

SEQ ID NO: 1593895 - DNA, 22 bp, Homo sapiens
tatatattttgttgttcctcta

SEQ ID NO: 1593896 - DNA, 14 bp, Homo sapiens
tatatcacacaata

SEQ ID NO: 1593897 - DNA, 15 bp, Homo sapiens
tatatcatatgtata

SEQ ID NO: 1593898 - DNA, 13 bp, Homo sapiens
tatatcatatttc

SEQ ID NO: 1593899 - DNA, 20 bp, Homo sapiens
tatatccaaaagctttttat

SEQ ID NO: 1593900 - DNA, 18 bp, Homo sapiens
tatatcctgtgactgtct

SEQ ID NO: 1593901 - DNA, 15 bp, Homo sapiens
tatatctattattca

SEQ ID NO: 1593902 - DNA, 16 bp, Homo sapiens
tatatctcctttgtat

SEQ ID NO: 1593903 - DNA, 23 bp, Homo sapiens
tatatctgaagagtatccttcct

SEQ ID NO: 1593904 - DNA, 13 bp, Homo sapiens
tatatctggcctc

SEQ ID NO: 1593905 - DNA, 14 bp, Homo sapiens
tatatctgtaaatt

SEQ ID NO: 1593906 - DNA, 15 bp, Homo sapiens
tatatctgtatataa

SEQ ID NO: 1593907 - DNA, 16 bp, Homo sapiens
tatatctgttggagaa

SEQ ID NO: 1593908 - DNA, 14 bp, Homo sapiens
tatatcttgtagct

SEQ ID NO: 1593909 - DNA, 18 bp, Homo sapiens
tatatgagtagatactct

SEQ ID NO: 1593910 - DNA, 17 bp, Homo sapiens
tatatgatgaaattctt

SEQ ID NO: 1593911 - DNA, 13 bp, Homo sapiens
tatatgatggggg

SEQ ID NO: 1593912 - DNA, 16 bp, Homo sapiens
tatatgattctcttga

SEQ ID NO: 1593913 - DNA, 17 bp, Homo sapiens
tatatgatttttatcca

SEQ ID NO: 1593914 - DNA, 14 bp, Homo sapiens
tatatgcttactga

SEQ ID NO: 1593915 - DNA, 17 bp, Homo sapiens
tatatgcttttggaagt

SEQ ID NO: 1593916 - DNA, 17 bp, Homo sapiens
tatatggaagaggaaaa

SEQ ID NO: 1593917 - DNA, 18 bp, Homo sapiens
tatatggaaggttcctgt

SEQ ID NO: 1593918 - DNA, 21 bp, Homo sapiens
tatatggaggattctttcccc

SEQ ID NO: 1593919 - DNA, 20 bp, Homo sapiens
tatatggtggtaataaggga

SEQ ID NO: 1593920 - DNA, 14 bp, Homo sapiens
tatatgtactgttt

SEQ ID NO: 1593921 - DNA, 15 bp, Homo sapiens
tatatgtataatata

SEQ ID NO: 1593922 - DNA, 20 bp, Homo sapiens
tatatgtataatatatatct

SEQ ID NO: 1593923 - DNA, 18 bp, Homo sapiens
tatatgtatatgtatata

SEQ ID NO: 1593924 - DNA, 15 bp, Homo sapiens
tatatgtattccctt

SEQ ID NO: 1593925 - DNA, 12 bp, Homo sapiens
tatatgtcaata

SEQ ID NO: 1593926 - DNA, 13 bp, Homo sapiens
tatatgtgaaaca

SEQ ID NO: 1593927 - DNA, 14 bp, Homo sapiens
tatatgtgtatgca

SEQ ID NO: 1593928 - DNA, 14 bp, Homo sapiens
tatatgttgtaata

SEQ ID NO: 1593929 - DNA, 12 bp, Homo sapiens
tatattaaaaca

SEQ ID NO: 1593930 - DNA, 14 bp, Homo sapiens
tatattaaaacaat

SEQ ID NO: 1593931 - DNA, 22 bp, Homo sapiens
tatattaaacaaagtttcagag

SEQ ID NO: 1593932 - DNA, 15 bp, Homo sapiens
tatattaatgtactt

SEQ ID NO: 1593933 - DNA, 16 bp, Homo sapiens
tatattatatatatct

SEQ ID NO: 1593934 - DNA, 14 bp, Homo sapiens
tatattatcatgca

SEQ ID NO: 1593935 - DNA, 15 bp, Homo sapiens
tatattattgattca

SEQ ID NO: 1593936 - DNA, 12 bp, Homo sapiens
tatattcacaga

SEQ ID NO: 1593937 - DNA, 17 bp, Homo sapiens
tatattcatatacaaac

SEQ ID NO: 1593938 - DNA, 19 bp, Homo sapiens
tatattccaccattcacat

SEQ ID NO: 1593939 - DNA, 18 bp, Homo sapiens
tatattcccaatagcaac

SEQ ID NO: 1593940 - DNA, 18 bp, Homo sapiens
tatattccgtatttaaag

SEQ ID NO: 1593941 - DNA, 21 bp, Homo sapiens
tatattcgggcaggactgttg

SEQ ID NO: 1593942 - DNA, 22 bp, Homo sapiens
tatattgaacttttgtactgaa

SEQ ID NO: 1593943 - DNA, 16 bp, Homo sapiens
tatattgctgcatttt

SEQ ID NO: 1593944 - DNA, 14 bp, Homo sapiens
tatattgtaattta

SEQ ID NO: 1593945 - DNA, 12 bp, Homo sapiens
tatattgtgaac

SEQ ID NO: 1593946 - DNA, 21 bp, Homo sapiens
tatattgttaaatcctttgct

SEQ ID NO: 1593947 - DNA, 17 bp, Homo sapiens
tatatttaaaaataagt

SEQ ID NO: 1593948 - DNA, 14 bp, Homo sapiens
tatatttaacaatg

SEQ ID NO: 1593949 - DNA, 17 bp, Homo sapiens
tatatttacaaataaaa

SEQ ID NO: 1593950 - DNA, 21 bp, Homo sapiens
tatatttagattgttaaaata

SEQ ID NO: 1593951 - DNA, 24 bp, Homo sapiens
tatatttataactcatcataaaat

SEQ ID NO: 1593952 - DNA, 19 bp, Homo sapiens
tatatttattcataatgaa

SEQ ID NO: 1593953 - DNA, 12 bp, Homo sapiens
tatatttattgt

SEQ ID NO: 1593954 - DNA, 15 bp, Homo sapiens
tatatttcagacatt

SEQ ID NO: 1593955 - DNA, 13 bp, Homo sapiens
tatatttcatatt

SEQ ID NO: 1593956 - DNA, 17 bp, Homo sapiens
tatatttcctttatgtg

SEQ ID NO: 1593957 - DNA, 18 bp, Homo sapiens
tatatttcctttatgtga

SEQ ID NO: 1593958 - DNA, 18 bp, Homo sapiens
tatatttcttcttctaag

SEQ ID NO: 1593959 - DNA, 21 bp, Homo sapiens
tatcagtattctgacatgtaa

SEQ ID NO: 1593960 - DNA, 17 bp, Homo sapiens
tatcagtcgttttagtg

SEQ ID NO: 1593961 - DNA, 22 bp, Homo sapiens
tatcagtcgttttagtgtctga

SEQ ID NO: 1593962 - DNA, 16 bp, Homo sapiens
tatcagtgacagagtt

SEQ ID NO: 1593963 - DNA, 11 bp, Homo sapiens
tatcagtgctt

SEQ ID NO: 1593964 - DNA, 13 bp, Homo sapiens
tatcagtgtcctt

SEQ ID NO: 1593965 - DNA, 15 bp, Homo sapiens
tatcagttactcagc

SEQ ID NO: 1593966 - DNA, 20 bp, Homo sapiens
tatcagttactcagccctgg

SEQ ID NO: 1593967 - DNA, 21 bp, Homo sapiens
tatcagttactcagccctggg

SEQ ID NO: 1593968 - DNA, 23 bp, Homo sapiens
tatcagtttgctagcagaaatct

SEQ ID NO: 1593969 - DNA, 14 bp, Homo sapiens
tatcatactcttct

SEQ ID NO: 1593970 - DNA, 17 bp, Homo sapiens
tatcatactcttctaaa

SEQ ID NO: 1593971 - DNA, 20 bp, Homo sapiens
tatcatactcttctaaaact

SEQ ID NO: 1593972 - DNA, 21 bp, Homo sapiens
tatcatactcttctaaaactt

SEQ ID NO: 1593973 - DNA, 15 bp, Homo sapiens
tatcatatattaaaa

SEQ ID NO: 1593974 - DNA, 17 bp, Homo sapiens
tatcatatattaaaaca

SEQ ID NO: 1593975 - DNA, 18 bp, Homo sapiens
tatcatcaagcaggaatt

SEQ ID NO: 1593976 - DNA, 17 bp, Homo sapiens
tatcatccacattgttt

SEQ ID NO: 1593977 - DNA, 20 bp, Homo sapiens
tatcatcccaacagccaaga

SEQ ID NO: 1593978 - DNA, 18 bp, Homo sapiens
tatcatgaattttaaagt

SEQ ID NO: 1593979 - DNA, 17 bp, Homo sapiens
tatcatgcaaatgctgt

SEQ ID NO: 1593980 - DNA, 18 bp, Homo sapiens
tatcatgcccctgtactc

SEQ ID NO: 1593981 - DNA, 15 bp, Homo sapiens
tatcatgttaaatta

SEQ ID NO: 1593982 - DNA, 19 bp, Homo sapiens
tatcatgttaaattagaat

SEQ ID NO: 1593983 - DNA, 20 bp, Homo sapiens
tatcattacaattttctgta

SEQ ID NO: 1593984 - DNA, 13 bp, Homo sapiens
tatcattcattct

SEQ ID NO: 1593985 - DNA, 17 bp, Homo sapiens
tatcattctaaagatag

SEQ ID NO: 1593986 - DNA, 23 bp, Homo sapiens
tatcattctaaagatagagtaaa

SEQ ID NO: 1593987 - DNA, 22 bp, Homo sapiens
tatcattgctcccctgatagaa

SEQ ID NO: 1593988 - DNA, 19 bp, Homo sapiens
tatcattgcttcctcctcc

SEQ ID NO: 1593989 - DNA, 23 bp, Homo sapiens
tatcatttgagtttagggttctg

SEQ ID NO: 1593990 - DNA, 20 bp, Homo sapiens
tatcattttcttttttaacc

SEQ ID NO: 1593991 - DNA, 16 bp, Homo sapiens
tatcattttttcctgt

SEQ ID NO: 1593992 - DNA, 18 bp, Homo sapiens
tatcattttttcctgttt

SEQ ID NO: 1593993 - DNA, 18 bp, Homo sapiens
tatccaaaataatgagga

SEQ ID NO: 1593994 - DNA, 22 bp, Homo sapiens
tatccaaaatgtgtatttctta

SEQ ID NO: 1593995 - DNA, 20 bp, Homo sapiens
tatccaaatctgaagattgc

SEQ ID NO: 1593996 - DNA, 18 bp, Homo sapiens
tatccaaccaacttggtt

SEQ ID NO: 1593997 - DNA, 20 bp, Homo sapiens
tatccaagtaccaatgctgt

SEQ ID NO: 1593998 - DNA, 17 bp, Homo sapiens
tatccaattttgatctt

SEQ ID NO: 1593999 - DNA, 19 bp, Homo sapiens
tatccaattttgatctttt

SEQ ID NO: 1594000 - DNA, 20 bp, Homo sapiens
tatccacaatagctgacggc

SEQ ID NO: 1594001 - DNA, 16 bp, Homo sapiens
tatccacatgaaaata

SEQ ID NO: 1594002 - DNA, 17 bp, Homo sapiens
tatccaggcaccaggac

SEQ ID NO: 1594003 - DNA, 14 bp, Homo sapiens
tatccagttactgc

SEQ ID NO: 1594004 - DNA, 20 bp, Homo sapiens
tatccatgcatgtgcatata

SEQ ID NO: 1594005 - DNA, 20 bp, Homo sapiens
tatccatgtacttgtttgca

SEQ ID NO: 1594006 - DNA, 21 bp, Homo sapiens
tatgctgatcttttaaaatca

SEQ ID NO: 1594007 - DNA, 15 bp, Homo sapiens
tatgctgatgatcaa

SEQ ID NO: 1594008 - DNA, 19 bp, Homo sapiens
tatgctgtattttaacact

SEQ ID NO: 1594009 - DNA, 20 bp, Homo sapiens
tatgctgttatgtccagaaa

SEQ ID NO: 1594010 - DNA, 16 bp, Homo sapiens
tatgcttaaaataagc

SEQ ID NO: 1594011 - DNA, 15 bp, Homo sapiens
tatgcttatacactt

SEQ ID NO: 1594012 - DNA, 17 bp, Homo sapiens
tatgctttttctcagat

SEQ ID NO: 1594013 - DNA, 20 bp, Homo sapiens
tatggaacataaagttgtat

SEQ ID NO: 1594014 - DNA, 14 bp, Homo sapiens
tatggaatacagtg

SEQ ID NO: 1594015 - DNA, 16 bp, Homo sapiens
tatggacaacttattt

SEQ ID NO: 1594016 - DNA, 13 bp, Homo sapiens
tatggactatctg

SEQ ID NO: 1594017 - DNA, 16 bp, Homo sapiens
tatggactctgcacat

SEQ ID NO: 1594018 - DNA, 16 bp, Homo sapiens
tatggagttaaataaa

SEQ ID NO: 1594019 - DNA, 16 bp, Homo sapiens
tatggatttgaagttt

SEQ ID NO: 1594020 - DNA, 20 bp, Homo sapiens
tatggatttggggtgttaca

SEQ ID NO: 1594021 - DNA, 19 bp, Homo sapiens
tatggcaaatagccacaat

SEQ ID NO: 1594022 - DNA, 11 bp, Homo sapiens
tatggcaaggg

SEQ ID NO: 1594023 - DNA, 23 bp, Homo sapiens
tatggcaagtgatatcacctctc

SEQ ID NO: 1594024 - DNA, 21 bp, Homo sapiens
tatggcacttattatgaggct

SEQ ID NO: 1594025 - DNA, 17 bp, Homo sapiens
tatggcagaggtgcaag

SEQ ID NO: 1594026 - DNA, 22 bp, Homo sapiens
tatggcagtccagccagctcct

SEQ ID NO: 1594027 - DNA, 16 bp, Homo sapiens
tatggccagtctgccc

SEQ ID NO: 1594028 - DNA, 12 bp, Homo sapiens
tatggcctcagc

SEQ ID NO: 1594029 - DNA, 19 bp, Homo sapiens
tatggctctatcttttcct

SEQ ID NO: 1594030 - DNA, 15 bp, Homo sapiens
tatgggagccccagg

SEQ ID NO: 1594031 - DNA, 19 bp, Homo sapiens
tatgggaggcagccgaggc

SEQ ID NO: 1594032 - DNA, 20 bp, Homo sapiens
tatgggatattcccaagccg

SEQ ID NO: 1594033 - DNA, 15 bp, Homo sapiens
tatgggcccctggca

SEQ ID NO: 1594034 - DNA, 21 bp, Homo sapiens
tatggggaaggttatcagtgc

SEQ ID NO: 1594035 - DNA, 23 bp, Homo sapiens
tatggggaaggttatcagtgctt

SEQ ID NO: 1594036 - DNA, 17 bp, Homo sapiens
tatgggggatttcaaac

SEQ ID NO: 1594037 - DNA, 13 bp, Homo sapiens
tatgggtcacagg

SEQ ID NO: 1594038 - DNA, 19 bp, Homo sapiens
tatgggtgggattttgcaa

SEQ ID NO: 1594039 - DNA, 20 bp, Homo sapiens
tatggtaacactttgctttc

SEQ ID NO: 1594040 - DNA, 18 bp, Homo sapiens
tatggtaggggagggcag

SEQ ID NO: 1594041 - DNA, 15 bp, Homo sapiens
tatggtgaagggaag

SEQ ID NO: 1594042 - DNA, 15 bp, Homo sapiens
tatggtgatgactta

SEQ ID NO: 1594043 - DNA, 13 bp, Homo sapiens
tatggtgcttcct

SEQ ID NO: 1594044 - DNA, 13 bp, Homo sapiens
tatggtgtatttt

SEQ ID NO: 1594045 - DNA, 16 bp, Homo sapiens
tatggttcccaataaa

SEQ ID NO: 1594046 - DNA, 17 bp, Homo sapiens
tatggttcccaataaaa

SEQ ID NO: 1594047 - DNA, 19 bp, Homo sapiens
tatggttcccaataaaagt

SEQ ID NO: 1594048 - DNA, 21 bp, Homo sapiens
tatggttcccaataaaagtga

SEQ ID NO: 1594049 - DNA, 20 bp, Homo sapiens
tatggttgatagtttacctg

SEQ ID NO: 1594050 - DNA, 12 bp, Homo sapiens
tatgtaaaataa

SEQ ID NO: 1594051 - DNA, 20 bp, Homo sapiens
tatgtaaaatgaattgaaaa

SEQ ID NO: 1594052 - DNA, 22 bp, Homo sapiens
tatgtaaacaaaccacagcagg

SEQ ID NO: 1594053 - DNA, 20 bp, Homo sapiens
tatgtaaatctgctttgtgg

SEQ ID NO: 1594054 - DNA, 20 bp, Homo sapiens
tatgtaacagtcaaatatca

SEQ ID NO: 1594055 - DNA, 14 bp, Homo sapiens
tatgtaactgcatt

SEQ ID NO: 1594056 - DNA, 24 bp, Homo sapiens
tatgtaactgcattgagaactgca

SEQ ID NO: 1594057 - DNA, 21 bp, Homo sapiens
tatgtaagaattcagaagacc

SEQ ID NO: 1594058 - DNA, 20 bp, Homo sapiens
tatgtaatatattgtacaaa

SEQ ID NO: 1594059 - DNA, 16 bp, Homo sapiens
tatgtaatttcaaaat

SEQ ID NO: 1594060 - DNA, 17 bp, Homo sapiens
tatgtacaatacaatgt

SEQ ID NO: 1594061 - DNA, 13 bp, Homo sapiens
tatgtacatttct

SEQ ID NO: 1594062 - DNA, 14 bp, Homo sapiens
tatgtacatttcta

SEQ ID NO: 1594063 - DNA, 20 bp, Homo sapiens
tatgttaacctcagtgtcat

SEQ ID NO: 1594064 - DNA, 19 bp, Homo sapiens
tatgttaagctctttatga

SEQ ID NO: 1594065 - DNA, 14 bp, Homo sapiens
tatgttaagggctt

SEQ ID NO: 1594066 - DNA, 22 bp, Homo sapiens
tatgttacatctgttttaaatt

SEQ ID NO: 1594067 - DNA, 15 bp, Homo sapiens
tatgttactattttc

SEQ ID NO: 1594068 - DNA, 17 bp, Homo sapiens
tatgttatacaaggcaa

SEQ ID NO: 1594069 - DNA, 14 bp, Homo sapiens
tatgttatatcaac

SEQ ID NO: 1594070 - DNA, 12 bp, Homo sapiens
tatgttcaatgc

SEQ ID NO: 1594071 - DNA, 16 bp, Homo sapiens
tatgttcagaagaaat

SEQ ID NO: 1594072 - DNA, 16 bp, Homo sapiens
tatgttcagattattg

SEQ ID NO: 1594073 - DNA, 13 bp, Homo sapiens
tatgttcatttgt

SEQ ID NO: 1594074 - DNA, 21 bp, Homo sapiens
tatgttccaaaccctcctggg

SEQ ID NO: 1594075 - DNA, 15 bp, Homo sapiens
tatgttcctcaaatc

SEQ ID NO: 1594076 - DNA, 13 bp, Homo sapiens
tatgttcctgctg

SEQ ID NO: 1594077 - DNA, 14 bp, Homo sapiens
tatgttcctgctgt

SEQ ID NO: 1594078 - DNA, 15 bp, Homo sapiens
tatgttcctgctgta

SEQ ID NO: 1594079 - DNA, 21 bp, Homo sapiens
tatgttcctgctgtatttcct

SEQ ID NO: 1594080 - DNA, 12 bp, Homo sapiens
tatgttgatact

SEQ ID NO: 1594081 - DNA, 20 bp, Homo sapiens
tatgttgtaataaaacttat

SEQ ID NO: 1594082 - DNA, 21 bp, Homo sapiens
tatgttgtccaattgttgaca

SEQ ID NO: 1594083 - DNA, 13 bp, Homo sapiens
tatgtttattaca

SEQ ID NO: 1594084 - DNA, 20 bp, Homo sapiens
tatgtttgtcttttaatgct

SEQ ID NO: 1594085 - DNA, 18 bp, Homo sapiens
tatgtttgtgtgatttcc

SEQ ID NO: 1594086 - DNA, 18 bp, Homo sapiens
tatgttttgtttctgaaa

SEQ ID NO: 1594087 - DNA, 18 bp, Homo sapiens
tattaaaaaacttcatgt

SEQ ID NO: 1594088 - DNA, 16 bp, Homo sapiens
tattaaaaacatgacc

SEQ ID NO: 1594089 - DNA, 12 bp, Homo sapiens
tattaaaactaa

SEQ ID NO: 1594090 - DNA, 14 bp, Homo sapiens
tattaaaactaaat

SEQ ID NO: 1594091 - DNA, 17 bp, Homo sapiens
tattaaaactaaatttc

SEQ ID NO: 1594092 - DNA, 14 bp, Homo sapiens
tattaaaattccaa

SEQ ID NO: 1594093 - DNA, 15 bp, Homo sapiens
tattaaaattccaaa

SEQ ID NO: 1594094 - DNA, 20 bp, Homo sapiens
tattaaaattctgatgtttc

SEQ ID NO: 1594095 - DNA, 14 bp, Homo sapiens
tattaaaattgtta

SEQ ID NO: 1594096 - DNA, 15 bp, Homo sapiens
tattaaaattgttgt

SEQ ID NO: 1594097 - DNA, 19 bp, Homo sapiens
tattaaacaaagtttcaga

SEQ ID NO: 1594098 - DNA, 21 bp, Homo sapiens
tattaaacagatttttacaaa

SEQ ID NO: 1594099 - DNA, 17 bp, Homo sapiens
tattaaagattctcttt

SEQ ID NO: 1594100 - DNA, 17 bp, Homo sapiens
tattaaagcatttccta

SEQ ID NO: 1594101 - DNA, 18 bp, Homo sapiens
tattaaatacagacacta

SEQ ID NO: 1594102 - DNA, 14 bp, Homo sapiens
tattaaatcttaaa

SEQ ID NO: 1594103 - DNA, 21 bp, Homo sapiens
tattaaatcttaaacaatgta

SEQ ID NO: 1594104 - DNA, 20 bp, Homo sapiens
tattaaattaattgaatcta

SEQ ID NO: 1594105 - DNA, 14 bp, Homo sapiens
tattaaattacatt

SEQ ID NO: 1594106 - DNA, 20 bp, Homo sapiens
tattaaattacatttgtaat

SEQ ID NO: 1594107 - DNA, 12 bp, Homo sapiens
tattaaattatg

SEQ ID NO: 1594108 - DNA, 17 bp, Homo sapiens
tattaaatttatttgaa

SEQ ID NO: 1594109 - DNA, 18 bp, Homo sapiens
tattaacaaattatgtta

SEQ ID NO: 1594110 - DNA, 18 bp, Homo sapiens
tattaacacgctgcctgg

SEQ ID NO: 1594111 - DNA, 18 bp, Homo sapiens
tattaactttaatgtttt

SEQ ID NO: 1594112 - DNA, 12 bp, Homo sapiens
tattaagaaagg

SEQ ID NO: 1594113 - DNA, 14 bp, Homo sapiens
tattaagaaaggaa

SEQ ID NO: 1594114 - DNA, 24 bp, Homo sapiens
tattaagaaaggaagcattgtaaa

SEQ ID NO: 1594115 - DNA, 15 bp, Homo sapiens
tattaagacagtgta

SEQ ID NO: 1594116 - DNA, 22 bp, Homo sapiens
tattaagaggcagaaaattgca

SEQ ID NO: 1594117 - DNA, 13 bp, Homo sapiens
tattcttgtgctt

SEQ ID NO: 1594118 - DNA, 19 bp, Homo sapiens
tattcttgtggttaaaaac

SEQ ID NO: 1594119 - DNA, 21 bp, Homo sapiens
tattctttctcataaaactgt

SEQ ID NO: 1594120 - DNA, 16 bp, Homo sapiens
tattctttctcctttt

SEQ ID NO: 1594121 - DNA, 18 bp, Homo sapiens
tattctttggttgtgaat

SEQ ID NO: 1594122 - DNA, 14 bp, Homo sapiens
tattcttttcaatt

SEQ ID NO: 1594123 - DNA, 15 bp, Homo sapiens
tattgaaaacactta

SEQ ID NO: 1594124 - DNA, 19 bp, Homo sapiens
tattgaaaattgaaaagta

SEQ ID NO: 1594125 - DNA, 22 bp, Homo sapiens
tattgaaaggggacacctgtac

SEQ ID NO: 1594126 - DNA, 13 bp, Homo sapiens
tattgaaattcta

SEQ ID NO: 1594127 - DNA, 13 bp, Homo sapiens
tattgaacttttt

SEQ ID NO: 1594128 - DNA, 17 bp, Homo sapiens
tattgaagacaatttga

SEQ ID NO: 1594129 - DNA, 16 bp, Homo sapiens
tattgaagatgctgcc

SEQ ID NO: 1594130 - DNA, 19 bp, Homo sapiens
tattgaagttgtttatcaa

SEQ ID NO: 1594131 - DNA, 21 bp, Homo sapiens
tattgaatcagaatgccttca

SEQ ID NO: 1594132 - DNA, 13 bp, Homo sapiens
tattgacaataat

SEQ ID NO: 1594133 - DNA, 16 bp, Homo sapiens
tattgacatttgtagt

SEQ ID NO: 1594134 - DNA, 16 bp, Homo sapiens
tattgacgaactggct

SEQ ID NO: 1594135 - DNA, 22 bp, Homo sapiens
tattgacgaactggctacagta

SEQ ID NO: 1594136 - DNA, 16 bp, Homo sapiens
tattgactttgacaat

SEQ ID NO: 1594137 - DNA, 19 bp, Homo sapiens
tattgactttgacaattac

SEQ ID NO: 1594138 - DNA, 23 bp, Homo sapiens
tattgagaagatcggaacagctc

SEQ ID NO: 1594139 - DNA, 18 bp, Homo sapiens
tattgagaattttaaatt

SEQ ID NO: 1594140 - DNA, 14 bp, Homo sapiens
tattgagatttctt

SEQ ID NO: 1594141 - DNA, 19 bp, Homo sapiens
tattgagatttcttaaata

SEQ ID NO: 1594142 - DNA, 21 bp, Homo sapiens
tattgagcccaaaaacaagca

SEQ ID NO: 1594143 - DNA, 14 bp, Homo sapiens
tattgataagttca

SEQ ID NO: 1594144 - DNA, 20 bp, Homo sapiens
tattgatgtacagtctgtca

SEQ ID NO: 1594145 - DNA, 16 bp, Homo sapiens
tattgatgttaacaag

SEQ ID NO: 1594146 - DNA, 23 bp, Homo sapiens
tattgatgttaacaagaggggaa

SEQ ID NO: 1594147 - DNA, 16 bp, Homo sapiens
tattgattaaaaatgt

SEQ ID NO: 1594148 - DNA, 19 bp, Homo sapiens
tattgattgggaaaacatt

SEQ ID NO: 1594149 - DNA, 20 bp, Homo sapiens
tattgattgggaaaacattt

SEQ ID NO: 1594150 - DNA, 21 bp, Homo sapiens
tattgcaaaggttccaactgt

SEQ ID NO: 1594151 - DNA, 23 bp, Homo sapiens
tattgcaaggcagtctctatatt

SEQ ID NO: 1594152 - DNA, 19 bp, Homo sapiens
tattgcatgcaatttgaag

SEQ ID NO: 1594153 - DNA, 15 bp, Homo sapiens
tattgcctctacttt

SEQ ID NO: 1594154 - DNA, 17 bp, Homo sapiens
tattgccttttaatttt

SEQ ID NO: 1594155 - DNA, 19 bp, Homo sapiens
tattgctatcttttctgga

SEQ ID NO: 1594156 - DNA, 17 bp, Homo sapiens
tattgctgagaagcaaa

SEQ ID NO: 1594157 - DNA, 22 bp, Homo sapiens
tattgcttattttattatgagc

SEQ ID NO: 1594158 - DNA, 15 bp, Homo sapiens
tattgcttcatctgt

SEQ ID NO: 1594159 - DNA, 22 bp, Homo sapiens
tattggaaatttgttataatga

SEQ ID NO: 1594160 - DNA, 12 bp, Homo sapiens
tattggcctgga

SEQ ID NO: 1594161 - DNA, 20 bp, Homo sapiens
tattgggcacagcctagggt

SEQ ID NO: 1594162 - DNA, 14 bp, Homo sapiens
tattatagaaaatt

SEQ ID NO: 1594163 - DNA, 22 bp, Homo sapiens
tattatagagcagaaattctgt

SEQ ID NO: 1594164 - DNA, 21 bp, Homo sapiens
tattatagcaactttaagaag

SEQ ID NO: 1594165 - DNA, 17 bp, Homo sapiens
tattatatatatctata

SEQ ID NO: 1594166 - DNA, 14 bp, Homo sapiens
tattatcaagtaga

SEQ ID NO: 1594167 - DNA, 16 bp, Homo sapiens
tattatcatgcaaatg

SEQ ID NO: 1594168 - DNA, 14 bp, Homo sapiens
tattatccttctac

SEQ ID NO: 1594169 - DNA, 14 bp, Homo sapiens
tattatctgggctt

SEQ ID NO: 1594170 - DNA, 13 bp, Homo sapiens
tattatctgtcag

SEQ ID NO: 1594171 - DNA, 14 bp, Homo sapiens
tattatctgtcagc

SEQ ID NO: 1594172 - DNA, 21 bp, Homo sapiens
tattatcttgttcaggaaaag

SEQ ID NO: 1594173 - DNA, 18 bp, Homo sapiens
tattatgagctacaacaa

SEQ ID NO: 1594174 - DNA, 19 bp, Homo sapiens
tattatgagctttctttgc

SEQ ID NO: 1594175 - DNA, 12 bp, Homo sapiens
tattatgcataa

SEQ ID NO: 1594176 - DNA, 20 bp, Homo sapiens
tattatgccccagttcagaa

SEQ ID NO: 1594177 - DNA, 22 bp, Homo sapiens
tattatgcctgagttataaata

SEQ ID NO: 1594178 - DNA, 17 bp, Homo sapiens
tattatgtgcctaattt

SEQ ID NO: 1594179 - DNA, 13 bp, Homo sapiens
tattatgttctta

SEQ ID NO: 1594180 - DNA, 17 bp, Homo sapiens
tattatgtttattacaa

SEQ ID NO: 1594181 - DNA, 20 bp, Homo sapiens
tattatgtttattacaattt

SEQ ID NO: 1594182 - DNA, 19 bp, Homo sapiens
tattattacttatttttga

SEQ ID NO: 1594183 - DNA, 19 bp, Homo sapiens
tattattagaaattagaaa

SEQ ID NO: 1594184 - DNA, 17 bp, Homo sapiens
tattattagataatatt

SEQ ID NO: 1594185 - DNA, 22 bp, Homo sapiens
tattattataatcttataattg

SEQ ID NO: 1594186 - DNA, 16 bp, Homo sapiens
tattattcccattcta

SEQ ID NO: 1594187 - DNA, 23 bp, Homo sapiens
tattattcccgacgacacatata

SEQ ID NO: 1594188 - DNA, 22 bp, Homo sapiens
tattattctgttttgcacagtt

SEQ ID NO: 1594189 - DNA, 15 bp, Homo sapiens
tattatttaaatgtt

SEQ ID NO: 1594190 - DNA, 18 bp, Homo sapiens
tattatttcaccagcagc

SEQ ID NO: 1594191 - DNA, 21 bp, Homo sapiens
tattatttctaatccttttcc

SEQ ID NO: 1594192 - DNA, 12 bp, Homo sapiens
tattatttcttc

SEQ ID NO: 1594193 - DNA, 15 bp, Homo sapiens
tattatttcttctct

SEQ ID NO: 1594194 - DNA, 18 bp, Homo sapiens
tattcaacaatttcaata

SEQ ID NO: 1594195 - DNA, 16 bp, Homo sapiens
tattcaaggaagtttt

SEQ ID NO: 1594196 - DNA, 19 bp, Homo sapiens
tattcaagtgcctcttgtt

SEQ ID NO: 1594197 - DNA, 23 bp, Homo sapiens
tattcaataaaaaaaagaaatga

SEQ ID NO: 1594198 - DNA, 20 bp, Homo sapiens
tattcaataccgctcagtat

SEQ ID NO: 1594199 - DNA, 22 bp, Homo sapiens
tattcaataccgctcagtattt

SEQ ID NO: 1594200 - DNA, 15 bp, Homo sapiens
tattcaatgcattta

SEQ ID NO: 1594201 - DNA, 15 bp, Homo sapiens
tattcaattcctctg

SEQ ID NO: 1594202 - DNA, 16 bp, Homo sapiens
tattcaattcctctgg

SEQ ID NO: 1594203 - DNA, 21 bp, Homo sapiens
tattcacatcgcttctgtgta

SEQ ID NO: 1594204 - DNA, 16 bp, Homo sapiens
tattcacccctgcccc

SEQ ID NO: 1594205 - DNA, 20 bp, Homo sapiens
tattcaccctccacttcccg

SEQ ID NO: 1594206 - DNA, 22 bp, Homo sapiens
tattcacctttttaataaaaat

SEQ ID NO: 1594207 - DNA, 19 bp, Homo sapiens
tattcacgccgtaattctt

SEQ ID NO: 1594208 - DNA, 22 bp, Homo sapiens
tattcacgccgtaattctttct

SEQ ID NO: 1594209 - DNA, 14 bp, Homo sapiens
tattcactggcccc

SEQ ID NO: 1594210 - DNA, 18 bp, Homo sapiens
tattcagaggcagtgatg

SEQ ID NO: 1594211 - DNA, 16 bp, Homo sapiens
tcacagcatggaggag

SEQ ID NO: 1594212 - DNA, 17 bp, Homo sapiens
tcacagcatggaggagg

SEQ ID NO: 1594213 - DNA, 15 bp, Homo sapiens
tcacagcccagcccg

SEQ ID NO: 1594214 - DNA, 14 bp, Homo sapiens
tcacagcgtctgct

SEQ ID NO: 1594215 - DNA, 17 bp, Homo sapiens
tcacagcgtctgctcat

SEQ ID NO: 1594216 - DNA, 13 bp, Homo sapiens
tcacagctgcagc

SEQ ID NO: 1594217 - DNA, 19 bp, Homo sapiens
tcacagctgcagctgggcc

SEQ ID NO: 1594218 - DNA, 17 bp, Homo sapiens
tcacagcttcagccagg

SEQ ID NO: 1594219 - DNA, 19 bp, Homo sapiens
tcacagcttctccaagcat

SEQ ID NO: 1594220 - DNA, 19 bp, Homo sapiens
tcacaggcagtgcatgtga

SEQ ID NO: 1594221 - DNA, 15 bp, Homo sapiens
tcacaggcatcagga

SEQ ID NO: 1594222 - DNA, 23 bp, Homo sapiens
tcacaggccagatgttgttcctg

SEQ ID NO: 1594223 - DNA, 15 bp, Homo sapiens
tcacagggcagagcc

SEQ ID NO: 1594224 - DNA, 17 bp, Homo sapiens
tcacagggccccagaag

SEQ ID NO: 1594225 - DNA, 17 bp, Homo sapiens
tcacaggggcggggcag

SEQ ID NO: 1594226 - DNA, 19 bp, Homo sapiens
tcacaggggcggggcagga

SEQ ID NO: 1594227 - DNA, 15 bp, Homo sapiens
tcacagggtgggcct

SEQ ID NO: 1594228 - DNA, 22 bp, Homo sapiens
tcactcacactggccacaagga

SEQ ID NO: 1594229 - DNA, 16 bp, Homo sapiens
tcactcaccactacca

SEQ ID NO: 1594230 - DNA, 22 bp, Homo sapiens
tcactcaccactaccagccagc

SEQ ID NO: 1594231 - DNA, 17 bp, Homo sapiens
tcactcagtaaaacata

SEQ ID NO: 1594232 - DNA, 18 bp, Homo sapiens
tcactcatggaacactca

SEQ ID NO: 1594233 - DNA, 15 bp, Homo sapiens
tcactcattgctgag

SEQ ID NO: 1594234 - DNA, 22 bp, Homo sapiens
tcactcattgctgagcctctgc

SEQ ID NO: 1594235 - DNA, 14 bp, Homo sapiens
tcactccaccatcc

SEQ ID NO: 1594236 - DNA, 19 bp, Homo sapiens
tcactccaccatccccacc

SEQ ID NO: 1594237 - DNA, 21 bp, Homo sapiens
tcagggtcaaagacagaatgg

SEQ ID NO: 1594238 - DNA, 22 bp, Homo sapiens
tcagggtcaaagacagaatggt

SEQ ID NO: 1594239 - DNA, 19 bp, Homo sapiens
tcagggtgggaagaaagaa

SEQ ID NO: 1594240 - DNA, 17 bp, Homo sapiens
tcagggtttaatagact

SEQ ID NO: 1594241 - DNA, 16 bp, Homo sapiens
tcaggtacctggagtt

SEQ ID NO: 1594242 - DNA, 16 bp, Homo sapiens
tcaggtacggagaaga

SEQ ID NO: 1594243 - DNA, 15 bp, Homo sapiens
tcaggtatgttgcct

SEQ ID NO: 1594244 - DNA, 21 bp, Homo sapiens
tcaggtatgttgcctttatgg

SEQ ID NO: 1594245 - DNA, 23 bp, Homo sapiens
tcaggtcacataaaactttgtat

SEQ ID NO: 1594246 - DNA, 20 bp, Homo sapiens
tcaccatttggatcctgtgt

SEQ ID NO: 1594247 - DNA, 16 bp, Homo sapiens
tcacccaaacacttct

SEQ ID NO: 1594248 - DNA, 20 bp, Homo sapiens
tcacccaaacacttctgctt

SEQ ID NO: 1594249 - DNA, 19 bp, Homo sapiens
tcacccaagagattgttgt

SEQ ID NO: 1594250 - DNA, 13 bp, Homo sapiens
tcacccacccctg

SEQ ID NO: 1594251 - DNA, 16 bp, Homo sapiens
tcacccagacagctcc

SEQ ID NO: 1594252 - DNA, 17 bp, Homo sapiens
tcacccagacagctccc

SEQ ID NO: 1594253 - DNA, 19 bp, Homo sapiens
tcacccaggctggactgca

SEQ ID NO: 1594254 - DNA, 14 bp, Homo sapiens
tcacccagtcccca

SEQ ID NO: 1594255 - DNA, 21 bp, Homo sapiens
tcacccagttggtgactggga

SEQ ID NO: 1594256 - DNA, 17 bp, Homo sapiens
tcacccatgaagacagg

SEQ ID NO: 1594257 - DNA, 19 bp, Homo sapiens
tcacccatgcaagcagagg

SEQ ID NO: 1594258 - DNA, 13 bp, Homo sapiens
tcaccccatccca

SEQ ID NO: 1594259 - DNA, 14 bp, Homo sapiens
tcataaacctgttt

SEQ ID NO: 1594260 - DNA, 14 bp, Homo sapiens
tcataaagaattgt

SEQ ID NO: 1594261 - DNA, 19 bp, Homo sapiens
tcataacggttaagaaagc

SEQ ID NO: 1594262 - DNA, 23 bp, Homo sapiens
tcataacggttaagaaagcactt

SEQ ID NO: 1594263 - DNA, 17 bp, Homo sapiens
tcataacttcctgtact

SEQ ID NO: 1594264 - DNA, 20 bp, Homo sapiens
tcataaggcttcaaaatgtt

SEQ ID NO: 1594265 - DNA, 14 bp, Homo sapiens
tcataatcagtaaa

SEQ ID NO: 1594266 - DNA, 20 bp, Homo sapiens
tcataatcagtaaatagtgt

SEQ ID NO: 1594267 - DNA, 12 bp, Homo sapiens
tcataattacat

SEQ ID NO: 1594268 - DNA, 16 bp, Homo sapiens
tcataattacattcct

SEQ ID NO: 1594269 - DNA, 15 bp, Homo sapiens
tcataatttatacag

SEQ ID NO: 1594270 - DNA, 15 bp, Homo sapiens
tcatacaaactctca

SEQ ID NO: 1594271 - DNA, 16 bp, Homo sapiens
tcatacccatgcacag

SEQ ID NO: 1594272 - DNA, 19 bp, Homo sapiens
tcatacccatgcacagtac

SEQ ID NO: 1594273 - DNA, 22 bp, Homo sapiens
tcatacccatgcacagtacaat

SEQ ID NO: 1594274 - DNA, 21 bp, Homo sapiens
tcataccgcctcgtgccagca

SEQ ID NO: 1594275 - DNA, 22 bp, Homo sapiens
tcataccgcctcgtgccagcag

SEQ ID NO: 1594276 - DNA, 23 bp, Homo sapiens
tcataccgcctcgtgccagcagc

SEQ ID NO: 1594277 - DNA, 24 bp, Homo sapiens
tcataccgcctcgtgccagcagcc

SEQ ID NO: 1594278 - DNA, 18 bp, Homo sapiens
tcatacctatcatcttaa

SEQ ID NO: 1594279 - DNA, 20 bp, Homo sapiens
tcatactactgaaacagatt

SEQ ID NO: 1594280 - DNA, 13 bp, Homo sapiens
tcatactgtctgg

SEQ ID NO: 1594281 - DNA, 16 bp, Homo sapiens
tcatacttaagcaaaa

SEQ ID NO: 1594282 - DNA, 22 bp, Homo sapiens
tcatagaaatgtaacttttgta

SEQ ID NO: 1594283 - DNA, 23 bp, Homo sapiens
tcatagaaatgtaacttttgtaa

SEQ ID NO: 1594284 - DNA, 14 bp, Homo sapiens
tcatagagatttgt

SEQ ID NO: 1594285 - DNA, 19 bp, Homo sapiens
tcatagaggtgagaaaact

SEQ ID NO: 1594286 - DNA, 20 bp, Homo sapiens
tcatagatattttatatgta

SEQ ID NO: 1594287 - DNA, 16 bp, Homo sapiens
tcatagattattataa

SEQ ID NO: 1594288 - DNA, 18 bp, Homo sapiens
tcatagattattataaac

SEQ ID NO: 1594289 - DNA, 23 bp, Homo sapiens
tcatagattattataaactataa

SEQ ID NO: 1594290 - DNA, 18 bp, Homo sapiens
tcatagcagattttaatt

SEQ ID NO: 1594291 - DNA, 17 bp, Homo sapiens
tcatagcatagccagca

SEQ ID NO: 1594292 - DNA, 15 bp, Homo sapiens
tcatagccactttta

SEQ ID NO: 1594293 - DNA, 17 bp, Homo sapiens
tcatagccataaatgat

SEQ ID NO: 1594294 - DNA, 21 bp, Homo sapiens
tcataggaagggaccaaggca

SEQ ID NO: 1594295 - DNA, 14 bp, Homo sapiens
tcataggagactgc

SEQ ID NO: 1594296 - DNA, 18 bp, Homo sapiens
tcataggcggtcatgtgt

SEQ ID NO: 1594297 - DNA, 21 bp, Homo sapiens
tcataggcggtcatgtgtgca

SEQ ID NO: 1594298 - DNA, 23 bp, Homo sapiens
tcataggcggtcatgtgtgcatg

SEQ ID NO: 1594299 - DNA, 18 bp, Homo sapiens
tcatagggtctcttcagg

SEQ ID NO: 1594300 - DNA, 21 bp, Homo sapiens
tcatagggtctcttcaggttc

SEQ ID NO: 1594301 - DNA, 14 bp, Homo sapiens
tcataggttaaaaa

SEQ ID NO: 1594302 - DNA, 20 bp, Homo sapiens
tcataggttaaaaaaaaaag

SEQ ID NO: 1594303 - DNA, 14 bp, Homo sapiens
tcataggttactac

SEQ ID NO: 1594304 - DNA, 15 bp, Homo sapiens
tcataggttttaaat

SEQ ID NO: 1594305 - DNA, 14 bp, Homo sapiens
tcatagtaaaatac

SEQ ID NO: 1594306 - DNA, 17 bp, Homo sapiens
tcatagtcttgaaatga

SEQ ID NO: 1594307 - DNA, 18 bp, Homo sapiens
tcatagtcttgaaatgaa

SEQ ID NO: 1594308 - DNA, 19 bp, Homo sapiens
tcatataaattttttgtga

SEQ ID NO: 1594309 - DNA, 16 bp, Homo sapiens
tcatataataaatgta

SEQ ID NO: 1594310 - DNA, 16 bp, Homo sapiens
tcatataccagcaata

SEQ ID NO: 1594311 - DNA, 12 bp, Homo sapiens
tcatatacttat

SEQ ID NO: 1594312 - DNA, 15 bp, Homo sapiens
tcatatattaaacat

SEQ ID NO: 1594313 - DNA, 14 bp, Homo sapiens
tcatatcaaacatt

SEQ ID NO: 1594314 - DNA, 21 bp, Homo sapiens
tcatatcaacttagtcaataa

SEQ ID NO: 1594315 - DNA, 16 bp, Homo sapiens
tcatatctggagcctg

SEQ ID NO: 1594316 - DNA, 15 bp, Homo sapiens
tcatatgatctccct

SEQ ID NO: 1594317 - DNA, 22 bp, Homo sapiens
tcatatgtaccatgtacatgaa

SEQ ID NO: 1594318 - DNA, 18 bp, Homo sapiens
tcatatgtcacctttgct

SEQ ID NO: 1594319 - DNA, 18 bp, Homo sapiens
tcatattaagacagtgta

SEQ ID NO: 1594320 - DNA, 21 bp, Homo sapiens
tcatattcatgcaagtattct

SEQ ID NO: 1594321 - DNA, 18 bp, Homo sapiens
tcatattctaaaaccatt

SEQ ID NO: 1594322 - DNA, 14 bp, Homo sapiens
tcatattgtttcct

SEQ ID NO: 1594323 - DNA, 16 bp, Homo sapiens
tcatatttacttctta

SEQ ID NO: 1594324 - DNA, 22 bp, Homo sapiens
tcatatttacttcttatacatt

SEQ ID NO: 1594325 - DNA, 14 bp, Homo sapiens
tcatatttatactt

SEQ ID NO: 1594326 - DNA, 13 bp, Homo sapiens
tcatatttctacc

SEQ ID NO: 1594327 - DNA, 15 bp, Homo sapiens
tcatattttaaatct

SEQ ID NO: 1594328 - DNA, 23 bp, Homo sapiens
tcatcaaacatttgccaagtgag

SEQ ID NO: 1594329 - DNA, 13 bp, Homo sapiens
tcatcaactgaat

SEQ ID NO: 1594330 - DNA, 19 bp, Homo sapiens
tcatcaacttaaaagtcag

SEQ ID NO: 1594331 - DNA, 13 bp, Homo sapiens
tcatcaagaaata

SEQ ID NO: 1594332 - DNA, 11 bp, Homo sapiens
tcatcaagaag

SEQ ID NO: 1594333 - DNA, 21 bp, Homo sapiens
tcatcaagaagggctgcatga

SEQ ID NO: 1594334 - DNA, 21 bp, Homo sapiens
tcatcaagcaggaattatgtc

SEQ ID NO: 1594335 - DNA, 21 bp, Homo sapiens
tcatcaatcaaataagtattt

SEQ ID NO: 1594336 - DNA, 19 bp, Homo sapiens
tcatcaatggggccagtca

SEQ ID NO: 1594337 - DNA, 14 bp, Homo sapiens
tcatcacactgggt

SEQ ID NO: 1594338 - DNA, 21 bp, Homo sapiens
tcatcacctgctagaacctct

SEQ ID NO: 1594339 - DNA, 14 bp, Homo sapiens
tcatcactccctgg

SEQ ID NO: 1594340 - DNA, 15 bp, Homo sapiens
tcatcactccctgga

SEQ ID NO: 1594341 - DNA, 21 bp, Homo sapiens
tcatcactcttttaagatctt

SEQ ID NO: 1594342 - DNA, 14 bp, Homo sapiens
tcatcactggactg

SEQ ID NO: 1594343 - DNA, 19 bp, Homo sapiens
tcatcactggactgcatgg

SEQ ID NO: 1594344 - DNA, 20 bp, Homo sapiens
tcatcagatgcctgcttgat

SEQ ID NO: 1594345 - DNA, 19 bp, Homo sapiens
tcatcagtgttaaaaaatt

SEQ ID NO: 1594346 - DNA, 13 bp, Homo sapiens
tcatcataaaata

SEQ ID NO: 1594347 - DNA, 15 bp, Homo sapiens
tcatcataaaataaa

SEQ ID NO: 1594348 - DNA, 13 bp, Homo sapiens
tcatcatattcca

SEQ ID NO: 1594349 - DNA, 14 bp, Homo sapiens
tcatcatcctaagc

SEQ ID NO: 1594350 - DNA, 23 bp, Homo sapiens
tcatcatgaactggcttgtacat

SEQ ID NO: 1594351 - DNA, 14 bp, Homo sapiens
tcatcattccctct

SEQ ID NO: 1594352 - DNA, 17 bp, Homo sapiens
tcatcattccttgagaa

SEQ ID NO: 1594353 - DNA, 23 bp, Homo sapiens
tcatcattcttgtgggagacagc

SEQ ID NO: 1594354 - DNA, 12 bp, Homo sapiens
tcatcattgttt

SEQ ID NO: 1594355 - DNA, 18 bp, Homo sapiens
tcatcatttgtcctgttc

SEQ ID NO: 1594356 - DNA, 17 bp, Homo sapiens
tcatccacacaacacca

SEQ ID NO: 1594357 - DNA, 14 bp, Homo sapiens
tcatccacattgtt

SEQ ID NO: 1594358 - DNA, 23 bp, Homo sapiens
tcatctataaagaagaacttgca

SEQ ID NO: 1594359 - DNA, 20 bp, Homo sapiens
tcatctatggcagtccagcc

SEQ ID NO: 1594360 - DNA, 21 bp, Homo sapiens
tcatctatggcagtccagcca

SEQ ID NO: 1594361 - DNA, 23 bp, Homo sapiens
tcatctatggcagtccagccagc

SEQ ID NO: 1594362 - DNA, 15 bp, Homo sapiens
tcatctattctagca

SEQ ID NO: 1594363 - DNA, 16 bp, Homo sapiens
tcatctcaggtagaag

SEQ ID NO: 1594364 - DNA, 16 bp, Homo sapiens
tcatctccatcagctg

SEQ ID NO: 1594365 - DNA, 17 bp, Homo sapiens
tcatctccatcagctgt

SEQ ID NO: 1594366 - DNA, 16 bp, Homo sapiens
tcatctccctcctcca

SEQ ID NO: 1594367 - DNA, 18 bp, Homo sapiens
tcatctcctttattgcag

SEQ ID NO: 1594368 - DNA, 21 bp, Homo sapiens
tcatctcggctgttcctgaga

SEQ ID NO: 1594369 - DNA, 19 bp, Homo sapiens
tcatctctctacctccacc

SEQ ID NO: 1594370 - DNA, 13 bp, Homo sapiens
tcatctcttagct

SEQ ID NO: 1594371 - DNA, 21 bp, Homo sapiens
tcatctcttagctcccctcca

SEQ ID NO: 1594372 - DNA, 17 bp, Homo sapiens
tcatctgaaaagcagtt

SEQ ID NO: 1594373 - DNA, 23 bp, Homo sapiens
tcatctgaaaagcagttcatgtc

SEQ ID NO: 1594374 - DNA, 17 bp, Homo sapiens
tcatctgcatgtctact

SEQ ID NO: 1594375 - DNA, 21 bp, Homo sapiens
tcatctgctctccttcctgga

SEQ ID NO: 1594376 - DNA, 13 bp, Homo sapiens
tcatctgctggtc

SEQ ID NO: 1594377 - DNA, 23 bp, Homo sapiens
tcatctggcaacatctttatccg

SEQ ID NO: 1594378 - DNA, 23 bp, Homo sapiens
tcatctggcggaggtctctggga

SEQ ID NO: 1594379 - DNA, 13 bp, Homo sapiens
tcatctgtaactc

SEQ ID NO: 1594380 - DNA, 15 bp, Homo sapiens
tcatctgtggagctg

SEQ ID NO: 1594381 - DNA, 19 bp, Homo sapiens
tcatctgttagggccttgg

SEQ ID NO: 1594382 - DNA, 17 bp, Homo sapiens
tcatctgtttttctttt

SEQ ID NO: 1594383 - DNA, 13 bp, Homo sapiens
tcatcttaaacta

SEQ ID NO: 1594384 - DNA, 12 bp, Homo sapiens
tcatcttactgt

SEQ ID NO: 1594385 - DNA, 16 bp, Homo sapiens
tcatcttactgtacct

SEQ ID NO: 1594386 - DNA, 16 bp, Homo sapiens
tcatcttcctgtgtcc

SEQ ID NO: 1594387 - DNA, 17 bp, Homo sapiens
tcatcttgctaccagta

SEQ ID NO: 1594388 - DNA, 20 bp, Homo sapiens
tcatcttggaaaggggagga

SEQ ID NO: 1594389 - DNA, 13 bp, Homo sapiens
tcatctttaagaa

SEQ ID NO: 1594390 - DNA, 17 bp, Homo sapiens
tcatcttttattttgga

SEQ ID NO: 1594391 - DNA, 20 bp, Homo sapiens
tcatcttttattttggaact

SEQ ID NO: 1594392 - DNA, 14 bp, Homo sapiens
tcatgaaaatacca

SEQ ID NO: 1594393 - DNA, 17 bp, Homo sapiens
tcatgaaacttgtttca

SEQ ID NO: 1594394 - DNA, 14 bp, Homo sapiens
tcatgaaatatgca

SEQ ID NO: 1594395 - DNA, 15 bp, Homo sapiens
tcatgaaatgtggaa

SEQ ID NO: 1594396 - DNA, 23 bp, Homo sapiens
tcatgaacatgttcctgaattct

SEQ ID NO: 1594397 - DNA, 13 bp, Homo sapiens
tcatgaactggct

SEQ ID NO: 1594398 - DNA, 14 bp, Homo sapiens
tcatgaactggctt

SEQ ID NO: 1594399 - DNA, 20 bp, Homo sapiens
tcatgaactggcttgtacat

SEQ ID NO: 1594400 - DNA, 18 bp, Homo sapiens
tcatgaagaatgtttctg

SEQ ID NO: 1594401 - DNA, 16 bp, Homo sapiens
tcatgaagcaggaggc

SEQ ID NO: 1594402 - DNA, 12 bp, Homo sapiens
tcatgaagccca

SEQ ID NO: 1594403 - DNA, 13 bp, Homo sapiens
tcatgaagcccaa

SEQ ID NO: 1594404 - DNA, 17 bp, Homo sapiens
tcatgaagcttactttt

SEQ ID NO: 1594405 - DNA, 15 bp, Homo sapiens
tcatgaatgctttta

SEQ ID NO: 1594406 - DNA, 21 bp, Homo sapiens
tcatgaatgcttttagtgtgt

SEQ ID NO: 1594407 - DNA, 20 bp, Homo sapiens
tcatgaatgtaaatttgtac

SEQ ID NO: 1594408 - DNA, 21 bp, Homo sapiens
tcatgaatgtaaatttgtact

SEQ ID NO: 1594409 - DNA, 12 bp, Homo sapiens
tcatgaatttta

SEQ ID NO: 1594410 - DNA, 22 bp, Homo sapiens
tcatgacaagatgggacagcaa

SEQ ID NO: 1594411 - DNA, 14 bp, Homo sapiens
tcatgacagccaga

SEQ ID NO: 1594412 - DNA, 15 bp, Homo sapiens
tcatgacagccagag

SEQ ID NO: 1594413 - DNA, 19 bp, Homo sapiens
tcatgacagccagagcctg

SEQ ID NO: 1594414 - DNA, 14 bp, Homo sapiens
tcatgacagcctcc

SEQ ID NO: 1594415 - DNA, 15 bp, Homo sapiens
tcatgaccagtaaag

SEQ ID NO: 1594416 - DNA, 21 bp, Homo sapiens
tcatgacccaggatatctgaa

SEQ ID NO: 1594417 - DNA, 16 bp, Homo sapiens
tcatgagaagccaagc

SEQ ID NO: 1594418 - DNA, 16 bp, Homo sapiens
tcatgagcctgctgga

SEQ ID NO: 1594419 - DNA, 19 bp, Homo sapiens
tcatgaggagggtggggga

SEQ ID NO: 1594420 - DNA, 18 bp, Homo sapiens
tcatgataccacctttac

SEQ ID NO: 1594421 - DNA, 14 bp, Homo sapiens
tcatgatctccctg

SEQ ID NO: 1594422 - DNA, 14 bp, Homo sapiens
tcatgattagcaag

SEQ ID NO: 1594423 - DNA, 18 bp, Homo sapiens
tcatgattatagcaacta

SEQ ID NO: 1594424 - DNA, 16 bp, Homo sapiens
tcatgatttataaatg

SEQ ID NO: 1594425 - DNA, 20 bp, Homo sapiens
tcatgcaaatgctgtattct

SEQ ID NO: 1594426 - DNA, 14 bp, Homo sapiens
tcatgcaagagttt

SEQ ID NO: 1594427 - DNA, 20 bp, Homo sapiens
tcatgcaagagtttcttgta

SEQ ID NO: 1594428 - DNA, 12 bp, Homo sapiens
tcatgcagacaa

SEQ ID NO: 1594429 - DNA, 22 bp, Homo sapiens
tcatgcagacaaagccctgtcc

SEQ ID NO: 1594430 - DNA, 21 bp, Homo sapiens
tcatgcagagtatttctaaag

SEQ ID NO: 1594431 - DNA, 14 bp, Homo sapiens
tcatgcagccgtga

SEQ ID NO: 1594432 - DNA, 14 bp, Homo sapiens
tcatgcagctgtgg

SEQ ID NO: 1594433 - DNA, 16 bp, Homo sapiens
tcatgcagttcctggc

SEQ ID NO: 1594434 - DNA, 18 bp, Homo sapiens
tcatgcatagtcccagct

SEQ ID NO: 1594435 - DNA, 22 bp, Homo sapiens
tcatgccaccatggccagccaa

SEQ ID NO: 1594436 - DNA, 11 bp, Homo sapiens
tcatgccatct

SEQ ID NO: 1594437 - DNA, 16 bp, Homo sapiens
tcatgccatctgtttt

SEQ ID NO: 1594438 - DNA, 16 bp, Homo sapiens
tcatgcccaccccctg

SEQ ID NO: 1594439 - DNA, 20 bp, Homo sapiens
tcatgcccaccccctgccct

SEQ ID NO: 1594440 - DNA, 23 bp, Homo sapiens
tcatgcccaccccctgccctgca

SEQ ID NO: 1594441 - DNA, 14 bp, Homo sapiens
tcatgcccagctct

SEQ ID NO: 1594442 - DNA, 15 bp, Homo sapiens
tcatgcccagctctc

SEQ ID NO: 1594443 - DNA, 22 bp, Homo sapiens
tcatgcccccctcaaacctcct

SEQ ID NO: 1594444 - DNA, 15 bp, Homo sapiens
tcatgcccttctgat

SEQ ID NO: 1594445 - DNA, 13 bp, Homo sapiens
tcatgcctttgta

SEQ ID NO: 1594446 - DNA, 21 bp, Homo sapiens
tcatgcgttttatatcttcct

SEQ ID NO: 1594447 - DNA, 13 bp, Homo sapiens
tcatgctacagaa

SEQ ID NO: 1594448 - DNA, 22 bp, Homo sapiens
tcatgctatatatcttttgtaa

SEQ ID NO: 1594449 - DNA, 18 bp, Homo sapiens
tcatgctcagccttgctg

SEQ ID NO: 1594450 - DNA, 18 bp, Homo sapiens
tcatgctccactatttta

SEQ ID NO: 1594451 - DNA, 17 bp, Homo sapiens
tcatgctggagggaggc

SEQ ID NO: 1594452 - DNA, 17 bp, Homo sapiens
tcatggaaactggccag

SEQ ID NO: 1594453 - DNA, 22 bp, Homo sapiens
tccaagggcccggtttcccggc

SEQ ID NO: 1594454 - DNA, 19 bp, Homo sapiens
tccaagggccgtgcccttg

SEQ ID NO: 1594455 - DNA, 21 bp, Homo sapiens
tccaagggtttcgactggtcc

SEQ ID NO: 1594456 - DNA, 23 bp, Homo sapiens
tccaagggtttcgactggtccag

SEQ ID NO: 1594457 - DNA, 16 bp, Homo sapiens
tccaaggtgatgttgt

SEQ ID NO: 1594458 - DNA, 14 bp, Homo sapiens
tccaaggtttaaag

SEQ ID NO: 1594459 - DNA, 16 bp, Homo sapiens
tccaaggtttaaagag

SEQ ID NO: 1594460 - DNA, 22 bp, Homo sapiens
tccaaggtttaaagagtctaga

SEQ ID NO: 1594461 - DNA, 18 bp, Homo sapiens
tccaagtgccagaggtgg

SEQ ID NO: 1594462 - DNA, 17 bp, Homo sapiens
tccaatatgtgattttt

SEQ ID NO: 1594463 - DNA, 15 bp, Homo sapiens
tccaatcctcactgg

SEQ ID NO: 1594464 - DNA, 18 bp, Homo sapiens
tccaatcctcactgggtg

SEQ ID NO: 1594465 - DNA, 17 bp, Homo sapiens
tccaatgcctcttgtct

SEQ ID NO: 1594466 - DNA, 21 bp, Homo sapiens
tccaatgcctcttgtcttcct

SEQ ID NO: 1594467 - DNA, 17 bp, Homo sapiens
tccaatggggccagcac

SEQ ID NO: 1594468 - DNA, 14 bp, Homo sapiens
tccaatgtcttttg

SEQ ID NO: 1594469 - DNA, 23 bp, Homo sapiens
tccaatgtgaagttcatcttgca

SEQ ID NO: 1594470 - DNA, 21 bp, Homo sapiens
tccaattaattagtaaggatt

SEQ ID NO: 1594471 - DNA, 23 bp, Homo sapiens
tccaattagtttcctttttaata

SEQ ID NO: 1594472 - DNA, 13 bp, Homo sapiens
tccaattccactg

SEQ ID NO: 1594473 - DNA, 22 bp, Homo sapiens
tccaattgatgtatatgtttat

SEQ ID NO: 1594474 - DNA, 18 bp, Homo sapiens
tccaatttgtaagtaaca

SEQ ID NO: 1594475 - DNA, 14 bp, Homo sapiens
tccaattttctgga

SEQ ID NO: 1594476 - DNA, 17 bp, Homo sapiens
tccacaagattcccaga

SEQ ID NO: 1594477 - DNA, 23 bp, Homo sapiens
tccacaagattcccagagacagg

SEQ ID NO: 1594478 - DNA, 17 bp, Homo sapiens
tccacaagttaaataaa

SEQ ID NO: 1594479 - DNA, 18 bp, Homo sapiens
tccacaagttaaataaat

SEQ ID NO: 1594480 - DNA, 15 bp, Homo sapiens
tccacacaacaccag

SEQ ID NO: 1594481 - DNA, 19 bp, Homo sapiens
tccacacaacaccaggact

SEQ ID NO: 1594482 - DNA, 19 bp, Homo sapiens
tccacacacagaggaagag

SEQ ID NO: 1594483 - DNA, 17 bp, Homo sapiens
tccacacagcagtgtcc

SEQ ID NO: 1594484 - DNA, 21 bp, Homo sapiens
tccacacagcagtgtcccctg

SEQ ID NO: 1594485 - DNA, 23 bp, Homo sapiens
tccacacagcagtgtcccctgcc

SEQ ID NO: 1594486 - DNA, 16 bp, Homo sapiens
tccacacccgtgagaa

SEQ ID NO: 1594487 - DNA, 20 bp, Homo sapiens
tccacagagtgagccagtga

SEQ ID NO: 1594488 - DNA, 21 bp, Homo sapiens
tccacagccccaacctcccac

SEQ ID NO: 1594489 - DNA, 19 bp, Homo sapiens
tccacagcgagggcagctg

SEQ ID NO: 1594490 - DNA, 12 bp, Homo sapiens
tccacagctgca

SEQ ID NO: 1594491 - DNA, 14 bp, Homo sapiens
tccacagctgcagc

SEQ ID NO: 1594492 - DNA, 16 bp, Homo sapiens
tccacagctgcagctg

SEQ ID NO: 1594493 - DNA, 23 bp, Homo sapiens
tccacaggggcaggcctgggacc

SEQ ID NO: 1594494 - DNA, 14 bp, Homo sapiens
tccacaggggccac

SEQ ID NO: 1594495 - DNA, 14 bp, Homo sapiens
tccacaggtctaga

SEQ ID NO: 1594496 - DNA, 13 bp, Homo sapiens
tccacagtgctgc

SEQ ID NO: 1594497 - DNA, 19 bp, Homo sapiens
tccacagtgttgtgcccct

SEQ ID NO: 1594498 - DNA, 15 bp, Homo sapiens
tccacatccccagag

SEQ ID NO: 1594499 - DNA, 17 bp, Homo sapiens
tccacatccccagagcc

SEQ ID NO: 1594500 - DNA, 22 bp, Homo sapiens
tccacatccccagagcccagct

SEQ ID NO: 1594501 - DNA, 22 bp, Homo sapiens
tccacatcctttctaaacaaga

SEQ ID NO: 1594502 - DNA, 15 bp, Homo sapiens
tccacatctgcatca

SEQ ID NO: 1594503 - DNA, 14 bp, Homo sapiens
tccacatctgcctt

SEQ ID NO: 1594504 - DNA, 23 bp, Homo sapiens
tccacatctgtttcaaactgaat

SEQ ID NO: 1594505 - DNA, 15 bp, Homo sapiens
tccacatgacctcca

SEQ ID NO: 1594506 - DNA, 15 bp, Homo sapiens
tccacatttctaaaa

SEQ ID NO: 1594507 - DNA, 20 bp, Homo sapiens
tccaccaagggtatctgctg

SEQ ID NO: 1594508 - DNA, 13 bp, Homo sapiens
tccaccaccttgc

SEQ ID NO: 1594509 - DNA, 15 bp, Homo sapiens
tccaccaccttgcca

SEQ ID NO: 1594510 - DNA, 15 bp, Homo sapiens
tccaccagcagcatg

SEQ ID NO: 1594511 - DNA, 14 bp, Homo sapiens
tccaccagcctgca

SEQ ID NO: 1594512 - DNA, 16 bp, Homo sapiens
tccaccagcctgctga

SEQ ID NO: 1594513 - DNA, 16 bp, Homo sapiens
tccaccaggattaatc

SEQ ID NO: 1594514 - DNA, 15 bp, Homo sapiens
tccaccatgcactca

SEQ ID NO: 1594515 - DNA, 12 bp, Homo sapiens
tccacccacccc

SEQ ID NO: 1594516 - DNA, 15 bp, Homo sapiens
tccacccaccccctt

SEQ ID NO: 1594517 - DNA, 14 bp, Homo sapiens
tccacccagcccat

SEQ ID NO: 1594518 - DNA, 13 bp, Homo sapiens
tccacccaggctg

SEQ ID NO: 1594519 - DNA, 20 bp, Homo sapiens
tccacccaggctgcactgca

SEQ ID NO: 1594520 - DNA, 24 bp, Homo sapiens
tccacccaggctgcactgcagtga

SEQ ID NO: 1594521 - DNA, 13 bp, Homo sapiens
tccacccagtgct

SEQ ID NO: 1594522 - DNA, 14 bp, Homo sapiens
tccacccagtgctg

SEQ ID NO: 1594523 - DNA, 17 bp, Homo sapiens
tccacccagtgctgcca

SEQ ID NO: 1594524 - DNA, 19 bp, Homo sapiens
tccacccagtgctgccatg

SEQ ID NO: 1594525 - DNA, 20 bp, Homo sapiens
tccacccataataagagaat

SEQ ID NO: 1594526 - DNA, 12 bp, Homo sapiens
tccaccccatcc

SEQ ID NO: 1594527 - DNA, 17 bp, Homo sapiens
tccaccccccacgtctg

SEQ ID NO: 1594528 - DNA, 20 bp, Homo sapiens
tccaccccccacgtctgtcc

SEQ ID NO: 1594529 - DNA, 23 bp, Homo sapiens
tccaccccccagaacctgtcctt

SEQ ID NO: 1594530 - DNA, 21 bp, Homo sapiens
tccacccccgccacggccacc

SEQ ID NO: 1594531 - DNA, 19 bp, Homo sapiens
tccacccgggggagcccag

SEQ ID NO: 1594532 - DNA, 20 bp, Homo sapiens
tccaccctcatttctgccag

SEQ ID NO: 1594533 - DNA, 22 bp, Homo sapiens
tccaccctcatttctgccagcg

SEQ ID NO: 1594534 - DNA, 13 bp, Homo sapiens
tccaccctccacc

SEQ ID NO: 1594535 - DNA, 18 bp, Homo sapiens
tccaccctccaccttcca

SEQ ID NO: 1594536 - DNA, 17 bp, Homo sapiens
tccactcactccagccc

SEQ ID NO: 1594537 - DNA, 18 bp, Homo sapiens
tccactcgacccagaatg

SEQ ID NO: 1594538 - DNA, 19 bp, Homo sapiens
tccactcgatgatgcttct

SEQ ID NO: 1594539 - DNA, 19 bp, Homo sapiens
tccactcgtccaagggaca

SEQ ID NO: 1594540 - DNA, 17 bp, Homo sapiens
tccactctaccctccca

SEQ ID NO: 1594541 - DNA, 21 bp, Homo sapiens
tccactctaccctcccacccc

SEQ ID NO: 1594542 - DNA, 14 bp, Homo sapiens
tccactctagttct

SEQ ID NO: 1594543 - DNA, 14 bp, Homo sapiens
tccactctccccca

SEQ ID NO: 1594544 - DNA, 22 bp, Homo sapiens
tccactctcccccaccccctcc

SEQ ID NO: 1594545 - DNA, 21 bp, Homo sapiens
tccactctcggggcccttggg

SEQ ID NO: 1594546 - DNA, 12 bp, Homo sapiens
tccactctgatt

SEQ ID NO: 1594547 - DNA, 22 bp, Homo sapiens
tccactctgattcacctcttcc

SEQ ID NO: 1594548 - DNA, 21 bp, Homo sapiens
tccactgacaaacgtccccag

SEQ ID NO: 1594549 - DNA, 22 bp, Homo sapiens
tccactgagactttcccctctc

SEQ ID NO: 1594550 - DNA, 15 bp, Homo sapiens
tccactgccctggca

SEQ ID NO: 1594551 - DNA, 20 bp, Homo sapiens
tccactgccctggcagcagc

SEQ ID NO: 1594552 - DNA, 12 bp, Homo sapiens
tccactgcctgg

SEQ ID NO: 1594553 - DNA, 18 bp, Homo sapiens
tccactgctctcagcctc

SEQ ID NO: 1594554 - DNA, 17 bp, Homo sapiens
tccactggacttgagct

SEQ ID NO: 1594555 - DNA, 23 bp, Homo sapiens
tccactggcttttgcctgtaaga

SEQ ID NO: 1594556 - DNA, 12 bp, Homo sapiens
tccactgtgtat

SEQ ID NO: 1594557 - DNA, 20 bp, Homo sapiens
tccactgtgtatagaagtag

SEQ ID NO: 1594558 - DNA, 19 bp, Homo sapiens
tccactgttgagccccagt

SEQ ID NO: 1594559 - DNA, 23 bp, Homo sapiens
tccactgttgagccccagtgctg

SEQ ID NO: 1594560 - DNA, 18 bp, Homo sapiens
tccacttcccgtctcaga

SEQ ID NO: 1594561 - DNA, 19 bp, Homo sapiens
tccacttcccgtctcagaa

SEQ ID NO: 1594562 - DNA, 20 bp, Homo sapiens
tccacttcccgtctcagaat

SEQ ID NO: 1594563 - DNA, 17 bp, Homo sapiens
tccacttgtgggcttca

SEQ ID NO: 1594564 - DNA, 14 bp, Homo sapiens
tccacttgtttgca

SEQ ID NO: 1594565 - DNA, 16 bp, Homo sapiens
tccacttgtttgcact

SEQ ID NO: 1594566 - DNA, 23 bp, Homo sapiens
tccactttgtttcgtggggaggt

SEQ ID NO: 1594567 - DNA, 14 bp, Homo sapiens
tccagaaaactgtg

SEQ ID NO: 1594568 - DNA, 23 bp, Homo sapiens
tccagaaaactgtgatttcagga

SEQ ID NO: 1594569 - DNA, 16 bp, Homo sapiens
tccagaaactcctgtt

SEQ ID NO: 1594570 - DNA, 20 bp, Homo sapiens
tccagaaactcctgtttctc

SEQ ID NO: 1594571 - DNA, 19 bp, Homo sapiens
tccagaaagcaggagcagc

SEQ ID NO: 1594572 - DNA, 23 bp, Homo sapiens
tccagaaatgtctaaatgctgaa

SEQ ID NO: 1594573 - DNA, 20 bp, Homo sapiens
tccagaacacggctcacgct

SEQ ID NO: 1594574 - DNA, 22 bp, Homo sapiens
tccagaactcactggggcctac

SEQ ID NO: 1594575 - DNA, 18 bp, Homo sapiens
tccagaagaagagaagct

SEQ ID NO: 1594576 - DNA, 20 bp, Homo sapiens
tccagaagaagagaagctgc

SEQ ID NO: 1594577 - DNA, 16 bp, Homo sapiens
tccagaagaatattca

SEQ ID NO: 1594578 - DNA, 18 bp, Homo sapiens
tccagaagaatattcagg

SEQ ID NO: 1594579 - DNA, 19 bp, Homo sapiens
tccagaagaatattcagga

SEQ ID NO: 1594580 - DNA, 20 bp, Homo sapiens
tccagaagatgccagcttct

SEQ ID NO: 1594581 - DNA, 16 bp, Homo sapiens
tccagaagcctctggc

SEQ ID NO: 1594582 - DNA, 16 bp, Homo sapiens
tccagaatctgctgtt

SEQ ID NO: 1594583 - DNA, 16 bp, Homo sapiens
tccagaattgaccttt

SEQ ID NO: 1594584 - DNA, 22 bp, Homo sapiens
tccagaatttattagtttaaaa

SEQ ID NO: 1594585 - DNA, 13 bp, Homo sapiens
tccagacccctgg

SEQ ID NO: 1594586 - DNA, 15 bp, Homo sapiens
tccagacccctggct

SEQ ID NO: 1594587 - DNA, 19 bp, Homo sapiens
tccagaccctgcctgagcc

SEQ ID NO: 1594588 - DNA, 14 bp, Homo sapiens
tccagacctggctc

SEQ ID NO: 1594589 - DNA, 14 bp, Homo sapiens
tccagagacaacag

SEQ ID NO: 1594590 - DNA, 15 bp, Homo sapiens
tccagagacaacagg

SEQ ID NO: 1594591 - DNA, 20 bp, Homo sapiens
tccagagacagggaaaggtc

SEQ ID NO: 1594592 - DNA, 18 bp, Homo sapiens
tccagagaccacaccact

SEQ ID NO: 1594593 - DNA, 16 bp, Homo sapiens
tccagagagtggctcc

SEQ ID NO: 1594594 - DNA, 17 bp, Homo sapiens
tccagagccagcctggg

SEQ ID NO: 1594595 - DNA, 18 bp, Homo sapiens
tccagagccagcctggga

SEQ ID NO: 1594596 - DNA, 16 bp, Homo sapiens
tccagagcttgtgctc

SEQ ID NO: 1594597 - DNA, 20 bp, Homo sapiens
tccagaggctattattttca

SEQ ID NO: 1594598 - DNA, 17 bp, Homo sapiens
tccagaggggtcacgtg

SEQ ID NO: 1594599 - DNA, 14 bp, Homo sapiens
tccagagtctgagc

SEQ ID NO: 1594600 - DNA, 22 bp, Homo sapiens
tccagagtctgagcccccggct

SEQ ID NO: 1594601 - DNA, 16 bp, Homo sapiens
tccagagtgctgaggc

SEQ ID NO: 1594602 - DNA, 22 bp, Homo sapiens
tccagagttaaaatgtttactg

SEQ ID NO: 1594603 - DNA, 17 bp, Homo sapiens
tccagataactctcttt

SEQ ID NO: 1594604 - DNA, 19 bp, Homo sapiens
tccagataactctctttcc

SEQ ID NO: 1594605 - DNA, 20 bp, Homo sapiens
tccagataactctctttcct

SEQ ID NO: 1594606 - DNA, 21 bp, Homo sapiens
tccagatggcccccagctggt

SEQ ID NO: 1594607 - DNA, 18 bp, Homo sapiens
tccagatgtttccagact

SEQ ID NO: 1594608 - DNA, 17 bp, Homo sapiens
tccagattagagcctgt

SEQ ID NO: 1594609 - DNA, 17 bp, Homo sapiens
tccagattctgatgcat

SEQ ID NO: 1594610 - DNA, 17 bp, Homo sapiens
tccagattgacgacaag

SEQ ID NO: 1594611 - DNA, 11 bp, Homo sapiens
tccagattgta

SEQ ID NO: 1594612 - DNA, 16 bp, Homo sapiens
tccagcaacacagcct

SEQ ID NO: 1594613 - DNA, 20 bp, Homo sapiens
tccagcaacacagcctgggc

SEQ ID NO: 1594614 - DNA, 22 bp, Homo sapiens
tccagcaacacagcctgggccc

SEQ ID NO: 1594615 - DNA, 20 bp, Homo sapiens
tccagcaactgcccttccag

SEQ ID NO: 1594616 - DNA, 18 bp, Homo sapiens
tccagcaattctcctgcc

SEQ ID NO: 1594617 - DNA, 19 bp, Homo sapiens
tccagcaattctcctgcct

SEQ ID NO: 1594618 - DNA, 22 bp, Homo sapiens
tccagcaccttgtgcctggggt

SEQ ID NO: 1594619 - DNA, 12 bp, Homo sapiens
tccagcactggt

SEQ ID NO: 1594620 - DNA, 12 bp, Homo sapiens
tccagcagcaca

SEQ ID NO: 1594621 - DNA, 23 bp, Homo sapiens
tccagcagcacacctcagcccca

SEQ ID NO: 1594622 - DNA, 13 bp, Homo sapiens
tccagcagctgcg

SEQ ID NO: 1594623 - DNA, 12 bp, Homo sapiens
tccagcagttgt

SEQ ID NO: 1594624 - DNA, 14 bp, Homo sapiens
tccagcatccagcc

SEQ ID NO: 1594625 - DNA, 15 bp, Homo sapiens
tccagcatccagcct

SEQ ID NO: 1594626 - DNA, 16 bp, Homo sapiens
tccagcatccagcctg

SEQ ID NO: 1594627 - DNA, 18 bp, Homo sapiens
tccagcatccagcctgtg

SEQ ID NO: 1594628 - DNA, 17 bp, Homo sapiens
tccagcatttttataaa

SEQ ID NO: 1594629 - DNA, 13 bp, Homo sapiens
tccagccacctag

SEQ ID NO: 1594630 - DNA, 21 bp, Homo sapiens
tccagccagctcctgggcagc

SEQ ID NO: 1594631 - DNA, 15 bp, Homo sapiens
tccagcccacattgg

SEQ ID NO: 1594632 - DNA, 23 bp, Homo sapiens
tccagcccctctggtcgctcctg

SEQ ID NO: 1594633 - DNA, 16 bp, Homo sapiens
tccagcccctgtccca

SEQ ID NO: 1594634 - DNA, 18 bp, Homo sapiens
tccagccctgtcccctga

SEQ ID NO: 1594635 - DNA, 23 bp, Homo sapiens
tccagccgccattgccaccagga

SEQ ID NO: 1594636 - DNA, 16 bp, Homo sapiens
tccagccgctggcaac

SEQ ID NO: 1594637 - DNA, 22 bp, Homo sapiens
tccagccgctggcaacaacagc

SEQ ID NO: 1594638 - DNA, 15 bp, Homo sapiens
tccagcctccagggc

SEQ ID NO: 1594639 - DNA, 16 bp, Homo sapiens
tccagcctccagggca

SEQ ID NO: 1594640 - DNA, 16 bp, Homo sapiens
tccagcctccctgtct

SEQ ID NO: 1594641 - DNA, 19 bp, Homo sapiens
tccagcctccctgtctcca

SEQ ID NO: 1594642 - DNA, 20 bp, Homo sapiens
tccagcctccctgtctccag

SEQ ID NO: 1594643 - DNA, 16 bp, Homo sapiens
tccagcctctcccggc

SEQ ID NO: 1594644 - DNA, 23 bp, Homo sapiens
tccagcctctcccggctgcctgc

SEQ ID NO: 1594645 - DNA, 21 bp, Homo sapiens
tccagcctgggcaacaagagc

SEQ ID NO: 1594646 - DNA, 20 bp, Homo sapiens
tccagcctgggcaacagagc

SEQ ID NO: 1594647 - DNA, 19 bp, Homo sapiens
tccagcctgggcagccagg

SEQ ID NO: 1594648 - DNA, 13 bp, Homo sapiens
tccagcctgggcg

SEQ ID NO: 1594649 - DNA, 17 bp, Homo sapiens
tccagcctgggcgacag

SEQ ID NO: 1594650 - DNA, 13 bp, Homo sapiens
tccagcctgggga

SEQ ID NO: 1594651 - DNA, 20 bp, Homo sapiens
tccagcctgggtcacagagt

SEQ ID NO: 1594652 - DNA, 16 bp, Homo sapiens
tccatgtgcctttctt

SEQ ID NO: 1594653 - DNA, 18 bp, Homo sapiens
tccatgtggacttaggaa

SEQ ID NO: 1594654 - DNA, 13 bp, Homo sapiens
tccattaaatggt

SEQ ID NO: 1594655 - DNA, 17 bp, Homo sapiens
tccattacctccatcca

SEQ ID NO: 1594656 - DNA, 18 bp, Homo sapiens
tccattacctccatccat

SEQ ID NO: 1594657 - DNA, 21 bp, Homo sapiens
tccattacctccatccatcct

SEQ ID NO: 1594658 - DNA, 13 bp, Homo sapiens
tccattactgtga

SEQ ID NO: 1594659 - DNA, 20 bp, Homo sapiens
tccattactgtgatttctgg

SEQ ID NO: 1594660 - DNA, 20 bp, Homo sapiens
tccattagaaaattttgtaa

SEQ ID NO: 1594661 - DNA, 14 bp, Homo sapiens
tccattaggatttg

SEQ ID NO: 1594662 - DNA, 14 bp, Homo sapiens
tccattcagatgaa

SEQ ID NO: 1594663 - DNA, 16 bp, Homo sapiens
tccattcatccttcca

SEQ ID NO: 1594664 - DNA, 21 bp, Homo sapiens
tccattccacacagaatgcaa

SEQ ID NO: 1594665 - DNA, 13 bp, Homo sapiens
tccattcctcagg

SEQ ID NO: 1594666 - DNA, 15 bp, Homo sapiens
tccattcctcaggga

SEQ ID NO: 1594667 - DNA, 13 bp, Homo sapiens
tccattctttcag

SEQ ID NO: 1594668 - DNA, 22 bp, Homo sapiens
tccattgaagccgactctggcc

SEQ ID NO: 1594669 - DNA, 14 bp, Homo sapiens
tccattgaccagct

SEQ ID NO: 1594670 - DNA, 12 bp, Homo sapiens
tccattgatttt

SEQ ID NO: 1594671 - DNA, 18 bp, Homo sapiens
tccattggtccaagattc

SEQ ID NO: 1594672 - DNA, 19 bp, Homo sapiens
tccattggtccaagattcc

SEQ ID NO: 1594673 - DNA, 16 bp, Homo sapiens
tccattgttgtgtctg

SEQ ID NO: 1594674 - DNA, 20 bp, Homo sapiens
tccatttagttctttgttat

SEQ ID NO: 1594675 - DNA, 23 bp, Homo sapiens
tccatttcatctatttctgagaa

SEQ ID NO: 1594676 - DNA, 20 bp, Homo sapiens
tccatttccagttcatctat

SEQ ID NO: 1594677 - DNA, 17 bp, Homo sapiens
tccatttcccacatctt

SEQ ID NO: 1594678 - DNA, 17 bp, Homo sapiens
tccatttgtattcaaat

SEQ ID NO: 1594679 - DNA, 15 bp, Homo sapiens
tccatttgttcctgc

SEQ ID NO: 1594680 - DNA, 14 bp, Homo sapiens
tccattttatgcag

SEQ ID NO: 1594681 - DNA, 14 bp, Homo sapiens
tccattttcaagct

SEQ ID NO: 1594682 - DNA, 14 bp, Homo sapiens
tccattttccccca

SEQ ID NO: 1594683 - DNA, 11 bp, Homo sapiens
tccattttcta

SEQ ID NO: 1594684 - DNA, 22 bp, Homo sapiens
tccattttcttattgcgctgct

SEQ ID NO: 1594685 - DNA, 18 bp, Homo sapiens
tccatttttcctctgttc

SEQ ID NO: 1594686 - DNA, 13 bp, Homo sapiens
tccatttttttct

SEQ ID NO: 1594687 - DNA, 16 bp, Homo sapiens
tccatttttttcttta

SEQ ID NO: 1594688 - DNA, 15 bp, Homo sapiens
tcccaaaattgtttt

SEQ ID NO: 1594689 - DNA, 14 bp, Homo sapiens
tcccaaacccagtc

SEQ ID NO: 1594690 - DNA, 15 bp, Homo sapiens
tcccaaacgcctccc

SEQ ID NO: 1594691 - DNA, 14 bp, Homo sapiens
tcccaaagggcaca

SEQ ID NO: 1594692 - DNA, 17 bp, Homo sapiens
tcccaaagtcctctgct

SEQ ID NO: 1594693 - DNA, 18 bp, Homo sapiens
tcccaaagtcctctgctc

SEQ ID NO: 1594694 - DNA, 19 bp, Homo sapiens
tcccaaagtcctctgctcc

SEQ ID NO: 1594695 - DNA, 23 bp, Homo sapiens
tcccaaagtcctctgctccagca

SEQ ID NO: 1594696 - DNA, 18 bp, Homo sapiens
tcccaaagtgctgagatt

SEQ ID NO: 1594697 - DNA, 19 bp, Homo sapiens
tcccaaagtgctgagatta

SEQ ID NO: 1594698 - DNA, 23 bp, Homo sapiens
tcccaaagtgctgggattacaga

SEQ ID NO: 1594699 - DNA, 17 bp, Homo sapiens
tcccaaatctgtcagca

SEQ ID NO: 1594700 - DNA, 16 bp, Homo sapiens
tcccaaatttcatacc

SEQ ID NO: 1594701 - DNA, 14 bp, Homo sapiens
tcccaacaacatga

SEQ ID NO: 1594702 - DNA, 16 bp, Homo sapiens
tcccaacaacatgaaa

SEQ ID NO: 1594703 - DNA, 17 bp, Homo sapiens
tcccaacagaggcctcc

SEQ ID NO: 1594704 - DNA, 15 bp, Homo sapiens
tcccaaccaggcacc

SEQ ID NO: 1594705 - DNA, 15 bp, Homo sapiens
tcccaaccccagggc

SEQ ID NO: 1594706 - DNA, 15 bp, Homo sapiens
tcccaacccccctcc

SEQ ID NO: 1594707 - DNA, 20 bp, Homo sapiens
tcccaacccccctcctgctc

SEQ ID NO: 1594708 - DNA, 15 bp, Homo sapiens
tcccaaccctggctt

SEQ ID NO: 1594709 - DNA, 23 bp, Homo sapiens
tcccaaccctgggctggggagga

SEQ ID NO: 1594710 - DNA, 21 bp, Homo sapiens
tcccaacctcaatgccctgcc

SEQ ID NO: 1594711 - DNA, 20 bp, Homo sapiens
tcccaacgtgcaaagccaag

SEQ ID NO: 1594712 - DNA, 10 bp, Homo sapiens
tcccaactcc

SEQ ID NO: 1594713 - DNA, 17 bp, Homo sapiens
tcccaactcctataatt

SEQ ID NO: 1594714 - DNA, 17 bp, Homo sapiens
tcccaacttcttcctgt

SEQ ID NO: 1594715 - DNA, 20 bp, Homo sapiens
tcccaacttgcctttgaaga

SEQ ID NO: 1594716 - DNA, 21 bp, Homo sapiens
tcccaagcacctgggattaca

SEQ ID NO: 1594717 - DNA, 17 bp, Homo sapiens
tcccaagccgggagcca

SEQ ID NO: 1594718 - DNA, 18 bp, Homo sapiens
tcccaaggaaagccccag

SEQ ID NO: 1594719 - DNA, 18 bp, Homo sapiens
tccccaacttccctagtc

SEQ ID NO: 1594720 - DNA, 13 bp, Homo sapiens
tccccaaggcctc

SEQ ID NO: 1594721 - DNA, 14 bp, Homo sapiens
tccccaaggcctct

SEQ ID NO: 1594722 - DNA, 17 bp, Homo sapiens
tccccaagggccctggc

SEQ ID NO: 1594723 - DNA, 23 bp, Homo sapiens
tccccaatatcttgcttgaactt

SEQ ID NO: 1594724 - DNA, 10 bp, Homo sapiens
tccccacact

SEQ ID NO: 1594725 - DNA, 13 bp, Homo sapiens
tccccacactcca

SEQ ID NO: 1594726 - DNA, 20 bp, Homo sapiens
tccccacactccactctgat

SEQ ID NO: 1594727 - DNA, 17 bp, Homo sapiens
tccccacagcgtccctg

SEQ ID NO: 1594728 - DNA, 20 bp, Homo sapiens
tccccacagcgtccctggcg

SEQ ID NO: 1594729 - DNA, 18 bp, Homo sapiens
tccccacaggagccctgc

SEQ ID NO: 1594730 - DNA, 15 bp, Homo sapiens
tccccacagtgccac

SEQ ID NO: 1594731 - DNA, 17 bp, Homo sapiens
tccccacagtgccaccc

SEQ ID NO: 1594732 - DNA, 13 bp, Homo sapiens
tccccacccgcct

SEQ ID NO: 1594733 - DNA, 14 bp, Homo sapiens
tccccaccctccac

SEQ ID NO: 1594734 - DNA, 16 bp, Homo sapiens
tccccaccctccactc

SEQ ID NO: 1594735 - DNA, 15 bp, Homo sapiens
tccccacctacccag

SEQ ID NO: 1594736 - DNA, 20 bp, Homo sapiens
tccccaccttcaattcctgg

SEQ ID NO: 1594737 - DNA, 15 bp, Homo sapiens
tccccacgagggctg

SEQ ID NO: 1594738 - DNA, 20 bp, Homo sapiens
tccccacgagggctggctgg

SEQ ID NO: 1594739 - DNA, 18 bp, Homo sapiens
tccccacgagtcacctgc

SEQ ID NO: 1594740 - DNA, 21 bp, Homo sapiens
tccccacgagtcacctgcaag

SEQ ID NO: 1594741 - DNA, 22 bp, Homo sapiens
tccccacgagtcacctgcaagc

SEQ ID NO: 1594742 - DNA, 23 bp, Homo sapiens
tccccactcccccgtttctcctt

SEQ ID NO: 1594743 - DNA, 22 bp, Homo sapiens
tccccactccctggctctcaga

SEQ ID NO: 1594744 - DNA, 16 bp, Homo sapiens
tccccactgacagcct

SEQ ID NO: 1594745 - DNA, 19 bp, Homo sapiens
tccccacttgcagccctgt

SEQ ID NO: 1594746 - DNA, 21 bp, Homo sapiens
tccccacttgtccgctgggtg

SEQ ID NO: 1594747 - DNA, 17 bp, Homo sapiens
tccccagaaaggagact

SEQ ID NO: 1594748 - DNA, 15 bp, Homo sapiens
tccccagagcccagc

SEQ ID NO: 1594749 - DNA, 17 bp, Homo sapiens
tccccagagcccagctc

SEQ ID NO: 1594750 - DNA, 19 bp, Homo sapiens
tccccagagcccagctctt

SEQ ID NO: 1594751 - DNA, 21 bp, Homo sapiens
tccccagagcccagctcttgc

SEQ ID NO: 1594752 - DNA, 14 bp, Homo sapiens
tccccagagctgtg

SEQ ID NO: 1594753 - DNA, 14 bp, Homo sapiens
tccccagaggctcc

SEQ ID NO: 1594754 - DNA, 14 bp, Homo sapiens
tccccagccacagg

SEQ ID NO: 1594755 - DNA, 12 bp, Homo sapiens
tccccagccaga

SEQ ID NO: 1594756 - DNA, 16 bp, Homo sapiens
tccccagcccagagac

SEQ ID NO: 1594757 - DNA, 17 bp, Homo sapiens
tccccagcccagagaca

SEQ ID NO: 1594758 - DNA, 15 bp, Homo sapiens
tccccagccccaccc

SEQ ID NO: 1594759 - DNA, 24 bp, Homo sapiens
tccccagccccagccccttccatg

SEQ ID NO: 1594760 - DNA, 22 bp, Homo sapiens
tccccagcccttctgcctttct

SEQ ID NO: 1594761 - DNA, 17 bp, Homo sapiens
tccccagctccccagga

SEQ ID NO: 1594762 - DNA, 22 bp, Homo sapiens
tccccagctcttctcttcctag

SEQ ID NO: 1594763 - DNA, 14 bp, Homo sapiens
tccccaggactcac

SEQ ID NO: 1594764 - DNA, 17 bp, Homo sapiens
tccccaggactcaccct

SEQ ID NO: 1594765 - DNA, 12 bp, Homo sapiens
tccccaggagca

SEQ ID NO: 1594766 - DNA, 21 bp, Homo sapiens
tccccaggcatttgccaaggg

SEQ ID NO: 1594767 - DNA, 15 bp, Homo sapiens
tccccaggccaggtc

SEQ ID NO: 1594768 - DNA, 19 bp, Homo sapiens
tccccaggccaggtccctg

SEQ ID NO: 1594769 - DNA, 14 bp, Homo sapiens
tccccaggcccacc

SEQ ID NO: 1594770 - DNA, 15 bp, Homo sapiens
tccccaggcctccag

SEQ ID NO: 1594771 - DNA, 19 bp, Homo sapiens
tccccaggcctccagcctc

SEQ ID NO: 1594772 - DNA, 16 bp, Homo sapiens
tccccagggaaggaaa

SEQ ID NO: 1594773 - DNA, 20 bp, Homo sapiens
tccccagggagctctgggga

SEQ ID NO: 1594774 - DNA, 12 bp, Homo sapiens
tccccagggccc

SEQ ID NO: 1594775 - DNA, 10 bp, Homo sapiens
tccccagggg

SEQ ID NO: 1594776 - DNA, 23 bp, Homo sapiens
tccccaggggtcccagccacccc

SEQ ID NO: 1594777 - DNA, 14 bp, Homo sapiens
tccagtataaccag

SEQ ID NO: 1594778 - DNA, 21 bp, Homo sapiens
tccagtataagactactgaat

SEQ ID NO: 1594779 - DNA, 18 bp, Homo sapiens
tccagtcaaatctgggct

SEQ ID NO: 1594780 - DNA, 22 bp, Homo sapiens
tccagtcaacaaactatttctt

SEQ ID NO: 1594781 - DNA, 15 bp, Homo sapiens
tccagtcgggaggag

SEQ ID NO: 1594782 - DNA, 13 bp, Homo sapiens
tccagtctattca

SEQ ID NO: 1594783 - DNA, 10 bp, Homo sapiens
tccagtctgt

SEQ ID NO: 1594784 - DNA, 15 bp, Homo sapiens
tccagtctgtgatcc

SEQ ID NO: 1594785 - DNA, 21 bp, Homo sapiens
tccagtcttcctgacacttta

SEQ ID NO: 1594786 - DNA, 15 bp, Homo sapiens
tccagtgaacattcc

SEQ ID NO: 1594787 - DNA, 19 bp, Homo sapiens
tccagtgaagtagcctctt

SEQ ID NO: 1594788 - DNA, 14 bp, Homo sapiens
tccagtgacctctc

SEQ ID NO: 1594789 - DNA, 17 bp, Homo sapiens
tccagtgacctctctct

SEQ ID NO: 1594790 - DNA, 22 bp, Homo sapiens
tccagtgagccgagatggcgct

SEQ ID NO: 1594791 - DNA, 12 bp, Homo sapiens
tccagtgaggaa

SEQ ID NO: 1594792 - DNA, 14 bp, Homo sapiens
tccagtgcaattgt

SEQ ID NO: 1594793 - DNA, 16 bp, Homo sapiens
tccagtgcattttgtt

SEQ ID NO: 1594794 - DNA, 15 bp, Homo sapiens
tccagtgctcagctg

SEQ ID NO: 1594795 - DNA, 20 bp, Homo sapiens
tccagtgctcagctgtggct

SEQ ID NO: 1594796 - DNA, 21 bp, Homo sapiens
tccagtgctcagctgtggctg

SEQ ID NO: 1594797 - DNA, 15 bp, Homo sapiens
tccagtgctggattt

SEQ ID NO: 1594798 - DNA, 17 bp, Homo sapiens
tccagtgggcccggaga

SEQ ID NO: 1594799 - DNA, 13 bp, Homo sapiens
tccagtggtgggt

SEQ ID NO: 1594800 - DNA, 21 bp, Homo sapiens
tccagtgtgcacccctcccca

SEQ ID NO: 1594801 - DNA, 18 bp, Homo sapiens
tccagtgtgggcttgacc

SEQ ID NO: 1594802 - DNA, 16 bp, Homo sapiens
tccagtgttggctgtg

SEQ ID NO: 1594803 - DNA, 18 bp, Homo sapiens
tccagtgttggctgtgtg

SEQ ID NO: 1594804 - DNA, 13 bp, Homo sapiens
tccagttcccact

SEQ ID NO: 1594805 - DNA, 15 bp, Homo sapiens
tccagttcctttaga

SEQ ID NO: 1594806 - DNA, 22 bp, Homo sapiens
tccagtttaagtaattgcctac

SEQ ID NO: 1594807 - DNA, 14 bp, Homo sapiens
tccagtttctttcc

SEQ ID NO: 1594808 - DNA, 13 bp, Homo sapiens
tccagtttgcatt

SEQ ID NO: 1594809 - DNA, 20 bp, Homo sapiens
tccataaagacaatcactgc

SEQ ID NO: 1594810 - DNA, 21 bp, Homo sapiens
tccataaagacaatcactgcc

SEQ ID NO: 1594811 - DNA, 22 bp, Homo sapiens
tccataaagacaatcactgcca

SEQ ID NO: 1594812 - DNA, 20 bp, Homo sapiens
tccataaagtacaaatgaag

SEQ ID NO: 1594813 - DNA, 18 bp, Homo sapiens
tccataaatctattgtct

SEQ ID NO: 1594814 - DNA, 13 bp, Homo sapiens
tccataaatgtgt

SEQ ID NO: 1594815 - DNA, 14 bp, Homo sapiens
tccataaatgtgtt

SEQ ID NO: 1594816 - DNA, 15 bp, Homo sapiens
tccataaatgtgttc

SEQ ID NO: 1594817 - DNA, 16 bp, Homo sapiens
tccataaatgtgttcc

SEQ ID NO: 1594818 - DNA, 16 bp, Homo sapiens
tccataatgctactgt

SEQ ID NO: 1594819 - DNA, 16 bp, Homo sapiens
tccataatgttctgct

SEQ ID NO: 1594820 - DNA, 21 bp, Homo sapiens
tccataattatgacagttata

SEQ ID NO: 1594821 - DNA, 14 bp, Homo sapiens
tccatacagcctct

SEQ ID NO: 1594822 - DNA, 22 bp, Homo sapiens
tccataccttttctcttttctt

SEQ ID NO: 1594823 - DNA, 18 bp, Homo sapiens
tccatactgggctaagga

SEQ ID NO: 1594824 - DNA, 15 bp, Homo sapiens
tccatacttctctca

SEQ ID NO: 1594825 - DNA, 15 bp, Homo sapiens
tccatagtgactttt

SEQ ID NO: 1594826 - DNA, 17 bp, Homo sapiens
tccatatatatgaaatg

SEQ ID NO: 1594827 - DNA, 18 bp, Homo sapiens
tccatatatatgaaatgt

SEQ ID NO: 1594828 - DNA, 12 bp, Homo sapiens
tccatatccata

SEQ ID NO: 1594829 - DNA, 14 bp, Homo sapiens
tccatatcctggtg

SEQ ID NO: 1594830 - DNA, 23 bp, Homo sapiens
tccatatcttaaagaaacagctt

SEQ ID NO: 1594831 - DNA, 14 bp, Homo sapiens
tccatatgctccag

SEQ ID NO: 1594832 - DNA, 16 bp, Homo sapiens
tccatatgctccagga

SEQ ID NO: 1594833 - DNA, 22 bp, Homo sapiens
tccatcaaacctcacatttgtg

SEQ ID NO: 1594834 - DNA, 22 bp, Homo sapiens
tccatcaactcccaacttcttc

SEQ ID NO: 1594835 - DNA, 21 bp, Homo sapiens
tccatcaggtgaggtgtgctc

SEQ ID NO: 1594836 - DNA, 19 bp, Homo sapiens
tccatcaggttccatcccg

SEQ ID NO: 1594837 - DNA, 17 bp, Homo sapiens
tccatcatcactgtaaa

SEQ ID NO: 1594838 - DNA, 14 bp, Homo sapiens
tccatcatgtctgt

SEQ ID NO: 1594839 - DNA, 23 bp, Homo sapiens
tccatcatgtctgtatactcctg

SEQ ID NO: 1594840 - DNA, 14 bp, Homo sapiens
tccatcatttggtt

SEQ ID NO: 1594841 - DNA, 21 bp, Homo sapiens
tccatccaaggccaggttctc

SEQ ID NO: 1594842 - DNA, 17 bp, Homo sapiens
tccatccaccaccttgc

SEQ ID NO: 1594843 - DNA, 19 bp, Homo sapiens
tccatcccaacagccatgc

SEQ ID NO: 1594844 - DNA, 22 bp, Homo sapiens
tccatcgccatcttcttccctt

SEQ ID NO: 1594845 - DNA, 14 bp, Homo sapiens
tccatctaaaaata

SEQ ID NO: 1594846 - DNA, 15 bp, Homo sapiens
tccatctaaaaatat

SEQ ID NO: 1594847 - DNA, 21 bp, Homo sapiens
tccatctaaaatactcaccaa

SEQ ID NO: 1594848 - DNA, 18 bp, Homo sapiens
tccccctcccagggccag

SEQ ID NO: 1594849 - DNA, 19 bp, Homo sapiens
tccccctcccagggccagg

SEQ ID NO: 1594850 - DNA, 17 bp, Homo sapiens
tccccctccccctcctg

SEQ ID NO: 1594851 - DNA, 11 bp, Homo sapiens
tccccctcctc

SEQ ID NO: 1594852 - DNA, 12 bp, Homo sapiens
tccccctcctca

SEQ ID NO: 1594853 - DNA, 18 bp, Homo sapiens
tccccctcctgctgtgct

SEQ ID NO: 1594854 - DNA, 16 bp, Homo sapiens
tccccctctgcttctc

SEQ ID NO: 1594855 - DNA, 17 bp, Homo sapiens
tccccctcttcttctga

SEQ ID NO: 1594856 - DNA, 11 bp, Homo sapiens
tccccctgcaa

SEQ ID NO: 1594857 - DNA, 12 bp, Homo sapiens
tccccctgcaac

SEQ ID NO: 1594858 - DNA, 18 bp, Homo sapiens
tccccctgccagtgcctt

SEQ ID NO: 1594859 - DNA, 12 bp, Homo sapiens
tccccctgccct

SEQ ID NO: 1594860 - DNA, 20 bp, Homo sapiens
tccccctgggctctgcccca

SEQ ID NO: 1594861 - DNA, 22 bp, Homo sapiens
tccccctgggctctgccccagc

SEQ ID NO: 1594862 - DNA, 21 bp, Homo sapiens
tccccctgtttttagagcttc

SEQ ID NO: 1594863 - DNA, 19 bp, Homo sapiens
tcccccttcccgccttcca

SEQ ID NO: 1594864 - DNA, 24 bp, Homo sapiens
tccccgaaacaggctactctcctc

SEQ ID NO: 1594865 - DNA, 18 bp, Homo sapiens
tccccgaggagctgggcc

SEQ ID NO: 1594866 - DNA, 21 bp, Homo sapiens
tccccgaggctgccccaggcc

SEQ ID NO: 1594867 - DNA, 14 bp, Homo sapiens
tccccgagtgccta

SEQ ID NO: 1594868 - DNA, 14 bp, Homo sapiens
tccccgatgctgac

SEQ ID NO: 1594869 - DNA, 16 bp, Homo sapiens
tccccgatgctgacct

SEQ ID NO: 1594870 - DNA, 21 bp, Homo sapiens
tccccgcaccccccaagctgt

SEQ ID NO: 1594871 - DNA, 13 bp, Homo sapiens
tccccgcctccac

SEQ ID NO: 1594872 - DNA, 19 bp, Homo sapiens
tccccgcctggccaggagc

SEQ ID NO: 1594873 - DNA, 21 bp, Homo sapiens
tccccgctcaggggcctggag

SEQ ID NO: 1594874 - DNA, 22 bp, Homo sapiens
tccccgctcaggggcctggagg

SEQ ID NO: 1594875 - DNA, 13 bp, Homo sapiens
tccccgctctccc

SEQ ID NO: 1594876 - DNA, 16 bp, Homo sapiens
tccccgctctccctgt

SEQ ID NO: 1594877 - DNA, 17 bp, Homo sapiens
tccccgctgctgtgcaa

SEQ ID NO: 1594878 - DNA, 14 bp, Homo sapiens
tccccggcaggcct

SEQ ID NO: 1594879 - DNA, 16 bp, Homo sapiens
tccccggcaggcctga

SEQ ID NO: 1594880 - DNA, 22 bp, Homo sapiens
tccccggcatgagactcagtgc

SEQ ID NO: 1594881 - DNA, 18 bp, Homo sapiens
tccccgtgtaaaaagcct

SEQ ID NO: 1594882 - DNA, 22 bp, Homo sapiens
tccccgtgtcctctccctgcca

SEQ ID NO: 1594883 - DNA, 15 bp, Homo sapiens
tcccctactccctct

SEQ ID NO: 1594884 - DNA, 16 bp, Homo sapiens
tcccctagcttactga

SEQ ID NO: 1594885 - DNA, 15 bp, Homo sapiens
tcccctatccaccca

SEQ ID NO: 1594886 - DNA, 18 bp, Homo sapiens
tcccctatccacccagcc

SEQ ID NO: 1594887 - DNA, 22 bp, Homo sapiens
tcccctcaaggacaaagtctcc

SEQ ID NO: 1594888 - DNA, 17 bp, Homo sapiens
tcccctcacctcctcta

SEQ ID NO: 1594889 - DNA, 18 bp, Homo sapiens
tcccctcagaaggtctgt

SEQ ID NO: 1594890 - DNA, 13 bp, Homo sapiens
tcccctcattcag

SEQ ID NO: 1594891 - DNA, 13 bp, Homo sapiens
tcccctccaggaa

SEQ ID NO: 1594892 - DNA, 14 bp, Homo sapiens
tcccctccaggaag

SEQ ID NO: 1594893 - DNA, 20 bp, Homo sapiens
tcccctcccacccacagcca

SEQ ID NO: 1594894 - DNA, 19 bp, Homo sapiens
tcccctcccacctctcctt

SEQ ID NO: 1594895 - DNA, 22 bp, Homo sapiens
tcccctcccaggggagccagct

SEQ ID NO: 1594896 - DNA, 11 bp, Homo sapiens
tcccctcccat

SEQ ID NO: 1594897 - DNA, 15 bp, Homo sapiens
tcccctcccatctgg

SEQ ID NO: 1594898 - DNA, 13 bp, Homo sapiens
tcccctcccccaa

SEQ ID NO: 1594899 - DNA, 12 bp, Homo sapiens
tcccctccctgg

SEQ ID NO: 1594900 - DNA, 15 bp, Homo sapiens
tcccctccctggctc

SEQ ID NO: 1594901 - DNA, 17 bp, Homo sapiens
tcccctccggactggtg

SEQ ID NO: 1594902 - DNA, 19 bp, Homo sapiens
tcccctccggactggtgcc

SEQ ID NO: 1594903 - DNA, 14 bp, Homo sapiens
tcccctcctccact

SEQ ID NO: 1594904 - DNA, 16 bp, Homo sapiens
tcccctcctcttccct

SEQ ID NO: 1594905 - DNA, 13 bp, Homo sapiens
tcccctccttggc

SEQ ID NO: 1594906 - DNA, 16 bp, Homo sapiens
tcccctctccttcctg

SEQ ID NO: 1594907 - DNA, 14 bp, Homo sapiens
tcccctctctctgg

SEQ ID NO: 1594908 - DNA, 20 bp, Homo sapiens
tcccctctcttgcacccgcc

SEQ ID NO: 1594909 - DNA, 21 bp, Homo sapiens
tcccctctgccggtcccccat

SEQ ID NO: 1594910 - DNA, 14 bp, Homo sapiens
tcccttacaaggtg

SEQ ID NO: 1594911 - DNA, 20 bp, Homo sapiens
tcccttagccccgagtttaa

SEQ ID NO: 1594912 - DNA, 15 bp, Homo sapiens
tcccttagcctctcc

SEQ ID NO: 1594913 - DNA, 22 bp, Homo sapiens
tcccttcaaccattccccatgg

SEQ ID NO: 1594914 - DNA, 21 bp, Homo sapiens
tcccttcaagacgaggggcag

SEQ ID NO: 1594915 - DNA, 20 bp, Homo sapiens
tcccttcagcaacttatttt

SEQ ID NO: 1594916 - DNA, 19 bp, Homo sapiens
tcccttcagtaccctctca

SEQ ID NO: 1594917 - DNA, 20 bp, Homo sapiens
tcccttcagtaccctctcag

SEQ ID NO: 1594918 - DNA, 14 bp, Homo sapiens
tcccttccatgccc

SEQ ID NO: 1594919 - DNA, 19 bp, Homo sapiens
tcccttccatgccccagga

SEQ ID NO: 1594920 - DNA, 16 bp, Homo sapiens
tcccttccctccctga

SEQ ID NO: 1594921 - DNA, 16 bp, Homo sapiens
tcccttcctctctcct

SEQ ID NO: 1594922 - DNA, 13 bp, Homo sapiens
tcccttcctcttc

SEQ ID NO: 1594923 - DNA, 14 bp, Homo sapiens
tcccttcctcttcc

SEQ ID NO: 1594924 - DNA, 18 bp, Homo sapiens
tcccttcctcttcctgcc

SEQ ID NO: 1594925 - DNA, 14 bp, Homo sapiens
tcccttcctgccac

SEQ ID NO: 1594926 - DNA, 15 bp, Homo sapiens
tcccttcctgccact

SEQ ID NO: 1594927 - DNA, 17 bp, Homo sapiens
tcccttcctggaaacag

SEQ ID NO: 1594928 - DNA, 18 bp, Homo sapiens
tcccttccttttccctgc

SEQ ID NO: 1594929 - DNA, 23 bp, Homo sapiens
tcccttcggagccaacaagaccg

SEQ ID NO: 1594930 - DNA, 13 bp, Homo sapiens
tcccttctcccca

SEQ ID NO: 1594931 - DNA, 19 bp, Homo sapiens
tcccttctccccagccaga

SEQ ID NO: 1594932 - DNA, 20 bp, Homo sapiens
tcccttctccccagccagag

SEQ ID NO: 1594933 - DNA, 12 bp, Homo sapiens
tcccttctctct

SEQ ID NO: 1594934 - DNA, 19 bp, Homo sapiens
tcccttctggacactgaga

SEQ ID NO: 1594935 - DNA, 15 bp, Homo sapiens
tcccttctgggaaac

SEQ ID NO: 1594936 - DNA, 20 bp, Homo sapiens
tcccttgaaactttgggaaa

SEQ ID NO: 1594937 - DNA, 14 bp, Homo sapiens
tcccttgaccttaa

SEQ ID NO: 1594938 - DNA, 17 bp, Homo sapiens
tcccttgagacctcagc

SEQ ID NO: 1594939 - DNA, 19 bp, Homo sapiens
tcccttgagacctcagcca

SEQ ID NO: 1594940 - DNA, 14 bp, Homo sapiens
tcccttgagccctc

SEQ ID NO: 1594941 - DNA, 20 bp, Homo sapiens
tcccttgcaggggtcccccc

SEQ ID NO: 1594942 - DNA, 21 bp, Homo sapiens
tcccttgcaggggtcccccct

SEQ ID NO: 1594943 - DNA, 21 bp, Homo sapiens
tcccttgccatcctaaaagcc

SEQ ID NO: 1594944 - DNA, 13 bp, Homo sapiens
tcccttgcctctg

SEQ ID NO: 1594945 - DNA, 20 bp, Homo sapiens
tcccttgcctttcgaggcct

SEQ ID NO: 1594946 - DNA, 17 bp, Homo sapiens
tcccttgctggccccag

SEQ ID NO: 1594947 - DNA, 14 bp, Homo sapiens
tcccttgcttgcct

SEQ ID NO: 1594948 - DNA, 21 bp, Homo sapiens
tcccttgctttgttttaataa

SEQ ID NO: 1594949 - DNA, 15 bp, Homo sapiens
tcccttggcccagag

SEQ ID NO: 1594950 - DNA, 15 bp, Homo sapiens
tcccttggctgttaa

SEQ ID NO: 1594951 - DNA, 18 bp, Homo sapiens
tcccttggtcttccatgg

SEQ ID NO: 1594952 - DNA, 23 bp, Homo sapiens
tcccttgtacctatggctgcctg

SEQ ID NO: 1594953 - DNA, 12 bp, Homo sapiens
tcccttgtattt

SEQ ID NO: 1594954 - DNA, 18 bp, Homo sapiens
tcccttgtattttgttaa

SEQ ID NO: 1594955 - DNA, 23 bp, Homo sapiens
tcccttgtattttgttaaagctg

SEQ ID NO: 1594956 - DNA, 15 bp, Homo sapiens
tcccttgtgtcaaga

SEQ ID NO: 1594957 - DNA, 21 bp, Homo sapiens
tcccttgtgtcaagacatttc

SEQ ID NO: 1594958 - DNA, 18 bp, Homo sapiens
tccctttagctgtgttat

SEQ ID NO: 1594959 - DNA, 13 bp, Homo sapiens
tccctttccctac

SEQ ID NO: 1594960 - DNA, 17 bp, Homo sapiens
tccctttccttccatcc

SEQ ID NO: 1594961 - DNA, 23 bp, Homo sapiens
tccctttccttccatccctaccc

SEQ ID NO: 1594962 - DNA, 16 bp, Homo sapiens
tccctttcttggccag

SEQ ID NO: 1594963 - DNA, 17 bp, Homo sapiens
tccctttgcacctgaga

SEQ ID NO: 1594964 - DNA, 14 bp, Homo sapiens
tccctttgctcccg

SEQ ID NO: 1594965 - DNA, 17 bp, Homo sapiens
tcccttttacatactgc

SEQ ID NO: 1594966 - DNA, 19 bp, Homo sapiens
tcccttttacatactgctg

SEQ ID NO: 1594967 - DNA, 20 bp, Homo sapiens
tcccttttcaccttttcagg

SEQ ID NO: 1594968 - DNA, 12 bp, Homo sapiens
tcccttttgcta

SEQ ID NO: 1594969 - DNA, 20 bp, Homo sapiens
tccctttttatatcccattt

SEQ ID NO: 1594970 - DNA, 22 bp, Homo sapiens
tccctttttctccacactccac

SEQ ID NO: 1594971 - DNA, 22 bp, Homo sapiens
tccgaagggaattaaaaagaag

SEQ ID NO: 1594972 - DNA, 19 bp, Homo sapiens
tccgaatctctttcccttc

SEQ ID NO: 1594973 - DNA, 14 bp, Homo sapiens
tccgacttcccctg

SEQ ID NO: 1594974 - DNA, 17 bp, Homo sapiens
tccgacttcccctgggc

SEQ ID NO: 1594975 - DNA, 19 bp, Homo sapiens
tccgacttcccctgggcaa

SEQ ID NO: 1594976 - DNA, 20 bp, Homo sapiens
tccgagagcagtgggcaggt

SEQ ID NO: 1594977 - DNA, 15 bp, Homo sapiens
tccgagagggagaga

SEQ ID NO: 1594978 - DNA, 14 bp, Homo sapiens
tccgagatccccag

SEQ ID NO: 1594979 - DNA, 15 bp, Homo sapiens
tccgagcattccagt

SEQ ID NO: 1594980 - DNA, 17 bp, Homo sapiens
tccgagcattccagtaa

SEQ ID NO: 1594981 - DNA, 14 bp, Homo sapiens
tccgagctctggtg

SEQ ID NO: 1594982 - DNA, 15 bp, Homo sapiens
tccgagctctggtgc

SEQ ID NO: 1594983 - DNA, 17 bp, Homo sapiens
tccgagctgtaggagag

SEQ ID NO: 1594984 - DNA, 15 bp, Homo sapiens
tcccgagctcctctt

SEQ ID NO: 1594985 - DNA, 18 bp, Homo sapiens
tcccgatacctcagccct

SEQ ID NO: 1594986 - DNA, 20 bp, Homo sapiens
tcccgatacctcagccctgg

SEQ ID NO: 1594987 - DNA, 16 bp, Homo sapiens
tcccgatgcctccctt

SEQ ID NO: 1594988 - DNA, 16 bp, Homo sapiens
tcccgattgagcctta

SEQ ID NO: 1594989 - DNA, 22 bp, Homo sapiens
tcccgcacatggtgtggggggc

SEQ ID NO: 1594990 - DNA, 13 bp, Homo sapiens
tcccgcaccaggc

SEQ ID NO: 1594991 - DNA, 16 bp, Homo sapiens
tcccgcactctgcccc

SEQ ID NO: 1594992 - DNA, 18 bp, Homo sapiens
tcccgccagactgttaga

SEQ ID NO: 1594993 - DNA, 20 bp, Homo sapiens
tcccgcctcagcctcctgag

SEQ ID NO: 1594994 - DNA, 15 bp, Homo sapiens
tcccgcctccctagt

SEQ ID NO: 1594995 - DNA, 13 bp, Homo sapiens
tcccgcctcggct

SEQ ID NO: 1594996 - DNA, 12 bp, Homo sapiens
tcccgcggtgcc

SEQ ID NO: 1594997 - DNA, 19 bp, Homo sapiens
tcccgcggtgctgactgag

SEQ ID NO: 1594998 - DNA, 13 bp, Homo sapiens
tcccgctcagccc

SEQ ID NO: 1594999 - DNA, 13 bp, Homo sapiens
tcccgctccccac

SEQ ID NO: 1595000 - DNA, 13 bp, Homo sapiens
tcccgctgctgct

SEQ ID NO: 1595001 - DNA, 19 bp, Homo sapiens
tcccgcttcctggcctccc

SEQ ID NO: 1595002 - DNA, 20 bp, Homo sapiens
tcccgcttcctggcctccct

SEQ ID NO: 1595003 - DNA, 19 bp, Homo sapiens
tcccggagcacagccctgg

SEQ ID NO: 1595004 - DNA, 13 bp, Homo sapiens
tcccggccagctc

SEQ ID NO: 1595005 - DNA, 19 bp, Homo sapiens
tcccggccagctctggagt

SEQ ID NO: 1595006 - DNA, 19 bp, Homo sapiens
tcccggccgcgccgccgcc

SEQ ID NO: 1595007 - DNA, 16 bp, Homo sapiens
tcccggctcccctccc

SEQ ID NO: 1595008 - DNA, 15 bp, Homo sapiens
tcccggctgcctgcc

SEQ ID NO: 1595009 - DNA, 16 bp, Homo sapiens
tcccgggccagggctg

SEQ ID NO: 1595010 - DNA, 13 bp, Homo sapiens
tcccgggccctcc

SEQ ID NO: 1595011 - DNA, 16 bp, Homo sapiens
tcccggggccttcctt

SEQ ID NO: 1595012 - DNA, 21 bp, Homo sapiens
tcccgggtttggctgagcctg

SEQ ID NO: 1595013 - DNA, 20 bp, Homo sapiens
tcccggttcagacccctgcc

SEQ ID NO: 1595014 - DNA, 21 bp, Homo sapiens
tcccgtacgtgttcattttat

SEQ ID NO: 1595015 - DNA, 15 bp, Homo sapiens
tcccgtagctgccag

SEQ ID NO: 1595016 - DNA, 16 bp, Homo sapiens
tcccgtagctgccagt

SEQ ID NO: 1595017 - DNA, 16 bp, Homo sapiens
tcccgtcagggcccaa

SEQ ID NO: 1595018 - DNA, 20 bp, Homo sapiens
tcccgtcagggcccaagtcc

SEQ ID NO: 1595019 - DNA, 12 bp, Homo sapiens
tcccgtttcctc

SEQ ID NO: 1595020 - DNA, 20 bp, Homo sapiens
tcccgtttctccacctagac

SEQ ID NO: 1595021 - DNA, 22 bp, Homo sapiens
tccctaaacaaaagcaaagatg

SEQ ID NO: 1595022 - DNA, 18 bp, Homo sapiens
tccctaaatatacatctg

SEQ ID NO: 1595023 - DNA, 20 bp, Homo sapiens
tccctaattctcttcgctgt

SEQ ID NO: 1595024 - DNA, 20 bp, Homo sapiens
tccctaatttaacccagctc

SEQ ID NO: 1595025 - DNA, 15 bp, Homo sapiens
tccctacagcctagg

SEQ ID NO: 1595026 - DNA, 19 bp, Homo sapiens
tccctaccccctaagagcc

SEQ ID NO: 1595027 - DNA, 19 bp, Homo sapiens
tccctaccgagtctcttct

SEQ ID NO: 1595028 - DNA, 13 bp, Homo sapiens
tccctacctcagg

SEQ ID NO: 1595029 - DNA, 14 bp, Homo sapiens
tccctaccttgcct

SEQ ID NO: 1595030 - DNA, 16 bp, Homo sapiens
tccctacttccaagaa

SEQ ID NO: 1595031 - DNA, 17 bp, Homo sapiens
tccctagagagaataaa

SEQ ID NO: 1595032 - DNA, 19 bp, Homo sapiens
tccctagagagaataaatt

SEQ ID NO: 1595033 - DNA, 23 bp, Homo sapiens
tccctagagagaataaattggat

SEQ ID NO: 1595034 - DNA, 16 bp, Homo sapiens
tccctagcagtgaact

SEQ ID NO: 1595035 - DNA, 16 bp, Homo sapiens
tccctagccagcactt

SEQ ID NO: 1595036 - DNA, 15 bp, Homo sapiens
tccctaggagaccaa

SEQ ID NO: 1595037 - DNA, 18 bp, Homo sapiens
tccctaggggacacttcc

SEQ ID NO: 1595038 - DNA, 13 bp, Homo sapiens
tccctatgtattt

SEQ ID NO: 1595039 - DNA, 15 bp, Homo sapiens
tccctatgtatttgc

SEQ ID NO: 1595040 - DNA, 21 bp, Homo sapiens
tccctcaaatgcgcgtgtgca

SEQ ID NO: 1595041 - DNA, 19 bp, Homo sapiens
tccctcaactgagggccag

SEQ ID NO: 1595042 - DNA, 15 bp, Homo sapiens
tccctcacccccatg

SEQ ID NO: 1595043 - DNA, 14 bp, Homo sapiens
tccctcaccttctg

SEQ ID NO: 1595044 - DNA, 15 bp, Homo sapiens
tccctcaccttctga

SEQ ID NO: 1595045 - DNA, 21 bp, Homo sapiens
tccctcaccttggcaccagac

SEQ ID NO: 1595046 - DNA, 11 bp, Homo sapiens
tccctcagaga

SEQ ID NO: 1595047 - DNA, 17 bp, Homo sapiens
tccctcagctctctggg

SEQ ID NO: 1595048 - DNA, 15 bp, Homo sapiens
tccctccaccagcct

SEQ ID NO: 1595049 - DNA, 21 bp, Homo sapiens
tccgaggacccaggaaaggca

SEQ ID NO: 1595050 - DNA, 14 bp, Homo sapiens
tccgaggctccccg

SEQ ID NO: 1595051 - DNA, 19 bp, Homo sapiens
tccgaggctccccgcctcc

SEQ ID NO: 1595052 - DNA, 13 bp, Homo sapiens
tccgatcaacatt

SEQ ID NO: 1595053 - DNA, 20 bp, Homo sapiens
tccgatcaacatttatgacc

SEQ ID NO: 1595054 - DNA, 15 bp, Homo sapiens
tccgatgacagtgct

SEQ ID NO: 1595055 - DNA, 14 bp, Homo sapiens
tccgatggtatctg

SEQ ID NO: 1595056 - DNA, 17 bp, Homo sapiens
tccgatggtatctgggt

SEQ ID NO: 1595057 - DNA, 16 bp, Homo sapiens
tccgcaccagctgctc

SEQ ID NO: 1595058 - DNA, 18 bp, Homo sapiens
tccgcaccagctgctctg

SEQ ID NO: 1595059 - DNA, 15 bp, Homo sapiens
tccgcagcagggaag

SEQ ID NO: 1595060 - DNA, 15 bp, Homo sapiens
tccgcaggtgctggt

SEQ ID NO: 1595061 - DNA, 16 bp, Homo sapiens
tccgcatccctgcttc

SEQ ID NO: 1595062 - DNA, 14 bp, Homo sapiens
tccgccactcagcc

SEQ ID NO: 1595063 - DNA, 11 bp, Homo sapiens
tccgccagcct

SEQ ID NO: 1595064 - DNA, 18 bp, Homo sapiens
tccgccagcctcctctgg

SEQ ID NO: 1595065 - DNA, 20 bp, Homo sapiens
tccgccagcctcctctggac

SEQ ID NO: 1595066 - DNA, 16 bp, Homo sapiens
tccgccctgccactca

SEQ ID NO: 1595067 - DNA, 20 bp, Homo sapiens
tccgccctgctcctccctgg

SEQ ID NO: 1595068 - DNA, 18 bp, Homo sapiens
tccgcctacctcagcctc

SEQ ID NO: 1595069 - DNA, 16 bp, Homo sapiens
tccgcctccacactga

SEQ ID NO: 1595070 - DNA, 13 bp, Homo sapiens
tccgcctgcctct

SEQ ID NO: 1595071 - DNA, 18 bp, Homo sapiens
tccgcctgcctctgcctc

SEQ ID NO: 1595072 - DNA, 21 bp, Homo sapiens
tccgcctgctgggaagagctc

SEQ ID NO: 1595073 - DNA, 21 bp, Homo sapiens
tccgcctggccggctccagtt

SEQ ID NO: 1595074 - DNA, 16 bp, Homo sapiens
tccgccttctcccaca

SEQ ID NO: 1595075 - DNA, 17 bp, Homo sapiens
tccgcctttacaaggga

SEQ ID NO: 1595076 - DNA, 17 bp, Homo sapiens
tccgcgccgatgccacc

SEQ ID NO: 1595077 - DNA, 15 bp, Homo sapiens
tccgctcccaccgcc

SEQ ID NO: 1595078 - DNA, 23 bp, Homo sapiens
tccgctcccaccgcccccacccc

SEQ ID NO: 1595079 - DNA, 12 bp, Homo sapiens
tccgctgccacc

SEQ ID NO: 1595080 - DNA, 14 bp, Homo sapiens
tccgctgccagcct

SEQ ID NO: 1595081 - DNA, 14 bp, Homo sapiens
tccgctgccgtgcc

SEQ ID NO: 1595082 - DNA, 14 bp, Homo sapiens
tccgctgggcttca

SEQ ID NO: 1595083 - DNA, 20 bp, Homo sapiens
tccgctttgaaagaagcaag

SEQ ID NO: 1595084 - DNA, 12 bp, Homo sapiens
tccggaaagaag

SEQ ID NO: 1595085 - DNA, 15 bp, Homo sapiens
tccggactctctgct

SEQ ID NO: 1595086 - DNA, 12 bp, Homo sapiens
tccggactggtg

SEQ ID NO: 1595087 - DNA, 22 bp, Homo sapiens
tcctgtctttctgagcacactt

SEQ ID NO: 1595088 - DNA, 19 bp, Homo sapiens
tcctgtctttgttgtctcc

SEQ ID NO: 1595089 - DNA, 23 bp, Homo sapiens
tcctgtgaagtaacccctcctgg

SEQ ID NO: 1595090 - DNA, 22 bp, Homo sapiens
tcctgtgaagtttaattgtctc

SEQ ID NO: 1595091 - DNA, 22 bp, Homo sapiens
tcctgtgaatgccactgccttc

SEQ ID NO: 1595092 - DNA, 17 bp, Homo sapiens
tcctgtgacaacactca

SEQ ID NO: 1595093 - DNA, 18 bp, Homo sapiens
tcctgtgacatgtaacag

SEQ ID NO: 1595094 - DNA, 20 bp, Homo sapiens
tcctataattccctatcttt

SEQ ID NO: 1595095 - DNA, 22 bp, Homo sapiens
tcctatccttataggcctgtcc

SEQ ID NO: 1595096 - DNA, 17 bp, Homo sapiens
tcctatctatcttccaa

SEQ ID NO: 1595097 - DNA, 17 bp, Homo sapiens
tcctatctccagcggcc

SEQ ID NO: 1595098 - DNA, 13 bp, Homo sapiens
tcctatctgtgtt

SEQ ID NO: 1595099 - DNA, 15 bp, Homo sapiens
tcctatggaaaaggg

SEQ ID NO: 1595100 - DNA, 21 bp, Homo sapiens
tcctatggacaacttatttaa

SEQ ID NO: 1595101 - DNA, 18 bp, Homo sapiens
tcctatgtggcagctggg

SEQ ID NO: 1595102 - DNA, 15 bp, Homo sapiens
tcctattctataaaa

SEQ ID NO: 1595103 - DNA, 12 bp, Homo sapiens
tcctatttcaga

SEQ ID NO: 1595104 - DNA, 17 bp, Homo sapiens
tcctcaaaaagcagaag

SEQ ID NO: 1595105 - DNA, 20 bp, Homo sapiens
tcctcaaaaagcagaaggag

SEQ ID NO: 1595106 - DNA, 16 bp, Homo sapiens
tcctcaaagaaagtgt

SEQ ID NO: 1595107 - DNA, 18 bp, Homo sapiens
tcctcaaagaaagtgtat

SEQ ID NO: 1595108 - DNA, 19 bp, Homo sapiens
tcctcaaagaaagtgtatt

SEQ ID NO: 1595109 - DNA, 21 bp, Homo sapiens
tcctcaaatcagtgataattg

SEQ ID NO: 1595110 - DNA, 16 bp, Homo sapiens
tcctcaagcaataatt

SEQ ID NO: 1595111 - DNA, 13 bp, Homo sapiens
tcctcacacccct

SEQ ID NO: 1595112 - DNA, 20 bp, Homo sapiens
tcctcacatctttcacactt

SEQ ID NO: 1595113 - DNA, 15 bp, Homo sapiens
tcctcaccatccaca

SEQ ID NO: 1595114 - DNA, 16 bp, Homo sapiens
tcctcacccccagctt

SEQ ID NO: 1595115 - DNA, 15 bp, Homo sapiens
tcctcacctcatgcc

SEQ ID NO: 1595116 - DNA, 15 bp, Homo sapiens
tcctcacctctggac

SEQ ID NO: 1595117 - DNA, 17 bp, Homo sapiens
tcctcacctgtctaggt

SEQ ID NO: 1595118 - DNA, 16 bp, Homo sapiens
tcctcacgtgcaggac

SEQ ID NO: 1595119 - DNA, 18 bp, Homo sapiens
tcctcacgtgcaggacag

SEQ ID NO: 1595120 - DNA, 21 bp, Homo sapiens
tcctcactatgacactgagca

SEQ ID NO: 1595121 - DNA, 18 bp, Homo sapiens
tcctcactggaggagcag

SEQ ID NO: 1595122 - DNA, 13 bp, Homo sapiens
tcctcactgggtg

SEQ ID NO: 1595123 - DNA, 15 bp, Homo sapiens
tcctcacttctgtct

SEQ ID NO: 1595124 - DNA, 23 bp, Homo sapiens
tcctcacttggctgtctgaccag

SEQ ID NO: 1595125 - DNA, 20 bp, Homo sapiens
tcctcagagaatttctacca

SEQ ID NO: 1595126 - DNA, 19 bp, Homo sapiens
tcctcagaggcgtgctggt

SEQ ID NO: 1595127 - DNA, 19 bp, Homo sapiens
tcctcagatcatccagaag

SEQ ID NO: 1595128 - DNA, 15 bp, Homo sapiens
tcctcagatggggca

SEQ ID NO: 1595129 - DNA, 18 bp, Homo sapiens
tcctcagatggggcacca

SEQ ID NO: 1595130 - DNA, 19 bp, Homo sapiens
tcctcagcatttcttttct

SEQ ID NO: 1595131 - DNA, 18 bp, Homo sapiens
tcctcagcctccaaagtg

SEQ ID NO: 1595132 - DNA, 21 bp, Homo sapiens
tcctcagccttgccagagatc

SEQ ID NO: 1595133 - DNA, 20 bp, Homo sapiens
tcctcagctgccaagcactc

SEQ ID NO: 1595134 - DNA, 16 bp, Homo sapiens
tcctcaggcacacagc

SEQ ID NO: 1595135 - DNA, 17 bp, Homo sapiens
tcctcaggcacacagct

SEQ ID NO: 1595136 - DNA, 22 bp, Homo sapiens
tcctcaggcacacagctactct

SEQ ID NO: 1595137 - DNA, 18 bp, Homo sapiens
tcctcagggacagagaca

SEQ ID NO: 1595138 - DNA, 21 bp, Homo sapiens
tcctcagggagcagggaaggc

SEQ ID NO: 1595139 - DNA, 12 bp, Homo sapiens
tcctcagggcag

SEQ ID NO: 1595140 - DNA, 16 bp, Homo sapiens
tcctcagggtgggggg

SEQ ID NO: 1595141 - DNA, 17 bp, Homo sapiens
tcctcagggtggggggt

SEQ ID NO: 1595142 - DNA, 22 bp, Homo sapiens
tcctcaggtggccagcctggat

SEQ ID NO: 1595143 - DNA, 17 bp, Homo sapiens
tcctcagttggaatcat

SEQ ID NO: 1595144 - DNA, 20 bp, Homo sapiens
tcctcagtttaatccttcta

SEQ ID NO: 1595145 - DNA, 18 bp, Homo sapiens
tcctcatccaccccatcc

SEQ ID NO: 1595146 - DNA, 12 bp, Homo sapiens
tcctcatccctg

SEQ ID NO: 1595147 - DNA, 18 bp, Homo sapiens
tcctcatctccaaggcag

SEQ ID NO: 1595148 - DNA, 22 bp, Homo sapiens
tcctcatctgagaggctctccg

SEQ ID NO: 1595149 - DNA, 21 bp, Homo sapiens
tcctcatgaatgtaaatttgt

SEQ ID NO: 1595150 - DNA, 22 bp, Homo sapiens
tcctcatggcagcctactctcc

SEQ ID NO: 1595151 - DNA, 13 bp, Homo sapiens
tcctcatgtaaca

SEQ ID NO: 1595152 - DNA, 18 bp, Homo sapiens
tcctcatgtaacattggt

SEQ ID NO: 1595153 - DNA, 22 bp, Homo sapiens
tcctcattaatagctgccttca

SEQ ID NO: 1595154 - DNA, 14 bp, Homo sapiens
tcctcattcctgaa

SEQ ID NO: 1595155 - DNA, 15 bp, Homo sapiens
tcctcattgcctcct

SEQ ID NO: 1595156 - DNA, 17 bp, Homo sapiens
tcctcattgcctcctgt

SEQ ID NO: 1595157 - DNA, 19 bp, Homo sapiens
tcctcattgcctcctgttc

SEQ ID NO: 1595158 - DNA, 12 bp, Homo sapiens
tcctcatttccc

SEQ ID NO: 1595159 - DNA, 19 bp, Homo sapiens
tcctcatttcccctcccaa

SEQ ID NO: 1595160 - DNA, 23 bp, Homo sapiens
tcctccaaagactgaaggagcat

SEQ ID NO: 1595161 - DNA, 11 bp, Homo sapiens
tcctccacaga

SEQ ID NO: 1595162 - DNA, 14 bp, Homo sapiens
tcctccacagagag

SEQ ID NO: 1595163 - DNA, 17 bp, Homo sapiens
tcctccacctcaactcc

SEQ ID NO: 1595164 - DNA, 20 bp, Homo sapiens
tcctccactcactccagccc

SEQ ID NO: 1595165 - DNA, 16 bp, Homo sapiens
tcctccagaagcctct

SEQ ID NO: 1595166 - DNA, 20 bp, Homo sapiens
tcctccagaagcctctggct

SEQ ID NO: 1595167 - DNA, 21 bp, Homo sapiens
tcctccagaagcctctggcta

SEQ ID NO: 1595168 - DNA, 12 bp, Homo sapiens
tcctccagcccc

SEQ ID NO: 1595169 - DNA, 13 bp, Homo sapiens
tcctccaggagct

SEQ ID NO: 1595170 - DNA, 19 bp, Homo sapiens
tcctccaggagcttcttgt

SEQ ID NO: 1595171 - DNA, 21 bp, Homo sapiens
tcctccagggatgatcaacag

SEQ ID NO: 1595172 - DNA, 23 bp, Homo sapiens
tcctccagggccacgtgccaggc

SEQ ID NO: 1595173 - DNA, 18 bp, Homo sapiens
tcctccagtaccttgctt

SEQ ID NO: 1595174 - DNA, 20 bp, Homo sapiens
tcctcccaatttcagactcc

SEQ ID NO: 1595175 - DNA, 13 bp, Homo sapiens
tcctcccagcggc

SEQ ID NO: 1595176 - DNA, 13 bp, Homo sapiens
tcctcccaggcgc

SEQ ID NO: 1595177 - DNA, 19 bp, Homo sapiens
tcctcccaggcgccccttc

SEQ ID NO: 1595178 - DNA, 21 bp, Homo sapiens
tcctccccaaatcaatacact

SEQ ID NO: 1595179 - DNA, 16 bp, Homo sapiens
tcctccccacactcca

SEQ ID NO: 1595180 - DNA, 23 bp, Homo sapiens
tcctccccacactccactctgat

SEQ ID NO: 1595181 - DNA, 19 bp, Homo sapiens
tcctccccagctcttctct

SEQ ID NO: 1595182 - DNA, 22 bp, Homo sapiens
tcctccccagctcttctcttcc

SEQ ID NO: 1595183 - DNA, 17 bp, Homo sapiens
tcctcccccggctgggc

SEQ ID NO: 1595184 - DNA, 19 bp, Homo sapiens
tcctcccccggctgggcct

SEQ ID NO: 1595185 - DNA, 21 bp, Homo sapiens
tcctccccgctccgtctctgt

SEQ ID NO: 1595186 - DNA, 14 bp, Homo sapiens
tcctcccctcaagg

SEQ ID NO: 1595187 - DNA, 20 bp, Homo sapiens
tcctcccctcctcttccctt

SEQ ID NO: 1595188 - DNA, 13 bp, Homo sapiens
tcctccccttggg

SEQ ID NO: 1595189 - DNA, 19 bp, Homo sapiens
tcctcccgcccttccatgt

SEQ ID NO: 1595190 - DNA, 19 bp, Homo sapiens
tcctcccgggccctccctt

SEQ ID NO: 1595191 - DNA, 17 bp, Homo sapiens
tcctcccggggccttcc

SEQ ID NO: 1595192 - DNA, 19 bp, Homo sapiens
tcctccctcatggctctgg

SEQ ID NO: 1595193 - DNA, 19 bp, Homo sapiens
tcctccctcctgcaggctg

SEQ ID NO: 1595194 - DNA, 17 bp, Homo sapiens
tcctccctgccccccaa

SEQ ID NO: 1595195 - DNA, 15 bp, Homo sapiens
tcctccctggcagac

SEQ ID NO: 1595196 - DNA, 17 bp, Homo sapiens
tcctccctggctgccct

SEQ ID NO: 1595197 - DNA, 19 bp, Homo sapiens
tcctccctggctgccctgg

SEQ ID NO: 1595198 - DNA, 21 bp, Homo sapiens
tcctcccttccttttccctgc

SEQ ID NO: 1595199 - DNA, 19 bp, Homo sapiens
tcctccgcctactgtccct

SEQ ID NO: 1595200 - DNA, 14 bp, Homo sapiens
tcctccgtccagcc

SEQ ID NO: 1595201 - DNA, 16 bp, Homo sapiens
tcctccgtccagccgc

SEQ ID NO: 1595202 - DNA, 18 bp, Homo sapiens
tcctccgtccagccgcca

SEQ ID NO: 1595203 - DNA, 22 bp, Homo sapiens
tcctccgtccatatcagaactg

SEQ ID NO: 1595204 - DNA, 18 bp, Homo sapiens
tcctcctcacctcatgcc

SEQ ID NO: 1595205 - DNA, 13 bp, Homo sapiens
tcctcctccacag

SEQ ID NO: 1595206 - DNA, 15 bp, Homo sapiens
tcctcctccagggtg

SEQ ID NO: 1595207 - DNA, 20 bp, Homo sapiens
tcctcctccatctttctaca

SEQ ID NO: 1595208 - DNA, 16 bp, Homo sapiens
tcctcctcccctcctc

SEQ ID NO: 1595209 - DNA, 14 bp, Homo sapiens
tcctcctcggaaga

SEQ ID NO: 1595210 - DNA, 20 bp, Homo sapiens
tcgaggagtaacaatacaaa

SEQ ID NO: 1595211 - DNA, 22 bp, Homo sapiens
tcgaggcaccggcgctgcaggt

SEQ ID NO: 1595212 - DNA, 20 bp, Homo sapiens
tcctggaattgccagctgac

SEQ ID NO: 1595213 - DNA, 20 bp, Homo sapiens
tcctggaatttggacaagtg

SEQ ID NO: 1595214 - DNA, 17 bp, Homo sapiens
tcctggacactcagacc

SEQ ID NO: 1595215 - DNA, 18 bp, Homo sapiens
tcctggacatcaccagtc

SEQ ID NO: 1595216 - DNA, 15 bp, Homo sapiens
tcctggacctgagtc

SEQ ID NO: 1595217 - DNA, 21 bp, Homo sapiens
tcctggaccttgacagagcag

SEQ ID NO: 1595218 - DNA, 21 bp, Homo sapiens
tcctggactcccctccctgcc

SEQ ID NO: 1595219 - DNA, 18 bp, Homo sapiens
tcctggagcccagaggag

SEQ ID NO: 1595220 - DNA, 13 bp, Homo sapiens
tcctggagcccga

SEQ ID NO: 1595221 - DNA, 16 bp, Homo sapiens
tcctggagctctgtgg

SEQ ID NO: 1595222 - DNA, 13 bp, Homo sapiens
tcctggagttttg

SEQ ID NO: 1595223 - DNA, 18 bp, Homo sapiens
tcctggagttttgatttg

SEQ ID NO: 1595224 - DNA, 13 bp, Homo sapiens
tcgggagcaccca

SEQ ID NO: 1595225 - DNA, 16 bp, Homo sapiens
tcgggagcacccagag

SEQ ID NO: 1595226 - DNA, 20 bp, Homo sapiens
tcgggagcacccagagcacc

SEQ ID NO: 1595227 - DNA, 13 bp, Homo sapiens
tcgggagcagtgt

SEQ ID NO: 1595228 - DNA, 19 bp, Homo sapiens
tcgggaggctgaggcagga

SEQ ID NO: 1595229 - DNA, 19 bp, Homo sapiens
tcgggcagtggaggctgct

SEQ ID NO: 1595230 - DNA, 22 bp, Homo sapiens
tcgggccccatcctcatccctg

SEQ ID NO: 1595231 - DNA, 19 bp, Homo sapiens
tcgggctggagcctccgac

SEQ ID NO: 1595232 - DNA, 16 bp, Homo sapiens
tcggggaactcctgga

SEQ ID NO: 1595233 - DNA, 20 bp, Homo sapiens
tcggggcccttggggcctgg

SEQ ID NO: 1595234 - DNA, 20 bp, Homo sapiens
tctaacagccctcctctgca

SEQ ID NO: 1595235 - DNA, 21 bp, Homo sapiens
tctaacagccctcctctgcac

SEQ ID NO: 1595236 - DNA, 14 bp, Homo sapiens
tctaaccaaaaagt

SEQ ID NO: 1595237 - DNA, 19 bp, Homo sapiens
tctaaccctatactgtagt

SEQ ID NO: 1595238 - DNA, 18 bp, Homo sapiens
tctaaccttgaatgctgc

SEQ ID NO: 1595239 - DNA, 22 bp, Homo sapiens
tctaaccttgaatgctgccagt

SEQ ID NO: 1595240 - DNA, 22 bp, Homo sapiens
tctaacggtctgttctgtttca

SEQ ID NO: 1595241 - DNA, 18 bp, Homo sapiens
tctaactcagaattattt

SEQ ID NO: 1595242 - DNA, 15 bp, Homo sapiens
tctaactcctgccat

SEQ ID NO: 1595243 - DNA, 16 bp, Homo sapiens
tctaactggacatgaa

SEQ ID NO: 1595244 - DNA, 17 bp, Homo sapiens
tctaactggacatgaag

SEQ ID NO: 1595245 - DNA, 15 bp, Homo sapiens
tctaactttctttac

SEQ ID NO: 1595246 - DNA, 11 bp, Homo sapiens
tctaagaaaag

SEQ ID NO: 1595247 - DNA, 23 bp, Homo sapiens
tctaagacttactctaagatctt

SEQ ID NO: 1595248 - DNA, 21 bp, Homo sapiens
tctaagatagtaacaatgaag

SEQ ID NO: 1595249 - DNA, 15 bp, Homo sapiens
tctaagatcttagat

SEQ ID NO: 1595250 - DNA, 17 bp, Homo sapiens
tctaagatcttagattc

SEQ ID NO: 1595251 - DNA, 19 bp, Homo sapiens
tctaagatcttagattctc

SEQ ID NO: 1595252 - DNA, 19 bp, Homo sapiens
tctaagatgtgatattcta

SEQ ID NO: 1595253 - DNA, 15 bp, Homo sapiens
tctacctcaggcagc

SEQ ID NO: 1595254 - DNA, 13 bp, Homo sapiens
tctacctccaccc

SEQ ID NO: 1595255 - DNA, 15 bp, Homo sapiens
tctacctccaccctg

SEQ ID NO: 1595256 - DNA, 12 bp, Homo sapiens
tctacctgccct

SEQ ID NO: 1595257 - DNA, 18 bp, Homo sapiens
tctacctgccctcaaggg

SEQ ID NO: 1595258 - DNA, 22 bp, Homo sapiens
tctacctgtacacattcctgca

SEQ ID NO: 1595259 - DNA, 14 bp, Homo sapiens
tctaccttttctgg

SEQ ID NO: 1595260 - DNA, 18 bp, Homo sapiens
tctactaaaaataccaaa

SEQ ID NO: 1595261 - DNA, 12 bp, Homo sapiens
tctactacctac

SEQ ID NO: 1595262 - DNA, 18 bp, Homo sapiens
tctactacctacgtttgc

SEQ ID NO: 1595263 - DNA, 20 bp, Homo sapiens
tctactattaagtttgaaaa

SEQ ID NO: 1595264 - DNA, 20 bp, Homo sapiens
tctactcaacccattgttgt

SEQ ID NO: 1595265 - DNA, 15 bp, Homo sapiens
tctactcatccagac

SEQ ID NO: 1595266 - DNA, 21 bp, Homo sapiens
tctactcccaagtatggggtt

SEQ ID NO: 1595267 - DNA, 19 bp, Homo sapiens
tctactcttgagagctcag

SEQ ID NO: 1595268 - DNA, 22 bp, Homo sapiens
tctactcttgagagctcaggca

SEQ ID NO: 1595269 - DNA, 23 bp, Homo sapiens
tctactcttgagagctcaggcag

SEQ ID NO: 1595270 - DNA, 16 bp, Homo sapiens
tctactcttgtcattt

SEQ ID NO: 1595271 - DNA, 20 bp, Homo sapiens
tctactggaaatgtagcact

SEQ ID NO: 1595272 - DNA, 21 bp, Homo sapiens
tctactggaaatgtagcactt

SEQ ID NO: 1595273 - DNA, 20 bp, Homo sapiens
tctactggtcttgtggaatt

SEQ ID NO: 1595274 - DNA, 22 bp, Homo sapiens
tctactttagaatgagagtgtg

SEQ ID NO: 1595275 - DNA, 19 bp, Homo sapiens
tctactttcatcttaaact

SEQ ID NO: 1595276 - DNA, 14 bp, Homo sapiens
tctactttgattct

SEQ ID NO: 1595277 - DNA, 15 bp, Homo sapiens
tctactttgcccctt

SEQ ID NO: 1595278 - DNA, 23 bp, Homo sapiens
tctagaaagaaaagaccctgaga

SEQ ID NO: 1595279 - DNA, 15 bp, Homo sapiens
tctagaacacaggca

SEQ ID NO: 1595280 - DNA, 20 bp, Homo sapiens
tctagtgccctccacagccg

SEQ ID NO: 1595281 - DNA, 21 bp, Homo sapiens
tctagtgggttgacctttaaa

SEQ ID NO: 1595282 - DNA, 12 bp, Homo sapiens
tctagttcaaga

SEQ ID NO: 1595283 - DNA, 21 bp, Homo sapiens
tctagttcctgatgacccagg

SEQ ID NO: 1595284 - DNA, 13 bp, Homo sapiens
tctagttttgtca

SEQ ID NO: 1595285 - DNA, 13 bp, Homo sapiens
tctataaatcagt

SEQ ID NO: 1595286 - DNA, 16 bp, Homo sapiens
tctataaattgtccgt

SEQ ID NO: 1595287 - DNA, 21 bp, Homo sapiens
tctataagcaaattgcttttt

SEQ ID NO: 1595288 - DNA, 17 bp, Homo sapiens
tctataagtagtaaatc

SEQ ID NO: 1595289 - DNA, 22 bp, Homo sapiens
tctataagtgaggaagagttta

SEQ ID NO: 1595290 - DNA, 19 bp, Homo sapiens
tctataatcccagcacttt

SEQ ID NO: 1595291 - DNA, 19 bp, Homo sapiens
tctataatggaaacattta

SEQ ID NO: 1595292 - DNA, 12 bp, Homo sapiens
tctataatttac

SEQ ID NO: 1595293 - DNA, 14 bp, Homo sapiens
tctataccaataaa

SEQ ID NO: 1595294 - DNA, 15 bp, Homo sapiens
tctataccaataaag

SEQ ID NO: 1595295 - DNA, 15 bp, Homo sapiens
tctatacctgtgtcc

SEQ ID NO: 1595296 - DNA, 16 bp, Homo sapiens
tctatactttgttctg

SEQ ID NO: 1595297 - DNA, 19 bp, Homo sapiens
tctatactttgttctgttg

SEQ ID NO: 1595298 - DNA, 20 bp, Homo sapiens
tctatactttgttctgttgt

SEQ ID NO: 1595299 - DNA, 22 bp, Homo sapiens
tctatactttgttctgttgtct

SEQ ID NO: 1595300 - DNA, 21 bp, Homo sapiens
tctatagaaaaagtaaaagat

SEQ ID NO: 1595301 - DNA, 15 bp, Homo sapiens
tctataggcagcttc

SEQ ID NO: 1595302 - DNA, 14 bp, Homo sapiens
tctatagttctaga

SEQ ID NO: 1595303 - DNA, 15 bp, Homo sapiens
tctatatatgtgtat

SEQ ID NO: 1595304 - DNA, 19 bp, Homo sapiens
tctatatatgtgtatgtac

SEQ ID NO: 1595305 - DNA, 13 bp, Homo sapiens
tctatatcaaaaa

SEQ ID NO: 1595306 - DNA, 16 bp, Homo sapiens
tctatatcatatttct

SEQ ID NO: 1595307 - DNA, 12 bp, Homo sapiens
tctatatctgaa

SEQ ID NO: 1595308 - DNA, 12 bp, Homo sapiens
tctatatgaatt

SEQ ID NO: 1595309 - DNA, 14 bp, Homo sapiens
tctatatgaattta

SEQ ID NO: 1595310 - DNA, 18 bp, Homo sapiens
tctatattagatcaaata

SEQ ID NO: 1595311 - DNA, 12 bp, Homo sapiens
tctatatttcat

SEQ ID NO: 1595312 - DNA, 14 bp, Homo sapiens
tctcaaactggggc

SEQ ID NO: 1595313 - DNA, 18 bp, Homo sapiens
tctcaaaggagaaaaaaa

SEQ ID NO: 1595314 - DNA, 22 bp, Homo sapiens
tctcaaaggagaaaaaaaacct

SEQ ID NO: 1595315 - DNA, 21 bp, Homo sapiens
tctcaaaggagctttctcaat

SEQ ID NO: 1595316 - DNA, 18 bp, Homo sapiens
tctcaagagggcactggt

SEQ ID NO: 1595317 - DNA, 14 bp, Homo sapiens
tctcaatcagtgca

SEQ ID NO: 1595318 - DNA, 16 bp, Homo sapiens
tctcaatcagtgcagt

SEQ ID NO: 1595319 - DNA, 23 bp, Homo sapiens
tctcaatcctaatttctcctccc

SEQ ID NO: 1595320 - DNA, 19 bp, Homo sapiens
tctcaatgaaccataaatt

SEQ ID NO: 1595321 - DNA, 19 bp, Homo sapiens
tctcaatggtattgtaact

SEQ ID NO: 1595322 - DNA, 20 bp, Homo sapiens
tctcaattgaaagcttttaa

SEQ ID NO: 1595323 - DNA, 23 bp, Homo sapiens
tctcaattgaaagcttttaaaat

SEQ ID NO: 1595324 - DNA, 12 bp, Homo sapiens
tctcacacacac

SEQ ID NO: 1595325 - DNA, 14 bp, Homo sapiens
tctcacacacatag

SEQ ID NO: 1595326 - DNA, 13 bp, Homo sapiens
tctcacagagaag

SEQ ID NO: 1595327 - DNA, 18 bp, Homo sapiens
tctcacaggctgagaact

SEQ ID NO: 1595328 - DNA, 19 bp, Homo sapiens
tctcacaggctgagaactc

SEQ ID NO: 1595329 - DNA, 15 bp, Homo sapiens
tctcacattgctgta

SEQ ID NO: 1595330 - DNA, 23 bp, Homo sapiens
tctcacatttttatacctgttta

SEQ ID NO: 1595331 - DNA, 19 bp, Homo sapiens
tctcacccagtccccaccc

SEQ ID NO: 1595332 - DNA, 23 bp, Homo sapiens
tctcacccatgcaagcagaggac

SEQ ID NO: 1595333 - DNA, 21 bp, Homo sapiens
tctcaccccatcccacaccct

SEQ ID NO: 1595334 - DNA, 15 bp, Homo sapiens
tctcaccctgtgaaa

SEQ ID NO: 1595335 - DNA, 18 bp, Homo sapiens
tctcaccggctctcacct

SEQ ID NO: 1595336 - DNA, 13 bp, Homo sapiens
tctcacctggact

SEQ ID NO: 1595337 - DNA, 24 bp, Homo sapiens
tctcacctggacttaagcatctgg

SEQ ID NO: 1595338 - DNA, 16 bp, Homo sapiens
tctcacctggccctgc

SEQ ID NO: 1595339 - DNA, 21 bp, Homo sapiens
tctcacctggccctgcttcct

SEQ ID NO: 1595340 - DNA, 20 bp, Homo sapiens
tctcacgggcagtagctgtg

SEQ ID NO: 1595341 - DNA, 12 bp, Homo sapiens
tctcactcacca

SEQ ID NO: 1595342 - DNA, 17 bp, Homo sapiens
tctcactccaccaccca

SEQ ID NO: 1595343 - DNA, 13 bp, Homo sapiens
tctcactccccag

SEQ ID NO: 1595344 - DNA, 13 bp, Homo sapiens
tctcactcctacc

SEQ ID NO: 1595345 - DNA, 16 bp, Homo sapiens
tctcactcctacctgg

SEQ ID NO: 1595346 - DNA, 22 bp, Homo sapiens
tctcactgaactccaccgacca

SEQ ID NO: 1595347 - DNA, 16 bp, Homo sapiens
atcaaagtggtaaata

SEQ ID NO: 1595348 - DNA, 18 bp, Homo sapiens
tctccactgctctcagcc

SEQ ID NO: 1595349 - DNA, 22 bp, Homo sapiens
tctccactgctctcagcctccc

SEQ ID NO: 1595350 - DNA, 18 bp, Homo sapiens
tctccactgctggacatg

SEQ ID NO: 1595351 - DNA, 10 bp, Homo sapiens
tctccactgt

SEQ ID NO: 1595352 - DNA, 16 bp, Homo sapiens
tctccacttttttcat

SEQ ID NO: 1595353 - DNA, 13 bp, Homo sapiens
tctccagcccacg

SEQ ID NO: 1595354 - DNA, 16 bp, Homo sapiens
tctccagcctcagcct

SEQ ID NO: 1595355 - DNA, 12 bp, Homo sapiens
tctccagctgcc

SEQ ID NO: 1595356 - DNA, 16 bp, Homo sapiens
tctccagctgcctggg

SEQ ID NO: 1595357 - DNA, 21 bp, Homo sapiens
tctccagctgggctctgcaat

SEQ ID NO: 1595358 - DNA, 20 bp, Homo sapiens
tctccagcttcagctcaact

SEQ ID NO: 1595359 - DNA, 19 bp, Homo sapiens
tctccaggattttaatttc

SEQ ID NO: 1595360 - DNA, 21 bp, Homo sapiens
tctccaggattttaatttcag

SEQ ID NO: 1595361 - DNA, 13 bp, Homo sapiens
tctccaggcccca

SEQ ID NO: 1595362 - DNA, 15 bp, Homo sapiens
tctccaggcgccggc

SEQ ID NO: 1595363 - DNA, 20 bp, Homo sapiens
tctccagggagtcccctccc

SEQ ID NO: 1595364 - DNA, 15 bp, Homo sapiens
tctccagggctccaa

SEQ ID NO: 1595365 - DNA, 22 bp, Homo sapiens
tctccaggggctgcttcctcct

SEQ ID NO: 1595366 - DNA, 15 bp, Homo sapiens
tctccaggtcagcct

SEQ ID NO: 1595367 - DNA, 16 bp, Homo sapiens
tctccaggtcagcctg

SEQ ID NO: 1595368 - DNA, 19 bp, Homo sapiens
tctccagtatccactttgc

SEQ ID NO: 1595369 - DNA, 18 bp, Homo sapiens
tctccagtggattcccag

SEQ ID NO: 1595370 - DNA, 23 bp, Homo sapiens
tctccagttgggactcaggatat

SEQ ID NO: 1595371 - DNA, 18 bp, Homo sapiens
tctccagtttgcacctgt

SEQ ID NO: 1595372 - DNA, 15 bp, Homo sapiens
tctccagttttcagt

SEQ ID NO: 1595373 - DNA, 15 bp, Homo sapiens
tctccatatctcctt

SEQ ID NO: 1595374 - DNA, 16 bp, Homo sapiens
tctccatatctccttc

SEQ ID NO: 1595375 - DNA, 14 bp, Homo sapiens
tctccatatgttac

SEQ ID NO: 1595376 - DNA, 15 bp, Homo sapiens
tctccatatgttaca

SEQ ID NO: 1595377 - DNA, 17 bp, Homo sapiens
tctccatcagctgtaag

SEQ ID NO: 1595378 - DNA, 17 bp, Homo sapiens
tctccatgaagagcttg

SEQ ID NO: 1595379 - DNA, 14 bp, Homo sapiens
tctccatgctgcaa

SEQ ID NO: 1595380 - DNA, 15 bp, Homo sapiens
tctccattaataccc

SEQ ID NO: 1595381 - DNA, 16 bp, Homo sapiens
tctccattagaaaatt

SEQ ID NO: 1595382 - DNA, 13 bp, Homo sapiens
tctccatttgctc

SEQ ID NO: 1595383 - DNA, 15 bp, Homo sapiens
tctccattttagccc

SEQ ID NO: 1595384 - DNA, 20 bp, Homo sapiens
tctcccaaagggcacacccc

SEQ ID NO: 1595385 - DNA, 22 bp, Homo sapiens
tctcccaaatgtctattttctt

SEQ ID NO: 1595386 - DNA, 21 bp, Homo sapiens
tctcccacatgaggccatctc

SEQ ID NO: 1595387 - DNA, 22 bp, Homo sapiens
tctcccacatgaggccatctca

SEQ ID NO: 1595388 - DNA, 21 bp, Homo sapiens
tctcccaccccggcctccact

SEQ ID NO: 1595389 - DNA, 16 bp, Homo sapiens
tctcccacccggccac

SEQ ID NO: 1595390 - DNA, 13 bp, Homo sapiens
tctcccaggccag

SEQ ID NO: 1595391 - DNA, 14 bp, Homo sapiens
tctcccaggccagg

SEQ ID NO: 1595392 - DNA, 18 bp, Homo sapiens
tctcccaggcctgcctgc

SEQ ID NO: 1595393 - DNA, 18 bp, Homo sapiens
tctcccaggtaccagctg

SEQ ID NO: 1595394 - DNA, 21 bp, Homo sapiens
tctcccagtgtgagaccccaa

SEQ ID NO: 1595395 - DNA, 13 bp, Homo sapiens
tctcccatccccc

SEQ ID NO: 1595396 - DNA, 15 bp, Homo sapiens
tctcccatccccctg

SEQ ID NO: 1595397 - DNA, 17 bp, Homo sapiens
tctcccatccccctgcc

SEQ ID NO: 1595398 - DNA, 24 bp, Homo sapiens
tctcccatcctggggcagcactcc

SEQ ID NO: 1595399 - DNA, 18 bp, Homo sapiens
tctccccagccagaggtg

SEQ ID NO: 1595400 - DNA, 16 bp, Homo sapiens
tctccccagcccagag

SEQ ID NO: 1595401 - DNA, 17 bp, Homo sapiens
tctccccagcccagaga

SEQ ID NO: 1595402 - DNA, 19 bp, Homo sapiens
tctccccagcccagagaca

SEQ ID NO: 1595403 - DNA, 18 bp, Homo sapiens
tctccccaggcatttgcc

SEQ ID NO: 1595404 - DNA, 12 bp, Homo sapiens
tctccccaggcc

SEQ ID NO: 1595405 - DNA, 13 bp, Homo sapiens
tctccccaggcct

SEQ ID NO: 1595406 - DNA, 12 bp, Homo sapiens
tctccccagtgc

SEQ ID NO: 1595407 - DNA, 18 bp, Homo sapiens
tctccccagtgcctgcca

SEQ ID NO: 1595408 - DNA, 19 bp, Homo sapiens
tctccccagtgcctgccac

SEQ ID NO: 1595409 - DNA, 21 bp, Homo sapiens
tctccccagtgcctgccactc

SEQ ID NO: 1595410 - DNA, 22 bp, Homo sapiens
tctccccatgtgcctgcaccag

SEQ ID NO: 1595411 - DNA, 22 bp, Homo sapiens
tctcccccaacaccccgcctgc

SEQ ID NO: 1595412 - DNA, 15 bp, Homo sapiens
tctcccccaccccct

SEQ ID NO: 1595413 - DNA, 12 bp, Homo sapiens
tctcccctgcac

SEQ ID NO: 1595414 - DNA, 15 bp, Homo sapiens
tctcccctgcactgt

SEQ ID NO: 1595415 - DNA, 16 bp, Homo sapiens
tctcccctgcccccag

SEQ ID NO: 1595416 - DNA, 21 bp, Homo sapiens
tctcccctgcccccaggactg

SEQ ID NO: 1595417 - DNA, 22 bp, Homo sapiens
tctcccctgcccccaggactgg

SEQ ID NO: 1595418 - DNA, 14 bp, Homo sapiens
tctcccctgccctt

SEQ ID NO: 1595419 - DNA, 14 bp, Homo sapiens
tctcccctgccggt

SEQ ID NO: 1595420 - DNA, 14 bp, Homo sapiens
tctcccgcctcagc

SEQ ID NO: 1595421 - DNA, 13 bp, Homo sapiens
ttggtccaaaaaa

SEQ ID NO: 1595422 - DNA, 16 bp, Homo sapiens
ttggtcccaagcctga

SEQ ID NO: 1595423 - DNA, 15 bp, Homo sapiens
ttggtcctctctctg

SEQ ID NO: 1595424 - DNA, 14 bp, Homo sapiens
ttggtcctttacac

SEQ ID NO: 1595425 - DNA, 16 bp, Homo sapiens
ttggtctctatctcct

SEQ ID NO: 1595426 - DNA, 15 bp, Homo sapiens
ttggtcttatttatt

SEQ ID NO: 1595427 - DNA, 19 bp, Homo sapiens
ttggtcttatttattattg

SEQ ID NO: 1595428 - DNA, 21 bp, Homo sapiens
ttggtcttgaagtctgtacag

SEQ ID NO: 1595429 - DNA, 19 bp, Homo sapiens
ttggtgaaggatccaggaa

SEQ ID NO: 1595430 - DNA, 22 bp, Homo sapiens
ttggtgaatcggttgttctttc

SEQ ID NO: 1595431 - DNA, 17 bp, Homo sapiens
ttggtgaatttcacaag

SEQ ID NO: 1595432 - DNA, 15 bp, Homo sapiens
ttggtgaattttcaa

SEQ ID NO: 1595433 - DNA, 18 bp, Homo sapiens
ttggtgactgggaaagtt

SEQ ID NO: 1595434 - DNA, 18 bp, Homo sapiens
ttggtgagcagagcggga

SEQ ID NO: 1595435 - DNA, 21 bp, Homo sapiens
ttggtgagtcttggttctaaa

SEQ ID NO: 1595436 - DNA, 16 bp, Homo sapiens
ttggtgattttagatt

SEQ ID NO: 1595437 - DNA, 17 bp, Homo sapiens
ttggtgcatctagaaag

SEQ ID NO: 1595438 - DNA, 12 bp, Homo sapiens
ttggtgcctggc

SEQ ID NO: 1595439 - DNA, 13 bp, Homo sapiens
ttggtgcctggcc

SEQ ID NO: 1595440 - DNA, 14 bp, Homo sapiens
ttggtgctgtgtgc

SEQ ID NO: 1595441 - DNA, 16 bp, Homo sapiens
ttggtggagataaaga

SEQ ID NO: 1595442 - DNA, 18 bp, Homo sapiens
ttggtggagcagccagag

SEQ ID NO: 1595443 - DNA, 23 bp, Homo sapiens
ttggtggccgcaaccacttgcta

SEQ ID NO: 1595444 - DNA, 20 bp, Homo sapiens
ttggtggggggtccagtctg

SEQ ID NO: 1595445 - DNA, 20 bp, Homo sapiens
ttggtggtagccatcaagca

SEQ ID NO: 1595446 - DNA, 18 bp, Homo sapiens
ttggtgtattatcatttt

SEQ ID NO: 1595447 - DNA, 14 bp, Homo sapiens
ttggtgttcctgga

SEQ ID NO: 1595448 - DNA, 22 bp, Homo sapiens
ttggtgttcgtttccatcatgt

SEQ ID NO: 1595449 - DNA, 22 bp, Homo sapiens
ttggttaaaactgtacatttaa

SEQ ID NO: 1595450 - DNA, 12 bp, Homo sapiens
ttggttaatatg

SEQ ID NO: 1595451 - DNA, 22 bp, Homo sapiens
ttggttagacgccttccaggtc

SEQ ID NO: 1595452 - DNA, 18 bp, Homo sapiens
ttggttcatcagtgttaa

SEQ ID NO: 1595453 - DNA, 13 bp, Homo sapiens
ttggttctaagga

SEQ ID NO: 1595454 - DNA, 16 bp, Homo sapiens
ttggttctctccagga

SEQ ID NO: 1595455 - DNA, 19 bp, Homo sapiens
ttggttctctccaggaagg

SEQ ID NO: 1595456 - DNA, 12 bp, Homo sapiens
ttggttcttccc

SEQ ID NO: 1595457 - DNA, 22 bp, Homo sapiens
ttggttggaagctaccagagct

SEQ ID NO: 1595458 - DNA, 22 bp, Homo sapiens
ttggttgtaaatgctcgtgtga

SEQ ID NO: 1595459 - DNA, 12 bp, Homo sapiens
ttggttgtcaat

SEQ ID NO: 1595460 - DNA, 14 bp, Homo sapiens
ttggttgtgctgat

SEQ ID NO: 1595461 - DNA, 18 bp, Homo sapiens
ttggttgttttttccttt

SEQ ID NO: 1595462 - DNA, 18 bp, Homo sapiens
ttggtttaaagaaagtgt

SEQ ID NO: 1595463 - DNA, 11 bp, Homo sapiens
ttggtttgaca

SEQ ID NO: 1595464 - DNA, 22 bp, Homo sapiens
ttggtttgacaattttgtctta

SEQ ID NO: 1595465 - DNA, 19 bp, Homo sapiens
ttggtttgctagtatcttg

SEQ ID NO: 1595466 - DNA, 16 bp, Homo sapiens
ttggtttggggagaaa

SEQ ID NO: 1595467 - DNA, 17 bp, Homo sapiens
ttggtttggggagaaat

SEQ ID NO: 1595468 - DNA, 12 bp, Homo sapiens
ttggtttgtatg

SEQ ID NO: 1595469 - DNA, 14 bp, Homo sapiens
ttggtttgtatgag

SEQ ID NO: 1595470 - DNA, 23 bp, Homo sapiens
ttggttttatggttacttcttct

SEQ ID NO: 1595471 - DNA, 14 bp, Homo sapiens
ttggttttgttccc

SEQ ID NO: 1595472 - DNA, 18 bp, Homo sapiens
ttggttttgttcccctcc

SEQ ID NO: 1595473 - DNA, 22 bp, Homo sapiens
ttggtttttactgctctgagaa

SEQ ID NO: 1595474 - DNA, 13 bp, Homo sapiens
ttgtaaaaaaagc

SEQ ID NO: 1595475 - DNA, 14 bp, Homo sapiens
ttgtaaaaaaagca

SEQ ID NO: 1595476 - DNA, 19 bp, Homo sapiens
ttgtaaaaacagcattgct

SEQ ID NO: 1595477 - DNA, 20 bp, Homo sapiens
ttgtaaaaacagcattgctt

SEQ ID NO: 1595478 - DNA, 22 bp, Homo sapiens
ttgtaaaaatcttttgaagcat

SEQ ID NO: 1595479 - DNA, 22 bp, Homo sapiens
ttgtaaaacaatgccatgaaca

SEQ ID NO: 1595480 - DNA, 15 bp, Homo sapiens
ttgtaaaacaggtag

SEQ ID NO: 1595481 - DNA, 13 bp, Homo sapiens
ttgtaaaactgtt

SEQ ID NO: 1595482 - DNA, 16 bp, Homo sapiens
ttgtaaaactgttatt

SEQ ID NO: 1595483 - DNA, 20 bp, Homo sapiens
ttgtaaaagaacagtaaaca

SEQ ID NO: 1595484 - DNA, 18 bp, Homo sapiens
ttgtaaaatagaaaaagt

SEQ ID NO: 1595485 - DNA, 17 bp, Homo sapiens
ttgtaaagatttctgtt

SEQ ID NO: 1595486 - DNA, 17 bp, Homo sapiens
ttgtaaagtatgtatta

SEQ ID NO: 1595487 - DNA, 20 bp, Homo sapiens
ttgtaaataaagtctatttt

SEQ ID NO: 1595488 - DNA, 12 bp, Homo sapiens
ttgtaaatacac

SEQ ID NO: 1595489 - DNA, 13 bp, Homo sapiens
ttgtaaatacacc

SEQ ID NO: 1595490 - DNA, 19 bp, Homo sapiens
ttgtaaatatttatgtaaa

SEQ ID NO: 1595491 - DNA, 12 bp, Homo sapiens
ttgtaaatgcct

SEQ ID NO: 1595492 - DNA, 13 bp, Homo sapiens
ttgtaaatgcctc

SEQ ID NO: 1595493 - DNA, 22 bp, Homo sapiens
ttgtaaatgtactggtaattgt

SEQ ID NO: 1595494 - DNA, 16 bp, Homo sapiens
ttgtaacaagaaaaca

SEQ ID NO: 1595495 - DNA, 12 bp, Homo sapiens
ttgtaacctgct

SEQ ID NO: 1595496 - DNA, 19 bp, Homo sapiens
ttgtaacttatattgaaga

SEQ ID NO: 1595497 - DNA, 12 bp, Homo sapiens
ttgtaagtcatc

SEQ ID NO: 1595498 - DNA, 19 bp, Homo sapiens
ttgtaagtgtaaaaaatgt

SEQ ID NO: 1595499 - DNA, 13 bp, Homo sapiens
ttgtaataagcaa

SEQ ID NO: 1595500 - DNA, 14 bp, Homo sapiens
ttgtaataagcaat

SEQ ID NO: 1595501 - DNA, 21 bp, Homo sapiens
ttgtaatatgtatattaagaa

SEQ ID NO: 1595502 - DNA, 16 bp, Homo sapiens
ttgtaatcaagccttt

SEQ ID NO: 1595503 - DNA, 18 bp, Homo sapiens
ttgtaatcctagcacttt

SEQ ID NO: 1595504 - DNA, 15 bp, Homo sapiens
ttgtaatctgaataa

SEQ ID NO: 1595505 - DNA, 17 bp, Homo sapiens
ttgtaatctgaataaag

SEQ ID NO: 1595506 - DNA, 23 bp, Homo sapiens
ttgtaattaaaagcaaatcattt

SEQ ID NO: 1595507 - DNA, 17 bp, Homo sapiens
ttgtaattctaaatgaa

SEQ ID NO: 1595508 - DNA, 17 bp, Homo sapiens
ttgtaattgcttacatt

SEQ ID NO: 1595509 - DNA, 18 bp, Homo sapiens
ttgtaattgcttacattt

SEQ ID NO: 1595510 - DNA, 12 bp, Homo sapiens
ttgtaattgtgg

SEQ ID NO: 1595511 - DNA, 13 bp, Homo sapiens
ttgtaattgtgta

SEQ ID NO: 1595512 - DNA, 22 bp, Homo sapiens
ttgtaattgtgtaaaaaatgga

SEQ ID NO: 1595513 - DNA, 16 bp, Homo sapiens
ttgtaatttaaaataa

SEQ ID NO: 1595514 - DNA, 19 bp, Homo sapiens
ttgtaattttaaaagtcta

SEQ ID NO: 1595515 - DNA, 18 bp, Homo sapiens
ttgtacaaaattaagcaa

SEQ ID NO: 1595516 - DNA, 15 bp, Homo sapiens
ttgtacaaataaacc

SEQ ID NO: 1595517 - DNA, 18 bp, Homo sapiens
ttgtacaaataaacctga

SEQ ID NO: 1595518 - DNA, 13 bp, Homo sapiens
ttgtacaaatgta

SEQ ID NO: 1595519 - DNA, 13 bp, Homo sapiens
ttgtacaataaat

SEQ ID NO: 1595520 - DNA, 22 bp, Homo sapiens
ttgtacaatggtttattcccaa

SEQ ID NO: 1595521 - DNA, 19 bp, Homo sapiens
ttgtacaattactaaattg

SEQ ID NO: 1595522 - DNA, 14 bp, Homo sapiens
ttgtacaattttaa

SEQ ID NO: 1595523 - DNA, 20 bp, Homo sapiens
ttgtacaattttaaagttct

SEQ ID NO: 1595524 - DNA, 21 bp, Homo sapiens
ttgtacagaatatttctattg

SEQ ID NO: 1595525 - DNA, 22 bp, Homo sapiens
ttgtacagaatatttctattga

SEQ ID NO: 1595526 - DNA, 14 bp, Homo sapiens
ttgtacagactgtt

SEQ ID NO: 1595527 - DNA, 19 bp, Homo sapiens
ttgtacatacgatttaagg

SEQ ID NO: 1595528 - DNA, 15 bp, Homo sapiens
ttgtacatattgtta

SEQ ID NO: 1595529 - DNA, 20 bp, Homo sapiens
ttgtacatgtaacattaaag

SEQ ID NO: 1595530 - DNA, 21 bp, Homo sapiens
ttgtacatgtgtagcctgtgc

SEQ ID NO: 1595531 - DNA, 22 bp, Homo sapiens
ttgtacattacactaaattatt

SEQ ID NO: 1595532 - DNA, 16 bp, Homo sapiens
ttgtacgaagagtatt

SEQ ID NO: 1595533 - DNA, 17 bp, Homo sapiens
ttgtacgtaaagcttaa

SEQ ID NO: 1595534 - DNA, 21 bp, Homo sapiens
ttgtacgtaaagcttaaattg

SEQ ID NO: 1595535 - DNA, 11 bp, Homo sapiens
ttgtactatgt

SEQ ID NO: 1595536 - DNA, 17 bp, Homo sapiens
tttaagcctgcattctt

SEQ ID NO: 1595537 - DNA, 18 bp, Homo sapiens
tttaagcctttgttgaac

SEQ ID NO: 1595538 - DNA, 23 bp, Homo sapiens
tttaagcctttgttgaactgtta

SEQ ID NO: 1595539 - DNA, 17 bp, Homo sapiens
tttaagccttttgtgta

SEQ ID NO: 1595540 - DNA, 16 bp, Homo sapiens
tttaaggatggatggc

SEQ ID NO: 1595541 - DNA, 21 bp, Homo sapiens
tttaaggatggatggcaccct

SEQ ID NO: 1595542 - DNA, 18 bp, Homo sapiens
tttaaggctaaaacttaa

SEQ ID NO: 1595543 - DNA, 14 bp, Homo sapiens
tttaagggggaaaa

SEQ ID NO: 1595544 - DNA, 13 bp, Homo sapiens
tttaagtatatag

SEQ ID NO: 1595545 - DNA, 15 bp, Homo sapiens
tttaagtgaaaatgg

SEQ ID NO: 1595546 - DNA, 17 bp, Homo sapiens
tttaagtgaaaatggtc

SEQ ID NO: 1595547 - DNA, 13 bp, Homo sapiens
tttaagtgaagga

SEQ ID NO: 1595548 - DNA, 15 bp, Homo sapiens
tttaagtgacacaga

SEQ ID NO: 1595549 - DNA, 21 bp, Homo sapiens
tttaagtgacacagacatttt

SEQ ID NO: 1595550 - DNA, 22 bp, Homo sapiens
tttaagtgtaactggcagtttt

SEQ ID NO: 1595551 - DNA, 22 bp, Homo sapiens
tttaagtttcaaacttactatt

SEQ ID NO: 1595552 - DNA, 18 bp, Homo sapiens
tttaagtttgcactcaaa

SEQ ID NO: 1595553 - DNA, 19 bp, Homo sapiens
tttaataaaaatacacatg

SEQ ID NO: 1595554 - DNA, 11 bp, Homo sapiens
tttaataaaac

SEQ ID NO: 1595555 - DNA, 19 bp, Homo sapiens
tttaataaaagatttacat

SEQ ID NO: 1595556 - DNA, 15 bp, Homo sapiens
tttaataaagatgag

SEQ ID NO: 1595557 - DNA, 17 bp, Homo sapiens
tttaataaagatgagtt

SEQ ID NO: 1595558 - DNA, 16 bp, Homo sapiens
tttaataaatattgag

SEQ ID NO: 1595559 - DNA, 20 bp, Homo sapiens
tttaataacaaggagatttc

SEQ ID NO: 1595560 - DNA, 16 bp, Homo sapiens
tttaataacatatcta

SEQ ID NO: 1595561 - DNA, 14 bp, Homo sapiens
tttaatacagcagt

SEQ ID NO: 1595562 - DNA, 20 bp, Homo sapiens
tttaatacagctcagtaaat

SEQ ID NO: 1595563 - DNA, 15 bp, Homo sapiens
tttaatacttgtaat

SEQ ID NO: 1595564 - DNA, 23 bp, Homo sapiens
tttaatagaaataaattcctaaa

SEQ ID NO: 1595565 - DNA, 20 bp, Homo sapiens
tttaatagtcattccaaata

SEQ ID NO: 1595566 - DNA, 23 bp, Homo sapiens
tttaatataaagtagtcctgtga

SEQ ID NO: 1595567 - DNA, 15 bp, Homo sapiens
tttaatatactgcat

SEQ ID NO: 1595568 - DNA, 15 bp, Homo sapiens
tttaatatcttcagc

SEQ ID NO: 1595569 - DNA, 14 bp, Homo sapiens
tttaatattactgt

SEQ ID NO: 1595570 - DNA, 15 bp, Homo sapiens
tttaatattgagaaa

SEQ ID NO: 1595571 - DNA, 22 bp, Homo sapiens
tttaatattgagaaagaaacta

SEQ ID NO: 1595572 - DNA, 20 bp, Homo sapiens
tttaatattttgtattttca

SEQ ID NO: 1595573 - DNA, 14 bp, Homo sapiens
tttaatcatgaaat

SEQ ID NO: 1595574 - DNA, 24 bp, Homo sapiens
tttaatcatgaaattacttatcat

SEQ ID NO: 1595575 - DNA, 17 bp, Homo sapiens
tttaatcttagctttta

SEQ ID NO: 1595576 - DNA, 24 bp, Homo sapiens
tttaatcttagcttttaatagtgt

SEQ ID NO: 1595577 - DNA, 11 bp, Homo sapiens
tttaatgaaat

SEQ ID NO: 1595578 - DNA, 23 bp, Homo sapiens
tttaatgaaatcaaatgtatgta

SEQ ID NO: 1595579 - DNA, 19 bp, Homo sapiens
tttaatgagtgcacctgcc

SEQ ID NO: 1595580 - DNA, 12 bp, Homo sapiens
tttaatgctgcc

SEQ ID NO: 1595581 - DNA, 14 bp, Homo sapiens
tttaatgctgcctt

SEQ ID NO: 1595582 - DNA, 15 bp, Homo sapiens
tttaatgggatttca

SEQ ID NO: 1595583 - DNA, 22 bp, Homo sapiens
tttaatgggggtagcagctgga

SEQ ID NO: 1595584 - DNA, 14 bp, Homo sapiens
tttaatgtacaagt

SEQ ID NO: 1595585 - DNA, 18 bp, Homo sapiens
tttaatgtatctatttgt

SEQ ID NO: 1595586 - DNA, 19 bp, Homo sapiens
tttaatgtctcctttgctc

SEQ ID NO: 1595587 - DNA, 15 bp, Homo sapiens
tttaatgtctgttta

SEQ ID NO: 1595588 - DNA, 19 bp, Homo sapiens
tttaattaatcatgaatgt

SEQ ID NO: 1595589 - DNA, 17 bp, Homo sapiens
tttaattaatgaaatat

SEQ ID NO: 1595590 - DNA, 12 bp, Homo sapiens
tttaattatttt

SEQ ID NO: 1595591 - DNA, 15 bp, Homo sapiens
tttaattattttaaa

SEQ ID NO: 1595592 - DNA, 17 bp, Homo sapiens
tttaattcaccaaagta

SEQ ID NO: 1595593 - DNA, 16 bp, Homo sapiens
tttaattcacgtgctt

SEQ ID NO: 1595594 - DNA, 12 bp, Homo sapiens
tttaattctctc

SEQ ID NO: 1595595 - DNA, 21 bp, Homo sapiens
tttaattctgtcttgttcatt

SEQ ID NO: 1595596 - DNA, 16 bp, Homo sapiens
tttaattgaaattaac

SEQ ID NO: 1595597 - DNA, 15 bp, Homo sapiens
tttaattgtaaagta

SEQ ID NO: 1595598 - DNA, 22 bp, Homo sapiens
tttaattgtagttctgtgtact

SEQ ID NO: 1595599 - DNA, 12 bp, Homo sapiens
tttaattgtata

SEQ ID NO: 1595600 - DNA, 15 bp, Homo sapiens
tttaattgtataagt

SEQ ID NO: 1595601 - DNA, 21 bp, Homo sapiens
tttaattgtataagtcaagca

SEQ ID NO: 1595602 - DNA, 14 bp, Homo sapiens
tttaatttaaactg

SEQ ID NO: 1595603 - DNA, 13 bp, Homo sapiens
tttaattttaatg

SEQ ID NO: 1595604 - DNA, 17 bp, Homo sapiens
tttaattttaatgctgt

SEQ ID NO: 1595605 - DNA, 22 bp, Homo sapiens
tttaattttgacactatatctg

SEQ ID NO: 1595606 - DNA, 14 bp, Homo sapiens
tttaattttgatat

SEQ ID NO: 1595607 - DNA, 14 bp, Homo sapiens
tttaatttttaaat

SEQ ID NO: 1595608 - DNA, 17 bp, Homo sapiens
tttaattttttttagta

SEQ ID NO: 1595609 - DNA, 18 bp, Homo sapiens
tttaattttttttagtat

SEQ ID NO: 1595610 - DNA, 20 bp, Homo sapiens
tttacaaaatacaaaaaagt

SEQ ID NO: 1595611 - DNA, 20 bp, Homo sapiens
tttacaacataatctagttt

SEQ ID NO: 1595612 - DNA, 17 bp, Homo sapiens
tttacaagggagaagac

SEQ ID NO: 1595613 - DNA, 15 bp, Homo sapiens
tttacaataaatatt

SEQ ID NO: 1595614 - DNA, 19 bp, Homo sapiens
tttacaataaatattctgc

SEQ ID NO: 1595615 - DNA, 21 bp, Homo sapiens
tttacaatcagccacattcta

SEQ ID NO: 1595616 - DNA, 15 bp, Homo sapiens
tttacaatgtcatat

SEQ ID NO: 1595617 - DNA, 15 bp, Homo sapiens
tttacaattgaaatg

SEQ ID NO: 1595618 - DNA, 14 bp, Homo sapiens
tttacacagaaaca

SEQ ID NO: 1595619 - DNA, 16 bp, Homo sapiens
tttacactctttgtaa

SEQ ID NO: 1595620 - DNA, 23 bp, Homo sapiens
tttacagagaggatacatttaat

SEQ ID NO: 1595621 - DNA, 14 bp, Homo sapiens
tttacagcaaaaga

SEQ ID NO: 1595622 - DNA, 16 bp, Homo sapiens
tttacagcactactct

SEQ ID NO: 1595623 - DNA, 18 bp, Homo sapiens
tttacagcactactctgt

SEQ ID NO: 1595624 - DNA, 20 bp, Homo sapiens
tttacagcattgtctttgct

SEQ ID NO: 1595625 - DNA, 22 bp, Homo sapiens
tttacaggaaaaaaaattctgt

SEQ ID NO: 1595626 - DNA, 20 bp, Homo sapiens
tttacagttagggttttgca

SEQ ID NO: 1595627 - DNA, 21 bp, Homo sapiens
tttacagttagggttttgcaa

SEQ ID NO: 1595628 - DNA, 19 bp, Homo sapiens
tttacatataaaatgtaat

SEQ ID NO: 1595629 - DNA, 14 bp, Homo sapiens
tttacatgctacta

SEQ ID NO: 1595630 - DNA, 16 bp, Homo sapiens
tttacattcatcaata

SEQ ID NO: 1595631 - DNA, 13 bp, Homo sapiens
tttacattgtaaa

SEQ ID NO: 1595632 - DNA, 19 bp, Homo sapiens
tttacattgtcctgtagct

SEQ ID NO: 1595633 - DNA, 11 bp, Homo sapiens
tttaccaaagc

SEQ ID NO: 1595634 - DNA, 12 bp, Homo sapiens
tttaccaaagca

SEQ ID NO: 1595635 - DNA, 15 bp, Homo sapiens
tttaccaaagcatca

SEQ ID NO: 1595636 - DNA, 13 bp, Homo sapiens
tttaccatcatct

SEQ ID NO: 1595637 - DNA, 16 bp, Homo sapiens
tttacccacctagaac

SEQ ID NO: 1595638 - DNA, 15 bp, Homo sapiens
tttacccatgaagat

SEQ ID NO: 1595639 - DNA, 13 bp, Homo sapiens
tttaccctcttgg

SEQ ID NO: 1595640 - DNA, 13 bp, Homo sapiens
tttacccttcagg

SEQ ID NO: 1595641 - DNA, 22 bp, Homo sapiens
tttaccctttggccccactttg

SEQ ID NO: 1595642 - DNA, 18 bp, Homo sapiens
tttacccttttccccctt

SEQ ID NO: 1595643 - DNA, 15 bp, Homo sapiens
tttacctaagattac

SEQ ID NO: 1595644 - DNA, 11 bp, Homo sapiens
tttacctaatc

SEQ ID NO: 1595645 - DNA, 14 bp, Homo sapiens
tttacctaatctcc

SEQ ID NO: 1595646 - DNA, 19 bp, Homo sapiens
tttacctaccacagtgtct

SEQ ID NO: 1595647 - DNA, 21 bp, Homo sapiens
tttacctatggaagtggttct

SEQ ID NO: 1595648 - DNA, 13 bp, Homo sapiens
tttacctgagacc

SEQ ID NO: 1595649 - DNA, 21 bp, Homo sapiens
tttacctggcttatttaatat

SEQ ID NO: 1595650 - DNA, 15 bp, Homo sapiens
tttacctgtgaaata

SEQ ID NO: 1595651 - DNA, 15 bp, Homo sapiens
tttcagaattttgta

SEQ ID NO: 1595652 - DNA, 17 bp, Homo sapiens
tttcagagcccccagcc

SEQ ID NO: 1595653 - DNA, 23 bp, Homo sapiens
tttcagatatcttggacaaatca

SEQ ID NO: 1595654 - DNA, 16 bp, Homo sapiens
tttcagatgcttctgg

SEQ ID NO: 1595655 - DNA, 15 bp, Homo sapiens
tttcagatgtcttct

SEQ ID NO: 1595656 - DNA, 20 bp, Homo sapiens
tttcagatgtcttctgcctg

SEQ ID NO: 1595657 - DNA, 16 bp, Homo sapiens
tttcagatgtgcaata

SEQ ID NO: 1595658 - DNA, 17 bp, Homo sapiens
tttcagcaacaagactg

SEQ ID NO: 1595659 - DNA, 19 bp, Homo sapiens
tttcagccaaactgtagat

SEQ ID NO: 1595660 - DNA, 12 bp, Homo sapiens
tttcagccacat

SEQ ID NO: 1595661 - DNA, 18 bp, Homo sapiens
tttcagcgactccgttgg

SEQ ID NO: 1595662 - DNA, 11 bp, Homo sapiens
tttcaggaaaa

SEQ ID NO: 1595663 - DNA, 19 bp, Homo sapiens
tttcaggatactctgtcag

SEQ ID NO: 1595664 - DNA, 18 bp, Homo sapiens
tttcaggtgtttagttgc

SEQ ID NO: 1595665 - DNA, 18 bp, Homo sapiens
tttcaggttttgtaaaga

SEQ ID NO: 1595666 - DNA, 15 bp, Homo sapiens
tttcagtatactgtg

SEQ ID NO: 1595667 - DNA, 16 bp, Homo sapiens
tttcagtatactgtgt

SEQ ID NO: 1595668 - DNA, 23 bp, Homo sapiens
tttcagtatgtccccataagaca

SEQ ID NO: 1595669 - DNA, 13 bp, Homo sapiens
tttcagtcccctc

SEQ ID NO: 1595670 - DNA, 16 bp, Homo sapiens
tttcagtcccctctct

SEQ ID NO: 1595671 - DNA, 19 bp, Homo sapiens
tttcagtcccctctctctg

SEQ ID NO: 1595672 - DNA, 22 bp, Homo sapiens
tttcagtgaagatgctgtaaat

SEQ ID NO: 1595673 - DNA, 14 bp, Homo sapiens
tttcagtggcttcc

SEQ ID NO: 1595674 - DNA, 21 bp, Homo sapiens
tttcagttgatcactggcaat

SEQ ID NO: 1595675 - DNA, 14 bp, Homo sapiens
tttcatacacttat

SEQ ID NO: 1595676 - DNA, 12 bp, Homo sapiens
tttcatagatgt

SEQ ID NO: 1595677 - DNA, 17 bp, Homo sapiens
tttcatagcctacattt

SEQ ID NO: 1595678 - DNA, 13 bp, Homo sapiens
tttcatatttctt

SEQ ID NO: 1595679 - DNA, 14 bp, Homo sapiens
tttcatatttgggg

SEQ ID NO: 1595680 - DNA, 17 bp, Homo sapiens
tttcatcgtgttaacca

SEQ ID NO: 1595681 - DNA, 14 bp, Homo sapiens
tttcatctaccttt

SEQ ID NO: 1595682 - DNA, 16 bp, Homo sapiens
tttcatctatttctga

SEQ ID NO: 1595683 - DNA, 18 bp, Homo sapiens
tttcatctctctacctcc

SEQ ID NO: 1595684 - DNA, 15 bp, Homo sapiens
tttcatctgaaaagc

SEQ ID NO: 1595685 - DNA, 18 bp, Homo sapiens
tttcatctgaaaagcagt

SEQ ID NO: 1595686 - DNA, 15 bp, Homo sapiens
tttcatctgctctcc

SEQ ID NO: 1595687 - DNA, 16 bp, Homo sapiens
tttcatctgctctcct

SEQ ID NO: 1595688 - DNA, 17 bp, Homo sapiens
tttcatctgctctcctt

SEQ ID NO: 1595689 - DNA, 19 bp, Homo sapiens
tttcatctgctctccttcc

SEQ ID NO: 1595690 - DNA, 16 bp, Homo sapiens
tttcatcttctggaat

SEQ ID NO: 1595691 - DNA, 15 bp, Homo sapiens
tttcatgaaaaagct

SEQ ID NO: 1595692 - DNA, 17 bp, Homo sapiens
tttcatgaccagtaaag

SEQ ID NO: 1595693 - DNA, 20 bp, Homo sapiens
tttcatgattcatgagctgg

SEQ ID NO: 1595694 - DNA, 18 bp, Homo sapiens
tttcatggacactttgaa

SEQ ID NO: 1595695 - DNA, 20 bp, Homo sapiens
tttcatggctgctgttgctt

SEQ ID NO: 1595696 - DNA, 23 bp, Homo sapiens
tttcatgtgcggggatcatctgc

SEQ ID NO: 1595697 - DNA, 23 bp, Homo sapiens
tttcatgtgttgcaaattattct

SEQ ID NO: 1595698 - DNA, 17 bp, Homo sapiens
tttcatgttcactgtga

SEQ ID NO: 1595699 - DNA, 14 bp, Homo sapiens
tttcattaaacttg

SEQ ID NO: 1595700 - DNA, 21 bp, Homo sapiens
tttcattaaacttgaagcagt

SEQ ID NO: 1595701 - DNA, 22 bp, Homo sapiens
tttcattaaataaatttgactt

SEQ ID NO: 1595702 - DNA, 21 bp, Homo sapiens
tttcattaatacagggcattt

SEQ ID NO: 1595703 - DNA, 18 bp, Homo sapiens
tttcattagcagttgctc

SEQ ID NO: 1595704 - DNA, 15 bp, Homo sapiens
tttcattatcatcaa

SEQ ID NO: 1595705 - DNA, 20 bp, Homo sapiens
tttcattatgtaaaatgttt

SEQ ID NO: 1595706 - DNA, 13 bp, Homo sapiens
tttcatttacaaa

SEQ ID NO: 1595707 - DNA, 20 bp, Homo sapiens
tttcatttagtgctaaacaa

SEQ ID NO: 1595708 - DNA, 15 bp, Homo sapiens
tttcattttagacat

SEQ ID NO: 1595709 - DNA, 20 bp, Homo sapiens
tttcatttttttccaggctg

SEQ ID NO: 1595710 - DNA, 22 bp, Homo sapiens
tttccaaaacaaaaagatgtct

SEQ ID NO: 1595711 - DNA, 21 bp, Homo sapiens
tttccaaaacatttctggaca

SEQ ID NO: 1595712 - DNA, 19 bp, Homo sapiens
tttccaaaacctcagttaa

SEQ ID NO: 1595713 - DNA, 11 bp, Homo sapiens
tttccaaagag

SEQ ID NO: 1595714 - DNA, 15 bp, Homo sapiens
tttccaaataaacat

SEQ ID NO: 1595715 - DNA, 13 bp, Homo sapiens
tttccaaattaaa

SEQ ID NO: 1595716 - DNA, 14 bp, Homo sapiens
tttccaaattaaaa

SEQ ID NO: 1595717 - DNA, 20 bp, Homo sapiens
tttccaaattaaaacaaata

SEQ ID NO: 1595718 - DNA, 21 bp, Homo sapiens
tttccaacaccacagacacac

SEQ ID NO: 1595719 - DNA, 19 bp, Homo sapiens
tttccaactactaatagaa

SEQ ID NO: 1595720 - DNA, 14 bp, Homo sapiens
tttccaagctcctt

SEQ ID NO: 1595721 - DNA, 15 bp, Homo sapiens
tttccaatatgtgat

SEQ ID NO: 1595722 - DNA, 17 bp, Homo sapiens
tttccaatatgtgattt

SEQ ID NO: 1595723 - DNA, 19 bp, Homo sapiens
tttccacaaaatctgtcca

SEQ ID NO: 1595724 - DNA, 20 bp, Homo sapiens
tttccacaagattcccagag

SEQ ID NO: 1595725 - DNA, 22 bp, Homo sapiens
tttccacaagattcccagagac

SEQ ID NO: 1595726 - DNA, 14 bp, Homo sapiens
tttccacacgcatt

SEQ ID NO: 1595727 - DNA, 19 bp, Homo sapiens
tttccacgatgaaaaactt

SEQ ID NO: 1595728 - DNA, 15 bp, Homo sapiens
tttccacttgtgggc

SEQ ID NO: 1595729 - DNA, 19 bp, Homo sapiens
tttccagaggctattattt

SEQ ID NO: 1595730 - DNA, 16 bp, Homo sapiens
tttccagcagaagaca

SEQ ID NO: 1595731 - DNA, 22 bp, Homo sapiens
tttccagcatttttataaacta

SEQ ID NO: 1595732 - DNA, 21 bp, Homo sapiens
tttccaggaaaaaataaaaag

SEQ ID NO: 1595733 - DNA, 18 bp, Homo sapiens
tttccaggatcctgcagg

SEQ ID NO: 1595734 - DNA, 22 bp, Homo sapiens
tttccaggctatgtataaaata

SEQ ID NO: 1595735 - DNA, 12 bp, Homo sapiens
tttccagtctgt

SEQ ID NO: 1595736 - DNA, 15 bp, Homo sapiens
tttccagtctgtaca

SEQ ID NO: 1595737 - DNA, 23 bp, Homo sapiens
tttccagtggtcatgctcagcct

SEQ ID NO: 1595738 - DNA, 16 bp, Homo sapiens
tttccagttaaggacc

SEQ ID NO: 1595739 - DNA, 17 bp, Homo sapiens
tttccagttcctctttt

SEQ ID NO: 1595740 - DNA, 19 bp, Homo sapiens
tttccatagtgttaactgt

SEQ ID NO: 1595741 - DNA, 23 bp, Homo sapiens
tttccatcaactcccaacttctt

SEQ ID NO: 1595742 - DNA, 12 bp, Homo sapiens
tttccatcatgt

SEQ ID NO: 1595743 - DNA, 16 bp, Homo sapiens
tttccatcatgtctgt

SEQ ID NO: 1595744 - DNA, 13 bp, Homo sapiens
tttccatctaaaa

SEQ ID NO: 1595745 - DNA, 14 bp, Homo sapiens
tttccatctaaaat

SEQ ID NO: 1595746 - DNA, 16 bp, Homo sapiens
tttccatctctgcctg

SEQ ID NO: 1595747 - DNA, 18 bp, Homo sapiens
tttccatcttaatgttac

SEQ ID NO: 1595748 - DNA, 12 bp, Homo sapiens
tttccatgtttt

SEQ ID NO: 1595749 - DNA, 18 bp, Homo sapiens
tttccattgaccagctct

SEQ ID NO: 1595750 - DNA, 18 bp, Homo sapiens
tttccatttcttcctcac

SEQ ID NO: 1595751 - DNA, 20 bp, Homo sapiens
tttccatttttttctttact

SEQ ID NO: 1595752 - DNA, 22 bp, Homo sapiens
tttcccaaagcatccctcttag

SEQ ID NO: 1595753 - DNA, 18 bp, Homo sapiens
tttcccaaagtcctctgc

SEQ ID NO: 1595754 - DNA, 10 bp, Homo sapiens
tttcccaagc

SEQ ID NO: 1595755 - DNA, 15 bp, Homo sapiens
tttcccacatctttc

SEQ ID NO: 1595756 - DNA, 21 bp, Homo sapiens
tttcccaccattcctgccttt

SEQ ID NO: 1595757 - DNA, 19 bp, Homo sapiens
tttcccacttcccaccctg

SEQ ID NO: 1595758 - DNA, 23 bp, Homo sapiens
tttcccacttcccaccctgcccc

SEQ ID NO: 1595759 - DNA, 14 bp, Homo sapiens
tttcccaggaccct

SEQ ID NO: 1595760 - DNA, 13 bp, Homo sapiens
tttcccagtattt

SEQ ID NO: 1595761 - DNA, 14 bp, Homo sapiens
tttcccataatttt

SEQ ID NO: 1595762 - DNA, 13 bp, Homo sapiens
tttcccatctgca

SEQ ID NO: 1595763 - DNA, 22 bp, Homo sapiens
tttcccatctgcaccccttctc

SEQ ID NO: 1595764 - DNA, 14 bp, Homo sapiens
tttcccatttagaa

SEQ ID NO: 1595765 - DNA, 21 bp, Homo sapiens
tttcccatttgtgccagagga

SEQ ID NO: 1595766 - DNA, 13 bp, Homo sapiens
tttgattaatgtt

SEQ ID NO: 1595767 - DNA, 19 bp, Homo sapiens
tttgattatgtatggatat

SEQ ID NO: 1595768 - DNA, 19 bp, Homo sapiens
tttgattcattttcctgtt

SEQ ID NO: 1595769 - DNA, 18 bp, Homo sapiens
tttgattcgccctcctcc

SEQ ID NO: 1595770 - DNA, 11 bp, Homo sapiens
tttgattggct

SEQ ID NO: 1595771 - DNA, 14 bp, Homo sapiens
tttgattgtgaaac

SEQ ID NO: 1595772 - DNA, 21 bp, Homo sapiens
tttgatttccatcttaatgtt

SEQ ID NO: 1595773 - DNA, 18 bp, Homo sapiens
tttgatttctaattgtaa

SEQ ID NO: 1595774 - DNA, 23 bp, Homo sapiens
tttgattttggaaagatgttaag

SEQ ID NO: 1595775 - DNA, 18 bp, Homo sapiens
tttgcaaaaaatgttttt

SEQ ID NO: 1595776 - DNA, 20 bp, Homo sapiens
tttgcaaaaaatgtttttgg

SEQ ID NO: 1595777 - DNA, 14 bp, Homo sapiens
tttgcaaccaggaa

SEQ ID NO: 1595778 - DNA, 23 bp, Homo sapiens
tttgcaaccaggaacagcaaatg

SEQ ID NO: 1595779 - DNA, 17 bp, Homo sapiens
tttgcaataacttctat

SEQ ID NO: 1595780 - DNA, 11 bp, Homo sapiens
tttgcaatgta

SEQ ID NO: 1595781 - DNA, 21 bp, Homo sapiens
tttgcacaaacttgtgagcat

SEQ ID NO: 1595782 - DNA, 19 bp, Homo sapiens
tttgcacatgtttcctcta

SEQ ID NO: 1595783 - DNA, 13 bp, Homo sapiens
tttgcacattttg

SEQ ID NO: 1595784 - DNA, 23 bp, Homo sapiens
tttgcacattttgtggctgttga

SEQ ID NO: 1595785 - DNA, 13 bp, Homo sapiens
tttgcaccaaaga

SEQ ID NO: 1595786 - DNA, 15 bp, Homo sapiens
tttgcaccatcatgt

SEQ ID NO: 1595787 - DNA, 15 bp, Homo sapiens
tttgcacccctccca

SEQ ID NO: 1595788 - DNA, 16 bp, Homo sapiens
tttgcacccctcccat

SEQ ID NO: 1595789 - DNA, 15 bp, Homo sapiens
tttgcacctgtcccc

SEQ ID NO: 1595790 - DNA, 14 bp, Homo sapiens
tttgcactgagggc

SEQ ID NO: 1595791 - DNA, 17 bp, Homo sapiens
tttgcactgtgtgctga

SEQ ID NO: 1595792 - DNA, 19 bp, Homo sapiens
tttgcactgtgtgctgact

SEQ ID NO: 1595793 - DNA, 15 bp, Homo sapiens
tttgcacttaaaaat

SEQ ID NO: 1595794 - DNA, 17 bp, Homo sapiens
tttgcacttctgtaaac

SEQ ID NO: 1595795 - DNA, 22 bp, Homo sapiens
tttgcactttttcttaatcatt

SEQ ID NO: 1595796 - DNA, 20 bp, Homo sapiens
tttgcagaaaagcacctgcc

SEQ ID NO: 1595797 - DNA, 21 bp, Homo sapiens
tttgcagaggctatgggaaga

SEQ ID NO: 1595798 - DNA, 18 bp, Homo sapiens
tttgcagatgttcaaata

SEQ ID NO: 1595799 - DNA, 21 bp, Homo sapiens
tttgcagcagtgagtctcttc

SEQ ID NO: 1595800 - DNA, 21 bp, Homo sapiens
tttgcaggattcccttctggg

SEQ ID NO: 1595801 - DNA, 12 bp, Homo sapiens
tttgcaggctca

SEQ ID NO: 1595802 - DNA, 13 bp, Homo sapiens
tttgcaggctctg

SEQ ID NO: 1595803 - DNA, 10 bp, Homo sapiens
tttgcagtaa

SEQ ID NO: 1595804 - DNA, 23 bp, Homo sapiens
tttgcatagtaccaatcatttta

SEQ ID NO: 1595805 - DNA, 20 bp, Homo sapiens
tttgcatatcacccttccct

SEQ ID NO: 1595806 - DNA, 22 bp, Homo sapiens
tttgcatctgaaataggaaaca

SEQ ID NO: 1595807 - DNA, 17 bp, Homo sapiens
tttgcatgatatcttca

SEQ ID NO: 1595808 - DNA, 13 bp, Homo sapiens
tttgcatgcatgc

SEQ ID NO: 1595809 - DNA, 22 bp, Homo sapiens
tttgcatggctccagaaatgtc

SEQ ID NO: 1595810 - DNA, 14 bp, Homo sapiens
tttgcattcctaca

SEQ ID NO: 1595811 - DNA, 13 bp, Homo sapiens
tttgcattgtcta

SEQ ID NO: 1595812 - DNA, 13 bp, Homo sapiens
tttgcatttctct

SEQ ID NO: 1595813 - DNA, 21 bp, Homo sapiens
tttgccaaaataccagagcct

SEQ ID NO: 1595814 - DNA, 23 bp, Homo sapiens
tttgccaaaattcatttctaatt

SEQ ID NO: 1595815 - DNA, 23 bp, Homo sapiens
tttgccaagttgctgtcactgtt

SEQ ID NO: 1595816 - DNA, 12 bp, Homo sapiens
tttgccaataaa

SEQ ID NO: 1595817 - DNA, 15 bp, Homo sapiens
tttgccaataaagct

SEQ ID NO: 1595818 - DNA, 16 bp, Homo sapiens
tttgccacagcttttg

SEQ ID NO: 1595819 - DNA, 18 bp, Homo sapiens
tttgccacagcttttgca

SEQ ID NO: 1595820 - DNA, 16 bp, Homo sapiens
tttgccagacttaaat

SEQ ID NO: 1595821 - DNA, 12 bp, Homo sapiens
tttgccagagca

SEQ ID NO: 1595822 - DNA, 20 bp, Homo sapiens
tttgccagttttccctggaa

SEQ ID NO: 1595823 - DNA, 19 bp, Homo sapiens
tttgccatttttctataaa

SEQ ID NO: 1595824 - DNA, 21 bp, Homo sapiens
tttgcccaaaatttattttat

SEQ ID NO: 1595825 - DNA, 18 bp, Homo sapiens
tttgcccagaaagaagat

SEQ ID NO: 1595826 - DNA, 21 bp, Homo sapiens
tttgcccagggtcctgtgcct

SEQ ID NO: 1595827 - DNA, 17 bp, Homo sapiens
tttgcctcttccagtct

SEQ ID NO: 1595828 - DNA, 15 bp, Homo sapiens
tttgcctcttctttg

SEQ ID NO: 1595829 - DNA, 16 bp, Homo sapiens
tttgcctcttctttgt

SEQ ID NO: 1595830 - DNA, 18 bp, Homo sapiens
tttgcctgcaagagaatc

SEQ ID NO: 1595831 - DNA, 11 bp, Homo sapiens
tttgcctggct

SEQ ID NO: 1595832 - DNA, 22 bp, Homo sapiens
tttgcctggctgtggaggcctg

SEQ ID NO: 1595833 - DNA, 15 bp, Homo sapiens
tttgccttctactcc

SEQ ID NO: 1595834 - DNA, 21 bp, Homo sapiens
tttgccttgggctgctcctca

SEQ ID NO: 1595835 - DNA, 15 bp, Homo sapiens
tttgcgcctcggtat

SEQ ID NO: 1595836 - DNA, 14 bp, Homo sapiens
tttgcggacgggct

SEQ ID NO: 1595837 - DNA, 15 bp, Homo sapiens
tttgcgtacacagag

SEQ ID NO: 1595838 - DNA, 19 bp, Homo sapiens
tttgcgtacacagagaagg

SEQ ID NO: 1595839 - DNA, 13 bp, Homo sapiens
tttgctaaataca

SEQ ID NO: 1595840 - DNA, 14 bp, Homo sapiens
tttgctaactggtt

SEQ ID NO: 1595841 - DNA, 17 bp, Homo sapiens
tttgctaactggttaaa

SEQ ID NO: 1595842 - DNA, 14 bp, Homo sapiens
tttgctacaaattt

SEQ ID NO: 1595843 - DNA, 17 bp, Homo sapiens
tttgctacaaatttatg

SEQ ID NO: 1595844 - DNA, 19 bp, Homo sapiens
tttgctacaaatttatgca

SEQ ID NO: 1595845 - DNA, 21 bp, Homo sapiens
tttgctactgttgtaagaatt

SEQ ID NO: 1595846 - DNA, 24 bp, Homo sapiens
tttgctagcagtaaaagatgaagt

SEQ ID NO: 1595847 - DNA, 21 bp, Homo sapiens
tttgctagttctgctgccctc

SEQ ID NO: 1595848 - DNA, 22 bp, Homo sapiens
tttgctagttctgctgccctct

SEQ ID NO: 1595849 - DNA, 24 bp, Homo sapiens
tttgctagttggagtgcttgttta

SEQ ID NO: 1595850 - DNA, 17 bp, Homo sapiens
tttgctataatcattag

SEQ ID NO: 1595851 - DNA, 12 bp, Homo sapiens
tttgctatgact

SEQ ID NO: 1595852 - DNA, 19 bp, Homo sapiens
tttgctatgactacatttt

SEQ ID NO: 1595853 - DNA, 19 bp, Homo sapiens
tttgctatgagctggggat

SEQ ID NO: 1595854 - DNA, 15 bp, Homo sapiens
tttgctatgtaaggg

SEQ ID NO: 1595855 - DNA, 17 bp, Homo sapiens
tttgctcaaaattgctt

SEQ ID NO: 1595856 - DNA, 17 bp, Homo sapiens
tttgctccgctcccacc

SEQ ID NO: 1595857 - DNA, 20 bp, Homo sapiens
tttgctccgctcccaccgcc

SEQ ID NO: 1595858 - DNA, 15 bp, Homo sapiens
tttgctctaaaatat

SEQ ID NO: 1595859 - DNA, 21 bp, Homo sapiens
tttgctcttcagatgccactt

SEQ ID NO: 1595860 - DNA, 13 bp, Homo sapiens
tttgctgaattca

SEQ ID NO: 1595861 - DNA, 16 bp, Homo sapiens
tttgctgaattcatct

SEQ ID NO: 1595862 - DNA, 22 bp, Homo sapiens
tttgctgaattcatctatttcg

SEQ ID NO: 1595863 - DNA, 20 bp, Homo sapiens
tttgctgcacaaacatgaaa

SEQ ID NO: 1595864 - DNA, 10 bp, Homo sapiens
tttgctgcca

SEQ ID NO: 1595865 - DNA, 12 bp, Homo sapiens
tttgctgcctta

SEQ ID NO: 1595866 - DNA, 22 bp, Homo sapiens
tttgctgctatgaaaatgagca

SEQ ID NO: 1595867 - DNA, 18 bp, Homo sapiens
tttgctggtttgaaagat

SEQ ID NO: 1595868 - DNA, 19 bp, Homo sapiens
tttgctgtgaggctgtcct

SEQ ID NO: 1595869 - DNA, 21 bp, Homo sapiens
tttgctgttgattcagacttt

SEQ ID NO: 1595870 - DNA, 12 bp, Homo sapiens
tttgcttagaaa

SEQ ID NO: 1595871 - DNA, 15 bp, Homo sapiens
tttgcttcaaaaaca

SEQ ID NO: 1595872 - DNA, 13 bp, Homo sapiens
tttgcttcataaa

SEQ ID NO: 1595873 - DNA, 12 bp, Homo sapiens
tttgcttcctca

SEQ ID NO: 1595874 - DNA, 23 bp, Homo sapiens
tttgcttgctttgaagtagctct

SEQ ID NO: 1595875 - DNA, 17 bp, Homo sapiens
tttgcttgttatattaa

SEQ ID NO: 1595876 - DNA, 16 bp, Homo sapiens
tttgctttaaaacaag

SEQ ID NO: 1595877 - DNA, 12 bp, Homo sapiens
tttgctttaatg

SEQ ID NO: 1595878 - DNA, 12 bp, Homo sapiens
tttgctttaatt

SEQ ID NO: 1595879 - DNA, 17 bp, Homo sapiens
tttgctttaattttagc

SEQ ID NO: 1595880 - DNA, 13 bp, Homo sapiens
tttgctttcctct

SEQ ID NO: 1595881 - DNA, 23 bp, Homo sapiens
ttttactccaggttattgcaata

SEQ ID NO: 1595882 - DNA, 12 bp, Homo sapiens
ttttactctgcc

SEQ ID NO: 1595883 - DNA, 14 bp, Homo sapiens
ttttactctgccta

SEQ ID NO: 1595884 - DNA, 18 bp, Homo sapiens
ttttagaataaggaggag

SEQ ID NO: 1595885 - DNA, 23 bp, Homo sapiens
ttttagagaatgtgtttcaaaac

SEQ ID NO: 1595886 - DNA, 17 bp, Homo sapiens
ttttagagcttccaaat

SEQ ID NO: 1595887 - DNA, 17 bp, Homo sapiens
ttttagatggtttcttg

SEQ ID NO: 1595888 - DNA, 13 bp, Homo sapiens
ttttagatttctt

SEQ ID NO: 1595889 - DNA, 19 bp, Homo sapiens
ttttagcctagttcatcca

SEQ ID NO: 1595890 - DNA, 20 bp, Homo sapiens
ttttagctgatgaacttatt

SEQ ID NO: 1595891 - DNA, 21 bp, Homo sapiens
ttttagctgatgaacttattc

SEQ ID NO: 1595892 - DNA, 16 bp, Homo sapiens
ttttaggacatcttaa

SEQ ID NO: 1595893 - DNA, 16 bp, Homo sapiens
ttttaggcataagatg

SEQ ID NO: 1595894 - DNA, 17 bp, Homo sapiens
ttttaggcataagatga

SEQ ID NO: 1595895 - DNA, 15 bp, Homo sapiens
ttttaggtagaaaaa

SEQ ID NO: 1595896 - DNA, 14 bp, Homo sapiens
ttttagtaatttct

SEQ ID NO: 1595897 - DNA, 15 bp, Homo sapiens
ttttagtattcattc

SEQ ID NO: 1595898 - DNA, 20 bp, Homo sapiens
ttttagtatttatttatgta

SEQ ID NO: 1595899 - DNA, 13 bp, Homo sapiens
ttttagtttctga

SEQ ID NO: 1595900 - DNA, 15 bp, Homo sapiens
ttttagtttctgaac

SEQ ID NO: 1595901 - DNA, 12 bp, Homo sapiens
ttttataaacta

SEQ ID NO: 1595902 - DNA, 12 bp, Homo sapiens
ttttataaagca

SEQ ID NO: 1595903 - DNA, 22 bp, Homo sapiens
ttttataaagtctaagcaagat

SEQ ID NO: 1595904 - DNA, 16 bp, Homo sapiens
ttttataacaatataa

SEQ ID NO: 1595905 - DNA, 16 bp, Homo sapiens
ttttatacaagtaatt

SEQ ID NO: 1595906 - DNA, 17 bp, Homo sapiens
ttttatactccatacat

SEQ ID NO: 1595907 - DNA, 12 bp, Homo sapiens
ttttatactgta

SEQ ID NO: 1595908 - DNA, 15 bp, Homo sapiens
ttttatactgtactt

SEQ ID NO: 1595909 - DNA, 20 bp, Homo sapiens
ttttatagaaaacctgactt

SEQ ID NO: 1595910 - DNA, 17 bp, Homo sapiens
ttttatagcctggactg

SEQ ID NO: 1595911 - DNA, 15 bp, Homo sapiens
ttttatatatacagt

SEQ ID NO: 1595912 - DNA, 12 bp, Homo sapiens
ttttatatcatt

SEQ ID NO: 1595913 - DNA, 14 bp, Homo sapiens
ttttatatctgtaa

SEQ ID NO: 1595914 - DNA, 15 bp, Homo sapiens
ttttatatctgtaaa

SEQ ID NO: 1595915 - DNA, 17 bp, Homo sapiens
ttttatatgatggggga

SEQ ID NO: 1595916 - DNA, 21 bp, Homo sapiens
ttttatatgctttttctcaga

SEQ ID NO: 1595917 - DNA, 12 bp, Homo sapiens
ttttatatgtat

SEQ ID NO: 1595918 - DNA, 16 bp, Homo sapiens
ttttatatgttgctat

SEQ ID NO: 1595919 - DNA, 14 bp, Homo sapiens
ttttatattaaagt

SEQ ID NO: 1595920 - DNA, 14 bp, Homo sapiens
ttttatatttaaaa

SEQ ID NO: 1595921 - DNA, 22 bp, Homo sapiens
ttttatatttcctttatgtgaa

SEQ ID NO: 1595922 - DNA, 23 bp, Homo sapiens
ttttatatttcctttatgtgaat

SEQ ID NO: 1595923 - DNA, 19 bp, Homo sapiens
ttttatcattttcaaaatg

SEQ ID NO: 1595924 - DNA, 23 bp, Homo sapiens
ttttatcgtttttgtattttcat

SEQ ID NO: 1595925 - DNA, 18 bp, Homo sapiens
ttttatgaacattgtact

SEQ ID NO: 1595926 - DNA, 19 bp, Homo sapiens
ttttatgaacattgtactg

SEQ ID NO: 1595927 - DNA, 18 bp, Homo sapiens
ttttatgcagacagtctg

SEQ ID NO: 1595928 - DNA, 20 bp, Homo sapiens
ttttatgcctttatatactt

SEQ ID NO: 1595929 - DNA, 17 bp, Homo sapiens
ttttatgtcatactctg

SEQ ID NO: 1595930 - DNA, 21 bp, Homo sapiens
ttttatgtcatactctgtgta

SEQ ID NO: 1595931 - DNA, 14 bp, Homo sapiens
ttttattaaatgta

SEQ ID NO: 1595932 - DNA, 19 bp, Homo sapiens
ttttattaattttagtttt

SEQ ID NO: 1595933 - DNA, 14 bp, Homo sapiens
ttttattatgagct

SEQ ID NO: 1595934 - DNA, 14 bp, Homo sapiens
ttttattatgcatt

SEQ ID NO: 1595935 - DNA, 13 bp, Homo sapiens
ttttattcttgat

SEQ ID NO: 1595936 - DNA, 23 bp, Homo sapiens
ttttatttagggccttttctgtg

SEQ ID NO: 1595937 - DNA, 14 bp, Homo sapiens
ttttatttatatgt

SEQ ID NO: 1595938 - DNA, 20 bp, Homo sapiens
ttttatttctgactcttatt

SEQ ID NO: 1595939 - DNA, 13 bp, Homo sapiens
ttttatttgtaaa

SEQ ID NO: 1595940 - DNA, 14 bp, Homo sapiens
ttttattttgctga

SEQ ID NO: 1595941 - DNA, 13 bp, Homo sapiens
ttttattttggaa

SEQ ID NO: 1595942 - DNA, 22 bp, Homo sapiens
ttttcaaacctcaaatatagta

SEQ ID NO: 1595943 - DNA, 17 bp, Homo sapiens
ttttcaacgcagccctg

SEQ ID NO: 1595944 - DNA, 15 bp, Homo sapiens
ttttcaactgctttg

SEQ ID NO: 1595945 - DNA, 13 bp, Homo sapiens
ttttcaagaaatg

SEQ ID NO: 1595946 - DNA, 16 bp, Homo sapiens
ttttcaagaataatca

SEQ ID NO: 1595947 - DNA, 15 bp, Homo sapiens
ttttcaagcagcatc

SEQ ID NO: 1595948 - DNA, 12 bp, Homo sapiens
ttttcaaggcat

SEQ ID NO: 1595949 - DNA, 16 bp, Homo sapiens
ttttcaaggccctcag

SEQ ID NO: 1595950 - DNA, 12 bp, Homo sapiens
ttttcaaggcct

SEQ ID NO: 1595951 - DNA, 16 bp, Homo sapiens
ttttcaagtatttaag

SEQ ID NO: 1595952 - DNA, 13 bp, Homo sapiens
ttttcaagttgta

SEQ ID NO: 1595953 - DNA, 16 bp, Homo sapiens
ttttcaataaatcagc

SEQ ID NO: 1595954 - DNA, 15 bp, Homo sapiens
ttttcaatatattga

SEQ ID NO: 1595955 - DNA, 18 bp, Homo sapiens
ttttcaatatattgaact

SEQ ID NO: 1595956 - DNA, 22 bp, Homo sapiens
ttttcaatatattgaacttttg

SEQ ID NO: 1595957 - DNA, 16 bp, Homo sapiens
ttttcaatatttatta

SEQ ID NO: 1595958 - DNA, 20 bp, Homo sapiens
ttttcaatcaactttactgt

SEQ ID NO: 1595959 - DNA, 20 bp, Homo sapiens
ttttcacaatgtgaaactga

SEQ ID NO: 1595960 - DNA, 15 bp, Homo sapiens
ttttcacactgtctt

SEQ ID NO: 1595961 - DNA, 18 bp, Homo sapiens
ttttcacactgtcttccc

SEQ ID NO: 1595962 - DNA, 13 bp, Homo sapiens
ttttcacatatct

SEQ ID NO: 1595963 - DNA, 19 bp, Homo sapiens
ttttcaccaggggtgctca

SEQ ID NO: 1595964 - DNA, 13 bp, Homo sapiens
ttttcaccccacc

SEQ ID NO: 1595965 - DNA, 20 bp, Homo sapiens
ttttcaccccacccttcccc

SEQ ID NO: 1595966 - DNA, 19 bp, Homo sapiens
ttttcactgctggctgcct

SEQ ID NO: 1595967 - DNA, 18 bp, Homo sapiens
ttttcagcaaactctttt

SEQ ID NO: 1595968 - DNA, 21 bp, Homo sapiens
ttttcagcttgtttctatact

SEQ ID NO: 1595969 - DNA, 13 bp, Homo sapiens
ttttcaggaagct

SEQ ID NO: 1595970 - DNA, 23 bp, Homo sapiens
ttttcagtcttgtagtgtgtgct

SEQ ID NO: 1595971 - DNA, 14 bp, Homo sapiens
ttttcagtgtacat

SEQ ID NO: 1595972 - DNA, 16 bp, Homo sapiens
ttttcagttgtttgtt

SEQ ID NO: 1595973 - DNA, 17 bp, Homo sapiens
ttttcataacttgctga

SEQ ID NO: 1595974 - DNA, 18 bp, Homo sapiens
ttttcatacttttacctt

SEQ ID NO: 1595975 - DNA, 21 bp, Homo sapiens
ttttcatcttctctggcgaca

SEQ ID NO: 1595976 - DNA, 22 bp, Homo sapiens
ttttcatctttaagaatgctta

SEQ ID NO: 1595977 - DNA, 14 bp, Homo sapiens
ttttcatgttatga

SEQ ID NO: 1595978 - DNA, 11 bp, Homo sapiens
ttttcatgttt

SEQ ID NO: 1595979 - DNA, 16 bp, Homo sapiens
ttttcattaaacttga

SEQ ID NO: 1595980 - DNA, 14 bp, Homo sapiens
ttttcattaaataa

SEQ ID NO: 1595981 - DNA, 18 bp, Homo sapiens
ttttcattaaataaattt

SEQ ID NO: 1595982 - DNA, 20 bp, Homo sapiens
ttttcattaaataaatttga

SEQ ID NO: 1595983 - DNA, 16 bp, Homo sapiens
ttttcattagcagttg

SEQ ID NO: 1595984 - DNA, 15 bp, Homo sapiens
ttttcatttgtacaa

SEQ ID NO: 1595985 - DNA, 16 bp, Homo sapiens
ttttcatttgtacaag

SEQ ID NO: 1595986 - DNA, 19 bp, Homo sapiens
ttttcatttgtacaaggta

SEQ ID NO: 1595987 - DNA, 14 bp, Homo sapiens
ttttcatttgtttt

SEQ ID NO: 1595988 - DNA, 16 bp, Homo sapiens
ttttcatttgttttgc

SEQ ID NO: 1595989 - DNA, 22 bp, Homo sapiens
ttttcatttgttttgcttttgt

SEQ ID NO: 1595990 - DNA, 13 bp, Homo sapiens
ttttccaaaacaa

SEQ ID NO: 1595991 - DNA, 22 bp, Homo sapiens
ttttccaaatgtaataaacttt

SEQ ID NO: 1595992 - DNA, 14 bp, Homo sapiens
ttttccaactacta

SEQ ID NO: 1595993 - DNA, 17 bp, Homo sapiens
ttttccaagtaaagtga

SEQ ID NO: 1595994 - DNA, 17 bp, Homo sapiens
ttttccattatgttcat

SEQ ID NO: 1595995 - DNA, 18 bp, Homo sapiens
ttttcccaaagcactttt

SEQ ID NO: 1595996 - DNA, 13 bp, Homo sapiens
ttttcccaaagcc

SEQ ID NO: 1595997 - DNA, 16 bp, Homo sapiens
ttttttatgctaatca

SEQ ID NO: 1595998 - DNA, 11 bp, Homo sapiens
ttttttatgtt

SEQ ID NO: 1595999 - DNA, 14 bp, Homo sapiens
ttttttatgttcct

SEQ ID NO: 1596000 - DNA, 13 bp, Homo sapiens
ttttttccaaaac

SEQ ID NO: 1596001 - DNA, 12 bp, Homo sapiens
ttttttcctgtt

SEQ ID NO: 1596002 - DNA, 10 bp, Homo sapiens
ttttttcctt

SEQ ID NO: 1596003 - DNA, 12 bp, Homo sapiens
ttttttcttcta

SEQ ID NO: 1596004 - DNA, 20 bp, Homo sapiens
ttttttctttcccatgtatt

SEQ ID NO: 1596005 - DNA, 12 bp, Homo sapiens
ttttttgaaaac

SEQ ID NO: 1596006 - DNA, 20 bp, Homo sapiens
ttttttgaaccaacatcttt

SEQ ID NO: 1596007 - DNA, 13 bp, Homo sapiens
ttttttgactaaa

SEQ ID NO: 1596008 - DNA, 10 bp, Homo sapiens
ttttttgaga

SEQ ID NO: 1596009 - DNA, 12 bp, Homo sapiens
ttttttgataaa

SEQ ID NO: 1596010 - DNA, 9 bp, Homo sapiens
ttttttgca

SEQ ID NO: 1596011 - DNA, 11 bp, Homo sapiens
ttttttggaga

SEQ ID NO: 1596012 - DNA, 12 bp, Homo sapiens
ttttttgtagtt

SEQ ID NO: 1596013 - DNA, 13 bp, Homo sapiens
ttttttgtatatt

SEQ ID NO: 1596014 - DNA, 13 bp, Homo sapiens
ttttttgtatgtg

SEQ ID NO: 1596015 - DNA, 12 bp, Homo sapiens
ttttttgttcaa

SEQ ID NO: 1596016 - DNA, 13 bp, Homo sapiens
ttttttgttcaat

SEQ ID NO: 1596017 - DNA, 10 bp, Homo sapiens
tttttttccc

SEQ ID NO: 1596018 - DNA, 13 bp, Homo sapiens
tttttttcctttt

SEQ ID NO: 1596019 - DNA, 14 bp, Homo sapiens
tttttttgaaactt

SEQ ID NO: 1596020 - DNA, 10 bp, Homo sapiens
tttttttgca

SEQ ID NO: 1596021 - DNA, 11 bp, Homo sapiens
tttttttgcag

SEQ ID NO: 1596022 - DNA, 10 bp, Homo sapiens
tttttttggc

SEQ ID NO: 1596023 - DNA, 13 bp, Homo sapiens
tttttttgtaata

SEQ ID NO: 1596024 - DNA, 14 bp, Homo sapiens
ttttttttaaacta

SEQ ID NO: 1596025 - DNA, 11 bp, Homo sapiens
ttttttttgca

SEQ ID NO: 1596026 - DNA, 13 bp, Homo sapiens
ttttttttttggt

SEQ ID NO: 1596027 - DNA, 18 bp, Homo sapiens
aaaaggtgataaaatcat

SEQ ID NO: 1596028 - DNA, 22 bp, Homo sapiens
aaaaggtgcctgtgaggcaggg

SEQ ID NO: 1596029 - DNA, 16 bp, Homo sapiens
aaaaggttaataaagt

SEQ ID NO: 1596030 - DNA, 17 bp, Homo sapiens
aaaaggttaataaagta

SEQ ID NO: 1596031 - DNA, 22 bp, Homo sapiens
aaaaggttgccaaattgctgca

SEQ ID NO: 1596032 - DNA, 17 bp, Homo sapiens
aaaagtaatctttaaac

SEQ ID NO: 1596033 - DNA, 21 bp, Homo sapiens
aaaagtaatgacttagaaact

SEQ ID NO: 1596034 - DNA, 18 bp, Homo sapiens
aaaagtacaattcattgt

SEQ ID NO: 1596035 - DNA, 17 bp, Homo sapiens
aaaagtacatttaatac

SEQ ID NO: 1596036 - DNA, 20 bp, Homo sapiens
aaaagtaggtttacattcat

SEQ ID NO: 1596037 - DNA, 15 bp, Homo sapiens
aaaagtatatgttag

SEQ ID NO: 1596038 - DNA, 20 bp, Homo sapiens
aaaagtcaaagtgttgctgt

SEQ ID NO: 1596039 - DNA, 23 bp, Homo sapiens
aaaagtcaccaaatagtgtgaaa

SEQ ID NO: 1596040 - DNA, 21 bp, Homo sapiens
aaaagtcagtatcatattatt

SEQ ID NO: 1596041 - DNA, 14 bp, Homo sapiens
aaaagtgacacagc

SEQ ID NO: 1596042 - DNA, 17 bp, Homo sapiens
aaaagtgacacagcagc

SEQ ID NO: 1596043 - DNA, 17 bp, Homo sapiens
aaaagtgactctcagcg

SEQ ID NO: 1596044 - DNA, 13 bp, Homo sapiens
aaaagtgtccttc

SEQ ID NO: 1596045 - DNA, 15 bp, Homo sapiens
aaaagtgtctcaaag

SEQ ID NO: 1596046 - DNA, 17 bp, Homo sapiens
aaaagtgtctcaaagga

SEQ ID NO: 1596047 - DNA, 19 bp, Homo sapiens
aaaagtgttgattacataa

SEQ ID NO: 1596048 - DNA, 14 bp, Homo sapiens
aaaagttaaactaa

SEQ ID NO: 1596049 - DNA, 15 bp, Homo sapiens
aaaagttccaagagt

SEQ ID NO: 1596050 - DNA, 11 bp, Homo sapiens
aaaagttcttt

SEQ ID NO: 1596051 - DNA, 16 bp, Homo sapiens
aaaagttgagattttg

SEQ ID NO: 1596052 - DNA, 13 bp, Homo sapiens
aaaagttggaagg

SEQ ID NO: 1596053 - DNA, 12 bp, Homo sapiens
aaaagtttccat

SEQ ID NO: 1596054 - DNA, 12 bp, Homo sapiens
aaaagtttgttt

SEQ ID NO: 1596055 - DNA, 16 bp, Homo sapiens
aaaagtttttgtttgg

SEQ ID NO: 1596056 - DNA, 21 bp, Homo sapiens
aaaataaaaaagatcccaaat

SEQ ID NO: 1596057 - DNA, 21 bp, Homo sapiens
aaaataaaaagcgggcacggg

SEQ ID NO: 1596058 - DNA, 17 bp, Homo sapiens
aaaataaaaagtgacac

SEQ ID NO: 1596059 - DNA, 21 bp, Homo sapiens
aaaataaaaagtgacacagca

SEQ ID NO: 1596060 - DNA, 14 bp, Homo sapiens
aaaataaaacacac

SEQ ID NO: 1596061 - DNA, 11 bp, Homo sapiens
aaaataaaata

SEQ ID NO: 1596062 - DNA, 13 bp, Homo sapiens
aaaataaaatatt

SEQ ID NO: 1596063 - DNA, 17 bp, Homo sapiens
aaaataaaatattcact

SEQ ID NO: 1596064 - DNA, 16 bp, Homo sapiens
aaaataaaatgtttca

SEQ ID NO: 1596065 - DNA, 14 bp, Homo sapiens
aaaataaactagtt

SEQ ID NO: 1596066 - DNA, 18 bp, Homo sapiens
aaaataaactagtttcca

SEQ ID NO: 1596067 - DNA, 22 bp, Homo sapiens
aaaataaagcctatttttcaaa

SEQ ID NO: 1596068 - DNA, 20 bp, Homo sapiens
aaaataaataaaaactaatt

SEQ ID NO: 1596069 - DNA, 13 bp, Homo sapiens
aaaataaattgga

SEQ ID NO: 1596070 - DNA, 21 bp, Homo sapiens
aaaataacaactaacttgttt

SEQ ID NO: 1596071 - DNA, 21 bp, Homo sapiens
aaaataacatctgaaaagaaa

SEQ ID NO: 1596072 - DNA, 18 bp, Homo sapiens
aaaataacttagactcta

SEQ ID NO: 1596073 - DNA, 18 bp, Homo sapiens
aaaataagtcaacagtaa

SEQ ID NO: 1596074 - DNA, 22 bp, Homo sapiens
aaaataagtggattttgtattt

SEQ ID NO: 1596075 - DNA, 13 bp, Homo sapiens
aaaataataataa

SEQ ID NO: 1596076 - DNA, 23 bp, Homo sapiens
aaaataatcaaaagctatttaaa

SEQ ID NO: 1596077 - DNA, 17 bp, Homo sapiens
aaaataatttctctaca

SEQ ID NO: 1596078 - DNA, 19 bp, Homo sapiens
aaaataattttaaacaaag

SEQ ID NO: 1596079 - DNA, 16 bp, Homo sapiens
aaaatacatagtgaaa

SEQ ID NO: 1596080 - DNA, 12 bp, Homo sapiens
aaaatacattgt

SEQ ID NO: 1596081 - DNA, 19 bp, Homo sapiens
aaaataccagagccttcaa

SEQ ID NO: 1596082 - DNA, 15 bp, Homo sapiens
aaaataccagtgttg

SEQ ID NO: 1596083 - DNA, 20 bp, Homo sapiens
aaaatacctattttatatga

SEQ ID NO: 1596084 - DNA, 14 bp, Homo sapiens
aaaatactattgcc

SEQ ID NO: 1596085 - DNA, 16 bp, Homo sapiens
aaaatactatttaaga

SEQ ID NO: 1596086 - DNA, 15 bp, Homo sapiens
aaaatactctagcct

SEQ ID NO: 1596087 - DNA, 14 bp, Homo sapiens
aaaatactctgcta

SEQ ID NO: 1596088 - DNA, 11 bp, Homo sapiens
aaaatactttt

SEQ ID NO: 1596089 - DNA, 21 bp, Homo sapiens
aaaatagaaattttgtaagaa

SEQ ID NO: 1596090 - DNA, 17 bp, Homo sapiens
aaaatagaatacatttt

SEQ ID NO: 1596091 - DNA, 14 bp, Homo sapiens
aaaatagacatctt

SEQ ID NO: 1596092 - DNA, 15 bp, Homo sapiens
aaaatagacatcttt

SEQ ID NO: 1596093 - DNA, 19 bp, Homo sapiens
aaaatagatcaataaatgt

SEQ ID NO: 1596094 - DNA, 12 bp, Homo sapiens
aaaataggcagg

SEQ ID NO: 1596095 - DNA, 12 bp, Homo sapiens
aaaatagtgtaa

SEQ ID NO: 1596096 - DNA, 15 bp, Homo sapiens
aaaatagtgtaagaa

SEQ ID NO: 1596097 - DNA, 20 bp, Homo sapiens
aaaatagtgtaagaactgta

SEQ ID NO: 1596098 - DNA, 17 bp, Homo sapiens
aaaatagttctatttct

SEQ ID NO: 1596099 - DNA, 17 bp, Homo sapiens
aaaatatatctggaact

SEQ ID NO: 1596100 - DNA, 12 bp, Homo sapiens
aaaatatatgaa

SEQ ID NO: 1596101 - DNA, 19 bp, Homo sapiens
aaaatatattgctgcattt

SEQ ID NO: 1596102 - DNA, 16 bp, Homo sapiens
aaaatatatttaatga

SEQ ID NO: 1596103 - DNA, 18 bp, Homo sapiens
aaaatatattttcagtac

SEQ ID NO: 1596104 - DNA, 16 bp, Homo sapiens
aaaatatcataaagca

SEQ ID NO: 1596105 - DNA, 18 bp, Homo sapiens
aaaatatctgaaatgtga

SEQ ID NO: 1596106 - DNA, 16 bp, Homo sapiens
aaaatatgaacctatt

SEQ ID NO: 1596107 - DNA, 19 bp, Homo sapiens
aaaatatgaacctattttc

SEQ ID NO: 1596108 - DNA, 21 bp, Homo sapiens
aaaatatgtaagaacacattt

SEQ ID NO: 1596109 - DNA, 17 bp, Homo sapiens
aaaatattaacattctt

SEQ ID NO: 1596110 - DNA, 16 bp, Homo sapiens
aaaatattataactta

SEQ ID NO: 1596111 - DNA, 22 bp, Homo sapiens
aaaatattcactctccattaga

SEQ ID NO: 1596112 - DNA, 18 bp, Homo sapiens
cattcaaaagttgaaatt

SEQ ID NO: 1596113 - DNA, 20 bp, Homo sapiens
cattcaaaatagttctattt

SEQ ID NO: 1596114 - DNA, 18 bp, Homo sapiens
cattcaaatgacgcctga

SEQ ID NO: 1596115 - DNA, 15 bp, Homo sapiens
cattcaagctattta

SEQ ID NO: 1596116 - DNA, 18 bp, Homo sapiens
cattcaattccagagaac

SEQ ID NO: 1596117 - DNA, 14 bp, Homo sapiens
cattcacagagcct

SEQ ID NO: 1596118 - DNA, 19 bp, Homo sapiens
cattcacatttgatgtaca

SEQ ID NO: 1596119 - DNA, 13 bp, Homo sapiens
cattcacccagac

SEQ ID NO: 1596120 - DNA, 14 bp, Homo sapiens
cattcacccagaca

SEQ ID NO: 1596121 - DNA, 20 bp, Homo sapiens
cattcacccagacagctccc

SEQ ID NO: 1596122 - DNA, 14 bp, Homo sapiens
cattcacttcataa

SEQ ID NO: 1596123 - DNA, 15 bp, Homo sapiens
cattcacttcataat

SEQ ID NO: 1596124 - DNA, 18 bp, Homo sapiens
cattcacttgcatttctt

SEQ ID NO: 1596125 - DNA, 19 bp, Homo sapiens
cattcagactaaaaataca

SEQ ID NO: 1596126 - DNA, 13 bp, Homo sapiens
cattcagagtcag

SEQ ID NO: 1596127 - DNA, 21 bp, Homo sapiens
cattcagatcactgaatttat

SEQ ID NO: 1596128 - DNA, 19 bp, Homo sapiens
cattcagcagcaaattttc

SEQ ID NO: 1596129 - DNA, 17 bp, Homo sapiens
cattcagctctggagaa

SEQ ID NO: 1596130 - DNA, 21 bp, Homo sapiens
cattcagctctggagaacagt

SEQ ID NO: 1596131 - DNA, 14 bp, Homo sapiens
cattcagtcccaaa

SEQ ID NO: 1596132 - DNA, 16 bp, Homo sapiens
cattcatattaagaca

SEQ ID NO: 1596133 - DNA, 18 bp, Homo sapiens
cattcatcttgtgtttta

SEQ ID NO: 1596134 - DNA, 16 bp, Homo sapiens
cattcatgcaagagtt

SEQ ID NO: 1596135 - DNA, 17 bp, Homo sapiens
cattccaagactctaga

SEQ ID NO: 1596136 - DNA, 13 bp, Homo sapiens
cattccacacaga

SEQ ID NO: 1596137 - DNA, 20 bp, Homo sapiens
cattccacagctgccctggc

SEQ ID NO: 1596138 - DNA, 13 bp, Homo sapiens
cattccagaatct

SEQ ID NO: 1596139 - DNA, 14 bp, Homo sapiens
cattccagaatctt

SEQ ID NO: 1596140 - DNA, 13 bp, Homo sapiens
cattccagaggaa

SEQ ID NO: 1596141 - DNA, 19 bp, Homo sapiens
cattccagcccctctggtc

SEQ ID NO: 1596142 - DNA, 14 bp, Homo sapiens
cattccagctctgc

SEQ ID NO: 1596143 - DNA, 19 bp, Homo sapiens
aaaatccttatgcatgaaa

SEQ ID NO: 1596144 - DNA, 12 bp, Homo sapiens
aaaatctagttt

SEQ ID NO: 1596145 - DNA, 14 bp, Homo sapiens
aaaatctagttttt

SEQ ID NO: 1596146 - DNA, 12 bp, Homo sapiens
aaaatctatatt

SEQ ID NO: 1596147 - DNA, 13 bp, Homo sapiens
aaaatctccatta

SEQ ID NO: 1596148 - DNA, 19 bp, Homo sapiens
aaaatctgaattttgcaat

SEQ ID NO: 1596149 - DNA, 21 bp, Homo sapiens
aaaatctgctgcaccttgtaa

SEQ ID NO: 1596150 - DNA, 13 bp, Homo sapiens
aaaatctgtggca

SEQ ID NO: 1596151 - DNA, 18 bp, Homo sapiens
aaaatcttaatactgtta

SEQ ID NO: 1596152 - DNA, 18 bp, Homo sapiens
aaaatcttatagttctag

SEQ ID NO: 1596153 - DNA, 19 bp, Homo sapiens
aaaatcttatagttctagg

SEQ ID NO: 1596154 - DNA, 20 bp, Homo sapiens
aaaatcttatagttctaggc

SEQ ID NO: 1596155 - DNA, 11 bp, Homo sapiens
aaaatcttgtc

SEQ ID NO: 1596156 - DNA, 12 bp, Homo sapiens
aaaatcttgtca

SEQ ID NO: 1596157 - DNA, 22 bp, Homo sapiens
aaaatcttgtgctagaatactt

SEQ ID NO: 1596158 - DNA, 14 bp, Homo sapiens
aaaatcttgttaat

SEQ ID NO: 1596159 - DNA, 19 bp, Homo sapiens
aaaatcttgttaatgtcat

SEQ ID NO: 1596160 - DNA, 18 bp, Homo sapiens
aaaatctttgtataaata

SEQ ID NO: 1596161 - DNA, 12 bp, Homo sapiens
aaaatgaaaaat

SEQ ID NO: 1596162 - DNA, 11 bp, Homo sapiens
aaaatgaaaca

SEQ ID NO: 1596163 - DNA, 14 bp, Homo sapiens
aaaatgaaagctac

SEQ ID NO: 1596164 - DNA, 19 bp, Homo sapiens
aaaatgaaagctactcata

SEQ ID NO: 1596165 - DNA, 15 bp, Homo sapiens
aaaatgaacatctct

SEQ ID NO: 1596166 - DNA, 16 bp, Homo sapiens
aaaatgaacattttgt

SEQ ID NO: 1596167 - DNA, 22 bp, Homo sapiens
aaaatgaatatctattaatata

SEQ ID NO: 1596168 - DNA, 22 bp, Homo sapiens
aaaatgaattgaaaaacaattt

SEQ ID NO: 1596169 - DNA, 16 bp, Homo sapiens
aaaatgaattttttcc

SEQ ID NO: 1596170 - DNA, 18 bp, Homo sapiens
aaaatgacaacagaaaaa

SEQ ID NO: 1596171 - DNA, 13 bp, Homo sapiens
aaaatgacagatg

SEQ ID NO: 1596172 - DNA, 15 bp, Homo sapiens
aaaatgacagatgtt

SEQ ID NO: 1596173 - DNA, 21 bp, Homo sapiens
aaaatgactaaaaatattata

SEQ ID NO: 1596174 - DNA, 14 bp, Homo sapiens
aaaatgagaaagga

SEQ ID NO: 1596175 - DNA, 13 bp, Homo sapiens
aaaatgagaattt

SEQ ID NO: 1596176 - DNA, 15 bp, Homo sapiens
aaaatgagagctgta

SEQ ID NO: 1596177 - DNA, 23 bp, Homo sapiens
aaaatgagagggcagtgtttcct

SEQ ID NO: 1596178 - DNA, 16 bp, Homo sapiens
aaaatgaggaatagca

SEQ ID NO: 1596179 - DNA, 16 bp, Homo sapiens
aaaatgcaaaatgaaa

SEQ ID NO: 1596180 - DNA, 14 bp, Homo sapiens
aaaatgcaaagctg

SEQ ID NO: 1596181 - DNA, 23 bp, Homo sapiens
aaaatgccaagggggtgactgga

SEQ ID NO: 1596182 - DNA, 14 bp, Homo sapiens
aaaatggaaagaat

SEQ ID NO: 1596183 - DNA, 14 bp, Homo sapiens
aaaatggaataaaa

SEQ ID NO: 1596184 - DNA, 21 bp, Homo sapiens
aaaatggcagggggtggaatt

SEQ ID NO: 1596185 - DNA, 19 bp, Homo sapiens
aaaatggccatttgctttt

SEQ ID NO: 1596186 - DNA, 18 bp, Homo sapiens
aaaatggctaataaactg

SEQ ID NO: 1596187 - DNA, 13 bp, Homo sapiens
aaaatgggaaata

SEQ ID NO: 1596188 - DNA, 17 bp, Homo sapiens
aaaatgggaagactgag

SEQ ID NO: 1596189 - DNA, 15 bp, Homo sapiens
aaaatggtataaaag

SEQ ID NO: 1596190 - DNA, 19 bp, Homo sapiens
aaaatgtaacatcataatt

SEQ ID NO: 1596191 - DNA, 23 bp, Homo sapiens
aaaatgtaagattatagattcta

SEQ ID NO: 1596192 - DNA, 12 bp, Homo sapiens
aaaatgtacact

SEQ ID NO: 1596193 - DNA, 21 bp, Homo sapiens
aaaatgtacactggatatgtt

SEQ ID NO: 1596194 - DNA, 16 bp, Homo sapiens
aaaatgtcctgccttt

SEQ ID NO: 1596195 - DNA, 12 bp, Homo sapiens
aaaatgtgaagt

SEQ ID NO: 1596196 - DNA, 20 bp, Homo sapiens
aaaatgtgatgttctaaggc

SEQ ID NO: 1596197 - DNA, 21 bp, Homo sapiens
aaaatgtgatgttctaaggct

SEQ ID NO: 1596198 - DNA, 22 bp, Homo sapiens
aaaatgtgggattatgggtcac

SEQ ID NO: 1596199 - DNA, 13 bp, Homo sapiens
aaaatgtgtacag

SEQ ID NO: 1596200 - DNA, 22 bp, Homo sapiens
aaaatgtgtacagtgaattgtc

SEQ ID NO: 1596201 - DNA, 21 bp, Homo sapiens
aaaatgttacggcatcacact

SEQ ID NO: 1596202 - DNA, 18 bp, Homo sapiens
aaaatgttatcttctcaa

SEQ ID NO: 1596203 - DNA, 16 bp, Homo sapiens
aaaatgttctatttaa

SEQ ID NO: 1596204 - DNA, 23 bp, Homo sapiens
aaaatgttctatttaacaactgg

SEQ ID NO: 1596205 - DNA, 23 bp, Homo sapiens
aaaatgtttggtttcaggtattt

SEQ ID NO: 1596206 - DNA, 18 bp, Homo sapiens
aaaatgttttagcaattt

SEQ ID NO: 1596207 - DNA, 22 bp, Homo sapiens
aaaatgtttttggtcttttata

SEQ ID NO: 1596208 - DNA, 15 bp, Homo sapiens
aaaattaaaaaatga

SEQ ID NO: 1596209 - DNA, 18 bp, Homo sapiens
aaaattaaaaaatgaaat

SEQ ID NO: 1596210 - DNA, 20 bp, Homo sapiens
aaaattaaaccaatgaagaa

SEQ ID NO: 1596211 - DNA, 19 bp, Homo sapiens
aaaattaaatgccttgtat

SEQ ID NO: 1596212 - DNA, 22 bp, Homo sapiens
aaaattaaatgccttgtataaa

SEQ ID NO: 1596213 - DNA, 13 bp, Homo sapiens
aaaattaactttt

SEQ ID NO: 1596214 - DNA, 20 bp, Homo sapiens
aaaattaagcaaatgttaaa

SEQ ID NO: 1596215 - DNA, 16 bp, Homo sapiens
aaaattaagtagaaca

SEQ ID NO: 1596216 - DNA, 17 bp, Homo sapiens
aaaattaagtagaacaa

SEQ ID NO: 1596217 - DNA, 19 bp, Homo sapiens
aaaattaagtagaacaaaa

SEQ ID NO: 1596218 - DNA, 20 bp, Homo sapiens
aaaattaatatggtgtattt

SEQ ID NO: 1596219 - DNA, 14 bp, Homo sapiens
aaaattagaaagga

SEQ ID NO: 1596220 - DNA, 22 bp, Homo sapiens
aaaattagaaaggacaacagtt

SEQ ID NO: 1596221 - DNA, 17 bp, Homo sapiens
aaaattatcaaaaagct

SEQ ID NO: 1596222 - DNA, 16 bp, Homo sapiens
aaaattattttgttca

SEQ ID NO: 1596223 - DNA, 20 bp, Homo sapiens
aaaattattttgttcataca

SEQ ID NO: 1596224 - DNA, 21 bp, Homo sapiens
aaaattcagcaaaccattttt

SEQ ID NO: 1596225 - DNA, 14 bp, Homo sapiens
aaaattcatttcta

SEQ ID NO: 1596226 - DNA, 15 bp, Homo sapiens
aaaattcatttctaa

SEQ ID NO: 1596227 - DNA, 16 bp, Homo sapiens
aaaattccagaaagga

SEQ ID NO: 1596228 - DNA, 12 bp, Homo sapiens
aaaattctagtc

SEQ ID NO: 1596229 - DNA, 21 bp, Homo sapiens
aaaattctatggaatagttct

SEQ ID NO: 1596230 - DNA, 16 bp, Homo sapiens
aaaattctgatgtttc

SEQ ID NO: 1596231 - DNA, 21 bp, Homo sapiens
cattcttgttggtagcatgta

SEQ ID NO: 1596232 - DNA, 22 bp, Homo sapiens
cattcttgttggtagcatgtac

SEQ ID NO: 1596233 - DNA, 15 bp, Homo sapiens
cattctttactgcac

SEQ ID NO: 1596234 - DNA, 18 bp, Homo sapiens
cattctttactgcactca

SEQ ID NO: 1596235 - DNA, 19 bp, Homo sapiens
cattctttactgcactcag

SEQ ID NO: 1596236 - DNA, 18 bp, Homo sapiens
cattctttatcttgacat

SEQ ID NO: 1596237 - DNA, 22 bp, Homo sapiens
cattcttttcagcttgtttcta

SEQ ID NO: 1596238 - DNA, 23 bp, Homo sapiens
cattcttttcagcttgtttctat

SEQ ID NO: 1596239 - DNA, 19 bp, Homo sapiens
cattctttttctgttgaaa

SEQ ID NO: 1596240 - DNA, 16 bp, Homo sapiens
cattgaaaacagatat

SEQ ID NO: 1596241 - DNA, 18 bp, Homo sapiens
cattgaaagaagagatga

SEQ ID NO: 1596242 - DNA, 11 bp, Homo sapiens
cattgaaagag

SEQ ID NO: 1596243 - DNA, 16 bp, Homo sapiens
cattgaaagagaacca

SEQ ID NO: 1596244 - DNA, 19 bp, Homo sapiens
cattgaaagagaaccagtt

SEQ ID NO: 1596245 - DNA, 18 bp, Homo sapiens
cattgaaattctgagaaa

SEQ ID NO: 1596246 - DNA, 21 bp, Homo sapiens
cattgaaggaaagctatatct

SEQ ID NO: 1596247 - DNA, 14 bp, Homo sapiens
cattgaaggcttaa

SEQ ID NO: 1596248 - DNA, 15 bp, Homo sapiens
cattgaccaagaact

SEQ ID NO: 1596249 - DNA, 20 bp, Homo sapiens
cattgaccaagaactgcatg

SEQ ID NO: 1596250 - DNA, 14 bp, Homo sapiens
cattgaccagctct

SEQ ID NO: 1596251 - DNA, 21 bp, Homo sapiens
cattgacctatttccagaaat

SEQ ID NO: 1596252 - DNA, 13 bp, Homo sapiens
cattgacctcagc

SEQ ID NO: 1596253 - DNA, 18 bp, Homo sapiens
cattgactatcaaactga

SEQ ID NO: 1596254 - DNA, 19 bp, Homo sapiens
cattgactatcaaactgaa

SEQ ID NO: 1596255 - DNA, 23 bp, Homo sapiens
cattgagaactgcatatgtttcg

SEQ ID NO: 1596256 - DNA, 19 bp, Homo sapiens
cattgagcagttagctcat

SEQ ID NO: 1596257 - DNA, 17 bp, Homo sapiens
cattgagcatttgaaag

SEQ ID NO: 1596258 - DNA, 15 bp, Homo sapiens
catttatactctttt

SEQ ID NO: 1596259 - DNA, 16 bp, Homo sapiens
catttatataaaactt

SEQ ID NO: 1596260 - DNA, 23 bp, Homo sapiens
catttatataaaacttaaaaaca

SEQ ID NO: 1596261 - DNA, 14 bp, Homo sapiens
catttatatatata

SEQ ID NO: 1596262 - DNA, 14 bp, Homo sapiens
catttatatctgct

SEQ ID NO: 1596263 - DNA, 18 bp, Homo sapiens
catttatcaatcagtata

SEQ ID NO: 1596264 - DNA, 15 bp, Homo sapiens
catttatcttatcta

SEQ ID NO: 1596265 - DNA, 15 bp, Homo sapiens
catttatcttgaagg

SEQ ID NO: 1596266 - DNA, 16 bp, Homo sapiens
catttatcttgaagga

SEQ ID NO: 1596267 - DNA, 17 bp, Homo sapiens
catttatcttgaaggaa

SEQ ID NO: 1596268 - DNA, 12 bp, Homo sapiens
catttatctttt

SEQ ID NO: 1596269 - DNA, 14 bp, Homo sapiens
catttatgacctaa

SEQ ID NO: 1596270 - DNA, 19 bp, Homo sapiens
catttatgacctaagtcag

SEQ ID NO: 1596271 - DNA, 14 bp, Homo sapiens
catttatgcacatt

SEQ ID NO: 1596272 - DNA, 21 bp, Homo sapiens
catttatggtcaacacttaag

SEQ ID NO: 1596273 - DNA, 14 bp, Homo sapiens
catttatgtttatt

SEQ ID NO: 1596274 - DNA, 22 bp, Homo sapiens
catttatttatgaaaaaatatg

SEQ ID NO: 1596275 - DNA, 19 bp, Homo sapiens
catttatttttagttaaaa

SEQ ID NO: 1596276 - DNA, 17 bp, Homo sapiens
catttattttttacatt

SEQ ID NO: 1596277 - DNA, 16 bp, Homo sapiens
catttcaaagccctgc

SEQ ID NO: 1596278 - DNA, 17 bp, Homo sapiens
catttcaaagccctgcc

SEQ ID NO: 1596279 - DNA, 16 bp, Homo sapiens
catttcaaagctgagt

SEQ ID NO: 1596280 - DNA, 20 bp, Homo sapiens
catttcaaggaacagccaca

SEQ ID NO: 1596281 - DNA, 15 bp, Homo sapiens
catttcacccctccc

SEQ ID NO: 1596282 - DNA, 21 bp, Homo sapiens
catttcacccctccctttctc

SEQ ID NO: 1596283 - DNA, 17 bp, Homo sapiens
catttcagaaagccttt

SEQ ID NO: 1596284 - DNA, 20 bp, Homo sapiens
catttcagccaaactgtaga

SEQ ID NO: 1596285 - DNA, 19 bp, Homo sapiens
catttcagggtcttggctg

SEQ ID NO: 1596286 - DNA, 15 bp, Homo sapiens
catttcatacaacag

SEQ ID NO: 1596287 - DNA, 13 bp, Homo sapiens
catttcatgaaaa

SEQ ID NO: 1596288 - DNA, 14 bp, Homo sapiens
catttcatgaaaaa

SEQ ID NO: 1596289 - DNA, 15 bp, Homo sapiens
catttcatgaaaaag

SEQ ID NO: 1596290 - DNA, 23 bp, Homo sapiens
catttcatgaaaaagctgcttct

SEQ ID NO: 1596291 - DNA, 15 bp, Homo sapiens
catttcattcaaatc

SEQ ID NO: 1596292 - DNA, 21 bp, Homo sapiens
catttcattcaaatcagtgat

SEQ ID NO: 1596293 - DNA, 21 bp, Homo sapiens
catttcattcctaacacagca

SEQ ID NO: 1596294 - DNA, 17 bp, Homo sapiens
catttccaaattcacaa

SEQ ID NO: 1596295 - DNA, 13 bp, Homo sapiens
catttccaacacc

SEQ ID NO: 1596296 - DNA, 19 bp, Homo sapiens
catttccaacaccacagac

SEQ ID NO: 1596297 - DNA, 20 bp, Homo sapiens
catttccagggcagcagccg

SEQ ID NO: 1596298 - DNA, 15 bp, Homo sapiens
catttccattgctta

SEQ ID NO: 1596299 - DNA, 18 bp, Homo sapiens
catttcccaaagtcctct

SEQ ID NO: 1596300 - DNA, 19 bp, Homo sapiens
catttcccaaagtcctctg

SEQ ID NO: 1596301 - DNA, 14 bp, Homo sapiens
catttcccacatct

SEQ ID NO: 1596302 - DNA, 18 bp, Homo sapiens
catttcctcacactaaga

SEQ ID NO: 1596303 - DNA, 14 bp, Homo sapiens
catttcctgctgaa

SEQ ID NO: 1596304 - DNA, 13 bp, Homo sapiens
catttccttggag

SEQ ID NO: 1596305 - DNA, 23 bp, Homo sapiens
catttccttggaggccaccggga

SEQ ID NO: 1596306 - DNA, 16 bp, Homo sapiens
catttccttttcacat

SEQ ID NO: 1596307 - DNA, 12 bp, Homo sapiens
catttccttttt

SEQ ID NO: 1596308 - DNA, 18 bp, Homo sapiens
catttctaattcctgttt

SEQ ID NO: 1596309 - DNA, 15 bp, Homo sapiens
catttctagactcaa

SEQ ID NO: 1596310 - DNA, 18 bp, Homo sapiens
catttctatttatttact

SEQ ID NO: 1596311 - DNA, 15 bp, Homo sapiens
catttctctccacct

SEQ ID NO: 1596312 - DNA, 14 bp, Homo sapiens
catttctctgagca

SEQ ID NO: 1596313 - DNA, 19 bp, Homo sapiens
catttctctgagcagtcag

SEQ ID NO: 1596314 - DNA, 16 bp, Homo sapiens
catttctcttcctaaa

SEQ ID NO: 1596315 - DNA, 17 bp, Homo sapiens
catttctcttcctaaat

SEQ ID NO: 1596316 - DNA, 12 bp, Homo sapiens
catttctgcaga

SEQ ID NO: 1596317 - DNA, 13 bp, Homo sapiens
catttctgccagc

SEQ ID NO: 1596318 - DNA, 14 bp, Homo sapiens
catttctgccagcg

SEQ ID NO: 1596319 - DNA, 21 bp, Homo sapiens
catttcttctcccaaatgtct

SEQ ID NO: 1596320 - DNA, 19 bp, Homo sapiens
catttcttggcattggaat

SEQ ID NO: 1596321 - DNA, 14 bp, Homo sapiens
catttctttcttgc

SEQ ID NO: 1596322 - DNA, 19 bp, Homo sapiens
catttctttcttgctggct

SEQ ID NO: 1596323 - DNA, 21 bp, Homo sapiens
catttctttcttgctggctct

SEQ ID NO: 1596324 - DNA, 22 bp, Homo sapiens
catttctttttgggagagactt

SEQ ID NO: 1596325 - DNA, 22 bp, Homo sapiens
catttgaacctggatccagcac

SEQ ID NO: 1596326 - DNA, 21 bp, Homo sapiens
catttgacacaaagcttctaa

SEQ ID NO: 1596327 - DNA, 23 bp, Homo sapiens
catttgactgttcaatgattatt

SEQ ID NO: 1596328 - DNA, 17 bp, Homo sapiens
catttgagaaatgcata

SEQ ID NO: 1596329 - DNA, 22 bp, Homo sapiens
catttgagaaatgcatattgta

SEQ ID NO: 1596330 - DNA, 13 bp, Homo sapiens
catttgagataaa

SEQ ID NO: 1596331 - DNA, 13 bp, Homo sapiens
catttgatatttt

SEQ ID NO: 1596332 - DNA, 15 bp, Homo sapiens
catttgatatttttc

SEQ ID NO: 1596333 - DNA, 20 bp, Homo sapiens
catttgatgcatgtctttta

SEQ ID NO: 1596334 - DNA, 14 bp, Homo sapiens
catttgattaacat

SEQ ID NO: 1596335 - DNA, 15 bp, Homo sapiens
catttgatttccatg

SEQ ID NO: 1596336 - DNA, 21 bp, Homo sapiens
catttgcatatcacccttccc

SEQ ID NO: 1596337 - DNA, 18 bp, Homo sapiens
catttgctactgttgtaa

SEQ ID NO: 1596338 - DNA, 22 bp, Homo sapiens
catttgctactgttgtaagaat

SEQ ID NO: 1596339 - DNA, 22 bp, Homo sapiens
catttgctagttctgctgccct

SEQ ID NO: 1596340 - DNA, 22 bp, Homo sapiens
catttgctcttcagatgccact

SEQ ID NO: 1596341 - DNA, 15 bp, Homo sapiens
catttgctgttttaa

SEQ ID NO: 1596342 - DNA, 18 bp, Homo sapiens
catttgcttgtactggga

SEQ ID NO: 1596343 - DNA, 20 bp, Homo sapiens
catttgcttgtactgggaca

SEQ ID NO: 1596344 - DNA, 15 bp, Homo sapiens
catttggtctcaggc

SEQ ID NO: 1596345 - DNA, 18 bp, Homo sapiens
catttggtctcaggcagc

SEQ ID NO: 1596346 - DNA, 16 bp, Homo sapiens
catttggtctgccaga

SEQ ID NO: 1596347 - DNA, 22 bp, Homo sapiens
catttggtctgccagaatactg

SEQ ID NO: 1596348 - DNA, 21 bp, Homo sapiens
catttggtggtactttattct

SEQ ID NO: 1596349 - DNA, 22 bp, Homo sapiens
catttggtggtactttattctt

SEQ ID NO: 1596350 - DNA, 15 bp, Homo sapiens
catttggtgttcctg

SEQ ID NO: 1596351 - DNA, 22 bp, Homo sapiens
catttggtgttcctggaagcag

SEQ ID NO: 1596352 - DNA, 21 bp, Homo sapiens
aaacaggagcaaatggcgttt

SEQ ID NO: 1596353 - DNA, 13 bp, Homo sapiens
aaacaggcccagc

SEQ ID NO: 1596354 - DNA, 17 bp, Homo sapiens
aaacagggccacataga

SEQ ID NO: 1596355 - DNA, 22 bp, Homo sapiens
aaacagggctgccttctggcct

SEQ ID NO: 1596356 - DNA, 23 bp, Homo sapiens
aaacaggtatatactttgaaagg

SEQ ID NO: 1596357 - DNA, 22 bp, Homo sapiens
aaacaggtatttttttaaatca

SEQ ID NO: 1596358 - DNA, 20 bp, Homo sapiens
aaacagtaatctaggtgtgg

SEQ ID NO: 1596359 - DNA, 14 bp, Homo sapiens
aaacagtgagcctg

SEQ ID NO: 1596360 - DNA, 23 bp, Homo sapiens
aaacagtggatcacaaagtggaa

SEQ ID NO: 1596361 - DNA, 18 bp, Homo sapiens
aaacagtgtcttcttaaa

SEQ ID NO: 1596362 - DNA, 14 bp, Homo sapiens
aaacagttaacttt

SEQ ID NO: 1596363 - DNA, 18 bp, Homo sapiens
aaacagttaactttcaga

SEQ ID NO: 1596364 - DNA, 14 bp, Homo sapiens
aaacagttatttct

SEQ ID NO: 1596365 - DNA, 22 bp, Homo sapiens
aaacagttctcactgggaagaa

SEQ ID NO: 1596366 - DNA, 19 bp, Homo sapiens
aaacagttgcatgtagtaa

SEQ ID NO: 1596367 - DNA, 20 bp, Homo sapiens
aaacagttgcatgtagtaac

SEQ ID NO: 1596368 - DNA, 15 bp, Homo sapiens
aaacagttgctgtga

SEQ ID NO: 1596369 - DNA, 16 bp, Homo sapiens
aaacagttggtaactt

SEQ ID NO: 1596370 - DNA, 18 bp, Homo sapiens
aaacagttggtaactttt

SEQ ID NO: 1596371 - DNA, 19 bp, Homo sapiens
aaacagttggtaacttttg

SEQ ID NO: 1596372 - DNA, 14 bp, Homo sapiens
catttgttcctgct

SEQ ID NO: 1596373 - DNA, 14 bp, Homo sapiens
catttgttctcaca

SEQ ID NO: 1596374 - DNA, 20 bp, Homo sapiens
catttgtttacatttgatgc

SEQ ID NO: 1596375 - DNA, 15 bp, Homo sapiens
catttgtttgtattc

SEQ ID NO: 1596376 - DNA, 17 bp, Homo sapiens
catttgttttagcatta

SEQ ID NO: 1596377 - DNA, 20 bp, Homo sapiens
catttgttttagcattacct

SEQ ID NO: 1596378 - DNA, 22 bp, Homo sapiens
catttgttttagcattacctaa

SEQ ID NO: 1596379 - DNA, 16 bp, Homo sapiens
catttgttttgctttt

SEQ ID NO: 1596380 - DNA, 17 bp, Homo sapiens
cattttaaagttagtat

SEQ ID NO: 1596381 - DNA, 18 bp, Homo sapiens
cattttaaggttctcaga

SEQ ID NO: 1596382 - DNA, 15 bp, Homo sapiens
cattttaattttaaa

SEQ ID NO: 1596383 - DNA, 16 bp, Homo sapiens
cattttacacagcacc

SEQ ID NO: 1596384 - DNA, 16 bp, Homo sapiens
cattttacagatttct

SEQ ID NO: 1596385 - DNA, 20 bp, Homo sapiens
cattttactttttcctggct

SEQ ID NO: 1596386 - DNA, 15 bp, Homo sapiens
cattttatcattaaa

SEQ ID NO: 1596387 - DNA, 21 bp, Homo sapiens
cattttattaagctttttgga

SEQ ID NO: 1596388 - DNA, 22 bp, Homo sapiens
cattttattaagctttttggaa

SEQ ID NO: 1596389 - DNA, 20 bp, Homo sapiens
cattttattaataatattta

SEQ ID NO: 1596390 - DNA, 15 bp, Homo sapiens
cattttattttcatg

SEQ ID NO: 1596391 - DNA, 15 bp, Homo sapiens
cattttcaactgctt

SEQ ID NO: 1596392 - DNA, 23 bp, Homo sapiens
cattttcccatcatcctttgttc

SEQ ID NO: 1596393 - DNA, 14 bp, Homo sapiens
cattttccccccac

SEQ ID NO: 1596394 - DNA, 11 bp, Homo sapiens
cattttcctgt

SEQ ID NO: 1596395 - DNA, 15 bp, Homo sapiens
cattttcctgttcag

SEQ ID NO: 1596396 - DNA, 13 bp, Homo sapiens
cattttctaaata

SEQ ID NO: 1596397 - DNA, 18 bp, Homo sapiens
cattttctaaataaaaat

SEQ ID NO: 1596398 - DNA, 23 bp, Homo sapiens
cattttctaaataaaaatatgta

SEQ ID NO: 1596399 - DNA, 15 bp, Homo sapiens
cattttctataacat

SEQ ID NO: 1596400 - DNA, 12 bp, Homo sapiens
cattttctctta

SEQ ID NO: 1596401 - DNA, 18 bp, Homo sapiens
cattttctggtttggcat

SEQ ID NO: 1596402 - DNA, 18 bp, Homo sapiens
cattttctttttttaact

SEQ ID NO: 1596403 - DNA, 14 bp, Homo sapiens
cattttgacctact

SEQ ID NO: 1596404 - DNA, 15 bp, Homo sapiens
cattttgagtatttt

SEQ ID NO: 1596405 - DNA, 17 bp, Homo sapiens
cattttgcaaaatttcc

SEQ ID NO: 1596406 - DNA, 18 bp, Homo sapiens
cattttgcagcagtgagt

SEQ ID NO: 1596407 - DNA, 20 bp, Homo sapiens
cattttgcagcagtgagtct

SEQ ID NO: 1596408 - DNA, 18 bp, Homo sapiens
cattttggaagttttcag

SEQ ID NO: 1596409 - DNA, 20 bp, Homo sapiens
cattttggaagttttcagga

SEQ ID NO: 1596410 - DNA, 18 bp, Homo sapiens
cattttgggatccttcag

SEQ ID NO: 1596411 - DNA, 19 bp, Homo sapiens
cattttgggatccttcagc

SEQ ID NO: 1596412 - DNA, 21 bp, Homo sapiens
cattttgggccttgctaaatt

SEQ ID NO: 1596413 - DNA, 23 bp, Homo sapiens
cattttgggccttgctaaattga

SEQ ID NO: 1596414 - DNA, 23 bp, Homo sapiens
cattttggggctatatttacatg

SEQ ID NO: 1596415 - DNA, 19 bp, Homo sapiens
cattttgtaacaaatgaac

SEQ ID NO: 1596416 - DNA, 13 bp, Homo sapiens
cattttgtactct

SEQ ID NO: 1596417 - DNA, 19 bp, Homo sapiens
cattttgtatattaacttt

SEQ ID NO: 1596418 - DNA, 22 bp, Homo sapiens
cattttgtggtcattaagcatt

SEQ ID NO: 1596419 - DNA, 14 bp, Homo sapiens
cattttgtgtgaga

SEQ ID NO: 1596420 - DNA, 17 bp, Homo sapiens
cattttgtttctgtata

SEQ ID NO: 1596421 - DNA, 18 bp, Homo sapiens
cattttgttttgctctga

SEQ ID NO: 1596422 - DNA, 18 bp, Homo sapiens
catttttaaacttgaaat

SEQ ID NO: 1596423 - DNA, 13 bp, Homo sapiens
catttttaacagc

SEQ ID NO: 1596424 - DNA, 19 bp, Homo sapiens
catttttaatcatgaaatt

SEQ ID NO: 1596425 - DNA, 15 bp, Homo sapiens
catttttaatgtatc

SEQ ID NO: 1596426 - DNA, 20 bp, Homo sapiens
catttttaatgtatctattt

SEQ ID NO: 1596427 - DNA, 23 bp, Homo sapiens
catttttacaccaatttggtaaa

SEQ ID NO: 1596428 - DNA, 20 bp, Homo sapiens
catttttatacctgtttaaa

SEQ ID NO: 1596429 - DNA, 21 bp, Homo sapiens
catttttatacctgtttaaat

SEQ ID NO: 1596430 - DNA, 16 bp, Homo sapiens
catttttatgcagaca

SEQ ID NO: 1596431 - DNA, 14 bp, Homo sapiens
catttttatttctt

SEQ ID NO: 1596432 - DNA, 17 bp, Homo sapiens
catttttcaatagcaca

SEQ ID NO: 1596433 - DNA, 18 bp, Homo sapiens
catttttcctctgttcac

SEQ ID NO: 1596434 - DNA, 15 bp, Homo sapiens
catttttctataaat

SEQ ID NO: 1596435 - DNA, 20 bp, Homo sapiens
catttttctcccaagaaacc

SEQ ID NO: 1596436 - DNA, 21 bp, Homo sapiens
catttttctcccaagaaacct

SEQ ID NO: 1596437 - DNA, 15 bp, Homo sapiens
catttttgctgaatt

SEQ ID NO: 1596438 - DNA, 20 bp, Homo sapiens
catttttgtactaactagca

SEQ ID NO: 1596439 - DNA, 23 bp, Homo sapiens
catttttgtatttttcatcttta

SEQ ID NO: 1596440 - DNA, 20 bp, Homo sapiens
cattttttaaaaaagcaagg

SEQ ID NO: 1596441 - DNA, 19 bp, Homo sapiens
cattttttaagaaaacatt

SEQ ID NO: 1596442 - DNA, 22 bp, Homo sapiens
cattttttaagaaaacatttct

SEQ ID NO: 1596443 - DNA, 13 bp, Homo sapiens
cattttttaagct

SEQ ID NO: 1596444 - DNA, 17 bp, Homo sapiens
cattttttaaggaaaca

SEQ ID NO: 1596445 - DNA, 21 bp, Homo sapiens
cattttttaatttacttgttt

SEQ ID NO: 1596446 - DNA, 14 bp, Homo sapiens
cattttttaggaca

SEQ ID NO: 1596447 - DNA, 22 bp, Homo sapiens
cattttttaggacatcttaaat

SEQ ID NO: 1596448 - DNA, 13 bp, Homo sapiens
cattttttcttca

SEQ ID NO: 1596449 - DNA, 14 bp, Homo sapiens
cattttttcttctg

SEQ ID NO: 1596450 - DNA, 17 bp, Homo sapiens
cattttttcttctgaag

SEQ ID NO: 1596451 - DNA, 20 bp, Homo sapiens
cattttttgaaatgctgaaa

SEQ ID NO: 1596452 - DNA, 14 bp, Homo sapiens
cattttttgctata

SEQ ID NO: 1596453 - DNA, 19 bp, Homo sapiens
cattttttgctataatcat

SEQ ID NO: 1596454 - DNA, 18 bp, Homo sapiens
catttttttccaggctgg

SEQ ID NO: 1596455 - DNA, 16 bp, Homo sapiens
catttttttctctctg

SEQ ID NO: 1596456 - DNA, 16 bp, Homo sapiens
catttttttctttact

SEQ ID NO: 1596457 - DNA, 18 bp, Homo sapiens
catttttttttcaatcaa

SEQ ID NO: 1596458 - DNA, 22 bp, Homo sapiens
ccaaaaaaaggaaaaataatca

SEQ ID NO: 1596459 - DNA, 23 bp, Homo sapiens
ccaaaaaaaggaaaaataatcaa

SEQ ID NO: 1596460 - DNA, 12 bp, Homo sapiens
ccaaaaaatatc

SEQ ID NO: 1596461 - DNA, 19 bp, Homo sapiens
ccaaaaaatatctagtaat

SEQ ID NO: 1596462 - DNA, 22 bp, Homo sapiens
ccaaaaaattctacaacacaca

SEQ ID NO: 1596463 - DNA, 14 bp, Homo sapiens
ccaaaaaccatgtt

SEQ ID NO: 1596464 - DNA, 22 bp, Homo sapiens
ccaaaaaggttgctgtttcaca

SEQ ID NO: 1596465 - DNA, 18 bp, Homo sapiens
ccaaaacaaacaaacaga

SEQ ID NO: 1596466 - DNA, 18 bp, Homo sapiens
ccaaaacatttctggaca

SEQ ID NO: 1596467 - DNA, 22 bp, Homo sapiens
ccaaaacctcatgacagccaga

SEQ ID NO: 1596468 - DNA, 19 bp, Homo sapiens
ccaaaacctgcttccttca

SEQ ID NO: 1596469 - DNA, 14 bp, Homo sapiens
ccaaaacttctctt

SEQ ID NO: 1596470 - DNA, 22 bp, Homo sapiens
aaaccttgctctcctcatctcc

SEQ ID NO: 1596471 - DNA, 17 bp, Homo sapiens
aaaccttggagaggaga

SEQ ID NO: 1596472 - DNA, 20 bp, Homo sapiens
aaaccttgtaaaaaaagcaa

SEQ ID NO: 1596473 - DNA, 17 bp, Homo sapiens
aaaccttttatttttat

SEQ ID NO: 1596474 - DNA, 18 bp, Homo sapiens
aaacgaagccatctttct

SEQ ID NO: 1596475 - DNA, 22 bp, Homo sapiens
aaacgctaaagagcccttgcct

SEQ ID NO: 1596476 - DNA, 13 bp, Homo sapiens
aaacgctacctct

SEQ ID NO: 1596477 - DNA, 16 bp, Homo sapiens
aaacgctcctttgtgt

SEQ ID NO: 1596478 - DNA, 20 bp, Homo sapiens
aaacggcaacgtagcctggg

SEQ ID NO: 1596479 - DNA, 19 bp, Homo sapiens
aaacgggaacatgccccct

SEQ ID NO: 1596480 - DNA, 20 bp, Homo sapiens
aaacgggaacatgccccctg

SEQ ID NO: 1596481 - DNA, 13 bp, Homo sapiens
aaacgtccccagc

SEQ ID NO: 1596482 - DNA, 19 bp, Homo sapiens
aaacgtggtcaccttcgag

SEQ ID NO: 1596483 - DNA, 14 bp, Homo sapiens
aaacgtttctcaaa

SEQ ID NO: 1596484 - DNA, 22 bp, Homo sapiens
aaactaagagacagttctctgt

SEQ ID NO: 1596485 - DNA, 14 bp, Homo sapiens
aaactacaaagtaa

SEQ ID NO: 1596486 - DNA, 20 bp, Homo sapiens
aaagaactccttattttgta

SEQ ID NO: 1596487 - DNA, 17 bp, Homo sapiens
aaagaacttactgatta

SEQ ID NO: 1596488 - DNA, 17 bp, Homo sapiens
aaagaagaaacgtctat

SEQ ID NO: 1596489 - DNA, 19 bp, Homo sapiens
aaagaagaaagtctatgct

SEQ ID NO: 1596490 - DNA, 21 bp, Homo sapiens
aaagaagaagaagaaggagag

SEQ ID NO: 1596491 - DNA, 19 bp, Homo sapiens
aaagaagagtttacagaca

SEQ ID NO: 1596492 - DNA, 12 bp, Homo sapiens
aaagaagcaaga

SEQ ID NO: 1596493 - DNA, 13 bp, Homo sapiens
aaagaagccacag

SEQ ID NO: 1596494 - DNA, 18 bp, Homo sapiens
aaagaaggaaaatgatct

SEQ ID NO: 1596495 - DNA, 16 bp, Homo sapiens
aaagaagggatcccta

SEQ ID NO: 1596496 - DNA, 19 bp, Homo sapiens
aaagaagggggccctgcta

SEQ ID NO: 1596497 - DNA, 16 bp, Homo sapiens
aaagaaggtgctgatc

SEQ ID NO: 1596498 - DNA, 23 bp, Homo sapiens
aaagaagtaggggaagacatgca

SEQ ID NO: 1596499 - DNA, 15 bp, Homo sapiens
aaagaatacagaaag

SEQ ID NO: 1596500 - DNA, 14 bp, Homo sapiens
aaagaatttagtat

SEQ ID NO: 1596501 - DNA, 15 bp, Homo sapiens
aaagacaaaaatcaa

SEQ ID NO: 1596502 - DNA, 19 bp, Homo sapiens
aaagacaaattctgtttct

SEQ ID NO: 1596503 - DNA, 16 bp, Homo sapiens
aaagacaacaaaagaa

SEQ ID NO: 1596504 - DNA, 19 bp, Homo sapiens
aaagacacctactgagtgg

SEQ ID NO: 1596505 - DNA, 16 bp, Homo sapiens
aaagacactgcctggg

SEQ ID NO: 1596506 - DNA, 17 bp, Homo sapiens
aaagacactgcctgggc

SEQ ID NO: 1596507 - DNA, 19 bp, Homo sapiens
aaagacactgcctgggctg

SEQ ID NO: 1596508 - DNA, 13 bp, Homo sapiens
aaagacagaatgg

SEQ ID NO: 1596509 - DNA, 12 bp, Homo sapiens
aaagacatcaat

SEQ ID NO: 1596510 - DNA, 16 bp, Homo sapiens
aaagacatgctttcca

SEQ ID NO: 1596511 - DNA, 13 bp, Homo sapiens
aaagacattttaa

SEQ ID NO: 1596512 - DNA, 23 bp, Homo sapiens
aaagacattttaagtttgtagta

SEQ ID NO: 1596513 - DNA, 12 bp, Homo sapiens
aaagacctgcct

SEQ ID NO: 1596514 - DNA, 19 bp, Homo sapiens
aaagactattcaaacagtc

SEQ ID NO: 1596515 - DNA, 21 bp, Homo sapiens
aaagactattcaaacagtctc

SEQ ID NO: 1596516 - DNA, 15 bp, Homo sapiens
aaagactcagtgttc

SEQ ID NO: 1596517 - DNA, 14 bp, Homo sapiens
aaagactccaaaga

SEQ ID NO: 1596518 - DNA, 23 bp, Homo sapiens
aaagactcctaatagcttttcct

SEQ ID NO: 1596519 - DNA, 15 bp, Homo sapiens
aaagactctggaggt

SEQ ID NO: 1596520 - DNA, 20 bp, Homo sapiens
aaagactgaacatgtttaca

SEQ ID NO: 1596521 - DNA, 16 bp, Homo sapiens
aaagactgagctcaag

SEQ ID NO: 1596522 - DNA, 12 bp, Homo sapiens
aaagactgcaga

SEQ ID NO: 1596523 - DNA, 13 bp, Homo sapiens
aaagactgcagaa

SEQ ID NO: 1596524 - DNA, 17 bp, Homo sapiens
aaagactgcagctgctg

SEQ ID NO: 1596525 - DNA, 18 bp, Homo sapiens
aaagactgcagctgctga

SEQ ID NO: 1596526 - DNA, 15 bp, Homo sapiens
aaagactgtacaaag

SEQ ID NO: 1596527 - DNA, 20 bp, Homo sapiens
aaagacttagtatattttct

SEQ ID NO: 1596528 - DNA, 16 bp, Homo sapiens
aaagagaaaccgggag

SEQ ID NO: 1596529 - DNA, 20 bp, Homo sapiens
aaagagaatgagtccttgat

SEQ ID NO: 1596530 - DNA, 19 bp, Homo sapiens
aaagagagaagccagccac

SEQ ID NO: 1596531 - DNA, 14 bp, Homo sapiens
aaagagattcgaat

SEQ ID NO: 1596532 - DNA, 15 bp, Homo sapiens
aaagagcccttgcct

SEQ ID NO: 1596533 - DNA, 18 bp, Homo sapiens
aaagagcccttgcctccc

SEQ ID NO: 1596534 - DNA, 18 bp, Homo sapiens
aaagagccttcagaatgc

SEQ ID NO: 1596535 - DNA, 15 bp, Homo sapiens
aaagagctgcctgga

SEQ ID NO: 1596536 - DNA, 19 bp, Homo sapiens
aaagagctgcctggatgag

SEQ ID NO: 1596537 - DNA, 20 bp, Homo sapiens
aaagaggcagcttgaaactg

SEQ ID NO: 1596538 - DNA, 16 bp, Homo sapiens
aaagaggctgaaagag

SEQ ID NO: 1596539 - DNA, 21 bp, Homo sapiens
aaagaggctgaggcctggact

SEQ ID NO: 1596540 - DNA, 22 bp, Homo sapiens
aaagaggctgcccctctcacca

SEQ ID NO: 1596541 - DNA, 13 bp, Homo sapiens
aaagagggacaag

SEQ ID NO: 1596542 - DNA, 19 bp, Homo sapiens
aaagagggtttattttcag

SEQ ID NO: 1596543 - DNA, 18 bp, Homo sapiens
aaagaggttactttagtt

SEQ ID NO: 1596544 - DNA, 22 bp, Homo sapiens
aaagaggttactttagttagca

SEQ ID NO: 1596545 - DNA, 20 bp, Homo sapiens
aaagagtaatttcatttaaa

SEQ ID NO: 1596546 - DNA, 16 bp, Homo sapiens
aaagagttcttaagga

SEQ ID NO: 1596547 - DNA, 19 bp, Homo sapiens
aaagagttggcatgaaagt

SEQ ID NO: 1596548 - DNA, 21 bp, Homo sapiens
aaagataaaaggtttcttttt

SEQ ID NO: 1596549 - DNA, 21 bp, Homo sapiens
aaagataaacctggagatatt

SEQ ID NO: 1596550 - DNA, 15 bp, Homo sapiens
aaagataaagaccag

SEQ ID NO: 1596551 - DNA, 22 bp, Homo sapiens
aaagataggattgggaaagaag

SEQ ID NO: 1596552 - DNA, 20 bp, Homo sapiens
aaagatatatgaatatgaca

SEQ ID NO: 1596553 - DNA, 16 bp, Homo sapiens
aaagatatttttatct

SEQ ID NO: 1596554 - DNA, 15 bp, Homo sapiens
aaagatcaccttgta

SEQ ID NO: 1596555 - DNA, 22 bp, Homo sapiens
aaagatcacttgttgttttact

SEQ ID NO: 1596556 - DNA, 21 bp, Homo sapiens
aaagatctgtcctcagccttg

SEQ ID NO: 1596557 - DNA, 17 bp, Homo sapiens
aaagatgaaaatatttg

SEQ ID NO: 1596558 - DNA, 16 bp, Homo sapiens
aaagatgaaactgaaa

SEQ ID NO: 1596559 - DNA, 19 bp, Homo sapiens
aaagatgagaggggctcag

SEQ ID NO: 1596560 - DNA, 12 bp, Homo sapiens
aaagatgagttg

SEQ ID NO: 1596561 - DNA, 12 bp, Homo sapiens
aaagatgatgat

SEQ ID NO: 1596562 - DNA, 13 bp, Homo sapiens
aaagatgcacaga

SEQ ID NO: 1596563 - DNA, 21 bp, Homo sapiens
aaagatgcagagtaagtatta

SEQ ID NO: 1596564 - DNA, 21 bp, Homo sapiens
aaagatgcattttgagtgttt

SEQ ID NO: 1596565 - DNA, 17 bp, Homo sapiens
aaagatgctcttctgtg

SEQ ID NO: 1596566 - DNA, 14 bp, Homo sapiens
aaagatggataaac

SEQ ID NO: 1596567 - DNA, 21 bp, Homo sapiens
aaagatggataaactgagcct

SEQ ID NO: 1596568 - DNA, 16 bp, Homo sapiens
aaagatggatgtgctt

SEQ ID NO: 1596569 - DNA, 18 bp, Homo sapiens
aaagatggatttgaaaat

SEQ ID NO: 1596570 - DNA, 18 bp, Homo sapiens
aaagatgttaagcattta

SEQ ID NO: 1596571 - DNA, 19 bp, Homo sapiens
aaagatgttaagcatttat

SEQ ID NO: 1596572 - DNA, 19 bp, Homo sapiens
aaagattaaatgtgtcatt

SEQ ID NO: 1596573 - DNA, 13 bp, Homo sapiens
aaagattcatttt

SEQ ID NO: 1596574 - DNA, 15 bp, Homo sapiens
aaagattcattttta

SEQ ID NO: 1596575 - DNA, 22 bp, Homo sapiens
aaagattctctttaaaaaagac

SEQ ID NO: 1596576 - DNA, 19 bp, Homo sapiens
aaagattctggggctgtgt

SEQ ID NO: 1596577 - DNA, 23 bp, Homo sapiens
aaagattctgtgtcagagcccag

SEQ ID NO: 1596578 - DNA, 23 bp, Homo sapiens
aaagattgaagtattttgctgga

SEQ ID NO: 1596579 - DNA, 19 bp, Homo sapiens
aaagattgctgaaatttta

SEQ ID NO: 1596580 - DNA, 13 bp, Homo sapiens
aaagattgtactt

SEQ ID NO: 1596581 - DNA, 14 bp, Homo sapiens
aaagattgtactta

SEQ ID NO: 1596582 - DNA, 12 bp, Homo sapiens
aaagatttatca

SEQ ID NO: 1596583 - DNA, 14 bp, Homo sapiens
aaagatttctgttc

SEQ ID NO: 1596584 - DNA, 18 bp, Homo sapiens
aaagatttgtgaactgga

SEQ ID NO: 1596585 - DNA, 20 bp, Homo sapiens
aaagatttgtgaactggaag

SEQ ID NO: 1596586 - DNA, 14 bp, Homo sapiens
aaagatttgttact

SEQ ID NO: 1596587 - DNA, 15 bp, Homo sapiens
aaagattttattgta

SEQ ID NO: 1596588 - DNA, 18 bp, Homo sapiens
aaagattttattgtataa

SEQ ID NO: 1596589 - DNA, 23 bp, Homo sapiens
aaagatttttactaatatatatt

SEQ ID NO: 1596590 - DNA, 17 bp, Homo sapiens
ccaacatcacagcccag

SEQ ID NO: 1596591 - DNA, 21 bp, Homo sapiens
ccaacatcatcaggaagcctg

SEQ ID NO: 1596592 - DNA, 22 bp, Homo sapiens
ccaacatccagtcctgctgact

SEQ ID NO: 1596593 - DNA, 23 bp, Homo sapiens
ccaacatggagaaaccctgtctc

SEQ ID NO: 1596594 - DNA, 21 bp, Homo sapiens
ccaacatgtttctgttttgtt

SEQ ID NO: 1596595 - DNA, 19 bp, Homo sapiens
ccaaccaaggaatttaaaa

SEQ ID NO: 1596596 - DNA, 21 bp, Homo sapiens
ccaaccacagcatcgggagca

SEQ ID NO: 1596597 - DNA, 23 bp, Homo sapiens
ccaaccaggagctgatggcagct

SEQ ID NO: 1596598 - DNA, 14 bp, Homo sapiens
ccaacccagccacg

SEQ ID NO: 1596599 - DNA, 17 bp, Homo sapiens
ccaacccagccacgact

SEQ ID NO: 1596600 - DNA, 13 bp, Homo sapiens
ccaagcttcagag

SEQ ID NO: 1596601 - DNA, 14 bp, Homo sapiens
ccaagcttcagagc

SEQ ID NO: 1596602 - DNA, 15 bp, Homo sapiens
ccaagcttcagagcc

SEQ ID NO: 1596603 - DNA, 18 bp, Homo sapiens
ccaagcttcagagcctag

SEQ ID NO: 1596604 - DNA, 19 bp, Homo sapiens
ccaagcttcagagcctagc

SEQ ID NO: 1596605 - DNA, 21 bp, Homo sapiens
ccaagcttcagagcctagcca

SEQ ID NO: 1596606 - DNA, 11 bp, Homo sapiens
ccaagcttccc

SEQ ID NO: 1596607 - DNA, 13 bp, Homo sapiens
ccaagcttccctc

SEQ ID NO: 1596608 - DNA, 20 bp, Homo sapiens
ccaaggacagggctggctcc

SEQ ID NO: 1596609 - DNA, 22 bp, Homo sapiens
ccaaggaccttttggaatgact

SEQ ID NO: 1596610 - DNA, 22 bp, Homo sapiens
ccaaggactgagcaccctctgg

SEQ ID NO: 1596611 - DNA, 17 bp, Homo sapiens
ccaaggactgagggcag

SEQ ID NO: 1596612 - DNA, 14 bp, Homo sapiens
ccaaggagaaacag

SEQ ID NO: 1596613 - DNA, 18 bp, Homo sapiens
ccaaggagaaacagagac

SEQ ID NO: 1596614 - DNA, 21 bp, Homo sapiens
ccaaggagaccaagtcctggc

SEQ ID NO: 1596615 - DNA, 22 bp, Homo sapiens
ccaaggagaccaagtcctggct

SEQ ID NO: 1596616 - DNA, 23 bp, Homo sapiens
ccaaggagctgatttccaggccc

SEQ ID NO: 1596617 - DNA, 13 bp, Homo sapiens
ccaaggaggaaaa

SEQ ID NO: 1596618 - DNA, 23 bp, Homo sapiens
ccaaggaggtgaggagcagagca

SEQ ID NO: 1596619 - DNA, 23 bp, Homo sapiens
ccaaggcaaggcaggtgcctcca

SEQ ID NO: 1596620 - DNA, 17 bp, Homo sapiens
ccaaggcagcctccaga

SEQ ID NO: 1596621 - DNA, 18 bp, Homo sapiens
ccaaggcagcctccagag

SEQ ID NO: 1596622 - DNA, 20 bp, Homo sapiens
ccaaggcagcctccagagcc

SEQ ID NO: 1596623 - DNA, 21 bp, Homo sapiens
ccaaggcagcctccagagcca

SEQ ID NO: 1596624 - DNA, 13 bp, Homo sapiens
ccaaggccaggtt

SEQ ID NO: 1596625 - DNA, 18 bp, Homo sapiens
ccaaggccctgctttttt

SEQ ID NO: 1596626 - DNA, 20 bp, Homo sapiens
ccaaggccgaagctctggct

SEQ ID NO: 1596627 - DNA, 15 bp, Homo sapiens
ccaaggcctctctct

SEQ ID NO: 1596628 - DNA, 17 bp, Homo sapiens
ccaaggcctctctctgc

SEQ ID NO: 1596629 - DNA, 20 bp, Homo sapiens
ccaaggcctctctctgcctg

SEQ ID NO: 1596630 - DNA, 16 bp, Homo sapiens
ccaaggccttctcctc

SEQ ID NO: 1596631 - DNA, 19 bp, Homo sapiens
ccaagggaacctgtgtccg

SEQ ID NO: 1596632 - DNA, 15 bp, Homo sapiens
ccaagggacagccca

SEQ ID NO: 1596633 - DNA, 18 bp, Homo sapiens
ccaagggacaggagaaga

SEQ ID NO: 1596634 - DNA, 15 bp, Homo sapiens
ccaagggcccagacc

SEQ ID NO: 1596635 - DNA, 17 bp, Homo sapiens
ccaagggcccagaccct

SEQ ID NO: 1596636 - DNA, 19 bp, Homo sapiens
ccaagggcccagaccctgg

SEQ ID NO: 1596637 - DNA, 16 bp, Homo sapiens
ccaagggccccagggg

SEQ ID NO: 1596638 - DNA, 18 bp, Homo sapiens
ccaagggccccaggggca

SEQ ID NO: 1596639 - DNA, 14 bp, Homo sapiens
ccaagggccctggc

SEQ ID NO: 1596640 - DNA, 16 bp, Homo sapiens
ccaagggccctggcac

SEQ ID NO: 1596641 - DNA, 22 bp, Homo sapiens
ccaagggccctggcacccccac

SEQ ID NO: 1596642 - DNA, 18 bp, Homo sapiens
ccaagggccgactaagag

SEQ ID NO: 1596643 - DNA, 13 bp, Homo sapiens
ccaagggccgtgc

SEQ ID NO: 1596644 - DNA, 23 bp, Homo sapiens
ccaagggcttctgcaccctccac

SEQ ID NO: 1596645 - DNA, 16 bp, Homo sapiens
ccaagggggtgactgg

SEQ ID NO: 1596646 - DNA, 19 bp, Homo sapiens
ccaagggggtgactggaag

SEQ ID NO: 1596647 - DNA, 20 bp, Homo sapiens
ccaaggggtggccgggcaca

SEQ ID NO: 1596648 - DNA, 22 bp, Homo sapiens
ccaaggggtggccgggcacagt

SEQ ID NO: 1596649 - DNA, 21 bp, Homo sapiens
ccaaggggtgggcctgtgaat

SEQ ID NO: 1596650 - DNA, 23 bp, Homo sapiens
ccaagggtatccaagttggactg

SEQ ID NO: 1596651 - DNA, 23 bp, Homo sapiens
ccaagggttcagagactcagggc

SEQ ID NO: 1596652 - DNA, 22 bp, Homo sapiens
ccaagggtttcgactggtccag

SEQ ID NO: 1596653 - DNA, 21 bp, Homo sapiens
ccaaggtaccgatttctgcta

SEQ ID NO: 1596654 - DNA, 14 bp, Homo sapiens
ccaaggtcctgctc

SEQ ID NO: 1596655 - DNA, 15 bp, Homo sapiens
ccaaggtcctgctca

SEQ ID NO: 1596656 - DNA, 16 bp, Homo sapiens
ccaaggtcctgctcaa

SEQ ID NO: 1596657 - DNA, 16 bp, Homo sapiens
ccaaggtcttcttaat

SEQ ID NO: 1596658 - DNA, 14 bp, Homo sapiens
ccaaggtggaggga

SEQ ID NO: 1596659 - DNA, 20 bp, Homo sapiens
ccaaggtgggctgagccctg

SEQ ID NO: 1596660 - DNA, 20 bp, Homo sapiens
ccaaggtgggtagatcacga

SEQ ID NO: 1596661 - DNA, 22 bp, Homo sapiens
ccaaggtttaaagagtctagat

SEQ ID NO: 1596662 - DNA, 17 bp, Homo sapiens
ccaaggtttgagtccct

SEQ ID NO: 1596663 - DNA, 14 bp, Homo sapiens
ccaagtacactgag

SEQ ID NO: 1596664 - DNA, 17 bp, Homo sapiens
ccaagtaccaatgctgt

SEQ ID NO: 1596665 - DNA, 20 bp, Homo sapiens
ccaagtagctgagactacag

SEQ ID NO: 1596666 - DNA, 15 bp, Homo sapiens
ccaagtatgccttaa

SEQ ID NO: 1596667 - DNA, 17 bp, Homo sapiens
ccaagtcagacaccaag

SEQ ID NO: 1596668 - DNA, 18 bp, Homo sapiens
ccaagtcctagctcctcc

SEQ ID NO: 1596669 - DNA, 19 bp, Homo sapiens
ccaagtcctgaagaggcgg

SEQ ID NO: 1596670 - DNA, 16 bp, Homo sapiens
ccaagtctaatgaaga

SEQ ID NO: 1596671 - DNA, 16 bp, Homo sapiens
ccaagtctcagaagag

SEQ ID NO: 1596672 - DNA, 12 bp, Homo sapiens
ccaagtgcaata

SEQ ID NO: 1596673 - DNA, 14 bp, Homo sapiens
ccaagtgccagagg

SEQ ID NO: 1596674 - DNA, 12 bp, Homo sapiens
ccaagtgcctca

SEQ ID NO: 1596675 - DNA, 13 bp, Homo sapiens
ccaagtgcctcac

SEQ ID NO: 1596676 - DNA, 14 bp, Homo sapiens
ccaagtgctggccc

SEQ ID NO: 1596677 - DNA, 20 bp, Homo sapiens
ccaagtgctggcccacccag

SEQ ID NO: 1596678 - DNA, 19 bp, Homo sapiens
ccaagtggctgggtgccct

SEQ ID NO: 1596679 - DNA, 20 bp, Homo sapiens
ccaagtggctgggtgccctc

SEQ ID NO: 1596680 - DNA, 16 bp, Homo sapiens
ccaagtggggtgctgg

SEQ ID NO: 1596681 - DNA, 20 bp, Homo sapiens
ccaagttataaatcaatgtc

SEQ ID NO: 1596682 - DNA, 17 bp, Homo sapiens
ccaagttcctttttcct

SEQ ID NO: 1596683 - DNA, 16 bp, Homo sapiens
ccaagtttccatagca

SEQ ID NO: 1596684 - DNA, 10 bp, Homo sapiens
ccaataaagc

SEQ ID NO: 1596685 - DNA, 12 bp, Homo sapiens
ccaataaagctt

SEQ ID NO: 1596686 - DNA, 18 bp, Homo sapiens
ccaataaagcttttggaa

SEQ ID NO: 1596687 - DNA, 12 bp, Homo sapiens
ccaataaaggca

SEQ ID NO: 1596688 - DNA, 13 bp, Homo sapiens
ccaataaaggcag

SEQ ID NO: 1596689 - DNA, 15 bp, Homo sapiens
ccaataaaggcagct

SEQ ID NO: 1596690 - DNA, 18 bp, Homo sapiens
ccaataaaggcagctgcc

SEQ ID NO: 1596691 - DNA, 23 bp, Homo sapiens
ccaataaaggcagctgcctctgc

SEQ ID NO: 1596692 - DNA, 14 bp, Homo sapiens
ccaataaatgtttg

SEQ ID NO: 1596693 - DNA, 22 bp, Homo sapiens
ccaataaatgtttgttatttac

SEQ ID NO: 1596694 - DNA, 21 bp, Homo sapiens
ccaataacaaggagctcaccc

SEQ ID NO: 1596695 - DNA, 24 bp, Homo sapiens
ccaataactaatgctaagaaatgc

SEQ ID NO: 1596696 - DNA, 19 bp, Homo sapiens
ccaatacatttgtattttg

SEQ ID NO: 1596697 - DNA, 22 bp, Homo sapiens
ccaatacatttgtattttgtga

SEQ ID NO: 1596698 - DNA, 16 bp, Homo sapiens
ccaatagcctgaattt

SEQ ID NO: 1596699 - DNA, 18 bp, Homo sapiens
ccaatagggctgagctct

SEQ ID NO: 1596700 - DNA, 23 bp, Homo sapiens
ccaatatatagtgggtacatcaa

SEQ ID NO: 1596701 - DNA, 22 bp, Homo sapiens
ccaatatgtgattttttttccc

SEQ ID NO: 1596702 - DNA, 23 bp, Homo sapiens
ccaatattaacacgctgcctggt

SEQ ID NO: 1596703 - DNA, 12 bp, Homo sapiens
ccaatattataa

SEQ ID NO: 1596704 - DNA, 13 bp, Homo sapiens
ccaatattataat

SEQ ID NO: 1596705 - DNA, 18 bp, Homo sapiens
ccaatcaaagaattacag

SEQ ID NO: 1596706 - DNA, 20 bp, Homo sapiens
ccaatcaacagcatgtctac

SEQ ID NO: 1596707 - DNA, 19 bp, Homo sapiens
ccaatcagcttttgttcta

SEQ ID NO: 1596708 - DNA, 21 bp, Homo sapiens
ccaatcagcttttgttctaga

SEQ ID NO: 1596709 - DNA, 11 bp, Homo sapiens
aaaggaaaagt

SEQ ID NO: 1596710 - DNA, 15 bp, Homo sapiens
aaaggaaagaaaaca

SEQ ID NO: 1596711 - DNA, 15 bp, Homo sapiens
aaaggaaagctgtgt

SEQ ID NO: 1596712 - DNA, 13 bp, Homo sapiens
aaaggaaatttgt

SEQ ID NO: 1596713 - DNA, 18 bp, Homo sapiens
aaaggaaatttgtttgta

SEQ ID NO: 1596714 - DNA, 14 bp, Homo sapiens
ccaatcccgtgaaa

SEQ ID NO: 1596715 - DNA, 18 bp, Homo sapiens
ccaatcccgtgaaagaat

SEQ ID NO: 1596716 - DNA, 18 bp, Homo sapiens
ccaatcctcactgggtgg

SEQ ID NO: 1596717 - DNA, 17 bp, Homo sapiens
ccaatcctctctcccct

SEQ ID NO: 1596718 - DNA, 17 bp, Homo sapiens
ccaatcggtgtgttctt

SEQ ID NO: 1596719 - DNA, 23 bp, Homo sapiens
ccaatctctgttctgtttggcac

SEQ ID NO: 1596720 - DNA, 20 bp, Homo sapiens
ccaatgaaaacatgtactac

SEQ ID NO: 1596721 - DNA, 15 bp, Homo sapiens
ccaatgaagaagaca

SEQ ID NO: 1596722 - DNA, 23 bp, Homo sapiens
ccaatgaataatggaaaatgcca

SEQ ID NO: 1596723 - DNA, 21 bp, Homo sapiens
ccaatgagactctagggtcca

SEQ ID NO: 1596724 - DNA, 17 bp, Homo sapiens
ccaatgctttgggaggc

SEQ ID NO: 1596725 - DNA, 16 bp, Homo sapiens
ccaatggggccagcac

SEQ ID NO: 1596726 - DNA, 12 bp, Homo sapiens
ccaatggtgctt

SEQ ID NO: 1596727 - DNA, 15 bp, Homo sapiens
ccaatggtgcttccc

SEQ ID NO: 1596728 - DNA, 23 bp, Homo sapiens
ccaattctaaatccgacttgaat

SEQ ID NO: 1596729 - DNA, 18 bp, Homo sapiens
ccaattctggacagacag

SEQ ID NO: 1596730 - DNA, 13 bp, Homo sapiens
ccaattgaaaagt

SEQ ID NO: 1596731 - DNA, 14 bp, Homo sapiens
ccaattgtgctgcc

SEQ ID NO: 1596732 - DNA, 21 bp, Homo sapiens
ccaattgttgacagttctgaa

SEQ ID NO: 1596733 - DNA, 22 bp, Homo sapiens
ccaattgttgacagttctgaag

SEQ ID NO: 1596734 - DNA, 13 bp, Homo sapiens
ccaatttcctctc

SEQ ID NO: 1596735 - DNA, 15 bp, Homo sapiens
ccaatttcctctcca

SEQ ID NO: 1596736 - DNA, 20 bp, Homo sapiens
ccaatttggtaaaaatgctg

SEQ ID NO: 1596737 - DNA, 23 bp, Homo sapiens
ccaatttggtaaaaatgctgctc

SEQ ID NO: 1596738 - DNA, 18 bp, Homo sapiens
ccaattttgatcttttta

SEQ ID NO: 1596739 - DNA, 15 bp, Homo sapiens
ccacaaaaaatactt

SEQ ID NO: 1596740 - DNA, 15 bp, Homo sapiens
ccacaaacggagccc

SEQ ID NO: 1596741 - DNA, 23 bp, Homo sapiens
ccacaaacggagcccctgaaagc

SEQ ID NO: 1596742 - DNA, 22 bp, Homo sapiens
ccacaaagctaggatggttctg

SEQ ID NO: 1596743 - DNA, 17 bp, Homo sapiens
ccacaaataaatgacaa

SEQ ID NO: 1596744 - DNA, 19 bp, Homo sapiens
ccacaaatcaaagcaaggg

SEQ ID NO: 1596745 - DNA, 20 bp, Homo sapiens
ccacaaatcaaagcaagggc

SEQ ID NO: 1596746 - DNA, 19 bp, Homo sapiens
ccacaacatgaaaactcca

SEQ ID NO: 1596747 - DNA, 16 bp, Homo sapiens
ccacaagattcccaga

SEQ ID NO: 1596748 - DNA, 17 bp, Homo sapiens
ccacaagattcccagag

SEQ ID NO: 1596749 - DNA, 20 bp, Homo sapiens
ccacaagattcccagagaca

SEQ ID NO: 1596750 - DNA, 24 bp, Homo sapiens
ccacaagattcccagagacaggaa

SEQ ID NO: 1596751 - DNA, 15 bp, Homo sapiens
ccacaagcctgagaa

SEQ ID NO: 1596752 - DNA, 17 bp, Homo sapiens
ccacaagcctgagaact

SEQ ID NO: 1596753 - DNA, 23 bp, Homo sapiens
ccacaagcctgagaactgaattt

SEQ ID NO: 1596754 - DNA, 15 bp, Homo sapiens
ccacaagctgcactg

SEQ ID NO: 1596755 - DNA, 18 bp, Homo sapiens
ccacaagctgcactgtga

SEQ ID NO: 1596756 - DNA, 21 bp, Homo sapiens
ccacaagctgcactgtgaacc

SEQ ID NO: 1596757 - DNA, 21 bp, Homo sapiens
ccacaagctgtccctgcaggg

SEQ ID NO: 1596758 - DNA, 18 bp, Homo sapiens
ccacaaggggcttttccc

SEQ ID NO: 1596759 - DNA, 22 bp, Homo sapiens
ccacaagtcttccagaggatgc

SEQ ID NO: 1596760 - DNA, 20 bp, Homo sapiens
ccacaatctggcttagtgcc

SEQ ID NO: 1596761 - DNA, 17 bp, Homo sapiens
ccacacaacaccaggac

SEQ ID NO: 1596762 - DNA, 19 bp, Homo sapiens
ccacacactttccatctct

SEQ ID NO: 1596763 - DNA, 20 bp, Homo sapiens
ccacacactttccatctctg

SEQ ID NO: 1596764 - DNA, 16 bp, Homo sapiens
ccacacagcagtgtcc

SEQ ID NO: 1596765 - DNA, 15 bp, Homo sapiens
ccacacagctgccct

SEQ ID NO: 1596766 - DNA, 21 bp, Homo sapiens
ccacacagctgccctagctga

SEQ ID NO: 1596767 - DNA, 14 bp, Homo sapiens
ccacacccagcggc

SEQ ID NO: 1596768 - DNA, 15 bp, Homo sapiens
ccacacccagcggcc

SEQ ID NO: 1596769 - DNA, 19 bp, Homo sapiens
ccacaccccaacacttcca

SEQ ID NO: 1596770 - DNA, 18 bp, Homo sapiens
ccacaccctctcccagga

SEQ ID NO: 1596771 - DNA, 16 bp, Homo sapiens
ccacaccctgtactgt

SEQ ID NO: 1596772 - DNA, 19 bp, Homo sapiens
ccacaccctgtactgttct

SEQ ID NO: 1596773 - DNA, 15 bp, Homo sapiens
ccacaccgcagaagc

SEQ ID NO: 1596774 - DNA, 22 bp, Homo sapiens
ccacaccgctggtccctgccct

SEQ ID NO: 1596775 - DNA, 15 bp, Homo sapiens
ccacacctccctact

SEQ ID NO: 1596776 - DNA, 17 bp, Homo sapiens
ccacacctccctgaacc

SEQ ID NO: 1596777 - DNA, 18 bp, Homo sapiens
ccacacctgaacttgcct

SEQ ID NO: 1596778 - DNA, 13 bp, Homo sapiens
ccacacctgcctg

SEQ ID NO: 1596779 - DNA, 13 bp, Homo sapiens
ccacacctggtgg

SEQ ID NO: 1596780 - DNA, 14 bp, Homo sapiens
ccacactcagtccc

SEQ ID NO: 1596781 - DNA, 12 bp, Homo sapiens
ccacactccact

SEQ ID NO: 1596782 - DNA, 13 bp, Homo sapiens
ccacactccactg

SEQ ID NO: 1596783 - DNA, 15 bp, Homo sapiens
ccacactcccaaggt

SEQ ID NO: 1596784 - DNA, 14 bp, Homo sapiens
ccacactgaccaag

SEQ ID NO: 1596785 - DNA, 23 bp, Homo sapiens
ccacactgaggcttaggcctctc

SEQ ID NO: 1596786 - DNA, 13 bp, Homo sapiens
ccacactgggcct

SEQ ID NO: 1596787 - DNA, 15 bp, Homo sapiens
ccacactgggcctgg

SEQ ID NO: 1596788 - DNA, 16 bp, Homo sapiens
ccacactgggcctgga

SEQ ID NO: 1596789 - DNA, 21 bp, Homo sapiens
ccacacttcaggctcttctcc

SEQ ID NO: 1596790 - DNA, 12 bp, Homo sapiens
ccacactttgaa

SEQ ID NO: 1596791 - DNA, 20 bp, Homo sapiens
ccacagaaccttcaacccag

SEQ ID NO: 1596792 - DNA, 18 bp, Homo sapiens
ccacagaactgcttacta

SEQ ID NO: 1596793 - DNA, 15 bp, Homo sapiens
ccacagacacacaca

SEQ ID NO: 1596794 - DNA, 20 bp, Homo sapiens
ccacagaccacctgcttctg

SEQ ID NO: 1596795 - DNA, 23 bp, Homo sapiens
ccacagacgggcacacagactgg

SEQ ID NO: 1596796 - DNA, 11 bp, Homo sapiens
ccacagactga

SEQ ID NO: 1596797 - DNA, 16 bp, Homo sapiens
ccacagactggttttg

SEQ ID NO: 1596798 - DNA, 21 bp, Homo sapiens
ccacagacttgcactgaagcc

SEQ ID NO: 1596799 - DNA, 21 bp, Homo sapiens
ccacagagagggagagcagag

SEQ ID NO: 1596800 - DNA, 12 bp, Homo sapiens
ccacagagcaaa

SEQ ID NO: 1596801 - DNA, 15 bp, Homo sapiens
ccacagagcaggaag

SEQ ID NO: 1596802 - DNA, 21 bp, Homo sapiens
ccacagcaggatcgaagggtt

SEQ ID NO: 1596803 - DNA, 17 bp, Homo sapiens
ccacagcagttgaaaag

SEQ ID NO: 1596804 - DNA, 18 bp, Homo sapiens
ccacagcagttgaaaaga

SEQ ID NO: 1596805 - DNA, 17 bp, Homo sapiens
ccacagccagcacctgg

SEQ ID NO: 1596806 - DNA, 20 bp, Homo sapiens
ccacagcccagccacggacg

SEQ ID NO: 1596807 - DNA, 22 bp, Homo sapiens
ccacagcccccttgccctccgc

SEQ ID NO: 1596808 - DNA, 15 bp, Homo sapiens
ccacagcctccttct

SEQ ID NO: 1596809 - DNA, 15 bp, Homo sapiens
ccacagcgagggcag

SEQ ID NO: 1596810 - DNA, 20 bp, Homo sapiens
ccacagcgagggcagctgct

SEQ ID NO: 1596811 - DNA, 21 bp, Homo sapiens
ccacagcgagggcagctgcta

SEQ ID NO: 1596812 - DNA, 18 bp, Homo sapiens
ccacagcggaggagacca

SEQ ID NO: 1596813 - DNA, 21 bp, Homo sapiens
ccacagcggaggagaccagct

SEQ ID NO: 1596814 - DNA, 22 bp, Homo sapiens
ccacagcggaggagaccagctc

SEQ ID NO: 1596815 - DNA, 12 bp, Homo sapiens
ccacagcgtccc

SEQ ID NO: 1596816 - DNA, 15 bp, Homo sapiens
ccacagctcagctgc

SEQ ID NO: 1596817 - DNA, 17 bp, Homo sapiens
ccacagctcagctgccc

SEQ ID NO: 1596818 - DNA, 19 bp, Homo sapiens
ccacagctcccaccccacc

SEQ ID NO: 1596819 - DNA, 12 bp, Homo sapiens
ccacagctgcag

SEQ ID NO: 1596820 - DNA, 15 bp, Homo sapiens
ccacagctgcagctg

SEQ ID NO: 1596821 - DNA, 16 bp, Homo sapiens
ccacagctgccctggc

SEQ ID NO: 1596822 - DNA, 13 bp, Homo sapiens
ccacagctggaaa

SEQ ID NO: 1596823 - DNA, 13 bp, Homo sapiens
ccacagctgggca

SEQ ID NO: 1596824 - DNA, 19 bp, Homo sapiens
ccacaggaagcctgcagtc

SEQ ID NO: 1596825 - DNA, 23 bp, Homo sapiens
ccacaggaagcctgcagtcctgg

SEQ ID NO: 1596826 - DNA, 16 bp, Homo sapiens
ccacaggaagctcagc

SEQ ID NO: 1596827 - DNA, 15 bp, Homo sapiens
ccacaggcagcccag

SEQ ID NO: 1596828 - DNA, 23 bp, Homo sapiens
aaatccatatcttaaagaaacag

SEQ ID NO: 1596829 - DNA, 21 bp, Homo sapiens
aaatccattttctaaactgtt

SEQ ID NO: 1596830 - DNA, 16 bp, Homo sapiens
aaatcccaccttccca

SEQ ID NO: 1596831 - DNA, 20 bp, Homo sapiens
aaatccccttcgctgaaatt

SEQ ID NO: 1596832 - DNA, 22 bp, Homo sapiens
aaatcctattctgatgaatctc

SEQ ID NO: 1596833 - DNA, 19 bp, Homo sapiens
aaatcctcaacactattgt

SEQ ID NO: 1596834 - DNA, 18 bp, Homo sapiens
aaatcctgccatttaaaa

SEQ ID NO: 1596835 - DNA, 18 bp, Homo sapiens
ccaccccatccagccaga

SEQ ID NO: 1596836 - DNA, 16 bp, Homo sapiens
ccacccccagctcaat

SEQ ID NO: 1596837 - DNA, 9 bp, Homo sapiens
ccacccccc

SEQ ID NO: 1596838 - DNA, 19 bp, Homo sapiens
ccacccccgaccctgccct

SEQ ID NO: 1596839 - DNA, 16 bp, Homo sapiens
ccacccccgccacggc

SEQ ID NO: 1596840 - DNA, 21 bp, Homo sapiens
ccacccccgccacggccaccc

SEQ ID NO: 1596841 - DNA, 14 bp, Homo sapiens
ccacccccgccatg

SEQ ID NO: 1596842 - DNA, 19 bp, Homo sapiens
ccaccccctccccaaagcc

SEQ ID NO: 1596843 - DNA, 17 bp, Homo sapiens
ccaccccctccccaggg

SEQ ID NO: 1596844 - DNA, 13 bp, Homo sapiens
ccaccccctgccc

SEQ ID NO: 1596845 - DNA, 20 bp, Homo sapiens
ccacccccttctctgctcca

SEQ ID NO: 1596846 - DNA, 15 bp, Homo sapiens
ccaccccggcctcca

SEQ ID NO: 1596847 - DNA, 17 bp, Homo sapiens
ccaccccgggctctctg

SEQ ID NO: 1596848 - DNA, 21 bp, Homo sapiens
ccacccctacagcctgcacac

SEQ ID NO: 1596849 - DNA, 11 bp, Homo sapiens
ccacccctcac

SEQ ID NO: 1596850 - DNA, 21 bp, Homo sapiens
ccacccctcactccccaggga

SEQ ID NO: 1596851 - DNA, 21 bp, Homo sapiens
ccacccctccacgtgtccgtc

SEQ ID NO: 1596852 - DNA, 13 bp, Homo sapiens
ccacccctgccca

SEQ ID NO: 1596853 - DNA, 13 bp, Homo sapiens
ccacccctgcccc

SEQ ID NO: 1596854 - DNA, 15 bp, Homo sapiens
ccacccctgtgctcc

SEQ ID NO: 1596855 - DNA, 16 bp, Homo sapiens
ccaccccttccccagg

SEQ ID NO: 1596856 - DNA, 13 bp, Homo sapiens
ccaccccttcctc

SEQ ID NO: 1596857 - DNA, 22 bp, Homo sapiens
ccaccccttggaggagagagac

SEQ ID NO: 1596858 - DNA, 13 bp, Homo sapiens
ccacccgatgctg

SEQ ID NO: 1596859 - DNA, 14 bp, Homo sapiens
ccacccgatgctgc

SEQ ID NO: 1596860 - DNA, 16 bp, Homo sapiens
ccacccgatgctgctt

SEQ ID NO: 1596861 - DNA, 16 bp, Homo sapiens
ccacccgcctgcagag

SEQ ID NO: 1596862 - DNA, 16 bp, Homo sapiens
ccacccgggggagccc

SEQ ID NO: 1596863 - DNA, 16 bp, Homo sapiens
ccacccgtaggcagcc

SEQ ID NO: 1596864 - DNA, 19 bp, Homo sapiens
ccacccgtaggcagcctct

SEQ ID NO: 1596865 - DNA, 21 bp, Homo sapiens
ccaccctagccaatgtctcct

SEQ ID NO: 1596866 - DNA, 12 bp, Homo sapiens
ccaccctcccta

SEQ ID NO: 1596867 - DNA, 13 bp, Homo sapiens
ccaccctgagccg

SEQ ID NO: 1596868 - DNA, 15 bp, Homo sapiens
ccaccctgagccggc

SEQ ID NO: 1596869 - DNA, 20 bp, Homo sapiens
ccaccctgagttgcttttca

SEQ ID NO: 1596870 - DNA, 11 bp, Homo sapiens
ccaccctgcat

SEQ ID NO: 1596871 - DNA, 24 bp, Homo sapiens
ccaccctgcattttcctcttgtcc

SEQ ID NO: 1596872 - DNA, 14 bp, Homo sapiens
ccaccctgctgctg

SEQ ID NO: 1596873 - DNA, 15 bp, Homo sapiens
ccaccctgctgctgg

SEQ ID NO: 1596874 - DNA, 21 bp, Homo sapiens
ccaccctgctgctggtgcaca

SEQ ID NO: 1596875 - DNA, 13 bp, Homo sapiens
ccaccctggcccg

SEQ ID NO: 1596876 - DNA, 13 bp, Homo sapiens
ccaccctgggccc

SEQ ID NO: 1596877 - DNA, 15 bp, Homo sapiens
ccaccctgggccctg

SEQ ID NO: 1596878 - DNA, 18 bp, Homo sapiens
ccaccctgggctccacac

SEQ ID NO: 1596879 - DNA, 20 bp, Homo sapiens
ccacccttggaggctgtctt

SEQ ID NO: 1596880 - DNA, 13 bp, Homo sapiens
ccacccttggcct

SEQ ID NO: 1596881 - DNA, 18 bp, Homo sapiens
ccaccgaagccgcctgtg

SEQ ID NO: 1596882 - DNA, 15 bp, Homo sapiens
ccaccgaccaactgc

SEQ ID NO: 1596883 - DNA, 16 bp, Homo sapiens
ccaccgaccaactgcc

SEQ ID NO: 1596884 - DNA, 19 bp, Homo sapiens
ccaccgcagcgtcccccgc

SEQ ID NO: 1596885 - DNA, 12 bp, Homo sapiens
ccaccgcagggg

SEQ ID NO: 1596886 - DNA, 22 bp, Homo sapiens
ccaccgcaggggactgtctcag

SEQ ID NO: 1596887 - DNA, 13 bp, Homo sapiens
ccaccgcccagag

SEQ ID NO: 1596888 - DNA, 13 bp, Homo sapiens
ccaccgctgccta

SEQ ID NO: 1596889 - DNA, 21 bp, Homo sapiens
ccaccgctgcctaagtggctg

SEQ ID NO: 1596890 - DNA, 21 bp, Homo sapiens
ccaccggaggtcactccacca

SEQ ID NO: 1596891 - DNA, 14 bp, Homo sapiens
ccaccggcctgtgg

SEQ ID NO: 1596892 - DNA, 23 bp, Homo sapiens
ccaccggcctgtgggtctctgaa

SEQ ID NO: 1596893 - DNA, 14 bp, Homo sapiens
ccaccgtccgccct

SEQ ID NO: 1596894 - DNA, 15 bp, Homo sapiens
ccaccgtccgccctg

SEQ ID NO: 1596895 - DNA, 19 bp, Homo sapiens
ccaccgtgggcagtgccac

SEQ ID NO: 1596896 - DNA, 22 bp, Homo sapiens
ccaccgttaggattcaggcagc

SEQ ID NO: 1596897 - DNA, 15 bp, Homo sapiens
ccacctacacaggag

SEQ ID NO: 1596898 - DNA, 16 bp, Homo sapiens
ccacctacacaggagt

SEQ ID NO: 1596899 - DNA, 13 bp, Homo sapiens
ccacctacccagc

SEQ ID NO: 1596900 - DNA, 15 bp, Homo sapiens
ccacctacccagctg

SEQ ID NO: 1596901 - DNA, 19 bp, Homo sapiens
ccacctagaacactaactc

SEQ ID NO: 1596902 - DNA, 23 bp, Homo sapiens
ccacctagaagtctccctgcaca

SEQ ID NO: 1596903 - DNA, 21 bp, Homo sapiens
ccacctagactgtaaacctct

SEQ ID NO: 1596904 - DNA, 16 bp, Homo sapiens
ccacctaggccactcc

SEQ ID NO: 1596905 - DNA, 11 bp, Homo sapiens
ccacctatgcc

SEQ ID NO: 1596906 - DNA, 12 bp, Homo sapiens
ccacctcacagc

SEQ ID NO: 1596907 - DNA, 10 bp, Homo sapiens
ccacctcagc

SEQ ID NO: 1596908 - DNA, 16 bp, Homo sapiens
ccacctcagccttgga

SEQ ID NO: 1596909 - DNA, 14 bp, Homo sapiens
ccacctcagggcac

SEQ ID NO: 1596910 - DNA, 16 bp, Homo sapiens
ccacctcagggcacgc

SEQ ID NO: 1596911 - DNA, 18 bp, Homo sapiens
ccacctcatcactggact

SEQ ID NO: 1596912 - DNA, 22 bp, Homo sapiens
ccacctcatcactggactgcat

SEQ ID NO: 1596913 - DNA, 22 bp, Homo sapiens
ccacctccacccccgccacggc

SEQ ID NO: 1596914 - DNA, 23 bp, Homo sapiens
ccacctccacccccgccacggcc

SEQ ID NO: 1596915 - DNA, 13 bp, Homo sapiens
ccacctcccactc

SEQ ID NO: 1596916 - DNA, 18 bp, Homo sapiens
ccacctcccactcctgct

SEQ ID NO: 1596917 - DNA, 19 bp, Homo sapiens
ccacctcccactcctgctg

SEQ ID NO: 1596918 - DNA, 13 bp, Homo sapiens
ccacctcctcccc

SEQ ID NO: 1596919 - DNA, 20 bp, Homo sapiens
ccacctcctccccctgttct

SEQ ID NO: 1596920 - DNA, 14 bp, Homo sapiens
ccacctcggcctcc

SEQ ID NO: 1596921 - DNA, 15 bp, Homo sapiens
ccacctcggcctccc

SEQ ID NO: 1596922 - DNA, 13 bp, Homo sapiens
ccacctctccaag

SEQ ID NO: 1596923 - DNA, 14 bp, Homo sapiens
ccacctctccaagg

SEQ ID NO: 1596924 - DNA, 16 bp, Homo sapiens
ccacctctccaagggc

SEQ ID NO: 1596925 - DNA, 14 bp, Homo sapiens
ccacctctgcctct

SEQ ID NO: 1596926 - DNA, 14 bp, Homo sapiens
ccacctctgtgggc

SEQ ID NO: 1596927 - DNA, 21 bp, Homo sapiens
ccacctgacaatggcagctag

SEQ ID NO: 1596928 - DNA, 20 bp, Homo sapiens
ccacctgaggtgggcccagg

SEQ ID NO: 1596929 - DNA, 17 bp, Homo sapiens
ccacctgcatctggggc

SEQ ID NO: 1596930 - DNA, 21 bp, Homo sapiens
ccacctgccacccccttccct

SEQ ID NO: 1596931 - DNA, 14 bp, Homo sapiens
ccacctgcccatca

SEQ ID NO: 1596932 - DNA, 16 bp, Homo sapiens
ccacctgcccatcaca

SEQ ID NO: 1596933 - DNA, 15 bp, Homo sapiens
ccacctgcctggtgc

SEQ ID NO: 1596934 - DNA, 13 bp, Homo sapiens
ccacctgcttctg

SEQ ID NO: 1596935 - DNA, 14 bp, Homo sapiens
ccacctgcttctga

SEQ ID NO: 1596936 - DNA, 11 bp, Homo sapiens
ccacctggaga

SEQ ID NO: 1596937 - DNA, 23 bp, Homo sapiens
ccacctggatctatccctgcggc

SEQ ID NO: 1596938 - DNA, 11 bp, Homo sapiens
ccacctggcaa

SEQ ID NO: 1596939 - DNA, 18 bp, Homo sapiens
ccacctggccacctgagg

SEQ ID NO: 1596940 - DNA, 21 bp, Homo sapiens
ccacctggtactgacccagga

SEQ ID NO: 1596941 - DNA, 12 bp, Homo sapiens
ccacctgtctca

SEQ ID NO: 1596942 - DNA, 20 bp, Homo sapiens
ccacctgtctcagcctccca

SEQ ID NO: 1596943 - DNA, 19 bp, Homo sapiens
ccacctgttaaaatgtaca

SEQ ID NO: 1596944 - DNA, 13 bp, Homo sapiens
catccgtttttta

SEQ ID NO: 1596945 - DNA, 15 bp, Homo sapiens
catcctaccctcggg

SEQ ID NO: 1596946 - DNA, 23 bp, Homo sapiens
catcctaccctcgggcccacctg

SEQ ID NO: 1596947 - DNA, 14 bp, Homo sapiens
catcctcaaagaaa

SEQ ID NO: 1596948 - DNA, 20 bp, Homo sapiens
catcctcatccctgactggc

SEQ ID NO: 1596949 - DNA, 21 bp, Homo sapiens
catcctcattgcctcctgttc

SEQ ID NO: 1596950 - DNA, 20 bp, Homo sapiens
catcctccgtccagccgcca

SEQ ID NO: 1596951 - DNA, 12 bp, Homo sapiens
catcctgagcca

SEQ ID NO: 1596952 - DNA, 15 bp, Homo sapiens
catcctggcccctcc

SEQ ID NO: 1596953 - DNA, 14 bp, Homo sapiens
catcctggcctggc

SEQ ID NO: 1596954 - DNA, 19 bp, Homo sapiens
catcctggggcagcactcc

SEQ ID NO: 1596955 - DNA, 15 bp, Homo sapiens
catcctgtgtttcta

SEQ ID NO: 1596956 - DNA, 17 bp, Homo sapiens
catcctgtttgtatgaa

SEQ ID NO: 1596957 - DNA, 22 bp, Homo sapiens
catccttcaagaactctgggct

SEQ ID NO: 1596958 - DNA, 20 bp, Homo sapiens
catccttcaccagagcccat

SEQ ID NO: 1596959 - DNA, 12 bp, Homo sapiens
catccttcccca

SEQ ID NO: 1596960 - DNA, 15 bp, Homo sapiens
catccttccccaact

SEQ ID NO: 1596961 - DNA, 13 bp, Homo sapiens
catccttcccttt

SEQ ID NO: 1596962 - DNA, 13 bp, Homo sapiens
catccttcctggg

SEQ ID NO: 1596963 - DNA, 15 bp, Homo sapiens
catccttccttccca

SEQ ID NO: 1596964 - DNA, 17 bp, Homo sapiens
catccttccttcccacc

SEQ ID NO: 1596965 - DNA, 23 bp, Homo sapiens
catccttctgtgtaccacttcct

SEQ ID NO: 1596966 - DNA, 13 bp, Homo sapiens
catccttgtcttt

SEQ ID NO: 1596967 - DNA, 16 bp, Homo sapiens
catccttgtcttttga

SEQ ID NO: 1596968 - DNA, 20 bp, Homo sapiens
catccttgtcttttgagcta

SEQ ID NO: 1596969 - DNA, 19 bp, Homo sapiens
catcctttacgtgtttaaa

SEQ ID NO: 1596970 - DNA, 16 bp, Homo sapiens
catcgcaccattctga

SEQ ID NO: 1596971 - DNA, 18 bp, Homo sapiens
catcgcaccattctgact

SEQ ID NO: 1596972 - DNA, 19 bp, Homo sapiens
catcgcaccattctgactc

SEQ ID NO: 1596973 - DNA, 13 bp, Homo sapiens
catcgccagacaa

SEQ ID NO: 1596974 - DNA, 19 bp, Homo sapiens
catcggacaagacccccag

SEQ ID NO: 1596975 - DNA, 20 bp, Homo sapiens
catcggacaagacccccagc

SEQ ID NO: 1596976 - DNA, 18 bp, Homo sapiens
catcggaggcccatgccc

SEQ ID NO: 1596977 - DNA, 17 bp, Homo sapiens
catcggtaggcaaagga

SEQ ID NO: 1596978 - DNA, 13 bp, Homo sapiens
catcgtgaccctt

SEQ ID NO: 1596979 - DNA, 15 bp, Homo sapiens
catcgtgacccttca

SEQ ID NO: 1596980 - DNA, 22 bp, Homo sapiens
catcgtgggtcactacagggag

SEQ ID NO: 1596981 - DNA, 14 bp, Homo sapiens
catctaaaaatata

SEQ ID NO: 1596982 - DNA, 18 bp, Homo sapiens
catctaaaaatatacatg

SEQ ID NO: 1596983 - DNA, 19 bp, Homo sapiens
catctaaaaatatacatgt

SEQ ID NO: 1596984 - DNA, 21 bp, Homo sapiens
catctaaactggagtgatgtt

SEQ ID NO: 1596985 - DNA, 20 bp, Homo sapiens
catctaagttataagactct

SEQ ID NO: 1596986 - DNA, 13 bp, Homo sapiens
catctaatgaatg

SEQ ID NO: 1596987 - DNA, 13 bp, Homo sapiens
catctaattaaat

SEQ ID NO: 1596988 - DNA, 21 bp, Homo sapiens
catctaattctctgtggaatg

SEQ ID NO: 1596989 - DNA, 15 bp, Homo sapiens
catctaattctgatt

SEQ ID NO: 1596990 - DNA, 23 bp, Homo sapiens
catctaattttattttgtgaagt

SEQ ID NO: 1596991 - DNA, 19 bp, Homo sapiens
catctacaatcagttgact

SEQ ID NO: 1596992 - DNA, 16 bp, Homo sapiens
catctacacagcctgg

SEQ ID NO: 1596993 - DNA, 12 bp, Homo sapiens
catctagccagc

SEQ ID NO: 1596994 - DNA, 22 bp, Homo sapiens
catctagccagcccctcttccc

SEQ ID NO: 1596995 - DNA, 20 bp, Homo sapiens
catctatcgagtttgcaatg

SEQ ID NO: 1596996 - DNA, 13 bp, Homo sapiens
catctatctagtt

SEQ ID NO: 1596997 - DNA, 16 bp, Homo sapiens
catctatctcaatcct

SEQ ID NO: 1596998 - DNA, 13 bp, Homo sapiens
catctatctgtgc

SEQ ID NO: 1596999 - DNA, 14 bp, Homo sapiens
catctatctgtgct

SEQ ID NO: 1597000 - DNA, 20 bp, Homo sapiens
catctatggcagtccagcca

SEQ ID NO: 1597001 - DNA, 21 bp, Homo sapiens
catctatggcagtccagccag

SEQ ID NO: 1597002 - DNA, 21 bp, Homo sapiens
catctattctttgtaccatct

SEQ ID NO: 1597003 - DNA, 17 bp, Homo sapiens
catctatttcgagtgtt

SEQ ID NO: 1597004 - DNA, 17 bp, Homo sapiens
catctcaaaacaaaaca

SEQ ID NO: 1597005 - DNA, 13 bp, Homo sapiens
catctcagcccac

SEQ ID NO: 1597006 - DNA, 22 bp, Homo sapiens
catctcaggagatggagggctt

SEQ ID NO: 1597007 - DNA, 18 bp, Homo sapiens
catctcaggagatttcat

SEQ ID NO: 1597008 - DNA, 21 bp, Homo sapiens
catctcaggaggggcagcgca

SEQ ID NO: 1597009 - DNA, 18 bp, Homo sapiens
catctcagggtccagacc

SEQ ID NO: 1597010 - DNA, 19 bp, Homo sapiens
catctcaggtgccactccc

SEQ ID NO: 1597011 - DNA, 14 bp, Homo sapiens
catctcatcctggc

SEQ ID NO: 1597012 - DNA, 16 bp, Homo sapiens
catctcatcctggcac

SEQ ID NO: 1597013 - DNA, 18 bp, Homo sapiens
catctcatcctggcacgc

SEQ ID NO: 1597014 - DNA, 19 bp, Homo sapiens
catctcatgaggggagagg

SEQ ID NO: 1597015 - DNA, 14 bp, Homo sapiens
catctccatcagct

SEQ ID NO: 1597016 - DNA, 16 bp, Homo sapiens
catctccccaggcctc

SEQ ID NO: 1597017 - DNA, 17 bp, Homo sapiens
catctccccaggcctcc

SEQ ID NO: 1597018 - DNA, 18 bp, Homo sapiens
catctccccaggcctcca

SEQ ID NO: 1597019 - DNA, 22 bp, Homo sapiens
catctccccaggcctccagcct

SEQ ID NO: 1597020 - DNA, 24 bp, Homo sapiens
catctcccccatcccccactgcca

SEQ ID NO: 1597021 - DNA, 14 bp, Homo sapiens
catctcccctagct

SEQ ID NO: 1597022 - DNA, 17 bp, Homo sapiens
catctcccctagctcac

SEQ ID NO: 1597023 - DNA, 17 bp, Homo sapiens
catctcccctcctggcg

SEQ ID NO: 1597024 - DNA, 15 bp, Homo sapiens
catctccctcccaca

SEQ ID NO: 1597025 - DNA, 17 bp, Homo sapiens
catctccctcctccagg

SEQ ID NO: 1597026 - DNA, 18 bp, Homo sapiens
catctccctcctccaggt

SEQ ID NO: 1597027 - DNA, 18 bp, Homo sapiens
catctccctgcctggccc

SEQ ID NO: 1597028 - DNA, 21 bp, Homo sapiens
catctccctgcctggccccca

SEQ ID NO: 1597029 - DNA, 16 bp, Homo sapiens
catctccgcctccaca

SEQ ID NO: 1597030 - DNA, 17 bp, Homo sapiens
catctccgcctccacac

SEQ ID NO: 1597031 - DNA, 20 bp, Homo sapiens
catctccgcctccacactga

SEQ ID NO: 1597032 - DNA, 14 bp, Homo sapiens
catctcctgatttc

SEQ ID NO: 1597033 - DNA, 11 bp, Homo sapiens
catctcctgtc

SEQ ID NO: 1597034 - DNA, 17 bp, Homo sapiens
catctcctgtcctgggc

SEQ ID NO: 1597035 - DNA, 17 bp, Homo sapiens
catctccttcccccagc

SEQ ID NO: 1597036 - DNA, 21 bp, Homo sapiens
catctcgccacccctccttcc

SEQ ID NO: 1597037 - DNA, 12 bp, Homo sapiens
catctctccctc

SEQ ID NO: 1597038 - DNA, 16 bp, Homo sapiens
catctctccctcccct

SEQ ID NO: 1597039 - DNA, 20 bp, Homo sapiens
catctctccctcccctgcca

SEQ ID NO: 1597040 - DNA, 19 bp, Homo sapiens
catctctctacctccaccc

SEQ ID NO: 1597041 - DNA, 20 bp, Homo sapiens
catctctctacctccaccct

SEQ ID NO: 1597042 - DNA, 21 bp, Homo sapiens
catctctctacctccaccctg

SEQ ID NO: 1597043 - DNA, 21 bp, Homo sapiens
catctctctactcctacctca

SEQ ID NO: 1597044 - DNA, 12 bp, Homo sapiens
catctctgaagg

SEQ ID NO: 1597045 - DNA, 18 bp, Homo sapiens
catctctgtactttgctt

SEQ ID NO: 1597046 - DNA, 19 bp, Homo sapiens
catctctgtgaagcctctc

SEQ ID NO: 1597047 - DNA, 21 bp, Homo sapiens
catctcttagctcccctccaa

SEQ ID NO: 1597048 - DNA, 13 bp, Homo sapiens
catctgaaaagca

SEQ ID NO: 1597049 - DNA, 16 bp, Homo sapiens
catctgaaaagcagtt

SEQ ID NO: 1597050 - DNA, 16 bp, Homo sapiens
catctgaaagccacgt

SEQ ID NO: 1597051 - DNA, 13 bp, Homo sapiens
catctgaccatct

SEQ ID NO: 1597052 - DNA, 14 bp, Homo sapiens
catctgaccatctg

SEQ ID NO: 1597053 - DNA, 15 bp, Homo sapiens
catctgaccatctgt

SEQ ID NO: 1597054 - DNA, 13 bp, Homo sapiens
catctgactgcca

SEQ ID NO: 1597055 - DNA, 20 bp, Homo sapiens
catctgagaaacctgttgaa

SEQ ID NO: 1597056 - DNA, 21 bp, Homo sapiens
catctgaggttttatttcatt

SEQ ID NO: 1597057 - DNA, 12 bp, Homo sapiens
catctgcaaagg

SEQ ID NO: 1597058 - DNA, 17 bp, Homo sapiens
catctgcaatatgaatt

SEQ ID NO: 1597059 - DNA, 17 bp, Homo sapiens
catctgcatgtctactc

SEQ ID NO: 1597060 - DNA, 16 bp, Homo sapiens
catctgcattcctgat

SEQ ID NO: 1597061 - DNA, 21 bp, Homo sapiens
catgcctctgatatgggactg

SEQ ID NO: 1597062 - DNA, 22 bp, Homo sapiens
catgcctctgatatgggactga

SEQ ID NO: 1597063 - DNA, 23 bp, Homo sapiens
catgcctctgatatgggactgag

SEQ ID NO: 1597064 - DNA, 20 bp, Homo sapiens
catgcctgcccccctcatct

SEQ ID NO: 1597065 - DNA, 15 bp, Homo sapiens
catgcctgctccctg

SEQ ID NO: 1597066 - DNA, 23 bp, Homo sapiens
catgcctgctccctgtctgtgtc

SEQ ID NO: 1597067 - DNA, 12 bp, Homo sapiens
catgcctggccc

SEQ ID NO: 1597068 - DNA, 16 bp, Homo sapiens
catgcctggtattttc

SEQ ID NO: 1597069 - DNA, 20 bp, Homo sapiens
catgcctgtagtctcagcta

SEQ ID NO: 1597070 - DNA, 22 bp, Homo sapiens
catgcctgtagtctcagctagt

SEQ ID NO: 1597071 - DNA, 13 bp, Homo sapiens
catgcctgtctct

SEQ ID NO: 1597072 - DNA, 13 bp, Homo sapiens
catgccttccagc

SEQ ID NO: 1597073 - DNA, 20 bp, Homo sapiens
catgccttccagcaccctgc

SEQ ID NO: 1597074 - DNA, 15 bp, Homo sapiens
catgcgcagaggcca

SEQ ID NO: 1597075 - DNA, 17 bp, Homo sapiens
catgcgcagaggccagt

SEQ ID NO: 1597076 - DNA, 21 bp, Homo sapiens
catgcgccccctccgccctgc

SEQ ID NO: 1597077 - DNA, 13 bp, Homo sapiens
catgcgcgctgtg

SEQ ID NO: 1597078 - DNA, 15 bp, Homo sapiens
catgcgtcaggggcc

SEQ ID NO: 1597079 - DNA, 14 bp, Homo sapiens
catgctactaaatt

SEQ ID NO: 1597080 - DNA, 17 bp, Homo sapiens
catgctatatatctttt

SEQ ID NO: 1597081 - DNA, 12 bp, Homo sapiens
catgctatgttc

SEQ ID NO: 1597082 - DNA, 17 bp, Homo sapiens
catgctcaaccactgtg

SEQ ID NO: 1597083 - DNA, 18 bp, Homo sapiens
catgctcaaccactgtgg

SEQ ID NO: 1597084 - DNA, 22 bp, Homo sapiens
catgctcacacattacaacagt

SEQ ID NO: 1597085 - DNA, 12 bp, Homo sapiens
catgctcagcct

SEQ ID NO: 1597086 - DNA, 13 bp, Homo sapiens
catgctcagcctt

SEQ ID NO: 1597087 - DNA, 18 bp, Homo sapiens
catgctcagccttgctgc

SEQ ID NO: 1597088 - DNA, 21 bp, Homo sapiens
catgctcagccttgctgctct

SEQ ID NO: 1597089 - DNA, 18 bp, Homo sapiens
catgctcatctgctggtc

SEQ ID NO: 1597090 - DNA, 15 bp, Homo sapiens
catgctccagggtca

SEQ ID NO: 1597091 - DNA, 18 bp, Homo sapiens
catgctccagggtcaggc

SEQ ID NO: 1597092 - DNA, 21 bp, Homo sapiens
catgctctctgcagccagccc

SEQ ID NO: 1597093 - DNA, 13 bp, Homo sapiens
catgctctgcccc

SEQ ID NO: 1597094 - DNA, 19 bp, Homo sapiens
catgctctgccccaagccc

SEQ ID NO: 1597095 - DNA, 12 bp, Homo sapiens
catgctctggaa

SEQ ID NO: 1597096 - DNA, 17 bp, Homo sapiens
catgctctggaagcctg

SEQ ID NO: 1597097 - DNA, 21 bp, Homo sapiens
catgctctggaagcctggact

SEQ ID NO: 1597098 - DNA, 13 bp, Homo sapiens
catgctgaatgcc

SEQ ID NO: 1597099 - DNA, 22 bp, Homo sapiens
catgctgaatgccccctgctta

SEQ ID NO: 1597100 - DNA, 16 bp, Homo sapiens
catgctgaggcctggg

SEQ ID NO: 1597101 - DNA, 17 bp, Homo sapiens
catgctgctggggaaga

SEQ ID NO: 1597102 - DNA, 22 bp, Homo sapiens
catgctgctggggaagacagtg

SEQ ID NO: 1597103 - DNA, 12 bp, Homo sapiens
catgctgctttg

SEQ ID NO: 1597104 - DNA, 19 bp, Homo sapiens
catgctgctttttggcaca

SEQ ID NO: 1597105 - DNA, 20 bp, Homo sapiens
catgctgctttttggcacag

SEQ ID NO: 1597106 - DNA, 16 bp, Homo sapiens
catgctggagggaggc

SEQ ID NO: 1597107 - DNA, 20 bp, Homo sapiens
catgctggggcaagtccctg

SEQ ID NO: 1597108 - DNA, 13 bp, Homo sapiens
catgctgtgctct

SEQ ID NO: 1597109 - DNA, 19 bp, Homo sapiens
catgctgtgctctttgaag

SEQ ID NO: 1597110 - DNA, 13 bp, Homo sapiens
catgcttaaattt

SEQ ID NO: 1597111 - DNA, 14 bp, Homo sapiens
catgcttaaatttt

SEQ ID NO: 1597112 - DNA, 21 bp, Homo sapiens
catgcttagtcactgcctgca

SEQ ID NO: 1597113 - DNA, 14 bp, Homo sapiens
catgcttcctttct

SEQ ID NO: 1597114 - DNA, 18 bp, Homo sapiens
catgcttcctttctctcc

SEQ ID NO: 1597115 - DNA, 19 bp, Homo sapiens
catgcttcctttctctcct

SEQ ID NO: 1597116 - DNA, 20 bp, Homo sapiens
catgcttcctttctctcctg

SEQ ID NO: 1597117 - DNA, 21 bp, Homo sapiens
catgcttcctttctctcctgg

SEQ ID NO: 1597118 - DNA, 22 bp, Homo sapiens
catgcttcctttctctcctggc

SEQ ID NO: 1597119 - DNA, 23 bp, Homo sapiens
catgcttcctttctctcctggct

SEQ ID NO: 1597120 - DNA, 18 bp, Homo sapiens
catgcttgggctgaccca

SEQ ID NO: 1597121 - DNA, 19 bp, Homo sapiens
catgcttgtgaaaatgtgt

SEQ ID NO: 1597122 - DNA, 15 bp, Homo sapiens
catgctttgctgcta

SEQ ID NO: 1597123 - DNA, 15 bp, Homo sapiens
catgcttttacttta

SEQ ID NO: 1597124 - DNA, 15 bp, Homo sapiens
catgcttttctgcca

SEQ ID NO: 1597125 - DNA, 17 bp, Homo sapiens
catgcttttctgccact

SEQ ID NO: 1597126 - DNA, 16 bp, Homo sapiens
catggaaactggccag

SEQ ID NO: 1597127 - DNA, 17 bp, Homo sapiens
catggaactcattcctg

SEQ ID NO: 1597128 - DNA, 19 bp, Homo sapiens
catggaactcattcctgcc

SEQ ID NO: 1597129 - DNA, 21 bp, Homo sapiens
catggaactcattcctgcctg

SEQ ID NO: 1597130 - DNA, 18 bp, Homo sapiens
catggaagcaataaagct

SEQ ID NO: 1597131 - DNA, 18 bp, Homo sapiens
catggaaggggcttctgg

SEQ ID NO: 1597132 - DNA, 14 bp, Homo sapiens
catgagtcaaaaca

SEQ ID NO: 1597133 - DNA, 18 bp, Homo sapiens
catgagtcagatacacaa

SEQ ID NO: 1597134 - DNA, 18 bp, Homo sapiens
catgagtccttgaaaata

SEQ ID NO: 1597135 - DNA, 21 bp, Homo sapiens
catgagtccttgaaaatattt

SEQ ID NO: 1597136 - DNA, 16 bp, Homo sapiens
catgagttatcatgaa

SEQ ID NO: 1597137 - DNA, 23 bp, Homo sapiens
catgagttatcatgaattttaaa

SEQ ID NO: 1597138 - DNA, 18 bp, Homo sapiens
catgagttccagaaagta

SEQ ID NO: 1597139 - DNA, 16 bp, Homo sapiens
catgagtttaaatcaa

SEQ ID NO: 1597140 - DNA, 20 bp, Homo sapiens
catgataccacctttactgt

SEQ ID NO: 1597141 - DNA, 14 bp, Homo sapiens
catgatatgtcagg

SEQ ID NO: 1597142 - DNA, 20 bp, Homo sapiens
catgatcagacatacagctg

SEQ ID NO: 1597143 - DNA, 21 bp, Homo sapiens
catgatcagacatacagctgc

SEQ ID NO: 1597144 - DNA, 22 bp, Homo sapiens
catgatcagacatacagctgcc

SEQ ID NO: 1597145 - DNA, 22 bp, Homo sapiens
catgatccctgtgttgtctcta

SEQ ID NO: 1597146 - DNA, 16 bp, Homo sapiens
catgatctccctgccg

SEQ ID NO: 1597147 - DNA, 19 bp, Homo sapiens
catgatctccctgccgcct

SEQ ID NO: 1597148 - DNA, 14 bp, Homo sapiens
catgatgctagcca

SEQ ID NO: 1597149 - DNA, 19 bp, Homo sapiens
catgatggagcgcacctgc

SEQ ID NO: 1597150 - DNA, 15 bp, Homo sapiens
catgatggcaacaga

SEQ ID NO: 1597151 - DNA, 17 bp, Homo sapiens
catgatgggaaaatatt

SEQ ID NO: 1597152 - DNA, 19 bp, Homo sapiens
catgatgggaaaatatttc

SEQ ID NO: 1597153 - DNA, 23 bp, Homo sapiens
catgatgggaatagggagacagg

SEQ ID NO: 1597154 - DNA, 17 bp, Homo sapiens
catgatggtgcatgcct

SEQ ID NO: 1597155 - DNA, 22 bp, Homo sapiens
catgatggttattttcttttct

SEQ ID NO: 1597156 - DNA, 13 bp, Homo sapiens
catgatgtttgcc

SEQ ID NO: 1597157 - DNA, 21 bp, Homo sapiens
catgattatagcaactaatgt

SEQ ID NO: 1597158 - DNA, 22 bp, Homo sapiens
catgattatagcaactaatgtt

SEQ ID NO: 1597159 - DNA, 22 bp, Homo sapiens
catgattgcagaattgtttaga

SEQ ID NO: 1597160 - DNA, 16 bp, Homo sapiens
catgatttcccactgc

SEQ ID NO: 1597161 - DNA, 19 bp, Homo sapiens
catgatttcccactgcact

SEQ ID NO: 1597162 - DNA, 22 bp, Homo sapiens
catgatttcccactgcactcca

SEQ ID NO: 1597163 - DNA, 16 bp, Homo sapiens
catgatttgtcccagc

SEQ ID NO: 1597164 - DNA, 18 bp, Homo sapiens
catgatttgtcccagcct

SEQ ID NO: 1597165 - DNA, 22 bp, Homo sapiens
catgatttgtcccagcctgggg

SEQ ID NO: 1597166 - DNA, 21 bp, Homo sapiens
catgattttaagtttctctgc

SEQ ID NO: 1597167 - DNA, 17 bp, Homo sapiens
catgcaagcagaggacc

SEQ ID NO: 1597168 - DNA, 22 bp, Homo sapiens
catgcaagcagaggaccagggc

SEQ ID NO: 1597169 - DNA, 14 bp, Homo sapiens
catgcaatttgaag

SEQ ID NO: 1597170 - DNA, 13 bp, Homo sapiens
catgcacacagat

SEQ ID NO: 1597171 - DNA, 12 bp, Homo sapiens
catgcacactca

SEQ ID NO: 1597172 - DNA, 19 bp, Homo sapiens
catgcacactcatgtgcaa

SEQ ID NO: 1597173 - DNA, 19 bp, Homo sapiens
catgcacagctgcttgtcc

SEQ ID NO: 1597174 - DNA, 20 bp, Homo sapiens
catgcacagtatttgtaatt

SEQ ID NO: 1597175 - DNA, 22 bp, Homo sapiens
catgcacagtatttgtaattaa

SEQ ID NO: 1597176 - DNA, 13 bp, Homo sapiens
catgcacatttat

SEQ ID NO: 1597177 - DNA, 20 bp, Homo sapiens
catgcaccaggactggctgt

SEQ ID NO: 1597178 - DNA, 22 bp, Homo sapiens
catgcaccaggactggctgtgt

SEQ ID NO: 1597179 - DNA, 19 bp, Homo sapiens
catgcactcacccctagcc

SEQ ID NO: 1597180 - DNA, 18 bp, Homo sapiens
catgcactgacccttcca

SEQ ID NO: 1597181 - DNA, 14 bp, Homo sapiens
catgcactgtgaag

SEQ ID NO: 1597182 - DNA, 20 bp, Homo sapiens
catgcactgtgaaggaccct

SEQ ID NO: 1597183 - DNA, 19 bp, Homo sapiens
catgcagacaaagccctgt

SEQ ID NO: 1597184 - DNA, 20 bp, Homo sapiens
catgcagacaaagccctgtc

SEQ ID NO: 1597185 - DNA, 19 bp, Homo sapiens
catgcagactcctcagatc

SEQ ID NO: 1597186 - DNA, 22 bp, Homo sapiens
catgcagcccatgcccacctgc

SEQ ID NO: 1597187 - DNA, 15 bp, Homo sapiens
catgcagccgtgatc

SEQ ID NO: 1597188 - DNA, 14 bp, Homo sapiens
catgcagccttggg

SEQ ID NO: 1597189 - DNA, 18 bp, Homo sapiens
catgcagccttggggcat

SEQ ID NO: 1597190 - DNA, 17 bp, Homo sapiens
catgcagctgctcccca

SEQ ID NO: 1597191 - DNA, 24 bp, Homo sapiens
catgcagctgctccccaggccacc

SEQ ID NO: 1597192 - DNA, 17 bp, Homo sapiens
catgcaggaagaggccc

SEQ ID NO: 1597193 - DNA, 20 bp, Homo sapiens
catgcaggaagaggcccact

SEQ ID NO: 1597194 - DNA, 15 bp, Homo sapiens
catgcaggaggtgga

SEQ ID NO: 1597195 - DNA, 19 bp, Homo sapiens
catgcaggtggtgggacac

SEQ ID NO: 1597196 - DNA, 22 bp, Homo sapiens
catgcaggtggtgggacactgg

SEQ ID NO: 1597197 - DNA, 19 bp, Homo sapiens
catcttcttcccttaactc

SEQ ID NO: 1597198 - DNA, 13 bp, Homo sapiens
catcttgaatcct

SEQ ID NO: 1597199 - DNA, 18 bp, Homo sapiens
catcttgaatccttccat

SEQ ID NO: 1597200 - DNA, 16 bp, Homo sapiens
catcttgcctccaggt

SEQ ID NO: 1597201 - DNA, 18 bp, Homo sapiens
catcttgcctccaggtgc

SEQ ID NO: 1597202 - DNA, 23 bp, Homo sapiens
catcttgcctccaggtgcagagg

SEQ ID NO: 1597203 - DNA, 12 bp, Homo sapiens
catcttgctacc

SEQ ID NO: 1597204 - DNA, 16 bp, Homo sapiens
catcttgctaccagta

SEQ ID NO: 1597205 - DNA, 17 bp, Homo sapiens
catcttgctaccagtat

SEQ ID NO: 1597206 - DNA, 16 bp, Homo sapiens
catcttggaactgcat

SEQ ID NO: 1597207 - DNA, 11 bp, Homo sapiens
catcttggggg

SEQ ID NO: 1597208 - DNA, 15 bp, Homo sapiens
catcttgtggggcca

SEQ ID NO: 1597209 - DNA, 12 bp, Homo sapiens
catctttcacat

SEQ ID NO: 1597210 - DNA, 13 bp, Homo sapiens
catctttcacatt

SEQ ID NO: 1597211 - DNA, 23 bp, Homo sapiens
catctttcaccaagatgggtggc

SEQ ID NO: 1597212 - DNA, 14 bp, Homo sapiens
catctttctttgga

SEQ ID NO: 1597213 - DNA, 23 bp, Homo sapiens
catctttgatccttctgagctcc

SEQ ID NO: 1597214 - DNA, 17 bp, Homo sapiens
catctttgccttgggct

SEQ ID NO: 1597215 - DNA, 17 bp, Homo sapiens
catctttgcgaaaagat

SEQ ID NO: 1597216 - DNA, 20 bp, Homo sapiens
catctttgttacttccttat

SEQ ID NO: 1597217 - DNA, 21 bp, Homo sapiens
catcttttatagacgctcttt

SEQ ID NO: 1597218 - DNA, 15 bp, Homo sapiens
catcttttcctgatg

SEQ ID NO: 1597219 - DNA, 22 bp, Homo sapiens
catcttttctaatcacagtgtt

SEQ ID NO: 1597220 - DNA, 16 bp, Homo sapiens
catcttttcttgcctc

SEQ ID NO: 1597221 - DNA, 22 bp, Homo sapiens
catctttttctttttaacccta

SEQ ID NO: 1597222 - DNA, 18 bp, Homo sapiens
catgaaaaaaggacaatt

SEQ ID NO: 1597223 - DNA, 24 bp, Homo sapiens
catgaaaataccatttagtaagaa

SEQ ID NO: 1597224 - DNA, 13 bp, Homo sapiens
catgaaacaaagc

SEQ ID NO: 1597225 - DNA, 21 bp, Homo sapiens
catgaaacggaggcagatgga

SEQ ID NO: 1597226 - DNA, 15 bp, Homo sapiens
catgaaactgcctat

SEQ ID NO: 1597227 - DNA, 19 bp, Homo sapiens
catgaaaggttaaaaaagc

SEQ ID NO: 1597228 - DNA, 15 bp, Homo sapiens
catgaaatatgcatc

SEQ ID NO: 1597229 - DNA, 13 bp, Homo sapiens
catgaaatgtgaa

SEQ ID NO: 1597230 - DNA, 14 bp, Homo sapiens
catgaaatgtgaat

SEQ ID NO: 1597231 - DNA, 22 bp, Homo sapiens
catgaacagaaaacattctgat

SEQ ID NO: 1597232 - DNA, 23 bp, Homo sapiens
catgaacagaaaacattctgatt

SEQ ID NO: 1597233 - DNA, 16 bp, Homo sapiens
catgaacatgttcctg

SEQ ID NO: 1597234 - DNA, 18 bp, Homo sapiens
catgaactggcttgtaca

SEQ ID NO: 1597235 - DNA, 20 bp, Homo sapiens
catgaactggcttgtacatt

SEQ ID NO: 1597236 - DNA, 21 bp, Homo sapiens
catgaactggcttgtacattt

SEQ ID NO: 1597237 - DNA, 16 bp, Homo sapiens
catgaagacaggacag

SEQ ID NO: 1597238 - DNA, 13 bp, Homo sapiens
catgaagagcttg

SEQ ID NO: 1597239 - DNA, 14 bp, Homo sapiens
catgaagagcttgt

SEQ ID NO: 1597240 - DNA, 14 bp, Homo sapiens
catgaagcaggagg

SEQ ID NO: 1597241 - DNA, 15 bp, Homo sapiens
catgaagctgttgtg

SEQ ID NO: 1597242 - DNA, 14 bp, Homo sapiens
catgaaggtaaata

SEQ ID NO: 1597243 - DNA, 16 bp, Homo sapiens
catgaaggtaaataaa

SEQ ID NO: 1597244 - DNA, 17 bp, Homo sapiens
catgaagtaaattatgt

SEQ ID NO: 1597245 - DNA, 21 bp, Homo sapiens
catgaagtaaattatgtaact

SEQ ID NO: 1597246 - DNA, 18 bp, Homo sapiens
catgaagtgcacaggagc

SEQ ID NO: 1597247 - DNA, 12 bp, Homo sapiens
catgaatattta

SEQ ID NO: 1597248 - DNA, 19 bp, Homo sapiens
catgaatcactgtgctcag

SEQ ID NO: 1597249 - DNA, 22 bp, Homo sapiens
catgaatcactgtgctcagcca

SEQ ID NO: 1597250 - DNA, 21 bp, Homo sapiens
catgaatcccacccacatgtg

SEQ ID NO: 1597251 - DNA, 22 bp, Homo sapiens
catgaatggtatggaactctct

SEQ ID NO: 1597252 - DNA, 14 bp, Homo sapiens
catgaatgtaaatt

SEQ ID NO: 1597253 - DNA, 16 bp, Homo sapiens
catgaatgtaaatttg

SEQ ID NO: 1597254 - DNA, 22 bp, Homo sapiens
catgaatgtaaatttgtactat

SEQ ID NO: 1597255 - DNA, 17 bp, Homo sapiens
catgaatgtatcaggaa

SEQ ID NO: 1597256 - DNA, 18 bp, Homo sapiens
catgaatgtatcaggaaa

SEQ ID NO: 1597257 - DNA, 13 bp, Homo sapiens
catgaatgtgctg

SEQ ID NO: 1597258 - DNA, 23 bp, Homo sapiens
catacagaggatgccttttctgt

SEQ ID NO: 1597259 - DNA, 13 bp, Homo sapiens
catacagctgcct

SEQ ID NO: 1597260 - DNA, 20 bp, Homo sapiens
catacattatttcttcccag

SEQ ID NO: 1597261 - DNA, 15 bp, Homo sapiens
catacattgtacgaa

SEQ ID NO: 1597262 - DNA, 17 bp, Homo sapiens
catacatttataatgtt

SEQ ID NO: 1597263 - DNA, 18 bp, Homo sapiens
cataccaggcaacctccc

SEQ ID NO: 1597264 - DNA, 19 bp, Homo sapiens
cataccaggcaacctccca

SEQ ID NO: 1597265 - DNA, 21 bp, Homo sapiens
cataccaggcaacctcccatc

SEQ ID NO: 1597266 - DNA, 22 bp, Homo sapiens
cataccaggcaacctcccatcc

SEQ ID NO: 1597267 - DNA, 18 bp, Homo sapiens
catacccaaaccaggtgg

SEQ ID NO: 1597268 - DNA, 20 bp, Homo sapiens
catacccatgcacagtacaa

SEQ ID NO: 1597269 - DNA, 13 bp, Homo sapiens
cataccctccccc

SEQ ID NO: 1597270 - DNA, 17 bp, Homo sapiens
cataccgcctcgtgcca

SEQ ID NO: 1597271 - DNA, 19 bp, Homo sapiens
cataccgcctcgtgccagc

SEQ ID NO: 1597272 - DNA, 23 bp, Homo sapiens
cataccgcctcgtgccagcagcc

SEQ ID NO: 1597273 - DNA, 24 bp, Homo sapiens
cataccgcctcgtgccagcagcct

SEQ ID NO: 1597274 - DNA, 22 bp, Homo sapiens
cataccggacttgtcacacgga

SEQ ID NO: 1597275 - DNA, 17 bp, Homo sapiens
catacctaccagtatta

SEQ ID NO: 1597276 - DNA, 18 bp, Homo sapiens
cagtgtggcctcttggct

SEQ ID NO: 1597277 - DNA, 20 bp, Homo sapiens
cagtgtgggcgctctcccta

SEQ ID NO: 1597278 - DNA, 20 bp, Homo sapiens
cagtgtggttatgttcccag

SEQ ID NO: 1597279 - DNA, 14 bp, Homo sapiens
cagtgtgtctaaat

SEQ ID NO: 1597280 - DNA, 14 bp, Homo sapiens
cagtgttattttct

SEQ ID NO: 1597281 - DNA, 20 bp, Homo sapiens
cagtgttggctgtgtgacag

SEQ ID NO: 1597282 - DNA, 22 bp, Homo sapiens
cagtgttggctgtgtgacagaa

SEQ ID NO: 1597283 - DNA, 22 bp, Homo sapiens
cagtgttgtttgtaaataagag

SEQ ID NO: 1597284 - DNA, 14 bp, Homo sapiens
cagtgtttcctttt

SEQ ID NO: 1597285 - DNA, 22 bp, Homo sapiens
cagtgttttctgggataagtaa

SEQ ID NO: 1597286 - DNA, 15 bp, Homo sapiens
cagtgttttctttga

SEQ ID NO: 1597287 - DNA, 16 bp, Homo sapiens
cagtgtttttattgct

SEQ ID NO: 1597288 - DNA, 20 bp, Homo sapiens
cagtgtttttattgctcgcc

SEQ ID NO: 1597289 - DNA, 13 bp, Homo sapiens
cagttaaagatta

SEQ ID NO: 1597290 - DNA, 19 bp, Homo sapiens
cagttaaaggttgccagca

SEQ ID NO: 1597291 - DNA, 23 bp, Homo sapiens
cagttaacacaatgtgaatttct

SEQ ID NO: 1597292 - DNA, 16 bp, Homo sapiens
cagttaactttcagaa

SEQ ID NO: 1597293 - DNA, 22 bp, Homo sapiens
cagttaactttcagaagagatg

SEQ ID NO: 1597294 - DNA, 17 bp, Homo sapiens
cagttaaggaagatcct

SEQ ID NO: 1597295 - DNA, 19 bp, Homo sapiens
cagttaatttttccaacta

SEQ ID NO: 1597296 - DNA, 18 bp, Homo sapiens
cagttacaaattataatg

SEQ ID NO: 1597297 - DNA, 19 bp, Homo sapiens
cagttacaaattataatgt

SEQ ID NO: 1597298 - DNA, 22 bp, Homo sapiens
cagttactaagaagaaaattgc

SEQ ID NO: 1597299 - DNA, 14 bp, Homo sapiens
cagttactcagccc

SEQ ID NO: 1597300 - DNA, 18 bp, Homo sapiens
cagttactcagccctggg

SEQ ID NO: 1597301 - DNA, 13 bp, Homo sapiens
cagttactctgaa

SEQ ID NO: 1597302 - DNA, 22 bp, Homo sapiens
cagttagccccagaaaatgaaa

SEQ ID NO: 1597303 - DNA, 14 bp, Homo sapiens
cagttatcaaaaag

SEQ ID NO: 1597304 - DNA, 14 bp, Homo sapiens
cagttatttctgtt

SEQ ID NO: 1597305 - DNA, 15 bp, Homo sapiens
cagttatttctgttt

SEQ ID NO: 1597306 - DNA, 13 bp, Homo sapiens
cagttcagcacca

SEQ ID NO: 1597307 - DNA, 20 bp, Homo sapiens
cagttcagctttaaaggcca

SEQ ID NO: 1597308 - DNA, 23 bp, Homo sapiens
cagttcaggagtcccaaggaaag

SEQ ID NO: 1597309 - DNA, 19 bp, Homo sapiens
cagttcatcaccatttcct

SEQ ID NO: 1597310 - DNA, 22 bp, Homo sapiens
cagttcatctatggcagtccag

SEQ ID NO: 1597311 - DNA, 22 bp, Homo sapiens
cagttcatgtatgttcagaaga

SEQ ID NO: 1597312 - DNA, 16 bp, Homo sapiens
cagttcatgtctgaaa

SEQ ID NO: 1597313 - DNA, 12 bp, Homo sapiens
cagttcccagct

SEQ ID NO: 1597314 - DNA, 16 bp, Homo sapiens
cagttcccagctcccc

SEQ ID NO: 1597315 - DNA, 15 bp, Homo sapiens
cagttcccccagtac

SEQ ID NO: 1597316 - DNA, 20 bp, Homo sapiens
cagttcccccagtacctcca

SEQ ID NO: 1597317 - DNA, 21 bp, Homo sapiens
cagttcccggagcacagccct

SEQ ID NO: 1597318 - DNA, 23 bp, Homo sapiens
cagttcccggagcacagccctgg

SEQ ID NO: 1597319 - DNA, 13 bp, Homo sapiens
cagttcccttggc

SEQ ID NO: 1597320 - DNA, 18 bp, Homo sapiens
cagttcctgtggctccct

SEQ ID NO: 1597321 - DNA, 17 bp, Homo sapiens
cagttctagtttgcatt

SEQ ID NO: 1597322 - DNA, 18 bp, Homo sapiens
cagttctagtttgcattc

SEQ ID NO: 1597323 - DNA, 16 bp, Homo sapiens
cagttctgaactggaa

SEQ ID NO: 1597324 - DNA, 14 bp, Homo sapiens
cagttctgaagaat

SEQ ID NO: 1597325 - DNA, 20 bp, Homo sapiens
cagttctttcctctttctgc

SEQ ID NO: 1597326 - DNA, 22 bp, Homo sapiens
cagttctttcctctttctgctc

SEQ ID NO: 1597327 - DNA, 16 bp, Homo sapiens
cagttctttgggccag

SEQ ID NO: 1597328 - DNA, 18 bp, Homo sapiens
cagttgaaaatggatttt

SEQ ID NO: 1597329 - DNA, 14 bp, Homo sapiens
cagttgaattttaa

SEQ ID NO: 1597330 - DNA, 14 bp, Homo sapiens
cagttgattacttc

SEQ ID NO: 1597331 - DNA, 23 bp, Homo sapiens
cagttgattatttcaactaatgt

SEQ ID NO: 1597332 - DNA, 15 bp, Homo sapiens
cagttgcaataatac

SEQ ID NO: 1597333 - DNA, 18 bp, Homo sapiens
cagttgcatgtagtaaca

SEQ ID NO: 1597334 - DNA, 23 bp, Homo sapiens
cagttgcatgtagtaacactaat

SEQ ID NO: 1597335 - DNA, 20 bp, Homo sapiens
cagttgccatgtagacccct

SEQ ID NO: 1597336 - DNA, 18 bp, Homo sapiens
cagttgccgtctaggatt

SEQ ID NO: 1597337 - DNA, 19 bp, Homo sapiens
cagttgccgtctaggattg

SEQ ID NO: 1597338 - DNA, 22 bp, Homo sapiens
cagttgccttttatcccaaagt

SEQ ID NO: 1597339 - DNA, 19 bp, Homo sapiens
cagttgctcaaaaagaaat

SEQ ID NO: 1597340 - DNA, 23 bp, Homo sapiens
cagttgctcaaaaagaaatcaat

SEQ ID NO: 1597341 - DNA, 20 bp, Homo sapiens
cagttgctctgacgtagaaa

SEQ ID NO: 1597342 - DNA, 12 bp, Homo sapiens
cagttgctgtga

SEQ ID NO: 1597343 - DNA, 14 bp, Homo sapiens
cagttgcttgtctt

SEQ ID NO: 1597344 - DNA, 15 bp, Homo sapiens
cagttggactctcag

SEQ ID NO: 1597345 - DNA, 13 bp, Homo sapiens
cagttggcagaga

SEQ ID NO: 1597346 - DNA, 15 bp, Homo sapiens
cagttgggactcagg

SEQ ID NO: 1597347 - DNA, 16 bp, Homo sapiens
cagttgggactcagga

SEQ ID NO: 1597348 - DNA, 14 bp, Homo sapiens
cagttgggagcact

SEQ ID NO: 1597349 - DNA, 15 bp, Homo sapiens
cagttgggagcactg

SEQ ID NO: 1597350 - DNA, 17 bp, Homo sapiens
cagttgggagcactgga

SEQ ID NO: 1597351 - DNA, 18 bp, Homo sapiens
cagttgggaggaggaagt

SEQ ID NO: 1597352 - DNA, 14 bp, Homo sapiens
cagttggtgatttt

SEQ ID NO: 1597353 - DNA, 23 bp, Homo sapiens
cagttgtagggttacagagacct

SEQ ID NO: 1597354 - DNA, 16 bp, Homo sapiens
cagttgtatgtttgct

SEQ ID NO: 1597355 - DNA, 21 bp, Homo sapiens
cagttgtatgtttgctgatta

SEQ ID NO: 1597356 - DNA, 17 bp, Homo sapiens
cagttgtcctatggaca

SEQ ID NO: 1597357 - DNA, 14 bp, Homo sapiens
cagttgtttgcttc

SEQ ID NO: 1597358 - DNA, 19 bp, Homo sapiens
cagtttaagtaattgccta

SEQ ID NO: 1597359 - DNA, 21 bp, Homo sapiens
cagtttaatccttctagtttc

SEQ ID NO: 1597360 - DNA, 18 bp, Homo sapiens
cagtttataccctagtta

SEQ ID NO: 1597361 - DNA, 19 bp, Homo sapiens
cagtttatggatatgctgc

SEQ ID NO: 1597362 - DNA, 21 bp, Homo sapiens
cagtttatttttaaagataga

SEQ ID NO: 1597363 - DNA, 17 bp, Homo sapiens
cagtttcacagaaaata

SEQ ID NO: 1597364 - DNA, 21 bp, Homo sapiens
cagtttcacagaaaataaggc

SEQ ID NO: 1597365 - DNA, 15 bp, Homo sapiens
cagtttcaggtgttt

SEQ ID NO: 1597366 - DNA, 17 bp, Homo sapiens
cagtttccgaatctctt

SEQ ID NO: 1597367 - DNA, 20 bp, Homo sapiens
cagtttccgaatctctttcc

SEQ ID NO: 1597368 - DNA, 14 bp, Homo sapiens
cagtttctccttga

SEQ ID NO: 1597369 - DNA, 16 bp, Homo sapiens
cagtttctccttgaaa

SEQ ID NO: 1597370 - DNA, 22 bp, Homo sapiens
cagtttcttactgttttgtatc

SEQ ID NO: 1597371 - DNA, 23 bp, Homo sapiens
cagtttcttttcacattaggctg

SEQ ID NO: 1597372 - DNA, 13 bp, Homo sapiens
cagtttgaacaaa

SEQ ID NO: 1597373 - DNA, 17 bp, Homo sapiens
cagtttgcaaaaaatgt

SEQ ID NO: 1597374 - DNA, 12 bp, Homo sapiens
cagtttgctttg

SEQ ID NO: 1597375 - DNA, 19 bp, Homo sapiens
cagtttggccctggagcca

SEQ ID NO: 1597376 - DNA, 13 bp, Homo sapiens
cagtttggttggg

SEQ ID NO: 1597377 - DNA, 20 bp, Homo sapiens
cagtttgtggcatcttgcca

SEQ ID NO: 1597378 - DNA, 16 bp, Homo sapiens
cagtttgtgtgtctta

SEQ ID NO: 1597379 - DNA, 21 bp, Homo sapiens
cagtttgtgtgtcttaattat

SEQ ID NO: 1597380 - DNA, 14 bp, Homo sapiens
cagtttgttggaaa

SEQ ID NO: 1597381 - DNA, 12 bp, Homo sapiens
cagttttaactg

SEQ ID NO: 1597382 - DNA, 14 bp, Homo sapiens
cagttttaactgtg

SEQ ID NO: 1597383 - DNA, 16 bp, Homo sapiens
cagttttaactgtgga

SEQ ID NO: 1597384 - DNA, 18 bp, Homo sapiens
cagttttaactgtggata

SEQ ID NO: 1597385 - DNA, 22 bp, Homo sapiens
cagttttaactgtggatattgt

SEQ ID NO: 1597386 - DNA, 13 bp, Homo sapiens
cagttttaagaat

SEQ ID NO: 1597387 - DNA, 17 bp, Homo sapiens
cagttttaataagaaca

SEQ ID NO: 1597388 - DNA, 18 bp, Homo sapiens
cagttttaataagaacag

SEQ ID NO: 1597389 - DNA, 22 bp, Homo sapiens
cagttttaataagaacagatca

SEQ ID NO: 1597390 - DNA, 12 bp, Homo sapiens
cagttttcataa

SEQ ID NO: 1597391 - DNA, 13 bp, Homo sapiens
cagttttccattg

SEQ ID NO: 1597392 - DNA, 13 bp, Homo sapiens
caggtcaataaac

SEQ ID NO: 1597393 - DNA, 21 bp, Homo sapiens
caggtcaataaacttagagga

SEQ ID NO: 1597394 - DNA, 11 bp, Homo sapiens
caggtcactgt

SEQ ID NO: 1597395 - DNA, 13 bp, Homo sapiens
caggtcagcctgg

SEQ ID NO: 1597396 - DNA, 16 bp, Homo sapiens
caggtcagcctggaag

SEQ ID NO: 1597397 - DNA, 21 bp, Homo sapiens
caggtcagcctggaagggaca

SEQ ID NO: 1597398 - DNA, 16 bp, Homo sapiens
caggggagatggggag

SEQ ID NO: 1597399 - DNA, 17 bp, Homo sapiens
caggggagatggggagg

SEQ ID NO: 1597400 - DNA, 18 bp, Homo sapiens
caggggagatggggagga

SEQ ID NO: 1597401 - DNA, 16 bp, Homo sapiens
caggggagccagctgc

SEQ ID NO: 1597402 - DNA, 13 bp, Homo sapiens
caggggaggagcc

SEQ ID NO: 1597403 - DNA, 14 bp, Homo sapiens
caggggaggagcct

SEQ ID NO: 1597404 - DNA, 15 bp, Homo sapiens
caggggaggagcctg

SEQ ID NO: 1597405 - DNA, 16 bp, Homo sapiens
caggggaggtgatagc

SEQ ID NO: 1597406 - DNA, 16 bp, Homo sapiens
caggggcagcaaggcc

SEQ ID NO: 1597407 - DNA, 17 bp, Homo sapiens
caggggcagcaaggcct

SEQ ID NO: 1597408 - DNA, 13 bp, Homo sapiens
caggggcagccac

SEQ ID NO: 1597409 - DNA, 15 bp, Homo sapiens
caggggcaggactga

SEQ ID NO: 1597410 - DNA, 15 bp, Homo sapiens
caggggcaggcctgg

SEQ ID NO: 1597411 - DNA, 17 bp, Homo sapiens
caggggcaggcctggga

SEQ ID NO: 1597412 - DNA, 20 bp, Homo sapiens
caggggcatgtattggcctg

SEQ ID NO: 1597413 - DNA, 23 bp, Homo sapiens
caggggcatgtattggcctggag

SEQ ID NO: 1597414 - DNA, 14 bp, Homo sapiens
caggggccccagat

SEQ ID NO: 1597415 - DNA, 15 bp, Homo sapiens
caggggccccagatc

SEQ ID NO: 1597416 - DNA, 19 bp, Homo sapiens
caggggccccagatctgcc

SEQ ID NO: 1597417 - DNA, 22 bp, Homo sapiens
caggggccccagatctgcctgg

SEQ ID NO: 1597418 - DNA, 24 bp, Homo sapiens
caggggccccagatctgcctgggc

SEQ ID NO: 1597419 - DNA, 14 bp, Homo sapiens
caggggcctggaga

SEQ ID NO: 1597420 - DNA, 13 bp, Homo sapiens
caggggcggggca

SEQ ID NO: 1597421 - DNA, 14 bp, Homo sapiens
caggggcggggcag

SEQ ID NO: 1597422 - DNA, 17 bp, Homo sapiens
caggggcgggtggatca

SEQ ID NO: 1597423 - DNA, 13 bp, Homo sapiens
caggggctctgct

SEQ ID NO: 1597424 - DNA, 20 bp, Homo sapiens
caggggctggtgggacagtg

SEQ ID NO: 1597425 - DNA, 20 bp, Homo sapiens
caggggctgtggccgtctcc

SEQ ID NO: 1597426 - DNA, 12 bp, Homo sapiens
caggggctgttt

SEQ ID NO: 1597427 - DNA, 15 bp, Homo sapiens
caggggctgtttgag

SEQ ID NO: 1597428 - DNA, 17 bp, Homo sapiens
cagggggcatgaccaga

SEQ ID NO: 1597429 - DNA, 13 bp, Homo sapiens
cagggggccctgc

SEQ ID NO: 1597430 - DNA, 17 bp, Homo sapiens
cagggggccctgcccca

SEQ ID NO: 1597431 - DNA, 20 bp, Homo sapiens
cagggggccctgccccaccc

SEQ ID NO: 1597432 - DNA, 15 bp, Homo sapiens
cagggggcctggagc

SEQ ID NO: 1597433 - DNA, 14 bp, Homo sapiens
caggggggctgtgc

SEQ ID NO: 1597434 - DNA, 17 bp, Homo sapiens
caggggggctgtgccaa

SEQ ID NO: 1597435 - DNA, 15 bp, Homo sapiens
caggggggtgaggag

SEQ ID NO: 1597436 - DNA, 18 bp, Homo sapiens
caggggggtgaggagctg

SEQ ID NO: 1597437 - DNA, 17 bp, Homo sapiens
cagggggtgaggggcag

SEQ ID NO: 1597438 - DNA, 22 bp, Homo sapiens
cagggggtgaggggcaggtcta

SEQ ID NO: 1597439 - DNA, 19 bp, Homo sapiens
caggggtcaggtgtcaggc

SEQ ID NO: 1597440 - DNA, 20 bp, Homo sapiens
caggggtcaggtgtcaggcc

SEQ ID NO: 1597441 - DNA, 14 bp, Homo sapiens
caggggtcagtgca

SEQ ID NO: 1597442 - DNA, 18 bp, Homo sapiens
caggggtcgtcaccacct

SEQ ID NO: 1597443 - DNA, 13 bp, Homo sapiens
caggggtctccct

SEQ ID NO: 1597444 - DNA, 14 bp, Homo sapiens
caggggtctccctg

SEQ ID NO: 1597445 - DNA, 15 bp, Homo sapiens
caggggtctccctgg

SEQ ID NO: 1597446 - DNA, 16 bp, Homo sapiens
caggggtgccccctcc

SEQ ID NO: 1597447 - DNA, 15 bp, Homo sapiens
caggggttggtcaag

SEQ ID NO: 1597448 - DNA, 18 bp, Homo sapiens
cagggtagacttggagct

SEQ ID NO: 1597449 - DNA, 22 bp, Homo sapiens
cagggtagacttggagctgtcc

SEQ ID NO: 1597450 - DNA, 16 bp, Homo sapiens
cagggtagcaggtacc

SEQ ID NO: 1597451 - DNA, 13 bp, Homo sapiens
cagggtaggaaag

SEQ ID NO: 1597452 - DNA, 14 bp, Homo sapiens
cagggtaggaaagg

SEQ ID NO: 1597453 - DNA, 17 bp, Homo sapiens
cagggtcaaagacagaa

SEQ ID NO: 1597454 - DNA, 19 bp, Homo sapiens
cagggtcaaagacagaatg

SEQ ID NO: 1597455 - DNA, 20 bp, Homo sapiens
cagggtcaaagacagaatgg

SEQ ID NO: 1597456 - DNA, 21 bp, Homo sapiens
cagggtcactgaaccactgct

SEQ ID NO: 1597457 - DNA, 20 bp, Homo sapiens
cagggtccacagctggaaag

SEQ ID NO: 1597458 - DNA, 18 bp, Homo sapiens
cagggtccagaccctgaa

SEQ ID NO: 1597459 - DNA, 14 bp, Homo sapiens
cagggtccttttga

SEQ ID NO: 1597460 - DNA, 23 bp, Homo sapiens
cagggtccttttgacactgctct

SEQ ID NO: 1597461 - DNA, 21 bp, Homo sapiens
cagggtctgctctttctctgc

SEQ ID NO: 1597462 - DNA, 14 bp, Homo sapiens
cagggtcttggctg

SEQ ID NO: 1597463 - DNA, 13 bp, Homo sapiens
cagggtcttgggc

SEQ ID NO: 1597464 - DNA, 19 bp, Homo sapiens
cagggtcttgggctactgg

SEQ ID NO: 1597465 - DNA, 20 bp, Homo sapiens
cagggtcttgggctactggc

SEQ ID NO: 1597466 - DNA, 18 bp, Homo sapiens
cagggtgaactgcaaagc

SEQ ID NO: 1597467 - DNA, 20 bp, Homo sapiens
cagggtgaactgcaaagctt

SEQ ID NO: 1597468 - DNA, 23 bp, Homo sapiens
cagggtgcttagttggctttgcc

SEQ ID NO: 1597469 - DNA, 18 bp, Homo sapiens
cagggtgggaagagaaga

SEQ ID NO: 1597470 - DNA, 17 bp, Homo sapiens
cagggtgggatggagga

SEQ ID NO: 1597471 - DNA, 20 bp, Homo sapiens
cagggtgggatggaggagaa

SEQ ID NO: 1597472 - DNA, 13 bp, Homo sapiens
cagggtgggcctc

SEQ ID NO: 1597473 - DNA, 20 bp, Homo sapiens
cagggtgggcctcggcccct

SEQ ID NO: 1597474 - DNA, 15 bp, Homo sapiens
cagggtggggaggga

SEQ ID NO: 1597475 - DNA, 15 bp, Homo sapiens
cagggtggggggtga

SEQ ID NO: 1597476 - DNA, 16 bp, Homo sapiens
cagggtggtgctggga

SEQ ID NO: 1597477 - DNA, 18 bp, Homo sapiens
cagggtgtggccctgcca

SEQ ID NO: 1597478 - DNA, 19 bp, Homo sapiens
cagggtgtggtatgagggg

SEQ ID NO: 1597479 - DNA, 20 bp, Homo sapiens
cagggtgtggtatgaggggg

SEQ ID NO: 1597480 - DNA, 13 bp, Homo sapiens
cagggttgggccc

SEQ ID NO: 1597481 - DNA, 16 bp, Homo sapiens
cagggttgggcccaga

SEQ ID NO: 1597482 - DNA, 14 bp, Homo sapiens
cagggttggggggt

SEQ ID NO: 1597483 - DNA, 14 bp, Homo sapiens
cagggttgtgcttt

SEQ ID NO: 1597484 - DNA, 19 bp, Homo sapiens
cagggttgtgctttctagc

SEQ ID NO: 1597485 - DNA, 16 bp, Homo sapiens
cagggtttaatagact

SEQ ID NO: 1597486 - DNA, 15 bp, Homo sapiens
cagggttttgtattc

SEQ ID NO: 1597487 - DNA, 15 bp, Homo sapiens
caggtaatatgtctt

SEQ ID NO: 1597488 - DNA, 14 bp, Homo sapiens
caggtacagaaaac

SEQ ID NO: 1597489 - DNA, 21 bp, Homo sapiens
caggtacagaaaacatgttta

SEQ ID NO: 1597490 - DNA, 14 bp, Homo sapiens
caggtacagcaaca

SEQ ID NO: 1597491 - DNA, 13 bp, Homo sapiens
caggtaccagctg

SEQ ID NO: 1597492 - DNA, 19 bp, Homo sapiens
caggtaccagctgcgcttg

SEQ ID NO: 1597493 - DNA, 17 bp, Homo sapiens
caggtacggagaagaat

SEQ ID NO: 1597494 - DNA, 18 bp, Homo sapiens
caggtagatcgcttgagc

SEQ ID NO: 1597495 - DNA, 21 bp, Homo sapiens
caggtagatcgcttgagccca

SEQ ID NO: 1597496 - DNA, 12 bp, Homo sapiens
caggtaggccct

SEQ ID NO: 1597497 - DNA, 21 bp, Homo sapiens
caggtaggcccttgtcctgcc

SEQ ID NO: 1597498 - DNA, 22 bp, Homo sapiens
caggtaggcccttgtcctgcca

SEQ ID NO: 1597499 - DNA, 18 bp, Homo sapiens
caggtatatactttgaaa

SEQ ID NO: 1597500 - DNA, 21 bp, Homo sapiens
caggtatttttattcatgtga

SEQ ID NO: 1597501 - DNA, 19 bp, Homo sapiens
caggtatttttttaaatca

SEQ ID NO: 1597502 - DNA, 22 bp, Homo sapiens
caggtatttttttaaatcaagg

SEQ ID NO: 1597503 - DNA, 23 bp, Homo sapiens
caggtatttttttaaatcaagga

SEQ ID NO: 1597504 - DNA, 21 bp, Homo sapiens
cagggagaagtagctagtagc

SEQ ID NO: 1597505 - DNA, 23 bp, Homo sapiens
cagggagacggtttccagggagg

SEQ ID NO: 1597506 - DNA, 22 bp, Homo sapiens
cagggagactgggtaggaaaga

SEQ ID NO: 1597507 - DNA, 16 bp, Homo sapiens
cagggagactttctga

SEQ ID NO: 1597508 - DNA, 17 bp, Homo sapiens
cagggagcaagacagag

SEQ ID NO: 1597509 - DNA, 17 bp, Homo sapiens
cagggagcacctgtctg

SEQ ID NO: 1597510 - DNA, 18 bp, Homo sapiens
cagggagcacctgtctgg

SEQ ID NO: 1597511 - DNA, 23 bp, Homo sapiens
cagggagcatttaatggcagcta

SEQ ID NO: 1597512 - DNA, 17 bp, Homo sapiens
cagggaggaaaagtgca

SEQ ID NO: 1597513 - DNA, 12 bp, Homo sapiens
cagggaggagag

SEQ ID NO: 1597514 - DNA, 23 bp, Homo sapiens
cagggaggagaggggaagggcca

SEQ ID NO: 1597515 - DNA, 19 bp, Homo sapiens
cagggaggaggtggcagcc

SEQ ID NO: 1597516 - DNA, 22 bp, Homo sapiens
cagggaggaggtggcagccctg

SEQ ID NO: 1597517 - DNA, 22 bp, Homo sapiens
cagggaggcaacactgctgtcc

SEQ ID NO: 1597518 - DNA, 12 bp, Homo sapiens
cagggaggggac

SEQ ID NO: 1597519 - DNA, 18 bp, Homo sapiens
cagggaggggaggcagat

SEQ ID NO: 1597520 - DNA, 14 bp, Homo sapiens
cagggatattgcct

SEQ ID NO: 1597521 - DNA, 14 bp, Homo sapiens
cagggatgctgggc

SEQ ID NO: 1597522 - DNA, 19 bp, Homo sapiens
cagggatgctgggctgggc

SEQ ID NO: 1597523 - DNA, 20 bp, Homo sapiens
cagggatgctgggctgggcc

SEQ ID NO: 1597524 - DNA, 14 bp, Homo sapiens
cagggatgggcagc

SEQ ID NO: 1597525 - DNA, 18 bp, Homo sapiens
cagggattaacctctgca

SEQ ID NO: 1597526 - DNA, 19 bp, Homo sapiens
cagggattaacctctgcac

SEQ ID NO: 1597527 - DNA, 18 bp, Homo sapiens
cagggattgattttaaaa

SEQ ID NO: 1597528 - DNA, 20 bp, Homo sapiens
cagggattgattttaaaatg

SEQ ID NO: 1597529 - DNA, 21 bp, Homo sapiens
cagggattgattttaaaatgt

SEQ ID NO: 1597530 - DNA, 20 bp, Homo sapiens
cagggcaagggttaaggcct

SEQ ID NO: 1597531 - DNA, 21 bp, Homo sapiens
cagggcaagggttaaggcctg

SEQ ID NO: 1597532 - DNA, 14 bp, Homo sapiens
cagggcaccagagg

SEQ ID NO: 1597533 - DNA, 18 bp, Homo sapiens
cagggcagagcaggaagg

SEQ ID NO: 1597534 - DNA, 18 bp, Homo sapiens
cagggcagcaagggacct

SEQ ID NO: 1597535 - DNA, 13 bp, Homo sapiens
cagggcagcagat

SEQ ID NO: 1597536 - DNA, 20 bp, Homo sapiens
cagggcagccgtcacccctg

SEQ ID NO: 1597537 - DNA, 11 bp, Homo sapiens
cagggcagcct

SEQ ID NO: 1597538 - DNA, 17 bp, Homo sapiens
cagggcagcctggatcc

SEQ ID NO: 1597539 - DNA, 15 bp, Homo sapiens
cagggcagggctcat

SEQ ID NO: 1597540 - DNA, 15 bp, Homo sapiens
cagggcagggctctg

SEQ ID NO: 1597541 - DNA, 17 bp, Homo sapiens
cagggcagggctctgat

SEQ ID NO: 1597542 - DNA, 16 bp, Homo sapiens
cagggcattgctcagc

SEQ ID NO: 1597543 - DNA, 17 bp, Homo sapiens
cagggcattgctcagcc

SEQ ID NO: 1597544 - DNA, 19 bp, Homo sapiens
cagggcattgctcagcccg

SEQ ID NO: 1597545 - DNA, 18 bp, Homo sapiens
cagggccaaagcacagct

SEQ ID NO: 1597546 - DNA, 23 bp, Homo sapiens
cagggccacgctccagctgcccc

SEQ ID NO: 1597547 - DNA, 12 bp, Homo sapiens
cagggccactct

SEQ ID NO: 1597548 - DNA, 19 bp, Homo sapiens
cagggccagaaggagggca

SEQ ID NO: 1597549 - DNA, 15 bp, Homo sapiens
cagggccagactgga

SEQ ID NO: 1597550 - DNA, 22 bp, Homo sapiens
cagggccagatgagcagaagct

SEQ ID NO: 1597551 - DNA, 16 bp, Homo sapiens
cagggccagggccctg

SEQ ID NO: 1597552 - DNA, 18 bp, Homo sapiens
cagggccagggccctgca

SEQ ID NO: 1597553 - DNA, 12 bp, Homo sapiens
cagggccaggtg

SEQ ID NO: 1597554 - DNA, 19 bp, Homo sapiens
cagggccaggtgcagacct

SEQ ID NO: 1597555 - DNA, 15 bp, Homo sapiens
cagggccatccactg

SEQ ID NO: 1597556 - DNA, 17 bp, Homo sapiens
cagggccatccactgtg

SEQ ID NO: 1597557 - DNA, 19 bp, Homo sapiens
cagggccatccactgtgac

SEQ ID NO: 1597558 - DNA, 20 bp, Homo sapiens
cagggccatccactgtgacg

SEQ ID NO: 1597559 - DNA, 12 bp, Homo sapiens
cagggccatgca

SEQ ID NO: 1597560 - DNA, 14 bp, Homo sapiens
cagggccatgcaga

SEQ ID NO: 1597561 - DNA, 15 bp, Homo sapiens
cagggccatgcagac

SEQ ID NO: 1597562 - DNA, 18 bp, Homo sapiens
cagggccatgctgaggcc

SEQ ID NO: 1597563 - DNA, 22 bp, Homo sapiens
cagggccatgctgaggcctggg

SEQ ID NO: 1597564 - DNA, 14 bp, Homo sapiens
cagggcccacgtgt

SEQ ID NO: 1597565 - DNA, 13 bp, Homo sapiens
cagggcccagagc

SEQ ID NO: 1597566 - DNA, 15 bp, Homo sapiens
cagggcccagagccc

SEQ ID NO: 1597567 - DNA, 14 bp, Homo sapiens
cagggcccaggttc

SEQ ID NO: 1597568 - DNA, 20 bp, Homo sapiens
cagggcccaggttcgagacc

SEQ ID NO: 1597569 - DNA, 15 bp, Homo sapiens
cagggccccagaagg

SEQ ID NO: 1597570 - DNA, 17 bp, Homo sapiens
cagggccccagaaggca

SEQ ID NO: 1597571 - DNA, 21 bp, Homo sapiens
cagggccccagaaggcaggga

SEQ ID NO: 1597572 - DNA, 16 bp, Homo sapiens
cagggccccagcacta

SEQ ID NO: 1597573 - DNA, 16 bp, Homo sapiens
cagggcccccggccac

SEQ ID NO: 1597574 - DNA, 11 bp, Homo sapiens
cagggcccctc

SEQ ID NO: 1597575 - DNA, 14 bp, Homo sapiens
cagggccctcccag

SEQ ID NO: 1597576 - DNA, 15 bp, Homo sapiens
cagggccctgcagag

SEQ ID NO: 1597577 - DNA, 23 bp, Homo sapiens
cagggccgcccgggcccagagga

SEQ ID NO: 1597578 - DNA, 17 bp, Homo sapiens
cagggccgcgagaggcc

SEQ ID NO: 1597579 - DNA, 21 bp, Homo sapiens
cagggccgcggccgcccgcac

SEQ ID NO: 1597580 - DNA, 13 bp, Homo sapiens
cagggcctagagg

SEQ ID NO: 1597581 - DNA, 19 bp, Homo sapiens
cagggcctccagggcccag

SEQ ID NO: 1597582 - DNA, 20 bp, Homo sapiens
cagggcctctccaaccactg

SEQ ID NO: 1597583 - DNA, 18 bp, Homo sapiens
cagggcctgagcagctgg

SEQ ID NO: 1597584 - DNA, 15 bp, Homo sapiens
cagggcctggagccc

SEQ ID NO: 1597585 - DNA, 17 bp, Homo sapiens
cagggcctggagcccca

SEQ ID NO: 1597586 - DNA, 18 bp, Homo sapiens
cagggcctggagccccat

SEQ ID NO: 1597587 - DNA, 14 bp, Homo sapiens
cagggcctgggcct

SEQ ID NO: 1597588 - DNA, 21 bp, Homo sapiens
cagggcctgggcctcatggct

SEQ ID NO: 1597589 - DNA, 13 bp, Homo sapiens
cagggcctggggg

SEQ ID NO: 1597590 - DNA, 23 bp, Homo sapiens
cagggcctgggggcagtgactgg

SEQ ID NO: 1597591 - DNA, 15 bp, Homo sapiens
cagggccttgcccag

SEQ ID NO: 1597592 - DNA, 17 bp, Homo sapiens
cagggccttgcccagag

SEQ ID NO: 1597593 - DNA, 18 bp, Homo sapiens
cagggccttgcccagaga

SEQ ID NO: 1597594 - DNA, 11 bp, Homo sapiens
cagggcctttt

SEQ ID NO: 1597595 - DNA, 20 bp, Homo sapiens
cagggcgagactctgtctca

SEQ ID NO: 1597596 - DNA, 14 bp, Homo sapiens
cagggcgctcagac

SEQ ID NO: 1597597 - DNA, 17 bp, Homo sapiens
cagggcgggcagagggc

SEQ ID NO: 1597598 - DNA, 19 bp, Homo sapiens
cagggctcagcctggtggg

SEQ ID NO: 1597599 - DNA, 15 bp, Homo sapiens
cagggctcccacaga

SEQ ID NO: 1597600 - DNA, 15 bp, Homo sapiens
cagggctctgcagca

SEQ ID NO: 1597601 - DNA, 17 bp, Homo sapiens
cagggctctgcagcacc

SEQ ID NO: 1597602 - DNA, 15 bp, Homo sapiens
cagggctctgcaggc

SEQ ID NO: 1597603 - DNA, 17 bp, Homo sapiens
cagggctctgcaggcca

SEQ ID NO: 1597604 - DNA, 18 bp, Homo sapiens
cagggctctttgatggac

SEQ ID NO: 1597605 - DNA, 16 bp, Homo sapiens
cagggctgaggcctct

SEQ ID NO: 1597606 - DNA, 18 bp, Homo sapiens
cagggctgaggcctctca

SEQ ID NO: 1597607 - DNA, 13 bp, Homo sapiens
cagggctgcaggg

SEQ ID NO: 1597608 - DNA, 17 bp, Homo sapiens
cagggctggactgaggc

SEQ ID NO: 1597609 - DNA, 21 bp, Homo sapiens
cagggctggactgaggcctga

SEQ ID NO: 1597610 - DNA, 17 bp, Homo sapiens
cagggctggagggaagg

SEQ ID NO: 1597611 - DNA, 22 bp, Homo sapiens
cagggctggagtgcgctcttgg

SEQ ID NO: 1597612 - DNA, 20 bp, Homo sapiens
cagggctggctcctctgccc

SEQ ID NO: 1597613 - DNA, 14 bp, Homo sapiens
cagggctgggagga

SEQ ID NO: 1597614 - DNA, 12 bp, Homo sapiens
cagggctgggcc

SEQ ID NO: 1597615 - DNA, 14 bp, Homo sapiens
cagggctgggccag

SEQ ID NO: 1597616 - DNA, 19 bp, Homo sapiens
cagggctgggccaggtctc

SEQ ID NO: 1597617 - DNA, 20 bp, Homo sapiens
cagggctgggccaggtctcc

SEQ ID NO: 1597618 - DNA, 20 bp, Homo sapiens
cagggctggggacagagggt

SEQ ID NO: 1597619 - DNA, 20 bp, Homo sapiens
cagggctggtgtggctgctc

SEQ ID NO: 1597620 - DNA, 17 bp, Homo sapiens
cagggcttttcccagga

SEQ ID NO: 1597621 - DNA, 18 bp, Homo sapiens
cagctacttgggaggctg

SEQ ID NO: 1597622 - DNA, 16 bp, Homo sapiens
cagctaggaagagcag

SEQ ID NO: 1597623 - DNA, 13 bp, Homo sapiens
cagctatatttga

SEQ ID NO: 1597624 - DNA, 17 bp, Homo sapiens
cagctatctctcagtga

SEQ ID NO: 1597625 - DNA, 18 bp, Homo sapiens
cagctatctctcagtgaa

SEQ ID NO: 1597626 - DNA, 17 bp, Homo sapiens
cagctatgggagcccca

SEQ ID NO: 1597627 - DNA, 18 bp, Homo sapiens
cagctatgggagccccag

SEQ ID NO: 1597628 - DNA, 23 bp, Homo sapiens
cagctatgggagccccagggtct

SEQ ID NO: 1597629 - DNA, 14 bp, Homo sapiens
cagctattttgtga

SEQ ID NO: 1597630 - DNA, 16 bp, Homo sapiens
cagctcaacctaccct

SEQ ID NO: 1597631 - DNA, 22 bp, Homo sapiens
cagctcaactcacagcttctcc

SEQ ID NO: 1597632 - DNA, 14 bp, Homo sapiens
cagctcaagggctg

SEQ ID NO: 1597633 - DNA, 19 bp, Homo sapiens
cagctcaagggctggcact

SEQ ID NO: 1597634 - DNA, 16 bp, Homo sapiens
cagctcaatggactgg

SEQ ID NO: 1597635 - DNA, 22 bp, Homo sapiens
cagctcacaccctaccttcccc

SEQ ID NO: 1597636 - DNA, 15 bp, Homo sapiens
cagctcactgcaacc

SEQ ID NO: 1597637 - DNA, 14 bp, Homo sapiens
cagctcagccagtg

SEQ ID NO: 1597638 - DNA, 19 bp, Homo sapiens
cagctcagctgcccatccc

SEQ ID NO: 1597639 - DNA, 18 bp, Homo sapiens
cagctcaggacagatgcc

SEQ ID NO: 1597640 - DNA, 12 bp, Homo sapiens
cagctcaggcac

SEQ ID NO: 1597641 - DNA, 21 bp, Homo sapiens
cagctcaggcacacttcttct

SEQ ID NO: 1597642 - DNA, 12 bp, Homo sapiens
cagctcagtccc

SEQ ID NO: 1597643 - DNA, 13 bp, Homo sapiens
cagctcatagaat

SEQ ID NO: 1597644 - DNA, 20 bp, Homo sapiens
cagctcatagaattttgagt

SEQ ID NO: 1597645 - DNA, 17 bp, Homo sapiens
cagctcatgcccccttt

SEQ ID NO: 1597646 - DNA, 20 bp, Homo sapiens
cagctccaacctgcaaagat

SEQ ID NO: 1597647 - DNA, 21 bp, Homo sapiens
cagctccagggaatccaagcc

SEQ ID NO: 1597648 - DNA, 22 bp, Homo sapiens
cagctccagggaatccaagcct

SEQ ID NO: 1597649 - DNA, 14 bp, Homo sapiens
cagctccagggcca

SEQ ID NO: 1597650 - DNA, 14 bp, Homo sapiens
cagctccattttct

SEQ ID NO: 1597651 - DNA, 20 bp, Homo sapiens
cagctcccaacagaggcctc

SEQ ID NO: 1597652 - DNA, 12 bp, Homo sapiens
cagctcccaggc

SEQ ID NO: 1597653 - DNA, 11 bp, Homo sapiens
cagctccccag

SEQ ID NO: 1597654 - DNA, 12 bp, Homo sapiens
cagctccccagg

SEQ ID NO: 1597655 - DNA, 17 bp, Homo sapiens
cagctcccctcggagaa

SEQ ID NO: 1597656 - DNA, 18 bp, Homo sapiens
cagctcccctcggagaag

SEQ ID NO: 1597657 - DNA, 21 bp, Homo sapiens
cagctcccctcggagaagagc

SEQ ID NO: 1597658 - DNA, 15 bp, Homo sapiens
cagctccctaggaga

SEQ ID NO: 1597659 - DNA, 18 bp, Homo sapiens
cagctccctaggagacca

SEQ ID NO: 1597660 - DNA, 19 bp, Homo sapiens
cagctccctaggagaccaa

SEQ ID NO: 1597661 - DNA, 21 bp, Homo sapiens
cagctccctcctgcacacaga

SEQ ID NO: 1597662 - DNA, 19 bp, Homo sapiens
cagctcctcctcttggagc

SEQ ID NO: 1597663 - DNA, 15 bp, Homo sapiens
cagctcctgaataaa

SEQ ID NO: 1597664 - DNA, 13 bp, Homo sapiens
cagctcctgccag

SEQ ID NO: 1597665 - DNA, 17 bp, Homo sapiens
cagctcctgggcagctt

SEQ ID NO: 1597666 - DNA, 22 bp, Homo sapiens
cagctccttggggcagggcctg

SEQ ID NO: 1597667 - DNA, 18 bp, Homo sapiens
cagctcgctggctttctc

SEQ ID NO: 1597668 - DNA, 19 bp, Homo sapiens
cagctcgctggctttctct

SEQ ID NO: 1597669 - DNA, 20 bp, Homo sapiens
cagctcgctggctttctctc

SEQ ID NO: 1597670 - DNA, 12 bp, Homo sapiens
cagctctcagcc

SEQ ID NO: 1597671 - DNA, 14 bp, Homo sapiens
cagctctccccagg

SEQ ID NO: 1597672 - DNA, 12 bp, Homo sapiens
cagctctccctc

SEQ ID NO: 1597673 - DNA, 21 bp, Homo sapiens
caggcgcggtggctcacgcct

SEQ ID NO: 1597674 - DNA, 15 bp, Homo sapiens
caggcgctaattcaa

SEQ ID NO: 1597675 - DNA, 18 bp, Homo sapiens
caggcgggcccagaccgg

SEQ ID NO: 1597676 - DNA, 24 bp, Homo sapiens
caggcggggcccagcgctctcctg

SEQ ID NO: 1597677 - DNA, 17 bp, Homo sapiens
caggcggggtgctgtgg

SEQ ID NO: 1597678 - DNA, 18 bp, Homo sapiens
caggcggggtgctgtggt

SEQ ID NO: 1597679 - DNA, 21 bp, Homo sapiens
caggcgtgggacgtggtcagg

SEQ ID NO: 1597680 - DNA, 17 bp, Homo sapiens
caggcgttggtgccact

SEQ ID NO: 1597681 - DNA, 21 bp, Homo sapiens
caggctaaatgcaccaagaaa

SEQ ID NO: 1597682 - DNA, 24 bp, Homo sapiens
caggctaagaccctgtgtcctcca

SEQ ID NO: 1597683 - DNA, 14 bp, Homo sapiens
caggctactctcct

SEQ ID NO: 1597684 - DNA, 16 bp, Homo sapiens
caggctactctcctcg

SEQ ID NO: 1597685 - DNA, 17 bp, Homo sapiens
caggctatgtataaaat

SEQ ID NO: 1597686 - DNA, 16 bp, Homo sapiens
caggctcactcacaga

SEQ ID NO: 1597687 - DNA, 16 bp, Homo sapiens
caggctcactgccagg

SEQ ID NO: 1597688 - DNA, 21 bp, Homo sapiens
caggctcactgccaggccagc

SEQ ID NO: 1597689 - DNA, 23 bp, Homo sapiens
caggctcactgccaggccagcct

SEQ ID NO: 1597690 - DNA, 19 bp, Homo sapiens
caggctccatgcacctccc

SEQ ID NO: 1597691 - DNA, 22 bp, Homo sapiens
caggctcctacctgtctgctgc

SEQ ID NO: 1597692 - DNA, 15 bp, Homo sapiens
caggctcctggctgt

SEQ ID NO: 1597693 - DNA, 20 bp, Homo sapiens
caggctcctggctgtgccca

SEQ ID NO: 1597694 - DNA, 15 bp, Homo sapiens
caggctcctgtgata

SEQ ID NO: 1597695 - DNA, 14 bp, Homo sapiens
caggctccttcctg

SEQ ID NO: 1597696 - DNA, 21 bp, Homo sapiens
caggctcggaggaccctggaa

SEQ ID NO: 1597697 - DNA, 21 bp, Homo sapiens
caggctcgtggactgagtggg

SEQ ID NO: 1597698 - DNA, 11 bp, Homo sapiens
caggctctgca

SEQ ID NO: 1597699 - DNA, 14 bp, Homo sapiens
caggctctgcacag

SEQ ID NO: 1597700 - DNA, 13 bp, Homo sapiens
caggctctgccct

SEQ ID NO: 1597701 - DNA, 18 bp, Homo sapiens
caggctctgggctcaggg

SEQ ID NO: 1597702 - DNA, 20 bp, Homo sapiens
caggctctgggctcagggct

SEQ ID NO: 1597703 - DNA, 15 bp, Homo sapiens
caggctcttagcagc

SEQ ID NO: 1597704 - DNA, 18 bp, Homo sapiens
caggctcttcctggacct

SEQ ID NO: 1597705 - DNA, 21 bp, Homo sapiens
caggctcttcctggacctgag

SEQ ID NO: 1597706 - DNA, 23 bp, Homo sapiens
caggctcttcctggacctgagtc

SEQ ID NO: 1597707 - DNA, 12 bp, Homo sapiens
caggctcttctc

SEQ ID NO: 1597708 - DNA, 18 bp, Homo sapiens
caggctcttctcctttca

SEQ ID NO: 1597709 - DNA, 16 bp, Homo sapiens
caggctgaagagaggg

SEQ ID NO: 1597710 - DNA, 15 bp, Homo sapiens
caggctgagagccag

SEQ ID NO: 1597711 - DNA, 16 bp, Homo sapiens
caggctgagagccaga

SEQ ID NO: 1597712 - DNA, 19 bp, Homo sapiens
caggctgagagccagatgc

SEQ ID NO: 1597713 - DNA, 16 bp, Homo sapiens
caggctgagccatgag

SEQ ID NO: 1597714 - DNA, 18 bp, Homo sapiens
caggctgagccatgagga

SEQ ID NO: 1597715 - DNA, 19 bp, Homo sapiens
caggctgagccatgaggag

SEQ ID NO: 1597716 - DNA, 15 bp, Homo sapiens
caggctgcacagcat

SEQ ID NO: 1597717 - DNA, 18 bp, Homo sapiens
caggctgcacctctggct

SEQ ID NO: 1597718 - DNA, 18 bp, Homo sapiens
caggctgcactgcagtga

SEQ ID NO: 1597719 - DNA, 21 bp, Homo sapiens
caggctgcactgcagtgatgg

SEQ ID NO: 1597720 - DNA, 20 bp, Homo sapiens
caggctgcagaggcacctca

SEQ ID NO: 1597721 - DNA, 14 bp, Homo sapiens
caggctgcagcctc

SEQ ID NO: 1597722 - DNA, 21 bp, Homo sapiens
caggctgcctcggactccatg

SEQ ID NO: 1597723 - DNA, 15 bp, Homo sapiens
caggctgcctgagca

SEQ ID NO: 1597724 - DNA, 20 bp, Homo sapiens
caggctgcctgagcacctcc

SEQ ID NO: 1597725 - DNA, 21 bp, Homo sapiens
caggctgcctgagcacctccc

SEQ ID NO: 1597726 - DNA, 18 bp, Homo sapiens
caggctgctcagggctgg

SEQ ID NO: 1597727 - DNA, 12 bp, Homo sapiens
caggctgcttgg

SEQ ID NO: 1597728 - DNA, 15 bp, Homo sapiens
caggctgcttgggat

SEQ ID NO: 1597729 - DNA, 21 bp, Homo sapiens
caggctggacaccctctgccg

SEQ ID NO: 1597730 - DNA, 14 bp, Homo sapiens
caggctggccagtc

SEQ ID NO: 1597731 - DNA, 19 bp, Homo sapiens
caggctggccagtccaggc

SEQ ID NO: 1597732 - DNA, 21 bp, Homo sapiens
caggctggccagtccaggctg

SEQ ID NO: 1597733 - DNA, 24 bp, Homo sapiens
caggctggccagtgctgcccatga

SEQ ID NO: 1597734 - DNA, 18 bp, Homo sapiens
caggctggcgcagccaag

SEQ ID NO: 1597735 - DNA, 20 bp, Homo sapiens
caggctggcgcagccaaggc

SEQ ID NO: 1597736 - DNA, 16 bp, Homo sapiens
caggctggctgttggc

SEQ ID NO: 1597737 - DNA, 12 bp, Homo sapiens
caggctgggaac

SEQ ID NO: 1597738 - DNA, 13 bp, Homo sapiens
caggctgggccat

SEQ ID NO: 1597739 - DNA, 18 bp, Homo sapiens
caggctgggccatgtcca

SEQ ID NO: 1597740 - DNA, 23 bp, Homo sapiens
caggctgggctctgcctgtctgg

SEQ ID NO: 1597741 - DNA, 18 bp, Homo sapiens
caggctggtctaaaactc

SEQ ID NO: 1597742 - DNA, 13 bp, Homo sapiens
caggctggtctca

SEQ ID NO: 1597743 - DNA, 18 bp, Homo sapiens
caggctgttctgcactga

SEQ ID NO: 1597744 - DNA, 22 bp, Homo sapiens
caggctgttcttcaactcctgg

SEQ ID NO: 1597745 - DNA, 23 bp, Homo sapiens
caggctgttcttcaactcctggg

SEQ ID NO: 1597746 - DNA, 20 bp, Homo sapiens
caggcttccctgacttgctt

SEQ ID NO: 1597747 - DNA, 22 bp, Homo sapiens
caggcttcctgggtcctgcctg

SEQ ID NO: 1597748 - DNA, 20 bp, Homo sapiens
caggcttggggaaaatggcc

SEQ ID NO: 1597749 - DNA, 21 bp, Homo sapiens
caggcttgtcactagcagctg

SEQ ID NO: 1597750 - DNA, 15 bp, Homo sapiens
caggcttttgctaga

SEQ ID NO: 1597751 - DNA, 18 bp, Homo sapiens
cagggaaaataggcagga

SEQ ID NO: 1597752 - DNA, 18 bp, Homo sapiens
cagggaaacaaagtttac

SEQ ID NO: 1597753 - DNA, 12 bp, Homo sapiens
cagggaaagcat

SEQ ID NO: 1597754 - DNA, 14 bp, Homo sapiens
cagggaaaggctct

SEQ ID NO: 1597755 - DNA, 15 bp, Homo sapiens
cagggaacagcccca

SEQ ID NO: 1597756 - DNA, 16 bp, Homo sapiens
cagggaacagccccag

SEQ ID NO: 1597757 - DNA, 17 bp, Homo sapiens
cagggaacagccccagg

SEQ ID NO: 1597758 - DNA, 14 bp, Homo sapiens
cagggaagagggca

SEQ ID NO: 1597759 - DNA, 16 bp, Homo sapiens
cagggaagagggcagt

SEQ ID NO: 1597760 - DNA, 20 bp, Homo sapiens
cagggaagagggcagtacct

SEQ ID NO: 1597761 - DNA, 12 bp, Homo sapiens
cagggaagccca

SEQ ID NO: 1597762 - DNA, 13 bp, Homo sapiens
cagggaagcccag

SEQ ID NO: 1597763 - DNA, 22 bp, Homo sapiens
cagggaagccccacatgtccag

SEQ ID NO: 1597764 - DNA, 13 bp, Homo sapiens
cagggaagctggc

SEQ ID NO: 1597765 - DNA, 15 bp, Homo sapiens
cagggaaggatgaca

SEQ ID NO: 1597766 - DNA, 17 bp, Homo sapiens
cagggaaggtggggccc

SEQ ID NO: 1597767 - DNA, 16 bp, Homo sapiens
cagggaatgcagcagg

SEQ ID NO: 1597768 - DNA, 18 bp, Homo sapiens
cagggacaaagaggcctt

SEQ ID NO: 1597769 - DNA, 17 bp, Homo sapiens
cagggacacgggcagcc

SEQ ID NO: 1597770 - DNA, 14 bp, Homo sapiens
cagggacagagaca

SEQ ID NO: 1597771 - DNA, 22 bp, Homo sapiens
cagggacagagacacctgcacc

SEQ ID NO: 1597772 - DNA, 18 bp, Homo sapiens
cagggacaggataagagg

SEQ ID NO: 1597773 - DNA, 17 bp, Homo sapiens
cagggacatgccctgtg

SEQ ID NO: 1597774 - DNA, 16 bp, Homo sapiens
cagggaccacaccctg

SEQ ID NO: 1597775 - DNA, 18 bp, Homo sapiens
cagggaccactgggtgag

SEQ ID NO: 1597776 - DNA, 20 bp, Homo sapiens
cagggaccactgggtgagag

SEQ ID NO: 1597777 - DNA, 22 bp, Homo sapiens
cagggaccactgggtgagagag

SEQ ID NO: 1597778 - DNA, 14 bp, Homo sapiens
cagggaccagggcc

SEQ ID NO: 1597779 - DNA, 21 bp, Homo sapiens
cagggacccaggtgtgcctgt

SEQ ID NO: 1597780 - DNA, 22 bp, Homo sapiens
cagggacccaggtgtgcctgtg

SEQ ID NO: 1597781 - DNA, 23 bp, Homo sapiens
cagggacccggggtctcctggac

SEQ ID NO: 1597782 - DNA, 15 bp, Homo sapiens
cagggaccggtgctg

SEQ ID NO: 1597783 - DNA, 20 bp, Homo sapiens
cagggaccggtgctgcagga

SEQ ID NO: 1597784 - DNA, 15 bp, Homo sapiens
cagggacctgagagc

SEQ ID NO: 1597785 - DNA, 23 bp, Homo sapiens
cagggacctgagagcatctcagg

SEQ ID NO: 1597786 - DNA, 23 bp, Homo sapiens
cagggacttgtttagagagcctg

SEQ ID NO: 1597787 - DNA, 16 bp, Homo sapiens
cagggactttgctggt

SEQ ID NO: 1597788 - DNA, 12 bp, Homo sapiens
cagggagaagct

SEQ ID NO: 1597789 - DNA, 23 bp, Homo sapiens
cagcacagaaggaatctgtgcag

SEQ ID NO: 1597790 - DNA, 12 bp, Homo sapiens
cagcacagagcg

SEQ ID NO: 1597791 - DNA, 15 bp, Homo sapiens
cagcacagcttgacc

SEQ ID NO: 1597792 - DNA, 12 bp, Homo sapiens
cagcacaggaat

SEQ ID NO: 1597793 - DNA, 13 bp, Homo sapiens
cagcacaggggcc

SEQ ID NO: 1597794 - DNA, 21 bp, Homo sapiens
cagcacaggggccccagatct

SEQ ID NO: 1597795 - DNA, 22 bp, Homo sapiens
cagcacagtacacacaaaaacc

SEQ ID NO: 1597796 - DNA, 14 bp, Homo sapiens
cagcacatggccat

SEQ ID NO: 1597797 - DNA, 17 bp, Homo sapiens
cagcacatggccataga

SEQ ID NO: 1597798 - DNA, 15 bp, Homo sapiens
cagcacattcgggac

SEQ ID NO: 1597799 - DNA, 22 bp, Homo sapiens
cagcaccaagagcagctgggaa

SEQ ID NO: 1597800 - DNA, 14 bp, Homo sapiens
cagcaccacactgg

SEQ ID NO: 1597801 - DNA, 17 bp, Homo sapiens
cagcaccacactgggtg

SEQ ID NO: 1597802 - DNA, 22 bp, Homo sapiens
cagcaccaccctagtcccttcc

SEQ ID NO: 1597803 - DNA, 13 bp, Homo sapiens
cagcaccccttcc

SEQ ID NO: 1597804 - DNA, 15 bp, Homo sapiens
cagcaccccttccat

SEQ ID NO: 1597805 - DNA, 19 bp, Homo sapiens
cagcaccccttccatgtgg

SEQ ID NO: 1597806 - DNA, 23 bp, Homo sapiens
cagcaccccttccatgtggagaa

SEQ ID NO: 1597807 - DNA, 13 bp, Homo sapiens
cagcaccctaaga

SEQ ID NO: 1597808 - DNA, 12 bp, Homo sapiens
cagcaccctgca

SEQ ID NO: 1597809 - DNA, 14 bp, Homo sapiens
cagcaccctgcaga

SEQ ID NO: 1597810 - DNA, 11 bp, Homo sapiens
cagcaccctgg

SEQ ID NO: 1597811 - DNA, 17 bp, Homo sapiens
cagcaccctgggtgcca

SEQ ID NO: 1597812 - DNA, 15 bp, Homo sapiens
cagcaccgaggggcc

SEQ ID NO: 1597813 - DNA, 17 bp, Homo sapiens
cagcacctcagcctgca

SEQ ID NO: 1597814 - DNA, 18 bp, Homo sapiens
cagcacctccaggcctgt

SEQ ID NO: 1597815 - DNA, 13 bp, Homo sapiens
cagcacctgctcc

SEQ ID NO: 1597816 - DNA, 15 bp, Homo sapiens
cagcacctgctccca

SEQ ID NO: 1597817 - DNA, 12 bp, Homo sapiens
cagcacctggca

SEQ ID NO: 1597818 - DNA, 15 bp, Homo sapiens
cagcaccttgtgcct

SEQ ID NO: 1597819 - DNA, 18 bp, Homo sapiens
cagcaccttgtgcctggg

SEQ ID NO: 1597820 - DNA, 23 bp, Homo sapiens
cagcacggcgtggtgtgtccctg

SEQ ID NO: 1597821 - DNA, 19 bp, Homo sapiens
cagcactaaagcagtggac

SEQ ID NO: 1597822 - DNA, 20 bp, Homo sapiens
cagcactaaagcagtggaca

SEQ ID NO: 1597823 - DNA, 14 bp, Homo sapiens
cagcactactctgt

SEQ ID NO: 1597824 - DNA, 20 bp, Homo sapiens
cagcactagtaaaggaggaa

SEQ ID NO: 1597825 - DNA, 12 bp, Homo sapiens
cagcactcccca

SEQ ID NO: 1597826 - DNA, 20 bp, Homo sapiens
cagcactccccagagctgtg

SEQ ID NO: 1597827 - DNA, 23 bp, Homo sapiens
cagcactccccagagctgtgcca

SEQ ID NO: 1597828 - DNA, 22 bp, Homo sapiens
cagcactctctaaatcttcctt

SEQ ID NO: 1597829 - DNA, 12 bp, Homo sapiens
cagcactgaaaa

SEQ ID NO: 1597830 - DNA, 14 bp, Homo sapiens
cagcactgaaaata

SEQ ID NO: 1597831 - DNA, 15 bp, Homo sapiens
cagcactgaggaaga

SEQ ID NO: 1597832 - DNA, 14 bp, Homo sapiens
cagcactgatttca

SEQ ID NO: 1597833 - DNA, 12 bp, Homo sapiens
cagcactgtccc

SEQ ID NO: 1597834 - DNA, 14 bp, Homo sapiens
cagcactgtctcag

SEQ ID NO: 1597835 - DNA, 15 bp, Homo sapiens
cagcactgtctcagt

SEQ ID NO: 1597836 - DNA, 12 bp, Homo sapiens
cagcactgtgaa

SEQ ID NO: 1597837 - DNA, 12 bp, Homo sapiens
cagcacttccat

SEQ ID NO: 1597838 - DNA, 13 bp, Homo sapiens
cagcacttccatg

SEQ ID NO: 1597839 - DNA, 18 bp, Homo sapiens
cagcactttgagaggctg

SEQ ID NO: 1597840 - DNA, 18 bp, Homo sapiens
cagcactttgggaggcag

SEQ ID NO: 1597841 - DNA, 18 bp, Homo sapiens
cagcactttgggaggccg

SEQ ID NO: 1597842 - DNA, 18 bp, Homo sapiens
cagcactttgggaggctg

SEQ ID NO: 1597843 - DNA, 15 bp, Homo sapiens
cagcactttggtttt

SEQ ID NO: 1597844 - DNA, 20 bp, Homo sapiens
cagcagaacaagtgcctcct

SEQ ID NO: 1597845 - DNA, 24 bp, Homo sapiens
cagcagaacctgcacacaggacag

SEQ ID NO: 1597846 - DNA, 13 bp, Homo sapiens
cagcagaaggggg

SEQ ID NO: 1597847 - DNA, 16 bp, Homo sapiens
cagcagaatggaggca

SEQ ID NO: 1597848 - DNA, 18 bp, Homo sapiens
cagcagaatggaggcagg

SEQ ID NO: 1597849 - DNA, 12 bp, Homo sapiens
cagcagacagag

SEQ ID NO: 1597850 - DNA, 15 bp, Homo sapiens
cagcagacagagcca

SEQ ID NO: 1597851 - DNA, 22 bp, Homo sapiens
cagcagagcggggtcccctctg

SEQ ID NO: 1597852 - DNA, 23 bp, Homo sapiens
cagcagagcggggtcccctctgt

SEQ ID NO: 1597853 - DNA, 22 bp, Homo sapiens
cagcagaggacagtctggagaa

SEQ ID NO: 1597854 - DNA, 17 bp, Homo sapiens
cagcagatcccagctca

SEQ ID NO: 1597855 - DNA, 12 bp, Homo sapiens
cagcagatctgt

SEQ ID NO: 1597856 - DNA, 18 bp, Homo sapiens
cagcagcaccaaccacag

SEQ ID NO: 1597857 - DNA, 22 bp, Homo sapiens
cagcagcactggaaccacctgg

SEQ ID NO: 1597858 - DNA, 13 bp, Homo sapiens
cagcagcagctca

SEQ ID NO: 1597859 - DNA, 16 bp, Homo sapiens
cagcagcagctcacac

SEQ ID NO: 1597860 - DNA, 13 bp, Homo sapiens
cagcagccagcac

SEQ ID NO: 1597861 - DNA, 14 bp, Homo sapiens
cagcagccagcacc

SEQ ID NO: 1597862 - DNA, 13 bp, Homo sapiens
cagcagccagctc

SEQ ID NO: 1597863 - DNA, 18 bp, Homo sapiens
cagcagccagctctcagc

SEQ ID NO: 1597864 - DNA, 13 bp, Homo sapiens
cagcagcccaagc

SEQ ID NO: 1597865 - DNA, 16 bp, Homo sapiens
cagcagcccagcttcc

SEQ ID NO: 1597866 - DNA, 18 bp, Homo sapiens
cagcagcccagcttcctg

SEQ ID NO: 1597867 - DNA, 21 bp, Homo sapiens
cagcagcccagcttcctggtg

SEQ ID NO: 1597868 - DNA, 23 bp, Homo sapiens
cagcagccccggcaactctggct

SEQ ID NO: 1597869 - DNA, 12 bp, Homo sapiens
cagcagccctcc

SEQ ID NO: 1597870 - DNA, 14 bp, Homo sapiens
cagcagccctcctc

SEQ ID NO: 1597871 - DNA, 14 bp, Homo sapiens
cagcagcctccctg

SEQ ID NO: 1597872 - DNA, 17 bp, Homo sapiens
cagcagcctccctgtca

SEQ ID NO: 1597873 - DNA, 18 bp, Homo sapiens
cagcagcctccctgtcac

SEQ ID NO: 1597874 - DNA, 15 bp, Homo sapiens
cagcagcctgtatgt

SEQ ID NO: 1597875 - DNA, 16 bp, Homo sapiens
cagcagcctgtatgtg

SEQ ID NO: 1597876 - DNA, 17 bp, Homo sapiens
cagcagcgcgcaggcct

SEQ ID NO: 1597877 - DNA, 22 bp, Homo sapiens
cagcagctaggactgaggagtg

SEQ ID NO: 1597878 - DNA, 14 bp, Homo sapiens
cagcagctcaacct

SEQ ID NO: 1597879 - DNA, 19 bp, Homo sapiens
cagcagctcaacctaccct

SEQ ID NO: 1597880 - DNA, 13 bp, Homo sapiens
cagcagctcaggc

SEQ ID NO: 1597881 - DNA, 15 bp, Homo sapiens
cagcagctcatagaa

SEQ ID NO: 1597882 - DNA, 16 bp, Homo sapiens
cagcagctctgagaca

SEQ ID NO: 1597883 - DNA, 12 bp, Homo sapiens
cagcagctgcag

SEQ ID NO: 1597884 - DNA, 17 bp, Homo sapiens
cagcagctgcgggtctg

SEQ ID NO: 1597885 - DNA, 22 bp, Homo sapiens
cagcagctgcgggtctgaagga

SEQ ID NO: 1597886 - DNA, 14 bp, Homo sapiens
cagcagctgggacc

SEQ ID NO: 1597887 - DNA, 18 bp, Homo sapiens
cagcagctggtgccccac

SEQ ID NO: 1597888 - DNA, 22 bp, Homo sapiens
cagcagctggtgccccacctgc

SEQ ID NO: 1597889 - DNA, 18 bp, Homo sapiens
cagcagcttcaccagagc

SEQ ID NO: 1597890 - DNA, 17 bp, Homo sapiens
cagcagcttttaataca

SEQ ID NO: 1597891 - DNA, 14 bp, Homo sapiens
cagcaggaagccag

SEQ ID NO: 1597892 - DNA, 18 bp, Homo sapiens
cagcaggaagccaggctg

SEQ ID NO: 1597893 - DNA, 20 bp, Homo sapiens
cagcaggaagccaggctgag

SEQ ID NO: 1597894 - DNA, 22 bp, Homo sapiens
cagcaggaaggaacaaagacag

SEQ ID NO: 1597895 - DNA, 11 bp, Homo sapiens
cagcaggagag

SEQ ID NO: 1597896 - DNA, 13 bp, Homo sapiens
cagcaggaggagt

SEQ ID NO: 1597897 - DNA, 22 bp, Homo sapiens
cagcaggaggttctgggcctct

SEQ ID NO: 1597898 - DNA, 18 bp, Homo sapiens
cagcaggatcgaagggtt

SEQ ID NO: 1597899 - DNA, 15 bp, Homo sapiens
cagcaggcaggtgga

SEQ ID NO: 1597900 - DNA, 22 bp, Homo sapiens
cagcaggcaggtggactgactg

SEQ ID NO: 1597901 - DNA, 12 bp, Homo sapiens
cagcaggcccag

SEQ ID NO: 1597902 - DNA, 17 bp, Homo sapiens
cagcaggcccagcatgc

SEQ ID NO: 1597903 - DNA, 19 bp, Homo sapiens
cagcaggcccagcatgcag

SEQ ID NO: 1597904 - DNA, 13 bp, Homo sapiens
cagcaggctcagg

SEQ ID NO: 1597905 - DNA, 15 bp, Homo sapiens
cagcaggctcaggca

SEQ ID NO: 1597906 - DNA, 17 bp, Homo sapiens
cagcaggctcaggcaca

SEQ ID NO: 1597907 - DNA, 17 bp, Homo sapiens
cagcagggaagctcttt

SEQ ID NO: 1597908 - DNA, 17 bp, Homo sapiens
cagcagggcctcaaagt

SEQ ID NO: 1597909 - DNA, 20 bp, Homo sapiens
cagcagggtagtctggtttc

SEQ ID NO: 1597910 - DNA, 18 bp, Homo sapiens
cagcaggtgattggacca

SEQ ID NO: 1597911 - DNA, 13 bp, Homo sapiens
cagcaggtgctgt

SEQ ID NO: 1597912 - DNA, 16 bp, Homo sapiens
cagcaggtgtggccaa

SEQ ID NO: 1597913 - DNA, 16 bp, Homo sapiens
cagcaggtgtggtggc

SEQ ID NO: 1597914 - DNA, 20 bp, Homo sapiens
cagcaggtgtggtggctcat

SEQ ID NO: 1597915 - DNA, 22 bp, Homo sapiens
cagcaggtgtggtggctcatgg

SEQ ID NO: 1597916 - DNA, 20 bp, Homo sapiens
cagcagtctccttcagcacg

SEQ ID NO: 1597917 - DNA, 19 bp, Homo sapiens
cagcagtgaccacaccaac

SEQ ID NO: 1597918 - DNA, 19 bp, Homo sapiens
cagcagtgagtctcttcag

SEQ ID NO: 1597919 - DNA, 19 bp, Homo sapiens
cagcagtgatctcagggca

SEQ ID NO: 1597920 - DNA, 21 bp, Homo sapiens
cagcagtgatctcagggcaga

SEQ ID NO: 1597921 - DNA, 16 bp, Homo sapiens
cagcagtgcagccggg

SEQ ID NO: 1597922 - DNA, 13 bp, Homo sapiens
cagcagtgtcccc

SEQ ID NO: 1597923 - DNA, 14 bp, Homo sapiens
cagcagtgtcccct

SEQ ID NO: 1597924 - DNA, 19 bp, Homo sapiens
cagcagtgtcccctgcccc

SEQ ID NO: 1597925 - DNA, 22 bp, Homo sapiens
cagcagtgtcccctgccccaga

SEQ ID NO: 1597926 - DNA, 23 bp, Homo sapiens
cagcagtgtcccctgccccagag

SEQ ID NO: 1597927 - DNA, 21 bp, Homo sapiens
cagcagttgaaaagactccaa

SEQ ID NO: 1597928 - DNA, 22 bp, Homo sapiens
cagcataacaaggtccaagata

SEQ ID NO: 1597929 - DNA, 14 bp, Homo sapiens
cagcataccaatta

SEQ ID NO: 1597930 - DNA, 23 bp, Homo sapiens
cagcatagaacaggacctctgct

SEQ ID NO: 1597931 - DNA, 12 bp, Homo sapiens
cagcatatttat

SEQ ID NO: 1597932 - DNA, 18 bp, Homo sapiens
cagcatatttatagcaat

SEQ ID NO: 1597933 - DNA, 20 bp, Homo sapiens
cagcatcatggaggtttgaa

SEQ ID NO: 1597934 - DNA, 16 bp, Homo sapiens
cagcatccagcctgtg

SEQ ID NO: 1597935 - DNA, 17 bp, Homo sapiens
cagcatccagcctgtgt

SEQ ID NO: 1597936 - DNA, 18 bp, Homo sapiens
cagcatccagcctgtgtg

SEQ ID NO: 1597937 - DNA, 22 bp, Homo sapiens
cagcatccctggagcaggagcc

SEQ ID NO: 1597938 - DNA, 12 bp, Homo sapiens
cagcatccgcag

SEQ ID NO: 1597939 - DNA, 23 bp, Homo sapiens
cagcatccttttctgcagagggg

SEQ ID NO: 1597940 - DNA, 15 bp, Homo sapiens
cagcatcgggagcac

SEQ ID NO: 1597941 - DNA, 24 bp, Homo sapiens
cagcatcgggagcacccagagcac

SEQ ID NO: 1597942 - DNA, 15 bp, Homo sapiens
cagcatctcccagca

SEQ ID NO: 1597943 - DNA, 23 bp, Homo sapiens
cagcatctcccagcaagacctca

SEQ ID NO: 1597944 - DNA, 11 bp, Homo sapiens
cagcatctgac

SEQ ID NO: 1597945 - DNA, 18 bp, Homo sapiens
cagcatctgaccatctgt

SEQ ID NO: 1597946 - DNA, 19 bp, Homo sapiens
cagcatctgaccatctgtg

SEQ ID NO: 1597947 - DNA, 21 bp, Homo sapiens
cagcatctgaccatctgtgac

SEQ ID NO: 1597948 - DNA, 22 bp, Homo sapiens
cagcatctgaccatctgtgact

SEQ ID NO: 1597949 - DNA, 23 bp, Homo sapiens
cagcatctggctgtctagaatgt

SEQ ID NO: 1597950 - DNA, 15 bp, Homo sapiens
cagcatcttctggtt

SEQ ID NO: 1597951 - DNA, 21 bp, Homo sapiens
cagcatgacctgtgaccagca

SEQ ID NO: 1597952 - DNA, 20 bp, Homo sapiens
cagcatgagactttctgctg

SEQ ID NO: 1597953 - DNA, 21 bp, Homo sapiens
cagcatgagactttctgctgg

SEQ ID NO: 1597954 - DNA, 22 bp, Homo sapiens
cagcatgaggacagaccacaga

SEQ ID NO: 1597955 - DNA, 14 bp, Homo sapiens
cagcatgcttgggc

SEQ ID NO: 1597956 - DNA, 23 bp, Homo sapiens
cagcatgcttgggctgacccagc

SEQ ID NO: 1597957 - DNA, 15 bp, Homo sapiens
cagcatggaaaaatg

SEQ ID NO: 1597958 - DNA, 17 bp, Homo sapiens
cagcatggaaaaatggt

SEQ ID NO: 1597959 - DNA, 19 bp, Homo sapiens
cagcatggcatagccccgg

SEQ ID NO: 1597960 - DNA, 18 bp, Homo sapiens
cagcatgggtccttgatg

SEQ ID NO: 1597961 - DNA, 22 bp, Homo sapiens
cagcatgtccaacatggtaatt

SEQ ID NO: 1597962 - DNA, 15 bp, Homo sapiens
cagcatgtctactgc

SEQ ID NO: 1597963 - DNA, 19 bp, Homo sapiens
cagcatgtgccaagattct

SEQ ID NO: 1597964 - DNA, 17 bp, Homo sapiens
cagcatgttgctgagga

SEQ ID NO: 1597965 - DNA, 18 bp, Homo sapiens
cagcattacaaattgctt

SEQ ID NO: 1597966 - DNA, 12 bp, Homo sapiens
cagcattcaaaa

SEQ ID NO: 1597967 - DNA, 15 bp, Homo sapiens
cagcattcaaaatag

SEQ ID NO: 1597968 - DNA, 21 bp, Homo sapiens
cagcattcaaaatagttctat

SEQ ID NO: 1597969 - DNA, 15 bp, Homo sapiens
cagcattcagcacac

SEQ ID NO: 1597970 - DNA, 16 bp, Homo sapiens
cagcattcagcacaca

SEQ ID NO: 1597971 - DNA, 21 bp, Homo sapiens
cagcattccagcccctctggt

SEQ ID NO: 1597972 - DNA, 16 bp, Homo sapiens
cagcattccagctctg

SEQ ID NO: 1597973 - DNA, 13 bp, Homo sapiens
cagcattccctac

SEQ ID NO: 1597974 - DNA, 14 bp, Homo sapiens
cagcattctcactc

SEQ ID NO: 1597975 - DNA, 15 bp, Homo sapiens
cagcattctggaggg

SEQ ID NO: 1597976 - DNA, 19 bp, Homo sapiens
cagcattctggaggggaga

SEQ ID NO: 1597977 - DNA, 12 bp, Homo sapiens
cagcattgcttt

SEQ ID NO: 1597978 - DNA, 13 bp, Homo sapiens
cagcattgtcttt

SEQ ID NO: 1597979 - DNA, 16 bp, Homo sapiens
cagcattgtctttgct

SEQ ID NO: 1597980 - DNA, 22 bp, Homo sapiens
cagcatttagtgaagttgtgca

SEQ ID NO: 1597981 - DNA, 20 bp, Homo sapiens
cagcatttgctttcctctga

SEQ ID NO: 1597982 - DNA, 17 bp, Homo sapiens
cagccaaacccatgagg

SEQ ID NO: 1597983 - DNA, 19 bp, Homo sapiens
cagccaaacccatgaggca

SEQ ID NO: 1597984 - DNA, 21 bp, Homo sapiens
cagccaaactgtagatgaaga

SEQ ID NO: 1597985 - DNA, 14 bp, Homo sapiens
cagccaaatttaaa

SEQ ID NO: 1597986 - DNA, 22 bp, Homo sapiens
cagccaaatttaaaactgttgg

SEQ ID NO: 1597987 - DNA, 21 bp, Homo sapiens
cagccaaatttcctgtttgaa

SEQ ID NO: 1597988 - DNA, 19 bp, Homo sapiens
cagccaacgagacacattg

SEQ ID NO: 1597989 - DNA, 17 bp, Homo sapiens
cagccaactagcccctg

SEQ ID NO: 1597990 - DNA, 18 bp, Homo sapiens
cagccaactagcccctgg

SEQ ID NO: 1597991 - DNA, 16 bp, Homo sapiens
cagccaagcacctcca

SEQ ID NO: 1597992 - DNA, 23 bp, Homo sapiens
cactcccggcctaggcacctccc

SEQ ID NO: 1597993 - DNA, 13 bp, Homo sapiens
cactccctcctgg

SEQ ID NO: 1597994 - DNA, 22 bp, Homo sapiens
cactccctcctggagctctgtg

SEQ ID NO: 1597995 - DNA, 14 bp, Homo sapiens
cactccctgagctt

SEQ ID NO: 1597996 - DNA, 16 bp, Homo sapiens
cactccctggccttgc

SEQ ID NO: 1597997 - DNA, 18 bp, Homo sapiens
cactccctggccttgccc

SEQ ID NO: 1597998 - DNA, 17 bp, Homo sapiens
cactcccttgctggccc

SEQ ID NO: 1597999 - DNA, 19 bp, Homo sapiens
cactcccttgctggcccca

SEQ ID NO: 1598000 - DNA, 20 bp, Homo sapiens
cactcccttgctggccccag

SEQ ID NO: 1598001 - DNA, 14 bp, Homo sapiens
cactccctttccaa

SEQ ID NO: 1598002 - DNA, 21 bp, Homo sapiens
cactccgcgccgatgccaccg

SEQ ID NO: 1598003 - DNA, 19 bp, Homo sapiens
cactccggtgtgcctgcag

SEQ ID NO: 1598004 - DNA, 20 bp, Homo sapiens
cactccggtgtgcctgcagc

SEQ ID NO: 1598005 - DNA, 14 bp, Homo sapiens
cactcctacctggt

SEQ ID NO: 1598006 - DNA, 12 bp, Homo sapiens
cactcctccctc

SEQ ID NO: 1598007 - DNA, 14 bp, Homo sapiens
cactcctccctccg

SEQ ID NO: 1598008 - DNA, 11 bp, Homo sapiens
cactcctcctc

SEQ ID NO: 1598009 - DNA, 12 bp, Homo sapiens
cactcctcctcg

SEQ ID NO: 1598010 - DNA, 16 bp, Homo sapiens
cactcctcctcggaag

SEQ ID NO: 1598011 - DNA, 12 bp, Homo sapiens
cactcctgctgc

SEQ ID NO: 1598012 - DNA, 14 bp, Homo sapiens
cactcctgctgcac

SEQ ID NO: 1598013 - DNA, 19 bp, Homo sapiens
cactcctgcttaatcttca

SEQ ID NO: 1598014 - DNA, 19 bp, Homo sapiens
cactcctggggcctcttgg

SEQ ID NO: 1598015 - DNA, 13 bp, Homo sapiens
cactccttgtccc

SEQ ID NO: 1598016 - DNA, 21 bp, Homo sapiens
cactcgacccagaatggagcc

SEQ ID NO: 1598017 - DNA, 20 bp, Homo sapiens
cactcgagaccatcctggcc

SEQ ID NO: 1598018 - DNA, 21 bp, Homo sapiens
cactcgagaccatcctggccc

SEQ ID NO: 1598019 - DNA, 15 bp, Homo sapiens
cactcgcagtcgcag

SEQ ID NO: 1598020 - DNA, 16 bp, Homo sapiens
cactcgccatttcctc

SEQ ID NO: 1598021 - DNA, 19 bp, Homo sapiens
cactcgctgttatcaaata

SEQ ID NO: 1598022 - DNA, 14 bp, Homo sapiens
cactcggtcccagt

SEQ ID NO: 1598023 - DNA, 20 bp, Homo sapiens
cactcggtcccagttttgtt

SEQ ID NO: 1598024 - DNA, 17 bp, Homo sapiens
cactcgtccaagggaca

SEQ ID NO: 1598025 - DNA, 22 bp, Homo sapiens
cactcgtccaagggacagccca

SEQ ID NO: 1598026 - DNA, 18 bp, Homo sapiens
cactcgtggtgaggctga

SEQ ID NO: 1598027 - DNA, 16 bp, Homo sapiens
cactctagcctggcaa

SEQ ID NO: 1598028 - DNA, 19 bp, Homo sapiens
cactctaggggtcaggctc

SEQ ID NO: 1598029 - DNA, 22 bp, Homo sapiens
cactctaggggtcaggctccat

SEQ ID NO: 1598030 - DNA, 15 bp, Homo sapiens
cactctagttctaga

SEQ ID NO: 1598031 - DNA, 17 bp, Homo sapiens
cactctcattccccagg

SEQ ID NO: 1598032 - DNA, 13 bp, Homo sapiens
cactctccatcac

SEQ ID NO: 1598033 - DNA, 14 bp, Homo sapiens
cactctccccacac

SEQ ID NO: 1598034 - DNA, 15 bp, Homo sapiens
cactctccccacact

SEQ ID NO: 1598035 - DNA, 20 bp, Homo sapiens
cactctccccgctcaggggc

SEQ ID NO: 1598036 - DNA, 23 bp, Homo sapiens
cactctccttcgtgtctctccca

SEQ ID NO: 1598037 - DNA, 17 bp, Homo sapiens
cactctcggggcccttg

SEQ ID NO: 1598038 - DNA, 23 bp, Homo sapiens
cactctcggggcccttggggcct

SEQ ID NO: 1598039 - DNA, 14 bp, Homo sapiens
cactctctaaatct

SEQ ID NO: 1598040 - DNA, 22 bp, Homo sapiens
cactctctattgtcatggggat

SEQ ID NO: 1598041 - DNA, 13 bp, Homo sapiens
cactctctgctgg

SEQ ID NO: 1598042 - DNA, 15 bp, Homo sapiens
cactctctgctggca

SEQ ID NO: 1598043 - DNA, 15 bp, Homo sapiens
cactctctgggactc

SEQ ID NO: 1598044 - DNA, 21 bp, Homo sapiens
cactctctgggactctcctcc

SEQ ID NO: 1598045 - DNA, 23 bp, Homo sapiens
cactctgagtttaccatttgtaa

SEQ ID NO: 1598046 - DNA, 16 bp, Homo sapiens
cactctgattcacctc

SEQ ID NO: 1598047 - DNA, 12 bp, Homo sapiens
cactctgccccc

SEQ ID NO: 1598048 - DNA, 16 bp, Homo sapiens
cactctgccctctgct

SEQ ID NO: 1598049 - DNA, 19 bp, Homo sapiens
cactctgccctctgctgct

SEQ ID NO: 1598050 - DNA, 21 bp, Homo sapiens
cactctgccctctgctgctgc

SEQ ID NO: 1598051 - DNA, 17 bp, Homo sapiens
cactctgcctctgcctg

SEQ ID NO: 1598052 - DNA, 12 bp, Homo sapiens
cactctgctctg

SEQ ID NO: 1598053 - DNA, 12 bp, Homo sapiens
cactctgcttct

SEQ ID NO: 1598054 - DNA, 15 bp, Homo sapiens
cactctgcttctctg

SEQ ID NO: 1598055 - DNA, 18 bp, Homo sapiens
cactctgcttctctgact

SEQ ID NO: 1598056 - DNA, 23 bp, Homo sapiens
cactctgtaattgcactttttaa

SEQ ID NO: 1598057 - DNA, 13 bp, Homo sapiens
cactctgttattt

SEQ ID NO: 1598058 - DNA, 17 bp, Homo sapiens
cactctgttatttagac

SEQ ID NO: 1598059 - DNA, 20 bp, Homo sapiens
cactcttcagtgactcctgc

SEQ ID NO: 1598060 - DNA, 21 bp, Homo sapiens
cactcttcagtgactcctgct

SEQ ID NO: 1598061 - DNA, 22 bp, Homo sapiens
cactcttcagtgactcctgctg

SEQ ID NO: 1598062 - DNA, 23 bp, Homo sapiens
cactcttcagtgactcctgctgg

SEQ ID NO: 1598063 - DNA, 17 bp, Homo sapiens
cactcttgaagtccagg

SEQ ID NO: 1598064 - DNA, 18 bp, Homo sapiens
cactcttgaagtccagga

SEQ ID NO: 1598065 - DNA, 15 bp, Homo sapiens
cactcttgatctctc

SEQ ID NO: 1598066 - DNA, 20 bp, Homo sapiens
cactcttgatctctcttgtc

SEQ ID NO: 1598067 - DNA, 17 bp, Homo sapiens
cactgaaaacttagcca

SEQ ID NO: 1598068 - DNA, 19 bp, Homo sapiens
cactgaaaacttagccaga

SEQ ID NO: 1598069 - DNA, 22 bp, Homo sapiens
cactgaaaattggacagattgc

SEQ ID NO: 1598070 - DNA, 16 bp, Homo sapiens
cactgaaacctctgcc

SEQ ID NO: 1598071 - DNA, 16 bp, Homo sapiens
cactgaaagttttgta

SEQ ID NO: 1598072 - DNA, 23 bp, Homo sapiens
cactgaaagttttgtaaaagaaa

SEQ ID NO: 1598073 - DNA, 12 bp, Homo sapiens
cactgaacaaaa

SEQ ID NO: 1598074 - DNA, 14 bp, Homo sapiens
cactgaaccactgc

SEQ ID NO: 1598075 - DNA, 22 bp, Homo sapiens
cactgaagccggacagctgccc

SEQ ID NO: 1598076 - DNA, 23 bp, Homo sapiens
cactgaagccggacagctgccca

SEQ ID NO: 1598077 - DNA, 13 bp, Homo sapiens
cactgaagctggg

SEQ ID NO: 1598078 - DNA, 13 bp, Homo sapiens
cactgaatattta

SEQ ID NO: 1598079 - DNA, 15 bp, Homo sapiens
cactgaatcttcacg

SEQ ID NO: 1598080 - DNA, 23 bp, Homo sapiens
cactgaattaatgacagagccag

SEQ ID NO: 1598081 - DNA, 14 bp, Homo sapiens
cactgaattcactc

SEQ ID NO: 1598082 - DNA, 14 bp, Homo sapiens
cactgaatttataa

SEQ ID NO: 1598083 - DNA, 21 bp, Homo sapiens
cactgacaaacgtccccagcg

SEQ ID NO: 1598084 - DNA, 19 bp, Homo sapiens
cactgacacaaaaagtaga

SEQ ID NO: 1598085 - DNA, 22 bp, Homo sapiens
cactgacagatttccatcctag

SEQ ID NO: 1598086 - DNA, 17 bp, Homo sapiens
cactgtttggcctttct

SEQ ID NO: 1598087 - DNA, 19 bp, Homo sapiens
cactgttttatctctgtga

SEQ ID NO: 1598088 - DNA, 16 bp, Homo sapiens
cacttaaaaattagca

SEQ ID NO: 1598089 - DNA, 17 bp, Homo sapiens
cacttaaacagaagcag

SEQ ID NO: 1598090 - DNA, 18 bp, Homo sapiens
cacttaagtcttccttaa

SEQ ID NO: 1598091 - DNA, 13 bp, Homo sapiens
cacttaagtgtct

SEQ ID NO: 1598092 - DNA, 16 bp, Homo sapiens
cacttaagtttttcca

SEQ ID NO: 1598093 - DNA, 15 bp, Homo sapiens
cacttaatgtatgtt

SEQ ID NO: 1598094 - DNA, 15 bp, Homo sapiens
cacttacgtaaaaca

SEQ ID NO: 1598095 - DNA, 17 bp, Homo sapiens
cacttacgtaaaacatt

SEQ ID NO: 1598096 - DNA, 15 bp, Homo sapiens
cacttactggtagga

SEQ ID NO: 1598097 - DNA, 16 bp, Homo sapiens
cacttacttgcttatt

SEQ ID NO: 1598098 - DNA, 17 bp, Homo sapiens
cacttagaaattgcatt

SEQ ID NO: 1598099 - DNA, 20 bp, Homo sapiens
cacttagaaattgcatttcc

SEQ ID NO: 1598100 - DNA, 23 bp, Homo sapiens
cagaggcctggcatcttctggag

SEQ ID NO: 1598101 - DNA, 16 bp, Homo sapiens
cagaggcctgggctgg

SEQ ID NO: 1598102 - DNA, 19 bp, Homo sapiens
cagaggcgtactacccagc

SEQ ID NO: 1598103 - DNA, 21 bp, Homo sapiens
cagaggcgtactacccagctc

SEQ ID NO: 1598104 - DNA, 22 bp, Homo sapiens
cagaggcgtactacccagctct

SEQ ID NO: 1598105 - DNA, 14 bp, Homo sapiens
cagaggctgcagga

SEQ ID NO: 1598106 - DNA, 17 bp, Homo sapiens
cagaggctgcaggactt

SEQ ID NO: 1598107 - DNA, 23 bp, Homo sapiens
cagaggctgcctctcccatcact

SEQ ID NO: 1598108 - DNA, 14 bp, Homo sapiens
cagaggctggaggc

SEQ ID NO: 1598109 - DNA, 14 bp, Homo sapiens
cagaggctgggttc

SEQ ID NO: 1598110 - DNA, 15 bp, Homo sapiens
cagccagcagccagc

SEQ ID NO: 1598111 - DNA, 19 bp, Homo sapiens
cagccagcagccagctctc

SEQ ID NO: 1598112 - DNA, 14 bp, Homo sapiens
cagccagccagtct

SEQ ID NO: 1598113 - DNA, 16 bp, Homo sapiens
cagccagcccagccca

SEQ ID NO: 1598114 - DNA, 18 bp, Homo sapiens
cagccagccggtgcctgg

SEQ ID NO: 1598115 - DNA, 14 bp, Homo sapiens
cagccagccgtgag

SEQ ID NO: 1598116 - DNA, 12 bp, Homo sapiens
cagccagcctca

SEQ ID NO: 1598117 - DNA, 15 bp, Homo sapiens
cagccagctcctggg

SEQ ID NO: 1598118 - DNA, 12 bp, Homo sapiens
cagccagctctc

SEQ ID NO: 1598119 - DNA, 15 bp, Homo sapiens
cagccagctctcagc

SEQ ID NO: 1598120 - DNA, 18 bp, Homo sapiens
cagccagctctcagccaa

SEQ ID NO: 1598121 - DNA, 12 bp, Homo sapiens
cagccaggagct

SEQ ID NO: 1598122 - DNA, 14 bp, Homo sapiens
cagccaggagctgg

SEQ ID NO: 1598123 - DNA, 15 bp, Homo sapiens
cagccaggagctggg

SEQ ID NO: 1598124 - DNA, 16 bp, Homo sapiens
cagccaggagctgggc

SEQ ID NO: 1598125 - DNA, 22 bp, Homo sapiens
cagccaggagctgggcagaagg

SEQ ID NO: 1598126 - DNA, 18 bp, Homo sapiens
cagccaggagctgtcacc

SEQ ID NO: 1598127 - DNA, 16 bp, Homo sapiens
cagccaggccaacagc

SEQ ID NO: 1598128 - DNA, 17 bp, Homo sapiens
cagccaggccctgccag

SEQ ID NO: 1598129 - DNA, 13 bp, Homo sapiens
cagccaggcgggc

SEQ ID NO: 1598130 - DNA, 24 bp, Homo sapiens
cagccaggctcctacctgtctgct

SEQ ID NO: 1598131 - DNA, 12 bp, Homo sapiens
cagccagggacc

SEQ ID NO: 1598132 - DNA, 14 bp, Homo sapiens
cagccagggacccc

SEQ ID NO: 1598133 - DNA, 18 bp, Homo sapiens
cagccagggacccccaga

SEQ ID NO: 1598134 - DNA, 19 bp, Homo sapiens
cagccagggacccccagaa

SEQ ID NO: 1598135 - DNA, 12 bp, Homo sapiens
cagccagtctca

SEQ ID NO: 1598136 - DNA, 16 bp, Homo sapiens
cagccagtctcagaga

SEQ ID NO: 1598137 - DNA, 18 bp, Homo sapiens
cagccagtctcagagacc

SEQ ID NO: 1598138 - DNA, 19 bp, Homo sapiens
cagccagtctcagagacca

SEQ ID NO: 1598139 - DNA, 22 bp, Homo sapiens
cagccagtctcagagaccagca

SEQ ID NO: 1598140 - DNA, 23 bp, Homo sapiens
cagccagtctcagagaccagcac

SEQ ID NO: 1598141 - DNA, 22 bp, Homo sapiens
cagccatgaggagttgctgttt

SEQ ID NO: 1598142 - DNA, 11 bp, Homo sapiens
cagccatgcct

SEQ ID NO: 1598143 - DNA, 13 bp, Homo sapiens
cagccatgcctca

SEQ ID NO: 1598144 - DNA, 17 bp, Homo sapiens
cagccatgcctcatgcc

SEQ ID NO: 1598145 - DNA, 18 bp, Homo sapiens
cagccatgcctcatgcca

SEQ ID NO: 1598146 - DNA, 19 bp, Homo sapiens
cagccatgcctcatgccac

SEQ ID NO: 1598147 - DNA, 13 bp, Homo sapiens
cagccatgtttgg

SEQ ID NO: 1598148 - DNA, 14 bp, Homo sapiens
cagccatgtttggt

SEQ ID NO: 1598149 - DNA, 16 bp, Homo sapiens
cagccattaccatgga

SEQ ID NO: 1598150 - DNA, 20 bp, Homo sapiens
cagccattaccatggagaca

SEQ ID NO: 1598151 - DNA, 21 bp, Homo sapiens
cagccatttccccctcctcag

SEQ ID NO: 1598152 - DNA, 18 bp, Homo sapiens
cagcccaaaacccagggc

SEQ ID NO: 1598153 - DNA, 13 bp, Homo sapiens
cagcccaacagca

SEQ ID NO: 1598154 - DNA, 15 bp, Homo sapiens
cagcccaacagcact

SEQ ID NO: 1598155 - DNA, 21 bp, Homo sapiens
cagcccaagaggactgagact

SEQ ID NO: 1598156 - DNA, 12 bp, Homo sapiens
cagcccaataaa

SEQ ID NO: 1598157 - DNA, 12 bp, Homo sapiens
cagcccaccctg

SEQ ID NO: 1598158 - DNA, 13 bp, Homo sapiens
cagcccaccctgc

SEQ ID NO: 1598159 - DNA, 21 bp, Homo sapiens
cagcccagagacatacttgaa

SEQ ID NO: 1598160 - DNA, 22 bp, Homo sapiens
cagcccagagacatacttgaag

SEQ ID NO: 1598161 - DNA, 13 bp, Homo sapiens
cagcccagagccc

SEQ ID NO: 1598162 - DNA, 14 bp, Homo sapiens
cagcccagagcctg

SEQ ID NO: 1598163 - DNA, 12 bp, Homo sapiens
cagcccagcacc

SEQ ID NO: 1598164 - DNA, 13 bp, Homo sapiens
cagcccagcacct

SEQ ID NO: 1598165 - DNA, 14 bp, Homo sapiens
cagcccagcacctg

SEQ ID NO: 1598166 - DNA, 17 bp, Homo sapiens
cagcccagcccagctgg

SEQ ID NO: 1598167 - DNA, 10 bp, Homo sapiens
cagcccagct

SEQ ID NO: 1598168 - DNA, 19 bp, Homo sapiens
cagcccagctcctgaataa

SEQ ID NO: 1598169 - DNA, 17 bp, Homo sapiens
cagcccagctggccacc

SEQ ID NO: 1598170 - DNA, 12 bp, Homo sapiens
cagcccagggcc

SEQ ID NO: 1598171 - DNA, 17 bp, Homo sapiens
cagcccagttcccgtga

SEQ ID NO: 1598172 - DNA, 19 bp, Homo sapiens
cagcccatgcccacctgcc

SEQ ID NO: 1598173 - DNA, 17 bp, Homo sapiens
cagcccatggcccccaa

SEQ ID NO: 1598174 - DNA, 21 bp, Homo sapiens
cagcccatggcctctggccag

SEQ ID NO: 1598175 - DNA, 15 bp, Homo sapiens
cagccccaagctggg

SEQ ID NO: 1598176 - DNA, 21 bp, Homo sapiens
cagccccaagctgggccgagg

SEQ ID NO: 1598177 - DNA, 22 bp, Homo sapiens
cagccccacccaggagggaggg

SEQ ID NO: 1598178 - DNA, 21 bp, Homo sapiens
cagccccacccctaagtgccc

SEQ ID NO: 1598179 - DNA, 22 bp, Homo sapiens
cagccccacccctaagtgccca

SEQ ID NO: 1598180 - DNA, 15 bp, Homo sapiens
cagccccaccctggc

SEQ ID NO: 1598181 - DNA, 12 bp, Homo sapiens
cagccccactgc

SEQ ID NO: 1598182 - DNA, 13 bp, Homo sapiens
cagccccactgcc

SEQ ID NO: 1598183 - DNA, 15 bp, Homo sapiens
cagccccactgccag

SEQ ID NO: 1598184 - DNA, 18 bp, Homo sapiens
cagccccactgccagcag

SEQ ID NO: 1598185 - DNA, 21 bp, Homo sapiens
cagccccactgccagcagcag

SEQ ID NO: 1598186 - DNA, 18 bp, Homo sapiens
cagcccccacccccaagg

SEQ ID NO: 1598187 - DNA, 20 bp, Homo sapiens
cagcccccatcacccaagcc

SEQ ID NO: 1598188 - DNA, 13 bp, Homo sapiens
cagccccccttgc

SEQ ID NO: 1598189 - DNA, 16 bp, Homo sapiens
cagccccctccagctc

SEQ ID NO: 1598190 - DNA, 19 bp, Homo sapiens
cagccccctccagctcatg

SEQ ID NO: 1598191 - DNA, 13 bp, Homo sapiens
cagccccctgtgg

SEQ ID NO: 1598192 - DNA, 23 bp, Homo sapiens
cagcctcctgagtagctgggact

SEQ ID NO: 1598193 - DNA, 14 bp, Homo sapiens
cagcctcctggggg

SEQ ID NO: 1598194 - DNA, 16 bp, Homo sapiens
cagcctcctttgtgtg

SEQ ID NO: 1598195 - DNA, 15 bp, Homo sapiens
cagcctcgcacaggc

SEQ ID NO: 1598196 - DNA, 20 bp, Homo sapiens
cagcctcgcacaggccctag

SEQ ID NO: 1598197 - DNA, 19 bp, Homo sapiens
cagcctcgttggagagcag

SEQ ID NO: 1598198 - DNA, 20 bp, Homo sapiens
cagcctctcaagtagctggg

SEQ ID NO: 1598199 - DNA, 19 bp, Homo sapiens
cagcctctccccaggtcca

SEQ ID NO: 1598200 - DNA, 20 bp, Homo sapiens
cagcctctccccaggtccag

SEQ ID NO: 1598201 - DNA, 23 bp, Homo sapiens
cagcctctccccaggtccagctc

SEQ ID NO: 1598202 - DNA, 18 bp, Homo sapiens
cagcctctccgactctgc

SEQ ID NO: 1598203 - DNA, 14 bp, Homo sapiens
cagcctctctgcta

SEQ ID NO: 1598204 - DNA, 14 bp, Homo sapiens
cagcctctgccagg

SEQ ID NO: 1598205 - DNA, 18 bp, Homo sapiens
cagcctctgtcaggcctt

SEQ ID NO: 1598206 - DNA, 17 bp, Homo sapiens
cagcctcttaccttccc

SEQ ID NO: 1598207 - DNA, 17 bp, Homo sapiens
cagcctgacatggaccc

SEQ ID NO: 1598208 - DNA, 18 bp, Homo sapiens
cagcctgaggctgagact

SEQ ID NO: 1598209 - DNA, 16 bp, Homo sapiens
cagcctgagtctcctg

SEQ ID NO: 1598210 - DNA, 19 bp, Homo sapiens
cagcctgagtctcctgtgc

SEQ ID NO: 1598211 - DNA, 20 bp, Homo sapiens
cagcctgagtgacagagcga

SEQ ID NO: 1598212 - DNA, 19 bp, Homo sapiens
cagcctgatcaggcttcct

SEQ ID NO: 1598213 - DNA, 16 bp, Homo sapiens
cagcctgatggccaag

SEQ ID NO: 1598214 - DNA, 14 bp, Homo sapiens
cagcctgcacctgg

SEQ ID NO: 1598215 - DNA, 14 bp, Homo sapiens
cagcctgccccgga

SEQ ID NO: 1598216 - DNA, 13 bp, Homo sapiens
cagcctgcctgtc

SEQ ID NO: 1598217 - DNA, 12 bp, Homo sapiens
cagcctggaagg

SEQ ID NO: 1598218 - DNA, 18 bp, Homo sapiens
cagcctggccacgcagcc

SEQ ID NO: 1598219 - DNA, 22 bp, Homo sapiens
cagcctggccacgcagccagga

SEQ ID NO: 1598220 - DNA, 14 bp, Homo sapiens
cagcctggccagac

SEQ ID NO: 1598221 - DNA, 14 bp, Homo sapiens
cagcctggcttctg

SEQ ID NO: 1598222 - DNA, 20 bp, Homo sapiens
cagcctggcttctggagccc

SEQ ID NO: 1598223 - DNA, 16 bp, Homo sapiens
cagcctgggagcccag

SEQ ID NO: 1598224 - DNA, 18 bp, Homo sapiens
cagcctgggagcccagag

SEQ ID NO: 1598225 - DNA, 20 bp, Homo sapiens
cagcctgggagcccagaggg

SEQ ID NO: 1598226 - DNA, 20 bp, Homo sapiens
cagcctgggcagcatagcaa

SEQ ID NO: 1598227 - DNA, 20 bp, Homo sapiens
cagcctgggcagccaggctg

SEQ ID NO: 1598228 - DNA, 20 bp, Homo sapiens
cagcctggggaccccacttc

SEQ ID NO: 1598229 - DNA, 17 bp, Homo sapiens
cagcctggggctccctc

SEQ ID NO: 1598230 - DNA, 20 bp, Homo sapiens
cagcctggggctccctctct

SEQ ID NO: 1598231 - DNA, 20 bp, Homo sapiens
cagcctggtcaacatggtga

SEQ ID NO: 1598232 - DNA, 15 bp, Homo sapiens
cagcctggtgggcct

SEQ ID NO: 1598233 - DNA, 16 bp, Homo sapiens
cagcctggtgggcctc

SEQ ID NO: 1598234 - DNA, 18 bp, Homo sapiens
cagcctggtgggcctcct

SEQ ID NO: 1598235 - DNA, 21 bp, Homo sapiens
cagcctgtaccttgctgtggg

SEQ ID NO: 1598236 - DNA, 18 bp, Homo sapiens
cagcctgtagggaacttt

SEQ ID NO: 1598237 - DNA, 15 bp, Homo sapiens
cagcctgtatgtggt

SEQ ID NO: 1598238 - DNA, 16 bp, Homo sapiens
cagcctgtccaacatg

SEQ ID NO: 1598239 - DNA, 19 bp, Homo sapiens
cagcctgtgcctgcctttg

SEQ ID NO: 1598240 - DNA, 19 bp, Homo sapiens
cagcctgtggcatctttgc

SEQ ID NO: 1598241 - DNA, 12 bp, Homo sapiens
cagcctgtggcg

SEQ ID NO: 1598242 - DNA, 20 bp, Homo sapiens
cagcctgtggcggtgcctgg

SEQ ID NO: 1598243 - DNA, 20 bp, Homo sapiens
cagcctgtggcttggagtgg

SEQ ID NO: 1598244 - DNA, 23 bp, Homo sapiens
cagcctgtggcttggagtggcca

SEQ ID NO: 1598245 - DNA, 16 bp, Homo sapiens
cagcctgttccagaag

SEQ ID NO: 1598246 - DNA, 14 bp, Homo sapiens
cagccttaatattt

SEQ ID NO: 1598247 - DNA, 21 bp, Homo sapiens
cagccttagctctcccaactc

SEQ ID NO: 1598248 - DNA, 18 bp, Homo sapiens
cagccttcaagaatcaga

SEQ ID NO: 1598249 - DNA, 10 bp, Homo sapiens
cagccttcag

SEQ ID NO: 1598250 - DNA, 23 bp, Homo sapiens
cagccttcagacagagaggactg

SEQ ID NO: 1598251 - DNA, 11 bp, Homo sapiens
cagccttcagc

SEQ ID NO: 1598252 - DNA, 23 bp, Homo sapiens
cagccttcagcagcagctcacac

SEQ ID NO: 1598253 - DNA, 16 bp, Homo sapiens
cagccttccccttgcc

SEQ ID NO: 1598254 - DNA, 14 bp, Homo sapiens
cagccttcctctgc

SEQ ID NO: 1598255 - DNA, 19 bp, Homo sapiens
cagccttcctctgcagctg

SEQ ID NO: 1598256 - DNA, 17 bp, Homo sapiens
cagccttctcctcccaa

SEQ ID NO: 1598257 - DNA, 13 bp, Homo sapiens
cagccttgaccac

SEQ ID NO: 1598258 - DNA, 22 bp, Homo sapiens
cagccttgaccacggctgttcc

SEQ ID NO: 1598259 - DNA, 18 bp, Homo sapiens
cagccttgagccctggct

SEQ ID NO: 1598260 - DNA, 16 bp, Homo sapiens
cagccttgccagagat

SEQ ID NO: 1598261 - DNA, 18 bp, Homo sapiens
cagccttgctgctctgcg

SEQ ID NO: 1598262 - DNA, 19 bp, Homo sapiens
cagccttgctgctctgcgt

SEQ ID NO: 1598263 - DNA, 20 bp, Homo sapiens
cagccttgctgctctgcgtg

SEQ ID NO: 1598264 - DNA, 11 bp, Homo sapiens
cagccttggaa

SEQ ID NO: 1598265 - DNA, 17 bp, Homo sapiens
cagcctttgcctccccg

SEQ ID NO: 1598266 - DNA, 19 bp, Homo sapiens
cagcctttgggtcctgggc

SEQ ID NO: 1598267 - DNA, 20 bp, Homo sapiens
cagcctttgggtcctgggca

SEQ ID NO: 1598268 - DNA, 14 bp, Homo sapiens
cagcgaccccagga

SEQ ID NO: 1598269 - DNA, 18 bp, Homo sapiens
cagcgaccgccccctcct

SEQ ID NO: 1598270 - DNA, 20 bp, Homo sapiens
cagcgacctcaagtgtcctg

SEQ ID NO: 1598271 - DNA, 22 bp, Homo sapiens
cagcgagagagtttcaaaagca

SEQ ID NO: 1598272 - DNA, 19 bp, Homo sapiens
cagcgatgtatataagcca

SEQ ID NO: 1598273 - DNA, 13 bp, Homo sapiens
cagcgcatgtgtc

SEQ ID NO: 1598274 - DNA, 14 bp, Homo sapiens
cagcgcatgtgtgc

SEQ ID NO: 1598275 - DNA, 23 bp, Homo sapiens
cagcgccaaaacaagccaaagag

SEQ ID NO: 1598276 - DNA, 20 bp, Homo sapiens
cagcgccaaatgttcatcct

SEQ ID NO: 1598277 - DNA, 19 bp, Homo sapiens
cagcgcccgctgggctgag

SEQ ID NO: 1598278 - DNA, 21 bp, Homo sapiens
cagcgcccggtgctctgtgtc

SEQ ID NO: 1598279 - DNA, 20 bp, Homo sapiens
cagcgcggaggaggagggag

SEQ ID NO: 1598280 - DNA, 14 bp, Homo sapiens
cagcgcggccagcg

SEQ ID NO: 1598281 - DNA, 17 bp, Homo sapiens
cagcgcggccagcgtcc

SEQ ID NO: 1598282 - DNA, 13 bp, Homo sapiens
cagcgctctcctg

SEQ ID NO: 1598283 - DNA, 17 bp, Homo sapiens
cagcgctgagcatgggg

SEQ ID NO: 1598284 - DNA, 15 bp, Homo sapiens
cagcgcttaaaaaaa

SEQ ID NO: 1598285 - DNA, 21 bp, Homo sapiens
cagcggagtctgtcctgtgac

SEQ ID NO: 1598286 - DNA, 15 bp, Homo sapiens
cagcggattgctctg

SEQ ID NO: 1598287 - DNA, 22 bp, Homo sapiens
cagcggattgctctggagcagc

SEQ ID NO: 1598288 - DNA, 15 bp, Homo sapiens
cagcggcagagcaat

SEQ ID NO: 1598289 - DNA, 19 bp, Homo sapiens
cacgcactgcgcctgtcag

SEQ ID NO: 1598290 - DNA, 18 bp, Homo sapiens
cacgcactgggccacgga

SEQ ID NO: 1598291 - DNA, 21 bp, Homo sapiens
cacgcacttgcctgttggctg

SEQ ID NO: 1598292 - DNA, 14 bp, Homo sapiens
cacgcagcaccctt

SEQ ID NO: 1598293 - DNA, 16 bp, Homo sapiens
cacgcagcctgctctg

SEQ ID NO: 1598294 - DNA, 18 bp, Homo sapiens
cacgcagcctgctctgga

SEQ ID NO: 1598295 - DNA, 19 bp, Homo sapiens
cacgcagcctgctctggag

SEQ ID NO: 1598296 - DNA, 13 bp, Homo sapiens
cacgcaggaccag

SEQ ID NO: 1598297 - DNA, 12 bp, Homo sapiens
cacgcagggcca

SEQ ID NO: 1598298 - DNA, 17 bp, Homo sapiens
cacgcagggccatccac

SEQ ID NO: 1598299 - DNA, 21 bp, Homo sapiens
cacgcagggccatccactgtg

SEQ ID NO: 1598300 - DNA, 15 bp, Homo sapiens
cacgcatacacacat

SEQ ID NO: 1598301 - DNA, 15 bp, Homo sapiens
cacgcatgcagtgtt

SEQ ID NO: 1598302 - DNA, 14 bp, Homo sapiens
cacgccactgcact

SEQ ID NO: 1598303 - DNA, 18 bp, Homo sapiens
cacgccattgtactccag

SEQ ID NO: 1598304 - DNA, 22 bp, Homo sapiens
cacgccattgtactccagcctg

SEQ ID NO: 1598305 - DNA, 16 bp, Homo sapiens
cacgcccgtcctgcct

SEQ ID NO: 1598306 - DNA, 19 bp, Homo sapiens
cacgcccgtcctgcctgtg

SEQ ID NO: 1598307 - DNA, 21 bp, Homo sapiens
cacgcccgtcctgcctgtggc

SEQ ID NO: 1598308 - DNA, 18 bp, Homo sapiens
cacgccctactccactgc

SEQ ID NO: 1598309 - DNA, 19 bp, Homo sapiens
cacgccctactccactgcc

SEQ ID NO: 1598310 - DNA, 21 bp, Homo sapiens
cacgccgggagaagccacctt

SEQ ID NO: 1598311 - DNA, 22 bp, Homo sapiens
cacgccgggagaagccaccttc

SEQ ID NO: 1598312 - DNA, 23 bp, Homo sapiens
cacgccgggagaagccaccttcc

SEQ ID NO: 1598313 - DNA, 20 bp, Homo sapiens
cacgccgtaattctttctgt

SEQ ID NO: 1598314 - DNA, 19 bp, Homo sapiens
cacgcctatgatcccagca

SEQ ID NO: 1598315 - DNA, 21 bp, Homo sapiens
cacgcctatgatcccagcact

SEQ ID NO: 1598316 - DNA, 22 bp, Homo sapiens
cacgcctatgatcccagcactt

SEQ ID NO: 1598317 - DNA, 14 bp, Homo sapiens
cacgcctcaccagc

SEQ ID NO: 1598318 - DNA, 13 bp, Homo sapiens
cacgcctggaagg

SEQ ID NO: 1598319 - DNA, 14 bp, Homo sapiens
cacgcctggaaggg

SEQ ID NO: 1598320 - DNA, 20 bp, Homo sapiens
cacgcctgtaatcccagcag

SEQ ID NO: 1598321 - DNA, 21 bp, Homo sapiens
cacgcctgtaatcccagcagt

SEQ ID NO: 1598322 - DNA, 12 bp, Homo sapiens
cacgcctgtgca

SEQ ID NO: 1598323 - DNA, 15 bp, Homo sapiens
cacgccttcccctca

SEQ ID NO: 1598324 - DNA, 20 bp, Homo sapiens
cacgcgtgtgctcctctcct

SEQ ID NO: 1598325 - DNA, 20 bp, Homo sapiens
cacgctcatgtcctgtcctg

SEQ ID NO: 1598326 - DNA, 12 bp, Homo sapiens
cacgctccagct

SEQ ID NO: 1598327 - DNA, 15 bp, Homo sapiens
cacgctccagctgcc

SEQ ID NO: 1598328 - DNA, 15 bp, Homo sapiens
cacgctcgcgggcag

SEQ ID NO: 1598329 - DNA, 16 bp, Homo sapiens
cacgctcgcgggcagc

SEQ ID NO: 1598330 - DNA, 22 bp, Homo sapiens
cacgctcgcgggcagcgggcca

SEQ ID NO: 1598331 - DNA, 13 bp, Homo sapiens
cacgctctggtgc

SEQ ID NO: 1598332 - DNA, 15 bp, Homo sapiens
cacgctctggtgcag

SEQ ID NO: 1598333 - DNA, 21 bp, Homo sapiens
cacgctcttgaggaagcccag

SEQ ID NO: 1598334 - DNA, 23 bp, Homo sapiens
cacgctcttgaggaagcccaggc

SEQ ID NO: 1598335 - DNA, 14 bp, Homo sapiens
cacgctgcctggtc

SEQ ID NO: 1598336 - DNA, 14 bp, Homo sapiens
cacgctttcctgaa

SEQ ID NO: 1598337 - DNA, 21 bp, Homo sapiens
cacggaaccgtagactaggaa

SEQ ID NO: 1598338 - DNA, 14 bp, Homo sapiens
cacggaatggggaa

SEQ ID NO: 1598339 - DNA, 16 bp, Homo sapiens
cacggacgctggctcc

SEQ ID NO: 1598340 - DNA, 22 bp, Homo sapiens
cacggaggagggatgctgctcc

SEQ ID NO: 1598341 - DNA, 21 bp, Homo sapiens
cacggaggcatctgcaccctc

SEQ ID NO: 1598342 - DNA, 23 bp, Homo sapiens
cacggatccatgtagcaggactg

SEQ ID NO: 1598343 - DNA, 14 bp, Homo sapiens
cacggccaccctcc

SEQ ID NO: 1598344 - DNA, 15 bp, Homo sapiens
cacggccaccctcct

SEQ ID NO: 1598345 - DNA, 19 bp, Homo sapiens
cacggccccgggtccagga

SEQ ID NO: 1598346 - DNA, 13 bp, Homo sapiens
cacggcctggctg

SEQ ID NO: 1598347 - DNA, 14 bp, Homo sapiens
cacggcctggctgg

SEQ ID NO: 1598348 - DNA, 18 bp, Homo sapiens
cacggcgggatcctccac

SEQ ID NO: 1598349 - DNA, 20 bp, Homo sapiens
cacggcgggatcctccacag

SEQ ID NO: 1598350 - DNA, 22 bp, Homo sapiens
cacggcgggatcctccacagag

SEQ ID NO: 1598351 - DNA, 18 bp, Homo sapiens
cacggctggtcactctgc

SEQ ID NO: 1598352 - DNA, 20 bp, Homo sapiens
cacggctggtcactctgccc

SEQ ID NO: 1598353 - DNA, 17 bp, Homo sapiens
cacggcttcactgacca

SEQ ID NO: 1598354 - DNA, 21 bp, Homo sapiens
cacggcttcactgaccagcgg

SEQ ID NO: 1598355 - DNA, 15 bp, Homo sapiens
cacgggagatttctt

SEQ ID NO: 1598356 - DNA, 15 bp, Homo sapiens
cacgggcagcctggc

SEQ ID NO: 1598357 - DNA, 20 bp, Homo sapiens
cacgggcatgcacacggctg

SEQ ID NO: 1598358 - DNA, 15 bp, Homo sapiens
cacgggggcagtgtg

SEQ ID NO: 1598359 - DNA, 23 bp, Homo sapiens
cacggggttggctgttccagact

SEQ ID NO: 1598360 - DNA, 13 bp, Homo sapiens
cacgggtggtccc

SEQ ID NO: 1598361 - DNA, 14 bp, Homo sapiens
cacgggtggtcccc

SEQ ID NO: 1598362 - DNA, 15 bp, Homo sapiens
cacgggtggtccccg

SEQ ID NO: 1598363 - DNA, 17 bp, Homo sapiens
cacggtctggggaagag

SEQ ID NO: 1598364 - DNA, 14 bp, Homo sapiens
cacggtgcgtggct

SEQ ID NO: 1598365 - DNA, 15 bp, Homo sapiens
cacggtgcgtggctg

SEQ ID NO: 1598366 - DNA, 21 bp, Homo sapiens
cacgtacaaaactctgtataa

SEQ ID NO: 1598367 - DNA, 23 bp, Homo sapiens
cacgtacaaaactctgtataagt

SEQ ID NO: 1598368 - DNA, 19 bp, Homo sapiens
cacgtatttatatttggaa

SEQ ID NO: 1598369 - DNA, 17 bp, Homo sapiens
cacgtatttcacagagc

SEQ ID NO: 1598370 - DNA, 19 bp, Homo sapiens
cacgtatttcacagagcac

SEQ ID NO: 1598371 - DNA, 12 bp, Homo sapiens
cactaaagcagt

SEQ ID NO: 1598372 - DNA, 21 bp, Homo sapiens
cactaaagcatgaaatgtgaa

SEQ ID NO: 1598373 - DNA, 13 bp, Homo sapiens
cactaaagcttca

SEQ ID NO: 1598374 - DNA, 17 bp, Homo sapiens
cactaaatgagctcctg

SEQ ID NO: 1598375 - DNA, 13 bp, Homo sapiens
cactaaattatta

SEQ ID NO: 1598376 - DNA, 23 bp, Homo sapiens
cactaaccaagctgagtttccta

SEQ ID NO: 1598377 - DNA, 17 bp, Homo sapiens
cactaaccaatgccttt

SEQ ID NO: 1598378 - DNA, 16 bp, Homo sapiens
cactaaccatccccaa

SEQ ID NO: 1598379 - DNA, 19 bp, Homo sapiens
cactaactcaccagcccca

SEQ ID NO: 1598380 - DNA, 14 bp, Homo sapiens
cactaactgctggt

SEQ ID NO: 1598381 - DNA, 18 bp, Homo sapiens
cactaagctctctgggcc

SEQ ID NO: 1598382 - DNA, 17 bp, Homo sapiens
cactaatatatttaaaa

SEQ ID NO: 1598383 - DNA, 19 bp, Homo sapiens
cactaatatatttaaaaat

SEQ ID NO: 1598384 - DNA, 12 bp, Homo sapiens
cactaattcata

SEQ ID NO: 1598385 - DNA, 17 bp, Homo sapiens
cactaatttcttcttta

SEQ ID NO: 1598386 - DNA, 19 bp, Homo sapiens
cactaatttcttctttaga

SEQ ID NO: 1598387 - DNA, 18 bp, Homo sapiens
cactaatttttgtattat

SEQ ID NO: 1598388 - DNA, 23 bp, Homo sapiens
cactacacctggctgaggttcct

SEQ ID NO: 1598389 - DNA, 16 bp, Homo sapiens
cactacaccttgcctt

SEQ ID NO: 1598390 - DNA, 16 bp, Homo sapiens
cactacactccagcct

SEQ ID NO: 1598391 - DNA, 20 bp, Homo sapiens
cactacactccagcctgagc

SEQ ID NO: 1598392 - DNA, 22 bp, Homo sapiens
cactacaggtgaaggctctcac

SEQ ID NO: 1598393 - DNA, 21 bp, Homo sapiens
cactaccaaacactcagtcca

SEQ ID NO: 1598394 - DNA, 15 bp, Homo sapiens
cactaccccttgatt

SEQ ID NO: 1598395 - DNA, 18 bp, Homo sapiens
cactaccctgattcttga

SEQ ID NO: 1598396 - DNA, 14 bp, Homo sapiens
cactaccttatcag

SEQ ID NO: 1598397 - DNA, 18 bp, Homo sapiens
cactactcctctgcagtg

SEQ ID NO: 1598398 - DNA, 13 bp, Homo sapiens
cactactctgtgc

SEQ ID NO: 1598399 - DNA, 12 bp, Homo sapiens
cactactgaaca

SEQ ID NO: 1598400 - DNA, 15 bp, Homo sapiens
cactactgacatgtg

SEQ ID NO: 1598401 - DNA, 16 bp, Homo sapiens
cactactgcagcacct

SEQ ID NO: 1598402 - DNA, 19 bp, Homo sapiens
cactactgcagcacctcca

SEQ ID NO: 1598403 - DNA, 20 bp, Homo sapiens
cactagaagaaaagcccatt

SEQ ID NO: 1598404 - DNA, 13 bp, Homo sapiens
cactagagggccc

SEQ ID NO: 1598405 - DNA, 14 bp, Homo sapiens
cactagcagctgca

SEQ ID NO: 1598406 - DNA, 14 bp, Homo sapiens
cactagcctctcca

SEQ ID NO: 1598407 - DNA, 16 bp, Homo sapiens
cactagcctctccagg

SEQ ID NO: 1598408 - DNA, 13 bp, Homo sapiens
cactagcttactg

SEQ ID NO: 1598409 - DNA, 17 bp, Homo sapiens
cactaggactctgaggc

SEQ ID NO: 1598410 - DNA, 20 bp, Homo sapiens
cactagggcagggacaggat

SEQ ID NO: 1598411 - DNA, 21 bp, Homo sapiens
cactagggcagggacaggata

SEQ ID NO: 1598412 - DNA, 16 bp, Homo sapiens
cactaggtgtccccaa

SEQ ID NO: 1598413 - DNA, 17 bp, Homo sapiens
cactaggtgtccccaac

SEQ ID NO: 1598414 - DNA, 16 bp, Homo sapiens
cactagtaaaggagga

SEQ ID NO: 1598415 - DNA, 16 bp, Homo sapiens
cactagtcaccgacag

SEQ ID NO: 1598416 - DNA, 21 bp, Homo sapiens
cactagtcaccgacagcggcc

SEQ ID NO: 1598417 - DNA, 12 bp, Homo sapiens
cactagttttgt

SEQ ID NO: 1598418 - DNA, 19 bp, Homo sapiens
cactataaatggtgttttt

SEQ ID NO: 1598419 - DNA, 18 bp, Homo sapiens
cactataatgtaagctct

SEQ ID NO: 1598420 - DNA, 19 bp, Homo sapiens
cactatatctgtatataaa

SEQ ID NO: 1598421 - DNA, 19 bp, Homo sapiens
cactatcccaatcaaagaa

SEQ ID NO: 1598422 - DNA, 21 bp, Homo sapiens
cactatcccaatcaaagaatt

SEQ ID NO: 1598423 - DNA, 19 bp, Homo sapiens
cactatctccgttccatct

SEQ ID NO: 1598424 - DNA, 19 bp, Homo sapiens
cactatctttctgataaca

SEQ ID NO: 1598425 - DNA, 21 bp, Homo sapiens
cactatgaagatgtttcaaaa

SEQ ID NO: 1598426 - DNA, 17 bp, Homo sapiens
cactatgatttctgaat

SEQ ID NO: 1598427 - DNA, 17 bp, Homo sapiens
cactatggtatttgagt

SEQ ID NO: 1598428 - DNA, 15 bp, Homo sapiens
cactattgtaatcat

SEQ ID NO: 1598429 - DNA, 19 bp, Homo sapiens
cactcaaattaatctttct

SEQ ID NO: 1598430 - DNA, 20 bp, Homo sapiens
cactcaaattaatctttctt

SEQ ID NO: 1598431 - DNA, 14 bp, Homo sapiens
cactcaactctgag

SEQ ID NO: 1598432 - DNA, 20 bp, Homo sapiens
cactcaactctgagcccata

SEQ ID NO: 1598433 - DNA, 22 bp, Homo sapiens
cactcaagcaacaagcctcaaa

SEQ ID NO: 1598434 - DNA, 13 bp, Homo sapiens
cactcaagcttgg

SEQ ID NO: 1598435 - DNA, 22 bp, Homo sapiens
cactcacaatttaaaatatttc

SEQ ID NO: 1598436 - DNA, 13 bp, Homo sapiens
cactcacactggc

SEQ ID NO: 1598437 - DNA, 15 bp, Homo sapiens
cactcacactggcca

SEQ ID NO: 1598438 - DNA, 16 bp, Homo sapiens
cactcacagacctgga

SEQ ID NO: 1598439 - DNA, 18 bp, Homo sapiens
cactcaccactaccagcc

SEQ ID NO: 1598440 - DNA, 14 bp, Homo sapiens
cactcaccgaagcc

SEQ ID NO: 1598441 - DNA, 12 bp, Homo sapiens
cactcacctgca

SEQ ID NO: 1598442 - DNA, 22 bp, Homo sapiens
cactcactaggcccccacttgc

SEQ ID NO: 1598443 - DNA, 15 bp, Homo sapiens
cactcactcactcat

SEQ ID NO: 1598444 - DNA, 14 bp, Homo sapiens
cactcactccagcc

SEQ ID NO: 1598445 - DNA, 19 bp, Homo sapiens
cactcagaactctccaggg

SEQ ID NO: 1598446 - DNA, 17 bp, Homo sapiens
cactcagccaccctgag

SEQ ID NO: 1598447 - DNA, 19 bp, Homo sapiens
cactcaggaggctgaggca

SEQ ID NO: 1598448 - DNA, 21 bp, Homo sapiens
cactcaggaggctgaggcagg

SEQ ID NO: 1598449 - DNA, 18 bp, Homo sapiens
cactcaggcctctgcaga

SEQ ID NO: 1598450 - DNA, 15 bp, Homo sapiens
cactcagtccactgt

SEQ ID NO: 1598451 - DNA, 17 bp, Homo sapiens
cactcagtcccccacca

SEQ ID NO: 1598452 - DNA, 20 bp, Homo sapiens
cactcatcaatggggccagt

SEQ ID NO: 1598453 - DNA, 15 bp, Homo sapiens
cactccacagagtga

SEQ ID NO: 1598454 - DNA, 22 bp, Homo sapiens
cactccacataaggggtttagt

SEQ ID NO: 1598455 - DNA, 18 bp, Homo sapiens
cactccacatctgcatca

SEQ ID NO: 1598456 - DNA, 21 bp, Homo sapiens
cactccacatctgcatcactc

SEQ ID NO: 1598457 - DNA, 12 bp, Homo sapiens
cactccaccctc

SEQ ID NO: 1598458 - DNA, 13 bp, Homo sapiens
cactccactctga

SEQ ID NO: 1598459 - DNA, 12 bp, Homo sapiens
cactccactgcc

SEQ ID NO: 1598460 - DNA, 13 bp, Homo sapiens
aatgatttcatgc

SEQ ID NO: 1598461 - DNA, 22 bp, Homo sapiens
aatgatttcatgctatctctgt

SEQ ID NO: 1598462 - DNA, 14 bp, Homo sapiens
aatgcaaaaaatct

SEQ ID NO: 1598463 - DNA, 12 bp, Homo sapiens
aatgcaaaatga

SEQ ID NO: 1598464 - DNA, 14 bp, Homo sapiens
aatgcaaaattgtt

SEQ ID NO: 1598465 - DNA, 20 bp, Homo sapiens
aatgcaaaatttttttaatc

SEQ ID NO: 1598466 - DNA, 15 bp, Homo sapiens
aatgcaaagctgaag

SEQ ID NO: 1598467 - DNA, 19 bp, Homo sapiens
aatgcaaatgtctaattgt

SEQ ID NO: 1598468 - DNA, 21 bp, Homo sapiens
aatgcaagattttccacaaga

SEQ ID NO: 1598469 - DNA, 14 bp, Homo sapiens
aatgcaataactct

SEQ ID NO: 1598470 - DNA, 16 bp, Homo sapiens
aatgcaatttgattga

SEQ ID NO: 1598471 - DNA, 16 bp, Homo sapiens
aatgcacaagctcaga

SEQ ID NO: 1598472 - DNA, 13 bp, Homo sapiens
aatgcacactagc

SEQ ID NO: 1598473 - DNA, 14 bp, Homo sapiens
aatgcaccaagaaa

SEQ ID NO: 1598474 - DNA, 17 bp, Homo sapiens
aatgcaccaagaaagct

SEQ ID NO: 1598475 - DNA, 20 bp, Homo sapiens
aatgcagaaaacagggtctg

SEQ ID NO: 1598476 - DNA, 20 bp, Homo sapiens
aatgcagacttttcagactg

SEQ ID NO: 1598477 - DNA, 16 bp, Homo sapiens
cactgacagcctccca

SEQ ID NO: 1598478 - DNA, 17 bp, Homo sapiens
cactgacagcctcccac

SEQ ID NO: 1598479 - DNA, 13 bp, Homo sapiens
cactgaccagaac

SEQ ID NO: 1598480 - DNA, 15 bp, Homo sapiens
cactgaccagaacta

SEQ ID NO: 1598481 - DNA, 17 bp, Homo sapiens
cactgaccagcggctgc

SEQ ID NO: 1598482 - DNA, 18 bp, Homo sapiens
cactgaccagcggctgct

SEQ ID NO: 1598483 - DNA, 20 bp, Homo sapiens
cactgaccagcggctgctca

SEQ ID NO: 1598484 - DNA, 16 bp, Homo sapiens
cactgaccatccactc

SEQ ID NO: 1598485 - DNA, 14 bp, Homo sapiens
cactgacccttcca

SEQ ID NO: 1598486 - DNA, 15 bp, Homo sapiens
cactgacccttccag

SEQ ID NO: 1598487 - DNA, 21 bp, Homo sapiens
cactgacccttccagacatac

SEQ ID NO: 1598488 - DNA, 14 bp, Homo sapiens
cactgactcctgtg

SEQ ID NO: 1598489 - DNA, 13 bp, Homo sapiens
cactgacttgctg

SEQ ID NO: 1598490 - DNA, 21 bp, Homo sapiens
cactgagaatgtaagaactac

SEQ ID NO: 1598491 - DNA, 20 bp, Homo sapiens
cactgagactttcccctctc

SEQ ID NO: 1598492 - DNA, 20 bp, Homo sapiens
cactgagagggcaaggaagt

SEQ ID NO: 1598493 - DNA, 21 bp, Homo sapiens
cactgagcatcactagtgaca

SEQ ID NO: 1598494 - DNA, 22 bp, Homo sapiens
cactgagcatcactagtgacaa

SEQ ID NO: 1598495 - DNA, 14 bp, Homo sapiens
cactgagccccccc

SEQ ID NO: 1598496 - DNA, 16 bp, Homo sapiens
cactgagcccccccaa

SEQ ID NO: 1598497 - DNA, 15 bp, Homo sapiens
cactgaggaagaacg

SEQ ID NO: 1598498 - DNA, 19 bp, Homo sapiens
cactgaggagacagaaagc

SEQ ID NO: 1598499 - DNA, 20 bp, Homo sapiens
cactgaggcagcgacctcaa

SEQ ID NO: 1598500 - DNA, 14 bp, Homo sapiens
cactgagggccaca

SEQ ID NO: 1598501 - DNA, 18 bp, Homo sapiens
cactgatgagtttcactg

SEQ ID NO: 1598502 - DNA, 12 bp, Homo sapiens
cactgatgctgc

SEQ ID NO: 1598503 - DNA, 17 bp, Homo sapiens
cactgatgctgcccctc

SEQ ID NO: 1598504 - DNA, 14 bp, Homo sapiens
cactgatggctcaa

SEQ ID NO: 1598505 - DNA, 15 bp, Homo sapiens
cactgatggctcaag

SEQ ID NO: 1598506 - DNA, 16 bp, Homo sapiens
cactgatggctcaaga

SEQ ID NO: 1598507 - DNA, 20 bp, Homo sapiens
cactgatggctcaagacaag

SEQ ID NO: 1598508 - DNA, 17 bp, Homo sapiens
cactgatgtgactttta

SEQ ID NO: 1598509 - DNA, 13 bp, Homo sapiens
cactgatttcaca

SEQ ID NO: 1598510 - DNA, 21 bp, Homo sapiens
cactgatttcacaacagatca

SEQ ID NO: 1598511 - DNA, 22 bp, Homo sapiens
cactgcaacttccgcctcctgt

SEQ ID NO: 1598512 - DNA, 17 bp, Homo sapiens
cactgcaacttctgcct

SEQ ID NO: 1598513 - DNA, 18 bp, Homo sapiens
cactgcaagaagtcttga

SEQ ID NO: 1598514 - DNA, 13 bp, Homo sapiens
cactgcaagagcc

SEQ ID NO: 1598515 - DNA, 16 bp, Homo sapiens
cactgcaagagccttg

SEQ ID NO: 1598516 - DNA, 16 bp, Homo sapiens
cactgcaatcctgtct

SEQ ID NO: 1598517 - DNA, 22 bp, Homo sapiens
cactgcacagtgcatctcagcc

SEQ ID NO: 1598518 - DNA, 21 bp, Homo sapiens
cactgcactcaaccttaagac

SEQ ID NO: 1598519 - DNA, 12 bp, Homo sapiens
cactgcactcca

SEQ ID NO: 1598520 - DNA, 16 bp, Homo sapiens
cactgcaggccccgct

SEQ ID NO: 1598521 - DNA, 23 bp, Homo sapiens
cactgcagtccgcagtctggcct

SEQ ID NO: 1598522 - DNA, 15 bp, Homo sapiens
cactgcagtgatggc

SEQ ID NO: 1598523 - DNA, 22 bp, Homo sapiens
cactgcatgagcttttatacta

SEQ ID NO: 1598524 - DNA, 19 bp, Homo sapiens
cactgccacaccctcccca

SEQ ID NO: 1598525 - DNA, 12 bp, Homo sapiens
cactgccactgg

SEQ ID NO: 1598526 - DNA, 22 bp, Homo sapiens
cactgccagaagagaattcagt

SEQ ID NO: 1598527 - DNA, 13 bp, Homo sapiens
cactgccagcagc

SEQ ID NO: 1598528 - DNA, 20 bp, Homo sapiens
cactgccagcagcagcaggt

SEQ ID NO: 1598529 - DNA, 22 bp, Homo sapiens
cactgccagcagcagcaggtga

SEQ ID NO: 1598530 - DNA, 12 bp, Homo sapiens
cactgccaggca

SEQ ID NO: 1598531 - DNA, 13 bp, Homo sapiens
cactgccaggcac

SEQ ID NO: 1598532 - DNA, 14 bp, Homo sapiens
cactgccaggcacc

SEQ ID NO: 1598533 - DNA, 12 bp, Homo sapiens
cactgccaggcc

SEQ ID NO: 1598534 - DNA, 13 bp, Homo sapiens
cactgccaggcca

SEQ ID NO: 1598535 - DNA, 21 bp, Homo sapiens
cactgccaggccagcctccga

SEQ ID NO: 1598536 - DNA, 22 bp, Homo sapiens
cactgccatgcaccaggactgg

SEQ ID NO: 1598537 - DNA, 22 bp, Homo sapiens
cactgccattacccagtgccga

SEQ ID NO: 1598538 - DNA, 20 bp, Homo sapiens
cactgccccccgaggctgct

SEQ ID NO: 1598539 - DNA, 17 bp, Homo sapiens
cactgccccctgctgcc

SEQ ID NO: 1598540 - DNA, 19 bp, Homo sapiens
cactgccccctgctgccat

SEQ ID NO: 1598541 - DNA, 14 bp, Homo sapiens
cactgccctgcctg

SEQ ID NO: 1598542 - DNA, 17 bp, Homo sapiens
cactgccctgcctgccc

SEQ ID NO: 1598543 - DNA, 15 bp, Homo sapiens
cactgccctggcagc

SEQ ID NO: 1598544 - DNA, 20 bp, Homo sapiens
cactgcccttttcaggaagc

SEQ ID NO: 1598545 - DNA, 22 bp, Homo sapiens
cactgccgacatccctccccca

SEQ ID NO: 1598546 - DNA, 22 bp, Homo sapiens
cactgcctaggaggctggccaa

SEQ ID NO: 1598547 - DNA, 16 bp, Homo sapiens
cactgcctctccctgg

SEQ ID NO: 1598548 - DNA, 15 bp, Homo sapiens
cactgcctctggaat

SEQ ID NO: 1598549 - DNA, 22 bp, Homo sapiens
cactgcctgcagaggtctgtgc

SEQ ID NO: 1598550 - DNA, 17 bp, Homo sapiens
cactgcctgcatgagct

SEQ ID NO: 1598551 - DNA, 19 bp, Homo sapiens
cactgcctgggctgacccc

SEQ ID NO: 1598552 - DNA, 21 bp, Homo sapiens
cactgccttcgcttcttgcct

SEQ ID NO: 1598553 - DNA, 23 bp, Homo sapiens
cactgccttcgcttcttgcctct

SEQ ID NO: 1598554 - DNA, 19 bp, Homo sapiens
cactgcctttttatttata

SEQ ID NO: 1598555 - DNA, 22 bp, Homo sapiens
cactgcgaagaccctcttgccc

SEQ ID NO: 1598556 - DNA, 16 bp, Homo sapiens
cactgcgcaggtctct

SEQ ID NO: 1598557 - DNA, 22 bp, Homo sapiens
cactgcgcaggtctcttctggg

SEQ ID NO: 1598558 - DNA, 17 bp, Homo sapiens
cactgcggaagccaaag

SEQ ID NO: 1598559 - DNA, 18 bp, Homo sapiens
cactgcgggagctctgta

SEQ ID NO: 1598560 - DNA, 20 bp, Homo sapiens
cactgcgggagctctgtatg

SEQ ID NO: 1598561 - DNA, 22 bp, Homo sapiens
cactgctagagacgctgatcca

SEQ ID NO: 1598562 - DNA, 19 bp, Homo sapiens
cactgctcaagaagacatg

SEQ ID NO: 1598563 - DNA, 17 bp, Homo sapiens
cactgctcacgtctctg

SEQ ID NO: 1598564 - DNA, 18 bp, Homo sapiens
cactgctcacgtctctgc

SEQ ID NO: 1598565 - DNA, 19 bp, Homo sapiens
cactgctcacgtctctgcc

SEQ ID NO: 1598566 - DNA, 20 bp, Homo sapiens
cactgctcacgtctctgccg

SEQ ID NO: 1598567 - DNA, 22 bp, Homo sapiens
cactgctcacgtctctgccgcc

SEQ ID NO: 1598568 - DNA, 19 bp, Homo sapiens
cactgctcgtggactgtgc

SEQ ID NO: 1598569 - DNA, 15 bp, Homo sapiens
cactgctctaacagc

SEQ ID NO: 1598570 - DNA, 19 bp, Homo sapiens
cactgctctaacagccctc

SEQ ID NO: 1598571 - DNA, 13 bp, Homo sapiens
cactgctctcagc

SEQ ID NO: 1598572 - DNA, 17 bp, Homo sapiens
cactgctctcagcctcc

SEQ ID NO: 1598573 - DNA, 12 bp, Homo sapiens
cactgctgcacc

SEQ ID NO: 1598574 - DNA, 15 bp, Homo sapiens
cactgctgcaccaga

SEQ ID NO: 1598575 - DNA, 16 bp, Homo sapiens
cactgctgcaccagag

SEQ ID NO: 1598576 - DNA, 17 bp, Homo sapiens
cactgctggacatgaga

SEQ ID NO: 1598577 - DNA, 12 bp, Homo sapiens
cactgctggctg

SEQ ID NO: 1598578 - DNA, 22 bp, Homo sapiens
cactgctggctgcagcggcagg

SEQ ID NO: 1598579 - DNA, 15 bp, Homo sapiens
cactgctggctgcct

SEQ ID NO: 1598580 - DNA, 18 bp, Homo sapiens
cactgctggggagtccct

SEQ ID NO: 1598581 - DNA, 13 bp, Homo sapiens
cactgctgtccac

SEQ ID NO: 1598582 - DNA, 16 bp, Homo sapiens
cactgcttcccactgg

SEQ ID NO: 1598583 - DNA, 19 bp, Homo sapiens
cactgcttcccactggggc

SEQ ID NO: 1598584 - DNA, 20 bp, Homo sapiens
cactgcttgaactaggctga

SEQ ID NO: 1598585 - DNA, 12 bp, Homo sapiens
cactgctttgca

SEQ ID NO: 1598586 - DNA, 21 bp, Homo sapiens
cactgcttttccctttgtgag

SEQ ID NO: 1598587 - DNA, 15 bp, Homo sapiens
cactggaaaggggag

SEQ ID NO: 1598588 - DNA, 16 bp, Homo sapiens
cactggaaaggggaga

SEQ ID NO: 1598589 - DNA, 23 bp, Homo sapiens
cactggaaaggggagagcctgct

SEQ ID NO: 1598590 - DNA, 16 bp, Homo sapiens
cactggaaccacctgg

SEQ ID NO: 1598591 - DNA, 12 bp, Homo sapiens
cactggaatata

SEQ ID NO: 1598592 - DNA, 22 bp, Homo sapiens
cactggaatataaaacagtcat

SEQ ID NO: 1598593 - DNA, 15 bp, Homo sapiens
cactggaccaggtcc

SEQ ID NO: 1598594 - DNA, 14 bp, Homo sapiens
cactggactgcatg

SEQ ID NO: 1598595 - DNA, 22 bp, Homo sapiens
cactggactgcatggggaggca

SEQ ID NO: 1598596 - DNA, 22 bp, Homo sapiens
cactggagagcacagcatgcct

SEQ ID NO: 1598597 - DNA, 21 bp, Homo sapiens
cactggagcaccaggcacgaa

SEQ ID NO: 1598598 - DNA, 18 bp, Homo sapiens
cactggaggagcagcttc

SEQ ID NO: 1598599 - DNA, 18 bp, Homo sapiens
cactggaggttgaagcca

SEQ ID NO: 1598600 - DNA, 18 bp, Homo sapiens
cactggagtgcagggagg

SEQ ID NO: 1598601 - DNA, 22 bp, Homo sapiens
cactggagttacattaatgtta

SEQ ID NO: 1598602 - DNA, 19 bp, Homo sapiens
cactggatgcaaagaaaat

SEQ ID NO: 1598603 - DNA, 14 bp, Homo sapiens
cactggcagcctgc

SEQ ID NO: 1598604 - DNA, 15 bp, Homo sapiens
cactggcagcctgca

SEQ ID NO: 1598605 - DNA, 10 bp, Homo sapiens
cactggccac

SEQ ID NO: 1598606 - DNA, 12 bp, Homo sapiens
cactggccacca

SEQ ID NO: 1598607 - DNA, 14 bp, Homo sapiens
cactggccaccagg

SEQ ID NO: 1598608 - DNA, 15 bp, Homo sapiens
cactggccaccaggc

SEQ ID NO: 1598609 - DNA, 16 bp, Homo sapiens
cactggccaccaggct

SEQ ID NO: 1598610 - DNA, 18 bp, Homo sapiens
caccccggccccctgccc

SEQ ID NO: 1598611 - DNA, 19 bp, Homo sapiens
caccccggcctcagggcgc

SEQ ID NO: 1598612 - DNA, 16 bp, Homo sapiens
caccccggcctccact

SEQ ID NO: 1598613 - DNA, 18 bp, Homo sapiens
caccccggggaccctgtg

SEQ ID NO: 1598614 - DNA, 22 bp, Homo sapiens
caccccgtctggggttcagccc

SEQ ID NO: 1598615 - DNA, 15 bp, Homo sapiens
caccccgtgccaccc

SEQ ID NO: 1598616 - DNA, 16 bp, Homo sapiens
cacccctaagtgccca

SEQ ID NO: 1598617 - DNA, 16 bp, Homo sapiens
cacccctacagcctgc

SEQ ID NO: 1598618 - DNA, 13 bp, Homo sapiens
cacccctagccct

SEQ ID NO: 1598619 - DNA, 16 bp, Homo sapiens
cacccctagccctggt

SEQ ID NO: 1598620 - DNA, 17 bp, Homo sapiens
cacccctagccctggtt

SEQ ID NO: 1598621 - DNA, 14 bp, Homo sapiens
cacccctcactccc

SEQ ID NO: 1598622 - DNA, 17 bp, Homo sapiens
cacccctcactccccag

SEQ ID NO: 1598623 - DNA, 13 bp, Homo sapiens
cacccctccccat

SEQ ID NO: 1598624 - DNA, 15 bp, Homo sapiens
cacccctcccctgcc

SEQ ID NO: 1598625 - DNA, 22 bp, Homo sapiens
cacccctcccctgccctagagc

SEQ ID NO: 1598626 - DNA, 22 bp, Homo sapiens
cacccctctgtctaggactgca

SEQ ID NO: 1598627 - DNA, 14 bp, Homo sapiens
cacccctgccccca

SEQ ID NO: 1598628 - DNA, 23 bp, Homo sapiens
cacccctggggctgagtctccag

SEQ ID NO: 1598629 - DNA, 17 bp, Homo sapiens
cacccctggttctcatc

SEQ ID NO: 1598630 - DNA, 23 bp, Homo sapiens
cacccctgtcccacccacacagc

SEQ ID NO: 1598631 - DNA, 17 bp, Homo sapiens
cacccctgtgctccgtg

SEQ ID NO: 1598632 - DNA, 21 bp, Homo sapiens
cacccctgtgctccgtgcctc

SEQ ID NO: 1598633 - DNA, 23 bp, Homo sapiens
cacccctgtgctccgtgcctcca

SEQ ID NO: 1598634 - DNA, 11 bp, Homo sapiens
caccccttcca

SEQ ID NO: 1598635 - DNA, 16 bp, Homo sapiens
caccccttccatgtgg

SEQ ID NO: 1598636 - DNA, 18 bp, Homo sapiens
caccccttccccaggccc

SEQ ID NO: 1598637 - DNA, 21 bp, Homo sapiens
caccccttctctcctccccaa

SEQ ID NO: 1598638 - DNA, 17 bp, Homo sapiens
caccccttggaggagag

SEQ ID NO: 1598639 - DNA, 21 bp, Homo sapiens
caccccttggaggagagagac

SEQ ID NO: 1598640 - DNA, 15 bp, Homo sapiens
caccccttgtttctg

SEQ ID NO: 1598641 - DNA, 21 bp, Homo sapiens
cacccgaagcgcttctgcacc

SEQ ID NO: 1598642 - DNA, 17 bp, Homo sapiens
cacccgagttcctctgg

SEQ ID NO: 1598643 - DNA, 19 bp, Homo sapiens
cacccgatgctgctttccc

SEQ ID NO: 1598644 - DNA, 23 bp, Homo sapiens
cacccgatgctgctttcccctgt

SEQ ID NO: 1598645 - DNA, 13 bp, Homo sapiens
cacccgcctctcc

SEQ ID NO: 1598646 - DNA, 14 bp, Homo sapiens
cacccgcctctccc

SEQ ID NO: 1598647 - DNA, 17 bp, Homo sapiens
cacccggccacagctgc

SEQ ID NO: 1598648 - DNA, 17 bp, Homo sapiens
cacccggctggccggga

SEQ ID NO: 1598649 - DNA, 17 bp, Homo sapiens
cacccgtaggcagcctc

SEQ ID NO: 1598650 - DNA, 20 bp, Homo sapiens
cacccgtcttcaatctctgt

SEQ ID NO: 1598651 - DNA, 21 bp, Homo sapiens
cacccgtcttcaatctctgtt

SEQ ID NO: 1598652 - DNA, 12 bp, Homo sapiens
caccctacctgt

SEQ ID NO: 1598653 - DNA, 18 bp, Homo sapiens
caccctaccttccccaga

SEQ ID NO: 1598654 - DNA, 20 bp, Homo sapiens
caccctaccttccccagact

SEQ ID NO: 1598655 - DNA, 17 bp, Homo sapiens
caccctaggcagcctgc

SEQ ID NO: 1598656 - DNA, 20 bp, Homo sapiens
caccctagtcccttcccctc

SEQ ID NO: 1598657 - DNA, 16 bp, Homo sapiens
caccctagtttccctg

SEQ ID NO: 1598658 - DNA, 19 bp, Homo sapiens
caccctcagcaccccttcc

SEQ ID NO: 1598659 - DNA, 19 bp, Homo sapiens
caccctcataccatctgct

SEQ ID NO: 1598660 - DNA, 22 bp, Homo sapiens
caccctcataccatctgctgcc

SEQ ID NO: 1598661 - DNA, 15 bp, Homo sapiens
caccctcatccttta

SEQ ID NO: 1598662 - DNA, 17 bp, Homo sapiens
caccctccaccttccat

SEQ ID NO: 1598663 - DNA, 15 bp, Homo sapiens
caccctccactcagc

SEQ ID NO: 1598664 - DNA, 14 bp, Homo sapiens
caccctccatgctc

SEQ ID NO: 1598665 - DNA, 22 bp, Homo sapiens
caccctccatgctcctcacctg

SEQ ID NO: 1598666 - DNA, 21 bp, Homo sapiens
caccctcccctatgctggtag

SEQ ID NO: 1598667 - DNA, 13 bp, Homo sapiens
caccctcccctct

SEQ ID NO: 1598668 - DNA, 15 bp, Homo sapiens
caccctcccctctct

SEQ ID NO: 1598669 - DNA, 19 bp, Homo sapiens
caccctccggccagcgagt

SEQ ID NO: 1598670 - DNA, 16 bp, Homo sapiens
caccctctaaatggga

SEQ ID NO: 1598671 - DNA, 12 bp, Homo sapiens
caccctctgccg

SEQ ID NO: 1598672 - DNA, 19 bp, Homo sapiens
caccctctgggggtcctct

SEQ ID NO: 1598673 - DNA, 20 bp, Homo sapiens
caccctctgggggtcctctc

SEQ ID NO: 1598674 - DNA, 23 bp, Homo sapiens
caccctctgggggtcctctctga

SEQ ID NO: 1598675 - DNA, 15 bp, Homo sapiens
caccctcttcctgtg

SEQ ID NO: 1598676 - DNA, 12 bp, Homo sapiens
caccctgagccg

SEQ ID NO: 1598677 - DNA, 14 bp, Homo sapiens
caccctgcagagca

SEQ ID NO: 1598678 - DNA, 20 bp, Homo sapiens
caccctgcagagcacacagg

SEQ ID NO: 1598679 - DNA, 17 bp, Homo sapiens
caccctgcccctcagag

SEQ ID NO: 1598680 - DNA, 13 bp, Homo sapiens
caccctgcccgct

SEQ ID NO: 1598681 - DNA, 16 bp, Homo sapiens
caccctgcgcctccag

SEQ ID NO: 1598682 - DNA, 19 bp, Homo sapiens
caccctgcgcctccagagg

SEQ ID NO: 1598683 - DNA, 20 bp, Homo sapiens
caccctgcgcctccagaggt

SEQ ID NO: 1598684 - DNA, 20 bp, Homo sapiens
caccctgctgctggtgcaca

SEQ ID NO: 1598685 - DNA, 21 bp, Homo sapiens
caccctggaggatttcatctc

SEQ ID NO: 1598686 - DNA, 11 bp, Homo sapiens
caccctggcct

SEQ ID NO: 1598687 - DNA, 12 bp, Homo sapiens
caccctggcctg

SEQ ID NO: 1598688 - DNA, 13 bp, Homo sapiens
caccctggcctga

SEQ ID NO: 1598689 - DNA, 21 bp, Homo sapiens
caccctggcctgaactgagga

SEQ ID NO: 1598690 - DNA, 15 bp, Homo sapiens
caccctggcctggtc

SEQ ID NO: 1598691 - DNA, 21 bp, Homo sapiens
caccctgggccctgggctgga

SEQ ID NO: 1598692 - DNA, 23 bp, Homo sapiens
caccctgggccctgggctggaat

SEQ ID NO: 1598693 - DNA, 12 bp, Homo sapiens
caccctgggctc

SEQ ID NO: 1598694 - DNA, 13 bp, Homo sapiens
caccctgggctcc

SEQ ID NO: 1598695 - DNA, 16 bp, Homo sapiens
caccctgggctccaca

SEQ ID NO: 1598696 - DNA, 19 bp, Homo sapiens
caccctgggctccacacag

SEQ ID NO: 1598697 - DNA, 22 bp, Homo sapiens
caccctgggctccacacagcag

SEQ ID NO: 1598698 - DNA, 14 bp, Homo sapiens
caccctggggcctg

SEQ ID NO: 1598699 - DNA, 19 bp, Homo sapiens
caccctggggcctggacct

SEQ ID NO: 1598700 - DNA, 22 bp, Homo sapiens
caccctggggcctggacctgcc

SEQ ID NO: 1598701 - DNA, 17 bp, Homo sapiens
caccctgggtgccattc

SEQ ID NO: 1598702 - DNA, 17 bp, Homo sapiens
caccctggtcctgactt

SEQ ID NO: 1598703 - DNA, 22 bp, Homo sapiens
caccctggtcctgacttccctg

SEQ ID NO: 1598704 - DNA, 13 bp, Homo sapiens
caccctgtcaagt

SEQ ID NO: 1598705 - DNA, 23 bp, Homo sapiens
caccctgtccaaactgcctaagc

SEQ ID NO: 1598706 - DNA, 15 bp, Homo sapiens
caccctgtcccccag

SEQ ID NO: 1598707 - DNA, 17 bp, Homo sapiens
caccctgtctaaaaaac

SEQ ID NO: 1598708 - DNA, 13 bp, Homo sapiens
cacccttccatca

SEQ ID NO: 1598709 - DNA, 15 bp, Homo sapiens
cacccttccatcagc

SEQ ID NO: 1598710 - DNA, 13 bp, Homo sapiens
cacccttcccctc

SEQ ID NO: 1598711 - DNA, 22 bp, Homo sapiens
cacccttcccctccttctccct

SEQ ID NO: 1598712 - DNA, 16 bp, Homo sapiens
cacccttccctcttcc

SEQ ID NO: 1598713 - DNA, 21 bp, Homo sapiens
cacccttccctcttccctctc

SEQ ID NO: 1598714 - DNA, 20 bp, Homo sapiens
cacccttccctgctcccacc

SEQ ID NO: 1598715 - DNA, 20 bp, Homo sapiens
cacccttggaggctgtcttc

SEQ ID NO: 1598716 - DNA, 12 bp, Homo sapiens
cacccttggcct

SEQ ID NO: 1598717 - DNA, 15 bp, Homo sapiens
cacccttggcctgtc

SEQ ID NO: 1598718 - DNA, 14 bp, Homo sapiens
caccgacagcggcc

SEQ ID NO: 1598719 - DNA, 18 bp, Homo sapiens
caccgaccaactgcccta

SEQ ID NO: 1598720 - DNA, 18 bp, Homo sapiens
caccgagagtagccgaga

SEQ ID NO: 1598721 - DNA, 16 bp, Homo sapiens
caccgagccagcttgg

SEQ ID NO: 1598722 - DNA, 13 bp, Homo sapiens
caccgaggggcct

SEQ ID NO: 1598723 - DNA, 15 bp, Homo sapiens
caccgcagcgtcccc

SEQ ID NO: 1598724 - DNA, 16 bp, Homo sapiens
caccgcagcgtccccc

SEQ ID NO: 1598725 - DNA, 20 bp, Homo sapiens
caccgcagcgtcccccgccg

SEQ ID NO: 1598726 - DNA, 14 bp, Homo sapiens
caccgcccccaccc

SEQ ID NO: 1598727 - DNA, 18 bp, Homo sapiens
caccaaagctgcccactg

SEQ ID NO: 1598728 - DNA, 22 bp, Homo sapiens
caccaacatcccattgccctgg

SEQ ID NO: 1598729 - DNA, 18 bp, Homo sapiens
caccaactcctaatttta

SEQ ID NO: 1598730 - DNA, 16 bp, Homo sapiens
caccaactctgcactc

SEQ ID NO: 1598731 - DNA, 19 bp, Homo sapiens
caccaactctgcactccat

SEQ ID NO: 1598732 - DNA, 13 bp, Homo sapiens
caccaacttgcca

SEQ ID NO: 1598733 - DNA, 15 bp, Homo sapiens
caccaagagcagctg

SEQ ID NO: 1598734 - DNA, 14 bp, Homo sapiens
caccaagctcacag

SEQ ID NO: 1598735 - DNA, 20 bp, Homo sapiens
caccaagctcacagttcctc

SEQ ID NO: 1598736 - DNA, 20 bp, Homo sapiens
caccaaggaaacgctacctc

SEQ ID NO: 1598737 - DNA, 18 bp, Homo sapiens
caccaagtccccttctgt

SEQ ID NO: 1598738 - DNA, 13 bp, Homo sapiens
caccaagtgcaat

SEQ ID NO: 1598739 - DNA, 14 bp, Homo sapiens
caccaataaatgtt

SEQ ID NO: 1598740 - DNA, 23 bp, Homo sapiens
caccaataatggggcagacacaa

SEQ ID NO: 1598741 - DNA, 21 bp, Homo sapiens
caccaatattaacacgctgcc

SEQ ID NO: 1598742 - DNA, 13 bp, Homo sapiens
caccaatgaaaac

SEQ ID NO: 1598743 - DNA, 14 bp, Homo sapiens
caccaatgagcctt

SEQ ID NO: 1598744 - DNA, 15 bp, Homo sapiens
caccacactgggtgc

SEQ ID NO: 1598745 - DNA, 16 bp, Homo sapiens
caccacagacacacac

SEQ ID NO: 1598746 - DNA, 17 bp, Homo sapiens
caccacagccagcacct

SEQ ID NO: 1598747 - DNA, 22 bp, Homo sapiens
caccacatagcatgcttccttt

SEQ ID NO: 1598748 - DNA, 21 bp, Homo sapiens
caccaccaaatgccaagaaaa

SEQ ID NO: 1598749 - DNA, 13 bp, Homo sapiens
caccaccaagcca

SEQ ID NO: 1598750 - DNA, 13 bp, Homo sapiens
caccaccactggc

SEQ ID NO: 1598751 - DNA, 11 bp, Homo sapiens
caccaccagga

SEQ ID NO: 1598752 - DNA, 13 bp, Homo sapiens
caccaccaggagc

SEQ ID NO: 1598753 - DNA, 20 bp, Homo sapiens
caccaccccctgtcccattc

SEQ ID NO: 1598754 - DNA, 23 bp, Homo sapiens
caccacccgctttcttgctggtt

SEQ ID NO: 1598755 - DNA, 13 bp, Homo sapiens
caccacccttcca

SEQ ID NO: 1598756 - DNA, 22 bp, Homo sapiens
caccacctaggccactcctcca

SEQ ID NO: 1598757 - DNA, 17 bp, Homo sapiens
caccacctcactcctgt

SEQ ID NO: 1598758 - DNA, 15 bp, Homo sapiens
caccaccttcccagc

SEQ ID NO: 1598759 - DNA, 15 bp, Homo sapiens
caccacgatgtggcc

SEQ ID NO: 1598760 - DNA, 18 bp, Homo sapiens
caccacgatgtggccctg

SEQ ID NO: 1598761 - DNA, 21 bp, Homo sapiens
caccacgatgtggccctggcc

SEQ ID NO: 1598762 - DNA, 22 bp, Homo sapiens
caccacggcgttgtacctgtag

SEQ ID NO: 1598763 - DNA, 22 bp, Homo sapiens
caccacgggacatcacagggtg

SEQ ID NO: 1598764 - DNA, 11 bp, Homo sapiens
caccacgtctg

SEQ ID NO: 1598765 - DNA, 14 bp, Homo sapiens
caccacgtctgcca

SEQ ID NO: 1598766 - DNA, 18 bp, Homo sapiens
caccacgtctgccaggcc

SEQ ID NO: 1598767 - DNA, 21 bp, Homo sapiens
caccactaaccatccccaact

SEQ ID NO: 1598768 - DNA, 19 bp, Homo sapiens
caccactaggaatcccaga

SEQ ID NO: 1598769 - DNA, 20 bp, Homo sapiens
caccactaggaatcccagag

SEQ ID NO: 1598770 - DNA, 20 bp, Homo sapiens
caccactaggactctgaggc

SEQ ID NO: 1598771 - DNA, 23 bp, Homo sapiens
caccactatctccgttccatctg

SEQ ID NO: 1598772 - DNA, 13 bp, Homo sapiens
caccactgcactc

SEQ ID NO: 1598773 - DNA, 20 bp, Homo sapiens
caccactgcactccagcctg

SEQ ID NO: 1598774 - DNA, 22 bp, Homo sapiens
caccactgccattacccagtgc

SEQ ID NO: 1598775 - DNA, 13 bp, Homo sapiens
caccactgcttcc

SEQ ID NO: 1598776 - DNA, 19 bp, Homo sapiens
caccactgcttcccactgg

SEQ ID NO: 1598777 - DNA, 23 bp, Homo sapiens
caccactgcttcccactggggcc

SEQ ID NO: 1598778 - DNA, 16 bp, Homo sapiens
caccactggccaccag

SEQ ID NO: 1598779 - DNA, 18 bp, Homo sapiens
caccactggccaccaggc

SEQ ID NO: 1598780 - DNA, 21 bp, Homo sapiens
caccactggccaccaggctgg

SEQ ID NO: 1598781 - DNA, 13 bp, Homo sapiens
caccagaagttac

SEQ ID NO: 1598782 - DNA, 15 bp, Homo sapiens
caccagacacccagg

SEQ ID NO: 1598783 - DNA, 20 bp, Homo sapiens
caccagacacccaggactta

SEQ ID NO: 1598784 - DNA, 21 bp, Homo sapiens
caccagagcatttccaacacc

SEQ ID NO: 1598785 - DNA, 16 bp, Homo sapiens
caccagagcccatgct

SEQ ID NO: 1598786 - DNA, 13 bp, Homo sapiens
caccagagctgcc

SEQ ID NO: 1598787 - DNA, 14 bp, Homo sapiens
caccagagcttctc

SEQ ID NO: 1598788 - DNA, 16 bp, Homo sapiens
caccagagcttctctg

SEQ ID NO: 1598789 - DNA, 17 bp, Homo sapiens
caccagagcttctctgg

SEQ ID NO: 1598790 - DNA, 20 bp, Homo sapiens
caccagagcttctctgggct

SEQ ID NO: 1598791 - DNA, 12 bp, Homo sapiens
caccagagtgaa

SEQ ID NO: 1598792 - DNA, 17 bp, Homo sapiens
caccagcaacatctcga

SEQ ID NO: 1598793 - DNA, 10 bp, Homo sapiens
caccagcagc

SEQ ID NO: 1598794 - DNA, 19 bp, Homo sapiens
caccagcatcacctgcctg

SEQ ID NO: 1598795 - DNA, 11 bp, Homo sapiens
caccagccagc

SEQ ID NO: 1598796 - DNA, 21 bp, Homo sapiens
caccagccccactgccagcag

SEQ ID NO: 1598797 - DNA, 14 bp, Homo sapiens
caccagccccagca

SEQ ID NO: 1598798 - DNA, 15 bp, Homo sapiens
caccagccccagcaa

SEQ ID NO: 1598799 - DNA, 16 bp, Homo sapiens
caccagccccagcaag

SEQ ID NO: 1598800 - DNA, 19 bp, Homo sapiens
caccatatgaattgtacag

SEQ ID NO: 1598801 - DNA, 20 bp, Homo sapiens
caccatatgaattgtacaga

SEQ ID NO: 1598802 - DNA, 21 bp, Homo sapiens
caccatattcagtgctgtggc

SEQ ID NO: 1598803 - DNA, 21 bp, Homo sapiens
caccatattggccagtctggt

SEQ ID NO: 1598804 - DNA, 22 bp, Homo sapiens
caccatcatgtttcagtgaaga

SEQ ID NO: 1598805 - DNA, 13 bp, Homo sapiens
caccatccagtgg

SEQ ID NO: 1598806 - DNA, 17 bp, Homo sapiens
caccatcctgagccagg

SEQ ID NO: 1598807 - DNA, 15 bp, Homo sapiens
caccatcctgcagcc

SEQ ID NO: 1598808 - DNA, 21 bp, Homo sapiens
caccatcctgcagcctcctcc

SEQ ID NO: 1598809 - DNA, 12 bp, Homo sapiens
caccatctgctt

SEQ ID NO: 1598810 - DNA, 17 bp, Homo sapiens
caccatgctgctgggga

SEQ ID NO: 1598811 - DNA, 19 bp, Homo sapiens
caccatgctgctggggaag

SEQ ID NO: 1598812 - DNA, 19 bp, Homo sapiens
caccatggtcatcaccacc

SEQ ID NO: 1598813 - DNA, 15 bp, Homo sapiens
caccatgtattttgt

SEQ ID NO: 1598814 - DNA, 15 bp, Homo sapiens
caccatgtgcaataa

SEQ ID NO: 1598815 - DNA, 19 bp, Homo sapiens
caccatgtgggcacggagg

SEQ ID NO: 1598816 - DNA, 23 bp, Homo sapiens
caccatgtttgagctcagacccc

SEQ ID NO: 1598817 - DNA, 19 bp, Homo sapiens
caccattatattttgaaag

SEQ ID NO: 1598818 - DNA, 21 bp, Homo sapiens
caccattcacatttgatgtac

SEQ ID NO: 1598819 - DNA, 22 bp, Homo sapiens
caccattcctgcctttaagcca

SEQ ID NO: 1598820 - DNA, 13 bp, Homo sapiens
caccattctacct

SEQ ID NO: 1598821 - DNA, 13 bp, Homo sapiens
caccattctgact

SEQ ID NO: 1598822 - DNA, 13 bp, Homo sapiens
caccattgaaggc

SEQ ID NO: 1598823 - DNA, 15 bp, Homo sapiens
caccattgaaggctt

SEQ ID NO: 1598824 - DNA, 18 bp, Homo sapiens
caccatttctgtcactca

SEQ ID NO: 1598825 - DNA, 18 bp, Homo sapiens
caccatttcttggcattg

SEQ ID NO: 1598826 - DNA, 14 bp, Homo sapiens
cacccaaacacttc

SEQ ID NO: 1598827 - DNA, 17 bp, Homo sapiens
cacccaaacacttctgc

SEQ ID NO: 1598828 - DNA, 22 bp, Homo sapiens
cacccaaagaggtatttatctt

SEQ ID NO: 1598829 - DNA, 17 bp, Homo sapiens
cacccaaagcatggact

SEQ ID NO: 1598830 - DNA, 18 bp, Homo sapiens
cacccaaagcatggacta

SEQ ID NO: 1598831 - DNA, 15 bp, Homo sapiens
cacccaaagctgagc

SEQ ID NO: 1598832 - DNA, 19 bp, Homo sapiens
cacccaaagctgagcctgc

SEQ ID NO: 1598833 - DNA, 22 bp, Homo sapiens
cacccaaagctgagcctgcagg

SEQ ID NO: 1598834 - DNA, 15 bp, Homo sapiens
cacccaagccacaag

SEQ ID NO: 1598835 - DNA, 16 bp, Homo sapiens
cacccaagcctgctgg

SEQ ID NO: 1598836 - DNA, 18 bp, Homo sapiens
cacccaagcctgctggct

SEQ ID NO: 1598837 - DNA, 20 bp, Homo sapiens
cacccaagcctgctggctgc

SEQ ID NO: 1598838 - DNA, 14 bp, Homo sapiens
cacccaagcttggc

SEQ ID NO: 1598839 - DNA, 15 bp, Homo sapiens
cacccaattttaaaa

SEQ ID NO: 1598840 - DNA, 14 bp, Homo sapiens
cacccacacagctg

SEQ ID NO: 1598841 - DNA, 15 bp, Homo sapiens
cacccacacagctgc

SEQ ID NO: 1598842 - DNA, 17 bp, Homo sapiens
cacccacacagctgccc

SEQ ID NO: 1598843 - DNA, 18 bp, Homo sapiens
cacccacacagctgccct

SEQ ID NO: 1598844 - DNA, 24 bp, Homo sapiens
cacccacacagctgccctagctga

SEQ ID NO: 1598845 - DNA, 19 bp, Homo sapiens
cacccacatgtgacacata

SEQ ID NO: 1598846 - DNA, 15 bp, Homo sapiens
cacccaccagggcga

SEQ ID NO: 1598847 - DNA, 12 bp, Homo sapiens
cacccaccccct

SEQ ID NO: 1598848 - DNA, 13 bp, Homo sapiens
cacccacccctgc

SEQ ID NO: 1598849 - DNA, 20 bp, Homo sapiens
cacccaccgtccgccctgct

SEQ ID NO: 1598850 - DNA, 22 bp, Homo sapiens
cacccaccgtccgccctgctcc

SEQ ID NO: 1598851 - DNA, 23 bp, Homo sapiens
cacccaccgtccgccctgctcct

SEQ ID NO: 1598852 - DNA, 15 bp, Homo sapiens
cacccacctccaccc

SEQ ID NO: 1598853 - DNA, 14 bp, Homo sapiens
cacccacctgtttt

SEQ ID NO: 1598854 - DNA, 22 bp, Homo sapiens
cacccaccttgacgtttcttct

SEQ ID NO: 1598855 - DNA, 13 bp, Homo sapiens
cacccactcacca

SEQ ID NO: 1598856 - DNA, 20 bp, Homo sapiens
cacccagaatgtagcatctg

SEQ ID NO: 1598857 - DNA, 14 bp, Homo sapiens
cacccagacagctc

SEQ ID NO: 1598858 - DNA, 22 bp, Homo sapiens
cacccagacagctccctctgcc

SEQ ID NO: 1598859 - DNA, 17 bp, Homo sapiens
cacccagagcaccccct

SEQ ID NO: 1598860 - DNA, 10 bp, Homo sapiens
cacccagccc

SEQ ID NO: 1598861 - DNA, 15 bp, Homo sapiens
cacccagcccattct

SEQ ID NO: 1598862 - DNA, 11 bp, Homo sapiens
cacccaggcct

SEQ ID NO: 1598863 - DNA, 16 bp, Homo sapiens
cacccaggcctccctg

SEQ ID NO: 1598864 - DNA, 21 bp, Homo sapiens
cacccaggcctccctgcagac

SEQ ID NO: 1598865 - DNA, 22 bp, Homo sapiens
cacccaggcctccctgcagact

SEQ ID NO: 1598866 - DNA, 20 bp, Homo sapiens
cacccaggctgcactgcagt

SEQ ID NO: 1598867 - DNA, 17 bp, Homo sapiens
cacccagtccccacccg

SEQ ID NO: 1598868 - DNA, 15 bp, Homo sapiens
attggtttaaagaaa

SEQ ID NO: 1598869 - DNA, 21 bp, Homo sapiens
attggttttatcgcagatttt

SEQ ID NO: 1598870 - DNA, 22 bp, Homo sapiens
attgtaaaaaaggttttctata

SEQ ID NO: 1598871 - DNA, 17 bp, Homo sapiens
attgtaaaataattctg

SEQ ID NO: 1598872 - DNA, 14 bp, Homo sapiens
attgtaaatactgg

SEQ ID NO: 1598873 - DNA, 21 bp, Homo sapiens
attgtaaatactggactcagg

SEQ ID NO: 1598874 - DNA, 17 bp, Homo sapiens
attgtaagtgaaattaa

SEQ ID NO: 1598875 - DNA, 23 bp, Homo sapiens
attgtaagtgaaattaagcattt

SEQ ID NO: 1598876 - DNA, 13 bp, Homo sapiens
attgtaatgtaat

SEQ ID NO: 1598877 - DNA, 22 bp, Homo sapiens
attgtaatgttgtgaataatta

SEQ ID NO: 1598878 - DNA, 17 bp, Homo sapiens
attgtacaataaatttt

SEQ ID NO: 1598879 - DNA, 12 bp, Homo sapiens
attgtacctctc

SEQ ID NO: 1598880 - DNA, 16 bp, Homo sapiens
attgtacgaagagtat

SEQ ID NO: 1598881 - DNA, 17 bp, Homo sapiens
attgtactaatctgaga

SEQ ID NO: 1598882 - DNA, 18 bp, Homo sapiens
attgtactaatctgagat

SEQ ID NO: 1598883 - DNA, 15 bp, Homo sapiens
attgtactccagcct

SEQ ID NO: 1598884 - DNA, 20 bp, Homo sapiens
attgtactgttgctttaata

SEQ ID NO: 1598885 - DNA, 17 bp, Homo sapiens
attgtagaattgtatat

SEQ ID NO: 1598886 - DNA, 17 bp, Homo sapiens
attgtagagccagaggt

SEQ ID NO: 1598887 - DNA, 18 bp, Homo sapiens
attgtagagccagaggtc

SEQ ID NO: 1598888 - DNA, 13 bp, Homo sapiens
attgtagcagtta

SEQ ID NO: 1598889 - DNA, 22 bp, Homo sapiens
attgtagcagttacagctctgt

SEQ ID NO: 1598890 - DNA, 16 bp, Homo sapiens
attgtagcatttcttg

SEQ ID NO: 1598891 - DNA, 13 bp, Homo sapiens
attgtatattgta

SEQ ID NO: 1598892 - DNA, 22 bp, Homo sapiens
attgtatgaaaatccttttaac

SEQ ID NO: 1598893 - DNA, 19 bp, Homo sapiens
attgtcagagttctgctct

SEQ ID NO: 1598894 - DNA, 20 bp, Homo sapiens
attgtcatggggatcaattt

SEQ ID NO: 1598895 - DNA, 20 bp, Homo sapiens
attgtccaggtgaggcccaa

SEQ ID NO: 1598896 - DNA, 17 bp, Homo sapiens
attgtccggccgctttg

SEQ ID NO: 1598897 - DNA, 15 bp, Homo sapiens
attgtcgctattgat

SEQ ID NO: 1598898 - DNA, 22 bp, Homo sapiens
attgtcgtataggcatgtaaac

SEQ ID NO: 1598899 - DNA, 21 bp, Homo sapiens
attgtctcaacgcctccccct

SEQ ID NO: 1598900 - DNA, 23 bp, Homo sapiens
attgtctcaacgcctccccctcc

SEQ ID NO: 1598901 - DNA, 16 bp, Homo sapiens
attgtctgaacttgca

SEQ ID NO: 1598902 - DNA, 16 bp, Homo sapiens
attgtcttgatgtttt

SEQ ID NO: 1598903 - DNA, 12 bp, Homo sapiens
attgtctttgct

SEQ ID NO: 1598904 - DNA, 19 bp, Homo sapiens
attgtctttgctgtactct

SEQ ID NO: 1598905 - DNA, 14 bp, Homo sapiens
attgtgaagtacat

SEQ ID NO: 1598906 - DNA, 16 bp, Homo sapiens
attgtgaccaagttat

SEQ ID NO: 1598907 - DNA, 17 bp, Homo sapiens
attgtgaccaagttata

SEQ ID NO: 1598908 - DNA, 13 bp, Homo sapiens
caaatttgtgtgt

SEQ ID NO: 1598909 - DNA, 15 bp, Homo sapiens
caaattttaaaacat

SEQ ID NO: 1598910 - DNA, 17 bp, Homo sapiens
caaattttaaaacattt

SEQ ID NO: 1598911 - DNA, 13 bp, Homo sapiens
caaattttggcca

SEQ ID NO: 1598912 - DNA, 15 bp, Homo sapiens
caaattttttgactt

SEQ ID NO: 1598913 - DNA, 23 bp, Homo sapiens
caaattttttgactttttttgta

SEQ ID NO: 1598914 - DNA, 20 bp, Homo sapiens
caacaaaaggacttcaggaa

SEQ ID NO: 1598915 - DNA, 15 bp, Homo sapiens
caacaaagaaacaaa

SEQ ID NO: 1598916 - DNA, 23 bp, Homo sapiens
caacaaagacatgctttccattt

SEQ ID NO: 1598917 - DNA, 23 bp, Homo sapiens
caacaaagcgagatcccatctct

SEQ ID NO: 1598918 - DNA, 15 bp, Homo sapiens
caacaacaaaaaata

SEQ ID NO: 1598919 - DNA, 22 bp, Homo sapiens
caacaacaaaaaatacattata

SEQ ID NO: 1598920 - DNA, 17 bp, Homo sapiens
caacaacaacaataata

SEQ ID NO: 1598921 - DNA, 15 bp, Homo sapiens
caacaacaataataa

SEQ ID NO: 1598922 - DNA, 14 bp, Homo sapiens
caacaacatgaaac

SEQ ID NO: 1598923 - DNA, 19 bp, Homo sapiens
caacaacctcaactgccta

SEQ ID NO: 1598924 - DNA, 19 bp, Homo sapiens
caacaacgtgagagaaaga

SEQ ID NO: 1598925 - DNA, 21 bp, Homo sapiens
caacaagcccgttagccccag

SEQ ID NO: 1598926 - DNA, 22 bp, Homo sapiens
caacaataataaagatgtgaaa

SEQ ID NO: 1598927 - DNA, 22 bp, Homo sapiens
caacaatacatgctgctaattc

SEQ ID NO: 1598928 - DNA, 18 bp, Homo sapiens
caacaatggggtgggccc

SEQ ID NO: 1598929 - DNA, 19 bp, Homo sapiens
caacaatggggtgggccca

SEQ ID NO: 1598930 - DNA, 16 bp, Homo sapiens
caacaatttatgaatt

SEQ ID NO: 1598931 - DNA, 17 bp, Homo sapiens
caacaatttatgaattg

SEQ ID NO: 1598932 - DNA, 13 bp, Homo sapiens
caacacaaagaga

SEQ ID NO: 1598933 - DNA, 16 bp, Homo sapiens
caacacaaagagaaaa

SEQ ID NO: 1598934 - DNA, 20 bp, Homo sapiens
caacacaaagagaaaaagaa

SEQ ID NO: 1598935 - DNA, 23 bp, Homo sapiens
caacacaaagagaaaaagaaatg

SEQ ID NO: 1598936 - DNA, 14 bp, Homo sapiens
caacaccacagaca

SEQ ID NO: 1598937 - DNA, 15 bp, Homo sapiens
caacaccacagacac

SEQ ID NO: 1598938 - DNA, 19 bp, Homo sapiens
caacaccacagacacacac

SEQ ID NO: 1598939 - DNA, 15 bp, Homo sapiens
caacaccccgcctgc

SEQ ID NO: 1598940 - DNA, 19 bp, Homo sapiens
caacaccccgcctgcctcc

SEQ ID NO: 1598941 - DNA, 23 bp, Homo sapiens
caacaccccgcctgcctcctggc

SEQ ID NO: 1598942 - DNA, 22 bp, Homo sapiens
caacaccttcagaggctgaggt

SEQ ID NO: 1598943 - DNA, 20 bp, Homo sapiens
caacactcatcacacttcat

SEQ ID NO: 1598944 - DNA, 24 bp, Homo sapiens
caacacttccagcatttagctggc

SEQ ID NO: 1598945 - DNA, 15 bp, Homo sapiens
caacagaaaaacaat

SEQ ID NO: 1598946 - DNA, 16 bp, Homo sapiens
caacagaaaaacaatc

SEQ ID NO: 1598947 - DNA, 20 bp, Homo sapiens
caacagaaaaacaatcttat

SEQ ID NO: 1598948 - DNA, 21 bp, Homo sapiens
caacagaaaaacaatcttatt

SEQ ID NO: 1598949 - DNA, 13 bp, Homo sapiens
caacagaaacctt

SEQ ID NO: 1598950 - DNA, 15 bp, Homo sapiens
caacagaaagaggga

SEQ ID NO: 1598951 - DNA, 18 bp, Homo sapiens
caacagactgttgagtta

SEQ ID NO: 1598952 - DNA, 15 bp, Homo sapiens
caacagagggagttt

SEQ ID NO: 1598953 - DNA, 19 bp, Homo sapiens
caacagagtgagaccctgt

SEQ ID NO: 1598954 - DNA, 17 bp, Homo sapiens
caacagatcaatttgta

SEQ ID NO: 1598955 - DNA, 17 bp, Homo sapiens
caacagatctggaacct

SEQ ID NO: 1598956 - DNA, 23 bp, Homo sapiens
caacagatctggaacctcagcct

SEQ ID NO: 1598957 - DNA, 20 bp, Homo sapiens
caacagattcagaatgagaa

SEQ ID NO: 1598958 - DNA, 14 bp, Homo sapiens
caacagcaagtgtt

SEQ ID NO: 1598959 - DNA, 18 bp, Homo sapiens
caacagcacctccccgct

SEQ ID NO: 1598960 - DNA, 13 bp, Homo sapiens
caacagcagtctc

SEQ ID NO: 1598961 - DNA, 22 bp, Homo sapiens
caacagcagtctccttcagcac

SEQ ID NO: 1598962 - DNA, 17 bp, Homo sapiens
caacagcatgtctactg

SEQ ID NO: 1598963 - DNA, 19 bp, Homo sapiens
caacagcatgtctactgct

SEQ ID NO: 1598964 - DNA, 14 bp, Homo sapiens
caacagccaagacc

SEQ ID NO: 1598965 - DNA, 14 bp, Homo sapiens
caacagctgaagca

SEQ ID NO: 1598966 - DNA, 16 bp, Homo sapiens
caacaggaatctcaga

SEQ ID NO: 1598967 - DNA, 21 bp, Homo sapiens
caacaggaatctcagagacag

SEQ ID NO: 1598968 - DNA, 20 bp, Homo sapiens
caacaggctgttctgcactg

SEQ ID NO: 1598969 - DNA, 22 bp, Homo sapiens
caacaggctgttctgcactgaa

SEQ ID NO: 1598970 - DNA, 23 bp, Homo sapiens
caacaggctgttctgcactgaaa

SEQ ID NO: 1598971 - DNA, 22 bp, Homo sapiens
caacaggggaggaaaaaagaac

SEQ ID NO: 1598972 - DNA, 17 bp, Homo sapiens
caacaggtaaaacaggg

SEQ ID NO: 1598973 - DNA, 21 bp, Homo sapiens
caacaggttttcaccatagcc

SEQ ID NO: 1598974 - DNA, 17 bp, Homo sapiens
caacagtaaaccactga

SEQ ID NO: 1598975 - DNA, 22 bp, Homo sapiens
caacagtaaaccactgaaaaaa

SEQ ID NO: 1598976 - DNA, 12 bp, Homo sapiens
caacagttcaaa

SEQ ID NO: 1598977 - DNA, 11 bp, Homo sapiens
caacagttgta

SEQ ID NO: 1598978 - DNA, 17 bp, Homo sapiens
caacataaaacaaaacc

SEQ ID NO: 1598979 - DNA, 19 bp, Homo sapiens
caacataaaacaaaaccaa

SEQ ID NO: 1598980 - DNA, 20 bp, Homo sapiens
caacataaaacaaaaccaag

SEQ ID NO: 1598981 - DNA, 14 bp, Homo sapiens
caacatcacagccc

SEQ ID NO: 1598982 - DNA, 15 bp, Homo sapiens
caacatcattccaaa

SEQ ID NO: 1598983 - DNA, 18 bp, Homo sapiens
caacatcccattgccctg

SEQ ID NO: 1598984 - DNA, 14 bp, Homo sapiens
caacatctctgaat

SEQ ID NO: 1598985 - DNA, 17 bp, Homo sapiens
caacatgaaactgccta

SEQ ID NO: 1598986 - DNA, 13 bp, Homo sapiens
caacatggagaaa

SEQ ID NO: 1598987 - DNA, 22 bp, Homo sapiens
caacatggtaattcacttcagt

SEQ ID NO: 1598988 - DNA, 18 bp, Homo sapiens
caacatgttactgaccag

SEQ ID NO: 1598989 - DNA, 19 bp, Homo sapiens
caacatgttgggaaacttg

SEQ ID NO: 1598990 - DNA, 22 bp, Homo sapiens
caacattcattgccaagggccc

SEQ ID NO: 1598991 - DNA, 14 bp, Homo sapiens
caacattctttgca

SEQ ID NO: 1598992 - DNA, 14 bp, Homo sapiens
caacatttatgacc

SEQ ID NO: 1598993 - DNA, 23 bp, Homo sapiens
caacatttatgacctaagtcagg

SEQ ID NO: 1598994 - DNA, 12 bp, Homo sapiens
caacatttatgt

SEQ ID NO: 1598995 - DNA, 13 bp, Homo sapiens
caacatttatgtg

SEQ ID NO: 1598996 - DNA, 17 bp, Homo sapiens
caacatttattttgaga

SEQ ID NO: 1598997 - DNA, 17 bp, Homo sapiens
caacatttttttttctc

SEQ ID NO: 1598998 - DNA, 22 bp, Homo sapiens
caaccaagaatgttatgtgcaa

SEQ ID NO: 1598999 - DNA, 13 bp, Homo sapiens
caaccaagtcaca

SEQ ID NO: 1599000 - DNA, 20 bp, Homo sapiens
caaccaagtcatgtgcattt

SEQ ID NO: 1599001 - DNA, 20 bp, Homo sapiens
caaccaatttacactgccat

SEQ ID NO: 1599002 - DNA, 22 bp, Homo sapiens
caaccactggtctgtagggatt

SEQ ID NO: 1599003 - DNA, 17 bp, Homo sapiens
caaccactgtgccactg

SEQ ID NO: 1599004 - DNA, 22 bp, Homo sapiens
caaccactgtggcgttctgctg

SEQ ID NO: 1599005 - DNA, 18 bp, Homo sapiens
caaccagaaacacccctc

SEQ ID NO: 1599006 - DNA, 12 bp, Homo sapiens
caaccagacctg

SEQ ID NO: 1599007 - DNA, 22 bp, Homo sapiens
caaccaggagctgatggcagct

SEQ ID NO: 1599008 - DNA, 18 bp, Homo sapiens
caaccaggccttcatcct

SEQ ID NO: 1599009 - DNA, 21 bp, Homo sapiens
caaccaggccttcatcctcct

SEQ ID NO: 1599010 - DNA, 18 bp, Homo sapiens
caaccaggctcctgtgat

SEQ ID NO: 1599011 - DNA, 13 bp, Homo sapiens
caaccatcgcttt

SEQ ID NO: 1599012 - DNA, 23 bp, Homo sapiens
caaccatgagaccactgttatca

SEQ ID NO: 1599013 - DNA, 22 bp, Homo sapiens
caaccatgtcatttcagaagtt

SEQ ID NO: 1599014 - DNA, 13 bp, Homo sapiens
caacccacagctc

SEQ ID NO: 1599015 - DNA, 20 bp, Homo sapiens
caacccacagctcagctgcc

SEQ ID NO: 1599016 - DNA, 23 bp, Homo sapiens
caacccacatggggttcctggtt

SEQ ID NO: 1599017 - DNA, 13 bp, Homo sapiens
caacccaccacaa

SEQ ID NO: 1599018 - DNA, 13 bp, Homo sapiens
caaccccagggcc

SEQ ID NO: 1599019 - DNA, 22 bp, Homo sapiens
caaccccagggcccccacaggc

SEQ ID NO: 1599020 - DNA, 11 bp, Homo sapiens
caacccccacc

SEQ ID NO: 1599021 - DNA, 12 bp, Homo sapiens
caacccccaccc

SEQ ID NO: 1599022 - DNA, 18 bp, Homo sapiens
caacccccaccccacact

SEQ ID NO: 1599023 - DNA, 23 bp, Homo sapiens
caacccccaccccacacttgttc

SEQ ID NO: 1599024 - DNA, 19 bp, Homo sapiens
atttttgcaataccaagta

SEQ ID NO: 1599025 - DNA, 14 bp, Homo sapiens
atttttgccttcat

SEQ ID NO: 1599026 - DNA, 15 bp, Homo sapiens
atttttgccttcatt

SEQ ID NO: 1599027 - DNA, 15 bp, Homo sapiens
atttttgctgaattc

SEQ ID NO: 1599028 - DNA, 18 bp, Homo sapiens
atttttggagtttaccac

SEQ ID NO: 1599029 - DNA, 19 bp, Homo sapiens
atttttggcagtctgaatt

SEQ ID NO: 1599030 - DNA, 19 bp, Homo sapiens
atttttggtgggaatccaa

SEQ ID NO: 1599031 - DNA, 13 bp, Homo sapiens
atttttgtacata

SEQ ID NO: 1599032 - DNA, 19 bp, Homo sapiens
atttttgtacattacacta

SEQ ID NO: 1599033 - DNA, 13 bp, Homo sapiens
atttttgtatttt

SEQ ID NO: 1599034 - DNA, 22 bp, Homo sapiens
atttttgtgtcatttattcaag

SEQ ID NO: 1599035 - DNA, 17 bp, Homo sapiens
atttttgtgtttctaaa

SEQ ID NO: 1599036 - DNA, 18 bp, Homo sapiens
atttttgtgttttcttgt

SEQ ID NO: 1599037 - DNA, 19 bp, Homo sapiens
atttttgtgttttcttgta

SEQ ID NO: 1599038 - DNA, 20 bp, Homo sapiens
atttttgtgttttcttgtaa

SEQ ID NO: 1599039 - DNA, 16 bp, Homo sapiens
atttttgttagcaaag

SEQ ID NO: 1599040 - DNA, 21 bp, Homo sapiens
atttttgttagcaaagattaa

SEQ ID NO: 1599041 - DNA, 22 bp, Homo sapiens
atttttgtttcttccaaagcac

SEQ ID NO: 1599042 - DNA, 20 bp, Homo sapiens
attttttaaagttactttgt

SEQ ID NO: 1599043 - DNA, 17 bp, Homo sapiens
attttttaaatgtaaaa

SEQ ID NO: 1599044 - DNA, 17 bp, Homo sapiens
attttttaaggaaacaa

SEQ ID NO: 1599045 - DNA, 18 bp, Homo sapiens
attttttaaggagctggg

SEQ ID NO: 1599046 - DNA, 16 bp, Homo sapiens
attttttaagtattta

SEQ ID NO: 1599047 - DNA, 18 bp, Homo sapiens
attttttaagtatttata

SEQ ID NO: 1599048 - DNA, 20 bp, Homo sapiens
attttttaagtatttatata

SEQ ID NO: 1599049 - DNA, 22 bp, Homo sapiens
attttttaagtatttatatatt

SEQ ID NO: 1599050 - DNA, 21 bp, Homo sapiens
attttttaatttgatgaaagc

SEQ ID NO: 1599051 - DNA, 14 bp, Homo sapiens
attttttagtctgt

SEQ ID NO: 1599052 - DNA, 14 bp, Homo sapiens
attttttatactgt

SEQ ID NO: 1599053 - DNA, 14 bp, Homo sapiens
attttttcagttgt

SEQ ID NO: 1599054 - DNA, 13 bp, Homo sapiens
attttttcccaaa

SEQ ID NO: 1599055 - DNA, 11 bp, Homo sapiens
attttttcctt

SEQ ID NO: 1599056 - DNA, 18 bp, Homo sapiens
attttttcttctgaagat

SEQ ID NO: 1599057 - DNA, 20 bp, Homo sapiens
attttttcttttgtaattgt

SEQ ID NO: 1599058 - DNA, 13 bp, Homo sapiens
attttttgaaagt

SEQ ID NO: 1599059 - DNA, 14 bp, Homo sapiens
attttttgaaagtt

SEQ ID NO: 1599060 - DNA, 12 bp, Homo sapiens
attttttgactt

SEQ ID NO: 1599061 - DNA, 18 bp, Homo sapiens
attttttgtctgtttatt

SEQ ID NO: 1599062 - DNA, 16 bp, Homo sapiens
attttttgtttgttta

SEQ ID NO: 1599063 - DNA, 23 bp, Homo sapiens
atttttttaacctaatatcactt

SEQ ID NO: 1599064 - DNA, 16 bp, Homo sapiens
atttttttatgctctt

SEQ ID NO: 1599065 - DNA, 13 bp, Homo sapiens
caaaggctccctc

SEQ ID NO: 1599066 - DNA, 21 bp, Homo sapiens
caaaggctccctcgccctgtg

SEQ ID NO: 1599067 - DNA, 15 bp, Homo sapiens
caaaggctggtggca

SEQ ID NO: 1599068 - DNA, 20 bp, Homo sapiens
caaagggaaagcctctggcc

SEQ ID NO: 1599069 - DNA, 21 bp, Homo sapiens
caaagggaaagcctctggccg

SEQ ID NO: 1599070 - DNA, 15 bp, Homo sapiens
caaagggaaatatca

SEQ ID NO: 1599071 - DNA, 22 bp, Homo sapiens
caaagggagcactgggttgact

SEQ ID NO: 1599072 - DNA, 22 bp, Homo sapiens
caaagggctcctctccagtctg

SEQ ID NO: 1599073 - DNA, 15 bp, Homo sapiens
caaaggggctgctgg

SEQ ID NO: 1599074 - DNA, 18 bp, Homo sapiens
caaagggtgaaaattatt

SEQ ID NO: 1599075 - DNA, 20 bp, Homo sapiens
caaagggtgaagctatttat

SEQ ID NO: 1599076 - DNA, 14 bp, Homo sapiens
caaaggtataattt

SEQ ID NO: 1599077 - DNA, 20 bp, Homo sapiens
caaaggtggaataaacatta

SEQ ID NO: 1599078 - DNA, 14 bp, Homo sapiens
caaaggtggtaaat

SEQ ID NO: 1599079 - DNA, 16 bp, Homo sapiens
caaaggtggtaaattc

SEQ ID NO: 1599080 - DNA, 22 bp, Homo sapiens
caaaggtggtaaattcagacaa

SEQ ID NO: 1599081 - DNA, 12 bp, Homo sapiens
caaaggttctag

SEQ ID NO: 1599082 - DNA, 14 bp, Homo sapiens
caaaggttctaggt

SEQ ID NO: 1599083 - DNA, 15 bp, Homo sapiens
caaaggttgagatgt

SEQ ID NO: 1599084 - DNA, 20 bp, Homo sapiens
caaaggtttgaagacacagc

SEQ ID NO: 1599085 - DNA, 21 bp, Homo sapiens
caaaggtttgaagacacagcc

SEQ ID NO: 1599086 - DNA, 18 bp, Homo sapiens
caaaggtttggaaggagc

SEQ ID NO: 1599087 - DNA, 11 bp, Homo sapiens
caaaggttttc

SEQ ID NO: 1599088 - DNA, 18 bp, Homo sapiens
caaagtaaaacttgctgc

SEQ ID NO: 1599089 - DNA, 21 bp, Homo sapiens
caaagtaaaacttgctgcctg

SEQ ID NO: 1599090 - DNA, 12 bp, Homo sapiens
caaagtaaaatg

SEQ ID NO: 1599091 - DNA, 15 bp, Homo sapiens
caaagtacagaattt

SEQ ID NO: 1599092 - DNA, 16 bp, Homo sapiens
caaagtacagaatttg

SEQ ID NO: 1599093 - DNA, 14 bp, Homo sapiens
caaagtacattgta

SEQ ID NO: 1599094 - DNA, 15 bp, Homo sapiens
caaagtacattgtaa

SEQ ID NO: 1599095 - DNA, 22 bp, Homo sapiens
caaagtacattgtaaaataaag

SEQ ID NO: 1599096 - DNA, 14 bp, Homo sapiens
caaagtactcttta

SEQ ID NO: 1599097 - DNA, 21 bp, Homo sapiens
caaagtagaagtcttagatgt

SEQ ID NO: 1599098 - DNA, 22 bp, Homo sapiens
caaagtagaagtcttagatgta

SEQ ID NO: 1599099 - DNA, 17 bp, Homo sapiens
caaagtatgcaatgctt

SEQ ID NO: 1599100 - DNA, 17 bp, Homo sapiens
caaagtcacttctccat

SEQ ID NO: 1599101 - DNA, 14 bp, Homo sapiens
caaagtcgccagtc

SEQ ID NO: 1599102 - DNA, 20 bp, Homo sapiens
caaagtcgccagtcactgct

SEQ ID NO: 1599103 - DNA, 21 bp, Homo sapiens
caaagtcgccagtcactgctg

SEQ ID NO: 1599104 - DNA, 14 bp, Homo sapiens
caaagtctctaatt

SEQ ID NO: 1599105 - DNA, 15 bp, Homo sapiens
caaagtctctaattc

SEQ ID NO: 1599106 - DNA, 15 bp, Homo sapiens
caaagtgatagaaaa

SEQ ID NO: 1599107 - DNA, 24 bp, Homo sapiens
caaagtgatgggagaattggtata

SEQ ID NO: 1599108 - DNA, 16 bp, Homo sapiens
caaagtgctgagatta

SEQ ID NO: 1599109 - DNA, 16 bp, Homo sapiens
caaagtgctgggatga

SEQ ID NO: 1599110 - DNA, 19 bp, Homo sapiens
caaagtgctgggattacag

SEQ ID NO: 1599111 - DNA, 11 bp, Homo sapiens
caaagtggaac

SEQ ID NO: 1599112 - DNA, 14 bp, Homo sapiens
caaagtggaacgaa

SEQ ID NO: 1599113 - DNA, 14 bp, Homo sapiens
caaagtggagctgg

SEQ ID NO: 1599114 - DNA, 18 bp, Homo sapiens
caaagtggggagggacaa

SEQ ID NO: 1599115 - DNA, 18 bp, Homo sapiens
caaagtggtaaatactgt

SEQ ID NO: 1599116 - DNA, 23 bp, Homo sapiens
caaagtggtacaggaaggcttgc

SEQ ID NO: 1599117 - DNA, 14 bp, Homo sapiens
caaagtgtatattt

SEQ ID NO: 1599118 - DNA, 20 bp, Homo sapiens
caaagtgtctacatgtgcca

SEQ ID NO: 1599119 - DNA, 21 bp, Homo sapiens
caaagtgtgtaattatgtaaa

SEQ ID NO: 1599120 - DNA, 23 bp, Homo sapiens
caaagtgtgtaattatgtaaata

SEQ ID NO: 1599121 - DNA, 17 bp, Homo sapiens
caaagtgttgctgtggc

SEQ ID NO: 1599122 - DNA, 18 bp, Homo sapiens
caaagtgttgctgtggct

SEQ ID NO: 1599123 - DNA, 19 bp, Homo sapiens
caaagtgttgctgtggctc

SEQ ID NO: 1599124 - DNA, 21 bp, Homo sapiens
caaagtgttgctgtggctcca

SEQ ID NO: 1599125 - DNA, 18 bp, Homo sapiens
caaagtgttgtgttcctg

SEQ ID NO: 1599126 - DNA, 19 bp, Homo sapiens
caaagtgttgtgttcctgg

SEQ ID NO: 1599127 - DNA, 19 bp, Homo sapiens
caaagttcccactccttca

SEQ ID NO: 1599128 - DNA, 20 bp, Homo sapiens
caaagttctaataatttcta

SEQ ID NO: 1599129 - DNA, 22 bp, Homo sapiens
caaagttgccacagatgatact

SEQ ID NO: 1599130 - DNA, 23 bp, Homo sapiens
caaagtttacagatgtttttaat

SEQ ID NO: 1599131 - DNA, 17 bp, Homo sapiens
caaagtttacattgtcc

SEQ ID NO: 1599132 - DNA, 16 bp, Homo sapiens
caaagtttcagagtat

SEQ ID NO: 1599133 - DNA, 16 bp, Homo sapiens
caaagtttgacaggaa

SEQ ID NO: 1599134 - DNA, 19 bp, Homo sapiens
caaagtttgacaggaacct

SEQ ID NO: 1599135 - DNA, 14 bp, Homo sapiens
caaagttttcaaac

SEQ ID NO: 1599136 - DNA, 16 bp, Homo sapiens
caaataaaaatattgt

SEQ ID NO: 1599137 - DNA, 15 bp, Homo sapiens
caaataaaatatcat

SEQ ID NO: 1599138 - DNA, 18 bp, Homo sapiens
caaataaaattggcacca

SEQ ID NO: 1599139 - DNA, 20 bp, Homo sapiens
caaataaatcatcctcatgt

SEQ ID NO: 1599140 - DNA, 22 bp, Homo sapiens
caaataaatcatcctcatgtcc

SEQ ID NO: 1599141 - DNA, 12 bp, Homo sapiens
caaataaatgat

SEQ ID NO: 1599142 - DNA, 17 bp, Homo sapiens
caaataaggacagcagc

SEQ ID NO: 1599143 - DNA, 18 bp, Homo sapiens
caaataaggacagcagct

SEQ ID NO: 1599144 - DNA, 16 bp, Homo sapiens
caaataagtatttata

SEQ ID NO: 1599145 - DNA, 17 bp, Homo sapiens
caaataagtatttataa

SEQ ID NO: 1599146 - DNA, 18 bp, Homo sapiens
caaataagtatttataat

SEQ ID NO: 1599147 - DNA, 23 bp, Homo sapiens
caaataatgtctctgtgagactc

SEQ ID NO: 1599148 - DNA, 14 bp, Homo sapiens
caaatacaatcagc

SEQ ID NO: 1599149 - DNA, 14 bp, Homo sapiens
caaatacacatttg

SEQ ID NO: 1599150 - DNA, 16 bp, Homo sapiens
caaatacacatttgct

SEQ ID NO: 1599151 - DNA, 22 bp, Homo sapiens
caaatacctccattaaatggtc

SEQ ID NO: 1599152 - DNA, 23 bp, Homo sapiens
caaataggagggagactgtggta

SEQ ID NO: 1599153 - DNA, 20 bp, Homo sapiens
caaataggctattaaaaaag

SEQ ID NO: 1599154 - DNA, 18 bp, Homo sapiens
attttagcccagtgtttt

SEQ ID NO: 1599155 - DNA, 16 bp, Homo sapiens
attttagctgcagaac

SEQ ID NO: 1599156 - DNA, 15 bp, Homo sapiens
attttaggaacttca

SEQ ID NO: 1599157 - DNA, 17 bp, Homo sapiens
attttaggaacttcaga

SEQ ID NO: 1599158 - DNA, 19 bp, Homo sapiens
attttagtattcattctgc

SEQ ID NO: 1599159 - DNA, 18 bp, Homo sapiens
attttagtgactgtaatt

SEQ ID NO: 1599160 - DNA, 20 bp, Homo sapiens
attttagtgtattaatcata

SEQ ID NO: 1599161 - DNA, 13 bp, Homo sapiens
attttataagaaa

SEQ ID NO: 1599162 - DNA, 20 bp, Homo sapiens
attttatatttaaaaattgt

SEQ ID NO: 1599163 - DNA, 20 bp, Homo sapiens
attttatatttttgtacata

SEQ ID NO: 1599164 - DNA, 22 bp, Homo sapiens
attttatatttttgtacatatt

SEQ ID NO: 1599165 - DNA, 20 bp, Homo sapiens
attttatcattaaaaattac

SEQ ID NO: 1599166 - DNA, 12 bp, Homo sapiens
attttatcctgt

SEQ ID NO: 1599167 - DNA, 16 bp, Homo sapiens
attttatcctgtattc

SEQ ID NO: 1599168 - DNA, 22 bp, Homo sapiens
attttatctggaacaacttgta

SEQ ID NO: 1599169 - DNA, 15 bp, Homo sapiens
attttatctttgatt

SEQ ID NO: 1599170 - DNA, 22 bp, Homo sapiens
attttatctttgattctccttc

SEQ ID NO: 1599171 - DNA, 19 bp, Homo sapiens
attttatgaacattgtact

SEQ ID NO: 1599172 - DNA, 22 bp, Homo sapiens
attttatgaacattgtactgtt

SEQ ID NO: 1599173 - DNA, 16 bp, Homo sapiens
attttattaaacacag

SEQ ID NO: 1599174 - DNA, 22 bp, Homo sapiens
attttattaagctttttggaat

SEQ ID NO: 1599175 - DNA, 16 bp, Homo sapiens
attttattaataatat

SEQ ID NO: 1599176 - DNA, 22 bp, Homo sapiens
attttattatgagctacaacaa

SEQ ID NO: 1599177 - DNA, 15 bp, Homo sapiens
attttattattttct

SEQ ID NO: 1599178 - DNA, 18 bp, Homo sapiens
attttattcaagaatgcc

SEQ ID NO: 1599179 - DNA, 19 bp, Homo sapiens
attttattctatgtatgtt

SEQ ID NO: 1599180 - DNA, 12 bp, Homo sapiens
attttattcttg

SEQ ID NO: 1599181 - DNA, 13 bp, Homo sapiens
attttattcttga

SEQ ID NO: 1599182 - DNA, 15 bp, Homo sapiens
attttattcttgatc

SEQ ID NO: 1599183 - DNA, 23 bp, Homo sapiens
attttattgtataaaaagtttca

SEQ ID NO: 1599184 - DNA, 22 bp, Homo sapiens
attttatttagacaagagatgg

SEQ ID NO: 1599185 - DNA, 19 bp, Homo sapiens
attttattttaaaatttca

SEQ ID NO: 1599186 - DNA, 19 bp, Homo sapiens
attttattttgctgagttg

SEQ ID NO: 1599187 - DNA, 23 bp, Homo sapiens
attttattttgtgctcatttaag

SEQ ID NO: 1599188 - DNA, 23 bp, Homo sapiens
attttcaaacctcaaatatagta

SEQ ID NO: 1599189 - DNA, 16 bp, Homo sapiens
attttcaaagacttaa

SEQ ID NO: 1599190 - DNA, 22 bp, Homo sapiens
attttcaaccataaaagaagtt

SEQ ID NO: 1599191 - DNA, 16 bp, Homo sapiens
attttcaactgctttg

SEQ ID NO: 1599192 - DNA, 20 bp, Homo sapiens
attttcaactgtcttcctca

SEQ ID NO: 1599193 - DNA, 16 bp, Homo sapiens
attttcaagaaactga

SEQ ID NO: 1599194 - DNA, 23 bp, Homo sapiens
attttcaagaaactgaggaattt

SEQ ID NO: 1599195 - DNA, 20 bp, Homo sapiens
attttcaagattctaaagct

SEQ ID NO: 1599196 - DNA, 20 bp, Homo sapiens
attttcaagcagcatcttct

SEQ ID NO: 1599197 - DNA, 21 bp, Homo sapiens
attttcaagcagcatcttctg

SEQ ID NO: 1599198 - DNA, 20 bp, Homo sapiens
attttcaaggccctcagcat

SEQ ID NO: 1599199 - DNA, 16 bp, Homo sapiens
attttcaaggccttca

SEQ ID NO: 1599200 - DNA, 21 bp, Homo sapiens
attttcacactggtaaatgtt

SEQ ID NO: 1599201 - DNA, 15 bp, Homo sapiens
attttcacattcttg

SEQ ID NO: 1599202 - DNA, 16 bp, Homo sapiens
attttcaccccaccct

SEQ ID NO: 1599203 - DNA, 21 bp, Homo sapiens
attttcacctgtttttaagct

SEQ ID NO: 1599204 - DNA, 13 bp, Homo sapiens
attttcactgtag

SEQ ID NO: 1599205 - DNA, 14 bp, Homo sapiens
attttcagaaaata

SEQ ID NO: 1599206 - DNA, 12 bp, Homo sapiens
attttcagaccc

SEQ ID NO: 1599207 - DNA, 12 bp, Homo sapiens
attttcagagac

SEQ ID NO: 1599208 - DNA, 19 bp, Homo sapiens
attttcagtcgttgtgctt

SEQ ID NO: 1599209 - DNA, 15 bp, Homo sapiens
attttcagtgatctt

SEQ ID NO: 1599210 - DNA, 16 bp, Homo sapiens
attttcataatcagta

SEQ ID NO: 1599211 - DNA, 21 bp, Homo sapiens
attttcataatcagtaaatag

SEQ ID NO: 1599212 - DNA, 16 bp, Homo sapiens
attttcatagatgtgt

SEQ ID NO: 1599213 - DNA, 12 bp, Homo sapiens
attttcatcccg

SEQ ID NO: 1599214 - DNA, 14 bp, Homo sapiens
attttcatgaaaat

SEQ ID NO: 1599215 - DNA, 18 bp, Homo sapiens
attttcatgcaaaagttc

SEQ ID NO: 1599216 - DNA, 17 bp, Homo sapiens
attttcatgtatatgtg

SEQ ID NO: 1599217 - DNA, 18 bp, Homo sapiens
attttcatgtatatgtgt

SEQ ID NO: 1599218 - DNA, 12 bp, Homo sapiens
attttcattaaa

SEQ ID NO: 1599219 - DNA, 15 bp, Homo sapiens
attttcattaaactt

SEQ ID NO: 1599220 - DNA, 13 bp, Homo sapiens
attttcatttgta

SEQ ID NO: 1599221 - DNA, 16 bp, Homo sapiens
attttcatttgtacaa

SEQ ID NO: 1599222 - DNA, 22 bp, Homo sapiens
attttcatttgtacaaggtaat

SEQ ID NO: 1599223 - DNA, 14 bp, Homo sapiens
attttccaaagagt

SEQ ID NO: 1599224 - DNA, 14 bp, Homo sapiens
attttccaaccttt

SEQ ID NO: 1599225 - DNA, 17 bp, Homo sapiens
attttccaagtaaagtg

SEQ ID NO: 1599226 - DNA, 18 bp, Homo sapiens
attttccatctaaaaata

SEQ ID NO: 1599227 - DNA, 20 bp, Homo sapiens
attttccatctaaaaatata

SEQ ID NO: 1599228 - DNA, 18 bp, Homo sapiens
attttcccatcatccttt

SEQ ID NO: 1599229 - DNA, 23 bp, Homo sapiens
attttcccatcatcctttgttct

SEQ ID NO: 1599230 - DNA, 14 bp, Homo sapiens
attttccccccact

SEQ ID NO: 1599231 - DNA, 15 bp, Homo sapiens
attttccccccactc

SEQ ID NO: 1599232 - DNA, 16 bp, Homo sapiens
attttccgggaacttt

SEQ ID NO: 1599233 - DNA, 23 bp, Homo sapiens
attttccgggaactttgcagcat

SEQ ID NO: 1599234 - DNA, 16 bp, Homo sapiens
attttccgtcacttaa

SEQ ID NO: 1599235 - DNA, 18 bp, Homo sapiens
attttcctgacatttgtt

SEQ ID NO: 1599236 - DNA, 12 bp, Homo sapiens
attttcctgata

SEQ ID NO: 1599237 - DNA, 20 bp, Homo sapiens
attttcctgttcagtgagat

SEQ ID NO: 1599238 - DNA, 14 bp, Homo sapiens
attttccttttcaa

SEQ ID NO: 1599239 - DNA, 17 bp, Homo sapiens
attttcctttttcttcg

SEQ ID NO: 1599240 - DNA, 16 bp, Homo sapiens
attttctaaactgttt

SEQ ID NO: 1599241 - DNA, 18 bp, Homo sapiens
attttctaattaaagatg

SEQ ID NO: 1599242 - DNA, 14 bp, Homo sapiens
attttctacagtgg

SEQ ID NO: 1599243 - DNA, 17 bp, Homo sapiens
attttctatgtgttgtg

SEQ ID NO: 1599244 - DNA, 21 bp, Homo sapiens
attttctcataggaagtttgg

SEQ ID NO: 1599245 - DNA, 13 bp, Homo sapiens
attttctccttgg

SEQ ID NO: 1599246 - DNA, 17 bp, Homo sapiens
attttctgcagctgttt

SEQ ID NO: 1599247 - DNA, 18 bp, Homo sapiens
attttctggaatacatga

SEQ ID NO: 1599248 - DNA, 13 bp, Homo sapiens
attttctggattc

SEQ ID NO: 1599249 - DNA, 18 bp, Homo sapiens
attttctggccagtgttt

SEQ ID NO: 1599250 - DNA, 16 bp, Homo sapiens
attttctgtgcctgaa

SEQ ID NO: 1599251 - DNA, 17 bp, Homo sapiens
attttctgttcagatta

SEQ ID NO: 1599252 - DNA, 21 bp, Homo sapiens
attttctgttcagattaaaaa

SEQ ID NO: 1599253 - DNA, 19 bp, Homo sapiens
attttcttattgcgctgct

SEQ ID NO: 1599254 - DNA, 18 bp, Homo sapiens
attttctttatcattgct

SEQ ID NO: 1599255 - DNA, 16 bp, Homo sapiens
attttctttctatgta

SEQ ID NO: 1599256 - DNA, 16 bp, Homo sapiens
attttctttctgtaac

SEQ ID NO: 1599257 - DNA, 16 bp, Homo sapiens
attttctttgtttctt

SEQ ID NO: 1599258 - DNA, 13 bp, Homo sapiens
attttcttttata

SEQ ID NO: 1599259 - DNA, 16 bp, Homo sapiens
attttctttttcttaa

SEQ ID NO: 1599260 - DNA, 22 bp, Homo sapiens
attttcttttttatcttgcact

SEQ ID NO: 1599261 - DNA, 15 bp, Homo sapiens
attttgaaacaaagt

SEQ ID NO: 1599262 - DNA, 22 bp, Homo sapiens
attttgaatgtcacaaattgat

SEQ ID NO: 1599263 - DNA, 24 bp, Homo sapiens
attttgacagttattttgataaca

SEQ ID NO: 1599264 - DNA, 19 bp, Homo sapiens
attttgacttaatgtgatt

SEQ ID NO: 1599265 - DNA, 14 bp, Homo sapiens
attttgagaaactg

SEQ ID NO: 1599266 - DNA, 21 bp, Homo sapiens
attttgagaaactgctgcaga

SEQ ID NO: 1599267 - DNA, 19 bp, Homo sapiens
attttgaggacatcactta

SEQ ID NO: 1599268 - DNA, 16 bp, Homo sapiens
attttgagtattccat

SEQ ID NO: 1599269 - DNA, 21 bp, Homo sapiens
attttgagtattccatgagct

SEQ ID NO: 1599270 - DNA, 16 bp, Homo sapiens
atttgtatatggtatt

SEQ ID NO: 1599271 - DNA, 13 bp, Homo sapiens
atttgtattaata

SEQ ID NO: 1599272 - DNA, 14 bp, Homo sapiens
atttgtattaataa

SEQ ID NO: 1599273 - DNA, 16 bp, Homo sapiens
atttgtattaataaag

SEQ ID NO: 1599274 - DNA, 18 bp, Homo sapiens
atttgtattaataaagca

SEQ ID NO: 1599275 - DNA, 20 bp, Homo sapiens
atttgtattaataaagcatt

SEQ ID NO: 1599276 - DNA, 14 bp, Homo sapiens
atttgtattactag

SEQ ID NO: 1599277 - DNA, 23 bp, Homo sapiens
atttgtattcaaatttgtgtcat

SEQ ID NO: 1599278 - DNA, 14 bp, Homo sapiens
atttgtattccatt

SEQ ID NO: 1599279 - DNA, 17 bp, Homo sapiens
atttgtatttctcttgt

SEQ ID NO: 1599280 - DNA, 19 bp, Homo sapiens
atttgtatttctcttgtcc

SEQ ID NO: 1599281 - DNA, 18 bp, Homo sapiens
atttgtattttgtgatga

SEQ ID NO: 1599282 - DNA, 20 bp, Homo sapiens
atttgtattttgtgatgaat

SEQ ID NO: 1599283 - DNA, 20 bp, Homo sapiens
atttgtcaaaaagtaatgat

SEQ ID NO: 1599284 - DNA, 22 bp, Homo sapiens
atttgtcacagaaatcagagga

SEQ ID NO: 1599285 - DNA, 16 bp, Homo sapiens
atttgtccaattgagt

SEQ ID NO: 1599286 - DNA, 13 bp, Homo sapiens
atttgtcccagcc

SEQ ID NO: 1599287 - DNA, 23 bp, Homo sapiens
atttgtccttttatttctccatc

SEQ ID NO: 1599288 - DNA, 20 bp, Homo sapiens
atttgtctctgtcacccttg

SEQ ID NO: 1599289 - DNA, 23 bp, Homo sapiens
atttgtcttccgatcaacattta

SEQ ID NO: 1599290 - DNA, 15 bp, Homo sapiens
atttgtgaactggaa

SEQ ID NO: 1599291 - DNA, 14 bp, Homo sapiens
atttgtgccgtaat

SEQ ID NO: 1599292 - DNA, 18 bp, Homo sapiens
atttgtggtaatctacac

SEQ ID NO: 1599293 - DNA, 13 bp, Homo sapiens
atttgtggtcaca

SEQ ID NO: 1599294 - DNA, 18 bp, Homo sapiens
atttgtgtcataccagaa

SEQ ID NO: 1599295 - DNA, 21 bp, Homo sapiens
atttgtgttttaatttaaaca

SEQ ID NO: 1599296 - DNA, 19 bp, Homo sapiens
atttgtgtttttctttttc

SEQ ID NO: 1599297 - DNA, 14 bp, Homo sapiens
atttgttatatata

SEQ ID NO: 1599298 - DNA, 17 bp, Homo sapiens
atttgttatatataata

SEQ ID NO: 1599299 - DNA, 23 bp, Homo sapiens
atttgttatatataataaatact

SEQ ID NO: 1599300 - DNA, 23 bp, Homo sapiens
atttgttcctggagttttgattt

SEQ ID NO: 1599301 - DNA, 16 bp, Homo sapiens
atttgttcttgtattt

SEQ ID NO: 1599302 - DNA, 13 bp, Homo sapiens
atttgttctttgt

SEQ ID NO: 1599303 - DNA, 17 bp, Homo sapiens
atttgttctttttctga

SEQ ID NO: 1599304 - DNA, 19 bp, Homo sapiens
atttgttgacagcaaaatg

SEQ ID NO: 1599305 - DNA, 20 bp, Homo sapiens
atttgttgacagcaaaatgt

SEQ ID NO: 1599306 - DNA, 14 bp, Homo sapiens
atttgtttaaaagg

SEQ ID NO: 1599307 - DNA, 20 bp, Homo sapiens
atttgtttaaagaataaagt

SEQ ID NO: 1599308 - DNA, 20 bp, Homo sapiens
atttgtttatggtaaaaaat

SEQ ID NO: 1599309 - DNA, 16 bp, Homo sapiens
atttgtttcatttctg

SEQ ID NO: 1599310 - DNA, 13 bp, Homo sapiens
atttgtttccccc

SEQ ID NO: 1599311 - DNA, 13 bp, Homo sapiens
atttgtttgtatt

SEQ ID NO: 1599312 - DNA, 21 bp, Homo sapiens
atttgtttgtgttcaatatca

SEQ ID NO: 1599313 - DNA, 13 bp, Homo sapiens
atttgttttagca

SEQ ID NO: 1599314 - DNA, 18 bp, Homo sapiens
atttgttttgaattttgt

SEQ ID NO: 1599315 - DNA, 17 bp, Homo sapiens
atttgttttgcattcct

SEQ ID NO: 1599316 - DNA, 18 bp, Homo sapiens
atttgttttgcattcctt

SEQ ID NO: 1599317 - DNA, 15 bp, Homo sapiens
atttgttttggatat

SEQ ID NO: 1599318 - DNA, 16 bp, Homo sapiens
atttgttttggatata

SEQ ID NO: 1599319 - DNA, 17 bp, Homo sapiens
atttgttttgtgtttca

SEQ ID NO: 1599320 - DNA, 20 bp, Homo sapiens
atttgtttttgtagagattt

SEQ ID NO: 1599321 - DNA, 14 bp, Homo sapiens
attttaaaaaaggg

SEQ ID NO: 1599322 - DNA, 20 bp, Homo sapiens
atttaacagaaattgtatat

SEQ ID NO: 1599323 - DNA, 18 bp, Homo sapiens
atttaacagtcatttaaa

SEQ ID NO: 1599324 - DNA, 17 bp, Homo sapiens
atttaacattatttata

SEQ ID NO: 1599325 - DNA, 22 bp, Homo sapiens
atttaaccccttggtactgaaa

SEQ ID NO: 1599326 - DNA, 13 bp, Homo sapiens
atttaagatgtga

SEQ ID NO: 1599327 - DNA, 15 bp, Homo sapiens
atttaagatgtgaaa

SEQ ID NO: 1599328 - DNA, 16 bp, Homo sapiens
atttaagcctaaagat

SEQ ID NO: 1599329 - DNA, 22 bp, Homo sapiens
atttaagcctaaagattttgat

SEQ ID NO: 1599330 - DNA, 18 bp, Homo sapiens
atttaagccttacaaagg

SEQ ID NO: 1599331 - DNA, 20 bp, Homo sapiens
atttaagccttttgtgtaat

SEQ ID NO: 1599332 - DNA, 22 bp, Homo sapiens
atttaaggatggatggcaccct

SEQ ID NO: 1599333 - DNA, 23 bp, Homo sapiens
atttaagtagtgggcatttcata

SEQ ID NO: 1599334 - DNA, 13 bp, Homo sapiens
atttaagtatctt

SEQ ID NO: 1599335 - DNA, 17 bp, Homo sapiens
atttaagtgacacagac

SEQ ID NO: 1599336 - DNA, 18 bp, Homo sapiens
atttaagttatcaacttt

SEQ ID NO: 1599337 - DNA, 20 bp, Homo sapiens
atttaagtttcaaacttact

SEQ ID NO: 1599338 - DNA, 17 bp, Homo sapiens
atttaataaaaaggaat

SEQ ID NO: 1599339 - DNA, 11 bp, Homo sapiens
atttaataaag

SEQ ID NO: 1599340 - DNA, 16 bp, Homo sapiens
atttaataaatgtgcc

SEQ ID NO: 1599341 - DNA, 15 bp, Homo sapiens
atttaatacagataa

SEQ ID NO: 1599342 - DNA, 15 bp, Homo sapiens
atttaatacagcagt

SEQ ID NO: 1599343 - DNA, 22 bp, Homo sapiens
atttaatacagctgaagtcaaa

SEQ ID NO: 1599344 - DNA, 19 bp, Homo sapiens
atttaataccagatacctt

SEQ ID NO: 1599345 - DNA, 13 bp, Homo sapiens
atttaatatcaaa

SEQ ID NO: 1599346 - DNA, 14 bp, Homo sapiens
atttaatattatat

SEQ ID NO: 1599347 - DNA, 18 bp, Homo sapiens
atttaatattatatagga

SEQ ID NO: 1599348 - DNA, 15 bp, Homo sapiens
atttaatattttgca

SEQ ID NO: 1599349 - DNA, 16 bp, Homo sapiens
atttaatgaaagactg

SEQ ID NO: 1599350 - DNA, 14 bp, Homo sapiens
atttaatgctgcct

SEQ ID NO: 1599351 - DNA, 15 bp, Homo sapiens
atttaatggcagcta

SEQ ID NO: 1599352 - DNA, 15 bp, Homo sapiens
atttaatgttgaaca

SEQ ID NO: 1599353 - DNA, 19 bp, Homo sapiens
atttaatgttgaacaaaat

SEQ ID NO: 1599354 - DNA, 18 bp, Homo sapiens
atttaatgtttttaatca

SEQ ID NO: 1599355 - DNA, 21 bp, Homo sapiens
atttaatgtttttaatcacat

SEQ ID NO: 1599356 - DNA, 16 bp, Homo sapiens
atttaattatgaaaac

SEQ ID NO: 1599357 - DNA, 15 bp, Homo sapiens
atttaattcatgttt

SEQ ID NO: 1599358 - DNA, 14 bp, Homo sapiens
atttaattttgaca

SEQ ID NO: 1599359 - DNA, 15 bp, Homo sapiens
atttacaaaagattt

SEQ ID NO: 1599360 - DNA, 14 bp, Homo sapiens
atttacaagatatt

SEQ ID NO: 1599361 - DNA, 17 bp, Homo sapiens
atttacaagatattatt

SEQ ID NO: 1599362 - DNA, 18 bp, Homo sapiens
atttacaataaatattct

SEQ ID NO: 1599363 - DNA, 21 bp, Homo sapiens
atttacaataaatattctgca

SEQ ID NO: 1599364 - DNA, 14 bp, Homo sapiens
atttacagaacaaa

SEQ ID NO: 1599365 - DNA, 16 bp, Homo sapiens
atttacagagaagtga

SEQ ID NO: 1599366 - DNA, 21 bp, Homo sapiens
atttacagcctcacttgaatg

SEQ ID NO: 1599367 - DNA, 21 bp, Homo sapiens
atttacatgaattgcatttta

SEQ ID NO: 1599368 - DNA, 22 bp, Homo sapiens
atttacatgtattatttcatta

SEQ ID NO: 1599369 - DNA, 23 bp, Homo sapiens
atttacattaggtattacaagta

SEQ ID NO: 1599370 - DNA, 20 bp, Homo sapiens
atttacatttaatacagata

SEQ ID NO: 1599371 - DNA, 12 bp, Homo sapiens
atttacatttta

SEQ ID NO: 1599372 - DNA, 13 bp, Homo sapiens
atttaccaaagta

SEQ ID NO: 1599373 - DNA, 18 bp, Homo sapiens
atttaccaaggatgaatt

SEQ ID NO: 1599374 - DNA, 22 bp, Homo sapiens
atttaccaaggatgaattcttt

SEQ ID NO: 1599375 - DNA, 18 bp, Homo sapiens
atttacctaagattacaa

SEQ ID NO: 1599376 - DNA, 20 bp, Homo sapiens
atttaccttttctgttgtac

SEQ ID NO: 1599377 - DNA, 22 bp, Homo sapiens
atttactacaatatgtacattt

SEQ ID NO: 1599378 - DNA, 15 bp, Homo sapiens
atttactacttttgc

SEQ ID NO: 1599379 - DNA, 15 bp, Homo sapiens
atttactatgcacaa

SEQ ID NO: 1599380 - DNA, 15 bp, Homo sapiens
atttactcctcctgc

SEQ ID NO: 1599381 - DNA, 14 bp, Homo sapiens
atttacttcttata

SEQ ID NO: 1599382 - DNA, 17 bp, Homo sapiens
atttacttcttatacat

SEQ ID NO: 1599383 - DNA, 21 bp, Homo sapiens
atttacttttaccactattta

SEQ ID NO: 1599384 - DNA, 21 bp, Homo sapiens
atttagaaaagtgaattgaag

SEQ ID NO: 1599385 - DNA, 21 bp, Homo sapiens
atttagaaaatagagctttta

SEQ ID NO: 1599386 - DNA, 15 bp, Homo sapiens
atttagaaatataat

SEQ ID NO: 1599387 - DNA, 17 bp, Homo sapiens
atttagaacctaacttt

SEQ ID NO: 1599388 - DNA, 18 bp, Homo sapiens
atttagaacctaactttt

SEQ ID NO: 1599389 - DNA, 12 bp, Homo sapiens
atttagaagcca

SEQ ID NO: 1599390 - DNA, 22 bp, Homo sapiens
atttagaagccaactatgatta

SEQ ID NO: 1599391 - DNA, 14 bp, Homo sapiens
atttatttgtttcc

SEQ ID NO: 1599392 - DNA, 15 bp, Homo sapiens
atttattttattcta

SEQ ID NO: 1599393 - DNA, 16 bp, Homo sapiens
atttattttattctat

SEQ ID NO: 1599394 - DNA, 18 bp, Homo sapiens
atttattttattctatgt

SEQ ID NO: 1599395 - DNA, 18 bp, Homo sapiens
atttattttttacattat

SEQ ID NO: 1599396 - DNA, 14 bp, Homo sapiens
atttcaaaaatata

SEQ ID NO: 1599397 - DNA, 15 bp, Homo sapiens
atttcaaaaatataa

SEQ ID NO: 1599398 - DNA, 18 bp, Homo sapiens
atttcaaaaatataactt

SEQ ID NO: 1599399 - DNA, 14 bp, Homo sapiens
atttcaaaatacat

SEQ ID NO: 1599400 - DNA, 19 bp, Homo sapiens
atttcaaaatacatttgta

SEQ ID NO: 1599401 - DNA, 21 bp, Homo sapiens
atttcaaaatacatttgtaag

SEQ ID NO: 1599402 - DNA, 20 bp, Homo sapiens
atttcaaacttaaacaaaaa

SEQ ID NO: 1599403 - DNA, 22 bp, Homo sapiens
atttcaaataaaggtacttctg

SEQ ID NO: 1599404 - DNA, 13 bp, Homo sapiens
atttcaaatgcag

SEQ ID NO: 1599405 - DNA, 12 bp, Homo sapiens
atttcaagacag

SEQ ID NO: 1599406 - DNA, 15 bp, Homo sapiens
atttcaagagattta

SEQ ID NO: 1599407 - DNA, 12 bp, Homo sapiens
atttcaagctct

SEQ ID NO: 1599408 - DNA, 13 bp, Homo sapiens
atttcaaggttct

SEQ ID NO: 1599409 - DNA, 15 bp, Homo sapiens
atttcaaggttctaa

SEQ ID NO: 1599410 - DNA, 13 bp, Homo sapiens
atttcaagtgcct

SEQ ID NO: 1599411 - DNA, 14 bp, Homo sapiens
atttcaagtgccta

SEQ ID NO: 1599412 - DNA, 16 bp, Homo sapiens
atttcaagttccaagt

SEQ ID NO: 1599413 - DNA, 22 bp, Homo sapiens
atttcaagttccaagttgctaa

SEQ ID NO: 1599414 - DNA, 23 bp, Homo sapiens
atttcaagttccaagttgctaat

SEQ ID NO: 1599415 - DNA, 14 bp, Homo sapiens
atttcaatccattt

SEQ ID NO: 1599416 - DNA, 13 bp, Homo sapiens
atttcaatctttt

SEQ ID NO: 1599417 - DNA, 21 bp, Homo sapiens
atttcaatgcgttttgttgta

SEQ ID NO: 1599418 - DNA, 20 bp, Homo sapiens
atttcacagagcacgcctgc

SEQ ID NO: 1599419 - DNA, 23 bp, Homo sapiens
atttcacatgagtcaaaacaaag

SEQ ID NO: 1599420 - DNA, 21 bp, Homo sapiens
atttcacccctccctttctcc

SEQ ID NO: 1599421 - DNA, 14 bp, Homo sapiens
atttcacctgtaaa

SEQ ID NO: 1599422 - DNA, 23 bp, Homo sapiens
atttcacgcttttaattctcatt

SEQ ID NO: 1599423 - DNA, 18 bp, Homo sapiens
atttcactactagattga

SEQ ID NO: 1599424 - DNA, 12 bp, Homo sapiens
atttcacttaat

SEQ ID NO: 1599425 - DNA, 18 bp, Homo sapiens
atttcacttaataatttt

SEQ ID NO: 1599426 - DNA, 12 bp, Homo sapiens
atttcacttgat

SEQ ID NO: 1599427 - DNA, 19 bp, Homo sapiens
atttcacttgatgatacaa

SEQ ID NO: 1599428 - DNA, 15 bp, Homo sapiens
atttcactttagatg

SEQ ID NO: 1599429 - DNA, 21 bp, Homo sapiens
atttcagaaatacagataaat

SEQ ID NO: 1599430 - DNA, 13 bp, Homo sapiens
atttcagaagttt

SEQ ID NO: 1599431 - DNA, 15 bp, Homo sapiens
atttcagaagtttaa

SEQ ID NO: 1599432 - DNA, 16 bp, Homo sapiens
atttcagaagtttaaa

SEQ ID NO: 1599433 - DNA, 12 bp, Homo sapiens
atttcagacatt

SEQ ID NO: 1599434 - DNA, 16 bp, Homo sapiens
atttcagagaggcctt

SEQ ID NO: 1599435 - DNA, 22 bp, Homo sapiens
atttcagagaggccttttggaa

SEQ ID NO: 1599436 - DNA, 23 bp, Homo sapiens
atttcagagtgactacacacagt

SEQ ID NO: 1599437 - DNA, 21 bp, Homo sapiens
atttcaggaaaatgtattgat

SEQ ID NO: 1599438 - DNA, 16 bp, Homo sapiens
atttcaggaatttaaa

SEQ ID NO: 1599439 - DNA, 19 bp, Homo sapiens
atttcaggcattggatatt

SEQ ID NO: 1599440 - DNA, 22 bp, Homo sapiens
atttcaggggtcgtcaccacct

SEQ ID NO: 1599441 - DNA, 20 bp, Homo sapiens
atttcaggttttgtaaagat

SEQ ID NO: 1599442 - DNA, 18 bp, Homo sapiens
atttcagtgttttcattt

SEQ ID NO: 1599443 - DNA, 16 bp, Homo sapiens
attgcagatatgggac

SEQ ID NO: 1599444 - DNA, 14 bp, Homo sapiens
attgcagctttatg

SEQ ID NO: 1599445 - DNA, 16 bp, Homo sapiens
attgcagctttatgtt

SEQ ID NO: 1599446 - DNA, 17 bp, Homo sapiens
attgcagctttatgttc

SEQ ID NO: 1599447 - DNA, 20 bp, Homo sapiens
attgcagctttatgttcatt

SEQ ID NO: 1599448 - DNA, 21 bp, Homo sapiens
attgcaggaccttgggcacat

SEQ ID NO: 1599449 - DNA, 15 bp, Homo sapiens
attgcatcactgtat

SEQ ID NO: 1599450 - DNA, 14 bp, Homo sapiens
attgcatcagttca

SEQ ID NO: 1599451 - DNA, 23 bp, Homo sapiens
attgcattaaatataatatgcac

SEQ ID NO: 1599452 - DNA, 14 bp, Homo sapiens
attgccaccaggag

SEQ ID NO: 1599453 - DNA, 15 bp, Homo sapiens
attgccaccaggaga

SEQ ID NO: 1599454 - DNA, 21 bp, Homo sapiens
attgccaccaggagaaccact

SEQ ID NO: 1599455 - DNA, 22 bp, Homo sapiens
attgccatattaaaatctgatg

SEQ ID NO: 1599456 - DNA, 23 bp, Homo sapiens
attgcccccatggggtccttgga

SEQ ID NO: 1599457 - DNA, 13 bp, Homo sapiens
attgcccctggct

SEQ ID NO: 1599458 - DNA, 16 bp, Homo sapiens
attgcccctggctttg

SEQ ID NO: 1599459 - DNA, 17 bp, Homo sapiens
attgcccctggctttgc

SEQ ID NO: 1599460 - DNA, 20 bp, Homo sapiens
attgcccctggctttgcctc

SEQ ID NO: 1599461 - DNA, 16 bp, Homo sapiens
attgcctacaataaaa

SEQ ID NO: 1599462 - DNA, 18 bp, Homo sapiens
attgcctacaataaaaag

SEQ ID NO: 1599463 - DNA, 21 bp, Homo sapiens
attgcctacaataaaaagaaa

SEQ ID NO: 1599464 - DNA, 21 bp, Homo sapiens
attgcctagaaatatctttct

SEQ ID NO: 1599465 - DNA, 23 bp, Homo sapiens
attgcctagaaatatctttctct

SEQ ID NO: 1599466 - DNA, 20 bp, Homo sapiens
attgcctcctgttctgccca

SEQ ID NO: 1599467 - DNA, 22 bp, Homo sapiens
attgcctctactttgattctga

SEQ ID NO: 1599468 - DNA, 13 bp, Homo sapiens
attgcctggactg

SEQ ID NO: 1599469 - DNA, 19 bp, Homo sapiens
attgccttatttgtctgta

SEQ ID NO: 1599470 - DNA, 22 bp, Homo sapiens
attgccttatttgtctgtaaaa

SEQ ID NO: 1599471 - DNA, 17 bp, Homo sapiens
attgccttttaattttt

SEQ ID NO: 1599472 - DNA, 16 bp, Homo sapiens
attgcgctctcaagac

SEQ ID NO: 1599473 - DNA, 13 bp, Homo sapiens
attgcgctgctac

SEQ ID NO: 1599474 - DNA, 21 bp, Homo sapiens
attgctaatcaccaaaggctc

SEQ ID NO: 1599475 - DNA, 17 bp, Homo sapiens
attgctaccgagaaggt

SEQ ID NO: 1599476 - DNA, 17 bp, Homo sapiens
attgctagataaaagct

SEQ ID NO: 1599477 - DNA, 22 bp, Homo sapiens
attgctatcgccctcctttccc

SEQ ID NO: 1599478 - DNA, 12 bp, Homo sapiens
attgctccagag

SEQ ID NO: 1599479 - DNA, 16 bp, Homo sapiens
atgttctaaggctctg

SEQ ID NO: 1599480 - DNA, 15 bp, Homo sapiens
atgttctaagtttct

SEQ ID NO: 1599481 - DNA, 19 bp, Homo sapiens
atgttctaagtttctaaga

SEQ ID NO: 1599482 - DNA, 14 bp, Homo sapiens
atgttctaggtttc

SEQ ID NO: 1599483 - DNA, 19 bp, Homo sapiens
atgttctatttaacaactg

SEQ ID NO: 1599484 - DNA, 16 bp, Homo sapiens
atgttctgtgactgaa

SEQ ID NO: 1599485 - DNA, 18 bp, Homo sapiens
atgttcttagcaataaat

SEQ ID NO: 1599486 - DNA, 18 bp, Homo sapiens
atgttgaaagatcaaaag

SEQ ID NO: 1599487 - DNA, 19 bp, Homo sapiens
atgttgaacaaaataaatt

SEQ ID NO: 1599488 - DNA, 16 bp, Homo sapiens
atgttgaagaaaaaag

SEQ ID NO: 1599489 - DNA, 14 bp, Homo sapiens
atgttgagggaaca

SEQ ID NO: 1599490 - DNA, 18 bp, Homo sapiens
atgttgatcatgtacttt

SEQ ID NO: 1599491 - DNA, 22 bp, Homo sapiens
atgttgccatcctaccgtcttt

SEQ ID NO: 1599492 - DNA, 16 bp, Homo sapiens
atgttgccatgtgttt

SEQ ID NO: 1599493 - DNA, 22 bp, Homo sapiens
atgttgctgatggcccctccag

SEQ ID NO: 1599494 - DNA, 11 bp, Homo sapiens
atgttgctgcc

SEQ ID NO: 1599495 - DNA, 20 bp, Homo sapiens
atgttgctgtgcacggtgga

SEQ ID NO: 1599496 - DNA, 17 bp, Homo sapiens
atgttgcttaggatgtg

SEQ ID NO: 1599497 - DNA, 23 bp, Homo sapiens
atgttgctttaacctgaaccttg

SEQ ID NO: 1599498 - DNA, 17 bp, Homo sapiens
atgttgcttttgaaaag

SEQ ID NO: 1599499 - DNA, 19 bp, Homo sapiens
atgttggacacctttaggt

SEQ ID NO: 1599500 - DNA, 21 bp, Homo sapiens
atgttggccaggctggtctaa

SEQ ID NO: 1599501 - DNA, 19 bp, Homo sapiens
atgttgggaaacttggctc

SEQ ID NO: 1599502 - DNA, 16 bp, Homo sapiens
atgttgtacttgaaaa

SEQ ID NO: 1599503 - DNA, 23 bp, Homo sapiens
atgttgtacttgaaaatgctata

SEQ ID NO: 1599504 - DNA, 16 bp, Homo sapiens
atgttgtccaacaata

SEQ ID NO: 1599505 - DNA, 12 bp, Homo sapiens
atgttgtgaata

SEQ ID NO: 1599506 - DNA, 19 bp, Homo sapiens
atgttgtgaataattacag

SEQ ID NO: 1599507 - DNA, 15 bp, Homo sapiens
atgttgttaaacacg

SEQ ID NO: 1599508 - DNA, 13 bp, Homo sapiens
atgttgttcctgg

SEQ ID NO: 1599509 - DNA, 15 bp, Homo sapiens
atgttgttttgtaca

SEQ ID NO: 1599510 - DNA, 21 bp, Homo sapiens
atgttgttttgtacagatgtg

SEQ ID NO: 1599511 - DNA, 16 bp, Homo sapiens
atgtttaaaagaaata

SEQ ID NO: 1599512 - DNA, 19 bp, Homo sapiens
atgtttaaaagaaatatat

SEQ ID NO: 1599513 - DNA, 17 bp, Homo sapiens
atgtttaacatcattgc

SEQ ID NO: 1599514 - DNA, 20 bp, Homo sapiens
atgtttaacatcattgcata

SEQ ID NO: 1599515 - DNA, 22 bp, Homo sapiens
atgtttacactctttgtaagag

SEQ ID NO: 1599516 - DNA, 19 bp, Homo sapiens
atgtttacaggtttgaatt

SEQ ID NO: 1599517 - DNA, 13 bp, Homo sapiens
atgtttacatatc

SEQ ID NO: 1599518 - DNA, 18 bp, Homo sapiens
atgtttaccttttaatta

SEQ ID NO: 1599519 - DNA, 15 bp, Homo sapiens
atgtttactgtaaat

SEQ ID NO: 1599520 - DNA, 16 bp, Homo sapiens
atgtttactgtaaatt

SEQ ID NO: 1599521 - DNA, 20 bp, Homo sapiens
atgtttataaatcttatgct

SEQ ID NO: 1599522 - DNA, 14 bp, Homo sapiens
atgtttatgagcca

SEQ ID NO: 1599523 - DNA, 23 bp, Homo sapiens
atgtttatgtaaacaaatctttc

SEQ ID NO: 1599524 - DNA, 17 bp, Homo sapiens
atgtttattcttctaga

SEQ ID NO: 1599525 - DNA, 18 bp, Homo sapiens
atgtttattcttctagag

SEQ ID NO: 1599526 - DNA, 21 bp, Homo sapiens
atgtttattcttctagagttc

SEQ ID NO: 1599527 - DNA, 14 bp, Homo sapiens
atgtttatttcagg

SEQ ID NO: 1599528 - DNA, 18 bp, Homo sapiens
atgtttcaggaggctgga

SEQ ID NO: 1599529 - DNA, 22 bp, Homo sapiens
atgtttcagtgaagatgctgta

SEQ ID NO: 1599530 - DNA, 21 bp, Homo sapiens
atgtttcattatgcactttta

SEQ ID NO: 1599531 - DNA, 19 bp, Homo sapiens
atgtttccagcagaagaca

SEQ ID NO: 1599532 - DNA, 24 bp, Homo sapiens
atgtttccagcagaagacaaaaag

SEQ ID NO: 1599533 - DNA, 11 bp, Homo sapiens
atgtttcctta

SEQ ID NO: 1599534 - DNA, 20 bp, Homo sapiens
atgtttcgtgaagtatactg

SEQ ID NO: 1599535 - DNA, 11 bp, Homo sapiens
atgtttctcac

SEQ ID NO: 1599536 - DNA, 20 bp, Homo sapiens
atgtttctggacattctctt

SEQ ID NO: 1599537 - DNA, 13 bp, Homo sapiens
atgtttctgtgaa

SEQ ID NO: 1599538 - DNA, 14 bp, Homo sapiens
atgtttctgtgaaa

SEQ ID NO: 1599539 - DNA, 18 bp, Homo sapiens
atgtttcttaaatgggct

SEQ ID NO: 1599540 - DNA, 14 bp, Homo sapiens
atgtttcttagccc

SEQ ID NO: 1599541 - DNA, 18 bp, Homo sapiens
atgtttcttcatttctct

SEQ ID NO: 1599542 - DNA, 20 bp, Homo sapiens
atgtttcttcatttctctgc

SEQ ID NO: 1599543 - DNA, 21 bp, Homo sapiens
atgtttctttgatcatgaata

SEQ ID NO: 1599544 - DNA, 21 bp, Homo sapiens
atgtttcttttgtttggtaaa

SEQ ID NO: 1599545 - DNA, 18 bp, Homo sapiens
atgtttgcctcataatag

SEQ ID NO: 1599546 - DNA, 22 bp, Homo sapiens
atgtttgctgattatttatgac

SEQ ID NO: 1599547 - DNA, 22 bp, Homo sapiens
atgtttggaaaccacagtcagt

SEQ ID NO: 1599548 - DNA, 19 bp, Homo sapiens
atgtttggctctgctttta

SEQ ID NO: 1599549 - DNA, 23 bp, Homo sapiens
atgtttggggatcgatgtgctca

SEQ ID NO: 1599550 - DNA, 23 bp, Homo sapiens
atgtttgtcctgaacacttttgt

SEQ ID NO: 1599551 - DNA, 18 bp, Homo sapiens
atgtttgtgatattaaat

SEQ ID NO: 1599552 - DNA, 13 bp, Homo sapiens
atgtttgtgcctt

SEQ ID NO: 1599553 - DNA, 15 bp, Homo sapiens
atgtttgtgctctgt

SEQ ID NO: 1599554 - DNA, 14 bp, Homo sapiens
atgtttgtggcctc

SEQ ID NO: 1599555 - DNA, 15 bp, Homo sapiens
atgtttgtggcctca

SEQ ID NO: 1599556 - DNA, 19 bp, Homo sapiens
atgttttaaaaaaatttga

SEQ ID NO: 1599557 - DNA, 21 bp, Homo sapiens
atgttttaaacatagaaagtt

SEQ ID NO: 1599558 - DNA, 22 bp, Homo sapiens
atgttttaaagaatatgacttt

SEQ ID NO: 1599559 - DNA, 16 bp, Homo sapiens
atgttttactgtgaaa

SEQ ID NO: 1599560 - DNA, 23 bp, Homo sapiens
atgttttagggagtggttcctgt

SEQ ID NO: 1599561 - DNA, 22 bp, Homo sapiens
atgttttcaaaaggtattatac

SEQ ID NO: 1599562 - DNA, 16 bp, Homo sapiens
atgttttgaaagacag

SEQ ID NO: 1599563 - DNA, 12 bp, Homo sapiens
atgttttgtaca

SEQ ID NO: 1599564 - DNA, 14 bp, Homo sapiens
atgttttgtacaat

SEQ ID NO: 1599565 - DNA, 15 bp, Homo sapiens
atgttttgtataaaa

SEQ ID NO: 1599566 - DNA, 16 bp, Homo sapiens
atgttttgtataaaat

SEQ ID NO: 1599567 - DNA, 18 bp, Homo sapiens
atgttttgtataaaatct

SEQ ID NO: 1599568 - DNA, 23 bp, Homo sapiens
atgttttgtataaaatctgaatt

SEQ ID NO: 1599569 - DNA, 14 bp, Homo sapiens
atgttttgtttctg

SEQ ID NO: 1599570 - DNA, 16 bp, Homo sapiens
atgttttgtttctgaa

SEQ ID NO: 1599571 - DNA, 19 bp, Homo sapiens
atgttttgtttctgaaaat

SEQ ID NO: 1599572 - DNA, 21 bp, Homo sapiens
atgttttgtttctgaaaattc

SEQ ID NO: 1599573 - DNA, 11 bp, Homo sapiens
atgtttttaat

SEQ ID NO: 1599574 - DNA, 16 bp, Homo sapiens
atgtttttatttttgt

SEQ ID NO: 1599575 - DNA, 22 bp, Homo sapiens
atgtttttgatcaaaaactatt

SEQ ID NO: 1599576 - DNA, 18 bp, Homo sapiens
atgtttttggttattggt

SEQ ID NO: 1599577 - DNA, 22 bp, Homo sapiens
atgttttttaaaatatttatct

SEQ ID NO: 1599578 - DNA, 21 bp, Homo sapiens
atgttttttctgtaatgtaaa

SEQ ID NO: 1599579 - DNA, 21 bp, Homo sapiens
atgttttttgccacagctttt

SEQ ID NO: 1599580 - DNA, 23 bp, Homo sapiens
attaaaaaaaaaagcctgtattt

SEQ ID NO: 1599581 - DNA, 14 bp, Homo sapiens
attaaaaaaaaaga

SEQ ID NO: 1599582 - DNA, 13 bp, Homo sapiens
attaaaaaagtct

SEQ ID NO: 1599583 - DNA, 20 bp, Homo sapiens
attaaaaaatcagttgtaca

SEQ ID NO: 1599584 - DNA, 13 bp, Homo sapiens
attaaaaacatga

SEQ ID NO: 1599585 - DNA, 14 bp, Homo sapiens
attaaaaagaagat

SEQ ID NO: 1599586 - DNA, 22 bp, Homo sapiens
attaaaaattacctttaatttt

SEQ ID NO: 1599587 - DNA, 13 bp, Homo sapiens
attaaaacaaata

SEQ ID NO: 1599588 - DNA, 14 bp, Homo sapiens
attaaaacaaatat

SEQ ID NO: 1599589 - DNA, 22 bp, Homo sapiens
attaaaacagctgcattagaaa

SEQ ID NO: 1599590 - DNA, 16 bp, Homo sapiens
attaaaactaaatttc

SEQ ID NO: 1599591 - DNA, 14 bp, Homo sapiens
attaaaagaatatc

SEQ ID NO: 1599592 - DNA, 15 bp, Homo sapiens
attaaaagcaaatca

SEQ ID NO: 1599593 - DNA, 16 bp, Homo sapiens
attaaaagcaaatcat

SEQ ID NO: 1599594 - DNA, 21 bp, Homo sapiens
attaaaatacagctgcactga

SEQ ID NO: 1599595 - DNA, 19 bp, Homo sapiens
atgtgggtaagaggagcag

SEQ ID NO: 1599596 - DNA, 15 bp, Homo sapiens
atgtgggtgaccagg

SEQ ID NO: 1599597 - DNA, 18 bp, Homo sapiens
atgtgggtgaccaggtcc

SEQ ID NO: 1599598 - DNA, 15 bp, Homo sapiens
atgtgggtggagaag

SEQ ID NO: 1599599 - DNA, 16 bp, Homo sapiens
atgtgggtggagaagg

SEQ ID NO: 1599600 - DNA, 17 bp, Homo sapiens
atgtgggtggagaaggg

SEQ ID NO: 1599601 - DNA, 12 bp, Homo sapiens
atgagatgctgg

SEQ ID NO: 1599602 - DNA, 20 bp, Homo sapiens
atgagatttgccagcacagg

SEQ ID NO: 1599603 - DNA, 16 bp, Homo sapiens
atgagatttttaaaaa

SEQ ID NO: 1599604 - DNA, 15 bp, Homo sapiens
atgagcagaagctct

SEQ ID NO: 1599605 - DNA, 13 bp, Homo sapiens
atgagcagaggga

SEQ ID NO: 1599606 - DNA, 18 bp, Homo sapiens
atgagcagagggaggaag

SEQ ID NO: 1599607 - DNA, 13 bp, Homo sapiens
atgagcagtcaca

SEQ ID NO: 1599608 - DNA, 19 bp, Homo sapiens
atgagccactgagcctggc

SEQ ID NO: 1599609 - DNA, 14 bp, Homo sapiens
atgagccagacaaa

SEQ ID NO: 1599610 - DNA, 16 bp, Homo sapiens
atgagccccttcatcc

SEQ ID NO: 1599611 - DNA, 14 bp, Homo sapiens
atgagccctaaaaa

SEQ ID NO: 1599612 - DNA, 15 bp, Homo sapiens
atgagcgccacctct

SEQ ID NO: 1599613 - DNA, 20 bp, Homo sapiens
atgagctacaacaaaaggac

SEQ ID NO: 1599614 - DNA, 21 bp, Homo sapiens
atgagctacaacaaaaggact

SEQ ID NO: 1599615 - DNA, 14 bp, Homo sapiens
atgagctatgtatt

SEQ ID NO: 1599616 - DNA, 19 bp, Homo sapiens
atgagctctgaaatcttcc

SEQ ID NO: 1599617 - DNA, 17 bp, Homo sapiens
atgagctgatctgcgga

SEQ ID NO: 1599618 - DNA, 11 bp, Homo sapiens
atgagctggca

SEQ ID NO: 1599619 - DNA, 15 bp, Homo sapiens
atgagctggcaacca

SEQ ID NO: 1599620 - DNA, 19 bp, Homo sapiens
atgagctggcaaccagcca

SEQ ID NO: 1599621 - DNA, 16 bp, Homo sapiens
atgagcttcaatataa

SEQ ID NO: 1599622 - DNA, 15 bp, Homo sapiens
atgagcttgattaaa

SEQ ID NO: 1599623 - DNA, 18 bp, Homo sapiens
atgagctttctttgcact

SEQ ID NO: 1599624 - DNA, 14 bp, Homo sapiens
atgaggaaatgtgt

SEQ ID NO: 1599625 - DNA, 14 bp, Homo sapiens
atgaggaatccaaa

SEQ ID NO: 1599626 - DNA, 16 bp, Homo sapiens
atgaggacagaaggac

SEQ ID NO: 1599627 - DNA, 17 bp, Homo sapiens
atgaggacagaaggact

SEQ ID NO: 1599628 - DNA, 19 bp, Homo sapiens
atgaggacagagggcacat

SEQ ID NO: 1599629 - DNA, 12 bp, Homo sapiens
atgaggagggga

SEQ ID NO: 1599630 - DNA, 12 bp, Homo sapiens
atgaggagggtg

SEQ ID NO: 1599631 - DNA, 22 bp, Homo sapiens
atgaggagggtgggggagggag

SEQ ID NO: 1599632 - DNA, 22 bp, Homo sapiens
atgaggccatctcaggagatgg

SEQ ID NO: 1599633 - DNA, 17 bp, Homo sapiens
atgaggctattaaaaga

SEQ ID NO: 1599634 - DNA, 22 bp, Homo sapiens
atgagggagggggcgctcagga

SEQ ID NO: 1599635 - DNA, 16 bp, Homo sapiens
atgagggatcacaggg

SEQ ID NO: 1599636 - DNA, 14 bp, Homo sapiens
atgaggggagagga

SEQ ID NO: 1599637 - DNA, 21 bp, Homo sapiens
atgaggggcttcctgggtcct

SEQ ID NO: 1599638 - DNA, 14 bp, Homo sapiens
atgaggtcaccagg

SEQ ID NO: 1599639 - DNA, 22 bp, Homo sapiens
atgaggtcaccaggggaggagc

SEQ ID NO: 1599640 - DNA, 15 bp, Homo sapiens
atgaggtcccaggca

SEQ ID NO: 1599641 - DNA, 19 bp, Homo sapiens
atgaggtcccaggcagaga

SEQ ID NO: 1599642 - DNA, 14 bp, Homo sapiens
atgaggtctgaaat

SEQ ID NO: 1599643 - DNA, 17 bp, Homo sapiens
atgaggtctgaaatgga

SEQ ID NO: 1599644 - DNA, 17 bp, Homo sapiens
atgagtatttggtccaa

SEQ ID NO: 1599645 - DNA, 15 bp, Homo sapiens
atgagtcaaaacaaa

SEQ ID NO: 1599646 - DNA, 18 bp, Homo sapiens
atgagtccttgaaaatat

SEQ ID NO: 1599647 - DNA, 19 bp, Homo sapiens
atgagtccttgatttcaaa

SEQ ID NO: 1599648 - DNA, 13 bp, Homo sapiens
atgagtgagaata

SEQ ID NO: 1599649 - DNA, 20 bp, Homo sapiens
atgagtgcaggtttctattg

SEQ ID NO: 1599650 - DNA, 18 bp, Homo sapiens
atgagtgggctgtagttg

SEQ ID NO: 1599651 - DNA, 13 bp, Homo sapiens
atgagtgtctgga

SEQ ID NO: 1599652 - DNA, 18 bp, Homo sapiens
atgagtgttgggagggga

SEQ ID NO: 1599653 - DNA, 15 bp, Homo sapiens
atgtatggatatatt

SEQ ID NO: 1599654 - DNA, 18 bp, Homo sapiens
atgtatggtatctttaga

SEQ ID NO: 1599655 - DNA, 15 bp, Homo sapiens
atgtatgtacaatac

SEQ ID NO: 1599656 - DNA, 22 bp, Homo sapiens
atgtatgtacaatacaatgtac

SEQ ID NO: 1599657 - DNA, 16 bp, Homo sapiens
atgtatgtgtaagtat

SEQ ID NO: 1599658 - DNA, 20 bp, Homo sapiens
atgtatgtgtcactgcatgg

SEQ ID NO: 1599659 - DNA, 16 bp, Homo sapiens
atgtatgtgtggctgt

SEQ ID NO: 1599660 - DNA, 13 bp, Homo sapiens
atgtatgttaatt

SEQ ID NO: 1599661 - DNA, 14 bp, Homo sapiens
atgtatgtttacat

SEQ ID NO: 1599662 - DNA, 18 bp, Homo sapiens
atgtatgtttacatatca

SEQ ID NO: 1599663 - DNA, 15 bp, Homo sapiens
atgtattatttcatt

SEQ ID NO: 1599664 - DNA, 14 bp, Homo sapiens
atgtattcaaatac

SEQ ID NO: 1599665 - DNA, 19 bp, Homo sapiens
atgtattctagctaatgta

SEQ ID NO: 1599666 - DNA, 13 bp, Homo sapiens
atgtattctgtat

SEQ ID NO: 1599667 - DNA, 16 bp, Homo sapiens
atgtattctgtatccg

SEQ ID NO: 1599668 - DNA, 18 bp, Homo sapiens
atgtattctttctgcctt

SEQ ID NO: 1599669 - DNA, 12 bp, Homo sapiens
atgtattgattc

SEQ ID NO: 1599670 - DNA, 19 bp, Homo sapiens
atgtatttagctacagctt

SEQ ID NO: 1599671 - DNA, 19 bp, Homo sapiens
atgtatttatttaaaagat

SEQ ID NO: 1599672 - DNA, 15 bp, Homo sapiens
atgtatttgctgaca

SEQ ID NO: 1599673 - DNA, 16 bp, Homo sapiens
atgtatttgttatata

SEQ ID NO: 1599674 - DNA, 17 bp, Homo sapiens
atgtatttgttatatat

SEQ ID NO: 1599675 - DNA, 16 bp, Homo sapiens
atgtattttaataaca

SEQ ID NO: 1599676 - DNA, 19 bp, Homo sapiens
atgtattttattattttct

SEQ ID NO: 1599677 - DNA, 21 bp, Homo sapiens
atgtattttctttttattttg

SEQ ID NO: 1599678 - DNA, 21 bp, Homo sapiens
atgtcaaacatgagatgtgtg

SEQ ID NO: 1599679 - DNA, 18 bp, Homo sapiens
atgtcaaagatatgttaa

SEQ ID NO: 1599680 - DNA, 15 bp, Homo sapiens
atgtcaaagtgtaac

SEQ ID NO: 1599681 - DNA, 23 bp, Homo sapiens
atgtcaaccaggtccagatgtgc

SEQ ID NO: 1599682 - DNA, 19 bp, Homo sapiens
atgtcaataaacaacagct

SEQ ID NO: 1599683 - DNA, 19 bp, Homo sapiens
atgtcaattcataaaaaca

SEQ ID NO: 1599684 - DNA, 18 bp, Homo sapiens
atgtcaatttgtatatca

SEQ ID NO: 1599685 - DNA, 14 bp, Homo sapiens
atgtcacaaattga

SEQ ID NO: 1599686 - DNA, 19 bp, Homo sapiens
atgtcacaaattgatcaag

SEQ ID NO: 1599687 - DNA, 22 bp, Homo sapiens
atgtcacaacctctctgatctt

SEQ ID NO: 1599688 - DNA, 13 bp, Homo sapiens
atgtcacagtcca

SEQ ID NO: 1599689 - DNA, 19 bp, Homo sapiens
atgtcacagtccaaccaga

SEQ ID NO: 1599690 - DNA, 13 bp, Homo sapiens
atgtcaccacctt

SEQ ID NO: 1599691 - DNA, 15 bp, Homo sapiens
atgtcaccaccttcc

SEQ ID NO: 1599692 - DNA, 12 bp, Homo sapiens
atgtcacctcag

SEQ ID NO: 1599693 - DNA, 15 bp, Homo sapiens
atgtcacctcagctg

SEQ ID NO: 1599694 - DNA, 20 bp, Homo sapiens
atgtcaggaacagaaggatg

SEQ ID NO: 1599695 - DNA, 14 bp, Homo sapiens
atgtcagtatgtgg

SEQ ID NO: 1599696 - DNA, 11 bp, Homo sapiens
atgtcataaat

SEQ ID NO: 1599697 - DNA, 14 bp, Homo sapiens
atgtcatactctgt

SEQ ID NO: 1599698 - DNA, 17 bp, Homo sapiens
atgtcatactctgtgta

SEQ ID NO: 1599699 - DNA, 14 bp, Homo sapiens
atgtcatagaaata

SEQ ID NO: 1599700 - DNA, 14 bp, Homo sapiens
atgtcatagccaaa

SEQ ID NO: 1599701 - DNA, 18 bp, Homo sapiens
atgtcatagtcttgaaat

SEQ ID NO: 1599702 - DNA, 13 bp, Homo sapiens
atgtcattgctaa

SEQ ID NO: 1599703 - DNA, 14 bp, Homo sapiens
atgtcattgtctac

SEQ ID NO: 1599704 - DNA, 16 bp, Homo sapiens
atgtcatttcagaagt

SEQ ID NO: 1599705 - DNA, 20 bp, Homo sapiens
atgtcatttttaatgtatct

SEQ ID NO: 1599706 - DNA, 20 bp, Homo sapiens
atgtccaaagaggctgcccc

SEQ ID NO: 1599707 - DNA, 21 bp, Homo sapiens
atgtccaccatgaacttgata

SEQ ID NO: 1599708 - DNA, 22 bp, Homo sapiens
atgtccagaagaatattcagga

SEQ ID NO: 1599709 - DNA, 15 bp, Homo sapiens
atgtccagggggaga

SEQ ID NO: 1599710 - DNA, 17 bp, Homo sapiens
atgtccagggggagaag

SEQ ID NO: 1599711 - DNA, 15 bp, Homo sapiens
atgtcccacccaccc

SEQ ID NO: 1599712 - DNA, 17 bp, Homo sapiens
atgtcccaccctcccta

SEQ ID NO: 1599713 - DNA, 15 bp, Homo sapiens
atgtcccctgtccca

SEQ ID NO: 1599714 - DNA, 14 bp, Homo sapiens
atgtcccttgctgt

SEQ ID NO: 1599715 - DNA, 21 bp, Homo sapiens
atgtccgatggtatctgggta

SEQ ID NO: 1599716 - DNA, 18 bp, Homo sapiens
atgtcctaaggacacact

SEQ ID NO: 1599717 - DNA, 19 bp, Homo sapiens
atgtcctaaggacacacta

SEQ ID NO: 1599718 - DNA, 16 bp, Homo sapiens
atgtcctccagaagcc

SEQ ID NO: 1599719 - DNA, 18 bp, Homo sapiens
atgtcctccagaagcctc

SEQ ID NO: 1599720 - DNA, 23 bp, Homo sapiens
atgtcctccagaagcctctggct

SEQ ID NO: 1599721 - DNA, 15 bp, Homo sapiens
atgtcctgcctttta

SEQ ID NO: 1599722 - DNA, 12 bp, Homo sapiens
atgtcctgtcct

SEQ ID NO: 1599723 - DNA, 14 bp, Homo sapiens
atgtcctgtcctgg

SEQ ID NO: 1599724 - DNA, 16 bp, Homo sapiens
atgtcctgtcctggtc

SEQ ID NO: 1599725 - DNA, 18 bp, Homo sapiens
atgtcctgtcctggtcct

SEQ ID NO: 1599726 - DNA, 14 bp, Homo sapiens
atgtccttattctt

SEQ ID NO: 1599727 - DNA, 17 bp, Homo sapiens
atgtcctttccatctgt

SEQ ID NO: 1599728 - DNA, 17 bp, Homo sapiens
atgtcgtagaattcctt

SEQ ID NO: 1599729 - DNA, 20 bp, Homo sapiens
atgtctactcagcatttgat

SEQ ID NO: 1599730 - DNA, 12 bp, Homo sapiens
atgtctactgct

SEQ ID NO: 1599731 - DNA, 22 bp, Homo sapiens
atgtctataatcccagcacttt

SEQ ID NO: 1599732 - DNA, 20 bp, Homo sapiens
atgtctatcaactttaatca

SEQ ID NO: 1599733 - DNA, 23 bp, Homo sapiens
atgtctcaaaaatccttatgcat

SEQ ID NO: 1599734 - DNA, 17 bp, Homo sapiens
atgtctcctttgctctt

SEQ ID NO: 1599735 - DNA, 15 bp, Homo sapiens
atgtctctctgccaa

SEQ ID NO: 1599736 - DNA, 16 bp, Homo sapiens
atgtctctctgccaag

SEQ ID NO: 1599737 - DNA, 13 bp, Homo sapiens
atgtctcttctga

SEQ ID NO: 1599738 - DNA, 13 bp, Homo sapiens
atgtctcttgtag

SEQ ID NO: 1599739 - DNA, 15 bp, Homo sapiens
atgtctcttgtagaa

SEQ ID NO: 1599740 - DNA, 14 bp, Homo sapiens
atgtctgcagctca

SEQ ID NO: 1599741 - DNA, 16 bp, Homo sapiens
atgtctgcagctcaag

SEQ ID NO: 1599742 - DNA, 19 bp, Homo sapiens
atgtctgcagtgtgccccc

SEQ ID NO: 1599743 - DNA, 20 bp, Homo sapiens
atgtctgcagtgtgcccccc

SEQ ID NO: 1599744 - DNA, 20 bp, Homo sapiens
atgtctgctgagttggcctg

SEQ ID NO: 1599745 - DNA, 11 bp, Homo sapiens
atgtctgctgg

SEQ ID NO: 1599746 - DNA, 12 bp, Homo sapiens
atgtctgctggt

SEQ ID NO: 1599747 - DNA, 19 bp, Homo sapiens
atgtctgtagctcctcaac

SEQ ID NO: 1599748 - DNA, 10 bp, Homo sapiens
atgtctgtgt

SEQ ID NO: 1599749 - DNA, 13 bp, Homo sapiens
atgtctgtgtatg

SEQ ID NO: 1599750 - DNA, 15 bp, Homo sapiens
atgtctgtttattaa

SEQ ID NO: 1599751 - DNA, 22 bp, Homo sapiens
atgtctgtttttgtatctttat

SEQ ID NO: 1599752 - DNA, 18 bp, Homo sapiens
atgtcttaacgaataaag

SEQ ID NO: 1599753 - DNA, 18 bp, Homo sapiens
atgtcttccatgtatctt

SEQ ID NO: 1599754 - DNA, 22 bp, Homo sapiens
atgtcttccatgtatcttttga

SEQ ID NO: 1599755 - DNA, 20 bp, Homo sapiens
atgtgaaactacagatcttt

SEQ ID NO: 1599756 - DNA, 20 bp, Homo sapiens
atgtgaaatttacatcattt

SEQ ID NO: 1599757 - DNA, 15 bp, Homo sapiens
atgtgaacacatcag

SEQ ID NO: 1599758 - DNA, 22 bp, Homo sapiens
attcagtaatgcagtttttaaa

SEQ ID NO: 1599759 - DNA, 14 bp, Homo sapiens
attcagtctcagct

SEQ ID NO: 1599760 - DNA, 14 bp, Homo sapiens
attcagtgcttctt

SEQ ID NO: 1599761 - DNA, 19 bp, Homo sapiens
attcagtgcttcttaaaga

SEQ ID NO: 1599762 - DNA, 23 bp, Homo sapiens
attcagttcccaccatctgatta

SEQ ID NO: 1599763 - DNA, 13 bp, Homo sapiens
attcagttttttt

SEQ ID NO: 1599764 - DNA, 11 bp, Homo sapiens
attcataataa

SEQ ID NO: 1599765 - DNA, 21 bp, Homo sapiens
attcataatgaattataacag

SEQ ID NO: 1599766 - DNA, 22 bp, Homo sapiens
attcataatgaattataacagt

SEQ ID NO: 1599767 - DNA, 19 bp, Homo sapiens
attcatagcatcctgatta

SEQ ID NO: 1599768 - DNA, 21 bp, Homo sapiens
attcatagcatcctgattatt

SEQ ID NO: 1599769 - DNA, 21 bp, Homo sapiens
attcatatacaaacatgtatg

SEQ ID NO: 1599770 - DNA, 19 bp, Homo sapiens
attcatatttacttcttat

SEQ ID NO: 1599771 - DNA, 17 bp, Homo sapiens
attcatatttgtacttt

SEQ ID NO: 1599772 - DNA, 19 bp, Homo sapiens
attcatatttgtactttct

SEQ ID NO: 1599773 - DNA, 23 bp, Homo sapiens
attcatcaatatccctcttgtaa

SEQ ID NO: 1599774 - DNA, 15 bp, Homo sapiens
attcatctaatgtat

SEQ ID NO: 1599775 - DNA, 16 bp, Homo sapiens
attcatctatttcgag

SEQ ID NO: 1599776 - DNA, 20 bp, Homo sapiens
attcatctatttcgagtgtt

SEQ ID NO: 1599777 - DNA, 20 bp, Homo sapiens
attcatgaagcttacttttt

SEQ ID NO: 1599778 - DNA, 20 bp, Homo sapiens
attcatgcaagagtttcttg

SEQ ID NO: 1599779 - DNA, 14 bp, Homo sapiens
attcatgccatctg

SEQ ID NO: 1599780 - DNA, 17 bp, Homo sapiens
attcatggcctggggga

SEQ ID NO: 1599781 - DNA, 19 bp, Homo sapiens
attcattcttagctcttaa

SEQ ID NO: 1599782 - DNA, 15 bp, Homo sapiens
attcattgttttgca

SEQ ID NO: 1599783 - DNA, 10 bp, Homo sapiens
attcatttaa

SEQ ID NO: 1599784 - DNA, 13 bp, Homo sapiens
attcatttaaaat

SEQ ID NO: 1599785 - DNA, 15 bp, Homo sapiens
attcatttaaaatga

SEQ ID NO: 1599786 - DNA, 16 bp, Homo sapiens
attcatttaaaatgat

SEQ ID NO: 1599787 - DNA, 12 bp, Homo sapiens
attcatttctaa

SEQ ID NO: 1599788 - DNA, 13 bp, Homo sapiens
attcatttctaga

SEQ ID NO: 1599789 - DNA, 14 bp, Homo sapiens
attcatttgtattg

SEQ ID NO: 1599790 - DNA, 20 bp, Homo sapiens
attcatttgtattgcttatt

SEQ ID NO: 1599791 - DNA, 23 bp, Homo sapiens
attcatttgtattgcttatttta

SEQ ID NO: 1599792 - DNA, 14 bp, Homo sapiens
attcattttcctgt

SEQ ID NO: 1599793 - DNA, 15 bp, Homo sapiens
attcattttcctgtt

SEQ ID NO: 1599794 - DNA, 17 bp, Homo sapiens
attcattttcctgttca

SEQ ID NO: 1599795 - DNA, 22 bp, Homo sapiens
attcattttcctgttcagtgag

SEQ ID NO: 1599796 - DNA, 13 bp, Homo sapiens
attcatttttaag

SEQ ID NO: 1599797 - DNA, 13 bp, Homo sapiens
attcatttttaat

SEQ ID NO: 1599798 - DNA, 12 bp, Homo sapiens
attccaaaatat

SEQ ID NO: 1599799 - DNA, 19 bp, Homo sapiens
attccaaagtctctaattc

SEQ ID NO: 1599800 - DNA, 22 bp, Homo sapiens
attccaagacatgtctgttcta

SEQ ID NO: 1599801 - DNA, 17 bp, Homo sapiens
attccaagactctagag

SEQ ID NO: 1599802 - DNA, 18 bp, Homo sapiens
attccaagactctagagt

SEQ ID NO: 1599803 - DNA, 13 bp, Homo sapiens
attccaattctaa

SEQ ID NO: 1599804 - DNA, 14 bp, Homo sapiens
attccaattctaaa

SEQ ID NO: 1599805 - DNA, 19 bp, Homo sapiens
attccaattctaaatccga

SEQ ID NO: 1599806 - DNA, 15 bp, Homo sapiens
attccaccattcaca

SEQ ID NO: 1599807 - DNA, 16 bp, Homo sapiens
attccaccattcacat

SEQ ID NO: 1599808 - DNA, 16 bp, Homo sapiens
attccacctgcaatca

SEQ ID NO: 1599809 - DNA, 17 bp, Homo sapiens
attccactacacctggc

SEQ ID NO: 1599810 - DNA, 22 bp, Homo sapiens
attccactcgtccaagggacag

SEQ ID NO: 1599811 - DNA, 12 bp, Homo sapiens
attccactggac

SEQ ID NO: 1599812 - DNA, 13 bp, Homo sapiens
attccagaatctt

SEQ ID NO: 1599813 - DNA, 23 bp, Homo sapiens
attccagactgcttccaattttc

SEQ ID NO: 1599814 - DNA, 18 bp, Homo sapiens
attccagagacatcagca

SEQ ID NO: 1599815 - DNA, 19 bp, Homo sapiens
attccagagagtggctcct

SEQ ID NO: 1599816 - DNA, 12 bp, Homo sapiens
attccagaggaa

SEQ ID NO: 1599817 - DNA, 16 bp, Homo sapiens
attccagagttaaaat

SEQ ID NO: 1599818 - DNA, 22 bp, Homo sapiens
attccagagttaaaatgtttac

SEQ ID NO: 1599819 - DNA, 21 bp, Homo sapiens
attccagatctttcagaaata

SEQ ID NO: 1599820 - DNA, 17 bp, Homo sapiens
attccagcccctctggt

SEQ ID NO: 1599821 - DNA, 18 bp, Homo sapiens
attccagctctgcccccg

SEQ ID NO: 1599822 - DNA, 23 bp, Homo sapiens
attccagctgtcactctgtgcct

SEQ ID NO: 1599823 - DNA, 12 bp, Homo sapiens
attccaggctga

SEQ ID NO: 1599824 - DNA, 14 bp, Homo sapiens
attccagtaacttt

SEQ ID NO: 1599825 - DNA, 18 bp, Homo sapiens
attccagtacagtattct

SEQ ID NO: 1599826 - DNA, 14 bp, Homo sapiens
attccataatacat

SEQ ID NO: 1599827 - DNA, 15 bp, Homo sapiens
attccataatacata

SEQ ID NO: 1599828 - DNA, 18 bp, Homo sapiens
attccatccatatacttt

SEQ ID NO: 1599829 - DNA, 14 bp, Homo sapiens
attccatcttgtaa

SEQ ID NO: 1599830 - DNA, 15 bp, Homo sapiens
attccatgaatgtat

SEQ ID NO: 1599831 - DNA, 18 bp, Homo sapiens
attccatggaatttctag

SEQ ID NO: 1599832 - DNA, 16 bp, Homo sapiens
attcccactcaccagc

SEQ ID NO: 1599833 - DNA, 18 bp, Homo sapiens
attcccactcaccagccc

SEQ ID NO: 1599834 - DNA, 19 bp, Homo sapiens
attcccactcaccagccct

SEQ ID NO: 1599835 - DNA, 23 bp, Homo sapiens
attcccactcaccagccctagct

SEQ ID NO: 1599836 - DNA, 15 bp, Homo sapiens
attcccactgccagg

SEQ ID NO: 1599837 - DNA, 17 bp, Homo sapiens
attcccagagcaaaata

SEQ ID NO: 1599838 - DNA, 21 bp, Homo sapiens
attccccaggtggctgaccca

SEQ ID NO: 1599839 - DNA, 21 bp, Homo sapiens
attcccccagccaaactgtct

SEQ ID NO: 1599840 - DNA, 21 bp, Homo sapiens
attcccccatgtggctgaaga

SEQ ID NO: 1599841 - DNA, 22 bp, Homo sapiens
attcccctcccacctctccttt

SEQ ID NO: 1599842 - DNA, 15 bp, Homo sapiens
attcccctttgcact

SEQ ID NO: 1599843 - DNA, 21 bp, Homo sapiens
attcccgttttgtcacttttt

SEQ ID NO: 1599844 - DNA, 17 bp, Homo sapiens
attccctacagcctagg

SEQ ID NO: 1599845 - DNA, 13 bp, Homo sapiens
attccctccattt

SEQ ID NO: 1599846 - DNA, 12 bp, Homo sapiens
attccctccccc

SEQ ID NO: 1599847 - DNA, 17 bp, Homo sapiens
attccctccccctcctt

SEQ ID NO: 1599848 - DNA, 21 bp, Homo sapiens
attccctcctgctactctgtt

SEQ ID NO: 1599849 - DNA, 13 bp, Homo sapiens
attcccttgtatt

SEQ ID NO: 1599850 - DNA, 14 bp, Homo sapiens
attcccttgtattt

SEQ ID NO: 1599851 - DNA, 15 bp, Homo sapiens
attccgagcattcca

SEQ ID NO: 1599852 - DNA, 16 bp, Homo sapiens
attccgagcattccag

SEQ ID NO: 1599853 - DNA, 22 bp, Homo sapiens
attccgagcattccagtaactt

SEQ ID NO: 1599854 - DNA, 23 bp, Homo sapiens
attccggaaactagtgtacattt

SEQ ID NO: 1599855 - DNA, 12 bp, Homo sapiens
attccgtcacca

SEQ ID NO: 1599856 - DNA, 13 bp, Homo sapiens
attccgttaggaa

SEQ ID NO: 1599857 - DNA, 20 bp, Homo sapiens
attcctaacacagcatgtgt

SEQ ID NO: 1599858 - DNA, 18 bp, Homo sapiens
attcctaacttttcaatg

SEQ ID NO: 1599859 - DNA, 15 bp, Homo sapiens
attcctaagccactt

SEQ ID NO: 1599860 - DNA, 13 bp, Homo sapiens
attcctacaactt

SEQ ID NO: 1599861 - DNA, 21 bp, Homo sapiens
attcctacaacttaatggaaa

SEQ ID NO: 1599862 - DNA, 19 bp, Homo sapiens
attcctagataaaaagatg

SEQ ID NO: 1599863 - DNA, 21 bp, Homo sapiens
attcctagataaaaagatggc

SEQ ID NO: 1599864 - DNA, 23 bp, Homo sapiens
attcctaggaggaaaaagaaatg

SEQ ID NO: 1599865 - DNA, 19 bp, Homo sapiens
attcctcatgaatgtaaat

SEQ ID NO: 1599866 - DNA, 16 bp, Homo sapiens
attcctccctccggcc

SEQ ID NO: 1599867 - DNA, 16 bp, Homo sapiens
attcctcctataggga

SEQ ID NO: 1599868 - DNA, 13 bp, Homo sapiens
attcctcctgctc

SEQ ID NO: 1599869 - DNA, 13 bp, Homo sapiens
attcctctcttaa

SEQ ID NO: 1599870 - DNA, 22 bp, Homo sapiens
attcctctgggaatgttacatt

SEQ ID NO: 1599871 - DNA, 17 bp, Homo sapiens
attcctgaatgaaatat

SEQ ID NO: 1599872 - DNA, 17 bp, Homo sapiens
attcctgacccaggccg

SEQ ID NO: 1599873 - DNA, 21 bp, Homo sapiens
attcctgacccaggccgcagc

SEQ ID NO: 1599874 - DNA, 22 bp, Homo sapiens
attcctgactaacccctctctt

SEQ ID NO: 1599875 - DNA, 12 bp, Homo sapiens
attatttaaaca

SEQ ID NO: 1599876 - DNA, 12 bp, Homo sapiens
attatttataat

SEQ ID NO: 1599877 - DNA, 16 bp, Homo sapiens
attatttatatatgta

SEQ ID NO: 1599878 - DNA, 22 bp, Homo sapiens
attatttatatggggaatatat

SEQ ID NO: 1599879 - DNA, 14 bp, Homo sapiens
attatttatgacct

SEQ ID NO: 1599880 - DNA, 15 bp, Homo sapiens
attatttcaccagca

SEQ ID NO: 1599881 - DNA, 12 bp, Homo sapiens
attatttcttct

SEQ ID NO: 1599882 - DNA, 13 bp, Homo sapiens
attatttcttctc

SEQ ID NO: 1599883 - DNA, 16 bp, Homo sapiens
attatttcttctctta

SEQ ID NO: 1599884 - DNA, 16 bp, Homo sapiens
attatttgaatgacta

SEQ ID NO: 1599885 - DNA, 22 bp, Homo sapiens
attatttgcttttcatgtagaa

SEQ ID NO: 1599886 - DNA, 13 bp, Homo sapiens
attattttaaaat

SEQ ID NO: 1599887 - DNA, 16 bp, Homo sapiens
attattttaaaatatt

SEQ ID NO: 1599888 - DNA, 17 bp, Homo sapiens
attattttaaaatattt

SEQ ID NO: 1599889 - DNA, 18 bp, Homo sapiens
attattttaaaatattta

SEQ ID NO: 1599890 - DNA, 16 bp, Homo sapiens
attattttaatatttt

SEQ ID NO: 1599891 - DNA, 21 bp, Homo sapiens
attattttcttcatccaactt

SEQ ID NO: 1599892 - DNA, 17 bp, Homo sapiens
attattttgttcataca

SEQ ID NO: 1599893 - DNA, 21 bp, Homo sapiens
attattttgttcatacatatt

SEQ ID NO: 1599894 - DNA, 14 bp, Homo sapiens
attatttttataat

SEQ ID NO: 1599895 - DNA, 18 bp, Homo sapiens
attatttttataattgta

SEQ ID NO: 1599896 - DNA, 11 bp, Homo sapiens
attatttttgt

SEQ ID NO: 1599897 - DNA, 17 bp, Homo sapiens
attatttttgtgtttct

SEQ ID NO: 1599898 - DNA, 20 bp, Homo sapiens
attatttttgtgtttctaaa

SEQ ID NO: 1599899 - DNA, 16 bp, Homo sapiens
attattttttatactg

SEQ ID NO: 1599900 - DNA, 21 bp, Homo sapiens
attatttttttaaaattttgt

SEQ ID NO: 1599901 - DNA, 21 bp, Homo sapiens
attcaaaaaactctctcccag

SEQ ID NO: 1599902 - DNA, 19 bp, Homo sapiens
attcaaaaagtcacagtta

SEQ ID NO: 1599903 - DNA, 16 bp, Homo sapiens
attcaaaagttgaaat

SEQ ID NO: 1599904 - DNA, 17 bp, Homo sapiens
attcaaaatagttctat

SEQ ID NO: 1599905 - DNA, 18 bp, Homo sapiens
attcaaactgctccaagt

SEQ ID NO: 1599906 - DNA, 19 bp, Homo sapiens
attcaaactggggcctcca

SEQ ID NO: 1599907 - DNA, 15 bp, Homo sapiens
attcaaatcagtgat

SEQ ID NO: 1599908 - DNA, 15 bp, Homo sapiens
attcaaattgctgct

SEQ ID NO: 1599909 - DNA, 18 bp, Homo sapiens
attcaaattgctgcttgg

SEQ ID NO: 1599910 - DNA, 21 bp, Homo sapiens
attcaaattgctgcttggatt

SEQ ID NO: 1599911 - DNA, 14 bp, Homo sapiens
attcaaatttgatg

SEQ ID NO: 1599912 - DNA, 14 bp, Homo sapiens
attcaaatttgtac

SEQ ID NO: 1599913 - DNA, 22 bp, Homo sapiens
attcaacaatttcaataaaaga

SEQ ID NO: 1599914 - DNA, 15 bp, Homo sapiens
attcaacacttattt

SEQ ID NO: 1599915 - DNA, 18 bp, Homo sapiens
attcaacacttattttct

SEQ ID NO: 1599916 - DNA, 22 bp, Homo sapiens
attcaaccactgtaaaatgaaa

SEQ ID NO: 1599917 - DNA, 18 bp, Homo sapiens
attcaagaaaataaaact

SEQ ID NO: 1599918 - DNA, 19 bp, Homo sapiens
attcaagagctagaaaaat

SEQ ID NO: 1599919 - DNA, 20 bp, Homo sapiens
attcaagagctagaaaaata

SEQ ID NO: 1599920 - DNA, 16 bp, Homo sapiens
attcaagcctgtgaat

SEQ ID NO: 1599921 - DNA, 21 bp, Homo sapiens
attcaagctatttaatatctg

SEQ ID NO: 1599922 - DNA, 16 bp, Homo sapiens
attcaaggaatttctt

SEQ ID NO: 1599923 - DNA, 22 bp, Homo sapiens
attcaaggaatttcttaacttc

SEQ ID NO: 1599924 - DNA, 18 bp, Homo sapiens
attcaaggagaatatgat

SEQ ID NO: 1599925 - DNA, 20 bp, Homo sapiens
attcaaggagaatatgataa

SEQ ID NO: 1599926 - DNA, 20 bp, Homo sapiens
attcaagtattgagaacctg

SEQ ID NO: 1599927 - DNA, 14 bp, Homo sapiens
attcaagtatttga

SEQ ID NO: 1599928 - DNA, 12 bp, Homo sapiens
attcaagtgcct

SEQ ID NO: 1599929 - DNA, 21 bp, Homo sapiens
attcaagtgcctcttgttgca

SEQ ID NO: 1599930 - DNA, 22 bp, Homo sapiens
attcaataaaaaaaagaaatga

SEQ ID NO: 1599931 - DNA, 17 bp, Homo sapiens
attcaataccgctcagt

SEQ ID NO: 1599932 - DNA, 21 bp, Homo sapiens
attcaatagtaatataataca

SEQ ID NO: 1599933 - DNA, 13 bp, Homo sapiens
attcaatattgac

SEQ ID NO: 1599934 - DNA, 17 bp, Homo sapiens
attcaatattgacattt

SEQ ID NO: 1599935 - DNA, 15 bp, Homo sapiens
attcaatcatttatt

SEQ ID NO: 1599936 - DNA, 18 bp, Homo sapiens
attcaatcatttattcat

SEQ ID NO: 1599937 - DNA, 14 bp, Homo sapiens
attcaatctgtaaa

SEQ ID NO: 1599938 - DNA, 15 bp, Homo sapiens
attcaatctgtaaac

SEQ ID NO: 1599939 - DNA, 13 bp, Homo sapiens
attcaatgtgaca

SEQ ID NO: 1599940 - DNA, 17 bp, Homo sapiens
attcaattcctctggga

SEQ ID NO: 1599941 - DNA, 18 bp, Homo sapiens
attcaattcctctgggaa

SEQ ID NO: 1599942 - DNA, 16 bp, Homo sapiens
attcacaataaaagct

SEQ ID NO: 1599943 - DNA, 13 bp, Homo sapiens
attcacaatagaa

SEQ ID NO: 1599944 - DNA, 18 bp, Homo sapiens
attcacacagggctcttt

SEQ ID NO: 1599945 - DNA, 15 bp, Homo sapiens
attcacacctgactc

SEQ ID NO: 1599946 - DNA, 16 bp, Homo sapiens
attcacacttgaacca

SEQ ID NO: 1599947 - DNA, 14 bp, Homo sapiens
attcacagagcctt

SEQ ID NO: 1599948 - DNA, 19 bp, Homo sapiens
attcacagtgctcttttct

SEQ ID NO: 1599949 - DNA, 15 bp, Homo sapiens
attcacatttagaaa

SEQ ID NO: 1599950 - DNA, 20 bp, Homo sapiens
attcacatttgatgtacatg

SEQ ID NO: 1599951 - DNA, 21 bp, Homo sapiens
attcaccaaaatagtcttctc

SEQ ID NO: 1599952 - DNA, 20 bp, Homo sapiens
attcacccccctctgctgcc

SEQ ID NO: 1599953 - DNA, 16 bp, Homo sapiens
attcaccccctttcct

SEQ ID NO: 1599954 - DNA, 13 bp, Homo sapiens
attcacctcttcc

SEQ ID NO: 1599955 - DNA, 15 bp, Homo sapiens
attcacctcttcctc

SEQ ID NO: 1599956 - DNA, 18 bp, Homo sapiens
attcacctcttcctctgg

SEQ ID NO: 1599957 - DNA, 23 bp, Homo sapiens
attcaccttccagtgtctcggag

SEQ ID NO: 1599958 - DNA, 20 bp, Homo sapiens
attcacgccgtaattctttc

SEQ ID NO: 1599959 - DNA, 16 bp, Homo sapiens
attcactagaaaatga

SEQ ID NO: 1599960 - DNA, 15 bp, Homo sapiens
attcactccagtcaa

SEQ ID NO: 1599961 - DNA, 21 bp, Homo sapiens
attcactccagtcaacagatt

SEQ ID NO: 1599962 - DNA, 22 bp, Homo sapiens
attcactccagtcaacagattc

SEQ ID NO: 1599963 - DNA, 15 bp, Homo sapiens
attcactctccatta

SEQ ID NO: 1599964 - DNA, 15 bp, Homo sapiens
attcactcttccaga

SEQ ID NO: 1599965 - DNA, 18 bp, Homo sapiens
attcactgccttcctctc

SEQ ID NO: 1599966 - DNA, 17 bp, Homo sapiens
attcactgtttcactga

SEQ ID NO: 1599967 - DNA, 13 bp, Homo sapiens
attcacttaagtt

SEQ ID NO: 1599968 - DNA, 17 bp, Homo sapiens
attcacttaagtttttc

SEQ ID NO: 1599969 - DNA, 14 bp, Homo sapiens
attcacttgcattt

SEQ ID NO: 1599970 - DNA, 18 bp, Homo sapiens
attcagaatatcatcttt

SEQ ID NO: 1599971 - DNA, 14 bp, Homo sapiens
attcagacaacatt

SEQ ID NO: 1599972 - DNA, 17 bp, Homo sapiens
attcagacaacattatg

SEQ ID NO: 1599973 - DNA, 19 bp, Homo sapiens
attcagatcactgaattta

SEQ ID NO: 1599974 - DNA, 16 bp, Homo sapiens
attcagcaccctgggt

SEQ ID NO: 1599975 - DNA, 18 bp, Homo sapiens
attcagcaccctgggtgc

SEQ ID NO: 1599976 - DNA, 20 bp, Homo sapiens
attcagcaccctgggtgcca

SEQ ID NO: 1599977 - DNA, 21 bp, Homo sapiens
attcagcactgatttcacaac

SEQ ID NO: 1599978 - DNA, 19 bp, Homo sapiens
attcagcatttgatttcca

SEQ ID NO: 1599979 - DNA, 14 bp, Homo sapiens
attcagccagctta

SEQ ID NO: 1599980 - DNA, 19 bp, Homo sapiens
attcagccagcttaaaccc

SEQ ID NO: 1599981 - DNA, 15 bp, Homo sapiens
attcagctctggaga

SEQ ID NO: 1599982 - DNA, 19 bp, Homo sapiens
attcaggacttgaaagaaa

SEQ ID NO: 1599983 - DNA, 16 bp, Homo sapiens
attcaggccagcccag

SEQ ID NO: 1599984 - DNA, 18 bp, Homo sapiens
attcagggtaaataggaa

SEQ ID NO: 1599985 - DNA, 20 bp, Homo sapiens
attcaggtacagaaaacatg

SEQ ID NO: 1599986 - DNA, 18 bp, Homo sapiens
attcaggtatgttgcctt

SEQ ID NO: 1599987 - DNA, 20 bp, Homo sapiens
attcaggtatgttgccttta

SEQ ID NO: 1599988 - DNA, 23 bp, Homo sapiens
attcaggtggccagaagagcttg

SEQ ID NO: 1599989 - DNA, 14 bp, Homo sapiens
attcaggtttttcc

SEQ ID NO: 1599990 - DNA, 23 bp, Homo sapiens
attcaggtttttcctttttttgt

SEQ ID NO: 1599991 - DNA, 19 bp, Homo sapiens
attcagtaaacaaattctt

SEQ ID NO: 1599992 - DNA, 11 bp, Homo sapiens
attaaaatata

SEQ ID NO: 1599993 - DNA, 18 bp, Homo sapiens
attaaaatatagagacag

SEQ ID NO: 1599994 - DNA, 23 bp, Homo sapiens
attaaaatatagagacaggacag

SEQ ID NO: 1599995 - DNA, 18 bp, Homo sapiens
attaaaatctacagaact

SEQ ID NO: 1599996 - DNA, 13 bp, Homo sapiens
attaaacaaagtt

SEQ ID NO: 1599997 - DNA, 20 bp, Homo sapiens
attaaacaaagtttcagagt

SEQ ID NO: 1599998 - DNA, 14 bp, Homo sapiens
attaaacacaggga

SEQ ID NO: 1599999 - DNA, 14 bp, Homo sapiens
attaaacactgtaa

SEQ ID NO: 1600000 - DNA, 15 bp, Homo sapiens
attaaacactgtaat

SEQ ID NO: 1600001 - DNA, 20 bp, Homo sapiens
attaaaccaatgaagaagac

SEQ ID NO: 1600002 - DNA, 21 bp, Homo sapiens
attaaaccaatgaagaagaca

SEQ ID NO: 1600003 - DNA, 21 bp, Homo sapiens
attaaacttccaaagaaagtt

SEQ ID NO: 1600004 - DNA, 13 bp, Homo sapiens
attaaacttgaag

SEQ ID NO: 1600005 - DNA, 17 bp, Homo sapiens
attaaacttgaagcagt

SEQ ID NO: 1600006 - DNA, 12 bp, Homo sapiens
attaaacttttt

SEQ ID NO: 1600007 - DNA, 15 bp, Homo sapiens
attaaagattctctt

SEQ ID NO: 1600008 - DNA, 17 bp, Homo sapiens
attaaagattctcttta

SEQ ID NO: 1600009 - DNA, 16 bp, Homo sapiens
attaaagcatttccta

SEQ ID NO: 1600010 - DNA, 17 bp, Homo sapiens
attaaagctaaagtatc

SEQ ID NO: 1600011 - DNA, 18 bp, Homo sapiens
attaaagctaaagtatct

SEQ ID NO: 1600012 - DNA, 12 bp, Homo sapiens
attaaaggaagg

SEQ ID NO: 1600013 - DNA, 13 bp, Homo sapiens
attaaaggaagga

SEQ ID NO: 1600014 - DNA, 14 bp, Homo sapiens
attaaagtaaatgg

SEQ ID NO: 1600015 - DNA, 16 bp, Homo sapiens
attaaagtcagaagtt

SEQ ID NO: 1600016 - DNA, 19 bp, Homo sapiens
attaaagtgctaaggttct

SEQ ID NO: 1600017 - DNA, 23 bp, Homo sapiens
attaaagtgctaaggttctaagg

SEQ ID NO: 1600018 - DNA, 15 bp, Homo sapiens
attaaataagattct

SEQ ID NO: 1600019 - DNA, 19 bp, Homo sapiens
attaaataagattctaacg

SEQ ID NO: 1600020 - DNA, 19 bp, Homo sapiens
attaaatacagacactaag

SEQ ID NO: 1600021 - DNA, 15 bp, Homo sapiens
attaaatatttgaag

SEQ ID NO: 1600022 - DNA, 16 bp, Homo sapiens
attaaatatttgaaga

SEQ ID NO: 1600023 - DNA, 17 bp, Homo sapiens
attaaatccaactttca

SEQ ID NO: 1600024 - DNA, 16 bp, Homo sapiens
attaaatcttaaacaa

SEQ ID NO: 1600025 - DNA, 20 bp, Homo sapiens
attaaatcttaaacaatgta

SEQ ID NO: 1600026 - DNA, 16 bp, Homo sapiens
attaaatgcttcattt

SEQ ID NO: 1600027 - DNA, 20 bp, Homo sapiens
attaaatgtagacagatatt

SEQ ID NO: 1600028 - DNA, 14 bp, Homo sapiens
attaaattacattt

SEQ ID NO: 1600029 - DNA, 15 bp, Homo sapiens
attaaattacatttg

SEQ ID NO: 1600030 - DNA, 14 bp, Homo sapiens
attaaattctgagc

SEQ ID NO: 1600031 - DNA, 20 bp, Homo sapiens
attaaattgggcttcaatca

SEQ ID NO: 1600032 - DNA, 15 bp, Homo sapiens
attaaatttaatata

SEQ ID NO: 1600033 - DNA, 17 bp, Homo sapiens
attaaatttaatatact

SEQ ID NO: 1600034 - DNA, 15 bp, Homo sapiens
attaaatttaattag

SEQ ID NO: 1600035 - DNA, 20 bp, Homo sapiens
attaaatttatttgaaaatg

SEQ ID NO: 1600036 - DNA, 18 bp, Homo sapiens
attaaatttcaaatgcag

SEQ ID NO: 1600037 - DNA, 20 bp, Homo sapiens
attaaattttgagttctaca

SEQ ID NO: 1600038 - DNA, 20 bp, Homo sapiens
attaacaaattatgttacat

SEQ ID NO: 1600039 - DNA, 15 bp, Homo sapiens
attaacaaatttctt

SEQ ID NO: 1600040 - DNA, 21 bp, Homo sapiens
attaacactactcaaagcaaa

SEQ ID NO: 1600041 - DNA, 17 bp, Homo sapiens
attaaccttactaatta

SEQ ID NO: 1600042 - DNA, 21 bp, Homo sapiens
attaactactgaataatgcta

SEQ ID NO: 1600043 - DNA, 14 bp, Homo sapiens
attaactccctcca

SEQ ID NO: 1600044 - DNA, 21 bp, Homo sapiens
attaactccctccaccagcct

SEQ ID NO: 1600045 - DNA, 23 bp, Homo sapiens
attaactccctccaccagcctgc

SEQ ID NO: 1600046 - DNA, 14 bp, Homo sapiens
attaacttatttag

SEQ ID NO: 1600047 - DNA, 15 bp, Homo sapiens
attaacttatttaga

SEQ ID NO: 1600048 - DNA, 17 bp, Homo sapiens
attaacttatttagaga

SEQ ID NO: 1600049 - DNA, 20 bp, Homo sapiens
attaacttggatgagttttg

SEQ ID NO: 1600050 - DNA, 13 bp, Homo sapiens
attaagaaagact

SEQ ID NO: 1600051 - DNA, 23 bp, Homo sapiens
attaagaaaggaagcattgtaaa

SEQ ID NO: 1600052 - DNA, 15 bp, Homo sapiens
attaagacagtgtac

SEQ ID NO: 1600053 - DNA, 17 bp, Homo sapiens
attaagacagtgtacaa

SEQ ID NO: 1600054 - DNA, 19 bp, Homo sapiens
attaagacagtgtacaaaa

SEQ ID NO: 1600055 - DNA, 14 bp, Homo sapiens
attaagatacaaat

SEQ ID NO: 1600056 - DNA, 15 bp, Homo sapiens
attaagatacaaatt

SEQ ID NO: 1600057 - DNA, 14 bp, Homo sapiens
attaagatctgtgt

SEQ ID NO: 1600058 - DNA, 16 bp, Homo sapiens
attaagattggaaatg

SEQ ID NO: 1600059 - DNA, 13 bp, Homo sapiens
attaagatttcca

SEQ ID NO: 1600060 - DNA, 16 bp, Homo sapiens
attaagatttccaagt

SEQ ID NO: 1600061 - DNA, 17 bp, Homo sapiens
attaagcaaatgttaaa

SEQ ID NO: 1600062 - DNA, 12 bp, Homo sapiens
attaagcacaca

SEQ ID NO: 1600063 - DNA, 13 bp, Homo sapiens
attaagcacacac

SEQ ID NO: 1600064 - DNA, 19 bp, Homo sapiens
attaagcacacacatctgg

SEQ ID NO: 1600065 - DNA, 22 bp, Homo sapiens
attaagcatgacagaaaatatg

SEQ ID NO: 1600066 - DNA, 21 bp, Homo sapiens
attaagcccttatttgttttg

SEQ ID NO: 1600067 - DNA, 17 bp, Homo sapiens
attaagctttttggaat

SEQ ID NO: 1600068 - DNA, 18 bp, Homo sapiens
attaagctttttggaatc

SEQ ID NO: 1600069 - DNA, 16 bp, Homo sapiens
attaagggctacttaa

SEQ ID NO: 1600070 - DNA, 18 bp, Homo sapiens
attaaggggaagaatgaa

SEQ ID NO: 1600071 - DNA, 19 bp, Homo sapiens
attaaggggaagaatgaaa

SEQ ID NO: 1600072 - DNA, 17 bp, Homo sapiens
attaaggtcaagcccag

SEQ ID NO: 1600073 - DNA, 16 bp, Homo sapiens
attaagtactatgtat

SEQ ID NO: 1600074 - DNA, 18 bp, Homo sapiens
attaagtagaacaaaaaa

SEQ ID NO: 1600075 - DNA, 21 bp, Homo sapiens
attaagtagaacaaaaaaccc

SEQ ID NO: 1600076 - DNA, 19 bp, Homo sapiens
attaagtggtcccaatgct

SEQ ID NO: 1600077 - DNA, 15 bp, Homo sapiens
attaagttgaaaaag

SEQ ID NO: 1600078 - DNA, 16 bp, Homo sapiens
attaataaaaaatgga

SEQ ID NO: 1600079 - DNA, 12 bp, Homo sapiens
attaataaagca

SEQ ID NO: 1600080 - DNA, 16 bp, Homo sapiens
attaatacttcatttg

SEQ ID NO: 1600081 - DNA, 17 bp, Homo sapiens
attaatagcagcctttc

SEQ ID NO: 1600082 - DNA, 21 bp, Homo sapiens
attaatatatgtattatttat

SEQ ID NO: 1600083 - DNA, 15 bp, Homo sapiens
attaatatatttcca

SEQ ID NO: 1600084 - DNA, 15 bp, Homo sapiens
attaatatttaccaa

SEQ ID NO: 1600085 - DNA, 22 bp, Homo sapiens
attaatatttaccaaagtagga

SEQ ID NO: 1600086 - DNA, 16 bp, Homo sapiens
attaatcaaaattgtc

SEQ ID NO: 1600087 - DNA, 11 bp, Homo sapiens
attaatcaaag

SEQ ID NO: 1600088 - DNA, 11 bp, Homo sapiens
attaatcaaga

SEQ ID NO: 1600089 - DNA, 18 bp, Homo sapiens
attaatcaagagaaactt

SEQ ID NO: 1600090 - DNA, 14 bp, Homo sapiens
attaatcatacaaa

SEQ ID NO: 1600091 - DNA, 22 bp, Homo sapiens
attaatcatacaaactctcacc

SEQ ID NO: 1600092 - DNA, 14 bp, Homo sapiens
attaatcatagatt

SEQ ID NO: 1600093 - DNA, 22 bp, Homo sapiens
attaatcatagattattataaa

SEQ ID NO: 1600094 - DNA, 23 bp, Homo sapiens
attaatccaaagcttattttgta

SEQ ID NO: 1600095 - DNA, 21 bp, Homo sapiens
attaatccccatcattactgg

SEQ ID NO: 1600096 - DNA, 20 bp, Homo sapiens
attaatctaccttgcagtgt

SEQ ID NO: 1600097 - DNA, 12 bp, Homo sapiens
attaatctctaa

SEQ ID NO: 1600098 - DNA, 14 bp, Homo sapiens
attaatctctaaaa

SEQ ID NO: 1600099 - DNA, 19 bp, Homo sapiens
attaatctctaaaattcta

SEQ ID NO: 1600100 - DNA, 16 bp, Homo sapiens
attaatcttagtgtat

SEQ ID NO: 1600101 - DNA, 18 bp, Homo sapiens
attaatgaaatatctgta

SEQ ID NO: 1600102 - DNA, 15 bp, Homo sapiens
attaatgaagctttt

SEQ ID NO: 1600103 - DNA, 19 bp, Homo sapiens
attaatgatgatcttcaga

SEQ ID NO: 1600104 - DNA, 15 bp, Homo sapiens
attaatgcctttaaa

SEQ ID NO: 1600105 - DNA, 21 bp, Homo sapiens
attaatgcctttaaagtatga

SEQ ID NO: 1600106 - DNA, 16 bp, Homo sapiens
atatctgttattcaaa

SEQ ID NO: 1600107 - DNA, 14 bp, Homo sapiens
atatcttaaagaaa

SEQ ID NO: 1600108 - DNA, 20 bp, Homo sapiens
attagtggtcataaaataga

SEQ ID NO: 1600109 - DNA, 16 bp, Homo sapiens
attagttgcctgactt

SEQ ID NO: 1600110 - DNA, 18 bp, Homo sapiens
attagtttacatcatttt

SEQ ID NO: 1600111 - DNA, 12 bp, Homo sapiens
attagtttcctt

SEQ ID NO: 1600112 - DNA, 20 bp, Homo sapiens
attagtttcctttttaatat

SEQ ID NO: 1600113 - DNA, 12 bp, Homo sapiens
attataaactat

SEQ ID NO: 1600114 - DNA, 14 bp, Homo sapiens
attataaactataa

SEQ ID NO: 1600115 - DNA, 15 bp, Homo sapiens
attataaactataaa

SEQ ID NO: 1600116 - DNA, 14 bp, Homo sapiens
attataacagttat

SEQ ID NO: 1600117 - DNA, 16 bp, Homo sapiens
attataacttaaaata

SEQ ID NO: 1600118 - DNA, 20 bp, Homo sapiens
attataacttaaaatatttt

SEQ ID NO: 1600119 - DNA, 22 bp, Homo sapiens
attataacttgtctaaataagt

SEQ ID NO: 1600120 - DNA, 19 bp, Homo sapiens
attataataaatatataca

SEQ ID NO: 1600121 - DNA, 19 bp, Homo sapiens
attataatatgtgccttaa

SEQ ID NO: 1600122 - DNA, 21 bp, Homo sapiens
attataatatgtgccttaagt

SEQ ID NO: 1600123 - DNA, 22 bp, Homo sapiens
attataatatgtgccttaagtt

SEQ ID NO: 1600124 - DNA, 14 bp, Homo sapiens
attataatgtattc

SEQ ID NO: 1600125 - DNA, 19 bp, Homo sapiens
attataatgtattcatatt

SEQ ID NO: 1600126 - DNA, 22 bp, Homo sapiens
attataatgtattcatatttgt

SEQ ID NO: 1600127 - DNA, 20 bp, Homo sapiens
attataattgtaatggattt

SEQ ID NO: 1600128 - DNA, 18 bp, Homo sapiens
attataattgttgcatag

SEQ ID NO: 1600129 - DNA, 15 bp, Homo sapiens
attatacatgtgata

SEQ ID NO: 1600130 - DNA, 20 bp, Homo sapiens
attatactgtagctgatgaa

SEQ ID NO: 1600131 - DNA, 14 bp, Homo sapiens
attatacttacttc

SEQ ID NO: 1600132 - DNA, 19 bp, Homo sapiens
attatagacaaaagaataa

SEQ ID NO: 1600133 - DNA, 21 bp, Homo sapiens
attatagacaaaagaataaga

SEQ ID NO: 1600134 - DNA, 15 bp, Homo sapiens
attatagatatataa

SEQ ID NO: 1600135 - DNA, 18 bp, Homo sapiens
attatagatatataaata

SEQ ID NO: 1600136 - DNA, 14 bp, Homo sapiens
attatagattctaa

SEQ ID NO: 1600137 - DNA, 16 bp, Homo sapiens
attatagcaactaatg

SEQ ID NO: 1600138 - DNA, 16 bp, Homo sapiens
attatagtttctgagg

SEQ ID NO: 1600139 - DNA, 14 bp, Homo sapiens
attatataagtatt

SEQ ID NO: 1600140 - DNA, 20 bp, Homo sapiens
attatataagtattctaaat

SEQ ID NO: 1600141 - DNA, 20 bp, Homo sapiens
attatatacatactgcatct

SEQ ID NO: 1600142 - DNA, 21 bp, Homo sapiens
attatatattttgttgttcct

SEQ ID NO: 1600143 - DNA, 16 bp, Homo sapiens
attatatgcctgattc

SEQ ID NO: 1600144 - DNA, 14 bp, Homo sapiens
attatattaaaata

SEQ ID NO: 1600145 - DNA, 13 bp, Homo sapiens
attatattaaaca

SEQ ID NO: 1600146 - DNA, 15 bp, Homo sapiens
attatattaaacata

SEQ ID NO: 1600147 - DNA, 15 bp, Homo sapiens
attatattcaatgca

SEQ ID NO: 1600148 - DNA, 21 bp, Homo sapiens
attatattcaatgcatttaaa

SEQ ID NO: 1600149 - DNA, 13 bp, Homo sapiens
attatattcacag

SEQ ID NO: 1600150 - DNA, 19 bp, Homo sapiens
attatattcacagactgat

SEQ ID NO: 1600151 - DNA, 12 bp, Homo sapiens
attatattgttt

SEQ ID NO: 1600152 - DNA, 14 bp, Homo sapiens
attatatttgacat

SEQ ID NO: 1600153 - DNA, 20 bp, Homo sapiens
attatatttgacatgggtat

SEQ ID NO: 1600154 - DNA, 22 bp, Homo sapiens
attatcaaagggataaagaaaa

SEQ ID NO: 1600155 - DNA, 15 bp, Homo sapiens
attatcagcaaagaa

SEQ ID NO: 1600156 - DNA, 15 bp, Homo sapiens
attatcatgcaaatg

SEQ ID NO: 1600157 - DNA, 17 bp, Homo sapiens
attatcatgcaaatgct

SEQ ID NO: 1600158 - DNA, 20 bp, Homo sapiens
attatcctcctgttctgaaa

SEQ ID NO: 1600159 - DNA, 19 bp, Homo sapiens
attatcgggaacagtgttt

SEQ ID NO: 1600160 - DNA, 16 bp, Homo sapiens
attatcgggagcagtg

SEQ ID NO: 1600161 - DNA, 20 bp, Homo sapiens
attatcgggagcagtgtctt

SEQ ID NO: 1600162 - DNA, 18 bp, Homo sapiens
attatctcaaaactgcac

SEQ ID NO: 1600163 - DNA, 23 bp, Homo sapiens
attatctcaaaactgcactgtca

SEQ ID NO: 1600164 - DNA, 12 bp, Homo sapiens
attatcttcagc

SEQ ID NO: 1600165 - DNA, 20 bp, Homo sapiens
attatgagaggcaatgattg

SEQ ID NO: 1600166 - DNA, 18 bp, Homo sapiens
attatgaggctattaaaa

SEQ ID NO: 1600167 - DNA, 13 bp, Homo sapiens
attatgatctaat

SEQ ID NO: 1600168 - DNA, 15 bp, Homo sapiens
attatgatctaataa

SEQ ID NO: 1600169 - DNA, 19 bp, Homo sapiens
attatgatctaataaactt

SEQ ID NO: 1600170 - DNA, 20 bp, Homo sapiens
attatgatctaataaacttt

SEQ ID NO: 1600171 - DNA, 21 bp, Homo sapiens
attatgatctaataaacttta

SEQ ID NO: 1600172 - DNA, 12 bp, Homo sapiens
attatgcataaa

SEQ ID NO: 1600173 - DNA, 16 bp, Homo sapiens
attatgcattatatca

SEQ ID NO: 1600174 - DNA, 22 bp, Homo sapiens
attatgcctgagttataaatat

SEQ ID NO: 1600175 - DNA, 20 bp, Homo sapiens
attatgcttccacaggcaaa

SEQ ID NO: 1600176 - DNA, 16 bp, Homo sapiens
attatggaagatttta

SEQ ID NO: 1600177 - DNA, 20 bp, Homo sapiens
attatggaagattttaaatt

SEQ ID NO: 1600178 - DNA, 15 bp, Homo sapiens
attatgggtcacagg

SEQ ID NO: 1600179 - DNA, 23 bp, Homo sapiens
attatgggttaggcattaatgtt

SEQ ID NO: 1600180 - DNA, 23 bp, Homo sapiens
attatgtaaatacaatttgtact

SEQ ID NO: 1600181 - DNA, 17 bp, Homo sapiens
attatgtaatatattgt

SEQ ID NO: 1600182 - DNA, 19 bp, Homo sapiens
attatgtaccatgaatatt

SEQ ID NO: 1600183 - DNA, 14 bp, Homo sapiens
attatgtataacaa

SEQ ID NO: 1600184 - DNA, 15 bp, Homo sapiens
attatgtataacaag

SEQ ID NO: 1600185 - DNA, 20 bp, Homo sapiens
attatgtatggatatatttg

SEQ ID NO: 1600186 - DNA, 15 bp, Homo sapiens
attatgtatgtttac

SEQ ID NO: 1600187 - DNA, 16 bp, Homo sapiens
attatgtcttcttttg

SEQ ID NO: 1600188 - DNA, 20 bp, Homo sapiens
attatgtgaccataatgtac

SEQ ID NO: 1600189 - DNA, 18 bp, Homo sapiens
attatgttcctgctgtat

SEQ ID NO: 1600190 - DNA, 22 bp, Homo sapiens
attatgttcctgctgtatttcc

SEQ ID NO: 1600191 - DNA, 19 bp, Homo sapiens
attatgttcttagcaataa

SEQ ID NO: 1600192 - DNA, 23 bp, Homo sapiens
attatgttcttagcaataaatgc

SEQ ID NO: 1600193 - DNA, 15 bp, Homo sapiens
attatgtttattaca

SEQ ID NO: 1600194 - DNA, 20 bp, Homo sapiens
attatgtttattacaatttt

SEQ ID NO: 1600195 - DNA, 16 bp, Homo sapiens
attatgttttttaaaa

SEQ ID NO: 1600196 - DNA, 20 bp, Homo sapiens
attatgttttttaaaatatt

SEQ ID NO: 1600197 - DNA, 20 bp, Homo sapiens
attattaccttacagaagtt

SEQ ID NO: 1600198 - DNA, 20 bp, Homo sapiens
attattacttatttttgaca

SEQ ID NO: 1600199 - DNA, 21 bp, Homo sapiens
attattacttatttttgacag

SEQ ID NO: 1600200 - DNA, 22 bp, Homo sapiens
attattagccaggtaatgtgaa

SEQ ID NO: 1600201 - DNA, 22 bp, Homo sapiens
attattagtttacatcattttt

SEQ ID NO: 1600202 - DNA, 14 bp, Homo sapiens
attattataaacta

SEQ ID NO: 1600203 - DNA, 15 bp, Homo sapiens
attattataaactat

SEQ ID NO: 1600204 - DNA, 13 bp, Homo sapiens
attattatagcaa

SEQ ID NO: 1600205 - DNA, 14 bp, Homo sapiens
attattatgttctt

SEQ ID NO: 1600206 - DNA, 22 bp, Homo sapiens
attattatgtttattacaattt

SEQ ID NO: 1600207 - DNA, 16 bp, Homo sapiens
attattattcttcata

SEQ ID NO: 1600208 - DNA, 16 bp, Homo sapiens
attattatttctgttc

SEQ ID NO: 1600209 - DNA, 19 bp, Homo sapiens
attattcaagaatgaaaaa

SEQ ID NO: 1600210 - DNA, 20 bp, Homo sapiens
attattcaagaatgaaaaat

SEQ ID NO: 1600211 - DNA, 21 bp, Homo sapiens
attattcaagtgcctcttgtt

SEQ ID NO: 1600212 - DNA, 20 bp, Homo sapiens
attattcatttaaaatgatt

SEQ ID NO: 1600213 - DNA, 12 bp, Homo sapiens
attattctagtc

SEQ ID NO: 1600214 - DNA, 18 bp, Homo sapiens
attattctagtcaactgc

SEQ ID NO: 1600215 - DNA, 23 bp, Homo sapiens
attattctagtcaactgctgttt

SEQ ID NO: 1600216 - DNA, 12 bp, Homo sapiens
attattctctgc

SEQ ID NO: 1600217 - DNA, 16 bp, Homo sapiens
attattctttctcctt

SEQ ID NO: 1600218 - DNA, 12 bp, Homo sapiens
attattgacact

SEQ ID NO: 1600219 - DNA, 15 bp, Homo sapiens
attattgacactgaa

SEQ ID NO: 1600220 - DNA, 15 bp, Homo sapiens
attattgctgtttgg

SEQ ID NO: 1600221 - DNA, 21 bp, Homo sapiens
attattggaaaggacctaaaa

SEQ ID NO: 1600222 - DNA, 20 bp, Homo sapiens
attattgtgacttcactgta

SEQ ID NO: 1600223 - DNA, 21 bp, Homo sapiens
attattgttcccctaagtgga

SEQ ID NO: 1600224 - DNA, 18 bp, Homo sapiens
atgaataaagcctttgta

SEQ ID NO: 1600225 - DNA, 21 bp, Homo sapiens
atgaatacagggcatgcattt

SEQ ID NO: 1600226 - DNA, 21 bp, Homo sapiens
atgaatacatttccaaaatgg

SEQ ID NO: 1600227 - DNA, 21 bp, Homo sapiens
atgaatagatggaatttggaa

SEQ ID NO: 1600228 - DNA, 20 bp, Homo sapiens
atgaatagatgtgatcactg

SEQ ID NO: 1600229 - DNA, 18 bp, Homo sapiens
atgaatatcatacaaatc

SEQ ID NO: 1600230 - DNA, 13 bp, Homo sapiens
atgaatattgatg

SEQ ID NO: 1600231 - DNA, 18 bp, Homo sapiens
atgaatatttataacagc

SEQ ID NO: 1600232 - DNA, 14 bp, Homo sapiens
atgaatctacattt

SEQ ID NO: 1600233 - DNA, 15 bp, Homo sapiens
atgaatctacatttg

SEQ ID NO: 1600234 - DNA, 17 bp, Homo sapiens
atgaatctacatttgtt

SEQ ID NO: 1600235 - DNA, 11 bp, Homo sapiens
atgaatctatg

SEQ ID NO: 1600236 - DNA, 17 bp, Homo sapiens
atgaatctgctcacttt

SEQ ID NO: 1600237 - DNA, 18 bp, Homo sapiens
atgaatctgctcacttta

SEQ ID NO: 1600238 - DNA, 23 bp, Homo sapiens
atgaatctttgtttcaggttcag

SEQ ID NO: 1600239 - DNA, 22 bp, Homo sapiens
atgaatgacttccccaatatct

SEQ ID NO: 1600240 - DNA, 17 bp, Homo sapiens
atgaatgagtgggctgt

SEQ ID NO: 1600241 - DNA, 16 bp, Homo sapiens
atgaatgcaaaattgt

SEQ ID NO: 1600242 - DNA, 16 bp, Homo sapiens
atgaatgcttttagtg

SEQ ID NO: 1600243 - DNA, 13 bp, Homo sapiens
atgaatgtaaatt

SEQ ID NO: 1600244 - DNA, 15 bp, Homo sapiens
atgaatgtaaggatg

SEQ ID NO: 1600245 - DNA, 15 bp, Homo sapiens
atgaatgtatttatt

SEQ ID NO: 1600246 - DNA, 20 bp, Homo sapiens
atgaatgtatttatttggga

SEQ ID NO: 1600247 - DNA, 12 bp, Homo sapiens
atgaatgtgctg

SEQ ID NO: 1600248 - DNA, 23 bp, Homo sapiens
atgaatgttcctgcctccttgat

SEQ ID NO: 1600249 - DNA, 20 bp, Homo sapiens
atgaattcaagaaaggaaat

SEQ ID NO: 1600250 - DNA, 13 bp, Homo sapiens
atgaattgtacag

SEQ ID NO: 1600251 - DNA, 22 bp, Homo sapiens
atgaattgtacagaatatttct

SEQ ID NO: 1600252 - DNA, 11 bp, Homo sapiens
atgaatttaaa

SEQ ID NO: 1600253 - DNA, 23 bp, Homo sapiens
atgaatttaaatataattctgta

SEQ ID NO: 1600254 - DNA, 15 bp, Homo sapiens
atgaatttggagact

SEQ ID NO: 1600255 - DNA, 22 bp, Homo sapiens
atgaattttaaagtatgcatta

SEQ ID NO: 1600256 - DNA, 18 bp, Homo sapiens
atgaattttcaagtaatt

SEQ ID NO: 1600257 - DNA, 14 bp, Homo sapiens
atgaattttctgca

SEQ ID NO: 1600258 - DNA, 16 bp, Homo sapiens
atgaattttctgcagc

SEQ ID NO: 1600259 - DNA, 17 bp, Homo sapiens
atgaattttctgcagct

SEQ ID NO: 1600260 - DNA, 18 bp, Homo sapiens
atgaattttctgcagctg

SEQ ID NO: 1600261 - DNA, 19 bp, Homo sapiens
atgaattttgtatgctgaa

SEQ ID NO: 1600262 - DNA, 22 bp, Homo sapiens
atgaatttttttcatcttctct

SEQ ID NO: 1600263 - DNA, 13 bp, Homo sapiens
atgacaaatgttt

SEQ ID NO: 1600264 - DNA, 17 bp, Homo sapiens
atgacaaattggggctg

SEQ ID NO: 1600265 - DNA, 21 bp, Homo sapiens
atgacacaaaggtggaataaa

SEQ ID NO: 1600266 - DNA, 14 bp, Homo sapiens
atgacagaaaatat

SEQ ID NO: 1600267 - DNA, 18 bp, Homo sapiens
atgacagaaaatatgtat

SEQ ID NO: 1600268 - DNA, 13 bp, Homo sapiens
atgacagccagag

SEQ ID NO: 1600269 - DNA, 15 bp, Homo sapiens
atgacagcctgcagc

SEQ ID NO: 1600270 - DNA, 18 bp, Homo sapiens
atgacagctcttctaagg

SEQ ID NO: 1600271 - DNA, 21 bp, Homo sapiens
atgacaggcgcctgccatcat

SEQ ID NO: 1600272 - DNA, 11 bp, Homo sapiens
atgacagtgaa

SEQ ID NO: 1600273 - DNA, 18 bp, Homo sapiens
atgacagtggaagttttt

SEQ ID NO: 1600274 - DNA, 21 bp, Homo sapiens
atgacataaaatttacattta

SEQ ID NO: 1600275 - DNA, 15 bp, Homo sapiens
atgacatgaaatgaa

SEQ ID NO: 1600276 - DNA, 23 bp, Homo sapiens
atgacatgcactgacccttccag

SEQ ID NO: 1600277 - DNA, 14 bp, Homo sapiens
atgaccacacctgc

SEQ ID NO: 1600278 - DNA, 23 bp, Homo sapiens
atgaccacataagaaggcaattt

SEQ ID NO: 1600279 - DNA, 14 bp, Homo sapiens
atgaccagcaaata

SEQ ID NO: 1600280 - DNA, 17 bp, Homo sapiens
atgaccagggatgctgg

SEQ ID NO: 1600281 - DNA, 19 bp, Homo sapiens
atgaccagggatgctgggc

SEQ ID NO: 1600282 - DNA, 20 bp, Homo sapiens
atgaccagggatgctgggct

SEQ ID NO: 1600283 - DNA, 21 bp, Homo sapiens
atgaccagggatgctgggctg

SEQ ID NO: 1600284 - DNA, 13 bp, Homo sapiens
atgaccagtaaag

SEQ ID NO: 1600285 - DNA, 17 bp, Homo sapiens
atgaccatactgaggga

SEQ ID NO: 1600286 - DNA, 20 bp, Homo sapiens
atgaccattgagtccctgct

SEQ ID NO: 1600287 - DNA, 16 bp, Homo sapiens
atgacccacactgcca

SEQ ID NO: 1600288 - DNA, 21 bp, Homo sapiens
atgacccacactgccagaaga

SEQ ID NO: 1600289 - DNA, 19 bp, Homo sapiens
atgacccacccctgtgctc

SEQ ID NO: 1600290 - DNA, 23 bp, Homo sapiens
atgaccctgcgaaggggccctgg

SEQ ID NO: 1600291 - DNA, 15 bp, Homo sapiens
atgaccgagccctgg

SEQ ID NO: 1600292 - DNA, 19 bp, Homo sapiens
atgaccgagccctggagag

SEQ ID NO: 1600293 - DNA, 14 bp, Homo sapiens
atgacctaaatcca

SEQ ID NO: 1600294 - DNA, 23 bp, Homo sapiens
atgacctaaatccattttctaaa

SEQ ID NO: 1600295 - DNA, 14 bp, Homo sapiens
atgacgcggctcaa

SEQ ID NO: 1600296 - DNA, 16 bp, Homo sapiens
atgacggaagaacata

SEQ ID NO: 1600297 - DNA, 20 bp, Homo sapiens
atgacggtaagtgttctcat

SEQ ID NO: 1600298 - DNA, 20 bp, Homo sapiens
atgacggtgttaattttgct

SEQ ID NO: 1600299 - DNA, 22 bp, Homo sapiens
atgacggtgttaattttgctaa

SEQ ID NO: 1600300 - DNA, 14 bp, Homo sapiens
atgactaaaaatat

SEQ ID NO: 1600301 - DNA, 16 bp, Homo sapiens
atgactaaaaatatta

SEQ ID NO: 1600302 - DNA, 23 bp, Homo sapiens
atgactaaaaatattataactta

SEQ ID NO: 1600303 - DNA, 16 bp, Homo sapiens
atgactaaagagagaa

SEQ ID NO: 1600304 - DNA, 18 bp, Homo sapiens
atgactaaagagagaatg

SEQ ID NO: 1600305 - DNA, 20 bp, Homo sapiens
atgactaaagagagaatgta

SEQ ID NO: 1600306 - DNA, 15 bp, Homo sapiens
atgactaatgctttt

SEQ ID NO: 1600307 - DNA, 20 bp, Homo sapiens
atgactaatgctttttagaa

SEQ ID NO: 1600308 - DNA, 14 bp, Homo sapiens
atgactacattttg

SEQ ID NO: 1600309 - DNA, 19 bp, Homo sapiens
atgactagaggcagggagg

SEQ ID NO: 1600310 - DNA, 20 bp, Homo sapiens
atgactggctgtctgcctgt

SEQ ID NO: 1600311 - DNA, 15 bp, Homo sapiens
atgacttagaaactg

SEQ ID NO: 1600312 - DNA, 16 bp, Homo sapiens
atgacttattatgcat

SEQ ID NO: 1600313 - DNA, 18 bp, Homo sapiens
atgacttattatgcataa

SEQ ID NO: 1600314 - DNA, 20 bp, Homo sapiens
atgacttatttctgctctgg

SEQ ID NO: 1600315 - DNA, 21 bp, Homo sapiens
atgacttatttctgctctgga

SEQ ID NO: 1600316 - DNA, 22 bp, Homo sapiens
atgacttatttctgctctggaa

SEQ ID NO: 1600317 - DNA, 22 bp, Homo sapiens
atgacttccccaatatcttgct

SEQ ID NO: 1600318 - DNA, 15 bp, Homo sapiens
atgacttgccattaa

SEQ ID NO: 1600319 - DNA, 18 bp, Homo sapiens
atgactttttataaaatg

SEQ ID NO: 1600320 - DNA, 11 bp, Homo sapiens
atgagaaaaaa

SEQ ID NO: 1600321 - DNA, 14 bp, Homo sapiens
atgagaaaaaacta

SEQ ID NO: 1600322 - DNA, 17 bp, Homo sapiens
atgagaaacagctcagc

SEQ ID NO: 1600323 - DNA, 19 bp, Homo sapiens
atgagaaacagctcagcca

SEQ ID NO: 1600324 - DNA, 11 bp, Homo sapiens
atgagaaactt

SEQ ID NO: 1600325 - DNA, 12 bp, Homo sapiens
atgagaagaaaa

SEQ ID NO: 1600326 - DNA, 23 bp, Homo sapiens
atgagaagaaaaatggaaaaaaa

SEQ ID NO: 1600327 - DNA, 24 bp, Homo sapiens
atgagaatagaaacgtaaactatg

SEQ ID NO: 1600328 - DNA, 17 bp, Homo sapiens
atgagaatataccttat

SEQ ID NO: 1600329 - DNA, 11 bp, Homo sapiens
atgagaatcta

SEQ ID NO: 1600330 - DNA, 13 bp, Homo sapiens
atgagaattttat

SEQ ID NO: 1600331 - DNA, 22 bp, Homo sapiens
atgagacataggccatgaaaaa

SEQ ID NO: 1600332 - DNA, 18 bp, Homo sapiens
atgagaccactgttatca

SEQ ID NO: 1600333 - DNA, 17 bp, Homo sapiens
atgagactttctgctgg

SEQ ID NO: 1600334 - DNA, 18 bp, Homo sapiens
atgagagcaaatgcaaaa

SEQ ID NO: 1600335 - DNA, 17 bp, Homo sapiens
atgagagcgacacagac

SEQ ID NO: 1600336 - DNA, 18 bp, Homo sapiens
atgagagcgacacagacg

SEQ ID NO: 1600337 - DNA, 17 bp, Homo sapiens
atgagatatttgtattt

SEQ ID NO: 1600338 - DNA, 18 bp, Homo sapiens
atgagatatttgtattta

SEQ ID NO: 1600339 - DNA, 19 bp, Homo sapiens
atgagatgcgttgttacag

SEQ ID NO: 1600340 - DNA, 16 bp, Homo sapiens
atatttccccttggac

SEQ ID NO: 1600341 - DNA, 15 bp, Homo sapiens
atatttcctgacttg

SEQ ID NO: 1600342 - DNA, 21 bp, Homo sapiens
atatttccttaaactgtgtgg

SEQ ID NO: 1600343 - DNA, 12 bp, Homo sapiens
atatttccttta

SEQ ID NO: 1600344 - DNA, 14 bp, Homo sapiens
atatttcctttatg

SEQ ID NO: 1600345 - DNA, 15 bp, Homo sapiens
atatttctgatataa

SEQ ID NO: 1600346 - DNA, 12 bp, Homo sapiens
atatttctgttg

SEQ ID NO: 1600347 - DNA, 14 bp, Homo sapiens
atatttcttgcttt

SEQ ID NO: 1600348 - DNA, 15 bp, Homo sapiens
atatttcttgctttc

SEQ ID NO: 1600349 - DNA, 20 bp, Homo sapiens
atatttcttgctttcaatta

SEQ ID NO: 1600350 - DNA, 15 bp, Homo sapiens
atatttgaaatagta

SEQ ID NO: 1600351 - DNA, 23 bp, Homo sapiens
atatttgaaatagtatacattgt

SEQ ID NO: 1600352 - DNA, 20 bp, Homo sapiens
atatttgaattttaaatcta

SEQ ID NO: 1600353 - DNA, 19 bp, Homo sapiens
atatttgacttgaaaagaa

SEQ ID NO: 1600354 - DNA, 13 bp, Homo sapiens
atatttgatttct

SEQ ID NO: 1600355 - DNA, 16 bp, Homo sapiens
atatttgatttctaat

SEQ ID NO: 1600356 - DNA, 15 bp, Homo sapiens
atatttggaaagaga

SEQ ID NO: 1600357 - DNA, 19 bp, Homo sapiens
atatttgtaaactacaaag

SEQ ID NO: 1600358 - DNA, 15 bp, Homo sapiens
atatttgtaaagcta

SEQ ID NO: 1600359 - DNA, 20 bp, Homo sapiens
atatttgtaaatttatgtga

SEQ ID NO: 1600360 - DNA, 11 bp, Homo sapiens
atatttgtaca

SEQ ID NO: 1600361 - DNA, 14 bp, Homo sapiens
atatttgtacaaaa

SEQ ID NO: 1600362 - DNA, 13 bp, Homo sapiens
atatttgtacata

SEQ ID NO: 1600363 - DNA, 14 bp, Homo sapiens
atatttgtactttc

SEQ ID NO: 1600364 - DNA, 19 bp, Homo sapiens
atatttgtactttctgtta

SEQ ID NO: 1600365 - DNA, 18 bp, Homo sapiens
atatttgtagctagaata

SEQ ID NO: 1600366 - DNA, 17 bp, Homo sapiens
atatttgtctttaaaca

SEQ ID NO: 1600367 - DNA, 21 bp, Homo sapiens
atatttgtgaatataatttta

SEQ ID NO: 1600368 - DNA, 14 bp, Homo sapiens
atatttgtgccgta

SEQ ID NO: 1600369 - DNA, 15 bp, Homo sapiens
atatttgtgccgtaa

SEQ ID NO: 1600370 - DNA, 12 bp, Homo sapiens
atattttaatgt

SEQ ID NO: 1600371 - DNA, 13 bp, Homo sapiens
atattttaatttt

SEQ ID NO: 1600372 - DNA, 15 bp, Homo sapiens
atattttaattttta

SEQ ID NO: 1600373 - DNA, 14 bp, Homo sapiens
atattttagcattt

SEQ ID NO: 1600374 - DNA, 23 bp, Homo sapiens
atattttagcattttaattctct

SEQ ID NO: 1600375 - DNA, 14 bp, Homo sapiens
atattttatattac

SEQ ID NO: 1600376 - DNA, 13 bp, Homo sapiens
atattttatgaac

SEQ ID NO: 1600377 - DNA, 19 bp, Homo sapiens
atattttatgaacattgta

SEQ ID NO: 1600378 - DNA, 13 bp, Homo sapiens
atattttcagtac

SEQ ID NO: 1600379 - DNA, 22 bp, Homo sapiens
atattttccataaatttggact

SEQ ID NO: 1600380 - DNA, 19 bp, Homo sapiens
atattttcctgatagcata

SEQ ID NO: 1600381 - DNA, 23 bp, Homo sapiens
atattttcttccaagcaaaggtg

SEQ ID NO: 1600382 - DNA, 13 bp, Homo sapiens
atattttcttttc

SEQ ID NO: 1600383 - DNA, 16 bp, Homo sapiens
atattttgctaactgg

SEQ ID NO: 1600384 - DNA, 12 bp, Homo sapiens
atattttgctgg

SEQ ID NO: 1600385 - DNA, 13 bp, Homo sapiens
atattttgtattt

SEQ ID NO: 1600386 - DNA, 18 bp, Homo sapiens
atattttgtgtgaaattg

SEQ ID NO: 1600387 - DNA, 22 bp, Homo sapiens
atattttgtgtgaaattgcata

SEQ ID NO: 1600388 - DNA, 20 bp, Homo sapiens
atattttgttgttcctctat

SEQ ID NO: 1600389 - DNA, 20 bp, Homo sapiens
atatttttaaaatatttatt

SEQ ID NO: 1600390 - DNA, 17 bp, Homo sapiens
atatttttatactttat

SEQ ID NO: 1600391 - DNA, 18 bp, Homo sapiens
atatttttatactttatt

SEQ ID NO: 1600392 - DNA, 18 bp, Homo sapiens
atatttttatatttcctt

SEQ ID NO: 1600393 - DNA, 14 bp, Homo sapiens
atatttttatcttt

SEQ ID NO: 1600394 - DNA, 22 bp, Homo sapiens
atatttttatctttatatgaag

SEQ ID NO: 1600395 - DNA, 21 bp, Homo sapiens
atatttttggttgtcaatatt

SEQ ID NO: 1600396 - DNA, 10 bp, Homo sapiens
atatttttgt

SEQ ID NO: 1600397 - DNA, 16 bp, Homo sapiens
atatttttgtagcact

SEQ ID NO: 1600398 - DNA, 23 bp, Homo sapiens
atatttttgtagcactgacagat

SEQ ID NO: 1600399 - DNA, 14 bp, Homo sapiens
atatttttgtattt

SEQ ID NO: 1600400 - DNA, 23 bp, Homo sapiens
atattttttaaaaaacacttgaa

SEQ ID NO: 1600401 - DNA, 20 bp, Homo sapiens
atattttttatatatacagt

SEQ ID NO: 1600402 - DNA, 21 bp, Homo sapiens
atattttttcttttgacataa

SEQ ID NO: 1600403 - DNA, 14 bp, Homo sapiens
atattttttgtctg

SEQ ID NO: 1600404 - DNA, 16 bp, Homo sapiens
atatttttttcctatg

SEQ ID NO: 1600405 - DNA, 19 bp, Homo sapiens
atatttttttctttctttg

SEQ ID NO: 1600406 - DNA, 22 bp, Homo sapiens
atatttttttttggatgaaggt

SEQ ID NO: 1600407 - DNA, 20 bp, Homo sapiens
atcaaaaagaaactttgttt

SEQ ID NO: 1600408 - DNA, 14 bp, Homo sapiens
atcaaaaataaact

SEQ ID NO: 1600409 - DNA, 15 bp, Homo sapiens
atcaaaaataaacta

SEQ ID NO: 1600410 - DNA, 19 bp, Homo sapiens
atcaaaaccttccttccct

SEQ ID NO: 1600411 - DNA, 15 bp, Homo sapiens
atcaaaataaaaagt

SEQ ID NO: 1600412 - DNA, 18 bp, Homo sapiens
atcaaaatcactatcttt

SEQ ID NO: 1600413 - DNA, 21 bp, Homo sapiens
atcaaaatcactatctttctg

SEQ ID NO: 1600414 - DNA, 17 bp, Homo sapiens
atcaaaatcctacagat

SEQ ID NO: 1600415 - DNA, 16 bp, Homo sapiens
atcaaacattttctgg

SEQ ID NO: 1600416 - DNA, 22 bp, Homo sapiens
atcaaaccctagccttgcttgt

SEQ ID NO: 1600417 - DNA, 16 bp, Homo sapiens
atcaaagaaattcaga

SEQ ID NO: 1600418 - DNA, 13 bp, Homo sapiens
atcaaagaacaga

SEQ ID NO: 1600419 - DNA, 13 bp, Homo sapiens
atcaaagaattac

SEQ ID NO: 1600420 - DNA, 14 bp, Homo sapiens
atcaaagaattaca

SEQ ID NO: 1600421 - DNA, 16 bp, Homo sapiens
atcaaagaattacagt

SEQ ID NO: 1600422 - DNA, 18 bp, Homo sapiens
atcaaagaattacagtac

SEQ ID NO: 1600423 - DNA, 18 bp, Homo sapiens
atcaaagagagaaaataa

SEQ ID NO: 1600424 - DNA, 13 bp, Homo sapiens
atcaaagcctggc

SEQ ID NO: 1600425 - DNA, 20 bp, Homo sapiens
atcaaagggtgaaaattatt

SEQ ID NO: 1600426 - DNA, 14 bp, Homo sapiens
atcaaagtaaaaaa

SEQ ID NO: 1600427 - DNA, 18 bp, Homo sapiens
atcaaagtggtaaatact

SEQ ID NO: 1600428 - DNA, 18 bp, Homo sapiens
atcaaataagtatttata

SEQ ID NO: 1600429 - DNA, 19 bp, Homo sapiens
atcaaataagtatttataa

SEQ ID NO: 1600430 - DNA, 15 bp, Homo sapiens
atcaaatactcattt

SEQ ID NO: 1600431 - DNA, 15 bp, Homo sapiens
atcaaatgtaaatca

SEQ ID NO: 1600432 - DNA, 23 bp, Homo sapiens
atcaacaatagtaactctttctt

SEQ ID NO: 1600433 - DNA, 15 bp, Homo sapiens
atcaacagcttccct

SEQ ID NO: 1600434 - DNA, 18 bp, Homo sapiens
atcaacatgttattcaat

SEQ ID NO: 1600435 - DNA, 16 bp, Homo sapiens
atcaacatttatgacc

SEQ ID NO: 1600436 - DNA, 19 bp, Homo sapiens
atcaacatttatgacctaa

SEQ ID NO: 1600437 - DNA, 23 bp, Homo sapiens
atcaaccacctatttttgacatg

SEQ ID NO: 1600438 - DNA, 12 bp, Homo sapiens
atcaactaaagt

SEQ ID NO: 1600439 - DNA, 22 bp, Homo sapiens
atcaactaaagttgtactttaa

SEQ ID NO: 1600440 - DNA, 20 bp, Homo sapiens
atcaactcccaacttcttcc

SEQ ID NO: 1600441 - DNA, 13 bp, Homo sapiens
atcaactctaata

SEQ ID NO: 1600442 - DNA, 12 bp, Homo sapiens
atcaactctgaa

SEQ ID NO: 1600443 - DNA, 11 bp, Homo sapiens
atcatgtctgt

SEQ ID NO: 1600444 - DNA, 16 bp, Homo sapiens
atcatgtctgtatact

SEQ ID NO: 1600445 - DNA, 16 bp, Homo sapiens
atcatgttgaaacaaa

SEQ ID NO: 1600446 - DNA, 16 bp, Homo sapiens
atcatgtttattttga

SEQ ID NO: 1600447 - DNA, 14 bp, Homo sapiens
atcatgtttgctct

SEQ ID NO: 1600448 - DNA, 15 bp, Homo sapiens
atcatgtttgctctc

SEQ ID NO: 1600449 - DNA, 15 bp, Homo sapiens
atcattaataagtga

SEQ ID NO: 1600450 - DNA, 19 bp, Homo sapiens
atcattacaattttctgta

SEQ ID NO: 1600451 - DNA, 20 bp, Homo sapiens
atcattacaattttctgtaa

SEQ ID NO: 1600452 - DNA, 16 bp, Homo sapiens
atcattataaacgtga

SEQ ID NO: 1600453 - DNA, 20 bp, Homo sapiens
atcattatcagcctgtgcca

SEQ ID NO: 1600454 - DNA, 13 bp, Homo sapiens
atcattcagaaat

SEQ ID NO: 1600455 - DNA, 22 bp, Homo sapiens
atcattcattcttagctcttaa

SEQ ID NO: 1600456 - DNA, 18 bp, Homo sapiens
atcattccaattctaaat

SEQ ID NO: 1600457 - DNA, 14 bp, Homo sapiens
atcattctaaagat

SEQ ID NO: 1600458 - DNA, 15 bp, Homo sapiens
atcattctaaagata

SEQ ID NO: 1600459 - DNA, 12 bp, Homo sapiens
atcattctttta

SEQ ID NO: 1600460 - DNA, 13 bp, Homo sapiens
atcattcttttat

SEQ ID NO: 1600461 - DNA, 18 bp, Homo sapiens
atcattgattgtcagcta

SEQ ID NO: 1600462 - DNA, 15 bp, Homo sapiens
atcattgctcccctg

SEQ ID NO: 1600463 - DNA, 17 bp, Homo sapiens
atcattgctcccctgat

SEQ ID NO: 1600464 - DNA, 19 bp, Homo sapiens
atcattgcttcctcctccc

SEQ ID NO: 1600465 - DNA, 15 bp, Homo sapiens
atcatttattcattg

SEQ ID NO: 1600466 - DNA, 22 bp, Homo sapiens
atcatttcacctgctgcttgcc

SEQ ID NO: 1600467 - DNA, 11 bp, Homo sapiens
atcatttctgg

SEQ ID NO: 1600468 - DNA, 20 bp, Homo sapiens
atctgcagggggtgtgtctg

SEQ ID NO: 1600469 - DNA, 23 bp, Homo sapiens
atctgcatggggctggggtcctc

SEQ ID NO: 1600470 - DNA, 14 bp, Homo sapiens
atctgcattcctga

SEQ ID NO: 1600471 - DNA, 21 bp, Homo sapiens
atctgcccacctcggcctccc

SEQ ID NO: 1600472 - DNA, 15 bp, Homo sapiens
atctgcccaggggtg

SEQ ID NO: 1600473 - DNA, 16 bp, Homo sapiens
atctgcccaggggtgc

SEQ ID NO: 1600474 - DNA, 17 bp, Homo sapiens
atctgcccctcccccaa

SEQ ID NO: 1600475 - DNA, 15 bp, Homo sapiens
atctgcctagaaaac

SEQ ID NO: 1600476 - DNA, 12 bp, Homo sapiens
atctgcctcccc

SEQ ID NO: 1600477 - DNA, 11 bp, Homo sapiens
atctgcctggc

SEQ ID NO: 1600478 - DNA, 12 bp, Homo sapiens
atctgcctggcc

SEQ ID NO: 1600479 - DNA, 13 bp, Homo sapiens
atctgcctggcct

SEQ ID NO: 1600480 - DNA, 14 bp, Homo sapiens
atctgcctgggcct

SEQ ID NO: 1600481 - DNA, 16 bp, Homo sapiens
atctgcctgggcctgt

SEQ ID NO: 1600482 - DNA, 21 bp, Homo sapiens
atctgcctgggcctgtgcagc

SEQ ID NO: 1600483 - DNA, 23 bp, Homo sapiens
atctgcctgggcctgtgcagcag

SEQ ID NO: 1600484 - DNA, 17 bp, Homo sapiens
atctgccttaaaaccaa

SEQ ID NO: 1600485 - DNA, 19 bp, Homo sapiens
atctgccttaaaaccaaag

SEQ ID NO: 1600486 - DNA, 14 bp, Homo sapiens
atctgctcacttta

SEQ ID NO: 1600487 - DNA, 18 bp, Homo sapiens
atctgctcattttgacaa

SEQ ID NO: 1600488 - DNA, 15 bp, Homo sapiens
atctgctccaacaga

SEQ ID NO: 1600489 - DNA, 21 bp, Homo sapiens
atctgctctagattcataaat

SEQ ID NO: 1600490 - DNA, 22 bp, Homo sapiens
atctgctctagattcataaata

SEQ ID NO: 1600491 - DNA, 17 bp, Homo sapiens
atctgctctccttcctg

SEQ ID NO: 1600492 - DNA, 21 bp, Homo sapiens
atctgctgaggcccagtgcat

SEQ ID NO: 1600493 - DNA, 10 bp, Homo sapiens
atctgctgca

SEQ ID NO: 1600494 - DNA, 13 bp, Homo sapiens
atctgctgccccg

SEQ ID NO: 1600495 - DNA, 15 bp, Homo sapiens
atctgctgcctctga

SEQ ID NO: 1600496 - DNA, 17 bp, Homo sapiens
atctgctgcctctgaaa

SEQ ID NO: 1600497 - DNA, 21 bp, Homo sapiens
atctgctgcctctgaaaatat

SEQ ID NO: 1600498 - DNA, 20 bp, Homo sapiens
atctgcttcatccaatgtga

SEQ ID NO: 1600499 - DNA, 18 bp, Homo sapiens
atctggaacccagactca

SEQ ID NO: 1600500 - DNA, 23 bp, Homo sapiens
atctggaacccagactcagacat

SEQ ID NO: 1600501 - DNA, 11 bp, Homo sapiens
atctggaacct

SEQ ID NO: 1600502 - DNA, 16 bp, Homo sapiens
atctggaacctcagcc

SEQ ID NO: 1600503 - DNA, 17 bp, Homo sapiens
atctggacccttggcct

SEQ ID NO: 1600504 - DNA, 20 bp, Homo sapiens
atctggagaactatacctgc

SEQ ID NO: 1600505 - DNA, 12 bp, Homo sapiens
atctggagcctg

SEQ ID NO: 1600506 - DNA, 13 bp, Homo sapiens
atctggatgtaaa

SEQ ID NO: 1600507 - DNA, 14 bp, Homo sapiens
atctggatgtaaat

SEQ ID NO: 1600508 - DNA, 15 bp, Homo sapiens
atctggcacactccc

SEQ ID NO: 1600509 - DNA, 14 bp, Homo sapiens
atctggcactgtta

SEQ ID NO: 1600510 - DNA, 22 bp, Homo sapiens
atctggcagagcctcagctgta

SEQ ID NO: 1600511 - DNA, 13 bp, Homo sapiens
atctggccctgac

SEQ ID NO: 1600512 - DNA, 16 bp, Homo sapiens
atctggcggaggtctc

SEQ ID NO: 1600513 - DNA, 21 bp, Homo sapiens
atctggctgcagttttgctat

SEQ ID NO: 1600514 - DNA, 19 bp, Homo sapiens
atctggctgtctagaatgt

SEQ ID NO: 1600515 - DNA, 20 bp, Homo sapiens
atctggctgtctagaatgtg

SEQ ID NO: 1600516 - DNA, 12 bp, Homo sapiens
atctggcttttt

SEQ ID NO: 1600517 - DNA, 18 bp, Homo sapiens
atctggctttttctgcca

SEQ ID NO: 1600518 - DNA, 20 bp, Homo sapiens
atctggctttttctgccact

SEQ ID NO: 1600519 - DNA, 21 bp, Homo sapiens
atctggctttttctgccactg

SEQ ID NO: 1600520 - DNA, 16 bp, Homo sapiens
atctgggaccctttcc

SEQ ID NO: 1600521 - DNA, 20 bp, Homo sapiens
atctggggagagcggctgga

SEQ ID NO: 1600522 - DNA, 23 bp, Homo sapiens
atctggggagagcggctggagaa

SEQ ID NO: 1600523 - DNA, 16 bp, Homo sapiens
atctggggctctggga

SEQ ID NO: 1600524 - DNA, 19 bp, Homo sapiens
atctgggtggtaactgcca

SEQ ID NO: 1600525 - DNA, 21 bp, Homo sapiens
atctggtcttgttagaaaaca

SEQ ID NO: 1600526 - DNA, 18 bp, Homo sapiens
atctggtgacaaatattc

SEQ ID NO: 1600527 - DNA, 22 bp, Homo sapiens
atctggtgccaaatgaagattt

SEQ ID NO: 1600528 - DNA, 13 bp, Homo sapiens
atctgtaaactgt

SEQ ID NO: 1600529 - DNA, 22 bp, Homo sapiens
atctgtaaactgtgtattccaa

SEQ ID NO: 1600530 - DNA, 13 bp, Homo sapiens
atctgtaaagcca

SEQ ID NO: 1600531 - DNA, 18 bp, Homo sapiens
atctgtaaagccagttag

SEQ ID NO: 1600532 - DNA, 17 bp, Homo sapiens
atctgtaagagcttgct

SEQ ID NO: 1600533 - DNA, 22 bp, Homo sapiens
atctgtagatactagctatcta

SEQ ID NO: 1600534 - DNA, 14 bp, Homo sapiens
atctgtagggctgg

SEQ ID NO: 1600535 - DNA, 17 bp, Homo sapiens
atcttgccggtcatttt

SEQ ID NO: 1600536 - DNA, 23 bp, Homo sapiens
atcttgctaccagtatttagaag

SEQ ID NO: 1600537 - DNA, 15 bp, Homo sapiens
atcttgcttccctaa

SEQ ID NO: 1600538 - DNA, 22 bp, Homo sapiens
atcttggacaaatcacatattt

SEQ ID NO: 1600539 - DNA, 14 bp, Homo sapiens
atcttggactgaca

SEQ ID NO: 1600540 - DNA, 21 bp, Homo sapiens
atcttggactgacatttagcg

SEQ ID NO: 1600541 - DNA, 13 bp, Homo sapiens
atcttggctatgt

SEQ ID NO: 1600542 - DNA, 17 bp, Homo sapiens
atcttggctgttctaga

SEQ ID NO: 1600543 - DNA, 15 bp, Homo sapiens
atcttgggtgtattc

SEQ ID NO: 1600544 - DNA, 18 bp, Homo sapiens
atcttggtagttctgtgc

SEQ ID NO: 1600545 - DNA, 22 bp, Homo sapiens
atcttggtagttctgtgcctcc

SEQ ID NO: 1600546 - DNA, 20 bp, Homo sapiens
atcttggtcagatttgaact

SEQ ID NO: 1600547 - DNA, 19 bp, Homo sapiens
atcttgtagctttatcaaa

SEQ ID NO: 1600548 - DNA, 23 bp, Homo sapiens
atcttgtatttgggccaaggtgt

SEQ ID NO: 1600549 - DNA, 19 bp, Homo sapiens
atcttgtcatgtgtataaa

SEQ ID NO: 1600550 - DNA, 14 bp, Homo sapiens
atcttgtctctggg

SEQ ID NO: 1600551 - DNA, 15 bp, Homo sapiens
atcttgtctctgggc

SEQ ID NO: 1600552 - DNA, 16 bp, Homo sapiens
atcttgtgagtggata

SEQ ID NO: 1600553 - DNA, 22 bp, Homo sapiens
atcttgtgctagaatacttttt

SEQ ID NO: 1600554 - DNA, 15 bp, Homo sapiens
atcttgtggggccag

SEQ ID NO: 1600555 - DNA, 18 bp, Homo sapiens
atcttgtgtgattaactt

SEQ ID NO: 1600556 - DNA, 21 bp, Homo sapiens
atcttgttactgctgattctt

SEQ ID NO: 1600557 - DNA, 17 bp, Homo sapiens
atcttgttcaggaaaag

SEQ ID NO: 1600558 - DNA, 12 bp, Homo sapiens
atctttaaaata

SEQ ID NO: 1600559 - DNA, 15 bp, Homo sapiens
atctttaaaatacac

SEQ ID NO: 1600560 - DNA, 18 bp, Homo sapiens
atctttaaactggctggc

SEQ ID NO: 1600561 - DNA, 17 bp, Homo sapiens
atctttaagaatgctta

SEQ ID NO: 1600562 - DNA, 11 bp, Homo sapiens
atctttaatta

SEQ ID NO: 1600563 - DNA, 15 bp, Homo sapiens
atctttaccaaaaac

SEQ ID NO: 1600564 - DNA, 15 bp, Homo sapiens
atctttatgctgtat

SEQ ID NO: 1600565 - DNA, 22 bp, Homo sapiens
atctttatgctgtattttaaca

SEQ ID NO: 1600566 - DNA, 19 bp, Homo sapiens
atctttattaaaacaaaag

SEQ ID NO: 1600567 - DNA, 21 bp, Homo sapiens
atctttattaaaacaaaaggg

SEQ ID NO: 1600568 - DNA, 16 bp, Homo sapiens
atctttattgaaattc

SEQ ID NO: 1600569 - DNA, 15 bp, Homo sapiens
atctttcacttgaaa

SEQ ID NO: 1600570 - DNA, 17 bp, Homo sapiens
atctttcacttgaaaga

SEQ ID NO: 1600571 - DNA, 21 bp, Homo sapiens
atctttcacttgaaagatttt

SEQ ID NO: 1600572 - DNA, 15 bp, Homo sapiens
atctttcccaggccg

SEQ ID NO: 1600573 - DNA, 16 bp, Homo sapiens
atctttcctcaagtat

SEQ ID NO: 1600574 - DNA, 22 bp, Homo sapiens
atctttcctcaagtatcttcta

SEQ ID NO: 1600575 - DNA, 14 bp, Homo sapiens
atctttctaaaact

SEQ ID NO: 1600576 - DNA, 12 bp, Homo sapiens
atctttctagag

SEQ ID NO: 1600577 - DNA, 23 bp, Homo sapiens
atctttctccctcaactgaaggg

SEQ ID NO: 1600578 - DNA, 18 bp, Homo sapiens
atctttctcttacctgtt

SEQ ID NO: 1600579 - DNA, 20 bp, Homo sapiens
atctttctcttacctgttat

SEQ ID NO: 1600580 - DNA, 15 bp, Homo sapiens
atctttctcttccct

SEQ ID NO: 1600581 - DNA, 13 bp, Homo sapiens
atctttctgggag

SEQ ID NO: 1600582 - DNA, 18 bp, Homo sapiens
atctttcttgatcaacat

SEQ ID NO: 1600583 - DNA, 18 bp, Homo sapiens
atctttctttacctgaga

SEQ ID NO: 1600584 - DNA, 23 bp, Homo sapiens
atctttctttccaaaacatttct

SEQ ID NO: 1600585 - DNA, 16 bp, Homo sapiens
atctttctttctctaa

SEQ ID NO: 1600586 - DNA, 20 bp, Homo sapiens
atctttctttggatgggact

SEQ ID NO: 1600587 - DNA, 12 bp, Homo sapiens
atctttgaaata

SEQ ID NO: 1600588 - DNA, 15 bp, Homo sapiens
atattagctgaaaca

SEQ ID NO: 1600589 - DNA, 17 bp, Homo sapiens
atattaggggggaaagt

SEQ ID NO: 1600590 - DNA, 19 bp, Homo sapiens
atattaggggggaaagtca

SEQ ID NO: 1600591 - DNA, 21 bp, Homo sapiens
atattaggtccattcattaat

SEQ ID NO: 1600592 - DNA, 18 bp, Homo sapiens
atattagtgattctgatt

SEQ ID NO: 1600593 - DNA, 23 bp, Homo sapiens
atattagtgattctgatttcagt

SEQ ID NO: 1600594 - DNA, 22 bp, Homo sapiens
atattataagggagagctgagc

SEQ ID NO: 1600595 - DNA, 11 bp, Homo sapiens
atattatagaa

SEQ ID NO: 1600596 - DNA, 14 bp, Homo sapiens
atattatagaaaat

SEQ ID NO: 1600597 - DNA, 15 bp, Homo sapiens
atattatatatatat

SEQ ID NO: 1600598 - DNA, 15 bp, Homo sapiens
atattatatatatct

SEQ ID NO: 1600599 - DNA, 15 bp, Homo sapiens
atattatattaaaca

SEQ ID NO: 1600600 - DNA, 21 bp, Homo sapiens
atattatcatgcaaatgctgt

SEQ ID NO: 1600601 - DNA, 12 bp, Homo sapiens
atattatgtctt

SEQ ID NO: 1600602 - DNA, 13 bp, Homo sapiens
atattatgtgttt

SEQ ID NO: 1600603 - DNA, 23 bp, Homo sapiens
atattattataatcttataattg

SEQ ID NO: 1600604 - DNA, 19 bp, Homo sapiens
atattattcaagtgcctct

SEQ ID NO: 1600605 - DNA, 16 bp, Homo sapiens
atattcaatgaacttc

SEQ ID NO: 1600606 - DNA, 15 bp, Homo sapiens
atattcaatgcattt

SEQ ID NO: 1600607 - DNA, 16 bp, Homo sapiens
atattcaatgcattta

SEQ ID NO: 1600608 - DNA, 15 bp, Homo sapiens
atattcacacttgaa

SEQ ID NO: 1600609 - DNA, 21 bp, Homo sapiens
atattcacagactgattggaa

SEQ ID NO: 1600610 - DNA, 11 bp, Homo sapiens
atattcactct

SEQ ID NO: 1600611 - DNA, 17 bp, Homo sapiens
atattcactctccatta

SEQ ID NO: 1600612 - DNA, 13 bp, Homo sapiens
atattcagaaatt

SEQ ID NO: 1600613 - DNA, 14 bp, Homo sapiens
atattcagacatca

SEQ ID NO: 1600614 - DNA, 20 bp, Homo sapiens
atattcagccagcttaaacc

SEQ ID NO: 1600615 - DNA, 20 bp, Homo sapiens
atattcagggtaaataggaa

SEQ ID NO: 1600616 - DNA, 15 bp, Homo sapiens
atattccagatcttt

SEQ ID NO: 1600617 - DNA, 21 bp, Homo sapiens
atattccagatctttcagaaa

SEQ ID NO: 1600618 - DNA, 15 bp, Homo sapiens
atattccatgaatgt

SEQ ID NO: 1600619 - DNA, 19 bp, Homo sapiens
atattccatgaatgtatca

SEQ ID NO: 1600620 - DNA, 15 bp, Homo sapiens
atattccatttacat

SEQ ID NO: 1600621 - DNA, 18 bp, Homo sapiens
atattcccctatctctag

SEQ ID NO: 1600622 - DNA, 22 bp, Homo sapiens
atattcctgaatgaaatatcag

SEQ ID NO: 1600623 - DNA, 22 bp, Homo sapiens
atattcctggacttacaaaatg

SEQ ID NO: 1600624 - DNA, 18 bp, Homo sapiens
atattcgctagtgtttaa

SEQ ID NO: 1600625 - DNA, 16 bp, Homo sapiens
atattctaaaaccatt

SEQ ID NO: 1600626 - DNA, 14 bp, Homo sapiens
atattctaagactt

SEQ ID NO: 1600627 - DNA, 22 bp, Homo sapiens
atattctacacatgtaaaatat

SEQ ID NO: 1600628 - DNA, 12 bp, Homo sapiens
atattctagaac

SEQ ID NO: 1600629 - DNA, 18 bp, Homo sapiens
atattcttgctttcacaa

SEQ ID NO: 1600630 - DNA, 23 bp, Homo sapiens
atattcttgctttcacaaatata

SEQ ID NO: 1600631 - DNA, 15 bp, Homo sapiens
atattcttgtgcttt

SEQ ID NO: 1600632 - DNA, 17 bp, Homo sapiens
atattctttctcataaa

SEQ ID NO: 1600633 - DNA, 14 bp, Homo sapiens
atattgaagacaat

SEQ ID NO: 1600634 - DNA, 16 bp, Homo sapiens
atattgaagacaattt

SEQ ID NO: 1600635 - DNA, 20 bp, Homo sapiens
atattgacccaaatgtgtaa

SEQ ID NO: 1600636 - DNA, 18 bp, Homo sapiens
atattgactcaaaccata

SEQ ID NO: 1600637 - DNA, 16 bp, Homo sapiens
atattgagatcagcat

SEQ ID NO: 1600638 - DNA, 14 bp, Homo sapiens
atattgaggctgca

SEQ ID NO: 1600639 - DNA, 16 bp, Homo sapiens
atattgaggctgcagc

SEQ ID NO: 1600640 - DNA, 22 bp, Homo sapiens
atattgataagctattgtctgt

SEQ ID NO: 1600641 - DNA, 15 bp, Homo sapiens
atattgatgttaaca

SEQ ID NO: 1600642 - DNA, 19 bp, Homo sapiens
atattgattgggaaaacat

SEQ ID NO: 1600643 - DNA, 15 bp, Homo sapiens
atattgcagattgaa

SEQ ID NO: 1600644 - DNA, 19 bp, Homo sapiens
atattgccttatttgtctg

SEQ ID NO: 1600645 - DNA, 18 bp, Homo sapiens
atattgctaattgtgtat

SEQ ID NO: 1600646 - DNA, 18 bp, Homo sapiens
atattgcttagtaagtat

SEQ ID NO: 1600647 - DNA, 19 bp, Homo sapiens
atattggaattataaatat

SEQ ID NO: 1600648 - DNA, 21 bp, Homo sapiens
atattggtgcgtttttacagt

SEQ ID NO: 1600649 - DNA, 16 bp, Homo sapiens
atattgtaaaacaggt

SEQ ID NO: 1600650 - DNA, 22 bp, Homo sapiens
atattgtaaaactttggtgcat

SEQ ID NO: 1600651 - DNA, 14 bp, Homo sapiens
atattgtaagtcag

SEQ ID NO: 1600652 - DNA, 21 bp, Homo sapiens
atattgtacaaatgtaagcaa

SEQ ID NO: 1600653 - DNA, 14 bp, Homo sapiens
atattgtacataaa

SEQ ID NO: 1600654 - DNA, 16 bp, Homo sapiens
atattgtacataaaag

SEQ ID NO: 1600655 - DNA, 21 bp, Homo sapiens
atattgtacataaaagaattt

SEQ ID NO: 1600656 - DNA, 20 bp, Homo sapiens
atattgtagcagttacagct

SEQ ID NO: 1600657 - DNA, 13 bp, Homo sapiens
atattgtatgtaa

SEQ ID NO: 1600658 - DNA, 16 bp, Homo sapiens
atattgtattactaga

SEQ ID NO: 1600659 - DNA, 12 bp, Homo sapiens
atattgtcagat

SEQ ID NO: 1600660 - DNA, 16 bp, Homo sapiens
atattgtcagatattt

SEQ ID NO: 1600661 - DNA, 17 bp, Homo sapiens
atattgtcagatatttt

SEQ ID NO: 1600662 - DNA, 14 bp, Homo sapiens
atattgtgattctg

SEQ ID NO: 1600663 - DNA, 14 bp, Homo sapiens
atattgtgtaattt

SEQ ID NO: 1600664 - DNA, 14 bp, Homo sapiens
atattgtttccctc

SEQ ID NO: 1600665 - DNA, 12 bp, Homo sapiens
atattgtttcta

SEQ ID NO: 1600666 - DNA, 16 bp, Homo sapiens
atattgtttggtaaat

SEQ ID NO: 1600667 - DNA, 13 bp, Homo sapiens
atattgttttcag

SEQ ID NO: 1600668 - DNA, 13 bp, Homo sapiens
atatttaaaaata

SEQ ID NO: 1600669 - DNA, 21 bp, Homo sapiens
atatttaaacctttttcttga

SEQ ID NO: 1600670 - DNA, 22 bp, Homo sapiens
atatttaaacctttttcttgat

SEQ ID NO: 1600671 - DNA, 14 bp, Homo sapiens
atatttaaagggaa

SEQ ID NO: 1600672 - DNA, 20 bp, Homo sapiens
atatttaagaaaatacaata

SEQ ID NO: 1600673 - DNA, 22 bp, Homo sapiens
atatttaagaaaatacaataaa

SEQ ID NO: 1600674 - DNA, 23 bp, Homo sapiens
atatttaagaaaatacaataaac

SEQ ID NO: 1600675 - DNA, 18 bp, Homo sapiens
atatttaagccttttgtg

SEQ ID NO: 1600676 - DNA, 15 bp, Homo sapiens
atatttaagtatata

SEQ ID NO: 1600677 - DNA, 11 bp, Homo sapiens
atatttaagtg

SEQ ID NO: 1600678 - DNA, 17 bp, Homo sapiens
atatttaagtgaaggag

SEQ ID NO: 1600679 - DNA, 13 bp, Homo sapiens
atatttaatatca

SEQ ID NO: 1600680 - DNA, 22 bp, Homo sapiens
atatttaatgttgaacaaaata

SEQ ID NO: 1600681 - DNA, 16 bp, Homo sapiens
atatttaattatgaaa

SEQ ID NO: 1600682 - DNA, 13 bp, Homo sapiens
atatttaccaaag

SEQ ID NO: 1600683 - DNA, 18 bp, Homo sapiens
atatttactaactaaata

SEQ ID NO: 1600684 - DNA, 19 bp, Homo sapiens
atatttacttcttatacat

SEQ ID NO: 1600685 - DNA, 12 bp, Homo sapiens
atatttagaaaa

SEQ ID NO: 1600686 - DNA, 16 bp, Homo sapiens
atatttaggaaattca

SEQ ID NO: 1600687 - DNA, 20 bp, Homo sapiens
atatttataactcatcataa

SEQ ID NO: 1600688 - DNA, 21 bp, Homo sapiens
atatttataactcatcataaa

SEQ ID NO: 1600689 - DNA, 22 bp, Homo sapiens
atatttataactcatcataaaa

SEQ ID NO: 1600690 - DNA, 15 bp, Homo sapiens
atatttatactttgc

SEQ ID NO: 1600691 - DNA, 15 bp, Homo sapiens
atatttatatattta

SEQ ID NO: 1600692 - DNA, 14 bp, Homo sapiens
atatttatatttca

SEQ ID NO: 1600693 - DNA, 15 bp, Homo sapiens
atatttattacacaa

SEQ ID NO: 1600694 - DNA, 14 bp, Homo sapiens
atatttattacctc

SEQ ID NO: 1600695 - DNA, 13 bp, Homo sapiens
atagctctggggt

SEQ ID NO: 1600696 - DNA, 18 bp, Homo sapiens
atagctgaaaagggcact

SEQ ID NO: 1600697 - DNA, 21 bp, Homo sapiens
atagctgagattcctggttcg

SEQ ID NO: 1600698 - DNA, 20 bp, Homo sapiens
atagctgccttcaaggactg

SEQ ID NO: 1600699 - DNA, 23 bp, Homo sapiens
atagctgcttggattctctgaga

SEQ ID NO: 1600700 - DNA, 13 bp, Homo sapiens
atagctggggctt

SEQ ID NO: 1600701 - DNA, 21 bp, Homo sapiens
atagctgtagttttccctgca

SEQ ID NO: 1600702 - DNA, 14 bp, Homo sapiens
atagtttgtgaatc

SEQ ID NO: 1600703 - DNA, 15 bp, Homo sapiens
atagttttactttta

SEQ ID NO: 1600704 - DNA, 22 bp, Homo sapiens
atagttttacttttaaactgtg

SEQ ID NO: 1600705 - DNA, 17 bp, Homo sapiens
atagttttataaaactc

SEQ ID NO: 1600706 - DNA, 13 bp, Homo sapiens
atagttttctaga

SEQ ID NO: 1600707 - DNA, 19 bp, Homo sapiens
atagttttttacttctctt

SEQ ID NO: 1600708 - DNA, 16 bp, Homo sapiens
atataaaaaatcatgc

SEQ ID NO: 1600709 - DNA, 18 bp, Homo sapiens
atataaaaagaaaagata

SEQ ID NO: 1600710 - DNA, 23 bp, Homo sapiens
atataaaaagaaaagataaagat

SEQ ID NO: 1600711 - DNA, 15 bp, Homo sapiens
atataaaacagtcat

SEQ ID NO: 1600712 - DNA, 17 bp, Homo sapiens
atataaaactgtacttc

SEQ ID NO: 1600713 - DNA, 12 bp, Homo sapiens
atataaaactta

SEQ ID NO: 1600714 - DNA, 20 bp, Homo sapiens
atataaaaggcaaatgtgta

SEQ ID NO: 1600715 - DNA, 23 bp, Homo sapiens
atataaaaggcaaatgtgtacat

SEQ ID NO: 1600716 - DNA, 13 bp, Homo sapiens
atataaaatattt

SEQ ID NO: 1600717 - DNA, 12 bp, Homo sapiens
atataaaatgaa

SEQ ID NO: 1600718 - DNA, 13 bp, Homo sapiens
atataaaatgtgc

SEQ ID NO: 1600719 - DNA, 12 bp, Homo sapiens
atataaaattat

SEQ ID NO: 1600720 - DNA, 14 bp, Homo sapiens
atataaactcattt

SEQ ID NO: 1600721 - DNA, 16 bp, Homo sapiens
atataaactcatttat

SEQ ID NO: 1600722 - DNA, 13 bp, Homo sapiens
atataaagacaac

SEQ ID NO: 1600723 - DNA, 14 bp, Homo sapiens
atataaagatgtta

SEQ ID NO: 1600724 - DNA, 18 bp, Homo sapiens
atataaatgtataaatat

SEQ ID NO: 1600725 - DNA, 15 bp, Homo sapiens
atataaatttaagca

SEQ ID NO: 1600726 - DNA, 15 bp, Homo sapiens
atataaattttttgt

SEQ ID NO: 1600727 - DNA, 12 bp, Homo sapiens
atataacacatt

SEQ ID NO: 1600728 - DNA, 18 bp, Homo sapiens
atataaccctaggaattt

SEQ ID NO: 1600729 - DNA, 14 bp, Homo sapiens
atataactatttta

SEQ ID NO: 1600730 - DNA, 20 bp, Homo sapiens
atataactgtatttgaaata

SEQ ID NO: 1600731 - DNA, 13 bp, Homo sapiens
atataactgtctt

SEQ ID NO: 1600732 - DNA, 21 bp, Homo sapiens
atataacttaaaaatgtaaat

SEQ ID NO: 1600733 - DNA, 16 bp, Homo sapiens
atataagactattcca

SEQ ID NO: 1600734 - DNA, 21 bp, Homo sapiens
atataagagaagtctcattcg

SEQ ID NO: 1600735 - DNA, 23 bp, Homo sapiens
atataaggaaagcaataaatgaa

SEQ ID NO: 1600736 - DNA, 15 bp, Homo sapiens
atataagtgacttga

SEQ ID NO: 1600737 - DNA, 14 bp, Homo sapiens
atataagtttgaag

SEQ ID NO: 1600738 - DNA, 14 bp, Homo sapiens
atataataaatact

SEQ ID NO: 1600739 - DNA, 18 bp, Homo sapiens
atataataaatactcagt

SEQ ID NO: 1600740 - DNA, 16 bp, Homo sapiens
atataatacacaaaat

SEQ ID NO: 1600741 - DNA, 17 bp, Homo sapiens
atataatacacaaaatc

SEQ ID NO: 1600742 - DNA, 13 bp, Homo sapiens
atataatattcag

SEQ ID NO: 1600743 - DNA, 22 bp, Homo sapiens
atataatattcagccagcttaa

SEQ ID NO: 1600744 - DNA, 23 bp, Homo sapiens
atataatattcagccagcttaaa

SEQ ID NO: 1600745 - DNA, 18 bp, Homo sapiens
atataatggtttcaaaga

SEQ ID NO: 1600746 - DNA, 21 bp, Homo sapiens
atataatggtttcaaagattc

SEQ ID NO: 1600747 - DNA, 20 bp, Homo sapiens
atataatgttgataatatat

SEQ ID NO: 1600748 - DNA, 21 bp, Homo sapiens
atataatgttgttatttaaag

SEQ ID NO: 1600749 - DNA, 22 bp, Homo sapiens
atataattttggtaattttgat

SEQ ID NO: 1600750 - DNA, 21 bp, Homo sapiens
atataatttttttatgttttg

SEQ ID NO: 1600751 - DNA, 23 bp, Homo sapiens
atataatttttttatgttttgtt

SEQ ID NO: 1600752 - DNA, 17 bp, Homo sapiens
atatacagtttttgtaa

SEQ ID NO: 1600753 - DNA, 18 bp, Homo sapiens
atatacatactgcatctt

SEQ ID NO: 1600754 - DNA, 16 bp, Homo sapiens
atatacatattgtata

SEQ ID NO: 1600755 - DNA, 15 bp, Homo sapiens
atatacatgtttatg

SEQ ID NO: 1600756 - DNA, 16 bp, Homo sapiens
atatacatgtttatgt

SEQ ID NO: 1600757 - DNA, 18 bp, Homo sapiens
atatacatgtttatgtaa

SEQ ID NO: 1600758 - DNA, 21 bp, Homo sapiens
atatacatgtttatgtaaaca

SEQ ID NO: 1600759 - DNA, 18 bp, Homo sapiens
atatacattctttatctt

SEQ ID NO: 1600760 - DNA, 11 bp, Homo sapiens
atatacattgt

SEQ ID NO: 1600761 - DNA, 23 bp, Homo sapiens
atatacattgtgtgaaaaaagaa

SEQ ID NO: 1600762 - DNA, 13 bp, Homo sapiens
atatacattttct

SEQ ID NO: 1600763 - DNA, 23 bp, Homo sapiens
atatacattttctaaataaaaat

SEQ ID NO: 1600764 - DNA, 16 bp, Homo sapiens
atataccaaattaaaa

SEQ ID NO: 1600765 - DNA, 19 bp, Homo sapiens
atataccaaattaaaaaaa

SEQ ID NO: 1600766 - DNA, 14 bp, Homo sapiens
atataccatttatc

SEQ ID NO: 1600767 - DNA, 17 bp, Homo sapiens
atatacccccccatgca

SEQ ID NO: 1600768 - DNA, 19 bp, Homo sapiens
atatacctggcttttactt

SEQ ID NO: 1600769 - DNA, 14 bp, Homo sapiens
atataccttattta

SEQ ID NO: 1600770 - DNA, 16 bp, Homo sapiens
atataccttatttatt

SEQ ID NO: 1600771 - DNA, 22 bp, Homo sapiens
atatactaagatgttcactgtg

SEQ ID NO: 1600772 - DNA, 15 bp, Homo sapiens
atatactgctattta

SEQ ID NO: 1600773 - DNA, 19 bp, Homo sapiens
atatactgctatttacact

SEQ ID NO: 1600774 - DNA, 13 bp, Homo sapiens
atatactgtgtgc

SEQ ID NO: 1600775 - DNA, 13 bp, Homo sapiens
atatacttaaaaa

SEQ ID NO: 1600776 - DNA, 13 bp, Homo sapiens
atatacttagaaa

SEQ ID NO: 1600777 - DNA, 14 bp, Homo sapiens
atatacttgttttt

SEQ ID NO: 1600778 - DNA, 17 bp, Homo sapiens
atatagagtcattgtaa

SEQ ID NO: 1600779 - DNA, 19 bp, Homo sapiens
atatagagtcattgtaatg

SEQ ID NO: 1600780 - DNA, 23 bp, Homo sapiens
atatagattataacttgtctaaa

SEQ ID NO: 1600781 - DNA, 21 bp, Homo sapiens
atataggtcctgtgttaaaca

SEQ ID NO: 1600782 - DNA, 18 bp, Homo sapiens
atataggtgatgtttgct

SEQ ID NO: 1600783 - DNA, 13 bp, Homo sapiens
atatagtatattt

SEQ ID NO: 1600784 - DNA, 18 bp, Homo sapiens
atatagttccttgcctta

SEQ ID NO: 1600785 - DNA, 23 bp, Homo sapiens
atatagttgaacaagatttccct

SEQ ID NO: 1600786 - DNA, 18 bp, Homo sapiens
atatagttgaggccgagg

SEQ ID NO: 1600787 - DNA, 13 bp, Homo sapiens
atatagttttact

SEQ ID NO: 1600788 - DNA, 23 bp, Homo sapiens
atatagttttacttttaaactgt

SEQ ID NO: 1600789 - DNA, 21 bp, Homo sapiens
atatataaaacggtgctgtga

SEQ ID NO: 1600790 - DNA, 19 bp, Homo sapiens
atatataaacaataaaaac

SEQ ID NO: 1600791 - DNA, 19 bp, Homo sapiens
atatataaagacaacaaaa

SEQ ID NO: 1600792 - DNA, 21 bp, Homo sapiens
atatataaagacaacaaaaga

SEQ ID NO: 1600793 - DNA, 13 bp, Homo sapiens
atatataaataat

SEQ ID NO: 1600794 - DNA, 18 bp, Homo sapiens
atatataacatatatgga

SEQ ID NO: 1600795 - DNA, 21 bp, Homo sapiens
atatataagactattccaact

SEQ ID NO: 1600796 - DNA, 14 bp, Homo sapiens
atatataataaata

SEQ ID NO: 1600797 - DNA, 16 bp, Homo sapiens
atatataataaatact

SEQ ID NO: 1600798 - DNA, 15 bp, Homo sapiens
atatatacaaggtga

SEQ ID NO: 1600799 - DNA, 16 bp, Homo sapiens
atatatacatagaaac

SEQ ID NO: 1600800 - DNA, 13 bp, Homo sapiens
atatatacatata

SEQ ID NO: 1600801 - DNA, 14 bp, Homo sapiens
atatatacatatat

SEQ ID NO: 1600802 - DNA, 13 bp, Homo sapiens
atatatacatgga

SEQ ID NO: 1600803 - DNA, 14 bp, Homo sapiens
atatatacattgct

SEQ ID NO: 1600804 - DNA, 15 bp, Homo sapiens
atatataccccccca

SEQ ID NO: 1600805 - DNA, 19 bp, Homo sapiens
atatatacccccccatgca

SEQ ID NO: 1600806 - DNA, 16 bp, Homo sapiens
atatatagatatgtat

SEQ ID NO: 1600807 - DNA, 14 bp, Homo sapiens
atatataggcagtt

SEQ ID NO: 1600808 - DNA, 16 bp, Homo sapiens
atatatataacatata

SEQ ID NO: 1600809 - DNA, 11 bp, Homo sapiens
atatatataat

SEQ ID NO: 1600810 - DNA, 12 bp, Homo sapiens
atatatatacat

SEQ ID NO: 1600811 - DNA, 15 bp, Homo sapiens
atatatatagtcaaa

SEQ ID NO: 1600812 - DNA, 15 bp, Homo sapiens
atatatatctacaat

SEQ ID NO: 1600813 - DNA, 20 bp, Homo sapiens
atatatatgatgaaattctt

SEQ ID NO: 1600814 - DNA, 14 bp, Homo sapiens
atatatatgtatat

SEQ ID NO: 1600815 - DNA, 14 bp, Homo sapiens
atatatatgtcaat

SEQ ID NO: 1600816 - DNA, 17 bp, Homo sapiens
atacttgaagaaacaga

SEQ ID NO: 1600817 - DNA, 18 bp, Homo sapiens
atacttgaagggccagag

SEQ ID NO: 1600818 - DNA, 19 bp, Homo sapiens
atacttgaagggccagagc

SEQ ID NO: 1600819 - DNA, 23 bp, Homo sapiens
atacttgaagggccagagccagg

SEQ ID NO: 1600820 - DNA, 22 bp, Homo sapiens
atacttgactcatttaaagcta

SEQ ID NO: 1600821 - DNA, 17 bp, Homo sapiens
atacttgtcttgttcac

SEQ ID NO: 1600822 - DNA, 15 bp, Homo sapiens
atacttgtttttgta

SEQ ID NO: 1600823 - DNA, 19 bp, Homo sapiens
atacttgtttttgtaaaga

SEQ ID NO: 1600824 - DNA, 19 bp, Homo sapiens
atactttaatgttttaact

SEQ ID NO: 1600825 - DNA, 12 bp, Homo sapiens
atactttacagg

SEQ ID NO: 1600826 - DNA, 22 bp, Homo sapiens
atactttcaggggtggcccaat

SEQ ID NO: 1600827 - DNA, 13 bp, Homo sapiens
agttctgaagaat

SEQ ID NO: 1600828 - DNA, 14 bp, Homo sapiens
agttctgagctgta

SEQ ID NO: 1600829 - DNA, 18 bp, Homo sapiens
agttctgagctgtaattt

SEQ ID NO: 1600830 - DNA, 15 bp, Homo sapiens
agttctgagtgtttt

SEQ ID NO: 1600831 - DNA, 13 bp, Homo sapiens
agttctgctgccc

SEQ ID NO: 1600832 - DNA, 22 bp, Homo sapiens
agttctgctttctgcctctcct

SEQ ID NO: 1600833 - DNA, 10 bp, Homo sapiens
agttctggaa

SEQ ID NO: 1600834 - DNA, 23 bp, Homo sapiens
agttctggagcttaattttctgt

SEQ ID NO: 1600835 - DNA, 16 bp, Homo sapiens
agttctggtgttccta

SEQ ID NO: 1600836 - DNA, 14 bp, Homo sapiens
agttctgtaaaata

SEQ ID NO: 1600837 - DNA, 11 bp, Homo sapiens
agttctgtgac

SEQ ID NO: 1600838 - DNA, 19 bp, Homo sapiens
agttctgtgactaggaaaa

SEQ ID NO: 1600839 - DNA, 14 bp, Homo sapiens
agttctgtgcctcc

SEQ ID NO: 1600840 - DNA, 19 bp, Homo sapiens
agttctgtgcctcccccca

SEQ ID NO: 1600841 - DNA, 22 bp, Homo sapiens
agttctgtgcctccccccagac

SEQ ID NO: 1600842 - DNA, 14 bp, Homo sapiens
agttcttattttag

SEQ ID NO: 1600843 - DNA, 19 bp, Homo sapiens
agttcttgggaatcttgga

SEQ ID NO: 1600844 - DNA, 12 bp, Homo sapiens
agttcttgtgcc

SEQ ID NO: 1600845 - DNA, 16 bp, Homo sapiens
agttcttgtgtcctgg

SEQ ID NO: 1600846 - DNA, 17 bp, Homo sapiens
agttcttgtgtcctggt

SEQ ID NO: 1600847 - DNA, 18 bp, Homo sapiens
agttctttcctctttctg

SEQ ID NO: 1600848 - DNA, 22 bp, Homo sapiens
agttctttcctctttctgctct

SEQ ID NO: 1600849 - DNA, 18 bp, Homo sapiens
agttctttgattctgtaa

SEQ ID NO: 1600850 - DNA, 16 bp, Homo sapiens
agttctttgggccaga

SEQ ID NO: 1600851 - DNA, 19 bp, Homo sapiens
agttgaaaaaggaaatatt

SEQ ID NO: 1600852 - DNA, 18 bp, Homo sapiens
agttgaaaagactccaaa

SEQ ID NO: 1600853 - DNA, 19 bp, Homo sapiens
agttgaaaattcatagtaa

SEQ ID NO: 1600854 - DNA, 23 bp, Homo sapiens
agttgaaactgctatagcctaag

SEQ ID NO: 1600855 - DNA, 21 bp, Homo sapiens
agttgaagggaaacaaagaag

SEQ ID NO: 1600856 - DNA, 16 bp, Homo sapiens
agttgaagggaggtga

SEQ ID NO: 1600857 - DNA, 19 bp, Homo sapiens
agttgaagttagtggaaat

SEQ ID NO: 1600858 - DNA, 22 bp, Homo sapiens
agttgaagttagtggaaatctg

SEQ ID NO: 1600859 - DNA, 15 bp, Homo sapiens
agttgaagtttagga

SEQ ID NO: 1600860 - DNA, 10 bp, Homo sapiens
agttgaattt

SEQ ID NO: 1600861 - DNA, 19 bp, Homo sapiens
agttgacaacctagaatgt

SEQ ID NO: 1600862 - DNA, 16 bp, Homo sapiens
agttgaggacttcttg

SEQ ID NO: 1600863 - DNA, 16 bp, Homo sapiens
agttgaggccaggagt

SEQ ID NO: 1600864 - DNA, 20 bp, Homo sapiens
agttgagtacagtgaggagg

SEQ ID NO: 1600865 - DNA, 23 bp, Homo sapiens
agttgagtctcctctctgagact

SEQ ID NO: 1600866 - DNA, 13 bp, Homo sapiens
agttgatctggaa

SEQ ID NO: 1600867 - DNA, 17 bp, Homo sapiens
agttgatctggaaccca

SEQ ID NO: 1600868 - DNA, 16 bp, Homo sapiens
agttgatgtatggtat

SEQ ID NO: 1600869 - DNA, 16 bp, Homo sapiens
agttgatgttgcattt

SEQ ID NO: 1600870 - DNA, 11 bp, Homo sapiens
agttgcaagac

SEQ ID NO: 1600871 - DNA, 13 bp, Homo sapiens
agttgcaataata

SEQ ID NO: 1600872 - DNA, 22 bp, Homo sapiens
agttgcaataatacttctcaaa

SEQ ID NO: 1600873 - DNA, 23 bp, Homo sapiens
agttgcacttattgaccattttt

SEQ ID NO: 1600874 - DNA, 11 bp, Homo sapiens
agttgcagaaa

SEQ ID NO: 1600875 - DNA, 17 bp, Homo sapiens
agttgcagactcagttt

SEQ ID NO: 1600876 - DNA, 18 bp, Homo sapiens
agttgcagactcagtttg

SEQ ID NO: 1600877 - DNA, 22 bp, Homo sapiens
agttgcagactcagtttgtcag

SEQ ID NO: 1600878 - DNA, 23 bp, Homo sapiens
agttgcaggtaattttttgtctg

SEQ ID NO: 1600879 - DNA, 17 bp, Homo sapiens
agttgcatagcagtata

SEQ ID NO: 1600880 - DNA, 18 bp, Homo sapiens
agttgcatagcagtatat

SEQ ID NO: 1600881 - DNA, 14 bp, Homo sapiens
agttgcatcagaaa

SEQ ID NO: 1600882 - DNA, 13 bp, Homo sapiens
agttgcatgtagt

SEQ ID NO: 1600883 - DNA, 21 bp, Homo sapiens
agttgcatgtagtaacactaa

SEQ ID NO: 1600884 - DNA, 20 bp, Homo sapiens
agttgcgtggactctgcaca

SEQ ID NO: 1600885 - DNA, 22 bp, Homo sapiens
agttgctaagtgtgcttagttt

SEQ ID NO: 1600886 - DNA, 14 bp, Homo sapiens
agttgctcacatgt

SEQ ID NO: 1600887 - DNA, 19 bp, Homo sapiens
agttgctgatccctgctct

SEQ ID NO: 1600888 - DNA, 17 bp, Homo sapiens
agttgctgcaaacctga

SEQ ID NO: 1600889 - DNA, 16 bp, Homo sapiens
agttgctgtcactgtt

SEQ ID NO: 1600890 - DNA, 21 bp, Homo sapiens
agttgctgtgaactttcatgt

SEQ ID NO: 1600891 - DNA, 16 bp, Homo sapiens
agttgctgtgtgtctg

SEQ ID NO: 1600892 - DNA, 13 bp, Homo sapiens
agttgctgtttat

SEQ ID NO: 1600893 - DNA, 19 bp, Homo sapiens
agttgcttgtcttctggta

SEQ ID NO: 1600894 - DNA, 20 bp, Homo sapiens
agttggaaatcagttgtgaa

SEQ ID NO: 1600895 - DNA, 22 bp, Homo sapiens
agttggaaatcagttgtgaata

SEQ ID NO: 1600896 - DNA, 23 bp, Homo sapiens
agttggaaccgtgtccagcacag

SEQ ID NO: 1600897 - DNA, 15 bp, Homo sapiens
agttggaaggatctg

SEQ ID NO: 1600898 - DNA, 18 bp, Homo sapiens
agttggaaggatctgctg

SEQ ID NO: 1600899 - DNA, 14 bp, Homo sapiens
agttggactctcag

SEQ ID NO: 1600900 - DNA, 15 bp, Homo sapiens
agttggactctcagg

SEQ ID NO: 1600901 - DNA, 20 bp, Homo sapiens
agtttgcagaaaagcacctg

SEQ ID NO: 1600902 - DNA, 21 bp, Homo sapiens
agtttgcagaaaagcacctgc

SEQ ID NO: 1600903 - DNA, 23 bp, Homo sapiens
agtttgcatttcagaaagccttt

SEQ ID NO: 1600904 - DNA, 15 bp, Homo sapiens
agtttggaatgaaga

SEQ ID NO: 1600905 - DNA, 18 bp, Homo sapiens
agtttggattcttatgta

SEQ ID NO: 1600906 - DNA, 18 bp, Homo sapiens
agtttggccctggagcca

SEQ ID NO: 1600907 - DNA, 23 bp, Homo sapiens
agtttggccctggagccagggca

SEQ ID NO: 1600908 - DNA, 20 bp, Homo sapiens
agtttggctataagtgctca

SEQ ID NO: 1600909 - DNA, 22 bp, Homo sapiens
agtttggggactcaggaccaga

SEQ ID NO: 1600910 - DNA, 20 bp, Homo sapiens
agtttgggtaaaatactttt

SEQ ID NO: 1600911 - DNA, 18 bp, Homo sapiens
agtttgtagaactttatt

SEQ ID NO: 1600912 - DNA, 16 bp, Homo sapiens
agtttgtagccaggta

SEQ ID NO: 1600913 - DNA, 23 bp, Homo sapiens
agtttgtattttaattatgggaa

SEQ ID NO: 1600914 - DNA, 14 bp, Homo sapiens
agtttgtattttgc

SEQ ID NO: 1600915 - DNA, 14 bp, Homo sapiens
agtttgtctatttt

SEQ ID NO: 1600916 - DNA, 16 bp, Homo sapiens
agtttgtctattttaa

SEQ ID NO: 1600917 - DNA, 19 bp, Homo sapiens
agtttgtctattttaaaat

SEQ ID NO: 1600918 - DNA, 21 bp, Homo sapiens
agtttgtctattttaaaataa

SEQ ID NO: 1600919 - DNA, 20 bp, Homo sapiens
agtttgtgtctgttgcttgt

SEQ ID NO: 1600920 - DNA, 14 bp, Homo sapiens
agtttgtgtgtctt

SEQ ID NO: 1600921 - DNA, 16 bp, Homo sapiens
agtttgtgtgtcttaa

SEQ ID NO: 1600922 - DNA, 16 bp, Homo sapiens
agtttgtgtgttgtct

SEQ ID NO: 1600923 - DNA, 19 bp, Homo sapiens
agtttgtgtgttgtcttga

SEQ ID NO: 1600924 - DNA, 20 bp, Homo sapiens
agtttgtgtgttgtcttgaa

SEQ ID NO: 1600925 - DNA, 22 bp, Homo sapiens
agtttgtgttgttgttgctgct

SEQ ID NO: 1600926 - DNA, 22 bp, Homo sapiens
agtttgtttaaacacttatctt

SEQ ID NO: 1600927 - DNA, 12 bp, Homo sapiens
agtttgttttag

SEQ ID NO: 1600928 - DNA, 18 bp, Homo sapiens
agttttaactagaattta

SEQ ID NO: 1600929 - DNA, 14 bp, Homo sapiens
agttttaactttaa

SEQ ID NO: 1600930 - DNA, 22 bp, Homo sapiens
agttttaagaattgtttttgaa

SEQ ID NO: 1600931 - DNA, 22 bp, Homo sapiens
agttttacagagaggatacatt

SEQ ID NO: 1600932 - DNA, 13 bp, Homo sapiens
agttttacagatt

SEQ ID NO: 1600933 - DNA, 20 bp, Homo sapiens
agttttacagattgcctcct

SEQ ID NO: 1600934 - DNA, 15 bp, Homo sapiens
agttggagcaggggt

SEQ ID NO: 1600935 - DNA, 18 bp, Homo sapiens
agttggagtttgtgtctg

SEQ ID NO: 1600936 - DNA, 18 bp, Homo sapiens
agttggcaggagctcctg

SEQ ID NO: 1600937 - DNA, 19 bp, Homo sapiens
agttggcaggagctcctgg

SEQ ID NO: 1600938 - DNA, 20 bp, Homo sapiens
agttggcaggagctcctgga

SEQ ID NO: 1600939 - DNA, 15 bp, Homo sapiens
agttggcatgaaagt

SEQ ID NO: 1600940 - DNA, 16 bp, Homo sapiens
agttggccaggctctt

SEQ ID NO: 1600941 - DNA, 13 bp, Homo sapiens
agttgggagcact

SEQ ID NO: 1600942 - DNA, 16 bp, Homo sapiens
agttgggtgtctcctt

SEQ ID NO: 1600943 - DNA, 11 bp, Homo sapiens
agttgggtgtt

SEQ ID NO: 1600944 - DNA, 19 bp, Homo sapiens
agttgggttcacttgccat

SEQ ID NO: 1600945 - DNA, 15 bp, Homo sapiens
agttggtaacttttg

SEQ ID NO: 1600946 - DNA, 16 bp, Homo sapiens
agttggtaacttttgt

SEQ ID NO: 1600947 - DNA, 20 bp, Homo sapiens
agttggtgattttagatttc

SEQ ID NO: 1600948 - DNA, 18 bp, Homo sapiens
agttgtaaataatttatt

SEQ ID NO: 1600949 - DNA, 18 bp, Homo sapiens
agttgtaacttatattga

SEQ ID NO: 1600950 - DNA, 18 bp, Homo sapiens
agttgtagcagattgttt

SEQ ID NO: 1600951 - DNA, 14 bp, Homo sapiens
agttgtatctcttt

SEQ ID NO: 1600952 - DNA, 17 bp, Homo sapiens
agttgtatctcttttga

SEQ ID NO: 1600953 - DNA, 17 bp, Homo sapiens
agttgtatgtttgctga

SEQ ID NO: 1600954 - DNA, 18 bp, Homo sapiens
agttgtatgtttgctgat

SEQ ID NO: 1600955 - DNA, 23 bp, Homo sapiens
agttgtatttaacagaaattgta

SEQ ID NO: 1600956 - DNA, 18 bp, Homo sapiens
agttgtcctatggacaac

SEQ ID NO: 1600957 - DNA, 13 bp, Homo sapiens
agttgtctaaaca

SEQ ID NO: 1600958 - DNA, 13 bp, Homo sapiens
agttgtcttatgt

SEQ ID NO: 1600959 - DNA, 21 bp, Homo sapiens
agttgtcttatgtgaaaaatt

SEQ ID NO: 1600960 - DNA, 20 bp, Homo sapiens
agttgtgcaacggccagggt

SEQ ID NO: 1600961 - DNA, 21 bp, Homo sapiens
agttgtgcaacggccagggtt

SEQ ID NO: 1600962 - DNA, 19 bp, Homo sapiens
agttgtgcttgtttacagc

SEQ ID NO: 1600963 - DNA, 21 bp, Homo sapiens
agttgtgtctaggctggaaga

SEQ ID NO: 1600964 - DNA, 18 bp, Homo sapiens
agttgtgtgtatgtgtgt

SEQ ID NO: 1600965 - DNA, 23 bp, Homo sapiens
agttgtgttgacacatatgaaca

SEQ ID NO: 1600966 - DNA, 13 bp, Homo sapiens
agttgttaaaaca

SEQ ID NO: 1600967 - DNA, 14 bp, Homo sapiens
agttgttaaaacat

SEQ ID NO: 1600968 - DNA, 15 bp, Homo sapiens
agttgttaaaacatt

SEQ ID NO: 1600969 - DNA, 18 bp, Homo sapiens
agttgttaaaacatttaa

SEQ ID NO: 1600970 - DNA, 19 bp, Homo sapiens
agttgttaaaacatttaat

SEQ ID NO: 1600971 - DNA, 20 bp, Homo sapiens
agttgttcaataataaatat

SEQ ID NO: 1600972 - DNA, 18 bp, Homo sapiens
agttgttcattgatggga

SEQ ID NO: 1600973 - DNA, 11 bp, Homo sapiens
agttgttcttt

SEQ ID NO: 1600974 - DNA, 13 bp, Homo sapiens
agttgttctttgt

SEQ ID NO: 1600975 - DNA, 13 bp, Homo sapiens
agttgttggcctc

SEQ ID NO: 1600976 - DNA, 19 bp, Homo sapiens
agttgttggcctccggcct

SEQ ID NO: 1600977 - DNA, 19 bp, Homo sapiens
agttgtttcattgactatc

SEQ ID NO: 1600978 - DNA, 16 bp, Homo sapiens
agttgtttctgaccca

SEQ ID NO: 1600979 - DNA, 13 bp, Homo sapiens
agttgtttgcatg

SEQ ID NO: 1600980 - DNA, 17 bp, Homo sapiens
agttgtttgtttttgct

SEQ ID NO: 1600981 - DNA, 18 bp, Homo sapiens
agttgttttttgtgtttc

SEQ ID NO: 1600982 - DNA, 14 bp, Homo sapiens
agtttaaaaaaata

SEQ ID NO: 1600983 - DNA, 16 bp, Homo sapiens
agtttaaaaaaataac

SEQ ID NO: 1600984 - DNA, 12 bp, Homo sapiens
agtttaaagcaa

SEQ ID NO: 1600985 - DNA, 16 bp, Homo sapiens
agtttaaatgagacta

SEQ ID NO: 1600986 - DNA, 23 bp, Homo sapiens
agtttaatacaggaaattgactt

SEQ ID NO: 1600987 - DNA, 13 bp, Homo sapiens
agtttacattgta

SEQ ID NO: 1600988 - DNA, 15 bp, Homo sapiens
agtttacattgtaaa

SEQ ID NO: 1600989 - DNA, 20 bp, Homo sapiens
agtttaccaatcaacagcat

SEQ ID NO: 1600990 - DNA, 19 bp, Homo sapiens
agtttaccatttgtaataa

SEQ ID NO: 1600991 - DNA, 17 bp, Homo sapiens
agtttacccatgaagat

SEQ ID NO: 1600992 - DNA, 16 bp, Homo sapiens
agtttacctctttaaa

SEQ ID NO: 1600993 - DNA, 18 bp, Homo sapiens
agtttacctggcttattt

SEQ ID NO: 1600994 - DNA, 21 bp, Homo sapiens
agtttagaggaaaaaaatgac

SEQ ID NO: 1600995 - DNA, 20 bp, Homo sapiens
agtttagtgtgtgtgcagag

SEQ ID NO: 1600996 - DNA, 15 bp, Homo sapiens
agtttatacagtgta

SEQ ID NO: 1600997 - DNA, 15 bp, Homo sapiens
agtttatcttaagca

SEQ ID NO: 1600998 - DNA, 16 bp, Homo sapiens
agtttatgatgcaaat

SEQ ID NO: 1600999 - DNA, 21 bp, Homo sapiens
agtttatggatatgctgcttt

SEQ ID NO: 1601000 - DNA, 19 bp, Homo sapiens
agtttatggcaaagatttt

SEQ ID NO: 1601001 - DNA, 17 bp, Homo sapiens
agtttattacaatgtat

SEQ ID NO: 1601002 - DNA, 22 bp, Homo sapiens
agtttattgacaataatttcag

SEQ ID NO: 1601003 - DNA, 21 bp, Homo sapiens
agtttatttccactattttca

SEQ ID NO: 1601004 - DNA, 20 bp, Homo sapiens
agtttatttttaaagataga

SEQ ID NO: 1601005 - DNA, 16 bp, Homo sapiens
agtttattttttctac

SEQ ID NO: 1601006 - DNA, 18 bp, Homo sapiens
agtttattttttctacac

SEQ ID NO: 1601007 - DNA, 21 bp, Homo sapiens
agtttcaaacttactattttg

SEQ ID NO: 1601008 - DNA, 14 bp, Homo sapiens
agtttcaaatctgt

SEQ ID NO: 1601009 - DNA, 16 bp, Homo sapiens
agtttcaaatctgtaa

SEQ ID NO: 1601010 - DNA, 17 bp, Homo sapiens
agtttcacaggtcaata

SEQ ID NO: 1601011 - DNA, 23 bp, Homo sapiens
agtttcactgtactgcatgtgac

SEQ ID NO: 1601012 - DNA, 13 bp, Homo sapiens
agtttcagacagg

SEQ ID NO: 1601013 - DNA, 14 bp, Homo sapiens
agtttcagacaggg

SEQ ID NO: 1601014 - DNA, 17 bp, Homo sapiens
agtttcagagtatattg

SEQ ID NO: 1601015 - DNA, 20 bp, Homo sapiens
agtttcagatttgccattca

SEQ ID NO: 1601016 - DNA, 18 bp, Homo sapiens
agtttcaggtgtttagtt

SEQ ID NO: 1601017 - DNA, 22 bp, Homo sapiens
agtttcagtattagatgcactt

SEQ ID NO: 1601018 - DNA, 16 bp, Homo sapiens
agtttccaaaaccaga

SEQ ID NO: 1601019 - DNA, 18 bp, Homo sapiens
agtttccaattccactgt

SEQ ID NO: 1601020 - DNA, 20 bp, Homo sapiens
agtttccatagcaacaggaa

SEQ ID NO: 1601021 - DNA, 12 bp, Homo sapiens
agtttcctgaaa

SEQ ID NO: 1601022 - DNA, 16 bp, Homo sapiens
agtttcctgaagcatt

SEQ ID NO: 1601023 - DNA, 22 bp, Homo sapiens
agtttcctgagggttttctcat

SEQ ID NO: 1601024 - DNA, 24 bp, Homo sapiens
agtttcctgagggttttctcataa

SEQ ID NO: 1601025 - DNA, 18 bp, Homo sapiens
agtttcctttttaatatg

SEQ ID NO: 1601026 - DNA, 19 bp, Homo sapiens
agtttctaagattctaaag

SEQ ID NO: 1601027 - DNA, 12 bp, Homo sapiens
agtttctaaggt

SEQ ID NO: 1601028 - DNA, 17 bp, Homo sapiens
agtttctagaggcctca

SEQ ID NO: 1601029 - DNA, 16 bp, Homo sapiens
agtttctagctagaaa

SEQ ID NO: 1601030 - DNA, 21 bp, Homo sapiens
agtttctagctagaaatatga

SEQ ID NO: 1601031 - DNA, 12 bp, Homo sapiens
agtttctatttt

SEQ ID NO: 1601032 - DNA, 15 bp, Homo sapiens
agtttctcagatcct

SEQ ID NO: 1601033 - DNA, 23 bp, Homo sapiens
agtttctcagatccttgtttcaa

SEQ ID NO: 1601034 - DNA, 14 bp, Homo sapiens
agtttctccttgaa

SEQ ID NO: 1601035 - DNA, 23 bp, Homo sapiens
agtttctctgcagaaactactga

SEQ ID NO: 1601036 - DNA, 17 bp, Homo sapiens
agtttctgggacctcag

SEQ ID NO: 1601037 - DNA, 18 bp, Homo sapiens
agtttcttgtaagccatc

SEQ ID NO: 1601038 - DNA, 18 bp, Homo sapiens
agtttgaaggaaacagtt

SEQ ID NO: 1601039 - DNA, 21 bp, Homo sapiens
agtttgagacaagccctggca

SEQ ID NO: 1601040 - DNA, 15 bp, Homo sapiens
agtttgagaccagcc

SEQ ID NO: 1601041 - DNA, 19 bp, Homo sapiens
agtttgagaccagcctggc

SEQ ID NO: 1601042 - DNA, 22 bp, Homo sapiens
agtttgagaccagcctggccaa

SEQ ID NO: 1601043 - DNA, 18 bp, Homo sapiens
agtttgagaccaggctgg

SEQ ID NO: 1601044 - DNA, 16 bp, Homo sapiens
agtttgagctgccttc

SEQ ID NO: 1601045 - DNA, 14 bp, Homo sapiens
agtttgaggctgca

SEQ ID NO: 1601046 - DNA, 19 bp, Homo sapiens
agtttgaggctgcaatgag

SEQ ID NO: 1601047 - DNA, 21 bp, Homo sapiens
agtttgattattatgtttatt

SEQ ID NO: 1601048 - DNA, 23 bp, Homo sapiens
agtttgcaaataggcagaatgga

SEQ ID NO: 1601049 - DNA, 16 bp, Homo sapiens
agtttgcacctgtccc

SEQ ID NO: 1601050 - DNA, 15 bp, Homo sapiens
agttagatctttgta

SEQ ID NO: 1601051 - DNA, 22 bp, Homo sapiens
agttagatctttgtaaatgcat

SEQ ID NO: 1601052 - DNA, 15 bp, Homo sapiens
agttagcaaactttg

SEQ ID NO: 1601053 - DNA, 18 bp, Homo sapiens
agttagcaactagggcta

SEQ ID NO: 1601054 - DNA, 18 bp, Homo sapiens
agttagcatccaggctgg

SEQ ID NO: 1601055 - DNA, 20 bp, Homo sapiens
agttagcatgcgcgctgtgg

SEQ ID NO: 1601056 - DNA, 23 bp, Homo sapiens
agttagccccagaaaatgaaatc

SEQ ID NO: 1601057 - DNA, 12 bp, Homo sapiens
agttagccctca

SEQ ID NO: 1601058 - DNA, 19 bp, Homo sapiens
agttagctcaggaggcttg

SEQ ID NO: 1601059 - DNA, 15 bp, Homo sapiens
agttagctccataaa

SEQ ID NO: 1601060 - DNA, 18 bp, Homo sapiens
agttaggctattcacaac

SEQ ID NO: 1601061 - DNA, 13 bp, Homo sapiens
agttagggagaga

SEQ ID NO: 1601062 - DNA, 17 bp, Homo sapiens
agttagggagagagaag

SEQ ID NO: 1601063 - DNA, 16 bp, Homo sapiens
agttagggtctatgta

SEQ ID NO: 1601064 - DNA, 16 bp, Homo sapiens
agttagggttttgcaa

SEQ ID NO: 1601065 - DNA, 14 bp, Homo sapiens
agttagtttgtata

SEQ ID NO: 1601066 - DNA, 22 bp, Homo sapiens
agttagtttgtatatattatta

SEQ ID NO: 1601067 - DNA, 16 bp, Homo sapiens
agttataaatacatat

SEQ ID NO: 1601068 - DNA, 14 bp, Homo sapiens
agttataaatattt

SEQ ID NO: 1601069 - DNA, 12 bp, Homo sapiens
agttataaatca

SEQ ID NO: 1601070 - DNA, 14 bp, Homo sapiens
agttataagaagaa

SEQ ID NO: 1601071 - DNA, 20 bp, Homo sapiens
agttatacttatttgtatat

SEQ ID NO: 1601072 - DNA, 15 bp, Homo sapiens
agttatagatgtcta

SEQ ID NO: 1601073 - DNA, 15 bp, Homo sapiens
agttatagtgaatac

SEQ ID NO: 1601074 - DNA, 19 bp, Homo sapiens
agttatattggaattataa

SEQ ID NO: 1601075 - DNA, 22 bp, Homo sapiens
agttatcatgaattttaaagta

SEQ ID NO: 1601076 - DNA, 18 bp, Homo sapiens
agttatctgcagatatgt

SEQ ID NO: 1601077 - DNA, 12 bp, Homo sapiens
agttatgatgta

SEQ ID NO: 1601078 - DNA, 17 bp, Homo sapiens
agttatggtgatgactt

SEQ ID NO: 1601079 - DNA, 18 bp, Homo sapiens
agttatgtatttaaagtt

SEQ ID NO: 1601080 - DNA, 17 bp, Homo sapiens
agttattaaaattgttg

SEQ ID NO: 1601081 - DNA, 20 bp, Homo sapiens
agttattaactttaatgttt

SEQ ID NO: 1601082 - DNA, 22 bp, Homo sapiens
agttattaatttttaaggatgt

SEQ ID NO: 1601083 - DNA, 15 bp, Homo sapiens
agttattattgctgt

SEQ ID NO: 1601084 - DNA, 18 bp, Homo sapiens
agttattattgctgtttg

SEQ ID NO: 1601085 - DNA, 13 bp, Homo sapiens
agttattcaaatt

SEQ ID NO: 1601086 - DNA, 19 bp, Homo sapiens
agttattgataagttcata

SEQ ID NO: 1601087 - DNA, 23 bp, Homo sapiens
agttattgataagttcatacatt

SEQ ID NO: 1601088 - DNA, 20 bp, Homo sapiens
agttattgctggtgcaaaga

SEQ ID NO: 1601089 - DNA, 14 bp, Homo sapiens
agttatttactttt

SEQ ID NO: 1601090 - DNA, 21 bp, Homo sapiens
agttatttatttattggagat

SEQ ID NO: 1601091 - DNA, 18 bp, Homo sapiens
agttatttcttgtttgtt

SEQ ID NO: 1601092 - DNA, 17 bp, Homo sapiens
agttatttttgtacatg

SEQ ID NO: 1601093 - DNA, 13 bp, Homo sapiens
agttcaaagaagt

SEQ ID NO: 1601094 - DNA, 16 bp, Homo sapiens
agttcaaagtgtatat

SEQ ID NO: 1601095 - DNA, 18 bp, Homo sapiens
agttcaaagtgtatattt

SEQ ID NO: 1601096 - DNA, 18 bp, Homo sapiens
agttcaaattcttctgaa

SEQ ID NO: 1601097 - DNA, 14 bp, Homo sapiens
agttcaagaagata

SEQ ID NO: 1601098 - DNA, 17 bp, Homo sapiens
agttcaagaccagcctg

SEQ ID NO: 1601099 - DNA, 16 bp, Homo sapiens
agttcaagcctgtggg

SEQ ID NO: 1601100 - DNA, 22 bp, Homo sapiens
agttcaagcctgtgggagtaga

SEQ ID NO: 1601101 - DNA, 18 bp, Homo sapiens
agttcaataaatgtctgt

SEQ ID NO: 1601102 - DNA, 22 bp, Homo sapiens
agttcaatactcttgaaatgta

SEQ ID NO: 1601103 - DNA, 22 bp, Homo sapiens
agttcaatctcccgctgctgct

SEQ ID NO: 1601104 - DNA, 15 bp, Homo sapiens
agttcaccttggaag

SEQ ID NO: 1601105 - DNA, 16 bp, Homo sapiens
agttcaccttggaagg

SEQ ID NO: 1601106 - DNA, 21 bp, Homo sapiens
agttcactataaatggtgttt

SEQ ID NO: 1601107 - DNA, 21 bp, Homo sapiens
agttcagaatggcagtcctgg

SEQ ID NO: 1601108 - DNA, 22 bp, Homo sapiens
agttcagaatggcagtcctgga

SEQ ID NO: 1601109 - DNA, 15 bp, Homo sapiens
agttcagccaccctg

SEQ ID NO: 1601110 - DNA, 16 bp, Homo sapiens
agttcagggaccgtcc

SEQ ID NO: 1601111 - DNA, 18 bp, Homo sapiens
agttcagtagaattacca

SEQ ID NO: 1601112 - DNA, 17 bp, Homo sapiens
agttcatccgcactgta

SEQ ID NO: 1601113 - DNA, 22 bp, Homo sapiens
agttcatgcagctgtggcagag

SEQ ID NO: 1601114 - DNA, 17 bp, Homo sapiens
agttcatggtgatcagt

SEQ ID NO: 1601115 - DNA, 23 bp, Homo sapiens
agttcatgtctgaaacagagaac

SEQ ID NO: 1601116 - DNA, 15 bp, Homo sapiens
agttcatgtttgtaa

SEQ ID NO: 1601117 - DNA, 15 bp, Homo sapiens
agttcattagaaata

SEQ ID NO: 1601118 - DNA, 16 bp, Homo sapiens
agttcattagaaatat

SEQ ID NO: 1601119 - DNA, 18 bp, Homo sapiens
agttcattgacctcatca

SEQ ID NO: 1601120 - DNA, 13 bp, Homo sapiens
agtcacagctgca

SEQ ID NO: 1601121 - DNA, 17 bp, Homo sapiens
agtcacagctgcagctg

SEQ ID NO: 1601122 - DNA, 19 bp, Homo sapiens
agtcacagctgcagctggg

SEQ ID NO: 1601123 - DNA, 21 bp, Homo sapiens
agtcacagctgcagctgggcc

SEQ ID NO: 1601124 - DNA, 20 bp, Homo sapiens
agtcacatcagtgaggaggg

SEQ ID NO: 1601125 - DNA, 19 bp, Homo sapiens
agtcacattccacatctgt

SEQ ID NO: 1601126 - DNA, 21 bp, Homo sapiens
agtcacattccacatctgttt

SEQ ID NO: 1601127 - DNA, 20 bp, Homo sapiens
agtcaccaaatagtgtgaaa

SEQ ID NO: 1601128 - DNA, 21 bp, Homo sapiens
agtcaccaaatagtgtgaaat

SEQ ID NO: 1601129 - DNA, 14 bp, Homo sapiens
agtcacccaaacac

SEQ ID NO: 1601130 - DNA, 17 bp, Homo sapiens
agtcacccatgaagaca

SEQ ID NO: 1601131 - DNA, 20 bp, Homo sapiens
agtcacccggcccccatgca

SEQ ID NO: 1601132 - DNA, 14 bp, Homo sapiens
agtcacctcctcca

SEQ ID NO: 1601133 - DNA, 13 bp, Homo sapiens
agtcacctgcaag

SEQ ID NO: 1601134 - DNA, 15 bp, Homo sapiens
agtcacctgcaagcc

SEQ ID NO: 1601135 - DNA, 19 bp, Homo sapiens
agtcacctgcaagccccag

SEQ ID NO: 1601136 - DNA, 20 bp, Homo sapiens
agtcacctgcaagccccagg

SEQ ID NO: 1601137 - DNA, 15 bp, Homo sapiens
agtcacctgctccag

SEQ ID NO: 1601138 - DNA, 16 bp, Homo sapiens
agtcacctgctccaga

SEQ ID NO: 1601139 - DNA, 17 bp, Homo sapiens
agtcactcacactggcc

SEQ ID NO: 1601140 - DNA, 18 bp, Homo sapiens
agtcactccctctgcctt

SEQ ID NO: 1601141 - DNA, 22 bp, Homo sapiens
agtcactcctctctagggcaga

SEQ ID NO: 1601142 - DNA, 16 bp, Homo sapiens
agtcactgatgtacaa

SEQ ID NO: 1601143 - DNA, 13 bp, Homo sapiens
agtcactgcacag

SEQ ID NO: 1601144 - DNA, 17 bp, Homo sapiens
agtcactgctgcaaggt

SEQ ID NO: 1601145 - DNA, 18 bp, Homo sapiens
agtcactgctgcaaggtg

SEQ ID NO: 1601146 - DNA, 15 bp, Homo sapiens
agtcactggcagcct

SEQ ID NO: 1601147 - DNA, 19 bp, Homo sapiens
agtcactggcagcctgcac

SEQ ID NO: 1601148 - DNA, 19 bp, Homo sapiens
agtcactgttcgtcactca

SEQ ID NO: 1601149 - DNA, 15 bp, Homo sapiens
agtcacttctccatc

SEQ ID NO: 1601150 - DNA, 20 bp, Homo sapiens
agtcagaagcaggttcttga

SEQ ID NO: 1601151 - DNA, 17 bp, Homo sapiens
agtcagaaggacggcag

SEQ ID NO: 1601152 - DNA, 20 bp, Homo sapiens
agtcagaatgtgaaaaagga

SEQ ID NO: 1601153 - DNA, 21 bp, Homo sapiens
agtcagaatgtgaaaaaggaa

SEQ ID NO: 1601154 - DNA, 23 bp, Homo sapiens
agtcagaatgtgaaaaaggaata

SEQ ID NO: 1601155 - DNA, 15 bp, Homo sapiens
agtcagactgctggg

SEQ ID NO: 1601156 - DNA, 17 bp, Homo sapiens
agtcagagagagtgttt

SEQ ID NO: 1601157 - DNA, 22 bp, Homo sapiens
agtcagagcccctacagcattg

SEQ ID NO: 1601158 - DNA, 20 bp, Homo sapiens
agtcagatggaaaattcatt

SEQ ID NO: 1601159 - DNA, 16 bp, Homo sapiens
agtcagcaccttggcc

SEQ ID NO: 1601160 - DNA, 19 bp, Homo sapiens
agtcagcaccttggcccag

SEQ ID NO: 1601161 - DNA, 15 bp, Homo sapiens
agtcagccacactgg

SEQ ID NO: 1601162 - DNA, 18 bp, Homo sapiens
agtcagccaggagctgtc

SEQ ID NO: 1601163 - DNA, 14 bp, Homo sapiens
agtcagccagtggc

SEQ ID NO: 1601164 - DNA, 20 bp, Homo sapiens
agtcagccccgacttcctga

SEQ ID NO: 1601165 - DNA, 18 bp, Homo sapiens
agtcagctttcatctttg

SEQ ID NO: 1601166 - DNA, 17 bp, Homo sapiens
agtcaggggtcaggtgt

SEQ ID NO: 1601167 - DNA, 22 bp, Homo sapiens
agtcagggtgaactgcaaagct

SEQ ID NO: 1601168 - DNA, 15 bp, Homo sapiens
agtcaggtaatatac

SEQ ID NO: 1601169 - DNA, 17 bp, Homo sapiens
agtcagtacgatcaagt

SEQ ID NO: 1601170 - DNA, 21 bp, Homo sapiens
agtcagtaggtccaagggcca

SEQ ID NO: 1601171 - DNA, 16 bp, Homo sapiens
agtcagtgcaaatgtc

SEQ ID NO: 1601172 - DNA, 15 bp, Homo sapiens
agtcagtgcatttca

SEQ ID NO: 1601173 - DNA, 15 bp, Homo sapiens
agtcagtgctctcag

SEQ ID NO: 1601174 - DNA, 20 bp, Homo sapiens
agtcagtggagagatgtttg

SEQ ID NO: 1601175 - DNA, 19 bp, Homo sapiens
agtcagtggagcctgggtg

SEQ ID NO: 1601176 - DNA, 22 bp, Homo sapiens
agtcagtgggaacgtgactgcc

SEQ ID NO: 1601177 - DNA, 21 bp, Homo sapiens
agtcagtgtcgtttatattgt

SEQ ID NO: 1601178 - DNA, 15 bp, Homo sapiens
agtcataaaccttaa

SEQ ID NO: 1601179 - DNA, 18 bp, Homo sapiens
agtcataaaccttaagta

SEQ ID NO: 1601180 - DNA, 12 bp, Homo sapiens
agtcataaatac

SEQ ID NO: 1601181 - DNA, 21 bp, Homo sapiens
agtcataacggttaagaaagc

SEQ ID NO: 1601182 - DNA, 18 bp, Homo sapiens
agtcatcatgaactggct

SEQ ID NO: 1601183 - DNA, 16 bp, Homo sapiens
agtcatctactttttt

SEQ ID NO: 1601184 - DNA, 19 bp, Homo sapiens
agtcatctgtaagagcttg

SEQ ID NO: 1601185 - DNA, 22 bp, Homo sapiens
agtcatcttgtgagtggataat

SEQ ID NO: 1601186 - DNA, 14 bp, Homo sapiens
agtcatgaagccca

SEQ ID NO: 1601187 - DNA, 19 bp, Homo sapiens
agtcatggcccaaatccag

SEQ ID NO: 1601188 - DNA, 21 bp, Homo sapiens
agtcatggggtccctgctgca

SEQ ID NO: 1601189 - DNA, 13 bp, Homo sapiens
agtcatgtgcatt

SEQ ID NO: 1601190 - DNA, 19 bp, Homo sapiens
agtcattaaaatggaagtg

SEQ ID NO: 1601191 - DNA, 18 bp, Homo sapiens
agtggttttatactgaag

SEQ ID NO: 1601192 - DNA, 21 bp, Homo sapiens
agtggttttatactgaaggaa

SEQ ID NO: 1601193 - DNA, 15 bp, Homo sapiens
agtgtaaaattgtta

SEQ ID NO: 1601194 - DNA, 15 bp, Homo sapiens
agtgtaacaattgtg

SEQ ID NO: 1601195 - DNA, 23 bp, Homo sapiens
agtgtaacaattgtgtagccttt

SEQ ID NO: 1601196 - DNA, 19 bp, Homo sapiens
agtgtaacactgcaagaag

SEQ ID NO: 1601197 - DNA, 14 bp, Homo sapiens
agtgtaacagctga

SEQ ID NO: 1601198 - DNA, 15 bp, Homo sapiens
agtgtaacagctgag

SEQ ID NO: 1601199 - DNA, 16 bp, Homo sapiens
agtgtaacagctgagg

SEQ ID NO: 1601200 - DNA, 12 bp, Homo sapiens
agtgtaagaact

SEQ ID NO: 1601201 - DNA, 15 bp, Homo sapiens
agtgtaagaactgta

SEQ ID NO: 1601202 - DNA, 17 bp, Homo sapiens
agtgtaagaactgtaca

SEQ ID NO: 1601203 - DNA, 15 bp, Homo sapiens
agtgtaagtgaatta

SEQ ID NO: 1601204 - DNA, 12 bp, Homo sapiens
agtgtaatgtga

SEQ ID NO: 1601205 - DNA, 17 bp, Homo sapiens
agtgtaatgtgacttca

SEQ ID NO: 1601206 - DNA, 16 bp, Homo sapiens
agtgtacaaaactgta

SEQ ID NO: 1601207 - DNA, 22 bp, Homo sapiens
agtgtacatggaataacatgta

SEQ ID NO: 1601208 - DNA, 13 bp, Homo sapiens
agtgtacatgtac

SEQ ID NO: 1601209 - DNA, 17 bp, Homo sapiens
agtgtacctcctctcag

SEQ ID NO: 1601210 - DNA, 19 bp, Homo sapiens
agtgtagcatcctaaagat

SEQ ID NO: 1601211 - DNA, 19 bp, Homo sapiens
agtgtagcctaaagggcag

SEQ ID NO: 1601212 - DNA, 13 bp, Homo sapiens
agtgtagccttgc

SEQ ID NO: 1601213 - DNA, 17 bp, Homo sapiens
agtgtagccttgcccgg

SEQ ID NO: 1601214 - DNA, 18 bp, Homo sapiens
agtgtagccttgcccgga

SEQ ID NO: 1601215 - DNA, 19 bp, Homo sapiens
agtgtagctgtaagggcag

SEQ ID NO: 1601216 - DNA, 20 bp, Homo sapiens
agtgtagctgtaagggcagt

SEQ ID NO: 1601217 - DNA, 14 bp, Homo sapiens
agtgtagctgtgaa

SEQ ID NO: 1601218 - DNA, 17 bp, Homo sapiens
agtgtataatataaaaa

SEQ ID NO: 1601219 - DNA, 14 bp, Homo sapiens
agtgtatgattact

SEQ ID NO: 1601220 - DNA, 20 bp, Homo sapiens
agtgtatggcgttggtttgt

SEQ ID NO: 1601221 - DNA, 17 bp, Homo sapiens
agtgtattaatcataga

SEQ ID NO: 1601222 - DNA, 15 bp, Homo sapiens
agtgtcaagttgtgc

SEQ ID NO: 1601223 - DNA, 19 bp, Homo sapiens
agtgtcaagttgtgcttgt

SEQ ID NO: 1601224 - DNA, 16 bp, Homo sapiens
agtgtcacatgaggaa

SEQ ID NO: 1601225 - DNA, 21 bp, Homo sapiens
agtgtcacttacctagattta

SEQ ID NO: 1601226 - DNA, 21 bp, Homo sapiens
agtgtcagctgtggggaacat

SEQ ID NO: 1601227 - DNA, 16 bp, Homo sapiens
agtgtcatcagaagat

SEQ ID NO: 1601228 - DNA, 20 bp, Homo sapiens
agtgtcatgaagtgcacagg

SEQ ID NO: 1601229 - DNA, 24 bp, Homo sapiens
agtgtcattcccctttgcactgta

SEQ ID NO: 1601230 - DNA, 22 bp, Homo sapiens
agtgtccagcttccaaagccta

SEQ ID NO: 1601231 - DNA, 22 bp, Homo sapiens
agtgtcccccaggttccgaaga

SEQ ID NO: 1601232 - DNA, 19 bp, Homo sapiens
agtgtcggatcctgtgagt

SEQ ID NO: 1601233 - DNA, 14 bp, Homo sapiens
agtgtctcaaagga

SEQ ID NO: 1601234 - DNA, 22 bp, Homo sapiens
agtgtctcggagggattcccct

SEQ ID NO: 1601235 - DNA, 18 bp, Homo sapiens
agtgtctgacttttgtta

SEQ ID NO: 1601236 - DNA, 12 bp, Homo sapiens
agtgtctgcagt

SEQ ID NO: 1601237 - DNA, 17 bp, Homo sapiens
agtgtctgcagtcctgg

SEQ ID NO: 1601238 - DNA, 23 bp, Homo sapiens
agtgtctgccagctgggcccagc

SEQ ID NO: 1601239 - DNA, 23 bp, Homo sapiens
agtgtctggcccgcaatactgta

SEQ ID NO: 1601240 - DNA, 17 bp, Homo sapiens
agtgtcttaattaaaag

SEQ ID NO: 1601241 - DNA, 18 bp, Homo sapiens
agtgtcttaattaaaaga

SEQ ID NO: 1601242 - DNA, 22 bp, Homo sapiens
agtgtcttcttaaaatcaaatg

SEQ ID NO: 1601243 - DNA, 15 bp, Homo sapiens
agtgtcttttgacat

SEQ ID NO: 1601244 - DNA, 14 bp, Homo sapiens
agtgtgaaatatat

SEQ ID NO: 1601245 - DNA, 17 bp, Homo sapiens
agtgtgacagtttccaa

SEQ ID NO: 1601246 - DNA, 18 bp, Homo sapiens
agtgtgacagtttccaaa

SEQ ID NO: 1601247 - DNA, 23 bp, Homo sapiens
agtgtgagaccccaaagactctg

SEQ ID NO: 1601248 - DNA, 16 bp, Homo sapiens
agtgtgagagagactg

SEQ ID NO: 1601249 - DNA, 17 bp, Homo sapiens
agtgtgagctcttccct

SEQ ID NO: 1601250 - DNA, 18 bp, Homo sapiens
agtgtgagctcttccctt

SEQ ID NO: 1601251 - DNA, 12 bp, Homo sapiens
agtgtgagtaag

SEQ ID NO: 1601252 - DNA, 16 bp, Homo sapiens
agtgtgagtaagagct

SEQ ID NO: 1601253 - DNA, 17 bp, Homo sapiens
agtgtgagtcagaatgt

SEQ ID NO: 1601254 - DNA, 15 bp, Homo sapiens
agtgtgagtggcagc

SEQ ID NO: 1601255 - DNA, 16 bp, Homo sapiens
agtgtgagtggcagcc

SEQ ID NO: 1601256 - DNA, 19 bp, Homo sapiens
agtgtgagtggcagccatg

SEQ ID NO: 1601257 - DNA, 19 bp, Homo sapiens
agtgtgcacgcctgcaggc

SEQ ID NO: 1601258 - DNA, 16 bp, Homo sapiens
agtgtgctaaaaatga

SEQ ID NO: 1601259 - DNA, 21 bp, Homo sapiens
agtgtggagaggggtgcaccc

SEQ ID NO: 1601260 - DNA, 16 bp, Homo sapiens
agtgtggcctcttggc

SEQ ID NO: 1601261 - DNA, 17 bp, Homo sapiens
agtgtgggaagggagag

SEQ ID NO: 1601262 - DNA, 16 bp, Homo sapiens
agtgtgggcttgacca

SEQ ID NO: 1601263 - DNA, 13 bp, Homo sapiens
agtgtggtttctt

SEQ ID NO: 1601264 - DNA, 19 bp, Homo sapiens
agtgtgtaattatgtaaat

SEQ ID NO: 1601265 - DNA, 14 bp, Homo sapiens
agtgtgtctaaatt

SEQ ID NO: 1601266 - DNA, 20 bp, Homo sapiens
agtgtgtcttcctagaattc

SEQ ID NO: 1601267 - DNA, 16 bp, Homo sapiens
agtgtgtgggcagggt

SEQ ID NO: 1601268 - DNA, 17 bp, Homo sapiens
agtgtgtgtgcagagtc

SEQ ID NO: 1601269 - DNA, 15 bp, Homo sapiens
agtgtgtgtgcatgt

SEQ ID NO: 1601270 - DNA, 17 bp, Homo sapiens
agtgtgtgtgcatgtgt

SEQ ID NO: 1601271 - DNA, 20 bp, Homo sapiens
agtgtgtgtgtgcatgtgtg

SEQ ID NO: 1601272 - DNA, 15 bp, Homo sapiens
agtgtgtttaaataa

SEQ ID NO: 1601273 - DNA, 22 bp, Homo sapiens
agtgttactacagccttaatat

SEQ ID NO: 1601274 - DNA, 21 bp, Homo sapiens
agtgttagtgctggtcagaga

SEQ ID NO: 1601275 - DNA, 17 bp, Homo sapiens
agtgttcacaaactgtg

SEQ ID NO: 1601276 - DNA, 18 bp, Homo sapiens
agtgttcacaaactgtga

SEQ ID NO: 1601277 - DNA, 20 bp, Homo sapiens
agtgttcacaaactgtgaaa

SEQ ID NO: 1601278 - DNA, 15 bp, Homo sapiens
agtgttcctgcacca

SEQ ID NO: 1601279 - DNA, 21 bp, Homo sapiens
agtgttctagattatgtcttt

SEQ ID NO: 1601280 - DNA, 20 bp, Homo sapiens
agtgttctcatgaagcagga

SEQ ID NO: 1601281 - DNA, 22 bp, Homo sapiens
agtgttctcatgaagcaggagg

SEQ ID NO: 1601282 - DNA, 14 bp, Homo sapiens
agtgttctgctcct

SEQ ID NO: 1601283 - DNA, 23 bp, Homo sapiens
agtgttctgctcctgcttttctg

SEQ ID NO: 1601284 - DNA, 22 bp, Homo sapiens
agtgttctgtttgttattgttt

SEQ ID NO: 1601285 - DNA, 20 bp, Homo sapiens
agtgttcttaggtttactgt

SEQ ID NO: 1601286 - DNA, 21 bp, Homo sapiens
agtgttcttaggtttactgtg

SEQ ID NO: 1601287 - DNA, 15 bp, Homo sapiens
agtgttcttcagtgt

SEQ ID NO: 1601288 - DNA, 16 bp, Homo sapiens
agtgttcttcagtgta

SEQ ID NO: 1601289 - DNA, 21 bp, Homo sapiens
agtgttcttcagtgtaatgtg

SEQ ID NO: 1601290 - DNA, 17 bp, Homo sapiens
agtgttgaaaatgttca

SEQ ID NO: 1601291 - DNA, 19 bp, Homo sapiens
agtgttgcatatgagcctg

SEQ ID NO: 1601292 - DNA, 19 bp, Homo sapiens
agtgttggggttgacattt

SEQ ID NO: 1601293 - DNA, 16 bp, Homo sapiens
agtgttgtgttcctgg

SEQ ID NO: 1601294 - DNA, 17 bp, Homo sapiens
agtgttgtgttcctggc

SEQ ID NO: 1601295 - DNA, 20 bp, Homo sapiens
agtgttgtgttcctggctga

SEQ ID NO: 1601296 - DNA, 23 bp, Homo sapiens
agtgttgtgttcctggctgatga

SEQ ID NO: 1601297 - DNA, 18 bp, Homo sapiens
agtgttgtttgtaaataa

SEQ ID NO: 1601298 - DNA, 19 bp, Homo sapiens
agtgttgtttgtaaataag

SEQ ID NO: 1601299 - DNA, 22 bp, Homo sapiens
agtgttgtttgtaaataagaga

SEQ ID NO: 1601300 - DNA, 14 bp, Homo sapiens
agtgtttaaaactt

SEQ ID NO: 1601301 - DNA, 22 bp, Homo sapiens
agtgtttaaaaggctaagaata

SEQ ID NO: 1601302 - DNA, 16 bp, Homo sapiens
agtgtttatgtaatag

SEQ ID NO: 1601303 - DNA, 16 bp, Homo sapiens
agtgtttcccataatt

SEQ ID NO: 1601304 - DNA, 19 bp, Homo sapiens
agtgtttcgacagctgatt

SEQ ID NO: 1601305 - DNA, 21 bp, Homo sapiens
agtgtttctaataaacttgga

SEQ ID NO: 1601306 - DNA, 13 bp, Homo sapiens
agtgtttgtggga

SEQ ID NO: 1601307 - DNA, 19 bp, Homo sapiens
agtgagtcacctgctccag

SEQ ID NO: 1601308 - DNA, 22 bp, Homo sapiens
agtgagtcacctgctccagaag

SEQ ID NO: 1601309 - DNA, 16 bp, Homo sapiens
agtgagtgatcactgg

SEQ ID NO: 1601310 - DNA, 20 bp, Homo sapiens
agtgataatattgtttccct

SEQ ID NO: 1601311 - DNA, 19 bp, Homo sapiens
agtgataatttctggaatt

SEQ ID NO: 1601312 - DNA, 16 bp, Homo sapiens
agtgatacactgtatc

SEQ ID NO: 1601313 - DNA, 15 bp, Homo sapiens
agtgatagtcttttg

SEQ ID NO: 1601314 - DNA, 17 bp, Homo sapiens
agtgatagtcttttgct

SEQ ID NO: 1601315 - DNA, 19 bp, Homo sapiens
agtgatccttccacctcag

SEQ ID NO: 1601316 - DNA, 20 bp, Homo sapiens
agtgatccttccacctcagt

SEQ ID NO: 1601317 - DNA, 23 bp, Homo sapiens
agtgatccttccacctcagtctc

SEQ ID NO: 1601318 - DNA, 22 bp, Homo sapiens
agtgatctaaaatttgtaatat

SEQ ID NO: 1601319 - DNA, 16 bp, Homo sapiens
agtgatctcagggcag

SEQ ID NO: 1601320 - DNA, 17 bp, Homo sapiens
agtgatctcagggcaga

SEQ ID NO: 1601321 - DNA, 21 bp, Homo sapiens
agtgatctccatatgttacac

SEQ ID NO: 1601322 - DNA, 17 bp, Homo sapiens
agtgatctgcccgcctc

SEQ ID NO: 1601323 - DNA, 14 bp, Homo sapiens
agtgatgaatgtac

SEQ ID NO: 1601324 - DNA, 16 bp, Homo sapiens
agtgatgacttgctgt

SEQ ID NO: 1601325 - DNA, 22 bp, Homo sapiens
agtgatgcttttagttttaaaa

SEQ ID NO: 1601326 - DNA, 20 bp, Homo sapiens
agtgatggcgcgggaggcac

SEQ ID NO: 1601327 - DNA, 21 bp, Homo sapiens
agtgatgggaaggtttttaag

SEQ ID NO: 1601328 - DNA, 20 bp, Homo sapiens
agtgatgggagaattggtat

SEQ ID NO: 1601329 - DNA, 16 bp, Homo sapiens
agtgattatctctttg

SEQ ID NO: 1601330 - DNA, 12 bp, Homo sapiens
agtgattctaga

SEQ ID NO: 1601331 - DNA, 19 bp, Homo sapiens
agtgattctcctgcctcag

SEQ ID NO: 1601332 - DNA, 20 bp, Homo sapiens
agtgattctgatttcagttt

SEQ ID NO: 1601333 - DNA, 15 bp, Homo sapiens
agtgattgacacaca

SEQ ID NO: 1601334 - DNA, 17 bp, Homo sapiens
agtgattgacacacagc

SEQ ID NO: 1601335 - DNA, 14 bp, Homo sapiens
agtgattgcagctt

SEQ ID NO: 1601336 - DNA, 20 bp, Homo sapiens
agtgattgcagctttatgtt

SEQ ID NO: 1601337 - DNA, 24 bp, Homo sapiens
agtgattgtgtctgcattgttatt

SEQ ID NO: 1601338 - DNA, 15 bp, Homo sapiens
agtgattttcaaacc

SEQ ID NO: 1601339 - DNA, 13 bp, Homo sapiens
agtgcaaaccact

SEQ ID NO: 1601340 - DNA, 19 bp, Homo sapiens
agtgcaaaccacttctcca

SEQ ID NO: 1601341 - DNA, 16 bp, Homo sapiens
agtgcaaattcatttt

SEQ ID NO: 1601342 - DNA, 22 bp, Homo sapiens
agtgcaataaatctgacccagt

SEQ ID NO: 1601343 - DNA, 18 bp, Homo sapiens
agtgcaatgacacagtct

SEQ ID NO: 1601344 - DNA, 18 bp, Homo sapiens
agtgcaatgcttgtagaa

SEQ ID NO: 1601345 - DNA, 15 bp, Homo sapiens
agtgcacaggagcca

SEQ ID NO: 1601346 - DNA, 15 bp, Homo sapiens
agtgcacctgcctcc

SEQ ID NO: 1601347 - DNA, 23 bp, Homo sapiens
agtgcactccggcctgggtgaca

SEQ ID NO: 1601348 - DNA, 12 bp, Homo sapiens
agtgcactgatt

SEQ ID NO: 1601349 - DNA, 20 bp, Homo sapiens
agtgcactgcattcctgtgc

SEQ ID NO: 1601350 - DNA, 22 bp, Homo sapiens
agtgcactgcattcctgtgccc

SEQ ID NO: 1601351 - DNA, 18 bp, Homo sapiens
agtgcactttctaatgtt

SEQ ID NO: 1601352 - DNA, 21 bp, Homo sapiens
agtgcactttctaatgtttct

SEQ ID NO: 1601353 - DNA, 15 bp, Homo sapiens
agtgcacttttttat

SEQ ID NO: 1601354 - DNA, 20 bp, Homo sapiens
agtgcagaatgtaagtgggc

SEQ ID NO: 1601355 - DNA, 21 bp, Homo sapiens
agtgcagaccccttggccagc

SEQ ID NO: 1601356 - DNA, 17 bp, Homo sapiens
agtgcagagccttctca

SEQ ID NO: 1601357 - DNA, 18 bp, Homo sapiens
agtgcagagccttctcag

SEQ ID NO: 1601358 - DNA, 17 bp, Homo sapiens
agtgcagccgtttgaga

SEQ ID NO: 1601359 - DNA, 15 bp, Homo sapiens
agtgcagggaggaaa

SEQ ID NO: 1601360 - DNA, 23 bp, Homo sapiens
agtgcagtggcatcatctcagct

SEQ ID NO: 1601361 - DNA, 16 bp, Homo sapiens
agtgcatatttatcca

SEQ ID NO: 1601362 - DNA, 16 bp, Homo sapiens
agtgcatgctctctgc

SEQ ID NO: 1601363 - DNA, 20 bp, Homo sapiens
agtgcatgctctctgcagcc

SEQ ID NO: 1601364 - DNA, 16 bp, Homo sapiens
agtgcatggtggccag

SEQ ID NO: 1601365 - DNA, 18 bp, Homo sapiens
agtgcatgtactatctta

SEQ ID NO: 1601366 - DNA, 23 bp, Homo sapiens
agtggcaggtgggctgcctgctg

SEQ ID NO: 1601367 - DNA, 20 bp, Homo sapiens
agtggcatcatctcagctca

SEQ ID NO: 1601368 - DNA, 21 bp, Homo sapiens
agtggccaaataggagggaga

SEQ ID NO: 1601369 - DNA, 17 bp, Homo sapiens
agtggcctccctgctgt

SEQ ID NO: 1601370 - DNA, 14 bp, Homo sapiens
agtggcctggccag

SEQ ID NO: 1601371 - DNA, 13 bp, Homo sapiens
agtggcctggccg

SEQ ID NO: 1601372 - DNA, 23 bp, Homo sapiens
agtggcctggccgttcagcctgt

SEQ ID NO: 1601373 - DNA, 17 bp, Homo sapiens
agtggctagtcctcact

SEQ ID NO: 1601374 - DNA, 16 bp, Homo sapiens
agtggctcacacctgt

SEQ ID NO: 1601375 - DNA, 13 bp, Homo sapiens
agtggctcctccc

SEQ ID NO: 1601376 - DNA, 21 bp, Homo sapiens
agtggctgccggaggagcatg

SEQ ID NO: 1601377 - DNA, 11 bp, Homo sapiens
agtggctgctg

SEQ ID NO: 1601378 - DNA, 16 bp, Homo sapiens
agtggctggatctgtg

SEQ ID NO: 1601379 - DNA, 15 bp, Homo sapiens
agtggctggtagaaa

SEQ ID NO: 1601380 - DNA, 22 bp, Homo sapiens
agtggctgtcttaaaagatata

SEQ ID NO: 1601381 - DNA, 14 bp, Homo sapiens
agtgggaagatttt

SEQ ID NO: 1601382 - DNA, 19 bp, Homo sapiens
agtgggacagggcatggcc

SEQ ID NO: 1601383 - DNA, 13 bp, Homo sapiens
agtgggagaaaac

SEQ ID NO: 1601384 - DNA, 17 bp, Homo sapiens
agtgggagaaaacactt

SEQ ID NO: 1601385 - DNA, 16 bp, Homo sapiens
agtgggagcttcccgg

SEQ ID NO: 1601386 - DNA, 18 bp, Homo sapiens
agtgggaggcgtgccccc

SEQ ID NO: 1601387 - DNA, 14 bp, Homo sapiens
agtgggaggggcag

SEQ ID NO: 1601388 - DNA, 15 bp, Homo sapiens
agtgggaggggcagg

SEQ ID NO: 1601389 - DNA, 16 bp, Homo sapiens
agtgggaggggcaggc

SEQ ID NO: 1601390 - DNA, 19 bp, Homo sapiens
agtgggaggggcaggctga

SEQ ID NO: 1601391 - DNA, 22 bp, Homo sapiens
agtgggaggggcaggctgacat

SEQ ID NO: 1601392 - DNA, 22 bp, Homo sapiens
agtgggataaaggcccagactc

SEQ ID NO: 1601393 - DNA, 15 bp, Homo sapiens
agtgggatgaaccag

SEQ ID NO: 1601394 - DNA, 13 bp, Homo sapiens
agtgggcaggtgg

SEQ ID NO: 1601395 - DNA, 14 bp, Homo sapiens
agtgggcaggtggc

SEQ ID NO: 1601396 - DNA, 17 bp, Homo sapiens
agtgggccagccacaga

SEQ ID NO: 1601397 - DNA, 20 bp, Homo sapiens
agtgggccccgggctggaga

SEQ ID NO: 1601398 - DNA, 18 bp, Homo sapiens
agtgggccctctctctgg

SEQ ID NO: 1601399 - DNA, 19 bp, Homo sapiens
agtggggacgggggctgct

SEQ ID NO: 1601400 - DNA, 21 bp, Homo sapiens
agtggggacgggggctgcttc

SEQ ID NO: 1601401 - DNA, 12 bp, Homo sapiens
agtggggaggga

SEQ ID NO: 1601402 - DNA, 14 bp, Homo sapiens
agtggggcctgccc

SEQ ID NO: 1601403 - DNA, 20 bp, Homo sapiens
agtggggtcccccctgagtg

SEQ ID NO: 1601404 - DNA, 23 bp, Homo sapiens
agtggggtcccccctgagtgggc

SEQ ID NO: 1601405 - DNA, 22 bp, Homo sapiens
agtggggtctccctctcctgcc

SEQ ID NO: 1601406 - DNA, 22 bp, Homo sapiens
agtggggtgaacagctggtgcc

SEQ ID NO: 1601407 - DNA, 16 bp, Homo sapiens
agtggggtgctgggag

SEQ ID NO: 1601408 - DNA, 18 bp, Homo sapiens
agtggggttatctctgtg

SEQ ID NO: 1601409 - DNA, 22 bp, Homo sapiens
agtggggttgcaaccactgcaa

SEQ ID NO: 1601410 - DNA, 21 bp, Homo sapiens
agtgggtcttggaccagggca

SEQ ID NO: 1601411 - DNA, 12 bp, Homo sapiens
agtgggtttttt

SEQ ID NO: 1601412 - DNA, 15 bp, Homo sapiens
agtgggttttttagt

SEQ ID NO: 1601413 - DNA, 22 bp, Homo sapiens
agtgggttttttagttgaattt

SEQ ID NO: 1601414 - DNA, 17 bp, Homo sapiens
agtggtaatttttgtac

SEQ ID NO: 1601415 - DNA, 18 bp, Homo sapiens
agtggtaatttttgtaca

SEQ ID NO: 1601416 - DNA, 22 bp, Homo sapiens
agtggtagtatctcgtaatagc

SEQ ID NO: 1601417 - DNA, 21 bp, Homo sapiens
agtggtcataaaatagaataa

SEQ ID NO: 1601418 - DNA, 16 bp, Homo sapiens
agtggtctttctggag

SEQ ID NO: 1601419 - DNA, 15 bp, Homo sapiens
agtggtgatttgaaa

SEQ ID NO: 1601420 - DNA, 22 bp, Homo sapiens
agtggtgggtaattgtacaata

SEQ ID NO: 1601421 - DNA, 20 bp, Homo sapiens
agtggtgtgatctcggctca

SEQ ID NO: 1601422 - DNA, 16 bp, Homo sapiens
agtggtgtttattgca

SEQ ID NO: 1601423 - DNA, 15 bp, Homo sapiens
agtggttaattacct

SEQ ID NO: 1601424 - DNA, 14 bp, Homo sapiens
agtggttgcctggg

SEQ ID NO: 1601425 - DNA, 23 bp, Homo sapiens
agtggtttaggctatttgtaaat

SEQ ID NO: 1601426 - DNA, 18 bp, Homo sapiens
agtggtttgtagacttcc

SEQ ID NO: 1601427 - DNA, 21 bp, Homo sapiens
agtagctgggatgacaggcgc

SEQ ID NO: 1601428 - DNA, 18 bp, Homo sapiens
agtagctgggattacagg

SEQ ID NO: 1601429 - DNA, 14 bp, Homo sapiens
agtagctttccaca

SEQ ID NO: 1601430 - DNA, 18 bp, Homo sapiens
agtaggaatgtacatgaa

SEQ ID NO: 1601431 - DNA, 21 bp, Homo sapiens
agtaggaatgtacatgaagca

SEQ ID NO: 1601432 - DNA, 13 bp, Homo sapiens
agtaggccctggt

SEQ ID NO: 1601433 - DNA, 20 bp, Homo sapiens
agtaggccgctgatgatata

SEQ ID NO: 1601434 - DNA, 23 bp, Homo sapiens
agtaggccgctgatgatatattc

SEQ ID NO: 1601435 - DNA, 21 bp, Homo sapiens
agtaggctgtattttctttta

SEQ ID NO: 1601436 - DNA, 15 bp, Homo sapiens
agtaggtcccggcca

SEQ ID NO: 1601437 - DNA, 18 bp, Homo sapiens
agtaggtcccggccagct

SEQ ID NO: 1601438 - DNA, 13 bp, Homo sapiens
agtaggtgcttga

SEQ ID NO: 1601439 - DNA, 15 bp, Homo sapiens
agtagtatggcactt

SEQ ID NO: 1601440 - DNA, 13 bp, Homo sapiens
agtagtcctgtga

SEQ ID NO: 1601441 - DNA, 15 bp, Homo sapiens
agtagttaaataact

SEQ ID NO: 1601442 - DNA, 20 bp, Homo sapiens
agtagttgattcagccctca

SEQ ID NO: 1601443 - DNA, 16 bp, Homo sapiens
agtagttggtttgtat

SEQ ID NO: 1601444 - DNA, 17 bp, Homo sapiens
agtagttggtttgtatg

SEQ ID NO: 1601445 - DNA, 19 bp, Homo sapiens
agtagttggtttgtatgag

SEQ ID NO: 1601446 - DNA, 19 bp, Homo sapiens
agtagtttgagaccagcct

SEQ ID NO: 1601447 - DNA, 13 bp, Homo sapiens
agtagtttgcatt

SEQ ID NO: 1601448 - DNA, 15 bp, Homo sapiens
agtagtttgcatttc

SEQ ID NO: 1601449 - DNA, 18 bp, Homo sapiens
agtagtttgcatttcaga

SEQ ID NO: 1601450 - DNA, 16 bp, Homo sapiens
agtagttttcaaaaca

SEQ ID NO: 1601451 - DNA, 13 bp, Homo sapiens
agtataaaaacaa

SEQ ID NO: 1601452 - DNA, 19 bp, Homo sapiens
agtataaagtcacttccag

SEQ ID NO: 1601453 - DNA, 17 bp, Homo sapiens
agtataaccatatgata

SEQ ID NO: 1601454 - DNA, 19 bp, Homo sapiens
agtatacgtataaatatca

SEQ ID NO: 1601455 - DNA, 23 bp, Homo sapiens
agtatactagggagccatttgag

SEQ ID NO: 1601456 - DNA, 16 bp, Homo sapiens
agtatactgtgtggga

SEQ ID NO: 1601457 - DNA, 22 bp, Homo sapiens
agtatactgtgtgggatactta

SEQ ID NO: 1601458 - DNA, 19 bp, Homo sapiens
agtatagatacaaaacctt

SEQ ID NO: 1601459 - DNA, 16 bp, Homo sapiens
agtatatctggacaag

SEQ ID NO: 1601460 - DNA, 17 bp, Homo sapiens
agtatatgtcatttact

SEQ ID NO: 1601461 - DNA, 14 bp, Homo sapiens
agtatatgtgcagt

SEQ ID NO: 1601462 - DNA, 18 bp, Homo sapiens
agtatattgttgaagaga

SEQ ID NO: 1601463 - DNA, 22 bp, Homo sapiens
agtatattgttgaagagacaga

SEQ ID NO: 1601464 - DNA, 16 bp, Homo sapiens
agtatatttatactct

SEQ ID NO: 1601465 - DNA, 19 bp, Homo sapiens
agtatattttcttttcctc

SEQ ID NO: 1601466 - DNA, 11 bp, Homo sapiens
agtatccaggc

SEQ ID NO: 1601467 - DNA, 16 bp, Homo sapiens
agtatctcttcagtct

SEQ ID NO: 1601468 - DNA, 24 bp, Homo sapiens
agtatcttcaaactttcactttga

SEQ ID NO: 1601469 - DNA, 20 bp, Homo sapiens
agtatcttctatttttatca

SEQ ID NO: 1601470 - DNA, 16 bp, Homo sapiens
agtatgaataaagaca

SEQ ID NO: 1601471 - DNA, 15 bp, Homo sapiens
agtatgaatctatgc

SEQ ID NO: 1601472 - DNA, 16 bp, Homo sapiens
agtatgaatctatgcc

SEQ ID NO: 1601473 - DNA, 17 bp, Homo sapiens
agtatgaatctatgcca

SEQ ID NO: 1601474 - DNA, 14 bp, Homo sapiens
agtatgagccctaa

SEQ ID NO: 1601475 - DNA, 23 bp, Homo sapiens
agtatgagtcttctgtaattcat

SEQ ID NO: 1601476 - DNA, 18 bp, Homo sapiens
agtatgatttacctcata

SEQ ID NO: 1601477 - DNA, 21 bp, Homo sapiens
agtatgcattattaaattgta

SEQ ID NO: 1601478 - DNA, 20 bp, Homo sapiens
agtatgccttaagcagaaca

SEQ ID NO: 1601479 - DNA, 22 bp, Homo sapiens
agtatgccttaagcagaacaaa

SEQ ID NO: 1601480 - DNA, 19 bp, Homo sapiens
agtatgcttgggccctgca

SEQ ID NO: 1601481 - DNA, 20 bp, Homo sapiens
agtatgctttccctgaggaa

SEQ ID NO: 1601482 - DNA, 19 bp, Homo sapiens
agtatggtaggggagggca

SEQ ID NO: 1601483 - DNA, 14 bp, Homo sapiens
agtatggttcaaga

SEQ ID NO: 1601484 - DNA, 15 bp, Homo sapiens
agtatggttcaagat

SEQ ID NO: 1601485 - DNA, 22 bp, Homo sapiens
agtatggttcaagattgttgat

SEQ ID NO: 1601486 - DNA, 19 bp, Homo sapiens
agtatgtccccataagaca

SEQ ID NO: 1601487 - DNA, 18 bp, Homo sapiens
agtatgtctgtttttgta

SEQ ID NO: 1601488 - DNA, 19 bp, Homo sapiens
agtatgtctgtttttgtat

SEQ ID NO: 1601489 - DNA, 22 bp, Homo sapiens
agtatgtgctatacacacacac

SEQ ID NO: 1601490 - DNA, 23 bp, Homo sapiens
agtatgtgggcagattttcagca

SEQ ID NO: 1601491 - DNA, 17 bp, Homo sapiens
agtatgttttttatgtt

SEQ ID NO: 1601492 - DNA, 20 bp, Homo sapiens
agtattaaaagttgcatttg

SEQ ID NO: 1601493 - DNA, 12 bp, Homo sapiens
agtattaaaatc

SEQ ID NO: 1601494 - DNA, 15 bp, Homo sapiens
agtattaaagggggg

SEQ ID NO: 1601495 - DNA, 23 bp, Homo sapiens
agtattatcttgttcaggaaaag

SEQ ID NO: 1601496 - DNA, 21 bp, Homo sapiens
agtattatgccccagttcaga

SEQ ID NO: 1601497 - DNA, 21 bp, Homo sapiens
agtattccatgagctgctcat

SEQ ID NO: 1601498 - DNA, 16 bp, Homo sapiens
agtattctcttttcaa

SEQ ID NO: 1601499 - DNA, 19 bp, Homo sapiens
agtattctgacatgtaaga

SEQ ID NO: 1601500 - DNA, 16 bp, Homo sapiens
agtattcttttcaatt

SEQ ID NO: 1601501 - DNA, 20 bp, Homo sapiens
agtattcttttcaattatat

SEQ ID NO: 1601502 - DNA, 23 bp, Homo sapiens
agtattgacaactgcacatgaaa

SEQ ID NO: 1601503 - DNA, 16 bp, Homo sapiens
agtaaccagaaatctt

SEQ ID NO: 1601504 - DNA, 19 bp, Homo sapiens
agtaacccccttaaattta

SEQ ID NO: 1601505 - DNA, 14 bp, Homo sapiens
agtaacccctcctg

SEQ ID NO: 1601506 - DNA, 16 bp, Homo sapiens
agtaacccctcctggc

SEQ ID NO: 1601507 - DNA, 16 bp, Homo sapiens
agtaactaattttgtt

SEQ ID NO: 1601508 - DNA, 21 bp, Homo sapiens
agtaactactttttatactcc

SEQ ID NO: 1601509 - DNA, 12 bp, Homo sapiens
agtaactcattt

SEQ ID NO: 1601510 - DNA, 22 bp, Homo sapiens
agtaactcatttgttaaaatta

SEQ ID NO: 1601511 - DNA, 14 bp, Homo sapiens
agtaactgtgactg

SEQ ID NO: 1601512 - DNA, 20 bp, Homo sapiens
agtaactttatgtgtaaata

SEQ ID NO: 1601513 - DNA, 20 bp, Homo sapiens
agtaagaaagtgaagcaaat

SEQ ID NO: 1601514 - DNA, 17 bp, Homo sapiens
agtaagaaccttgcctg

SEQ ID NO: 1601515 - DNA, 15 bp, Homo sapiens
agtaagaagacatga

SEQ ID NO: 1601516 - DNA, 16 bp, Homo sapiens
agtaagaagacatgaa

SEQ ID NO: 1601517 - DNA, 12 bp, Homo sapiens
agtaagcagtgt

SEQ ID NO: 1601518 - DNA, 13 bp, Homo sapiens
agtaagcagtgtt

SEQ ID NO: 1601519 - DNA, 19 bp, Homo sapiens
agtaaggtgcttggagttt

SEQ ID NO: 1601520 - DNA, 14 bp, Homo sapiens
agtaagtattatgc

SEQ ID NO: 1601521 - DNA, 14 bp, Homo sapiens
agtaatataataca

SEQ ID NO: 1601522 - DNA, 22 bp, Homo sapiens
agtaatcaatacagacaaggtt

SEQ ID NO: 1601523 - DNA, 20 bp, Homo sapiens
agtaatcagattactgcttt

SEQ ID NO: 1601524 - DNA, 22 bp, Homo sapiens
agtaatcagattactgctttaa

SEQ ID NO: 1601525 - DNA, 12 bp, Homo sapiens
agtaatcatcta

SEQ ID NO: 1601526 - DNA, 17 bp, Homo sapiens
agtaatcatctaagtca

SEQ ID NO: 1601527 - DNA, 14 bp, Homo sapiens
agtaatccacctgc

SEQ ID NO: 1601528 - DNA, 12 bp, Homo sapiens
agtaatgaattt

SEQ ID NO: 1601529 - DNA, 20 bp, Homo sapiens
agtaatgacgtgtgtggctg

SEQ ID NO: 1601530 - DNA, 15 bp, Homo sapiens
agtaatgggtttcat

SEQ ID NO: 1601531 - DNA, 21 bp, Homo sapiens
agtaatgggtttcatatttct

SEQ ID NO: 1601532 - DNA, 22 bp, Homo sapiens
agtaatgggtttcatatttctt

SEQ ID NO: 1601533 - DNA, 16 bp, Homo sapiens
agtaatggtgtagaac

SEQ ID NO: 1601534 - DNA, 19 bp, Homo sapiens
agtaatggtgtagaacact

SEQ ID NO: 1601535 - DNA, 17 bp, Homo sapiens
agtaatgtaaagatgat

SEQ ID NO: 1601536 - DNA, 14 bp, Homo sapiens
agtaatgtattagt

SEQ ID NO: 1601537 - DNA, 19 bp, Homo sapiens
agtaatgtgactaaaggaa

SEQ ID NO: 1601538 - DNA, 15 bp, Homo sapiens
agtaattcaagaaaa

SEQ ID NO: 1601539 - DNA, 17 bp, Homo sapiens
agtaattgcatttctgc

SEQ ID NO: 1601540 - DNA, 19 bp, Homo sapiens
agtaattgcatttctgctc

SEQ ID NO: 1601541 - DNA, 23 bp, Homo sapiens
agtaattggttatcatgggaaag

SEQ ID NO: 1601542 - DNA, 15 bp, Homo sapiens
agtaattgtgaaaaa

SEQ ID NO: 1601543 - DNA, 13 bp, Homo sapiens
agtaatttattgt

SEQ ID NO: 1601544 - DNA, 22 bp, Homo sapiens
agtaatttattgtttttccttg

SEQ ID NO: 1601545 - DNA, 13 bp, Homo sapiens
agtaatttcagtg

SEQ ID NO: 1601546 - DNA, 13 bp, Homo sapiens
agtacaaaacaat

SEQ ID NO: 1601547 - DNA, 15 bp, Homo sapiens
agtacaaatgaagaa

SEQ ID NO: 1601548 - DNA, 16 bp, Homo sapiens
agtacaataatgtact

SEQ ID NO: 1601549 - DNA, 17 bp, Homo sapiens
agtacaataatgtactc

SEQ ID NO: 1601550 - DNA, 14 bp, Homo sapiens
agtacaatgaactg

SEQ ID NO: 1601551 - DNA, 14 bp, Homo sapiens
agtacaattcattg

SEQ ID NO: 1601552 - DNA, 15 bp, Homo sapiens
agtacaattcattgt

SEQ ID NO: 1601553 - DNA, 23 bp, Homo sapiens
agtacaattcattgttttgcaaa

SEQ ID NO: 1601554 - DNA, 15 bp, Homo sapiens
agtacaattcttact

SEQ ID NO: 1601555 - DNA, 11 bp, Homo sapiens
agtacacacaa

SEQ ID NO: 1601556 - DNA, 21 bp, Homo sapiens
agtacacaccagaagatgtga

SEQ ID NO: 1601557 - DNA, 13 bp, Homo sapiens
agtacactgagag

SEQ ID NO: 1601558 - DNA, 14 bp, Homo sapiens
agtacagaatttga

SEQ ID NO: 1601559 - DNA, 16 bp, Homo sapiens
agtacagaatttgaat

SEQ ID NO: 1601560 - DNA, 19 bp, Homo sapiens
agtacagatactgtgagct

SEQ ID NO: 1601561 - DNA, 15 bp, Homo sapiens
agtacatttaaattt

SEQ ID NO: 1601562 - DNA, 21 bp, Homo sapiens
agtacatttaaattttttggc

SEQ ID NO: 1601563 - DNA, 21 bp, Homo sapiens
agtacatttaatacagcagtg

SEQ ID NO: 1601564 - DNA, 16 bp, Homo sapiens
agtacatttggagaca

SEQ ID NO: 1601565 - DNA, 15 bp, Homo sapiens
agtacattttttgaa

SEQ ID NO: 1601566 - DNA, 18 bp, Homo sapiens
agtacattttttgaaatg

SEQ ID NO: 1601567 - DNA, 20 bp, Homo sapiens
agtacattttttgaaatgct

SEQ ID NO: 1601568 - DNA, 15 bp, Homo sapiens
agtaccaatgctgtt

SEQ ID NO: 1601569 - DNA, 16 bp, Homo sapiens
agtaccctctcagctc

SEQ ID NO: 1601570 - DNA, 18 bp, Homo sapiens
agtaccctctcagctcca

SEQ ID NO: 1601571 - DNA, 19 bp, Homo sapiens
agtaccctctcagctccag

SEQ ID NO: 1601572 - DNA, 17 bp, Homo sapiens
agtacctccaagcaagt

SEQ ID NO: 1601573 - DNA, 13 bp, Homo sapiens
agtacctgcaaaa

SEQ ID NO: 1601574 - DNA, 18 bp, Homo sapiens
agtacctgcaaaaatgag

SEQ ID NO: 1601575 - DNA, 20 bp, Homo sapiens
agtacctgcaaaaatgagtt

SEQ ID NO: 1601576 - DNA, 19 bp, Homo sapiens
agtacctgctgccccagct

SEQ ID NO: 1601577 - DNA, 17 bp, Homo sapiens
agtacctgtagtgagaa

SEQ ID NO: 1601578 - DNA, 13 bp, Homo sapiens
agtacctttgtca

SEQ ID NO: 1601579 - DNA, 14 bp, Homo sapiens
agtacggatttgtc

SEQ ID NO: 1601580 - DNA, 19 bp, Homo sapiens
agtacggatttgtccaaat

SEQ ID NO: 1601581 - DNA, 21 bp, Homo sapiens
agtacgtcccgctgctgtgct

SEQ ID NO: 1601582 - DNA, 23 bp, Homo sapiens
agtactatttcttaatgtaacat

SEQ ID NO: 1601583 - DNA, 19 bp, Homo sapiens
agtactcaatgtttctgga

SEQ ID NO: 1601584 - DNA, 16 bp, Homo sapiens
agtactcctgcaaaat

SEQ ID NO: 1601585 - DNA, 18 bp, Homo sapiens
aggttaggatttaacagt

SEQ ID NO: 1601586 - DNA, 19 bp, Homo sapiens
aggttataattttttttaa

SEQ ID NO: 1601587 - DNA, 20 bp, Homo sapiens
aggttataattttttttaaa

SEQ ID NO: 1601588 - DNA, 17 bp, Homo sapiens
aggttataggtcactcc

SEQ ID NO: 1601589 - DNA, 22 bp, Homo sapiens
aggttatatgagtagatactct

SEQ ID NO: 1601590 - DNA, 13 bp, Homo sapiens
aggttatctgcct

SEQ ID NO: 1601591 - DNA, 17 bp, Homo sapiens
aggttatctgcctggcc

SEQ ID NO: 1601592 - DNA, 14 bp, Homo sapiens
aggttatttaaaat

SEQ ID NO: 1601593 - DNA, 16 bp, Homo sapiens
aggttattttgctttg

SEQ ID NO: 1601594 - DNA, 13 bp, Homo sapiens
aggttcagccaag

SEQ ID NO: 1601595 - DNA, 21 bp, Homo sapiens
aggttcatgccaccatggcca

SEQ ID NO: 1601596 - DNA, 17 bp, Homo sapiens
aggttccaactgtatat

SEQ ID NO: 1601597 - DNA, 16 bp, Homo sapiens
aggttccatcctttac

SEQ ID NO: 1601598 - DNA, 17 bp, Homo sapiens
aggttcccccagcaagc

SEQ ID NO: 1601599 - DNA, 14 bp, Homo sapiens
aggttccctcccag

SEQ ID NO: 1601600 - DNA, 14 bp, Homo sapiens
aggttcctctgcct

SEQ ID NO: 1601601 - DNA, 18 bp, Homo sapiens
aggttcctctgcctgccc

SEQ ID NO: 1601602 - DNA, 19 bp, Homo sapiens
aggttcctctgcctgcccc

SEQ ID NO: 1601603 - DNA, 12 bp, Homo sapiens
aggttctaaagt

SEQ ID NO: 1601604 - DNA, 13 bp, Homo sapiens
aggttctaaagtt

SEQ ID NO: 1601605 - DNA, 13 bp, Homo sapiens
aggttctaaggcc

SEQ ID NO: 1601606 - DNA, 19 bp, Homo sapiens
aggttctaaggcctaggat

SEQ ID NO: 1601607 - DNA, 20 bp, Homo sapiens
aggttctccgttagctcctg

SEQ ID NO: 1601608 - DNA, 22 bp, Homo sapiens
aggttctccgttagctcctgtg

SEQ ID NO: 1601609 - DNA, 12 bp, Homo sapiens
aggttctgccct

SEQ ID NO: 1601610 - DNA, 14 bp, Homo sapiens
aggttctgggcctc

SEQ ID NO: 1601611 - DNA, 23 bp, Homo sapiens
aggttctgttttgttttgtttta

SEQ ID NO: 1601612 - DNA, 19 bp, Homo sapiens
aggttcttaaaaaggaaca

SEQ ID NO: 1601613 - DNA, 23 bp, Homo sapiens
aggttcttcccttttacatactg

SEQ ID NO: 1601614 - DNA, 18 bp, Homo sapiens
aggttcttgatgtcatgt

SEQ ID NO: 1601615 - DNA, 13 bp, Homo sapiens
aggttgaaaaaca

SEQ ID NO: 1601616 - DNA, 15 bp, Homo sapiens
aggttgaagccaagt

SEQ ID NO: 1601617 - DNA, 23 bp, Homo sapiens
aggttgaagccaagtggggtgct

SEQ ID NO: 1601618 - DNA, 22 bp, Homo sapiens
aggttgaagctaaaaggaaaag

SEQ ID NO: 1601619 - DNA, 21 bp, Homo sapiens
aggttgacaataaatgtgctt

SEQ ID NO: 1601620 - DNA, 13 bp, Homo sapiens
aggttgcagctgc

SEQ ID NO: 1601621 - DNA, 18 bp, Homo sapiens
aggttgcagggagccgag

SEQ ID NO: 1601622 - DNA, 18 bp, Homo sapiens
aggttgcagtgagccaag

SEQ ID NO: 1601623 - DNA, 16 bp, Homo sapiens
aggttgcagtgagctg

SEQ ID NO: 1601624 - DNA, 17 bp, Homo sapiens
aggttgcagtgagctga

SEQ ID NO: 1601625 - DNA, 12 bp, Homo sapiens
aggttgccaaat

SEQ ID NO: 1601626 - DNA, 12 bp, Homo sapiens
aggttgcctgaa

SEQ ID NO: 1601627 - DNA, 16 bp, Homo sapiens
aggttggagcccaggg

SEQ ID NO: 1601628 - DNA, 15 bp, Homo sapiens
aggttggatggatgg

SEQ ID NO: 1601629 - DNA, 20 bp, Homo sapiens
aggttggcgactgtcatgtg

SEQ ID NO: 1601630 - DNA, 19 bp, Homo sapiens
aggttgggaacatgctgga

SEQ ID NO: 1601631 - DNA, 23 bp, Homo sapiens
aggttgggagaatgtcagtatgt

SEQ ID NO: 1601632 - DNA, 18 bp, Homo sapiens
aggttgggcttccatgcc

SEQ ID NO: 1601633 - DNA, 16 bp, Homo sapiens
aggttggggtgtacta

SEQ ID NO: 1601634 - DNA, 23 bp, Homo sapiens
aggttgtggatgctccagggcag

SEQ ID NO: 1601635 - DNA, 13 bp, Homo sapiens
aggtttaaagagt

SEQ ID NO: 1601636 - DNA, 20 bp, Homo sapiens
aggtttaaagagtctagatt

SEQ ID NO: 1601637 - DNA, 17 bp, Homo sapiens
aggtttaaccttaaaat

SEQ ID NO: 1601638 - DNA, 19 bp, Homo sapiens
aggtttattgttaatacaa

SEQ ID NO: 1601639 - DNA, 20 bp, Homo sapiens
aggtttcactgtgttggcca

SEQ ID NO: 1601640 - DNA, 17 bp, Homo sapiens
aggtttcgtttctgtat

SEQ ID NO: 1601641 - DNA, 16 bp, Homo sapiens
aggtttctctcttccc

SEQ ID NO: 1601642 - DNA, 19 bp, Homo sapiens
aggtttctttttttttcct

SEQ ID NO: 1601643 - DNA, 22 bp, Homo sapiens
aggtttgatgcctgtgaagaac

SEQ ID NO: 1601644 - DNA, 19 bp, Homo sapiens
aggtttgcaaattaaaaag

SEQ ID NO: 1601645 - DNA, 16 bp, Homo sapiens
aggtttgccagtgaag

SEQ ID NO: 1601646 - DNA, 13 bp, Homo sapiens
aggtttgcctgtg

SEQ ID NO: 1601647 - DNA, 14 bp, Homo sapiens
aggtttggaagagt

SEQ ID NO: 1601648 - DNA, 14 bp, Homo sapiens
aggtttggaaggag

SEQ ID NO: 1601649 - DNA, 21 bp, Homo sapiens
aggtttggggagggggaagag

SEQ ID NO: 1601650 - DNA, 20 bp, Homo sapiens
aggtttgtatattgtcagat

SEQ ID NO: 1601651 - DNA, 22 bp, Homo sapiens
aggtttgtcccagtcagaaata

SEQ ID NO: 1601652 - DNA, 23 bp, Homo sapiens
aggtttgtcgggcaccagccagc

SEQ ID NO: 1601653 - DNA, 22 bp, Homo sapiens
aggtttgtgagagcgaggctga

SEQ ID NO: 1601654 - DNA, 23 bp, Homo sapiens
aggtttgtttagaagaagtgtgt

SEQ ID NO: 1601655 - DNA, 20 bp, Homo sapiens
aggtttgttttgtgaatttt

SEQ ID NO: 1601656 - DNA, 19 bp, Homo sapiens
aggttttaagctaaaatgt

SEQ ID NO: 1601657 - DNA, 16 bp, Homo sapiens
aggttttaggttctaa

SEQ ID NO: 1601658 - DNA, 17 bp, Homo sapiens
aggttttaggttctaaa

SEQ ID NO: 1601659 - DNA, 19 bp, Homo sapiens
aggttttaggttctaaagt

SEQ ID NO: 1601660 - DNA, 20 bp, Homo sapiens
aggttttatttcatttttca

SEQ ID NO: 1601661 - DNA, 22 bp, Homo sapiens
aggttttcaaccggaaggaggc

SEQ ID NO: 1601662 - DNA, 13 bp, Homo sapiens
aggttttgtaaag

SEQ ID NO: 1601663 - DNA, 15 bp, Homo sapiens
aggttttgtaaagat

SEQ ID NO: 1601664 - DNA, 20 bp, Homo sapiens
aggtttttcctactgtcctc

SEQ ID NO: 1601665 - DNA, 12 bp, Homo sapiens
aggtttttcctt

SEQ ID NO: 1601666 - DNA, 17 bp, Homo sapiens
aggtttttgtaaagatt

SEQ ID NO: 1601667 - DNA, 22 bp, Homo sapiens
agtaaaaacactacctcttttg

SEQ ID NO: 1601668 - DNA, 14 bp, Homo sapiens
agtaaaaattaaaa

SEQ ID NO: 1601669 - DNA, 15 bp, Homo sapiens
agtaaaaccacagca

SEQ ID NO: 1601670 - DNA, 15 bp, Homo sapiens
aggtgtagctctgtt

SEQ ID NO: 1601671 - DNA, 22 bp, Homo sapiens
aggtgtatgccacacctggcct

SEQ ID NO: 1601672 - DNA, 13 bp, Homo sapiens
aggtgtatttaaa

SEQ ID NO: 1601673 - DNA, 11 bp, Homo sapiens
aggtgtcccca

SEQ ID NO: 1601674 - DNA, 14 bp, Homo sapiens
aggtgtccctgcct

SEQ ID NO: 1601675 - DNA, 20 bp, Homo sapiens
aggtgtctgccttcacaaat

SEQ ID NO: 1601676 - DNA, 15 bp, Homo sapiens
aggtgtgcctgtgct

SEQ ID NO: 1601677 - DNA, 16 bp, Homo sapiens
aggtgtgcctgtgctc

SEQ ID NO: 1601678 - DNA, 20 bp, Homo sapiens
aggtgtggagccgaggccta

SEQ ID NO: 1601679 - DNA, 18 bp, Homo sapiens
aggtgtgggatctgggga

SEQ ID NO: 1601680 - DNA, 19 bp, Homo sapiens
aggtgtgggatctggggag

SEQ ID NO: 1601681 - DNA, 14 bp, Homo sapiens
aggtgtgggggctg

SEQ ID NO: 1601682 - DNA, 23 bp, Homo sapiens
aggtgtgggtgggaggggcccac

SEQ ID NO: 1601683 - DNA, 23 bp, Homo sapiens
aggtgttacagaggacccttacg

SEQ ID NO: 1601684 - DNA, 17 bp, Homo sapiens
aggtgttctacactcat

SEQ ID NO: 1601685 - DNA, 23 bp, Homo sapiens
aggtgttgccaaatatgtcctgg

SEQ ID NO: 1601686 - DNA, 15 bp, Homo sapiens
aggtgttgggacctg

SEQ ID NO: 1601687 - DNA, 17 bp, Homo sapiens
aggtgttgggacctgct

SEQ ID NO: 1601688 - DNA, 20 bp, Homo sapiens
aggtgttgggacctgctgct

SEQ ID NO: 1601689 - DNA, 16 bp, Homo sapiens
aggtgtttccatttct

SEQ ID NO: 1601690 - DNA, 12 bp, Homo sapiens
aggttaaaaaaa

SEQ ID NO: 1601691 - DNA, 18 bp, Homo sapiens
aggttaaaaaaaaaagtc

SEQ ID NO: 1601692 - DNA, 18 bp, Homo sapiens
aggttaaggtgggtccag

SEQ ID NO: 1601693 - DNA, 20 bp, Homo sapiens
aggttaaggtgggtccagga

SEQ ID NO: 1601694 - DNA, 15 bp, Homo sapiens
aggttaattccaatt

SEQ ID NO: 1601695 - DNA, 20 bp, Homo sapiens
aggttaattctctagggcta

SEQ ID NO: 1601696 - DNA, 21 bp, Homo sapiens
aggttacaagcctgcacaata

SEQ ID NO: 1601697 - DNA, 16 bp, Homo sapiens
aggttacgaagacaaa

SEQ ID NO: 1601698 - DNA, 21 bp, Homo sapiens
aggacccggggcccgcctcac

SEQ ID NO: 1601699 - DNA, 18 bp, Homo sapiens
aggaccctaacacagtat

SEQ ID NO: 1601700 - DNA, 13 bp, Homo sapiens
aggaccctcagga

SEQ ID NO: 1601701 - DNA, 14 bp, Homo sapiens
aggaccctgcacct

SEQ ID NO: 1601702 - DNA, 20 bp, Homo sapiens
aggacccttacgtgagaaat

SEQ ID NO: 1601703 - DNA, 12 bp, Homo sapiens
aggacccttccc

SEQ ID NO: 1601704 - DNA, 22 bp, Homo sapiens
aggaccgggagctttgggtgac

SEQ ID NO: 1601705 - DNA, 23 bp, Homo sapiens
aggaccgtggccctgccctctcc

SEQ ID NO: 1601706 - DNA, 23 bp, Homo sapiens
aggacctctgcttttgcacacct

SEQ ID NO: 1601707 - DNA, 19 bp, Homo sapiens
aggacctctgtaggcagca

SEQ ID NO: 1601708 - DNA, 20 bp, Homo sapiens
aggacctctgtaggcagcag

SEQ ID NO: 1601709 - DNA, 20 bp, Homo sapiens
aggacctgcatccttcctgg

SEQ ID NO: 1601710 - DNA, 22 bp, Homo sapiens
aggacctgcatccttcctgggg

SEQ ID NO: 1601711 - DNA, 19 bp, Homo sapiens
aggaccttcgggctgtgcc

SEQ ID NO: 1601712 - DNA, 20 bp, Homo sapiens
aggaccttcgggctgtgccc

SEQ ID NO: 1601713 - DNA, 20 bp, Homo sapiens
aggaccttgggcacatctgc

SEQ ID NO: 1601714 - DNA, 16 bp, Homo sapiens
aggacgagacccccat

SEQ ID NO: 1601715 - DNA, 19 bp, Homo sapiens
aggacgctggctactgtct

SEQ ID NO: 1601716 - DNA, 22 bp, Homo sapiens
aggacggtgccaagggccccag

SEQ ID NO: 1601717 - DNA, 22 bp, Homo sapiens
aggactaacataaaatctgtga

SEQ ID NO: 1601718 - DNA, 18 bp, Homo sapiens
aggactaccgcaggcccg

SEQ ID NO: 1601719 - DNA, 16 bp, Homo sapiens
aggactccaggcccaa

SEQ ID NO: 1601720 - DNA, 18 bp, Homo sapiens
aggactcccaaccctggc

SEQ ID NO: 1601721 - DNA, 15 bp, Homo sapiens
aggactccccgaggt

SEQ ID NO: 1601722 - DNA, 23 bp, Homo sapiens
aggactccctcctcacctctgga

SEQ ID NO: 1601723 - DNA, 13 bp, Homo sapiens
aggactctgaggc

SEQ ID NO: 1601724 - DNA, 13 bp, Homo sapiens
aggactgaaagaa

SEQ ID NO: 1601725 - DNA, 23 bp, Homo sapiens
aggactgaaagaagaaaacagta

SEQ ID NO: 1601726 - DNA, 14 bp, Homo sapiens
aggactgagggcag

SEQ ID NO: 1601727 - DNA, 21 bp, Homo sapiens
aggactgagggcagtgccctt

SEQ ID NO: 1601728 - DNA, 21 bp, Homo sapiens
aggactgagtcccctccagga

SEQ ID NO: 1601729 - DNA, 22 bp, Homo sapiens
aggactgagtcccctccaggaa

SEQ ID NO: 1601730 - DNA, 13 bp, Homo sapiens
aggactgcagtgt

SEQ ID NO: 1601731 - DNA, 15 bp, Homo sapiens
aggactgcagtgtgg

SEQ ID NO: 1601732 - DNA, 16 bp, Homo sapiens
aggactgcagtgtgga

SEQ ID NO: 1601733 - DNA, 22 bp, Homo sapiens
aggactgggtctgacctggtgg

SEQ ID NO: 1601734 - DNA, 22 bp, Homo sapiens
aggactggtgcgaccccccacc

SEQ ID NO: 1601735 - DNA, 15 bp, Homo sapiens
aggactgtaaagatt

SEQ ID NO: 1601736 - DNA, 17 bp, Homo sapiens
aggacttaacggctcca

SEQ ID NO: 1601737 - DNA, 19 bp, Homo sapiens
aggacttatttaaactctg

SEQ ID NO: 1601738 - DNA, 22 bp, Homo sapiens
aggacttcctgtccagctccaa

SEQ ID NO: 1601739 - DNA, 17 bp, Homo sapiens
aggacttgctaaagcac

SEQ ID NO: 1601740 - DNA, 19 bp, Homo sapiens
aggacttgctaaagcactt

SEQ ID NO: 1601741 - DNA, 16 bp, Homo sapiens
aggacttgtgtctctg

SEQ ID NO: 1601742 - DNA, 11 bp, Homo sapiens
aggactttgca

SEQ ID NO: 1601743 - DNA, 15 bp, Homo sapiens
aggagaaaaaaaacc

SEQ ID NO: 1601744 - DNA, 18 bp, Homo sapiens
aggagaaagatgaaactg

SEQ ID NO: 1601745 - DNA, 20 bp, Homo sapiens
aggagaaagatgaaactgaa

SEQ ID NO: 1601746 - DNA, 18 bp, Homo sapiens
aggagaaagcaaaataca

SEQ ID NO: 1601747 - DNA, 19 bp, Homo sapiens
aggagaaagcaaaatacat

SEQ ID NO: 1601748 - DNA, 12 bp, Homo sapiens
aggagaaatgca

SEQ ID NO: 1601749 - DNA, 22 bp, Homo sapiens
aggagaaccaaatctggaagcc

SEQ ID NO: 1601750 - DNA, 14 bp, Homo sapiens
aggagaaccactac

SEQ ID NO: 1601751 - DNA, 15 bp, Homo sapiens
aggagaaccactaca

SEQ ID NO: 1601752 - DNA, 22 bp, Homo sapiens
aggagaagcacagctcctgcca

SEQ ID NO: 1601753 - DNA, 14 bp, Homo sapiens
aggagaagccagga

SEQ ID NO: 1601754 - DNA, 19 bp, Homo sapiens
aggagaagctcagctgcat

SEQ ID NO: 1601755 - DNA, 16 bp, Homo sapiens
aggagaagctgatcca

SEQ ID NO: 1601756 - DNA, 12 bp, Homo sapiens
aggagaaggaag

SEQ ID NO: 1601757 - DNA, 21 bp, Homo sapiens
aggagaagtattcctgttgct

SEQ ID NO: 1601758 - DNA, 17 bp, Homo sapiens
aggagaagtgctccctg

SEQ ID NO: 1601759 - DNA, 20 bp, Homo sapiens
aggagaatcactcgaacccg

SEQ ID NO: 1601760 - DNA, 20 bp, Homo sapiens
aggagaatcacttgaacccg

SEQ ID NO: 1601761 - DNA, 20 bp, Homo sapiens
aggagacacgacagcacaca

SEQ ID NO: 1601762 - DNA, 17 bp, Homo sapiens
aggagacagaaagcctc

SEQ ID NO: 1601763 - DNA, 12 bp, Homo sapiens
aggagacagagc

SEQ ID NO: 1601764 - DNA, 18 bp, Homo sapiens
aggagacagttcaagaaa

SEQ ID NO: 1601765 - DNA, 16 bp, Homo sapiens
aggagacggaggggag

SEQ ID NO: 1601766 - DNA, 13 bp, Homo sapiens
aggagactcacct

SEQ ID NO: 1601767 - DNA, 16 bp, Homo sapiens
aggagactcacctctg

SEQ ID NO: 1601768 - DNA, 17 bp, Homo sapiens
aggagactcacctctgc

SEQ ID NO: 1601769 - DNA, 16 bp, Homo sapiens
aggagagaagaaagtg

SEQ ID NO: 1601770 - DNA, 11 bp, Homo sapiens
aggagagaccc

SEQ ID NO: 1601771 - DNA, 22 bp, Homo sapiens
aggagagactgaaagcagcagc

SEQ ID NO: 1601772 - DNA, 13 bp, Homo sapiens
aggtcttggtgcc

SEQ ID NO: 1601773 - DNA, 18 bp, Homo sapiens
aggtctttcagtactttt

SEQ ID NO: 1601774 - DNA, 16 bp, Homo sapiens
aggtctttgcacatgt

SEQ ID NO: 1601775 - DNA, 17 bp, Homo sapiens
aggtctttgcacatgtg

SEQ ID NO: 1601776 - DNA, 22 bp, Homo sapiens
aggtgaaatgggagatggtcag

SEQ ID NO: 1601777 - DNA, 20 bp, Homo sapiens
aggtgacaaaccatttccaa

SEQ ID NO: 1601778 - DNA, 15 bp, Homo sapiens
aggtgacgatttagc

SEQ ID NO: 1601779 - DNA, 15 bp, Homo sapiens
aggtgactgtgctgt

SEQ ID NO: 1601780 - DNA, 19 bp, Homo sapiens
aggtgacttaggttctaga

SEQ ID NO: 1601781 - DNA, 14 bp, Homo sapiens
aggtgagaaaaaaa

SEQ ID NO: 1601782 - DNA, 14 bp, Homo sapiens
aggtgagaacccag

SEQ ID NO: 1601783 - DNA, 22 bp, Homo sapiens
aggtgagcaggcagggctgggc

SEQ ID NO: 1601784 - DNA, 18 bp, Homo sapiens
aggtgaggagcagagcag

SEQ ID NO: 1601785 - DNA, 16 bp, Homo sapiens
aggtgaggattccaaa

SEQ ID NO: 1601786 - DNA, 22 bp, Homo sapiens
aggtgagtttgagctgccttcc

SEQ ID NO: 1601787 - DNA, 16 bp, Homo sapiens
aggtgataaagaggca

SEQ ID NO: 1601788 - DNA, 21 bp, Homo sapiens
aggtgataagggaaaagataa

SEQ ID NO: 1601789 - DNA, 23 bp, Homo sapiens
aggtgatcaaaataaaggcgcta

SEQ ID NO: 1601790 - DNA, 21 bp, Homo sapiens
aggtgatgccattacagaacc

SEQ ID NO: 1601791 - DNA, 17 bp, Homo sapiens
aggtgattccagtgaag

SEQ ID NO: 1601792 - DNA, 21 bp, Homo sapiens
aggtgcaacagacttgaatgc

SEQ ID NO: 1601793 - DNA, 20 bp, Homo sapiens
aggtgcaatttcaaggttct

SEQ ID NO: 1601794 - DNA, 22 bp, Homo sapiens
aggtgcaatttcaaggttctaa

SEQ ID NO: 1601795 - DNA, 12 bp, Homo sapiens
aggtgcagaggt

SEQ ID NO: 1601796 - DNA, 12 bp, Homo sapiens
aaaatatcttgg

SEQ ID NO: 1601797 - DNA, 15 bp, Homo sapiens
aaaatatgtaaaact

SEQ ID NO: 1601798 - DNA, 16 bp, Homo sapiens
aaaatatgtaatttca

SEQ ID NO: 1601799 - DNA, 17 bp, Homo sapiens
aaaatatgtaatttcaa

SEQ ID NO: 1601800 - DNA, 20 bp, Homo sapiens
aaaatatgtcccagaaatgt

SEQ ID NO: 1601801 - DNA, 14 bp, Homo sapiens
aaaatattatgtgt

SEQ ID NO: 1601802 - DNA, 21 bp, Homo sapiens
aaaatattatgtgtttccata

SEQ ID NO: 1601803 - DNA, 12 bp, Homo sapiens
aaaatattcact

SEQ ID NO: 1601804 - DNA, 13 bp, Homo sapiens
aaaatattcactc

SEQ ID NO: 1601805 - DNA, 23 bp, Homo sapiens
aaaatattcactctccattagaa

SEQ ID NO: 1601806 - DNA, 11 bp, Homo sapiens
aaaatatttaa

SEQ ID NO: 1601807 - DNA, 14 bp, Homo sapiens
aaaatatttaagtg

SEQ ID NO: 1601808 - DNA, 17 bp, Homo sapiens
aaaatatttaatatcaa

SEQ ID NO: 1601809 - DNA, 11 bp, Homo sapiens
aaaatatttat

SEQ ID NO: 1601810 - DNA, 13 bp, Homo sapiens
aaaatatttcaga

SEQ ID NO: 1601811 - DNA, 17 bp, Homo sapiens
aaaatatttcagatatc

SEQ ID NO: 1601812 - DNA, 19 bp, Homo sapiens
aaaatatttcagatatcaa

SEQ ID NO: 1601813 - DNA, 23 bp, Homo sapiens
aaaatatttctaagcttatttct

SEQ ID NO: 1601814 - DNA, 21 bp, Homo sapiens
aaaatatttgactattctgta

SEQ ID NO: 1601815 - DNA, 19 bp, Homo sapiens
aaaatatttgtctttaaac

SEQ ID NO: 1601816 - DNA, 17 bp, Homo sapiens
aaaatattttataattt

SEQ ID NO: 1601817 - DNA, 13 bp, Homo sapiens
aaaatattttcat

SEQ ID NO: 1601818 - DNA, 13 bp, Homo sapiens
aaaatattttcct

SEQ ID NO: 1601819 - DNA, 23 bp, Homo sapiens
aaaatattttctctgtacttttc

SEQ ID NO: 1601820 - DNA, 15 bp, Homo sapiens
aaaatcaagtattat

SEQ ID NO: 1601821 - DNA, 15 bp, Homo sapiens
aaaatcactatcttt

SEQ ID NO: 1601822 - DNA, 21 bp, Homo sapiens
aaaatcactatctttctgata

SEQ ID NO: 1601823 - DNA, 20 bp, Homo sapiens
aaaatcactggattataagt

SEQ ID NO: 1601824 - DNA, 15 bp, Homo sapiens
aaaatcactttcata

SEQ ID NO: 1601825 - DNA, 20 bp, Homo sapiens
aaaatcactttcataatctt

SEQ ID NO: 1601826 - DNA, 12 bp, Homo sapiens
aaaatcatcaag

SEQ ID NO: 1601827 - DNA, 17 bp, Homo sapiens
aaaatcatgccagtatt

SEQ ID NO: 1601828 - DNA, 16 bp, Homo sapiens
aaaatccaaatattgt

SEQ ID NO: 1601829 - DNA, 21 bp, Homo sapiens
aaaatccccttcgctgaaatt

SEQ ID NO: 1601830 - DNA, 22 bp, Homo sapiens
aaaatccccttcgctgaaattg

SEQ ID NO: 1601831 - DNA, 20 bp, Homo sapiens
aaaatcctcaacactattgt

SEQ ID NO: 1601832 - DNA, 22 bp, Homo sapiens
aaaatcctcaacactattgtaa

SEQ ID NO: 1601833 - DNA, 22 bp, Homo sapiens
aaaatccttgttgaagtttttt

SEQ ID NO: 1601834 - DNA, 22 bp, Homo sapiens
aaaatctaagcagcttattgtt

SEQ ID NO: 1601835 - DNA, 23 bp, Homo sapiens
aaaatctaagcagcttattgttt

SEQ ID NO: 1601836 - DNA, 17 bp, Homo sapiens
aaaatctacagaactac

SEQ ID NO: 1601837 - DNA, 23 bp, Homo sapiens
aaaatctatatttgtcttccgat

SEQ ID NO: 1601838 - DNA, 21 bp, Homo sapiens
aaaatctgaattttgcaatgt

SEQ ID NO: 1601839 - DNA, 22 bp, Homo sapiens
aaaatctgaattttgcaatgta

SEQ ID NO: 1601840 - DNA, 13 bp, Homo sapiens
aaaatctgctgca

SEQ ID NO: 1601841 - DNA, 12 bp, Homo sapiens
aaaatctgtcca

SEQ ID NO: 1601842 - DNA, 20 bp, Homo sapiens
aaaatctgttgataaatcca

SEQ ID NO: 1601843 - DNA, 14 bp, Homo sapiens
aaaatcttgcataa

SEQ ID NO: 1601844 - DNA, 17 bp, Homo sapiens
aaaatcttggcacagaa

SEQ ID NO: 1601845 - DNA, 13 bp, Homo sapiens
aaaatcttgtcat

SEQ ID NO: 1601846 - DNA, 19 bp, Homo sapiens
aaaatcttgtcatgtgtat

SEQ ID NO: 1601847 - DNA, 18 bp, Homo sapiens
aaaatcttgtgctagaat

SEQ ID NO: 1601848 - DNA, 20 bp, Homo sapiens
aaaatcttgttaatgtcatt

SEQ ID NO: 1601849 - DNA, 16 bp, Homo sapiens
aaaatcttttgaagca

SEQ ID NO: 1601850 - DNA, 15 bp, Homo sapiens
aaaatgaaagatttt

SEQ ID NO: 1601851 - DNA, 19 bp, Homo sapiens
aaaatgaaagcatgtctca

SEQ ID NO: 1601852 - DNA, 20 bp, Homo sapiens
aaaatgaacctgcaagcctt

SEQ ID NO: 1601853 - DNA, 14 bp, Homo sapiens
aaaatgaatatcta

SEQ ID NO: 1601854 - DNA, 14 bp, Homo sapiens
aaaatgaattttgt

SEQ ID NO: 1601855 - DNA, 22 bp, Homo sapiens
aaaatgaattttgtatgctgaa

SEQ ID NO: 1601856 - DNA, 14 bp, Homo sapiens
aaaatgacaacaga

SEQ ID NO: 1601857 - DNA, 15 bp, Homo sapiens
aaaatgacaacagaa

SEQ ID NO: 1601858 - DNA, 17 bp, Homo sapiens
aaaatgacagatgttga

SEQ ID NO: 1601859 - DNA, 19 bp, Homo sapiens
aaaatgagagctgtaactg

SEQ ID NO: 1601860 - DNA, 18 bp, Homo sapiens
aaaatgagcatacatctt

SEQ ID NO: 1601861 - DNA, 23 bp, Homo sapiens
aaaatgagctcgcatttgtcaat

SEQ ID NO: 1601862 - DNA, 16 bp, Homo sapiens
aaaatgagcttgatta

SEQ ID NO: 1601863 - DNA, 18 bp, Homo sapiens
aaaatgaggttcaactgt

SEQ ID NO: 1601864 - DNA, 16 bp, Homo sapiens
aaaatgagttgtcaca

SEQ ID NO: 1601865 - DNA, 18 bp, Homo sapiens
aaaatgagttgtcacaga

SEQ ID NO: 1601866 - DNA, 16 bp, Homo sapiens
aaaatgatgttcattt

SEQ ID NO: 1601867 - DNA, 23 bp, Homo sapiens
aaaatgattcctggacatcacca

SEQ ID NO: 1601868 - DNA, 17 bp, Homo sapiens
aaaatgcaaaaaatctt

SEQ ID NO: 1601869 - DNA, 16 bp, Homo sapiens
aaaatgcatgattgca

SEQ ID NO: 1601870 - DNA, 23 bp, Homo sapiens
aaaatgcatttaaactcatttga

SEQ ID NO: 1601871 - DNA, 17 bp, Homo sapiens
aaaatgccatagtttgt

SEQ ID NO: 1601872 - DNA, 17 bp, Homo sapiens
aaaatgcccttaaatca

SEQ ID NO: 1601873 - DNA, 19 bp, Homo sapiens
aaaatgcctcaattcacat

SEQ ID NO: 1601874 - DNA, 18 bp, Homo sapiens
aaaatgctccccacagcg

SEQ ID NO: 1601875 - DNA, 17 bp, Homo sapiens
aaaatgctgacaaaaat

SEQ ID NO: 1601876 - DNA, 20 bp, Homo sapiens
aaaatgctgacaaaaatatt

SEQ ID NO: 1601877 - DNA, 22 bp, Homo sapiens
aaaatgcttaaaaaataataca

SEQ ID NO: 1601878 - DNA, 23 bp, Homo sapiens
aaaatgcttaaaaaataatacaa

SEQ ID NO: 1601879 - DNA, 11 bp, Homo sapiens
aaaatggaaaa

SEQ ID NO: 1601880 - DNA, 15 bp, Homo sapiens
aaaatggaaaaaaac

SEQ ID NO: 1601881 - DNA, 16 bp, Homo sapiens
aaaatggaaaaaaaca

SEQ ID NO: 1601882 - DNA, 18 bp, Homo sapiens
aaaatggaaaaaaacata

SEQ ID NO: 1601883 - DNA, 12 bp, Homo sapiens
aaaatggaaaga

SEQ ID NO: 1601884 - DNA, 21 bp, Homo sapiens
aaaatggatattattagaaat

SEQ ID NO: 1601885 - DNA, 15 bp, Homo sapiens
aaaatggctaataaa

SEQ ID NO: 1601886 - DNA, 19 bp, Homo sapiens
aaaatggctaataaactgt

SEQ ID NO: 1601887 - DNA, 21 bp, Homo sapiens
aaaatggctaataaactgtat

SEQ ID NO: 1601888 - DNA, 23 bp, Homo sapiens
aaaatggcttcagaattaaaact

SEQ ID NO: 1601889 - DNA, 13 bp, Homo sapiens
aaaatggtataaa

SEQ ID NO: 1601890 - DNA, 22 bp, Homo sapiens
aaaatggtccaattagtttcct

SEQ ID NO: 1601891 - DNA, 17 bp, Homo sapiens
aaaatggttgatggaaa

SEQ ID NO: 1601892 - DNA, 19 bp, Homo sapiens
aaaatggttgatggaaaat

SEQ ID NO: 1601893 - DNA, 20 bp, Homo sapiens
aaaatggttgatggaaaata

SEQ ID NO: 1601894 - DNA, 20 bp, Homo sapiens
aaaatgtaaatattctatat

SEQ ID NO: 1601895 - DNA, 12 bp, Homo sapiens
aaaatgtaacat

SEQ ID NO: 1601896 - DNA, 23 bp, Homo sapiens
aaaatgtaacatcataattacat

SEQ ID NO: 1601897 - DNA, 22 bp, Homo sapiens
aaaatgtaagattatagattct

SEQ ID NO: 1601898 - DNA, 22 bp, Homo sapiens
aaaatgtacatgtattaaatta

SEQ ID NO: 1601899 - DNA, 19 bp, Homo sapiens
aaaatgtacttaaagggtt

SEQ ID NO: 1601900 - DNA, 21 bp, Homo sapiens
aaaatgtagggttataataat

SEQ ID NO: 1601901 - DNA, 20 bp, Homo sapiens
aaaatgtataaaaattatca

SEQ ID NO: 1601902 - DNA, 18 bp, Homo sapiens
aaaatgtatgtgtaagta

SEQ ID NO: 1601903 - DNA, 16 bp, Homo sapiens
aaaatgtcaagacagg

SEQ ID NO: 1601904 - DNA, 12 bp, Homo sapiens
aaaatgtgattt

SEQ ID NO: 1601905 - DNA, 13 bp, Homo sapiens
aaaatgtgatttt

SEQ ID NO: 1601906 - DNA, 20 bp, Homo sapiens
aaaatgtgctatactgcata

SEQ ID NO: 1601907 - DNA, 12 bp, Homo sapiens
aaaatgtgtaca

SEQ ID NO: 1601908 - DNA, 21 bp, Homo sapiens
aaaatgttactccctgtttta

SEQ ID NO: 1601909 - DNA, 17 bp, Homo sapiens
aaaatgttacttatttt

SEQ ID NO: 1601910 - DNA, 14 bp, Homo sapiens
aaaatgttaggaca

SEQ ID NO: 1601911 - DNA, 21 bp, Homo sapiens
aaaatgttggtcattttatgt

SEQ ID NO: 1601912 - DNA, 22 bp, Homo sapiens
aaaggagctttctcaatgtctt

SEQ ID NO: 1601913 - DNA, 18 bp, Homo sapiens
aaaggaggcatgcctctg

SEQ ID NO: 1601914 - DNA, 22 bp, Homo sapiens
aaaggaggccctgttccctgga

SEQ ID NO: 1601915 - DNA, 14 bp, Homo sapiens
aaaggaggctggca

SEQ ID NO: 1601916 - DNA, 21 bp, Homo sapiens
aaaggatatttaagaaaatac

SEQ ID NO: 1601917 - DNA, 23 bp, Homo sapiens
aaaggatatttaagaaaatacaa

SEQ ID NO: 1601918 - DNA, 15 bp, Homo sapiens
aaaggatattttctt

SEQ ID NO: 1601919 - DNA, 17 bp, Homo sapiens
aaaggatctaagggaag

SEQ ID NO: 1601920 - DNA, 13 bp, Homo sapiens
aaaggatctgtga

SEQ ID NO: 1601921 - DNA, 14 bp, Homo sapiens
aaaggatggtggtt

SEQ ID NO: 1601922 - DNA, 18 bp, Homo sapiens
aaaggatgtataaatttt

SEQ ID NO: 1601923 - DNA, 16 bp, Homo sapiens
aaaggattttaccaaa

SEQ ID NO: 1601924 - DNA, 20 bp, Homo sapiens
aaaggattttaccaaagcat

SEQ ID NO: 1601925 - DNA, 20 bp, Homo sapiens
aaaggcaaataatggaaaaa

SEQ ID NO: 1601926 - DNA, 16 bp, Homo sapiens
aaaggcaaatattgaa

SEQ ID NO: 1601927 - DNA, 20 bp, Homo sapiens
aaaggcagccctcacctctg

SEQ ID NO: 1601928 - DNA, 14 bp, Homo sapiens
aaaggcagctaaga

SEQ ID NO: 1601929 - DNA, 20 bp, Homo sapiens
aaaggcagctaagatagaaa

SEQ ID NO: 1601930 - DNA, 16 bp, Homo sapiens
aaacactgaaaagaag

SEQ ID NO: 1601931 - DNA, 17 bp, Homo sapiens
aaacactgcctttttat

SEQ ID NO: 1601932 - DNA, 13 bp, Homo sapiens
aaacacttagtat

SEQ ID NO: 1601933 - DNA, 21 bp, Homo sapiens
aaacacttatcttctggatta

SEQ ID NO: 1601934 - DNA, 17 bp, Homo sapiens
aaacacttctgctttca

SEQ ID NO: 1601935 - DNA, 19 bp, Homo sapiens
aaacacttggcatacaaaa

SEQ ID NO: 1601936 - DNA, 21 bp, Homo sapiens
aaacacttggcatacaaaata

SEQ ID NO: 1601937 - DNA, 23 bp, Homo sapiens
aaacacttggcatacaaaatatt

SEQ ID NO: 1601938 - DNA, 14 bp, Homo sapiens
aaacagaacactta

SEQ ID NO: 1601939 - DNA, 13 bp, Homo sapiens
aaacagaacatca

SEQ ID NO: 1601940 - DNA, 13 bp, Homo sapiens
aaacagaatttga

SEQ ID NO: 1601941 - DNA, 16 bp, Homo sapiens
aaacagacaaaaacaa

SEQ ID NO: 1601942 - DNA, 16 bp, Homo sapiens
aaacagacaatatgtg

SEQ ID NO: 1601943 - DNA, 15 bp, Homo sapiens
aaacagagacaggcc

SEQ ID NO: 1601944 - DNA, 22 bp, Homo sapiens
aaacagagacaggcccaagaga

SEQ ID NO: 1601945 - DNA, 18 bp, Homo sapiens
aaacagagtggcctccct

SEQ ID NO: 1601946 - DNA, 20 bp, Homo sapiens
aaacagatgtaatgggaaga

SEQ ID NO: 1601947 - DNA, 21 bp, Homo sapiens
aaacagattcaggccagccca

SEQ ID NO: 1601948 - DNA, 14 bp, Homo sapiens
aaacagatttttac

SEQ ID NO: 1601949 - DNA, 16 bp, Homo sapiens
aaacagcattgctttc

SEQ ID NO: 1601950 - DNA, 22 bp, Homo sapiens
aaacagccgtcagccaaatgta

SEQ ID NO: 1601951 - DNA, 16 bp, Homo sapiens
aaacagcgtcttcctt

SEQ ID NO: 1601952 - DNA, 11 bp, Homo sapiens
aaacagctcag

SEQ ID NO: 1601953 - DNA, 17 bp, Homo sapiens
aaacagctcagccagtg

SEQ ID NO: 1601954 - DNA, 14 bp, Homo sapiens
aaacagctgcctct

SEQ ID NO: 1601955 - DNA, 20 bp, Homo sapiens
aaacagcttcatgcctttgt

SEQ ID NO: 1601956 - DNA, 21 bp, Homo sapiens
aaacagcttcatgcctttgta

SEQ ID NO: 1601957 - DNA, 12 bp, Homo sapiens
aaacagctttca

SEQ ID NO: 1601958 - DNA, 18 bp, Homo sapiens
aaacagctttcaagtgcc

SEQ ID NO: 1601959 - DNA, 19 bp, Homo sapiens
aaacagctttcaagtgcct

SEQ ID NO: 1601960 - DNA, 14 bp, Homo sapiens
aaacaggaatttta

SEQ ID NO: 1601961 - DNA, 16 bp, Homo sapiens
aaacaggaattttatt

SEQ ID NO: 1601962 - DNA, 21 bp, Homo sapiens
aaacaggacttaaaatgacat

SEQ ID NO: 1601963 - DNA, 20 bp, Homo sapiens
aaagaacatggacttgtata

SEQ ID NO: 1601964 - DNA, 14 bp, Homo sapiens
aaagaaccaaaact

SEQ ID NO: 1601965 - DNA, 12 bp, Homo sapiens
aaagaacttact

SEQ ID NO: 1601966 - DNA, 19 bp, Homo sapiens
aaagaacttgctgctgcct

SEQ ID NO: 1601967 - DNA, 17 bp, Homo sapiens
aaagaagaacttgcatg

SEQ ID NO: 1601968 - DNA, 19 bp, Homo sapiens
aaagaagacaacattaaaa

SEQ ID NO: 1601969 - DNA, 13 bp, Homo sapiens
aaagaagagaagt

SEQ ID NO: 1601970 - DNA, 22 bp, Homo sapiens
aaagaagagcgagagatcaaag

SEQ ID NO: 1601971 - DNA, 14 bp, Homo sapiens
aaagaagcaagaca

SEQ ID NO: 1601972 - DNA, 12 bp, Homo sapiens
aaagaagccaca

SEQ ID NO: 1601973 - DNA, 18 bp, Homo sapiens
aaagaagccacagctctt

SEQ ID NO: 1601974 - DNA, 19 bp, Homo sapiens
aaagaagcttccacaaaat

SEQ ID NO: 1601975 - DNA, 13 bp, Homo sapiens
aaagaaggtgctg

SEQ ID NO: 1601976 - DNA, 19 bp, Homo sapiens
aaagaaggtgctgatccta

SEQ ID NO: 1601977 - DNA, 19 bp, Homo sapiens
aaagaagtgtccgagaact

SEQ ID NO: 1601978 - DNA, 21 bp, Homo sapiens
aaagaagtgtccgagaactaa

SEQ ID NO: 1601979 - DNA, 12 bp, Homo sapiens
aaagaatctact

SEQ ID NO: 1601980 - DNA, 20 bp, Homo sapiens
aaagaattacttgtgttact

SEQ ID NO: 1601981 - DNA, 22 bp, Homo sapiens
aaagaattatttttgtgtttct

SEQ ID NO: 1601982 - DNA, 23 bp, Homo sapiens
aaagaattatttttgtgtttcta

SEQ ID NO: 1601983 - DNA, 13 bp, Homo sapiens
aaagaattttcat

SEQ ID NO: 1601984 - DNA, 17 bp, Homo sapiens
aaagacaaagtgtgtaa

SEQ ID NO: 1601985 - DNA, 22 bp, Homo sapiens
aaagacaaattctgtttcttga

SEQ ID NO: 1601986 - DNA, 15 bp, Homo sapiens
aaagacaacaaaaga

SEQ ID NO: 1601987 - DNA, 22 bp, Homo sapiens
aaagacaagtatgaatattact

SEQ ID NO: 1601988 - DNA, 17 bp, Homo sapiens
aaagacaatcactgcca

SEQ ID NO: 1601989 - DNA, 12 bp, Homo sapiens
aaagacactgcc

SEQ ID NO: 1601990 - DNA, 14 bp, Homo sapiens
aaagacatcaatga

SEQ ID NO: 1601991 - DNA, 21 bp, Homo sapiens
aaagacatcagtctccaacat

SEQ ID NO: 1601992 - DNA, 15 bp, Homo sapiens
aaagaccaagacttt

SEQ ID NO: 1601993 - DNA, 13 bp, Homo sapiens
aaagaccagggct

SEQ ID NO: 1601994 - DNA, 15 bp, Homo sapiens
aaagacccaggggga

SEQ ID NO: 1601995 - DNA, 16 bp, Homo sapiens
aaagacccagggggag

SEQ ID NO: 1601996 - DNA, 20 bp, Homo sapiens
aaagaccctaaatctgagga

SEQ ID NO: 1601997 - DNA, 22 bp, Homo sapiens
aaagaccctcctattctataaa

SEQ ID NO: 1601998 - DNA, 19 bp, Homo sapiens
aaagacgatttgtcagtta

SEQ ID NO: 1601999 - DNA, 18 bp, Homo sapiens
aaagactattcaaacagt

SEQ ID NO: 1602000 - DNA, 15 bp, Homo sapiens
aaagactccaaagaa

SEQ ID NO: 1602001 - DNA, 16 bp, Homo sapiens
aaagactgaacatgtt

SEQ ID NO: 1602002 - DNA, 17 bp, Homo sapiens
aaagactgaacatgttt

SEQ ID NO: 1602003 - DNA, 15 bp, Homo sapiens
aaagactgcagaacc

SEQ ID NO: 1602004 - DNA, 13 bp, Homo sapiens
aaagactgcagct

SEQ ID NO: 1602005 - DNA, 16 bp, Homo sapiens
aaagactgcagctgct

SEQ ID NO: 1602006 - DNA, 14 bp, Homo sapiens
aaagactgtacaaa

SEQ ID NO: 1602007 - DNA, 18 bp, Homo sapiens
aaagacttggttggtagg

SEQ ID NO: 1602008 - DNA, 15 bp, Homo sapiens
aaagagaaaccgagg

SEQ ID NO: 1602009 - DNA, 12 bp, Homo sapiens
aaagagaatgag

SEQ ID NO: 1602010 - DNA, 14 bp, Homo sapiens
aaagagaccagcac

SEQ ID NO: 1602011 - DNA, 18 bp, Homo sapiens
aaagagagaaacactgaa

SEQ ID NO: 1602012 - DNA, 13 bp, Homo sapiens
aaagagagaagcc

SEQ ID NO: 1602013 - DNA, 20 bp, Homo sapiens
aaagagagaagccagccaca

SEQ ID NO: 1602014 - DNA, 16 bp, Homo sapiens
aaagagagaagggaga

SEQ ID NO: 1602015 - DNA, 19 bp, Homo sapiens
aaagagagttaaaagcagc

SEQ ID NO: 1602016 - DNA, 13 bp, Homo sapiens
aaagagattcgaa

SEQ ID NO: 1602017 - DNA, 21 bp, Homo sapiens
aaagagatttaaactctgaat

SEQ ID NO: 1602018 - DNA, 13 bp, Homo sapiens
aaagagatttcaa

SEQ ID NO: 1602019 - DNA, 15 bp, Homo sapiens
aaagagcaagtctgg

SEQ ID NO: 1602020 - DNA, 22 bp, Homo sapiens
aaagagccactttcaagctgca

SEQ ID NO: 1602021 - DNA, 20 bp, Homo sapiens
aaagagctcagacattttct

SEQ ID NO: 1602022 - DNA, 16 bp, Homo sapiens
aaagaggagaccctgg

SEQ ID NO: 1602023 - DNA, 18 bp, Homo sapiens
aaagaggcgtctgtatat

SEQ ID NO: 1602024 - DNA, 14 bp, Homo sapiens
aaagaggctgcccc

SEQ ID NO: 1602025 - DNA, 18 bp, Homo sapiens
aaagaggctgcccctctc

SEQ ID NO: 1602026 - DNA, 19 bp, Homo sapiens
aaagagggcttcctctaga

SEQ ID NO: 1602027 - DNA, 15 bp, Homo sapiens
aaagaggttacttta

SEQ ID NO: 1602028 - DNA, 23 bp, Homo sapiens
aaagaggttactttagttagcat

SEQ ID NO: 1602029 - DNA, 18 bp, Homo sapiens
aaagagtaatttcattta

SEQ ID NO: 1602030 - DNA, 15 bp, Homo sapiens
aaagagtctagattc

SEQ ID NO: 1602031 - DNA, 23 bp, Homo sapiens
aaagagtgaatgccatttagaat

SEQ ID NO: 1602032 - DNA, 21 bp, Homo sapiens
aaagagttgggtgtctcctta

SEQ ID NO: 1602033 - DNA, 15 bp, Homo sapiens
aaagataaagatgat

SEQ ID NO: 1602034 - DNA, 20 bp, Homo sapiens
aaagataacaagatctttca

SEQ ID NO: 1602035 - DNA, 15 bp, Homo sapiens
aaagatagatatcca

SEQ ID NO: 1602036 - DNA, 20 bp, Homo sapiens
aaagatagtgctgaaagaat

SEQ ID NO: 1602037 - DNA, 14 bp, Homo sapiens
aaagatcaaaataa

SEQ ID NO: 1602038 - DNA, 15 bp, Homo sapiens
aaagatcaaaataaa

SEQ ID NO: 1602039 - DNA, 17 bp, Homo sapiens
aaagatcaaaataaaaa

SEQ ID NO: 1602040 - DNA, 20 bp, Homo sapiens
aaagatcaaaataaaaagtg

SEQ ID NO: 1602041 - DNA, 16 bp, Homo sapiens
aaagatcaccttgtat

SEQ ID NO: 1602042 - DNA, 13 bp, Homo sapiens
aaagatcccaaat

SEQ ID NO: 1602043 - DNA, 17 bp, Homo sapiens
aaagatctctagagttt

SEQ ID NO: 1602044 - DNA, 13 bp, Homo sapiens
aaagatgaaaata

SEQ ID NO: 1602045 - DNA, 12 bp, Homo sapiens
aaagatgaagtt

SEQ ID NO: 1602046 - DNA, 22 bp, Homo sapiens
aaagatgacctgtggtaagcaa

SEQ ID NO: 1602047 - DNA, 20 bp, Homo sapiens
aaagatgcaaggaccaggac

SEQ ID NO: 1602048 - DNA, 15 bp, Homo sapiens
aaagatgcattttga

SEQ ID NO: 1602049 - DNA, 18 bp, Homo sapiens
aaagatggagtttctaag

SEQ ID NO: 1602050 - DNA, 23 bp, Homo sapiens
aaagatggtgtgggtgtcctgcc

SEQ ID NO: 1602051 - DNA, 22 bp, Homo sapiens
aaagatggttgtagcatttaaa

SEQ ID NO: 1602052 - DNA, 14 bp, Homo sapiens
aaagatgtgaaaac

SEQ ID NO: 1602053 - DNA, 21 bp, Homo sapiens
aaagatgttccagtgaggaac

SEQ ID NO: 1602054 - DNA, 12 bp, Homo sapiens
aaatctgtcctc

SEQ ID NO: 1602055 - DNA, 20 bp, Homo sapiens
aaatctgtctgattctatgc

SEQ ID NO: 1602056 - DNA, 19 bp, Homo sapiens
aaatctgtgatgatcctca

SEQ ID NO: 1602057 - DNA, 18 bp, Homo sapiens
aaatctgtttgatccctg

SEQ ID NO: 1602058 - DNA, 19 bp, Homo sapiens
aaatctgtttgatccctgt

SEQ ID NO: 1602059 - DNA, 21 bp, Homo sapiens
aaatcttaaacaatgtataaa

SEQ ID NO: 1602060 - DNA, 16 bp, Homo sapiens
aaatcttaatactgtt

SEQ ID NO: 1602061 - DNA, 23 bp, Homo sapiens
aaatcttaatactgttattcttt

SEQ ID NO: 1602062 - DNA, 22 bp, Homo sapiens
aaatcttaatgaatgagtctgt

SEQ ID NO: 1602063 - DNA, 15 bp, Homo sapiens
aaatcttccttgtga

SEQ ID NO: 1602064 - DNA, 17 bp, Homo sapiens
aaatcttgtcatgtgta

SEQ ID NO: 1602065 - DNA, 18 bp, Homo sapiens
aaatcttgtcatgtgtat

SEQ ID NO: 1602066 - DNA, 20 bp, Homo sapiens
aaatcttgtcatgtgtataa

SEQ ID NO: 1602067 - DNA, 14 bp, Homo sapiens
aaatcttgttaatg

SEQ ID NO: 1602068 - DNA, 22 bp, Homo sapiens
aaatcttgttaatgtcattgct

SEQ ID NO: 1602069 - DNA, 22 bp, Homo sapiens
aaatcttttaaaaattcaaatg

SEQ ID NO: 1602070 - DNA, 17 bp, Homo sapiens
aaatcttttgaagcata

SEQ ID NO: 1602071 - DNA, 15 bp, Homo sapiens
aaatctttttgcttc

SEQ ID NO: 1602072 - DNA, 18 bp, Homo sapiens
aaatgaaaacatgtaata

SEQ ID NO: 1602073 - DNA, 21 bp, Homo sapiens
aaatgaaacaaataatcacat

SEQ ID NO: 1602074 - DNA, 16 bp, Homo sapiens
aaatgaaactttcttt

SEQ ID NO: 1602075 - DNA, 14 bp, Homo sapiens
aaatgaaagaaaat

SEQ ID NO: 1602076 - DNA, 15 bp, Homo sapiens
aaatgaaagaaaatt

SEQ ID NO: 1602077 - DNA, 14 bp, Homo sapiens
aaatgaaagctact

SEQ ID NO: 1602078 - DNA, 17 bp, Homo sapiens
aaatgaatgaataacta

SEQ ID NO: 1602079 - DNA, 14 bp, Homo sapiens
aaatgaatgtctga

SEQ ID NO: 1602080 - DNA, 17 bp, Homo sapiens
aaatgaattgaaaaaca

SEQ ID NO: 1602081 - DNA, 14 bp, Homo sapiens
aaatgacaacagaa

SEQ ID NO: 1602082 - DNA, 18 bp, Homo sapiens
aaatgacactttataact

SEQ ID NO: 1602083 - DNA, 17 bp, Homo sapiens
aaatgacagatttctgt

SEQ ID NO: 1602084 - DNA, 14 bp, Homo sapiens
aaatgaccaaagat

SEQ ID NO: 1602085 - DNA, 19 bp, Homo sapiens
aaatgaccactcttttaat

SEQ ID NO: 1602086 - DNA, 20 bp, Homo sapiens
aaatgaccgagccctggaga

SEQ ID NO: 1602087 - DNA, 22 bp, Homo sapiens
aaatgaccgagccctggagagc

SEQ ID NO: 1602088 - DNA, 22 bp, Homo sapiens
aaatgactaaaaaacaaagaag

SEQ ID NO: 1602089 - DNA, 20 bp, Homo sapiens
aaatgactaaaaatattata

SEQ ID NO: 1602090 - DNA, 15 bp, Homo sapiens
aaatgacttttctta

SEQ ID NO: 1602091 - DNA, 14 bp, Homo sapiens
aaatgagctcctgc

SEQ ID NO: 1602092 - DNA, 23 bp, Homo sapiens
aaatgagctcgcatttgtcaatg

SEQ ID NO: 1602093 - DNA, 18 bp, Homo sapiens
aaatgagggctgcacatt

SEQ ID NO: 1602094 - DNA, 16 bp, Homo sapiens
aaatgaggtactctcc

SEQ ID NO: 1602095 - DNA, 12 bp, Homo sapiens
aaatgagtaaca

SEQ ID NO: 1602096 - DNA, 18 bp, Homo sapiens
aaatgagtgtgtttgtca

SEQ ID NO: 1602097 - DNA, 20 bp, Homo sapiens
aaatgagtttaaaaaaataa

SEQ ID NO: 1602098 - DNA, 14 bp, Homo sapiens
aaatgataaatgta

SEQ ID NO: 1602099 - DNA, 18 bp, Homo sapiens
aaatgatagaactgtact

SEQ ID NO: 1602100 - DNA, 20 bp, Homo sapiens
aaatgatctgagtcccagga

SEQ ID NO: 1602101 - DNA, 17 bp, Homo sapiens
aaatgatggggagtgag

SEQ ID NO: 1602102 - DNA, 19 bp, Homo sapiens
aaatgattatattcacaga

SEQ ID NO: 1602103 - DNA, 20 bp, Homo sapiens
aaatgattcaaattgctgct

SEQ ID NO: 1602104 - DNA, 22 bp, Homo sapiens
aaatgcaaaaaatcttaatact

SEQ ID NO: 1602105 - DNA, 19 bp, Homo sapiens
aaatgcaaaaactctttga

SEQ ID NO: 1602106 - DNA, 15 bp, Homo sapiens
aaatgcaaaaatctc

SEQ ID NO: 1602107 - DNA, 16 bp, Homo sapiens
aaatgcaaaaatctct

SEQ ID NO: 1602108 - DNA, 21 bp, Homo sapiens
aaatgcaaacacacaaaggta

SEQ ID NO: 1602109 - DNA, 15 bp, Homo sapiens
aaatgcaaagctgaa

SEQ ID NO: 1602110 - DNA, 20 bp, Homo sapiens
aaatgcaacagtttttaaaa

SEQ ID NO: 1602111 - DNA, 14 bp, Homo sapiens
aaatgcaagatttt

SEQ ID NO: 1602112 - DNA, 12 bp, Homo sapiens
aaatgcaataac

SEQ ID NO: 1602113 - DNA, 15 bp, Homo sapiens
aaatgcaataactct

SEQ ID NO: 1602114 - DNA, 14 bp, Homo sapiens
aaatgcaatattaa

SEQ ID NO: 1602115 - DNA, 17 bp, Homo sapiens
aaatgcaatattaatgc

SEQ ID NO: 1602116 - DNA, 18 bp, Homo sapiens
aaatgcaccaagaaagct

SEQ ID NO: 1602117 - DNA, 17 bp, Homo sapiens
aaatgcagaatacttga

SEQ ID NO: 1602118 - DNA, 21 bp, Homo sapiens
aaatgcagggaggggaggcag

SEQ ID NO: 1602119 - DNA, 22 bp, Homo sapiens
aaatgcagggaggggaggcaga

SEQ ID NO: 1602120 - DNA, 16 bp, Homo sapiens
aaatgcaggtgaactt

SEQ ID NO: 1602121 - DNA, 15 bp, Homo sapiens
aaatgcataaatgca

SEQ ID NO: 1602122 - DNA, 19 bp, Homo sapiens
aaatgcatatcctgagcca

SEQ ID NO: 1602123 - DNA, 16 bp, Homo sapiens
aaatgcatccattcct

SEQ ID NO: 1602124 - DNA, 18 bp, Homo sapiens
aaatgcatgattgcagaa

SEQ ID NO: 1602125 - DNA, 21 bp, Homo sapiens
aaatgcatgattgcagaattg

SEQ ID NO: 1602126 - DNA, 20 bp, Homo sapiens
aaatgcattataggatcatt

SEQ ID NO: 1602127 - DNA, 15 bp, Homo sapiens
aaatgcattgaacat

SEQ ID NO: 1602128 - DNA, 20 bp, Homo sapiens
aaatgccaagggggtgactg

SEQ ID NO: 1602129 - DNA, 12 bp, Homo sapiens
aaatgccagagc

SEQ ID NO: 1602130 - DNA, 14 bp, Homo sapiens
aaatgccagagcca

SEQ ID NO: 1602131 - DNA, 18 bp, Homo sapiens
aaatgccatagtttgtga

SEQ ID NO: 1602132 - DNA, 19 bp, Homo sapiens
aaatgccatttatttattg

SEQ ID NO: 1602133 - DNA, 20 bp, Homo sapiens
aaatgccatttatttattga

SEQ ID NO: 1602134 - DNA, 13 bp, Homo sapiens
aaatgccctcttc

SEQ ID NO: 1602135 - DNA, 17 bp, Homo sapiens
aaatgcctcttaaatta

SEQ ID NO: 1602136 - DNA, 20 bp, Homo sapiens
aaatgccttgcttgtatgat

SEQ ID NO: 1602137 - DNA, 14 bp, Homo sapiens
aaatgccttgtata

SEQ ID NO: 1602138 - DNA, 14 bp, Homo sapiens
aaatgctaatgtaa

SEQ ID NO: 1602139 - DNA, 13 bp, Homo sapiens
aaatgctcttgtc

SEQ ID NO: 1602140 - DNA, 17 bp, Homo sapiens
aaatgctgaaaattgcc

SEQ ID NO: 1602141 - DNA, 13 bp, Homo sapiens
aaatgcttaaaaa

SEQ ID NO: 1602142 - DNA, 12 bp, Homo sapiens
aaatggaaaaaa

SEQ ID NO: 1602143 - DNA, 20 bp, Homo sapiens
aaatggaaaaaaattacaag

SEQ ID NO: 1602144 - DNA, 13 bp, Homo sapiens
aaatggaaactat

SEQ ID NO: 1602145 - DNA, 21 bp, Homo sapiens
aaatggaaagcagagttttca

SEQ ID NO: 1602146 - DNA, 16 bp, Homo sapiens
aaatggacactgtgcc

SEQ ID NO: 1602147 - DNA, 16 bp, Homo sapiens
aaatggagaagctctg

SEQ ID NO: 1602148 - DNA, 14 bp, Homo sapiens
aaatggattaatta

SEQ ID NO: 1602149 - DNA, 22 bp, Homo sapiens
aaatggccatttgctttttcac

SEQ ID NO: 1602150 - DNA, 22 bp, Homo sapiens
aaatggcctcatgtggctggaa

SEQ ID NO: 1602151 - DNA, 17 bp, Homo sapiens
aaatggctggtttttag

SEQ ID NO: 1602152 - DNA, 16 bp, Homo sapiens
aaatgggaaatagtct

SEQ ID NO: 1602153 - DNA, 21 bp, Homo sapiens
aaatgggaattctcaggtagg

SEQ ID NO: 1602154 - DNA, 19 bp, Homo sapiens
aaatgggactgatgtcatc

SEQ ID NO: 1602155 - DNA, 17 bp, Homo sapiens
aaatgggagacagcctc

SEQ ID NO: 1602156 - DNA, 14 bp, Homo sapiens
aaatgggagccagg

SEQ ID NO: 1602157 - DNA, 15 bp, Homo sapiens
aaatgggagccagga

SEQ ID NO: 1602158 - DNA, 18 bp, Homo sapiens
aaatgggtcatgacaaga

SEQ ID NO: 1602159 - DNA, 20 bp, Homo sapiens
aaatggtgtacataatgtat

SEQ ID NO: 1602160 - DNA, 14 bp, Homo sapiens
aaatggttgatgga

SEQ ID NO: 1602161 - DNA, 15 bp, Homo sapiens
aaatggttgatggaa

SEQ ID NO: 1602162 - DNA, 21 bp, Homo sapiens
aaatggttgatggaaaataaa

SEQ ID NO: 1602163 - DNA, 18 bp, Homo sapiens
aaatggttgtcacctctc

SEQ ID NO: 1602164 - DNA, 17 bp, Homo sapiens
aaatggtttcctctgga

SEQ ID NO: 1602165 - DNA, 15 bp, Homo sapiens
aaatgtaaaggaggg

SEQ ID NO: 1602166 - DNA, 17 bp, Homo sapiens
aaatgtaaatattctat

SEQ ID NO: 1602167 - DNA, 18 bp, Homo sapiens
aaatgtaactgtgccagt

SEQ ID NO: 1602168 - DNA, 23 bp, Homo sapiens
aaatgtaactgtgccagttcttt

SEQ ID NO: 1602169 - DNA, 18 bp, Homo sapiens
aaatgtaacttttgtaag

SEQ ID NO: 1602170 - DNA, 22 bp, Homo sapiens
aaatgtaagattatagattcta

SEQ ID NO: 1602171 - DNA, 15 bp, Homo sapiens
aaatacaaaaaatta

SEQ ID NO: 1602172 - DNA, 16 bp, Homo sapiens
aaatacaacacatcta

SEQ ID NO: 1602173 - DNA, 18 bp, Homo sapiens
aaatacaacacatctaat

SEQ ID NO: 1602174 - DNA, 14 bp, Homo sapiens
aaatacaataaact

SEQ ID NO: 1602175 - DNA, 16 bp, Homo sapiens
aaatacaatttgtact

SEQ ID NO: 1602176 - DNA, 19 bp, Homo sapiens
aaatacacactcaaatcaa

SEQ ID NO: 1602177 - DNA, 13 bp, Homo sapiens
aaatacacatttg

SEQ ID NO: 1602178 - DNA, 17 bp, Homo sapiens
aaatacagatagatata

SEQ ID NO: 1602179 - DNA, 17 bp, Homo sapiens
aaatacagctgcactga

SEQ ID NO: 1602180 - DNA, 19 bp, Homo sapiens
aaatacataaaaaagtgtt

SEQ ID NO: 1602181 - DNA, 17 bp, Homo sapiens
aaatacatagtgaaaat

SEQ ID NO: 1602182 - DNA, 14 bp, Homo sapiens
aaatacatgcatct

SEQ ID NO: 1602183 - DNA, 21 bp, Homo sapiens
aaagtgcttcaagggtaatct

SEQ ID NO: 1602184 - DNA, 19 bp, Homo sapiens
aaagtggcaagaccaaaat

SEQ ID NO: 1602185 - DNA, 22 bp, Homo sapiens
aaagtggcgtgggagccagcct

SEQ ID NO: 1602186 - DNA, 16 bp, Homo sapiens
aaagtggctgcggtgt

SEQ ID NO: 1602187 - DNA, 17 bp, Homo sapiens
aaagtggtacaggaagg

SEQ ID NO: 1602188 - DNA, 14 bp, Homo sapiens
aaagtggttgttag

SEQ ID NO: 1602189 - DNA, 15 bp, Homo sapiens
aaagtgtaacagata

SEQ ID NO: 1602190 - DNA, 17 bp, Homo sapiens
aaagtgtatatttattc

SEQ ID NO: 1602191 - DNA, 22 bp, Homo sapiens
aaagtgtatttggaaataaagt

SEQ ID NO: 1602192 - DNA, 23 bp, Homo sapiens
aaagtgtatttggaaataaagtc

SEQ ID NO: 1602193 - DNA, 14 bp, Homo sapiens
aaagtgtctcaaag

SEQ ID NO: 1602194 - DNA, 18 bp, Homo sapiens
aaagtgtctcaaaggagc

SEQ ID NO: 1602195 - DNA, 14 bp, Homo sapiens
aaagtgttactttt

SEQ ID NO: 1602196 - DNA, 23 bp, Homo sapiens
aaagtgttgtgttcctggctgat

SEQ ID NO: 1602197 - DNA, 16 bp, Homo sapiens
aaagttaaacattgaa

SEQ ID NO: 1602198 - DNA, 22 bp, Homo sapiens
aacactgtccttccctgccact

SEQ ID NO: 1602199 - DNA, 15 bp, Homo sapiens
aacactgtgaccagg

SEQ ID NO: 1602200 - DNA, 15 bp, Homo sapiens
aacactgtgccctgg

SEQ ID NO: 1602201 - DNA, 16 bp, Homo sapiens
aacactgtgccctggt

SEQ ID NO: 1602202 - DNA, 21 bp, Homo sapiens
aacactgtgccctggtggaga

SEQ ID NO: 1602203 - DNA, 18 bp, Homo sapiens
aacacttggcatacaaaa

SEQ ID NO: 1602204 - DNA, 20 bp, Homo sapiens
aacacttggcatacaaaata

SEQ ID NO: 1602205 - DNA, 21 bp, Homo sapiens
aacacttggcatacaaaatat

SEQ ID NO: 1602206 - DNA, 21 bp, Homo sapiens
aacacttgtgacttttgcttt

SEQ ID NO: 1602207 - DNA, 22 bp, Homo sapiens
aacacttgtgacttttgcttta

SEQ ID NO: 1602208 - DNA, 18 bp, Homo sapiens
aacactttgtattactta

SEQ ID NO: 1602209 - DNA, 14 bp, Homo sapiens
aacagaaatggaaa

SEQ ID NO: 1602210 - DNA, 18 bp, Homo sapiens
aacagaaattgtatattg

SEQ ID NO: 1602211 - DNA, 19 bp, Homo sapiens
aacagaaattgtatattgt

SEQ ID NO: 1602212 - DNA, 21 bp, Homo sapiens
aacagaaattgtatattgtaa

SEQ ID NO: 1602213 - DNA, 13 bp, Homo sapiens
aacagaacactta

SEQ ID NO: 1602214 - DNA, 14 bp, Homo sapiens
aacagaagcagcaa

SEQ ID NO: 1602215 - DNA, 13 bp, Homo sapiens
aacagaaggatga

SEQ ID NO: 1602216 - DNA, 15 bp, Homo sapiens
aacagaatcttctgg

SEQ ID NO: 1602217 - DNA, 14 bp, Homo sapiens
aacagaatgtttta

SEQ ID NO: 1602218 - DNA, 21 bp, Homo sapiens
aacagacaaaaacagcctcac

SEQ ID NO: 1602219 - DNA, 17 bp, Homo sapiens
aacagacaagtgactgt

SEQ ID NO: 1602220 - DNA, 21 bp, Homo sapiens
aacagacaatatgtgagtgcc

SEQ ID NO: 1602221 - DNA, 14 bp, Homo sapiens
aacagacaggagaa

SEQ ID NO: 1602222 - DNA, 17 bp, Homo sapiens
aacagaccaatagacat

SEQ ID NO: 1602223 - DNA, 17 bp, Homo sapiens
aacagactgttgagtta

SEQ ID NO: 1602224 - DNA, 21 bp, Homo sapiens
aacagagacaagaaaggcaga

SEQ ID NO: 1602225 - DNA, 19 bp, Homo sapiens
aacagagactgaatagata

SEQ ID NO: 1602226 - DNA, 20 bp, Homo sapiens
aacagagccattcccttgga

SEQ ID NO: 1602227 - DNA, 15 bp, Homo sapiens
aacagagctactgag

SEQ ID NO: 1602228 - DNA, 17 bp, Homo sapiens
aacagaggccatggcag

SEQ ID NO: 1602229 - DNA, 23 bp, Homo sapiens
aacagaggcctcccccagccagg

SEQ ID NO: 1602230 - DNA, 19 bp, Homo sapiens
aacagagggctgcattcga

SEQ ID NO: 1602231 - DNA, 18 bp, Homo sapiens
aacagagtggcctccctg

SEQ ID NO: 1602232 - DNA, 19 bp, Homo sapiens
aacagagtggcctccctgc

SEQ ID NO: 1602233 - DNA, 14 bp, Homo sapiens
aacagataaagatt

SEQ ID NO: 1602234 - DNA, 19 bp, Homo sapiens
aacagataagcaagagaga

SEQ ID NO: 1602235 - DNA, 23 bp, Homo sapiens
aacagatgcaatgtgctactgat

SEQ ID NO: 1602236 - DNA, 22 bp, Homo sapiens
aacagatggggtctgtgactgg

SEQ ID NO: 1602237 - DNA, 19 bp, Homo sapiens
aacagattattaccttaca

SEQ ID NO: 1602238 - DNA, 13 bp, Homo sapiens
aacagattcagaa

SEQ ID NO: 1602239 - DNA, 23 bp, Homo sapiens
aacagattcaggccagcccagcc

SEQ ID NO: 1602240 - DNA, 16 bp, Homo sapiens
aacagattttggggtt

SEQ ID NO: 1602241 - DNA, 20 bp, Homo sapiens
aacagcaaatgcaaaaactc

SEQ ID NO: 1602242 - DNA, 13 bp, Homo sapiens
aacagcaactaca

SEQ ID NO: 1602243 - DNA, 17 bp, Homo sapiens
aacagcagaggttcttt

SEQ ID NO: 1602244 - DNA, 21 bp, Homo sapiens
aacagcagaggttcttttaaa

SEQ ID NO: 1602245 - DNA, 14 bp, Homo sapiens
aacagcagctcata

SEQ ID NO: 1602246 - DNA, 12 bp, Homo sapiens
aacagcagtctc

SEQ ID NO: 1602247 - DNA, 23 bp, Homo sapiens
aacagcagtctccttcagcacgg

SEQ ID NO: 1602248 - DNA, 19 bp, Homo sapiens
aacagcagtgatctcaggg

SEQ ID NO: 1602249 - DNA, 18 bp, Homo sapiens
aacagcatgaataaaaca

SEQ ID NO: 1602250 - DNA, 19 bp, Homo sapiens
aacagcatgaataaaacac

SEQ ID NO: 1602251 - DNA, 17 bp, Homo sapiens
aacagcatgctgctttg

SEQ ID NO: 1602252 - DNA, 19 bp, Homo sapiens
aacagcatgctgctttgcc

SEQ ID NO: 1602253 - DNA, 17 bp, Homo sapiens
aacagcatgtctactgc

SEQ ID NO: 1602254 - DNA, 17 bp, Homo sapiens
aacagcattgctttctg

SEQ ID NO: 1602255 - DNA, 17 bp, Homo sapiens
aacagccctcctctgca

SEQ ID NO: 1602256 - DNA, 22 bp, Homo sapiens
aacagccgtcagccaaatgtaa

SEQ ID NO: 1602257 - DNA, 13 bp, Homo sapiens
aacagcctcacag

SEQ ID NO: 1602258 - DNA, 16 bp, Homo sapiens
aacagcgtggcttaga

SEQ ID NO: 1602259 - DNA, 14 bp, Homo sapiens
aacagctcagccag

SEQ ID NO: 1602260 - DNA, 15 bp, Homo sapiens
aacagctcagccagt

SEQ ID NO: 1602261 - DNA, 19 bp, Homo sapiens
aacagctgaggtctcttga

SEQ ID NO: 1602262 - DNA, 20 bp, Homo sapiens
aacagctgaggtctcttgag

SEQ ID NO: 1602263 - DNA, 21 bp, Homo sapiens
aacagctgaggtctcttgagg

SEQ ID NO: 1602264 - DNA, 13 bp, Homo sapiens
aacagctgcctct

SEQ ID NO: 1602265 - DNA, 16 bp, Homo sapiens
aacagctgtgtctgcc

SEQ ID NO: 1602266 - DNA, 23 bp, Homo sapiens
aacagctgtgtctgccaaacaca

SEQ ID NO: 1602267 - DNA, 15 bp, Homo sapiens
aacagcttgctgtca

SEQ ID NO: 1602268 - DNA, 16 bp, Homo sapiens
aacaggaatctcagag

SEQ ID NO: 1602269 - DNA, 19 bp, Homo sapiens
aacaggaatctcagagaca

SEQ ID NO: 1602270 - DNA, 18 bp, Homo sapiens
aacaggaattttattttg

SEQ ID NO: 1602271 - DNA, 16 bp, Homo sapiens
aacaggcaaagtttta

SEQ ID NO: 1602272 - DNA, 24 bp, Homo sapiens
aacagggacttgtttagagagcct

SEQ ID NO: 1602273 - DNA, 14 bp, Homo sapiens
aacagggagactgc

SEQ ID NO: 1602274 - DNA, 22 bp, Homo sapiens
aacagggagactgcatctcaaa

SEQ ID NO: 1602275 - DNA, 15 bp, Homo sapiens
aacagggagcacctg

SEQ ID NO: 1602276 - DNA, 19 bp, Homo sapiens
aacagggattgattttaaa

SEQ ID NO: 1602277 - DNA, 22 bp, Homo sapiens
aacagggattgattttaaaatg

SEQ ID NO: 1602278 - DNA, 19 bp, Homo sapiens
aacagggctatttgaagaa

SEQ ID NO: 1602279 - DNA, 17 bp, Homo sapiens
aacaggggaggaaaaaa

SEQ ID NO: 1602280 - DNA, 18 bp, Homo sapiens
aacaggggaggaaaaaag

SEQ ID NO: 1602281 - DNA, 19 bp, Homo sapiens
aacaggggaggaaaaaaga

SEQ ID NO: 1602282 - DNA, 20 bp, Homo sapiens
aacaggggaggaaaaaagaa

SEQ ID NO: 1602283 - DNA, 22 bp, Homo sapiens
aacaggtatttttttaaatcaa

SEQ ID NO: 1602284 - DNA, 15 bp, Homo sapiens
aacaggtctcctctt

SEQ ID NO: 1602285 - DNA, 17 bp, Homo sapiens
aacaggtctcctcttaa

SEQ ID NO: 1602286 - DNA, 12 bp, Homo sapiens
aacaggtgggct

SEQ ID NO: 1602287 - DNA, 19 bp, Homo sapiens
aacaggttataacagtgtt

SEQ ID NO: 1602288 - DNA, 19 bp, Homo sapiens
aacaggttgttttctactt

SEQ ID NO: 1602289 - DNA, 15 bp, Homo sapiens
aacagtaaaccactg

SEQ ID NO: 1602290 - DNA, 23 bp, Homo sapiens
aacagtaaaccactgaaaaaata

SEQ ID NO: 1602291 - DNA, 22 bp, Homo sapiens
aacagtatttctggtgtatatt

SEQ ID NO: 1602292 - DNA, 23 bp, Homo sapiens
aacagtcaaatatcatttactct

SEQ ID NO: 1602293 - DNA, 14 bp, Homo sapiens
aacagtcatttaaa

SEQ ID NO: 1602294 - DNA, 18 bp, Homo sapiens
aacagtcttactgcaggc

SEQ ID NO: 1602295 - DNA, 20 bp, Homo sapiens
aacagtgaagttttactgtc

SEQ ID NO: 1602296 - DNA, 13 bp, Homo sapiens
aacagtgagcctg

SEQ ID NO: 1602297 - DNA, 17 bp, Homo sapiens
aacagtggttgcctggg

SEQ ID NO: 1602298 - DNA, 18 bp, Homo sapiens
aacagtggttgcctgggg

SEQ ID NO: 1602299 - DNA, 20 bp, Homo sapiens
aaatattaaaattgttaata

SEQ ID NO: 1602300 - DNA, 13 bp, Homo sapiens
aaatattaaagat

SEQ ID NO: 1602301 - DNA, 12 bp, Homo sapiens
aaatattaacat

SEQ ID NO: 1602302 - DNA, 14 bp, Homo sapiens
aaatattacagtga

SEQ ID NO: 1602303 - DNA, 19 bp, Homo sapiens
aaatattacttatttatcc

SEQ ID NO: 1602304 - DNA, 19 bp, Homo sapiens
aaatattcactctccatta

SEQ ID NO: 1602305 - DNA, 17 bp, Homo sapiens
aaatattcactggcccc

SEQ ID NO: 1602306 - DNA, 16 bp, Homo sapiens
aacataaaatctgtga

SEQ ID NO: 1602307 - DNA, 21 bp, Homo sapiens
aacataaccattacagggagc

SEQ ID NO: 1602308 - DNA, 14 bp, Homo sapiens
aacataactgcttc

SEQ ID NO: 1602309 - DNA, 14 bp, Homo sapiens
aacataatctagtt

SEQ ID NO: 1602310 - DNA, 15 bp, Homo sapiens
aacatacaagaaaat

SEQ ID NO: 1602311 - DNA, 12 bp, Homo sapiens
aacatacatcta

SEQ ID NO: 1602312 - DNA, 14 bp, Homo sapiens
aacatactgattgg

SEQ ID NO: 1602313 - DNA, 16 bp, Homo sapiens
aacatagaaactcggg

SEQ ID NO: 1602314 - DNA, 22 bp, Homo sapiens
aacatataatgttgttatttaa

SEQ ID NO: 1602315 - DNA, 18 bp, Homo sapiens
aacatatatttattgagt

SEQ ID NO: 1602316 - DNA, 12 bp, Homo sapiens
aacatatctaaa

SEQ ID NO: 1602317 - DNA, 13 bp, Homo sapiens
aacatatgttgca

SEQ ID NO: 1602318 - DNA, 11 bp, Homo sapiens
aacatattctt

SEQ ID NO: 1602319 - DNA, 22 bp, Homo sapiens
aacatattcttgctttcacaaa

SEQ ID NO: 1602320 - DNA, 19 bp, Homo sapiens
aacatatttttatacttta

SEQ ID NO: 1602321 - DNA, 15 bp, Homo sapiens
aacatcagacctgtc

SEQ ID NO: 1602322 - DNA, 15 bp, Homo sapiens
aacatcataattaca

SEQ ID NO: 1602323 - DNA, 16 bp, Homo sapiens
aacatcataattacat

SEQ ID NO: 1602324 - DNA, 15 bp, Homo sapiens
aacatcattagaaca

SEQ ID NO: 1602325 - DNA, 21 bp, Homo sapiens
aacatcattttactcttatga

SEQ ID NO: 1602326 - DNA, 16 bp, Homo sapiens
aacatccaaccttccc

SEQ ID NO: 1602327 - DNA, 14 bp, Homo sapiens
aacatccaagccag

SEQ ID NO: 1602328 - DNA, 22 bp, Homo sapiens
aacatcccacttagccgcaccc

SEQ ID NO: 1602329 - DNA, 18 bp, Homo sapiens
aacatcccattgccctgg

SEQ ID NO: 1602330 - DNA, 22 bp, Homo sapiens
aacatcctatcaacaacaaggt

SEQ ID NO: 1602331 - DNA, 19 bp, Homo sapiens
aacatccttcaagaactct

SEQ ID NO: 1602332 - DNA, 21 bp, Homo sapiens
aacatcgtgggtcactacagg

SEQ ID NO: 1602333 - DNA, 14 bp, Homo sapiens
aacatctgaaaaga

SEQ ID NO: 1602334 - DNA, 18 bp, Homo sapiens
aacatctgaaaagaaatg

SEQ ID NO: 1602335 - DNA, 19 bp, Homo sapiens
aacatctttattgaaattc

SEQ ID NO: 1602336 - DNA, 19 bp, Homo sapiens
aacatctttgcgaaaagat

SEQ ID NO: 1602337 - DNA, 20 bp, Homo sapiens
aacatctttgcgaaaagata

SEQ ID NO: 1602338 - DNA, 11 bp, Homo sapiens
aacatcttttc

SEQ ID NO: 1602339 - DNA, 22 bp, Homo sapiens
aacatcttttggaagttttgct

SEQ ID NO: 1602340 - DNA, 14 bp, Homo sapiens
aacatgcaaacagg

SEQ ID NO: 1602341 - DNA, 19 bp, Homo sapiens
aacatgcacatttatatat

SEQ ID NO: 1602342 - DNA, 20 bp, Homo sapiens
aacatgcacatttatatata

SEQ ID NO: 1602343 - DNA, 19 bp, Homo sapiens
aacatgcacattttgtaca

SEQ ID NO: 1602344 - DNA, 13 bp, Homo sapiens
aacatgccccctg

SEQ ID NO: 1602345 - DNA, 14 bp, Homo sapiens
aacatgccccctgc

SEQ ID NO: 1602346 - DNA, 22 bp, Homo sapiens
aacatgccccctgcagacacgt

SEQ ID NO: 1602347 - DNA, 21 bp, Homo sapiens
aacatgcctgccccaaacaaa

SEQ ID NO: 1602348 - DNA, 22 bp, Homo sapiens
aacatgcctgccccaaacaaat

SEQ ID NO: 1602349 - DNA, 18 bp, Homo sapiens
aacatgcttttactttat

SEQ ID NO: 1602350 - DNA, 14 bp, Homo sapiens
aacatggacttgta

SEQ ID NO: 1602351 - DNA, 19 bp, Homo sapiens
aacatggagaaaccctgtc

SEQ ID NO: 1602352 - DNA, 16 bp, Homo sapiens
aacatggagaaatcta

SEQ ID NO: 1602353 - DNA, 18 bp, Homo sapiens
aacatggagaaatctact

SEQ ID NO: 1602354 - DNA, 18 bp, Homo sapiens
aacatggctggcctggta

SEQ ID NO: 1602355 - DNA, 15 bp, Homo sapiens
aacatgggcattggg

SEQ ID NO: 1602356 - DNA, 22 bp, Homo sapiens
aacatgggcattgggttctaaa

SEQ ID NO: 1602357 - DNA, 15 bp, Homo sapiens
aacatggtgcctata

SEQ ID NO: 1602358 - DNA, 20 bp, Homo sapiens
aacatgtaaccggcatgttt

SEQ ID NO: 1602359 - DNA, 18 bp, Homo sapiens
aacatgtaatataaagat

SEQ ID NO: 1602360 - DNA, 16 bp, Homo sapiens
aacatgtatgtgcatt

SEQ ID NO: 1602361 - DNA, 11 bp, Homo sapiens
aacatgtcatg

SEQ ID NO: 1602362 - DNA, 22 bp, Homo sapiens
aacatgttaatgacaatattcc

SEQ ID NO: 1602363 - DNA, 16 bp, Homo sapiens
aacatgttactgacca

SEQ ID NO: 1602364 - DNA, 13 bp, Homo sapiens
aacatgtttaatg

SEQ ID NO: 1602365 - DNA, 16 bp, Homo sapiens
aacatgtttaatgggt

SEQ ID NO: 1602366 - DNA, 16 bp, Homo sapiens
aacatgtttacaggtt

SEQ ID NO: 1602367 - DNA, 16 bp, Homo sapiens
aacattaaacactgta

SEQ ID NO: 1602368 - DNA, 15 bp, Homo sapiens
aacattaaatcacag

SEQ ID NO: 1602369 - DNA, 18 bp, Homo sapiens
aacattaagtaaatgctg

SEQ ID NO: 1602370 - DNA, 17 bp, Homo sapiens
aacattaattttgtgca

SEQ ID NO: 1602371 - DNA, 20 bp, Homo sapiens
aacattaattttgtgcattc

SEQ ID NO: 1602372 - DNA, 22 bp, Homo sapiens
aacattacaaaaaaattttatg

SEQ ID NO: 1602373 - DNA, 22 bp, Homo sapiens
aacattagttgcactaactgct

SEQ ID NO: 1602374 - DNA, 13 bp, Homo sapiens
aacattatgatct

SEQ ID NO: 1602375 - DNA, 21 bp, Homo sapiens
aacattatgatctaataaact

SEQ ID NO: 1602376 - DNA, 20 bp, Homo sapiens
aacattcacacagggctctt

SEQ ID NO: 1602377 - DNA, 16 bp, Homo sapiens
aacattcagctctgga

SEQ ID NO: 1602378 - DNA, 12 bp, Homo sapiens
aacattccaaga

SEQ ID NO: 1602379 - DNA, 20 bp, Homo sapiens
aacattcctcatgaatgtaa

SEQ ID NO: 1602380 - DNA, 18 bp, Homo sapiens
aacattctcctgtggaag

SEQ ID NO: 1602381 - DNA, 17 bp, Homo sapiens
aacattctgatttggaa

SEQ ID NO: 1602382 - DNA, 14 bp, Homo sapiens
aacattctttttct

SEQ ID NO: 1602383 - DNA, 23 bp, Homo sapiens
aacattctttttctgttgaaact

SEQ ID NO: 1602384 - DNA, 16 bp, Homo sapiens
aacattgaagtaatga

SEQ ID NO: 1602385 - DNA, 17 bp, Homo sapiens
aacattgacttcttggt

SEQ ID NO: 1602386 - DNA, 19 bp, Homo sapiens
aacattgcataaacacttt

SEQ ID NO: 1602387 - DNA, 16 bp, Homo sapiens
aacattgctgatgtag

SEQ ID NO: 1602388 - DNA, 21 bp, Homo sapiens
aacattggcacatgccacctg

SEQ ID NO: 1602389 - DNA, 20 bp, Homo sapiens
aacattgtactgttgcttta

SEQ ID NO: 1602390 - DNA, 22 bp, Homo sapiens
aacattgtactgttgctttaat

SEQ ID NO: 1602391 - DNA, 13 bp, Homo sapiens
aacattgtgttcc

SEQ ID NO: 1602392 - DNA, 15 bp, Homo sapiens
aacatttatatgtag

SEQ ID NO: 1602393 - DNA, 13 bp, Homo sapiens
aacatttatgtga

SEQ ID NO: 1602394 - DNA, 10 bp, Homo sapiens
aacatttctt

SEQ ID NO: 1602395 - DNA, 16 bp, Homo sapiens
aacatttgatattttt

SEQ ID NO: 1602396 - DNA, 13 bp, Homo sapiens
aacatttgccaag

SEQ ID NO: 1602397 - DNA, 12 bp, Homo sapiens
aacatttgctgc

SEQ ID NO: 1602398 - DNA, 16 bp, Homo sapiens
aacatttgctgccatt

SEQ ID NO: 1602399 - DNA, 21 bp, Homo sapiens
aacatttgtgtaatatgaaat

SEQ ID NO: 1602400 - DNA, 14 bp, Homo sapiens
aacatttgttcctg

SEQ ID NO: 1602401 - DNA, 17 bp, Homo sapiens
aacatttgttcctggag

SEQ ID NO: 1602402 - DNA, 22 bp, Homo sapiens
aagtgcaataaatctgacccag

SEQ ID NO: 1602403 - DNA, 16 bp, Homo sapiens
aagtgcaatagattac

SEQ ID NO: 1602404 - DNA, 18 bp, Homo sapiens
aagtgcacttttttatga

SEQ ID NO: 1602405 - DNA, 19 bp, Homo sapiens
aagtgcacttttttatgaa

SEQ ID NO: 1602406 - DNA, 17 bp, Homo sapiens
aagtgcatttttcttat

SEQ ID NO: 1602407 - DNA, 11 bp, Homo sapiens
aagtgccaaac

SEQ ID NO: 1602408 - DNA, 18 bp, Homo sapiens
aagtgccagaggtgggca

SEQ ID NO: 1602409 - DNA, 19 bp, Homo sapiens
aagtgccagaggtgggcag

SEQ ID NO: 1602410 - DNA, 21 bp, Homo sapiens
aagtgccagtcttgtgtctgc

SEQ ID NO: 1602411 - DNA, 11 bp, Homo sapiens
aagtgcccaaa

SEQ ID NO: 1602412 - DNA, 13 bp, Homo sapiens
aagtgcccaaagt

SEQ ID NO: 1602413 - DNA, 14 bp, Homo sapiens
aagtgcccaaagtg

SEQ ID NO: 1602414 - DNA, 16 bp, Homo sapiens
aagtgcccacatttga

SEQ ID NO: 1602415 - DNA, 12 bp, Homo sapiens
aagtgcccagcc

SEQ ID NO: 1602416 - DNA, 15 bp, Homo sapiens
aagtgcccagtggag

SEQ ID NO: 1602417 - DNA, 19 bp, Homo sapiens
aagtgcccagtggagcctg

SEQ ID NO: 1602418 - DNA, 14 bp, Homo sapiens
aagtgcctcttgtt

SEQ ID NO: 1602419 - DNA, 19 bp, Homo sapiens
aagtgcctgagctggggaa

SEQ ID NO: 1602420 - DNA, 17 bp, Homo sapiens
aagtgctaaggttctaa

SEQ ID NO: 1602421 - DNA, 17 bp, Homo sapiens
aagtgctccctggaggc

SEQ ID NO: 1602422 - DNA, 19 bp, Homo sapiens
aagtgctcttggctgaccc

SEQ ID NO: 1602423 - DNA, 21 bp, Homo sapiens
aagtgctcttggctgacccct

SEQ ID NO: 1602424 - DNA, 23 bp, Homo sapiens
aagtgctcttggctgacccctct

SEQ ID NO: 1602425 - DNA, 14 bp, Homo sapiens
aagtgctgcacaaa

SEQ ID NO: 1602426 - DNA, 17 bp, Homo sapiens
aagtgctgcacaaaagc

SEQ ID NO: 1602427 - DNA, 13 bp, Homo sapiens
aagtgctgggatt

SEQ ID NO: 1602428 - DNA, 22 bp, Homo sapiens
aagtgctggggaccttaagtga

SEQ ID NO: 1602429 - DNA, 13 bp, Homo sapiens
aagtgctgtaccc

SEQ ID NO: 1602430 - DNA, 16 bp, Homo sapiens
aagtgctgtttattaa

SEQ ID NO: 1602431 - DNA, 16 bp, Homo sapiens
aagtggaccaggacag

SEQ ID NO: 1602432 - DNA, 19 bp, Homo sapiens
aagtggaccaggacaggac

SEQ ID NO: 1602433 - DNA, 16 bp, Homo sapiens
aagtggagacagtcct

SEQ ID NO: 1602434 - DNA, 12 bp, Homo sapiens
aagtggcgtgtg

SEQ ID NO: 1602435 - DNA, 12 bp, Homo sapiens
aagtggctgctg

SEQ ID NO: 1602436 - DNA, 21 bp, Homo sapiens
aagtggctgggtgccctctca

SEQ ID NO: 1602437 - DNA, 19 bp, Homo sapiens
aagtgggaggtcaggaaac

SEQ ID NO: 1602438 - DNA, 20 bp, Homo sapiens
aagtgggatttggggcctca

SEQ ID NO: 1602439 - DNA, 16 bp, Homo sapiens
aagtgggccaggacag

SEQ ID NO: 1602440 - DNA, 11 bp, Homo sapiens
aagtgggccca

SEQ ID NO: 1602441 - DNA, 15 bp, Homo sapiens
aagtgggcccacccg

SEQ ID NO: 1602442 - DNA, 19 bp, Homo sapiens
aagtgggggcagagggcag

SEQ ID NO: 1602443 - DNA, 18 bp, Homo sapiens
aagtggggtgctgggagg

SEQ ID NO: 1602444 - DNA, 15 bp, Homo sapiens
aagtggggtgttctt

SEQ ID NO: 1602445 - DNA, 17 bp, Homo sapiens
aagtgggttttttagtt

SEQ ID NO: 1602446 - DNA, 15 bp, Homo sapiens
aagtggtaaatactg

SEQ ID NO: 1602447 - DNA, 19 bp, Homo sapiens
aagtggtaaatactgtgaa

SEQ ID NO: 1602448 - DNA, 19 bp, Homo sapiens
aagtggtaatttttgtaca

SEQ ID NO: 1602449 - DNA, 23 bp, Homo sapiens
aagtggtaatttttgtacattac

SEQ ID NO: 1602450 - DNA, 12 bp, Homo sapiens
aagtggtccagc

SEQ ID NO: 1602451 - DNA, 15 bp, Homo sapiens
aagtggtctctgctg

SEQ ID NO: 1602452 - DNA, 16 bp, Homo sapiens
aagtggtctctgctgg

SEQ ID NO: 1602453 - DNA, 17 bp, Homo sapiens
aagtgtaacagctgagg

SEQ ID NO: 1602454 - DNA, 11 bp, Homo sapiens
aagtgtaactg

SEQ ID NO: 1602455 - DNA, 13 bp, Homo sapiens
aagtgtagctcaa

SEQ ID NO: 1602456 - DNA, 14 bp, Homo sapiens
aagtgtataatata

SEQ ID NO: 1602457 - DNA, 19 bp, Homo sapiens
aagtgtataatataaaaaa

SEQ ID NO: 1602458 - DNA, 15 bp, Homo sapiens
aagtgtccgagaact

SEQ ID NO: 1602459 - DNA, 18 bp, Homo sapiens
aagtgtctacatgtgcca

SEQ ID NO: 1602460 - DNA, 19 bp, Homo sapiens
aagtgtctcactaaagcat

SEQ ID NO: 1602461 - DNA, 21 bp, Homo sapiens
aagtgtctcactaaagcatga

SEQ ID NO: 1602462 - DNA, 22 bp, Homo sapiens
aagtgtctgccagctgggccca

SEQ ID NO: 1602463 - DNA, 15 bp, Homo sapiens
aagtgtcttaaattt

SEQ ID NO: 1602464 - DNA, 18 bp, Homo sapiens
aagtgtgagtaagagctg

SEQ ID NO: 1602465 - DNA, 19 bp, Homo sapiens
aagtgtgagtaagagctgg

SEQ ID NO: 1602466 - DNA, 18 bp, Homo sapiens
aagtgtgccaaatcagtt

SEQ ID NO: 1602467 - DNA, 20 bp, Homo sapiens
aagtgtgggtttggttagag

SEQ ID NO: 1602468 - DNA, 15 bp, Homo sapiens
aagtgtgtatatatt

SEQ ID NO: 1602469 - DNA, 17 bp, Homo sapiens
aagtgttcaagaaataa

SEQ ID NO: 1602470 - DNA, 23 bp, Homo sapiens
aagtgttctcatgaagcaggagg

SEQ ID NO: 1602471 - DNA, 15 bp, Homo sapiens
aagtgttctctagaa

SEQ ID NO: 1602472 - DNA, 17 bp, Homo sapiens
aagtgttgtaaatattt

SEQ ID NO: 1602473 - DNA, 20 bp, Homo sapiens
aagtgttgtaaatatttatg

SEQ ID NO: 1602474 - DNA, 22 bp, Homo sapiens
aagtgttgtatcaaagtgtgat

SEQ ID NO: 1602475 - DNA, 21 bp, Homo sapiens
aagtgttgtgttcctggctga

SEQ ID NO: 1602476 - DNA, 22 bp, Homo sapiens
aagtgtttcaaaaaattatatg

SEQ ID NO: 1602477 - DNA, 12 bp, Homo sapiens
aagtgtttctca

SEQ ID NO: 1602478 - DNA, 22 bp, Homo sapiens
aagtgtttctcaaaagaggtta

SEQ ID NO: 1602479 - DNA, 22 bp, Homo sapiens
aagtgttttctcagaacagctg

SEQ ID NO: 1602480 - DNA, 15 bp, Homo sapiens
aagttaaaaaacagc

SEQ ID NO: 1602481 - DNA, 22 bp, Homo sapiens
aagttaaaagtgttgattacat

SEQ ID NO: 1602482 - DNA, 18 bp, Homo sapiens
aagttaaacattgaagta

SEQ ID NO: 1602483 - DNA, 11 bp, Homo sapiens
aagttaaaggg

SEQ ID NO: 1602484 - DNA, 12 bp, Homo sapiens
aagttaaataaa

SEQ ID NO: 1602485 - DNA, 15 bp, Homo sapiens
aagttaaatatgtag

SEQ ID NO: 1602486 - DNA, 22 bp, Homo sapiens
aagttacacagaaatgctgctg

SEQ ID NO: 1602487 - DNA, 16 bp, Homo sapiens
aagttacagtttgcac

SEQ ID NO: 1602488 - DNA, 14 bp, Homo sapiens
aagttactgaatgc

SEQ ID NO: 1602489 - DNA, 15 bp, Homo sapiens
aagttactgtaaatg

SEQ ID NO: 1602490 - DNA, 16 bp, Homo sapiens
aagttacttattctag

SEQ ID NO: 1602491 - DNA, 12 bp, Homo sapiens
aagttactttgt

SEQ ID NO: 1602492 - DNA, 17 bp, Homo sapiens
aagttagagattttaca

SEQ ID NO: 1602493 - DNA, 14 bp, Homo sapiens
aagttagctcagga

SEQ ID NO: 1602494 - DNA, 13 bp, Homo sapiens
aagttagtattaa

SEQ ID NO: 1602495 - DNA, 17 bp, Homo sapiens
aagttagtattaaaatc

SEQ ID NO: 1602496 - DNA, 23 bp, Homo sapiens
aagttagtgcttgttctaagatt

SEQ ID NO: 1602497 - DNA, 17 bp, Homo sapiens
aagttagtttgtatata

SEQ ID NO: 1602498 - DNA, 19 bp, Homo sapiens
aagttataaatcaatgtca

SEQ ID NO: 1602499 - DNA, 20 bp, Homo sapiens
aagttataaatcaatgtcac

SEQ ID NO: 1602500 - DNA, 14 bp, Homo sapiens
aagttataagactc

SEQ ID NO: 1602501 - DNA, 15 bp, Homo sapiens
aagttataagactct

SEQ ID NO: 1602502 - DNA, 15 bp, Homo sapiens
aagttatgtgtatgt

SEQ ID NO: 1602503 - DNA, 16 bp, Homo sapiens
aagttattaaaattgt

SEQ ID NO: 1602504 - DNA, 17 bp, Homo sapiens
aagttattaaaattgtt

SEQ ID NO: 1602505 - DNA, 23 bp, Homo sapiens
aagttattgataagttcatacat

SEQ ID NO: 1602506 - DNA, 23 bp, Homo sapiens
aagttatttacttttaccactat

SEQ ID NO: 1602507 - DNA, 13 bp, Homo sapiens
aagttatttcttg

SEQ ID NO: 1602508 - DNA, 14 bp, Homo sapiens
aagttattttctac

SEQ ID NO: 1602509 - DNA, 17 bp, Homo sapiens
aagttatttttgtacat

SEQ ID NO: 1602510 - DNA, 13 bp, Homo sapiens
aagttcatacatt

SEQ ID NO: 1602511 - DNA, 15 bp, Homo sapiens
aagttcatattccat

SEQ ID NO: 1602512 - DNA, 16 bp, Homo sapiens
aagttcatcttgcagc

SEQ ID NO: 1602513 - DNA, 17 bp, Homo sapiens
aagttcatgtttgtaaa

SEQ ID NO: 1602514 - DNA, 22 bp, Homo sapiens
aagttcccattattatttctgt

SEQ ID NO: 1602515 - DNA, 14 bp, Homo sapiens
aagttcctctagtg

SEQ ID NO: 1602516 - DNA, 11 bp, Homo sapiens
aagttccttcc

SEQ ID NO: 1602517 - DNA, 12 bp, Homo sapiens
aagttctaagat

SEQ ID NO: 1602518 - DNA, 21 bp, Homo sapiens
aagttctaagattctaatgat

SEQ ID NO: 1602519 - DNA, 20 bp, Homo sapiens
aaggagaatcatgtttcttt

SEQ ID NO: 1602520 - DNA, 13 bp, Homo sapiens
aaggagaatttaa

SEQ ID NO: 1602521 - DNA, 20 bp, Homo sapiens
aaggagacattgctctatgt

SEQ ID NO: 1602522 - DNA, 16 bp, Homo sapiens
aaggagactcacctct

SEQ ID NO: 1602523 - DNA, 20 bp, Homo sapiens
aaggagactcacctctgcct

SEQ ID NO: 1602524 - DNA, 14 bp, Homo sapiens
aaggagagcctgct

SEQ ID NO: 1602525 - DNA, 23 bp, Homo sapiens
aaggagatagacgggttgaaaga

SEQ ID NO: 1602526 - DNA, 18 bp, Homo sapiens
aaggagatgtcttggaac

SEQ ID NO: 1602527 - DNA, 13 bp, Homo sapiens
aaggagatttctt

SEQ ID NO: 1602528 - DNA, 14 bp, Homo sapiens
aaggagatttctta

SEQ ID NO: 1602529 - DNA, 20 bp, Homo sapiens
aaggagcaaaaatctgagaa

SEQ ID NO: 1602530 - DNA, 21 bp, Homo sapiens
aaggagcaaaaatctgagaaa

SEQ ID NO: 1602531 - DNA, 15 bp, Homo sapiens
aaggagccagtttgc

SEQ ID NO: 1602532 - DNA, 24 bp, Homo sapiens
aaggagctgatttccaggcccctg

SEQ ID NO: 1602533 - DNA, 11 bp, Homo sapiens
aaggagctggg

SEQ ID NO: 1602534 - DNA, 17 bp, Homo sapiens
aaggagcttacccaagc

SEQ ID NO: 1602535 - DNA, 14 bp, Homo sapiens
aaggagctttctca

SEQ ID NO: 1602536 - DNA, 20 bp, Homo sapiens
aaggagctttctcaatgtct

SEQ ID NO: 1602537 - DNA, 18 bp, Homo sapiens
aaggaggaatttactttc

SEQ ID NO: 1602538 - DNA, 15 bp, Homo sapiens
aaggaggaggaggga

SEQ ID NO: 1602539 - DNA, 17 bp, Homo sapiens
aaggaggaggagggaga

SEQ ID NO: 1602540 - DNA, 18 bp, Homo sapiens
aaggaggcatgcctctga

SEQ ID NO: 1602541 - DNA, 16 bp, Homo sapiens
aaggaggccaaccagc

SEQ ID NO: 1602542 - DNA, 20 bp, Homo sapiens
aaggaggccaaccagcccga

SEQ ID NO: 1602543 - DNA, 13 bp, Homo sapiens
aaggagggagctg

SEQ ID NO: 1602544 - DNA, 15 bp, Homo sapiens
aaggagggagctgct

SEQ ID NO: 1602545 - DNA, 18 bp, Homo sapiens
aaggagggcacattaact

SEQ ID NO: 1602546 - DNA, 15 bp, Homo sapiens
aaggagggcagagcc

SEQ ID NO: 1602547 - DNA, 19 bp, Homo sapiens
aaggagggcagagccatgg

SEQ ID NO: 1602548 - DNA, 17 bp, Homo sapiens
aaggagtacaaaacaat

SEQ ID NO: 1602549 - DNA, 16 bp, Homo sapiens
aaggagttacagggaa

SEQ ID NO: 1602550 - DNA, 20 bp, Homo sapiens
aaggataaatcataaagtca

SEQ ID NO: 1602551 - DNA, 20 bp, Homo sapiens
aaggatacacttatttgtca

SEQ ID NO: 1602552 - DNA, 21 bp, Homo sapiens
aaggatacacttatttgtcaa

SEQ ID NO: 1602553 - DNA, 14 bp, Homo sapiens
aaggatagtaagca

SEQ ID NO: 1602554 - DNA, 20 bp, Homo sapiens
aaggatagtaagcatagaaa

SEQ ID NO: 1602555 - DNA, 23 bp, Homo sapiens
aaggatatgattaatattattaa

SEQ ID NO: 1602556 - DNA, 22 bp, Homo sapiens
aaggatcagaacagcagaggtt

SEQ ID NO: 1602557 - DNA, 15 bp, Homo sapiens
aaggtgcctcagact

SEQ ID NO: 1602558 - DNA, 20 bp, Homo sapiens
aaggtgcctcagttttcctt

SEQ ID NO: 1602559 - DNA, 12 bp, Homo sapiens
aaggtgcctcat

SEQ ID NO: 1602560 - DNA, 13 bp, Homo sapiens
aaggtgctgagct

SEQ ID NO: 1602561 - DNA, 17 bp, Homo sapiens
aaggtggaataaacatt

SEQ ID NO: 1602562 - DNA, 20 bp, Homo sapiens
aaggtggagggaaggataaa

SEQ ID NO: 1602563 - DNA, 17 bp, Homo sapiens
aaggtggcctctgcctg

SEQ ID NO: 1602564 - DNA, 19 bp, Homo sapiens
aaggtggcctctgcctggg

SEQ ID NO: 1602565 - DNA, 21 bp, Homo sapiens
aaggtggcctctgcctggggc

SEQ ID NO: 1602566 - DNA, 17 bp, Homo sapiens
aaggtgggccttgctac

SEQ ID NO: 1602567 - DNA, 18 bp, Homo sapiens
aaggtgggctgagccctg

SEQ ID NO: 1602568 - DNA, 19 bp, Homo sapiens
aaggtgggctgagccctgg

SEQ ID NO: 1602569 - DNA, 20 bp, Homo sapiens
aaggtgggctgagccctggc

SEQ ID NO: 1602570 - DNA, 21 bp, Homo sapiens
aaggtgggctgagccctggca

SEQ ID NO: 1602571 - DNA, 19 bp, Homo sapiens
aaggtggggccctgcccct

SEQ ID NO: 1602572 - DNA, 15 bp, Homo sapiens
aaggtggtaaattca

SEQ ID NO: 1602573 - DNA, 20 bp, Homo sapiens
aaggtggtggggctgccgga

SEQ ID NO: 1602574 - DNA, 16 bp, Homo sapiens
aaggtgtagaaaaggt

SEQ ID NO: 1602575 - DNA, 12 bp, Homo sapiens
aaggtgtattta

SEQ ID NO: 1602576 - DNA, 13 bp, Homo sapiens
aaggtgtccaggg

SEQ ID NO: 1602577 - DNA, 17 bp, Homo sapiens
aaggtgtccttttcctt

SEQ ID NO: 1602578 - DNA, 13 bp, Homo sapiens
aaggtgtggtctg

SEQ ID NO: 1602579 - DNA, 15 bp, Homo sapiens
aaggttaataaagta

SEQ ID NO: 1602580 - DNA, 16 bp, Homo sapiens
aaggttaataaagtaa

SEQ ID NO: 1602581 - DNA, 22 bp, Homo sapiens
aaggttacatgtgagtattaat

SEQ ID NO: 1602582 - DNA, 18 bp, Homo sapiens
aaggttaggatttaacag

SEQ ID NO: 1602583 - DNA, 18 bp, Homo sapiens
aaggttatcagtgcttcc

SEQ ID NO: 1602584 - DNA, 19 bp, Homo sapiens
aaggttccaactgtatata

SEQ ID NO: 1602585 - DNA, 13 bp, Homo sapiens
aaggttctaaggc

SEQ ID NO: 1602586 - DNA, 14 bp, Homo sapiens
aaggttctaaggcc

SEQ ID NO: 1602587 - DNA, 12 bp, Homo sapiens
aaggttctcaga

SEQ ID NO: 1602588 - DNA, 21 bp, Homo sapiens
aaggttctcaggtgttgccaa

SEQ ID NO: 1602589 - DNA, 17 bp, Homo sapiens
aaggttctcataggaaa

SEQ ID NO: 1602590 - DNA, 17 bp, Homo sapiens
aaggttcttcatccctt

SEQ ID NO: 1602591 - DNA, 22 bp, Homo sapiens
aaggttgacaataaatgtgctt

SEQ ID NO: 1602592 - DNA, 17 bp, Homo sapiens
aaggttggagcccaggg

SEQ ID NO: 1602593 - DNA, 18 bp, Homo sapiens
aaggttggagcccagggc

SEQ ID NO: 1602594 - DNA, 16 bp, Homo sapiens
aaggttgggcagggtg

SEQ ID NO: 1602595 - DNA, 16 bp, Homo sapiens
aaggttggtggggggt

SEQ ID NO: 1602596 - DNA, 21 bp, Homo sapiens
aaggttggtggggggtccagt

SEQ ID NO: 1602597 - DNA, 18 bp, Homo sapiens
aaggttgttttgaaactg

SEQ ID NO: 1602598 - DNA, 20 bp, Homo sapiens
aaggtttaaccttaaaatta

SEQ ID NO: 1602599 - DNA, 20 bp, Homo sapiens
aaggtttattgttaatacaa

SEQ ID NO: 1602600 - DNA, 21 bp, Homo sapiens
aaggtttcgtttctgtataca

SEQ ID NO: 1602601 - DNA, 16 bp, Homo sapiens
aaggtttgcaaattaa

SEQ ID NO: 1602602 - DNA, 19 bp, Homo sapiens
aaggtttgcaaattaaaaa

SEQ ID NO: 1602603 - DNA, 18 bp, Homo sapiens
aaggtttggtccagcctg

SEQ ID NO: 1602604 - DNA, 20 bp, Homo sapiens
aaggttttaggttctaaagt

SEQ ID NO: 1602605 - DNA, 20 bp, Homo sapiens
aaggtttttaagggccgggg

SEQ ID NO: 1602606 - DNA, 17 bp, Homo sapiens
aaggtttttgtaaagat

SEQ ID NO: 1602607 - DNA, 15 bp, Homo sapiens
aagtaaatatatatg

SEQ ID NO: 1602608 - DNA, 14 bp, Homo sapiens
aagtaaattatgta

SEQ ID NO: 1602609 - DNA, 17 bp, Homo sapiens
aagtaacacagtattat

SEQ ID NO: 1602610 - DNA, 20 bp, Homo sapiens
aagtaacacatttggccaca

SEQ ID NO: 1602611 - DNA, 21 bp, Homo sapiens
aagtaagaaagtgaagcaaat

SEQ ID NO: 1602612 - DNA, 14 bp, Homo sapiens
aagtaagaagacat

SEQ ID NO: 1602613 - DNA, 22 bp, Homo sapiens
aagtaagaagaggagcctcaga

SEQ ID NO: 1602614 - DNA, 20 bp, Homo sapiens
aagtaaggtgcttggagttt

SEQ ID NO: 1602615 - DNA, 20 bp, Homo sapiens
aagtaagtaccactcaggcc

SEQ ID NO: 1602616 - DNA, 15 bp, Homo sapiens
aagtaatcatctaag

SEQ ID NO: 1602617 - DNA, 21 bp, Homo sapiens
aagtaatgaatttttatgata

SEQ ID NO: 1602618 - DNA, 21 bp, Homo sapiens
aagtaatgatactgtgtgttt

SEQ ID NO: 1602619 - DNA, 23 bp, Homo sapiens
aagtaatgtattagtatggttca

SEQ ID NO: 1602620 - DNA, 11 bp, Homo sapiens
aagtaattatc

SEQ ID NO: 1602621 - DNA, 13 bp, Homo sapiens
aagtaattatcgg

SEQ ID NO: 1602622 - DNA, 23 bp, Homo sapiens
aagtaattatcgggaacagtgtt

SEQ ID NO: 1602623 - DNA, 19 bp, Homo sapiens
aagtaattattttttagat

SEQ ID NO: 1602624 - DNA, 18 bp, Homo sapiens
aagtaattgcatttctgc

SEQ ID NO: 1602625 - DNA, 16 bp, Homo sapiens
aagtaattgtgaaaaa

SEQ ID NO: 1602626 - DNA, 13 bp, Homo sapiens
aagtaatttcagt

SEQ ID NO: 1602627 - DNA, 14 bp, Homo sapiens
aagtaatttcagtg

SEQ ID NO: 1602628 - DNA, 13 bp, Homo sapiens
aagtaatttcctg

SEQ ID NO: 1602629 - DNA, 17 bp, Homo sapiens
aagtacaattcattgtt

SEQ ID NO: 1602630 - DNA, 14 bp, Homo sapiens
aagtacacctgtgt

SEQ ID NO: 1602631 - DNA, 21 bp, Homo sapiens
aagtacattttttgaaatgct

SEQ ID NO: 1602632 - DNA, 16 bp, Homo sapiens
aagtactatgtatcaa

SEQ ID NO: 1602633 - DNA, 13 bp, Homo sapiens
aagtacttaaact

SEQ ID NO: 1602634 - DNA, 20 bp, Homo sapiens
aagtactttaaaaaggaaat

SEQ ID NO: 1602635 - DNA, 22 bp, Homo sapiens
aagtagccgctctggttgaagc

SEQ ID NO: 1602636 - DNA, 21 bp, Homo sapiens
aagtagcctgatctttctaga

SEQ ID NO: 1602637 - DNA, 22 bp, Homo sapiens
aagtagcctgatctttctagag

SEQ ID NO: 1602638 - DNA, 16 bp, Homo sapiens
aagtagctagtagcaa

SEQ ID NO: 1602639 - DNA, 21 bp, Homo sapiens
aagtagctagtagcaatgtgc

SEQ ID NO: 1602640 - DNA, 17 bp, Homo sapiens
aagtaggaggaaacagt

SEQ ID NO: 1602641 - DNA, 18 bp, Homo sapiens
aagtaggaggaaacagtt

SEQ ID NO: 1602642 - DNA, 22 bp, Homo sapiens
aagctctgtttataaaaacaaa

SEQ ID NO: 1602643 - DNA, 16 bp, Homo sapiens
aagctcttactctttc

SEQ ID NO: 1602644 - DNA, 22 bp, Homo sapiens
aagctgagttaggtgtctgtcc

SEQ ID NO: 1602645 - DNA, 22 bp, Homo sapiens
aagctgagtttcctatgggaac

SEQ ID NO: 1602646 - DNA, 23 bp, Homo sapiens
aagctgatattatttcttctctt

SEQ ID NO: 1602647 - DNA, 13 bp, Homo sapiens
aagctgatccagt

SEQ ID NO: 1602648 - DNA, 21 bp, Homo sapiens
aagctgatccagtttccggaa

SEQ ID NO: 1602649 - DNA, 22 bp, Homo sapiens
aagctgattactgtcaataaac

SEQ ID NO: 1602650 - DNA, 18 bp, Homo sapiens
aagctgattttttttaat

SEQ ID NO: 1602651 - DNA, 15 bp, Homo sapiens
aagctgcaaatctga

SEQ ID NO: 1602652 - DNA, 12 bp, Homo sapiens
aagctgcacatg

SEQ ID NO: 1602653 - DNA, 13 bp, Homo sapiens
aagctgcactgtg

SEQ ID NO: 1602654 - DNA, 16 bp, Homo sapiens
aagctgcactgtgaac

SEQ ID NO: 1602655 - DNA, 23 bp, Homo sapiens
aagctgcagagatttctcattga

SEQ ID NO: 1602656 - DNA, 23 bp, Homo sapiens
aagctgcctcccctctccttcct

SEQ ID NO: 1602657 - DNA, 15 bp, Homo sapiens
aagctgcctggtata

SEQ ID NO: 1602658 - DNA, 19 bp, Homo sapiens
aagctgctctgagccacag

SEQ ID NO: 1602659 - DNA, 17 bp, Homo sapiens
aagctgctgcagccctg

SEQ ID NO: 1602660 - DNA, 14 bp, Homo sapiens
aagctgctttattc

SEQ ID NO: 1602661 - DNA, 14 bp, Homo sapiens
aagctggaacattt

SEQ ID NO: 1602662 - DNA, 11 bp, Homo sapiens
aagctggaaga

SEQ ID NO: 1602663 - DNA, 13 bp, Homo sapiens
aagctggcctgag

SEQ ID NO: 1602664 - DNA, 14 bp, Homo sapiens
aagctggcctgaga

SEQ ID NO: 1602665 - DNA, 16 bp, Homo sapiens
aagctgtacccttgag

SEQ ID NO: 1602666 - DNA, 19 bp, Homo sapiens
aagctgtactcagagcaga

SEQ ID NO: 1602667 - DNA, 20 bp, Homo sapiens
aagctgtactcagagcagag

SEQ ID NO: 1602668 - DNA, 12 bp, Homo sapiens
aagctgtccctg

SEQ ID NO: 1602669 - DNA, 14 bp, Homo sapiens
aagctgtccctgca

SEQ ID NO: 1602670 - DNA, 23 bp, Homo sapiens
aagctgtctcttcggcagggagg

SEQ ID NO: 1602671 - DNA, 13 bp, Homo sapiens
aagctgtgcaggc

SEQ ID NO: 1602672 - DNA, 22 bp, Homo sapiens
aagctgtgtccttgcacctgca

SEQ ID NO: 1602673 - DNA, 21 bp, Homo sapiens
aagctgttatttcttccctgc

SEQ ID NO: 1602674 - DNA, 13 bp, Homo sapiens
aagctgttcctgt

SEQ ID NO: 1602675 - DNA, 20 bp, Homo sapiens
aagctgttgggagaaagcaa

SEQ ID NO: 1602676 - DNA, 19 bp, Homo sapiens
aagctgtttatttattcac

SEQ ID NO: 1602677 - DNA, 14 bp, Homo sapiens
aagctgtttggaaa

SEQ ID NO: 1602678 - DNA, 14 bp, Homo sapiens
aagcttaatgattc

SEQ ID NO: 1602679 - DNA, 11 bp, Homo sapiens
aagcttagaac

SEQ ID NO: 1602680 - DNA, 13 bp, Homo sapiens
aagcttatttcta

SEQ ID NO: 1602681 - DNA, 21 bp, Homo sapiens
aagcttcaaagtttatatgcc

SEQ ID NO: 1602682 - DNA, 14 bp, Homo sapiens
aagcttcaaattaa

SEQ ID NO: 1602683 - DNA, 12 bp, Homo sapiens
aagcttcagagc

SEQ ID NO: 1602684 - DNA, 18 bp, Homo sapiens
aagccatgtactcaagta

SEQ ID NO: 1602685 - DNA, 21 bp, Homo sapiens
aagccatgtactcaagtacca

SEQ ID NO: 1602686 - DNA, 17 bp, Homo sapiens
aagccattggagagctg

SEQ ID NO: 1602687 - DNA, 20 bp, Homo sapiens
aagccattggagagctgtct

SEQ ID NO: 1602688 - DNA, 17 bp, Homo sapiens
aagcccaacctcctgac

SEQ ID NO: 1602689 - DNA, 22 bp, Homo sapiens
aagcccaacctcctgacctgtc

SEQ ID NO: 1602690 - DNA, 18 bp, Homo sapiens
aagcccaatattataatt

SEQ ID NO: 1602691 - DNA, 12 bp, Homo sapiens
aagcccagctcc

SEQ ID NO: 1602692 - DNA, 13 bp, Homo sapiens
aagcccagctcca

SEQ ID NO: 1602693 - DNA, 15 bp, Homo sapiens
aagcccagctccagg

SEQ ID NO: 1602694 - DNA, 21 bp, Homo sapiens
aagcccagctccagggccaga

SEQ ID NO: 1602695 - DNA, 17 bp, Homo sapiens
aagcccagtgcactgaa

SEQ ID NO: 1602696 - DNA, 14 bp, Homo sapiens
aagcccatcctgac

SEQ ID NO: 1602697 - DNA, 18 bp, Homo sapiens
aagcccatcctgaccagc

SEQ ID NO: 1602698 - DNA, 20 bp, Homo sapiens
aagcccatcctgaccagctg

SEQ ID NO: 1602699 - DNA, 18 bp, Homo sapiens
aagccccagcttggctca

SEQ ID NO: 1602700 - DNA, 15 bp, Homo sapiens
aagccccagggcctg

SEQ ID NO: 1602701 - DNA, 17 bp, Homo sapiens
aagccccatctcatcct

SEQ ID NO: 1602702 - DNA, 18 bp, Homo sapiens
aagcccccagggcctcca

SEQ ID NO: 1602703 - DNA, 19 bp, Homo sapiens
aagcccccagggcctccag

SEQ ID NO: 1602704 - DNA, 13 bp, Homo sapiens
aagcccctcagcc

SEQ ID NO: 1602705 - DNA, 19 bp, Homo sapiens
aagcccctcagcccttgcc

SEQ ID NO: 1602706 - DNA, 19 bp, Homo sapiens
aagcccgttagccccaggg

SEQ ID NO: 1602707 - DNA, 9 bp, Homo sapiens
aagccctcc

SEQ ID NO: 1602708 - DNA, 20 bp, Homo sapiens
aagccctcccaggtgttaac

SEQ ID NO: 1602709 - DNA, 11 bp, Homo sapiens
aagccctcctt

SEQ ID NO: 1602710 - DNA, 15 bp, Homo sapiens
aagccctccttccac

SEQ ID NO: 1602711 - DNA, 14 bp, Homo sapiens
aagccctgcctctg

SEQ ID NO: 1602712 - DNA, 17 bp, Homo sapiens
aagccctgcctctgtgt

SEQ ID NO: 1602713 - DNA, 14 bp, Homo sapiens
aagccctggcaaca

SEQ ID NO: 1602714 - DNA, 13 bp, Homo sapiens
aagcccttatttg

SEQ ID NO: 1602715 - DNA, 15 bp, Homo sapiens
aagccctttgctctg

SEQ ID NO: 1602716 - DNA, 14 bp, Homo sapiens
aagccgactctggc

SEQ ID NO: 1602717 - DNA, 19 bp, Homo sapiens
aagccgactctggccctgg

SEQ ID NO: 1602718 - DNA, 17 bp, Homo sapiens
aagccggacagctgccc

SEQ ID NO: 1602719 - DNA, 19 bp, Homo sapiens
aagccggacagctgcccag

SEQ ID NO: 1602720 - DNA, 14 bp, Homo sapiens
aagccgggagccaa

SEQ ID NO: 1602721 - DNA, 18 bp, Homo sapiens
aagccgtctgactccaga

SEQ ID NO: 1602722 - DNA, 20 bp, Homo sapiens
aagccgtctgactccagagt

SEQ ID NO: 1602723 - DNA, 13 bp, Homo sapiens
aagcctaaaattg

SEQ ID NO: 1602724 - DNA, 14 bp, Homo sapiens
aagcctaaaattga

SEQ ID NO: 1602725 - DNA, 15 bp, Homo sapiens
aagcctaaatttgtg

SEQ ID NO: 1602726 - DNA, 20 bp, Homo sapiens
aagcctaacttcatagaaac

SEQ ID NO: 1602727 - DNA, 21 bp, Homo sapiens
aagcctacccgactctattta

SEQ ID NO: 1602728 - DNA, 21 bp, Homo sapiens
aagcctagacaacctttctgt

SEQ ID NO: 1602729 - DNA, 21 bp, Homo sapiens
aagcctagtgtgtgtgctttc

SEQ ID NO: 1602730 - DNA, 21 bp, Homo sapiens
aagcctcaaggttttaggttc

SEQ ID NO: 1602731 - DNA, 16 bp, Homo sapiens
aagcctcatgccaacc

SEQ ID NO: 1602732 - DNA, 19 bp, Homo sapiens
aagcctccaagggtttcga

SEQ ID NO: 1602733 - DNA, 15 bp, Homo sapiens
aagcctccacagcga

SEQ ID NO: 1602734 - DNA, 23 bp, Homo sapiens
aagcctccacagcgagggcagct

SEQ ID NO: 1602735 - DNA, 19 bp, Homo sapiens
aagcctccttagaaaaaaa

SEQ ID NO: 1602736 - DNA, 16 bp, Homo sapiens
aagcctctctctccct

SEQ ID NO: 1602737 - DNA, 19 bp, Homo sapiens
aagcctctctctccctccc

SEQ ID NO: 1602738 - DNA, 19 bp, Homo sapiens
aagcctctgcctccctagc

SEQ ID NO: 1602739 - DNA, 14 bp, Homo sapiens
aagcctctgctgcc

SEQ ID NO: 1602740 - DNA, 12 bp, Homo sapiens
aagcctctggct

SEQ ID NO: 1602741 - DNA, 23 bp, Homo sapiens
aagcctctggctagaggccagcc

SEQ ID NO: 1602742 - DNA, 17 bp, Homo sapiens
aagcctgaactgaggcc

SEQ ID NO: 1602743 - DNA, 15 bp, Homo sapiens
aagcctgaagagctt

SEQ ID NO: 1602744 - DNA, 17 bp, Homo sapiens
aagcctgcaatttcata

SEQ ID NO: 1602745 - DNA, 19 bp, Homo sapiens
aagcctgctggctgcggcc

SEQ ID NO: 1602746 - DNA, 21 bp, Homo sapiens
aagcctgctggctgcggcccc

SEQ ID NO: 1602747 - DNA, 13 bp, Homo sapiens
aagcctggattcc

SEQ ID NO: 1602748 - DNA, 22 bp, Homo sapiens
aagccttcaaaactatagcttg

SEQ ID NO: 1602749 - DNA, 19 bp, Homo sapiens
aagccttctggatccatgg

SEQ ID NO: 1602750 - DNA, 18 bp, Homo sapiens
aagcctttgttgaactgt

SEQ ID NO: 1602751 - DNA, 21 bp, Homo sapiens
aagcgaaggaacctctcgcca

SEQ ID NO: 1602752 - DNA, 22 bp, Homo sapiens
aagcgaagtctttgccttctct

SEQ ID NO: 1602753 - DNA, 18 bp, Homo sapiens
aagcgcccacccaggtcc

SEQ ID NO: 1602754 - DNA, 15 bp, Homo sapiens
aagcgcctattgttt

SEQ ID NO: 1602755 - DNA, 17 bp, Homo sapiens
aagcggagagagccaag

SEQ ID NO: 1602756 - DNA, 18 bp, Homo sapiens
aagcggagagagccaaga

SEQ ID NO: 1602757 - DNA, 22 bp, Homo sapiens
aagcggggcttcatctgcaaag

SEQ ID NO: 1602758 - DNA, 22 bp, Homo sapiens
aagcggtggataactagccaga

SEQ ID NO: 1602759 - DNA, 12 bp, Homo sapiens
aagctaaaagga

SEQ ID NO: 1602760 - DNA, 15 bp, Homo sapiens
aagctaaaatgttac

SEQ ID NO: 1602761 - DNA, 11 bp, Homo sapiens
aagctaaagag

SEQ ID NO: 1602762 - DNA, 18 bp, Homo sapiens
aagctaaattttgttact

SEQ ID NO: 1602763 - DNA, 14 bp, Homo sapiens
aagctaatgtgcag

SEQ ID NO: 1602764 - DNA, 16 bp, Homo sapiens
aagctagacacatgaa

SEQ ID NO: 1602765 - DNA, 20 bp, Homo sapiens
aagctagacacatgaaggta

SEQ ID NO: 1602766 - DNA, 22 bp, Homo sapiens
aagctagacacatgaaggtaaa

SEQ ID NO: 1602767 - DNA, 23 bp, Homo sapiens
aagctagatacgaaatcagtttc

SEQ ID NO: 1602768 - DNA, 14 bp, Homo sapiens
aagctaggaatgaa

SEQ ID NO: 1602769 - DNA, 19 bp, Homo sapiens
aagctaggccccagaggcc

SEQ ID NO: 1602770 - DNA, 19 bp, Homo sapiens
aagctagggtggcccttgc

SEQ ID NO: 1602771 - DNA, 22 bp, Homo sapiens
aagctagggtggcccttgcagt

SEQ ID NO: 1602772 - DNA, 20 bp, Homo sapiens
aagctataaagcagtatttt

SEQ ID NO: 1602773 - DNA, 19 bp, Homo sapiens
aagctataaagtatatatt

SEQ ID NO: 1602774 - DNA, 12 bp, Homo sapiens
aagctatatcta

SEQ ID NO: 1602775 - DNA, 19 bp, Homo sapiens
aagctatatctatttgaga

SEQ ID NO: 1602776 - DNA, 17 bp, Homo sapiens
aagctatccaaataact

SEQ ID NO: 1602777 - DNA, 21 bp, Homo sapiens
aagctattccctcaaatctga

SEQ ID NO: 1602778 - DNA, 15 bp, Homo sapiens
aagctattggaattt

SEQ ID NO: 1602779 - DNA, 18 bp, Homo sapiens
aagctatttaaagcatct

SEQ ID NO: 1602780 - DNA, 20 bp, Homo sapiens
aagctcaaaggtttggaagg

SEQ ID NO: 1602781 - DNA, 22 bp, Homo sapiens
aagctcaaagtatgcaatgctt

SEQ ID NO: 1602782 - DNA, 19 bp, Homo sapiens
aagctcaaatgaaatgtat

SEQ ID NO: 1602783 - DNA, 20 bp, Homo sapiens
aagctcaagatgacagctct

SEQ ID NO: 1602784 - DNA, 16 bp, Homo sapiens
aagctcaattcaagtg

SEQ ID NO: 1602785 - DNA, 11 bp, Homo sapiens
aagctcagcct

SEQ ID NO: 1602786 - DNA, 18 bp, Homo sapiens
aagctcagccttctcctc

SEQ ID NO: 1602787 - DNA, 13 bp, Homo sapiens
aagctccaagccc

SEQ ID NO: 1602788 - DNA, 19 bp, Homo sapiens
aagctccacggtgcgtggc

SEQ ID NO: 1602789 - DNA, 23 bp, Homo sapiens
aagctccacggtgcgtggctgtg

SEQ ID NO: 1602790 - DNA, 16 bp, Homo sapiens
aagctcctctccccag

SEQ ID NO: 1602791 - DNA, 21 bp, Homo sapiens
aagctctactgaggtgctatg

SEQ ID NO: 1602792 - DNA, 15 bp, Homo sapiens
aagctctattaagat

SEQ ID NO: 1602793 - DNA, 15 bp, Homo sapiens
aagctctctgcatct

SEQ ID NO: 1602794 - DNA, 15 bp, Homo sapiens
aagctctctgggcct

SEQ ID NO: 1602795 - DNA, 15 bp, Homo sapiens
aagctctgaagaact

SEQ ID NO: 1602796 - DNA, 22 bp, Homo sapiens
aagctctgaagtcacatcacag

SEQ ID NO: 1602797 - DNA, 16 bp, Homo sapiens
aagctctgaccacttg

SEQ ID NO: 1602798 - DNA, 21 bp, Homo sapiens
aagctctggctgaaccctgtg

SEQ ID NO: 1602799 - DNA, 24 bp, Homo sapiens
aagctctggctgaaccctgtgctg

SEQ ID NO: 1602800 - DNA, 19 bp, Homo sapiens
aagaggcgtctgtatattt

SEQ ID NO: 1602801 - DNA, 17 bp, Homo sapiens
aagaggctgcccctctc

SEQ ID NO: 1602802 - DNA, 23 bp, Homo sapiens
aagaggctgcccctctcaccaaa

SEQ ID NO: 1602803 - DNA, 18 bp, Homo sapiens
aagagggagaagcatgaa

SEQ ID NO: 1602804 - DNA, 12 bp, Homo sapiens
aagagggcctgt

SEQ ID NO: 1602805 - DNA, 19 bp, Homo sapiens
aagagggcctgtgggagcc

SEQ ID NO: 1602806 - DNA, 14 bp, Homo sapiens
aagaggggaaaaca

SEQ ID NO: 1602807 - DNA, 15 bp, Homo sapiens
aagaggggcagccct

SEQ ID NO: 1602808 - DNA, 16 bp, Homo sapiens
aagagggggtggaggg

SEQ ID NO: 1602809 - DNA, 14 bp, Homo sapiens
aagaggggtggaga

SEQ ID NO: 1602810 - DNA, 15 bp, Homo sapiens
aagaggggtggagac

SEQ ID NO: 1602811 - DNA, 15 bp, Homo sapiens
aagaggtataaagct

SEQ ID NO: 1602812 - DNA, 21 bp, Homo sapiens
aagaggtatttatctttactt

SEQ ID NO: 1602813 - DNA, 15 bp, Homo sapiens
aagaggtctgagccc

SEQ ID NO: 1602814 - DNA, 18 bp, Homo sapiens
aagaggtctgagccctgg

SEQ ID NO: 1602815 - DNA, 22 bp, Homo sapiens
aagaggtctgagccctggtgtg

SEQ ID NO: 1602816 - DNA, 15 bp, Homo sapiens
aagaggtctgattgg

SEQ ID NO: 1602817 - DNA, 16 bp, Homo sapiens
aagaggtctgattggc

SEQ ID NO: 1602818 - DNA, 17 bp, Homo sapiens
aagaggtgggagggccc

SEQ ID NO: 1602819 - DNA, 22 bp, Homo sapiens
aagaggtgtgggtgtctgtttg

SEQ ID NO: 1602820 - DNA, 21 bp, Homo sapiens
aagaggttactttagttagca

SEQ ID NO: 1602821 - DNA, 23 bp, Homo sapiens
aagaggttgggcttccatgcctg

SEQ ID NO: 1602822 - DNA, 15 bp, Homo sapiens
aagagtatccttcct

SEQ ID NO: 1602823 - DNA, 18 bp, Homo sapiens
aagagtatccttccttca

SEQ ID NO: 1602824 - DNA, 17 bp, Homo sapiens
aagagtccggatttcta

SEQ ID NO: 1602825 - DNA, 22 bp, Homo sapiens
aagagtctaaaccccagattct

SEQ ID NO: 1602826 - DNA, 24 bp, Homo sapiens
aagagtctaaagatggagtttcta

SEQ ID NO: 1602827 - DNA, 14 bp, Homo sapiens
aagagtctagattc

SEQ ID NO: 1602828 - DNA, 23 bp, Homo sapiens
aagagtctagattcaaaggttct

SEQ ID NO: 1602829 - DNA, 13 bp, Homo sapiens
aagagtctttctt

SEQ ID NO: 1602830 - DNA, 22 bp, Homo sapiens
aagagtgacagtggattgcatt

SEQ ID NO: 1602831 - DNA, 21 bp, Homo sapiens
aagagtgattgcagctttatg

SEQ ID NO: 1602832 - DNA, 12 bp, Homo sapiens
aagagtggagga

SEQ ID NO: 1602833 - DNA, 13 bp, Homo sapiens
aagagtgttcttt

SEQ ID NO: 1602834 - DNA, 15 bp, Homo sapiens
aagagttaagaatgt

SEQ ID NO: 1602835 - DNA, 20 bp, Homo sapiens
aagagttacaataaagttta

SEQ ID NO: 1602836 - DNA, 16 bp, Homo sapiens
aagagttcccttgaaa

SEQ ID NO: 1602837 - DNA, 23 bp, Homo sapiens
aagagttcttaaggattgtgata

SEQ ID NO: 1602838 - DNA, 20 bp, Homo sapiens
aagagttgctttgccagagc

SEQ ID NO: 1602839 - DNA, 23 bp, Homo sapiens
aagagttgctttgccagagcagg

SEQ ID NO: 1602840 - DNA, 19 bp, Homo sapiens
aagagttggggacagaact

SEQ ID NO: 1602841 - DNA, 13 bp, Homo sapiens
aagagtttcttgt

SEQ ID NO: 1602842 - DNA, 19 bp, Homo sapiens
aagataaaatatcctcagg

SEQ ID NO: 1602843 - DNA, 17 bp, Homo sapiens
aagataaacctggagat

SEQ ID NO: 1602844 - DNA, 12 bp, Homo sapiens
aagataaatgtg

SEQ ID NO: 1602845 - DNA, 20 bp, Homo sapiens
aagataacaagatctttcag

SEQ ID NO: 1602846 - DNA, 21 bp, Homo sapiens
aagataacaagatctttcagg

SEQ ID NO: 1602847 - DNA, 22 bp, Homo sapiens
aagataacaagatctttcagga

SEQ ID NO: 1602848 - DNA, 16 bp, Homo sapiens
aagataacttactgta

SEQ ID NO: 1602849 - DNA, 18 bp, Homo sapiens
aagataacttactgtata

SEQ ID NO: 1602850 - DNA, 15 bp, Homo sapiens
aagataacttgagca

SEQ ID NO: 1602851 - DNA, 15 bp, Homo sapiens
aagataataatatat

SEQ ID NO: 1602852 - DNA, 20 bp, Homo sapiens
aagataatgttctttaatgt

SEQ ID NO: 1602853 - DNA, 18 bp, Homo sapiens
aagatacaaaagcttttt

SEQ ID NO: 1602854 - DNA, 18 bp, Homo sapiens
aagatacagacattcaat

SEQ ID NO: 1602855 - DNA, 19 bp, Homo sapiens
aagatacataaaagtgctt

SEQ ID NO: 1602856 - DNA, 18 bp, Homo sapiens
aagatttgttactgtatt

SEQ ID NO: 1602857 - DNA, 19 bp, Homo sapiens
aagatttgttactgtattt

SEQ ID NO: 1602858 - DNA, 19 bp, Homo sapiens
aagattttagggcttttat

SEQ ID NO: 1602859 - DNA, 23 bp, Homo sapiens
aagattttattgtataaaaagtt

SEQ ID NO: 1602860 - DNA, 13 bp, Homo sapiens
aagattttcagaa

SEQ ID NO: 1602861 - DNA, 21 bp, Homo sapiens
aagattttgatctcacatttt

SEQ ID NO: 1602862 - DNA, 15 bp, Homo sapiens
aagatttttactaat

SEQ ID NO: 1602863 - DNA, 21 bp, Homo sapiens
aagatttttactaatatatat

SEQ ID NO: 1602864 - DNA, 21 bp, Homo sapiens
aagcaaaaatgacaacagaaa

SEQ ID NO: 1602865 - DNA, 21 bp, Homo sapiens
aagcaaaacatctctgcagtt

SEQ ID NO: 1602866 - DNA, 13 bp, Homo sapiens
aagcaaaagaaaa

SEQ ID NO: 1602867 - DNA, 14 bp, Homo sapiens
aagcaaaaggctga

SEQ ID NO: 1602868 - DNA, 18 bp, Homo sapiens
aagcaaaaggctgagaag

SEQ ID NO: 1602869 - DNA, 21 bp, Homo sapiens
aagcaaaaggctgagaaggaa

SEQ ID NO: 1602870 - DNA, 13 bp, Homo sapiens
aagcaaaatatta

SEQ ID NO: 1602871 - DNA, 14 bp, Homo sapiens
aagcaaaatattat

SEQ ID NO: 1602872 - DNA, 15 bp, Homo sapiens
aagcaaaatgtctct

SEQ ID NO: 1602873 - DNA, 11 bp, Homo sapiens
aagcaaagatg

SEQ ID NO: 1602874 - DNA, 12 bp, Homo sapiens
aagcaaagggga

SEQ ID NO: 1602875 - DNA, 18 bp, Homo sapiens
aagcaaaggggacagctg

SEQ ID NO: 1602876 - DNA, 19 bp, Homo sapiens
aagcaaatcatttgtttaa

SEQ ID NO: 1602877 - DNA, 17 bp, Homo sapiens
aagcaaattgctttttt

SEQ ID NO: 1602878 - DNA, 19 bp, Homo sapiens
aagcaacaaagagcgagtc

SEQ ID NO: 1602879 - DNA, 12 bp, Homo sapiens
aagcaacaaatt

SEQ ID NO: 1602880 - DNA, 14 bp, Homo sapiens
aagcaacaggtttt

SEQ ID NO: 1602881 - DNA, 17 bp, Homo sapiens
aagcaacttcatttgac

SEQ ID NO: 1602882 - DNA, 15 bp, Homo sapiens
aagcaagagagatgt

SEQ ID NO: 1602883 - DNA, 18 bp, Homo sapiens
aagcaagagagatgtttt

SEQ ID NO: 1602884 - DNA, 17 bp, Homo sapiens
aagcaagatgttttgta

SEQ ID NO: 1602885 - DNA, 20 bp, Homo sapiens
aagcaagtaaaaaggctaaa

SEQ ID NO: 1602886 - DNA, 19 bp, Homo sapiens
aagcaagtagctttccaca

SEQ ID NO: 1602887 - DNA, 22 bp, Homo sapiens
aagcaagtcccttcagactggc

SEQ ID NO: 1602888 - DNA, 14 bp, Homo sapiens
aagcaataaatgaa

SEQ ID NO: 1602889 - DNA, 22 bp, Homo sapiens
aagcaataactatttttcctca

SEQ ID NO: 1602890 - DNA, 18 bp, Homo sapiens
aagcaatacgtttgtgca

SEQ ID NO: 1602891 - DNA, 20 bp, Homo sapiens
aagcaatacgtttgtgcaga

SEQ ID NO: 1602892 - DNA, 21 bp, Homo sapiens
aagcaatacgtttgtgcagaa

SEQ ID NO: 1602893 - DNA, 23 bp, Homo sapiens
aagcaatacgtttgtgcagaatc

SEQ ID NO: 1602894 - DNA, 16 bp, Homo sapiens
aagcaatctttgaaat

SEQ ID NO: 1602895 - DNA, 18 bp, Homo sapiens
aagcaatctttgaaataa

SEQ ID NO: 1602896 - DNA, 14 bp, Homo sapiens
aagcaatgatgacc

SEQ ID NO: 1602897 - DNA, 23 bp, Homo sapiens
aagcaatgtgagtcccagagccc

SEQ ID NO: 1602898 - DNA, 17 bp, Homo sapiens
aagcaatgtgttttttc

SEQ ID NO: 1602899 - DNA, 20 bp, Homo sapiens
aagcaattaggtagcacagc

SEQ ID NO: 1602900 - DNA, 17 bp, Homo sapiens
aagcaattatttttaaa

SEQ ID NO: 1602901 - DNA, 12 bp, Homo sapiens
aagcaattctga

SEQ ID NO: 1602902 - DNA, 15 bp, Homo sapiens
aagcaattctgactg

SEQ ID NO: 1602903 - DNA, 22 bp, Homo sapiens
aagcaattctgactgtccagga

SEQ ID NO: 1602904 - DNA, 15 bp, Homo sapiens
aagcaattgccctgt

SEQ ID NO: 1602905 - DNA, 14 bp, Homo sapiens
aagcacaataacta

SEQ ID NO: 1602906 - DNA, 19 bp, Homo sapiens
aagcacacacaataaagaa

SEQ ID NO: 1602907 - DNA, 15 bp, Homo sapiens
aagcacacacatctg

SEQ ID NO: 1602908 - DNA, 15 bp, Homo sapiens
aagcacagaatattt

SEQ ID NO: 1602909 - DNA, 16 bp, Homo sapiens
aagcacagaatatttt

SEQ ID NO: 1602910 - DNA, 17 bp, Homo sapiens
aagcacagatttgcatt

SEQ ID NO: 1602911 - DNA, 15 bp, Homo sapiens
aagcacagctgggca

SEQ ID NO: 1602912 - DNA, 16 bp, Homo sapiens
aagcacagctgggcat

SEQ ID NO: 1602913 - DNA, 15 bp, Homo sapiens
aagcacagtgcctgc

SEQ ID NO: 1602914 - DNA, 14 bp, Homo sapiens
aagcacagtttgaa

SEQ ID NO: 1602915 - DNA, 16 bp, Homo sapiens
aagcacagtttgaaca

SEQ ID NO: 1602916 - DNA, 13 bp, Homo sapiens
aagcacctgccga

SEQ ID NO: 1602917 - DNA, 17 bp, Homo sapiens
aagcacctgccgacctc

SEQ ID NO: 1602918 - DNA, 16 bp, Homo sapiens
aagcaccttagctggc

SEQ ID NO: 1602919 - DNA, 19 bp, Homo sapiens
aagcactacaccttgcctt

SEQ ID NO: 1602920 - DNA, 15 bp, Homo sapiens
aagacccccagcact

SEQ ID NO: 1602921 - DNA, 16 bp, Homo sapiens
aagaccctcttgccca

SEQ ID NO: 1602922 - DNA, 21 bp, Homo sapiens
aagaccctcttgcccatcctg

SEQ ID NO: 1602923 - DNA, 22 bp, Homo sapiens
aagaccctcttgcccatcctga

SEQ ID NO: 1602924 - DNA, 15 bp, Homo sapiens
aagaccctggtctga

SEQ ID NO: 1602925 - DNA, 12 bp, Homo sapiens
aagaccctgtgt

SEQ ID NO: 1602926 - DNA, 13 bp, Homo sapiens
aagaccctgtgtc

SEQ ID NO: 1602927 - DNA, 14 bp, Homo sapiens
aagaccgccccagg

SEQ ID NO: 1602928 - DNA, 15 bp, Homo sapiens
aagaccgccccaggg

SEQ ID NO: 1602929 - DNA, 20 bp, Homo sapiens
aagacctactgttctaaagc

SEQ ID NO: 1602930 - DNA, 13 bp, Homo sapiens
aagacctcatctc

SEQ ID NO: 1602931 - DNA, 12 bp, Homo sapiens
aagacctgagta

SEQ ID NO: 1602932 - DNA, 11 bp, Homo sapiens
aagacctgcct

SEQ ID NO: 1602933 - DNA, 15 bp, Homo sapiens
aagacctgcctgtgt

SEQ ID NO: 1602934 - DNA, 21 bp, Homo sapiens
aagacctttggagcaaagctg

SEQ ID NO: 1602935 - DNA, 13 bp, Homo sapiens
aagacgaggggca

SEQ ID NO: 1602936 - DNA, 23 bp, Homo sapiens
aagacggaagtaaattatgatgt

SEQ ID NO: 1602937 - DNA, 22 bp, Homo sapiens
aagactagaggccagggcagca

SEQ ID NO: 1602938 - DNA, 20 bp, Homo sapiens
aagactagaggcttgcataa

SEQ ID NO: 1602939 - DNA, 14 bp, Homo sapiens
aagactatatatat

SEQ ID NO: 1602940 - DNA, 16 bp, Homo sapiens
aagactatctaaatgt

SEQ ID NO: 1602941 - DNA, 18 bp, Homo sapiens
aagactatctaaatgttg

SEQ ID NO: 1602942 - DNA, 14 bp, Homo sapiens
aagactattcaaac

SEQ ID NO: 1602943 - DNA, 20 bp, Homo sapiens
aagactatttcaaaatgtcc

SEQ ID NO: 1602944 - DNA, 14 bp, Homo sapiens
aagactcaaatgtt

SEQ ID NO: 1602945 - DNA, 21 bp, Homo sapiens
aagactcaggagtctgccact

SEQ ID NO: 1602946 - DNA, 14 bp, Homo sapiens
aagactccaaagaa

SEQ ID NO: 1602947 - DNA, 18 bp, Homo sapiens
aagactccctgatcccag

SEQ ID NO: 1602948 - DNA, 22 bp, Homo sapiens
aagactccctgatcccagacct

SEQ ID NO: 1602949 - DNA, 16 bp, Homo sapiens
aagactcgaataaaat

SEQ ID NO: 1602950 - DNA, 12 bp, Homo sapiens
aagactctagag

SEQ ID NO: 1602951 - DNA, 19 bp, Homo sapiens
aagactctagagtccaagg

SEQ ID NO: 1602952 - DNA, 13 bp, Homo sapiens
aagactctggagg

SEQ ID NO: 1602953 - DNA, 17 bp, Homo sapiens
aagactgaacatgttta

SEQ ID NO: 1602954 - DNA, 15 bp, Homo sapiens
aagactgataacaac

SEQ ID NO: 1602955 - DNA, 14 bp, Homo sapiens
aagactgccaggtg

SEQ ID NO: 1602956 - DNA, 17 bp, Homo sapiens
aagactgtagatatgta

SEQ ID NO: 1602957 - DNA, 13 bp, Homo sapiens
aagactgtgcaga

SEQ ID NO: 1602958 - DNA, 14 bp, Homo sapiens
aagactgtgcagaa

SEQ ID NO: 1602959 - DNA, 24 bp, Homo sapiens
aagactgttgctcaaatctattca

SEQ ID NO: 1602960 - DNA, 17 bp, Homo sapiens
aagacttaaaagagctc

SEQ ID NO: 1602961 - DNA, 17 bp, Homo sapiens
aagacttactctaagat

SEQ ID NO: 1602962 - DNA, 16 bp, Homo sapiens
aagacttgagccatcc

SEQ ID NO: 1602963 - DNA, 13 bp, Homo sapiens
aagagaaaatatt

SEQ ID NO: 1602964 - DNA, 21 bp, Homo sapiens
aagagaaaatgtaaaggaggg

SEQ ID NO: 1602965 - DNA, 20 bp, Homo sapiens
aagagaaacagttggtaact

SEQ ID NO: 1602966 - DNA, 15 bp, Homo sapiens
aagagaaactgtgta

SEQ ID NO: 1602967 - DNA, 16 bp, Homo sapiens
aagagaaccgagcaaa

SEQ ID NO: 1602968 - DNA, 11 bp, Homo sapiens
aagagaactcg

SEQ ID NO: 1602969 - DNA, 20 bp, Homo sapiens
aagagaactcgcgctcagta

SEQ ID NO: 1602970 - DNA, 16 bp, Homo sapiens
aagagaagacgaaata

SEQ ID NO: 1602971 - DNA, 14 bp, Homo sapiens
aagagaagctgctg

SEQ ID NO: 1602972 - DNA, 17 bp, Homo sapiens
aagagaagctgctgacc

SEQ ID NO: 1602973 - DNA, 16 bp, Homo sapiens
aagagaaggcacacag

SEQ ID NO: 1602974 - DNA, 18 bp, Homo sapiens
aagagaagggcagggctg

SEQ ID NO: 1602975 - DNA, 20 bp, Homo sapiens
aagagaaggtggacctggca

SEQ ID NO: 1602976 - DNA, 18 bp, Homo sapiens
aagagaagtctcattcgc

SEQ ID NO: 1602977 - DNA, 17 bp, Homo sapiens
aagagaagtgagtggtg

SEQ ID NO: 1602978 - DNA, 16 bp, Homo sapiens
aagagaatctgatcaa

SEQ ID NO: 1602979 - DNA, 11 bp, Homo sapiens
aagagaatgag

SEQ ID NO: 1602980 - DNA, 18 bp, Homo sapiens
aagagaatgtattctgta

SEQ ID NO: 1602981 - DNA, 17 bp, Homo sapiens
aagagaattcagtattt

SEQ ID NO: 1602982 - DNA, 18 bp, Homo sapiens
aacttcccagtgaattct

SEQ ID NO: 1602983 - DNA, 14 bp, Homo sapiens
aacttccgctgagg

SEQ ID NO: 1602984 - DNA, 22 bp, Homo sapiens
aacttcctcccttacagagcat

SEQ ID NO: 1602985 - DNA, 13 bp, Homo sapiens
aacttcctgctgc

SEQ ID NO: 1602986 - DNA, 14 bp, Homo sapiens
aacttcctgctgca

SEQ ID NO: 1602987 - DNA, 17 bp, Homo sapiens
aacttcctgctgcaccc

SEQ ID NO: 1602988 - DNA, 16 bp, Homo sapiens
aacttcgctagaaaaa

SEQ ID NO: 1602989 - DNA, 16 bp, Homo sapiens
aacttctatattttaa

SEQ ID NO: 1602990 - DNA, 22 bp, Homo sapiens
aacttctgcaacaagcatgcag

SEQ ID NO: 1602991 - DNA, 22 bp, Homo sapiens
aacttcttaaaccatttttgct

SEQ ID NO: 1602992 - DNA, 12 bp, Homo sapiens
aacttcttgctt

SEQ ID NO: 1602993 - DNA, 21 bp, Homo sapiens
aacttctttttaatcttaaga

SEQ ID NO: 1602994 - DNA, 14 bp, Homo sapiens
aacttgaagcagtc

SEQ ID NO: 1602995 - DNA, 16 bp, Homo sapiens
aacttgaatgtgtcag

SEQ ID NO: 1602996 - DNA, 17 bp, Homo sapiens
aacttgacaccactaag

SEQ ID NO: 1602997 - DNA, 19 bp, Homo sapiens
aacttgaccctgagcttaa

SEQ ID NO: 1602998 - DNA, 16 bp, Homo sapiens
aacttgactccatttc

SEQ ID NO: 1602999 - DNA, 21 bp, Homo sapiens
aacttgactgggtgagaccca

SEQ ID NO: 1603000 - DNA, 20 bp, Homo sapiens
aacttgagatgtatgaaggc

SEQ ID NO: 1603001 - DNA, 22 bp, Homo sapiens
aacttgagatgtatgaaggctt

SEQ ID NO: 1603002 - DNA, 19 bp, Homo sapiens
aacttgagcgtgaatctgt

SEQ ID NO: 1603003 - DNA, 23 bp, Homo sapiens
aacttgatgttccacctgccaca

SEQ ID NO: 1603004 - DNA, 14 bp, Homo sapiens
aacttgcctttgaa

SEQ ID NO: 1603005 - DNA, 15 bp, Homo sapiens
aacttgctgctgcct

SEQ ID NO: 1603006 - DNA, 19 bp, Homo sapiens
aacttgcttaaatttctta

SEQ ID NO: 1603007 - DNA, 23 bp, Homo sapiens
aacttggaaaaatccagaaagaa

SEQ ID NO: 1603008 - DNA, 15 bp, Homo sapiens
aacttggagccccag

SEQ ID NO: 1603009 - DNA, 16 bp, Homo sapiens
aacttggatgagtttt

SEQ ID NO: 1603010 - DNA, 22 bp, Homo sapiens
aacttggctcgaatctctgtgc

SEQ ID NO: 1603011 - DNA, 23 bp, Homo sapiens
aacttggctcgaatctctgtgcc

SEQ ID NO: 1603012 - DNA, 13 bp, Homo sapiens
aacttggggaggc

SEQ ID NO: 1603013 - DNA, 22 bp, Homo sapiens
aacttggggagttaagacctgg

SEQ ID NO: 1603014 - DNA, 16 bp, Homo sapiens
aacttggtcagagcca

SEQ ID NO: 1603015 - DNA, 13 bp, Homo sapiens
aacttgtaaaaag

SEQ ID NO: 1603016 - DNA, 15 bp, Homo sapiens
aacttgtactatgtt

SEQ ID NO: 1603017 - DNA, 19 bp, Homo sapiens
aacttgtatattccaccat

SEQ ID NO: 1603018 - DNA, 14 bp, Homo sapiens
aacttgtatttcca

SEQ ID NO: 1603019 - DNA, 17 bp, Homo sapiens
aacttgtgagcatcaga

SEQ ID NO: 1603020 - DNA, 14 bp, Homo sapiens
aactttaaatcttt

SEQ ID NO: 1603021 - DNA, 12 bp, Homo sapiens
aactttaatcaa

SEQ ID NO: 1603022 - DNA, 21 bp, Homo sapiens
aactttaattctctttcaaag

SEQ ID NO: 1603023 - DNA, 19 bp, Homo sapiens
aactttataaatccagtga

SEQ ID NO: 1603024 - DNA, 22 bp, Homo sapiens
aactttatacccagaaagttat

SEQ ID NO: 1603025 - DNA, 23 bp, Homo sapiens
aactttatcatggaatttaatgc

SEQ ID NO: 1603026 - DNA, 18 bp, Homo sapiens
aaccaatcccgtgaaaga

SEQ ID NO: 1603027 - DNA, 13 bp, Homo sapiens
aaccaatgaagaa

SEQ ID NO: 1603028 - DNA, 23 bp, Homo sapiens
aaccaatgcctttttagatgtat

SEQ ID NO: 1603029 - DNA, 20 bp, Homo sapiens
aaccaattcaccaacacagt

SEQ ID NO: 1603030 - DNA, 14 bp, Homo sapiens
aaccacaactgaca

SEQ ID NO: 1603031 - DNA, 20 bp, Homo sapiens
aaccacaactgacacaggaa

SEQ ID NO: 1603032 - DNA, 17 bp, Homo sapiens
aaccacaatgtttcttc

SEQ ID NO: 1603033 - DNA, 20 bp, Homo sapiens
aaccacaatgtttcttcatt

SEQ ID NO: 1603034 - DNA, 19 bp, Homo sapiens
aaccacacttgaaaccttt

SEQ ID NO: 1603035 - DNA, 12 bp, Homo sapiens
aaccacagcagt

SEQ ID NO: 1603036 - DNA, 12 bp, Homo sapiens
aaccacagctgg

SEQ ID NO: 1603037 - DNA, 20 bp, Homo sapiens
aaccacagtcagtggagaga

SEQ ID NO: 1603038 - DNA, 14 bp, Homo sapiens
aaccacggaaaaga

SEQ ID NO: 1603039 - DNA, 13 bp, Homo sapiens
aaccactgaaaaa

SEQ ID NO: 1603040 - DNA, 14 bp, Homo sapiens
aaccactgcaacgg

SEQ ID NO: 1603041 - DNA, 17 bp, Homo sapiens
aaccactgcttctcttt

SEQ ID NO: 1603042 - DNA, 14 bp, Homo sapiens
aaccactgtgccac

SEQ ID NO: 1603043 - DNA, 22 bp, Homo sapiens
aaccagaaacacccctctgtct

SEQ ID NO: 1603044 - DNA, 11 bp, Homo sapiens
aaccagcaggt

SEQ ID NO: 1603045 - DNA, 19 bp, Homo sapiens
aaccagccacagtacatat

SEQ ID NO: 1603046 - DNA, 20 bp, Homo sapiens
aaccagccacagtacatatg

SEQ ID NO: 1603047 - DNA, 12 bp, Homo sapiens
aaccagccaggc

SEQ ID NO: 1603048 - DNA, 11 bp, Homo sapiens
aaccagctgct

SEQ ID NO: 1603049 - DNA, 16 bp, Homo sapiens
aaccaggcacctcttc

SEQ ID NO: 1603050 - DNA, 18 bp, Homo sapiens
aaccaggcacctcttcct

SEQ ID NO: 1603051 - DNA, 18 bp, Homo sapiens
aaccagggaagctgtccc

SEQ ID NO: 1603052 - DNA, 13 bp, Homo sapiens
aaccagggaggag

SEQ ID NO: 1603053 - DNA, 17 bp, Homo sapiens
aaccagggaggagagga

SEQ ID NO: 1603054 - DNA, 22 bp, Homo sapiens
aaccagtccccccaccctcatt

SEQ ID NO: 1603055 - DNA, 23 bp, Homo sapiens
aaccagtggccggttgccactct

SEQ ID NO: 1603056 - DNA, 18 bp, Homo sapiens
aaccagtgtacaggtcac

SEQ ID NO: 1603057 - DNA, 17 bp, Homo sapiens
aaccagttaaagccaca

SEQ ID NO: 1603058 - DNA, 12 bp, Homo sapiens
aaccatagttac

SEQ ID NO: 1603059 - DNA, 18 bp, Homo sapiens
aaccatatgattgaaaag

SEQ ID NO: 1603060 - DNA, 20 bp, Homo sapiens
aaccatatgattgaaaagaa

SEQ ID NO: 1603061 - DNA, 23 bp, Homo sapiens
aaccatatgattgaaaagaagaa

SEQ ID NO: 1603062 - DNA, 20 bp, Homo sapiens
aaccatccagtgacaaacca

SEQ ID NO: 1603063 - DNA, 15 bp, Homo sapiens
aaccattaaagtcag

SEQ ID NO: 1603064 - DNA, 22 bp, Homo sapiens
aaccattcaaatgacgcctgat

SEQ ID NO: 1603065 - DNA, 13 bp, Homo sapiens
aaccatttatctt

SEQ ID NO: 1603066 - DNA, 21 bp, Homo sapiens
aaccatttccaacagcaacac

SEQ ID NO: 1603067 - DNA, 13 bp, Homo sapiens
aaccatttttgct

SEQ ID NO: 1603068 - DNA, 16 bp, Homo sapiens
aaccatttttgctgaa

SEQ ID NO: 1603069 - DNA, 13 bp, Homo sapiens
aacccaaaccatg

SEQ ID NO: 1603070 - DNA, 15 bp, Homo sapiens
aacccaagtgcctca

SEQ ID NO: 1603071 - DNA, 19 bp, Homo sapiens
aacccaagtgctgcacaaa

SEQ ID NO: 1603072 - DNA, 17 bp, Homo sapiens
aacccacagctcagctg

SEQ ID NO: 1603073 - DNA, 19 bp, Homo sapiens
aacccaccagcctaagaag

SEQ ID NO: 1603074 - DNA, 14 bp, Homo sapiens
aacccacctgctga

SEQ ID NO: 1603075 - DNA, 18 bp, Homo sapiens
aacccagactcagacatt

SEQ ID NO: 1603076 - DNA, 11 bp, Homo sapiens
aacccagagag

SEQ ID NO: 1603077 - DNA, 12 bp, Homo sapiens
aacccagagagg

SEQ ID NO: 1603078 - DNA, 16 bp, Homo sapiens
aacccagcaacagaaa

SEQ ID NO: 1603079 - DNA, 23 bp, Homo sapiens
aacccagcaacagaaaaatggag

SEQ ID NO: 1603080 - DNA, 16 bp, Homo sapiens
aacccagtctcctctc

SEQ ID NO: 1603081 - DNA, 19 bp, Homo sapiens
aacccagtctcctctccat

SEQ ID NO: 1603082 - DNA, 16 bp, Homo sapiens
aacccagtttcccgtc

SEQ ID NO: 1603083 - DNA, 16 bp, Homo sapiens
aacccatacaatgtat

SEQ ID NO: 1603084 - DNA, 21 bp, Homo sapiens
aacccatacaatgtatgtaca

SEQ ID NO: 1603085 - DNA, 15 bp, Homo sapiens
aacccatgagattca

SEQ ID NO: 1603086 - DNA, 20 bp, Homo sapiens
aacccatttgtctctacttt

SEQ ID NO: 1603087 - DNA, 17 bp, Homo sapiens
aacccatttttgagcca

SEQ ID NO: 1603088 - DNA, 15 bp, Homo sapiens
aaccccaacgcacag

SEQ ID NO: 1603089 - DNA, 19 bp, Homo sapiens
aaccccaaggactgagggc

SEQ ID NO: 1603090 - DNA, 20 bp, Homo sapiens
aaccccaaggactgagggca

SEQ ID NO: 1603091 - DNA, 14 bp, Homo sapiens
aaccccagcatcct

SEQ ID NO: 1603092 - DNA, 17 bp, Homo sapiens
aaccccagggcccccac

SEQ ID NO: 1603093 - DNA, 20 bp, Homo sapiens
aacccccaaaatccaaaact

SEQ ID NO: 1603094 - DNA, 17 bp, Homo sapiens
aacccccaccccacact

SEQ ID NO: 1603095 - DNA, 21 bp, Homo sapiens
aacccccagctaataaaccag

SEQ ID NO: 1603096 - DNA, 18 bp, Homo sapiens
aaccccccagcactgagg

SEQ ID NO: 1603097 - DNA, 13 bp, Homo sapiens
aaccccccagctc

SEQ ID NO: 1603098 - DNA, 15 bp, Homo sapiens
aacccccctcctgct

SEQ ID NO: 1603099 - DNA, 16 bp, Homo sapiens
aacccccctcctgctc

SEQ ID NO: 1603100 - DNA, 19 bp, Homo sapiens
aacccccctcctgctcctc

SEQ ID NO: 1603101 - DNA, 18 bp, Homo sapiens
aacccccgccacctcagg

SEQ ID NO: 1603102 - DNA, 18 bp, Homo sapiens
aaccccctccctgtccca

SEQ ID NO: 1603103 - DNA, 15 bp, Homo sapiens
aaccccgcagcccgt

SEQ ID NO: 1603104 - DNA, 17 bp, Homo sapiens
aaccccgcggtgctctg

SEQ ID NO: 1603105 - DNA, 19 bp, Homo sapiens
aaccccgcggtgctctggc

SEQ ID NO: 1603106 - DNA, 23 bp, Homo sapiens
aacccctctcaggtaccttttct

SEQ ID NO: 1603107 - DNA, 21 bp, Homo sapiens
aacccctgatgtttgaagagt

SEQ ID NO: 1603108 - DNA, 12 bp, Homo sapiens
aacccctggcca

SEQ ID NO: 1603109 - DNA, 10 bp, Homo sapiens
aacccctgtg

SEQ ID NO: 1603110 - DNA, 11 bp, Homo sapiens
aacccctgtgt

SEQ ID NO: 1603111 - DNA, 23 bp, Homo sapiens
aacccgggagcggaggttgcagt

SEQ ID NO: 1603112 - DNA, 23 bp, Homo sapiens
aaccctatcctaattgtccacat

SEQ ID NO: 1603113 - DNA, 19 bp, Homo sapiens
aaccctatctcctgacaga

SEQ ID NO: 1603114 - DNA, 16 bp, Homo sapiens
aaccctcccagaaaca

SEQ ID NO: 1603115 - DNA, 21 bp, Homo sapiens
aaccctcccagaaacatctct

SEQ ID NO: 1603116 - DNA, 12 bp, Homo sapiens
aaccctcctggg

SEQ ID NO: 1603117 - DNA, 16 bp, Homo sapiens
aaccctcctgggaagg

SEQ ID NO: 1603118 - DNA, 20 bp, Homo sapiens
aactcgcgagtgtaactttc

SEQ ID NO: 1603119 - DNA, 16 bp, Homo sapiens
aactcgcgctcagtaa

SEQ ID NO: 1603120 - DNA, 14 bp, Homo sapiens
aactctaaaagatc

SEQ ID NO: 1603121 - DNA, 15 bp, Homo sapiens
aactctaaccagtgt

SEQ ID NO: 1603122 - DNA, 21 bp, Homo sapiens
aactctaattcccattttgca

SEQ ID NO: 1603123 - DNA, 22 bp, Homo sapiens
aactctacatgtaactatttct

SEQ ID NO: 1603124 - DNA, 16 bp, Homo sapiens
aactctagagagcctt

SEQ ID NO: 1603125 - DNA, 19 bp, Homo sapiens
aactctagagagccttaac

SEQ ID NO: 1603126 - DNA, 21 bp, Homo sapiens
aactctagagagccttaactt

SEQ ID NO: 1603127 - DNA, 13 bp, Homo sapiens
aactctccccagt

SEQ ID NO: 1603128 - DNA, 19 bp, Homo sapiens
aactctccccagtgcctgc

SEQ ID NO: 1603129 - DNA, 14 bp, Homo sapiens
aactctctcccagg

SEQ ID NO: 1603130 - DNA, 15 bp, Homo sapiens
aactctctcccagga

SEQ ID NO: 1603131 - DNA, 14 bp, Homo sapiens
aactctctttcctt

SEQ ID NO: 1603132 - DNA, 13 bp, Homo sapiens
aactctgaagcta

SEQ ID NO: 1603133 - DNA, 23 bp, Homo sapiens
aactctgaatttatctttgataa

SEQ ID NO: 1603134 - DNA, 18 bp, Homo sapiens
aactctgagcccatactt

SEQ ID NO: 1603135 - DNA, 21 bp, Homo sapiens
aactctgcactccatggccac

SEQ ID NO: 1603136 - DNA, 23 bp, Homo sapiens
aactctgcactccatggccaccc

SEQ ID NO: 1603137 - DNA, 21 bp, Homo sapiens
aactctgcctttatgatgcta

SEQ ID NO: 1603138 - DNA, 19 bp, Homo sapiens
aactctggacactctatat

SEQ ID NO: 1603139 - DNA, 21 bp, Homo sapiens
aactctgggctgctacccaga

SEQ ID NO: 1603140 - DNA, 22 bp, Homo sapiens
aactctgggctgctacccagaa

SEQ ID NO: 1603141 - DNA, 13 bp, Homo sapiens
aactctgtataag

SEQ ID NO: 1603142 - DNA, 22 bp, Homo sapiens
aactctgtataagttgaaggaa

SEQ ID NO: 1603143 - DNA, 14 bp, Homo sapiens
aactctgttccccc

SEQ ID NO: 1603144 - DNA, 15 bp, Homo sapiens
aactctgttccccca

SEQ ID NO: 1603145 - DNA, 19 bp, Homo sapiens
aactctgttcccccaccct

SEQ ID NO: 1603146 - DNA, 20 bp, Homo sapiens
aactcttaattagacctagg

SEQ ID NO: 1603147 - DNA, 20 bp, Homo sapiens
aactcttagaagtgttgtaa

SEQ ID NO: 1603148 - DNA, 23 bp, Homo sapiens
aactcttcagaacacacagactt

SEQ ID NO: 1603149 - DNA, 17 bp, Homo sapiens
aactcttgtgaattatt

SEQ ID NO: 1603150 - DNA, 14 bp, Homo sapiens
aactcttttctatt

SEQ ID NO: 1603151 - DNA, 17 bp, Homo sapiens
aactcttttctattttg

SEQ ID NO: 1603152 - DNA, 12 bp, Homo sapiens
aactgaaaagac

SEQ ID NO: 1603153 - DNA, 20 bp, Homo sapiens
aactgaaagcacatgaataa

SEQ ID NO: 1603154 - DNA, 23 bp, Homo sapiens
aactgaaagcacatgaataattt

SEQ ID NO: 1603155 - DNA, 17 bp, Homo sapiens
aactgaaggggtgcacc

SEQ ID NO: 1603156 - DNA, 21 bp, Homo sapiens
aactgaaggggtgcacccacc

SEQ ID NO: 1603157 - DNA, 12 bp, Homo sapiens
aactgaatgaat

SEQ ID NO: 1603158 - DNA, 22 bp, Homo sapiens
aactgaatggaaggtttgtata

SEQ ID NO: 1603159 - DNA, 14 bp, Homo sapiens
aactgaatttggag

SEQ ID NO: 1603160 - DNA, 17 bp, Homo sapiens
aactgaatttgttctta

SEQ ID NO: 1603161 - DNA, 16 bp, Homo sapiens
aactgaattttgggac

SEQ ID NO: 1603162 - DNA, 10 bp, Homo sapiens
aactgacaag

SEQ ID NO: 1603163 - DNA, 17 bp, Homo sapiens
aactgacaagccatctt

SEQ ID NO: 1603164 - DNA, 16 bp, Homo sapiens
aactgacaatgaaggg

SEQ ID NO: 1603165 - DNA, 23 bp, Homo sapiens
aactgacctgaccccattcctga

SEQ ID NO: 1603166 - DNA, 23 bp, Homo sapiens
aactgactattcttgatgtaaaa

SEQ ID NO: 1603167 - DNA, 14 bp, Homo sapiens
aactgacttaatgc

SEQ ID NO: 1603168 - DNA, 11 bp, Homo sapiens
aactgagccta

SEQ ID NO: 1603169 - DNA, 12 bp, Homo sapiens
aactgagcctag

SEQ ID NO: 1603170 - DNA, 20 bp, Homo sapiens
aactgagctgggcaggaagg

SEQ ID NO: 1603171 - DNA, 13 bp, Homo sapiens
aactgaggaattt

SEQ ID NO: 1603172 - DNA, 18 bp, Homo sapiens
aactgaggaattttcttt

SEQ ID NO: 1603173 - DNA, 19 bp, Homo sapiens
aactgaggagatgaccagg

SEQ ID NO: 1603174 - DNA, 20 bp, Homo sapiens
aactgaggagatgaccaggg

SEQ ID NO: 1603175 - DNA, 20 bp, Homo sapiens
aactgaggagcggactcact

SEQ ID NO: 1603176 - DNA, 12 bp, Homo sapiens
aactgaggcaga

SEQ ID NO: 1603177 - DNA, 21 bp, Homo sapiens
aactgaggccttgtgtgtcag

SEQ ID NO: 1603178 - DNA, 23 bp, Homo sapiens
aactgaggccttgtgtgtcaggc

SEQ ID NO: 1603179 - DNA, 18 bp, Homo sapiens
aactgagggccagggacc

SEQ ID NO: 1603180 - DNA, 15 bp, Homo sapiens
aactgatcaaaaata

SEQ ID NO: 1603181 - DNA, 21 bp, Homo sapiens
aactgatccagtataagacta

SEQ ID NO: 1603182 - DNA, 16 bp, Homo sapiens
aactgatcctgctcca

SEQ ID NO: 1603183 - DNA, 21 bp, Homo sapiens
aactgatcctgctccagcagc

SEQ ID NO: 1603184 - DNA, 20 bp, Homo sapiens
aactgatctcaagtatatgt

SEQ ID NO: 1603185 - DNA, 19 bp, Homo sapiens
aactgattcttatgattac

SEQ ID NO: 1603186 - DNA, 18 bp, Homo sapiens
aactgcaaaaaaagcctc

SEQ ID NO: 1603187 - DNA, 20 bp, Homo sapiens
aactgcaaaaaaagcctcca

SEQ ID NO: 1603188 - DNA, 21 bp, Homo sapiens
aactgcaaaaaaagcctccaa

SEQ ID NO: 1603189 - DNA, 15 bp, Homo sapiens
aactgcaaagtgaag

SEQ ID NO: 1603190 - DNA, 23 bp, Homo sapiens
aactgcaatagagactgtagatt

SEQ ID NO: 1603191 - DNA, 19 bp, Homo sapiens
aactgcactgtcaagatga

SEQ ID NO: 1603192 - DNA, 13 bp, Homo sapiens
aactgcaggccct

SEQ ID NO: 1603193 - DNA, 14 bp, Homo sapiens
aactgcaggccctg

SEQ ID NO: 1603194 - DNA, 17 bp, Homo sapiens
aactgcaggccctggcc

SEQ ID NO: 1603195 - DNA, 18 bp, Homo sapiens
aactgcaggccctggcct

SEQ ID NO: 1603196 - DNA, 20 bp, Homo sapiens
aactgcaggccctggcctcc

SEQ ID NO: 1603197 - DNA, 21 bp, Homo sapiens
aactgcatggacctaacattc

SEQ ID NO: 1603198 - DNA, 16 bp, Homo sapiens
aactgcattagaaatt

SEQ ID NO: 1603199 - DNA, 16 bp, Homo sapiens
aactgcccagtttcca

SEQ ID NO: 1603200 - DNA, 15 bp, Homo sapiens
aactgccctaagccc

SEQ ID NO: 1603201 - DNA, 17 bp, Homo sapiens
aactgccctaagccccc

SEQ ID NO: 1603202 - DNA, 17 bp, Homo sapiens
aactgccgtaatttaac

SEQ ID NO: 1603203 - DNA, 16 bp, Homo sapiens
aactgccttggcttca

SEQ ID NO: 1603204 - DNA, 14 bp, Homo sapiens
aactgcgacaaaac

SEQ ID NO: 1603205 - DNA, 14 bp, Homo sapiens
aactgcgaggacat

SEQ ID NO: 1603206 - DNA, 18 bp, Homo sapiens
aactgcgaggacatcaaa

SEQ ID NO: 1603207 - DNA, 17 bp, Homo sapiens
aactgctcagctctggt

SEQ ID NO: 1603208 - DNA, 23 bp, Homo sapiens
aactgctgaaaactagctcgtga

SEQ ID NO: 1603209 - DNA, 15 bp, Homo sapiens
aactgctgagccact

SEQ ID NO: 1603210 - DNA, 10 bp, Homo sapiens
aactgctgca

SEQ ID NO: 1603211 - DNA, 15 bp, Homo sapiens
aactgctgttttatg

SEQ ID NO: 1603212 - DNA, 17 bp, Homo sapiens
aactggaaaacagaaca

SEQ ID NO: 1603213 - DNA, 19 bp, Homo sapiens
aactggaaaacagaacact

SEQ ID NO: 1603214 - DNA, 21 bp, Homo sapiens
aactggaaaggatctgtgatt

SEQ ID NO: 1603215 - DNA, 19 bp, Homo sapiens
aactggaacggtgaaggtg

SEQ ID NO: 1603216 - DNA, 15 bp, Homo sapiens
aactggaagaaagca

SEQ ID NO: 1603217 - DNA, 19 bp, Homo sapiens
aactggactggttcaaatg

SEQ ID NO: 1603218 - DNA, 22 bp, Homo sapiens
aactggatatttcaatctttta

SEQ ID NO: 1603219 - DNA, 23 bp, Homo sapiens
aactggcaggggagacaggagcc

SEQ ID NO: 1603220 - DNA, 17 bp, Homo sapiens
aactggcatctgctcta

SEQ ID NO: 1603221 - DNA, 13 bp, Homo sapiens
aactggcttcccc

SEQ ID NO: 1603222 - DNA, 18 bp, Homo sapiens
aactggcttctgcttgtc

SEQ ID NO: 1603223 - DNA, 22 bp, Homo sapiens
aactggcttctgcttgtcatcc

SEQ ID NO: 1603224 - DNA, 14 bp, Homo sapiens
aactggcttgtaca

SEQ ID NO: 1603225 - DNA, 15 bp, Homo sapiens
aactgggaaactggg

SEQ ID NO: 1603226 - DNA, 17 bp, Homo sapiens
aactgggcatttcaatc

SEQ ID NO: 1603227 - DNA, 18 bp, Homo sapiens
aactgggcatttcaatcc

SEQ ID NO: 1603228 - DNA, 14 bp, Homo sapiens
aactgggttaaata

SEQ ID NO: 1603229 - DNA, 22 bp, Homo sapiens
aactgggttaaatattttgcta

SEQ ID NO: 1603230 - DNA, 21 bp, Homo sapiens
aactgggttacagtgttttat

SEQ ID NO: 1603231 - DNA, 17 bp, Homo sapiens
aactgggttctttggaa

SEQ ID NO: 1603232 - DNA, 18 bp, Homo sapiens
aactgggtttctcattaa

SEQ ID NO: 1603233 - DNA, 21 bp, Homo sapiens
aactggtattctgttctggag

SEQ ID NO: 1603234 - DNA, 17 bp, Homo sapiens
acagtgagcctgaattt

SEQ ID NO: 1603235 - DNA, 21 bp, Homo sapiens
acagtgagcctgaattttgtt

SEQ ID NO: 1603236 - DNA, 12 bp, Homo sapiens
acagtgatgaat

SEQ ID NO: 1603237 - DNA, 14 bp, Homo sapiens
acagtgatgaatgt

SEQ ID NO: 1603238 - DNA, 15 bp, Homo sapiens
acataattgtggatt

SEQ ID NO: 1603239 - DNA, 18 bp, Homo sapiens
acatacaacacaaagaga

SEQ ID NO: 1603240 - DNA, 16 bp, Homo sapiens
acatacaattattttt

SEQ ID NO: 1603241 - DNA, 22 bp, Homo sapiens
acatacacccaaacacttacac

SEQ ID NO: 1603242 - DNA, 15 bp, Homo sapiens
acatacagagtgggc

SEQ ID NO: 1603243 - DNA, 14 bp, Homo sapiens
acatacagatttta

SEQ ID NO: 1603244 - DNA, 15 bp, Homo sapiens
acatacataatacaa

SEQ ID NO: 1603245 - DNA, 15 bp, Homo sapiens
acatacatctaagtc

SEQ ID NO: 1603246 - DNA, 15 bp, Homo sapiens
acataccagcttaga

SEQ ID NO: 1603247 - DNA, 15 bp, Homo sapiens
acatacctaccagta

SEQ ID NO: 1603248 - DNA, 18 bp, Homo sapiens
acatacgatttaaggtat

SEQ ID NO: 1603249 - DNA, 16 bp, Homo sapiens
acatacgtgtgcatgt

SEQ ID NO: 1603250 - DNA, 21 bp, Homo sapiens
acatacgtgtgcatgtgtctt

SEQ ID NO: 1603251 - DNA, 18 bp, Homo sapiens
acatacgtgttaggaggc

SEQ ID NO: 1603252 - DNA, 20 bp, Homo sapiens
acatactacctagaagtaag

SEQ ID NO: 1603253 - DNA, 17 bp, Homo sapiens
acatactaggtgccttt

SEQ ID NO: 1603254 - DNA, 14 bp, Homo sapiens
acatactctgctta

SEQ ID NO: 1603255 - DNA, 15 bp, Homo sapiens
acatactgtgttcca

SEQ ID NO: 1603256 - DNA, 21 bp, Homo sapiens
acatacttgaagggccagagc

SEQ ID NO: 1603257 - DNA, 23 bp, Homo sapiens
acatacttgaagggccagagcca

SEQ ID NO: 1603258 - DNA, 14 bp, Homo sapiens
acatagagcaatgt

SEQ ID NO: 1603259 - DNA, 19 bp, Homo sapiens
acatagagcaatgttggtt

SEQ ID NO: 1603260 - DNA, 21 bp, Homo sapiens
acatagagcaatgttggtttt

SEQ ID NO: 1603261 - DNA, 15 bp, Homo sapiens
acatagagcttttta

SEQ ID NO: 1603262 - DNA, 20 bp, Homo sapiens
acatagattaatggcactga

SEQ ID NO: 1603263 - DNA, 20 bp, Homo sapiens
acatagcaggggcaccttcc

SEQ ID NO: 1603264 - DNA, 21 bp, Homo sapiens
acatagcatgcttcctttctc

SEQ ID NO: 1603265 - DNA, 18 bp, Homo sapiens
acatagccaactctccca

SEQ ID NO: 1603266 - DNA, 22 bp, Homo sapiens
acatagcttgataaagggccaa

SEQ ID NO: 1603267 - DNA, 13 bp, Homo sapiens
acataggaaggga

SEQ ID NO: 1603268 - DNA, 20 bp, Homo sapiens
acataggaagggatctgaga

SEQ ID NO: 1603269 - DNA, 20 bp, Homo sapiens
acataggctggtggccttgg

SEQ ID NO: 1603270 - DNA, 13 bp, Homo sapiens
acatagtaaagta

SEQ ID NO: 1603271 - DNA, 21 bp, Homo sapiens
acatagtaagaccccatctct

SEQ ID NO: 1603272 - DNA, 16 bp, Homo sapiens
acatagtgatggttcc

SEQ ID NO: 1603273 - DNA, 21 bp, Homo sapiens
acatagttggtaatgcttgga

SEQ ID NO: 1603274 - DNA, 21 bp, Homo sapiens
acatataaatagatgatttca

SEQ ID NO: 1603275 - DNA, 15 bp, Homo sapiens
acatatacaacacca

SEQ ID NO: 1603276 - DNA, 11 bp, Homo sapiens
acatatatata

SEQ ID NO: 1603277 - DNA, 15 bp, Homo sapiens
acatatatatatata

SEQ ID NO: 1603278 - DNA, 14 bp, Homo sapiens
acatatatgtataa

SEQ ID NO: 1603279 - DNA, 21 bp, Homo sapiens
acatatatgtataatatatat

SEQ ID NO: 1603280 - DNA, 17 bp, Homo sapiens
acatatctagtatgaaa

SEQ ID NO: 1603281 - DNA, 20 bp, Homo sapiens
acatatctagtatgaaatta

SEQ ID NO: 1603282 - DNA, 19 bp, Homo sapiens
acatatgagaatatacctt

SEQ ID NO: 1603283 - DNA, 16 bp, Homo sapiens
acatatgcaccttgtg

SEQ ID NO: 1603284 - DNA, 19 bp, Homo sapiens
acatatgctgatcttttaa

SEQ ID NO: 1603285 - DNA, 18 bp, Homo sapiens
acatatgtatacatgtgc

SEQ ID NO: 1603286 - DNA, 20 bp, Homo sapiens
acatattactgttgcattta

SEQ ID NO: 1603287 - DNA, 18 bp, Homo sapiens
acatattaggaaaatatg

SEQ ID NO: 1603288 - DNA, 21 bp, Homo sapiens
acatatttgtagctagaatat

SEQ ID NO: 1603289 - DNA, 22 bp, Homo sapiens
acatatttgtagctagaatatc

SEQ ID NO: 1603290 - DNA, 15 bp, Homo sapiens
acatatttttatact

SEQ ID NO: 1603291 - DNA, 13 bp, Homo sapiens
acatcaaaccttt

SEQ ID NO: 1603292 - DNA, 14 bp, Homo sapiens
acatcaaataaact

SEQ ID NO: 1603293 - DNA, 18 bp, Homo sapiens
acatcaaataagaaataa

SEQ ID NO: 1603294 - DNA, 14 bp, Homo sapiens
acatcacaagacta

SEQ ID NO: 1603295 - DNA, 13 bp, Homo sapiens
acatcacacacac

SEQ ID NO: 1603296 - DNA, 14 bp, Homo sapiens
acatcacagcccag

SEQ ID NO: 1603297 - DNA, 16 bp, Homo sapiens
acatcacagcccagcc

SEQ ID NO: 1603298 - DNA, 14 bp, Homo sapiens
acatcacagggtgg

SEQ ID NO: 1603299 - DNA, 19 bp, Homo sapiens
acatcacagggtgggcctc

SEQ ID NO: 1603300 - DNA, 18 bp, Homo sapiens
acatcacctatttaatgt

SEQ ID NO: 1603301 - DNA, 21 bp, Homo sapiens
acatcacctatttaatgtttt

SEQ ID NO: 1603302 - DNA, 14 bp, Homo sapiens
acatcactccctct

SEQ ID NO: 1603303 - DNA, 14 bp, Homo sapiens
acatcagaaaataa

SEQ ID NO: 1603304 - DNA, 15 bp, Homo sapiens
acatcagaaaataaa

SEQ ID NO: 1603305 - DNA, 17 bp, Homo sapiens
acatcagaaaataaaat

SEQ ID NO: 1603306 - DNA, 19 bp, Homo sapiens
acatcagacctgtcttcca

SEQ ID NO: 1603307 - DNA, 19 bp, Homo sapiens
acatcagactctagaaaaa

SEQ ID NO: 1603308 - DNA, 20 bp, Homo sapiens
acatcagactctagaaaaaa

SEQ ID NO: 1603309 - DNA, 15 bp, Homo sapiens
acatcagctgaattc

SEQ ID NO: 1603310 - DNA, 18 bp, Homo sapiens
acatcaggagactgggct

SEQ ID NO: 1603311 - DNA, 23 bp, Homo sapiens
acatcaggagactgggctctggc

SEQ ID NO: 1603312 - DNA, 20 bp, Homo sapiens
acatcagtctccaacatgtt

SEQ ID NO: 1603313 - DNA, 19 bp, Homo sapiens
acatcagtgaggagggatg

SEQ ID NO: 1603314 - DNA, 14 bp, Homo sapiens
acatcataattaca

SEQ ID NO: 1603315 - DNA, 16 bp, Homo sapiens
acatcataattacatt

SEQ ID NO: 1603316 - DNA, 17 bp, Homo sapiens
acatcataattacattc

SEQ ID NO: 1603317 - DNA, 21 bp, Homo sapiens
acatcatcaggaagcctgtgg

SEQ ID NO: 1603318 - DNA, 19 bp, Homo sapiens
acatcattccaaaaagaac

SEQ ID NO: 1603319 - DNA, 20 bp, Homo sapiens
acatcattccaaaaagaaca

SEQ ID NO: 1603320 - DNA, 11 bp, Homo sapiens
acatcatttct

SEQ ID NO: 1603321 - DNA, 13 bp, Homo sapiens
acatcatttcttt

SEQ ID NO: 1603322 - DNA, 16 bp, Homo sapiens
acatccaactccagca

SEQ ID NO: 1603323 - DNA, 18 bp, Homo sapiens
acatccaactccagcaac

SEQ ID NO: 1603324 - DNA, 19 bp, Homo sapiens
acatccaactccagcaact

SEQ ID NO: 1603325 - DNA, 15 bp, Homo sapiens
acatccaagccagag

SEQ ID NO: 1603326 - DNA, 22 bp, Homo sapiens
acatccaaggagaaacagagac

SEQ ID NO: 1603327 - DNA, 23 bp, Homo sapiens
acatccaaggagaaacagagaca

SEQ ID NO: 1603328 - DNA, 14 bp, Homo sapiens
acatccccaccctt

SEQ ID NO: 1603329 - DNA, 13 bp, Homo sapiens
acatccccagagc

SEQ ID NO: 1603330 - DNA, 14 bp, Homo sapiens
acatccccagagcc

SEQ ID NO: 1603331 - DNA, 15 bp, Homo sapiens
acatccccagagccc

SEQ ID NO: 1603332 - DNA, 19 bp, Homo sapiens
acatccccagagcccagct

SEQ ID NO: 1603333 - DNA, 22 bp, Homo sapiens
acatccccagagcccagctctt

SEQ ID NO: 1603334 - DNA, 23 bp, Homo sapiens
acatccccagagcccagctcttg

SEQ ID NO: 1603335 - DNA, 18 bp, Homo sapiens
acatcccggcctcttcca

SEQ ID NO: 1603336 - DNA, 17 bp, Homo sapiens
acatccctgagcaggaa

SEQ ID NO: 1603337 - DNA, 14 bp, Homo sapiens
acatccctgtaaat

SEQ ID NO: 1603338 - DNA, 12 bp, Homo sapiens
acatcccttcct

SEQ ID NO: 1603339 - DNA, 13 bp, Homo sapiens
acatcccttcctg

SEQ ID NO: 1603340 - DNA, 19 bp, Homo sapiens
acatccgtcattgctgctg

SEQ ID NO: 1603341 - DNA, 14 bp, Homo sapiens
acatccttccttcc

SEQ ID NO: 1603342 - DNA, 15 bp, Homo sapiens
acatccttccttccc

SEQ ID NO: 1603343 - DNA, 17 bp, Homo sapiens
acatcgtaggcagccac

SEQ ID NO: 1603344 - DNA, 18 bp, Homo sapiens
acatcgtaggcagccacg

SEQ ID NO: 1603345 - DNA, 18 bp, Homo sapiens
acatcgtgggtcactaca

SEQ ID NO: 1603346 - DNA, 22 bp, Homo sapiens
acatctaagtcagtttcacata

SEQ ID NO: 1603347 - DNA, 22 bp, Homo sapiens
acatctctgcaccctggggcct

SEQ ID NO: 1603348 - DNA, 15 bp, Homo sapiens
acatctcttgaaacc

SEQ ID NO: 1603349 - DNA, 18 bp, Homo sapiens
acatctgacctggcatct

SEQ ID NO: 1603350 - DNA, 21 bp, Homo sapiens
acatctgaggttttatttcat

SEQ ID NO: 1603351 - DNA, 12 bp, Homo sapiens
acatctgcctta

SEQ ID NO: 1603352 - DNA, 14 bp, Homo sapiens
acatctggccctga

SEQ ID NO: 1603353 - DNA, 17 bp, Homo sapiens
acaggacacctggccgc

SEQ ID NO: 1603354 - DNA, 19 bp, Homo sapiens
acaggacacctggccgcct

SEQ ID NO: 1603355 - DNA, 14 bp, Homo sapiens
acaggacagcggga

SEQ ID NO: 1603356 - DNA, 17 bp, Homo sapiens
acaggacagtgcttcag

SEQ ID NO: 1603357 - DNA, 23 bp, Homo sapiens
acaggactgattctgggatgctc

SEQ ID NO: 1603358 - DNA, 15 bp, Homo sapiens
acaggactgtaaaga

SEQ ID NO: 1603359 - DNA, 17 bp, Homo sapiens
acaggactgtaaagatt

SEQ ID NO: 1603360 - DNA, 17 bp, Homo sapiens
acaggagaggcagcatg

SEQ ID NO: 1603361 - DNA, 18 bp, Homo sapiens
acaggagaggcagcatgc

SEQ ID NO: 1603362 - DNA, 17 bp, Homo sapiens
acaggagcctagcggag

SEQ ID NO: 1603363 - DNA, 18 bp, Homo sapiens
acagcccctcaaagactt

SEQ ID NO: 1603364 - DNA, 15 bp, Homo sapiens
acagcccgctctctg

SEQ ID NO: 1603365 - DNA, 17 bp, Homo sapiens
acagcccgctctctggc

SEQ ID NO: 1603366 - DNA, 15 bp, Homo sapiens
acagccctcggcctc

SEQ ID NO: 1603367 - DNA, 13 bp, Homo sapiens
acagccctgggag

SEQ ID NO: 1603368 - DNA, 22 bp, Homo sapiens
acagcccttatgcggttaattt

SEQ ID NO: 1603369 - DNA, 23 bp, Homo sapiens
acagccgctcctgtctgccagcc

SEQ ID NO: 1603370 - DNA, 14 bp, Homo sapiens
acagcctagggcag

SEQ ID NO: 1603371 - DNA, 17 bp, Homo sapiens
acagcctcacagaagaa

SEQ ID NO: 1603372 - DNA, 16 bp, Homo sapiens
acagcctcccaccccc

SEQ ID NO: 1603373 - DNA, 12 bp, Homo sapiens
acagcctccccc

SEQ ID NO: 1603374 - DNA, 13 bp, Homo sapiens
acagcctcccccg

SEQ ID NO: 1603375 - DNA, 13 bp, Homo sapiens
acagcctgcacac

SEQ ID NO: 1603376 - DNA, 19 bp, Homo sapiens
acagcctgcacacacctgc

SEQ ID NO: 1603377 - DNA, 11 bp, Homo sapiens
acagcctggca

SEQ ID NO: 1603378 - DNA, 18 bp, Homo sapiens
acacttattttctgaatt

SEQ ID NO: 1603379 - DNA, 21 bp, Homo sapiens
acacttattttctgaattcat

SEQ ID NO: 1603380 - DNA, 21 bp, Homo sapiens
acacttcacaaagccaagcct

SEQ ID NO: 1603381 - DNA, 12 bp, Homo sapiens
acacttcagatc

SEQ ID NO: 1603382 - DNA, 23 bp, Homo sapiens
acacttccaaagactccctccat

SEQ ID NO: 1603383 - DNA, 15 bp, Homo sapiens
acacttccaccagcc

SEQ ID NO: 1603384 - DNA, 19 bp, Homo sapiens
acacttccaccagcctgca

SEQ ID NO: 1603385 - DNA, 22 bp, Homo sapiens
acacttccctctgtttctcttt

SEQ ID NO: 1603386 - DNA, 19 bp, Homo sapiens
acacttctcatcatattgt

SEQ ID NO: 1603387 - DNA, 20 bp, Homo sapiens
acacttctgtgagaccccca

SEQ ID NO: 1603388 - DNA, 19 bp, Homo sapiens
acacttcttacgcaatgct

SEQ ID NO: 1603389 - DNA, 24 bp, Homo sapiens
acacttgaagcctaaatttgtgct

SEQ ID NO: 1603390 - DNA, 18 bp, Homo sapiens
acacttgccttcttcacc

SEQ ID NO: 1603391 - DNA, 15 bp, Homo sapiens
acacttggagcccgt

SEQ ID NO: 1603392 - DNA, 16 bp, Homo sapiens
acacttggcatacaaa

SEQ ID NO: 1603393 - DNA, 22 bp, Homo sapiens
acacttggcatacaaaatattt

SEQ ID NO: 1603394 - DNA, 22 bp, Homo sapiens
acacttggttgggtcctcacat

SEQ ID NO: 1603395 - DNA, 14 bp, Homo sapiens
acacttgtgacttt

SEQ ID NO: 1603396 - DNA, 15 bp, Homo sapiens
acacttgtgactttt

SEQ ID NO: 1603397 - DNA, 20 bp, Homo sapiens
acacttgtgacttttgcttt

SEQ ID NO: 1603398 - DNA, 16 bp, Homo sapiens
acacttgtgtgtgggc

SEQ ID NO: 1603399 - DNA, 19 bp, Homo sapiens
acacttgttccagctcttt

SEQ ID NO: 1603400 - DNA, 22 bp, Homo sapiens
acactttatgccggatgtgctt

SEQ ID NO: 1603401 - DNA, 21 bp, Homo sapiens
acactttgaaatgtgtttctg

SEQ ID NO: 1603402 - DNA, 13 bp, Homo sapiens
acactttgaagca

SEQ ID NO: 1603403 - DNA, 20 bp, Homo sapiens
acacagttgggacccaaaac

SEQ ID NO: 1603404 - DNA, 13 bp, Homo sapiens
acacataagaaaa

SEQ ID NO: 1603405 - DNA, 17 bp, Homo sapiens
acacatacgtgcacagg

SEQ ID NO: 1603406 - DNA, 18 bp, Homo sapiens
acacatagtggcttctcc

SEQ ID NO: 1603407 - DNA, 22 bp, Homo sapiens
acacatataaacatcacacaca

SEQ ID NO: 1603408 - DNA, 16 bp, Homo sapiens
acacatatacatatga

SEQ ID NO: 1603409 - DNA, 16 bp, Homo sapiens
acacatattcaaattc

SEQ ID NO: 1603410 - DNA, 16 bp, Homo sapiens
acacatcaaataaact

SEQ ID NO: 1603411 - DNA, 15 bp, Homo sapiens
acacatcagcttgcc

SEQ ID NO: 1603412 - DNA, 22 bp, Homo sapiens
acacatcagcttgccctgttaa

SEQ ID NO: 1603413 - DNA, 22 bp, Homo sapiens
acacatcccggcctcttccacc

SEQ ID NO: 1603414 - DNA, 21 bp, Homo sapiens
acacatctattgcagagactc

SEQ ID NO: 1603415 - DNA, 13 bp, Homo sapiens
acacatctggccc

SEQ ID NO: 1603416 - DNA, 17 bp, Homo sapiens
acacatctgggtgccct

SEQ ID NO: 1603417 - DNA, 19 bp, Homo sapiens
acacatgaaggtaaataaa

SEQ ID NO: 1603418 - DNA, 14 bp, Homo sapiens
acacatgccctcct

SEQ ID NO: 1603419 - DNA, 16 bp, Homo sapiens
acacatgccctcctgg

SEQ ID NO: 1603420 - DNA, 17 bp, Homo sapiens
acacatggtgagcctag

SEQ ID NO: 1603421 - DNA, 13 bp, Homo sapiens
acacatgtaaaat

SEQ ID NO: 1603422 - DNA, 22 bp, Homo sapiens
acacattaaacaggattttaca

SEQ ID NO: 1603423 - DNA, 14 bp, Homo sapiens
acacattaatgata

SEQ ID NO: 1603424 - DNA, 22 bp, Homo sapiens
acacattaatgataaactcaga

SEQ ID NO: 1603425 - DNA, 16 bp, Homo sapiens
acacattacaaagcca

SEQ ID NO: 1603426 - DNA, 23 bp, Homo sapiens
acacattagattttattttacta

SEQ ID NO: 1603427 - DNA, 12 bp, Homo sapiens
acacattgcctt

SEQ ID NO: 1603428 - DNA, 14 bp, Homo sapiens
acacattgccttct

SEQ ID NO: 1603429 - DNA, 14 bp, Homo sapiens
acacatttgaaaca

SEQ ID NO: 1603430 - DNA, 13 bp, Homo sapiens
acacatttttttg

SEQ ID NO: 1603431 - DNA, 14 bp, Homo sapiens
acaccaaaaaatat

SEQ ID NO: 1603432 - DNA, 15 bp, Homo sapiens
acaccaaagttctaa

SEQ ID NO: 1603433 - DNA, 17 bp, Homo sapiens
acaccaaccaggccttc

SEQ ID NO: 1603434 - DNA, 14 bp, Homo sapiens
acaccaacccctga

SEQ ID NO: 1603435 - DNA, 17 bp, Homo sapiens
acaccaagtggctgggt

SEQ ID NO: 1603436 - DNA, 23 bp, Homo sapiens
acaccaagtggctgggtgccctc

SEQ ID NO: 1603437 - DNA, 20 bp, Homo sapiens
acaccaatgaaaacatgtac

SEQ ID NO: 1603438 - DNA, 22 bp, Homo sapiens
acaccacagacacacacacgca

SEQ ID NO: 1603439 - DNA, 17 bp, Homo sapiens
acaccaccggccccctc

SEQ ID NO: 1603440 - DNA, 18 bp, Homo sapiens
acaccactaaccatcccc

SEQ ID NO: 1603441 - DNA, 21 bp, Homo sapiens
acaccactgccattacccagt

SEQ ID NO: 1603442 - DNA, 15 bp, Homo sapiens
acaccactgccctgc

SEQ ID NO: 1603443 - DNA, 14 bp, Homo sapiens
acaccagaagatgt

SEQ ID NO: 1603444 - DNA, 13 bp, Homo sapiens
acaccagagctgc

SEQ ID NO: 1603445 - DNA, 13 bp, Homo sapiens
acaccagcctcct

SEQ ID NO: 1603446 - DNA, 12 bp, Homo sapiens
acaccagctgct

SEQ ID NO: 1603447 - DNA, 22 bp, Homo sapiens
acaccaggacttaagacaaatg

SEQ ID NO: 1603448 - DNA, 23 bp, Homo sapiens
acaccagtcacctcgtctccctg

SEQ ID NO: 1603449 - DNA, 15 bp, Homo sapiens
acaccatcctggcta

SEQ ID NO: 1603450 - DNA, 18 bp, Homo sapiens
acaccatggagatgaaat

SEQ ID NO: 1603451 - DNA, 23 bp, Homo sapiens
acaccatggagatgaaatgcctt

SEQ ID NO: 1603452 - DNA, 23 bp, Homo sapiens
acaccatgtgcaataagattggt

SEQ ID NO: 1603453 - DNA, 22 bp, Homo sapiens
acaccattttttttttcttttt

SEQ ID NO: 1603454 - DNA, 13 bp, Homo sapiens
acacccaaagctg

SEQ ID NO: 1603455 - DNA, 19 bp, Homo sapiens
acacccaaagctgagcctg

SEQ ID NO: 1603456 - DNA, 21 bp, Homo sapiens
acaccccctccccgcccctgt

SEQ ID NO: 1603457 - DNA, 22 bp, Homo sapiens
acacccctcaaaaaaagccttt

SEQ ID NO: 1603458 - DNA, 13 bp, Homo sapiens
acacccctctgtc

SEQ ID NO: 1603459 - DNA, 21 bp, Homo sapiens
acacccctctgtctaggactg

SEQ ID NO: 1603460 - DNA, 21 bp, Homo sapiens
acacccctgtgctcccctgcc

SEQ ID NO: 1603461 - DNA, 17 bp, Homo sapiens
acacccgactcctcaaa

SEQ ID NO: 1603462 - DNA, 14 bp, Homo sapiens
acaccctccagaga

SEQ ID NO: 1603463 - DNA, 13 bp, Homo sapiens
acaccctccccat

SEQ ID NO: 1603464 - DNA, 17 bp, Homo sapiens
acaccctccccattcag

SEQ ID NO: 1603465 - DNA, 12 bp, Homo sapiens
acaccctctccc

SEQ ID NO: 1603466 - DNA, 13 bp, Homo sapiens
acaccctctccca

SEQ ID NO: 1603467 - DNA, 13 bp, Homo sapiens
acaccctctgggg

SEQ ID NO: 1603468 - DNA, 20 bp, Homo sapiens
acaccctctgggggtcctct

SEQ ID NO: 1603469 - DNA, 11 bp, Homo sapiens
acaccctggcc

SEQ ID NO: 1603470 - DNA, 12 bp, Homo sapiens
acaccctggcct

SEQ ID NO: 1603471 - DNA, 22 bp, Homo sapiens
acaccctgtactgttctgtgtc

SEQ ID NO: 1603472 - DNA, 13 bp, Homo sapiens
acacccttagaaa

SEQ ID NO: 1603473 - DNA, 13 bp, Homo sapiens
acaccctttctgt

SEQ ID NO: 1603474 - DNA, 16 bp, Homo sapiens
acaccgactagccagg

SEQ ID NO: 1603475 - DNA, 22 bp, Homo sapiens
acaccgctggtccctgccctcc

SEQ ID NO: 1603476 - DNA, 14 bp, Homo sapiens
acaccgggcctgga

SEQ ID NO: 1603477 - DNA, 18 bp, Homo sapiens
acaccgtacatctgcaat

SEQ ID NO: 1603478 - DNA, 20 bp, Homo sapiens
acaccgtccctcagtgatac

SEQ ID NO: 1603479 - DNA, 21 bp, Homo sapiens
acaccgtttagaaaaaacaat

SEQ ID NO: 1603480 - DNA, 21 bp, Homo sapiens
acacctaaaggtgtatttaaa

SEQ ID NO: 1603481 - DNA, 16 bp, Homo sapiens
acacctaccatgctgc

SEQ ID NO: 1603482 - DNA, 18 bp, Homo sapiens
acacctagctttattctt

SEQ ID NO: 1603483 - DNA, 21 bp, Homo sapiens
acacctagctttattcttcag

SEQ ID NO: 1603484 - DNA, 22 bp, Homo sapiens
acacctagctttattcttcaga

SEQ ID NO: 1603485 - DNA, 15 bp, Homo sapiens
acacctcagtgggaa

SEQ ID NO: 1603486 - DNA, 22 bp, Homo sapiens
acacctcagttcccttggcctc

SEQ ID NO: 1603487 - DNA, 13 bp, Homo sapiens
acacctcccagga

SEQ ID NO: 1603488 - DNA, 22 bp, Homo sapiens
acacctccccctttcacactgg

SEQ ID NO: 1603489 - DNA, 14 bp, Homo sapiens
acacctccctactc

SEQ ID NO: 1603490 - DNA, 21 bp, Homo sapiens
acacctcgcccttcagcccac

SEQ ID NO: 1603491 - DNA, 21 bp, Homo sapiens
acacctcgtcaagagcatgca

SEQ ID NO: 1603492 - DNA, 18 bp, Homo sapiens
acacctgagcgctgtgga

SEQ ID NO: 1603493 - DNA, 19 bp, Homo sapiens
acacctgagcgctgtggac

SEQ ID NO: 1603494 - DNA, 22 bp, Homo sapiens
acacctgagcgctgtggactgt

SEQ ID NO: 1603495 - DNA, 19 bp, Homo sapiens
acacctgcacctcccccca

SEQ ID NO: 1603496 - DNA, 16 bp, Homo sapiens
acacctgcctgcagag

SEQ ID NO: 1603497 - DNA, 18 bp, Homo sapiens
acacctggccgcctccag

SEQ ID NO: 1603498 - DNA, 19 bp, Homo sapiens
acacctggccgcctccagg

SEQ ID NO: 1603499 - DNA, 19 bp, Homo sapiens
acacctggccttaaagagg

SEQ ID NO: 1603500 - DNA, 20 bp, Homo sapiens
acacctgggcatttggtgag

SEQ ID NO: 1603501 - DNA, 23 bp, Homo sapiens
acacctggtgcgggcctggccct

SEQ ID NO: 1603502 - DNA, 12 bp, Homo sapiens
acacctgtacat

SEQ ID NO: 1603503 - DNA, 13 bp, Homo sapiens
acacctgtacatt

SEQ ID NO: 1603504 - DNA, 16 bp, Homo sapiens
acacctgtacattctt

SEQ ID NO: 1603505 - DNA, 16 bp, Homo sapiens
acacctgtcttgaata

SEQ ID NO: 1603506 - DNA, 11 bp, Homo sapiens
acacctgtgtc

SEQ ID NO: 1603507 - DNA, 20 bp, Homo sapiens
acaccttccagctcctgtaa

SEQ ID NO: 1603508 - DNA, 15 bp, Homo sapiens
acaccttccagggcc

SEQ ID NO: 1603509 - DNA, 17 bp, Homo sapiens
acaccttccagggccct

SEQ ID NO: 1603510 - DNA, 19 bp, Homo sapiens
acaccttttccccaggagc

SEQ ID NO: 1603511 - DNA, 19 bp, Homo sapiens
acacgagcaggctactgtc

SEQ ID NO: 1603512 - DNA, 21 bp, Homo sapiens
acacgagcaggctactgtcag

SEQ ID NO: 1603513 - DNA, 13 bp, Homo sapiens
acacgagccacaa

SEQ ID NO: 1603514 - DNA, 14 bp, Homo sapiens
acacgcacgcacac

SEQ ID NO: 1603515 - DNA, 20 bp, Homo sapiens
acacgcacgcacacacacaa

SEQ ID NO: 1603516 - DNA, 19 bp, Homo sapiens
acacgccttgttcttggcc

SEQ ID NO: 1603517 - DNA, 22 bp, Homo sapiens
acacgctcgcgggcagcgggcc

SEQ ID NO: 1603518 - DNA, 14 bp, Homo sapiens
acacgctgcctggt

SEQ ID NO: 1603519 - DNA, 22 bp, Homo sapiens
acacggagcccagccctcccca

SEQ ID NO: 1603520 - DNA, 14 bp, Homo sapiens
acacggaggcatct

SEQ ID NO: 1603521 - DNA, 19 bp, Homo sapiens
acacggatctgctgggctc

SEQ ID NO: 1603522 - DNA, 19 bp, Homo sapiens
acacggctggtcactctgc

SEQ ID NO: 1603523 - DNA, 21 bp, Homo sapiens
acacggctggtcactctgccc

SEQ ID NO: 1603524 - DNA, 13 bp, Homo sapiens
acacggcttcact

SEQ ID NO: 1603525 - DNA, 16 bp, Homo sapiens
acacgggaccagctca

SEQ ID NO: 1603526 - DNA, 16 bp, Homo sapiens
acacgtacttaaatga

SEQ ID NO: 1603527 - DNA, 13 bp, Homo sapiens
acacgtatttata

SEQ ID NO: 1603528 - DNA, 19 bp, Homo sapiens
acacgtatttatatttgga

SEQ ID NO: 1603529 - DNA, 21 bp, Homo sapiens
acacgtgagaatccctggcaa

SEQ ID NO: 1603530 - DNA, 18 bp, Homo sapiens
acacgtgctgtgggcctc

SEQ ID NO: 1603531 - DNA, 23 bp, Homo sapiens
acacgtgctgtgggcctcaggcg

SEQ ID NO: 1603532 - DNA, 14 bp, Homo sapiens
acacgtgtctataa

SEQ ID NO: 1603533 - DNA, 13 bp, Homo sapiens
acacgttgccagg

SEQ ID NO: 1603534 - DNA, 22 bp, Homo sapiens
acacgttgccaggggcttgaga

SEQ ID NO: 1603535 - DNA, 17 bp, Homo sapiens
acacgtttaatcccagc

SEQ ID NO: 1603536 - DNA, 18 bp, Homo sapiens
acacgtttaatcccagca

SEQ ID NO: 1603537 - DNA, 19 bp, Homo sapiens
acacgtttaatcccagcac

SEQ ID NO: 1603538 - DNA, 22 bp, Homo sapiens
acacgtttaatcccagcacttt

SEQ ID NO: 1603539 - DNA, 14 bp, Homo sapiens
acactaaaaataaa

SEQ ID NO: 1603540 - DNA, 13 bp, Homo sapiens
acactaaacattc

SEQ ID NO: 1603541 - DNA, 12 bp, Homo sapiens
acactaaattat

SEQ ID NO: 1603542 - DNA, 13 bp, Homo sapiens
acactaaattatt

SEQ ID NO: 1603543 - DNA, 15 bp, Homo sapiens
acactaaattattag

SEQ ID NO: 1603544 - DNA, 18 bp, Homo sapiens
acactaaattattagcat

SEQ ID NO: 1603545 - DNA, 22 bp, Homo sapiens
acactaaattattagcatttgt

SEQ ID NO: 1603546 - DNA, 16 bp, Homo sapiens
acactaaccaagctga

SEQ ID NO: 1603547 - DNA, 15 bp, Homo sapiens
acactaacctgggtt

SEQ ID NO: 1603548 - DNA, 18 bp, Homo sapiens
acactaagctctctgggc

SEQ ID NO: 1603549 - DNA, 23 bp, Homo sapiens
acactaagttatagtatatctgg

SEQ ID NO: 1603550 - DNA, 14 bp, Homo sapiens
acactaatatattt

SEQ ID NO: 1603551 - DNA, 17 bp, Homo sapiens
acactaatatatttaaa

SEQ ID NO: 1603552 - DNA, 12 bp, Homo sapiens
acactaattcat

SEQ ID NO: 1603553 - DNA, 23 bp, Homo sapiens
acactaatttgaataaactctcc

SEQ ID NO: 1603554 - DNA, 16 bp, Homo sapiens
acactaccaaacactc

SEQ ID NO: 1603555 - DNA, 18 bp, Homo sapiens
acactaccaaacactcag

SEQ ID NO: 1603556 - DNA, 20 bp, Homo sapiens
acactaccttatcaggcaaa

SEQ ID NO: 1603557 - DNA, 17 bp, Homo sapiens
acactactgctaaatcc

SEQ ID NO: 1603558 - DNA, 21 bp, Homo sapiens
acactagccagacactctgct

SEQ ID NO: 1603559 - DNA, 22 bp, Homo sapiens
acactagctaatatcaatagaa

SEQ ID NO: 1603560 - DNA, 17 bp, Homo sapiens
acactagggtcaggcgg

SEQ ID NO: 1603561 - DNA, 18 bp, Homo sapiens
acactagttttgtgccag

SEQ ID NO: 1603562 - DNA, 17 bp, Homo sapiens
acactatggtatttgag

SEQ ID NO: 1603563 - DNA, 18 bp, Homo sapiens
acactatggtatttgagt

SEQ ID NO: 1603564 - DNA, 19 bp, Homo sapiens
acactatggtatttgagtg

SEQ ID NO: 1603565 - DNA, 17 bp, Homo sapiens
acactattatttcctat

SEQ ID NO: 1603566 - DNA, 16 bp, Homo sapiens
acactattcactaaaa

SEQ ID NO: 1603567 - DNA, 20 bp, Homo sapiens
acactcatcctacttcaaga

SEQ ID NO: 1603568 - DNA, 18 bp, Homo sapiens
acactccaccctccacct

SEQ ID NO: 1603569 - DNA, 17 bp, Homo sapiens
acactccactctgattc

SEQ ID NO: 1603570 - DNA, 14 bp, Homo sapiens
acactccagcctga

SEQ ID NO: 1603571 - DNA, 15 bp, Homo sapiens
acactccagcctgag

SEQ ID NO: 1603572 - DNA, 13 bp, Homo sapiens
acactccagtggc

SEQ ID NO: 1603573 - DNA, 16 bp, Homo sapiens
acactccagtggcaga

SEQ ID NO: 1603574 - DNA, 14 bp, Homo sapiens
acactccctctcct

SEQ ID NO: 1603575 - DNA, 18 bp, Homo sapiens
acactctatatgtagtgc

SEQ ID NO: 1603576 - DNA, 13 bp, Homo sapiens
acactctgctctg

SEQ ID NO: 1603577 - DNA, 21 bp, Homo sapiens
acactcttcagtgactcctgc

SEQ ID NO: 1603578 - DNA, 16 bp, Homo sapiens
acactctttgtaagag

SEQ ID NO: 1603579 - DNA, 22 bp, Homo sapiens
acactgaaaagaaggaaagatg

SEQ ID NO: 1603580 - DNA, 12 bp, Homo sapiens
acactgaaaatg

SEQ ID NO: 1603581 - DNA, 23 bp, Homo sapiens
acactgaaagttttgtaaaagaa

SEQ ID NO: 1603582 - DNA, 23 bp, Homo sapiens
acactgaatatttatatttcact

SEQ ID NO: 1603583 - DNA, 20 bp, Homo sapiens
acactgaccaagtgctggcc

SEQ ID NO: 1603584 - DNA, 13 bp, Homo sapiens
acactgacttgag

SEQ ID NO: 1603585 - DNA, 19 bp, Homo sapiens
acactgagaatgtaagaac

SEQ ID NO: 1603586 - DNA, 14 bp, Homo sapiens
acactgaggactgt

SEQ ID NO: 1603587 - DNA, 21 bp, Homo sapiens
acactgatgagtttcactgta

SEQ ID NO: 1603588 - DNA, 17 bp, Homo sapiens
acactgatggctcaaga

SEQ ID NO: 1603589 - DNA, 13 bp, Homo sapiens
acactgcaagaag

SEQ ID NO: 1603590 - DNA, 15 bp, Homo sapiens
acactgcaagaagtc

SEQ ID NO: 1603591 - DNA, 22 bp, Homo sapiens
acactgcacacagtgacttcct

SEQ ID NO: 1603592 - DNA, 16 bp, Homo sapiens
acactgcagccctctc

SEQ ID NO: 1603593 - DNA, 16 bp, Homo sapiens
acactgcagtttcctg

SEQ ID NO: 1603594 - DNA, 21 bp, Homo sapiens
acactgccaactgatctgtta

SEQ ID NO: 1603595 - DNA, 17 bp, Homo sapiens
acactgccagaagagaa

SEQ ID NO: 1603596 - DNA, 12 bp, Homo sapiens
acactgcctggg

SEQ ID NO: 1603597 - DNA, 13 bp, Homo sapiens
acactgcctgggc

SEQ ID NO: 1603598 - DNA, 23 bp, Homo sapiens
acactgcctttttatttatatgt

SEQ ID NO: 1603599 - DNA, 17 bp, Homo sapiens
acactgcgcaggtctct

SEQ ID NO: 1603600 - DNA, 15 bp, Homo sapiens
acactgcggaagcca

SEQ ID NO: 1603601 - DNA, 17 bp, Homo sapiens
acactgctctaacagcc

SEQ ID NO: 1603602 - DNA, 20 bp, Homo sapiens
acactgctctaacagccctc

SEQ ID NO: 1603603 - DNA, 15 bp, Homo sapiens
acactgctgcaccag

SEQ ID NO: 1603604 - DNA, 16 bp, Homo sapiens
acactgctgttaaaga

SEQ ID NO: 1603605 - DNA, 17 bp, Homo sapiens
acactggaatataaaac

SEQ ID NO: 1603606 - DNA, 21 bp, Homo sapiens
acactggaatataaaacagtc

SEQ ID NO: 1603607 - DNA, 20 bp, Homo sapiens
acactggcttgaaggactgc

SEQ ID NO: 1603608 - DNA, 16 bp, Homo sapiens
acactgggcagcaagg

SEQ ID NO: 1603609 - DNA, 22 bp, Homo sapiens
acactgggcagcaaggctgctg

SEQ ID NO: 1603610 - DNA, 18 bp, Homo sapiens
acactgggtggtggcctg

SEQ ID NO: 1603611 - DNA, 18 bp, Homo sapiens
acactggtctaatgtttg

SEQ ID NO: 1603612 - DNA, 11 bp, Homo sapiens
acactggtggt

SEQ ID NO: 1603613 - DNA, 22 bp, Homo sapiens
acactggtggttctactgaccc

SEQ ID NO: 1603614 - DNA, 20 bp, Homo sapiens
acactggtttgccaggccaa

SEQ ID NO: 1603615 - DNA, 18 bp, Homo sapiens
acactgtatctaaaaaat

SEQ ID NO: 1603616 - DNA, 12 bp, Homo sapiens
acactgtgaagg

SEQ ID NO: 1603617 - DNA, 21 bp, Homo sapiens
acactgtgaagggtacagatt

SEQ ID NO: 1603618 - DNA, 18 bp, Homo sapiens
acactgtgccctggtgga

SEQ ID NO: 1603619 - DNA, 22 bp, Homo sapiens
acactgtgtcccccccagtgca

SEQ ID NO: 1603620 - DNA, 13 bp, Homo sapiens
acactgtgtcctg

SEQ ID NO: 1603621 - DNA, 20 bp, Homo sapiens
acactgtgtcctggtgctct

SEQ ID NO: 1603622 - DNA, 22 bp, Homo sapiens
acactgtgtcctggtgctctct

SEQ ID NO: 1603623 - DNA, 16 bp, Homo sapiens
acactgttactccaca

SEQ ID NO: 1603624 - DNA, 14 bp, Homo sapiens
acactgttctgaaa

SEQ ID NO: 1603625 - DNA, 20 bp, Homo sapiens
acactgttctgaaagtgact

SEQ ID NO: 1603626 - DNA, 15 bp, Homo sapiens
acactgttttataga

SEQ ID NO: 1603627 - DNA, 23 bp, Homo sapiens
acacttaaggttgggtgctgcta

SEQ ID NO: 1603628 - DNA, 13 bp, Homo sapiens
acacttataaaat

SEQ ID NO: 1603629 - DNA, 15 bp, Homo sapiens
acacttatattttat

SEQ ID NO: 1603630 - DNA, 16 bp, Homo sapiens
acacttatattttatg

SEQ ID NO: 1603631 - DNA, 24 bp, Homo sapiens
acacttatattttatgaacattgt

SEQ ID NO: 1603632 - DNA, 15 bp, Homo sapiens
acacttatcttctgg

SEQ ID NO: 1603633 - DNA, 16 bp, Homo sapiens
acacttatcttctgga

SEQ ID NO: 1603634 - DNA, 20 bp, Homo sapiens
acacttattggaactctgct

SEQ ID NO: 1603635 - DNA, 23 bp, Homo sapiens
acaatgttgtccaacaataaaca

SEQ ID NO: 1603636 - DNA, 17 bp, Homo sapiens
acaattactaaattgta

SEQ ID NO: 1603637 - DNA, 16 bp, Homo sapiens
acaattactgtacaca

SEQ ID NO: 1603638 - DNA, 15 bp, Homo sapiens
acaattatgtctctt

SEQ ID NO: 1603639 - DNA, 20 bp, Homo sapiens
acaattatgtctcttgagca

SEQ ID NO: 1603640 - DNA, 21 bp, Homo sapiens
acaattatttttacagttctc

SEQ ID NO: 1603641 - DNA, 15 bp, Homo sapiens
acaattcacagtatg

SEQ ID NO: 1603642 - DNA, 21 bp, Homo sapiens
acaattcattgttttgcaaaa

SEQ ID NO: 1603643 - DNA, 18 bp, Homo sapiens
acaattccaaaggaatct

SEQ ID NO: 1603644 - DNA, 23 bp, Homo sapiens
acaattcctagataaaaagatgg

SEQ ID NO: 1603645 - DNA, 21 bp, Homo sapiens
acaattctgtttttaatgcta

SEQ ID NO: 1603646 - DNA, 19 bp, Homo sapiens
acaattgaagtaaactttt

SEQ ID NO: 1603647 - DNA, 22 bp, Homo sapiens
acaattgaagtaaactttttgt

SEQ ID NO: 1603648 - DNA, 17 bp, Homo sapiens
acaattgatacttcagg

SEQ ID NO: 1603649 - DNA, 21 bp, Homo sapiens
acaattgtcgaaaagagtctt

SEQ ID NO: 1603650 - DNA, 23 bp, Homo sapiens
acaattgtgtagcctttttgtat

SEQ ID NO: 1603651 - DNA, 24 bp, Homo sapiens
acaattgtgtataactggattgca

SEQ ID NO: 1603652 - DNA, 19 bp, Homo sapiens
acaatttcaaaaaaataaa

SEQ ID NO: 1603653 - DNA, 22 bp, Homo sapiens
acaatttcatttccagcatttt

SEQ ID NO: 1603654 - DNA, 15 bp, Homo sapiens
acaatttgatacata

SEQ ID NO: 1603655 - DNA, 16 bp, Homo sapiens
acaatttgatacataa

SEQ ID NO: 1603656 - DNA, 22 bp, Homo sapiens
acaatttgtacttttttcttaa

SEQ ID NO: 1603657 - DNA, 18 bp, Homo sapiens
acaattttaaagttctta

SEQ ID NO: 1603658 - DNA, 16 bp, Homo sapiens
acaattttctgtaaga

SEQ ID NO: 1603659 - DNA, 12 bp, Homo sapiens
acaattttgtcc

SEQ ID NO: 1603660 - DNA, 20 bp, Homo sapiens
acaattttgtcttaagtgtt

SEQ ID NO: 1603661 - DNA, 17 bp, Homo sapiens
acaatttttaataaatt

SEQ ID NO: 1603662 - DNA, 16 bp, Homo sapiens
acaattttttatcatg

SEQ ID NO: 1603663 - DNA, 17 bp, Homo sapiens
acacaaaaaccttggca

SEQ ID NO: 1603664 - DNA, 15 bp, Homo sapiens
acacaaaagatggga

SEQ ID NO: 1603665 - DNA, 12 bp, Homo sapiens
acacaaaatcaa

SEQ ID NO: 1603666 - DNA, 23 bp, Homo sapiens
acacaaagaagtttttctttgtg

SEQ ID NO: 1603667 - DNA, 13 bp, Homo sapiens
acacaaaggaagt

SEQ ID NO: 1603668 - DNA, 14 bp, Homo sapiens
acacaaatgcaggg

SEQ ID NO: 1603669 - DNA, 16 bp, Homo sapiens
acacaacaccaggact

SEQ ID NO: 1603670 - DNA, 19 bp, Homo sapiens
acacaacactgatgtgact

SEQ ID NO: 1603671 - DNA, 22 bp, Homo sapiens
acacaagggatataaaatgaaa

SEQ ID NO: 1603672 - DNA, 15 bp, Homo sapiens
acacaataaagaacc

SEQ ID NO: 1603673 - DNA, 18 bp, Homo sapiens
acacaattgatacttcag

SEQ ID NO: 1603674 - DNA, 23 bp, Homo sapiens
acacaattgatacttcaggtgct

SEQ ID NO: 1603675 - DNA, 21 bp, Homo sapiens
acacaatttaattcctctttt

SEQ ID NO: 1603676 - DNA, 21 bp, Homo sapiens
acacacaaaaaccttggcata

SEQ ID NO: 1603677 - DNA, 16 bp, Homo sapiens
acacacaataaagaac

SEQ ID NO: 1603678 - DNA, 13 bp, Homo sapiens
acacacacacaca

SEQ ID NO: 1603679 - DNA, 15 bp, Homo sapiens
acacacacacacaaa

SEQ ID NO: 1603680 - DNA, 14 bp, Homo sapiens
acacacacacacac

SEQ ID NO: 1603681 - DNA, 15 bp, Homo sapiens
acacacacacacaca

SEQ ID NO: 1603682 - DNA, 14 bp, Homo sapiens
acacacacacacga

SEQ ID NO: 1603683 - DNA, 16 bp, Homo sapiens
acacacacacacgatg

SEQ ID NO: 1603684 - DNA, 13 bp, Homo sapiens
acacacacacgca

SEQ ID NO: 1603685 - DNA, 22 bp, Homo sapiens
acacacacgatgcatttaataa

SEQ ID NO: 1603686 - DNA, 14 bp, Homo sapiens
acacacacgcacgc

SEQ ID NO: 1603687 - DNA, 16 bp, Homo sapiens
acacacacgctccctg

SEQ ID NO: 1603688 - DNA, 22 bp, Homo sapiens
acacacagaggaagagcaggca

SEQ ID NO: 1603689 - DNA, 15 bp, Homo sapiens
acacacagatacaca

SEQ ID NO: 1603690 - DNA, 19 bp, Homo sapiens
acacacataccttcatgtg

SEQ ID NO: 1603691 - DNA, 12 bp, Homo sapiens
acacacatagat

SEQ ID NO: 1603692 - DNA, 15 bp, Homo sapiens
acacacatcccagga

SEQ ID NO: 1603693 - DNA, 14 bp, Homo sapiens
acacaccaggcgct

SEQ ID NO: 1603694 - DNA, 13 bp, Homo sapiens
acacacccctcaa

SEQ ID NO: 1603695 - DNA, 19 bp, Homo sapiens
acacacccctcaaaaaaag

SEQ ID NO: 1603696 - DNA, 16 bp, Homo sapiens
acacacctgctccaat

SEQ ID NO: 1603697 - DNA, 11 bp, Homo sapiens
acacacctgta

SEQ ID NO: 1603698 - DNA, 18 bp, Homo sapiens
acacacgatgcatttaat

SEQ ID NO: 1603699 - DNA, 21 bp, Homo sapiens
acacacgatgcatttaataaa

SEQ ID NO: 1603700 - DNA, 22 bp, Homo sapiens
acacacgatgcatttaataaag

SEQ ID NO: 1603701 - DNA, 18 bp, Homo sapiens
acacacgcacgcacacac

SEQ ID NO: 1603702 - DNA, 19 bp, Homo sapiens
acacacgctccctggaagc

SEQ ID NO: 1603703 - DNA, 21 bp, Homo sapiens
acacacgtatttatatttgga

SEQ ID NO: 1603704 - DNA, 16 bp, Homo sapiens
acacactgtgtcctgg

SEQ ID NO: 1603705 - DNA, 17 bp, Homo sapiens
acacactttccatctct

SEQ ID NO: 1603706 - DNA, 20 bp, Homo sapiens
acacactttccatctctgcc

SEQ ID NO: 1603707 - DNA, 12 bp, Homo sapiens
acacagaaacac

SEQ ID NO: 1603708 - DNA, 16 bp, Homo sapiens
acacagaaacactgcc

SEQ ID NO: 1603709 - DNA, 14 bp, Homo sapiens
acacagaaatgctg

SEQ ID NO: 1603710 - DNA, 16 bp, Homo sapiens
acacagaaatgctgct

SEQ ID NO: 1603711 - DNA, 17 bp, Homo sapiens
acacagaaatgctgctg

SEQ ID NO: 1603712 - DNA, 18 bp, Homo sapiens
acacagaaatgctgctgg

SEQ ID NO: 1603713 - DNA, 20 bp, Homo sapiens
acacagaaatgctgctggcc

SEQ ID NO: 1603714 - DNA, 19 bp, Homo sapiens
acacagacattttgtgtga

SEQ ID NO: 1603715 - DNA, 18 bp, Homo sapiens
acacagactgacgaaact

SEQ ID NO: 1603716 - DNA, 23 bp, Homo sapiens
acacagactgcgatttgtcccag

SEQ ID NO: 1603717 - DNA, 19 bp, Homo sapiens
acacagagtggtctttctg

SEQ ID NO: 1603718 - DNA, 23 bp, Homo sapiens
acacagagtggtctttctggaga

SEQ ID NO: 1603719 - DNA, 16 bp, Homo sapiens
acacagatacacacac

SEQ ID NO: 1603720 - DNA, 18 bp, Homo sapiens
acacagattatgttcctg

SEQ ID NO: 1603721 - DNA, 19 bp, Homo sapiens
acacagattatgttcctgc

SEQ ID NO: 1603722 - DNA, 22 bp, Homo sapiens
acacagattatgttcctgctgt

SEQ ID NO: 1603723 - DNA, 20 bp, Homo sapiens
acacagcacaccagccgctg

SEQ ID NO: 1603724 - DNA, 22 bp, Homo sapiens
acacagcagaggcccagatatt

SEQ ID NO: 1603725 - DNA, 15 bp, Homo sapiens
acacagcagtgagta

SEQ ID NO: 1603726 - DNA, 12 bp, Homo sapiens
acacagcagtgt

SEQ ID NO: 1603727 - DNA, 13 bp, Homo sapiens
acacagcagtgtc

SEQ ID NO: 1603728 - DNA, 14 bp, Homo sapiens
acacagcagtgtcc

SEQ ID NO: 1603729 - DNA, 20 bp, Homo sapiens
acacagcagtgtcccctgcc

SEQ ID NO: 1603730 - DNA, 13 bp, Homo sapiens
acacagcccaaga

SEQ ID NO: 1603731 - DNA, 14 bp, Homo sapiens
acacagcctccccc

SEQ ID NO: 1603732 - DNA, 22 bp, Homo sapiens
acacagcctcccccgccagccc

SEQ ID NO: 1603733 - DNA, 19 bp, Homo sapiens
acacagcctgggccccagc

SEQ ID NO: 1603734 - DNA, 21 bp, Homo sapiens
acacagcgtccctagcagtga

SEQ ID NO: 1603735 - DNA, 17 bp, Homo sapiens
acacagctactctcccc

SEQ ID NO: 1603736 - DNA, 17 bp, Homo sapiens
acacagctgagcactta

SEQ ID NO: 1603737 - DNA, 11 bp, Homo sapiens
acacagctgcc

SEQ ID NO: 1603738 - DNA, 12 bp, Homo sapiens
acacagctgccc

SEQ ID NO: 1603739 - DNA, 18 bp, Homo sapiens
acacagctgccctagctg

SEQ ID NO: 1603740 - DNA, 21 bp, Homo sapiens
acacaggcaactgaggcagac

SEQ ID NO: 1603741 - DNA, 13 bp, Homo sapiens
acacaggccctcc

SEQ ID NO: 1603742 - DNA, 12 bp, Homo sapiens
acacaggctgtc

SEQ ID NO: 1603743 - DNA, 16 bp, Homo sapiens
acacagggaaagcatt

SEQ ID NO: 1603744 - DNA, 19 bp, Homo sapiens
acacagggctctttgatgg

SEQ ID NO: 1603745 - DNA, 21 bp, Homo sapiens
acacaggggaggtgatagcat

SEQ ID NO: 1603746 - DNA, 18 bp, Homo sapiens
acacagtactttattgta

SEQ ID NO: 1603747 - DNA, 16 bp, Homo sapiens
acacagtgccttcaat

SEQ ID NO: 1603748 - DNA, 20 bp, Homo sapiens
acacagtggagcccacgagc

SEQ ID NO: 1603749 - DNA, 20 bp, Homo sapiens
acacagtgggaactctgaca

SEQ ID NO: 1603750 - DNA, 13 bp, Homo sapiens
acacagtgtctgt

SEQ ID NO: 1603751 - DNA, 22 bp, Homo sapiens
aattgatattatattaaacata

SEQ ID NO: 1603752 - DNA, 21 bp, Homo sapiens
aattgatgtcggtcatagttt

SEQ ID NO: 1603753 - DNA, 14 bp, Homo sapiens
aattgatgtgttta

SEQ ID NO: 1603754 - DNA, 15 bp, Homo sapiens
aattgatttcaagac

SEQ ID NO: 1603755 - DNA, 21 bp, Homo sapiens
aattgcacaatattgaacttt

SEQ ID NO: 1603756 - DNA, 18 bp, Homo sapiens
aattgcacttttaaacct

SEQ ID NO: 1603757 - DNA, 16 bp, Homo sapiens
aattgcatactttgta

SEQ ID NO: 1603758 - DNA, 23 bp, Homo sapiens
aattgcatcagttcattgacctc

SEQ ID NO: 1603759 - DNA, 23 bp, Homo sapiens
aattgcctagaaatatctttctc

SEQ ID NO: 1603760 - DNA, 13 bp, Homo sapiens
aattgctatgtta

SEQ ID NO: 1603761 - DNA, 14 bp, Homo sapiens
aattgctatgttac

SEQ ID NO: 1603762 - DNA, 20 bp, Homo sapiens
aattgctatgttactatttt

SEQ ID NO: 1603763 - DNA, 21 bp, Homo sapiens
aattgctatgttactattttc

SEQ ID NO: 1603764 - DNA, 20 bp, Homo sapiens
aattgctattttatttgtat

SEQ ID NO: 1603765 - DNA, 13 bp, Homo sapiens
aattgctcacagt

SEQ ID NO: 1603766 - DNA, 21 bp, Homo sapiens
aattgctcatgcatagtccca

SEQ ID NO: 1603767 - DNA, 14 bp, Homo sapiens
aattgctgcatatt

SEQ ID NO: 1603768 - DNA, 17 bp, Homo sapiens
aattgctgcatatttgt

SEQ ID NO: 1603769 - DNA, 17 bp, Homo sapiens
aattgctggatgcattt

SEQ ID NO: 1603770 - DNA, 19 bp, Homo sapiens
aattgctggatgcattttt

SEQ ID NO: 1603771 - DNA, 22 bp, Homo sapiens
aattgctgtgcctcccaaaatt

SEQ ID NO: 1603772 - DNA, 17 bp, Homo sapiens
aattgcttaaaagacat

SEQ ID NO: 1603773 - DNA, 19 bp, Homo sapiens
aattgctttaaatcttaag

SEQ ID NO: 1603774 - DNA, 14 bp, Homo sapiens
aattgctttatggg

SEQ ID NO: 1603775 - DNA, 20 bp, Homo sapiens
aattgctttatgggggggag

SEQ ID NO: 1603776 - DNA, 16 bp, Homo sapiens
aattgctttgccaaaa

SEQ ID NO: 1603777 - DNA, 21 bp, Homo sapiens
aattgctttgccaaaatacca

SEQ ID NO: 1603778 - DNA, 17 bp, Homo sapiens
aattgcttttgttgtga

SEQ ID NO: 1603779 - DNA, 20 bp, Homo sapiens
aattgcttttgttgtgactt

SEQ ID NO: 1603780 - DNA, 22 bp, Homo sapiens
aattgcttttgttgtgactttt

SEQ ID NO: 1603781 - DNA, 20 bp, Homo sapiens
aattggaagctgccctgccc

SEQ ID NO: 1603782 - DNA, 13 bp, Homo sapiens
aattggaatcttc

SEQ ID NO: 1603783 - DNA, 23 bp, Homo sapiens
aattggaatcttcacctcagagt

SEQ ID NO: 1603784 - DNA, 23 bp, Homo sapiens
aattggaatggaactactgtact

SEQ ID NO: 1603785 - DNA, 14 bp, Homo sapiens
aattggacttttat

SEQ ID NO: 1603786 - DNA, 20 bp, Homo sapiens
aattgggcttcaatcactgt

SEQ ID NO: 1603787 - DNA, 22 bp, Homo sapiens
aattgggcttcaatcactgtaa

SEQ ID NO: 1603788 - DNA, 23 bp, Homo sapiens
aattggtaaaaacagcagctcat

SEQ ID NO: 1603789 - DNA, 13 bp, Homo sapiens
aattggtgaataa

SEQ ID NO: 1603790 - DNA, 19 bp, Homo sapiens
aattggtgtaatggggcag

SEQ ID NO: 1603791 - DNA, 20 bp, Homo sapiens
aattggttatcatgggaaag

SEQ ID NO: 1603792 - DNA, 17 bp, Homo sapiens
aattggttttccagagg

SEQ ID NO: 1603793 - DNA, 15 bp, Homo sapiens
aattgtaagtgaaat

SEQ ID NO: 1603794 - DNA, 13 bp, Homo sapiens
aattgtacaaaat

SEQ ID NO: 1603795 - DNA, 19 bp, Homo sapiens
aattgtacaaaattaagca

SEQ ID NO: 1603796 - DNA, 20 bp, Homo sapiens
aattgtacaaaattaagcaa

SEQ ID NO: 1603797 - DNA, 13 bp, Homo sapiens
aattgtacaataa

SEQ ID NO: 1603798 - DNA, 12 bp, Homo sapiens
aattgtataagt

SEQ ID NO: 1603799 - DNA, 20 bp, Homo sapiens
acaaaatttgactaatttta

SEQ ID NO: 1603800 - DNA, 14 bp, Homo sapiens
acaaaatttgagaa

SEQ ID NO: 1603801 - DNA, 21 bp, Homo sapiens
acaaaatttgagaatacataa

SEQ ID NO: 1603802 - DNA, 13 bp, Homo sapiens
acaaaattttgtt

SEQ ID NO: 1603803 - DNA, 15 bp, Homo sapiens
acaaaattttgttta

SEQ ID NO: 1603804 - DNA, 16 bp, Homo sapiens
acaaacaaaatttcta

SEQ ID NO: 1603805 - DNA, 18 bp, Homo sapiens
acaaacaatggaaactga

SEQ ID NO: 1603806 - DNA, 23 bp, Homo sapiens
acaaacactgccatattgtgtaa

SEQ ID NO: 1603807 - DNA, 18 bp, Homo sapiens
acaaacagaaacgagatt

SEQ ID NO: 1603808 - DNA, 13 bp, Homo sapiens
acaaaccaacatc

SEQ ID NO: 1603809 - DNA, 16 bp, Homo sapiens
acaaaccaacatcttt

SEQ ID NO: 1603810 - DNA, 22 bp, Homo sapiens
acaaaccaacatctttgcgaaa

SEQ ID NO: 1603811 - DNA, 19 bp, Homo sapiens
acaaaccacaactgacaca

SEQ ID NO: 1603812 - DNA, 14 bp, Homo sapiens
acaaaccacagcag

SEQ ID NO: 1603813 - DNA, 18 bp, Homo sapiens
acaaaccaccaggactga

SEQ ID NO: 1603814 - DNA, 20 bp, Homo sapiens
acaaaccaccaggactgaaa

SEQ ID NO: 1603815 - DNA, 21 bp, Homo sapiens
acaaaccaccaggactgaaag

SEQ ID NO: 1603816 - DNA, 14 bp, Homo sapiens
acaaaccatttcca

SEQ ID NO: 1603817 - DNA, 17 bp, Homo sapiens
acaaacctactgcccac

SEQ ID NO: 1603818 - DNA, 20 bp, Homo sapiens
acaaactatgatcacagtga

SEQ ID NO: 1603819 - DNA, 10 bp, Homo sapiens
acaaactgca

SEQ ID NO: 1603820 - DNA, 20 bp, Homo sapiens
acaaactgcaatagagactg

SEQ ID NO: 1603821 - DNA, 22 bp, Homo sapiens
acaaactgcttcccttactttg

SEQ ID NO: 1603822 - DNA, 17 bp, Homo sapiens
acaaactggtattctgt

SEQ ID NO: 1603823 - DNA, 16 bp, Homo sapiens
acaaactgtgaaaata

SEQ ID NO: 1603824 - DNA, 17 bp, Homo sapiens
acaaagaaacaaagatg

SEQ ID NO: 1603825 - DNA, 15 bp, Homo sapiens
acaaagaacttgctg

SEQ ID NO: 1603826 - DNA, 19 bp, Homo sapiens
acaaagaacttgctgctgc

SEQ ID NO: 1603827 - DNA, 20 bp, Homo sapiens
acaaagaacttgctgctgcc

SEQ ID NO: 1603828 - DNA, 21 bp, Homo sapiens
acaaagagaaaaagaaatgca

SEQ ID NO: 1603829 - DNA, 22 bp, Homo sapiens
acaaagatgtttgtcagatatg

SEQ ID NO: 1603830 - DNA, 24 bp, Homo sapiens
acaaagatgtttgtcagatatgat

SEQ ID NO: 1603831 - DNA, 16 bp, Homo sapiens
acaaagattgagaagc

SEQ ID NO: 1603832 - DNA, 19 bp, Homo sapiens
acaaagccaaactctgcca

SEQ ID NO: 1603833 - DNA, 16 bp, Homo sapiens
acaaagccagaggaga

SEQ ID NO: 1603834 - DNA, 20 bp, Homo sapiens
acaaagcgtttctttacttc

SEQ ID NO: 1603835 - DNA, 23 bp, Homo sapiens
acaaagctaggatggttctgtga

SEQ ID NO: 1603836 - DNA, 15 bp, Homo sapiens
acaaagcttctaaag

SEQ ID NO: 1603837 - DNA, 17 bp, Homo sapiens
acaaagcttctaaagca

SEQ ID NO: 1603838 - DNA, 20 bp, Homo sapiens
acaaagcttctatcccagga

SEQ ID NO: 1603839 - DNA, 21 bp, Homo sapiens
acaaagcttctatcccaggag

SEQ ID NO: 1603840 - DNA, 23 bp, Homo sapiens
acaaagcttctatcccaggaggt

SEQ ID NO: 1603841 - DNA, 16 bp, Homo sapiens
acaaagctttgctaca

SEQ ID NO: 1603842 - DNA, 19 bp, Homo sapiens
acaaagctttgctacaaat

SEQ ID NO: 1603843 - DNA, 22 bp, Homo sapiens
acaaagctttgctacaaattta

SEQ ID NO: 1603844 - DNA, 17 bp, Homo sapiens
acaaagggaaagcctct

SEQ ID NO: 1603845 - DNA, 19 bp, Homo sapiens
acaaaggtataattttatg

SEQ ID NO: 1603846 - DNA, 24 bp, Homo sapiens
acaaaggtggaataaacattaatt

SEQ ID NO: 1603847 - DNA, 11 bp, Homo sapiens
acaaaggtggt

SEQ ID NO: 1603848 - DNA, 18 bp, Homo sapiens
acaaaggtggtaaattca

SEQ ID NO: 1603849 - DNA, 15 bp, Homo sapiens
acaaaggttttgtct

SEQ ID NO: 1603850 - DNA, 17 bp, Homo sapiens
acaaagtctaaggaaga

SEQ ID NO: 1603851 - DNA, 15 bp, Homo sapiens
acaaagtgtgtaatt

SEQ ID NO: 1603852 - DNA, 20 bp, Homo sapiens
acaaagtgtgtaattatgta

SEQ ID NO: 1603853 - DNA, 16 bp, Homo sapiens
acaaagtttacattgt

SEQ ID NO: 1603854 - DNA, 19 bp, Homo sapiens
acaaagtttacattgtcct

SEQ ID NO: 1603855 - DNA, 14 bp, Homo sapiens
acaaataaatgatt

SEQ ID NO: 1603856 - DNA, 15 bp, Homo sapiens
acaaataaatgatta

SEQ ID NO: 1603857 - DNA, 18 bp, Homo sapiens
acaaataaatgattatat

SEQ ID NO: 1603858 - DNA, 14 bp, Homo sapiens
aattgtataagtca

SEQ ID NO: 1603859 - DNA, 13 bp, Homo sapiens
aattgtatacatt

SEQ ID NO: 1603860 - DNA, 20 bp, Homo sapiens
aattgtatacattttgttat

SEQ ID NO: 1603861 - DNA, 18 bp, Homo sapiens
aattgtatcatttgaaca

SEQ ID NO: 1603862 - DNA, 14 bp, Homo sapiens
aattgtatgaaaat

SEQ ID NO: 1603863 - DNA, 19 bp, Homo sapiens
aattgtcactttttatgct

SEQ ID NO: 1603864 - DNA, 18 bp, Homo sapiens
aattgtccctctgtggct

SEQ ID NO: 1603865 - DNA, 18 bp, Homo sapiens
aattgtcgaaaagagtct

SEQ ID NO: 1603866 - DNA, 17 bp, Homo sapiens
aattgtcgggggagaga

SEQ ID NO: 1603867 - DNA, 14 bp, Homo sapiens
aattgtctatttat

SEQ ID NO: 1603868 - DNA, 18 bp, Homo sapiens
aattgtctcaacgcctcc

SEQ ID NO: 1603869 - DNA, 17 bp, Homo sapiens
aattgtcttttagacaa

SEQ ID NO: 1603870 - DNA, 19 bp, Homo sapiens
aattgtcttttagacaact

SEQ ID NO: 1603871 - DNA, 23 bp, Homo sapiens
aattgtcttttagacaactagat

SEQ ID NO: 1603872 - DNA, 21 bp, Homo sapiens
aattgtgaatgttggtgtgaa

SEQ ID NO: 1603873 - DNA, 11 bp, Homo sapiens
aattgtgatgt

SEQ ID NO: 1603874 - DNA, 21 bp, Homo sapiens
aattgtgcagtactttgtgca

SEQ ID NO: 1603875 - DNA, 13 bp, Homo sapiens
aattgtgctgcca

SEQ ID NO: 1603876 - DNA, 20 bp, Homo sapiens
aattgtggattataaaaaat

SEQ ID NO: 1603877 - DNA, 23 bp, Homo sapiens
aattgtggattataaaaaatgta

SEQ ID NO: 1603878 - DNA, 23 bp, Homo sapiens
aattgtgtaaaaaatggaaaaaa

SEQ ID NO: 1603879 - DNA, 16 bp, Homo sapiens
aattgtgtagcctttt

SEQ ID NO: 1603880 - DNA, 19 bp, Homo sapiens
aattgtgtattgatgcaat

SEQ ID NO: 1603881 - DNA, 21 bp, Homo sapiens
aattgtgtattgatgcaatat

SEQ ID NO: 1603882 - DNA, 15 bp, Homo sapiens
aattgtgtgatattt

SEQ ID NO: 1603883 - DNA, 19 bp, Homo sapiens
aattgtgtgatatttcaga

SEQ ID NO: 1603884 - DNA, 15 bp, Homo sapiens
aattgtgtggattct

SEQ ID NO: 1603885 - DNA, 19 bp, Homo sapiens
aattgtgtggattctttaa

SEQ ID NO: 1603886 - DNA, 23 bp, Homo sapiens
aattgtgtgtctggtaactggaa

SEQ ID NO: 1603887 - DNA, 14 bp, Homo sapiens
aattgtgtgtgcaa

SEQ ID NO: 1603888 - DNA, 16 bp, Homo sapiens
aattgttacaagtgtt

SEQ ID NO: 1603889 - DNA, 18 bp, Homo sapiens
aattgttacaagtgttct

SEQ ID NO: 1603890 - DNA, 13 bp, Homo sapiens
aattgttctcaga

SEQ ID NO: 1603891 - DNA, 17 bp, Homo sapiens
aattgttgagatacttt

SEQ ID NO: 1603892 - DNA, 22 bp, Homo sapiens
aattgttgtccggtttacttta

SEQ ID NO: 1603893 - DNA, 21 bp, Homo sapiens
aattgtttccaacttgtctgg

SEQ ID NO: 1603894 - DNA, 20 bp, Homo sapiens
aattgtttgtaagtgaagtg

SEQ ID NO: 1603895 - DNA, 22 bp, Homo sapiens
aattgtttttgaatttaaataa

SEQ ID NO: 1603896 - DNA, 23 bp, Homo sapiens
aattgtttttgaatttaaataaa

SEQ ID NO: 1603897 - DNA, 20 bp, Homo sapiens
aattgttttttaaagcaagt

SEQ ID NO: 1603898 - DNA, 13 bp, Homo sapiens
aatttaaaactgt

SEQ ID NO: 1603899 - DNA, 19 bp, Homo sapiens
aatttaaaactgttatttt

SEQ ID NO: 1603900 - DNA, 23 bp, Homo sapiens
aatttaaaactgttatttttaca

SEQ ID NO: 1603901 - DNA, 19 bp, Homo sapiens
aatttaaaataattatata

SEQ ID NO: 1603902 - DNA, 18 bp, Homo sapiens
aatttaaacaggcccagc

SEQ ID NO: 1603903 - DNA, 16 bp, Homo sapiens
aatttaaacatttgtt

SEQ ID NO: 1603904 - DNA, 20 bp, Homo sapiens
aatttaaacatttgttcctg

SEQ ID NO: 1603905 - DNA, 22 bp, Homo sapiens
aatttaaacatttgttcctgga

SEQ ID NO: 1603906 - DNA, 13 bp, Homo sapiens
aatttaaactgtg

SEQ ID NO: 1603907 - DNA, 19 bp, Homo sapiens
aatttaaagggtgtactta

SEQ ID NO: 1603908 - DNA, 22 bp, Homo sapiens
aatttaaagggtgtacttatat

SEQ ID NO: 1603909 - DNA, 15 bp, Homo sapiens
aatttaaataaagtt

SEQ ID NO: 1603910 - DNA, 19 bp, Homo sapiens
aatttaaatataattctgt

SEQ ID NO: 1603911 - DNA, 22 bp, Homo sapiens
aatttaaatgaaagaaaattga

SEQ ID NO: 1603912 - DNA, 22 bp, Homo sapiens
aatttaaatggcttttgccaca

SEQ ID NO: 1603913 - DNA, 13 bp, Homo sapiens
aatttaactgcat

SEQ ID NO: 1603914 - DNA, 11 bp, Homo sapiens
aatttaagcaa

SEQ ID NO: 1603915 - DNA, 14 bp, Homo sapiens
aatttaagtatctt

SEQ ID NO: 1603916 - DNA, 21 bp, Homo sapiens
aatttaagtgacacagacatt

SEQ ID NO: 1603917 - DNA, 15 bp, Homo sapiens
aatttaatatactgc

SEQ ID NO: 1603918 - DNA, 14 bp, Homo sapiens
aatttaatgcatgt

SEQ ID NO: 1603919 - DNA, 17 bp, Homo sapiens
aatttaatgctgccttt

SEQ ID NO: 1603920 - DNA, 18 bp, Homo sapiens
aatttaattcatgtttct

SEQ ID NO: 1603921 - DNA, 15 bp, Homo sapiens
aatttacactgccat

SEQ ID NO: 1603922 - DNA, 15 bp, Homo sapiens
aatttacatactctg

SEQ ID NO: 1603923 - DNA, 19 bp, Homo sapiens
aatttaccaaggatgaatt

SEQ ID NO: 1603924 - DNA, 16 bp, Homo sapiens
aatttacctaagatta

SEQ ID NO: 1603925 - DNA, 16 bp, Homo sapiens
aatttacttgttttgg

SEQ ID NO: 1603926 - DNA, 14 bp, Homo sapiens
aatttactttcttc

SEQ ID NO: 1603927 - DNA, 12 bp, Homo sapiens
aatttagtatta

SEQ ID NO: 1603928 - DNA, 16 bp, Homo sapiens
aatttataaagaaaaa

SEQ ID NO: 1603929 - DNA, 20 bp, Homo sapiens
aatttatatctaatatgaag

SEQ ID NO: 1603930 - DNA, 17 bp, Homo sapiens
aatttatcacacttctg

SEQ ID NO: 1603931 - DNA, 18 bp, Homo sapiens
aatttatcctgaaatttc

SEQ ID NO: 1603932 - DNA, 18 bp, Homo sapiens
aatttatctttaccaaaa

SEQ ID NO: 1603933 - DNA, 16 bp, Homo sapiens
aatttatctttgataa

SEQ ID NO: 1603934 - DNA, 13 bp, Homo sapiens
aatttatgcattt

SEQ ID NO: 1603935 - DNA, 14 bp, Homo sapiens
aatttatgcatttc

SEQ ID NO: 1603936 - DNA, 22 bp, Homo sapiens
aatttattacaaatcagaactt

SEQ ID NO: 1603937 - DNA, 16 bp, Homo sapiens
aatttattagtttaaa

SEQ ID NO: 1603938 - DNA, 21 bp, Homo sapiens
aatttattagtttaaaatgca

SEQ ID NO: 1603939 - DNA, 21 bp, Homo sapiens
aatttattcaattcctctggg

SEQ ID NO: 1603940 - DNA, 20 bp, Homo sapiens
aatttattgtctgtctacat

SEQ ID NO: 1603941 - DNA, 18 bp, Homo sapiens
aatttatttcttaacctt

SEQ ID NO: 1603942 - DNA, 12 bp, Homo sapiens
aatttatttgtt

SEQ ID NO: 1603943 - DNA, 16 bp, Homo sapiens
aatttattttataaga

SEQ ID NO: 1603944 - DNA, 22 bp, Homo sapiens
aatttattttataagaaaaact

SEQ ID NO: 1603945 - DNA, 19 bp, Homo sapiens
aatttcaaaaatataactt

SEQ ID NO: 1603946 - DNA, 18 bp, Homo sapiens
aatttcaaggttctaacc

SEQ ID NO: 1603947 - DNA, 14 bp, Homo sapiens
aatttcacattaat

SEQ ID NO: 1603948 - DNA, 21 bp, Homo sapiens
aatttcaccaccaaatgccaa

SEQ ID NO: 1603949 - DNA, 20 bp, Homo sapiens
aatttcagagagaatcaaga

SEQ ID NO: 1603950 - DNA, 13 bp, Homo sapiens
aatttcaggaaaa

SEQ ID NO: 1603951 - DNA, 16 bp, Homo sapiens
aatttcaggcattttg

SEQ ID NO: 1603952 - DNA, 18 bp, Homo sapiens
aatttcatatgctgtata

SEQ ID NO: 1603953 - DNA, 15 bp, Homo sapiens
aatttcattgtgttg

SEQ ID NO: 1603954 - DNA, 19 bp, Homo sapiens
aatttccaggaaaaaataa

SEQ ID NO: 1603955 - DNA, 17 bp, Homo sapiens
aatttcccaggaccctg

SEQ ID NO: 1603956 - DNA, 21 bp, Homo sapiens
aatttcccaggaccctgaagg

SEQ ID NO: 1603957 - DNA, 17 bp, Homo sapiens
aatttcccagttaaaga

SEQ ID NO: 1603958 - DNA, 17 bp, Homo sapiens
aatttcctctccactgc

SEQ ID NO: 1603959 - DNA, 11 bp, Homo sapiens
aatttcctggc

SEQ ID NO: 1603960 - DNA, 16 bp, Homo sapiens
aatttcctgtttgaaa

SEQ ID NO: 1603961 - DNA, 15 bp, Homo sapiens
aatttcctttttgac

SEQ ID NO: 1603962 - DNA, 18 bp, Homo sapiens
aatttcctttttgacact

SEQ ID NO: 1603963 - DNA, 21 bp, Homo sapiens
aatttcctttttgacactgaa

SEQ ID NO: 1603964 - DNA, 14 bp, Homo sapiens
aatttcgccttaaa

SEQ ID NO: 1603965 - DNA, 15 bp, Homo sapiens
aatttcgccttaaac

SEQ ID NO: 1603966 - DNA, 17 bp, Homo sapiens
aatttcgttgtccaatt

SEQ ID NO: 1603967 - DNA, 13 bp, Homo sapiens
aatttctattaaa

SEQ ID NO: 1603968 - DNA, 15 bp, Homo sapiens
aatttctattaatat

SEQ ID NO: 1603969 - DNA, 12 bp, Homo sapiens
aatttctcctcc

SEQ ID NO: 1603970 - DNA, 14 bp, Homo sapiens
aatttctcctccct

SEQ ID NO: 1603971 - DNA, 20 bp, Homo sapiens
aatttctcctcccttccttt

SEQ ID NO: 1603972 - DNA, 19 bp, Homo sapiens
aatttctgaaagatgagta

SEQ ID NO: 1603973 - DNA, 18 bp, Homo sapiens
aatttctgctaaatatca

SEQ ID NO: 1603974 - DNA, 15 bp, Homo sapiens
aatttcttatttacc

SEQ ID NO: 1603975 - DNA, 17 bp, Homo sapiens
aatttcttggtaagaag

SEQ ID NO: 1603976 - DNA, 12 bp, Homo sapiens
aatttctttgtt

SEQ ID NO: 1603977 - DNA, 19 bp, Homo sapiens
aatttcttttttcctctga

SEQ ID NO: 1603978 - DNA, 14 bp, Homo sapiens
aatttgaagtaact

SEQ ID NO: 1603979 - DNA, 16 bp, Homo sapiens
aatttgaatgtatttg

SEQ ID NO: 1603980 - DNA, 18 bp, Homo sapiens
aatttgacttttctgtaa

SEQ ID NO: 1603981 - DNA, 18 bp, Homo sapiens
aatttgaggagggaatga

SEQ ID NO: 1603982 - DNA, 14 bp, Homo sapiens
aatttgatacataa

SEQ ID NO: 1603983 - DNA, 18 bp, Homo sapiens
aatttgatcgttccagtt

SEQ ID NO: 1603984 - DNA, 18 bp, Homo sapiens
aatttgatgcccaatata

SEQ ID NO: 1603985 - DNA, 13 bp, Homo sapiens
aatttgatttcca

SEQ ID NO: 1603986 - DNA, 18 bp, Homo sapiens
aatttgcacagtgtgtga

SEQ ID NO: 1603987 - DNA, 22 bp, Homo sapiens
aatttgcacatcttggctatgt

SEQ ID NO: 1603988 - DNA, 20 bp, Homo sapiens
aatttgcactaaatcagaga

SEQ ID NO: 1603989 - DNA, 18 bp, Homo sapiens
aatttggagcacaaaatt

SEQ ID NO: 1603990 - DNA, 19 bp, Homo sapiens
aatttggagcacaaaattc

SEQ ID NO: 1603991 - DNA, 21 bp, Homo sapiens
aatttggagcacaaaattcaa

SEQ ID NO: 1603992 - DNA, 18 bp, Homo sapiens
aatttggcctgcactaat

SEQ ID NO: 1603993 - DNA, 17 bp, Homo sapiens
aatttggccttaagaac

SEQ ID NO: 1603994 - DNA, 20 bp, Homo sapiens
aatttggccttaagaactgt

SEQ ID NO: 1603995 - DNA, 21 bp, Homo sapiens
aatttggccttaagaactgtg

SEQ ID NO: 1603996 - DNA, 21 bp, Homo sapiens
aatttgggagaagcaaatata

SEQ ID NO: 1603997 - DNA, 22 bp, Homo sapiens
aatttgggagaagcaaatatag

SEQ ID NO: 1603998 - DNA, 18 bp, Homo sapiens
aatttggtaaaaatgctg

SEQ ID NO: 1603999 - DNA, 14 bp, Homo sapiens
aatttggtataatt

SEQ ID NO: 1604000 - DNA, 16 bp, Homo sapiens
aatttggttctaatag

SEQ ID NO: 1604001 - DNA, 23 bp, Homo sapiens
aatttgtaaaaacagcattgctt

SEQ ID NO: 1604002 - DNA, 24 bp, Homo sapiens
aatttgtaaaaacagcattgcttt

SEQ ID NO: 1604003 - DNA, 15 bp, Homo sapiens
aatttgtaattgctt

SEQ ID NO: 1604004 - DNA, 16 bp, Homo sapiens
aatttgtacaatggtt

SEQ ID NO: 1604005 - DNA, 18 bp, Homo sapiens
aatttgtacaatggttta

SEQ ID NO: 1604006 - DNA, 21 bp, Homo sapiens
aatttgtacaatggtttattc

SEQ ID NO: 1604007 - DNA, 20 bp, Homo sapiens
aatttgtacatatgtaaaat

SEQ ID NO: 1604008 - DNA, 13 bp, Homo sapiens
aatttgtacttct

SEQ ID NO: 1604009 - DNA, 20 bp, Homo sapiens
aatttgtcagcgttctacca

SEQ ID NO: 1604010 - DNA, 16 bp, Homo sapiens
aatttgtcttgcctta

SEQ ID NO: 1604011 - DNA, 19 bp, Homo sapiens
aatttgtggtaaagtagtt

SEQ ID NO: 1604012 - DNA, 21 bp, Homo sapiens
aatttgtgtgtttttagctgt

SEQ ID NO: 1604013 - DNA, 16 bp, Homo sapiens
aatttgttataatgaa

SEQ ID NO: 1604014 - DNA, 21 bp, Homo sapiens
aatttgttcttgtatttattg

SEQ ID NO: 1604015 - DNA, 14 bp, Homo sapiens
aatttgtttaaaga

SEQ ID NO: 1604016 - DNA, 23 bp, Homo sapiens
aatttgtttgtgttcaatatcag

SEQ ID NO: 1604017 - DNA, 15 bp, Homo sapiens
aattttaaaaatcta

SEQ ID NO: 1604018 - DNA, 15 bp, Homo sapiens
aattttaaaacattt

SEQ ID NO: 1604019 - DNA, 15 bp, Homo sapiens
aattttaaagccatt

SEQ ID NO: 1604020 - DNA, 13 bp, Homo sapiens
aattttaaagtgc

SEQ ID NO: 1604021 - DNA, 16 bp, Homo sapiens
aattttaaagtgcaaa

SEQ ID NO: 1604022 - DNA, 13 bp, Homo sapiens
aattttaaagttc

SEQ ID NO: 1604023 - DNA, 18 bp, Homo sapiens
aattttaaataaaagtga

SEQ ID NO: 1604024 - DNA, 22 bp, Homo sapiens
aattttaaataaaagtgatcaa

SEQ ID NO: 1604025 - DNA, 17 bp, Homo sapiens
aattttaaataatttct

SEQ ID NO: 1604026 - DNA, 12 bp, Homo sapiens
aattttaaatta

SEQ ID NO: 1604027 - DNA, 23 bp, Homo sapiens
aattttaagcctttgttgaactg

SEQ ID NO: 1604028 - DNA, 16 bp, Homo sapiens
aattttaatattttat

SEQ ID NO: 1604029 - DNA, 13 bp, Homo sapiens
aattttaatgtga

SEQ ID NO: 1604030 - DNA, 14 bp, Homo sapiens
aattttaatgtgaa

SEQ ID NO: 1604031 - DNA, 16 bp, Homo sapiens
aattttaatgtgaaga

SEQ ID NO: 1604032 - DNA, 23 bp, Homo sapiens
aattttaccctgaggtcactgct

SEQ ID NO: 1604033 - DNA, 18 bp, Homo sapiens
aattttaccctttagact

SEQ ID NO: 1604034 - DNA, 21 bp, Homo sapiens
aattttaccctttagactgta

SEQ ID NO: 1604035 - DNA, 23 bp, Homo sapiens
aattttactccataaacagactg

SEQ ID NO: 1604036 - DNA, 16 bp, Homo sapiens
aattttagaaatattc

SEQ ID NO: 1604037 - DNA, 12 bp, Homo sapiens
aattttaggaac

SEQ ID NO: 1604038 - DNA, 21 bp, Homo sapiens
aattttaggaacttcagagat

SEQ ID NO: 1604039 - DNA, 21 bp, Homo sapiens
aattttagtgtgccttccaaa

SEQ ID NO: 1604040 - DNA, 14 bp, Homo sapiens
aattttagtttttc

SEQ ID NO: 1604041 - DNA, 16 bp, Homo sapiens
aattttagtttttcat

SEQ ID NO: 1604042 - DNA, 15 bp, Homo sapiens
aattttatatcttgt

SEQ ID NO: 1604043 - DNA, 19 bp, Homo sapiens
aattttatctgtttcctga

SEQ ID NO: 1604044 - DNA, 23 bp, Homo sapiens
aattttatttgttctttttctga

SEQ ID NO: 1604045 - DNA, 16 bp, Homo sapiens
aattttattttgctga

SEQ ID NO: 1604046 - DNA, 21 bp, Homo sapiens
aattttcaaggccttcagttt

SEQ ID NO: 1604047 - DNA, 15 bp, Homo sapiens
aattttcaagtaatt

SEQ ID NO: 1604048 - DNA, 19 bp, Homo sapiens
aattttcaagtaattgtga

SEQ ID NO: 1604049 - DNA, 17 bp, Homo sapiens
aattttcagaccccagc

SEQ ID NO: 1604050 - DNA, 16 bp, Homo sapiens
aattttcagagacttt

SEQ ID NO: 1604051 - DNA, 12 bp, Homo sapiens
aattttcagcat

SEQ ID NO: 1604052 - DNA, 15 bp, Homo sapiens
aattttccaaccttt

SEQ ID NO: 1604053 - DNA, 16 bp, Homo sapiens
aattttccaacctttg

SEQ ID NO: 1604054 - DNA, 18 bp, Homo sapiens
aattttccaagtaaagtg

SEQ ID NO: 1604055 - DNA, 15 bp, Homo sapiens
aattttctatgtgtt

SEQ ID NO: 1604056 - DNA, 13 bp, Homo sapiens
aattttctccttg

SEQ ID NO: 1604057 - DNA, 11 bp, Homo sapiens
aattttctgta

SEQ ID NO: 1604058 - DNA, 19 bp, Homo sapiens
aattttctgtggatcattt

SEQ ID NO: 1604059 - DNA, 20 bp, Homo sapiens
aattttctgtggatcatttc

SEQ ID NO: 1604060 - DNA, 13 bp, Homo sapiens
aattttcttgttt

SEQ ID NO: 1604061 - DNA, 16 bp, Homo sapiens
aattttctttgtttct

SEQ ID NO: 1604062 - DNA, 17 bp, Homo sapiens
aattttctttgtttctt

SEQ ID NO: 1604063 - DNA, 16 bp, Homo sapiens
aattttgacactatat

SEQ ID NO: 1604064 - DNA, 20 bp, Homo sapiens
aattttgagttctacataag

SEQ ID NO: 1604065 - DNA, 20 bp, Homo sapiens
aattttgatatacattgtgt

SEQ ID NO: 1604066 - DNA, 22 bp, Homo sapiens
aattttgatatacattgtgtga

SEQ ID NO: 1604067 - DNA, 23 bp, Homo sapiens
aattttgatctttttatattctt

SEQ ID NO: 1604068 - DNA, 13 bp, Homo sapiens
aattttgatttct

SEQ ID NO: 1604069 - DNA, 12 bp, Homo sapiens
aattttgcaatg

SEQ ID NO: 1604070 - DNA, 16 bp, Homo sapiens
aattttgctaactggg

SEQ ID NO: 1604071 - DNA, 21 bp, Homo sapiens
aattttgctaactgggttaaa

SEQ ID NO: 1604072 - DNA, 16 bp, Homo sapiens
aattttgcttttaatt

SEQ ID NO: 1604073 - DNA, 19 bp, Homo sapiens
aattttggaataatttcta

SEQ ID NO: 1604074 - DNA, 17 bp, Homo sapiens
aattttggccaaagtgt

SEQ ID NO: 1604075 - DNA, 15 bp, Homo sapiens
aattttgtaacgaag

SEQ ID NO: 1604076 - DNA, 21 bp, Homo sapiens
aattttgtatattgtaggaat

SEQ ID NO: 1604077 - DNA, 23 bp, Homo sapiens
aattttgtcctaatatatacata

SEQ ID NO: 1604078 - DNA, 21 bp, Homo sapiens
aattttgtcttaagtgtttct

SEQ ID NO: 1604079 - DNA, 21 bp, Homo sapiens
aattttgtgcattctttggta

SEQ ID NO: 1604080 - DNA, 16 bp, Homo sapiens
aattttgttctctggg

SEQ ID NO: 1604081 - DNA, 19 bp, Homo sapiens
aattttgttctctgggaga

SEQ ID NO: 1604082 - DNA, 24 bp, Homo sapiens
aattttgttctctgggagaaaatc

SEQ ID NO: 1604083 - DNA, 22 bp, Homo sapiens
aattttgttgaaaatggtttca

SEQ ID NO: 1604084 - DNA, 13 bp, Homo sapiens
aattttgttgctg

SEQ ID NO: 1604085 - DNA, 14 bp, Homo sapiens
aattttgtttttat

SEQ ID NO: 1604086 - DNA, 20 bp, Homo sapiens
aatttttaaagtatatattt

SEQ ID NO: 1604087 - DNA, 14 bp, Homo sapiens
aatttttacattca

SEQ ID NO: 1604088 - DNA, 12 bp, Homo sapiens
aatttttataaa

SEQ ID NO: 1604089 - DNA, 15 bp, Homo sapiens
aatttttatttattt

SEQ ID NO: 1604090 - DNA, 20 bp, Homo sapiens
aattaaatccaactttcaca

SEQ ID NO: 1604091 - DNA, 11 bp, Homo sapiens
aattaaatgta

SEQ ID NO: 1604092 - DNA, 14 bp, Homo sapiens
aattaaattttgag

SEQ ID NO: 1604093 - DNA, 22 bp, Homo sapiens
aattaaattttgagttctacat

SEQ ID NO: 1604094 - DNA, 21 bp, Homo sapiens
aattaacaaatttctttgttt

SEQ ID NO: 1604095 - DNA, 13 bp, Homo sapiens
aattaactcacca

SEQ ID NO: 1604096 - DNA, 23 bp, Homo sapiens
aattaagaaatactcatgtgcaa

SEQ ID NO: 1604097 - DNA, 16 bp, Homo sapiens
aattaagaaattccat

SEQ ID NO: 1604098 - DNA, 15 bp, Homo sapiens
aattaagatttcctt

SEQ ID NO: 1604099 - DNA, 18 bp, Homo sapiens
aattaagcaaatgttaaa

SEQ ID NO: 1604100 - DNA, 23 bp, Homo sapiens
aattaagcaaatgttaaaagttt

SEQ ID NO: 1604101 - DNA, 21 bp, Homo sapiens
aattaagcattttgaaacaaa

SEQ ID NO: 1604102 - DNA, 16 bp, Homo sapiens
aattaagtactatgta

SEQ ID NO: 1604103 - DNA, 17 bp, Homo sapiens
aattaagtactatgtat

SEQ ID NO: 1604104 - DNA, 12 bp, Homo sapiens
aattaagttgaa

SEQ ID NO: 1604105 - DNA, 13 bp, Homo sapiens
aattaagttgaaa

SEQ ID NO: 1604106 - DNA, 23 bp, Homo sapiens
aattaataaaaaatggaaagaat

SEQ ID NO: 1604107 - DNA, 14 bp, Homo sapiens
aattaatagtttgt

SEQ ID NO: 1604108 - DNA, 23 bp, Homo sapiens
aattaatatggtgtatttttcca

SEQ ID NO: 1604109 - DNA, 21 bp, Homo sapiens
aattaatcttgcttcattgtt

SEQ ID NO: 1604110 - DNA, 18 bp, Homo sapiens
aattaatgcagatttctc

SEQ ID NO: 1604111 - DNA, 16 bp, Homo sapiens
aattaatggaatcttc

SEQ ID NO: 1604112 - DNA, 15 bp, Homo sapiens
aattaattgtaatct

SEQ ID NO: 1604113 - DNA, 12 bp, Homo sapiens
aattaattttac

SEQ ID NO: 1604114 - DNA, 15 bp, Homo sapiens
aattacaaaaggctc

SEQ ID NO: 1604115 - DNA, 14 bp, Homo sapiens
aattacaattgtca

SEQ ID NO: 1604116 - DNA, 19 bp, Homo sapiens
aattacagtccaaaatact

SEQ ID NO: 1604117 - DNA, 19 bp, Homo sapiens
aattacagtgcctaaaata

SEQ ID NO: 1604118 - DNA, 23 bp, Homo sapiens
aattacagtgcctaaaataagaa

SEQ ID NO: 1604119 - DNA, 16 bp, Homo sapiens
aattacatacagattt

SEQ ID NO: 1604120 - DNA, 17 bp, Homo sapiens
aattacatttgtaattt

SEQ ID NO: 1604121 - DNA, 19 bp, Homo sapiens
aattacatttgtaatttaa

SEQ ID NO: 1604122 - DNA, 19 bp, Homo sapiens
aattacccataaacagcac

SEQ ID NO: 1604123 - DNA, 13 bp, Homo sapiens
aatgtattcaaat

SEQ ID NO: 1604124 - DNA, 17 bp, Homo sapiens
aatgtattcatatttgt

SEQ ID NO: 1604125 - DNA, 14 bp, Homo sapiens
aatgtattgattca

SEQ ID NO: 1604126 - DNA, 22 bp, Homo sapiens
aatgtatttagctacagcttgt

SEQ ID NO: 1604127 - DNA, 21 bp, Homo sapiens
aatgtatttatttaaaagatt

SEQ ID NO: 1604128 - DNA, 17 bp, Homo sapiens
aatgtatttgatttata

SEQ ID NO: 1604129 - DNA, 19 bp, Homo sapiens
aatgtcaccaccttcccag

SEQ ID NO: 1604130 - DNA, 12 bp, Homo sapiens
aatgtcagaaca

SEQ ID NO: 1604131 - DNA, 17 bp, Homo sapiens
aatgtcagatacaatgt

SEQ ID NO: 1604132 - DNA, 16 bp, Homo sapiens
aatgtcagatttctgg

SEQ ID NO: 1604133 - DNA, 16 bp, Homo sapiens
aatgtcagtatgtgga

SEQ ID NO: 1604134 - DNA, 18 bp, Homo sapiens
aatgtcataaattactgt

SEQ ID NO: 1604135 - DNA, 20 bp, Homo sapiens
aatgtcataaattactgttt

SEQ ID NO: 1604136 - DNA, 18 bp, Homo sapiens
aatgtcatatactgccat

SEQ ID NO: 1604137 - DNA, 14 bp, Homo sapiens
aatgtcattgctaa

SEQ ID NO: 1604138 - DNA, 15 bp, Homo sapiens
aatgtcattgctaaa

SEQ ID NO: 1604139 - DNA, 20 bp, Homo sapiens
aatgtcattgctaaaaaata

SEQ ID NO: 1604140 - DNA, 18 bp, Homo sapiens
aatgtccatgatggaata

SEQ ID NO: 1604141 - DNA, 19 bp, Homo sapiens
aatgtccccattctataaa

SEQ ID NO: 1604142 - DNA, 17 bp, Homo sapiens
aatgtcctccagaagcc

SEQ ID NO: 1604143 - DNA, 18 bp, Homo sapiens
aatgtcctccagaagcct

SEQ ID NO: 1604144 - DNA, 21 bp, Homo sapiens
aatgtcctccagaagcctctg

SEQ ID NO: 1604145 - DNA, 14 bp, Homo sapiens
aatgtcctcttgga

SEQ ID NO: 1604146 - DNA, 21 bp, Homo sapiens
aatgtccttattcttgtggtt

SEQ ID NO: 1604147 - DNA, 12 bp, Homo sapiens
aatgtctaaatg

SEQ ID NO: 1604148 - DNA, 12 bp, Homo sapiens
aatgtctgcagc

SEQ ID NO: 1604149 - DNA, 13 bp, Homo sapiens
aatgtctgctggt

SEQ ID NO: 1604150 - DNA, 12 bp, Homo sapiens
aatgtcttttga

SEQ ID NO: 1604151 - DNA, 19 bp, Homo sapiens
aatggagtcagtttgcagt

SEQ ID NO: 1604152 - DNA, 14 bp, Homo sapiens
aatggatagctcat

SEQ ID NO: 1604153 - DNA, 14 bp, Homo sapiens
aatggatattatta

SEQ ID NO: 1604154 - DNA, 17 bp, Homo sapiens
aatggatattattagaa

SEQ ID NO: 1604155 - DNA, 19 bp, Homo sapiens
aatggatattattagaaat

SEQ ID NO: 1604156 - DNA, 17 bp, Homo sapiens
aatggatcacaagatgg

SEQ ID NO: 1604157 - DNA, 19 bp, Homo sapiens
aatggatttttaaattata

SEQ ID NO: 1604158 - DNA, 13 bp, Homo sapiens
aatggatttttct

SEQ ID NO: 1604159 - DNA, 18 bp, Homo sapiens
aatggatttttctttaac

SEQ ID NO: 1604160 - DNA, 20 bp, Homo sapiens
aatggatttttctttaactg

SEQ ID NO: 1604161 - DNA, 19 bp, Homo sapiens
aatggatttttgactttgt

SEQ ID NO: 1604162 - DNA, 21 bp, Homo sapiens
aatggcaaggcagccctgtct

SEQ ID NO: 1604163 - DNA, 12 bp, Homo sapiens
aatggcactgat

SEQ ID NO: 1604164 - DNA, 13 bp, Homo sapiens
aatggcagctaga

SEQ ID NO: 1604165 - DNA, 19 bp, Homo sapiens
aatggcagctagactggag

SEQ ID NO: 1604166 - DNA, 16 bp, Homo sapiens
aatggcagctagtgcc

SEQ ID NO: 1604167 - DNA, 13 bp, Homo sapiens
aatggcagtcctg

SEQ ID NO: 1604168 - DNA, 14 bp, Homo sapiens
aatggcagtcctgg

SEQ ID NO: 1604169 - DNA, 17 bp, Homo sapiens
aatggcagtcctggagg

SEQ ID NO: 1604170 - DNA, 18 bp, Homo sapiens
aatggcatttctctttaa

SEQ ID NO: 1604171 - DNA, 17 bp, Homo sapiens
aatggccatgcaggagg

SEQ ID NO: 1604172 - DNA, 17 bp, Homo sapiens
aatggccatttgctttt

SEQ ID NO: 1604173 - DNA, 20 bp, Homo sapiens
aatggcctgccttgaagcca

SEQ ID NO: 1604174 - DNA, 22 bp, Homo sapiens
aagtttattttttctacacagt

SEQ ID NO: 1604175 - DNA, 19 bp, Homo sapiens
aagtttcaagttttaaagt

SEQ ID NO: 1604176 - DNA, 20 bp, Homo sapiens
aagtttcaagttttaaagtt

SEQ ID NO: 1604177 - DNA, 12 bp, Homo sapiens
aagtttccatat

SEQ ID NO: 1604178 - DNA, 16 bp, Homo sapiens
aagtttccatcatcta

SEQ ID NO: 1604179 - DNA, 18 bp, Homo sapiens
aagtttcgtatgcactcc

SEQ ID NO: 1604180 - DNA, 12 bp, Homo sapiens
aagtttctaaga

SEQ ID NO: 1604181 - DNA, 19 bp, Homo sapiens
aagtttctagctagaaata

SEQ ID NO: 1604182 - DNA, 21 bp, Homo sapiens
aagtttctagctagaaatatg

SEQ ID NO: 1604183 - DNA, 17 bp, Homo sapiens
aagtttctattctgtca

SEQ ID NO: 1604184 - DNA, 13 bp, Homo sapiens
aagtttctcagat

SEQ ID NO: 1604185 - DNA, 13 bp, Homo sapiens
aagtttctcttct

SEQ ID NO: 1604186 - DNA, 17 bp, Homo sapiens
aagtttgaaaatagtta

SEQ ID NO: 1604187 - DNA, 17 bp, Homo sapiens
aagtttgaaggaaacag

SEQ ID NO: 1604188 - DNA, 11 bp, Homo sapiens
aagtttgcact

SEQ ID NO: 1604189 - DNA, 20 bp, Homo sapiens
aagtttgcactcaaatctta

SEQ ID NO: 1604190 - DNA, 15 bp, Homo sapiens
aagtttgcttagaaa

SEQ ID NO: 1604191 - DNA, 23 bp, Homo sapiens
aagtttggagcactagtttgatt

SEQ ID NO: 1604192 - DNA, 17 bp, Homo sapiens
aagttttaaaaagccag

SEQ ID NO: 1604193 - DNA, 19 bp, Homo sapiens
aagttttaaaaagccagtt

SEQ ID NO: 1604194 - DNA, 14 bp, Homo sapiens
aagttttaacttta

SEQ ID NO: 1604195 - DNA, 21 bp, Homo sapiens
aagttttaactttaatacagc

SEQ ID NO: 1604196 - DNA, 11 bp, Homo sapiens
aagttttcagg

SEQ ID NO: 1604197 - DNA, 23 bp, Homo sapiens
aagttttccctgaagttatgtgt

SEQ ID NO: 1604198 - DNA, 15 bp, Homo sapiens
aagttttgcatttat

SEQ ID NO: 1604199 - DNA, 16 bp, Homo sapiens
aagttttggagaggga

SEQ ID NO: 1604200 - DNA, 17 bp, Homo sapiens
aagttttggagagggaa

SEQ ID NO: 1604201 - DNA, 23 bp, Homo sapiens
aagttttgggtatgtttaatctg

SEQ ID NO: 1604202 - DNA, 19 bp, Homo sapiens
aagttttgtaaaagaaatc

SEQ ID NO: 1604203 - DNA, 13 bp, Homo sapiens
aagttttgttgta

SEQ ID NO: 1604204 - DNA, 22 bp, Homo sapiens
aagttttgttgtacttaaatgg

SEQ ID NO: 1604205 - DNA, 11 bp, Homo sapiens
aagtttttcca

SEQ ID NO: 1604206 - DNA, 13 bp, Homo sapiens
aagtttttccaaa

SEQ ID NO: 1604207 - DNA, 13 bp, Homo sapiens
aagtttttttgct

SEQ ID NO: 1604208 - DNA, 16 bp, Homo sapiens
aataaaaaatggctga

SEQ ID NO: 1604209 - DNA, 15 bp, Homo sapiens
aataaaaagaaaggc

SEQ ID NO: 1604210 - DNA, 17 bp, Homo sapiens
aataaaaagatcacttt

SEQ ID NO: 1604211 - DNA, 12 bp, Homo sapiens
aataaaaaggaa

SEQ ID NO: 1604212 - DNA, 13 bp, Homo sapiens
aataaaaagtgac

SEQ ID NO: 1604213 - DNA, 15 bp, Homo sapiens
aataaaacaataaat

SEQ ID NO: 1604214 - DNA, 15 bp, Homo sapiens
aataaaacacacctc

SEQ ID NO: 1604215 - DNA, 22 bp, Homo sapiens
aataaaactgcgaggacatcaa

SEQ ID NO: 1604216 - DNA, 14 bp, Homo sapiens
aataaaagtgcaca

SEQ ID NO: 1604217 - DNA, 14 bp, Homo sapiens
aataaaataaaaat

SEQ ID NO: 1604218 - DNA, 22 bp, Homo sapiens
aataaaatatcataaagcattt

SEQ ID NO: 1604219 - DNA, 20 bp, Homo sapiens
aataaaatcatgtagtttgt

SEQ ID NO: 1604220 - DNA, 15 bp, Homo sapiens
aataaaatgaacatc

SEQ ID NO: 1604221 - DNA, 13 bp, Homo sapiens
aataaaatgcatt

SEQ ID NO: 1604222 - DNA, 15 bp, Homo sapiens
aataaaatgcattta

SEQ ID NO: 1604223 - DNA, 17 bp, Homo sapiens
aataaaatgcatttaaa

SEQ ID NO: 1604224 - DNA, 14 bp, Homo sapiens
aataaaatgtgatt

SEQ ID NO: 1604225 - DNA, 16 bp, Homo sapiens
aataaaatgtgtacag

SEQ ID NO: 1604226 - DNA, 17 bp, Homo sapiens
aataaaatgtgtacagt

SEQ ID NO: 1604227 - DNA, 19 bp, Homo sapiens
aataaaatgtgtacagtga

SEQ ID NO: 1604228 - DNA, 16 bp, Homo sapiens
aataaaattacacagt

SEQ ID NO: 1604229 - DNA, 13 bp, Homo sapiens
aataaaattccta

SEQ ID NO: 1604230 - DNA, 18 bp, Homo sapiens
aataaaattcctatctca

SEQ ID NO: 1604231 - DNA, 14 bp, Homo sapiens
aataaaattgcact

SEQ ID NO: 1604232 - DNA, 12 bp, Homo sapiens
aataaaatttcc

SEQ ID NO: 1604233 - DNA, 19 bp, Homo sapiens
aataaacagacaaaaacaa

SEQ ID NO: 1604234 - DNA, 21 bp, Homo sapiens
aataaacagcttcatgccttt

SEQ ID NO: 1604235 - DNA, 18 bp, Homo sapiens
aataaacaggaattttat

SEQ ID NO: 1604236 - DNA, 13 bp, Homo sapiens
aataaacatcctt

SEQ ID NO: 1604237 - DNA, 12 bp, Homo sapiens
aataaaccagat

SEQ ID NO: 1604238 - DNA, 16 bp, Homo sapiens
aataaacctgaggcag

SEQ ID NO: 1604239 - DNA, 18 bp, Homo sapiens
aataaacctgggctcagc

SEQ ID NO: 1604240 - DNA, 16 bp, Homo sapiens
aataaactagtttcca

SEQ ID NO: 1604241 - DNA, 17 bp, Homo sapiens
aataaactagtttccag

SEQ ID NO: 1604242 - DNA, 18 bp, Homo sapiens
aataaactgtattaaatc

SEQ ID NO: 1604243 - DNA, 17 bp, Homo sapiens
aataaactgtgtttact

SEQ ID NO: 1604244 - DNA, 17 bp, Homo sapiens
aataaacttagaggaaa

SEQ ID NO: 1604245 - DNA, 23 bp, Homo sapiens
aataaacttgattatattgtttt

SEQ ID NO: 1604246 - DNA, 13 bp, Homo sapiens
aataaactttaat

SEQ ID NO: 1604247 - DNA, 20 bp, Homo sapiens
aataaactttattttttaaa

SEQ ID NO: 1604248 - DNA, 23 bp, Homo sapiens
aataaagaactccttattttgta

SEQ ID NO: 1604249 - DNA, 20 bp, Homo sapiens
aataaagaagtatggtaatc

SEQ ID NO: 1604250 - DNA, 19 bp, Homo sapiens
aataaagcctatttttcaa

SEQ ID NO: 1604251 - DNA, 20 bp, Homo sapiens
aataaagcctttgtatcttt

SEQ ID NO: 1604252 - DNA, 13 bp, Homo sapiens
aataaagcgtcct

SEQ ID NO: 1604253 - DNA, 17 bp, Homo sapiens
aataaagcgtcctctca

SEQ ID NO: 1604254 - DNA, 12 bp, Homo sapiens
aataaagctttt

SEQ ID NO: 1604255 - DNA, 17 bp, Homo sapiens
aataaagcttttggaag

SEQ ID NO: 1604256 - DNA, 14 bp, Homo sapiens
aataaaggcagctg

SEQ ID NO: 1604257 - DNA, 19 bp, Homo sapiens
aataaaggcagctgcctct

SEQ ID NO: 1604258 - DNA, 16 bp, Homo sapiens
aataaaggcagttttc

SEQ ID NO: 1604259 - DNA, 19 bp, Homo sapiens
aataaaggcagttttctaa

SEQ ID NO: 1604260 - DNA, 18 bp, Homo sapiens
aataaaggctgaagcttt

SEQ ID NO: 1604261 - DNA, 12 bp, Homo sapiens
aataaagtataa

SEQ ID NO: 1604262 - DNA, 15 bp, Homo sapiens
aataaagtatataat

SEQ ID NO: 1604263 - DNA, 17 bp, Homo sapiens
aataaagtcagatggaa

SEQ ID NO: 1604264 - DNA, 20 bp, Homo sapiens
aataaagttacttgaatttc

SEQ ID NO: 1604265 - DNA, 19 bp, Homo sapiens
aataaagtttgcttagaaa

SEQ ID NO: 1604266 - DNA, 14 bp, Homo sapiens
aataaataaagaag

SEQ ID NO: 1604267 - DNA, 14 bp, Homo sapiens
aataaatactcagt

SEQ ID NO: 1604268 - DNA, 23 bp, Homo sapiens
aataaatatatctaccccagact

SEQ ID NO: 1604269 - DNA, 18 bp, Homo sapiens
aataaatcagtgtttaca

SEQ ID NO: 1604270 - DNA, 16 bp, Homo sapiens
aataaatcataaaact

SEQ ID NO: 1604271 - DNA, 16 bp, Homo sapiens
aataaatcatcctcat

SEQ ID NO: 1604272 - DNA, 22 bp, Homo sapiens
aataaatctcttctttgctgca

SEQ ID NO: 1604273 - DNA, 20 bp, Homo sapiens
aagtatgccttaagcagaac

SEQ ID NO: 1604274 - DNA, 23 bp, Homo sapiens
aagtatgccttaagcagaacaaa

SEQ ID NO: 1604275 - DNA, 18 bp, Homo sapiens
aagtattcctgttgctgt

SEQ ID NO: 1604276 - DNA, 13 bp, Homo sapiens
aagtattctaaat

SEQ ID NO: 1604277 - DNA, 21 bp, Homo sapiens
aagtattcttatttaatgaaa

SEQ ID NO: 1604278 - DNA, 19 bp, Homo sapiens
aagtatttaagcctaaaga

SEQ ID NO: 1604279 - DNA, 16 bp, Homo sapiens
aagtatttaggttttt

SEQ ID NO: 1604280 - DNA, 15 bp, Homo sapiens
aagtatttatatatt

SEQ ID NO: 1604281 - DNA, 21 bp, Homo sapiens
aagtatttatatatttataac

SEQ ID NO: 1604282 - DNA, 11 bp, Homo sapiens
aagtattttct

SEQ ID NO: 1604283 - DNA, 15 bp, Homo sapiens
aagtattttgctgga

SEQ ID NO: 1604284 - DNA, 14 bp, Homo sapiens
aagtattttttcaa

SEQ ID NO: 1604285 - DNA, 19 bp, Homo sapiens
aagtcaaacacttgtgact

SEQ ID NO: 1604286 - DNA, 18 bp, Homo sapiens
aagtcaaagtgttgctgt

SEQ ID NO: 1604287 - DNA, 15 bp, Homo sapiens
aagtcaaatgccaaa

SEQ ID NO: 1604288 - DNA, 13 bp, Homo sapiens
aagtcaacagtaa

SEQ ID NO: 1604289 - DNA, 21 bp, Homo sapiens
aagtcaacagtaaaccactga

SEQ ID NO: 1604290 - DNA, 22 bp, Homo sapiens
aagtcaaccaatgtagaaagct

SEQ ID NO: 1604291 - DNA, 16 bp, Homo sapiens
aagtcaagcacatgta

SEQ ID NO: 1604292 - DNA, 21 bp, Homo sapiens
aagtcaagcacatgtaataaa

SEQ ID NO: 1604293 - DNA, 12 bp, Homo sapiens
aagtcacagctg

SEQ ID NO: 1604294 - DNA, 23 bp, Homo sapiens
aagtcacagctgcagctgggccc

SEQ ID NO: 1604295 - DNA, 19 bp, Homo sapiens
aagtcacatcacaggacac

SEQ ID NO: 1604296 - DNA, 16 bp, Homo sapiens
aagtcacccaaacact

SEQ ID NO: 1604297 - DNA, 23 bp, Homo sapiens
aagtcacccaaacacttctgctt

SEQ ID NO: 1604298 - DNA, 21 bp, Homo sapiens
aagtcacccggcccccatgca

SEQ ID NO: 1604299 - DNA, 18 bp, Homo sapiens
aagtcactcacactggcc

SEQ ID NO: 1604300 - DNA, 12 bp, Homo sapiens
aagtcactgcac

SEQ ID NO: 1604301 - DNA, 13 bp, Homo sapiens
aagtcacttctcc

SEQ ID NO: 1604302 - DNA, 23 bp, Homo sapiens
aagtcagaatcagaagatagtct

SEQ ID NO: 1604303 - DNA, 23 bp, Homo sapiens
aagtcagatggaaaattcatttt

SEQ ID NO: 1604304 - DNA, 17 bp, Homo sapiens
aagtcagccacactggg

SEQ ID NO: 1604305 - DNA, 20 bp, Homo sapiens
aagtcagccacactgggcct

SEQ ID NO: 1604306 - DNA, 22 bp, Homo sapiens
aagtcagccacactgggcctgg

SEQ ID NO: 1604307 - DNA, 18 bp, Homo sapiens
aagtcagtgggaacgtga

SEQ ID NO: 1604308 - DNA, 14 bp, Homo sapiens
aagtcatcttgcta

SEQ ID NO: 1604309 - DNA, 15 bp, Homo sapiens
aagtcatgaagccca

SEQ ID NO: 1604310 - DNA, 14 bp, Homo sapiens
aagtcatgtgcatt

SEQ ID NO: 1604311 - DNA, 15 bp, Homo sapiens
aagtcatgtgcattt

SEQ ID NO: 1604312 - DNA, 20 bp, Homo sapiens
aagtcatttttgtatttttc

SEQ ID NO: 1604313 - DNA, 17 bp, Homo sapiens
aagtccatctgacaaaa

SEQ ID NO: 1604314 - DNA, 18 bp, Homo sapiens
aagtccccttctgtgttt

SEQ ID NO: 1604315 - DNA, 22 bp, Homo sapiens
aagtccctgttttctgagcccg

SEQ ID NO: 1604316 - DNA, 18 bp, Homo sapiens
aagtccgcagaagccctg

SEQ ID NO: 1604317 - DNA, 19 bp, Homo sapiens
aagtccgcagaagccctga

SEQ ID NO: 1604318 - DNA, 19 bp, Homo sapiens
aagtcctccctcctgcagg

SEQ ID NO: 1604319 - DNA, 17 bp, Homo sapiens
aagtcctctgctccagc

SEQ ID NO: 1604320 - DNA, 19 bp, Homo sapiens
aagtcctctgctccagcaa

SEQ ID NO: 1604321 - DNA, 13 bp, Homo sapiens
aagtcctgaagag

SEQ ID NO: 1604322 - DNA, 22 bp, Homo sapiens
aagtcctgaagaggcgggccag

SEQ ID NO: 1604323 - DNA, 23 bp, Homo sapiens
aagtcctgaagaggcgggccagc

SEQ ID NO: 1604324 - DNA, 15 bp, Homo sapiens
aagtcgggtcaaaaa

SEQ ID NO: 1604325 - DNA, 17 bp, Homo sapiens
aagtctaaatatttcct

SEQ ID NO: 1604326 - DNA, 17 bp, Homo sapiens
aagtctaagcaagatgt

SEQ ID NO: 1604327 - DNA, 19 bp, Homo sapiens
aagtctaatgaagagaaaa

SEQ ID NO: 1604328 - DNA, 19 bp, Homo sapiens
aagtctaggagctgggagg

SEQ ID NO: 1604329 - DNA, 20 bp, Homo sapiens
aagtctcacccattatctgg

SEQ ID NO: 1604330 - DNA, 16 bp, Homo sapiens
aagtctccagcccacg

SEQ ID NO: 1604331 - DNA, 16 bp, Homo sapiens
aagtctccatgaagag

SEQ ID NO: 1604332 - DNA, 12 bp, Homo sapiens
aagtctcctgtc

SEQ ID NO: 1604333 - DNA, 15 bp, Homo sapiens
aagtctctaattcta

SEQ ID NO: 1604334 - DNA, 15 bp, Homo sapiens
aagtctctgctggcc

SEQ ID NO: 1604335 - DNA, 16 bp, Homo sapiens
aagtctctgctggccc

SEQ ID NO: 1604336 - DNA, 12 bp, Homo sapiens
aagtctctgtga

SEQ ID NO: 1604337 - DNA, 17 bp, Homo sapiens
aagtctggctttgctct

SEQ ID NO: 1604338 - DNA, 18 bp, Homo sapiens
aagtctgggatgtagaac

SEQ ID NO: 1604339 - DNA, 20 bp, Homo sapiens
aagtcttaacaaaccaacat

SEQ ID NO: 1604340 - DNA, 18 bp, Homo sapiens
aagtcttagatgtatata

SEQ ID NO: 1604341 - DNA, 18 bp, Homo sapiens
aagtcttccctgatcaag

SEQ ID NO: 1604342 - DNA, 13 bp, Homo sapiens
aagtcttccttaa

SEQ ID NO: 1604343 - DNA, 16 bp, Homo sapiens
aagtcttgagaaaaag

SEQ ID NO: 1604344 - DNA, 14 bp, Homo sapiens
aagtgaatttttct

SEQ ID NO: 1604345 - DNA, 19 bp, Homo sapiens
aagtgaatttttctctaac

SEQ ID NO: 1604346 - DNA, 15 bp, Homo sapiens
aagtgacacagacat

SEQ ID NO: 1604347 - DNA, 24 bp, Homo sapiens
aagtgacacagcagcttcaccaga

SEQ ID NO: 1604348 - DNA, 18 bp, Homo sapiens
aagtgacacattaatgat

SEQ ID NO: 1604349 - DNA, 17 bp, Homo sapiens
aagtgactgtatctgtg

SEQ ID NO: 1604350 - DNA, 15 bp, Homo sapiens
aagtgactttaaact

SEQ ID NO: 1604351 - DNA, 20 bp, Homo sapiens
aagtgagagacctctgccta

SEQ ID NO: 1604352 - DNA, 17 bp, Homo sapiens
aagtgagagagacaaga

SEQ ID NO: 1604353 - DNA, 11 bp, Homo sapiens
aagtgagcaga

SEQ ID NO: 1604354 - DNA, 12 bp, Homo sapiens
aagtgaggccca

SEQ ID NO: 1604355 - DNA, 17 bp, Homo sapiens
aagtgaggcccaaggag

SEQ ID NO: 1604356 - DNA, 17 bp, Homo sapiens
aagtgagggctcactca

SEQ ID NO: 1604357 - DNA, 13 bp, Homo sapiens
aagtgataaattc

SEQ ID NO: 1604358 - DNA, 15 bp, Homo sapiens
aagtgataatttctg

SEQ ID NO: 1604359 - DNA, 16 bp, Homo sapiens
aagtgatatcacctct

SEQ ID NO: 1604360 - DNA, 22 bp, Homo sapiens
aagtgatcaataaaatgtgatt

SEQ ID NO: 1604361 - DNA, 10 bp, Homo sapiens
aagtgatctt

SEQ ID NO: 1604362 - DNA, 21 bp, Homo sapiens
aagtgatttttggtcttctgt

SEQ ID NO: 1604363 - DNA, 13 bp, Homo sapiens
agctggactgacc

SEQ ID NO: 1604364 - DNA, 17 bp, Homo sapiens
agctggagaaatatggt

SEQ ID NO: 1604365 - DNA, 15 bp, Homo sapiens
agctggagctcttgg

SEQ ID NO: 1604366 - DNA, 16 bp, Homo sapiens
agctggagctcttgga

SEQ ID NO: 1604367 - DNA, 15 bp, Homo sapiens
agctggaggggtggg

SEQ ID NO: 1604368 - DNA, 22 bp, Homo sapiens
agctggatttgggagctctgct

SEQ ID NO: 1604369 - DNA, 19 bp, Homo sapiens
agctggcaaccagccagcg

SEQ ID NO: 1604370 - DNA, 13 bp, Homo sapiens
agctggcaggaca

SEQ ID NO: 1604371 - DNA, 19 bp, Homo sapiens
agctggcaggacacatccc

SEQ ID NO: 1604372 - DNA, 23 bp, Homo sapiens
agctggcaggacacatcccggcc

SEQ ID NO: 1604373 - DNA, 18 bp, Homo sapiens
agctggcagtgcaatgct

SEQ ID NO: 1604374 - DNA, 18 bp, Homo sapiens
agctggccaaagagcctt

SEQ ID NO: 1604375 - DNA, 15 bp, Homo sapiens
agctggcccactgct

SEQ ID NO: 1604376 - DNA, 21 bp, Homo sapiens
agctggcccactgctggctgc

SEQ ID NO: 1604377 - DNA, 22 bp, Homo sapiens
agctggcccactgctggctgca

SEQ ID NO: 1604378 - DNA, 12 bp, Homo sapiens
agctggcccagg

SEQ ID NO: 1604379 - DNA, 13 bp, Homo sapiens
agctggcccaggg

SEQ ID NO: 1604380 - DNA, 20 bp, Homo sapiens
agctggcccagggggcctgg

SEQ ID NO: 1604381 - DNA, 21 bp, Homo sapiens
agctggccccgcttggtggcc

SEQ ID NO: 1604382 - DNA, 20 bp, Homo sapiens
agctggccgagggtcctggc

SEQ ID NO: 1604383 - DNA, 16 bp, Homo sapiens
agctggcctctctagc

SEQ ID NO: 1604384 - DNA, 12 bp, Homo sapiens
agctggcctgag

SEQ ID NO: 1604385 - DNA, 21 bp, Homo sapiens
agctggcctgagaggggaagc

SEQ ID NO: 1604386 - DNA, 13 bp, Homo sapiens
agctggcctgtgg

SEQ ID NO: 1604387 - DNA, 20 bp, Homo sapiens
agctggcctgtggcacagcc

SEQ ID NO: 1604388 - DNA, 17 bp, Homo sapiens
agctggcgcccatccta

SEQ ID NO: 1604389 - DNA, 14 bp, Homo sapiens
agctggctcacctt

SEQ ID NO: 1604390 - DNA, 14 bp, Homo sapiens
agctggctctgagc

SEQ ID NO: 1604391 - DNA, 20 bp, Homo sapiens
agctggctctgagcgcctcc

SEQ ID NO: 1604392 - DNA, 13 bp, Homo sapiens
agctggctggcag

SEQ ID NO: 1604393 - DNA, 15 bp, Homo sapiens
agctggctggcaggt

SEQ ID NO: 1604394 - DNA, 15 bp, Homo sapiens
agctgggacccctcc

SEQ ID NO: 1604395 - DNA, 13 bp, Homo sapiens
agctgggaggaaa

SEQ ID NO: 1604396 - DNA, 17 bp, Homo sapiens
agctgggaggcaagagg

SEQ ID NO: 1604397 - DNA, 19 bp, Homo sapiens
agctgggaggcaagagggg

SEQ ID NO: 1604398 - DNA, 15 bp, Homo sapiens
agctgggcagggtga

SEQ ID NO: 1604399 - DNA, 17 bp, Homo sapiens
agctgggcccctgcaca

SEQ ID NO: 1604400 - DNA, 19 bp, Homo sapiens
agctgggcctcctgcctcc

SEQ ID NO: 1604401 - DNA, 20 bp, Homo sapiens
agctgggcctcctgcctccg

SEQ ID NO: 1604402 - DNA, 14 bp, Homo sapiens
agctggggacctgg

SEQ ID NO: 1604403 - DNA, 15 bp, Homo sapiens
agctggggactcagg

SEQ ID NO: 1604404 - DNA, 18 bp, Homo sapiens
agctggggactcagggac

SEQ ID NO: 1604405 - DNA, 16 bp, Homo sapiens
agctggggagcagctg

SEQ ID NO: 1604406 - DNA, 18 bp, Homo sapiens
agctggggagcagctgag

SEQ ID NO: 1604407 - DNA, 15 bp, Homo sapiens
agctggggatccctc

SEQ ID NO: 1604408 - DNA, 20 bp, Homo sapiens
agctggggcgtggggagggc

SEQ ID NO: 1604409 - DNA, 21 bp, Homo sapiens
agctgggggaaggcaggagcc

SEQ ID NO: 1604410 - DNA, 15 bp, Homo sapiens
agctggggggctgtc

SEQ ID NO: 1604411 - DNA, 23 bp, Homo sapiens
agctgggtacggtggcacgtgcc

SEQ ID NO: 1604412 - DNA, 20 bp, Homo sapiens
agctggtaatcttgctctgc

SEQ ID NO: 1604413 - DNA, 19 bp, Homo sapiens
agctggtcagtctttgctc

SEQ ID NO: 1604414 - DNA, 23 bp, Homo sapiens
agctggtcagtctttgctcagtg

SEQ ID NO: 1604415 - DNA, 20 bp, Homo sapiens
agctggtgcaaattcagaac

SEQ ID NO: 1604416 - DNA, 17 bp, Homo sapiens
agctggtgccccacctg

SEQ ID NO: 1604417 - DNA, 23 bp, Homo sapiens
agctggtgccccacctgcctggt

SEQ ID NO: 1604418 - DNA, 16 bp, Homo sapiens
agctggtggccctgtg

SEQ ID NO: 1604419 - DNA, 23 bp, Homo sapiens
agctggtggccctgtgcctgggc

SEQ ID NO: 1604420 - DNA, 21 bp, Homo sapiens
agctggtttcctcattcctga

SEQ ID NO: 1604421 - DNA, 16 bp, Homo sapiens
agctctactgccctcc

SEQ ID NO: 1604422 - DNA, 17 bp, Homo sapiens
agctctactgccctccc

SEQ ID NO: 1604423 - DNA, 20 bp, Homo sapiens
agctctactgccctcccctt

SEQ ID NO: 1604424 - DNA, 21 bp, Homo sapiens
agctctcagcaagtgcccagt

SEQ ID NO: 1604425 - DNA, 17 bp, Homo sapiens
agctctccaggccaggt

SEQ ID NO: 1604426 - DNA, 15 bp, Homo sapiens
agctctccaggcccc

SEQ ID NO: 1604427 - DNA, 22 bp, Homo sapiens
agctctcccctcctgctgggcg

SEQ ID NO: 1604428 - DNA, 16 bp, Homo sapiens
agctctccctctggcc

SEQ ID NO: 1604429 - DNA, 18 bp, Homo sapiens
agctctccctctggccct

SEQ ID NO: 1604430 - DNA, 23 bp, Homo sapiens
agctctccctctggccctgcctt

SEQ ID NO: 1604431 - DNA, 17 bp, Homo sapiens
agctctccgagctctgg

SEQ ID NO: 1604432 - DNA, 18 bp, Homo sapiens
agctctctaggcctctcc

SEQ ID NO: 1604433 - DNA, 22 bp, Homo sapiens
agctctctaggcctctccagtt

SEQ ID NO: 1604434 - DNA, 22 bp, Homo sapiens
agctctctgacgcttgtgacag

SEQ ID NO: 1604435 - DNA, 23 bp, Homo sapiens
agctctctgacgcttgtgacagt

SEQ ID NO: 1604436 - DNA, 11 bp, Homo sapiens
agctctctgca

SEQ ID NO: 1604437 - DNA, 18 bp, Homo sapiens
agctctctgccctgtgta

SEQ ID NO: 1604438 - DNA, 19 bp, Homo sapiens
agctctctgccctgtgtac

SEQ ID NO: 1604439 - DNA, 12 bp, Homo sapiens
agctctctggga

SEQ ID NO: 1604440 - DNA, 18 bp, Homo sapiens
agctctctgggacctcct

SEQ ID NO: 1604441 - DNA, 14 bp, Homo sapiens
agctctcttcctgt

SEQ ID NO: 1604442 - DNA, 22 bp, Homo sapiens
agctctgaagaactctctggaa

SEQ ID NO: 1604443 - DNA, 17 bp, Homo sapiens
agctctgacatcccttc

SEQ ID NO: 1604444 - DNA, 19 bp, Homo sapiens
agctctgacatcccttcct

SEQ ID NO: 1604445 - DNA, 20 bp, Homo sapiens
agctctgacatcccttcctg

SEQ ID NO: 1604446 - DNA, 22 bp, Homo sapiens
agctctgaccacttgaggcctg

SEQ ID NO: 1604447 - DNA, 19 bp, Homo sapiens
agctctgagacccttttct

SEQ ID NO: 1604448 - DNA, 21 bp, Homo sapiens
agctctgagacccttttctca

SEQ ID NO: 1604449 - DNA, 23 bp, Homo sapiens
agctctgagacccttttctcagg

SEQ ID NO: 1604450 - DNA, 23 bp, Homo sapiens
agctctgaggggaggcacctcca

SEQ ID NO: 1604451 - DNA, 16 bp, Homo sapiens
agctctgcgccaggca

SEQ ID NO: 1604452 - DNA, 22 bp, Homo sapiens
agctctgcgccaggcagagctg

SEQ ID NO: 1604453 - DNA, 21 bp, Homo sapiens
agctctggacagccccaccct

SEQ ID NO: 1604454 - DNA, 16 bp, Homo sapiens
agctctggacgtgaaa

SEQ ID NO: 1604455 - DNA, 11 bp, Homo sapiens
agctctggaga

SEQ ID NO: 1604456 - DNA, 12 bp, Homo sapiens
agctctggagaa

SEQ ID NO: 1604457 - DNA, 17 bp, Homo sapiens
agctctggaggggaggg

SEQ ID NO: 1604458 - DNA, 18 bp, Homo sapiens
agctctggccccaggctt

SEQ ID NO: 1604459 - DNA, 20 bp, Homo sapiens
agctctggccccaggcttgt

SEQ ID NO: 1604460 - DNA, 22 bp, Homo sapiens
agctctggccccaggcttgtca

SEQ ID NO: 1604461 - DNA, 16 bp, Homo sapiens
agctctggctgaaccc

SEQ ID NO: 1604462 - DNA, 17 bp, Homo sapiens
agctctggctgaaccct

SEQ ID NO: 1604463 - DNA, 18 bp, Homo sapiens
agctctggctgaaccctg

SEQ ID NO: 1604464 - DNA, 22 bp, Homo sapiens
agctctggctgaaccctgtgct

SEQ ID NO: 1604465 - DNA, 14 bp, Homo sapiens
agctctggggtggg

SEQ ID NO: 1604466 - DNA, 19 bp, Homo sapiens
agctctggggtgggcagtt

SEQ ID NO: 1604467 - DNA, 20 bp, Homo sapiens
agctctggggtgggcagttt

SEQ ID NO: 1604468 - DNA, 21 bp, Homo sapiens
agctctggggtgggcagtttt

SEQ ID NO: 1604469 - DNA, 22 bp, Homo sapiens
agctctggggtgggcagttttt

SEQ ID NO: 1604470 - DNA, 20 bp, Homo sapiens
agctctggtgacaccagcct

SEQ ID NO: 1604471 - DNA, 23 bp, Homo sapiens
agctctggtgagtcttggcggca

SEQ ID NO: 1604472 - DNA, 13 bp, Homo sapiens
agctctggtgctt

SEQ ID NO: 1604473 - DNA, 22 bp, Homo sapiens
agctctggttatttttctcttg

SEQ ID NO: 1604474 - DNA, 19 bp, Homo sapiens
agctctgtatggtcaggat

SEQ ID NO: 1604475 - DNA, 19 bp, Homo sapiens
agctctgtcctcttggcca

SEQ ID NO: 1604476 - DNA, 13 bp, Homo sapiens
agctctgtggcct

SEQ ID NO: 1604477 - DNA, 19 bp, Homo sapiens
agctcttactctttcctat

SEQ ID NO: 1604478 - DNA, 13 bp, Homo sapiens
agctcttcaggcc

SEQ ID NO: 1604479 - DNA, 15 bp, Homo sapiens
agctcttcaggcctc

SEQ ID NO: 1604480 - DNA, 17 bp, Homo sapiens
agctcttcaggcctccc

SEQ ID NO: 1604481 - DNA, 10 bp, Homo sapiens
agctcttcat

SEQ ID NO: 1604482 - DNA, 11 bp, Homo sapiens
agctcttcatt

SEQ ID NO: 1604483 - DNA, 20 bp, Homo sapiens
agctcttcattccattgact

SEQ ID NO: 1604484 - DNA, 11 bp, Homo sapiens
agctcttccct

SEQ ID NO: 1604485 - DNA, 22 bp, Homo sapiens
agctcttcctatccctctccta

SEQ ID NO: 1604486 - DNA, 15 bp, Homo sapiens
agctcttctaaggaa

SEQ ID NO: 1604487 - DNA, 16 bp, Homo sapiens
agctcttctcttccta

SEQ ID NO: 1604488 - DNA, 14 bp, Homo sapiens
agctcttctttttt

SEQ ID NO: 1604489 - DNA, 19 bp, Homo sapiens
agctcttgatttgggtgga

SEQ ID NO: 1604490 - DNA, 12 bp, Homo sapiens
agctcttgccct

SEQ ID NO: 1604491 - DNA, 15 bp, Homo sapiens
agctcttgcccttcc

SEQ ID NO: 1604492 - DNA, 19 bp, Homo sapiens
agctcttgcccttccctgt

SEQ ID NO: 1604493 - DNA, 21 bp, Homo sapiens
agctcttgcccttccctgtcc

SEQ ID NO: 1604494 - DNA, 14 bp, Homo sapiens
agctcttgctctct

SEQ ID NO: 1604495 - DNA, 18 bp, Homo sapiens
agctcttgctctcttgtg

SEQ ID NO: 1604496 - DNA, 19 bp, Homo sapiens
agctcttgctctcttgtga

SEQ ID NO: 1604497 - DNA, 14 bp, Homo sapiens
agctcttgctgtta

SEQ ID NO: 1604498 - DNA, 20 bp, Homo sapiens
agctcttggaagagctcttc

SEQ ID NO: 1604499 - DNA, 20 bp, Homo sapiens
agctcttggcccctgtgtga

SEQ ID NO: 1604500 - DNA, 15 bp, Homo sapiens
agctcttgggtcaga

SEQ ID NO: 1604501 - DNA, 19 bp, Homo sapiens
agctcttttctcctgcaga

SEQ ID NO: 1604502 - DNA, 19 bp, Homo sapiens
agctgaaaaatcacatcct

SEQ ID NO: 1604503 - DNA, 20 bp, Homo sapiens
agctgaaaagggcactccca

SEQ ID NO: 1604504 - DNA, 22 bp, Homo sapiens
agctgaaaagggcactcccaac

SEQ ID NO: 1604505 - DNA, 18 bp, Homo sapiens
agctgaaagggagcccct

SEQ ID NO: 1604506 - DNA, 16 bp, Homo sapiens
agctgaaatgctgcat

SEQ ID NO: 1604507 - DNA, 18 bp, Homo sapiens
agctgaaatgctgcattt

SEQ ID NO: 1604508 - DNA, 20 bp, Homo sapiens
agctgaaatgctgcatttta

SEQ ID NO: 1604509 - DNA, 12 bp, Homo sapiens
agctgaaattga

SEQ ID NO: 1604510 - DNA, 16 bp, Homo sapiens
agctgaaattgaaaag

SEQ ID NO: 1604511 - DNA, 19 bp, Homo sapiens
agctgaacacatttctttt

SEQ ID NO: 1604512 - DNA, 14 bp, Homo sapiens
agctgaaccaaagc

SEQ ID NO: 1604513 - DNA, 14 bp, Homo sapiens
agctgaaccccctc

SEQ ID NO: 1604514 - DNA, 20 bp, Homo sapiens
agctgaaccttgaggggcta

SEQ ID NO: 1604515 - DNA, 21 bp, Homo sapiens
agctgaagattaggcacacag

SEQ ID NO: 1604516 - DNA, 12 bp, Homo sapiens
agctgaaggcag

SEQ ID NO: 1604517 - DNA, 17 bp, Homo sapiens
agctgacagtcagctgt

SEQ ID NO: 1604518 - DNA, 16 bp, Homo sapiens
agctgacatcttgaat

SEQ ID NO: 1604519 - DNA, 12 bp, Homo sapiens
agctgacatgga

SEQ ID NO: 1604520 - DNA, 14 bp, Homo sapiens
agctgacatggaaa

SEQ ID NO: 1604521 - DNA, 21 bp, Homo sapiens
agctgacccagagtggagtct

SEQ ID NO: 1604522 - DNA, 22 bp, Homo sapiens
agctgacccagagtggagtctg

SEQ ID NO: 1604523 - DNA, 17 bp, Homo sapiens
agctgacctctgttgtc

SEQ ID NO: 1604524 - DNA, 22 bp, Homo sapiens
agctgacctctgttgtcctccc

SEQ ID NO: 1604525 - DNA, 14 bp, Homo sapiens
agctgactgtggcc

SEQ ID NO: 1604526 - DNA, 13 bp, Homo sapiens
agctgactgttct

SEQ ID NO: 1604527 - DNA, 15 bp, Homo sapiens
agctgacttggcact

SEQ ID NO: 1604528 - DNA, 14 bp, Homo sapiens
agctgagagccctg

SEQ ID NO: 1604529 - DNA, 15 bp, Homo sapiens
agctgagatgtggac

SEQ ID NO: 1604530 - DNA, 10 bp, Homo sapiens
agctgagcca

SEQ ID NO: 1604531 - DNA, 18 bp, Homo sapiens
agctgagctggaaggggc

SEQ ID NO: 1604532 - DNA, 14 bp, Homo sapiens
agctgaggagccct

SEQ ID NO: 1604533 - DNA, 22 bp, Homo sapiens
agctgagggccctgtggagtcc

SEQ ID NO: 1604534 - DNA, 23 bp, Homo sapiens
agctgagggccctgtggagtcca

SEQ ID NO: 1604535 - DNA, 24 bp, Homo sapiens
agctgagggccctgtggagtccag

SEQ ID NO: 1604536 - DNA, 21 bp, Homo sapiens
agctgaggtctcttgagggag

SEQ ID NO: 1604537 - DNA, 17 bp, Homo sapiens
agctgagtcacctcctc

SEQ ID NO: 1604538 - DNA, 19 bp, Homo sapiens
agctgagtcacctcctcca

SEQ ID NO: 1604539 - DNA, 20 bp, Homo sapiens
agctgagtcacctcctccac

SEQ ID NO: 1604540 - DNA, 21 bp, Homo sapiens
agctgagttacttgtctgagg

SEQ ID NO: 1604541 - DNA, 21 bp, Homo sapiens
agctgagtttcctatgggaac

SEQ ID NO: 1604542 - DNA, 20 bp, Homo sapiens
agctgatattatttcttctc

SEQ ID NO: 1604543 - DNA, 19 bp, Homo sapiens
agctgatccataggactac

SEQ ID NO: 1604544 - DNA, 22 bp, Homo sapiens
agctgatctgcggatctcagct

SEQ ID NO: 1604545 - DNA, 20 bp, Homo sapiens
agctgatgaacttattctgt

SEQ ID NO: 1604546 - DNA, 20 bp, Homo sapiens
agctgatgatgtctcttgta

SEQ ID NO: 1604547 - DNA, 14 bp, Homo sapiens
agctgatggcagct

SEQ ID NO: 1604548 - DNA, 16 bp, Homo sapiens
agctgatggcagctgg

SEQ ID NO: 1604549 - DNA, 18 bp, Homo sapiens
agctgattactgtcaata

SEQ ID NO: 1604550 - DNA, 21 bp, Homo sapiens
agctgattactgtcaataaac

SEQ ID NO: 1604551 - DNA, 17 bp, Homo sapiens
agctgattgcagaaagg

SEQ ID NO: 1604552 - DNA, 21 bp, Homo sapiens
agctgattgcagaaaggagag

SEQ ID NO: 1604553 - DNA, 16 bp, Homo sapiens
agctgatttccaggcc

SEQ ID NO: 1604554 - DNA, 18 bp, Homo sapiens
agctgcacattcctggcc

SEQ ID NO: 1604555 - DNA, 21 bp, Homo sapiens
agctgcacctgccagcctggc

SEQ ID NO: 1604556 - DNA, 19 bp, Homo sapiens
agctgcactgatcacccaa

SEQ ID NO: 1604557 - DNA, 22 bp, Homo sapiens
agctgcactgatgctgcccctc

SEQ ID NO: 1604558 - DNA, 16 bp, Homo sapiens
agctgcactgtgaacc

SEQ ID NO: 1604559 - DNA, 16 bp, Homo sapiens
agctgcagagatttct

SEQ ID NO: 1604560 - DNA, 13 bp, Homo sapiens
agctgcagctggg

SEQ ID NO: 1604561 - DNA, 18 bp, Homo sapiens
agctgcatcctccaagaa

SEQ ID NO: 1604562 - DNA, 22 bp, Homo sapiens
agctgcatcctccaagaatcta

SEQ ID NO: 1604563 - DNA, 19 bp, Homo sapiens
agctgcatttcacatgcct

SEQ ID NO: 1604564 - DNA, 20 bp, Homo sapiens
agctgcatttcacatgcctt

SEQ ID NO: 1604565 - DNA, 14 bp, Homo sapiens
agctgccaagagtg

SEQ ID NO: 1604566 - DNA, 14 bp, Homo sapiens
agctgccaagcact

SEQ ID NO: 1604567 - DNA, 20 bp, Homo sapiens
agctgccaagtgctctttgt

SEQ ID NO: 1604568 - DNA, 10 bp, Homo sapiens
agctgccact

SEQ ID NO: 1604569 - DNA, 19 bp, Homo sapiens
agctgccactgggcacctg

SEQ ID NO: 1604570 - DNA, 24 bp, Homo sapiens
agctgcccactgtttctcttgagc

SEQ ID NO: 1604571 - DNA, 14 bp, Homo sapiens
agctgcccagacac

SEQ ID NO: 1604572 - DNA, 15 bp, Homo sapiens
agctgcccagacaca

SEQ ID NO: 1604573 - DNA, 20 bp, Homo sapiens
agctgcccatcccagtccct

SEQ ID NO: 1604574 - DNA, 16 bp, Homo sapiens
agctgccccggcccct

SEQ ID NO: 1604575 - DNA, 15 bp, Homo sapiens
agctgcccctggcac

SEQ ID NO: 1604576 - DNA, 17 bp, Homo sapiens
agctgcccctggcacct

SEQ ID NO: 1604577 - DNA, 20 bp, Homo sapiens
agctgcccctggcacctgtg

SEQ ID NO: 1604578 - DNA, 10 bp, Homo sapiens
agctgcccta

SEQ ID NO: 1604579 - DNA, 23 bp, Homo sapiens
agctgccctcccctccggactgg

SEQ ID NO: 1604580 - DNA, 17 bp, Homo sapiens
agctgccgacttggaga

SEQ ID NO: 1604581 - DNA, 17 bp, Homo sapiens
agctgccgcaccagccc

SEQ ID NO: 1604582 - DNA, 18 bp, Homo sapiens
agctgccgcccccggact

SEQ ID NO: 1604583 - DNA, 14 bp, Homo sapiens
agctgcctctgctc

SEQ ID NO: 1604584 - DNA, 15 bp, Homo sapiens
agctgcctctgctcc

SEQ ID NO: 1604585 - DNA, 22 bp, Homo sapiens
agctatttatgggcccctggca

SEQ ID NO: 1604586 - DNA, 14 bp, Homo sapiens
agctatttcatcta

SEQ ID NO: 1604587 - DNA, 17 bp, Homo sapiens
agctatttcatctattt

SEQ ID NO: 1604588 - DNA, 18 bp, Homo sapiens
agctcaaagacttccacc

SEQ ID NO: 1604589 - DNA, 20 bp, Homo sapiens
agctcaaaggtttggaagga

SEQ ID NO: 1604590 - DNA, 21 bp, Homo sapiens
agctcaaaggtttggaaggag

SEQ ID NO: 1604591 - DNA, 19 bp, Homo sapiens
agctcaagatgacagctct

SEQ ID NO: 1604592 - DNA, 20 bp, Homo sapiens
agctcaagatgacagctctt

SEQ ID NO: 1604593 - DNA, 23 bp, Homo sapiens
agctcaagtcttccctgatcaag

SEQ ID NO: 1604594 - DNA, 13 bp, Homo sapiens
agctcaatgcagt

SEQ ID NO: 1604595 - DNA, 16 bp, Homo sapiens
agctcaattcaagtga

SEQ ID NO: 1604596 - DNA, 17 bp, Homo sapiens
agctcacaccctacctt

SEQ ID NO: 1604597 - DNA, 20 bp, Homo sapiens
agctcacagttcctcgccct

SEQ ID NO: 1604598 - DNA, 19 bp, Homo sapiens
agctcacatccagccttgg

SEQ ID NO: 1604599 - DNA, 17 bp, Homo sapiens
agctcaccaggcctggc

SEQ ID NO: 1604600 - DNA, 20 bp, Homo sapiens
agctcaccaggcctggcctc

SEQ ID NO: 1604601 - DNA, 21 bp, Homo sapiens
agctcaccaggcctggcctct

SEQ ID NO: 1604602 - DNA, 12 bp, Homo sapiens
agctcaccctgc

SEQ ID NO: 1604603 - DNA, 19 bp, Homo sapiens
agctcaccctgcccgctcc

SEQ ID NO: 1604604 - DNA, 20 bp, Homo sapiens
agctcaccctgcccgctccc

SEQ ID NO: 1604605 - DNA, 23 bp, Homo sapiens
agctcacgtaatgcattgcctgt

SEQ ID NO: 1604606 - DNA, 17 bp, Homo sapiens
agctcactgaatcttca

SEQ ID NO: 1604607 - DNA, 18 bp, Homo sapiens
agctcagacattttcttt

SEQ ID NO: 1604608 - DNA, 15 bp, Homo sapiens
agctcagacccccac

SEQ ID NO: 1604609 - DNA, 16 bp, Homo sapiens
agctcagacccccact

SEQ ID NO: 1604610 - DNA, 17 bp, Homo sapiens
agctcagacccccactc

SEQ ID NO: 1604611 - DNA, 18 bp, Homo sapiens
agctcagccccaactctt

SEQ ID NO: 1604612 - DNA, 19 bp, Homo sapiens
agctcagctgcattccgca

SEQ ID NO: 1604613 - DNA, 23 bp, Homo sapiens
agctcagctgcattccgcagccc

SEQ ID NO: 1604614 - DNA, 12 bp, Homo sapiens
agctcagctgcc

SEQ ID NO: 1604615 - DNA, 13 bp, Homo sapiens
agctcagctgccc

SEQ ID NO: 1604616 - DNA, 14 bp, Homo sapiens
agctcagctgccca

SEQ ID NO: 1604617 - DNA, 16 bp, Homo sapiens
agctcagctgcccatc

SEQ ID NO: 1604618 - DNA, 15 bp, Homo sapiens
agctcaggaggcgcc

SEQ ID NO: 1604619 - DNA, 12 bp, Homo sapiens
agctcaggaggg

SEQ ID NO: 1604620 - DNA, 23 bp, Homo sapiens
agctcaggagggtgacgcccagc

SEQ ID NO: 1604621 - DNA, 20 bp, Homo sapiens
agctcaggagtttgagacca

SEQ ID NO: 1604622 - DNA, 22 bp, Homo sapiens
agctcaggagtttgagaccagg

SEQ ID NO: 1604623 - DNA, 12 bp, Homo sapiens
agctcaggcagc

SEQ ID NO: 1604624 - DNA, 22 bp, Homo sapiens
agctcaggcagcgttagggctg

SEQ ID NO: 1604625 - DNA, 24 bp, Homo sapiens
agctcaggcagcgttagggctgct

SEQ ID NO: 1604626 - DNA, 19 bp, Homo sapiens
agctcagtaacataactgc

SEQ ID NO: 1604627 - DNA, 19 bp, Homo sapiens
agctcagtcatcaaagcag

SEQ ID NO: 1604628 - DNA, 19 bp, Homo sapiens
agctcagtttatccaaggt

SEQ ID NO: 1604629 - DNA, 18 bp, Homo sapiens
agccccgcgcctccttcc

SEQ ID NO: 1604630 - DNA, 13 bp, Homo sapiens
agccccggccccc

SEQ ID NO: 1604631 - DNA, 24 bp, Homo sapiens
agccccggggtgagtccattctcc

SEQ ID NO: 1604632 - DNA, 17 bp, Homo sapiens
agccccggtggctgggc

SEQ ID NO: 1604633 - DNA, 21 bp, Homo sapiens
agcccctaccccacaccaggc

SEQ ID NO: 1604634 - DNA, 21 bp, Homo sapiens
agcccctcaaagggagagaaa

SEQ ID NO: 1604635 - DNA, 15 bp, Homo sapiens
agcccctcagccctt

SEQ ID NO: 1604636 - DNA, 17 bp, Homo sapiens
agcccctcagcccttgc

SEQ ID NO: 1604637 - DNA, 21 bp, Homo sapiens
agcccctcagcccttgccccc

SEQ ID NO: 1604638 - DNA, 12 bp, Homo sapiens
agcgggcacagg

SEQ ID NO: 1604639 - DNA, 13 bp, Homo sapiens
agcgggcacaggg

SEQ ID NO: 1604640 - DNA, 18 bp, Homo sapiens
agcgggcacagggcacca

SEQ ID NO: 1604641 - DNA, 14 bp, Homo sapiens
agcgggccaggccc

SEQ ID NO: 1604642 - DNA, 16 bp, Homo sapiens
agcgggccaggcccgc

SEQ ID NO: 1604643 - DNA, 13 bp, Homo sapiens
agcgggcggaggg

SEQ ID NO: 1604644 - DNA, 21 bp, Homo sapiens
agcggggccaggagccgggcc

SEQ ID NO: 1604645 - DNA, 22 bp, Homo sapiens
agcggggcttcatctgcaaagg

SEQ ID NO: 1604646 - DNA, 18 bp, Homo sapiens
agcgggggcctaaaaaaa

SEQ ID NO: 1604647 - DNA, 23 bp, Homo sapiens
agcgggggccttgaagactccct

SEQ ID NO: 1604648 - DNA, 22 bp, Homo sapiens
agcgtacttgaatttttcttcc

SEQ ID NO: 1604649 - DNA, 23 bp, Homo sapiens
agcgtagctaagtgaaaaggtca

SEQ ID NO: 1604650 - DNA, 14 bp, Homo sapiens
agcgtcaagacatt

SEQ ID NO: 1604651 - DNA, 13 bp, Homo sapiens
agcgtcactccag

SEQ ID NO: 1604652 - DNA, 15 bp, Homo sapiens
agcgtcactccagtg

SEQ ID NO: 1604653 - DNA, 16 bp, Homo sapiens
agcgtcactccagtgc

SEQ ID NO: 1604654 - DNA, 21 bp, Homo sapiens
agcgtcactccagtgctcagc

SEQ ID NO: 1604655 - DNA, 17 bp, Homo sapiens
agcgtcccccgccgcgc

SEQ ID NO: 1604656 - DNA, 20 bp, Homo sapiens
agcgtcccctgctactcctg

SEQ ID NO: 1604657 - DNA, 22 bp, Homo sapiens
agcgtcccctgctactcctgtg

SEQ ID NO: 1604658 - DNA, 14 bp, Homo sapiens
agcgtccctggcgc

SEQ ID NO: 1604659 - DNA, 16 bp, Homo sapiens
agcgtccggggtggtg

SEQ ID NO: 1604660 - DNA, 15 bp, Homo sapiens
agcgtcctgccctgc

SEQ ID NO: 1604661 - DNA, 12 bp, Homo sapiens
agcgtctgttgt

SEQ ID NO: 1604662 - DNA, 23 bp, Homo sapiens
agcgtcttgctctgttcacagtc

SEQ ID NO: 1604663 - DNA, 15 bp, Homo sapiens
agcgtgcataagtta

SEQ ID NO: 1604664 - DNA, 20 bp, Homo sapiens
agcgtgtggagcagagctct

SEQ ID NO: 1604665 - DNA, 16 bp, Homo sapiens
agcgttagggctgctt

SEQ ID NO: 1604666 - DNA, 14 bp, Homo sapiens
agcgttctggactc

SEQ ID NO: 1604667 - DNA, 17 bp, Homo sapiens
agcgtttctttacttct

SEQ ID NO: 1604668 - DNA, 18 bp, Homo sapiens
agcgttttgttgagcatg

SEQ ID NO: 1604669 - DNA, 14 bp, Homo sapiens
agcgtttttctcaa

SEQ ID NO: 1604670 - DNA, 13 bp, Homo sapiens
agctaaaatgtta

SEQ ID NO: 1604671 - DNA, 21 bp, Homo sapiens
agctaaagaggctgaaagagg

SEQ ID NO: 1604672 - DNA, 16 bp, Homo sapiens
agctaaagcccaacct

SEQ ID NO: 1604673 - DNA, 15 bp, Homo sapiens
agctaaatgtaactt

SEQ ID NO: 1604674 - DNA, 18 bp, Homo sapiens
agctaaatgtaacttatt

SEQ ID NO: 1604675 - DNA, 23 bp, Homo sapiens
agctaacccccttctactgagcc

SEQ ID NO: 1604676 - DNA, 19 bp, Homo sapiens
agctaactgggttacagtg

SEQ ID NO: 1604677 - DNA, 15 bp, Homo sapiens
agctaactgtaaatc

SEQ ID NO: 1604678 - DNA, 16 bp, Homo sapiens
agctaagatagaaagc

SEQ ID NO: 1604679 - DNA, 23 bp, Homo sapiens
aggagagactgaaagcagcagct

SEQ ID NO: 1604680 - DNA, 11 bp, Homo sapiens
aggagagagac

SEQ ID NO: 1604681 - DNA, 14 bp, Homo sapiens
aggagagccagccc

SEQ ID NO: 1604682 - DNA, 15 bp, Homo sapiens
aggagagccagccct

SEQ ID NO: 1604683 - DNA, 12 bp, Homo sapiens
aggagagcctgc

SEQ ID NO: 1604684 - DNA, 13 bp, Homo sapiens
aggagagcctgct

SEQ ID NO: 1604685 - DNA, 14 bp, Homo sapiens
aggagagcctgctg

SEQ ID NO: 1604686 - DNA, 13 bp, Homo sapiens
aggagaggcagca

SEQ ID NO: 1604687 - DNA, 15 bp, Homo sapiens
aggagaggcagcatg

SEQ ID NO: 1604688 - DNA, 18 bp, Homo sapiens
aggagaggggaagggcca

SEQ ID NO: 1604689 - DNA, 13 bp, Homo sapiens
aggagaggggcag

SEQ ID NO: 1604690 - DNA, 17 bp, Homo sapiens
aggagagtcccagagca

SEQ ID NO: 1604691 - DNA, 24 bp, Homo sapiens
aggagagtcccagagcaggaggcc

SEQ ID NO: 1604692 - DNA, 22 bp, Homo sapiens
aggagagtcggtctgctttgga

SEQ ID NO: 1604693 - DNA, 18 bp, Homo sapiens
aggagagtggcaggtggg

SEQ ID NO: 1604694 - DNA, 20 bp, Homo sapiens
aggagataattactgccttg

SEQ ID NO: 1604695 - DNA, 14 bp, Homo sapiens
aggagatagacggg

SEQ ID NO: 1604696 - DNA, 22 bp, Homo sapiens
aggagatgaccagggatgctgg

SEQ ID NO: 1604697 - DNA, 14 bp, Homo sapiens
aggagatgggcctt

SEQ ID NO: 1604698 - DNA, 12 bp, Homo sapiens
aggagatttctt

SEQ ID NO: 1604699 - DNA, 14 bp, Homo sapiens
aggagatttcttag

SEQ ID NO: 1604700 - DNA, 16 bp, Homo sapiens
aggagcacaagccaca

SEQ ID NO: 1604701 - DNA, 15 bp, Homo sapiens
aggagcacaggcagc

SEQ ID NO: 1604702 - DNA, 22 bp, Homo sapiens
aggagcagagggcaggggtgct

SEQ ID NO: 1604703 - DNA, 13 bp, Homo sapiens
aggagcagcagcc

SEQ ID NO: 1604704 - DNA, 14 bp, Homo sapiens
aggagcagcagcca

SEQ ID NO: 1604705 - DNA, 12 bp, Homo sapiens
aggagcagctgt

SEQ ID NO: 1604706 - DNA, 18 bp, Homo sapiens
aggagcatgcgcagaggc

SEQ ID NO: 1604707 - DNA, 23 bp, Homo sapiens
aggagccaaatgaccgagccctg

SEQ ID NO: 1604708 - DNA, 14 bp, Homo sapiens
aggagccaccagtt

SEQ ID NO: 1604709 - DNA, 23 bp, Homo sapiens
aggagccagtttgccggatacaa

SEQ ID NO: 1604710 - DNA, 17 bp, Homo sapiens
aggagcccagaaaacct

SEQ ID NO: 1604711 - DNA, 18 bp, Homo sapiens
aggagcctagcggagccc

SEQ ID NO: 1604712 - DNA, 21 bp, Homo sapiens
aggagcctagcggagcccagc

SEQ ID NO: 1604713 - DNA, 20 bp, Homo sapiens
aggagcctcagaagaaaaca

SEQ ID NO: 1604714 - DNA, 21 bp, Homo sapiens
aggagcctgtgcgtcccagct

SEQ ID NO: 1604715 - DNA, 21 bp, Homo sapiens
aggagccttcctttctcctgc

SEQ ID NO: 1604716 - DNA, 20 bp, Homo sapiens
aggagccttgctgggccagg

SEQ ID NO: 1604717 - DNA, 16 bp, Homo sapiens
aggagcgtggactctg

SEQ ID NO: 1604718 - DNA, 13 bp, Homo sapiens
aggagctaaggct

SEQ ID NO: 1604719 - DNA, 15 bp, Homo sapiens
aggagctaaggctct

SEQ ID NO: 1604720 - DNA, 16 bp, Homo sapiens
aggagctaaggctcta

SEQ ID NO: 1604721 - DNA, 17 bp, Homo sapiens
aggagctaaggctctat

SEQ ID NO: 1604722 - DNA, 18 bp, Homo sapiens
aggagctagtaggaatgt

SEQ ID NO: 1604723 - DNA, 15 bp, Homo sapiens
aggagctcaccctgc

SEQ ID NO: 1604724 - DNA, 16 bp, Homo sapiens
aggagctcaccctgcc

SEQ ID NO: 1604725 - DNA, 17 bp, Homo sapiens
aggagctctgcgccagg

SEQ ID NO: 1604726 - DNA, 19 bp, Homo sapiens
aggagctctgcgccaggca

SEQ ID NO: 1604727 - DNA, 20 bp, Homo sapiens
aggagctctgcgccaggcag

SEQ ID NO: 1604728 - DNA, 16 bp, Homo sapiens
aggagctgagtcacct

SEQ ID NO: 1604729 - DNA, 15 bp, Homo sapiens
aggagctgatggcag

SEQ ID NO: 1604730 - DNA, 18 bp, Homo sapiens
aggagctgatggcagctg

SEQ ID NO: 1604731 - DNA, 12 bp, Homo sapiens
aggagctgcctg

SEQ ID NO: 1604732 - DNA, 23 bp, Homo sapiens
aggagctgccttggctcagacat

SEQ ID NO: 1604733 - DNA, 17 bp, Homo sapiens
aggagctggaggggtgg

SEQ ID NO: 1604734 - DNA, 21 bp, Homo sapiens
aggagctggaggggtggggag

SEQ ID NO: 1604735 - DNA, 12 bp, Homo sapiens
aggagctggcct

SEQ ID NO: 1604736 - DNA, 13 bp, Homo sapiens
aggagctggcctg

SEQ ID NO: 1604737 - DNA, 17 bp, Homo sapiens
aggagctggcctgtggc

SEQ ID NO: 1604738 - DNA, 14 bp, Homo sapiens
aggagctggctggc

SEQ ID NO: 1604739 - DNA, 16 bp, Homo sapiens
aggagctggctggcag

SEQ ID NO: 1604740 - DNA, 17 bp, Homo sapiens
aggagctggctggcagg

SEQ ID NO: 1604741 - DNA, 18 bp, Homo sapiens
aggagctgggagccgggc

SEQ ID NO: 1604742 - DNA, 12 bp, Homo sapiens
aggagctgggga

SEQ ID NO: 1604743 - DNA, 18 bp, Homo sapiens
aggagcttacccaagctg

SEQ ID NO: 1604744 - DNA, 19 bp, Homo sapiens
aggagcttctcccagtgtg

SEQ ID NO: 1604745 - DNA, 22 bp, Homo sapiens
aggagcttctcccagtgtgaga

SEQ ID NO: 1604746 - DNA, 19 bp, Homo sapiens
aggagcttcttgtttcctt

SEQ ID NO: 1604747 - DNA, 20 bp, Homo sapiens
aggagcttcttgtttccttg

SEQ ID NO: 1604748 - DNA, 22 bp, Homo sapiens
aggagcttcttgtttccttgtt

SEQ ID NO: 1604749 - DNA, 16 bp, Homo sapiens
aggagctttctcaatg

SEQ ID NO: 1604750 - DNA, 14 bp, Homo sapiens
aggaggaaaaggaa

SEQ ID NO: 1604751 - DNA, 16 bp, Homo sapiens
aggaggaaacagttct

SEQ ID NO: 1604752 - DNA, 14 bp, Homo sapiens
aggaggaaggcaag

SEQ ID NO: 1604753 - DNA, 17 bp, Homo sapiens
aggaggaaggcaagagg

SEQ ID NO: 1604754 - DNA, 18 bp, Homo sapiens
aggaggaatagtgcttgc

SEQ ID NO: 1604755 - DNA, 19 bp, Homo sapiens
aggaggaatgctggactgg

SEQ ID NO: 1604756 - DNA, 14 bp, Homo sapiens
aggaggagccttgc

SEQ ID NO: 1604757 - DNA, 19 bp, Homo sapiens
aggaggagccttgctgggc

SEQ ID NO: 1604758 - DNA, 22 bp, Homo sapiens
aggaggagccttgctgggccag

SEQ ID NO: 1604759 - DNA, 22 bp, Homo sapiens
aggaggagggaggcgctgctgg

SEQ ID NO: 1604760 - DNA, 23 bp, Homo sapiens
aggaggattgcttgagcccagga

SEQ ID NO: 1604761 - DNA, 18 bp, Homo sapiens
aggaggcacctacactca

SEQ ID NO: 1604762 - DNA, 17 bp, Homo sapiens
aggaggccaaccagccc

SEQ ID NO: 1604763 - DNA, 22 bp, Homo sapiens
aggaggccaaccagcccgacag

SEQ ID NO: 1604764 - DNA, 13 bp, Homo sapiens
aggaggccacctc

SEQ ID NO: 1604765 - DNA, 17 bp, Homo sapiens
aggaggccacctctcca

SEQ ID NO: 1604766 - DNA, 20 bp, Homo sapiens
aggaggccacctctccaagg

SEQ ID NO: 1604767 - DNA, 23 bp, Homo sapiens
aggaggccacctctccaagggct

SEQ ID NO: 1604768 - DNA, 21 bp, Homo sapiens
aggaggccccaggctgagagc

SEQ ID NO: 1604769 - DNA, 20 bp, Homo sapiens
aggaggccctgttccctgga

SEQ ID NO: 1604770 - DNA, 20 bp, Homo sapiens
aggaggccgagtggctgccg

SEQ ID NO: 1604771 - DNA, 19 bp, Homo sapiens
aggaggcggcccggccagc

SEQ ID NO: 1604772 - DNA, 20 bp, Homo sapiens
aggaggctcaggtgatctgt

SEQ ID NO: 1604773 - DNA, 21 bp, Homo sapiens
aggaggctcaggtgatctgtt

SEQ ID NO: 1604774 - DNA, 17 bp, Homo sapiens
aggaggctgagacagga

SEQ ID NO: 1604775 - DNA, 21 bp, Homo sapiens
aggaggctgcatgctctggaa

SEQ ID NO: 1604776 - DNA, 12 bp, Homo sapiens
aggaggctggag

SEQ ID NO: 1604777 - DNA, 16 bp, Homo sapiens
aggaggctggaggaag

SEQ ID NO: 1604778 - DNA, 18 bp, Homo sapiens
aggaggctggaggaaggg

SEQ ID NO: 1604779 - DNA, 16 bp, Homo sapiens
aggaggctggcaggta

SEQ ID NO: 1604780 - DNA, 13 bp, Homo sapiens
aggagggagaaga

SEQ ID NO: 1604781 - DNA, 15 bp, Homo sapiens
aggagggagaagaga

SEQ ID NO: 1604782 - DNA, 16 bp, Homo sapiens
aggagggagacactgg

SEQ ID NO: 1604783 - DNA, 12 bp, Homo sapiens
aggagggagagg

SEQ ID NO: 1604784 - DNA, 15 bp, Homo sapiens
aggagggagagggag

SEQ ID NO: 1604785 - DNA, 14 bp, Homo sapiens
aggagggagctgct

SEQ ID NO: 1604786 - DNA, 15 bp, Homo sapiens
aggagggagggggct

SEQ ID NO: 1604787 - DNA, 13 bp, Homo sapiens
aggagggcagagc

SEQ ID NO: 1604788 - DNA, 17 bp, Homo sapiens
aggagggcagagccatg

SEQ ID NO: 1604789 - DNA, 12 bp, Homo sapiens
aggagggccagc

SEQ ID NO: 1604790 - DNA, 20 bp, Homo sapiens
aggagggccctacctgattg

SEQ ID NO: 1604791 - DNA, 14 bp, Homo sapiens
aggaggggaagggg

SEQ ID NO: 1604792 - DNA, 15 bp, Homo sapiens
aggaggggaaggggc

SEQ ID NO: 1604793 - DNA, 17 bp, Homo sapiens
aggaggggaaggggctg

SEQ ID NO: 1604794 - DNA, 19 bp, Homo sapiens
aggaggggaaggggctgag

SEQ ID NO: 1604795 - DNA, 14 bp, Homo sapiens
aggaggggagggta

SEQ ID NO: 1604796 - DNA, 15 bp, Homo sapiens
aggaagctcagcctt

SEQ ID NO: 1604797 - DNA, 17 bp, Homo sapiens
aggaagctcagccttct

SEQ ID NO: 1604798 - DNA, 11 bp, Homo sapiens
aggaaggaaaa

SEQ ID NO: 1604799 - DNA, 14 bp, Homo sapiens
aggaaggaaaagaa

SEQ ID NO: 1604800 - DNA, 12 bp, Homo sapiens
aggaaggaaaga

SEQ ID NO: 1604801 - DNA, 15 bp, Homo sapiens
aggaaggacaggaag

SEQ ID NO: 1604802 - DNA, 14 bp, Homo sapiens
aggaaggagggcac

SEQ ID NO: 1604803 - DNA, 14 bp, Homo sapiens
aggaaggcaagagg

SEQ ID NO: 1604804 - DNA, 21 bp, Homo sapiens
aggaaggccaaaatcaagagt

SEQ ID NO: 1604805 - DNA, 20 bp, Homo sapiens
aggaaggcctttcttctgtg

SEQ ID NO: 1604806 - DNA, 23 bp, Homo sapiens
aggaagggaccaaggcaaggcag

SEQ ID NO: 1604807 - DNA, 17 bp, Homo sapiens
aggaagggatctgagaa

SEQ ID NO: 1604808 - DNA, 16 bp, Homo sapiens
aggaagggggttgtgg

SEQ ID NO: 1604809 - DNA, 14 bp, Homo sapiens
aggaaggtagaaat

SEQ ID NO: 1604810 - DNA, 16 bp, Homo sapiens
aggaaggtgctgagct

SEQ ID NO: 1604811 - DNA, 16 bp, Homo sapiens
aggaaggtggatggcc

SEQ ID NO: 1604812 - DNA, 17 bp, Homo sapiens
aggaagtctaggagctg

SEQ ID NO: 1604813 - DNA, 18 bp, Homo sapiens
aggaagtctaggagctgg

SEQ ID NO: 1604814 - DNA, 23 bp, Homo sapiens
aggaagtgatttttgagcccttg

SEQ ID NO: 1604815 - DNA, 16 bp, Homo sapiens
aggaagtgtaacagct

SEQ ID NO: 1604816 - DNA, 22 bp, Homo sapiens
aggaataaaaccatcctgtttg

SEQ ID NO: 1604817 - DNA, 17 bp, Homo sapiens
aggaataacactgcagc

SEQ ID NO: 1604818 - DNA, 12 bp, Homo sapiens
aggaataagaat

SEQ ID NO: 1604819 - DNA, 15 bp, Homo sapiens
aggaatagccagaga

SEQ ID NO: 1604820 - DNA, 17 bp, Homo sapiens
aggaatagttgagcccc

SEQ ID NO: 1604821 - DNA, 21 bp, Homo sapiens
aggaatagttgagccccaagt

SEQ ID NO: 1604822 - DNA, 15 bp, Homo sapiens
aggaatcaacagggc

SEQ ID NO: 1604823 - DNA, 15 bp, Homo sapiens
aggaatcccagaggt

SEQ ID NO: 1604824 - DNA, 14 bp, Homo sapiens
aggaatcctggcag

SEQ ID NO: 1604825 - DNA, 20 bp, Homo sapiens
aggaatcctggcagcccaga

SEQ ID NO: 1604826 - DNA, 16 bp, Homo sapiens
aggaatctcagagaca

SEQ ID NO: 1604827 - DNA, 17 bp, Homo sapiens
aggaatctcagagacag

SEQ ID NO: 1604828 - DNA, 23 bp, Homo sapiens
aggaatctcttcactaccctgat

SEQ ID NO: 1604829 - DNA, 14 bp, Homo sapiens
aggaatctgtttct

SEQ ID NO: 1604830 - DNA, 14 bp, Homo sapiens
aggaatgcctgtgc

SEQ ID NO: 1604831 - DNA, 16 bp, Homo sapiens
aggaatgcctgtgcca

SEQ ID NO: 1604832 - DNA, 17 bp, Homo sapiens
aggaatgcctgtgccaa

SEQ ID NO: 1604833 - DNA, 21 bp, Homo sapiens
aggaatgcctgtgccaataaa

SEQ ID NO: 1604834 - DNA, 16 bp, Homo sapiens
aggaatgctggactgg

SEQ ID NO: 1604835 - DNA, 17 bp, Homo sapiens
aggaatgctggactgga

SEQ ID NO: 1604836 - DNA, 23 bp, Homo sapiens
aggaatggctgcacctttttgca

SEQ ID NO: 1604837 - DNA, 20 bp, Homo sapiens
aggaatgggggcctcttcaa

SEQ ID NO: 1604838 - DNA, 15 bp, Homo sapiens
aggaatgtcagggcc

SEQ ID NO: 1604839 - DNA, 17 bp, Homo sapiens
aggaatgtcagggccag

SEQ ID NO: 1604840 - DNA, 20 bp, Homo sapiens
aggaatgtcagggccaggtg

SEQ ID NO: 1604841 - DNA, 17 bp, Homo sapiens
aggaatgtgcttttcca

SEQ ID NO: 1604842 - DNA, 16 bp, Homo sapiens
aggaattcagtgcctt

SEQ ID NO: 1604843 - DNA, 22 bp, Homo sapiens
aggaattcccagcccaaagctg

SEQ ID NO: 1604844 - DNA, 19 bp, Homo sapiens
aggaattctcaagacctga

SEQ ID NO: 1604845 - DNA, 17 bp, Homo sapiens
aggaatttactttcttc

SEQ ID NO: 1604846 - DNA, 15 bp, Homo sapiens
aggaatttgtacttc

SEQ ID NO: 1604847 - DNA, 23 bp, Homo sapiens
aggaattttattttgctgagttg

SEQ ID NO: 1604848 - DNA, 14 bp, Homo sapiens
aggaattttctttg

SEQ ID NO: 1604849 - DNA, 13 bp, Homo sapiens
aggaattttgtaa

SEQ ID NO: 1604850 - DNA, 17 bp, Homo sapiens
aggaattttgtgtgatt

SEQ ID NO: 1604851 - DNA, 14 bp, Homo sapiens
aggacaaaatgtta

SEQ ID NO: 1604852 - DNA, 17 bp, Homo sapiens
aggacaaagtctccagc

SEQ ID NO: 1604853 - DNA, 14 bp, Homo sapiens
aggacaaccattcc

SEQ ID NO: 1604854 - DNA, 18 bp, Homo sapiens
aggacaatcagtcccctc

SEQ ID NO: 1604855 - DNA, 15 bp, Homo sapiens
aggacaatttcaaaa

SEQ ID NO: 1604856 - DNA, 13 bp, Homo sapiens
aggacacagcaca

SEQ ID NO: 1604857 - DNA, 22 bp, Homo sapiens
aggacacagcacaagggcacat

SEQ ID NO: 1604858 - DNA, 12 bp, Homo sapiens
aggacacagtga

SEQ ID NO: 1604859 - DNA, 16 bp, Homo sapiens
aggacacagtgatgaa

SEQ ID NO: 1604860 - DNA, 15 bp, Homo sapiens
aggacacagttcctg

SEQ ID NO: 1604861 - DNA, 16 bp, Homo sapiens
aggacacagttcctgg

SEQ ID NO: 1604862 - DNA, 18 bp, Homo sapiens
aggacacagttcctggga

SEQ ID NO: 1604863 - DNA, 21 bp, Homo sapiens
aggacacatcccggcctcttc

SEQ ID NO: 1604864 - DNA, 15 bp, Homo sapiens
aggacacatctattg

SEQ ID NO: 1604865 - DNA, 20 bp, Homo sapiens
aggacaccagtgaaagaagc

SEQ ID NO: 1604866 - DNA, 22 bp, Homo sapiens
agcttaaataacaaaactgtgc

SEQ ID NO: 1604867 - DNA, 15 bp, Homo sapiens
agcttacaagccagc

SEQ ID NO: 1604868 - DNA, 19 bp, Homo sapiens
agcttacaagccagctgga

SEQ ID NO: 1604869 - DNA, 12 bp, Homo sapiens
agcttacactga

SEQ ID NO: 1604870 - DNA, 15 bp, Homo sapiens
agcttacactgagga

SEQ ID NO: 1604871 - DNA, 16 bp, Homo sapiens
agcttacactgaggac

SEQ ID NO: 1604872 - DNA, 18 bp, Homo sapiens
agcttacactgaggactg

SEQ ID NO: 1604873 - DNA, 13 bp, Homo sapiens
agcttacaggaag

SEQ ID NO: 1604874 - DNA, 22 bp, Homo sapiens
agcttacattgaaaacagatat

SEQ ID NO: 1604875 - DNA, 16 bp, Homo sapiens
agcttacattttcctg

SEQ ID NO: 1604876 - DNA, 12 bp, Homo sapiens
agcttacccaag

SEQ ID NO: 1604877 - DNA, 16 bp, Homo sapiens
agcttacctgaacagg

SEQ ID NO: 1604878 - DNA, 13 bp, Homo sapiens
agcttacctgaca

SEQ ID NO: 1604879 - DNA, 15 bp, Homo sapiens
agcttacctgacaca

SEQ ID NO: 1604880 - DNA, 14 bp, Homo sapiens
agcttagacctcag

SEQ ID NO: 1604881 - DNA, 16 bp, Homo sapiens
agcttagacctcagcc

SEQ ID NO: 1604882 - DNA, 13 bp, Homo sapiens
agcttagagttct

SEQ ID NO: 1604883 - DNA, 18 bp, Homo sapiens
agcttagagttcttcttt

SEQ ID NO: 1604884 - DNA, 20 bp, Homo sapiens
agcttagagttcttctttct

SEQ ID NO: 1604885 - DNA, 21 bp, Homo sapiens
agcttagagttcttctttctt

SEQ ID NO: 1604886 - DNA, 19 bp, Homo sapiens
agcttatctcttttatatt

SEQ ID NO: 1604887 - DNA, 15 bp, Homo sapiens
agcttattaaaactc

SEQ ID NO: 1604888 - DNA, 20 bp, Homo sapiens
agcttattaaaactcatttt

SEQ ID NO: 1604889 - DNA, 12 bp, Homo sapiens
agcttatttcta

SEQ ID NO: 1604890 - DNA, 16 bp, Homo sapiens
agcttatttttctgtg

SEQ ID NO: 1604891 - DNA, 18 bp, Homo sapiens
agcttcaaccctcagcct

SEQ ID NO: 1604892 - DNA, 18 bp, Homo sapiens
agcttcaacttttctctt

SEQ ID NO: 1604893 - DNA, 18 bp, Homo sapiens
agcttcacagtacccaaa

SEQ ID NO: 1604894 - DNA, 15 bp, Homo sapiens
agcttcaccagagca

SEQ ID NO: 1604895 - DNA, 22 bp, Homo sapiens
agcttcagagcctagccacctc

SEQ ID NO: 1604896 - DNA, 23 bp, Homo sapiens
agcttcagagcctagccacctcc

SEQ ID NO: 1604897 - DNA, 21 bp, Homo sapiens
agcttcatgcctttgtaagtt

SEQ ID NO: 1604898 - DNA, 12 bp, Homo sapiens
agcttccaaagc

SEQ ID NO: 1604899 - DNA, 13 bp, Homo sapiens
agcttccaaagcc

SEQ ID NO: 1604900 - DNA, 16 bp, Homo sapiens
agcttccaaagcctag

SEQ ID NO: 1604901 - DNA, 21 bp, Homo sapiens
agcttccaaatgtgtcagaat

SEQ ID NO: 1604902 - DNA, 18 bp, Homo sapiens
agcttccacctgtccctc

SEQ ID NO: 1604903 - DNA, 15 bp, Homo sapiens
agcttccattttaat

SEQ ID NO: 1604904 - DNA, 20 bp, Homo sapiens
agcttccattttaattttaa

SEQ ID NO: 1604905 - DNA, 16 bp, Homo sapiens
agcttccctattttga

SEQ ID NO: 1604906 - DNA, 13 bp, Homo sapiens
agcttccctccat

SEQ ID NO: 1604907 - DNA, 19 bp, Homo sapiens
agcttccgctttgaaagaa

SEQ ID NO: 1604908 - DNA, 23 bp, Homo sapiens
agcttccgctttgaaagaagcaa

SEQ ID NO: 1604909 - DNA, 21 bp, Homo sapiens
agcttcctgctgctggggcca

SEQ ID NO: 1604910 - DNA, 19 bp, Homo sapiens
agcttcggagggcccctgc

SEQ ID NO: 1604911 - DNA, 20 bp, Homo sapiens
agcttcgtttattttcaaga

SEQ ID NO: 1604912 - DNA, 17 bp, Homo sapiens
agcttctaccatgaaca

SEQ ID NO: 1604913 - DNA, 18 bp, Homo sapiens
agcttctagacagagttg

SEQ ID NO: 1604914 - DNA, 14 bp, Homo sapiens
agcttctctctcca

SEQ ID NO: 1604915 - DNA, 14 bp, Homo sapiens
agcttctctgggct

SEQ ID NO: 1604916 - DNA, 22 bp, Homo sapiens
agcttctgcttttctgccctgg

SEQ ID NO: 1604917 - DNA, 22 bp, Homo sapiens
agcttctgggagatttttttga

SEQ ID NO: 1604918 - DNA, 12 bp, Homo sapiens
agcttcttcaga

SEQ ID NO: 1604919 - DNA, 13 bp, Homo sapiens
agcttcttgtttc

SEQ ID NO: 1604920 - DNA, 14 bp, Homo sapiens
agcttcttgtttcc

SEQ ID NO: 1604921 - DNA, 17 bp, Homo sapiens
agcttgaaagttttcag

SEQ ID NO: 1604922 - DNA, 22 bp, Homo sapiens
agcttgaagatcgttagtatct

SEQ ID NO: 1604923 - DNA, 13 bp, Homo sapiens
agcttgaatgtcc

SEQ ID NO: 1604924 - DNA, 22 bp, Homo sapiens
agcttgaatgtccccattctat

SEQ ID NO: 1604925 - DNA, 23 bp, Homo sapiens
agcttgaatgtccccattctata

SEQ ID NO: 1604926 - DNA, 22 bp, Homo sapiens
agcttgactgcttttaaatgac

SEQ ID NO: 1604927 - DNA, 15 bp, Homo sapiens
agcttgagcctcccc

SEQ ID NO: 1604928 - DNA, 22 bp, Homo sapiens
aggaggggtgagtcccctactc

SEQ ID NO: 1604929 - DNA, 21 bp, Homo sapiens
aggagggtctcgaactcctgg

SEQ ID NO: 1604930 - DNA, 16 bp, Homo sapiens
aggagggtgacgccca

SEQ ID NO: 1604931 - DNA, 21 bp, Homo sapiens
aggagggtgacgcccagctcc

SEQ ID NO: 1604932 - DNA, 14 bp, Homo sapiens
aggagggtgggaag

SEQ ID NO: 1604933 - DNA, 16 bp, Homo sapiens
aggaggtgcttgaggc

SEQ ID NO: 1604934 - DNA, 20 bp, Homo sapiens
aggaggtgcttgaggccccg

SEQ ID NO: 1604935 - DNA, 14 bp, Homo sapiens
aggaggtggagaaa

SEQ ID NO: 1604936 - DNA, 20 bp, Homo sapiens
aggaggtggagaaaattgga

SEQ ID NO: 1604937 - DNA, 20 bp, Homo sapiens
aggaggtggaggttgcagtg

SEQ ID NO: 1604938 - DNA, 19 bp, Homo sapiens
aggaggtgtctggggtgag

SEQ ID NO: 1604939 - DNA, 13 bp, Homo sapiens
aggaggtgtgagg

SEQ ID NO: 1604940 - DNA, 16 bp, Homo sapiens
aggaggttggtgactg

SEQ ID NO: 1604941 - DNA, 15 bp, Homo sapiens
aggaggttgtggatg

SEQ ID NO: 1604942 - DNA, 18 bp, Homo sapiens
aggaggttgtggatgctc

SEQ ID NO: 1604943 - DNA, 21 bp, Homo sapiens
aggaggttgtggatgctccag

SEQ ID NO: 1604944 - DNA, 13 bp, Homo sapiens
aggagtaaaagag

SEQ ID NO: 1604945 - DNA, 16 bp, Homo sapiens
aggagtaaaattcagt

SEQ ID NO: 1604946 - DNA, 12 bp, Homo sapiens
aggagtattttt

SEQ ID NO: 1604947 - DNA, 12 bp, Homo sapiens
aggagtccctgg

SEQ ID NO: 1604948 - DNA, 13 bp, Homo sapiens
aggagtctgtgct

SEQ ID NO: 1604949 - DNA, 17 bp, Homo sapiens
aggagtctgtgctcttt

SEQ ID NO: 1604950 - DNA, 17 bp, Homo sapiens
aggagtcttcagaccca

SEQ ID NO: 1604951 - DNA, 21 bp, Homo sapiens
aggagtcttcagacccagaga

SEQ ID NO: 1604952 - DNA, 17 bp, Homo sapiens
aggagtgagaggggaca

SEQ ID NO: 1604953 - DNA, 14 bp, Homo sapiens
aggagtgccaggac

SEQ ID NO: 1604954 - DNA, 17 bp, Homo sapiens
aggagtggtgatttgaa

SEQ ID NO: 1604955 - DNA, 14 bp, Homo sapiens
aggagtgtcctctt

SEQ ID NO: 1604956 - DNA, 21 bp, Homo sapiens
aggagttcaagactagcctgg

SEQ ID NO: 1604957 - DNA, 19 bp, Homo sapiens
aggagttcctaaccagcct

SEQ ID NO: 1604958 - DNA, 22 bp, Homo sapiens
aggagttggagaccaggcctga

SEQ ID NO: 1604959 - DNA, 13 bp, Homo sapiens
aggagttgtgtct

SEQ ID NO: 1604960 - DNA, 20 bp, Homo sapiens
aggagttgtttctgacccac

SEQ ID NO: 1604961 - DNA, 19 bp, Homo sapiens
aggagtttaagaccagcct

SEQ ID NO: 1604962 - DNA, 17 bp, Homo sapiens
aggagtttattacaatg

SEQ ID NO: 1604963 - DNA, 22 bp, Homo sapiens
aggagtttattacaatgtatct

SEQ ID NO: 1604964 - DNA, 17 bp, Homo sapiens
aggagtttgagacaagc

SEQ ID NO: 1604965 - DNA, 21 bp, Homo sapiens
aggagtttgagacaagccctg

SEQ ID NO: 1604966 - DNA, 23 bp, Homo sapiens
aggagtttgagacaagccctggc

SEQ ID NO: 1604967 - DNA, 19 bp, Homo sapiens
aggagtttgagaccaggct

SEQ ID NO: 1604968 - DNA, 15 bp, Homo sapiens
aggataaagccactt

SEQ ID NO: 1604969 - DNA, 13 bp, Homo sapiens
aggataagaaagc

SEQ ID NO: 1604970 - DNA, 21 bp, Homo sapiens
aggataagaaagcctaaaatt

SEQ ID NO: 1604971 - DNA, 16 bp, Homo sapiens
aggatacagggagccg

SEQ ID NO: 1604972 - DNA, 13 bp, Homo sapiens
aggatacatttaa

SEQ ID NO: 1604973 - DNA, 16 bp, Homo sapiens
aggatacatttaataa

SEQ ID NO: 1604974 - DNA, 18 bp, Homo sapiens
aggatacatttaataaaa

SEQ ID NO: 1604975 - DNA, 18 bp, Homo sapiens
aggatatctgaaaatatt

SEQ ID NO: 1604976 - DNA, 16 bp, Homo sapiens
aggatatggacactgg

SEQ ID NO: 1604977 - DNA, 15 bp, Homo sapiens
aggatatttgcacta

SEQ ID NO: 1604978 - DNA, 19 bp, Homo sapiens
aggatcacctgaggtcagg

SEQ ID NO: 1604979 - DNA, 20 bp, Homo sapiens
aggatcacctgaggtcagga

SEQ ID NO: 1604980 - DNA, 17 bp, Homo sapiens
aggatcactctctgctg

SEQ ID NO: 1604981 - DNA, 14 bp, Homo sapiens
aggatcactggagc

SEQ ID NO: 1604982 - DNA, 16 bp, Homo sapiens
aggatcactggagccc

SEQ ID NO: 1604983 - DNA, 18 bp, Homo sapiens
aggatcactggagcccag

SEQ ID NO: 1604984 - DNA, 20 bp, Homo sapiens
aggatcactggagcccagga

SEQ ID NO: 1604985 - DNA, 22 bp, Homo sapiens
aggatcactggagcccaggagt

SEQ ID NO: 1604986 - DNA, 21 bp, Homo sapiens
aggatcagatgactctctcca

SEQ ID NO: 1604987 - DNA, 22 bp, Homo sapiens
aggatcagttttttgttttaca

SEQ ID NO: 1604988 - DNA, 21 bp, Homo sapiens
aggatcatttgttggaatgaa

SEQ ID NO: 1604989 - DNA, 17 bp, Homo sapiens
aggatccaggaatatga

SEQ ID NO: 1604990 - DNA, 18 bp, Homo sapiens
aggatcccctccaagcct

SEQ ID NO: 1604991 - DNA, 14 bp, Homo sapiens
aggatccctcctga

SEQ ID NO: 1604992 - DNA, 17 bp, Homo sapiens
aggatccgctgccacca

SEQ ID NO: 1604993 - DNA, 14 bp, Homo sapiens
aggatccggaaaga

SEQ ID NO: 1604994 - DNA, 13 bp, Homo sapiens
aggatcctgcagg

SEQ ID NO: 1604995 - DNA, 23 bp, Homo sapiens
aggatcgaagggtttttagagaa

SEQ ID NO: 1604996 - DNA, 16 bp, Homo sapiens
aggatctcaagccagc

SEQ ID NO: 1604997 - DNA, 19 bp, Homo sapiens
aggatctcaagccagcccc

SEQ ID NO: 1604998 - DNA, 14 bp, Homo sapiens
aggatctctcagga

SEQ ID NO: 1604999 - DNA, 19 bp, Homo sapiens
aggatctctcaggagcaca

SEQ ID NO: 1605000 - DNA, 21 bp, Homo sapiens
aggatctctcaggagcacagg

SEQ ID NO: 1605001 - DNA, 19 bp, Homo sapiens
aggatctgctccaacagaa

SEQ ID NO: 1605002 - DNA, 20 bp, Homo sapiens
aggatctgtgattggctggt

SEQ ID NO: 1605003 - DNA, 15 bp, Homo sapiens
aggatctttgactga

SEQ ID NO: 1605004 - DNA, 21 bp, Homo sapiens
aggatgaatgaggtcccaggc

SEQ ID NO: 1605005 - DNA, 13 bp, Homo sapiens
aggatgacttttt

SEQ ID NO: 1605006 - DNA, 12 bp, Homo sapiens
aggatgagcaga

SEQ ID NO: 1605007 - DNA, 21 bp, Homo sapiens
aggatgaggacagagggcaca

SEQ ID NO: 1605008 - DNA, 23 bp, Homo sapiens
aggatgaggacagagggcacatg

SEQ ID NO: 1605009 - DNA, 21 bp, Homo sapiens
aggatgaggccgctagaggcc

SEQ ID NO: 1605010 - DNA, 18 bp, Homo sapiens
aggatgataagttccttt

SEQ ID NO: 1605011 - DNA, 15 bp, Homo sapiens
aggatgcacatttct

SEQ ID NO: 1605012 - DNA, 16 bp, Homo sapiens
aggatgccacgcctgg

SEQ ID NO: 1605013 - DNA, 20 bp, Homo sapiens
aggatgccacgcctggaagg

SEQ ID NO: 1605014 - DNA, 15 bp, Homo sapiens
aggatgccttttctg

SEQ ID NO: 1605015 - DNA, 16 bp, Homo sapiens
aggatgccttttctgt

SEQ ID NO: 1605016 - DNA, 21 bp, Homo sapiens
aggatgctctttcccaggacg

SEQ ID NO: 1605017 - DNA, 19 bp, Homo sapiens
aggatggagagaggggaat

SEQ ID NO: 1605018 - DNA, 17 bp, Homo sapiens
aggatggagccagctct

SEQ ID NO: 1605019 - DNA, 13 bp, Homo sapiens
aggatggatggca

SEQ ID NO: 1605020 - DNA, 14 bp, Homo sapiens
aggatggatggcac

SEQ ID NO: 1605021 - DNA, 19 bp, Homo sapiens
aggatggatggcaccctgg

SEQ ID NO: 1605022 - DNA, 12 bp, Homo sapiens
aggatggcctgg

SEQ ID NO: 1605023 - DNA, 23 bp, Homo sapiens
aggatgggcagctggggggctgt

SEQ ID NO: 1605024 - DNA, 16 bp, Homo sapiens
aggatgggggagaggg

SEQ ID NO: 1605025 - DNA, 21 bp, Homo sapiens
aggatggtctcgatctcctga

SEQ ID NO: 1605026 - DNA, 14 bp, Homo sapiens
aggatggtgggcag

SEQ ID NO: 1605027 - DNA, 18 bp, Homo sapiens
aggatggtgggcaggatc

SEQ ID NO: 1605028 - DNA, 19 bp, Homo sapiens
aggatggtgggcaggatct

SEQ ID NO: 1605029 - DNA, 21 bp, Homo sapiens
aggatggtggttattttaaat

SEQ ID NO: 1605030 - DNA, 16 bp, Homo sapiens
aggatggttctgtgac

SEQ ID NO: 1605031 - DNA, 19 bp, Homo sapiens
aggatgtaaacagtgcctg

SEQ ID NO: 1605032 - DNA, 20 bp, Homo sapiens
aggatgtaaacagtgcctgc

SEQ ID NO: 1605033 - DNA, 21 bp, Homo sapiens
aggatgtaaacagtgcctgct

SEQ ID NO: 1605034 - DNA, 18 bp, Homo sapiens
aggatgtggaagagcatt

SEQ ID NO: 1605035 - DNA, 15 bp, Homo sapiens
aggatgtgttttgca

SEQ ID NO: 1605036 - DNA, 20 bp, Homo sapiens
aggattaatctctaaaattc

SEQ ID NO: 1605037 - DNA, 14 bp, Homo sapiens
aggattatcagtat

SEQ ID NO: 1605038 - DNA, 19 bp, Homo sapiens
aggattatgggtcctgcaa

SEQ ID NO: 1605039 - DNA, 14 bp, Homo sapiens
aggattattggaaa

SEQ ID NO: 1605040 - DNA, 15 bp, Homo sapiens
aggattcccccagcc

SEQ ID NO: 1605041 - DNA, 14 bp, Homo sapiens
aggattctaaaatg

SEQ ID NO: 1605042 - DNA, 16 bp, Homo sapiens
aggattcttcccgctc

SEQ ID NO: 1605043 - DNA, 16 bp, Homo sapiens
aggattctttccccag

SEQ ID NO: 1605044 - DNA, 17 bp, Homo sapiens
aggattctttccccaga

SEQ ID NO: 1605045 - DNA, 24 bp, Homo sapiens
aggattctttccccagaggctccc

SEQ ID NO: 1605046 - DNA, 24 bp, Homo sapiens
aggattgaaaatgtccaggaaagt

SEQ ID NO: 1605047 - DNA, 14 bp, Homo sapiens
aggattgctatctg

SEQ ID NO: 1605048 - DNA, 22 bp, Homo sapiens
aggattgcttgagcccaggagt

SEQ ID NO: 1605049 - DNA, 18 bp, Homo sapiens
aggatttaaaaactggaa

SEQ ID NO: 1605050 - DNA, 20 bp, Homo sapiens
aggatttaacagtcatttaa

SEQ ID NO: 1605051 - DNA, 21 bp, Homo sapiens
aggatttaacagtcatttaaa

SEQ ID NO: 1605052 - DNA, 14 bp, Homo sapiens
aggatttcaagcct

SEQ ID NO: 1605053 - DNA, 15 bp, Homo sapiens
aggatttcaagcctg

SEQ ID NO: 1605054 - DNA, 18 bp, Homo sapiens
aggatttcaccagaagtt

SEQ ID NO: 1605055 - DNA, 13 bp, Homo sapiens
aggattttaccaa

SEQ ID NO: 1605056 - DNA, 19 bp, Homo sapiens
aggattttaccaaagcatc

SEQ ID NO: 1605057 - DNA, 12 bp, Homo sapiens
aggatttttaga

SEQ ID NO: 1605058 - DNA, 17 bp, Homo sapiens
aggcaaaaactgtactg

SEQ ID NO: 1605059 - DNA, 18 bp, Homo sapiens
aggcaaacgaataaagat

SEQ ID NO: 1605060 - DNA, 22 bp, Homo sapiens
aggcaaagtacattgtaaaata

SEQ ID NO: 1605061 - DNA, 20 bp, Homo sapiens
aggcaaagtttacagatgtt

SEQ ID NO: 1605062 - DNA, 17 bp, Homo sapiens
aggcaaataatggaaaa

SEQ ID NO: 1605063 - DNA, 12 bp, Homo sapiens
aggcaaatattg

SEQ ID NO: 1605064 - DNA, 13 bp, Homo sapiens
aggcaacaggatt

SEQ ID NO: 1605065 - DNA, 16 bp, Homo sapiens
aggcaacctcccatcc

SEQ ID NO: 1605066 - DNA, 14 bp, Homo sapiens
aggcaactgaggca

SEQ ID NO: 1605067 - DNA, 14 bp, Homo sapiens
aggcaagaaaagga

SEQ ID NO: 1605068 - DNA, 16 bp, Homo sapiens
aggcaagcccctcagc

SEQ ID NO: 1605069 - DNA, 21 bp, Homo sapiens
aggcaagcccctcagcccttg

SEQ ID NO: 1605070 - DNA, 15 bp, Homo sapiens
aggcaagcttgaggc

SEQ ID NO: 1605071 - DNA, 17 bp, Homo sapiens
aggcaagcttgaggcca

SEQ ID NO: 1605072 - DNA, 20 bp, Homo sapiens
aggcaaggaaagaaatacag

SEQ ID NO: 1605073 - DNA, 13 bp, Homo sapiens
aggcaaggcaggt

SEQ ID NO: 1605074 - DNA, 14 bp, Homo sapiens
aggcaaggcaggtg

SEQ ID NO: 1605075 - DNA, 19 bp, Homo sapiens
aggcaaggcaggtgcctcc

SEQ ID NO: 1605076 - DNA, 20 bp, Homo sapiens
aggcaaggctatgtgattac

SEQ ID NO: 1605077 - DNA, 22 bp, Homo sapiens
aggcaagttttccctgaagtta

SEQ ID NO: 1605078 - DNA, 23 bp, Homo sapiens
aggcaatgtcaggaacagaagga

SEQ ID NO: 1605079 - DNA, 17 bp, Homo sapiens
aggcaattttagtgtat

SEQ ID NO: 1605080 - DNA, 11 bp, Homo sapiens
aggcacacagc

SEQ ID NO: 1605081 - DNA, 19 bp, Homo sapiens
aggcacactttctggcaaa

SEQ ID NO: 1605082 - DNA, 17 bp, Homo sapiens
aggcacagggcccgcag

SEQ ID NO: 1605083 - DNA, 22 bp, Homo sapiens
aggcacagggcccgcagtgctg

SEQ ID NO: 1605084 - DNA, 16 bp, Homo sapiens
aggcacagtcttctga

SEQ ID NO: 1605085 - DNA, 19 bp, Homo sapiens
aggcacagtgggagctgag

SEQ ID NO: 1605086 - DNA, 23 bp, Homo sapiens
aggcacataggctggtggccttg

SEQ ID NO: 1605087 - DNA, 13 bp, Homo sapiens
aggcacatggagg

SEQ ID NO: 1605088 - DNA, 12 bp, Homo sapiens
aggcacatgttg

SEQ ID NO: 1605089 - DNA, 21 bp, Homo sapiens
aggcaccaccaggagcagcag

SEQ ID NO: 1605090 - DNA, 14 bp, Homo sapiens
aggcaccagctctg

SEQ ID NO: 1605091 - DNA, 17 bp, Homo sapiens
aggcaccagctctgtgg

SEQ ID NO: 1605092 - DNA, 14 bp, Homo sapiens
aggcaccagtgtcc

SEQ ID NO: 1605093 - DNA, 20 bp, Homo sapiens
aggcaccgccacgtcccagc

SEQ ID NO: 1605094 - DNA, 21 bp, Homo sapiens
aggcaccgccacgtcccagca

SEQ ID NO: 1605095 - DNA, 15 bp, Homo sapiens
aggcaccggcgctgc

SEQ ID NO: 1605096 - DNA, 19 bp, Homo sapiens
aggcaccggcgctgcaggt

SEQ ID NO: 1605097 - DNA, 17 bp, Homo sapiens
aggcaccgtccaggccc

SEQ ID NO: 1605098 - DNA, 18 bp, Homo sapiens
aggcaccgtccaggcccc

SEQ ID NO: 1605099 - DNA, 20 bp, Homo sapiens
aggcacctcacaggccccag

SEQ ID NO: 1605100 - DNA, 12 bp, Homo sapiens
aggcacctccag

SEQ ID NO: 1605101 - DNA, 19 bp, Homo sapiens
aggcacctccccgctctcc

SEQ ID NO: 1605102 - DNA, 21 bp, Homo sapiens
aggcacctggcctgctgggaa

SEQ ID NO: 1605103 - DNA, 22 bp, Homo sapiens
aggcacctggcctgctgggaac

SEQ ID NO: 1605104 - DNA, 18 bp, Homo sapiens
aggcacgaacccacctgc

SEQ ID NO: 1605105 - DNA, 21 bp, Homo sapiens
aggcacgaacccacctgctga

SEQ ID NO: 1605106 - DNA, 16 bp, Homo sapiens
aggcacgggtggtccc

SEQ ID NO: 1605107 - DNA, 16 bp, Homo sapiens
aggcactacatgaaat

SEQ ID NO: 1605108 - DNA, 16 bp, Homo sapiens
aggcactccaaacctg

SEQ ID NO: 1605109 - DNA, 13 bp, Homo sapiens
aggcactgccctt

SEQ ID NO: 1605110 - DNA, 21 bp, Homo sapiens
aggcactgtagttctaagact

SEQ ID NO: 1605111 - DNA, 18 bp, Homo sapiens
aggcactgtcaggaatgg

SEQ ID NO: 1605112 - DNA, 22 bp, Homo sapiens
aggcactgttttatctctgtga

SEQ ID NO: 1605113 - DNA, 16 bp, Homo sapiens
aggcacttaagcacaa

SEQ ID NO: 1605114 - DNA, 16 bp, Homo sapiens
aggcagaaaattgcac

SEQ ID NO: 1605115 - DNA, 15 bp, Homo sapiens
aggcagacaagagct

SEQ ID NO: 1605116 - DNA, 16 bp, Homo sapiens
aggcagacaagagctg

SEQ ID NO: 1605117 - DNA, 17 bp, Homo sapiens
aggcagacaagagctgc

SEQ ID NO: 1605118 - DNA, 20 bp, Homo sapiens
aggcagacaagagctgctgt

SEQ ID NO: 1605119 - DNA, 15 bp, Homo sapiens
aggcagacacaccgc

SEQ ID NO: 1605120 - DNA, 19 bp, Homo sapiens
aggcagacagcagctcagg

SEQ ID NO: 1605121 - DNA, 20 bp, Homo sapiens
aggcagacagcagctcaggc

SEQ ID NO: 1605122 - DNA, 21 bp, Homo sapiens
aggcagacagcagctcaggca

SEQ ID NO: 1605123 - DNA, 11 bp, Homo sapiens
aggcagagctg

SEQ ID NO: 1605124 - DNA, 12 bp, Homo sapiens
aggcagagctga

SEQ ID NO: 1605125 - DNA, 21 bp, Homo sapiens
aggcagagctgagggccctgt

SEQ ID NO: 1605126 - DNA, 22 bp, Homo sapiens
aggcagagctgagggccctgtg

SEQ ID NO: 1605127 - DNA, 22 bp, Homo sapiens
aggcagaggcctgggctgggaa

SEQ ID NO: 1605128 - DNA, 15 bp, Homo sapiens
aggcagaggttgcag

SEQ ID NO: 1605129 - DNA, 23 bp, Homo sapiens
aggcagaggttttaatgtctgtt

SEQ ID NO: 1605130 - DNA, 17 bp, Homo sapiens
aggcagatccaggacta

SEQ ID NO: 1605131 - DNA, 20 bp, Homo sapiens
aggcagatctgtgccccatg

SEQ ID NO: 1605132 - DNA, 12 bp, Homo sapiens
aggcagatggag

SEQ ID NO: 1605133 - DNA, 18 bp, Homo sapiens
aggcagatgtggggctga

SEQ ID NO: 1605134 - DNA, 15 bp, Homo sapiens
aggcagatgtttgcc

SEQ ID NO: 1605135 - DNA, 18 bp, Homo sapiens
aggcagatgtttgcctca

SEQ ID NO: 1605136 - DNA, 18 bp, Homo sapiens
aggcagcatgcttgggct

SEQ ID NO: 1605137 - DNA, 20 bp, Homo sapiens
aggcagcatgcttgggctga

SEQ ID NO: 1605138 - DNA, 24 bp, Homo sapiens
aggcagcatgcttgggctgaccca

SEQ ID NO: 1605139 - DNA, 15 bp, Homo sapiens
aggcagcccagccct

SEQ ID NO: 1605140 - DNA, 21 bp, Homo sapiens
aggcagcccagctcctgaata

SEQ ID NO: 1605141 - DNA, 18 bp, Homo sapiens
aggcagccctcacctctg

SEQ ID NO: 1605142 - DNA, 20 bp, Homo sapiens
aggcagccctgtctgaagga

SEQ ID NO: 1605143 - DNA, 16 bp, Homo sapiens
aggcagccgaggcctg

SEQ ID NO: 1605144 - DNA, 11 bp, Homo sapiens
aggcagcctcc

SEQ ID NO: 1605145 - DNA, 13 bp, Homo sapiens
aggcagcctccag

SEQ ID NO: 1605146 - DNA, 15 bp, Homo sapiens
aggcagcctccagag

SEQ ID NO: 1605147 - DNA, 16 bp, Homo sapiens
aggcagcctccagagc

SEQ ID NO: 1605148 - DNA, 20 bp, Homo sapiens
aggcagcctccagagccagc

SEQ ID NO: 1605149 - DNA, 12 bp, Homo sapiens
aggcagcgaccc

SEQ ID NO: 1605150 - DNA, 16 bp, Homo sapiens
aggcagcgacctcaag

SEQ ID NO: 1605151 - DNA, 19 bp, Homo sapiens
aggcagcgttagggctgct

SEQ ID NO: 1605152 - DNA, 20 bp, Homo sapiens
aggcagctaagatagaaagc

SEQ ID NO: 1605153 - DNA, 21 bp, Homo sapiens
aggcagctaagatagaaagct

SEQ ID NO: 1605154 - DNA, 22 bp, Homo sapiens
aggcagctaagatagaaagctg

SEQ ID NO: 1605155 - DNA, 23 bp, Homo sapiens
aggcagctaagatagaaagctgg

SEQ ID NO: 1605156 - DNA, 14 bp, Homo sapiens
aggcagctccctcc

SEQ ID NO: 1605157 - DNA, 11 bp, Homo sapiens
aggcagctgcc

SEQ ID NO: 1605158 - DNA, 20 bp, Homo sapiens
aggcagctgcctctgctccc

SEQ ID NO: 1605159 - DNA, 22 bp, Homo sapiens
aggcagctgcctctgctccctc

SEQ ID NO: 1605160 - DNA, 21 bp, Homo sapiens
agcccctcctccagcccctgt

SEQ ID NO: 1605161 - DNA, 13 bp, Homo sapiens
agcccctcctccc

SEQ ID NO: 1605162 - DNA, 23 bp, Homo sapiens
agcccctcctctgagcagcctct

SEQ ID NO: 1605163 - DNA, 18 bp, Homo sapiens
agcccctcctctgccacc

SEQ ID NO: 1605164 - DNA, 19 bp, Homo sapiens
agcccctcctctgccacct

SEQ ID NO: 1605165 - DNA, 21 bp, Homo sapiens
agcccctcctctgccacctcc

SEQ ID NO: 1605166 - DNA, 22 bp, Homo sapiens
agcccctcctctgccacctccc

SEQ ID NO: 1605167 - DNA, 23 bp, Homo sapiens
agcccctcctctgccacctcccc

SEQ ID NO: 1605168 - DNA, 13 bp, Homo sapiens
agcccctccttct

SEQ ID NO: 1605169 - DNA, 14 bp, Homo sapiens
agcccctccttctc

SEQ ID NO: 1605170 - DNA, 17 bp, Homo sapiens
agcccctccttctcccc

SEQ ID NO: 1605171 - DNA, 22 bp, Homo sapiens
agcccctccttctcccctgccg

SEQ ID NO: 1605172 - DNA, 12 bp, Homo sapiens
agcccctctggt

SEQ ID NO: 1605173 - DNA, 20 bp, Homo sapiens
agcccctctggtcgctcctg

SEQ ID NO: 1605174 - DNA, 21 bp, Homo sapiens
agcccctctggtcgctcctgc

SEQ ID NO: 1605175 - DNA, 22 bp, Homo sapiens
agcccctctggtcgctcctgcc

SEQ ID NO: 1605176 - DNA, 17 bp, Homo sapiens
agcccctcttccccaat

SEQ ID NO: 1605177 - DNA, 17 bp, Homo sapiens
agcccctcttggagaag

SEQ ID NO: 1605178 - DNA, 20 bp, Homo sapiens
agcccctcttggagaagtct

SEQ ID NO: 1605179 - DNA, 23 bp, Homo sapiens
agcccctcttggagaagtctcag

SEQ ID NO: 1605180 - DNA, 18 bp, Homo sapiens
agcccctgcccctcatgc

SEQ ID NO: 1605181 - DNA, 11 bp, Homo sapiens
agcccctgtcc

SEQ ID NO: 1605182 - DNA, 14 bp, Homo sapiens
agccccttctggcc

SEQ ID NO: 1605183 - DNA, 23 bp, Homo sapiens
agccccttctggccggtgctggg

SEQ ID NO: 1605184 - DNA, 15 bp, Homo sapiens
agcccgacagtgcca

SEQ ID NO: 1605185 - DNA, 20 bp, Homo sapiens
agcccgatattctccctgac

SEQ ID NO: 1605186 - DNA, 16 bp, Homo sapiens
agcccgcactgtccca

SEQ ID NO: 1605187 - DNA, 20 bp, Homo sapiens
agcccgcagggccatgcaga

SEQ ID NO: 1605188 - DNA, 21 bp, Homo sapiens
agcccgcagggccatgcagac

SEQ ID NO: 1605189 - DNA, 22 bp, Homo sapiens
agcccgcttttgttcttcccca

SEQ ID NO: 1605190 - DNA, 20 bp, Homo sapiens
agcccggcgccaccatcctg

SEQ ID NO: 1605191 - DNA, 18 bp, Homo sapiens
agcccggcgcccctgcca

SEQ ID NO: 1605192 - DNA, 16 bp, Homo sapiens
agcccgggctgcctgg

SEQ ID NO: 1605193 - DNA, 19 bp, Homo sapiens
agcccgggctgcctgggct

SEQ ID NO: 1605194 - DNA, 20 bp, Homo sapiens
agcccgggctgcctgggctg

SEQ ID NO: 1605195 - DNA, 21 bp, Homo sapiens
agcccgggctgcctgggctgt

SEQ ID NO: 1605196 - DNA, 20 bp, Homo sapiens
agcccgtcgcgctggacagc

SEQ ID NO: 1605197 - DNA, 20 bp, Homo sapiens
agcccgtgcagtacaggcaa

SEQ ID NO: 1605198 - DNA, 19 bp, Homo sapiens
agcccgttagccccaggga

SEQ ID NO: 1605199 - DNA, 15 bp, Homo sapiens
agcccgttttcacac

SEQ ID NO: 1605200 - DNA, 18 bp, Homo sapiens
agccctaacatagtgtct

SEQ ID NO: 1605201 - DNA, 21 bp, Homo sapiens
agccctaaggatctctcagga

SEQ ID NO: 1605202 - DNA, 22 bp, Homo sapiens
agccctaagtggctgccttctt

SEQ ID NO: 1605203 - DNA, 17 bp, Homo sapiens
agccctacagagctgtg

SEQ ID NO: 1605204 - DNA, 15 bp, Homo sapiens
agccctactccctgc

SEQ ID NO: 1605205 - DNA, 17 bp, Homo sapiens
agccctactccctgcag

SEQ ID NO: 1605206 - DNA, 18 bp, Homo sapiens
agccctactccctgcaga

SEQ ID NO: 1605207 - DNA, 21 bp, Homo sapiens
agccctactccctgcagatgc

SEQ ID NO: 1605208 - DNA, 22 bp, Homo sapiens
agccctcacccctggttctcat

SEQ ID NO: 1605209 - DNA, 17 bp, Homo sapiens
agccctcacctctgagg

SEQ ID NO: 1605210 - DNA, 18 bp, Homo sapiens
agccctcacctctgagga

SEQ ID NO: 1605211 - DNA, 21 bp, Homo sapiens
agccctcacctctgaggacag

SEQ ID NO: 1605212 - DNA, 23 bp, Homo sapiens
agccctcagaagaaaacttttgt

SEQ ID NO: 1605213 - DNA, 15 bp, Homo sapiens
agccctcatttttat

SEQ ID NO: 1605214 - DNA, 20 bp, Homo sapiens
agccctcatttttataacct

SEQ ID NO: 1605215 - DNA, 19 bp, Homo sapiens
agccctccaggcctgcagg

SEQ ID NO: 1605216 - DNA, 12 bp, Homo sapiens
agccctccccat

SEQ ID NO: 1605217 - DNA, 19 bp, Homo sapiens
agccctccccatggagcca

SEQ ID NO: 1605218 - DNA, 21 bp, Homo sapiens
agccctccccatggagccagc

SEQ ID NO: 1605219 - DNA, 16 bp, Homo sapiens
agccctccctgcccct

SEQ ID NO: 1605220 - DNA, 19 bp, Homo sapiens
agccctccctgcccctccc

SEQ ID NO: 1605221 - DNA, 22 bp, Homo sapiens
agccctccctgcccctcccttc

SEQ ID NO: 1605222 - DNA, 14 bp, Homo sapiens
agccctccctggct

SEQ ID NO: 1605223 - DNA, 17 bp, Homo sapiens
agccctccctggctgtg

SEQ ID NO: 1605224 - DNA, 12 bp, Homo sapiens
agccctcctcac

SEQ ID NO: 1605225 - DNA, 11 bp, Homo sapiens
agccctccttc

SEQ ID NO: 1605226 - DNA, 13 bp, Homo sapiens
agccctccttcca

SEQ ID NO: 1605227 - DNA, 19 bp, Homo sapiens
agccctcgaaccaaggcag

SEQ ID NO: 1605228 - DNA, 20 bp, Homo sapiens
agccctcgaaccaaggcagc

SEQ ID NO: 1605229 - DNA, 21 bp, Homo sapiens
agccctcgaaccaaggcagcc

SEQ ID NO: 1605230 - DNA, 14 bp, Homo sapiens
agccctcggcctcc

SEQ ID NO: 1605231 - DNA, 16 bp, Homo sapiens
agccctcttgcccgca

SEQ ID NO: 1605232 - DNA, 23 bp, Homo sapiens
agccctcttgcccgcacccctcc

SEQ ID NO: 1605233 - DNA, 18 bp, Homo sapiens
agccctgaggacctctca

SEQ ID NO: 1605234 - DNA, 20 bp, Homo sapiens
agccctgaggacctctcagc

SEQ ID NO: 1605235 - DNA, 21 bp, Homo sapiens
agccctgaggtgaaagggagc

SEQ ID NO: 1605236 - DNA, 12 bp, Homo sapiens
agccctgcacca

SEQ ID NO: 1605237 - DNA, 20 bp, Homo sapiens
agccctgcaccatgctgctg

SEQ ID NO: 1605238 - DNA, 15 bp, Homo sapiens
agccctgccctccca

SEQ ID NO: 1605239 - DNA, 16 bp, Homo sapiens
agccctgccctcccaa

SEQ ID NO: 1605240 - DNA, 18 bp, Homo sapiens
agccctgccctcccaagt

SEQ ID NO: 1605241 - DNA, 22 bp, Homo sapiens
agccctgccctcccaagtccca

SEQ ID NO: 1605242 - DNA, 12 bp, Homo sapiens
agccctgcctct

SEQ ID NO: 1605243 - DNA, 13 bp, Homo sapiens
agccctgcctctg

SEQ ID NO: 1605244 - DNA, 15 bp, Homo sapiens
agccctgcctctgtg

SEQ ID NO: 1605245 - DNA, 16 bp, Homo sapiens
agccctgcctctgtgt

SEQ ID NO: 1605246 - DNA, 20 bp, Homo sapiens
agccctgcggagccggcacc

SEQ ID NO: 1605247 - DNA, 22 bp, Homo sapiens
agccctggagagccccatggtg

SEQ ID NO: 1605248 - DNA, 17 bp, Homo sapiens
agccctggcaggatgac

SEQ ID NO: 1605249 - DNA, 21 bp, Homo sapiens
agccctggcaggatgaccctg

SEQ ID NO: 1605250 - DNA, 14 bp, Homo sapiens
agccctggccctgc

SEQ ID NO: 1605251 - DNA, 16 bp, Homo sapiens
agccctgggaaccact

SEQ ID NO: 1605252 - DNA, 19 bp, Homo sapiens
agccctggttagctgacag

SEQ ID NO: 1605253 - DNA, 13 bp, Homo sapiens
agccctgtcccct

SEQ ID NO: 1605254 - DNA, 22 bp, Homo sapiens
agccctgtctgctaggcgctgg

SEQ ID NO: 1605255 - DNA, 14 bp, Homo sapiens
agccctgtggccgc

SEQ ID NO: 1605256 - DNA, 15 bp, Homo sapiens
agccctgtggccgcc

SEQ ID NO: 1605257 - DNA, 13 bp, Homo sapiens
agcccttcagatt

SEQ ID NO: 1605258 - DNA, 14 bp, Homo sapiens
agcccttcctacct

SEQ ID NO: 1605259 - DNA, 14 bp, Homo sapiens
agcccttctgcctt

SEQ ID NO: 1605260 - DNA, 19 bp, Homo sapiens
agcccttgaagtcacccgg

SEQ ID NO: 1605261 - DNA, 15 bp, Homo sapiens
agcccttgcccccat

SEQ ID NO: 1605262 - DNA, 12 bp, Homo sapiens
agcccttgcctc

SEQ ID NO: 1605263 - DNA, 19 bp, Homo sapiens
agcccttggaacaccctgg

SEQ ID NO: 1605264 - DNA, 21 bp, Homo sapiens
agcccttggaacaccctggat

SEQ ID NO: 1605265 - DNA, 16 bp, Homo sapiens
agccctttgctctgga

SEQ ID NO: 1605266 - DNA, 23 bp, Homo sapiens
agccctttggagaacgccagtct

SEQ ID NO: 1605267 - DNA, 21 bp, Homo sapiens
agccctttgggaggctgaggc

SEQ ID NO: 1605268 - DNA, 16 bp, Homo sapiens
agccgacctcagcctt

SEQ ID NO: 1605269 - DNA, 13 bp, Homo sapiens
agccgactctggc

SEQ ID NO: 1605270 - DNA, 15 bp, Homo sapiens
agccgactctggccc

SEQ ID NO: 1605271 - DNA, 16 bp, Homo sapiens
agccgactctggccct

SEQ ID NO: 1605272 - DNA, 14 bp, Homo sapiens
agccgagagcctgc

SEQ ID NO: 1605273 - DNA, 18 bp, Homo sapiens
agccgagagcctgctccc

SEQ ID NO: 1605274 - DNA, 16 bp, Homo sapiens
agccgagggcgtcaga

SEQ ID NO: 1605275 - DNA, 15 bp, Homo sapiens
agccgaggggagaga

SEQ ID NO: 1605276 - DNA, 22 bp, Homo sapiens
agcattctttggagttaaaatg

SEQ ID NO: 1605277 - DNA, 16 bp, Homo sapiens
agccatctgcccaggg

SEQ ID NO: 1605278 - DNA, 16 bp, Homo sapiens
agccatcttggcaggg

SEQ ID NO: 1605279 - DNA, 20 bp, Homo sapiens
agccatgaggagcgtggact

SEQ ID NO: 1605280 - DNA, 22 bp, Homo sapiens
agccatgatcgagccactgcac

SEQ ID NO: 1605281 - DNA, 21 bp, Homo sapiens
agccatgatttcccactgcac

SEQ ID NO: 1605282 - DNA, 17 bp, Homo sapiens
agccgaggggagagagg

SEQ ID NO: 1605283 - DNA, 20 bp, Homo sapiens
agccgaggggagagagggac

SEQ ID NO: 1605284 - DNA, 15 bp, Homo sapiens
agccgcaagctctca

SEQ ID NO: 1605285 - DNA, 17 bp, Homo sapiens
agccgcaagctctcagc

SEQ ID NO: 1605286 - DNA, 21 bp, Homo sapiens
agccgcaccctgcacctgctg

SEQ ID NO: 1605287 - DNA, 18 bp, Homo sapiens
agccgcagcctccctctg

SEQ ID NO: 1605288 - DNA, 17 bp, Homo sapiens
agccgcatcttctccat

SEQ ID NO: 1605289 - DNA, 17 bp, Homo sapiens
agccgccattgccacca

SEQ ID NO: 1605290 - DNA, 19 bp, Homo sapiens
agccgccattgccaccagg

SEQ ID NO: 1605291 - DNA, 20 bp, Homo sapiens
agccgccattgccaccagga

SEQ ID NO: 1605292 - DNA, 14 bp, Homo sapiens
agccgcccacttcc

SEQ ID NO: 1605293 - DNA, 18 bp, Homo sapiens
agccgcccacttcccgtt

SEQ ID NO: 1605294 - DNA, 12 bp, Homo sapiens
agccgccctgag

SEQ ID NO: 1605295 - DNA, 15 bp, Homo sapiens
agccgctaggagaga

SEQ ID NO: 1605296 - DNA, 22 bp, Homo sapiens
agccgctgcagggctcccatgg

SEQ ID NO: 1605297 - DNA, 15 bp, Homo sapiens
agccggacagctgcc

SEQ ID NO: 1605298 - DNA, 14 bp, Homo sapiens
agccggcacagggt

SEQ ID NO: 1605299 - DNA, 18 bp, Homo sapiens
agccggcctctctggcct

SEQ ID NO: 1605300 - DNA, 23 bp, Homo sapiens
agccggcctctctggcctcccac

SEQ ID NO: 1605301 - DNA, 14 bp, Homo sapiens
agccggcggcctct

SEQ ID NO: 1605302 - DNA, 14 bp, Homo sapiens
agccgggcatggtg

SEQ ID NO: 1605303 - DNA, 18 bp, Homo sapiens
agccgggcccctgggctt

SEQ ID NO: 1605304 - DNA, 19 bp, Homo sapiens
agccggggtgtaacttcct

SEQ ID NO: 1605305 - DNA, 12 bp, Homo sapiens
agccggtgcctg

SEQ ID NO: 1605306 - DNA, 13 bp, Homo sapiens
agccggtgcctgg

SEQ ID NO: 1605307 - DNA, 14 bp, Homo sapiens
agccggtggtgccc

SEQ ID NO: 1605308 - DNA, 20 bp, Homo sapiens
agccgtagggtggcactggg

SEQ ID NO: 1605309 - DNA, 23 bp, Homo sapiens
agccgtagggtggcactgggagg

SEQ ID NO: 1605310 - DNA, 14 bp, Homo sapiens
agccgtcacccctg

SEQ ID NO: 1605311 - DNA, 19 bp, Homo sapiens
agccgtcagccaaatgtaa

SEQ ID NO: 1605312 - DNA, 16 bp, Homo sapiens
agccgtccatggcacc

SEQ ID NO: 1605313 - DNA, 21 bp, Homo sapiens
agccgtccatggcaccagccc

SEQ ID NO: 1605314 - DNA, 14 bp, Homo sapiens
agccgtcccaggcc

SEQ ID NO: 1605315 - DNA, 15 bp, Homo sapiens
agccgtcccaggcca

SEQ ID NO: 1605316 - DNA, 16 bp, Homo sapiens
agccgtcccaggccac

SEQ ID NO: 1605317 - DNA, 22 bp, Homo sapiens
agccgtctgactccagagtctg

SEQ ID NO: 1605318 - DNA, 24 bp, Homo sapiens
agccgtctgactccagagtctgag

SEQ ID NO: 1605319 - DNA, 14 bp, Homo sapiens
agccgtgagtgcag

SEQ ID NO: 1605320 - DNA, 21 bp, Homo sapiens
agccgtggcttcccgctcagc

SEQ ID NO: 1605321 - DNA, 23 bp, Homo sapiens
agccgtggcttcccgctcagccc

SEQ ID NO: 1605322 - DNA, 15 bp, Homo sapiens
agccgtggtccctga

SEQ ID NO: 1605323 - DNA, 21 bp, Homo sapiens
agcctaaaacgaatggtcttt

SEQ ID NO: 1605324 - DNA, 14 bp, Homo sapiens
agcctaaagggcag

SEQ ID NO: 1605325 - DNA, 17 bp, Homo sapiens
agcctaaagggcagggc

SEQ ID NO: 1605326 - DNA, 13 bp, Homo sapiens
agcctaaatgatg

SEQ ID NO: 1605327 - DNA, 13 bp, Homo sapiens
agcctaaatttgt

SEQ ID NO: 1605328 - DNA, 16 bp, Homo sapiens
agcctaagaagctctg

SEQ ID NO: 1605329 - DNA, 18 bp, Homo sapiens
agcctaagatatacttgt

SEQ ID NO: 1605330 - DNA, 19 bp, Homo sapiens
agcctaagcggctgtttac

SEQ ID NO: 1605331 - DNA, 18 bp, Homo sapiens
agcctaaggctcctgttt

SEQ ID NO: 1605332 - DNA, 19 bp, Homo sapiens
agcctaaggctcctgtttt

SEQ ID NO: 1605333 - DNA, 21 bp, Homo sapiens
agcctaagggatcctgcctgc

SEQ ID NO: 1605334 - DNA, 14 bp, Homo sapiens
agcctaatgaaagg

SEQ ID NO: 1605335 - DNA, 16 bp, Homo sapiens
agcctacaaagagatg

SEQ ID NO: 1605336 - DNA, 20 bp, Homo sapiens
agcctacccgactctattta

SEQ ID NO: 1605337 - DNA, 20 bp, Homo sapiens
agcctaccgctggccctgcc

SEQ ID NO: 1605338 - DNA, 13 bp, Homo sapiens
agcctagccacct

SEQ ID NO: 1605339 - DNA, 14 bp, Homo sapiens
agcctagccacctc

SEQ ID NO: 1605340 - DNA, 13 bp, Homo sapiens
agcctagccctgg

SEQ ID NO: 1605341 - DNA, 16 bp, Homo sapiens
agcctagccctgggac

SEQ ID NO: 1605342 - DNA, 20 bp, Homo sapiens
agcctagccgacctcagcct

SEQ ID NO: 1605343 - DNA, 18 bp, Homo sapiens
agcctagcggagcccagc

SEQ ID NO: 1605344 - DNA, 21 bp, Homo sapiens
agcctagcggagcccagcctg

SEQ ID NO: 1605345 - DNA, 23 bp, Homo sapiens
agcctagcggagcccagcctggg

SEQ ID NO: 1605346 - DNA, 12 bp, Homo sapiens
agcctagctcct

SEQ ID NO: 1605347 - DNA, 17 bp, Homo sapiens
agcctagctcctgccac

SEQ ID NO: 1605348 - DNA, 17 bp, Homo sapiens
agcctagttcatccaat

SEQ ID NO: 1605349 - DNA, 23 bp, Homo sapiens
agcctagttcatccaatcctcac

SEQ ID NO: 1605350 - DNA, 23 bp, Homo sapiens
agcctcaaggttttaggttctaa

SEQ ID NO: 1605351 - DNA, 15 bp, Homo sapiens
agcctcacagaagaa

SEQ ID NO: 1605352 - DNA, 21 bp, Homo sapiens
agcctcacgtatttcacagag

SEQ ID NO: 1605353 - DNA, 22 bp, Homo sapiens
agcctcacgtatttcacagagc

SEQ ID NO: 1605354 - DNA, 16 bp, Homo sapiens
agcctcacttgaatgt

SEQ ID NO: 1605355 - DNA, 17 bp, Homo sapiens
agcctcacttgaatgtg

SEQ ID NO: 1605356 - DNA, 17 bp, Homo sapiens
agcctcagaaggcccca

SEQ ID NO: 1605357 - DNA, 22 bp, Homo sapiens
agcctcagaaggccccagagag

SEQ ID NO: 1605358 - DNA, 16 bp, Homo sapiens
agcctcagctgtacga

SEQ ID NO: 1605359 - DNA, 14 bp, Homo sapiens
agcctcagtgccac

SEQ ID NO: 1605360 - DNA, 14 bp, Homo sapiens
agcctcatgttctg

SEQ ID NO: 1605361 - DNA, 19 bp, Homo sapiens
agcctccacaccagctgct

SEQ ID NO: 1605362 - DNA, 22 bp, Homo sapiens
agcctccacaccagctgctgct

SEQ ID NO: 1605363 - DNA, 14 bp, Homo sapiens
agcctccacagcga

SEQ ID NO: 1605364 - DNA, 21 bp, Homo sapiens
agcctccacagcgagggcagc

SEQ ID NO: 1605365 - DNA, 22 bp, Homo sapiens
agcctccacagcgagggcagct

SEQ ID NO: 1605366 - DNA, 23 bp, Homo sapiens
agcctccacagcgagggcagctg

SEQ ID NO: 1605367 - DNA, 12 bp, Homo sapiens
agcctccagagc

SEQ ID NO: 1605368 - DNA, 22 bp, Homo sapiens
agcctccagggcattgctcagc

SEQ ID NO: 1605369 - DNA, 17 bp, Homo sapiens
agcctccatttagttct

SEQ ID NO: 1605370 - DNA, 14 bp, Homo sapiens
agcctcccaaagtg

SEQ ID NO: 1605371 - DNA, 12 bp, Homo sapiens
agcctcccccaa

SEQ ID NO: 1605372 - DNA, 19 bp, Homo sapiens
agcctcccccgccagcccc

SEQ ID NO: 1605373 - DNA, 13 bp, Homo sapiens
agcctccctctga

SEQ ID NO: 1605374 - DNA, 15 bp, Homo sapiens
agcctccctctgacc

SEQ ID NO: 1605375 - DNA, 11 bp, Homo sapiens
agcctccctga

SEQ ID NO: 1605376 - DNA, 12 bp, Homo sapiens
agcctccctgaa

SEQ ID NO: 1605377 - DNA, 16 bp, Homo sapiens
agcctccctgaagcct

SEQ ID NO: 1605378 - DNA, 16 bp, Homo sapiens
agcctccctgtctcca

SEQ ID NO: 1605379 - DNA, 21 bp, Homo sapiens
agcctccctgtctccagctgc

SEQ ID NO: 1605380 - DNA, 17 bp, Homo sapiens
agcctccgagagggaga

SEQ ID NO: 1605381 - DNA, 13 bp, Homo sapiens
agcctccggaagc

SEQ ID NO: 1605382 - DNA, 15 bp, Homo sapiens
agcctccggaagctg

SEQ ID NO: 1605383 - DNA, 20 bp, Homo sapiens
agcctccgtttatgggcctt

SEQ ID NO: 1605384 - DNA, 21 bp, Homo sapiens
agcctccgtttatgggccttg

SEQ ID NO: 1605385 - DNA, 13 bp, Homo sapiens
agcctcctcctga

SEQ ID NO: 1605386 - DNA, 19 bp, Homo sapiens
agcctcctcctgaccacgg

SEQ ID NO: 1605387 - DNA, 18 bp, Homo sapiens
agcctcctctggacggca

SEQ ID NO: 1605388 - DNA, 16 bp, Homo sapiens
agcctcgcacaggccc

SEQ ID NO: 1605389 - DNA, 17 bp, Homo sapiens
agcctcgcacaggccct

SEQ ID NO: 1605390 - DNA, 21 bp, Homo sapiens
agcctcgttggaagaggaaca

SEQ ID NO: 1605391 - DNA, 17 bp, Homo sapiens
agcctcgttttgatgcc

SEQ ID NO: 1605392 - DNA, 23 bp, Homo sapiens
agcctctacagccgtcccgcgtt

SEQ ID NO: 1605393 - DNA, 14 bp, Homo sapiens
agcctctcccaccc

SEQ ID NO: 1605394 - DNA, 15 bp, Homo sapiens
agcctctcccacccg

SEQ ID NO: 1605395 - DNA, 22 bp, Homo sapiens
agcctctcccggctgcctgccg

SEQ ID NO: 1605396 - DNA, 18 bp, Homo sapiens
agcctctccgactctgca

SEQ ID NO: 1605397 - DNA, 23 bp, Homo sapiens
agcctctctccttggccacagac

SEQ ID NO: 1605398 - DNA, 15 bp, Homo sapiens
agcacagtgcctgca

SEQ ID NO: 1605399 - DNA, 18 bp, Homo sapiens
agcacatactacctagaa

SEQ ID NO: 1605400 - DNA, 19 bp, Homo sapiens
agcacatactgtgttccaa

SEQ ID NO: 1605401 - DNA, 14 bp, Homo sapiens
agcacatcacctct

SEQ ID NO: 1605402 - DNA, 15 bp, Homo sapiens
agcacatctgcattt

SEQ ID NO: 1605403 - DNA, 23 bp, Homo sapiens
agcacatgcgtatatgtgcgtct

SEQ ID NO: 1605404 - DNA, 20 bp, Homo sapiens
agcacatggccatagaggcc

SEQ ID NO: 1605405 - DNA, 21 bp, Homo sapiens
agcacatggccatagaggccc

SEQ ID NO: 1605406 - DNA, 15 bp, Homo sapiens
agcacatggtttaaa

SEQ ID NO: 1605407 - DNA, 22 bp, Homo sapiens
agcacatggtttaaatatgaat

SEQ ID NO: 1605408 - DNA, 15 bp, Homo sapiens
agcaccaaccacagc

SEQ ID NO: 1605409 - DNA, 23 bp, Homo sapiens
agcaccaagagcagctgggaact

SEQ ID NO: 1605410 - DNA, 14 bp, Homo sapiens
agcaccacactggg

SEQ ID NO: 1605411 - DNA, 23 bp, Homo sapiens
agcaccaccctagtcccttcccc

SEQ ID NO: 1605412 - DNA, 21 bp, Homo sapiens
agcaccacctacacaggagtc

SEQ ID NO: 1605413 - DNA, 14 bp, Homo sapiens
agcaccaggcacga

SEQ ID NO: 1605414 - DNA, 23 bp, Homo sapiens
agcaccaggcacgaacccacctg

SEQ ID NO: 1605415 - DNA, 14 bp, Homo sapiens
agcacccagagcac

SEQ ID NO: 1605416 - DNA, 16 bp, Homo sapiens
agcaccctaggcagcc

SEQ ID NO: 1605417 - DNA, 14 bp, Homo sapiens
agcaccctgcagag

SEQ ID NO: 1605418 - DNA, 17 bp, Homo sapiens
agcaccctgggtgccat

SEQ ID NO: 1605419 - DNA, 17 bp, Homo sapiens
agcaccgggggagaggg

SEQ ID NO: 1605420 - DNA, 21 bp, Homo sapiens
agcacctcacctgagacctcc

SEQ ID NO: 1605421 - DNA, 16 bp, Homo sapiens
agcacctccagcctga

SEQ ID NO: 1605422 - DNA, 20 bp, Homo sapiens
agcacctccagcctgaacag

SEQ ID NO: 1605423 - DNA, 22 bp, Homo sapiens
agcacctcccagcccctgcccc

SEQ ID NO: 1605424 - DNA, 13 bp, Homo sapiens
agcacctgaaccc

SEQ ID NO: 1605425 - DNA, 15 bp, Homo sapiens
agcacctgaacccca

SEQ ID NO: 1605426 - DNA, 11 bp, Homo sapiens
agcacctgccg

SEQ ID NO: 1605427 - DNA, 15 bp, Homo sapiens
agcacctgccgacct

SEQ ID NO: 1605428 - DNA, 15 bp, Homo sapiens
agcacctgctcccag

SEQ ID NO: 1605429 - DNA, 21 bp, Homo sapiens
agcacctggaggggcaccagg

SEQ ID NO: 1605430 - DNA, 17 bp, Homo sapiens
agcaccttggcccagga

SEQ ID NO: 1605431 - DNA, 24 bp, Homo sapiens
agcaccttggcccaggagctctgc

SEQ ID NO: 1605432 - DNA, 15 bp, Homo sapiens
agcaccttgtgcctg

SEQ ID NO: 1605433 - DNA, 17 bp, Homo sapiens
agcacgaaatgttattt

SEQ ID NO: 1605434 - DNA, 20 bp, Homo sapiens
agcacgcctgccatcttctc

SEQ ID NO: 1605435 - DNA, 13 bp, Homo sapiens
agcacgcctggct

SEQ ID NO: 1605436 - DNA, 23 bp, Homo sapiens
agcactaaagcagtggacaccag

SEQ ID NO: 1605437 - DNA, 19 bp, Homo sapiens
agcactaaccaatgccttt

SEQ ID NO: 1605438 - DNA, 18 bp, Homo sapiens
agcactacaccttgcctt

SEQ ID NO: 1605439 - DNA, 17 bp, Homo sapiens
agcactactctgtgcca

SEQ ID NO: 1605440 - DNA, 19 bp, Homo sapiens
agcactagaaattgggcag

SEQ ID NO: 1605441 - DNA, 18 bp, Homo sapiens
agcactagtaaaggagga

SEQ ID NO: 1605442 - DNA, 22 bp, Homo sapiens
agcactagtttgattattatgt

SEQ ID NO: 1605443 - DNA, 18 bp, Homo sapiens
agcactccccagagctgt

SEQ ID NO: 1605444 - DNA, 20 bp, Homo sapiens
agcactcctgcttaatcttc

SEQ ID NO: 1605445 - DNA, 22 bp, Homo sapiens
agcactcgagaccatcctggcc

SEQ ID NO: 1605446 - DNA, 14 bp, Homo sapiens
agcactcgtgtgca

SEQ ID NO: 1605447 - DNA, 22 bp, Homo sapiens
agcactgaaaataccatcaggc

SEQ ID NO: 1605448 - DNA, 18 bp, Homo sapiens
agcactgacagatttcca

SEQ ID NO: 1605449 - DNA, 22 bp, Homo sapiens
agcactgacctgtcatgccccc

SEQ ID NO: 1605450 - DNA, 16 bp, Homo sapiens
agcactgacttctaag

SEQ ID NO: 1605451 - DNA, 11 bp, Homo sapiens
agcactgagca

SEQ ID NO: 1605452 - DNA, 14 bp, Homo sapiens
agcactgaggaaga

SEQ ID NO: 1605453 - DNA, 13 bp, Homo sapiens
agcactgatttca

SEQ ID NO: 1605454 - DNA, 19 bp, Homo sapiens
agcactggaggggcccacc

SEQ ID NO: 1605455 - DNA, 23 bp, Homo sapiens
agcactggaggggcccacccaca

SEQ ID NO: 1605456 - DNA, 17 bp, Homo sapiens
agcactggagtgcaggg

SEQ ID NO: 1605457 - DNA, 22 bp, Homo sapiens
agcactggggtgggggtggaat

SEQ ID NO: 1605458 - DNA, 15 bp, Homo sapiens
agcactgtcccttgc

SEQ ID NO: 1605459 - DNA, 14 bp, Homo sapiens
agcactgtctcagt

SEQ ID NO: 1605460 - DNA, 20 bp, Homo sapiens
agcactgtctcagtttcact

SEQ ID NO: 1605461 - DNA, 15 bp, Homo sapiens
agcactgttcacatc

SEQ ID NO: 1605462 - DNA, 16 bp, Homo sapiens
agcacttcccaggatc

SEQ ID NO: 1605463 - DNA, 23 bp, Homo sapiens
agcacttcccaggatctgctcca

SEQ ID NO: 1605464 - DNA, 20 bp, Homo sapiens
agcacttgcgtcctgcagag

SEQ ID NO: 1605465 - DNA, 17 bp, Homo sapiens
agcactttgggaggcag

SEQ ID NO: 1605466 - DNA, 19 bp, Homo sapiens
agcactttgggaggcaggg

SEQ ID NO: 1605467 - DNA, 16 bp, Homo sapiens
agcactttgggaggct

SEQ ID NO: 1605468 - DNA, 18 bp, Homo sapiens
agcacttttaaaaaaatt

SEQ ID NO: 1605469 - DNA, 23 bp, Homo sapiens
agcagaaaaaaaagtgtctcaaa

SEQ ID NO: 1605470 - DNA, 21 bp, Homo sapiens
agcagaaaacccttgggccag

SEQ ID NO: 1605471 - DNA, 18 bp, Homo sapiens
agcagaaagaagagaagt

SEQ ID NO: 1605472 - DNA, 13 bp, Homo sapiens
agcagaacaaatg

SEQ ID NO: 1605473 - DNA, 21 bp, Homo sapiens
agcagaacaaatgtgtttttc

SEQ ID NO: 1605474 - DNA, 15 bp, Homo sapiens
agcagaacaggtagt

SEQ ID NO: 1605475 - DNA, 19 bp, Homo sapiens
agcagaacctgcacacagg

SEQ ID NO: 1605476 - DNA, 22 bp, Homo sapiens
agcagaacctgcacacaggaca

SEQ ID NO: 1605477 - DNA, 24 bp, Homo sapiens
agcagaacctgcacacaggacagc

SEQ ID NO: 1605478 - DNA, 11 bp, Homo sapiens
agcagaaggag

SEQ ID NO: 1605479 - DNA, 12 bp, Homo sapiens
agcagaaggggg

SEQ ID NO: 1605480 - DNA, 16 bp, Homo sapiens
agcagaagggggtggt

SEQ ID NO: 1605481 - DNA, 16 bp, Homo sapiens
agcagaatggaggcag

SEQ ID NO: 1605482 - DNA, 20 bp, Homo sapiens
agcagaatgttgtacttgaa

SEQ ID NO: 1605483 - DNA, 13 bp, Homo sapiens
agcagaattttaa

SEQ ID NO: 1605484 - DNA, 17 bp, Homo sapiens
agcagaattttaatgtg

SEQ ID NO: 1605485 - DNA, 16 bp, Homo sapiens
agcagacagagccagg

SEQ ID NO: 1605486 - DNA, 19 bp, Homo sapiens
agcagacagagccaggaga

SEQ ID NO: 1605487 - DNA, 16 bp, Homo sapiens
agcagactcagctgct

SEQ ID NO: 1605488 - DNA, 17 bp, Homo sapiens
agcagactcagctgcta

SEQ ID NO: 1605489 - DNA, 15 bp, Homo sapiens
agcagagagagagga

SEQ ID NO: 1605490 - DNA, 22 bp, Homo sapiens
agcagagagagaggacagaggg

SEQ ID NO: 1605491 - DNA, 19 bp, Homo sapiens
agcagagagccaaatctga

SEQ ID NO: 1605492 - DNA, 17 bp, Homo sapiens
agcagagatgtactgca

SEQ ID NO: 1605493 - DNA, 18 bp, Homo sapiens
agcagagcaaaatgctct

SEQ ID NO: 1605494 - DNA, 22 bp, Homo sapiens
agcagagcaaaatgctcttgtc

SEQ ID NO: 1605495 - DNA, 17 bp, Homo sapiens
agcagagcaaatgaggg

SEQ ID NO: 1605496 - DNA, 18 bp, Homo sapiens
agcagagcaaatgaggga

SEQ ID NO: 1605497 - DNA, 12 bp, Homo sapiens
agcagagcggga

SEQ ID NO: 1605498 - DNA, 21 bp, Homo sapiens
agcagaggacagtctggagaa

SEQ ID NO: 1605499 - DNA, 22 bp, Homo sapiens
agcagaggacagtctggagaag

SEQ ID NO: 1605500 - DNA, 18 bp, Homo sapiens
agcagagggactttgtat

SEQ ID NO: 1605501 - DNA, 15 bp, Homo sapiens
agcagagggaggaag

SEQ ID NO: 1605502 - DNA, 16 bp, Homo sapiens
agcagagggcaggggt

SEQ ID NO: 1605503 - DNA, 16 bp, Homo sapiens
agcagagtgcacagct

SEQ ID NO: 1605504 - DNA, 17 bp, Homo sapiens
agcagagtgcacagctg

SEQ ID NO: 1605505 - DNA, 18 bp, Homo sapiens
agcagagtgcacagctgt

SEQ ID NO: 1605506 - DNA, 16 bp, Homo sapiens
agcagagtggactgca

SEQ ID NO: 1605507 - DNA, 18 bp, Homo sapiens
agcagagttaaatctcaa

SEQ ID NO: 1605508 - DNA, 23 bp, Homo sapiens
agcagagttttcattaaatcctt

SEQ ID NO: 1605509 - DNA, 21 bp, Homo sapiens
agcagatggaatgctgtgtta

SEQ ID NO: 1605510 - DNA, 21 bp, Homo sapiens
agcagattttaattttgaata

SEQ ID NO: 1605511 - DNA, 15 bp, Homo sapiens
agcagcaaattttca

SEQ ID NO: 1605512 - DNA, 14 bp, Homo sapiens
agcagcagccagca

SEQ ID NO: 1605513 - DNA, 16 bp, Homo sapiens
agcagcagccagcacc

SEQ ID NO: 1605514 - DNA, 12 bp, Homo sapiens
agcagcagctca

SEQ ID NO: 1605515 - DNA, 13 bp, Homo sapiens
agcagcaggtgat

SEQ ID NO: 1605516 - DNA, 21 bp, Homo sapiens
agcagcaggtgctgtgcgcct

SEQ ID NO: 1605517 - DNA, 20 bp, Homo sapiens
agcagcatagaacaggacct

SEQ ID NO: 1605518 - DNA, 14 bp, Homo sapiens
agcagcatcttctg

SEQ ID NO: 1605519 - DNA, 17 bp, Homo sapiens
agcagcatggaaaaatg

SEQ ID NO: 1605520 - DNA, 20 bp, Homo sapiens
agcagcatggaaaaatggtt

SEQ ID NO: 1605521 - DNA, 21 bp, Homo sapiens
agcagcatggaaaaatggttg

SEQ ID NO: 1605522 - DNA, 18 bp, Homo sapiens
agcagccagagctgtgcc

SEQ ID NO: 1605523 - DNA, 19 bp, Homo sapiens
agcagccagagctgtgcct

SEQ ID NO: 1605524 - DNA, 12 bp, Homo sapiens
agcagccagcac

SEQ ID NO: 1605525 - DNA, 22 bp, Homo sapiens
agcagccagcaccacctacaca

SEQ ID NO: 1605526 - DNA, 12 bp, Homo sapiens
agcagccagcca

SEQ ID NO: 1605527 - DNA, 12 bp, Homo sapiens
agcagccagctc

SEQ ID NO: 1605528 - DNA, 21 bp, Homo sapiens
agcagtgggcaggtggccgcc

SEQ ID NO: 1605529 - DNA, 13 bp, Homo sapiens
agcagtgtcatca

SEQ ID NO: 1605530 - DNA, 13 bp, Homo sapiens
agcagtgtcccct

SEQ ID NO: 1605531 - DNA, 15 bp, Homo sapiens
agcagtgtcccctgc

SEQ ID NO: 1605532 - DNA, 16 bp, Homo sapiens
agcagtgtcccctgcc

SEQ ID NO: 1605533 - DNA, 20 bp, Homo sapiens
agcaaatcagaaacttgtga

SEQ ID NO: 1605534 - DNA, 22 bp, Homo sapiens
agcaaatcatttgtttaaaaag

SEQ ID NO: 1605535 - DNA, 16 bp, Homo sapiens
agcaaatgacagattt

SEQ ID NO: 1605536 - DNA, 12 bp, Homo sapiens
agcaaatgcaaa

SEQ ID NO: 1605537 - DNA, 17 bp, Homo sapiens
agcaaatgttatgcata

SEQ ID NO: 1605538 - DNA, 17 bp, Homo sapiens
agcaaattagttggttt

SEQ ID NO: 1605539 - DNA, 19 bp, Homo sapiens
agcaaattgctagtcaggg

SEQ ID NO: 1605540 - DNA, 13 bp, Homo sapiens
agcaacaaagagc

SEQ ID NO: 1605541 - DNA, 22 bp, Homo sapiens
agcaacaataatgattttcttg

SEQ ID NO: 1605542 - DNA, 13 bp, Homo sapiens
agcaacacagcct

SEQ ID NO: 1605543 - DNA, 17 bp, Homo sapiens
agcaacacagcctgggc

SEQ ID NO: 1605544 - DNA, 18 bp, Homo sapiens
agcaacacagcctgggcc

SEQ ID NO: 1605545 - DNA, 23 bp, Homo sapiens
agcaacagagtgagaccctgtct

SEQ ID NO: 1605546 - DNA, 19 bp, Homo sapiens
agcaacaggaatctcagag

SEQ ID NO: 1605547 - DNA, 22 bp, Homo sapiens
agcaacaggaatctcagagaca

SEQ ID NO: 1605548 - DNA, 19 bp, Homo sapiens
agcaacccctgtacccagc

SEQ ID NO: 1605549 - DNA, 19 bp, Homo sapiens
agcaacctactgtctaagc

SEQ ID NO: 1605550 - DNA, 19 bp, Homo sapiens
agcaacctgggcatcttag

SEQ ID NO: 1605551 - DNA, 15 bp, Homo sapiens
agcaacgcccctcca

SEQ ID NO: 1605552 - DNA, 16 bp, Homo sapiens
agcaacgcccctccaa

SEQ ID NO: 1605553 - DNA, 19 bp, Homo sapiens
agcaacgcccctccaaacc

SEQ ID NO: 1605554 - DNA, 16 bp, Homo sapiens
agcaactaggccttca

SEQ ID NO: 1605555 - DNA, 16 bp, Homo sapiens
agcaactgaggtaacc

SEQ ID NO: 1605556 - DNA, 15 bp, Homo sapiens
agcaacttcttctcc

SEQ ID NO: 1605557 - DNA, 16 bp, Homo sapiens
agcaacttcttctcca

SEQ ID NO: 1605558 - DNA, 15 bp, Homo sapiens
agcaacttgtctttt

SEQ ID NO: 1605559 - DNA, 20 bp, Homo sapiens
agcaacttgtctttttctgg

SEQ ID NO: 1605560 - DNA, 20 bp, Homo sapiens
agcaacttttgtgtaatgaa

SEQ ID NO: 1605561 - DNA, 16 bp, Homo sapiens
agcaagaaacagtttc

SEQ ID NO: 1605562 - DNA, 21 bp, Homo sapiens
agcaagaataaaaaagaaatc

SEQ ID NO: 1605563 - DNA, 21 bp, Homo sapiens
agcaagaatgcagtacagaat

SEQ ID NO: 1605564 - DNA, 17 bp, Homo sapiens
agcaagacacgtggcct

SEQ ID NO: 1605565 - DNA, 21 bp, Homo sapiens
agcaagaccctaaacatccat

SEQ ID NO: 1605566 - DNA, 19 bp, Homo sapiens
agcaagacctcatctgtgg

SEQ ID NO: 1605567 - DNA, 12 bp, Homo sapiens
agcaagactctg

SEQ ID NO: 1605568 - DNA, 22 bp, Homo sapiens
agcaagaggcaagctgaaattt

SEQ ID NO: 1605569 - DNA, 17 bp, Homo sapiens
agcaagagtaagcagtg

SEQ ID NO: 1605570 - DNA, 18 bp, Homo sapiens
agcaagagtaagcagtgt

SEQ ID NO: 1605571 - DNA, 17 bp, Homo sapiens
agcaagatcttgtctcc

SEQ ID NO: 1605572 - DNA, 12 bp, Homo sapiens
agcaagatgttt

SEQ ID NO: 1605573 - DNA, 15 bp, Homo sapiens
agcaagcatctccgc

SEQ ID NO: 1605574 - DNA, 15 bp, Homo sapiens
agcaagcgggagccc

SEQ ID NO: 1605575 - DNA, 15 bp, Homo sapiens
agcaaggcacagcct

SEQ ID NO: 1605576 - DNA, 20 bp, Homo sapiens
agcaagggagaaaagagaaa

SEQ ID NO: 1605577 - DNA, 21 bp, Homo sapiens
agcaagggagaaaagagaaac

SEQ ID NO: 1605578 - DNA, 20 bp, Homo sapiens
agcaagggctccagcatcca

SEQ ID NO: 1605579 - DNA, 17 bp, Homo sapiens
agcaaggggaccccgag

SEQ ID NO: 1605580 - DNA, 15 bp, Homo sapiens
agcaaggggctctgc

SEQ ID NO: 1605581 - DNA, 14 bp, Homo sapiens
agcaagggggccca

SEQ ID NO: 1605582 - DNA, 22 bp, Homo sapiens
agcaagggtgatgggaaagcat

SEQ ID NO: 1605583 - DNA, 17 bp, Homo sapiens
agcaaggtggccacagt

SEQ ID NO: 1605584 - DNA, 19 bp, Homo sapiens
agcaaggtgtccctgcctt

SEQ ID NO: 1605585 - DNA, 15 bp, Homo sapiens
agcaagtgagcagag

SEQ ID NO: 1605586 - DNA, 14 bp, Homo sapiens
agcaagtgcccagt

SEQ ID NO: 1605587 - DNA, 15 bp, Homo sapiens
agcaataaatgcttt

SEQ ID NO: 1605588 - DNA, 19 bp, Homo sapiens
agcaataacattcccactg

SEQ ID NO: 1605589 - DNA, 21 bp, Homo sapiens
agcaataatggtcccatccag

SEQ ID NO: 1605590 - DNA, 23 bp, Homo sapiens
agcaataatggtcccatccaggc

SEQ ID NO: 1605591 - DNA, 13 bp, Homo sapiens
agcaataattgtt

SEQ ID NO: 1605592 - DNA, 17 bp, Homo sapiens
agcaatacgtttgtgca

SEQ ID NO: 1605593 - DNA, 21 bp, Homo sapiens
agcaatacgtttgtgcagaat

SEQ ID NO: 1605594 - DNA, 17 bp, Homo sapiens
agcaatccatgttagtt

SEQ ID NO: 1605595 - DNA, 18 bp, Homo sapiens
agcaatctcttcattatt

SEQ ID NO: 1605596 - DNA, 14 bp, Homo sapiens
agcaatctttgaaa

SEQ ID NO: 1605597 - DNA, 16 bp, Homo sapiens
agcaatctttgaaata

SEQ ID NO: 1605598 - DNA, 21 bp, Homo sapiens
agcaatgatgacccactaaag

SEQ ID NO: 1605599 - DNA, 20 bp, Homo sapiens
agcaatgatgtccagaagaa

SEQ ID NO: 1605600 - DNA, 17 bp, Homo sapiens
agcaatgcctgtgaaaa

SEQ ID NO: 1605601 - DNA, 21 bp, Homo sapiens
agcaatggacggtccgcagaa

SEQ ID NO: 1605602 - DNA, 13 bp, Homo sapiens
agcaatgtctgtg

SEQ ID NO: 1605603 - DNA, 15 bp, Homo sapiens
agcaatgtgagtccc

SEQ ID NO: 1605604 - DNA, 20 bp, Homo sapiens
agcaattccaggctgagcca

SEQ ID NO: 1605605 - DNA, 21 bp, Homo sapiens
agcaattccaggctgagccat

SEQ ID NO: 1605606 - DNA, 23 bp, Homo sapiens
agcaattccaggctgagccatga

SEQ ID NO: 1605607 - DNA, 24 bp, Homo sapiens
agcaattccaggctgagccatgag

SEQ ID NO: 1605608 - DNA, 23 bp, Homo sapiens
agcaattccatgctataaaaact

SEQ ID NO: 1605609 - DNA, 15 bp, Homo sapiens
agcaattgccctgta

SEQ ID NO: 1605610 - DNA, 13 bp, Homo sapiens
agcaattggcagc

SEQ ID NO: 1605611 - DNA, 20 bp, Homo sapiens
agcaatttatacaatatcat

SEQ ID NO: 1605612 - DNA, 20 bp, Homo sapiens
agcaattttctttgtttctt

SEQ ID NO: 1605613 - DNA, 22 bp, Homo sapiens
agcaattttctttgtttctttt

SEQ ID NO: 1605614 - DNA, 12 bp, Homo sapiens
agcacaaaattc

SEQ ID NO: 1605615 - DNA, 22 bp, Homo sapiens
agcacaaaattcaaagcatgga

SEQ ID NO: 1605616 - DNA, 16 bp, Homo sapiens
agcacaaagctcaaga

SEQ ID NO: 1605617 - DNA, 19 bp, Homo sapiens
agcacaagaggaagagaga

SEQ ID NO: 1605618 - DNA, 21 bp, Homo sapiens
agcacaaggccttgcctggcc

SEQ ID NO: 1605619 - DNA, 14 bp, Homo sapiens
agcacaagggcaca

SEQ ID NO: 1605620 - DNA, 19 bp, Homo sapiens
agcacacacaaacctactg

SEQ ID NO: 1605621 - DNA, 22 bp, Homo sapiens
agcacacacaaacctactgccc

SEQ ID NO: 1605622 - DNA, 23 bp, Homo sapiens
agcacacacaaacctactgccca

SEQ ID NO: 1605623 - DNA, 14 bp, Homo sapiens
agcacacacatctg

SEQ ID NO: 1605624 - DNA, 21 bp, Homo sapiens
agcacacacatctggccctga

SEQ ID NO: 1605625 - DNA, 20 bp, Homo sapiens
agcacacaggtacagcaaca

SEQ ID NO: 1605626 - DNA, 17 bp, Homo sapiens
agcacaccaagtggctg

SEQ ID NO: 1605627 - DNA, 13 bp, Homo sapiens
agcacacccgtgt

SEQ ID NO: 1605628 - DNA, 17 bp, Homo sapiens
agcacaccgggccaagt

SEQ ID NO: 1605629 - DNA, 18 bp, Homo sapiens
agcacacctcagccccac

SEQ ID NO: 1605630 - DNA, 11 bp, Homo sapiens
agcacacctgt

SEQ ID NO: 1605631 - DNA, 15 bp, Homo sapiens
agcacacctgtgtcc

SEQ ID NO: 1605632 - DNA, 18 bp, Homo sapiens
agcacacgagttccagac

SEQ ID NO: 1605633 - DNA, 14 bp, Homo sapiens
agcacactgtagca

SEQ ID NO: 1605634 - DNA, 21 bp, Homo sapiens
agcacactttacacaagaatc

SEQ ID NO: 1605635 - DNA, 19 bp, Homo sapiens
agcacagaaacagaggaga

SEQ ID NO: 1605636 - DNA, 14 bp, Homo sapiens
agcacagaatattt

SEQ ID NO: 1605637 - DNA, 23 bp, Homo sapiens
agcacagccagacttgcttcctg

SEQ ID NO: 1605638 - DNA, 13 bp, Homo sapiens
agcacagccctgg

SEQ ID NO: 1605639 - DNA, 17 bp, Homo sapiens
agcacagccctgggagg

SEQ ID NO: 1605640 - DNA, 12 bp, Homo sapiens
agcacagccctt

SEQ ID NO: 1605641 - DNA, 18 bp, Homo sapiens
agcacagctcctgccagg

SEQ ID NO: 1605642 - DNA, 17 bp, Homo sapiens
agcacaggaattctcaa

SEQ ID NO: 1605643 - DNA, 15 bp, Homo sapiens
agcacaggcagctgg

SEQ ID NO: 1605644 - DNA, 16 bp, Homo sapiens
agcacaggggccccag

SEQ ID NO: 1605645 - DNA, 19 bp, Homo sapiens
agcacaggggccccagatc

SEQ ID NO: 1605646 - DNA, 20 bp, Homo sapiens
agcacaggggccccagatct

SEQ ID NO: 1605647 - DNA, 20 bp, Homo sapiens
agcacagtaggtcccggcca

SEQ ID NO: 1605648 - DNA, 23 bp, Homo sapiens
agcacagtaggtcccggccagct

SEQ ID NO: 1605649 - DNA, 14 bp, Homo sapiens
agagcatgcacatg

SEQ ID NO: 1605650 - DNA, 17 bp, Homo sapiens
agagcattagctggcgc

SEQ ID NO: 1605651 - DNA, 20 bp, Homo sapiens
agagcatttccaacaccaca

SEQ ID NO: 1605652 - DNA, 15 bp, Homo sapiens
agagccaacctggac

SEQ ID NO: 1605653 - DNA, 22 bp, Homo sapiens
agagccaacctggacttcctgt

SEQ ID NO: 1605654 - DNA, 13 bp, Homo sapiens
agagccaagacgg

SEQ ID NO: 1605655 - DNA, 18 bp, Homo sapiens
agagccaagacggaggag

SEQ ID NO: 1605656 - DNA, 19 bp, Homo sapiens
agagccaagcactgctcac

SEQ ID NO: 1605657 - DNA, 20 bp, Homo sapiens
agagccaagcactgctcacg

SEQ ID NO: 1605658 - DNA, 21 bp, Homo sapiens
agagccaagcactgctcacgt

SEQ ID NO: 1605659 - DNA, 14 bp, Homo sapiens
agagccacctgcaa

SEQ ID NO: 1605660 - DNA, 18 bp, Homo sapiens
agagccacctgcaagatg

SEQ ID NO: 1605661 - DNA, 22 bp, Homo sapiens
agagccactttcaagctgcact

SEQ ID NO: 1605662 - DNA, 19 bp, Homo sapiens
agagccagatgcaggacag

SEQ ID NO: 1605663 - DNA, 20 bp, Homo sapiens
agagccagatgcaggacagg

SEQ ID NO: 1605664 - DNA, 12 bp, Homo sapiens
agagccagccct

SEQ ID NO: 1605665 - DNA, 20 bp, Homo sapiens
agagccagccctccctgtcc

SEQ ID NO: 1605666 - DNA, 21 bp, Homo sapiens
agagccagccctccctgtcct

SEQ ID NO: 1605667 - DNA, 22 bp, Homo sapiens
agagccagccctccctgtcctc

SEQ ID NO: 1605668 - DNA, 15 bp, Homo sapiens
agagccagcctggct

SEQ ID NO: 1605669 - DNA, 13 bp, Homo sapiens
agagccagctccc

SEQ ID NO: 1605670 - DNA, 11 bp, Homo sapiens
agagccagctt

SEQ ID NO: 1605671 - DNA, 12 bp, Homo sapiens
agagccagcttg

SEQ ID NO: 1605672 - DNA, 16 bp, Homo sapiens
agagccaggagaagct

SEQ ID NO: 1605673 - DNA, 22 bp, Homo sapiens
agagccaggagaagctcagctg

SEQ ID NO: 1605674 - DNA, 22 bp, Homo sapiens
agagccaggatgcccagatgaa

SEQ ID NO: 1605675 - DNA, 22 bp, Homo sapiens
agagccaggggggtgaggagct

SEQ ID NO: 1605676 - DNA, 23 bp, Homo sapiens
agagccaggggggtgaggagctg

SEQ ID NO: 1605677 - DNA, 23 bp, Homo sapiens
agagccatgggcctgggcctgct

SEQ ID NO: 1605678 - DNA, 21 bp, Homo sapiens
agagcccagcagggcctcaaa

SEQ ID NO: 1605679 - DNA, 14 bp, Homo sapiens
agagcccagccatt

SEQ ID NO: 1605680 - DNA, 16 bp, Homo sapiens
agagcccagcccagga

SEQ ID NO: 1605681 - DNA, 17 bp, Homo sapiens
agagcccagcccaggag

SEQ ID NO: 1605682 - DNA, 14 bp, Homo sapiens
agagcccagctcca

SEQ ID NO: 1605683 - DNA, 14 bp, Homo sapiens
agagcccatgctca

SEQ ID NO: 1605684 - DNA, 14 bp, Homo sapiens
agagccccatggtg

SEQ ID NO: 1605685 - DNA, 16 bp, Homo sapiens
agagcccccagccctg

SEQ ID NO: 1605686 - DNA, 16 bp, Homo sapiens
agagcccgcgtgctgg

SEQ ID NO: 1605687 - DNA, 17 bp, Homo sapiens
agagcccgcgtgctgga

SEQ ID NO: 1605688 - DNA, 19 bp, Homo sapiens
agagcccgcgtgctggaga

SEQ ID NO: 1605689 - DNA, 17 bp, Homo sapiens
agagcccgtcgcgctgg

SEQ ID NO: 1605690 - DNA, 20 bp, Homo sapiens
agagcccgtcgcgctggaca

SEQ ID NO: 1605691 - DNA, 16 bp, Homo sapiens
agagccctccaggcct

SEQ ID NO: 1605692 - DNA, 18 bp, Homo sapiens
agagccctccaggcctgc

SEQ ID NO: 1605693 - DNA, 19 bp, Homo sapiens
agagccctccaggcctgca

SEQ ID NO: 1605694 - DNA, 21 bp, Homo sapiens
agagccctccaggcctgcagg

SEQ ID NO: 1605695 - DNA, 14 bp, Homo sapiens
agagccctgaggcc

SEQ ID NO: 1605696 - DNA, 14 bp, Homo sapiens
agattgagaaatgt

SEQ ID NO: 1605697 - DNA, 19 bp, Homo sapiens
agattgagagaagagacaa

SEQ ID NO: 1605698 - DNA, 17 bp, Homo sapiens
agattgatatctataaa

SEQ ID NO: 1605699 - DNA, 19 bp, Homo sapiens
agattgatatctataaaat

SEQ ID NO: 1605700 - DNA, 20 bp, Homo sapiens
agattgatatctataaaata

SEQ ID NO: 1605701 - DNA, 14 bp, Homo sapiens
agattgattgtatt

SEQ ID NO: 1605702 - DNA, 15 bp, Homo sapiens
agattgattgtattg

SEQ ID NO: 1605703 - DNA, 16 bp, Homo sapiens
agattgcgccactgca

SEQ ID NO: 1605704 - DNA, 13 bp, Homo sapiens
agattgctgaaat

SEQ ID NO: 1605705 - DNA, 22 bp, Homo sapiens
agattgctgaaattttatatgc

SEQ ID NO: 1605706 - DNA, 19 bp, Homo sapiens
agattggctcacactgaga

SEQ ID NO: 1605707 - DNA, 22 bp, Homo sapiens
agattggctcacactgagaatg

SEQ ID NO: 1605708 - DNA, 21 bp, Homo sapiens
agattggtgggattttttgtt

SEQ ID NO: 1605709 - DNA, 23 bp, Homo sapiens
agattgtccggccgctttgtgat

SEQ ID NO: 1605710 - DNA, 13 bp, Homo sapiens
agattgtgtaaca

SEQ ID NO: 1605711 - DNA, 21 bp, Homo sapiens
agattgtgtaacaattttaat

SEQ ID NO: 1605712 - DNA, 21 bp, Homo sapiens
agattgtgtacatagagcaat

SEQ ID NO: 1605713 - DNA, 15 bp, Homo sapiens
agattgttaaaataa

SEQ ID NO: 1605714 - DNA, 21 bp, Homo sapiens
agattgttggtgaattttcaa

SEQ ID NO: 1605715 - DNA, 15 bp, Homo sapiens
agattgttgtttgcc

SEQ ID NO: 1605716 - DNA, 19 bp, Homo sapiens
agattgtttcctcttccaa

SEQ ID NO: 1605717 - DNA, 19 bp, Homo sapiens
agatttaaactctgaattt

SEQ ID NO: 1605718 - DNA, 20 bp, Homo sapiens
agatttaaactctgaattta

SEQ ID NO: 1605719 - DNA, 17 bp, Homo sapiens
agatttaagccttacaa

SEQ ID NO: 1605720 - DNA, 11 bp, Homo sapiens
agatttacatt

SEQ ID NO: 1605721 - DNA, 14 bp, Homo sapiens
agatttacattcca

SEQ ID NO: 1605722 - DNA, 22 bp, Homo sapiens
agatttaccttttctgttgtac

SEQ ID NO: 1605723 - DNA, 13 bp, Homo sapiens
agatttatcaaat

SEQ ID NO: 1605724 - DNA, 15 bp, Homo sapiens
agatttatcaaatca

SEQ ID NO: 1605725 - DNA, 17 bp, Homo sapiens
agatttatcaaatcagt

SEQ ID NO: 1605726 - DNA, 15 bp, Homo sapiens
agatttcatctgctc

SEQ ID NO: 1605727 - DNA, 19 bp, Homo sapiens
agatttcatctgctctcct

SEQ ID NO: 1605728 - DNA, 21 bp, Homo sapiens
agatttcatctgctctccttc

SEQ ID NO: 1605729 - DNA, 22 bp, Homo sapiens
agatttcctccatggtggaagg

SEQ ID NO: 1605730 - DNA, 17 bp, Homo sapiens
agatttccttaacctta

SEQ ID NO: 1605731 - DNA, 18 bp, Homo sapiens
agatttctcattgacttt

SEQ ID NO: 1605732 - DNA, 19 bp, Homo sapiens
agatttctggttgatttgt

SEQ ID NO: 1605733 - DNA, 17 bp, Homo sapiens
agatttgaactcttcaa

SEQ ID NO: 1605734 - DNA, 15 bp, Homo sapiens
agatttgccagcaca

SEQ ID NO: 1605735 - DNA, 22 bp, Homo sapiens
agatttggaataggaataagct

SEQ ID NO: 1605736 - DNA, 20 bp, Homo sapiens
agatttggggtataggtctc

SEQ ID NO: 1605737 - DNA, 12 bp, Homo sapiens
agatttgtcctt

SEQ ID NO: 1605738 - DNA, 13 bp, Homo sapiens
agatttgtccttt

SEQ ID NO: 1605739 - DNA, 17 bp, Homo sapiens
agatttgttactgtatt

SEQ ID NO: 1605740 - DNA, 18 bp, Homo sapiens
agatttgttactgtattt

SEQ ID NO: 1605741 - DNA, 16 bp, Homo sapiens
agatttgttgacagca

SEQ ID NO: 1605742 - DNA, 22 bp, Homo sapiens
agatttgttgacagcaaaatgt

SEQ ID NO: 1605743 - DNA, 18 bp, Homo sapiens
agatttgtttttgtagag

SEQ ID NO: 1605744 - DNA, 22 bp, Homo sapiens
agattttaaattcacaatagaa

SEQ ID NO: 1605745 - DNA, 17 bp, Homo sapiens
agattttaaattttatg

SEQ ID NO: 1605746 - DNA, 14 bp, Homo sapiens
agattttaattttg

SEQ ID NO: 1605747 - DNA, 17 bp, Homo sapiens
agattttaattttgaat

SEQ ID NO: 1605748 - DNA, 18 bp, Homo sapiens
agattttacaaaagatgt

SEQ ID NO: 1605749 - DNA, 13 bp, Homo sapiens
agattttattgta

SEQ ID NO: 1605750 - DNA, 23 bp, Homo sapiens
agattttccacaagattcccaga

SEQ ID NO: 1605751 - DNA, 22 bp, Homo sapiens
agattttcttttgccttttgca

SEQ ID NO: 1605752 - DNA, 21 bp, Homo sapiens
agattttgaaatttttattaa

SEQ ID NO: 1605753 - DNA, 13 bp, Homo sapiens
agattttgcattt

SEQ ID NO: 1605754 - DNA, 19 bp, Homo sapiens
agattttgtgtttattctt

SEQ ID NO: 1605755 - DNA, 16 bp, Homo sapiens
agatttttaacgaatg

SEQ ID NO: 1605756 - DNA, 18 bp, Homo sapiens
agatttttactaatatat

SEQ ID NO: 1605757 - DNA, 19 bp, Homo sapiens
agatttttactaatatata

SEQ ID NO: 1605758 - DNA, 13 bp, Homo sapiens
agatttttattta

SEQ ID NO: 1605759 - DNA, 19 bp, Homo sapiens
agatttttattttgaaaaa

SEQ ID NO: 1605760 - DNA, 13 bp, Homo sapiens
agcaaaaatctcc

SEQ ID NO: 1605761 - DNA, 21 bp, Homo sapiens
agcaaaaatctcccagtgaca

SEQ ID NO: 1605762 - DNA, 14 bp, Homo sapiens
agcaaaaatgacaa

SEQ ID NO: 1605763 - DNA, 20 bp, Homo sapiens
agcaaaaatgacaacagaaa

SEQ ID NO: 1605764 - DNA, 17 bp, Homo sapiens
agcaaaactccatctca

SEQ ID NO: 1605765 - DNA, 12 bp, Homo sapiens
agcaaaactccg

SEQ ID NO: 1605766 - DNA, 12 bp, Homo sapiens
agcaaaagaaaa

SEQ ID NO: 1605767 - DNA, 14 bp, Homo sapiens
agcaaaagaaaaag

SEQ ID NO: 1605768 - DNA, 11 bp, Homo sapiens
agcaaaagaga

SEQ ID NO: 1605769 - DNA, 12 bp, Homo sapiens
agcaaaagagaa

SEQ ID NO: 1605770 - DNA, 15 bp, Homo sapiens
agcaaaaggctgaga

SEQ ID NO: 1605771 - DNA, 21 bp, Homo sapiens
agcaaaataattttaaacaaa

SEQ ID NO: 1605772 - DNA, 13 bp, Homo sapiens
agcaaaatgttga

SEQ ID NO: 1605773 - DNA, 23 bp, Homo sapiens
agcaaaccatttttaaagtagaa

SEQ ID NO: 1605774 - DNA, 19 bp, Homo sapiens
agcaaacgtctattttgta

SEQ ID NO: 1605775 - DNA, 13 bp, Homo sapiens
agcaaactctttt

SEQ ID NO: 1605776 - DNA, 17 bp, Homo sapiens
agcaaagatcaaaataa

SEQ ID NO: 1605777 - DNA, 13 bp, Homo sapiens
agcaaagatgcat

SEQ ID NO: 1605778 - DNA, 16 bp, Homo sapiens
agcaaagcgcccaccc

SEQ ID NO: 1605779 - DNA, 23 bp, Homo sapiens
agcaaagctgatgacaacttccc

SEQ ID NO: 1605780 - DNA, 14 bp, Homo sapiens
agcaaagcttggtg

SEQ ID NO: 1605781 - DNA, 22 bp, Homo sapiens
agcaaagcttggtgtcttggca

SEQ ID NO: 1605782 - DNA, 15 bp, Homo sapiens
agcaaaggctccctc

SEQ ID NO: 1605783 - DNA, 17 bp, Homo sapiens
agcaaagtcacttctcc

SEQ ID NO: 1605784 - DNA, 24 bp, Homo sapiens
agcaaatataggtcctgtgttaaa

SEQ ID NO: 1605785 - DNA, 14 bp, Homo sapiens
agcaaatatgctgt

SEQ ID NO: 1605786 - DNA, 15 bp, Homo sapiens
agcaaatatgctgtt

SEQ ID NO: 1605787 - DNA, 16 bp, Homo sapiens
agcaaatcagaaactt

SEQ ID NO: 1605788 - DNA, 24 bp, Homo sapiens
agagacatctttgggcctgtccct

SEQ ID NO: 1605789 - DNA, 19 bp, Homo sapiens
agagacatgggcctcccac

SEQ ID NO: 1605790 - DNA, 13 bp, Homo sapiens
agagaccagggct

SEQ ID NO: 1605791 - DNA, 12 bp, Homo sapiens
agagacccaagg

SEQ ID NO: 1605792 - DNA, 14 bp, Homo sapiens
agagacccagatct

SEQ ID NO: 1605793 - DNA, 13 bp, Homo sapiens
agagacccccagg

SEQ ID NO: 1605794 - DNA, 17 bp, Homo sapiens
agagacccgggaaggaa

SEQ ID NO: 1605795 - DNA, 14 bp, Homo sapiens
agagacctgccctc

SEQ ID NO: 1605796 - DNA, 18 bp, Homo sapiens
agagacctgccctctctg

SEQ ID NO: 1605797 - DNA, 14 bp, Homo sapiens
agagacctgtgtga

SEQ ID NO: 1605798 - DNA, 12 bp, Homo sapiens
agagacgaggtc

SEQ ID NO: 1605799 - DNA, 16 bp, Homo sapiens
agagacgcaggaatgg

SEQ ID NO: 1605800 - DNA, 19 bp, Homo sapiens
agagacgccctatttctat

SEQ ID NO: 1605801 - DNA, 19 bp, Homo sapiens
agagacggggtttcaccct

SEQ ID NO: 1605802 - DNA, 19 bp, Homo sapiens
agagactcagggccccagc

SEQ ID NO: 1605803 - DNA, 22 bp, Homo sapiens
agagactcatttcacagccttt

SEQ ID NO: 1605804 - DNA, 13 bp, Homo sapiens
agagactgaaagc

SEQ ID NO: 1605805 - DNA, 17 bp, Homo sapiens
agagactgaaagcagca

SEQ ID NO: 1605806 - DNA, 19 bp, Homo sapiens
agagactgaaagcagcagc

SEQ ID NO: 1605807 - DNA, 23 bp, Homo sapiens
agagactgaaagcagcagctagg

SEQ ID NO: 1605808 - DNA, 14 bp, Homo sapiens
agagactgaaatta

SEQ ID NO: 1605809 - DNA, 15 bp, Homo sapiens
agagactgagcagcc

SEQ ID NO: 1605810 - DNA, 20 bp, Homo sapiens
agagactgagcagccgccag

SEQ ID NO: 1605811 - DNA, 22 bp, Homo sapiens
agagactgagcagccgccagct

SEQ ID NO: 1605812 - DNA, 15 bp, Homo sapiens
agagactgcgttctg

SEQ ID NO: 1605813 - DNA, 18 bp, Homo sapiens
agagactgcgttctgcaa

SEQ ID NO: 1605814 - DNA, 23 bp, Homo sapiens
agagactgggaagataggctctg

SEQ ID NO: 1605815 - DNA, 22 bp, Homo sapiens
agagactgggagccacttctcc

SEQ ID NO: 1605816 - DNA, 13 bp, Homo sapiens
agagactgtagat

SEQ ID NO: 1605817 - DNA, 14 bp, Homo sapiens
agagactgtgaggc

SEQ ID NO: 1605818 - DNA, 13 bp, Homo sapiens
agagagaaaaaaa

SEQ ID NO: 1605819 - DNA, 14 bp, Homo sapiens
agagagaaaataaa

SEQ ID NO: 1605820 - DNA, 12 bp, Homo sapiens
agagagaagcca

SEQ ID NO: 1605821 - DNA, 19 bp, Homo sapiens
agagagacctcatcctgct

SEQ ID NO: 1605822 - DNA, 14 bp, Homo sapiens
agagagagagaaag

SEQ ID NO: 1605823 - DNA, 15 bp, Homo sapiens
agagagagagaaaga

SEQ ID NO: 1605824 - DNA, 15 bp, Homo sapiens
agagagagagagaaa

SEQ ID NO: 1605825 - DNA, 13 bp, Homo sapiens
agagagagagagg

SEQ ID NO: 1605826 - DNA, 16 bp, Homo sapiens
agagagagaggacaga

SEQ ID NO: 1605827 - DNA, 16 bp, Homo sapiens
agagagaggggcctgc

SEQ ID NO: 1605828 - DNA, 14 bp, Homo sapiens
agagagccaagacg

SEQ ID NO: 1605829 - DNA, 12 bp, Homo sapiens
agagagccagga

SEQ ID NO: 1605830 - DNA, 16 bp, Homo sapiens
agagagccaggatgcc

SEQ ID NO: 1605831 - DNA, 15 bp, Homo sapiens
agagagccttaactt

SEQ ID NO: 1605832 - DNA, 18 bp, Homo sapiens
agagagctgccatcgctg

SEQ ID NO: 1605833 - DNA, 23 bp, Homo sapiens
agagagcttggcaattcatgggg

SEQ ID NO: 1605834 - DNA, 20 bp, Homo sapiens
agagaggaaattctccactg

SEQ ID NO: 1605835 - DNA, 14 bp, Homo sapiens
agagaggaatcaga

SEQ ID NO: 1605836 - DNA, 17 bp, Homo sapiens
agagaggaatcagactt

SEQ ID NO: 1605837 - DNA, 15 bp, Homo sapiens
agagaggagcacctg

SEQ ID NO: 1605838 - DNA, 19 bp, Homo sapiens
agagaggcccgcccgccca

SEQ ID NO: 1605839 - DNA, 13 bp, Homo sapiens
agagaggctgcct

SEQ ID NO: 1605840 - DNA, 18 bp, Homo sapiens
agacaaatggaggaatat

SEQ ID NO: 1605841 - DNA, 15 bp, Homo sapiens
agacaaatgggactg

SEQ ID NO: 1605842 - DNA, 20 bp, Homo sapiens
agacaacagaaagagggaca

SEQ ID NO: 1605843 - DNA, 19 bp, Homo sapiens
agacaacaggtaaaacagg

SEQ ID NO: 1605844 - DNA, 12 bp, Homo sapiens
agacaacattat

SEQ ID NO: 1605845 - DNA, 15 bp, Homo sapiens
agacaacattatgat

SEQ ID NO: 1605846 - DNA, 17 bp, Homo sapiens
agacaacattatgatct

SEQ ID NO: 1605847 - DNA, 17 bp, Homo sapiens
agacaacctgaaattta

SEQ ID NO: 1605848 - DNA, 14 bp, Homo sapiens
agacaactagattt

SEQ ID NO: 1605849 - DNA, 14 bp, Homo sapiens
agacaagagatcta

SEQ ID NO: 1605850 - DNA, 19 bp, Homo sapiens
agacaagagatctacacat

SEQ ID NO: 1605851 - DNA, 20 bp, Homo sapiens
agacaagagatctacacatg

SEQ ID NO: 1605852 - DNA, 21 bp, Homo sapiens
agacaagagatctacacatgt

SEQ ID NO: 1605853 - DNA, 16 bp, Homo sapiens
agacaagatattgtac

SEQ ID NO: 1605854 - DNA, 16 bp, Homo sapiens
agacaagcagcccttg

SEQ ID NO: 1605855 - DNA, 23 bp, Homo sapiens
agacaaggctggcaaaccctccc

SEQ ID NO: 1605856 - DNA, 15 bp, Homo sapiens
agacaagtaatttca

SEQ ID NO: 1605857 - DNA, 18 bp, Homo sapiens
agacaagtaatttcagtg

SEQ ID NO: 1605858 - DNA, 17 bp, Homo sapiens
agacaagtatgaatatt

SEQ ID NO: 1605859 - DNA, 18 bp, Homo sapiens
agacaatatgaacaaact

SEQ ID NO: 1605860 - DNA, 20 bp, Homo sapiens
agacaatatgtgagtgcctt

SEQ ID NO: 1605861 - DNA, 15 bp, Homo sapiens
agacaatcactgcca

SEQ ID NO: 1605862 - DNA, 13 bp, Homo sapiens
agacaatttgata

SEQ ID NO: 1605863 - DNA, 16 bp, Homo sapiens
agacaatttgatacat

SEQ ID NO: 1605864 - DNA, 18 bp, Homo sapiens
agacaatttgcacatctt

SEQ ID NO: 1605865 - DNA, 15 bp, Homo sapiens
agacacaaaagatgg

SEQ ID NO: 1605866 - DNA, 14 bp, Homo sapiens
agacacaactattt

SEQ ID NO: 1605867 - DNA, 14 bp, Homo sapiens
agacacaatttcat

SEQ ID NO: 1605868 - DNA, 16 bp, Homo sapiens
agacacaatttcattt

SEQ ID NO: 1605869 - DNA, 10 bp, Homo sapiens
agacacacac

SEQ ID NO: 1605870 - DNA, 18 bp, Homo sapiens
agacacacacacgcacgc

SEQ ID NO: 1605871 - DNA, 21 bp, Homo sapiens
agacacacacacgcacgcaca

SEQ ID NO: 1605872 - DNA, 23 bp, Homo sapiens
agacacaccgcggccaggcaccc

SEQ ID NO: 1605873 - DNA, 12 bp, Homo sapiens
agacacagactg

SEQ ID NO: 1605874 - DNA, 13 bp, Homo sapiens
agacacagcctcc

SEQ ID NO: 1605875 - DNA, 12 bp, Homo sapiens
agacacaggccc

SEQ ID NO: 1605876 - DNA, 23 bp, Homo sapiens
agacacatgaaggtaaataaaaa

SEQ ID NO: 1605877 - DNA, 14 bp, Homo sapiens
agacaccaaagttc

SEQ ID NO: 1605878 - DNA, 18 bp, Homo sapiens
agacaccaaagttctaat

SEQ ID NO: 1605879 - DNA, 12 bp, Homo sapiens
agacacccagga

SEQ ID NO: 1605880 - DNA, 16 bp, Homo sapiens
agacacccaggactta

SEQ ID NO: 1605881 - DNA, 19 bp, Homo sapiens
agacaccctcaacctcttc

SEQ ID NO: 1605882 - DNA, 14 bp, Homo sapiens
agacaccctctggg

SEQ ID NO: 1605883 - DNA, 21 bp, Homo sapiens
agacacctgcacctcccccca

SEQ ID NO: 1605884 - DNA, 14 bp, Homo sapiens
agacacctggttgc

SEQ ID NO: 1605885 - DNA, 21 bp, Homo sapiens
agacacctgttcacagaaaaa

SEQ ID NO: 1605886 - DNA, 17 bp, Homo sapiens
agacacgacagcacaca

SEQ ID NO: 1605887 - DNA, 21 bp, Homo sapiens
agacacgctcgcgggcagcgg

SEQ ID NO: 1605888 - DNA, 20 bp, Homo sapiens
agacactcctataaggagag

SEQ ID NO: 1605889 - DNA, 16 bp, Homo sapiens
agacactctgctctgc

SEQ ID NO: 1605890 - DNA, 20 bp, Homo sapiens
agacactgccacacagggtc

SEQ ID NO: 1605891 - DNA, 14 bp, Homo sapiens
agacactgcctggg

SEQ ID NO: 1605892 - DNA, 16 bp, Homo sapiens
agacactgcctgggct

SEQ ID NO: 1605893 - DNA, 13 bp, Homo sapiens
agacactggcccc

SEQ ID NO: 1605894 - DNA, 15 bp, Homo sapiens
agacactggcccctc

SEQ ID NO: 1605895 - DNA, 13 bp, Homo sapiens
agacacttcagat

SEQ ID NO: 1605896 - DNA, 21 bp, Homo sapiens
agacacttcatggaccaagaa

SEQ ID NO: 1605897 - DNA, 14 bp, Homo sapiens
agacacttgctccc

SEQ ID NO: 1605898 - DNA, 15 bp, Homo sapiens
agacagaaaagtgcc

SEQ ID NO: 1605899 - DNA, 18 bp, Homo sapiens
agacagaaaagtgcctga

SEQ ID NO: 1605900 - DNA, 15 bp, Homo sapiens
agacagaaaccaagc

SEQ ID NO: 1605901 - DNA, 12 bp, Homo sapiens
agacagaaagcc

SEQ ID NO: 1605902 - DNA, 13 bp, Homo sapiens
agacagaaagcct

SEQ ID NO: 1605903 - DNA, 14 bp, Homo sapiens
agacagaaagcctc

SEQ ID NO: 1605904 - DNA, 18 bp, Homo sapiens
agacagaacacctatgca

SEQ ID NO: 1605905 - DNA, 17 bp, Homo sapiens
agacagaacccctacat

SEQ ID NO: 1605906 - DNA, 19 bp, Homo sapiens
agactatttgctaatgtat

SEQ ID NO: 1605907 - DNA, 22 bp, Homo sapiens
agactcaaaacctggagatgca

SEQ ID NO: 1605908 - DNA, 15 bp, Homo sapiens
agactcaaatgttct

SEQ ID NO: 1605909 - DNA, 16 bp, Homo sapiens
agactcaaatgttcta

SEQ ID NO: 1605910 - DNA, 20 bp, Homo sapiens
agactcaaatgttctaagtt

SEQ ID NO: 1605911 - DNA, 15 bp, Homo sapiens
agactcacctctgcc

SEQ ID NO: 1605912 - DNA, 16 bp, Homo sapiens
agactcacctctgcct

SEQ ID NO: 1605913 - DNA, 22 bp, Homo sapiens
agactcagctgctatacttatc

SEQ ID NO: 1605914 - DNA, 16 bp, Homo sapiens
agactcagggccccag

SEQ ID NO: 1605915 - DNA, 18 bp, Homo sapiens
agactcagggccccagca

SEQ ID NO: 1605916 - DNA, 16 bp, Homo sapiens
agactcagtgcagatg

SEQ ID NO: 1605917 - DNA, 18 bp, Homo sapiens
agactcagtgcagatgga

SEQ ID NO: 1605918 - DNA, 13 bp, Homo sapiens
agactcagtgttc

SEQ ID NO: 1605919 - DNA, 15 bp, Homo sapiens
agactcagtttgtca

SEQ ID NO: 1605920 - DNA, 12 bp, Homo sapiens
agactccaaaga

SEQ ID NO: 1605921 - DNA, 21 bp, Homo sapiens
agactccaatggggccagcac

SEQ ID NO: 1605922 - DNA, 22 bp, Homo sapiens
agactccaatggggccagcact

SEQ ID NO: 1605923 - DNA, 16 bp, Homo sapiens
agactccatctcttct

SEQ ID NO: 1605924 - DNA, 17 bp, Homo sapiens
agactccatctcttctg

SEQ ID NO: 1605925 - DNA, 17 bp, Homo sapiens
agactcccattcctgaa

SEQ ID NO: 1605926 - DNA, 11 bp, Homo sapiens
agactccctga

SEQ ID NO: 1605927 - DNA, 18 bp, Homo sapiens
agactccctgatcccaga

SEQ ID NO: 1605928 - DNA, 22 bp, Homo sapiens
agactccctgatcccagacctg

SEQ ID NO: 1605929 - DNA, 14 bp, Homo sapiens
agactccgccctcc

SEQ ID NO: 1605930 - DNA, 15 bp, Homo sapiens
agactcctgccctgt

SEQ ID NO: 1605931 - DNA, 15 bp, Homo sapiens
agactcgagaacttt

SEQ ID NO: 1605932 - DNA, 18 bp, Homo sapiens
agactcgagaactttcat

SEQ ID NO: 1605933 - DNA, 19 bp, Homo sapiens
agactcgagaactttcatt

SEQ ID NO: 1605934 - DNA, 20 bp, Homo sapiens
agactctagagtccaaggtt

SEQ ID NO: 1605935 - DNA, 21 bp, Homo sapiens
agactctaggacataaattag

SEQ ID NO: 1605936 - DNA, 17 bp, Homo sapiens
agactctagtatttatg

SEQ ID NO: 1605937 - DNA, 16 bp, Homo sapiens
agactctatttaagat

SEQ ID NO: 1605938 - DNA, 17 bp, Homo sapiens
agactcttgcctgtttc

SEQ ID NO: 1605939 - DNA, 15 bp, Homo sapiens
agactctttgcatat

SEQ ID NO: 1605940 - DNA, 18 bp, Homo sapiens
agactctttttttgagtg

SEQ ID NO: 1605941 - DNA, 22 bp, Homo sapiens
agactctttttttgagtgacag

SEQ ID NO: 1605942 - DNA, 16 bp, Homo sapiens
agactgaaagcagcag

SEQ ID NO: 1605943 - DNA, 17 bp, Homo sapiens
agactgaaagcagcagc

SEQ ID NO: 1605944 - DNA, 18 bp, Homo sapiens
agactgaaagcagcagct

SEQ ID NO: 1605945 - DNA, 21 bp, Homo sapiens
agactgaatagatatgaaagc

SEQ ID NO: 1605946 - DNA, 22 bp, Homo sapiens
agactgaatagatatgaaagct

SEQ ID NO: 1605947 - DNA, 16 bp, Homo sapiens
agactgagctctccag

SEQ ID NO: 1605948 - DNA, 17 bp, Homo sapiens
agactgagctctccagg

SEQ ID NO: 1605949 - DNA, 23 bp, Homo sapiens
agactgagctctccaggccaggt

SEQ ID NO: 1605950 - DNA, 18 bp, Homo sapiens
agactgaggtataaagac

SEQ ID NO: 1605951 - DNA, 17 bp, Homo sapiens
agactgagtcagatggg

SEQ ID NO: 1605952 - DNA, 19 bp, Homo sapiens
agactgataacaacctttt

SEQ ID NO: 1605953 - DNA, 21 bp, Homo sapiens
agactgataacttggggaggc

SEQ ID NO: 1605954 - DNA, 23 bp, Homo sapiens
agactgatggggtcgctctttgg

SEQ ID NO: 1605955 - DNA, 19 bp, Homo sapiens
agactgcagaacccccagg

SEQ ID NO: 1605956 - DNA, 14 bp, Homo sapiens
agactgcatctcaa

SEQ ID NO: 1605957 - DNA, 12 bp, Homo sapiens
agactgccaggt

SEQ ID NO: 1605958 - DNA, 20 bp, Homo sapiens
agactgcgggatggtcctgg

SEQ ID NO: 1605959 - DNA, 17 bp, Homo sapiens
agactgcgttctgcaag

SEQ ID NO: 1605960 - DNA, 14 bp, Homo sapiens
agactgctgggact

SEQ ID NO: 1605961 - DNA, 22 bp, Homo sapiens
agactgctgggactggccaggt

SEQ ID NO: 1605962 - DNA, 19 bp, Homo sapiens
agactgcttccaattttct

SEQ ID NO: 1605963 - DNA, 17 bp, Homo sapiens
agactgcttcccatcct

SEQ ID NO: 1605964 - DNA, 15 bp, Homo sapiens
agactggcacagttt

SEQ ID NO: 1605965 - DNA, 22 bp, Homo sapiens
agactggcctaggggccagggc

SEQ ID NO: 1605966 - DNA, 20 bp, Homo sapiens
agactggctggctgcagtga

SEQ ID NO: 1605967 - DNA, 23 bp, Homo sapiens
agactgggaagataggctctgca

SEQ ID NO: 1605968 - DNA, 18 bp, Homo sapiens
agactgggagccacttct

SEQ ID NO: 1605969 - DNA, 13 bp, Homo sapiens
agactgggcccag

SEQ ID NO: 1605970 - DNA, 14 bp, Homo sapiens
agactgggcccagg

SEQ ID NO: 1605971 - DNA, 15 bp, Homo sapiens
agactgggcccaggc

SEQ ID NO: 1605972 - DNA, 21 bp, Homo sapiens
agactgggcccaggcaggtct

SEQ ID NO: 1605973 - DNA, 19 bp, Homo sapiens
agactgggtaatttataaa

SEQ ID NO: 1605974 - DNA, 18 bp, Homo sapiens
agactgggtaggaaagag

SEQ ID NO: 1605975 - DNA, 23 bp, Homo sapiens
agactggtctcgaactcctggcc

SEQ ID NO: 1605976 - DNA, 16 bp, Homo sapiens
agactgtacaaagtag

SEQ ID NO: 1605977 - DNA, 18 bp, Homo sapiens
agactgtcattgcccctc

SEQ ID NO: 1605978 - DNA, 20 bp, Homo sapiens
agactgtcattgcccctccg

SEQ ID NO: 1605979 - DNA, 14 bp, Homo sapiens
agactgtctcaaga

SEQ ID NO: 1605980 - DNA, 21 bp, Homo sapiens
agactgtgaacttgactgggt

SEQ ID NO: 1605981 - DNA, 21 bp, Homo sapiens
agactgtgaggcggcagctgg

SEQ ID NO: 1605982 - DNA, 14 bp, Homo sapiens
agactgtgcagaag

SEQ ID NO: 1605983 - DNA, 18 bp, Homo sapiens
agactgtggaaatgccaa

SEQ ID NO: 1605984 - DNA, 20 bp, Homo sapiens
agactgtggctgctagcact

SEQ ID NO: 1605985 - DNA, 13 bp, Homo sapiens
agactgtggtagg

SEQ ID NO: 1605986 - DNA, 19 bp, Homo sapiens
agactgtggtaggggcagg

SEQ ID NO: 1605987 - DNA, 21 bp, Homo sapiens
agactgtggtaggggcaggga

SEQ ID NO: 1605988 - DNA, 23 bp, Homo sapiens
agactgtgtttggtcctgtagga

SEQ ID NO: 1605989 - DNA, 18 bp, Homo sapiens
agactgttaaatgaaacc

SEQ ID NO: 1605990 - DNA, 16 bp, Homo sapiens
agactgttttactgtt

SEQ ID NO: 1605991 - DNA, 13 bp, Homo sapiens
agacttaaaacat

SEQ ID NO: 1605992 - DNA, 15 bp, Homo sapiens
agacttaaaacatgg

SEQ ID NO: 1605993 - DNA, 21 bp, Homo sapiens
agacttaaagggcccaatgaa

SEQ ID NO: 1605994 - DNA, 18 bp, Homo sapiens
agacttaagcccagtgca

SEQ ID NO: 1605995 - DNA, 16 bp, Homo sapiens
agacttaattctgatt

SEQ ID NO: 1605996 - DNA, 23 bp, Homo sapiens
agacttacagggataaggcctgt

SEQ ID NO: 1605997 - DNA, 15 bp, Homo sapiens
agacttactctaaga

SEQ ID NO: 1605998 - DNA, 16 bp, Homo sapiens
agacttactctaagat

SEQ ID NO: 1605999 - DNA, 22 bp, Homo sapiens
agacttaggcattaacatgttt

SEQ ID NO: 1606000 - DNA, 22 bp, Homo sapiens
agacttagtatattttcttttc

SEQ ID NO: 1606001 - DNA, 20 bp, Homo sapiens
agacttccaaacctgacaga

SEQ ID NO: 1606002 - DNA, 21 bp, Homo sapiens
agacttccaaacctgacagat

SEQ ID NO: 1606003 - DNA, 12 bp, Homo sapiens
agacttccccat

SEQ ID NO: 1606004 - DNA, 15 bp, Homo sapiens
agacttccctgaatg

SEQ ID NO: 1606005 - DNA, 16 bp, Homo sapiens
agacttcctttataat

SEQ ID NO: 1606006 - DNA, 20 bp, Homo sapiens
agacttcgactcaggatcca

SEQ ID NO: 1606007 - DNA, 13 bp, Homo sapiens
agacttctggaag

SEQ ID NO: 1606008 - DNA, 15 bp, Homo sapiens
agacttctggaaggc

SEQ ID NO: 1606009 - DNA, 16 bp, Homo sapiens
agacttctggaaggct

SEQ ID NO: 1606010 - DNA, 21 bp, Homo sapiens
agacttctggaaggctggctg

SEQ ID NO: 1606011 - DNA, 18 bp, Homo sapiens
agacttctggttgtattt

SEQ ID NO: 1606012 - DNA, 22 bp, Homo sapiens
agacttgacaacatcccacagt

SEQ ID NO: 1606013 - DNA, 12 bp, Homo sapiens
agacttgcactg

SEQ ID NO: 1606014 - DNA, 17 bp, Homo sapiens
agactttagaaataaat

SEQ ID NO: 1606015 - DNA, 14 bp, Homo sapiens
agactttctgaagt

SEQ ID NO: 1606016 - DNA, 21 bp, Homo sapiens
agactttgtgttcatttcatt

SEQ ID NO: 1606017 - DNA, 13 bp, Homo sapiens
agacttttcagac

SEQ ID NO: 1606018 - DNA, 16 bp, Homo sapiens
agagaaaaaaaaaata

SEQ ID NO: 1606019 - DNA, 18 bp, Homo sapiens
agagaaaaaaaaaatagt

SEQ ID NO: 1606020 - DNA, 17 bp, Homo sapiens
agacatgtgaggaggaa

SEQ ID NO: 1606021 - DNA, 21 bp, Homo sapiens
agacattaattttttttttaa

SEQ ID NO: 1606022 - DNA, 15 bp, Homo sapiens
agacattctcacata

SEQ ID NO: 1606023 - DNA, 19 bp, Homo sapiens
agacattctcacataagcc

SEQ ID NO: 1606024 - DNA, 19 bp, Homo sapiens
agacattcttccaaaaaga

SEQ ID NO: 1606025 - DNA, 20 bp, Homo sapiens
agacattgctctatgtctgc

SEQ ID NO: 1606026 - DNA, 21 bp, Homo sapiens
agacatttatactcttttttc

SEQ ID NO: 1606027 - DNA, 21 bp, Homo sapiens
agacatttgctatgagctggg

SEQ ID NO: 1606028 - DNA, 13 bp, Homo sapiens
agacatttgctga

SEQ ID NO: 1606029 - DNA, 19 bp, Homo sapiens
agacatttgctgaactcag

SEQ ID NO: 1606030 - DNA, 12 bp, Homo sapiens
agacatttgtat

SEQ ID NO: 1606031 - DNA, 15 bp, Homo sapiens
agacatttgtatatt

SEQ ID NO: 1606032 - DNA, 17 bp, Homo sapiens
agacatttgtatattgt

SEQ ID NO: 1606033 - DNA, 21 bp, Homo sapiens
agacattttaagtttgtagta

SEQ ID NO: 1606034 - DNA, 14 bp, Homo sapiens
agacattttctttt

SEQ ID NO: 1606035 - DNA, 22 bp, Homo sapiens
agacattttgtgtgagacttaa

SEQ ID NO: 1606036 - DNA, 13 bp, Homo sapiens
agacattttgtta

SEQ ID NO: 1606037 - DNA, 18 bp, Homo sapiens
agacattttgttacataa

SEQ ID NO: 1606038 - DNA, 17 bp, Homo sapiens
agacattttttgctata

SEQ ID NO: 1606039 - DNA, 18 bp, Homo sapiens
agacattttttgctataa

SEQ ID NO: 1606040 - DNA, 13 bp, Homo sapiens
agaccaaaataaa

SEQ ID NO: 1606041 - DNA, 15 bp, Homo sapiens
agaccaaagcaaaga

SEQ ID NO: 1606042 - DNA, 16 bp, Homo sapiens
agaccaaaggaaggaa

SEQ ID NO: 1606043 - DNA, 17 bp, Homo sapiens
agaccaaagtttgcaac

SEQ ID NO: 1606044 - DNA, 14 bp, Homo sapiens
agaccaacctgacc

SEQ ID NO: 1606045 - DNA, 17 bp, Homo sapiens
agaccaagactctgaaa

SEQ ID NO: 1606046 - DNA, 23 bp, Homo sapiens
agaccaaggcgggagcatctctt

SEQ ID NO: 1606047 - DNA, 17 bp, Homo sapiens
agaccacagagctgtca

SEQ ID NO: 1606048 - DNA, 20 bp, Homo sapiens
agaccacagggttcaaaatg

SEQ ID NO: 1606049 - DNA, 21 bp, Homo sapiens
agaccacagggttcaaaatgt

SEQ ID NO: 1606050 - DNA, 16 bp, Homo sapiens
agaccaccacttcgaa

SEQ ID NO: 1606051 - DNA, 15 bp, Homo sapiens
agaccacctgcttct

SEQ ID NO: 1606052 - DNA, 21 bp, Homo sapiens
agaccacctgcttctgaactc

SEQ ID NO: 1606053 - DNA, 23 bp, Homo sapiens
agaccacgcccgtcctgcctgtg

SEQ ID NO: 1606054 - DNA, 24 bp, Homo sapiens
agaccacgcccgtcctgcctgtgg

SEQ ID NO: 1606055 - DNA, 12 bp, Homo sapiens
agaccactgtct

SEQ ID NO: 1606056 - DNA, 16 bp, Homo sapiens
agaccacttgccacgc

SEQ ID NO: 1606057 - DNA, 14 bp, Homo sapiens
agaccagaaattcc

SEQ ID NO: 1606058 - DNA, 13 bp, Homo sapiens
agaccagaattcc

SEQ ID NO: 1606059 - DNA, 18 bp, Homo sapiens
agaccagaattcccttga

SEQ ID NO: 1606060 - DNA, 21 bp, Homo sapiens
agaccagaattcccttgaatt

SEQ ID NO: 1606061 - DNA, 18 bp, Homo sapiens
agaccagagctgtctgaa

SEQ ID NO: 1606062 - DNA, 15 bp, Homo sapiens
agaccagcactcagc

SEQ ID NO: 1606063 - DNA, 15 bp, Homo sapiens
agaccagcctgtcca

SEQ ID NO: 1606064 - DNA, 13 bp, Homo sapiens
agaccagctcaga

SEQ ID NO: 1606065 - DNA, 20 bp, Homo sapiens
agaccagctcagaggcccag

SEQ ID NO: 1606066 - DNA, 22 bp, Homo sapiens
agaccagctcagaggcccagga

SEQ ID NO: 1606067 - DNA, 21 bp, Homo sapiens
agaccaggctgcagcctccac

SEQ ID NO: 1606068 - DNA, 12 bp, Homo sapiens
agaccaggctgg

SEQ ID NO: 1606069 - DNA, 16 bp, Homo sapiens
agaccagggctccagc

SEQ ID NO: 1606070 - DNA, 20 bp, Homo sapiens
agaccagttgggagcactgg

SEQ ID NO: 1606071 - DNA, 16 bp, Homo sapiens
agaccatcctggcccc

SEQ ID NO: 1606072 - DNA, 17 bp, Homo sapiens
agaccatcctggcccct

SEQ ID NO: 1606073 - DNA, 19 bp, Homo sapiens
agaccatcctggcccctcc

SEQ ID NO: 1606074 - DNA, 17 bp, Homo sapiens
agaccatgccagaccca

SEQ ID NO: 1606075 - DNA, 17 bp, Homo sapiens
agacccagctgcagacc

SEQ ID NO: 1606076 - DNA, 13 bp, Homo sapiens
agacccaggtgga

SEQ ID NO: 1606077 - DNA, 21 bp, Homo sapiens
agacccaggtggagggcacag

SEQ ID NO: 1606078 - DNA, 23 bp, Homo sapiens
agacccattgcgatggccgctcc

SEQ ID NO: 1606079 - DNA, 15 bp, Homo sapiens
agaccccacccaagc

SEQ ID NO: 1606080 - DNA, 23 bp, Homo sapiens
agaccccacccaagcttggcagc

SEQ ID NO: 1606081 - DNA, 19 bp, Homo sapiens
agaccccatcttccagcca

SEQ ID NO: 1606082 - DNA, 13 bp, Homo sapiens
agacccccacacc

SEQ ID NO: 1606083 - DNA, 14 bp, Homo sapiens
agacccccacacct

SEQ ID NO: 1606084 - DNA, 14 bp, Homo sapiens
agacccccagcact

SEQ ID NO: 1606085 - DNA, 15 bp, Homo sapiens
agacccccaggcctg

SEQ ID NO: 1606086 - DNA, 12 bp, Homo sapiens
agacccccatcc

SEQ ID NO: 1606087 - DNA, 14 bp, Homo sapiens
agacccccatccag

SEQ ID NO: 1606088 - DNA, 15 bp, Homo sapiens
agacccccatccagc

SEQ ID NO: 1606089 - DNA, 17 bp, Homo sapiens
agacccccatccagcct

SEQ ID NO: 1606090 - DNA, 20 bp, Homo sapiens
agacccccatccagcctcca

SEQ ID NO: 1606091 - DNA, 23 bp, Homo sapiens
agacccccatccagcctccaggg

SEQ ID NO: 1606092 - DNA, 22 bp, Homo sapiens
agacccccccatttcccgcaca

SEQ ID NO: 1606093 - DNA, 21 bp, Homo sapiens
agaccccgcaggatccctcct

SEQ ID NO: 1606094 - DNA, 22 bp, Homo sapiens
agaccccgcaggatccctcctg

SEQ ID NO: 1606095 - DNA, 17 bp, Homo sapiens
agacccctctggccagg

SEQ ID NO: 1606096 - DNA, 11 bp, Homo sapiens
agacccctgcc

SEQ ID NO: 1606097 - DNA, 15 bp, Homo sapiens
agacccctggctttt

SEQ ID NO: 1606098 - DNA, 14 bp, Homo sapiens
agacccgggaagga

SEQ ID NO: 1606099 - DNA, 17 bp, Homo sapiens
agacccgggaaggaagg

SEQ ID NO: 1606100 - DNA, 17 bp, Homo sapiens
agaccctaaatctgagg

SEQ ID NO: 1606101 - DNA, 20 bp, Homo sapiens
agaccctactgaagtggctg

SEQ ID NO: 1606102 - DNA, 22 bp, Homo sapiens
agaccctactgaagtggctggt

SEQ ID NO: 1606103 - DNA, 21 bp, Homo sapiens
agaccctccccacagtgccac

SEQ ID NO: 1606104 - DNA, 16 bp, Homo sapiens
agaccctcgcagacct

SEQ ID NO: 1606105 - DNA, 17 bp, Homo sapiens
agaccctcgcagaccta

SEQ ID NO: 1606106 - DNA, 13 bp, Homo sapiens
agaccctcgggcc

SEQ ID NO: 1606107 - DNA, 18 bp, Homo sapiens
agaccctcttgcccatcc

SEQ ID NO: 1606108 - DNA, 20 bp, Homo sapiens
agaccctcttgcccatcctg

SEQ ID NO: 1606109 - DNA, 17 bp, Homo sapiens
agaccctgaagatttca

SEQ ID NO: 1606110 - DNA, 14 bp, Homo sapiens
agaccctgagactc

SEQ ID NO: 1606111 - DNA, 14 bp, Homo sapiens
agaccctggaggcc

SEQ ID NO: 1606112 - DNA, 12 bp, Homo sapiens
agaccctgggca

SEQ ID NO: 1606113 - DNA, 21 bp, Homo sapiens
agaccctgggcaaacagagct

SEQ ID NO: 1606114 - DNA, 13 bp, Homo sapiens
agaccctgtctct

SEQ ID NO: 1606115 - DNA, 21 bp, Homo sapiens
agaccctgtgtcctccaccat

SEQ ID NO: 1606116 - DNA, 21 bp, Homo sapiens
agacccttattgctgtcctgg

SEQ ID NO: 1606117 - DNA, 18 bp, Homo sapiens
agaccgcttcacccctgc

SEQ ID NO: 1606118 - DNA, 23 bp, Homo sapiens
agaccgtcgggggctgaggggca

SEQ ID NO: 1606119 - DNA, 14 bp, Homo sapiens
agaccgtgagcgcc

SEQ ID NO: 1606120 - DNA, 14 bp, Homo sapiens
agacctacagacct

SEQ ID NO: 1606121 - DNA, 19 bp, Homo sapiens
agacctacagacctggctc

SEQ ID NO: 1606122 - DNA, 17 bp, Homo sapiens
agacctactgttctaaa

SEQ ID NO: 1606123 - DNA, 20 bp, Homo sapiens
agacctactgttctaaagct

SEQ ID NO: 1606124 - DNA, 16 bp, Homo sapiens
agacctatttgacata

SEQ ID NO: 1606125 - DNA, 11 bp, Homo sapiens
agacctcagcc

SEQ ID NO: 1606126 - DNA, 12 bp, Homo sapiens
agacctcagcca

SEQ ID NO: 1606127 - DNA, 18 bp, Homo sapiens
agacctcagccatgagga

SEQ ID NO: 1606128 - DNA, 14 bp, Homo sapiens
agacctcagcctgt

SEQ ID NO: 1606129 - DNA, 18 bp, Homo sapiens
agacctcagtgccttcct

SEQ ID NO: 1606130 - DNA, 21 bp, Homo sapiens
agacctcttccctctgggcct

SEQ ID NO: 1606131 - DNA, 20 bp, Homo sapiens
agacctgacaccgtccctca

SEQ ID NO: 1606132 - DNA, 17 bp, Homo sapiens
agacctgagggaccctt

SEQ ID NO: 1606133 - DNA, 18 bp, Homo sapiens
agacctgatcctggaggc

SEQ ID NO: 1606134 - DNA, 23 bp, Homo sapiens
agacctgatcctggaggcccagt

SEQ ID NO: 1606135 - DNA, 17 bp, Homo sapiens
agacctgccctctctgc

SEQ ID NO: 1606136 - DNA, 13 bp, Homo sapiens
agacctgctctcc

SEQ ID NO: 1606137 - DNA, 17 bp, Homo sapiens
agaatccataaatgtgt

SEQ ID NO: 1606138 - DNA, 17 bp, Homo sapiens
agaatcccaatgtttga

SEQ ID NO: 1606139 - DNA, 16 bp, Homo sapiens
agaatcccacattagc

SEQ ID NO: 1606140 - DNA, 21 bp, Homo sapiens
agaatcctaggctccacccca

SEQ ID NO: 1606141 - DNA, 19 bp, Homo sapiens
agaatcctcccttcccagg

SEQ ID NO: 1606142 - DNA, 12 bp, Homo sapiens
agaatcctctcc

SEQ ID NO: 1606143 - DNA, 19 bp, Homo sapiens
agaatcggccagtgggcct

SEQ ID NO: 1606144 - DNA, 20 bp, Homo sapiens
agaatctaaaccttacatgt

SEQ ID NO: 1606145 - DNA, 15 bp, Homo sapiens
agaatctaaagccag

SEQ ID NO: 1606146 - DNA, 12 bp, Homo sapiens
agaatctagaaa

SEQ ID NO: 1606147 - DNA, 14 bp, Homo sapiens
agaatctagaagat

SEQ ID NO: 1606148 - DNA, 17 bp, Homo sapiens
agaatctagaagatgtg

SEQ ID NO: 1606149 - DNA, 21 bp, Homo sapiens
agaatctagaagatgtgtaaa

SEQ ID NO: 1606150 - DNA, 13 bp, Homo sapiens
agaatctctgagc

SEQ ID NO: 1606151 - DNA, 17 bp, Homo sapiens
agaatctgcaattcaaa

SEQ ID NO: 1606152 - DNA, 12 bp, Homo sapiens
agaatctgcctg

SEQ ID NO: 1606153 - DNA, 17 bp, Homo sapiens
agaatctgctgcatagc

SEQ ID NO: 1606154 - DNA, 16 bp, Homo sapiens
agaatcttgactttct

SEQ ID NO: 1606155 - DNA, 17 bp, Homo sapiens
agaatcttgactttctg

SEQ ID NO: 1606156 - DNA, 19 bp, Homo sapiens
agaatcttgactttctgat

SEQ ID NO: 1606157 - DNA, 22 bp, Homo sapiens
agaatcttgactttctgattgg

SEQ ID NO: 1606158 - DNA, 14 bp, Homo sapiens
agaatcttgtattt

SEQ ID NO: 1606159 - DNA, 12 bp, Homo sapiens
agaatgaaaact

SEQ ID NO: 1606160 - DNA, 16 bp, Homo sapiens
agaatgaaagctgttc

SEQ ID NO: 1606161 - DNA, 16 bp, Homo sapiens
agaatgaaatgtatgt

SEQ ID NO: 1606162 - DNA, 20 bp, Homo sapiens
agaatgaaattgctgaaaga

SEQ ID NO: 1606163 - DNA, 22 bp, Homo sapiens
agaatgaatttatctttaccaa

SEQ ID NO: 1606164 - DNA, 14 bp, Homo sapiens
agaatgagacatcc

SEQ ID NO: 1606165 - DNA, 18 bp, Homo sapiens
agaatgaggaagcaaaga

SEQ ID NO: 1606166 - DNA, 21 bp, Homo sapiens
agaatgagggaaattgctatt

SEQ ID NO: 1606167 - DNA, 16 bp, Homo sapiens
agaatgagtgggaatc

SEQ ID NO: 1606168 - DNA, 16 bp, Homo sapiens
agaatgatgcacactg

SEQ ID NO: 1606169 - DNA, 18 bp, Homo sapiens
agaatgatgttttaaaaa

SEQ ID NO: 1606170 - DNA, 18 bp, Homo sapiens
agaatgattaatcaaagg

SEQ ID NO: 1606171 - DNA, 13 bp, Homo sapiens
agaatgatttcat

SEQ ID NO: 1606172 - DNA, 16 bp, Homo sapiens
agaatgcacaagaatg

SEQ ID NO: 1606173 - DNA, 16 bp, Homo sapiens
agaatgcagtacagaa

SEQ ID NO: 1606174 - DNA, 16 bp, Homo sapiens
agaatgcattccctga

SEQ ID NO: 1606175 - DNA, 18 bp, Homo sapiens
agaatgctggttttccta

SEQ ID NO: 1606176 - DNA, 14 bp, Homo sapiens
agaatgcttaaaaa

SEQ ID NO: 1606177 - DNA, 15 bp, Homo sapiens
agaatgctttgccat

SEQ ID NO: 1606178 - DNA, 13 bp, Homo sapiens
agaatggagacag

SEQ ID NO: 1606179 - DNA, 21 bp, Homo sapiens
agaatggaggaagaacaacaa

SEQ ID NO: 1606180 - DNA, 14 bp, Homo sapiens
agaatggaggcagg

SEQ ID NO: 1606181 - DNA, 22 bp, Homo sapiens
agaatggctttcaatacccttt

SEQ ID NO: 1606182 - DNA, 21 bp, Homo sapiens
agaatggtgattttaaatgtg

SEQ ID NO: 1606183 - DNA, 23 bp, Homo sapiens
agaatggtgattttaaatgtgtg

SEQ ID NO: 1606184 - DNA, 19 bp, Homo sapiens
agaatggtgtgaacccggg

SEQ ID NO: 1606185 - DNA, 19 bp, Homo sapiens
agaatgtaaagttatgtat

SEQ ID NO: 1606186 - DNA, 21 bp, Homo sapiens
agaatgtaaagttatgtattt

SEQ ID NO: 1606187 - DNA, 19 bp, Homo sapiens
agaatgtaactccagatag

SEQ ID NO: 1606188 - DNA, 15 bp, Homo sapiens
agaatgtaagaacta

SEQ ID NO: 1606189 - DNA, 14 bp, Homo sapiens
agaatgtagtttga

SEQ ID NO: 1606190 - DNA, 11 bp, Homo sapiens
agaatgtattt

SEQ ID NO: 1606191 - DNA, 19 bp, Homo sapiens
agaatgtcagatttctggt

SEQ ID NO: 1606192 - DNA, 20 bp, Homo sapiens
agaatgtcagatttctggtt

SEQ ID NO: 1606193 - DNA, 16 bp, Homo sapiens
agaatgtcctcttgga

SEQ ID NO: 1606194 - DNA, 17 bp, Homo sapiens
agaatgtccttattctt

SEQ ID NO: 1606195 - DNA, 17 bp, Homo sapiens
agaatgtgaaaaaggaa

SEQ ID NO: 1606196 - DNA, 20 bp, Homo sapiens
agaatgtgattccttttgat

SEQ ID NO: 1606197 - DNA, 17 bp, Homo sapiens
agaatgtgttcttttct

SEQ ID NO: 1606198 - DNA, 18 bp, Homo sapiens
agaatgttgtacttgaaa

SEQ ID NO: 1606199 - DNA, 23 bp, Homo sapiens
agaattaagaaatactcatgtgc

SEQ ID NO: 1606200 - DNA, 17 bp, Homo sapiens
agaattacagtacacat

SEQ ID NO: 1606201 - DNA, 19 bp, Homo sapiens
agaattaccattaattaca

SEQ ID NO: 1606202 - DNA, 20 bp, Homo sapiens
agaattaccattaattacat

SEQ ID NO: 1606203 - DNA, 22 bp, Homo sapiens
agaattagtgccagaattttag

SEQ ID NO: 1606204 - DNA, 20 bp, Homo sapiens
agaattatctaatttataaa

SEQ ID NO: 1606205 - DNA, 21 bp, Homo sapiens
agaattatctaatttataaaa

SEQ ID NO: 1606206 - DNA, 15 bp, Homo sapiens
agaattatgtaatat

SEQ ID NO: 1606207 - DNA, 14 bp, Homo sapiens
acttctacctgccc

SEQ ID NO: 1606208 - DNA, 16 bp, Homo sapiens
acttctacctgccctc

SEQ ID NO: 1606209 - DNA, 12 bp, Homo sapiens
acttctatattt

SEQ ID NO: 1606210 - DNA, 13 bp, Homo sapiens
acttctatatttt

SEQ ID NO: 1606211 - DNA, 19 bp, Homo sapiens
acttctatattttaataga

SEQ ID NO: 1606212 - DNA, 22 bp, Homo sapiens
acttctcaaacctgtttaaata

SEQ ID NO: 1606213 - DNA, 23 bp, Homo sapiens
acttctcaagtcccttgttttgt

SEQ ID NO: 1606214 - DNA, 22 bp, Homo sapiens
acttctcatcatattgtatgta

SEQ ID NO: 1606215 - DNA, 15 bp, Homo sapiens
acttctcccctgccc

SEQ ID NO: 1606216 - DNA, 15 bp, Homo sapiens
acttctcccctgggt

SEQ ID NO: 1606217 - DNA, 19 bp, Homo sapiens
acttctgaaataaatgttc

SEQ ID NO: 1606218 - DNA, 22 bp, Homo sapiens
acttctgacaaaggtggtaaat

SEQ ID NO: 1606219 - DNA, 23 bp, Homo sapiens
acttctgacaaaggtggtaaatt

SEQ ID NO: 1606220 - DNA, 20 bp, Homo sapiens
acttctgagatctgttgatt

SEQ ID NO: 1606221 - DNA, 19 bp, Homo sapiens
acttctgcaacaagcatgc

SEQ ID NO: 1606222 - DNA, 24 bp, Homo sapiens
acttctgcaacaagcatgcagctt

SEQ ID NO: 1606223 - DNA, 14 bp, Homo sapiens
acttctgctggcat

SEQ ID NO: 1606224 - DNA, 11 bp, Homo sapiens
acttctgcttt

SEQ ID NO: 1606225 - DNA, 18 bp, Homo sapiens
acttctgctttcacttaa

SEQ ID NO: 1606226 - DNA, 19 bp, Homo sapiens
acttctggaaggctggctg

SEQ ID NO: 1606227 - DNA, 22 bp, Homo sapiens
acttctggaaggctggctgagt

SEQ ID NO: 1606228 - DNA, 23 bp, Homo sapiens
acttctggagatggatccttcca

SEQ ID NO: 1606229 - DNA, 19 bp, Homo sapiens
acttctggcataactaaaa

SEQ ID NO: 1606230 - DNA, 23 bp, Homo sapiens
acttctggcttcagcccccacca

SEQ ID NO: 1606231 - DNA, 17 bp, Homo sapiens
acttctgggtggggcag

SEQ ID NO: 1606232 - DNA, 17 bp, Homo sapiens
acttctggtataattgt

SEQ ID NO: 1606233 - DNA, 19 bp, Homo sapiens
acttctggtataattgtgt

SEQ ID NO: 1606234 - DNA, 20 bp, Homo sapiens
acttctggtataattgtgta

SEQ ID NO: 1606235 - DNA, 15 bp, Homo sapiens
acttctggttgtatt

SEQ ID NO: 1606236 - DNA, 21 bp, Homo sapiens
acttctgtaattgtgtggatt

SEQ ID NO: 1606237 - DNA, 13 bp, Homo sapiens
acttctgtctcct

SEQ ID NO: 1606238 - DNA, 17 bp, Homo sapiens
acttctgtctcctgtct

SEQ ID NO: 1606239 - DNA, 20 bp, Homo sapiens
acttctgtgagacccccaca

SEQ ID NO: 1606240 - DNA, 17 bp, Homo sapiens
acttctgtgttcatttt

SEQ ID NO: 1606241 - DNA, 23 bp, Homo sapiens
acttctgtttgatcactgtgaac

SEQ ID NO: 1606242 - DNA, 18 bp, Homo sapiens
acttcttaaaaggagctc

SEQ ID NO: 1606243 - DNA, 20 bp, Homo sapiens
acttcttaaaggcctggaac

SEQ ID NO: 1606244 - DNA, 23 bp, Homo sapiens
acttcttattgcaaggcagtctc

SEQ ID NO: 1606245 - DNA, 22 bp, Homo sapiens
acttcttatttttcttaccaat

SEQ ID NO: 1606246 - DNA, 19 bp, Homo sapiens
acttcttcacctcttccac

SEQ ID NO: 1606247 - DNA, 14 bp, Homo sapiens
acttcttctccatc

SEQ ID NO: 1606248 - DNA, 16 bp, Homo sapiens
acttcttctcttagat

SEQ ID NO: 1606249 - DNA, 12 bp, Homo sapiens
acttcttgaagg

SEQ ID NO: 1606250 - DNA, 16 bp, Homo sapiens
acttcttgaaggtgct

SEQ ID NO: 1606251 - DNA, 13 bp, Homo sapiens
acttcttgaatat

SEQ ID NO: 1606252 - DNA, 19 bp, Homo sapiens
acttcttgcttctttctag

SEQ ID NO: 1606253 - DNA, 21 bp, Homo sapiens
acttctttagcatttttatgc

SEQ ID NO: 1606254 - DNA, 19 bp, Homo sapiens
acttgaaccatagttactg

SEQ ID NO: 1606255 - DNA, 17 bp, Homo sapiens
acttgaagcacttaagt

SEQ ID NO: 1606256 - DNA, 21 bp, Homo sapiens
acttgaagcctaaatttgtgc

SEQ ID NO: 1606257 - DNA, 22 bp, Homo sapiens
acttgaagcctaaatttgtgct

SEQ ID NO: 1606258 - DNA, 17 bp, Homo sapiens
acttgaagggccagagc

SEQ ID NO: 1606259 - DNA, 19 bp, Homo sapiens
acttgaagggccagagcca

SEQ ID NO: 1606260 - DNA, 16 bp, Homo sapiens
acttgaatgtgtcact

SEQ ID NO: 1606261 - DNA, 14 bp, Homo sapiens
acttgaatttcaaa

SEQ ID NO: 1606262 - DNA, 14 bp, Homo sapiens
acttgacattcctt

SEQ ID NO: 1606263 - DNA, 17 bp, Homo sapiens
acttgagaacttgacaa

SEQ ID NO: 1606264 - DNA, 23 bp, Homo sapiens
acttgagaacttgacaagttgcg

SEQ ID NO: 1606265 - DNA, 22 bp, Homo sapiens
acttgagatgtatgaaggcttt

SEQ ID NO: 1606266 - DNA, 21 bp, Homo sapiens
acttgagcctatatcagtcgt

SEQ ID NO: 1606267 - DNA, 21 bp, Homo sapiens
acttgagttacaccagacctg

SEQ ID NO: 1606268 - DNA, 22 bp, Homo sapiens
acttgagttggagtactatatt

SEQ ID NO: 1606269 - DNA, 22 bp, Homo sapiens
acttgataatattagtgattct

SEQ ID NO: 1606270 - DNA, 19 bp, Homo sapiens
acttgatacgtccgtgtgt

SEQ ID NO: 1606271 - DNA, 19 bp, Homo sapiens
acttgatatagaaagctgt

SEQ ID NO: 1606272 - DNA, 23 bp, Homo sapiens
acttgatgtacataactcctgtc

SEQ ID NO: 1606273 - DNA, 17 bp, Homo sapiens
acttgatgtttcctgga

SEQ ID NO: 1606274 - DNA, 20 bp, Homo sapiens
acttgatgtttcctggaagc

SEQ ID NO: 1606275 - DNA, 21 bp, Homo sapiens
acttgcaaccgtctgttatgc

SEQ ID NO: 1606276 - DNA, 23 bp, Homo sapiens
acttgcagctgatgttggaagag

SEQ ID NO: 1606277 - DNA, 14 bp, Homo sapiens
acttgcatgaatta

SEQ ID NO: 1606278 - DNA, 20 bp, Homo sapiens
acttgcatgaattactgtat

SEQ ID NO: 1606279 - DNA, 20 bp, Homo sapiens
acttgcattccagagttaaa

SEQ ID NO: 1606280 - DNA, 14 bp, Homo sapiens
acttgccatgcagg

SEQ ID NO: 1606281 - DNA, 21 bp, Homo sapiens
acttgccattccaaaatatta

SEQ ID NO: 1606282 - DNA, 22 bp, Homo sapiens
acttgccgtcccctaaggaaat

SEQ ID NO: 1606283 - DNA, 17 bp, Homo sapiens
acttgcctcatttccct

SEQ ID NO: 1606284 - DNA, 12 bp, Homo sapiens
acttgcctcttc

SEQ ID NO: 1606285 - DNA, 13 bp, Homo sapiens
acttgcctcttcc

SEQ ID NO: 1606286 - DNA, 17 bp, Homo sapiens
acttgcctggggtctga

SEQ ID NO: 1606287 - DNA, 13 bp, Homo sapiens
acttgcctgggtc

SEQ ID NO: 1606288 - DNA, 14 bp, Homo sapiens
acttgcctgggtca

SEQ ID NO: 1606289 - DNA, 13 bp, Homo sapiens
acttgcctgttgg

SEQ ID NO: 1606290 - DNA, 15 bp, Homo sapiens
acttgcctgttggct

SEQ ID NO: 1606291 - DNA, 20 bp, Homo sapiens
acttgcctgttggctgctgc

SEQ ID NO: 1606292 - DNA, 16 bp, Homo sapiens
acttgcgtcctgcaga

SEQ ID NO: 1606293 - DNA, 17 bp, Homo sapiens
acttgcgtcctgcagag

SEQ ID NO: 1606294 - DNA, 14 bp, Homo sapiens
acttgctaaagcac

SEQ ID NO: 1606295 - DNA, 16 bp, Homo sapiens
acttgctaaagcactt

SEQ ID NO: 1606296 - DNA, 13 bp, Homo sapiens
acttgctcccaac

SEQ ID NO: 1606297 - DNA, 14 bp, Homo sapiens
acttgctcccaacc

SEQ ID NO: 1606298 - DNA, 15 bp, Homo sapiens
acttgctgctgtctt

SEQ ID NO: 1606299 - DNA, 21 bp, Homo sapiens
acttgctgtgtgaccctgggc

SEQ ID NO: 1606300 - DNA, 22 bp, Homo sapiens
actttctatagcagattgtgta

SEQ ID NO: 1606301 - DNA, 13 bp, Homo sapiens
actttctcagttt

SEQ ID NO: 1606302 - DNA, 19 bp, Homo sapiens
actttctgttaaaatgcat

SEQ ID NO: 1606303 - DNA, 22 bp, Homo sapiens
actttctgttaaaatgcatgat

SEQ ID NO: 1606304 - DNA, 23 bp, Homo sapiens
actttctgttaaaatgcatgatt

SEQ ID NO: 1606305 - DNA, 23 bp, Homo sapiens
actttgaagcaaatacaattcac

SEQ ID NO: 1606306 - DNA, 21 bp, Homo sapiens
actttgaagggcaagaaatgg

SEQ ID NO: 1606307 - DNA, 23 bp, Homo sapiens
actttgaagggcaagaaatggcg

SEQ ID NO: 1606308 - DNA, 14 bp, Homo sapiens
actttgacagtgtt

SEQ ID NO: 1606309 - DNA, 18 bp, Homo sapiens
actttgacagtgttttta

SEQ ID NO: 1606310 - DNA, 15 bp, Homo sapiens
actttgactttttgc

SEQ ID NO: 1606311 - DNA, 21 bp, Homo sapiens
actttgagatctaaaaataac

SEQ ID NO: 1606312 - DNA, 13 bp, Homo sapiens
actttgcacttaa

SEQ ID NO: 1606313 - DNA, 15 bp, Homo sapiens
actttgccatttttc

SEQ ID NO: 1606314 - DNA, 23 bp, Homo sapiens
actttgcccagggtcctgtgcct

SEQ ID NO: 1606315 - DNA, 15 bp, Homo sapiens
actttgcccctttca

SEQ ID NO: 1606316 - DNA, 18 bp, Homo sapiens
actttgcttgagaatcct

SEQ ID NO: 1606317 - DNA, 14 bp, Homo sapiens
actttgcttgcttt

SEQ ID NO: 1606318 - DNA, 15 bp, Homo sapiens
actttggaacaagat

SEQ ID NO: 1606319 - DNA, 15 bp, Homo sapiens
actttggaaccagac

SEQ ID NO: 1606320 - DNA, 17 bp, Homo sapiens
actttggaaccagactc

SEQ ID NO: 1606321 - DNA, 21 bp, Homo sapiens
actttggaaccagactcttgc

SEQ ID NO: 1606322 - DNA, 23 bp, Homo sapiens
actttggaaccagactcttgcct

SEQ ID NO: 1606323 - DNA, 18 bp, Homo sapiens
actttggaagtttgtgtt

SEQ ID NO: 1606324 - DNA, 15 bp, Homo sapiens
actttggaatacatt

SEQ ID NO: 1606325 - DNA, 16 bp, Homo sapiens
actttggcaatttcct

SEQ ID NO: 1606326 - DNA, 17 bp, Homo sapiens
actttggctgaactaca

SEQ ID NO: 1606327 - DNA, 12 bp, Homo sapiens
actttgggaggc

SEQ ID NO: 1606328 - DNA, 16 bp, Homo sapiens
actttgggaggcaggg

SEQ ID NO: 1606329 - DNA, 15 bp, Homo sapiens
actttggtaggcaaa

SEQ ID NO: 1606330 - DNA, 23 bp, Homo sapiens
actttggtagtggaatagtgaat

SEQ ID NO: 1606331 - DNA, 23 bp, Homo sapiens
actttggtgcgggcacaataaat

SEQ ID NO: 1606332 - DNA, 15 bp, Homo sapiens
actttggtttttcca

SEQ ID NO: 1606333 - DNA, 12 bp, Homo sapiens
actttgtaaata

SEQ ID NO: 1606334 - DNA, 13 bp, Homo sapiens
actttgtaaatag

SEQ ID NO: 1606335 - DNA, 19 bp, Homo sapiens
actttgtatgtcatttcct

SEQ ID NO: 1606336 - DNA, 14 bp, Homo sapiens
actttgtgctcata

SEQ ID NO: 1606337 - DNA, 20 bp, Homo sapiens
actttgttaggattttcaca

SEQ ID NO: 1606338 - DNA, 13 bp, Homo sapiens
actttgttctgtt

SEQ ID NO: 1606339 - DNA, 15 bp, Homo sapiens
actttgttctgttgt

SEQ ID NO: 1606340 - DNA, 17 bp, Homo sapiens
actttgttctgttgtct

SEQ ID NO: 1606341 - DNA, 20 bp, Homo sapiens
actttgttctgttgtctgcg

SEQ ID NO: 1606342 - DNA, 20 bp, Homo sapiens
actttgttgcaagatgtgaa

SEQ ID NO: 1606343 - DNA, 12 bp, Homo sapiens
acttttaaacag

SEQ ID NO: 1606344 - DNA, 15 bp, Homo sapiens
acttttaaacagtga

SEQ ID NO: 1606345 - DNA, 14 bp, Homo sapiens
acttttaaactgtg

SEQ ID NO: 1606346 - DNA, 20 bp, Homo sapiens
acttttaaactgtgtacata

SEQ ID NO: 1606347 - DNA, 18 bp, Homo sapiens
acttttaaagaaaaatat

SEQ ID NO: 1606348 - DNA, 18 bp, Homo sapiens
acttttaaggataaatca

SEQ ID NO: 1606349 - DNA, 18 bp, Homo sapiens
acttttagaaatgcatat

SEQ ID NO: 1606350 - DNA, 20 bp, Homo sapiens
acttttatgatgtatattta

SEQ ID NO: 1606351 - DNA, 15 bp, Homo sapiens
acttttattaataaa

SEQ ID NO: 1606352 - DNA, 18 bp, Homo sapiens
acttttattttacacaga

SEQ ID NO: 1606353 - DNA, 15 bp, Homo sapiens
acttttattttcttt

SEQ ID NO: 1606354 - DNA, 16 bp, Homo sapiens
acttttcaagtattta

SEQ ID NO: 1606355 - DNA, 17 bp, Homo sapiens
acttttcaataaatcag

SEQ ID NO: 1606356 - DNA, 16 bp, Homo sapiens
acttttcacactgtct

SEQ ID NO: 1606357 - DNA, 20 bp, Homo sapiens
acttttcacactgtcttccc

SEQ ID NO: 1606358 - DNA, 23 bp, Homo sapiens
acttttcacactgtcttcccgat

SEQ ID NO: 1606359 - DNA, 15 bp, Homo sapiens
acttttcaccaatga

SEQ ID NO: 1606360 - DNA, 18 bp, Homo sapiens
acttttcattctctttta

SEQ ID NO: 1606361 - DNA, 17 bp, Homo sapiens
acttttccaatatgtga

SEQ ID NO: 1606362 - DNA, 12 bp, Homo sapiens
acttttcgttaa

SEQ ID NO: 1606363 - DNA, 22 bp, Homo sapiens
acttttctaagaaaagcatttt

SEQ ID NO: 1606364 - DNA, 12 bp, Homo sapiens
acttttctcttt

SEQ ID NO: 1606365 - DNA, 24 bp, Homo sapiens
acttttcttaaaccttcagttatg

SEQ ID NO: 1606366 - DNA, 12 bp, Homo sapiens
acttttcttaag

SEQ ID NO: 1606367 - DNA, 20 bp, Homo sapiens
acttttgagtgtgtgtgtgc

SEQ ID NO: 1606368 - DNA, 19 bp, Homo sapiens
acttttgtgtaatgaaaat

SEQ ID NO: 1606369 - DNA, 12 bp, Homo sapiens
acttttgttaaa

SEQ ID NO: 1606370 - DNA, 16 bp, Homo sapiens
acttttgttaaattca

SEQ ID NO: 1606371 - DNA, 17 bp, Homo sapiens
acttttgttaaattcag

SEQ ID NO: 1606372 - DNA, 22 bp, Homo sapiens
acttttgttaggaaaaaattga

SEQ ID NO: 1606373 - DNA, 20 bp, Homo sapiens
acttttgttagggctgcttt

SEQ ID NO: 1606374 - DNA, 16 bp, Homo sapiens
actttttagattattc

SEQ ID NO: 1606375 - DNA, 15 bp, Homo sapiens
actttttagtaattt

SEQ ID NO: 1606376 - DNA, 18 bp, Homo sapiens
actttttatactccatac

SEQ ID NO: 1606377 - DNA, 11 bp, Homo sapiens
actttttccag

SEQ ID NO: 1606378 - DNA, 16 bp, Homo sapiens
acttttttaaatattt

SEQ ID NO: 1606379 - DNA, 13 bp, Homo sapiens
acttttttatagc

SEQ ID NO: 1606380 - DNA, 16 bp, Homo sapiens
acttttttatgaagaa

SEQ ID NO: 1606381 - DNA, 21 bp, Homo sapiens
actttttttctgtaccagtta

SEQ ID NO: 1606382 - DNA, 23 bp, Homo sapiens
actttttttctgtaccagttaat

SEQ ID NO: 1606383 - DNA, 13 bp, Homo sapiens
actttttttcttt

SEQ ID NO: 1606384 - DNA, 13 bp, Homo sapiens
actttttttgtat

SEQ ID NO: 1606385 - DNA, 16 bp, Homo sapiens
acttttttttgagaat

SEQ ID NO: 1606386 - DNA, 16 bp, Homo sapiens
actttttttttatact

SEQ ID NO: 1606387 - DNA, 22 bp, Homo sapiens
actttttttttttctgcctgag

SEQ ID NO: 1606388 - DNA, 22 bp, Homo sapiens
agaaaaaaaaaagaaatgcaaa

SEQ ID NO: 1606389 - DNA, 17 bp, Homo sapiens
agaaaaaaaaccttgta

SEQ ID NO: 1606390 - DNA, 19 bp, Homo sapiens
agaaaaaaaaccttgtaaa

SEQ ID NO: 1606391 - DNA, 16 bp, Homo sapiens
agaaaaaaaagtgtct

SEQ ID NO: 1606392 - DNA, 23 bp, Homo sapiens
agaaaaaaaagtgtctcaaagga

SEQ ID NO: 1606393 - DNA, 17 bp, Homo sapiens
agaaaaaaaataacaca

SEQ ID NO: 1606394 - DNA, 18 bp, Homo sapiens
agaaaaaaaatagacttt

SEQ ID NO: 1606395 - DNA, 18 bp, Homo sapiens
agaaaaaaaccacacaaa

SEQ ID NO: 1606396 - DNA, 13 bp, Homo sapiens
agaaaaaaaccat

SEQ ID NO: 1606397 - DNA, 16 bp, Homo sapiens
agaaaaaaagggagaa

SEQ ID NO: 1606398 - DNA, 18 bp, Homo sapiens
agaaaaaacaatttttga

SEQ ID NO: 1606399 - DNA, 19 bp, Homo sapiens
agaaaaaacaatttttgaa

SEQ ID NO: 1606400 - DNA, 16 bp, Homo sapiens
agaaaaacatgtcatg

SEQ ID NO: 1606401 - DNA, 15 bp, Homo sapiens
agaaaaagaaatgca

SEQ ID NO: 1606402 - DNA, 14 bp, Homo sapiens
agaaaaaggcagtg

SEQ ID NO: 1606403 - DNA, 19 bp, Homo sapiens
agaaaaaggctgaaaagaa

SEQ ID NO: 1606404 - DNA, 14 bp, Homo sapiens
agaaaaaggggcct

SEQ ID NO: 1606405 - DNA, 19 bp, Homo sapiens
agaaaaataaaaatctctt

SEQ ID NO: 1606406 - DNA, 15 bp, Homo sapiens
agaaaaataaaatgt

SEQ ID NO: 1606407 - DNA, 16 bp, Homo sapiens
agaaaaataaaatgtt

SEQ ID NO: 1606408 - DNA, 15 bp, Homo sapiens
agaaaaataaccctt

SEQ ID NO: 1606409 - DNA, 11 bp, Homo sapiens
agaaaaatagg

SEQ ID NO: 1606410 - DNA, 12 bp, Homo sapiens
agaaaaatatga

SEQ ID NO: 1606411 - DNA, 11 bp, Homo sapiens
agaaaaatatt

SEQ ID NO: 1606412 - DNA, 13 bp, Homo sapiens
agaaaaatattta

SEQ ID NO: 1606413 - DNA, 21 bp, Homo sapiens
agaaaaatgagcatacatctt

SEQ ID NO: 1606414 - DNA, 20 bp, Homo sapiens
agaaaaattcagcaaaccat

SEQ ID NO: 1606415 - DNA, 15 bp, Homo sapiens
agaaaggaagcattg

SEQ ID NO: 1606416 - DNA, 17 bp, Homo sapiens
agaaaggaagcattgta

SEQ ID NO: 1606417 - DNA, 13 bp, Homo sapiens
agaaaggagagac

SEQ ID NO: 1606418 - DNA, 21 bp, Homo sapiens
agaaaggatatttaagaaaat

SEQ ID NO: 1606419 - DNA, 14 bp, Homo sapiens
agaaaggcagccct

SEQ ID NO: 1606420 - DNA, 22 bp, Homo sapiens
agaaaggcagccctcacctctg

SEQ ID NO: 1606421 - DNA, 20 bp, Homo sapiens
agaaaggggcagtttaaagc

SEQ ID NO: 1606422 - DNA, 22 bp, Homo sapiens
agaaagtaaggtgcttggagtt

SEQ ID NO: 1606423 - DNA, 18 bp, Homo sapiens
agaaagtcaaaaaattat

SEQ ID NO: 1606424 - DNA, 19 bp, Homo sapiens
agaaagtcaaaaaattatt

SEQ ID NO: 1606425 - DNA, 21 bp, Homo sapiens
agaaagtcattcgcgtggctc

SEQ ID NO: 1606426 - DNA, 13 bp, Homo sapiens
agaaagtctatgc

SEQ ID NO: 1606427 - DNA, 17 bp, Homo sapiens
agaaagtgataagtgca

SEQ ID NO: 1606428 - DNA, 19 bp, Homo sapiens
agaaagtgcctgacacact

SEQ ID NO: 1606429 - DNA, 21 bp, Homo sapiens
agaaagtggccatgccaccct

SEQ ID NO: 1606430 - DNA, 22 bp, Homo sapiens
agaaagtgggaggtcaggaaac

SEQ ID NO: 1606431 - DNA, 22 bp, Homo sapiens
agaaagtgggcttaatggagtt

SEQ ID NO: 1606432 - DNA, 12 bp, Homo sapiens
agaaataaaaat

SEQ ID NO: 1606433 - DNA, 21 bp, Homo sapiens
agaaataaagttggtgacaga

SEQ ID NO: 1606434 - DNA, 13 bp, Homo sapiens
agaaataaatgtt

SEQ ID NO: 1606435 - DNA, 11 bp, Homo sapiens
agaaataaatt

SEQ ID NO: 1606436 - DNA, 23 bp, Homo sapiens
agaaataaattcctaaactccct

SEQ ID NO: 1606437 - DNA, 14 bp, Homo sapiens
agaaataatatgca

SEQ ID NO: 1606438 - DNA, 16 bp, Homo sapiens
agaaataatatgcatt

SEQ ID NO: 1606439 - DNA, 17 bp, Homo sapiens
agaaataatgctacaat

SEQ ID NO: 1606440 - DNA, 19 bp, Homo sapiens
agaaataatgctacaattt

SEQ ID NO: 1606441 - DNA, 19 bp, Homo sapiens
agaaatacaattctacatt

SEQ ID NO: 1606442 - DNA, 18 bp, Homo sapiens
agaaatacagataaatga

SEQ ID NO: 1606443 - DNA, 21 bp, Homo sapiens
agaaatacataaaaaagtgtt

SEQ ID NO: 1606444 - DNA, 15 bp, Homo sapiens
agaaatactcatgtg

SEQ ID NO: 1606445 - DNA, 16 bp, Homo sapiens
agaaatagttctgtga

SEQ ID NO: 1606446 - DNA, 16 bp, Homo sapiens
agaaatataacacatt

SEQ ID NO: 1606447 - DNA, 17 bp, Homo sapiens
agaaatataacacattt

SEQ ID NO: 1606448 - DNA, 15 bp, Homo sapiens
agaaatatagtgcaa

SEQ ID NO: 1606449 - DNA, 14 bp, Homo sapiens
agaaatatattttt

SEQ ID NO: 1606450 - DNA, 16 bp, Homo sapiens
agaaatatattttttg

SEQ ID NO: 1606451 - DNA, 20 bp, Homo sapiens
agaaatatctgaaaatgtat

SEQ ID NO: 1606452 - DNA, 14 bp, Homo sapiens
agaaatatctttct

SEQ ID NO: 1606453 - DNA, 16 bp, Homo sapiens
agaaatatgattttat

SEQ ID NO: 1606454 - DNA, 22 bp, Homo sapiens
agaaatatgattttatttgaca

SEQ ID NO: 1606455 - DNA, 14 bp, Homo sapiens
agaaatattttaat

SEQ ID NO: 1606456 - DNA, 17 bp, Homo sapiens
agaaatcacagaatcat

SEQ ID NO: 1606457 - DNA, 14 bp, Homo sapiens
agaaatcagaggag

SEQ ID NO: 1606458 - DNA, 16 bp, Homo sapiens
agaaatcatgtccata

SEQ ID NO: 1606459 - DNA, 22 bp, Homo sapiens
agaaatcattgtagaaacacag

SEQ ID NO: 1606460 - DNA, 16 bp, Homo sapiens
agaaatccatatctta

SEQ ID NO: 1606461 - DNA, 18 bp, Homo sapiens
agaaatcctgcaatgaaa

SEQ ID NO: 1606462 - DNA, 19 bp, Homo sapiens
agaaatctggcccagggtg

SEQ ID NO: 1606463 - DNA, 20 bp, Homo sapiens
agaaatctgggatgtactgt

SEQ ID NO: 1606464 - DNA, 18 bp, Homo sapiens
agaaatgatgttggagaa

SEQ ID NO: 1606465 - DNA, 22 bp, Homo sapiens
agaaatgattcaaattgctgct

SEQ ID NO: 1606466 - DNA, 14 bp, Homo sapiens
agaaatgcaaaaat

SEQ ID NO: 1606467 - DNA, 15 bp, Homo sapiens
agaaatgcaataact

SEQ ID NO: 1606468 - DNA, 13 bp, Homo sapiens
agaaatgcatatt

SEQ ID NO: 1606469 - DNA, 15 bp, Homo sapiens
agaaatgcatattgt

SEQ ID NO: 1606470 - DNA, 22 bp, Homo sapiens
agaaatgcatatttgccacaaa

SEQ ID NO: 1606471 - DNA, 18 bp, Homo sapiens
agaaatgcatccattcct

SEQ ID NO: 1606472 - DNA, 22 bp, Homo sapiens
agaaatgcatccattcctcagg

SEQ ID NO: 1606473 - DNA, 12 bp, Homo sapiens
agaaatgctaat

SEQ ID NO: 1606474 - DNA, 13 bp, Homo sapiens
agaaatgctgcct

SEQ ID NO: 1606475 - DNA, 15 bp, Homo sapiens
agaaatgctgcctgc

SEQ ID NO: 1606476 - DNA, 13 bp, Homo sapiens
agaaatgctgctg

SEQ ID NO: 1606477 - DNA, 15 bp, Homo sapiens
agaaatgctgctggc

SEQ ID NO: 1606478 - DNA, 16 bp, Homo sapiens
agaaatggaaagcaga

SEQ ID NO: 1606479 - DNA, 16 bp, Homo sapiens
agaaatggcgtctgct

SEQ ID NO: 1606480 - DNA, 20 bp, Homo sapiens
agaaatggtttcctctggat

SEQ ID NO: 1606481 - DNA, 14 bp, Homo sapiens
agaaatgtcataaa

SEQ ID NO: 1606482 - DNA, 17 bp, Homo sapiens
agaaatgtcataaatta

SEQ ID NO: 1606483 - DNA, 11 bp, Homo sapiens
agaaattagaa

SEQ ID NO: 1606484 - DNA, 15 bp, Homo sapiens
agaaattagctgtgt

SEQ ID NO: 1606485 - DNA, 17 bp, Homo sapiens
agaaattagctgtgtga

SEQ ID NO: 1606486 - DNA, 19 bp, Homo sapiens
agaaattcaatttggattt

SEQ ID NO: 1606487 - DNA, 22 bp, Homo sapiens
agaaattcaatttggatttaaa

SEQ ID NO: 1606488 - DNA, 20 bp, Homo sapiens
agaaattcaggtacagaaaa

SEQ ID NO: 1606489 - DNA, 17 bp, Homo sapiens
agaaattctggcccagc

SEQ ID NO: 1606490 - DNA, 19 bp, Homo sapiens
agaaattctgtttttaaaa

SEQ ID NO: 1606491 - DNA, 20 bp, Homo sapiens
agaaattgcatttcctgaca

SEQ ID NO: 1606492 - DNA, 22 bp, Homo sapiens
agaaattggaacagaatgtttt

SEQ ID NO: 1606493 - DNA, 15 bp, Homo sapiens
agaaattggctggat

SEQ ID NO: 1606494 - DNA, 17 bp, Homo sapiens
agaaatttaattcatgt

SEQ ID NO: 1606495 - DNA, 13 bp, Homo sapiens
agaaattttgtaa

SEQ ID NO: 1606496 - DNA, 21 bp, Homo sapiens
agaaattttgtaagaaggcaa

SEQ ID NO: 1606497 - DNA, 13 bp, Homo sapiens
agaaatttttatt

SEQ ID NO: 1606498 - DNA, 18 bp, Homo sapiens
agaaatttttatttttga

SEQ ID NO: 1606499 - DNA, 13 bp, Homo sapiens
agaacaaatgtgt

SEQ ID NO: 1606500 - DNA, 18 bp, Homo sapiens
agaacaaatgtgtttttc

SEQ ID NO: 1606501 - DNA, 17 bp, Homo sapiens
agaacaaggtagttttt

SEQ ID NO: 1606502 - DNA, 20 bp, Homo sapiens
agaacaagtcacagctgcag

SEQ ID NO: 1606503 - DNA, 20 bp, Homo sapiens
agaacaataatgagagcaaa

SEQ ID NO: 1606504 - DNA, 17 bp, Homo sapiens
agaacacaaaacttgaa

SEQ ID NO: 1606505 - DNA, 18 bp, Homo sapiens
agaacacaaaacttgaaa

SEQ ID NO: 1606506 - DNA, 19 bp, Homo sapiens
agaacacaaaacttgaaag

SEQ ID NO: 1606507 - DNA, 15 bp, Homo sapiens
agaacacacagactt

SEQ ID NO: 1606508 - DNA, 20 bp, Homo sapiens
agaacacacagactttctgt

SEQ ID NO: 1606509 - DNA, 15 bp, Homo sapiens
agaacacagcatgtg

SEQ ID NO: 1606510 - DNA, 16 bp, Homo sapiens
agaacacagcatgtgc

SEQ ID NO: 1606511 - DNA, 11 bp, Homo sapiens
agaacacagtt

SEQ ID NO: 1606512 - DNA, 17 bp, Homo sapiens
agaacacctatgcaaag

SEQ ID NO: 1606513 - DNA, 18 bp, Homo sapiens
agaacactaactcaccag

SEQ ID NO: 1606514 - DNA, 14 bp, Homo sapiens
agaacactaattca

SEQ ID NO: 1606515 - DNA, 16 bp, Homo sapiens
agaacactaattcata

SEQ ID NO: 1606516 - DNA, 12 bp, Homo sapiens
agaacacttatg

SEQ ID NO: 1606517 - DNA, 13 bp, Homo sapiens
agaacagcagagg

SEQ ID NO: 1606518 - DNA, 17 bp, Homo sapiens
agaacaggcctctccat

SEQ ID NO: 1606519 - DNA, 22 bp, Homo sapiens
agaacagggaaaataggcagga

SEQ ID NO: 1606520 - DNA, 14 bp, Homo sapiens
agaacagtaaacat

SEQ ID NO: 1606521 - DNA, 20 bp, Homo sapiens
agaacagtggttgcctgggg

SEQ ID NO: 1606522 - DNA, 22 bp, Homo sapiens
agaacagtggttgcctgggggc

SEQ ID NO: 1606523 - DNA, 18 bp, Homo sapiens
agaacatcattagaacaa

SEQ ID NO: 1606524 - DNA, 20 bp, Homo sapiens
agaacatcattagaacaaag

SEQ ID NO: 1606525 - DNA, 14 bp, Homo sapiens
agaacatggacttg

SEQ ID NO: 1606526 - DNA, 19 bp, Homo sapiens
agaacatggacttgtatat

SEQ ID NO: 1606527 - DNA, 21 bp, Homo sapiens
agaacatgttaagataactta

SEQ ID NO: 1606528 - DNA, 17 bp, Homo sapiens
agaacattcagctctgg

SEQ ID NO: 1606529 - DNA, 16 bp, Homo sapiens
agaaccaaaacttcca

SEQ ID NO: 1606530 - DNA, 21 bp, Homo sapiens
agaataattcaattttaaaga

SEQ ID NO: 1606531 - DNA, 18 bp, Homo sapiens
agaatacagaaagatgga

SEQ ID NO: 1606532 - DNA, 12 bp, Homo sapiens
agaatacatcag

SEQ ID NO: 1606533 - DNA, 13 bp, Homo sapiens
agaatacatcaga

SEQ ID NO: 1606534 - DNA, 14 bp, Homo sapiens
agaatacatcagaa

SEQ ID NO: 1606535 - DNA, 19 bp, Homo sapiens
agaatacttttttctagtt

SEQ ID NO: 1606536 - DNA, 17 bp, Homo sapiens
agaatagaacacagttt

SEQ ID NO: 1606537 - DNA, 15 bp, Homo sapiens
agaatagagctgcca

SEQ ID NO: 1606538 - DNA, 17 bp, Homo sapiens
agaatagaggtcctcat

SEQ ID NO: 1606539 - DNA, 20 bp, Homo sapiens
agaatagatctgatggtgag

SEQ ID NO: 1606540 - DNA, 23 bp, Homo sapiens
agaatagatctgatggtgagctg

SEQ ID NO: 1606541 - DNA, 12 bp, Homo sapiens
agaatagcacag

SEQ ID NO: 1606542 - DNA, 18 bp, Homo sapiens
agaatagcagagagccaa

SEQ ID NO: 1606543 - DNA, 19 bp, Homo sapiens
agaatagcagagagccaaa

SEQ ID NO: 1606544 - DNA, 14 bp, Homo sapiens
agaatataacatgt

SEQ ID NO: 1606545 - DNA, 23 bp, Homo sapiens
agaatataattatcggaagcagt

SEQ ID NO: 1606546 - DNA, 11 bp, Homo sapiens
agaatatacct

SEQ ID NO: 1606547 - DNA, 13 bp, Homo sapiens
agaatatacctta

SEQ ID NO: 1606548 - DNA, 17 bp, Homo sapiens
agaatatccatgaccta

SEQ ID NO: 1606549 - DNA, 21 bp, Homo sapiens
agaatatgacaatctaccaac

SEQ ID NO: 1606550 - DNA, 17 bp, Homo sapiens
agaatatgtttcaaact

SEQ ID NO: 1606551 - DNA, 12 bp, Homo sapiens
agaatattcagg

SEQ ID NO: 1606552 - DNA, 13 bp, Homo sapiens
agaatattcagga

SEQ ID NO: 1606553 - DNA, 19 bp, Homo sapiens
agaatatttattacctctg

SEQ ID NO: 1606554 - DNA, 16 bp, Homo sapiens
agaatatttctattga

SEQ ID NO: 1606555 - DNA, 15 bp, Homo sapiens
agaatcaaatactca

SEQ ID NO: 1606556 - DNA, 17 bp, Homo sapiens
agaatcagatcatttca

SEQ ID NO: 1606557 - DNA, 19 bp, Homo sapiens
agaatcagtcttgcagctg

SEQ ID NO: 1606558 - DNA, 20 bp, Homo sapiens
agaatcatatgattctgctt

SEQ ID NO: 1606559 - DNA, 20 bp, Homo sapiens
agaatcatgtcgatcctggg

SEQ ID NO: 1606560 - DNA, 14 bp, Homo sapiens
agaatcatgtttct

SEQ ID NO: 1606561 - DNA, 15 bp, Homo sapiens
agaatcatgtttctt

SEQ ID NO: 1606562 - DNA, 17 bp, Homo sapiens
agaatccaaagatcaca

SEQ ID NO: 1606563 - DNA, 20 bp, Homo sapiens
agaatccacaaggacctctt

SEQ ID NO: 1606564 - DNA, 16 bp, Homo sapiens
agaatccacatttcta

SEQ ID NO: 1606565 - DNA, 20 bp, Homo sapiens
agaatccacatttctaaaat

SEQ ID NO: 1606566 - DNA, 14 bp, Homo sapiens
acttacacttataa

SEQ ID NO: 1606567 - DNA, 16 bp, Homo sapiens
acttacactttatgca

SEQ ID NO: 1606568 - DNA, 17 bp, Homo sapiens
acttacagctctggcca

SEQ ID NO: 1606569 - DNA, 15 bp, Homo sapiens
acttacatcatgtgt

SEQ ID NO: 1606570 - DNA, 19 bp, Homo sapiens
acttacctgagttgaagag

SEQ ID NO: 1606571 - DNA, 17 bp, Homo sapiens
acttacgtaaaacattt

SEQ ID NO: 1606572 - DNA, 14 bp, Homo sapiens
acttactagcttta

SEQ ID NO: 1606573 - DNA, 12 bp, Homo sapiens
acttactatttt

SEQ ID NO: 1606574 - DNA, 17 bp, Homo sapiens
acttactgtatatgtat

SEQ ID NO: 1606575 - DNA, 22 bp, Homo sapiens
acttactgtcagagaatatgac

SEQ ID NO: 1606576 - DNA, 15 bp, Homo sapiens
acttacttttgtaaa

SEQ ID NO: 1606577 - DNA, 19 bp, Homo sapiens
acttagaacctttctgtgt

SEQ ID NO: 1606578 - DNA, 19 bp, Homo sapiens
acttagactctagtattta

SEQ ID NO: 1606579 - DNA, 13 bp, Homo sapiens
acttagaggaaat

SEQ ID NO: 1606580 - DNA, 21 bp, Homo sapiens
acttagaggaaataagaaaaa

SEQ ID NO: 1606581 - DNA, 19 bp, Homo sapiens
acttagcatctaatttcaa

SEQ ID NO: 1606582 - DNA, 20 bp, Homo sapiens
acttagcctttacctgtgaa

SEQ ID NO: 1606583 - DNA, 21 bp, Homo sapiens
acttagcgtcaagacatttgc

SEQ ID NO: 1606584 - DNA, 23 bp, Homo sapiens
acttagcgtcaagacatttgctg

SEQ ID NO: 1606585 - DNA, 12 bp, Homo sapiens
acttagctcagg

SEQ ID NO: 1606586 - DNA, 15 bp, Homo sapiens
acttagctcaggtgc

SEQ ID NO: 1606587 - DNA, 16 bp, Homo sapiens
acttagctgtactata

SEQ ID NO: 1606588 - DNA, 20 bp, Homo sapiens
acttagctgtactataagta

SEQ ID NO: 1606589 - DNA, 18 bp, Homo sapiens
acttaggcatgcacagct

SEQ ID NO: 1606590 - DNA, 16 bp, Homo sapiens
acttaggcattaacat

SEQ ID NO: 1606591 - DNA, 20 bp, Homo sapiens
acttaggcattaacatgttt

SEQ ID NO: 1606592 - DNA, 21 bp, Homo sapiens
acttaggcttggctgccctgt

SEQ ID NO: 1606593 - DNA, 22 bp, Homo sapiens
acttaggttattttgctttggt

SEQ ID NO: 1606594 - DNA, 19 bp, Homo sapiens
acttagtatgcagttgata

SEQ ID NO: 1606595 - DNA, 19 bp, Homo sapiens
acttagtggtatgtctctt

SEQ ID NO: 1606596 - DNA, 17 bp, Homo sapiens
acttagttttgcatagt

SEQ ID NO: 1606597 - DNA, 13 bp, Homo sapiens
acttataaaataa

SEQ ID NO: 1606598 - DNA, 18 bp, Homo sapiens
acttatattttatgaaca

SEQ ID NO: 1606599 - DNA, 20 bp, Homo sapiens
acttatcatccacattgttt

SEQ ID NO: 1606600 - DNA, 18 bp, Homo sapiens
acttatctagaaagaaaa

SEQ ID NO: 1606601 - DNA, 21 bp, Homo sapiens
acttatctagaaagaaaagac

SEQ ID NO: 1606602 - DNA, 20 bp, Homo sapiens
acttatctctcaaaacaata

SEQ ID NO: 1606603 - DNA, 22 bp, Homo sapiens
acttatctctcaaaacaatatt

SEQ ID NO: 1606604 - DNA, 17 bp, Homo sapiens
acttatcttctggatta

SEQ ID NO: 1606605 - DNA, 21 bp, Homo sapiens
acttatgcaagatatttttga

SEQ ID NO: 1606606 - DNA, 23 bp, Homo sapiens
acttatgttactggtgtccagct

SEQ ID NO: 1606607 - DNA, 14 bp, Homo sapiens
acttatgtttttaa

SEQ ID NO: 1606608 - DNA, 15 bp, Homo sapiens
acttatgtttttaaa

SEQ ID NO: 1606609 - DNA, 14 bp, Homo sapiens
acttattactgcta

SEQ ID NO: 1606610 - DNA, 20 bp, Homo sapiens
acttattggaactctgcttg

SEQ ID NO: 1606611 - DNA, 21 bp, Homo sapiens
acttattggaactctgcttga

SEQ ID NO: 1606612 - DNA, 17 bp, Homo sapiens
acttattgtccaggtga

SEQ ID NO: 1606613 - DNA, 12 bp, Homo sapiens
acttatttaaaa

SEQ ID NO: 1606614 - DNA, 20 bp, Homo sapiens
acttatttaaaaatatttca

SEQ ID NO: 1606615 - DNA, 21 bp, Homo sapiens
acttatttaaaaatatttcag

SEQ ID NO: 1606616 - DNA, 11 bp, Homo sapiens
acttatttctg

SEQ ID NO: 1606617 - DNA, 13 bp, Homo sapiens
acttatttttctg

SEQ ID NO: 1606618 - DNA, 16 bp, Homo sapiens
acttatttttgacagt

SEQ ID NO: 1606619 - DNA, 15 bp, Homo sapiens
acttcaaagcaagct

SEQ ID NO: 1606620 - DNA, 22 bp, Homo sapiens
acttcaagcagaatcctcagtt

SEQ ID NO: 1606621 - DNA, 15 bp, Homo sapiens
acttcaatgatagta

SEQ ID NO: 1606622 - DNA, 16 bp, Homo sapiens
acttcacacacaggca

SEQ ID NO: 1606623 - DNA, 19 bp, Homo sapiens
acttcacacacaggcaact

SEQ ID NO: 1606624 - DNA, 13 bp, Homo sapiens
acttcacactgca

SEQ ID NO: 1606625 - DNA, 23 bp, Homo sapiens
acttcacactgcaagagccttgg

SEQ ID NO: 1606626 - DNA, 15 bp, Homo sapiens
acttcacagcgtctg

SEQ ID NO: 1606627 - DNA, 22 bp, Homo sapiens
acttcacagtgacactggacca

SEQ ID NO: 1606628 - DNA, 17 bp, Homo sapiens
acttcacataggaaggg

SEQ ID NO: 1606629 - DNA, 21 bp, Homo sapiens
acttcactgtcaggaagaaat

SEQ ID NO: 1606630 - DNA, 13 bp, Homo sapiens
acttcactgtgag

SEQ ID NO: 1606631 - DNA, 12 bp, Homo sapiens
acttcagaaaga

SEQ ID NO: 1606632 - DNA, 20 bp, Homo sapiens
acttcagcttaataagtatt

SEQ ID NO: 1606633 - DNA, 17 bp, Homo sapiens
acttcaggaacaagtaa

SEQ ID NO: 1606634 - DNA, 18 bp, Homo sapiens
acttcaggctcttctcct

SEQ ID NO: 1606635 - DNA, 21 bp, Homo sapiens
acttcagggcagggctctgat

SEQ ID NO: 1606636 - DNA, 22 bp, Homo sapiens
acttcagtgaatatttttgtat

SEQ ID NO: 1606637 - DNA, 13 bp, Homo sapiens
acttcatggacca

SEQ ID NO: 1606638 - DNA, 22 bp, Homo sapiens
acttcatggcctttgataaatg

SEQ ID NO: 1606639 - DNA, 19 bp, Homo sapiens
acttcattctaaaccaaaa

SEQ ID NO: 1606640 - DNA, 15 bp, Homo sapiens
acttcattcttgaaa

SEQ ID NO: 1606641 - DNA, 20 bp, Homo sapiens
acttcatttgacacaaagct

SEQ ID NO: 1606642 - DNA, 20 bp, Homo sapiens
acttccaaacctgacagatg

SEQ ID NO: 1606643 - DNA, 18 bp, Homo sapiens
acttccaaagaaagttct

SEQ ID NO: 1606644 - DNA, 20 bp, Homo sapiens
acttccaaagggttaggact

SEQ ID NO: 1606645 - DNA, 22 bp, Homo sapiens
acttccacaagagtgaatttga

SEQ ID NO: 1606646 - DNA, 15 bp, Homo sapiens
acttccaccagcctg

SEQ ID NO: 1606647 - DNA, 16 bp, Homo sapiens
acttccaggggaacct

SEQ ID NO: 1606648 - DNA, 21 bp, Homo sapiens
acttccagtgttggctgtgtg

SEQ ID NO: 1606649 - DNA, 22 bp, Homo sapiens
acttccagtgttggctgtgtga

SEQ ID NO: 1606650 - DNA, 22 bp, Homo sapiens
acttccataggacatactgcat

SEQ ID NO: 1606651 - DNA, 12 bp, Homo sapiens
acttccatgcct

SEQ ID NO: 1606652 - DNA, 14 bp, Homo sapiens
acttcccactgttc

SEQ ID NO: 1606653 - DNA, 23 bp, Homo sapiens
acttcccagctaggaagagcagg

SEQ ID NO: 1606654 - DNA, 19 bp, Homo sapiens
acttccccagctctcagta

SEQ ID NO: 1606655 - DNA, 13 bp, Homo sapiens
acttcccctgggc

SEQ ID NO: 1606656 - DNA, 19 bp, Homo sapiens
acttcccgggccagggctg

SEQ ID NO: 1606657 - DNA, 16 bp, Homo sapiens
acttcccgtctcagaa

SEQ ID NO: 1606658 - DNA, 14 bp, Homo sapiens
acttccctagtccc

SEQ ID NO: 1606659 - DNA, 22 bp, Homo sapiens
acttccctgctccaacccccgc

SEQ ID NO: 1606660 - DNA, 18 bp, Homo sapiens
acttccctggaggagaag

SEQ ID NO: 1606661 - DNA, 12 bp, Homo sapiens
acttcccttcct

SEQ ID NO: 1606662 - DNA, 14 bp, Homo sapiens
acttcccttcctcc

SEQ ID NO: 1606663 - DNA, 14 bp, Homo sapiens
acttccctttctgc

SEQ ID NO: 1606664 - DNA, 22 bp, Homo sapiens
acttaaatgttatgtatatggt

SEQ ID NO: 1606665 - DNA, 17 bp, Homo sapiens
acttaaattttaattta

SEQ ID NO: 1606666 - DNA, 16 bp, Homo sapiens
acttaagaaacactga

SEQ ID NO: 1606667 - DNA, 20 bp, Homo sapiens
acttaagacaaatgggactg

SEQ ID NO: 1606668 - DNA, 16 bp, Homo sapiens
acttaagtcttcctta

SEQ ID NO: 1606669 - DNA, 16 bp, Homo sapiens
acttaagtgcactttt

SEQ ID NO: 1606670 - DNA, 13 bp, Homo sapiens
acttaataaattc

SEQ ID NO: 1606671 - DNA, 17 bp, Homo sapiens
acttaataaattcagat

SEQ ID NO: 1606672 - DNA, 21 bp, Homo sapiens
acttaataatttttacctaat

SEQ ID NO: 1606673 - DNA, 19 bp, Homo sapiens
acttaatactcaaatgagt

SEQ ID NO: 1606674 - DNA, 15 bp, Homo sapiens
acttacaaaatgcca

SEQ ID NO: 1606675 - DNA, 17 bp, Homo sapiens
acttacaaaatgccaag

SEQ ID NO: 1606676 - DNA, 23 bp, Homo sapiens
acttacaaaatgccaagggggtg

SEQ ID NO: 1606677 - DNA, 16 bp, Homo sapiens
acctgcaggctccatg

SEQ ID NO: 1606678 - DNA, 12 bp, Homo sapiens
acctgcaggctt

SEQ ID NO: 1606679 - DNA, 21 bp, Homo sapiens
acctgcaggcttaggtcctca

SEQ ID NO: 1606680 - DNA, 23 bp, Homo sapiens
acctgcaggcttaggtcctcact

SEQ ID NO: 1606681 - DNA, 19 bp, Homo sapiens
acctgcagtgccagctccc

SEQ ID NO: 1606682 - DNA, 18 bp, Homo sapiens
acctgcagttaacaggat

SEQ ID NO: 1606683 - DNA, 18 bp, Homo sapiens
acctgcatccttcctggg

SEQ ID NO: 1606684 - DNA, 17 bp, Homo sapiens
acctgcatctggggccc

SEQ ID NO: 1606685 - DNA, 21 bp, Homo sapiens
acctgcatttgtatgtgtccc

SEQ ID NO: 1606686 - DNA, 21 bp, Homo sapiens
acctgccacccccttccctgg

SEQ ID NO: 1606687 - DNA, 14 bp, Homo sapiens
acctgccagcctgg

SEQ ID NO: 1606688 - DNA, 15 bp, Homo sapiens
acctgccaggcaggg

SEQ ID NO: 1606689 - DNA, 20 bp, Homo sapiens
acctgccaggcaggggtggg

SEQ ID NO: 1606690 - DNA, 19 bp, Homo sapiens
acctgccatgccaggaacc

SEQ ID NO: 1606691 - DNA, 17 bp, Homo sapiens
acctgccccgcccagct

SEQ ID NO: 1606692 - DNA, 12 bp, Homo sapiens
acctgccctctc

SEQ ID NO: 1606693 - DNA, 19 bp, Homo sapiens
acctgccctgcctgagggc

SEQ ID NO: 1606694 - DNA, 19 bp, Homo sapiens
acctgccgcatgctccctc

SEQ ID NO: 1606695 - DNA, 15 bp, Homo sapiens
acctgcctccaccag

SEQ ID NO: 1606696 - DNA, 19 bp, Homo sapiens
acctgcctccaccagcaag

SEQ ID NO: 1606697 - DNA, 14 bp, Homo sapiens
acctgcctcctgcc

SEQ ID NO: 1606698 - DNA, 14 bp, Homo sapiens
acctgcctggtgca

SEQ ID NO: 1606699 - DNA, 20 bp, Homo sapiens
acctgcctggtgcattgctg

SEQ ID NO: 1606700 - DNA, 13 bp, Homo sapiens
acctgcctgtacc

SEQ ID NO: 1606701 - DNA, 15 bp, Homo sapiens
acctgcctgtgtgct

SEQ ID NO: 1606702 - DNA, 23 bp, Homo sapiens
acctgcgagggccgcccgctccc

SEQ ID NO: 1606703 - DNA, 17 bp, Homo sapiens
acctgcgcacaggtggg

SEQ ID NO: 1606704 - DNA, 16 bp, Homo sapiens
acctgctagaacctct

SEQ ID NO: 1606705 - DNA, 20 bp, Homo sapiens
acctgctcacgtcaaatgca

SEQ ID NO: 1606706 - DNA, 23 bp, Homo sapiens
acctgctccagaagatgccagct

SEQ ID NO: 1606707 - DNA, 12 bp, Homo sapiens
acctgctcccag

SEQ ID NO: 1606708 - DNA, 22 bp, Homo sapiens
acctgctctccggcgcagacag

SEQ ID NO: 1606709 - DNA, 16 bp, Homo sapiens
acctgctgagagaccc

SEQ ID NO: 1606710 - DNA, 20 bp, Homo sapiens
acctgctgcgtccccactcc

SEQ ID NO: 1606711 - DNA, 10 bp, Homo sapiens
acctgctgct

SEQ ID NO: 1606712 - DNA, 16 bp, Homo sapiens
acctgctgctccatgg

SEQ ID NO: 1606713 - DNA, 17 bp, Homo sapiens
acctgctgctccatgga

SEQ ID NO: 1606714 - DNA, 18 bp, Homo sapiens
acgtacttagcagctatc

SEQ ID NO: 1606715 - DNA, 24 bp, Homo sapiens
acgtagcttctaccatgaacagaa

SEQ ID NO: 1606716 - DNA, 13 bp, Homo sapiens
acgtataaatatc

SEQ ID NO: 1606717 - DNA, 23 bp, Homo sapiens
acgtataaatatcagtattctga

SEQ ID NO: 1606718 - DNA, 16 bp, Homo sapiens
acgtatattgtatcat

SEQ ID NO: 1606719 - DNA, 17 bp, Homo sapiens
acgtattcattcagtga

SEQ ID NO: 1606720 - DNA, 16 bp, Homo sapiens
acgtattgctgtgtct

SEQ ID NO: 1606721 - DNA, 21 bp, Homo sapiens
acgtattgctgtgtctcctct

SEQ ID NO: 1606722 - DNA, 16 bp, Homo sapiens
acgtattggtccagct

SEQ ID NO: 1606723 - DNA, 21 bp, Homo sapiens
acgtatttatatttggaaaga

SEQ ID NO: 1606724 - DNA, 17 bp, Homo sapiens
acgtcagacttggctca

SEQ ID NO: 1606725 - DNA, 13 bp, Homo sapiens
acgtcagcctctt

SEQ ID NO: 1606726 - DNA, 13 bp, Homo sapiens
acgtcatctcagg

SEQ ID NO: 1606727 - DNA, 23 bp, Homo sapiens
acgtcattaaggttatgcactgc

SEQ ID NO: 1606728 - DNA, 21 bp, Homo sapiens
acgtcccagcatccctggagc

SEQ ID NO: 1606729 - DNA, 19 bp, Homo sapiens
acgtcccgctgctgtgctc

SEQ ID NO: 1606730 - DNA, 18 bp, Homo sapiens
acgtccgtgtgtcccaga

SEQ ID NO: 1606731 - DNA, 16 bp, Homo sapiens
acgtcctgagaaagct

SEQ ID NO: 1606732 - DNA, 19 bp, Homo sapiens
acgtcggccgaccaggctg

SEQ ID NO: 1606733 - DNA, 20 bp, Homo sapiens
acgtctcctcctcgaagcca

SEQ ID NO: 1606734 - DNA, 17 bp, Homo sapiens
acgtctctgccgcctgc

SEQ ID NO: 1606735 - DNA, 14 bp, Homo sapiens
acgtctgccaggcc

SEQ ID NO: 1606736 - DNA, 17 bp, Homo sapiens
acgtctgccaggcccat

SEQ ID NO: 1606737 - DNA, 19 bp, Homo sapiens
acgtctgccaggcccatct

SEQ ID NO: 1606738 - DNA, 18 bp, Homo sapiens
acgtctgtgacttatcta

SEQ ID NO: 1606739 - DNA, 13 bp, Homo sapiens
acgtcttgctatt

SEQ ID NO: 1606740 - DNA, 13 bp, Homo sapiens
acgtgaaatactt

SEQ ID NO: 1606741 - DNA, 21 bp, Homo sapiens
acgtgaccggacttttctgca

SEQ ID NO: 1606742 - DNA, 14 bp, Homo sapiens
acgtgactgcccca

SEQ ID NO: 1606743 - DNA, 20 bp, Homo sapiens
acgtgagagaaagagagaag

SEQ ID NO: 1606744 - DNA, 22 bp, Homo sapiens
acgtgagagaaagagagaagcc

SEQ ID NO: 1606745 - DNA, 23 bp, Homo sapiens
acgtgagagaaagagagaagcca

SEQ ID NO: 1606746 - DNA, 21 bp, Homo sapiens
acgtgatctctgttacaaaag

SEQ ID NO: 1606747 - DNA, 14 bp, Homo sapiens
acgtgatgtgccac

SEQ ID NO: 1606748 - DNA, 16 bp, Homo sapiens
acgtgatgtgccacta

SEQ ID NO: 1606749 - DNA, 14 bp, Homo sapiens
acgtgcaaagccaa

SEQ ID NO: 1606750 - DNA, 11 bp, Homo sapiens
acgtgcacagg

SEQ ID NO: 1606751 - DNA, 23 bp, Homo sapiens
acgtgcacctgtactcaggaggc

SEQ ID NO: 1606752 - DNA, 13 bp, Homo sapiens
acgtgcactgtga

SEQ ID NO: 1606753 - DNA, 15 bp, Homo sapiens
acgtgcaggacagct

SEQ ID NO: 1606754 - DNA, 18 bp, Homo sapiens
acgtgcaggacagctctt

SEQ ID NO: 1606755 - DNA, 20 bp, Homo sapiens
acgtgcatgctgtagctgca

SEQ ID NO: 1606756 - DNA, 18 bp, Homo sapiens
acgtgccagatataactg

SEQ ID NO: 1606757 - DNA, 18 bp, Homo sapiens
acgtgccaggcccggggc

SEQ ID NO: 1606758 - DNA, 23 bp, Homo sapiens
acgtgcctgtgatcccagctact

SEQ ID NO: 1606759 - DNA, 19 bp, Homo sapiens
acgtgccttttgcacccct

SEQ ID NO: 1606760 - DNA, 22 bp, Homo sapiens
acgtgccttttgcacccctccc

SEQ ID NO: 1606761 - DNA, 16 bp, Homo sapiens
acgtgcgacagagaga

SEQ ID NO: 1606762 - DNA, 17 bp, Homo sapiens
acgtgctaggggatgag

SEQ ID NO: 1606763 - DNA, 15 bp, Homo sapiens
acgtggcccagagaa

SEQ ID NO: 1606764 - DNA, 18 bp, Homo sapiens
acgtggcctccgcagtgt

SEQ ID NO: 1606765 - DNA, 21 bp, Homo sapiens
acgtggcctccgcagtgtctc

SEQ ID NO: 1606766 - DNA, 13 bp, Homo sapiens
acgtgggaggctg

SEQ ID NO: 1606767 - DNA, 22 bp, Homo sapiens
acgtgtaaccagttataaatac

SEQ ID NO: 1606768 - DNA, 22 bp, Homo sapiens
acgtgtcagaagcctccaagcc

SEQ ID NO: 1606769 - DNA, 22 bp, Homo sapiens
acgtgtccgtccacccttccat

SEQ ID NO: 1606770 - DNA, 20 bp, Homo sapiens
acgtgttaggaggctgcatg

SEQ ID NO: 1606771 - DNA, 23 bp, Homo sapiens
acgtgttaggaggctgcatgctc

SEQ ID NO: 1606772 - DNA, 22 bp, Homo sapiens
acgtgttcattttattttcatg

SEQ ID NO: 1606773 - DNA, 11 bp, Homo sapiens
acgtgtttaaa

SEQ ID NO: 1606774 - DNA, 23 bp, Homo sapiens
acgttaacccatttttgagccaa

SEQ ID NO: 1606775 - DNA, 16 bp, Homo sapiens
acgttcatcacctgct

SEQ ID NO: 1606776 - DNA, 14 bp, Homo sapiens
acgttcctaagctg

SEQ ID NO: 1606777 - DNA, 16 bp, Homo sapiens
acgttccttactgcag

SEQ ID NO: 1606778 - DNA, 20 bp, Homo sapiens
acgttccttactgcagaata

SEQ ID NO: 1606779 - DNA, 21 bp, Homo sapiens
acgttccttactgcagaatag

SEQ ID NO: 1606780 - DNA, 17 bp, Homo sapiens
acgttctcacacccacc

SEQ ID NO: 1606781 - DNA, 21 bp, Homo sapiens
acgttgccaggggcttgagaa

SEQ ID NO: 1606782 - DNA, 18 bp, Homo sapiens
acgtttaatcccagcact

SEQ ID NO: 1606783 - DNA, 14 bp, Homo sapiens
acgtttataaacag

SEQ ID NO: 1606784 - DNA, 16 bp, Homo sapiens
acgtttataaacagaa

SEQ ID NO: 1606785 - DNA, 18 bp, Homo sapiens
acgtttccccgaagagtc

SEQ ID NO: 1606786 - DNA, 15 bp, Homo sapiens
acgtttcctgagaag

SEQ ID NO: 1606787 - DNA, 12 bp, Homo sapiens
acgtttctggaa

SEQ ID NO: 1606788 - DNA, 17 bp, Homo sapiens
acgttttggttctatgc

SEQ ID NO: 1606789 - DNA, 17 bp, Homo sapiens
acgttttttcctcagtg

SEQ ID NO: 1606790 - DNA, 15 bp, Homo sapiens
actaaaaaaaagatg

SEQ ID NO: 1606791 - DNA, 14 bp, Homo sapiens
actaaaattaagta

SEQ ID NO: 1606792 - DNA, 15 bp, Homo sapiens
actaaaattaatgca

SEQ ID NO: 1606793 - DNA, 14 bp, Homo sapiens
actaaaattcaaca

SEQ ID NO: 1606794 - DNA, 22 bp, Homo sapiens
actaaaattcaacaaatgatgt

SEQ ID NO: 1606795 - DNA, 14 bp, Homo sapiens
actaaacattttgt

SEQ ID NO: 1606796 - DNA, 17 bp, Homo sapiens
actaaactttttttctg

SEQ ID NO: 1606797 - DNA, 14 bp, Homo sapiens
actaaagagagaat

SEQ ID NO: 1606798 - DNA, 16 bp, Homo sapiens
actaaagagagaatgt

SEQ ID NO: 1606799 - DNA, 15 bp, Homo sapiens
actaaagagtgaatg

SEQ ID NO: 1606800 - DNA, 20 bp, Homo sapiens
actaaagcatgaaatgtgaa

SEQ ID NO: 1606801 - DNA, 22 bp, Homo sapiens
actaaagcatgaaatgtgaatt

SEQ ID NO: 1606802 - DNA, 16 bp, Homo sapiens
actaaagctatgttac

SEQ ID NO: 1606803 - DNA, 15 bp, Homo sapiens
actaaagttgtactt

SEQ ID NO: 1606804 - DNA, 18 bp, Homo sapiens
actaaatcagagacaaaa

SEQ ID NO: 1606805 - DNA, 19 bp, Homo sapiens
actaaatcagagacaaaat

SEQ ID NO: 1606806 - DNA, 14 bp, Homo sapiens
actaaatcccctca

SEQ ID NO: 1606807 - DNA, 14 bp, Homo sapiens
actaaatgagctcc

SEQ ID NO: 1606808 - DNA, 20 bp, Homo sapiens
actaaattcgtgattttcaa

SEQ ID NO: 1606809 - DNA, 18 bp, Homo sapiens
actaaattgtatacattt

SEQ ID NO: 1606810 - DNA, 14 bp, Homo sapiens
actaacaagaatgt

SEQ ID NO: 1606811 - DNA, 18 bp, Homo sapiens
actaacaggccaaagagt

SEQ ID NO: 1606812 - DNA, 15 bp, Homo sapiens
actaacagggagaag

SEQ ID NO: 1606813 - DNA, 15 bp, Homo sapiens
actaacatataatgt

SEQ ID NO: 1606814 - DNA, 17 bp, Homo sapiens
actaacatgtcctgcct

SEQ ID NO: 1606815 - DNA, 21 bp, Homo sapiens
actaaccaagctgagtttcct

SEQ ID NO: 1606816 - DNA, 16 bp, Homo sapiens
actaaccatccccaac

SEQ ID NO: 1606817 - DNA, 19 bp, Homo sapiens
actaaccatccccaactcc

SEQ ID NO: 1606818 - DNA, 17 bp, Homo sapiens
actaaccccaacgcaca

SEQ ID NO: 1606819 - DNA, 15 bp, Homo sapiens
actaactatgcatgg

SEQ ID NO: 1606820 - DNA, 15 bp, Homo sapiens
actaactcaaataca

SEQ ID NO: 1606821 - DNA, 15 bp, Homo sapiens
actaagaaacacatc

SEQ ID NO: 1606822 - DNA, 14 bp, Homo sapiens
actaagaagaaaat

SEQ ID NO: 1606823 - DNA, 18 bp, Homo sapiens
actaagaattcaaactgg

SEQ ID NO: 1606824 - DNA, 17 bp, Homo sapiens
actaagagaaactgtgt

SEQ ID NO: 1606825 - DNA, 20 bp, Homo sapiens
actaagaggaaagtacattt

SEQ ID NO: 1606826 - DNA, 21 bp, Homo sapiens
actaagaggaaagtacatttt

SEQ ID NO: 1606827 - DNA, 18 bp, Homo sapiens
actaagatgttcactgtg

SEQ ID NO: 1606828 - DNA, 16 bp, Homo sapiens
actccatacagcctct

SEQ ID NO: 1606829 - DNA, 17 bp, Homo sapiens
actccatacagcctcta

SEQ ID NO: 1606830 - DNA, 21 bp, Homo sapiens
actccatacagcctctacagc

SEQ ID NO: 1606831 - DNA, 21 bp, Homo sapiens
actccatcgccatcttcttcc

SEQ ID NO: 1606832 - DNA, 22 bp, Homo sapiens
actccatcgccatcttcttccc

SEQ ID NO: 1606833 - DNA, 16 bp, Homo sapiens
actccatctcaaaaca

SEQ ID NO: 1606834 - DNA, 20 bp, Homo sapiens
actccatctcaaaacaaaac

SEQ ID NO: 1606835 - DNA, 13 bp, Homo sapiens
actccatgctcct

SEQ ID NO: 1606836 - DNA, 13 bp, Homo sapiens
actccatggccac

SEQ ID NO: 1606837 - DNA, 14 bp, Homo sapiens
actccatggccacc

SEQ ID NO: 1606838 - DNA, 16 bp, Homo sapiens
actccatggccacccc

SEQ ID NO: 1606839 - DNA, 20 bp, Homo sapiens
actccatggggttcgagact

SEQ ID NO: 1606840 - DNA, 16 bp, Homo sapiens
actcccaaccctggct

SEQ ID NO: 1606841 - DNA, 18 bp, Homo sapiens
actcccaacttcttcctg

SEQ ID NO: 1606842 - DNA, 19 bp, Homo sapiens
actcccaaggttggagccc

SEQ ID NO: 1606843 - DNA, 14 bp, Homo sapiens
actcccacctgaca

SEQ ID NO: 1606844 - DNA, 16 bp, Homo sapiens
actcccacctgacaca

SEQ ID NO: 1606845 - DNA, 15 bp, Homo sapiens
actcccatctgattt

SEQ ID NO: 1606846 - DNA, 19 bp, Homo sapiens
actccccagagctgtgcca

SEQ ID NO: 1606847 - DNA, 14 bp, Homo sapiens
actccccagcccca

SEQ ID NO: 1606848 - DNA, 17 bp, Homo sapiens
actccccagccccaccc

SEQ ID NO: 1606849 - DNA, 12 bp, Homo sapiens
actccccaggga

SEQ ID NO: 1606850 - DNA, 14 bp, Homo sapiens
actccccagggagc

SEQ ID NO: 1606851 - DNA, 16 bp, Homo sapiens
actccccagggagctc

SEQ ID NO: 1606852 - DNA, 20 bp, Homo sapiens
actccccagggagctctggg

SEQ ID NO: 1606853 - DNA, 12 bp, Homo sapiens
actcccctgcac

SEQ ID NO: 1606854 - DNA, 16 bp, Homo sapiens
actcccctgcactgga

SEQ ID NO: 1606855 - DNA, 19 bp, Homo sapiens
actcccggcctaggcacct

SEQ ID NO: 1606856 - DNA, 20 bp, Homo sapiens
actccctccaccagcctgct

SEQ ID NO: 1606857 - DNA, 22 bp, Homo sapiens
actccctccaccagcctgctga

SEQ ID NO: 1606858 - DNA, 13 bp, Homo sapiens
actccctcctcac

SEQ ID NO: 1606859 - DNA, 22 bp, Homo sapiens
actccctcctcacctctggact

SEQ ID NO: 1606860 - DNA, 16 bp, Homo sapiens
actccctcctggagct

SEQ ID NO: 1606861 - DNA, 13 bp, Homo sapiens
actccctctcagg

SEQ ID NO: 1606862 - DNA, 23 bp, Homo sapiens
actccctcttcactgtggccaca

SEQ ID NO: 1606863 - DNA, 17 bp, Homo sapiens
actccctgcagatgcca

SEQ ID NO: 1606864 - DNA, 17 bp, Homo sapiens
actccctggctctcaga

SEQ ID NO: 1606865 - DNA, 13 bp, Homo sapiens
actccctgttatt

SEQ ID NO: 1606866 - DNA, 20 bp, Homo sapiens
actcccttcctggcctcact

SEQ ID NO: 1606867 - DNA, 17 bp, Homo sapiens
actcccttgctggcccc

SEQ ID NO: 1606868 - DNA, 18 bp, Homo sapiens
actcccttgctggcccca

SEQ ID NO: 1606869 - DNA, 23 bp, Homo sapiens
actcccttgctggccccagccct

SEQ ID NO: 1606870 - DNA, 23 bp, Homo sapiens
actccgagaggtgggccagtctg

SEQ ID NO: 1606871 - DNA, 17 bp, Homo sapiens
actccgcgccgatgcca

SEQ ID NO: 1606872 - DNA, 19 bp, Homo sapiens
actccgcgccgatgccacc

SEQ ID NO: 1606873 - DNA, 18 bp, Homo sapiens
actccgggaccattgacc

SEQ ID NO: 1606874 - DNA, 16 bp, Homo sapiens
actccggtgtgcctgc

SEQ ID NO: 1606875 - DNA, 16 bp, Homo sapiens
actccgtgaggctgct

SEQ ID NO: 1606876 - DNA, 19 bp, Homo sapiens
actccgtgaggctgctgcc

SEQ ID NO: 1606877 - DNA, 17 bp, Homo sapiens
actccgttggccactcc

SEQ ID NO: 1606878 - DNA, 21 bp, Homo sapiens
actccgttggccactccgaga

SEQ ID NO: 1606879 - DNA, 20 bp, Homo sapiens
actcctaatagcttttcctg

SEQ ID NO: 1606880 - DNA, 22 bp, Homo sapiens
actcctacaagatttagaaaaa

SEQ ID NO: 1606881 - DNA, 13 bp, Homo sapiens
actcctagaagaa

SEQ ID NO: 1606882 - DNA, 19 bp, Homo sapiens
actcctcagatctgaacac

SEQ ID NO: 1606883 - DNA, 12 bp, Homo sapiens
actcctccctcc

SEQ ID NO: 1606884 - DNA, 16 bp, Homo sapiens
actcctcctcggaaga

SEQ ID NO: 1606885 - DNA, 21 bp, Homo sapiens
actcctcctcggaagagcccg

SEQ ID NO: 1606886 - DNA, 15 bp, Homo sapiens
actcctcctgctcct

SEQ ID NO: 1606887 - DNA, 20 bp, Homo sapiens
actcctcctgctcctcaccc

SEQ ID NO: 1606888 - DNA, 23 bp, Homo sapiens
actcctctgcgtctatcctgtgt

SEQ ID NO: 1606889 - DNA, 15 bp, Homo sapiens
actcctgacctcaag

SEQ ID NO: 1606890 - DNA, 18 bp, Homo sapiens
actcctgacctcaagtga

SEQ ID NO: 1606891 - DNA, 21 bp, Homo sapiens
actcctgacgtctgaagcttg

SEQ ID NO: 1606892 - DNA, 13 bp, Homo sapiens
actcctgcaaaat

SEQ ID NO: 1606893 - DNA, 15 bp, Homo sapiens
actcctgcaaaattt

SEQ ID NO: 1606894 - DNA, 20 bp, Homo sapiens
actcctgcctgagtttccag

SEQ ID NO: 1606895 - DNA, 20 bp, Homo sapiens
actcctgctgcacaggccct

SEQ ID NO: 1606896 - DNA, 21 bp, Homo sapiens
actcctgctgcacaggccctg

SEQ ID NO: 1606897 - DNA, 22 bp, Homo sapiens
actcctgctggtacctgccctc

SEQ ID NO: 1606898 - DNA, 15 bp, Homo sapiens
actcctggcctcaag

SEQ ID NO: 1606899 - DNA, 13 bp, Homo sapiens
actcctggccttt

SEQ ID NO: 1606900 - DNA, 16 bp, Homo sapiens
actcctggggcctctt

SEQ ID NO: 1606901 - DNA, 14 bp, Homo sapiens
actcctgggtgggt

SEQ ID NO: 1606902 - DNA, 23 bp, Homo sapiens
actcctggtaacagtaatacatt

SEQ ID NO: 1606903 - DNA, 13 bp, Homo sapiens
actcctggtctgt

SEQ ID NO: 1606904 - DNA, 15 bp, Homo sapiens
actcctgtacactga

SEQ ID NO: 1606905 - DNA, 19 bp, Homo sapiens
actcctgtcccgccttcct

SEQ ID NO: 1606906 - DNA, 20 bp, Homo sapiens
actcctgtcccgccttcctc

SEQ ID NO: 1606907 - DNA, 22 bp, Homo sapiens
actcctgtccctgtagctcagt

SEQ ID NO: 1606908 - DNA, 23 bp, Homo sapiens
actcctgtccctgtagctcagtc

SEQ ID NO: 1606909 - DNA, 13 bp, Homo sapiens
actcctgtccctt

SEQ ID NO: 1606910 - DNA, 19 bp, Homo sapiens
actcctgtcccttttccct

SEQ ID NO: 1606911 - DNA, 21 bp, Homo sapiens
actcctgtcccttttccctta

SEQ ID NO: 1606912 - DNA, 16 bp, Homo sapiens
actcctgtgctctgga

SEQ ID NO: 1606913 - DNA, 16 bp, Homo sapiens
actcctgttacttacc

SEQ ID NO: 1606914 - DNA, 14 bp, Homo sapiens
actccttcctggcc

SEQ ID NO: 1606915 - DNA, 13 bp, Homo sapiens
actccttgcttcc

SEQ ID NO: 1606916 - DNA, 16 bp, Homo sapiens
actccttgcttcctga

SEQ ID NO: 1606917 - DNA, 15 bp, Homo sapiens
actcctttcagccac

SEQ ID NO: 1606918 - DNA, 16 bp, Homo sapiens
actcctttcagccaca

SEQ ID NO: 1606919 - DNA, 13 bp, Homo sapiens
actcgacccagaa

SEQ ID NO: 1606920 - DNA, 15 bp, Homo sapiens
actcgactctgtgcc

SEQ ID NO: 1606921 - DNA, 16 bp, Homo sapiens
actcgagaccatcctg

SEQ ID NO: 1606922 - DNA, 23 bp, Homo sapiens
actcgatcaaaaccttccttccc

SEQ ID NO: 1606923 - DNA, 20 bp, Homo sapiens
actcgatgtaagggattcct

SEQ ID NO: 1606924 - DNA, 16 bp, Homo sapiens
actcgccatttcctca

SEQ ID NO: 1606925 - DNA, 21 bp, Homo sapiens
actcgcccgcccactgtcctg

SEQ ID NO: 1606926 - DNA, 18 bp, Homo sapiens
actcgcttgccgggcctg

SEQ ID NO: 1606927 - DNA, 14 bp, Homo sapiens
actcggtttctcca

SEQ ID NO: 1606928 - DNA, 21 bp, Homo sapiens
actcgtccaagggacagccca

SEQ ID NO: 1606929 - DNA, 15 bp, Homo sapiens
actcgttacctgccg

SEQ ID NO: 1606930 - DNA, 21 bp, Homo sapiens
actctaaaattataaatgaca

SEQ ID NO: 1606931 - DNA, 13 bp, Homo sapiens
actctaaccagtg

SEQ ID NO: 1606932 - DNA, 14 bp, Homo sapiens
actctaaccagtgt

SEQ ID NO: 1606933 - DNA, 15 bp, Homo sapiens
actctaaccagtgta

SEQ ID NO: 1606934 - DNA, 12 bp, Homo sapiens
actctaagatct

SEQ ID NO: 1606935 - DNA, 17 bp, Homo sapiens
actctaagatcttagat

SEQ ID NO: 1606936 - DNA, 19 bp, Homo sapiens
actctaagctggagctctt

SEQ ID NO: 1606937 - DNA, 14 bp, Homo sapiens
actctacccctgct

SEQ ID NO: 1606938 - DNA, 15 bp, Homo sapiens
actctacccctgctc

SEQ ID NO: 1606939 - DNA, 19 bp, Homo sapiens
actctacccctgctcccat

SEQ ID NO: 1606940 - DNA, 15 bp, Homo sapiens
actctaccctcccac

SEQ ID NO: 1606941 - DNA, 18 bp, Homo sapiens
actctaccctcccacccc

SEQ ID NO: 1606942 - DNA, 21 bp, Homo sapiens
actctacttagcatgtcccta

SEQ ID NO: 1606943 - DNA, 15 bp, Homo sapiens
actgaacaaaaccta

SEQ ID NO: 1606944 - DNA, 18 bp, Homo sapiens
actgaacaaaagctcagg

SEQ ID NO: 1606945 - DNA, 15 bp, Homo sapiens
actgaacacatgtgt

SEQ ID NO: 1606946 - DNA, 13 bp, Homo sapiens
actgaacatgttt

SEQ ID NO: 1606947 - DNA, 14 bp, Homo sapiens
actgaacatgttta

SEQ ID NO: 1606948 - DNA, 20 bp, Homo sapiens
actgaacattagttgcacta

SEQ ID NO: 1606949 - DNA, 15 bp, Homo sapiens
actgaaccactgctt

SEQ ID NO: 1606950 - DNA, 21 bp, Homo sapiens
actgaaccactgcttctcttt

SEQ ID NO: 1606951 - DNA, 22 bp, Homo sapiens
actgaacctgggaaagagattt

SEQ ID NO: 1606952 - DNA, 10 bp, Homo sapiens
actgaactcc

SEQ ID NO: 1606953 - DNA, 18 bp, Homo sapiens
actgaagccagaaataaa

SEQ ID NO: 1606954 - DNA, 20 bp, Homo sapiens
actgaagccggacagctgcc

SEQ ID NO: 1606955 - DNA, 24 bp, Homo sapiens
actgaagccggacagctgcccaga

SEQ ID NO: 1606956 - DNA, 14 bp, Homo sapiens
actgaagcctgcag

SEQ ID NO: 1606957 - DNA, 19 bp, Homo sapiens
actgaagcctgcaggagtt

SEQ ID NO: 1606958 - DNA, 20 bp, Homo sapiens
actgaaggaaaaacacaagc

SEQ ID NO: 1606959 - DNA, 23 bp, Homo sapiens
actgaaggaaaaacacaagcaaa

SEQ ID NO: 1606960 - DNA, 13 bp, Homo sapiens
actgaaggccact

SEQ ID NO: 1606961 - DNA, 23 bp, Homo sapiens
actgaaggggtgcacccacctgt

SEQ ID NO: 1606962 - DNA, 17 bp, Homo sapiens
actgaagttaacagaga

SEQ ID NO: 1606963 - DNA, 23 bp, Homo sapiens
actgaataaggagaagagtattt

SEQ ID NO: 1606964 - DNA, 22 bp, Homo sapiens
actgaataatatcaaataaaat

SEQ ID NO: 1606965 - DNA, 19 bp, Homo sapiens
actgaataatgctaccagg

SEQ ID NO: 1606966 - DNA, 21 bp, Homo sapiens
actgaataatggaattatgta

SEQ ID NO: 1606967 - DNA, 15 bp, Homo sapiens
actgaatatttatat

SEQ ID NO: 1606968 - DNA, 21 bp, Homo sapiens
actgaatatttatatttcact

SEQ ID NO: 1606969 - DNA, 20 bp, Homo sapiens
actgaatgaagcagtatttt

SEQ ID NO: 1606970 - DNA, 15 bp, Homo sapiens
actgaatgctgttaa

SEQ ID NO: 1606971 - DNA, 13 bp, Homo sapiens
actgaattaatca

SEQ ID NO: 1606972 - DNA, 14 bp, Homo sapiens
actgaattcactcc

SEQ ID NO: 1606973 - DNA, 15 bp, Homo sapiens
actgaattcactcca

SEQ ID NO: 1606974 - DNA, 21 bp, Homo sapiens
actgaattccaaacatggttt

SEQ ID NO: 1606975 - DNA, 18 bp, Homo sapiens
actgaattggcttccaga

SEQ ID NO: 1606976 - DNA, 19 bp, Homo sapiens
actgacaaacgtccccagc

SEQ ID NO: 1606977 - DNA, 20 bp, Homo sapiens
actgacacaggaaaccaaca

SEQ ID NO: 1606978 - DNA, 23 bp, Homo sapiens
actgacatcaattttaccctgag

SEQ ID NO: 1606979 - DNA, 18 bp, Homo sapiens
actgacatgtggggccag

SEQ ID NO: 1606980 - DNA, 13 bp, Homo sapiens
actgacatttctt

SEQ ID NO: 1606981 - DNA, 22 bp, Homo sapiens
actgaccaaagactgcagaacc

SEQ ID NO: 1606982 - DNA, 22 bp, Homo sapiens
actgaccacaccaaccaggcct

SEQ ID NO: 1606983 - DNA, 12 bp, Homo sapiens
actgaccactgg

SEQ ID NO: 1606984 - DNA, 12 bp, Homo sapiens
actgaccagaac

SEQ ID NO: 1606985 - DNA, 17 bp, Homo sapiens
actgaccagcggctgct

SEQ ID NO: 1606986 - DNA, 18 bp, Homo sapiens
actgaccagcggctgctc

SEQ ID NO: 1606987 - DNA, 16 bp, Homo sapiens
actgaccatccactct

SEQ ID NO: 1606988 - DNA, 23 bp, Homo sapiens
actgaccatccactctaccctcc

SEQ ID NO: 1606989 - DNA, 17 bp, Homo sapiens
actgacccttccagaca

SEQ ID NO: 1606990 - DNA, 21 bp, Homo sapiens
actgacctgaccccattcctg

SEQ ID NO: 1606991 - DNA, 21 bp, Homo sapiens
actgacctgtcatgcccccct

SEQ ID NO: 1606992 - DNA, 18 bp, Homo sapiens
actgactgagataagaaa

SEQ ID NO: 1606993 - DNA, 20 bp, Homo sapiens
actgactgtgttgggcaaga

SEQ ID NO: 1606994 - DNA, 15 bp, Homo sapiens
actgacttcagtggg

SEQ ID NO: 1606995 - DNA, 22 bp, Homo sapiens
actgacttctaagtaaaaccac

SEQ ID NO: 1606996 - DNA, 24 bp, Homo sapiens
actgacttgtttgtcttccattcc

SEQ ID NO: 1606997 - DNA, 15 bp, Homo sapiens
actgactttgcttgc

SEQ ID NO: 1606998 - DNA, 16 bp, Homo sapiens
actgactttgcttgct

SEQ ID NO: 1606999 - DNA, 17 bp, Homo sapiens
actgactttgcttgctt

SEQ ID NO: 1607000 - DNA, 23 bp, Homo sapiens
actgactttgcttgctttgaagt

SEQ ID NO: 1607001 - DNA, 18 bp, Homo sapiens
actgactttttcccccca

SEQ ID NO: 1607002 - DNA, 19 bp, Homo sapiens
actgagaatgtaagaacta

SEQ ID NO: 1607003 - DNA, 15 bp, Homo sapiens
actgagaccaaagaa

SEQ ID NO: 1607004 - DNA, 17 bp, Homo sapiens
actgagactttcccctc

SEQ ID NO: 1607005 - DNA, 23 bp, Homo sapiens
actgagagggcaatctttgcctt

SEQ ID NO: 1607006 - DNA, 15 bp, Homo sapiens
actgagataagaaaa

SEQ ID NO: 1607007 - DNA, 20 bp, Homo sapiens
actgagataagaaaagcctg

SEQ ID NO: 1607008 - DNA, 14 bp, Homo sapiens
actgagatcactga

SEQ ID NO: 1607009 - DNA, 22 bp, Homo sapiens
actgagatgtgaacacatcagc

SEQ ID NO: 1607010 - DNA, 12 bp, Homo sapiens
actgagcagccg

SEQ ID NO: 1607011 - DNA, 16 bp, Homo sapiens
actgagcagccgccag

SEQ ID NO: 1607012 - DNA, 18 bp, Homo sapiens
actgagcagccgccagct

SEQ ID NO: 1607013 - DNA, 13 bp, Homo sapiens
actgagcctgttc

SEQ ID NO: 1607014 - DNA, 14 bp, Homo sapiens
actgagctctccag

SEQ ID NO: 1607015 - DNA, 17 bp, Homo sapiens
actgagcttctctgtga

SEQ ID NO: 1607016 - DNA, 19 bp, Homo sapiens
actgaggaatttcacctgt

SEQ ID NO: 1607017 - DNA, 13 bp, Homo sapiens
actgaggactgtg

SEQ ID NO: 1607018 - DNA, 19 bp, Homo sapiens
actgaggagacagaaagcc

SEQ ID NO: 1607019 - DNA, 13 bp, Homo sapiens
actgaggcagaca

SEQ ID NO: 1607020 - DNA, 21 bp, Homo sapiens
actgaggcctgcttccccctc

SEQ ID NO: 1607021 - DNA, 22 bp, Homo sapiens
actgagggaccaactgggccca

SEQ ID NO: 1607022 - DNA, 18 bp, Homo sapiens
actgagggccagggaccc

SEQ ID NO: 1607023 - DNA, 19 bp, Homo sapiens
actgagggctctgtttgtg

SEQ ID NO: 1607024 - DNA, 19 bp, Homo sapiens
actgagtgatactttaagt

SEQ ID NO: 1607025 - DNA, 18 bp, Homo sapiens
actgagttacattgtcat

SEQ ID NO: 1607026 - DNA, 14 bp, Homo sapiens
actgataaacctaa

SEQ ID NO: 1607027 - DNA, 22 bp, Homo sapiens
actgataaacctaatattcaat

SEQ ID NO: 1607028 - DNA, 12 bp, Homo sapiens
actgataacaac

SEQ ID NO: 1607029 - DNA, 20 bp, Homo sapiens
actgatcaaaaataaactag

SEQ ID NO: 1607030 - DNA, 21 bp, Homo sapiens
actgatcaaaaataaactagt

SEQ ID NO: 1607031 - DNA, 15 bp, Homo sapiens
actgatcacccaatg

SEQ ID NO: 1607032 - DNA, 17 bp, Homo sapiens
actgatcctgctccagc

SEQ ID NO: 1607033 - DNA, 22 bp, Homo sapiens
actgatcctgctccagcagcac

SEQ ID NO: 1607034 - DNA, 17 bp, Homo sapiens
actgatctctactacca

SEQ ID NO: 1607035 - DNA, 20 bp, Homo sapiens
actgatctttgtatattaca

SEQ ID NO: 1607036 - DNA, 15 bp, Homo sapiens
actgatgacttacta

SEQ ID NO: 1607037 - DNA, 21 bp, Homo sapiens
actgatgagtttcactgtact

SEQ ID NO: 1607038 - DNA, 16 bp, Homo sapiens
actgatgattttcctt

SEQ ID NO: 1607039 - DNA, 21 bp, Homo sapiens
actgatggaccgggtgggcct

SEQ ID NO: 1607040 - DNA, 22 bp, Homo sapiens
actgatggaccgggtgggcctg

SEQ ID NO: 1607041 - DNA, 19 bp, Homo sapiens
actgatgtgatattctgtt

SEQ ID NO: 1607042 - DNA, 18 bp, Homo sapiens
actgatgtttgtgcagta

SEQ ID NO: 1607043 - DNA, 13 bp, Homo sapiens
actgattaaatat

SEQ ID NO: 1607044 - DNA, 14 bp, Homo sapiens
actgattaaatatt

SEQ ID NO: 1607045 - DNA, 19 bp, Homo sapiens
actgattaaatatttgaag

SEQ ID NO: 1607046 - DNA, 20 bp, Homo sapiens
actgattaaatatttgaaga

SEQ ID NO: 1607047 - DNA, 22 bp, Homo sapiens
actgattagtaagtcttgccta

SEQ ID NO: 1607048 - DNA, 15 bp, Homo sapiens
actgattattttctt

SEQ ID NO: 1607049 - DNA, 18 bp, Homo sapiens
actgattattttcttcat

SEQ ID NO: 1607050 - DNA, 20 bp, Homo sapiens
actgattctgggatgctcct

SEQ ID NO: 1607051 - DNA, 22 bp, Homo sapiens
actgatttgcaataaaaatgat

SEQ ID NO: 1607052 - DNA, 15 bp, Homo sapiens
actgatttgtggaaa

SEQ ID NO: 1607053 - DNA, 19 bp, Homo sapiens
actgatttttgtaagacaa

SEQ ID NO: 1607054 - DNA, 17 bp, Homo sapiens
actgcaaaaaaagcctc

SEQ ID NO: 1607055 - DNA, 20 bp, Homo sapiens
actgcaaaaaaagcctccaa

SEQ ID NO: 1607056 - DNA, 17 bp, Homo sapiens
actgcaaagctttggct

SEQ ID NO: 1607057 - DNA, 23 bp, Homo sapiens
actgcaaagctttggctgagacc

SEQ ID NO: 1607058 - DNA, 22 bp, Homo sapiens
actgcaaatcaggcttttgttt

SEQ ID NO: 1607059 - DNA, 18 bp, Homo sapiens
actgcaacaacgcctggt

SEQ ID NO: 1607060 - DNA, 18 bp, Homo sapiens
actgcaacctctgcctcc

SEQ ID NO: 1607061 - DNA, 17 bp, Homo sapiens
actgcaagctctgcctc

SEQ ID NO: 1607062 - DNA, 19 bp, Homo sapiens
actgcaatagagactgtag

SEQ ID NO: 1607063 - DNA, 22 bp, Homo sapiens
actgcaatagagactgtagatt

SEQ ID NO: 1607064 - DNA, 16 bp, Homo sapiens
actgcaatgtcaaagt

SEQ ID NO: 1607065 - DNA, 16 bp, Homo sapiens
actgcacacacagctc

SEQ ID NO: 1607066 - DNA, 19 bp, Homo sapiens
actgcacacacagctcctc

SEQ ID NO: 1607067 - DNA, 15 bp, Homo sapiens
actgcacaggaggag

SEQ ID NO: 1607068 - DNA, 23 bp, Homo sapiens
actgcacagtgcatctcagccca

SEQ ID NO: 1607069 - DNA, 9 bp, Homo sapiens
actgcactc

SEQ ID NO: 1607070 - DNA, 14 bp, Homo sapiens
actgcactccagcc

SEQ ID NO: 1607071 - DNA, 18 bp, Homo sapiens
actgcactccagcctgag

SEQ ID NO: 1607072 - DNA, 20 bp, Homo sapiens
actgcactccagcctgagtg

SEQ ID NO: 1607073 - DNA, 20 bp, Homo sapiens
actgcactccagcctgggca

SEQ ID NO: 1607074 - DNA, 19 bp, Homo sapiens
actgcagaggggaaagact

SEQ ID NO: 1607075 - DNA, 18 bp, Homo sapiens
actgcagcacctccaggc

SEQ ID NO: 1607076 - DNA, 22 bp, Homo sapiens
actgcagcacctccaggcctgt

SEQ ID NO: 1607077 - DNA, 14 bp, Homo sapiens
actgcagctgctga

SEQ ID NO: 1607078 - DNA, 22 bp, Homo sapiens
actgcaggccctggcctcccct

SEQ ID NO: 1607079 - DNA, 12 bp, Homo sapiens
actgcagggaca

SEQ ID NO: 1607080 - DNA, 13 bp, Homo sapiens
actgcagtttcct

SEQ ID NO: 1607081 - DNA, 14 bp, Homo sapiens
actgcagtttcctg

SEQ ID NO: 1607082 - DNA, 15 bp, Homo sapiens
actgcagtttcctgg

SEQ ID NO: 1607083 - DNA, 16 bp, Homo sapiens
actgcagtttcctgga

SEQ ID NO: 1607084 - DNA, 14 bp, Homo sapiens
actgcatacaatct

SEQ ID NO: 1607085 - DNA, 21 bp, Homo sapiens
actgcatacgttttggtgttg

SEQ ID NO: 1607086 - DNA, 16 bp, Homo sapiens
actgcatatgaaagga

SEQ ID NO: 1607087 - DNA, 14 bp, Homo sapiens
actgcatcatatat

SEQ ID NO: 1607088 - DNA, 17 bp, Homo sapiens
actgcatggacctaaca

SEQ ID NO: 1607089 - DNA, 20 bp, Homo sapiens
actgcatggcttctgaaagc

SEQ ID NO: 1607090 - DNA, 14 bp, Homo sapiens
actgcatgtgactt

SEQ ID NO: 1607091 - DNA, 16 bp, Homo sapiens
actgcattcctgtgcc

SEQ ID NO: 1607092 - DNA, 20 bp, Homo sapiens
actgcattctctcccatcct

SEQ ID NO: 1607093 - DNA, 21 bp, Homo sapiens
actgcattctctcccatcctg

SEQ ID NO: 1607094 - DNA, 23 bp, Homo sapiens
actgcattcttctgagcactgtt

SEQ ID NO: 1607095 - DNA, 22 bp, Homo sapiens
actgcatttaaatttgatttcc

SEQ ID NO: 1607096 - DNA, 16 bp, Homo sapiens
actgcattttaccaga

SEQ ID NO: 1607097 - DNA, 21 bp, Homo sapiens
actgccaaagggaaatatcat

SEQ ID NO: 1607098 - DNA, 20 bp, Homo sapiens
actgccaaataaatcatcct

SEQ ID NO: 1607099 - DNA, 19 bp, Homo sapiens
actgccaactgatctgtta

SEQ ID NO: 1607100 - DNA, 18 bp, Homo sapiens
actgccacactctccatc

SEQ ID NO: 1607101 - DNA, 13 bp, Homo sapiens
actgccagcaacg

SEQ ID NO: 1607102 - DNA, 12 bp, Homo sapiens
actgccagcagc

SEQ ID NO: 1607103 - DNA, 12 bp, Homo sapiens
actgccagcctt

SEQ ID NO: 1607104 - DNA, 12 bp, Homo sapiens
actgccaggcac

SEQ ID NO: 1607105 - DNA, 13 bp, Homo sapiens
actgccaggcacc

SEQ ID NO: 1607106 - DNA, 14 bp, Homo sapiens
actgccaggcacct

SEQ ID NO: 1607107 - DNA, 15 bp, Homo sapiens
actgccaggcacctg

SEQ ID NO: 1607108 - DNA, 19 bp, Homo sapiens
actgccaggcacctggcct

SEQ ID NO: 1607109 - DNA, 21 bp, Homo sapiens
actgccaggcacctggcctgc

SEQ ID NO: 1607110 - DNA, 18 bp, Homo sapiens
actgccaggccagcctcc

SEQ ID NO: 1607111 - DNA, 17 bp, Homo sapiens
actgccagggccgcggc

SEQ ID NO: 1607112 - DNA, 18 bp, Homo sapiens
actgccagggccgcggcc

SEQ ID NO: 1607113 - DNA, 20 bp, Homo sapiens
actgccaggtggttgggttc

SEQ ID NO: 1607114 - DNA, 23 bp, Homo sapiens
actgccattacccagtgccgagg

SEQ ID NO: 1607115 - DNA, 21 bp, Homo sapiens
actgcccaaggataggtattt

SEQ ID NO: 1607116 - DNA, 23 bp, Homo sapiens
actgcccacatttgggctcaggg

SEQ ID NO: 1607117 - DNA, 14 bp, Homo sapiens
actgcccaccccct

SEQ ID NO: 1607118 - DNA, 15 bp, Homo sapiens
actgccccaactcct

SEQ ID NO: 1607119 - DNA, 18 bp, Homo sapiens
actgccccaactcctgga

SEQ ID NO: 1607120 - DNA, 13 bp, Homo sapiens
actgccccccgag

SEQ ID NO: 1607121 - DNA, 18 bp, Homo sapiens
actgccccccgaggctgc

SEQ ID NO: 1607122 - DNA, 18 bp, Homo sapiens
actgccctccccttcccc

SEQ ID NO: 1607123 - DNA, 13 bp, Homo sapiens
actgccctgcctg

SEQ ID NO: 1607124 - DNA, 23 bp, Homo sapiens
actgccctgcctgcccacttagc

SEQ ID NO: 1607125 - DNA, 19 bp, Homo sapiens
actgccctggcagcagcag

SEQ ID NO: 1607126 - DNA, 17 bp, Homo sapiens
actgcccttttcaggaa

SEQ ID NO: 1607127 - DNA, 22 bp, Homo sapiens
actgccgcaagtctgcagcccg

SEQ ID NO: 1607128 - DNA, 18 bp, Homo sapiens
actgcctaaggccctttg

SEQ ID NO: 1607129 - DNA, 19 bp, Homo sapiens
actgcctagaaaatgcaaa

SEQ ID NO: 1607130 - DNA, 21 bp, Homo sapiens
actgcctaggaggctggccaa

SEQ ID NO: 1607131 - DNA, 22 bp, Homo sapiens
actgcctaggaggctggccaag

SEQ ID NO: 1607132 - DNA, 20 bp, Homo sapiens
actgcctattcacgccgtaa

SEQ ID NO: 1607133 - DNA, 22 bp, Homo sapiens
actgcctgcagaggtctgtgct

SEQ ID NO: 1607134 - DNA, 11 bp, Homo sapiens
actgcctgggc

SEQ ID NO: 1607135 - DNA, 16 bp, Homo sapiens
actgcctgtctccatg

SEQ ID NO: 1607136 - DNA, 15 bp, Homo sapiens
actgccttcgcttct

SEQ ID NO: 1607137 - DNA, 23 bp, Homo sapiens
actgccttcgcttcttgcctctg

SEQ ID NO: 1607138 - DNA, 20 bp, Homo sapiens
actgcctttttatttatatg

SEQ ID NO: 1607139 - DNA, 15 bp, Homo sapiens
actgcgactttctgc

SEQ ID NO: 1607140 - DNA, 18 bp, Homo sapiens
actgcgactttctgcctg

SEQ ID NO: 1607141 - DNA, 22 bp, Homo sapiens
actgcgactttctgcctggagt

SEQ ID NO: 1607142 - DNA, 23 bp, Homo sapiens
actgcgactttctgcctggagtg

SEQ ID NO: 1607143 - DNA, 16 bp, Homo sapiens
actgcgcaggtctctt

SEQ ID NO: 1607144 - DNA, 19 bp, Homo sapiens
actgcgcaggtctcttctg

SEQ ID NO: 1607145 - DNA, 17 bp, Homo sapiens
actgcggaagccaaagg

SEQ ID NO: 1607146 - DNA, 19 bp, Homo sapiens
actgcgggatggtcctggg

SEQ ID NO: 1607147 - DNA, 20 bp, Homo sapiens
actgcgggatggtcctgggg

SEQ ID NO: 1607148 - DNA, 21 bp, Homo sapiens
actgcgggatggtcctggggc

SEQ ID NO: 1607149 - DNA, 22 bp, Homo sapiens
actgcgggatggtcctggggct

SEQ ID NO: 1607150 - DNA, 16 bp, Homo sapiens
actgcgtcaagcaatc

SEQ ID NO: 1607151 - DNA, 15 bp, Homo sapiens
actgctaaatcctca

SEQ ID NO: 1607152 - DNA, 17 bp, Homo sapiens
actgctaagtatttccc

SEQ ID NO: 1607153 - DNA, 15 bp, Homo sapiens
actgctacctctgag

SEQ ID NO: 1607154 - DNA, 19 bp, Homo sapiens
actgctacctttcaaagct

SEQ ID NO: 1607155 - DNA, 17 bp, Homo sapiens
actgctataaataggtt

SEQ ID NO: 1607156 - DNA, 16 bp, Homo sapiens
actgctatagcctaag

SEQ ID NO: 1607157 - DNA, 19 bp, Homo sapiens
actgctcatcattccttga

SEQ ID NO: 1607158 - DNA, 14 bp, Homo sapiens
acctaccaaaatgg

SEQ ID NO: 1607159 - DNA, 15 bp, Homo sapiens
acctaccacagtgtc

SEQ ID NO: 1607160 - DNA, 17 bp, Homo sapiens
acctaccacagtgtctg

SEQ ID NO: 1607161 - DNA, 19 bp, Homo sapiens
acctaccacagtgtctgta

SEQ ID NO: 1607162 - DNA, 15 bp, Homo sapiens
acctaccatgctgct

SEQ ID NO: 1607163 - DNA, 16 bp, Homo sapiens
acctaccccagccagg

SEQ ID NO: 1607164 - DNA, 17 bp, Homo sapiens
acctacgtttgcaccgc

SEQ ID NO: 1607165 - DNA, 19 bp, Homo sapiens
acctactgcactttccccc

SEQ ID NO: 1607166 - DNA, 12 bp, Homo sapiens
acctactgccca

SEQ ID NO: 1607167 - DNA, 21 bp, Homo sapiens
acctactgttctaaagctctg

SEQ ID NO: 1607168 - DNA, 20 bp, Homo sapiens
acctacttgtgactgaaggg

SEQ ID NO: 1607169 - DNA, 21 bp, Homo sapiens
acctactttgactttttgcat

SEQ ID NO: 1607170 - DNA, 13 bp, Homo sapiens
acctactttttat

SEQ ID NO: 1607171 - DNA, 22 bp, Homo sapiens
acctactttttatgtgctatgc

SEQ ID NO: 1607172 - DNA, 22 bp, Homo sapiens
acctagaaattgacacaagtgg

SEQ ID NO: 1607173 - DNA, 22 bp, Homo sapiens
acctagaacgtgcatccttgta

SEQ ID NO: 1607174 - DNA, 19 bp, Homo sapiens
acctagaagtaagaagagg

SEQ ID NO: 1607175 - DNA, 16 bp, Homo sapiens
acctagaagtctccct

SEQ ID NO: 1607176 - DNA, 20 bp, Homo sapiens
acctagaagtctccctgcac

SEQ ID NO: 1607177 - DNA, 15 bp, Homo sapiens
acctagcagcctcaa

SEQ ID NO: 1607178 - DNA, 18 bp, Homo sapiens
acctagctggctctgtga

SEQ ID NO: 1607179 - DNA, 23 bp, Homo sapiens
acctaggggtttctgttggataa

SEQ ID NO: 1607180 - DNA, 15 bp, Homo sapiens
acctaggtctccagt

SEQ ID NO: 1607181 - DNA, 16 bp, Homo sapiens
acctagtgccccagac

SEQ ID NO: 1607182 - DNA, 18 bp, Homo sapiens
acctagtgccccagactg

SEQ ID NO: 1607183 - DNA, 17 bp, Homo sapiens
acctataagaagcctta

SEQ ID NO: 1607184 - DNA, 22 bp, Homo sapiens
acctatagtcccagctactcag

SEQ ID NO: 1607185 - DNA, 16 bp, Homo sapiens
acctatggctgcctgc

SEQ ID NO: 1607186 - DNA, 14 bp, Homo sapiens
acctattcaccctc

SEQ ID NO: 1607187 - DNA, 16 bp, Homo sapiens
acctattcaccctcca

SEQ ID NO: 1607188 - DNA, 20 bp, Homo sapiens
acctattctgtagttgcagc

SEQ ID NO: 1607189 - DNA, 12 bp, Homo sapiens
acctatttaatg

SEQ ID NO: 1607190 - DNA, 15 bp, Homo sapiens
acctattttcatttg

SEQ ID NO: 1607191 - DNA, 16 bp, Homo sapiens
acctattttcatttgt

SEQ ID NO: 1607192 - DNA, 21 bp, Homo sapiens
acctattttcatttgtacaag

SEQ ID NO: 1607193 - DNA, 20 bp, Homo sapiens
acctatttttgacatggaaa

SEQ ID NO: 1607194 - DNA, 16 bp, Homo sapiens
acctcaaaatgtctaa

SEQ ID NO: 1607195 - DNA, 22 bp, Homo sapiens
acctcaacccccatttctattt

SEQ ID NO: 1607196 - DNA, 23 bp, Homo sapiens
acctcaagtgatctgcccacctc

SEQ ID NO: 1607197 - DNA, 16 bp, Homo sapiens
acctcaagtgtcctga

SEQ ID NO: 1607198 - DNA, 15 bp, Homo sapiens
acctcaatgccctgc

SEQ ID NO: 1607199 - DNA, 18 bp, Homo sapiens
acctcaatgccctgccat

SEQ ID NO: 1607200 - DNA, 19 bp, Homo sapiens
acctcacagtgacccttcc

SEQ ID NO: 1607201 - DNA, 20 bp, Homo sapiens
acctcacagtgacccttccc

SEQ ID NO: 1607202 - DNA, 21 bp, Homo sapiens
acctcacagtgacccttccca

SEQ ID NO: 1607203 - DNA, 14 bp, Homo sapiens
acctcacctagaaa

SEQ ID NO: 1607204 - DNA, 13 bp, Homo sapiens
acctcactcctgt

SEQ ID NO: 1607205 - DNA, 17 bp, Homo sapiens
acctcactgtcctgtga

SEQ ID NO: 1607206 - DNA, 11 bp, Homo sapiens
acctcagagca

SEQ ID NO: 1607207 - DNA, 12 bp, Homo sapiens
acctcagagcag

SEQ ID NO: 1607208 - DNA, 20 bp, Homo sapiens
acctcagagcagggccaaag

SEQ ID NO: 1607209 - DNA, 19 bp, Homo sapiens
acctcagattcttcattga

SEQ ID NO: 1607210 - DNA, 14 bp, Homo sapiens
acctcagccatgag

SEQ ID NO: 1607211 - DNA, 10 bp, Homo sapiens
acctcagcct

SEQ ID NO: 1607212 - DNA, 19 bp, Homo sapiens
acccttctcctttccttcc

SEQ ID NO: 1607213 - DNA, 20 bp, Homo sapiens
acccttgcatccattgttgt

SEQ ID NO: 1607214 - DNA, 23 bp, Homo sapiens
acccttgcccggctgtgattgct

SEQ ID NO: 1607215 - DNA, 15 bp, Homo sapiens
acccttgctgcttta

SEQ ID NO: 1607216 - DNA, 21 bp, Homo sapiens
acccttggaggctgtcttctc

SEQ ID NO: 1607217 - DNA, 20 bp, Homo sapiens
acccttggcctccatttctg

SEQ ID NO: 1607218 - DNA, 12 bp, Homo sapiens
acccttggcctg

SEQ ID NO: 1607219 - DNA, 17 bp, Homo sapiens
acccttgggccagaagt

SEQ ID NO: 1607220 - DNA, 20 bp, Homo sapiens
acccttgggccagaagtacc

SEQ ID NO: 1607221 - DNA, 18 bp, Homo sapiens
acccttgtcatctctctg

SEQ ID NO: 1607222 - DNA, 18 bp, Homo sapiens
acccttgtgagagcccat

SEQ ID NO: 1607223 - DNA, 15 bp, Homo sapiens
accctttaaatgtaa

SEQ ID NO: 1607224 - DNA, 21 bp, Homo sapiens
accctttaagatatccatctt

SEQ ID NO: 1607225 - DNA, 20 bp, Homo sapiens
accctttcccccttctctta

SEQ ID NO: 1607226 - DNA, 15 bp, Homo sapiens
accctttccttcctt

SEQ ID NO: 1607227 - DNA, 18 bp, Homo sapiens
accctttccttccttccc

SEQ ID NO: 1607228 - DNA, 21 bp, Homo sapiens
accctttccttccttccctgg

SEQ ID NO: 1607229 - DNA, 23 bp, Homo sapiens
accctttccttccttccctggct

SEQ ID NO: 1607230 - DNA, 23 bp, Homo sapiens
accctttgctgtgaggctgtcct

SEQ ID NO: 1607231 - DNA, 21 bp, Homo sapiens
accctttggtttttttcttct

SEQ ID NO: 1607232 - DNA, 23 bp, Homo sapiens
accctttggtttttttcttctgt

SEQ ID NO: 1607233 - DNA, 18 bp, Homo sapiens
acccttttcccccttccc

SEQ ID NO: 1607234 - DNA, 22 bp, Homo sapiens
acccttttcccccttcccattt

SEQ ID NO: 1607235 - DNA, 13 bp, Homo sapiens
acccttttctcag

SEQ ID NO: 1607236 - DNA, 16 bp, Homo sapiens
accgaccaactgccct

SEQ ID NO: 1607237 - DNA, 18 bp, Homo sapiens
accgagaaggtttatccc

SEQ ID NO: 1607238 - DNA, 15 bp, Homo sapiens
accgagaccaaactc

SEQ ID NO: 1607239 - DNA, 12 bp, Homo sapiens
accgagccctgg

SEQ ID NO: 1607240 - DNA, 16 bp, Homo sapiens
accgagccctggagag

SEQ ID NO: 1607241 - DNA, 14 bp, Homo sapiens
accgaggggccttt

SEQ ID NO: 1607242 - DNA, 12 bp, Homo sapiens
accgatttctgc

SEQ ID NO: 1607243 - DNA, 14 bp, Homo sapiens
accgcacagctcag

SEQ ID NO: 1607244 - DNA, 23 bp, Homo sapiens
accgcagccagccggtgcctggc

SEQ ID NO: 1607245 - DNA, 16 bp, Homo sapiens
accgcaggcccggact

SEQ ID NO: 1607246 - DNA, 18 bp, Homo sapiens
accgcaggggactgtctc

SEQ ID NO: 1607247 - DNA, 24 bp, Homo sapiens
accgccagcagcgcgcaggcctgc

SEQ ID NO: 1607248 - DNA, 15 bp, Homo sapiens
accgcccccacccct

SEQ ID NO: 1607249 - DNA, 21 bp, Homo sapiens
accgcccccaccccttcccca

SEQ ID NO: 1607250 - DNA, 13 bp, Homo sapiens
accgcccggcagc

SEQ ID NO: 1607251 - DNA, 14 bp, Homo sapiens
accgcccggcagcc

SEQ ID NO: 1607252 - DNA, 19 bp, Homo sapiens
accgcctagtttactgttt

SEQ ID NO: 1607253 - DNA, 21 bp, Homo sapiens
accgcctccccacctccaggc

SEQ ID NO: 1607254 - DNA, 15 bp, Homo sapiens
accgcctcgtgccag

SEQ ID NO: 1607255 - DNA, 19 bp, Homo sapiens
accgcctctggccgccacc

SEQ ID NO: 1607256 - DNA, 19 bp, Homo sapiens
accgctgccagcacagagc

SEQ ID NO: 1607257 - DNA, 19 bp, Homo sapiens
accgctggccctgccgttt

SEQ ID NO: 1607258 - DNA, 14 bp, Homo sapiens
accgcttcacccct

SEQ ID NO: 1607259 - DNA, 16 bp, Homo sapiens
accgcttcacccctgc

SEQ ID NO: 1607260 - DNA, 18 bp, Homo sapiens
accgcttcacccctgcac

SEQ ID NO: 1607261 - DNA, 15 bp, Homo sapiens
accgcttctgccttt

SEQ ID NO: 1607262 - DNA, 23 bp, Homo sapiens
accggaaggaggccaaccagccc

SEQ ID NO: 1607263 - DNA, 15 bp, Homo sapiens
accggaaggttttta

SEQ ID NO: 1607264 - DNA, 23 bp, Homo sapiens
accggagctttcaaagaaggaat

SEQ ID NO: 1607265 - DNA, 21 bp, Homo sapiens
accggccaggccgcgcccagc

SEQ ID NO: 1607266 - DNA, 17 bp, Homo sapiens
accggcctcggcctccc

SEQ ID NO: 1607267 - DNA, 20 bp, Homo sapiens
accggcctgtgggtctctga

SEQ ID NO: 1607268 - DNA, 21 bp, Homo sapiens
accggcctgtgggtctctgaa

SEQ ID NO: 1607269 - DNA, 22 bp, Homo sapiens
accggcctgtgggtctctgaag

SEQ ID NO: 1607270 - DNA, 16 bp, Homo sapiens
accggctctcacctgg

SEQ ID NO: 1607271 - DNA, 19 bp, Homo sapiens
accggctttaccaaaccgc

SEQ ID NO: 1607272 - DNA, 16 bp, Homo sapiens
accgggacagacctgg

SEQ ID NO: 1607273 - DNA, 11 bp, Homo sapiens
accgggacccc

SEQ ID NO: 1607274 - DNA, 19 bp, Homo sapiens
accgggagaaggcatgaga

SEQ ID NO: 1607275 - DNA, 19 bp, Homo sapiens
accgggccaagtgaagaat

SEQ ID NO: 1607276 - DNA, 15 bp, Homo sapiens
accgggtgggcctgg

SEQ ID NO: 1607277 - DNA, 16 bp, Homo sapiens
accgggtgggcctggc

SEQ ID NO: 1607278 - DNA, 17 bp, Homo sapiens
accgggtgggcctggcc

SEQ ID NO: 1607279 - DNA, 18 bp, Homo sapiens
accgggtgggcctggcct

SEQ ID NO: 1607280 - DNA, 23 bp, Homo sapiens
accgggtgggcctggcctgagct

SEQ ID NO: 1607281 - DNA, 23 bp, Homo sapiens
accgggttctgcagcggcagagc

SEQ ID NO: 1607282 - DNA, 13 bp, Homo sapiens
accggtacagaaa

SEQ ID NO: 1607283 - DNA, 15 bp, Homo sapiens
accggtccagctggc

SEQ ID NO: 1607284 - DNA, 16 bp, Homo sapiens
accggtccagctggcc

SEQ ID NO: 1607285 - DNA, 17 bp, Homo sapiens
accggtccagctggcct

SEQ ID NO: 1607286 - DNA, 23 bp, Homo sapiens
accggtccagctggcctggacag

SEQ ID NO: 1607287 - DNA, 17 bp, Homo sapiens
accgtaataattattat

SEQ ID NO: 1607288 - DNA, 14 bp, Homo sapiens
accgtccctcagtg

SEQ ID NO: 1607289 - DNA, 15 bp, Homo sapiens
accgtccgccctgct

SEQ ID NO: 1607290 - DNA, 16 bp, Homo sapiens
accgtcgggggctgag

SEQ ID NO: 1607291 - DNA, 19 bp, Homo sapiens
accgtgagtgacatagcct

SEQ ID NO: 1607292 - DNA, 18 bp, Homo sapiens
accgtgctggccccagtg

SEQ ID NO: 1607293 - DNA, 14 bp, Homo sapiens
accgtggacaggcc

SEQ ID NO: 1607294 - DNA, 15 bp, Homo sapiens
accgtggaggaggaa

SEQ ID NO: 1607295 - DNA, 22 bp, Homo sapiens
accgtggaggaggaaggcaaga

SEQ ID NO: 1607296 - DNA, 17 bp, Homo sapiens
accgtggtatgtctgcc

SEQ ID NO: 1607297 - DNA, 13 bp, Homo sapiens
accgtgtcaagct

SEQ ID NO: 1607298 - DNA, 19 bp, Homo sapiens
accgtgtcaagctgctctg

SEQ ID NO: 1607299 - DNA, 23 bp, Homo sapiens
accgtgtccagcacagaaggaat

SEQ ID NO: 1607300 - DNA, 19 bp, Homo sapiens
accgtgtcccaaggagctg

SEQ ID NO: 1607301 - DNA, 17 bp, Homo sapiens
accgtgtctgtctggca

SEQ ID NO: 1607302 - DNA, 17 bp, Homo sapiens
accgttaggattcaggc

SEQ ID NO: 1607303 - DNA, 20 bp, Homo sapiens
accgttaggattcaggcagc

SEQ ID NO: 1607304 - DNA, 21 bp, Homo sapiens
accgttcgtacgcccaggaca

SEQ ID NO: 1607305 - DNA, 18 bp, Homo sapiens
accgttggggattgggga

SEQ ID NO: 1607306 - DNA, 12 bp, Homo sapiens
accgtttcttcc

SEQ ID NO: 1607307 - DNA, 22 bp, Homo sapiens
accgtttcttcctgccagcagg

SEQ ID NO: 1607308 - DNA, 21 bp, Homo sapiens
acctaaaagagatttcaagag

SEQ ID NO: 1607309 - DNA, 19 bp, Homo sapiens
acctaaatccattttctaa

SEQ ID NO: 1607310 - DNA, 17 bp, Homo sapiens
acctaacccctttcctg

SEQ ID NO: 1607311 - DNA, 15 bp, Homo sapiens
acctaactgcaatgt

SEQ ID NO: 1607312 - DNA, 20 bp, Homo sapiens
acctaagtttcagttgattt

SEQ ID NO: 1607313 - DNA, 16 bp, Homo sapiens
acctaatatcacttaa

SEQ ID NO: 1607314 - DNA, 15 bp, Homo sapiens
acctaatcactaatt

SEQ ID NO: 1607315 - DNA, 20 bp, Homo sapiens
acctaatccaggcagatcca

SEQ ID NO: 1607316 - DNA, 22 bp, Homo sapiens
acctaatccaggcagatccagg

SEQ ID NO: 1607317 - DNA, 21 bp, Homo sapiens
acctaatctccacttttttca

SEQ ID NO: 1607318 - DNA, 23 bp, Homo sapiens
acctacacactgtcatgcttcat

SEQ ID NO: 1607319 - DNA, 13 bp, Homo sapiens
acctacacccctg

SEQ ID NO: 1607320 - DNA, 18 bp, Homo sapiens
acctacacccctgtgctc

SEQ ID NO: 1607321 - DNA, 16 bp, Homo sapiens
acctacagacctggct

SEQ ID NO: 1607322 - DNA, 17 bp, Homo sapiens
acctacagactccatct

SEQ ID NO: 1607323 - DNA, 18 bp, Homo sapiens
acctacagttttaactgt

SEQ ID NO: 1607324 - DNA, 22 bp, Homo sapiens
acctacatatgctgatctttta

SEQ ID NO: 1607325 - DNA, 23 bp, Homo sapiens
acctacatatgctgatcttttaa

SEQ ID NO: 1607326 - DNA, 17 bp, Homo sapiens
acctacatccccaggtc

SEQ ID NO: 1607327 - DNA, 21 bp, Homo sapiens
acatctggccctgacttctgg

SEQ ID NO: 1607328 - DNA, 15 bp, Homo sapiens
acatctgggtgccct

SEQ ID NO: 1607329 - DNA, 17 bp, Homo sapiens
acatctgggtgccctga

SEQ ID NO: 1607330 - DNA, 12 bp, Homo sapiens
acatctgtgtat

SEQ ID NO: 1607331 - DNA, 17 bp, Homo sapiens
acatctgttttaaattt

SEQ ID NO: 1607332 - DNA, 11 bp, Homo sapiens
acatcttaaat

SEQ ID NO: 1607333 - DNA, 20 bp, Homo sapiens
acatcttaaattcatttcta

SEQ ID NO: 1607334 - DNA, 13 bp, Homo sapiens
acatcttcaaagc

SEQ ID NO: 1607335 - DNA, 16 bp, Homo sapiens
acatcttgcattcaaa

SEQ ID NO: 1607336 - DNA, 20 bp, Homo sapiens
acatctttaacatagtcctg

SEQ ID NO: 1607337 - DNA, 13 bp, Homo sapiens
acatctttatccg

SEQ ID NO: 1607338 - DNA, 22 bp, Homo sapiens
acatctttattgaaattctatt

SEQ ID NO: 1607339 - DNA, 14 bp, Homo sapiens
acatctttcacact

SEQ ID NO: 1607340 - DNA, 15 bp, Homo sapiens
acatctttcacactt

SEQ ID NO: 1607341 - DNA, 20 bp, Homo sapiens
acatctttcacacttccacc

SEQ ID NO: 1607342 - DNA, 15 bp, Homo sapiens
acatctttcacattg

SEQ ID NO: 1607343 - DNA, 20 bp, Homo sapiens
acatctttcctcaagtatct

SEQ ID NO: 1607344 - DNA, 15 bp, Homo sapiens
acatcttttttcaca

SEQ ID NO: 1607345 - DNA, 22 bp, Homo sapiens
acatgaaaacaagaaagaaatg

SEQ ID NO: 1607346 - DNA, 15 bp, Homo sapiens
acatgaaacagaaac

SEQ ID NO: 1607347 - DNA, 20 bp, Homo sapiens
acatgaaacctacacactgt

SEQ ID NO: 1607348 - DNA, 20 bp, Homo sapiens
acatgaaactgaataaggag

SEQ ID NO: 1607349 - DNA, 14 bp, Homo sapiens
acatgaaactgcct

SEQ ID NO: 1607350 - DNA, 17 bp, Homo sapiens
acatgaaaggaccctgt

SEQ ID NO: 1607351 - DNA, 13 bp, Homo sapiens
acatgaagaagct

SEQ ID NO: 1607352 - DNA, 13 bp, Homo sapiens
acatgaaggtaaa

SEQ ID NO: 1607353 - DNA, 16 bp, Homo sapiens
acatgaaggtaaataa

SEQ ID NO: 1607354 - DNA, 23 bp, Homo sapiens
acatgaaggtaaataaaaagaaa

SEQ ID NO: 1607355 - DNA, 23 bp, Homo sapiens
acatgaataaagcctttgtatct

SEQ ID NO: 1607356 - DNA, 18 bp, Homo sapiens
acatgaataatttcactt

SEQ ID NO: 1607357 - DNA, 15 bp, Homo sapiens
acatgaatgcacact

SEQ ID NO: 1607358 - DNA, 14 bp, Homo sapiens
acatgaattaaagt

SEQ ID NO: 1607359 - DNA, 15 bp, Homo sapiens
acatgacactgacct

SEQ ID NO: 1607360 - DNA, 15 bp, Homo sapiens
acatgacccagcctg

SEQ ID NO: 1607361 - DNA, 20 bp, Homo sapiens
acatgacttattatgcataa

SEQ ID NO: 1607362 - DNA, 18 bp, Homo sapiens
acatgagatggagaggct

SEQ ID NO: 1607363 - DNA, 14 bp, Homo sapiens
acatgaggaactgt

SEQ ID NO: 1607364 - DNA, 22 bp, Homo sapiens
acatgaggacagaaggactggt

SEQ ID NO: 1607365 - DNA, 15 bp, Homo sapiens
acatgatcttcttta

SEQ ID NO: 1607366 - DNA, 17 bp, Homo sapiens
acatgatcttctttata

SEQ ID NO: 1607367 - DNA, 19 bp, Homo sapiens
acatgatcttctttataat

SEQ ID NO: 1607368 - DNA, 19 bp, Homo sapiens
acatgcaataaaatttaaa

SEQ ID NO: 1607369 - DNA, 16 bp, Homo sapiens
acatgcacatttatat

SEQ ID NO: 1607370 - DNA, 20 bp, Homo sapiens
acatgcacattttgtacatt

SEQ ID NO: 1607371 - DNA, 13 bp, Homo sapiens
acatgcactgacc

SEQ ID NO: 1607372 - DNA, 23 bp, Homo sapiens
acatgcagccacttaggacaaat

SEQ ID NO: 1607373 - DNA, 17 bp, Homo sapiens
acatgcagcccatgccc

SEQ ID NO: 1607374 - DNA, 20 bp, Homo sapiens
acatgcagcccatgcccacc

SEQ ID NO: 1607375 - DNA, 19 bp, Homo sapiens
acatgccacatcaaacctt

SEQ ID NO: 1607376 - DNA, 22 bp, Homo sapiens
acatgccacatcaaacctttga

SEQ ID NO: 1607377 - DNA, 13 bp, Homo sapiens
acatgccctcctg

SEQ ID NO: 1607378 - DNA, 14 bp, Homo sapiens
acatgccctcctgg

SEQ ID NO: 1607379 - DNA, 14 bp, Homo sapiens
acatgccctgtgtg

SEQ ID NO: 1607380 - DNA, 16 bp, Homo sapiens
acatgccctgtgtggc

SEQ ID NO: 1607381 - DNA, 19 bp, Homo sapiens
acatgccgcgtccctgccc

SEQ ID NO: 1607382 - DNA, 11 bp, Homo sapiens
acatgcctcaa

SEQ ID NO: 1607383 - DNA, 13 bp, Homo sapiens
acatgcgggctcg

SEQ ID NO: 1607384 - DNA, 16 bp, Homo sapiens
acatgcgggctcgccc

SEQ ID NO: 1607385 - DNA, 15 bp, Homo sapiens
acatgctaaagccag

SEQ ID NO: 1607386 - DNA, 16 bp, Homo sapiens
acatgctaaagccagg

SEQ ID NO: 1607387 - DNA, 16 bp, Homo sapiens
acatgctactaaattt

SEQ ID NO: 1607388 - DNA, 21 bp, Homo sapiens
acatgctggaaataaaacagc

SEQ ID NO: 1607389 - DNA, 23 bp, Homo sapiens
acatgctggaaataaaacagctg

SEQ ID NO: 1607390 - DNA, 23 bp, Homo sapiens
acatgctgtgctctttgaagaga

SEQ ID NO: 1607391 - DNA, 15 bp, Homo sapiens
acatgcttgaatgga

SEQ ID NO: 1607392 - DNA, 21 bp, Homo sapiens
acatggacagacttcacagcg

SEQ ID NO: 1607393 - DNA, 15 bp, Homo sapiens
acatggacttgtata

SEQ ID NO: 1607394 - DNA, 17 bp, Homo sapiens
acatggagactcctgcc

SEQ ID NO: 1607395 - DNA, 19 bp, Homo sapiens
acatggagccccctctgcc

SEQ ID NO: 1607396 - DNA, 19 bp, Homo sapiens
acatggaggttctaaggcc

SEQ ID NO: 1607397 - DNA, 19 bp, Homo sapiens
acatggatgaaattcccgt

SEQ ID NO: 1607398 - DNA, 21 bp, Homo sapiens
acatggccatagaggcccagg

SEQ ID NO: 1607399 - DNA, 22 bp, Homo sapiens
acatggccatagaggcccaggc

SEQ ID NO: 1607400 - DNA, 23 bp, Homo sapiens
acatggccatagaggcccaggca

SEQ ID NO: 1607401 - DNA, 17 bp, Homo sapiens
acatggcctatgcacat

SEQ ID NO: 1607402 - DNA, 14 bp, Homo sapiens
acatggctagcctt

SEQ ID NO: 1607403 - DNA, 15 bp, Homo sapiens
acatggctagccttt

SEQ ID NO: 1607404 - DNA, 22 bp, Homo sapiens
acatggctccggcctctgcctt

SEQ ID NO: 1607405 - DNA, 14 bp, Homo sapiens
acatggctggcctg

SEQ ID NO: 1607406 - DNA, 20 bp, Homo sapiens
acatggcttaatcttatttt

SEQ ID NO: 1607407 - DNA, 16 bp, Homo sapiens
acatgggtgaattatg

SEQ ID NO: 1607408 - DNA, 16 bp, Homo sapiens
acatggtgcctgagag

SEQ ID NO: 1607409 - DNA, 23 bp, Homo sapiens
acatggtgcctgagaggcaggca

SEQ ID NO: 1607410 - DNA, 21 bp, Homo sapiens
acatgtaaaatatgtaaaact

SEQ ID NO: 1607411 - DNA, 21 bp, Homo sapiens
acatgtaactatttcttcaga

SEQ ID NO: 1607412 - DNA, 13 bp, Homo sapiens
acatgtaagaaaa

SEQ ID NO: 1607413 - DNA, 17 bp, Homo sapiens
acatgtaataaaaagta

SEQ ID NO: 1607414 - DNA, 20 bp, Homo sapiens
acatgtaataaaaagtatat

SEQ ID NO: 1607415 - DNA, 16 bp, Homo sapiens
acatgtaataaattca

SEQ ID NO: 1607416 - DNA, 22 bp, Homo sapiens
acatgtaattaagtactatgta

SEQ ID NO: 1607417 - DNA, 19 bp, Homo sapiens
acatgtactacagctatat

SEQ ID NO: 1607418 - DNA, 15 bp, Homo sapiens
acatgtactccagag

SEQ ID NO: 1607419 - DNA, 18 bp, Homo sapiens
acatgtactccagaggga

SEQ ID NO: 1607420 - DNA, 18 bp, Homo sapiens
acatgtatggacgtgtgt

SEQ ID NO: 1607421 - DNA, 11 bp, Homo sapiens
acatgtatgtg

SEQ ID NO: 1607422 - DNA, 14 bp, Homo sapiens
acatgtattaaatt

SEQ ID NO: 1607423 - DNA, 21 bp, Homo sapiens
acatgtattaaattacatttg

SEQ ID NO: 1607424 - DNA, 12 bp, Homo sapiens
acatgtcaatct

SEQ ID NO: 1607425 - DNA, 11 bp, Homo sapiens
acatgtcatgt

SEQ ID NO: 1607426 - DNA, 23 bp, Homo sapiens
acatgtcctgcctattatctgtc

SEQ ID NO: 1607427 - DNA, 16 bp, Homo sapiens
acatgtctcctatcct

SEQ ID NO: 1607428 - DNA, 18 bp, Homo sapiens
acatgtctcctatcctgg

SEQ ID NO: 1607429 - DNA, 19 bp, Homo sapiens
acatgtcttgtacatgtgt

SEQ ID NO: 1607430 - DNA, 15 bp, Homo sapiens
acatgtgacacatat

SEQ ID NO: 1607431 - DNA, 21 bp, Homo sapiens
acatgtgacacatatgcacct

SEQ ID NO: 1607432 - DNA, 17 bp, Homo sapiens
acatgtgaggaggaaaa

SEQ ID NO: 1607433 - DNA, 14 bp, Homo sapiens
acatgtgatacatt

SEQ ID NO: 1607434 - DNA, 18 bp, Homo sapiens
acatgtgtacatatatgt

SEQ ID NO: 1607435 - DNA, 20 bp, Homo sapiens
acatgtgtacatatatgtat

SEQ ID NO: 1607436 - DNA, 20 bp, Homo sapiens
acatgtgtagcctgtgcatg

SEQ ID NO: 1607437 - DNA, 22 bp, Homo sapiens
acatgttaagataacttactgt

SEQ ID NO: 1607438 - DNA, 22 bp, Homo sapiens
acctcccttaagcagcaacagc

SEQ ID NO: 1607439 - DNA, 21 bp, Homo sapiens
acctcccttcccacctactgc

SEQ ID NO: 1607440 - DNA, 13 bp, Homo sapiens
acctcccttccct

SEQ ID NO: 1607441 - DNA, 23 bp, Homo sapiens
acctcctagaggtgggcagctgg

SEQ ID NO: 1607442 - DNA, 23 bp, Homo sapiens
acctcctcacttggctgtctgac

SEQ ID NO: 1607443 - DNA, 12 bp, Homo sapiens
acctcctccact

SEQ ID NO: 1607444 - DNA, 12 bp, Homo sapiens
acctcctccccc

SEQ ID NO: 1607445 - DNA, 13 bp, Homo sapiens
acctcctccccct

SEQ ID NO: 1607446 - DNA, 20 bp, Homo sapiens
acctcctctgtgatttcttt

SEQ ID NO: 1607447 - DNA, 19 bp, Homo sapiens
acctcctgagaaggcgagg

SEQ ID NO: 1607448 - DNA, 16 bp, Homo sapiens
acctcctgcccaggag

SEQ ID NO: 1607449 - DNA, 19 bp, Homo sapiens
acctcctgcccaggagagc

SEQ ID NO: 1607450 - DNA, 21 bp, Homo sapiens
acctcctgcccaggagagcca

SEQ ID NO: 1607451 - DNA, 21 bp, Homo sapiens
acctccttgtaacatcaggga

SEQ ID NO: 1607452 - DNA, 19 bp, Homo sapiens
acctcctttcatcacactg

SEQ ID NO: 1607453 - DNA, 23 bp, Homo sapiens
acctcggagggatggagaaagaa

SEQ ID NO: 1607454 - DNA, 15 bp, Homo sapiens
acctcgggcctgctg

SEQ ID NO: 1607455 - DNA, 21 bp, Homo sapiens
acctcgtcctccccctgccag

SEQ ID NO: 1607456 - DNA, 22 bp, Homo sapiens
acctcgtcctccccctgccagt

SEQ ID NO: 1607457 - DNA, 23 bp, Homo sapiens
acctcgtgatccgcctgcctctg

SEQ ID NO: 1607458 - DNA, 16 bp, Homo sapiens
acctctaataaacact

SEQ ID NO: 1607459 - DNA, 22 bp, Homo sapiens
acctctactaaaaagaaggaaa

SEQ ID NO: 1607460 - DNA, 18 bp, Homo sapiens
acctctagaatcccagca

SEQ ID NO: 1607461 - DNA, 23 bp, Homo sapiens
acctctagaatcccagcagcaga

SEQ ID NO: 1607462 - DNA, 16 bp, Homo sapiens
acctctagagaaaaga

SEQ ID NO: 1607463 - DNA, 22 bp, Homo sapiens
acctctcagcatagcctgcctg

SEQ ID NO: 1607464 - DNA, 18 bp, Homo sapiens
acctctcatcagtgtcct

SEQ ID NO: 1607465 - DNA, 10 bp, Homo sapiens
acctctccaa

SEQ ID NO: 1607466 - DNA, 13 bp, Homo sapiens
acctctccaaggg

SEQ ID NO: 1607467 - DNA, 22 bp, Homo sapiens
acctctccaagggcttctgcac

SEQ ID NO: 1607468 - DNA, 14 bp, Homo sapiens
acctctcctgaccc

SEQ ID NO: 1607469 - DNA, 15 bp, Homo sapiens
acctctcctgacccc

SEQ ID NO: 1607470 - DNA, 21 bp, Homo sapiens
acctctcgccatgatcagaca

SEQ ID NO: 1607471 - DNA, 14 bp, Homo sapiens
acctctctctctgg

SEQ ID NO: 1607472 - DNA, 14 bp, Homo sapiens
acctctctgtagtt

SEQ ID NO: 1607473 - DNA, 20 bp, Homo sapiens
acctctctgtagtttatggc

SEQ ID NO: 1607474 - DNA, 14 bp, Homo sapiens
acctctctgtccct

SEQ ID NO: 1607475 - DNA, 23 bp, Homo sapiens
acctctcttatagaatatttatt

SEQ ID NO: 1607476 - DNA, 14 bp, Homo sapiens
acctctcttcagcc

SEQ ID NO: 1607477 - DNA, 21 bp, Homo sapiens
acctctcttggaaagacacaa

SEQ ID NO: 1607478 - DNA, 21 bp, Homo sapiens
acctctgaggacagaggccgg

SEQ ID NO: 1607479 - DNA, 15 bp, Homo sapiens
acctctgatacctca

SEQ ID NO: 1607480 - DNA, 21 bp, Homo sapiens
acctctgcactactgacatgt

SEQ ID NO: 1607481 - DNA, 15 bp, Homo sapiens
acctctgcctcaatg

SEQ ID NO: 1607482 - DNA, 20 bp, Homo sapiens
acctctgcttttgcacacct

SEQ ID NO: 1607483 - DNA, 17 bp, Homo sapiens
ctctgtaccgcccggca

SEQ ID NO: 1607484 - DNA, 20 bp, Homo sapiens
ctctgtacttttcattctct

SEQ ID NO: 1607485 - DNA, 17 bp, Homo sapiens
ctctgtagctccctcct

SEQ ID NO: 1607486 - DNA, 19 bp, Homo sapiens
ctctgtagctccctcctcc

SEQ ID NO: 1607487 - DNA, 21 bp, Homo sapiens
actgtgaaaatagtgtaagaa

SEQ ID NO: 1607488 - DNA, 23 bp, Homo sapiens
actgtgaaaatagtgtaagaact

SEQ ID NO: 1607489 - DNA, 14 bp, Homo sapiens
actgtgaaatacca

SEQ ID NO: 1607490 - DNA, 16 bp, Homo sapiens
actgtgaacagcttgc

SEQ ID NO: 1607491 - DNA, 20 bp, Homo sapiens
actgtgaacagcttgctgtc

SEQ ID NO: 1607492 - DNA, 21 bp, Homo sapiens
actgtgaacagcttgctgtca

SEQ ID NO: 1607493 - DNA, 21 bp, Homo sapiens
ctgtggtggctccccctctgc

SEQ ID NO: 1607494 - DNA, 23 bp, Homo sapiens
ctgtggtggctccccctctgctt

SEQ ID NO: 1607495 - DNA, 14 bp, Homo sapiens
ctgtggttacagtg

SEQ ID NO: 1607496 - DNA, 17 bp, Homo sapiens
ctgtggttacagtgcag

SEQ ID NO: 1607497 - DNA, 22 bp, Homo sapiens
ctgtggttacagtgcagacagg

SEQ ID NO: 1607498 - DNA, 23 bp, Homo sapiens
ctgtggttacagtgcagacaggc

SEQ ID NO: 1607499 - DNA, 18 bp, Homo sapiens
ctgtggtttcagatgtgc

SEQ ID NO: 1607500 - DNA, 15 bp, Homo sapiens
ctgtgtaacactgtt

SEQ ID NO: 1607501 - DNA, 22 bp, Homo sapiens
ctgtgtaacatccaagccagag

SEQ ID NO: 1607502 - DNA, 20 bp, Homo sapiens
ctgtgtaagaagctgtgaat

SEQ ID NO: 1607503 - DNA, 15 bp, Homo sapiens
ctgtgtacaatgtga

SEQ ID NO: 1607504 - DNA, 17 bp, Homo sapiens
ctgtgtacacctctgga

SEQ ID NO: 1607505 - DNA, 22 bp, Homo sapiens
ctgtgtaccacttcctgaggcc

SEQ ID NO: 1607506 - DNA, 17 bp, Homo sapiens
tgctctttcccaggacg

SEQ ID NO: 1607507 - DNA, 22 bp, Homo sapiens
tgctctttcttggattggacag

SEQ ID NO: 1607508 - DNA, 16 bp, Homo sapiens
tgctctttgtggcagt

SEQ ID NO: 1607509 - DNA, 24 bp, Homo sapiens
tgctctttgtggcagtggccaggc

SEQ ID NO: 1607510 - DNA, 14 bp, Homo sapiens
tgctcttttcctgg

SEQ ID NO: 1607511 - DNA, 15 bp, Homo sapiens
tgctcttttctcctc

SEQ ID NO: 1607512 - DNA, 14 bp, Homo sapiens
tgctcttttgtgat

SEQ ID NO: 1607513 - DNA, 17 bp, Homo sapiens
tgctgaaacaacaaata

SEQ ID NO: 1607514 - DNA, 16 bp, Homo sapiens
tgctgaaacaatgcct

SEQ ID NO: 1607515 - DNA, 17 bp, Homo sapiens
tgctgaaatttggaaag

SEQ ID NO: 1607516 - DNA, 18 bp, Homo sapiens
tgctgaacacagtgtctg

SEQ ID NO: 1607517 - DNA, 19 bp, Homo sapiens
tgctgaacacagtgtctgt

SEQ ID NO: 1607518 - DNA, 16 bp, Homo sapiens
tgctgaactccttgtt

SEQ ID NO: 1607519 - DNA, 17 bp, Homo sapiens
tgctgaagttctgagcc

SEQ ID NO: 1607520 - DNA, 18 bp, Homo sapiens
tgctgaatggttttcaaa

SEQ ID NO: 1607521 - DNA, 22 bp, Homo sapiens
tgctgaatggttttcaaaataa

SEQ ID NO: 1607522 - DNA, 16 bp, Homo sapiens
tgctgacaacttagct

SEQ ID NO: 1607523 - DNA, 13 bp, Homo sapiens
tgctgacagacac

SEQ ID NO: 1607524 - DNA, 15 bp, Homo sapiens
tgctgacagctgacc

SEQ ID NO: 1607525 - DNA, 20 bp, Homo sapiens
tgctgaccaattgtgctgcc

SEQ ID NO: 1607526 - DNA, 22 bp, Homo sapiens
tgctgaccaattgtgctgccat

SEQ ID NO: 1607527 - DNA, 18 bp, Homo sapiens
tgctgacctcacctggtc

SEQ ID NO: 1607528 - DNA, 19 bp, Homo sapiens
tgctgacctcacctggtcc

SEQ ID NO: 1607529 - DNA, 20 bp, Homo sapiens
tgctgacctcacctggtcct

SEQ ID NO: 1607530 - DNA, 21 bp, Homo sapiens
tgctgacctcacctggtcctc

SEQ ID NO: 1607531 - DNA, 13 bp, Homo sapiens
tgctgacctcact

SEQ ID NO: 1607532 - DNA, 19 bp, Homo sapiens
tgctgacctcactgtcctg

SEQ ID NO: 1607533 - DNA, 15 bp, Homo sapiens
tgctgacggccaggg

SEQ ID NO: 1607534 - DNA, 22 bp, Homo sapiens
tgctgacggccagggagaagct

SEQ ID NO: 1607535 - DNA, 15 bp, Homo sapiens
tgctgactgaggcct

SEQ ID NO: 1607536 - DNA, 23 bp, Homo sapiens
tgctgactgaggcctgcttcccc

SEQ ID NO: 1607537 - DNA, 18 bp, Homo sapiens
tgctgactggcttcagca

SEQ ID NO: 1607538 - DNA, 15 bp, Homo sapiens
tgctgagagacccaa

SEQ ID NO: 1607539 - DNA, 17 bp, Homo sapiens
tgctgagagacccaagg

SEQ ID NO: 1607540 - DNA, 12 bp, Homo sapiens
tgctgagccact

SEQ ID NO: 1607541 - DNA, 16 bp, Homo sapiens
tgctgagcctctgctc

SEQ ID NO: 1607542 - DNA, 17 bp, Homo sapiens
tgctgagcctctgctcc

SEQ ID NO: 1607543 - DNA, 10 bp, Homo sapiens
tgctgagctt

SEQ ID NO: 1607544 - DNA, 14 bp, Homo sapiens
tgctgagcttagcc

SEQ ID NO: 1607545 - DNA, 15 bp, Homo sapiens
tgctgagcttagcct

SEQ ID NO: 1607546 - DNA, 17 bp, Homo sapiens
tgctgagcttagccttg

SEQ ID NO: 1607547 - DNA, 18 bp, Homo sapiens
tgctgaggatacagctct

SEQ ID NO: 1607548 - DNA, 21 bp, Homo sapiens
tgctgaggatacagctcttct

SEQ ID NO: 1607549 - DNA, 13 bp, Homo sapiens
tgctgaggcaccg

SEQ ID NO: 1607550 - DNA, 21 bp, Homo sapiens
tgctttcgtccatgtttctca

SEQ ID NO: 1607551 - DNA, 18 bp, Homo sapiens
tgctttctagcaaatatg

SEQ ID NO: 1607552 - DNA, 15 bp, Homo sapiens
tgctttctcctttaa

SEQ ID NO: 1607553 - DNA, 22 bp, Homo sapiens
tgctttctcctttaattgtaaa

SEQ ID NO: 1607554 - DNA, 12 bp, Homo sapiens
tgctttctgaaa

SEQ ID NO: 1607555 - DNA, 15 bp, Homo sapiens
tgctttctgaagctt

SEQ ID NO: 1607556 - DNA, 20 bp, Homo sapiens
tgctttctgaagctttacca

SEQ ID NO: 1607557 - DNA, 21 bp, Homo sapiens
tgctttctgaagctttaccag

SEQ ID NO: 1607558 - DNA, 14 bp, Homo sapiens
tgctttctgaattg

SEQ ID NO: 1607559 - DNA, 13 bp, Homo sapiens
tgctttctgccct

SEQ ID NO: 1607560 - DNA, 15 bp, Homo sapiens
tgctttctgcctctc

SEQ ID NO: 1607561 - DNA, 19 bp, Homo sapiens
tgctttctgcctctcctcc

SEQ ID NO: 1607562 - DNA, 16 bp, Homo sapiens
tgctttgaagtagctc

SEQ ID NO: 1607563 - DNA, 14 bp, Homo sapiens
tgctttgcattact

SEQ ID NO: 1607564 - DNA, 18 bp, Homo sapiens
tgctttgcattactgtcc

SEQ ID NO: 1607565 - DNA, 23 bp, Homo sapiens
tgctttgccaagttgctgtcact

SEQ ID NO: 1607566 - DNA, 14 bp, Homo sapiens
tgctttgccagagc

SEQ ID NO: 1607567 - DNA, 17 bp, Homo sapiens
tgctttgctagatgctg

SEQ ID NO: 1607568 - DNA, 12 bp, Homo sapiens
tgctttgctgct

SEQ ID NO: 1607569 - DNA, 22 bp, Homo sapiens
tgctttggacctaaatggcctc

SEQ ID NO: 1607570 - DNA, 19 bp, Homo sapiens
tgctttgggaggccaaggc

SEQ ID NO: 1607571 - DNA, 14 bp, Homo sapiens
tgctttgggctgcc

SEQ ID NO: 1607572 - DNA, 18 bp, Homo sapiens
tgctttgggctgccctgg

SEQ ID NO: 1607573 - DNA, 15 bp, Homo sapiens
tgctttgggctttgc

SEQ ID NO: 1607574 - DNA, 18 bp, Homo sapiens
tgctttgggctttgcagg

SEQ ID NO: 1607575 - DNA, 19 bp, Homo sapiens
tgctttgggctttgcaggc

SEQ ID NO: 1607576 - DNA, 12 bp, Homo sapiens
tgcttttaatta

SEQ ID NO: 1607577 - DNA, 16 bp, Homo sapiens
tgcttttaattaaata

SEQ ID NO: 1607578 - DNA, 19 bp, Homo sapiens
tgcttttagtgtgtgcata

SEQ ID NO: 1607579 - DNA, 23 bp, Homo sapiens
tgcttttcaccaaaatttctaca

SEQ ID NO: 1607580 - DNA, 12 bp, Homo sapiens
tgcttttccagg

SEQ ID NO: 1607581 - DNA, 12 bp, Homo sapiens
tgcttttccatc

SEQ ID NO: 1607582 - DNA, 14 bp, Homo sapiens
tgcttttccatcta

SEQ ID NO: 1607583 - DNA, 21 bp, Homo sapiens
tgcttttccctttgtgagtca

SEQ ID NO: 1607584 - DNA, 16 bp, Homo sapiens
tgcttttcctcaagca

SEQ ID NO: 1607585 - DNA, 23 bp, Homo sapiens
tgcttttctccaatatcagtgct

SEQ ID NO: 1607586 - DNA, 15 bp, Homo sapiens
tgcttttctgccctg

SEQ ID NO: 1607587 - DNA, 17 bp, Homo sapiens
tgcttttctgtatttta

SEQ ID NO: 1607588 - DNA, 14 bp, Homo sapiens
tgcttttctgtcct

SEQ ID NO: 1607589 - DNA, 17 bp, Homo sapiens
tgcttttctgtcctggg

SEQ ID NO: 1607590 - DNA, 20 bp, Homo sapiens
tgcttttgatgtgaaaatca

SEQ ID NO: 1607591 - DNA, 17 bp, Homo sapiens
tgcttttgcatttctct

SEQ ID NO: 1607592 - DNA, 23 bp, Homo sapiens
tgcttttgcatttctcttcctaa

SEQ ID NO: 1607593 - DNA, 23 bp, Homo sapiens
tgcttttgttccaatgtcaatgt

SEQ ID NO: 1607594 - DNA, 17 bp, Homo sapiens
tgcttttgttgtgactt

SEQ ID NO: 1607595 - DNA, 22 bp, Homo sapiens
tgctttttcttgtttgtttaaa

SEQ ID NO: 1607596 - DNA, 15 bp, Homo sapiens
tgctttttggcacag

SEQ ID NO: 1607597 - DNA, 16 bp, Homo sapiens
tgctttttgtgttttt

SEQ ID NO: 1607598 - DNA, 19 bp, Homo sapiens
tgcttttttccaaaacaaa

SEQ ID NO: 1607599 - DNA, 16 bp, Homo sapiens
tgcttttttgttttgt

SEQ ID NO: 1607600 - DNA, 16 bp, Homo sapiens
tgctttttttcttaaa

SEQ ID NO: 1607601 - DNA, 23 bp, Homo sapiens
tgctttttttgtgtgtatttgct

SEQ ID NO: 1607602 - DNA, 17 bp, Homo sapiens
tgcttttttttttccag

SEQ ID NO: 1607603 - DNA, 19 bp, Homo sapiens
tgcttttttttttccagca

SEQ ID NO: 1607604 - DNA, 18 bp, Homo sapiens
tggaaaaaaacataaaaa

SEQ ID NO: 1607605 - DNA, 17 bp, Homo sapiens
tggaaaaataacaacta

SEQ ID NO: 1607606 - DNA, 23 bp, Homo sapiens
tggaaaaatggttgatggaaaat

SEQ ID NO: 1607607 - DNA, 15 bp, Homo sapiens
tggaaaacgaagctc

SEQ ID NO: 1607608 - DNA, 21 bp, Homo sapiens
tggaaaactaagaaaattgct

SEQ ID NO: 1607609 - DNA, 12 bp, Homo sapiens
tggaaaagaaga

SEQ ID NO: 1607610 - DNA, 12 bp, Homo sapiens
tggaaaagacag

SEQ ID NO: 1607611 - DNA, 21 bp, Homo sapiens
tggaaaagcaacttcatttga

SEQ ID NO: 1607612 - DNA, 15 bp, Homo sapiens
tggaaaattcatttt

SEQ ID NO: 1607613 - DNA, 19 bp, Homo sapiens
tggaaaattttctccttgg

SEQ ID NO: 1607614 - DNA, 12 bp, Homo sapiens
tggaaacagcat

SEQ ID NO: 1607615 - DNA, 13 bp, Homo sapiens
tggaaacagcatg

SEQ ID NO: 1607616 - DNA, 14 bp, Homo sapiens
tggaaacctgccct

SEQ ID NO: 1607617 - DNA, 15 bp, Homo sapiens
tggaaacctgccctg

SEQ ID NO: 1607618 - DNA, 19 bp, Homo sapiens
tggaaacctgccctgcctg

SEQ ID NO: 1607619 - DNA, 22 bp, Homo sapiens
tggaaacctgccctgcctgagg

SEQ ID NO: 1607620 - DNA, 14 bp, Homo sapiens
tggaaactcagccg

SEQ ID NO: 1607621 - DNA, 15 bp, Homo sapiens
tggaaactcagccgt

SEQ ID NO: 1607622 - DNA, 18 bp, Homo sapiens
tggaaactcagccgtagg

SEQ ID NO: 1607623 - DNA, 14 bp, Homo sapiens
tggaaactgaatgc

SEQ ID NO: 1607624 - DNA, 14 bp, Homo sapiens
tggaaactgctccc

SEQ ID NO: 1607625 - DNA, 16 bp, Homo sapiens
tggaaagaatctaata

SEQ ID NO: 1607626 - DNA, 13 bp, Homo sapiens
tggaaagactggg

SEQ ID NO: 1607627 - DNA, 15 bp, Homo sapiens
tggaaagatgttaag

SEQ ID NO: 1607628 - DNA, 12 bp, Homo sapiens
tggaaagcctct

SEQ ID NO: 1607629 - DNA, 13 bp, Homo sapiens
tggaaaggaccaa

SEQ ID NO: 1607630 - DNA, 21 bp, Homo sapiens
tggaaaggatctgtgattggc

SEQ ID NO: 1607631 - DNA, 17 bp, Homo sapiens
tggaaaggctcagtctc

SEQ ID NO: 1607632 - DNA, 20 bp, Homo sapiens
tggaaaggctcagtctcagg

SEQ ID NO: 1607633 - DNA, 23 bp, Homo sapiens
tggaaaggctcagtctcaggagc

SEQ ID NO: 1607634 - DNA, 22 bp, Homo sapiens
tggaaaggtcctgctgtggaaa

SEQ ID NO: 1607635 - DNA, 19 bp, Homo sapiens
tggaaagtaactcatttgt

SEQ ID NO: 1607636 - DNA, 15 bp, Homo sapiens
tggaaagtaactgtg

SEQ ID NO: 1607637 - DNA, 17 bp, Homo sapiens
tggaaagttactgtaaa

SEQ ID NO: 1607638 - DNA, 19 bp, Homo sapiens
tggaacctcagcctggcca

SEQ ID NO: 1607639 - DNA, 22 bp, Homo sapiens
tggaacctcattgctaccacag

SEQ ID NO: 1607640 - DNA, 23 bp, Homo sapiens
tggaacctcattgctaccacaga

SEQ ID NO: 1607641 - DNA, 18 bp, Homo sapiens
tggaactactgtactttg

SEQ ID NO: 1607642 - DNA, 20 bp, Homo sapiens
tggaactctgtgcaggtgct

SEQ ID NO: 1607643 - DNA, 12 bp, Homo sapiens
tggaactgtccc

SEQ ID NO: 1607644 - DNA, 17 bp, Homo sapiens
tggaactgtcccagcta

SEQ ID NO: 1607645 - DNA, 21 bp, Homo sapiens
tggaacttgagttattaaaat

SEQ ID NO: 1607646 - DNA, 21 bp, Homo sapiens
tggaagaaaaaaaccacacaa

SEQ ID NO: 1607647 - DNA, 15 bp, Homo sapiens
tggaagaaccactgt

SEQ ID NO: 1607648 - DNA, 18 bp, Homo sapiens
tggaagaactgtgataaa

SEQ ID NO: 1607649 - DNA, 13 bp, Homo sapiens
tggaagaagggag

SEQ ID NO: 1607650 - DNA, 19 bp, Homo sapiens
tggaagaagggagaagaaa

SEQ ID NO: 1607651 - DNA, 21 bp, Homo sapiens
tggaagaagggagaagaaagg

SEQ ID NO: 1607652 - DNA, 13 bp, Homo sapiens
tggaagaccccac

SEQ ID NO: 1607653 - DNA, 16 bp, Homo sapiens
tggaagagcagcctga

SEQ ID NO: 1607654 - DNA, 18 bp, Homo sapiens
tggaagagcagcctgatg

SEQ ID NO: 1607655 - DNA, 21 bp, Homo sapiens
tggaagagcccagtctgttga

SEQ ID NO: 1607656 - DNA, 23 bp, Homo sapiens
tggaagaggaacagcactgggga

SEQ ID NO: 1607657 - DNA, 21 bp, Homo sapiens
tggaagatcctgcgggtgggg

SEQ ID NO: 1607658 - DNA, 22 bp, Homo sapiens
tggaagatttaccttttctgtt

SEQ ID NO: 1607659 - DNA, 12 bp, Homo sapiens
tggaagcagagc

SEQ ID NO: 1607660 - DNA, 14 bp, Homo sapiens
tggaagcagagcaa

SEQ ID NO: 1607661 - DNA, 16 bp, Homo sapiens
tggaagccagctttcc

SEQ ID NO: 1607662 - DNA, 18 bp, Homo sapiens
tggaagccaggtacagga

SEQ ID NO: 1607663 - DNA, 16 bp, Homo sapiens
tggaagcccctgggcc

SEQ ID NO: 1607664 - DNA, 20 bp, Homo sapiens
tggaagcccctgggcccagt

SEQ ID NO: 1607665 - DNA, 13 bp, Homo sapiens
tggaagccctcct

SEQ ID NO: 1607666 - DNA, 20 bp, Homo sapiens
tggaagcctgaactgaggcc

SEQ ID NO: 1607667 - DNA, 15 bp, Homo sapiens
tggaagcctggactc

SEQ ID NO: 1607668 - DNA, 20 bp, Homo sapiens
tggaagctagacacatgaag

SEQ ID NO: 1607669 - DNA, 20 bp, Homo sapiens
tggaagctctccgagctctg

SEQ ID NO: 1607670 - DNA, 17 bp, Homo sapiens
tggaagctgccctgccc

SEQ ID NO: 1607671 - DNA, 18 bp, Homo sapiens
tggaagctgccctgccca

SEQ ID NO: 1607672 - DNA, 14 bp, Homo sapiens
tggaagctgggtga

SEQ ID NO: 1607673 - DNA, 15 bp, Homo sapiens
tggaagctgtgtcct

SEQ ID NO: 1607674 - DNA, 17 bp, Homo sapiens
tggaagctgtttggaaa

SEQ ID NO: 1607675 - DNA, 23 bp, Homo sapiens
tggaagctgtttggaaaagacag

SEQ ID NO: 1607676 - DNA, 22 bp, Homo sapiens
tggaagcttgttgaaaacccag

SEQ ID NO: 1607677 - DNA, 19 bp, Homo sapiens
tggaagctttgagttgact

SEQ ID NO: 1607678 - DNA, 20 bp, Homo sapiens
tggaaggacacagtgatgaa

SEQ ID NO: 1607679 - DNA, 20 bp, Homo sapiens
tggaaggagcacatactacc

SEQ ID NO: 1607680 - DNA, 14 bp, Homo sapiens
tggaaggagcagaa

SEQ ID NO: 1607681 - DNA, 15 bp, Homo sapiens
tggaaggatctgctg

SEQ ID NO: 1607682 - DNA, 18 bp, Homo sapiens
tggaaggcagggcagagg

SEQ ID NO: 1607683 - DNA, 19 bp, Homo sapiens
tggaaggccccttccctgg

SEQ ID NO: 1607684 - DNA, 14 bp, Homo sapiens
tggaaggctggctg

SEQ ID NO: 1607685 - DNA, 14 bp, Homo sapiens
tggaagggaaaaaa

SEQ ID NO: 1607686 - DNA, 15 bp, Homo sapiens
tggaagggaaaaaaa

SEQ ID NO: 1607687 - DNA, 23 bp, Homo sapiens
tggaagggaggaaggcctttctt

SEQ ID NO: 1607688 - DNA, 18 bp, Homo sapiens
tggaagggccggcttctg

SEQ ID NO: 1607689 - DNA, 19 bp, Homo sapiens
tggaagggcgttctaggta

SEQ ID NO: 1607690 - DNA, 15 bp, Homo sapiens
tggaaggggcagcag

SEQ ID NO: 1607691 - DNA, 16 bp, Homo sapiens
tggaagggggagacag

SEQ ID NO: 1607692 - DNA, 18 bp, Homo sapiens
tggaagggggagacagga

SEQ ID NO: 1607693 - DNA, 21 bp, Homo sapiens
tggaagggggagacaggaagt

SEQ ID NO: 1607694 - DNA, 21 bp, Homo sapiens
tggaaggtatttttttaaatt

SEQ ID NO: 1607695 - DNA, 20 bp, Homo sapiens
tggaagtaaccatttgcact

SEQ ID NO: 1607696 - DNA, 22 bp, Homo sapiens
tggaagtctccatgaagagctt

SEQ ID NO: 1607697 - DNA, 13 bp, Homo sapiens
tggaagtgtgggt

SEQ ID NO: 1607698 - DNA, 20 bp, Homo sapiens
tggaagtgtgggtctgtgtg

SEQ ID NO: 1607699 - DNA, 21 bp, Homo sapiens
tggaagtgttccctgagaaac

SEQ ID NO: 1607700 - DNA, 15 bp, Homo sapiens
tggaagttgtggata

SEQ ID NO: 1607701 - DNA, 16 bp, Homo sapiens
tggaagtttgtgttct

SEQ ID NO: 1607702 - DNA, 19 bp, Homo sapiens
tggaagtttgtgttctgtt

SEQ ID NO: 1607703 - DNA, 23 bp, Homo sapiens
tggaagtttgtgttctgtttgtt

SEQ ID NO: 1607704 - DNA, 13 bp, Homo sapiens
tggaagttttcag

SEQ ID NO: 1607705 - DNA, 19 bp, Homo sapiens
tggaagttttcctacactt

SEQ ID NO: 1607706 - DNA, 13 bp, Homo sapiens
tggaataaacatt

SEQ ID NO: 1607707 - DNA, 16 bp, Homo sapiens
tggaataaagttgcag

SEQ ID NO: 1607708 - DNA, 18 bp, Homo sapiens
tggaataaagttgcagat

SEQ ID NO: 1607709 - DNA, 14 bp, Homo sapiens
tggaataacatgta

SEQ ID NO: 1607710 - DNA, 18 bp, Homo sapiens
tggaataaggcatggctc

SEQ ID NO: 1607711 - DNA, 15 bp, Homo sapiens
tggaataagttcaaa

SEQ ID NO: 1607712 - DNA, 14 bp, Homo sapiens
tggaataatttcta

SEQ ID NO: 1607713 - DNA, 17 bp, Homo sapiens
tggaataatttctatta

SEQ ID NO: 1607714 - DNA, 14 bp, Homo sapiens
tggaatacagtgtt

SEQ ID NO: 1607715 - DNA, 15 bp, Homo sapiens
tggaatacagtgtta

SEQ ID NO: 1607716 - DNA, 22 bp, Homo sapiens
tggaatacagtgttattttctt

SEQ ID NO: 1607717 - DNA, 18 bp, Homo sapiens
tggaatagatgtctcaaa

SEQ ID NO: 1607718 - DNA, 17 bp, Homo sapiens
tggaataggaataagct

SEQ ID NO: 1607719 - DNA, 16 bp, Homo sapiens
tggaatagtgaatact

SEQ ID NO: 1607720 - DNA, 14 bp, Homo sapiens
tggaatagttctgt

SEQ ID NO: 1607721 - DNA, 17 bp, Homo sapiens
tggaatagttctgtata

SEQ ID NO: 1607722 - DNA, 14 bp, Homo sapiens
tggaatataaggaa

SEQ ID NO: 1607723 - DNA, 21 bp, Homo sapiens
tggaatataaggaaagcaata

SEQ ID NO: 1607724 - DNA, 23 bp, Homo sapiens
tggaatatattctttgaaatata

SEQ ID NO: 1607725 - DNA, 21 bp, Homo sapiens
tggaatattttatcctgtatt

SEQ ID NO: 1607726 - DNA, 21 bp, Homo sapiens
tggaatcaggaatattttcca

SEQ ID NO: 1607727 - DNA, 16 bp, Homo sapiens
tggaatctaacgggca

SEQ ID NO: 1607728 - DNA, 20 bp, Homo sapiens
tggaatcttcacctcagagt

SEQ ID NO: 1607729 - DNA, 18 bp, Homo sapiens
tggacaccctctgccgag

SEQ ID NO: 1607730 - DNA, 15 bp, Homo sapiens
tggacacgagccaca

SEQ ID NO: 1607731 - DNA, 16 bp, Homo sapiens
tggacacgagccacaa

SEQ ID NO: 1607732 - DNA, 20 bp, Homo sapiens
tggacacgagccacaagctg

SEQ ID NO: 1607733 - DNA, 14 bp, Homo sapiens
tggacactgtacaa

SEQ ID NO: 1607734 - DNA, 20 bp, Homo sapiens
tggacagacttcacagcgtc

SEQ ID NO: 1607735 - DNA, 22 bp, Homo sapiens
tggacagattgcctgtttctga

SEQ ID NO: 1607736 - DNA, 14 bp, Homo sapiens
tggacagccccacc

SEQ ID NO: 1607737 - DNA, 14 bp, Homo sapiens
tggacagccccctt

SEQ ID NO: 1607738 - DNA, 13 bp, Homo sapiens
tggacagctgctt

SEQ ID NO: 1607739 - DNA, 14 bp, Homo sapiens
tggacagctgcttg

SEQ ID NO: 1607740 - DNA, 18 bp, Homo sapiens
tggacaggatgaggacag

SEQ ID NO: 1607741 - DNA, 21 bp, Homo sapiens
tggacaggatgaggacagagg

SEQ ID NO: 1607742 - DNA, 16 bp, Homo sapiens
tggacaggcagcctcc

SEQ ID NO: 1607743 - DNA, 21 bp, Homo sapiens
tggacaggcagcctcctttgt

SEQ ID NO: 1607744 - DNA, 12 bp, Homo sapiens
tggacaggccca

SEQ ID NO: 1607745 - DNA, 14 bp, Homo sapiens
tggacaggcccagc

SEQ ID NO: 1607746 - DNA, 22 bp, Homo sapiens
tggacaggcccagcgcggccag

SEQ ID NO: 1607747 - DNA, 14 bp, Homo sapiens
tggacaggctctgc

SEQ ID NO: 1607748 - DNA, 12 bp, Homo sapiens
tggacagtcctg

SEQ ID NO: 1607749 - DNA, 13 bp, Homo sapiens
tggacagtcctgg

SEQ ID NO: 1607750 - DNA, 15 bp, Homo sapiens
tggacagtcctggga

SEQ ID NO: 1607751 - DNA, 16 bp, Homo sapiens
tggacagtcctgggag

SEQ ID NO: 1607752 - DNA, 23 bp, Homo sapiens
tggacagtttaccagttgccttt

SEQ ID NO: 1607753 - DNA, 20 bp, Homo sapiens
tggacatcctcctcccaccc

SEQ ID NO: 1607754 - DNA, 21 bp, Homo sapiens
tggacatcgtaggcagccacg

SEQ ID NO: 1607755 - DNA, 14 bp, Homo sapiens
tggacatgaaggaa

SEQ ID NO: 1607756 - DNA, 19 bp, Homo sapiens
tggacatgagatggagagg

SEQ ID NO: 1607757 - DNA, 17 bp, Homo sapiens
tggacatgtgggtggag

SEQ ID NO: 1607758 - DNA, 18 bp, Homo sapiens
tggacatgtgggtggaga

SEQ ID NO: 1607759 - DNA, 16 bp, Homo sapiens
tggacattctctttga

SEQ ID NO: 1607760 - DNA, 20 bp, Homo sapiens
tggacattctctttgataac

SEQ ID NO: 1607761 - DNA, 19 bp, Homo sapiens
tggacattgagatactatc

SEQ ID NO: 1607762 - DNA, 21 bp, Homo sapiens
tggacatttgggttggttcca

SEQ ID NO: 1607763 - DNA, 20 bp, Homo sapiens
tggaccaatagggctgagct

SEQ ID NO: 1607764 - DNA, 13 bp, Homo sapiens
tggaccacaggca

SEQ ID NO: 1607765 - DNA, 15 bp, Homo sapiens
tggaccacaggcatc

SEQ ID NO: 1607766 - DNA, 17 bp, Homo sapiens
tggaccaccagccccag

SEQ ID NO: 1607767 - DNA, 19 bp, Homo sapiens
tggaccagaggaagcccct

SEQ ID NO: 1607768 - DNA, 13 bp, Homo sapiens
tggaccagcctcc

SEQ ID NO: 1607769 - DNA, 15 bp, Homo sapiens
tggaccagcctcctg

SEQ ID NO: 1607770 - DNA, 13 bp, Homo sapiens
tggaccaggacag

SEQ ID NO: 1607771 - DNA, 15 bp, Homo sapiens
tggaccagtggctgg

SEQ ID NO: 1607772 - DNA, 18 bp, Homo sapiens
tggaccagtggctggtct

SEQ ID NO: 1607773 - DNA, 19 bp, Homo sapiens
tggaccagtggtttccagt

SEQ ID NO: 1607774 - DNA, 21 bp, Homo sapiens
tggacccactacccttctcct

SEQ ID NO: 1607775 - DNA, 20 bp, Homo sapiens
tggacccagggatgacatgt

SEQ ID NO: 1607776 - DNA, 22 bp, Homo sapiens
tggacccatggtcatctctgtt

SEQ ID NO: 1607777 - DNA, 13 bp, Homo sapiens
tggaccccagctg

SEQ ID NO: 1607778 - DNA, 18 bp, Homo sapiens
tggaccctgtcttctggg

SEQ ID NO: 1607779 - DNA, 18 bp, Homo sapiens
tggaccgaaatctgtatt

SEQ ID NO: 1607780 - DNA, 14 bp, Homo sapiens
tggaccgggtgggc

SEQ ID NO: 1607781 - DNA, 19 bp, Homo sapiens
tggaccgggtgggcctggc

SEQ ID NO: 1607782 - DNA, 20 bp, Homo sapiens
tggaccgggtgggcctggcc

SEQ ID NO: 1607783 - DNA, 18 bp, Homo sapiens
tggaccgtggacaggccc

SEQ ID NO: 1607784 - DNA, 19 bp, Homo sapiens
tggaccgtggacaggccca

SEQ ID NO: 1607785 - DNA, 17 bp, Homo sapiens
tggacctaaatggcctc

SEQ ID NO: 1607786 - DNA, 21 bp, Homo sapiens
tggacctaaatggcctcatgt

SEQ ID NO: 1607787 - DNA, 14 bp, Homo sapiens
tggacctaatccaa

SEQ ID NO: 1607788 - DNA, 22 bp, Homo sapiens
tggacctatgtcctaaggacac

SEQ ID NO: 1607789 - DNA, 16 bp, Homo sapiens
tggacctgcctcctgc

SEQ ID NO: 1607790 - DNA, 19 bp, Homo sapiens
tggacctgcctcctgcctg

SEQ ID NO: 1607791 - DNA, 15 bp, Homo sapiens
tggacctgcctgcat

SEQ ID NO: 1607792 - DNA, 17 bp, Homo sapiens
tggaccttaggccttcc

SEQ ID NO: 1607793 - DNA, 22 bp, Homo sapiens
tggacctttcctgaggaagagg

SEQ ID NO: 1607794 - DNA, 14 bp, Homo sapiens
tggacgctgccctg

SEQ ID NO: 1607795 - DNA, 12 bp, Homo sapiens
tggacgtgaaat

SEQ ID NO: 1607796 - DNA, 23 bp, Homo sapiens
tggactaaaggcatccttgtctt

SEQ ID NO: 1607797 - DNA, 14 bp, Homo sapiens
tggactaagcaatt

SEQ ID NO: 1607798 - DNA, 20 bp, Homo sapiens
tggactaattattattttaa

SEQ ID NO: 1607799 - DNA, 20 bp, Homo sapiens
tggactacacaatacagtat

SEQ ID NO: 1607800 - DNA, 15 bp, Homo sapiens
tggactccaggcctg

SEQ ID NO: 1607801 - DNA, 13 bp, Homo sapiens
tggactcccctcc

SEQ ID NO: 1607802 - DNA, 14 bp, Homo sapiens
tggactcctcttgg

SEQ ID NO: 1607803 - DNA, 12 bp, Homo sapiens
tggactcctgac

SEQ ID NO: 1607804 - DNA, 18 bp, Homo sapiens
tggactctgcacatgtct

SEQ ID NO: 1607805 - DNA, 17 bp, Homo sapiens
tggactctgccccaatc

SEQ ID NO: 1607806 - DNA, 21 bp, Homo sapiens
tggactctggtgcctccagag

SEQ ID NO: 1607807 - DNA, 15 bp, Homo sapiens
tggactgaagcctgc

SEQ ID NO: 1607808 - DNA, 13 bp, Homo sapiens
tggactgacattt

SEQ ID NO: 1607809 - DNA, 19 bp, Homo sapiens
tggactgactgcagccccc

SEQ ID NO: 1607810 - DNA, 14 bp, Homo sapiens
tggactgactgtgt

SEQ ID NO: 1607811 - DNA, 15 bp, Homo sapiens
tggactgactgtgtt

SEQ ID NO: 1607812 - DNA, 19 bp, Homo sapiens
tggactgagaaattatact

SEQ ID NO: 1607813 - DNA, 17 bp, Homo sapiens
tggactgagctggggga

SEQ ID NO: 1607814 - DNA, 15 bp, Homo sapiens
tggactgaggcctga

SEQ ID NO: 1607815 - DNA, 16 bp, Homo sapiens
tggactgatttgtgga

SEQ ID NO: 1607816 - DNA, 20 bp, Homo sapiens
tggactgcagtcggcatgcc

SEQ ID NO: 1607817 - DNA, 13 bp, Homo sapiens
tggactgcatggg

SEQ ID NO: 1607818 - DNA, 12 bp, Homo sapiens
tggactgcattt

SEQ ID NO: 1607819 - DNA, 20 bp, Homo sapiens
tggactgcatttaaatttga

SEQ ID NO: 1607820 - DNA, 22 bp, Homo sapiens
tggactgctacctttcaaagct

SEQ ID NO: 1607821 - DNA, 17 bp, Homo sapiens
tggactggaggcccctg

SEQ ID NO: 1607822 - DNA, 23 bp, Homo sapiens
tggactggaggcccctggagcca

SEQ ID NO: 1607823 - DNA, 12 bp, Homo sapiens
tggactggccat

SEQ ID NO: 1607824 - DNA, 13 bp, Homo sapiens
tgctatgaatgat

SEQ ID NO: 1607825 - DNA, 23 bp, Homo sapiens
tgctatgcaaaatagacatcttt

SEQ ID NO: 1607826 - DNA, 20 bp, Homo sapiens
tgctatgcgggttgattatt

SEQ ID NO: 1607827 - DNA, 20 bp, Homo sapiens
tgctatggaacataaagttg

SEQ ID NO: 1607828 - DNA, 20 bp, Homo sapiens
tgctatggcaggataagaaa

SEQ ID NO: 1607829 - DNA, 13 bp, Homo sapiens
tgctatgtaaggg

SEQ ID NO: 1607830 - DNA, 12 bp, Homo sapiens
tgctatgttctg

SEQ ID NO: 1607831 - DNA, 17 bp, Homo sapiens
tgctatgttctgtcttc

SEQ ID NO: 1607832 - DNA, 19 bp, Homo sapiens
tgctatgttctgtcttccc

SEQ ID NO: 1607833 - DNA, 22 bp, Homo sapiens
tgctatgttctgtcttcccaaa

SEQ ID NO: 1607834 - DNA, 18 bp, Homo sapiens
tgctattaaaaaaaaaga

SEQ ID NO: 1607835 - DNA, 21 bp, Homo sapiens
tgctattctgtgttgaacaca

SEQ ID NO: 1607836 - DNA, 16 bp, Homo sapiens
tgctattgacaagtca

SEQ ID NO: 1607837 - DNA, 22 bp, Homo sapiens
tgctattgtagagccagaggtc

SEQ ID NO: 1607838 - DNA, 16 bp, Homo sapiens
tgctattgtgaatagt

SEQ ID NO: 1607839 - DNA, 18 bp, Homo sapiens
tgctatttattttcctaa

SEQ ID NO: 1607840 - DNA, 17 bp, Homo sapiens
tgctatttgagcatgca

SEQ ID NO: 1607841 - DNA, 17 bp, Homo sapiens
tgctatttgtacaaata

SEQ ID NO: 1607842 - DNA, 15 bp, Homo sapiens
tgctcaaaaagaaat

SEQ ID NO: 1607843 - DNA, 16 bp, Homo sapiens
tgctcaaaattgcttc

SEQ ID NO: 1607844 - DNA, 19 bp, Homo sapiens
tgctcaaatctattcagac

SEQ ID NO: 1607845 - DNA, 16 bp, Homo sapiens
tgctcaaccactgtgg

SEQ ID NO: 1607846 - DNA, 23 bp, Homo sapiens
tgctcaactctacccctgctccc

SEQ ID NO: 1607847 - DNA, 14 bp, Homo sapiens
tgctcaagaagaca

SEQ ID NO: 1607848 - DNA, 15 bp, Homo sapiens
tgctcaagaagacat

SEQ ID NO: 1607849 - DNA, 19 bp, Homo sapiens
tgctcaagggttctttcct

SEQ ID NO: 1607850 - DNA, 21 bp, Homo sapiens
tgctcaataaatgattcttag

SEQ ID NO: 1607851 - DNA, 16 bp, Homo sapiens
tgctcacacattacaa

SEQ ID NO: 1607852 - DNA, 14 bp, Homo sapiens
tgctcacagctgta

SEQ ID NO: 1607853 - DNA, 14 bp, Homo sapiens
tgctcacctctgcc

SEQ ID NO: 1607854 - DNA, 20 bp, Homo sapiens
tgctcacctgtgtgcccagc

SEQ ID NO: 1607855 - DNA, 22 bp, Homo sapiens
tgctcactcccaagggacagca

SEQ ID NO: 1607856 - DNA, 22 bp, Homo sapiens
tgctcagaacttgctgctgtct

SEQ ID NO: 1607857 - DNA, 16 bp, Homo sapiens
tgctcagaatgccgca

SEQ ID NO: 1607858 - DNA, 14 bp, Homo sapiens
tgctcagagaagga

SEQ ID NO: 1607859 - DNA, 19 bp, Homo sapiens
tgctcagcacactctcctg

SEQ ID NO: 1607860 - DNA, 13 bp, Homo sapiens
tgctcagcagcca

SEQ ID NO: 1607861 - DNA, 14 bp, Homo sapiens
tgctcagcagccag

SEQ ID NO: 1607862 - DNA, 18 bp, Homo sapiens
tgctcagcagccagtctc

SEQ ID NO: 1607863 - DNA, 19 bp, Homo sapiens
tgctcagcagccagtctca

SEQ ID NO: 1607864 - DNA, 21 bp, Homo sapiens
tgctcagcagccagtctcaga

SEQ ID NO: 1607865 - DNA, 18 bp, Homo sapiens
tgctcagccaaatttcct

SEQ ID NO: 1607866 - DNA, 19 bp, Homo sapiens
tgctcagccaaatttcctg

SEQ ID NO: 1607867 - DNA, 21 bp, Homo sapiens
tgctcagccttgctgctctgc

SEQ ID NO: 1607868 - DNA, 23 bp, Homo sapiens
tgctcagccttgctgctctgcgt

SEQ ID NO: 1607869 - DNA, 18 bp, Homo sapiens
tgctcagggtcactgaac

SEQ ID NO: 1607870 - DNA, 20 bp, Homo sapiens
tgctcataggacctgcatcc

SEQ ID NO: 1607871 - DNA, 22 bp, Homo sapiens
tgctcatattgtgattctgcct

SEQ ID NO: 1607872 - DNA, 22 bp, Homo sapiens
tgctcatcattccttgagaaaa

SEQ ID NO: 1607873 - DNA, 14 bp, Homo sapiens
tgctcatcggagac

SEQ ID NO: 1607874 - DNA, 13 bp, Homo sapiens
tgctcatctgctg

SEQ ID NO: 1607875 - DNA, 15 bp, Homo sapiens
tgctcatctgctggt

SEQ ID NO: 1607876 - DNA, 16 bp, Homo sapiens
tgctcatctgctggtc

SEQ ID NO: 1607877 - DNA, 16 bp, Homo sapiens
tgctcatctgtacata

SEQ ID NO: 1607878 - DNA, 18 bp, Homo sapiens
tgctcatctgtacatact

SEQ ID NO: 1607879 - DNA, 18 bp, Homo sapiens
tgctcattacagttcttt

SEQ ID NO: 1607880 - DNA, 17 bp, Homo sapiens
tgctcattatgccactt

SEQ ID NO: 1607881 - DNA, 18 bp, Homo sapiens
tgctcatttaagtttcaa

SEQ ID NO: 1607882 - DNA, 16 bp, Homo sapiens
tgctcattttctggtt

SEQ ID NO: 1607883 - DNA, 16 bp, Homo sapiens
tgctccaacctgaagg

SEQ ID NO: 1607884 - DNA, 15 bp, Homo sapiens
tgctccaccacatcc

SEQ ID NO: 1607885 - DNA, 15 bp, Homo sapiens
tgctccaccagcagc

SEQ ID NO: 1607886 - DNA, 16 bp, Homo sapiens
tgctccacccttggcc

SEQ ID NO: 1607887 - DNA, 17 bp, Homo sapiens
tgctccacccttggcct

SEQ ID NO: 1607888 - DNA, 12 bp, Homo sapiens
tgctgtggctcc

SEQ ID NO: 1607889 - DNA, 14 bp, Homo sapiens
tgctgtggtgggga

SEQ ID NO: 1607890 - DNA, 20 bp, Homo sapiens
tgctgtggtggggagaggca

SEQ ID NO: 1607891 - DNA, 20 bp, Homo sapiens
tgctgtgtcttcattttcat

SEQ ID NO: 1607892 - DNA, 16 bp, Homo sapiens
tgctgttaatatttct

SEQ ID NO: 1607893 - DNA, 23 bp, Homo sapiens
tgctgttcccccaggtgttgtaa

SEQ ID NO: 1607894 - DNA, 18 bp, Homo sapiens
tgctgttcctgctccatg

SEQ ID NO: 1607895 - DNA, 18 bp, Homo sapiens
tgctgttgaggtggctgt

SEQ ID NO: 1607896 - DNA, 14 bp, Homo sapiens
tgctgttgcctcat

SEQ ID NO: 1607897 - DNA, 22 bp, Homo sapiens
tgctgttgctgctactgtctta

SEQ ID NO: 1607898 - DNA, 14 bp, Homo sapiens
tgctgttgtaaaca

SEQ ID NO: 1607899 - DNA, 23 bp, Homo sapiens
tgctgtttaaagtcacatccctg

SEQ ID NO: 1607900 - DNA, 17 bp, Homo sapiens
tgctgtttattaatctt

SEQ ID NO: 1607901 - DNA, 23 bp, Homo sapiens
tgctgtttattaatcttagtgta

SEQ ID NO: 1607902 - DNA, 13 bp, Homo sapiens
tgctgtttcacaa

SEQ ID NO: 1607903 - DNA, 23 bp, Homo sapiens
tgctgtttgggttgttggtctgt

SEQ ID NO: 1607904 - DNA, 12 bp, Homo sapiens
tgctgttttatg

SEQ ID NO: 1607905 - DNA, 15 bp, Homo sapiens
tgctgttttgttctg

SEQ ID NO: 1607906 - DNA, 18 bp, Homo sapiens
tgctgttttgttctgtgg

SEQ ID NO: 1607907 - DNA, 15 bp, Homo sapiens
tgcttaaaaaataat

SEQ ID NO: 1607908 - DNA, 17 bp, Homo sapiens
tgcttaaaaatcattga

SEQ ID NO: 1607909 - DNA, 12 bp, Homo sapiens
tgcttaaaagac

SEQ ID NO: 1607910 - DNA, 16 bp, Homo sapiens
tgcttaaatttcttat

SEQ ID NO: 1607911 - DNA, 16 bp, Homo sapiens
tgcttaatcttcaaag

SEQ ID NO: 1607912 - DNA, 12 bp, Homo sapiens
tgcttaatgaaa

SEQ ID NO: 1607913 - DNA, 13 bp, Homo sapiens
tgcttaattttga

SEQ ID NO: 1607914 - DNA, 14 bp, Homo sapiens
tgcttacattttta

SEQ ID NO: 1607915 - DNA, 18 bp, Homo sapiens
tgcttacatttttacaat

SEQ ID NO: 1607916 - DNA, 20 bp, Homo sapiens
tgcttacatttttacaataa

SEQ ID NO: 1607917 - DNA, 17 bp, Homo sapiens
tgcttacccttcacctt

SEQ ID NO: 1607918 - DNA, 16 bp, Homo sapiens
tgcttactcattaaaa

SEQ ID NO: 1607919 - DNA, 15 bp, Homo sapiens
tgcttactcttgctt

SEQ ID NO: 1607920 - DNA, 22 bp, Homo sapiens
tgcttactgatatattttacaa

SEQ ID NO: 1607921 - DNA, 21 bp, Homo sapiens
tgcttagatgagggtgactgt

SEQ ID NO: 1607922 - DNA, 14 bp, Homo sapiens
tgcttaggatgtgt

SEQ ID NO: 1607923 - DNA, 18 bp, Homo sapiens
tgcttagtcactgcctgc

SEQ ID NO: 1607924 - DNA, 19 bp, Homo sapiens
tgcttataacctagttaaa

SEQ ID NO: 1607925 - DNA, 13 bp, Homo sapiens
tgcttatacactt

SEQ ID NO: 1607926 - DNA, 19 bp, Homo sapiens
tgcttatgaatatttataa

SEQ ID NO: 1607927 - DNA, 17 bp, Homo sapiens
tgcttattatgtaggta

SEQ ID NO: 1607928 - DNA, 23 bp, Homo sapiens
tgcttatttgacaacgtttcagc

SEQ ID NO: 1607929 - DNA, 21 bp, Homo sapiens
tgcttcaaaaacattcttaca

SEQ ID NO: 1607930 - DNA, 23 bp, Homo sapiens
tgcttcaagagaaaatgcggtta

SEQ ID NO: 1607931 - DNA, 16 bp, Homo sapiens
tgcttcaaggcttcca

SEQ ID NO: 1607932 - DNA, 20 bp, Homo sapiens
tgcttcacagtagagccagc

SEQ ID NO: 1607933 - DNA, 18 bp, Homo sapiens
tgcttcagacctgacacc

SEQ ID NO: 1607934 - DNA, 14 bp, Homo sapiens
tgcttcagagtttg

SEQ ID NO: 1607935 - DNA, 18 bp, Homo sapiens
tgcttcagagtttgtgtg

SEQ ID NO: 1607936 - DNA, 12 bp, Homo sapiens
tgcttcagcctg

SEQ ID NO: 1607937 - DNA, 16 bp, Homo sapiens
tgcttcagtgaaataa

SEQ ID NO: 1607938 - DNA, 23 bp, Homo sapiens
tgcttcatcattccctctcatct

SEQ ID NO: 1607939 - DNA, 19 bp, Homo sapiens
tgcttcattattcaagaat

SEQ ID NO: 1607940 - DNA, 14 bp, Homo sapiens
tgcttcattgaaag

SEQ ID NO: 1607941 - DNA, 16 bp, Homo sapiens
tgcttcattgaaagct

SEQ ID NO: 1607942 - DNA, 17 bp, Homo sapiens
tgcttccaacaaggaca

SEQ ID NO: 1607943 - DNA, 14 bp, Homo sapiens
tgcttcccactggg

SEQ ID NO: 1607944 - DNA, 15 bp, Homo sapiens
tgcttcccactgggg

SEQ ID NO: 1607945 - DNA, 16 bp, Homo sapiens
tgcttcccactggggc

SEQ ID NO: 1607946 - DNA, 16 bp, Homo sapiens
tgcttcccatcctacc

SEQ ID NO: 1607947 - DNA, 23 bp, Homo sapiens
tgcttcccatcctaccctcgggc

SEQ ID NO: 1607948 - DNA, 17 bp, Homo sapiens
tgcttcccattgtggct

SEQ ID NO: 1607949 - DNA, 19 bp, Homo sapiens
tgcttcccccacccctcca

SEQ ID NO: 1607950 - DNA, 16 bp, Homo sapiens
tgcttcccgctgcaca

SEQ ID NO: 1607951 - DNA, 22 bp, Homo sapiens
tgcttcccgctgcacatggaca

SEQ ID NO: 1607952 - DNA, 15 bp, Homo sapiens
tgcttccctaatcta

SEQ ID NO: 1607953 - DNA, 14 bp, Homo sapiens
tgcttccgccactc

SEQ ID NO: 1607954 - DNA, 20 bp, Homo sapiens
tgcttcctagaagttactga

SEQ ID NO: 1607955 - DNA, 14 bp, Homo sapiens
tgcttcctgatgct

SEQ ID NO: 1607956 - DNA, 12 bp, Homo sapiens
tgcttccttcag

SEQ ID NO: 1607957 - DNA, 22 bp, Homo sapiens
tgcttccttcagtttgtaaagt

SEQ ID NO: 1607958 - DNA, 21 bp, Homo sapiens
tgcttcctttctctcctggct

SEQ ID NO: 1607959 - DNA, 14 bp, Homo sapiens
tgcttcgactactg

SEQ ID NO: 1607960 - DNA, 17 bp, Homo sapiens
tgcttctaaaacaataa

SEQ ID NO: 1607961 - DNA, 12 bp, Homo sapiens
tgcttctacttt

SEQ ID NO: 1607962 - DNA, 21 bp, Homo sapiens
tgcttctataattttgccttt

SEQ ID NO: 1607963 - DNA, 15 bp, Homo sapiens
tgcttctcaggctat

SEQ ID NO: 1607964 - DNA, 13 bp, Homo sapiens
tgcttctccacct

SEQ ID NO: 1607965 - DNA, 14 bp, Homo sapiens
tgcttctccacctc

SEQ ID NO: 1607966 - DNA, 15 bp, Homo sapiens
tgcttctccacctcc

SEQ ID NO: 1607967 - DNA, 13 bp, Homo sapiens
tgcttctccagcc

SEQ ID NO: 1607968 - DNA, 17 bp, Homo sapiens
tgcttctcggggtccag

SEQ ID NO: 1607969 - DNA, 16 bp, Homo sapiens
tgcttctctacagact

SEQ ID NO: 1607970 - DNA, 15 bp, Homo sapiens
tgcttctctctctct

SEQ ID NO: 1607971 - DNA, 20 bp, Homo sapiens
tgcttctctgacttctgcct

SEQ ID NO: 1607972 - DNA, 23 bp, Homo sapiens
tgcttctctgacttctgcctgga

SEQ ID NO: 1607973 - DNA, 22 bp, Homo sapiens
tgcttctcttgggaactccact

SEQ ID NO: 1607974 - DNA, 14 bp, Homo sapiens
tgcttctgaactca

SEQ ID NO: 1607975 - DNA, 20 bp, Homo sapiens
tgcttctgaactcaagctgc

SEQ ID NO: 1607976 - DNA, 19 bp, Homo sapiens
tgcttctgagagcaaaggg

SEQ ID NO: 1607977 - DNA, 17 bp, Homo sapiens
tgcttctgctgccctga

SEQ ID NO: 1607978 - DNA, 13 bp, Homo sapiens
tgcttctgggaga

SEQ ID NO: 1607979 - DNA, 17 bp, Homo sapiens
tgcttctgtagtactcc

SEQ ID NO: 1607980 - DNA, 20 bp, Homo sapiens
tgcttctgtatttccttgga

SEQ ID NO: 1607981 - DNA, 17 bp, Homo sapiens
tgcttcttactgataat

SEQ ID NO: 1607982 - DNA, 12 bp, Homo sapiens
tgcttctttgta

SEQ ID NO: 1607983 - DNA, 15 bp, Homo sapiens
tgcttctttgtaatg

SEQ ID NO: 1607984 - DNA, 19 bp, Homo sapiens
tgcttgaaggccctgctga

SEQ ID NO: 1607985 - DNA, 15 bp, Homo sapiens
tgcttgacataccta

SEQ ID NO: 1607986 - DNA, 14 bp, Homo sapiens
tgcttgagcccagg

SEQ ID NO: 1607987 - DNA, 14 bp, Homo sapiens
tgcttgagctcagg

SEQ ID NO: 1607988 - DNA, 15 bp, Homo sapiens
tgcttgagctcagga

SEQ ID NO: 1607989 - DNA, 15 bp, Homo sapiens
tgcttgataatatat

SEQ ID NO: 1607990 - DNA, 14 bp, Homo sapiens
tgcttgattttgta

SEQ ID NO: 1607991 - DNA, 18 bp, Homo sapiens
tgcttgcacacttcccca

SEQ ID NO: 1607992 - DNA, 21 bp, Homo sapiens
tgcttgcacacttccccatct

SEQ ID NO: 1607993 - DNA, 17 bp, Homo sapiens
tgcttgcataagagctt

SEQ ID NO: 1607994 - DNA, 14 bp, Homo sapiens
tgcttgccaaagta

SEQ ID NO: 1607995 - DNA, 15 bp, Homo sapiens
tgcttgccaaagtac

SEQ ID NO: 1607996 - DNA, 18 bp, Homo sapiens
tgcttgcctgcagggcca

SEQ ID NO: 1607997 - DNA, 20 bp, Homo sapiens
tgcttgcctgcagggccatg

SEQ ID NO: 1607998 - DNA, 17 bp, Homo sapiens
tgcttgcggcaaaagga

SEQ ID NO: 1607999 - DNA, 21 bp, Homo sapiens
tgcttgcggcaaaaggaaagc

SEQ ID NO: 1608000 - DNA, 15 bp, Homo sapiens
tgcttgctttgaagt

SEQ ID NO: 1608001 - DNA, 16 bp, Homo sapiens
tgcttggaagccaggt

SEQ ID NO: 1608002 - DNA, 16 bp, Homo sapiens
tgcttggatccataca

SEQ ID NO: 1608003 - DNA, 14 bp, Homo sapiens
tgcttggcccggcc

SEQ ID NO: 1608004 - DNA, 23 bp, Homo sapiens
tgcttggcccggccggcctggca

SEQ ID NO: 1608005 - DNA, 14 bp, Homo sapiens
tgctgctaattctt

SEQ ID NO: 1608006 - DNA, 18 bp, Homo sapiens
tgctgctaattctttgca

SEQ ID NO: 1608007 - DNA, 13 bp, Homo sapiens
tgctgctactacc

SEQ ID NO: 1608008 - DNA, 13 bp, Homo sapiens
tgctgctccatgg

SEQ ID NO: 1608009 - DNA, 10 bp, Homo sapiens
tgctgctctc

SEQ ID NO: 1608010 - DNA, 12 bp, Homo sapiens
tgctgctctcag

SEQ ID NO: 1608011 - DNA, 13 bp, Homo sapiens
tgctgctctgcgt

SEQ ID NO: 1608012 - DNA, 15 bp, Homo sapiens
tgctgctgcgccctt

SEQ ID NO: 1608013 - DNA, 11 bp, Homo sapiens
tgctgctggcc

SEQ ID NO: 1608014 - DNA, 12 bp, Homo sapiens
tgctgctggcca

SEQ ID NO: 1608015 - DNA, 15 bp, Homo sapiens
tgctgctggggaaga

SEQ ID NO: 1608016 - DNA, 23 bp, Homo sapiens
tgctgctggggaagacagtggcc

SEQ ID NO: 1608017 - DNA, 24 bp, Homo sapiens
tgctgctggggaagacagtggccc

SEQ ID NO: 1608018 - DNA, 12 bp, Homo sapiens
tgctgctggtgc

SEQ ID NO: 1608019 - DNA, 9 bp, Homo sapiens
tgctgctgt

SEQ ID NO: 1608020 - DNA, 23 bp, Homo sapiens
tgctgctgtaactgctgagccac

SEQ ID NO: 1608021 - DNA, 13 bp, Homo sapiens
tgctgctgtccct

SEQ ID NO: 1608022 - DNA, 12 bp, Homo sapiens
tgctgctgtctt

SEQ ID NO: 1608023 - DNA, 14 bp, Homo sapiens
tgctgcttggattt

SEQ ID NO: 1608024 - DNA, 15 bp, Homo sapiens
tgctgctttcccctg

SEQ ID NO: 1608025 - DNA, 11 bp, Homo sapiens
tgctggaaata

SEQ ID NO: 1608026 - DNA, 17 bp, Homo sapiens
tgctggaaataaaacag

SEQ ID NO: 1608027 - DNA, 20 bp, Homo sapiens
tgctggaaataaaacagctg

SEQ ID NO: 1608028 - DNA, 15 bp, Homo sapiens
tgctggaagcccagc

SEQ ID NO: 1608029 - DNA, 19 bp, Homo sapiens
tgctggaagggaggaaggc

SEQ ID NO: 1608030 - DNA, 14 bp, Homo sapiens
tgctggaagtctcc

SEQ ID NO: 1608031 - DNA, 20 bp, Homo sapiens
tgctggaagtctccatgaag

SEQ ID NO: 1608032 - DNA, 19 bp, Homo sapiens
tgctggacatgagatggag

SEQ ID NO: 1608033 - DNA, 19 bp, Homo sapiens
tgctggacggcattcctgc

SEQ ID NO: 1608034 - DNA, 20 bp, Homo sapiens
tgctggacggcattcctgct

SEQ ID NO: 1608035 - DNA, 14 bp, Homo sapiens
tgctggactgtcat

SEQ ID NO: 1608036 - DNA, 23 bp, Homo sapiens
tgctggagcccgcactgtcccag

SEQ ID NO: 1608037 - DNA, 13 bp, Homo sapiens
tgctggaggcctc

SEQ ID NO: 1608038 - DNA, 16 bp, Homo sapiens
tgctggagggaggctg

SEQ ID NO: 1608039 - DNA, 19 bp, Homo sapiens
tgctggcaggattcttccc

SEQ ID NO: 1608040 - DNA, 18 bp, Homo sapiens
tgctggcatcaagaggtg

SEQ ID NO: 1608041 - DNA, 19 bp, Homo sapiens
tgctggccaaatagcaaag

SEQ ID NO: 1608042 - DNA, 13 bp, Homo sapiens
tgctggcccaggg

SEQ ID NO: 1608043 - DNA, 14 bp, Homo sapiens
tgctggcccagggc

SEQ ID NO: 1608044 - DNA, 20 bp, Homo sapiens
tgctggcccagggcccagag

SEQ ID NO: 1608045 - DNA, 13 bp, Homo sapiens
tgctggccccagc

SEQ ID NO: 1608046 - DNA, 14 bp, Homo sapiens
tgctggccccagcc

SEQ ID NO: 1608047 - DNA, 11 bp, Homo sapiens
tgctggccccc

SEQ ID NO: 1608048 - DNA, 13 bp, Homo sapiens
tgctggcccccag

SEQ ID NO: 1608049 - DNA, 20 bp, Homo sapiens
tgctgggaaccccgcagccc

SEQ ID NO: 1608050 - DNA, 18 bp, Homo sapiens
tgctgggaccagagccag

SEQ ID NO: 1608051 - DNA, 18 bp, Homo sapiens
tgctgggactcagccttc

SEQ ID NO: 1608052 - DNA, 17 bp, Homo sapiens
tgctgggactgagccag

SEQ ID NO: 1608053 - DNA, 20 bp, Homo sapiens
tgctgggactgagccagtcc

SEQ ID NO: 1608054 - DNA, 17 bp, Homo sapiens
tgctgggactggccagg

SEQ ID NO: 1608055 - DNA, 17 bp, Homo sapiens
tgctgggagctccactc

SEQ ID NO: 1608056 - DNA, 22 bp, Homo sapiens
tgctgggagctccactctgctt

SEQ ID NO: 1608057 - DNA, 23 bp, Homo sapiens
tgctgggagctccactctgcttc

SEQ ID NO: 1608058 - DNA, 17 bp, Homo sapiens
tgctgggaggagggaga

SEQ ID NO: 1608059 - DNA, 16 bp, Homo sapiens
tgctgggatgacaggc

SEQ ID NO: 1608060 - DNA, 14 bp, Homo sapiens
tgctgggccactgg

SEQ ID NO: 1608061 - DNA, 17 bp, Homo sapiens
tgctgggccactgggga

SEQ ID NO: 1608062 - DNA, 17 bp, Homo sapiens
tgctgggccagtggctg

SEQ ID NO: 1608063 - DNA, 17 bp, Homo sapiens
tgctgggctctccacct

SEQ ID NO: 1608064 - DNA, 14 bp, Homo sapiens
tgctgggctggact

SEQ ID NO: 1608065 - DNA, 15 bp, Homo sapiens
tgctgggctggactg

SEQ ID NO: 1608066 - DNA, 13 bp, Homo sapiens
tgctgggctgggc

SEQ ID NO: 1608067 - DNA, 15 bp, Homo sapiens
tgctggggagtccct

SEQ ID NO: 1608068 - DNA, 18 bp, Homo sapiens
tgctggggcaagtccctg

SEQ ID NO: 1608069 - DNA, 23 bp, Homo sapiens
tgctggggccgccacggcctggc

SEQ ID NO: 1608070 - DNA, 16 bp, Homo sapiens
tgctgggttggtgcac

SEQ ID NO: 1608071 - DNA, 21 bp, Homo sapiens
tgctgggttggtgcacagtga

SEQ ID NO: 1608072 - DNA, 17 bp, Homo sapiens
tgctggtaacagtggct

SEQ ID NO: 1608073 - DNA, 19 bp, Homo sapiens
tgctggtaacagtggctgc

SEQ ID NO: 1608074 - DNA, 14 bp, Homo sapiens
tgctggtagagacc

SEQ ID NO: 1608075 - DNA, 17 bp, Homo sapiens
tgctggtagatgctgag

SEQ ID NO: 1608076 - DNA, 14 bp, Homo sapiens
tgctggtcagagag

SEQ ID NO: 1608077 - DNA, 15 bp, Homo sapiens
tgctggtcagagaga

SEQ ID NO: 1608078 - DNA, 14 bp, Homo sapiens
tgctggtgaacact

SEQ ID NO: 1608079 - DNA, 20 bp, Homo sapiens
tgctggtgaacactgtgacc

SEQ ID NO: 1608080 - DNA, 14 bp, Homo sapiens
tgctggtgattttt

SEQ ID NO: 1608081 - DNA, 14 bp, Homo sapiens
tgctggtgcaaaga

SEQ ID NO: 1608082 - DNA, 19 bp, Homo sapiens
tgctggtggttaaggccag

SEQ ID NO: 1608083 - DNA, 16 bp, Homo sapiens
tgctggttttaacaac

SEQ ID NO: 1608084 - DNA, 14 bp, Homo sapiens
tgctggttttccta

SEQ ID NO: 1608085 - DNA, 15 bp, Homo sapiens
tgctggttttcctaa

SEQ ID NO: 1608086 - DNA, 20 bp, Homo sapiens
tgctgtaaataaatgcttta

SEQ ID NO: 1608087 - DNA, 16 bp, Homo sapiens
tgctgtaactgctgag

SEQ ID NO: 1608088 - DNA, 19 bp, Homo sapiens
tgctgtaccatattcagca

SEQ ID NO: 1608089 - DNA, 19 bp, Homo sapiens
tgctgtacccttccacctc

SEQ ID NO: 1608090 - DNA, 20 bp, Homo sapiens
tgctgtacccttccacctcc

SEQ ID NO: 1608091 - DNA, 22 bp, Homo sapiens
tgctgtagaaacacataacaaa

SEQ ID NO: 1608092 - DNA, 16 bp, Homo sapiens
tgctgtataagttatt

SEQ ID NO: 1608093 - DNA, 23 bp, Homo sapiens
tgctgtatttcctgcttccctgt

SEQ ID NO: 1608094 - DNA, 17 bp, Homo sapiens
tgctgtattttaacact

SEQ ID NO: 1608095 - DNA, 16 bp, Homo sapiens
tgctgtcaacttccca

SEQ ID NO: 1608096 - DNA, 16 bp, Homo sapiens
tgctgtcacttcttca

SEQ ID NO: 1608097 - DNA, 23 bp, Homo sapiens
tgctgtcatggtcctttctggaa

SEQ ID NO: 1608098 - DNA, 13 bp, Homo sapiens
tgctgtccacatg

SEQ ID NO: 1608099 - DNA, 21 bp, Homo sapiens
tgctgtccacatgacctccat

SEQ ID NO: 1608100 - DNA, 16 bp, Homo sapiens
tgctgtccaggcagct

SEQ ID NO: 1608101 - DNA, 12 bp, Homo sapiens
tgctgtccctcc

SEQ ID NO: 1608102 - DNA, 16 bp, Homo sapiens
tgctgtcggcaccatg

SEQ ID NO: 1608103 - DNA, 20 bp, Homo sapiens
tgctgtctacagtagctgct

SEQ ID NO: 1608104 - DNA, 18 bp, Homo sapiens
tgctgtctctctgggctg

SEQ ID NO: 1608105 - DNA, 14 bp, Homo sapiens
tgctgtcttaaact

SEQ ID NO: 1608106 - DNA, 21 bp, Homo sapiens
tgctgtgaaccctggggcctg

SEQ ID NO: 1608107 - DNA, 13 bp, Homo sapiens
tgctgtgaggctg

SEQ ID NO: 1608108 - DNA, 14 bp, Homo sapiens
tgctgtgaggctgt

SEQ ID NO: 1608109 - DNA, 17 bp, Homo sapiens
tgctgtgaggctgtcct

SEQ ID NO: 1608110 - DNA, 18 bp, Homo sapiens
tgctgtgagggaggggaa

SEQ ID NO: 1608111 - DNA, 22 bp, Homo sapiens
tgctgtgatacgatgcttcaag

SEQ ID NO: 1608112 - DNA, 19 bp, Homo sapiens
tgctgtgccatgctgggcc

SEQ ID NO: 1608113 - DNA, 20 bp, Homo sapiens
tgctgtgccatgctgggcca

SEQ ID NO: 1608114 - DNA, 23 bp, Homo sapiens
tgctgtgccatgctgggccactg

SEQ ID NO: 1608115 - DNA, 11 bp, Homo sapiens
tgctgtgcctg

SEQ ID NO: 1608116 - DNA, 19 bp, Homo sapiens
tgctgtgcctgctagagca

SEQ ID NO: 1608117 - DNA, 18 bp, Homo sapiens
tgctgtgcgcccagggct

SEQ ID NO: 1608118 - DNA, 19 bp, Homo sapiens
tgctgtgctctggcaccat

SEQ ID NO: 1608119 - DNA, 23 bp, Homo sapiens
tgctgtgctctggggatttctgg

SEQ ID NO: 1608120 - DNA, 18 bp, Homo sapiens
tgctgtgctctttgaaga

SEQ ID NO: 1608121 - DNA, 16 bp, Homo sapiens
tgctgtggacatgtgg

SEQ ID NO: 1608122 - DNA, 22 bp, Homo sapiens
tgctgtggacatgtgggtggag

SEQ ID NO: 1608123 - DNA, 18 bp, Homo sapiens
tgcgcacaccgccagcag

SEQ ID NO: 1608124 - DNA, 14 bp, Homo sapiens
tgcgcaggtctctt

SEQ ID NO: 1608125 - DNA, 20 bp, Homo sapiens
tgcgcatcttgcctccaggt

SEQ ID NO: 1608126 - DNA, 22 bp, Homo sapiens
tgcgcatcttgcctccaggtgc

SEQ ID NO: 1608127 - DNA, 13 bp, Homo sapiens
tgcgccaggcaga

SEQ ID NO: 1608128 - DNA, 18 bp, Homo sapiens
tgcgccaggcagagctga

SEQ ID NO: 1608129 - DNA, 18 bp, Homo sapiens
tgcgccattgcactccag

SEQ ID NO: 1608130 - DNA, 15 bp, Homo sapiens
tgcgcccttaccttc

SEQ ID NO: 1608131 - DNA, 23 bp, Homo sapiens
tgcgcccttgtgccctgcctcca

SEQ ID NO: 1608132 - DNA, 18 bp, Homo sapiens
tgcgcctcggtatctggc

SEQ ID NO: 1608133 - DNA, 19 bp, Homo sapiens
tgcgcctcggtatctggct

SEQ ID NO: 1608134 - DNA, 14 bp, Homo sapiens
tgcgcgtgtgcacg

SEQ ID NO: 1608135 - DNA, 16 bp, Homo sapiens
tgcgctcacctgcagc

SEQ ID NO: 1608136 - DNA, 13 bp, Homo sapiens
tgcgctcagggcc

SEQ ID NO: 1608137 - DNA, 20 bp, Homo sapiens
tgcgctctagcctgggcaac

SEQ ID NO: 1608138 - DNA, 14 bp, Homo sapiens
tgcgctctcaagac

SEQ ID NO: 1608139 - DNA, 18 bp, Homo sapiens
tgcgctctcaagaccaga

SEQ ID NO: 1608140 - DNA, 21 bp, Homo sapiens
tgcgctcttggtccctggtcc

SEQ ID NO: 1608141 - DNA, 13 bp, Homo sapiens
tgcgctgcctggc

SEQ ID NO: 1608142 - DNA, 15 bp, Homo sapiens
tgcgctgcctggcca

SEQ ID NO: 1608143 - DNA, 20 bp, Homo sapiens
tgcgctggttccgccaggcg

SEQ ID NO: 1608144 - DNA, 19 bp, Homo sapiens
tgcgctgtgtacaatgtga

SEQ ID NO: 1608145 - DNA, 23 bp, Homo sapiens
tgcggagtcattttgtgttgaag

SEQ ID NO: 1608146 - DNA, 21 bp, Homo sapiens
tgcggcccactttcctgagct

SEQ ID NO: 1608147 - DNA, 23 bp, Homo sapiens
tgcggccccctctcggccaggca

SEQ ID NO: 1608148 - DNA, 15 bp, Homo sapiens
tgcgggacagagggt

SEQ ID NO: 1608149 - DNA, 16 bp, Homo sapiens
tgcgggagctctgtat

SEQ ID NO: 1608150 - DNA, 17 bp, Homo sapiens
tgcgggagtagttggaa

SEQ ID NO: 1608151 - DNA, 17 bp, Homo sapiens
tgcgggcacaataaatc

SEQ ID NO: 1608152 - DNA, 15 bp, Homo sapiens
tgcgggcccagctga

SEQ ID NO: 1608153 - DNA, 22 bp, Homo sapiens
tgcgggcctggccctcactcaa

SEQ ID NO: 1608154 - DNA, 22 bp, Homo sapiens
tgcgggcgcgggcagccaccca

SEQ ID NO: 1608155 - DNA, 14 bp, Homo sapiens
tgcgggctcgccca

SEQ ID NO: 1608156 - DNA, 17 bp, Homo sapiens
tgcgggctcgcccatac

SEQ ID NO: 1608157 - DNA, 17 bp, Homo sapiens
tgcgggcttttccccgg

SEQ ID NO: 1608158 - DNA, 14 bp, Homo sapiens
tgcggggccaccca

SEQ ID NO: 1608159 - DNA, 14 bp, Homo sapiens
tgcggtcactcagg

SEQ ID NO: 1608160 - DNA, 16 bp, Homo sapiens
tgcggttaattttgaa

SEQ ID NO: 1608161 - DNA, 14 bp, Homo sapiens
tgcgtacacagaga

SEQ ID NO: 1608162 - DNA, 20 bp, Homo sapiens
tgcgtacgtttcctgagaag

SEQ ID NO: 1608163 - DNA, 18 bp, Homo sapiens
tgcgtcccagctgaaggc

SEQ ID NO: 1608164 - DNA, 20 bp, Homo sapiens
tgcgtcccagctgaaggcag

SEQ ID NO: 1608165 - DNA, 14 bp, Homo sapiens
tgcgtccccactcc

SEQ ID NO: 1608166 - DNA, 14 bp, Homo sapiens
tgcgtcctcctcac

SEQ ID NO: 1608167 - DNA, 19 bp, Homo sapiens
tgcgtcctcctcacctcat

SEQ ID NO: 1608168 - DNA, 17 bp, Homo sapiens
tgcgtctctctttctcc

SEQ ID NO: 1608169 - DNA, 22 bp, Homo sapiens
tgcgtctctctttctccctcac

SEQ ID NO: 1608170 - DNA, 19 bp, Homo sapiens
tgcgtctgttttgtgtctg

SEQ ID NO: 1608171 - DNA, 16 bp, Homo sapiens
tgcgtcttttttctct

SEQ ID NO: 1608172 - DNA, 19 bp, Homo sapiens
tgcgtcttttttctcttcc

SEQ ID NO: 1608173 - DNA, 17 bp, Homo sapiens
tgcgtgccgcctgctcc

SEQ ID NO: 1608174 - DNA, 17 bp, Homo sapiens
tgcgtggactctgcaca

SEQ ID NO: 1608175 - DNA, 24 bp, Homo sapiens
tgcgtggccacgggggcagtgtga

SEQ ID NO: 1608176 - DNA, 15 bp, Homo sapiens
tgcgtggctgtggca

SEQ ID NO: 1608177 - DNA, 16 bp, Homo sapiens
tgcgtggctgtggcac

SEQ ID NO: 1608178 - DNA, 20 bp, Homo sapiens
tgcgtggcttccctgtccca

SEQ ID NO: 1608179 - DNA, 22 bp, Homo sapiens
tgcgtggcttccctgtcccagt

SEQ ID NO: 1608180 - DNA, 20 bp, Homo sapiens
tgcgtggtatacatgtgtac

SEQ ID NO: 1608181 - DNA, 13 bp, Homo sapiens
tgcgtgtcgtggg

SEQ ID NO: 1608182 - DNA, 15 bp, Homo sapiens
tgcgtgtctctgcca

SEQ ID NO: 1608183 - DNA, 22 bp, Homo sapiens
tgcgtgtctctgccatgtggca

SEQ ID NO: 1608184 - DNA, 21 bp, Homo sapiens
tgcgtgtgtatatttgtaata

SEQ ID NO: 1608185 - DNA, 19 bp, Homo sapiens
tgcgtgtgtgtatgtgtga

SEQ ID NO: 1608186 - DNA, 18 bp, Homo sapiens
tgcgtgtgtttgtatgtc

SEQ ID NO: 1608187 - DNA, 20 bp, Homo sapiens
tgcgtgttagtgtgtgtgca

SEQ ID NO: 1608188 - DNA, 23 bp, Homo sapiens
tgcgtgttagtgtgtgtgcatgt

SEQ ID NO: 1608189 - DNA, 14 bp, Homo sapiens
tgcgtgttcagcag

SEQ ID NO: 1608190 - DNA, 18 bp, Homo sapiens
tgcgtgttcagcagaacc

SEQ ID NO: 1608191 - DNA, 22 bp, Homo sapiens
tgcgtgtttgggtttttttcct

SEQ ID NO: 1608192 - DNA, 16 bp, Homo sapiens
tgcgttggagccactc

SEQ ID NO: 1608193 - DNA, 18 bp, Homo sapiens
tgcgtttataattggctt

SEQ ID NO: 1608194 - DNA, 20 bp, Homo sapiens
tgcgtttggaggcccctggg

SEQ ID NO: 1608195 - DNA, 23 bp, Homo sapiens
tgctaaaaaagcatatataacta

SEQ ID NO: 1608196 - DNA, 14 bp, Homo sapiens
tgctaaaccttagt

SEQ ID NO: 1608197 - DNA, 22 bp, Homo sapiens
tgctaaagcactttgcacttaa

SEQ ID NO: 1608198 - DNA, 20 bp, Homo sapiens
tgctaaagccaaccagcctt

SEQ ID NO: 1608199 - DNA, 14 bp, Homo sapiens
tgctaaagccagga

SEQ ID NO: 1608200 - DNA, 24 bp, Homo sapiens
tgctaaataaacatgtgccctcag

SEQ ID NO: 1608201 - DNA, 16 bp, Homo sapiens
tgctaaatacaacact

SEQ ID NO: 1608202 - DNA, 19 bp, Homo sapiens
tgctaaatacaacactgat

SEQ ID NO: 1608203 - DNA, 12 bp, Homo sapiens
tgctaaatagtt

SEQ ID NO: 1608204 - DNA, 21 bp, Homo sapiens
tgctaaatggtcgcccaggag

SEQ ID NO: 1608205 - DNA, 15 bp, Homo sapiens
tgctaaattttcagt

SEQ ID NO: 1608206 - DNA, 15 bp, Homo sapiens
tgctaactgggttaa

SEQ ID NO: 1608207 - DNA, 16 bp, Homo sapiens
tgctaactgggttaaa

SEQ ID NO: 1608208 - DNA, 14 bp, Homo sapiens
tgctaactggttaa

SEQ ID NO: 1608209 - DNA, 22 bp, Homo sapiens
tgctaactggttaaacattaat

SEQ ID NO: 1608210 - DNA, 22 bp, Homo sapiens
tgctaagaagcgagcactgacc

SEQ ID NO: 1608211 - DNA, 16 bp, Homo sapiens
tgctaaggctcctcct

SEQ ID NO: 1608212 - DNA, 15 bp, Homo sapiens
tgctaaggttctaag

SEQ ID NO: 1608213 - DNA, 16 bp, Homo sapiens
tgctaaggttctaagg

SEQ ID NO: 1608214 - DNA, 18 bp, Homo sapiens
tgctaagtgtgcttagtt

SEQ ID NO: 1608215 - DNA, 21 bp, Homo sapiens
tgctaagtgtgcttagtttta

SEQ ID NO: 1608216 - DNA, 15 bp, Homo sapiens
tgctaagttctccca

SEQ ID NO: 1608217 - DNA, 12 bp, Homo sapiens
tgctaataaaac

SEQ ID NO: 1608218 - DNA, 15 bp, Homo sapiens
tgctaatcaaaactt

SEQ ID NO: 1608219 - DNA, 22 bp, Homo sapiens
tgctaatcagggaggtcatttt

SEQ ID NO: 1608220 - DNA, 18 bp, Homo sapiens
tgctaatgtaatcattta

SEQ ID NO: 1608221 - DNA, 13 bp, Homo sapiens
tgctaattctttg

SEQ ID NO: 1608222 - DNA, 21 bp, Homo sapiens
tgctaattctttgcaaaaatc

SEQ ID NO: 1608223 - DNA, 22 bp, Homo sapiens
tgctaattctttgcaaaaatcc

SEQ ID NO: 1608224 - DNA, 16 bp, Homo sapiens
tgctaatttaaagaga

SEQ ID NO: 1608225 - DNA, 13 bp, Homo sapiens
tgctaatttgttt

SEQ ID NO: 1608226 - DNA, 23 bp, Homo sapiens
tgctaatttttggagaaatgtca

SEQ ID NO: 1608227 - DNA, 18 bp, Homo sapiens
tgctacaaaaacacagca

SEQ ID NO: 1608228 - DNA, 15 bp, Homo sapiens
tgctacaacatgtga

SEQ ID NO: 1608229 - DNA, 17 bp, Homo sapiens
tgctacatcagactcta

SEQ ID NO: 1608230 - DNA, 15 bp, Homo sapiens
tgctaccagtattta

SEQ ID NO: 1608231 - DNA, 19 bp, Homo sapiens
tgctacccatttacaaata

SEQ ID NO: 1608232 - DNA, 18 bp, Homo sapiens
tgctacctcccttgcctt

SEQ ID NO: 1608233 - DNA, 16 bp, Homo sapiens
tgctacctctgagaag

SEQ ID NO: 1608234 - DNA, 20 bp, Homo sapiens
tgctacctctgagaagacac

SEQ ID NO: 1608235 - DNA, 22 bp, Homo sapiens
tgctacctgggtccttttcaga

SEQ ID NO: 1608236 - DNA, 23 bp, Homo sapiens
tgctacctgggtccttttcagaa

SEQ ID NO: 1608237 - DNA, 21 bp, Homo sapiens
tgctactacccgagcccagct

SEQ ID NO: 1608238 - DNA, 16 bp, Homo sapiens
tgctactctgttcctt

SEQ ID NO: 1608239 - DNA, 14 bp, Homo sapiens
tgccactcctccct

SEQ ID NO: 1608240 - DNA, 14 bp, Homo sapiens
tgccactctcctcc

SEQ ID NO: 1608241 - DNA, 17 bp, Homo sapiens
tgccactctcctcccct

SEQ ID NO: 1608242 - DNA, 20 bp, Homo sapiens
tgccactctcctcccctccc

SEQ ID NO: 1608243 - DNA, 13 bp, Homo sapiens
tgccactgaggag

SEQ ID NO: 1608244 - DNA, 18 bp, Homo sapiens
tgccactgccaggcacct

SEQ ID NO: 1608245 - DNA, 19 bp, Homo sapiens
tgccactgccaggcacctg

SEQ ID NO: 1608246 - DNA, 21 bp, Homo sapiens
tgccactgccaggcacctggc

SEQ ID NO: 1608247 - DNA, 18 bp, Homo sapiens
tgccactgccccccgagg

SEQ ID NO: 1608248 - DNA, 21 bp, Homo sapiens
tgccactgccttcgcttcttg

SEQ ID NO: 1608249 - DNA, 13 bp, Homo sapiens
tgccactgggcac

SEQ ID NO: 1608250 - DNA, 20 bp, Homo sapiens
tgccacttaatgtatgttac

SEQ ID NO: 1608251 - DNA, 23 bp, Homo sapiens
tgccacttaatgtatgttaccaa

SEQ ID NO: 1608252 - DNA, 20 bp, Homo sapiens
tgccacttcaacccccagct

SEQ ID NO: 1608253 - DNA, 15 bp, Homo sapiens
tgccacttcctttta

SEQ ID NO: 1608254 - DNA, 16 bp, Homo sapiens
tgccacttctaagaaa

SEQ ID NO: 1608255 - DNA, 20 bp, Homo sapiens
tgccacttcttaaaggcctg

SEQ ID NO: 1608256 - DNA, 17 bp, Homo sapiens
tgccacttgacattcct

SEQ ID NO: 1608257 - DNA, 19 bp, Homo sapiens
tgccacttgacattccttg

SEQ ID NO: 1608258 - DNA, 20 bp, Homo sapiens
tgccactttacccacctaga

SEQ ID NO: 1608259 - DNA, 16 bp, Homo sapiens
tgccactttggcttct

SEQ ID NO: 1608260 - DNA, 20 bp, Homo sapiens
tgccactttggcttctcctg

SEQ ID NO: 1608261 - DNA, 21 bp, Homo sapiens
tgccactttggcttctcctgt

SEQ ID NO: 1608262 - DNA, 22 bp, Homo sapiens
tgccactttggcttctcctgtg

SEQ ID NO: 1608263 - DNA, 11 bp, Homo sapiens
tgccagagcca

SEQ ID NO: 1608264 - DNA, 15 bp, Homo sapiens
tgccagagccaacct

SEQ ID NO: 1608265 - DNA, 19 bp, Homo sapiens
tgccagagccaacctggac

SEQ ID NO: 1608266 - DNA, 21 bp, Homo sapiens
tgccagaggaatcctggcagc

SEQ ID NO: 1608267 - DNA, 22 bp, Homo sapiens
tgccagaggaatcctggcagcc

SEQ ID NO: 1608268 - DNA, 23 bp, Homo sapiens
tgccagaggatgctctttcccag

SEQ ID NO: 1608269 - DNA, 22 bp, Homo sapiens
tgccagaggctgatgtcaagca

SEQ ID NO: 1608270 - DNA, 14 bp, Homo sapiens
tgccagagggccag

SEQ ID NO: 1608271 - DNA, 17 bp, Homo sapiens
tgccagagggccagcag

SEQ ID NO: 1608272 - DNA, 21 bp, Homo sapiens
tgccagatataactgtcttgt

SEQ ID NO: 1608273 - DNA, 21 bp, Homo sapiens
tgccagatgcctttatggctg

SEQ ID NO: 1608274 - DNA, 16 bp, Homo sapiens
tgccagcaaccttgta

SEQ ID NO: 1608275 - DNA, 13 bp, Homo sapiens
tgccagcacagag

SEQ ID NO: 1608276 - DNA, 22 bp, Homo sapiens
tgccagcacctttgagccttgg

SEQ ID NO: 1608277 - DNA, 14 bp, Homo sapiens
tgccagcagcagca

SEQ ID NO: 1608278 - DNA, 17 bp, Homo sapiens
tgccagcagcagcaggt

SEQ ID NO: 1608279 - DNA, 12 bp, Homo sapiens
tgccagcagcct

SEQ ID NO: 1608280 - DNA, 13 bp, Homo sapiens
tgccagcagcctc

SEQ ID NO: 1608281 - DNA, 14 bp, Homo sapiens
tgccagcagcctcg

SEQ ID NO: 1608282 - DNA, 19 bp, Homo sapiens
tgccagcagcctcgcacag

SEQ ID NO: 1608283 - DNA, 15 bp, Homo sapiens
tgccagcatatactg

SEQ ID NO: 1608284 - DNA, 12 bp, Homo sapiens
tgccagccagaa

SEQ ID NO: 1608285 - DNA, 12 bp, Homo sapiens
tgccagccagca

SEQ ID NO: 1608286 - DNA, 23 bp, Homo sapiens
tgccagccagcagccagctctca

SEQ ID NO: 1608287 - DNA, 22 bp, Homo sapiens
tgccagccccctaaaagcactc

SEQ ID NO: 1608288 - DNA, 20 bp, Homo sapiens
tgccagccgtgatgctcagg

SEQ ID NO: 1608289 - DNA, 15 bp, Homo sapiens
tgccagcctggcttc

SEQ ID NO: 1608290 - DNA, 23 bp, Homo sapiens
tgccagcctggcttctggagccc

SEQ ID NO: 1608291 - DNA, 21 bp, Homo sapiens
tgccagccttcctctgcagct

SEQ ID NO: 1608292 - DNA, 19 bp, Homo sapiens
tgccagccttgagccctgg

SEQ ID NO: 1608293 - DNA, 21 bp, Homo sapiens
tgccagccttgagccctggct

SEQ ID NO: 1608294 - DNA, 14 bp, Homo sapiens
tgccagccttggag

SEQ ID NO: 1608295 - DNA, 16 bp, Homo sapiens
tgccagcgcatgtgtc

SEQ ID NO: 1608296 - DNA, 23 bp, Homo sapiens
tgccagctgacatcttgaatcct

SEQ ID NO: 1608297 - DNA, 15 bp, Homo sapiens
tgccagctgcactga

SEQ ID NO: 1608298 - DNA, 17 bp, Homo sapiens
tgccagctgggcccagc

SEQ ID NO: 1608299 - DNA, 19 bp, Homo sapiens
tgccagctgggcccagcac

SEQ ID NO: 1608300 - DNA, 20 bp, Homo sapiens
tgccaggacatgcaataaaa

SEQ ID NO: 1608301 - DNA, 14 bp, Homo sapiens
tgccaggaccagcc

SEQ ID NO: 1608302 - DNA, 15 bp, Homo sapiens
tgccaggaccagcct

SEQ ID NO: 1608303 - DNA, 16 bp, Homo sapiens
tgccaggaccagcctg

SEQ ID NO: 1608304 - DNA, 16 bp, Homo sapiens
tgccaggacccgccag

SEQ ID NO: 1608305 - DNA, 21 bp, Homo sapiens
tgccaggacccgccagccccg

SEQ ID NO: 1608306 - DNA, 14 bp, Homo sapiens
tgccaggcacctgg

SEQ ID NO: 1608307 - DNA, 18 bp, Homo sapiens
tgccaggcacctggcctg

SEQ ID NO: 1608308 - DNA, 19 bp, Homo sapiens
tgccaggcacctggcctgc

SEQ ID NO: 1608309 - DNA, 15 bp, Homo sapiens
tgccaggcaggggtg

SEQ ID NO: 1608310 - DNA, 15 bp, Homo sapiens
tgccaggccagcctc

SEQ ID NO: 1608311 - DNA, 16 bp, Homo sapiens
tgccaggccagcctcc

SEQ ID NO: 1608312 - DNA, 21 bp, Homo sapiens
tgccaggcccatctcaggtgc

SEQ ID NO: 1608313 - DNA, 11 bp, Homo sapiens
tgccaggcccg

SEQ ID NO: 1608314 - DNA, 18 bp, Homo sapiens
tgccaggcgttggtgcca

SEQ ID NO: 1608315 - DNA, 23 bp, Homo sapiens
tgccaggctccctttctcttctt

SEQ ID NO: 1608316 - DNA, 16 bp, Homo sapiens
tgccaggctgcctcct

SEQ ID NO: 1608317 - DNA, 20 bp, Homo sapiens
tgccaggctggagtgcagtg

SEQ ID NO: 1608318 - DNA, 17 bp, Homo sapiens
tgccagggatgggcagc

SEQ ID NO: 1608319 - DNA, 17 bp, Homo sapiens
tgccaggggcttgagaa

SEQ ID NO: 1608320 - DNA, 18 bp, Homo sapiens
tgccaggtccctttcatt

SEQ ID NO: 1608321 - DNA, 20 bp, Homo sapiens
tgccaggtggttgggttctg

SEQ ID NO: 1608322 - DNA, 15 bp, Homo sapiens
tgccaggttgcagct

SEQ ID NO: 1608323 - DNA, 16 bp, Homo sapiens
tgccaggttgcagctg

SEQ ID NO: 1608324 - DNA, 17 bp, Homo sapiens
tgccaggttgcagctgc

SEQ ID NO: 1608325 - DNA, 19 bp, Homo sapiens
tgcccaggggtgccccctc

SEQ ID NO: 1608326 - DNA, 18 bp, Homo sapiens
tgcccagggtcctgtgcc

SEQ ID NO: 1608327 - DNA, 19 bp, Homo sapiens
tgcccagggtcctgtgcct

SEQ ID NO: 1608328 - DNA, 20 bp, Homo sapiens
tgcccagggtcctgtgcctg

SEQ ID NO: 1608329 - DNA, 15 bp, Homo sapiens
tgcccagtacattta

SEQ ID NO: 1608330 - DNA, 19 bp, Homo sapiens
tgcccagtacatttaaatt

SEQ ID NO: 1608331 - DNA, 18 bp, Homo sapiens
tgcccagtggagcctgcc

SEQ ID NO: 1608332 - DNA, 18 bp, Homo sapiens
tgcccagtgttgtttgta

SEQ ID NO: 1608333 - DNA, 14 bp, Homo sapiens
tgcccatcccagtc

SEQ ID NO: 1608334 - DNA, 16 bp, Homo sapiens
tgcccatcccagtccc

SEQ ID NO: 1608335 - DNA, 17 bp, Homo sapiens
tgcccatcccagtccct

SEQ ID NO: 1608336 - DNA, 21 bp, Homo sapiens
tgcccatcccagtccctcgcc

SEQ ID NO: 1608337 - DNA, 15 bp, Homo sapiens
tgcccatcctgactg

SEQ ID NO: 1608338 - DNA, 23 bp, Homo sapiens
tgcccatcgtgaagaagcctgta

SEQ ID NO: 1608339 - DNA, 21 bp, Homo sapiens
tgcccatgtgtacattctgcc

SEQ ID NO: 1608340 - DNA, 20 bp, Homo sapiens
tgccccaaacaaatatgcaa

SEQ ID NO: 1608341 - DNA, 13 bp, Homo sapiens
tgccccaactcct

SEQ ID NO: 1608342 - DNA, 20 bp, Homo sapiens
tgccccaagggcccagaccc

SEQ ID NO: 1608343 - DNA, 14 bp, Homo sapiens
tgccccaagtcctc

SEQ ID NO: 1608344 - DNA, 22 bp, Homo sapiens
tgccccacatgtggccatggcc

SEQ ID NO: 1608345 - DNA, 21 bp, Homo sapiens
tgccccaccccacctcacagc

SEQ ID NO: 1608346 - DNA, 23 bp, Homo sapiens
tgccccaccccacctcacagcta

SEQ ID NO: 1608347 - DNA, 21 bp, Homo sapiens
tgccccacctcccccttcccc

SEQ ID NO: 1608348 - DNA, 14 bp, Homo sapiens
tgccccacctgcct

SEQ ID NO: 1608349 - DNA, 15 bp, Homo sapiens
tgccccacctgcctg

SEQ ID NO: 1608350 - DNA, 19 bp, Homo sapiens
tgccccacctgcctggtgc

SEQ ID NO: 1608351 - DNA, 19 bp, Homo sapiens
tgccccacctttattaaaa

SEQ ID NO: 1608352 - DNA, 11 bp, Homo sapiens
tgccccactcc

SEQ ID NO: 1608353 - DNA, 16 bp, Homo sapiens
tgccccactccagcct

SEQ ID NO: 1608354 - DNA, 21 bp, Homo sapiens
tgccccactccagcctgggga

SEQ ID NO: 1608355 - DNA, 19 bp, Homo sapiens
tgccccactctgcctgcct

SEQ ID NO: 1608356 - DNA, 12 bp, Homo sapiens
tgccccagactg

SEQ ID NO: 1608357 - DNA, 23 bp, Homo sapiens
tgccccagactgagctctccagg

SEQ ID NO: 1608358 - DNA, 13 bp, Homo sapiens
tgccccagagctg

SEQ ID NO: 1608359 - DNA, 23 bp, Homo sapiens
tgccccagagctgtttatggcct

SEQ ID NO: 1608360 - DNA, 13 bp, Homo sapiens
tgccccagaggtc

SEQ ID NO: 1608361 - DNA, 19 bp, Homo sapiens
tgccccagaggtcgcagct

SEQ ID NO: 1608362 - DNA, 16 bp, Homo sapiens
tgcagaggtctgtgct

SEQ ID NO: 1608363 - DNA, 12 bp, Homo sapiens
tgcagaggtttc

SEQ ID NO: 1608364 - DNA, 11 bp, Homo sapiens
tgcagagtaag

SEQ ID NO: 1608365 - DNA, 14 bp, Homo sapiens
tgcagagtccattt

SEQ ID NO: 1608366 - DNA, 15 bp, Homo sapiens
tgcagagtgcccaga

SEQ ID NO: 1608367 - DNA, 20 bp, Homo sapiens
tgcagagtggaaactcagcc

SEQ ID NO: 1608368 - DNA, 19 bp, Homo sapiens
tgcagatatctgcatgtgt

SEQ ID NO: 1608369 - DNA, 20 bp, Homo sapiens
tgcagatgccaccctagcca

SEQ ID NO: 1608370 - DNA, 14 bp, Homo sapiens
tgcagatgggctgt

SEQ ID NO: 1608371 - DNA, 18 bp, Homo sapiens
tgcagatggggctcccgc

SEQ ID NO: 1608372 - DNA, 14 bp, Homo sapiens
tgcagattcctggg

SEQ ID NO: 1608373 - DNA, 15 bp, Homo sapiens
tgcagattcctgggc

SEQ ID NO: 1608374 - DNA, 20 bp, Homo sapiens
tgcagcaaatatatgattct

SEQ ID NO: 1608375 - DNA, 23 bp, Homo sapiens
tgcagcacatgcgggctcgccca

SEQ ID NO: 1608376 - DNA, 17 bp, Homo sapiens
tgcagcacctcacctga

SEQ ID NO: 1608377 - DNA, 18 bp, Homo sapiens
tgcagcacctccaggcct

SEQ ID NO: 1608378 - DNA, 13 bp, Homo sapiens
tgcagcagaggac

SEQ ID NO: 1608379 - DNA, 23 bp, Homo sapiens
tgcagcagaggacagtctggaga

SEQ ID NO: 1608380 - DNA, 22 bp, Homo sapiens
tgcagcaggaaggaacaaagac

SEQ ID NO: 1608381 - DNA, 19 bp, Homo sapiens
tgcagcaggtgctgggctg

SEQ ID NO: 1608382 - DNA, 17 bp, Homo sapiens
tgcagcatgacctgtga

SEQ ID NO: 1608383 - DNA, 22 bp, Homo sapiens
tgcagcatgacctgtgaccagc

SEQ ID NO: 1608384 - DNA, 20 bp, Homo sapiens
tgcagcatgttgctgaggag

SEQ ID NO: 1608385 - DNA, 23 bp, Homo sapiens
tgcagcatgttgctgaggagtga

SEQ ID NO: 1608386 - DNA, 15 bp, Homo sapiens
tgcagcatttactat

SEQ ID NO: 1608387 - DNA, 13 bp, Homo sapiens
tgcagccagccca

SEQ ID NO: 1608388 - DNA, 14 bp, Homo sapiens
tgcagccagcccag

SEQ ID NO: 1608389 - DNA, 15 bp, Homo sapiens
tgcagccagcccagc

SEQ ID NO: 1608390 - DNA, 17 bp, Homo sapiens
tgcagccagcccagccc

SEQ ID NO: 1608391 - DNA, 22 bp, Homo sapiens
tgcagccagcccagcccagctg

SEQ ID NO: 1608392 - DNA, 13 bp, Homo sapiens
tgcagcccaaaac

SEQ ID NO: 1608393 - DNA, 12 bp, Homo sapiens
tgcagcccatgc

SEQ ID NO: 1608394 - DNA, 13 bp, Homo sapiens
tgcagcccatgcc

SEQ ID NO: 1608395 - DNA, 23 bp, Homo sapiens
tgcagcccatgcccacctgccca

SEQ ID NO: 1608396 - DNA, 22 bp, Homo sapiens
tgcagcccggcgccaccatcct

SEQ ID NO: 1608397 - DNA, 14 bp, Homo sapiens
tgcagccctctcca

SEQ ID NO: 1608398 - DNA, 17 bp, Homo sapiens
tgcagccggcacagggt

SEQ ID NO: 1608399 - DNA, 15 bp, Homo sapiens
tgcagcctccacttc

SEQ ID NO: 1608400 - DNA, 20 bp, Homo sapiens
tgcagcctccacttccctcg

SEQ ID NO: 1608401 - DNA, 12 bp, Homo sapiens
tgcagcctccct

SEQ ID NO: 1608402 - DNA, 21 bp, Homo sapiens
tgcagcctccgcctcccgggt

SEQ ID NO: 1608403 - DNA, 18 bp, Homo sapiens
tgcagcctgcatcccttc

SEQ ID NO: 1608404 - DNA, 14 bp, Homo sapiens
tgcagcctgtggct

SEQ ID NO: 1608405 - DNA, 15 bp, Homo sapiens
tgcagcggcagagca

SEQ ID NO: 1608406 - DNA, 20 bp, Homo sapiens
tgcagctcaagggctggcac

SEQ ID NO: 1608407 - DNA, 15 bp, Homo sapiens
tgcagctgaaattga

SEQ ID NO: 1608408 - DNA, 12 bp, Homo sapiens
tgcagctgctcc

SEQ ID NO: 1608409 - DNA, 16 bp, Homo sapiens
tgcagctgctccccag

SEQ ID NO: 1608410 - DNA, 13 bp, Homo sapiens
tgcagctggccca

SEQ ID NO: 1608411 - DNA, 21 bp, Homo sapiens
tgcagctggcccactgctggc

SEQ ID NO: 1608412 - DNA, 12 bp, Homo sapiens
tgcagctgggcc

SEQ ID NO: 1608413 - DNA, 18 bp, Homo sapiens
tgcagctgggccccatgc

SEQ ID NO: 1608414 - DNA, 20 bp, Homo sapiens
tgcagctgggccccatgctc

SEQ ID NO: 1608415 - DNA, 22 bp, Homo sapiens
tgcagctgggccccatgctctg

SEQ ID NO: 1608416 - DNA, 23 bp, Homo sapiens
tgcagctgggccccatgctctgc

SEQ ID NO: 1608417 - DNA, 22 bp, Homo sapiens
tgcagctgtgagaagtcactca

SEQ ID NO: 1608418 - DNA, 20 bp, Homo sapiens
tgcagctgtggcagagttac

SEQ ID NO: 1608419 - DNA, 15 bp, Homo sapiens
tgcagctttatgttc

SEQ ID NO: 1608420 - DNA, 16 bp, Homo sapiens
tgcagcttttggttaa

SEQ ID NO: 1608421 - DNA, 20 bp, Homo sapiens
tgcaggaagaaaagcccctc

SEQ ID NO: 1608422 - DNA, 16 bp, Homo sapiens
tgcaggaagaggccca

SEQ ID NO: 1608423 - DNA, 14 bp, Homo sapiens
tgcaggacagctct

SEQ ID NO: 1608424 - DNA, 15 bp, Homo sapiens
tgcaggacttgagaa

SEQ ID NO: 1608425 - DNA, 11 bp, Homo sapiens
tgcaggagaaa

SEQ ID NO: 1608426 - DNA, 14 bp, Homo sapiens
tgcaggaggtggag

SEQ ID NO: 1608427 - DNA, 16 bp, Homo sapiens
tgcaggaggtggagaa

SEQ ID NO: 1608428 - DNA, 23 bp, Homo sapiens
tgcaggagttaaaaagggcaggg

SEQ ID NO: 1608429 - DNA, 15 bp, Homo sapiens
tgcaggattcccttc

SEQ ID NO: 1608430 - DNA, 17 bp, Homo sapiens
tgcaggattcccttctg

SEQ ID NO: 1608431 - DNA, 14 bp, Homo sapiens
tgcaggcaggaaca

SEQ ID NO: 1608432 - DNA, 21 bp, Homo sapiens
tgcaggccaagagcagaggca

SEQ ID NO: 1608433 - DNA, 16 bp, Homo sapiens
tgcaggctccatgcac

SEQ ID NO: 1608434 - DNA, 12 bp, Homo sapiens
tgcaggctctgg

SEQ ID NO: 1608435 - DNA, 18 bp, Homo sapiens
tgcaggctctgggctcag

SEQ ID NO: 1608436 - DNA, 19 bp, Homo sapiens
tgcaggctgcacctctggc

SEQ ID NO: 1608437 - DNA, 18 bp, Homo sapiens
tgcaggctggagactgga

SEQ ID NO: 1608438 - DNA, 20 bp, Homo sapiens
tgcagggaagagggcagtac

SEQ ID NO: 1608439 - DNA, 15 bp, Homo sapiens
tgcagggacaaagag

SEQ ID NO: 1608440 - DNA, 16 bp, Homo sapiens
tgcagggacaaagagg

SEQ ID NO: 1608441 - DNA, 15 bp, Homo sapiens
tgcagggagcactgt

SEQ ID NO: 1608442 - DNA, 13 bp, Homo sapiens
tgcagggagggga

SEQ ID NO: 1608443 - DNA, 23 bp, Homo sapiens
tgcagggccatctgactgccaag

SEQ ID NO: 1608444 - DNA, 23 bp, Homo sapiens
tgcagggccgcgagaggccgagc

SEQ ID NO: 1608445 - DNA, 23 bp, Homo sapiens
tgcaggggcaaggggctggctgg

SEQ ID NO: 1608446 - DNA, 23 bp, Homo sapiens
tgcaggggtcagtgcagcagagg

SEQ ID NO: 1608447 - DNA, 17 bp, Homo sapiens
tgcagggtggtgctggg

SEQ ID NO: 1608448 - DNA, 20 bp, Homo sapiens
tgcaggtacttcctcctgat

SEQ ID NO: 1608449 - DNA, 24 bp, Homo sapiens
tgcaggtacttcctcctgatggcc

SEQ ID NO: 1608450 - DNA, 19 bp, Homo sapiens
tgcaggtcagttgtaataa

SEQ ID NO: 1608451 - DNA, 17 bp, Homo sapiens
tgcaggtcctggtgggt

SEQ ID NO: 1608452 - DNA, 17 bp, Homo sapiens
tgcaggtgagcaggcag

SEQ ID NO: 1608453 - DNA, 14 bp, Homo sapiens
tgcaggtgctgcct

SEQ ID NO: 1608454 - DNA, 23 bp, Homo sapiens
tgcaggtgtggagagagaggctt

SEQ ID NO: 1608455 - DNA, 18 bp, Homo sapiens
tgcaggttagttacatat

SEQ ID NO: 1608456 - DNA, 14 bp, Homo sapiens
tgcaggttttctgt

SEQ ID NO: 1608457 - DNA, 16 bp, Homo sapiens
tgcagtaactgttttt

SEQ ID NO: 1608458 - DNA, 22 bp, Homo sapiens
tgcatggctccagaaatgtcta

SEQ ID NO: 1608459 - DNA, 18 bp, Homo sapiens
tgcatggctcctgtctgg

SEQ ID NO: 1608460 - DNA, 21 bp, Homo sapiens
tgcatggctcctgtctggctc

SEQ ID NO: 1608461 - DNA, 21 bp, Homo sapiens
tgcatggcttctgaaagcagg

SEQ ID NO: 1608462 - DNA, 17 bp, Homo sapiens
tgcatgggaggaattca

SEQ ID NO: 1608463 - DNA, 15 bp, Homo sapiens
tgcatggggaggcag

SEQ ID NO: 1608464 - DNA, 20 bp, Homo sapiens
tgcatggggctggggtcctc

SEQ ID NO: 1608465 - DNA, 23 bp, Homo sapiens
tgcatggggtggggtagggctga

SEQ ID NO: 1608466 - DNA, 21 bp, Homo sapiens
tgcatggtgccccaggaccag

SEQ ID NO: 1608467 - DNA, 13 bp, Homo sapiens
tgcatggtggcca

SEQ ID NO: 1608468 - DNA, 15 bp, Homo sapiens
tgcatgtactatctt

SEQ ID NO: 1608469 - DNA, 16 bp, Homo sapiens
tgcatgtactatctta

SEQ ID NO: 1608470 - DNA, 20 bp, Homo sapiens
tgcatgtcaaacatgagatg

SEQ ID NO: 1608471 - DNA, 16 bp, Homo sapiens
tgcatgtgacttctcc

SEQ ID NO: 1608472 - DNA, 23 bp, Homo sapiens
tgcatgtgacttctcccctgccc

SEQ ID NO: 1608473 - DNA, 16 bp, Homo sapiens
tgcatgtgtctttata

SEQ ID NO: 1608474 - DNA, 20 bp, Homo sapiens
tgcatgtgtgtgtctgtctt

SEQ ID NO: 1608475 - DNA, 21 bp, Homo sapiens
tgcatgtgtgtgtctgtcttt

SEQ ID NO: 1608476 - DNA, 18 bp, Homo sapiens
tgcattaaaatttcttat

SEQ ID NO: 1608477 - DNA, 18 bp, Homo sapiens
tgcattaatctaagaaaa

SEQ ID NO: 1608478 - DNA, 22 bp, Homo sapiens
tgcattaccagcttaaaacact

SEQ ID NO: 1608479 - DNA, 13 bp, Homo sapiens
tgcattagaaatt

SEQ ID NO: 1608480 - DNA, 14 bp, Homo sapiens
tgcattagaaatta

SEQ ID NO: 1608481 - DNA, 12 bp, Homo sapiens
tgcacacaggac

SEQ ID NO: 1608482 - DNA, 14 bp, Homo sapiens
tgcacacagtgctt

SEQ ID NO: 1608483 - DNA, 20 bp, Homo sapiens
tgcacacccatgcacactca

SEQ ID NO: 1608484 - DNA, 20 bp, Homo sapiens
tgcacaccctccagagacaa

SEQ ID NO: 1608485 - DNA, 16 bp, Homo sapiens
tgcacacggctggtca

SEQ ID NO: 1608486 - DNA, 20 bp, Homo sapiens
tgcacacggctggtcactct

SEQ ID NO: 1608487 - DNA, 21 bp, Homo sapiens
tgcacacggctggtcactctg

SEQ ID NO: 1608488 - DNA, 15 bp, Homo sapiens
tgcacacgggcgagc

SEQ ID NO: 1608489 - DNA, 21 bp, Homo sapiens
tgcacacgggcgagctttctc

SEQ ID NO: 1608490 - DNA, 17 bp, Homo sapiens
tgcacagaagctgtttt

SEQ ID NO: 1608491 - DNA, 13 bp, Homo sapiens
tgcacagacaagc

SEQ ID NO: 1608492 - DNA, 15 bp, Homo sapiens
tgcacagacaagcag

SEQ ID NO: 1608493 - DNA, 21 bp, Homo sapiens
tgcacagatatttccatttct

SEQ ID NO: 1608494 - DNA, 17 bp, Homo sapiens
tgcacagatgccatggc

SEQ ID NO: 1608495 - DNA, 20 bp, Homo sapiens
tgcacagccaacgagacaca

SEQ ID NO: 1608496 - DNA, 21 bp, Homo sapiens
tgcacagccaacgagacacat

SEQ ID NO: 1608497 - DNA, 20 bp, Homo sapiens
tgcacagccactccccggca

SEQ ID NO: 1608498 - DNA, 12 bp, Homo sapiens
tgcacagcctct

SEQ ID NO: 1608499 - DNA, 18 bp, Homo sapiens
tgcacagctgcttgtcct

SEQ ID NO: 1608500 - DNA, 19 bp, Homo sapiens
tgcacagctgcttgtcctg

SEQ ID NO: 1608501 - DNA, 12 bp, Homo sapiens
tgcacagctgtc

SEQ ID NO: 1608502 - DNA, 19 bp, Homo sapiens
tgcacaggcacacagggcc

SEQ ID NO: 1608503 - DNA, 17 bp, Homo sapiens
tgcacaggccctgggga

SEQ ID NO: 1608504 - DNA, 12 bp, Homo sapiens
tgcacaggcctc

SEQ ID NO: 1608505 - DNA, 13 bp, Homo sapiens
tgcacaggcctct

SEQ ID NO: 1608506 - DNA, 17 bp, Homo sapiens
tgcacaggcctctgcct

SEQ ID NO: 1608507 - DNA, 18 bp, Homo sapiens
tgcacaggcctctgcctg

SEQ ID NO: 1608508 - DNA, 19 bp, Homo sapiens
tgcacaggcctctgcctgc

SEQ ID NO: 1608509 - DNA, 20 bp, Homo sapiens
tgcacaggcctctgcctgct

SEQ ID NO: 1608510 - DNA, 19 bp, Homo sapiens
tgcacagggtccccgagtg

SEQ ID NO: 1608511 - DNA, 22 bp, Homo sapiens
tgcacagggtgtggtatgaggg

SEQ ID NO: 1608512 - DNA, 22 bp, Homo sapiens
tgcacaggtgccgccagctgcc

SEQ ID NO: 1608513 - DNA, 14 bp, Homo sapiens
tgcacagtaaaaat

SEQ ID NO: 1608514 - DNA, 17 bp, Homo sapiens
tgcacagtacaataatg

SEQ ID NO: 1608515 - DNA, 19 bp, Homo sapiens
tgcacagtatttgtaatta

SEQ ID NO: 1608516 - DNA, 17 bp, Homo sapiens
tgcacagtcactgctct

SEQ ID NO: 1608517 - DNA, 12 bp, Homo sapiens
tgcacagtcaga

SEQ ID NO: 1608518 - DNA, 18 bp, Homo sapiens
tgcacagtcagaaggacg

SEQ ID NO: 1608519 - DNA, 17 bp, Homo sapiens
tgcacagtgcatctcag

SEQ ID NO: 1608520 - DNA, 18 bp, Homo sapiens
tgcacagtgcatctcagc

SEQ ID NO: 1608521 - DNA, 13 bp, Homo sapiens
tgcacagtggctt

SEQ ID NO: 1608522 - DNA, 15 bp, Homo sapiens
tgcacagtggcttct

SEQ ID NO: 1608523 - DNA, 19 bp, Homo sapiens
tgcacatatggactctgca

SEQ ID NO: 1608524 - DNA, 14 bp, Homo sapiens
tgcacatgaaagtt

SEQ ID NO: 1608525 - DNA, 15 bp, Homo sapiens
tgcacatgaaagttt

SEQ ID NO: 1608526 - DNA, 23 bp, Homo sapiens
tgcacatgaatcccacccacatg

SEQ ID NO: 1608527 - DNA, 19 bp, Homo sapiens
tgcacatgctgtctggccc

SEQ ID NO: 1608528 - DNA, 22 bp, Homo sapiens
tgcacatgctgtctggccctgg

SEQ ID NO: 1608529 - DNA, 19 bp, Homo sapiens
tgcacatgtgccacacagt

SEQ ID NO: 1608530 - DNA, 14 bp, Homo sapiens
tgcacatgtttcct

SEQ ID NO: 1608531 - DNA, 16 bp, Homo sapiens
tgcacatgtttcctct

SEQ ID NO: 1608532 - DNA, 11 bp, Homo sapiens
tgcacattcct

SEQ ID NO: 1608533 - DNA, 14 bp, Homo sapiens
tgcacattcctggc

SEQ ID NO: 1608534 - DNA, 16 bp, Homo sapiens
tgcacattcctggccc

SEQ ID NO: 1608535 - DNA, 17 bp, Homo sapiens
tgcacattcctggcccc

SEQ ID NO: 1608536 - DNA, 23 bp, Homo sapiens
tgcacattgcctgttctgcttcg

SEQ ID NO: 1608537 - DNA, 17 bp, Homo sapiens
tgcacattgttgttttt

SEQ ID NO: 1608538 - DNA, 13 bp, Homo sapiens
tgcacatttatat

SEQ ID NO: 1608539 - DNA, 20 bp, Homo sapiens
tgcacatttatatatatatg

SEQ ID NO: 1608540 - DNA, 22 bp, Homo sapiens
tgcacatttatatatatatgta

SEQ ID NO: 1608541 - DNA, 12 bp, Homo sapiens
tgcacatttctg

SEQ ID NO: 1608542 - DNA, 13 bp, Homo sapiens
tgcacatttctgg

SEQ ID NO: 1608543 - DNA, 17 bp, Homo sapiens
tgcacatttctggattg

SEQ ID NO: 1608544 - DNA, 17 bp, Homo sapiens
tgcacatttctttgcat

SEQ ID NO: 1608545 - DNA, 21 bp, Homo sapiens
tgcacattttgtggctgttga

SEQ ID NO: 1608546 - DNA, 12 bp, Homo sapiens
tgcaccagagtg

SEQ ID NO: 1608547 - DNA, 14 bp, Homo sapiens
tgcacccacccctg

SEQ ID NO: 1608548 - DNA, 22 bp, Homo sapiens
tgcacccacctgttttctgaaa

SEQ ID NO: 1608549 - DNA, 16 bp, Homo sapiens
tgcacccactcaccag

SEQ ID NO: 1608550 - DNA, 18 bp, Homo sapiens
tgcacccactcaccaggg

SEQ ID NO: 1608551 - DNA, 17 bp, Homo sapiens
tgcacccagaacagtgg

SEQ ID NO: 1608552 - DNA, 22 bp, Homo sapiens
tgcaccccaaagctttcctgcc

SEQ ID NO: 1608553 - DNA, 23 bp, Homo sapiens
tgcaccccaaagctttcctgccc

SEQ ID NO: 1608554 - DNA, 20 bp, Homo sapiens
tgcaccccagcattccagct

SEQ ID NO: 1608555 - DNA, 23 bp, Homo sapiens
tgcaccccagcattccagctctg

SEQ ID NO: 1608556 - DNA, 22 bp, Homo sapiens
tgcaccccatgtgggtgaccag

SEQ ID NO: 1608557 - DNA, 15 bp, Homo sapiens
tgcacccctccccat

SEQ ID NO: 1608558 - DNA, 15 bp, Homo sapiens
tgcaccccttctctc

SEQ ID NO: 1608559 - DNA, 19 bp, Homo sapiens
tgcaccccttctctcctcc

SEQ ID NO: 1608560 - DNA, 14 bp, Homo sapiens
tgcacccgcctctc

SEQ ID NO: 1608561 - DNA, 16 bp, Homo sapiens
tgcacccgcctctccc

SEQ ID NO: 1608562 - DNA, 16 bp, Homo sapiens
tgcaccctccgccttc

SEQ ID NO: 1608563 - DNA, 17 bp, Homo sapiens
tgcaccctgcgcctcca

SEQ ID NO: 1608564 - DNA, 20 bp, Homo sapiens
tgcaccctgcgcctccagag

SEQ ID NO: 1608565 - DNA, 15 bp, Homo sapiens
tgcaccctggggcct

SEQ ID NO: 1608566 - DNA, 13 bp, Homo sapiens
tgcacccttccct

SEQ ID NO: 1608567 - DNA, 16 bp, Homo sapiens
tgcacccttccctctt

SEQ ID NO: 1608568 - DNA, 13 bp, Homo sapiens
tgcaccgcctgcc

SEQ ID NO: 1608569 - DNA, 13 bp, Homo sapiens
tgcaccgtcctca

SEQ ID NO: 1608570 - DNA, 15 bp, Homo sapiens
tgcaccgtcctcagc

SEQ ID NO: 1608571 - DNA, 19 bp, Homo sapiens
tgcacctaccccttggaaa

SEQ ID NO: 1608572 - DNA, 14 bp, Homo sapiens
tgcacctattctgt

SEQ ID NO: 1608573 - DNA, 23 bp, Homo sapiens
tgcacctattctgtagttgcagc

SEQ ID NO: 1608574 - DNA, 15 bp, Homo sapiens
tgcacctccccccac

SEQ ID NO: 1608575 - DNA, 19 bp, Homo sapiens
tgcacctccccccactgca

SEQ ID NO: 1608576 - DNA, 21 bp, Homo sapiens
tgcacctcccttccctccctg

SEQ ID NO: 1608577 - DNA, 13 bp, Homo sapiens
tgcacctctggct

SEQ ID NO: 1608578 - DNA, 21 bp, Homo sapiens
tgcacctctggctagagccga

SEQ ID NO: 1608579 - DNA, 13 bp, Homo sapiens
tgcacctgagacc

SEQ ID NO: 1608580 - DNA, 21 bp, Homo sapiens
tgcacctgagaccctactgaa

SEQ ID NO: 1608581 - DNA, 11 bp, Homo sapiens
tgcacctgcat

SEQ ID NO: 1608582 - DNA, 20 bp, Homo sapiens
tgcacctgccagcctggctt

SEQ ID NO: 1608583 - DNA, 19 bp, Homo sapiens
tgcacctgcctccaccagc

SEQ ID NO: 1608584 - DNA, 22 bp, Homo sapiens
tgcacctgcctccaccagcaag

SEQ ID NO: 1608585 - DNA, 12 bp, Homo sapiens
tgcacctgctgc

SEQ ID NO: 1608586 - DNA, 21 bp, Homo sapiens
tgcacctgctgcgtccccact

SEQ ID NO: 1608587 - DNA, 11 bp, Homo sapiens
tcttctttccc

SEQ ID NO: 1608588 - DNA, 13 bp, Homo sapiens
tcttctttccctg

SEQ ID NO: 1608589 - DNA, 15 bp, Homo sapiens
tcttctttctggttg

SEQ ID NO: 1608590 - DNA, 15 bp, Homo sapiens
tcttctttgtgcctt

SEQ ID NO: 1608591 - DNA, 21 bp, Homo sapiens
tcttctttgtgcctttggcct

SEQ ID NO: 1608592 - DNA, 22 bp, Homo sapiens
tcttctttgtgcctttggcctg

SEQ ID NO: 1608593 - DNA, 20 bp, Homo sapiens
tcttgaaacctgttaaaaca

SEQ ID NO: 1608594 - DNA, 23 bp, Homo sapiens
tcttgaaagattcaggtatgttg

SEQ ID NO: 1608595 - DNA, 20 bp, Homo sapiens
tcttgaaatgaaagggaaac

SEQ ID NO: 1608596 - DNA, 22 bp, Homo sapiens
tcttgaaatgaaagggaaactg

SEQ ID NO: 1608597 - DNA, 18 bp, Homo sapiens
tcttgaacgagcagccca

SEQ ID NO: 1608598 - DNA, 19 bp, Homo sapiens
tcttgaacgagcagcccag

SEQ ID NO: 1608599 - DNA, 21 bp, Homo sapiens
tcttgaagcatttcaaagccc

SEQ ID NO: 1608600 - DNA, 15 bp, Homo sapiens
tcttgaagtcagcca

SEQ ID NO: 1608601 - DNA, 22 bp, Homo sapiens
tcttgaagtcagccacactggg

SEQ ID NO: 1608602 - DNA, 23 bp, Homo sapiens
tcttgaagtcagccacactgggc

SEQ ID NO: 1608603 - DNA, 18 bp, Homo sapiens
tcttgaagtccaggactg

SEQ ID NO: 1608604 - DNA, 17 bp, Homo sapiens
tcttgaagtctgtacag

SEQ ID NO: 1608605 - DNA, 16 bp, Homo sapiens
tcttgaatcctctatt

SEQ ID NO: 1608606 - DNA, 15 bp, Homo sapiens
tcttgaatttctgac

SEQ ID NO: 1608607 - DNA, 23 bp, Homo sapiens
tcttgacagtatatttgaaactg

SEQ ID NO: 1608608 - DNA, 16 bp, Homo sapiens
tcttgacatttatcac

SEQ ID NO: 1608609 - DNA, 19 bp, Homo sapiens
tcttgaccaacagaaacct

SEQ ID NO: 1608610 - DNA, 18 bp, Homo sapiens
tcttgactcatggcagct

SEQ ID NO: 1608611 - DNA, 19 bp, Homo sapiens
tcttgactcatggcagctg

SEQ ID NO: 1608612 - DNA, 13 bp, Homo sapiens
tcttgactctaaa

SEQ ID NO: 1608613 - DNA, 15 bp, Homo sapiens
tcttgactttctgat

SEQ ID NO: 1608614 - DNA, 18 bp, Homo sapiens
tcttgagcatcaatcttg

SEQ ID NO: 1608615 - DNA, 17 bp, Homo sapiens
tcttgagccacagtcac

SEQ ID NO: 1608616 - DNA, 19 bp, Homo sapiens
tcttgaggaagcccaggct

SEQ ID NO: 1608617 - DNA, 16 bp, Homo sapiens
tcttgaggccaggagt

SEQ ID NO: 1608618 - DNA, 14 bp, Homo sapiens
tcttgagtttgtcg

SEQ ID NO: 1608619 - DNA, 22 bp, Homo sapiens
tcttgagtttgtcgctcatgtg

SEQ ID NO: 1608620 - DNA, 21 bp, Homo sapiens
tcttgagttttgttttaaaat

SEQ ID NO: 1608621 - DNA, 20 bp, Homo sapiens
tcttgataaatgactgtttt

SEQ ID NO: 1608622 - DNA, 17 bp, Homo sapiens
tcttgatacccccctct

SEQ ID NO: 1608623 - DNA, 19 bp, Homo sapiens
tcttgatcaacatcttttc

SEQ ID NO: 1608624 - DNA, 23 bp, Homo sapiens
tcttgatcaacatcttttcttgc

SEQ ID NO: 1608625 - DNA, 19 bp, Homo sapiens
tcttgatgtaaaatcttgt

SEQ ID NO: 1608626 - DNA, 22 bp, Homo sapiens
tcttgatgtaaaatcttgtcat

SEQ ID NO: 1608627 - DNA, 15 bp, Homo sapiens
tcttgattcagtcac

SEQ ID NO: 1608628 - DNA, 17 bp, Homo sapiens
tcttgattcagtcacat

SEQ ID NO: 1608629 - DNA, 14 bp, Homo sapiens
tcttgattcctggt

SEQ ID NO: 1608630 - DNA, 16 bp, Homo sapiens
tcttgattctctccct

SEQ ID NO: 1608631 - DNA, 17 bp, Homo sapiens
tcttgattttcaagctt

SEQ ID NO: 1608632 - DNA, 19 bp, Homo sapiens
tcttgattttcaagctttc

SEQ ID NO: 1608633 - DNA, 19 bp, Homo sapiens
tcttgcacccgcctctccc

SEQ ID NO: 1608634 - DNA, 19 bp, Homo sapiens
tcttgcagattctatttcc

SEQ ID NO: 1608635 - DNA, 14 bp, Homo sapiens
tcttgcagcattta

SEQ ID NO: 1608636 - DNA, 22 bp, Homo sapiens
tcttgcataggctcttaagcag

SEQ ID NO: 1608637 - DNA, 17 bp, Homo sapiens
tcttgcattcaaaatct

SEQ ID NO: 1608638 - DNA, 19 bp, Homo sapiens
tcttgcattcaaaatcttc

SEQ ID NO: 1608639 - DNA, 14 bp, Homo sapiens
tcttgcccagcagc

SEQ ID NO: 1608640 - DNA, 21 bp, Homo sapiens
tcttgcccgcacccctccctg

SEQ ID NO: 1608641 - DNA, 16 bp, Homo sapiens
tcttgcccttccctgt

SEQ ID NO: 1608642 - DNA, 21 bp, Homo sapiens
tcttgcccttccctgtccctc

SEQ ID NO: 1608643 - DNA, 15 bp, Homo sapiens
tcttgcctccaggtg

SEQ ID NO: 1608644 - DNA, 19 bp, Homo sapiens
tcttgcctccaggtgcaga

SEQ ID NO: 1608645 - DNA, 15 bp, Homo sapiens
tcttgcgggcctgga

SEQ ID NO: 1608646 - DNA, 19 bp, Homo sapiens
tcttgctgatggctgctag

SEQ ID NO: 1608647 - DNA, 20 bp, Homo sapiens
tcttgctgatggctgctaga

SEQ ID NO: 1608648 - DNA, 21 bp, Homo sapiens
tcttgctgatggctgctagat

SEQ ID NO: 1608649 - DNA, 23 bp, Homo sapiens
tcttgctggctacgcctcttctg

SEQ ID NO: 1608650 - DNA, 22 bp, Homo sapiens
tcttgctggtctagtcacgcat

SEQ ID NO: 1608651 - DNA, 22 bp, Homo sapiens
tcttgctggttgtcatttttgc

SEQ ID NO: 1608652 - DNA, 16 bp, Homo sapiens
tcttgcttctttctag

SEQ ID NO: 1608653 - DNA, 19 bp, Homo sapiens
tcttggaagctgtttggaa

SEQ ID NO: 1608654 - DNA, 15 bp, Homo sapiens
tcttggacaaatcac

SEQ ID NO: 1608655 - DNA, 17 bp, Homo sapiens
tcttggacactgtacaa

SEQ ID NO: 1608656 - DNA, 16 bp, Homo sapiens
tcttggagaagtctca

SEQ ID NO: 1608657 - DNA, 19 bp, Homo sapiens
tcttggagaagtctcagct

SEQ ID NO: 1608658 - DNA, 17 bp, Homo sapiens
tcttggagcctaaagag

SEQ ID NO: 1608659 - DNA, 21 bp, Homo sapiens
tcttggcagcttaacattgac

SEQ ID NO: 1608660 - DNA, 13 bp, Homo sapiens
tcttggccagcca

SEQ ID NO: 1608661 - DNA, 16 bp, Homo sapiens
tcttggctattgaaga

SEQ ID NO: 1608662 - DNA, 21 bp, Homo sapiens
tcttggctattgaagatgctg

SEQ ID NO: 1608663 - DNA, 17 bp, Homo sapiens
tcttggctatttctgtg

SEQ ID NO: 1608664 - DNA, 14 bp, Homo sapiens
tcttggctgacccc

SEQ ID NO: 1608665 - DNA, 16 bp, Homo sapiens
tcttggctgacccctc

SEQ ID NO: 1608666 - DNA, 19 bp, Homo sapiens
tcttggctgcctgtgggct

SEQ ID NO: 1608667 - DNA, 15 bp, Homo sapiens
tcttggcttaatcat

SEQ ID NO: 1608668 - DNA, 20 bp, Homo sapiens
tgcacggttcaatggtagat

SEQ ID NO: 1608669 - DNA, 15 bp, Homo sapiens
tgcacgtcatgggag

SEQ ID NO: 1608670 - DNA, 16 bp, Homo sapiens
tgcacgtcttgctatt

SEQ ID NO: 1608671 - DNA, 18 bp, Homo sapiens
tgcacgtggagagctggt

SEQ ID NO: 1608672 - DNA, 20 bp, Homo sapiens
tgcacgtggagagctggtgc

SEQ ID NO: 1608673 - DNA, 16 bp, Homo sapiens
tgcacgtggcatgtgg

SEQ ID NO: 1608674 - DNA, 15 bp, Homo sapiens
tgcacgtggggccca

SEQ ID NO: 1608675 - DNA, 17 bp, Homo sapiens
tgcacgtggggcccact

SEQ ID NO: 1608676 - DNA, 17 bp, Homo sapiens
tgcactaacagagtggc

SEQ ID NO: 1608677 - DNA, 14 bp, Homo sapiens
tgcactaactgctg

SEQ ID NO: 1608678 - DNA, 15 bp, Homo sapiens
tgcactaactgctgg

SEQ ID NO: 1608679 - DNA, 16 bp, Homo sapiens
tgcactaactgctggt

SEQ ID NO: 1608680 - DNA, 18 bp, Homo sapiens
tgcactactcctctgcag

SEQ ID NO: 1608681 - DNA, 16 bp, Homo sapiens
tgcactatttccacat

SEQ ID NO: 1608682 - DNA, 14 bp, Homo sapiens
tgcactcaaatctt

SEQ ID NO: 1608683 - DNA, 15 bp, Homo sapiens
tgcactcaaatctta

SEQ ID NO: 1608684 - DNA, 22 bp, Homo sapiens
tgcactcacccctagccctggt

SEQ ID NO: 1608685 - DNA, 21 bp, Homo sapiens
tgcactccacacatctttctt

SEQ ID NO: 1608686 - DNA, 13 bp, Homo sapiens
tgcactccagcct

SEQ ID NO: 1608687 - DNA, 15 bp, Homo sapiens
tgcactccagcctgg

SEQ ID NO: 1608688 - DNA, 18 bp, Homo sapiens
tgcactccagcctgggcg

SEQ ID NO: 1608689 - DNA, 18 bp, Homo sapiens
tgcactccagcctggggg

SEQ ID NO: 1608690 - DNA, 14 bp, Homo sapiens
tgcactccatggcc

SEQ ID NO: 1608691 - DNA, 20 bp, Homo sapiens
tgcactccatggccaccccg

SEQ ID NO: 1608692 - DNA, 13 bp, Homo sapiens
tgcactccctggc

SEQ ID NO: 1608693 - DNA, 12 bp, Homo sapiens
tgcactcctcag

SEQ ID NO: 1608694 - DNA, 19 bp, Homo sapiens
tgcactcgccatttcctca

SEQ ID NO: 1608695 - DNA, 20 bp, Homo sapiens
tgcactctgtaattgcactt

SEQ ID NO: 1608696 - DNA, 12 bp, Homo sapiens
tgcactcttgaa

SEQ ID NO: 1608697 - DNA, 20 bp, Homo sapiens
tgcactcttgaactgggcga

SEQ ID NO: 1608698 - DNA, 18 bp, Homo sapiens
tgcactgaacagaattaa

SEQ ID NO: 1608699 - DNA, 20 bp, Homo sapiens
tgcactgaagccggacagct

SEQ ID NO: 1608700 - DNA, 16 bp, Homo sapiens
tgcactgacccttcca

SEQ ID NO: 1608701 - DNA, 14 bp, Homo sapiens
tgcactgagggcca

SEQ ID NO: 1608702 - DNA, 19 bp, Homo sapiens
tgcactgagggccacacta

SEQ ID NO: 1608703 - DNA, 15 bp, Homo sapiens
tgcactgatcaccca

SEQ ID NO: 1608704 - DNA, 14 bp, Homo sapiens
tgcactgatgctgc

SEQ ID NO: 1608705 - DNA, 16 bp, Homo sapiens
tgcactgatgctgccc

SEQ ID NO: 1608706 - DNA, 21 bp, Homo sapiens
tgcactgatgctgcccctcat

SEQ ID NO: 1608707 - DNA, 22 bp, Homo sapiens
tgcactgatgctgcccctcatc

SEQ ID NO: 1608708 - DNA, 13 bp, Homo sapiens
tgcactgatgttg

SEQ ID NO: 1608709 - DNA, 14 bp, Homo sapiens
tgcactgcctgcat

SEQ ID NO: 1608710 - DNA, 15 bp, Homo sapiens
tgcactgcctgcatg

SEQ ID NO: 1608711 - DNA, 17 bp, Homo sapiens
tgcactgcctgcatgag

SEQ ID NO: 1608712 - DNA, 20 bp, Homo sapiens
tgcactgcctgcatgagctg

SEQ ID NO: 1608713 - DNA, 21 bp, Homo sapiens
tgcactgcctgccatgtagtt

SEQ ID NO: 1608714 - DNA, 13 bp, Homo sapiens
tgcactgctgtaa

SEQ ID NO: 1608715 - DNA, 13 bp, Homo sapiens
tgcactgctgttc

SEQ ID NO: 1608716 - DNA, 15 bp, Homo sapiens
tgcactggggtggga

SEQ ID NO: 1608717 - DNA, 12 bp, Homo sapiens
tgcactgtaaaa

SEQ ID NO: 1608718 - DNA, 13 bp, Homo sapiens
tgcactgtaaaat

SEQ ID NO: 1608719 - DNA, 17 bp, Homo sapiens
tgcactgtaaaatgtgg

SEQ ID NO: 1608720 - DNA, 17 bp, Homo sapiens
tgcactgtaaattgctg

SEQ ID NO: 1608721 - DNA, 16 bp, Homo sapiens
tgcactgtatgctgga

SEQ ID NO: 1608722 - DNA, 18 bp, Homo sapiens
tgcactgtgaatcctggc

SEQ ID NO: 1608723 - DNA, 19 bp, Homo sapiens
tgcactgtgtcatcttttc

SEQ ID NO: 1608724 - DNA, 17 bp, Homo sapiens
tgcactgtgtgctgact

SEQ ID NO: 1608725 - DNA, 22 bp, Homo sapiens
tgcactgtgtgctgactgaaca

SEQ ID NO: 1608726 - DNA, 20 bp, Homo sapiens
tgcacttaagttagcctcca

SEQ ID NO: 1608727 - DNA, 20 bp, Homo sapiens
tgcacttatgatttcatgtg

SEQ ID NO: 1608728 - DNA, 21 bp, Homo sapiens
tgcacttattgtccccttttt

SEQ ID NO: 1608729 - DNA, 15 bp, Homo sapiens
tgcacttcagacacc

SEQ ID NO: 1608730 - DNA, 15 bp, Homo sapiens
tgcacttctgtaaac

SEQ ID NO: 1608731 - DNA, 14 bp, Homo sapiens
tgcactttcagact

SEQ ID NO: 1608732 - DNA, 19 bp, Homo sapiens
tgcacttttagaaatgcat

SEQ ID NO: 1608733 - DNA, 21 bp, Homo sapiens
tgcacttttagaaatgcatat

SEQ ID NO: 1608734 - DNA, 16 bp, Homo sapiens
tgcacttttttatgaa

SEQ ID NO: 1608735 - DNA, 20 bp, Homo sapiens
tgcacttttttatgaagaaa

SEQ ID NO: 1608736 - DNA, 21 bp, Homo sapiens
tgcacttttttatgaagaaaa

SEQ ID NO: 1608737 - DNA, 16 bp, Homo sapiens
tgcagaaaacagggtc

SEQ ID NO: 1608738 - DNA, 17 bp, Homo sapiens
tgcagaaaagcacctgc

SEQ ID NO: 1608739 - DNA, 18 bp, Homo sapiens
tgcagaaaagcacctgcc

SEQ ID NO: 1608740 - DNA, 20 bp, Homo sapiens
tgcagaaagcatccctcacc

SEQ ID NO: 1608741 - DNA, 20 bp, Homo sapiens
tgcagaaagggccacccatg

SEQ ID NO: 1608742 - DNA, 21 bp, Homo sapiens
tgcagaaatagacaaaaagta

SEQ ID NO: 1608743 - DNA, 14 bp, Homo sapiens
tgcagaacccccag

SEQ ID NO: 1608744 - DNA, 15 bp, Homo sapiens
tgcagaacccccagg

SEQ ID NO: 1608745 - DNA, 19 bp, Homo sapiens
tgcagaacccccaggtggc

SEQ ID NO: 1608746 - DNA, 20 bp, Homo sapiens
tgcagaagagggtgtgtttg

SEQ ID NO: 1608747 - DNA, 19 bp, Homo sapiens
tgcagaagccaagggaaga

SEQ ID NO: 1608748 - DNA, 21 bp, Homo sapiens
tgcagaatacagtaagctgct

SEQ ID NO: 1608749 - DNA, 16 bp, Homo sapiens
tgcagaatatgacaat

SEQ ID NO: 1608750 - DNA, 19 bp, Homo sapiens
tgcagaatgtaagtgggcc

SEQ ID NO: 1608751 - DNA, 14 bp, Homo sapiens
tgcagaattgttta

SEQ ID NO: 1608752 - DNA, 23 bp, Homo sapiens
tgcagacaggccatgtgagccac

SEQ ID NO: 1608753 - DNA, 15 bp, Homo sapiens
tgcagacaggctctg

SEQ ID NO: 1608754 - DNA, 18 bp, Homo sapiens
tgcagacagtctgttatg

SEQ ID NO: 1608755 - DNA, 22 bp, Homo sapiens
tgcagacagtctgttatgcact

SEQ ID NO: 1608756 - DNA, 23 bp, Homo sapiens
tgcagaccatgaagtaaattatg

SEQ ID NO: 1608757 - DNA, 23 bp, Homo sapiens
tgcagacctgtcaccctgcagga

SEQ ID NO: 1608758 - DNA, 14 bp, Homo sapiens
tgcagactcagttt

SEQ ID NO: 1608759 - DNA, 19 bp, Homo sapiens
tgcagactcagtttgtcag

SEQ ID NO: 1608760 - DNA, 20 bp, Homo sapiens
tgcagactccaatggggcca

SEQ ID NO: 1608761 - DNA, 14 bp, Homo sapiens
tgcagactcctcag

SEQ ID NO: 1608762 - DNA, 22 bp, Homo sapiens
tgcagactgttagcttttacct

SEQ ID NO: 1608763 - DNA, 15 bp, Homo sapiens
tgcagacttcccagc

SEQ ID NO: 1608764 - DNA, 22 bp, Homo sapiens
tgcagacttcttaaaaggagct

SEQ ID NO: 1608765 - DNA, 19 bp, Homo sapiens
tgcagagaaacttaagcaa

SEQ ID NO: 1608766 - DNA, 20 bp, Homo sapiens
tgcagagaaacttaagcaaa

SEQ ID NO: 1608767 - DNA, 13 bp, Homo sapiens
tgatgatgttaaa

SEQ ID NO: 1608768 - DNA, 14 bp, Homo sapiens
tgatgatgttaacc

SEQ ID NO: 1608769 - DNA, 15 bp, Homo sapiens
tgatgattttccttt

SEQ ID NO: 1608770 - DNA, 17 bp, Homo sapiens
tgatgcagcctgtggct

SEQ ID NO: 1608771 - DNA, 20 bp, Homo sapiens
tgatgcatacagttttctag

SEQ ID NO: 1608772 - DNA, 15 bp, Homo sapiens
tgatgccaacctctg

SEQ ID NO: 1608773 - DNA, 20 bp, Homo sapiens
tgatgccacttcccagaggc

SEQ ID NO: 1608774 - DNA, 13 bp, Homo sapiens
tgatgccagaggg

SEQ ID NO: 1608775 - DNA, 14 bp, Homo sapiens
tgatgccagagggc

SEQ ID NO: 1608776 - DNA, 16 bp, Homo sapiens
tgatgccagagggcca

SEQ ID NO: 1608777 - DNA, 19 bp, Homo sapiens
tgatgccagagggccagca

SEQ ID NO: 1608778 - DNA, 14 bp, Homo sapiens
tgatgcctccctgt

SEQ ID NO: 1608779 - DNA, 22 bp, Homo sapiens
tgatgcctgcccgcaccctggc

SEQ ID NO: 1608780 - DNA, 18 bp, Homo sapiens
tgatgctatttatgcaag

SEQ ID NO: 1608781 - DNA, 16 bp, Homo sapiens
tgatgctccctcccct

SEQ ID NO: 1608782 - DNA, 21 bp, Homo sapiens
tgatgctccctcccctgccct

SEQ ID NO: 1608783 - DNA, 22 bp, Homo sapiens
tgatgctgccccgttccctgtc

SEQ ID NO: 1608784 - DNA, 15 bp, Homo sapiens
tgatgctgggcaatg

SEQ ID NO: 1608785 - DNA, 21 bp, Homo sapiens
tgatgcttgtaacaagaaaac

SEQ ID NO: 1608786 - DNA, 15 bp, Homo sapiens
tgatggaaaatacca

SEQ ID NO: 1608787 - DNA, 21 bp, Homo sapiens
tgatggaaaataccagtgttg

SEQ ID NO: 1608788 - DNA, 19 bp, Homo sapiens
tgatggaccgggtgggcct

SEQ ID NO: 1608789 - DNA, 14 bp, Homo sapiens
tgatggagccccac

SEQ ID NO: 1608790 - DNA, 15 bp, Homo sapiens
tgatggcagagccag

SEQ ID NO: 1608791 - DNA, 13 bp, Homo sapiens
tgatggcagctgg

SEQ ID NO: 1608792 - DNA, 15 bp, Homo sapiens
tgatggccaagagca

SEQ ID NO: 1608793 - DNA, 16 bp, Homo sapiens
tgatggccaagagcat

SEQ ID NO: 1608794 - DNA, 14 bp, Homo sapiens
tgatggccaagggg

SEQ ID NO: 1608795 - DNA, 20 bp, Homo sapiens
tgatggcccctccagcacac

SEQ ID NO: 1608796 - DNA, 16 bp, Homo sapiens
tgatggccttaatttc

SEQ ID NO: 1608797 - DNA, 20 bp, Homo sapiens
tgatggcgcgggaggcacca

SEQ ID NO: 1608798 - DNA, 14 bp, Homo sapiens
tgatggctgctaga

SEQ ID NO: 1608799 - DNA, 11 bp, Homo sapiens
tgatggctggg

SEQ ID NO: 1608800 - DNA, 23 bp, Homo sapiens
tgatggctgggtccttgggcctg

SEQ ID NO: 1608801 - DNA, 15 bp, Homo sapiens
tgatgggaaaatatt

SEQ ID NO: 1608802 - DNA, 17 bp, Homo sapiens
tgatgggaaaatatttc

SEQ ID NO: 1608803 - DNA, 20 bp, Homo sapiens
tgatggggaatccgtgtgtg

SEQ ID NO: 1608804 - DNA, 18 bp, Homo sapiens
tgatggggacatttcttc

SEQ ID NO: 1608805 - DNA, 14 bp, Homo sapiens
tgatggggagaaag

SEQ ID NO: 1608806 - DNA, 17 bp, Homo sapiens
tgatgggggagagggtg

SEQ ID NO: 1608807 - DNA, 14 bp, Homo sapiens
tgatggtcagaggg

SEQ ID NO: 1608808 - DNA, 13 bp, Homo sapiens
tgatggtgagctg

SEQ ID NO: 1608809 - DNA, 16 bp, Homo sapiens
tgatggtgagctggga

SEQ ID NO: 1608810 - DNA, 18 bp, Homo sapiens
tgatggtgccagagaggg

SEQ ID NO: 1608811 - DNA, 20 bp, Homo sapiens
tgatggtggactaagcaatt

SEQ ID NO: 1608812 - DNA, 18 bp, Homo sapiens
tgatggtttccaatttca

SEQ ID NO: 1608813 - DNA, 15 bp, Homo sapiens
tgatgtaaggactgt

SEQ ID NO: 1608814 - DNA, 20 bp, Homo sapiens
tgatgtaaggactgtaaaca

SEQ ID NO: 1608815 - DNA, 21 bp, Homo sapiens
tgatgtaaggactgtaaacat

SEQ ID NO: 1608816 - DNA, 22 bp, Homo sapiens
tgatgtaatctctctgcagctg

SEQ ID NO: 1608817 - DNA, 22 bp, Homo sapiens
tgatgtacataactcctgtccc

SEQ ID NO: 1608818 - DNA, 24 bp, Homo sapiens
tgatgtacataactcctgtccctt

SEQ ID NO: 1608819 - DNA, 16 bp, Homo sapiens
tgatgtacatgtgtag

SEQ ID NO: 1608820 - DNA, 15 bp, Homo sapiens
tgatgtacctgatgc

SEQ ID NO: 1608821 - DNA, 15 bp, Homo sapiens
tgatgtaggagctgg

SEQ ID NO: 1608822 - DNA, 12 bp, Homo sapiens
tgatgtatattt

SEQ ID NO: 1608823 - DNA, 19 bp, Homo sapiens
tgatgtatggtatctttag

SEQ ID NO: 1608824 - DNA, 17 bp, Homo sapiens
tgatgtatgtgtgaaac

SEQ ID NO: 1608825 - DNA, 14 bp, Homo sapiens
tgatgtattctagc

SEQ ID NO: 1608826 - DNA, 18 bp, Homo sapiens
tgatgtcaatttctgtgt

SEQ ID NO: 1608827 - DNA, 19 bp, Homo sapiens
tgatgtcaatttctgtgtt

SEQ ID NO: 1608828 - DNA, 21 bp, Homo sapiens
tgatgtcatgtacttcctgtg

SEQ ID NO: 1608829 - DNA, 12 bp, Homo sapiens
tgatgtccagaa

SEQ ID NO: 1608830 - DNA, 22 bp, Homo sapiens
tgatgtccagggggagaaggaa

SEQ ID NO: 1608831 - DNA, 19 bp, Homo sapiens
tgatgtgaagagtttcaca

SEQ ID NO: 1608832 - DNA, 20 bp, Homo sapiens
tgatgtgaagagtttcacaa

SEQ ID NO: 1608833 - DNA, 21 bp, Homo sapiens
tgatgtgaagagtttcacaaa

SEQ ID NO: 1608834 - DNA, 15 bp, Homo sapiens
tgatgtgacttttat

SEQ ID NO: 1608835 - DNA, 12 bp, Homo sapiens
tgatgtggactg

SEQ ID NO: 1608836 - DNA, 21 bp, Homo sapiens
tgatgtggaggaagagccacc

SEQ ID NO: 1608837 - DNA, 22 bp, Homo sapiens
tgatgtggaggaagagccacct

SEQ ID NO: 1608838 - DNA, 18 bp, Homo sapiens
tgatgtgtcctgtacaca

SEQ ID NO: 1608839 - DNA, 16 bp, Homo sapiens
tgatgtgttatctctt

SEQ ID NO: 1608840 - DNA, 15 bp, Homo sapiens
tgatgttagaagaag

SEQ ID NO: 1608841 - DNA, 22 bp, Homo sapiens
tgatgttagaagaagaggaaga

SEQ ID NO: 1608842 - DNA, 16 bp, Homo sapiens
tgatgttagcagaccc

SEQ ID NO: 1608843 - DNA, 12 bp, Homo sapiens
tgatgttctaag

SEQ ID NO: 1608844 - DNA, 22 bp, Homo sapiens
tgatgttctaaggctctgagag

SEQ ID NO: 1608845 - DNA, 17 bp, Homo sapiens
tgatgtttcctggaagc

SEQ ID NO: 1608846 - DNA, 12 bp, Homo sapiens
tgatgtttgaaa

SEQ ID NO: 1608847 - DNA, 15 bp, Homo sapiens
tgatgtttgcccaaa

SEQ ID NO: 1608848 - DNA, 11 bp, Homo sapiens
tgatgtttgtg

SEQ ID NO: 1608849 - DNA, 17 bp, Homo sapiens
tgatgtttgtggcctca

SEQ ID NO: 1608850 - DNA, 17 bp, Homo sapiens
tgatgttttttctgtaa

SEQ ID NO: 1608851 - DNA, 20 bp, Homo sapiens
tgatgttttttctgtaatgt

SEQ ID NO: 1608852 - DNA, 22 bp, Homo sapiens
tgatgttttttctgtaatgtaa

SEQ ID NO: 1608853 - DNA, 13 bp, Homo sapiens
tgattaaaaatgt

SEQ ID NO: 1608854 - DNA, 16 bp, Homo sapiens
tgattaaagactgtga

SEQ ID NO: 1608855 - DNA, 19 bp, Homo sapiens
tgattaaataagattctaa

SEQ ID NO: 1608856 - DNA, 18 bp, Homo sapiens
tgattaaatatttgaaga

SEQ ID NO: 1608857 - DNA, 23 bp, Homo sapiens
tgattaacaatgtattttaataa

SEQ ID NO: 1608858 - DNA, 13 bp, Homo sapiens
tgattaacatttg

SEQ ID NO: 1608859 - DNA, 14 bp, Homo sapiens
tgattaacttggat

SEQ ID NO: 1608860 - DNA, 12 bp, Homo sapiens
tgattaatcaaa

SEQ ID NO: 1608861 - DNA, 14 bp, Homo sapiens
tgattaatcaaagg

SEQ ID NO: 1608862 - DNA, 23 bp, Homo sapiens
tgattactggcctttttcattta

SEQ ID NO: 1608863 - DNA, 19 bp, Homo sapiens
tgattactgtcaataaaca

SEQ ID NO: 1608864 - DNA, 16 bp, Homo sapiens
tgattagacagaacac

SEQ ID NO: 1608865 - DNA, 17 bp, Homo sapiens
tgattagacagaacacc

SEQ ID NO: 1608866 - DNA, 14 bp, Homo sapiens
tgattagataaaga

SEQ ID NO: 1608867 - DNA, 14 bp, Homo sapiens
tgattagatcacat

SEQ ID NO: 1608868 - DNA, 14 bp, Homo sapiens
tgattagtaagtct

SEQ ID NO: 1608869 - DNA, 13 bp, Homo sapiens
tgattatcttcag

SEQ ID NO: 1608870 - DNA, 18 bp, Homo sapiens
tgattatcttcagcccag

SEQ ID NO: 1608871 - DNA, 13 bp, Homo sapiens
tgattattatgtt

SEQ ID NO: 1608872 - DNA, 14 bp, Homo sapiens
tgattattatgttt

SEQ ID NO: 1608873 - DNA, 16 bp, Homo sapiens
tgattattcaacacat

SEQ ID NO: 1608874 - DNA, 17 bp, Homo sapiens
tgattattcaacacatt

SEQ ID NO: 1608875 - DNA, 13 bp, Homo sapiens
tgattattgaatg

SEQ ID NO: 1608876 - DNA, 19 bp, Homo sapiens
tgattattttcttcatcca

SEQ ID NO: 1608877 - DNA, 16 bp, Homo sapiens
tgattcaaggctcaga

SEQ ID NO: 1608878 - DNA, 16 bp, Homo sapiens
tgattcaatctgtaaa

SEQ ID NO: 1608879 - DNA, 17 bp, Homo sapiens
tgattcaatctgtaaac

SEQ ID NO: 1608880 - DNA, 23 bp, Homo sapiens
tgattcaatctgtaaactgtgta

SEQ ID NO: 1608881 - DNA, 22 bp, Homo sapiens
tgattcacatgctaaagccagg

SEQ ID NO: 1608882 - DNA, 24 bp, Homo sapiens
tgattcaccaaaatagtcttctca

SEQ ID NO: 1608883 - DNA, 16 bp, Homo sapiens
tgattcacctcttcct

SEQ ID NO: 1608884 - DNA, 15 bp, Homo sapiens
tgattcagcaaaaat

SEQ ID NO: 1608885 - DNA, 15 bp, Homo sapiens
tgattcagtcacatg

SEQ ID NO: 1608886 - DNA, 16 bp, Homo sapiens
tgattcagtcttctgg

SEQ ID NO: 1608887 - DNA, 17 bp, Homo sapiens
tgattcagtcttctgga

SEQ ID NO: 1608888 - DNA, 20 bp, Homo sapiens
tgattcatcctgggatgtaa

SEQ ID NO: 1608889 - DNA, 15 bp, Homo sapiens
tgattcatgagctgg

SEQ ID NO: 1608890 - DNA, 17 bp, Homo sapiens
tgattccaaatatgtat

SEQ ID NO: 1608891 - DNA, 19 bp, Homo sapiens
tgattccaatctctgttct

SEQ ID NO: 1608892 - DNA, 19 bp, Homo sapiens
tgattccactacacctggc

SEQ ID NO: 1608893 - DNA, 15 bp, Homo sapiens
tgattccacttttat

SEQ ID NO: 1608894 - DNA, 18 bp, Homo sapiens
tgattcccacccaaaccc

SEQ ID NO: 1608895 - DNA, 14 bp, Homo sapiens
tgattcccgggctt

SEQ ID NO: 1608896 - DNA, 14 bp, Homo sapiens
tgattcctcccagg

SEQ ID NO: 1608897 - DNA, 24 bp, Homo sapiens
tgattcctggacatcaccagtcct

SEQ ID NO: 1608898 - DNA, 15 bp, Homo sapiens
tgattcctggctcta

SEQ ID NO: 1608899 - DNA, 22 bp, Homo sapiens
tgattccttgatggagatattt

SEQ ID NO: 1608900 - DNA, 19 bp, Homo sapiens
tgattcggacggccaatgg

SEQ ID NO: 1608901 - DNA, 15 bp, Homo sapiens
tgattctacagtgat

SEQ ID NO: 1608902 - DNA, 13 bp, Homo sapiens
tgattctccttca

SEQ ID NO: 1608903 - DNA, 16 bp, Homo sapiens
tgattctccttcagcc

SEQ ID NO: 1608904 - DNA, 23 bp, Homo sapiens
tgattctccttcagccctcaccc

SEQ ID NO: 1608905 - DNA, 22 bp, Homo sapiens
tgattctcttgagataaggttt

SEQ ID NO: 1608906 - DNA, 13 bp, Homo sapiens
tgattctgccttt

SEQ ID NO: 1608907 - DNA, 19 bp, Homo sapiens
tgattctgcttttaccatg

SEQ ID NO: 1608908 - DNA, 18 bp, Homo sapiens
tgattctggctttaagcc

SEQ ID NO: 1608909 - DNA, 13 bp, Homo sapiens
tgattctgtggct

SEQ ID NO: 1608910 - DNA, 19 bp, Homo sapiens
tgattcttgattcctggct

SEQ ID NO: 1608911 - DNA, 21 bp, Homo sapiens
tgattcttgattcctggctct

SEQ ID NO: 1608912 - DNA, 21 bp, Homo sapiens
tgattcttgattttcaagctt

SEQ ID NO: 1608913 - DNA, 14 bp, Homo sapiens
tgattcttgtaaat

SEQ ID NO: 1608914 - DNA, 23 bp, Homo sapiens
tgattctttaatagaagttttat

SEQ ID NO: 1608915 - DNA, 14 bp, Homo sapiens
tgattctttgttac

SEQ ID NO: 1608916 - DNA, 22 bp, Homo sapiens
tgattgaaaagaagaaagtcta

SEQ ID NO: 1608917 - DNA, 19 bp, Homo sapiens
tgattgaaccatttgggat

SEQ ID NO: 1608918 - DNA, 15 bp, Homo sapiens
tgattgacacacagc

SEQ ID NO: 1608919 - DNA, 19 bp, Homo sapiens
tgattgacacacagcactc

SEQ ID NO: 1608920 - DNA, 20 bp, Homo sapiens
tgattgaggagctgcactga

SEQ ID NO: 1608921 - DNA, 19 bp, Homo sapiens
tgattgatcacacagtgtt

SEQ ID NO: 1608922 - DNA, 21 bp, Homo sapiens
tgattgatcacacagtgttag

SEQ ID NO: 1608923 - DNA, 21 bp, Homo sapiens
tgattgcagaattgtttagat

SEQ ID NO: 1608924 - DNA, 13 bp, Homo sapiens
tgattgctgccat

SEQ ID NO: 1608925 - DNA, 20 bp, Homo sapiens
tgattggaagggcttttcaa

SEQ ID NO: 1608926 - DNA, 14 bp, Homo sapiens
tgattggattattc

SEQ ID NO: 1608927 - DNA, 19 bp, Homo sapiens
tgattggattattcattta

SEQ ID NO: 1608928 - DNA, 14 bp, Homo sapiens
tgattggctgcagg

SEQ ID NO: 1608929 - DNA, 15 bp, Homo sapiens
tgattgggaaaacat

SEQ ID NO: 1608930 - DNA, 17 bp, Homo sapiens
tgattgggaaaacattt

SEQ ID NO: 1608931 - DNA, 16 bp, Homo sapiens
tgattgggtgggattt

SEQ ID NO: 1608932 - DNA, 21 bp, Homo sapiens
tgattggtgcaacccttaccc

SEQ ID NO: 1608933 - DNA, 15 bp, Homo sapiens
tgattggttgtgcct

SEQ ID NO: 1608934 - DNA, 16 bp, Homo sapiens
tgattgtattgttgaa

SEQ ID NO: 1608935 - DNA, 19 bp, Homo sapiens
tgattgttaatttacagct

SEQ ID NO: 1608936 - DNA, 13 bp, Homo sapiens
tgattgtttacag

SEQ ID NO: 1608937 - DNA, 16 bp, Homo sapiens
tgatttaaacacacag

SEQ ID NO: 1608938 - DNA, 20 bp, Homo sapiens
tgatttagcaagttctagaa

SEQ ID NO: 1608939 - DNA, 20 bp, Homo sapiens
tgatttaggagaagccagga

SEQ ID NO: 1608940 - DNA, 15 bp, Homo sapiens
tgatttaggcttcta

SEQ ID NO: 1608941 - DNA, 23 bp, Homo sapiens
tgatttataaacagacaatatgt

SEQ ID NO: 1608942 - DNA, 20 bp, Homo sapiens
tgatttatgatcacttggaa

SEQ ID NO: 1608943 - DNA, 21 bp, Homo sapiens
tgatttcaaagttttgttgta

SEQ ID NO: 1608944 - DNA, 19 bp, Homo sapiens
tgatttcacaacagatcaa

SEQ ID NO: 1608945 - DNA, 21 bp, Homo sapiens
tgatttcagactgcagagggg

SEQ ID NO: 1608946 - DNA, 19 bp, Homo sapiens
tgatttcaggatactctgt

SEQ ID NO: 1608947 - DNA, 23 bp, Homo sapiens
tgatttcaggatactctgtcaga

SEQ ID NO: 1608948 - DNA, 16 bp, Homo sapiens
tgatttcagtaagtct

SEQ ID NO: 1608949 - DNA, 19 bp, Homo sapiens
tgatttcagtaagtctcat

SEQ ID NO: 1608950 - DNA, 20 bp, Homo sapiens
tgatttcagtttttcatttg

SEQ ID NO: 1608951 - DNA, 15 bp, Homo sapiens
tgatttcattaatac

SEQ ID NO: 1608952 - DNA, 13 bp, Homo sapiens
tgatttcatttca

SEQ ID NO: 1608953 - DNA, 18 bp, Homo sapiens
tgatttccaaagagaaaa

SEQ ID NO: 1608954 - DNA, 14 bp, Homo sapiens
tgatttccaggccc

SEQ ID NO: 1608955 - DNA, 15 bp, Homo sapiens
tgatttcccactgca

SEQ ID NO: 1608956 - DNA, 20 bp, Homo sapiens
tgatttcccactgcactcca

SEQ ID NO: 1608957 - DNA, 20 bp, Homo sapiens
tgatttcctaaacataattg

SEQ ID NO: 1608958 - DNA, 12 bp, Homo sapiens
tgatttctaatt

SEQ ID NO: 1608959 - DNA, 22 bp, Homo sapiens
tgatttctaattgtaagtgaaa

SEQ ID NO: 1608960 - DNA, 15 bp, Homo sapiens
tgatttctctgaaca

SEQ ID NO: 1608961 - DNA, 21 bp, Homo sapiens
tgatttctctgaacagaaaac

SEQ ID NO: 1608962 - DNA, 16 bp, Homo sapiens
tgatttgaaaaatata

SEQ ID NO: 1608963 - DNA, 13 bp, Homo sapiens
tgatttgaattct

SEQ ID NO: 1608964 - DNA, 17 bp, Homo sapiens
tgatttgcaataaaaat

SEQ ID NO: 1608965 - DNA, 17 bp, Homo sapiens
tgatttgctgctcttca

SEQ ID NO: 1608966 - DNA, 22 bp, Homo sapiens
tgatttggtcagattgggataa

SEQ ID NO: 1608967 - DNA, 20 bp, Homo sapiens
tgatttggtgaccaactgtc

SEQ ID NO: 1608968 - DNA, 14 bp, Homo sapiens
tgatttgtcccagc

SEQ ID NO: 1608969 - DNA, 15 bp, Homo sapiens
tgatttgtcccagcc

SEQ ID NO: 1608970 - DNA, 22 bp, Homo sapiens
tgatttgtcccagcctggggct

SEQ ID NO: 1608971 - DNA, 15 bp, Homo sapiens
tgatttgtggaaatg

SEQ ID NO: 1608972 - DNA, 14 bp, Homo sapiens
tgatttgttttgaa

SEQ ID NO: 1608973 - DNA, 14 bp, Homo sapiens
tgattttaaaatgt

SEQ ID NO: 1608974 - DNA, 22 bp, Homo sapiens
tgattttaaaatgtacatgtat

SEQ ID NO: 1608975 - DNA, 19 bp, Homo sapiens
tgattttaagtttctctgc

SEQ ID NO: 1608976 - DNA, 18 bp, Homo sapiens
tgattttagctgcagaac

SEQ ID NO: 1608977 - DNA, 13 bp, Homo sapiens
tgattttattctt

SEQ ID NO: 1608978 - DNA, 17 bp, Homo sapiens
tgattttcaaacctcaa

SEQ ID NO: 1608979 - DNA, 19 bp, Homo sapiens
tgattttccatctaaaaat

SEQ ID NO: 1608980 - DNA, 22 bp, Homo sapiens
tgattttccatctaaaaatata

SEQ ID NO: 1608981 - DNA, 15 bp, Homo sapiens
tgatttttctagcat

SEQ ID NO: 1608982 - DNA, 16 bp, Homo sapiens
tgatttttctcttcat

SEQ ID NO: 1608983 - DNA, 18 bp, Homo sapiens
tgatttttttttcataca

SEQ ID NO: 1608984 - DNA, 15 bp, Homo sapiens
tgcaaaaaaagcctc

SEQ ID NO: 1608985 - DNA, 16 bp, Homo sapiens
tgcaaaaaaagcctcc

SEQ ID NO: 1608986 - DNA, 21 bp, Homo sapiens
tgcaaaaaaagcctccaaggg

SEQ ID NO: 1608987 - DNA, 13 bp, Homo sapiens
tgcaaaaataacc

SEQ ID NO: 1608988 - DNA, 21 bp, Homo sapiens
tgcaaaaataaccaagtcctc

SEQ ID NO: 1608989 - DNA, 17 bp, Homo sapiens
tgcaaaaataatcatga

SEQ ID NO: 1608990 - DNA, 18 bp, Homo sapiens
tgcaaaaatgagttgtca

SEQ ID NO: 1608991 - DNA, 15 bp, Homo sapiens
tgcaaaagcttcaaa

SEQ ID NO: 1608992 - DNA, 21 bp, Homo sapiens
tgcaaaatagggtaagaagat

SEQ ID NO: 1608993 - DNA, 16 bp, Homo sapiens
tgcaaaatttccagta

SEQ ID NO: 1608994 - DNA, 21 bp, Homo sapiens
tgcaaaatttccagtaccttt

SEQ ID NO: 1608995 - DNA, 12 bp, Homo sapiens
tgcaaacaatga

SEQ ID NO: 1608996 - DNA, 23 bp, Homo sapiens
tgcaaacacacaaaggtataatt

SEQ ID NO: 1608997 - DNA, 20 bp, Homo sapiens
tgcaaacaggttgttttcta

SEQ ID NO: 1608998 - DNA, 14 bp, Homo sapiens
tgcaaaccacttct

SEQ ID NO: 1608999 - DNA, 19 bp, Homo sapiens
tgcaaaccacttctccatg

SEQ ID NO: 1609000 - DNA, 22 bp, Homo sapiens
tgcaaaccacttctccatgctg

SEQ ID NO: 1609001 - DNA, 22 bp, Homo sapiens
tgcaaacctgacccctgctcag

SEQ ID NO: 1609002 - DNA, 23 bp, Homo sapiens
tgcaaacctgacccctgctcagt

SEQ ID NO: 1609003 - DNA, 19 bp, Homo sapiens
tgcaaactgggctggaaga

SEQ ID NO: 1609004 - DNA, 23 bp, Homo sapiens
tgcaaactgggctggaagatatt

SEQ ID NO: 1609005 - DNA, 22 bp, Homo sapiens
tgcaaagcactgacttctaagt

SEQ ID NO: 1609006 - DNA, 16 bp, Homo sapiens
tgcaaagccaaggcag

SEQ ID NO: 1609007 - DNA, 17 bp, Homo sapiens
tgcaaagccaaggcagc

SEQ ID NO: 1609008 - DNA, 18 bp, Homo sapiens
tgcaaagctttggctgag

SEQ ID NO: 1609009 - DNA, 20 bp, Homo sapiens
tgcaaagtaaaaaaatatga

SEQ ID NO: 1609010 - DNA, 22 bp, Homo sapiens
tgcaaagtcgccagtcactgct

SEQ ID NO: 1609011 - DNA, 19 bp, Homo sapiens
tgcaaataaggacagcagc

SEQ ID NO: 1609012 - DNA, 20 bp, Homo sapiens
tgcaaataaggacagcagct

SEQ ID NO: 1609013 - DNA, 23 bp, Homo sapiens
tgcaaataaggacagcagctggt

SEQ ID NO: 1609014 - DNA, 23 bp, Homo sapiens
tgcaaatactgtatattcaggac

SEQ ID NO: 1609015 - DNA, 18 bp, Homo sapiens
tgcaaatagtttcaaatg

SEQ ID NO: 1609016 - DNA, 20 bp, Homo sapiens
tgcaaatcaggcttttgttt

SEQ ID NO: 1609017 - DNA, 18 bp, Homo sapiens
tgcaaatgagctctgaaa

SEQ ID NO: 1609018 - DNA, 17 bp, Homo sapiens
tgcaaatgcacatttgt

SEQ ID NO: 1609019 - DNA, 18 bp, Homo sapiens
tgcaaatggagataaaag

SEQ ID NO: 1609020 - DNA, 13 bp, Homo sapiens
tgcaaattcagaa

SEQ ID NO: 1609021 - DNA, 15 bp, Homo sapiens
tgcaacaagcatgca

SEQ ID NO: 1609022 - DNA, 19 bp, Homo sapiens
tgcaacagactgttgagtt

SEQ ID NO: 1609023 - DNA, 16 bp, Homo sapiens
tgcaacagacttgaat

SEQ ID NO: 1609024 - DNA, 22 bp, Homo sapiens
tgcaacaggggaggaaaaaaga

SEQ ID NO: 1609025 - DNA, 16 bp, Homo sapiens
tgcaacatctctgaat

SEQ ID NO: 1609026 - DNA, 17 bp, Homo sapiens
tgcaaccaactacaacc

SEQ ID NO: 1609027 - DNA, 16 bp, Homo sapiens
tgcaaccaattgaaaa

SEQ ID NO: 1609028 - DNA, 13 bp, Homo sapiens
tgcaaccactgca

SEQ ID NO: 1609029 - DNA, 20 bp, Homo sapiens
tgcaaccaggaacagcaaat

SEQ ID NO: 1609030 - DNA, 14 bp, Homo sapiens
tgcaaccccccagc

SEQ ID NO: 1609031 - DNA, 16 bp, Homo sapiens
tgcaaccgggccctct

SEQ ID NO: 1609032 - DNA, 16 bp, Homo sapiens
tgcaaccgtctgttat

SEQ ID NO: 1609033 - DNA, 15 bp, Homo sapiens
tgcaacctccacctc

SEQ ID NO: 1609034 - DNA, 17 bp, Homo sapiens
tgcaacctccgcctccc

SEQ ID NO: 1609035 - DNA, 16 bp, Homo sapiens
tgcaacctctgcctcc

SEQ ID NO: 1609036 - DNA, 14 bp, Homo sapiens
tgcaacctgttgat

SEQ ID NO: 1609037 - DNA, 14 bp, Homo sapiens
tgcaaccttcacct

SEQ ID NO: 1609038 - DNA, 20 bp, Homo sapiens
tgcaacgctttttgggagaa

SEQ ID NO: 1609039 - DNA, 16 bp, Homo sapiens
tgcaactagccaaggc

SEQ ID NO: 1609040 - DNA, 13 bp, Homo sapiens
tgcaacttctgcc

SEQ ID NO: 1609041 - DNA, 14 bp, Homo sapiens
tgcaacttctgcct

SEQ ID NO: 1609042 - DNA, 21 bp, Homo sapiens
tgcaacttctttctgttgaga

SEQ ID NO: 1609043 - DNA, 17 bp, Homo sapiens
tgcaacttctttttatt

SEQ ID NO: 1609044 - DNA, 14 bp, Homo sapiens
tgcaacttggactt

SEQ ID NO: 1609045 - DNA, 18 bp, Homo sapiens
tgcaagaccacggaggga

SEQ ID NO: 1609046 - DNA, 18 bp, Homo sapiens
tgcaagagaatctgatca

SEQ ID NO: 1609047 - DNA, 23 bp, Homo sapiens
tgcaagagccttggtgtccacct

SEQ ID NO: 1609048 - DNA, 23 bp, Homo sapiens
tgcaagatggacacgagccacaa

SEQ ID NO: 1609049 - DNA, 15 bp, Homo sapiens
tgcaagcacagccct

SEQ ID NO: 1609050 - DNA, 13 bp, Homo sapiens
tgcaagcagagga

SEQ ID NO: 1609051 - DNA, 22 bp, Homo sapiens
tgcaagcagaggaccagggcct

SEQ ID NO: 1609052 - DNA, 18 bp, Homo sapiens
tgcaagccttctaaatga

SEQ ID NO: 1609053 - DNA, 15 bp, Homo sapiens
tgcaagctctgcctc

SEQ ID NO: 1609054 - DNA, 14 bp, Homo sapiens
tgcaaggaccagga

SEQ ID NO: 1609055 - DNA, 24 bp, Homo sapiens
tgcaaggccgctgttcacccacag

SEQ ID NO: 1609056 - DNA, 18 bp, Homo sapiens
tgcaagggcccagagtga

SEQ ID NO: 1609057 - DNA, 22 bp, Homo sapiens
tgcaagggcccagagtgaaccg

SEQ ID NO: 1609058 - DNA, 15 bp, Homo sapiens
tgcaaggtaaaattt

SEQ ID NO: 1609059 - DNA, 20 bp, Homo sapiens
tgcaaggtggcctctgcctg

SEQ ID NO: 1609060 - DNA, 15 bp, Homo sapiens
tgcaagtactgctgt

SEQ ID NO: 1609061 - DNA, 20 bp, Homo sapiens
tgcaagtatactagggagcc

SEQ ID NO: 1609062 - DNA, 17 bp, Homo sapiens
tgcaagttagggtctat

SEQ ID NO: 1609063 - DNA, 22 bp, Homo sapiens
tgcaagtttctgtttcaaagca

SEQ ID NO: 1609064 - DNA, 17 bp, Homo sapiens
tgcaataaaatttaaaa

SEQ ID NO: 1609065 - DNA, 14 bp, Homo sapiens
tgcaataaagtata

SEQ ID NO: 1609066 - DNA, 16 bp, Homo sapiens
tgcaataaagtataat

SEQ ID NO: 1609067 - DNA, 14 bp, Homo sapiens
tgcaataacttcta

SEQ ID NO: 1609068 - DNA, 17 bp, Homo sapiens
tgcaataacttctatat

SEQ ID NO: 1609069 - DNA, 22 bp, Homo sapiens
tgcaataacttctatattttaa

SEQ ID NO: 1609070 - DNA, 20 bp, Homo sapiens
tgcaataagattggtgttcg

SEQ ID NO: 1609071 - DNA, 14 bp, Homo sapiens
tgcaataatacttc

SEQ ID NO: 1609072 - DNA, 15 bp, Homo sapiens
tgcaataatttgtac

SEQ ID NO: 1609073 - DNA, 16 bp, Homo sapiens
tgcaataatttgtaca

SEQ ID NO: 1609074 - DNA, 18 bp, Homo sapiens
tgcaataatttgtacaat

SEQ ID NO: 1609075 - DNA, 13 bp, Homo sapiens
tgcaatacatttt

SEQ ID NO: 1609076 - DNA, 16 bp, Homo sapiens
tgcaatagagactgta

SEQ ID NO: 1609077 - DNA, 20 bp, Homo sapiens
tgcaatagattactgatgtg

SEQ ID NO: 1609078 - DNA, 18 bp, Homo sapiens
tgcaatattaatgccttt

SEQ ID NO: 1609079 - DNA, 14 bp, Homo sapiens
tgcaatcagacaag

SEQ ID NO: 1609080 - DNA, 17 bp, Homo sapiens
tgcaatccaaataaaga

SEQ ID NO: 1609081 - DNA, 20 bp, Homo sapiens
tgcaatccatttatttcatt

SEQ ID NO: 1609082 - DNA, 12 bp, Homo sapiens
tgcaatctactg

SEQ ID NO: 1609083 - DNA, 15 bp, Homo sapiens
tgcaatctactggaa

SEQ ID NO: 1609084 - DNA, 21 bp, Homo sapiens
tgcaatgaaaggtactatatt

SEQ ID NO: 1609085 - DNA, 17 bp, Homo sapiens
tgcaatgacatcttcaa

SEQ ID NO: 1609086 - DNA, 13 bp, Homo sapiens
tgcaatgccctca

SEQ ID NO: 1609087 - DNA, 12 bp, Homo sapiens
tgcaatgcttgt

SEQ ID NO: 1609088 - DNA, 19 bp, Homo sapiens
tgcaatggatcagccaagg

SEQ ID NO: 1609089 - DNA, 13 bp, Homo sapiens
tgcaatgtattta

SEQ ID NO: 1609090 - DNA, 19 bp, Homo sapiens
tgcaatgtcacaacctctc

SEQ ID NO: 1609091 - DNA, 21 bp, Homo sapiens
tgcaatgtcacaacctctctg

SEQ ID NO: 1609092 - DNA, 20 bp, Homo sapiens
tgcaatgtccagcagtctga

SEQ ID NO: 1609093 - DNA, 16 bp, Homo sapiens
tgcaatgtgctactga

SEQ ID NO: 1609094 - DNA, 17 bp, Homo sapiens
tgcaattcaaaagttcc

SEQ ID NO: 1609095 - DNA, 19 bp, Homo sapiens
tgcaattcaaaagttccaa

SEQ ID NO: 1609096 - DNA, 14 bp, Homo sapiens
tgcaattgctccca

SEQ ID NO: 1609097 - DNA, 13 bp, Homo sapiens
tgcaattgtcttt

SEQ ID NO: 1609098 - DNA, 20 bp, Homo sapiens
tgcaatttcatatgctgtat

SEQ ID NO: 1609099 - DNA, 18 bp, Homo sapiens
tgcaatttgtttaaagaa

SEQ ID NO: 1609100 - DNA, 20 bp, Homo sapiens
tgcacaaacttgtgagcatc

SEQ ID NO: 1609101 - DNA, 21 bp, Homo sapiens
tgcacaaatatttattttctt

SEQ ID NO: 1609102 - DNA, 15 bp, Homo sapiens
tgcacaacagagtaa

SEQ ID NO: 1609103 - DNA, 14 bp, Homo sapiens
tgcacaagaatgga

SEQ ID NO: 1609104 - DNA, 20 bp, Homo sapiens
tgcacaagaatggatcacaa

SEQ ID NO: 1609105 - DNA, 23 bp, Homo sapiens
tgcacaagaatggatcacaagat

SEQ ID NO: 1609106 - DNA, 13 bp, Homo sapiens
tgcacaagccagg

SEQ ID NO: 1609107 - DNA, 14 bp, Homo sapiens
tgcacaagccaggg

SEQ ID NO: 1609108 - DNA, 14 bp, Homo sapiens
tgcacaagctcaga

SEQ ID NO: 1609109 - DNA, 23 bp, Homo sapiens
tgcacaaggacattgtatgcagg

SEQ ID NO: 1609110 - DNA, 19 bp, Homo sapiens
tgacagcctcccaccccca

SEQ ID NO: 1609111 - DNA, 14 bp, Homo sapiens
tgacagcctgcagc

SEQ ID NO: 1609112 - DNA, 15 bp, Homo sapiens
tgacagcctgcagca

SEQ ID NO: 1609113 - DNA, 14 bp, Homo sapiens
tgacagctccggga

SEQ ID NO: 1609114 - DNA, 14 bp, Homo sapiens
tgacagctgtccct

SEQ ID NO: 1609115 - DNA, 16 bp, Homo sapiens
tgacagctttctggga

SEQ ID NO: 1609116 - DNA, 12 bp, Homo sapiens
tgacaggctgtt

SEQ ID NO: 1609117 - DNA, 16 bp, Homo sapiens
tgacagggcagagcag

SEQ ID NO: 1609118 - DNA, 20 bp, Homo sapiens
tgacaggtgcctgtccttga

SEQ ID NO: 1609119 - DNA, 20 bp, Homo sapiens
tgacagtatatttgaaactg

SEQ ID NO: 1609120 - DNA, 21 bp, Homo sapiens
tgacagtatatttgaaactgt

SEQ ID NO: 1609121 - DNA, 14 bp, Homo sapiens
tgacagtcataaat

SEQ ID NO: 1609122 - DNA, 21 bp, Homo sapiens
tgacagtcataaatactgtca

SEQ ID NO: 1609123 - DNA, 18 bp, Homo sapiens
tgacagtccacaggggcc

SEQ ID NO: 1609124 - DNA, 19 bp, Homo sapiens
tgacagtgaagcagcactg

SEQ ID NO: 1609125 - DNA, 22 bp, Homo sapiens
tgacagtgcctcttccagtgaa

SEQ ID NO: 1609126 - DNA, 20 bp, Homo sapiens
tgacagtgcctgggaatgta

SEQ ID NO: 1609127 - DNA, 16 bp, Homo sapiens
tgacagtgctctaggc

SEQ ID NO: 1609128 - DNA, 19 bp, Homo sapiens
tgacagtgctctaggctgc

SEQ ID NO: 1609129 - DNA, 16 bp, Homo sapiens
tgacagtgttgaaaat

SEQ ID NO: 1609130 - DNA, 13 bp, Homo sapiens
tgacagttatttt

SEQ ID NO: 1609131 - DNA, 16 bp, Homo sapiens
tgacagttctgaagaa

SEQ ID NO: 1609132 - DNA, 19 bp, Homo sapiens
tgacataaaatttacattt

SEQ ID NO: 1609133 - DNA, 18 bp, Homo sapiens
tgacatagagaaaaggct

SEQ ID NO: 1609134 - DNA, 13 bp, Homo sapiens
tgacatagcctca

SEQ ID NO: 1609135 - DNA, 17 bp, Homo sapiens
tgacatcaaagcctggc

SEQ ID NO: 1609136 - DNA, 19 bp, Homo sapiens
tgacatcacttgtacaaaa

SEQ ID NO: 1609137 - DNA, 20 bp, Homo sapiens
tgacatcacttgtacaaaat

SEQ ID NO: 1609138 - DNA, 22 bp, Homo sapiens
tgacatcacttgtacaaaataa

SEQ ID NO: 1609139 - DNA, 16 bp, Homo sapiens
tgacatccaaatctag

SEQ ID NO: 1609140 - DNA, 11 bp, Homo sapiens
tgacatccctt

SEQ ID NO: 1609141 - DNA, 19 bp, Homo sapiens
tgacatcccttcctggaaa

SEQ ID NO: 1609142 - DNA, 20 bp, Homo sapiens
tgacatcccttcctggaaac

SEQ ID NO: 1609143 - DNA, 22 bp, Homo sapiens
tgacatcccttcctggaaacag

SEQ ID NO: 1609144 - DNA, 19 bp, Homo sapiens
tgacatcggaaaaataatc

SEQ ID NO: 1609145 - DNA, 14 bp, Homo sapiens
tgacatctggaatc

SEQ ID NO: 1609146 - DNA, 11 bp, Homo sapiens
tgacatgcact

SEQ ID NO: 1609147 - DNA, 13 bp, Homo sapiens
tgacatgcactga

SEQ ID NO: 1609148 - DNA, 14 bp, Homo sapiens
tgacatgcactgac

SEQ ID NO: 1609149 - DNA, 21 bp, Homo sapiens
tgacatgcactgacccttcca

SEQ ID NO: 1609150 - DNA, 13 bp, Homo sapiens
tgacatgctcaca

SEQ ID NO: 1609151 - DNA, 22 bp, Homo sapiens
tgacatgctcacacattacaac

SEQ ID NO: 1609152 - DNA, 16 bp, Homo sapiens
tgacatggaaatgaag

SEQ ID NO: 1609153 - DNA, 12 bp, Homo sapiens
tgacatggaccc

SEQ ID NO: 1609154 - DNA, 21 bp, Homo sapiens
tgacatggacccactaccctt

SEQ ID NO: 1609155 - DNA, 23 bp, Homo sapiens
tgagtgacagctttctgggatgt

SEQ ID NO: 1609156 - DNA, 19 bp, Homo sapiens
tgagtgacatagcctcatg

SEQ ID NO: 1609157 - DNA, 23 bp, Homo sapiens
tgagtgagccacagaccacctgc

SEQ ID NO: 1609158 - DNA, 15 bp, Homo sapiens
tgagtgatcctccaa

SEQ ID NO: 1609159 - DNA, 21 bp, Homo sapiens
tgagtgattgacacacagcac

SEQ ID NO: 1609160 - DNA, 14 bp, Homo sapiens
tgagtgcacctgcc

SEQ ID NO: 1609161 - DNA, 15 bp, Homo sapiens
tgagtgcacctgcct

SEQ ID NO: 1609162 - DNA, 22 bp, Homo sapiens
tgagtgcacctgcctccaccag

SEQ ID NO: 1609163 - DNA, 18 bp, Homo sapiens
tgagtggaatgcagggaa

SEQ ID NO: 1609164 - DNA, 17 bp, Homo sapiens
tgagtggcagcagcccc

SEQ ID NO: 1609165 - DNA, 14 bp, Homo sapiens
tgagtggcagccat

SEQ ID NO: 1609166 - DNA, 12 bp, Homo sapiens
tgagtgggaagc

SEQ ID NO: 1609167 - DNA, 21 bp, Homo sapiens
tgagtgggaggcgtgcccccc

SEQ ID NO: 1609168 - DNA, 16 bp, Homo sapiens
tgagtgggctgtagtt

SEQ ID NO: 1609169 - DNA, 15 bp, Homo sapiens
tgagtggggagcagt

SEQ ID NO: 1609170 - DNA, 13 bp, Homo sapiens
tgagtgtggactt

SEQ ID NO: 1609171 - DNA, 23 bp, Homo sapiens
tgagtgttcctttttaaatgtga

SEQ ID NO: 1609172 - DNA, 18 bp, Homo sapiens
tgagtgtttaataaagtt

SEQ ID NO: 1609173 - DNA, 19 bp, Homo sapiens
tgagttaatgtgctgagca

SEQ ID NO: 1609174 - DNA, 22 bp, Homo sapiens
tgagttacttgtctgaggcctc

SEQ ID NO: 1609175 - DNA, 13 bp, Homo sapiens
tgagttaggaaca

SEQ ID NO: 1609176 - DNA, 17 bp, Homo sapiens
tgagttaggctttctct

SEQ ID NO: 1609177 - DNA, 16 bp, Homo sapiens
tgagttatattggaat

SEQ ID NO: 1609178 - DNA, 23 bp, Homo sapiens
tgagttatcatgaattttaaagt

SEQ ID NO: 1609179 - DNA, 19 bp, Homo sapiens
tgagttccagttgaagtta

SEQ ID NO: 1609180 - DNA, 15 bp, Homo sapiens
tgagttctacataag

SEQ ID NO: 1609181 - DNA, 22 bp, Homo sapiens
tgagttctacataagtaattca

SEQ ID NO: 1609182 - DNA, 17 bp, Homo sapiens
tgagttggctgggaata

SEQ ID NO: 1609183 - DNA, 19 bp, Homo sapiens
tgagttgggggagggaaga

SEQ ID NO: 1609184 - DNA, 23 bp, Homo sapiens
tgagttgggggagggaagaccag

SEQ ID NO: 1609185 - DNA, 13 bp, Homo sapiens
tgagttgtttaaa

SEQ ID NO: 1609186 - DNA, 14 bp, Homo sapiens
tgagttgtttaaag

SEQ ID NO: 1609187 - DNA, 14 bp, Homo sapiens
tgagtttaaagcaa

SEQ ID NO: 1609188 - DNA, 21 bp, Homo sapiens
tgagtttaacaataataaaaa

SEQ ID NO: 1609189 - DNA, 15 bp, Homo sapiens
tgagtttaccatttg

SEQ ID NO: 1609190 - DNA, 20 bp, Homo sapiens
tgagtttaccatttgtaata

SEQ ID NO: 1609191 - DNA, 15 bp, Homo sapiens
tgagtttcactgtac

SEQ ID NO: 1609192 - DNA, 14 bp, Homo sapiens
tgagtttgtaaata

SEQ ID NO: 1609193 - DNA, 20 bp, Homo sapiens
tgagtttgtcgctcatgtgt

SEQ ID NO: 1609194 - DNA, 18 bp, Homo sapiens
tgagtttttatggggctg

SEQ ID NO: 1609195 - DNA, 13 bp, Homo sapiens
tgagtttttgata

SEQ ID NO: 1609196 - DNA, 22 bp, Homo sapiens
tgataaacattaaacactgtaa

SEQ ID NO: 1609197 - DNA, 13 bp, Homo sapiens
tgataaacctaat

SEQ ID NO: 1609198 - DNA, 14 bp, Homo sapiens
tgataaacctaata

SEQ ID NO: 1609199 - DNA, 16 bp, Homo sapiens
tgataaacctaatatt

SEQ ID NO: 1609200 - DNA, 21 bp, Homo sapiens
tgataaagaggcatcttttct

SEQ ID NO: 1609201 - DNA, 19 bp, Homo sapiens
tgataaattccactggact

SEQ ID NO: 1609202 - DNA, 17 bp, Homo sapiens
tgataacaaaaaataaa

SEQ ID NO: 1609203 - DNA, 23 bp, Homo sapiens
tgataacagggattgattttaaa

SEQ ID NO: 1609204 - DNA, 19 bp, Homo sapiens
tgataagaggaatttggta

SEQ ID NO: 1609205 - DNA, 15 bp, Homo sapiens
tgataagcattgact

SEQ ID NO: 1609206 - DNA, 22 bp, Homo sapiens
tgataagccgaggaggcattct

SEQ ID NO: 1609207 - DNA, 16 bp, Homo sapiens
tgataaggatcagaac

SEQ ID NO: 1609208 - DNA, 19 bp, Homo sapiens
tgataagggaaaagataaa

SEQ ID NO: 1609209 - DNA, 14 bp, Homo sapiens
tgataagtagcatg

SEQ ID NO: 1609210 - DNA, 13 bp, Homo sapiens
tgataagttcata

SEQ ID NO: 1609211 - DNA, 15 bp, Homo sapiens
tgataagttcataca

SEQ ID NO: 1609212 - DNA, 12 bp, Homo sapiens
tgataataataa

SEQ ID NO: 1609213 - DNA, 15 bp, Homo sapiens
tgataatagattctc

SEQ ID NO: 1609214 - DNA, 18 bp, Homo sapiens
tgataatctggtgacaaa

SEQ ID NO: 1609215 - DNA, 14 bp, Homo sapiens
tgataattgcattc

SEQ ID NO: 1609216 - DNA, 16 bp, Homo sapiens
tgataattgcattcat

SEQ ID NO: 1609217 - DNA, 19 bp, Homo sapiens
tgataattgcattcatctt

SEQ ID NO: 1609218 - DNA, 20 bp, Homo sapiens
tgataattgtgtagtaatgt

SEQ ID NO: 1609219 - DNA, 23 bp, Homo sapiens
tgatacactgaaaggaaaaatgt

SEQ ID NO: 1609220 - DNA, 16 bp, Homo sapiens
tgatacactgtatcta

SEQ ID NO: 1609221 - DNA, 14 bp, Homo sapiens
tgatacatttttgt

SEQ ID NO: 1609222 - DNA, 17 bp, Homo sapiens
tgataccagaagggaaa

SEQ ID NO: 1609223 - DNA, 18 bp, Homo sapiens
tgataccagaagggaaag

SEQ ID NO: 1609224 - DNA, 15 bp, Homo sapiens
tgatacccccctctg

SEQ ID NO: 1609225 - DNA, 15 bp, Homo sapiens
tgatacgatgcttca

SEQ ID NO: 1609226 - DNA, 21 bp, Homo sapiens
tgatacgtccgtgtgtcccag

SEQ ID NO: 1609227 - DNA, 18 bp, Homo sapiens
tgatactggaggaacact

SEQ ID NO: 1609228 - DNA, 13 bp, Homo sapiens
tgatacttcaggt

SEQ ID NO: 1609229 - DNA, 16 bp, Homo sapiens
tgatacttcaggtgct

SEQ ID NO: 1609230 - DNA, 19 bp, Homo sapiens
tgatacttccaagtgataa

SEQ ID NO: 1609231 - DNA, 19 bp, Homo sapiens
tgatactttagccatcata

SEQ ID NO: 1609232 - DNA, 13 bp, Homo sapiens
tgatagaactgta

SEQ ID NO: 1609233 - DNA, 18 bp, Homo sapiens
tgatagaactgtactgtt

SEQ ID NO: 1609234 - DNA, 17 bp, Homo sapiens
tgatagcaaaatcaaga

SEQ ID NO: 1609235 - DNA, 21 bp, Homo sapiens
tgatagcttacactgaggact

SEQ ID NO: 1609236 - DNA, 14 bp, Homo sapiens
tgatagctttattt

SEQ ID NO: 1609237 - DNA, 17 bp, Homo sapiens
tgatagtgatgtatttt

SEQ ID NO: 1609238 - DNA, 22 bp, Homo sapiens
tgatagttgaagggaggtgaag

SEQ ID NO: 1609239 - DNA, 13 bp, Homo sapiens
tgatataaatgca

SEQ ID NO: 1609240 - DNA, 14 bp, Homo sapiens
tgatatacattgtg

SEQ ID NO: 1609241 - DNA, 19 bp, Homo sapiens
tgatatacattgtgtgaaa

SEQ ID NO: 1609242 - DNA, 20 bp, Homo sapiens
tgatatagtcagctgccttt

SEQ ID NO: 1609243 - DNA, 13 bp, Homo sapiens
tgatatatgtgtt

SEQ ID NO: 1609244 - DNA, 21 bp, Homo sapiens
tgatatatgtgtttttcacat

SEQ ID NO: 1609245 - DNA, 13 bp, Homo sapiens
tgatatattttac

SEQ ID NO: 1609246 - DNA, 14 bp, Homo sapiens
tgatatattttaca

SEQ ID NO: 1609247 - DNA, 13 bp, Homo sapiens
tgatatcacctct

SEQ ID NO: 1609248 - DNA, 16 bp, Homo sapiens
tgatatcacctctctt

SEQ ID NO: 1609249 - DNA, 17 bp, Homo sapiens
tgatatcattcagcatc

SEQ ID NO: 1609250 - DNA, 19 bp, Homo sapiens
tgatatgatttaaaacatg

SEQ ID NO: 1609251 - DNA, 16 bp, Homo sapiens
tgatatgcatttcctg

SEQ ID NO: 1609252 - DNA, 18 bp, Homo sapiens
tgatatggtgaagggaag

SEQ ID NO: 1609253 - DNA, 15 bp, Homo sapiens
tgatatgtaaacata

SEQ ID NO: 1609254 - DNA, 20 bp, Homo sapiens
tgatatgtaagtacttccac

SEQ ID NO: 1609255 - DNA, 20 bp, Homo sapiens
tgatatgtatccatcaggat

SEQ ID NO: 1609256 - DNA, 14 bp, Homo sapiens
tgatattaaatttc

SEQ ID NO: 1609257 - DNA, 14 bp, Homo sapiens
tgatattaatcaaa

SEQ ID NO: 1609258 - DNA, 20 bp, Homo sapiens
tgatattccatgaatgtatc

SEQ ID NO: 1609259 - DNA, 21 bp, Homo sapiens
tgatattccccccacttaaga

SEQ ID NO: 1609260 - DNA, 16 bp, Homo sapiens
tgatattctgttgctt

SEQ ID NO: 1609261 - DNA, 20 bp, Homo sapiens
tgatattctgttgctttaca

SEQ ID NO: 1609262 - DNA, 12 bp, Homo sapiens
tgatatttcaga

SEQ ID NO: 1609263 - DNA, 15 bp, Homo sapiens
tgatatttcttgctt

SEQ ID NO: 1609264 - DNA, 16 bp, Homo sapiens
tgatatttcttgcttt

SEQ ID NO: 1609265 - DNA, 17 bp, Homo sapiens
tgatatttcttgctttc

SEQ ID NO: 1609266 - DNA, 15 bp, Homo sapiens
tgatatttgtattta

SEQ ID NO: 1609267 - DNA, 21 bp, Homo sapiens
tgatatttgtatttattcttt

SEQ ID NO: 1609268 - DNA, 21 bp, Homo sapiens
tgatattttcaacgcagccct

SEQ ID NO: 1609269 - DNA, 15 bp, Homo sapiens
tgatatttttataca

SEQ ID NO: 1609270 - DNA, 17 bp, Homo sapiens
tgatatttttatacaag

SEQ ID NO: 1609271 - DNA, 18 bp, Homo sapiens
tgatatttttccatttat

SEQ ID NO: 1609272 - DNA, 20 bp, Homo sapiens
tgatatttttccatttattt

SEQ ID NO: 1609273 - DNA, 14 bp, Homo sapiens
tgatcaaaaataaa

SEQ ID NO: 1609274 - DNA, 15 bp, Homo sapiens
tgatcaaaaataaac

SEQ ID NO: 1609275 - DNA, 15 bp, Homo sapiens
tgatcaaaacctgtg

SEQ ID NO: 1609276 - DNA, 18 bp, Homo sapiens
tgatcaaaacctgtgcca

SEQ ID NO: 1609277 - DNA, 13 bp, Homo sapiens
tgatcaaaataaa

SEQ ID NO: 1609278 - DNA, 14 bp, Homo sapiens
tgatcaacatcttt

SEQ ID NO: 1609279 - DNA, 15 bp, Homo sapiens
tgatcaagaatgcaa

SEQ ID NO: 1609280 - DNA, 16 bp, Homo sapiens
tgatcaagatattaaa

SEQ ID NO: 1609281 - DNA, 22 bp, Homo sapiens
tgatcaagggaatgtaactgct

SEQ ID NO: 1609282 - DNA, 14 bp, Homo sapiens
tgatcaagtggttt

SEQ ID NO: 1609283 - DNA, 15 bp, Homo sapiens
tgatcaataaaatgt

SEQ ID NO: 1609284 - DNA, 18 bp, Homo sapiens
tgatcaataaaatgtgat

SEQ ID NO: 1609285 - DNA, 19 bp, Homo sapiens
tgatcaataaaatgtgatt

SEQ ID NO: 1609286 - DNA, 21 bp, Homo sapiens
tgatcaataaaatgtgatttt

SEQ ID NO: 1609287 - DNA, 14 bp, Homo sapiens
tgatcaattaaatg

SEQ ID NO: 1609288 - DNA, 15 bp, Homo sapiens
tgatcaattaaatgt

SEQ ID NO: 1609289 - DNA, 17 bp, Homo sapiens
tgatcaattaaatgtag

SEQ ID NO: 1609290 - DNA, 12 bp, Homo sapiens
tgatcacacagt

SEQ ID NO: 1609291 - DNA, 16 bp, Homo sapiens
tgatcacagtgacttt

SEQ ID NO: 1609292 - DNA, 18 bp, Homo sapiens
tgatcactggcaatgaaa

SEQ ID NO: 1609293 - DNA, 20 bp, Homo sapiens
tgatcagacatacagctgcc

SEQ ID NO: 1609294 - DNA, 21 bp, Homo sapiens
tgatcagacatacagctgcct

SEQ ID NO: 1609295 - DNA, 18 bp, Homo sapiens
tgatcagaccataatgtt

SEQ ID NO: 1609296 - DNA, 16 bp, Homo sapiens
tgatcagccccaccct

SEQ ID NO: 1609297 - DNA, 17 bp, Homo sapiens
tgatcaggcttcctggt

SEQ ID NO: 1609298 - DNA, 21 bp, Homo sapiens
tgatcaggcttcctggtgaga

SEQ ID NO: 1609299 - DNA, 18 bp, Homo sapiens
tgatcagtgattttcaaa

SEQ ID NO: 1609300 - DNA, 22 bp, Homo sapiens
tgatcagtgattttcaaacctc

SEQ ID NO: 1609301 - DNA, 12 bp, Homo sapiens
tgatcagtgttg

SEQ ID NO: 1609302 - DNA, 15 bp, Homo sapiens
tgatcataagtctaa

SEQ ID NO: 1609303 - DNA, 15 bp, Homo sapiens
tgatcatgtactttt

SEQ ID NO: 1609304 - DNA, 16 bp, Homo sapiens
tgatcattttcccccc

SEQ ID NO: 1609305 - DNA, 17 bp, Homo sapiens
tgatcattttcccccca

SEQ ID NO: 1609306 - DNA, 20 bp, Homo sapiens
tgatcattttccccccactc

SEQ ID NO: 1609307 - DNA, 16 bp, Homo sapiens
tgatccacccaaccct

SEQ ID NO: 1609308 - DNA, 12 bp, Homo sapiens
tgatccagcctt

SEQ ID NO: 1609309 - DNA, 15 bp, Homo sapiens
tgatcccacttcact

SEQ ID NO: 1609310 - DNA, 19 bp, Homo sapiens
tgatcccacttcactgtga

SEQ ID NO: 1609311 - DNA, 13 bp, Homo sapiens
tgatcccagcact

SEQ ID NO: 1609312 - DNA, 18 bp, Homo sapiens
tgatccccaagtgtgaac

SEQ ID NO: 1609313 - DNA, 22 bp, Homo sapiens
tgatcccggccggccctggctt

SEQ ID NO: 1609314 - DNA, 20 bp, Homo sapiens
tgatccctgaacccctggcc

SEQ ID NO: 1609315 - DNA, 21 bp, Homo sapiens
tgatccctgctctctgagttt

SEQ ID NO: 1609316 - DNA, 20 bp, Homo sapiens
tgatccgcctgcctctgcct

SEQ ID NO: 1609317 - DNA, 19 bp, Homo sapiens
tgatccgtccgaggctgct

SEQ ID NO: 1609318 - DNA, 13 bp, Homo sapiens
tgatcctccaaca

SEQ ID NO: 1609319 - DNA, 14 bp, Homo sapiens
tgatcctctcacct

SEQ ID NO: 1609320 - DNA, 18 bp, Homo sapiens
tgatcctgctccagcagc

SEQ ID NO: 1609321 - DNA, 13 bp, Homo sapiens
tgatcctgtcctt

SEQ ID NO: 1609322 - DNA, 13 bp, Homo sapiens
tgatcctgttctg

SEQ ID NO: 1609323 - DNA, 15 bp, Homo sapiens
tgatccttacaagtt

SEQ ID NO: 1609324 - DNA, 19 bp, Homo sapiens
tgatccttctgagctccac

SEQ ID NO: 1609325 - DNA, 15 bp, Homo sapiens
tgatcgagccactgc

SEQ ID NO: 1609326 - DNA, 18 bp, Homo sapiens
tgatcgagccactgcact

SEQ ID NO: 1609327 - DNA, 19 bp, Homo sapiens
tgatctaaaatttgtaata

SEQ ID NO: 1609328 - DNA, 22 bp, Homo sapiens
tgatctaaaatttgtaatattt

SEQ ID NO: 1609329 - DNA, 17 bp, Homo sapiens
tgatctaacaaaataag

SEQ ID NO: 1609330 - DNA, 15 bp, Homo sapiens
tgatctaataaactt

SEQ ID NO: 1609331 - DNA, 16 bp, Homo sapiens
tgatctaataaacttt

SEQ ID NO: 1609332 - DNA, 18 bp, Homo sapiens
tgatctaataaactttat

SEQ ID NO: 1609333 - DNA, 19 bp, Homo sapiens
tgatctaataaactttatt

SEQ ID NO: 1609334 - DNA, 21 bp, Homo sapiens
tgatctacttctgtaattgtg

SEQ ID NO: 1609335 - DNA, 14 bp, Homo sapiens
tgatctacttgcct

SEQ ID NO: 1609336 - DNA, 19 bp, Homo sapiens
tgatctacttgcctcattt

SEQ ID NO: 1609337 - DNA, 22 bp, Homo sapiens
tgatctatgtttgtgtgatttc

SEQ ID NO: 1609338 - DNA, 16 bp, Homo sapiens
tgatctcagggaagcc

SEQ ID NO: 1609339 - DNA, 14 bp, Homo sapiens
tgatctcagggcag

SEQ ID NO: 1609340 - DNA, 21 bp, Homo sapiens
tgatctccaggcaaaaggagt

SEQ ID NO: 1609341 - DNA, 21 bp, Homo sapiens
tgatctccatatgttacacta

SEQ ID NO: 1609342 - DNA, 14 bp, Homo sapiens
tgatctccctgccg

SEQ ID NO: 1609343 - DNA, 17 bp, Homo sapiens
tgatctcggatgaccaa

SEQ ID NO: 1609344 - DNA, 23 bp, Homo sapiens
tgatctcggatgaccaaaccagc

SEQ ID NO: 1609345 - DNA, 22 bp, Homo sapiens
tgatctctactaccacaaggaa

SEQ ID NO: 1609346 - DNA, 24 bp, Homo sapiens
tgatctctcttgtcctcttctgct

SEQ ID NO: 1609347 - DNA, 14 bp, Homo sapiens
tgatctgaaaaata

SEQ ID NO: 1609348 - DNA, 17 bp, Homo sapiens
tgatctggaacccagac

SEQ ID NO: 1609349 - DNA, 18 bp, Homo sapiens
tgatctggaacccagact

SEQ ID NO: 1609350 - DNA, 13 bp, Homo sapiens
tgatctgtatata

SEQ ID NO: 1609351 - DNA, 22 bp, Homo sapiens
tgatctgtatatacaataacat

SEQ ID NO: 1609352 - DNA, 19 bp, Homo sapiens
tgatctgtgaattgagctg

SEQ ID NO: 1609353 - DNA, 20 bp, Homo sapiens
tgatcttctttataattcta

SEQ ID NO: 1609354 - DNA, 18 bp, Homo sapiens
tgatcttgagaacctttt

SEQ ID NO: 1609355 - DNA, 15 bp, Homo sapiens
tgatcttgtgctcag

SEQ ID NO: 1609356 - DNA, 19 bp, Homo sapiens
tgatgaaaactaaggattt

SEQ ID NO: 1609357 - DNA, 22 bp, Homo sapiens
tgatgaaatctgctagaaagtt

SEQ ID NO: 1609358 - DNA, 20 bp, Homo sapiens
tgatgaacatattcatgaaa

SEQ ID NO: 1609359 - DNA, 17 bp, Homo sapiens
tgatgaacttattctgt

SEQ ID NO: 1609360 - DNA, 14 bp, Homo sapiens
tgatgaagaagggg

SEQ ID NO: 1609361 - DNA, 14 bp, Homo sapiens
tgatgaatctacat

SEQ ID NO: 1609362 - DNA, 16 bp, Homo sapiens
tgatgaatctacattt

SEQ ID NO: 1609363 - DNA, 17 bp, Homo sapiens
tgatgaatctacatttg

SEQ ID NO: 1609364 - DNA, 17 bp, Homo sapiens
tgatgaatgtactatgt

SEQ ID NO: 1609365 - DNA, 13 bp, Homo sapiens
tgatgacccacta

SEQ ID NO: 1609366 - DNA, 16 bp, Homo sapiens
tgatgacccactaaag

SEQ ID NO: 1609367 - DNA, 17 bp, Homo sapiens
tgatgacccactaaaga

SEQ ID NO: 1609368 - DNA, 18 bp, Homo sapiens
tgatgacccactaaagag

SEQ ID NO: 1609369 - DNA, 15 bp, Homo sapiens
tgatgacccaggctg

SEQ ID NO: 1609370 - DNA, 16 bp, Homo sapiens
tgatgacccttttcat

SEQ ID NO: 1609371 - DNA, 15 bp, Homo sapiens
tgatgacttgctgtc

SEQ ID NO: 1609372 - DNA, 18 bp, Homo sapiens
tgatgacttgctgtccag

SEQ ID NO: 1609373 - DNA, 17 bp, Homo sapiens
tgatgagacagtgaagt

SEQ ID NO: 1609374 - DNA, 18 bp, Homo sapiens
tgatgagacagtgaagta

SEQ ID NO: 1609375 - DNA, 19 bp, Homo sapiens
tgatgagacagtgaagtaa

SEQ ID NO: 1609376 - DNA, 18 bp, Homo sapiens
tgatgagttaactgtgaa

SEQ ID NO: 1609377 - DNA, 17 bp, Homo sapiens
tgatgatacaatgaaca

SEQ ID NO: 1609378 - DNA, 15 bp, Homo sapiens
tgatgatccagaaca

SEQ ID NO: 1609379 - DNA, 15 bp, Homo sapiens
tgatgatgatgatga

SEQ ID NO: 1609380 - DNA, 17 bp, Homo sapiens
tgatgatgatgatgatg

SEQ ID NO: 1609381 - DNA, 21 bp, Homo sapiens
tgatgatgtctcttgtagaag

SEQ ID NO: 1609382 - DNA, 23 bp, Homo sapiens
tgaagaactgcaggccctggcct

SEQ ID NO: 1609383 - DNA, 11 bp, Homo sapiens
tgaagaagaca

SEQ ID NO: 1609384 - DNA, 12 bp, Homo sapiens
tgaagaagcctg

SEQ ID NO: 1609385 - DNA, 14 bp, Homo sapiens
tgaagaagcctgta

SEQ ID NO: 1609386 - DNA, 12 bp, Homo sapiens
tgaagaatctta

SEQ ID NO: 1609387 - DNA, 22 bp, Homo sapiens
tgaagaatgcacaagaatggat

SEQ ID NO: 1609388 - DNA, 17 bp, Homo sapiens
tgaagaattaagataca

SEQ ID NO: 1609389 - DNA, 14 bp, Homo sapiens
tgaagacaataatt

SEQ ID NO: 1609390 - DNA, 13 bp, Homo sapiens
tgaagacaatttg

SEQ ID NO: 1609391 - DNA, 20 bp, Homo sapiens
tgaagacaatttgatacata

SEQ ID NO: 1609392 - DNA, 22 bp, Homo sapiens
tgaagacagagcaaagcgccca

SEQ ID NO: 1609393 - DNA, 14 bp, Homo sapiens
tgaagacaggacag

SEQ ID NO: 1609394 - DNA, 16 bp, Homo sapiens
tgaagaccaaatgata

SEQ ID NO: 1609395 - DNA, 16 bp, Homo sapiens
tgaagacggaaaacaa

SEQ ID NO: 1609396 - DNA, 12 bp, Homo sapiens
tgaagacgtgga

SEQ ID NO: 1609397 - DNA, 13 bp, Homo sapiens
tgaagacgtggac

SEQ ID NO: 1609398 - DNA, 20 bp, Homo sapiens
tgaagacgtggactcctctt

SEQ ID NO: 1609399 - DNA, 14 bp, Homo sapiens
tgaagactccctga

SEQ ID NO: 1609400 - DNA, 19 bp, Homo sapiens
tgaagacttaaaagagctc

SEQ ID NO: 1609401 - DNA, 13 bp, Homo sapiens
tgaagagaaaaaa

SEQ ID NO: 1609402 - DNA, 15 bp, Homo sapiens
tgaagagaaaaaaag

SEQ ID NO: 1609403 - DNA, 17 bp, Homo sapiens
tgaagagaaaaaggctg

SEQ ID NO: 1609404 - DNA, 22 bp, Homo sapiens
tgaagagaaaaaggctgaaaag

SEQ ID NO: 1609405 - DNA, 19 bp, Homo sapiens
tgaagagacagagacaagt

SEQ ID NO: 1609406 - DNA, 21 bp, Homo sapiens
tgaagagacagagacaagtaa

SEQ ID NO: 1609407 - DNA, 23 bp, Homo sapiens
tgaagagaccaagactctgaaat

SEQ ID NO: 1609408 - DNA, 20 bp, Homo sapiens
tgaagagagggacaggcact

SEQ ID NO: 1609409 - DNA, 17 bp, Homo sapiens
tgaagagcttgtgtcct

SEQ ID NO: 1609410 - DNA, 19 bp, Homo sapiens
tgaagaggcgggccagcca

SEQ ID NO: 1609411 - DNA, 20 bp, Homo sapiens
tgaagaggcgggccagccag

SEQ ID NO: 1609412 - DNA, 18 bp, Homo sapiens
tgaagagggagaagcatg

SEQ ID NO: 1609413 - DNA, 12 bp, Homo sapiens
tgaagaggggca

SEQ ID NO: 1609414 - DNA, 14 bp, Homo sapiens
tgaagaggggcagc

SEQ ID NO: 1609415 - DNA, 15 bp, Homo sapiens
tgaagaggggcagcc

SEQ ID NO: 1609416 - DNA, 18 bp, Homo sapiens
tgaagaggggcagccctt

SEQ ID NO: 1609417 - DNA, 18 bp, Homo sapiens
tgaagaggtctgattggc

SEQ ID NO: 1609418 - DNA, 20 bp, Homo sapiens
tgaagagtatccttccttca

SEQ ID NO: 1609419 - DNA, 17 bp, Homo sapiens
tgaagagtgagagggca

SEQ ID NO: 1609420 - DNA, 18 bp, Homo sapiens
tgaagagtgagagggcat

SEQ ID NO: 1609421 - DNA, 15 bp, Homo sapiens
tgaagagtttcacaa

SEQ ID NO: 1609422 - DNA, 19 bp, Homo sapiens
tgaagatcgttagtatcta

SEQ ID NO: 1609423 - DNA, 22 bp, Homo sapiens
tgaagatgcaatcagacaagtg

SEQ ID NO: 1609424 - DNA, 15 bp, Homo sapiens
tgaagatgctgtaaa

SEQ ID NO: 1609425 - DNA, 16 bp, Homo sapiens
tgaagatgctgtaaat

SEQ ID NO: 1609426 - DNA, 15 bp, Homo sapiens
tgaagatgggagcct

SEQ ID NO: 1609427 - DNA, 19 bp, Homo sapiens
tgaagattaggcacacaga

SEQ ID NO: 1609428 - DNA, 20 bp, Homo sapiens
tgaagattaggcacacagat

SEQ ID NO: 1609429 - DNA, 15 bp, Homo sapiens
tgaagattctcctgt

SEQ ID NO: 1609430 - DNA, 13 bp, Homo sapiens
tgaagatttcaga

SEQ ID NO: 1609431 - DNA, 14 bp, Homo sapiens
tgaagatttccatt

SEQ ID NO: 1609432 - DNA, 22 bp, Homo sapiens
tgaagcaaactctaaaattata

SEQ ID NO: 1609433 - DNA, 18 bp, Homo sapiens
tgaagcaaatcagaaact

SEQ ID NO: 1609434 - DNA, 18 bp, Homo sapiens
tgaagcaattagtctgaa

SEQ ID NO: 1609435 - DNA, 23 bp, Homo sapiens
tgaagcaattagtctgaaactgg

SEQ ID NO: 1609436 - DNA, 21 bp, Homo sapiens
tgaagcacagagggctaggga

SEQ ID NO: 1609437 - DNA, 22 bp, Homo sapiens
tgaagcacagcaccgggggaga

SEQ ID NO: 1609438 - DNA, 17 bp, Homo sapiens
tgaagcacttaagtctt

SEQ ID NO: 1609439 - DNA, 21 bp, Homo sapiens
tgaagcacttaagtcttcctt

SEQ ID NO: 1609440 - DNA, 22 bp, Homo sapiens
tgaatgctgttaatatttctaa

SEQ ID NO: 1609441 - DNA, 14 bp, Homo sapiens
tgaatgcttttagt

SEQ ID NO: 1609442 - DNA, 18 bp, Homo sapiens
tgaatggatcaatacaca

SEQ ID NO: 1609443 - DNA, 15 bp, Homo sapiens
tgaatggcctgcctt

SEQ ID NO: 1609444 - DNA, 17 bp, Homo sapiens
tgaatggcctgccttga

SEQ ID NO: 1609445 - DNA, 18 bp, Homo sapiens
tgaatggggtctcaaagt

SEQ ID NO: 1609446 - DNA, 20 bp, Homo sapiens
tgaatggtatggaactctct

SEQ ID NO: 1609447 - DNA, 21 bp, Homo sapiens
tgaatggtgttgtatgccttt

SEQ ID NO: 1609448 - DNA, 19 bp, Homo sapiens
tgaatggttccatgcctga

SEQ ID NO: 1609449 - DNA, 23 bp, Homo sapiens
tgaatggtttaacaaaagatttg

SEQ ID NO: 1609450 - DNA, 15 bp, Homo sapiens
tgaatgtaaatttgt

SEQ ID NO: 1609451 - DNA, 11 bp, Homo sapiens
tgaatgtattt

SEQ ID NO: 1609452 - DNA, 15 bp, Homo sapiens
tgaatgtatttattt

SEQ ID NO: 1609453 - DNA, 23 bp, Homo sapiens
tgaatgtatttatttgggagacc

SEQ ID NO: 1609454 - DNA, 22 bp, Homo sapiens
tgaatgtccccattctataaat

SEQ ID NO: 1609455 - DNA, 23 bp, Homo sapiens
tgaatgtcttttgaatattccca

SEQ ID NO: 1609456 - DNA, 22 bp, Homo sapiens
tgaatgttcccaagtaggcatt

SEQ ID NO: 1609457 - DNA, 19 bp, Homo sapiens
tgaatgtttacactctttg

SEQ ID NO: 1609458 - DNA, 15 bp, Homo sapiens
tgaattaaatttaat

SEQ ID NO: 1609459 - DNA, 14 bp, Homo sapiens
tgaattacagtgaa

SEQ ID NO: 1609460 - DNA, 15 bp, Homo sapiens
tgaattacagtgaaa

SEQ ID NO: 1609461 - DNA, 18 bp, Homo sapiens
tgaattacagtgaaattt

SEQ ID NO: 1609462 - DNA, 21 bp, Homo sapiens
tgaattaggctgtaactactt

SEQ ID NO: 1609463 - DNA, 18 bp, Homo sapiens
tgaattagtgagtatagt

SEQ ID NO: 1609464 - DNA, 13 bp, Homo sapiens
tgaattataacag

SEQ ID NO: 1609465 - DNA, 13 bp, Homo sapiens
tgaattatataat

SEQ ID NO: 1609466 - DNA, 17 bp, Homo sapiens
tgaattatcagcaaaga

SEQ ID NO: 1609467 - DNA, 19 bp, Homo sapiens
tgaattatcagcaaagaaa

SEQ ID NO: 1609468 - DNA, 20 bp, Homo sapiens
tgaattatcagcaaagaaaa

SEQ ID NO: 1609469 - DNA, 21 bp, Homo sapiens
tgaattatccacatgaaaata

SEQ ID NO: 1609470 - DNA, 21 bp, Homo sapiens
tgaattatcttggttgaaaat

SEQ ID NO: 1609471 - DNA, 17 bp, Homo sapiens
tgaattatgcttccaca

SEQ ID NO: 1609472 - DNA, 18 bp, Homo sapiens
tgaattattgacactgaa

SEQ ID NO: 1609473 - DNA, 17 bp, Homo sapiens
tgaattcaagaaaggaa

SEQ ID NO: 1609474 - DNA, 13 bp, Homo sapiens
tgaattcactcca

SEQ ID NO: 1609475 - DNA, 16 bp, Homo sapiens
tgaattcacttaagtt

SEQ ID NO: 1609476 - DNA, 16 bp, Homo sapiens
tgaattgaaaaacaat

SEQ ID NO: 1609477 - DNA, 12 bp, Homo sapiens
tgaattgaagtt

SEQ ID NO: 1609478 - DNA, 17 bp, Homo sapiens
tgaattgaagtttcaag

SEQ ID NO: 1609479 - DNA, 18 bp, Homo sapiens
tgaattgataaaagagtt

SEQ ID NO: 1609480 - DNA, 17 bp, Homo sapiens
tgaattggcaggataag

SEQ ID NO: 1609481 - DNA, 13 bp, Homo sapiens
tgaattggtgaat

SEQ ID NO: 1609482 - DNA, 20 bp, Homo sapiens
tgaattggtgaataaaacct

SEQ ID NO: 1609483 - DNA, 13 bp, Homo sapiens
tgaattgtacaga

SEQ ID NO: 1609484 - DNA, 12 bp, Homo sapiens
tgaattgtcttt

SEQ ID NO: 1609485 - DNA, 18 bp, Homo sapiens
tgaattgtcttttagaca

SEQ ID NO: 1609486 - DNA, 19 bp, Homo sapiens
tgaattgtcttttagacaa

SEQ ID NO: 1609487 - DNA, 17 bp, Homo sapiens
tgaattgtgaccaagtt

SEQ ID NO: 1609488 - DNA, 12 bp, Homo sapiens
tgaatttaaata

SEQ ID NO: 1609489 - DNA, 17 bp, Homo sapiens
tgaatttataaagtacc

SEQ ID NO: 1609490 - DNA, 18 bp, Homo sapiens
tgaatttatatttagtaa

SEQ ID NO: 1609491 - DNA, 14 bp, Homo sapiens
tgaatttatcttta

SEQ ID NO: 1609492 - DNA, 17 bp, Homo sapiens
tgaatttatctttacca

SEQ ID NO: 1609493 - DNA, 19 bp, Homo sapiens
tgaatttatctttaccaaa

SEQ ID NO: 1609494 - DNA, 13 bp, Homo sapiens
tgaatttctaaaa

SEQ ID NO: 1609495 - DNA, 13 bp, Homo sapiens
tgaatttctaaat

SEQ ID NO: 1609496 - DNA, 16 bp, Homo sapiens
tgaatttctggaagat

SEQ ID NO: 1609497 - DNA, 18 bp, Homo sapiens
tgaatttgaggagggaat

SEQ ID NO: 1609498 - DNA, 11 bp, Homo sapiens
tgaatttggag

SEQ ID NO: 1609499 - DNA, 14 bp, Homo sapiens
tgaatttggagact

SEQ ID NO: 1609500 - DNA, 16 bp, Homo sapiens
tgaatttgttcttaaa

SEQ ID NO: 1609501 - DNA, 14 bp, Homo sapiens
tgaattttaaagta

SEQ ID NO: 1609502 - DNA, 16 bp, Homo sapiens
tgaattttcaaggcct

SEQ ID NO: 1609503 - DNA, 19 bp, Homo sapiens
tgaattttcaaggccttca

SEQ ID NO: 1609504 - DNA, 20 bp, Homo sapiens
tgaattttcaaggccttcag

SEQ ID NO: 1609505 - DNA, 16 bp, Homo sapiens
tctttgagtaatgtga

SEQ ID NO: 1609506 - DNA, 13 bp, Homo sapiens
tctttgatccttc

SEQ ID NO: 1609507 - DNA, 15 bp, Homo sapiens
tctttgattgtgaaa

SEQ ID NO: 1609508 - DNA, 22 bp, Homo sapiens
tctttgcaaaaatccaaatatt

SEQ ID NO: 1609509 - DNA, 18 bp, Homo sapiens
tctttgcacatgtgacca

SEQ ID NO: 1609510 - DNA, 15 bp, Homo sapiens
tctttgcaccaaaga

SEQ ID NO: 1609511 - DNA, 18 bp, Homo sapiens
tctttgccaacatggtga

SEQ ID NO: 1609512 - DNA, 21 bp, Homo sapiens
tctttgccagtcattcagcag

SEQ ID NO: 1609513 - DNA, 12 bp, Homo sapiens
tctttgcctctg

SEQ ID NO: 1609514 - DNA, 17 bp, Homo sapiens
tctttgcctctgcagtc

SEQ ID NO: 1609515 - DNA, 14 bp, Homo sapiens
tctttgccttctct

SEQ ID NO: 1609516 - DNA, 21 bp, Homo sapiens
tctttgccttgggctgctcct

SEQ ID NO: 1609517 - DNA, 22 bp, Homo sapiens
tctttgctccagataactctct

SEQ ID NO: 1609518 - DNA, 12 bp, Homo sapiens
tctttgctgcag

SEQ ID NO: 1609519 - DNA, 13 bp, Homo sapiens
tctttgctgcaga

SEQ ID NO: 1609520 - DNA, 17 bp, Homo sapiens
tctttggaaatagcatg

SEQ ID NO: 1609521 - DNA, 17 bp, Homo sapiens
tctttggaacactgttt

SEQ ID NO: 1609522 - DNA, 22 bp, Homo sapiens
tctttggctcccctgtaccttt

SEQ ID NO: 1609523 - DNA, 13 bp, Homo sapiens
tctttggctgcag

SEQ ID NO: 1609524 - DNA, 20 bp, Homo sapiens
tctttgggccagacatgcca

SEQ ID NO: 1609525 - DNA, 17 bp, Homo sapiens
tctttgtaccaaaattt

SEQ ID NO: 1609526 - DNA, 18 bp, Homo sapiens
tctttgtaccttttgtag

SEQ ID NO: 1609527 - DNA, 19 bp, Homo sapiens
tctttgtataaataaatat

SEQ ID NO: 1609528 - DNA, 19 bp, Homo sapiens
tctttgtgcctttggcctg

SEQ ID NO: 1609529 - DNA, 16 bp, Homo sapiens
tctttgtgctttggct

SEQ ID NO: 1609530 - DNA, 19 bp, Homo sapiens
tctttgtgggtttttcatc

SEQ ID NO: 1609531 - DNA, 15 bp, Homo sapiens
tctttgttacaggca

SEQ ID NO: 1609532 - DNA, 21 bp, Homo sapiens
tctttgttatcaaacttcagc

SEQ ID NO: 1609533 - DNA, 16 bp, Homo sapiens
tctttgttcatagccc

SEQ ID NO: 1609534 - DNA, 14 bp, Homo sapiens
tctttgttctgttt

SEQ ID NO: 1609535 - DNA, 19 bp, Homo sapiens
tctttgtttaacaaaagat

SEQ ID NO: 1609536 - DNA, 16 bp, Homo sapiens
tctttgtttctttctt

SEQ ID NO: 1609537 - DNA, 18 bp, Homo sapiens
tctttgtttctttttaca

SEQ ID NO: 1609538 - DNA, 20 bp, Homo sapiens
tctttgttttattttaatag

SEQ ID NO: 1609539 - DNA, 18 bp, Homo sapiens
tcttttaaagaccctcct

SEQ ID NO: 1609540 - DNA, 18 bp, Homo sapiens
tcttttaaagtgttactt

SEQ ID NO: 1609541 - DNA, 12 bp, Homo sapiens
tcttttaaattg

SEQ ID NO: 1609542 - DNA, 21 bp, Homo sapiens
tcttttaatgaggaccaatgt

SEQ ID NO: 1609543 - DNA, 12 bp, Homo sapiens
tcttttaatgct

SEQ ID NO: 1609544 - DNA, 19 bp, Homo sapiens
tcttttaatgcttcattca

SEQ ID NO: 1609545 - DNA, 15 bp, Homo sapiens
tcttttagagagggg

SEQ ID NO: 1609546 - DNA, 13 bp, Homo sapiens
tcttttataattc

SEQ ID NO: 1609547 - DNA, 16 bp, Homo sapiens
tcttttattttggaac

SEQ ID NO: 1609548 - DNA, 16 bp, Homo sapiens
tcttttcagcttgttt

SEQ ID NO: 1609549 - DNA, 16 bp, Homo sapiens
tcttttcattgaacag

SEQ ID NO: 1609550 - DNA, 12 bp, Homo sapiens
tcttttccaagc

SEQ ID NO: 1609551 - DNA, 19 bp, Homo sapiens
tcttttcccactgtttaag

SEQ ID NO: 1609552 - DNA, 18 bp, Homo sapiens
tcttttcccctttcctgt

SEQ ID NO: 1609553 - DNA, 19 bp, Homo sapiens
tcttttcccctttcctgtc

SEQ ID NO: 1609554 - DNA, 13 bp, Homo sapiens
tcttttcctgctc

SEQ ID NO: 1609555 - DNA, 17 bp, Homo sapiens
tcttttctaccctagcc

SEQ ID NO: 1609556 - DNA, 13 bp, Homo sapiens
tcttttctattta

SEQ ID NO: 1609557 - DNA, 17 bp, Homo sapiens
tcttttctcctttacca

SEQ ID NO: 1609558 - DNA, 17 bp, Homo sapiens
tcttttctctgtgcttc

SEQ ID NO: 1609559 - DNA, 17 bp, Homo sapiens
tcttttcttcaacttga

SEQ ID NO: 1609560 - DNA, 16 bp, Homo sapiens
tcttttctttctgtct

SEQ ID NO: 1609561 - DNA, 12 bp, Homo sapiens
tcttttgaagca

SEQ ID NO: 1609562 - DNA, 20 bp, Homo sapiens
tcttttgaatccatgcttgg

SEQ ID NO: 1609563 - DNA, 12 bp, Homo sapiens
tcttttgattct

SEQ ID NO: 1609564 - DNA, 19 bp, Homo sapiens
tcttttgcacaaggaaata

SEQ ID NO: 1609565 - DNA, 18 bp, Homo sapiens
tcttttgcttttggcaaa

SEQ ID NO: 1609566 - DNA, 14 bp, Homo sapiens
tcttttgtgatgaa

SEQ ID NO: 1609567 - DNA, 23 bp, Homo sapiens
tcttttgttctctgaattttcag

SEQ ID NO: 1609568 - DNA, 12 bp, Homo sapiens
tcttttgtttgg

SEQ ID NO: 1609569 - DNA, 16 bp, Homo sapiens
tctttttaatcttaag

SEQ ID NO: 1609570 - DNA, 13 bp, Homo sapiens
tctttttaattat

SEQ ID NO: 1609571 - DNA, 15 bp, Homo sapiens
tctttttacagcatt

SEQ ID NO: 1609572 - DNA, 19 bp, Homo sapiens
tctttttacagcattgtct

SEQ ID NO: 1609573 - DNA, 15 bp, Homo sapiens
tctttttactgttga

SEQ ID NO: 1609574 - DNA, 14 bp, Homo sapiens
tctttttatgcatt

SEQ ID NO: 1609575 - DNA, 15 bp, Homo sapiens
tctttttctttttaa

SEQ ID NO: 1609576 - DNA, 21 bp, Homo sapiens
tctttttgccagttttccctg

SEQ ID NO: 1609577 - DNA, 22 bp, Homo sapiens
tctttttgccagttttccctgg

SEQ ID NO: 1609578 - DNA, 13 bp, Homo sapiens
tctttttgtactt

SEQ ID NO: 1609579 - DNA, 12 bp, Homo sapiens
tctttttgtttg

SEQ ID NO: 1609580 - DNA, 15 bp, Homo sapiens
tcttttttaaaaaca

SEQ ID NO: 1609581 - DNA, 15 bp, Homo sapiens
tcttttttagcataa

SEQ ID NO: 1609582 - DNA, 16 bp, Homo sapiens
tcttttttagcataaa

SEQ ID NO: 1609583 - DNA, 13 bp, Homo sapiens
tcttttttatgtt

SEQ ID NO: 1609584 - DNA, 17 bp, Homo sapiens
tcttttttcaaaagaaa

SEQ ID NO: 1609585 - DNA, 14 bp, Homo sapiens
tcttttttcacaaa

SEQ ID NO: 1609586 - DNA, 23 bp, Homo sapiens
tcttttttcatggacactttgaa

SEQ ID NO: 1609587 - DNA, 15 bp, Homo sapiens
tcttttttctcttcc

SEQ ID NO: 1609588 - DNA, 16 bp, Homo sapiens
tctttttttcttttct

SEQ ID NO: 1609589 - DNA, 17 bp, Homo sapiens
tctttttttgagtgaca

SEQ ID NO: 1609590 - DNA, 17 bp, Homo sapiens
tctttttttggcccagg

SEQ ID NO: 1609591 - DNA, 17 bp, Homo sapiens
tcttttttttcctttga

SEQ ID NO: 1609592 - DNA, 20 bp, Homo sapiens
tctttttttttaagttctta

SEQ ID NO: 1609593 - DNA, 21 bp, Homo sapiens
tgaaaaaaaaaaagaagaaga

SEQ ID NO: 1609594 - DNA, 15 bp, Homo sapiens
tgaaaaaaattgaaa

SEQ ID NO: 1609595 - DNA, 21 bp, Homo sapiens
tgaaaaaaattttagaacagt

SEQ ID NO: 1609596 - DNA, 13 bp, Homo sapiens
tgaaaaaatatat

SEQ ID NO: 1609597 - DNA, 20 bp, Homo sapiens
tgaaaaacaattttctgtaa

SEQ ID NO: 1609598 - DNA, 18 bp, Homo sapiens
tgaaaaacattccaggaa

SEQ ID NO: 1609599 - DNA, 23 bp, Homo sapiens
tgaaaaactgatcaaaaataaac

SEQ ID NO: 1609600 - DNA, 16 bp, Homo sapiens
tgaaaaagtaaagtgt

SEQ ID NO: 1609601 - DNA, 22 bp, Homo sapiens
tgaaaaagtatcctgcttctga

SEQ ID NO: 1609602 - DNA, 17 bp, Homo sapiens
tgaaaaatataaaatta

SEQ ID NO: 1609603 - DNA, 12 bp, Homo sapiens
tgaaaaattaac

SEQ ID NO: 1609604 - DNA, 17 bp, Homo sapiens
tgaaaaattaacttttt

SEQ ID NO: 1609605 - DNA, 22 bp, Homo sapiens
tgaaaacaagaaagaaatggct

SEQ ID NO: 1609606 - DNA, 18 bp, Homo sapiens
tgaaaacagatattacag

SEQ ID NO: 1609607 - DNA, 15 bp, Homo sapiens
tgaaaacagtgtctt

SEQ ID NO: 1609608 - DNA, 15 bp, Homo sapiens
tgaaaaccacagtca

SEQ ID NO: 1609609 - DNA, 13 bp, Homo sapiens
tgaaaacccagac

SEQ ID NO: 1609610 - DNA, 16 bp, Homo sapiens
tgaaaacccagactgt

SEQ ID NO: 1609611 - DNA, 23 bp, Homo sapiens
tgaaaacccagagaggaatcaga

SEQ ID NO: 1609612 - DNA, 14 bp, Homo sapiens
tgaaaactagcatt

SEQ ID NO: 1609613 - DNA, 22 bp, Homo sapiens
tgaaaactagcattacattatt

SEQ ID NO: 1609614 - DNA, 13 bp, Homo sapiens
tgaaaagaaagaa

SEQ ID NO: 1609615 - DNA, 18 bp, Homo sapiens
tgaaaagaagaaagtcta

SEQ ID NO: 1609616 - DNA, 21 bp, Homo sapiens
tgaaaagaagaaagtctatgc

SEQ ID NO: 1609617 - DNA, 18 bp, Homo sapiens
tgaaaagaccaagacttt

SEQ ID NO: 1609618 - DNA, 15 bp, Homo sapiens
tgaaaagactccaaa

SEQ ID NO: 1609619 - DNA, 14 bp, Homo sapiens
tgaaaagaggaaca

SEQ ID NO: 1609620 - DNA, 13 bp, Homo sapiens
tgaaaagccaaag

SEQ ID NO: 1609621 - DNA, 19 bp, Homo sapiens
tgaaaagggcactcccaac

SEQ ID NO: 1609622 - DNA, 19 bp, Homo sapiens
tgaaaagggcggaagagtt

SEQ ID NO: 1609623 - DNA, 20 bp, Homo sapiens
tgaaagaaacagttaacttt

SEQ ID NO: 1609624 - DNA, 11 bp, Homo sapiens
tgaaagaagca

SEQ ID NO: 1609625 - DNA, 16 bp, Homo sapiens
tgaaagaagcaagaca

SEQ ID NO: 1609626 - DNA, 23 bp, Homo sapiens
tgaaagaagcaagacacgtggcc

SEQ ID NO: 1609627 - DNA, 20 bp, Homo sapiens
tgaaagaatagaacacagtt

SEQ ID NO: 1609628 - DNA, 16 bp, Homo sapiens
tgaaagaattattttt

SEQ ID NO: 1609629 - DNA, 11 bp, Homo sapiens
tgaaagacatc

SEQ ID NO: 1609630 - DNA, 13 bp, Homo sapiens
tgaaagacatcaa

SEQ ID NO: 1609631 - DNA, 18 bp, Homo sapiens
tgaaagacatcaatgaaa

SEQ ID NO: 1609632 - DNA, 16 bp, Homo sapiens
tgaaagactgtacaaa

SEQ ID NO: 1609633 - DNA, 19 bp, Homo sapiens
tgaaagactgtacaaagta

SEQ ID NO: 1609634 - DNA, 19 bp, Homo sapiens
tgaaagaggctgaggcctg

SEQ ID NO: 1609635 - DNA, 21 bp, Homo sapiens
tgaaagaggctgaggcctgga

SEQ ID NO: 1609636 - DNA, 23 bp, Homo sapiens
tgaaagattatgatgcatacagt

SEQ ID NO: 1609637 - DNA, 19 bp, Homo sapiens
tgaaagcacatgaataatt

SEQ ID NO: 1609638 - DNA, 21 bp, Homo sapiens
tgaaagcacatgaataatttc

SEQ ID NO: 1609639 - DNA, 16 bp, Homo sapiens
tgaaagcagcagctag

SEQ ID NO: 1609640 - DNA, 23 bp, Homo sapiens
tgaaagccaacaactctgccttt

SEQ ID NO: 1609641 - DNA, 18 bp, Homo sapiens
tgaaagcttcaaagttta

SEQ ID NO: 1609642 - DNA, 14 bp, Homo sapiens
tgaaaggaaaaatg

SEQ ID NO: 1609643 - DNA, 15 bp, Homo sapiens
tgaaaggaacatttt

SEQ ID NO: 1609644 - DNA, 15 bp, Homo sapiens
tgaaaggaccctgtg

SEQ ID NO: 1609645 - DNA, 18 bp, Homo sapiens
tgaaaggatgtggaagag

SEQ ID NO: 1609646 - DNA, 20 bp, Homo sapiens
tgaaaggcagtagtcatttt

SEQ ID NO: 1609647 - DNA, 12 bp, Homo sapiens
tgaaagggaaac

SEQ ID NO: 1609648 - DNA, 20 bp, Homo sapiens
tgaaagggaaactgggaaac

SEQ ID NO: 1609649 - DNA, 14 bp, Homo sapiens
tgaaagggagcccc

SEQ ID NO: 1609650 - DNA, 16 bp, Homo sapiens
tgaaagggctatggca

SEQ ID NO: 1609651 - DNA, 21 bp, Homo sapiens
tgaaaggggacacctgtacat

SEQ ID NO: 1609652 - DNA, 23 bp, Homo sapiens
tgaaagtacatttggagacacaa

SEQ ID NO: 1609653 - DNA, 18 bp, Homo sapiens
tgaaagtcagatgcccag

SEQ ID NO: 1609654 - DNA, 17 bp, Homo sapiens
tgaaagtgacagagacc

SEQ ID NO: 1609655 - DNA, 19 bp, Homo sapiens
tgaaagttcatatctggag

SEQ ID NO: 1609656 - DNA, 13 bp, Homo sapiens
tgaaagttttgta

SEQ ID NO: 1609657 - DNA, 16 bp, Homo sapiens
tgaaagttttgtaaaa

SEQ ID NO: 1609658 - DNA, 23 bp, Homo sapiens
tgaaataaaaaaaaaaggatgaa

SEQ ID NO: 1609659 - DNA, 17 bp, Homo sapiens
tgaaataaaaaaagatt

SEQ ID NO: 1609660 - DNA, 21 bp, Homo sapiens
tgaaataaagacccaggggga

SEQ ID NO: 1609661 - DNA, 17 bp, Homo sapiens
tgaaataaattctgact

SEQ ID NO: 1609662 - DNA, 20 bp, Homo sapiens
tgaaataactggaacaaatt

SEQ ID NO: 1609663 - DNA, 15 bp, Homo sapiens
tgaaataagaattca

SEQ ID NO: 1609664 - DNA, 21 bp, Homo sapiens
tgaaataatatatttcttctt

SEQ ID NO: 1609665 - DNA, 17 bp, Homo sapiens
tgaaataatgttctgtc

SEQ ID NO: 1609666 - DNA, 14 bp, Homo sapiens
tgaaataccagtgt

SEQ ID NO: 1609667 - DNA, 24 bp, Homo sapiens
tgaaatacctattaattcttaata

SEQ ID NO: 1609668 - DNA, 23 bp, Homo sapiens
tgaaataccttttctcacaaaaa

SEQ ID NO: 1609669 - DNA, 15 bp, Homo sapiens
tgaaataggaaacaa

SEQ ID NO: 1609670 - DNA, 21 bp, Homo sapiens
tctggctgtctagaatgtgga

SEQ ID NO: 1609671 - DNA, 16 bp, Homo sapiens
tctggcttagtgccac

SEQ ID NO: 1609672 - DNA, 16 bp, Homo sapiens
tctggcttccctggaa

SEQ ID NO: 1609673 - DNA, 15 bp, Homo sapiens
tctggcttctctctt

SEQ ID NO: 1609674 - DNA, 16 bp, Homo sapiens
tctggcttctctcttt

SEQ ID NO: 1609675 - DNA, 18 bp, Homo sapiens
tctggcttctctcttttc

SEQ ID NO: 1609676 - DNA, 21 bp, Homo sapiens
tctggcttctctcttttcctc

SEQ ID NO: 1609677 - DNA, 14 bp, Homo sapiens
tctggctttaagcc

SEQ ID NO: 1609678 - DNA, 12 bp, Homo sapiens
tctggctttgct

SEQ ID NO: 1609679 - DNA, 23 bp, Homo sapiens
tctggctttgggcaggtctgaga

SEQ ID NO: 1609680 - DNA, 24 bp, Homo sapiens
tctggctttttctgccactgagga

SEQ ID NO: 1609681 - DNA, 19 bp, Homo sapiens
tctgggaagggagagggcc

SEQ ID NO: 1609682 - DNA, 18 bp, Homo sapiens
tctgggaatgggagaggg

SEQ ID NO: 1609683 - DNA, 14 bp, Homo sapiens
tctgggaattgtgt

SEQ ID NO: 1609684 - DNA, 17 bp, Homo sapiens
tctgggaattgtgtgtc

SEQ ID NO: 1609685 - DNA, 19 bp, Homo sapiens
tctgggaccctttccttcc

SEQ ID NO: 1609686 - DNA, 22 bp, Homo sapiens
tctgggacgtggacatgcctca

SEQ ID NO: 1609687 - DNA, 22 bp, Homo sapiens
tctgggactctcctcctcccct

SEQ ID NO: 1609688 - DNA, 20 bp, Homo sapiens
tctgggagaaaatcatcaag

SEQ ID NO: 1609689 - DNA, 13 bp, Homo sapiens
tctgggaggcaga

SEQ ID NO: 1609690 - DNA, 20 bp, Homo sapiens
tctgggaggcagaacaggct

SEQ ID NO: 1609691 - DNA, 16 bp, Homo sapiens
tctgggagtccccttt

SEQ ID NO: 1609692 - DNA, 23 bp, Homo sapiens
tctgggatatggctgcccaggag

SEQ ID NO: 1609693 - DNA, 20 bp, Homo sapiens
tctgggatctgttttctgga

SEQ ID NO: 1609694 - DNA, 22 bp, Homo sapiens
tctgggatctgttttctggaag

SEQ ID NO: 1609695 - DNA, 21 bp, Homo sapiens
tctgggcaccacctctgtggg

SEQ ID NO: 1609696 - DNA, 12 bp, Homo sapiens
tctgggccaagt

SEQ ID NO: 1609697 - DNA, 14 bp, Homo sapiens
tctgggcctctgaa

SEQ ID NO: 1609698 - DNA, 22 bp, Homo sapiens
tctgggcctgagggtccacctg

SEQ ID NO: 1609699 - DNA, 21 bp, Homo sapiens
tctgggcctgggttccaggga

SEQ ID NO: 1609700 - DNA, 15 bp, Homo sapiens
tctgggcctgttctc

SEQ ID NO: 1609701 - DNA, 17 bp, Homo sapiens
tctgggcgtctgagctg

SEQ ID NO: 1609702 - DNA, 13 bp, Homo sapiens
tctgggctcaggg

SEQ ID NO: 1609703 - DNA, 14 bp, Homo sapiens
tctgggctcagggc

SEQ ID NO: 1609704 - DNA, 18 bp, Homo sapiens
tctgggctcagggctgga

SEQ ID NO: 1609705 - DNA, 20 bp, Homo sapiens
tctgggctcagggctggagt

SEQ ID NO: 1609706 - DNA, 22 bp, Homo sapiens
tctgggctgtaacgtggcactg

SEQ ID NO: 1609707 - DNA, 15 bp, Homo sapiens
tctgggctgtggggc

SEQ ID NO: 1609708 - DNA, 21 bp, Homo sapiens
tctgggcttatatctggcctc

SEQ ID NO: 1609709 - DNA, 19 bp, Homo sapiens
tctgggcttggggcttcct

SEQ ID NO: 1609710 - DNA, 21 bp, Homo sapiens
tctgggcttggggcttcctaa

SEQ ID NO: 1609711 - DNA, 21 bp, Homo sapiens
tctggggagagcggctggaga

SEQ ID NO: 1609712 - DNA, 17 bp, Homo sapiens
tctggggcaggctgggc

SEQ ID NO: 1609713 - DNA, 22 bp, Homo sapiens
tctgggggtcctctctgagtca

SEQ ID NO: 1609714 - DNA, 24 bp, Homo sapiens
tctgggggtcctctctgagtcaaa

SEQ ID NO: 1609715 - DNA, 22 bp, Homo sapiens
tctggggtctttttatgcattt

SEQ ID NO: 1609716 - DNA, 17 bp, Homo sapiens
tctggggtgagggagtt

SEQ ID NO: 1609717 - DNA, 18 bp, Homo sapiens
tctggggttcagcccctc

SEQ ID NO: 1609718 - DNA, 19 bp, Homo sapiens
tctggggttcagcccctcc

SEQ ID NO: 1609719 - DNA, 21 bp, Homo sapiens
tctggggttcagcccctcctc

SEQ ID NO: 1609720 - DNA, 12 bp, Homo sapiens
tctgggtgccct

SEQ ID NO: 1609721 - DNA, 20 bp, Homo sapiens
tctgggtggtaactgccagc

SEQ ID NO: 1609722 - DNA, 22 bp, Homo sapiens
tctgggtggtaactgccagcct

SEQ ID NO: 1609723 - DNA, 13 bp, Homo sapiens
tctgggtgtgtcc

SEQ ID NO: 1609724 - DNA, 13 bp, Homo sapiens
tctgggtttctaa

SEQ ID NO: 1609725 - DNA, 22 bp, Homo sapiens
tctggtacgaatctcatccctc

SEQ ID NO: 1609726 - DNA, 20 bp, Homo sapiens
tctggtagatttttaacgaa

SEQ ID NO: 1609727 - DNA, 20 bp, Homo sapiens
tctggtcaagggctgtcatt

SEQ ID NO: 1609728 - DNA, 17 bp, Homo sapiens
tctggtctactctagaa

SEQ ID NO: 1609729 - DNA, 18 bp, Homo sapiens
tctggtctactctagaag

SEQ ID NO: 1609730 - DNA, 14 bp, Homo sapiens
tctggtctcgaact

SEQ ID NO: 1609731 - DNA, 18 bp, Homo sapiens
tctggtgacaccagcctt

SEQ ID NO: 1609732 - DNA, 14 bp, Homo sapiens
tctggtggccccgt

SEQ ID NO: 1609733 - DNA, 12 bp, Homo sapiens
tctggtggctcc

SEQ ID NO: 1609734 - DNA, 16 bp, Homo sapiens
tctggtggctcctcct

SEQ ID NO: 1609735 - DNA, 17 bp, Homo sapiens
tctggtggctcctccta

SEQ ID NO: 1609736 - DNA, 20 bp, Homo sapiens
tctggtggctcctcctagga

SEQ ID NO: 1609737 - DNA, 13 bp, Homo sapiens
tctggtgttctat

SEQ ID NO: 1609738 - DNA, 14 bp, Homo sapiens
tctggttcatgcag

SEQ ID NO: 1609739 - DNA, 12 bp, Homo sapiens
tctggttccagg

SEQ ID NO: 1609740 - DNA, 23 bp, Homo sapiens
tctggttccagggtccctctgtg

SEQ ID NO: 1609741 - DNA, 13 bp, Homo sapiens
tctggttgaagct

SEQ ID NO: 1609742 - DNA, 21 bp, Homo sapiens
tctggttgaagctttgcttat

SEQ ID NO: 1609743 - DNA, 20 bp, Homo sapiens
tctggttgtatttctatatt

SEQ ID NO: 1609744 - DNA, 19 bp, Homo sapiens
tctggttgtttttgttctt

SEQ ID NO: 1609745 - DNA, 13 bp, Homo sapiens
tctggtttctaag

SEQ ID NO: 1609746 - DNA, 13 bp, Homo sapiens
tctggtttggcat

SEQ ID NO: 1609747 - DNA, 18 bp, Homo sapiens
tctgtaaaaaatggagct

SEQ ID NO: 1609748 - DNA, 16 bp, Homo sapiens
tctgtaaactgtgtat

SEQ ID NO: 1609749 - DNA, 19 bp, Homo sapiens
tctgtaaactgtgtattcc

SEQ ID NO: 1609750 - DNA, 12 bp, Homo sapiens
tctgtaaataac

SEQ ID NO: 1609751 - DNA, 15 bp, Homo sapiens
tctgtaaatttaact

SEQ ID NO: 1609752 - DNA, 19 bp, Homo sapiens
tctgtaaatttaactgcat

SEQ ID NO: 1609753 - DNA, 22 bp, Homo sapiens
tctgtaactctaaaagatcctt

SEQ ID NO: 1609754 - DNA, 13 bp, Homo sapiens
tctgtaactcttt

SEQ ID NO: 1609755 - DNA, 19 bp, Homo sapiens
tctgtaagagaaaatatta

SEQ ID NO: 1609756 - DNA, 16 bp, Homo sapiens
tctgtaagagcttgct

SEQ ID NO: 1609757 - DNA, 22 bp, Homo sapiens
tctgtaagagcttgctccagat

SEQ ID NO: 1609758 - DNA, 17 bp, Homo sapiens
tctgtaagtgtagctca

SEQ ID NO: 1609759 - DNA, 17 bp, Homo sapiens
tctgtaatagttcagta

SEQ ID NO: 1609760 - DNA, 16 bp, Homo sapiens
tctgtaatcagcaata

SEQ ID NO: 1609761 - DNA, 17 bp, Homo sapiens
tctgtaatgtaaataaa

SEQ ID NO: 1609762 - DNA, 22 bp, Homo sapiens
tctgtaatgtaaataaactatt

SEQ ID NO: 1609763 - DNA, 13 bp, Homo sapiens
tctgtaattgtgt

SEQ ID NO: 1609764 - DNA, 13 bp, Homo sapiens
tctgtacacgtgt

SEQ ID NO: 1609765 - DNA, 17 bp, Homo sapiens
tctgtacacgtgtcctg

SEQ ID NO: 1609766 - DNA, 14 bp, Homo sapiens
tctgtcacgtgaaa

SEQ ID NO: 1609767 - DNA, 18 bp, Homo sapiens
tctgtcagatgggaagac

SEQ ID NO: 1609768 - DNA, 17 bp, Homo sapiens
tctgtcagcatctggct

SEQ ID NO: 1609769 - DNA, 14 bp, Homo sapiens
tctgtcagctgcaa

SEQ ID NO: 1609770 - DNA, 12 bp, Homo sapiens
tctgtcagttct

SEQ ID NO: 1609771 - DNA, 21 bp, Homo sapiens
tctgtccacatccccagagcc

SEQ ID NO: 1609772 - DNA, 22 bp, Homo sapiens
tctgtccacatccccagagccc

SEQ ID NO: 1609773 - DNA, 23 bp, Homo sapiens
tctgtccacatccccagagccca

SEQ ID NO: 1609774 - DNA, 21 bp, Homo sapiens
tctgtccagctcccgctgtgg

SEQ ID NO: 1609775 - DNA, 14 bp, Homo sapiens
tctgtccaggccac

SEQ ID NO: 1609776 - DNA, 18 bp, Homo sapiens
tctgtccaggccactgtg

SEQ ID NO: 1609777 - DNA, 13 bp, Homo sapiens
tctgtccagggcc

SEQ ID NO: 1609778 - DNA, 17 bp, Homo sapiens
tctgtccagggccctga

SEQ ID NO: 1609779 - DNA, 19 bp, Homo sapiens
tctgtccagggccctgagc

SEQ ID NO: 1609780 - DNA, 17 bp, Homo sapiens
tctgtcccttgctgtat

SEQ ID NO: 1609781 - DNA, 17 bp, Homo sapiens
tctgtcccttttctttg

SEQ ID NO: 1609782 - DNA, 13 bp, Homo sapiens
tctgtcctacttc

SEQ ID NO: 1609783 - DNA, 23 bp, Homo sapiens
tctgtcctcagccttgccagaga

SEQ ID NO: 1609784 - DNA, 21 bp, Homo sapiens
tctgtcctgggcatgggtcca

SEQ ID NO: 1609785 - DNA, 19 bp, Homo sapiens
tctgtccttttggcactga

SEQ ID NO: 1609786 - DNA, 15 bp, Homo sapiens
tctgtctactgtggt

SEQ ID NO: 1609787 - DNA, 17 bp, Homo sapiens
tctgtctcccttctctc

SEQ ID NO: 1609788 - DNA, 12 bp, Homo sapiens
tctgtctcgatg

SEQ ID NO: 1609789 - DNA, 16 bp, Homo sapiens
tctgtctcgatgcctg

SEQ ID NO: 1609790 - DNA, 18 bp, Homo sapiens
tctgtctcgatgcctgat

SEQ ID NO: 1609791 - DNA, 18 bp, Homo sapiens
tctgtctgccaacctaaa

SEQ ID NO: 1609792 - DNA, 21 bp, Homo sapiens
tctgtctgccaacctaaaact

SEQ ID NO: 1609793 - DNA, 13 bp, Homo sapiens
tctgtctggtggc

SEQ ID NO: 1609794 - DNA, 16 bp, Homo sapiens
tctgtctggtggcccc

SEQ ID NO: 1609795 - DNA, 17 bp, Homo sapiens
tctgtctggtggccccg

SEQ ID NO: 1609796 - DNA, 22 bp, Homo sapiens
tctgtcttaaatgagaagtact

SEQ ID NO: 1609797 - DNA, 19 bp, Homo sapiens
tctgtcttgttaatgcttt

SEQ ID NO: 1609798 - DNA, 16 bp, Homo sapiens
tctgtgaaagtacatt

SEQ ID NO: 1609799 - DNA, 17 bp, Homo sapiens
tctgtgaaatgctggca

SEQ ID NO: 1609800 - DNA, 19 bp, Homo sapiens
tctgtgaaattctcagagt

SEQ ID NO: 1609801 - DNA, 21 bp, Homo sapiens
tctgtgaaattctcagagtgt

SEQ ID NO: 1609802 - DNA, 21 bp, Homo sapiens
tctgtgaacgatttagaaaga

SEQ ID NO: 1609803 - DNA, 13 bp, Homo sapiens
tctgtgaattaaa

SEQ ID NO: 1609804 - DNA, 15 bp, Homo sapiens
tctgtgacccatctg

SEQ ID NO: 1609805 - DNA, 14 bp, Homo sapiens
tctgtgactataaa

SEQ ID NO: 1609806 - DNA, 20 bp, Homo sapiens
tctgtgactataaagctgtt

SEQ ID NO: 1609807 - DNA, 11 bp, Homo sapiens
tctgtgactgg

SEQ ID NO: 1609808 - DNA, 12 bp, Homo sapiens
tctgtgactgga

SEQ ID NO: 1609809 - DNA, 14 bp, Homo sapiens
tctgtgacttatct

SEQ ID NO: 1609810 - DNA, 20 bp, Homo sapiens
tctgtgagaaggtttattgt

SEQ ID NO: 1609811 - DNA, 21 bp, Homo sapiens
tctgtgagggtgctgactggc

SEQ ID NO: 1609812 - DNA, 16 bp, Homo sapiens
tctgtgaggtgctgat

SEQ ID NO: 1609813 - DNA, 15 bp, Homo sapiens
tctgtgatcttttaa

SEQ ID NO: 1609814 - DNA, 14 bp, Homo sapiens
tctgtgatgagctg

SEQ ID NO: 1609815 - DNA, 17 bp, Homo sapiens
tctgtgatgagctgatc

SEQ ID NO: 1609816 - DNA, 17 bp, Homo sapiens
tctgtgcactagcctgt

SEQ ID NO: 1609817 - DNA, 19 bp, Homo sapiens
tctgtgcactagcctgtga

SEQ ID NO: 1609818 - DNA, 13 bp, Homo sapiens
tctgtgcaggtgc

SEQ ID NO: 1609819 - DNA, 18 bp, Homo sapiens
tctgtgcaggtgctgcct

SEQ ID NO: 1609820 - DNA, 21 bp, Homo sapiens
tctgtgccagacattgctctc

SEQ ID NO: 1609821 - DNA, 14 bp, Homo sapiens
tctgtgcctccccc

SEQ ID NO: 1609822 - DNA, 17 bp, Homo sapiens
tctgtgcctccccccag

SEQ ID NO: 1609823 - DNA, 18 bp, Homo sapiens
tctgtgcctccccccaga

SEQ ID NO: 1609824 - DNA, 19 bp, Homo sapiens
tctgtgcctccccccagac

SEQ ID NO: 1609825 - DNA, 21 bp, Homo sapiens
tctgtgcctccccccagaccc

SEQ ID NO: 1609826 - DNA, 15 bp, Homo sapiens
tctgtgcctgaatat

SEQ ID NO: 1609827 - DNA, 22 bp, Homo sapiens
tctgtgcctgcactgagagggc

SEQ ID NO: 1609828 - DNA, 15 bp, Homo sapiens
tctgtgccttggtct

SEQ ID NO: 1609829 - DNA, 22 bp, Homo sapiens
tctgtgctcttttggtggggag

SEQ ID NO: 1609830 - DNA, 15 bp, Homo sapiens
tctgtgctgtgcctg

SEQ ID NO: 1609831 - DNA, 19 bp, Homo sapiens
tctgtgctgtgcctgctag

SEQ ID NO: 1609832 - DNA, 12 bp, Homo sapiens
tctgtgctgtgt

SEQ ID NO: 1609833 - DNA, 19 bp, Homo sapiens
tctgtggatgccagggccg

SEQ ID NO: 1609834 - DNA, 14 bp, Homo sapiens
tctgtggattctat

SEQ ID NO: 1609835 - DNA, 20 bp, Homo sapiens
tctgtggattctatatttca

SEQ ID NO: 1609836 - DNA, 22 bp, Homo sapiens
tctgtggattctatatttcata

SEQ ID NO: 1609837 - DNA, 15 bp, Homo sapiens
tctgtgggtctctgg

SEQ ID NO: 1609838 - DNA, 16 bp, Homo sapiens
tctgtgggtctctgga

SEQ ID NO: 1609839 - DNA, 18 bp, Homo sapiens
tctgtggttcctctgctc

SEQ ID NO: 1609840 - DNA, 19 bp, Homo sapiens
tctgtggttttcccctccc

SEQ ID NO: 1609841 - DNA, 23 bp, Homo sapiens
tctgtggttttcccctccctggg

SEQ ID NO: 1609842 - DNA, 17 bp, Homo sapiens
tctgtggttttttttga

SEQ ID NO: 1609843 - DNA, 18 bp, Homo sapiens
tctgtgtaatctctgatt

SEQ ID NO: 1609844 - DNA, 19 bp, Homo sapiens
tctgtgtaccacttcctga

SEQ ID NO: 1609845 - DNA, 13 bp, Homo sapiens
tctgtgtatgtat

SEQ ID NO: 1609846 - DNA, 21 bp, Homo sapiens
tctgtgtcagagcccagccca

SEQ ID NO: 1609847 - DNA, 14 bp, Homo sapiens
tctgtgtcatttct

SEQ ID NO: 1609848 - DNA, 15 bp, Homo sapiens
tctgtgtcatttctt

SEQ ID NO: 1609849 - DNA, 14 bp, Homo sapiens
tctgtgtcccagcc

SEQ ID NO: 1609850 - DNA, 15 bp, Homo sapiens
tctgtgtcccagcca

SEQ ID NO: 1609851 - DNA, 17 bp, Homo sapiens
tctgtgtctaagattct

SEQ ID NO: 1609852 - DNA, 11 bp, Homo sapiens
tctgtgtcttt

SEQ ID NO: 1609853 - DNA, 14 bp, Homo sapiens
tctgtgtgcacaaa

SEQ ID NO: 1609854 - DNA, 14 bp, Homo sapiens
tctgtgtggctcct

SEQ ID NO: 1609855 - DNA, 21 bp, Homo sapiens
tctgtgtgtgagctaccgtgg

SEQ ID NO: 1609856 - DNA, 11 bp, Homo sapiens
tctgtgtgtgt

SEQ ID NO: 1609857 - DNA, 13 bp, Homo sapiens
tctgtgtgtgtgt

SEQ ID NO: 1609858 - DNA, 15 bp, Homo sapiens
tctgtgtgtgtgtat

SEQ ID NO: 1609859 - DNA, 16 bp, Homo sapiens
tcttcagagtgaagaa

SEQ ID NO: 1609860 - DNA, 20 bp, Homo sapiens
tcttcagagtgaagaatctt

SEQ ID NO: 1609861 - DNA, 17 bp, Homo sapiens
tcttcagcccaggcttt

SEQ ID NO: 1609862 - DNA, 11 bp, Homo sapiens
tcttcagccta

SEQ ID NO: 1609863 - DNA, 20 bp, Homo sapiens
tcttcaggaggccctggtgt

SEQ ID NO: 1609864 - DNA, 13 bp, Homo sapiens
tcttcaggcctcc

SEQ ID NO: 1609865 - DNA, 14 bp, Homo sapiens
tcttcaggcctccc

SEQ ID NO: 1609866 - DNA, 18 bp, Homo sapiens
tcttcaggcctccctctc

SEQ ID NO: 1609867 - DNA, 14 bp, Homo sapiens
tcttcaggttctta

SEQ ID NO: 1609868 - DNA, 17 bp, Homo sapiens
tcttcagtgactcctgc

SEQ ID NO: 1609869 - DNA, 18 bp, Homo sapiens
tcttcagtgactcctgct

SEQ ID NO: 1609870 - DNA, 20 bp, Homo sapiens
tcttcagtgactcctgctgg

SEQ ID NO: 1609871 - DNA, 21 bp, Homo sapiens
tcttcagtgactcctgctggt

SEQ ID NO: 1609872 - DNA, 22 bp, Homo sapiens
tcttcagtgtaatgtgacttca

SEQ ID NO: 1609873 - DNA, 18 bp, Homo sapiens
tcttcagttttatcttta

SEQ ID NO: 1609874 - DNA, 20 bp, Homo sapiens
tcttcataacaattttagga

SEQ ID NO: 1609875 - DNA, 21 bp, Homo sapiens
tcttcatattctaaaaccatt

SEQ ID NO: 1609876 - DNA, 19 bp, Homo sapiens
tcttcatgcgtgccctttt

SEQ ID NO: 1609877 - DNA, 23 bp, Homo sapiens
tcttcatggcatcttcaatatga

SEQ ID NO: 1609878 - DNA, 22 bp, Homo sapiens
tcttcattacctcagtgagaag

SEQ ID NO: 1609879 - DNA, 17 bp, Homo sapiens
tcttcattattctctgc

SEQ ID NO: 1609880 - DNA, 17 bp, Homo sapiens
tcttcattccattgact

SEQ ID NO: 1609881 - DNA, 16 bp, Homo sapiens
tcttcattctttactg

SEQ ID NO: 1609882 - DNA, 21 bp, Homo sapiens
tcttcatttttttttcaatca

SEQ ID NO: 1609883 - DNA, 21 bp, Homo sapiens
tcttccactccttctctcact

SEQ ID NO: 1609884 - DNA, 17 bp, Homo sapiens
tcttccatcatcactgt

SEQ ID NO: 1609885 - DNA, 14 bp, Homo sapiens
tcttccatgatttt

SEQ ID NO: 1609886 - DNA, 14 bp, Homo sapiens
tcttccatgctgtg

SEQ ID NO: 1609887 - DNA, 23 bp, Homo sapiens
tcttccatgggatggttagtgtg

SEQ ID NO: 1609888 - DNA, 14 bp, Homo sapiens
tcttccatgtgaac

SEQ ID NO: 1609889 - DNA, 21 bp, Homo sapiens
tcttccatgtgaacagcataa

SEQ ID NO: 1609890 - DNA, 18 bp, Homo sapiens
tcttcccaacttgccttt

SEQ ID NO: 1609891 - DNA, 19 bp, Homo sapiens
tcttcccagaatctctgag

SEQ ID NO: 1609892 - DNA, 11 bp, Homo sapiens
tcttccccaca

SEQ ID NO: 1609893 - DNA, 14 bp, Homo sapiens
tcttccccactccc

SEQ ID NO: 1609894 - DNA, 14 bp, Homo sapiens
tcttcccccaccac

SEQ ID NO: 1609895 - DNA, 14 bp, Homo sapiens
tcttccccttcctg

SEQ ID NO: 1609896 - DNA, 17 bp, Homo sapiens
tcttccccttcctgttt

SEQ ID NO: 1609897 - DNA, 18 bp, Homo sapiens
tcttccccttcctgtttc

SEQ ID NO: 1609898 - DNA, 22 bp, Homo sapiens
tcttccccttcctgtttcagac

SEQ ID NO: 1609899 - DNA, 10 bp, Homo sapiens
tcttccctcc

SEQ ID NO: 1609900 - DNA, 18 bp, Homo sapiens
tcttccctcggggagcca

SEQ ID NO: 1609901 - DNA, 14 bp, Homo sapiens
tcttccctctccct

SEQ ID NO: 1609902 - DNA, 16 bp, Homo sapiens
tcttccctctccctct

SEQ ID NO: 1609903 - DNA, 17 bp, Homo sapiens
tcttccctctcgctccc

SEQ ID NO: 1609904 - DNA, 18 bp, Homo sapiens
tcttccctctgggcctgt

SEQ ID NO: 1609905 - DNA, 19 bp, Homo sapiens
tcttccctctgggcctgtt

SEQ ID NO: 1609906 - DNA, 19 bp, Homo sapiens
tcttccctgaacgttttct

SEQ ID NO: 1609907 - DNA, 22 bp, Homo sapiens
tcttccctgaacgttttcttct

SEQ ID NO: 1609908 - DNA, 22 bp, Homo sapiens
tcttcctaaatttcattgtgtt

SEQ ID NO: 1609909 - DNA, 13 bp, Homo sapiens
tcttcctagaatt

SEQ ID NO: 1609910 - DNA, 20 bp, Homo sapiens
tcttcctagatctgcaggct

SEQ ID NO: 1609911 - DNA, 19 bp, Homo sapiens
tcttcctatccctctccta

SEQ ID NO: 1609912 - DNA, 15 bp, Homo sapiens
tcttcctatttcaga

SEQ ID NO: 1609913 - DNA, 23 bp, Homo sapiens
tcttcctcaaaataaagaagtat

SEQ ID NO: 1609914 - DNA, 17 bp, Homo sapiens
tcttcctccctgggggc

SEQ ID NO: 1609915 - DNA, 15 bp, Homo sapiens
tcttcctctggttcc

SEQ ID NO: 1609916 - DNA, 15 bp, Homo sapiens
tcttcctcttagcct

SEQ ID NO: 1609917 - DNA, 18 bp, Homo sapiens
tcttcctgagtggtgcca

SEQ ID NO: 1609918 - DNA, 12 bp, Homo sapiens
tcttcctgccct

SEQ ID NO: 1609919 - DNA, 13 bp, Homo sapiens
tcttcctgccctt

SEQ ID NO: 1609920 - DNA, 14 bp, Homo sapiens
tcttcctgcccttg

SEQ ID NO: 1609921 - DNA, 22 bp, Homo sapiens
tcttcctgtctttgttgtctcc

SEQ ID NO: 1609922 - DNA, 23 bp, Homo sapiens
tcttcctgtgaagtttaattgtc

SEQ ID NO: 1609923 - DNA, 14 bp, Homo sapiens
tcttcctgtgtcct

SEQ ID NO: 1609924 - DNA, 21 bp, Homo sapiens
tcttccttgaagaactgcagg

SEQ ID NO: 1609925 - DNA, 22 bp, Homo sapiens
tcttccttgaagaactgcaggc

SEQ ID NO: 1609926 - DNA, 15 bp, Homo sapiens
tcttccttgatgttt

SEQ ID NO: 1609927 - DNA, 20 bp, Homo sapiens
tcttcgacagctgggctgga

SEQ ID NO: 1609928 - DNA, 13 bp, Homo sapiens
tcttcgaggtgga

SEQ ID NO: 1609929 - DNA, 13 bp, Homo sapiens
tcttcgctgtgat

SEQ ID NO: 1609930 - DNA, 14 bp, Homo sapiens
tcttcggcagggag

SEQ ID NO: 1609931 - DNA, 14 bp, Homo sapiens
tcttcgtgaacata

SEQ ID NO: 1609932 - DNA, 17 bp, Homo sapiens
tcttctaaaacttgagt

SEQ ID NO: 1609933 - DNA, 12 bp, Homo sapiens
tcttctaaatgg

SEQ ID NO: 1609934 - DNA, 22 bp, Homo sapiens
tcttctaccacacctggaaaca

SEQ ID NO: 1609935 - DNA, 23 bp, Homo sapiens
tcttctagagccgtgatgcctcc

SEQ ID NO: 1609936 - DNA, 12 bp, Homo sapiens
tcttctagagtt

SEQ ID NO: 1609937 - DNA, 17 bp, Homo sapiens
tcttctagagttcagag

SEQ ID NO: 1609938 - DNA, 14 bp, Homo sapiens
tcttctaggcccat

SEQ ID NO: 1609939 - DNA, 14 bp, Homo sapiens
tcttctcaagttct

SEQ ID NO: 1609940 - DNA, 19 bp, Homo sapiens
tcttctcaagttctaagat

SEQ ID NO: 1609941 - DNA, 23 bp, Homo sapiens
tcttctcaagttctaagattcta

SEQ ID NO: 1609942 - DNA, 14 bp, Homo sapiens
tcttctcaggctct

SEQ ID NO: 1609943 - DNA, 15 bp, Homo sapiens
tcttctcagtgtctg

SEQ ID NO: 1609944 - DNA, 14 bp, Homo sapiens
tctctcttgcttga

SEQ ID NO: 1609945 - DNA, 13 bp, Homo sapiens
tctctcttgtcct

SEQ ID NO: 1609946 - DNA, 16 bp, Homo sapiens
tctctcttgtcctctt

SEQ ID NO: 1609947 - DNA, 16 bp, Homo sapiens
tctctctttatacagc

SEQ ID NO: 1609948 - DNA, 22 bp, Homo sapiens
tctctgaagagtgggtttcaca

SEQ ID NO: 1609949 - DNA, 18 bp, Homo sapiens
tctctgaagggacccccc

SEQ ID NO: 1609950 - DNA, 15 bp, Homo sapiens
tctctgaatgcccca

SEQ ID NO: 1609951 - DNA, 15 bp, Homo sapiens
tctctgaattttcag

SEQ ID NO: 1609952 - DNA, 18 bp, Homo sapiens
tctctgacttctgcctgg

SEQ ID NO: 1609953 - DNA, 19 bp, Homo sapiens
tctctgacttctgcctgga

SEQ ID NO: 1609954 - DNA, 16 bp, Homo sapiens
tctctgagtcaaatcc

SEQ ID NO: 1609955 - DNA, 17 bp, Homo sapiens
tctctgagtcaaatcca

SEQ ID NO: 1609956 - DNA, 21 bp, Homo sapiens
tctctgagtcaaatccagtgg

SEQ ID NO: 1609957 - DNA, 23 bp, Homo sapiens
tctctgatcttgtgctcagcatg

SEQ ID NO: 1609958 - DNA, 14 bp, Homo sapiens
tctctgattaaatt

SEQ ID NO: 1609959 - DNA, 19 bp, Homo sapiens
tctctgattttcaaagctt

SEQ ID NO: 1609960 - DNA, 19 bp, Homo sapiens
tctgccagggagcttgaaa

SEQ ID NO: 1609961 - DNA, 15 bp, Homo sapiens
tctgccatcttcagg

SEQ ID NO: 1609962 - DNA, 12 bp, Homo sapiens
tctgcccaaccc

SEQ ID NO: 1609963 - DNA, 20 bp, Homo sapiens
tctgcccacagtctttccgt

SEQ ID NO: 1609964 - DNA, 13 bp, Homo sapiens
tctgcccagccgg

SEQ ID NO: 1609965 - DNA, 21 bp, Homo sapiens
tctgcccaggggtgccccctc

SEQ ID NO: 1609966 - DNA, 14 bp, Homo sapiens
tctgccccaagccc

SEQ ID NO: 1609967 - DNA, 16 bp, Homo sapiens
tctgccccaagccccc

SEQ ID NO: 1609968 - DNA, 21 bp, Homo sapiens
tctgccccaatcgggtccaga

SEQ ID NO: 1609969 - DNA, 10 bp, Homo sapiens
tctgccccag

SEQ ID NO: 1609970 - DNA, 15 bp, Homo sapiens
tctgccccagcccag

SEQ ID NO: 1609971 - DNA, 16 bp, Homo sapiens
tctgccccagcccaga

SEQ ID NO: 1609972 - DNA, 17 bp, Homo sapiens
tctgccccagcccagat

SEQ ID NO: 1609973 - DNA, 15 bp, Homo sapiens
tctgccccagcctgt

SEQ ID NO: 1609974 - DNA, 14 bp, Homo sapiens
tctgccccagctct

SEQ ID NO: 1609975 - DNA, 15 bp, Homo sapiens
tctgccccaggccct

SEQ ID NO: 1609976 - DNA, 20 bp, Homo sapiens
tctgccccatcattgcacct

SEQ ID NO: 1609977 - DNA, 21 bp, Homo sapiens
tctgcccccgcgggttctaga

SEQ ID NO: 1609978 - DNA, 14 bp, Homo sapiens
tctgcccccgctga

SEQ ID NO: 1609979 - DNA, 19 bp, Homo sapiens
tctgcccccgttccagctg

SEQ ID NO: 1609980 - DNA, 13 bp, Homo sapiens
tctgccccctccc

SEQ ID NO: 1609981 - DNA, 13 bp, Homo sapiens
tctgcccctcccc

SEQ ID NO: 1609982 - DNA, 22 bp, Homo sapiens
tctgcccctcccccaaccccca

SEQ ID NO: 1609983 - DNA, 19 bp, Homo sapiens
tctgcccggctacatcagc

SEQ ID NO: 1609984 - DNA, 19 bp, Homo sapiens
tctgccctaacctgacaga

SEQ ID NO: 1609985 - DNA, 13 bp, Homo sapiens
tctgccctctgct

SEQ ID NO: 1609986 - DNA, 20 bp, Homo sapiens
tctgccctctgctgctgccc

SEQ ID NO: 1609987 - DNA, 14 bp, Homo sapiens
tctgccctgcctga

SEQ ID NO: 1609988 - DNA, 16 bp, Homo sapiens
tctgccctgcctgagg

SEQ ID NO: 1609989 - DNA, 22 bp, Homo sapiens
tctgccctgggttcttccacag

SEQ ID NO: 1609990 - DNA, 14 bp, Homo sapiens
tctgccgcctcagc

SEQ ID NO: 1609991 - DNA, 20 bp, Homo sapiens
tctgccgcctcagcttctca

SEQ ID NO: 1609992 - DNA, 19 bp, Homo sapiens
tctgccgctacctccctcc

SEQ ID NO: 1609993 - DNA, 22 bp, Homo sapiens
tctgccggtcccccatgccacc

SEQ ID NO: 1609994 - DNA, 23 bp, Homo sapiens
tctgccggtcccccatgccacca

SEQ ID NO: 1609995 - DNA, 21 bp, Homo sapiens
tctgcctacagaacttcagaa

SEQ ID NO: 1609996 - DNA, 21 bp, Homo sapiens
tctgcctagagtgtagcctaa

SEQ ID NO: 1609997 - DNA, 16 bp, Homo sapiens
tctgcctcaatgtgaa

SEQ ID NO: 1609998 - DNA, 20 bp, Homo sapiens
tctgcctcacatagcttaca

SEQ ID NO: 1609999 - DNA, 21 bp, Homo sapiens
tctgcctctagtccccaaggc

SEQ ID NO: 1610000 - DNA, 20 bp, Homo sapiens
tctgcctgaacctggggtca

SEQ ID NO: 1610001 - DNA, 14 bp, Homo sapiens
tctgcctgagattc

SEQ ID NO: 1610002 - DNA, 20 bp, Homo sapiens
tctgcctgcactccctggcc

SEQ ID NO: 1610003 - DNA, 22 bp, Homo sapiens
tctgcctgccagctgcactgat

SEQ ID NO: 1610004 - DNA, 15 bp, Homo sapiens
tctgcctgcggccca

SEQ ID NO: 1610005 - DNA, 9 bp, Homo sapiens
tctgcctgg

SEQ ID NO: 1610006 - DNA, 23 bp, Homo sapiens
tctgcctggagacttagggcacc

SEQ ID NO: 1610007 - DNA, 19 bp, Homo sapiens
tctgcctggcctggctccc

SEQ ID NO: 1610008 - DNA, 20 bp, Homo sapiens
tctgcctggcctggctcccc

SEQ ID NO: 1610009 - DNA, 12 bp, Homo sapiens
tctgcctgggcc

SEQ ID NO: 1610010 - DNA, 23 bp, Homo sapiens
tctgcctggggcctccagaagct

SEQ ID NO: 1610011 - DNA, 13 bp, Homo sapiens
tctgcctgtctgg

SEQ ID NO: 1610012 - DNA, 17 bp, Homo sapiens
tctgcctgtgagccagt

SEQ ID NO: 1610013 - DNA, 19 bp, Homo sapiens
tctgccttagtctcagttt

SEQ ID NO: 1610014 - DNA, 17 bp, Homo sapiens
tctgccttcaggcttct

SEQ ID NO: 1610015 - DNA, 19 bp, Homo sapiens
tctgcgtctatcctgtgta

SEQ ID NO: 1610016 - DNA, 20 bp, Homo sapiens
tctgcgtctctgctttaaag

SEQ ID NO: 1610017 - DNA, 16 bp, Homo sapiens
tctgcgtgcagggaca

SEQ ID NO: 1610018 - DNA, 15 bp, Homo sapiens
tctgctaaataaaca

SEQ ID NO: 1610019 - DNA, 16 bp, Homo sapiens
tctgctaaataaacat

SEQ ID NO: 1610020 - DNA, 15 bp, Homo sapiens
tctgctaaatatcac

SEQ ID NO: 1610021 - DNA, 16 bp, Homo sapiens
tctgctacttcactgt

SEQ ID NO: 1610022 - DNA, 14 bp, Homo sapiens
tctgctagaaagtt

SEQ ID NO: 1610023 - DNA, 17 bp, Homo sapiens
tctgctagactcctcag

SEQ ID NO: 1610024 - DNA, 16 bp, Homo sapiens
tctgctatatataaaa

SEQ ID NO: 1610025 - DNA, 13 bp, Homo sapiens
tctgctcacttta

SEQ ID NO: 1610026 - DNA, 19 bp, Homo sapiens
tctgctcactttaaacctg

SEQ ID NO: 1610027 - DNA, 17 bp, Homo sapiens
tctgctcataggacctg

SEQ ID NO: 1610028 - DNA, 19 bp, Homo sapiens
tctgctcataggacctgca

SEQ ID NO: 1610029 - DNA, 14 bp, Homo sapiens
tctgctccaccaca

SEQ ID NO: 1610030 - DNA, 12 bp, Homo sapiens
tctgctccaccc

SEQ ID NO: 1610031 - DNA, 21 bp, Homo sapiens
tctgctccagcaactgccctt

SEQ ID NO: 1610032 - DNA, 20 bp, Homo sapiens
tctgctcccagatgccttct

SEQ ID NO: 1610033 - DNA, 16 bp, Homo sapiens
tctgctccccagggga

SEQ ID NO: 1610034 - DNA, 13 bp, Homo sapiens
tctgctccctctg

SEQ ID NO: 1610035 - DNA, 14 bp, Homo sapiens
tctgctcctgcttt

SEQ ID NO: 1610036 - DNA, 23 bp, Homo sapiens
tctgctcggcttcttggaccttg

SEQ ID NO: 1610037 - DNA, 18 bp, Homo sapiens
tctgctctagattcataa

SEQ ID NO: 1610038 - DNA, 20 bp, Homo sapiens
tctgctctagattcataaat

SEQ ID NO: 1610039 - DNA, 13 bp, Homo sapiens
tctgctctagcca

SEQ ID NO: 1610040 - DNA, 18 bp, Homo sapiens
tctgctctagccaggagt

SEQ ID NO: 1610041 - DNA, 18 bp, Homo sapiens
tctgctctagggaatctg

SEQ ID NO: 1610042 - DNA, 20 bp, Homo sapiens
tctgctctagggaatctgga

SEQ ID NO: 1610043 - DNA, 12 bp, Homo sapiens
tctgctctcctt

SEQ ID NO: 1610044 - DNA, 13 bp, Homo sapiens
tctgctctccttc

SEQ ID NO: 1610045 - DNA, 14 bp, Homo sapiens
tctgctctccttcc

SEQ ID NO: 1610046 - DNA, 14 bp, Homo sapiens
tctgctctgccatc

SEQ ID NO: 1610047 - DNA, 14 bp, Homo sapiens
tctgctctgcctgg

SEQ ID NO: 1610048 - DNA, 12 bp, Homo sapiens
tctgctctggaa

SEQ ID NO: 1610049 - DNA, 17 bp, Homo sapiens
tctgctctggtggctta

SEQ ID NO: 1610050 - DNA, 18 bp, Homo sapiens
tctgctcttccaaagctc

SEQ ID NO: 1610051 - DNA, 15 bp, Homo sapiens
tctgctctttctctg

SEQ ID NO: 1610052 - DNA, 16 bp, Homo sapiens
tctgctcttttcctgg

SEQ ID NO: 1610053 - DNA, 17 bp, Homo sapiens
tctgctgagttggcctg

SEQ ID NO: 1610054 - DNA, 12 bp, Homo sapiens
tctgctgcacct

SEQ ID NO: 1610055 - DNA, 20 bp, Homo sapiens
tctgctgcaccttgtaaatg

SEQ ID NO: 1610056 - DNA, 16 bp, Homo sapiens
tctgctgcccctgcag

SEQ ID NO: 1610057 - DNA, 17 bp, Homo sapiens
tctgctgcccctgcagt

SEQ ID NO: 1610058 - DNA, 14 bp, Homo sapiens
tctgctgctgcccg

SEQ ID NO: 1610059 - DNA, 18 bp, Homo sapiens
tctgctgctgtccctccc

SEQ ID NO: 1610060 - DNA, 20 bp, Homo sapiens
tctgctggaaggggcagcag

SEQ ID NO: 1610061 - DNA, 21 bp, Homo sapiens
tctgctggaaggggcagcagg

SEQ ID NO: 1610062 - DNA, 16 bp, Homo sapiens
tctgctggataaaatg

SEQ ID NO: 1610063 - DNA, 13 bp, Homo sapiens
tctgctggatatt

SEQ ID NO: 1610064 - DNA, 22 bp, Homo sapiens
tctgctggcaggattcttcccg

SEQ ID NO: 1610065 - DNA, 12 bp, Homo sapiens
tctgctggccca

SEQ ID NO: 1610066 - DNA, 14 bp, Homo sapiens
tctgctggcccagc

SEQ ID NO: 1610067 - DNA, 20 bp, Homo sapiens
tctgctggcccagccaaacc

SEQ ID NO: 1610068 - DNA, 15 bp, Homo sapiens
tctgctggcctggat

SEQ ID NO: 1610069 - DNA, 17 bp, Homo sapiens
tctgctggcctggatct

SEQ ID NO: 1610070 - DNA, 15 bp, Homo sapiens
tctgctggtatttct

SEQ ID NO: 1610071 - DNA, 13 bp, Homo sapiens
tctgctgttgcca

SEQ ID NO: 1610072 - DNA, 18 bp, Homo sapiens
tctgctgttgccatagcc

SEQ ID NO: 1610073 - DNA, 19 bp, Homo sapiens
tctgctgttgccatagccc

SEQ ID NO: 1610074 - DNA, 17 bp, Homo sapiens
tctgcttaaagcttccc

SEQ ID NO: 1610075 - DNA, 13 bp, Homo sapiens
tctgcttaccctt

SEQ ID NO: 1610076 - DNA, 15 bp, Homo sapiens
tctccttagttggct

SEQ ID NO: 1610077 - DNA, 20 bp, Homo sapiens
tctccttatagacacttgct

SEQ ID NO: 1610078 - DNA, 14 bp, Homo sapiens
tctccttcagcacg

SEQ ID NO: 1610079 - DNA, 15 bp, Homo sapiens
tctccttcagccctc

SEQ ID NO: 1610080 - DNA, 21 bp, Homo sapiens
tctccttcatgacagcctcca

SEQ ID NO: 1610081 - DNA, 14 bp, Homo sapiens
tctccttcccccag

SEQ ID NO: 1610082 - DNA, 18 bp, Homo sapiens
tctccttcccccagccca

SEQ ID NO: 1610083 - DNA, 18 bp, Homo sapiens
tctccttcccctacacct

SEQ ID NO: 1610084 - DNA, 19 bp, Homo sapiens
tctccttcccctttcccca

SEQ ID NO: 1610085 - DNA, 14 bp, Homo sapiens
tctccttcccttct

SEQ ID NO: 1610086 - DNA, 20 bp, Homo sapiens
tctccttcccttctcttggg

SEQ ID NO: 1610087 - DNA, 16 bp, Homo sapiens
tctccttcctcttggc

SEQ ID NO: 1610088 - DNA, 11 bp, Homo sapiens
tctccttcctt

SEQ ID NO: 1610089 - DNA, 14 bp, Homo sapiens
tctccttccttacc

SEQ ID NO: 1610090 - DNA, 18 bp, Homo sapiens
tctccttccttacccaaa

SEQ ID NO: 1610091 - DNA, 13 bp, Homo sapiens
tctccttcttagc

SEQ ID NO: 1610092 - DNA, 20 bp, Homo sapiens
tctccttggccacagactga

SEQ ID NO: 1610093 - DNA, 21 bp, Homo sapiens
tctccttgggctcctggctgc

SEQ ID NO: 1610094 - DNA, 17 bp, Homo sapiens
tctcctttaattgtaaa

SEQ ID NO: 1610095 - DNA, 14 bp, Homo sapiens
tctcctttccactg

SEQ ID NO: 1610096 - DNA, 12 bp, Homo sapiens
tctgcttcaata

SEQ ID NO: 1610097 - DNA, 19 bp, Homo sapiens
tctgcttcaataaatcttt

SEQ ID NO: 1610098 - DNA, 19 bp, Homo sapiens
tctgcttcatccaatgtga

SEQ ID NO: 1610099 - DNA, 21 bp, Homo sapiens
tctgcttcatccaatgtgaag

SEQ ID NO: 1610100 - DNA, 21 bp, Homo sapiens
tctgcttctcggggtccagtg

SEQ ID NO: 1610101 - DNA, 23 bp, Homo sapiens
tctgcttctcggggtccagtgca

SEQ ID NO: 1610102 - DNA, 22 bp, Homo sapiens
tctgcttctctgacttctgcct

SEQ ID NO: 1610103 - DNA, 19 bp, Homo sapiens
tctgcttgacaacatctga

SEQ ID NO: 1610104 - DNA, 18 bp, Homo sapiens
tctgcttgatttttgcct

SEQ ID NO: 1610105 - DNA, 14 bp, Homo sapiens
tctgcttgccgact

SEQ ID NO: 1610106 - DNA, 13 bp, Homo sapiens
tctgcttgtcatc

SEQ ID NO: 1610107 - DNA, 22 bp, Homo sapiens
tctgctttcacttaagtgtctg

SEQ ID NO: 1610108 - DNA, 17 bp, Homo sapiens
tctgctttctcctttaa

SEQ ID NO: 1610109 - DNA, 19 bp, Homo sapiens
tctgctttctgcctctcct

SEQ ID NO: 1610110 - DNA, 22 bp, Homo sapiens
tctgctttggggtttatcagaa

SEQ ID NO: 1610111 - DNA, 19 bp, Homo sapiens
tctgcttttaaacttggct

SEQ ID NO: 1610112 - DNA, 18 bp, Homo sapiens
tctgcttttaccatgccc

SEQ ID NO: 1610113 - DNA, 19 bp, Homo sapiens
tctgcttttctgccctggc

SEQ ID NO: 1610114 - DNA, 20 bp, Homo sapiens
tctgcttttctgccctggct

SEQ ID NO: 1610115 - DNA, 13 bp, Homo sapiens
tctggaaaggggg

SEQ ID NO: 1610116 - DNA, 19 bp, Homo sapiens
tctggaaatttagagttct

SEQ ID NO: 1610117 - DNA, 14 bp, Homo sapiens
tctggaacccagac

SEQ ID NO: 1610118 - DNA, 15 bp, Homo sapiens
tctggaacccagact

SEQ ID NO: 1610119 - DNA, 17 bp, Homo sapiens
tctggaacccagactca

SEQ ID NO: 1610120 - DNA, 23 bp, Homo sapiens
tctggaacccagactcagacatt

SEQ ID NO: 1610121 - DNA, 17 bp, Homo sapiens
tctggaacctcagcctg

SEQ ID NO: 1610122 - DNA, 13 bp, Homo sapiens
tctggaagaaaaa

SEQ ID NO: 1610123 - DNA, 14 bp, Homo sapiens
tctggaagaaaaaa

SEQ ID NO: 1610124 - DNA, 13 bp, Homo sapiens
tctggaagagagg

SEQ ID NO: 1610125 - DNA, 17 bp, Homo sapiens
tctggaagcccctgggc

SEQ ID NO: 1610126 - DNA, 14 bp, Homo sapiens
tctggaaggctggc

SEQ ID NO: 1610127 - DNA, 15 bp, Homo sapiens
tctggaaggctggct

SEQ ID NO: 1610128 - DNA, 16 bp, Homo sapiens
tctggaaggctggctg

SEQ ID NO: 1610129 - DNA, 18 bp, Homo sapiens
tctggaaggctggctgag

SEQ ID NO: 1610130 - DNA, 18 bp, Homo sapiens
tctggaagtttctggtgc

SEQ ID NO: 1610131 - DNA, 20 bp, Homo sapiens
tctggaagttttctagcaac

SEQ ID NO: 1610132 - DNA, 15 bp, Homo sapiens
tctggaatattgtga

SEQ ID NO: 1610133 - DNA, 20 bp, Homo sapiens
tctggaatattgtgattctg

SEQ ID NO: 1610134 - DNA, 15 bp, Homo sapiens
tctggaatgtaatca

SEQ ID NO: 1610135 - DNA, 16 bp, Homo sapiens
tctggaatgtaatcaa

SEQ ID NO: 1610136 - DNA, 21 bp, Homo sapiens
tctggacaagccaacttgtaa

SEQ ID NO: 1610137 - DNA, 15 bp, Homo sapiens
tctggacagtacctg

SEQ ID NO: 1610138 - DNA, 21 bp, Homo sapiens
tctggacattctctttgataa

SEQ ID NO: 1610139 - DNA, 21 bp, Homo sapiens
tctggaccccgtttcattttt

SEQ ID NO: 1610140 - DNA, 23 bp, Homo sapiens
tctggacggcaggctcactgcca

SEQ ID NO: 1610141 - DNA, 18 bp, Homo sapiens
tctggacgtgaaatactt

SEQ ID NO: 1610142 - DNA, 22 bp, Homo sapiens
tctggactacacccaagcctga

SEQ ID NO: 1610143 - DNA, 19 bp, Homo sapiens
tctggactcccactctttg

SEQ ID NO: 1610144 - DNA, 22 bp, Homo sapiens
tctggactcccactctttgaat

SEQ ID NO: 1610145 - DNA, 19 bp, Homo sapiens
tctggactctgccccaatc

SEQ ID NO: 1610146 - DNA, 13 bp, Homo sapiens
tctggactgaagc

SEQ ID NO: 1610147 - DNA, 17 bp, Homo sapiens
tctggactgaagcctgc

SEQ ID NO: 1610148 - DNA, 14 bp, Homo sapiens
tctggactggctag

SEQ ID NO: 1610149 - DNA, 15 bp, Homo sapiens
tctggactggctaga

SEQ ID NO: 1610150 - DNA, 13 bp, Homo sapiens
tctggagaaaaag

SEQ ID NO: 1610151 - DNA, 11 bp, Homo sapiens
tctggagaagc

SEQ ID NO: 1610152 - DNA, 16 bp, Homo sapiens
tctggagaagcagtga

SEQ ID NO: 1610153 - DNA, 20 bp, Homo sapiens
tctggagaggttataggtca

SEQ ID NO: 1610154 - DNA, 22 bp, Homo sapiens
tctggagaggttataggtcact

SEQ ID NO: 1610155 - DNA, 13 bp, Homo sapiens
tctggagcccctc

SEQ ID NO: 1610156 - DNA, 16 bp, Homo sapiens
tctggagccctaaccc

SEQ ID NO: 1610157 - DNA, 23 bp, Homo sapiens
tctggagccctaaccccttccag

SEQ ID NO: 1610158 - DNA, 12 bp, Homo sapiens
tctggagccctt

SEQ ID NO: 1610159 - DNA, 16 bp, Homo sapiens
tctggagcccttgggt

SEQ ID NO: 1610160 - DNA, 16 bp, Homo sapiens
tctggagcctgatgtc

SEQ ID NO: 1610161 - DNA, 23 bp, Homo sapiens
tctggagcttaattttctgtgga

SEQ ID NO: 1610162 - DNA, 18 bp, Homo sapiens
tctggaggaaagggagga

SEQ ID NO: 1610163 - DNA, 18 bp, Homo sapiens
tctggaggaagttctcca

SEQ ID NO: 1610164 - DNA, 23 bp, Homo sapiens
tctggaggccgaggaccaccagc

SEQ ID NO: 1610165 - DNA, 16 bp, Homo sapiens
tctggaggccttccag

SEQ ID NO: 1610166 - DNA, 17 bp, Homo sapiens
tctggaggccttccagc

SEQ ID NO: 1610167 - DNA, 22 bp, Homo sapiens
tctggaggccttccagctgctg

SEQ ID NO: 1610168 - DNA, 24 bp, Homo sapiens
tctggaggctgcagagctgaccca

SEQ ID NO: 1610169 - DNA, 21 bp, Homo sapiens
tctggaggggagggggatccg

SEQ ID NO: 1610170 - DNA, 22 bp, Homo sapiens
tctggagtcacatcagtgagga

SEQ ID NO: 1610171 - DNA, 23 bp, Homo sapiens
tctggagtcacatcagtgaggag

SEQ ID NO: 1610172 - DNA, 19 bp, Homo sapiens
tctggagtcccctcctcca

SEQ ID NO: 1610173 - DNA, 18 bp, Homo sapiens
tctggagtgattctagag

SEQ ID NO: 1610174 - DNA, 21 bp, Homo sapiens
tctggagtgcccccagcccag

SEQ ID NO: 1610175 - DNA, 13 bp, Homo sapiens
tctggatctcctg

SEQ ID NO: 1610176 - DNA, 16 bp, Homo sapiens
tctggatctcctgctg

SEQ ID NO: 1610177 - DNA, 14 bp, Homo sapiens
tctggatctgggac

SEQ ID NO: 1610178 - DNA, 22 bp, Homo sapiens
tctggatgcacagatgccatgg

SEQ ID NO: 1610179 - DNA, 23 bp, Homo sapiens
tctggatggccgggctgctgctg

SEQ ID NO: 1610180 - DNA, 12 bp, Homo sapiens
tctggcaaggac

SEQ ID NO: 1610181 - DNA, 15 bp, Homo sapiens
tctggcaatattctg

SEQ ID NO: 1610182 - DNA, 16 bp, Homo sapiens
tctggcacactccctc

SEQ ID NO: 1610183 - DNA, 18 bp, Homo sapiens
tctggcaccatcagcctg

SEQ ID NO: 1610184 - DNA, 19 bp, Homo sapiens
tctggcagggtgggatgga

SEQ ID NO: 1610185 - DNA, 18 bp, Homo sapiens
tctggccaccctggcccg

SEQ ID NO: 1610186 - DNA, 12 bp, Homo sapiens
tctggcccagcc

SEQ ID NO: 1610187 - DNA, 13 bp, Homo sapiens
tctggcccagggt

SEQ ID NO: 1610188 - DNA, 23 bp, Homo sapiens
tctggccctcacccctgccctgg

SEQ ID NO: 1610189 - DNA, 15 bp, Homo sapiens
tctggccctgccttc

SEQ ID NO: 1610190 - DNA, 13 bp, Homo sapiens
tctggccctggcc

SEQ ID NO: 1610191 - DNA, 18 bp, Homo sapiens
tctggccggtgctgggtt

SEQ ID NO: 1610192 - DNA, 13 bp, Homo sapiens
tctggcctcccac

SEQ ID NO: 1610193 - DNA, 14 bp, Homo sapiens
tctggcctctgctg

SEQ ID NO: 1610194 - DNA, 19 bp, Homo sapiens
tctggcctctgctgaatgc

SEQ ID NO: 1610195 - DNA, 18 bp, Homo sapiens
tctggcgacagttttcct

SEQ ID NO: 1610196 - DNA, 20 bp, Homo sapiens
tctggcggaggtctctggga

SEQ ID NO: 1610197 - DNA, 22 bp, Homo sapiens
tctggcggaggtctctgggagc

SEQ ID NO: 1610198 - DNA, 15 bp, Homo sapiens
tctggcggcttcctg

SEQ ID NO: 1610199 - DNA, 19 bp, Homo sapiens
tctggcggcttcctgtcca

SEQ ID NO: 1610200 - DNA, 21 bp, Homo sapiens
tctggcggcttcctgtccact

SEQ ID NO: 1610201 - DNA, 23 bp, Homo sapiens
tctggctagagccgaggggagag

SEQ ID NO: 1610202 - DNA, 17 bp, Homo sapiens
tctggctagaggccagc

SEQ ID NO: 1610203 - DNA, 21 bp, Homo sapiens
tctggctagaggccagcccca

SEQ ID NO: 1610204 - DNA, 23 bp, Homo sapiens
tctggctcagggtcaaagacaga

SEQ ID NO: 1610205 - DNA, 16 bp, Homo sapiens
tctggctctaattcac

SEQ ID NO: 1610206 - DNA, 16 bp, Homo sapiens
tctggctgaaccctgt

SEQ ID NO: 1610207 - DNA, 18 bp, Homo sapiens
tctggctgaaccctgtgc

SEQ ID NO: 1610208 - DNA, 11 bp, Homo sapiens
tctagattctc

SEQ ID NO: 1610209 - DNA, 21 bp, Homo sapiens
tctagattctctggctgtaag

SEQ ID NO: 1610210 - DNA, 15 bp, Homo sapiens
tctagcaaatatgct

SEQ ID NO: 1610211 - DNA, 22 bp, Homo sapiens
tctagcaaatatgctgttatgt

SEQ ID NO: 1610212 - DNA, 16 bp, Homo sapiens
tctagcaaatgttatg

SEQ ID NO: 1610213 - DNA, 18 bp, Homo sapiens
tctagcaagaagattcta

SEQ ID NO: 1610214 - DNA, 14 bp, Homo sapiens
tctagcaattttct

SEQ ID NO: 1610215 - DNA, 16 bp, Homo sapiens
tctagcaattttcttt

SEQ ID NO: 1610216 - DNA, 21 bp, Homo sapiens
tctagcaattttctttgtttc

SEQ ID NO: 1610217 - DNA, 16 bp, Homo sapiens
tctagcagcacctcct

SEQ ID NO: 1610218 - DNA, 19 bp, Homo sapiens
tctagcattaggtatatct

SEQ ID NO: 1610219 - DNA, 17 bp, Homo sapiens
tctagcccactccctgc

SEQ ID NO: 1610220 - DNA, 13 bp, Homo sapiens
tctagcccatgga

SEQ ID NO: 1610221 - DNA, 21 bp, Homo sapiens
tctagcctggcaacagagcga

SEQ ID NO: 1610222 - DNA, 21 bp, Homo sapiens
tctagctagaaatatgatttt

SEQ ID NO: 1610223 - DNA, 23 bp, Homo sapiens
tctagctagaaatatgattttat

SEQ ID NO: 1610224 - DNA, 12 bp, Homo sapiens
tctagctataac

SEQ ID NO: 1610225 - DNA, 21 bp, Homo sapiens
tctagctataacaactctatt

SEQ ID NO: 1610226 - DNA, 14 bp, Homo sapiens
tctagctggcagga

SEQ ID NO: 1610227 - DNA, 13 bp, Homo sapiens
tctagctgtatga

SEQ ID NO: 1610228 - DNA, 21 bp, Homo sapiens
tctaggacacagttcctggga

SEQ ID NO: 1610229 - DNA, 23 bp, Homo sapiens
tctaggacacagttcctgggaac

SEQ ID NO: 1610230 - DNA, 14 bp, Homo sapiens
tctaggactgcagt

SEQ ID NO: 1610231 - DNA, 23 bp, Homo sapiens
tctaggagaaacttagaggaaaa

SEQ ID NO: 1610232 - DNA, 20 bp, Homo sapiens
tctaggagctgggaggaaaa

SEQ ID NO: 1610233 - DNA, 21 bp, Homo sapiens
tctaggagctgggaggaaaag

SEQ ID NO: 1610234 - DNA, 14 bp, Homo sapiens
tctaggatagctaa

SEQ ID NO: 1610235 - DNA, 16 bp, Homo sapiens
tctaggatgtgatgat

SEQ ID NO: 1610236 - DNA, 20 bp, Homo sapiens
tctaggattgggcctcccat

SEQ ID NO: 1610237 - DNA, 21 bp, Homo sapiens
tctaggcactgtagttctaag

SEQ ID NO: 1610238 - DNA, 21 bp, Homo sapiens
tctaggcccattgtcctcctt

SEQ ID NO: 1610239 - DNA, 22 bp, Homo sapiens
tctaggcccattgtcctccttt

SEQ ID NO: 1610240 - DNA, 13 bp, Homo sapiens
tctagggaaatga

SEQ ID NO: 1610241 - DNA, 21 bp, Homo sapiens
tctagggactgccaggctgtt

SEQ ID NO: 1610242 - DNA, 17 bp, Homo sapiens
tctagggagagaccctt

SEQ ID NO: 1610243 - DNA, 14 bp, Homo sapiens
tctaggtaggaaga

SEQ ID NO: 1610244 - DNA, 17 bp, Homo sapiens
tctaggtggagttgaaa

SEQ ID NO: 1610245 - DNA, 19 bp, Homo sapiens
tctaggtgtggctgtgaag

SEQ ID NO: 1610246 - DNA, 19 bp, Homo sapiens
tctaggtttcaaagatgct

SEQ ID NO: 1610247 - DNA, 14 bp, Homo sapiens
tctagtaatatatt

SEQ ID NO: 1610248 - DNA, 17 bp, Homo sapiens
tctagtattttatctgg

SEQ ID NO: 1610249 - DNA, 19 bp, Homo sapiens
tctagtccccaaggcctct

SEQ ID NO: 1610250 - DNA, 21 bp, Homo sapiens
tctagtccccaaggcctctct

SEQ ID NO: 1610251 - DNA, 16 bp, Homo sapiens
tctagtcctattctat

SEQ ID NO: 1610252 - DNA, 19 bp, Homo sapiens
tctagtccttgtcttgtaa

SEQ ID NO: 1610253 - DNA, 12 bp, Homo sapiens
tctagtgatgat

SEQ ID NO: 1610254 - DNA, 19 bp, Homo sapiens
tctagtgcagctgaaattg

SEQ ID NO: 1610255 - DNA, 17 bp, Homo sapiens
tctagtgctgctgaaga

SEQ ID NO: 1610256 - DNA, 13 bp, Homo sapiens
tctagtgggacag

SEQ ID NO: 1610257 - DNA, 15 bp, Homo sapiens
tctagtgggacagcc

SEQ ID NO: 1610258 - DNA, 24 bp, Homo sapiens
tctagtgggacagcccagagcctg

SEQ ID NO: 1610259 - DNA, 22 bp, Homo sapiens
tctagtgggttgacctttaaat

SEQ ID NO: 1610260 - DNA, 14 bp, Homo sapiens
tctagttctagatg

SEQ ID NO: 1610261 - DNA, 21 bp, Homo sapiens
tctagttctttcctccccctg

SEQ ID NO: 1610262 - DNA, 13 bp, Homo sapiens
tctagttctttgt

SEQ ID NO: 1610263 - DNA, 22 bp, Homo sapiens
tctagttgggagagttggagag

SEQ ID NO: 1610264 - DNA, 21 bp, Homo sapiens
tctagtttacagaaaaatctt

SEQ ID NO: 1610265 - DNA, 13 bp, Homo sapiens
tctagtttcccac

SEQ ID NO: 1610266 - DNA, 14 bp, Homo sapiens
tctagtttcccaca

SEQ ID NO: 1610267 - DNA, 13 bp, Homo sapiens
tctagtttgcata

SEQ ID NO: 1610268 - DNA, 13 bp, Homo sapiens
tctagtttgcatt

SEQ ID NO: 1610269 - DNA, 15 bp, Homo sapiens
tctagtttgcattcc

SEQ ID NO: 1610270 - DNA, 14 bp, Homo sapiens
tctataaactataa

SEQ ID NO: 1610271 - DNA, 13 bp, Homo sapiens
tctataaataacc

SEQ ID NO: 1610272 - DNA, 21 bp, Homo sapiens
tctataagtagtaaatcagaa

SEQ ID NO: 1610273 - DNA, 15 bp, Homo sapiens
tctataatggaaaca

SEQ ID NO: 1610274 - DNA, 16 bp, Homo sapiens
tctataccaataaagt

SEQ ID NO: 1610275 - DNA, 16 bp, Homo sapiens
tctatactgtttgtaa

SEQ ID NO: 1610276 - DNA, 22 bp, Homo sapiens
tctatactgtttgtaatataca

SEQ ID NO: 1610277 - DNA, 23 bp, Homo sapiens
tctatactgtttgtaatatacag

SEQ ID NO: 1610278 - DNA, 17 bp, Homo sapiens
tctatactttgttctgt

SEQ ID NO: 1610279 - DNA, 18 bp, Homo sapiens
tctatactttgttctgtt

SEQ ID NO: 1610280 - DNA, 18 bp, Homo sapiens
tctataggaacatatgaa

SEQ ID NO: 1610281 - DNA, 20 bp, Homo sapiens
tctataggaacatatgaaaa

SEQ ID NO: 1610282 - DNA, 21 bp, Homo sapiens
tctataggaacatatgaaaat

SEQ ID NO: 1610283 - DNA, 20 bp, Homo sapiens
tctataggcagcttctaaga

SEQ ID NO: 1610284 - DNA, 14 bp, Homo sapiens
tctatatatataat

SEQ ID NO: 1610285 - DNA, 21 bp, Homo sapiens
tctatatgaatttaaatataa

SEQ ID NO: 1610286 - DNA, 21 bp, Homo sapiens
tctatatgtagtgcattttta

SEQ ID NO: 1610287 - DNA, 14 bp, Homo sapiens
tctatattatgtct

SEQ ID NO: 1610288 - DNA, 13 bp, Homo sapiens
tctatatttcata

SEQ ID NO: 1610289 - DNA, 14 bp, Homo sapiens
tctatatttcatat

SEQ ID NO: 1610290 - DNA, 15 bp, Homo sapiens
tctatatttcatatt

SEQ ID NO: 1610291 - DNA, 16 bp, Homo sapiens
tctatatttcatattg

SEQ ID NO: 1610292 - DNA, 17 bp, Homo sapiens
tctatatttcatattga

SEQ ID NO: 1610293 - DNA, 21 bp, Homo sapiens
tctatatttcatattgagatc

SEQ ID NO: 1610294 - DNA, 15 bp, Homo sapiens
tctatatttgtcttc

SEQ ID NO: 1610295 - DNA, 20 bp, Homo sapiens
tctatcaactttaatcaagt

SEQ ID NO: 1610296 - DNA, 13 bp, Homo sapiens
tctatcacctgtc

SEQ ID NO: 1610297 - DNA, 15 bp, Homo sapiens
tctatcacctgtcat

SEQ ID NO: 1610298 - DNA, 18 bp, Homo sapiens
tctatcacctgtcatcat

SEQ ID NO: 1610299 - DNA, 16 bp, Homo sapiens
tctatcagaagttgta

SEQ ID NO: 1610300 - DNA, 17 bp, Homo sapiens
tctatcagaagttgtat

SEQ ID NO: 1610301 - DNA, 14 bp, Homo sapiens
tctatcagagaaaa

SEQ ID NO: 1610302 - DNA, 14 bp, Homo sapiens
tctatcattccaat

SEQ ID NO: 1610303 - DNA, 16 bp, Homo sapiens
tctatcattccaattc

SEQ ID NO: 1610304 - DNA, 13 bp, Homo sapiens
tctatcattgttg

SEQ ID NO: 1610305 - DNA, 16 bp, Homo sapiens
tctatcctagtcttca

SEQ ID NO: 1610306 - DNA, 20 bp, Homo sapiens
tctatcctagtcttcacaac

SEQ ID NO: 1610307 - DNA, 16 bp, Homo sapiens
tctatccttttgcctg

SEQ ID NO: 1610308 - DNA, 19 bp, Homo sapiens
tctatcgagtttgcaatgt

SEQ ID NO: 1610309 - DNA, 12 bp, Homo sapiens
tctatctcatct

SEQ ID NO: 1610310 - DNA, 20 bp, Homo sapiens
tctatctgcaaatagtttca

SEQ ID NO: 1610311 - DNA, 19 bp, Homo sapiens
tctatgaagttgctgttta

SEQ ID NO: 1610312 - DNA, 20 bp, Homo sapiens
tctatgaagttgctgtttat

SEQ ID NO: 1610313 - DNA, 21 bp, Homo sapiens
tctatgaagttgctgtttatt

SEQ ID NO: 1610314 - DNA, 14 bp, Homo sapiens
tctatgagtctaga

SEQ ID NO: 1610315 - DNA, 13 bp, Homo sapiens
tctatgatgtttc

SEQ ID NO: 1610316 - DNA, 21 bp, Homo sapiens
tctatgccaaagatcacttgt

SEQ ID NO: 1610317 - DNA, 22 bp, Homo sapiens
tctatggaatagttctgtatat

SEQ ID NO: 1610318 - DNA, 18 bp, Homo sapiens
tctatggcagtccagcca

SEQ ID NO: 1610319 - DNA, 21 bp, Homo sapiens
tctatggcagtccagccagct

SEQ ID NO: 1610320 - DNA, 23 bp, Homo sapiens
tctatggcagtccagccagctcc

SEQ ID NO: 1610321 - DNA, 13 bp, Homo sapiens
tctatgggaagat

SEQ ID NO: 1610322 - DNA, 19 bp, Homo sapiens
tctatgtagaactgttcat

SEQ ID NO: 1610323 - DNA, 12 bp, Homo sapiens
tctatgtatgtt

SEQ ID NO: 1610324 - DNA, 22 bp, Homo sapiens
tctatgtcatttttaatgtatc

SEQ ID NO: 1610325 - DNA, 13 bp, Homo sapiens
tccttttagccta

SEQ ID NO: 1610326 - DNA, 15 bp, Homo sapiens
tccttttataggtga

SEQ ID NO: 1610327 - DNA, 14 bp, Homo sapiens
tccttttcctatcc

SEQ ID NO: 1610328 - DNA, 23 bp, Homo sapiens
tccttttccttatttgccttcta

SEQ ID NO: 1610329 - DNA, 12 bp, Homo sapiens
tccttttccttt

SEQ ID NO: 1610330 - DNA, 13 bp, Homo sapiens
tccttttgacact

SEQ ID NO: 1610331 - DNA, 14 bp, Homo sapiens
tccttttgacactg

SEQ ID NO: 1610332 - DNA, 20 bp, Homo sapiens
tccttttgacactgctctaa

SEQ ID NO: 1610333 - DNA, 22 bp, Homo sapiens
tccttttgacactgctctaaca

SEQ ID NO: 1610334 - DNA, 14 bp, Homo sapiens
tccttttgaggctt

SEQ ID NO: 1610335 - DNA, 17 bp, Homo sapiens
tccttttgatggggaga

SEQ ID NO: 1610336 - DNA, 13 bp, Homo sapiens
tccttttgctgtc

SEQ ID NO: 1610337 - DNA, 16 bp, Homo sapiens
tccttttgctgtcttt

SEQ ID NO: 1610338 - DNA, 19 bp, Homo sapiens
tccttttggaacatttctt

SEQ ID NO: 1610339 - DNA, 14 bp, Homo sapiens
tccttttgtcccca

SEQ ID NO: 1610340 - DNA, 18 bp, Homo sapiens
tccttttgtccccagggc

SEQ ID NO: 1610341 - DNA, 20 bp, Homo sapiens
tccttttgtccccagggccc

SEQ ID NO: 1610342 - DNA, 16 bp, Homo sapiens
tcctttttaaatgtga

SEQ ID NO: 1610343 - DNA, 12 bp, Homo sapiens
tcctttttaata

SEQ ID NO: 1610344 - DNA, 17 bp, Homo sapiens
tcctttttaatatgctt

SEQ ID NO: 1610345 - DNA, 17 bp, Homo sapiens
tcctttttcaaatgagt

SEQ ID NO: 1610346 - DNA, 18 bp, Homo sapiens
tcctttttcccaataaat

SEQ ID NO: 1610347 - DNA, 17 bp, Homo sapiens
tcctttttgacactgaa

SEQ ID NO: 1610348 - DNA, 23 bp, Homo sapiens
tcctttttggtcgaggagtaaca

SEQ ID NO: 1610349 - DNA, 14 bp, Homo sapiens
tccttttttataca

SEQ ID NO: 1610350 - DNA, 15 bp, Homo sapiens
tccttttttgtctat

SEQ ID NO: 1610351 - DNA, 16 bp, Homo sapiens
tccttttttgtctatg

SEQ ID NO: 1610352 - DNA, 14 bp, Homo sapiens
tcctttttttgtac

SEQ ID NO: 1610353 - DNA, 19 bp, Homo sapiens
tcgaaacctgggattcagg

SEQ ID NO: 1610354 - DNA, 16 bp, Homo sapiens
tcgaaagctctagaat

SEQ ID NO: 1610355 - DNA, 12 bp, Homo sapiens
tcgaaccaaggc

SEQ ID NO: 1610356 - DNA, 16 bp, Homo sapiens
tcgaaccaaggcagcc

SEQ ID NO: 1610357 - DNA, 22 bp, Homo sapiens
tcgaacccgggaggcagaggtt

SEQ ID NO: 1610358 - DNA, 22 bp, Homo sapiens
tcgaagaaacccttgctgcttt

SEQ ID NO: 1610359 - DNA, 21 bp, Homo sapiens
tcgaagaggccagtaggagac

SEQ ID NO: 1610360 - DNA, 10 bp, Homo sapiens
tcgaagccat

SEQ ID NO: 1610361 - DNA, 20 bp, Homo sapiens
tcgaagggtttttagagaat

SEQ ID NO: 1610362 - DNA, 18 bp, Homo sapiens
tcgaagtcagctaattgg

SEQ ID NO: 1610363 - DNA, 13 bp, Homo sapiens
tcgaagtgctgag

SEQ ID NO: 1610364 - DNA, 19 bp, Homo sapiens
tcgaagtgtttatgtaata

SEQ ID NO: 1610365 - DNA, 15 bp, Homo sapiens
tcgaataaaatctgc

SEQ ID NO: 1610366 - DNA, 16 bp, Homo sapiens
tcgaatctctgtgcct

SEQ ID NO: 1610367 - DNA, 11 bp, Homo sapiens
tcgaatgtaat

SEQ ID NO: 1610368 - DNA, 16 bp, Homo sapiens
tcgaatgtaattggaa

SEQ ID NO: 1610369 - DNA, 16 bp, Homo sapiens
tcgacagctgggctgg

SEQ ID NO: 1610370 - DNA, 18 bp, Homo sapiens
tcgaccacaccagcctcc

SEQ ID NO: 1610371 - DNA, 21 bp, Homo sapiens
tcgaccacagcaagccatcat

SEQ ID NO: 1610372 - DNA, 21 bp, Homo sapiens
tcgaccccaaaggaacactga

SEQ ID NO: 1610373 - DNA, 16 bp, Homo sapiens
tcgacctccccacccg

SEQ ID NO: 1610374 - DNA, 14 bp, Homo sapiens
tcgactggtccagc

SEQ ID NO: 1610375 - DNA, 18 bp, Homo sapiens
tcgactggtccagctctg

SEQ ID NO: 1610376 - DNA, 19 bp, Homo sapiens
tcgactggtccagctctga

SEQ ID NO: 1610377 - DNA, 19 bp, Homo sapiens
tcgagaaagaggcaccagg

SEQ ID NO: 1610378 - DNA, 14 bp, Homo sapiens
tcgagaactttcat

SEQ ID NO: 1610379 - DNA, 22 bp, Homo sapiens
tcgagaactttcatttttttcc

SEQ ID NO: 1610380 - DNA, 14 bp, Homo sapiens
tcgagacacttgcc

SEQ ID NO: 1610381 - DNA, 13 bp, Homo sapiens
tcgagaccagcct

SEQ ID NO: 1610382 - DNA, 12 bp, Homo sapiens
tcgagagtgtgc

SEQ ID NO: 1610383 - DNA, 16 bp, Homo sapiens
tcgagatttgggagct

SEQ ID NO: 1610384 - DNA, 18 bp, Homo sapiens
tcgagatttgggagctga

SEQ ID NO: 1610385 - DNA, 22 bp, Homo sapiens
tcgagcagtcctgcctcagcct

SEQ ID NO: 1610386 - DNA, 24 bp, Homo sapiens
tcgagcatcaggctaagaccctgt

SEQ ID NO: 1610387 - DNA, 16 bp, Homo sapiens
tctatgtccaacagag

SEQ ID NO: 1610388 - DNA, 20 bp, Homo sapiens
tctatgtccaacagagtgga

SEQ ID NO: 1610389 - DNA, 14 bp, Homo sapiens
tctatgtctgcctt

SEQ ID NO: 1610390 - DNA, 18 bp, Homo sapiens
tctatgttcaaagactgt

SEQ ID NO: 1610391 - DNA, 15 bp, Homo sapiens
tctatgtttgtgtga

SEQ ID NO: 1610392 - DNA, 16 bp, Homo sapiens
tctattaaaattctga

SEQ ID NO: 1610393 - DNA, 18 bp, Homo sapiens
tctattaaaattctgatg

SEQ ID NO: 1610394 - DNA, 22 bp, Homo sapiens
tctattaaagtgctaaggttct

SEQ ID NO: 1610395 - DNA, 23 bp, Homo sapiens
tctattaaagtgctaaggttcta

SEQ ID NO: 1610396 - DNA, 19 bp, Homo sapiens
tctattaagattggaaatg

SEQ ID NO: 1610397 - DNA, 10 bp, Homo sapiens
tctattaata

SEQ ID NO: 1610398 - DNA, 21 bp, Homo sapiens
tctattaatcaagagaaactt

SEQ ID NO: 1610399 - DNA, 23 bp, Homo sapiens
tctattaatcaagagaaacttca

SEQ ID NO: 1610400 - DNA, 15 bp, Homo sapiens
tctattaattactgt

SEQ ID NO: 1610401 - DNA, 17 bp, Homo sapiens
tctattaattactgtgt

SEQ ID NO: 1610402 - DNA, 21 bp, Homo sapiens
tctattaattactgtgtgtga

SEQ ID NO: 1610403 - DNA, 14 bp, Homo sapiens
tctattagacttta

SEQ ID NO: 1610404 - DNA, 14 bp, Homo sapiens
tctattatactgta

SEQ ID NO: 1610405 - DNA, 19 bp, Homo sapiens
tctattatactgtattaag

SEQ ID NO: 1610406 - DNA, 16 bp, Homo sapiens
tctattcagacaagca

SEQ ID NO: 1610407 - DNA, 15 bp, Homo sapiens
tctattccaataaac

SEQ ID NO: 1610408 - DNA, 14 bp, Homo sapiens
tctattctgagcct

SEQ ID NO: 1610409 - DNA, 22 bp, Homo sapiens
tctattgacttcaatgatagta

SEQ ID NO: 1610410 - DNA, 14 bp, Homo sapiens
tctattgtagcatt

SEQ ID NO: 1610411 - DNA, 18 bp, Homo sapiens
tctattgtagcatttctt

SEQ ID NO: 1610412 - DNA, 17 bp, Homo sapiens
tctattgtttattcttt

SEQ ID NO: 1610413 - DNA, 22 bp, Homo sapiens
tctatttataagtgactttaaa

SEQ ID NO: 1610414 - DNA, 13 bp, Homo sapiens
tctatttatgttt

SEQ ID NO: 1610415 - DNA, 16 bp, Homo sapiens
tctatttattaatatt

SEQ ID NO: 1610416 - DNA, 12 bp, Homo sapiens
tctatttattag

SEQ ID NO: 1610417 - DNA, 14 bp, Homo sapiens
tctatttcatgttt

SEQ ID NO: 1610418 - DNA, 16 bp, Homo sapiens
tctatttcatgttttt

SEQ ID NO: 1610419 - DNA, 15 bp, Homo sapiens
tctatttccactgaa

SEQ ID NO: 1610420 - DNA, 19 bp, Homo sapiens
tctatttcgagtgttgtgt

SEQ ID NO: 1610421 - DNA, 19 bp, Homo sapiens
tctatttctatctgcaaat

SEQ ID NO: 1610422 - DNA, 13 bp, Homo sapiens
tctatttctgaga

SEQ ID NO: 1610423 - DNA, 12 bp, Homo sapiens
tctatttgagaa

SEQ ID NO: 1610424 - DNA, 12 bp, Homo sapiens
tctatttggaac

SEQ ID NO: 1610425 - DNA, 12 bp, Homo sapiens
tctatttgtaca

SEQ ID NO: 1610426 - DNA, 23 bp, Homo sapiens
tctcagaggaaaaatgggagcca

SEQ ID NO: 1610427 - DNA, 14 bp, Homo sapiens
tctcagagtgttta

SEQ ID NO: 1610428 - DNA, 14 bp, Homo sapiens
tctcagatatttgc

SEQ ID NO: 1610429 - DNA, 17 bp, Homo sapiens
tctcagatccttgtttc

SEQ ID NO: 1610430 - DNA, 21 bp, Homo sapiens
tctcagatgccccaaagtttc

SEQ ID NO: 1610431 - DNA, 13 bp, Homo sapiens
tctcagcaagtgc

SEQ ID NO: 1610432 - DNA, 16 bp, Homo sapiens
tctcagcaagtgccca

SEQ ID NO: 1610433 - DNA, 18 bp, Homo sapiens
tctcagcaagtgcccagt

SEQ ID NO: 1610434 - DNA, 13 bp, Homo sapiens
tctcagcctccca

SEQ ID NO: 1610435 - DNA, 15 bp, Homo sapiens
tctcagcctcctgag

SEQ ID NO: 1610436 - DNA, 16 bp, Homo sapiens
tctcagcctcctgagt

SEQ ID NO: 1610437 - DNA, 15 bp, Homo sapiens
tctcagcctctgcca

SEQ ID NO: 1610438 - DNA, 16 bp, Homo sapiens
tctcagctcactgcaa

SEQ ID NO: 1610439 - DNA, 14 bp, Homo sapiens
tctcagctcccagg

SEQ ID NO: 1610440 - DNA, 17 bp, Homo sapiens
tctcagctcccaggcca

SEQ ID NO: 1610441 - DNA, 19 bp, Homo sapiens
tctcagctggcagtgcaat

SEQ ID NO: 1610442 - DNA, 21 bp, Homo sapiens
tctcaggaaatcaaatatgca

SEQ ID NO: 1610443 - DNA, 22 bp, Homo sapiens
tctcaggacctctgtaggcagc

SEQ ID NO: 1610444 - DNA, 18 bp, Homo sapiens
tctcaggagcttgcaaga

SEQ ID NO: 1610445 - DNA, 18 bp, Homo sapiens
tctcaggaggggcagcgc

SEQ ID NO: 1610446 - DNA, 20 bp, Homo sapiens
tctcaggatcaagaaagtgt

SEQ ID NO: 1610447 - DNA, 14 bp, Homo sapiens
tctcaggatccaag

SEQ ID NO: 1610448 - DNA, 22 bp, Homo sapiens
tctcaggatttcaccagaagtt

SEQ ID NO: 1610449 - DNA, 19 bp, Homo sapiens
tctcaggccccgggcttcc

SEQ ID NO: 1610450 - DNA, 20 bp, Homo sapiens
tctcagggaagcccagctcc

SEQ ID NO: 1610451 - DNA, 22 bp, Homo sapiens
tctcagggaagcccagctccag

SEQ ID NO: 1610452 - DNA, 12 bp, Homo sapiens
tctcagggcaga

SEQ ID NO: 1610453 - DNA, 17 bp, Homo sapiens
tctcaggggctgtttga

SEQ ID NO: 1610454 - DNA, 20 bp, Homo sapiens
tctcagggggtcagcagagt

SEQ ID NO: 1610455 - DNA, 20 bp, Homo sapiens
tctcaggtgccactccctga

SEQ ID NO: 1610456 - DNA, 15 bp, Homo sapiens
tctcagtcagtaatt

SEQ ID NO: 1610457 - DNA, 23 bp, Homo sapiens
tctcagtgcttcttactattaag

SEQ ID NO: 1610458 - DNA, 14 bp, Homo sapiens
tctcagtgtctgaa

SEQ ID NO: 1610459 - DNA, 22 bp, Homo sapiens
tctcagtgttgagccttttccc

SEQ ID NO: 1610460 - DNA, 22 bp, Homo sapiens
tctcccctgcccttcctcctga

SEQ ID NO: 1610461 - DNA, 13 bp, Homo sapiens
tctcccctgggtc

SEQ ID NO: 1610462 - DNA, 18 bp, Homo sapiens
tctcccgcaccaggccgg

SEQ ID NO: 1610463 - DNA, 14 bp, Homo sapiens
tctcccgcttcctg

SEQ ID NO: 1610464 - DNA, 21 bp, Homo sapiens
tctcccgcttcctggcctccc

SEQ ID NO: 1610465 - DNA, 22 bp, Homo sapiens
tctcccgcttcctggcctccct

SEQ ID NO: 1610466 - DNA, 20 bp, Homo sapiens
tctcccggaggttgggtggg

SEQ ID NO: 1610467 - DNA, 15 bp, Homo sapiens
tctcccggttcttcc

SEQ ID NO: 1610468 - DNA, 16 bp, Homo sapiens
tctcccggttcttcca

SEQ ID NO: 1610469 - DNA, 22 bp, Homo sapiens
tctcccgtcagggcccaagtcc

SEQ ID NO: 1610470 - DNA, 17 bp, Homo sapiens
tctccctaccttgcctc

SEQ ID NO: 1610471 - DNA, 15 bp, Homo sapiens
tctccctagctcctc

SEQ ID NO: 1610472 - DNA, 16 bp, Homo sapiens
tctccctagctcctcc

SEQ ID NO: 1610473 - DNA, 17 bp, Homo sapiens
tctccctcaactgaagg

SEQ ID NO: 1610474 - DNA, 19 bp, Homo sapiens
tctccctcaactgaagggg

SEQ ID NO: 1610475 - DNA, 22 bp, Homo sapiens
tctccctccctctctcatgaga

SEQ ID NO: 1610476 - DNA, 14 bp, Homo sapiens
tctccctctcctgc

SEQ ID NO: 1610477 - DNA, 16 bp, Homo sapiens
tctccctctcctgcct

SEQ ID NO: 1610478 - DNA, 17 bp, Homo sapiens
tctccctctggccctgc

SEQ ID NO: 1610479 - DNA, 18 bp, Homo sapiens
tctccctctggccctgcc

SEQ ID NO: 1610480 - DNA, 19 bp, Homo sapiens
tctccctctggccctgcct

SEQ ID NO: 1610481 - DNA, 12 bp, Homo sapiens
tctccctgacct

SEQ ID NO: 1610482 - DNA, 20 bp, Homo sapiens
tctccctgccaagtctcaga

SEQ ID NO: 1610483 - DNA, 23 bp, Homo sapiens
tctccctgccaagtctcagaaga

SEQ ID NO: 1610484 - DNA, 12 bp, Homo sapiens
tctccctgccgc

SEQ ID NO: 1610485 - DNA, 13 bp, Homo sapiens
tctccctggctcc

SEQ ID NO: 1610486 - DNA, 13 bp, Homo sapiens
tctccctgggcct

SEQ ID NO: 1610487 - DNA, 19 bp, Homo sapiens
tctcccttcctctctcctt

SEQ ID NO: 1610488 - DNA, 16 bp, Homo sapiens
tctcccttgccctccc

SEQ ID NO: 1610489 - DNA, 16 bp, Homo sapiens
tctccgactctgcacc

SEQ ID NO: 1610490 - DNA, 19 bp, Homo sapiens
tctccgacttcccctgggc

SEQ ID NO: 1610491 - DNA, 15 bp, Homo sapiens
tctccgagctctggt

SEQ ID NO: 1610492 - DNA, 19 bp, Homo sapiens
tctccgagctctggtgctt

SEQ ID NO: 1610493 - DNA, 22 bp, Homo sapiens
tctccgcatcgcatcctcttcc

SEQ ID NO: 1610494 - DNA, 15 bp, Homo sapiens
tctccgccagcctcc

SEQ ID NO: 1610495 - DNA, 20 bp, Homo sapiens
tctccgccagcctcctctgg

SEQ ID NO: 1610496 - DNA, 15 bp, Homo sapiens
tctccggcgcagaca

SEQ ID NO: 1610497 - DNA, 16 bp, Homo sapiens
tctccgggactgccct

SEQ ID NO: 1610498 - DNA, 19 bp, Homo sapiens
tctccgggactgccctctc

SEQ ID NO: 1610499 - DNA, 16 bp, Homo sapiens
tctccgttagctcctg

SEQ ID NO: 1610500 - DNA, 19 bp, Homo sapiens
tctccgttagctcctgtgg

SEQ ID NO: 1610501 - DNA, 23 bp, Homo sapiens
tctccgttagctcctgtggcccc

SEQ ID NO: 1610502 - DNA, 15 bp, Homo sapiens
tctccgttccatctg

SEQ ID NO: 1610503 - DNA, 19 bp, Homo sapiens
tctcctaagctggagtgca

SEQ ID NO: 1610504 - DNA, 15 bp, Homo sapiens
tctcctactgaggat

SEQ ID NO: 1610505 - DNA, 22 bp, Homo sapiens
tctcctatatatttctattatt

SEQ ID NO: 1610506 - DNA, 14 bp, Homo sapiens
tctcctatgtggca

SEQ ID NO: 1610507 - DNA, 15 bp, Homo sapiens
tctcctcactgtatc

SEQ ID NO: 1610508 - DNA, 17 bp, Homo sapiens
tctcctcagggtggggg

SEQ ID NO: 1610509 - DNA, 12 bp, Homo sapiens
tctcctcccagg

SEQ ID NO: 1610510 - DNA, 18 bp, Homo sapiens
tctcctccccacccgccc

SEQ ID NO: 1610511 - DNA, 23 bp, Homo sapiens
tctcctcccgcccttccatgtgc

SEQ ID NO: 1610512 - DNA, 11 bp, Homo sapiens
tctcctccctc

SEQ ID NO: 1610513 - DNA, 13 bp, Homo sapiens
tctcctccctcag

SEQ ID NO: 1610514 - DNA, 17 bp, Homo sapiens
tctcctccctcctgggg

SEQ ID NO: 1610515 - DNA, 13 bp, Homo sapiens
tctcctcctcccc

SEQ ID NO: 1610516 - DNA, 16 bp, Homo sapiens
tctcctcctcccctcc

SEQ ID NO: 1610517 - DNA, 14 bp, Homo sapiens
tctcctcggccccc

SEQ ID NO: 1610518 - DNA, 16 bp, Homo sapiens
tctcctctcagagtga

SEQ ID NO: 1610519 - DNA, 23 bp, Homo sapiens
tctcctctcagagtgacagtcat

SEQ ID NO: 1610520 - DNA, 14 bp, Homo sapiens
tctcctctccattt

SEQ ID NO: 1610521 - DNA, 19 bp, Homo sapiens
tctcctctctctttcctcc

SEQ ID NO: 1610522 - DNA, 20 bp, Homo sapiens
tctcctctctctttcctcca

SEQ ID NO: 1610523 - DNA, 15 bp, Homo sapiens
tctcctctctgagac

SEQ ID NO: 1610524 - DNA, 14 bp, Homo sapiens
tctcctctcttggc

SEQ ID NO: 1610525 - DNA, 12 bp, Homo sapiens
tctcctcttaaa

SEQ ID NO: 1610526 - DNA, 23 bp, Homo sapiens
tctcctcttaaaaaataaaaact

SEQ ID NO: 1610527 - DNA, 22 bp, Homo sapiens
tctcctcttcatggcatcttca

SEQ ID NO: 1610528 - DNA, 22 bp, Homo sapiens
tctcctcttcgtggttgtgttt

SEQ ID NO: 1610529 - DNA, 22 bp, Homo sapiens
tctcctgaaaaaagcagttctt

SEQ ID NO: 1610530 - DNA, 17 bp, Homo sapiens
tctcctgaagttcagcc

SEQ ID NO: 1610531 - DNA, 15 bp, Homo sapiens
tctcctgaatatttt

SEQ ID NO: 1610532 - DNA, 23 bp, Homo sapiens
tctcctgatagtcacctgctggt

SEQ ID NO: 1610533 - DNA, 18 bp, Homo sapiens
tctcctgatttctctgaa

SEQ ID NO: 1610534 - DNA, 14 bp, Homo sapiens
tctcctgccctctg

SEQ ID NO: 1610535 - DNA, 12 bp, Homo sapiens
tctcctgccctg

SEQ ID NO: 1610536 - DNA, 13 bp, Homo sapiens
tctcctgcctcag

SEQ ID NO: 1610537 - DNA, 20 bp, Homo sapiens
tctcctgcctgtgctgtgac

SEQ ID NO: 1610538 - DNA, 19 bp, Homo sapiens
tctcctggcctatccgctg

SEQ ID NO: 1610539 - DNA, 22 bp, Homo sapiens
tctcctgtccctccatcccaga

SEQ ID NO: 1610540 - DNA, 12 bp, Homo sapiens
tctcctgtctgc

SEQ ID NO: 1610541 - DNA, 23 bp, Homo sapiens
tctcctgtcttatggtccagaaa

SEQ ID NO: 1610542 - DNA, 17 bp, Homo sapiens
tctcctgtgcatgggtg

SEQ ID NO: 1610543 - DNA, 12 bp, Homo sapiens
tctcctgtgccc

SEQ ID NO: 1610544 - DNA, 16 bp, Homo sapiens
tctccttactctgagc

SEQ ID NO: 1610545 - DNA, 21 bp, Homo sapiens
tctccttactctgagcccagg

SEQ ID NO: 1610546 - DNA, 22 bp, Homo sapiens
tctccttactctgagcccaggc

SEQ ID NO: 1610547 - DNA, 21 bp, Homo sapiens
gtgtgtcaggccctctgcctg

SEQ ID NO: 1610548 - DNA, 23 bp, Homo sapiens
gtgtgtccctggacacagctctt

SEQ ID NO: 1610549 - DNA, 22 bp, Homo sapiens
gtgtgtctgttcacttttcctc

SEQ ID NO: 1610550 - DNA, 20 bp, Homo sapiens
gtgtgtctttcctccctgaa

SEQ ID NO: 1610551 - DNA, 16 bp, Homo sapiens
gtgtgtgacactgatg

SEQ ID NO: 1610552 - DNA, 16 bp, Homo sapiens
gtgtgtgcatgtgtgt

SEQ ID NO: 1610553 - DNA, 23 bp, Homo sapiens
gtgtgtggaaggcacccgccctt

SEQ ID NO: 1610554 - DNA, 13 bp, Homo sapiens
gtgtgtggcaggg

SEQ ID NO: 1610555 - DNA, 18 bp, Homo sapiens
gtgtgtggccgcctggca

SEQ ID NO: 1610556 - DNA, 11 bp, Homo sapiens
gtgtgtggctg

SEQ ID NO: 1610557 - DNA, 16 bp, Homo sapiens
gtgtgtgggagtgtgt

SEQ ID NO: 1610558 - DNA, 14 bp, Homo sapiens
gtgtgtgtgcatgt

SEQ ID NO: 1610559 - DNA, 13 bp, Homo sapiens
gtgtgtgtgcccg

SEQ ID NO: 1610560 - DNA, 15 bp, Homo sapiens
gtgtgtgtgtcagct

SEQ ID NO: 1610561 - DNA, 16 bp, Homo sapiens
gtgtgtgtgtgtatgt

SEQ ID NO: 1610562 - DNA, 13 bp, Homo sapiens
gtgtgtgtgttgc

SEQ ID NO: 1610563 - DNA, 14 bp, Homo sapiens
gtgtgttatttaaa

SEQ ID NO: 1610564 - DNA, 22 bp, Homo sapiens
gtgtgttatttccccagccaca

SEQ ID NO: 1610565 - DNA, 23 bp, Homo sapiens
gtgtgttatttccccagccacag

SEQ ID NO: 1610566 - DNA, 14 bp, Homo sapiens
gtgtgttgcttatg

SEQ ID NO: 1610567 - DNA, 18 bp, Homo sapiens
gtgtgttgtcttgaaaga

SEQ ID NO: 1610568 - DNA, 12 bp, Homo sapiens
gtgtgttgtgtg

SEQ ID NO: 1610569 - DNA, 22 bp, Homo sapiens
gtgtgtttccagatcgatcctg

SEQ ID NO: 1610570 - DNA, 23 bp, Homo sapiens
gtgtgtttccagatcgatcctgg

SEQ ID NO: 1610571 - DNA, 22 bp, Homo sapiens
gtgttaaacactacacatttga

SEQ ID NO: 1610572 - DNA, 20 bp, Homo sapiens
gtgttaattgcgtagaggct

SEQ ID NO: 1610573 - DNA, 14 bp, Homo sapiens
gtgttaattttgct

SEQ ID NO: 1610574 - DNA, 21 bp, Homo sapiens
gtgttacacagcccaagagga

SEQ ID NO: 1610575 - DNA, 23 bp, Homo sapiens
gtgttacacagcccaagaggact

SEQ ID NO: 1610576 - DNA, 14 bp, Homo sapiens
gtgttacccactgc

SEQ ID NO: 1610577 - DNA, 15 bp, Homo sapiens
gtgttacctgtgtgc

SEQ ID NO: 1610578 - DNA, 15 bp, Homo sapiens
gtgttactgctttgc

SEQ ID NO: 1610579 - DNA, 19 bp, Homo sapiens
gtgttactgctttgcaaag

SEQ ID NO: 1610580 - DNA, 13 bp, Homo sapiens
gtgttagagaaat

SEQ ID NO: 1610581 - DNA, 19 bp, Homo sapiens
gtgttaggaggctgcatgc

SEQ ID NO: 1610582 - DNA, 15 bp, Homo sapiens
gtgttagtggcaccg

SEQ ID NO: 1610583 - DNA, 17 bp, Homo sapiens
gtgttagtgtgtgtgca

SEQ ID NO: 1610584 - DNA, 22 bp, Homo sapiens
gtgttatgaacatccaagtctt

SEQ ID NO: 1610585 - DNA, 17 bp, Homo sapiens
gtgttatttaaatgagt

SEQ ID NO: 1610586 - DNA, 21 bp, Homo sapiens
gtgttatttccccagccacag

SEQ ID NO: 1610587 - DNA, 15 bp, Homo sapiens
gtgttcaagaaataa

SEQ ID NO: 1610588 - DNA, 14 bp, Homo sapiens
gtgttcaatatttt

SEQ ID NO: 1610589 - DNA, 16 bp, Homo sapiens
gtgttcaatattttct

SEQ ID NO: 1610590 - DNA, 16 bp, Homo sapiens
gtgttcagcagaacct

SEQ ID NO: 1610591 - DNA, 17 bp, Homo sapiens
gtgttcatacatttgag

SEQ ID NO: 1610592 - DNA, 14 bp, Homo sapiens
gtgttcattgtttc

SEQ ID NO: 1610593 - DNA, 14 bp, Homo sapiens
gtgttcatttcatt

SEQ ID NO: 1610594 - DNA, 23 bp, Homo sapiens
gtgttccctgagaaacccaccag

SEQ ID NO: 1610595 - DNA, 22 bp, Homo sapiens
gtgttcctcggtgggccagagc

SEQ ID NO: 1610596 - DNA, 23 bp, Homo sapiens
gtgttcctcggtgggccagagct

SEQ ID NO: 1610597 - DNA, 21 bp, Homo sapiens
gtgttcctttttaaatgtgaa

SEQ ID NO: 1610598 - DNA, 18 bp, Homo sapiens
gtgttctcatgaagcagg

SEQ ID NO: 1610599 - DNA, 21 bp, Homo sapiens
gtgttctcatgaagcaggagg

SEQ ID NO: 1610600 - DNA, 11 bp, Homo sapiens
gtgttctcctt

SEQ ID NO: 1610601 - DNA, 14 bp, Homo sapiens
gtgttctctcttat

SEQ ID NO: 1610602 - DNA, 14 bp, Homo sapiens
gtgttctgctcctg

SEQ ID NO: 1610603 - DNA, 16 bp, Homo sapiens
gtgttctgctcctgct

SEQ ID NO: 1610604 - DNA, 17 bp, Homo sapiens
gtgttctgctcctgctt

SEQ ID NO: 1610605 - DNA, 21 bp, Homo sapiens
gtgttctgctcctgcttttct

SEQ ID NO: 1610606 - DNA, 19 bp, Homo sapiens
gtgttcttaggtttactgt

SEQ ID NO: 1610607 - DNA, 14 bp, Homo sapiens
gtgttcttcagtgt

SEQ ID NO: 1610608 - DNA, 12 bp, Homo sapiens
gtgttcttttct

SEQ ID NO: 1610609 - DNA, 21 bp, Homo sapiens
gtgttgaagagcagctccttc

SEQ ID NO: 1610610 - DNA, 15 bp, Homo sapiens
gtgttgagatccagt

SEQ ID NO: 1610611 - DNA, 19 bp, Homo sapiens
gtgttgagccttttccctc

SEQ ID NO: 1610612 - DNA, 14 bp, Homo sapiens
gtgttgaggttttt

SEQ ID NO: 1610613 - DNA, 21 bp, Homo sapiens
gtgttgcaaattattctagtc

SEQ ID NO: 1610614 - DNA, 19 bp, Homo sapiens
gtgttgccaaatatgtcct

SEQ ID NO: 1610615 - DNA, 20 bp, Homo sapiens
gtgttgccaaatatgtcctg

SEQ ID NO: 1610616 - DNA, 18 bp, Homo sapiens
gtgttgcgtgtcgtgggt

SEQ ID NO: 1610617 - DNA, 17 bp, Homo sapiens
gtgttgctgtggctcca

SEQ ID NO: 1610618 - DNA, 16 bp, Homo sapiens
gtgttgcttatgttgt

SEQ ID NO: 1610619 - DNA, 14 bp, Homo sapiens
gtgttggcattggt

SEQ ID NO: 1610620 - DNA, 19 bp, Homo sapiens
gtgttggctgtgtgacaga

SEQ ID NO: 1610621 - DNA, 18 bp, Homo sapiens
gtgttgggacctgctgct

SEQ ID NO: 1610622 - DNA, 21 bp, Homo sapiens
gtgttgggaggggaagggctg

SEQ ID NO: 1610623 - DNA, 14 bp, Homo sapiens
gtgttgtatgcctt

SEQ ID NO: 1610624 - DNA, 16 bp, Homo sapiens
gtgttgtcttgaaaga

SEQ ID NO: 1610625 - DNA, 14 bp, Homo sapiens
gtgttgtgttcctg

SEQ ID NO: 1610626 - DNA, 20 bp, Homo sapiens
gtgttgttgttgctgctgtt

SEQ ID NO: 1610627 - DNA, 14 bp, Homo sapiens
gtgtttaccctgaa

SEQ ID NO: 1610628 - DNA, 14 bp, Homo sapiens
gtgtttataaaata

SEQ ID NO: 1610629 - DNA, 12 bp, Homo sapiens
gtgtttccagaa

SEQ ID NO: 1610630 - DNA, 14 bp, Homo sapiens
gtgtttccatctca

SEQ ID NO: 1610631 - DNA, 12 bp, Homo sapiens
gtgtttcccata

SEQ ID NO: 1610632 - DNA, 11 bp, Homo sapiens
gtgtttctagg

SEQ ID NO: 1610633 - DNA, 13 bp, Homo sapiens
gtgtttctatctc

SEQ ID NO: 1610634 - DNA, 11 bp, Homo sapiens
gtgtttctgga

SEQ ID NO: 1610635 - DNA, 12 bp, Homo sapiens
gtgtttctggag

SEQ ID NO: 1610636 - DNA, 13 bp, Homo sapiens
gtgtttctggagt

SEQ ID NO: 1610637 - DNA, 23 bp, Homo sapiens
gtgtttctggagtgattctagag

SEQ ID NO: 1610638 - DNA, 23 bp, Homo sapiens
gtgtttgatggtgccagagaggg

SEQ ID NO: 1610639 - DNA, 17 bp, Homo sapiens
gtgtttggtttcttcat

SEQ ID NO: 1610640 - DNA, 23 bp, Homo sapiens
gtgtttgttcataataaaagtga

SEQ ID NO: 1610641 - DNA, 14 bp, Homo sapiens
gtgttttaattgta

SEQ ID NO: 1610642 - DNA, 13 bp, Homo sapiens
gtgttttaattta

SEQ ID NO: 1610643 - DNA, 14 bp, Homo sapiens
gtgtttttctatat

SEQ ID NO: 1610644 - DNA, 15 bp, Homo sapiens
gtgttttttaagata

SEQ ID NO: 1610645 - DNA, 20 bp, Homo sapiens
gtgttttttttttttttgtg

SEQ ID NO: 1610646 - DNA, 20 bp, Homo sapiens
gttaaaaaaaggcattgttt

SEQ ID NO: 1610647 - DNA, 12 bp, Homo sapiens
gttaaaaaggcc

SEQ ID NO: 1610648 - DNA, 15 bp, Homo sapiens
gttaaaaaggccaaa

SEQ ID NO: 1610649 - DNA, 23 bp, Homo sapiens
gttaaaaataaaaactaatttca

SEQ ID NO: 1610650 - DNA, 19 bp, Homo sapiens
gttaaaactgtacatttaa

SEQ ID NO: 1610651 - DNA, 14 bp, Homo sapiens
gttaaaagatgaaa

SEQ ID NO: 1610652 - DNA, 15 bp, Homo sapiens
gttaaaataaagcct

SEQ ID NO: 1610653 - DNA, 21 bp, Homo sapiens
gttaaactaaaaaaaaaaagg

SEQ ID NO: 1610654 - DNA, 23 bp, Homo sapiens
gttaaactattagagtatttccc

SEQ ID NO: 1610655 - DNA, 17 bp, Homo sapiens
gttaaagcatcagagat

SEQ ID NO: 1610656 - DNA, 21 bp, Homo sapiens
gttaaagggatatttttttct

SEQ ID NO: 1610657 - DNA, 20 bp, Homo sapiens
gttaaatacaggaaacagtt

SEQ ID NO: 1610658 - DNA, 21 bp, Homo sapiens
gttaaatagagtatatgcact

SEQ ID NO: 1610659 - DNA, 19 bp, Homo sapiens
gttaaatatgtagatcaag

SEQ ID NO: 1610660 - DNA, 15 bp, Homo sapiens
gttaaattcagtaat

SEQ ID NO: 1610661 - DNA, 18 bp, Homo sapiens
gttaaattccatatgctc

SEQ ID NO: 1610662 - DNA, 12 bp, Homo sapiens
gttaacaaatga

SEQ ID NO: 1610663 - DNA, 19 bp, Homo sapiens
gttaacaaatgagccatcc

SEQ ID NO: 1610664 - DNA, 19 bp, Homo sapiens
tcgtgtgcaacagacaagt

SEQ ID NO: 1610665 - DNA, 21 bp, Homo sapiens
tcgtgtgtgttatttccccag

SEQ ID NO: 1610666 - DNA, 22 bp, Homo sapiens
tcgtgtgtgttatttccccagc

SEQ ID NO: 1610667 - DNA, 16 bp, Homo sapiens
tcgttaaaaagttgtt

SEQ ID NO: 1610668 - DNA, 14 bp, Homo sapiens
tcgttaacattgac

SEQ ID NO: 1610669 - DNA, 13 bp, Homo sapiens
tcgttctctgcct

SEQ ID NO: 1610670 - DNA, 18 bp, Homo sapiens
tcgttctgctgaccaaat

SEQ ID NO: 1610671 - DNA, 20 bp, Homo sapiens
tcgttctgctgaccaaatgg

SEQ ID NO: 1610672 - DNA, 23 bp, Homo sapiens
tcgttctgctgaccaaatggcca

SEQ ID NO: 1610673 - DNA, 21 bp, Homo sapiens
tcgttctgtactgttactggg

SEQ ID NO: 1610674 - DNA, 12 bp, Homo sapiens
tcgttggagagc

SEQ ID NO: 1610675 - DNA, 18 bp, Homo sapiens
tcgttggagagcagcagg

SEQ ID NO: 1610676 - DNA, 22 bp, Homo sapiens
tcgttggttatacaagttcttg

SEQ ID NO: 1610677 - DNA, 19 bp, Homo sapiens
tcgttgttattaaagaatc

SEQ ID NO: 1610678 - DNA, 14 bp, Homo sapiens
tcgtttccatcatg

SEQ ID NO: 1610679 - DNA, 13 bp, Homo sapiens
tcgtttctgtata

SEQ ID NO: 1610680 - DNA, 14 bp, Homo sapiens
tctaaaaaataact

SEQ ID NO: 1610681 - DNA, 16 bp, Homo sapiens
tctaaaaaataactgt

SEQ ID NO: 1610682 - DNA, 15 bp, Homo sapiens
tctaaaaagaagcca

SEQ ID NO: 1610683 - DNA, 15 bp, Homo sapiens
tctaaaaataaagct

SEQ ID NO: 1610684 - DNA, 14 bp, Homo sapiens
tctaaaaatataca

SEQ ID NO: 1610685 - DNA, 15 bp, Homo sapiens
tctaaaaatatacat

SEQ ID NO: 1610686 - DNA, 19 bp, Homo sapiens
tctaaaaatatacatgttt

SEQ ID NO: 1610687 - DNA, 17 bp, Homo sapiens
tctaaaaatgaagatga

SEQ ID NO: 1610688 - DNA, 16 bp, Homo sapiens
tctaaaacaataaaga

SEQ ID NO: 1610689 - DNA, 21 bp, Homo sapiens
tctaaaactatggttcccaat

SEQ ID NO: 1610690 - DNA, 16 bp, Homo sapiens
tctaaaagcagaaaat

SEQ ID NO: 1610691 - DNA, 17 bp, Homo sapiens
tctaaaagcagaaaata

SEQ ID NO: 1610692 - DNA, 17 bp, Homo sapiens
tctaaaaggtaatgtgt

SEQ ID NO: 1610693 - DNA, 23 bp, Homo sapiens
tctaaaagtttctacattcagat

SEQ ID NO: 1610694 - DNA, 22 bp, Homo sapiens
tctaaaatatttatgaagaaaa

SEQ ID NO: 1610695 - DNA, 14 bp, Homo sapiens
tctaaaatcatgaa

SEQ ID NO: 1610696 - DNA, 18 bp, Homo sapiens
tctaaaatcttatagttc

SEQ ID NO: 1610697 - DNA, 19 bp, Homo sapiens
tctaaaatcttatagttct

SEQ ID NO: 1610698 - DNA, 18 bp, Homo sapiens
tctaaaatgtgatgttct

SEQ ID NO: 1610699 - DNA, 13 bp, Homo sapiens
tctaaaatttaaa

SEQ ID NO: 1610700 - DNA, 19 bp, Homo sapiens
tctaaacaagattttaaag

SEQ ID NO: 1610701 - DNA, 20 bp, Homo sapiens
tctaaacaatgctgatttgg

SEQ ID NO: 1610702 - DNA, 16 bp, Homo sapiens
tctaaacattttttct

SEQ ID NO: 1610703 - DNA, 20 bp, Homo sapiens
tctaaaccccagattcttca

SEQ ID NO: 1610704 - DNA, 13 bp, Homo sapiens
tctaaactgtttt

SEQ ID NO: 1610705 - DNA, 15 bp, Homo sapiens
tctaaactgttttca

SEQ ID NO: 1610706 - DNA, 19 bp, Homo sapiens
tctaaagaaaaatgcctgt

SEQ ID NO: 1610707 - DNA, 19 bp, Homo sapiens
tctaaagatggagtttcta

SEQ ID NO: 1610708 - DNA, 23 bp, Homo sapiens
tctaaagatggagtttctaaggt

SEQ ID NO: 1610709 - DNA, 15 bp, Homo sapiens
tctaaagattctata

SEQ ID NO: 1610710 - DNA, 20 bp, Homo sapiens
tctaaagattctatagttct

SEQ ID NO: 1610711 - DNA, 18 bp, Homo sapiens
tctaaagctttggacaag

SEQ ID NO: 1610712 - DNA, 23 bp, Homo sapiens
tctaaaggtccacaggtctagac

SEQ ID NO: 1610713 - DNA, 14 bp, Homo sapiens
tctaaagttctaag

SEQ ID NO: 1610714 - DNA, 16 bp, Homo sapiens
tctaaataaaaatatg

SEQ ID NO: 1610715 - DNA, 21 bp, Homo sapiens
tctaaataaaaatatgtaatt

SEQ ID NO: 1610716 - DNA, 13 bp, Homo sapiens
tctaaatatttcc

SEQ ID NO: 1610717 - DNA, 17 bp, Homo sapiens
tctaaatctatttatta

SEQ ID NO: 1610718 - DNA, 19 bp, Homo sapiens
tctaaatctatttattaat

SEQ ID NO: 1610719 - DNA, 21 bp, Homo sapiens
tctaaatctatttattaatat

SEQ ID NO: 1610720 - DNA, 16 bp, Homo sapiens
tctaaatcttccttgt

SEQ ID NO: 1610721 - DNA, 22 bp, Homo sapiens
tctaaatttgaatgttaagcag

SEQ ID NO: 1610722 - DNA, 18 bp, Homo sapiens
tctaaattttatatcttg

SEQ ID NO: 1610723 - DNA, 22 bp, Homo sapiens
tctaacagccctcctctgcact

SEQ ID NO: 1610724 - DNA, 18 bp, Homo sapiens
tctaacagtccttgcttt

SEQ ID NO: 1610725 - DNA, 13 bp, Homo sapiens
tctaaccagtgta

SEQ ID NO: 1610726 - DNA, 15 bp, Homo sapiens
tctaaccctcccatg

SEQ ID NO: 1610727 - DNA, 19 bp, Homo sapiens
tctaaccttgaatgctgcc

SEQ ID NO: 1610728 - DNA, 15 bp, Homo sapiens
tctaacgctgaactg

SEQ ID NO: 1610729 - DNA, 22 bp, Homo sapiens
tctaacgctgaactgacaatga

SEQ ID NO: 1610730 - DNA, 14 bp, Homo sapiens
tctaactcagaatt

SEQ ID NO: 1610731 - DNA, 18 bp, Homo sapiens
tctaactggacatgaagg

SEQ ID NO: 1610732 - DNA, 13 bp, Homo sapiens
tctaagaaaatgt

SEQ ID NO: 1610733 - DNA, 16 bp, Homo sapiens
tctaagaaaatgtagt

SEQ ID NO: 1610734 - DNA, 18 bp, Homo sapiens
tctaagaagacattttgt

SEQ ID NO: 1610735 - DNA, 19 bp, Homo sapiens
tctaagaagacattttgtt

SEQ ID NO: 1610736 - DNA, 20 bp, Homo sapiens
tctaagaatttctgctaaat

SEQ ID NO: 1610737 - DNA, 16 bp, Homo sapiens
tctaagactcaaatgt

SEQ ID NO: 1610738 - DNA, 21 bp, Homo sapiens
tctaagactcaaatgttctaa

SEQ ID NO: 1610739 - DNA, 22 bp, Homo sapiens
tctaagactcaaatgttctaag

SEQ ID NO: 1610740 - DNA, 20 bp, Homo sapiens
tctaagacttactctaagat

SEQ ID NO: 1610741 - DNA, 20 bp, Homo sapiens
tctaagagcgaacttcacat

SEQ ID NO: 1610742 - DNA, 12 bp, Homo sapiens
tctaagatgtga

SEQ ID NO: 1610743 - DNA, 18 bp, Homo sapiens
tctaagatgtgatattct

SEQ ID NO: 1610744 - DNA, 13 bp, Homo sapiens
tctaagattctag

SEQ ID NO: 1610745 - DNA, 16 bp, Homo sapiens
tctaagattctagatc

SEQ ID NO: 1610746 - DNA, 19 bp, Homo sapiens
tctaagattctgattttag

SEQ ID NO: 1610747 - DNA, 16 bp, Homo sapiens
tctaagcaagatgttt

SEQ ID NO: 1610748 - DNA, 18 bp, Homo sapiens
tctaagcaagatgttttg

SEQ ID NO: 1610749 - DNA, 20 bp, Homo sapiens
tctaagccctgttctcctgt

SEQ ID NO: 1610750 - DNA, 17 bp, Homo sapiens
tctaagcctttccataa

SEQ ID NO: 1610751 - DNA, 18 bp, Homo sapiens
tctaagcctttccataag

SEQ ID NO: 1610752 - DNA, 21 bp, Homo sapiens
tctaagctggagctcttggaa

SEQ ID NO: 1610753 - DNA, 14 bp, Homo sapiens
tctaagcttatttc

SEQ ID NO: 1610754 - DNA, 20 bp, Homo sapiens
tctaaggaaatggagaagct

SEQ ID NO: 1610755 - DNA, 17 bp, Homo sapiens
tctaaggacctgaaatt

SEQ ID NO: 1610756 - DNA, 19 bp, Homo sapiens
tctaaggcctaggattcta

SEQ ID NO: 1610757 - DNA, 21 bp, Homo sapiens
tctaaggcctaggattctaaa

SEQ ID NO: 1610758 - DNA, 23 bp, Homo sapiens
tctaagtaaaaccacagcagttg

SEQ ID NO: 1610759 - DNA, 20 bp, Homo sapiens
tctaagtcagtttcacatat

SEQ ID NO: 1610760 - DNA, 18 bp, Homo sapiens
tctaagttcatgtttgta

SEQ ID NO: 1610761 - DNA, 20 bp, Homo sapiens
tctaagttcatgtttgtaaa

SEQ ID NO: 1610762 - DNA, 14 bp, Homo sapiens
tctaagtttctaag

SEQ ID NO: 1610763 - DNA, 20 bp, Homo sapiens
tctaagtttctaagattcta

SEQ ID NO: 1610764 - DNA, 14 bp, Homo sapiens
tctaataaacactg

SEQ ID NO: 1610765 - DNA, 22 bp, Homo sapiens
tctaataaacttggattctcta

SEQ ID NO: 1610766 - DNA, 14 bp, Homo sapiens
tctaataaacttta

SEQ ID NO: 1610767 - DNA, 16 bp, Homo sapiens
tctaataatttctaat

SEQ ID NO: 1610768 - DNA, 16 bp, Homo sapiens
tctaatacctctgtgt

SEQ ID NO: 1610769 - DNA, 17 bp, Homo sapiens
tctaatacctctgtgtg

SEQ ID NO: 1610770 - DNA, 22 bp, Homo sapiens
tctaatacgagccttctcaccc

SEQ ID NO: 1610771 - DNA, 12 bp, Homo sapiens
tctaatagtctt

SEQ ID NO: 1610772 - DNA, 14 bp, Homo sapiens
tctaatcacagtgt

SEQ ID NO: 1610773 - DNA, 17 bp, Homo sapiens
tctaatccttttcctta

SEQ ID NO: 1610774 - DNA, 22 bp, Homo sapiens
tctaatccttttccttatttgc

SEQ ID NO: 1610775 - DNA, 19 bp, Homo sapiens
tctaatctagatatcgact

SEQ ID NO: 1610776 - DNA, 16 bp, Homo sapiens
tctaatctcttattct

SEQ ID NO: 1610777 - DNA, 21 bp, Homo sapiens
tctaatctcttattctaataa

SEQ ID NO: 1610778 - DNA, 11 bp, Homo sapiens
tctaatgaaga

SEQ ID NO: 1610779 - DNA, 14 bp, Homo sapiens
tctaatgaagagaa

SEQ ID NO: 1610780 - DNA, 18 bp, Homo sapiens
tctaccggagagagaatg

SEQ ID NO: 1610781 - DNA, 15 bp, Homo sapiens
tctacctggtctggt

SEQ ID NO: 1610782 - DNA, 15 bp, Homo sapiens
tctaccttgcagtgt

SEQ ID NO: 1610783 - DNA, 18 bp, Homo sapiens
tctacggatcatcaacaa

SEQ ID NO: 1610784 - DNA, 21 bp, Homo sapiens
tctacggatcatcaacaagat

SEQ ID NO: 1610785 - DNA, 21 bp, Homo sapiens
tctactaaaaagaaggaaaat

SEQ ID NO: 1610786 - DNA, 15 bp, Homo sapiens
tctactaaaaataca

SEQ ID NO: 1610787 - DNA, 21 bp, Homo sapiens
tctactaaaattcaaaaacaa

SEQ ID NO: 1610788 - DNA, 18 bp, Homo sapiens
tctactcagcatttgatt

SEQ ID NO: 1610789 - DNA, 12 bp, Homo sapiens
tctactcccctt

SEQ ID NO: 1610790 - DNA, 16 bp, Homo sapiens
tctactcctagaagaa

SEQ ID NO: 1610791 - DNA, 19 bp, Homo sapiens
tctactccttgtaaagact

SEQ ID NO: 1610792 - DNA, 13 bp, Homo sapiens
tctactctagaag

SEQ ID NO: 1610793 - DNA, 21 bp, Homo sapiens
tctactgaattggcttccaga

SEQ ID NO: 1610794 - DNA, 21 bp, Homo sapiens
tctactgacccaactgggggc

SEQ ID NO: 1610795 - DNA, 19 bp, Homo sapiens
tctactgaggtgctatgtt

SEQ ID NO: 1610796 - DNA, 22 bp, Homo sapiens
tctactgaggtgctatgttctt

SEQ ID NO: 1610797 - DNA, 14 bp, Homo sapiens
tctactgccctccc

SEQ ID NO: 1610798 - DNA, 17 bp, Homo sapiens
tctactgccctcccctt

SEQ ID NO: 1610799 - DNA, 20 bp, Homo sapiens
tctactgccctccccttccc

SEQ ID NO: 1610800 - DNA, 21 bp, Homo sapiens
tctactgccctccccttcccc

SEQ ID NO: 1610801 - DNA, 22 bp, Homo sapiens
tctactggaaatgtagcactta

SEQ ID NO: 1610802 - DNA, 14 bp, Homo sapiens
tctactggcctgta

SEQ ID NO: 1610803 - DNA, 13 bp, Homo sapiens
tctacttaataaa

SEQ ID NO: 1610804 - DNA, 20 bp, Homo sapiens
tctacttgtccagttcaaat

SEQ ID NO: 1610805 - DNA, 15 bp, Homo sapiens
tctactttgattctg

SEQ ID NO: 1610806 - DNA, 16 bp, Homo sapiens
tctactttgattctga

SEQ ID NO: 1610807 - DNA, 14 bp, Homo sapiens
tctagaaaaaaggg

SEQ ID NO: 1610808 - DNA, 16 bp, Homo sapiens
tctagaaagaaaagac

SEQ ID NO: 1610809 - DNA, 20 bp, Homo sapiens
tctagaaagaaaagaccctg

SEQ ID NO: 1610810 - DNA, 21 bp, Homo sapiens
tctagaaagaaaagaccctga

SEQ ID NO: 1610811 - DNA, 20 bp, Homo sapiens
tctagaaagctttgaatgca

SEQ ID NO: 1610812 - DNA, 22 bp, Homo sapiens
tctagaaataaatgttacctaa

SEQ ID NO: 1610813 - DNA, 13 bp, Homo sapiens
tctagaacacagg

SEQ ID NO: 1610814 - DNA, 19 bp, Homo sapiens
tctagaacatgcacattta

SEQ ID NO: 1610815 - DNA, 16 bp, Homo sapiens
tctagaagatgtgtaa

SEQ ID NO: 1610816 - DNA, 19 bp, Homo sapiens
tctagaagatgtgtaaaca

SEQ ID NO: 1610817 - DNA, 23 bp, Homo sapiens
tctagaagatgtgtaaacaggta

SEQ ID NO: 1610818 - DNA, 23 bp, Homo sapiens
tctagaagccaagggaaaggggt

SEQ ID NO: 1610819 - DNA, 19 bp, Homo sapiens
tctagaatcccagcagcag

SEQ ID NO: 1610820 - DNA, 23 bp, Homo sapiens
tctagaatctgcaattcaaaagt

SEQ ID NO: 1610821 - DNA, 11 bp, Homo sapiens
tctagaatgtg

SEQ ID NO: 1610822 - DNA, 19 bp, Homo sapiens
tctagaatttatcacactt

SEQ ID NO: 1610823 - DNA, 16 bp, Homo sapiens
tctagaattttaagcc

SEQ ID NO: 1610824 - DNA, 13 bp, Homo sapiens
tctagacaagata

SEQ ID NO: 1610825 - DNA, 20 bp, Homo sapiens
tctagacaagatattgtaca

SEQ ID NO: 1610826 - DNA, 21 bp, Homo sapiens
tctagacaagatattgtacat

SEQ ID NO: 1610827 - DNA, 20 bp, Homo sapiens
tctagacacaatttcatttc

SEQ ID NO: 1610828 - DNA, 20 bp, Homo sapiens
tctagacatggaggttctaa

SEQ ID NO: 1610829 - DNA, 22 bp, Homo sapiens
tctagacatggaggttctaagg

SEQ ID NO: 1610830 - DNA, 14 bp, Homo sapiens
tctagacgcccctc

SEQ ID NO: 1610831 - DNA, 18 bp, Homo sapiens
tctagacgcccctcccaa

SEQ ID NO: 1610832 - DNA, 13 bp, Homo sapiens
tctagacttcccc

SEQ ID NO: 1610833 - DNA, 15 bp, Homo sapiens
tctagacttccccat

SEQ ID NO: 1610834 - DNA, 19 bp, Homo sapiens
tctagacttccccatcccg

SEQ ID NO: 1610835 - DNA, 16 bp, Homo sapiens
tctagagagccttaac

SEQ ID NO: 1610836 - DNA, 20 bp, Homo sapiens
tctagagccgtgatgcctcc

SEQ ID NO: 1610837 - DNA, 21 bp, Homo sapiens
tctagagcttaatgctacatg

SEQ ID NO: 1610838 - DNA, 19 bp, Homo sapiens
tctagagtttatacagtgt

SEQ ID NO: 1610839 - DNA, 21 bp, Homo sapiens
tctagatcagatgctccaaga

SEQ ID NO: 1610840 - DNA, 22 bp, Homo sapiens
tctagatcagatgctccaagat

SEQ ID NO: 1610841 - DNA, 14 bp, Homo sapiens
tctagatctcagcc

SEQ ID NO: 1610842 - DNA, 19 bp, Homo sapiens
tctagatggaccccagcat

SEQ ID NO: 1610843 - DNA, 16 bp, Homo sapiens
tctagattcataaata

SEQ ID NO: 1610844 - DNA, 21 bp, Homo sapiens
tctagattccattggtccaag

SEQ ID NO: 1610845 - DNA, 11 bp, Homo sapiens
tttctgagccc

SEQ ID NO: 1610846 - DNA, 16 bp, Homo sapiens
tttctgagcttttcat

SEQ ID NO: 1610847 - DNA, 16 bp, Homo sapiens
tttctgaggtccttat

SEQ ID NO: 1610848 - DNA, 15 bp, Homo sapiens
tttctgattactgtc

SEQ ID NO: 1610849 - DNA, 15 bp, Homo sapiens
tttctgcagctgttt

SEQ ID NO: 1610850 - DNA, 24 bp, Homo sapiens
tttctgcatgaccaaagtgataaa

SEQ ID NO: 1610851 - DNA, 16 bp, Homo sapiens
tttctgccagggagct

SEQ ID NO: 1610852 - DNA, 14 bp, Homo sapiens
tttctgccctgggt

SEQ ID NO: 1610853 - DNA, 17 bp, Homo sapiens
tttctgcctgagattct

SEQ ID NO: 1610854 - DNA, 13 bp, Homo sapiens
tttctggactccc

SEQ ID NO: 1610855 - DNA, 21 bp, Homo sapiens
tttctggactgaagcctgcag

SEQ ID NO: 1610856 - DNA, 20 bp, Homo sapiens
tttctggagtgattctagag

SEQ ID NO: 1610857 - DNA, 11 bp, Homo sapiens
tttctggcaaa

SEQ ID NO: 1610858 - DNA, 21 bp, Homo sapiens
tttctggccaaaagcagtaaa

SEQ ID NO: 1610859 - DNA, 16 bp, Homo sapiens
tttctggctgggtcac

SEQ ID NO: 1610860 - DNA, 19 bp, Homo sapiens
tttctgggatgtcacagtc

SEQ ID NO: 1610861 - DNA, 17 bp, Homo sapiens
tttctggggaaagggga

SEQ ID NO: 1610862 - DNA, 15 bp, Homo sapiens
tttctgggtcttttg

SEQ ID NO: 1610863 - DNA, 23 bp, Homo sapiens
tttctggtaggaagatggaggtt

SEQ ID NO: 1610864 - DNA, 24 bp, Homo sapiens
tttctggtgccatttctgaactgt

SEQ ID NO: 1610865 - DNA, 22 bp, Homo sapiens
tttctggtggggctgtcctgct

SEQ ID NO: 1610866 - DNA, 23 bp, Homo sapiens
tttctggtggggctgtcctgctg

SEQ ID NO: 1610867 - DNA, 17 bp, Homo sapiens
tttctggtggtctgttg

SEQ ID NO: 1610868 - DNA, 15 bp, Homo sapiens
tttctggtgtatatt

SEQ ID NO: 1610869 - DNA, 14 bp, Homo sapiens
tttctgtaaataac

SEQ ID NO: 1610870 - DNA, 16 bp, Homo sapiens
tttctgtaaataacct

SEQ ID NO: 1610871 - DNA, 19 bp, Homo sapiens
tttctgtaattcaggtttt

SEQ ID NO: 1610872 - DNA, 15 bp, Homo sapiens
tttctgtaccagtta

SEQ ID NO: 1610873 - DNA, 17 bp, Homo sapiens
tttctgtctcccttctc

SEQ ID NO: 1610874 - DNA, 15 bp, Homo sapiens
tttctgtgaaattct

SEQ ID NO: 1610875 - DNA, 19 bp, Homo sapiens
tttctgtgaaattctcaga

SEQ ID NO: 1610876 - DNA, 14 bp, Homo sapiens
tttctgtgcttgga

SEQ ID NO: 1610877 - DNA, 14 bp, Homo sapiens
tttctgttaaaatg

SEQ ID NO: 1610878 - DNA, 20 bp, Homo sapiens
tttctgttcagcgttttgca

SEQ ID NO: 1610879 - DNA, 15 bp, Homo sapiens
tttctgttctgttga

SEQ ID NO: 1610880 - DNA, 19 bp, Homo sapiens
tttctgttcttacaaatgt

SEQ ID NO: 1610881 - DNA, 23 bp, Homo sapiens
tttctgttcttacaaatgtgaaa

SEQ ID NO: 1610882 - DNA, 20 bp, Homo sapiens
tttcttaaaagtactttaaa

SEQ ID NO: 1610883 - DNA, 16 bp, Homo sapiens
tttcttaaaccttcag

SEQ ID NO: 1610884 - DNA, 23 bp, Homo sapiens
tttcttaaataatgcttcagata

SEQ ID NO: 1610885 - DNA, 22 bp, Homo sapiens
tttcttaaatggaattattttg

SEQ ID NO: 1610886 - DNA, 18 bp, Homo sapiens
tttcttaacttcttgctt

SEQ ID NO: 1610887 - DNA, 21 bp, Homo sapiens
tttcttaacttcttgcttctt

SEQ ID NO: 1610888 - DNA, 23 bp, Homo sapiens
tttcttaagtaatgatactgtgt

SEQ ID NO: 1610889 - DNA, 21 bp, Homo sapiens
tttcttagtgcttcagagttt

SEQ ID NO: 1610890 - DNA, 23 bp, Homo sapiens
tttcttagtgcttcagagtttgt

SEQ ID NO: 1610891 - DNA, 13 bp, Homo sapiens
tttcttcatccaa

SEQ ID NO: 1610892 - DNA, 12 bp, Homo sapiens
tttcttcatgag

SEQ ID NO: 1610893 - DNA, 16 bp, Homo sapiens
tttcttcatgcaatga

SEQ ID NO: 1610894 - DNA, 22 bp, Homo sapiens
tttcttcatgcaatgacatctt

SEQ ID NO: 1610895 - DNA, 18 bp, Homo sapiens
tttcttcatttctctgca

SEQ ID NO: 1610896 - DNA, 13 bp, Homo sapiens
tttcttccccagt

SEQ ID NO: 1610897 - DNA, 20 bp, Homo sapiens
tttcttccctgctttgcatc

SEQ ID NO: 1610898 - DNA, 13 bp, Homo sapiens
tttcttctacttt

SEQ ID NO: 1610899 - DNA, 15 bp, Homo sapiens
tttcttctctgtgag

SEQ ID NO: 1610900 - DNA, 17 bp, Homo sapiens
tttcttctgaagattct

SEQ ID NO: 1610901 - DNA, 23 bp, Homo sapiens
tttcttctgtatttttttttcta

SEQ ID NO: 1610902 - DNA, 12 bp, Homo sapiens
tttcttcttccc

SEQ ID NO: 1610903 - DNA, 17 bp, Homo sapiens
tttcttcttctaagaag

SEQ ID NO: 1610904 - DNA, 18 bp, Homo sapiens
tttcttcttctaagaaga

SEQ ID NO: 1610905 - DNA, 20 bp, Homo sapiens
tttcttcttctaagaagaca

SEQ ID NO: 1610906 - DNA, 15 bp, Homo sapiens
tttcttctttccctg

SEQ ID NO: 1610907 - DNA, 16 bp, Homo sapiens
tttcttctttccctgg

SEQ ID NO: 1610908 - DNA, 14 bp, Homo sapiens
tttcttctttctag

SEQ ID NO: 1610909 - DNA, 17 bp, Homo sapiens
tttcttgatcttaaaga

SEQ ID NO: 1610910 - DNA, 15 bp, Homo sapiens
tttcttgcagattct

SEQ ID NO: 1610911 - DNA, 20 bp, Homo sapiens
tttcttggaactgtcccagc

SEQ ID NO: 1610912 - DNA, 14 bp, Homo sapiens
tttcttgtaaatgt

SEQ ID NO: 1610913 - DNA, 14 bp, Homo sapiens
tttcttgtttgtca

SEQ ID NO: 1610914 - DNA, 18 bp, Homo sapiens
tttcttgtttgtcagcat

SEQ ID NO: 1610915 - DNA, 12 bp, Homo sapiens
tttctttaactg

SEQ ID NO: 1610916 - DNA, 17 bp, Homo sapiens
tttctttacttatctct

SEQ ID NO: 1610917 - DNA, 19 bp, Homo sapiens
tttctttcaacttgcatcc

SEQ ID NO: 1610918 - DNA, 14 bp, Homo sapiens
tttctttccaaaac

SEQ ID NO: 1610919 - DNA, 14 bp, Homo sapiens
tttctttcccatgt

SEQ ID NO: 1610920 - DNA, 19 bp, Homo sapiens
tttctttcctgtaaagaaa

SEQ ID NO: 1610921 - DNA, 10 bp, Homo sapiens
tttctttctt

SEQ ID NO: 1610922 - DNA, 14 bp, Homo sapiens
tttctttcttcctc

SEQ ID NO: 1610923 - DNA, 22 bp, Homo sapiens
tttctttgaccagatctttctc

SEQ ID NO: 1610924 - DNA, 12 bp, Homo sapiens
tttctttgagga

SEQ ID NO: 1610925 - DNA, 15 bp, Homo sapiens
tttctttgcattcca

SEQ ID NO: 1610926 - DNA, 13 bp, Homo sapiens
tttctttgcctct

SEQ ID NO: 1610927 - DNA, 15 bp, Homo sapiens
tttctttgtgtagct

SEQ ID NO: 1610928 - DNA, 16 bp, Homo sapiens
tttctttgttatcaaa

SEQ ID NO: 1610929 - DNA, 16 bp, Homo sapiens
tttcttttatatctgt

SEQ ID NO: 1610930 - DNA, 9 bp, Homo sapiens
tttcttttc

SEQ ID NO: 1610931 - DNA, 14 bp, Homo sapiens
tttcttttcacata

SEQ ID NO: 1610932 - DNA, 14 bp, Homo sapiens
tttcttttgtaatt

SEQ ID NO: 1610933 - DNA, 15 bp, Homo sapiens
tttctttttactgtt

SEQ ID NO: 1610934 - DNA, 19 bp, Homo sapiens
tttctttttcttcttccct

SEQ ID NO: 1610935 - DNA, 17 bp, Homo sapiens
tttcttttttaaaatca

SEQ ID NO: 1610936 - DNA, 15 bp, Homo sapiens
tttcttttttatctt

SEQ ID NO: 1610937 - DNA, 21 bp, Homo sapiens
tttctttttttaactggtgaa

SEQ ID NO: 1610938 - DNA, 14 bp, Homo sapiens
tttctttttttcct

SEQ ID NO: 1610939 - DNA, 19 bp, Homo sapiens
tttgaaaaattacagcttc

SEQ ID NO: 1610940 - DNA, 14 bp, Homo sapiens
tttgaaaacaaaaa

SEQ ID NO: 1610941 - DNA, 20 bp, Homo sapiens
tttgaaaaggcggtactagt

SEQ ID NO: 1610942 - DNA, 18 bp, Homo sapiens
tttgaaaattatgcaaaa

SEQ ID NO: 1610943 - DNA, 17 bp, Homo sapiens
tttgaaaattttacttc

SEQ ID NO: 1610944 - DNA, 20 bp, Homo sapiens
tttgaaagacagagtcttca

SEQ ID NO: 1610945 - DNA, 22 bp, Homo sapiens
tttgaaataaaaaaagattttt

SEQ ID NO: 1610946 - DNA, 19 bp, Homo sapiens
tttgaaatagtctgtgtga

SEQ ID NO: 1610947 - DNA, 16 bp, Homo sapiens
tttgaaatgtgtttct

SEQ ID NO: 1610948 - DNA, 20 bp, Homo sapiens
tttgaacacgaaagaaatgt

SEQ ID NO: 1610949 - DNA, 16 bp, Homo sapiens
tttgaaccaacatctt

SEQ ID NO: 1610950 - DNA, 22 bp, Homo sapiens
tttgaacccccgccatccttca

SEQ ID NO: 1610951 - DNA, 16 bp, Homo sapiens
tttgaacgtgcttctt

SEQ ID NO: 1610952 - DNA, 17 bp, Homo sapiens
tttgaactggcaattgt

SEQ ID NO: 1610953 - DNA, 19 bp, Homo sapiens
tttgaactggcaattgtct

SEQ ID NO: 1610954 - DNA, 18 bp, Homo sapiens
tttgaagagtgaaatacc

SEQ ID NO: 1610955 - DNA, 20 bp, Homo sapiens
tttgaagcagtcttgctctg

SEQ ID NO: 1610956 - DNA, 13 bp, Homo sapiens
tttgaaggaaaca

SEQ ID NO: 1610957 - DNA, 20 bp, Homo sapiens
tttgaagtaacttatttgac

SEQ ID NO: 1610958 - DNA, 23 bp, Homo sapiens
tttgaagtaggtggcttgagcta

SEQ ID NO: 1610959 - DNA, 15 bp, Homo sapiens
tttgaagtgctgttt

SEQ ID NO: 1610960 - DNA, 13 bp, Homo sapiens
tttgaatacattt

SEQ ID NO: 1610961 - DNA, 22 bp, Homo sapiens
tttgaataccattaaaactgct

SEQ ID NO: 1610962 - DNA, 15 bp, Homo sapiens
tttagacaactagat

SEQ ID NO: 1610963 - DNA, 13 bp, Homo sapiens
tttagagagcctg

SEQ ID NO: 1610964 - DNA, 23 bp, Homo sapiens
tttagagagcctgtcaccagagc

SEQ ID NO: 1610965 - DNA, 16 bp, Homo sapiens
tttagagataattgct

SEQ ID NO: 1610966 - DNA, 17 bp, Homo sapiens
tttagagataattgctt

SEQ ID NO: 1610967 - DNA, 18 bp, Homo sapiens
tttagagataattgcttg

SEQ ID NO: 1610968 - DNA, 19 bp, Homo sapiens
tttagagataggaaactga

SEQ ID NO: 1610969 - DNA, 21 bp, Homo sapiens
tttagagatgaattaaattta

SEQ ID NO: 1610970 - DNA, 16 bp, Homo sapiens
tttagagccctcccta

SEQ ID NO: 1610971 - DNA, 16 bp, Homo sapiens
tttagagcttccaaat

SEQ ID NO: 1610972 - DNA, 21 bp, Homo sapiens
tttagatcccatgtcacctca

SEQ ID NO: 1610973 - DNA, 18 bp, Homo sapiens
tttagattgagaaatgtg

SEQ ID NO: 1610974 - DNA, 19 bp, Homo sapiens
tttagattttctggttcta

SEQ ID NO: 1610975 - DNA, 19 bp, Homo sapiens
tttagattttcttttgcct

SEQ ID NO: 1610976 - DNA, 23 bp, Homo sapiens
tttagcaaagcgggttataatga

SEQ ID NO: 1610977 - DNA, 14 bp, Homo sapiens
tttagcattaccta

SEQ ID NO: 1610978 - DNA, 17 bp, Homo sapiens
tttagcatttttatgca

SEQ ID NO: 1610979 - DNA, 19 bp, Homo sapiens
tttagcatttttatgcaga

SEQ ID NO: 1610980 - DNA, 11 bp, Homo sapiens
tttagccagtg

SEQ ID NO: 1610981 - DNA, 21 bp, Homo sapiens
tttagctacagcttgtttaac

SEQ ID NO: 1610982 - DNA, 18 bp, Homo sapiens
tttagctagtatcttcaa

SEQ ID NO: 1610983 - DNA, 19 bp, Homo sapiens
tttagctagtatcttcaaa

SEQ ID NO: 1610984 - DNA, 16 bp, Homo sapiens
tttagctgtgttatta

SEQ ID NO: 1610985 - DNA, 17 bp, Homo sapiens
tttagctgtgttattat

SEQ ID NO: 1610986 - DNA, 13 bp, Homo sapiens
tttagctttggaa

SEQ ID NO: 1610987 - DNA, 21 bp, Homo sapiens
tttaggaaatgggcagtgaag

SEQ ID NO: 1610988 - DNA, 16 bp, Homo sapiens
tttaggaacttcagag

SEQ ID NO: 1610989 - DNA, 16 bp, Homo sapiens
tttaggaatatgttca

SEQ ID NO: 1610990 - DNA, 16 bp, Homo sapiens
tttaggagaaaccagc

SEQ ID NO: 1610991 - DNA, 16 bp, Homo sapiens
tttaggagtgattact

SEQ ID NO: 1610992 - DNA, 12 bp, Homo sapiens
tttaggcttcta

SEQ ID NO: 1610993 - DNA, 13 bp, Homo sapiens
tttagggcagctt

SEQ ID NO: 1610994 - DNA, 15 bp, Homo sapiens
tttaggtaagaagtt

SEQ ID NO: 1610995 - DNA, 11 bp, Homo sapiens
tttaggttcta

SEQ ID NO: 1610996 - DNA, 13 bp, Homo sapiens
tttaggttctaaa

SEQ ID NO: 1610997 - DNA, 22 bp, Homo sapiens
tttagtatacgtataaatatca

SEQ ID NO: 1610998 - DNA, 17 bp, Homo sapiens
tttagtggatggaatat

SEQ ID NO: 1610999 - DNA, 18 bp, Homo sapiens
tttagtgtaaaattgtta

SEQ ID NO: 1611000 - DNA, 15 bp, Homo sapiens
tttagtgtctgacct

SEQ ID NO: 1611001 - DNA, 15 bp, Homo sapiens
tttagtgtgtgtgca

SEQ ID NO: 1611002 - DNA, 18 bp, Homo sapiens
tttagtgtttatgtttaa

SEQ ID NO: 1611003 - DNA, 23 bp, Homo sapiens
tttagttcaatatttgttactgt

SEQ ID NO: 1611004 - DNA, 14 bp, Homo sapiens
tttagttgaaaaat

SEQ ID NO: 1611005 - DNA, 18 bp, Homo sapiens
tttagttgaaaaatctag

SEQ ID NO: 1611006 - DNA, 11 bp, Homo sapiens
tttagttgaat

SEQ ID NO: 1611007 - DNA, 23 bp, Homo sapiens
tttagttgaattttttttaacat

SEQ ID NO: 1611008 - DNA, 19 bp, Homo sapiens
tttagtttaccaatcaaca

SEQ ID NO: 1611009 - DNA, 22 bp, Homo sapiens
tttagttttaaaagtctatgat

SEQ ID NO: 1611010 - DNA, 21 bp, Homo sapiens
tttataaaagcaaaagagaaa

SEQ ID NO: 1611011 - DNA, 21 bp, Homo sapiens
tttataaaatagagtgtagtt

SEQ ID NO: 1611012 - DNA, 19 bp, Homo sapiens
tttataaactaggtaaaat

SEQ ID NO: 1611013 - DNA, 12 bp, Homo sapiens
tttataaagtct

SEQ ID NO: 1611014 - DNA, 20 bp, Homo sapiens
tttataaataaaatcatgta

SEQ ID NO: 1611015 - DNA, 20 bp, Homo sapiens
tttataaataaactgttgct

SEQ ID NO: 1611016 - DNA, 14 bp, Homo sapiens
tttataaatccagt

SEQ ID NO: 1611017 - DNA, 15 bp, Homo sapiens
tttataaattactat

SEQ ID NO: 1611018 - DNA, 14 bp, Homo sapiens
tttataactaacat

SEQ ID NO: 1611019 - DNA, 18 bp, Homo sapiens
tttataactcatcataaa

SEQ ID NO: 1611020 - DNA, 14 bp, Homo sapiens
tttattcataatga

SEQ ID NO: 1611021 - DNA, 21 bp, Homo sapiens
tttattcataatgaattataa

SEQ ID NO: 1611022 - DNA, 14 bp, Homo sapiens
tttattcccaagta

SEQ ID NO: 1611023 - DNA, 12 bp, Homo sapiens
tttattcttcca

SEQ ID NO: 1611024 - DNA, 13 bp, Homo sapiens
tttattcttgctg

SEQ ID NO: 1611025 - DNA, 16 bp, Homo sapiens
tttattctttttaaag

SEQ ID NO: 1611026 - DNA, 14 bp, Homo sapiens
tttattgagaattt

SEQ ID NO: 1611027 - DNA, 16 bp, Homo sapiens
tttattgcagaatgtg

SEQ ID NO: 1611028 - DNA, 12 bp, Homo sapiens
tttattgcattg

SEQ ID NO: 1611029 - DNA, 23 bp, Homo sapiens
tttattgccttttaatttttaat

SEQ ID NO: 1611030 - DNA, 17 bp, Homo sapiens
tttattggttttgcaga

SEQ ID NO: 1611031 - DNA, 15 bp, Homo sapiens
tttattgttaataca

SEQ ID NO: 1611032 - DNA, 17 bp, Homo sapiens
tttattgttaatacaag

SEQ ID NO: 1611033 - DNA, 14 bp, Homo sapiens
tttatttaaaaaag

SEQ ID NO: 1611034 - DNA, 15 bp, Homo sapiens
tttatttaaaagatt

SEQ ID NO: 1611035 - DNA, 13 bp, Homo sapiens
tttatttaaggat

SEQ ID NO: 1611036 - DNA, 22 bp, Homo sapiens
tttatttaaggatggatggcac

SEQ ID NO: 1611037 - DNA, 15 bp, Homo sapiens
tttatttataaacta

SEQ ID NO: 1611038 - DNA, 13 bp, Homo sapiens
tttatttatttat

SEQ ID NO: 1611039 - DNA, 13 bp, Homo sapiens
tttatttatttct

SEQ ID NO: 1611040 - DNA, 11 bp, Homo sapiens
tttatttcact

SEQ ID NO: 1611041 - DNA, 23 bp, Homo sapiens
tttatttcatttacaaaagattt

SEQ ID NO: 1611042 - DNA, 14 bp, Homo sapiens
tttatttggcataa

SEQ ID NO: 1611043 - DNA, 17 bp, Homo sapiens
tttatttgttctttttc

SEQ ID NO: 1611044 - DNA, 21 bp, Homo sapiens
tttattttaaaacagaagaat

SEQ ID NO: 1611045 - DNA, 22 bp, Homo sapiens
tttattttcagtcccctctctc

SEQ ID NO: 1611046 - DNA, 18 bp, Homo sapiens
tttattttgctgagttgt

SEQ ID NO: 1611047 - DNA, 22 bp, Homo sapiens
tttattttgtgctcatttaagt

SEQ ID NO: 1611048 - DNA, 15 bp, Homo sapiens
tttatttttgtgtag

SEQ ID NO: 1611049 - DNA, 13 bp, Homo sapiens
tttattttttacc

SEQ ID NO: 1611050 - DNA, 21 bp, Homo sapiens
tttattttttaccataatctt

SEQ ID NO: 1611051 - DNA, 17 bp, Homo sapiens
tttattttttggacttc

SEQ ID NO: 1611052 - DNA, 15 bp, Homo sapiens
tttatttttttaagt

SEQ ID NO: 1611053 - DNA, 15 bp, Homo sapiens
tttcaaaaaaataaa

SEQ ID NO: 1611054 - DNA, 17 bp, Homo sapiens
tttcaaaaaccagccag

SEQ ID NO: 1611055 - DNA, 16 bp, Homo sapiens
tttcaaaaatataact

SEQ ID NO: 1611056 - DNA, 20 bp, Homo sapiens
tttcaaaactcatttcctat

SEQ ID NO: 1611057 - DNA, 13 bp, Homo sapiens
tttcaaaagaaag

SEQ ID NO: 1611058 - DNA, 19 bp, Homo sapiens
tttcaaaatacatttgtaa

SEQ ID NO: 1611059 - DNA, 17 bp, Homo sapiens
tttcaaaatccaaaaag

SEQ ID NO: 1611060 - DNA, 17 bp, Homo sapiens
tttcaaacacaaatgca

SEQ ID NO: 1611061 - DNA, 20 bp, Homo sapiens
tttcaaacatcagctgaatt

SEQ ID NO: 1611062 - DNA, 19 bp, Homo sapiens
tttcaaagatgctgtgagt

SEQ ID NO: 1611063 - DNA, 16 bp, Homo sapiens
tttcaaagattcaaaa

SEQ ID NO: 1611064 - DNA, 17 bp, Homo sapiens
tttcaaagccctgcctc

SEQ ID NO: 1611065 - DNA, 17 bp, Homo sapiens
tttcaaagctttttcca

SEQ ID NO: 1611066 - DNA, 12 bp, Homo sapiens
tttcaaagtttt

SEQ ID NO: 1611067 - DNA, 21 bp, Homo sapiens
tttcaaagttttgttgtactt

SEQ ID NO: 1611068 - DNA, 13 bp, Homo sapiens
tttcaaatatcac

SEQ ID NO: 1611069 - DNA, 15 bp, Homo sapiens
tttcaaatctgtaat

SEQ ID NO: 1611070 - DNA, 20 bp, Homo sapiens
tttcaaatgagtttaaaaaa

SEQ ID NO: 1611071 - DNA, 18 bp, Homo sapiens
tttcaaatgagtttaatg

SEQ ID NO: 1611072 - DNA, 23 bp, Homo sapiens
tttcaacaagaatattgtatgtt

SEQ ID NO: 1611073 - DNA, 18 bp, Homo sapiens
tttcaacatgagtgtatt

SEQ ID NO: 1611074 - DNA, 22 bp, Homo sapiens
tttcaacatttttttttctcca

SEQ ID NO: 1611075 - DNA, 15 bp, Homo sapiens
tttcaacctctagaa

SEQ ID NO: 1611076 - DNA, 22 bp, Homo sapiens
tttcaacctctagaattttaag

SEQ ID NO: 1611077 - DNA, 15 bp, Homo sapiens
tttcaacgcagccct

SEQ ID NO: 1611078 - DNA, 18 bp, Homo sapiens
tttcaacgtatgtgtgtt

SEQ ID NO: 1611079 - DNA, 15 bp, Homo sapiens
tttcaactaatgtgt

SEQ ID NO: 1611080 - DNA, 17 bp, Homo sapiens
tttcaagaaactgagga

SEQ ID NO: 1611081 - DNA, 19 bp, Homo sapiens
tttcaagaaactgaggaat

SEQ ID NO: 1611082 - DNA, 14 bp, Homo sapiens
tttccatcaactcc

SEQ ID NO: 1611083 - DNA, 20 bp, Homo sapiens
tttccatcatgtctgtatac

SEQ ID NO: 1611084 - DNA, 16 bp, Homo sapiens
tttccatctaaaaata

SEQ ID NO: 1611085 - DNA, 17 bp, Homo sapiens
tttccatgttgctgcca

SEQ ID NO: 1611086 - DNA, 13 bp, Homo sapiens
tttccatttattt

SEQ ID NO: 1611087 - DNA, 16 bp, Homo sapiens
tttcccaaagcacttt

SEQ ID NO: 1611088 - DNA, 15 bp, Homo sapiens
tttcccaattaggaa

SEQ ID NO: 1611089 - DNA, 16 bp, Homo sapiens
tttcccaccagctccc

SEQ ID NO: 1611090 - DNA, 23 bp, Homo sapiens
tttcccactcattctgaattaat

SEQ ID NO: 1611091 - DNA, 14 bp, Homo sapiens
tttcccaggaatat

SEQ ID NO: 1611092 - DNA, 16 bp, Homo sapiens
tttcccaggaccctga

SEQ ID NO: 1611093 - DNA, 16 bp, Homo sapiens
tttcccaggagaaaga

SEQ ID NO: 1611094 - DNA, 16 bp, Homo sapiens
tttcccaggttctgtt

SEQ ID NO: 1611095 - DNA, 15 bp, Homo sapiens
tttcccagttaaaga

SEQ ID NO: 1611096 - DNA, 17 bp, Homo sapiens
tttcccatcatcctttg

SEQ ID NO: 1611097 - DNA, 21 bp, Homo sapiens
tttcccatcatcctttgttct

SEQ ID NO: 1611098 - DNA, 23 bp, Homo sapiens
tttcccatctggctttttctgcc

SEQ ID NO: 1611099 - DNA, 20 bp, Homo sapiens
tttcccattggttcacctgt

SEQ ID NO: 1611100 - DNA, 22 bp, Homo sapiens
tttcccatttgtgccagaggaa

SEQ ID NO: 1611101 - DNA, 18 bp, Homo sapiens
tttccccagccacaggcc

SEQ ID NO: 1611102 - DNA, 21 bp, Homo sapiens
tttccccagggaaggaaaaat

SEQ ID NO: 1611103 - DNA, 12 bp, Homo sapiens
tttccccccact

SEQ ID NO: 1611104 - DNA, 13 bp, Homo sapiens
tttccccccactc

SEQ ID NO: 1611105 - DNA, 17 bp, Homo sapiens
tttccccccactctccc

SEQ ID NO: 1611106 - DNA, 23 bp, Homo sapiens
tttccccccactctccccacact

SEQ ID NO: 1611107 - DNA, 22 bp, Homo sapiens
tttcccccttgaggattgtgga

SEQ ID NO: 1611108 - DNA, 20 bp, Homo sapiens
tttccccgaagagtcagccc

SEQ ID NO: 1611109 - DNA, 20 bp, Homo sapiens
tttccccgggggaggaaggg

SEQ ID NO: 1611110 - DNA, 18 bp, Homo sapiens
tttccccggtcccttgag

SEQ ID NO: 1611111 - DNA, 14 bp, Homo sapiens
tttcccctcccaat

SEQ ID NO: 1611112 - DNA, 21 bp, Homo sapiens
tttcccctcccaatcctctct

SEQ ID NO: 1611113 - DNA, 21 bp, Homo sapiens
tttcccctgtggggatctcag

SEQ ID NO: 1611114 - DNA, 14 bp, Homo sapiens
tttcccctttcctg

SEQ ID NO: 1611115 - DNA, 16 bp, Homo sapiens
tttcccctttcctgtc

SEQ ID NO: 1611116 - DNA, 23 bp, Homo sapiens
tttccctcaaatgcgcgtgtgca

SEQ ID NO: 1611117 - DNA, 14 bp, Homo sapiens
tttccctcagtgaa

SEQ ID NO: 1611118 - DNA, 16 bp, Homo sapiens
tttccctcccagtttt

SEQ ID NO: 1611119 - DNA, 22 bp, Homo sapiens
tttccctcgtccgtctgtctcg

SEQ ID NO: 1611120 - DNA, 21 bp, Homo sapiens
tttccctgaagttatgtgtat

SEQ ID NO: 1611121 - DNA, 22 bp, Homo sapiens
tttccctgcaccactctcttca

SEQ ID NO: 1611122 - DNA, 16 bp, Homo sapiens
tttccctgcctctcat

SEQ ID NO: 1611123 - DNA, 16 bp, Homo sapiens
tttccctgctgaatgc

SEQ ID NO: 1611124 - DNA, 21 bp, Homo sapiens
tttccctggaactcctggcct

SEQ ID NO: 1611125 - DNA, 13 bp, Homo sapiens
tttccctggacag

SEQ ID NO: 1611126 - DNA, 19 bp, Homo sapiens
tttcccttacaaggtgggg

SEQ ID NO: 1611127 - DNA, 15 bp, Homo sapiens
tttcccttattgcct

SEQ ID NO: 1611128 - DNA, 15 bp, Homo sapiens
tttcccttgccttat

SEQ ID NO: 1611129 - DNA, 20 bp, Homo sapiens
tttcccttgtgtcaagacat

SEQ ID NO: 1611130 - DNA, 13 bp, Homo sapiens
tttccctttgcca

SEQ ID NO: 1611131 - DNA, 16 bp, Homo sapiens
tttccgtggcactgca

SEQ ID NO: 1611132 - DNA, 13 bp, Homo sapiens
tttcctaaacata

SEQ ID NO: 1611133 - DNA, 17 bp, Homo sapiens
tttcctaaatgcagtga

SEQ ID NO: 1611134 - DNA, 24 bp, Homo sapiens
tttcctactctcaggatcaagaaa

SEQ ID NO: 1611135 - DNA, 17 bp, Homo sapiens
tttcctactgtcctcag

SEQ ID NO: 1611136 - DNA, 16 bp, Homo sapiens
tttcctagaagtggtt

SEQ ID NO: 1611137 - DNA, 14 bp, Homo sapiens
tttcctatccttat

SEQ ID NO: 1611138 - DNA, 13 bp, Homo sapiens
tttcctatttaat

SEQ ID NO: 1611139 - DNA, 16 bp, Homo sapiens
tttcctatttcagtgt

SEQ ID NO: 1611140 - DNA, 13 bp, Homo sapiens
tttcctcaagcaa

SEQ ID NO: 1611141 - DNA, 15 bp, Homo sapiens
tttcctcaagcaata

SEQ ID NO: 1611142 - DNA, 21 bp, Homo sapiens
tttcctcaagcaataattgtt

SEQ ID NO: 1611143 - DNA, 21 bp, Homo sapiens
tttcctcattaatagctgcct

SEQ ID NO: 1611144 - DNA, 12 bp, Homo sapiens
tttcctccaccc

SEQ ID NO: 1611145 - DNA, 18 bp, Homo sapiens
tttcctcctcaggcacac

SEQ ID NO: 1611146 - DNA, 16 bp, Homo sapiens
tttcctctccactgct

SEQ ID NO: 1611147 - DNA, 19 bp, Homo sapiens
tttcctctccactgctgga

SEQ ID NO: 1611148 - DNA, 15 bp, Homo sapiens
tttcctcttccaaag

SEQ ID NO: 1611149 - DNA, 21 bp, Homo sapiens
tttcctcttctattttgtaaa

SEQ ID NO: 1611150 - DNA, 13 bp, Homo sapiens
tttcctgaaagtg

SEQ ID NO: 1611151 - DNA, 20 bp, Homo sapiens
tttcacgcctgaggcaatta

SEQ ID NO: 1611152 - DNA, 22 bp, Homo sapiens
tttcactaaatgtaaaatttgg

SEQ ID NO: 1611153 - DNA, 16 bp, Homo sapiens
tttcactatttccttt

SEQ ID NO: 1611154 - DNA, 24 bp, Homo sapiens
tttcactgtagaatgatttcatgc

SEQ ID NO: 1611155 - DNA, 14 bp, Homo sapiens
tttcacttcttcct

SEQ ID NO: 1611156 - DNA, 11 bp, Homo sapiens
tttcacttgta

SEQ ID NO: 1611157 - DNA, 14 bp, Homo sapiens
tttcacttgtattg

SEQ ID NO: 1611158 - DNA, 17 bp, Homo sapiens
tttcacttgtattgact

SEQ ID NO: 1611159 - DNA, 21 bp, Homo sapiens
tttcacttgtattgactttat

SEQ ID NO: 1611160 - DNA, 15 bp, Homo sapiens
tttcagaaagccttt

SEQ ID NO: 1611161 - DNA, 15 bp, Homo sapiens
tttcagaaggaccaa

SEQ ID NO: 1611162 - DNA, 22 bp, Homo sapiens
tttcagaagttagtttgtatat

SEQ ID NO: 1611163 - DNA, 23 bp, Homo sapiens
tttcagaagttagtttgtatata

SEQ ID NO: 1611164 - DNA, 21 bp, Homo sapiens
tttcagaagtttaaatattaa

SEQ ID NO: 1611165 - DNA, 16 bp, Homo sapiens
tttcagaatattttca

SEQ ID NO: 1611166 - DNA, 15 bp, Homo sapiens
tttcagaatcatctt

SEQ ID NO: 1611167 - DNA, 14 bp, Homo sapiens
tttcagacagggtc

SEQ ID NO: 1611168 - DNA, 20 bp, Homo sapiens
tttcagagactttttttata

SEQ ID NO: 1611169 - DNA, 22 bp, Homo sapiens
tttcagagccagcctggctctg

SEQ ID NO: 1611170 - DNA, 20 bp, Homo sapiens
tttcagagccctcggagcca

SEQ ID NO: 1611171 - DNA, 17 bp, Homo sapiens
tttcagaggctgcagga

SEQ ID NO: 1611172 - DNA, 16 bp, Homo sapiens
tttcagatatcaaaat

SEQ ID NO: 1611173 - DNA, 18 bp, Homo sapiens
tttcagatatcaaaattc

SEQ ID NO: 1611174 - DNA, 22 bp, Homo sapiens
tttcagatatcaaaattctagc

SEQ ID NO: 1611175 - DNA, 12 bp, Homo sapiens
tttcagatgctt

SEQ ID NO: 1611176 - DNA, 14 bp, Homo sapiens
tttcagatgcttct

SEQ ID NO: 1611177 - DNA, 12 bp, Homo sapiens
tttcagatgtct

SEQ ID NO: 1611178 - DNA, 17 bp, Homo sapiens
tttcagatgtcttctgc

SEQ ID NO: 1611179 - DNA, 19 bp, Homo sapiens
tttcagatgtcttctgcct

SEQ ID NO: 1611180 - DNA, 21 bp, Homo sapiens
tttcagatgtcttctgcctgt

SEQ ID NO: 1611181 - DNA, 22 bp, Homo sapiens
tttcagatgtcttctgcctgtt

SEQ ID NO: 1611182 - DNA, 20 bp, Homo sapiens
tttcagattcccagagcaaa

SEQ ID NO: 1611183 - DNA, 22 bp, Homo sapiens
tttcagcaacaagactgccagg

SEQ ID NO: 1611184 - DNA, 15 bp, Homo sapiens
tttcagcattcagtc

SEQ ID NO: 1611185 - DNA, 16 bp, Homo sapiens
tttcagcttgtttcta

SEQ ID NO: 1611186 - DNA, 22 bp, Homo sapiens
tttcagcttgtttctatactgt

SEQ ID NO: 1611187 - DNA, 15 bp, Homo sapiens
tttcaggaatttaaa

SEQ ID NO: 1611188 - DNA, 17 bp, Homo sapiens
tttcaggaatttaaaat

SEQ ID NO: 1611189 - DNA, 13 bp, Homo sapiens
tttcaggatactc

SEQ ID NO: 1611190 - DNA, 19 bp, Homo sapiens
tttcagggaggtggctggg

SEQ ID NO: 1611191 - DNA, 22 bp, Homo sapiens
tttcagggaggtggctgggttt

SEQ ID NO: 1611192 - DNA, 18 bp, Homo sapiens
tttcaggttatatccaat

SEQ ID NO: 1611193 - DNA, 19 bp, Homo sapiens
tttcaggttttgtaaagat

SEQ ID NO: 1611194 - DNA, 18 bp, Homo sapiens
tttcagtatactgtgtgg

SEQ ID NO: 1611195 - DNA, 15 bp, Homo sapiens
tttcagtcttgtagt

SEQ ID NO: 1611196 - DNA, 21 bp, Homo sapiens
tttcagtgaagatgctgtaaa

SEQ ID NO: 1611197 - DNA, 19 bp, Homo sapiens
tttcagtggaatagatgtc

SEQ ID NO: 1611198 - DNA, 17 bp, Homo sapiens
tttcagtgttacctgtg

SEQ ID NO: 1611199 - DNA, 14 bp, Homo sapiens
tttcagtgttttca

SEQ ID NO: 1611200 - DNA, 17 bp, Homo sapiens
tttcagtttttcatttg

SEQ ID NO: 1611201 - DNA, 18 bp, Homo sapiens
tttcagtttttcatttgt

SEQ ID NO: 1611202 - DNA, 20 bp, Homo sapiens
tttcagtttttcatttgttt

SEQ ID NO: 1611203 - DNA, 14 bp, Homo sapiens
tttcataaacaagt

SEQ ID NO: 1611204 - DNA, 22 bp, Homo sapiens
tttcataaataaaggtgtagaa

SEQ ID NO: 1611205 - DNA, 15 bp, Homo sapiens
tttcataatcagtaa

SEQ ID NO: 1611206 - DNA, 19 bp, Homo sapiens
tttcatactatttagattt

SEQ ID NO: 1611207 - DNA, 23 bp, Homo sapiens
tttcatccctatgggattcagtg

SEQ ID NO: 1611208 - DNA, 17 bp, Homo sapiens
tttcatctaccttttct

SEQ ID NO: 1611209 - DNA, 18 bp, Homo sapiens
tttcatctaccttttctg

SEQ ID NO: 1611210 - DNA, 13 bp, Homo sapiens
tttcatctatttc

SEQ ID NO: 1611211 - DNA, 19 bp, Homo sapiens
tttcatctctctacctcca

SEQ ID NO: 1611212 - DNA, 16 bp, Homo sapiens
tttcatctgaaaagca

SEQ ID NO: 1611213 - DNA, 11 bp, Homo sapiens
tttcatctgct

SEQ ID NO: 1611214 - DNA, 20 bp, Homo sapiens
tttcatctgctctccttcct

SEQ ID NO: 1611215 - DNA, 14 bp, Homo sapiens
tttcatcttaaact

SEQ ID NO: 1611216 - DNA, 15 bp, Homo sapiens
tttaaagtattttct

SEQ ID NO: 1611217 - DNA, 18 bp, Homo sapiens
tttaaagtcacatccctg

SEQ ID NO: 1611218 - DNA, 18 bp, Homo sapiens
tttaaagtgattaaacgt

SEQ ID NO: 1611219 - DNA, 14 bp, Homo sapiens
tttaaagtgcaaaa

SEQ ID NO: 1611220 - DNA, 22 bp, Homo sapiens
tttaaagttagtatcttttgat

SEQ ID NO: 1611221 - DNA, 15 bp, Homo sapiens
tttaaagttcttatt

SEQ ID NO: 1611222 - DNA, 21 bp, Homo sapiens
tttaaagttcttattttagta

SEQ ID NO: 1611223 - DNA, 11 bp, Homo sapiens
tttaaataatt

SEQ ID NO: 1611224 - DNA, 16 bp, Homo sapiens
tttaaatagcctaaat

SEQ ID NO: 1611225 - DNA, 17 bp, Homo sapiens
tttaaatataaatgttt

SEQ ID NO: 1611226 - DNA, 12 bp, Homo sapiens
tttaaatataat

SEQ ID NO: 1611227 - DNA, 15 bp, Homo sapiens
tttaaatataattct

SEQ ID NO: 1611228 - DNA, 20 bp, Homo sapiens
tttaaatatccatttatctt

SEQ ID NO: 1611229 - DNA, 13 bp, Homo sapiens
tttaaatatgaat

SEQ ID NO: 1611230 - DNA, 14 bp, Homo sapiens
tttaaatatgaatg

SEQ ID NO: 1611231 - DNA, 15 bp, Homo sapiens
tttaaatattttcta

SEQ ID NO: 1611232 - DNA, 17 bp, Homo sapiens
tttaaatattttctatt

SEQ ID NO: 1611233 - DNA, 18 bp, Homo sapiens
tttaaatcaaggaaaggc

SEQ ID NO: 1611234 - DNA, 19 bp, Homo sapiens
tttaaatctaaatctattt

SEQ ID NO: 1611235 - DNA, 22 bp, Homo sapiens
tttaaatctaaatctatttatt

SEQ ID NO: 1611236 - DNA, 12 bp, Homo sapiens
tttaaatctttt

SEQ ID NO: 1611237 - DNA, 15 bp, Homo sapiens
tttaaatgtaaagat

SEQ ID NO: 1611238 - DNA, 16 bp, Homo sapiens
tttaaatgtgaatttt

SEQ ID NO: 1611239 - DNA, 13 bp, Homo sapiens
tttaaattacaat

SEQ ID NO: 1611240 - DNA, 19 bp, Homo sapiens
tttaaattatactgtagct

SEQ ID NO: 1611241 - DNA, 11 bp, Homo sapiens
tttaaattgtg

SEQ ID NO: 1611242 - DNA, 12 bp, Homo sapiens
tttaaattgtgt

SEQ ID NO: 1611243 - DNA, 18 bp, Homo sapiens
tttaaatttgatttccat

SEQ ID NO: 1611244 - DNA, 16 bp, Homo sapiens
tttaacaaaagcaaga

SEQ ID NO: 1611245 - DNA, 14 bp, Homo sapiens
tttaacaaatctaa

SEQ ID NO: 1611246 - DNA, 17 bp, Homo sapiens
tttaacaaatctaatct

SEQ ID NO: 1611247 - DNA, 23 bp, Homo sapiens
tttaacaaatctaatctcttatt

SEQ ID NO: 1611248 - DNA, 13 bp, Homo sapiens
tttaacaatgaca

SEQ ID NO: 1611249 - DNA, 14 bp, Homo sapiens
tttaacaatgacaa

SEQ ID NO: 1611250 - DNA, 17 bp, Homo sapiens
tttaacacttaaatttc

SEQ ID NO: 1611251 - DNA, 14 bp, Homo sapiens
tttaacactttgta

SEQ ID NO: 1611252 - DNA, 21 bp, Homo sapiens
tttaacactttgtattactta

SEQ ID NO: 1611253 - DNA, 18 bp, Homo sapiens
tttaacagaaactttcaa

SEQ ID NO: 1611254 - DNA, 21 bp, Homo sapiens
tttaacagaaactttcaaaag

SEQ ID NO: 1611255 - DNA, 14 bp, Homo sapiens
tttaacagaaattg

SEQ ID NO: 1611256 - DNA, 16 bp, Homo sapiens
tttaacagaaattgta

SEQ ID NO: 1611257 - DNA, 21 bp, Homo sapiens
tttaacagaaattgtatattg

SEQ ID NO: 1611258 - DNA, 17 bp, Homo sapiens
tttaacagtcatttaaa

SEQ ID NO: 1611259 - DNA, 18 bp, Homo sapiens
tttaacatacaagaaaat

SEQ ID NO: 1611260 - DNA, 18 bp, Homo sapiens
tttaaccctaatctttca

SEQ ID NO: 1611261 - DNA, 21 bp, Homo sapiens
tttaaccctcctgggcccaag

SEQ ID NO: 1611262 - DNA, 19 bp, Homo sapiens
tttaacctaatatcactta

SEQ ID NO: 1611263 - DNA, 21 bp, Homo sapiens
tttaacctagatgtttaacaa

SEQ ID NO: 1611264 - DNA, 17 bp, Homo sapiens
tttaacggcagtgtcat

SEQ ID NO: 1611265 - DNA, 14 bp, Homo sapiens
tttaactaaatttt

SEQ ID NO: 1611266 - DNA, 21 bp, Homo sapiens
tttaactactaagaataaata

SEQ ID NO: 1611267 - DNA, 23 bp, Homo sapiens
tttaactgactattcttgatgta

SEQ ID NO: 1611268 - DNA, 21 bp, Homo sapiens
tttaactgattcttatgatta

SEQ ID NO: 1611269 - DNA, 12 bp, Homo sapiens
tttaactgccgt

SEQ ID NO: 1611270 - DNA, 21 bp, Homo sapiens
tttaactgccgtaatttaact

SEQ ID NO: 1611271 - DNA, 13 bp, Homo sapiens
tttaactggtgaa

SEQ ID NO: 1611272 - DNA, 20 bp, Homo sapiens
tttaacttagttttgcatag

SEQ ID NO: 1611273 - DNA, 12 bp, Homo sapiens
tttaacttttga

SEQ ID NO: 1611274 - DNA, 15 bp, Homo sapiens
tttaagaaaaacatg

SEQ ID NO: 1611275 - DNA, 11 bp, Homo sapiens
tttaagaaaat

SEQ ID NO: 1611276 - DNA, 13 bp, Homo sapiens
tttaagaaaatac

SEQ ID NO: 1611277 - DNA, 20 bp, Homo sapiens
tttaagaaaatacaataaac

SEQ ID NO: 1611278 - DNA, 21 bp, Homo sapiens
tttaagaaaatacaataaact

SEQ ID NO: 1611279 - DNA, 22 bp, Homo sapiens
tttaagaaaatacaataaacta

SEQ ID NO: 1611280 - DNA, 14 bp, Homo sapiens
tttaagaaatagaa

SEQ ID NO: 1611281 - DNA, 16 bp, Homo sapiens
tttaagaatattttta

SEQ ID NO: 1611282 - DNA, 20 bp, Homo sapiens
tttaagaattgagtaatggt

SEQ ID NO: 1611283 - DNA, 13 bp, Homo sapiens
tttaagagaatta

SEQ ID NO: 1611284 - DNA, 23 bp, Homo sapiens
tttaagataataatatatgttta

SEQ ID NO: 1611285 - DNA, 15 bp, Homo sapiens
tttaagataattata

SEQ ID NO: 1611286 - DNA, 17 bp, Homo sapiens
tttaagatagaacacaa

SEQ ID NO: 1611287 - DNA, 19 bp, Homo sapiens
tttaagatatccatctttt

SEQ ID NO: 1611288 - DNA, 18 bp, Homo sapiens
ttggcttctcctgtgacc

SEQ ID NO: 1611289 - DNA, 11 bp, Homo sapiens
ttggcttctgt

SEQ ID NO: 1611290 - DNA, 22 bp, Homo sapiens
ttggcttctgtgatgagctgat

SEQ ID NO: 1611291 - DNA, 14 bp, Homo sapiens
ttggcttgactcag

SEQ ID NO: 1611292 - DNA, 17 bp, Homo sapiens
ttggctttaaacaccct

SEQ ID NO: 1611293 - DNA, 23 bp, Homo sapiens
ttggctttcagagccagcctggc

SEQ ID NO: 1611294 - DNA, 14 bp, Homo sapiens
ttggctttgcccac

SEQ ID NO: 1611295 - DNA, 12 bp, Homo sapiens
ttgggaaaacat

SEQ ID NO: 1611296 - DNA, 15 bp, Homo sapiens
ttgggaaaacatttg

SEQ ID NO: 1611297 - DNA, 16 bp, Homo sapiens
ttgggaaaacatttgc

SEQ ID NO: 1611298 - DNA, 15 bp, Homo sapiens
ttgggacctgctgct

SEQ ID NO: 1611299 - DNA, 17 bp, Homo sapiens
ttgggacctgctgctcc

SEQ ID NO: 1611300 - DNA, 23 bp, Homo sapiens
ttgggactgggtttggaccccag

SEQ ID NO: 1611301 - DNA, 19 bp, Homo sapiens
ttgggagaagcaaatatag

SEQ ID NO: 1611302 - DNA, 22 bp, Homo sapiens
ttgggagcactggagtgcaggg

SEQ ID NO: 1611303 - DNA, 15 bp, Homo sapiens
ttgggaggctgaggc

SEQ ID NO: 1611304 - DNA, 19 bp, Homo sapiens
ttgggaggctgaggcagga

SEQ ID NO: 1611305 - DNA, 11 bp, Homo sapiens
ttgggaggtgc

SEQ ID NO: 1611306 - DNA, 22 bp, Homo sapiens
ttgggaggttttattctgactt

SEQ ID NO: 1611307 - DNA, 20 bp, Homo sapiens
ttgggatagtgttctgctcc

SEQ ID NO: 1611308 - DNA, 18 bp, Homo sapiens
ttgggatgatgcctcatg

SEQ ID NO: 1611309 - DNA, 19 bp, Homo sapiens
ttgggcaaggacaccatag

SEQ ID NO: 1611310 - DNA, 17 bp, Homo sapiens
ttgggcagagctggctc

SEQ ID NO: 1611311 - DNA, 22 bp, Homo sapiens
ttgggcagagctggctctgagc

SEQ ID NO: 1611312 - DNA, 20 bp, Homo sapiens
ttgggcatccacccagtgct

SEQ ID NO: 1611313 - DNA, 21 bp, Homo sapiens
ttgggcatccacccagtgctg

SEQ ID NO: 1611314 - DNA, 14 bp, Homo sapiens
ttgggccagaagta

SEQ ID NO: 1611315 - DNA, 14 bp, Homo sapiens
ttgggccagacatg

SEQ ID NO: 1611316 - DNA, 17 bp, Homo sapiens
ttgggccagacatgcca

SEQ ID NO: 1611317 - DNA, 12 bp, Homo sapiens
ttgggcccagct

SEQ ID NO: 1611318 - DNA, 16 bp, Homo sapiens
ttgggcccagctgggc

SEQ ID NO: 1611319 - DNA, 21 bp, Homo sapiens
ttgggccctgcattggcctgg

SEQ ID NO: 1611320 - DNA, 17 bp, Homo sapiens
ttgggccgaaagagaga

SEQ ID NO: 1611321 - DNA, 12 bp, Homo sapiens
ttgggcctcagg

SEQ ID NO: 1611322 - DNA, 23 bp, Homo sapiens
ttgggcctcaggctctgcacaga

SEQ ID NO: 1611323 - DNA, 17 bp, Homo sapiens
ttgggcctccatgcccc

SEQ ID NO: 1611324 - DNA, 14 bp, Homo sapiens
ttgggcctctcctg

SEQ ID NO: 1611325 - DNA, 19 bp, Homo sapiens
ttgggcctgctccagacct

SEQ ID NO: 1611326 - DNA, 15 bp, Homo sapiens
ttgggctactggcag

SEQ ID NO: 1611327 - DNA, 22 bp, Homo sapiens
ttgggctataaaatatttctgt

SEQ ID NO: 1611328 - DNA, 15 bp, Homo sapiens
ttgggctcaaagccc

SEQ ID NO: 1611329 - DNA, 21 bp, Homo sapiens
ttgggctcctggctgccaggc

SEQ ID NO: 1611330 - DNA, 16 bp, Homo sapiens
ttgggctgacacctac

SEQ ID NO: 1611331 - DNA, 23 bp, Homo sapiens
ttgggctgacacctaccatgctg

SEQ ID NO: 1611332 - DNA, 21 bp, Homo sapiens
ttgggcttagtatttctcagg

SEQ ID NO: 1611333 - DNA, 19 bp, Homo sapiens
ttgggctttgcaggctctg

SEQ ID NO: 1611334 - DNA, 12 bp, Homo sapiens
ttggggaggcaa

SEQ ID NO: 1611335 - DNA, 20 bp, Homo sapiens
ttggggagttaagacctggc

SEQ ID NO: 1611336 - DNA, 21 bp, Homo sapiens
ttggggccaccaaagctgccc

SEQ ID NO: 1611337 - DNA, 15 bp, Homo sapiens
ttggggcccagtgca

SEQ ID NO: 1611338 - DNA, 13 bp, Homo sapiens
ttggggccctgcc

SEQ ID NO: 1611339 - DNA, 18 bp, Homo sapiens
ttgggggacagccttcag

SEQ ID NO: 1611340 - DNA, 16 bp, Homo sapiens
ttgggggctgtgggga

SEQ ID NO: 1611341 - DNA, 19 bp, Homo sapiens
ttggggtataggtctcatc

SEQ ID NO: 1611342 - DNA, 23 bp, Homo sapiens
ttggggtcaagaaacagccagca

SEQ ID NO: 1611343 - DNA, 20 bp, Homo sapiens
ttggggtccctccaccccac

SEQ ID NO: 1611344 - DNA, 22 bp, Homo sapiens
ttggggtgcccctctccttctt

SEQ ID NO: 1611345 - DNA, 16 bp, Homo sapiens
ttggggttttttaata

SEQ ID NO: 1611346 - DNA, 23 bp, Homo sapiens
ttgggtcagagaaaatgagaaag

SEQ ID NO: 1611347 - DNA, 21 bp, Homo sapiens
ttgggtgaatatggtggaaaa

SEQ ID NO: 1611348 - DNA, 19 bp, Homo sapiens
ttgggtgctgctaattctt

SEQ ID NO: 1611349 - DNA, 19 bp, Homo sapiens
ttgggtgtaacaggtctcc

SEQ ID NO: 1611350 - DNA, 20 bp, Homo sapiens
ttgggtgtttttcatgtttt

SEQ ID NO: 1611351 - DNA, 21 bp, Homo sapiens
ttggtaaaaacagcagctcat

SEQ ID NO: 1611352 - DNA, 22 bp, Homo sapiens
ttggtaaaaacagcagctcata

SEQ ID NO: 1611353 - DNA, 19 bp, Homo sapiens
ttggtaaaaatgctgctct

SEQ ID NO: 1611354 - DNA, 14 bp, Homo sapiens
ttggtaacttttgt

SEQ ID NO: 1611355 - DNA, 15 bp, Homo sapiens
ttggtaacttttgtg

SEQ ID NO: 1611356 - DNA, 17 bp, Homo sapiens
ttggtagatgttctttt

SEQ ID NO: 1611357 - DNA, 14 bp, Homo sapiens
ttggtaggtaaatc

SEQ ID NO: 1611358 - DNA, 20 bp, Homo sapiens
ttggtagttctgtgcctccc

SEQ ID NO: 1611359 - DNA, 22 bp, Homo sapiens
ttggtagttctgtgcctccccc

SEQ ID NO: 1611360 - DNA, 18 bp, Homo sapiens
ttggtatagccatgattt

SEQ ID NO: 1611361 - DNA, 10 bp, Homo sapiens
ttggtcaaat

SEQ ID NO: 1611362 - DNA, 17 bp, Homo sapiens
ttggtccaaaaaaagga

SEQ ID NO: 1611363 - DNA, 22 bp, Homo sapiens
ttggtccaaaaaaaggaaaaat

SEQ ID NO: 1611364 - DNA, 23 bp, Homo sapiens
ttggtccaaagtgcgtgtgtgta

SEQ ID NO: 1611365 - DNA, 15 bp, Homo sapiens
ttggtccaagattcc

SEQ ID NO: 1611366 - DNA, 12 bp, Homo sapiens
ttggtccctggt

SEQ ID NO: 1611367 - DNA, 15 bp, Homo sapiens
ttggtccctggtccc

SEQ ID NO: 1611368 - DNA, 14 bp, Homo sapiens
ttggtcctctctct

SEQ ID NO: 1611369 - DNA, 17 bp, Homo sapiens
ttggtcctgtccccgca

SEQ ID NO: 1611370 - DNA, 21 bp, Homo sapiens
ttggtctcccatatgcagaaa

SEQ ID NO: 1611371 - DNA, 14 bp, Homo sapiens
ttggtcttccatgg

SEQ ID NO: 1611372 - DNA, 15 bp, Homo sapiens
ttggtgactgggaaa

SEQ ID NO: 1611373 - DNA, 22 bp, Homo sapiens
ttggtgagaaagggattgctga

SEQ ID NO: 1611374 - DNA, 21 bp, Homo sapiens
ttggtgcaacccttacccctt

SEQ ID NO: 1611375 - DNA, 20 bp, Homo sapiens
ttggtggaattcctctttaa

SEQ ID NO: 1611376 - DNA, 16 bp, Homo sapiens
ttggtggtgaaattga

SEQ ID NO: 1611377 - DNA, 17 bp, Homo sapiens
ttggtgtaatttgaaga

SEQ ID NO: 1611378 - DNA, 15 bp, Homo sapiens
ttgagacctcagcca

SEQ ID NO: 1611379 - DNA, 19 bp, Homo sapiens
ttgagagcagatgccattt

SEQ ID NO: 1611380 - DNA, 18 bp, Homo sapiens
ttgagataatatctgtga

SEQ ID NO: 1611381 - DNA, 12 bp, Homo sapiens
ttgagatccagt

SEQ ID NO: 1611382 - DNA, 19 bp, Homo sapiens
ttgagatctggggaggcag

SEQ ID NO: 1611383 - DNA, 13 bp, Homo sapiens
ttgagatgtatga

SEQ ID NO: 1611384 - DNA, 19 bp, Homo sapiens
ttgagcagtggctggtcca

SEQ ID NO: 1611385 - DNA, 19 bp, Homo sapiens
ttgagcatgacagcctgca

SEQ ID NO: 1611386 - DNA, 20 bp, Homo sapiens
ttgagcatgacagcctgcag

SEQ ID NO: 1611387 - DNA, 22 bp, Homo sapiens
ttgagcatgcacagctgcttgt

SEQ ID NO: 1611388 - DNA, 11 bp, Homo sapiens
ttgagcccagg

SEQ ID NO: 1611389 - DNA, 14 bp, Homo sapiens
ttgagccctggctg

SEQ ID NO: 1611390 - DNA, 15 bp, Homo sapiens
ttgagccctggctgt

SEQ ID NO: 1611391 - DNA, 18 bp, Homo sapiens
ttgagcccttgtttcagg

SEQ ID NO: 1611392 - DNA, 22 bp, Homo sapiens
ttgagctgaaatgctgcatttt

SEQ ID NO: 1611393 - DNA, 12 bp, Homo sapiens
ttgagctgtttt

SEQ ID NO: 1611394 - DNA, 18 bp, Homo sapiens
ttgagctgttttccctga

SEQ ID NO: 1611395 - DNA, 16 bp, Homo sapiens
ttgaggagccccagct

SEQ ID NO: 1611396 - DNA, 17 bp, Homo sapiens
ttgaggagctgcactga

SEQ ID NO: 1611397 - DNA, 17 bp, Homo sapiens
ttgaggagttgcctgac

SEQ ID NO: 1611398 - DNA, 18 bp, Homo sapiens
ttgaggatatattttcac

SEQ ID NO: 1611399 - DNA, 21 bp, Homo sapiens
ttgaggatatattttcacttt

SEQ ID NO: 1611400 - DNA, 17 bp, Homo sapiens
ttgaggattgtggaaaa

SEQ ID NO: 1611401 - DNA, 21 bp, Homo sapiens
ttgaggattgtggaaaaccag

SEQ ID NO: 1611402 - DNA, 19 bp, Homo sapiens
ttgaggcaaatctaaaatt

SEQ ID NO: 1611403 - DNA, 21 bp, Homo sapiens
ttgaggccaagatggctgctg

SEQ ID NO: 1611404 - DNA, 22 bp, Homo sapiens
ttgagggagctgggagaccctc

SEQ ID NO: 1611405 - DNA, 19 bp, Homo sapiens
ttgaggggccctggccagg

SEQ ID NO: 1611406 - DNA, 15 bp, Homo sapiens
ttgaggggctcctgg

SEQ ID NO: 1611407 - DNA, 21 bp, Homo sapiens
ttgagggtgggggtgctctct

SEQ ID NO: 1611408 - DNA, 23 bp, Homo sapiens
ttgaggtaggagaggcgggagaa

SEQ ID NO: 1611409 - DNA, 16 bp, Homo sapiens
ttgaggtcaagtaaga

SEQ ID NO: 1611410 - DNA, 22 bp, Homo sapiens
ttgaggtcaagtaagaagacat

SEQ ID NO: 1611411 - DNA, 19 bp, Homo sapiens
ttgaggtgtcagagaaaat

SEQ ID NO: 1611412 - DNA, 13 bp, Homo sapiens
ttgagtaaaaagg

SEQ ID NO: 1611413 - DNA, 14 bp, Homo sapiens
ttgagtacagatac

SEQ ID NO: 1611414 - DNA, 21 bp, Homo sapiens
ttgagtacctactgtgtgcca

SEQ ID NO: 1611415 - DNA, 13 bp, Homo sapiens
ttgagtattgttt

SEQ ID NO: 1611416 - DNA, 21 bp, Homo sapiens
ttgagtcagtgcatttcaagg

SEQ ID NO: 1611417 - DNA, 20 bp, Homo sapiens
ttgagtcctaggacttaaaa

SEQ ID NO: 1611418 - DNA, 22 bp, Homo sapiens
ttgagtctgtttttttatagtt

SEQ ID NO: 1611419 - DNA, 14 bp, Homo sapiens
ttgagtgacagctt

SEQ ID NO: 1611420 - DNA, 18 bp, Homo sapiens
ttgagtgccaatttctta

SEQ ID NO: 1611421 - DNA, 16 bp, Homo sapiens
ttgagtggctgtctta

SEQ ID NO: 1611422 - DNA, 23 bp, Homo sapiens
ttgagtggggttatctctgtgtt

SEQ ID NO: 1611423 - DNA, 14 bp, Homo sapiens
ttgagtgtgtggtc

SEQ ID NO: 1611424 - DNA, 21 bp, Homo sapiens
ttgagtgttcctttttaaatg

SEQ ID NO: 1611425 - DNA, 17 bp, Homo sapiens
ttgagtgttttaagata

SEQ ID NO: 1611426 - DNA, 16 bp, Homo sapiens
ttgagttacaatttgg

SEQ ID NO: 1611427 - DNA, 12 bp, Homo sapiens
ttgataaagtaa

SEQ ID NO: 1611428 - DNA, 12 bp, Homo sapiens
ttgataaagttt

SEQ ID NO: 1611429 - DNA, 17 bp, Homo sapiens
ttgataaagtttctcag

SEQ ID NO: 1611430 - DNA, 21 bp, Homo sapiens
ttgataaattccactggactt

SEQ ID NO: 1611431 - DNA, 21 bp, Homo sapiens
ttgataacaaaaaataaattt

SEQ ID NO: 1611432 - DNA, 22 bp, Homo sapiens
ttgataacaatgacactagaaa

SEQ ID NO: 1611433 - DNA, 22 bp, Homo sapiens
ttgataacagggattgatttta

SEQ ID NO: 1611434 - DNA, 13 bp, Homo sapiens
ttgataagaggaa

SEQ ID NO: 1611435 - DNA, 21 bp, Homo sapiens
ttgataagggactgatgtttg

SEQ ID NO: 1611436 - DNA, 22 bp, Homo sapiens
ttgataagggactgatgtttgt

SEQ ID NO: 1611437 - DNA, 17 bp, Homo sapiens
ttgataatatatattaa

SEQ ID NO: 1611438 - DNA, 20 bp, Homo sapiens
ttgatacataaacttttgca

SEQ ID NO: 1611439 - DNA, 23 bp, Homo sapiens
ttgatacataataaaaaattatg

SEQ ID NO: 1611440 - DNA, 17 bp, Homo sapiens
ttgataggaactgtctc

SEQ ID NO: 1611441 - DNA, 16 bp, Homo sapiens
ttgatagggaactggg

SEQ ID NO: 1611442 - DNA, 18 bp, Homo sapiens
ttgatagtgatgtatttt

SEQ ID NO: 1611443 - DNA, 21 bp, Homo sapiens
ttgatataatttccatagtgt

SEQ ID NO: 1611444 - DNA, 16 bp, Homo sapiens
ttgatatacattgtgt

SEQ ID NO: 1611445 - DNA, 19 bp, Homo sapiens
ttgatataccaaattaaaa

SEQ ID NO: 1611446 - DNA, 15 bp, Homo sapiens
ttgatatagaaagct

SEQ ID NO: 1611447 - DNA, 18 bp, Homo sapiens
ttgatatgcaactgcagt

SEQ ID NO: 1611448 - DNA, 17 bp, Homo sapiens
ttgatatgtaagtactt

SEQ ID NO: 1611449 - DNA, 15 bp, Homo sapiens
ttgatatttgtattt

SEQ ID NO: 1611450 - DNA, 22 bp, Homo sapiens
ttgatatttgtatttattcttt

SEQ ID NO: 1611451 - DNA, 20 bp, Homo sapiens
ttgatatttttccatttatt

SEQ ID NO: 1611452 - DNA, 15 bp, Homo sapiens
ttgatcactgtgaac

SEQ ID NO: 1611453 - DNA, 19 bp, Homo sapiens
ttgatcagtaagtcacagt

SEQ ID NO: 1611454 - DNA, 15 bp, Homo sapiens
ttgatcatgtacttt

SEQ ID NO: 1611455 - DNA, 17 bp, Homo sapiens
ttgatcatgtacttttt

SEQ ID NO: 1611456 - DNA, 15 bp, Homo sapiens
ttgatcccacttcac

SEQ ID NO: 1611457 - DNA, 19 bp, Homo sapiens
ttgatccttctgagctcca

SEQ ID NO: 1611458 - DNA, 23 bp, Homo sapiens
ttgatccttctgagctccacctc

SEQ ID NO: 1611459 - DNA, 15 bp, Homo sapiens
ttgatctggaaccca

SEQ ID NO: 1611460 - DNA, 20 bp, Homo sapiens
ttgatgagttaactgtgaaa

SEQ ID NO: 1611461 - DNA, 14 bp, Homo sapiens
ttgatgccagaggg

SEQ ID NO: 1611462 - DNA, 17 bp, Homo sapiens
ttgatgccagagggcca

SEQ ID NO: 1611463 - DNA, 15 bp, Homo sapiens
ttgatgcccaatata

SEQ ID NO: 1611464 - DNA, 14 bp, Homo sapiens
ttgatggagatatt

SEQ ID NO: 1611465 - DNA, 23 bp, Homo sapiens
ttgatggccccatctggatgtaa

SEQ ID NO: 1611466 - DNA, 12 bp, Homo sapiens
ttgatggctgcg

SEQ ID NO: 1611467 - DNA, 14 bp, Homo sapiens
ttgatgggaaaagc

SEQ ID NO: 1611468 - DNA, 22 bp, Homo sapiens
ttgatggggaatccgtgtgtgt

SEQ ID NO: 1611469 - DNA, 17 bp, Homo sapiens
ttgatggggacatttct

SEQ ID NO: 1611470 - DNA, 16 bp, Homo sapiens
ttgatggggagaaagg

SEQ ID NO: 1611471 - DNA, 17 bp, Homo sapiens
ttgatggtggactaagc

SEQ ID NO: 1611472 - DNA, 21 bp, Homo sapiens
ttgatgtaaaatcttgtcatg

SEQ ID NO: 1611473 - DNA, 16 bp, Homo sapiens
ttgatgtacagatttt

SEQ ID NO: 1611474 - DNA, 15 bp, Homo sapiens
ttgatgtacatgtgt

SEQ ID NO: 1611475 - DNA, 13 bp, Homo sapiens
ttgatgtatgtgt

SEQ ID NO: 1611476 - DNA, 17 bp, Homo sapiens
ttgatgtatgtgtgaaa

SEQ ID NO: 1611477 - DNA, 17 bp, Homo sapiens
ttgatgttccttccaga

SEQ ID NO: 1611478 - DNA, 22 bp, Homo sapiens
ttgatgtttgtggcctcagaat

SEQ ID NO: 1611479 - DNA, 18 bp, Homo sapiens
ttgatgttttttctgtaa

SEQ ID NO: 1611480 - DNA, 17 bp, Homo sapiens
ttgattaaaaatgcttt

SEQ ID NO: 1611481 - DNA, 15 bp, Homo sapiens
ttgattaacaatgta

SEQ ID NO: 1611482 - DNA, 16 bp, Homo sapiens
ttgattaatgtttctt

SEQ ID NO: 1611483 - DNA, 14 bp, Homo sapiens
ttgattatcttcag

SEQ ID NO: 1611484 - DNA, 21 bp, Homo sapiens
ttgattatgtatggatatatt

SEQ ID NO: 1611485 - DNA, 14 bp, Homo sapiens
ttggaaaagaatac

SEQ ID NO: 1611486 - DNA, 19 bp, Homo sapiens
ttggaaaagaatacagaaa

SEQ ID NO: 1611487 - DNA, 18 bp, Homo sapiens
ttggaaacctgccctgcc

SEQ ID NO: 1611488 - DNA, 20 bp, Homo sapiens
ttggaaacctgccctgcctg

SEQ ID NO: 1611489 - DNA, 19 bp, Homo sapiens
ttggaaagggaagatctta

SEQ ID NO: 1611490 - DNA, 12 bp, Homo sapiens
ttggaaagtcag

SEQ ID NO: 1611491 - DNA, 14 bp, Homo sapiens
ttggaaagtcagaa

SEQ ID NO: 1611492 - DNA, 16 bp, Homo sapiens
ttggaaatcagttgtg

SEQ ID NO: 1611493 - DNA, 18 bp, Homo sapiens
ttggaaatgtctgctggt

SEQ ID NO: 1611494 - DNA, 16 bp, Homo sapiens
ttggaacaccctggat

SEQ ID NO: 1611495 - DNA, 14 bp, Homo sapiens
ttggaacagaatgt

SEQ ID NO: 1611496 - DNA, 15 bp, Homo sapiens
ttggaacatttcttt

SEQ ID NO: 1611497 - DNA, 22 bp, Homo sapiens
ttggaacatttctttcttgctg

SEQ ID NO: 1611498 - DNA, 13 bp, Homo sapiens
ttggaaccagact

SEQ ID NO: 1611499 - DNA, 22 bp, Homo sapiens
ttggaaccgtgtccagcacaga

SEQ ID NO: 1611500 - DNA, 19 bp, Homo sapiens
ttggaaccttgttttggac

SEQ ID NO: 1611501 - DNA, 22 bp, Homo sapiens
ttggaacgacaaaatgaaacag

SEQ ID NO: 1611502 - DNA, 14 bp, Homo sapiens
ttggaactctactc

SEQ ID NO: 1611503 - DNA, 16 bp, Homo sapiens
ttggaactctgcttga

SEQ ID NO: 1611504 - DNA, 15 bp, Homo sapiens
ttggaagaccccacc

SEQ ID NO: 1611505 - DNA, 20 bp, Homo sapiens
ttggaagaccccacccaagc

SEQ ID NO: 1611506 - DNA, 17 bp, Homo sapiens
ttggaagctctgaagtc

SEQ ID NO: 1611507 - DNA, 18 bp, Homo sapiens
ttggaaggatctgctgag

SEQ ID NO: 1611508 - DNA, 23 bp, Homo sapiens
ttggaagggggagacaggaagtt

SEQ ID NO: 1611509 - DNA, 19 bp, Homo sapiens
ttggaagtttgtgttctgt

SEQ ID NO: 1611510 - DNA, 16 bp, Homo sapiens
ttggaagttttcagga

SEQ ID NO: 1611511 - DNA, 15 bp, Homo sapiens
ttggaataatttcta

SEQ ID NO: 1611512 - DNA, 13 bp, Homo sapiens
ttggaatattaaa

SEQ ID NO: 1611513 - DNA, 16 bp, Homo sapiens
ttggaatattaaaaaa

SEQ ID NO: 1611514 - DNA, 17 bp, Homo sapiens
ttggaatattaaaaaac

SEQ ID NO: 1611515 - DNA, 22 bp, Homo sapiens
ttggaatattttatcctgtatt

SEQ ID NO: 1611516 - DNA, 22 bp, Homo sapiens
ttggaatctagccgatggaaaa

SEQ ID NO: 1611517 - DNA, 17 bp, Homo sapiens
ttggaatgttctcagat

SEQ ID NO: 1611518 - DNA, 19 bp, Homo sapiens
ttggaattctactggaaaa

SEQ ID NO: 1611519 - DNA, 19 bp, Homo sapiens
ttggacacctttaggttct

SEQ ID NO: 1611520 - DNA, 13 bp, Homo sapiens
ttggacagccccc

SEQ ID NO: 1611521 - DNA, 15 bp, Homo sapiens
ttggacagccccctt

SEQ ID NO: 1611522 - DNA, 18 bp, Homo sapiens
ttggacattttcttcaga

SEQ ID NO: 1611523 - DNA, 13 bp, Homo sapiens
ttggaccccagct

SEQ ID NO: 1611524 - DNA, 15 bp, Homo sapiens
ttggaccccagctgg

SEQ ID NO: 1611525 - DNA, 16 bp, Homo sapiens
ttggaccccagctggg

SEQ ID NO: 1611526 - DNA, 23 bp, Homo sapiens
ttggacctaaatggcctcatgtg

SEQ ID NO: 1611527 - DNA, 17 bp, Homo sapiens
ttggacctaatccaagc

SEQ ID NO: 1611528 - DNA, 13 bp, Homo sapiens
ttggacggcctga

SEQ ID NO: 1611529 - DNA, 22 bp, Homo sapiens
ttggactccaggcctgaccagg

SEQ ID NO: 1611530 - DNA, 15 bp, Homo sapiens
ttggactctcaggga

SEQ ID NO: 1611531 - DNA, 22 bp, Homo sapiens
ttggacttttcgttaacattga

SEQ ID NO: 1611532 - DNA, 21 bp, Homo sapiens
ttggagaaatgtcataaatta

SEQ ID NO: 1611533 - DNA, 19 bp, Homo sapiens
ttggagaacgccagtctcc

SEQ ID NO: 1611534 - DNA, 20 bp, Homo sapiens
ttggagaagcccgtgtgaga

SEQ ID NO: 1611535 - DNA, 20 bp, Homo sapiens
ttggagagtaaaaactgaat

SEQ ID NO: 1611536 - DNA, 15 bp, Homo sapiens
ttggagagtttcctg

SEQ ID NO: 1611537 - DNA, 21 bp, Homo sapiens
ttggagcacaaaattcaaagc

SEQ ID NO: 1611538 - DNA, 19 bp, Homo sapiens
ttggagcactagtttgatt

SEQ ID NO: 1611539 - DNA, 14 bp, Homo sapiens
ttggagcccgtgca

SEQ ID NO: 1611540 - DNA, 17 bp, Homo sapiens
ttggagcctaaagagaa

SEQ ID NO: 1611541 - DNA, 13 bp, Homo sapiens
ttggagcctgcag

SEQ ID NO: 1611542 - DNA, 20 bp, Homo sapiens
ttggagcgagcatcccccaa

SEQ ID NO: 1611543 - DNA, 19 bp, Homo sapiens
ttggagctgagatgagccc

SEQ ID NO: 1611544 - DNA, 17 bp, Homo sapiens
ttggagctttggaatat

SEQ ID NO: 1611545 - DNA, 20 bp, Homo sapiens
ttggagctttggaatatttt

SEQ ID NO: 1611546 - DNA, 20 bp, Homo sapiens
ttggaggccttccctggcct

SEQ ID NO: 1611547 - DNA, 18 bp, Homo sapiens
ttggaggctgagttctgg

SEQ ID NO: 1611548 - DNA, 18 bp, Homo sapiens
ttggagtgcttgtttact

SEQ ID NO: 1611549 - DNA, 13 bp, Homo sapiens
ttggagttaaaat

SEQ ID NO: 1611550 - DNA, 22 bp, Homo sapiens
ttggatctatcacctgtcatca

SEQ ID NO: 1611551 - DNA, 12 bp, Homo sapiens
ttggatgaaggt

SEQ ID NO: 1611552 - DNA, 12 bp, Homo sapiens
ttggatgagttt

SEQ ID NO: 1611553 - DNA, 18 bp, Homo sapiens
ttggatgattttttaagc

SEQ ID NO: 1611554 - DNA, 22 bp, Homo sapiens
ttggatgattttttaagcagac

SEQ ID NO: 1611555 - DNA, 22 bp, Homo sapiens
ttggatgggactagagctttct

SEQ ID NO: 1611556 - DNA, 23 bp, Homo sapiens
ttggatggggctggcatgttttc

SEQ ID NO: 1611557 - DNA, 17 bp, Homo sapiens
ttggattattctttctc

SEQ ID NO: 1611558 - DNA, 21 bp, Homo sapiens
ttggattattctttctccttt

SEQ ID NO: 1611559 - DNA, 14 bp, Homo sapiens
ttggattcctgcac

SEQ ID NO: 1611560 - DNA, 15 bp, Homo sapiens
ttggattcttatgta

SEQ ID NO: 1611561 - DNA, 21 bp, Homo sapiens
ttggatttcctaatactgtca

SEQ ID NO: 1611562 - DNA, 19 bp, Homo sapiens
ttggatttggagagaaata

SEQ ID NO: 1611563 - DNA, 18 bp, Homo sapiens
ttggatttgtttaaaagg

SEQ ID NO: 1611564 - DNA, 16 bp, Homo sapiens
ttggcaaactaaagga

SEQ ID NO: 1611565 - DNA, 17 bp, Homo sapiens
ttggcaaattttaaaac

SEQ ID NO: 1611566 - DNA, 13 bp, Homo sapiens
ttggcaacatctt

SEQ ID NO: 1611567 - DNA, 16 bp, Homo sapiens
ttggcaagtcacgttg

SEQ ID NO: 1611568 - DNA, 15 bp, Homo sapiens
ttggcaatgctaatt

SEQ ID NO: 1611569 - DNA, 23 bp, Homo sapiens
ttggcacagaaacacaatatttt

SEQ ID NO: 1611570 - DNA, 20 bp, Homo sapiens
ttggcacatgccacctggca

SEQ ID NO: 1611571 - DNA, 19 bp, Homo sapiens
ttggcacctaatccaggca

SEQ ID NO: 1611572 - DNA, 23 bp, Homo sapiens
ttggcactcacagacctggagcc

SEQ ID NO: 1611573 - DNA, 20 bp, Homo sapiens
ttggcacttaagtgcacttt

SEQ ID NO: 1611574 - DNA, 19 bp, Homo sapiens
ttggcacttgccattccaa

SEQ ID NO: 1611575 - DNA, 20 bp, Homo sapiens
ttggcacttgccattccaaa

SEQ ID NO: 1611576 - DNA, 14 bp, Homo sapiens
ttggcacttgtatt

SEQ ID NO: 1611577 - DNA, 17 bp, Homo sapiens
ttggcaggataagaaaa

SEQ ID NO: 1611578 - DNA, 14 bp, Homo sapiens
ttggcaggcccact

SEQ ID NO: 1611579 - DNA, 13 bp, Homo sapiens
ttggcaggctggc

SEQ ID NO: 1611580 - DNA, 20 bp, Homo sapiens
ttggcataatagtcaatttc

SEQ ID NO: 1611581 - DNA, 14 bp, Homo sapiens
ttggcatacaaaat

SEQ ID NO: 1611582 - DNA, 16 bp, Homo sapiens
ttggcatacaaaatat

SEQ ID NO: 1611583 - DNA, 15 bp, Homo sapiens
ttggcatcgaccaca

SEQ ID NO: 1611584 - DNA, 15 bp, Homo sapiens
ttggcattgctgcat

SEQ ID NO: 1611585 - DNA, 17 bp, Homo sapiens
ttggcattggaattcta

SEQ ID NO: 1611586 - DNA, 20 bp, Homo sapiens
ttggccaaacatcagacctg

SEQ ID NO: 1611587 - DNA, 15 bp, Homo sapiens
ttggccaaagtgtta

SEQ ID NO: 1611588 - DNA, 13 bp, Homo sapiens
ttggccatgcaga

SEQ ID NO: 1611589 - DNA, 17 bp, Homo sapiens
ttggccatttgctagtt

SEQ ID NO: 1611590 - DNA, 17 bp, Homo sapiens
ttggcccagagacggag

SEQ ID NO: 1611591 - DNA, 16 bp, Homo sapiens
ttggcccaggagctct

SEQ ID NO: 1611592 - DNA, 19 bp, Homo sapiens
ttggccctcttgcgggcct

SEQ ID NO: 1611593 - DNA, 14 bp, Homo sapiens
ttggccctggagcc

SEQ ID NO: 1611594 - DNA, 19 bp, Homo sapiens
ttggccctttccttccaga

SEQ ID NO: 1611595 - DNA, 22 bp, Homo sapiens
ttggccgcacctaaagcagcca

SEQ ID NO: 1611596 - DNA, 12 bp, Homo sapiens
ttggcctcagaa

SEQ ID NO: 1611597 - DNA, 10 bp, Homo sapiens
ttggcctccc

SEQ ID NO: 1611598 - DNA, 18 bp, Homo sapiens
ttggcctctgtatgcagt

SEQ ID NO: 1611599 - DNA, 12 bp, Homo sapiens
ttggcctgctgt

SEQ ID NO: 1611600 - DNA, 11 bp, Homo sapiens
ttgtaaaacaa

SEQ ID NO: 1611601 - DNA, 12 bp, Homo sapiens
ttgtaaaacaat

SEQ ID NO: 1611602 - DNA, 14 bp, Homo sapiens
ttgtaaaacaatgc

SEQ ID NO: 1611603 - DNA, 15 bp, Homo sapiens
ttgtaaaacaatgcc

SEQ ID NO: 1611604 - DNA, 13 bp, Homo sapiens
ttgtaaaacaggt

SEQ ID NO: 1611605 - DNA, 21 bp, Homo sapiens
ttgtaaaagaacagtaaacat

SEQ ID NO: 1611606 - DNA, 19 bp, Homo sapiens
ttgtaaaatgttctcttat

SEQ ID NO: 1611607 - DNA, 22 bp, Homo sapiens
ttgtaaactcaaaatatttgta

SEQ ID NO: 1611608 - DNA, 18 bp, Homo sapiens
ttgtaaagatttctgttc

SEQ ID NO: 1611609 - DNA, 18 bp, Homo sapiens
ttgtaaataaagtctatt

SEQ ID NO: 1611610 - DNA, 13 bp, Homo sapiens
ttgtaaataagag

SEQ ID NO: 1611611 - DNA, 16 bp, Homo sapiens
ttgtaaataagagatt

SEQ ID NO: 1611612 - DNA, 21 bp, Homo sapiens
ttgtaaataagagatttggag

SEQ ID NO: 1611613 - DNA, 23 bp, Homo sapiens
ttgtaaataagttttttttctgg

SEQ ID NO: 1611614 - DNA, 14 bp, Homo sapiens
ttgtaaatacacat

SEQ ID NO: 1611615 - DNA, 21 bp, Homo sapiens
ttgtaaatactggactcagga

SEQ ID NO: 1611616 - DNA, 13 bp, Homo sapiens
ttgtaaatattta

SEQ ID NO: 1611617 - DNA, 16 bp, Homo sapiens
ttgtaaatatttatgt

SEQ ID NO: 1611618 - DNA, 14 bp, Homo sapiens
ttgtaaatcttttt

SEQ ID NO: 1611619 - DNA, 21 bp, Homo sapiens
ttgtaaatctttttgcttcta

SEQ ID NO: 1611620 - DNA, 19 bp, Homo sapiens
ttgtaaatgtactggtaat

SEQ ID NO: 1611621 - DNA, 11 bp, Homo sapiens
ttgtaaatgtg

SEQ ID NO: 1611622 - DNA, 18 bp, Homo sapiens
ttgtaaatgtgcttttaa

SEQ ID NO: 1611623 - DNA, 23 bp, Homo sapiens
ttgtaaattaatacttcatttgg

SEQ ID NO: 1611624 - DNA, 20 bp, Homo sapiens
ttgtaaccatatgattgaaa

SEQ ID NO: 1611625 - DNA, 9 bp, Homo sapiens
ttgtaacta

SEQ ID NO: 1611626 - DNA, 23 bp, Homo sapiens
ttgtaactacaaagctttgctac

SEQ ID NO: 1611627 - DNA, 14 bp, Homo sapiens
ttgtaactccacca

SEQ ID NO: 1611628 - DNA, 14 bp, Homo sapiens
ttgtaacttatatt

SEQ ID NO: 1611629 - DNA, 13 bp, Homo sapiens
ttgtaacttgttg

SEQ ID NO: 1611630 - DNA, 15 bp, Homo sapiens
ttgtaagaaggcaat

SEQ ID NO: 1611631 - DNA, 22 bp, Homo sapiens
ttgtaagacaaaggttttcctc

SEQ ID NO: 1611632 - DNA, 14 bp, Homo sapiens
ttgtaagacatttg

SEQ ID NO: 1611633 - DNA, 22 bp, Homo sapiens
ttgtaagatggataatgtgtat

SEQ ID NO: 1611634 - DNA, 14 bp, Homo sapiens
ttgtaagccatcag

SEQ ID NO: 1611635 - DNA, 18 bp, Homo sapiens
ttgtaagtaacacagtat

SEQ ID NO: 1611636 - DNA, 18 bp, Homo sapiens
ttgtaagtgtaaaaaatg

SEQ ID NO: 1611637 - DNA, 16 bp, Homo sapiens
ttgtaagtttgaattt

SEQ ID NO: 1611638 - DNA, 19 bp, Homo sapiens
ttgtaagtttgaatttgta

SEQ ID NO: 1611639 - DNA, 20 bp, Homo sapiens
ttgtaataaagtatataatt

SEQ ID NO: 1611640 - DNA, 20 bp, Homo sapiens
ttgtaatacttttgtaatct

SEQ ID NO: 1611641 - DNA, 15 bp, Homo sapiens
ttgtaatatacagtt

SEQ ID NO: 1611642 - DNA, 19 bp, Homo sapiens
ttgtaatatacagtttttg

SEQ ID NO: 1611643 - DNA, 16 bp, Homo sapiens
ttgtaatcgtgtgcca

SEQ ID NO: 1611644 - DNA, 23 bp, Homo sapiens
ttgtaatctgaagtatggtatta

SEQ ID NO: 1611645 - DNA, 13 bp, Homo sapiens
ttgtaatgctgca

SEQ ID NO: 1611646 - DNA, 16 bp, Homo sapiens
ttgtaatgctgcactt

SEQ ID NO: 1611647 - DNA, 12 bp, Homo sapiens
ttgtaatgttgt

SEQ ID NO: 1611648 - DNA, 21 bp, Homo sapiens
ttgtaatgttgtgaataatta

SEQ ID NO: 1611649 - DNA, 23 bp, Homo sapiens
ttgtaatgttgtgaataattaca

SEQ ID NO: 1611650 - DNA, 23 bp, Homo sapiens
ttgtaattctaaatgaatgttta

SEQ ID NO: 1611651 - DNA, 19 bp, Homo sapiens
ttgtaattgcttacatttt

SEQ ID NO: 1611652 - DNA, 14 bp, Homo sapiens
ttgtaattgtgtaa

SEQ ID NO: 1611653 - DNA, 21 bp, Homo sapiens
ttgtaatttaaacaggcccag

SEQ ID NO: 1611654 - DNA, 23 bp, Homo sapiens
ttgtaatttaaacaggcccagca

SEQ ID NO: 1611655 - DNA, 23 bp, Homo sapiens
ttgtaatttaaacatttgttcct

SEQ ID NO: 1611656 - DNA, 16 bp, Homo sapiens
ttgtacaaaaaaaaag

SEQ ID NO: 1611657 - DNA, 22 bp, Homo sapiens
ttgtacaaaaaaaaagttttat

SEQ ID NO: 1611658 - DNA, 12 bp, Homo sapiens
ttgtacaaaata

SEQ ID NO: 1611659 - DNA, 20 bp, Homo sapiens
ttgtacaaaattaagcaaat

SEQ ID NO: 1611660 - DNA, 16 bp, Homo sapiens
ttgtacaaataaacct

SEQ ID NO: 1611661 - DNA, 21 bp, Homo sapiens
ttgtacaaggtaattgttttt

SEQ ID NO: 1611662 - DNA, 12 bp, Homo sapiens
ttgtacaataaa

SEQ ID NO: 1611663 - DNA, 14 bp, Homo sapiens
ttgtacaataaatt

SEQ ID NO: 1611664 - DNA, 12 bp, Homo sapiens
ttgtacaatggt

SEQ ID NO: 1611665 - DNA, 13 bp, Homo sapiens
ttgtacaatggtt

SEQ ID NO: 1611666 - DNA, 18 bp, Homo sapiens
ttgtacacgctgatgaga

SEQ ID NO: 1611667 - DNA, 11 bp, Homo sapiens
ttgtacataaa

SEQ ID NO: 1611668 - DNA, 22 bp, Homo sapiens
ttgtacatacgatttaaggtat

SEQ ID NO: 1611669 - DNA, 15 bp, Homo sapiens
ttgtacattacacta

SEQ ID NO: 1611670 - DNA, 17 bp, Homo sapiens
ttgtacattacactaaa

SEQ ID NO: 1611671 - DNA, 20 bp, Homo sapiens
ttgtacattacactaaatta

SEQ ID NO: 1611672 - DNA, 19 bp, Homo sapiens
ttgtaccatagaaaaatgt

SEQ ID NO: 1611673 - DNA, 22 bp, Homo sapiens
ttgtaccgatgcagctctcttt

SEQ ID NO: 1611674 - DNA, 11 bp, Homo sapiens
ttgtacctctc

SEQ ID NO: 1611675 - DNA, 21 bp, Homo sapiens
ttgtacgaagagtatttttga

SEQ ID NO: 1611676 - DNA, 21 bp, Homo sapiens
ttgtactgaatttttttgtaa

SEQ ID NO: 1611677 - DNA, 12 bp, Homo sapiens
ttgtactgggac

SEQ ID NO: 1611678 - DNA, 22 bp, Homo sapiens
ttgtacttagccagttcaaagt

SEQ ID NO: 1611679 - DNA, 17 bp, Homo sapiens
ttgtacttctgtgttca

SEQ ID NO: 1611680 - DNA, 15 bp, Homo sapiens
ttgtactttaaaaat

SEQ ID NO: 1611681 - DNA, 15 bp, Homo sapiens
ttgtactttatcatg

SEQ ID NO: 1611682 - DNA, 13 bp, Homo sapiens
ttgtactttctgt

SEQ ID NO: 1611683 - DNA, 17 bp, Homo sapiens
ttgtactttctgttaaa

SEQ ID NO: 1611684 - DNA, 17 bp, Homo sapiens
ttgtacttttttcttaa

SEQ ID NO: 1611685 - DNA, 12 bp, Homo sapiens
ttgtagaaacac

SEQ ID NO: 1611686 - DNA, 17 bp, Homo sapiens
ttgtagaactcactctg

SEQ ID NO: 1611687 - DNA, 19 bp, Homo sapiens
ttgtcttcctatttcagaa

SEQ ID NO: 1611688 - DNA, 14 bp, Homo sapiens
ttgtcttgaaagat

SEQ ID NO: 1611689 - DNA, 15 bp, Homo sapiens
ttgtcttgaatgtct

SEQ ID NO: 1611690 - DNA, 16 bp, Homo sapiens
ttgtcttgtacttctg

SEQ ID NO: 1611691 - DNA, 12 bp, Homo sapiens
ttgtctttgctg

SEQ ID NO: 1611692 - DNA, 14 bp, Homo sapiens
ttgtctttgtaata

SEQ ID NO: 1611693 - DNA, 20 bp, Homo sapiens
ttgtcttttagacaactaga

SEQ ID NO: 1611694 - DNA, 20 bp, Homo sapiens
ttgtcttttttttcctttga

SEQ ID NO: 1611695 - DNA, 12 bp, Homo sapiens
ttgtgaactgga

SEQ ID NO: 1611696 - DNA, 14 bp, Homo sapiens
ttgtgaactggaag

SEQ ID NO: 1611697 - DNA, 21 bp, Homo sapiens
ttgtgaactggaagaaagcaa

SEQ ID NO: 1611698 - DNA, 14 bp, Homo sapiens
ttgtgaactgtctt

SEQ ID NO: 1611699 - DNA, 19 bp, Homo sapiens
ttgtgaagaaaaataaagt

SEQ ID NO: 1611700 - DNA, 19 bp, Homo sapiens
ttgtgaagaactattttat

SEQ ID NO: 1611701 - DNA, 13 bp, Homo sapiens
ttgtgaaggcagg

SEQ ID NO: 1611702 - DNA, 14 bp, Homo sapiens
ttgtgaagtacata

SEQ ID NO: 1611703 - DNA, 23 bp, Homo sapiens
ttgtgaagtgaaggatttgtgtt

SEQ ID NO: 1611704 - DNA, 21 bp, Homo sapiens
ttgtgaataattacagtgcct

SEQ ID NO: 1611705 - DNA, 19 bp, Homo sapiens
ttgtgaattaggctgtaac

SEQ ID NO: 1611706 - DNA, 21 bp, Homo sapiens
ttgtgaccaatacatttgtat

SEQ ID NO: 1611707 - DNA, 23 bp, Homo sapiens
ttgtgaccaatacatttgtattt

SEQ ID NO: 1611708 - DNA, 21 bp, Homo sapiens
ttgtgaccactgaattcactc

SEQ ID NO: 1611709 - DNA, 19 bp, Homo sapiens
ttgtgacccctttcactta

SEQ ID NO: 1611710 - DNA, 17 bp, Homo sapiens
ttgtgacttttgcttta

SEQ ID NO: 1611711 - DNA, 15 bp, Homo sapiens
ttgtgagagcgaggc

SEQ ID NO: 1611712 - DNA, 20 bp, Homo sapiens
ttgtgaggcccatggttgag

SEQ ID NO: 1611713 - DNA, 18 bp, Homo sapiens
ttgtgatattaaatttca

SEQ ID NO: 1611714 - DNA, 11 bp, Homo sapiens
ttgtgatgaac

SEQ ID NO: 1611715 - DNA, 20 bp, Homo sapiens
ttgtgatgaatctacatttg

SEQ ID NO: 1611716 - DNA, 12 bp, Homo sapiens
ttgtgatgtgtc

SEQ ID NO: 1611717 - DNA, 19 bp, Homo sapiens
ttgtgattcaatctgtaaa

SEQ ID NO: 1611718 - DNA, 13 bp, Homo sapiens
ttgtgattggctg

SEQ ID NO: 1611719 - DNA, 22 bp, Homo sapiens
ttgtgcaaaagcttcaaattaa

SEQ ID NO: 1611720 - DNA, 21 bp, Homo sapiens
ttgtgcaaaatatttgactat

SEQ ID NO: 1611721 - DNA, 15 bp, Homo sapiens
ttgttgaactgttag

SEQ ID NO: 1611722 - DNA, 17 bp, Homo sapiens
ttgttgacagcttggaa

SEQ ID NO: 1611723 - DNA, 17 bp, Homo sapiens
ttgttgaggttaagttt

SEQ ID NO: 1611724 - DNA, 15 bp, Homo sapiens
ttgttgataggaact

SEQ ID NO: 1611725 - DNA, 19 bp, Homo sapiens
ttgttgcaagatgtgaatt

SEQ ID NO: 1611726 - DNA, 18 bp, Homo sapiens
ttgttgcagagatttcct

SEQ ID NO: 1611727 - DNA, 21 bp, Homo sapiens
ttgttgccaggttgcagctgc

SEQ ID NO: 1611728 - DNA, 22 bp, Homo sapiens
ttgttgccaggttgcagctgct

SEQ ID NO: 1611729 - DNA, 20 bp, Homo sapiens
ttgttgctcagcaaggggct

SEQ ID NO: 1611730 - DNA, 18 bp, Homo sapiens
ttgttgctgttgatgttt

SEQ ID NO: 1611731 - DNA, 13 bp, Homo sapiens
ttgttggaatgaa

SEQ ID NO: 1611732 - DNA, 21 bp, Homo sapiens
ttgttggcctccggcctcccc

SEQ ID NO: 1611733 - DNA, 19 bp, Homo sapiens
ttgttgggattcctgaccc

SEQ ID NO: 1611734 - DNA, 20 bp, Homo sapiens
ttgttgggattcctgaccca

SEQ ID NO: 1611735 - DNA, 21 bp, Homo sapiens
ttgttgtaaaacaaaatttga

SEQ ID NO: 1611736 - DNA, 20 bp, Homo sapiens
ttgttgtgttgagatccagt

SEQ ID NO: 1611737 - DNA, 16 bp, Homo sapiens
ttgttgttgctgctgt

SEQ ID NO: 1611738 - DNA, 23 bp, Homo sapiens
ttgttgtttgccatactttgtct

SEQ ID NO: 1611739 - DNA, 14 bp, Homo sapiens
ttgtttaaaatcat

SEQ ID NO: 1611740 - DNA, 21 bp, Homo sapiens
ttgtttaaaatgtaatttaaa

SEQ ID NO: 1611741 - DNA, 21 bp, Homo sapiens
ttgtttaaacccaagtgctgc

SEQ ID NO: 1611742 - DNA, 18 bp, Homo sapiens
ttgtttagaagaagtgtg

SEQ ID NO: 1611743 - DNA, 20 bp, Homo sapiens
ttgtttagattttgtgttta

SEQ ID NO: 1611744 - DNA, 17 bp, Homo sapiens
ttgtttataatgttatc

SEQ ID NO: 1611745 - DNA, 14 bp, Homo sapiens
ttgtttatcaactt

SEQ ID NO: 1611746 - DNA, 12 bp, Homo sapiens
ttgtttatgtaa

SEQ ID NO: 1611747 - DNA, 20 bp, Homo sapiens
ttgtttatgtgttatgaaca

SEQ ID NO: 1611748 - DNA, 15 bp, Homo sapiens
ttgtttccaacttgt

SEQ ID NO: 1611749 - DNA, 17 bp, Homo sapiens
ttgtttctccccctggg

SEQ ID NO: 1611750 - DNA, 21 bp, Homo sapiens
ttgtttctgaaaattccagaa

SEQ ID NO: 1611751 - DNA, 12 bp, Homo sapiens
ttgtttcttaag

SEQ ID NO: 1611752 - DNA, 17 bp, Homo sapiens
ttgtttcttgacaagct

SEQ ID NO: 1611753 - DNA, 13 bp, Homo sapiens
ttgtttgcactgt

SEQ ID NO: 1611754 - DNA, 13 bp, Homo sapiens
ttgtttgccagga

SEQ ID NO: 1611755 - DNA, 16 bp, Homo sapiens
ttgtttgccatacttt

SEQ ID NO: 1611756 - DNA, 12 bp, Homo sapiens
ttgtttggagac

SEQ ID NO: 1611757 - DNA, 18 bp, Homo sapiens
ttgtttggcaatgcactg

SEQ ID NO: 1611758 - DNA, 17 bp, Homo sapiens
ttgtttggtaaatgttt

SEQ ID NO: 1611759 - DNA, 16 bp, Homo sapiens
ttgtttgtaaatgcct

SEQ ID NO: 1611760 - DNA, 11 bp, Homo sapiens
ttgtttgtatt

SEQ ID NO: 1611761 - DNA, 12 bp, Homo sapiens
ttgtttgtattc

SEQ ID NO: 1611762 - DNA, 13 bp, Homo sapiens
ttgtttgtcagca

SEQ ID NO: 1611763 - DNA, 12 bp, Homo sapiens
ttgtttgtctgt

SEQ ID NO: 1611764 - DNA, 21 bp, Homo sapiens
ttgtttgtttctccccctggg

SEQ ID NO: 1611765 - DNA, 15 bp, Homo sapiens
ttgtttgtttttgct

SEQ ID NO: 1611766 - DNA, 13 bp, Homo sapiens
ttgttttaatctt

SEQ ID NO: 1611767 - DNA, 19 bp, Homo sapiens
ttgttttccatcatttggt

SEQ ID NO: 1611768 - DNA, 20 bp, Homo sapiens
ttgttttgagctttccatgt

SEQ ID NO: 1611769 - DNA, 23 bp, Homo sapiens
ttgttttgatgtttgtggcctca

SEQ ID NO: 1611770 - DNA, 14 bp, Homo sapiens
ttgttttgcacttt

SEQ ID NO: 1611771 - DNA, 15 bp, Homo sapiens
ttgttttgcactttt

SEQ ID NO: 1611772 - DNA, 16 bp, Homo sapiens
ttgttttgcacttttt

SEQ ID NO: 1611773 - DNA, 13 bp, Homo sapiens
ttgttttgctttt

SEQ ID NO: 1611774 - DNA, 17 bp, Homo sapiens
ttgttttggatggcttg

SEQ ID NO: 1611775 - DNA, 16 bp, Homo sapiens
ttgttttgtgtttcat

SEQ ID NO: 1611776 - DNA, 18 bp, Homo sapiens
ttgtttttattttcaaga

SEQ ID NO: 1611777 - DNA, 13 bp, Homo sapiens
ttgtttttccttg

SEQ ID NO: 1611778 - DNA, 21 bp, Homo sapiens
ttgtttttccttgtatttaaa

SEQ ID NO: 1611779 - DNA, 15 bp, Homo sapiens
ttgtttttgtaaaga

SEQ ID NO: 1611780 - DNA, 15 bp, Homo sapiens
ttgttttttaaagca

SEQ ID NO: 1611781 - DNA, 18 bp, Homo sapiens
ttgttttttaaagcaagt

SEQ ID NO: 1611782 - DNA, 23 bp, Homo sapiens
ttgttttttaaagcaagtcacct

SEQ ID NO: 1611783 - DNA, 12 bp, Homo sapiens
tttaaaaaagaa

SEQ ID NO: 1611784 - DNA, 12 bp, Homo sapiens
tttaaaaaataa

SEQ ID NO: 1611785 - DNA, 18 bp, Homo sapiens
tttaaaaaatgttttctg

SEQ ID NO: 1611786 - DNA, 14 bp, Homo sapiens
tttaaaaacaaaca

SEQ ID NO: 1611787 - DNA, 19 bp, Homo sapiens
tttaaaaacatagaaaaat

SEQ ID NO: 1611788 - DNA, 21 bp, Homo sapiens
tttaaaaagaaacaagatgct

SEQ ID NO: 1611789 - DNA, 13 bp, Homo sapiens
tttaaaaaggaaa

SEQ ID NO: 1611790 - DNA, 11 bp, Homo sapiens
tttaaaaataa

SEQ ID NO: 1611791 - DNA, 20 bp, Homo sapiens
tttaaaaataagtcaacagt

SEQ ID NO: 1611792 - DNA, 22 bp, Homo sapiens
tttaaaaataagtcaacagtaa

SEQ ID NO: 1611793 - DNA, 20 bp, Homo sapiens
tttaaaaatagaatacattt

SEQ ID NO: 1611794 - DNA, 16 bp, Homo sapiens
tttaaaaattgtttct

SEQ ID NO: 1611795 - DNA, 14 bp, Homo sapiens
tttaaaaatttact

SEQ ID NO: 1611796 - DNA, 15 bp, Homo sapiens
tttaaaacagacact

SEQ ID NO: 1611797 - DNA, 15 bp, Homo sapiens
tttaaaacaggcaaa

SEQ ID NO: 1611798 - DNA, 14 bp, Homo sapiens
tttaaaacatgtaa

SEQ ID NO: 1611799 - DNA, 16 bp, Homo sapiens
tttaaaacatttttta

SEQ ID NO: 1611800 - DNA, 20 bp, Homo sapiens
tttaaaactcagaatataac

SEQ ID NO: 1611801 - DNA, 15 bp, Homo sapiens
tttaaaactgttgga

SEQ ID NO: 1611802 - DNA, 14 bp, Homo sapiens
tttaaaagattcat

SEQ ID NO: 1611803 - DNA, 21 bp, Homo sapiens
tttaaaaggtattttgaatac

SEQ ID NO: 1611804 - DNA, 22 bp, Homo sapiens
tttaaaaggtattttgaatacc

SEQ ID NO: 1611805 - DNA, 17 bp, Homo sapiens
tttaaaataaattccta

SEQ ID NO: 1611806 - DNA, 19 bp, Homo sapiens
tttaaaataaattcctaca

SEQ ID NO: 1611807 - DNA, 21 bp, Homo sapiens
tttaaaatagaaattttgtaa

SEQ ID NO: 1611808 - DNA, 22 bp, Homo sapiens
tttaaaatagaaattttgtaag

SEQ ID NO: 1611809 - DNA, 15 bp, Homo sapiens
tttaaaatcaactta

SEQ ID NO: 1611810 - DNA, 18 bp, Homo sapiens
tttaaaatcagctatttt

SEQ ID NO: 1611811 - DNA, 14 bp, Homo sapiens
tttaaaatgattag

SEQ ID NO: 1611812 - DNA, 18 bp, Homo sapiens
tttaaaatgtaatttaaa

SEQ ID NO: 1611813 - DNA, 21 bp, Homo sapiens
tttaaaatgtaatttaaatga

SEQ ID NO: 1611814 - DNA, 23 bp, Homo sapiens
tttaaaatgtaatttaaatgaaa

SEQ ID NO: 1611815 - DNA, 21 bp, Homo sapiens
tttaaaatgtacatgtattaa

SEQ ID NO: 1611816 - DNA, 15 bp, Homo sapiens
tttaaaattaatctt

SEQ ID NO: 1611817 - DNA, 19 bp, Homo sapiens
tttaaaattaatcttgctt

SEQ ID NO: 1611818 - DNA, 19 bp, Homo sapiens
tttaaaattctcttccaac

SEQ ID NO: 1611819 - DNA, 18 bp, Homo sapiens
tttaaaattgctatgtta

SEQ ID NO: 1611820 - DNA, 19 bp, Homo sapiens
tttaaaatttaagtatctt

SEQ ID NO: 1611821 - DNA, 17 bp, Homo sapiens
tttaaaattttgtatgt

SEQ ID NO: 1611822 - DNA, 21 bp, Homo sapiens
tttaaaattttgtatgttaaa

SEQ ID NO: 1611823 - DNA, 14 bp, Homo sapiens
tttaaacaaattca

SEQ ID NO: 1611824 - DNA, 22 bp, Homo sapiens
tttaaacactcttcagagaaat

SEQ ID NO: 1611825 - DNA, 19 bp, Homo sapiens
tttaaacattaatagcagc

SEQ ID NO: 1611826 - DNA, 20 bp, Homo sapiens
tttaaacatttgttcctgga

SEQ ID NO: 1611827 - DNA, 15 bp, Homo sapiens
tttaaacctttttct

SEQ ID NO: 1611828 - DNA, 15 bp, Homo sapiens
tttaaactgattcat

SEQ ID NO: 1611829 - DNA, 19 bp, Homo sapiens
tttaaactgtgtacataac

SEQ ID NO: 1611830 - DNA, 13 bp, Homo sapiens
tttaaactgtgtt

SEQ ID NO: 1611831 - DNA, 13 bp, Homo sapiens
tttaaacttgaaa

SEQ ID NO: 1611832 - DNA, 20 bp, Homo sapiens
tttaaacttgaaatatataa

SEQ ID NO: 1611833 - DNA, 14 bp, Homo sapiens
tttaaagaaagtgt

SEQ ID NO: 1611834 - DNA, 11 bp, Homo sapiens
tttaaagacag

SEQ ID NO: 1611835 - DNA, 24 bp, Homo sapiens
tttaaagcttattaaaactcattt

SEQ ID NO: 1611836 - DNA, 18 bp, Homo sapiens
tttaaaggcattagagtc

SEQ ID NO: 1611837 - DNA, 23 bp, Homo sapiens
tttaaagtatgaatctatgccaa

SEQ ID NO: 1611838 - DNA, 16 bp, Homo sapiens
ttctgtgttgaacaca

SEQ ID NO: 1611839 - DNA, 12 bp, Homo sapiens
ttctgtgtttta

SEQ ID NO: 1611840 - DNA, 13 bp, Homo sapiens
ttctgttaaaatg

SEQ ID NO: 1611841 - DNA, 24 bp, Homo sapiens
ttctgttaaaatggggataataat

SEQ ID NO: 1611842 - DNA, 16 bp, Homo sapiens
ttctgttctccctggg

SEQ ID NO: 1611843 - DNA, 16 bp, Homo sapiens
ttctgttctggaggaa

SEQ ID NO: 1611844 - DNA, 15 bp, Homo sapiens
ttctgttctgttgat

SEQ ID NO: 1611845 - DNA, 15 bp, Homo sapiens
ttctgttcttacaaa

SEQ ID NO: 1611846 - DNA, 16 bp, Homo sapiens
ttctgttcttacaaat

SEQ ID NO: 1611847 - DNA, 14 bp, Homo sapiens
ttctgttgagagaa

SEQ ID NO: 1611848 - DNA, 14 bp, Homo sapiens
ttctgttgtctgcg

SEQ ID NO: 1611849 - DNA, 19 bp, Homo sapiens
ttctgtttattcttccaga

SEQ ID NO: 1611850 - DNA, 16 bp, Homo sapiens
ttctgtttcaaagcac

SEQ ID NO: 1611851 - DNA, 18 bp, Homo sapiens
ttctgtttcctatttaat

SEQ ID NO: 1611852 - DNA, 23 bp, Homo sapiens
ttctgtttcctatttaatacagc

SEQ ID NO: 1611853 - DNA, 13 bp, Homo sapiens
ttctgtttggcac

SEQ ID NO: 1611854 - DNA, 18 bp, Homo sapiens
ttctgtttggcacttgta

SEQ ID NO: 1611855 - DNA, 20 bp, Homo sapiens
ttctgtttggcacttgtatt

SEQ ID NO: 1611856 - DNA, 21 bp, Homo sapiens
ttctgtttggcacttgtattt

SEQ ID NO: 1611857 - DNA, 12 bp, Homo sapiens
ttctgtttgtta

SEQ ID NO: 1611858 - DNA, 18 bp, Homo sapiens
ttctgttttcccccagca

SEQ ID NO: 1611859 - DNA, 17 bp, Homo sapiens
ttcttaaaagtacttta

SEQ ID NO: 1611860 - DNA, 22 bp, Homo sapiens
ttcttaaaatcaaatgtaaatc

SEQ ID NO: 1611861 - DNA, 19 bp, Homo sapiens
ttcttaaaattcaagaaaa

SEQ ID NO: 1611862 - DNA, 22 bp, Homo sapiens
ttcttaaaccatttttgctgaa

SEQ ID NO: 1611863 - DNA, 19 bp, Homo sapiens
ttcttaaaggcctggaacc

SEQ ID NO: 1611864 - DNA, 16 bp, Homo sapiens
ttcttaaatatgtata

SEQ ID NO: 1611865 - DNA, 13 bp, Homo sapiens
ttcttaacaaccg

SEQ ID NO: 1611866 - DNA, 13 bp, Homo sapiens
ttcttaacttctt

SEQ ID NO: 1611867 - DNA, 16 bp, Homo sapiens
ttcttaacttcttgct

SEQ ID NO: 1611868 - DNA, 22 bp, Homo sapiens
ttcttaagccctttgctctgga

SEQ ID NO: 1611869 - DNA, 22 bp, Homo sapiens
ttcttaaggattgtgatatttt

SEQ ID NO: 1611870 - DNA, 17 bp, Homo sapiens
ttcttaagggcacacac

SEQ ID NO: 1611871 - DNA, 19 bp, Homo sapiens
ttcttaattcatgaggagg

SEQ ID NO: 1611872 - DNA, 21 bp, Homo sapiens
ttcttacaattgcactgctgt

SEQ ID NO: 1611873 - DNA, 21 bp, Homo sapiens
ttcttacagcacatcacctct

SEQ ID NO: 1611874 - DNA, 13 bp, Homo sapiens
ttcttacatgttt

SEQ ID NO: 1611875 - DNA, 21 bp, Homo sapiens
ttcttacccagattgtgtaca

SEQ ID NO: 1611876 - DNA, 15 bp, Homo sapiens
ttcttactaaacatt

SEQ ID NO: 1611877 - DNA, 18 bp, Homo sapiens
ttcttactaaacattttg

SEQ ID NO: 1611878 - DNA, 16 bp, Homo sapiens
ttcttactgataattt

SEQ ID NO: 1611879 - DNA, 20 bp, Homo sapiens
ttcttactgataattttgct

SEQ ID NO: 1611880 - DNA, 13 bp, Homo sapiens
ttcttagagtgta

SEQ ID NO: 1611881 - DNA, 19 bp, Homo sapiens
ttcttagagtgtagctgta

SEQ ID NO: 1611882 - DNA, 14 bp, Homo sapiens
ttcttaggtttact

SEQ ID NO: 1611883 - DNA, 15 bp, Homo sapiens
ttcttaggtttactg

SEQ ID NO: 1611884 - DNA, 20 bp, Homo sapiens
ttcttagtgcttcagagttt

SEQ ID NO: 1611885 - DNA, 13 bp, Homo sapiens
ttcttagtgtcac

SEQ ID NO: 1611886 - DNA, 21 bp, Homo sapiens
ttcttatacatttgataaagt

SEQ ID NO: 1611887 - DNA, 17 bp, Homo sapiens
ttcttatacgcttttct

SEQ ID NO: 1611888 - DNA, 20 bp, Homo sapiens
ttcttatacgcttttctttg

SEQ ID NO: 1611889 - DNA, 18 bp, Homo sapiens
ttcttatgaggaggggag

SEQ ID NO: 1611890 - DNA, 17 bp, Homo sapiens
ttcttatttcatttatt

SEQ ID NO: 1611891 - DNA, 21 bp, Homo sapiens
ttcttcaaacagtatataact

SEQ ID NO: 1611892 - DNA, 15 bp, Homo sapiens
ttcttcaactcctgg

SEQ ID NO: 1611893 - DNA, 18 bp, Homo sapiens
ttcttcaccaagtgcaat

SEQ ID NO: 1611894 - DNA, 21 bp, Homo sapiens
ttcttcacccagctaatctgt

SEQ ID NO: 1611895 - DNA, 17 bp, Homo sapiens
ttcttcagaagacactg

SEQ ID NO: 1611896 - DNA, 20 bp, Homo sapiens
ttcttcagagtgaagaatct

SEQ ID NO: 1611897 - DNA, 18 bp, Homo sapiens
ttcttcagagtttgtcat

SEQ ID NO: 1611898 - DNA, 17 bp, Homo sapiens
ttcttcagatcagtgct

SEQ ID NO: 1611899 - DNA, 18 bp, Homo sapiens
ttcttcataacaatttta

SEQ ID NO: 1611900 - DNA, 15 bp, Homo sapiens
ttcttcatttctctg

SEQ ID NO: 1611901 - DNA, 23 bp, Homo sapiens
ttcttccaaatgcagttcattgc

SEQ ID NO: 1611902 - DNA, 18 bp, Homo sapiens
ttcttcccagaatctctg

SEQ ID NO: 1611903 - DNA, 21 bp, Homo sapiens
ttcttcccagaatctctgagc

SEQ ID NO: 1611904 - DNA, 19 bp, Homo sapiens
ttcttcccatcactggagc

SEQ ID NO: 1611905 - DNA, 21 bp, Homo sapiens
ttcttccccaggtccttcctt

SEQ ID NO: 1611906 - DNA, 13 bp, Homo sapiens
ttcttccctgctt

SEQ ID NO: 1611907 - DNA, 13 bp, Homo sapiens
ttcttcccttttc

SEQ ID NO: 1611908 - DNA, 15 bp, Homo sapiens
ttcttcctaatgtca

SEQ ID NO: 1611909 - DNA, 15 bp, Homo sapiens
ttcttcctcttcttt

SEQ ID NO: 1611910 - DNA, 14 bp, Homo sapiens
ttcttcctttctgt

SEQ ID NO: 1611911 - DNA, 14 bp, Homo sapiens
ttcttcgctgctct

SEQ ID NO: 1611912 - DNA, 17 bp, Homo sapiens
ttcttctaagaagacat

SEQ ID NO: 1611913 - DNA, 21 bp, Homo sapiens
ttcttctagaatgtaaagtta

SEQ ID NO: 1611914 - DNA, 11 bp, Homo sapiens
ttcttctagag

SEQ ID NO: 1611915 - DNA, 21 bp, Homo sapiens
ttcttctaggttctaaaaatt

SEQ ID NO: 1611916 - DNA, 23 bp, Homo sapiens
ttcttctgaactcaaactgagga

SEQ ID NO: 1611917 - DNA, 13 bp, Homo sapiens
ttcttctgaagat

SEQ ID NO: 1611918 - DNA, 20 bp, Homo sapiens
ttcttctgcaacatttgaca

SEQ ID NO: 1611919 - DNA, 11 bp, Homo sapiens
ttcttctgggc

SEQ ID NO: 1611920 - DNA, 23 bp, Homo sapiens
ttcttctggtgctactccatgca

SEQ ID NO: 1611921 - DNA, 13 bp, Homo sapiens
ttcttctgtattt

SEQ ID NO: 1611922 - DNA, 20 bp, Homo sapiens
ttcttctgtcctgagaagca

SEQ ID NO: 1611923 - DNA, 13 bp, Homo sapiens
ttcttctgtgtta

SEQ ID NO: 1611924 - DNA, 16 bp, Homo sapiens
ttcttctgttctgcag

SEQ ID NO: 1611925 - DNA, 13 bp, Homo sapiens
ttcttctttctag

SEQ ID NO: 1611926 - DNA, 15 bp, Homo sapiens
ttcttctttctagag

SEQ ID NO: 1611927 - DNA, 13 bp, Homo sapiens
ttcttgaaagctg

SEQ ID NO: 1611928 - DNA, 15 bp, Homo sapiens
ttcttgaaagctgtg

SEQ ID NO: 1611929 - DNA, 16 bp, Homo sapiens
ttcttgaatataaaaa

SEQ ID NO: 1611930 - DNA, 19 bp, Homo sapiens
ttcttgacaagctgacttg

SEQ ID NO: 1611931 - DNA, 18 bp, Homo sapiens
ttcttgaggaaaatattg

SEQ ID NO: 1611932 - DNA, 13 bp, Homo sapiens
ttcttgatcttaa

SEQ ID NO: 1611933 - DNA, 14 bp, Homo sapiens
ttcttgatgtcatg

SEQ ID NO: 1611934 - DNA, 15 bp, Homo sapiens
ttcttgattcctggc

SEQ ID NO: 1611935 - DNA, 19 bp, Homo sapiens
ttcttgattttcaagcttt

SEQ ID NO: 1611936 - DNA, 15 bp, Homo sapiens
ttcttgcagattcta

SEQ ID NO: 1611937 - DNA, 19 bp, Homo sapiens
ttcttgctatatgatttag

SEQ ID NO: 1611938 - DNA, 14 bp, Homo sapiens
ttcttgctggttgt

SEQ ID NO: 1611939 - DNA, 17 bp, Homo sapiens
ttcttgcttctttctag

SEQ ID NO: 1611940 - DNA, 17 bp, Homo sapiens
ttcttgcttggaagcca

SEQ ID NO: 1611941 - DNA, 14 bp, Homo sapiens
ttcttgctttcaca

SEQ ID NO: 1611942 - DNA, 18 bp, Homo sapiens
ttcttgggatagtgttct

SEQ ID NO: 1611943 - DNA, 19 bp, Homo sapiens
ttcttgggatagtgttctg

SEQ ID NO: 1611944 - DNA, 22 bp, Homo sapiens
ttcttgggcctcaggctctgca

SEQ ID NO: 1611945 - DNA, 23 bp, Homo sapiens
ttcttgggcctcaggctctgcac

SEQ ID NO: 1611946 - DNA, 19 bp, Homo sapiens
ttcttggggcccagtgcat

SEQ ID NO: 1611947 - DNA, 12 bp, Homo sapiens
ttcttgggtagt

SEQ ID NO: 1611948 - DNA, 15 bp, Homo sapiens
ttcttggtttgggga

SEQ ID NO: 1611949 - DNA, 14 bp, Homo sapiens
ttcttgtaaatctt

SEQ ID NO: 1611950 - DNA, 14 bp, Homo sapiens
ttctctactgtctg

SEQ ID NO: 1611951 - DNA, 17 bp, Homo sapiens
ttctctagctctctagg

SEQ ID NO: 1611952 - DNA, 18 bp, Homo sapiens
ttctctagctctctaggc

SEQ ID NO: 1611953 - DNA, 22 bp, Homo sapiens
ttctctatgacatgaaatgaaa

SEQ ID NO: 1611954 - DNA, 17 bp, Homo sapiens
ttctctcagctcccagg

SEQ ID NO: 1611955 - DNA, 19 bp, Homo sapiens
ttctctcagctcccaggcc

SEQ ID NO: 1611956 - DNA, 20 bp, Homo sapiens
ttctctcagctcccaggcca

SEQ ID NO: 1611957 - DNA, 21 bp, Homo sapiens
ttctctcatcggaggcccatg

SEQ ID NO: 1611958 - DNA, 23 bp, Homo sapiens
ttctctccgacttcccctgggca

SEQ ID NO: 1611959 - DNA, 11 bp, Homo sapiens
ttctctcctgg

SEQ ID NO: 1611960 - DNA, 16 bp, Homo sapiens
ttctctctcctgtcca

SEQ ID NO: 1611961 - DNA, 21 bp, Homo sapiens
ttctctctctctcacacacac

SEQ ID NO: 1611962 - DNA, 17 bp, Homo sapiens
ttctctctggagcccct

SEQ ID NO: 1611963 - DNA, 17 bp, Homo sapiens
ttctctctggcttctct

SEQ ID NO: 1611964 - DNA, 19 bp, Homo sapiens
ttctctctggcttctctct

SEQ ID NO: 1611965 - DNA, 13 bp, Homo sapiens
ttctctcttcaat

SEQ ID NO: 1611966 - DNA, 13 bp, Homo sapiens
ttctctcttccct

SEQ ID NO: 1611967 - DNA, 15 bp, Homo sapiens
ttctctcttttcctc

SEQ ID NO: 1611968 - DNA, 16 bp, Homo sapiens
ttctctgacttctgcc

SEQ ID NO: 1611969 - DNA, 15 bp, Homo sapiens
ttctctgcccacagt

SEQ ID NO: 1611970 - DNA, 12 bp, Homo sapiens
ttctctgcccag

SEQ ID NO: 1611971 - DNA, 16 bp, Homo sapiens
ttctctgcccagccgg

SEQ ID NO: 1611972 - DNA, 21 bp, Homo sapiens
ttctctgctatatataaaacg

SEQ ID NO: 1611973 - DNA, 15 bp, Homo sapiens
ttctctgctccacca

SEQ ID NO: 1611974 - DNA, 12 bp, Homo sapiens
ttctctgggaga

SEQ ID NO: 1611975 - DNA, 23 bp, Homo sapiens
ttctctgggagaaaatcatcaag

SEQ ID NO: 1611976 - DNA, 16 bp, Homo sapiens
ttctctgggtctgatt

SEQ ID NO: 1611977 - DNA, 19 bp, Homo sapiens
ttctctgtaagtgtagctc

SEQ ID NO: 1611978 - DNA, 14 bp, Homo sapiens
ttctctgtactttt

SEQ ID NO: 1611979 - DNA, 18 bp, Homo sapiens
ttctctgtacttttcatt

SEQ ID NO: 1611980 - DNA, 21 bp, Homo sapiens
ttctctgtacttttcattctc

SEQ ID NO: 1611981 - DNA, 21 bp, Homo sapiens
ttctctgtcctacttctgact

SEQ ID NO: 1611982 - DNA, 12 bp, Homo sapiens
ttctctgtgaac

SEQ ID NO: 1611983 - DNA, 21 bp, Homo sapiens
ttctctgtgctctgaatggga

SEQ ID NO: 1611984 - DNA, 20 bp, Homo sapiens
ttctctgtgtgcacacccat

SEQ ID NO: 1611985 - DNA, 19 bp, Homo sapiens
ttctcttaagattaatttt

SEQ ID NO: 1611986 - DNA, 12 bp, Homo sapiens
ttctcttcattt

SEQ ID NO: 1611987 - DNA, 17 bp, Homo sapiens
ttctcttccccttcctg

SEQ ID NO: 1611988 - DNA, 18 bp, Homo sapiens
ttctcttccccttcctgt

SEQ ID NO: 1611989 - DNA, 14 bp, Homo sapiens
ttctcttccctgaa

SEQ ID NO: 1611990 - DNA, 23 bp, Homo sapiens
ttctcttccctgcgcctgtgatg

SEQ ID NO: 1611991 - DNA, 14 bp, Homo sapiens
ttctcttcctaaat

SEQ ID NO: 1611992 - DNA, 16 bp, Homo sapiens
ttctcttcctagatct

SEQ ID NO: 1611993 - DNA, 20 bp, Homo sapiens
ttctcttcctagatctgcag

SEQ ID NO: 1611994 - DNA, 22 bp, Homo sapiens
ttctcttgagataaggttttaa

SEQ ID NO: 1611995 - DNA, 14 bp, Homo sapiens
ttctcttgagctgg

SEQ ID NO: 1611996 - DNA, 18 bp, Homo sapiens
ttctcttgagctggcctc

SEQ ID NO: 1611997 - DNA, 14 bp, Homo sapiens
ttctcttgcattgt

SEQ ID NO: 1611998 - DNA, 22 bp, Homo sapiens
ttctcttgcattgtgacaagaa

SEQ ID NO: 1611999 - DNA, 23 bp, Homo sapiens
ttctcttgtataagatcctagat

SEQ ID NO: 1612000 - DNA, 13 bp, Homo sapiens
ttctcttgtcctt

SEQ ID NO: 1612001 - DNA, 13 bp, Homo sapiens
ttctctttcaaag

SEQ ID NO: 1612002 - DNA, 13 bp, Homo sapiens
ttctctttctctc

SEQ ID NO: 1612003 - DNA, 16 bp, Homo sapiens
ttctctttctctcctt

SEQ ID NO: 1612004 - DNA, 18 bp, Homo sapiens
ttctctttgataacaaaa

SEQ ID NO: 1612005 - DNA, 19 bp, Homo sapiens
ttctctttggaaatagcat

SEQ ID NO: 1612006 - DNA, 21 bp, Homo sapiens
ttctcttttcaagaagttctt

SEQ ID NO: 1612007 - DNA, 21 bp, Homo sapiens
ttctcttttcccctttcctgt

SEQ ID NO: 1612008 - DNA, 18 bp, Homo sapiens
ttctcttttgctttctgt

SEQ ID NO: 1612009 - DNA, 22 bp, Homo sapiens
ttctcttttgctttctgtttct

SEQ ID NO: 1612010 - DNA, 12 bp, Homo sapiens
ttctgaaagagt

SEQ ID NO: 1612011 - DNA, 23 bp, Homo sapiens
ttctgaaaggagacattgctcta

SEQ ID NO: 1612012 - DNA, 22 bp, Homo sapiens
ttctgaactcaaactgaggaat

SEQ ID NO: 1612013 - DNA, 14 bp, Homo sapiens
ttctgaactcaagc

SEQ ID NO: 1612014 - DNA, 15 bp, Homo sapiens
ttctgaactgttaca

SEQ ID NO: 1612015 - DNA, 17 bp, Homo sapiens
ttctgaataaagcaatt

SEQ ID NO: 1612016 - DNA, 17 bp, Homo sapiens
ttctgaataatttctta

SEQ ID NO: 1612017 - DNA, 22 bp, Homo sapiens
ttctgacaaaaagtttccatat

SEQ ID NO: 1612018 - DNA, 18 bp, Homo sapiens
ttctgacctcaagtgatt

SEQ ID NO: 1612019 - DNA, 22 bp, Homo sapiens
ttctgacgtcagcgcaccaaaa

SEQ ID NO: 1612020 - DNA, 15 bp, Homo sapiens
ttctgactctgagct

SEQ ID NO: 1612021 - DNA, 13 bp, Homo sapiens
ttctgactgctga

SEQ ID NO: 1612022 - DNA, 12 bp, Homo sapiens
ttctgactgttt

SEQ ID NO: 1612023 - DNA, 19 bp, Homo sapiens
ttctgactgtttatttaag

SEQ ID NO: 1612024 - DNA, 21 bp, Homo sapiens
ttctgactgtttatttaagga

SEQ ID NO: 1612025 - DNA, 12 bp, Homo sapiens
ttctgagaaaac

SEQ ID NO: 1612026 - DNA, 16 bp, Homo sapiens
ttctgagaaagactat

SEQ ID NO: 1612027 - DNA, 18 bp, Homo sapiens
ttctgagaaggtccttaa

SEQ ID NO: 1612028 - DNA, 14 bp, Homo sapiens
ttctgagacagctt

SEQ ID NO: 1612029 - DNA, 23 bp, Homo sapiens
ttctgagctatttcatctatttt

SEQ ID NO: 1612030 - DNA, 12 bp, Homo sapiens
ttctgagctcca

SEQ ID NO: 1612031 - DNA, 13 bp, Homo sapiens
ttctgagtattct

SEQ ID NO: 1612032 - DNA, 14 bp, Homo sapiens
ttctgagtattctc

SEQ ID NO: 1612033 - DNA, 14 bp, Homo sapiens
ttctgagttcttga

SEQ ID NO: 1612034 - DNA, 14 bp, Homo sapiens
ttctgagttttgtg

SEQ ID NO: 1612035 - DNA, 15 bp, Homo sapiens
ttctgagttttgtgt

SEQ ID NO: 1612036 - DNA, 19 bp, Homo sapiens
ttctgagttttgtgtttgt

SEQ ID NO: 1612037 - DNA, 22 bp, Homo sapiens
ttctgagttttgtgtttgttgt

SEQ ID NO: 1612038 - DNA, 23 bp, Homo sapiens
ttctgagttttgtgtttgttgta

SEQ ID NO: 1612039 - DNA, 17 bp, Homo sapiens
ttctgatgtttctgtga

SEQ ID NO: 1612040 - DNA, 19 bp, Homo sapiens
ttctgatgtttctgtgaaa

SEQ ID NO: 1612041 - DNA, 12 bp, Homo sapiens
ttctgattccac

SEQ ID NO: 1612042 - DNA, 20 bp, Homo sapiens
ttctgatttcagtttttcat

SEQ ID NO: 1612043 - DNA, 17 bp, Homo sapiens
ttctgattttaggagct

SEQ ID NO: 1612044 - DNA, 24 bp, Homo sapiens
ttctgattttaggagctaaggctc

SEQ ID NO: 1612045 - DNA, 17 bp, Homo sapiens
ttctgatttttctcttt

SEQ ID NO: 1612046 - DNA, 17 bp, Homo sapiens
ttctgcaacaagcatgc

SEQ ID NO: 1612047 - DNA, 17 bp, Homo sapiens
ttctgcaactagccaag

SEQ ID NO: 1612048 - DNA, 20 bp, Homo sapiens
ttctgcaactagccaaggct

SEQ ID NO: 1612049 - DNA, 16 bp, Homo sapiens
ttctgcaagtttctgt

SEQ ID NO: 1612050 - DNA, 19 bp, Homo sapiens
ttctgcaccctccaccctg

SEQ ID NO: 1612051 - DNA, 23 bp, Homo sapiens
ttctgcaccctccaccctgtccc

SEQ ID NO: 1612052 - DNA, 12 bp, Homo sapiens
ttctgcactgaa

SEQ ID NO: 1612053 - DNA, 18 bp, Homo sapiens
ttgaagagcagctccttc

SEQ ID NO: 1612054 - DNA, 23 bp, Homo sapiens
ttgaagcacttaagtcttcctta

SEQ ID NO: 1612055 - DNA, 23 bp, Homo sapiens
ttgaagcatagataatattgttt

SEQ ID NO: 1612056 - DNA, 22 bp, Homo sapiens
ttgaagcatttcaaagccctgc

SEQ ID NO: 1612057 - DNA, 20 bp, Homo sapiens
ttgaagccaagtggggtgct

SEQ ID NO: 1612058 - DNA, 13 bp, Homo sapiens
ttgaagccactga

SEQ ID NO: 1612059 - DNA, 16 bp, Homo sapiens
ttgaaggaaaaattca

SEQ ID NO: 1612060 - DNA, 17 bp, Homo sapiens
ttgaaggaaaatgatac

SEQ ID NO: 1612061 - DNA, 13 bp, Homo sapiens
ttgaaggaaacag

SEQ ID NO: 1612062 - DNA, 15 bp, Homo sapiens
ttgaaggccctgctg

SEQ ID NO: 1612063 - DNA, 11 bp, Homo sapiens
ttgaaggctta

SEQ ID NO: 1612064 - DNA, 12 bp, Homo sapiens
ttgaaggcttaa

SEQ ID NO: 1612065 - DNA, 16 bp, Homo sapiens
ttgaagtaaacttttt

SEQ ID NO: 1612066 - DNA, 21 bp, Homo sapiens
ttgaagtaaattaaacatttt

SEQ ID NO: 1612067 - DNA, 16 bp, Homo sapiens
ttgaagtagctctttt

SEQ ID NO: 1612068 - DNA, 18 bp, Homo sapiens
ttgaagtctttaataaat

SEQ ID NO: 1612069 - DNA, 21 bp, Homo sapiens
ttgaagtgtataatataaaaa

SEQ ID NO: 1612070 - DNA, 22 bp, Homo sapiens
ttgaagttagtggaaatctgaa

SEQ ID NO: 1612071 - DNA, 11 bp, Homo sapiens
ttgaagttgtt

SEQ ID NO: 1612072 - DNA, 21 bp, Homo sapiens
ttgaagttgtttatcaacttc

SEQ ID NO: 1612073 - DNA, 22 bp, Homo sapiens
ttgaagtttcaagttttaaagt

SEQ ID NO: 1612074 - DNA, 22 bp, Homo sapiens
ttgaataaactctcccctttct

SEQ ID NO: 1612075 - DNA, 17 bp, Homo sapiens
ttgaataaagtattcta

SEQ ID NO: 1612076 - DNA, 21 bp, Homo sapiens
ttgaataaagtattctagtgt

SEQ ID NO: 1612077 - DNA, 19 bp, Homo sapiens
ttgaataaagttgaagcta

SEQ ID NO: 1612078 - DNA, 19 bp, Homo sapiens
ttgaatacatttgtattta

SEQ ID NO: 1612079 - DNA, 19 bp, Homo sapiens
ttgaataccattaaaactg

SEQ ID NO: 1612080 - DNA, 18 bp, Homo sapiens
ttgaataggaagatcgtt

SEQ ID NO: 1612081 - DNA, 17 bp, Homo sapiens
ttgaatataaaaaatca

SEQ ID NO: 1612082 - DNA, 19 bp, Homo sapiens
ttgaatatattataatctt

SEQ ID NO: 1612083 - DNA, 13 bp, Homo sapiens
ttgaatatgtagc

SEQ ID NO: 1612084 - DNA, 18 bp, Homo sapiens
ttgaatccattgaaagtg

SEQ ID NO: 1612085 - DNA, 22 bp, Homo sapiens
ttgaatcgatataggcatttgg

SEQ ID NO: 1612086 - DNA, 15 bp, Homo sapiens
ttgaatctcataatt

SEQ ID NO: 1612087 - DNA, 24 bp, Homo sapiens
ttgaatctgattggacattttctt

SEQ ID NO: 1612088 - DNA, 15 bp, Homo sapiens
ttgaatcttctccct

SEQ ID NO: 1612089 - DNA, 13 bp, Homo sapiens
ttgaatctttaat

SEQ ID NO: 1612090 - DNA, 20 bp, Homo sapiens
ttgaatgaaacaagcaggtg

SEQ ID NO: 1612091 - DNA, 12 bp, Homo sapiens
ttgaatgcagaa

SEQ ID NO: 1612092 - DNA, 15 bp, Homo sapiens
ttgaatgctgccagt

SEQ ID NO: 1612093 - DNA, 16 bp, Homo sapiens
ttgaatgcttcctgac

SEQ ID NO: 1612094 - DNA, 16 bp, Homo sapiens
ttgaatggtgttgtat

SEQ ID NO: 1612095 - DNA, 20 bp, Homo sapiens
ttgaatggtgttgtatgcct

SEQ ID NO: 1612096 - DNA, 23 bp, Homo sapiens
ttgaatgtcacaaattgatcaag

SEQ ID NO: 1612097 - DNA, 19 bp, Homo sapiens
ttgaatgtccccattctat

SEQ ID NO: 1612098 - DNA, 17 bp, Homo sapiens
ttgaatgtcttttgaat

SEQ ID NO: 1612099 - DNA, 22 bp, Homo sapiens
ttgaatgttaaagggatatttt

SEQ ID NO: 1612100 - DNA, 17 bp, Homo sapiens
ttgaattaaattaggaa

SEQ ID NO: 1612101 - DNA, 23 bp, Homo sapiens
ttgaattaaattaggaataaata

SEQ ID NO: 1612102 - DNA, 17 bp, Homo sapiens
ttgaattagtatttcag

SEQ ID NO: 1612103 - DNA, 18 bp, Homo sapiens
ttgaattagtatttcagt

SEQ ID NO: 1612104 - DNA, 20 bp, Homo sapiens
ttgaattatcagcaaagaaa

SEQ ID NO: 1612105 - DNA, 18 bp, Homo sapiens
ttgaattatcttggttga

SEQ ID NO: 1612106 - DNA, 18 bp, Homo sapiens
ttgaattggtgaataaaa

SEQ ID NO: 1612107 - DNA, 23 bp, Homo sapiens
ttgaattgtgtattgatgcaata

SEQ ID NO: 1612108 - DNA, 16 bp, Homo sapiens
ttgaatttaaataaag

SEQ ID NO: 1612109 - DNA, 19 bp, Homo sapiens
ttgaatttgtattaaaaag

SEQ ID NO: 1612110 - DNA, 14 bp, Homo sapiens
ttgaatttttctct

SEQ ID NO: 1612111 - DNA, 21 bp, Homo sapiens
ttgacaaaacctaacttgcgc

SEQ ID NO: 1612112 - DNA, 16 bp, Homo sapiens
ttgacaaaatttgttg

SEQ ID NO: 1612113 - DNA, 22 bp, Homo sapiens
ttgacaaacccggaagatcaga

SEQ ID NO: 1612114 - DNA, 16 bp, Homo sapiens
ttgacaaccatgagac

SEQ ID NO: 1612115 - DNA, 17 bp, Homo sapiens
ttgacaacctagaatgt

SEQ ID NO: 1612116 - DNA, 18 bp, Homo sapiens
ttgacaacctagaatgtc

SEQ ID NO: 1612117 - DNA, 14 bp, Homo sapiens
ttgacaagctgact

SEQ ID NO: 1612118 - DNA, 22 bp, Homo sapiens
ttgacaagtcattttaacttta

SEQ ID NO: 1612119 - DNA, 18 bp, Homo sapiens
ttgacaattactcaggtt

SEQ ID NO: 1612120 - DNA, 13 bp, Homo sapiens
ttgacacacagca

SEQ ID NO: 1612121 - DNA, 14 bp, Homo sapiens
ttgacacacagcac

SEQ ID NO: 1612122 - DNA, 18 bp, Homo sapiens
ttgacacctgtcttgaat

SEQ ID NO: 1612123 - DNA, 21 bp, Homo sapiens
ttgacactgaaagttttgtaa

SEQ ID NO: 1612124 - DNA, 17 bp, Homo sapiens
ttgacagaatatgtttc

SEQ ID NO: 1612125 - DNA, 15 bp, Homo sapiens
ttgacagttctgaag

SEQ ID NO: 1612126 - DNA, 18 bp, Homo sapiens
ttgacagttctgaagaat

SEQ ID NO: 1612127 - DNA, 20 bp, Homo sapiens
ttgacataacactataaagg

SEQ ID NO: 1612128 - DNA, 20 bp, Homo sapiens
ttgacatacctaccagtatt

SEQ ID NO: 1612129 - DNA, 11 bp, Homo sapiens
ttgacattcct

SEQ ID NO: 1612130 - DNA, 17 bp, Homo sapiens
ttgacatttagaacttt

SEQ ID NO: 1612131 - DNA, 14 bp, Homo sapiens
ttgaccaagaactg

SEQ ID NO: 1612132 - DNA, 15 bp, Homo sapiens
ttgaccaagaactgc

SEQ ID NO: 1612133 - DNA, 16 bp, Homo sapiens
ttgaccaagaactgca

SEQ ID NO: 1612134 - DNA, 18 bp, Homo sapiens
ttgaccaagaactgcatg

SEQ ID NO: 1612135 - DNA, 19 bp, Homo sapiens
ttgaccagatctttctctt

SEQ ID NO: 1612136 - DNA, 21 bp, Homo sapiens
ttgaccagcagatcccagctc

SEQ ID NO: 1612137 - DNA, 15 bp, Homo sapiens
ttgaccattctcacc

SEQ ID NO: 1612138 - DNA, 17 bp, Homo sapiens
ttgaccccgatatattt

SEQ ID NO: 1612139 - DNA, 15 bp, Homo sapiens
ttgacctcagctgca

SEQ ID NO: 1612140 - DNA, 16 bp, Homo sapiens
ttgacctcagctgcac

SEQ ID NO: 1612141 - DNA, 14 bp, Homo sapiens
ttgacctgtttcac

SEQ ID NO: 1612142 - DNA, 20 bp, Homo sapiens
ttgacctttaaatgcaacag

SEQ ID NO: 1612143 - DNA, 20 bp, Homo sapiens
ttgactaactcaaatacaca

SEQ ID NO: 1612144 - DNA, 19 bp, Homo sapiens
ttgactagggattcaggct

SEQ ID NO: 1612145 - DNA, 15 bp, Homo sapiens
ttgactcaggattta

SEQ ID NO: 1612146 - DNA, 17 bp, Homo sapiens
ttgactctaaatgcagt

SEQ ID NO: 1612147 - DNA, 22 bp, Homo sapiens
ttgactctcacactgaatcagc

SEQ ID NO: 1612148 - DNA, 15 bp, Homo sapiens
ttgactcttttgcca

SEQ ID NO: 1612149 - DNA, 15 bp, Homo sapiens
ttgactgaagcacag

SEQ ID NO: 1612150 - DNA, 17 bp, Homo sapiens
ttgactgatgattttcc

SEQ ID NO: 1612151 - DNA, 17 bp, Homo sapiens
ttgactgggtttctctg

SEQ ID NO: 1612152 - DNA, 15 bp, Homo sapiens
ttgactgtgattaga

SEQ ID NO: 1612153 - DNA, 17 bp, Homo sapiens
ttgactgtgattagatc

SEQ ID NO: 1612154 - DNA, 23 bp, Homo sapiens
ttgactttacgcccatctcagga

SEQ ID NO: 1612155 - DNA, 12 bp, Homo sapiens
ttgactttcagg

SEQ ID NO: 1612156 - DNA, 13 bp, Homo sapiens
ttgactttcaggt

SEQ ID NO: 1612157 - DNA, 15 bp, Homo sapiens
ttgactttcaggtac

SEQ ID NO: 1612158 - DNA, 15 bp, Homo sapiens
ttgactttctgattg

SEQ ID NO: 1612159 - DNA, 13 bp, Homo sapiens
ttgactttgtaat

SEQ ID NO: 1612160 - DNA, 17 bp, Homo sapiens
ttgactttttttgtatg

SEQ ID NO: 1612161 - DNA, 10 bp, Homo sapiens
ttgagaaacc

SEQ ID NO: 1612162 - DNA, 22 bp, Homo sapiens
ttgagaaccttggaccactcct

SEQ ID NO: 1612163 - DNA, 20 bp, Homo sapiens
ttgagaactgcttctaagat

SEQ ID NO: 1612164 - DNA, 22 bp, Homo sapiens
ttgagaagacctcacctagaaa

SEQ ID NO: 1612165 - DNA, 13 bp, Homo sapiens
ttcctttctcctg

SEQ ID NO: 1612166 - DNA, 23 bp, Homo sapiens
ttcctttgaacgtgcttctttgt

SEQ ID NO: 1612167 - DNA, 16 bp, Homo sapiens
ttcctttgtcttcaaa

SEQ ID NO: 1612168 - DNA, 17 bp, Homo sapiens
ttcctttgtcttcaaac

SEQ ID NO: 1612169 - DNA, 17 bp, Homo sapiens
ttccttttccctgcttc

SEQ ID NO: 1612170 - DNA, 15 bp, Homo sapiens
ttccttttgaaagaa

SEQ ID NO: 1612171 - DNA, 18 bp, Homo sapiens
ttccttttgatggggaga

SEQ ID NO: 1612172 - DNA, 15 bp, Homo sapiens
ttccttttggaacat

SEQ ID NO: 1612173 - DNA, 17 bp, Homo sapiens
ttcctttttaaatgtga

SEQ ID NO: 1612174 - DNA, 23 bp, Homo sapiens
ttcctttttaaatgtgaattttt

SEQ ID NO: 1612175 - DNA, 20 bp, Homo sapiens
ttcctttttaatatgcttaa

SEQ ID NO: 1612176 - DNA, 21 bp, Homo sapiens
ttcctttttcaaaaaccagcc

SEQ ID NO: 1612177 - DNA, 18 bp, Homo sapiens
ttccttttttgtctatga

SEQ ID NO: 1612178 - DNA, 19 bp, Homo sapiens
ttccttttttgtctatgaa

SEQ ID NO: 1612179 - DNA, 16 bp, Homo sapiens
ttcctttttttgtacc

SEQ ID NO: 1612180 - DNA, 13 bp, Homo sapiens
ttcgaaaggcctt

SEQ ID NO: 1612181 - DNA, 22 bp, Homo sapiens
ttcgaatcttaatttattattt

SEQ ID NO: 1612182 - DNA, 16 bp, Homo sapiens
ttcgactactgctcct

SEQ ID NO: 1612183 - DNA, 13 bp, Homo sapiens
ttcgactggtcca

SEQ ID NO: 1612184 - DNA, 17 bp, Homo sapiens
ttcgactggtccagctc

SEQ ID NO: 1612185 - DNA, 21 bp, Homo sapiens
ttcgactggtccagctctgac

SEQ ID NO: 1612186 - DNA, 14 bp, Homo sapiens
ttcgagaccagcct

SEQ ID NO: 1612187 - DNA, 22 bp, Homo sapiens
ttcgagatcatcacttccttgc

SEQ ID NO: 1612188 - DNA, 20 bp, Homo sapiens
ttctagctataacaactcta

SEQ ID NO: 1612189 - DNA, 22 bp, Homo sapiens
ttctagctataacaactctatt

SEQ ID NO: 1612190 - DNA, 16 bp, Homo sapiens
ttctagcttttctctt

SEQ ID NO: 1612191 - DNA, 20 bp, Homo sapiens
ttctagcttttctctttccc

SEQ ID NO: 1612192 - DNA, 23 bp, Homo sapiens
ttctaggcactgtagttctaaga

SEQ ID NO: 1612193 - DNA, 21 bp, Homo sapiens
ttctaggcccattgtcctcct

SEQ ID NO: 1612194 - DNA, 15 bp, Homo sapiens
ttctagggaaatgaa

SEQ ID NO: 1612195 - DNA, 13 bp, Homo sapiens
ttctaggtttcaa

SEQ ID NO: 1612196 - DNA, 20 bp, Homo sapiens
ttctagtcaactgctgtttt

SEQ ID NO: 1612197 - DNA, 22 bp, Homo sapiens
ttctagtctcctttgcactgag

SEQ ID NO: 1612198 - DNA, 23 bp, Homo sapiens
ttctagtctcctttgcactgagg

SEQ ID NO: 1612199 - DNA, 13 bp, Homo sapiens
ttctagtctctga

SEQ ID NO: 1612200 - DNA, 23 bp, Homo sapiens
ttctagtctctgatttgcaaatg

SEQ ID NO: 1612201 - DNA, 18 bp, Homo sapiens
ttctagtgtaacactgca

SEQ ID NO: 1612202 - DNA, 19 bp, Homo sapiens
ttctagttgccctctacct

SEQ ID NO: 1612203 - DNA, 13 bp, Homo sapiens
ttctataaatcag

SEQ ID NO: 1612204 - DNA, 22 bp, Homo sapiens
ttctataaattcaacacttatt

SEQ ID NO: 1612205 - DNA, 13 bp, Homo sapiens
ttctatactgttt

SEQ ID NO: 1612206 - DNA, 16 bp, Homo sapiens
ttctatagttctagac

SEQ ID NO: 1612207 - DNA, 18 bp, Homo sapiens
ttctatatttattttcag

SEQ ID NO: 1612208 - DNA, 14 bp, Homo sapiens
ttctatatttcata

SEQ ID NO: 1612209 - DNA, 16 bp, Homo sapiens
ttctatattttaatag

SEQ ID NO: 1612210 - DNA, 19 bp, Homo sapiens
ttctatattttaatagaaa

SEQ ID NO: 1612211 - DNA, 17 bp, Homo sapiens
ttctatcacatatttga

SEQ ID NO: 1612212 - DNA, 21 bp, Homo sapiens
ttctatcattccaattctaaa

SEQ ID NO: 1612213 - DNA, 14 bp, Homo sapiens
ttctatccttttgc

SEQ ID NO: 1612214 - DNA, 18 bp, Homo sapiens
ttctatccttttgcctgc

SEQ ID NO: 1612215 - DNA, 16 bp, Homo sapiens
ttctatgacaaattca

SEQ ID NO: 1612216 - DNA, 15 bp, Homo sapiens
ttctatgcctgtatt

SEQ ID NO: 1612217 - DNA, 16 bp, Homo sapiens
ttctatgcctgtattt

SEQ ID NO: 1612218 - DNA, 19 bp, Homo sapiens
ttctatggaatagttctgt

SEQ ID NO: 1612219 - DNA, 22 bp, Homo sapiens
ttctatggaatagttctgtata

SEQ ID NO: 1612220 - DNA, 16 bp, Homo sapiens
ttctatgtagaactgt

SEQ ID NO: 1612221 - DNA, 16 bp, Homo sapiens
ttctatgtcattttta

SEQ ID NO: 1612222 - DNA, 21 bp, Homo sapiens
ttctatgtcatttttaatgta

SEQ ID NO: 1612223 - DNA, 22 bp, Homo sapiens
ttctatgtcatttttaatgtat

SEQ ID NO: 1612224 - DNA, 17 bp, Homo sapiens
ttctatgtccattctca

SEQ ID NO: 1612225 - DNA, 19 bp, Homo sapiens
ttctattatttttataatt

SEQ ID NO: 1612226 - DNA, 14 bp, Homo sapiens
ttctattgaattcg

SEQ ID NO: 1612227 - DNA, 18 bp, Homo sapiens
ttctattgcagttataga

SEQ ID NO: 1612228 - DNA, 17 bp, Homo sapiens
ttctatttaacaactgg

SEQ ID NO: 1612229 - DNA, 18 bp, Homo sapiens
ttctatttattcctgtta

SEQ ID NO: 1612230 - DNA, 14 bp, Homo sapiens
ttctatttctatct

SEQ ID NO: 1612231 - DNA, 16 bp, Homo sapiens
ttctatttgctgggct

SEQ ID NO: 1612232 - DNA, 17 bp, Homo sapiens
ttctattttactgtctt

SEQ ID NO: 1612233 - DNA, 16 bp, Homo sapiens
ttctattttgtaaact

SEQ ID NO: 1612234 - DNA, 20 bp, Homo sapiens
ttctatttttatcatgaatt

SEQ ID NO: 1612235 - DNA, 22 bp, Homo sapiens
ttctcaaacctgtttaaatatt

SEQ ID NO: 1612236 - DNA, 19 bp, Homo sapiens
ttctcaaagatctgaatta

SEQ ID NO: 1612237 - DNA, 15 bp, Homo sapiens
ttctcaaagcaggaa

SEQ ID NO: 1612238 - DNA, 11 bp, Homo sapiens
ttctcaagaat

SEQ ID NO: 1612239 - DNA, 12 bp, Homo sapiens
ttctcaagaatc

SEQ ID NO: 1612240 - DNA, 16 bp, Homo sapiens
ttctcaagttctaaga

SEQ ID NO: 1612241 - DNA, 17 bp, Homo sapiens
ttctcaagttctaagat

SEQ ID NO: 1612242 - DNA, 18 bp, Homo sapiens
ttctcaagttctaagatt

SEQ ID NO: 1612243 - DNA, 18 bp, Homo sapiens
ttctcacacccaccgtcc

SEQ ID NO: 1612244 - DNA, 21 bp, Homo sapiens
ttctcacagtgggagccaggg

SEQ ID NO: 1612245 - DNA, 22 bp, Homo sapiens
ttctcacagtgggagccagggc

SEQ ID NO: 1612246 - DNA, 15 bp, Homo sapiens
ttctcacattgctgt

SEQ ID NO: 1612247 - DNA, 14 bp, Homo sapiens
ttctcactccacca

SEQ ID NO: 1612248 - DNA, 18 bp, Homo sapiens
ttctcactcctacctggt

SEQ ID NO: 1612249 - DNA, 14 bp, Homo sapiens
ttctcactgaactc

SEQ ID NO: 1612250 - DNA, 18 bp, Homo sapiens
ttctcacttcaattaatg

SEQ ID NO: 1612251 - DNA, 13 bp, Homo sapiens
ttctcagaagcac

SEQ ID NO: 1612252 - DNA, 15 bp, Homo sapiens
ttctcagagtgttta

SEQ ID NO: 1612253 - DNA, 21 bp, Homo sapiens
ttctcagatggattgataatt

SEQ ID NO: 1612254 - DNA, 14 bp, Homo sapiens
ttctcagatttctg

SEQ ID NO: 1612255 - DNA, 17 bp, Homo sapiens
ttctcaggtgttgccaa

SEQ ID NO: 1612256 - DNA, 22 bp, Homo sapiens
ttctcagtcagtaattgccaaa

SEQ ID NO: 1612257 - DNA, 17 bp, Homo sapiens
ttctcatagccccggtg

SEQ ID NO: 1612258 - DNA, 15 bp, Homo sapiens
ttctcatcatattgt

SEQ ID NO: 1612259 - DNA, 17 bp, Homo sapiens
ttctcatcatattgtat

SEQ ID NO: 1612260 - DNA, 21 bp, Homo sapiens
ttctcatcatattgtatgtaa

SEQ ID NO: 1612261 - DNA, 18 bp, Homo sapiens
ttctcatctttcttgatc

SEQ ID NO: 1612262 - DNA, 17 bp, Homo sapiens
ttctcatgatttacaga

SEQ ID NO: 1612263 - DNA, 20 bp, Homo sapiens
ttctcatgatttacagagaa

SEQ ID NO: 1612264 - DNA, 21 bp, Homo sapiens
ttctcattaaagttgtttccc

SEQ ID NO: 1612265 - DNA, 23 bp, Homo sapiens
ttctcattaaagttgtttcccac

SEQ ID NO: 1612266 - DNA, 15 bp, Homo sapiens
ttctcatttcacccc

SEQ ID NO: 1612267 - DNA, 20 bp, Homo sapiens
ttctccaaactgaagcagcc

SEQ ID NO: 1612268 - DNA, 19 bp, Homo sapiens
ttctccagcctcagcctcc

SEQ ID NO: 1612269 - DNA, 12 bp, Homo sapiens
ttctccagctgg

SEQ ID NO: 1612270 - DNA, 20 bp, Homo sapiens
ttctccagctgggctctgca

SEQ ID NO: 1612271 - DNA, 20 bp, Homo sapiens
ttctccaggattttaatttc

SEQ ID NO: 1612272 - DNA, 13 bp, Homo sapiens
ttctccatcagct

SEQ ID NO: 1612273 - DNA, 12 bp, Homo sapiens
ttctccatcttt

SEQ ID NO: 1612274 - DNA, 22 bp, Homo sapiens
ttctccatgctgcaaaggagaa

SEQ ID NO: 1612275 - DNA, 17 bp, Homo sapiens
ttctcccaagaaacctg

SEQ ID NO: 1612276 - DNA, 23 bp, Homo sapiens
ttctcccacatgaggccatctca

SEQ ID NO: 1612277 - DNA, 23 bp, Homo sapiens
ttctcccaggccaggctccttcc

SEQ ID NO: 1612278 - DNA, 21 bp, Homo sapiens
ttctcccctgcactgtaaaat

SEQ ID NO: 1612279 - DNA, 17 bp, Homo sapiens
ttctcccctgcccccag

SEQ ID NO: 1612280 - DNA, 14 bp, Homo sapiens
ttctcccctgccct

SEQ ID NO: 1612281 - DNA, 23 bp, Homo sapiens
ttctcccctgcccttcctcctga

SEQ ID NO: 1612282 - DNA, 16 bp, Homo sapiens
ttctcccgcctcagcc

SEQ ID NO: 1612283 - DNA, 21 bp, Homo sapiens
ttctcccgcttcctggcctcc

SEQ ID NO: 1612284 - DNA, 12 bp, Homo sapiens
ttctccctcacc

SEQ ID NO: 1612285 - DNA, 19 bp, Homo sapiens
ttctccctgaccttagcgt

SEQ ID NO: 1612286 - DNA, 18 bp, Homo sapiens
ttctccctgcacaagcca

SEQ ID NO: 1612287 - DNA, 16 bp, Homo sapiens
ttcagacaacattatg

SEQ ID NO: 1612288 - DNA, 21 bp, Homo sapiens
ttcagacaacattatgatcta

SEQ ID NO: 1612289 - DNA, 17 bp, Homo sapiens
ttcagacagggtctgaa

SEQ ID NO: 1612290 - DNA, 14 bp, Homo sapiens
ttcagacccagaga

SEQ ID NO: 1612291 - DNA, 10 bp, Homo sapiens
ttcagacccc

SEQ ID NO: 1612292 - DNA, 13 bp, Homo sapiens
ttcagaccccagc

SEQ ID NO: 1612293 - DNA, 15 bp, Homo sapiens
ttcagacccctgcct

SEQ ID NO: 1612294 - DNA, 23 bp, Homo sapiens
ttcagacctgacaccgtccctca

SEQ ID NO: 1612295 - DNA, 21 bp, Homo sapiens
ttcagactcccattcctgaag

SEQ ID NO: 1612296 - DNA, 20 bp, Homo sapiens
ttcagagactcagggcccca

SEQ ID NO: 1612297 - DNA, 15 bp, Homo sapiens
ttcagagaggccttt

SEQ ID NO: 1612298 - DNA, 16 bp, Homo sapiens
ttcagagccagcctgg

SEQ ID NO: 1612299 - DNA, 13 bp, Homo sapiens
ttcagagccagtg

SEQ ID NO: 1612300 - DNA, 13 bp, Homo sapiens
ttcagagcctagc

SEQ ID NO: 1612301 - DNA, 22 bp, Homo sapiens
ttcagagcctagccacctccca

SEQ ID NO: 1612302 - DNA, 23 bp, Homo sapiens
ttcagagtcctcattataaaatg

SEQ ID NO: 1612303 - DNA, 15 bp, Homo sapiens
ttcagagtttgtgtg

SEQ ID NO: 1612304 - DNA, 16 bp, Homo sapiens
ttcagatatatttttc

SEQ ID NO: 1612305 - DNA, 16 bp, Homo sapiens
ttcagatatcaaaatt

SEQ ID NO: 1612306 - DNA, 18 bp, Homo sapiens
ttcagatatcaaaattct

SEQ ID NO: 1612307 - DNA, 22 bp, Homo sapiens
ttcagatatcaaaattctagct

SEQ ID NO: 1612308 - DNA, 14 bp, Homo sapiens
ttcagatgtcttct

SEQ ID NO: 1612309 - DNA, 18 bp, Homo sapiens
ttcagatgtgcaataatt

SEQ ID NO: 1612310 - DNA, 15 bp, Homo sapiens
ttcagattaaaaaaa

SEQ ID NO: 1612311 - DNA, 22 bp, Homo sapiens
ttcagattcccagagcaaaata

SEQ ID NO: 1612312 - DNA, 14 bp, Homo sapiens
ttcagattttactg

SEQ ID NO: 1612313 - DNA, 20 bp, Homo sapiens
ttcagcaacttattttgctt

SEQ ID NO: 1612314 - DNA, 17 bp, Homo sapiens
ttcagcaccctgggtgc

SEQ ID NO: 1612315 - DNA, 20 bp, Homo sapiens
ttcagcactgtcccttgcct

SEQ ID NO: 1612316 - DNA, 21 bp, Homo sapiens
ttcagcactgtcccttgcctc

SEQ ID NO: 1612317 - DNA, 23 bp, Homo sapiens
ttcagcagaacctgcacacagga

SEQ ID NO: 1612318 - DNA, 20 bp, Homo sapiens
ttcagcagcaaattttcagc

SEQ ID NO: 1612319 - DNA, 16 bp, Homo sapiens
ttcagcatatttatag

SEQ ID NO: 1612320 - DNA, 23 bp, Homo sapiens
ttcagccacatgccccaggctct

SEQ ID NO: 1612321 - DNA, 18 bp, Homo sapiens
ttcagccaccagcccctg

SEQ ID NO: 1612322 - DNA, 12 bp, Homo sapiens
ttcagccaggag

SEQ ID NO: 1612323 - DNA, 13 bp, Homo sapiens
ttcagccaggagc

SEQ ID NO: 1612324 - DNA, 10 bp, Homo sapiens
ttcagcccac

SEQ ID NO: 1612325 - DNA, 12 bp, Homo sapiens
ttcagcccacca

SEQ ID NO: 1612326 - DNA, 16 bp, Homo sapiens
ttcagcccaccaccct

SEQ ID NO: 1612327 - DNA, 17 bp, Homo sapiens
ttcagcccaccaccctg

SEQ ID NO: 1612328 - DNA, 16 bp, Homo sapiens
ttcagcccccaccagg

SEQ ID NO: 1612329 - DNA, 13 bp, Homo sapiens
ttcagcccctcct

SEQ ID NO: 1612330 - DNA, 21 bp, Homo sapiens
ttcagcctagccgacctcagc

SEQ ID NO: 1612331 - DNA, 12 bp, Homo sapiens
ttcagcctgtct

SEQ ID NO: 1612332 - DNA, 13 bp, Homo sapiens
ttcagccttggga

SEQ ID NO: 1612333 - DNA, 18 bp, Homo sapiens
ttccaggctgagccatga

SEQ ID NO: 1612334 - DNA, 16 bp, Homo sapiens
ttccagggcctgagca

SEQ ID NO: 1612335 - DNA, 14 bp, Homo sapiens
ttccaggggaacct

SEQ ID NO: 1612336 - DNA, 18 bp, Homo sapiens
ttccaggggaacctgcca

SEQ ID NO: 1612337 - DNA, 18 bp, Homo sapiens
ttccagggtccctctgtg

SEQ ID NO: 1612338 - DNA, 21 bp, Homo sapiens
ttccaggttccatccaccacc

SEQ ID NO: 1612339 - DNA, 19 bp, Homo sapiens
ttccagtacctttgtcaca

SEQ ID NO: 1612340 - DNA, 22 bp, Homo sapiens
ttccagtcgggggaactgaggc

SEQ ID NO: 1612341 - DNA, 20 bp, Homo sapiens
ttccagtcttcctgacactt

SEQ ID NO: 1612342 - DNA, 18 bp, Homo sapiens
ttccagtggatcataaga

SEQ ID NO: 1612343 - DNA, 22 bp, Homo sapiens
ttccagtggtcatgctcagcct

SEQ ID NO: 1612344 - DNA, 20 bp, Homo sapiens
ttccagtgttggctgtgtga

SEQ ID NO: 1612345 - DNA, 22 bp, Homo sapiens
ttccagttcatctatggcagtc

SEQ ID NO: 1612346 - DNA, 19 bp, Homo sapiens
ttccagttctgacacacgt

SEQ ID NO: 1612347 - DNA, 13 bp, Homo sapiens
ttccataaatcta

SEQ ID NO: 1612348 - DNA, 19 bp, Homo sapiens
ttccataatgtataaagaa

SEQ ID NO: 1612349 - DNA, 13 bp, Homo sapiens
ttccataattatg

SEQ ID NO: 1612350 - DNA, 22 bp, Homo sapiens
ttccataattatgacagttata

SEQ ID NO: 1612351 - DNA, 18 bp, Homo sapiens
ttccataggacatactgc

SEQ ID NO: 1612352 - DNA, 15 bp, Homo sapiens
ttccatatcctggtg

SEQ ID NO: 1612353 - DNA, 23 bp, Homo sapiens
ttccatcagcgggtctcctccca

SEQ ID NO: 1612354 - DNA, 13 bp, Homo sapiens
ttccatcatcact

SEQ ID NO: 1612355 - DNA, 18 bp, Homo sapiens
ttccatcatcactgtaaa

SEQ ID NO: 1612356 - DNA, 21 bp, Homo sapiens
ttccatcatcactgtaaagac

SEQ ID NO: 1612357 - DNA, 13 bp, Homo sapiens
ttccatcatgtct

SEQ ID NO: 1612358 - DNA, 15 bp, Homo sapiens
ttccatcatgtctgt

SEQ ID NO: 1612359 - DNA, 19 bp, Homo sapiens
ttccatccaccaccttgcc

SEQ ID NO: 1612360 - DNA, 20 bp, Homo sapiens
ttccatccaccaccttgcca

SEQ ID NO: 1612361 - DNA, 22 bp, Homo sapiens
ttccatccatctttccatccat

SEQ ID NO: 1612362 - DNA, 18 bp, Homo sapiens
ttccatcctttacgtgtt

SEQ ID NO: 1612363 - DNA, 15 bp, Homo sapiens
ttccatctaaaatac

SEQ ID NO: 1612364 - DNA, 23 bp, Homo sapiens
ttccatctcgccacccctccttc

SEQ ID NO: 1612365 - DNA, 12 bp, Homo sapiens
ttccatcttgta

SEQ ID NO: 1612366 - DNA, 15 bp, Homo sapiens
ttccatgaatgtatc

SEQ ID NO: 1612367 - DNA, 20 bp, Homo sapiens
ttccatgaatgtatcaggaa

SEQ ID NO: 1612368 - DNA, 15 bp, Homo sapiens
ttccatgagctgctc

SEQ ID NO: 1612369 - DNA, 21 bp, Homo sapiens
ttccatgagttatcatgaatt

SEQ ID NO: 1612370 - DNA, 14 bp, Homo sapiens
ttccatgcaactgg

SEQ ID NO: 1612371 - DNA, 14 bp, Homo sapiens
ttccatgccccagg

SEQ ID NO: 1612372 - DNA, 13 bp, Homo sapiens
ttccatgcctgag

SEQ ID NO: 1612373 - DNA, 22 bp, Homo sapiens
ttccatgcctgagggtggagac

SEQ ID NO: 1612374 - DNA, 23 bp, Homo sapiens
ttccatgctgtgcgcccagggct

SEQ ID NO: 1612375 - DNA, 12 bp, Homo sapiens
ttccatgggaat

SEQ ID NO: 1612376 - DNA, 22 bp, Homo sapiens
ttccatgggactttccttccct

SEQ ID NO: 1612377 - DNA, 18 bp, Homo sapiens
ttccatgggccccaccat

SEQ ID NO: 1612378 - DNA, 14 bp, Homo sapiens
ttccatgtgccttt

SEQ ID NO: 1612379 - DNA, 15 bp, Homo sapiens
ttccatgtgcctttc

SEQ ID NO: 1612380 - DNA, 14 bp, Homo sapiens
ttccatgtggagaa

SEQ ID NO: 1612381 - DNA, 20 bp, Homo sapiens
ttccatgttttttcttcaaa

SEQ ID NO: 1612382 - DNA, 15 bp, Homo sapiens
ttccattatgattct

SEQ ID NO: 1612383 - DNA, 15 bp, Homo sapiens
ttccattgatttttt

SEQ ID NO: 1612384 - DNA, 12 bp, Homo sapiens
ttccatttccaa

SEQ ID NO: 1612385 - DNA, 13 bp, Homo sapiens
ttccatttctcaa

SEQ ID NO: 1612386 - DNA, 16 bp, Homo sapiens
ttccatttcttcctca

SEQ ID NO: 1612387 - DNA, 18 bp, Homo sapiens
ttccatttcttcctcact

SEQ ID NO: 1612388 - DNA, 19 bp, Homo sapiens
ttccatttcttcctcacta

SEQ ID NO: 1612389 - DNA, 15 bp, Homo sapiens
ttccatttgtattca

SEQ ID NO: 1612390 - DNA, 11 bp, Homo sapiens
ttccatttgtc

SEQ ID NO: 1612391 - DNA, 18 bp, Homo sapiens
ttccattttaattttaaa

SEQ ID NO: 1612392 - DNA, 12 bp, Homo sapiens
ttccattttatg

SEQ ID NO: 1612393 - DNA, 14 bp, Homo sapiens
ttccattttatgca

SEQ ID NO: 1612394 - DNA, 14 bp, Homo sapiens
ttccattttccccc

SEQ ID NO: 1612395 - DNA, 18 bp, Homo sapiens
ttccattttcccccacta

SEQ ID NO: 1612396 - DNA, 19 bp, Homo sapiens
ttccatttttcctctgttc

SEQ ID NO: 1612397 - DNA, 20 bp, Homo sapiens
ttccatttttcctctgttca

SEQ ID NO: 1612398 - DNA, 23 bp, Homo sapiens
ttccatttttcctctgttcacaa

SEQ ID NO: 1612399 - DNA, 15 bp, Homo sapiens
ttcccaactcagctg

SEQ ID NO: 1612400 - DNA, 16 bp, Homo sapiens
ttcccaagtatgcctt

SEQ ID NO: 1612401 - DNA, 12 bp, Homo sapiens
ttcccaataaaa

SEQ ID NO: 1612402 - DNA, 14 bp, Homo sapiens
ttcccaataaaagt

SEQ ID NO: 1612403 - DNA, 15 bp, Homo sapiens
ttcccaatcagcact

SEQ ID NO: 1612404 - DNA, 21 bp, Homo sapiens
ttcccacaggagggccagcgc

SEQ ID NO: 1612405 - DNA, 13 bp, Homo sapiens
ttcccacatcttt

SEQ ID NO: 1612406 - DNA, 15 bp, Homo sapiens
ttcccacatctttcc

SEQ ID NO: 1612407 - DNA, 22 bp, Homo sapiens
ttcccacatctttcctcaagta

SEQ ID NO: 1612408 - DNA, 19 bp, Homo sapiens
ttcccaccattcctgcctt

SEQ ID NO: 1612409 - DNA, 11 bp, Homo sapiens
ttcccaccctg

SEQ ID NO: 1612410 - DNA, 14 bp, Homo sapiens
ttcccacctactgc

SEQ ID NO: 1612411 - DNA, 15 bp, Homo sapiens
ttattagcatttgtt

SEQ ID NO: 1612412 - DNA, 21 bp, Homo sapiens
ttattagcatttgttttagca

SEQ ID NO: 1612413 - DNA, 18 bp, Homo sapiens
ttattagtttaaaatgca

SEQ ID NO: 1612414 - DNA, 14 bp, Homo sapiens
ttattagtttacat

SEQ ID NO: 1612415 - DNA, 23 bp, Homo sapiens
ttattataaactataaacttaag

SEQ ID NO: 1612416 - DNA, 16 bp, Homo sapiens
ttattatattcagagt

SEQ ID NO: 1612417 - DNA, 22 bp, Homo sapiens
ttattatatttgacatgggtat

SEQ ID NO: 1612418 - DNA, 19 bp, Homo sapiens
ttattatcctcctgttctg

SEQ ID NO: 1612419 - DNA, 19 bp, Homo sapiens
ttattatgtttattacaat

SEQ ID NO: 1612420 - DNA, 13 bp, Homo sapiens
ttattatttctgt

SEQ ID NO: 1612421 - DNA, 14 bp, Homo sapiens
ttattcaaatttga

SEQ ID NO: 1612422 - DNA, 15 bp, Homo sapiens
ttattcaaatttgat

SEQ ID NO: 1612423 - DNA, 17 bp, Homo sapiens
ttattcaagtattgaga

SEQ ID NO: 1612424 - DNA, 16 bp, Homo sapiens
ttattcacatatatca

SEQ ID NO: 1612425 - DNA, 16 bp, Homo sapiens
ttattcatagttttat

SEQ ID NO: 1612426 - DNA, 17 bp, Homo sapiens
ttattcatgccatctgt

SEQ ID NO: 1612427 - DNA, 13 bp, Homo sapiens
ttattcatgtgaa

SEQ ID NO: 1612428 - DNA, 15 bp, Homo sapiens
ttattcatgtgaagt

SEQ ID NO: 1612429 - DNA, 20 bp, Homo sapiens
ttattcatttaaaatgatta

SEQ ID NO: 1612430 - DNA, 14 bp, Homo sapiens
ttattcatttgagt

SEQ ID NO: 1612431 - DNA, 15 bp, Homo sapiens
ttattccaggagaag

SEQ ID NO: 1612432 - DNA, 19 bp, Homo sapiens
ttattcccaagtatgcctt

SEQ ID NO: 1612433 - DNA, 20 bp, Homo sapiens
ttattcccaagtatgcctta

SEQ ID NO: 1612434 - DNA, 21 bp, Homo sapiens
ttattcccaagtatgccttaa

SEQ ID NO: 1612435 - DNA, 20 bp, Homo sapiens
ttattcctcctgctcatatt

SEQ ID NO: 1612436 - DNA, 20 bp, Homo sapiens
ttattcctgataataattga

SEQ ID NO: 1612437 - DNA, 15 bp, Homo sapiens
ttattcctgtatgtt

SEQ ID NO: 1612438 - DNA, 23 bp, Homo sapiens
ttattctaataaatatactatga

SEQ ID NO: 1612439 - DNA, 13 bp, Homo sapiens
ttattctagatta

SEQ ID NO: 1612440 - DNA, 20 bp, Homo sapiens
ttattctagtcaactgctgt

SEQ ID NO: 1612441 - DNA, 14 bp, Homo sapiens
ttattctcaaagca

SEQ ID NO: 1612442 - DNA, 15 bp, Homo sapiens
ttattctcaaagcag

SEQ ID NO: 1612443 - DNA, 17 bp, Homo sapiens
ttattctcactccacca

SEQ ID NO: 1612444 - DNA, 13 bp, Homo sapiens
ttattctgattct

SEQ ID NO: 1612445 - DNA, 17 bp, Homo sapiens
ttattcttattactatt

SEQ ID NO: 1612446 - DNA, 14 bp, Homo sapiens
ttattcttccagaa

SEQ ID NO: 1612447 - DNA, 13 bp, Homo sapiens
ttattcttctaga

SEQ ID NO: 1612448 - DNA, 15 bp, Homo sapiens
ttattcttgatgaaa

SEQ ID NO: 1612449 - DNA, 12 bp, Homo sapiens
ttattcttgtta

SEQ ID NO: 1612450 - DNA, 13 bp, Homo sapiens
ttattcttgttat

SEQ ID NO: 1612451 - DNA, 17 bp, Homo sapiens
ttattctttgcactttt

SEQ ID NO: 1612452 - DNA, 16 bp, Homo sapiens
ttattctttttaaagt

SEQ ID NO: 1612453 - DNA, 22 bp, Homo sapiens
ttattgacaataatttcaggtt

SEQ ID NO: 1612454 - DNA, 13 bp, Homo sapiens
ttattgagaattt

SEQ ID NO: 1612455 - DNA, 19 bp, Homo sapiens
ttattgagaattttaaatt

SEQ ID NO: 1612456 - DNA, 19 bp, Homo sapiens
ttattgagttccagttgaa

SEQ ID NO: 1612457 - DNA, 15 bp, Homo sapiens
ttattgcgctgctac

SEQ ID NO: 1612458 - DNA, 12 bp, Homo sapiens
ttattgctgttg

SEQ ID NO: 1612459 - DNA, 13 bp, Homo sapiens
ttattgcttttat

SEQ ID NO: 1612460 - DNA, 14 bp, Homo sapiens
ttattggaaatgtg

SEQ ID NO: 1612461 - DNA, 22 bp, Homo sapiens
ttattggaagtgttcaagaaat

SEQ ID NO: 1612462 - DNA, 12 bp, Homo sapiens
ttattgggactt

SEQ ID NO: 1612463 - DNA, 15 bp, Homo sapiens
ttattggttttgcag

SEQ ID NO: 1612464 - DNA, 22 bp, Homo sapiens
ttattggtttttttgtatagac

SEQ ID NO: 1612465 - DNA, 16 bp, Homo sapiens
ttattgtaatgtaata

SEQ ID NO: 1612466 - DNA, 17 bp, Homo sapiens
ttattgtacctctctta

SEQ ID NO: 1612467 - DNA, 16 bp, Homo sapiens
ttattgtataaaaagt

SEQ ID NO: 1612468 - DNA, 21 bp, Homo sapiens
ttattgtctgtctacatttct

SEQ ID NO: 1612469 - DNA, 22 bp, Homo sapiens
ttattgtctgtctacatttctg

SEQ ID NO: 1612470 - DNA, 11 bp, Homo sapiens
ttatggttttg

SEQ ID NO: 1612471 - DNA, 16 bp, Homo sapiens
ttatgtaaaatgtttt

SEQ ID NO: 1612472 - DNA, 20 bp, Homo sapiens
ttatgtaaaatgttttagca

SEQ ID NO: 1612473 - DNA, 19 bp, Homo sapiens
ttatgtaaatacaatttgt

SEQ ID NO: 1612474 - DNA, 22 bp, Homo sapiens
ttatgtaaatacaatttgtact

SEQ ID NO: 1612475 - DNA, 21 bp, Homo sapiens
ttatgtaaatcacttcattgt

SEQ ID NO: 1612476 - DNA, 20 bp, Homo sapiens
ttatgtaaatgtttgttaaa

SEQ ID NO: 1612477 - DNA, 16 bp, Homo sapiens
ttatgtaatatattgt

SEQ ID NO: 1612478 - DNA, 16 bp, Homo sapiens
ttatgtagatgtgcat

SEQ ID NO: 1612479 - DNA, 13 bp, Homo sapiens
ttatgtatatggt

SEQ ID NO: 1612480 - DNA, 20 bp, Homo sapiens
ttatgtatggatatatttga

SEQ ID NO: 1612481 - DNA, 20 bp, Homo sapiens
ttatgtatttaaagttgtat

SEQ ID NO: 1612482 - DNA, 14 bp, Homo sapiens
ttatgtcagcagct

SEQ ID NO: 1612483 - DNA, 15 bp, Homo sapiens
ttatgtcttcttttg

SEQ ID NO: 1612484 - DNA, 12 bp, Homo sapiens
ttatgtgaaaaa

SEQ ID NO: 1612485 - DNA, 23 bp, Homo sapiens
ttatgtgaatgatctctctgaat

SEQ ID NO: 1612486 - DNA, 17 bp, Homo sapiens
ttatgtgaatttttaag

SEQ ID NO: 1612487 - DNA, 15 bp, Homo sapiens
ttatgtgacattaac

SEQ ID NO: 1612488 - DNA, 13 bp, Homo sapiens
ttatgtgagagaa

SEQ ID NO: 1612489 - DNA, 16 bp, Homo sapiens
ttatgtgatcatgtgt

SEQ ID NO: 1612490 - DNA, 16 bp, Homo sapiens
ttatgtgcactgcctg

SEQ ID NO: 1612491 - DNA, 12 bp, Homo sapiens
ttatgtgctatg

SEQ ID NO: 1612492 - DNA, 16 bp, Homo sapiens
ttatgtggttttagat

SEQ ID NO: 1612493 - DNA, 15 bp, Homo sapiens
ttatgtgtaaataca

SEQ ID NO: 1612494 - DNA, 20 bp, Homo sapiens
ttatgtgtagaatttgaaat

SEQ ID NO: 1612495 - DNA, 15 bp, Homo sapiens
ttatgtgttatgaac

SEQ ID NO: 1612496 - DNA, 22 bp, Homo sapiens
ttatgttaagggaagaattcca

SEQ ID NO: 1612497 - DNA, 14 bp, Homo sapiens
ttatgttcctgctg

SEQ ID NO: 1612498 - DNA, 23 bp, Homo sapiens
ttatgttcttagcaataaatgct

SEQ ID NO: 1612499 - DNA, 18 bp, Homo sapiens
ttatgttgttttgtacag

SEQ ID NO: 1612500 - DNA, 17 bp, Homo sapiens
ttatgtttaaaagaaat

SEQ ID NO: 1612501 - DNA, 18 bp, Homo sapiens
ttatgtttaaaagaaata

SEQ ID NO: 1612502 - DNA, 19 bp, Homo sapiens
ttatgtttattacaatttt

SEQ ID NO: 1612503 - DNA, 19 bp, Homo sapiens
ttatgttttgtttctgaaa

SEQ ID NO: 1612504 - DNA, 22 bp, Homo sapiens
ttatgttttttaaaatatttat

SEQ ID NO: 1612505 - DNA, 12 bp, Homo sapiens
ttattaaaattg

SEQ ID NO: 1612506 - DNA, 21 bp, Homo sapiens
ttattaacgatgtccaacccg

SEQ ID NO: 1612507 - DNA, 23 bp, Homo sapiens
ttattaactactgaataatgcta

SEQ ID NO: 1612508 - DNA, 15 bp, Homo sapiens
ttattaagctttttg

SEQ ID NO: 1612509 - DNA, 14 bp, Homo sapiens
ttattaagtaaaat

SEQ ID NO: 1612510 - DNA, 23 bp, Homo sapiens
ttattaagtctgggatgtagaac

SEQ ID NO: 1612511 - DNA, 13 bp, Homo sapiens
ttattaagtgatt

SEQ ID NO: 1612512 - DNA, 11 bp, Homo sapiens
ttattaatatt

SEQ ID NO: 1612513 - DNA, 22 bp, Homo sapiens
ttattaatcatacaaactctca

SEQ ID NO: 1612514 - DNA, 17 bp, Homo sapiens
ttattaatgttttcaaa

SEQ ID NO: 1612515 - DNA, 13 bp, Homo sapiens
ttattaattttta

SEQ ID NO: 1612516 - DNA, 12 bp, Homo sapiens
ttattacatctt

SEQ ID NO: 1612517 - DNA, 15 bp, Homo sapiens
ttattacatgtaatt

SEQ ID NO: 1612518 - DNA, 20 bp, Homo sapiens
ttattaccccctccttcaga

SEQ ID NO: 1612519 - DNA, 12 bp, Homo sapiens
ttattacctctg

SEQ ID NO: 1612520 - DNA, 12 bp, Homo sapiens
ttattagataat

SEQ ID NO: 1612521 - DNA, 14 bp, Homo sapiens
ttattagcatttgt

SEQ ID NO: 1612522 - DNA, 20 bp, Homo sapiens
tgttttgccaaagactgtaa

SEQ ID NO: 1612523 - DNA, 15 bp, Homo sapiens
tgttttgccgtggct

SEQ ID NO: 1612524 - DNA, 19 bp, Homo sapiens
tgttttggacagtttacca

SEQ ID NO: 1612525 - DNA, 22 bp, Homo sapiens
tgttttggatttggagagaaat

SEQ ID NO: 1612526 - DNA, 13 bp, Homo sapiens
tgttttgtacaat

SEQ ID NO: 1612527 - DNA, 12 bp, Homo sapiens
tgttttgtataa

SEQ ID NO: 1612528 - DNA, 15 bp, Homo sapiens
tgttttgtataaaat

SEQ ID NO: 1612529 - DNA, 17 bp, Homo sapiens
tgttttgttctttaaag

SEQ ID NO: 1612530 - DNA, 16 bp, Homo sapiens
tgttttgttttaatct

SEQ ID NO: 1612531 - DNA, 17 bp, Homo sapiens
tgttttgttttaatctt

SEQ ID NO: 1612532 - DNA, 15 bp, Homo sapiens
tgtttttaagaaaaa

SEQ ID NO: 1612533 - DNA, 18 bp, Homo sapiens
tgtttttaagaaaaacat

SEQ ID NO: 1612534 - DNA, 23 bp, Homo sapiens
tgtttttaagaaaaacatgtcat

SEQ ID NO: 1612535 - DNA, 22 bp, Homo sapiens
tgtttttaagctgtttccatag

SEQ ID NO: 1612536 - DNA, 19 bp, Homo sapiens
tgtttttaatgctatttga

SEQ ID NO: 1612537 - DNA, 20 bp, Homo sapiens
tgtttttccttgtatttaaa

SEQ ID NO: 1612538 - DNA, 20 bp, Homo sapiens
tgtttttgaatttaaataaa

SEQ ID NO: 1612539 - DNA, 13 bp, Homo sapiens
tgtttttgcatga

SEQ ID NO: 1612540 - DNA, 10 bp, Homo sapiens
tgtttttggg

SEQ ID NO: 1612541 - DNA, 14 bp, Homo sapiens
tgtttttgggaaga

SEQ ID NO: 1612542 - DNA, 12 bp, Homo sapiens
tgttttttcctt

SEQ ID NO: 1612543 - DNA, 22 bp, Homo sapiens
tgttttttctttttttttaagt

SEQ ID NO: 1612544 - DNA, 14 bp, Homo sapiens
tgttttttgaaaac

SEQ ID NO: 1612545 - DNA, 19 bp, Homo sapiens
tgttttttgccacagcttt

SEQ ID NO: 1612546 - DNA, 23 bp, Homo sapiens
tgttttttgccacagcttttgca

SEQ ID NO: 1612547 - DNA, 14 bp, Homo sapiens
tgttttttggtctt

SEQ ID NO: 1612548 - DNA, 12 bp, Homo sapiens
tgttttttgtaa

SEQ ID NO: 1612549 - DNA, 14 bp, Homo sapiens
tgttttttgtaact

SEQ ID NO: 1612550 - DNA, 15 bp, Homo sapiens
tgttttttgtaacta

SEQ ID NO: 1612551 - DNA, 18 bp, Homo sapiens
tgttttttgtaactacaa

SEQ ID NO: 1612552 - DNA, 9 bp, Homo sapiens
tgttttttt

SEQ ID NO: 1612553 - DNA, 12 bp, Homo sapiens
tgtttttttcct

SEQ ID NO: 1612554 - DNA, 21 bp, Homo sapiens
tgtttttttcctcatgtaaca

SEQ ID NO: 1612555 - DNA, 15 bp, Homo sapiens
tgtttttttgtttgt

SEQ ID NO: 1612556 - DNA, 21 bp, Homo sapiens
tgtttttttttttttaaataa

SEQ ID NO: 1612557 - DNA, 21 bp, Homo sapiens
ttaaaaaaaaaagtcaccaaa

SEQ ID NO: 1612558 - DNA, 19 bp, Homo sapiens
ttaaaaaaaaattgtatct

SEQ ID NO: 1612559 - DNA, 23 bp, Homo sapiens
ttaaaaaaatttttataaattac

SEQ ID NO: 1612560 - DNA, 23 bp, Homo sapiens
ttaaaaaacaaaaaccagcaggt

SEQ ID NO: 1612561 - DNA, 16 bp, Homo sapiens
ttaaaaaactctttgg

SEQ ID NO: 1612562 - DNA, 13 bp, Homo sapiens
ttaaaaaacttgt

SEQ ID NO: 1612563 - DNA, 20 bp, Homo sapiens
ttaaaaaagactgaacatgt

SEQ ID NO: 1612564 - DNA, 20 bp, Homo sapiens
ttaaaaaataacatattctt

SEQ ID NO: 1612565 - DNA, 19 bp, Homo sapiens
ttaaaaaataatacaacaa

SEQ ID NO: 1612566 - DNA, 14 bp, Homo sapiens
ttaaaaaatatttt

SEQ ID NO: 1612567 - DNA, 15 bp, Homo sapiens
ttaaaaaatcttaat

SEQ ID NO: 1612568 - DNA, 12 bp, Homo sapiens
ttaaaaaatgtc

SEQ ID NO: 1612569 - DNA, 13 bp, Homo sapiens
ttaaaaaatgtcc

SEQ ID NO: 1612570 - DNA, 16 bp, Homo sapiens
ttaaaaaatgtccatg

SEQ ID NO: 1612571 - DNA, 17 bp, Homo sapiens
ttaaaaaatttttgaaa

SEQ ID NO: 1612572 - DNA, 13 bp, Homo sapiens
ttaaaaacaaagg

SEQ ID NO: 1612573 - DNA, 16 bp, Homo sapiens
ttaaaaacatagaaaa

SEQ ID NO: 1612574 - DNA, 15 bp, Homo sapiens
ttaaaaacatgacca

SEQ ID NO: 1612575 - DNA, 17 bp, Homo sapiens
ttaaaaagaaacaagat

SEQ ID NO: 1612576 - DNA, 12 bp, Homo sapiens
ttaaaaagaaat

SEQ ID NO: 1612577 - DNA, 14 bp, Homo sapiens
ttaaaaagaaatct

SEQ ID NO: 1612578 - DNA, 16 bp, Homo sapiens
ttaaaaagaatgacgt

SEQ ID NO: 1612579 - DNA, 12 bp, Homo sapiens
ttaaaaaggaaa

SEQ ID NO: 1612580 - DNA, 22 bp, Homo sapiens
ttaaaaaggaaatttgtttgta

SEQ ID NO: 1612581 - DNA, 12 bp, Homo sapiens
ttaaaaaggaac

SEQ ID NO: 1612582 - DNA, 13 bp, Homo sapiens
ttaaaaaggccaa

SEQ ID NO: 1612583 - DNA, 19 bp, Homo sapiens
ttaaaaaggccaaagataa

SEQ ID NO: 1612584 - DNA, 14 bp, Homo sapiens
ttaaaaagtgctat

SEQ ID NO: 1612585 - DNA, 16 bp, Homo sapiens
ttaaaaagttgttctt

SEQ ID NO: 1612586 - DNA, 16 bp, Homo sapiens
ttaaaaataaaattac

SEQ ID NO: 1612587 - DNA, 21 bp, Homo sapiens
ttaaaaataagtcaacagtaa

SEQ ID NO: 1612588 - DNA, 20 bp, Homo sapiens
ttaaaaataatagagcccca

SEQ ID NO: 1612589 - DNA, 20 bp, Homo sapiens
ttaaaaatagaatacatttt

SEQ ID NO: 1612590 - DNA, 22 bp, Homo sapiens
ttaaaaatagaatacattttgt

SEQ ID NO: 1612591 - DNA, 17 bp, Homo sapiens
ttaaaaatatttcagat

SEQ ID NO: 1612592 - DNA, 16 bp, Homo sapiens
ttaaaaatgtaaatat

SEQ ID NO: 1612593 - DNA, 17 bp, Homo sapiens
ttaaaaatgtaaatatt

SEQ ID NO: 1612594 - DNA, 23 bp, Homo sapiens
ttaaaaattaatatggtgtattt

SEQ ID NO: 1612595 - DNA, 17 bp, Homo sapiens
ttaaaaattacctttaa

SEQ ID NO: 1612596 - DNA, 20 bp, Homo sapiens
ttaaaaattacctttaattt

SEQ ID NO: 1612597 - DNA, 15 bp, Homo sapiens
ttaaaaatttactac

SEQ ID NO: 1612598 - DNA, 15 bp, Homo sapiens
ttaaaacaaaagggt

SEQ ID NO: 1612599 - DNA, 19 bp, Homo sapiens
ttaaaacaaatatacattt

SEQ ID NO: 1612600 - DNA, 10 bp, Homo sapiens
ttaaaacaag

SEQ ID NO: 1612601 - DNA, 22 bp, Homo sapiens
ttaaaacaataatgcaattaga

SEQ ID NO: 1612602 - DNA, 14 bp, Homo sapiens
ttaaaacagacact

SEQ ID NO: 1612603 - DNA, 21 bp, Homo sapiens
ttaaaacagacactggcatgg

SEQ ID NO: 1612604 - DNA, 22 bp, Homo sapiens
ttaaaacaggcaaagttttaca

SEQ ID NO: 1612605 - DNA, 14 bp, Homo sapiens
ttaaaacatgcacg

SEQ ID NO: 1612606 - DNA, 14 bp, Homo sapiens
ttaaaacatgtaat

SEQ ID NO: 1612607 - DNA, 16 bp, Homo sapiens
ttaaaaccacagctgg

SEQ ID NO: 1612608 - DNA, 16 bp, Homo sapiens
ttaaaactaagcacaa

SEQ ID NO: 1612609 - DNA, 12 bp, Homo sapiens
ttaaaactgctt

SEQ ID NO: 1612610 - DNA, 12 bp, Homo sapiens
ttaaaagaatat

SEQ ID NO: 1612611 - DNA, 21 bp, Homo sapiens
ttaaaagaatattttaacttc

SEQ ID NO: 1612612 - DNA, 22 bp, Homo sapiens
ttaaaagaatattttaacttcc

SEQ ID NO: 1612613 - DNA, 17 bp, Homo sapiens
ttaaaagagctcagaca

SEQ ID NO: 1612614 - DNA, 18 bp, Homo sapiens
ttaaaagatgaaaatatt

SEQ ID NO: 1612615 - DNA, 21 bp, Homo sapiens
ttaaaagcaaatcatttgttt

SEQ ID NO: 1612616 - DNA, 12 bp, Homo sapiens
ttaaaagcagca

SEQ ID NO: 1612617 - DNA, 21 bp, Homo sapiens
ttaaaagccttggcctcagag

SEQ ID NO: 1612618 - DNA, 19 bp, Homo sapiens
ttaaaaggatgtataaatt

SEQ ID NO: 1612619 - DNA, 14 bp, Homo sapiens
ttaaaagtaaatgt

SEQ ID NO: 1612620 - DNA, 20 bp, Homo sapiens
ttaaaagtctattttattat

SEQ ID NO: 1612621 - DNA, 13 bp, Homo sapiens
ttaaaataaattc

SEQ ID NO: 1612622 - DNA, 15 bp, Homo sapiens
ttaaaataactagtg

SEQ ID NO: 1612623 - DNA, 22 bp, Homo sapiens
ttaaaatactcagtgctaaaca

SEQ ID NO: 1612624 - DNA, 12 bp, Homo sapiens
ttaaaatagaaa

SEQ ID NO: 1612625 - DNA, 18 bp, Homo sapiens
ttatttttattaaatgta

SEQ ID NO: 1612626 - DNA, 21 bp, Homo sapiens
ttatttttctcttgtaccata

SEQ ID NO: 1612627 - DNA, 12 bp, Homo sapiens
ttatttttctga

SEQ ID NO: 1612628 - DNA, 12 bp, Homo sapiens
ttatttttctgt

SEQ ID NO: 1612629 - DNA, 19 bp, Homo sapiens
ttatttttcttactggaaa

SEQ ID NO: 1612630 - DNA, 16 bp, Homo sapiens
ttatttttgacagact

SEQ ID NO: 1612631 - DNA, 17 bp, Homo sapiens
ttatttttgtacatgtt

SEQ ID NO: 1612632 - DNA, 17 bp, Homo sapiens
ttatttttgtgtttcta

SEQ ID NO: 1612633 - DNA, 23 bp, Homo sapiens
ttatttttgtttcttccaaagca

SEQ ID NO: 1612634 - DNA, 16 bp, Homo sapiens
ttattttttaaatgta

SEQ ID NO: 1612635 - DNA, 18 bp, Homo sapiens
ttattttttaagtattta

SEQ ID NO: 1612636 - DNA, 14 bp, Homo sapiens
ttattttttacatt

SEQ ID NO: 1612637 - DNA, 13 bp, Homo sapiens
ttattttttccca

SEQ ID NO: 1612638 - DNA, 14 bp, Homo sapiens
ttattttttctaca

SEQ ID NO: 1612639 - DNA, 16 bp, Homo sapiens
ttcaaaacctgcagtt

SEQ ID NO: 1612640 - DNA, 13 bp, Homo sapiens
ttcaaaagggaag

SEQ ID NO: 1612641 - DNA, 20 bp, Homo sapiens
ttcaaaaggtattatacatg

SEQ ID NO: 1612642 - DNA, 17 bp, Homo sapiens
ttcaaaagttgaaatta

SEQ ID NO: 1612643 - DNA, 17 bp, Homo sapiens
ttcaaaataaaaatgag

SEQ ID NO: 1612644 - DNA, 18 bp, Homo sapiens
ttcaaaatagttctattt

SEQ ID NO: 1612645 - DNA, 22 bp, Homo sapiens
ttcaaaatagttctatttctat

SEQ ID NO: 1612646 - DNA, 14 bp, Homo sapiens
ttcaaaatgtctgt

SEQ ID NO: 1612647 - DNA, 15 bp, Homo sapiens
ttcaaaatgttatct

SEQ ID NO: 1612648 - DNA, 23 bp, Homo sapiens
ttcaaaatgttatcttctcaagt

SEQ ID NO: 1612649 - DNA, 17 bp, Homo sapiens
ttcaaaatgttctattt

SEQ ID NO: 1612650 - DNA, 18 bp, Homo sapiens
ttcaaacagtctcaggaa

SEQ ID NO: 1612651 - DNA, 18 bp, Homo sapiens
ttcaaacatcagctgaat

SEQ ID NO: 1612652 - DNA, 21 bp, Homo sapiens
ttcaaacctcaaatatagtat

SEQ ID NO: 1612653 - DNA, 15 bp, Homo sapiens
ttcaaactgaatttg

SEQ ID NO: 1612654 - DNA, 17 bp, Homo sapiens
ttcaaactgctgcatac

SEQ ID NO: 1612655 - DNA, 15 bp, Homo sapiens
ttcaaactggggcct

SEQ ID NO: 1612656 - DNA, 16 bp, Homo sapiens
ttcaaactggggcctc

SEQ ID NO: 1612657 - DNA, 21 bp, Homo sapiens
ttcaaactggggcctccagaa

SEQ ID NO: 1612658 - DNA, 12 bp, Homo sapiens
ttcaaactgtga

SEQ ID NO: 1612659 - DNA, 13 bp, Homo sapiens
ttcaaacttaaac

SEQ ID NO: 1612660 - DNA, 16 bp, Homo sapiens
ttcaaactttcacttt

SEQ ID NO: 1612661 - DNA, 15 bp, Homo sapiens
ttcaaagactgtgaa

SEQ ID NO: 1612662 - DNA, 12 bp, Homo sapiens
ttcaaagatgct

SEQ ID NO: 1612663 - DNA, 14 bp, Homo sapiens
ttcaaagccctgcc

SEQ ID NO: 1612664 - DNA, 15 bp, Homo sapiens
ttcaaagccctgcct

SEQ ID NO: 1612665 - DNA, 16 bp, Homo sapiens
ttcaaagccctgcctc

SEQ ID NO: 1612666 - DNA, 22 bp, Homo sapiens
ttcaaagctaaaaaattgttaa

SEQ ID NO: 1612667 - DNA, 14 bp, Homo sapiens
ttcaaaggaacatt

SEQ ID NO: 1612668 - DNA, 12 bp, Homo sapiens
ttcaaaggttct

SEQ ID NO: 1612669 - DNA, 21 bp, Homo sapiens
ttcaaaggttctaggtttcaa

SEQ ID NO: 1612670 - DNA, 14 bp, Homo sapiens
ttcaaagtgtatat

SEQ ID NO: 1612671 - DNA, 23 bp, Homo sapiens
ttcaaagtgtatatttattcata

SEQ ID NO: 1612672 - DNA, 20 bp, Homo sapiens
ttcaaagtgttgtgttcctg

SEQ ID NO: 1612673 - DNA, 21 bp, Homo sapiens
ttcaaagtgttgtgttcctgg

SEQ ID NO: 1612674 - DNA, 22 bp, Homo sapiens
ttcaaagtgttgtgttcctggc

SEQ ID NO: 1612675 - DNA, 23 bp, Homo sapiens
ttcaaagtgttgtgttcctggct

SEQ ID NO: 1612676 - DNA, 18 bp, Homo sapiens
ttcaaatagggtctaact

SEQ ID NO: 1612677 - DNA, 22 bp, Homo sapiens
ttcaaatgatttttacaagttt

SEQ ID NO: 1612678 - DNA, 12 bp, Homo sapiens
ttcaaatgcaaa

SEQ ID NO: 1612679 - DNA, 22 bp, Homo sapiens
ttcaaatgtttgaaaacaaaaa

SEQ ID NO: 1612680 - DNA, 23 bp, Homo sapiens
ttcatctaatgtattatgagcca

SEQ ID NO: 1612681 - DNA, 14 bp, Homo sapiens
ttcatctacctttt

SEQ ID NO: 1612682 - DNA, 16 bp, Homo sapiens
ttcatctatttctgag

SEQ ID NO: 1612683 - DNA, 23 bp, Homo sapiens
ttcatctatttttggcagtctga

SEQ ID NO: 1612684 - DNA, 23 bp, Homo sapiens
ttcatctcatcaggcaaattgta

SEQ ID NO: 1612685 - DNA, 15 bp, Homo sapiens
ttcatctgaaaagca

SEQ ID NO: 1612686 - DNA, 20 bp, Homo sapiens
ttcatctgactatgacataa

SEQ ID NO: 1612687 - DNA, 14 bp, Homo sapiens
ttcatctgcaaagg

SEQ ID NO: 1612688 - DNA, 16 bp, Homo sapiens
ttcatctgctctcctt

SEQ ID NO: 1612689 - DNA, 18 bp, Homo sapiens
ttcatctgtaactctaaa

SEQ ID NO: 1612690 - DNA, 21 bp, Homo sapiens
ttcatctgtaactctaaaaga

SEQ ID NO: 1612691 - DNA, 13 bp, Homo sapiens
ttcatcttaaact

SEQ ID NO: 1612692 - DNA, 14 bp, Homo sapiens
ttcatcttcctgtg

SEQ ID NO: 1612693 - DNA, 15 bp, Homo sapiens
ttcatcttcctgtgt

SEQ ID NO: 1612694 - DNA, 18 bp, Homo sapiens
ttcatcttcctgtgtcct

SEQ ID NO: 1612695 - DNA, 17 bp, Homo sapiens
ttcatcttgaagttttt

SEQ ID NO: 1612696 - DNA, 22 bp, Homo sapiens
ttcatcttggtcacatacaatt

SEQ ID NO: 1612697 - DNA, 17 bp, Homo sapiens
ttcatgaaaataccatt

SEQ ID NO: 1612698 - DNA, 22 bp, Homo sapiens
ttcatgaataggaatattcaag

SEQ ID NO: 1612699 - DNA, 23 bp, Homo sapiens
ttcatgattagaaattacctgtg

SEQ ID NO: 1612700 - DNA, 22 bp, Homo sapiens
ttcatgattatagcaactaatg

SEQ ID NO: 1612701 - DNA, 22 bp, Homo sapiens
ttcatgcaagagtttcttgtaa

SEQ ID NO: 1612702 - DNA, 21 bp, Homo sapiens
ttcatgccaattagcaattga

SEQ ID NO: 1612703 - DNA, 19 bp, Homo sapiens
ttcatgccatctgttttca

SEQ ID NO: 1612704 - DNA, 14 bp, Homo sapiens
ttcatgcctttgta

SEQ ID NO: 1612705 - DNA, 17 bp, Homo sapiens
ttcatgcctttgtaagt

SEQ ID NO: 1612706 - DNA, 18 bp, Homo sapiens
ttcatgcctttgtaagtt

SEQ ID NO: 1612707 - DNA, 19 bp, Homo sapiens
ttcatgcttgacataccta

SEQ ID NO: 1612708 - DNA, 16 bp, Homo sapiens
ttcatggacactttga

SEQ ID NO: 1612709 - DNA, 21 bp, Homo sapiens
ttcatggacactttgaaatgt

SEQ ID NO: 1612710 - DNA, 21 bp, Homo sapiens
ttcatggcatgcttaaatttt

SEQ ID NO: 1612711 - DNA, 21 bp, Homo sapiens
ttcatggctgctgttgcttaa

SEQ ID NO: 1612712 - DNA, 16 bp, Homo sapiens
ttcatgtcccagaact

SEQ ID NO: 1612713 - DNA, 22 bp, Homo sapiens
ttcatgtcccagaacttagcct

SEQ ID NO: 1612714 - DNA, 21 bp, Homo sapiens
ttcatgtctgaaacagagaac

SEQ ID NO: 1612715 - DNA, 22 bp, Homo sapiens
ttcatgttagttaccttatagt

SEQ ID NO: 1612716 - DNA, 15 bp, Homo sapiens
ttcattaaaagctac

SEQ ID NO: 1612717 - DNA, 12 bp, Homo sapiens
ttcattaaactt

SEQ ID NO: 1612718 - DNA, 20 bp, Homo sapiens
ttcattaaacttgaagcagt

SEQ ID NO: 1612719 - DNA, 13 bp, Homo sapiens
ttcattaccaggt

SEQ ID NO: 1612720 - DNA, 19 bp, Homo sapiens
ttcattaccaggtttcatt

SEQ ID NO: 1612721 - DNA, 13 bp, Homo sapiens
ttcattagataca

SEQ ID NO: 1612722 - DNA, 13 bp, Homo sapiens
ttcattagcagtt

SEQ ID NO: 1612723 - DNA, 20 bp, Homo sapiens
ttcattagcagttgctcaca

SEQ ID NO: 1612724 - DNA, 17 bp, Homo sapiens
ttcattataatctcaaa

SEQ ID NO: 1612725 - DNA, 22 bp, Homo sapiens
ttcattatgcacttttagaaat

SEQ ID NO: 1612726 - DNA, 14 bp, Homo sapiens
ttcattattcaaga

SEQ ID NO: 1612727 - DNA, 19 bp, Homo sapiens
ttcattattcaagaatgaa

SEQ ID NO: 1612728 - DNA, 23 bp, Homo sapiens
ttcattattcaagaatgaaaaat

SEQ ID NO: 1612729 - DNA, 17 bp, Homo sapiens
ttcattctccttgttgt

SEQ ID NO: 1612730 - DNA, 14 bp, Homo sapiens
ttcattctctttta

SEQ ID NO: 1612731 - DNA, 19 bp, Homo sapiens
ttcattctgctacttcact

SEQ ID NO: 1612732 - DNA, 14 bp, Homo sapiens
ttcattctttactg

SEQ ID NO: 1612733 - DNA, 22 bp, Homo sapiens
ttcattgacctcatcattaata

SEQ ID NO: 1612734 - DNA, 15 bp, Homo sapiens
ttcattggcagctca

SEQ ID NO: 1612735 - DNA, 21 bp, Homo sapiens
ttcattgtaaatcacttgttt

SEQ ID NO: 1612736 - DNA, 10 bp, Homo sapiens
ttcattgttt

SEQ ID NO: 1612737 - DNA, 19 bp, Homo sapiens
ttcatttccaactcaggtt

SEQ ID NO: 1612738 - DNA, 13 bp, Homo sapiens
ttcatttccactc

SEQ ID NO: 1612739 - DNA, 12 bp, Homo sapiens
ttcatttctgca

SEQ ID NO: 1612740 - DNA, 15 bp, Homo sapiens
ttcatttctttcctt

SEQ ID NO: 1612741 - DNA, 21 bp, Homo sapiens
ttcatttggtgttcctggaag

SEQ ID NO: 1612742 - DNA, 13 bp, Homo sapiens
ttcatttgtacaa

SEQ ID NO: 1612743 - DNA, 18 bp, Homo sapiens
ttcatttgtatgtcaaag

SEQ ID NO: 1612744 - DNA, 22 bp, Homo sapiens
ttcatttgtttgtttgtttgtc

SEQ ID NO: 1612745 - DNA, 19 bp, Homo sapiens
ttcatttgttttgcttttg

SEQ ID NO: 1612746 - DNA, 17 bp, Homo sapiens
ttcattttgaaaaacac

SEQ ID NO: 1612747 - DNA, 17 bp, Homo sapiens
ttcattttgagctgaaa

SEQ ID NO: 1612748 - DNA, 14 bp, Homo sapiens
ttcatttttttcca

SEQ ID NO: 1612749 - DNA, 17 bp, Homo sapiens
ttcatttttttccaggc

SEQ ID NO: 1612750 - DNA, 18 bp, Homo sapiens
ttcatttttttccaggct

SEQ ID NO: 1612751 - DNA, 18 bp, Homo sapiens
ttccaaaacctgcttcct

SEQ ID NO: 1612752 - DNA, 14 bp, Homo sapiens
ttccaaaatattat

SEQ ID NO: 1612753 - DNA, 16 bp, Homo sapiens
ttccaaacctgacaga

SEQ ID NO: 1612754 - DNA, 23 bp, Homo sapiens
ttccaaagcctagacaacctttc

SEQ ID NO: 1612755 - DNA, 11 bp, Homo sapiens
ttccaaagctc

SEQ ID NO: 1612756 - DNA, 14 bp, Homo sapiens
ttccaaagtctcta

SEQ ID NO: 1612757 - DNA, 14 bp, Homo sapiens
ttccaaagttaaca

SEQ ID NO: 1612758 - DNA, 16 bp, Homo sapiens
ttccaaataaacattt

SEQ ID NO: 1612759 - DNA, 13 bp, Homo sapiens
ttccaaattcatg

SEQ ID NO: 1612760 - DNA, 21 bp, Homo sapiens
ttccaacaatggggtgggccc

SEQ ID NO: 1612761 - DNA, 19 bp, Homo sapiens
ttccaacaccacagacaca

SEQ ID NO: 1612762 - DNA, 13 bp, Homo sapiens
ttccaacatgcaa

SEQ ID NO: 1612763 - DNA, 14 bp, Homo sapiens
ttccaacatttctt

SEQ ID NO: 1612764 - DNA, 21 bp, Homo sapiens
ttccaacctcctgctctggga

SEQ ID NO: 1612765 - DNA, 16 bp, Homo sapiens
ttccaagacatgtctg

SEQ ID NO: 1612766 - DNA, 15 bp, Homo sapiens
ttccaagcatgacaa

SEQ ID NO: 1612767 - DNA, 18 bp, Homo sapiens
ttccaaggccctgctttt

SEQ ID NO: 1612768 - DNA, 17 bp, Homo sapiens
ttccaagggtactaagg

SEQ ID NO: 1612769 - DNA, 16 bp, Homo sapiens
ttccaagttgctaata

SEQ ID NO: 1612770 - DNA, 14 bp, Homo sapiens
ttccaatatgtgat

SEQ ID NO: 1612771 - DNA, 19 bp, Homo sapiens
ttccaatgcctcttgtctt

SEQ ID NO: 1612772 - DNA, 14 bp, Homo sapiens
ttccaattccactg

SEQ ID NO: 1612773 - DNA, 18 bp, Homo sapiens
ttccaattctaaatccga

SEQ ID NO: 1612774 - DNA, 22 bp, Homo sapiens
ttccaatttacatactctgctt

SEQ ID NO: 1612775 - DNA, 11 bp, Homo sapiens
ttccacaaaat

SEQ ID NO: 1612776 - DNA, 15 bp, Homo sapiens
ttccacaaaattaga

SEQ ID NO: 1612777 - DNA, 17 bp, Homo sapiens
ttccacaaaattagaaa

SEQ ID NO: 1612778 - DNA, 21 bp, Homo sapiens
ttccacaagattcccagagac

SEQ ID NO: 1612779 - DNA, 17 bp, Homo sapiens
ttccacacagaatgcaa

SEQ ID NO: 1612780 - DNA, 19 bp, Homo sapiens
ttccacacagaatgcaacc

SEQ ID NO: 1612781 - DNA, 23 bp, Homo sapiens
ttccacagcacaaacacacctct

SEQ ID NO: 1612782 - DNA, 22 bp, Homo sapiens
ttccacagcagcagaacaagtg

SEQ ID NO: 1612783 - DNA, 14 bp, Homo sapiens
ttccacagctgccc

SEQ ID NO: 1612784 - DNA, 20 bp, Homo sapiens
ttccacagctgccctggctg

SEQ ID NO: 1612785 - DNA, 15 bp, Homo sapiens
ttccacatctgtttc

SEQ ID NO: 1612786 - DNA, 22 bp, Homo sapiens
ttccacatctgtttcaaactga

SEQ ID NO: 1612787 - DNA, 15 bp, Homo sapiens
ttccaccacagccag

SEQ ID NO: 1612788 - DNA, 16 bp, Homo sapiens
ttccaccacagccagc

SEQ ID NO: 1612789 - DNA, 17 bp, Homo sapiens
ttccaccattgctggaa

SEQ ID NO: 1612790 - DNA, 23 bp, Homo sapiens
ttccacccagtgctgaatttccc

SEQ ID NO: 1612791 - DNA, 14 bp, Homo sapiens
ttccaccctggaga

SEQ ID NO: 1612792 - DNA, 14 bp, Homo sapiens
ttccacgatgaaaa

SEQ ID NO: 1612793 - DNA, 15 bp, Homo sapiens
ttccacgcagcaccc

SEQ ID NO: 1612794 - DNA, 19 bp, Homo sapiens
ttccacgtccccctggggc

SEQ ID NO: 1612795 - DNA, 19 bp, Homo sapiens
ttccacgtgttttattcct

SEQ ID NO: 1612796 - DNA, 17 bp, Homo sapiens
ttaaaatgtttggatgg

SEQ ID NO: 1612797 - DNA, 16 bp, Homo sapiens
ttaaaattaagtagaa

SEQ ID NO: 1612798 - DNA, 17 bp, Homo sapiens
ttaaaattaagttgaaa

SEQ ID NO: 1612799 - DNA, 23 bp, Homo sapiens
ttaaaattctcttccaaccattt

SEQ ID NO: 1612800 - DNA, 15 bp, Homo sapiens
ttaaaattctgatgt

SEQ ID NO: 1612801 - DNA, 20 bp, Homo sapiens
ttaaaatttcgttgtccaat

SEQ ID NO: 1612802 - DNA, 15 bp, Homo sapiens
ttaaacaaaaaacta

SEQ ID NO: 1612803 - DNA, 12 bp, Homo sapiens
ttaaacaaatga

SEQ ID NO: 1612804 - DNA, 15 bp, Homo sapiens
ttaaacaaatgattt

SEQ ID NO: 1612805 - DNA, 13 bp, Homo sapiens
ttaaacaatgtat

SEQ ID NO: 1612806 - DNA, 20 bp, Homo sapiens
ttaaacaatgtataaagatt

SEQ ID NO: 1612807 - DNA, 13 bp, Homo sapiens
ttaaacacctcct

SEQ ID NO: 1612808 - DNA, 19 bp, Homo sapiens
ttaaacactacacatttga

SEQ ID NO: 1612809 - DNA, 21 bp, Homo sapiens
ttaaacactacacatttgaaa

SEQ ID NO: 1612810 - DNA, 16 bp, Homo sapiens
ttaaacagatttttac

SEQ ID NO: 1612811 - DNA, 15 bp, Homo sapiens
ttaaacaggcccagc

SEQ ID NO: 1612812 - DNA, 16 bp, Homo sapiens
ttaaacaggcccagca

SEQ ID NO: 1612813 - DNA, 18 bp, Homo sapiens
ttaaacagtgagcctgaa

SEQ ID NO: 1612814 - DNA, 19 bp, Homo sapiens
ttaaacatacataatacaa

SEQ ID NO: 1612815 - DNA, 15 bp, Homo sapiens
ttaaacattgaagta

SEQ ID NO: 1612816 - DNA, 17 bp, Homo sapiens
ttaaacatttgttcctg

SEQ ID NO: 1612817 - DNA, 18 bp, Homo sapiens
ttaaacatttgttcctgg

SEQ ID NO: 1612818 - DNA, 17 bp, Homo sapiens
ttaaacccatacaatgt

SEQ ID NO: 1612819 - DNA, 21 bp, Homo sapiens
ttaaacccatacaatgtatgt

SEQ ID NO: 1612820 - DNA, 21 bp, Homo sapiens
ttaaacctgtttttttttcat

SEQ ID NO: 1612821 - DNA, 17 bp, Homo sapiens
ttaaacctttttcttga

SEQ ID NO: 1612822 - DNA, 23 bp, Homo sapiens
ttaaacgctctaggtacgatgac

SEQ ID NO: 1612823 - DNA, 20 bp, Homo sapiens
ttaaactaaaaaaaaaaagg

SEQ ID NO: 1612824 - DNA, 14 bp, Homo sapiens
ttaaactaaatgtg

SEQ ID NO: 1612825 - DNA, 22 bp, Homo sapiens
ttaaactaggagaaccaaatct

SEQ ID NO: 1612826 - DNA, 22 bp, Homo sapiens
ttaaactctgaatttatctttg

SEQ ID NO: 1612827 - DNA, 13 bp, Homo sapiens
ttaaactggtatt

SEQ ID NO: 1612828 - DNA, 19 bp, Homo sapiens
ttaaactggtattttatct

SEQ ID NO: 1612829 - DNA, 23 bp, Homo sapiens
ttaaactgtgaagctattggaat

SEQ ID NO: 1612830 - DNA, 20 bp, Homo sapiens
ttaaacttgaaatatataat

SEQ ID NO: 1612831 - DNA, 22 bp, Homo sapiens
ttaaacttgaaatatataatat

SEQ ID NO: 1612832 - DNA, 19 bp, Homo sapiens
ttaaactttcccttggctg

SEQ ID NO: 1612833 - DNA, 21 bp, Homo sapiens
ttaaagaaacagctttcaagt

SEQ ID NO: 1612834 - DNA, 16 bp, Homo sapiens
ttaaagaaaggaaaag

SEQ ID NO: 1612835 - DNA, 23 bp, Homo sapiens
ttaaagaataaagtccaaagtca

SEQ ID NO: 1612836 - DNA, 20 bp, Homo sapiens
ttaaagaatatgacttttta

SEQ ID NO: 1612837 - DNA, 10 bp, Homo sapiens
ttaaagacag

SEQ ID NO: 1612838 - DNA, 11 bp, Homo sapiens
ttaaagacaga

SEQ ID NO: 1612839 - DNA, 12 bp, Homo sapiens
ttaaagacaggt

SEQ ID NO: 1612840 - DNA, 14 bp, Homo sapiens
ttaaagacatacct

SEQ ID NO: 1612841 - DNA, 15 bp, Homo sapiens
ttaaagagaatgagt

SEQ ID NO: 1612842 - DNA, 14 bp, Homo sapiens
ttaaagatttatca

SEQ ID NO: 1612843 - DNA, 17 bp, Homo sapiens
ttaaagatttatcaaat

SEQ ID NO: 1612844 - DNA, 21 bp, Homo sapiens
ttaaagatttatcaaatcagt

SEQ ID NO: 1612845 - DNA, 16 bp, Homo sapiens
ttaaagatttcaaata

SEQ ID NO: 1612846 - DNA, 15 bp, Homo sapiens
ttaaagcaaagtcac

SEQ ID NO: 1612847 - DNA, 22 bp, Homo sapiens
ttaaagcaaagtcacttctcca

SEQ ID NO: 1612848 - DNA, 21 bp, Homo sapiens
ttaaagcagagggactttgta

SEQ ID NO: 1612849 - DNA, 18 bp, Homo sapiens
ttaaagccattctgatta

SEQ ID NO: 1612850 - DNA, 14 bp, Homo sapiens
ttaaagcctcctca

SEQ ID NO: 1612851 - DNA, 20 bp, Homo sapiens
ttaaagcttatttttctgtg

SEQ ID NO: 1612852 - DNA, 12 bp, Homo sapiens
ttaaaggaagga

SEQ ID NO: 1612853 - DNA, 15 bp, Homo sapiens
ttaaaggctgtggta

SEQ ID NO: 1612854 - DNA, 18 bp, Homo sapiens
ttaaagggaagaaaacac

SEQ ID NO: 1612855 - DNA, 23 bp, Homo sapiens
ttaaagggaagaaaacactgtta

SEQ ID NO: 1612856 - DNA, 22 bp, Homo sapiens
ttaaagggggagaattctagaa

SEQ ID NO: 1612857 - DNA, 20 bp, Homo sapiens
ttaaagtatgcattattaaa

SEQ ID NO: 1612858 - DNA, 23 bp, Homo sapiens
ttaaagtatgcattattaaattg

SEQ ID NO: 1612859 - DNA, 16 bp, Homo sapiens
ttaaagtgaacacaca

SEQ ID NO: 1612860 - DNA, 19 bp, Homo sapiens
ttaaataaaagcacaagta

SEQ ID NO: 1612861 - DNA, 14 bp, Homo sapiens
ttaaataaaagtga

SEQ ID NO: 1612862 - DNA, 15 bp, Homo sapiens
ttaaataaatcataa

SEQ ID NO: 1612863 - DNA, 22 bp, Homo sapiens
ttaaataaatttgacttttctg

SEQ ID NO: 1612864 - DNA, 18 bp, Homo sapiens
ttaaataagattctaacg

SEQ ID NO: 1612865 - DNA, 12 bp, Homo sapiens
ttaaataatttc

SEQ ID NO: 1612866 - DNA, 10 bp, Homo sapiens
ttaaatacag

SEQ ID NO: 1612867 - DNA, 20 bp, Homo sapiens
ttaaatacagacactaagtt

SEQ ID NO: 1612868 - DNA, 21 bp, Homo sapiens
ttaaatacagataattcattt

SEQ ID NO: 1612869 - DNA, 19 bp, Homo sapiens
ttaaatacaggaaacagtt

SEQ ID NO: 1612870 - DNA, 13 bp, Homo sapiens
ttaaatagataca

SEQ ID NO: 1612871 - DNA, 17 bp, Homo sapiens
ttaaatagatacaaatg

SEQ ID NO: 1612872 - DNA, 19 bp, Homo sapiens
ttaaatagcctaaatgatg

SEQ ID NO: 1612873 - DNA, 12 bp, Homo sapiens
ttaaatataaat

SEQ ID NO: 1612874 - DNA, 16 bp, Homo sapiens
ttaaatataattctgt

SEQ ID NO: 1612875 - DNA, 18 bp, Homo sapiens
ttaaatataattctgtaa

SEQ ID NO: 1612876 - DNA, 20 bp, Homo sapiens
ttaaatataattctgtaaat

SEQ ID NO: 1612877 - DNA, 16 bp, Homo sapiens
ttaaatatatattttg

SEQ ID NO: 1612878 - DNA, 18 bp, Homo sapiens
ttaaatatccacagtact

SEQ ID NO: 1612879 - DNA, 16 bp, Homo sapiens
ttaaatatgaatgaac

SEQ ID NO: 1612880 - DNA, 18 bp, Homo sapiens
ttaaatatttcaagacat

SEQ ID NO: 1612881 - DNA, 18 bp, Homo sapiens
ttaaatattttgctaact

SEQ ID NO: 1612882 - DNA, 14 bp, Homo sapiens
ttaaatcaaggaaa

SEQ ID NO: 1612883 - DNA, 22 bp, Homo sapiens
ttaaatcacagcccaaaatttg

SEQ ID NO: 1612884 - DNA, 19 bp, Homo sapiens
ttaaatccttttacctttt

SEQ ID NO: 1612885 - DNA, 17 bp, Homo sapiens
ttaaatctgctttagtt

SEQ ID NO: 1612886 - DNA, 14 bp, Homo sapiens
ttaaatctgtgatg

SEQ ID NO: 1612887 - DNA, 16 bp, Homo sapiens
ttaaatcttaaacaat

SEQ ID NO: 1612888 - DNA, 24 bp, Homo sapiens
ttaaatcttaaacaatgtataaag

SEQ ID NO: 1612889 - DNA, 17 bp, Homo sapiens
ttaaatcttttcttcaa

SEQ ID NO: 1612890 - DNA, 15 bp, Homo sapiens
ttaaatgaaagcatg

SEQ ID NO: 1612891 - DNA, 21 bp, Homo sapiens
ttaaatgaagtgattctaaga

SEQ ID NO: 1612892 - DNA, 12 bp, Homo sapiens
ttaaatgacttt

SEQ ID NO: 1612893 - DNA, 15 bp, Homo sapiens
ttaaatgacttttct

SEQ ID NO: 1612894 - DNA, 17 bp, Homo sapiens
ttaaatgacttttctta

SEQ ID NO: 1612895 - DNA, 18 bp, Homo sapiens
ttaaatgacttttcttaa

SEQ ID NO: 1612896 - DNA, 20 bp, Homo sapiens
ttaaatgcagttacaaatta

SEQ ID NO: 1612897 - DNA, 13 bp, Homo sapiens
ttaaatgccttgt

SEQ ID NO: 1612898 - DNA, 14 bp, Homo sapiens
ttaaatgccttgta

SEQ ID NO: 1612899 - DNA, 18 bp, Homo sapiens
ttaaatgccttgtataaa

SEQ ID NO: 1612900 - DNA, 20 bp, Homo sapiens
ttaaatgctcattttctggt

SEQ ID NO: 1612901 - DNA, 22 bp, Homo sapiens
ttaaatggtaataagcactgta

SEQ ID NO: 1612902 - DNA, 14 bp, Homo sapiens
ttaaatggttctgt

SEQ ID NO: 1612903 - DNA, 12 bp, Homo sapiens
ttaaatgtaaaa

SEQ ID NO: 1612904 - DNA, 16 bp, Homo sapiens
ttaaatgtaaataatc

SEQ ID NO: 1612905 - DNA, 21 bp, Homo sapiens
ttaaatgtgtgagtgcatgta

SEQ ID NO: 1612906 - DNA, 16 bp, Homo sapiens
ttaaatgttatgtata

SEQ ID NO: 1612907 - DNA, 16 bp, Homo sapiens
ttaaattacaatttta

SEQ ID NO: 1612908 - DNA, 18 bp, Homo sapiens
ttaaattacaattttatc

SEQ ID NO: 1612909 - DNA, 16 bp, Homo sapiens
ttaaattacatttgta

SEQ ID NO: 1612910 - DNA, 18 bp, Homo sapiens
ttaaattatactgtagct

SEQ ID NO: 1612911 - DNA, 12 bp, Homo sapiens
ttaaattatata

SEQ ID NO: 1612912 - DNA, 19 bp, Homo sapiens
ttaaattcttactctggag

SEQ ID NO: 1612913 - DNA, 21 bp, Homo sapiens
tgtttctccttagttggctgg

SEQ ID NO: 1612914 - DNA, 13 bp, Homo sapiens
tgtttctctgctg

SEQ ID NO: 1612915 - DNA, 16 bp, Homo sapiens
tgtttctctgctgtca

SEQ ID NO: 1612916 - DNA, 17 bp, Homo sapiens
tgtttctctgctgtcaa

SEQ ID NO: 1612917 - DNA, 18 bp, Homo sapiens
tgtttctcttgagctggc

SEQ ID NO: 1612918 - DNA, 12 bp, Homo sapiens
tgtttctgactc

SEQ ID NO: 1612919 - DNA, 19 bp, Homo sapiens
tgtttctgactctgagcta

SEQ ID NO: 1612920 - DNA, 19 bp, Homo sapiens
tgtttctggacattctctt

SEQ ID NO: 1612921 - DNA, 21 bp, Homo sapiens
tgtttctggacattctctttg

SEQ ID NO: 1612922 - DNA, 23 bp, Homo sapiens
tgtttctggacattctctttgat

SEQ ID NO: 1612923 - DNA, 19 bp, Homo sapiens
tgtttctggagtcacatca

SEQ ID NO: 1612924 - DNA, 21 bp, Homo sapiens
tgtttctggagtgattctaga

SEQ ID NO: 1612925 - DNA, 17 bp, Homo sapiens
tgtttctgtgaaattct

SEQ ID NO: 1612926 - DNA, 19 bp, Homo sapiens
tgtttctgtgaaattctca

SEQ ID NO: 1612927 - DNA, 13 bp, Homo sapiens
tgtttcttagccc

SEQ ID NO: 1612928 - DNA, 15 bp, Homo sapiens
tgtttcttcatttct

SEQ ID NO: 1612929 - DNA, 19 bp, Homo sapiens
tgtttcttcatttctctgc

SEQ ID NO: 1612930 - DNA, 16 bp, Homo sapiens
tgtttcttgacaagct

SEQ ID NO: 1612931 - DNA, 20 bp, Homo sapiens
tgtttctttcttcctcttct

SEQ ID NO: 1612932 - DNA, 17 bp, Homo sapiens
tgtttctttttacagca

SEQ ID NO: 1612933 - DNA, 19 bp, Homo sapiens
tgtttctttttacagcatt

SEQ ID NO: 1612934 - DNA, 14 bp, Homo sapiens
tgtttgaaatatca

SEQ ID NO: 1612935 - DNA, 16 bp, Homo sapiens
tgtttgaaatcatcgg

SEQ ID NO: 1612936 - DNA, 13 bp, Homo sapiens
tgtttgaaatctt

SEQ ID NO: 1612937 - DNA, 17 bp, Homo sapiens
tgtttgagagagaatga

SEQ ID NO: 1612938 - DNA, 18 bp, Homo sapiens
tgtttgagattctcaaag

SEQ ID NO: 1612939 - DNA, 23 bp, Homo sapiens
tgtttgagctcagacccccactc

SEQ ID NO: 1612940 - DNA, 19 bp, Homo sapiens
tgtttgatgctatttatgc

SEQ ID NO: 1612941 - DNA, 21 bp, Homo sapiens
tgtttgatgctatttatgcaa

SEQ ID NO: 1612942 - DNA, 15 bp, Homo sapiens
tgtttgatgtatgtg

SEQ ID NO: 1612943 - DNA, 16 bp, Homo sapiens
tgtttgatgtatgtgt

SEQ ID NO: 1612944 - DNA, 19 bp, Homo sapiens
tgtttgatgtatgtgtgaa

SEQ ID NO: 1612945 - DNA, 20 bp, Homo sapiens
tgtttgatgtatgtgtgaaa

SEQ ID NO: 1612946 - DNA, 13 bp, Homo sapiens
tgtttgattggct

SEQ ID NO: 1612947 - DNA, 11 bp, Homo sapiens
tgtttgatttc

SEQ ID NO: 1612948 - DNA, 24 bp, Homo sapiens
tgtttgcactgtgtgctgactgaa

SEQ ID NO: 1612949 - DNA, 13 bp, Homo sapiens
tgtttgcagctgt

SEQ ID NO: 1612950 - DNA, 19 bp, Homo sapiens
tgtttgcattgtctaatga

SEQ ID NO: 1612951 - DNA, 19 bp, Homo sapiens
tgtttgctatgactacatt

SEQ ID NO: 1612952 - DNA, 21 bp, Homo sapiens
tgtttgctatgactacatttt

SEQ ID NO: 1612953 - DNA, 19 bp, Homo sapiens
tgtttgctgattatttatg

SEQ ID NO: 1612954 - DNA, 17 bp, Homo sapiens
tgtttgcttcttgccat

SEQ ID NO: 1612955 - DNA, 19 bp, Homo sapiens
tgtttgcttcttgccatca

SEQ ID NO: 1612956 - DNA, 12 bp, Homo sapiens
tgtttggaaaaa

SEQ ID NO: 1612957 - DNA, 16 bp, Homo sapiens
tgtttggaaaagacag

SEQ ID NO: 1612958 - DNA, 17 bp, Homo sapiens
tgtttggaaaagacagt

SEQ ID NO: 1612959 - DNA, 14 bp, Homo sapiens
tgtttggaaaccac

SEQ ID NO: 1612960 - DNA, 22 bp, Homo sapiens
tgtttggcctttcttggggaga

SEQ ID NO: 1612961 - DNA, 20 bp, Homo sapiens
tgtttgggaagagcttagaa

SEQ ID NO: 1612962 - DNA, 20 bp, Homo sapiens
tgtttgggatattaaaacac

SEQ ID NO: 1612963 - DNA, 21 bp, Homo sapiens
tgtttgggatattaaaacaca

SEQ ID NO: 1612964 - DNA, 23 bp, Homo sapiens
tgtttgggtatcctgcccagtgt

SEQ ID NO: 1612965 - DNA, 14 bp, Homo sapiens
tgtttggtaaatgt

SEQ ID NO: 1612966 - DNA, 16 bp, Homo sapiens
tgtttggttgtaaatg

SEQ ID NO: 1612967 - DNA, 16 bp, Homo sapiens
tgtttggtttcttcat

SEQ ID NO: 1612968 - DNA, 13 bp, Homo sapiens
tgtttgtaaataa

SEQ ID NO: 1612969 - DNA, 14 bp, Homo sapiens
tgtttgtaaatgcc

SEQ ID NO: 1612970 - DNA, 22 bp, Homo sapiens
tgtttgtaaatgcctcttaaat

SEQ ID NO: 1612971 - DNA, 15 bp, Homo sapiens
tgtttgtaaattaat

SEQ ID NO: 1612972 - DNA, 19 bp, Homo sapiens
tgtttgtaaattaatactt

SEQ ID NO: 1612973 - DNA, 19 bp, Homo sapiens
tgtttgtagtcttgtctta

SEQ ID NO: 1612974 - DNA, 14 bp, Homo sapiens
tgtttgtatgaaat

SEQ ID NO: 1612975 - DNA, 15 bp, Homo sapiens
tgtttgtatgaaatt

SEQ ID NO: 1612976 - DNA, 14 bp, Homo sapiens
tgtttgtatgtctg

SEQ ID NO: 1612977 - DNA, 18 bp, Homo sapiens
tgtttgtcacaagtggtg

SEQ ID NO: 1612978 - DNA, 16 bp, Homo sapiens
tgtttgtcagatatga

SEQ ID NO: 1612979 - DNA, 11 bp, Homo sapiens
tgtttgtcagc

SEQ ID NO: 1612980 - DNA, 13 bp, Homo sapiens
tgtttgtcagcat

SEQ ID NO: 1612981 - DNA, 15 bp, Homo sapiens
tgtttgtcccttcta

SEQ ID NO: 1612982 - DNA, 19 bp, Homo sapiens
tgtttgtctgtcttcatag

SEQ ID NO: 1612983 - DNA, 20 bp, Homo sapiens
tgtttgtctgtttgtttcaa

SEQ ID NO: 1612984 - DNA, 17 bp, Homo sapiens
tgtttgtgcagtaactt

SEQ ID NO: 1612985 - DNA, 23 bp, Homo sapiens
tgtttgtgcagtaacttgggagt

SEQ ID NO: 1612986 - DNA, 14 bp, Homo sapiens
tgtttgtggcctca

SEQ ID NO: 1612987 - DNA, 15 bp, Homo sapiens
tgtttgtggcctcag

SEQ ID NO: 1612988 - DNA, 19 bp, Homo sapiens
tgtttgtgttcaatatcag

SEQ ID NO: 1612989 - DNA, 20 bp, Homo sapiens
tgtttgttatttacactggt

SEQ ID NO: 1612990 - DNA, 14 bp, Homo sapiens
tgtttgttcttgtt

SEQ ID NO: 1612991 - DNA, 16 bp, Homo sapiens
tgtttgttcttgtttt

SEQ ID NO: 1612992 - DNA, 15 bp, Homo sapiens
tgtttgttgtagatt

SEQ ID NO: 1612993 - DNA, 18 bp, Homo sapiens
tgttttaaaaaaatttga

SEQ ID NO: 1612994 - DNA, 12 bp, Homo sapiens
tgttttaaaaag

SEQ ID NO: 1612995 - DNA, 18 bp, Homo sapiens
tgttttaaaactggacct

SEQ ID NO: 1612996 - DNA, 22 bp, Homo sapiens
tgttttaaaggaataaacttga

SEQ ID NO: 1612997 - DNA, 22 bp, Homo sapiens
tgttttaaatttatttcaaaaa

SEQ ID NO: 1612998 - DNA, 22 bp, Homo sapiens
tgttttaatttaaacacctcct

SEQ ID NO: 1612999 - DNA, 23 bp, Homo sapiens
tgttttaatttaaacacctcctc

SEQ ID NO: 1613000 - DNA, 14 bp, Homo sapiens
tgttttaccagctc

SEQ ID NO: 1613001 - DNA, 16 bp, Homo sapiens
tgttttactaaagaaa

SEQ ID NO: 1613002 - DNA, 21 bp, Homo sapiens
tgttttactaaagaaagatta

SEQ ID NO: 1613003 - DNA, 18 bp, Homo sapiens
tgttttactgtgaaactg

SEQ ID NO: 1613004 - DNA, 22 bp, Homo sapiens
tgttttagtaaccagaaatctt

SEQ ID NO: 1613005 - DNA, 21 bp, Homo sapiens
tgttttagtgtttatgtttaa

SEQ ID NO: 1613006 - DNA, 21 bp, Homo sapiens
tgttttagtttctgaactctg

SEQ ID NO: 1613007 - DNA, 19 bp, Homo sapiens
tgttttataaaattttgct

SEQ ID NO: 1613008 - DNA, 15 bp, Homo sapiens
tgttttatatacctg

SEQ ID NO: 1613009 - DNA, 12 bp, Homo sapiens
tgttttatgtca

SEQ ID NO: 1613010 - DNA, 14 bp, Homo sapiens
tgttttatgtcata

SEQ ID NO: 1613011 - DNA, 20 bp, Homo sapiens
tgttttatgtcatactctgt

SEQ ID NO: 1613012 - DNA, 16 bp, Homo sapiens
tgttttattttaatag

SEQ ID NO: 1613013 - DNA, 19 bp, Homo sapiens
tgttttcaagtgtaaatga

SEQ ID NO: 1613014 - DNA, 15 bp, Homo sapiens
tgttttcacttgtat

SEQ ID NO: 1613015 - DNA, 15 bp, Homo sapiens
tgttttcagtgtaca

SEQ ID NO: 1613016 - DNA, 12 bp, Homo sapiens
tgttttcatttt

SEQ ID NO: 1613017 - DNA, 13 bp, Homo sapiens
tgttttcatttta

SEQ ID NO: 1613018 - DNA, 19 bp, Homo sapiens
tgttttcattttagacatt

SEQ ID NO: 1613019 - DNA, 18 bp, Homo sapiens
tgttgggagtgaggatgt

SEQ ID NO: 1613020 - DNA, 17 bp, Homo sapiens
tgttgggattcctgacc

SEQ ID NO: 1613021 - DNA, 20 bp, Homo sapiens
tgttggggaagggcctgccc

SEQ ID NO: 1613022 - DNA, 14 bp, Homo sapiens
tgttggtctgtgta

SEQ ID NO: 1613023 - DNA, 23 bp, Homo sapiens
tgttggtgcgaaagtaaaaacac

SEQ ID NO: 1613024 - DNA, 14 bp, Homo sapiens
tgttggttcaaact

SEQ ID NO: 1613025 - DNA, 16 bp, Homo sapiens
tgttggttgttttttc

SEQ ID NO: 1613026 - DNA, 20 bp, Homo sapiens
tgttggttgttttttccttt

SEQ ID NO: 1613027 - DNA, 18 bp, Homo sapiens
tgttgtaacctgctgtga

SEQ ID NO: 1613028 - DNA, 13 bp, Homo sapiens
tgttgtaatgctg

SEQ ID NO: 1613029 - DNA, 15 bp, Homo sapiens
tgttgtaatgctgca

SEQ ID NO: 1613030 - DNA, 22 bp, Homo sapiens
tgttgtacatttcaccatggcc

SEQ ID NO: 1613031 - DNA, 14 bp, Homo sapiens
tgttgtacttgaaa

SEQ ID NO: 1613032 - DNA, 17 bp, Homo sapiens
tgttgtacttgaaaatg

SEQ ID NO: 1613033 - DNA, 15 bp, Homo sapiens
tgttgtatgccttta

SEQ ID NO: 1613034 - DNA, 14 bp, Homo sapiens
tgttgtatttaatt

SEQ ID NO: 1613035 - DNA, 19 bp, Homo sapiens
tgttgtcaaggatggtttt

SEQ ID NO: 1613036 - DNA, 21 bp, Homo sapiens
tgttgtctacattaaatcact

SEQ ID NO: 1613037 - DNA, 15 bp, Homo sapiens
tgttgtctcttgagt

SEQ ID NO: 1613038 - DNA, 12 bp, Homo sapiens
tgttgtcttgaa

SEQ ID NO: 1613039 - DNA, 13 bp, Homo sapiens
tgttgtgaatgtt

SEQ ID NO: 1613040 - DNA, 20 bp, Homo sapiens
tgttgtgccccttcactcat

SEQ ID NO: 1613041 - DNA, 20 bp, Homo sapiens
tgttgtggtactggcaataa

SEQ ID NO: 1613042 - DNA, 22 bp, Homo sapiens
tgttgtgtctgtgccctccaaa

SEQ ID NO: 1613043 - DNA, 14 bp, Homo sapiens
tgttgtgttcctgg

SEQ ID NO: 1613044 - DNA, 17 bp, Homo sapiens
tgttgtgttcctggctg

SEQ ID NO: 1613045 - DNA, 19 bp, Homo sapiens
tgttgtgttcctggctgat

SEQ ID NO: 1613046 - DNA, 15 bp, Homo sapiens
tgttgtgtttgtagt

SEQ ID NO: 1613047 - DNA, 16 bp, Homo sapiens
tgttgtgtttgtagtc

SEQ ID NO: 1613048 - DNA, 18 bp, Homo sapiens
tgttgttaatgaaaatgt

SEQ ID NO: 1613049 - DNA, 14 bp, Homo sapiens
tgttgttccatttt

SEQ ID NO: 1613050 - DNA, 15 bp, Homo sapiens
tgttgttccttttga

SEQ ID NO: 1613051 - DNA, 13 bp, Homo sapiens
tgttgttgctgct

SEQ ID NO: 1613052 - DNA, 15 bp, Homo sapiens
tgttgttgctgctgt

SEQ ID NO: 1613053 - DNA, 15 bp, Homo sapiens
tgttgttgttctttc

SEQ ID NO: 1613054 - DNA, 21 bp, Homo sapiens
tgttgtttgtaaataagagat

SEQ ID NO: 1613055 - DNA, 13 bp, Homo sapiens
tgttgttttacta

SEQ ID NO: 1613056 - DNA, 14 bp, Homo sapiens
tgttgttttgtaca

SEQ ID NO: 1613057 - DNA, 19 bp, Homo sapiens
tgttgttttgtacagatgt

SEQ ID NO: 1613058 - DNA, 12 bp, Homo sapiens
tgtttaaaactt

SEQ ID NO: 1613059 - DNA, 13 bp, Homo sapiens
tgtttaaaatcat

SEQ ID NO: 1613060 - DNA, 18 bp, Homo sapiens
tgtttaaaatcatttctg

SEQ ID NO: 1613061 - DNA, 13 bp, Homo sapiens
tgtttaaaatgta

SEQ ID NO: 1613062 - DNA, 23 bp, Homo sapiens
tgtttaaacacttatcttctgga

SEQ ID NO: 1613063 - DNA, 24 bp, Homo sapiens
tgtttaaacacttatcttctggat

SEQ ID NO: 1613064 - DNA, 21 bp, Homo sapiens
tgtttaaacccaagtgctgca

SEQ ID NO: 1613065 - DNA, 14 bp, Homo sapiens
tgtttaaagaataa

SEQ ID NO: 1613066 - DNA, 16 bp, Homo sapiens
tgtttaaagaataaag

SEQ ID NO: 1613067 - DNA, 18 bp, Homo sapiens
tgtttaaagaataaagtc

SEQ ID NO: 1613068 - DNA, 17 bp, Homo sapiens
tgtttaaatagcctaaa

SEQ ID NO: 1613069 - DNA, 20 bp, Homo sapiens
tgtttaatctgttatgtact

SEQ ID NO: 1613070 - DNA, 12 bp, Homo sapiens
tgtttaatcttt

SEQ ID NO: 1613071 - DNA, 13 bp, Homo sapiens
tgtttaatctttt

SEQ ID NO: 1613072 - DNA, 17 bp, Homo sapiens
tgtttaatgggtatgct

SEQ ID NO: 1613073 - DNA, 18 bp, Homo sapiens
tgtttacactctttgtaa

SEQ ID NO: 1613074 - DNA, 14 bp, Homo sapiens
tgtttacagaggac

SEQ ID NO: 1613075 - DNA, 23 bp, Homo sapiens
tgtttacagcactactctgtgcc

SEQ ID NO: 1613076 - DNA, 18 bp, Homo sapiens
tgtttacagtatgatgaa

SEQ ID NO: 1613077 - DNA, 22 bp, Homo sapiens
tgtttacagtatgatgaaaata

SEQ ID NO: 1613078 - DNA, 12 bp, Homo sapiens
tgtttacatatc

SEQ ID NO: 1613079 - DNA, 15 bp, Homo sapiens
tgtttacctttctct

SEQ ID NO: 1613080 - DNA, 16 bp, Homo sapiens
tgtttacctttctctc

SEQ ID NO: 1613081 - DNA, 20 bp, Homo sapiens
tgtttacgatttcactagga

SEQ ID NO: 1613082 - DNA, 22 bp, Homo sapiens
tgtttacgatttcactaggact

SEQ ID NO: 1613083 - DNA, 17 bp, Homo sapiens
tgtttactatgtgccag

SEQ ID NO: 1613084 - DNA, 15 bp, Homo sapiens
tgtttactgtaaatt

SEQ ID NO: 1613085 - DNA, 18 bp, Homo sapiens
tgtttacttaaagattta

SEQ ID NO: 1613086 - DNA, 17 bp, Homo sapiens
tgtttagagagcctgtc

SEQ ID NO: 1613087 - DNA, 19 bp, Homo sapiens
tgtttataaatcttatgct

SEQ ID NO: 1613088 - DNA, 16 bp, Homo sapiens
tgtttataatgttatc

SEQ ID NO: 1613089 - DNA, 12 bp, Homo sapiens
tgtttatctctg

SEQ ID NO: 1613090 - DNA, 19 bp, Homo sapiens
tgtttatgatatttcttgc

SEQ ID NO: 1613091 - DNA, 23 bp, Homo sapiens
tgtttatgatatttcttgctttc

SEQ ID NO: 1613092 - DNA, 13 bp, Homo sapiens
tgtttatggcctc

SEQ ID NO: 1613093 - DNA, 13 bp, Homo sapiens
tgtttatggtaaa

SEQ ID NO: 1613094 - DNA, 14 bp, Homo sapiens
tgtttatgtaatag

SEQ ID NO: 1613095 - DNA, 13 bp, Homo sapiens
tgtttatgtgtgt

SEQ ID NO: 1613096 - DNA, 16 bp, Homo sapiens
tgtttatgtgtgtgtg

SEQ ID NO: 1613097 - DNA, 15 bp, Homo sapiens
tgtttattaatctta

SEQ ID NO: 1613098 - DNA, 18 bp, Homo sapiens
tgtttattcctgataata

SEQ ID NO: 1613099 - DNA, 14 bp, Homo sapiens
tgtttattcttgat

SEQ ID NO: 1613100 - DNA, 12 bp, Homo sapiens
tgtttattgcaa

SEQ ID NO: 1613101 - DNA, 14 bp, Homo sapiens
tgtttatttaagga

SEQ ID NO: 1613102 - DNA, 17 bp, Homo sapiens
tgtttatttaaggatgg

SEQ ID NO: 1613103 - DNA, 23 bp, Homo sapiens
tgtttatttaaggatggatggca

SEQ ID NO: 1613104 - DNA, 22 bp, Homo sapiens
tgtttatttataagcagattta

SEQ ID NO: 1613105 - DNA, 23 bp, Homo sapiens
tgtttatttataagcagatttaa

SEQ ID NO: 1613106 - DNA, 24 bp, Homo sapiens
tgtttatttatagagtgtacttaa

SEQ ID NO: 1613107 - DNA, 15 bp, Homo sapiens
tgtttatttatcagt

SEQ ID NO: 1613108 - DNA, 20 bp, Homo sapiens
tgtttatttatttccagtgg

SEQ ID NO: 1613109 - DNA, 14 bp, Homo sapiens
tgtttcaaagcaca

SEQ ID NO: 1613110 - DNA, 19 bp, Homo sapiens
tgtttcaagaacctggaaa

SEQ ID NO: 1613111 - DNA, 17 bp, Homo sapiens
tgtttcaagtggggctc

SEQ ID NO: 1613112 - DNA, 21 bp, Homo sapiens
tgtttcaagtggggctcgcca

SEQ ID NO: 1613113 - DNA, 15 bp, Homo sapiens
tgtttcaccagtgtt

SEQ ID NO: 1613114 - DNA, 18 bp, Homo sapiens
tgtttcacgaagtttgtt

SEQ ID NO: 1613115 - DNA, 14 bp, Homo sapiens
tgtttcagaccccc

SEQ ID NO: 1613116 - DNA, 22 bp, Homo sapiens
tgtttcagtgaagatgctgtaa

SEQ ID NO: 1613117 - DNA, 17 bp, Homo sapiens
tgtttcagtgtgagtca

SEQ ID NO: 1613118 - DNA, 22 bp, Homo sapiens
tgtttccaacttgtctgggaat

SEQ ID NO: 1613119 - DNA, 22 bp, Homo sapiens
tgtttccagaattggtaaaaac

SEQ ID NO: 1613120 - DNA, 19 bp, Homo sapiens
tgtttccagctgccaagtg

SEQ ID NO: 1613121 - DNA, 19 bp, Homo sapiens
tgtttccatattttatagg

SEQ ID NO: 1613122 - DNA, 15 bp, Homo sapiens
tgtttccatttctca

SEQ ID NO: 1613123 - DNA, 14 bp, Homo sapiens
tgtttcccataatt

SEQ ID NO: 1613124 - DNA, 15 bp, Homo sapiens
tgtttccctgctgaa

SEQ ID NO: 1613125 - DNA, 21 bp, Homo sapiens
tgtttcgctgatatatgtgtt

SEQ ID NO: 1613126 - DNA, 19 bp, Homo sapiens
tgtttcgtgaagtatactg

SEQ ID NO: 1613127 - DNA, 20 bp, Homo sapiens
tgtttcgtgaagtatactgt

SEQ ID NO: 1613128 - DNA, 22 bp, Homo sapiens
tgtttctaaggtaacaagatga

SEQ ID NO: 1613129 - DNA, 14 bp, Homo sapiens
tgtttctagaacag

SEQ ID NO: 1613130 - DNA, 22 bp, Homo sapiens
tgttcctcggtgggccagagct

SEQ ID NO: 1613131 - DNA, 24 bp, Homo sapiens
tgttcctcggtgggccagagctga

SEQ ID NO: 1613132 - DNA, 18 bp, Homo sapiens
tgttcctctatactttgt

SEQ ID NO: 1613133 - DNA, 18 bp, Homo sapiens
tgttcctgctcttcccag

SEQ ID NO: 1613134 - DNA, 11 bp, Homo sapiens
tgttcctgctg

SEQ ID NO: 1613135 - DNA, 13 bp, Homo sapiens
tgttcctgctgta

SEQ ID NO: 1613136 - DNA, 20 bp, Homo sapiens
tgttcctggcccactctgta

SEQ ID NO: 1613137 - DNA, 19 bp, Homo sapiens
tgttccttagaccttccat

SEQ ID NO: 1613138 - DNA, 17 bp, Homo sapiens
tgttcctttctctgggc

SEQ ID NO: 1613139 - DNA, 19 bp, Homo sapiens
tgttcgttggttatacaag

SEQ ID NO: 1613140 - DNA, 17 bp, Homo sapiens
tgttcgtttccatcatg

SEQ ID NO: 1613141 - DNA, 22 bp, Homo sapiens
tgttcgtttccatcatgtctgt

SEQ ID NO: 1613142 - DNA, 14 bp, Homo sapiens
tgttctaaagctct

SEQ ID NO: 1613143 - DNA, 19 bp, Homo sapiens
tgttctaagcaatgcaaat

SEQ ID NO: 1613144 - DNA, 17 bp, Homo sapiens
tgttctaagtttctaag

SEQ ID NO: 1613145 - DNA, 16 bp, Homo sapiens
tgttctacatgaggac

SEQ ID NO: 1613146 - DNA, 11 bp, Homo sapiens
tgttctagact

SEQ ID NO: 1613147 - DNA, 17 bp, Homo sapiens
tgttctagacttcccca

SEQ ID NO: 1613148 - DNA, 19 bp, Homo sapiens
tgttctagacttccccatc

SEQ ID NO: 1613149 - DNA, 13 bp, Homo sapiens
tgttctcacacca

SEQ ID NO: 1613150 - DNA, 22 bp, Homo sapiens
tgttctcagaatcccttaacag

SEQ ID NO: 1613151 - DNA, 18 bp, Homo sapiens
tgttctcctgtccctcca

SEQ ID NO: 1613152 - DNA, 18 bp, Homo sapiens
tgttctcggagtgtgtat

SEQ ID NO: 1613153 - DNA, 11 bp, Homo sapiens
tgttctctaga

SEQ ID NO: 1613154 - DNA, 22 bp, Homo sapiens
tgttctctgcttgacagactca

SEQ ID NO: 1613155 - DNA, 15 bp, Homo sapiens
tgttctctgggagaa

SEQ ID NO: 1613156 - DNA, 16 bp, Homo sapiens
tgttctcttggctgca

SEQ ID NO: 1613157 - DNA, 16 bp, Homo sapiens
tgttctctttaaaata

SEQ ID NO: 1613158 - DNA, 15 bp, Homo sapiens
tgttctgcactgaaa

SEQ ID NO: 1613159 - DNA, 20 bp, Homo sapiens
tgttctgcatggattcagca

SEQ ID NO: 1613160 - DNA, 19 bp, Homo sapiens
tgttctgcgctgtgtacaa

SEQ ID NO: 1613161 - DNA, 13 bp, Homo sapiens
tgttctgctcctg

SEQ ID NO: 1613162 - DNA, 15 bp, Homo sapiens
tgttctgctcctgct

SEQ ID NO: 1613163 - DNA, 14 bp, Homo sapiens
tgttctgtcttccc

SEQ ID NO: 1613164 - DNA, 17 bp, Homo sapiens
tgttctgtcttcccaaa

SEQ ID NO: 1613165 - DNA, 18 bp, Homo sapiens
tgttctgtcttcccaaac

SEQ ID NO: 1613166 - DNA, 23 bp, Homo sapiens
tgttctgtggttcctctgctcac

SEQ ID NO: 1613167 - DNA, 14 bp, Homo sapiens
tgttctgtttcaag

SEQ ID NO: 1613168 - DNA, 16 bp, Homo sapiens
tgttctgtttgaaact

SEQ ID NO: 1613169 - DNA, 21 bp, Homo sapiens
tgttctgtttggcacttgtat

SEQ ID NO: 1613170 - DNA, 17 bp, Homo sapiens
tgttctgtttgttaaaa

SEQ ID NO: 1613171 - DNA, 19 bp, Homo sapiens
tgttctgtttgttattgtt

SEQ ID NO: 1613172 - DNA, 21 bp, Homo sapiens
tgttcttactgtaactacttc

SEQ ID NO: 1613173 - DNA, 20 bp, Homo sapiens
tgttcttagcaataaatgct

SEQ ID NO: 1613174 - DNA, 22 bp, Homo sapiens
tgttcttaggtttactgtgaag

SEQ ID NO: 1613175 - DNA, 18 bp, Homo sapiens
tgttcttagtttgcagtt

SEQ ID NO: 1613176 - DNA, 20 bp, Homo sapiens
tgttcttcaactcctgggct

SEQ ID NO: 1613177 - DNA, 12 bp, Homo sapiens
tgttcttcagtg

SEQ ID NO: 1613178 - DNA, 12 bp, Homo sapiens
tgttcttcttgg

SEQ ID NO: 1613179 - DNA, 14 bp, Homo sapiens
tgttcttcttggga

SEQ ID NO: 1613180 - DNA, 19 bp, Homo sapiens
tgttcttgccactgcactc

SEQ ID NO: 1613181 - DNA, 13 bp, Homo sapiens
tgttcttgtattt

SEQ ID NO: 1613182 - DNA, 15 bp, Homo sapiens
tgttctttccggcca

SEQ ID NO: 1613183 - DNA, 15 bp, Homo sapiens
tgttctttcctcaca

SEQ ID NO: 1613184 - DNA, 20 bp, Homo sapiens
tgttcttttaaatgattgaa

SEQ ID NO: 1613185 - DNA, 21 bp, Homo sapiens
tgttcttttctcctttaccag

SEQ ID NO: 1613186 - DNA, 14 bp, Homo sapiens
tgttgaaaatgttc

SEQ ID NO: 1613187 - DNA, 11 bp, Homo sapiens
tgttgaaagat

SEQ ID NO: 1613188 - DNA, 14 bp, Homo sapiens
tgttgaaattatgt

SEQ ID NO: 1613189 - DNA, 21 bp, Homo sapiens
tgttgaaattatgtatgttta

SEQ ID NO: 1613190 - DNA, 14 bp, Homo sapiens
tgttgaactgttag

SEQ ID NO: 1613191 - DNA, 20 bp, Homo sapiens
tgttgaagaaaaaagcttat

SEQ ID NO: 1613192 - DNA, 17 bp, Homo sapiens
tgttgaagggaggtggc

SEQ ID NO: 1613193 - DNA, 17 bp, Homo sapiens
tgttgaattggtgaata

SEQ ID NO: 1613194 - DNA, 18 bp, Homo sapiens
tgttgaattggtgaataa

SEQ ID NO: 1613195 - DNA, 18 bp, Homo sapiens
tgttgacaactgtgactg

SEQ ID NO: 1613196 - DNA, 14 bp, Homo sapiens
tgttgactgtgatt

SEQ ID NO: 1613197 - DNA, 14 bp, Homo sapiens
tgttgagatgtgct

SEQ ID NO: 1613198 - DNA, 19 bp, Homo sapiens
tgttgagatgtgctttgct

SEQ ID NO: 1613199 - DNA, 19 bp, Homo sapiens
tgttgaggttaagtttctc

SEQ ID NO: 1613200 - DNA, 14 bp, Homo sapiens
tgttgagtgttcat

SEQ ID NO: 1613201 - DNA, 22 bp, Homo sapiens
tgttgagttagttaagttgggt

SEQ ID NO: 1613202 - DNA, 18 bp, Homo sapiens
tgttgatagtgatgtatt

SEQ ID NO: 1613203 - DNA, 23 bp, Homo sapiens
tgttgatcatgtactttttagta

SEQ ID NO: 1613204 - DNA, 22 bp, Homo sapiens
tgttgatcccacttcactgtga

SEQ ID NO: 1613205 - DNA, 16 bp, Homo sapiens
tgttgattattagcca

SEQ ID NO: 1613206 - DNA, 21 bp, Homo sapiens
tgttgcaaactcagttccaaa

SEQ ID NO: 1613207 - DNA, 16 bp, Homo sapiens
tgttgcaaattattct

SEQ ID NO: 1613208 - DNA, 17 bp, Homo sapiens
tgttgcaccatctgctt

SEQ ID NO: 1613209 - DNA, 17 bp, Homo sapiens
tgttgcagagatttcct

SEQ ID NO: 1613210 - DNA, 18 bp, Homo sapiens
tgttgcagtggcctggcc

SEQ ID NO: 1613211 - DNA, 19 bp, Homo sapiens
tgttgcagtggcctggccg

SEQ ID NO: 1613212 - DNA, 18 bp, Homo sapiens
tgttgccaggttgcagct

SEQ ID NO: 1613213 - DNA, 19 bp, Homo sapiens
tgttgccaggttgcagctg

SEQ ID NO: 1613214 - DNA, 14 bp, Homo sapiens
tgttgccatgtgtt

SEQ ID NO: 1613215 - DNA, 17 bp, Homo sapiens
tgttgccatttctctgc

SEQ ID NO: 1613216 - DNA, 18 bp, Homo sapiens
tgttgccatttctctgct

SEQ ID NO: 1613217 - DNA, 19 bp, Homo sapiens
tgttgccatttctctgctt

SEQ ID NO: 1613218 - DNA, 11 bp, Homo sapiens
tgttgccccag

SEQ ID NO: 1613219 - DNA, 21 bp, Homo sapiens
tgttgcccctttctcttttcc

SEQ ID NO: 1613220 - DNA, 23 bp, Homo sapiens
tgttgctcagcaaggggctctgc

SEQ ID NO: 1613221 - DNA, 20 bp, Homo sapiens
tgttgctctaggaagacatt

SEQ ID NO: 1613222 - DNA, 16 bp, Homo sapiens
tgttgctgattttatt

SEQ ID NO: 1613223 - DNA, 13 bp, Homo sapiens
tgttgctgccaac

SEQ ID NO: 1613224 - DNA, 14 bp, Homo sapiens
tgttgctgccaacc

SEQ ID NO: 1613225 - DNA, 18 bp, Homo sapiens
tgttgctgctactgtctt

SEQ ID NO: 1613226 - DNA, 22 bp, Homo sapiens
tgttgctgctactgtcttacta

SEQ ID NO: 1613227 - DNA, 13 bp, Homo sapiens
tgttgctgctgtt

SEQ ID NO: 1613228 - DNA, 23 bp, Homo sapiens
tgttgcttagatgagggtgactg

SEQ ID NO: 1613229 - DNA, 20 bp, Homo sapiens
tgttgcttatgttgttttgt

SEQ ID NO: 1613230 - DNA, 16 bp, Homo sapiens
tgttgcttctcaggct

SEQ ID NO: 1613231 - DNA, 14 bp, Homo sapiens
tgttgctttacagt

SEQ ID NO: 1613232 - DNA, 13 bp, Homo sapiens
tgttggaaaagaa

SEQ ID NO: 1613233 - DNA, 22 bp, Homo sapiens
tgttggaagaaaagaatcacag

SEQ ID NO: 1613234 - DNA, 16 bp, Homo sapiens
tgttggacagctgctt

SEQ ID NO: 1613235 - DNA, 13 bp, Homo sapiens
tgttggagtgagg

SEQ ID NO: 1613236 - DNA, 16 bp, Homo sapiens
tgttggagtgtttcta

SEQ ID NO: 1613237 - DNA, 20 bp, Homo sapiens
tgttggataaatcagtggtt

SEQ ID NO: 1613238 - DNA, 18 bp, Homo sapiens
tgttggcacatgcctgta

SEQ ID NO: 1613239 - DNA, 23 bp, Homo sapiens
tgttggcactcacagacctggag

SEQ ID NO: 1613240 - DNA, 12 bp, Homo sapiens
tgttggcaggct

SEQ ID NO: 1613241 - DNA, 23 bp, Homo sapiens
tgttggccaggctggtctaaaac

SEQ ID NO: 1613242 - DNA, 13 bp, Homo sapiens
tgttggctgctgc

SEQ ID NO: 1613243 - DNA, 14 bp, Homo sapiens
tgttgggaaaggaa

SEQ ID NO: 1613244 - DNA, 13 bp, Homo sapiens
tgttgggacctgc

SEQ ID NO: 1613245 - DNA, 17 bp, Homo sapiens
tgttgggacctgctgct

SEQ ID NO: 1613246 - DNA, 15 bp, Homo sapiens
tgttgggagaaagca

SEQ ID NO: 1613247 - DNA, 20 bp, Homo sapiens
tgttagaagaagaggaagaa

SEQ ID NO: 1613248 - DNA, 22 bp, Homo sapiens
tgttagaggttttaaagtgatt

SEQ ID NO: 1613249 - DNA, 23 bp, Homo sapiens
tgttagatatttttcataaacaa

SEQ ID NO: 1613250 - DNA, 19 bp, Homo sapiens
tgttagattttgcattttt

SEQ ID NO: 1613251 - DNA, 15 bp, Homo sapiens
tgttagcccttcaga

SEQ ID NO: 1613252 - DNA, 20 bp, Homo sapiens
tgttagcccttcagattgtt

SEQ ID NO: 1613253 - DNA, 16 bp, Homo sapiens
tgttagctacacagtg

SEQ ID NO: 1613254 - DNA, 15 bp, Homo sapiens
tgttagcttttacct

SEQ ID NO: 1613255 - DNA, 16 bp, Homo sapiens
tgttaggaaaatttca

SEQ ID NO: 1613256 - DNA, 21 bp, Homo sapiens
tgttaggattttcacattctt

SEQ ID NO: 1613257 - DNA, 20 bp, Homo sapiens
tgttaggcatgtcccaccca

SEQ ID NO: 1613258 - DNA, 19 bp, Homo sapiens
tgttagggctgcttttctt

SEQ ID NO: 1613259 - DNA, 12 bp, Homo sapiens
tgttagggtcag

SEQ ID NO: 1613260 - DNA, 13 bp, Homo sapiens
tgttagggtcagc

SEQ ID NO: 1613261 - DNA, 15 bp, Homo sapiens
tgttagggtcagcca

SEQ ID NO: 1613262 - DNA, 15 bp, Homo sapiens
tgttagtaaaggggc

SEQ ID NO: 1613263 - DNA, 20 bp, Homo sapiens
tgttagtagaaattttacaa

SEQ ID NO: 1613264 - DNA, 16 bp, Homo sapiens
tgttagtgctggtcag

SEQ ID NO: 1613265 - DNA, 17 bp, Homo sapiens
tgttagtgctggtcaga

SEQ ID NO: 1613266 - DNA, 17 bp, Homo sapiens
tgttagtggacttgttt

SEQ ID NO: 1613267 - DNA, 14 bp, Homo sapiens
tgttagtggcaccg

SEQ ID NO: 1613268 - DNA, 15 bp, Homo sapiens
tgttagtgtgtgtgc

SEQ ID NO: 1613269 - DNA, 18 bp, Homo sapiens
tgttagtgtgtgtgcatg

SEQ ID NO: 1613270 - DNA, 19 bp, Homo sapiens
tgttagtgtgtgtgcatgt

SEQ ID NO: 1613271 - DNA, 17 bp, Homo sapiens
tgttagttatagatgtc

SEQ ID NO: 1613272 - DNA, 23 bp, Homo sapiens
tgttagtttagtgtgtgtgcaga

SEQ ID NO: 1613273 - DNA, 14 bp, Homo sapiens
tgttataactctgc

SEQ ID NO: 1613274 - DNA, 15 bp, Homo sapiens
tgttatacaaggcaa

SEQ ID NO: 1613275 - DNA, 18 bp, Homo sapiens
tgttataggttgttggat

SEQ ID NO: 1613276 - DNA, 13 bp, Homo sapiens
tgttatatataat

SEQ ID NO: 1613277 - DNA, 18 bp, Homo sapiens
tgttatatataataaata

SEQ ID NO: 1613278 - DNA, 13 bp, Homo sapiens
tgttatcattttt

SEQ ID NO: 1613279 - DNA, 18 bp, Homo sapiens
tgttatcattttttcctg

SEQ ID NO: 1613280 - DNA, 19 bp, Homo sapiens
tgttatccttttttaaaag

SEQ ID NO: 1613281 - DNA, 19 bp, Homo sapiens
tgttatcggctctattctc

SEQ ID NO: 1613282 - DNA, 21 bp, Homo sapiens
tgttatcggctctattctcta

SEQ ID NO: 1613283 - DNA, 22 bp, Homo sapiens
tgttatcggctctattctctaa

SEQ ID NO: 1613284 - DNA, 15 bp, Homo sapiens
tgttatctcttgtta

SEQ ID NO: 1613285 - DNA, 23 bp, Homo sapiens
tgttatcttctcaagttctaaga

SEQ ID NO: 1613286 - DNA, 13 bp, Homo sapiens
tgttatgaacagc

SEQ ID NO: 1613287 - DNA, 16 bp, Homo sapiens
tgttatgcactgtggt

SEQ ID NO: 1613288 - DNA, 15 bp, Homo sapiens
tgttatgctgtgaca

SEQ ID NO: 1613289 - DNA, 17 bp, Homo sapiens
tgttatgtccagaaatt

SEQ ID NO: 1613290 - DNA, 20 bp, Homo sapiens
tgttattactgttttgggcc

SEQ ID NO: 1613291 - DNA, 16 bp, Homo sapiens
tgttattatctgggct

SEQ ID NO: 1613292 - DNA, 13 bp, Homo sapiens
tgttattctttgc

SEQ ID NO: 1613293 - DNA, 14 bp, Homo sapiens
tgttattctttgca

SEQ ID NO: 1613294 - DNA, 22 bp, Homo sapiens
tgttattgggcaagtgattgaa

SEQ ID NO: 1613295 - DNA, 13 bp, Homo sapiens
tgttattgtggaa

SEQ ID NO: 1613296 - DNA, 22 bp, Homo sapiens
tgttattgttttgttaattaca

SEQ ID NO: 1613297 - DNA, 14 bp, Homo sapiens
tgttatttaaagaa

SEQ ID NO: 1613298 - DNA, 14 bp, Homo sapiens
tgttatttcttccc

SEQ ID NO: 1613299 - DNA, 16 bp, Homo sapiens
tgttatttcttccctg

SEQ ID NO: 1613300 - DNA, 18 bp, Homo sapiens
tgttattttctgttgaag

SEQ ID NO: 1613301 - DNA, 22 bp, Homo sapiens
tgttatttttacagcaaaagat

SEQ ID NO: 1613302 - DNA, 23 bp, Homo sapiens
tgttatttttacagcaaaagatg

SEQ ID NO: 1613303 - DNA, 22 bp, Homo sapiens
tgttatttttatatcagcctga

SEQ ID NO: 1613304 - DNA, 18 bp, Homo sapiens
tgttattttttaattatt

SEQ ID NO: 1613305 - DNA, 19 bp, Homo sapiens
tgttcaaaaaaacactagt

SEQ ID NO: 1613306 - DNA, 20 bp, Homo sapiens
tgttcaaagactgtgaacag

SEQ ID NO: 1613307 - DNA, 18 bp, Homo sapiens
tgttcaaagccacattat

SEQ ID NO: 1613308 - DNA, 20 bp, Homo sapiens
tgttcaaagccacattattt

SEQ ID NO: 1613309 - DNA, 18 bp, Homo sapiens
tgttcaagaaataaaaat

SEQ ID NO: 1613310 - DNA, 15 bp, Homo sapiens
tgttcaatattttct

SEQ ID NO: 1613311 - DNA, 16 bp, Homo sapiens
tgttcaatgcaaagta

SEQ ID NO: 1613312 - DNA, 16 bp, Homo sapiens
tgttcaatgttccatt

SEQ ID NO: 1613313 - DNA, 20 bp, Homo sapiens
tgttcacagtctctggaaaa

SEQ ID NO: 1613314 - DNA, 20 bp, Homo sapiens
tgttcaccttcaaaatgttc

SEQ ID NO: 1613315 - DNA, 22 bp, Homo sapiens
tgttcagaagaaattctgtcat

SEQ ID NO: 1613316 - DNA, 17 bp, Homo sapiens
tgttcagatgtgcattt

SEQ ID NO: 1613317 - DNA, 16 bp, Homo sapiens
tgttcagattaaaaaa

SEQ ID NO: 1613318 - DNA, 14 bp, Homo sapiens
tgttcagcactgtc

SEQ ID NO: 1613319 - DNA, 15 bp, Homo sapiens
tgttcagcactgtcc

SEQ ID NO: 1613320 - DNA, 17 bp, Homo sapiens
tgttcagcactgtccct

SEQ ID NO: 1613321 - DNA, 14 bp, Homo sapiens
tgttcagcagaacc

SEQ ID NO: 1613322 - DNA, 18 bp, Homo sapiens
tgttcagcagaacctgca

SEQ ID NO: 1613323 - DNA, 22 bp, Homo sapiens
tgttcagcagaacctgcacaca

SEQ ID NO: 1613324 - DNA, 18 bp, Homo sapiens
tgttcagctctttccaaa

SEQ ID NO: 1613325 - DNA, 20 bp, Homo sapiens
tgttcagctctttccaaatt

SEQ ID NO: 1613326 - DNA, 23 bp, Homo sapiens
tgttcaggaaaaggttgaataat

SEQ ID NO: 1613327 - DNA, 12 bp, Homo sapiens
tgttcatacata

SEQ ID NO: 1613328 - DNA, 15 bp, Homo sapiens
tgttcatagcccagt

SEQ ID NO: 1613329 - DNA, 22 bp, Homo sapiens
tgttcatatgtacttgtttgct

SEQ ID NO: 1613330 - DNA, 22 bp, Homo sapiens
tgttcatcctcattgcctcctg

SEQ ID NO: 1613331 - DNA, 21 bp, Homo sapiens
tgttcatctgtaactctaaaa

SEQ ID NO: 1613332 - DNA, 17 bp, Homo sapiens
tgttcattataatctca

SEQ ID NO: 1613333 - DNA, 19 bp, Homo sapiens
tgttcattataatctcaaa

SEQ ID NO: 1613334 - DNA, 18 bp, Homo sapiens
tgttcattcaagctattt

SEQ ID NO: 1613335 - DNA, 22 bp, Homo sapiens
tgttcatttagattgaaaactt

SEQ ID NO: 1613336 - DNA, 20 bp, Homo sapiens
tgttcatttggtgttcctgg

SEQ ID NO: 1613337 - DNA, 21 bp, Homo sapiens
tgttcatttggtgttcctgga

SEQ ID NO: 1613338 - DNA, 17 bp, Homo sapiens
tgttccaaaccctcctg

SEQ ID NO: 1613339 - DNA, 22 bp, Homo sapiens
tgttccaacctcctgctctggg

SEQ ID NO: 1613340 - DNA, 20 bp, Homo sapiens
tgttccacaagttaaataaa

SEQ ID NO: 1613341 - DNA, 16 bp, Homo sapiens
tgttccacttgtttgc

SEQ ID NO: 1613342 - DNA, 14 bp, Homo sapiens
tgttccagctcttt

SEQ ID NO: 1613343 - DNA, 21 bp, Homo sapiens
tgttccattgaagccgactct

SEQ ID NO: 1613344 - DNA, 16 bp, Homo sapiens
tgttccattttatgca

SEQ ID NO: 1613345 - DNA, 19 bp, Homo sapiens
tgttccattttatgcagaa

SEQ ID NO: 1613346 - DNA, 19 bp, Homo sapiens
tgttcccaagtaggcattc

SEQ ID NO: 1613347 - DNA, 12 bp, Homo sapiens
tgttcccagaaa

SEQ ID NO: 1613348 - DNA, 15 bp, Homo sapiens
tgttcccagcagtgg

SEQ ID NO: 1613349 - DNA, 20 bp, Homo sapiens
tgttcccatgtagccccctg

SEQ ID NO: 1613350 - DNA, 14 bp, Homo sapiens
tgttccccagagaa

SEQ ID NO: 1613351 - DNA, 17 bp, Homo sapiens
tgttcccccagcctgcc

SEQ ID NO: 1613352 - DNA, 23 bp, Homo sapiens
tgttcccctcctccactctcccc

SEQ ID NO: 1613353 - DNA, 11 bp, Homo sapiens
tgttccctaga

SEQ ID NO: 1613354 - DNA, 19 bp, Homo sapiens
tgttccctagagagaataa

SEQ ID NO: 1613355 - DNA, 12 bp, Homo sapiens
tgttccctctgg

SEQ ID NO: 1613356 - DNA, 12 bp, Homo sapiens
tgttccctgcac

SEQ ID NO: 1613357 - DNA, 14 bp, Homo sapiens
tgttcccttcctct

SEQ ID NO: 1613358 - DNA, 21 bp, Homo sapiens
tgttcccttcctcttcctgcc

SEQ ID NO: 1613359 - DNA, 17 bp, Homo sapiens
tgttcctaacaaaatga

SEQ ID NO: 1613360 - DNA, 15 bp, Homo sapiens
tgttcctacgggctt

SEQ ID NO: 1613361 - DNA, 14 bp, Homo sapiens
tgttcctagtgaaa

SEQ ID NO: 1613362 - DNA, 19 bp, Homo sapiens
tgttcctcggtgggccaga

SEQ ID NO: 1613363 - DNA, 15 bp, Homo sapiens
tgtcatactctgtgt

SEQ ID NO: 1613364 - DNA, 20 bp, Homo sapiens
tgtcatactctgtgtaatct

SEQ ID NO: 1613365 - DNA, 22 bp, Homo sapiens
tgtcatagaaagtgccagaaag

SEQ ID NO: 1613366 - DNA, 23 bp, Homo sapiens
tgtcatagccaaagccaggcctg

SEQ ID NO: 1613367 - DNA, 16 bp, Homo sapiens
tgtcatagtcttgaaa

SEQ ID NO: 1613368 - DNA, 20 bp, Homo sapiens
tgtcatagtcttgaaatgaa

SEQ ID NO: 1613369 - DNA, 18 bp, Homo sapiens
tgtcatatagctggttat

SEQ ID NO: 1613370 - DNA, 15 bp, Homo sapiens
tgtcatcagccacca

SEQ ID NO: 1613371 - DNA, 22 bp, Homo sapiens
tgtcatccacacaacaccagga

SEQ ID NO: 1613372 - DNA, 22 bp, Homo sapiens
tgtcatccacctgtcttggcct

SEQ ID NO: 1613373 - DNA, 16 bp, Homo sapiens
tgtcatcctcaaagaa

SEQ ID NO: 1613374 - DNA, 14 bp, Homo sapiens
tgtcatctctctgc

SEQ ID NO: 1613375 - DNA, 13 bp, Homo sapiens
tgtcatctgagga

SEQ ID NO: 1613376 - DNA, 14 bp, Homo sapiens
tgtcatctgaggag

SEQ ID NO: 1613377 - DNA, 20 bp, Homo sapiens
tgtcatgaagaatgtttctg

SEQ ID NO: 1613378 - DNA, 14 bp, Homo sapiens
tgtcatgcccccct

SEQ ID NO: 1613379 - DNA, 23 bp, Homo sapiens
tgtcatgcccccctcaaacctcc

SEQ ID NO: 1613380 - DNA, 17 bp, Homo sapiens
tgtcatgtaccatcaat

SEQ ID NO: 1613381 - DNA, 18 bp, Homo sapiens
tgtcatgtacttcctgtg

SEQ ID NO: 1613382 - DNA, 19 bp, Homo sapiens
tgtcatgtaggttgtctaa

SEQ ID NO: 1613383 - DNA, 21 bp, Homo sapiens
tgtcatgtaggttgtctaaaa

SEQ ID NO: 1613384 - DNA, 11 bp, Homo sapiens
tgtcatgtgta

SEQ ID NO: 1613385 - DNA, 23 bp, Homo sapiens
tgtcattaaatggggctcacaaa

SEQ ID NO: 1613386 - DNA, 23 bp, Homo sapiens
tgtcattatttttgttagcaaag

SEQ ID NO: 1613387 - DNA, 18 bp, Homo sapiens
tgtcattcccctttgcac

SEQ ID NO: 1613388 - DNA, 13 bp, Homo sapiens
tgtcattgctaaa

SEQ ID NO: 1613389 - DNA, 14 bp, Homo sapiens
tgtcattgctaaaa

SEQ ID NO: 1613390 - DNA, 21 bp, Homo sapiens
tgtcattgtctactcctagaa

SEQ ID NO: 1613391 - DNA, 15 bp, Homo sapiens
tgtcattttgcactg

SEQ ID NO: 1613392 - DNA, 17 bp, Homo sapiens
tgtcattttgcactgta

SEQ ID NO: 1613393 - DNA, 14 bp, Homo sapiens
tgtcatttttaata

SEQ ID NO: 1613394 - DNA, 22 bp, Homo sapiens
tgtcatttttaatattactgtc

SEQ ID NO: 1613395 - DNA, 16 bp, Homo sapiens
tgtccaaaactgcctc

SEQ ID NO: 1613396 - DNA, 20 bp, Homo sapiens
tgtccaaataaattcaataa

SEQ ID NO: 1613397 - DNA, 13 bp, Homo sapiens
tgtccaacaataa

SEQ ID NO: 1613398 - DNA, 23 bp, Homo sapiens
tgtccaacatggtgaaaccccca

SEQ ID NO: 1613399 - DNA, 21 bp, Homo sapiens
tgtccaacctaacccctttcc

SEQ ID NO: 1613400 - DNA, 20 bp, Homo sapiens
tgtccacatccccagagccc

SEQ ID NO: 1613401 - DNA, 22 bp, Homo sapiens
tgtccaccctcatttctgccag

SEQ ID NO: 1613402 - DNA, 23 bp, Homo sapiens
tgtccaccctcatttctgccagc

SEQ ID NO: 1613403 - DNA, 11 bp, Homo sapiens
tgtccacctgg

SEQ ID NO: 1613404 - DNA, 15 bp, Homo sapiens
tgtccacctggcccc

SEQ ID NO: 1613405 - DNA, 21 bp, Homo sapiens
tgtccactctcggggcccttg

SEQ ID NO: 1613406 - DNA, 13 bp, Homo sapiens
tgtccactgagac

SEQ ID NO: 1613407 - DNA, 22 bp, Homo sapiens
tgtccactgagactttcccctc

SEQ ID NO: 1613408 - DNA, 16 bp, Homo sapiens
tgtccagaagaatatt

SEQ ID NO: 1613409 - DNA, 20 bp, Homo sapiens
tgtccagagacatgggcctc

SEQ ID NO: 1613410 - DNA, 16 bp, Homo sapiens
tgtccagcacagaagg

SEQ ID NO: 1613411 - DNA, 21 bp, Homo sapiens
tgtccagcacagaaggaatct

SEQ ID NO: 1613412 - DNA, 15 bp, Homo sapiens
tgtccagcaccttgt

SEQ ID NO: 1613413 - DNA, 14 bp, Homo sapiens
tgtccagcagctgc

SEQ ID NO: 1613414 - DNA, 11 bp, Homo sapiens
tgtccagctcc

SEQ ID NO: 1613415 - DNA, 17 bp, Homo sapiens
tgtccagctcccgctgt

SEQ ID NO: 1613416 - DNA, 21 bp, Homo sapiens
tgtccaggagctaatctgacc

SEQ ID NO: 1613417 - DNA, 12 bp, Homo sapiens
tgtccaggcagc

SEQ ID NO: 1613418 - DNA, 13 bp, Homo sapiens
tgtccaggcagct

SEQ ID NO: 1613419 - DNA, 17 bp, Homo sapiens
tgtccaggcagctccct

SEQ ID NO: 1613420 - DNA, 23 bp, Homo sapiens
tgtccaggcagctccctcctgca

SEQ ID NO: 1613421 - DNA, 14 bp, Homo sapiens
tgtccaggccactg

SEQ ID NO: 1613422 - DNA, 21 bp, Homo sapiens
tgtccaggccactgtggccag

SEQ ID NO: 1613423 - DNA, 17 bp, Homo sapiens
tgtccagggccctgagc

SEQ ID NO: 1613424 - DNA, 19 bp, Homo sapiens
tgtccagggccctgagctc

SEQ ID NO: 1613425 - DNA, 19 bp, Homo sapiens
tgtccatcagattctgtga

SEQ ID NO: 1613426 - DNA, 14 bp, Homo sapiens
tgtccatgtgaaat

SEQ ID NO: 1613427 - DNA, 16 bp, Homo sapiens
tgtccatttgtcccaa

SEQ ID NO: 1613428 - DNA, 16 bp, Homo sapiens
tgtcccaaggagctga

SEQ ID NO: 1613429 - DNA, 15 bp, Homo sapiens
tgtcccacaaaatat

SEQ ID NO: 1613430 - DNA, 22 bp, Homo sapiens
tgtcccaccaactctgcactcc

SEQ ID NO: 1613431 - DNA, 20 bp, Homo sapiens
tgtcccacccacacagctgc

SEQ ID NO: 1613432 - DNA, 16 bp, Homo sapiens
tgtcccagatgctgtc

SEQ ID NO: 1613433 - DNA, 18 bp, Homo sapiens
tgtcccagatgctgtcat

SEQ ID NO: 1613434 - DNA, 22 bp, Homo sapiens
tgtcccagatgctgtcattagt

SEQ ID NO: 1613435 - DNA, 12 bp, Homo sapiens
tgtcccagccac

SEQ ID NO: 1613436 - DNA, 15 bp, Homo sapiens
tgtcccagcctgggg

SEQ ID NO: 1613437 - DNA, 17 bp, Homo sapiens
tgtcccagcctggggct

SEQ ID NO: 1613438 - DNA, 21 bp, Homo sapiens
tgtcccagctaccaagtcaga

SEQ ID NO: 1613439 - DNA, 17 bp, Homo sapiens
tgtcccaggcagggaga

SEQ ID NO: 1613440 - DNA, 14 bp, Homo sapiens
tgtcccagggccct

SEQ ID NO: 1613441 - DNA, 18 bp, Homo sapiens
tgtcccagggccctccca

SEQ ID NO: 1613442 - DNA, 20 bp, Homo sapiens
tgtcccagggccctcccagc

SEQ ID NO: 1613443 - DNA, 21 bp, Homo sapiens
tgtcccagggccctcccagcc

SEQ ID NO: 1613444 - DNA, 23 bp, Homo sapiens
tgtcccagtagccaaggcccggg

SEQ ID NO: 1613445 - DNA, 16 bp, Homo sapiens
tgtcccatgacccacc

SEQ ID NO: 1613446 - DNA, 18 bp, Homo sapiens
tgtcccatgatccctgtg

SEQ ID NO: 1613447 - DNA, 23 bp, Homo sapiens
tgtcccatggggaaaccctggag

SEQ ID NO: 1613448 - DNA, 16 bp, Homo sapiens
tgtcccattctagatc

SEQ ID NO: 1613449 - DNA, 23 bp, Homo sapiens
tgtcccattctagatcctgcacc

SEQ ID NO: 1613450 - DNA, 23 bp, Homo sapiens
tgtcccatttccttggaggccac

SEQ ID NO: 1613451 - DNA, 18 bp, Homo sapiens
tgtccccaacgtcccctc

SEQ ID NO: 1613452 - DNA, 17 bp, Homo sapiens
tgtccccaccctccact

SEQ ID NO: 1613453 - DNA, 19 bp, Homo sapiens
tgtccccaccctccactca

SEQ ID NO: 1613454 - DNA, 13 bp, Homo sapiens
tgtccccagggcc

SEQ ID NO: 1613455 - DNA, 15 bp, Homo sapiens
tgtccccataagaca

SEQ ID NO: 1613456 - DNA, 17 bp, Homo sapiens
tgtcccccagctctggt

SEQ ID NO: 1613457 - DNA, 14 bp, Homo sapiens
tgtcccccccagtg

SEQ ID NO: 1613458 - DNA, 16 bp, Homo sapiens
tgtccccgcagccctg

SEQ ID NO: 1613459 - DNA, 13 bp, Homo sapiens
tgtcccctcagcg

SEQ ID NO: 1613460 - DNA, 14 bp, Homo sapiens
tgtcccctctgtca

SEQ ID NO: 1613461 - DNA, 13 bp, Homo sapiens
tgtcccctgcccc

SEQ ID NO: 1613462 - DNA, 15 bp, Homo sapiens
tgtcccctgccccag

SEQ ID NO: 1613463 - DNA, 14 bp, Homo sapiens
tgtcccctgcgggc

SEQ ID NO: 1613464 - DNA, 15 bp, Homo sapiens
tgtcccctgtcccac

SEQ ID NO: 1613465 - DNA, 14 bp, Homo sapiens
tgtccccttctctc

SEQ ID NO: 1613466 - DNA, 22 bp, Homo sapiens
tgtcccgccttcctcctccaca

SEQ ID NO: 1613467 - DNA, 16 bp, Homo sapiens
tgtcccgcggtgctga

SEQ ID NO: 1613468 - DNA, 20 bp, Homo sapiens
tgtccctaccgagtctcttc

SEQ ID NO: 1613469 - DNA, 21 bp, Homo sapiens
tgtccctaccgagtctcttct

SEQ ID NO: 1613470 - DNA, 13 bp, Homo sapiens
tgtccctctaaag

SEQ ID NO: 1613471 - DNA, 22 bp, Homo sapiens
tgtccctctagtgccttcttta

SEQ ID NO: 1613472 - DNA, 17 bp, Homo sapiens
tgtccctctcactcccc

SEQ ID NO: 1613473 - DNA, 22 bp, Homo sapiens
tgtccctctcagtgccttctct

SEQ ID NO: 1613474 - DNA, 16 bp, Homo sapiens
tgtccctctcttggct

SEQ ID NO: 1613475 - DNA, 19 bp, Homo sapiens
tgtccctctgggccaatgc

SEQ ID NO: 1613476 - DNA, 15 bp, Homo sapiens
tgtccctgcagggcc

SEQ ID NO: 1613477 - DNA, 12 bp, Homo sapiens
tgtccctgcctt

SEQ ID NO: 1613478 - DNA, 13 bp, Homo sapiens
tgtccctgccttc

SEQ ID NO: 1613479 - DNA, 14 bp, Homo sapiens
tgtctcaaaaggat

SEQ ID NO: 1613480 - DNA, 16 bp, Homo sapiens
tgtctcaacgcctccc

SEQ ID NO: 1613481 - DNA, 19 bp, Homo sapiens
tgtctcaacgcctccccct

SEQ ID NO: 1613482 - DNA, 20 bp, Homo sapiens
tgtctcaagagggcactggt

SEQ ID NO: 1613483 - DNA, 16 bp, Homo sapiens
tgtctcacctggactt

SEQ ID NO: 1613484 - DNA, 13 bp, Homo sapiens
tgtctcagcctcc

SEQ ID NO: 1613485 - DNA, 13 bp, Homo sapiens
tgtctcatcccca

SEQ ID NO: 1613486 - DNA, 23 bp, Homo sapiens
tgtctcatccccaggggtcccag

SEQ ID NO: 1613487 - DNA, 19 bp, Homo sapiens
tgtctccaaccccccagca

SEQ ID NO: 1613488 - DNA, 17 bp, Homo sapiens
tgtctccactaaatgag

SEQ ID NO: 1613489 - DNA, 13 bp, Homo sapiens
tgtctccagctgc

SEQ ID NO: 1613490 - DNA, 14 bp, Homo sapiens
tgtctccagctgcc

SEQ ID NO: 1613491 - DNA, 18 bp, Homo sapiens
tgtctccagctgcctggg

SEQ ID NO: 1613492 - DNA, 19 bp, Homo sapiens
tgtctccaggccatgatgg

SEQ ID NO: 1613493 - DNA, 21 bp, Homo sapiens
tgtctccctcccctctcagaa

SEQ ID NO: 1613494 - DNA, 23 bp, Homo sapiens
tgtctccctcccctctcagaaca

SEQ ID NO: 1613495 - DNA, 15 bp, Homo sapiens
tgtctcccttctctc

SEQ ID NO: 1613496 - DNA, 16 bp, Homo sapiens
tgtctcctactgagga

SEQ ID NO: 1613497 - DNA, 17 bp, Homo sapiens
tgtctcctactgaggat

SEQ ID NO: 1613498 - DNA, 22 bp, Homo sapiens
tgtctcctatatatttctatta

SEQ ID NO: 1613499 - DNA, 12 bp, Homo sapiens
tgtctcctcaac

SEQ ID NO: 1613500 - DNA, 16 bp, Homo sapiens
tgtctcctttccactg

SEQ ID NO: 1613501 - DNA, 19 bp, Homo sapiens
tgtctcctttgcaggctca

SEQ ID NO: 1613502 - DNA, 13 bp, Homo sapiens
tgtctcctttgct

SEQ ID NO: 1613503 - DNA, 15 bp, Homo sapiens
tgtctcctttgctct

SEQ ID NO: 1613504 - DNA, 15 bp, Homo sapiens
tgtgtgtctgtcttt

SEQ ID NO: 1613505 - DNA, 16 bp, Homo sapiens
tgtgtgtcttaattat

SEQ ID NO: 1613506 - DNA, 14 bp, Homo sapiens
tgtgtgtgattttt

SEQ ID NO: 1613507 - DNA, 12 bp, Homo sapiens
tgtgtgtgcaag

SEQ ID NO: 1613508 - DNA, 12 bp, Homo sapiens
tgtgtgtgggag

SEQ ID NO: 1613509 - DNA, 9 bp, Homo sapiens
tgtgtgtgt

SEQ ID NO: 1613510 - DNA, 14 bp, Homo sapiens
tgtgtgtgtatgtg

SEQ ID NO: 1613511 - DNA, 15 bp, Homo sapiens
tgtgtgtgtatgtga

SEQ ID NO: 1613512 - DNA, 14 bp, Homo sapiens
tgtgtgtgtcagct

SEQ ID NO: 1613513 - DNA, 13 bp, Homo sapiens
tgtgtgtgtctgt

SEQ ID NO: 1613514 - DNA, 13 bp, Homo sapiens
tgtgtgtgtgcat

SEQ ID NO: 1613515 - DNA, 16 bp, Homo sapiens
tgtgtgtgtgtgtgcg

SEQ ID NO: 1613516 - DNA, 22 bp, Homo sapiens
tgtgtgttcaccttcaaaatgt

SEQ ID NO: 1613517 - DNA, 18 bp, Homo sapiens
tgtgtgttgtctcttgag

SEQ ID NO: 1613518 - DNA, 18 bp, Homo sapiens
tgtgtgttgtcttgaaag

SEQ ID NO: 1613519 - DNA, 18 bp, Homo sapiens
tgtgtgttgtgtgtggga

SEQ ID NO: 1613520 - DNA, 18 bp, Homo sapiens
tgtgtgttttctcctaga

SEQ ID NO: 1613521 - DNA, 14 bp, Homo sapiens
tgtgttaaaatact

SEQ ID NO: 1613522 - DNA, 22 bp, Homo sapiens
tgtgttaagtatgtgtaaaatg

SEQ ID NO: 1613523 - DNA, 17 bp, Homo sapiens
tgtgttactgctttgca

SEQ ID NO: 1613524 - DNA, 14 bp, Homo sapiens
tgtgttattataga

SEQ ID NO: 1613525 - DNA, 20 bp, Homo sapiens
tgtgttatttccccagccac

SEQ ID NO: 1613526 - DNA, 13 bp, Homo sapiens
tgtgttcaatatc

SEQ ID NO: 1613527 - DNA, 20 bp, Homo sapiens
tgtgttcagctctttccaaa

SEQ ID NO: 1613528 - DNA, 21 bp, Homo sapiens
tgtgttcagctctttccaaat

SEQ ID NO: 1613529 - DNA, 18 bp, Homo sapiens
tgtgttcattcaagctat

SEQ ID NO: 1613530 - DNA, 14 bp, Homo sapiens
tgtgttcatttcat

SEQ ID NO: 1613531 - DNA, 20 bp, Homo sapiens
tgtgttcatttggtgttcct

SEQ ID NO: 1613532 - DNA, 11 bp, Homo sapiens
tgtgttcctgg

SEQ ID NO: 1613533 - DNA, 15 bp, Homo sapiens
tgtgttcctggctga

SEQ ID NO: 1613534 - DNA, 19 bp, Homo sapiens
tgtgttcctggctgatgat

SEQ ID NO: 1613535 - DNA, 14 bp, Homo sapiens
tgtgttctgctcca

SEQ ID NO: 1613536 - DNA, 19 bp, Homo sapiens
tgtgttctgtttgttaaaa

SEQ ID NO: 1613537 - DNA, 17 bp, Homo sapiens
tgtgttgaagagcagct

SEQ ID NO: 1613538 - DNA, 12 bp, Homo sapiens
tgtgttgacaca

SEQ ID NO: 1613539 - DNA, 23 bp, Homo sapiens
tgtgttgacacatatgaacacag

SEQ ID NO: 1613540 - DNA, 17 bp, Homo sapiens
tgtgttgcttatgttgt

SEQ ID NO: 1613541 - DNA, 13 bp, Homo sapiens
tgtgttgtgaatg

SEQ ID NO: 1613542 - DNA, 14 bp, Homo sapiens
tgtgttgtgtgtgg

SEQ ID NO: 1613543 - DNA, 23 bp, Homo sapiens
tgtgttgtgtgtgggagtgtgta

SEQ ID NO: 1613544 - DNA, 21 bp, Homo sapiens
tgtgttgttgttgctgctgtt

SEQ ID NO: 1613545 - DNA, 12 bp, Homo sapiens
tgtgtttatatg

SEQ ID NO: 1613546 - DNA, 15 bp, Homo sapiens
tgtgtttatatggaa

SEQ ID NO: 1613547 - DNA, 13 bp, Homo sapiens
tgtgtttatgtgt

SEQ ID NO: 1613548 - DNA, 15 bp, Homo sapiens
tgtgtttatgtgtgt

SEQ ID NO: 1613549 - DNA, 22 bp, Homo sapiens
tgtgtttattcttgatgaaaag

SEQ ID NO: 1613550 - DNA, 15 bp, Homo sapiens
tgtgtttatttcact

SEQ ID NO: 1613551 - DNA, 21 bp, Homo sapiens
tgtgtttcaaaaccatgcctg

SEQ ID NO: 1613552 - DNA, 21 bp, Homo sapiens
tgtgtttccagatcgatcctg

SEQ ID NO: 1613553 - DNA, 14 bp, Homo sapiens
tgtgtttgagcaag

SEQ ID NO: 1613554 - DNA, 16 bp, Homo sapiens
tgtgtttgcagcctgc

SEQ ID NO: 1613555 - DNA, 18 bp, Homo sapiens
tgtgtttgcattgtctaa

SEQ ID NO: 1613556 - DNA, 14 bp, Homo sapiens
tgtgtttgtgagca

SEQ ID NO: 1613557 - DNA, 18 bp, Homo sapiens
tgtgtttgttcataataa

SEQ ID NO: 1613558 - DNA, 17 bp, Homo sapiens
tgtgttttcatgttgaa

SEQ ID NO: 1613559 - DNA, 17 bp, Homo sapiens
tgtgttttctctggaat

SEQ ID NO: 1613560 - DNA, 14 bp, Homo sapiens
tgtgtttttaaaag

SEQ ID NO: 1613561 - DNA, 15 bp, Homo sapiens
tgtgtttttaacatg

SEQ ID NO: 1613562 - DNA, 19 bp, Homo sapiens
tgtgtttttattgttaact

SEQ ID NO: 1613563 - DNA, 16 bp, Homo sapiens
tgtgtttttctatata

SEQ ID NO: 1613564 - DNA, 14 bp, Homo sapiens
tgtgttttttaaga

SEQ ID NO: 1613565 - DNA, 19 bp, Homo sapiens
tgttaaaaatagcagtatt

SEQ ID NO: 1613566 - DNA, 14 bp, Homo sapiens
tgttaaaaatgtca

SEQ ID NO: 1613567 - DNA, 19 bp, Homo sapiens
tgttaaaactggcatctga

SEQ ID NO: 1613568 - DNA, 23 bp, Homo sapiens
tgttaaaaggaaaaataacaact

SEQ ID NO: 1613569 - DNA, 15 bp, Homo sapiens
tgttaaaagttttat

SEQ ID NO: 1613570 - DNA, 21 bp, Homo sapiens
tgttaaaattatcaatatcta

SEQ ID NO: 1613571 - DNA, 12 bp, Homo sapiens
tgttaaacacta

SEQ ID NO: 1613572 - DNA, 14 bp, Homo sapiens
tgttaaatgaaacc

SEQ ID NO: 1613573 - DNA, 12 bp, Homo sapiens
tgttaacatcta

SEQ ID NO: 1613574 - DNA, 15 bp, Homo sapiens
tgttaacattccaag

SEQ ID NO: 1613575 - DNA, 21 bp, Homo sapiens
tgttaacattccaagactcta

SEQ ID NO: 1613576 - DNA, 21 bp, Homo sapiens
tgttaagaatgaagttctgct

SEQ ID NO: 1613577 - DNA, 17 bp, Homo sapiens
tgttaagacttacacag

SEQ ID NO: 1613578 - DNA, 16 bp, Homo sapiens
tgttaagtatgtgtaa

SEQ ID NO: 1613579 - DNA, 16 bp, Homo sapiens
tgttaatacaaggtat

SEQ ID NO: 1613580 - DNA, 22 bp, Homo sapiens
tgttaatacaaggtataataaa

SEQ ID NO: 1613581 - DNA, 19 bp, Homo sapiens
tgttaatacacagtacttt

SEQ ID NO: 1613582 - DNA, 21 bp, Homo sapiens
tgttaatacacagtactttat

SEQ ID NO: 1613583 - DNA, 20 bp, Homo sapiens
tgttaatatttctaaaagtt

SEQ ID NO: 1613584 - DNA, 19 bp, Homo sapiens
tgttaatgaaaatgtcaga

SEQ ID NO: 1613585 - DNA, 13 bp, Homo sapiens
tgttaatgtcatt

SEQ ID NO: 1613586 - DNA, 15 bp, Homo sapiens
tgttaatttatttag

SEQ ID NO: 1613587 - DNA, 20 bp, Homo sapiens
tgttaatttgtgtgttttta

SEQ ID NO: 1613588 - DNA, 20 bp, Homo sapiens
tgttaattttattgcaaagt

SEQ ID NO: 1613589 - DNA, 20 bp, Homo sapiens
tgttaattttgctaactggg

SEQ ID NO: 1613590 - DNA, 17 bp, Homo sapiens
tgttacacagcccaaga

SEQ ID NO: 1613591 - DNA, 17 bp, Homo sapiens
tgttacacattaaacag

SEQ ID NO: 1613592 - DNA, 13 bp, Homo sapiens
tgttacagaggac

SEQ ID NO: 1613593 - DNA, 21 bp, Homo sapiens
tgttacaggcaccgagaatgt

SEQ ID NO: 1613594 - DNA, 23 bp, Homo sapiens
tgttacaggcaccgagaatgttg

SEQ ID NO: 1613595 - DNA, 18 bp, Homo sapiens
tgttaccatgtatgtata

SEQ ID NO: 1613596 - DNA, 16 bp, Homo sapiens
tgttacctactttgac

SEQ ID NO: 1613597 - DNA, 14 bp, Homo sapiens
tgttacctctgaat

SEQ ID NO: 1613598 - DNA, 13 bp, Homo sapiens
tgttacctgtgtg

SEQ ID NO: 1613599 - DNA, 17 bp, Homo sapiens
tgttacctgtgtgcttg

SEQ ID NO: 1613600 - DNA, 19 bp, Homo sapiens
tgttacctgttagctccct

SEQ ID NO: 1613601 - DNA, 21 bp, Homo sapiens
tgttacggcatcacacttata

SEQ ID NO: 1613602 - DNA, 20 bp, Homo sapiens
tgttactaaaaaaaagatga

SEQ ID NO: 1613603 - DNA, 22 bp, Homo sapiens
tgttactattttctacaattaa

SEQ ID NO: 1613604 - DNA, 18 bp, Homo sapiens
tgttactgacttggatcc

SEQ ID NO: 1613605 - DNA, 18 bp, Homo sapiens
tgttactgctgattcttg

SEQ ID NO: 1613606 - DNA, 21 bp, Homo sapiens
tgttactgctgattcttgtaa

SEQ ID NO: 1613607 - DNA, 15 bp, Homo sapiens
tgttactgggccctg

SEQ ID NO: 1613608 - DNA, 17 bp, Homo sapiens
tgttactggtgtccagc

SEQ ID NO: 1613609 - DNA, 12 bp, Homo sapiens
tgttacttacct

SEQ ID NO: 1613610 - DNA, 13 bp, Homo sapiens
tgtccctggacac

SEQ ID NO: 1613611 - DNA, 20 bp, Homo sapiens
tgtccctggacacagctctt

SEQ ID NO: 1613612 - DNA, 16 bp, Homo sapiens
tgtccctgtcaccaag

SEQ ID NO: 1613613 - DNA, 13 bp, Homo sapiens
tgtcccttgcctc

SEQ ID NO: 1613614 - DNA, 12 bp, Homo sapiens
tgtcccttgctg

SEQ ID NO: 1613615 - DNA, 16 bp, Homo sapiens
tgtccctttcttggcc

SEQ ID NO: 1613616 - DNA, 18 bp, Homo sapiens
tgtccctttgctcccggc

SEQ ID NO: 1613617 - DNA, 13 bp, Homo sapiens
tgtcccttttccc

SEQ ID NO: 1613618 - DNA, 15 bp, Homo sapiens
tgtccgctgggtggt

SEQ ID NO: 1613619 - DNA, 20 bp, Homo sapiens
tgtccgctgggtggtaccct

SEQ ID NO: 1613620 - DNA, 18 bp, Homo sapiens
tgtccggcccagtgccac

SEQ ID NO: 1613621 - DNA, 19 bp, Homo sapiens
tgtccggcccagtgccact

SEQ ID NO: 1613622 - DNA, 17 bp, Homo sapiens
tgtccgtccacccttcc

SEQ ID NO: 1613623 - DNA, 18 bp, Homo sapiens
tgtccgtccacccttcca

SEQ ID NO: 1613624 - DNA, 22 bp, Homo sapiens
tgtccgtccacccttccatcag

SEQ ID NO: 1613625 - DNA, 16 bp, Homo sapiens
tgtcctaaggaacctt

SEQ ID NO: 1613626 - DNA, 19 bp, Homo sapiens
tgtcctaaggaaccttcct

SEQ ID NO: 1613627 - DNA, 18 bp, Homo sapiens
tgtcctaaggacacacta

SEQ ID NO: 1613628 - DNA, 20 bp, Homo sapiens
tgtcctaaggacacactaat

SEQ ID NO: 1613629 - DNA, 15 bp, Homo sapiens
tgtcctaaggcccat

SEQ ID NO: 1613630 - DNA, 16 bp, Homo sapiens
tgtcctaattcttctg

SEQ ID NO: 1613631 - DNA, 22 bp, Homo sapiens
tgtcctacttctgactttactt

SEQ ID NO: 1613632 - DNA, 19 bp, Homo sapiens
tgtcctatctatcttccaa

SEQ ID NO: 1613633 - DNA, 20 bp, Homo sapiens
tgtcctatctatcttccaaa

SEQ ID NO: 1613634 - DNA, 20 bp, Homo sapiens
tgtcctcagccttgccagag

SEQ ID NO: 1613635 - DNA, 16 bp, Homo sapiens
tgtcctccaggagctt

SEQ ID NO: 1613636 - DNA, 17 bp, Homo sapiens
tgtcctcccgagctcct

SEQ ID NO: 1613637 - DNA, 21 bp, Homo sapiens
tgtcctcccgagctcctcttc

SEQ ID NO: 1613638 - DNA, 23 bp, Homo sapiens
tgtcctcccgagctcctcttcca

SEQ ID NO: 1613639 - DNA, 10 bp, Homo sapiens
tgtcctcctc

SEQ ID NO: 1613640 - DNA, 18 bp, Homo sapiens
tgtcctctccctgccaag

SEQ ID NO: 1613641 - DNA, 17 bp, Homo sapiens
tgtcctcttctgctctt

SEQ ID NO: 1613642 - DNA, 18 bp, Homo sapiens
tgtcctcttctgctcttt

SEQ ID NO: 1613643 - DNA, 21 bp, Homo sapiens
tgtcctcttctgctcttttcc

SEQ ID NO: 1613644 - DNA, 23 bp, Homo sapiens
tgtcctctttactcccttcctgg

SEQ ID NO: 1613645 - DNA, 22 bp, Homo sapiens
tgtcctgaaacgctcctttgtg

SEQ ID NO: 1613646 - DNA, 20 bp, Homo sapiens
tgtcctgaccaccctcccct

SEQ ID NO: 1613647 - DNA, 23 bp, Homo sapiens
tgtcctgaccaccctcccctctc

SEQ ID NO: 1613648 - DNA, 17 bp, Homo sapiens
tgtcctgagccccctgc

SEQ ID NO: 1613649 - DNA, 18 bp, Homo sapiens
tgtcctgagccccctgca

SEQ ID NO: 1613650 - DNA, 20 bp, Homo sapiens
tgtcctgagccccctgcacc

SEQ ID NO: 1613651 - DNA, 21 bp, Homo sapiens
tgtcctgagccccctgcaccc

SEQ ID NO: 1613652 - DNA, 18 bp, Homo sapiens
tgtcctgaggagccctga

SEQ ID NO: 1613653 - DNA, 12 bp, Homo sapiens
tgtcctgatttc

SEQ ID NO: 1613654 - DNA, 20 bp, Homo sapiens
tgtcctgatttctacaactg

SEQ ID NO: 1613655 - DNA, 12 bp, Homo sapiens
tgtcctgccagc

SEQ ID NO: 1613656 - DNA, 10 bp, Homo sapiens
tgtcctgcct

SEQ ID NO: 1613657 - DNA, 14 bp, Homo sapiens
tgtcctgcctgtct

SEQ ID NO: 1613658 - DNA, 16 bp, Homo sapiens
tgtcctgcctgtctgc

SEQ ID NO: 1613659 - DNA, 19 bp, Homo sapiens
tgtcctgctctcttcagga

SEQ ID NO: 1613660 - DNA, 10 bp, Homo sapiens
tgtcctgctg

SEQ ID NO: 1613661 - DNA, 11 bp, Homo sapiens
tgtcctggccc

SEQ ID NO: 1613662 - DNA, 13 bp, Homo sapiens
tgtcctggccctt

SEQ ID NO: 1613663 - DNA, 15 bp, Homo sapiens
tgtcctggcccttca

SEQ ID NO: 1613664 - DNA, 18 bp, Homo sapiens
tgtcctggcccttcagtc

SEQ ID NO: 1613665 - DNA, 14 bp, Homo sapiens
tgtcctgggcctgc

SEQ ID NO: 1613666 - DNA, 16 bp, Homo sapiens
tgtcctgggcgccctg

SEQ ID NO: 1613667 - DNA, 17 bp, Homo sapiens
tgtcctgggcgccctgg

SEQ ID NO: 1613668 - DNA, 21 bp, Homo sapiens
tgtcctggtaattcctctcca

SEQ ID NO: 1613669 - DNA, 16 bp, Homo sapiens
tgtcctggtggctggg

SEQ ID NO: 1613670 - DNA, 15 bp, Homo sapiens
tgtcctggttcccgt

SEQ ID NO: 1613671 - DNA, 12 bp, Homo sapiens
tgtcctgtcctg

SEQ ID NO: 1613672 - DNA, 23 bp, Homo sapiens
tgtcctgtgaagtaacccctcct

SEQ ID NO: 1613673 - DNA, 17 bp, Homo sapiens
tgtccttaacccacctc

SEQ ID NO: 1613674 - DNA, 19 bp, Homo sapiens
tgtccttcagagctcttca

SEQ ID NO: 1613675 - DNA, 11 bp, Homo sapiens
tgtccttccct

SEQ ID NO: 1613676 - DNA, 15 bp, Homo sapiens
tgtccttccctgcca

SEQ ID NO: 1613677 - DNA, 15 bp, Homo sapiens
tgtccttgcacctgc

SEQ ID NO: 1613678 - DNA, 16 bp, Homo sapiens
tgtccttgcacctgca

SEQ ID NO: 1613679 - DNA, 20 bp, Homo sapiens
tgtccttgtcacgatcacag

SEQ ID NO: 1613680 - DNA, 22 bp, Homo sapiens
tgtccttgtcacgatcacaggc

SEQ ID NO: 1613681 - DNA, 21 bp, Homo sapiens
tgtcctttggtactatggtgt

SEQ ID NO: 1613682 - DNA, 14 bp, Homo sapiens
tgtccttttaggaa

SEQ ID NO: 1613683 - DNA, 17 bp, Homo sapiens
tgtccttttaggaatat

SEQ ID NO: 1613684 - DNA, 15 bp, Homo sapiens
tgtccttttatttct

SEQ ID NO: 1613685 - DNA, 17 bp, Homo sapiens
tgtccttttatttctcc

SEQ ID NO: 1613686 - DNA, 20 bp, Homo sapiens
tgtccttttatttctccatc

SEQ ID NO: 1613687 - DNA, 15 bp, Homo sapiens
tgtcctttttcactt

SEQ ID NO: 1613688 - DNA, 23 bp, Homo sapiens
tgtcctttttcactttgaaaagt

SEQ ID NO: 1613689 - DNA, 22 bp, Homo sapiens
tgtcgaaggggaggcacacttt

SEQ ID NO: 1613690 - DNA, 15 bp, Homo sapiens
tgtcgagacacttgc

SEQ ID NO: 1613691 - DNA, 21 bp, Homo sapiens
tgtcgagagctggccaaagag

SEQ ID NO: 1613692 - DNA, 22 bp, Homo sapiens
tgtcgattaaaatcactctcag

SEQ ID NO: 1613693 - DNA, 13 bp, Homo sapiens
tgtcgccgcctgc

SEQ ID NO: 1613694 - DNA, 14 bp, Homo sapiens
tgtcgctcatgtgt

SEQ ID NO: 1613695 - DNA, 15 bp, Homo sapiens
tgtcgctgcctccat

SEQ ID NO: 1613696 - DNA, 21 bp, Homo sapiens
tgtcgctgggtcagtgctgga

SEQ ID NO: 1613697 - DNA, 22 bp, Homo sapiens
tgtcgggggctgtggatgggtg

SEQ ID NO: 1613698 - DNA, 14 bp, Homo sapiens
tgtcggggtggggg

SEQ ID NO: 1613699 - DNA, 20 bp, Homo sapiens
tgtcggttcttcctggaagt

SEQ ID NO: 1613700 - DNA, 23 bp, Homo sapiens
tgtcggttttttttaaataaaag

SEQ ID NO: 1613701 - DNA, 24 bp, Homo sapiens
tgtcgtcttgaacgagcagcccag

SEQ ID NO: 1613702 - DNA, 15 bp, Homo sapiens
tgtcgtgccagtcct

SEQ ID NO: 1613703 - DNA, 13 bp, Homo sapiens
tgtcgtgggatgg

SEQ ID NO: 1613704 - DNA, 21 bp, Homo sapiens
tgtcgttaaaaagttgtttgt

SEQ ID NO: 1613705 - DNA, 18 bp, Homo sapiens
tgtctaactcagaattat

SEQ ID NO: 1613706 - DNA, 23 bp, Homo sapiens
tgtctaagcagttttgtaaatgt

SEQ ID NO: 1613707 - DNA, 18 bp, Homo sapiens
tgtctacagtagctgcta

SEQ ID NO: 1613708 - DNA, 13 bp, Homo sapiens
tgtctacatttct

SEQ ID NO: 1613709 - DNA, 13 bp, Homo sapiens
tgtctactgcttg

SEQ ID NO: 1613710 - DNA, 16 bp, Homo sapiens
tgtctactgtggtgat

SEQ ID NO: 1613711 - DNA, 13 bp, Homo sapiens
tgtctagaatgtg

SEQ ID NO: 1613712 - DNA, 15 bp, Homo sapiens
tgtctagaatgtgga

SEQ ID NO: 1613713 - DNA, 14 bp, Homo sapiens
tgtctagagtagct

SEQ ID NO: 1613714 - DNA, 19 bp, Homo sapiens
tgtctaggattttggatgt

SEQ ID NO: 1613715 - DNA, 19 bp, Homo sapiens
tgtctaggtctcctcaggg

SEQ ID NO: 1613716 - DNA, 20 bp, Homo sapiens
tgtctaggtctcctcagggt

SEQ ID NO: 1613717 - DNA, 14 bp, Homo sapiens
tgtctagtgtattc

SEQ ID NO: 1613718 - DNA, 22 bp, Homo sapiens
tgtctagtttgcatacttcctg

SEQ ID NO: 1613719 - DNA, 18 bp, Homo sapiens
tgtctatgaagttgctgt

SEQ ID NO: 1613720 - DNA, 18 bp, Homo sapiens
tgtctattaaaattctga

SEQ ID NO: 1613721 - DNA, 18 bp, Homo sapiens
tgtctattatcacattaa

SEQ ID NO: 1613722 - DNA, 14 bp, Homo sapiens
tgtctattcagctt

SEQ ID NO: 1613723 - DNA, 16 bp, Homo sapiens
tgtctattctgagcct

SEQ ID NO: 1613724 - DNA, 17 bp, Homo sapiens
tgtctattctgagcctt

SEQ ID NO: 1613725 - DNA, 12 bp, Homo sapiens
tgtctattttaa

SEQ ID NO: 1613726 - DNA, 15 bp, Homo sapiens
tgtctattttaaaat

SEQ ID NO: 1613727 - DNA, 17 bp, Homo sapiens
tgtatgagtagccaggg

SEQ ID NO: 1613728 - DNA, 13 bp, Homo sapiens
tgtatgattactg

SEQ ID NO: 1613729 - DNA, 19 bp, Homo sapiens
tgtatgatttgttttgaat

SEQ ID NO: 1613730 - DNA, 14 bp, Homo sapiens
tgtatgcactttgt

SEQ ID NO: 1613731 - DNA, 14 bp, Homo sapiens
tgtatgcagggagc

SEQ ID NO: 1613732 - DNA, 16 bp, Homo sapiens
tgtatgccaagtgaga

SEQ ID NO: 1613733 - DNA, 18 bp, Homo sapiens
tgtatgccaagtgagaag

SEQ ID NO: 1613734 - DNA, 20 bp, Homo sapiens
tgtatgccaagtgagaagat

SEQ ID NO: 1613735 - DNA, 13 bp, Homo sapiens
tgtatgctgaatt

SEQ ID NO: 1613736 - DNA, 15 bp, Homo sapiens
tgtatgctgatcatc

SEQ ID NO: 1613737 - DNA, 14 bp, Homo sapiens
tgtatgctgatgat

SEQ ID NO: 1613738 - DNA, 12 bp, Homo sapiens
tgtatgctggac

SEQ ID NO: 1613739 - DNA, 16 bp, Homo sapiens
tgtatggaatacagtg

SEQ ID NO: 1613740 - DNA, 17 bp, Homo sapiens
tgtatggaatacagtgt

SEQ ID NO: 1613741 - DNA, 16 bp, Homo sapiens
tgtatggatatatttg

SEQ ID NO: 1613742 - DNA, 23 bp, Homo sapiens
tgtatggatatatttgaaatagt

SEQ ID NO: 1613743 - DNA, 17 bp, Homo sapiens
tgtatggggaatctaag

SEQ ID NO: 1613744 - DNA, 13 bp, Homo sapiens
tgtatggggaggc

SEQ ID NO: 1613745 - DNA, 15 bp, Homo sapiens
tgtatggggcagctt

SEQ ID NO: 1613746 - DNA, 20 bp, Homo sapiens
tgtatgggtagggtaaatca

SEQ ID NO: 1613747 - DNA, 22 bp, Homo sapiens
tgtatgggtagggtaaatcagt

SEQ ID NO: 1613748 - DNA, 13 bp, Homo sapiens
tgtatgtaaatct

SEQ ID NO: 1613749 - DNA, 14 bp, Homo sapiens
tgtatgtaaatctg

SEQ ID NO: 1613750 - DNA, 14 bp, Homo sapiens
tgtatgtacaatac

SEQ ID NO: 1613751 - DNA, 22 bp, Homo sapiens
tgtatgtcaataaacaacagct

SEQ ID NO: 1613752 - DNA, 16 bp, Homo sapiens
tgtatgtcagaagtgc

SEQ ID NO: 1613753 - DNA, 15 bp, Homo sapiens
tgtatgtctgtgtat

SEQ ID NO: 1613754 - DNA, 14 bp, Homo sapiens
tgtatgtcttggac

SEQ ID NO: 1613755 - DNA, 11 bp, Homo sapiens
tgtatgtgtga

SEQ ID NO: 1613756 - DNA, 19 bp, Homo sapiens
tgtatgtgtgaaacaatgt

SEQ ID NO: 1613757 - DNA, 16 bp, Homo sapiens
tgtatgtgtggctgtg

SEQ ID NO: 1613758 - DNA, 15 bp, Homo sapiens
tgtatgtgtgttttt

SEQ ID NO: 1613759 - DNA, 22 bp, Homo sapiens
tgtatgtttgcacacttgtgtg

SEQ ID NO: 1613760 - DNA, 20 bp, Homo sapiens
tgtattaaatcttaaacaat

SEQ ID NO: 1613761 - DNA, 22 bp, Homo sapiens
tgtattaaatcttaaacaatgt

SEQ ID NO: 1613762 - DNA, 17 bp, Homo sapiens
tgtattaaattacattt

SEQ ID NO: 1613763 - DNA, 23 bp, Homo sapiens
tgtattaaattacatttgtaatt

SEQ ID NO: 1613764 - DNA, 16 bp, Homo sapiens
tgtattaagaaaggaa

SEQ ID NO: 1613765 - DNA, 12 bp, Homo sapiens
tgtattaagagt

SEQ ID NO: 1613766 - DNA, 16 bp, Homo sapiens
tgtattaagagtgaaa

SEQ ID NO: 1613767 - DNA, 14 bp, Homo sapiens
tgtattaataaagc

SEQ ID NO: 1613768 - DNA, 18 bp, Homo sapiens
tgtattaataaagcattc

SEQ ID NO: 1613769 - DNA, 18 bp, Homo sapiens
tgtattaatcatagatta

SEQ ID NO: 1613770 - DNA, 15 bp, Homo sapiens
tgtattagctcactg

SEQ ID NO: 1613771 - DNA, 12 bp, Homo sapiens
tgtattagtatg

SEQ ID NO: 1613772 - DNA, 14 bp, Homo sapiens
tgtattatgagcca

SEQ ID NO: 1613773 - DNA, 14 bp, Homo sapiens
tgtattcagaggca

SEQ ID NO: 1613774 - DNA, 15 bp, Homo sapiens
tgtattcatatttgt

SEQ ID NO: 1613775 - DNA, 20 bp, Homo sapiens
tgtattcatgttcatgtgat

SEQ ID NO: 1613776 - DNA, 15 bp, Homo sapiens
tgtattcccttgtat

SEQ ID NO: 1613777 - DNA, 17 bp, Homo sapiens
tgtattcccttgtattt

SEQ ID NO: 1613778 - DNA, 18 bp, Homo sapiens
tgtattcccttgtatttt

SEQ ID NO: 1613779 - DNA, 17 bp, Homo sapiens
tgtattcgtgcattttt

SEQ ID NO: 1613780 - DNA, 22 bp, Homo sapiens
tgtattctctttaccttctaaa

SEQ ID NO: 1613781 - DNA, 17 bp, Homo sapiens
tgtattctgtatccgtg

SEQ ID NO: 1613782 - DNA, 17 bp, Homo sapiens
tgtattctgtcttcatc

SEQ ID NO: 1613783 - DNA, 16 bp, Homo sapiens
tgtattcttgtttgaa

SEQ ID NO: 1613784 - DNA, 17 bp, Homo sapiens
tgtattctttactaaag

SEQ ID NO: 1613785 - DNA, 22 bp, Homo sapiens
tgtattcttttccaagctcctt

SEQ ID NO: 1613786 - DNA, 16 bp, Homo sapiens
tgtattcttttctcag

SEQ ID NO: 1613787 - DNA, 19 bp, Homo sapiens
tgtattcttttctcagtgt

SEQ ID NO: 1613788 - DNA, 18 bp, Homo sapiens
tgtattgaaaacacttag

SEQ ID NO: 1613789 - DNA, 19 bp, Homo sapiens
tgtattgaaaacacttagt

SEQ ID NO: 1613790 - DNA, 21 bp, Homo sapiens
tgtattgaaaacacttagtat

SEQ ID NO: 1613791 - DNA, 22 bp, Homo sapiens
tgtattgaacttggaaagaaat

SEQ ID NO: 1613792 - DNA, 21 bp, Homo sapiens
tgtattgatgcaatataagca

SEQ ID NO: 1613793 - DNA, 18 bp, Homo sapiens
tgtattgggccttttgga

SEQ ID NO: 1613794 - DNA, 22 bp, Homo sapiens
tgtattgggccttttggatatg

SEQ ID NO: 1613795 - DNA, 18 bp, Homo sapiens
tgtattggttaaaactgt

SEQ ID NO: 1613796 - DNA, 20 bp, Homo sapiens
tgtattgttgaaaaagtttg

SEQ ID NO: 1613797 - DNA, 19 bp, Homo sapiens
tgtattgttttctgacagt

SEQ ID NO: 1613798 - DNA, 21 bp, Homo sapiens
tgtatttaaagaaaataaaca

SEQ ID NO: 1613799 - DNA, 14 bp, Homo sapiens
tgtatttaaagttg

SEQ ID NO: 1613800 - DNA, 14 bp, Homo sapiens
tgtatttaacagaa

SEQ ID NO: 1613801 - DNA, 13 bp, Homo sapiens
tgtatttaagaaa

SEQ ID NO: 1613802 - DNA, 11 bp, Homo sapiens
tgtatttaatt

SEQ ID NO: 1613803 - DNA, 14 bp, Homo sapiens
tgtatttataaata

SEQ ID NO: 1613804 - DNA, 17 bp, Homo sapiens
tgtcaagtctctgctgg

SEQ ID NO: 1613805 - DNA, 19 bp, Homo sapiens
tgtcaagttaacaaggaat

SEQ ID NO: 1613806 - DNA, 15 bp, Homo sapiens
tgtcaagttgtgctt

SEQ ID NO: 1613807 - DNA, 16 bp, Homo sapiens
tgtcaagttgtgcttg

SEQ ID NO: 1613808 - DNA, 12 bp, Homo sapiens
tgtcaataaaca

SEQ ID NO: 1613809 - DNA, 13 bp, Homo sapiens
tgtcaataaattt

SEQ ID NO: 1613810 - DNA, 19 bp, Homo sapiens
tgtcaatattaaatacaga

SEQ ID NO: 1613811 - DNA, 21 bp, Homo sapiens
tgtcaatattaaatacagaca

SEQ ID NO: 1613812 - DNA, 15 bp, Homo sapiens
tgtcaatctgtccgt

SEQ ID NO: 1613813 - DNA, 16 bp, Homo sapiens
tgtcaatttctgtgtt

SEQ ID NO: 1613814 - DNA, 17 bp, Homo sapiens
tgtcaatttgtatatca

SEQ ID NO: 1613815 - DNA, 15 bp, Homo sapiens
tgtcacaaattgatc

SEQ ID NO: 1613816 - DNA, 21 bp, Homo sapiens
tgtcacaagtggtgtttattg

SEQ ID NO: 1613817 - DNA, 16 bp, Homo sapiens
tgtcacaataaatgta

SEQ ID NO: 1613818 - DNA, 22 bp, Homo sapiens
tgtcacagtccaaccagaaaca

SEQ ID NO: 1613819 - DNA, 18 bp, Homo sapiens
tgtcaccaccctgctcat

SEQ ID NO: 1613820 - DNA, 18 bp, Homo sapiens
tgtcaccaccttcccagc

SEQ ID NO: 1613821 - DNA, 19 bp, Homo sapiens
tgtcaccaccttcccagct

SEQ ID NO: 1613822 - DNA, 12 bp, Homo sapiens
tgtcaccagagc

SEQ ID NO: 1613823 - DNA, 13 bp, Homo sapiens
tgtcaccagagct

SEQ ID NO: 1613824 - DNA, 22 bp, Homo sapiens
tgtcacccaggttggagtgcag

SEQ ID NO: 1613825 - DNA, 16 bp, Homo sapiens
tgtcaccgtgagcagc

SEQ ID NO: 1613826 - DNA, 19 bp, Homo sapiens
tgtcacctcagctgatatt

SEQ ID NO: 1613827 - DNA, 14 bp, Homo sapiens
tgtcacctctctct

SEQ ID NO: 1613828 - DNA, 21 bp, Homo sapiens
tgtcacctctctctgaggaca

SEQ ID NO: 1613829 - DNA, 21 bp, Homo sapiens
tgtcacgctcatgtcctgtcc

SEQ ID NO: 1613830 - DNA, 17 bp, Homo sapiens
tgtcacgtgaaatattt

SEQ ID NO: 1613831 - DNA, 19 bp, Homo sapiens
tgtcacgtgaaatatttaa

SEQ ID NO: 1613832 - DNA, 16 bp, Homo sapiens
tgtcactactcacagt

SEQ ID NO: 1613833 - DNA, 17 bp, Homo sapiens
tgtcactagcagctgca

SEQ ID NO: 1613834 - DNA, 19 bp, Homo sapiens
tgtcactcagctgagaagg

SEQ ID NO: 1613835 - DNA, 15 bp, Homo sapiens
tgtcactgagctgtg

SEQ ID NO: 1613836 - DNA, 12 bp, Homo sapiens
tgtcacttttta

SEQ ID NO: 1613837 - DNA, 22 bp, Homo sapiens
tgtcactttttaaaccactgta

SEQ ID NO: 1613838 - DNA, 16 bp, Homo sapiens
tgtcagaaacatgaaa

SEQ ID NO: 1613839 - DNA, 16 bp, Homo sapiens
tgtcagaaaccagtta

SEQ ID NO: 1613840 - DNA, 12 bp, Homo sapiens
tgtcagaagtgc

SEQ ID NO: 1613841 - DNA, 17 bp, Homo sapiens
tgtcagaagtgcagaat

SEQ ID NO: 1613842 - DNA, 17 bp, Homo sapiens
tgtcagaatttctttgt

SEQ ID NO: 1613843 - DNA, 18 bp, Homo sapiens
tgtcagacaataccactg

SEQ ID NO: 1613844 - DNA, 21 bp, Homo sapiens
tgtcagacagaacttgaatgt

SEQ ID NO: 1613845 - DNA, 23 bp, Homo sapiens
tgtcagacagaacttgaatgtgt

SEQ ID NO: 1613846 - DNA, 15 bp, Homo sapiens
tgtcagaccctggag

SEQ ID NO: 1613847 - DNA, 16 bp, Homo sapiens
tgtcagacttccaaat

SEQ ID NO: 1613848 - DNA, 17 bp, Homo sapiens
tgtcagagcccagccca

SEQ ID NO: 1613849 - DNA, 20 bp, Homo sapiens
tgtcagaggcacaaaagggt

SEQ ID NO: 1613850 - DNA, 12 bp, Homo sapiens
tgtcagaggcta

SEQ ID NO: 1613851 - DNA, 16 bp, Homo sapiens
tgtcagatacaatgta

SEQ ID NO: 1613852 - DNA, 15 bp, Homo sapiens
tgtcagatatgatat

SEQ ID NO: 1613853 - DNA, 20 bp, Homo sapiens
tgtcagatattttttcagaa

SEQ ID NO: 1613854 - DNA, 19 bp, Homo sapiens
tgtcagcaagaggaggaca

SEQ ID NO: 1613855 - DNA, 18 bp, Homo sapiens
tgtcagcatctgaccatc

SEQ ID NO: 1613856 - DNA, 21 bp, Homo sapiens
tgtcagcatctgaccatctgt

SEQ ID NO: 1613857 - DNA, 20 bp, Homo sapiens
tgtcagccgagccgggcctg

SEQ ID NO: 1613858 - DNA, 21 bp, Homo sapiens
tgtcagccgggccctgagtaa

SEQ ID NO: 1613859 - DNA, 22 bp, Homo sapiens
tgtcagccgggccctgagtaat

SEQ ID NO: 1613860 - DNA, 18 bp, Homo sapiens
tgtcagctactaatgatg

SEQ ID NO: 1613861 - DNA, 21 bp, Homo sapiens
tgtcagctactaatgatgttt

SEQ ID NO: 1613862 - DNA, 21 bp, Homo sapiens
tgtcagctgagcttgagctcc

SEQ ID NO: 1613863 - DNA, 23 bp, Homo sapiens
tgtcagctgagcttgagctcccc

SEQ ID NO: 1613864 - DNA, 13 bp, Homo sapiens
tgtcagctgaggc

SEQ ID NO: 1613865 - DNA, 24 bp, Homo sapiens
tgtcagctgaggctgggggagagc

SEQ ID NO: 1613866 - DNA, 22 bp, Homo sapiens
tgtcagctgcaaggtactctgg

SEQ ID NO: 1613867 - DNA, 20 bp, Homo sapiens
tgtcaggaacagaaggatga

SEQ ID NO: 1613868 - DNA, 12 bp, Homo sapiens
tgtcaggaatgg

SEQ ID NO: 1613869 - DNA, 19 bp, Homo sapiens
tgtcaggcccgtcggagct

SEQ ID NO: 1613870 - DNA, 20 bp, Homo sapiens
tgtcaggccctctgcctgca

SEQ ID NO: 1613871 - DNA, 22 bp, Homo sapiens
tgtcaggccctctgcctgcact

SEQ ID NO: 1613872 - DNA, 23 bp, Homo sapiens
tgtcaggccctctgcctgcactc

SEQ ID NO: 1613873 - DNA, 22 bp, Homo sapiens
tgtcagggccaggtgcagacct

SEQ ID NO: 1613874 - DNA, 15 bp, Homo sapiens
tgtcagtatccaggc

SEQ ID NO: 1613875 - DNA, 20 bp, Homo sapiens
tgtcagtatgtggaagtgtg

SEQ ID NO: 1613876 - DNA, 16 bp, Homo sapiens
tgtcagtatttttgcc

SEQ ID NO: 1613877 - DNA, 16 bp, Homo sapiens
tgtcagtggggcagcc

SEQ ID NO: 1613878 - DNA, 13 bp, Homo sapiens
tgtcataaagatt

SEQ ID NO: 1613879 - DNA, 21 bp, Homo sapiens
tgtcataaagattataatatg

SEQ ID NO: 1613880 - DNA, 10 bp, Homo sapiens
tgtcataaat

SEQ ID NO: 1613881 - DNA, 15 bp, Homo sapiens
tgtcataagaatgaa

SEQ ID NO: 1613882 - DNA, 16 bp, Homo sapiens
tgtcataaggttttta

SEQ ID NO: 1613883 - DNA, 16 bp, Homo sapiens
tggtagaatcattttt

SEQ ID NO: 1613884 - DNA, 20 bp, Homo sapiens
tggtagaattggagagtaaa

SEQ ID NO: 1613885 - DNA, 16 bp, Homo sapiens
tggtagatgctgaggc

SEQ ID NO: 1613886 - DNA, 15 bp, Homo sapiens
tggtagcagcaggct

SEQ ID NO: 1613887 - DNA, 18 bp, Homo sapiens
tggtagcatattcatggt

SEQ ID NO: 1613888 - DNA, 20 bp, Homo sapiens
tggtagccatcaagcacttc

SEQ ID NO: 1613889 - DNA, 14 bp, Homo sapiens
tggtagctccagcg

SEQ ID NO: 1613890 - DNA, 18 bp, Homo sapiens
tggtagctccagcgatgg

SEQ ID NO: 1613891 - DNA, 20 bp, Homo sapiens
tggtaggaactgctgggctt

SEQ ID NO: 1613892 - DNA, 22 bp, Homo sapiens
tggtaggagttttgttccagag

SEQ ID NO: 1613893 - DNA, 16 bp, Homo sapiens
tggtaggggagggcag

SEQ ID NO: 1613894 - DNA, 17 bp, Homo sapiens
tggtaggggagggcagg

SEQ ID NO: 1613895 - DNA, 21 bp, Homo sapiens
tggtaggggagggcaggcttg

SEQ ID NO: 1613896 - DNA, 19 bp, Homo sapiens
tggtagggggaaaatgtgt

SEQ ID NO: 1613897 - DNA, 18 bp, Homo sapiens
tggtaggttgggacacca

SEQ ID NO: 1613898 - DNA, 22 bp, Homo sapiens
tggtagtaatcacagttggcct

SEQ ID NO: 1613899 - DNA, 22 bp, Homo sapiens
tggtagtactcctgcaaaattt

SEQ ID NO: 1613900 - DNA, 22 bp, Homo sapiens
tggtagtatctcgtaatagctt

SEQ ID NO: 1613901 - DNA, 22 bp, Homo sapiens
tggtagtgtagctgtgtggctt

SEQ ID NO: 1613902 - DNA, 21 bp, Homo sapiens
tggtagttctgtgcctccccc

SEQ ID NO: 1613903 - DNA, 17 bp, Homo sapiens
tggtataaaaggttgcc

SEQ ID NO: 1613904 - DNA, 17 bp, Homo sapiens
tggtatagccatgattt

SEQ ID NO: 1613905 - DNA, 14 bp, Homo sapiens
tggtatatatacat

SEQ ID NO: 1613906 - DNA, 15 bp, Homo sapiens
tggtatcaagaaagt

SEQ ID NO: 1613907 - DNA, 22 bp, Homo sapiens
tggtatcattacaattttctgt

SEQ ID NO: 1613908 - DNA, 21 bp, Homo sapiens
tggtatcctcatcatgatgga

SEQ ID NO: 1613909 - DNA, 16 bp, Homo sapiens
tggtatcttaaagtgt

SEQ ID NO: 1613910 - DNA, 19 bp, Homo sapiens
tggtattattctgttttgc

SEQ ID NO: 1613911 - DNA, 21 bp, Homo sapiens
tggtattctgttctggaggaa

SEQ ID NO: 1613912 - DNA, 15 bp, Homo sapiens
tggtattttcaacca

SEQ ID NO: 1613913 - DNA, 15 bp, Homo sapiens
tggtcaagattttga

SEQ ID NO: 1613914 - DNA, 15 bp, Homo sapiens
tggtcaagttcccaa

SEQ ID NO: 1613915 - DNA, 23 bp, Homo sapiens
tggtcaatacacataagaccgtg

SEQ ID NO: 1613916 - DNA, 22 bp, Homo sapiens
tggtcacaacttgatggctgcg

SEQ ID NO: 1613917 - DNA, 15 bp, Homo sapiens
tggtcacagcggagg

SEQ ID NO: 1613918 - DNA, 21 bp, Homo sapiens
tggtcacagcggaggtgtgga

SEQ ID NO: 1613919 - DNA, 18 bp, Homo sapiens
tggtcaccaaatcagctg

SEQ ID NO: 1613920 - DNA, 20 bp, Homo sapiens
tggtcaccaaatcagctgct

SEQ ID NO: 1613921 - DNA, 21 bp, Homo sapiens
tggtcaccaaatcagctgcta

SEQ ID NO: 1613922 - DNA, 16 bp, Homo sapiens
tggtcacccttaatat

SEQ ID NO: 1613923 - DNA, 17 bp, Homo sapiens
tggtcactctgccctct

SEQ ID NO: 1613924 - DNA, 21 bp, Homo sapiens
tggtcactctgccctctgctg

SEQ ID NO: 1613925 - DNA, 22 bp, Homo sapiens
tggtcagagagacctcatcctg

SEQ ID NO: 1613926 - DNA, 16 bp, Homo sapiens
tggtcagatttgaact

SEQ ID NO: 1613927 - DNA, 15 bp, Homo sapiens
tggtcagtctttgct

SEQ ID NO: 1613928 - DNA, 16 bp, Homo sapiens
tggtcatgctcagcct

SEQ ID NO: 1613929 - DNA, 16 bp, Homo sapiens
tggtccaaaaaaagga

SEQ ID NO: 1613930 - DNA, 18 bp, Homo sapiens
tggtccaaaaaaaggaaa

SEQ ID NO: 1613931 - DNA, 19 bp, Homo sapiens
tggtccaaccaggagctga

SEQ ID NO: 1613932 - DNA, 18 bp, Homo sapiens
tggtccaattagtttcct

SEQ ID NO: 1613933 - DNA, 21 bp, Homo sapiens
tggtccagaaactcctgtttc

SEQ ID NO: 1613934 - DNA, 22 bp, Homo sapiens
tggtccagaaactcctgtttct

SEQ ID NO: 1613935 - DNA, 23 bp, Homo sapiens
tggtccagcgtcactccagtgct

SEQ ID NO: 1613936 - DNA, 13 bp, Homo sapiens
tggtccagctctg

SEQ ID NO: 1613937 - DNA, 22 bp, Homo sapiens
tggtccagctctgacatccctt

SEQ ID NO: 1613938 - DNA, 17 bp, Homo sapiens
tggtccagggaagctgg

SEQ ID NO: 1613939 - DNA, 22 bp, Homo sapiens
tggtccagtcgggaggagcagc

SEQ ID NO: 1613940 - DNA, 13 bp, Homo sapiens
tggtcccatcctc

SEQ ID NO: 1613941 - DNA, 13 bp, Homo sapiens
tggtcccatggct

SEQ ID NO: 1613942 - DNA, 19 bp, Homo sapiens
tggtccccaacaatgtgag

SEQ ID NO: 1613943 - DNA, 17 bp, Homo sapiens
tggtccccgttccaccc

SEQ ID NO: 1613944 - DNA, 14 bp, Homo sapiens
tggtcccctcctca

SEQ ID NO: 1613945 - DNA, 16 bp, Homo sapiens
tggtcccctcctcagt

SEQ ID NO: 1613946 - DNA, 13 bp, Homo sapiens
tggtccctcgtcc

SEQ ID NO: 1613947 - DNA, 13 bp, Homo sapiens
tggtccctgccct

SEQ ID NO: 1613948 - DNA, 16 bp, Homo sapiens
tggtccctgccctccc

SEQ ID NO: 1613949 - DNA, 21 bp, Homo sapiens
tggtccctgccctcccctgct

SEQ ID NO: 1613950 - DNA, 22 bp, Homo sapiens
tggtccctgttttcccacgagg

SEQ ID NO: 1613951 - DNA, 15 bp, Homo sapiens
tggttctaatagaac

SEQ ID NO: 1613952 - DNA, 16 bp, Homo sapiens
tggttctatttaatgg

SEQ ID NO: 1613953 - DNA, 14 bp, Homo sapiens
tggttctcatcttt

SEQ ID NO: 1613954 - DNA, 17 bp, Homo sapiens
tggttctcatctttctt

SEQ ID NO: 1613955 - DNA, 19 bp, Homo sapiens
tggttctccaagaaactga

SEQ ID NO: 1613956 - DNA, 15 bp, Homo sapiens
tggttctgcttcaat

SEQ ID NO: 1613957 - DNA, 12 bp, Homo sapiens
tggttctgtgac

SEQ ID NO: 1613958 - DNA, 19 bp, Homo sapiens
tggttctgtgacccatctg

SEQ ID NO: 1613959 - DNA, 20 bp, Homo sapiens
tggttgaaaaccacagtcag

SEQ ID NO: 1613960 - DNA, 20 bp, Homo sapiens
tggttgaaagttagagattt

SEQ ID NO: 1613961 - DNA, 23 bp, Homo sapiens
tggttgaactctggtggcacagg

SEQ ID NO: 1613962 - DNA, 15 bp, Homo sapiens
tggttgaggtggaag

SEQ ID NO: 1613963 - DNA, 21 bp, Homo sapiens
tggttgatggaaaataaacat

SEQ ID NO: 1613964 - DNA, 12 bp, Homo sapiens
tggttgatttgt

SEQ ID NO: 1613965 - DNA, 12 bp, Homo sapiens
tggttgcctggg

SEQ ID NO: 1613966 - DNA, 13 bp, Homo sapiens
tggttgcctgggg

SEQ ID NO: 1613967 - DNA, 23 bp, Homo sapiens
tggttgggaatgaggaaaattct

SEQ ID NO: 1613968 - DNA, 17 bp, Homo sapiens
tggttggttttatttgt

SEQ ID NO: 1613969 - DNA, 20 bp, Homo sapiens
tggttgtacgttttgcacat

SEQ ID NO: 1613970 - DNA, 17 bp, Homo sapiens
tggttgtcaatattaaa

SEQ ID NO: 1613971 - DNA, 23 bp, Homo sapiens
tggttgtcatttttgcagtagag

SEQ ID NO: 1613972 - DNA, 15 bp, Homo sapiens
tggttgttgccaggt

SEQ ID NO: 1613973 - DNA, 21 bp, Homo sapiens
tggttgttgccaggttgcagc

SEQ ID NO: 1613974 - DNA, 16 bp, Homo sapiens
tggtttaaagaaagtg

SEQ ID NO: 1613975 - DNA, 15 bp, Homo sapiens
tggtttaatttaaag

SEQ ID NO: 1613976 - DNA, 16 bp, Homo sapiens
tggtttagctttggaa

SEQ ID NO: 1613977 - DNA, 17 bp, Homo sapiens
tggtttcagatgtgcaa

SEQ ID NO: 1613978 - DNA, 12 bp, Homo sapiens
tggtttcatgtt

SEQ ID NO: 1613979 - DNA, 20 bp, Homo sapiens
tggtttccacgatgaaaaac

SEQ ID NO: 1613980 - DNA, 21 bp, Homo sapiens
tggtttccacgatgaaaaact

SEQ ID NO: 1613981 - DNA, 20 bp, Homo sapiens
tggtttcccccttctacatt

SEQ ID NO: 1613982 - DNA, 13 bp, Homo sapiens
tggtttcctctgg

SEQ ID NO: 1613983 - DNA, 19 bp, Homo sapiens
tggtttcctggcagcctgc

SEQ ID NO: 1613984 - DNA, 12 bp, Homo sapiens
tggtttcttcat

SEQ ID NO: 1613985 - DNA, 15 bp, Homo sapiens
tggtttcttcattct

SEQ ID NO: 1613986 - DNA, 18 bp, Homo sapiens
tggtttcttcattcttta

SEQ ID NO: 1613987 - DNA, 19 bp, Homo sapiens
tggtttgaaagattatgat

SEQ ID NO: 1613988 - DNA, 22 bp, Homo sapiens
tggtttgcaacctctttgctca

SEQ ID NO: 1613989 - DNA, 23 bp, Homo sapiens
tggtttgcaacctctttgctcaa

SEQ ID NO: 1613990 - DNA, 15 bp, Homo sapiens
tggtttgccaggcca

SEQ ID NO: 1613991 - DNA, 11 bp, Homo sapiens
tggtttggaat

SEQ ID NO: 1613992 - DNA, 20 bp, Homo sapiens
tggtttggcatggtgagtgt

SEQ ID NO: 1613993 - DNA, 15 bp, Homo sapiens
tggtttggggagaaa

SEQ ID NO: 1613994 - DNA, 18 bp, Homo sapiens
tggtttgggggcgccctc

SEQ ID NO: 1613995 - DNA, 14 bp, Homo sapiens
tggtttgtggacga

SEQ ID NO: 1613996 - DNA, 11 bp, Homo sapiens
tggtttgtgtg

SEQ ID NO: 1613997 - DNA, 16 bp, Homo sapiens
tggttttacacaggaa

SEQ ID NO: 1613998 - DNA, 14 bp, Homo sapiens
tggttttcaaaata

SEQ ID NO: 1613999 - DNA, 17 bp, Homo sapiens
tggttttcaaaataaaa

SEQ ID NO: 1614000 - DNA, 19 bp, Homo sapiens
tggttttcaacctctagaa

SEQ ID NO: 1614001 - DNA, 18 bp, Homo sapiens
tggttttcccctccctgg

SEQ ID NO: 1614002 - DNA, 20 bp, Homo sapiens
tggttttcccctccctgggt

SEQ ID NO: 1614003 - DNA, 15 bp, Homo sapiens
tggtttttacattca

SEQ ID NO: 1614004 - DNA, 17 bp, Homo sapiens
tggtttttgtagccttc

SEQ ID NO: 1614005 - DNA, 22 bp, Homo sapiens
tggttttttaggtggagagaca

SEQ ID NO: 1614006 - DNA, 10 bp, Homo sapiens
tggttttttt

SEQ ID NO: 1614007 - DNA, 14 bp, Homo sapiens
tgtaaaaaaagcaa

SEQ ID NO: 1614008 - DNA, 22 bp, Homo sapiens
tgtaaaaacagcattgctttct

SEQ ID NO: 1614009 - DNA, 16 bp, Homo sapiens
tgtaaaaagcctcctt

SEQ ID NO: 1614010 - DNA, 20 bp, Homo sapiens
tgtaaaaagcctccttgtgc

SEQ ID NO: 1614011 - DNA, 20 bp, Homo sapiens
tgtaacactgcaagaagtct

SEQ ID NO: 1614012 - DNA, 14 bp, Homo sapiens
tgtaacagctgagg

SEQ ID NO: 1614013 - DNA, 14 bp, Homo sapiens
tgtaacaggctttt

SEQ ID NO: 1614014 - DNA, 16 bp, Homo sapiens
tgtaacaggcttttat

SEQ ID NO: 1614015 - DNA, 18 bp, Homo sapiens
tgtaacaggtctcctctt

SEQ ID NO: 1614016 - DNA, 22 bp, Homo sapiens
tgtaacaggtctcctcttaaaa

SEQ ID NO: 1614017 - DNA, 17 bp, Homo sapiens
tgtaacagttggtgatt

SEQ ID NO: 1614018 - DNA, 14 bp, Homo sapiens
tgtaacatcataat

SEQ ID NO: 1614019 - DNA, 16 bp, Homo sapiens
tgtaacatcataatta

SEQ ID NO: 1614020 - DNA, 19 bp, Homo sapiens
tgtaacatcataattacat

SEQ ID NO: 1614021 - DNA, 20 bp, Homo sapiens
tgtaacatcataattacatt

SEQ ID NO: 1614022 - DNA, 17 bp, Homo sapiens
tgtaacatccaagccag

SEQ ID NO: 1614023 - DNA, 19 bp, Homo sapiens
tgtaacatccaagccagag

SEQ ID NO: 1614024 - DNA, 15 bp, Homo sapiens
tgtaacattggtgaa

SEQ ID NO: 1614025 - DNA, 13 bp, Homo sapiens
tgtaaccaagctg

SEQ ID NO: 1614026 - DNA, 23 bp, Homo sapiens
tgtaaccatatgattgaaaagaa

SEQ ID NO: 1614027 - DNA, 16 bp, Homo sapiens
tgtaacgtggcactgg

SEQ ID NO: 1614028 - DNA, 21 bp, Homo sapiens
tgtaactacaaagctttgcta

SEQ ID NO: 1614029 - DNA, 22 bp, Homo sapiens
tgtaactacaaagctttgctac

SEQ ID NO: 1614030 - DNA, 18 bp, Homo sapiens
tgtaactactttataact

SEQ ID NO: 1614031 - DNA, 13 bp, Homo sapiens
tgtaactccacca

SEQ ID NO: 1614032 - DNA, 12 bp, Homo sapiens
tgtaactctaaa

SEQ ID NO: 1614033 - DNA, 19 bp, Homo sapiens
tgtaactctaaaagatcct

SEQ ID NO: 1614034 - DNA, 20 bp, Homo sapiens
tgtaactctaaaagatcctt

SEQ ID NO: 1614035 - DNA, 12 bp, Homo sapiens
tgtaactgctga

SEQ ID NO: 1614036 - DNA, 21 bp, Homo sapiens
tgtaactggcagttttccatt

SEQ ID NO: 1614037 - DNA, 23 bp, Homo sapiens
tgtaactgtcagccgggccctga

SEQ ID NO: 1614038 - DNA, 18 bp, Homo sapiens
tgtaacttatattgaaga

SEQ ID NO: 1614039 - DNA, 22 bp, Homo sapiens
tgtaacttattccaagtgcatt

SEQ ID NO: 1614040 - DNA, 13 bp, Homo sapiens
tgtaacttcctgc

SEQ ID NO: 1614041 - DNA, 16 bp, Homo sapiens
tgtaacttcctgctgc

SEQ ID NO: 1614042 - DNA, 17 bp, Homo sapiens
tgtaacttcctgctgca

SEQ ID NO: 1614043 - DNA, 22 bp, Homo sapiens
tgtaacttgcttaaatttctta

SEQ ID NO: 1614044 - DNA, 16 bp, Homo sapiens
tgtaacttttgtaaga

SEQ ID NO: 1614045 - DNA, 12 bp, Homo sapiens
tgtaagaactgt

SEQ ID NO: 1614046 - DNA, 13 bp, Homo sapiens
tgtaagaactgta

SEQ ID NO: 1614047 - DNA, 21 bp, Homo sapiens
tgtaagaactgtacattgtga

SEQ ID NO: 1614048 - DNA, 15 bp, Homo sapiens
tgtaagacatttgta

SEQ ID NO: 1614049 - DNA, 21 bp, Homo sapiens
tgtaagacatttgtatattgt

SEQ ID NO: 1614050 - DNA, 19 bp, Homo sapiens
tgtaagagaaaatattact

SEQ ID NO: 1614051 - DNA, 17 bp, Homo sapiens
tgtaagatgctgggttg

SEQ ID NO: 1614052 - DNA, 18 bp, Homo sapiens
tgtaagattatagattct

SEQ ID NO: 1614053 - DNA, 19 bp, Homo sapiens
tgtaagattatagattcta

SEQ ID NO: 1614054 - DNA, 20 bp, Homo sapiens
tgtaagattatagattctaa

SEQ ID NO: 1614055 - DNA, 21 bp, Homo sapiens
tgtaagattatagattctaaa

SEQ ID NO: 1614056 - DNA, 23 bp, Homo sapiens
tgtaagattatagattctaaaga

SEQ ID NO: 1614057 - DNA, 21 bp, Homo sapiens
tgtaaggatccggaaagaaga

SEQ ID NO: 1614058 - DNA, 22 bp, Homo sapiens
tgtaaggccaagtacactgaga

SEQ ID NO: 1614059 - DNA, 22 bp, Homo sapiens
tgtaaggtgttcagtagagcta

SEQ ID NO: 1614060 - DNA, 19 bp, Homo sapiens
tgtaaggttgtgcagggtg

SEQ ID NO: 1614061 - DNA, 14 bp, Homo sapiens
tgtaagtaattatc

SEQ ID NO: 1614062 - DNA, 22 bp, Homo sapiens
tgtaagtcatctacttaataaa

SEQ ID NO: 1614063 - DNA, 23 bp, Homo sapiens
tgtaagtcatctacttaataaat

SEQ ID NO: 1614064 - DNA, 15 bp, Homo sapiens
tgtaagtgaaattaa

SEQ ID NO: 1614065 - DNA, 14 bp, Homo sapiens
tgtaagtgtgagta

SEQ ID NO: 1614066 - DNA, 17 bp, Homo sapiens
tggtgaggggctttctc

SEQ ID NO: 1614067 - DNA, 18 bp, Homo sapiens
tggtgagtcttggcggca

SEQ ID NO: 1614068 - DNA, 15 bp, Homo sapiens
tggtgagttaggaac

SEQ ID NO: 1614069 - DNA, 18 bp, Homo sapiens
tggtgatcaattaaatgt

SEQ ID NO: 1614070 - DNA, 18 bp, Homo sapiens
tggtgatctgtagacttc

SEQ ID NO: 1614071 - DNA, 21 bp, Homo sapiens
tggtgatctgtagacttctgg

SEQ ID NO: 1614072 - DNA, 20 bp, Homo sapiens
tggtgatttgaaaaatataa

SEQ ID NO: 1614073 - DNA, 12 bp, Homo sapiens
tggtgattttaa

SEQ ID NO: 1614074 - DNA, 18 bp, Homo sapiens
tggtgcaaattcagaact

SEQ ID NO: 1614075 - DNA, 21 bp, Homo sapiens
tggtgcaagtagcacatggtt

SEQ ID NO: 1614076 - DNA, 20 bp, Homo sapiens
tggtgcacgcaggcacagca

SEQ ID NO: 1614077 - DNA, 19 bp, Homo sapiens
tggtgcagaggtttcttga

SEQ ID NO: 1614078 - DNA, 17 bp, Homo sapiens
tggtgcagggcctccat

SEQ ID NO: 1614079 - DNA, 13 bp, Homo sapiens
tggtgcatgggct

SEQ ID NO: 1614080 - DNA, 14 bp, Homo sapiens
tggtgcattgttat

SEQ ID NO: 1614081 - DNA, 14 bp, Homo sapiens
tggtgccagccttc

SEQ ID NO: 1614082 - DNA, 21 bp, Homo sapiens
tggtgccagccttcctctgca

SEQ ID NO: 1614083 - DNA, 16 bp, Homo sapiens
tggtgccatccccagg

SEQ ID NO: 1614084 - DNA, 15 bp, Homo sapiens
tggtgccccacctgc

SEQ ID NO: 1614085 - DNA, 23 bp, Homo sapiens
tggtgccccacctgcctggtgca

SEQ ID NO: 1614086 - DNA, 14 bp, Homo sapiens
tggtgccccaggac

SEQ ID NO: 1614087 - DNA, 23 bp, Homo sapiens
tggtgcctatatctgagagacct

SEQ ID NO: 1614088 - DNA, 14 bp, Homo sapiens
tggtgcctgagagg

SEQ ID NO: 1614089 - DNA, 12 bp, Homo sapiens
tggtgcctggcc

SEQ ID NO: 1614090 - DNA, 13 bp, Homo sapiens
tggtgcctggcct

SEQ ID NO: 1614091 - DNA, 22 bp, Homo sapiens
tggtgcctggcctggcacacat

SEQ ID NO: 1614092 - DNA, 24 bp, Homo sapiens
tggtgcctggcctggcacacatca

SEQ ID NO: 1614093 - DNA, 14 bp, Homo sapiens
tggtgcgacccccc

SEQ ID NO: 1614094 - DNA, 13 bp, Homo sapiens
tggtgcgggcctg

SEQ ID NO: 1614095 - DNA, 16 bp, Homo sapiens
tggtgcgggcctggcc

SEQ ID NO: 1614096 - DNA, 16 bp, Homo sapiens
tggtgctcttttttct

SEQ ID NO: 1614097 - DNA, 18 bp, Homo sapiens
tggtgctgcccaggcctc

SEQ ID NO: 1614098 - DNA, 13 bp, Homo sapiens
tggtgctgggact

SEQ ID NO: 1614099 - DNA, 14 bp, Homo sapiens
tggtgctgggactg

SEQ ID NO: 1614100 - DNA, 14 bp, Homo sapiens
tggtgctgtgtgcc

SEQ ID NO: 1614101 - DNA, 13 bp, Homo sapiens
tggtgctgtttaa

SEQ ID NO: 1614102 - DNA, 19 bp, Homo sapiens
tggtgcttccaaatattgt

SEQ ID NO: 1614103 - DNA, 18 bp, Homo sapiens
tggtggaaaacgaagctc

SEQ ID NO: 1614104 - DNA, 15 bp, Homo sapiens
tggtggaattcctct

SEQ ID NO: 1614105 - DNA, 19 bp, Homo sapiens
tggtggaccacaggcatct

SEQ ID NO: 1614106 - DNA, 16 bp, Homo sapiens
tggtggagcagccaga

SEQ ID NO: 1614107 - DNA, 14 bp, Homo sapiens
tggtggagccaggg

SEQ ID NO: 1614108 - DNA, 12 bp, Homo sapiens
tggtggatgtga

SEQ ID NO: 1614109 - DNA, 19 bp, Homo sapiens
tggtggcagtggaggtggg

SEQ ID NO: 1614110 - DNA, 10 bp, Homo sapiens
tggtggcatg

SEQ ID NO: 1614111 - DNA, 21 bp, Homo sapiens
tggtggccctgtgcctgggcc

SEQ ID NO: 1614112 - DNA, 16 bp, Homo sapiens
tggtggcctggtccct

SEQ ID NO: 1614113 - DNA, 16 bp, Homo sapiens
tggtggctcatgcctg

SEQ ID NO: 1614114 - DNA, 22 bp, Homo sapiens
tggtggctccccctctgcttct

SEQ ID NO: 1614115 - DNA, 22 bp, Homo sapiens
tggtggcttaagtgagcagaac

SEQ ID NO: 1614116 - DNA, 17 bp, Homo sapiens
tggtgggagcacctgcc

SEQ ID NO: 1614117 - DNA, 22 bp, Homo sapiens
tggtgggcaggatctcaagcca

SEQ ID NO: 1614118 - DNA, 20 bp, Homo sapiens
tggtgggccaacaaagaaca

SEQ ID NO: 1614119 - DNA, 13 bp, Homo sapiens
tggtggggagggg

SEQ ID NO: 1614120 - DNA, 16 bp, Homo sapiens
tggtggggctgagcct

SEQ ID NO: 1614121 - DNA, 13 bp, Homo sapiens
tggtggggggcag

SEQ ID NO: 1614122 - DNA, 17 bp, Homo sapiens
tggtgggggtagagctg

SEQ ID NO: 1614123 - DNA, 18 bp, Homo sapiens
tggtgggggtagagctga

SEQ ID NO: 1614124 - DNA, 21 bp, Homo sapiens
tggtgggggtagagctgatcc

SEQ ID NO: 1614125 - DNA, 22 bp, Homo sapiens
tggtgggtaattgtacaataaa

SEQ ID NO: 1614126 - DNA, 23 bp, Homo sapiens
tggtgggtaattgtacaataaat

SEQ ID NO: 1614127 - DNA, 18 bp, Homo sapiens
tggtgggtcagcccagca

SEQ ID NO: 1614128 - DNA, 20 bp, Homo sapiens
tggtgggtcagcccagcacc

SEQ ID NO: 1614129 - DNA, 22 bp, Homo sapiens
tggtgggtctatgttccccagg

SEQ ID NO: 1614130 - DNA, 14 bp, Homo sapiens
tggtggtactttat

SEQ ID NO: 1614131 - DNA, 12 bp, Homo sapiens
tggtggtgggga

SEQ ID NO: 1614132 - DNA, 15 bp, Homo sapiens
tggtggttattttaa

SEQ ID NO: 1614133 - DNA, 17 bp, Homo sapiens
tggtgtagctgtcctct

SEQ ID NO: 1614134 - DNA, 13 bp, Homo sapiens
tggtgtagtcttt

SEQ ID NO: 1614135 - DNA, 14 bp, Homo sapiens
tggtgtccacctgg

SEQ ID NO: 1614136 - DNA, 15 bp, Homo sapiens
tggtgtccacctggc

SEQ ID NO: 1614137 - DNA, 13 bp, Homo sapiens
tggtgtccagctg

SEQ ID NO: 1614138 - DNA, 17 bp, Homo sapiens
tggtgtccagctgagtt

SEQ ID NO: 1614139 - DNA, 16 bp, Homo sapiens
tggtgtcctgaagctg

SEQ ID NO: 1614140 - DNA, 14 bp, Homo sapiens
tggtgtcctgacca

SEQ ID NO: 1614141 - DNA, 15 bp, Homo sapiens
tggtgtcctgaccac

SEQ ID NO: 1614142 - DNA, 20 bp, Homo sapiens
tggtgtcctgaccaccctcc

SEQ ID NO: 1614143 - DNA, 21 bp, Homo sapiens
tggtgtcctgaccaccctccc

SEQ ID NO: 1614144 - DNA, 11 bp, Homo sapiens
tggtgtcttcc

SEQ ID NO: 1614145 - DNA, 16 bp, Homo sapiens
tggtgtgaacccggga

SEQ ID NO: 1614146 - DNA, 17 bp, Homo sapiens
tggtgtgaacccgggag

SEQ ID NO: 1614147 - DNA, 19 bp, Homo sapiens
tggtgtgaccatgttcatt

SEQ ID NO: 1614148 - DNA, 15 bp, Homo sapiens
tggtgtgggtgtcct

SEQ ID NO: 1614149 - DNA, 22 bp, Homo sapiens
tggtgtgggtgtcctgcctgtc

SEQ ID NO: 1614150 - DNA, 16 bp, Homo sapiens
tggtgtgtccctggac

SEQ ID NO: 1614151 - DNA, 19 bp, Homo sapiens
tggtgtgtccctggacaca

SEQ ID NO: 1614152 - DNA, 13 bp, Homo sapiens
tggtgttcctgaa

SEQ ID NO: 1614153 - DNA, 17 bp, Homo sapiens
tggtgttcctggaagca

SEQ ID NO: 1614154 - DNA, 22 bp, Homo sapiens
tggtgttttgcacttctgtaaa

SEQ ID NO: 1614155 - DNA, 23 bp, Homo sapiens
tggtgttttgcacttctgtaaac

SEQ ID NO: 1614156 - DNA, 13 bp, Homo sapiens
tggtgttttgtca

SEQ ID NO: 1614157 - DNA, 15 bp, Homo sapiens
tggttaaaaacctgc

SEQ ID NO: 1614158 - DNA, 17 bp, Homo sapiens
tggttaaaaaggccaaa

SEQ ID NO: 1614159 - DNA, 17 bp, Homo sapiens
tggttaaaataaagcct

SEQ ID NO: 1614160 - DNA, 13 bp, Homo sapiens
tggttaagagtcc

SEQ ID NO: 1614161 - DNA, 20 bp, Homo sapiens
tggttaaggccagggcctct

SEQ ID NO: 1614162 - DNA, 21 bp, Homo sapiens
tggttaaggccagggcctctc

SEQ ID NO: 1614163 - DNA, 21 bp, Homo sapiens
tggttaatttttcctgcatgt

SEQ ID NO: 1614164 - DNA, 16 bp, Homo sapiens
tggttaccactctttt

SEQ ID NO: 1614165 - DNA, 18 bp, Homo sapiens
tggttacttcttctctta

SEQ ID NO: 1614166 - DNA, 13 bp, Homo sapiens
tggttagaaatgc

SEQ ID NO: 1614167 - DNA, 23 bp, Homo sapiens
tggttagacgccttccaggtcag

SEQ ID NO: 1614168 - DNA, 15 bp, Homo sapiens
tggttagaggaaggc

SEQ ID NO: 1614169 - DNA, 18 bp, Homo sapiens
tggttattggactccagg

SEQ ID NO: 1614170 - DNA, 22 bp, Homo sapiens
tggttatttagggaactgcttg

SEQ ID NO: 1614171 - DNA, 20 bp, Homo sapiens
tggttcagaattaaactttt

SEQ ID NO: 1614172 - DNA, 21 bp, Homo sapiens
tggttcagaattaaactttta

SEQ ID NO: 1614173 - DNA, 16 bp, Homo sapiens
tggttcatcagtgtta

SEQ ID NO: 1614174 - DNA, 18 bp, Homo sapiens
tggttcatgcagacaaag

SEQ ID NO: 1614175 - DNA, 19 bp, Homo sapiens
tggttccatgcctgagggt

SEQ ID NO: 1614176 - DNA, 22 bp, Homo sapiens
tggttccatgcctgagggtgga

SEQ ID NO: 1614177 - DNA, 15 bp, Homo sapiens
tggttcccaataaaa

SEQ ID NO: 1614178 - DNA, 16 bp, Homo sapiens
tggttcccaataaaag

SEQ ID NO: 1614179 - DNA, 21 bp, Homo sapiens
tggttcccaataaaagtgact

SEQ ID NO: 1614180 - DNA, 19 bp, Homo sapiens
tggttcccctgttcactct

SEQ ID NO: 1614181 - DNA, 16 bp, Homo sapiens
tggttccttccctggg

SEQ ID NO: 1614182 - DNA, 17 bp, Homo sapiens
tggttccttctctgggt

SEQ ID NO: 1614183 - DNA, 21 bp, Homo sapiens
gtcctgctctcttcaggaggc

SEQ ID NO: 1614184 - DNA, 21 bp, Homo sapiens
gtcctggaagcgcgagggcct

SEQ ID NO: 1614185 - DNA, 16 bp, Homo sapiens
gtcctggaatttggac

SEQ ID NO: 1614186 - DNA, 20 bp, Homo sapiens
gtcctggacaccgggccagt

SEQ ID NO: 1614187 - DNA, 15 bp, Homo sapiens
gtcctggcccttcag

SEQ ID NO: 1614188 - DNA, 16 bp, Homo sapiens
gtcctggcccttcagt

SEQ ID NO: 1614189 - DNA, 18 bp, Homo sapiens
gtcctggcccttcagtct

SEQ ID NO: 1614190 - DNA, 20 bp, Homo sapiens
gtcctggcccttcagtctgc

SEQ ID NO: 1614191 - DNA, 22 bp, Homo sapiens
gtcctggccttgtgtcactggc

SEQ ID NO: 1614192 - DNA, 20 bp, Homo sapiens
gtcctgggagaacctcaggc

SEQ ID NO: 1614193 - DNA, 13 bp, Homo sapiens
gtcctgggcaggt

SEQ ID NO: 1614194 - DNA, 16 bp, Homo sapiens
gtcctgggcaggtggg

SEQ ID NO: 1614195 - DNA, 21 bp, Homo sapiens
gtcctgggcaggtgggagctg

SEQ ID NO: 1614196 - DNA, 19 bp, Homo sapiens
gtcctgggcatgggtccag

SEQ ID NO: 1614197 - DNA, 14 bp, Homo sapiens
gtcctgggcctgcc

SEQ ID NO: 1614198 - DNA, 15 bp, Homo sapiens
gtcctgggcctgccc

SEQ ID NO: 1614199 - DNA, 22 bp, Homo sapiens
gtcctggggcctcggagcctca

SEQ ID NO: 1614200 - DNA, 17 bp, Homo sapiens
gtcctggggctctgtgc

SEQ ID NO: 1614201 - DNA, 14 bp, Homo sapiens
gtcctggtcctggc

SEQ ID NO: 1614202 - DNA, 15 bp, Homo sapiens
gtcctggtgctctct

SEQ ID NO: 1614203 - DNA, 19 bp, Homo sapiens
gtcctggtgctctctgcca

SEQ ID NO: 1614204 - DNA, 19 bp, Homo sapiens
gtcctggtggctgggccca

SEQ ID NO: 1614205 - DNA, 16 bp, Homo sapiens
ttaagattataattgt

SEQ ID NO: 1614206 - DNA, 18 bp, Homo sapiens
ttaagattctctgcccag

SEQ ID NO: 1614207 - DNA, 16 bp, Homo sapiens
ttaagattggaaatgt

SEQ ID NO: 1614208 - DNA, 22 bp, Homo sapiens
ttaagcaaacgtctattttgta

SEQ ID NO: 1614209 - DNA, 19 bp, Homo sapiens
ttaagcaaaggctccctcg

SEQ ID NO: 1614210 - DNA, 22 bp, Homo sapiens
ttaagcaaggtgtccctgcctt

SEQ ID NO: 1614211 - DNA, 17 bp, Homo sapiens
ttaagcagaacaaatgt

SEQ ID NO: 1614212 - DNA, 21 bp, Homo sapiens
ttaagcagatggaatgctgtg

SEQ ID NO: 1614213 - DNA, 15 bp, Homo sapiens
ttaagcagcatggaa

SEQ ID NO: 1614214 - DNA, 18 bp, Homo sapiens
ttaagcagtaaaaactgt

SEQ ID NO: 1614215 - DNA, 18 bp, Homo sapiens
ttaagcatgtcaattcat

SEQ ID NO: 1614216 - DNA, 16 bp, Homo sapiens
ttaagccaaagaaaca

SEQ ID NO: 1614217 - DNA, 17 bp, Homo sapiens
ttaagccaaagaaacaa

SEQ ID NO: 1614218 - DNA, 20 bp, Homo sapiens
ttaagcccagtgcactgaaa

SEQ ID NO: 1614219 - DNA, 17 bp, Homo sapiens
ttaagcctgaagagctt

SEQ ID NO: 1614220 - DNA, 14 bp, Homo sapiens
ttaagccttacaaa

SEQ ID NO: 1614221 - DNA, 16 bp, Homo sapiens
ttaagccttcaaaact

SEQ ID NO: 1614222 - DNA, 14 bp, Homo sapiens
ttaagctacttatt

SEQ ID NO: 1614223 - DNA, 14 bp, Homo sapiens
ttaagctttttgga

SEQ ID NO: 1614224 - DNA, 17 bp, Homo sapiens
ttaaggagaatcatgtt

SEQ ID NO: 1614225 - DNA, 22 bp, Homo sapiens
ttaaggagaatcatgtttcttt

SEQ ID NO: 1614226 - DNA, 12 bp, Homo sapiens
ttaaggagctgg

SEQ ID NO: 1614227 - DNA, 14 bp, Homo sapiens
ttaaggataaatca

SEQ ID NO: 1614228 - DNA, 22 bp, Homo sapiens
tttctaaccttgaatgctgcca

SEQ ID NO: 1614229 - DNA, 15 bp, Homo sapiens
tttctaagattctaa

SEQ ID NO: 1614230 - DNA, 21 bp, Homo sapiens
tttctaataaacttggattct

SEQ ID NO: 1614231 - DNA, 15 bp, Homo sapiens
tttctaatacgagcc

SEQ ID NO: 1614232 - DNA, 19 bp, Homo sapiens
tttctaatccttttcctta

SEQ ID NO: 1614233 - DNA, 22 bp, Homo sapiens
tttctaatgccttttgaataca

SEQ ID NO: 1614234 - DNA, 14 bp, Homo sapiens
tttctaatgtttct

SEQ ID NO: 1614235 - DNA, 22 bp, Homo sapiens
tttctaattcctgttgctctgt

SEQ ID NO: 1614236 - DNA, 21 bp, Homo sapiens
tttctacaattaatagtttgt

SEQ ID NO: 1614237 - DNA, 12 bp, Homo sapiens
tttctacagaga

SEQ ID NO: 1614238 - DNA, 12 bp, Homo sapiens
tttctactttgc

SEQ ID NO: 1614239 - DNA, 18 bp, Homo sapiens
tttctagaacagtaaaag

SEQ ID NO: 1614240 - DNA, 21 bp, Homo sapiens
tttctagaggtgctacatagt

SEQ ID NO: 1614241 - DNA, 17 bp, Homo sapiens
tttctagcaaatatgct

SEQ ID NO: 1614242 - DNA, 23 bp, Homo sapiens
tttctagctataacaactctatt

SEQ ID NO: 1614243 - DNA, 21 bp, Homo sapiens
tttctagctgttgagctgttt

SEQ ID NO: 1614244 - DNA, 14 bp, Homo sapiens
tttctagggaaatg

SEQ ID NO: 1614245 - DNA, 13 bp, Homo sapiens
tttctataaatca

SEQ ID NO: 1614246 - DNA, 14 bp, Homo sapiens
tttctatactgttt

SEQ ID NO: 1614247 - DNA, 13 bp, Homo sapiens
tttctatatcaaa

SEQ ID NO: 1614248 - DNA, 15 bp, Homo sapiens
tttctatgtagaact

SEQ ID NO: 1614249 - DNA, 17 bp, Homo sapiens
tttctatgtagaactgt

SEQ ID NO: 1614250 - DNA, 19 bp, Homo sapiens
tttctatgtagaactgttc

SEQ ID NO: 1614251 - DNA, 21 bp, Homo sapiens
tttctatgtgttgtgtttgta

SEQ ID NO: 1614252 - DNA, 22 bp, Homo sapiens
tttctattaaattaaattttgt

SEQ ID NO: 1614253 - DNA, 22 bp, Homo sapiens
tttctattaatatcaactctga

SEQ ID NO: 1614254 - DNA, 15 bp, Homo sapiens
tttctattttaagac

SEQ ID NO: 1614255 - DNA, 19 bp, Homo sapiens
tttctcacattgctgtatt

SEQ ID NO: 1614256 - DNA, 20 bp, Homo sapiens
tttctcagaatccaaagatc

SEQ ID NO: 1614257 - DNA, 20 bp, Homo sapiens
tttctcagatccttgtttca

SEQ ID NO: 1614258 - DNA, 21 bp, Homo sapiens
tttctcagattcctttgtatc

SEQ ID NO: 1614259 - DNA, 17 bp, Homo sapiens
tttctcagtgttggtat

SEQ ID NO: 1614260 - DNA, 14 bp, Homo sapiens
tttctcatgaagct

SEQ ID NO: 1614261 - DNA, 20 bp, Homo sapiens
tttctccaatatcagtgctc

SEQ ID NO: 1614262 - DNA, 13 bp, Homo sapiens
tttctccacactc

SEQ ID NO: 1614263 - DNA, 15 bp, Homo sapiens
tttctccatctttat

SEQ ID NO: 1614264 - DNA, 16 bp, Homo sapiens
tttctcccaagaaacc

SEQ ID NO: 1614265 - DNA, 19 bp, Homo sapiens
tttctcccaagaaacctga

SEQ ID NO: 1614266 - DNA, 21 bp, Homo sapiens
tttctcccagcttcaaatgca

SEQ ID NO: 1614267 - DNA, 20 bp, Homo sapiens
tttctcccaggccaggctcc

SEQ ID NO: 1614268 - DNA, 21 bp, Homo sapiens
tttctcccccgacactgctgc

SEQ ID NO: 1614269 - DNA, 13 bp, Homo sapiens
tttctccccctgg

SEQ ID NO: 1614270 - DNA, 13 bp, Homo sapiens
tttctcccctgcc

SEQ ID NO: 1614271 - DNA, 14 bp, Homo sapiens
tttctcccctgccc

SEQ ID NO: 1614272 - DNA, 16 bp, Homo sapiens
tttctcccctgccccc

SEQ ID NO: 1614273 - DNA, 24 bp, Homo sapiens
tttctcccctgcccccaggactgg

SEQ ID NO: 1614274 - DNA, 15 bp, Homo sapiens
tttctccctcacccc

SEQ ID NO: 1614275 - DNA, 14 bp, Homo sapiens
tttctccttgaaat

SEQ ID NO: 1614276 - DNA, 19 bp, Homo sapiens
tttctcctttaattgtaaa

SEQ ID NO: 1614277 - DNA, 14 bp, Homo sapiens
tttctcctttacca

SEQ ID NO: 1614278 - DNA, 15 bp, Homo sapiens
tttctcgacagatga

SEQ ID NO: 1614279 - DNA, 23 bp, Homo sapiens
tttctctaatgttgtatcatact

SEQ ID NO: 1614280 - DNA, 15 bp, Homo sapiens
tttctctacactaag

SEQ ID NO: 1614281 - DNA, 10 bp, Homo sapiens
tttctctctg

SEQ ID NO: 1614282 - DNA, 20 bp, Homo sapiens
tttctctctggcttctctct

SEQ ID NO: 1614283 - DNA, 21 bp, Homo sapiens
tttctctgcagaaactactga

SEQ ID NO: 1614284 - DNA, 11 bp, Homo sapiens
tttctctgcca

SEQ ID NO: 1614285 - DNA, 16 bp, Homo sapiens
tttctctgtacttttc

SEQ ID NO: 1614286 - DNA, 14 bp, Homo sapiens
tttctctgttgtaa

SEQ ID NO: 1614287 - DNA, 11 bp, Homo sapiens
tttctcttcac

SEQ ID NO: 1614288 - DNA, 15 bp, Homo sapiens
tttctcttccccttc

SEQ ID NO: 1614289 - DNA, 18 bp, Homo sapiens
tttctcttccccttcctg

SEQ ID NO: 1614290 - DNA, 14 bp, Homo sapiens
tttctcttccctga

SEQ ID NO: 1614291 - DNA, 19 bp, Homo sapiens
tttctcttcccttcccaga

SEQ ID NO: 1614292 - DNA, 15 bp, Homo sapiens
tttctcttcctaaat

SEQ ID NO: 1614293 - DNA, 12 bp, Homo sapiens
tttctcttgtac

SEQ ID NO: 1614294 - DNA, 14 bp, Homo sapiens
tttctcttgtcctt

SEQ ID NO: 1614295 - DNA, 13 bp, Homo sapiens
tttctcttttctt

SEQ ID NO: 1614296 - DNA, 17 bp, Homo sapiens
tttctgaactctgacag

SEQ ID NO: 1614297 - DNA, 18 bp, Homo sapiens
tttctgaattggaaggga

SEQ ID NO: 1614298 - DNA, 13 bp, Homo sapiens
tttctgacagttt

SEQ ID NO: 1614299 - DNA, 14 bp, Homo sapiens
tttctgactcttat

SEQ ID NO: 1614300 - DNA, 16 bp, Homo sapiens
tttctgagcacacttt

SEQ ID NO: 1614301 - DNA, 15 bp, Homo sapiens
tttgagatgtaaaaa

SEQ ID NO: 1614302 - DNA, 23 bp, Homo sapiens
tttgagattaagaatgccaggaa

SEQ ID NO: 1614303 - DNA, 15 bp, Homo sapiens
tttgagcccttgttt

SEQ ID NO: 1614304 - DNA, 19 bp, Homo sapiens
tttgagctattcacctcag

SEQ ID NO: 1614305 - DNA, 22 bp, Homo sapiens
tttgagctcagccccaactctt

SEQ ID NO: 1614306 - DNA, 21 bp, Homo sapiens
tttgagctgaaatgctgcatt

SEQ ID NO: 1614307 - DNA, 17 bp, Homo sapiens
tttgagctgccttccct

SEQ ID NO: 1614308 - DNA, 13 bp, Homo sapiens
tttgagctttcat

SEQ ID NO: 1614309 - DNA, 17 bp, Homo sapiens
tttgaggaaatttgcag

SEQ ID NO: 1614310 - DNA, 20 bp, Homo sapiens
tttgaggaattatcatggga

SEQ ID NO: 1614311 - DNA, 21 bp, Homo sapiens
tttgaggaattatcatgggaa

SEQ ID NO: 1614312 - DNA, 22 bp, Homo sapiens
tttgaggatatattttcacttt

SEQ ID NO: 1614313 - DNA, 16 bp, Homo sapiens
tttgaggcttaaacaa

SEQ ID NO: 1614314 - DNA, 17 bp, Homo sapiens
tttgagggcatgaagct

SEQ ID NO: 1614315 - DNA, 16 bp, Homo sapiens
tttgaggggaaaacac

SEQ ID NO: 1614316 - DNA, 18 bp, Homo sapiens
tttgaggttttgtaaaac

SEQ ID NO: 1614317 - DNA, 22 bp, Homo sapiens
tttgaggttttgtaaaactgtt

SEQ ID NO: 1614318 - DNA, 14 bp, Homo sapiens
tttgagtaaatatt

SEQ ID NO: 1614319 - DNA, 14 bp, Homo sapiens
tttgagtaatgtga

SEQ ID NO: 1614320 - DNA, 13 bp, Homo sapiens
tttgagtacagat

SEQ ID NO: 1614321 - DNA, 21 bp, Homo sapiens
tttgagtcctaggacttaaaa

SEQ ID NO: 1614322 - DNA, 17 bp, Homo sapiens
tttgagtgccaatttct

SEQ ID NO: 1614323 - DNA, 16 bp, Homo sapiens
tttgagtggatgatgt

SEQ ID NO: 1614324 - DNA, 19 bp, Homo sapiens
tttgagttattttaattat

SEQ ID NO: 1614325 - DNA, 17 bp, Homo sapiens
tttgagttggctttgct

SEQ ID NO: 1614326 - DNA, 15 bp, Homo sapiens
tttgataaagtttct

SEQ ID NO: 1614327 - DNA, 14 bp, Homo sapiens
tttgatacataata

SEQ ID NO: 1614328 - DNA, 15 bp, Homo sapiens
tttgatacataataa

SEQ ID NO: 1614329 - DNA, 23 bp, Homo sapiens
tttgatacataataaaaaattat

SEQ ID NO: 1614330 - DNA, 14 bp, Homo sapiens
tttgatacattttt

SEQ ID NO: 1614331 - DNA, 21 bp, Homo sapiens
tttgatataccaaattaaaaa

SEQ ID NO: 1614332 - DNA, 22 bp, Homo sapiens
tttgatataccaaattaaaaaa

SEQ ID NO: 1614333 - DNA, 23 bp, Homo sapiens
tttgatatccaaagctgaataca

SEQ ID NO: 1614334 - DNA, 19 bp, Homo sapiens
tttgatcatgaataactga

SEQ ID NO: 1614335 - DNA, 16 bp, Homo sapiens
tttgatccttcccctc

SEQ ID NO: 1614336 - DNA, 14 bp, Homo sapiens
tttgatctcacatt

SEQ ID NO: 1614337 - DNA, 18 bp, Homo sapiens
tttgatctcacattttta

SEQ ID NO: 1614338 - DNA, 22 bp, Homo sapiens
tttgatgcatgtcttttaaaat

SEQ ID NO: 1614339 - DNA, 17 bp, Homo sapiens
tttgatggggagaaagg

SEQ ID NO: 1614340 - DNA, 14 bp, Homo sapiens
tttgatggtggtat

SEQ ID NO: 1614341 - DNA, 14 bp, Homo sapiens
tttgatgtacatgt

SEQ ID NO: 1614342 - DNA, 12 bp, Homo sapiens
tttgatgtatgt

SEQ ID NO: 1614343 - DNA, 14 bp, Homo sapiens
tttgatgtatgtgt

SEQ ID NO: 1614344 - DNA, 19 bp, Homo sapiens
tttgatgtttgtggcctca

SEQ ID NO: 1614345 - DNA, 13 bp, Homo sapiens
tttgattaacaat

SEQ ID NO: 1614346 - DNA, 16 bp, Homo sapiens
tttgattaacaatgta

SEQ ID NO: 1614347 - DNA, 20 bp, Homo sapiens
tttgattaacaatgtatttt

SEQ ID NO: 1614348 - DNA, 23 bp, Homo sapiens
tttgattattatgtttattacaa

SEQ ID NO: 1614349 - DNA, 12 bp, Homo sapiens
tttgattctcct

SEQ ID NO: 1614350 - DNA, 14 bp, Homo sapiens
tttgattctccttc

SEQ ID NO: 1614351 - DNA, 16 bp, Homo sapiens
tttgattctccttcag

SEQ ID NO: 1614352 - DNA, 21 bp, Homo sapiens
tttgattctccttcagccctc

SEQ ID NO: 1614353 - DNA, 17 bp, Homo sapiens
tttgattgggatgaatg

SEQ ID NO: 1614354 - DNA, 17 bp, Homo sapiens
tttgatttataaaactt

SEQ ID NO: 1614355 - DNA, 12 bp, Homo sapiens
tttgatttcaac

SEQ ID NO: 1614356 - DNA, 12 bp, Homo sapiens
tttgatttctaa

SEQ ID NO: 1614357 - DNA, 14 bp, Homo sapiens
tttgatttctaatt

SEQ ID NO: 1614358 - DNA, 16 bp, Homo sapiens
tttgatttctaattgt

SEQ ID NO: 1614359 - DNA, 19 bp, Homo sapiens
tttgcaaacccgaaaataa

SEQ ID NO: 1614360 - DNA, 14 bp, Homo sapiens
tttgcaaataggca

SEQ ID NO: 1614361 - DNA, 15 bp, Homo sapiens
tttgcacaaggaaat

SEQ ID NO: 1614362 - DNA, 12 bp, Homo sapiens
tttgcacatgtg

SEQ ID NO: 1614363 - DNA, 13 bp, Homo sapiens
tttgcacatgtga

SEQ ID NO: 1614364 - DNA, 14 bp, Homo sapiens
tttgcacatgtgac

SEQ ID NO: 1614365 - DNA, 22 bp, Homo sapiens
tttgcacattttgtggctgttg

SEQ ID NO: 1614366 - DNA, 16 bp, Homo sapiens
tttgcaccaaagacat

SEQ ID NO: 1614367 - DNA, 12 bp, Homo sapiens
tttgcacccctc

SEQ ID NO: 1614368 - DNA, 13 bp, Homo sapiens
tttgcacctgtcc

SEQ ID NO: 1614369 - DNA, 14 bp, Homo sapiens
tttgcactaaatca

SEQ ID NO: 1614370 - DNA, 19 bp, Homo sapiens
tttgcactaaatcagagac

SEQ ID NO: 1614371 - DNA, 13 bp, Homo sapiens
tttgcactgtaat

SEQ ID NO: 1614372 - DNA, 17 bp, Homo sapiens
tttgcactgtatgctgg

SEQ ID NO: 1614373 - DNA, 21 bp, Homo sapiens
tttgcacttgtgattatttat

SEQ ID NO: 1614374 - DNA, 16 bp, Homo sapiens
tttgcaggattccctt

SEQ ID NO: 1614375 - DNA, 18 bp, Homo sapiens
tttgcaggattcccttct

SEQ ID NO: 1614376 - DNA, 22 bp, Homo sapiens
tttgcagggtcctcttctgggc

SEQ ID NO: 1614377 - DNA, 12 bp, Homo sapiens
tttgcagtaact

SEQ ID NO: 1614378 - DNA, 14 bp, Homo sapiens
tttgcagtaactgt

SEQ ID NO: 1614379 - DNA, 17 bp, Homo sapiens
tttgcagtaactgtttt

SEQ ID NO: 1614380 - DNA, 21 bp, Homo sapiens
tttgcatagattccctgagca

SEQ ID NO: 1614381 - DNA, 13 bp, Homo sapiens
tttgcatattttg

SEQ ID NO: 1614382 - DNA, 21 bp, Homo sapiens
tttgcatattttgagaaactg

SEQ ID NO: 1614383 - DNA, 15 bp, Homo sapiens
gtgtgcaacagacaa

SEQ ID NO: 1614384 - DNA, 14 bp, Homo sapiens
gtgtgcagacagcc

SEQ ID NO: 1614385 - DNA, 12 bp, Homo sapiens
gtgtgcccagca

SEQ ID NO: 1614386 - DNA, 11 bp, Homo sapiens
gtgtgccccac

SEQ ID NO: 1614387 - DNA, 16 bp, Homo sapiens
gtgtgccccactccag

SEQ ID NO: 1614388 - DNA, 14 bp, Homo sapiens
gtgtgcccttgggg

SEQ ID NO: 1614389 - DNA, 13 bp, Homo sapiens
gtgtgcctgcagc

SEQ ID NO: 1614390 - DNA, 16 bp, Homo sapiens
gtgtgcctggttaata

SEQ ID NO: 1614391 - DNA, 16 bp, Homo sapiens
gtgtgcctgtgctcct

SEQ ID NO: 1614392 - DNA, 14 bp, Homo sapiens
gtgtgcgctgcctg

SEQ ID NO: 1614393 - DNA, 15 bp, Homo sapiens
gtgtgcgctgcctgg

SEQ ID NO: 1614394 - DNA, 15 bp, Homo sapiens
gtgtgctaaaaatga

SEQ ID NO: 1614395 - DNA, 12 bp, Homo sapiens
gtgtgctgggag

SEQ ID NO: 1614396 - DNA, 17 bp, Homo sapiens
gtgtgctttttttgtgt

SEQ ID NO: 1614397 - DNA, 18 bp, Homo sapiens
gtgtggagagggaatgtg

SEQ ID NO: 1614398 - DNA, 21 bp, Homo sapiens
gtgtggagagggaatgtgaaa

SEQ ID NO: 1614399 - DNA, 14 bp, Homo sapiens
gtgtggagaggggt

SEQ ID NO: 1614400 - DNA, 11 bp, Homo sapiens
gtgtggagcag

SEQ ID NO: 1614401 - DNA, 19 bp, Homo sapiens
gtgtggagttcaccttgga

SEQ ID NO: 1614402 - DNA, 23 bp, Homo sapiens
gtgtggattgcctctgaaaagtg

SEQ ID NO: 1614403 - DNA, 19 bp, Homo sapiens
gtgtggccgcctggcaggt

SEQ ID NO: 1614404 - DNA, 14 bp, Homo sapiens
gtgtggctccttcc

SEQ ID NO: 1614405 - DNA, 13 bp, Homo sapiens
gtgtggctgcccc

SEQ ID NO: 1614406 - DNA, 15 bp, Homo sapiens
gtgtggctgggacct

SEQ ID NO: 1614407 - DNA, 17 bp, Homo sapiens
gtgtggctgtgggtgtg

SEQ ID NO: 1614408 - DNA, 18 bp, Homo sapiens
gtgtgggacacctgggag

SEQ ID NO: 1614409 - DNA, 19 bp, Homo sapiens
gtgtgggatacttagtggt

SEQ ID NO: 1614410 - DNA, 22 bp, Homo sapiens
gtgtgggatctggggagagcgg

SEQ ID NO: 1614411 - DNA, 14 bp, Homo sapiens
gtgtgggctgccct

SEQ ID NO: 1614412 - DNA, 16 bp, Homo sapiens
gtgtgggggctgcagc

SEQ ID NO: 1614413 - DNA, 19 bp, Homo sapiens
gtgtggggggctgggggag

SEQ ID NO: 1614414 - DNA, 15 bp, Homo sapiens
gtgtgggtctctggg

SEQ ID NO: 1614415 - DNA, 14 bp, Homo sapiens
gtgtgggtgtcctg

SEQ ID NO: 1614416 - DNA, 15 bp, Homo sapiens
gtgtgggttctacag

SEQ ID NO: 1614417 - DNA, 16 bp, Homo sapiens
gtgtggtgaggggctt

SEQ ID NO: 1614418 - DNA, 19 bp, Homo sapiens
gtgtggtggagccagggcc

SEQ ID NO: 1614419 - DNA, 15 bp, Homo sapiens
gtgtggttatgaact

SEQ ID NO: 1614420 - DNA, 18 bp, Homo sapiens
gtgtggttgctcacagct

SEQ ID NO: 1614421 - DNA, 14 bp, Homo sapiens
gtgtgtaatttaaa

SEQ ID NO: 1614422 - DNA, 14 bp, Homo sapiens
gtgtgtagccaagg

SEQ ID NO: 1614423 - DNA, 20 bp, Homo sapiens
gtgtgtatatttgtaatata

SEQ ID NO: 1614424 - DNA, 15 bp, Homo sapiens
gtgtgtatgtggggg

SEQ ID NO: 1614425 - DNA, 16 bp, Homo sapiens
gtgtgtatgtgtgtgt

SEQ ID NO: 1614426 - DNA, 19 bp, Homo sapiens
gtgtgtattcagaggcagt

SEQ ID NO: 1614427 - DNA, 22 bp, Homo sapiens
gtgtgtattcagaggcagtgat

SEQ ID NO: 1614428 - DNA, 15 bp, Homo sapiens
gtgtgtatttgctaa

SEQ ID NO: 1614429 - DNA, 14 bp, Homo sapiens
gtgtgtcaggccct

SEQ ID NO: 1614430 - DNA, 20 bp, Homo sapiens
gtgtgtcaggccctctgcct

SEQ ID NO: 1614431 - DNA, 19 bp, Homo sapiens
gtggctggaggagctggcc

SEQ ID NO: 1614432 - DNA, 20 bp, Homo sapiens
gtggctgggcccagcagggg

SEQ ID NO: 1614433 - DNA, 16 bp, Homo sapiens
gtggctgggtgccctc

SEQ ID NO: 1614434 - DNA, 18 bp, Homo sapiens
gtggctgggtttacacgc

SEQ ID NO: 1614435 - DNA, 15 bp, Homo sapiens
gtggctggtctcacc

SEQ ID NO: 1614436 - DNA, 12 bp, Homo sapiens
gtggctgtggca

SEQ ID NO: 1614437 - DNA, 15 bp, Homo sapiens
gtggctgtggcacag

SEQ ID NO: 1614438 - DNA, 18 bp, Homo sapiens
gtggcttcccgctcagcc

SEQ ID NO: 1614439 - DNA, 19 bp, Homo sapiens
gtggctttaattgtataag

SEQ ID NO: 1614440 - DNA, 17 bp, Homo sapiens
gtgggaacgtgactgcc

SEQ ID NO: 1614441 - DNA, 14 bp, Homo sapiens
gtgggaagaaagaa

SEQ ID NO: 1614442 - DNA, 22 bp, Homo sapiens
gtgggaagaccaaaggaaggaa

SEQ ID NO: 1614443 - DNA, 20 bp, Homo sapiens
gtgggaaggacttggcgcgc

SEQ ID NO: 1614444 - DNA, 23 bp, Homo sapiens
gtgggaaggacttggcgcgccct

SEQ ID NO: 1614445 - DNA, 22 bp, Homo sapiens
gtgggacccatagatcttctga

SEQ ID NO: 1614446 - DNA, 20 bp, Homo sapiens
gtgggacgggatggttctgg

SEQ ID NO: 1614447 - DNA, 19 bp, Homo sapiens
gtgggacggtgcccaagcc

SEQ ID NO: 1614448 - DNA, 20 bp, Homo sapiens
gtgggacggtgcccaagcca

SEQ ID NO: 1614449 - DNA, 15 bp, Homo sapiens
gtgggacgtggtcag

SEQ ID NO: 1614450 - DNA, 12 bp, Homo sapiens
gtgggagacagc

SEQ ID NO: 1614451 - DNA, 19 bp, Homo sapiens
gtgggaggaaagggcctgg

SEQ ID NO: 1614452 - DNA, 15 bp, Homo sapiens
gtgggaggggcaggc

SEQ ID NO: 1614453 - DNA, 13 bp, Homo sapiens
gtgggagggggag

SEQ ID NO: 1614454 - DNA, 13 bp, Homo sapiens
gtgggagtgtgta

SEQ ID NO: 1614455 - DNA, 14 bp, Homo sapiens
gtgggagtgtgtaa

SEQ ID NO: 1614456 - DNA, 16 bp, Homo sapiens
gtgggagtgtgtctgc

SEQ ID NO: 1614457 - DNA, 21 bp, Homo sapiens
gtgggagtgtgtctgctgagt

SEQ ID NO: 1614458 - DNA, 14 bp, Homo sapiens
gtgggatcctccct

SEQ ID NO: 1614459 - DNA, 15 bp, Homo sapiens
gtgggatctggggag

SEQ ID NO: 1614460 - DNA, 14 bp, Homo sapiens
gtgggatggaggag

SEQ ID NO: 1614461 - DNA, 22 bp, Homo sapiens
gtgggattatgggtcacaggaa

SEQ ID NO: 1614462 - DNA, 20 bp, Homo sapiens
gtgggatttccagaaccaca

SEQ ID NO: 1614463 - DNA, 21 bp, Homo sapiens
gtgggatttggggcctcaaga

SEQ ID NO: 1614464 - DNA, 17 bp, Homo sapiens
gtgggattttttccctt

SEQ ID NO: 1614465 - DNA, 18 bp, Homo sapiens
gtgggattttttcccttt

SEQ ID NO: 1614466 - DNA, 21 bp, Homo sapiens
gtgggcaattgttacaagtgt

SEQ ID NO: 1614467 - DNA, 12 bp, Homo sapiens
gtgggcagctgg

SEQ ID NO: 1614468 - DNA, 14 bp, Homo sapiens
gtgggcagctgggc

SEQ ID NO: 1614469 - DNA, 21 bp, Homo sapiens
gtgggcaggtggccgcccctg

SEQ ID NO: 1614470 - DNA, 19 bp, Homo sapiens
gtgggcagtgccacccgca

SEQ ID NO: 1614471 - DNA, 20 bp, Homo sapiens
gtgggcatttcttgcgagcc

SEQ ID NO: 1614472 - DNA, 20 bp, Homo sapiens
gtgggcccagcacatggcca

SEQ ID NO: 1614473 - DNA, 20 bp, Homo sapiens
gtgggcccaggaccagctgg

SEQ ID NO: 1614474 - DNA, 21 bp, Homo sapiens
gtgggcccaggaccagctggg

SEQ ID NO: 1614475 - DNA, 23 bp, Homo sapiens
gtgggcccaggaccagctggggc

SEQ ID NO: 1614476 - DNA, 15 bp, Homo sapiens
gtgggccccgggctg

SEQ ID NO: 1614477 - DNA, 15 bp, Homo sapiens
gtgggcctcctctgt

SEQ ID NO: 1614478 - DNA, 12 bp, Homo sapiens
gtgggcctggcc

SEQ ID NO: 1614479 - DNA, 17 bp, Homo sapiens
gtgggcctgtcgtgcca

SEQ ID NO: 1614480 - DNA, 14 bp, Homo sapiens
gtgggcgcaaaggt

SEQ ID NO: 1614481 - DNA, 21 bp, Homo sapiens
gtgggcgcaaaggtgcctcat

SEQ ID NO: 1614482 - DNA, 16 bp, Homo sapiens
gtgggcgcccaccctg

SEQ ID NO: 1614483 - DNA, 20 bp, Homo sapiens
gtgggcgctctccctacctt

SEQ ID NO: 1614484 - DNA, 13 bp, Homo sapiens
gtgggctgagccc

SEQ ID NO: 1614485 - DNA, 15 bp, Homo sapiens
gtgggctgagccctg

SEQ ID NO: 1614486 - DNA, 18 bp, Homo sapiens
gtgggctgagccctggca

SEQ ID NO: 1614487 - DNA, 13 bp, Homo sapiens
gtgggctgcctgc

SEQ ID NO: 1614488 - DNA, 15 bp, Homo sapiens
gtgggctgggccctc

SEQ ID NO: 1614489 - DNA, 21 bp, Homo sapiens
gtggggaagaggggctggggc

SEQ ID NO: 1614490 - DNA, 22 bp, Homo sapiens
gtggggacgggggctgcttctc

SEQ ID NO: 1614491 - DNA, 14 bp, Homo sapiens
gtggggagacctgg

SEQ ID NO: 1614492 - DNA, 22 bp, Homo sapiens
gtggggagcagttttcccctgg

SEQ ID NO: 1614493 - DNA, 22 bp, Homo sapiens
gtggggagccgagggcgtcaga

SEQ ID NO: 1614494 - DNA, 19 bp, Homo sapiens
gtggggaggcccaaatgat

SEQ ID NO: 1614495 - DNA, 11 bp, Homo sapiens
gtggggagggg

SEQ ID NO: 1614496 - DNA, 18 bp, Homo sapiens
gtggggatctcaggggct

SEQ ID NO: 1614497 - DNA, 19 bp, Homo sapiens
gtggggatctcaggggctg

SEQ ID NO: 1614498 - DNA, 21 bp, Homo sapiens
gtggggcaggagtgccaggac

SEQ ID NO: 1614499 - DNA, 23 bp, Homo sapiens
gtggggcaggagtgccaggacca

SEQ ID NO: 1614500 - DNA, 14 bp, Homo sapiens
gtggggcagggagc

SEQ ID NO: 1614501 - DNA, 17 bp, Homo sapiens
gtggggccgccgcctct

SEQ ID NO: 1614502 - DNA, 23 bp, Homo sapiens
gtggggcctccttgtccaggtct

SEQ ID NO: 1614503 - DNA, 21 bp, Homo sapiens
gtggggcctgggagggttccc

SEQ ID NO: 1614504 - DNA, 17 bp, Homo sapiens
gtggggctgagctgggg

SEQ ID NO: 1614505 - DNA, 13 bp, Homo sapiens
gtggggctgtcct

SEQ ID NO: 1614506 - DNA, 14 bp, Homo sapiens
gtggggctgtcctg

SEQ ID NO: 1614507 - DNA, 19 bp, Homo sapiens
gtggggctgtcctgctgcc

SEQ ID NO: 1614508 - DNA, 12 bp, Homo sapiens
gtgggggctgca

SEQ ID NO: 1614509 - DNA, 17 bp, Homo sapiens
gtggggggtccagtctg

SEQ ID NO: 1614510 - DNA, 12 bp, Homo sapiens
gtggggggtgac

SEQ ID NO: 1614511 - DNA, 12 bp, Homo sapiens
gtgggggtcatc

SEQ ID NO: 1614512 - DNA, 15 bp, Homo sapiens
gtgggggtctgtgtg

SEQ ID NO: 1614513 - DNA, 16 bp, Homo sapiens
gtgggggtctgtgtgt

SEQ ID NO: 1614514 - DNA, 17 bp, Homo sapiens
gtggggtgaacagctgg

SEQ ID NO: 1614515 - DNA, 17 bp, Homo sapiens
gtggggtgaggaccact

SEQ ID NO: 1614516 - DNA, 11 bp, Homo sapiens
gtggggtggga

SEQ ID NO: 1614517 - DNA, 16 bp, Homo sapiens
gtggggtggtgtcaga

SEQ ID NO: 1614518 - DNA, 19 bp, Homo sapiens
gtggggtgtgcatgccacg

SEQ ID NO: 1614519 - DNA, 15 bp, Homo sapiens
gtggggttctaggca

SEQ ID NO: 1614520 - DNA, 14 bp, Homo sapiens
gtgggtaagaggag

SEQ ID NO: 1614521 - DNA, 20 bp, Homo sapiens
gtgggtaagaggagcagagg

SEQ ID NO: 1614522 - DNA, 22 bp, Homo sapiens
gtgggtaagaggagcagagggc

SEQ ID NO: 1614523 - DNA, 19 bp, Homo sapiens
gtgggtaattgtacaataa

SEQ ID NO: 1614524 - DNA, 22 bp, Homo sapiens
gtgggtaattgtacaataaatt

SEQ ID NO: 1614525 - DNA, 15 bp, Homo sapiens
gtgggtacatcaagt

SEQ ID NO: 1614526 - DNA, 17 bp, Homo sapiens
gtgggtatgcgagacca

SEQ ID NO: 1614527 - DNA, 16 bp, Homo sapiens
gtgggtccaggaaggc

SEQ ID NO: 1614528 - DNA, 19 bp, Homo sapiens
gtgggtccaggaaggcagc

SEQ ID NO: 1614529 - DNA, 21 bp, Homo sapiens
gtgggtccaggaaggcagctg

SEQ ID NO: 1614530 - DNA, 18 bp, Homo sapiens
gtgggtcctgaggcctgc

SEQ ID NO: 1614531 - DNA, 13 bp, Homo sapiens
gtgggtctgtgtg

SEQ ID NO: 1614532 - DNA, 16 bp, Homo sapiens
gtgggtctgtgtgtgt

SEQ ID NO: 1614533 - DNA, 12 bp, Homo sapiens
gtgggtgagcca

SEQ ID NO: 1614534 - DNA, 13 bp, Homo sapiens
gtgggtgagccag

SEQ ID NO: 1614535 - DNA, 15 bp, Homo sapiens
gtgggtgccctctcc

SEQ ID NO: 1614536 - DNA, 19 bp, Homo sapiens
gtgggtggagtcaggcttc

SEQ ID NO: 1614537 - DNA, 17 bp, Homo sapiens
gtgggtggcacctcctg

SEQ ID NO: 1614538 - DNA, 19 bp, Homo sapiens
gtgggtggggtacaggcag

SEQ ID NO: 1614539 - DNA, 22 bp, Homo sapiens
gtgggtgtcctgcctgtctgcc

SEQ ID NO: 1614540 - DNA, 15 bp, Homo sapiens
gtgggtgtggccagc

SEQ ID NO: 1614541 - DNA, 13 bp, Homo sapiens
gtggtaaagaaag

SEQ ID NO: 1614542 - DNA, 21 bp, Homo sapiens
gtggtaaatactgtgaaatac

SEQ ID NO: 1614543 - DNA, 16 bp, Homo sapiens
gtggtaactgccagcc

SEQ ID NO: 1614544 - DNA, 17 bp, Homo sapiens
gtggtaatctacaccaa

SEQ ID NO: 1614545 - DNA, 14 bp, Homo sapiens
gtggtaccctctgg

SEQ ID NO: 1614546 - DNA, 21 bp, Homo sapiens
gtggtactttattcttgctgg

SEQ ID NO: 1614547 - DNA, 17 bp, Homo sapiens
gtggtaggcctataaaa

SEQ ID NO: 1614548 - DNA, 22 bp, Homo sapiens
gtggagggaaggataaagccac

SEQ ID NO: 1614549 - DNA, 13 bp, Homo sapiens
gtggagggcacag

SEQ ID NO: 1614550 - DNA, 17 bp, Homo sapiens
gtggagggttgccatgg

SEQ ID NO: 1614551 - DNA, 21 bp, Homo sapiens
gtggagggtttgcactccaca

SEQ ID NO: 1614552 - DNA, 18 bp, Homo sapiens
gtggaggtgggctgggcc

SEQ ID NO: 1614553 - DNA, 20 bp, Homo sapiens
gtggagttcaccttggaagg

SEQ ID NO: 1614554 - DNA, 14 bp, Homo sapiens
gtggagttcctgct

SEQ ID NO: 1614555 - DNA, 15 bp, Homo sapiens
gtggataatcaggaa

SEQ ID NO: 1614556 - DNA, 20 bp, Homo sapiens
gtggataatcaggaaaaatg

SEQ ID NO: 1614557 - DNA, 17 bp, Homo sapiens
gtggatataaaatgtgc

SEQ ID NO: 1614558 - DNA, 20 bp, Homo sapiens
gtggatatgacccacactgc

SEQ ID NO: 1614559 - DNA, 23 bp, Homo sapiens
gtggatcacaaagtggaacgaaa

SEQ ID NO: 1614560 - DNA, 16 bp, Homo sapiens
gtggatcacagaggct

SEQ ID NO: 1614561 - DNA, 22 bp, Homo sapiens
gtggatcacgaggtcaggagat

SEQ ID NO: 1614562 - DNA, 19 bp, Homo sapiens
gtggatctatttcatgttt

SEQ ID NO: 1614563 - DNA, 16 bp, Homo sapiens
gtggatctccttccct

SEQ ID NO: 1614564 - DNA, 14 bp, Homo sapiens
gtggatctttgcta

SEQ ID NO: 1614565 - DNA, 16 bp, Homo sapiens
gtggatgacagggcag

SEQ ID NO: 1614566 - DNA, 21 bp, Homo sapiens
gtggatgctccagggcagcct

SEQ ID NO: 1614567 - DNA, 13 bp, Homo sapiens
gtggatggcccca

SEQ ID NO: 1614568 - DNA, 15 bp, Homo sapiens
gtggatggccccagc

SEQ ID NO: 1614569 - DNA, 16 bp, Homo sapiens
gtggatggccccagca

SEQ ID NO: 1614570 - DNA, 23 bp, Homo sapiens
gtggattataaaaaatgtaacat

SEQ ID NO: 1614571 - DNA, 13 bp, Homo sapiens
gtggattctttaa

SEQ ID NO: 1614572 - DNA, 17 bp, Homo sapiens
gtggattgcctctgaaa

SEQ ID NO: 1614573 - DNA, 19 bp, Homo sapiens
gtggattgggctgcaggct

SEQ ID NO: 1614574 - DNA, 18 bp, Homo sapiens
gtggatttgattcatttt

SEQ ID NO: 1614575 - DNA, 22 bp, Homo sapiens
gtggatttgattcattttcctg

SEQ ID NO: 1614576 - DNA, 22 bp, Homo sapiens
gtggcaaagccttcattgcctt

SEQ ID NO: 1614577 - DNA, 14 bp, Homo sapiens
gtggcacaaaaaaa

SEQ ID NO: 1614578 - DNA, 19 bp, Homo sapiens
gtggcaccagaggtgcttc

SEQ ID NO: 1614579 - DNA, 12 bp, Homo sapiens
gtggcacctcct

SEQ ID NO: 1614580 - DNA, 14 bp, Homo sapiens
gtggcacctcctga

SEQ ID NO: 1614581 - DNA, 18 bp, Homo sapiens
gtggcacctcctgagaag

SEQ ID NO: 1614582 - DNA, 20 bp, Homo sapiens
gtggcacctcctgagaaggc

SEQ ID NO: 1614583 - DNA, 22 bp, Homo sapiens
gtggcactcagtctctcttctc

SEQ ID NO: 1614584 - DNA, 14 bp, Homo sapiens
gtggcactgagccc

SEQ ID NO: 1614585 - DNA, 17 bp, Homo sapiens
gtggcacttgcctgggt

SEQ ID NO: 1614586 - DNA, 18 bp, Homo sapiens
gtggcagattttacaaaa

SEQ ID NO: 1614587 - DNA, 22 bp, Homo sapiens
gtggcagattttacaaaagatg

SEQ ID NO: 1614588 - DNA, 14 bp, Homo sapiens
gtggcagcagcccc

SEQ ID NO: 1614589 - DNA, 17 bp, Homo sapiens
gtggcagccatgcctca

SEQ ID NO: 1614590 - DNA, 20 bp, Homo sapiens
gtggcagctgcccctggcac

SEQ ID NO: 1614591 - DNA, 11 bp, Homo sapiens
gtggcagctgg

SEQ ID NO: 1614592 - DNA, 14 bp, Homo sapiens
gtggcagctgggga

SEQ ID NO: 1614593 - DNA, 21 bp, Homo sapiens
gtggcagctggggagcagctg

SEQ ID NO: 1614594 - DNA, 23 bp, Homo sapiens
gtggcagctggggagcagctgag

SEQ ID NO: 1614595 - DNA, 20 bp, Homo sapiens
gtggcaggggacaggagtcc

SEQ ID NO: 1614596 - DNA, 15 bp, Homo sapiens
gtggcaggggagcag

SEQ ID NO: 1614597 - DNA, 18 bp, Homo sapiens
gtggcagggggccccgcc

SEQ ID NO: 1614598 - DNA, 23 bp, Homo sapiens
gtggcagggggccccgccagggc

SEQ ID NO: 1614599 - DNA, 16 bp, Homo sapiens
gtggcaggtcactgtc

SEQ ID NO: 1614600 - DNA, 19 bp, Homo sapiens
gtggcaggtgggctgcctg

SEQ ID NO: 1614601 - DNA, 17 bp, Homo sapiens
gtggcagtggccaggca

SEQ ID NO: 1614602 - DNA, 21 bp, Homo sapiens
gtggcagtggttttggcaaac

SEQ ID NO: 1614603 - DNA, 18 bp, Homo sapiens
gtggccaacgtggacctg

SEQ ID NO: 1614604 - DNA, 23 bp, Homo sapiens
gtggccaactgcaaaaaaagcct

SEQ ID NO: 1614605 - DNA, 17 bp, Homo sapiens
gtggccaagaagcagtg

SEQ ID NO: 1614606 - DNA, 19 bp, Homo sapiens
gtggccacagcaggactga

SEQ ID NO: 1614607 - DNA, 15 bp, Homo sapiens
gtggccacagccccc

SEQ ID NO: 1614608 - DNA, 16 bp, Homo sapiens
gtggccacagccccct

SEQ ID NO: 1614609 - DNA, 11 bp, Homo sapiens
gtggccagccc

SEQ ID NO: 1614610 - DNA, 16 bp, Homo sapiens
gtggccagcccggctg

SEQ ID NO: 1614611 - DNA, 15 bp, Homo sapiens
gtggccagcctggat

SEQ ID NO: 1614612 - DNA, 14 bp, Homo sapiens
gtggccaggcaggc

SEQ ID NO: 1614613 - DNA, 16 bp, Homo sapiens
gtggccatcatttctg

SEQ ID NO: 1614614 - DNA, 12 bp, Homo sapiens
gtggccatggcc

SEQ ID NO: 1614615 - DNA, 14 bp, Homo sapiens
gtggcccagagcct

SEQ ID NO: 1614616 - DNA, 18 bp, Homo sapiens
gtggccccaccctgggcc

SEQ ID NO: 1614617 - DNA, 20 bp, Homo sapiens
gtggccccaccctgggccct

SEQ ID NO: 1614618 - DNA, 23 bp, Homo sapiens
gtggccccgtttctggtggtctg

SEQ ID NO: 1614619 - DNA, 16 bp, Homo sapiens
gtggccccttttactt

SEQ ID NO: 1614620 - DNA, 16 bp, Homo sapiens
gtggcccgacagcctg

SEQ ID NO: 1614621 - DNA, 22 bp, Homo sapiens
gtggcccggttgaactcactcc

SEQ ID NO: 1614622 - DNA, 21 bp, Homo sapiens
gtggccctgccatcttcccag

SEQ ID NO: 1614623 - DNA, 16 bp, Homo sapiens
gtggccgcccctgagg

SEQ ID NO: 1614624 - DNA, 16 bp, Homo sapiens
gtggccgcctggcagg

SEQ ID NO: 1614625 - DNA, 22 bp, Homo sapiens
gtggccggttgccactctcctc

SEQ ID NO: 1614626 - DNA, 11 bp, Homo sapiens
gtggcctcaga

SEQ ID NO: 1614627 - DNA, 19 bp, Homo sapiens
gtggcctccctgctgtgcc

SEQ ID NO: 1614628 - DNA, 22 bp, Homo sapiens
gtggcctccctgctgtgccatg

SEQ ID NO: 1614629 - DNA, 12 bp, Homo sapiens
gtggcctggcca

SEQ ID NO: 1614630 - DNA, 20 bp, Homo sapiens
gtgctgatcctgctgacctc

SEQ ID NO: 1614631 - DNA, 11 bp, Homo sapiens
gtgctgcagga

SEQ ID NO: 1614632 - DNA, 16 bp, Homo sapiens
gtgctgcatccctgtg

SEQ ID NO: 1614633 - DNA, 21 bp, Homo sapiens
gtgctgccatttgatttttct

SEQ ID NO: 1614634 - DNA, 15 bp, Homo sapiens
gtgctgctgtgtgct

SEQ ID NO: 1614635 - DNA, 13 bp, Homo sapiens
gtgctgcttctct

SEQ ID NO: 1614636 - DNA, 15 bp, Homo sapiens
gtgctggaagggagg

SEQ ID NO: 1614637 - DNA, 19 bp, Homo sapiens
gtgctggaattccacaggg

SEQ ID NO: 1614638 - DNA, 13 bp, Homo sapiens
gtgctggccccca

SEQ ID NO: 1614639 - DNA, 15 bp, Homo sapiens
gtgctggctgcccag

SEQ ID NO: 1614640 - DNA, 18 bp, Homo sapiens
gtgctggctgcccagacc

SEQ ID NO: 1614641 - DNA, 15 bp, Homo sapiens
gtgctgggaccagag

SEQ ID NO: 1614642 - DNA, 19 bp, Homo sapiens
gtgctgggaccagagccag

SEQ ID NO: 1614643 - DNA, 20 bp, Homo sapiens
gtgctgggaccagagccaga

SEQ ID NO: 1614644 - DNA, 13 bp, Homo sapiens
gtgctgggactga

SEQ ID NO: 1614645 - DNA, 17 bp, Homo sapiens
gtgctgggactgagcca

SEQ ID NO: 1614646 - DNA, 18 bp, Homo sapiens
gtgctgggactgagccag

SEQ ID NO: 1614647 - DNA, 22 bp, Homo sapiens
gtgctgggagctccactctgct

SEQ ID NO: 1614648 - DNA, 15 bp, Homo sapiens
gtgctgggaggaggg

SEQ ID NO: 1614649 - DNA, 22 bp, Homo sapiens
gtgctgggattaccggcgtgag

SEQ ID NO: 1614650 - DNA, 15 bp, Homo sapiens
gtgctggggcacggc

SEQ ID NO: 1614651 - DNA, 21 bp, Homo sapiens
gtgctggtcagagagacctca

SEQ ID NO: 1614652 - DNA, 16 bp, Homo sapiens
gtgctggtcccctcct

SEQ ID NO: 1614653 - DNA, 20 bp, Homo sapiens
gtgctggtgtcctgaccacc

SEQ ID NO: 1614654 - DNA, 12 bp, Homo sapiens
gtgctgtaattt

SEQ ID NO: 1614655 - DNA, 16 bp, Homo sapiens
gtgctgtacccttcca

SEQ ID NO: 1614656 - DNA, 20 bp, Homo sapiens
gtgctgtacccttccacctc

SEQ ID NO: 1614657 - DNA, 18 bp, Homo sapiens
gtgctgtgaccatttata

SEQ ID NO: 1614658 - DNA, 14 bp, Homo sapiens
gtgctgtgcctgct

SEQ ID NO: 1614659 - DNA, 17 bp, Homo sapiens
gtgctgtggcctgggca

SEQ ID NO: 1614660 - DNA, 14 bp, Homo sapiens
gtgctgtgggcctc

SEQ ID NO: 1614661 - DNA, 15 bp, Homo sapiens
gtgctgtgggcctca

SEQ ID NO: 1614662 - DNA, 16 bp, Homo sapiens
gtgctgtgtaccctgg

SEQ ID NO: 1614663 - DNA, 17 bp, Homo sapiens
gtgctgtgtgagtgagc

SEQ ID NO: 1614664 - DNA, 20 bp, Homo sapiens
gtgctgtgtgccccactcca

SEQ ID NO: 1614665 - DNA, 23 bp, Homo sapiens
gtgctgtgtgccccactccagcc

SEQ ID NO: 1614666 - DNA, 16 bp, Homo sapiens
gtgcttaaggtttgtt

SEQ ID NO: 1614667 - DNA, 16 bp, Homo sapiens
gtgcttcaacattctt

SEQ ID NO: 1614668 - DNA, 21 bp, Homo sapiens
gtgcttcagagtttgtgtgta

SEQ ID NO: 1614669 - DNA, 21 bp, Homo sapiens
gtgcttcccccacccctccac

SEQ ID NO: 1614670 - DNA, 22 bp, Homo sapiens
gtgcttcccccacccctccacg

SEQ ID NO: 1614671 - DNA, 16 bp, Homo sapiens
gtgcttcgactactgc

SEQ ID NO: 1614672 - DNA, 18 bp, Homo sapiens
gtgcttcttcacttaccc

SEQ ID NO: 1614673 - DNA, 19 bp, Homo sapiens
gtgcttgaaggccctgctg

SEQ ID NO: 1614674 - DNA, 20 bp, Homo sapiens
gtgcttgaaggccctgctga

SEQ ID NO: 1614675 - DNA, 14 bp, Homo sapiens
gtgcttgaggcccc

SEQ ID NO: 1614676 - DNA, 21 bp, Homo sapiens
gtgcttgggtggtgggtgctg

SEQ ID NO: 1614677 - DNA, 20 bp, Homo sapiens
gtgcttgttttataaaattt

SEQ ID NO: 1614678 - DNA, 18 bp, Homo sapiens
gtgcttttatagaggcta

SEQ ID NO: 1614679 - DNA, 19 bp, Homo sapiens
gtgcttttatagaggctag

SEQ ID NO: 1614680 - DNA, 19 bp, Homo sapiens
gtgctttttaagaatattt

SEQ ID NO: 1614681 - DNA, 16 bp, Homo sapiens
gtgctttttttgtgtg

SEQ ID NO: 1614682 - DNA, 18 bp, Homo sapiens
gtggaagaagggagaaga

SEQ ID NO: 1614683 - DNA, 13 bp, Homo sapiens
gtggaagagcagc

SEQ ID NO: 1614684 - DNA, 14 bp, Homo sapiens
gtggaagagcagcc

SEQ ID NO: 1614685 - DNA, 15 bp, Homo sapiens
gtggaagagcagcct

SEQ ID NO: 1614686 - DNA, 17 bp, Homo sapiens
gtggaagagcagcctga

SEQ ID NO: 1614687 - DNA, 14 bp, Homo sapiens
gtggaagccctcct

SEQ ID NO: 1614688 - DNA, 16 bp, Homo sapiens
gtggaagggggtgtgc

SEQ ID NO: 1614689 - DNA, 17 bp, Homo sapiens
gtggaagggggtgtgcg

SEQ ID NO: 1614690 - DNA, 18 bp, Homo sapiens
gtggaagggggtgtgcgt

SEQ ID NO: 1614691 - DNA, 15 bp, Homo sapiens
gtggaagtcagtacg

SEQ ID NO: 1614692 - DNA, 16 bp, Homo sapiens
gtggaagtgcccagcc

SEQ ID NO: 1614693 - DNA, 21 bp, Homo sapiens
gtggaattcctctttaacaag

SEQ ID NO: 1614694 - DNA, 20 bp, Homo sapiens
gtggacacaacagcagtctc

SEQ ID NO: 1614695 - DNA, 21 bp, Homo sapiens
gtggacaccaggagtccctgg

SEQ ID NO: 1614696 - DNA, 14 bp, Homo sapiens
gtggacaggcccag

SEQ ID NO: 1614697 - DNA, 12 bp, Homo sapiens
gtggacagggcc

SEQ ID NO: 1614698 - DNA, 13 bp, Homo sapiens
gtggacagggccc

SEQ ID NO: 1614699 - DNA, 15 bp, Homo sapiens
gtggacagtcctggg

SEQ ID NO: 1614700 - DNA, 18 bp, Homo sapiens
gtggacatcgtaggcagc

SEQ ID NO: 1614701 - DNA, 21 bp, Homo sapiens
gtggacatcgtaggcagccac

SEQ ID NO: 1614702 - DNA, 22 bp, Homo sapiens
gtggacccagggatgacatgtc

SEQ ID NO: 1614703 - DNA, 17 bp, Homo sapiens
gtggaccgtggacaggc

SEQ ID NO: 1614704 - DNA, 21 bp, Homo sapiens
gtggaccgtggacaggcccag

SEQ ID NO: 1614705 - DNA, 12 bp, Homo sapiens
gtggacctggca

SEQ ID NO: 1614706 - DNA, 13 bp, Homo sapiens
gtggacctggcag

SEQ ID NO: 1614707 - DNA, 14 bp, Homo sapiens
gtggacgagagggc

SEQ ID NO: 1614708 - DNA, 14 bp, Homo sapiens
gtggactctgcaca

SEQ ID NO: 1614709 - DNA, 12 bp, Homo sapiens
gtggactctggt

SEQ ID NO: 1614710 - DNA, 18 bp, Homo sapiens
gtggactgagtgggaagc

SEQ ID NO: 1614711 - DNA, 16 bp, Homo sapiens
gtggactggctgtgcc

SEQ ID NO: 1614712 - DNA, 20 bp, Homo sapiens
gtggactgtcctgaggagcc

SEQ ID NO: 1614713 - DNA, 19 bp, Homo sapiens
gtggactgtgcctcaggcc

SEQ ID NO: 1614714 - DNA, 18 bp, Homo sapiens
gtggactgtgctggtgca

SEQ ID NO: 1614715 - DNA, 21 bp, Homo sapiens
gtggactgtggcacttgcctg

SEQ ID NO: 1614716 - DNA, 23 bp, Homo sapiens
gtggacttaggaaggtggccttc

SEQ ID NO: 1614717 - DNA, 20 bp, Homo sapiens
gtggacttgtatgctgccca

SEQ ID NO: 1614718 - DNA, 18 bp, Homo sapiens
gtggacttgttttaattt

SEQ ID NO: 1614719 - DNA, 22 bp, Homo sapiens
gtggagaagccacaggcctgag

SEQ ID NO: 1614720 - DNA, 14 bp, Homo sapiens
gtggagacagtcct

SEQ ID NO: 1614721 - DNA, 18 bp, Homo sapiens
gtgcctatatctgagaga

SEQ ID NO: 1614722 - DNA, 23 bp, Homo sapiens
gtgcctatatctgagagacctgt

SEQ ID NO: 1614723 - DNA, 19 bp, Homo sapiens
gtgcctatttgtgtggaca

SEQ ID NO: 1614724 - DNA, 13 bp, Homo sapiens
gtgcctcagactc

SEQ ID NO: 1614725 - DNA, 17 bp, Homo sapiens
gtcttcaaactgtgaag

SEQ ID NO: 1614726 - DNA, 16 bp, Homo sapiens
gtcttcagacccagag

SEQ ID NO: 1614727 - DNA, 18 bp, Homo sapiens
gtcttcagacccagagaa

SEQ ID NO: 1614728 - DNA, 22 bp, Homo sapiens
gtcttcagacccagagaaggac

SEQ ID NO: 1614729 - DNA, 14 bp, Homo sapiens
gtcttcagctgcat

SEQ ID NO: 1614730 - DNA, 21 bp, Homo sapiens
gtcttcagctgcatttcacat

SEQ ID NO: 1614731 - DNA, 20 bp, Homo sapiens
gtcttcagtctcacagagaa

SEQ ID NO: 1614732 - DNA, 19 bp, Homo sapiens
gtcttccaaggagaccaag

SEQ ID NO: 1614733 - DNA, 11 bp, Homo sapiens
gtcttccacaa

SEQ ID NO: 1614734 - DNA, 17 bp, Homo sapiens
gtcttccataatgtata

SEQ ID NO: 1614735 - DNA, 15 bp, Homo sapiens
gtcttccctacctca

SEQ ID NO: 1614736 - DNA, 18 bp, Homo sapiens
gtcttccctacctcaggc

SEQ ID NO: 1614737 - DNA, 23 bp, Homo sapiens
gtcttcctcaaaataaagaagta

SEQ ID NO: 1614738 - DNA, 14 bp, Homo sapiens
gtcttcctctgtct

SEQ ID NO: 1614739 - DNA, 16 bp, Homo sapiens
gtcttcctcttagcct

SEQ ID NO: 1614740 - DNA, 12 bp, Homo sapiens
gtcttcctgagt

SEQ ID NO: 1614741 - DNA, 19 bp, Homo sapiens
gtcttcctgagtggtgcca

SEQ ID NO: 1614742 - DNA, 15 bp, Homo sapiens
gtcttctcaggctct

SEQ ID NO: 1614743 - DNA, 18 bp, Homo sapiens
gtcttctcaggctctgcc

SEQ ID NO: 1614744 - DNA, 24 bp, Homo sapiens
gtcttctgagcgagtgctctcact

SEQ ID NO: 1614745 - DNA, 13 bp, Homo sapiens
gtcttctgcctgt

SEQ ID NO: 1614746 - DNA, 15 bp, Homo sapiens
gtcttctgcctgtta

SEQ ID NO: 1614747 - DNA, 21 bp, Homo sapiens
gtcttctgtaattcattgagc

SEQ ID NO: 1614748 - DNA, 17 bp, Homo sapiens
gtcttctttgcccacaa

SEQ ID NO: 1614749 - DNA, 20 bp, Homo sapiens
gtcttctttgcccacaatgc

SEQ ID NO: 1614750 - DNA, 17 bp, Homo sapiens
gtcttgaaatgaaaggg

SEQ ID NO: 1614751 - DNA, 18 bp, Homo sapiens
gtcttgaaatgaaaggga

SEQ ID NO: 1614752 - DNA, 19 bp, Homo sapiens
gtcttgaaatgaaagggaa

SEQ ID NO: 1614753 - DNA, 20 bp, Homo sapiens
gtcttgaaatgaaagggaaa

SEQ ID NO: 1614754 - DNA, 21 bp, Homo sapiens
gtcttgaaatgaaagggaaac

SEQ ID NO: 1614755 - DNA, 17 bp, Homo sapiens
gtcttgaagtctgtaca

SEQ ID NO: 1614756 - DNA, 22 bp, Homo sapiens
gtcttgaagttgggtgtttcca

SEQ ID NO: 1614757 - DNA, 15 bp, Homo sapiens
gtcttgaatgtcttt

SEQ ID NO: 1614758 - DNA, 20 bp, Homo sapiens
gtcttgactcatggcagctg

SEQ ID NO: 1614759 - DNA, 16 bp, Homo sapiens
gtcttgatgttttttc

SEQ ID NO: 1614760 - DNA, 18 bp, Homo sapiens
gtcttgattcagtcacat

SEQ ID NO: 1614761 - DNA, 22 bp, Homo sapiens
gtcttgcccagcagctcaagaa

SEQ ID NO: 1614762 - DNA, 19 bp, Homo sapiens
gtcttgctatttgagcatg

SEQ ID NO: 1614763 - DNA, 14 bp, Homo sapiens
gtcttggacactgt

SEQ ID NO: 1614764 - DNA, 14 bp, Homo sapiens
gtcttggccagcca

SEQ ID NO: 1614765 - DNA, 16 bp, Homo sapiens
gtcttgggcagagctg

SEQ ID NO: 1614766 - DNA, 22 bp, Homo sapiens
gtcttgggcagagctggctctg

SEQ ID NO: 1614767 - DNA, 16 bp, Homo sapiens
gtcttggtggttctat

SEQ ID NO: 1614768 - DNA, 15 bp, Homo sapiens
gtcttggtgtaattt

SEQ ID NO: 1614769 - DNA, 21 bp, Homo sapiens
gtcttgtacttctgtgttcat

SEQ ID NO: 1614770 - DNA, 13 bp, Homo sapiens
gtcttgttagaaa

SEQ ID NO: 1614771 - DNA, 16 bp, Homo sapiens
gtcttgttagaaaaca

SEQ ID NO: 1614772 - DNA, 17 bp, Homo sapiens
gtcttgttagaaaacaa

SEQ ID NO: 1614773 - DNA, 13 bp, Homo sapiens
gtcttgttcattt

SEQ ID NO: 1614774 - DNA, 14 bp, Homo sapiens
gtcttgttcatttt

SEQ ID NO: 1614775 - DNA, 14 bp, Homo sapiens
gtcttgtttcagtg

SEQ ID NO: 1614776 - DNA, 15 bp, Homo sapiens
gtctttaaaagagag

SEQ ID NO: 1614777 - DNA, 16 bp, Homo sapiens
gtctttcatggctgct

SEQ ID NO: 1614778 - DNA, 20 bp, Homo sapiens
gtctttcccatggggaggga

SEQ ID NO: 1614779 - DNA, 16 bp, Homo sapiens
gtctttcctggcacta

SEQ ID NO: 1614780 - DNA, 15 bp, Homo sapiens
gtctttcttcttttt

SEQ ID NO: 1614781 - DNA, 13 bp, Homo sapiens
gtctttgcacatg

SEQ ID NO: 1614782 - DNA, 14 bp, Homo sapiens
gtctttgcacatgt

SEQ ID NO: 1614783 - DNA, 22 bp, Homo sapiens
gtctttgtaatgtcaccacctt

SEQ ID NO: 1614784 - DNA, 23 bp, Homo sapiens
gtctttgtgggagggtaagacaa

SEQ ID NO: 1614785 - DNA, 13 bp, Homo sapiens
gtcttttgacatt

SEQ ID NO: 1614786 - DNA, 12 bp, Homo sapiens
gtcttttgcttt

SEQ ID NO: 1614787 - DNA, 16 bp, Homo sapiens
gtctttttatgcattt

SEQ ID NO: 1614788 - DNA, 17 bp, Homo sapiens
gtcttttttctcttccc

SEQ ID NO: 1614789 - DNA, 13 bp, Homo sapiens
gtctttttttgta

SEQ ID NO: 1614790 - DNA, 21 bp, Homo sapiens
gtctttttttgtattataaaa

SEQ ID NO: 1614791 - DNA, 14 bp, Homo sapiens
gtcttttttttcct

SEQ ID NO: 1614792 - DNA, 18 bp, Homo sapiens
gtgaaaaatcagatgaat

SEQ ID NO: 1614793 - DNA, 15 bp, Homo sapiens
gtgaaaacggagctg

SEQ ID NO: 1614794 - DNA, 15 bp, Homo sapiens
gtgaaaatagtgtaa

SEQ ID NO: 1614795 - DNA, 12 bp, Homo sapiens
gtgaaaattatt

SEQ ID NO: 1614796 - DNA, 15 bp, Homo sapiens
gtgaaacaaattaat

SEQ ID NO: 1614797 - DNA, 14 bp, Homo sapiens
gtgaaacacagctg

SEQ ID NO: 1614798 - DNA, 16 bp, Homo sapiens
gtgaaacacagctgtt

SEQ ID NO: 1614799 - DNA, 19 bp, Homo sapiens
gtgaaactaacagataagc

SEQ ID NO: 1614800 - DNA, 15 bp, Homo sapiens
gtgaaagaattattt

SEQ ID NO: 1614801 - DNA, 22 bp, Homo sapiens
gtgaaagaattatttttgtgtt

SEQ ID NO: 1614802 - DNA, 12 bp, Homo sapiens
gtgaaagggcta

SEQ ID NO: 1614803 - DNA, 14 bp, Homo sapiens
gtgaaatggctggg

SEQ ID NO: 1614804 - DNA, 11 bp, Homo sapiens
gtgaaattaag

SEQ ID NO: 1614805 - DNA, 20 bp, Homo sapiens
gtgaaattgcatactttgta

SEQ ID NO: 1614806 - DNA, 22 bp, Homo sapiens
gtgaaatttacatcatttcttt

SEQ ID NO: 1614807 - DNA, 13 bp, Homo sapiens
gtgaacacacacg

SEQ ID NO: 1614808 - DNA, 21 bp, Homo sapiens
gtgaacactagccagacactc

SEQ ID NO: 1614809 - DNA, 15 bp, Homo sapiens
gtgaacagcttgctg

SEQ ID NO: 1614810 - DNA, 18 bp, Homo sapiens
gtgaacagcttgctgtca

SEQ ID NO: 1614811 - DNA, 15 bp, Homo sapiens
gtgaacattcccagc

SEQ ID NO: 1614812 - DNA, 20 bp, Homo sapiens
gtgaacattcccagcccagc

SEQ ID NO: 1614813 - DNA, 19 bp, Homo sapiens
gtgaaccctggggcctgac

SEQ ID NO: 1614814 - DNA, 16 bp, Homo sapiens
gtgaaccgtcctttca

SEQ ID NO: 1614815 - DNA, 22 bp, Homo sapiens
gtgaactcaccctgggagccag

SEQ ID NO: 1614816 - DNA, 15 bp, Homo sapiens
gtgaactggaagaaa

SEQ ID NO: 1614817 - DNA, 18 bp, Homo sapiens
gtgaacttcttgaatcta

SEQ ID NO: 1614818 - DNA, 16 bp, Homo sapiens
gtgaacttgactgggt

SEQ ID NO: 1614819 - DNA, 23 bp, Homo sapiens
gtgaagaatgcacaagaatggat

SEQ ID NO: 1614820 - DNA, 14 bp, Homo sapiens
gtgaagaggggcag

SEQ ID NO: 1614821 - DNA, 19 bp, Homo sapiens
gtgaagaggggcagccctt

SEQ ID NO: 1614822 - DNA, 15 bp, Homo sapiens
gtgaagaggtctgat

SEQ ID NO: 1614823 - DNA, 22 bp, Homo sapiens
gtgaagaggtctgattggctgc

SEQ ID NO: 1614824 - DNA, 18 bp, Homo sapiens
gtgaagatgctgtaaata

SEQ ID NO: 1614825 - DNA, 23 bp, Homo sapiens
gtgaagcacatacggcagacctc

SEQ ID NO: 1614826 - DNA, 18 bp, Homo sapiens
gtgaagcagtcagccctt

SEQ ID NO: 1614827 - DNA, 22 bp, Homo sapiens
gtgaagcagtgcctcgaggcac

SEQ ID NO: 1614828 - DNA, 17 bp, Homo sapiens
gtgaagcatgctttgct

SEQ ID NO: 1614829 - DNA, 23 bp, Homo sapiens
gtgaaggatccaggaatatgaca

SEQ ID NO: 1614830 - DNA, 18 bp, Homo sapiens
gtgaagggaagagacagc

SEQ ID NO: 1614831 - DNA, 16 bp, Homo sapiens
gtgaagtgaatgaaac

SEQ ID NO: 1614832 - DNA, 15 bp, Homo sapiens
gtgaagttgcttctt

SEQ ID NO: 1614833 - DNA, 19 bp, Homo sapiens
gtgaagtttaattgtctca

SEQ ID NO: 1614834 - DNA, 14 bp, Homo sapiens
gtgaagtttacatt

SEQ ID NO: 1614835 - DNA, 18 bp, Homo sapiens
gtgaagttttactgtcta

SEQ ID NO: 1614836 - DNA, 21 bp, Homo sapiens
gtgaatacattctttgctagt

SEQ ID NO: 1614837 - DNA, 15 bp, Homo sapiens
gtgaatacctgctca

SEQ ID NO: 1614838 - DNA, 21 bp, Homo sapiens
gtgaatactgctacagcaatt

SEQ ID NO: 1614839 - DNA, 13 bp, Homo sapiens
gtgaatattttca

SEQ ID NO: 1614840 - DNA, 19 bp, Homo sapiens
gtgaatatttttgtatttt

SEQ ID NO: 1614841 - DNA, 19 bp, Homo sapiens
gtgaatccaggaggcagtg

SEQ ID NO: 1614842 - DNA, 21 bp, Homo sapiens
gtgagccaccatgcctggccc

SEQ ID NO: 1614843 - DNA, 20 bp, Homo sapiens
gtgagcgccccgcccccacc

SEQ ID NO: 1614844 - DNA, 18 bp, Homo sapiens
gtgagctctggtggagac

SEQ ID NO: 1614845 - DNA, 14 bp, Homo sapiens
gtgagctggggact

SEQ ID NO: 1614846 - DNA, 15 bp, Homo sapiens
gtgagctttgctgct

SEQ ID NO: 1614847 - DNA, 18 bp, Homo sapiens
gtgaggaaccctgatctc

SEQ ID NO: 1614848 - DNA, 20 bp, Homo sapiens
gtgaggaatagttgagcccc

SEQ ID NO: 1614849 - DNA, 15 bp, Homo sapiens
gtgaggaggaaaagg

SEQ ID NO: 1614850 - DNA, 18 bp, Homo sapiens
gtgaggaggaaaaggaaa

SEQ ID NO: 1614851 - DNA, 12 bp, Homo sapiens
gtgaggagggat

SEQ ID NO: 1614852 - DNA, 12 bp, Homo sapiens
gtgaggagggtg

SEQ ID NO: 1614853 - DNA, 20 bp, Homo sapiens
gtgaggattatgggtcctgc

SEQ ID NO: 1614854 - DNA, 16 bp, Homo sapiens
gtgaggcccaaggagc

SEQ ID NO: 1614855 - DNA, 16 bp, Homo sapiens
gtgaggcggcagctgg

SEQ ID NO: 1614856 - DNA, 14 bp, Homo sapiens
gtgaggctgtcctg

SEQ ID NO: 1614857 - DNA, 16 bp, Homo sapiens
gtgaggctgtcctgta

SEQ ID NO: 1614858 - DNA, 15 bp, Homo sapiens
gtgaggcttccaggc

SEQ ID NO: 1614859 - DNA, 21 bp, Homo sapiens
gtgagggaggggaaaagcatt

SEQ ID NO: 1614860 - DNA, 19 bp, Homo sapiens
gtgagggagttagggagag

SEQ ID NO: 1614861 - DNA, 21 bp, Homo sapiens
gtgagggagttagggagagag

SEQ ID NO: 1614862 - DNA, 15 bp, Homo sapiens
gtgaggggctttctc

SEQ ID NO: 1614863 - DNA, 19 bp, Homo sapiens
gtgaggggctttctcttcc

SEQ ID NO: 1614864 - DNA, 22 bp, Homo sapiens
gtgaggggctttctcttcccct

SEQ ID NO: 1614865 - DNA, 15 bp, Homo sapiens
gtgagggtcccatgt

SEQ ID NO: 1614866 - DNA, 18 bp, Homo sapiens
gtgagtaatcaatacaga

SEQ ID NO: 1614867 - DNA, 20 bp, Homo sapiens
gtgagtacctgcaaaaatga

SEQ ID NO: 1614868 - DNA, 14 bp, Homo sapiens
gtgagtcaccactt

SEQ ID NO: 1614869 - DNA, 16 bp, Homo sapiens
gtgagtcacctgctcc

SEQ ID NO: 1614870 - DNA, 19 bp, Homo sapiens
gtgagtcacctgctccaga

SEQ ID NO: 1614871 - DNA, 23 bp, Homo sapiens
gtgagtcagcaccttggcccagg

SEQ ID NO: 1614872 - DNA, 16 bp, Homo sapiens
gtgagtcccctactcc

SEQ ID NO: 1614873 - DNA, 16 bp, Homo sapiens
gtgagtcgtttcccct

SEQ ID NO: 1614874 - DNA, 16 bp, Homo sapiens
gtgagtcttggcggca

SEQ ID NO: 1614875 - DNA, 22 bp, Homo sapiens
gtgagtcttggcggcagcagcc

SEQ ID NO: 1614876 - DNA, 18 bp, Homo sapiens
gtgagtcttggttctaaa

SEQ ID NO: 1614877 - DNA, 14 bp, Homo sapiens
gtgagtgatcactg

SEQ ID NO: 1614878 - DNA, 17 bp, Homo sapiens
gtgagtgatcactggta

SEQ ID NO: 1614879 - DNA, 18 bp, Homo sapiens
gtgagtgatcactggtat

SEQ ID NO: 1614880 - DNA, 12 bp, Homo sapiens
gtgagtgccttt

SEQ ID NO: 1614881 - DNA, 18 bp, Homo sapiens
gtgagtttgagctgcctt

SEQ ID NO: 1614882 - DNA, 12 bp, Homo sapiens
gtgatacactgt

SEQ ID NO: 1614883 - DNA, 18 bp, Homo sapiens
gtgatatacaaagtgtac

SEQ ID NO: 1614884 - DNA, 12 bp, Homo sapiens
gtgatatataat

SEQ ID NO: 1614885 - DNA, 21 bp, Homo sapiens
gtgatatcacctctcttcagc

SEQ ID NO: 1614886 - DNA, 13 bp, Homo sapiens
gtgatattctaag

SEQ ID NO: 1614887 - DNA, 17 bp, Homo sapiens
gtgatcaattaaatgta

SEQ ID NO: 1614888 - DNA, 19 bp, Homo sapiens
gtgatcagtgattttcaaa

SEQ ID NO: 1614889 - DNA, 20 bp, Homo sapiens
gtgatccacccgcctcagcc

SEQ ID NO: 1614890 - DNA, 21 bp, Homo sapiens
gtgatccatccatctccaggg

SEQ ID NO: 1614891 - DNA, 18 bp, Homo sapiens
gtgatccttccacctcag

SEQ ID NO: 1614892 - DNA, 19 bp, Homo sapiens
gtgatccttggtgctgtgt

SEQ ID NO: 1614893 - DNA, 22 bp, Homo sapiens
gtgatccttggtgctgtgtgcc

SEQ ID NO: 1614894 - DNA, 23 bp, Homo sapiens
gtgatctcattgttcaattccca

SEQ ID NO: 1614895 - DNA, 22 bp, Homo sapiens
gtgatgaatgtactatgtctga

SEQ ID NO: 1614896 - DNA, 22 bp, Homo sapiens
gtgatgatcagctgtttgtcat

SEQ ID NO: 1614897 - DNA, 17 bp, Homo sapiens
gtgatggccaggccagg

SEQ ID NO: 1614898 - DNA, 17 bp, Homo sapiens
gtgatgggaaagcattg

SEQ ID NO: 1614899 - DNA, 22 bp, Homo sapiens
gtgatgggcgagtcccggagcc

SEQ ID NO: 1614900 - DNA, 14 bp, Homo sapiens
gtgatgggggagag

SEQ ID NO: 1614901 - DNA, 15 bp, Homo sapiens
gtgatgggggagagg

SEQ ID NO: 1614902 - DNA, 16 bp, Homo sapiens
gtgatgggggagaggg

SEQ ID NO: 1614903 - DNA, 17 bp, Homo sapiens
gtgatgggggagagggt

SEQ ID NO: 1614904 - DNA, 15 bp, Homo sapiens
gtgatgggtgcagga

SEQ ID NO: 1614905 - DNA, 16 bp, Homo sapiens
gtgatggttcccctgt

SEQ ID NO: 1614906 - DNA, 22 bp, Homo sapiens
gtgatggttcccctgttcactc

SEQ ID NO: 1614907 - DNA, 18 bp, Homo sapiens
gtgattaaacgtgcagac

SEQ ID NO: 1614908 - DNA, 17 bp, Homo sapiens
gtgattaaagctaagga

SEQ ID NO: 1614909 - DNA, 21 bp, Homo sapiens
gtgattatatttttgggggct

SEQ ID NO: 1614910 - DNA, 14 bp, Homo sapiens
gtgattatttttta

SEQ ID NO: 1614911 - DNA, 21 bp, Homo sapiens
gtgattcaatctgtaaactgt

SEQ ID NO: 1614912 - DNA, 14 bp, Homo sapiens
gtgattcagcaggc

SEQ ID NO: 1614913 - DNA, 22 bp, Homo sapiens
gtgattcctcccaggaggtgct

SEQ ID NO: 1614914 - DNA, 23 bp, Homo sapiens
gtgattccttttgatggggagaa

SEQ ID NO: 1614915 - DNA, 18 bp, Homo sapiens
gtgattctgatttcagtt

SEQ ID NO: 1614916 - DNA, 18 bp, Homo sapiens
gtgattgacacacagcac

SEQ ID NO: 1614917 - DNA, 18 bp, Homo sapiens
gtgattgctgccaggcac

SEQ ID NO: 1614918 - DNA, 23 bp, Homo sapiens
gtgatttcagactgcagagggga

SEQ ID NO: 1614919 - DNA, 16 bp, Homo sapiens
gtgattttaaatgtgt

SEQ ID NO: 1614920 - DNA, 22 bp, Homo sapiens
gtgattttcaaacctcaaatat

SEQ ID NO: 1614921 - DNA, 12 bp, Homo sapiens
gtgatttttgtt

SEQ ID NO: 1614922 - DNA, 14 bp, Homo sapiens
gtgatttttttctt

SEQ ID NO: 1614923 - DNA, 19 bp, Homo sapiens
gtgcaaaatatttgactat

SEQ ID NO: 1614924 - DNA, 17 bp, Homo sapiens
gtgcaaattcagaactg

SEQ ID NO: 1614925 - DNA, 16 bp, Homo sapiens
gtgcaaattcattttt

SEQ ID NO: 1614926 - DNA, 24 bp, Homo sapiens
gtgcaacagggtatggactatctg

SEQ ID NO: 1614927 - DNA, 16 bp, Homo sapiens
gtgcaacatctctgaa

SEQ ID NO: 1614928 - DNA, 16 bp, Homo sapiens
gtgcaacgccgtgggc

SEQ ID NO: 1614929 - DNA, 19 bp, Homo sapiens
gtgcaataaatctgaccca

SEQ ID NO: 1614930 - DNA, 23 bp, Homo sapiens
gtgcaataaatctgacccagtgc

SEQ ID NO: 1614931 - DNA, 23 bp, Homo sapiens
gtgcaataatttgtacaatggtt

SEQ ID NO: 1614932 - DNA, 15 bp, Homo sapiens
gtgcaataggtgaga

SEQ ID NO: 1614933 - DNA, 18 bp, Homo sapiens
gtgcaatttcaaggttct

SEQ ID NO: 1614934 - DNA, 12 bp, Homo sapiens
gtgcacagctgt

SEQ ID NO: 1614935 - DNA, 17 bp, Homo sapiens
gtgcacaggcctctgcc

SEQ ID NO: 1614936 - DNA, 19 bp, Homo sapiens
gtgcacaggcctctgcctg

SEQ ID NO: 1614937 - DNA, 21 bp, Homo sapiens
gtgcacaggcctctgcctgct

SEQ ID NO: 1614938 - DNA, 14 bp, Homo sapiens
gtgcacagtgattt

SEQ ID NO: 1614939 - DNA, 16 bp, Homo sapiens
gtgcacagtggcttct

SEQ ID NO: 1614940 - DNA, 13 bp, Homo sapiens
gtgcacccactca

SEQ ID NO: 1614941 - DNA, 19 bp, Homo sapiens
gtgcacccactcaccaggg

SEQ ID NO: 1614942 - DNA, 20 bp, Homo sapiens
gtgcacccactcaccagggt

SEQ ID NO: 1614943 - DNA, 20 bp, Homo sapiens
gtgcacctgcctccaccagc

SEQ ID NO: 1614944 - DNA, 16 bp, Homo sapiens
gtgcacgcctgcaggc

SEQ ID NO: 1614945 - DNA, 16 bp, Homo sapiens
gtgcacgtggagagct

SEQ ID NO: 1614946 - DNA, 13 bp, Homo sapiens
gtgcactccagct

SEQ ID NO: 1614947 - DNA, 23 bp, Homo sapiens
gtgcactgcctgcatgagctggc

SEQ ID NO: 1614948 - DNA, 19 bp, Homo sapiens
gtgcactgtgaatcctggc

SEQ ID NO: 1614949 - DNA, 20 bp, Homo sapiens
gtgcactgtgaatcctggca

SEQ ID NO: 1614950 - DNA, 15 bp, Homo sapiens
gtgcagaaaatattt

SEQ ID NO: 1614951 - DNA, 18 bp, Homo sapiens
gtgcagaaaatatttaat

SEQ ID NO: 1614952 - DNA, 12 bp, Homo sapiens
gtgcagaatgta

SEQ ID NO: 1614953 - DNA, 22 bp, Homo sapiens
gtgcagaatgtaagtgggccca

SEQ ID NO: 1614954 - DNA, 14 bp, Homo sapiens
gtgcagacagccat

SEQ ID NO: 1614955 - DNA, 23 bp, Homo sapiens
gtgcagacttcttaaaaggagct

SEQ ID NO: 1614956 - DNA, 23 bp, Homo sapiens
gtgcagagccttctcagaagcac

SEQ ID NO: 1614957 - DNA, 23 bp, Homo sapiens
gtgcagaggaagtggaaggcatc

SEQ ID NO: 1614958 - DNA, 15 bp, Homo sapiens
gtgaatccctgggag

SEQ ID NO: 1614959 - DNA, 21 bp, Homo sapiens
gtgaatcgcaaggcctgtgct

SEQ ID NO: 1614960 - DNA, 22 bp, Homo sapiens
gtgaatcgcaaggcctgtgctg

SEQ ID NO: 1614961 - DNA, 17 bp, Homo sapiens
gtgaatgccaaagccat

SEQ ID NO: 1614962 - DNA, 21 bp, Homo sapiens
gtgaatgccaaagccattctc

SEQ ID NO: 1614963 - DNA, 15 bp, Homo sapiens
gtgaatgctgggact

SEQ ID NO: 1614964 - DNA, 18 bp, Homo sapiens
gtgaattaggctgtaact

SEQ ID NO: 1614965 - DNA, 21 bp, Homo sapiens
gtgaattaggctgtaactact

SEQ ID NO: 1614966 - DNA, 12 bp, Homo sapiens
gtgaattgcttt

SEQ ID NO: 1614967 - DNA, 18 bp, Homo sapiens
gtgaattgtcttttagac

SEQ ID NO: 1614968 - DNA, 19 bp, Homo sapiens
gtgaattgtgaccaagtta

SEQ ID NO: 1614969 - DNA, 18 bp, Homo sapiens
gtgaattttcaaggcctt

SEQ ID NO: 1614970 - DNA, 11 bp, Homo sapiens
gtgaattttta

SEQ ID NO: 1614971 - DNA, 15 bp, Homo sapiens
gtgaatttttattgt

SEQ ID NO: 1614972 - DNA, 19 bp, Homo sapiens
gtgaatttttattgttgta

SEQ ID NO: 1614973 - DNA, 14 bp, Homo sapiens
gtgaatttttctct

SEQ ID NO: 1614974 - DNA, 18 bp, Homo sapiens
gtgacaaagccagaggag

SEQ ID NO: 1614975 - DNA, 15 bp, Homo sapiens
gtgacaagtgaagaa

SEQ ID NO: 1614976 - DNA, 20 bp, Homo sapiens
gtgacacaatcctcaaacat

SEQ ID NO: 1614977 - DNA, 14 bp, Homo sapiens
gtgacacagacatt

SEQ ID NO: 1614978 - DNA, 19 bp, Homo sapiens
gtgacacagcagcttcacc

SEQ ID NO: 1614979 - DNA, 19 bp, Homo sapiens
gtgacacatcgttttgggg

SEQ ID NO: 1614980 - DNA, 20 bp, Homo sapiens
gtgacaccaataaatgtttg

SEQ ID NO: 1614981 - DNA, 23 bp, Homo sapiens
gtgacaccaataaatgtttgtta

SEQ ID NO: 1614982 - DNA, 15 bp, Homo sapiens
gtgacacctccccct

SEQ ID NO: 1614983 - DNA, 14 bp, Homo sapiens
gtgacacctggtgc

SEQ ID NO: 1614984 - DNA, 16 bp, Homo sapiens
gtgacagacaggctct

SEQ ID NO: 1614985 - DNA, 17 bp, Homo sapiens
gtgacagacaggctctt

SEQ ID NO: 1614986 - DNA, 23 bp, Homo sapiens
gtgacagaccacatctttatctg

SEQ ID NO: 1614987 - DNA, 17 bp, Homo sapiens
gtgacagagttcactat

SEQ ID NO: 1614988 - DNA, 18 bp, Homo sapiens
gtgacagagttcactata

SEQ ID NO: 1614989 - DNA, 13 bp, Homo sapiens
gtgacagctttct

SEQ ID NO: 1614990 - DNA, 19 bp, Homo sapiens
gtgacagctttctgggatg

SEQ ID NO: 1614991 - DNA, 17 bp, Homo sapiens
gtgacagtgcctgggaa

SEQ ID NO: 1614992 - DNA, 23 bp, Homo sapiens
gtgacagtgcctgggaatgtatt

SEQ ID NO: 1614993 - DNA, 16 bp, Homo sapiens
gtgacatagcctcatg

SEQ ID NO: 1614994 - DNA, 14 bp, Homo sapiens
gtgacatcctgctt

SEQ ID NO: 1614995 - DNA, 19 bp, Homo sapiens
gtgacatcggaaaaataat

SEQ ID NO: 1614996 - DNA, 12 bp, Homo sapiens
gtgacattgaaa

SEQ ID NO: 1614997 - DNA, 19 bp, Homo sapiens
gtgaccaagttataaatca

SEQ ID NO: 1614998 - DNA, 16 bp, Homo sapiens
gtgaccaatacatttg

SEQ ID NO: 1614999 - DNA, 13 bp, Homo sapiens
gtgaccaggcttt

SEQ ID NO: 1615000 - DNA, 20 bp, Homo sapiens
gtgaccaggcttttgtagat

SEQ ID NO: 1615001 - DNA, 13 bp, Homo sapiens
gtgaccatgttca

SEQ ID NO: 1615002 - DNA, 20 bp, Homo sapiens
gtgaccctgggcaagtcact

SEQ ID NO: 1615003 - DNA, 18 bp, Homo sapiens
gtgacccttcagggccag

SEQ ID NO: 1615004 - DNA, 21 bp, Homo sapiens
gtgaccggacttttctgcaaa

SEQ ID NO: 1615005 - DNA, 20 bp, Homo sapiens
gtgacctatcagttattaat

SEQ ID NO: 1615006 - DNA, 15 bp, Homo sapiens
gtgacctccatactg

SEQ ID NO: 1615007 - DNA, 13 bp, Homo sapiens
gtgacctctctct

SEQ ID NO: 1615008 - DNA, 16 bp, Homo sapiens
gtgacctctctctctg

SEQ ID NO: 1615009 - DNA, 23 bp, Homo sapiens
gtgacctgaggatttaagggatg

SEQ ID NO: 1615010 - DNA, 23 bp, Homo sapiens
gtgacctgccccgcccagctgca

SEQ ID NO: 1615011 - DNA, 22 bp, Homo sapiens
gtgacctgggtatcccctgcct

SEQ ID NO: 1615012 - DNA, 23 bp, Homo sapiens
gtgacctgggtatcccctgcctc

SEQ ID NO: 1615013 - DNA, 12 bp, Homo sapiens
gtgactaggaaa

SEQ ID NO: 1615014 - DNA, 12 bp, Homo sapiens
gtgactataaag

SEQ ID NO: 1615015 - DNA, 17 bp, Homo sapiens
gtgactataaagctgtt

SEQ ID NO: 1615016 - DNA, 21 bp, Homo sapiens
gtgactatggagctgagcagg

SEQ ID NO: 1615017 - DNA, 20 bp, Homo sapiens
gtgactcctgctggtacctg

SEQ ID NO: 1615018 - DNA, 15 bp, Homo sapiens
gtgactctagcaagg

SEQ ID NO: 1615019 - DNA, 15 bp, Homo sapiens
gtgactgaagaagat

SEQ ID NO: 1615020 - DNA, 18 bp, Homo sapiens
gtgactgaaggggcacac

SEQ ID NO: 1615021 - DNA, 19 bp, Homo sapiens
gtgactgaaggggcacacc

SEQ ID NO: 1615022 - DNA, 14 bp, Homo sapiens
gtgactggatcttc

SEQ ID NO: 1615023 - DNA, 12 bp, Homo sapiens
gtgactggcagg

SEQ ID NO: 1615024 - DNA, 15 bp, Homo sapiens
gtgactggcaggtgc

SEQ ID NO: 1615025 - DNA, 21 bp, Homo sapiens
gtgactggcaggtgcagatgg

SEQ ID NO: 1615026 - DNA, 15 bp, Homo sapiens
gtgactgtatctgtg

SEQ ID NO: 1615027 - DNA, 19 bp, Homo sapiens
gtgactgtatctgtgtaga

SEQ ID NO: 1615028 - DNA, 21 bp, Homo sapiens
gtgactgtcaagtacaagcaa

SEQ ID NO: 1615029 - DNA, 13 bp, Homo sapiens
gtgactgtgctgt

SEQ ID NO: 1615030 - DNA, 21 bp, Homo sapiens
gtgactgtgtttgcattgtct

SEQ ID NO: 1615031 - DNA, 22 bp, Homo sapiens
gtgactgtgtttgcattgtcta

SEQ ID NO: 1615032 - DNA, 14 bp, Homo sapiens
gtgacttcactgta

SEQ ID NO: 1615033 - DNA, 18 bp, Homo sapiens
gtgacttctcccctgccc

SEQ ID NO: 1615034 - DNA, 19 bp, Homo sapiens
gtgacttctcccctgccct

SEQ ID NO: 1615035 - DNA, 20 bp, Homo sapiens
gtgactttttagccagtgac

SEQ ID NO: 1615036 - DNA, 17 bp, Homo sapiens
gtgagaaaatgcctcaa

SEQ ID NO: 1615037 - DNA, 14 bp, Homo sapiens
gtgagaacccagag

SEQ ID NO: 1615038 - DNA, 17 bp, Homo sapiens
gtgagaacccagtttcc

SEQ ID NO: 1615039 - DNA, 22 bp, Homo sapiens
gtgagaactctctccctggtct

SEQ ID NO: 1615040 - DNA, 15 bp, Homo sapiens
gtgagaagtcactca

SEQ ID NO: 1615041 - DNA, 21 bp, Homo sapiens
gtgagaagtgaatgctgggac

SEQ ID NO: 1615042 - DNA, 14 bp, Homo sapiens
gtgagaataagaga

SEQ ID NO: 1615043 - DNA, 22 bp, Homo sapiens
gtgagaataagagagtcataaa

SEQ ID NO: 1615044 - DNA, 19 bp, Homo sapiens
gtgagaattaagttttaaa

SEQ ID NO: 1615045 - DNA, 15 bp, Homo sapiens
gtgagacccccacac

SEQ ID NO: 1615046 - DNA, 17 bp, Homo sapiens
gtgagacccccacacct

SEQ ID NO: 1615047 - DNA, 15 bp, Homo sapiens
gtgagaccctcgcag

SEQ ID NO: 1615048 - DNA, 18 bp, Homo sapiens
gtgagacgaggcaggggc

SEQ ID NO: 1615049 - DNA, 20 bp, Homo sapiens
gtgagactcgagaactttca

SEQ ID NO: 1615050 - DNA, 16 bp, Homo sapiens
gtgagacttaaaacat

SEQ ID NO: 1615051 - DNA, 12 bp, Homo sapiens
gtgagagaaaga

SEQ ID NO: 1615052 - DNA, 14 bp, Homo sapiens
gtgagagaaagaga

SEQ ID NO: 1615053 - DNA, 16 bp, Homo sapiens
gtgagagaaagagaga

SEQ ID NO: 1615054 - DNA, 19 bp, Homo sapiens
gtgagagaaagagagaagc

SEQ ID NO: 1615055 - DNA, 20 bp, Homo sapiens
gtgagagaaagagagaagcc

SEQ ID NO: 1615056 - DNA, 21 bp, Homo sapiens
gtgagagaaagagagaagcca

SEQ ID NO: 1615057 - DNA, 17 bp, Homo sapiens
gtgagagaatctgcctg

SEQ ID NO: 1615058 - DNA, 15 bp, Homo sapiens
gtgagagaatgtatt

SEQ ID NO: 1615059 - DNA, 18 bp, Homo sapiens
gtgagagacctctgccta

SEQ ID NO: 1615060 - DNA, 16 bp, Homo sapiens
gtgagagccagcagca

SEQ ID NO: 1615061 - DNA, 12 bp, Homo sapiens
gtgagagcccat

SEQ ID NO: 1615062 - DNA, 15 bp, Homo sapiens
gtgagaggcaatgac

SEQ ID NO: 1615063 - DNA, 23 bp, Homo sapiens
gtgagagggcatgcgcacaaggc

SEQ ID NO: 1615064 - DNA, 16 bp, Homo sapiens
gtgagcagaacaggta

SEQ ID NO: 1615065 - DNA, 20 bp, Homo sapiens
gtgagcagaagtggagctgg

SEQ ID NO: 1615066 - DNA, 19 bp, Homo sapiens
gtgagcagagatgtactgc

SEQ ID NO: 1615067 - DNA, 21 bp, Homo sapiens
gtgagcagcctccactgtgtc

SEQ ID NO: 1615068 - DNA, 21 bp, Homo sapiens
gtgagcaggcagggctgggcc

SEQ ID NO: 1615069 - DNA, 19 bp, Homo sapiens
gtgagcagggtcaagcctc

SEQ ID NO: 1615070 - DNA, 21 bp, Homo sapiens
gtgagcagggtcaagcctctt

SEQ ID NO: 1615071 - DNA, 16 bp, Homo sapiens
gtgagcatcagagggc

SEQ ID NO: 1615072 - DNA, 16 bp, Homo sapiens
gtgagcatgggtgtgc

SEQ ID NO: 1615073 - DNA, 21 bp, Homo sapiens
gtgagccacagaccacctgct

SEQ ID NO: 1615074 - DNA, 17 bp, Homo sapiens
gtctatgttcaaagact

SEQ ID NO: 1615075 - DNA, 20 bp, Homo sapiens
gtctattaaaattctgatgt

SEQ ID NO: 1615076 - DNA, 21 bp, Homo sapiens
gtctattaaaattctgatgtt

SEQ ID NO: 1615077 - DNA, 23 bp, Homo sapiens
gtctattaaaattctgatgtttc

SEQ ID NO: 1615078 - DNA, 17 bp, Homo sapiens
gtctattatcacattaa

SEQ ID NO: 1615079 - DNA, 14 bp, Homo sapiens
gtctattctgagcc

SEQ ID NO: 1615080 - DNA, 12 bp, Homo sapiens
gtctattttatt

SEQ ID NO: 1615081 - DNA, 23 bp, Homo sapiens
gtctattttcttgaggaaaatat

SEQ ID NO: 1615082 - DNA, 16 bp, Homo sapiens
gtctatttttgtctta

SEQ ID NO: 1615083 - DNA, 18 bp, Homo sapiens
gtctcaacgcctccccct

SEQ ID NO: 1615084 - DNA, 15 bp, Homo sapiens
gtctcaagagggcac

SEQ ID NO: 1615085 - DNA, 17 bp, Homo sapiens
gtctcaagagggcactg

SEQ ID NO: 1615086 - DNA, 22 bp, Homo sapiens
gtctcacagagaagctcctgct

SEQ ID NO: 1615087 - DNA, 20 bp, Homo sapiens
gtctcaccggctctcacctg

SEQ ID NO: 1615088 - DNA, 19 bp, Homo sapiens
gtctcacctggacttaagc

SEQ ID NO: 1615089 - DNA, 14 bp, Homo sapiens
gtctcactgcttga

SEQ ID NO: 1615090 - DNA, 15 bp, Homo sapiens
gtctcagagaccagc

SEQ ID NO: 1615091 - DNA, 16 bp, Homo sapiens
gtctcagagaccagca

SEQ ID NO: 1615092 - DNA, 17 bp, Homo sapiens
gtctcagagaccagcac

SEQ ID NO: 1615093 - DNA, 18 bp, Homo sapiens
gtctcagagaccagcact

SEQ ID NO: 1615094 - DNA, 19 bp, Homo sapiens
gtctcagagcacagaggta

SEQ ID NO: 1615095 - DNA, 14 bp, Homo sapiens
gtctcagctgctga

SEQ ID NO: 1615096 - DNA, 15 bp, Homo sapiens
gtctcagctgctgaa

SEQ ID NO: 1615097 - DNA, 22 bp, Homo sapiens
gtctcagctgctgacacgcagc

SEQ ID NO: 1615098 - DNA, 16 bp, Homo sapiens
gtctcaggcagcacca

SEQ ID NO: 1615099 - DNA, 19 bp, Homo sapiens
gtctcaggcagcaccacac

SEQ ID NO: 1615100 - DNA, 18 bp, Homo sapiens
gtctcagtttgtgtgtct

SEQ ID NO: 1615101 - DNA, 19 bp, Homo sapiens
gtctcatctcttcaggttc

SEQ ID NO: 1615102 - DNA, 23 bp, Homo sapiens
gtctcattcgcctttgtcttgta

SEQ ID NO: 1615103 - DNA, 16 bp, Homo sapiens
gtctccaaccccccag

SEQ ID NO: 1615104 - DNA, 21 bp, Homo sapiens
gtctccaaccccccagcactg

SEQ ID NO: 1615105 - DNA, 22 bp, Homo sapiens
gtctccaaccccccagcactga

SEQ ID NO: 1615106 - DNA, 22 bp, Homo sapiens
gtctccactaaatgagctcctg

SEQ ID NO: 1615107 - DNA, 11 bp, Homo sapiens
gtctccagctg

SEQ ID NO: 1615108 - DNA, 20 bp, Homo sapiens
gtctccagctgcctgggccc

SEQ ID NO: 1615109 - DNA, 17 bp, Homo sapiens
gtctccagggcccccca

SEQ ID NO: 1615110 - DNA, 19 bp, Homo sapiens
gtctccaggggcctgcaga

SEQ ID NO: 1615111 - DNA, 16 bp, Homo sapiens
gtctccaggggctgct

SEQ ID NO: 1615112 - DNA, 23 bp, Homo sapiens
gtctccaggggctgcttcctcct

SEQ ID NO: 1615113 - DNA, 20 bp, Homo sapiens
gtctccatatcagctctctg

SEQ ID NO: 1615114 - DNA, 16 bp, Homo sapiens
gtctccctcccctctc

SEQ ID NO: 1615115 - DNA, 18 bp, Homo sapiens
gtctccctcccctctcag

SEQ ID NO: 1615116 - DNA, 20 bp, Homo sapiens
gtctccctcccctctcagaa

SEQ ID NO: 1615117 - DNA, 22 bp, Homo sapiens
gtctccctctcctgcctactca

SEQ ID NO: 1615118 - DNA, 13 bp, Homo sapiens
gtctccctgcaca

SEQ ID NO: 1615119 - DNA, 13 bp, Homo sapiens
gtctccctgggag

SEQ ID NO: 1615120 - DNA, 14 bp, Homo sapiens
gtctccctggtgcc

SEQ ID NO: 1615121 - DNA, 23 bp, Homo sapiens
gtctccctggtggggtgtgcatg

SEQ ID NO: 1615122 - DNA, 13 bp, Homo sapiens
gtctcccttctct

SEQ ID NO: 1615123 - DNA, 15 bp, Homo sapiens
gtctcccttctctct

SEQ ID NO: 1615124 - DNA, 17 bp, Homo sapiens
gtctccgggactgccct

SEQ ID NO: 1615125 - DNA, 22 bp, Homo sapiens
gtctcctatatatttctattat

SEQ ID NO: 1615126 - DNA, 13 bp, Homo sapiens
gtctcctcagggt

SEQ ID NO: 1615127 - DNA, 16 bp, Homo sapiens
gtctcctccccttccc

SEQ ID NO: 1615128 - DNA, 15 bp, Homo sapiens
gtctcctccctcagc

SEQ ID NO: 1615129 - DNA, 19 bp, Homo sapiens
gtctcctccctcagctctc

SEQ ID NO: 1615130 - DNA, 19 bp, Homo sapiens
gtctcctcctcgaagccat

SEQ ID NO: 1615131 - DNA, 13 bp, Homo sapiens
gtctcctctctga

SEQ ID NO: 1615132 - DNA, 14 bp, Homo sapiens
gtctcctcttaaaa

SEQ ID NO: 1615133 - DNA, 20 bp, Homo sapiens
gtctcctgactggtgctgca

SEQ ID NO: 1615134 - DNA, 13 bp, Homo sapiens
gtctcctggacct

SEQ ID NO: 1615135 - DNA, 12 bp, Homo sapiens
gtctcctgtctt

SEQ ID NO: 1615136 - DNA, 22 bp, Homo sapiens
gtctccttactctgagcccagg

SEQ ID NO: 1615137 - DNA, 23 bp, Homo sapiens
gtctcctttgcactgagggccac

SEQ ID NO: 1615138 - DNA, 15 bp, Homo sapiens
gtctcctttgctctt

SEQ ID NO: 1615139 - DNA, 15 bp, Homo sapiens
gtctcgaatgtaatt

SEQ ID NO: 1615140 - DNA, 16 bp, Homo sapiens
gtctcgatctcctgac

SEQ ID NO: 1615141 - DNA, 20 bp, Homo sapiens
gtctcgatgccataatcaga

SEQ ID NO: 1615142 - DNA, 23 bp, Homo sapiens
gtctcgatgccataatcagaaca

SEQ ID NO: 1615143 - DNA, 14 bp, Homo sapiens
gtctcgcagcctga

SEQ ID NO: 1615144 - DNA, 17 bp, Homo sapiens
gtctcgctttgttgccc

SEQ ID NO: 1615145 - DNA, 19 bp, Homo sapiens
gtctcgctttgttgcccag

SEQ ID NO: 1615146 - DNA, 23 bp, Homo sapiens
gtctcgctttgttgcccaggctg

SEQ ID NO: 1615147 - DNA, 21 bp, Homo sapiens
gtctcggatgacaccctggcc

SEQ ID NO: 1615148 - DNA, 22 bp, Homo sapiens
gtctcggatgacaccctggcct

SEQ ID NO: 1615149 - DNA, 16 bp, Homo sapiens
gtctctaaaaagaagc

SEQ ID NO: 1615150 - DNA, 21 bp, Homo sapiens
gtctctaaaaagaagccacag

SEQ ID NO: 1615151 - DNA, 22 bp, Homo sapiens
gtctctacttttccctgtactt

SEQ ID NO: 1615152 - DNA, 16 bp, Homo sapiens
gtctctagctgttctg

SEQ ID NO: 1615153 - DNA, 18 bp, Homo sapiens
gtctctataccaataaag

SEQ ID NO: 1615154 - DNA, 20 bp, Homo sapiens
gtctctataccaataaagtg

SEQ ID NO: 1615155 - DNA, 22 bp, Homo sapiens
gtctctatattatgtcttcttt

SEQ ID NO: 1615156 - DNA, 23 bp, Homo sapiens
gtctctatattgcttagtaagta

SEQ ID NO: 1615157 - DNA, 17 bp, Homo sapiens
gtctctatgccagctca

SEQ ID NO: 1615158 - DNA, 23 bp, Homo sapiens
gtctctatgccagctcagtccca

SEQ ID NO: 1615159 - DNA, 19 bp, Homo sapiens
gtctctccactgctctcag

SEQ ID NO: 1615160 - DNA, 20 bp, Homo sapiens
gtctctcccaccccggcctc

SEQ ID NO: 1615161 - DNA, 18 bp, Homo sapiens
gtctctccttcctcttgg

SEQ ID NO: 1615162 - DNA, 17 bp, Homo sapiens
gtctctctccaggtcag

SEQ ID NO: 1615163 - DNA, 15 bp, Homo sapiens
gtctctctctctcta

SEQ ID NO: 1615164 - DNA, 15 bp, Homo sapiens
gtctctctgggctgc

SEQ ID NO: 1615165 - DNA, 14 bp, Homo sapiens
gtctctcttctctc

SEQ ID NO: 1615166 - DNA, 20 bp, Homo sapiens
gtctctcttctctccagctg

SEQ ID NO: 1615167 - DNA, 20 bp, Homo sapiens
gtctctcttgcttgaggaat

SEQ ID NO: 1615168 - DNA, 19 bp, Homo sapiens
gtctctctttctccctcac

SEQ ID NO: 1615169 - DNA, 13 bp, Homo sapiens
gtctctgagtcct

SEQ ID NO: 1615170 - DNA, 20 bp, Homo sapiens
gtctctgctggcccagccaa

SEQ ID NO: 1615171 - DNA, 12 bp, Homo sapiens
gtctctgctggg

SEQ ID NO: 1615172 - DNA, 16 bp, Homo sapiens
gtctctgggagcccag

SEQ ID NO: 1615173 - DNA, 14 bp, Homo sapiens
gtctctgggcacag

SEQ ID NO: 1615174 - DNA, 12 bp, Homo sapiens
gtctctgtcctc

SEQ ID NO: 1615175 - DNA, 21 bp, Homo sapiens
gtctctgttaacatctagcct

SEQ ID NO: 1615176 - DNA, 22 bp, Homo sapiens
gtctctgttaacatctagccta

SEQ ID NO: 1615177 - DNA, 16 bp, Homo sapiens
gtctctgttcagatgt

SEQ ID NO: 1615178 - DNA, 17 bp, Homo sapiens
gtctcttaaaaaaataa

SEQ ID NO: 1615179 - DNA, 11 bp, Homo sapiens
gtctcttcaga

SEQ ID NO: 1615180 - DNA, 15 bp, Homo sapiens
gtctcttctccactg

SEQ ID NO: 1615181 - DNA, 18 bp, Homo sapiens
gtctcttctccactggat

SEQ ID NO: 1615182 - DNA, 14 bp, Homo sapiens
gtctcttctgagct

SEQ ID NO: 1615183 - DNA, 22 bp, Homo sapiens
gtctcttctgagctatttcatc

SEQ ID NO: 1615184 - DNA, 20 bp, Homo sapiens
gtctcttgagcatcaatctt

SEQ ID NO: 1615185 - DNA, 21 bp, Homo sapiens
gtctcttgagcatcaatcttg

SEQ ID NO: 1615186 - DNA, 22 bp, Homo sapiens
gtctcttgagcatcaatcttgt

SEQ ID NO: 1615187 - DNA, 23 bp, Homo sapiens
gtctcttgagggagcttagccaa

SEQ ID NO: 1615188 - DNA, 14 bp, Homo sapiens
gtctcttttctctt

SEQ ID NO: 1615189 - DNA, 21 bp, Homo sapiens
gtctctttttttggcccaggc

SEQ ID NO: 1615190 - DNA, 14 bp, Homo sapiens
gtctgaaactggct

SEQ ID NO: 1615191 - DNA, 22 bp, Homo sapiens
gtctgaaactggcttccccact

SEQ ID NO: 1615192 - DNA, 15 bp, Homo sapiens
gtctgaacatagaaa

SEQ ID NO: 1615193 - DNA, 23 bp, Homo sapiens
gtctgaaggaatagccagagagg

SEQ ID NO: 1615194 - DNA, 21 bp, Homo sapiens
gtctgaaggacacttcctgcc

SEQ ID NO: 1615195 - DNA, 22 bp, Homo sapiens
gtctgaaggacacttcctgcct

SEQ ID NO: 1615196 - DNA, 21 bp, Homo sapiens
gtctgaaggactggattggcc

SEQ ID NO: 1615197 - DNA, 16 bp, Homo sapiens
gtctgaagtcactgca

SEQ ID NO: 1615198 - DNA, 12 bp, Homo sapiens
gtctgaatattt

SEQ ID NO: 1615199 - DNA, 13 bp, Homo sapiens
gtctgaatatttt

SEQ ID NO: 1615200 - DNA, 17 bp, Homo sapiens
gtctgacctaatatttg

SEQ ID NO: 1615201 - DNA, 12 bp, Homo sapiens
gtctgacctggt

SEQ ID NO: 1615202 - DNA, 18 bp, Homo sapiens
gtctgacctggtgggagc

SEQ ID NO: 1615203 - DNA, 14 bp, Homo sapiens
gtctgactccagag

SEQ ID NO: 1615204 - DNA, 16 bp, Homo sapiens
gtctgagcatgatggg

SEQ ID NO: 1615205 - DNA, 14 bp, Homo sapiens
gtctgagctggggt

SEQ ID NO: 1615206 - DNA, 19 bp, Homo sapiens
gtctgaggcctcatccctc

SEQ ID NO: 1615207 - DNA, 17 bp, Homo sapiens
gtctgagtcctgtctct

SEQ ID NO: 1615208 - DNA, 21 bp, Homo sapiens
gtctgagtcctgtctctgcct

SEQ ID NO: 1615209 - DNA, 17 bp, Homo sapiens
gtctgagtctatgttca

SEQ ID NO: 1615210 - DNA, 16 bp, Homo sapiens
gtctgatattaatcaa

SEQ ID NO: 1615211 - DNA, 12 bp, Homo sapiens
gtctgattggct

SEQ ID NO: 1615212 - DNA, 14 bp, Homo sapiens
gtctgattggctgc

SEQ ID NO: 1615213 - DNA, 16 bp, Homo sapiens
gtctgattggctgctt

SEQ ID NO: 1615214 - DNA, 22 bp, Homo sapiens
gtctgatttcaggatactctgt

SEQ ID NO: 1615215 - DNA, 13 bp, Homo sapiens
gtctgattttaat

SEQ ID NO: 1615216 - DNA, 22 bp, Homo sapiens
gtctgattttctcactgaactc

SEQ ID NO: 1615217 - DNA, 23 bp, Homo sapiens
gtctgattttctcactgaactcc

SEQ ID NO: 1615218 - DNA, 18 bp, Homo sapiens
gtctgcagcccggcgcca

SEQ ID NO: 1615219 - DNA, 19 bp, Homo sapiens
gtctgcagcccggcgccac

SEQ ID NO: 1615220 - DNA, 19 bp, Homo sapiens
gtctgcagctcaagggctg

SEQ ID NO: 1615221 - DNA, 14 bp, Homo sapiens
gtctgcaggtgggc

SEQ ID NO: 1615222 - DNA, 20 bp, Homo sapiens
gtctgcaggtgggctgctga

SEQ ID NO: 1615223 - DNA, 21 bp, Homo sapiens
gtctgcaggtgggctgctgag

SEQ ID NO: 1615224 - DNA, 18 bp, Homo sapiens
gtctgcagtcctggtggg

SEQ ID NO: 1615225 - DNA, 22 bp, Homo sapiens
gtctgcattgttattgtggaag

SEQ ID NO: 1615226 - DNA, 13 bp, Homo sapiens
gtctgccaaacac

SEQ ID NO: 1615227 - DNA, 14 bp, Homo sapiens
gtctgccaaacaca

SEQ ID NO: 1615228 - DNA, 15 bp, Homo sapiens
gtctgccaaacacat

SEQ ID NO: 1615229 - DNA, 19 bp, Homo sapiens
gtctgccaacctaaaactc

SEQ ID NO: 1615230 - DNA, 17 bp, Homo sapiens
gtctgccagccagcagc

SEQ ID NO: 1615231 - DNA, 20 bp, Homo sapiens
gtctgccagctgggcccagc

SEQ ID NO: 1615232 - DNA, 11 bp, Homo sapiens
gtctgccaggc

SEQ ID NO: 1615233 - DNA, 16 bp, Homo sapiens
gtctgccatgttgccc

SEQ ID NO: 1615234 - DNA, 17 bp, Homo sapiens
gtctgccccacatgtgg

SEQ ID NO: 1615235 - DNA, 22 bp, Homo sapiens
gtctgcctaggagctggctggc

SEQ ID NO: 1615236 - DNA, 13 bp, Homo sapiens
gtctgccttcaca

SEQ ID NO: 1615237 - DNA, 18 bp, Homo sapiens
gtctgcgcctgaaaaggg

SEQ ID NO: 1615238 - DNA, 16 bp, Homo sapiens
gtctgctaaataaaca

SEQ ID NO: 1615239 - DNA, 23 bp, Homo sapiens
gtctgctcagacagaacccctac

SEQ ID NO: 1615240 - DNA, 22 bp, Homo sapiens
gtctgctcataggacctgcatc

SEQ ID NO: 1615241 - DNA, 23 bp, Homo sapiens
gtctgctcataggacctgcatcc

SEQ ID NO: 1615242 - DNA, 13 bp, Homo sapiens
gtctgctccacca

SEQ ID NO: 1615243 - DNA, 14 bp, Homo sapiens
gtctgctccaccaa

SEQ ID NO: 1615244 - DNA, 17 bp, Homo sapiens
gtctgctctttctctgc

SEQ ID NO: 1615245 - DNA, 19 bp, Homo sapiens
gtctgctctttctctgcca

SEQ ID NO: 1615246 - DNA, 20 bp, Homo sapiens
gtctgctgatcaaaagcatt

SEQ ID NO: 1615247 - DNA, 15 bp, Homo sapiens
gtctgctgatgcagc

SEQ ID NO: 1615248 - DNA, 17 bp, Homo sapiens
gtctgctgccagcacag

SEQ ID NO: 1615249 - DNA, 16 bp, Homo sapiens
gtctgctgctgcctcc

SEQ ID NO: 1615250 - DNA, 17 bp, Homo sapiens
gtctgctggtatttcta

SEQ ID NO: 1615251 - DNA, 14 bp, Homo sapiens
gtctggagaagcag

SEQ ID NO: 1615252 - DNA, 13 bp, Homo sapiens
gtctggaggccga

SEQ ID NO: 1615253 - DNA, 14 bp, Homo sapiens
gtctggccctgggg

SEQ ID NO: 1615254 - DNA, 21 bp, Homo sapiens
gtctggcgttctcaagaatct

SEQ ID NO: 1615255 - DNA, 14 bp, Homo sapiens
gtctggctccctgc

SEQ ID NO: 1615256 - DNA, 13 bp, Homo sapiens
gtctggctgagcc

SEQ ID NO: 1615257 - DNA, 14 bp, Homo sapiens
gtctggctgagccc

SEQ ID NO: 1615258 - DNA, 19 bp, Homo sapiens
gtctggctgagcccctggg

SEQ ID NO: 1615259 - DNA, 21 bp, Homo sapiens
gtctgggatatggctgcccag

SEQ ID NO: 1615260 - DNA, 22 bp, Homo sapiens
gtctgggatatggctgcccagg

SEQ ID NO: 1615261 - DNA, 16 bp, Homo sapiens
gtctgggatgtagaac

SEQ ID NO: 1615262 - DNA, 17 bp, Homo sapiens
gtctgggatgtagaact

SEQ ID NO: 1615263 - DNA, 23 bp, Homo sapiens
gtctgggcaccacctctgtgggc

SEQ ID NO: 1615264 - DNA, 18 bp, Homo sapiens
gtctggggttcagcccct

SEQ ID NO: 1615265 - DNA, 14 bp, Homo sapiens
gtctggtgctgagg

SEQ ID NO: 1615266 - DNA, 20 bp, Homo sapiens
gtctggtggccccgtttctg

SEQ ID NO: 1615267 - DNA, 18 bp, Homo sapiens
gtctggttgggcagccag

SEQ ID NO: 1615268 - DNA, 18 bp, Homo sapiens
gtctgtaatgacaaataa

SEQ ID NO: 1615269 - DNA, 19 bp, Homo sapiens
gtctgtacacgtgtcctgt

SEQ ID NO: 1615270 - DNA, 21 bp, Homo sapiens
gtctgtacacgtgtcctgtag

SEQ ID NO: 1615271 - DNA, 22 bp, Homo sapiens
gtctgtatactcctgtcaccta

SEQ ID NO: 1615272 - DNA, 23 bp, Homo sapiens
gtctgtatttatgtgtgaggagc

SEQ ID NO: 1615273 - DNA, 15 bp, Homo sapiens
gtctgtcccttttct

SEQ ID NO: 1615274 - DNA, 21 bp, Homo sapiens
gtctgtctacatttctgcaga

SEQ ID NO: 1615275 - DNA, 15 bp, Homo sapiens
gtctgtctactgtgg

SEQ ID NO: 1615276 - DNA, 13 bp, Homo sapiens
gtctgtgaagagc

SEQ ID NO: 1615277 - DNA, 12 bp, Homo sapiens
gtctgtgactgg

SEQ ID NO: 1615278 - DNA, 14 bp, Homo sapiens
gtctgtgactggat

SEQ ID NO: 1615279 - DNA, 18 bp, Homo sapiens
gtctgtgccctccaaaga

SEQ ID NO: 1615280 - DNA, 14 bp, Homo sapiens
gtctgtgctgtgcc

SEQ ID NO: 1615281 - DNA, 19 bp, Homo sapiens
gtctgtgctgtgcctgcta

SEQ ID NO: 1615282 - DNA, 20 bp, Homo sapiens
gtctgtgtaacatccaagcc

SEQ ID NO: 1615283 - DNA, 19 bp, Homo sapiens
gtctgtgtcccagccacgc

SEQ ID NO: 1615284 - DNA, 18 bp, Homo sapiens
gtctgtgtggtggagcca

SEQ ID NO: 1615285 - DNA, 21 bp, Homo sapiens
gtctgtgtgtgtgtgtgtgcg

SEQ ID NO: 1615286 - DNA, 19 bp, Homo sapiens
gtctgttaccttgttaata

SEQ ID NO: 1615287 - DNA, 17 bp, Homo sapiens
gtctgttcacttttcct

SEQ ID NO: 1615288 - DNA, 15 bp, Homo sapiens
gtctgttcagcaaac

SEQ ID NO: 1615289 - DNA, 16 bp, Homo sapiens
gtctgttggcaggctg

SEQ ID NO: 1615290 - DNA, 22 bp, Homo sapiens
gtctgttgtgtgtcatgccagt

SEQ ID NO: 1615291 - DNA, 22 bp, Homo sapiens
gtctgtttcaatgacctgtatt

SEQ ID NO: 1615292 - DNA, 13 bp, Homo sapiens
gtctgtttggact

SEQ ID NO: 1615293 - DNA, 17 bp, Homo sapiens
gtctgttttgtgtctgg

SEQ ID NO: 1615294 - DNA, 22 bp, Homo sapiens
gtctgttttgtgtctggtgcag

SEQ ID NO: 1615295 - DNA, 17 bp, Homo sapiens
gtcttaaactaaatgtg

SEQ ID NO: 1615296 - DNA, 16 bp, Homo sapiens
gtcttaacgaataaag

SEQ ID NO: 1615297 - DNA, 20 bp, Homo sapiens
gtcttaacgaataaaggtcc

SEQ ID NO: 1615298 - DNA, 13 bp, Homo sapiens
gtcttaagtgttt

SEQ ID NO: 1615299 - DNA, 19 bp, Homo sapiens
gtcttaattattatttgtg

SEQ ID NO: 1615300 - DNA, 23 bp, Homo sapiens
gtcttactaatttaaagatgctg

SEQ ID NO: 1615301 - DNA, 15 bp, Homo sapiens
gtcttagatgtatat

SEQ ID NO: 1615302 - DNA, 21 bp, Homo sapiens
gtcttaggtcaggagttgtgt

SEQ ID NO: 1615303 - DNA, 14 bp, Homo sapiens
gtcttatggtccag

SEQ ID NO: 1615304 - DNA, 17 bp, Homo sapiens
gtcttatggtccagaaa

SEQ ID NO: 1615305 - DNA, 20 bp, Homo sapiens
gtcttatggtccagaaactc

SEQ ID NO: 1615306 - DNA, 14 bp, Homo sapiens
gtatcttctatttt

SEQ ID NO: 1615307 - DNA, 17 bp, Homo sapiens
gtatcttctatttttat

SEQ ID NO: 1615308 - DNA, 20 bp, Homo sapiens
gtatcttgaaatcctggaaa

SEQ ID NO: 1615309 - DNA, 16 bp, Homo sapiens
gtatctttatgctgta

SEQ ID NO: 1615310 - DNA, 15 bp, Homo sapiens
gtatctttattaaaa

SEQ ID NO: 1615311 - DNA, 19 bp, Homo sapiens
gtatctttctttctctaat

SEQ ID NO: 1615312 - DNA, 21 bp, Homo sapiens
gtatgaaaatccttttaacca

SEQ ID NO: 1615313 - DNA, 17 bp, Homo sapiens
gtatgaaccaccgcgcc

SEQ ID NO: 1615314 - DNA, 19 bp, Homo sapiens
gtatgaataaagacaccta

SEQ ID NO: 1615315 - DNA, 23 bp, Homo sapiens
gtatgaataatgaaaataaaaca

SEQ ID NO: 1615316 - DNA, 15 bp, Homo sapiens
gtatgaatctatgcc

SEQ ID NO: 1615317 - DNA, 14 bp, Homo sapiens
gtatgactaaagag

SEQ ID NO: 1615318 - DNA, 17 bp, Homo sapiens
gtatgagatggttaaaa

SEQ ID NO: 1615319 - DNA, 17 bp, Homo sapiens
gtatgatttaggcttct

SEQ ID NO: 1615320 - DNA, 18 bp, Homo sapiens
gtatgatttgttttgaat

SEQ ID NO: 1615321 - DNA, 13 bp, Homo sapiens
gtatgcagggagc

SEQ ID NO: 1615322 - DNA, 17 bp, Homo sapiens
gtatgcattattaaatt

SEQ ID NO: 1615323 - DNA, 18 bp, Homo sapiens
gtatgcattattaaattg

SEQ ID NO: 1615324 - DNA, 20 bp, Homo sapiens
gtatgccacacctggcctta

SEQ ID NO: 1615325 - DNA, 16 bp, Homo sapiens
gtatgctgaatttcta

SEQ ID NO: 1615326 - DNA, 18 bp, Homo sapiens
gtatgctttccctgagga

SEQ ID NO: 1615327 - DNA, 18 bp, Homo sapiens
gtatggactatctgtctg

SEQ ID NO: 1615328 - DNA, 11 bp, Homo sapiens
gtatggagtta

SEQ ID NO: 1615329 - DNA, 21 bp, Homo sapiens
gtatggatatatttgaaatag

SEQ ID NO: 1615330 - DNA, 22 bp, Homo sapiens
gtatggtaggggagggcaggct

SEQ ID NO: 1615331 - DNA, 14 bp, Homo sapiens
gtatggtcaggatg

SEQ ID NO: 1615332 - DNA, 14 bp, Homo sapiens
gtatggttctcaga

SEQ ID NO: 1615333 - DNA, 15 bp, Homo sapiens
gtatggttgacacta

SEQ ID NO: 1615334 - DNA, 12 bp, Homo sapiens
gtatgtaaatct

SEQ ID NO: 1615335 - DNA, 15 bp, Homo sapiens
gtatgtaatttatgc

SEQ ID NO: 1615336 - DNA, 13 bp, Homo sapiens
gtatgtcaaagct

SEQ ID NO: 1615337 - DNA, 14 bp, Homo sapiens
gtatgtcatttcct

SEQ ID NO: 1615338 - DNA, 12 bp, Homo sapiens
gtatgtctgtgt

SEQ ID NO: 1615339 - DNA, 13 bp, Homo sapiens
gtatgtctgtttt

SEQ ID NO: 1615340 - DNA, 20 bp, Homo sapiens
gtatgtgctatacacacaca

SEQ ID NO: 1615341 - DNA, 17 bp, Homo sapiens
gtatgtggaagtgtggg

SEQ ID NO: 1615342 - DNA, 21 bp, Homo sapiens
gtatgtggaagtgtgggtctg

SEQ ID NO: 1615343 - DNA, 15 bp, Homo sapiens
gtatgtgggatattg

SEQ ID NO: 1615344 - DNA, 20 bp, Homo sapiens
gtatgtgggggtctgtgtgt

SEQ ID NO: 1615345 - DNA, 11 bp, Homo sapiens
gtatgtgtgtg

SEQ ID NO: 1615346 - DNA, 22 bp, Homo sapiens
gtatgttccaaaccctcctggg

SEQ ID NO: 1615347 - DNA, 21 bp, Homo sapiens
gtatgttgtccaattgttgac

SEQ ID NO: 1615348 - DNA, 20 bp, Homo sapiens
gtattaaaaagcctgcattc

SEQ ID NO: 1615349 - DNA, 11 bp, Homo sapiens
gtattaaaatc

SEQ ID NO: 1615350 - DNA, 15 bp, Homo sapiens
gtattaaaatctaca

SEQ ID NO: 1615351 - DNA, 17 bp, Homo sapiens
gtattaaacttgtcaga

SEQ ID NO: 1615352 - DNA, 14 bp, Homo sapiens
gtattaaagggggg

SEQ ID NO: 1615353 - DNA, 13 bp, Homo sapiens
gtattaaatctta

SEQ ID NO: 1615354 - DNA, 23 bp, Homo sapiens
gtattaaatcttaaacaatgtat

SEQ ID NO: 1615355 - DNA, 15 bp, Homo sapiens
gtattaaattacatt

SEQ ID NO: 1615356 - DNA, 18 bp, Homo sapiens
gtattaaattacatttgt

SEQ ID NO: 1615357 - DNA, 16 bp, Homo sapiens
gtattaagattataat

SEQ ID NO: 1615358 - DNA, 12 bp, Homo sapiens
gtattaataaag

SEQ ID NO: 1615359 - DNA, 13 bp, Homo sapiens
gtattaataaagc

SEQ ID NO: 1615360 - DNA, 16 bp, Homo sapiens
gtattaataaagcatt

SEQ ID NO: 1615361 - DNA, 17 bp, Homo sapiens
gtattaataaagcattc

SEQ ID NO: 1615362 - DNA, 18 bp, Homo sapiens
gtattaatcttattgttt

SEQ ID NO: 1615363 - DNA, 15 bp, Homo sapiens
gtattttgaatacca

SEQ ID NO: 1615364 - DNA, 17 bp, Homo sapiens
gtattttgctatatata

SEQ ID NO: 1615365 - DNA, 24 bp, Homo sapiens
gtattttgtgtcctccaggagctt

SEQ ID NO: 1615366 - DNA, 18 bp, Homo sapiens
gtattttgttaaagctgg

SEQ ID NO: 1615367 - DNA, 18 bp, Homo sapiens
gtatttttatacaaacct

SEQ ID NO: 1615368 - DNA, 20 bp, Homo sapiens
gtatttttgattaacaatgt

SEQ ID NO: 1615369 - DNA, 23 bp, Homo sapiens
gtattttttatttacattttata

SEQ ID NO: 1615370 - DNA, 16 bp, Homo sapiens
gtatttttttttctaa

SEQ ID NO: 1615371 - DNA, 18 bp, Homo sapiens
gtatttttttttctaaga

SEQ ID NO: 1615372 - DNA, 22 bp, Homo sapiens
gtatttttttttctaagagaag

SEQ ID NO: 1615373 - DNA, 13 bp, Homo sapiens
gtcaaaaaaggaa

SEQ ID NO: 1615374 - DNA, 19 bp, Homo sapiens
gtcaaaaaattatttgcta

SEQ ID NO: 1615375 - DNA, 16 bp, Homo sapiens
gtcaaaaagtaatgat

SEQ ID NO: 1615376 - DNA, 12 bp, Homo sapiens
gtcaaaacaaag

SEQ ID NO: 1615377 - DNA, 14 bp, Homo sapiens
gtcaaaaggtgcct

SEQ ID NO: 1615378 - DNA, 16 bp, Homo sapiens
gtcaaaaggtgcctgt

SEQ ID NO: 1615379 - DNA, 23 bp, Homo sapiens
gtcaaacattcgtgagctgggga

SEQ ID NO: 1615380 - DNA, 12 bp, Homo sapiens
gtcaaagaagac

SEQ ID NO: 1615381 - DNA, 22 bp, Homo sapiens
gtcaaagaagcttccacaaaat

SEQ ID NO: 1615382 - DNA, 21 bp, Homo sapiens
gtcaaagtgttgctgtggctc

SEQ ID NO: 1615383 - DNA, 15 bp, Homo sapiens
gtcaaatccagtggt

SEQ ID NO: 1615384 - DNA, 17 bp, Homo sapiens
gtcaaatccagtggtgg

SEQ ID NO: 1615385 - DNA, 20 bp, Homo sapiens
gtcaaatgtttccttaaaca

SEQ ID NO: 1615386 - DNA, 21 bp, Homo sapiens
gtcaacaagtatgaataaaga

SEQ ID NO: 1615387 - DNA, 19 bp, Homo sapiens
gtcaacacttaagggtttt

SEQ ID NO: 1615388 - DNA, 21 bp, Homo sapiens
gtcaacagattcagaatgaga

SEQ ID NO: 1615389 - DNA, 23 bp, Homo sapiens
gtcaacctgcttttttctgtttt

SEQ ID NO: 1615390 - DNA, 23 bp, Homo sapiens
gtcaactgctgttttatgtcata

SEQ ID NO: 1615391 - DNA, 14 bp, Homo sapiens
gtcaagattttgaa

SEQ ID NO: 1615392 - DNA, 23 bp, Homo sapiens
gtcaagcctcttattccaggaga

SEQ ID NO: 1615393 - DNA, 12 bp, Homo sapiens
gtcaagctgctc

SEQ ID NO: 1615394 - DNA, 20 bp, Homo sapiens
gtcaagctgctctgagccac

SEQ ID NO: 1615395 - DNA, 14 bp, Homo sapiens
gtcaaggccacctc

SEQ ID NO: 1615396 - DNA, 24 bp, Homo sapiens
gtcaaggccacctctgcctctagt

SEQ ID NO: 1615397 - DNA, 14 bp, Homo sapiens
gtcaagggaaaacc

SEQ ID NO: 1615398 - DNA, 22 bp, Homo sapiens
gtcaagggctgtcattgcacat

SEQ ID NO: 1615399 - DNA, 18 bp, Homo sapiens
gtcaagtgttaggtcaat

SEQ ID NO: 1615400 - DNA, 17 bp, Homo sapiens
gtcaagttaacaaggaa

SEQ ID NO: 1615401 - DNA, 17 bp, Homo sapiens
gtcaagttgtgcttgtt

SEQ ID NO: 1615402 - DNA, 20 bp, Homo sapiens
gtcaataaacagcttcatgc

SEQ ID NO: 1615403 - DNA, 23 bp, Homo sapiens
gtcaataaacttagaggaaaatg

SEQ ID NO: 1615404 - DNA, 20 bp, Homo sapiens
gtcaatagcattgtttttgt

SEQ ID NO: 1615405 - DNA, 22 bp, Homo sapiens
gtcaatagcattgtttttgtca

SEQ ID NO: 1615406 - DNA, 22 bp, Homo sapiens
gtcaatatcgtacctgtccctc

SEQ ID NO: 1615407 - DNA, 20 bp, Homo sapiens
gtcaatattaaatacagaca

SEQ ID NO: 1615408 - DNA, 23 bp, Homo sapiens
gtcaatattaaatacagacacta

SEQ ID NO: 1615409 - DNA, 16 bp, Homo sapiens
gtcaatcccctcattc

SEQ ID NO: 1615410 - DNA, 12 bp, Homo sapiens
gtcaatgatggt

SEQ ID NO: 1615411 - DNA, 14 bp, Homo sapiens
gtcacaaccaagaa

SEQ ID NO: 1615412 - DNA, 13 bp, Homo sapiens
gtcacacctgtgc

SEQ ID NO: 1615413 - DNA, 16 bp, Homo sapiens
ggcttaatgtttattc

SEQ ID NO: 1615414 - DNA, 16 bp, Homo sapiens
ggcttagtatttctca

SEQ ID NO: 1615415 - DNA, 20 bp, Homo sapiens
ggcttagtatttctcaggaa

SEQ ID NO: 1615416 - DNA, 13 bp, Homo sapiens
ggcttagtgccac

SEQ ID NO: 1615417 - DNA, 14 bp, Homo sapiens
ggcttcaatcactg

SEQ ID NO: 1615418 - DNA, 21 bp, Homo sapiens
ggcttcaccagtctgtctact

SEQ ID NO: 1615419 - DNA, 17 bp, Homo sapiens
ggcttcagcccccacca

SEQ ID NO: 1615420 - DNA, 16 bp, Homo sapiens
ggcttcatgccagcta

SEQ ID NO: 1615421 - DNA, 19 bp, Homo sapiens
ggcttcattccggactggc

SEQ ID NO: 1615422 - DNA, 21 bp, Homo sapiens
ggcttcattccggactggcag

SEQ ID NO: 1615423 - DNA, 13 bp, Homo sapiens
ggcttccaggctc

SEQ ID NO: 1615424 - DNA, 20 bp, Homo sapiens
ggcttcccatagtggggcct

SEQ ID NO: 1615425 - DNA, 16 bp, Homo sapiens
ggcttcccgctcagcc

SEQ ID NO: 1615426 - DNA, 19 bp, Homo sapiens
ggcttcccgctcagccctc

SEQ ID NO: 1615427 - DNA, 22 bp, Homo sapiens
ggcttcccgctcagccctccct

SEQ ID NO: 1615428 - DNA, 15 bp, Homo sapiens
ggcttccctgagcca

SEQ ID NO: 1615429 - DNA, 13 bp, Homo sapiens
ggcttccctggaa

SEQ ID NO: 1615430 - DNA, 19 bp, Homo sapiens
ggcttccctggaagctctc

SEQ ID NO: 1615431 - DNA, 20 bp, Homo sapiens
ggcttccctggaagctctcc

SEQ ID NO: 1615432 - DNA, 18 bp, Homo sapiens
ggcttcccttctccccag

SEQ ID NO: 1615433 - DNA, 23 bp, Homo sapiens
ggcttcccttctccccagccaga

SEQ ID NO: 1615434 - DNA, 21 bp, Homo sapiens
ggcttcctcagttcctgccct

SEQ ID NO: 1615435 - DNA, 13 bp, Homo sapiens
ggcttcctcctga

SEQ ID NO: 1615436 - DNA, 21 bp, Homo sapiens
ggcttcctctagaagccaagg

SEQ ID NO: 1615437 - DNA, 20 bp, Homo sapiens
ggcttcctgcgtcctcctca

SEQ ID NO: 1615438 - DNA, 17 bp, Homo sapiens
ggcttcctgtccactct

SEQ ID NO: 1615439 - DNA, 18 bp, Homo sapiens
ggcttcctgtccactctc

SEQ ID NO: 1615440 - DNA, 13 bp, Homo sapiens
ggcttctcctgac

SEQ ID NO: 1615441 - DNA, 13 bp, Homo sapiens
ggcttctctccac

SEQ ID NO: 1615442 - DNA, 12 bp, Homo sapiens
ggcttctctctt

SEQ ID NO: 1615443 - DNA, 14 bp, Homo sapiens
ggcttctctctttt

SEQ ID NO: 1615444 - DNA, 18 bp, Homo sapiens
ggcttctgatttttctct

SEQ ID NO: 1615445 - DNA, 19 bp, Homo sapiens
ggcttctgatttttctctt

SEQ ID NO: 1615446 - DNA, 13 bp, Homo sapiens
ggcttctgcaccc

SEQ ID NO: 1615447 - DNA, 18 bp, Homo sapiens
ggcttctgcaccctccac

SEQ ID NO: 1615448 - DNA, 20 bp, Homo sapiens
ggcttctgcaccctccaccc

SEQ ID NO: 1615449 - DNA, 22 bp, Homo sapiens
ggcttctgcaccctccaccctg

SEQ ID NO: 1615450 - DNA, 18 bp, Homo sapiens
ggcttctgcttgtcatcc

SEQ ID NO: 1615451 - DNA, 18 bp, Homo sapiens
ggcttcttggaccttggc

SEQ ID NO: 1615452 - DNA, 13 bp, Homo sapiens
ggcttgaagccaa

SEQ ID NO: 1615453 - DNA, 20 bp, Homo sapiens
ggcttgaagccaaagaaaaa

SEQ ID NO: 1615454 - DNA, 13 bp, Homo sapiens
gggaaggagccca

SEQ ID NO: 1615455 - DNA, 14 bp, Homo sapiens
gggaagggacacac

SEQ ID NO: 1615456 - DNA, 16 bp, Homo sapiens
gggaagggagagggcc

SEQ ID NO: 1615457 - DNA, 12 bp, Homo sapiens
gggaagggccag

SEQ ID NO: 1615458 - DNA, 13 bp, Homo sapiens
gggaagggccagt

SEQ ID NO: 1615459 - DNA, 13 bp, Homo sapiens
gggaaggggctga

SEQ ID NO: 1615460 - DNA, 23 bp, Homo sapiens
gggaagggtggcctgttccctag

SEQ ID NO: 1615461 - DNA, 22 bp, Homo sapiens
gggaaggtggggccctgcccct

SEQ ID NO: 1615462 - DNA, 21 bp, Homo sapiens
gggaaggttagaaaggcagcc

SEQ ID NO: 1615463 - DNA, 19 bp, Homo sapiens
gggaaggtttttaagggcc

SEQ ID NO: 1615464 - DNA, 17 bp, Homo sapiens
gggaagtgaggcccaag

SEQ ID NO: 1615465 - DNA, 14 bp, Homo sapiens
gggaagttaaaggg

SEQ ID NO: 1615466 - DNA, 14 bp, Homo sapiens
gggaatcagaactc

SEQ ID NO: 1615467 - DNA, 15 bp, Homo sapiens
gggaatccaagcctc

SEQ ID NO: 1615468 - DNA, 14 bp, Homo sapiens
gggaatgcagcagg

SEQ ID NO: 1615469 - DNA, 20 bp, Homo sapiens
gggaatgtattattctgcag

SEQ ID NO: 1615470 - DNA, 22 bp, Homo sapiens
gggaatgttccctgcaccctgg

SEQ ID NO: 1615471 - DNA, 15 bp, Homo sapiens
gggaattgaaaaaaa

SEQ ID NO: 1615472 - DNA, 12 bp, Homo sapiens
gggaatttcctc

SEQ ID NO: 1615473 - DNA, 18 bp, Homo sapiens
gggacaaaacccaccttg

SEQ ID NO: 1615474 - DNA, 17 bp, Homo sapiens
gggacaccagggaagaa

SEQ ID NO: 1615475 - DNA, 15 bp, Homo sapiens
gggacactcctcctc

SEQ ID NO: 1615476 - DNA, 21 bp, Homo sapiens
gggacactgggcagcaaggct

SEQ ID NO: 1615477 - DNA, 17 bp, Homo sapiens
gggacagagacacctgc

SEQ ID NO: 1615478 - DNA, 12 bp, Homo sapiens
gggacagagggt

SEQ ID NO: 1615479 - DNA, 15 bp, Homo sapiens
gggacagcagcctcc

SEQ ID NO: 1615480 - DNA, 13 bp, Homo sapiens
gggacagcttcct

SEQ ID NO: 1615481 - DNA, 17 bp, Homo sapiens
gggacaggagaagagag

SEQ ID NO: 1615482 - DNA, 12 bp, Homo sapiens
gggacaggctga

SEQ ID NO: 1615483 - DNA, 20 bp, Homo sapiens
gggacagttggcagagaagg

SEQ ID NO: 1615484 - DNA, 17 bp, Homo sapiens
gggacatcacagggtgg

SEQ ID NO: 1615485 - DNA, 19 bp, Homo sapiens
gggacatcaggagactggg

SEQ ID NO: 1615486 - DNA, 16 bp, Homo sapiens
gggacatttcttcccc

SEQ ID NO: 1615487 - DNA, 23 bp, Homo sapiens
gggaccaaggcaaggcaggtgcc

SEQ ID NO: 1615488 - DNA, 16 bp, Homo sapiens
gggaccactgggtgag

SEQ ID NO: 1615489 - DNA, 13 bp, Homo sapiens
gggaccagagcca

SEQ ID NO: 1615490 - DNA, 14 bp, Homo sapiens
gggaccagagccag

SEQ ID NO: 1615491 - DNA, 14 bp, Homo sapiens
gggagtgtctgcag

SEQ ID NO: 1615492 - DNA, 13 bp, Homo sapiens
gggagtgtgtgcc

SEQ ID NO: 1615493 - DNA, 23 bp, Homo sapiens
gggagttaagacctggcagctct

SEQ ID NO: 1615494 - DNA, 23 bp, Homo sapiens
gggagttagggagagagaagcag

SEQ ID NO: 1615495 - DNA, 20 bp, Homo sapiens
gggagttgagtcacaagagg

SEQ ID NO: 1615496 - DNA, 20 bp, Homo sapiens
gggagtttaatacaggaaat

SEQ ID NO: 1615497 - DNA, 13 bp, Homo sapiens
gggatacttagtg

SEQ ID NO: 1615498 - DNA, 13 bp, Homo sapiens
gggatagaggaaa

SEQ ID NO: 1615499 - DNA, 19 bp, Homo sapiens
gggatagtgttctgctcct

SEQ ID NO: 1615500 - DNA, 20 bp, Homo sapiens
gggatagtgttctgctcctg

SEQ ID NO: 1615501 - DNA, 13 bp, Homo sapiens
gggatatttccta

SEQ ID NO: 1615502 - DNA, 15 bp, Homo sapiens
gggatatttttttct

SEQ ID NO: 1615503 - DNA, 15 bp, Homo sapiens
gggatccagccactt

SEQ ID NO: 1615504 - DNA, 19 bp, Homo sapiens
gggatccccgcctggccag

SEQ ID NO: 1615505 - DNA, 20 bp, Homo sapiens
gggatccccgcctggccagg

SEQ ID NO: 1615506 - DNA, 17 bp, Homo sapiens
gggatccgactgctttg

SEQ ID NO: 1615507 - DNA, 19 bp, Homo sapiens
gggatcctccacagagagg

SEQ ID NO: 1615508 - DNA, 18 bp, Homo sapiens
gggatcgatgtgctcagc

SEQ ID NO: 1615509 - DNA, 14 bp, Homo sapiens
gggatctcaggggc

SEQ ID NO: 1615510 - DNA, 22 bp, Homo sapiens
gggatctgagctcccacctccc

SEQ ID NO: 1615511 - DNA, 23 bp, Homo sapiens
gggatgaggtcaccaggggagga

SEQ ID NO: 1615512 - DNA, 18 bp, Homo sapiens
gggatgccgttctgttcc

SEQ ID NO: 1615513 - DNA, 12 bp, Homo sapiens
gggatgctgctc

SEQ ID NO: 1615514 - DNA, 15 bp, Homo sapiens
gggatgctgggctgg

SEQ ID NO: 1615515 - DNA, 15 bp, Homo sapiens
gggatggaaaaggaa

SEQ ID NO: 1615516 - DNA, 19 bp, Homo sapiens
gggatggacgatctcccac

SEQ ID NO: 1615517 - DNA, 16 bp, Homo sapiens
gggatggagaaagaag

SEQ ID NO: 1615518 - DNA, 14 bp, Homo sapiens
gggatggaggagaa

SEQ ID NO: 1615519 - DNA, 18 bp, Homo sapiens
gggatggaggagaagaat

SEQ ID NO: 1615520 - DNA, 16 bp, Homo sapiens
gggatggtcctggggc

SEQ ID NO: 1615521 - DNA, 12 bp, Homo sapiens
gggatgtaaacc

SEQ ID NO: 1615522 - DNA, 12 bp, Homo sapiens
gggatgtagaac

SEQ ID NO: 1615523 - DNA, 22 bp, Homo sapiens
gggatgttcagcactgtccctt

SEQ ID NO: 1615524 - DNA, 20 bp, Homo sapiens
gggattacaggcgtgagcca

SEQ ID NO: 1615525 - DNA, 14 bp, Homo sapiens
gggattcctgaccc

SEQ ID NO: 1615526 - DNA, 18 bp, Homo sapiens
gggattgattttaaaatg

SEQ ID NO: 1615527 - DNA, 17 bp, Homo sapiens
gggattgctgccacttt

SEQ ID NO: 1615528 - DNA, 16 bp, Homo sapiens
gggattgggggctggt

SEQ ID NO: 1615529 - DNA, 22 bp, Homo sapiens
gggatttttggtgcaagtagca

SEQ ID NO: 1615530 - DNA, 16 bp, Homo sapiens
gggattttttcccttt

SEQ ID NO: 1615531 - DNA, 20 bp, Homo sapiens
gggcaaacagagctactgag

SEQ ID NO: 1615532 - DNA, 13 bp, Homo sapiens
gggcaaagcttgt

SEQ ID NO: 1615533 - DNA, 14 bp, Homo sapiens
gggcaacgaagaaa

SEQ ID NO: 1615534 - DNA, 21 bp, Homo sapiens
gggcaagacagaaaagtgcct

SEQ ID NO: 1615535 - DNA, 13 bp, Homo sapiens
gggcaagacctct

SEQ ID NO: 1615536 - DNA, 17 bp, Homo sapiens
gggcaagacctcttccc

SEQ ID NO: 1615537 - DNA, 12 bp, Homo sapiens
gggcaagagatg

SEQ ID NO: 1615538 - DNA, 19 bp, Homo sapiens
gggcaagtcgagagggctg

SEQ ID NO: 1615539 - DNA, 17 bp, Homo sapiens
gggcaagtggatgggaa

SEQ ID NO: 1615540 - DNA, 15 bp, Homo sapiens
gggcacacagactgg

SEQ ID NO: 1615541 - DNA, 17 bp, Homo sapiens
gggcacaccactgccct

SEQ ID NO: 1615542 - DNA, 19 bp, Homo sapiens
gggcacaccactgccctgc

SEQ ID NO: 1615543 - DNA, 20 bp, Homo sapiens
gggcacaccactgccctgcc

SEQ ID NO: 1615544 - DNA, 19 bp, Homo sapiens
gggcacagccctccgaccc

SEQ ID NO: 1615545 - DNA, 13 bp, Homo sapiens
gggcacaggaggc

SEQ ID NO: 1615546 - DNA, 16 bp, Homo sapiens
gggcacagggcaccag

SEQ ID NO: 1615547 - DNA, 19 bp, Homo sapiens
gggcacagtggactcagca

SEQ ID NO: 1615548 - DNA, 12 bp, Homo sapiens
gggcaccagagg

SEQ ID NO: 1615549 - DNA, 18 bp, Homo sapiens
gggcaccgggaccccctc

SEQ ID NO: 1615550 - DNA, 19 bp, Homo sapiens
gggcacctatagtcccagc

SEQ ID NO: 1615551 - DNA, 20 bp, Homo sapiens
gggcacgccctcctcagcga

SEQ ID NO: 1615552 - DNA, 17 bp, Homo sapiens
gggcactcccaaccctg

SEQ ID NO: 1615553 - DNA, 16 bp, Homo sapiens
gggcactggtggcccg

SEQ ID NO: 1615554 - DNA, 18 bp, Homo sapiens
gggcagactgtgaacttg

SEQ ID NO: 1615555 - DNA, 16 bp, Homo sapiens
gggcagagccatgggc

SEQ ID NO: 1615556 - DNA, 13 bp, Homo sapiens
gggcagagggctg

SEQ ID NO: 1615557 - DNA, 13 bp, Homo sapiens
gggcagaggggca

SEQ ID NO: 1615558 - DNA, 18 bp, Homo sapiens
gggcagaggggcagccgc

SEQ ID NO: 1615559 - DNA, 14 bp, Homo sapiens
gggcagcactcccc

SEQ ID NO: 1615560 - DNA, 20 bp, Homo sapiens
gggcagcagaagggggtggt

SEQ ID NO: 1615561 - DNA, 11 bp, Homo sapiens
gggcagcagcc

SEQ ID NO: 1615562 - DNA, 12 bp, Homo sapiens
gggcagccacac

SEQ ID NO: 1615563 - DNA, 15 bp, Homo sapiens
gggcagccacccaag

SEQ ID NO: 1615564 - DNA, 18 bp, Homo sapiens
gggcagccacccaagcct

SEQ ID NO: 1615565 - DNA, 23 bp, Homo sapiens
gggcagccacccaagcctgctgg

SEQ ID NO: 1615566 - DNA, 19 bp, Homo sapiens
gggcagccgctaggagaga

SEQ ID NO: 1615567 - DNA, 23 bp, Homo sapiens
gggcagccgctaggagagactga

SEQ ID NO: 1615568 - DNA, 22 bp, Homo sapiens
gggcagcctccaccttgctctt

SEQ ID NO: 1615569 - DNA, 15 bp, Homo sapiens
gggcagcctcccccg

SEQ ID NO: 1615570 - DNA, 18 bp, Homo sapiens
gggcagcctcccccggct

SEQ ID NO: 1615571 - DNA, 21 bp, Homo sapiens
gggcagcctctccgactctgc

SEQ ID NO: 1615572 - DNA, 15 bp, Homo sapiens
gggcagcctgtgcct

SEQ ID NO: 1615573 - DNA, 14 bp, Homo sapiens
gggcattgggctga

SEQ ID NO: 1615574 - DNA, 15 bp, Homo sapiens
gggcatttggtgaga

SEQ ID NO: 1615575 - DNA, 19 bp, Homo sapiens
gggcatttggtgagagtca

SEQ ID NO: 1615576 - DNA, 15 bp, Homo sapiens
gggccaaggtcctgc

SEQ ID NO: 1615577 - DNA, 18 bp, Homo sapiens
gggccacacgtggctggc

SEQ ID NO: 1615578 - DNA, 19 bp, Homo sapiens
gggccacatagatgctgat

SEQ ID NO: 1615579 - DNA, 24 bp, Homo sapiens
gggccacggaggagggatgctgct

SEQ ID NO: 1615580 - DNA, 14 bp, Homo sapiens
gggccacgtgccag

SEQ ID NO: 1615581 - DNA, 11 bp, Homo sapiens
gggccactggg

SEQ ID NO: 1615582 - DNA, 13 bp, Homo sapiens
gggccactgggga

SEQ ID NO: 1615583 - DNA, 22 bp, Homo sapiens
gggccactggggactttattta

SEQ ID NO: 1615584 - DNA, 22 bp, Homo sapiens
gggccactggtccccaacaatg

SEQ ID NO: 1615585 - DNA, 20 bp, Homo sapiens
gggccactgtggtggcagtg

SEQ ID NO: 1615586 - DNA, 14 bp, Homo sapiens
gggccagagccagg

SEQ ID NO: 1615587 - DNA, 15 bp, Homo sapiens
gggccagagccaggg

SEQ ID NO: 1615588 - DNA, 17 bp, Homo sapiens
gggccagatccagcctg

SEQ ID NO: 1615589 - DNA, 19 bp, Homo sapiens
gggccagatccagcctggg

SEQ ID NO: 1615590 - DNA, 12 bp, Homo sapiens
gggccagcaggc

SEQ ID NO: 1615591 - DNA, 13 bp, Homo sapiens
gggccagcaggct

SEQ ID NO: 1615592 - DNA, 20 bp, Homo sapiens
gggccagcaggctcctggct

SEQ ID NO: 1615593 - DNA, 14 bp, Homo sapiens
gggccagccaggcg

SEQ ID NO: 1615594 - DNA, 22 bp, Homo sapiens
gggccagccaggcgggctcaag

SEQ ID NO: 1615595 - DNA, 14 bp, Homo sapiens
gggccaggaccatg

SEQ ID NO: 1615596 - DNA, 21 bp, Homo sapiens
gggccaggagccgggcctccc

SEQ ID NO: 1615597 - DNA, 15 bp, Homo sapiens
gggccagggacccag

SEQ ID NO: 1615598 - DNA, 12 bp, Homo sapiens
gggccagggctg

SEQ ID NO: 1615599 - DNA, 15 bp, Homo sapiens
gggccagtcctgcct

SEQ ID NO: 1615600 - DNA, 21 bp, Homo sapiens
gggccagtcctgcctggccag

SEQ ID NO: 1615601 - DNA, 20 bp, Homo sapiens
gggccagtctgggctgccgg

SEQ ID NO: 1615602 - DNA, 20 bp, Homo sapiens
gggccatgctgaggcctggg

SEQ ID NO: 1615603 - DNA, 15 bp, Homo sapiens
gggccatgtccaaag

SEQ ID NO: 1615604 - DNA, 17 bp, Homo sapiens
gggccatgtccaaagag

SEQ ID NO: 1615605 - DNA, 21 bp, Homo sapiens
gggccatgtccaaagaggctg

SEQ ID NO: 1615606 - DNA, 22 bp, Homo sapiens
gggccatgtccaaagaggctgc

SEQ ID NO: 1615607 - DNA, 12 bp, Homo sapiens
gggcccagagtg

SEQ ID NO: 1615608 - DNA, 16 bp, Homo sapiens
gggcccagccaggagc

SEQ ID NO: 1615609 - DNA, 19 bp, Homo sapiens
gggcccagcccagagccac

SEQ ID NO: 1615610 - DNA, 12 bp, Homo sapiens
gggcccagctgt

SEQ ID NO: 1615611 - DNA, 19 bp, Homo sapiens
gggcccaggaccagctggg

SEQ ID NO: 1615612 - DNA, 22 bp, Homo sapiens
gggcccataatagttagccctc

SEQ ID NO: 1615613 - DNA, 14 bp, Homo sapiens
gggcccatcaggca

SEQ ID NO: 1615614 - DNA, 14 bp, Homo sapiens
gggccccagatctg

SEQ ID NO: 1615615 - DNA, 21 bp, Homo sapiens
gggccccagatctgcctgggc

SEQ ID NO: 1615616 - DNA, 23 bp, Homo sapiens
gggccccagatctgcctgggcct

SEQ ID NO: 1615617 - DNA, 14 bp, Homo sapiens
gggccccaggggca

SEQ ID NO: 1615618 - DNA, 22 bp, Homo sapiens
gggccccatcctcatccctgac

SEQ ID NO: 1615619 - DNA, 17 bp, Homo sapiens
gggccccatgctctgcc

SEQ ID NO: 1615620 - DNA, 18 bp, Homo sapiens
gggccccatgctctgccc

SEQ ID NO: 1615621 - DNA, 20 bp, Homo sapiens
gggccccatgctctgcccca

SEQ ID NO: 1615622 - DNA, 20 bp, Homo sapiens
gggcccccaatgacacccat

SEQ ID NO: 1615623 - DNA, 21 bp, Homo sapiens
gggccccggggctggcaagca

SEQ ID NO: 1615624 - DNA, 14 bp, Homo sapiens
gggcccctccatcc

SEQ ID NO: 1615625 - DNA, 15 bp, Homo sapiens
gggcccctccctctg

SEQ ID NO: 1615626 - DNA, 20 bp, Homo sapiens
gggcccctccctctgcccca

SEQ ID NO: 1615627 - DNA, 22 bp, Homo sapiens
gggcccctctgcccagcttggg

SEQ ID NO: 1615628 - DNA, 13 bp, Homo sapiens
gggcccctgagga

SEQ ID NO: 1615629 - DNA, 12 bp, Homo sapiens
gggcccctggca

SEQ ID NO: 1615630 - DNA, 15 bp, Homo sapiens
gggcccctggcccag

SEQ ID NO: 1615631 - DNA, 23 bp, Homo sapiens
gggcccctgggcttggcctgctg

SEQ ID NO: 1615632 - DNA, 20 bp, Homo sapiens
gggcccgcctcacaccccag

SEQ ID NO: 1615633 - DNA, 23 bp, Homo sapiens
gggcccggccacacccagcggcc

SEQ ID NO: 1615634 - DNA, 17 bp, Homo sapiens
gggcccgttgaggatga

SEQ ID NO: 1615635 - DNA, 20 bp, Homo sapiens
gggccctcagctcctgggga

SEQ ID NO: 1615636 - DNA, 13 bp, Homo sapiens
gggccctcccagc

SEQ ID NO: 1615637 - DNA, 21 bp, Homo sapiens
gggccctcccagcccattgct

SEQ ID NO: 1615638 - DNA, 23 bp, Homo sapiens
gggccctctgtagctccctcctc

SEQ ID NO: 1615639 - DNA, 14 bp, Homo sapiens
gggccctctgtcca

SEQ ID NO: 1615640 - DNA, 18 bp, Homo sapiens
gggccctctttccctgcg

SEQ ID NO: 1615641 - DNA, 14 bp, Homo sapiens
gggccctgagtctg

SEQ ID NO: 1615642 - DNA, 9 bp, Homo sapiens
gggccctgc

SEQ ID NO: 1615643 - DNA, 18 bp, Homo sapiens
gggccctgcacctgtgca

SEQ ID NO: 1615644 - DNA, 19 bp, Homo sapiens
gggccctgcacctgtgcag

SEQ ID NO: 1615645 - DNA, 15 bp, Homo sapiens
gggccctgcagaggg

SEQ ID NO: 1615646 - DNA, 20 bp, Homo sapiens
gggccctgcattggcctggc

SEQ ID NO: 1615647 - DNA, 15 bp, Homo sapiens
gggccctgggctgga

SEQ ID NO: 1615648 - DNA, 22 bp, Homo sapiens
gggccctgtggagtccagctct

SEQ ID NO: 1615649 - DNA, 20 bp, Homo sapiens
gggcccttgggccacgctct

SEQ ID NO: 1615650 - DNA, 18 bp, Homo sapiens
gggcccttggggcctggc

SEQ ID NO: 1615651 - DNA, 19 bp, Homo sapiens
gggcccttggggcctggct

SEQ ID NO: 1615652 - DNA, 14 bp, Homo sapiens
gggccctttttccc

SEQ ID NO: 1615653 - DNA, 18 bp, Homo sapiens
gggccctttttcccttcc

SEQ ID NO: 1615654 - DNA, 14 bp, Homo sapiens
gggccgccacggcc

SEQ ID NO: 1615655 - DNA, 14 bp, Homo sapiens
gggccgcccgctcc

SEQ ID NO: 1615656 - DNA, 21 bp, Homo sapiens
gggccgccgctgaccctgggc

SEQ ID NO: 1615657 - DNA, 23 bp, Homo sapiens
gggccgccgctgaccctgggcct

SEQ ID NO: 1615658 - DNA, 17 bp, Homo sapiens
gggccgcggccgcccgc

SEQ ID NO: 1615659 - DNA, 23 bp, Homo sapiens
gggccgcgtggtgccatccccag

SEQ ID NO: 1615660 - DNA, 14 bp, Homo sapiens
gggccggctgagtg

SEQ ID NO: 1615661 - DNA, 20 bp, Homo sapiens
gggccggctgagtggcagca

SEQ ID NO: 1615662 - DNA, 13 bp, Homo sapiens
gggccgggctgta

SEQ ID NO: 1615663 - DNA, 13 bp, Homo sapiens
gggccggggctga

SEQ ID NO: 1615664 - DNA, 20 bp, Homo sapiens
gggccgtaccccaccctcag

SEQ ID NO: 1615665 - DNA, 21 bp, Homo sapiens
gggccgtaggggctcctgagt

SEQ ID NO: 1615666 - DNA, 18 bp, Homo sapiens
gggccgtgcccttgccct

SEQ ID NO: 1615667 - DNA, 20 bp, Homo sapiens
gggcctagatccacacacag

SEQ ID NO: 1615668 - DNA, 20 bp, Homo sapiens
gggcctagcgatctctcctg

SEQ ID NO: 1615669 - DNA, 21 bp, Homo sapiens
gggcctagcgatctctcctgg

SEQ ID NO: 1615670 - DNA, 23 bp, Homo sapiens
gggcctagcgatctctcctggcc

SEQ ID NO: 1615671 - DNA, 20 bp, Homo sapiens
gggcctcaggctctgcacag

SEQ ID NO: 1615672 - DNA, 20 bp, Homo sapiens
gggcctcagtgtgcccatct

SEQ ID NO: 1615673 - DNA, 21 bp, Homo sapiens
gggcctccagaagctgctcct

SEQ ID NO: 1615674 - DNA, 14 bp, Homo sapiens
gggcctccagggcc

SEQ ID NO: 1615675 - DNA, 22 bp, Homo sapiens
gggcctcccaccgcagcgtccc

SEQ ID NO: 1615676 - DNA, 17 bp, Homo sapiens
gggcctcccctgggcag

SEQ ID NO: 1615677 - DNA, 22 bp, Homo sapiens
gggcctcccctgggcagggttc

SEQ ID NO: 1615678 - DNA, 19 bp, Homo sapiens
gggcctccctggcactgaa

SEQ ID NO: 1615679 - DNA, 18 bp, Homo sapiens
gggcctccttcttccact

SEQ ID NO: 1615680 - DNA, 19 bp, Homo sapiens
gggcctctcctgccctctg

SEQ ID NO: 1615681 - DNA, 15 bp, Homo sapiens
gggcctctgcctggg

SEQ ID NO: 1615682 - DNA, 15 bp, Homo sapiens
gggcctgacaccccc

SEQ ID NO: 1615683 - DNA, 14 bp, Homo sapiens
gggcctgactgctc

SEQ ID NO: 1615684 - DNA, 17 bp, Homo sapiens
gggcctgactgctcaga

SEQ ID NO: 1615685 - DNA, 23 bp, Homo sapiens
gggctccagcccctcttggagaa

SEQ ID NO: 1615686 - DNA, 13 bp, Homo sapiens
gggctcccagggg

SEQ ID NO: 1615687 - DNA, 13 bp, Homo sapiens
gggctcccgcccg

SEQ ID NO: 1615688 - DNA, 12 bp, Homo sapiens
gggctcctggaa

SEQ ID NO: 1615689 - DNA, 14 bp, Homo sapiens
gggctcctggaacc

SEQ ID NO: 1615690 - DNA, 14 bp, Homo sapiens
gggctcctggctgc

SEQ ID NO: 1615691 - DNA, 18 bp, Homo sapiens
gggctcctggctgccagg

SEQ ID NO: 1615692 - DNA, 19 bp, Homo sapiens
gggctcctggctgccaggc

SEQ ID NO: 1615693 - DNA, 13 bp, Homo sapiens
gggctccttcccc

SEQ ID NO: 1615694 - DNA, 20 bp, Homo sapiens
gggctcctttctccagccag

SEQ ID NO: 1615695 - DNA, 23 bp, Homo sapiens
gggctcgccgtgtctcagcctct

SEQ ID NO: 1615696 - DNA, 17 bp, Homo sapiens
gggctcgtggccttccc

SEQ ID NO: 1615697 - DNA, 18 bp, Homo sapiens
gggctctccaaaggggct

SEQ ID NO: 1615698 - DNA, 17 bp, Homo sapiens
gggctctccacctcagc

SEQ ID NO: 1615699 - DNA, 20 bp, Homo sapiens
gggctctgcaattcccctct

SEQ ID NO: 1615700 - DNA, 14 bp, Homo sapiens
gggctctgcagcac

SEQ ID NO: 1615701 - DNA, 12 bp, Homo sapiens
gggctctgcccc

SEQ ID NO: 1615702 - DNA, 16 bp, Homo sapiens
gggctctgccctccct

SEQ ID NO: 1615703 - DNA, 22 bp, Homo sapiens
gggctctgccctccctccttcc

SEQ ID NO: 1615704 - DNA, 11 bp, Homo sapiens
gggctctgcct

SEQ ID NO: 1615705 - DNA, 15 bp, Homo sapiens
gggctctgcttcctc

SEQ ID NO: 1615706 - DNA, 15 bp, Homo sapiens
gggctctggccaccc

SEQ ID NO: 1615707 - DNA, 15 bp, Homo sapiens
gggctcttctcattt

SEQ ID NO: 1615708 - DNA, 16 bp, Homo sapiens
ggcatcttttgtatta

SEQ ID NO: 1615709 - DNA, 21 bp, Homo sapiens
ggcatcttttgtattaagaaa

SEQ ID NO: 1615710 - DNA, 21 bp, Homo sapiens
ggcatgagactcagtgcagat

SEQ ID NO: 1615711 - DNA, 22 bp, Homo sapiens
ggcatgagccactgagcctggc

SEQ ID NO: 1615712 - DNA, 23 bp, Homo sapiens
ggcatgagccactgagcctggcc

SEQ ID NO: 1615713 - DNA, 21 bp, Homo sapiens
ggcatgatctgatccccaaga

SEQ ID NO: 1615714 - DNA, 19 bp, Homo sapiens
ggcatgcacacggctggtc

SEQ ID NO: 1615715 - DNA, 22 bp, Homo sapiens
ggcatgcacacggctggtcact

SEQ ID NO: 1615716 - DNA, 13 bp, Homo sapiens
ggcatgccaggac

SEQ ID NO: 1615717 - DNA, 19 bp, Homo sapiens
ggcatgcgcacaaggctga

SEQ ID NO: 1615718 - DNA, 12 bp, Homo sapiens
ggcatgctgaat

SEQ ID NO: 1615719 - DNA, 13 bp, Homo sapiens
ggcatgctggggc

SEQ ID NO: 1615720 - DNA, 15 bp, Homo sapiens
ggcatggaaggggct

SEQ ID NO: 1615721 - DNA, 17 bp, Homo sapiens
ggcatggccaggtggcc

SEQ ID NO: 1615722 - DNA, 23 bp, Homo sapiens
ggcatggctttatttgttttttt

SEQ ID NO: 1615723 - DNA, 17 bp, Homo sapiens
ggcatggggcatgtcct

SEQ ID NO: 1615724 - DNA, 16 bp, Homo sapiens
ggcatgggtccagggc

SEQ ID NO: 1615725 - DNA, 21 bp, Homo sapiens
ggcatggtggcgcaagcctgt

SEQ ID NO: 1615726 - DNA, 21 bp, Homo sapiens
ggcatggtggctcatgcctgt

SEQ ID NO: 1615727 - DNA, 23 bp, Homo sapiens
ggcatggttccttccctgggaag

SEQ ID NO: 1615728 - DNA, 16 bp, Homo sapiens
ggcatgtattggcctg

SEQ ID NO: 1615729 - DNA, 20 bp, Homo sapiens
ggcatgtattggcctggagg

SEQ ID NO: 1615730 - DNA, 16 bp, Homo sapiens
ggcatgtcccacccac

SEQ ID NO: 1615731 - DNA, 23 bp, Homo sapiens
ggcatgtcctttccatctgtcca

SEQ ID NO: 1615732 - DNA, 16 bp, Homo sapiens
ggcatgtggcctgtgg

SEQ ID NO: 1615733 - DNA, 20 bp, Homo sapiens
ggcatgtggcctgtggcctg

SEQ ID NO: 1615734 - DNA, 14 bp, Homo sapiens
ggcatgtgtgcctg

SEQ ID NO: 1615735 - DNA, 15 bp, Homo sapiens
ggcatgtgtgcctgt

SEQ ID NO: 1615736 - DNA, 17 bp, Homo sapiens
ggcatgtgtgcctgtgg

SEQ ID NO: 1615737 - DNA, 21 bp, Homo sapiens
ggcatgtgtgcctgtggcaga

SEQ ID NO: 1615738 - DNA, 21 bp, Homo sapiens
ggcatgttttctttgtttcct

SEQ ID NO: 1615739 - DNA, 15 bp, Homo sapiens
ggcattcggggaagc

SEQ ID NO: 1615740 - DNA, 23 bp, Homo sapiens
ggcattcggggaagctgcacatg

SEQ ID NO: 1615741 - DNA, 11 bp, Homo sapiens
ggcattgagta

SEQ ID NO: 1615742 - DNA, 22 bp, Homo sapiens
ggcattgcaggaccttgggcac

SEQ ID NO: 1615743 - DNA, 15 bp, Homo sapiens
ggcattgctcagccc

SEQ ID NO: 1615744 - DNA, 16 bp, Homo sapiens
ggcattgctcagcccg

SEQ ID NO: 1615745 - DNA, 17 bp, Homo sapiens
ggcattgctcagcccgc

SEQ ID NO: 1615746 - DNA, 23 bp, Homo sapiens
ggcattgctcagcccgcttggcc

SEQ ID NO: 1615747 - DNA, 13 bp, Homo sapiens
ggcattgggttct

SEQ ID NO: 1615748 - DNA, 17 bp, Homo sapiens
ggcattgttagtttagt

SEQ ID NO: 1615749 - DNA, 13 bp, Homo sapiens
ggcatttcaatcc

SEQ ID NO: 1615750 - DNA, 16 bp, Homo sapiens
ggcatttcctgctgaa

SEQ ID NO: 1615751 - DNA, 14 bp, Homo sapiens
ggcatttggtgaga

SEQ ID NO: 1615752 - DNA, 15 bp, Homo sapiens
ggcatttttatttta

SEQ ID NO: 1615753 - DNA, 16 bp, Homo sapiens
ggccaaaatcaagagt

SEQ ID NO: 1615754 - DNA, 16 bp, Homo sapiens
ggccaaagcacagctg

SEQ ID NO: 1615755 - DNA, 21 bp, Homo sapiens
ggccaactgcaaaaaaagcct

SEQ ID NO: 1615756 - DNA, 22 bp, Homo sapiens
ggccaactgcaaaaaaagcctc

SEQ ID NO: 1615757 - DNA, 21 bp, Homo sapiens
ggccaagaatgtacgtccagc

SEQ ID NO: 1615758 - DNA, 16 bp, Homo sapiens
ggccaagagatctgtg

SEQ ID NO: 1615759 - DNA, 16 bp, Homo sapiens
ggccaagatggctgct

SEQ ID NO: 1615760 - DNA, 17 bp, Homo sapiens
ggccaagatggctgctg

SEQ ID NO: 1615761 - DNA, 20 bp, Homo sapiens
ggccaagatggctgctgcct

SEQ ID NO: 1615762 - DNA, 15 bp, Homo sapiens
ggccaagatgtactt

SEQ ID NO: 1615763 - DNA, 12 bp, Homo sapiens
ggccaagcagaa

SEQ ID NO: 1615764 - DNA, 20 bp, Homo sapiens
ggccaagcagaaaaaaaagt

SEQ ID NO: 1615765 - DNA, 16 bp, Homo sapiens
ggccaagcagtgcctg

SEQ ID NO: 1615766 - DNA, 19 bp, Homo sapiens
ggccaagcagtgcctgcct

SEQ ID NO: 1615767 - DNA, 16 bp, Homo sapiens
ggccaaggccttctcc

SEQ ID NO: 1615768 - DNA, 18 bp, Homo sapiens
ggccaaggccttctcctc

SEQ ID NO: 1615769 - DNA, 15 bp, Homo sapiens
ggccaaggtcctgct

SEQ ID NO: 1615770 - DNA, 19 bp, Homo sapiens
ggccaagtctaatgaagag

SEQ ID NO: 1615771 - DNA, 21 bp, Homo sapiens
ggccaagtctaatgaagagaa

SEQ ID NO: 1615772 - DNA, 23 bp, Homo sapiens
ggccaagtctaatgaagagaaaa

SEQ ID NO: 1615773 - DNA, 20 bp, Homo sapiens
ggccaatggtgcttccccca

SEQ ID NO: 1615774 - DNA, 22 bp, Homo sapiens
ggccacaaggaaaaggaggagg

SEQ ID NO: 1615775 - DNA, 23 bp, Homo sapiens
ggccacaaggaaaaggaggaggt

SEQ ID NO: 1615776 - DNA, 22 bp, Homo sapiens
ggccacacctgagcgctgtgga

SEQ ID NO: 1615777 - DNA, 13 bp, Homo sapiens
ggccacagccccc

SEQ ID NO: 1615778 - DNA, 21 bp, Homo sapiens
ggccacagcccccttgccctc

SEQ ID NO: 1615779 - DNA, 16 bp, Homo sapiens
ggccacatagatgctg

SEQ ID NO: 1615780 - DNA, 13 bp, Homo sapiens
ggccaccaaagct

SEQ ID NO: 1615781 - DNA, 18 bp, Homo sapiens
ggccaccaaagctgccca

SEQ ID NO: 1615782 - DNA, 24 bp, Homo sapiens
ggccaccacctttggctggtagca

SEQ ID NO: 1615783 - DNA, 13 bp, Homo sapiens
ggccaccaggctg

SEQ ID NO: 1615784 - DNA, 21 bp, Homo sapiens
ggccacccactgacccaactg

SEQ ID NO: 1615785 - DNA, 15 bp, Homo sapiens
ggccaccccgtgcca

SEQ ID NO: 1615786 - DNA, 19 bp, Homo sapiens
ggccaccctccttcccgcc

SEQ ID NO: 1615787 - DNA, 13 bp, Homo sapiens
ggccaccctggcc

SEQ ID NO: 1615788 - DNA, 14 bp, Homo sapiens
ggccaccctggccc

SEQ ID NO: 1615789 - DNA, 19 bp, Homo sapiens
ggccaccgggacagacctg

SEQ ID NO: 1615790 - DNA, 15 bp, Homo sapiens
ggccatggcctctgc

SEQ ID NO: 1615791 - DNA, 23 bp, Homo sapiens
ggccatgtccaaagaggctgccc

SEQ ID NO: 1615792 - DNA, 21 bp, Homo sapiens
ggccatgtgagccaccgctgc

SEQ ID NO: 1615793 - DNA, 14 bp, Homo sapiens
ggccattctgccgc

SEQ ID NO: 1615794 - DNA, 21 bp, Homo sapiens
ggccattcttatgttccagat

SEQ ID NO: 1615795 - DNA, 23 bp, Homo sapiens
ggccatttgctagttctgctgcc

SEQ ID NO: 1615796 - DNA, 15 bp, Homo sapiens
ggccatttttctggg

SEQ ID NO: 1615797 - DNA, 21 bp, Homo sapiens
ggcccaaaggccttggacaac

SEQ ID NO: 1615798 - DNA, 23 bp, Homo sapiens
ggcccaacacaattcttcttcca

SEQ ID NO: 1615799 - DNA, 15 bp, Homo sapiens
ggcccaagccccatc

SEQ ID NO: 1615800 - DNA, 14 bp, Homo sapiens
ggcccaaggagctt

SEQ ID NO: 1615801 - DNA, 22 bp, Homo sapiens
ggcccaaggagcttacccaagc

SEQ ID NO: 1615802 - DNA, 15 bp, Homo sapiens
ggcccaagtccctgt

SEQ ID NO: 1615803 - DNA, 12 bp, Homo sapiens
ggcccacacctg

SEQ ID NO: 1615804 - DNA, 16 bp, Homo sapiens
ggcccacactgaggct

SEQ ID NO: 1615805 - DNA, 19 bp, Homo sapiens
ggcccacaggaagctcagc

SEQ ID NO: 1615806 - DNA, 21 bp, Homo sapiens
ggcccacaggaagctcagcct

SEQ ID NO: 1615807 - DNA, 15 bp, Homo sapiens
ggcccaccagggtcc

SEQ ID NO: 1615808 - DNA, 20 bp, Homo sapiens
ggcccaccatcaccaccgcc

SEQ ID NO: 1615809 - DNA, 20 bp, Homo sapiens
ggcccacccagtccatgctc

SEQ ID NO: 1615810 - DNA, 12 bp, Homo sapiens
ggcccacctggc

SEQ ID NO: 1615811 - DNA, 14 bp, Homo sapiens
ggcccacctggcca

SEQ ID NO: 1615812 - DNA, 18 bp, Homo sapiens
ggcccacgtgtatagtat

SEQ ID NO: 1615813 - DNA, 16 bp, Homo sapiens
ggcccactagagggcc

SEQ ID NO: 1615814 - DNA, 17 bp, Homo sapiens
ggcccactagagggccc

SEQ ID NO: 1615815 - DNA, 14 bp, Homo sapiens
ggcccactccccag

SEQ ID NO: 1615816 - DNA, 19 bp, Homo sapiens
ggcccactccccagcccca

SEQ ID NO: 1615817 - DNA, 18 bp, Homo sapiens
ggcccactgtgcctcaga

SEQ ID NO: 1615818 - DNA, 14 bp, Homo sapiens
ggcccactttcctg

SEQ ID NO: 1615819 - DNA, 17 bp, Homo sapiens
ggcccactttcctgagc

SEQ ID NO: 1615820 - DNA, 16 bp, Homo sapiens
ggcccagaaagcctct

SEQ ID NO: 1615821 - DNA, 17 bp, Homo sapiens
ggcccagaccactgtct

SEQ ID NO: 1615822 - DNA, 18 bp, Homo sapiens
ggcccagaccctgggcaa

SEQ ID NO: 1615823 - DNA, 13 bp, Homo sapiens
ggcccagagccca

SEQ ID NO: 1615824 - DNA, 15 bp, Homo sapiens
ggcccagagcccagc

SEQ ID NO: 1615825 - DNA, 19 bp, Homo sapiens
ggcccagagcccagctcca

SEQ ID NO: 1615826 - DNA, 20 bp, Homo sapiens
ggcccagagtttacattcta

SEQ ID NO: 1615827 - DNA, 15 bp, Homo sapiens
ggcccagcaggggcc

SEQ ID NO: 1615828 - DNA, 18 bp, Homo sapiens
ggcccagccaggagcaga

SEQ ID NO: 1615829 - DNA, 15 bp, Homo sapiens
ggcccagccctcaga

SEQ ID NO: 1615830 - DNA, 20 bp, Homo sapiens
ggcccagccggcctctctgg

SEQ ID NO: 1615831 - DNA, 21 bp, Homo sapiens
ggcccagccggcctctctggc

SEQ ID NO: 1615832 - DNA, 18 bp, Homo sapiens
ggcccagcgcggccagcg

SEQ ID NO: 1615833 - DNA, 18 bp, Homo sapiens
ggcccagcgctctcctgg

SEQ ID NO: 1615834 - DNA, 19 bp, Homo sapiens
ggcccagcgctctcctgga

SEQ ID NO: 1615835 - DNA, 16 bp, Homo sapiens
ggcccagcggcccctc

SEQ ID NO: 1615836 - DNA, 14 bp, Homo sapiens
ggcccagcgggcag

SEQ ID NO: 1615837 - DNA, 16 bp, Homo sapiens
ggcccagcgggcagat

SEQ ID NO: 1615838 - DNA, 13 bp, Homo sapiens
ggcccaggagctc

SEQ ID NO: 1615839 - DNA, 17 bp, Homo sapiens
ggcccaggcaccaccag

SEQ ID NO: 1615840 - DNA, 20 bp, Homo sapiens
ggcccaggcaccaccaggag

SEQ ID NO: 1615841 - DNA, 21 bp, Homo sapiens
ggcccaggcaccaccaggagc

SEQ ID NO: 1615842 - DNA, 22 bp, Homo sapiens
ggcccaggcaccaccaggagca

SEQ ID NO: 1615843 - DNA, 23 bp, Homo sapiens
ggcccaggcaccaccaggagcag

SEQ ID NO: 1615844 - DNA, 15 bp, Homo sapiens
ggcccaggcaggcca

SEQ ID NO: 1615845 - DNA, 19 bp, Homo sapiens
ggcccagggggcctggagc

SEQ ID NO: 1615846 - DNA, 11 bp, Homo sapiens
ggcccagggtg

SEQ ID NO: 1615847 - DNA, 20 bp, Homo sapiens
ggcccaggttcgagacccaa

SEQ ID NO: 1615848 - DNA, 18 bp, Homo sapiens
ggcccagtgcatggtggc

SEQ ID NO: 1615849 - DNA, 19 bp, Homo sapiens
ggcccagtgtcaagttgtg

SEQ ID NO: 1615850 - DNA, 22 bp, Homo sapiens
ggcccagtgtcaagttgtgctt

SEQ ID NO: 1615851 - DNA, 22 bp, Homo sapiens
ggcccataccttctggttgctt

SEQ ID NO: 1615852 - DNA, 14 bp, Homo sapiens
ggcccatcactgta

SEQ ID NO: 1615853 - DNA, 22 bp, Homo sapiens
ggcccatcaggcagtgttacct

SEQ ID NO: 1615854 - DNA, 11 bp, Homo sapiens
ggcccatctca

SEQ ID NO: 1615855 - DNA, 19 bp, Homo sapiens
ggccccaaccctgtcctcc

SEQ ID NO: 1615856 - DNA, 13 bp, Homo sapiens
ggccccacatggg

SEQ ID NO: 1615857 - DNA, 16 bp, Homo sapiens
ggccccacatgggaac

SEQ ID NO: 1615858 - DNA, 17 bp, Homo sapiens
ggccccacctgtgtccc

SEQ ID NO: 1615859 - DNA, 17 bp, Homo sapiens
ggccccactttgaaggg

SEQ ID NO: 1615860 - DNA, 19 bp, Homo sapiens
ggccccagaaggcagggaa

SEQ ID NO: 1615861 - DNA, 19 bp, Homo sapiens
ggccccagaggccctggag

SEQ ID NO: 1615862 - DNA, 17 bp, Homo sapiens
ggccccagatctgcctg

SEQ ID NO: 1615863 - DNA, 18 bp, Homo sapiens
ggccccagatctgcctgg

SEQ ID NO: 1615864 - DNA, 20 bp, Homo sapiens
ggccccagatgatcccagtc

SEQ ID NO: 1615865 - DNA, 20 bp, Homo sapiens
ggccccagcacctcagcctg

SEQ ID NO: 1615866 - DNA, 21 bp, Homo sapiens
ggccccagcactaaagcagtg

SEQ ID NO: 1615867 - DNA, 13 bp, Homo sapiens
ggccccagccaga

SEQ ID NO: 1615868 - DNA, 21 bp, Homo sapiens
ggccccagccagagttcctgc

SEQ ID NO: 1615869 - DNA, 14 bp, Homo sapiens
ggccccagccctgc

SEQ ID NO: 1615870 - DNA, 13 bp, Homo sapiens
ggccccagcctcc

SEQ ID NO: 1615871 - DNA, 14 bp, Homo sapiens
ggccccaggggcag

SEQ ID NO: 1615872 - DNA, 15 bp, Homo sapiens
ggccccaggggcagc

SEQ ID NO: 1615873 - DNA, 14 bp, Homo sapiens
ggccccatgctctg

SEQ ID NO: 1615874 - DNA, 16 bp, Homo sapiens
ggccccatgctctgcc

SEQ ID NO: 1615875 - DNA, 21 bp, Homo sapiens
ggccccatgctctgccccaag

SEQ ID NO: 1615876 - DNA, 21 bp, Homo sapiens
ggcccccaacctcagggctcc

SEQ ID NO: 1615877 - DNA, 16 bp, Homo sapiens
ggcccccaataaaggc

SEQ ID NO: 1615878 - DNA, 22 bp, Homo sapiens
ggcccccaataaaggcagctgc

SEQ ID NO: 1615879 - DNA, 12 bp, Homo sapiens
ggcccccacagg

SEQ ID NO: 1615880 - DNA, 21 bp, Homo sapiens
ggcccccacaggccccccgca

SEQ ID NO: 1615881 - DNA, 16 bp, Homo sapiens
ggcccccacttgcctc

SEQ ID NO: 1615882 - DNA, 18 bp, Homo sapiens
ggcccccagcccagggct

SEQ ID NO: 1615883 - DNA, 19 bp, Homo sapiens
ggccccccgcacagccacc

SEQ ID NO: 1615884 - DNA, 16 bp, Homo sapiens
ggccccccgcagcacc

SEQ ID NO: 1615885 - DNA, 17 bp, Homo sapiens
ggccccccgcagcaccc

SEQ ID NO: 1615886 - DNA, 18 bp, Homo sapiens
ggcccccggccacgctcc

SEQ ID NO: 1615887 - DNA, 16 bp, Homo sapiens
ggcccccgtgttcagg

SEQ ID NO: 1615888 - DNA, 15 bp, Homo sapiens
ggccccctccatcgg

SEQ ID NO: 1615889 - DNA, 13 bp, Homo sapiens
ggccccctgcatc

SEQ ID NO: 1615890 - DNA, 22 bp, Homo sapiens
ggccccgatggactcctgacca

SEQ ID NO: 1615891 - DNA, 16 bp, Homo sapiens
ggccccgccagggctg

SEQ ID NO: 1615892 - DNA, 20 bp, Homo sapiens
ggccccgccagggctgggga

SEQ ID NO: 1615893 - DNA, 13 bp, Homo sapiens
ggccccggcccca

SEQ ID NO: 1615894 - DNA, 18 bp, Homo sapiens
ggccccggccccagccag

SEQ ID NO: 1615895 - DNA, 18 bp, Homo sapiens
ggccccgggctctggcca

SEQ ID NO: 1615896 - DNA, 14 bp, Homo sapiens
ggccccgggctgga

SEQ ID NO: 1615897 - DNA, 14 bp, Homo sapiens
ggccccgggcttcc

SEQ ID NO: 1615898 - DNA, 14 bp, Homo sapiens
ggccccggggctgg

SEQ ID NO: 1615899 - DNA, 18 bp, Homo sapiens
ggccccgtttctggtggt

SEQ ID NO: 1615900 - DNA, 19 bp, Homo sapiens
ggcccctcaccctgcctta

SEQ ID NO: 1615901 - DNA, 21 bp, Homo sapiens
ggcccctcacctggtacctgg

SEQ ID NO: 1615902 - DNA, 23 bp, Homo sapiens
ggcccctcacctggtacctggac

SEQ ID NO: 1615903 - DNA, 15 bp, Homo sapiens
ggcccctccagcaca

SEQ ID NO: 1615904 - DNA, 22 bp, Homo sapiens
ggcccctcccacacacacccac

SEQ ID NO: 1615905 - DNA, 23 bp, Homo sapiens
ggcccctcccacacccaaagctg

SEQ ID NO: 1615906 - DNA, 17 bp, Homo sapiens
ggcccctccctctgccc

SEQ ID NO: 1615907 - DNA, 21 bp, Homo sapiens
ggcccctccctctgccccaag

SEQ ID NO: 1615908 - DNA, 15 bp, Homo sapiens
ggcccctctgctgtc

SEQ ID NO: 1615909 - DNA, 16 bp, Homo sapiens
ggcccctgctgtctct

SEQ ID NO: 1615910 - DNA, 19 bp, Homo sapiens
ggcccctgctgtctctctg

SEQ ID NO: 1615911 - DNA, 13 bp, Homo sapiens
ggcccctggcact

SEQ ID NO: 1615912 - DNA, 12 bp, Homo sapiens
ggcccctggccc

SEQ ID NO: 1615913 - DNA, 13 bp, Homo sapiens
ggcccctggccca

SEQ ID NO: 1615914 - DNA, 14 bp, Homo sapiens
ggcccctggcccag

SEQ ID NO: 1615915 - DNA, 20 bp, Homo sapiens
ggcccctgggcttggcctgc

SEQ ID NO: 1615916 - DNA, 18 bp, Homo sapiens
ggcccctgtgtgagttga

SEQ ID NO: 1615917 - DNA, 17 bp, Homo sapiens
ggcccgaacagggactt

SEQ ID NO: 1615918 - DNA, 17 bp, Homo sapiens
ggcccgacagcctggca

SEQ ID NO: 1615919 - DNA, 23 bp, Homo sapiens
ggcccgcaccccggcctcagggc

SEQ ID NO: 1615920 - DNA, 16 bp, Homo sapiens
ggcccgcagtgctggg

SEQ ID NO: 1615921 - DNA, 22 bp, Homo sapiens
ggcccgcagtgctgggaccaga

SEQ ID NO: 1615922 - DNA, 12 bp, Homo sapiens
ggcccgcccctc

SEQ ID NO: 1615923 - DNA, 19 bp, Homo sapiens
ggcccggagaaacctgatg

SEQ ID NO: 1615924 - DNA, 20 bp, Homo sapiens
ggcccggagaaacctgatga

SEQ ID NO: 1615925 - DNA, 18 bp, Homo sapiens
ggcccggccacacccagc

SEQ ID NO: 1615926 - DNA, 17 bp, Homo sapiens
ggcccggccggcctggc

SEQ ID NO: 1615927 - DNA, 23 bp, Homo sapiens
ggcccggcgcggtggctcacgcc

SEQ ID NO: 1615928 - DNA, 13 bp, Homo sapiens
ggcccggggctgg

SEQ ID NO: 1615929 - DNA, 19 bp, Homo sapiens
ggcccggggctggcggcta

SEQ ID NO: 1615930 - DNA, 15 bp, Homo sapiens
ggcccgtcggagctg

SEQ ID NO: 1615931 - DNA, 19 bp, Homo sapiens
ggcccgtcggagctgcctg

SEQ ID NO: 1615932 - DNA, 21 bp, Homo sapiens
ggcccgtcggagctgcctgca

SEQ ID NO: 1615933 - DNA, 15 bp, Homo sapiens
ggccctaggcccctc

SEQ ID NO: 1615934 - DNA, 15 bp, Homo sapiens
ggccctcacccctgc

SEQ ID NO: 1615935 - DNA, 12 bp, Homo sapiens
ggccctcccagc

SEQ ID NO: 1615936 - DNA, 20 bp, Homo sapiens
ggccctccctgttccccaga

SEQ ID NO: 1615937 - DNA, 22 bp, Homo sapiens
ggccctccgaccacttccaggg

SEQ ID NO: 1615938 - DNA, 20 bp, Homo sapiens
ggccctctcttctcaccttt

SEQ ID NO: 1615939 - DNA, 15 bp, Homo sapiens
ggccctctgcctgca

SEQ ID NO: 1615940 - DNA, 17 bp, Homo sapiens
ggccctctgcctgcact

SEQ ID NO: 1615941 - DNA, 19 bp, Homo sapiens
ggccctctgcctgcactcc

SEQ ID NO: 1615942 - DNA, 20 bp, Homo sapiens
ggccctctgcctgcactccc

SEQ ID NO: 1615943 - DNA, 19 bp, Homo sapiens
ggccctcttgcgggcctgg

SEQ ID NO: 1615944 - DNA, 21 bp, Homo sapiens
ggccctcttgcgggcctggac

SEQ ID NO: 1615945 - DNA, 16 bp, Homo sapiens
ggccctctttccctgc

SEQ ID NO: 1615946 - DNA, 19 bp, Homo sapiens
ggccctgagctcggtggac

SEQ ID NO: 1615947 - DNA, 16 bp, Homo sapiens
ggccctgcagccagct

SEQ ID NO: 1615948 - DNA, 21 bp, Homo sapiens
ggccctgcattggcctggcct

SEQ ID NO: 1615949 - DNA, 21 bp, Homo sapiens
ggccctgccctctccttcctt

SEQ ID NO: 1615950 - DNA, 17 bp, Homo sapiens
ggccctgccctggcagg

SEQ ID NO: 1615951 - DNA, 10 bp, Homo sapiens
ggccctgcct

SEQ ID NO: 1615952 - DNA, 20 bp, Homo sapiens
ggccctgctgaagctgctgc

SEQ ID NO: 1615953 - DNA, 14 bp, Homo sapiens
ggccctgcttcctg

SEQ ID NO: 1615954 - DNA, 12 bp, Homo sapiens
ggccctggagcc

SEQ ID NO: 1615955 - DNA, 20 bp, Homo sapiens
ggccctggagccagggcaga

SEQ ID NO: 1615956 - DNA, 21 bp, Homo sapiens
ggccctggagccagggcagag

SEQ ID NO: 1615957 - DNA, 23 bp, Homo sapiens
ggccctggagccagggcagagga

SEQ ID NO: 1615958 - DNA, 19 bp, Homo sapiens
ggccctggaggtctccagg

SEQ ID NO: 1615959 - DNA, 15 bp, Homo sapiens
ggccctggcaccccc

SEQ ID NO: 1615960 - DNA, 15 bp, Homo sapiens
ggccctggccaggac

SEQ ID NO: 1615961 - DNA, 14 bp, Homo sapiens
ggccctggcctccc

SEQ ID NO: 1615962 - DNA, 12 bp, Homo sapiens
ggccctggcctg

SEQ ID NO: 1615963 - DNA, 20 bp, Homo sapiens
ggccctggggatcttcccac

SEQ ID NO: 1615964 - DNA, 23 bp, Homo sapiens
ggccctggggatcttcccacagg

SEQ ID NO: 1615965 - DNA, 15 bp, Homo sapiens
ggccctgtgcctggg

SEQ ID NO: 1615966 - DNA, 16 bp, Homo sapiens
ggccctgttccctgga

SEQ ID NO: 1615967 - DNA, 22 bp, Homo sapiens
ggccctgttccctggagtcagg

SEQ ID NO: 1615968 - DNA, 11 bp, Homo sapiens
ggcccttcagt

SEQ ID NO: 1615969 - DNA, 19 bp, Homo sapiens
ggcccttcagtctgctcca

SEQ ID NO: 1615970 - DNA, 13 bp, Homo sapiens
ggcccttcctctc

SEQ ID NO: 1615971 - DNA, 20 bp, Homo sapiens
ggcccttctgactgtttatt

SEQ ID NO: 1615972 - DNA, 21 bp, Homo sapiens
ggcccttgcagttcagcacca

SEQ ID NO: 1615973 - DNA, 15 bp, Homo sapiens
ggcccttggggcctg

SEQ ID NO: 1615974 - DNA, 21 bp, Homo sapiens
ggcccttggggcctggcttgc

SEQ ID NO: 1615975 - DNA, 16 bp, Homo sapiens
ggcccttgtcctgcca

SEQ ID NO: 1615976 - DNA, 20 bp, Homo sapiens
ggcccttgtcctgccagctg

SEQ ID NO: 1615977 - DNA, 23 bp, Homo sapiens
ggcccttgtcctgccagctgcct

SEQ ID NO: 1615978 - DNA, 14 bp, Homo sapiens
ggccctttggcttc

SEQ ID NO: 1615979 - DNA, 16 bp, Homo sapiens
ggccgaagctctggct

SEQ ID NO: 1615980 - DNA, 18 bp, Homo sapiens
ggccgaagctctggctga

SEQ ID NO: 1615981 - DNA, 16 bp, Homo sapiens
ggccgaaggtgcctca

SEQ ID NO: 1615982 - DNA, 20 bp, Homo sapiens
ggccgaaggtgcctcagact

SEQ ID NO: 1615983 - DNA, 19 bp, Homo sapiens
ggccgaatcccctccctgt

SEQ ID NO: 1615984 - DNA, 20 bp, Homo sapiens
ggccgagcggtggccccgag

SEQ ID NO: 1615985 - DNA, 18 bp, Homo sapiens
ggccgaggaccaccagca

SEQ ID NO: 1615986 - DNA, 21 bp, Homo sapiens
ggccgaggaccaccagcaggc

SEQ ID NO: 1615987 - DNA, 13 bp, Homo sapiens
ggccgaggcccag

SEQ ID NO: 1615988 - DNA, 18 bp, Homo sapiens
ggccgaggcccagcgggc

SEQ ID NO: 1615989 - DNA, 21 bp, Homo sapiens
ggccgcacctaaagcagccag

SEQ ID NO: 1615990 - DNA, 22 bp, Homo sapiens
ggccgcacctaaagcagccagc

SEQ ID NO: 1615991 - DNA, 15 bp, Homo sapiens
ggccgcattccctga

SEQ ID NO: 1615992 - DNA, 16 bp, Homo sapiens
ggccgcattccctgag

SEQ ID NO: 1615993 - DNA, 13 bp, Homo sapiens
ggccgccagcgtg

SEQ ID NO: 1615994 - DNA, 20 bp, Homo sapiens
ggccgcccacccgcccgagg

SEQ ID NO: 1615995 - DNA, 12 bp, Homo sapiens
ggccgccccctg

SEQ ID NO: 1615996 - DNA, 19 bp, Homo sapiens
ggccgccccctgcccccca

SEQ ID NO: 1615997 - DNA, 21 bp, Homo sapiens
ggccgcccctgaggcttcacg

SEQ ID NO: 1615998 - DNA, 16 bp, Homo sapiens
ggccgcccctggccac

SEQ ID NO: 1615999 - DNA, 17 bp, Homo sapiens
ggccgccgccaggactg

SEQ ID NO: 1616000 - DNA, 14 bp, Homo sapiens
ggccgccgcctctt

SEQ ID NO: 1616001 - DNA, 13 bp, Homo sapiens
ggccgcctccagg

SEQ ID NO: 1616002 - DNA, 15 bp, Homo sapiens
ggccgcctggcaggt

SEQ ID NO: 1616003 - DNA, 16 bp, Homo sapiens
ggccgcctggcaggtg

SEQ ID NO: 1616004 - DNA, 18 bp, Homo sapiens
ggccgcctggcaggtgga

SEQ ID NO: 1616005 - DNA, 16 bp, Homo sapiens
ggccgcgcccagcaga

SEQ ID NO: 1616006 - DNA, 17 bp, Homo sapiens
ggccgcggccgcccgca

SEQ ID NO: 1616007 - DNA, 13 bp, Homo sapiens
ggccgctagaggc

SEQ ID NO: 1616008 - DNA, 15 bp, Homo sapiens
ggccgctagaggcct

SEQ ID NO: 1616009 - DNA, 17 bp, Homo sapiens
ggccgctagaggcctga

SEQ ID NO: 1616010 - DNA, 20 bp, Homo sapiens
ggccgctagaggcctgagga

SEQ ID NO: 1616011 - DNA, 12 bp, Homo sapiens
ggccgctgccac

SEQ ID NO: 1616012 - DNA, 14 bp, Homo sapiens
ggccgctggctggt

SEQ ID NO: 1616013 - DNA, 12 bp, Homo sapiens
ggccgctggggt

SEQ ID NO: 1616014 - DNA, 23 bp, Homo sapiens
ggctctccaagtgccagaggtgg

SEQ ID NO: 1616015 - DNA, 14 bp, Homo sapiens
ggctctccacctca

SEQ ID NO: 1616016 - DNA, 15 bp, Homo sapiens
ggctctccacctcag

SEQ ID NO: 1616017 - DNA, 23 bp, Homo sapiens
ggctctcgctgccctgtggacag

SEQ ID NO: 1616018 - DNA, 10 bp, Homo sapiens
ggctctgaga

SEQ ID NO: 1616019 - DNA, 18 bp, Homo sapiens
ggctctgagagtctagat

SEQ ID NO: 1616020 - DNA, 19 bp, Homo sapiens
ggctctgcaattcccctct

SEQ ID NO: 1616021 - DNA, 16 bp, Homo sapiens
ggctctgcagcacctc

SEQ ID NO: 1616022 - DNA, 20 bp, Homo sapiens
ggctctgccccagctctggc

SEQ ID NO: 1616023 - DNA, 14 bp, Homo sapiens
ggctctgccccctc

SEQ ID NO: 1616024 - DNA, 20 bp, Homo sapiens
ggctctgccccctcccccat

SEQ ID NO: 1616025 - DNA, 21 bp, Homo sapiens
ggctctgcctgtctggtgcct

SEQ ID NO: 1616026 - DNA, 14 bp, Homo sapiens
ggctctgccttctc

SEQ ID NO: 1616027 - DNA, 15 bp, Homo sapiens
ggctctggccaccct

SEQ ID NO: 1616028 - DNA, 15 bp, Homo sapiens
ggctctgggcctgag

SEQ ID NO: 1616029 - DNA, 12 bp, Homo sapiens
ggctctgggctc

SEQ ID NO: 1616030 - DNA, 16 bp, Homo sapiens
ggctctgggctcaggg

SEQ ID NO: 1616031 - DNA, 15 bp, Homo sapiens
ggctctgtgccttgg

SEQ ID NO: 1616032 - DNA, 20 bp, Homo sapiens
ggctctgtttgtgggactgg

SEQ ID NO: 1616033 - DNA, 19 bp, Homo sapiens
ggctcttagcagcttccag

SEQ ID NO: 1616034 - DNA, 14 bp, Homo sapiens
ggctcttcctggac

SEQ ID NO: 1616035 - DNA, 15 bp, Homo sapiens
ggctcttcctggacc

SEQ ID NO: 1616036 - DNA, 17 bp, Homo sapiens
ggctcttcctggacctg

SEQ ID NO: 1616037 - DNA, 13 bp, Homo sapiens
ggctcttctcctt

SEQ ID NO: 1616038 - DNA, 16 bp, Homo sapiens
ggctcttctcctttca

SEQ ID NO: 1616039 - DNA, 20 bp, Homo sapiens
ggctcttgatacccccctct

SEQ ID NO: 1616040 - DNA, 18 bp, Homo sapiens
ggctgaaattctcctgga

SEQ ID NO: 1616041 - DNA, 14 bp, Homo sapiens
ggctgaaccctgtg

SEQ ID NO: 1616042 - DNA, 17 bp, Homo sapiens
ggctgaaccctgtgctg

SEQ ID NO: 1616043 - DNA, 19 bp, Homo sapiens
ggctgaaccctgtgctggt

SEQ ID NO: 1616044 - DNA, 15 bp, Homo sapiens
ggctgaacggggaga

SEQ ID NO: 1616045 - DNA, 17 bp, Homo sapiens
ggctgaacggggagaaa

SEQ ID NO: 1616046 - DNA, 18 bp, Homo sapiens
ggctgaagaatgaagacc

SEQ ID NO: 1616047 - DNA, 14 bp, Homo sapiens
ggctgaagctggag

SEQ ID NO: 1616048 - DNA, 20 bp, Homo sapiens
ggctgaagctggagcagcgg

SEQ ID NO: 1616049 - DNA, 23 bp, Homo sapiens
ggctgacacctaccatgctgctt

SEQ ID NO: 1616050 - DNA, 21 bp, Homo sapiens
ggctgacatgctcacacatta

SEQ ID NO: 1616051 - DNA, 18 bp, Homo sapiens
ggctgacccagcatctcc

SEQ ID NO: 1616052 - DNA, 18 bp, Homo sapiens
ggctgacccagtccctgg

SEQ ID NO: 1616053 - DNA, 24 bp, Homo sapiens
ggctgactagaagggccagtcctg

SEQ ID NO: 1616054 - DNA, 13 bp, Homo sapiens
ggctgagaaggaa

SEQ ID NO: 1616055 - DNA, 16 bp, Homo sapiens
ggctgagagccccagc

SEQ ID NO: 1616056 - DNA, 15 bp, Homo sapiens
ggctgagaggaagca

SEQ ID NO: 1616057 - DNA, 21 bp, Homo sapiens
ggctgagcaaatattaaaatt

SEQ ID NO: 1616058 - DNA, 12 bp, Homo sapiens
ggctgagccccc

SEQ ID NO: 1616059 - DNA, 16 bp, Homo sapiens
ggctgagcccctgggg

SEQ ID NO: 1616060 - DNA, 18 bp, Homo sapiens
ggctgagcccctggggaa

SEQ ID NO: 1616061 - DNA, 13 bp, Homo sapiens
ggctgagccctgg

SEQ ID NO: 1616062 - DNA, 16 bp, Homo sapiens
ggctgagccctggcag

SEQ ID NO: 1616063 - DNA, 20 bp, Homo sapiens
ggctgaggacgagaccccca

SEQ ID NO: 1616064 - DNA, 21 bp, Homo sapiens
ggctgaggatttcaagcctgc

SEQ ID NO: 1616065 - DNA, 14 bp, Homo sapiens
ggctgaggcagaag

SEQ ID NO: 1616066 - DNA, 17 bp, Homo sapiens
ggctgaggcagaagaat

SEQ ID NO: 1616067 - DNA, 14 bp, Homo sapiens
ggctgaggcaggag

SEQ ID NO: 1616068 - DNA, 19 bp, Homo sapiens
ggctgcttctccacctccc

SEQ ID NO: 1616069 - DNA, 22 bp, Homo sapiens
ggctgcttctccacctccccca

SEQ ID NO: 1616070 - DNA, 14 bp, Homo sapiens
ggctgctttctgcc

SEQ ID NO: 1616071 - DNA, 22 bp, Homo sapiens
ggctgcttttcttaagtgccca

SEQ ID NO: 1616072 - DNA, 15 bp, Homo sapiens
ggctggaagatcctg

SEQ ID NO: 1616073 - DNA, 18 bp, Homo sapiens
ggctggacaccctctgcc

SEQ ID NO: 1616074 - DNA, 17 bp, Homo sapiens
ggctggactgaggcctg

SEQ ID NO: 1616075 - DNA, 18 bp, Homo sapiens
ggctggactgaggcctga

SEQ ID NO: 1616076 - DNA, 14 bp, Homo sapiens
ggctggagaaagag

SEQ ID NO: 1616077 - DNA, 21 bp, Homo sapiens
ggctggagaaagagctgcctg

SEQ ID NO: 1616078 - DNA, 15 bp, Homo sapiens
ggctggagagctgct

SEQ ID NO: 1616079 - DNA, 15 bp, Homo sapiens
ggctggaggagctgg

SEQ ID NO: 1616080 - DNA, 17 bp, Homo sapiens
ggctggaggcagggcct

SEQ ID NO: 1616081 - DNA, 23 bp, Homo sapiens
ggctggaggcagggccttgccca

SEQ ID NO: 1616082 - DNA, 13 bp, Homo sapiens
ggctggaggccca

SEQ ID NO: 1616083 - DNA, 15 bp, Homo sapiens
ggctggaggcccagg

SEQ ID NO: 1616084 - DNA, 17 bp, Homo sapiens
ggctggagtaatcagat

SEQ ID NO: 1616085 - DNA, 19 bp, Homo sapiens
ggctggagtgcagtggcgt

SEQ ID NO: 1616086 - DNA, 20 bp, Homo sapiens
ggctggagtgcagtggtgca

SEQ ID NO: 1616087 - DNA, 16 bp, Homo sapiens
ggctggagtgcgctct

SEQ ID NO: 1616088 - DNA, 19 bp, Homo sapiens
ggctggatggcacctcagg

SEQ ID NO: 1616089 - DNA, 19 bp, Homo sapiens
ggctggatgtggtggcata

SEQ ID NO: 1616090 - DNA, 14 bp, Homo sapiens
ggctggcaggtatg

SEQ ID NO: 1616091 - DNA, 20 bp, Homo sapiens
ggctggcatcaagggagaca

SEQ ID NO: 1616092 - DNA, 13 bp, Homo sapiens
ggctggccaaggt

SEQ ID NO: 1616093 - DNA, 20 bp, Homo sapiens
ggctggccagtccaggctgc

SEQ ID NO: 1616094 - DNA, 21 bp, Homo sapiens
ggctggcctaggagatatctg

SEQ ID NO: 1616095 - DNA, 14 bp, Homo sapiens
ggctggcgcagcca

SEQ ID NO: 1616096 - DNA, 16 bp, Homo sapiens
ggctggcgcagccaag

SEQ ID NO: 1616097 - DNA, 13 bp, Homo sapiens
ggctggctgaaga

SEQ ID NO: 1616098 - DNA, 10 bp, Homo sapiens
ggctggctgg

SEQ ID NO: 1616099 - DNA, 13 bp, Homo sapiens
ggctggctggcct

SEQ ID NO: 1616100 - DNA, 13 bp, Homo sapiens
ggctggctgggca

SEQ ID NO: 1616101 - DNA, 22 bp, Homo sapiens
ggctgggaacatgacccagcct

SEQ ID NO: 1616102 - DNA, 15 bp, Homo sapiens
ggctgggccaggtct

SEQ ID NO: 1616103 - DNA, 17 bp, Homo sapiens
ggctgggccatgtccaa

SEQ ID NO: 1616104 - DNA, 21 bp, Homo sapiens
ggctgggccatgtccaaagag

SEQ ID NO: 1616105 - DNA, 20 bp, Homo sapiens
ggctgggcccagcaggggcc

SEQ ID NO: 1616106 - DNA, 18 bp, Homo sapiens
ggctgggccctctgtcca

SEQ ID NO: 1616107 - DNA, 21 bp, Homo sapiens
ggctgggccctctttccctgc

SEQ ID NO: 1616108 - DNA, 19 bp, Homo sapiens
ggctgggcctcgtgcgccc

SEQ ID NO: 1616109 - DNA, 22 bp, Homo sapiens
ggctggggcagaggggcagccg

SEQ ID NO: 1616110 - DNA, 17 bp, Homo sapiens
ggctggggctgctcccc

SEQ ID NO: 1616111 - DNA, 19 bp, Homo sapiens
ggctgggggaggtccaagc

SEQ ID NO: 1616112 - DNA, 17 bp, Homo sapiens
ggctgggggcaggaggg

SEQ ID NO: 1616113 - DNA, 23 bp, Homo sapiens
ggctggggtcctcctgtgctatt

SEQ ID NO: 1616114 - DNA, 14 bp, Homo sapiens
ggctgggtcaccag

SEQ ID NO: 1616115 - DNA, 18 bp, Homo sapiens
ggctgggtcagggccaga

SEQ ID NO: 1616116 - DNA, 19 bp, Homo sapiens
ggctgggtcagggccagac

SEQ ID NO: 1616117 - DNA, 13 bp, Homo sapiens
ggggatggatctt

SEQ ID NO: 1616118 - DNA, 15 bp, Homo sapiens
ggggatgtggagtga

SEQ ID NO: 1616119 - DNA, 19 bp, Homo sapiens
ggggcaagacagaaaagtg

SEQ ID NO: 1616120 - DNA, 22 bp, Homo sapiens
ggggcaagacagaaaagtgcct

SEQ ID NO: 1616121 - DNA, 14 bp, Homo sapiens
ggggcaaggtctcc

SEQ ID NO: 1616122 - DNA, 18 bp, Homo sapiens
ggggcacaccactgccct

SEQ ID NO: 1616123 - DNA, 22 bp, Homo sapiens
ggggcacaccactgccctgcct

SEQ ID NO: 1616124 - DNA, 15 bp, Homo sapiens
ggggcagcaggagga

SEQ ID NO: 1616125 - DNA, 21 bp, Homo sapiens
ggggcagccaaacccatgagg

SEQ ID NO: 1616126 - DNA, 15 bp, Homo sapiens
ggggcagcccttgct

SEQ ID NO: 1616127 - DNA, 19 bp, Homo sapiens
ggggcagccgctaggagag

SEQ ID NO: 1616128 - DNA, 13 bp, Homo sapiens
ggggcaggagtgc

SEQ ID NO: 1616129 - DNA, 16 bp, Homo sapiens
ggggcaggagtgccag

SEQ ID NO: 1616130 - DNA, 23 bp, Homo sapiens
ggggcaggagtgccaggaccagc

SEQ ID NO: 1616131 - DNA, 12 bp, Homo sapiens
ggggcaggcctg

SEQ ID NO: 1616132 - DNA, 16 bp, Homo sapiens
ggggcaggcctgggac

SEQ ID NO: 1616133 - DNA, 18 bp, Homo sapiens
ggggcagggaaggacagg

SEQ ID NO: 1616134 - DNA, 13 bp, Homo sapiens
ggggcagggcctg

SEQ ID NO: 1616135 - DNA, 23 bp, Homo sapiens
ggggttcagcccctcctctgcca

SEQ ID NO: 1616136 - DNA, 19 bp, Homo sapiens
ggggttggctgttccagac

SEQ ID NO: 1616137 - DNA, 16 bp, Homo sapiens
ggggttggtcaaggcc

SEQ ID NO: 1616138 - DNA, 15 bp, Homo sapiens
gggtaaaaagtggct

SEQ ID NO: 1616139 - DNA, 16 bp, Homo sapiens
gggtaaaaagtggctg

SEQ ID NO: 1616140 - DNA, 12 bp, Homo sapiens
gggtaagacaat

SEQ ID NO: 1616141 - DNA, 14 bp, Homo sapiens
gggtaagaggagca

SEQ ID NO: 1616142 - DNA, 18 bp, Homo sapiens
gggtaattgtacaataaa

SEQ ID NO: 1616143 - DNA, 12 bp, Homo sapiens
gggtacaggcag

SEQ ID NO: 1616144 - DNA, 17 bp, Homo sapiens
gggtacctgcaagcaga

SEQ ID NO: 1616145 - DNA, 20 bp, Homo sapiens
gggtagaatgattaatcaaa

SEQ ID NO: 1616146 - DNA, 17 bp, Homo sapiens
gggtagacttggagctg

SEQ ID NO: 1616147 - DNA, 22 bp, Homo sapiens
gggtagcagctggactacccac

SEQ ID NO: 1616148 - DNA, 19 bp, Homo sapiens
gggtaggagggtgggaagg

SEQ ID NO: 1616149 - DNA, 16 bp, Homo sapiens
gggtaggcgggaagga

SEQ ID NO: 1616150 - DNA, 15 bp, Homo sapiens
gggtagggtaaatca

SEQ ID NO: 1616151 - DNA, 19 bp, Homo sapiens
gggtatccaagttggactg

SEQ ID NO: 1616152 - DNA, 21 bp, Homo sapiens
gggtatccaagttggactggg

SEQ ID NO: 1616153 - DNA, 18 bp, Homo sapiens
gggtatcccctgcctcct

SEQ ID NO: 1616154 - DNA, 23 bp, Homo sapiens
gggtcagagaaaatgagaaagga

SEQ ID NO: 1616155 - DNA, 14 bp, Homo sapiens
gggtcatcagggag

SEQ ID NO: 1616156 - DNA, 22 bp, Homo sapiens
gggtcatgacaagatgggacag

SEQ ID NO: 1616157 - DNA, 18 bp, Homo sapiens
gggtcattcatggcctgg

SEQ ID NO: 1616158 - DNA, 13 bp, Homo sapiens
gggtccacagctg

SEQ ID NO: 1616159 - DNA, 11 bp, Homo sapiens
gggtccaggaa

SEQ ID NO: 1616160 - DNA, 16 bp, Homo sapiens
gggtcccagtgggagg

SEQ ID NO: 1616161 - DNA, 22 bp, Homo sapiens
gggtcccagtgggaggggcagg

SEQ ID NO: 1616162 - DNA, 18 bp, Homo sapiens
gggtcccccctgagtggg

SEQ ID NO: 1616163 - DNA, 15 bp, Homo sapiens
gggtcccggccgcgc

SEQ ID NO: 1616164 - DNA, 21 bp, Homo sapiens
gggtcccggccgcgccgccgc

SEQ ID NO: 1616165 - DNA, 19 bp, Homo sapiens
gggtccgcaccagctgctc

SEQ ID NO: 1616166 - DNA, 23 bp, Homo sapiens
gggtccgcaccagctgctctgcc

SEQ ID NO: 1616167 - DNA, 15 bp, Homo sapiens
gggtccgcatccctg

SEQ ID NO: 1616168 - DNA, 18 bp, Homo sapiens
gggtcctctctgagtcaa

SEQ ID NO: 1616169 - DNA, 21 bp, Homo sapiens
gggtcctgaggcctgcagcac

SEQ ID NO: 1616170 - DNA, 13 bp, Homo sapiens
gggtcctgcaatt

SEQ ID NO: 1616171 - DNA, 13 bp, Homo sapiens
gggtcctggctcc

SEQ ID NO: 1616172 - DNA, 13 bp, Homo sapiens
gggtcctgggcag

SEQ ID NO: 1616173 - DNA, 13 bp, Homo sapiens
gggtcctgtgcct

SEQ ID NO: 1616174 - DNA, 16 bp, Homo sapiens
gggtccttgatgccag

SEQ ID NO: 1616175 - DNA, 18 bp, Homo sapiens
gggtccttgatgccagag

SEQ ID NO: 1616176 - DNA, 22 bp, Homo sapiens
gggtccttttgacactgctcta

SEQ ID NO: 1616177 - DNA, 14 bp, Homo sapiens
gggtcgaaagctct

SEQ ID NO: 1616178 - DNA, 16 bp, Homo sapiens
gggtctccctctcctg

SEQ ID NO: 1616179 - DNA, 18 bp, Homo sapiens
gggtctccctctcctgcc

SEQ ID NO: 1616180 - DNA, 14 bp, Homo sapiens
gggtctccctggct

SEQ ID NO: 1616181 - DNA, 16 bp, Homo sapiens
gggtctccctggctcc

SEQ ID NO: 1616182 - DNA, 21 bp, Homo sapiens
gggtctccctggctccctcct

SEQ ID NO: 1616183 - DNA, 13 bp, Homo sapiens
gggtctccttggc

SEQ ID NO: 1616184 - DNA, 17 bp, Homo sapiens
gggtctcgaactcctgg

SEQ ID NO: 1616185 - DNA, 21 bp, Homo sapiens
gggtctctcactgttgcagtg

SEQ ID NO: 1616186 - DNA, 18 bp, Homo sapiens
gggtctctctccaggtca

SEQ ID NO: 1616187 - DNA, 13 bp, Homo sapiens
gggtctgacctgg

SEQ ID NO: 1616188 - DNA, 15 bp, Homo sapiens
gggtctgagactgaa

SEQ ID NO: 1616189 - DNA, 14 bp, Homo sapiens
gggtctgattttct

SEQ ID NO: 1616190 - DNA, 17 bp, Homo sapiens
gggtctgattttctcac

SEQ ID NO: 1616191 - DNA, 20 bp, Homo sapiens
gggtctgctctttctctgcc

SEQ ID NO: 1616192 - DNA, 19 bp, Homo sapiens
gggtctgggatctgttttc

SEQ ID NO: 1616193 - DNA, 14 bp, Homo sapiens
gggtctgtgactgg

SEQ ID NO: 1616194 - DNA, 17 bp, Homo sapiens
gggtctgtgactggatc

SEQ ID NO: 1616195 - DNA, 18 bp, Homo sapiens
gggtctgtgactggatct

SEQ ID NO: 1616196 - DNA, 19 bp, Homo sapiens
gggtctgtgactggatctt

SEQ ID NO: 1616197 - DNA, 20 bp, Homo sapiens
gggtctgtgactggatcttc

SEQ ID NO: 1616198 - DNA, 15 bp, Homo sapiens
gggtctgtgctgtgc

SEQ ID NO: 1616199 - DNA, 19 bp, Homo sapiens
gggtcttgattcagtcaca

SEQ ID NO: 1616200 - DNA, 20 bp, Homo sapiens
gggtcttgccatgtgctggg

SEQ ID NO: 1616201 - DNA, 14 bp, Homo sapiens
gggtctttcttggg

SEQ ID NO: 1616202 - DNA, 19 bp, Homo sapiens
gggtctttcttgggatagt

SEQ ID NO: 1616203 - DNA, 13 bp, Homo sapiens
gggtgaagggaga

SEQ ID NO: 1616204 - DNA, 17 bp, Homo sapiens
gggtgacagctccggga

SEQ ID NO: 1616205 - DNA, 11 bp, Homo sapiens
gggtgaccagg

SEQ ID NO: 1616206 - DNA, 13 bp, Homo sapiens
gggtgactggaag

SEQ ID NO: 1616207 - DNA, 12 bp, Homo sapiens
gggtgagagagg

SEQ ID NO: 1616208 - DNA, 11 bp, Homo sapiens
gggtgagccag

SEQ ID NO: 1616209 - DNA, 18 bp, Homo sapiens
gggtgaggaccactcctg

SEQ ID NO: 1616210 - DNA, 14 bp, Homo sapiens
gggtgaggagctgg

SEQ ID NO: 1616211 - DNA, 14 bp, Homo sapiens
gggtgaggataaca

SEQ ID NO: 1616212 - DNA, 17 bp, Homo sapiens
gggtgagggtcccatgt

SEQ ID NO: 1616213 - DNA, 19 bp, Homo sapiens
gggtgagtccattctccca

SEQ ID NO: 1616214 - DNA, 21 bp, Homo sapiens
gggtgagtcccctactccctc

SEQ ID NO: 1616215 - DNA, 13 bp, Homo sapiens
gggtgattcctaa

SEQ ID NO: 1616216 - DNA, 23 bp, Homo sapiens
gggtgattttatgatcagtgttg

SEQ ID NO: 1616217 - DNA, 19 bp, Homo sapiens
gggtgcaggcagccttgac

SEQ ID NO: 1616218 - DNA, 12 bp, Homo sapiens
gggtgccccctc

SEQ ID NO: 1616219 - DNA, 15 bp, Homo sapiens
gggtgccccctcctc

SEQ ID NO: 1616220 - DNA, 13 bp, Homo sapiens
gggtgccctctcc

SEQ ID NO: 1616221 - DNA, 12 bp, Homo sapiens
gggtgccctgaa

SEQ ID NO: 1616222 - DNA, 21 bp, Homo sapiens
gggtgccgctgtctctgaggg

SEQ ID NO: 1616223 - DNA, 19 bp, Homo sapiens
gggtgcgctcacctgcagc

SEQ ID NO: 1616224 - DNA, 18 bp, Homo sapiens
gggtgctctctctgaggg

SEQ ID NO: 1616225 - DNA, 19 bp, Homo sapiens
gggtgctctgaggcctcac

SEQ ID NO: 1616226 - DNA, 20 bp, Homo sapiens
gggtgctgctaattctttgc

SEQ ID NO: 1616227 - DNA, 19 bp, Homo sapiens
gggtgctggctgcccagac

SEQ ID NO: 1616228 - DNA, 15 bp, Homo sapiens
gggtgctgggaggag

SEQ ID NO: 1616229 - DNA, 20 bp, Homo sapiens
gggtgcttttatagaggcta

SEQ ID NO: 1616230 - DNA, 23 bp, Homo sapiens
gggtggaccccctgagtcaactg

SEQ ID NO: 1616231 - DNA, 20 bp, Homo sapiens
gggtggacgcaattgtggga

SEQ ID NO: 1616232 - DNA, 22 bp, Homo sapiens
gggtggagactgcttcccatcc

SEQ ID NO: 1616233 - DNA, 23 bp, Homo sapiens
gggtggcactgggagggggtggg

SEQ ID NO: 1616234 - DNA, 18 bp, Homo sapiens
gggtggcaggtcactgtc

SEQ ID NO: 1616235 - DNA, 17 bp, Homo sapiens
gggtggccgctgagtgg

SEQ ID NO: 1616236 - DNA, 16 bp, Homo sapiens
gggtggccgggcacag

SEQ ID NO: 1616237 - DNA, 19 bp, Homo sapiens
gggtggcctgttccctaga

SEQ ID NO: 1616238 - DNA, 17 bp, Homo sapiens
ggtgttcctggaagcag

SEQ ID NO: 1616239 - DNA, 11 bp, Homo sapiens
ggtgttctaag

SEQ ID NO: 1616240 - DNA, 22 bp, Homo sapiens
ggtgttgccaaatatgtcctgg

SEQ ID NO: 1616241 - DNA, 14 bp, Homo sapiens
ggtgttgggagccc

SEQ ID NO: 1616242 - DNA, 17 bp, Homo sapiens
ggttaaaaaacaaatgt

SEQ ID NO: 1616243 - DNA, 21 bp, Homo sapiens
ggttaaaactgtacatttaaa

SEQ ID NO: 1616244 - DNA, 22 bp, Homo sapiens
ggttaaaactgtacatttaaaa

SEQ ID NO: 1616245 - DNA, 13 bp, Homo sapiens
ggttaaatatttt

SEQ ID NO: 1616246 - DNA, 12 bp, Homo sapiens
ggttaacaaatg

SEQ ID NO: 1616247 - DNA, 14 bp, Homo sapiens
ggttaacaaatgag

SEQ ID NO: 1616248 - DNA, 17 bp, Homo sapiens
ggttaagaaagcactta

SEQ ID NO: 1616249 - DNA, 13 bp, Homo sapiens
ggttaaggcctga

SEQ ID NO: 1616250 - DNA, 22 bp, Homo sapiens
ggttaagtttctcttcacccct

SEQ ID NO: 1616251 - DNA, 15 bp, Homo sapiens
ggttaataccagctt

SEQ ID NO: 1616252 - DNA, 15 bp, Homo sapiens
ggttaatttttcctg

SEQ ID NO: 1616253 - DNA, 19 bp, Homo sapiens
ggttaatttttcctgcatg

SEQ ID NO: 1616254 - DNA, 20 bp, Homo sapiens
ggttaatttttcctgcatgt

SEQ ID NO: 1616255 - DNA, 19 bp, Homo sapiens
ggttactgggagtgtgggc

SEQ ID NO: 1616256 - DNA, 17 bp, Homo sapiens
ggttacttcttctctta

SEQ ID NO: 1616257 - DNA, 18 bp, Homo sapiens
ggttagatgttgccatgt

SEQ ID NO: 1616258 - DNA, 18 bp, Homo sapiens
ggttagattcaaggcccc

SEQ ID NO: 1616259 - DNA, 15 bp, Homo sapiens
ggttagggaggggta

SEQ ID NO: 1616260 - DNA, 23 bp, Homo sapiens
ggttatagacagtcgttcccagt

SEQ ID NO: 1616261 - DNA, 18 bp, Homo sapiens
ggttatcaaaaatttcat

SEQ ID NO: 1616262 - DNA, 21 bp, Homo sapiens
ggttatctgcctggcctggct

SEQ ID NO: 1616263 - DNA, 20 bp, Homo sapiens
ggttatgttcccagcagtgg

SEQ ID NO: 1616264 - DNA, 20 bp, Homo sapiens
ggttatttagggaactgctt

SEQ ID NO: 1616265 - DNA, 14 bp, Homo sapiens
ggttattttgcttt

SEQ ID NO: 1616266 - DNA, 19 bp, Homo sapiens
ggttatttttattaaatgt

SEQ ID NO: 1616267 - DNA, 21 bp, Homo sapiens
ggttatttttattaaatgtat

SEQ ID NO: 1616268 - DNA, 15 bp, Homo sapiens
ggttatttttctctt

SEQ ID NO: 1616269 - DNA, 13 bp, Homo sapiens
ggttcaagcccag

SEQ ID NO: 1616270 - DNA, 22 bp, Homo sapiens
ggttcaagcccaggcttcctgg

SEQ ID NO: 1616271 - DNA, 22 bp, Homo sapiens
ggttcacgcctgtaatcccagc

SEQ ID NO: 1616272 - DNA, 23 bp, Homo sapiens
ggttcacgtacaaaactctgtat

SEQ ID NO: 1616273 - DNA, 21 bp, Homo sapiens
ggttcacttgccatgcaggaa

SEQ ID NO: 1616274 - DNA, 19 bp, Homo sapiens
ggttcagaattaaactttt

SEQ ID NO: 1616275 - DNA, 18 bp, Homo sapiens
ggttcagacccctgcctg

SEQ ID NO: 1616276 - DNA, 19 bp, Homo sapiens
ggttcagcccctcctctgc

SEQ ID NO: 1616277 - DNA, 12 bp, Homo sapiens
ggttcaggcccg

SEQ ID NO: 1616278 - DNA, 21 bp, Homo sapiens
ggttcataggtcactggctct

SEQ ID NO: 1616279 - DNA, 13 bp, Homo sapiens
ggttcatatttat

SEQ ID NO: 1616280 - DNA, 18 bp, Homo sapiens
ggttccatccaccacctt

SEQ ID NO: 1616281 - DNA, 15 bp, Homo sapiens
ggttccatgcctgag

SEQ ID NO: 1616282 - DNA, 19 bp, Homo sapiens
ggttccatttttcctctgt

SEQ ID NO: 1616283 - DNA, 20 bp, Homo sapiens
ggttccatttttcctctgtt

SEQ ID NO: 1616284 - DNA, 14 bp, Homo sapiens
ggttcccaataaaa

SEQ ID NO: 1616285 - DNA, 16 bp, Homo sapiens
ggttcccaataaaagt

SEQ ID NO: 1616286 - DNA, 20 bp, Homo sapiens
ggttcccaataaaagtgact

SEQ ID NO: 1616287 - DNA, 17 bp, Homo sapiens
ggttcccaccattccct

SEQ ID NO: 1616288 - DNA, 19 bp, Homo sapiens
ggttccccaagggccctgg

SEQ ID NO: 1616289 - DNA, 18 bp, Homo sapiens
ggttccccacacagggca

SEQ ID NO: 1616290 - DNA, 19 bp, Homo sapiens
ggttccccacacagggcac

SEQ ID NO: 1616291 - DNA, 14 bp, Homo sapiens
ggttcccctggcct

SEQ ID NO: 1616292 - DNA, 15 bp, Homo sapiens
ggttcccctggcctt

SEQ ID NO: 1616293 - DNA, 15 bp, Homo sapiens
ggttcctctgcctgc

SEQ ID NO: 1616294 - DNA, 15 bp, Homo sapiens
ggttcctgctgtcct

SEQ ID NO: 1616295 - DNA, 17 bp, Homo sapiens
ggttcgagactccatct

SEQ ID NO: 1616296 - DNA, 15 bp, Homo sapiens
ggttcgtgctgtgct

SEQ ID NO: 1616297 - DNA, 19 bp, Homo sapiens
ggttcgtgctgtgctctgg

SEQ ID NO: 1616298 - DNA, 11 bp, Homo sapiens
ggttctaaagt

SEQ ID NO: 1616299 - DNA, 13 bp, Homo sapiens
ggttctaaagttc

SEQ ID NO: 1616300 - DNA, 20 bp, Homo sapiens
ggttctagcatggcatattt

SEQ ID NO: 1616301 - DNA, 21 bp, Homo sapiens
ggttctaggcatctctgtact

SEQ ID NO: 1616302 - DNA, 15 bp, Homo sapiens
ggttctcagacctcc

SEQ ID NO: 1616303 - DNA, 12 bp, Homo sapiens
ggttctcatctt

SEQ ID NO: 1616304 - DNA, 22 bp, Homo sapiens
ggttctcattaggttttgcttg

SEQ ID NO: 1616305 - DNA, 18 bp, Homo sapiens
ggttctccccctttctct

SEQ ID NO: 1616306 - DNA, 17 bp, Homo sapiens
ggttctctccaggaagg

SEQ ID NO: 1616307 - DNA, 18 bp, Homo sapiens
ggttctgccctgcctgag

SEQ ID NO: 1616308 - DNA, 19 bp, Homo sapiens
ggttctgccctgcctgagg

SEQ ID NO: 1616309 - DNA, 23 bp, Homo sapiens
ggttctgccctgcctgaggagga

SEQ ID NO: 1616310 - DNA, 20 bp, Homo sapiens
ggttctgcctgccagctgca

SEQ ID NO: 1616311 - DNA, 23 bp, Homo sapiens
ggttctgcctttagcctggacca

SEQ ID NO: 1616312 - DNA, 19 bp, Homo sapiens
ggttctgcttcaaggcttc

SEQ ID NO: 1616313 - DNA, 13 bp, Homo sapiens
ggttctggctgtt

SEQ ID NO: 1616314 - DNA, 23 bp, Homo sapiens
ggttctggttccatttttcctct

SEQ ID NO: 1616315 - DNA, 19 bp, Homo sapiens
ggttctgtgacccatctgt

SEQ ID NO: 1616316 - DNA, 17 bp, Homo sapiens
ggttcttaaaaaggaac

SEQ ID NO: 1616317 - DNA, 12 bp, Homo sapiens
ggttcttcttat

SEQ ID NO: 1616318 - DNA, 15 bp, Homo sapiens
ggttgaaagacatca

SEQ ID NO: 1616319 - DNA, 20 bp, Homo sapiens
ggttgaagacggaaaacaat

SEQ ID NO: 1616320 - DNA, 21 bp, Homo sapiens
ggttgaaggcagtctgaaccc

SEQ ID NO: 1616321 - DNA, 19 bp, Homo sapiens
ggttgaatgaataaaacaa

SEQ ID NO: 1616322 - DNA, 16 bp, Homo sapiens
ggttgactttcaggta

SEQ ID NO: 1616323 - DNA, 13 bp, Homo sapiens
ggttgagaaatga

SEQ ID NO: 1616324 - DNA, 18 bp, Homo sapiens
ggttgaggggctcctgga

SEQ ID NO: 1616325 - DNA, 15 bp, Homo sapiens
ggttgagtgtgtggt

SEQ ID NO: 1616326 - DNA, 17 bp, Homo sapiens
ggttgcagctgctcttg

SEQ ID NO: 1616327 - DNA, 19 bp, Homo sapiens
ggttggcagagacactttg

SEQ ID NO: 1616328 - DNA, 19 bp, Homo sapiens
ggttgggggacagccttca

SEQ ID NO: 1616329 - DNA, 16 bp, Homo sapiens
ggttgggggctcctgt

SEQ ID NO: 1616330 - DNA, 20 bp, Homo sapiens
ggttggtcaaggccacctct

SEQ ID NO: 1616331 - DNA, 23 bp, Homo sapiens
ggttggtcaaggccacctctgcc

SEQ ID NO: 1616332 - DNA, 14 bp, Homo sapiens
ggttggtgcacagt

SEQ ID NO: 1616333 - DNA, 16 bp, Homo sapiens
ggttggtgcacagtga

SEQ ID NO: 1616334 - DNA, 23 bp, Homo sapiens
ggttgtacgttttgcacattttg

SEQ ID NO: 1616335 - DNA, 14 bp, Homo sapiens
ggttgtgcagggtg

SEQ ID NO: 1616336 - DNA, 22 bp, Homo sapiens
ggttgtgtttctcgtgctgcat

SEQ ID NO: 1616337 - DNA, 22 bp, Homo sapiens
ggttgttaggcttttctgcctg

SEQ ID NO: 1616338 - DNA, 13 bp, Homo sapiens
ggttgttatgtga

SEQ ID NO: 1616339 - DNA, 16 bp, Homo sapiens
ggttgttcctgcatcc

SEQ ID NO: 1616340 - DNA, 23 bp, Homo sapiens
ggttgttgccaggttgcagctgc

SEQ ID NO: 1616341 - DNA, 15 bp, Homo sapiens
ggttgttggtctgtg

SEQ ID NO: 1616342 - DNA, 17 bp, Homo sapiens
ggttgttttctactttg

SEQ ID NO: 1616343 - DNA, 15 bp, Homo sapiens
ggtttaaagagtcta

SEQ ID NO: 1616344 - DNA, 17 bp, Homo sapiens
ggtttaagaaatagaat

SEQ ID NO: 1616345 - DNA, 21 bp, Homo sapiens
ggtttacactgcggaagccaa

SEQ ID NO: 1616346 - DNA, 18 bp, Homo sapiens
ggtttagctttggaaagt

SEQ ID NO: 1616347 - DNA, 22 bp, Homo sapiens
ggtttattcccaagtatgcctt

SEQ ID NO: 1616348 - DNA, 20 bp, Homo sapiens
ggtttattttcagtcccctc

SEQ ID NO: 1616349 - DNA, 15 bp, Homo sapiens
ggtttcatgttctgt

SEQ ID NO: 1616350 - DNA, 14 bp, Homo sapiens
ggtttcctctggat

SEQ ID NO: 1616351 - DNA, 15 bp, Homo sapiens
ggtttccttttggaa

SEQ ID NO: 1616352 - DNA, 18 bp, Homo sapiens
ggtttccttttggaacat

SEQ ID NO: 1616353 - DNA, 14 bp, Homo sapiens
ggtttcgactggtc

SEQ ID NO: 1616354 - DNA, 19 bp, Homo sapiens
gtaaataaaatgtgtacag

SEQ ID NO: 1616355 - DNA, 20 bp, Homo sapiens
gtaaataaaatgtgtacagt

SEQ ID NO: 1616356 - DNA, 23 bp, Homo sapiens
gtaaataaaatgtgtacagtgaa

SEQ ID NO: 1616357 - DNA, 14 bp, Homo sapiens
gtaaataaaccact

SEQ ID NO: 1616358 - DNA, 21 bp, Homo sapiens
gtaaataaactatttatatca

SEQ ID NO: 1616359 - DNA, 23 bp, Homo sapiens
gtaaataaactatttatatcaca

SEQ ID NO: 1616360 - DNA, 17 bp, Homo sapiens
gtaaataaagtctattt

SEQ ID NO: 1616361 - DNA, 22 bp, Homo sapiens
gtaaatacaacacatctaatta

SEQ ID NO: 1616362 - DNA, 18 bp, Homo sapiens
gtaaatacaatttgtact

SEQ ID NO: 1616363 - DNA, 19 bp, Homo sapiens
gtaaatacacaacacacac

SEQ ID NO: 1616364 - DNA, 12 bp, Homo sapiens
gtaaatacacca

SEQ ID NO: 1616365 - DNA, 15 bp, Homo sapiens
gtaaatactggactc

SEQ ID NO: 1616366 - DNA, 23 bp, Homo sapiens
gtaaatactggactcaggaactt

SEQ ID NO: 1616367 - DNA, 18 bp, Homo sapiens
gtaaatactgtgaaatac

SEQ ID NO: 1616368 - DNA, 17 bp, Homo sapiens
gtaaataggaatcattc

SEQ ID NO: 1616369 - DNA, 21 bp, Homo sapiens
gtaaataggaatcattcagaa

SEQ ID NO: 1616370 - DNA, 17 bp, Homo sapiens
gtaaatagtatttgaga

SEQ ID NO: 1616371 - DNA, 22 bp, Homo sapiens
gtaaatagtttgaattcagtaa

SEQ ID NO: 1616372 - DNA, 22 bp, Homo sapiens
gtaaatattctacacatgtaaa

SEQ ID NO: 1616373 - DNA, 11 bp, Homo sapiens
gtaaatattta

SEQ ID NO: 1616374 - DNA, 18 bp, Homo sapiens
gtaaatcaattacagatt

SEQ ID NO: 1616375 - DNA, 15 bp, Homo sapiens
gtaaatcagaaagta

SEQ ID NO: 1616376 - DNA, 19 bp, Homo sapiens
gtaaatcctgagctcaaat

SEQ ID NO: 1616377 - DNA, 20 bp, Homo sapiens
gtaaatcctgccatttaaaa

SEQ ID NO: 1616378 - DNA, 17 bp, Homo sapiens
gtaaatctttttgcttc

SEQ ID NO: 1616379 - DNA, 17 bp, Homo sapiens
ggtggatgacagggcag

SEQ ID NO: 1616380 - DNA, 22 bp, Homo sapiens
ggtggatggccccagcacagct

SEQ ID NO: 1616381 - DNA, 18 bp, Homo sapiens
ggtggatgttatgaacag

SEQ ID NO: 1616382 - DNA, 21 bp, Homo sapiens
ggtggatgttatgaacagctg

SEQ ID NO: 1616383 - DNA, 20 bp, Homo sapiens
ggtggcactgggagggggtg

SEQ ID NO: 1616384 - DNA, 18 bp, Homo sapiens
ggtggcagccctgtaggg

SEQ ID NO: 1616385 - DNA, 19 bp, Homo sapiens
ggtggcaggcgcctataat

SEQ ID NO: 1616386 - DNA, 18 bp, Homo sapiens
ggtggcagtggaggtggg

SEQ ID NO: 1616387 - DNA, 16 bp, Homo sapiens
ggtggcatgcatggag

SEQ ID NO: 1616388 - DNA, 20 bp, Homo sapiens
ggtggccacagcaggactga

SEQ ID NO: 1616389 - DNA, 17 bp, Homo sapiens
ggtggccagaggtgtca

SEQ ID NO: 1616390 - DNA, 14 bp, Homo sapiens
ggtggcccctgcct

SEQ ID NO: 1616391 - DNA, 18 bp, Homo sapiens
ggtggcccgacagcctgg

SEQ ID NO: 1616392 - DNA, 23 bp, Homo sapiens
ggtggccgcccacccgcccgagg

SEQ ID NO: 1616393 - DNA, 14 bp, Homo sapiens
ggtggccgcccctg

SEQ ID NO: 1616394 - DNA, 22 bp, Homo sapiens
ggtggccggcttgctgctccgg

SEQ ID NO: 1616395 - DNA, 17 bp, Homo sapiens
ggtggcgctttctcctg

SEQ ID NO: 1616396 - DNA, 16 bp, Homo sapiens
ggtggctagtcagaga

SEQ ID NO: 1616397 - DNA, 13 bp, Homo sapiens
ggtggctgaccca

SEQ ID NO: 1616398 - DNA, 18 bp, Homo sapiens
ggtggctgacccagtccc

SEQ ID NO: 1616399 - DNA, 19 bp, Homo sapiens
ggtggctgacccagtccct

SEQ ID NO: 1616400 - DNA, 16 bp, Homo sapiens
ggtggctgccccggcc

SEQ ID NO: 1616401 - DNA, 23 bp, Homo sapiens
ggtgggaaggggagcacaatttc

SEQ ID NO: 1616402 - DNA, 12 bp, Homo sapiens
ggtgggaatcag

SEQ ID NO: 1616403 - DNA, 20 bp, Homo sapiens
ggtgggagaattgcttgagc

SEQ ID NO: 1616404 - DNA, 16 bp, Homo sapiens
ggtgggaggaaagggc

SEQ ID NO: 1616405 - DNA, 16 bp, Homo sapiens
ggtgggatggaggaga

SEQ ID NO: 1616406 - DNA, 17 bp, Homo sapiens
ggtgggatttgtaaagc

SEQ ID NO: 1616407 - DNA, 20 bp, Homo sapiens
ggtgggcagatcacgaggtc

SEQ ID NO: 1616408 - DNA, 12 bp, Homo sapiens
ggtgggcagctg

SEQ ID NO: 1616409 - DNA, 12 bp, Homo sapiens
ggtgggccagag

SEQ ID NO: 1616410 - DNA, 21 bp, Homo sapiens
ggtgggcccagaccactgtct

SEQ ID NO: 1616411 - DNA, 20 bp, Homo sapiens
ggtgggcccaggaccagctg

SEQ ID NO: 1616412 - DNA, 12 bp, Homo sapiens
ggtgggcctggc

SEQ ID NO: 1616413 - DNA, 15 bp, Homo sapiens
ggtgggcctggcctg

SEQ ID NO: 1616414 - DNA, 16 bp, Homo sapiens
ggtgggcctggcctga

SEQ ID NO: 1616415 - DNA, 19 bp, Homo sapiens
ggtgggcctggcctgagct

SEQ ID NO: 1616416 - DNA, 13 bp, Homo sapiens
ggtgggctctgtg

SEQ ID NO: 1616417 - DNA, 13 bp, Homo sapiens
ggtgggctgagcc

SEQ ID NO: 1616418 - DNA, 18 bp, Homo sapiens
ggtgggctgagccctggc

SEQ ID NO: 1616419 - DNA, 14 bp, Homo sapiens
ggtgggctggactt

SEQ ID NO: 1616420 - DNA, 22 bp, Homo sapiens
ggtgggctgtcactgcttgagg

SEQ ID NO: 1616421 - DNA, 23 bp, Homo sapiens
ggtggggacattgctctctgggc

SEQ ID NO: 1616422 - DNA, 19 bp, Homo sapiens
ggtggggaggcccaaatga

SEQ ID NO: 1616423 - DNA, 11 bp, Homo sapiens
ggtggggaggg

SEQ ID NO: 1616424 - DNA, 12 bp, Homo sapiens
ggtggggagggg

SEQ ID NO: 1616425 - DNA, 14 bp, Homo sapiens
ggtggggaggggcg

SEQ ID NO: 1616426 - DNA, 14 bp, Homo sapiens
ggtggggccctgcc

SEQ ID NO: 1616427 - DNA, 14 bp, Homo sapiens
ggtggggctgagcc

SEQ ID NO: 1616428 - DNA, 17 bp, Homo sapiens
ggtggggctgctcctcc

SEQ ID NO: 1616429 - DNA, 18 bp, Homo sapiens
ggtggggctgctcctcca

SEQ ID NO: 1616430 - DNA, 16 bp, Homo sapiens
ggtggggctgtcctgc

SEQ ID NO: 1616431 - DNA, 17 bp, Homo sapiens
ggtggggctgtcctgct

SEQ ID NO: 1616432 - DNA, 16 bp, Homo sapiens
ggtgggggctgtcctg

SEQ ID NO: 1616433 - DNA, 14 bp, Homo sapiens
ggtggggggtccag

SEQ ID NO: 1616434 - DNA, 18 bp, Homo sapiens
ggtggggggtccagtctg

SEQ ID NO: 1616435 - DNA, 21 bp, Homo sapiens
ggtggggggtccagtctgtga

SEQ ID NO: 1616436 - DNA, 22 bp, Homo sapiens
ggtgggggtgccgctctctctg

SEQ ID NO: 1616437 - DNA, 13 bp, Homo sapiens
ggtgggggtggga

SEQ ID NO: 1616438 - DNA, 14 bp, Homo sapiens
ggtggggtcctgga

SEQ ID NO: 1616439 - DNA, 15 bp, Homo sapiens
ggtggggtgcactcg

SEQ ID NO: 1616440 - DNA, 15 bp, Homo sapiens
ggtgggtcagcccag

SEQ ID NO: 1616441 - DNA, 17 bp, Homo sapiens
ggtgggtcagcccagca

SEQ ID NO: 1616442 - DNA, 19 bp, Homo sapiens
ggtgggtcagcccagcacc

SEQ ID NO: 1616443 - DNA, 20 bp, Homo sapiens
ggtgggtccaggaaggcagc

SEQ ID NO: 1616444 - DNA, 23 bp, Homo sapiens
ggtgggtccaggaaggcagctgc

SEQ ID NO: 1616445 - DNA, 14 bp, Homo sapiens
ggtgggtggtgggg

SEQ ID NO: 1616446 - DNA, 13 bp, Homo sapiens
ggtggtaaagaaa

SEQ ID NO: 1616447 - DNA, 12 bp, Homo sapiens
ggtggtaaattc

SEQ ID NO: 1616448 - DNA, 22 bp, Homo sapiens
ggtggtcctcctatctccctgg

SEQ ID NO: 1616449 - DNA, 16 bp, Homo sapiens
ggtggtctgttggcag

SEQ ID NO: 1616450 - DNA, 20 bp, Homo sapiens
ggtggtgctgggactgagcc

SEQ ID NO: 1616451 - DNA, 23 bp, Homo sapiens
ggtggtgctgggactgagccagt

SEQ ID NO: 1616452 - DNA, 14 bp, Homo sapiens
ggtggtggcctggt

SEQ ID NO: 1616453 - DNA, 13 bp, Homo sapiens
ggtggtggggagg

SEQ ID NO: 1616454 - DNA, 21 bp, Homo sapiens
ggtggtgtctccaacccccca

SEQ ID NO: 1616455 - DNA, 16 bp, Homo sapiens
ggtgtaacttcctgct

SEQ ID NO: 1616456 - DNA, 24 bp, Homo sapiens
ggtgtaacttcctgctgcaccctg

SEQ ID NO: 1616457 - DNA, 17 bp, Homo sapiens
ggtgtaggggccacctc

SEQ ID NO: 1616458 - DNA, 22 bp, Homo sapiens
ggtgtaggggccacctcctccc

SEQ ID NO: 1616459 - DNA, 21 bp, Homo sapiens
ggtgtatgccacacctggcct

SEQ ID NO: 1616460 - DNA, 16 bp, Homo sapiens
ggtgtatttaaactat

SEQ ID NO: 1616461 - DNA, 10 bp, Homo sapiens
ggtgtatttt

SEQ ID NO: 1616462 - DNA, 23 bp, Homo sapiens
ggtgtcacatggggcctggccca

SEQ ID NO: 1616463 - DNA, 24 bp, Homo sapiens
ggtgtcacccaaaccggcaggtgc

SEQ ID NO: 1616464 - DNA, 15 bp, Homo sapiens
ggtgtcatctgagga

SEQ ID NO: 1616465 - DNA, 23 bp, Homo sapiens
ggtgtccccaacgtcccctccgc

SEQ ID NO: 1616466 - DNA, 12 bp, Homo sapiens
ggtgtccctgcc

SEQ ID NO: 1616467 - DNA, 14 bp, Homo sapiens
ggtgtccctgcctt

SEQ ID NO: 1616468 - DNA, 15 bp, Homo sapiens
ggtgtccctgccttc

SEQ ID NO: 1616469 - DNA, 23 bp, Homo sapiens
ggtgtcctgaagctgctggagcc

SEQ ID NO: 1616470 - DNA, 13 bp, Homo sapiens
ggtgtcctgacca

SEQ ID NO: 1616471 - DNA, 20 bp, Homo sapiens
ggtgtcctgaccaccctccc

SEQ ID NO: 1616472 - DNA, 19 bp, Homo sapiens
ggtgtcctgcagaagaagc

SEQ ID NO: 1616473 - DNA, 20 bp, Homo sapiens
ggtgtcctgcctgtctgccc

SEQ ID NO: 1616474 - DNA, 22 bp, Homo sapiens
ggtgtcgaggccacattgctgg

SEQ ID NO: 1616475 - DNA, 22 bp, Homo sapiens
ggtgtcttttccactcctatgg

SEQ ID NO: 1616476 - DNA, 20 bp, Homo sapiens
ggtgtgaaagtcagatgccc

SEQ ID NO: 1616477 - DNA, 15 bp, Homo sapiens
ggtgtgaacatgttc

SEQ ID NO: 1616478 - DNA, 20 bp, Homo sapiens
ggtgtgaactcaccctggga

SEQ ID NO: 1616479 - DNA, 16 bp, Homo sapiens
ggtgtgcatgccacgc

SEQ ID NO: 1616480 - DNA, 15 bp, Homo sapiens
ggtgtgcctgcagcc

SEQ ID NO: 1616481 - DNA, 22 bp, Homo sapiens
ggtgtgcctgtgctcctgccca

SEQ ID NO: 1616482 - DNA, 15 bp, Homo sapiens
gtaaggttgtgcagg

SEQ ID NO: 1616483 - DNA, 13 bp, Homo sapiens
gtaagtacttcca

SEQ ID NO: 1616484 - DNA, 12 bp, Homo sapiens
gtaagtcatcta

SEQ ID NO: 1616485 - DNA, 21 bp, Homo sapiens
gtaagtgtgagtaagagctgg

SEQ ID NO: 1616486 - DNA, 22 bp, Homo sapiens
gtaagtgttctcatgaagcagg

SEQ ID NO: 1616487 - DNA, 14 bp, Homo sapiens
gtaagttcctacta

SEQ ID NO: 1616488 - DNA, 21 bp, Homo sapiens
gtaagttcctactaggcaaaa

SEQ ID NO: 1616489 - DNA, 12 bp, Homo sapiens
gtaagtttattt

SEQ ID NO: 1616490 - DNA, 12 bp, Homo sapiens
gtaataaagtat

SEQ ID NO: 1616491 - DNA, 14 bp, Homo sapiens
gtaataaagtatat

SEQ ID NO: 1616492 - DNA, 16 bp, Homo sapiens
gtaataactgtgaagt

SEQ ID NO: 1616493 - DNA, 22 bp, Homo sapiens
gtaataactgtgaagtttacat

SEQ ID NO: 1616494 - DNA, 12 bp, Homo sapiens
gtaataagaaag

SEQ ID NO: 1616495 - DNA, 19 bp, Homo sapiens
gtaataagggaaaaatcaa

SEQ ID NO: 1616496 - DNA, 19 bp, Homo sapiens
gtaatacgtagctctctta

SEQ ID NO: 1616497 - DNA, 22 bp, Homo sapiens
gtaatagcttctgtgtgtgagc

SEQ ID NO: 1616498 - DNA, 23 bp, Homo sapiens
gtaatagtaaaatgcttacagga

SEQ ID NO: 1616499 - DNA, 19 bp, Homo sapiens
gtaatataaagtattcaac

SEQ ID NO: 1616500 - DNA, 21 bp, Homo sapiens
gtaatataatacacaaaatca

SEQ ID NO: 1616501 - DNA, 15 bp, Homo sapiens
gtaatatacctggtt

SEQ ID NO: 1616502 - DNA, 19 bp, Homo sapiens
gtaatatatgatatttttc

SEQ ID NO: 1616503 - DNA, 12 bp, Homo sapiens
gtaatatattta

SEQ ID NO: 1616504 - DNA, 12 bp, Homo sapiens
gtaatatgtata

SEQ ID NO: 1616505 - DNA, 13 bp, Homo sapiens
gtaatatgtcttg

SEQ ID NO: 1616506 - DNA, 20 bp, Homo sapiens
gtaatattgtaaatactgga

SEQ ID NO: 1616507 - DNA, 21 bp, Homo sapiens
gtaatcaatacagacaaggtt

SEQ ID NO: 1616508 - DNA, 14 bp, Homo sapiens
gtaatcaatgtttc

SEQ ID NO: 1616509 - DNA, 11 bp, Homo sapiens
gtaatcaggca

SEQ ID NO: 1616510 - DNA, 16 bp, Homo sapiens
gtaatcatctaagtca

SEQ ID NO: 1616511 - DNA, 20 bp, Homo sapiens
gtaatcatttatcttatcta

SEQ ID NO: 1616512 - DNA, 24 bp, Homo sapiens
gtaatcatttatcttatctagcaa

SEQ ID NO: 1616513 - DNA, 16 bp, Homo sapiens
gtacatatgtaattct

SEQ ID NO: 1616514 - DNA, 13 bp, Homo sapiens
gtacatattgtta

SEQ ID NO: 1616515 - DNA, 23 bp, Homo sapiens
gtacatattgttagggtcagcca

SEQ ID NO: 1616516 - DNA, 22 bp, Homo sapiens
gtacatcaagtccatctgacaa

SEQ ID NO: 1616517 - DNA, 15 bp, Homo sapiens
gtacatcatgttatt

SEQ ID NO: 1616518 - DNA, 18 bp, Homo sapiens
gtacatctgcaatatgaa

SEQ ID NO: 1616519 - DNA, 22 bp, Homo sapiens
gtacatgtatgaaattggtttt

SEQ ID NO: 1616520 - DNA, 13 bp, Homo sapiens
gtacatgtattaa

SEQ ID NO: 1616521 - DNA, 19 bp, Homo sapiens
gtacatgtgtagcctgtgc

SEQ ID NO: 1616522 - DNA, 17 bp, Homo sapiens
gtacattctaaagagag

SEQ ID NO: 1616523 - DNA, 14 bp, Homo sapiens
gtacattctagctg

SEQ ID NO: 1616524 - DNA, 14 bp, Homo sapiens
gtacattctgccta

SEQ ID NO: 1616525 - DNA, 13 bp, Homo sapiens
gtacattgtaaaa

SEQ ID NO: 1616526 - DNA, 14 bp, Homo sapiens
gtacatttaaaatt

SEQ ID NO: 1616527 - DNA, 21 bp, Homo sapiens
gtacatttctataaatagatg

SEQ ID NO: 1616528 - DNA, 22 bp, Homo sapiens
gtacatttgggagtttttatga

SEQ ID NO: 1616529 - DNA, 14 bp, Homo sapiens
gtacattttttgaa

SEQ ID NO: 1616530 - DNA, 19 bp, Homo sapiens
gtaccaaaattttaaaaaa

SEQ ID NO: 1616531 - DNA, 20 bp, Homo sapiens
gtaccaaaattttaaaaaag

SEQ ID NO: 1616532 - DNA, 15 bp, Homo sapiens
gtaccaaacaaggaa

SEQ ID NO: 1616533 - DNA, 18 bp, Homo sapiens
gtaccaaacaaggaagcc

SEQ ID NO: 1616534 - DNA, 13 bp, Homo sapiens
gtaccaagtgaaa

SEQ ID NO: 1616535 - DNA, 21 bp, Homo sapiens
gtaccaatcattttaattatt

SEQ ID NO: 1616536 - DNA, 21 bp, Homo sapiens
gtaccaatgctgttgtaaaca

SEQ ID NO: 1616537 - DNA, 17 bp, Homo sapiens
gtaccacgtgggtcctc

SEQ ID NO: 1616538 - DNA, 16 bp, Homo sapiens
gtaccagctgcgcttg

SEQ ID NO: 1616539 - DNA, 23 bp, Homo sapiens
gtaccatctgtcttgccagccag

SEQ ID NO: 1616540 - DNA, 20 bp, Homo sapiens
gtaccatgaaacaaagctgc

SEQ ID NO: 1616541 - DNA, 15 bp, Homo sapiens
gtacccagccatctg

SEQ ID NO: 1616542 - DNA, 20 bp, Homo sapiens
gtacccagccatctgcccag

SEQ ID NO: 1616543 - DNA, 21 bp, Homo sapiens
gtacccagccatctgcccagg

SEQ ID NO: 1616544 - DNA, 12 bp, Homo sapiens
gtaccccaccct

SEQ ID NO: 1616545 - DNA, 19 bp, Homo sapiens
gtaccccaccctcagcacc

SEQ ID NO: 1616546 - DNA, 21 bp, Homo sapiens
gtacccctctcagtctgcagt

SEQ ID NO: 1616547 - DNA, 18 bp, Homo sapiens
gtaccctatagagagggg

SEQ ID NO: 1616548 - DNA, 23 bp, Homo sapiens
gtaccctgagcccaccagggaca

SEQ ID NO: 1616549 - DNA, 13 bp, Homo sapiens
gtaccctgggtgt

SEQ ID NO: 1616550 - DNA, 22 bp, Homo sapiens
gtaccctttaagatatccatct

SEQ ID NO: 1616551 - DNA, 14 bp, Homo sapiens
gtaccgatttctgc

SEQ ID NO: 1616552 - DNA, 15 bp, Homo sapiens
gtaccgatttctgct

SEQ ID NO: 1616553 - DNA, 19 bp, Homo sapiens
gtaccgccagcagctgtca

SEQ ID NO: 1616554 - DNA, 14 bp, Homo sapiens
gtacctatggctgc

SEQ ID NO: 1616555 - DNA, 16 bp, Homo sapiens
gtacctcaagccccat

SEQ ID NO: 1616556 - DNA, 17 bp, Homo sapiens
gtacctctagaatccca

SEQ ID NO: 1616557 - DNA, 12 bp, Homo sapiens
gtacctgaaaag

SEQ ID NO: 1616558 - DNA, 14 bp, Homo sapiens
gtacctgaaaagta

SEQ ID NO: 1616559 - DNA, 15 bp, Homo sapiens
gtacctgatgtacct

SEQ ID NO: 1616560 - DNA, 15 bp, Homo sapiens
gtacctgattgtatt

SEQ ID NO: 1616561 - DNA, 13 bp, Homo sapiens
gtacctgcaagca

SEQ ID NO: 1616562 - DNA, 12 bp, Homo sapiens
gtacctgctgcc

SEQ ID NO: 1616563 - DNA, 12 bp, Homo sapiens
gtacctgggaaa

SEQ ID NO: 1616564 - DNA, 19 bp, Homo sapiens
gtacctgtgggttagcatc

SEQ ID NO: 1616565 - DNA, 19 bp, Homo sapiens
gtacctgttccttagacct

SEQ ID NO: 1616566 - DNA, 15 bp, Homo sapiens
gtaccttaagatatt

SEQ ID NO: 1616567 - DNA, 14 bp, Homo sapiens
gtaccttgaacact

SEQ ID NO: 1616568 - DNA, 23 bp, Homo sapiens
gtaccttgcttcttactgataat

SEQ ID NO: 1616569 - DNA, 13 bp, Homo sapiens
gtacctttgtcac

SEQ ID NO: 1616570 - DNA, 15 bp, Homo sapiens
gtacgaagagtattt

SEQ ID NO: 1616571 - DNA, 22 bp, Homo sapiens
gtacgatcaagttgttgactgt

SEQ ID NO: 1616572 - DNA, 15 bp, Homo sapiens
gtacgcccaggacag

SEQ ID NO: 1616573 - DNA, 20 bp, Homo sapiens
gtacgcccaggacagctggt

SEQ ID NO: 1616574 - DNA, 24 bp, Homo sapiens
gtacgtcccgctgctgtgctctgg

SEQ ID NO: 1616575 - DNA, 12 bp, Homo sapiens
gtactaaaatta

SEQ ID NO: 1616576 - DNA, 21 bp, Homo sapiens
gtactactagatgtctttagg

SEQ ID NO: 1616577 - DNA, 21 bp, Homo sapiens
gtactaggttggacagccccc

SEQ ID NO: 1616578 - DNA, 17 bp, Homo sapiens
gtactagtgttctgttt

SEQ ID NO: 1616579 - DNA, 17 bp, Homo sapiens
gtactagttacacatct

SEQ ID NO: 1616580 - DNA, 13 bp, Homo sapiens
gtactatgtatca

SEQ ID NO: 1616581 - DNA, 16 bp, Homo sapiens
gtactatgttaataac

SEQ ID NO: 1616582 - DNA, 14 bp, Homo sapiens
gtactatttcttaa

SEQ ID NO: 1616583 - DNA, 22 bp, Homo sapiens
gtactcaatgtttctggacatt

SEQ ID NO: 1616584 - DNA, 13 bp, Homo sapiens
gtactcagagcag

SEQ ID NO: 1616585 - DNA, 17 bp, Homo sapiens
gtactcagagcagagca

SEQ ID NO: 1616586 - DNA, 23 bp, Homo sapiens
gtactcaggaggctgaggggagg

SEQ ID NO: 1616587 - DNA, 15 bp, Homo sapiens
gtagctccctcctcc

SEQ ID NO: 1616588 - DNA, 21 bp, Homo sapiens
gtagctcctataaagggccca

SEQ ID NO: 1616589 - DNA, 16 bp, Homo sapiens
gtagctgcaaaaataa

SEQ ID NO: 1616590 - DNA, 13 bp, Homo sapiens
gtagctgcagcct

SEQ ID NO: 1616591 - DNA, 13 bp, Homo sapiens
gtagctgctacct

SEQ ID NO: 1616592 - DNA, 16 bp, Homo sapiens
gtagctgtaagggcag

SEQ ID NO: 1616593 - DNA, 20 bp, Homo sapiens
gtagctgtaagggcagtgcc

SEQ ID NO: 1616594 - DNA, 12 bp, Homo sapiens
gtagctttgctc

SEQ ID NO: 1616595 - DNA, 18 bp, Homo sapiens
gtaggaacggtaaatttc

SEQ ID NO: 1616596 - DNA, 16 bp, Homo sapiens
gtaggaactgctgggc

SEQ ID NO: 1616597 - DNA, 13 bp, Homo sapiens
gtaggaagcaaca

SEQ ID NO: 1616598 - DNA, 22 bp, Homo sapiens
gtaggagacacgacagcacaca

SEQ ID NO: 1616599 - DNA, 14 bp, Homo sapiens
gtaggagctgcctt

SEQ ID NO: 1616600 - DNA, 23 bp, Homo sapiens
gtaggagctgccttggctcagac

SEQ ID NO: 1616601 - DNA, 16 bp, Homo sapiens
gtaggatcacctgagg

SEQ ID NO: 1616602 - DNA, 15 bp, Homo sapiens
gtaggcacagagctg

SEQ ID NO: 1616603 - DNA, 15 bp, Homo sapiens
gtaggcagaggctgc

SEQ ID NO: 1616604 - DNA, 12 bp, Homo sapiens
gtaggcagccac

SEQ ID NO: 1616605 - DNA, 13 bp, Homo sapiens
gtaggcagccacg

SEQ ID NO: 1616606 - DNA, 15 bp, Homo sapiens
gtaggcagccacggc

SEQ ID NO: 1616607 - DNA, 13 bp, Homo sapiens
gtaggcagcctct

SEQ ID NO: 1616608 - DNA, 17 bp, Homo sapiens
gtaggcatgagggatca

SEQ ID NO: 1616609 - DNA, 19 bp, Homo sapiens
gtaggccctggttcctgct

SEQ ID NO: 1616610 - DNA, 23 bp, Homo sapiens
gtaggcctataaaattaaatgcc

SEQ ID NO: 1616611 - DNA, 13 bp, Homo sapiens
gtaggctgtattt

SEQ ID NO: 1616612 - DNA, 17 bp, Homo sapiens
gtaggctgtattttctt

SEQ ID NO: 1616613 - DNA, 20 bp, Homo sapiens
gtagggaaaccttggagagg

SEQ ID NO: 1616614 - DNA, 16 bp, Homo sapiens
gtagggagagacacaa

SEQ ID NO: 1616615 - DNA, 13 bp, Homo sapiens
gtagggagggcgg

SEQ ID NO: 1616616 - DNA, 21 bp, Homo sapiens
gtagggagtacctgctgcccc

SEQ ID NO: 1616617 - DNA, 20 bp, Homo sapiens
gtagggatgcggatcctgct

SEQ ID NO: 1616618 - DNA, 13 bp, Homo sapiens
gtagggcctgcat

SEQ ID NO: 1616619 - DNA, 21 bp, Homo sapiens
gtagggcctgcatggagaagg

SEQ ID NO: 1616620 - DNA, 17 bp, Homo sapiens
gtaggggaacctaggag

SEQ ID NO: 1616621 - DNA, 18 bp, Homo sapiens
gtaggggagggcaggctt

SEQ ID NO: 1616622 - DNA, 13 bp, Homo sapiens
gtaggggcaggga

SEQ ID NO: 1616623 - DNA, 16 bp, Homo sapiens
gtaggggcagggaggc

SEQ ID NO: 1616624 - DNA, 15 bp, Homo sapiens
gtaggggccacctcc

SEQ ID NO: 1616625 - DNA, 18 bp, Homo sapiens
gtaggggccacctcctcc

SEQ ID NO: 1616626 - DNA, 20 bp, Homo sapiens
gtaggggccacctcctcccc

SEQ ID NO: 1616627 - DNA, 15 bp, Homo sapiens
gtaggggtgtgtgtg

SEQ ID NO: 1616628 - DNA, 17 bp, Homo sapiens
gtagggtaaggtgcctt

SEQ ID NO: 1616629 - DNA, 14 bp, Homo sapiens
gtagggtctttctt

SEQ ID NO: 1616630 - DNA, 19 bp, Homo sapiens
gtagggtggcactgggagg

SEQ ID NO: 1616631 - DNA, 15 bp, Homo sapiens
gtagggtgggagtgg

SEQ ID NO: 1616632 - DNA, 16 bp, Homo sapiens
gtagggttataataat

SEQ ID NO: 1616633 - DNA, 20 bp, Homo sapiens
gtaggtaaaagtagaagcat

SEQ ID NO: 1616634 - DNA, 16 bp, Homo sapiens
gtaggtccaagggcca

SEQ ID NO: 1616635 - DNA, 19 bp, Homo sapiens
gtaggtcccggccagctct

SEQ ID NO: 1616636 - DNA, 19 bp, Homo sapiens
gtacaatggtttattccca

SEQ ID NO: 1616637 - DNA, 21 bp, Homo sapiens
gtacaatggtttattcccaag

SEQ ID NO: 1616638 - DNA, 15 bp, Homo sapiens
gtacaattactaaat

SEQ ID NO: 1616639 - DNA, 14 bp, Homo sapiens
gtacaattcattgt

SEQ ID NO: 1616640 - DNA, 16 bp, Homo sapiens
gtacaattcattgttt

SEQ ID NO: 1616641 - DNA, 19 bp, Homo sapiens
gtacacacaaaaaccttgg

SEQ ID NO: 1616642 - DNA, 15 bp, Homo sapiens
gtacacagagaaggc

SEQ ID NO: 1616643 - DNA, 21 bp, Homo sapiens
gtacacagagaaggctatgta

SEQ ID NO: 1616644 - DNA, 14 bp, Homo sapiens
gtacacctgtgtgg

SEQ ID NO: 1616645 - DNA, 15 bp, Homo sapiens
gtacacgtgtcctgt

SEQ ID NO: 1616646 - DNA, 15 bp, Homo sapiens
gtacactgaatattt

SEQ ID NO: 1616647 - DNA, 14 bp, Homo sapiens
gtacagaaagctgc

SEQ ID NO: 1616648 - DNA, 14 bp, Homo sapiens
gtacagaatatttc

SEQ ID NO: 1616649 - DNA, 17 bp, Homo sapiens
gtacagaatatttctat

SEQ ID NO: 1616650 - DNA, 23 bp, Homo sapiens
gtacagaatgctatttcacttga

SEQ ID NO: 1616651 - DNA, 20 bp, Homo sapiens
gtacagaattctgctacctc

SEQ ID NO: 1616652 - DNA, 17 bp, Homo sapiens
gtacagaatttgaatta

SEQ ID NO: 1616653 - DNA, 18 bp, Homo sapiens
gtacagaatttgaattat

SEQ ID NO: 1616654 - DNA, 18 bp, Homo sapiens
gtacagactgttttactg

SEQ ID NO: 1616655 - DNA, 20 bp, Homo sapiens
gtacaggcagttaggtgctg

SEQ ID NO: 1616656 - DNA, 21 bp, Homo sapiens
gtacaggtcacccatcaggac

SEQ ID NO: 1616657 - DNA, 12 bp, Homo sapiens
gtacagtctgtc

SEQ ID NO: 1616658 - DNA, 22 bp, Homo sapiens
gtacagtgaattgtcttttaga

SEQ ID NO: 1616659 - DNA, 15 bp, Homo sapiens
gtacagtgaggaggg

SEQ ID NO: 1616660 - DNA, 18 bp, Homo sapiens
gtacagtgaggagggtgg

SEQ ID NO: 1616661 - DNA, 16 bp, Homo sapiens
gtacagtttctgcttg

SEQ ID NO: 1616662 - DNA, 12 bp, Homo sapiens
gtacataaaaga

SEQ ID NO: 1616663 - DNA, 14 bp, Homo sapiens
gtacataactgaaa

SEQ ID NO: 1616664 - DNA, 18 bp, Homo sapiens
gtacatagagcaatgttg

SEQ ID NO: 1616665 - DNA, 19 bp, Homo sapiens
gtacatagagcaatgttgg

SEQ ID NO: 1616666 - DNA, 12 bp, Homo sapiens
gtacatagtaaa

SEQ ID NO: 1616667 - DNA, 15 bp, Homo sapiens
gtacatagtaaagta

SEQ ID NO: 1616668 - DNA, 17 bp, Homo sapiens
gtacatagtaaagtatt

SEQ ID NO: 1616669 - DNA, 15 bp, Homo sapiens
gtacatatatgtata

SEQ ID NO: 1616670 - DNA, 19 bp, Homo sapiens
gtacatatatgtataatat

SEQ ID NO: 1616671 - DNA, 22 bp, Homo sapiens
gtacatatatgtataatatata

SEQ ID NO: 1616672 - DNA, 23 bp, Homo sapiens
gtacatatatgtataatatatat

SEQ ID NO: 1616673 - DNA, 22 bp, Homo sapiens
gtaggtcccggccagctctgga

SEQ ID NO: 1616674 - DNA, 21 bp, Homo sapiens
gtaggtgatgtttccagctgc

SEQ ID NO: 1616675 - DNA, 23 bp, Homo sapiens
gtaggtggaagctagacacatga

SEQ ID NO: 1616676 - DNA, 13 bp, Homo sapiens
gtaggttctgttt

SEQ ID NO: 1616677 - DNA, 23 bp, Homo sapiens
gtagtaaaagtggtctctgctgg

SEQ ID NO: 1616678 - DNA, 14 bp, Homo sapiens
gtagtaacactaat

SEQ ID NO: 1616679 - DNA, 16 bp, Homo sapiens
gtagtaatgtttttta

SEQ ID NO: 1616680 - DNA, 20 bp, Homo sapiens
gtagtactccttaagaacac

SEQ ID NO: 1616681 - DNA, 19 bp, Homo sapiens
gtagtctcactgcttgaac

SEQ ID NO: 1616682 - DNA, 21 bp, Homo sapiens
gtagtctttttataggtttta

SEQ ID NO: 1616683 - DNA, 18 bp, Homo sapiens
gtagtgcatttttaaact

SEQ ID NO: 1616684 - DNA, 15 bp, Homo sapiens
gtagtggaagagcag

SEQ ID NO: 1616685 - DNA, 20 bp, Homo sapiens
gtagtggaagagcagcctga

SEQ ID NO: 1616686 - DNA, 14 bp, Homo sapiens
gtagttaaataact

SEQ ID NO: 1616687 - DNA, 16 bp, Homo sapiens
gtagttctgtgcctcc

SEQ ID NO: 1616688 - DNA, 16 bp, Homo sapiens
gtagttgtctttcctg

SEQ ID NO: 1616689 - DNA, 17 bp, Homo sapiens
gtagtttagttctgttg

SEQ ID NO: 1616690 - DNA, 20 bp, Homo sapiens
gtagttttccctgcactgtg

SEQ ID NO: 1616691 - DNA, 23 bp, Homo sapiens
gtagttttttttttttttatgtg

SEQ ID NO: 1616692 - DNA, 17 bp, Homo sapiens
gtataaaaaattctcat

SEQ ID NO: 1616693 - DNA, 20 bp, Homo sapiens
gtataaaaattatcaaaaag

SEQ ID NO: 1616694 - DNA, 16 bp, Homo sapiens
gtataaaactttcctc

SEQ ID NO: 1616695 - DNA, 20 bp, Homo sapiens
gtataaaatacatagtgaaa

SEQ ID NO: 1616696 - DNA, 22 bp, Homo sapiens
gtataaaatacatagtgaaaat

SEQ ID NO: 1616697 - DNA, 16 bp, Homo sapiens
gtataaaatctgaatt

SEQ ID NO: 1616698 - DNA, 23 bp, Homo sapiens
gtataaaatctgaattttgcaat

SEQ ID NO: 1616699 - DNA, 14 bp, Homo sapiens
gtataaagaaaagt

SEQ ID NO: 1616700 - DNA, 12 bp, Homo sapiens
gtataaagaaca

SEQ ID NO: 1616701 - DNA, 21 bp, Homo sapiens
gtataacaagccaaacattct

SEQ ID NO: 1616702 - DNA, 14 bp, Homo sapiens
gtataagatcctag

SEQ ID NO: 1616703 - DNA, 21 bp, Homo sapiens
gtataagttatttttgtacat

SEQ ID NO: 1616704 - DNA, 23 bp, Homo sapiens
gtataagttatttttgtacatgt

SEQ ID NO: 1616705 - DNA, 13 bp, Homo sapiens
gtataataaaatt

SEQ ID NO: 1616706 - DNA, 14 bp, Homo sapiens
gtataatataaaaa

SEQ ID NO: 1616707 - DNA, 18 bp, Homo sapiens
gtataatgtttattaaat

SEQ ID NO: 1616708 - DNA, 22 bp, Homo sapiens
gtataattatggtgggtgatta

SEQ ID NO: 1616709 - DNA, 19 bp, Homo sapiens
gtataattggatttcctaa

SEQ ID NO: 1616710 - DNA, 21 bp, Homo sapiens
gtataattgtgtagccccttt

SEQ ID NO: 1616711 - DNA, 12 bp, Homo sapiens
gtatacatgtgt

SEQ ID NO: 1616712 - DNA, 15 bp, Homo sapiens
gtatacatgtgtaca

SEQ ID NO: 1616713 - DNA, 19 bp, Homo sapiens
gtatacatgtgtacatata

SEQ ID NO: 1616714 - DNA, 16 bp, Homo sapiens
gtatacattgtcttga

SEQ ID NO: 1616715 - DNA, 23 bp, Homo sapiens
gtatactagggagccatttgaga

SEQ ID NO: 1616716 - DNA, 13 bp, Homo sapiens
gtatactgtgtgg

SEQ ID NO: 1616717 - DNA, 23 bp, Homo sapiens
gtatactgtgtgggatacttagt

SEQ ID NO: 1616718 - DNA, 14 bp, Homo sapiens
gtatagaccaaagc

SEQ ID NO: 1616719 - DNA, 14 bp, Homo sapiens
gtatagatgcaaga

SEQ ID NO: 1616720 - DNA, 15 bp, Homo sapiens
gtataggatgtcaga

SEQ ID NO: 1616721 - DNA, 15 bp, Homo sapiens
gtatagtatctgtat

SEQ ID NO: 1616722 - DNA, 17 bp, Homo sapiens
gtatagtgttcacaaac

SEQ ID NO: 1616723 - DNA, 20 bp, Homo sapiens
gtatagtgttcacaaactgt

SEQ ID NO: 1616724 - DNA, 22 bp, Homo sapiens
gtatagtgttcacaaactgtga

SEQ ID NO: 1616725 - DNA, 17 bp, Homo sapiens
gtatagttgcttgcctg

SEQ ID NO: 1616726 - DNA, 20 bp, Homo sapiens
gtatagttttataaaactca

SEQ ID NO: 1616727 - DNA, 20 bp, Homo sapiens
gtatataaacatatttttat

SEQ ID NO: 1616728 - DNA, 21 bp, Homo sapiens
gtatataaatacatgcacaca

SEQ ID NO: 1616729 - DNA, 20 bp, Homo sapiens
gtatataggacaaaatgtta

SEQ ID NO: 1616730 - DNA, 14 bp, Homo sapiens
gtatatagtatatt

SEQ ID NO: 1616731 - DNA, 16 bp, Homo sapiens
gtatatagtatattta

SEQ ID NO: 1616732 - DNA, 21 bp, Homo sapiens
gtatatagtatatttatactc

SEQ ID NO: 1616733 - DNA, 23 bp, Homo sapiens
gtatatatatatagtaactactt

SEQ ID NO: 1616734 - DNA, 13 bp, Homo sapiens
gtatatatattca

SEQ ID NO: 1616735 - DNA, 21 bp, Homo sapiens
gtatatatctattattcaaaa

SEQ ID NO: 1616736 - DNA, 14 bp, Homo sapiens
gtatatattcccaa

SEQ ID NO: 1616737 - DNA, 13 bp, Homo sapiens
gtatatcattcta

SEQ ID NO: 1616738 - DNA, 19 bp, Homo sapiens
gtatatcattctaaagata

SEQ ID NO: 1616739 - DNA, 16 bp, Homo sapiens
gtatatgattctctgt

SEQ ID NO: 1616740 - DNA, 17 bp, Homo sapiens
gtatatgattctctgtg

SEQ ID NO: 1616741 - DNA, 18 bp, Homo sapiens
gtatatgattctctgtgg

SEQ ID NO: 1616742 - DNA, 13 bp, Homo sapiens
gtatatgtattcc

SEQ ID NO: 1616743 - DNA, 16 bp, Homo sapiens
gtatatgtattccctt

SEQ ID NO: 1616744 - DNA, 14 bp, Homo sapiens
gtatatgtcattta

SEQ ID NO: 1616745 - DNA, 16 bp, Homo sapiens
gtatatgtcatttact

SEQ ID NO: 1616746 - DNA, 11 bp, Homo sapiens
gtatattaaac

SEQ ID NO: 1616747 - DNA, 23 bp, Homo sapiens
gtatattaagaagcaataactat

SEQ ID NO: 1616748 - DNA, 23 bp, Homo sapiens
gtatattcaggacttgaaagaaa

SEQ ID NO: 1616749 - DNA, 18 bp, Homo sapiens
gtatattgtatcatttga

SEQ ID NO: 1616750 - DNA, 14 bp, Homo sapiens
gtatatttatactc

SEQ ID NO: 1616751 - DNA, 15 bp, Homo sapiens
gtatatttatactct

SEQ ID NO: 1616752 - DNA, 13 bp, Homo sapiens
gtatatttatagt

SEQ ID NO: 1616753 - DNA, 18 bp, Homo sapiens
gtatatttattcataatg

SEQ ID NO: 1616754 - DNA, 12 bp, Homo sapiens
gtatatttgaaa

SEQ ID NO: 1616755 - DNA, 13 bp, Homo sapiens
gtatatttgtaca

SEQ ID NO: 1616756 - DNA, 19 bp, Homo sapiens
gtatattttaatgaatatt

SEQ ID NO: 1616757 - DNA, 21 bp, Homo sapiens
gtatatttttttctaagagaa

SEQ ID NO: 1616758 - DNA, 11 bp, Homo sapiens
gtatcaaatca

SEQ ID NO: 1616759 - DNA, 13 bp, Homo sapiens
gtatcaaatctgt

SEQ ID NO: 1616760 - DNA, 19 bp, Homo sapiens
gtatcaagtggcatgtgct

SEQ ID NO: 1616761 - DNA, 17 bp, Homo sapiens
gtatcacaggccagatg

SEQ ID NO: 1616762 - DNA, 15 bp, Homo sapiens
gtatcacgatttgca

SEQ ID NO: 1616763 - DNA, 15 bp, Homo sapiens
gtatcatagaaatgt

SEQ ID NO: 1616764 - DNA, 18 bp, Homo sapiens
gtatcatatattaaaaca

SEQ ID NO: 1616765 - DNA, 21 bp, Homo sapiens
gtatccaaggaaacattttat

SEQ ID NO: 1616766 - DNA, 19 bp, Homo sapiens
gtatccactttgcacagct

SEQ ID NO: 1616767 - DNA, 16 bp, Homo sapiens
gtatccatgcatgtgc

SEQ ID NO: 1616768 - DNA, 19 bp, Homo sapiens
gtatcccaactcctataat

SEQ ID NO: 1616769 - DNA, 14 bp, Homo sapiens
gtatccccccatct

SEQ ID NO: 1616770 - DNA, 18 bp, Homo sapiens
gtatcccctgcctcctgc

SEQ ID NO: 1616771 - DNA, 18 bp, Homo sapiens
gtatccgtgaattgcttt

SEQ ID NO: 1616772 - DNA, 22 bp, Homo sapiens
gtatccgtgaattgctttatgg

SEQ ID NO: 1616773 - DNA, 20 bp, Homo sapiens
gtatcctccctggcagacac

SEQ ID NO: 1616774 - DNA, 17 bp, Homo sapiens
gtatcctggggctccct

SEQ ID NO: 1616775 - DNA, 17 bp, Homo sapiens
gtatcggagacagtgat

SEQ ID NO: 1616776 - DNA, 17 bp, Homo sapiens
gtatctaaaaaataact

SEQ ID NO: 1616777 - DNA, 22 bp, Homo sapiens
gtatctagagcttaatgctaca

SEQ ID NO: 1616778 - DNA, 16 bp, Homo sapiens
gtatctatttgtacaa

SEQ ID NO: 1616779 - DNA, 19 bp, Homo sapiens
gtatctatttgtacaattt

SEQ ID NO: 1616780 - DNA, 22 bp, Homo sapiens
gtatctcaagatattcaggtgg

SEQ ID NO: 1616781 - DNA, 14 bp, Homo sapiens
gtatctcagaaagt

SEQ ID NO: 1616782 - DNA, 22 bp, Homo sapiens
gtatctcagaaagtgcctgaca

SEQ ID NO: 1616783 - DNA, 16 bp, Homo sapiens
gtatctcatactgtct

SEQ ID NO: 1616784 - DNA, 23 bp, Homo sapiens
gtatctcgtaatagcttctgtgt

SEQ ID NO: 1616785 - DNA, 17 bp, Homo sapiens
gtatctcttcagtctct

SEQ ID NO: 1616786 - DNA, 20 bp, Homo sapiens
gtatctcttggtatgcatct

SEQ ID NO: 1616787 - DNA, 23 bp, Homo sapiens
gtatctgggtaagaagaaagcaa

SEQ ID NO: 1616788 - DNA, 22 bp, Homo sapiens
gtatcttaatatatacattttt

SEQ ID NO: 1616789 - DNA, 22 bp, Homo sapiens
gcttacaagccagctggagaaa

SEQ ID NO: 1616790 - DNA, 13 bp, Homo sapiens
gcttacactgagg

SEQ ID NO: 1616791 - DNA, 20 bp, Homo sapiens
gcttacactgaggactgtgg

SEQ ID NO: 1616792 - DNA, 13 bp, Homo sapiens
gcttacaggaagc

SEQ ID NO: 1616793 - DNA, 15 bp, Homo sapiens
gcttacattgaaaac

SEQ ID NO: 1616794 - DNA, 14 bp, Homo sapiens
gcttacatttttac

SEQ ID NO: 1616795 - DNA, 14 bp, Homo sapiens
gcttacctgacaca

SEQ ID NO: 1616796 - DNA, 16 bp, Homo sapiens
gcttacctgacacaag

SEQ ID NO: 1616797 - DNA, 13 bp, Homo sapiens
gcttactatttct

SEQ ID NO: 1616798 - DNA, 16 bp, Homo sapiens
gcttagacctcagcct

SEQ ID NO: 1616799 - DNA, 19 bp, Homo sapiens
gcttagacctcagcctgtg

SEQ ID NO: 1616800 - DNA, 14 bp, Homo sapiens
gcttagagttcttc

SEQ ID NO: 1616801 - DNA, 20 bp, Homo sapiens
gcttagatgagggtgactgt

SEQ ID NO: 1616802 - DNA, 20 bp, Homo sapiens
gcttagccttgtgccctgcc

SEQ ID NO: 1616803 - DNA, 20 bp, Homo sapiens
gcttagctgccttgagctaa

SEQ ID NO: 1616804 - DNA, 16 bp, Homo sapiens
gcttaggccagtcagt

SEQ ID NO: 1616805 - DNA, 14 bp, Homo sapiens
gcttaggcctctct

SEQ ID NO: 1616806 - DNA, 14 bp, Homo sapiens
gcttagggtcctgt

SEQ ID NO: 1616807 - DNA, 17 bp, Homo sapiens
gcttagtcactgcctgc

SEQ ID NO: 1616808 - DNA, 18 bp, Homo sapiens
gcttagtcactgcctgca

SEQ ID NO: 1616809 - DNA, 23 bp, Homo sapiens
gcttagtgctatgtgtgagatat

SEQ ID NO: 1616810 - DNA, 20 bp, Homo sapiens
gcttagttggctttgcccac

SEQ ID NO: 1616811 - DNA, 16 bp, Homo sapiens
gcttagtttgtgtgtt

SEQ ID NO: 1616812 - DNA, 17 bp, Homo sapiens
gcttagttttaataagt

SEQ ID NO: 1616813 - DNA, 12 bp, Homo sapiens
gcttatacactt

SEQ ID NO: 1616814 - DNA, 20 bp, Homo sapiens
gcttatacacttacacttta

SEQ ID NO: 1616815 - DNA, 15 bp, Homo sapiens
gcttatacccagtga

SEQ ID NO: 1616816 - DNA, 18 bp, Homo sapiens
gcttatatgtacttttat

SEQ ID NO: 1616817 - DNA, 22 bp, Homo sapiens
gcttatatgtacttttattttt

SEQ ID NO: 1616818 - DNA, 22 bp, Homo sapiens
gcttatctcttttatatttgta

SEQ ID NO: 1616819 - DNA, 23 bp, Homo sapiens
gcttatgacatcacttgtacaaa

SEQ ID NO: 1616820 - DNA, 15 bp, Homo sapiens
gcttatgtctctgcc

SEQ ID NO: 1616821 - DNA, 15 bp, Homo sapiens
gcttattacatttta

SEQ ID NO: 1616822 - DNA, 16 bp, Homo sapiens
gcttattctcaaagca

SEQ ID NO: 1616823 - DNA, 15 bp, Homo sapiens
gcttattggccactg

SEQ ID NO: 1616824 - DNA, 20 bp, Homo sapiens
gcttattgtgtgcgctgcct

SEQ ID NO: 1616825 - DNA, 21 bp, Homo sapiens
gcttattgtgtgcgctgcctg

SEQ ID NO: 1616826 - DNA, 23 bp, Homo sapiens
gcttattgtgtgcgctgcctggc

SEQ ID NO: 1616827 - DNA, 16 bp, Homo sapiens
gcttatttaataaaga

SEQ ID NO: 1616828 - DNA, 11 bp, Homo sapiens
gcttatttcta

SEQ ID NO: 1616829 - DNA, 15 bp, Homo sapiens
gcttcaatataagaa

SEQ ID NO: 1616830 - DNA, 18 bp, Homo sapiens
gcttcacagtagagccag

SEQ ID NO: 1616831 - DNA, 20 bp, Homo sapiens
gcttcacagtagagccagct

SEQ ID NO: 1616832 - DNA, 14 bp, Homo sapiens
gcttcaccagagca

SEQ ID NO: 1616833 - DNA, 15 bp, Homo sapiens
gcttcaccagagcat

SEQ ID NO: 1616834 - DNA, 17 bp, Homo sapiens
gcttcaccatggcctta

SEQ ID NO: 1616835 - DNA, 15 bp, Homo sapiens
gcttcactgaccagc

SEQ ID NO: 1616836 - DNA, 20 bp, Homo sapiens
gcttcactgaccagcggctg

SEQ ID NO: 1616837 - DNA, 17 bp, Homo sapiens
gcttcagaattaaaact

SEQ ID NO: 1616838 - DNA, 13 bp, Homo sapiens
gcttcagactcaa

SEQ ID NO: 1616839 - DNA, 16 bp, Homo sapiens
gcttcagagcctagcc

SEQ ID NO: 1616840 - DNA, 18 bp, Homo sapiens
gcttcagagcctagccac

SEQ ID NO: 1616841 - DNA, 20 bp, Homo sapiens
gcttcagagcctagccacct

SEQ ID NO: 1616842 - DNA, 21 bp, Homo sapiens
gcttcagagcctagccacctc

SEQ ID NO: 1616843 - DNA, 24 bp, Homo sapiens
gcttcagagcctagccacctccca

SEQ ID NO: 1616844 - DNA, 18 bp, Homo sapiens
gctgcggtcactcaggcc

SEQ ID NO: 1616845 - DNA, 23 bp, Homo sapiens
gctgcggtcactcaggcctctgc

SEQ ID NO: 1616846 - DNA, 15 bp, Homo sapiens
gctgcgtccccactc

SEQ ID NO: 1616847 - DNA, 18 bp, Homo sapiens
gctgcgtccccactccct

SEQ ID NO: 1616848 - DNA, 22 bp, Homo sapiens
gctgcgtttattaatgcctctc

SEQ ID NO: 1616849 - DNA, 17 bp, Homo sapiens
gctgctaattctttgca

SEQ ID NO: 1616850 - DNA, 21 bp, Homo sapiens
gctgctagattttaatttatt

SEQ ID NO: 1616851 - DNA, 19 bp, Homo sapiens
gctgctagcacttggagcc

SEQ ID NO: 1616852 - DNA, 17 bp, Homo sapiens
gctgctatccccatctc

SEQ ID NO: 1616853 - DNA, 23 bp, Homo sapiens
gctgctatccccatctccctgcc

SEQ ID NO: 1616854 - DNA, 14 bp, Homo sapiens
gctgctatgaaaat

SEQ ID NO: 1616855 - DNA, 20 bp, Homo sapiens
gctgctcaagccgcaagctc

SEQ ID NO: 1616856 - DNA, 18 bp, Homo sapiens
gctgctcattacagttct

SEQ ID NO: 1616857 - DNA, 17 bp, Homo sapiens
gctgctccccacccgcc

SEQ ID NO: 1616858 - DNA, 17 bp, Homo sapiens
gctgctccccaggccac

SEQ ID NO: 1616859 - DNA, 20 bp, Homo sapiens
gctgctccgaggacccagga

SEQ ID NO: 1616860 - DNA, 23 bp, Homo sapiens
gctgctccggtttgggctgtctt

SEQ ID NO: 1616861 - DNA, 15 bp, Homo sapiens
gctgctcctccaggg

SEQ ID NO: 1616862 - DNA, 20 bp, Homo sapiens
gctgctcctttaccctcttg

SEQ ID NO: 1616863 - DNA, 13 bp, Homo sapiens
gctgctctagctg

SEQ ID NO: 1616864 - DNA, 16 bp, Homo sapiens
gctgctctagctggca

SEQ ID NO: 1616865 - DNA, 17 bp, Homo sapiens
gctgctctagctggcag

SEQ ID NO: 1616866 - DNA, 14 bp, Homo sapiens
gctgctctgcccct

SEQ ID NO: 1616867 - DNA, 14 bp, Homo sapiens
gctgctctgcgtgg

SEQ ID NO: 1616868 - DNA, 22 bp, Homo sapiens
gctggttttgtaagatgctggg

SEQ ID NO: 1616869 - DNA, 14 bp, Homo sapiens
gctgtaaaatcttg

SEQ ID NO: 1616870 - DNA, 15 bp, Homo sapiens
gctgtaaataaatgc

SEQ ID NO: 1616871 - DNA, 18 bp, Homo sapiens
gctgtaacgtggcactgg

SEQ ID NO: 1616872 - DNA, 23 bp, Homo sapiens
gctgtaaggatccggaaagaaga

SEQ ID NO: 1616873 - DNA, 16 bp, Homo sapiens
gctgtaaggctctaga

SEQ ID NO: 1616874 - DNA, 13 bp, Homo sapiens
gctgtaagggcag

SEQ ID NO: 1616875 - DNA, 14 bp, Homo sapiens
gctgtaagggcagt

SEQ ID NO: 1616876 - DNA, 19 bp, Homo sapiens
gctgtaagggcagtgccca

SEQ ID NO: 1616877 - DNA, 22 bp, Homo sapiens
gctgtaatcatttgtttacatt

SEQ ID NO: 1616878 - DNA, 19 bp, Homo sapiens
gctgtaatgacaaaagata

SEQ ID NO: 1616879 - DNA, 13 bp, Homo sapiens
gctgtaccatatt

SEQ ID NO: 1616880 - DNA, 17 bp, Homo sapiens
gctgtactcagagcaga

SEQ ID NO: 1616881 - DNA, 14 bp, Homo sapiens
gctgtatgatttgt

SEQ ID NO: 1616882 - DNA, 15 bp, Homo sapiens
gctgtatgatttgtt

SEQ ID NO: 1616883 - DNA, 16 bp, Homo sapiens
gctgtatgatttgttt

SEQ ID NO: 1616884 - DNA, 21 bp, Homo sapiens
gctgtatgatttgttttgaat

SEQ ID NO: 1616885 - DNA, 14 bp, Homo sapiens
gctgtatttgctgt

SEQ ID NO: 1616886 - DNA, 14 bp, Homo sapiens
gctgtattttaaca

SEQ ID NO: 1616887 - DNA, 20 bp, Homo sapiens
gctgtattttaacactttgt

SEQ ID NO: 1616888 - DNA, 23 bp, Homo sapiens
gctgtattttaacactttgtatt

SEQ ID NO: 1616889 - DNA, 16 bp, Homo sapiens
gctgtattttctttta

SEQ ID NO: 1616890 - DNA, 19 bp, Homo sapiens
gctgtattttcttttatat

SEQ ID NO: 1616891 - DNA, 21 bp, Homo sapiens
gctgtattttcttttatatct

SEQ ID NO: 1616892 - DNA, 23 bp, Homo sapiens
gctgtattttcttttatatctgt

SEQ ID NO: 1616893 - DNA, 21 bp, Homo sapiens
gctgtcaaaactactgacagg

SEQ ID NO: 1616894 - DNA, 15 bp, Homo sapiens
gctgtcacttcttca

SEQ ID NO: 1616895 - DNA, 16 bp, Homo sapiens
gctgtcagataccctg

SEQ ID NO: 1616896 - DNA, 21 bp, Homo sapiens
gctgtcagtgtatggggcagc

SEQ ID NO: 1616897 - DNA, 21 bp, Homo sapiens
gctgtcatggtcctttctgga

SEQ ID NO: 1616898 - DNA, 13 bp, Homo sapiens
gctgtccaggcag

SEQ ID NO: 1616899 - DNA, 21 bp, Homo sapiens
gctgtccaggcagctccctcc

SEQ ID NO: 1616900 - DNA, 22 bp, Homo sapiens
gctgtccaggcagctccctcct

SEQ ID NO: 1616901 - DNA, 22 bp, Homo sapiens
gctgtcccatctccactgttat

SEQ ID NO: 1616902 - DNA, 15 bp, Homo sapiens
gctgtcccctcagcg

SEQ ID NO: 1616903 - DNA, 16 bp, Homo sapiens
gctgtcccctctgtca

SEQ ID NO: 1616904 - DNA, 11 bp, Homo sapiens
gctgtccctgc

SEQ ID NO: 1616905 - DNA, 14 bp, Homo sapiens
gctgtccctgcagg

SEQ ID NO: 1616906 - DNA, 18 bp, Homo sapiens
gctgtccctgtcaccaag

SEQ ID NO: 1616907 - DNA, 13 bp, Homo sapiens
gctgtcctaggcc

SEQ ID NO: 1616908 - DNA, 16 bp, Homo sapiens
gctgtcctccagaggg

SEQ ID NO: 1616909 - DNA, 16 bp, Homo sapiens
gctgtcctgcagtaga

SEQ ID NO: 1616910 - DNA, 19 bp, Homo sapiens
gctgtcctgctcacctgtg

SEQ ID NO: 1616911 - DNA, 12 bp, Homo sapiens
gctgtcctgctg

SEQ ID NO: 1616912 - DNA, 13 bp, Homo sapiens
gctgtcctgctgc

SEQ ID NO: 1616913 - DNA, 15 bp, Homo sapiens
gctgtcctgctgccc

SEQ ID NO: 1616914 - DNA, 17 bp, Homo sapiens
gctgtcctgctgccctc

SEQ ID NO: 1616915 - DNA, 15 bp, Homo sapiens
gctgtcctggagggg

SEQ ID NO: 1616916 - DNA, 23 bp, Homo sapiens
gctgtcctggaggggctggggac

SEQ ID NO: 1616917 - DNA, 14 bp, Homo sapiens
gctgtcctggtggc

SEQ ID NO: 1616918 - DNA, 18 bp, Homo sapiens
gctgtcctggtggctggg

SEQ ID NO: 1616919 - DNA, 22 bp, Homo sapiens
gctgtccttaacccacctctcc

SEQ ID NO: 1616920 - DNA, 17 bp, Homo sapiens
gctgtcgctgcctccat

SEQ ID NO: 1616921 - DNA, 20 bp, Homo sapiens
gctgtcgctgcctccatggc

SEQ ID NO: 1616922 - DNA, 19 bp, Homo sapiens
gctgtctagaatgtggatt

SEQ ID NO: 1616923 - DNA, 13 bp, Homo sapiens
gctgtctctgagg

SEQ ID NO: 1616924 - DNA, 19 bp, Homo sapiens
gctgtctgaccagagaatg

SEQ ID NO: 1616925 - DNA, 12 bp, Homo sapiens
gctgtctgcctg

SEQ ID NO: 1616926 - DNA, 18 bp, Homo sapiens
gctgtctgtctgcagtgc

SEQ ID NO: 1616927 - DNA, 20 bp, Homo sapiens
gctgtcttctcaggctctgc

SEQ ID NO: 1616928 - DNA, 13 bp, Homo sapiens
gctgtcttctgga

SEQ ID NO: 1616929 - DNA, 24 bp, Homo sapiens
gctgtcttctggacaggctctgct

SEQ ID NO: 1616930 - DNA, 13 bp, Homo sapiens
gctgtctttctct

SEQ ID NO: 1616931 - DNA, 14 bp, Homo sapiens
gctgtctttctcta

SEQ ID NO: 1616932 - DNA, 20 bp, Homo sapiens
gctgtcttttgttctctgaa

SEQ ID NO: 1616933 - DNA, 23 bp, Homo sapiens
gctgtgaaccctggggcctgact

SEQ ID NO: 1616934 - DNA, 20 bp, Homo sapiens
gctgtgaatgccaaagccat

SEQ ID NO: 1616935 - DNA, 22 bp, Homo sapiens
gctgtgaccatttataatgtta

SEQ ID NO: 1616936 - DNA, 19 bp, Homo sapiens
gctgtgactctgggcaggg

SEQ ID NO: 1616937 - DNA, 21 bp, Homo sapiens
gctgtgactctgggcagggac

SEQ ID NO: 1616938 - DNA, 16 bp, Homo sapiens
gctgtgagcagcctcc

SEQ ID NO: 1616939 - DNA, 17 bp, Homo sapiens
gctgtgagcagcctcca

SEQ ID NO: 1616940 - DNA, 22 bp, Homo sapiens
gctgtgagcagcctccactgtg

SEQ ID NO: 1616941 - DNA, 19 bp, Homo sapiens
gctgtgagcatcctggcag

SEQ ID NO: 1616942 - DNA, 12 bp, Homo sapiens
gctgtgaggctg

SEQ ID NO: 1616943 - DNA, 13 bp, Homo sapiens
gctgtgaggctgt

SEQ ID NO: 1616944 - DNA, 17 bp, Homo sapiens
gctgtgaggctgtcctg

SEQ ID NO: 1616945 - DNA, 18 bp, Homo sapiens
gctgtgaggctgtcctgt

SEQ ID NO: 1616946 - DNA, 15 bp, Homo sapiens
gctgtgagggagggg

SEQ ID NO: 1616947 - DNA, 23 bp, Homo sapiens
gctgtgagggaggggaaaagcat

SEQ ID NO: 1616948 - DNA, 18 bp, Homo sapiens
gctgtgattgctgccagg

SEQ ID NO: 1616949 - DNA, 19 bp, Homo sapiens
gctgtgcaacgccgtgggc

SEQ ID NO: 1616950 - DNA, 20 bp, Homo sapiens
gctgtgcaacgccgtgggct

SEQ ID NO: 1616951 - DNA, 14 bp, Homo sapiens
gctgtgccagcagg

SEQ ID NO: 1616952 - DNA, 17 bp, Homo sapiens
gctgtgccatgctgggc

SEQ ID NO: 1616953 - DNA, 16 bp, Homo sapiens
gctgtgcccagcaggc

SEQ ID NO: 1616954 - DNA, 17 bp, Homo sapiens
gctgtgcccagcaggcc

SEQ ID NO: 1616955 - DNA, 12 bp, Homo sapiens
gctgtgcctgct

SEQ ID NO: 1616956 - DNA, 17 bp, Homo sapiens
gctgtgcctgctagagc

SEQ ID NO: 1616957 - DNA, 18 bp, Homo sapiens
gctgtgcctgctagagca

SEQ ID NO: 1616958 - DNA, 20 bp, Homo sapiens
gctgtgcctgctagagcaac

SEQ ID NO: 1616959 - DNA, 21 bp, Homo sapiens
gctgtgcctgctcagcagcca

SEQ ID NO: 1616960 - DNA, 22 bp, Homo sapiens
gctgtgcctgctcagcagccag

SEQ ID NO: 1616961 - DNA, 16 bp, Homo sapiens
gctgtgcgcccagggc

SEQ ID NO: 1616962 - DNA, 17 bp, Homo sapiens
gctgtgcgcccagggct

SEQ ID NO: 1616963 - DNA, 18 bp, Homo sapiens
gctgtgcgcccagggctg

SEQ ID NO: 1616964 - DNA, 16 bp, Homo sapiens
gctgtgcggatctctg

SEQ ID NO: 1616965 - DNA, 14 bp, Homo sapiens
gctgtgctatgaat

SEQ ID NO: 1616966 - DNA, 15 bp, Homo sapiens
gctgtgctatgaatt

SEQ ID NO: 1616967 - DNA, 16 bp, Homo sapiens
gctgtgctatgaattt

SEQ ID NO: 1616968 - DNA, 17 bp, Homo sapiens
gctgtgctctggcacca

SEQ ID NO: 1616969 - DNA, 10 bp, Homo sapiens
gctgtgctgg

SEQ ID NO: 1616970 - DNA, 18 bp, Homo sapiens
gctgtgcttgaaggccct

SEQ ID NO: 1616971 - DNA, 20 bp, Homo sapiens
gctgtgcttgaaggccctgc

SEQ ID NO: 1616972 - DNA, 21 bp, Homo sapiens
gctgtggaccgtggacaggcc

SEQ ID NO: 1616973 - DNA, 16 bp, Homo sapiens
gctgtggactgtcctg

SEQ ID NO: 1616974 - DNA, 17 bp, Homo sapiens
gctgtggactgtcctga

SEQ ID NO: 1616975 - DNA, 20 bp, Homo sapiens
gctgtggactgtcctgagga

SEQ ID NO: 1616976 - DNA, 16 bp, Homo sapiens
gctgtggaggcctgat

SEQ ID NO: 1616977 - DNA, 13 bp, Homo sapiens
gctgtggcagccg

SEQ ID NO: 1616978 - DNA, 22 bp, Homo sapiens
gctgtggcagccgtcccaggcc

SEQ ID NO: 1616979 - DNA, 22 bp, Homo sapiens
gctgtggcatttccaaacatcc

SEQ ID NO: 1616980 - DNA, 19 bp, Homo sapiens
gctgtggccgtctcctccc

SEQ ID NO: 1616981 - DNA, 22 bp, Homo sapiens
gctgtggccgtctcctccctca

SEQ ID NO: 1616982 - DNA, 14 bp, Homo sapiens
gctgtggctggagg

SEQ ID NO: 1616983 - DNA, 16 bp, Homo sapiens
gctgtgggactccagg

SEQ ID NO: 1616984 - DNA, 22 bp, Homo sapiens
gctgcatttcacatgccttgca

SEQ ID NO: 1616985 - DNA, 23 bp, Homo sapiens
gctgcattttaattttaaccaaa

SEQ ID NO: 1616986 - DNA, 17 bp, Homo sapiens
gctgccaaattttggcc

SEQ ID NO: 1616987 - DNA, 16 bp, Homo sapiens
gctgccaaggccagag

SEQ ID NO: 1616988 - DNA, 23 bp, Homo sapiens
gctgccaaggccagagtggcctg

SEQ ID NO: 1616989 - DNA, 15 bp, Homo sapiens
gctgccacacttcag

SEQ ID NO: 1616990 - DNA, 16 bp, Homo sapiens
gctgccaccacgtctg

SEQ ID NO: 1616991 - DNA, 21 bp, Homo sapiens
gctgccaccacgtctgccagg

SEQ ID NO: 1616992 - DNA, 10 bp, Homo sapiens
gctgccactg

SEQ ID NO: 1616993 - DNA, 14 bp, Homo sapiens
gctgccactgggca

SEQ ID NO: 1616994 - DNA, 18 bp, Homo sapiens
gctgccactgggcacctg

SEQ ID NO: 1616995 - DNA, 22 bp, Homo sapiens
gctgccactgggcacctgcgca

SEQ ID NO: 1616996 - DNA, 23 bp, Homo sapiens
gctgccagccttgagccctggct

SEQ ID NO: 1616997 - DNA, 14 bp, Homo sapiens
gctgccagcgtctg

SEQ ID NO: 1616998 - DNA, 10 bp, Homo sapiens
gctgccaggc

SEQ ID NO: 1616999 - DNA, 20 bp, Homo sapiens
gctgccaggcgttggtgcca

SEQ ID NO: 1617000 - DNA, 16 bp, Homo sapiens
gctgccagtgcagcca

SEQ ID NO: 1617001 - DNA, 17 bp, Homo sapiens
gctgccagtgcagccac

SEQ ID NO: 1617002 - DNA, 22 bp, Homo sapiens
gctgccagtgcagccactggct

SEQ ID NO: 1617003 - DNA, 14 bp, Homo sapiens
gctgccataattct

SEQ ID NO: 1617004 - DNA, 17 bp, Homo sapiens
gctggcaaccagccagc

SEQ ID NO: 1617005 - DNA, 16 bp, Homo sapiens
gctggcaagcagggaa

SEQ ID NO: 1617006 - DNA, 15 bp, Homo sapiens
gctggcacattgttg

SEQ ID NO: 1617007 - DNA, 21 bp, Homo sapiens
gctggcacccaccgtggagga

SEQ ID NO: 1617008 - DNA, 15 bp, Homo sapiens
gctggcagctgagag

SEQ ID NO: 1617009 - DNA, 21 bp, Homo sapiens
gctggcaggacacatcccggc

SEQ ID NO: 1617010 - DNA, 21 bp, Homo sapiens
gctggcatcaagggagacacc

SEQ ID NO: 1617011 - DNA, 16 bp, Homo sapiens
gctggcattacaggtg

SEQ ID NO: 1617012 - DNA, 16 bp, Homo sapiens
gctggcatttgcacct

SEQ ID NO: 1617013 - DNA, 16 bp, Homo sapiens
gctggccagtccaggc

SEQ ID NO: 1617014 - DNA, 14 bp, Homo sapiens
gctggcccagccaa

SEQ ID NO: 1617015 - DNA, 13 bp, Homo sapiens
gctggcccagccg

SEQ ID NO: 1617016 - DNA, 19 bp, Homo sapiens
gctggcccagccggcctct

SEQ ID NO: 1617017 - DNA, 23 bp, Homo sapiens
gctggcccagccggcctctctgg

SEQ ID NO: 1617018 - DNA, 14 bp, Homo sapiens
gctggccccagccc

SEQ ID NO: 1617019 - DNA, 21 bp, Homo sapiens
gctggccccagccctgctggg

SEQ ID NO: 1617020 - DNA, 12 bp, Homo sapiens
gctggcccccag

SEQ ID NO: 1617021 - DNA, 13 bp, Homo sapiens
gctggcccccagg

SEQ ID NO: 1617022 - DNA, 14 bp, Homo sapiens
gctggcccccagga

SEQ ID NO: 1617023 - DNA, 19 bp, Homo sapiens
gctggcctctctagcacaa

SEQ ID NO: 1617024 - DNA, 14 bp, Homo sapiens
gctggcctggacag

SEQ ID NO: 1617025 - DNA, 14 bp, Homo sapiens
gctggcctggatct

SEQ ID NO: 1617026 - DNA, 12 bp, Homo sapiens
gctggcctggta

SEQ ID NO: 1617027 - DNA, 13 bp, Homo sapiens
gctggcctgtggc

SEQ ID NO: 1617028 - DNA, 19 bp, Homo sapiens
gctggcctgtggcacagcc

SEQ ID NO: 1617029 - DNA, 20 bp, Homo sapiens
gctggcctgtggcacagccc

SEQ ID NO: 1617030 - DNA, 13 bp, Homo sapiens
gctggcgcagcca

SEQ ID NO: 1617031 - DNA, 14 bp, Homo sapiens
gctggcgcagccaa

SEQ ID NO: 1617032 - DNA, 15 bp, Homo sapiens
gctggctacgcctct

SEQ ID NO: 1617033 - DNA, 13 bp, Homo sapiens
gctggctccccaa

SEQ ID NO: 1617034 - DNA, 21 bp, Homo sapiens
gctggctccccaaagggtgtg

SEQ ID NO: 1617035 - DNA, 18 bp, Homo sapiens
gctggctccctgggcagt

SEQ ID NO: 1617036 - DNA, 16 bp, Homo sapiens
gctggctctgagcgcc

SEQ ID NO: 1617037 - DNA, 19 bp, Homo sapiens
gctggctctgtgagggtgc

SEQ ID NO: 1617038 - DNA, 12 bp, Homo sapiens
gctggctgagtg

SEQ ID NO: 1617039 - DNA, 21 bp, Homo sapiens
gctggctgagtggaatgcagg

SEQ ID NO: 1617040 - DNA, 13 bp, Homo sapiens
gctggctgcagtg

SEQ ID NO: 1617041 - DNA, 14 bp, Homo sapiens
gctggctgcagtga

SEQ ID NO: 1617042 - DNA, 20 bp, Homo sapiens
gctggctgccttagaacctt

SEQ ID NO: 1617043 - DNA, 14 bp, Homo sapiens
gctggctgcggccc

SEQ ID NO: 1617044 - DNA, 18 bp, Homo sapiens
gctggctggagtctcaga

SEQ ID NO: 1617045 - DNA, 22 bp, Homo sapiens
gctggctggagtctcagagcac

SEQ ID NO: 1617046 - DNA, 15 bp, Homo sapiens
gctggctgggcatgg

SEQ ID NO: 1617047 - DNA, 16 bp, Homo sapiens
gctggctgggcatgga

SEQ ID NO: 1617048 - DNA, 19 bp, Homo sapiens
gctggctgggctggctgaa

SEQ ID NO: 1617049 - DNA, 18 bp, Homo sapiens
gctggcttgtttgatttc

SEQ ID NO: 1617050 - DNA, 15 bp, Homo sapiens
gctggctttctctct

SEQ ID NO: 1617051 - DNA, 16 bp, Homo sapiens
gctggctttctctctg

SEQ ID NO: 1617052 - DNA, 23 bp, Homo sapiens
gctgggaacatgacccagcctga

SEQ ID NO: 1617053 - DNA, 18 bp, Homo sapiens
gctgggaaccccgcagcc

SEQ ID NO: 1617054 - DNA, 19 bp, Homo sapiens
gctgggaaccccgcagccc

SEQ ID NO: 1617055 - DNA, 20 bp, Homo sapiens
gctgggaaccccgcagcccg

SEQ ID NO: 1617056 - DNA, 20 bp, Homo sapiens
gctgggaagagaagagggcc

SEQ ID NO: 1617057 - DNA, 21 bp, Homo sapiens
gctgggaagagctcccctcca

SEQ ID NO: 1617058 - DNA, 13 bp, Homo sapiens
gctgggaccagag

SEQ ID NO: 1617059 - DNA, 17 bp, Homo sapiens
gctgggaccagagccag

SEQ ID NO: 1617060 - DNA, 18 bp, Homo sapiens
gctgggaccagagccaga

SEQ ID NO: 1617061 - DNA, 18 bp, Homo sapiens
gctgggacgatcgcccag

SEQ ID NO: 1617062 - DNA, 18 bp, Homo sapiens
gctgggactacaggcgcc

SEQ ID NO: 1617063 - DNA, 14 bp, Homo sapiens
gctgggactgagcc

SEQ ID NO: 1617064 - DNA, 15 bp, Homo sapiens
gctgggactggccag

SEQ ID NO: 1617065 - DNA, 14 bp, Homo sapiens
gctgggagacaaag

SEQ ID NO: 1617066 - DNA, 16 bp, Homo sapiens
gctgggagctccactc

SEQ ID NO: 1617067 - DNA, 22 bp, Homo sapiens
gctgggaggaaggacttccctg

SEQ ID NO: 1617068 - DNA, 16 bp, Homo sapiens
gctgggaggagggaga

SEQ ID NO: 1617069 - DNA, 12 bp, Homo sapiens
gctgggaggcaa

SEQ ID NO: 1617070 - DNA, 20 bp, Homo sapiens
gctgggatttcttcgctgct

SEQ ID NO: 1617071 - DNA, 23 bp, Homo sapiens
gctgggatttcttcgctgctcta

SEQ ID NO: 1617072 - DNA, 13 bp, Homo sapiens
gctgggcagggtg

SEQ ID NO: 1617073 - DNA, 16 bp, Homo sapiens
gctgggcatactttct

SEQ ID NO: 1617074 - DNA, 21 bp, Homo sapiens
gctgggcatgccatgtctgag

SEQ ID NO: 1617075 - DNA, 13 bp, Homo sapiens
gctgggccactgg

SEQ ID NO: 1617076 - DNA, 13 bp, Homo sapiens
gctgggccaggga

SEQ ID NO: 1617077 - DNA, 14 bp, Homo sapiens
gctgggccagggaa

SEQ ID NO: 1617078 - DNA, 12 bp, Homo sapiens
gctgggcccagc

SEQ ID NO: 1617079 - DNA, 16 bp, Homo sapiens
gctgggccccatgctc

SEQ ID NO: 1617080 - DNA, 19 bp, Homo sapiens
gctgggccccatgctctgc

SEQ ID NO: 1617081 - DNA, 20 bp, Homo sapiens
gctgggccccatgctctgcc

SEQ ID NO: 1617082 - DNA, 13 bp, Homo sapiens
gctgggcccctgc

SEQ ID NO: 1617083 - DNA, 17 bp, Homo sapiens
gctgggcccctgcacag

SEQ ID NO: 1617084 - DNA, 21 bp, Homo sapiens
gctgggcccgacatggctccg

SEQ ID NO: 1617085 - DNA, 17 bp, Homo sapiens
gctgggccctctcttct

SEQ ID NO: 1617086 - DNA, 21 bp, Homo sapiens
gctgggccctctttccctgcg

SEQ ID NO: 1617087 - DNA, 19 bp, Homo sapiens
gctgggcctcccctgggca

SEQ ID NO: 1617088 - DNA, 13 bp, Homo sapiens
gctgggcctcctg

SEQ ID NO: 1617089 - DNA, 18 bp, Homo sapiens
gctgggcctcctgcctcc

SEQ ID NO: 1617090 - DNA, 14 bp, Homo sapiens
gctgggcctccttc

SEQ ID NO: 1617091 - DNA, 15 bp, Homo sapiens
gctgggcgtgtgtga

SEQ ID NO: 1617092 - DNA, 16 bp, Homo sapiens
gctgggcgtgtgtgac

SEQ ID NO: 1617093 - DNA, 18 bp, Homo sapiens
gctgggcgtgtgtgacac

SEQ ID NO: 1617094 - DNA, 19 bp, Homo sapiens
gctgggcgtgtgtgacact

SEQ ID NO: 1617095 - DNA, 15 bp, Homo sapiens
gctgggctctgcctg

SEQ ID NO: 1617096 - DNA, 20 bp, Homo sapiens
gctgggctgagcccctaccc

SEQ ID NO: 1617097 - DNA, 15 bp, Homo sapiens
gctgggctgggccct

SEQ ID NO: 1617098 - DNA, 22 bp, Homo sapiens
gctgggcttggcagcccgggtc

SEQ ID NO: 1617099 - DNA, 21 bp, Homo sapiens
gctggggaagggttttctttt

SEQ ID NO: 1617100 - DNA, 17 bp, Homo sapiens
gctggggagcagctgag

SEQ ID NO: 1617101 - DNA, 18 bp, Homo sapiens
gctggggaggaggagaga

SEQ ID NO: 1617102 - DNA, 14 bp, Homo sapiens
gctggggatgtctc

SEQ ID NO: 1617103 - DNA, 17 bp, Homo sapiens
gctggggcaagtccctg

SEQ ID NO: 1617104 - DNA, 18 bp, Homo sapiens
gctggggcagaggggcag

SEQ ID NO: 1617105 - DNA, 24 bp, Homo sapiens
gctggggcagaggggcagccgcta

SEQ ID NO: 1617106 - DNA, 13 bp, Homo sapiens
gctggggccagcg

SEQ ID NO: 1617107 - DNA, 21 bp, Homo sapiens
gctggggccgccacggcctgg

SEQ ID NO: 1617108 - DNA, 17 bp, Homo sapiens
gctggggccggggctga

SEQ ID NO: 1617109 - DNA, 18 bp, Homo sapiens
gctggggccggggctgag

SEQ ID NO: 1617110 - DNA, 17 bp, Homo sapiens
gctggggcgtggggagg

SEQ ID NO: 1617111 - DNA, 21 bp, Homo sapiens
gctggggctaggggaagggct

SEQ ID NO: 1617112 - DNA, 23 bp, Homo sapiens
gctggggctaggggaagggcttt

SEQ ID NO: 1617113 - DNA, 16 bp, Homo sapiens
gctgggggaaggcagg

SEQ ID NO: 1617114 - DNA, 21 bp, Homo sapiens
gctgggggaggtccaagcaga

SEQ ID NO: 1617115 - DNA, 20 bp, Homo sapiens
gctggggtcttgggttcctg

SEQ ID NO: 1617116 - DNA, 17 bp, Homo sapiens
gctgggtactgactgag

SEQ ID NO: 1617117 - DNA, 12 bp, Homo sapiens
gctgggtcacca

SEQ ID NO: 1617118 - DNA, 22 bp, Homo sapiens
gctgggtccttgggcctggcca

SEQ ID NO: 1617119 - DNA, 17 bp, Homo sapiens
gccctgccctggcaggg

SEQ ID NO: 1617120 - DNA, 11 bp, Homo sapiens
gccctgcctct

SEQ ID NO: 1617121 - DNA, 11 bp, Homo sapiens
gccctgcctga

SEQ ID NO: 1617122 - DNA, 17 bp, Homo sapiens
gccctgcctgaggagga

SEQ ID NO: 1617123 - DNA, 14 bp, Homo sapiens
gccctgcctgaggg

SEQ ID NO: 1617124 - DNA, 14 bp, Homo sapiens
gccctgcctgccca

SEQ ID NO: 1617125 - DNA, 19 bp, Homo sapiens
gccctgccttgtccctctc

SEQ ID NO: 1617126 - DNA, 16 bp, Homo sapiens
gccctgcgttggagcc

SEQ ID NO: 1617127 - DNA, 22 bp, Homo sapiens
gccctgcgttggagccactcct

SEQ ID NO: 1617128 - DNA, 23 bp, Homo sapiens
gccctgcgttggagccactcctg

SEQ ID NO: 1617129 - DNA, 13 bp, Homo sapiens
gccctgctacctg

SEQ ID NO: 1617130 - DNA, 17 bp, Homo sapiens
gccctgctacctgttct

SEQ ID NO: 1617131 - DNA, 22 bp, Homo sapiens
gccctgctcctccctggctgcc

SEQ ID NO: 1617132 - DNA, 13 bp, Homo sapiens
gccctgctgggga

SEQ ID NO: 1617133 - DNA, 21 bp, Homo sapiens
gccctgctggggatccccgcc

SEQ ID NO: 1617134 - DNA, 16 bp, Homo sapiens
gccctgctttgggctg

SEQ ID NO: 1617135 - DNA, 18 bp, Homo sapiens
gccctgctttgggctgcc

SEQ ID NO: 1617136 - DNA, 20 bp, Homo sapiens
gccctgctttgggctgccct

SEQ ID NO: 1617137 - DNA, 21 bp, Homo sapiens
gccctgctttgggctgccctg

SEQ ID NO: 1617138 - DNA, 23 bp, Homo sapiens
gccctgctttgggctgccctggt

SEQ ID NO: 1617139 - DNA, 20 bp, Homo sapiens
gccctggagagccccatggt

SEQ ID NO: 1617140 - DNA, 11 bp, Homo sapiens
gccctggagcc

SEQ ID NO: 1617141 - DNA, 13 bp, Homo sapiens
gccctggagccag

SEQ ID NO: 1617142 - DNA, 17 bp, Homo sapiens
gctcctctccagtctga

SEQ ID NO: 1617143 - DNA, 20 bp, Homo sapiens
gctcctctccttgggctcct

SEQ ID NO: 1617144 - DNA, 21 bp, Homo sapiens
gctcctctccttgggctcctg

SEQ ID NO: 1617145 - DNA, 22 bp, Homo sapiens
gctcctctccttgggctcctgg

SEQ ID NO: 1617146 - DNA, 23 bp, Homo sapiens
gctcctctccttgggctcctggc

SEQ ID NO: 1617147 - DNA, 23 bp, Homo sapiens
gctcctcttaccgtagcctccgt

SEQ ID NO: 1617148 - DNA, 18 bp, Homo sapiens
gctcctcttgattcctgg

SEQ ID NO: 1617149 - DNA, 18 bp, Homo sapiens
gctcctgaggggcatctg

SEQ ID NO: 1617150 - DNA, 22 bp, Homo sapiens
gctcctgccgcagacgggcaca

SEQ ID NO: 1617151 - DNA, 14 bp, Homo sapiens
gctcctgctacttc

SEQ ID NO: 1617152 - DNA, 13 bp, Homo sapiens
gctcctgctgcgg

SEQ ID NO: 1617153 - DNA, 14 bp, Homo sapiens
gctcctgctgcgga

SEQ ID NO: 1617154 - DNA, 15 bp, Homo sapiens
gctcctgcttttctg

SEQ ID NO: 1617155 - DNA, 18 bp, Homo sapiens
gctcctgcttttctgtcc

SEQ ID NO: 1617156 - DNA, 20 bp, Homo sapiens
gctcctgcttttctgtcctg

SEQ ID NO: 1617157 - DNA, 23 bp, Homo sapiens
gctcctgcttttctgtcctgggc

SEQ ID NO: 1617158 - DNA, 21 bp, Homo sapiens
gctcctggaaaggctcagtct

SEQ ID NO: 1617159 - DNA, 22 bp, Homo sapiens
gctcctggaaaggctcagtctc

SEQ ID NO: 1617160 - DNA, 22 bp, Homo sapiens
gctcctggaaccaatcccgtga

SEQ ID NO: 1617161 - DNA, 11 bp, Homo sapiens
gctcctggctg

SEQ ID NO: 1617162 - DNA, 13 bp, Homo sapiens
gctcctggctgcc

SEQ ID NO: 1617163 - DNA, 16 bp, Homo sapiens
gctcctggctgtgccc

SEQ ID NO: 1617164 - DNA, 20 bp, Homo sapiens
gctcctggctgtgcccagca

SEQ ID NO: 1617165 - DNA, 22 bp, Homo sapiens
gctcctggctgtgcccagcagg

SEQ ID NO: 1617166 - DNA, 14 bp, Homo sapiens
gctcctgggcagct

SEQ ID NO: 1617167 - DNA, 17 bp, Homo sapiens
gctcctgggcagcttga

SEQ ID NO: 1617168 - DNA, 14 bp, Homo sapiens
gctcctgtggcagc

SEQ ID NO: 1617169 - DNA, 16 bp, Homo sapiens
gctcctgtggcagctg

SEQ ID NO: 1617170 - DNA, 18 bp, Homo sapiens
gctcctgtggcagctgcc

SEQ ID NO: 1617171 - DNA, 14 bp, Homo sapiens
gctcctgtggcagg

SEQ ID NO: 1617172 - DNA, 22 bp, Homo sapiens
gctcctgttttgcacagccaaa

SEQ ID NO: 1617173 - DNA, 13 bp, Homo sapiens
gctccttcactgt

SEQ ID NO: 1617174 - DNA, 12 bp, Homo sapiens
gctccttccaga

SEQ ID NO: 1617175 - DNA, 13 bp, Homo sapiens
gctccttccagac

SEQ ID NO: 1617176 - DNA, 18 bp, Homo sapiens
gctccttcccatcgctgt

SEQ ID NO: 1617177 - DNA, 13 bp, Homo sapiens
gctccttcccctg

SEQ ID NO: 1617178 - DNA, 17 bp, Homo sapiens
gctccttcccctgcacc

SEQ ID NO: 1617179 - DNA, 17 bp, Homo sapiens
gctccttgagtaaaaag

SEQ ID NO: 1617180 - DNA, 20 bp, Homo sapiens
gctcctttgtgtgtgtgtca

SEQ ID NO: 1617181 - DNA, 22 bp, Homo sapiens
gctcctttgtgtgtgtgtcagc

SEQ ID NO: 1617182 - DNA, 18 bp, Homo sapiens
gctccttttgtccccagg

SEQ ID NO: 1617183 - DNA, 23 bp, Homo sapiens
gctccttttgtccccagggcccc

SEQ ID NO: 1617184 - DNA, 16 bp, Homo sapiens
gctcgaggggtgggct

SEQ ID NO: 1617185 - DNA, 17 bp, Homo sapiens
gctcgcagggtgcagga

SEQ ID NO: 1617186 - DNA, 22 bp, Homo sapiens
gctcgcccagacaccatgtgca

SEQ ID NO: 1617187 - DNA, 23 bp, Homo sapiens
gctcgcccagacaccatgtgcaa

SEQ ID NO: 1617188 - DNA, 14 bp, Homo sapiens
gctcgcgggcagcg

SEQ ID NO: 1617189 - DNA, 17 bp, Homo sapiens
gctcgcgggcagcgggc

SEQ ID NO: 1617190 - DNA, 20 bp, Homo sapiens
gctcgcgggcagcgggccag

SEQ ID NO: 1617191 - DNA, 23 bp, Homo sapiens
gctcgctccctgtagctctgcct

SEQ ID NO: 1617192 - DNA, 17 bp, Homo sapiens
gctcgctcgctctcgct

SEQ ID NO: 1617193 - DNA, 17 bp, Homo sapiens
gcctcttcaaattagaa

SEQ ID NO: 1617194 - DNA, 13 bp, Homo sapiens
gcctcttccaccc

SEQ ID NO: 1617195 - DNA, 14 bp, Homo sapiens
gcctcttccagtga

SEQ ID NO: 1617196 - DNA, 20 bp, Homo sapiens
gcctcttcttcttcagaaga

SEQ ID NO: 1617197 - DNA, 20 bp, Homo sapiens
gcctcttctttgtgcctttg

SEQ ID NO: 1617198 - DNA, 20 bp, Homo sapiens
gcctcttgaccaggctgcct

SEQ ID NO: 1617199 - DNA, 21 bp, Homo sapiens
gcctcttgagcagtggctggt

SEQ ID NO: 1617200 - DNA, 16 bp, Homo sapiens
gcctgcctcctggctc

SEQ ID NO: 1617201 - DNA, 17 bp, Homo sapiens
gcctgcctgatccctga

SEQ ID NO: 1617202 - DNA, 18 bp, Homo sapiens
gcctgcctgatccctgaa

SEQ ID NO: 1617203 - DNA, 14 bp, Homo sapiens
gcctgcctgtctgt

SEQ ID NO: 1617204 - DNA, 20 bp, Homo sapiens
gcctgcctttggcactctga

SEQ ID NO: 1617205 - DNA, 21 bp, Homo sapiens
gcctgcgccaccgcccagaga

SEQ ID NO: 1617206 - DNA, 22 bp, Homo sapiens
gcctgcgtcttttttctcttcc

SEQ ID NO: 1617207 - DNA, 15 bp, Homo sapiens
gcctgcgtgcgctgg

SEQ ID NO: 1617208 - DNA, 23 bp, Homo sapiens
gcctgcgtttggaggcccctggg

SEQ ID NO: 1617209 - DNA, 13 bp, Homo sapiens
gcctgctcagcag

SEQ ID NO: 1617210 - DNA, 14 bp, Homo sapiens
gcctgctccagacc

SEQ ID NO: 1617211 - DNA, 16 bp, Homo sapiens
gcctgctccagacctg

SEQ ID NO: 1617212 - DNA, 21 bp, Homo sapiens
gcctggtcagaaggccagccg

SEQ ID NO: 1617213 - DNA, 14 bp, Homo sapiens
gcctggtccctggg

SEQ ID NO: 1617214 - DNA, 13 bp, Homo sapiens
gcctggtgcattg

SEQ ID NO: 1617215 - DNA, 20 bp, Homo sapiens
gcctggtgcattgctgtgtg

SEQ ID NO: 1617216 - DNA, 15 bp, Homo sapiens
gcctggtgggcctcc

SEQ ID NO: 1617217 - DNA, 19 bp, Homo sapiens
gcctggttaatattaatat

SEQ ID NO: 1617218 - DNA, 20 bp, Homo sapiens
gcctgtaatcccagcacttt

SEQ ID NO: 1617219 - DNA, 18 bp, Homo sapiens
gcctgtaatcccagcagt

SEQ ID NO: 1617220 - DNA, 16 bp, Homo sapiens
gcctgtaatcccagct

SEQ ID NO: 1617221 - DNA, 16 bp, Homo sapiens
gcctgtagagttgctg

SEQ ID NO: 1617222 - DNA, 15 bp, Homo sapiens
gcctgtagggaactt

SEQ ID NO: 1617223 - DNA, 20 bp, Homo sapiens
gcctgtatttccaacaaact

SEQ ID NO: 1617224 - DNA, 20 bp, Homo sapiens
gcctgtcaccagagcttctc

SEQ ID NO: 1617225 - DNA, 20 bp, Homo sapiens
gcctgtcacgctctggtgca

SEQ ID NO: 1617226 - DNA, 20 bp, Homo sapiens
gcctgtcataggttttaaat

SEQ ID NO: 1617227 - DNA, 12 bp, Homo sapiens
gcctgtccagcc

SEQ ID NO: 1617228 - DNA, 18 bp, Homo sapiens
gcctgtcccttgcctctg

SEQ ID NO: 1617229 - DNA, 20 bp, Homo sapiens
gcctgtcctgacctgtctca

SEQ ID NO: 1617230 - DNA, 20 bp, Homo sapiens
gcctgtccttgaaaaacaaa

SEQ ID NO: 1617231 - DNA, 18 bp, Homo sapiens
gcctgtcgtgccagtcct

SEQ ID NO: 1617232 - DNA, 17 bp, Homo sapiens
gcctgtctcatccccag

SEQ ID NO: 1617233 - DNA, 22 bp, Homo sapiens
gcctgtctcatcttctgaagag

SEQ ID NO: 1617234 - DNA, 16 bp, Homo sapiens
gcctgtctggctcagg

SEQ ID NO: 1617235 - DNA, 14 bp, Homo sapiens
gcctgtctgtctct

SEQ ID NO: 1617236 - DNA, 20 bp, Homo sapiens
gcctgtctgtctctccatct

SEQ ID NO: 1617237 - DNA, 11 bp, Homo sapiens
gcctgtgaatc

SEQ ID NO: 1617238 - DNA, 15 bp, Homo sapiens
gcctgtgagccagtc

SEQ ID NO: 1617239 - DNA, 14 bp, Homo sapiens
gcctgtgaggcagg

SEQ ID NO: 1617240 - DNA, 18 bp, Homo sapiens
gcctgtgaggcaggggcg

SEQ ID NO: 1617241 - DNA, 24 bp, Homo sapiens
gcctgtgaggtgcagagtgcccag

SEQ ID NO: 1617242 - DNA, 18 bp, Homo sapiens
gcctgtgattaacttgct

SEQ ID NO: 1617243 - DNA, 20 bp, Homo sapiens
gcctgtgattaacttgctta

SEQ ID NO: 1617244 - DNA, 14 bp, Homo sapiens
gcctgtgcagcagc

SEQ ID NO: 1617245 - DNA, 15 bp, Homo sapiens
gcctgtgcagcagcc

SEQ ID NO: 1617246 - DNA, 19 bp, Homo sapiens
gcctgtgccacccaccagg

SEQ ID NO: 1617247 - DNA, 12 bp, Homo sapiens
gcctgtgcctgc

SEQ ID NO: 1617248 - DNA, 17 bp, Homo sapiens
gcctgtgctcctgccca

SEQ ID NO: 1617249 - DNA, 16 bp, Homo sapiens
gcctgtgctgggccag

SEQ ID NO: 1617250 - DNA, 22 bp, Homo sapiens
gcctgtgctgggccagtggctg

SEQ ID NO: 1617251 - DNA, 21 bp, Homo sapiens
gcctgtggcacagccctgagt

SEQ ID NO: 1617252 - DNA, 22 bp, Homo sapiens
gcctgtggcacagccctgagtg

SEQ ID NO: 1617253 - DNA, 19 bp, Homo sapiens
gcctgtggcgccgtctcca

SEQ ID NO: 1617254 - DNA, 18 bp, Homo sapiens
gcctgtggcggtgcctgg

SEQ ID NO: 1617255 - DNA, 21 bp, Homo sapiens
gcctgtggcttggagtggcca

SEQ ID NO: 1617256 - DNA, 11 bp, Homo sapiens
gcctgtgggag

SEQ ID NO: 1617257 - DNA, 15 bp, Homo sapiens
gcctgtgggagtaga

SEQ ID NO: 1617258 - DNA, 13 bp, Homo sapiens
gcctgtgggcttc

SEQ ID NO: 1617259 - DNA, 17 bp, Homo sapiens
gcctgtgggtctctgaa

SEQ ID NO: 1617260 - DNA, 18 bp, Homo sapiens
gcctgtgggtctctgaag

SEQ ID NO: 1617261 - DNA, 15 bp, Homo sapiens
gcctgtggtggctcc

SEQ ID NO: 1617262 - DNA, 23 bp, Homo sapiens
gcctgtggtggctccccctctgc

SEQ ID NO: 1617263 - DNA, 19 bp, Homo sapiens
gcctgtgtccatgcgctca

SEQ ID NO: 1617264 - DNA, 21 bp, Homo sapiens
gcctgtgtccatgcgctcagg

SEQ ID NO: 1617265 - DNA, 19 bp, Homo sapiens
gcctgtgtcccatgaccca

SEQ ID NO: 1617266 - DNA, 12 bp, Homo sapiens
gcctgtgtgtgt

SEQ ID NO: 1617267 - DNA, 14 bp, Homo sapiens
gcctgttccctaga

SEQ ID NO: 1617268 - DNA, 15 bp, Homo sapiens
gcctgttctcttggc

SEQ ID NO: 1617269 - DNA, 14 bp, Homo sapiens
gcctgttggcaggc

SEQ ID NO: 1617270 - DNA, 18 bp, Homo sapiens
gcctgttggcaggcccac

SEQ ID NO: 1617271 - DNA, 22 bp, Homo sapiens
gcctgttggcaggcccactccc

SEQ ID NO: 1617272 - DNA, 15 bp, Homo sapiens
gcctgttggctgctg

SEQ ID NO: 1617273 - DNA, 16 bp, Homo sapiens
gcctgttggctgctgc

SEQ ID NO: 1617274 - DNA, 17 bp, Homo sapiens
gcctgttggctgctgcg

SEQ ID NO: 1617275 - DNA, 21 bp, Homo sapiens
gcctgtttggcctctctatcc

SEQ ID NO: 1617276 - DNA, 22 bp, Homo sapiens
gccttaaaaggagagaagaaag

SEQ ID NO: 1617277 - DNA, 15 bp, Homo sapiens
gccttaaacacacat

SEQ ID NO: 1617278 - DNA, 14 bp, Homo sapiens
gccttaaagaggga

SEQ ID NO: 1617279 - DNA, 19 bp, Homo sapiens
gccttaaagagggacaggc

SEQ ID NO: 1617280 - DNA, 19 bp, Homo sapiens
gccttaactatttcacatg

SEQ ID NO: 1617281 - DNA, 16 bp, Homo sapiens
gccttaacttcttaaa

SEQ ID NO: 1617282 - DNA, 15 bp, Homo sapiens
gccttaagaactgtg

SEQ ID NO: 1617283 - DNA, 22 bp, Homo sapiens
gccttaagcagaacaaatgtgt

SEQ ID NO: 1617284 - DNA, 14 bp, Homo sapiens
gccttaagctgatc

SEQ ID NO: 1617285 - DNA, 16 bp, Homo sapiens
gccttaagctgatcct

SEQ ID NO: 1617286 - DNA, 15 bp, Homo sapiens
gccttaatacttttt

SEQ ID NO: 1617287 - DNA, 20 bp, Homo sapiens
gccttaatgacattcccctc

SEQ ID NO: 1617288 - DNA, 19 bp, Homo sapiens
gccttaatttcctttttga

SEQ ID NO: 1617289 - DNA, 22 bp, Homo sapiens
gccttacaaagggaaagcctct

SEQ ID NO: 1617290 - DNA, 19 bp, Homo sapiens
gccttacatcttttctaat

SEQ ID NO: 1617291 - DNA, 16 bp, Homo sapiens
gccttacctcctgccc

SEQ ID NO: 1617292 - DNA, 19 bp, Homo sapiens
gccttacctcctgcccagg

SEQ ID NO: 1617293 - DNA, 21 bp, Homo sapiens
gccttagccgcccatgcactg

SEQ ID NO: 1617294 - DNA, 18 bp, Homo sapiens
gccttagtctcagtttgt

SEQ ID NO: 1617295 - DNA, 18 bp, Homo sapiens
gccttattcaccttttta

SEQ ID NO: 1617296 - DNA, 21 bp, Homo sapiens
gccttattcacctttttaata

SEQ ID NO: 1617297 - DNA, 15 bp, Homo sapiens
gccttatttgtctgt

SEQ ID NO: 1617298 - DNA, 22 bp, Homo sapiens
gccttcaacaacgtgagagaaa

SEQ ID NO: 1617299 - DNA, 21 bp, Homo sapiens
gccttcaaggactgtttcagt

SEQ ID NO: 1617300 - DNA, 12 bp, Homo sapiens
gccttcaagtgc

SEQ ID NO: 1617301 - DNA, 15 bp, Homo sapiens
gccttcaataaatgg

SEQ ID NO: 1617302 - DNA, 17 bp, Homo sapiens
gccttcacaatctgtca

SEQ ID NO: 1617303 - DNA, 22 bp, Homo sapiens
gccttcacaatctgtcagttct

SEQ ID NO: 1617304 - DNA, 20 bp, Homo sapiens
gccttcactccggtgtgcct

SEQ ID NO: 1617305 - DNA, 21 bp, Homo sapiens
gccttcactgtgctccaacct

SEQ ID NO: 1617306 - DNA, 23 bp, Homo sapiens
gccttcactgtgctccaacctga

SEQ ID NO: 1617307 - DNA, 22 bp, Homo sapiens
gcgtggccacgggggcagtgtg

SEQ ID NO: 1617308 - DNA, 17 bp, Homo sapiens
gcgtggcgcaggtgcca

SEQ ID NO: 1617309 - DNA, 12 bp, Homo sapiens
gcgtggctgtgg

SEQ ID NO: 1617310 - DNA, 19 bp, Homo sapiens
gcgtggctgtggcacagac

SEQ ID NO: 1617311 - DNA, 16 bp, Homo sapiens
gcgtgggagccagcct

SEQ ID NO: 1617312 - DNA, 13 bp, Homo sapiens
gcgtggggagggc

SEQ ID NO: 1617313 - DNA, 22 bp, Homo sapiens
gcgtggtatacatgtgtacata

SEQ ID NO: 1617314 - DNA, 22 bp, Homo sapiens
gcgtggtgtggagtgtgtgtct

SEQ ID NO: 1617315 - DNA, 18 bp, Homo sapiens
gcgtggtgtgtccctgga

SEQ ID NO: 1617316 - DNA, 22 bp, Homo sapiens
gcgtggtgtgtccctggacaca

SEQ ID NO: 1617317 - DNA, 22 bp, Homo sapiens
gcgtgtgcatagcgtcctgccc

SEQ ID NO: 1617318 - DNA, 16 bp, Homo sapiens
gcgtgtgcgtgcgtgt

SEQ ID NO: 1617319 - DNA, 13 bp, Homo sapiens
gcgtgtggagcag

SEQ ID NO: 1617320 - DNA, 22 bp, Homo sapiens
gcgtgtgggtcccgcactctgc

SEQ ID NO: 1617321 - DNA, 21 bp, Homo sapiens
gcgtgtgggtctctgggcaca

SEQ ID NO: 1617322 - DNA, 13 bp, Homo sapiens
gcgtgtgtgacac

SEQ ID NO: 1617323 - DNA, 17 bp, Homo sapiens
gcgtgttcagcagaacc

SEQ ID NO: 1617324 - DNA, 17 bp, Homo sapiens
gcgttctgctgcccctg

SEQ ID NO: 1617325 - DNA, 19 bp, Homo sapiens
gcgttctgctgcccctgca

SEQ ID NO: 1617326 - DNA, 18 bp, Homo sapiens
gcgttctggactctgccc

SEQ ID NO: 1617327 - DNA, 15 bp, Homo sapiens
gcgttgggagcctag

SEQ ID NO: 1617328 - DNA, 15 bp, Homo sapiens
gcgttggtgccactt

SEQ ID NO: 1617329 - DNA, 23 bp, Homo sapiens
gcgtttagtttctagaggcctca

SEQ ID NO: 1617330 - DNA, 17 bp, Homo sapiens
gcgtttataattggctt

SEQ ID NO: 1617331 - DNA, 20 bp, Homo sapiens
gcgtttcaccatgttggcca

SEQ ID NO: 1617332 - DNA, 16 bp, Homo sapiens
gcgtttggaggcccct

SEQ ID NO: 1617333 - DNA, 16 bp, Homo sapiens
gcgttttgttgtagat

SEQ ID NO: 1617334 - DNA, 20 bp, Homo sapiens
gctaaaaaataaataaaagc

SEQ ID NO: 1617335 - DNA, 12 bp, Homo sapiens
gctaaaatgtta

SEQ ID NO: 1617336 - DNA, 18 bp, Homo sapiens
gctaaacaagtaagaaaa

SEQ ID NO: 1617337 - DNA, 20 bp, Homo sapiens
gctaaacccagatggtttcc

SEQ ID NO: 1617338 - DNA, 17 bp, Homo sapiens
gctaaactccttcctgg

SEQ ID NO: 1617339 - DNA, 22 bp, Homo sapiens
gctaaactccttcctggcctga

SEQ ID NO: 1617340 - DNA, 13 bp, Homo sapiens
gctatttatgcaa

SEQ ID NO: 1617341 - DNA, 18 bp, Homo sapiens
gctatttatgggcccctg

SEQ ID NO: 1617342 - DNA, 15 bp, Homo sapiens
gctatttattttcct

SEQ ID NO: 1617343 - DNA, 16 bp, Homo sapiens
gctatttattttccta

SEQ ID NO: 1617344 - DNA, 22 bp, Homo sapiens
gctatttattttcctaaagaga

SEQ ID NO: 1617345 - DNA, 14 bp, Homo sapiens
gctatttcatctat

SEQ ID NO: 1617346 - DNA, 15 bp, Homo sapiens
gctatttcatctatt

SEQ ID NO: 1617347 - DNA, 15 bp, Homo sapiens
gctatttctctcccc

SEQ ID NO: 1617348 - DNA, 15 bp, Homo sapiens
gctatttctcttgct

SEQ ID NO: 1617349 - DNA, 15 bp, Homo sapiens
gctatttctgtgtcc

SEQ ID NO: 1617350 - DNA, 12 bp, Homo sapiens
gctatttggaca

SEQ ID NO: 1617351 - DNA, 19 bp, Homo sapiens
gctatttgtacaaataaac

SEQ ID NO: 1617352 - DNA, 16 bp, Homo sapiens
gctatttgtgtgtatg

SEQ ID NO: 1617353 - DNA, 14 bp, Homo sapiens
gctatttgttcaga

SEQ ID NO: 1617354 - DNA, 17 bp, Homo sapiens
gctatttgttcagagag

SEQ ID NO: 1617355 - DNA, 19 bp, Homo sapiens
gctcaaaattgcttctaaa

SEQ ID NO: 1617356 - DNA, 22 bp, Homo sapiens
gctcaaaggtttggaaggagca

SEQ ID NO: 1617357 - DNA, 14 bp, Homo sapiens
gctcaaataaaaat

SEQ ID NO: 1617358 - DNA, 16 bp, Homo sapiens
gctcaaatgatcctcc

SEQ ID NO: 1617359 - DNA, 19 bp, Homo sapiens
gctcaaatgatcctcccac

SEQ ID NO: 1617360 - DNA, 15 bp, Homo sapiens
gctcaaccactgtgg

SEQ ID NO: 1617361 - DNA, 22 bp, Homo sapiens
gctcaaccactgtggcgttctg

SEQ ID NO: 1617362 - DNA, 20 bp, Homo sapiens
gctcaactcacagcttctcc

SEQ ID NO: 1617363 - DNA, 16 bp, Homo sapiens
gctcaagacaaggctg

SEQ ID NO: 1617364 - DNA, 19 bp, Homo sapiens
gctcaagatgacagctctt

SEQ ID NO: 1617365 - DNA, 21 bp, Homo sapiens
gctcaagccgcaagctctcag

SEQ ID NO: 1617366 - DNA, 16 bp, Homo sapiens
gctcaagggctggcac

SEQ ID NO: 1617367 - DNA, 16 bp, Homo sapiens
gctcaatccctgagga

SEQ ID NO: 1617368 - DNA, 21 bp, Homo sapiens
gctcaatgcattgtcttgtgg

SEQ ID NO: 1617369 - DNA, 23 bp, Homo sapiens
gctcaatgcattgtcttgtggag

SEQ ID NO: 1617370 - DNA, 17 bp, Homo sapiens
gctcaattcaagtgaca

SEQ ID NO: 1617371 - DNA, 20 bp, Homo sapiens
gctcaattcaagtgacacat

SEQ ID NO: 1617372 - DNA, 15 bp, Homo sapiens
gctcacaaggcccag

SEQ ID NO: 1617373 - DNA, 18 bp, Homo sapiens
gctcacaaggcccaggag

SEQ ID NO: 1617374 - DNA, 20 bp, Homo sapiens
gctcacaccctaccttcccc

SEQ ID NO: 1617375 - DNA, 22 bp, Homo sapiens
gctcacaccctaccttccccag

SEQ ID NO: 1617376 - DNA, 14 bp, Homo sapiens
gctcacactccagt

SEQ ID NO: 1617377 - DNA, 17 bp, Homo sapiens
gctcacactccagtggc

SEQ ID NO: 1617378 - DNA, 19 bp, Homo sapiens
gctcacactccagtggcag

SEQ ID NO: 1617379 - DNA, 12 bp, Homo sapiens
gcccctgggctc

SEQ ID NO: 1617380 - DNA, 19 bp, Homo sapiens
gcccctgggctctcaccca

SEQ ID NO: 1617381 - DNA, 20 bp, Homo sapiens
gcccctgggctctcacccag

SEQ ID NO: 1617382 - DNA, 23 bp, Homo sapiens
gcccctgggctctcacccagtcc

SEQ ID NO: 1617383 - DNA, 23 bp, Homo sapiens
gcccctggggctgtatttatctc

SEQ ID NO: 1617384 - DNA, 17 bp, Homo sapiens
gcccctgggtccttcta

SEQ ID NO: 1617385 - DNA, 20 bp, Homo sapiens
gcccctgggtgggtggtggg

SEQ ID NO: 1617386 - DNA, 15 bp, Homo sapiens
gcccctgtctcgggg

SEQ ID NO: 1617387 - DNA, 16 bp, Homo sapiens
gcccctgtctcggggc

SEQ ID NO: 1617388 - DNA, 14 bp, Homo sapiens
gcccctgtggccaa

SEQ ID NO: 1617389 - DNA, 15 bp, Homo sapiens
gcccctgtggccaac

SEQ ID NO: 1617390 - DNA, 16 bp, Homo sapiens
gcccctgtggccaact

SEQ ID NO: 1617391 - DNA, 20 bp, Homo sapiens
gcccctgtggccaactgcaa

SEQ ID NO: 1617392 - DNA, 21 bp, Homo sapiens
gcccctgtggccaactgcaaa

SEQ ID NO: 1617393 - DNA, 12 bp, Homo sapiens
gcccctgtgtga

SEQ ID NO: 1617394 - DNA, 18 bp, Homo sapiens
gccccttaagggttgaag

SEQ ID NO: 1617395 - DNA, 23 bp, Homo sapiens
gccccttaagggttgaaggcagt

SEQ ID NO: 1617396 - DNA, 20 bp, Homo sapiens
gccccttactatgatctcag

SEQ ID NO: 1617397 - DNA, 21 bp, Homo sapiens
gccccttactatgatctcagg

SEQ ID NO: 1617398 - DNA, 23 bp, Homo sapiens
gccccttactatgatctcaggag

SEQ ID NO: 1617399 - DNA, 18 bp, Homo sapiens
gccccttcactcattttt

SEQ ID NO: 1617400 - DNA, 22 bp, Homo sapiens
gccccttccatggtactgtagc

SEQ ID NO: 1617401 - DNA, 19 bp, Homo sapiens
gccccttctggccggtgct

SEQ ID NO: 1617402 - DNA, 14 bp, Homo sapiens
gccccttggagaga

SEQ ID NO: 1617403 - DNA, 13 bp, Homo sapiens
gccccttgggcat

SEQ ID NO: 1617404 - DNA, 22 bp, Homo sapiens
gccccttgggcatccacccagt

SEQ ID NO: 1617405 - DNA, 23 bp, Homo sapiens
gccccttgggcatccacccagtg

SEQ ID NO: 1617406 - DNA, 16 bp, Homo sapiens
gcccgaacagggactt

SEQ ID NO: 1617407 - DNA, 19 bp, Homo sapiens
gcccgacagcctggcacag

SEQ ID NO: 1617408 - DNA, 17 bp, Homo sapiens
gcccgacagtgccatcc

SEQ ID NO: 1617409 - DNA, 17 bp, Homo sapiens
gcccgacagttctgaac

SEQ ID NO: 1617410 - DNA, 16 bp, Homo sapiens
gcccgacatggctccg

SEQ ID NO: 1617411 - DNA, 18 bp, Homo sapiens
gcccgacttgctgttttg

SEQ ID NO: 1617412 - DNA, 14 bp, Homo sapiens
gcccgagagagctc

SEQ ID NO: 1617413 - DNA, 15 bp, Homo sapiens
gcccgatattctccc

SEQ ID NO: 1617414 - DNA, 16 bp, Homo sapiens
gcccgatattctccct

SEQ ID NO: 1617415 - DNA, 19 bp, Homo sapiens
gcccgcaccccggcctcag

SEQ ID NO: 1617416 - DNA, 20 bp, Homo sapiens
gcccgcaccccggcctcagg

SEQ ID NO: 1617417 - DNA, 21 bp, Homo sapiens
gcccgcaccccggcctcaggg

SEQ ID NO: 1617418 - DNA, 19 bp, Homo sapiens
gcccgcacccctccctgct

SEQ ID NO: 1617419 - DNA, 21 bp, Homo sapiens
gcccgcacccctccctgcttg

SEQ ID NO: 1617420 - DNA, 17 bp, Homo sapiens
gcccgcaccctggcctg

SEQ ID NO: 1617421 - DNA, 16 bp, Homo sapiens
gcccgcactgtcccag

SEQ ID NO: 1617422 - DNA, 21 bp, Homo sapiens
gcccgcactgtcccagtagcc

SEQ ID NO: 1617423 - DNA, 12 bp, Homo sapiens
gcccgcagggcc

SEQ ID NO: 1617424 - DNA, 19 bp, Homo sapiens
gcccgcagggccatgcaga

SEQ ID NO: 1617425 - DNA, 19 bp, Homo sapiens
gcccgcatgcggcccagga

SEQ ID NO: 1617426 - DNA, 21 bp, Homo sapiens
gcccgccaaggtagccatccc

SEQ ID NO: 1617427 - DNA, 18 bp, Homo sapiens
gcccgcctaggagttgag

SEQ ID NO: 1617428 - DNA, 23 bp, Homo sapiens
gcccgcctttcatctggattcta

SEQ ID NO: 1617429 - DNA, 16 bp, Homo sapiens
gcccgcgtgctggaga

SEQ ID NO: 1617430 - DNA, 18 bp, Homo sapiens
gcccgctcctgccgcaga

SEQ ID NO: 1617431 - DNA, 15 bp, Homo sapiens
gcccgctgggctgag

SEQ ID NO: 1617432 - DNA, 17 bp, Homo sapiens
gcccgctgggctgagcc

SEQ ID NO: 1617433 - DNA, 12 bp, Homo sapiens
gcccgcttggcc

SEQ ID NO: 1617434 - DNA, 15 bp, Homo sapiens
gcccgcttggccacc

SEQ ID NO: 1617435 - DNA, 14 bp, Homo sapiens
gcccggaccttggc

SEQ ID NO: 1617436 - DNA, 22 bp, Homo sapiens
gcccggactcaccaacttgcca

SEQ ID NO: 1617437 - DNA, 18 bp, Homo sapiens
gcccggagaaacctgatg

SEQ ID NO: 1617438 - DNA, 19 bp, Homo sapiens
gcccggagtaatcaggcag

SEQ ID NO: 1617439 - DNA, 20 bp, Homo sapiens
gcccggagtaatcaggcagc

SEQ ID NO: 1617440 - DNA, 17 bp, Homo sapiens
gcccggattctgggagg

SEQ ID NO: 1617441 - DNA, 11 bp, Homo sapiens
gcccggccagc

SEQ ID NO: 1617442 - DNA, 16 bp, Homo sapiens
gcccggccagcgggca

SEQ ID NO: 1617443 - DNA, 22 bp, Homo sapiens
gcccggccagcgggcacagggc

SEQ ID NO: 1617444 - DNA, 14 bp, Homo sapiens
gcccggcctgctcc

SEQ ID NO: 1617445 - DNA, 16 bp, Homo sapiens
gcccggcgccgggcac

SEQ ID NO: 1617446 - DNA, 20 bp, Homo sapiens
gcccggctacatcagccttc

SEQ ID NO: 1617447 - DNA, 15 bp, Homo sapiens
gcccggctgagcccc

SEQ ID NO: 1617448 - DNA, 18 bp, Homo sapiens
gcccggctgtgattgctg

SEQ ID NO: 1617449 - DNA, 13 bp, Homo sapiens
gcccgggctgcct

SEQ ID NO: 1617450 - DNA, 14 bp, Homo sapiens
gcccgggctgcctg

SEQ ID NO: 1617451 - DNA, 16 bp, Homo sapiens
gcccgggctgcctggg

SEQ ID NO: 1617452 - DNA, 14 bp, Homo sapiens
gcccggtgggtccg

SEQ ID NO: 1617453 - DNA, 14 bp, Homo sapiens
gcccgtcctgcctg

SEQ ID NO: 1617454 - DNA, 16 bp, Homo sapiens
gcccgtcctgcctgtg

SEQ ID NO: 1617455 - DNA, 17 bp, Homo sapiens
gcccgtcctgcctgtgg

SEQ ID NO: 1617456 - DNA, 18 bp, Homo sapiens
gcccgtcggagctgcctg

SEQ ID NO: 1617457 - DNA, 20 bp, Homo sapiens
gcccgtcggagctgcctgca

SEQ ID NO: 1617458 - DNA, 17 bp, Homo sapiens
gcccgtcttcagcctag

SEQ ID NO: 1617459 - DNA, 18 bp, Homo sapiens
gcccgtcttcagcctagc

SEQ ID NO: 1617460 - DNA, 14 bp, Homo sapiens
gcccgtgaagcagt

SEQ ID NO: 1617461 - DNA, 22 bp, Homo sapiens
gcccgtgaagcagtgcctcgag

SEQ ID NO: 1617462 - DNA, 21 bp, Homo sapiens
gcccgtgcccccgcctgccac

SEQ ID NO: 1617463 - DNA, 22 bp, Homo sapiens
gccccatgctctgccccaagcc

SEQ ID NO: 1617464 - DNA, 15 bp, Homo sapiens
gccccatgtctctca

SEQ ID NO: 1617465 - DNA, 17 bp, Homo sapiens
gcccccaaattgccttc

SEQ ID NO: 1617466 - DNA, 19 bp, Homo sapiens
gcccccaacctcagggctc

SEQ ID NO: 1617467 - DNA, 12 bp, Homo sapiens
gcccccaataaa

SEQ ID NO: 1617468 - DNA, 13 bp, Homo sapiens
gcccccaataaag

SEQ ID NO: 1617469 - DNA, 15 bp, Homo sapiens
gcccccaataaaggc

SEQ ID NO: 1617470 - DNA, 19 bp, Homo sapiens
gcccccaataaaggcagct

SEQ ID NO: 1617471 - DNA, 22 bp, Homo sapiens
gcccccaataaaggcagctgcc

SEQ ID NO: 1617472 - DNA, 24 bp, Homo sapiens
gcccccaataaaggcagctgcctc

SEQ ID NO: 1617473 - DNA, 11 bp, Homo sapiens
gcccccacagg

SEQ ID NO: 1617474 - DNA, 22 bp, Homo sapiens
gcccccaccccggggaccctgt

SEQ ID NO: 1617475 - DNA, 17 bp, Homo sapiens
gcccccacccctacagc

SEQ ID NO: 1617476 - DNA, 20 bp, Homo sapiens
gcccccacccctacagcctg

SEQ ID NO: 1617477 - DNA, 19 bp, Homo sapiens
gcccccaccccttccccag

SEQ ID NO: 1617478 - DNA, 17 bp, Homo sapiens
gcccccagccctgggaa

SEQ ID NO: 1617479 - DNA, 21 bp, Homo sapiens
gcccccagccctgggaaccac

SEQ ID NO: 1617480 - DNA, 15 bp, Homo sapiens
gcccccagctaagaa

SEQ ID NO: 1617481 - DNA, 13 bp, Homo sapiens
gcccccaggactg

SEQ ID NO: 1617482 - DNA, 15 bp, Homo sapiens
gcccccaggactggg

SEQ ID NO: 1617483 - DNA, 12 bp, Homo sapiens
gcccccagggcc

SEQ ID NO: 1617484 - DNA, 16 bp, Homo sapiens
gcccccagggcctcca

SEQ ID NO: 1617485 - DNA, 16 bp, Homo sapiens
gcccccaggggcagga

SEQ ID NO: 1617486 - DNA, 19 bp, Homo sapiens
gcccccaggggcaggactg

SEQ ID NO: 1617487 - DNA, 16 bp, Homo sapiens
gcccccaggtgccagt

SEQ ID NO: 1617488 - DNA, 19 bp, Homo sapiens
gcccccatctccccaggcc

SEQ ID NO: 1617489 - DNA, 17 bp, Homo sapiens
gcccccatggggtcctt

SEQ ID NO: 1617490 - DNA, 19 bp, Homo sapiens
gccccccacccctggaaga

SEQ ID NO: 1617491 - DNA, 19 bp, Homo sapiens
gcccccccaacactgtgcc

SEQ ID NO: 1617492 - DNA, 17 bp, Homo sapiens
gccccccgcacagccac

SEQ ID NO: 1617493 - DNA, 13 bp, Homo sapiens
gccccccgcagca

SEQ ID NO: 1617494 - DNA, 16 bp, Homo sapiens
gccccccgcagcaccc

SEQ ID NO: 1617495 - DNA, 20 bp, Homo sapiens
gccccccgcagcaccctgca

SEQ ID NO: 1617496 - DNA, 19 bp, Homo sapiens
gccccccgcgcgcccaccc

SEQ ID NO: 1617497 - DNA, 11 bp, Homo sapiens
gcccccctcaa

SEQ ID NO: 1617498 - DNA, 16 bp, Homo sapiens
gcccccctcaaacctc

SEQ ID NO: 1617499 - DNA, 14 bp, Homo sapiens
gcccccctcctcca

SEQ ID NO: 1617500 - DNA, 17 bp, Homo sapiens
gcccccgacggctgtga

SEQ ID NO: 1617501 - DNA, 19 bp, Homo sapiens
gcccccgcccgcacagctc

SEQ ID NO: 1617502 - DNA, 15 bp, Homo sapiens
gcccccgcctgggca

SEQ ID NO: 1617503 - DNA, 16 bp, Homo sapiens
gcccccgcctgggcac

SEQ ID NO: 1617504 - DNA, 16 bp, Homo sapiens
gcccccgcgggttcta

SEQ ID NO: 1617505 - DNA, 18 bp, Homo sapiens
gcccccgcgggttctaga

SEQ ID NO: 1617506 - DNA, 19 bp, Homo sapiens
gcccccggccacgctccct

SEQ ID NO: 1617507 - DNA, 21 bp, Homo sapiens
gcccccgtcagggagaggtca

SEQ ID NO: 1617508 - DNA, 15 bp, Homo sapiens
gccccctccagctca

SEQ ID NO: 1617509 - DNA, 17 bp, Homo sapiens
gccccctccaggagaga

SEQ ID NO: 1617510 - DNA, 18 bp, Homo sapiens
gccccctccgccctgcca

SEQ ID NO: 1617511 - DNA, 15 bp, Homo sapiens
gccccctcctctccc

SEQ ID NO: 1617512 - DNA, 16 bp, Homo sapiens
gccccaccggccaggc

SEQ ID NO: 1617513 - DNA, 17 bp, Homo sapiens
gccccacctacttgtga

SEQ ID NO: 1617514 - DNA, 23 bp, Homo sapiens
gccccacctacttgtgactgaag

SEQ ID NO: 1617515 - DNA, 19 bp, Homo sapiens
gccccacctcccccttccc

SEQ ID NO: 1617516 - DNA, 20 bp, Homo sapiens
gccccacctcccccttcccc

SEQ ID NO: 1617517 - DNA, 21 bp, Homo sapiens
gccccacctcccccttcccct

SEQ ID NO: 1617518 - DNA, 14 bp, Homo sapiens
gccccacctgcctg

SEQ ID NO: 1617519 - DNA, 15 bp, Homo sapiens
gccccacctgcctgg

SEQ ID NO: 1617520 - DNA, 17 bp, Homo sapiens
gccccaccttgtctgct

SEQ ID NO: 1617521 - DNA, 20 bp, Homo sapiens
gccccacctttattaaaatc

SEQ ID NO: 1617522 - DNA, 12 bp, Homo sapiens
gccccactccag

SEQ ID NO: 1617523 - DNA, 18 bp, Homo sapiens
gccccactccagcctggg

SEQ ID NO: 1617524 - DNA, 22 bp, Homo sapiens
gccccactccagcctggggacc

SEQ ID NO: 1617525 - DNA, 20 bp, Homo sapiens
gccccactcccttgctggcc

SEQ ID NO: 1617526 - DNA, 22 bp, Homo sapiens
gccccactcccttgctggcccc

SEQ ID NO: 1617527 - DNA, 23 bp, Homo sapiens
gccccactcccttgctggcccca

SEQ ID NO: 1617528 - DNA, 16 bp, Homo sapiens
gccccactgccagcag

SEQ ID NO: 1617529 - DNA, 20 bp, Homo sapiens
gccccactgccagcagcagc

SEQ ID NO: 1617530 - DNA, 23 bp, Homo sapiens
gccccactgccagcagcagcagg

SEQ ID NO: 1617531 - DNA, 14 bp, Homo sapiens
gccccacttcaccc

SEQ ID NO: 1617532 - DNA, 17 bp, Homo sapiens
gccccacttcaccccca

SEQ ID NO: 1617533 - DNA, 16 bp, Homo sapiens
gccccactttgaaggg

SEQ ID NO: 1617534 - DNA, 18 bp, Homo sapiens
gccccagactgggcccag

SEQ ID NO: 1617535 - DNA, 19 bp, Homo sapiens
gccccagactgggcccagg

SEQ ID NO: 1617536 - DNA, 13 bp, Homo sapiens
gccccagaggccc

SEQ ID NO: 1617537 - DNA, 22 bp, Homo sapiens
gccccagaggccctggaggtct

SEQ ID NO: 1617538 - DNA, 18 bp, Homo sapiens
gccccagaggtcgcagct

SEQ ID NO: 1617539 - DNA, 15 bp, Homo sapiens
gccccagatctgcct

SEQ ID NO: 1617540 - DNA, 17 bp, Homo sapiens
gccccagatctgcctgg

SEQ ID NO: 1617541 - DNA, 21 bp, Homo sapiens
gccccagatctgcctgggcct

SEQ ID NO: 1617542 - DNA, 23 bp, Homo sapiens
gccccagatctgcctgggcctgt

SEQ ID NO: 1617543 - DNA, 19 bp, Homo sapiens
gccccagcacctcagcctg

SEQ ID NO: 1617544 - DNA, 12 bp, Homo sapiens
gccccagcacta

SEQ ID NO: 1617545 - DNA, 11 bp, Homo sapiens
gccccagccag

SEQ ID NO: 1617546 - DNA, 18 bp, Homo sapiens
gccccagcctgtccttgt

SEQ ID NO: 1617547 - DNA, 12 bp, Homo sapiens
gccccagctctg

SEQ ID NO: 1617548 - DNA, 13 bp, Homo sapiens
gccccagctctgg

SEQ ID NO: 1617549 - DNA, 14 bp, Homo sapiens
gccccagctctgga

SEQ ID NO: 1617550 - DNA, 15 bp, Homo sapiens
gccccaggaccagct

SEQ ID NO: 1617551 - DNA, 23 bp, Homo sapiens
gccccaggatgccacgcctggaa

SEQ ID NO: 1617552 - DNA, 15 bp, Homo sapiens
gccccaggccggagc

SEQ ID NO: 1617553 - DNA, 16 bp, Homo sapiens
gccccaggccggagcc

SEQ ID NO: 1617554 - DNA, 18 bp, Homo sapiens
gccccaggggcagcaagg

SEQ ID NO: 1617555 - DNA, 14 bp, Homo sapiens
gccccagtgccaag

SEQ ID NO: 1617556 - DNA, 19 bp, Homo sapiens
gccccagtgctggaaggga

SEQ ID NO: 1617557 - DNA, 19 bp, Homo sapiens
gccccagtggctgttctgg

SEQ ID NO: 1617558 - DNA, 18 bp, Homo sapiens
gccccagttcaatctccc

SEQ ID NO: 1617559 - DNA, 17 bp, Homo sapiens
gccccatcattgcacct

SEQ ID NO: 1617560 - DNA, 19 bp, Homo sapiens
gccccatccagacctggct

SEQ ID NO: 1617561 - DNA, 17 bp, Homo sapiens
gccccatctcatcctgg

SEQ ID NO: 1617562 - DNA, 18 bp, Homo sapiens
gccccatctcatcctggc

SEQ ID NO: 1617563 - DNA, 14 bp, Homo sapiens
gccccatgcctgtc

SEQ ID NO: 1617564 - DNA, 17 bp, Homo sapiens
gccccatgcctgtccag

SEQ ID NO: 1617565 - DNA, 15 bp, Homo sapiens
gccccatgctctgcc

SEQ ID NO: 1617566 - DNA, 16 bp, Homo sapiens
gcccagctgggctctg

SEQ ID NO: 1617567 - DNA, 23 bp, Homo sapiens
gcccagctgggctctgccaccct

SEQ ID NO: 1617568 - DNA, 14 bp, Homo sapiens
gcccagctgtagcc

SEQ ID NO: 1617569 - DNA, 19 bp, Homo sapiens
gcccagctgtagccatggc

SEQ ID NO: 1617570 - DNA, 13 bp, Homo sapiens
gcccagcttgggc

SEQ ID NO: 1617571 - DNA, 14 bp, Homo sapiens
gcccagcttgggcc

SEQ ID NO: 1617572 - DNA, 15 bp, Homo sapiens
gcccagcttgggccc

SEQ ID NO: 1617573 - DNA, 16 bp, Homo sapiens
gcccagcttgggccca

SEQ ID NO: 1617574 - DNA, 23 bp, Homo sapiens
gcccagcttgggcccagctgggc

SEQ ID NO: 1617575 - DNA, 13 bp, Homo sapiens
gcccaggacagct

SEQ ID NO: 1617576 - DNA, 16 bp, Homo sapiens
gcccaggacagctggt

SEQ ID NO: 1617577 - DNA, 18 bp, Homo sapiens
gcccaggagagccagccc

SEQ ID NO: 1617578 - DNA, 19 bp, Homo sapiens
gcccaggagagccagccct

SEQ ID NO: 1617579 - DNA, 21 bp, Homo sapiens
gcccaggagagccagccctcc

SEQ ID NO: 1617580 - DNA, 14 bp, Homo sapiens
gcccaggagcagct

SEQ ID NO: 1617581 - DNA, 16 bp, Homo sapiens
gcccaggagctctgcg

SEQ ID NO: 1617582 - DNA, 17 bp, Homo sapiens
gcccaggagctctgcgc

SEQ ID NO: 1617583 - DNA, 21 bp, Homo sapiens
gcccaggagctctgcgccagg

SEQ ID NO: 1617584 - DNA, 23 bp, Homo sapiens
gcccaggagctctgcgccaggca

SEQ ID NO: 1617585 - DNA, 21 bp, Homo sapiens
gcccaggagctgagtcacctc

SEQ ID NO: 1617586 - DNA, 22 bp, Homo sapiens
gcccaggagctgagtcacctcc

SEQ ID NO: 1617587 - DNA, 20 bp, Homo sapiens
gcccaggatactggcacaga

SEQ ID NO: 1617588 - DNA, 22 bp, Homo sapiens
gcccaggatactggcacagagg

SEQ ID NO: 1617589 - DNA, 23 bp, Homo sapiens
gcccaggatactggcacagaggt

SEQ ID NO: 1617590 - DNA, 15 bp, Homo sapiens
gcccaggatggcttt

SEQ ID NO: 1617591 - DNA, 19 bp, Homo sapiens
gcccaggcaccaccaggag

SEQ ID NO: 1617592 - DNA, 22 bp, Homo sapiens
gcccaggcaccaccaggagcag

SEQ ID NO: 1617593 - DNA, 16 bp, Homo sapiens
gcccaggcccttggct

SEQ ID NO: 1617594 - DNA, 23 bp, Homo sapiens
gcccaggccggggtggagcatgg

SEQ ID NO: 1617595 - DNA, 22 bp, Homo sapiens
gcccaggccgttccccttggct

SEQ ID NO: 1617596 - DNA, 23 bp, Homo sapiens
gcccaggctcggaggaccctgga

SEQ ID NO: 1617597 - DNA, 20 bp, Homo sapiens
gcccaggctggagtgcagtg

SEQ ID NO: 1617598 - DNA, 11 bp, Homo sapiens
gcccaggcttc

SEQ ID NO: 1617599 - DNA, 20 bp, Homo sapiens
gcccaggcttcctgggtcct

SEQ ID NO: 1617600 - DNA, 18 bp, Homo sapiens
gcccagggcatcttgctg

SEQ ID NO: 1617601 - DNA, 23 bp, Homo sapiens
gcccagggcatcttgctggctac

SEQ ID NO: 1617602 - DNA, 13 bp, Homo sapiens
gcccagggccact

SEQ ID NO: 1617603 - DNA, 20 bp, Homo sapiens
gcccagggccactctgcctc

SEQ ID NO: 1617604 - DNA, 22 bp, Homo sapiens
gcccagggccactctgcctctg

SEQ ID NO: 1617605 - DNA, 18 bp, Homo sapiens
gcccagggccagtgggac

SEQ ID NO: 1617606 - DNA, 15 bp, Homo sapiens
gcccagggcccagag

SEQ ID NO: 1617607 - DNA, 16 bp, Homo sapiens
gcccagggcccagagc

SEQ ID NO: 1617608 - DNA, 20 bp, Homo sapiens
gcccagggcccagagcccag

SEQ ID NO: 1617609 - DNA, 14 bp, Homo sapiens
gcccagggcctaga

SEQ ID NO: 1617610 - DNA, 17 bp, Homo sapiens
gcccagggctcagcctg

SEQ ID NO: 1617611 - DNA, 14 bp, Homo sapiens
gcccagggctcctg

SEQ ID NO: 1617612 - DNA, 21 bp, Homo sapiens
gcccagggctgggaggaagga

SEQ ID NO: 1617613 - DNA, 23 bp, Homo sapiens
gagaacagtggttgcctgggggc

SEQ ID NO: 1617614 - DNA, 13 bp, Homo sapiens
gagaaccaaatct

SEQ ID NO: 1617615 - DNA, 18 bp, Homo sapiens
gagaaccaaatctggaag

SEQ ID NO: 1617616 - DNA, 16 bp, Homo sapiens
gagaaccaccactgcc

SEQ ID NO: 1617617 - DNA, 16 bp, Homo sapiens
gagaacccagtttccc

SEQ ID NO: 1617618 - DNA, 23 bp, Homo sapiens
gagaacctcaggtacggagaaga

SEQ ID NO: 1617619 - DNA, 18 bp, Homo sapiens
gagaacgccagtctccca

SEQ ID NO: 1617620 - DNA, 22 bp, Homo sapiens
gagaactcgcgctcagtaaacg

SEQ ID NO: 1617621 - DNA, 22 bp, Homo sapiens
gagaactctctccctggtctct

SEQ ID NO: 1617622 - DNA, 13 bp, Homo sapiens
gagaactgggatt

SEQ ID NO: 1617623 - DNA, 20 bp, Homo sapiens
gagaactgggatttgaaccc

SEQ ID NO: 1617624 - DNA, 23 bp, Homo sapiens
gagaactggggttcaagcccagg

SEQ ID NO: 1617625 - DNA, 15 bp, Homo sapiens
gagaactttcatttt

SEQ ID NO: 1617626 - DNA, 23 bp, Homo sapiens
gagaagaaggaagatcttgagag

SEQ ID NO: 1617627 - DNA, 14 bp, Homo sapiens
gagaagagaaaatg

SEQ ID NO: 1617628 - DNA, 12 bp, Homo sapiens
gagaagagagga

SEQ ID NO: 1617629 - DNA, 22 bp, Homo sapiens
gagaagagctgttcacagccag

SEQ ID NO: 1617630 - DNA, 21 bp, Homo sapiens
gagaagagcttgcacagccaa

SEQ ID NO: 1617631 - DNA, 16 bp, Homo sapiens
gagaagagggcctgtg

SEQ ID NO: 1617632 - DNA, 16 bp, Homo sapiens
gagaagatcgcatggc

SEQ ID NO: 1617633 - DNA, 22 bp, Homo sapiens
gagaagcaagtaaaaaggctaa

SEQ ID NO: 1617634 - DNA, 18 bp, Homo sapiens
gagaagcagtgagccgca

SEQ ID NO: 1617635 - DNA, 13 bp, Homo sapiens
gagaagccacagg

SEQ ID NO: 1617636 - DNA, 18 bp, Homo sapiens
gagaagccacaggcctga

SEQ ID NO: 1617637 - DNA, 22 bp, Homo sapiens
gagaagccacaggcctgagatt

SEQ ID NO: 1617638 - DNA, 11 bp, Homo sapiens
gagaagccagc

SEQ ID NO: 1617639 - DNA, 15 bp, Homo sapiens
gagaagcccgtgtga

SEQ ID NO: 1617640 - DNA, 13 bp, Homo sapiens
gagaagccttcag

SEQ ID NO: 1617641 - DNA, 18 bp, Homo sapiens
gagaagccttcagctcca

SEQ ID NO: 1617642 - DNA, 22 bp, Homo sapiens
gagaagctcctctccccagccc

SEQ ID NO: 1617643 - DNA, 14 bp, Homo sapiens
gagaagctcctgct

SEQ ID NO: 1617644 - DNA, 13 bp, Homo sapiens
gagaagctctgaa

SEQ ID NO: 1617645 - DNA, 16 bp, Homo sapiens
gagaagctgatccagt

SEQ ID NO: 1617646 - DNA, 13 bp, Homo sapiens
gagaagctgctga

SEQ ID NO: 1617647 - DNA, 21 bp, Homo sapiens
gagaagcttctaattagatca

SEQ ID NO: 1617648 - DNA, 22 bp, Homo sapiens
gagaagcttgtggtgttcctga

SEQ ID NO: 1617649 - DNA, 13 bp, Homo sapiens
gagaaggaacagg

SEQ ID NO: 1617650 - DNA, 14 bp, Homo sapiens
gagaaggaaggaga

SEQ ID NO: 1617651 - DNA, 12 bp, Homo sapiens
gagaaggaaggg

SEQ ID NO: 1617652 - DNA, 23 bp, Homo sapiens
gagaaggacccggaggggcctgg

SEQ ID NO: 1617653 - DNA, 21 bp, Homo sapiens
gagaaggcagtagttttcaaa

SEQ ID NO: 1617654 - DNA, 21 bp, Homo sapiens
gagaaggcccataccttctgg

SEQ ID NO: 1617655 - DNA, 13 bp, Homo sapiens
gagaaggctatgt

SEQ ID NO: 1617656 - DNA, 20 bp, Homo sapiens
gagaagggaatcctcctcca

SEQ ID NO: 1617657 - DNA, 12 bp, Homo sapiens
gagaagggaggg

SEQ ID NO: 1617658 - DNA, 15 bp, Homo sapiens
gagaagggctggggc

SEQ ID NO: 1617659 - DNA, 16 bp, Homo sapiens
gagaagggctggggcc

SEQ ID NO: 1617660 - DNA, 19 bp, Homo sapiens
gagaagggggctctgcccc

SEQ ID NO: 1617661 - DNA, 19 bp, Homo sapiens
gagaagggggtctctgtta

SEQ ID NO: 1617662 - DNA, 20 bp, Homo sapiens
gagaagggttctgccctgcc

SEQ ID NO: 1617663 - DNA, 23 bp, Homo sapiens
gagaagggttctgccctgcctga

SEQ ID NO: 1617664 - DNA, 17 bp, Homo sapiens
gagaaggtggacctggc

SEQ ID NO: 1617665 - DNA, 18 bp, Homo sapiens
gagaagtcaaacatttca

SEQ ID NO: 1617666 - DNA, 23 bp, Homo sapiens
gagaagtcactcacactggccac

SEQ ID NO: 1617667 - DNA, 22 bp, Homo sapiens
gagaagtctcagctaagctcac

SEQ ID NO: 1617668 - DNA, 17 bp, Homo sapiens
gagaagtgaatgctggg

SEQ ID NO: 1617669 - DNA, 19 bp, Homo sapiens
gagaagtgaatgctgggac

SEQ ID NO: 1617670 - DNA, 14 bp, Homo sapiens
gagaagtgctccct

SEQ ID NO: 1617671 - DNA, 20 bp, Homo sapiens
gagaagtgctccctggaggc

SEQ ID NO: 1617672 - DNA, 16 bp, Homo sapiens
gagaagttgtaaagta

SEQ ID NO: 1617673 - DNA, 23 bp, Homo sapiens
gagaataaattggattattttct

SEQ ID NO: 1617674 - DNA, 20 bp, Homo sapiens
gagaataagagagtcataaa

SEQ ID NO: 1617675 - DNA, 13 bp, Homo sapiens
gagaatacataaa

SEQ ID NO: 1617676 - DNA, 19 bp, Homo sapiens
gagaatagagctgccactg

SEQ ID NO: 1617677 - DNA, 23 bp, Homo sapiens
gagaatagcagagagccaaatct

SEQ ID NO: 1617678 - DNA, 14 bp, Homo sapiens
gagaatatatacat

SEQ ID NO: 1617679 - DNA, 20 bp, Homo sapiens
gagaatcagatcatttcaaa

SEQ ID NO: 1617680 - DNA, 21 bp, Homo sapiens
gagaatcatacttagcaaagt

SEQ ID NO: 1617681 - DNA, 17 bp, Homo sapiens
gagaatctcaacatgtc

SEQ ID NO: 1617682 - DNA, 22 bp, Homo sapiens
gagaatgagagcgacacagacg

SEQ ID NO: 1617683 - DNA, 23 bp, Homo sapiens
gagaatgagtccttgatttcaaa

SEQ ID NO: 1617684 - DNA, 18 bp, Homo sapiens
gccaaggcagcgacccca

SEQ ID NO: 1617685 - DNA, 15 bp, Homo sapiens
gccaaggcaggtaga

SEQ ID NO: 1617686 - DNA, 15 bp, Homo sapiens
gccaaggccgccagc

SEQ ID NO: 1617687 - DNA, 16 bp, Homo sapiens
gccaaggccgccagcg

SEQ ID NO: 1617688 - DNA, 17 bp, Homo sapiens
gccaaggccgccagcgt

SEQ ID NO: 1617689 - DNA, 15 bp, Homo sapiens
gccaaggccttctcc

SEQ ID NO: 1617690 - DNA, 18 bp, Homo sapiens
gccaaggccttctcctcc

SEQ ID NO: 1617691 - DNA, 18 bp, Homo sapiens
gccaagggaacctgtgtc

SEQ ID NO: 1617692 - DNA, 20 bp, Homo sapiens
gccaagggcccaaagaaaga

SEQ ID NO: 1617693 - DNA, 17 bp, Homo sapiens
gccaagggggtgactgg

SEQ ID NO: 1617694 - DNA, 22 bp, Homo sapiens
gccaaggtagccatcccatgaa

SEQ ID NO: 1617695 - DNA, 16 bp, Homo sapiens
gccaaggtcctgctca

SEQ ID NO: 1617696 - DNA, 17 bp, Homo sapiens
gccaaggtggagggaag

SEQ ID NO: 1617697 - DNA, 18 bp, Homo sapiens
gccaaggtgggctgagcc

SEQ ID NO: 1617698 - DNA, 14 bp, Homo sapiens
gccaaggtgtccag

SEQ ID NO: 1617699 - DNA, 22 bp, Homo sapiens
gccaaggtgtccagggtcctct

SEQ ID NO: 1617700 - DNA, 20 bp, Homo sapiens
gccaaggttttataaggctg

SEQ ID NO: 1617701 - DNA, 16 bp, Homo sapiens
gccaagtaaacagggt

SEQ ID NO: 1617702 - DNA, 21 bp, Homo sapiens
gccaagtccgcagaagccctg

SEQ ID NO: 1617703 - DNA, 20 bp, Homo sapiens
gccaagtcctagctcctcct

SEQ ID NO: 1617704 - DNA, 13 bp, Homo sapiens
gccaagtgaagaa

SEQ ID NO: 1617705 - DNA, 15 bp, Homo sapiens
gccaagtttatatac

SEQ ID NO: 1617706 - DNA, 17 bp, Homo sapiens
gccaagtttatatacaa

SEQ ID NO: 1617707 - DNA, 20 bp, Homo sapiens
gccaataaagcttttggaag

SEQ ID NO: 1617708 - DNA, 13 bp, Homo sapiens
gccaatcccctcc

SEQ ID NO: 1617709 - DNA, 21 bp, Homo sapiens
gccaatcccctccttgggcac

SEQ ID NO: 1617710 - DNA, 17 bp, Homo sapiens
gccaatgaacagctcct

SEQ ID NO: 1617711 - DNA, 22 bp, Homo sapiens
gccaatgaggtctgaaatggag

SEQ ID NO: 1617712 - DNA, 16 bp, Homo sapiens
gccaatggtgcttccc

SEQ ID NO: 1617713 - DNA, 12 bp, Homo sapiens
gccaatgttata

SEQ ID NO: 1617714 - DNA, 17 bp, Homo sapiens
gccaatgttgctgatgg

SEQ ID NO: 1617715 - DNA, 13 bp, Homo sapiens
gccaattgctacc

SEQ ID NO: 1617716 - DNA, 16 bp, Homo sapiens
gccaatttcctctcca

SEQ ID NO: 1617717 - DNA, 15 bp, Homo sapiens
gccacaaaaacaggt

SEQ ID NO: 1617718 - DNA, 18 bp, Homo sapiens
gccacaaggacttcctgt

SEQ ID NO: 1617719 - DNA, 21 bp, Homo sapiens
gccacaaggacttcctgtcca

SEQ ID NO: 1617720 - DNA, 20 bp, Homo sapiens
gccacaatgcagttctgagc

SEQ ID NO: 1617721 - DNA, 17 bp, Homo sapiens
gccacacgtggctggcg

SEQ ID NO: 1617722 - DNA, 13 bp, Homo sapiens
gccacactgggcc

SEQ ID NO: 1617723 - DNA, 14 bp, Homo sapiens
gccacactgggcct

SEQ ID NO: 1617724 - DNA, 17 bp, Homo sapiens
gccacactgggcctgga

SEQ ID NO: 1617725 - DNA, 22 bp, Homo sapiens
gccacacttcaggctcttctcc

SEQ ID NO: 1617726 - DNA, 14 bp, Homo sapiens
gccacagaccacct

SEQ ID NO: 1617727 - DNA, 17 bp, Homo sapiens
gccacagaccacctgct

SEQ ID NO: 1617728 - DNA, 21 bp, Homo sapiens
gccacagaccacctgcttctg

SEQ ID NO: 1617729 - DNA, 23 bp, Homo sapiens
gccacagagaagtttgtagccag

SEQ ID NO: 1617730 - DNA, 19 bp, Homo sapiens
gccacagcccagccacgga

SEQ ID NO: 1617731 - DNA, 18 bp, Homo sapiens
gccacagctgctggagaa

SEQ ID NO: 1617732 - DNA, 13 bp, Homo sapiens
gccacagcttttg

SEQ ID NO: 1617733 - DNA, 15 bp, Homo sapiens
gccacagcttttgca

SEQ ID NO: 1617734 - DNA, 20 bp, Homo sapiens
gccacaggccaaatccttgg

SEQ ID NO: 1617735 - DNA, 15 bp, Homo sapiens
gccacagtgggatga

SEQ ID NO: 1617736 - DNA, 17 bp, Homo sapiens
gccacatgccccaggct

SEQ ID NO: 1617737 - DNA, 15 bp, Homo sapiens
gccacattgctggct

SEQ ID NO: 1617738 - DNA, 16 bp, Homo sapiens
gccaccaaagctgccc

SEQ ID NO: 1617739 - DNA, 16 bp, Homo sapiens
gccaccaacactgctc

SEQ ID NO: 1617740 - DNA, 16 bp, Homo sapiens
gccaccacccacccca

SEQ ID NO: 1617741 - DNA, 13 bp, Homo sapiens
gccaccaccctgc

SEQ ID NO: 1617742 - DNA, 14 bp, Homo sapiens
gccaccaccctgcc

SEQ ID NO: 1617743 - DNA, 23 bp, Homo sapiens
gccaccacctttggctggtagca

SEQ ID NO: 1617744 - DNA, 16 bp, Homo sapiens
gccaccacgtccagct

SEQ ID NO: 1617745 - DNA, 20 bp, Homo sapiens
gccaccacgtctgccaggcc

SEQ ID NO: 1617746 - DNA, 21 bp, Homo sapiens
gccaccacgtctgccaggccc

SEQ ID NO: 1617747 - DNA, 12 bp, Homo sapiens
gccaccagacca

SEQ ID NO: 1617748 - DNA, 15 bp, Homo sapiens
gccaccaggccacct

SEQ ID NO: 1617749 - DNA, 13 bp, Homo sapiens
gccaccaggctgg

SEQ ID NO: 1617750 - DNA, 18 bp, Homo sapiens
gccaccaggctggcgcag

SEQ ID NO: 1617751 - DNA, 19 bp, Homo sapiens
gccaccaggctggcgcagc

SEQ ID NO: 1617752 - DNA, 22 bp, Homo sapiens
gccaccatattcagtgctgtgg

SEQ ID NO: 1617753 - DNA, 18 bp, Homo sapiens
gccaccatcctattgcaa

SEQ ID NO: 1617754 - DNA, 17 bp, Homo sapiens
gccaccatggccagcca

SEQ ID NO: 1617755 - DNA, 18 bp, Homo sapiens
gccacccaagcctgctgg

SEQ ID NO: 1617756 - DNA, 16 bp, Homo sapiens
gccacccactgaccca

SEQ ID NO: 1617757 - DNA, 20 bp, Homo sapiens
gccacccatcgtccacccca

SEQ ID NO: 1617758 - DNA, 22 bp, Homo sapiens
gccacccatgcagctgctcccc

SEQ ID NO: 1617759 - DNA, 15 bp, Homo sapiens
gccacccccttccct

SEQ ID NO: 1617760 - DNA, 19 bp, Homo sapiens
gccacccccttccctggga

SEQ ID NO: 1617761 - DNA, 15 bp, Homo sapiens
gccacccctccttcc

SEQ ID NO: 1617762 - DNA, 21 bp, Homo sapiens
gccacccgtggggtgctgccc

SEQ ID NO: 1617763 - DNA, 21 bp, Homo sapiens
gccacccgttctgctggcctg

SEQ ID NO: 1617764 - DNA, 23 bp, Homo sapiens
gccacccgttctgctggcctgga

SEQ ID NO: 1617765 - DNA, 13 bp, Homo sapiens
gccaccctacctg

SEQ ID NO: 1617766 - DNA, 21 bp, Homo sapiens
gccaccctcccctatgctggt

SEQ ID NO: 1617767 - DNA, 20 bp, Homo sapiens
gccaccggaggtcactccac

SEQ ID NO: 1617768 - DNA, 23 bp, Homo sapiens
gccaccggcctgtgggtctctga

SEQ ID NO: 1617769 - DNA, 18 bp, Homo sapiens
gccaccgggacagacctg

SEQ ID NO: 1617770 - DNA, 24 bp, Homo sapiens
gccaccgtttcttcctgccagcag

SEQ ID NO: 1617771 - DNA, 22 bp, Homo sapiens
gccacctagaagtctccctgca

SEQ ID NO: 1617772 - DNA, 13 bp, Homo sapiens
gccacctcccacc

SEQ ID NO: 1617773 - DNA, 14 bp, Homo sapiens
gccacctcccaccc

SEQ ID NO: 1617774 - DNA, 16 bp, Homo sapiens
gccacctcccacccca

SEQ ID NO: 1617775 - DNA, 19 bp, Homo sapiens
gccacctcccaccccactc

SEQ ID NO: 1617776 - DNA, 20 bp, Homo sapiens
gccacctcccactcctgctg

SEQ ID NO: 1617777 - DNA, 22 bp, Homo sapiens
gccacctcccactcctgctgca

SEQ ID NO: 1617778 - DNA, 11 bp, Homo sapiens
gccacctcccc

SEQ ID NO: 1617779 - DNA, 12 bp, Homo sapiens
gccacctcccct

SEQ ID NO: 1617780 - DNA, 17 bp, Homo sapiens
gccacctcccctatcca

SEQ ID NO: 1617781 - DNA, 22 bp, Homo sapiens
gccacctcctccccctgttctg

SEQ ID NO: 1617782 - DNA, 22 bp, Homo sapiens
gccacctctccaagggcttctg

SEQ ID NO: 1617783 - DNA, 23 bp, Homo sapiens
gccacctctccaagggcttctgc

SEQ ID NO: 1617784 - DNA, 13 bp, Homo sapiens
gccacctctctcc

SEQ ID NO: 1617785 - DNA, 16 bp, Homo sapiens
gccacctctctccttt

SEQ ID NO: 1617786 - DNA, 15 bp, Homo sapiens
gccacctctgcctct

SEQ ID NO: 1617787 - DNA, 15 bp, Homo sapiens
gccacctgaggtggg

SEQ ID NO: 1617788 - DNA, 18 bp, Homo sapiens
gccacctgaggtgggccc

SEQ ID NO: 1617789 - DNA, 20 bp, Homo sapiens
gccacctgaggtgggcccag

SEQ ID NO: 1617790 - DNA, 23 bp, Homo sapiens
gccacctgaggtgggctggggct

SEQ ID NO: 1617791 - DNA, 13 bp, Homo sapiens
gccacctgcaaga

SEQ ID NO: 1617792 - DNA, 14 bp, Homo sapiens
gccacgactgccat

SEQ ID NO: 1617793 - DNA, 16 bp, Homo sapiens
gccacgcagccaggac

SEQ ID NO: 1617794 - DNA, 13 bp, Homo sapiens
gccacgcctggaa

SEQ ID NO: 1617795 - DNA, 15 bp, Homo sapiens
gccacgcctggaagg

SEQ ID NO: 1617796 - DNA, 14 bp, Homo sapiens
gccacgctccagct

SEQ ID NO: 1617797 - DNA, 17 bp, Homo sapiens
gcataatgtccctctct

SEQ ID NO: 1617798 - DNA, 11 bp, Homo sapiens
gcatacaaaat

SEQ ID NO: 1617799 - DNA, 14 bp, Homo sapiens
gcatacaaaatatt

SEQ ID NO: 1617800 - DNA, 17 bp, Homo sapiens
gcatacacacatgccct

SEQ ID NO: 1617801 - DNA, 21 bp, Homo sapiens
gcatacacacatgccctcctg

SEQ ID NO: 1617802 - DNA, 14 bp, Homo sapiens
gcatacagttttct

SEQ ID NO: 1617803 - DNA, 21 bp, Homo sapiens
gcatactccgtgaggctgctg

SEQ ID NO: 1617804 - DNA, 14 bp, Homo sapiens
gcatactttgtatt

SEQ ID NO: 1617805 - DNA, 15 bp, Homo sapiens
gcatagactgaggta

SEQ ID NO: 1617806 - DNA, 22 bp, Homo sapiens
gcatagaggcttctccgccagc

SEQ ID NO: 1617807 - DNA, 20 bp, Homo sapiens
gcatagcgtcctgccctgcc

SEQ ID NO: 1617808 - DNA, 14 bp, Homo sapiens
gcatagctctgggg

SEQ ID NO: 1617809 - DNA, 20 bp, Homo sapiens
gcatagtaccaatcatttta

SEQ ID NO: 1617810 - DNA, 15 bp, Homo sapiens
gcatagtcagtgtcg

SEQ ID NO: 1617811 - DNA, 12 bp, Homo sapiens
gcatatactggt

SEQ ID NO: 1617812 - DNA, 19 bp, Homo sapiens
gcatataggtgatgtttgc

SEQ ID NO: 1617813 - DNA, 17 bp, Homo sapiens
gcatatcacccttccct

SEQ ID NO: 1617814 - DNA, 16 bp, Homo sapiens
gcatatcgctgggctc

SEQ ID NO: 1617815 - DNA, 17 bp, Homo sapiens
gcatatctgcctcccct

SEQ ID NO: 1617816 - DNA, 17 bp, Homo sapiens
gcatatgacaaatgttt

SEQ ID NO: 1617817 - DNA, 21 bp, Homo sapiens
gcatatgtttcgctgatatat

SEQ ID NO: 1617818 - DNA, 22 bp, Homo sapiens
gcatatttattgcattgctggt

SEQ ID NO: 1617819 - DNA, 16 bp, Homo sapiens
gcatatttgctatgtc

SEQ ID NO: 1617820 - DNA, 18 bp, Homo sapiens
gcatatttgtatagttgc

SEQ ID NO: 1617821 - DNA, 20 bp, Homo sapiens
gcatatttgtgccgtaatta

SEQ ID NO: 1617822 - DNA, 21 bp, Homo sapiens
gcatattttgagaaactgctg

SEQ ID NO: 1617823 - DNA, 16 bp, Homo sapiens
gcatatttttcacata

SEQ ID NO: 1617824 - DNA, 19 bp, Homo sapiens
gcatatttttcacatatct

SEQ ID NO: 1617825 - DNA, 22 bp, Homo sapiens
gcatcaaaaacatcactccctc

SEQ ID NO: 1617826 - DNA, 14 bp, Homo sapiens
gcatcacagggcag

SEQ ID NO: 1617827 - DNA, 17 bp, Homo sapiens
gcatcacagggcagagc

SEQ ID NO: 1617828 - DNA, 13 bp, Homo sapiens
gcatcacctcagg

SEQ ID NO: 1617829 - DNA, 12 bp, Homo sapiens
gcatcaggcact

SEQ ID NO: 1617830 - DNA, 17 bp, Homo sapiens
gcatcaggcactggtgg

SEQ ID NO: 1617831 - DNA, 19 bp, Homo sapiens
gcatcaggctaagaccctg

SEQ ID NO: 1617832 - DNA, 20 bp, Homo sapiens
gcatcaggctaagaccctgt

SEQ ID NO: 1617833 - DNA, 15 bp, Homo sapiens
gcatcagttctacgg

SEQ ID NO: 1617834 - DNA, 17 bp, Homo sapiens
gcatcatagtagttttt

SEQ ID NO: 1617835 - DNA, 20 bp, Homo sapiens
gcatcatctgtagatactag

SEQ ID NO: 1617836 - DNA, 13 bp, Homo sapiens
gcatcatgcatgt

SEQ ID NO: 1617837 - DNA, 22 bp, Homo sapiens
gcatcattatttgcagagacag

SEQ ID NO: 1617838 - DNA, 20 bp, Homo sapiens
gcatccacccagtgctgcca

SEQ ID NO: 1617839 - DNA, 12 bp, Homo sapiens
gcatcccccaaa

SEQ ID NO: 1617840 - DNA, 16 bp, Homo sapiens
gcatcccccaaagttc

SEQ ID NO: 1617841 - DNA, 22 bp, Homo sapiens
gcatcccgatacctcagccctg

SEQ ID NO: 1617842 - DNA, 23 bp, Homo sapiens
gcatcccgatacctcagccctgg

SEQ ID NO: 1617843 - DNA, 18 bp, Homo sapiens
gcatccctgcagaggaaa

SEQ ID NO: 1617844 - DNA, 16 bp, Homo sapiens
gcatccctggagcagg

SEQ ID NO: 1617845 - DNA, 21 bp, Homo sapiens
gcatccctggagcaggagccc

SEQ ID NO: 1617846 - DNA, 15 bp, Homo sapiens
gcatccctgtgtcca

SEQ ID NO: 1617847 - DNA, 15 bp, Homo sapiens
gcatccgcaggtgct

SEQ ID NO: 1617848 - DNA, 14 bp, Homo sapiens
gcatcctccaagaa

SEQ ID NO: 1617849 - DNA, 15 bp, Homo sapiens
gcatcctccaagaat

SEQ ID NO: 1617850 - DNA, 19 bp, Homo sapiens
gcatcctccaagaatctat

SEQ ID NO: 1617851 - DNA, 18 bp, Homo sapiens
gcatcctccacaatagca

SEQ ID NO: 1617852 - DNA, 15 bp, Homo sapiens
gcatcctcctcctgg

SEQ ID NO: 1617853 - DNA, 20 bp, Homo sapiens
gcatcctgcagggcttctcc

SEQ ID NO: 1617854 - DNA, 13 bp, Homo sapiens
gcatcctggcagg

SEQ ID NO: 1617855 - DNA, 20 bp, Homo sapiens
gcatccttgtaatacctgat

SEQ ID NO: 1617856 - DNA, 19 bp, Homo sapiens
gcatcgtgacccttcaggg

SEQ ID NO: 1617857 - DNA, 22 bp, Homo sapiens
gcatcgtgacccttcagggcca

SEQ ID NO: 1617858 - DNA, 19 bp, Homo sapiens
gcatctaagttataagact

SEQ ID NO: 1617859 - DNA, 22 bp, Homo sapiens
gcatctaagttataagactctc

SEQ ID NO: 1617860 - DNA, 15 bp, Homo sapiens
gcatctacacagcct

SEQ ID NO: 1617861 - DNA, 16 bp, Homo sapiens
gcatctactctaaaga

SEQ ID NO: 1617862 - DNA, 15 bp, Homo sapiens
gcatctatctgtgct

SEQ ID NO: 1617863 - DNA, 16 bp, Homo sapiens
gcatctatctgtgcta

SEQ ID NO: 1617864 - DNA, 23 bp, Homo sapiens
gcatctattctttgtaccatctg

SEQ ID NO: 1617865 - DNA, 21 bp, Homo sapiens
gcatctcaaaacagagggctg

SEQ ID NO: 1617866 - DNA, 12 bp, Homo sapiens
gcatctcagccc

SEQ ID NO: 1617867 - DNA, 19 bp, Homo sapiens
gcatctcctcccgcccttc

SEQ ID NO: 1617868 - DNA, 17 bp, Homo sapiens
gcatctctgtactttgc

SEQ ID NO: 1617869 - DNA, 20 bp, Homo sapiens
gcatctcttgaggccaggag

SEQ ID NO: 1617870 - DNA, 21 bp, Homo sapiens
gcatctcttgaggccaggagt

SEQ ID NO: 1617871 - DNA, 19 bp, Homo sapiens
gcatctgacacaaaaaaag

SEQ ID NO: 1617872 - DNA, 14 bp, Homo sapiens
gcatctgaccatct

SEQ ID NO: 1617873 - DNA, 16 bp, Homo sapiens
gcatctgaccatctgt

SEQ ID NO: 1617874 - DNA, 12 bp, Homo sapiens
gcatctgcaccc

SEQ ID NO: 1617875 - DNA, 14 bp, Homo sapiens
gcatctgctctaga

SEQ ID NO: 1617876 - DNA, 21 bp, Homo sapiens
gcatctgctctagattcataa

SEQ ID NO: 1617877 - DNA, 22 bp, Homo sapiens
gcatctgctctagattcataaa

SEQ ID NO: 1617878 - DNA, 12 bp, Homo sapiens
gcatctggctgt

SEQ ID NO: 1617879 - DNA, 18 bp, Homo sapiens
gcatctggtgtaggaagt

SEQ ID NO: 1617880 - DNA, 14 bp, Homo sapiens
gcatcttctggaga

SEQ ID NO: 1617881 - DNA, 15 bp, Homo sapiens
gcatcttgcctccag

SEQ ID NO: 1617882 - DNA, 16 bp, Homo sapiens
gcatcttgcctccagg

SEQ ID NO: 1617883 - DNA, 19 bp, Homo sapiens
gcatcttgcctccaggtgc

SEQ ID NO: 1617884 - DNA, 12 bp, Homo sapiens
gcatcttttgta

SEQ ID NO: 1617885 - DNA, 14 bp, Homo sapiens
gcatgaaatgtgaa

SEQ ID NO: 1617886 - DNA, 22 bp, Homo sapiens
gcatgaataaaacactcatccc

SEQ ID NO: 1617887 - DNA, 15 bp, Homo sapiens
gcatgaatcactgtg

SEQ ID NO: 1617888 - DNA, 17 bp, Homo sapiens
gcatgacagaaaatatg

SEQ ID NO: 1617889 - DNA, 21 bp, Homo sapiens
gcatgacagaaaatatgtatt

SEQ ID NO: 1617890 - DNA, 14 bp, Homo sapiens
gcatgacagcctgc

SEQ ID NO: 1617891 - DNA, 18 bp, Homo sapiens
gcatgacagcctgcagca

SEQ ID NO: 1617892 - DNA, 18 bp, Homo sapiens
gcatgactaatgcttttt

SEQ ID NO: 1617893 - DNA, 12 bp, Homo sapiens
gcatgagaaaga

SEQ ID NO: 1617894 - DNA, 12 bp, Homo sapiens
gcatgagacttt

SEQ ID NO: 1617895 - DNA, 20 bp, Homo sapiens
gcatgagccactgagcctgg

SEQ ID NO: 1617896 - DNA, 22 bp, Homo sapiens
gcatgagctccctcgctgtatg

SEQ ID NO: 1617897 - DNA, 15 bp, Homo sapiens
gcatgagctggcaac

SEQ ID NO: 1617898 - DNA, 21 bp, Homo sapiens
gcatgataagccgaggaggca

SEQ ID NO: 1617899 - DNA, 19 bp, Homo sapiens
gcatgatcttgttactgtg

SEQ ID NO: 1617900 - DNA, 19 bp, Homo sapiens
gcatgatgggaaaatattt

SEQ ID NO: 1617901 - DNA, 20 bp, Homo sapiens
gcatgatggtgcatgcctgt

SEQ ID NO: 1617902 - DNA, 20 bp, Homo sapiens
gcatgatgttaaccagaata

SEQ ID NO: 1617903 - DNA, 22 bp, Homo sapiens
gcatgatgtttgcccaaaattt

SEQ ID NO: 1617904 - DNA, 22 bp, Homo sapiens
gcatgcaaaatatacactcatc

SEQ ID NO: 1617905 - DNA, 16 bp, Homo sapiens
gcatgcaaatgagctc

SEQ ID NO: 1617906 - DNA, 13 bp, Homo sapiens
gcatgcaatttga

SEQ ID NO: 1617907 - DNA, 15 bp, Homo sapiens
gcatgcaatttgaag

SEQ ID NO: 1617908 - DNA, 15 bp, Homo sapiens
gcatgcacagctgct

SEQ ID NO: 1617909 - DNA, 17 bp, Homo sapiens
gcatgcacagctgcttg

SEQ ID NO: 1617910 - DNA, 13 bp, Homo sapiens
gcatgcacgggca

SEQ ID NO: 1617911 - DNA, 21 bp, Homo sapiens
gcatgcacgggcatgcacacg

SEQ ID NO: 1617912 - DNA, 14 bp, Homo sapiens
gcatgcatgcaaat

SEQ ID NO: 1617913 - DNA, 15 bp, Homo sapiens
gcatgcatggaggac

SEQ ID NO: 1617914 - DNA, 21 bp, Homo sapiens
gacaggcggggcccagcgctc

SEQ ID NO: 1617915 - DNA, 13 bp, Homo sapiens
gacaggctgaaga

SEQ ID NO: 1617916 - DNA, 15 bp, Homo sapiens
gacaggctggtgcta

SEQ ID NO: 1617917 - DNA, 15 bp, Homo sapiens
gacagggactttgct

SEQ ID NO: 1617918 - DNA, 17 bp, Homo sapiens
gacagggagcagccccc

SEQ ID NO: 1617919 - DNA, 15 bp, Homo sapiens
gacagggcatggcca

SEQ ID NO: 1617920 - DNA, 16 bp, Homo sapiens
gacagggctggctcct

SEQ ID NO: 1617921 - DNA, 18 bp, Homo sapiens
gacagggctggctcctct

SEQ ID NO: 1617922 - DNA, 15 bp, Homo sapiens
gacagggtaggaaag

SEQ ID NO: 1617923 - DNA, 12 bp, Homo sapiens
gacagggtttca

SEQ ID NO: 1617924 - DNA, 17 bp, Homo sapiens
gacagggtttcgccatg

SEQ ID NO: 1617925 - DNA, 17 bp, Homo sapiens
gacagtacctgattgta

SEQ ID NO: 1617926 - DNA, 16 bp, Homo sapiens
gacagtaggatttttc

SEQ ID NO: 1617927 - DNA, 15 bp, Homo sapiens
gacagtatttgtggg

SEQ ID NO: 1617928 - DNA, 15 bp, Homo sapiens
gacagtcagctgtgg

SEQ ID NO: 1617929 - DNA, 18 bp, Homo sapiens
gacagtcagctgtgggga

SEQ ID NO: 1617930 - DNA, 18 bp, Homo sapiens
gacagtcataaatactgt

SEQ ID NO: 1617931 - DNA, 19 bp, Homo sapiens
gacagtccacaggggccac

SEQ ID NO: 1617932 - DNA, 23 bp, Homo sapiens
gacagtcctgggagaacctcagg

SEQ ID NO: 1617933 - DNA, 18 bp, Homo sapiens
gacagtcctttcccacca

SEQ ID NO: 1617934 - DNA, 17 bp, Homo sapiens
gacagtcgttcccagtg

SEQ ID NO: 1617935 - DNA, 16 bp, Homo sapiens
gacagtctgttatgca

SEQ ID NO: 1617936 - DNA, 17 bp, Homo sapiens
gacagtctgttatgcac

SEQ ID NO: 1617937 - DNA, 11 bp, Homo sapiens
gacagtgcccc

SEQ ID NO: 1617938 - DNA, 20 bp, Homo sapiens
gacagtgcctcttccagtga

SEQ ID NO: 1617939 - DNA, 22 bp, Homo sapiens
gacagtgcctcttccagtgaac

SEQ ID NO: 1617940 - DNA, 13 bp, Homo sapiens
gacagtgcctggg

SEQ ID NO: 1617941 - DNA, 22 bp, Homo sapiens
gacagtgcctgggaatgtatta

SEQ ID NO: 1617942 - DNA, 15 bp, Homo sapiens
gacagtgccttctct

SEQ ID NO: 1617943 - DNA, 17 bp, Homo sapiens
gacagtgcttcagcctg

SEQ ID NO: 1617944 - DNA, 20 bp, Homo sapiens
gacagtgcttcagcctgagg

SEQ ID NO: 1617945 - DNA, 20 bp, Homo sapiens
gacagtggattgcatttctt

SEQ ID NO: 1617946 - DNA, 17 bp, Homo sapiens
gacagtgggcaggaggc

SEQ ID NO: 1617947 - DNA, 22 bp, Homo sapiens
gacagtgggcaggaggccccag

SEQ ID NO: 1617948 - DNA, 15 bp, Homo sapiens
gacagtgtcatggtg

SEQ ID NO: 1617949 - DNA, 20 bp, Homo sapiens
gacagtgtgggcgctctccc

SEQ ID NO: 1617950 - DNA, 18 bp, Homo sapiens
gacagttggcagagaagg

SEQ ID NO: 1617951 - DNA, 23 bp, Homo sapiens
gacagtttaccagttgcctttta

SEQ ID NO: 1617952 - DNA, 17 bp, Homo sapiens
gacataaaatttacatt

SEQ ID NO: 1617953 - DNA, 19 bp, Homo sapiens
gacataactatctttttga

SEQ ID NO: 1617954 - DNA, 23 bp, Homo sapiens
gacataatatattctatttttat

SEQ ID NO: 1617955 - DNA, 14 bp, Homo sapiens
gacatacagctgcc

SEQ ID NO: 1617956 - DNA, 18 bp, Homo sapiens
gacatacttgaagggcca

SEQ ID NO: 1617957 - DNA, 22 bp, Homo sapiens
gacatacttgaagggccagagc

SEQ ID NO: 1617958 - DNA, 23 bp, Homo sapiens
gacatacttgaagggccagagcc

SEQ ID NO: 1617959 - DNA, 21 bp, Homo sapiens
gacatagcctcatgttctgtg

SEQ ID NO: 1617960 - DNA, 21 bp, Homo sapiens
gacatatgggatattcccaag

SEQ ID NO: 1617961 - DNA, 15 bp, Homo sapiens
gacatcaaagcctgg

SEQ ID NO: 1617962 - DNA, 20 bp, Homo sapiens
gacatcaaagcctggcctaa

SEQ ID NO: 1617963 - DNA, 13 bp, Homo sapiens
gacatcaatgaaa

SEQ ID NO: 1617964 - DNA, 16 bp, Homo sapiens
gacatcacagggtggg

SEQ ID NO: 1617965 - DNA, 14 bp, Homo sapiens
gacatccaaatcta

SEQ ID NO: 1617966 - DNA, 20 bp, Homo sapiens
gacatccctcccccagcaga

SEQ ID NO: 1617967 - DNA, 19 bp, Homo sapiens
gacatcccttcctggaaac

SEQ ID NO: 1617968 - DNA, 16 bp, Homo sapiens
gacatccgttgtgctt

SEQ ID NO: 1617969 - DNA, 20 bp, Homo sapiens
gacatcttcaaagcttgaag

SEQ ID NO: 1617970 - DNA, 15 bp, Homo sapiens
gacatcttgaatcct

SEQ ID NO: 1617971 - DNA, 14 bp, Homo sapiens
gacatctttaacat

SEQ ID NO: 1617972 - DNA, 22 bp, Homo sapiens
gacatctttaacatagtcctgt

SEQ ID NO: 1617973 - DNA, 14 bp, Homo sapiens
gacatgaaatgaaa

SEQ ID NO: 1617974 - DNA, 16 bp, Homo sapiens
gacatgaagctgttgt

SEQ ID NO: 1617975 - DNA, 12 bp, Homo sapiens
gacatgagatgg

SEQ ID NO: 1617976 - DNA, 14 bp, Homo sapiens
gacatgatcttctt

SEQ ID NO: 1617977 - DNA, 17 bp, Homo sapiens
gacatgatggggaagga

SEQ ID NO: 1617978 - DNA, 19 bp, Homo sapiens
gacatgcaataaaatttaa

SEQ ID NO: 1617979 - DNA, 12 bp, Homo sapiens
gacatgcactga

SEQ ID NO: 1617980 - DNA, 20 bp, Homo sapiens
gacatgcactgacccttcca

SEQ ID NO: 1617981 - DNA, 13 bp, Homo sapiens
gacatgcatgaca

SEQ ID NO: 1617982 - DNA, 18 bp, Homo sapiens
gacatgcatgacacttcc

SEQ ID NO: 1617983 - DNA, 14 bp, Homo sapiens
gacatgccctgtgt

SEQ ID NO: 1617984 - DNA, 16 bp, Homo sapiens
gacatgccctgtgtgg

SEQ ID NO: 1617985 - DNA, 17 bp, Homo sapiens
gacatgccctgtgtggc

SEQ ID NO: 1617986 - DNA, 22 bp, Homo sapiens
gacatggacccactacccttct

SEQ ID NO: 1617987 - DNA, 14 bp, Homo sapiens
gacatggaggttct

SEQ ID NO: 1617988 - DNA, 17 bp, Homo sapiens
gacatgggtattttata

SEQ ID NO: 1617989 - DNA, 14 bp, Homo sapiens
gacatggtgcctga

SEQ ID NO: 1617990 - DNA, 19 bp, Homo sapiens
gacatggtgcctgagaggc

SEQ ID NO: 1617991 - DNA, 22 bp, Homo sapiens
gacatggtgcctgagaggcagg

SEQ ID NO: 1617992 - DNA, 17 bp, Homo sapiens
gacatgtctgttctaca

SEQ ID NO: 1617993 - DNA, 21 bp, Homo sapiens
gacatgtggaggggcagcctg

SEQ ID NO: 1617994 - DNA, 18 bp, Homo sapiens
gacatgtgggtggagaag

SEQ ID NO: 1617995 - DNA, 19 bp, Homo sapiens
gacatgtttgtgctctgtt

SEQ ID NO: 1617996 - DNA, 14 bp, Homo sapiens
gacattaaaagatt

SEQ ID NO: 1617997 - DNA, 18 bp, Homo sapiens
gacattaataaagttgct

SEQ ID NO: 1617998 - DNA, 23 bp, Homo sapiens
gacattcaaaaaactctctccca

SEQ ID NO: 1617999 - DNA, 17 bp, Homo sapiens
gacattcagactaaaaa

SEQ ID NO: 1618000 - DNA, 23 bp, Homo sapiens
gacattcagtatataaaatatgt

SEQ ID NO: 1618001 - DNA, 22 bp, Homo sapiens
gacattcctaagagtggaggag

SEQ ID NO: 1618002 - DNA, 17 bp, Homo sapiens
gacattccttgtcacca

SEQ ID NO: 1618003 - DNA, 14 bp, Homo sapiens
gacattctctttga

SEQ ID NO: 1618004 - DNA, 17 bp, Homo sapiens
gacattgctctcagtgc

SEQ ID NO: 1618005 - DNA, 13 bp, Homo sapiens
gacattgctctct

SEQ ID NO: 1618006 - DNA, 15 bp, Homo sapiens
gacattgctctctgg

SEQ ID NO: 1618007 - DNA, 17 bp, Homo sapiens
gacattgtatgcaggga

SEQ ID NO: 1618008 - DNA, 18 bp, Homo sapiens
gacattgtatgcagggag

SEQ ID NO: 1618009 - DNA, 23 bp, Homo sapiens
gacattgtatgcagggagcactg

SEQ ID NO: 1618010 - DNA, 22 bp, Homo sapiens
gacatttctctaactcctgcca

SEQ ID NO: 1618011 - DNA, 17 bp, Homo sapiens
gacatttgctgaactca

SEQ ID NO: 1618012 - DNA, 21 bp, Homo sapiens
gacatttgctgaactcagcac

SEQ ID NO: 1618013 - DNA, 22 bp, Homo sapiens
gacatttgctgaactcagcaca

SEQ ID NO: 1618014 - DNA, 14 bp, Homo sapiens
gacatttgtatatt

SEQ ID NO: 1618015 - DNA, 23 bp, Homo sapiens
gacattttaagtttgtagtaaaa

SEQ ID NO: 1618016 - DNA, 18 bp, Homo sapiens
gacattttggggttttat

SEQ ID NO: 1618017 - DNA, 17 bp, Homo sapiens
gaccaaaatgacaatga

SEQ ID NO: 1618018 - DNA, 16 bp, Homo sapiens
gaccaaaccagccttc

SEQ ID NO: 1618019 - DNA, 17 bp, Homo sapiens
gaccaaactcagttcaa

SEQ ID NO: 1618020 - DNA, 22 bp, Homo sapiens
gaccaaattccttggcatgcct

SEQ ID NO: 1618021 - DNA, 17 bp, Homo sapiens
gaccaacagaaaccttt

SEQ ID NO: 1618022 - DNA, 16 bp, Homo sapiens
gaccaacatggagaaa

SEQ ID NO: 1618023 - DNA, 21 bp, Homo sapiens
gaccaacatggagaaaccctg

SEQ ID NO: 1618024 - DNA, 20 bp, Homo sapiens
gaccaaccctggggaaggag

SEQ ID NO: 1618025 - DNA, 14 bp, Homo sapiens
gaccaacctgacca

SEQ ID NO: 1618026 - DNA, 17 bp, Homo sapiens
gaccaactgccctaagc

SEQ ID NO: 1618027 - DNA, 13 bp, Homo sapiens
gaccaactggctt

SEQ ID NO: 1618028 - DNA, 17 bp, Homo sapiens
gaccaactggcttctgt

SEQ ID NO: 1618029 - DNA, 14 bp, Homo sapiens
gaccaactgtcact

SEQ ID NO: 1618030 - DNA, 13 bp, Homo sapiens
gaccaagaactgc

SEQ ID NO: 1618031 - DNA, 14 bp, Homo sapiens
gaccaagagagaaa

SEQ ID NO: 1618032 - DNA, 15 bp, Homo sapiens
gaccaagagagaaag

SEQ ID NO: 1618033 - DNA, 21 bp, Homo sapiens
gaccaaggtaccgatttctgc

SEQ ID NO: 1618034 - DNA, 16 bp, Homo sapiens
gaccaagtcctggcta

SEQ ID NO: 1618035 - DNA, 14 bp, Homo sapiens
gaccaagttataaa

SEQ ID NO: 1618036 - DNA, 18 bp, Homo sapiens
gaccaataaatttgtaac

SEQ ID NO: 1618037 - DNA, 14 bp, Homo sapiens
gaccaatacatttg

SEQ ID NO: 1618038 - DNA, 15 bp, Homo sapiens
gaccaatacatttgt

SEQ ID NO: 1618039 - DNA, 21 bp, Homo sapiens
gaccaattctggacagacaga

SEQ ID NO: 1618040 - DNA, 13 bp, Homo sapiens
gaccaattgtgct

SEQ ID NO: 1618041 - DNA, 15 bp, Homo sapiens
gaccaattgtgctgc

SEQ ID NO: 1618042 - DNA, 17 bp, Homo sapiens
gaccaattgtgctgcca

SEQ ID NO: 1618043 - DNA, 17 bp, Homo sapiens
gaccacaccaaccaggc

SEQ ID NO: 1618044 - DNA, 22 bp, Homo sapiens
gaccacaccactaaccatcccc

SEQ ID NO: 1618045 - DNA, 23 bp, Homo sapiens
gaccacaccactaaccatcccca

SEQ ID NO: 1618046 - DNA, 13 bp, Homo sapiens
gaccacagctgct

SEQ ID NO: 1618047 - DNA, 21 bp, Homo sapiens
gaccacagctgctggccaggg

SEQ ID NO: 1618048 - DNA, 21 bp, Homo sapiens
gaccacaggcatctacacagc

SEQ ID NO: 1618049 - DNA, 22 bp, Homo sapiens
gaccacagtgggtggcacctcc

SEQ ID NO: 1618050 - DNA, 20 bp, Homo sapiens
gaccacataagaaggcaatt

SEQ ID NO: 1618051 - DNA, 23 bp, Homo sapiens
gaccacatctttatctgttcttg

SEQ ID NO: 1618052 - DNA, 18 bp, Homo sapiens
gaccacattttatattta

SEQ ID NO: 1618053 - DNA, 19 bp, Homo sapiens
gaccaccagccccagcaag

SEQ ID NO: 1618054 - DNA, 18 bp, Homo sapiens
gaccaccccgcctgccct

SEQ ID NO: 1618055 - DNA, 19 bp, Homo sapiens
gaccaccccgcctgccctc

SEQ ID NO: 1618056 - DNA, 19 bp, Homo sapiens
gaccacctgcttctgaact

SEQ ID NO: 1618057 - DNA, 19 bp, Homo sapiens
gaccacgcccgtcctgcct

SEQ ID NO: 1618058 - DNA, 16 bp, Homo sapiens
gaccactcctgtccct

SEQ ID NO: 1618059 - DNA, 21 bp, Homo sapiens
gaccactgcatgagcttttat

SEQ ID NO: 1618060 - DNA, 14 bp, Homo sapiens
gaccactgttatca

SEQ ID NO: 1618061 - DNA, 16 bp, Homo sapiens
gaccacttgaggcctg

SEQ ID NO: 1618062 - DNA, 16 bp, Homo sapiens
gaccacttgccacgct

SEQ ID NO: 1618063 - DNA, 20 bp, Homo sapiens
gaccagaaaatgtaaggcaa

SEQ ID NO: 1618064 - DNA, 16 bp, Homo sapiens
gaccagaaatcaaaaa

SEQ ID NO: 1618065 - DNA, 15 bp, Homo sapiens
gaccagaattccctt

SEQ ID NO: 1618066 - DNA, 11 bp, Homo sapiens
gaccagagaat

SEQ ID NO: 1618067 - DNA, 13 bp, Homo sapiens
gaccagagccaga

SEQ ID NO: 1618068 - DNA, 15 bp, Homo sapiens
gaccagagccagatg

SEQ ID NO: 1618069 - DNA, 17 bp, Homo sapiens
gaccagagccagatgca

SEQ ID NO: 1618070 - DNA, 18 bp, Homo sapiens
gaccagagccagatgcag

SEQ ID NO: 1618071 - DNA, 21 bp, Homo sapiens
gaccagagccagatgcaggac

SEQ ID NO: 1618072 - DNA, 22 bp, Homo sapiens
gaccagagccagatgcaggaca

SEQ ID NO: 1618073 - DNA, 15 bp, Homo sapiens
gaccagaggagcctt

SEQ ID NO: 1618074 - DNA, 15 bp, Homo sapiens
gaccagatctttctc

SEQ ID NO: 1618075 - DNA, 13 bp, Homo sapiens
gaccagcaaatac

SEQ ID NO: 1618076 - DNA, 18 bp, Homo sapiens
gaccagcactcagcctca

SEQ ID NO: 1618077 - DNA, 17 bp, Homo sapiens
gaccagcactgtctcag

SEQ ID NO: 1618078 - DNA, 20 bp, Homo sapiens
gaccagcagatcccagctca

SEQ ID NO: 1618079 - DNA, 18 bp, Homo sapiens
gaccagccactcaaagga

SEQ ID NO: 1618080 - DNA, 16 bp, Homo sapiens
gaccagccagcagcag

SEQ ID NO: 1618081 - DNA, 12 bp, Homo sapiens
gaccagcctggc

SEQ ID NO: 1618082 - DNA, 14 bp, Homo sapiens
gaccagcctgtcca

SEQ ID NO: 1618083 - DNA, 18 bp, Homo sapiens
gaccagcctgtccaacat

SEQ ID NO: 1618084 - DNA, 19 bp, Homo sapiens
gaccagcggctgctcaagc

SEQ ID NO: 1618085 - DNA, 20 bp, Homo sapiens
gaccagcggctgctcaagcc

SEQ ID NO: 1618086 - DNA, 21 bp, Homo sapiens
gaccagctcagaggcccagga

SEQ ID NO: 1618087 - DNA, 12 bp, Homo sapiens
gaccagctcagg

SEQ ID NO: 1618088 - DNA, 23 bp, Homo sapiens
gaccagctctcttcctgtctttg

SEQ ID NO: 1618089 - DNA, 19 bp, Homo sapiens
gaccagctgctccgaggac

SEQ ID NO: 1618090 - DNA, 11 bp, Homo sapiens
gaccagctggg

SEQ ID NO: 1618091 - DNA, 15 bp, Homo sapiens
gaccaggaaaggctt

SEQ ID NO: 1618092 - DNA, 14 bp, Homo sapiens
gaccaggactccct

SEQ ID NO: 1618093 - DNA, 16 bp, Homo sapiens
gaccaggactccctcc

SEQ ID NO: 1618094 - DNA, 23 bp, Homo sapiens
gaccaggactccctcctcacctc

SEQ ID NO: 1618095 - DNA, 20 bp, Homo sapiens
gaccaggatcccaagcctcc

SEQ ID NO: 1618096 - DNA, 22 bp, Homo sapiens
gaccaggatcccaagcctcctg

SEQ ID NO: 1618097 - DNA, 14 bp, Homo sapiens
gaccaggctgcagc

SEQ ID NO: 1618098 - DNA, 22 bp, Homo sapiens
gaccaggctggacaccctctgc

SEQ ID NO: 1618099 - DNA, 15 bp, Homo sapiens
gaccaggctgggcat

SEQ ID NO: 1618100 - DNA, 22 bp, Homo sapiens
gaccaggctgggcatcatagca

SEQ ID NO: 1618101 - DNA, 15 bp, Homo sapiens
gaccaggctgtgtcc

SEQ ID NO: 1618102 - DNA, 21 bp, Homo sapiens
gaccaggcttttgtagatggc

SEQ ID NO: 1618103 - DNA, 14 bp, Homo sapiens
gaccagggagcctt

SEQ ID NO: 1618104 - DNA, 15 bp, Homo sapiens
gaccagggagccttt

SEQ ID NO: 1618105 - DNA, 15 bp, Homo sapiens
gaccagggatgctgg

SEQ ID NO: 1618106 - DNA, 16 bp, Homo sapiens
gaccagggatgctggg

SEQ ID NO: 1618107 - DNA, 18 bp, Homo sapiens
gaccagggatgctgggct

SEQ ID NO: 1618108 - DNA, 19 bp, Homo sapiens
gaccagggatgctgggctg

SEQ ID NO: 1618109 - DNA, 16 bp, Homo sapiens
gaccaggggagaggca

SEQ ID NO: 1618110 - DNA, 15 bp, Homo sapiens
gaccagtcccacacc

SEQ ID NO: 1618111 - DNA, 18 bp, Homo sapiens
gaccagtcccacaccgct

SEQ ID NO: 1618112 - DNA, 22 bp, Homo sapiens
gaccagtggtttccagtcatga

SEQ ID NO: 1618113 - DNA, 19 bp, Homo sapiens
gaccataatcctagccccg

SEQ ID NO: 1618114 - DNA, 19 bp, Homo sapiens
gaccatcctggcccctcca

SEQ ID NO: 1618115 - DNA, 21 bp, Homo sapiens
gaccatcctggcccctccaga

SEQ ID NO: 1618116 - DNA, 13 bp, Homo sapiens
gaccatcctggct

SEQ ID NO: 1618117 - DNA, 14 bp, Homo sapiens
gaccatcctggcta

SEQ ID NO: 1618118 - DNA, 14 bp, Homo sapiens
gaccatctgtgact

SEQ ID NO: 1618119 - DNA, 21 bp, Homo sapiens
gaccatctgtgactataaagc

SEQ ID NO: 1618120 - DNA, 22 bp, Homo sapiens
gaccatggccgaagccccttgg

SEQ ID NO: 1618121 - DNA, 22 bp, Homo sapiens
gaccatggttaagagtccaaga

SEQ ID NO: 1618122 - DNA, 17 bp, Homo sapiens
gaccattgacctcagct

SEQ ID NO: 1618123 - DNA, 16 bp, Homo sapiens
gaccattgagtccctg

SEQ ID NO: 1618124 - DNA, 18 bp, Homo sapiens
gaccattgagtccctgct

SEQ ID NO: 1618125 - DNA, 14 bp, Homo sapiens
gacccaaaacacag

SEQ ID NO: 1618126 - DNA, 20 bp, Homo sapiens
gacccaactgggggcaaagg

SEQ ID NO: 1618127 - DNA, 20 bp, Homo sapiens
gacctaaatccattttctaa

SEQ ID NO: 1618128 - DNA, 21 bp, Homo sapiens
gacctaagtcaggtaatatac

SEQ ID NO: 1618129 - DNA, 14 bp, Homo sapiens
gacctacagtgctg

SEQ ID NO: 1618130 - DNA, 13 bp, Homo sapiens
gacctaccccagc

SEQ ID NO: 1618131 - DNA, 15 bp, Homo sapiens
gacctaccccagcca

SEQ ID NO: 1618132 - DNA, 17 bp, Homo sapiens
gacctaccccagccagg

SEQ ID NO: 1618133 - DNA, 18 bp, Homo sapiens
gacctaccccagccaggc

SEQ ID NO: 1618134 - DNA, 20 bp, Homo sapiens
gacctacctcaaagggcagt

SEQ ID NO: 1618135 - DNA, 17 bp, Homo sapiens
gacctactgttctaaag

SEQ ID NO: 1618136 - DNA, 17 bp, Homo sapiens
gacctagctctttgggc

SEQ ID NO: 1618137 - DNA, 22 bp, Homo sapiens
gacctagggatgttctggccct

SEQ ID NO: 1618138 - DNA, 16 bp, Homo sapiens
gacctaggggtttctg

SEQ ID NO: 1618139 - DNA, 18 bp, Homo sapiens
gacctaggggtttctgtt

SEQ ID NO: 1618140 - DNA, 19 bp, Homo sapiens
gacctagtcccctttcctc

SEQ ID NO: 1618141 - DNA, 21 bp, Homo sapiens
gacctatgtcctaaggacaca

SEQ ID NO: 1618142 - DNA, 21 bp, Homo sapiens
gacctattcaccctccacttc

SEQ ID NO: 1618143 - DNA, 14 bp, Homo sapiens
gacctcaagcaacc

SEQ ID NO: 1618144 - DNA, 17 bp, Homo sapiens
gacctcaagtgtcctga

SEQ ID NO: 1618145 - DNA, 21 bp, Homo sapiens
gacctcacagtgacccttccc

SEQ ID NO: 1618146 - DNA, 17 bp, Homo sapiens
gacctcacctaggaagt

SEQ ID NO: 1618147 - DNA, 13 bp, Homo sapiens
gacctcacctggt

SEQ ID NO: 1618148 - DNA, 13 bp, Homo sapiens
gacctcagccttc

SEQ ID NO: 1618149 - DNA, 17 bp, Homo sapiens
gacctcagctgcacatt

SEQ ID NO: 1618150 - DNA, 21 bp, Homo sapiens
gacctcagctgcacattcctg

SEQ ID NO: 1618151 - DNA, 16 bp, Homo sapiens
gaaggagggcagagcc

SEQ ID NO: 1618152 - DNA, 21 bp, Homo sapiens
gaaggagggcagagccatggg

SEQ ID NO: 1618153 - DNA, 17 bp, Homo sapiens
gaaggatgtacatttcc

SEQ ID NO: 1618154 - DNA, 16 bp, Homo sapiens
gaatgtatttatttgg

SEQ ID NO: 1618155 - DNA, 14 bp, Homo sapiens
gaatgtattttaac

SEQ ID NO: 1618156 - DNA, 15 bp, Homo sapiens
gaatgtcacaaattg

SEQ ID NO: 1618157 - DNA, 18 bp, Homo sapiens
gaatgtcagatttctggt

SEQ ID NO: 1618158 - DNA, 23 bp, Homo sapiens
gaatgtcagggccaggtgcagac

SEQ ID NO: 1618159 - DNA, 19 bp, Homo sapiens
gaatgtcagtatgtggaag

SEQ ID NO: 1618160 - DNA, 18 bp, Homo sapiens
gaatgtccccattctata

SEQ ID NO: 1618161 - DNA, 21 bp, Homo sapiens
gaatgtccccattctataaat

SEQ ID NO: 1618162 - DNA, 18 bp, Homo sapiens
gaatgtctgccttactgg

SEQ ID NO: 1618163 - DNA, 16 bp, Homo sapiens
gaatgtcttttgaata

SEQ ID NO: 1618164 - DNA, 12 bp, Homo sapiens
gaatgtgctggt

SEQ ID NO: 1618165 - DNA, 22 bp, Homo sapiens
gaatgtggcccctgaacaagaa

SEQ ID NO: 1618166 - DNA, 21 bp, Homo sapiens
gaatgtgggtagtcattctta

SEQ ID NO: 1618167 - DNA, 14 bp, Homo sapiens
gaatgttaagcaga

SEQ ID NO: 1618168 - DNA, 20 bp, Homo sapiens
gaatgttacattgtttgtct

SEQ ID NO: 1618169 - DNA, 16 bp, Homo sapiens
gaatgttccctgcacc

SEQ ID NO: 1618170 - DNA, 17 bp, Homo sapiens
gaatgttccctgcaccc

SEQ ID NO: 1618171 - DNA, 22 bp, Homo sapiens
gaatgttccctgcaccctggaa

SEQ ID NO: 1618172 - DNA, 21 bp, Homo sapiens
gaatgttcctgcctccttgat

SEQ ID NO: 1618173 - DNA, 14 bp, Homo sapiens
gaatgttctcagat

SEQ ID NO: 1618174 - DNA, 16 bp, Homo sapiens
gaatgttgtacttgaa

SEQ ID NO: 1618175 - DNA, 20 bp, Homo sapiens
gaattaaacttttaattcat

SEQ ID NO: 1618176 - DNA, 15 bp, Homo sapiens
gaattaaagcctttg

SEQ ID NO: 1618177 - DNA, 12 bp, Homo sapiens
gaattaaataaa

SEQ ID NO: 1618178 - DNA, 13 bp, Homo sapiens
gaattaaatttaa

SEQ ID NO: 1618179 - DNA, 17 bp, Homo sapiens
gaattaagatacaaatt

SEQ ID NO: 1618180 - DNA, 13 bp, Homo sapiens
gaattaagcagaa

SEQ ID NO: 1618181 - DNA, 21 bp, Homo sapiens
gaattaatcatctataaagaa

SEQ ID NO: 1618182 - DNA, 19 bp, Homo sapiens
gaattaatgacagagccag

SEQ ID NO: 1618183 - DNA, 17 bp, Homo sapiens
gaattaattaatttgga

SEQ ID NO: 1618184 - DNA, 19 bp, Homo sapiens
gaattaccaagaatatcct

SEQ ID NO: 1618185 - DNA, 18 bp, Homo sapiens
gaattactgtatataaac

SEQ ID NO: 1618186 - DNA, 15 bp, Homo sapiens
gaattaggctgtaac

SEQ ID NO: 1618187 - DNA, 12 bp, Homo sapiens
gaattataacag

SEQ ID NO: 1618188 - DNA, 13 bp, Homo sapiens
gaattataacagt

SEQ ID NO: 1618189 - DNA, 15 bp, Homo sapiens
gaattataacagtta

SEQ ID NO: 1618190 - DNA, 16 bp, Homo sapiens
gaattatcagcaaaga

SEQ ID NO: 1618191 - DNA, 18 bp, Homo sapiens
gaattatcagcaaagaaa

SEQ ID NO: 1618192 - DNA, 13 bp, Homo sapiens
gaattattttgaa

SEQ ID NO: 1618193 - DNA, 22 bp, Homo sapiens
gaattatttttgtgtttctaaa

SEQ ID NO: 1618194 - DNA, 20 bp, Homo sapiens
gaattcaaaagtgattatct

SEQ ID NO: 1618195 - DNA, 22 bp, Homo sapiens
gaattcaaaagtgattatctct

SEQ ID NO: 1618196 - DNA, 16 bp, Homo sapiens
gaattcaaactggggc

SEQ ID NO: 1618197 - DNA, 17 bp, Homo sapiens
gaattcactaggaggtc

SEQ ID NO: 1618198 - DNA, 20 bp, Homo sapiens
gaattcactccagtcaacag

SEQ ID NO: 1618199 - DNA, 13 bp, Homo sapiens
gaattcagacatc

SEQ ID NO: 1618200 - DNA, 18 bp, Homo sapiens
gaattcagcaccctgggt

SEQ ID NO: 1618201 - DNA, 19 bp, Homo sapiens
gaattcagcaccctgggtg

SEQ ID NO: 1618202 - DNA, 11 bp, Homo sapiens
gaattcagtaa

SEQ ID NO: 1618203 - DNA, 13 bp, Homo sapiens
gaattcagtgcct

SEQ ID NO: 1618204 - DNA, 17 bp, Homo sapiens
gaattcagtgccttcaa

SEQ ID NO: 1618205 - DNA, 24 bp, Homo sapiens
gaattcagtgccttcaacaacgtg

SEQ ID NO: 1618206 - DNA, 19 bp, Homo sapiens
gaattcctctttaacaagg

SEQ ID NO: 1618207 - DNA, 13 bp, Homo sapiens
gaattcctctttt

SEQ ID NO: 1618208 - DNA, 13 bp, Homo sapiens
gaattccttcgaa

SEQ ID NO: 1618209 - DNA, 19 bp, Homo sapiens
gaattccttcgaaaggcct

SEQ ID NO: 1618210 - DNA, 20 bp, Homo sapiens
gaattccttcgaaaggcctt

SEQ ID NO: 1618211 - DNA, 12 bp, Homo sapiens
gaattctactgg

SEQ ID NO: 1618212 - DNA, 16 bp, Homo sapiens
gaattctactggaaaa

SEQ ID NO: 1618213 - DNA, 16 bp, Homo sapiens
gaattctagaaataaa

SEQ ID NO: 1618214 - DNA, 23 bp, Homo sapiens
gaattctaggcatcccaggggac

SEQ ID NO: 1618215 - DNA, 14 bp, Homo sapiens
gaattctagtgctg

SEQ ID NO: 1618216 - DNA, 17 bp, Homo sapiens
gaattctcagaatctca

SEQ ID NO: 1618217 - DNA, 15 bp, Homo sapiens
gaattctgattgatt

SEQ ID NO: 1618218 - DNA, 18 bp, Homo sapiens
gaattcttacatgttttc

SEQ ID NO: 1618219 - DNA, 20 bp, Homo sapiens
gaattcttccgggggaaggg

SEQ ID NO: 1618220 - DNA, 18 bp, Homo sapiens
gaattcttgaaggaaaat

SEQ ID NO: 1618221 - DNA, 11 bp, Homo sapiens
gaattgaaaaa

SEQ ID NO: 1618222 - DNA, 17 bp, Homo sapiens
gaattgaaaagtttttg

SEQ ID NO: 1618223 - DNA, 22 bp, Homo sapiens
gaattgaaaagtttttgtttgg

SEQ ID NO: 1618224 - DNA, 22 bp, Homo sapiens
gaattgaatcgctgcgatactg

SEQ ID NO: 1618225 - DNA, 19 bp, Homo sapiens
gaattgactgaagcacagc

SEQ ID NO: 1618226 - DNA, 16 bp, Homo sapiens
gaattgagctgcagaa

SEQ ID NO: 1618227 - DNA, 14 bp, Homo sapiens
gaattgagtaatgg

SEQ ID NO: 1618228 - DNA, 18 bp, Homo sapiens
gaattgataaaagagttc

SEQ ID NO: 1618229 - DNA, 17 bp, Homo sapiens
gaattgggagcttggga

SEQ ID NO: 1618230 - DNA, 12 bp, Homo sapiens
gaattgtacaga

SEQ ID NO: 1618231 - DNA, 14 bp, Homo sapiens
gaattgtatcattt

SEQ ID NO: 1618232 - DNA, 20 bp, Homo sapiens
gaattgtgtattgatgcaat

SEQ ID NO: 1618233 - DNA, 22 bp, Homo sapiens
gaattgtgtattgatgcaatat

SEQ ID NO: 1618234 - DNA, 20 bp, Homo sapiens
gaattgtttagattttgtgt

SEQ ID NO: 1618235 - DNA, 22 bp, Homo sapiens
gaattgtttagattttgtgttt

SEQ ID NO: 1618236 - DNA, 22 bp, Homo sapiens
gaattgtttggcaatgcactga

SEQ ID NO: 1618237 - DNA, 14 bp, Homo sapiens
gaatttaaaactgt

SEQ ID NO: 1618238 - DNA, 18 bp, Homo sapiens
gaatttaaaattaagtag

SEQ ID NO: 1618239 - DNA, 16 bp, Homo sapiens
gaatttaaataaagtt

SEQ ID NO: 1618240 - DNA, 13 bp, Homo sapiens
gaatttaaatata

SEQ ID NO: 1618241 - DNA, 20 bp, Homo sapiens
gaatttaaatataattctgt

SEQ ID NO: 1618242 - DNA, 19 bp, Homo sapiens
gaatttactttcttcacca

SEQ ID NO: 1618243 - DNA, 22 bp, Homo sapiens
gaatttatcacacttctgtgag

SEQ ID NO: 1618244 - DNA, 19 bp, Homo sapiens
gaatttatctttaccaaaa

SEQ ID NO: 1618245 - DNA, 17 bp, Homo sapiens
gaatttattcaattcct

SEQ ID NO: 1618246 - DNA, 23 bp, Homo sapiens
gaatttattcaattcctctggga

SEQ ID NO: 1618247 - DNA, 12 bp, Homo sapiens
gaatttcacctg

SEQ ID NO: 1618248 - DNA, 17 bp, Homo sapiens
gaatttcccaggaccct

SEQ ID NO: 1618249 - DNA, 22 bp, Homo sapiens
gaatttcccaggaccctgaagg

SEQ ID NO: 1618250 - DNA, 15 bp, Homo sapiens
gaatttcttaacttc

SEQ ID NO: 1618251 - DNA, 19 bp, Homo sapiens
gaatttcttaacttcttgc

SEQ ID NO: 1618252 - DNA, 12 bp, Homo sapiens
gaatttcttggt

SEQ ID NO: 1618253 - DNA, 21 bp, Homo sapiens
gaatttcttggtaagaagccg

SEQ ID NO: 1618254 - DNA, 22 bp, Homo sapiens
gaatttgaaatggttgtcacct

SEQ ID NO: 1618255 - DNA, 13 bp, Homo sapiens
gaatttgagaacc

SEQ ID NO: 1618256 - DNA, 16 bp, Homo sapiens
gaatttgagaaccttg

SEQ ID NO: 1618257 - DNA, 21 bp, Homo sapiens
gaatttgctaaatacaacact

SEQ ID NO: 1618258 - DNA, 12 bp, Homo sapiens
gaatttgtactt

SEQ ID NO: 1618259 - DNA, 13 bp, Homo sapiens
gaatttgtacttc

SEQ ID NO: 1618260 - DNA, 14 bp, Homo sapiens
gaatttgtacttct

SEQ ID NO: 1618261 - DNA, 21 bp, Homo sapiens
gaatttgtcagcgttctacca

SEQ ID NO: 1618262 - DNA, 13 bp, Homo sapiens
gaatttgttctta

SEQ ID NO: 1618263 - DNA, 14 bp, Homo sapiens
gaattttaggaact

SEQ ID NO: 1618264 - DNA, 12 bp, Homo sapiens
gaattttatatt

SEQ ID NO: 1618265 - DNA, 16 bp, Homo sapiens
gaattttatctgtgga

SEQ ID NO: 1618266 - DNA, 15 bp, Homo sapiens
gaattttattttgct

SEQ ID NO: 1618267 - DNA, 21 bp, Homo sapiens
gaattttcatcccgtatcaca

SEQ ID NO: 1618268 - DNA, 17 bp, Homo sapiens
gaattttccaagaacat

SEQ ID NO: 1618269 - DNA, 17 bp, Homo sapiens
gacacatgctatgttct

SEQ ID NO: 1618270 - DNA, 21 bp, Homo sapiens
gacacattgccttctggagct

SEQ ID NO: 1618271 - DNA, 22 bp, Homo sapiens
gacacattgccttctggagctg

SEQ ID NO: 1618272 - DNA, 18 bp, Homo sapiens
gacaccaaactgccaaaa

SEQ ID NO: 1618273 - DNA, 17 bp, Homo sapiens
gacaccaataaatgttt

SEQ ID NO: 1618274 - DNA, 13 bp, Homo sapiens
gacaccagagctg

SEQ ID NO: 1618275 - DNA, 15 bp, Homo sapiens
gacaccagagctgcc

SEQ ID NO: 1618276 - DNA, 17 bp, Homo sapiens
gacaccattctcctgcc

SEQ ID NO: 1618277 - DNA, 13 bp, Homo sapiens
gacacccaggact

SEQ ID NO: 1618278 - DNA, 14 bp, Homo sapiens
gacacccaggactt

SEQ ID NO: 1618279 - DNA, 18 bp, Homo sapiens
gacacccagtgtccttcc

SEQ ID NO: 1618280 - DNA, 17 bp, Homo sapiens
gacacccatgccagaga

SEQ ID NO: 1618281 - DNA, 14 bp, Homo sapiens
gactaaaaatacac

SEQ ID NO: 1618282 - DNA, 23 bp, Homo sapiens
gactaaaacattttgactaagtt

SEQ ID NO: 1618283 - DNA, 19 bp, Homo sapiens
gactaaactttttttctgt

SEQ ID NO: 1618284 - DNA, 14 bp, Homo sapiens
gactaaattcgtga

SEQ ID NO: 1618285 - DNA, 21 bp, Homo sapiens
gactaacataaaatctgtgaa

SEQ ID NO: 1618286 - DNA, 16 bp, Homo sapiens
gactaactcaaataca

SEQ ID NO: 1618287 - DNA, 19 bp, Homo sapiens
gactaagaataagaagcat

SEQ ID NO: 1618288 - DNA, 14 bp, Homo sapiens
gactaagccctgtc

SEQ ID NO: 1618289 - DNA, 12 bp, Homo sapiens
gactaaggcctc

SEQ ID NO: 1618290 - DNA, 15 bp, Homo sapiens
gactaattaggcaag

SEQ ID NO: 1618291 - DNA, 15 bp, Homo sapiens
gactacaaaaatgaa

SEQ ID NO: 1618292 - DNA, 15 bp, Homo sapiens
gactacacctacgga

SEQ ID NO: 1618293 - DNA, 13 bp, Homo sapiens
gactacagggctt

SEQ ID NO: 1618294 - DNA, 12 bp, Homo sapiens
gactacattttg

SEQ ID NO: 1618295 - DNA, 14 bp, Homo sapiens
gactacctgggacc

SEQ ID NO: 1618296 - DNA, 15 bp, Homo sapiens
gactactgctcctgt

SEQ ID NO: 1618297 - DNA, 22 bp, Homo sapiens
gactagaattctagtgctgctg

SEQ ID NO: 1618298 - DNA, 15 bp, Homo sapiens
gactagagctttctt

SEQ ID NO: 1618299 - DNA, 14 bp, Homo sapiens
gactagcctggcca

SEQ ID NO: 1618300 - DNA, 24 bp, Homo sapiens
gactaggacctgagcctggtcctg

SEQ ID NO: 1618301 - DNA, 17 bp, Homo sapiens
gactagggattcaggct

SEQ ID NO: 1618302 - DNA, 19 bp, Homo sapiens
gactagtgagtcagcacct

SEQ ID NO: 1618303 - DNA, 21 bp, Homo sapiens
gactagtgagtcagcaccttg

SEQ ID NO: 1618304 - DNA, 20 bp, Homo sapiens
gactatatatataaatgtat

SEQ ID NO: 1618305 - DNA, 19 bp, Homo sapiens
gactatatttgggcctgct

SEQ ID NO: 1618306 - DNA, 18 bp, Homo sapiens
gactatcaaactgaagcc

SEQ ID NO: 1618307 - DNA, 18 bp, Homo sapiens
gactatctgtctggtggc

SEQ ID NO: 1618308 - DNA, 19 bp, Homo sapiens
gactatgccgtcttctgcc

SEQ ID NO: 1618309 - DNA, 21 bp, Homo sapiens
gactatgccgtcttctgccct

SEQ ID NO: 1618310 - DNA, 20 bp, Homo sapiens
gactatggagcctggcacag

SEQ ID NO: 1618311 - DNA, 12 bp, Homo sapiens
gactatggtgct

SEQ ID NO: 1618312 - DNA, 22 bp, Homo sapiens
gactattaggtgcaatttcaag

SEQ ID NO: 1618313 - DNA, 14 bp, Homo sapiens
gactattcagtttt

SEQ ID NO: 1618314 - DNA, 19 bp, Homo sapiens
gactattccttttctgtat

SEQ ID NO: 1618315 - DNA, 17 bp, Homo sapiens
gactattgtgccaactg

SEQ ID NO: 1618316 - DNA, 13 bp, Homo sapiens
gactatttatgaa

SEQ ID NO: 1618317 - DNA, 19 bp, Homo sapiens
gactatttcaaaatgtcca

SEQ ID NO: 1618318 - DNA, 19 bp, Homo sapiens
gactatttgacccccacaa

SEQ ID NO: 1618319 - DNA, 21 bp, Homo sapiens
gactatttgacccccacaaca

SEQ ID NO: 1618320 - DNA, 14 bp, Homo sapiens
gactatttgctaat

SEQ ID NO: 1618321 - DNA, 19 bp, Homo sapiens
gactatttgctaatgtata

SEQ ID NO: 1618322 - DNA, 21 bp, Homo sapiens
gactcaagggaaaggcaagct

SEQ ID NO: 1618323 - DNA, 21 bp, Homo sapiens
gactcaagtacccattctgtt

SEQ ID NO: 1618324 - DNA, 18 bp, Homo sapiens
gactcaattatttgcata

SEQ ID NO: 1618325 - DNA, 17 bp, Homo sapiens
gactcaccaacttgcca

SEQ ID NO: 1618326 - DNA, 20 bp, Homo sapiens
gactcaccaacttttaatgg

SEQ ID NO: 1618327 - DNA, 13 bp, Homo sapiens
gactcacctctgc

SEQ ID NO: 1618328 - DNA, 20 bp, Homo sapiens
gactcacttgatgtttcctg

SEQ ID NO: 1618329 - DNA, 18 bp, Homo sapiens
gactcagacattggcacc

SEQ ID NO: 1618330 - DNA, 16 bp, Homo sapiens
gactcagactccattt

SEQ ID NO: 1618331 - DNA, 12 bp, Homo sapiens
gactcagcagtg

SEQ ID NO: 1618332 - DNA, 14 bp, Homo sapiens
gactcagcagtgac

SEQ ID NO: 1618333 - DNA, 11 bp, Homo sapiens
gactcagccct

SEQ ID NO: 1618334 - DNA, 16 bp, Homo sapiens
gactcagccctgaggt

SEQ ID NO: 1618335 - DNA, 12 bp, Homo sapiens
gactcagccttc

SEQ ID NO: 1618336 - DNA, 15 bp, Homo sapiens
gactcagctgctata

SEQ ID NO: 1618337 - DNA, 18 bp, Homo sapiens
gactcaggaccagatgtc

SEQ ID NO: 1618338 - DNA, 19 bp, Homo sapiens
gactcaggagtctgccact

SEQ ID NO: 1618339 - DNA, 17 bp, Homo sapiens
gactcaggatgcccagg

SEQ ID NO: 1618340 - DNA, 22 bp, Homo sapiens
gactcaggatttaaaaactgga

SEQ ID NO: 1618341 - DNA, 18 bp, Homo sapiens
gactcagggaccggtgct

SEQ ID NO: 1618342 - DNA, 15 bp, Homo sapiens
gactcagggccccag

SEQ ID NO: 1618343 - DNA, 20 bp, Homo sapiens
gactcagggccccagcacta

SEQ ID NO: 1618344 - DNA, 16 bp, Homo sapiens
gactcaggtgggccct

SEQ ID NO: 1618345 - DNA, 15 bp, Homo sapiens
gactcaggttccaga

SEQ ID NO: 1618346 - DNA, 20 bp, Homo sapiens
gactcaggttccagaacagc

SEQ ID NO: 1618347 - DNA, 14 bp, Homo sapiens
gactcatcatttgt

SEQ ID NO: 1618348 - DNA, 18 bp, Homo sapiens
gactcatttcacagcctt

SEQ ID NO: 1618349 - DNA, 11 bp, Homo sapiens
gactccaaaga

SEQ ID NO: 1618350 - DNA, 12 bp, Homo sapiens
gactccaaagaa

SEQ ID NO: 1618351 - DNA, 16 bp, Homo sapiens
gactccaaagaaatgt

SEQ ID NO: 1618352 - DNA, 20 bp, Homo sapiens
gactccaatggggccagcac

SEQ ID NO: 1618353 - DNA, 21 bp, Homo sapiens
gactccaatggggccagcact

SEQ ID NO: 1618354 - DNA, 22 bp, Homo sapiens
gactccaatggggccagcactg

SEQ ID NO: 1618355 - DNA, 23 bp, Homo sapiens
gactccagaatctgctgttgcca

SEQ ID NO: 1618356 - DNA, 14 bp, Homo sapiens
gactccaggcccaa

SEQ ID NO: 1618357 - DNA, 12 bp, Homo sapiens
gactccaggcct

SEQ ID NO: 1618358 - DNA, 13 bp, Homo sapiens
gactccaggcctg

SEQ ID NO: 1618359 - DNA, 15 bp, Homo sapiens
gactccaggcctgac

SEQ ID NO: 1618360 - DNA, 18 bp, Homo sapiens
gactccatctcttctgca

SEQ ID NO: 1618361 - DNA, 21 bp, Homo sapiens
gactcccaagtttccatagca

SEQ ID NO: 1618362 - DNA, 22 bp, Homo sapiens
gactcccattcctgaagaacca

SEQ ID NO: 1618363 - DNA, 16 bp, Homo sapiens
gactccctcctcacct

SEQ ID NO: 1618364 - DNA, 24 bp, Homo sapiens
gactccctcctcacctctggactg

SEQ ID NO: 1618365 - DNA, 18 bp, Homo sapiens
gactccctgatcccagac

SEQ ID NO: 1618366 - DNA, 22 bp, Homo sapiens
gactgtagggagggcggcaggg

SEQ ID NO: 1618367 - DNA, 15 bp, Homo sapiens
gactgtatctgtgta

SEQ ID NO: 1618368 - DNA, 19 bp, Homo sapiens
gactgtatctgtgtagact

SEQ ID NO: 1618369 - DNA, 13 bp, Homo sapiens
gactgtcagctga

SEQ ID NO: 1618370 - DNA, 20 bp, Homo sapiens
gactgtcatgtggcttggtt

SEQ ID NO: 1618371 - DNA, 22 bp, Homo sapiens
gactgtctatatcataactata

SEQ ID NO: 1618372 - DNA, 21 bp, Homo sapiens
gactgtctcaagagggcactg

SEQ ID NO: 1618373 - DNA, 19 bp, Homo sapiens
gactgtctcacttaatcct

SEQ ID NO: 1618374 - DNA, 17 bp, Homo sapiens
gactgtgaggcggcagc

SEQ ID NO: 1618375 - DNA, 19 bp, Homo sapiens
gactgtgatgccacacaga

SEQ ID NO: 1618376 - DNA, 17 bp, Homo sapiens
gactgtgattagatcac

SEQ ID NO: 1618377 - DNA, 17 bp, Homo sapiens
gactgtgatttatttgg

SEQ ID NO: 1618378 - DNA, 19 bp, Homo sapiens
gactgtgatttgaatccag

SEQ ID NO: 1618379 - DNA, 19 bp, Homo sapiens
gactgtgcctcaggccagg

SEQ ID NO: 1618380 - DNA, 14 bp, Homo sapiens
gactgtggctgcta

SEQ ID NO: 1618381 - DNA, 22 bp, Homo sapiens
gactgtggtaggggcagggagg

SEQ ID NO: 1618382 - DNA, 22 bp, Homo sapiens
gactgtgtttccaaaggttccc

SEQ ID NO: 1618383 - DNA, 22 bp, Homo sapiens
gactgttagaaaatggacactg

SEQ ID NO: 1618384 - DNA, 13 bp, Homo sapiens
gactgttgagtta

SEQ ID NO: 1618385 - DNA, 11 bp, Homo sapiens
gactgtttatt

SEQ ID NO: 1618386 - DNA, 16 bp, Homo sapiens
gactgtttatttaagg

SEQ ID NO: 1618387 - DNA, 22 bp, Homo sapiens
gactgtttatttaaggatggat

SEQ ID NO: 1618388 - DNA, 14 bp, Homo sapiens
gactgttttactgt

SEQ ID NO: 1618389 - DNA, 16 bp, Homo sapiens
gactgttttactgttt

SEQ ID NO: 1618390 - DNA, 19 bp, Homo sapiens
gacttaaaacatggtgcct

SEQ ID NO: 1618391 - DNA, 16 bp, Homo sapiens
gacttaaaagagctca

SEQ ID NO: 1618392 - DNA, 13 bp, Homo sapiens
gacttaaagcaga

SEQ ID NO: 1618393 - DNA, 14 bp, Homo sapiens
gacttaacggctcc

SEQ ID NO: 1618394 - DNA, 21 bp, Homo sapiens
gacttaagcccagtgcactga

SEQ ID NO: 1618395 - DNA, 15 bp, Homo sapiens
gacttaatgtgatta

SEQ ID NO: 1618396 - DNA, 12 bp, Homo sapiens
gacttactctaa

SEQ ID NO: 1618397 - DNA, 14 bp, Homo sapiens
gacttactctaaga

SEQ ID NO: 1618398 - DNA, 13 bp, Homo sapiens
gacttactgcagt

SEQ ID NO: 1618399 - DNA, 20 bp, Homo sapiens
gacttagaggcaacaggatt

SEQ ID NO: 1618400 - DNA, 17 bp, Homo sapiens
gacttagcgtcaagaca

SEQ ID NO: 1618401 - DNA, 21 bp, Homo sapiens
gacttagcgtcaagacatttg

SEQ ID NO: 1618402 - DNA, 17 bp, Homo sapiens
gacttagggcaccaggg

SEQ ID NO: 1618403 - DNA, 22 bp, Homo sapiens
gacttagttgcgttacaccctt

SEQ ID NO: 1618404 - DNA, 21 bp, Homo sapiens
gaaaagctgccatttcccttc

SEQ ID NO: 1618405 - DNA, 14 bp, Homo sapiens
gaaaagctttgttt

SEQ ID NO: 1618406 - DNA, 12 bp, Homo sapiens
gaaaaggaggag

SEQ ID NO: 1618407 - DNA, 13 bp, Homo sapiens
gaaaaggatctaa

SEQ ID NO: 1618408 - DNA, 12 bp, Homo sapiens
gaaaaggcaaaa

SEQ ID NO: 1618409 - DNA, 18 bp, Homo sapiens
gaaaagggcactcccaac

SEQ ID NO: 1618410 - DNA, 19 bp, Homo sapiens
gaaaagggtcttcttggca

SEQ ID NO: 1618411 - DNA, 23 bp, Homo sapiens
gaaaaggttcttcatccctttcc

SEQ ID NO: 1618412 - DNA, 16 bp, Homo sapiens
gaaaaggttgaataat

SEQ ID NO: 1618413 - DNA, 20 bp, Homo sapiens
gaaaagtgcatatttatcca

SEQ ID NO: 1618414 - DNA, 19 bp, Homo sapiens
gaaaagtggcaagaccaaa

SEQ ID NO: 1618415 - DNA, 17 bp, Homo sapiens
gaaaagttaaactaaaa

SEQ ID NO: 1618416 - DNA, 20 bp, Homo sapiens
gaaaagttaaactaaaaaaa

SEQ ID NO: 1618417 - DNA, 22 bp, Homo sapiens
gaaaagttcaatactcttgaaa

SEQ ID NO: 1618418 - DNA, 23 bp, Homo sapiens
gaaaagttcaatactcttgaaat

SEQ ID NO: 1618419 - DNA, 16 bp, Homo sapiens
gaaaagttcagggacc

SEQ ID NO: 1618420 - DNA, 20 bp, Homo sapiens
gaaaagttggaaggatctgc

SEQ ID NO: 1618421 - DNA, 17 bp, Homo sapiens
gaaaataaaaagagaaa

SEQ ID NO: 1618422 - DNA, 16 bp, Homo sapiens
gaaaataaaacacacc

SEQ ID NO: 1618423 - DNA, 18 bp, Homo sapiens
gaaaataaaatattcact

SEQ ID NO: 1618424 - DNA, 20 bp, Homo sapiens
gaaaataaaatattcactct

SEQ ID NO: 1618425 - DNA, 21 bp, Homo sapiens
gaaaataaaatattcactctc

SEQ ID NO: 1618426 - DNA, 18 bp, Homo sapiens
gaaaataaacagacaaaa

SEQ ID NO: 1618427 - DNA, 12 bp, Homo sapiens
gaaaataaacat

SEQ ID NO: 1618428 - DNA, 21 bp, Homo sapiens
gaaaataacaagagttttaac

SEQ ID NO: 1618429 - DNA, 18 bp, Homo sapiens
gaaaataactgaatttgg

SEQ ID NO: 1618430 - DNA, 13 bp, Homo sapiens
gaaaataaggcac

SEQ ID NO: 1618431 - DNA, 19 bp, Homo sapiens
gaaaataattttccaagta

SEQ ID NO: 1618432 - DNA, 19 bp, Homo sapiens
gaaaatacaacttaaataa

SEQ ID NO: 1618433 - DNA, 13 bp, Homo sapiens
gaaaatacaataa

SEQ ID NO: 1618434 - DNA, 14 bp, Homo sapiens
gaaaatacaataaa

SEQ ID NO: 1618435 - DNA, 15 bp, Homo sapiens
gaaaataccagtgtt

SEQ ID NO: 1618436 - DNA, 19 bp, Homo sapiens
gaaaatacctattttatat

SEQ ID NO: 1618437 - DNA, 16 bp, Homo sapiens
gaaaatacttaaatgt

SEQ ID NO: 1618438 - DNA, 17 bp, Homo sapiens
gaaaataggcaggaagc

SEQ ID NO: 1618439 - DNA, 17 bp, Homo sapiens
gaaaatagtgtaagaac

SEQ ID NO: 1618440 - DNA, 20 bp, Homo sapiens
gaaaatagtgtaagaactgt

SEQ ID NO: 1618441 - DNA, 22 bp, Homo sapiens
gaaaatatagacattctcacat

SEQ ID NO: 1618442 - DNA, 13 bp, Homo sapiens
gaaaatatgtatt

SEQ ID NO: 1618443 - DNA, 19 bp, Homo sapiens
gaaaatatgtattaacact

SEQ ID NO: 1618444 - DNA, 17 bp, Homo sapiens
gaaaatattatgtgttt

SEQ ID NO: 1618445 - DNA, 18 bp, Homo sapiens
gaaaatatttgtatcaca

SEQ ID NO: 1618446 - DNA, 18 bp, Homo sapiens
gaaaatattttttatata

SEQ ID NO: 1618447 - DNA, 18 bp, Homo sapiens
gaaaatatttttttctag

SEQ ID NO: 1618448 - DNA, 19 bp, Homo sapiens
gaaaatatttttttctagc

SEQ ID NO: 1618449 - DNA, 14 bp, Homo sapiens
gaaaatcaaagtaa

SEQ ID NO: 1618450 - DNA, 20 bp, Homo sapiens
gaaaatcatcaagaagggct

SEQ ID NO: 1618451 - DNA, 22 bp, Homo sapiens
gaaaatcatcaagaagggctgc

SEQ ID NO: 1618452 - DNA, 16 bp, Homo sapiens
gaaaatccaggtcatg

SEQ ID NO: 1618453 - DNA, 15 bp, Homo sapiens
gaaaatcctctggct

SEQ ID NO: 1618454 - DNA, 21 bp, Homo sapiens
gaaaatctatatttgtcttcc

SEQ ID NO: 1618455 - DNA, 22 bp, Homo sapiens
gaaaatctatatttgtcttccg

SEQ ID NO: 1618456 - DNA, 23 bp, Homo sapiens
gaaaatctatatttgtcttccga

SEQ ID NO: 1618457 - DNA, 12 bp, Homo sapiens
gaaaatgaaatc

SEQ ID NO: 1618458 - DNA, 14 bp, Homo sapiens
gaaaatgaagggat

SEQ ID NO: 1618459 - DNA, 20 bp, Homo sapiens
gaaaatgaatatctattaat

SEQ ID NO: 1618460 - DNA, 14 bp, Homo sapiens
gaaaatgacttatt

SEQ ID NO: 1618461 - DNA, 15 bp, Homo sapiens
gaaaatgacttattt

SEQ ID NO: 1618462 - DNA, 17 bp, Homo sapiens
gaaaatgagaaaggaca

SEQ ID NO: 1618463 - DNA, 18 bp, Homo sapiens
gaaaatgagaaaggacag

SEQ ID NO: 1618464 - DNA, 22 bp, Homo sapiens
gaaaatgagaaaggacagagcc

SEQ ID NO: 1618465 - DNA, 24 bp, Homo sapiens
gaaaatgagaaaggacagagccag

SEQ ID NO: 1618466 - DNA, 20 bp, Homo sapiens
gaaaatgcattagggaaaac

SEQ ID NO: 1618467 - DNA, 15 bp, Homo sapiens
gaaaatgcggttata

SEQ ID NO: 1618468 - DNA, 21 bp, Homo sapiens
gaaaatggctaataaactgta

SEQ ID NO: 1618469 - DNA, 22 bp, Homo sapiens
gaaaatggtccaattagtttcc

SEQ ID NO: 1618470 - DNA, 15 bp, Homo sapiens
gaaaatgtatccaag

SEQ ID NO: 1618471 - DNA, 23 bp, Homo sapiens
gaaaatgtcagaaaccagttatg

SEQ ID NO: 1618472 - DNA, 17 bp, Homo sapiens
gaaaattatttgtatga

SEQ ID NO: 1618473 - DNA, 22 bp, Homo sapiens
gaaaattattttgttcatacat

SEQ ID NO: 1618474 - DNA, 13 bp, Homo sapiens
gaaaattcatttt

SEQ ID NO: 1618475 - DNA, 12 bp, Homo sapiens
gaactagggcac

SEQ ID NO: 1618476 - DNA, 19 bp, Homo sapiens
gaactatttattaaaaaca

SEQ ID NO: 1618477 - DNA, 23 bp, Homo sapiens
gaactatttattaaaaacatgac

SEQ ID NO: 1618478 - DNA, 20 bp, Homo sapiens
gaactattttcaaagactta

SEQ ID NO: 1618479 - DNA, 16 bp, Homo sapiens
gaactcaactttgaca

SEQ ID NO: 1618480 - DNA, 22 bp, Homo sapiens
gaactcaccctgggagccagtc

SEQ ID NO: 1618481 - DNA, 18 bp, Homo sapiens
gaactcactctgggctgt

SEQ ID NO: 1618482 - DNA, 23 bp, Homo sapiens
gaactcagtagctgaacctgtct

SEQ ID NO: 1618483 - DNA, 14 bp, Homo sapiens
gaactcattcctgc

SEQ ID NO: 1618484 - DNA, 13 bp, Homo sapiens
gaactcattctct

SEQ ID NO: 1618485 - DNA, 15 bp, Homo sapiens
gaactcattctcttc

SEQ ID NO: 1618486 - DNA, 23 bp, Homo sapiens
gaactcattctcttcttgctata

SEQ ID NO: 1618487 - DNA, 14 bp, Homo sapiens
gaactcatttattc

SEQ ID NO: 1618488 - DNA, 12 bp, Homo sapiens
gaactccactct

SEQ ID NO: 1618489 - DNA, 17 bp, Homo sapiens
gaactccatacagcctc

SEQ ID NO: 1618490 - DNA, 23 bp, Homo sapiens
gaactcctgacctcaagtgattc

SEQ ID NO: 1618491 - DNA, 21 bp, Homo sapiens
gaactcctgtgtgtggaaggc

SEQ ID NO: 1618492 - DNA, 17 bp, Homo sapiens
gaactccttattttgta

SEQ ID NO: 1618493 - DNA, 20 bp, Homo sapiens
gaactccttattttgtatta

SEQ ID NO: 1618494 - DNA, 17 bp, Homo sapiens
gaactccttccccactt

SEQ ID NO: 1618495 - DNA, 19 bp, Homo sapiens
gaactcgcgctcagtaaac

SEQ ID NO: 1618496 - DNA, 16 bp, Homo sapiens
gaactctaaccagtgt

SEQ ID NO: 1618497 - DNA, 18 bp, Homo sapiens
gaactctaaccagtgtac

SEQ ID NO: 1618498 - DNA, 17 bp, Homo sapiens
gaactctgacaagggct

SEQ ID NO: 1618499 - DNA, 16 bp, Homo sapiens
gaagagcagctccttc

SEQ ID NO: 1618500 - DNA, 22 bp, Homo sapiens
gaagagcaggactccaggccca

SEQ ID NO: 1618501 - DNA, 15 bp, Homo sapiens
gaagagcaggcacat

SEQ ID NO: 1618502 - DNA, 15 bp, Homo sapiens
gaagagccacctgca

SEQ ID NO: 1618503 - DNA, 23 bp, Homo sapiens
gaagagccacctgcaagatggac

SEQ ID NO: 1618504 - DNA, 20 bp, Homo sapiens
gaagagccatcttggcaggg

SEQ ID NO: 1618505 - DNA, 17 bp, Homo sapiens
gaagagcccgcagggcc

SEQ ID NO: 1618506 - DNA, 22 bp, Homo sapiens
gaagagcccgcagggccatgca

SEQ ID NO: 1618507 - DNA, 23 bp, Homo sapiens
gaagagcccgcagggccatgcag

SEQ ID NO: 1618508 - DNA, 20 bp, Homo sapiens
gaagagcccgtcgcgctgga

SEQ ID NO: 1618509 - DNA, 24 bp, Homo sapiens
gaagagcccgtcgcgctggacagc

SEQ ID NO: 1618510 - DNA, 22 bp, Homo sapiens
gaagagcgagagatcaaagatg

SEQ ID NO: 1618511 - DNA, 22 bp, Homo sapiens
gaagagctcccctccacagctg

SEQ ID NO: 1618512 - DNA, 12 bp, Homo sapiens
gaagagctcttc

SEQ ID NO: 1618513 - DNA, 13 bp, Homo sapiens
gaagagctgttca

SEQ ID NO: 1618514 - DNA, 18 bp, Homo sapiens
gaagaggaagaaattcag

SEQ ID NO: 1618515 - DNA, 21 bp, Homo sapiens
gaagaggaagaaattcaggta

SEQ ID NO: 1618516 - DNA, 13 bp, Homo sapiens
gaagaggagcctc

SEQ ID NO: 1618517 - DNA, 15 bp, Homo sapiens
gaagaggagcctcag

SEQ ID NO: 1618518 - DNA, 16 bp, Homo sapiens
gaagaggagcctcaga

SEQ ID NO: 1618519 - DNA, 18 bp, Homo sapiens
gaagaggagcctcagaag

SEQ ID NO: 1618520 - DNA, 22 bp, Homo sapiens
gaagaggagcctcagaagaaaa

SEQ ID NO: 1618521 - DNA, 21 bp, Homo sapiens
gaagaggcccactagagggcc

SEQ ID NO: 1618522 - DNA, 19 bp, Homo sapiens
gaagaggcgggccagccag

SEQ ID NO: 1618523 - DNA, 21 bp, Homo sapiens
gaagagggaatggatggggag

SEQ ID NO: 1618524 - DNA, 22 bp, Homo sapiens
gaagagggaatggatggggaga

SEQ ID NO: 1618525 - DNA, 19 bp, Homo sapiens
gaagagggcagtacctggg

SEQ ID NO: 1618526 - DNA, 13 bp, Homo sapiens
gaagagggcctgt

SEQ ID NO: 1618527 - DNA, 21 bp, Homo sapiens
gaagaggggaggggcctaggg

SEQ ID NO: 1618528 - DNA, 15 bp, Homo sapiens
gaagaggggcagccc

SEQ ID NO: 1618529 - DNA, 18 bp, Homo sapiens
gaagaggggcagcccttg

SEQ ID NO: 1618530 - DNA, 18 bp, Homo sapiens
gaagagggtgtgtttgaa

SEQ ID NO: 1618531 - DNA, 21 bp, Homo sapiens
gaagaggtctgattggctgct

SEQ ID NO: 1618532 - DNA, 15 bp, Homo sapiens
gaagagtaagttttc

SEQ ID NO: 1618533 - DNA, 21 bp, Homo sapiens
gaagagttcccttgaaacttt

SEQ ID NO: 1618534 - DNA, 13 bp, Homo sapiens
gaagataggacgt

SEQ ID NO: 1618535 - DNA, 21 bp, Homo sapiens
gaagataggacgtatttataa

SEQ ID NO: 1618536 - DNA, 13 bp, Homo sapiens
gaagataggctct

SEQ ID NO: 1618537 - DNA, 16 bp, Homo sapiens
gaagataggctctgca

SEQ ID NO: 1618538 - DNA, 19 bp, Homo sapiens
gaagatataacattcagtt

SEQ ID NO: 1618539 - DNA, 14 bp, Homo sapiens
gaagatcactgtag

SEQ ID NO: 1618540 - DNA, 14 bp, Homo sapiens
gaagatcagaacat

SEQ ID NO: 1618541 - DNA, 22 bp, Homo sapiens
gaagatccgagtgtgatttgaa

SEQ ID NO: 1618542 - DNA, 14 bp, Homo sapiens
gaagatcctgcggg

SEQ ID NO: 1618543 - DNA, 15 bp, Homo sapiens
gaagatcgcatggca

SEQ ID NO: 1618544 - DNA, 17 bp, Homo sapiens
gaagatcggaacagctc

SEQ ID NO: 1618545 - DNA, 17 bp, Homo sapiens
gaagatcttgagagctg

SEQ ID NO: 1618546 - DNA, 22 bp, Homo sapiens
gaagatcttgagagctgctgag

SEQ ID NO: 1618547 - DNA, 12 bp, Homo sapiens
gaagatgagcct

SEQ ID NO: 1618548 - DNA, 16 bp, Homo sapiens
gaagatgccagcttct

SEQ ID NO: 1618549 - DNA, 20 bp, Homo sapiens
gaagatgccagcttctctct

SEQ ID NO: 1618550 - DNA, 14 bp, Homo sapiens
gaagatgtgtaaac

SEQ ID NO: 1618551 - DNA, 18 bp, Homo sapiens
gaagatgtgtaaacaggt

SEQ ID NO: 1618552 - DNA, 20 bp, Homo sapiens
gaagatttatgaacagaaat

SEQ ID NO: 1618553 - DNA, 21 bp, Homo sapiens
gaagatttatgaacagaaata

SEQ ID NO: 1618554 - DNA, 19 bp, Homo sapiens
gaagcaaacaagcttgatt

SEQ ID NO: 1618555 - DNA, 15 bp, Homo sapiens
gaagcaaagagtgag

SEQ ID NO: 1618556 - DNA, 17 bp, Homo sapiens
gaagcaaatacaattca

SEQ ID NO: 1618557 - DNA, 18 bp, Homo sapiens
gaagcaagacacgtggcc

SEQ ID NO: 1618558 - DNA, 23 bp, Homo sapiens
gaagcaaggctggggtcttgggt

SEQ ID NO: 1618559 - DNA, 14 bp, Homo sapiens
gaagcaagggcaag

SEQ ID NO: 1618560 - DNA, 15 bp, Homo sapiens
gaagcaagggcaaga

SEQ ID NO: 1618561 - DNA, 20 bp, Homo sapiens
gaagcaagtaaaaaggctaa

SEQ ID NO: 1618562 - DNA, 16 bp, Homo sapiens
gaagcaataaagctct

SEQ ID NO: 1618563 - DNA, 19 bp, Homo sapiens
gaagcaatctttgaaataa

SEQ ID NO: 1618564 - DNA, 16 bp, Homo sapiens
gaagcacagctcctgc

SEQ ID NO: 1618565 - DNA, 18 bp, Homo sapiens
gaagcacagctcctgcca

SEQ ID NO: 1618566 - DNA, 19 bp, Homo sapiens
gaagcacagctcctgccag

SEQ ID NO: 1618567 - DNA, 20 bp, Homo sapiens
gaagcactacaccttgcctt

SEQ ID NO: 1618568 - DNA, 16 bp, Homo sapiens
gaagcacttaagtctt

SEQ ID NO: 1618569 - DNA, 22 bp, Homo sapiens
gaagcagaaatatagtgcaata

SEQ ID NO: 1618570 - DNA, 16 bp, Homo sapiens
gaagcagcactgtgag

SEQ ID NO: 1618571 - DNA, 17 bp, Homo sapiens
gaagcagggtttctttt

SEQ ID NO: 1618572 - DNA, 15 bp, Homo sapiens
gaagcagtcagccct

SEQ ID NO: 1618573 - DNA, 15 bp, Homo sapiens
gaagcagtcttgctc

SEQ ID NO: 1618574 - DNA, 20 bp, Homo sapiens
gaagcagtgcctcgaggcac

SEQ ID NO: 1618575 - DNA, 17 bp, Homo sapiens
gaagcagtgccttccat

SEQ ID NO: 1618576 - DNA, 18 bp, Homo sapiens
gaagcagtgtgagcaggg

SEQ ID NO: 1618577 - DNA, 18 bp, Homo sapiens
gaagcatgctttgctgct

SEQ ID NO: 1618578 - DNA, 22 bp, Homo sapiens
gaagcatgctttgctgctatga

SEQ ID NO: 1618579 - DNA, 17 bp, Homo sapiens
gaagcattgcctggact

SEQ ID NO: 1618580 - DNA, 18 bp, Homo sapiens
gaagcattgcctggactg

SEQ ID NO: 1618581 - DNA, 19 bp, Homo sapiens
gaagcattgcctggactga

SEQ ID NO: 1618582 - DNA, 20 bp, Homo sapiens
gaagcattgcctggactgac

SEQ ID NO: 1618583 - DNA, 22 bp, Homo sapiens
gaagcattgcctggactgacca

SEQ ID NO: 1618584 - DNA, 20 bp, Homo sapiens
gaagcattgtaaaataattc

SEQ ID NO: 1618585 - DNA, 21 bp, Homo sapiens
gaagcatttcaaagccctgcc

SEQ ID NO: 1618586 - DNA, 10 bp, Homo sapiens
gaagccaaag

SEQ ID NO: 1618587 - DNA, 14 bp, Homo sapiens
gaagccaaagaaaa

SEQ ID NO: 1618588 - DNA, 16 bp, Homo sapiens
gaagccaaagaaaaat

SEQ ID NO: 1618589 - DNA, 22 bp, Homo sapiens
gaagccaaagttttcaaactgc

SEQ ID NO: 1618590 - DNA, 19 bp, Homo sapiens
gaagccaagggaaaggggt

SEQ ID NO: 1618591 - DNA, 20 bp, Homo sapiens
gaagccaagggaaaggggtg

SEQ ID NO: 1618592 - DNA, 20 bp, Homo sapiens
gaagccaagtaaagtgctta

SEQ ID NO: 1618593 - DNA, 23 bp, Homo sapiens
gaagccaagtggggtgctgggag

SEQ ID NO: 1618594 - DNA, 13 bp, Homo sapiens
gaaaattcctaga

SEQ ID NO: 1618595 - DNA, 17 bp, Homo sapiens
gaaaattgcctttctgt

SEQ ID NO: 1618596 - DNA, 18 bp, Homo sapiens
gaaaattgcctttctgtg

SEQ ID NO: 1618597 - DNA, 16 bp, Homo sapiens
gaaaattgctgtgcct

SEQ ID NO: 1618598 - DNA, 22 bp, Homo sapiens
gaaaattgctgtgcctcccaaa

SEQ ID NO: 1618599 - DNA, 18 bp, Homo sapiens
gaaaattgttgtgcttag

SEQ ID NO: 1618600 - DNA, 12 bp, Homo sapiens
gaaaattttctc

SEQ ID NO: 1618601 - DNA, 18 bp, Homo sapiens
gaaaattttgtaaaacaa

SEQ ID NO: 1618602 - DNA, 21 bp, Homo sapiens
gaaaattttgtaaaacaatgc

SEQ ID NO: 1618603 - DNA, 22 bp, Homo sapiens
gaaaattttgtaaaacaatgcc

SEQ ID NO: 1618604 - DNA, 18 bp, Homo sapiens
gaaaatttttacattcat

SEQ ID NO: 1618605 - DNA, 17 bp, Homo sapiens
gaaacaaaaagagcttt

SEQ ID NO: 1618606 - DNA, 18 bp, Homo sapiens
gaaacaaaaagagctttc

SEQ ID NO: 1618607 - DNA, 21 bp, Homo sapiens
gaaacaaaaagagctttcctt

SEQ ID NO: 1618608 - DNA, 22 bp, Homo sapiens
gaaacaaaccgaaaatggacat

SEQ ID NO: 1618609 - DNA, 16 bp, Homo sapiens
gaaacaacatttatat

SEQ ID NO: 1618610 - DNA, 17 bp, Homo sapiens
gaaacaagaagagtaaa

SEQ ID NO: 1618611 - DNA, 15 bp, Homo sapiens
gaaacaagctgtgca

SEQ ID NO: 1618612 - DNA, 16 bp, Homo sapiens
gaaacaatcctgttac

SEQ ID NO: 1618613 - DNA, 23 bp, Homo sapiens
gaaacaatgcctacagctgtctt

SEQ ID NO: 1618614 - DNA, 15 bp, Homo sapiens
gaaacacaatatttt

SEQ ID NO: 1618615 - DNA, 14 bp, Homo sapiens
gaaacacacaagca

SEQ ID NO: 1618616 - DNA, 15 bp, Homo sapiens
gaaacacagctgttc

SEQ ID NO: 1618617 - DNA, 19 bp, Homo sapiens
gaaacacatcaaataaact

SEQ ID NO: 1618618 - DNA, 21 bp, Homo sapiens
gaaacacccctctgtctagga

SEQ ID NO: 1618619 - DNA, 17 bp, Homo sapiens
gaaacactgactcctgt

SEQ ID NO: 1618620 - DNA, 11 bp, Homo sapiens
gaaacactgcc

SEQ ID NO: 1618621 - DNA, 12 bp, Homo sapiens
gaaacactgcct

SEQ ID NO: 1618622 - DNA, 15 bp, Homo sapiens
gaaacacttctattt

SEQ ID NO: 1618623 - DNA, 16 bp, Homo sapiens
gaaacagagacaggcc

SEQ ID NO: 1618624 - DNA, 19 bp, Homo sapiens
gaaacagagacaggcccaa

SEQ ID NO: 1618625 - DNA, 20 bp, Homo sapiens
gaaacagaggagagtcccag

SEQ ID NO: 1618626 - DNA, 20 bp, Homo sapiens
gaaacagagtggcctccctg

SEQ ID NO: 1618627 - DNA, 21 bp, Homo sapiens
gaaacagagtggcctccctgc

SEQ ID NO: 1618628 - DNA, 20 bp, Homo sapiens
gaaacagatctcctggcaaa

SEQ ID NO: 1618629 - DNA, 20 bp, Homo sapiens
gaaacagattcaggccagcc

SEQ ID NO: 1618630 - DNA, 11 bp, Homo sapiens
gaaacagcatg

SEQ ID NO: 1618631 - DNA, 17 bp, Homo sapiens
gaaacagcatgaataaa

SEQ ID NO: 1618632 - DNA, 20 bp, Homo sapiens
gaaacagcatgaataaaaca

SEQ ID NO: 1618633 - DNA, 16 bp, Homo sapiens
gaaacagctttcaagt

SEQ ID NO: 1618634 - DNA, 22 bp, Homo sapiens
gaaacaggaccacaaaaatgaa

SEQ ID NO: 1618635 - DNA, 19 bp, Homo sapiens
gaaacagttgcatgtagta

SEQ ID NO: 1618636 - DNA, 23 bp, Homo sapiens
gaaacagttgcatgtagtaacac

SEQ ID NO: 1618637 - DNA, 20 bp, Homo sapiens
gaaacagttggtaacttttg

SEQ ID NO: 1618638 - DNA, 21 bp, Homo sapiens
gaaacagttggtaacttttgt

SEQ ID NO: 1618639 - DNA, 12 bp, Homo sapiens
gaaacatacaga

SEQ ID NO: 1618640 - DNA, 13 bp, Homo sapiens
gaaacatctctgg

SEQ ID NO: 1618641 - DNA, 15 bp, Homo sapiens
gaaacatggttttga

SEQ ID NO: 1618642 - DNA, 22 bp, Homo sapiens
gaaacattcacacagggctctt

SEQ ID NO: 1618643 - DNA, 18 bp, Homo sapiens
gaaacattccgaagaggg

SEQ ID NO: 1618644 - DNA, 15 bp, Homo sapiens
gaaaccacagtcagt

SEQ ID NO: 1618645 - DNA, 17 bp, Homo sapiens
gaaacccacctctctgg

SEQ ID NO: 1618646 - DNA, 15 bp, Homo sapiens
gaaaccctatttccc

SEQ ID NO: 1618647 - DNA, 21 bp, Homo sapiens
gaaaccctgcacccattagca

SEQ ID NO: 1618648 - DNA, 21 bp, Homo sapiens
gaaacctactttttatgtgct

SEQ ID NO: 1618649 - DNA, 18 bp, Homo sapiens
gaaacctagtactgcccc

SEQ ID NO: 1618650 - DNA, 20 bp, Homo sapiens
gaaacctctactaaaaagaa

SEQ ID NO: 1618651 - DNA, 13 bp, Homo sapiens
gaaacctgccctg

SEQ ID NO: 1618652 - DNA, 18 bp, Homo sapiens
gaaacctgccctgcctga

SEQ ID NO: 1618653 - DNA, 17 bp, Homo sapiens
gaaaccttgctctcctc

SEQ ID NO: 1618654 - DNA, 20 bp, Homo sapiens
gaaacctttagggcagcttg

SEQ ID NO: 1618655 - DNA, 14 bp, Homo sapiens
gaaaccttttattt

SEQ ID NO: 1618656 - DNA, 17 bp, Homo sapiens
gaaacgagatttgccaa

SEQ ID NO: 1618657 - DNA, 14 bp, Homo sapiens
gaaacgcagacact

SEQ ID NO: 1618658 - DNA, 18 bp, Homo sapiens
gaaacgctacctctctgt

SEQ ID NO: 1618659 - DNA, 23 bp, Homo sapiens
gaaactaagagacagttctctgt

SEQ ID NO: 1618660 - DNA, 21 bp, Homo sapiens
gaaactcacactcccctaggg

SEQ ID NO: 1618661 - DNA, 20 bp, Homo sapiens
gaaactcaccatgtaaaaga

SEQ ID NO: 1618662 - DNA, 18 bp, Homo sapiens
gaaactcatagacactga

SEQ ID NO: 1618663 - DNA, 20 bp, Homo sapiens
gaaactccacatctgcctta

SEQ ID NO: 1618664 - DNA, 22 bp, Homo sapiens
gaaactcctgattttgtagtta

SEQ ID NO: 1618665 - DNA, 19 bp, Homo sapiens
gaaactccttttgctgtct

SEQ ID NO: 1618666 - DNA, 16 bp, Homo sapiens
gaaactcgggcttgag

SEQ ID NO: 1618667 - DNA, 13 bp, Homo sapiens
gaaactctcattt

SEQ ID NO: 1618668 - DNA, 21 bp, Homo sapiens
gaaactgaaggtcaataaatt

SEQ ID NO: 1618669 - DNA, 14 bp, Homo sapiens
gaaactgaatgctc

SEQ ID NO: 1618670 - DNA, 18 bp, Homo sapiens
gaaactgaggaattttct

SEQ ID NO: 1618671 - DNA, 22 bp, Homo sapiens
gaaactgctcccatcattcctt

SEQ ID NO: 1618672 - DNA, 15 bp, Homo sapiens
gaaactgctgcagat

SEQ ID NO: 1618673 - DNA, 13 bp, Homo sapiens
gaaactgggaaac

SEQ ID NO: 1618674 - DNA, 19 bp, Homo sapiens
gaaactgggaaactgggtt

SEQ ID NO: 1618675 - DNA, 23 bp, Homo sapiens
gaaactggtccatgtaaatactt

SEQ ID NO: 1618676 - DNA, 19 bp, Homo sapiens
gaaacttaaatgttattat

SEQ ID NO: 1618677 - DNA, 12 bp, Homo sapiens
gaaacttggctc

SEQ ID NO: 1618678 - DNA, 22 bp, Homo sapiens
gaaactttgagatctaaaaata

SEQ ID NO: 1618679 - DNA, 19 bp, Homo sapiens
gaaacttttaactgagaaa

SEQ ID NO: 1618680 - DNA, 24 bp, Homo sapiens
gaaagaaaaataccatgtctctaa

SEQ ID NO: 1618681 - DNA, 12 bp, Homo sapiens
gaaagaaaagac

SEQ ID NO: 1618682 - DNA, 22 bp, Homo sapiens
gaaagaaatggcttttcttacc

SEQ ID NO: 1618683 - DNA, 19 bp, Homo sapiens
gaaagaacatggacttgta

SEQ ID NO: 1618684 - DNA, 11 bp, Homo sapiens
gaaagaaggaa

SEQ ID NO: 1618685 - DNA, 17 bp, Homo sapiens
gaaagaagggggccctg

SEQ ID NO: 1618686 - DNA, 20 bp, Homo sapiens
gaaagaagggggccctgcta

SEQ ID NO: 1618687 - DNA, 13 bp, Homo sapiens
gaaagaatagaac

SEQ ID NO: 1618688 - DNA, 21 bp, Homo sapiens
gaaagaattatttttgtgttt

SEQ ID NO: 1618689 - DNA, 15 bp, Homo sapiens
gaaagacactgcctg

SEQ ID NO: 1618690 - DNA, 19 bp, Homo sapiens
gaaagacactgcctgggct

SEQ ID NO: 1618691 - DNA, 15 bp, Homo sapiens
gaaagacatcaatga

SEQ ID NO: 1618692 - DNA, 17 bp, Homo sapiens
gaaagacatcaatgaaa

SEQ ID NO: 1618693 - DNA, 18 bp, Homo sapiens
gaaagactatctaaatgt

SEQ ID NO: 1618694 - DNA, 20 bp, Homo sapiens
gaaagactatctaaatgttg

SEQ ID NO: 1618695 - DNA, 14 bp, Homo sapiens
gaaagactattcaa

SEQ ID NO: 1618696 - DNA, 20 bp, Homo sapiens
gaaagactgggacagcccag

SEQ ID NO: 1618697 - DNA, 18 bp, Homo sapiens
gaaagagaaacagttggt

SEQ ID NO: 1618698 - DNA, 15 bp, Homo sapiens
gaaagagagaagcca

SEQ ID NO: 1618699 - DNA, 18 bp, Homo sapiens
gaaagagagaagccagcc

SEQ ID NO: 1618700 - DNA, 19 bp, Homo sapiens
gaaagagcaccctcgagaa

SEQ ID NO: 1618701 - DNA, 17 bp, Homo sapiens
gaaagaggagtgcttgt

SEQ ID NO: 1618702 - DNA, 20 bp, Homo sapiens
gaaagaggcagcttgaaact

SEQ ID NO: 1618703 - DNA, 21 bp, Homo sapiens
gaaagaggctgaggcctggac

SEQ ID NO: 1618704 - DNA, 13 bp, Homo sapiens
gaaagagggacaa

SEQ ID NO: 1618705 - DNA, 18 bp, Homo sapiens
gaaagaggttaggagtag

SEQ ID NO: 1618706 - DNA, 22 bp, Homo sapiens
gaaagataatattgtctgtctc

SEQ ID NO: 1618707 - DNA, 16 bp, Homo sapiens
gaaagatgaaactgaa

SEQ ID NO: 1618708 - DNA, 22 bp, Homo sapiens
gaaagatgaaactgaaagcaca

SEQ ID NO: 1618709 - DNA, 14 bp, Homo sapiens
gaaagatgcagtgg

SEQ ID NO: 1618710 - DNA, 17 bp, Homo sapiens
gaaaggaggcatgcctc

SEQ ID NO: 1618711 - DNA, 22 bp, Homo sapiens
gaaaggaggccctgttccctgg

SEQ ID NO: 1618712 - DNA, 14 bp, Homo sapiens
gaaaggatatttaa

SEQ ID NO: 1618713 - DNA, 22 bp, Homo sapiens
gaaaggatatttaagaaaatac

SEQ ID NO: 1618714 - DNA, 23 bp, Homo sapiens
gaaaggatctgtgattggctggt

SEQ ID NO: 1618715 - DNA, 22 bp, Homo sapiens
gaaaggatgtaaacagtgcctg

SEQ ID NO: 1618716 - DNA, 20 bp, Homo sapiens
gaaaggatgtggaagagcat

SEQ ID NO: 1618717 - DNA, 14 bp, Homo sapiens
gaaaggcctcaaga

SEQ ID NO: 1618718 - DNA, 14 bp, Homo sapiens
gaaaggccttcaga

SEQ ID NO: 1618719 - DNA, 20 bp, Homo sapiens
gaaaggccttcagacacatg

SEQ ID NO: 1618720 - DNA, 18 bp, Homo sapiens
gaaaggctcagtctcagg

SEQ ID NO: 1618721 - DNA, 13 bp, Homo sapiens
gaaagggaaactg

SEQ ID NO: 1618722 - DNA, 21 bp, Homo sapiens
gaaagggagcccctcctctga

SEQ ID NO: 1618723 - DNA, 19 bp, Homo sapiens
gaaagggatgaacttggcc

SEQ ID NO: 1618724 - DNA, 17 bp, Homo sapiens
gaaagggcccttcccct

SEQ ID NO: 1618725 - DNA, 14 bp, Homo sapiens
gaaagggctggctg

SEQ ID NO: 1618726 - DNA, 16 bp, Homo sapiens
gaaagggctggctgca

SEQ ID NO: 1618727 - DNA, 17 bp, Homo sapiens
gaaaggggacacctgta

SEQ ID NO: 1618728 - DNA, 18 bp, Homo sapiens
gaaaggggagagcctgct

SEQ ID NO: 1618729 - DNA, 13 bp, Homo sapiens
gaaaggggagccc

SEQ ID NO: 1618730 - DNA, 20 bp, Homo sapiens
gaaaggggcagtttaaagca

SEQ ID NO: 1618731 - DNA, 19 bp, Homo sapiens
gaaaggggcgagggagggg

SEQ ID NO: 1618732 - DNA, 22 bp, Homo sapiens
gaaagggggtcccagtgggagg

SEQ ID NO: 1618733 - DNA, 18 bp, Homo sapiens
gaaaggtactatatttgc

SEQ ID NO: 1618734 - DNA, 21 bp, Homo sapiens
gaaaggtcagcccgtttcaga

SEQ ID NO: 1618735 - DNA, 16 bp, Homo sapiens
gaaaggttaaaaaagc

SEQ ID NO: 1618736 - DNA, 18 bp, Homo sapiens
gaaagtcaaaaaattatt

SEQ ID NO: 1618737 - DNA, 21 bp, Homo sapiens
gaaagtcaaaaaattatttgc

SEQ ID NO: 1618738 - DNA, 10 bp, Homo sapiens
gaaagtcaga

SEQ ID NO: 1618739 - DNA, 21 bp, Homo sapiens
gaaagtcagaatcagaagata

SEQ ID NO: 1618740 - DNA, 20 bp, Homo sapiens
gaaagtcagccatatctcca

SEQ ID NO: 1618741 - DNA, 19 bp, Homo sapiens
gaaagtcagctttcagagc

SEQ ID NO: 1618742 - DNA, 21 bp, Homo sapiens
gaaagtggccatgccaccctg

SEQ ID NO: 1618743 - DNA, 22 bp, Homo sapiens
gaaagtgggcttaatggagttc

SEQ ID NO: 1618744 - DNA, 11 bp, Homo sapiens
gaaagtgtatt

SEQ ID NO: 1618745 - DNA, 18 bp, Homo sapiens
gaaagtgtgagctcttcc

SEQ ID NO: 1618746 - DNA, 19 bp, Homo sapiens
gaaagtgtgagctcttccc

SEQ ID NO: 1618747 - DNA, 16 bp, Homo sapiens
gaaagttactgtaaat

SEQ ID NO: 1618748 - DNA, 17 bp, Homo sapiens
gaaagttactgtaaatg

SEQ ID NO: 1618749 - DNA, 18 bp, Homo sapiens
gaaagttagggggttctt

SEQ ID NO: 1618750 - DNA, 15 bp, Homo sapiens
gaaagttctcagaac

SEQ ID NO: 1618751 - DNA, 14 bp, Homo sapiens
gaaagttggaaagg

SEQ ID NO: 1618752 - DNA, 20 bp, Homo sapiens
gaaagtttacccatgaagat

SEQ ID NO: 1618753 - DNA, 20 bp, Homo sapiens
gaaagtttcgttatattaaa

SEQ ID NO: 1618754 - DNA, 22 bp, Homo sapiens
gaaagtttggggacatgtgatt

SEQ ID NO: 1618755 - DNA, 22 bp, Homo sapiens
gaaagttttcagaacctcttcc

SEQ ID NO: 1618756 - DNA, 19 bp, Homo sapiens
gaaagtttttttttattat

SEQ ID NO: 1618757 - DNA, 23 bp, Homo sapiens
gaaataaaatgccatagtttgtg

SEQ ID NO: 1618758 - DNA, 14 bp, Homo sapiens
gaaataaaatttga

SEQ ID NO: 1618759 - DNA, 20 bp, Homo sapiens
gaaataaatgtacctgatgt

SEQ ID NO: 1618760 - DNA, 18 bp, Homo sapiens
gaaataaattttgtttca

SEQ ID NO: 1618761 - DNA, 21 bp, Homo sapiens
gaaataagaaaaatcatgttt

SEQ ID NO: 1618762 - DNA, 13 bp, Homo sapiens
gaaataataaaaa

SEQ ID NO: 1618763 - DNA, 20 bp, Homo sapiens
gaaataataaaaaatttcag

SEQ ID NO: 1618764 - DNA, 14 bp, Homo sapiens
gaaataatatgcat

SEQ ID NO: 1618765 - DNA, 17 bp, Homo sapiens
gaaataatcagtgactg

SEQ ID NO: 1618766 - DNA, 13 bp, Homo sapiens
gaaataatgcact

SEQ ID NO: 1618767 - DNA, 14 bp, Homo sapiens
gaaataatgctaca

SEQ ID NO: 1618768 - DNA, 19 bp, Homo sapiens
gaaataatgctacaatttt

SEQ ID NO: 1618769 - DNA, 21 bp, Homo sapiens
gaaataatgctacaattttaa

SEQ ID NO: 1618770 - DNA, 13 bp, Homo sapiens
gaaataatttgaa

SEQ ID NO: 1618771 - DNA, 14 bp, Homo sapiens
gaaataatttgaat

SEQ ID NO: 1618772 - DNA, 19 bp, Homo sapiens
gaaatacacaagtaaacat

SEQ ID NO: 1618773 - DNA, 19 bp, Homo sapiens
gaaatacagataaatgatt

SEQ ID NO: 1618774 - DNA, 16 bp, Homo sapiens
gaaataccacaagcct

SEQ ID NO: 1618775 - DNA, 14 bp, Homo sapiens
gaaatactcatgtg

SEQ ID NO: 1618776 - DNA, 13 bp, Homo sapiens
gaaatactgctct

SEQ ID NO: 1618777 - DNA, 18 bp, Homo sapiens
gaaatagacagtatattt

SEQ ID NO: 1618778 - DNA, 19 bp, Homo sapiens
gaaatagacagtatattta

SEQ ID NO: 1618779 - DNA, 21 bp, Homo sapiens
gaaatagcatgacaggctgtt

SEQ ID NO: 1618780 - DNA, 14 bp, Homo sapiens
gaaataggaaacaa

SEQ ID NO: 1618781 - DNA, 17 bp, Homo sapiens
gaaatagtatacattgt

SEQ ID NO: 1618782 - DNA, 17 bp, Homo sapiens
gaaatagtctgatttta

SEQ ID NO: 1618783 - DNA, 15 bp, Homo sapiens
gaaatagtctgtgtg

SEQ ID NO: 1618784 - DNA, 17 bp, Homo sapiens
gaaatagtctgtgtgaa

SEQ ID NO: 1618785 - DNA, 17 bp, Homo sapiens
gaaatagttctgtgact

SEQ ID NO: 1618786 - DNA, 16 bp, Homo sapiens
gaaatatagtgcaata

SEQ ID NO: 1618787 - DNA, 11 bp, Homo sapiens
gaaatatataa

SEQ ID NO: 1618788 - DNA, 17 bp, Homo sapiens
gaaatatatatgtgtgt

SEQ ID NO: 1618789 - DNA, 14 bp, Homo sapiens
gaaatatcatgtta

SEQ ID NO: 1618790 - DNA, 22 bp, Homo sapiens
gaaatatcgctgatgcagacac

SEQ ID NO: 1618791 - DNA, 19 bp, Homo sapiens
gaaatatctgaaaatgtat

SEQ ID NO: 1618792 - DNA, 20 bp, Homo sapiens
gaaatatctgaaaatgtatg

SEQ ID NO: 1618793 - DNA, 15 bp, Homo sapiens
gaaatatgattttat

SEQ ID NO: 1618794 - DNA, 18 bp, Homo sapiens
gaaatatgcacaatagca

SEQ ID NO: 1618795 - DNA, 22 bp, Homo sapiens
gaaatatgtagtattaaaagtt

SEQ ID NO: 1618796 - DNA, 19 bp, Homo sapiens
gaaatattaaaccctggat

SEQ ID NO: 1618797 - DNA, 16 bp, Homo sapiens
gaaatattcagaaatt

SEQ ID NO: 1618798 - DNA, 21 bp, Homo sapiens
gaaatattgactcaaaccata

SEQ ID NO: 1618799 - DNA, 19 bp, Homo sapiens
gaaatattggttgaaagtt

SEQ ID NO: 1618800 - DNA, 13 bp, Homo sapiens
gaaatattttaat

SEQ ID NO: 1618801 - DNA, 23 bp, Homo sapiens
gaaatattttaatttttaaatgc

SEQ ID NO: 1618802 - DNA, 19 bp, Homo sapiens
gaaatcaaagagagaaaat

SEQ ID NO: 1618803 - DNA, 15 bp, Homo sapiens
gaaatcaaccctctc

SEQ ID NO: 1618804 - DNA, 16 bp, Homo sapiens
gaaatcacagaatcat

SEQ ID NO: 1618805 - DNA, 19 bp, Homo sapiens
gaaatcacaggggcggggc

SEQ ID NO: 1618806 - DNA, 22 bp, Homo sapiens
gaaatcacaggggcggggcagg

SEQ ID NO: 1618807 - DNA, 20 bp, Homo sapiens
gaaatcagtaatatttatat

SEQ ID NO: 1618808 - DNA, 17 bp, Homo sapiens
gaaatcagttgtgaata

SEQ ID NO: 1618809 - DNA, 15 bp, Homo sapiens
gaaatcataccagtt

SEQ ID NO: 1618810 - DNA, 20 bp, Homo sapiens
gaaatccatatatatgaaat

SEQ ID NO: 1618811 - DNA, 22 bp, Homo sapiens
gaaatccgagcggctacaaagc

SEQ ID NO: 1618812 - DNA, 12 bp, Homo sapiens
gaaatctcaccc

SEQ ID NO: 1618813 - DNA, 14 bp, Homo sapiens
gaaatctgaacatt

SEQ ID NO: 1618814 - DNA, 17 bp, Homo sapiens
gaaatctgctagaaagt

SEQ ID NO: 1618815 - DNA, 16 bp, Homo sapiens
gaaatctgtaaagcca

SEQ ID NO: 1618816 - DNA, 12 bp, Homo sapiens
gaaatctgtatt

SEQ ID NO: 1618817 - DNA, 18 bp, Homo sapiens
gaaatgaaagggaaactg

SEQ ID NO: 1618818 - DNA, 23 bp, Homo sapiens
gaaatgaaagggaaactgggaaa

SEQ ID NO: 1618819 - DNA, 13 bp, Homo sapiens
gaaatgaataatt

SEQ ID NO: 1618820 - DNA, 18 bp, Homo sapiens
gaaatgaataatttccca

SEQ ID NO: 1618821 - DNA, 15 bp, Homo sapiens
gaaatgaattaaagt

SEQ ID NO: 1618822 - DNA, 22 bp, Homo sapiens
gaaatgacggtgttaattttgc

SEQ ID NO: 1618823 - DNA, 19 bp, Homo sapiens
gaaatgactaaaaaacaaa

SEQ ID NO: 1618824 - DNA, 12 bp, Homo sapiens
cttttttgtcta

SEQ ID NO: 1618825 - DNA, 23 bp, Homo sapiens
cttttttgtctatgaagttgctg

SEQ ID NO: 1618826 - DNA, 13 bp, Homo sapiens
cttttttgtgtat

SEQ ID NO: 1618827 - DNA, 15 bp, Homo sapiens
cttttttgtgtatgt

SEQ ID NO: 1618828 - DNA, 17 bp, Homo sapiens
cttttttgtgtatgtac

SEQ ID NO: 1618829 - DNA, 18 bp, Homo sapiens
cttttttgtgtatgtact

SEQ ID NO: 1618830 - DNA, 16 bp, Homo sapiens
ctttttttaaaattat

SEQ ID NO: 1618831 - DNA, 16 bp, Homo sapiens
ctttttttaactggtg

SEQ ID NO: 1618832 - DNA, 17 bp, Homo sapiens
ctttttttaactggtga

SEQ ID NO: 1618833 - DNA, 16 bp, Homo sapiens
ctttttttccttttta

SEQ ID NO: 1618834 - DNA, 19 bp, Homo sapiens
ctttttttctgtaccagtt

SEQ ID NO: 1618835 - DNA, 14 bp, Homo sapiens
ctttttttcttaaa

SEQ ID NO: 1618836 - DNA, 18 bp, Homo sapiens
ctttttttctttaataac

SEQ ID NO: 1618837 - DNA, 13 bp, Homo sapiens
ctttttttgaaac

SEQ ID NO: 1618838 - DNA, 17 bp, Homo sapiens
ctttttttgtatgtgtg

SEQ ID NO: 1618839 - DNA, 21 bp, Homo sapiens
ctttttttgtgtgtatttgct

SEQ ID NO: 1618840 - DNA, 22 bp, Homo sapiens
ctttttttgtgtgtatttgcta

SEQ ID NO: 1618841 - DNA, 13 bp, Homo sapiens
cttttttttcctt

SEQ ID NO: 1618842 - DNA, 15 bp, Homo sapiens
cttttttttcctttg

SEQ ID NO: 1618843 - DNA, 17 bp, Homo sapiens
cttttttttctctcttt

SEQ ID NO: 1618844 - DNA, 15 bp, Homo sapiens
ctttttttttctctt

SEQ ID NO: 1618845 - DNA, 21 bp, Homo sapiens
ctttttttttttctgcctgag

SEQ ID NO: 1618846 - DNA, 23 bp, Homo sapiens
ctttttttttttttaaagacaga

SEQ ID NO: 1618847 - DNA, 22 bp, Homo sapiens
gaaaaaaaaaactttatttaaa

SEQ ID NO: 1618848 - DNA, 21 bp, Homo sapiens
gaaaaaaaaagtcagactgct

SEQ ID NO: 1618849 - DNA, 18 bp, Homo sapiens
gaaaaaaaaccttgtaaa

SEQ ID NO: 1618850 - DNA, 15 bp, Homo sapiens
gaaaaaaaagaaagc

SEQ ID NO: 1618851 - DNA, 19 bp, Homo sapiens
gaaaaaaaagtttcagaga

SEQ ID NO: 1618852 - DNA, 14 bp, Homo sapiens
gaaaaaaaatgtac

SEQ ID NO: 1618853 - DNA, 20 bp, Homo sapiens
gaaaaaaaatgttctttggg

SEQ ID NO: 1618854 - DNA, 23 bp, Homo sapiens
gaaaaaaacaaaaacagaatttg

SEQ ID NO: 1618855 - DNA, 13 bp, Homo sapiens
gaaaaaaattgaa

SEQ ID NO: 1618856 - DNA, 19 bp, Homo sapiens
gaaaaaacacctagcttta

SEQ ID NO: 1618857 - DNA, 19 bp, Homo sapiens
gaaaaaagaaaatggctaa

SEQ ID NO: 1618858 - DNA, 21 bp, Homo sapiens
gaaaaaagaagtgtccgagaa

SEQ ID NO: 1618859 - DNA, 13 bp, Homo sapiens
gaaaaaattgaaa

SEQ ID NO: 1618860 - DNA, 14 bp, Homo sapiens
gaaaaacacaagca

SEQ ID NO: 1618861 - DNA, 17 bp, Homo sapiens
gaaaaacacaagcaaaa

SEQ ID NO: 1618862 - DNA, 12 bp, Homo sapiens
gaaaaacatgtc

SEQ ID NO: 1618863 - DNA, 14 bp, Homo sapiens
gaaaaacatgtcat

SEQ ID NO: 1618864 - DNA, 17 bp, Homo sapiens
gaaaaacatgtcatgta

SEQ ID NO: 1618865 - DNA, 20 bp, Homo sapiens
gaaaaacggcagtatcacag

SEQ ID NO: 1618866 - DNA, 20 bp, Homo sapiens
gaaaaactgatcaaaaataa

SEQ ID NO: 1618867 - DNA, 22 bp, Homo sapiens
gaaaaactttggaaccagactc

SEQ ID NO: 1618868 - DNA, 12 bp, Homo sapiens
gaaaaagaaatg

SEQ ID NO: 1618869 - DNA, 13 bp, Homo sapiens
gaaaaagaaatgc

SEQ ID NO: 1618870 - DNA, 20 bp, Homo sapiens
gaaaaagactttaaaagtga

SEQ ID NO: 1618871 - DNA, 22 bp, Homo sapiens
gaaaaagcagtaactgacaact

SEQ ID NO: 1618872 - DNA, 19 bp, Homo sapiens
gaaaaagcatgatgggaaa

SEQ ID NO: 1618873 - DNA, 13 bp, Homo sapiens
gaaaaaggcagtg

SEQ ID NO: 1618874 - DNA, 15 bp, Homo sapiens
gaaaaagtacaatga

SEQ ID NO: 1618875 - DNA, 22 bp, Homo sapiens
gaaaaataacaactaacttgtt

SEQ ID NO: 1618876 - DNA, 19 bp, Homo sapiens
gaaaaataacttcaagcaa

SEQ ID NO: 1618877 - DNA, 13 bp, Homo sapiens
gaaaaataatcaa

SEQ ID NO: 1618878 - DNA, 12 bp, Homo sapiens
gaaaaatataaa

SEQ ID NO: 1618879 - DNA, 16 bp, Homo sapiens
gaaaaatataaaatta

SEQ ID NO: 1618880 - DNA, 17 bp, Homo sapiens
gaaaaatataaaattat

SEQ ID NO: 1618881 - DNA, 15 bp, Homo sapiens
gaaaaatatttctga

SEQ ID NO: 1618882 - DNA, 16 bp, Homo sapiens
gaaaaatatttctgag

SEQ ID NO: 1618883 - DNA, 21 bp, Homo sapiens
gaaaaatcaagtattataaac

SEQ ID NO: 1618884 - DNA, 11 bp, Homo sapiens
gaaaaatcttg

SEQ ID NO: 1618885 - DNA, 21 bp, Homo sapiens
gaaaaatcttgtgctagaata

SEQ ID NO: 1618886 - DNA, 20 bp, Homo sapiens
gaaaaatgagaattttatat

SEQ ID NO: 1618887 - DNA, 16 bp, Homo sapiens
gaaaaatgctccccac

SEQ ID NO: 1618888 - DNA, 13 bp, Homo sapiens
cttttctctttgg

SEQ ID NO: 1618889 - DNA, 22 bp, Homo sapiens
cttttctgagttcttgaagcat

SEQ ID NO: 1618890 - DNA, 13 bp, Homo sapiens
cttttctgccctg

SEQ ID NO: 1618891 - DNA, 17 bp, Homo sapiens
cttttctgccctggctg

SEQ ID NO: 1618892 - DNA, 16 bp, Homo sapiens
cttttctgcctgctcc

SEQ ID NO: 1618893 - DNA, 18 bp, Homo sapiens
cttttctggaatgtaatc

SEQ ID NO: 1618894 - DNA, 13 bp, Homo sapiens
cttttctgtattt

SEQ ID NO: 1618895 - DNA, 15 bp, Homo sapiens
cttttctgtcctggg

SEQ ID NO: 1618896 - DNA, 13 bp, Homo sapiens
cttttctgtgatt

SEQ ID NO: 1618897 - DNA, 14 bp, Homo sapiens
cttttctgtgccag

SEQ ID NO: 1618898 - DNA, 18 bp, Homo sapiens
cttttctgttattgtatt

SEQ ID NO: 1618899 - DNA, 14 bp, Homo sapiens
cttttctttaaaga

SEQ ID NO: 1618900 - DNA, 17 bp, Homo sapiens
cttttctttaaagaagt

SEQ ID NO: 1618901 - DNA, 14 bp, Homo sapiens
cttttctttaactt

SEQ ID NO: 1618902 - DNA, 16 bp, Homo sapiens
cttttctttgaccaga

SEQ ID NO: 1618903 - DNA, 15 bp, Homo sapiens
cttttctttgttata

SEQ ID NO: 1618904 - DNA, 20 bp, Homo sapiens
cttttcttttctaccctagc

SEQ ID NO: 1618905 - DNA, 17 bp, Homo sapiens
cttttgaaaaaaaagtt

SEQ ID NO: 1618906 - DNA, 19 bp, Homo sapiens
cttttgaaaagaccaagac

SEQ ID NO: 1618907 - DNA, 18 bp, Homo sapiens
cttttgaaagtagagcta

SEQ ID NO: 1618908 - DNA, 21 bp, Homo sapiens
cttttgaaagtagagctagct

SEQ ID NO: 1618909 - DNA, 21 bp, Homo sapiens
cttttgaatacatttgtattt

SEQ ID NO: 1618910 - DNA, 13 bp, Homo sapiens
cttttgaatattc

SEQ ID NO: 1618911 - DNA, 23 bp, Homo sapiens
cttttgaatccatgcttgggtgt

SEQ ID NO: 1618912 - DNA, 12 bp, Homo sapiens
cttttgacactg

SEQ ID NO: 1618913 - DNA, 11 bp, Homo sapiens
cttttgacatt

SEQ ID NO: 1618914 - DNA, 16 bp, Homo sapiens
cttttgaggagctgga

SEQ ID NO: 1618915 - DNA, 12 bp, Homo sapiens
cttttgaggctt

SEQ ID NO: 1618916 - DNA, 20 bp, Homo sapiens
cttttgagtgtgtgtgtgca

SEQ ID NO: 1618917 - DNA, 15 bp, Homo sapiens
cttttgataaatcct

SEQ ID NO: 1618918 - DNA, 23 bp, Homo sapiens
cttttgataaatttaaaatgtta

SEQ ID NO: 1618919 - DNA, 15 bp, Homo sapiens
cttttgatatgcata

SEQ ID NO: 1618920 - DNA, 15 bp, Homo sapiens
cttttgatggggaga

SEQ ID NO: 1618921 - DNA, 16 bp, Homo sapiens
cttttgcaaccaggaa

SEQ ID NO: 1618922 - DNA, 18 bp, Homo sapiens
cttttgcaacttaatact

SEQ ID NO: 1618923 - DNA, 21 bp, Homo sapiens
cttttgcacaaggaaataaag

SEQ ID NO: 1618924 - DNA, 14 bp, Homo sapiens
cttttgcagaagag

SEQ ID NO: 1618925 - DNA, 23 bp, Homo sapiens
cttttgcagaagagggtgtgttt

SEQ ID NO: 1618926 - DNA, 22 bp, Homo sapiens
cttttgcataagattaaaggaa

SEQ ID NO: 1618927 - DNA, 13 bp, Homo sapiens
cttttgccactcc

SEQ ID NO: 1618928 - DNA, 18 bp, Homo sapiens
cttttgccactgctgtgt

SEQ ID NO: 1618929 - DNA, 22 bp, Homo sapiens
cttttgcccgttgaggtagagg

SEQ ID NO: 1618930 - DNA, 21 bp, Homo sapiens
cttttgcccttcacagtgttt

SEQ ID NO: 1618931 - DNA, 15 bp, Homo sapiens
cttttgcctgcaaga

SEQ ID NO: 1618932 - DNA, 20 bp, Homo sapiens
cttttgccttttgcaaccag

SEQ ID NO: 1618933 - DNA, 23 bp, Homo sapiens
cttttgctactaagttcacatta

SEQ ID NO: 1618934 - DNA, 14 bp, Homo sapiens
cttttgctgtcttt

SEQ ID NO: 1618935 - DNA, 15 bp, Homo sapiens
cttttgctgtctttc

SEQ ID NO: 1618936 - DNA, 17 bp, Homo sapiens
cttttgctgtctttctc

SEQ ID NO: 1618937 - DNA, 12 bp, Homo sapiens
cttttgctgtgc

SEQ ID NO: 1618938 - DNA, 20 bp, Homo sapiens
cttttgcttgccaaagtaca

SEQ ID NO: 1618939 - DNA, 20 bp, Homo sapiens
cttttgctttctgtttctta

SEQ ID NO: 1618940 - DNA, 15 bp, Homo sapiens
cttttgcttttggca

SEQ ID NO: 1618941 - DNA, 14 bp, Homo sapiens
cttttggtctccct

SEQ ID NO: 1618942 - DNA, 21 bp, Homo sapiens
cttttgtaattgtgtaaaaaa

SEQ ID NO: 1618943 - DNA, 12 bp, Homo sapiens
cttttgtattaa

SEQ ID NO: 1618944 - DNA, 17 bp, Homo sapiens
cttttgtccccagggcc

SEQ ID NO: 1618945 - DNA, 13 bp, Homo sapiens
cttttgtgatgaa

SEQ ID NO: 1618946 - DNA, 18 bp, Homo sapiens
cttttgtgatgaacatat

SEQ ID NO: 1618947 - DNA, 15 bp, Homo sapiens
cttttgtggagggga

SEQ ID NO: 1618948 - DNA, 22 bp, Homo sapiens
cttttgtgggtttctctgtgct

SEQ ID NO: 1618949 - DNA, 23 bp, Homo sapiens
cttggtttttttttttcttaaat

SEQ ID NO: 1618950 - DNA, 11 bp, Homo sapiens
cttgtaaaaaa

SEQ ID NO: 1618951 - DNA, 15 bp, Homo sapiens
cttgtaaaaaaagca

SEQ ID NO: 1618952 - DNA, 16 bp, Homo sapiens
cttgtaaaaaaagcaa

SEQ ID NO: 1618953 - DNA, 17 bp, Homo sapiens
cttgtaaaaaaagcaaa

SEQ ID NO: 1618954 - DNA, 18 bp, Homo sapiens
cttgtaaagactgtagaa

SEQ ID NO: 1618955 - DNA, 16 bp, Homo sapiens
cttgtaaaggatatta

SEQ ID NO: 1618956 - DNA, 13 bp, Homo sapiens
cttgtaaatcttt

SEQ ID NO: 1618957 - DNA, 18 bp, Homo sapiens
cttgtaagctatctgtgc

SEQ ID NO: 1618958 - DNA, 22 bp, Homo sapiens
cttgtaatacctgattgatcac

SEQ ID NO: 1618959 - DNA, 13 bp, Homo sapiens
cttgtaattctaa

SEQ ID NO: 1618960 - DNA, 23 bp, Homo sapiens
cttgtaatttaaacaggcccagc

SEQ ID NO: 1618961 - DNA, 13 bp, Homo sapiens
cttgtacatgtgt

SEQ ID NO: 1618962 - DNA, 20 bp, Homo sapiens
cttgtacatgtgtagcctgt

SEQ ID NO: 1618963 - DNA, 23 bp, Homo sapiens
cttgtacatgtgtagcctgtgca

SEQ ID NO: 1618964 - DNA, 18 bp, Homo sapiens
cttgtaccatagaaaaat

SEQ ID NO: 1618965 - DNA, 19 bp, Homo sapiens
cttgtaccatagaaaaatg

SEQ ID NO: 1618966 - DNA, 22 bp, Homo sapiens
cttgtaccatagaaaaatgtat

SEQ ID NO: 1618967 - DNA, 19 bp, Homo sapiens
cttgtacctatggctgcct

SEQ ID NO: 1618968 - DNA, 13 bp, Homo sapiens
cttgtactgggac

SEQ ID NO: 1618969 - DNA, 14 bp, Homo sapiens
cttgtactgggaca

SEQ ID NO: 1618970 - DNA, 22 bp, Homo sapiens
cttgtacttctgtgttcatttt

SEQ ID NO: 1618971 - DNA, 17 bp, Homo sapiens
cttgtagaactcactct

SEQ ID NO: 1618972 - DNA, 17 bp, Homo sapiens
cttgtagaggagcaggg

SEQ ID NO: 1618973 - DNA, 17 bp, Homo sapiens
cttgtagggatgccttt

SEQ ID NO: 1618974 - DNA, 21 bp, Homo sapiens
cttgtagtttacctctttaaa

SEQ ID NO: 1618975 - DNA, 20 bp, Homo sapiens
cttgtatatacgcatctata

SEQ ID NO: 1618976 - DNA, 16 bp, Homo sapiens
cttgtatattccacca

SEQ ID NO: 1618977 - DNA, 23 bp, Homo sapiens
cttgtatattccaccattcacat

SEQ ID NO: 1618978 - DNA, 19 bp, Homo sapiens
cttgtatatttgtacaaaa

SEQ ID NO: 1618979 - DNA, 19 bp, Homo sapiens
cttgtatcaacactgttac

SEQ ID NO: 1618980 - DNA, 20 bp, Homo sapiens
cttgtatcaacactgttact

SEQ ID NO: 1618981 - DNA, 15 bp, Homo sapiens
cttgtatgctgccca

SEQ ID NO: 1618982 - DNA, 13 bp, Homo sapiens
cttgtattgactt

SEQ ID NO: 1618983 - DNA, 12 bp, Homo sapiens
cttgtatttaaa

SEQ ID NO: 1618984 - DNA, 13 bp, Homo sapiens
cttgtatttaatt

SEQ ID NO: 1618985 - DNA, 15 bp, Homo sapiens
cttgtatttaattct

SEQ ID NO: 1618986 - DNA, 13 bp, Homo sapiens
cttgtatttccaa

SEQ ID NO: 1618987 - DNA, 23 bp, Homo sapiens
cttgtcaaagaaggtgctgatcc

SEQ ID NO: 1618988 - DNA, 16 bp, Homo sapiens
cttgtcacaataaatg

SEQ ID NO: 1618989 - DNA, 20 bp, Homo sapiens
cttgtcacgatcacaggcct

SEQ ID NO: 1618990 - DNA, 18 bp, Homo sapiens
cttgtcactagcagctgc

SEQ ID NO: 1618991 - DNA, 19 bp, Homo sapiens
cttgtcactagcagctgca

SEQ ID NO: 1618992 - DNA, 22 bp, Homo sapiens
cttgtcactggtagaccaaaat

SEQ ID NO: 1618993 - DNA, 13 bp, Homo sapiens
cttgtcagcaaga

SEQ ID NO: 1618994 - DNA, 15 bp, Homo sapiens
cttgtcatccacaca

SEQ ID NO: 1618995 - DNA, 14 bp, Homo sapiens
cttgtcatgtgaca

SEQ ID NO: 1618996 - DNA, 13 bp, Homo sapiens
cttgtcatgtgta

SEQ ID NO: 1618997 - DNA, 14 bp, Homo sapiens
cttgtcatgtgtat

SEQ ID NO: 1618998 - DNA, 15 bp, Homo sapiens
cttgtcattccagag

SEQ ID NO: 1618999 - DNA, 20 bp, Homo sapiens
cttgtccaacccgaggcccg

SEQ ID NO: 1619000 - DNA, 22 bp, Homo sapiens
cttgtccaggtctcactgcttt

SEQ ID NO: 1619001 - DNA, 23 bp, Homo sapiens
cttgtcccccgtgatctcccctc

SEQ ID NO: 1619002 - DNA, 13 bp, Homo sapiens
cttgtcctcttct

SEQ ID NO: 1619003 - DNA, 17 bp, Homo sapiens
cttgtcctcttctgctc

SEQ ID NO: 1619004 - DNA, 14 bp, Homo sapiens
cttgtcctgccagc

SEQ ID NO: 1619005 - DNA, 20 bp, Homo sapiens
cttgtcctgccagctgcctt

SEQ ID NO: 1619006 - DNA, 14 bp, Homo sapiens
cttgtcctgctctc

SEQ ID NO: 1619007 - DNA, 18 bp, Homo sapiens
cttgtcctgctctcttca

SEQ ID NO: 1619008 - DNA, 17 bp, Homo sapiens
cttgtcctggcccttca

SEQ ID NO: 1619009 - DNA, 19 bp, Homo sapiens
cttgtcctggcccttcagt

SEQ ID NO: 1619010 - DNA, 22 bp, Homo sapiens
cttgtcctggcccttcagtctg

SEQ ID NO: 1619011 - DNA, 23 bp, Homo sapiens
cttgtccttttgtaccatggtgt

SEQ ID NO: 1619012 - DNA, 20 bp, Homo sapiens
cttgtctggcaaaagaaaaa

SEQ ID NO: 1619013 - DNA, 23 bp, Homo sapiens
cttgtctgtcaaatgtttcctta

SEQ ID NO: 1619014 - DNA, 15 bp, Homo sapiens
cttgtcttagctctg

SEQ ID NO: 1619015 - DNA, 16 bp, Homo sapiens
cttgtcttagctctgg

SEQ ID NO: 1619016 - DNA, 21 bp, Homo sapiens
cttgtcttcctatttcagaag

SEQ ID NO: 1619017 - DNA, 18 bp, Homo sapiens
cttgtcttctggtacttt

SEQ ID NO: 1619018 - DNA, 16 bp, Homo sapiens
cttgtcttttgagcta

SEQ ID NO: 1619019 - DNA, 19 bp, Homo sapiens
cttgtgaattattctgatt

SEQ ID NO: 1619020 - DNA, 17 bp, Homo sapiens
cttgtgacgtgcactgt

SEQ ID NO: 1619021 - DNA, 18 bp, Homo sapiens
ctttaagccttcaaaact

SEQ ID NO: 1619022 - DNA, 20 bp, Homo sapiens
ctttaagccttcaaaactat

SEQ ID NO: 1619023 - DNA, 13 bp, Homo sapiens
ctttaagctcctt

SEQ ID NO: 1619024 - DNA, 12 bp, Homo sapiens
ctttaaggaaaa

SEQ ID NO: 1619025 - DNA, 23 bp, Homo sapiens
ctttaataacaaggagatttctt

SEQ ID NO: 1619026 - DNA, 17 bp, Homo sapiens
ctttaatacaaaaagca

SEQ ID NO: 1619027 - DNA, 23 bp, Homo sapiens
ctttaatagtcaccttcatgatt

SEQ ID NO: 1619028 - DNA, 17 bp, Homo sapiens
ctttaatcactgcattt

SEQ ID NO: 1619029 - DNA, 17 bp, Homo sapiens
ctttaatcttcagtttt

SEQ ID NO: 1619030 - DNA, 22 bp, Homo sapiens
ctttaatcttcagttttatctt

SEQ ID NO: 1619031 - DNA, 18 bp, Homo sapiens
ctttaatgagaatagaaa

SEQ ID NO: 1619032 - DNA, 22 bp, Homo sapiens
ctttaatgttttaactcttttg

SEQ ID NO: 1619033 - DNA, 23 bp, Homo sapiens
ctttaatgttttttgccacagct

SEQ ID NO: 1619034 - DNA, 22 bp, Homo sapiens
ctttaattaaaacctgggatta

SEQ ID NO: 1619035 - DNA, 19 bp, Homo sapiens
ctttaattctctttcaaag

SEQ ID NO: 1619036 - DNA, 15 bp, Homo sapiens
ctttaattttcttgt

SEQ ID NO: 1619037 - DNA, 16 bp, Homo sapiens
ctttacacaagaatct

SEQ ID NO: 1619038 - DNA, 15 bp, Homo sapiens
ctttacactcaggct

SEQ ID NO: 1619039 - DNA, 23 bp, Homo sapiens
ctttacagttagcagggatgttc

SEQ ID NO: 1619040 - DNA, 20 bp, Homo sapiens
ctttacagtttttttctttg

SEQ ID NO: 1619041 - DNA, 13 bp, Homo sapiens
ctttaccaaaaac

SEQ ID NO: 1619042 - DNA, 19 bp, Homo sapiens
ctttaccaaaaaccatgtt

SEQ ID NO: 1619043 - DNA, 17 bp, Homo sapiens
ctttacccacctagaac

SEQ ID NO: 1619044 - DNA, 17 bp, Homo sapiens
ctttaccctctttgctg

SEQ ID NO: 1619045 - DNA, 16 bp, Homo sapiens
ctttacctgcaggctc

SEQ ID NO: 1619046 - DNA, 20 bp, Homo sapiens
ctttacgttcatcacctgct

SEQ ID NO: 1619047 - DNA, 19 bp, Homo sapiens
ctttactaactctggttta

SEQ ID NO: 1619048 - DNA, 18 bp, Homo sapiens
ctttactatgtttctcag

SEQ ID NO: 1619049 - DNA, 21 bp, Homo sapiens
ctttactcagcccagctggcc

SEQ ID NO: 1619050 - DNA, 12 bp, Homo sapiens
ctttactccctt

SEQ ID NO: 1619051 - DNA, 19 bp, Homo sapiens
ctttactcccttcctggcc

SEQ ID NO: 1619052 - DNA, 19 bp, Homo sapiens
ctttactgtcaaaataatt

SEQ ID NO: 1619053 - DNA, 12 bp, Homo sapiens
ctttactgtttg

SEQ ID NO: 1619054 - DNA, 17 bp, Homo sapiens
ctttacttatctctcaa

SEQ ID NO: 1619055 - DNA, 15 bp, Homo sapiens
ctttacttgtggtgt

SEQ ID NO: 1619056 - DNA, 21 bp, Homo sapiens
ctttacttgtggtgtgaccat

SEQ ID NO: 1619057 - DNA, 14 bp, Homo sapiens
ctttacttttaaac

SEQ ID NO: 1619058 - DNA, 15 bp, Homo sapiens
ctttagaaataaatg

SEQ ID NO: 1619059 - DNA, 16 bp, Homo sapiens
ctttagaaataaatgt

SEQ ID NO: 1619060 - DNA, 19 bp, Homo sapiens
ctttagaatttttacccaa

SEQ ID NO: 1619061 - DNA, 15 bp, Homo sapiens
ctttagagataattg

SEQ ID NO: 1619062 - DNA, 13 bp, Homo sapiens
ctttagagtagca

SEQ ID NO: 1619063 - DNA, 12 bp, Homo sapiens
ctttagatgctg

SEQ ID NO: 1619064 - DNA, 13 bp, Homo sapiens
ctttagatgctga

SEQ ID NO: 1619065 - DNA, 15 bp, Homo sapiens
ctttagcctggacca

SEQ ID NO: 1619066 - DNA, 22 bp, Homo sapiens
ctttaggagatttattttttgg

SEQ ID NO: 1619067 - DNA, 15 bp, Homo sapiens
ctttaggatgtaaag

SEQ ID NO: 1619068 - DNA, 16 bp, Homo sapiens
ctttagggcagcttgc

SEQ ID NO: 1619069 - DNA, 12 bp, Homo sapiens
ctttcactttga

SEQ ID NO: 1619070 - DNA, 15 bp, Homo sapiens
ctttcagaaatataa

SEQ ID NO: 1619071 - DNA, 23 bp, Homo sapiens
ctttcagaaatataacacatttt

SEQ ID NO: 1619072 - DNA, 16 bp, Homo sapiens
ctttcagaatattttc

SEQ ID NO: 1619073 - DNA, 19 bp, Homo sapiens
ctttcagactctctctggg

SEQ ID NO: 1619074 - DNA, 22 bp, Homo sapiens
ctttcagagccagcctggctct

SEQ ID NO: 1619075 - DNA, 15 bp, Homo sapiens
ctttcagagccagtg

SEQ ID NO: 1619076 - DNA, 17 bp, Homo sapiens
ctttcagatgtcttctg

SEQ ID NO: 1619077 - DNA, 19 bp, Homo sapiens
ctttcagatgtcttctgcc

SEQ ID NO: 1619078 - DNA, 23 bp, Homo sapiens
ctttcagatgtcttctgcctgtt

SEQ ID NO: 1619079 - DNA, 21 bp, Homo sapiens
ctttcagcattaggcttttaa

SEQ ID NO: 1619080 - DNA, 20 bp, Homo sapiens
ctttcagccacatgccccag

SEQ ID NO: 1619081 - DNA, 21 bp, Homo sapiens
ctttcagctgtgtctgacatg

SEQ ID NO: 1619082 - DNA, 14 bp, Homo sapiens
ctttcagtactttt

SEQ ID NO: 1619083 - DNA, 22 bp, Homo sapiens
ctttcagtatgtccccataaga

SEQ ID NO: 1619084 - DNA, 17 bp, Homo sapiens
ctttcagtgcagtttct

SEQ ID NO: 1619085 - DNA, 21 bp, Homo sapiens
ctttcagtgcagtttcttttc

SEQ ID NO: 1619086 - DNA, 18 bp, Homo sapiens
ctttcatagtataacttt

SEQ ID NO: 1619087 - DNA, 18 bp, Homo sapiens
ctttcatcgtaaagtgct

SEQ ID NO: 1619088 - DNA, 16 bp, Homo sapiens
ctttcatctacctttt

SEQ ID NO: 1619089 - DNA, 15 bp, Homo sapiens
ctttcatcttaaact

SEQ ID NO: 1619090 - DNA, 13 bp, Homo sapiens
ctttcatgctaca

SEQ ID NO: 1619091 - DNA, 21 bp, Homo sapiens
ctttcattttgctttaatttt

SEQ ID NO: 1619092 - DNA, 17 bp, Homo sapiens
ctttccaaaacatttct

SEQ ID NO: 1619093 - DNA, 15 bp, Homo sapiens
ctttccaaattaaaa

SEQ ID NO: 1619094 - DNA, 13 bp, Homo sapiens
ctttccaacctca

SEQ ID NO: 1619095 - DNA, 21 bp, Homo sapiens
ctttccacatttgtcacagaa

SEQ ID NO: 1619096 - DNA, 22 bp, Homo sapiens
ctttccacatttgtcacagaaa

SEQ ID NO: 1619097 - DNA, 15 bp, Homo sapiens
ctttccaccacagcc

SEQ ID NO: 1619098 - DNA, 21 bp, Homo sapiens
ctttccaccacagccagcacc

SEQ ID NO: 1619099 - DNA, 23 bp, Homo sapiens
ctttccaccacagccagcacctg

SEQ ID NO: 1619100 - DNA, 11 bp, Homo sapiens
ctttccactgc

SEQ ID NO: 1619101 - DNA, 21 bp, Homo sapiens
ctttccagaggagtttcttaa

SEQ ID NO: 1619102 - DNA, 17 bp, Homo sapiens
ctttccagcagtcagtc

SEQ ID NO: 1619103 - DNA, 23 bp, Homo sapiens
ctttccagcagtcagtccctggt

SEQ ID NO: 1619104 - DNA, 22 bp, Homo sapiens
ctttccaggctatgtataaaat

SEQ ID NO: 1619105 - DNA, 23 bp, Homo sapiens
ctttccaggctatgtataaaata

SEQ ID NO: 1619106 - DNA, 12 bp, Homo sapiens
ctttccatctct

SEQ ID NO: 1619107 - DNA, 14 bp, Homo sapiens
ctttccatctctgc

SEQ ID NO: 1619108 - DNA, 15 bp, Homo sapiens
ctttccatctctgcc

SEQ ID NO: 1619109 - DNA, 17 bp, Homo sapiens
ctttccatctctgcctg

SEQ ID NO: 1619110 - DNA, 18 bp, Homo sapiens
ctttccatctctgcctgt

SEQ ID NO: 1619111 - DNA, 16 bp, Homo sapiens
ctttccatctgtccac

SEQ ID NO: 1619112 - DNA, 23 bp, Homo sapiens
ctttccatctgtccacatcccca

SEQ ID NO: 1619113 - DNA, 18 bp, Homo sapiens
ctttccatgggagccagc

SEQ ID NO: 1619114 - DNA, 22 bp, Homo sapiens
ctttccatgttttttcttcaaa

SEQ ID NO: 1619115 - DNA, 22 bp, Homo sapiens
ctttcccaccattcctgccttt

SEQ ID NO: 1619116 - DNA, 22 bp, Homo sapiens
ctttcccaccccacgccttatc

SEQ ID NO: 1619117 - DNA, 16 bp, Homo sapiens
ctttcccatggggagg

SEQ ID NO: 1619118 - DNA, 19 bp, Homo sapiens
ctttcccatggtcaatgca

SEQ ID NO: 1619119 - DNA, 13 bp, Homo sapiens
ctttccccagagg

SEQ ID NO: 1619120 - DNA, 23 bp, Homo sapiens
ctttccccagcagtttctgtcct

SEQ ID NO: 1619121 - DNA, 14 bp, Homo sapiens
ctttcccccttccc

SEQ ID NO: 1619122 - DNA, 21 bp, Homo sapiens
ctttccccgggggaggaaggg

SEQ ID NO: 1619123 - DNA, 14 bp, Homo sapiens
ctttcccctgtggg

SEQ ID NO: 1619124 - DNA, 22 bp, Homo sapiens
ctttccctcctaaagctgaatc

SEQ ID NO: 1619125 - DNA, 13 bp, Homo sapiens
ctttccctgcctc

SEQ ID NO: 1619126 - DNA, 14 bp, Homo sapiens
ctttccctggacag

SEQ ID NO: 1619127 - DNA, 16 bp, Homo sapiens
ctttcccttattgcct

SEQ ID NO: 1619128 - DNA, 21 bp, Homo sapiens
ctttcccttcccctgtggtct

SEQ ID NO: 1619129 - DNA, 23 bp, Homo sapiens
ctttccgtttttttctttcctgt

SEQ ID NO: 1619130 - DNA, 18 bp, Homo sapiens
ctttcctcaaaaagcaga

SEQ ID NO: 1619131 - DNA, 13 bp, Homo sapiens
ctttcctcacatt

SEQ ID NO: 1619132 - DNA, 11 bp, Homo sapiens
ctttcctctga

SEQ ID NO: 1619133 - DNA, 14 bp, Homo sapiens
ctttcctctttctg

SEQ ID NO: 1619134 - DNA, 16 bp, Homo sapiens
ctttcctctttctgct

SEQ ID NO: 1619135 - DNA, 22 bp, Homo sapiens
ctttcctctttctgctctgcca

SEQ ID NO: 1619136 - DNA, 23 bp, Homo sapiens
ctttcctctttctgctctgccat

SEQ ID NO: 1619137 - DNA, 17 bp, Homo sapiens
ctttcctgatgcccctg

SEQ ID NO: 1619138 - DNA, 13 bp, Homo sapiens
ctttcctgcatct

SEQ ID NO: 1619139 - DNA, 23 bp, Homo sapiens
ctttcctggacactcagacctga

SEQ ID NO: 1619140 - DNA, 9 bp, Homo sapiens
ctttcctgt

SEQ ID NO: 1619141 - DNA, 13 bp, Homo sapiens
ctttcctgtccca

SEQ ID NO: 1619142 - DNA, 12 bp, Homo sapiens
ctttccttccca

SEQ ID NO: 1619143 - DNA, 16 bp, Homo sapiens
ctttccttcccaggcc

SEQ ID NO: 1619144 - DNA, 18 bp, Homo sapiens
ctttccttcccaggccct

SEQ ID NO: 1619145 - DNA, 19 bp, Homo sapiens
ctttccttcccaggccctt

SEQ ID NO: 1619146 - DNA, 20 bp, Homo sapiens
ctttccttcccaggcccttt

SEQ ID NO: 1619147 - DNA, 11 bp, Homo sapiens
ctttccttcct

SEQ ID NO: 1619148 - DNA, 19 bp, Homo sapiens
ctttccttgaaaataaaaa

SEQ ID NO: 1619149 - DNA, 13 bp, Homo sapiens
ctttccttgcctt

SEQ ID NO: 1619150 - DNA, 16 bp, Homo sapiens
ctttccttggctccca

SEQ ID NO: 1619151 - DNA, 17 bp, Homo sapiens
ctttccttggctcccat

SEQ ID NO: 1619152 - DNA, 15 bp, Homo sapiens
ctttccttttcttta

SEQ ID NO: 1619153 - DNA, 13 bp, Homo sapiens
ctttcgaggcctg

SEQ ID NO: 1619154 - DNA, 19 bp, Homo sapiens
ctttcgatacccaggacca

SEQ ID NO: 1619155 - DNA, 20 bp, Homo sapiens
ctttcgggccatgttgcccc

SEQ ID NO: 1619156 - DNA, 15 bp, Homo sapiens
ctttcgtacattggc

SEQ ID NO: 1619157 - DNA, 22 bp, Homo sapiens
ctttcgtgtaaattatgtaatg

SEQ ID NO: 1619158 - DNA, 18 bp, Homo sapiens
ctttctaaacaagatttt

SEQ ID NO: 1619159 - DNA, 19 bp, Homo sapiens
ctttctaactttctttact

SEQ ID NO: 1619160 - DNA, 14 bp, Homo sapiens
ctttctacaggcca

SEQ ID NO: 1619161 - DNA, 11 bp, Homo sapiens
ctttctagagc

SEQ ID NO: 1619162 - DNA, 14 bp, Homo sapiens
ctttctagctgttg

SEQ ID NO: 1619163 - DNA, 23 bp, Homo sapiens
ctttctagctgttgagctgtttt

SEQ ID NO: 1619164 - DNA, 13 bp, Homo sapiens
ctttctatgtaga

SEQ ID NO: 1619165 - DNA, 19 bp, Homo sapiens
ctttctatgtagaactgtt

SEQ ID NO: 1619166 - DNA, 19 bp, Homo sapiens
ctttctattgttaaacaaa

SEQ ID NO: 1619167 - DNA, 22 bp, Homo sapiens
ctttctattgttaaacaaatga

SEQ ID NO: 1619168 - DNA, 21 bp, Homo sapiens
ctttctcagccgcttctgact

SEQ ID NO: 1619169 - DNA, 22 bp, Homo sapiens
ctttctcagccgcttctgactg

SEQ ID NO: 1619170 - DNA, 24 bp, Homo sapiens
ctttctcagggggtcagcagagtt

SEQ ID NO: 1619171 - DNA, 17 bp, Homo sapiens
ctttctcagttttcata

SEQ ID NO: 1619172 - DNA, 15 bp, Homo sapiens
ctttctcataaaact

SEQ ID NO: 1619173 - DNA, 22 bp, Homo sapiens
ctttctcataaaactgtgacta

SEQ ID NO: 1619174 - DNA, 13 bp, Homo sapiens
ctttctccagcca

SEQ ID NO: 1619175 - DNA, 16 bp, Homo sapiens
ctttctccagccagca

SEQ ID NO: 1619176 - DNA, 20 bp, Homo sapiens
ctttctcccaggccaggctc

SEQ ID NO: 1619177 - DNA, 19 bp, Homo sapiens
ctttctcccccgacactgc

SEQ ID NO: 1619178 - DNA, 22 bp, Homo sapiens
ctttctcccccgacactgctgc

SEQ ID NO: 1619179 - DNA, 19 bp, Homo sapiens
ctttctcccctgcccccag

SEQ ID NO: 1619180 - DNA, 24 bp, Homo sapiens
ctttctcccctgcccccaggactg

SEQ ID NO: 1619181 - DNA, 19 bp, Homo sapiens
ctttctccctcaactgaag

SEQ ID NO: 1619182 - DNA, 21 bp, Homo sapiens
ctttctccctcaactgaaggg

SEQ ID NO: 1619183 - DNA, 22 bp, Homo sapiens
ctttctccctcaactgaagggg

SEQ ID NO: 1619184 - DNA, 15 bp, Homo sapiens
ctttctccctcaccc

SEQ ID NO: 1619185 - DNA, 16 bp, Homo sapiens
ctttctcgcgccctcc

SEQ ID NO: 1619186 - DNA, 20 bp, Homo sapiens
ctttctcgcgccctccccca

SEQ ID NO: 1619187 - DNA, 17 bp, Homo sapiens
ctttctctcctttcttt

SEQ ID NO: 1619188 - DNA, 22 bp, Homo sapiens
ctttctctctggcttctctctt

SEQ ID NO: 1619189 - DNA, 16 bp, Homo sapiens
ctttctctgccagtga

SEQ ID NO: 1619190 - DNA, 15 bp, Homo sapiens
ctttctcttacctgt

SEQ ID NO: 1619191 - DNA, 22 bp, Homo sapiens
ctttctcttccccttcctgttt

SEQ ID NO: 1619192 - DNA, 24 bp, Homo sapiens
ctttctcttccctgaacgttttct

SEQ ID NO: 1619193 - DNA, 21 bp, Homo sapiens
ctttctcttttcccctttcct

SEQ ID NO: 1619194 - DNA, 17 bp, Homo sapiens
ctttctgaattgcacat

SEQ ID NO: 1619195 - DNA, 18 bp, Homo sapiens
ctttctgaattggaaggg

SEQ ID NO: 1619196 - DNA, 20 bp, Homo sapiens
ctttctgaattggaagggaa

SEQ ID NO: 1619197 - DNA, 20 bp, Homo sapiens
ctttctgagcacactttagt

SEQ ID NO: 1619198 - DNA, 16 bp, Homo sapiens
ctttctgattactgtc

SEQ ID NO: 1619199 - DNA, 15 bp, Homo sapiens
ctttctgcagttttt

SEQ ID NO: 1619200 - DNA, 21 bp, Homo sapiens
ctttctgcagtttttcaggag

SEQ ID NO: 1619201 - DNA, 21 bp, Homo sapiens
ctttctgcccttctccccact

SEQ ID NO: 1619202 - DNA, 14 bp, Homo sapiens
ctttctgcctctcc

SEQ ID NO: 1619203 - DNA, 11 bp, Homo sapiens
ctttctgcctg

SEQ ID NO: 1619204 - DNA, 19 bp, Homo sapiens
ctttctgctctgccatctt

SEQ ID NO: 1619205 - DNA, 17 bp, Homo sapiens
ctttctggactcccact

SEQ ID NO: 1619206 - DNA, 17 bp, Homo sapiens
ctttctggcctgccttc

SEQ ID NO: 1619207 - DNA, 22 bp, Homo sapiens
ctttctggttgtttttgttctt

SEQ ID NO: 1619208 - DNA, 16 bp, Homo sapiens
ctttctgtaaccataa

SEQ ID NO: 1619209 - DNA, 13 bp, Homo sapiens
ctttctgtagcct

SEQ ID NO: 1619210 - DNA, 14 bp, Homo sapiens
ctttctgtagccta

SEQ ID NO: 1619211 - DNA, 11 bp, Homo sapiens
ctttctgtctc

SEQ ID NO: 1619212 - DNA, 17 bp, Homo sapiens
ctttctgtctcccttct

SEQ ID NO: 1619213 - DNA, 21 bp, Homo sapiens
ctttctgtctcccttctctct

SEQ ID NO: 1619214 - DNA, 18 bp, Homo sapiens
ctttctgtcttctacaga

SEQ ID NO: 1619215 - DNA, 15 bp, Homo sapiens
ctttctgtgcttgga

SEQ ID NO: 1619216 - DNA, 13 bp, Homo sapiens
ctttctgttaaaa

SEQ ID NO: 1619217 - DNA, 16 bp, Homo sapiens
ctttctgttaaaatgc

SEQ ID NO: 1619218 - DNA, 19 bp, Homo sapiens
ctttctgttaaaatgcatg

SEQ ID NO: 1619219 - DNA, 16 bp, Homo sapiens
ctttctgttgaaaagc

SEQ ID NO: 1619220 - DNA, 16 bp, Homo sapiens
ctttctgttgccacaa

SEQ ID NO: 1619221 - DNA, 23 bp, Homo sapiens
ctttctgtttggacccatggtca

SEQ ID NO: 1619222 - DNA, 22 bp, Homo sapiens
ctttcttaagccctttgctctg

SEQ ID NO: 1619223 - DNA, 13 bp, Homo sapiens
ctttcttcaccaa

SEQ ID NO: 1619224 - DNA, 22 bp, Homo sapiens
ctttcttcaccaagtgcaatag

SEQ ID NO: 1619225 - DNA, 23 bp, Homo sapiens
ctttcttcaccaagtgcaataga

SEQ ID NO: 1619226 - DNA, 15 bp, Homo sapiens
ctttcttctatttta

SEQ ID NO: 1619227 - DNA, 16 bp, Homo sapiens
ctttcttctattttat

SEQ ID NO: 1619228 - DNA, 17 bp, Homo sapiens
ctttcttctgtgttaat

SEQ ID NO: 1619229 - DNA, 12 bp, Homo sapiens
ctttcttgacaa

SEQ ID NO: 1619230 - DNA, 21 bp, Homo sapiens
ctttcttgatcaacatctttt

SEQ ID NO: 1619231 - DNA, 22 bp, Homo sapiens
ctttcttgatcaacatcttttc

SEQ ID NO: 1619232 - DNA, 20 bp, Homo sapiens
ctttcttgcatgaatcagat

SEQ ID NO: 1619233 - DNA, 17 bp, Homo sapiens
ctttcttgctggctctg

SEQ ID NO: 1619234 - DNA, 19 bp, Homo sapiens
cttctggtttaaacttgtt

SEQ ID NO: 1619235 - DNA, 20 bp, Homo sapiens
cttctgtaattgtgtggatt

SEQ ID NO: 1619236 - DNA, 15 bp, Homo sapiens
cttctgtagtactcc

SEQ ID NO: 1619237 - DNA, 14 bp, Homo sapiens
cttctgtatttcct

SEQ ID NO: 1619238 - DNA, 14 bp, Homo sapiens
cttctgtgaaagta

SEQ ID NO: 1619239 - DNA, 19 bp, Homo sapiens
cttctgtgagacccccaca

SEQ ID NO: 1619240 - DNA, 13 bp, Homo sapiens
cttctgtggctca

SEQ ID NO: 1619241 - DNA, 13 bp, Homo sapiens
cttctgtgtgtga

SEQ ID NO: 1619242 - DNA, 14 bp, Homo sapiens
cttctgtgtgtgag

SEQ ID NO: 1619243 - DNA, 11 bp, Homo sapiens
cttctgtgttt

SEQ ID NO: 1619244 - DNA, 14 bp, Homo sapiens
cttctgtgtttata

SEQ ID NO: 1619245 - DNA, 19 bp, Homo sapiens
cttctgtgtttctggagtg

SEQ ID NO: 1619246 - DNA, 23 bp, Homo sapiens
cttctgtttgtcgagcatttctt

SEQ ID NO: 1619247 - DNA, 17 bp, Homo sapiens
cttcttaaaccattttt

SEQ ID NO: 1619248 - DNA, 16 bp, Homo sapiens
cttcttacgcaatgct

SEQ ID NO: 1619249 - DNA, 22 bp, Homo sapiens
cttcttacttgtctgtacagta

SEQ ID NO: 1619250 - DNA, 16 bp, Homo sapiens
cttcttatacatttga

SEQ ID NO: 1619251 - DNA, 17 bp, Homo sapiens
cttcttattctcactcc

SEQ ID NO: 1619252 - DNA, 20 bp, Homo sapiens
cttcttattctcactccacc

SEQ ID NO: 1619253 - DNA, 22 bp, Homo sapiens
cttcttcacccagctaatctgt

SEQ ID NO: 1619254 - DNA, 22 bp, Homo sapiens
cttcttcagagtgaagaatctt

SEQ ID NO: 1619255 - DNA, 18 bp, Homo sapiens
cttcttcagatcagtgct

SEQ ID NO: 1619256 - DNA, 14 bp, Homo sapiens
cttcttccacttct

SEQ ID NO: 1619257 - DNA, 15 bp, Homo sapiens
cttcttccacttctc

SEQ ID NO: 1619258 - DNA, 19 bp, Homo sapiens
cttcttcccctctgcggct

SEQ ID NO: 1619259 - DNA, 21 bp, Homo sapiens
cttcttcccttaactccaaga

SEQ ID NO: 1619260 - DNA, 20 bp, Homo sapiens
cttcttcgcaaactgatgga

SEQ ID NO: 1619261 - DNA, 17 bp, Homo sapiens
cttcttcggggaactcc

SEQ ID NO: 1619262 - DNA, 15 bp, Homo sapiens
cttcttctaagaaga

SEQ ID NO: 1619263 - DNA, 21 bp, Homo sapiens
cttcttctacttcagtcttct

SEQ ID NO: 1619264 - DNA, 22 bp, Homo sapiens
cttcttctgaagatcagaacat

SEQ ID NO: 1619265 - DNA, 14 bp, Homo sapiens
cttcttcttcagaa

SEQ ID NO: 1619266 - DNA, 17 bp, Homo sapiens
cttcttgcctctgtgct

SEQ ID NO: 1619267 - DNA, 18 bp, Homo sapiens
cttcttggagctttggaa

SEQ ID NO: 1619268 - DNA, 19 bp, Homo sapiens
cttcttggagctttggaat

SEQ ID NO: 1619269 - DNA, 11 bp, Homo sapiens
cttcttgggat

SEQ ID NO: 1619270 - DNA, 21 bp, Homo sapiens
cttcttggggcccagtgcatg

SEQ ID NO: 1619271 - DNA, 23 bp, Homo sapiens
cttcttggggcccagtgcatggt

SEQ ID NO: 1619272 - DNA, 21 bp, Homo sapiens
cttcttgtgattgctgccata

SEQ ID NO: 1619273 - DNA, 22 bp, Homo sapiens
cttcttgtgattgctgccataa

SEQ ID NO: 1619274 - DNA, 13 bp, Homo sapiens
cttcttgttcccc

SEQ ID NO: 1619275 - DNA, 17 bp, Homo sapiens
cttcttgtttccttgtt

SEQ ID NO: 1619276 - DNA, 12 bp, Homo sapiens
cttctttaaaca

SEQ ID NO: 1619277 - DNA, 14 bp, Homo sapiens
cttctttagaacag

SEQ ID NO: 1619278 - DNA, 19 bp, Homo sapiens
cttctttagaccctcgggc

SEQ ID NO: 1619279 - DNA, 21 bp, Homo sapiens
cttctttagaccctcgggccc

SEQ ID NO: 1619280 - DNA, 16 bp, Homo sapiens
cttctttattctgtgt

SEQ ID NO: 1619281 - DNA, 22 bp, Homo sapiens
cttctttccctggacaggcagc

SEQ ID NO: 1619282 - DNA, 16 bp, Homo sapiens
cttctttctagagcag

SEQ ID NO: 1619283 - DNA, 14 bp, Homo sapiens
cttctttgtgcctt

SEQ ID NO: 1619284 - DNA, 14 bp, Homo sapiens
cttcttttgattat

SEQ ID NO: 1619285 - DNA, 14 bp, Homo sapiens
cttcttttgctctt

SEQ ID NO: 1619286 - DNA, 24 bp, Homo sapiens
cttcttttgtggtgtcttccatgt

SEQ ID NO: 1619287 - DNA, 17 bp, Homo sapiens
cttcttttttaagttgt

SEQ ID NO: 1619288 - DNA, 20 bp, Homo sapiens
cttcttttttcaaaagaaag

SEQ ID NO: 1619289 - DNA, 16 bp, Homo sapiens
cttcttttttttcatt

SEQ ID NO: 1619290 - DNA, 11 bp, Homo sapiens
cttgaaaagtt

SEQ ID NO: 1619291 - DNA, 20 bp, Homo sapiens
cttgaaaagttcagggaccg

SEQ ID NO: 1619292 - DNA, 18 bp, Homo sapiens
cttgaaactttgggaaaa

SEQ ID NO: 1619293 - DNA, 13 bp, Homo sapiens
cttgaaagatttt

SEQ ID NO: 1619294 - DNA, 20 bp, Homo sapiens
cttgaaagattttattgtat

SEQ ID NO: 1619295 - DNA, 16 bp, Homo sapiens
cttgaaatatataata

SEQ ID NO: 1619296 - DNA, 17 bp, Homo sapiens
cttgaaatatataatat

SEQ ID NO: 1619297 - DNA, 16 bp, Homo sapiens
cttgaaatattcagaa

SEQ ID NO: 1619298 - DNA, 21 bp, Homo sapiens
cttgaaatgaaagggaaactg

SEQ ID NO: 1619299 - DNA, 20 bp, Homo sapiens
cttgaaatgagtaaaaacta

SEQ ID NO: 1619300 - DNA, 22 bp, Homo sapiens
cttgaaatgagtaaaaactaga

SEQ ID NO: 1619301 - DNA, 21 bp, Homo sapiens
cttgaaatgctcttttgcaca

SEQ ID NO: 1619302 - DNA, 16 bp, Homo sapiens
cttgaaattttaacct

SEQ ID NO: 1619303 - DNA, 17 bp, Homo sapiens
cttgaaattttaaccta

SEQ ID NO: 1619304 - DNA, 16 bp, Homo sapiens
cttgaaccccctccct

SEQ ID NO: 1619305 - DNA, 19 bp, Homo sapiens
cttgaaccccctccctgtc

SEQ ID NO: 1619306 - DNA, 24 bp, Homo sapiens
cttgaaccccctccctgtcccagg

SEQ ID NO: 1619307 - DNA, 18 bp, Homo sapiens
cttgaacccgggggacag

SEQ ID NO: 1619308 - DNA, 19 bp, Homo sapiens
cttgaacccgggggacaga

SEQ ID NO: 1619309 - DNA, 19 bp, Homo sapiens
cttgaacctgggaggcaga

SEQ ID NO: 1619310 - DNA, 17 bp, Homo sapiens
cttgaacgagcagccca

SEQ ID NO: 1619311 - DNA, 18 bp, Homo sapiens
cttgaacgagcagcccag

SEQ ID NO: 1619312 - DNA, 17 bp, Homo sapiens
cttgaagaaacagagtg

SEQ ID NO: 1619313 - DNA, 21 bp, Homo sapiens
cttgaagaaggggctgttctt

SEQ ID NO: 1619314 - DNA, 22 bp, Homo sapiens
cttgaagacagagcaaagcgcc

SEQ ID NO: 1619315 - DNA, 15 bp, Homo sapiens
cttctccaagcatca

SEQ ID NO: 1619316 - DNA, 16 bp, Homo sapiens
cttctccacctccccc

SEQ ID NO: 1619317 - DNA, 15 bp, Homo sapiens
cttctccactggatg

SEQ ID NO: 1619318 - DNA, 17 bp, Homo sapiens
cttctccactggatgga

SEQ ID NO: 1619319 - DNA, 12 bp, Homo sapiens
cttctccagtgg

SEQ ID NO: 1619320 - DNA, 14 bp, Homo sapiens
cttctccatctggc

SEQ ID NO: 1619321 - DNA, 17 bp, Homo sapiens
cttctcccacatgaggc

SEQ ID NO: 1619322 - DNA, 22 bp, Homo sapiens
cttctcccagtgtgagacccca

SEQ ID NO: 1619323 - DNA, 22 bp, Homo sapiens
cttctccccagccagaggtgga

SEQ ID NO: 1619324 - DNA, 22 bp, Homo sapiens
cttctccccgaggctgccccag

SEQ ID NO: 1619325 - DNA, 14 bp, Homo sapiens
cttctccccgcagc

SEQ ID NO: 1619326 - DNA, 13 bp, Homo sapiens
cttctcccctgca

SEQ ID NO: 1619327 - DNA, 19 bp, Homo sapiens
cttctcccctgcactgtaa

SEQ ID NO: 1619328 - DNA, 20 bp, Homo sapiens
cttctcccctgcactgtaaa

SEQ ID NO: 1619329 - DNA, 20 bp, Homo sapiens
cttctcccctgggtcctcca

SEQ ID NO: 1619330 - DNA, 19 bp, Homo sapiens
cttctccctagctcctccc

SEQ ID NO: 1619331 - DNA, 22 bp, Homo sapiens
cttctccctgcacaagccaggg

SEQ ID NO: 1619332 - DNA, 14 bp, Homo sapiens
cttctccgccagcc

SEQ ID NO: 1619333 - DNA, 16 bp, Homo sapiens
cttctccgccagcctc

SEQ ID NO: 1619334 - DNA, 18 bp, Homo sapiens
cttctccgccagcctcct

SEQ ID NO: 1619335 - DNA, 24 bp, Homo sapiens
cttctccgccagcctcctctggac

SEQ ID NO: 1619336 - DNA, 19 bp, Homo sapiens
cttctcctcctctgtcttt

SEQ ID NO: 1619337 - DNA, 14 bp, Homo sapiens
cttctcctttcaca

SEQ ID NO: 1619338 - DNA, 20 bp, Homo sapiens
cttctcctttcacaaccttc

SEQ ID NO: 1619339 - DNA, 22 bp, Homo sapiens
cttctcctttcacaaccttctg

SEQ ID NO: 1619340 - DNA, 13 bp, Homo sapiens
cttctcctttcct

SEQ ID NO: 1619341 - DNA, 19 bp, Homo sapiens
cttctcggagctggcccag

SEQ ID NO: 1619342 - DNA, 20 bp, Homo sapiens
cttctcggggtccagtgcat

SEQ ID NO: 1619343 - DNA, 13 bp, Homo sapiens
cttctctacagac

SEQ ID NO: 1619344 - DNA, 18 bp, Homo sapiens
cttctctacccatctccc

SEQ ID NO: 1619345 - DNA, 14 bp, Homo sapiens
cttctctcagatgg

SEQ ID NO: 1619346 - DNA, 13 bp, Homo sapiens
cttctctcagctc

SEQ ID NO: 1619347 - DNA, 15 bp, Homo sapiens
cttctctcagctccc

SEQ ID NO: 1619348 - DNA, 15 bp, Homo sapiens
cttctctccagctga

SEQ ID NO: 1619349 - DNA, 18 bp, Homo sapiens
cttctctccagctgacta

SEQ ID NO: 1619350 - DNA, 19 bp, Homo sapiens
cttctctccagctgactaa

SEQ ID NO: 1619351 - DNA, 14 bp, Homo sapiens
cttctctctccagg

SEQ ID NO: 1619352 - DNA, 15 bp, Homo sapiens
cttctctctccaggg

SEQ ID NO: 1619353 - DNA, 15 bp, Homo sapiens
cttctctctctctca

SEQ ID NO: 1619354 - DNA, 21 bp, Homo sapiens
cttctctctctctctctcgct

SEQ ID NO: 1619355 - DNA, 15 bp, Homo sapiens
cttctctctggctca

SEQ ID NO: 1619356 - DNA, 14 bp, Homo sapiens
cttctctcttcaat

SEQ ID NO: 1619357 - DNA, 16 bp, Homo sapiens
cttctctcttttcctc

SEQ ID NO: 1619358 - DNA, 12 bp, Homo sapiens
cttctctgactt

SEQ ID NO: 1619359 - DNA, 20 bp, Homo sapiens
cttctctgacttctgcctgg

SEQ ID NO: 1619360 - DNA, 13 bp, Homo sapiens
cttctctgcccac

SEQ ID NO: 1619361 - DNA, 13 bp, Homo sapiens
cttctctgctcca

SEQ ID NO: 1619362 - DNA, 15 bp, Homo sapiens
cttctctgctccacc

SEQ ID NO: 1619363 - DNA, 16 bp, Homo sapiens
cttctctgctccacca

SEQ ID NO: 1619364 - DNA, 14 bp, Homo sapiens
cttctctgggctga

SEQ ID NO: 1619365 - DNA, 21 bp, Homo sapiens
cttctctgggtctgattttct

SEQ ID NO: 1619366 - DNA, 18 bp, Homo sapiens
cttctctggtctccttga

SEQ ID NO: 1619367 - DNA, 14 bp, Homo sapiens
cttctctgtgagaa

SEQ ID NO: 1619368 - DNA, 14 bp, Homo sapiens
cttctctgtgtgca

SEQ ID NO: 1619369 - DNA, 23 bp, Homo sapiens
cttctcttcctagatctgcaggc

SEQ ID NO: 1619370 - DNA, 23 bp, Homo sapiens
cttctgaaatgaaacaaataatc

SEQ ID NO: 1619371 - DNA, 17 bp, Homo sapiens
cttctgaactcaaactg

SEQ ID NO: 1619372 - DNA, 23 bp, Homo sapiens
cttctgaactccatacagcctct

SEQ ID NO: 1619373 - DNA, 21 bp, Homo sapiens
cttctgacaaaggtggtaaat

SEQ ID NO: 1619374 - DNA, 19 bp, Homo sapiens
cttctgacgtgccttttgc

SEQ ID NO: 1619375 - DNA, 22 bp, Homo sapiens
cttctgacgtgccttttgcacc

SEQ ID NO: 1619376 - DNA, 13 bp, Homo sapiens
cttctgactgttt

SEQ ID NO: 1619377 - DNA, 19 bp, Homo sapiens
cttctgactgtttatttaa

SEQ ID NO: 1619378 - DNA, 22 bp, Homo sapiens
cttctgactgtttatttaagga

SEQ ID NO: 1619379 - DNA, 17 bp, Homo sapiens
cttctgagctatttcat

SEQ ID NO: 1619380 - DNA, 12 bp, Homo sapiens
cttctgagctcc

SEQ ID NO: 1619381 - DNA, 15 bp, Homo sapiens
cttctgagctccacc

SEQ ID NO: 1619382 - DNA, 17 bp, Homo sapiens
cttctgagctccacctc

SEQ ID NO: 1619383 - DNA, 22 bp, Homo sapiens
cttctgaggaccgctgataagc

SEQ ID NO: 1619384 - DNA, 15 bp, Homo sapiens
cttctgagtattctc

SEQ ID NO: 1619385 - DNA, 17 bp, Homo sapiens
cttctgatttttctctt

SEQ ID NO: 1619386 - DNA, 18 bp, Homo sapiens
cttctgcaacaagcatgc

SEQ ID NO: 1619387 - DNA, 18 bp, Homo sapiens
cttctgcaagcctcatgc

SEQ ID NO: 1619388 - DNA, 15 bp, Homo sapiens
cttctgcaccctcca

SEQ ID NO: 1619389 - DNA, 21 bp, Homo sapiens
cttctgcccccgttccagctg

SEQ ID NO: 1619390 - DNA, 13 bp, Homo sapiens
cttctgcctggag

SEQ ID NO: 1619391 - DNA, 15 bp, Homo sapiens
cttctgcctggagac

SEQ ID NO: 1619392 - DNA, 14 bp, Homo sapiens
cttctgcctgttat

SEQ ID NO: 1619393 - DNA, 16 bp, Homo sapiens
cttctgccttctcatg

SEQ ID NO: 1619394 - DNA, 10 bp, Homo sapiens
cttctgctcc

SEQ ID NO: 1619395 - DNA, 13 bp, Homo sapiens
cttctgctccacc

SEQ ID NO: 1619396 - DNA, 14 bp, Homo sapiens
cttctgctccaccc

SEQ ID NO: 1619397 - DNA, 17 bp, Homo sapiens
cttctgctcttttcctg

SEQ ID NO: 1619398 - DNA, 18 bp, Homo sapiens
cttctgctcttttcctgg

SEQ ID NO: 1619399 - DNA, 12 bp, Homo sapiens
cttctgctgccc

SEQ ID NO: 1619400 - DNA, 12 bp, Homo sapiens
cttcctcctgga

SEQ ID NO: 1619401 - DNA, 13 bp, Homo sapiens
cttcctcctggaa

SEQ ID NO: 1619402 - DNA, 22 bp, Homo sapiens
cttcctctacgtttatcctggc

SEQ ID NO: 1619403 - DNA, 18 bp, Homo sapiens
cttcctctagaagccaag

SEQ ID NO: 1619404 - DNA, 13 bp, Homo sapiens
cttcctctccact

SEQ ID NO: 1619405 - DNA, 15 bp, Homo sapiens
cttcctctccactgc

SEQ ID NO: 1619406 - DNA, 19 bp, Homo sapiens
cttcctctccactgccttc

SEQ ID NO: 1619407 - DNA, 16 bp, Homo sapiens
cttcctctctctacca

SEQ ID NO: 1619408 - DNA, 20 bp, Homo sapiens
cttcctctgcagctgacctc

SEQ ID NO: 1619409 - DNA, 16 bp, Homo sapiens
cttcctcttcctgccc

SEQ ID NO: 1619410 - DNA, 16 bp, Homo sapiens
cttcctgacactttaa

SEQ ID NO: 1619411 - DNA, 21 bp, Homo sapiens
cttcctgcaggcaggaacaaa

SEQ ID NO: 1619412 - DNA, 21 bp, Homo sapiens
cttcctgcattcacccagaca

SEQ ID NO: 1619413 - DNA, 22 bp, Homo sapiens
cttcctgcattcacccagacag

SEQ ID NO: 1619414 - DNA, 12 bp, Homo sapiens
cttcctgccact

SEQ ID NO: 1619415 - DNA, 15 bp, Homo sapiens
cttcctgccactgcc

SEQ ID NO: 1619416 - DNA, 15 bp, Homo sapiens
cttcctgccagcagg

SEQ ID NO: 1619417 - DNA, 12 bp, Homo sapiens
cttcctgccctt

SEQ ID NO: 1619418 - DNA, 18 bp, Homo sapiens
cttcctgcgtcctcctca

SEQ ID NO: 1619419 - DNA, 10 bp, Homo sapiens
cttcctgctg

SEQ ID NO: 1619420 - DNA, 17 bp, Homo sapiens
cttcctgctgcaccctg

SEQ ID NO: 1619421 - DNA, 22 bp, Homo sapiens
cttcctgctgctgctactgctg

SEQ ID NO: 1619422 - DNA, 15 bp, Homo sapiens
cttcctgctgctgta

SEQ ID NO: 1619423 - DNA, 18 bp, Homo sapiens
cttcctggaaacagcatg

SEQ ID NO: 1619424 - DNA, 17 bp, Homo sapiens
cttcctggagcccagag

SEQ ID NO: 1619425 - DNA, 22 bp, Homo sapiens
cttcctggattttctttctatg

SEQ ID NO: 1619426 - DNA, 13 bp, Homo sapiens
cttcctggcctca

SEQ ID NO: 1619427 - DNA, 20 bp, Homo sapiens
cttcctggcctcactggctg

SEQ ID NO: 1619428 - DNA, 12 bp, Homo sapiens
cttcctggcctg

SEQ ID NO: 1619429 - DNA, 14 bp, Homo sapiens
cttcctggcctgag

SEQ ID NO: 1619430 - DNA, 15 bp, Homo sapiens
cttcctggcctgaga

SEQ ID NO: 1619431 - DNA, 12 bp, Homo sapiens
cttcctggggac

SEQ ID NO: 1619432 - DNA, 16 bp, Homo sapiens
cttcctggggatgtca

SEQ ID NO: 1619433 - DNA, 15 bp, Homo sapiens
cttcctgggtcctgc

SEQ ID NO: 1619434 - DNA, 17 bp, Homo sapiens
cttcctgggtcctgcct

SEQ ID NO: 1619435 - DNA, 19 bp, Homo sapiens
cttcctgggtcctgcctgg

SEQ ID NO: 1619436 - DNA, 23 bp, Homo sapiens
cttcctgggtcctgcctggtcct

SEQ ID NO: 1619437 - DNA, 18 bp, Homo sapiens
cttcctggtgagaactga

SEQ ID NO: 1619438 - DNA, 16 bp, Homo sapiens
cttcctgtccactctc

SEQ ID NO: 1619439 - DNA, 20 bp, Homo sapiens
cttcctgtcttcctgcattc

SEQ ID NO: 1619440 - DNA, 21 bp, Homo sapiens
cttcctgtgaagtttaattgt

SEQ ID NO: 1619441 - DNA, 12 bp, Homo sapiens
cttcctgtgtcc

SEQ ID NO: 1619442 - DNA, 14 bp, Homo sapiens
cttcctgtgtcctg

SEQ ID NO: 1619443 - DNA, 16 bp, Homo sapiens
cttcctgtttttcaca

SEQ ID NO: 1619444 - DNA, 17 bp, Homo sapiens
cttcctgtttttcacat

SEQ ID NO: 1619445 - DNA, 18 bp, Homo sapiens
cttcctgtttttcacatt

SEQ ID NO: 1619446 - DNA, 12 bp, Homo sapiens
cttccttcccac

SEQ ID NO: 1619447 - DNA, 17 bp, Homo sapiens
cttccttccctggctac

SEQ ID NO: 1619448 - DNA, 17 bp, Homo sapiens
cttccttccctggcttg

SEQ ID NO: 1619449 - DNA, 21 bp, Homo sapiens
cttccttccctgggctgtgct

SEQ ID NO: 1619450 - DNA, 17 bp, Homo sapiens
cttccttgctgtcctag

SEQ ID NO: 1619451 - DNA, 20 bp, Homo sapiens
cttccttggactcattttaa

SEQ ID NO: 1619452 - DNA, 15 bp, Homo sapiens
cttcctttaaaaaac

SEQ ID NO: 1619453 - DNA, 19 bp, Homo sapiens
cttcctttaggtctggttg

SEQ ID NO: 1619454 - DNA, 14 bp, Homo sapiens
cttcctttataata

SEQ ID NO: 1619455 - DNA, 14 bp, Homo sapiens
cttcctttcaggcc

SEQ ID NO: 1619456 - DNA, 18 bp, Homo sapiens
cttcctttcaggccaagg

SEQ ID NO: 1619457 - DNA, 12 bp, Homo sapiens
cttcctttctct

SEQ ID NO: 1619458 - DNA, 15 bp, Homo sapiens
cttcctttctctcct

SEQ ID NO: 1619459 - DNA, 15 bp, Homo sapiens
cttccttttccctgc

SEQ ID NO: 1619460 - DNA, 17 bp, Homo sapiens
cttccttttccctgctt

SEQ ID NO: 1619461 - DNA, 19 bp, Homo sapiens
cttccttttccctgcttcc

SEQ ID NO: 1619462 - DNA, 16 bp, Homo sapiens
cttccttttgaggagc

SEQ ID NO: 1619463 - DNA, 14 bp, Homo sapiens
cttcgaaaggcctt

SEQ ID NO: 1619464 - DNA, 20 bp, Homo sapiens
cttcgaaaggccttcagaca

SEQ ID NO: 1619465 - DNA, 12 bp, Homo sapiens
cttcgaagtatt

SEQ ID NO: 1619466 - DNA, 13 bp, Homo sapiens
cttcgaagtattc

SEQ ID NO: 1619467 - DNA, 23 bp, Homo sapiens
cttcgaggtggatcacagaggct

SEQ ID NO: 1619468 - DNA, 16 bp, Homo sapiens
cttcgagttcccaggg

SEQ ID NO: 1619469 - DNA, 19 bp, Homo sapiens
cttcgctgtgatgcatgag

SEQ ID NO: 1619470 - DNA, 20 bp, Homo sapiens
cttcgcttcttgcctctgtg

SEQ ID NO: 1619471 - DNA, 13 bp, Homo sapiens
cttcggaagacct

SEQ ID NO: 1619472 - DNA, 17 bp, Homo sapiens
cttcggacagacatatg

SEQ ID NO: 1619473 - DNA, 23 bp, Homo sapiens
cttcggagaggccaagtctaatg

SEQ ID NO: 1619474 - DNA, 14 bp, Homo sapiens
cttcgggctgtgcc

SEQ ID NO: 1619475 - DNA, 16 bp, Homo sapiens
cttcgggctgtgcccg

SEQ ID NO: 1619476 - DNA, 19 bp, Homo sapiens
cttcggggaactcctggaa

SEQ ID NO: 1619477 - DNA, 14 bp, Homo sapiens
cttcggtttctgag

SEQ ID NO: 1619478 - DNA, 15 bp, Homo sapiens
cttcggtttctgagc

SEQ ID NO: 1619479 - DNA, 21 bp, Homo sapiens
cttcgtaagaaggaatgcgag

SEQ ID NO: 1619480 - DNA, 17 bp, Homo sapiens
cttcgttaactgtgtat

SEQ ID NO: 1619481 - DNA, 13 bp, Homo sapiens
cttctaaatgcat

SEQ ID NO: 1619482 - DNA, 15 bp, Homo sapiens
cttctaaatgcatat

SEQ ID NO: 1619483 - DNA, 14 bp, Homo sapiens
cttctaagaagaca

SEQ ID NO: 1619484 - DNA, 22 bp, Homo sapiens
cttctaagtaaaaccacagcag

SEQ ID NO: 1619485 - DNA, 15 bp, Homo sapiens
cttctaattgctgtg

SEQ ID NO: 1619486 - DNA, 17 bp, Homo sapiens
cttctaccatgaacaga

SEQ ID NO: 1619487 - DNA, 17 bp, Homo sapiens
cttctacctcttggctg

SEQ ID NO: 1619488 - DNA, 18 bp, Homo sapiens
cttctacctgccctcaag

SEQ ID NO: 1619489 - DNA, 15 bp, Homo sapiens
cttctactcttgaga

SEQ ID NO: 1619490 - DNA, 17 bp, Homo sapiens
cttctacttttaactaa

SEQ ID NO: 1619491 - DNA, 18 bp, Homo sapiens
cttctagatctcagccat

SEQ ID NO: 1619492 - DNA, 19 bp, Homo sapiens
ctgtttggcacttgtattt

SEQ ID NO: 1619493 - DNA, 14 bp, Homo sapiens
ctgtttggcctctc

SEQ ID NO: 1619494 - DNA, 22 bp, Homo sapiens
ctgtttgggttgttggtctgtg

SEQ ID NO: 1619495 - DNA, 14 bp, Homo sapiens
ctgtttgtgggact

SEQ ID NO: 1619496 - DNA, 14 bp, Homo sapiens
ctgtttgtttcaag

SEQ ID NO: 1619497 - DNA, 14 bp, Homo sapiens
ctgtttgtttcata

SEQ ID NO: 1619498 - DNA, 15 bp, Homo sapiens
ctgttttaagaaatc

SEQ ID NO: 1619499 - DNA, 13 bp, Homo sapiens
ctgttttaattgt

SEQ ID NO: 1619500 - DNA, 19 bp, Homo sapiens
ctgttttagtttctgaact

SEQ ID NO: 1619501 - DNA, 17 bp, Homo sapiens
ctgttttatctctgtga

SEQ ID NO: 1619502 - DNA, 19 bp, Homo sapiens
ctgttttatgtcatactct

SEQ ID NO: 1619503 - DNA, 21 bp, Homo sapiens
ctgttttatgtcatactctgt

SEQ ID NO: 1619504 - DNA, 13 bp, Homo sapiens
ctgttttccctga

SEQ ID NO: 1619505 - DNA, 13 bp, Homo sapiens
ctgttttctgaaa

SEQ ID NO: 1619506 - DNA, 15 bp, Homo sapiens
ctgttttctgaaaca

SEQ ID NO: 1619507 - DNA, 17 bp, Homo sapiens
ctgttttctgaaacaca

SEQ ID NO: 1619508 - DNA, 20 bp, Homo sapiens
ctgttttctgagcccgggct

SEQ ID NO: 1619509 - DNA, 12 bp, Homo sapiens
ctgttttcttct

SEQ ID NO: 1619510 - DNA, 22 bp, Homo sapiens
ctgttttgccaagaatatagtt

SEQ ID NO: 1619511 - DNA, 16 bp, Homo sapiens
ctgttttgggcctcca

SEQ ID NO: 1619512 - DNA, 23 bp, Homo sapiens
ctgttttgtatcaaaatcactat

SEQ ID NO: 1619513 - DNA, 15 bp, Homo sapiens
ctgttttgtgagaac

SEQ ID NO: 1619514 - DNA, 18 bp, Homo sapiens
ctgttttgtggtttggaa

SEQ ID NO: 1619515 - DNA, 20 bp, Homo sapiens
ctgttttgtggtttggaata

SEQ ID NO: 1619516 - DNA, 14 bp, Homo sapiens
ctgtttttaaaaat

SEQ ID NO: 1619517 - DNA, 21 bp, Homo sapiens
ctgtttttagagcttccaaat

SEQ ID NO: 1619518 - DNA, 22 bp, Homo sapiens
ctgtttttagagcttccaaatg

SEQ ID NO: 1619519 - DNA, 14 bp, Homo sapiens
ctgtttttgtagtg

SEQ ID NO: 1619520 - DNA, 13 bp, Homo sapiens
ctgtttttgttgt

SEQ ID NO: 1619521 - DNA, 14 bp, Homo sapiens
ctgtttttgttgtg

SEQ ID NO: 1619522 - DNA, 16 bp, Homo sapiens
ctgtttttttttcatt

SEQ ID NO: 1619523 - DNA, 23 bp, Homo sapiens
cttaaaaaaacaaattggacagc

SEQ ID NO: 1619524 - DNA, 13 bp, Homo sapiens
cttaaaaaaataa

SEQ ID NO: 1619525 - DNA, 21 bp, Homo sapiens
cttaaaaaaataaaatatttt

SEQ ID NO: 1619526 - DNA, 18 bp, Homo sapiens
cttaaaaaacttgtaaat

SEQ ID NO: 1619527 - DNA, 17 bp, Homo sapiens
cttaaaaaataatacaa

SEQ ID NO: 1619528 - DNA, 13 bp, Homo sapiens
cttaaaaaggaac

SEQ ID NO: 1619529 - DNA, 14 bp, Homo sapiens
cttaaaaattaata

SEQ ID NO: 1619530 - DNA, 13 bp, Homo sapiens
cttaaaaccaaag

SEQ ID NO: 1619531 - DNA, 15 bp, Homo sapiens
cttaaaaccaaagag

SEQ ID NO: 1619532 - DNA, 17 bp, Homo sapiens
cttaaaagagctcagac

SEQ ID NO: 1619533 - DNA, 20 bp, Homo sapiens
cttaaaaggggcccaagccc

SEQ ID NO: 1619534 - DNA, 12 bp, Homo sapiens
cttaaaataagc

SEQ ID NO: 1619535 - DNA, 22 bp, Homo sapiens
cttaaaataatgaatacatttc

SEQ ID NO: 1619536 - DNA, 20 bp, Homo sapiens
cttaaaatacggtacctggc

SEQ ID NO: 1619537 - DNA, 22 bp, Homo sapiens
cttaaaatagcaacactctata

SEQ ID NO: 1619538 - DNA, 13 bp, Homo sapiens
cttaaaatatttt

SEQ ID NO: 1619539 - DNA, 20 bp, Homo sapiens
cttaaaatcaaatgtaaatc

SEQ ID NO: 1619540 - DNA, 22 bp, Homo sapiens
cttaaaatcactcagcactcca

SEQ ID NO: 1619541 - DNA, 21 bp, Homo sapiens
cttaaaattcaagaaaataaa

SEQ ID NO: 1619542 - DNA, 21 bp, Homo sapiens
cttaaaattgatattatatta

SEQ ID NO: 1619543 - DNA, 11 bp, Homo sapiens
cttaaacaaaa

SEQ ID NO: 1619544 - DNA, 16 bp, Homo sapiens
cttaaacaaaaaacta

SEQ ID NO: 1619545 - DNA, 17 bp, Homo sapiens
cttaaacaatgtataaa

SEQ ID NO: 1619546 - DNA, 21 bp, Homo sapiens
cttaaacacaggctgtcctta

SEQ ID NO: 1619547 - DNA, 16 bp, Homo sapiens
cttaaacccatacaat

SEQ ID NO: 1619548 - DNA, 19 bp, Homo sapiens
cttaaacccatacaatgta

SEQ ID NO: 1619549 - DNA, 21 bp, Homo sapiens
cttaaactctggacactctat

SEQ ID NO: 1619550 - DNA, 14 bp, Homo sapiens
cttaaactgtgtgg

SEQ ID NO: 1619551 - DNA, 15 bp, Homo sapiens
cttaaactgtgtgga

SEQ ID NO: 1619552 - DNA, 23 bp, Homo sapiens
cttaaagaaacagctttcaagtg

SEQ ID NO: 1619553 - DNA, 16 bp, Homo sapiens
cttaaagatttatcaa

SEQ ID NO: 1619554 - DNA, 16 bp, Homo sapiens
cttaaagcaaagtcac

SEQ ID NO: 1619555 - DNA, 14 bp, Homo sapiens
cttaaagcttccct

SEQ ID NO: 1619556 - DNA, 20 bp, Homo sapiens
cttaaataacaaaactgtgc

SEQ ID NO: 1619557 - DNA, 19 bp, Homo sapiens
cttaaataatgcttcagat

SEQ ID NO: 1619558 - DNA, 14 bp, Homo sapiens
cttaaatacagata

SEQ ID NO: 1619559 - DNA, 16 bp, Homo sapiens
cttaaatgttatgtat

SEQ ID NO: 1619560 - DNA, 16 bp, Homo sapiens
cttaaatgttattatc

SEQ ID NO: 1619561 - DNA, 19 bp, Homo sapiens
cttaaattcatttctagac

SEQ ID NO: 1619562 - DNA, 20 bp, Homo sapiens
cttaaattcatttctagact

SEQ ID NO: 1619563 - DNA, 16 bp, Homo sapiens
cttaaatttaatacca

SEQ ID NO: 1619564 - DNA, 14 bp, Homo sapiens
cttaaatttcttat

SEQ ID NO: 1619565 - DNA, 18 bp, Homo sapiens
cttaaatttcttatgtga

SEQ ID NO: 1619566 - DNA, 22 bp, Homo sapiens
cttaaatttcttatgtgacatt

SEQ ID NO: 1619567 - DNA, 18 bp, Homo sapiens
cttaaattttaactaaat

SEQ ID NO: 1619568 - DNA, 18 bp, Homo sapiens
cttaaattttaatttatt

SEQ ID NO: 1619569 - DNA, 16 bp, Homo sapiens
cttaacagttgtattt

SEQ ID NO: 1619570 - DNA, 15 bp, Homo sapiens
cttaacatttctctc

SEQ ID NO: 1619571 - DNA, 15 bp, Homo sapiens
cttaacccagtgtcc

SEQ ID NO: 1619572 - DNA, 21 bp, Homo sapiens
cttaaccccaaggactgaggg

SEQ ID NO: 1619573 - DNA, 19 bp, Homo sapiens
cttaaccctgtgctgtcag

SEQ ID NO: 1619574 - DNA, 14 bp, Homo sapiens
cttaacggctccag

SEQ ID NO: 1619575 - DNA, 13 bp, Homo sapiens
cttaactaatttg

SEQ ID NO: 1619576 - DNA, 15 bp, Homo sapiens
cttaactaatttgaa

SEQ ID NO: 1619577 - DNA, 17 bp, Homo sapiens
cttaactataaggtgcc

SEQ ID NO: 1619578 - DNA, 19 bp, Homo sapiens
cttaactataaggtgcctc

SEQ ID NO: 1619579 - DNA, 12 bp, Homo sapiens
cttaactccaag

SEQ ID NO: 1619580 - DNA, 19 bp, Homo sapiens
cttaactgcatttttagac

SEQ ID NO: 1619581 - DNA, 16 bp, Homo sapiens
cttaactggtctcctt

SEQ ID NO: 1619582 - DNA, 14 bp, Homo sapiens
cttaacttcttgct

SEQ ID NO: 1619583 - DNA, 14 bp, Homo sapiens
cttaagaactgtgt

SEQ ID NO: 1619584 - DNA, 15 bp, Homo sapiens
cttaagaactgtgtc

SEQ ID NO: 1619585 - DNA, 16 bp, Homo sapiens
cttaagaactgtgtct

SEQ ID NO: 1619586 - DNA, 19 bp, Homo sapiens
cttaagaatgagtttctta

SEQ ID NO: 1619587 - DNA, 22 bp, Homo sapiens
cttaagaatgagtttcttagac

SEQ ID NO: 1619588 - DNA, 15 bp, Homo sapiens
cttaagacaaatggg

SEQ ID NO: 1619589 - DNA, 17 bp, Homo sapiens
cttaagacaaatgggac

SEQ ID NO: 1619590 - DNA, 19 bp, Homo sapiens
cttaagacaaatgggactg

SEQ ID NO: 1619591 - DNA, 21 bp, Homo sapiens
cttaagacaaatgggactgat

SEQ ID NO: 1619592 - DNA, 22 bp, Homo sapiens
cttaagacaaatgggactgatg

SEQ ID NO: 1619593 - DNA, 20 bp, Homo sapiens
cttaagacctactgttctaa

SEQ ID NO: 1619594 - DNA, 17 bp, Homo sapiens
cttaagatattgaagga

SEQ ID NO: 1619595 - DNA, 17 bp, Homo sapiens
cttaagatctgactgcc

SEQ ID NO: 1619596 - DNA, 18 bp, Homo sapiens
cttaagatctgactgcca

SEQ ID NO: 1619597 - DNA, 15 bp, Homo sapiens
cttaagattaatttt

SEQ ID NO: 1619598 - DNA, 16 bp, Homo sapiens
cttaagattctttgtg

SEQ ID NO: 1619599 - DNA, 19 bp, Homo sapiens
cttaagcaaaggggacagc

SEQ ID NO: 1619600 - DNA, 11 bp, Homo sapiens
cttaagcacaa

SEQ ID NO: 1619601 - DNA, 14 bp, Homo sapiens
cttaagcagcatgg

SEQ ID NO: 1619602 - DNA, 16 bp, Homo sapiens
cttaagcagcatggaa

SEQ ID NO: 1619603 - DNA, 23 bp, Homo sapiens
cttaagcatctggctctaattca

SEQ ID NO: 1619604 - DNA, 23 bp, Homo sapiens
cttagcagctatctctcagtgaa

SEQ ID NO: 1619605 - DNA, 17 bp, Homo sapiens
cttagcagcttccagat

SEQ ID NO: 1619606 - DNA, 12 bp, Homo sapiens
cttagcccaaga

SEQ ID NO: 1619607 - DNA, 17 bp, Homo sapiens
cttagcccaagaggtct

SEQ ID NO: 1619608 - DNA, 23 bp, Homo sapiens
cttagcccaagaggtctgagccc

SEQ ID NO: 1619609 - DNA, 18 bp, Homo sapiens
cttagccgtccatggcac

SEQ ID NO: 1619610 - DNA, 12 bp, Homo sapiens
cttagcctctcc

SEQ ID NO: 1619611 - DNA, 17 bp, Homo sapiens
cttagcctctggatcta

SEQ ID NO: 1619612 - DNA, 15 bp, Homo sapiens
cttagccttgtgccc

SEQ ID NO: 1619613 - DNA, 18 bp, Homo sapiens
cttagccttgtgccctgc

SEQ ID NO: 1619614 - DNA, 19 bp, Homo sapiens
cttagccttgtgccctgcc

SEQ ID NO: 1619615 - DNA, 23 bp, Homo sapiens
cttagccttgtgccctgccccca

SEQ ID NO: 1619616 - DNA, 17 bp, Homo sapiens
cttagcgtcaagacatt

SEQ ID NO: 1619617 - DNA, 16 bp, Homo sapiens
cttagcgttctggact

SEQ ID NO: 1619618 - DNA, 14 bp, Homo sapiens
cttagctactgtat

SEQ ID NO: 1619619 - DNA, 20 bp, Homo sapiens
cttagctatccttggctttc

SEQ ID NO: 1619620 - DNA, 15 bp, Homo sapiens
cttagctcaggtgcc

SEQ ID NO: 1619621 - DNA, 19 bp, Homo sapiens
cttagctctcccaactctt

SEQ ID NO: 1619622 - DNA, 12 bp, Homo sapiens
cttagctctgga

SEQ ID NO: 1619623 - DNA, 13 bp, Homo sapiens
cttagctctggac

SEQ ID NO: 1619624 - DNA, 17 bp, Homo sapiens
cttagctcttaattgtt

SEQ ID NO: 1619625 - DNA, 13 bp, Homo sapiens
cttagctgtacta

SEQ ID NO: 1619626 - DNA, 17 bp, Homo sapiens
cttagctgtctgctcag

SEQ ID NO: 1619627 - DNA, 16 bp, Homo sapiens
cttagcttacaggaag

SEQ ID NO: 1619628 - DNA, 17 bp, Homo sapiens
cttagcttacaggaagc

SEQ ID NO: 1619629 - DNA, 23 bp, Homo sapiens
cttagcttagacctcagcctgtg

SEQ ID NO: 1619630 - DNA, 17 bp, Homo sapiens
cttaggaagagaaacca

SEQ ID NO: 1619631 - DNA, 22 bp, Homo sapiens
cttaggaagagaaaccagggag

SEQ ID NO: 1619632 - DNA, 13 bp, Homo sapiens
cttaggattctaa

SEQ ID NO: 1619633 - DNA, 22 bp, Homo sapiens
cttaggattctgttccctgggc

SEQ ID NO: 1619634 - DNA, 19 bp, Homo sapiens
cttaggcctctctgcctgg

SEQ ID NO: 1619635 - DNA, 13 bp, Homo sapiens
cttaggccttcct

SEQ ID NO: 1619636 - DNA, 23 bp, Homo sapiens
cttaggctttgtatgacagtgaa

SEQ ID NO: 1619637 - DNA, 12 bp, Homo sapiens
cttagggaaaga

SEQ ID NO: 1619638 - DNA, 23 bp, Homo sapiens
cttagggactacccatagacatg

SEQ ID NO: 1619639 - DNA, 15 bp, Homo sapiens
cttagggcaccaggg

SEQ ID NO: 1619640 - DNA, 17 bp, Homo sapiens
cttagggcactgggctg

SEQ ID NO: 1619641 - DNA, 15 bp, Homo sapiens
cttaggggaaggaga

SEQ ID NO: 1619642 - DNA, 19 bp, Homo sapiens
cttaggttattttgctttg

SEQ ID NO: 1619643 - DNA, 21 bp, Homo sapiens
cttaggtttactgtgaagaga

SEQ ID NO: 1619644 - DNA, 15 bp, Homo sapiens
cttagtatttctcag

SEQ ID NO: 1619645 - DNA, 13 bp, Homo sapiens
cttagtcactgcc

SEQ ID NO: 1619646 - DNA, 16 bp, Homo sapiens
cttagtcactgcctgc

SEQ ID NO: 1619647 - DNA, 17 bp, Homo sapiens
cttagtcactgcctgca

SEQ ID NO: 1619648 - DNA, 17 bp, Homo sapiens
cttagtccagttgtgtt

SEQ ID NO: 1619649 - DNA, 15 bp, Homo sapiens
cttagtctaggtcct

SEQ ID NO: 1619650 - DNA, 21 bp, Homo sapiens
cttagtctaggtccttgttgt

SEQ ID NO: 1619651 - DNA, 19 bp, Homo sapiens
cttagtctcagtttgtgtg

SEQ ID NO: 1619652 - DNA, 20 bp, Homo sapiens
cttagtctcagtttgtgtgt

SEQ ID NO: 1619653 - DNA, 20 bp, Homo sapiens
cttagtgcggacaagtttta

SEQ ID NO: 1619654 - DNA, 11 bp, Homo sapiens
cttagtgtatg

SEQ ID NO: 1619655 - DNA, 20 bp, Homo sapiens
cttagttgacaacctagaat

SEQ ID NO: 1619656 - DNA, 23 bp, Homo sapiens
cttagttgacaacctagaatgtc

SEQ ID NO: 1619657 - DNA, 17 bp, Homo sapiens
cttagttggctttgccc

SEQ ID NO: 1619658 - DNA, 17 bp, Homo sapiens
cttagtttgtgtgttgt

SEQ ID NO: 1619659 - DNA, 23 bp, Homo sapiens
cttagtttgtgtgttgtctcttg

SEQ ID NO: 1619660 - DNA, 11 bp, Homo sapiens
cttagttttaa

SEQ ID NO: 1619661 - DNA, 20 bp, Homo sapiens
cttagttttttttaaaaaaa

SEQ ID NO: 1619662 - DNA, 22 bp, Homo sapiens
cttataaaataacttgcatcta

SEQ ID NO: 1619663 - DNA, 19 bp, Homo sapiens
cttataaaatcctgtgcaa

SEQ ID NO: 1619664 - DNA, 21 bp, Homo sapiens
cttataacctagttaaagaaa

SEQ ID NO: 1619665 - DNA, 20 bp, Homo sapiens
cttataagtgaagtgatact

SEQ ID NO: 1619666 - DNA, 14 bp, Homo sapiens
cttatagaataaaa

SEQ ID NO: 1619667 - DNA, 16 bp, Homo sapiens
cttatagaatatttat

SEQ ID NO: 1619668 - DNA, 18 bp, Homo sapiens
cttataggcctgtccctt

SEQ ID NO: 1619669 - DNA, 15 bp, Homo sapiens
cttatagttactgtg

SEQ ID NO: 1619670 - DNA, 18 bp, Homo sapiens
cttatagttactgtgtaa

SEQ ID NO: 1619671 - DNA, 19 bp, Homo sapiens
cttatagttactgtgtaat

SEQ ID NO: 1619672 - DNA, 18 bp, Homo sapiens
cttatattttatgaacat

SEQ ID NO: 1619673 - DNA, 22 bp, Homo sapiens
cttatattttatgaacattgta

SEQ ID NO: 1619674 - DNA, 21 bp, Homo sapiens
cttatcacccccttgttgtaa

SEQ ID NO: 1619675 - DNA, 12 bp, Homo sapiens
cttatccctctc

SEQ ID NO: 1619676 - DNA, 15 bp, Homo sapiens
cttatccctctcttc

SEQ ID NO: 1619677 - DNA, 13 bp, Homo sapiens
cttatcctctctc

SEQ ID NO: 1619678 - DNA, 16 bp, Homo sapiens
cttatcgggctccagc

SEQ ID NO: 1619679 - DNA, 17 bp, Homo sapiens
cttatctctcaaaacaa

SEQ ID NO: 1619680 - DNA, 15 bp, Homo sapiens
cttatcttctggatt

SEQ ID NO: 1619681 - DNA, 14 bp, Homo sapiens
cttatcttgtttca

SEQ ID NO: 1619682 - DNA, 16 bp, Homo sapiens
cttatgcatgaaatga

SEQ ID NO: 1619683 - DNA, 22 bp, Homo sapiens
cttatgccacgggaagtttaga

SEQ ID NO: 1619684 - DNA, 16 bp, Homo sapiens
cttatggagctcacac

SEQ ID NO: 1619685 - DNA, 18 bp, Homo sapiens
cttatgggatccttgtct

SEQ ID NO: 1619686 - DNA, 21 bp, Homo sapiens
cttatggtatgtagccagctg

SEQ ID NO: 1619687 - DNA, 14 bp, Homo sapiens
cttatggtccagaa

SEQ ID NO: 1619688 - DNA, 19 bp, Homo sapiens
cttatgtatcagtgtcctt

SEQ ID NO: 1619689 - DNA, 14 bp, Homo sapiens
cttatgtcctgtca

SEQ ID NO: 1619690 - DNA, 12 bp, Homo sapiens
cttatgtctctg

SEQ ID NO: 1619691 - DNA, 16 bp, Homo sapiens
cttatgtctctgcctt

SEQ ID NO: 1619692 - DNA, 18 bp, Homo sapiens
cttatgtgaaaaattaac

SEQ ID NO: 1619693 - DNA, 21 bp, Homo sapiens
cttatgtgaaaaattaacttt

SEQ ID NO: 1619694 - DNA, 14 bp, Homo sapiens
cttattaaagttct

SEQ ID NO: 1619695 - DNA, 18 bp, Homo sapiens
cttattaaagttctgtaa

SEQ ID NO: 1619696 - DNA, 21 bp, Homo sapiens
cttattaatcatacaaactct

SEQ ID NO: 1619697 - DNA, 12 bp, Homo sapiens
cttattaatttc

SEQ ID NO: 1619698 - DNA, 19 bp, Homo sapiens
cttattcacctttttaata

SEQ ID NO: 1619699 - DNA, 18 bp, Homo sapiens
cttattccaagtgcattt

SEQ ID NO: 1619700 - DNA, 16 bp, Homo sapiens
cttattccaggagaag

SEQ ID NO: 1619701 - DNA, 21 bp, Homo sapiens
cttattcccaaactacagaat

SEQ ID NO: 1619702 - DNA, 12 bp, Homo sapiens
cttattctgtag

SEQ ID NO: 1619703 - DNA, 13 bp, Homo sapiens
cttattctgtatc

SEQ ID NO: 1619704 - DNA, 16 bp, Homo sapiens
cttattgcgctgctac

SEQ ID NO: 1619705 - DNA, 17 bp, Homo sapiens
cttattggaactctgct

SEQ ID NO: 1619706 - DNA, 22 bp, Homo sapiens
cttattgtgtgcgctgcctggc

SEQ ID NO: 1619707 - DNA, 13 bp, Homo sapiens
cttatttaaaaat

SEQ ID NO: 1619708 - DNA, 16 bp, Homo sapiens
cttatttaaaaatatt

SEQ ID NO: 1619709 - DNA, 18 bp, Homo sapiens
cttatttacccttttccc

SEQ ID NO: 1619710 - DNA, 13 bp, Homo sapiens
cttatttagagat

SEQ ID NO: 1619711 - DNA, 12 bp, Homo sapiens
cttatttattta

SEQ ID NO: 1619712 - DNA, 13 bp, Homo sapiens
cttatttcactaa

SEQ ID NO: 1619713 - DNA, 15 bp, Homo sapiens
cttatttcatttctt

SEQ ID NO: 1619714 - DNA, 17 bp, Homo sapiens
cttatttctatgacaaa

SEQ ID NO: 1619715 - DNA, 14 bp, Homo sapiens
cttatttgccttct

SEQ ID NO: 1619716 - DNA, 19 bp, Homo sapiens
cttatttgccttctactcc

SEQ ID NO: 1619717 - DNA, 20 bp, Homo sapiens
cttaagccctttgctctgga

SEQ ID NO: 1619718 - DNA, 21 bp, Homo sapiens
cttaaggcacagtgggagctg

SEQ ID NO: 1619719 - DNA, 16 bp, Homo sapiens
cttaaggcactctgtt

SEQ ID NO: 1619720 - DNA, 18 bp, Homo sapiens
cttaagggttgaaggcag

SEQ ID NO: 1619721 - DNA, 20 bp, Homo sapiens
cttaagggttgaaggcagtc

SEQ ID NO: 1619722 - DNA, 16 bp, Homo sapiens
cttaaggtttgttttc

SEQ ID NO: 1619723 - DNA, 22 bp, Homo sapiens
cttaaggtttgttttcattaaa

SEQ ID NO: 1619724 - DNA, 19 bp, Homo sapiens
cttaagtctcgaatgtaat

SEQ ID NO: 1619725 - DNA, 16 bp, Homo sapiens
cttaagtcttccttaa

SEQ ID NO: 1619726 - DNA, 17 bp, Homo sapiens
cttaagtgagcagaaca

SEQ ID NO: 1619727 - DNA, 19 bp, Homo sapiens
cttaagtgagcagaacagg

SEQ ID NO: 1619728 - DNA, 15 bp, Homo sapiens
cttaagtgcactttt

SEQ ID NO: 1619729 - DNA, 15 bp, Homo sapiens
cttaagtgcccacat

SEQ ID NO: 1619730 - DNA, 15 bp, Homo sapiens
cttaagtgtttctca

SEQ ID NO: 1619731 - DNA, 17 bp, Homo sapiens
cttaataaaataaacta

SEQ ID NO: 1619732 - DNA, 14 bp, Homo sapiens
cttaataaatatgt

SEQ ID NO: 1619733 - DNA, 17 bp, Homo sapiens
cttaataaattcagata

SEQ ID NO: 1619734 - DNA, 18 bp, Homo sapiens
cttaataaattcagatat

SEQ ID NO: 1619735 - DNA, 15 bp, Homo sapiens
cttaataactgtgta

SEQ ID NO: 1619736 - DNA, 19 bp, Homo sapiens
cttaataactgtgtactgt

SEQ ID NO: 1619737 - DNA, 22 bp, Homo sapiens
cttaatactcaaatgagtaaca

SEQ ID NO: 1619738 - DNA, 19 bp, Homo sapiens
cttaatactgttattcttt

SEQ ID NO: 1619739 - DNA, 22 bp, Homo sapiens
cttaatagctgtagttttccct

SEQ ID NO: 1619740 - DNA, 19 bp, Homo sapiens
cttaatatatacatttttt

SEQ ID NO: 1619741 - DNA, 19 bp, Homo sapiens
cttaatattgaggctgcag

SEQ ID NO: 1619742 - DNA, 12 bp, Homo sapiens
cttaatcatttt

SEQ ID NO: 1619743 - DNA, 20 bp, Homo sapiens
cttaatcattttcattccta

SEQ ID NO: 1619744 - DNA, 18 bp, Homo sapiens
cttaatcattttttatat

SEQ ID NO: 1619745 - DNA, 20 bp, Homo sapiens
cttaatcttgctttctttag

SEQ ID NO: 1619746 - DNA, 17 bp, Homo sapiens
cttaatgtaacatgttt

SEQ ID NO: 1619747 - DNA, 14 bp, Homo sapiens
cttaatgtatgtta

SEQ ID NO: 1619748 - DNA, 20 bp, Homo sapiens
cttaatgtgattactgctct

SEQ ID NO: 1619749 - DNA, 20 bp, Homo sapiens
cttaatgttctgaataattt

SEQ ID NO: 1619750 - DNA, 22 bp, Homo sapiens
cttaatgttctgaataatttct

SEQ ID NO: 1619751 - DNA, 22 bp, Homo sapiens
cttaattagacctaggcctcag

SEQ ID NO: 1619752 - DNA, 11 bp, Homo sapiens
cttaattatta

SEQ ID NO: 1619753 - DNA, 15 bp, Homo sapiens
cttaattattatttg

SEQ ID NO: 1619754 - DNA, 14 bp, Homo sapiens
cttaattctctgca

SEQ ID NO: 1619755 - DNA, 14 bp, Homo sapiens
cttaattctgatta

SEQ ID NO: 1619756 - DNA, 14 bp, Homo sapiens
cttaattctttgtt

SEQ ID NO: 1619757 - DNA, 15 bp, Homo sapiens
cttaattctttgttc

SEQ ID NO: 1619758 - DNA, 17 bp, Homo sapiens
cttaattctttgttctg

SEQ ID NO: 1619759 - DNA, 20 bp, Homo sapiens
cttaattgtattgttttccc

SEQ ID NO: 1619760 - DNA, 23 bp, Homo sapiens
cttaattgttcattttgagctga

SEQ ID NO: 1619761 - DNA, 23 bp, Homo sapiens
cttaatttatttcttaacctttg

SEQ ID NO: 1619762 - DNA, 13 bp, Homo sapiens
cttaatttccttt

SEQ ID NO: 1619763 - DNA, 15 bp, Homo sapiens
cttaatttgcacagt

SEQ ID NO: 1619764 - DNA, 16 bp, Homo sapiens
cttaattttttttaat

SEQ ID NO: 1619765 - DNA, 19 bp, Homo sapiens
cttaatttttttttcatag

SEQ ID NO: 1619766 - DNA, 14 bp, Homo sapiens
cttacaaaatgcca

SEQ ID NO: 1619767 - DNA, 15 bp, Homo sapiens
cttacaatattgatt

SEQ ID NO: 1619768 - DNA, 16 bp, Homo sapiens
cttacactgaaaatgt

SEQ ID NO: 1619769 - DNA, 14 bp, Homo sapiens
cttacactgaggac

SEQ ID NO: 1619770 - DNA, 16 bp, Homo sapiens
cttacacttggagccc

SEQ ID NO: 1619771 - DNA, 15 bp, Homo sapiens
cttacagagccttga

SEQ ID NO: 1619772 - DNA, 20 bp, Homo sapiens
cttacagcacatcacctctt

SEQ ID NO: 1619773 - DNA, 22 bp, Homo sapiens
cttacagccctaagtggctgcc

SEQ ID NO: 1619774 - DNA, 14 bp, Homo sapiens
cttacaggtgatta

SEQ ID NO: 1619775 - DNA, 16 bp, Homo sapiens
cttacatcttttctaa

SEQ ID NO: 1619776 - DNA, 14 bp, Homo sapiens
cttacatgcatttg

SEQ ID NO: 1619777 - DNA, 20 bp, Homo sapiens
cttacatgtgtaaaggtttc

SEQ ID NO: 1619778 - DNA, 20 bp, Homo sapiens
cttacattagcagtttgctt

SEQ ID NO: 1619779 - DNA, 18 bp, Homo sapiens
cttaccaattgtgaatgt

SEQ ID NO: 1619780 - DNA, 15 bp, Homo sapiens
cttaccgtagcctcc

SEQ ID NO: 1619781 - DNA, 13 bp, Homo sapiens
cttacctcctgcc

SEQ ID NO: 1619782 - DNA, 14 bp, Homo sapiens
cttacctcctgccc

SEQ ID NO: 1619783 - DNA, 11 bp, Homo sapiens
cttacctgaca

SEQ ID NO: 1619784 - DNA, 12 bp, Homo sapiens
cttacctgacac

SEQ ID NO: 1619785 - DNA, 16 bp, Homo sapiens
cttacctgacacaaga

SEQ ID NO: 1619786 - DNA, 17 bp, Homo sapiens
cttacctgagttgaaga

SEQ ID NO: 1619787 - DNA, 18 bp, Homo sapiens
cttaccttggttggaagg

SEQ ID NO: 1619788 - DNA, 19 bp, Homo sapiens
cttacctttttatttgcat

SEQ ID NO: 1619789 - DNA, 14 bp, Homo sapiens
cttacgtaaaacat

SEQ ID NO: 1619790 - DNA, 12 bp, Homo sapiens
cttactaggaag

SEQ ID NO: 1619791 - DNA, 16 bp, Homo sapiens
cttactagtactattt

SEQ ID NO: 1619792 - DNA, 17 bp, Homo sapiens
cttactatccatttctt

SEQ ID NO: 1619793 - DNA, 20 bp, Homo sapiens
cttactatgatctcaggagc

SEQ ID NO: 1619794 - DNA, 22 bp, Homo sapiens
cttactatttctgggtcttttg

SEQ ID NO: 1619795 - DNA, 13 bp, Homo sapiens
cttactctaagat

SEQ ID NO: 1619796 - DNA, 20 bp, Homo sapiens
cttactctaagatcttagat

SEQ ID NO: 1619797 - DNA, 14 bp, Homo sapiens
cttactctgagccc

SEQ ID NO: 1619798 - DNA, 20 bp, Homo sapiens
cttactctgagcccaggccg

SEQ ID NO: 1619799 - DNA, 21 bp, Homo sapiens
cttactctgagcccaggccgt

SEQ ID NO: 1619800 - DNA, 12 bp, Homo sapiens
cttactctttcc

SEQ ID NO: 1619801 - DNA, 15 bp, Homo sapiens
cttactctttcctat

SEQ ID NO: 1619802 - DNA, 17 bp, Homo sapiens
cttactgattattttct

SEQ ID NO: 1619803 - DNA, 12 bp, Homo sapiens
cttactggaaaa

SEQ ID NO: 1619804 - DNA, 13 bp, Homo sapiens
cttactgtatatg

SEQ ID NO: 1619805 - DNA, 19 bp, Homo sapiens
cttactgtatatgtattcc

SEQ ID NO: 1619806 - DNA, 22 bp, Homo sapiens
cttacttgccaagaaaatgaag

SEQ ID NO: 1619807 - DNA, 12 bp, Homo sapiens
cttactttgctt

SEQ ID NO: 1619808 - DNA, 21 bp, Homo sapiens
cttacttttaaggataaatca

SEQ ID NO: 1619809 - DNA, 18 bp, Homo sapiens
cttacttttccagtctgt

SEQ ID NO: 1619810 - DNA, 16 bp, Homo sapiens
cttagaaattgcattt

SEQ ID NO: 1619811 - DNA, 17 bp, Homo sapiens
cttagaaattgcatttc

SEQ ID NO: 1619812 - DNA, 17 bp, Homo sapiens
cttagaacgttaaacta

SEQ ID NO: 1619813 - DNA, 18 bp, Homo sapiens
cttagaactatgctaatt

SEQ ID NO: 1619814 - DNA, 14 bp, Homo sapiens
cttagaaggtatta

SEQ ID NO: 1619815 - DNA, 21 bp, Homo sapiens
cttagaagtggaccaggacag

SEQ ID NO: 1619816 - DNA, 22 bp, Homo sapiens
cttagaagtggaccaggacagg

SEQ ID NO: 1619817 - DNA, 18 bp, Homo sapiens
cttagaagtgttgtaaaa

SEQ ID NO: 1619818 - DNA, 22 bp, Homo sapiens
cttagaattgctggatgcattt

SEQ ID NO: 1619819 - DNA, 18 bp, Homo sapiens
cttagacctcagcctgtg

SEQ ID NO: 1619820 - DNA, 21 bp, Homo sapiens
cttagactctagtatttatgg

SEQ ID NO: 1619821 - DNA, 20 bp, Homo sapiens
cttagacttcgactcaggat

SEQ ID NO: 1619822 - DNA, 22 bp, Homo sapiens
cttagacttttccaatatgtga

SEQ ID NO: 1619823 - DNA, 13 bp, Homo sapiens
cttagagatatgt

SEQ ID NO: 1619824 - DNA, 19 bp, Homo sapiens
cttagagcaacctctgtat

SEQ ID NO: 1619825 - DNA, 13 bp, Homo sapiens
cttagaggaaaat

SEQ ID NO: 1619826 - DNA, 16 bp, Homo sapiens
cttagagtgtagctgt

SEQ ID NO: 1619827 - DNA, 18 bp, Homo sapiens
cttagagtgtagctgtaa

SEQ ID NO: 1619828 - DNA, 19 bp, Homo sapiens
cttagatgagggtgactgt

SEQ ID NO: 1619829 - DNA, 16 bp, Homo sapiens
cttagatggattctcc

SEQ ID NO: 1619830 - DNA, 14 bp, Homo sapiens
cttagattcttaat

SEQ ID NO: 1619831 - DNA, 15 bp, Homo sapiens
cttagattgtgttcc

SEQ ID NO: 1619832 - DNA, 15 bp, Homo sapiens
ctgttcacggcagac

SEQ ID NO: 1619833 - DNA, 13 bp, Homo sapiens
ctgttcactctac

SEQ ID NO: 1619834 - DNA, 18 bp, Homo sapiens
ctgttcagatgtgcattt

SEQ ID NO: 1619835 - DNA, 19 bp, Homo sapiens
ctgttcagcttttattcct

SEQ ID NO: 1619836 - DNA, 19 bp, Homo sapiens
ctgttcagtgagatatcat

SEQ ID NO: 1619837 - DNA, 16 bp, Homo sapiens
ctgttcagtgtcccgg

SEQ ID NO: 1619838 - DNA, 17 bp, Homo sapiens
ctgttccaacctcctgc

SEQ ID NO: 1619839 - DNA, 19 bp, Homo sapiens
ctgttccaacctcctgctc

SEQ ID NO: 1619840 - DNA, 22 bp, Homo sapiens
ctgttccaacctcctgctctgg

SEQ ID NO: 1619841 - DNA, 14 bp, Homo sapiens
ctgttccccagaga

SEQ ID NO: 1619842 - DNA, 14 bp, Homo sapiens
ctgttcccccaccc

SEQ ID NO: 1619843 - DNA, 17 bp, Homo sapiens
ctgttcccctcacccaa

SEQ ID NO: 1619844 - DNA, 13 bp, Homo sapiens
ctgttccctagag

SEQ ID NO: 1619845 - DNA, 13 bp, Homo sapiens
ctgttccctctgg

SEQ ID NO: 1619846 - DNA, 17 bp, Homo sapiens
ctgttccctctggcttc

SEQ ID NO: 1619847 - DNA, 21 bp, Homo sapiens
ctgttccctctggcttcccat

SEQ ID NO: 1619848 - DNA, 15 bp, Homo sapiens
ctgttccttcacatc

SEQ ID NO: 1619849 - DNA, 19 bp, Homo sapiens
ctgttcctttctctgggct

SEQ ID NO: 1619850 - DNA, 13 bp, Homo sapiens
ctgttcggaaggg

SEQ ID NO: 1619851 - DNA, 23 bp, Homo sapiens
ctgttcggaaggggttcctcaaa

SEQ ID NO: 1619852 - DNA, 12 bp, Homo sapiens
ctgttctaaagc

SEQ ID NO: 1619853 - DNA, 19 bp, Homo sapiens
ctgttctatgcctttagtc

SEQ ID NO: 1619854 - DNA, 12 bp, Homo sapiens
ctgttctcctgt

SEQ ID NO: 1619855 - DNA, 16 bp, Homo sapiens
ctgttctcttggctgc

SEQ ID NO: 1619856 - DNA, 15 bp, Homo sapiens
ctgttctgcactgaa

SEQ ID NO: 1619857 - DNA, 17 bp, Homo sapiens
ctgttctgcactgaaaa

SEQ ID NO: 1619858 - DNA, 18 bp, Homo sapiens
ctgttctgcactgaaaag

SEQ ID NO: 1619859 - DNA, 21 bp, Homo sapiens
ctgttctgtggttcctctgct

SEQ ID NO: 1619860 - DNA, 13 bp, Homo sapiens
ctgttctgtgtct

SEQ ID NO: 1619861 - DNA, 14 bp, Homo sapiens
ctgttctgtgtctt

SEQ ID NO: 1619862 - DNA, 17 bp, Homo sapiens
ctgttctgtttggcact

SEQ ID NO: 1619863 - DNA, 23 bp, Homo sapiens
ctgttctgtttggcacttgtatt

SEQ ID NO: 1619864 - DNA, 15 bp, Homo sapiens
ctgttcttacaaatg

SEQ ID NO: 1619865 - DNA, 15 bp, Homo sapiens
ctgttcttagagtgt

SEQ ID NO: 1619866 - DNA, 16 bp, Homo sapiens
ctgttcttcaactcct

SEQ ID NO: 1619867 - DNA, 13 bp, Homo sapiens
ctgttcttggtaa

SEQ ID NO: 1619868 - DNA, 21 bp, Homo sapiens
ctgttgaattggtgaataaaa

SEQ ID NO: 1619869 - DNA, 23 bp, Homo sapiens
ctgttgaattttgttctctggga

SEQ ID NO: 1619870 - DNA, 19 bp, Homo sapiens
ctgttgagatgtgctttgc

SEQ ID NO: 1619871 - DNA, 21 bp, Homo sapiens
ctgttgagatgtgctttgctg

SEQ ID NO: 1619872 - DNA, 15 bp, Homo sapiens
ctgttgagccccagt

SEQ ID NO: 1619873 - DNA, 15 bp, Homo sapiens
ctgttgagctgtttt

SEQ ID NO: 1619874 - DNA, 17 bp, Homo sapiens
ctgttgagggccaagag

SEQ ID NO: 1619875 - DNA, 17 bp, Homo sapiens
ctgttgaggtggctgta

SEQ ID NO: 1619876 - DNA, 18 bp, Homo sapiens
ctgttgataaatccatca

SEQ ID NO: 1619877 - DNA, 21 bp, Homo sapiens
ctgttgatcccacttcactgt

SEQ ID NO: 1619878 - DNA, 15 bp, Homo sapiens
ctgttgatgggaaaa

SEQ ID NO: 1619879 - DNA, 17 bp, Homo sapiens
ctgttgattatcttcag

SEQ ID NO: 1619880 - DNA, 18 bp, Homo sapiens
ctgttgattatcttcagc

SEQ ID NO: 1619881 - DNA, 12 bp, Homo sapiens
ctgttgcagtgg

SEQ ID NO: 1619882 - DNA, 18 bp, Homo sapiens
ctgttgcagtggcctggc

SEQ ID NO: 1619883 - DNA, 21 bp, Homo sapiens
ctgttgcagtggcctggccgt

SEQ ID NO: 1619884 - DNA, 17 bp, Homo sapiens
ctgttgcatttactttt

SEQ ID NO: 1619885 - DNA, 18 bp, Homo sapiens
ctgttgccatagccccat

SEQ ID NO: 1619886 - DNA, 13 bp, Homo sapiens
ctgttgccatgga

SEQ ID NO: 1619887 - DNA, 16 bp, Homo sapiens
ctgttgcccaggctgg

SEQ ID NO: 1619888 - DNA, 14 bp, Homo sapiens
ctgttgctgatttt

SEQ ID NO: 1619889 - DNA, 15 bp, Homo sapiens
ctgttgctgatttta

SEQ ID NO: 1619890 - DNA, 22 bp, Homo sapiens
ctgttgctgattttattcttga

SEQ ID NO: 1619891 - DNA, 16 bp, Homo sapiens
ctgttgctgtcttcag

SEQ ID NO: 1619892 - DNA, 11 bp, Homo sapiens
ctgttgcttgt

SEQ ID NO: 1619893 - DNA, 18 bp, Homo sapiens
ctgttgctttaatatgag

SEQ ID NO: 1619894 - DNA, 12 bp, Homo sapiens
ctgttggaagaa

SEQ ID NO: 1619895 - DNA, 13 bp, Homo sapiens
ctgttggaagaaa

SEQ ID NO: 1619896 - DNA, 13 bp, Homo sapiens
ctgttggacagct

SEQ ID NO: 1619897 - DNA, 20 bp, Homo sapiens
ctgttggacagctgcttgtg

SEQ ID NO: 1619898 - DNA, 14 bp, Homo sapiens
ctgttggagcccga

SEQ ID NO: 1619899 - DNA, 17 bp, Homo sapiens
ctgttggcaggcccact

SEQ ID NO: 1619900 - DNA, 22 bp, Homo sapiens
ctgttggcaggcccactcccca

SEQ ID NO: 1619901 - DNA, 19 bp, Homo sapiens
ctgttggcccctctgctgt

SEQ ID NO: 1619902 - DNA, 21 bp, Homo sapiens
ctgttggcccctctgctgtcc

SEQ ID NO: 1619903 - DNA, 18 bp, Homo sapiens
ctgttgggaacagcatgg

SEQ ID NO: 1619904 - DNA, 12 bp, Homo sapiens
ctgttgggagaa

SEQ ID NO: 1619905 - DNA, 16 bp, Homo sapiens
ctgttgggagaaagca

SEQ ID NO: 1619906 - DNA, 17 bp, Homo sapiens
ctgttgggagaaagcaa

SEQ ID NO: 1619907 - DNA, 19 bp, Homo sapiens
ctgttgtaagaattctgat

SEQ ID NO: 1619908 - DNA, 14 bp, Homo sapiens
ctgttgtctgcgcc

SEQ ID NO: 1619909 - DNA, 21 bp, Homo sapiens
ctgttgtctgcgcctgaaaag

SEQ ID NO: 1619910 - DNA, 14 bp, Homo sapiens
ctgttgttcccgtg

SEQ ID NO: 1619911 - DNA, 13 bp, Homo sapiens
ctgttgttgttaa

SEQ ID NO: 1619912 - DNA, 19 bp, Homo sapiens
ctgtttaaatatttcaaga

SEQ ID NO: 1619913 - DNA, 14 bp, Homo sapiens
ctgtttaatttaca

SEQ ID NO: 1619914 - DNA, 20 bp, Homo sapiens
ctgtttaggttcccctgtca

SEQ ID NO: 1619915 - DNA, 16 bp, Homo sapiens
ctgtttataaaaacaa

SEQ ID NO: 1619916 - DNA, 20 bp, Homo sapiens
ctgtttataaaaacaaaaac

SEQ ID NO: 1619917 - DNA, 15 bp, Homo sapiens
ctgtttatggcctca

SEQ ID NO: 1619918 - DNA, 17 bp, Homo sapiens
ctgtttatggcctcagc

SEQ ID NO: 1619919 - DNA, 19 bp, Homo sapiens
ctgtttatggcctcagctg

SEQ ID NO: 1619920 - DNA, 17 bp, Homo sapiens
ctgtttattcttccaga

SEQ ID NO: 1619921 - DNA, 19 bp, Homo sapiens
ctgtttattcttccagaat

SEQ ID NO: 1619922 - DNA, 14 bp, Homo sapiens
ctgtttatttaagg

SEQ ID NO: 1619923 - DNA, 22 bp, Homo sapiens
ctgtttcaaactgaatttgttc

SEQ ID NO: 1619924 - DNA, 11 bp, Homo sapiens
ctgtttcacaa

SEQ ID NO: 1619925 - DNA, 22 bp, Homo sapiens
ctgtttcactgaaatgtttgga

SEQ ID NO: 1619926 - DNA, 13 bp, Homo sapiens
ctgtttcagaccc

SEQ ID NO: 1619927 - DNA, 16 bp, Homo sapiens
ctgtttccctgctgaa

SEQ ID NO: 1619928 - DNA, 19 bp, Homo sapiens
ctgtttcctgacattgtct

SEQ ID NO: 1619929 - DNA, 20 bp, Homo sapiens
ctgtttcctgacattgtctc

SEQ ID NO: 1619930 - DNA, 22 bp, Homo sapiens
ctgtttcgtgtagtggaagagc

SEQ ID NO: 1619931 - DNA, 11 bp, Homo sapiens
ctgtttctaag

SEQ ID NO: 1619932 - DNA, 11 bp, Homo sapiens
ctgtttctcat

SEQ ID NO: 1619933 - DNA, 17 bp, Homo sapiens
ctgtttctcatgaagct

SEQ ID NO: 1619934 - DNA, 20 bp, Homo sapiens
ctgtttctcatgaagctaat

SEQ ID NO: 1619935 - DNA, 15 bp, Homo sapiens
ctgtttctctgctgt

SEQ ID NO: 1619936 - DNA, 17 bp, Homo sapiens
ctgtttcttaagggcac

SEQ ID NO: 1619937 - DNA, 18 bp, Homo sapiens
ctgtttgatataccaaat

SEQ ID NO: 1619938 - DNA, 23 bp, Homo sapiens
ctgtttgatataccaaattaaaa

SEQ ID NO: 1619939 - DNA, 11 bp, Homo sapiens
ctgtttgatgt

SEQ ID NO: 1619940 - DNA, 16 bp, Homo sapiens
ctgtttgatgtatgtg

SEQ ID NO: 1619941 - DNA, 17 bp, Homo sapiens
ctgtgaatgccaaagcc

SEQ ID NO: 1619942 - DNA, 15 bp, Homo sapiens
ctgtgaatgccactg

SEQ ID NO: 1619943 - DNA, 15 bp, Homo sapiens
ctgtgaattgagctg

SEQ ID NO: 1619944 - DNA, 19 bp, Homo sapiens
ctgtgaattgagctgcaga

SEQ ID NO: 1619945 - DNA, 21 bp, Homo sapiens
ctgtgaattgagctgcagaaa

SEQ ID NO: 1619946 - DNA, 23 bp, Homo sapiens
ctgtgacaaaggatgaagaacac

SEQ ID NO: 1619947 - DNA, 14 bp, Homo sapiens
ctgtgacagtgaaa

SEQ ID NO: 1619948 - DNA, 18 bp, Homo sapiens
ctgtgacatcctgcttct

SEQ ID NO: 1619949 - DNA, 16 bp, Homo sapiens
ctgtgacatggtgcct

SEQ ID NO: 1619950 - DNA, 20 bp, Homo sapiens
ctgtgaccagcactgtctca

SEQ ID NO: 1619951 - DNA, 19 bp, Homo sapiens
ctgtgaccatttataatgt

SEQ ID NO: 1619952 - DNA, 17 bp, Homo sapiens
ctgtgaccccaccttga

SEQ ID NO: 1619953 - DNA, 16 bp, Homo sapiens
ctgtgacctgccccgc

SEQ ID NO: 1619954 - DNA, 23 bp, Homo sapiens
ctgtgacgcagccggagggaggc

SEQ ID NO: 1619955 - DNA, 20 bp, Homo sapiens
ctgtgacgtcggccgaccag

SEQ ID NO: 1619956 - DNA, 15 bp, Homo sapiens
ctgtgactaggcata

SEQ ID NO: 1619957 - DNA, 21 bp, Homo sapiens
ctgtgactcctgttgccatgg

SEQ ID NO: 1619958 - DNA, 22 bp, Homo sapiens
ctgtgactcctgttgccatgga

SEQ ID NO: 1619959 - DNA, 23 bp, Homo sapiens
ctgtgactgaagaagatgagcct

SEQ ID NO: 1619960 - DNA, 16 bp, Homo sapiens
ctgtgactggatcttc

SEQ ID NO: 1619961 - DNA, 23 bp, Homo sapiens
ctgtgactggatcttctatcatt

SEQ ID NO: 1619962 - DNA, 18 bp, Homo sapiens
ctgtgacttatctaccat

SEQ ID NO: 1619963 - DNA, 20 bp, Homo sapiens
ctgtgagaaggtttattgtt

SEQ ID NO: 1619964 - DNA, 16 bp, Homo sapiens
ctgtgagacccccaca

SEQ ID NO: 1619965 - DNA, 17 bp, Homo sapiens
ctgtgagacgaggcagg

SEQ ID NO: 1619966 - DNA, 22 bp, Homo sapiens
ctgtgagacgaggcaggggctc

SEQ ID NO: 1619967 - DNA, 18 bp, Homo sapiens
ctgtgagactcgagaact

SEQ ID NO: 1619968 - DNA, 13 bp, Homo sapiens
ctgtgagattttg

SEQ ID NO: 1619969 - DNA, 21 bp, Homo sapiens
ctgtgagattttgcttttcca

SEQ ID NO: 1619970 - DNA, 15 bp, Homo sapiens
ctgtgagcaagaagt

SEQ ID NO: 1619971 - DNA, 16 bp, Homo sapiens
ctgtgagcagcctcca

SEQ ID NO: 1619972 - DNA, 13 bp, Homo sapiens
ctgtgagcatcct

SEQ ID NO: 1619973 - DNA, 16 bp, Homo sapiens
ctgtgaggcggcagct

SEQ ID NO: 1619974 - DNA, 17 bp, Homo sapiens
ctgtgaggcggcagctg

SEQ ID NO: 1619975 - DNA, 22 bp, Homo sapiens
ctgtgagggaggggaaaagcat

SEQ ID NO: 1619976 - DNA, 22 bp, Homo sapiens
ctgtgagggcgagcggcaaagg

SEQ ID NO: 1619977 - DNA, 23 bp, Homo sapiens
ctgtgaggtgcagagtgcccaga

SEQ ID NO: 1619978 - DNA, 15 bp, Homo sapiens
ctgtgaggtgctgat

SEQ ID NO: 1619979 - DNA, 16 bp, Homo sapiens
ctgtgaggtgctgatg

SEQ ID NO: 1619980 - DNA, 23 bp, Homo sapiens
ctgtgagtctttggttctaagga

SEQ ID NO: 1619981 - DNA, 14 bp, Homo sapiens
ctgtgagtgtaagt

SEQ ID NO: 1619982 - DNA, 21 bp, Homo sapiens
ctgtgagtgtaagtgtgagta

SEQ ID NO: 1619983 - DNA, 16 bp, Homo sapiens
ctgtgatatgtctgct

SEQ ID NO: 1619984 - DNA, 19 bp, Homo sapiens
ctgtgatccacccaaccct

SEQ ID NO: 1619985 - DNA, 22 bp, Homo sapiens
ctgtgatccttggtgctgtgtg

SEQ ID NO: 1619986 - DNA, 23 bp, Homo sapiens
ctgtgatccttggtgctgtgtgc

SEQ ID NO: 1619987 - DNA, 16 bp, Homo sapiens
ctgtgatgagctgatc

SEQ ID NO: 1619988 - DNA, 18 bp, Homo sapiens
ctgtgatgcatgagctcc

SEQ ID NO: 1619989 - DNA, 14 bp, Homo sapiens
ctgtgatgctgggc

SEQ ID NO: 1619990 - DNA, 13 bp, Homo sapiens
ctgtgatggccag

SEQ ID NO: 1619991 - DNA, 19 bp, Homo sapiens
ctgtgattgggtgggattt

SEQ ID NO: 1619992 - DNA, 17 bp, Homo sapiens
ctgtgatttatttggag

SEQ ID NO: 1619993 - DNA, 21 bp, Homo sapiens
ctgtgatttatttggagtgga

SEQ ID NO: 1619994 - DNA, 11 bp, Homo sapiens
ctgtgatttct

SEQ ID NO: 1619995 - DNA, 23 bp, Homo sapiens
ctgtgatttctggctgggtcacc

SEQ ID NO: 1619996 - DNA, 18 bp, Homo sapiens
ctgtgcaacgccgtgggc

SEQ ID NO: 1619997 - DNA, 16 bp, Homo sapiens
ctgtgcaaggcctggt

SEQ ID NO: 1619998 - DNA, 14 bp, Homo sapiens
ctgtgcacagtggc

SEQ ID NO: 1619999 - DNA, 23 bp, Homo sapiens
ctgtgcacctaccccttggaaat

SEQ ID NO: 1620000 - DNA, 17 bp, Homo sapiens
ctgtgcactagcctgtg

SEQ ID NO: 1620001 - DNA, 20 bp, Homo sapiens
ctgtgcagagatgactgtcc

SEQ ID NO: 1620002 - DNA, 23 bp, Homo sapiens
ctgtgcagatgagcagtcacact

SEQ ID NO: 1620003 - DNA, 13 bp, Homo sapiens
ctgtgcagcagcc

SEQ ID NO: 1620004 - DNA, 15 bp, Homo sapiens
ctgtgcagcagccca

SEQ ID NO: 1620005 - DNA, 15 bp, Homo sapiens
ctgtgcagggaggag

SEQ ID NO: 1620006 - DNA, 22 bp, Homo sapiens
ctgtgcagggaggaggtggcag

SEQ ID NO: 1620007 - DNA, 15 bp, Homo sapiens
ctgtgcaggtgctgc

SEQ ID NO: 1620008 - DNA, 17 bp, Homo sapiens
ctgtgcaggtgctgcct

SEQ ID NO: 1620009 - DNA, 23 bp, Homo sapiens
ctgtgcagtggcccccacagaaa

SEQ ID NO: 1620010 - DNA, 19 bp, Homo sapiens
ctgtgcatcaaccaggaag

SEQ ID NO: 1620011 - DNA, 22 bp, Homo sapiens
ctgtgcatcaaccaggaagagt

SEQ ID NO: 1620012 - DNA, 18 bp, Homo sapiens
ctgtgccacccaccaggg

SEQ ID NO: 1620013 - DNA, 23 bp, Homo sapiens
ctgtgccactgacttgctgtgtg

SEQ ID NO: 1620014 - DNA, 15 bp, Homo sapiens
ctgtgccatgctggg

SEQ ID NO: 1620015 - DNA, 18 bp, Homo sapiens
ctgtgcccacatcccagg

SEQ ID NO: 1620016 - DNA, 19 bp, Homo sapiens
ctgtgcccacatcccaggc

SEQ ID NO: 1620017 - DNA, 23 bp, Homo sapiens
ctgtgcccacatcccaggcttca

SEQ ID NO: 1620018 - DNA, 18 bp, Homo sapiens
ctgtgcccagcaggccca

SEQ ID NO: 1620019 - DNA, 15 bp, Homo sapiens
ctgtgcccctgatgc

SEQ ID NO: 1620020 - DNA, 23 bp, Homo sapiens
ctgtgcccctgatgcagcctgtg

SEQ ID NO: 1620021 - DNA, 18 bp, Homo sapiens
ctgtgccctcaccaccac

SEQ ID NO: 1620022 - DNA, 16 bp, Homo sapiens
ctgtgccctggtggag

SEQ ID NO: 1620023 - DNA, 13 bp, Homo sapiens
ctgtgcctccccc

SEQ ID NO: 1620024 - DNA, 18 bp, Homo sapiens
ctgtgcctccccccagac

SEQ ID NO: 1620025 - DNA, 23 bp, Homo sapiens
ctgtgcctccctccccagtgcaa

SEQ ID NO: 1620026 - DNA, 13 bp, Homo sapiens
ctgtgcctcctca

SEQ ID NO: 1620027 - DNA, 15 bp, Homo sapiens
ctgtgcctgaatatt

SEQ ID NO: 1620028 - DNA, 15 bp, Homo sapiens
ctgtgcctgcactga

SEQ ID NO: 1620029 - DNA, 11 bp, Homo sapiens
ctgtgcctgct

SEQ ID NO: 1620030 - DNA, 13 bp, Homo sapiens
ctgtgcctgctag

SEQ ID NO: 1620031 - DNA, 14 bp, Homo sapiens
ctgtgcctgctaga

SEQ ID NO: 1620032 - DNA, 14 bp, Homo sapiens
ctgtgcctgctcag

SEQ ID NO: 1620033 - DNA, 17 bp, Homo sapiens
ctgtgcctgctcagcag

SEQ ID NO: 1620034 - DNA, 18 bp, Homo sapiens
ctgtgcctgctcagcagc

SEQ ID NO: 1620035 - DNA, 12 bp, Homo sapiens
ctgtgcctgggc

SEQ ID NO: 1620036 - DNA, 22 bp, Homo sapiens
ctgtgctccgtgcctccaccac

SEQ ID NO: 1620037 - DNA, 17 bp, Homo sapiens
ctgtgctcctgcccagg

SEQ ID NO: 1620038 - DNA, 16 bp, Homo sapiens
ctgtgctctggaggct

SEQ ID NO: 1620039 - DNA, 21 bp, Homo sapiens
ctgtgctctggcaccatcagc

SEQ ID NO: 1620040 - DNA, 18 bp, Homo sapiens
ctgtgctctggggatttc

SEQ ID NO: 1620041 - DNA, 21 bp, Homo sapiens
ctgtgctcttttggtggggag

SEQ ID NO: 1620042 - DNA, 16 bp, Homo sapiens
ctgtgctgaggcctta

SEQ ID NO: 1620043 - DNA, 21 bp, Homo sapiens
ctgtgctgaggccttatcatt

SEQ ID NO: 1620044 - DNA, 16 bp, Homo sapiens
ctgtgctgatcctgct

SEQ ID NO: 1620045 - DNA, 20 bp, Homo sapiens
ctgtgctgcccgtcttcagc

SEQ ID NO: 1620046 - DNA, 18 bp, Homo sapiens
ctgtgctggaattccaca

SEQ ID NO: 1620047 - DNA, 20 bp, Homo sapiens
ctgtgctggaattccacagg

SEQ ID NO: 1620048 - DNA, 13 bp, Homo sapiens
ctgtgctgggcca

SEQ ID NO: 1620049 - DNA, 14 bp, Homo sapiens
ctgtgctgggccag

SEQ ID NO: 1620050 - DNA, 12 bp, Homo sapiens
ctgtgctggtgt

SEQ ID NO: 1620051 - DNA, 18 bp, Homo sapiens
ctgtgctggtgtcctgac

SEQ ID NO: 1620052 - DNA, 21 bp, Homo sapiens
ctgtgctggtgtcctgaccac

SEQ ID NO: 1620053 - DNA, 14 bp, Homo sapiens
ctgtgctgtgcctg

SEQ ID NO: 1620054 - DNA, 17 bp, Homo sapiens
ctgtgctgtgcctgcta

SEQ ID NO: 1620055 - DNA, 17 bp, Homo sapiens
ctgtgcttcaattaata

SEQ ID NO: 1620056 - DNA, 21 bp, Homo sapiens
ctgtgcttcgactactgctcc

SEQ ID NO: 1620057 - DNA, 15 bp, Homo sapiens
ctgtgcttgaaggcc

SEQ ID NO: 1620058 - DNA, 17 bp, Homo sapiens
ctgtgcttgaaggccct

SEQ ID NO: 1620059 - DNA, 20 bp, Homo sapiens
ctgtgcttgaaggccctgct

SEQ ID NO: 1620060 - DNA, 22 bp, Homo sapiens
ctgtgcttgaaggccctgctga

SEQ ID NO: 1620061 - DNA, 17 bp, Homo sapiens
ctgtgcttttaaatgca

SEQ ID NO: 1620062 - DNA, 15 bp, Homo sapiens
ctgtggaaatgccaa

SEQ ID NO: 1620063 - DNA, 17 bp, Homo sapiens
ctgtggaagcaaggctg

SEQ ID NO: 1620064 - DNA, 23 bp, Homo sapiens
ctgtggacaggatgaggacagag

SEQ ID NO: 1620065 - DNA, 13 bp, Homo sapiens
ctgtggactgtcc

SEQ ID NO: 1620066 - DNA, 18 bp, Homo sapiens
ctgtggactgtcctgagg

SEQ ID NO: 1620067 - DNA, 19 bp, Homo sapiens
ctgtggactgtcctgagga

SEQ ID NO: 1620068 - DNA, 18 bp, Homo sapiens
ctgtggagactttctgtt

SEQ ID NO: 1620069 - DNA, 11 bp, Homo sapiens
ctgtggagctg

SEQ ID NO: 1620070 - DNA, 23 bp, Homo sapiens
ctgtggagctgccacagagaagt

SEQ ID NO: 1620071 - DNA, 15 bp, Homo sapiens
ctgtggaggcctgat

SEQ ID NO: 1620072 - DNA, 17 bp, Homo sapiens
ctgtggagtccagctct

SEQ ID NO: 1620073 - DNA, 17 bp, Homo sapiens
ctgtggagttcctgctc

SEQ ID NO: 1620074 - DNA, 21 bp, Homo sapiens
ctgtggagttcctgctccgtg

SEQ ID NO: 1620075 - DNA, 12 bp, Homo sapiens
ctgtggattcta

SEQ ID NO: 1620076 - DNA, 13 bp, Homo sapiens
ctgtggattctat

SEQ ID NO: 1620077 - DNA, 15 bp, Homo sapiens
ctgtggattctatat

SEQ ID NO: 1620078 - DNA, 22 bp, Homo sapiens
ctgtggcacagacttctggaag

SEQ ID NO: 1620079 - DNA, 13 bp, Homo sapiens
ctgtggcacagcc

SEQ ID NO: 1620080 - DNA, 15 bp, Homo sapiens
ctgtggcacagccct

SEQ ID NO: 1620081 - DNA, 20 bp, Homo sapiens
ctgtggcacagccctgagtg

SEQ ID NO: 1620082 - DNA, 17 bp, Homo sapiens
ctgtggcagagttacag

SEQ ID NO: 1620083 - DNA, 22 bp, Homo sapiens
ctgtggcagagttacagttctg

SEQ ID NO: 1620084 - DNA, 23 bp, Homo sapiens
ctgtggcagccgtcccaggccac

SEQ ID NO: 1620085 - DNA, 13 bp, Homo sapiens
ctgtggcagctgc

SEQ ID NO: 1620086 - DNA, 17 bp, Homo sapiens
ctgtggcagctgcccct

SEQ ID NO: 1620087 - DNA, 21 bp, Homo sapiens
ctgtggcagctgcccctggca

SEQ ID NO: 1620088 - DNA, 17 bp, Homo sapiens
ctgtggcataaattgca

SEQ ID NO: 1620089 - DNA, 15 bp, Homo sapiens
ctgtggccacagccc

SEQ ID NO: 1620090 - DNA, 16 bp, Homo sapiens
ctgtggccacagcccc

SEQ ID NO: 1620091 - DNA, 18 bp, Homo sapiens
ctgtggccacagccccct

SEQ ID NO: 1620092 - DNA, 13 bp, Homo sapiens
ctgtggccagagc

SEQ ID NO: 1620093 - DNA, 20 bp, Homo sapiens
ctgtggccagagctggaagg

SEQ ID NO: 1620094 - DNA, 23 bp, Homo sapiens
ctgtggccagagctggaaggcag

SEQ ID NO: 1620095 - DNA, 20 bp, Homo sapiens
ctgtggccccaccctgggcc

SEQ ID NO: 1620096 - DNA, 19 bp, Homo sapiens
ctgtggccgtctcctccct

SEQ ID NO: 1620097 - DNA, 17 bp, Homo sapiens
ctgtggcctgtgtccag

SEQ ID NO: 1620098 - DNA, 19 bp, Homo sapiens
ctgtggcctgtgtccagca

SEQ ID NO: 1620099 - DNA, 20 bp, Homo sapiens
ctgtggcctgtgtccagcag

SEQ ID NO: 1620100 - DNA, 22 bp, Homo sapiens
ctgtggcctgtgtccagcagct

SEQ ID NO: 1620101 - DNA, 24 bp, Homo sapiens
ctgtggcctgtgtccagcagctgc

SEQ ID NO: 1620102 - DNA, 17 bp, Homo sapiens
ctgtggccttgcccgcc

SEQ ID NO: 1620103 - DNA, 18 bp, Homo sapiens
ctgtggcgactctgcaga

SEQ ID NO: 1620104 - DNA, 17 bp, Homo sapiens
ctgtggcgccgtctcca

SEQ ID NO: 1620105 - DNA, 19 bp, Homo sapiens
ctgtggcgccgtctccagg

SEQ ID NO: 1620106 - DNA, 20 bp, Homo sapiens
ctgtggcgccgtctccaggg

SEQ ID NO: 1620107 - DNA, 24 bp, Homo sapiens
ctgtggcgccgtctccaggggctg

SEQ ID NO: 1620108 - DNA, 18 bp, Homo sapiens
ctgtggctccctcctcct

SEQ ID NO: 1620109 - DNA, 19 bp, Homo sapiens
ctgtggctggaggagctgg

SEQ ID NO: 1620110 - DNA, 19 bp, Homo sapiens
ctgtggctttttgttcaga

SEQ ID NO: 1620111 - DNA, 17 bp, Homo sapiens
ctgtgggcactggtggg

SEQ ID NO: 1620112 - DNA, 11 bp, Homo sapiens
ctgtgggcctc

SEQ ID NO: 1620113 - DNA, 15 bp, Homo sapiens
ctgtgggcctcaggc

SEQ ID NO: 1620114 - DNA, 15 bp, Homo sapiens
ctgtgggctggcagt

SEQ ID NO: 1620115 - DNA, 19 bp, Homo sapiens
ctgtggggaacacagctac

SEQ ID NO: 1620116 - DNA, 21 bp, Homo sapiens
ctgtggggaacatggctggcc

SEQ ID NO: 1620117 - DNA, 23 bp, Homo sapiens
ctgtggggaacatggctggcctg

SEQ ID NO: 1620118 - DNA, 21 bp, Homo sapiens
ctgtggggaaccaattgcttt

SEQ ID NO: 1620119 - DNA, 14 bp, Homo sapiens
ctgtggggagccga

SEQ ID NO: 1620120 - DNA, 20 bp, Homo sapiens
ctgtggggatctcaggggct

SEQ ID NO: 1620121 - DNA, 12 bp, Homo sapiens
ctgtggggcagg

SEQ ID NO: 1620122 - DNA, 15 bp, Homo sapiens
ctgtggggcaggagt

SEQ ID NO: 1620123 - DNA, 18 bp, Homo sapiens
ctgtggggcaggagtgcc

SEQ ID NO: 1620124 - DNA, 19 bp, Homo sapiens
ctgtggggcaggagtgcca

SEQ ID NO: 1620125 - DNA, 19 bp, Homo sapiens
ctgtggggccttggttccc

SEQ ID NO: 1620126 - DNA, 21 bp, Homo sapiens
ctgtggggggtaatccctgct

SEQ ID NO: 1620127 - DNA, 20 bp, Homo sapiens
ctgtgggggtgtgccccctt

SEQ ID NO: 1620128 - DNA, 16 bp, Homo sapiens
ctgtgggtctgggagt

SEQ ID NO: 1620129 - DNA, 16 bp, Homo sapiens
ctgtggtagctccagc

SEQ ID NO: 1620130 - DNA, 17 bp, Homo sapiens
ctgtggtagctccagcg

SEQ ID NO: 1620131 - DNA, 16 bp, Homo sapiens
ctgtggtaggggcagg

SEQ ID NO: 1620132 - DNA, 20 bp, Homo sapiens
ctgtggtaggggcagggagg

SEQ ID NO: 1620133 - DNA, 22 bp, Homo sapiens
ctgtggtcctgaattctttccc

SEQ ID NO: 1620134 - DNA, 16 bp, Homo sapiens
ctgtggtgatgttgcc

SEQ ID NO: 1620135 - DNA, 18 bp, Homo sapiens
ctgtccctgtagctcagt

SEQ ID NO: 1620136 - DNA, 19 bp, Homo sapiens
ctgtccctgtagctcagtc

SEQ ID NO: 1620137 - DNA, 12 bp, Homo sapiens
ctgtccctgtca

SEQ ID NO: 1620138 - DNA, 19 bp, Homo sapiens
ctgtcccttcccccataag

SEQ ID NO: 1620139 - DNA, 16 bp, Homo sapiens
ctgtcccttgcctcaa

SEQ ID NO: 1620140 - DNA, 15 bp, Homo sapiens
ctgtcccttgcctct

SEQ ID NO: 1620141 - DNA, 18 bp, Homo sapiens
ctgtcccttgctgtatgc

SEQ ID NO: 1620142 - DNA, 13 bp, Homo sapiens
ctgtccctttgct

SEQ ID NO: 1620143 - DNA, 16 bp, Homo sapiens
ctgtcccttttccctt

SEQ ID NO: 1620144 - DNA, 15 bp, Homo sapiens
ctgtcccttttcttt

SEQ ID NO: 1620145 - DNA, 22 bp, Homo sapiens
ctgtcccttttctttgaccaga

SEQ ID NO: 1620146 - DNA, 15 bp, Homo sapiens
ctgtccggcccagtg

SEQ ID NO: 1620147 - DNA, 23 bp, Homo sapiens
ctgtccggcccagtgccactgcc

SEQ ID NO: 1620148 - DNA, 21 bp, Homo sapiens
ctgtccgttcacatgtgtggt

SEQ ID NO: 1620149 - DNA, 18 bp, Homo sapiens
ctgtccgtttactccaag

SEQ ID NO: 1620150 - DNA, 22 bp, Homo sapiens
ctgtcctacttctgactttact

SEQ ID NO: 1620151 - DNA, 20 bp, Homo sapiens
ctgtcctcagccttgccaga

SEQ ID NO: 1620152 - DNA, 21 bp, Homo sapiens
ctgtcctcagccttgccagag

SEQ ID NO: 1620153 - DNA, 22 bp, Homo sapiens
ctgtcctcccctattgcgctct

SEQ ID NO: 1620154 - DNA, 12 bp, Homo sapiens
ctgtcctcctcg

SEQ ID NO: 1620155 - DNA, 16 bp, Homo sapiens
ctgtcctcctttctta

SEQ ID NO: 1620156 - DNA, 24 bp, Homo sapiens
ctgtcctgaggagccctgaggacc

SEQ ID NO: 1620157 - DNA, 21 bp, Homo sapiens
ctgtcctgcagtagaaggtgc

SEQ ID NO: 1620158 - DNA, 12 bp, Homo sapiens
ctgtcctgctca

SEQ ID NO: 1620159 - DNA, 11 bp, Homo sapiens
ctgtcctgctg

SEQ ID NO: 1620160 - DNA, 14 bp, Homo sapiens
ctgtcctgctgccc

SEQ ID NO: 1620161 - DNA, 20 bp, Homo sapiens
ctgtcctgctgccctcccac

SEQ ID NO: 1620162 - DNA, 13 bp, Homo sapiens
ctgtcctgggcct

SEQ ID NO: 1620163 - DNA, 14 bp, Homo sapiens
ctgtcctgggcctg

SEQ ID NO: 1620164 - DNA, 12 bp, Homo sapiens
ctgtcctgggcg

SEQ ID NO: 1620165 - DNA, 18 bp, Homo sapiens
ctgtcctgggcgccctgg

SEQ ID NO: 1620166 - DNA, 21 bp, Homo sapiens
ctgtcctgggcgccctggaag

SEQ ID NO: 1620167 - DNA, 22 bp, Homo sapiens
ctgtcctgggcgccctggaagc

SEQ ID NO: 1620168 - DNA, 12 bp, Homo sapiens
ctggattttctt

SEQ ID NO: 1620169 - DNA, 17 bp, Homo sapiens
ctggattttctttctat

SEQ ID NO: 1620170 - DNA, 20 bp, Homo sapiens
ctggattttctttctatgta

SEQ ID NO: 1620171 - DNA, 17 bp, Homo sapiens
ctggcaaaccctcccag

SEQ ID NO: 1620172 - DNA, 20 bp, Homo sapiens
ctggcaaaccctcccagaaa

SEQ ID NO: 1620173 - DNA, 22 bp, Homo sapiens
ctggcaaagggagcagaactga

SEQ ID NO: 1620174 - DNA, 16 bp, Homo sapiens
ctggcaacacagaggc

SEQ ID NO: 1620175 - DNA, 14 bp, Homo sapiens
ctggcaacatcttt

SEQ ID NO: 1620176 - DNA, 16 bp, Homo sapiens
ctggcaaccagccagc

SEQ ID NO: 1620177 - DNA, 22 bp, Homo sapiens
ctggcaagcagggaaagctcca

SEQ ID NO: 1620178 - DNA, 21 bp, Homo sapiens
ctggcaatgaaaaattctcag

SEQ ID NO: 1620179 - DNA, 19 bp, Homo sapiens
ctggcaattgtctatttat

SEQ ID NO: 1620180 - DNA, 21 bp, Homo sapiens
ctggcacacatcaggagttca

SEQ ID NO: 1620181 - DNA, 13 bp, Homo sapiens
ctggcacagaggt

SEQ ID NO: 1620182 - DNA, 18 bp, Homo sapiens
ctggcacaggactgattc

SEQ ID NO: 1620183 - DNA, 18 bp, Homo sapiens
ctggcaccatcagcctgt

SEQ ID NO: 1620184 - DNA, 19 bp, Homo sapiens
ctggcacccaccgtggagg

SEQ ID NO: 1620185 - DNA, 19 bp, Homo sapiens
ctggcacttagcccaagag

SEQ ID NO: 1620186 - DNA, 18 bp, Homo sapiens
ctggcacttttttaaata

SEQ ID NO: 1620187 - DNA, 19 bp, Homo sapiens
ctggcacttttttaaatat

SEQ ID NO: 1620188 - DNA, 12 bp, Homo sapiens
ctggcagacaca

SEQ ID NO: 1620189 - DNA, 16 bp, Homo sapiens
ctggcagcagcaggtg

SEQ ID NO: 1620190 - DNA, 13 bp, Homo sapiens
ctggcagcccaga

SEQ ID NO: 1620191 - DNA, 22 bp, Homo sapiens
ctggcagcccagagactttgta

SEQ ID NO: 1620192 - DNA, 21 bp, Homo sapiens
ctggcagccgtgccttcagct

SEQ ID NO: 1620193 - DNA, 22 bp, Homo sapiens
ctggcagccgtgccttcagctc

SEQ ID NO: 1620194 - DNA, 14 bp, Homo sapiens
ctggcagcctgctg

SEQ ID NO: 1620195 - DNA, 16 bp, Homo sapiens
ctggcagctcctctcc

SEQ ID NO: 1620196 - DNA, 18 bp, Homo sapiens
ctggcagctcctctcctt

SEQ ID NO: 1620197 - DNA, 22 bp, Homo sapiens
ctggcagctcctctccttgggc

SEQ ID NO: 1620198 - DNA, 20 bp, Homo sapiens
ctggcagctctggacagccc

SEQ ID NO: 1620199 - DNA, 21 bp, Homo sapiens
ctggcagctctggacagcccc

SEQ ID NO: 1620200 - DNA, 18 bp, Homo sapiens
ctggcagctgagagccct

SEQ ID NO: 1620201 - DNA, 23 bp, Homo sapiens
ctggcaggacacatcccggcctc

SEQ ID NO: 1620202 - DNA, 18 bp, Homo sapiens
ctggcaggatgaccctgc

SEQ ID NO: 1620203 - DNA, 17 bp, Homo sapiens
ctggcaggattcttccc

SEQ ID NO: 1620204 - DNA, 18 bp, Homo sapiens
ctggcaggattcttcccg

SEQ ID NO: 1620205 - DNA, 23 bp, Homo sapiens
ctggcaggattcttcccgctccc

SEQ ID NO: 1620206 - DNA, 18 bp, Homo sapiens
ctggcaggcagttctaga

SEQ ID NO: 1620207 - DNA, 20 bp, Homo sapiens
ctggcaggcagttctagaag

SEQ ID NO: 1620208 - DNA, 14 bp, Homo sapiens
ctggcaggtgcaga

SEQ ID NO: 1620209 - DNA, 16 bp, Homo sapiens
ctggcaggtgcagatg

SEQ ID NO: 1620210 - DNA, 11 bp, Homo sapiens
ctggcaggtgg

SEQ ID NO: 1620211 - DNA, 15 bp, Homo sapiens
ctggcaggtggccag

SEQ ID NO: 1620212 - DNA, 22 bp, Homo sapiens
ctggcaggtgttgggacctgct

SEQ ID NO: 1620213 - DNA, 21 bp, Homo sapiens
ctggcagtaacctagtgaatt

SEQ ID NO: 1620214 - DNA, 22 bp, Homo sapiens
ctggcagtcctggaagccagct

SEQ ID NO: 1620215 - DNA, 17 bp, Homo sapiens
ctggcagtgcaatgctt

SEQ ID NO: 1620216 - DNA, 19 bp, Homo sapiens
ctggcagtgcaatgcttgt

SEQ ID NO: 1620217 - DNA, 19 bp, Homo sapiens
ctggcagtgctgagggacc

SEQ ID NO: 1620218 - DNA, 15 bp, Homo sapiens
ctggcagttttccat

SEQ ID NO: 1620219 - DNA, 20 bp, Homo sapiens
ctggcataactaaaattaag

SEQ ID NO: 1620220 - DNA, 15 bp, Homo sapiens
ctggcatagccctcc

SEQ ID NO: 1620221 - DNA, 19 bp, Homo sapiens
ctggcatcgcaccattctg

SEQ ID NO: 1620222 - DNA, 23 bp, Homo sapiens
ctggcatcgcaccattctgactc

SEQ ID NO: 1620223 - DNA, 18 bp, Homo sapiens
ctggcatctgacacaaaa

SEQ ID NO: 1620224 - DNA, 19 bp, Homo sapiens
ctggcatctgacacaaaaa

SEQ ID NO: 1620225 - DNA, 15 bp, Homo sapiens
ctggcatctgctcta

SEQ ID NO: 1620226 - DNA, 20 bp, Homo sapiens
ctggcatgttcaaagccaca

SEQ ID NO: 1620227 - DNA, 15 bp, Homo sapiens
ctggcattacagctg

SEQ ID NO: 1620228 - DNA, 15 bp, Homo sapiens
ctggcattggccaga

SEQ ID NO: 1620229 - DNA, 21 bp, Homo sapiens
ctggccaaagagcctttccaa

SEQ ID NO: 1620230 - DNA, 16 bp, Homo sapiens
ctggccaaatagcaaa

SEQ ID NO: 1620231 - DNA, 18 bp, Homo sapiens
ctggccaaatagcaaaga

SEQ ID NO: 1620232 - DNA, 14 bp, Homo sapiens
ctggccaaggggtg

SEQ ID NO: 1620233 - DNA, 19 bp, Homo sapiens
ctggccaaggtgtccaggg

SEQ ID NO: 1620234 - DNA, 19 bp, Homo sapiens
ctggccaatgcggcccact

SEQ ID NO: 1620235 - DNA, 13 bp, Homo sapiens
ctggccacaagga

SEQ ID NO: 1620236 - DNA, 22 bp, Homo sapiens
ctggccacaaggaaaaggagga

SEQ ID NO: 1620237 - DNA, 16 bp, Homo sapiens
ctggccaccaggctgg

SEQ ID NO: 1620238 - DNA, 17 bp, Homo sapiens
ctggccaccaggctggc

SEQ ID NO: 1620239 - DNA, 21 bp, Homo sapiens
ctggccaccaggctggcgcag

SEQ ID NO: 1620240 - DNA, 22 bp, Homo sapiens
ctggccaccaggctggcgcagc

SEQ ID NO: 1620241 - DNA, 23 bp, Homo sapiens
ctggccaccaggctggcgcagcc

SEQ ID NO: 1620242 - DNA, 17 bp, Homo sapiens
ctggccaccctggcccg

SEQ ID NO: 1620243 - DNA, 23 bp, Homo sapiens
ctggccacctagaagtctccctg

SEQ ID NO: 1620244 - DNA, 11 bp, Homo sapiens
ctggccacctg

SEQ ID NO: 1620245 - DNA, 16 bp, Homo sapiens
ctggccacctgaggtg

SEQ ID NO: 1620246 - DNA, 17 bp, Homo sapiens
ctggccacctgaggtgg

SEQ ID NO: 1620247 - DNA, 20 bp, Homo sapiens
ctggccacctgaggtgggcc

SEQ ID NO: 1620248 - DNA, 21 bp, Homo sapiens
ctggccacctgaggtgggccc

SEQ ID NO: 1620249 - DNA, 15 bp, Homo sapiens
ctggccacgcagcca

SEQ ID NO: 1620250 - DNA, 13 bp, Homo sapiens
ctggccagacaca

SEQ ID NO: 1620251 - DNA, 15 bp, Homo sapiens
ctggccagagagggc

SEQ ID NO: 1620252 - DNA, 17 bp, Homo sapiens
ctggccagagagggccc

SEQ ID NO: 1620253 - DNA, 20 bp, Homo sapiens
ctggccagagagggcccagc

SEQ ID NO: 1620254 - DNA, 22 bp, Homo sapiens
ctggccagagagggcccagctg

SEQ ID NO: 1620255 - DNA, 16 bp, Homo sapiens
ctggccagctctgagg

SEQ ID NO: 1620256 - DNA, 22 bp, Homo sapiens
ctggccagctctgaggggaggc

SEQ ID NO: 1620257 - DNA, 23 bp, Homo sapiens
ctggccagctctgaggggaggca

SEQ ID NO: 1620258 - DNA, 13 bp, Homo sapiens
ctggccaggagca

SEQ ID NO: 1620259 - DNA, 12 bp, Homo sapiens
ctggccaggatg

SEQ ID NO: 1620260 - DNA, 13 bp, Homo sapiens
ctggccaggcaga

SEQ ID NO: 1620261 - DNA, 14 bp, Homo sapiens
ctggccaggcagat

SEQ ID NO: 1620262 - DNA, 15 bp, Homo sapiens
ctggccaggcatggc

SEQ ID NO: 1620263 - DNA, 12 bp, Homo sapiens
ctggccaggccc

SEQ ID NO: 1620264 - DNA, 13 bp, Homo sapiens
ctggccaggccct

SEQ ID NO: 1620265 - DNA, 15 bp, Homo sapiens
ctggccaggccctgg

SEQ ID NO: 1620266 - DNA, 17 bp, Homo sapiens
ctggccaggccctgggt

SEQ ID NO: 1620267 - DNA, 16 bp, Homo sapiens
ctggccagtccaggct

SEQ ID NO: 1620268 - DNA, 21 bp, Homo sapiens
ctggccagtccaggctgccgt

SEQ ID NO: 1620269 - DNA, 17 bp, Homo sapiens
ctggccagtcttcctct

SEQ ID NO: 1620270 - DNA, 21 bp, Homo sapiens
ctggccagtggctggatctgt

SEQ ID NO: 1620271 - DNA, 21 bp, Homo sapiens
ctggccatttccaagaggctg

SEQ ID NO: 1620272 - DNA, 18 bp, Homo sapiens
ctggccatttttctgggg

SEQ ID NO: 1620273 - DNA, 19 bp, Homo sapiens
ctggcccagaaagcctctc

SEQ ID NO: 1620274 - DNA, 23 bp, Homo sapiens
ctggcccagaaagcctctctctc

SEQ ID NO: 1620275 - DNA, 23 bp, Homo sapiens
ctggcccagccaaaccctgtctg

SEQ ID NO: 1620276 - DNA, 14 bp, Homo sapiens
ctggcccagccggc

SEQ ID NO: 1620277 - DNA, 18 bp, Homo sapiens
ctggcccagccggcctct

SEQ ID NO: 1620278 - DNA, 21 bp, Homo sapiens
ctggcccagccggcctctctg

SEQ ID NO: 1620279 - DNA, 14 bp, Homo sapiens
ctggcccagcggcc

SEQ ID NO: 1620280 - DNA, 19 bp, Homo sapiens
ctggcccagcggcccctcc

SEQ ID NO: 1620281 - DNA, 11 bp, Homo sapiens
ctggcccaggg

SEQ ID NO: 1620282 - DNA, 19 bp, Homo sapiens
ctggcccagggcccagagc

SEQ ID NO: 1620283 - DNA, 20 bp, Homo sapiens
ctggcccagggggcctggag

SEQ ID NO: 1620284 - DNA, 16 bp, Homo sapiens
ctggtctactctagaa

SEQ ID NO: 1620285 - DNA, 21 bp, Homo sapiens
ctggtctcaaactcctgggct

SEQ ID NO: 1620286 - DNA, 15 bp, Homo sapiens
ctggtctcacccaac

SEQ ID NO: 1620287 - DNA, 13 bp, Homo sapiens
ctggtctccttga

SEQ ID NO: 1620288 - DNA, 20 bp, Homo sapiens
ctggtctgatgacttgctta

SEQ ID NO: 1620289 - DNA, 21 bp, Homo sapiens
ctggtctggttgggcagccag

SEQ ID NO: 1620290 - DNA, 17 bp, Homo sapiens
ctggtctgtctggatcc

SEQ ID NO: 1620291 - DNA, 20 bp, Homo sapiens
ctggtcttgttagaaaacaa

SEQ ID NO: 1620292 - DNA, 21 bp, Homo sapiens
ctggtgaacactgtgaccagg

SEQ ID NO: 1620293 - DNA, 14 bp, Homo sapiens
ctggtgaatatttt

SEQ ID NO: 1620294 - DNA, 15 bp, Homo sapiens
ctggtgacaccagcc

SEQ ID NO: 1620295 - DNA, 14 bp, Homo sapiens
ctggtgagaactga

SEQ ID NO: 1620296 - DNA, 23 bp, Homo sapiens
ctggtgagtcttggcggcagcag

SEQ ID NO: 1620297 - DNA, 17 bp, Homo sapiens
ctggtgcaaattcagaa

SEQ ID NO: 1620298 - DNA, 23 bp, Homo sapiens
ctggtgcaagttgaggacttctt

SEQ ID NO: 1620299 - DNA, 12 bp, Homo sapiens
ctggtgcagtgg

SEQ ID NO: 1620300 - DNA, 14 bp, Homo sapiens
ctggtgcattgctg

SEQ ID NO: 1620301 - DNA, 16 bp, Homo sapiens
ctggtgcattgctgtg

SEQ ID NO: 1620302 - DNA, 19 bp, Homo sapiens
ctggtgcattgctgtgtga

SEQ ID NO: 1620303 - DNA, 15 bp, Homo sapiens
ctggtgccaatttca

SEQ ID NO: 1620304 - DNA, 21 bp, Homo sapiens
ctggtgccagccttcctctgc

SEQ ID NO: 1620305 - DNA, 12 bp, Homo sapiens
ctggtgccccac

SEQ ID NO: 1620306 - DNA, 13 bp, Homo sapiens
ctggtgccccacc

SEQ ID NO: 1620307 - DNA, 14 bp, Homo sapiens
ctggtgccccacct

SEQ ID NO: 1620308 - DNA, 16 bp, Homo sapiens
ctggtgccccacctgc

SEQ ID NO: 1620309 - DNA, 24 bp, Homo sapiens
ctggtgccccacctgcctggtgca

SEQ ID NO: 1620310 - DNA, 14 bp, Homo sapiens
ctggtgcccggaga

SEQ ID NO: 1620311 - DNA, 12 bp, Homo sapiens
ctggtgcctctg

SEQ ID NO: 1620312 - DNA, 15 bp, Homo sapiens
ctggtgcctctgtgc

SEQ ID NO: 1620313 - DNA, 19 bp, Homo sapiens
ctggtgcgggcctggccct

SEQ ID NO: 1620314 - DNA, 21 bp, Homo sapiens
ctggtgcgggcctggccctca

SEQ ID NO: 1620315 - DNA, 18 bp, Homo sapiens
ctggtgctctctgccact

SEQ ID NO: 1620316 - DNA, 22 bp, Homo sapiens
ctggtgctgaggatacagctct

SEQ ID NO: 1620317 - DNA, 20 bp, Homo sapiens
ctggtgctgccacacttcag

SEQ ID NO: 1620318 - DNA, 12 bp, Homo sapiens
ctggtggacagt

SEQ ID NO: 1620319 - DNA, 19 bp, Homo sapiens
ctggtggacagtcctggga

SEQ ID NO: 1620320 - DNA, 16 bp, Homo sapiens
ctggtggaccacaggc

SEQ ID NO: 1620321 - DNA, 18 bp, Homo sapiens
ctggtggagaaagcactg

SEQ ID NO: 1620322 - DNA, 20 bp, Homo sapiens
ctggtggcatcgtagaagag

SEQ ID NO: 1620323 - DNA, 20 bp, Homo sapiens
ctggtggccccgtttctggt

SEQ ID NO: 1620324 - DNA, 21 bp, Homo sapiens
ctggtggcccgacagcctggc

SEQ ID NO: 1620325 - DNA, 22 bp, Homo sapiens
ctggtggcccgacagcctggca

SEQ ID NO: 1620326 - DNA, 17 bp, Homo sapiens
ctggtggccctgtgcct

SEQ ID NO: 1620327 - DNA, 20 bp, Homo sapiens
ctggtggccctgtgcctggg

SEQ ID NO: 1620328 - DNA, 18 bp, Homo sapiens
ctggtggctgggcccagc

SEQ ID NO: 1620329 - DNA, 17 bp, Homo sapiens
ctggtggcttaagtgag

SEQ ID NO: 1620330 - DNA, 15 bp, Homo sapiens
ctggtgggagcacct

SEQ ID NO: 1620331 - DNA, 17 bp, Homo sapiens
ctggtgggcctcctctg

SEQ ID NO: 1620332 - DNA, 22 bp, Homo sapiens
ctggtggggctgagcctgaggc

SEQ ID NO: 1620333 - DNA, 18 bp, Homo sapiens
ctggtgggtcagcccagc

SEQ ID NO: 1620334 - DNA, 16 bp, Homo sapiens
ctggtgggtggcccag

SEQ ID NO: 1620335 - DNA, 17 bp, Homo sapiens
ctggtgggtggcccaga

SEQ ID NO: 1620336 - DNA, 22 bp, Homo sapiens
ctggtgggtggtgtcctgaagc

SEQ ID NO: 1620337 - DNA, 14 bp, Homo sapiens
ctggtggtacctgt

SEQ ID NO: 1620338 - DNA, 15 bp, Homo sapiens
ctggtggtcttcctt

SEQ ID NO: 1620339 - DNA, 19 bp, Homo sapiens
ctggtggttaaggccaggg

SEQ ID NO: 1620340 - DNA, 17 bp, Homo sapiens
ctggtggtttttgctct

SEQ ID NO: 1620341 - DNA, 20 bp, Homo sapiens
ctggtgtaggaagttttttc

SEQ ID NO: 1620342 - DNA, 21 bp, Homo sapiens
ctggtgtagtctttttatagg

SEQ ID NO: 1620343 - DNA, 19 bp, Homo sapiens
ctggtgtatattttaatgt

SEQ ID NO: 1620344 - DNA, 14 bp, Homo sapiens
ctggtgtcaggcag

SEQ ID NO: 1620345 - DNA, 20 bp, Homo sapiens
ctggtgtcctgaccaccctc

SEQ ID NO: 1620346 - DNA, 18 bp, Homo sapiens
ctggtgtctagtttgcat

SEQ ID NO: 1620347 - DNA, 22 bp, Homo sapiens
ctggtgtgaactcaccctggga

SEQ ID NO: 1620348 - DNA, 14 bp, Homo sapiens
ctggtgtgtggtga

SEQ ID NO: 1620349 - DNA, 13 bp, Homo sapiens
ctggtgtttcttg

SEQ ID NO: 1620350 - DNA, 20 bp, Homo sapiens
ctggttaacagcagtccttt

SEQ ID NO: 1620351 - DNA, 14 bp, Homo sapiens
ctggttaatttata

SEQ ID NO: 1620352 - DNA, 14 bp, Homo sapiens
ctggttagaaatgc

SEQ ID NO: 1620353 - DNA, 23 bp, Homo sapiens
ctggttagaaatgcagaatccta

SEQ ID NO: 1620354 - DNA, 17 bp, Homo sapiens
ctggttatagttgatat

SEQ ID NO: 1620355 - DNA, 14 bp, Homo sapiens
ctggttcacagttt

SEQ ID NO: 1620356 - DNA, 18 bp, Homo sapiens
ctggttcccaccattccc

SEQ ID NO: 1620357 - DNA, 18 bp, Homo sapiens
ctggttcccgtttctcca

SEQ ID NO: 1620358 - DNA, 16 bp, Homo sapiens
ctggttcctcctggta

SEQ ID NO: 1620359 - DNA, 14 bp, Homo sapiens
ctggttcctttcat

SEQ ID NO: 1620360 - DNA, 14 bp, Homo sapiens
ctggttctcatctt

SEQ ID NO: 1620361 - DNA, 24 bp, Homo sapiens
ctggttctgtctagactggcctag

SEQ ID NO: 1620362 - DNA, 19 bp, Homo sapiens
ctggttgagtgtgtggtct

SEQ ID NO: 1620363 - DNA, 17 bp, Homo sapiens
ctggttgggcagccaga

SEQ ID NO: 1620364 - DNA, 13 bp, Homo sapiens
ctggttgtatttc

SEQ ID NO: 1620365 - DNA, 15 bp, Homo sapiens
ctggttgtatttcta

SEQ ID NO: 1620366 - DNA, 21 bp, Homo sapiens
ctggttgttgcaccatctgct

SEQ ID NO: 1620367 - DNA, 16 bp, Homo sapiens
ctggttgttgccaggt

SEQ ID NO: 1620368 - DNA, 20 bp, Homo sapiens
ctggttgtttttgttctttg

SEQ ID NO: 1620369 - DNA, 20 bp, Homo sapiens
ctggtttccccagggaagga

SEQ ID NO: 1620370 - DNA, 14 bp, Homo sapiens
ctggtttctgttct

SEQ ID NO: 1620371 - DNA, 18 bp, Homo sapiens
ctggttttgatggctggg

SEQ ID NO: 1620372 - DNA, 21 bp, Homo sapiens
ctggttttgatggctgggtcc

SEQ ID NO: 1620373 - DNA, 13 bp, Homo sapiens
ctggttttgtaag

SEQ ID NO: 1620374 - DNA, 19 bp, Homo sapiens
ctggttttgtaagatgctg

SEQ ID NO: 1620375 - DNA, 22 bp, Homo sapiens
ctggttttgtaagatgctgggt

SEQ ID NO: 1620376 - DNA, 15 bp, Homo sapiens
ctggtttttgtagcc

SEQ ID NO: 1620377 - DNA, 13 bp, Homo sapiens
ctgtaaaaaatgg

SEQ ID NO: 1620378 - DNA, 18 bp, Homo sapiens
ctgtaaactttatcactt

SEQ ID NO: 1620379 - DNA, 16 bp, Homo sapiens
ctgtaaagacaaataa

SEQ ID NO: 1620380 - DNA, 14 bp, Homo sapiens
ctgtaaagagttgc

SEQ ID NO: 1620381 - DNA, 21 bp, Homo sapiens
ctgtaaagatgtttatttcag

SEQ ID NO: 1620382 - DNA, 22 bp, Homo sapiens
ctgtaaagatgtttatttcagg

SEQ ID NO: 1620383 - DNA, 20 bp, Homo sapiens
ctgtaaataaaatgtgtaca

SEQ ID NO: 1620384 - DNA, 17 bp, Homo sapiens
ctgtaaataagagttgc

SEQ ID NO: 1620385 - DNA, 21 bp, Homo sapiens
ctgtaaataggttcagatttt

SEQ ID NO: 1620386 - DNA, 16 bp, Homo sapiens
ctgtaaatatgtttgt

SEQ ID NO: 1620387 - DNA, 17 bp, Homo sapiens
ctgtaaatatgtttgtg

SEQ ID NO: 1620388 - DNA, 18 bp, Homo sapiens
ctgtaaatatgtttgtgc

SEQ ID NO: 1620389 - DNA, 11 bp, Homo sapiens
ctgtaaatcat

SEQ ID NO: 1620390 - DNA, 18 bp, Homo sapiens
ctgtaaatggtgtacata

SEQ ID NO: 1620391 - DNA, 16 bp, Homo sapiens
ctgtaaattgctggca

SEQ ID NO: 1620392 - DNA, 14 bp, Homo sapiens
ctgtaacaatgtaa

SEQ ID NO: 1620393 - DNA, 15 bp, Homo sapiens
ctgtaacaatgtaat

SEQ ID NO: 1620394 - DNA, 19 bp, Homo sapiens
ctgtaacaatgtaataaaa

SEQ ID NO: 1620395 - DNA, 17 bp, Homo sapiens
ctgtaactactttataa

SEQ ID NO: 1620396 - DNA, 15 bp, Homo sapiens
ctgtaactctaaaag

SEQ ID NO: 1620397 - DNA, 14 bp, Homo sapiens
ctgtaactgagaga

SEQ ID NO: 1620398 - DNA, 14 bp, Homo sapiens
ctgtaactgctgag

SEQ ID NO: 1620399 - DNA, 18 bp, Homo sapiens
ctgtaactgctgagccac

SEQ ID NO: 1620400 - DNA, 19 bp, Homo sapiens
ctgtaactgctgagccact

SEQ ID NO: 1620401 - DNA, 17 bp, Homo sapiens
ctgtaccagttaatttt

SEQ ID NO: 1620402 - DNA, 13 bp, Homo sapiens
ctgtacccagctc

SEQ ID NO: 1620403 - DNA, 16 bp, Homo sapiens
ctgtacccttccacct

SEQ ID NO: 1620404 - DNA, 17 bp, Homo sapiens
ctgtacccttccacctc

SEQ ID NO: 1620405 - DNA, 21 bp, Homo sapiens
ctgtacccttccacctcctag

SEQ ID NO: 1620406 - DNA, 19 bp, Homo sapiens
ctgtacgaaaaagagcata

SEQ ID NO: 1620407 - DNA, 21 bp, Homo sapiens
ctgtactactcctaattattg

SEQ ID NO: 1620408 - DNA, 14 bp, Homo sapiens
ctgtactactgcct

SEQ ID NO: 1620409 - DNA, 15 bp, Homo sapiens
ctgtactactgcctt

SEQ ID NO: 1620410 - DNA, 13 bp, Homo sapiens
ctgtactcaggag

SEQ ID NO: 1620411 - DNA, 19 bp, Homo sapiens
ctgtactcctcccaggcgc

SEQ ID NO: 1620412 - DNA, 22 bp, Homo sapiens
ctgtactgatttttgtaagaca

SEQ ID NO: 1620413 - DNA, 19 bp, Homo sapiens
ctgtactgttactgggccc

SEQ ID NO: 1620414 - DNA, 17 bp, Homo sapiens
ctgtactgttctgtgtc

SEQ ID NO: 1620415 - DNA, 14 bp, Homo sapiens
ctgtacttcactgt

SEQ ID NO: 1620416 - DNA, 22 bp, Homo sapiens
ctgtacttcactgtcaggaaga

SEQ ID NO: 1620417 - DNA, 23 bp, Homo sapiens
ctgtagaagtgagtttgtaaata

SEQ ID NO: 1620418 - DNA, 17 bp, Homo sapiens
ctgtagagttgctgaga

SEQ ID NO: 1620419 - DNA, 23 bp, Homo sapiens
ctgtagagttgctgagagggctc

SEQ ID NO: 1620420 - DNA, 12 bp, Homo sapiens
ctgtagatcagg

SEQ ID NO: 1620421 - DNA, 15 bp, Homo sapiens
ctgtagatcaggttt

SEQ ID NO: 1620422 - DNA, 14 bp, Homo sapiens
ctgtagatgaagag

SEQ ID NO: 1620423 - DNA, 15 bp, Homo sapiens
ctgtagatgaagagg

SEQ ID NO: 1620424 - DNA, 18 bp, Homo sapiens
ctgtagattgcttctgta

SEQ ID NO: 1620425 - DNA, 19 bp, Homo sapiens
ctgtagattgcttctgtag

SEQ ID NO: 1620426 - DNA, 16 bp, Homo sapiens
ctgtagcacttactgg

SEQ ID NO: 1620427 - DNA, 15 bp, Homo sapiens
ctgtagccatggctc

SEQ ID NO: 1620428 - DNA, 21 bp, Homo sapiens
ctgtagccatggctcaggcaa

SEQ ID NO: 1620429 - DNA, 24 bp, Homo sapiens
ctgtagccatggctcaggcaagcc

SEQ ID NO: 1620430 - DNA, 21 bp, Homo sapiens
ctgtagcctatttttttagat

SEQ ID NO: 1620431 - DNA, 22 bp, Homo sapiens
ctgtagctccctcctcccatct

SEQ ID NO: 1620432 - DNA, 15 bp, Homo sapiens
ctgtagctctgcctc

SEQ ID NO: 1620433 - DNA, 20 bp, Homo sapiens
ctgtagctctgcctccctct

SEQ ID NO: 1620434 - DNA, 14 bp, Homo sapiens
ctgtagctgccatg

SEQ ID NO: 1620435 - DNA, 12 bp, Homo sapiens
ctgtagctttaa

SEQ ID NO: 1620436 - DNA, 14 bp, Homo sapiens
ctgtagctttcctg

SEQ ID NO: 1620437 - DNA, 16 bp, Homo sapiens
ctgtagcttttaggaa

SEQ ID NO: 1620438 - DNA, 14 bp, Homo sapiens
ctgtaggaaaccca

SEQ ID NO: 1620439 - DNA, 21 bp, Homo sapiens
ctgtaggaaggttaatgttca

SEQ ID NO: 1620440 - DNA, 23 bp, Homo sapiens
ctgtaggagagtcggtctgcttt

SEQ ID NO: 1620441 - DNA, 17 bp, Homo sapiens
ctgtaggcagaggctgc

SEQ ID NO: 1620442 - DNA, 19 bp, Homo sapiens
ctgtagggaaaccttggag

SEQ ID NO: 1620443 - DNA, 13 bp, Homo sapiens
ctgtagggaactt

SEQ ID NO: 1620444 - DNA, 16 bp, Homo sapiens
ctgtagggctggacct

SEQ ID NO: 1620445 - DNA, 17 bp, Homo sapiens
ctgtagggctggaccta

SEQ ID NO: 1620446 - DNA, 17 bp, Homo sapiens
ctgtaggtttctctctt

SEQ ID NO: 1620447 - DNA, 21 bp, Homo sapiens
ctgtaggtttctctcttccct

SEQ ID NO: 1620448 - DNA, 18 bp, Homo sapiens
ctgtagtaaactatttat

SEQ ID NO: 1620449 - DNA, 15 bp, Homo sapiens
ctgtagtcccagcta

SEQ ID NO: 1620450 - DNA, 23 bp, Homo sapiens
ctgtagtcccagctactcaggag

SEQ ID NO: 1620451 - DNA, 14 bp, Homo sapiens
ctgtagtctcagga

SEQ ID NO: 1620452 - DNA, 15 bp, Homo sapiens
ctgtagtctcaggac

SEQ ID NO: 1620453 - DNA, 20 bp, Homo sapiens
ctgtagtctcaggacctagg

SEQ ID NO: 1620454 - DNA, 17 bp, Homo sapiens
ctgtagtgagaaactga

SEQ ID NO: 1620455 - DNA, 19 bp, Homo sapiens
ctgtagtggccccctcctc

SEQ ID NO: 1620456 - DNA, 14 bp, Homo sapiens
ctgtagttctaaga

SEQ ID NO: 1620457 - DNA, 19 bp, Homo sapiens
ctgtagttctaagactcaa

SEQ ID NO: 1620458 - DNA, 14 bp, Homo sapiens
ctgtagttgcagct

SEQ ID NO: 1620459 - DNA, 20 bp, Homo sapiens
ctgtagtttagttctgttga

SEQ ID NO: 1620460 - DNA, 13 bp, Homo sapiens
ctgtagtttatgg

SEQ ID NO: 1620461 - DNA, 23 bp, Homo sapiens
ctgtagtttatggcagaagggaa

SEQ ID NO: 1620462 - DNA, 17 bp, Homo sapiens
ctgtataagttgaagga

SEQ ID NO: 1620463 - DNA, 19 bp, Homo sapiens
ctgtataagttgaaggaaa

SEQ ID NO: 1620464 - DNA, 13 bp, Homo sapiens
ctgtatacagtgc

SEQ ID NO: 1620465 - DNA, 23 bp, Homo sapiens
ctgtatatgtattcccttgtatt

SEQ ID NO: 1620466 - DNA, 14 bp, Homo sapiens
ctgtatatgttgta

SEQ ID NO: 1620467 - DNA, 15 bp, Homo sapiens
ctgtatatgttgtaa

SEQ ID NO: 1620468 - DNA, 16 bp, Homo sapiens
ctgtatatgttgtaat

SEQ ID NO: 1620469 - DNA, 16 bp, Homo sapiens
ctgtatatttgtaaag

SEQ ID NO: 1620470 - DNA, 17 bp, Homo sapiens
ctgtatcaagtcatggc

SEQ ID NO: 1620471 - DNA, 15 bp, Homo sapiens
ctgtatccgtgaatt

SEQ ID NO: 1620472 - DNA, 19 bp, Homo sapiens
ctgtatccgtgaattgctt

SEQ ID NO: 1620473 - DNA, 22 bp, Homo sapiens
ctgtatccgtgaattgctttat

SEQ ID NO: 1620474 - DNA, 23 bp, Homo sapiens
ctgtatccgtgaattgctttatg

SEQ ID NO: 1620475 - DNA, 18 bp, Homo sapiens
ctgtatcggagacagtga

SEQ ID NO: 1620476 - DNA, 19 bp, Homo sapiens
ctgtatgatttaggcttct

SEQ ID NO: 1620477 - DNA, 19 bp, Homo sapiens
ctgggacccacctccccct

SEQ ID NO: 1620478 - DNA, 23 bp, Homo sapiens
ctgggacccagctactctgtcca

SEQ ID NO: 1620479 - DNA, 23 bp, Homo sapiens
ctgggaccccgcagttgggagga

SEQ ID NO: 1620480 - DNA, 12 bp, Homo sapiens
ctgggacccctc

SEQ ID NO: 1620481 - DNA, 23 bp, Homo sapiens
ctgggacccctcccaacctcaat

SEQ ID NO: 1620482 - DNA, 19 bp, Homo sapiens
ctgggaccctttccttcct

SEQ ID NO: 1620483 - DNA, 23 bp, Homo sapiens
ctgggaccctttccttccttccc

SEQ ID NO: 1620484 - DNA, 23 bp, Homo sapiens
ctgggacctgatttattgaaatt

SEQ ID NO: 1620485 - DNA, 22 bp, Homo sapiens
ctgggacgatcgcccaggctgg

SEQ ID NO: 1620486 - DNA, 21 bp, Homo sapiens
ctgggacgtggacatgcctca

SEQ ID NO: 1620487 - DNA, 13 bp, Homo sapiens
ctgggactcagcc

SEQ ID NO: 1620488 - DNA, 13 bp, Homo sapiens
ctgggactcccag

SEQ ID NO: 1620489 - DNA, 14 bp, Homo sapiens
ctgggactcccagt

SEQ ID NO: 1620490 - DNA, 20 bp, Homo sapiens
ctgggactgagccagtccca

SEQ ID NO: 1620491 - DNA, 12 bp, Homo sapiens
ctgggagaaaat

SEQ ID NO: 1620492 - DNA, 16 bp, Homo sapiens
ctgggagaaaatcatc

SEQ ID NO: 1620493 - DNA, 18 bp, Homo sapiens
ctgggagaaaatcatcaa

SEQ ID NO: 1620494 - DNA, 12 bp, Homo sapiens
ctgggagaacct

SEQ ID NO: 1620495 - DNA, 16 bp, Homo sapiens
ctgggagaacctcagg

SEQ ID NO: 1620496 - DNA, 19 bp, Homo sapiens
ctgggagaccctccccaca

SEQ ID NO: 1620497 - DNA, 19 bp, Homo sapiens
ctgggagccacttctcccc

SEQ ID NO: 1620498 - DNA, 20 bp, Homo sapiens
ctgggagccacttctcccca

SEQ ID NO: 1620499 - DNA, 14 bp, Homo sapiens
ctgggagccagtcc

SEQ ID NO: 1620500 - DNA, 17 bp, Homo sapiens
ctgggagcccagaaccc

SEQ ID NO: 1620501 - DNA, 19 bp, Homo sapiens
ctgggagccgggccgcaga

SEQ ID NO: 1620502 - DNA, 21 bp, Homo sapiens
ctgggagctccactctgcttc

SEQ ID NO: 1620503 - DNA, 20 bp, Homo sapiens
ctgggagctgcgccggacag

SEQ ID NO: 1620504 - DNA, 22 bp, Homo sapiens
ctgggagctgcgccggacagag

SEQ ID NO: 1620505 - DNA, 13 bp, Homo sapiens
ctgggaggaagca

SEQ ID NO: 1620506 - DNA, 14 bp, Homo sapiens
ctgggaggagggag

SEQ ID NO: 1620507 - DNA, 18 bp, Homo sapiens
ctgggaggcaagaggggt

SEQ ID NO: 1620508 - DNA, 21 bp, Homo sapiens
ctgggaggcaagaggggtgga

SEQ ID NO: 1620509 - DNA, 12 bp, Homo sapiens
ctgggaggcaga

SEQ ID NO: 1620510 - DNA, 17 bp, Homo sapiens
ctgggaggcagaacagg

SEQ ID NO: 1620511 - DNA, 20 bp, Homo sapiens
ctgggaggccctgagacagg

SEQ ID NO: 1620512 - DNA, 13 bp, Homo sapiens
ctgggagggggct

SEQ ID NO: 1620513 - DNA, 15 bp, Homo sapiens
ctgggagggggtggg

SEQ ID NO: 1620514 - DNA, 22 bp, Homo sapiens
ctgggagggttcccctggcctt

SEQ ID NO: 1620515 - DNA, 16 bp, Homo sapiens
ctgggagtagctagtt

SEQ ID NO: 1620516 - DNA, 22 bp, Homo sapiens
ctgggagtcacacagtgttgga

SEQ ID NO: 1620517 - DNA, 14 bp, Homo sapiens
ctgggagtcccctt

SEQ ID NO: 1620518 - DNA, 15 bp, Homo sapiens
ctgggagtgtgggct

SEQ ID NO: 1620519 - DNA, 17 bp, Homo sapiens
ctgggagtgtgggctgc

SEQ ID NO: 1620520 - DNA, 20 bp, Homo sapiens
ctgggagtgtgggctgccct

SEQ ID NO: 1620521 - DNA, 21 bp, Homo sapiens
ctgggagtgtgggctgccctt

SEQ ID NO: 1620522 - DNA, 15 bp, Homo sapiens
ctgggatatggctgc

SEQ ID NO: 1620523 - DNA, 20 bp, Homo sapiens
ctgggatatggctgcccagg

SEQ ID NO: 1620524 - DNA, 21 bp, Homo sapiens
ctgggatctgttttctggaag

SEQ ID NO: 1620525 - DNA, 18 bp, Homo sapiens
ctgggatgtcacagtcca

SEQ ID NO: 1620526 - DNA, 20 bp, Homo sapiens
ctgggattacaggcatgagc

SEQ ID NO: 1620527 - DNA, 21 bp, Homo sapiens
ctgggattacaggcgtgagcc

SEQ ID NO: 1620528 - DNA, 23 bp, Homo sapiens
ctgggattacaggtgtgagccac

SEQ ID NO: 1620529 - DNA, 21 bp, Homo sapiens
ctgggattaccggcgtgagcc

SEQ ID NO: 1620530 - DNA, 20 bp, Homo sapiens
ctgggattactggcatgagc

SEQ ID NO: 1620531 - DNA, 14 bp, Homo sapiens
ctgggattcctccc

SEQ ID NO: 1620532 - DNA, 21 bp, Homo sapiens
ctgggatttatgctcatgaac

SEQ ID NO: 1620533 - DNA, 19 bp, Homo sapiens
ctgggatttcttcgctgct

SEQ ID NO: 1620534 - DNA, 21 bp, Homo sapiens
ctgggatttcttcgctgctct

SEQ ID NO: 1620535 - DNA, 22 bp, Homo sapiens
ctgggatttcttcgctgctcta

SEQ ID NO: 1620536 - DNA, 16 bp, Homo sapiens
ctgggcaagagatggg

SEQ ID NO: 1620537 - DNA, 19 bp, Homo sapiens
ctgggcaagagatgggaca

SEQ ID NO: 1620538 - DNA, 21 bp, Homo sapiens
ctgggcaatgaggcagatagc

SEQ ID NO: 1620539 - DNA, 19 bp, Homo sapiens
ctgggcaatgatggcaatt

SEQ ID NO: 1620540 - DNA, 22 bp, Homo sapiens
ctgggcacagtggactcagcag

SEQ ID NO: 1620541 - DNA, 17 bp, Homo sapiens
ctgggcacccacctcca

SEQ ID NO: 1620542 - DNA, 17 bp, Homo sapiens
ctgggcaccctcccacc

SEQ ID NO: 1620543 - DNA, 21 bp, Homo sapiens
ctgggcaccctcccacccggc

SEQ ID NO: 1620544 - DNA, 15 bp, Homo sapiens
ctgggcaccgggacc

SEQ ID NO: 1620545 - DNA, 19 bp, Homo sapiens
ctgggcaccgggaccccct

SEQ ID NO: 1620546 - DNA, 20 bp, Homo sapiens
ctgggcaccgggaccccctc

SEQ ID NO: 1620547 - DNA, 15 bp, Homo sapiens
ctgggcagcaaggct

SEQ ID NO: 1620548 - DNA, 17 bp, Homo sapiens
ctgggcagccaggctgc

SEQ ID NO: 1620549 - DNA, 18 bp, Homo sapiens
ctgggcagccaggctgcc

SEQ ID NO: 1620550 - DNA, 16 bp, Homo sapiens
ctgggcagctgtccct

SEQ ID NO: 1620551 - DNA, 17 bp, Homo sapiens
ctgggcagctgtccctt

SEQ ID NO: 1620552 - DNA, 12 bp, Homo sapiens
ctgggcaggtgg

SEQ ID NO: 1620553 - DNA, 20 bp, Homo sapiens
ctgggcagtgtggcctcttg

SEQ ID NO: 1620554 - DNA, 22 bp, Homo sapiens
ctgggcagtgtggcctcttggc

SEQ ID NO: 1620555 - DNA, 17 bp, Homo sapiens
ctgggcatcttctggct

SEQ ID NO: 1620556 - DNA, 18 bp, Homo sapiens
ctgggcatgggtccaggg

SEQ ID NO: 1620557 - DNA, 13 bp, Homo sapiens
ctgggcattgctt

SEQ ID NO: 1620558 - DNA, 15 bp, Homo sapiens
ctgggcatttcaatc

SEQ ID NO: 1620559 - DNA, 16 bp, Homo sapiens
ctgggcatttcaatcc

SEQ ID NO: 1620560 - DNA, 18 bp, Homo sapiens
ctgggccaagttcctcta

SEQ ID NO: 1620561 - DNA, 19 bp, Homo sapiens
ctgggccacacctgagcgc

SEQ ID NO: 1620562 - DNA, 22 bp, Homo sapiens
ctgggccacacctgagcgctgt

SEQ ID NO: 1620563 - DNA, 14 bp, Homo sapiens
ctgggccacggagg

SEQ ID NO: 1620564 - DNA, 15 bp, Homo sapiens
ctgggccactgggga

SEQ ID NO: 1620565 - DNA, 16 bp, Homo sapiens
ctgggccactggggac

SEQ ID NO: 1620566 - DNA, 18 bp, Homo sapiens
ctgggccagccctgcagc

SEQ ID NO: 1620567 - DNA, 20 bp, Homo sapiens
ctgggccagggatctctcta

SEQ ID NO: 1620568 - DNA, 11 bp, Homo sapiens
ctgggccaggt

SEQ ID NO: 1620569 - DNA, 14 bp, Homo sapiens
ctgggccaggtctc

SEQ ID NO: 1620570 - DNA, 15 bp, Homo sapiens
ctgggccaggtctcc

SEQ ID NO: 1620571 - DNA, 13 bp, Homo sapiens
ctgggccagtggc

SEQ ID NO: 1620572 - DNA, 12 bp, Homo sapiens
ctgggcccaagt

SEQ ID NO: 1620573 - DNA, 19 bp, Homo sapiens
ctgggcccaggcaggtctg

SEQ ID NO: 1620574 - DNA, 15 bp, Homo sapiens
ctgggcccaggggct

SEQ ID NO: 1620575 - DNA, 16 bp, Homo sapiens
ctgggccccaccacct

SEQ ID NO: 1620576 - DNA, 18 bp, Homo sapiens
ctgggccccaccacctag

SEQ ID NO: 1620577 - DNA, 15 bp, Homo sapiens
ctgggccccatgctc

SEQ ID NO: 1620578 - DNA, 16 bp, Homo sapiens
ctgggccccatgctct

SEQ ID NO: 1620579 - DNA, 21 bp, Homo sapiens
ctgggccccatgctctgcccc

SEQ ID NO: 1620580 - DNA, 20 bp, Homo sapiens
ctgggcccctgcacaggcac

SEQ ID NO: 1620581 - DNA, 21 bp, Homo sapiens
ctgggcccgacatggctccgg

SEQ ID NO: 1620582 - DNA, 19 bp, Homo sapiens
ctgggcccggaagggcttt

SEQ ID NO: 1620583 - DNA, 15 bp, Homo sapiens
ctgggccctctcttc

SEQ ID NO: 1620584 - DNA, 18 bp, Homo sapiens
ctgggccctctttccctg

SEQ ID NO: 1620585 - DNA, 18 bp, Homo sapiens
ctgggccctgggctggaa

SEQ ID NO: 1620586 - DNA, 15 bp, Homo sapiens
ctgggccgctgccac

SEQ ID NO: 1620587 - DNA, 20 bp, Homo sapiens
ctgggccggctgagtggcag

SEQ ID NO: 1620588 - DNA, 23 bp, Homo sapiens
ctgggccggctgagtggcagcag

SEQ ID NO: 1620589 - DNA, 17 bp, Homo sapiens
ctgggccgggcctgggg

SEQ ID NO: 1620590 - DNA, 20 bp, Homo sapiens
ctgggccgggcctggggctc

SEQ ID NO: 1620591 - DNA, 17 bp, Homo sapiens
ctgggcctcccctgggc

SEQ ID NO: 1620592 - DNA, 18 bp, Homo sapiens
ctgggcctcccctgggca

SEQ ID NO: 1620593 - DNA, 13 bp, Homo sapiens
ctgggcctcctgc

SEQ ID NO: 1620594 - DNA, 19 bp, Homo sapiens
ctgggcctccttcttccac

SEQ ID NO: 1620595 - DNA, 13 bp, Homo sapiens
ctgggcctgtccc

SEQ ID NO: 1620596 - DNA, 16 bp, Homo sapiens
ctgggcctgtgcagca

SEQ ID NO: 1620597 - DNA, 19 bp, Homo sapiens
ctgggcctgtgcagcagcc

SEQ ID NO: 1620598 - DNA, 16 bp, Homo sapiens
ctgggcctttgcaaga

SEQ ID NO: 1620599 - DNA, 17 bp, Homo sapiens
ctgggcctttgcaagat

SEQ ID NO: 1620600 - DNA, 22 bp, Homo sapiens
ctgggcgagcccctccttctcc

SEQ ID NO: 1620601 - DNA, 14 bp, Homo sapiens
ctgggcgccctgga

SEQ ID NO: 1620602 - DNA, 15 bp, Homo sapiens
ctgggcgccctggaa

SEQ ID NO: 1620603 - DNA, 16 bp, Homo sapiens
ctgggcggccagtgcg

SEQ ID NO: 1620604 - DNA, 12 bp, Homo sapiens
ctgggcgtctga

SEQ ID NO: 1620605 - DNA, 15 bp, Homo sapiens
ctgggcgtctgagct

SEQ ID NO: 1620606 - DNA, 18 bp, Homo sapiens
ctgggcgtctgagctggg

SEQ ID NO: 1620607 - DNA, 22 bp, Homo sapiens
ctgggctaaggaagtatcagca

SEQ ID NO: 1620608 - DNA, 19 bp, Homo sapiens
ctgggctaccatctgcatg

SEQ ID NO: 1620609 - DNA, 13 bp, Homo sapiens
ctgggctatattc

SEQ ID NO: 1620610 - DNA, 16 bp, Homo sapiens
ctgggctattgctgct

SEQ ID NO: 1620611 - DNA, 22 bp, Homo sapiens
ctgggctattgctgctgcccct

SEQ ID NO: 1620612 - DNA, 14 bp, Homo sapiens
ctgggctcactgtg

SEQ ID NO: 1620613 - DNA, 22 bp, Homo sapiens
ctgggctcactgtgctggggca

SEQ ID NO: 1620614 - DNA, 13 bp, Homo sapiens
ctgggctcagggc

SEQ ID NO: 1620615 - DNA, 21 bp, Homo sapiens
ctgggctcagggctggagtgc

SEQ ID NO: 1620616 - DNA, 14 bp, Homo sapiens
ctgggctccacaca

SEQ ID NO: 1620617 - DNA, 22 bp, Homo sapiens
ctgggctccacacagcagtgtc

SEQ ID NO: 1620618 - DNA, 20 bp, Homo sapiens
ctgggctctcacccagtccc

SEQ ID NO: 1620619 - DNA, 16 bp, Homo sapiens
ctgggctctccacctc

SEQ ID NO: 1620620 - DNA, 20 bp, Homo sapiens
ctgggctctccacctcagcc

SEQ ID NO: 1620621 - DNA, 21 bp, Homo sapiens
ctgggctctccacctcagcct

SEQ ID NO: 1620622 - DNA, 21 bp, Homo sapiens
ctgggctctgccaccctacct

SEQ ID NO: 1620623 - DNA, 17 bp, Homo sapiens
ctgggctctgccccagc

SEQ ID NO: 1620624 - DNA, 20 bp, Homo sapiens
ctgggctctgcctgtctggt

SEQ ID NO: 1620625 - DNA, 14 bp, Homo sapiens
ctgggctctggctc

SEQ ID NO: 1620626 - DNA, 18 bp, Homo sapiens
ctgggctgagcccctacc

SEQ ID NO: 1620627 - DNA, 13 bp, Homo sapiens
ctgggctgagtga

SEQ ID NO: 1620628 - DNA, 13 bp, Homo sapiens
ctgggctggactg

SEQ ID NO: 1620629 - DNA, 17 bp, Homo sapiens
ctgggctggactggcca

SEQ ID NO: 1620630 - DNA, 14 bp, Homo sapiens
ctgggctgggccct

SEQ ID NO: 1620631 - DNA, 21 bp, Homo sapiens
ctgggctgggccctctttccc

SEQ ID NO: 1620632 - DNA, 13 bp, Homo sapiens
ctgggctggggag

SEQ ID NO: 1620633 - DNA, 22 bp, Homo sapiens
ctgggctgggtggcccctgtct

SEQ ID NO: 1620634 - DNA, 13 bp, Homo sapiens
ctgggctgtgggg

SEQ ID NO: 1620635 - DNA, 14 bp, Homo sapiens
ctgggctgtggggc

SEQ ID NO: 1620636 - DNA, 14 bp, Homo sapiens
ctgggctgttggca

SEQ ID NO: 1620637 - DNA, 14 bp, Homo sapiens
ctgggctgttgttc

SEQ ID NO: 1620638 - DNA, 22 bp, Homo sapiens
ctgggcttagggtcctgtcgaa

SEQ ID NO: 1620639 - DNA, 20 bp, Homo sapiens
ctgggcttatatctggcctc

SEQ ID NO: 1620640 - DNA, 22 bp, Homo sapiens
ctgggcttatatctggcctctg

SEQ ID NO: 1620641 - DNA, 17 bp, Homo sapiens
ctgggcttcattctgga

SEQ ID NO: 1620642 - DNA, 18 bp, Homo sapiens
ctgggcttggcctgctgt

SEQ ID NO: 1620643 - DNA, 23 bp, Homo sapiens
ctgggctttttttttctctttct

SEQ ID NO: 1620644 - DNA, 16 bp, Homo sapiens
ctggggaaagacactg

SEQ ID NO: 1620645 - DNA, 20 bp, Homo sapiens
ctggggaaagacactgcctg

SEQ ID NO: 1620646 - DNA, 12 bp, Homo sapiens
ctggggaaaggg

SEQ ID NO: 1620647 - DNA, 21 bp, Homo sapiens
ctggggaaagggctggctgca

SEQ ID NO: 1620648 - DNA, 12 bp, Homo sapiens
ctggggaaggag

SEQ ID NO: 1620649 - DNA, 15 bp, Homo sapiens
ctggggaaggagcca

SEQ ID NO: 1620650 - DNA, 13 bp, Homo sapiens
ctggggacagagg

SEQ ID NO: 1620651 - DNA, 18 bp, Homo sapiens
ctggggaccaggagctag

SEQ ID NO: 1620652 - DNA, 22 bp, Homo sapiens
ctggggacctggtaccctcctg

SEQ ID NO: 1620653 - DNA, 20 bp, Homo sapiens
ctggggacgaattccactcg

SEQ ID NO: 1620654 - DNA, 21 bp, Homo sapiens
ctggggacgctccgctgccgt

SEQ ID NO: 1620655 - DNA, 18 bp, Homo sapiens
ctggggacttgtgtctgc

SEQ ID NO: 1620656 - DNA, 23 bp, Homo sapiens
ctggggactttatttatttctag

SEQ ID NO: 1620657 - DNA, 21 bp, Homo sapiens
ctggggagagcggctggagaa

SEQ ID NO: 1620658 - DNA, 22 bp, Homo sapiens
ctggggagagcggctggagaaa

SEQ ID NO: 1620659 - DNA, 15 bp, Homo sapiens
ctggggagcagctga

SEQ ID NO: 1620660 - DNA, 13 bp, Homo sapiens
ctggggaggcagg

SEQ ID NO: 1620661 - DNA, 15 bp, Homo sapiens
ctggggaggctgagg

SEQ ID NO: 1620662 - DNA, 19 bp, Homo sapiens
ctggggaggctgaggcagg

SEQ ID NO: 1620663 - DNA, 20 bp, Homo sapiens
ctggggatccccgcctggcc

SEQ ID NO: 1620664 - DNA, 22 bp, Homo sapiens
ctggggatccccgcctggccag

SEQ ID NO: 1620665 - DNA, 23 bp, Homo sapiens
ctggggatccccgcctggccagg

SEQ ID NO: 1620666 - DNA, 16 bp, Homo sapiens
ctggggatttctggga

SEQ ID NO: 1620667 - DNA, 17 bp, Homo sapiens
ctggggatttctgggat

SEQ ID NO: 1620668 - DNA, 21 bp, Homo sapiens
ctggggcaagtccctgactct

SEQ ID NO: 1620669 - DNA, 12 bp, Homo sapiens
ctggggcacggc

SEQ ID NO: 1620670 - DNA, 17 bp, Homo sapiens
ctggggcagaggggcag

SEQ ID NO: 1620671 - DNA, 21 bp, Homo sapiens
ctggggcagaggggcagccgc

SEQ ID NO: 1620672 - DNA, 22 bp, Homo sapiens
ctggggcagaggggcagccgct

SEQ ID NO: 1620673 - DNA, 17 bp, Homo sapiens
ctggggcaggctgggcc

SEQ ID NO: 1620674 - DNA, 21 bp, Homo sapiens
ctggggcaggctgggccatgt

SEQ ID NO: 1620675 - DNA, 23 bp, Homo sapiens
ctggggcatgtgtgcctgtggca

SEQ ID NO: 1620676 - DNA, 22 bp, Homo sapiens
ctggggccacaaatcaaagcaa

SEQ ID NO: 1620677 - DNA, 17 bp, Homo sapiens
ctggggccccgctggga

SEQ ID NO: 1620678 - DNA, 21 bp, Homo sapiens
ctggggccctcagctcctggg

SEQ ID NO: 1620679 - DNA, 19 bp, Homo sapiens
ctggggccgccacggcctg

SEQ ID NO: 1620680 - DNA, 21 bp, Homo sapiens
ctggggccgccacggcctggc

SEQ ID NO: 1620681 - DNA, 17 bp, Homo sapiens
ctggggccggcggggcc

SEQ ID NO: 1620682 - DNA, 24 bp, Homo sapiens
ctggggcctagcgatctctcctgg

SEQ ID NO: 1620683 - DNA, 11 bp, Homo sapiens
ctggggcctcc

SEQ ID NO: 1620684 - DNA, 12 bp, Homo sapiens
ctggggcctcca

SEQ ID NO: 1620685 - DNA, 15 bp, Homo sapiens
ctggggcctccagaa

SEQ ID NO: 1620686 - DNA, 19 bp, Homo sapiens
ctggggcctccagaagctg

SEQ ID NO: 1620687 - DNA, 20 bp, Homo sapiens
ctggggcctcggagcctcat

SEQ ID NO: 1620688 - DNA, 16 bp, Homo sapiens
ctggggcctgactgct

SEQ ID NO: 1620689 - DNA, 19 bp, Homo sapiens
ctggggcctggacctgcct

SEQ ID NO: 1620690 - DNA, 15 bp, Homo sapiens
ctggggcgtggggag

SEQ ID NO: 1620691 - DNA, 22 bp, Homo sapiens
ctggggctcccttcatctccag

SEQ ID NO: 1620692 - DNA, 17 bp, Homo sapiens
ctggggctgatctcagg

SEQ ID NO: 1620693 - DNA, 22 bp, Homo sapiens
ctggggctgatctcagggaagc

SEQ ID NO: 1620694 - DNA, 14 bp, Homo sapiens
ctggggctgtgtta

SEQ ID NO: 1620695 - DNA, 14 bp, Homo sapiens
ctgggggaagccct

SEQ ID NO: 1620696 - DNA, 19 bp, Homo sapiens
ctgggggaaggcaggagcc

SEQ ID NO: 1620697 - DNA, 15 bp, Homo sapiens
ctgggggagtgtgag

SEQ ID NO: 1620698 - DNA, 18 bp, Homo sapiens
ctgggggcaaaggtttga

SEQ ID NO: 1620699 - DNA, 14 bp, Homo sapiens
ctgggggcacagga

SEQ ID NO: 1620700 - DNA, 19 bp, Homo sapiens
ctgggggcacaggaggcag

SEQ ID NO: 1620701 - DNA, 16 bp, Homo sapiens
ctgggggcagtgactg

SEQ ID NO: 1620702 - DNA, 14 bp, Homo sapiens
ctgggggccccagg

SEQ ID NO: 1620703 - DNA, 18 bp, Homo sapiens
ctggggggacccagtgca

SEQ ID NO: 1620704 - DNA, 19 bp, Homo sapiens
ctggggggacccagtgcag

SEQ ID NO: 1620705 - DNA, 12 bp, Homo sapiens
ctggggggctgt

SEQ ID NO: 1620706 - DNA, 23 bp, Homo sapiens
ctgggggtcctctctgagtcaaa

SEQ ID NO: 1620707 - DNA, 20 bp, Homo sapiens
ctggggtataaaactttcct

SEQ ID NO: 1620708 - DNA, 17 bp, Homo sapiens
ctggggtcctcctgtgc

SEQ ID NO: 1620709 - DNA, 14 bp, Homo sapiens
ctggggtctgagca

SEQ ID NO: 1620710 - DNA, 19 bp, Homo sapiens
ctggggtcttgggttcctg

SEQ ID NO: 1620711 - DNA, 15 bp, Homo sapiens
ctggggtgagggagt

SEQ ID NO: 1620712 - DNA, 16 bp, Homo sapiens
ctggggtggccaccag

SEQ ID NO: 1620713 - DNA, 18 bp, Homo sapiens
ctggggtgggatctgagc

SEQ ID NO: 1620714 - DNA, 20 bp, Homo sapiens
ctggggtgttagtggcaccg

SEQ ID NO: 1620715 - DNA, 19 bp, Homo sapiens
ctggggttcaagcccaggc

SEQ ID NO: 1620716 - DNA, 21 bp, Homo sapiens
ctggggttcaagcccaggctt

SEQ ID NO: 1620717 - DNA, 13 bp, Homo sapiens
ctggggttcagcc

SEQ ID NO: 1620718 - DNA, 17 bp, Homo sapiens
ctggggttcagcccctc

SEQ ID NO: 1620719 - DNA, 23 bp, Homo sapiens
ctggggttcagcccctcctctgc

SEQ ID NO: 1620720 - DNA, 15 bp, Homo sapiens
ctgggtaagaagaaa

SEQ ID NO: 1620721 - DNA, 16 bp, Homo sapiens
ctgggtaagaagaaag

SEQ ID NO: 1620722 - DNA, 23 bp, Homo sapiens
ctgggtacaagagatgggatgct

SEQ ID NO: 1620723 - DNA, 17 bp, Homo sapiens
ctgggtacctgcaagca

SEQ ID NO: 1620724 - DNA, 19 bp, Homo sapiens
ctgggtacctgcaagcaga

SEQ ID NO: 1620725 - DNA, 18 bp, Homo sapiens
ctgggtactgaaagcctt

SEQ ID NO: 1620726 - DNA, 23 bp, Homo sapiens
ctgggtacttcttgaaggtgctg

SEQ ID NO: 1620727 - DNA, 15 bp, Homo sapiens
ctgggtaggaaagag

SEQ ID NO: 1620728 - DNA, 17 bp, Homo sapiens
ctgggtaggaaagagga

SEQ ID NO: 1620729 - DNA, 17 bp, Homo sapiens
ctgggtatcccctgcct

SEQ ID NO: 1620730 - DNA, 22 bp, Homo sapiens
ctgggtcaaagtggtacaggaa

SEQ ID NO: 1620731 - DNA, 14 bp, Homo sapiens
ctgggtcacacacg

SEQ ID NO: 1620732 - DNA, 12 bp, Homo sapiens
ctgggtcaccag

SEQ ID NO: 1620733 - DNA, 17 bp, Homo sapiens
ctgggtcagaaccagag

SEQ ID NO: 1620734 - DNA, 16 bp, Homo sapiens
ctgggtcagcttgaat

SEQ ID NO: 1620735 - DNA, 14 bp, Homo sapiens
ctgggtcagggcca

SEQ ID NO: 1620736 - DNA, 14 bp, Homo sapiens
ctgggtcctccaaa

SEQ ID NO: 1620737 - DNA, 18 bp, Homo sapiens
ctgggtcctccaaagact

SEQ ID NO: 1620738 - DNA, 16 bp, Homo sapiens
ctgggtcctgcctggt

SEQ ID NO: 1620739 - DNA, 18 bp, Homo sapiens
ctgggtctgacctggtgg

SEQ ID NO: 1620740 - DNA, 13 bp, Homo sapiens
ctgggtgacagag

SEQ ID NO: 1620741 - DNA, 20 bp, Homo sapiens
ctgggtgaccgactacccca

SEQ ID NO: 1620742 - DNA, 14 bp, Homo sapiens
ctgggtgccctctc

SEQ ID NO: 1620743 - DNA, 16 bp, Homo sapiens
ctgggtgccctctcag

SEQ ID NO: 1620744 - DNA, 15 bp, Homo sapiens
ctgggtgctggctgc

SEQ ID NO: 1620745 - DNA, 18 bp, Homo sapiens
ctgggtggaagtgcccag

SEQ ID NO: 1620746 - DNA, 19 bp, Homo sapiens
ctgggtggaagtgcccagc

SEQ ID NO: 1620747 - DNA, 15 bp, Homo sapiens
ctgggtggggcagtg

SEQ ID NO: 1620748 - DNA, 20 bp, Homo sapiens
ctgggtggggctgctcctcc

SEQ ID NO: 1620749 - DNA, 17 bp, Homo sapiens
ctgggtgggtggtgggg

SEQ ID NO: 1620750 - DNA, 19 bp, Homo sapiens
ctgggtgggtggtggggag

SEQ ID NO: 1620751 - DNA, 19 bp, Homo sapiens
ctgggtggtacccaggctt

SEQ ID NO: 1620752 - DNA, 14 bp, Homo sapiens
ctgggtggtggcct

SEQ ID NO: 1620753 - DNA, 21 bp, Homo sapiens
ctgggtgtccccgctgctgtg

SEQ ID NO: 1620754 - DNA, 21 bp, Homo sapiens
ctgggttaaatattttgctaa

SEQ ID NO: 1620755 - DNA, 15 bp, Homo sapiens
ctgggttaacaaatg

SEQ ID NO: 1620756 - DNA, 22 bp, Homo sapiens
ctgggttcagaaatgctgcctg

SEQ ID NO: 1620757 - DNA, 16 bp, Homo sapiens
ctgggttcccactccc

SEQ ID NO: 1620758 - DNA, 16 bp, Homo sapiens
ctgggttccctttcct

SEQ ID NO: 1620759 - DNA, 20 bp, Homo sapiens
ctgggttccctttccttcca

SEQ ID NO: 1620760 - DNA, 15 bp, Homo sapiens
ctgggttctttggaa

SEQ ID NO: 1620761 - DNA, 13 bp, Homo sapiens
ctgggttggtgca

SEQ ID NO: 1620762 - DNA, 14 bp, Homo sapiens
ctgggtttatagat

SEQ ID NO: 1620763 - DNA, 13 bp, Homo sapiens
ctgggtttctagc

SEQ ID NO: 1620764 - DNA, 18 bp, Homo sapiens
ctgggtttctctgtatag

SEQ ID NO: 1620765 - DNA, 16 bp, Homo sapiens
ctgggtttggacccca

SEQ ID NO: 1620766 - DNA, 23 bp, Homo sapiens
ctgggtttggaccccagctggga

SEQ ID NO: 1620767 - DNA, 18 bp, Homo sapiens
ctggtaaaaagatccagg

SEQ ID NO: 1620768 - DNA, 20 bp, Homo sapiens
ctggtaaaaagatccaggga

SEQ ID NO: 1620769 - DNA, 19 bp, Homo sapiens
ctggtaactggaaggcctt

SEQ ID NO: 1620770 - DNA, 22 bp, Homo sapiens
ctggtaattcctctccaggcca

SEQ ID NO: 1620771 - DNA, 15 bp, Homo sapiens
ctggtaccctcctgg

SEQ ID NO: 1620772 - DNA, 14 bp, Homo sapiens
ctggtacctgccct

SEQ ID NO: 1620773 - DNA, 21 bp, Homo sapiens
ctggtacgaatctcatccctc

SEQ ID NO: 1620774 - DNA, 20 bp, Homo sapiens
ctggtactccctctcaggat

SEQ ID NO: 1620775 - DNA, 23 bp, Homo sapiens
ctggtagaaaaaggggcctgagt

SEQ ID NO: 1620776 - DNA, 19 bp, Homo sapiens
ctggtagagacccccaggc

SEQ ID NO: 1620777 - DNA, 20 bp, Homo sapiens
ctggtagagacccccaggcc

SEQ ID NO: 1620778 - DNA, 20 bp, Homo sapiens
ctggtagatgctgaggcccc

SEQ ID NO: 1620779 - DNA, 14 bp, Homo sapiens
ctggtagcagcagg

SEQ ID NO: 1620780 - DNA, 16 bp, Homo sapiens
ctggtagcagcaggct

SEQ ID NO: 1620781 - DNA, 21 bp, Homo sapiens
ctggtagcagcaggctcaggc

SEQ ID NO: 1620782 - DNA, 15 bp, Homo sapiens
ctggtaggaccaagc

SEQ ID NO: 1620783 - DNA, 17 bp, Homo sapiens
ctggtaggaccaagcat

SEQ ID NO: 1620784 - DNA, 16 bp, Homo sapiens
ctggtaggttgggaca

SEQ ID NO: 1620785 - DNA, 20 bp, Homo sapiens
ctggtatatccaaaagcttt

SEQ ID NO: 1620786 - DNA, 15 bp, Homo sapiens
ctggtatctcagaaa

SEQ ID NO: 1620787 - DNA, 17 bp, Homo sapiens
ctggtatctcagaaagt

SEQ ID NO: 1620788 - DNA, 19 bp, Homo sapiens
ctggtatctcagaaagtgc

SEQ ID NO: 1620789 - DNA, 23 bp, Homo sapiens
ctggtatctcagaaagtgcctga

SEQ ID NO: 1620790 - DNA, 19 bp, Homo sapiens
ctggtatctggcgttcttt

SEQ ID NO: 1620791 - DNA, 18 bp, Homo sapiens
ctggtattctgttctgga

SEQ ID NO: 1620792 - DNA, 14 bp, Homo sapiens
ctggtatttctaat

SEQ ID NO: 1620793 - DNA, 12 bp, Homo sapiens
ctggtcactctg

SEQ ID NO: 1620794 - DNA, 14 bp, Homo sapiens
ctggtcactctgcc

SEQ ID NO: 1620795 - DNA, 20 bp, Homo sapiens
ctggtcactctgccctctgc

SEQ ID NO: 1620796 - DNA, 16 bp, Homo sapiens
ctggtcagagagacct

SEQ ID NO: 1620797 - DNA, 18 bp, Homo sapiens
ctggtcagagagacctca

SEQ ID NO: 1620798 - DNA, 21 bp, Homo sapiens
ctggtccagctctgacatccc

SEQ ID NO: 1620799 - DNA, 22 bp, Homo sapiens
ctggtccagctctgacatccct

SEQ ID NO: 1620800 - DNA, 16 bp, Homo sapiens
ctggtccaggccctgt

SEQ ID NO: 1620801 - DNA, 22 bp, Homo sapiens
ctggtccagggaagctggccga

SEQ ID NO: 1620802 - DNA, 20 bp, Homo sapiens
ctggtccaggtcttcagttt

SEQ ID NO: 1620803 - DNA, 23 bp, Homo sapiens
ctggtccatgtaaatactttcca

SEQ ID NO: 1620804 - DNA, 18 bp, Homo sapiens
ctggtcccctcctcagtg

SEQ ID NO: 1620805 - DNA, 19 bp, Homo sapiens
ctggtcccctcctcagtga

SEQ ID NO: 1620806 - DNA, 22 bp, Homo sapiens
ctggtccctgccctcccctgct

SEQ ID NO: 1620807 - DNA, 15 bp, Homo sapiens
ctggtccctgggagg

SEQ ID NO: 1620808 - DNA, 15 bp, Homo sapiens
ctggtccctggtcct

SEQ ID NO: 1620809 - DNA, 17 bp, Homo sapiens
ctggtccctggtccttc

SEQ ID NO: 1620810 - DNA, 15 bp, Homo sapiens
ctggtccgtgggacg

SEQ ID NO: 1620811 - DNA, 16 bp, Homo sapiens
ctggtccgtgggacgg

SEQ ID NO: 1620812 - DNA, 17 bp, Homo sapiens
ctggtcctccctcccaa

SEQ ID NO: 1620813 - DNA, 19 bp, Homo sapiens
ctggtcctccctcccaagg

SEQ ID NO: 1620814 - DNA, 20 bp, Homo sapiens
ctggtcctccctcccaagga

SEQ ID NO: 1620815 - DNA, 18 bp, Homo sapiens
ctggtcctccgcctactg

SEQ ID NO: 1620816 - DNA, 14 bp, Homo sapiens
ctggtcctggctgc

SEQ ID NO: 1620817 - DNA, 15 bp, Homo sapiens
ctggtcctggctgca

SEQ ID NO: 1620818 - DNA, 17 bp, Homo sapiens
ctggtcctggctgcact

SEQ ID NO: 1620819 - DNA, 19 bp, Homo sapiens
ctggtcctggctgcactct

SEQ ID NO: 1620820 - DNA, 17 bp, Homo sapiens
ctggtccttcactggcg

SEQ ID NO: 1620821 - DNA, 19 bp, Homo sapiens
ctggtccttccaggccccc

SEQ ID NO: 1620822 - DNA, 14 bp, Homo sapiens
ctggtcgctcctgc

SEQ ID NO: 1620823 - DNA, 15 bp, Homo sapiens
ctggtcgctcctgcc

SEQ ID NO: 1620824 - DNA, 23 bp, Homo sapiens
ctggtcgctcctgcccacggagt

SEQ ID NO: 1620825 - DNA, 21 bp, Homo sapiens
ctggcccagggggcctggagc

SEQ ID NO: 1620826 - DNA, 12 bp, Homo sapiens
ctggcccagggt

SEQ ID NO: 1620827 - DNA, 23 bp, Homo sapiens
ctggcccagggtgtttgcagctg

SEQ ID NO: 1620828 - DNA, 16 bp, Homo sapiens
ctggcccatagaaaca

SEQ ID NO: 1620829 - DNA, 21 bp, Homo sapiens
ctggcccatagaaacatgaca

SEQ ID NO: 1620830 - DNA, 16 bp, Homo sapiens
ctggccccagccctgc

SEQ ID NO: 1620831 - DNA, 19 bp, Homo sapiens
ctggccccagccctgctgg

SEQ ID NO: 1620832 - DNA, 18 bp, Homo sapiens
ctggcccccaacctcagg

SEQ ID NO: 1620833 - DNA, 13 bp, Homo sapiens
ctggcccccagga

SEQ ID NO: 1620834 - DNA, 21 bp, Homo sapiens
ctggccccgctagcggggcca

SEQ ID NO: 1620835 - DNA, 19 bp, Homo sapiens
ctggccccgggctctggcc

SEQ ID NO: 1620836 - DNA, 22 bp, Homo sapiens
ctggccccgggctctggccacc

SEQ ID NO: 1620837 - DNA, 23 bp, Homo sapiens
ctggccccgggctctggccaccc

SEQ ID NO: 1620838 - DNA, 19 bp, Homo sapiens
ctggcccgcccctcgctgc

SEQ ID NO: 1620839 - DNA, 19 bp, Homo sapiens
ctggccctcacccctgccc

SEQ ID NO: 1620840 - DNA, 22 bp, Homo sapiens
ctggccctcacccctgccctgg

SEQ ID NO: 1620841 - DNA, 23 bp, Homo sapiens
ctggccctcacccctgccctggg

SEQ ID NO: 1620842 - DNA, 13 bp, Homo sapiens
ctggccctcactc

SEQ ID NO: 1620843 - DNA, 19 bp, Homo sapiens
ctggccctcactcaagacc

SEQ ID NO: 1620844 - DNA, 12 bp, Homo sapiens
ctggccctccac

SEQ ID NO: 1620845 - DNA, 16 bp, Homo sapiens
ctggccctccactcct

SEQ ID NO: 1620846 - DNA, 11 bp, Homo sapiens
ctggccctgac

SEQ ID NO: 1620847 - DNA, 13 bp, Homo sapiens
ctggccctgaggt

SEQ ID NO: 1620848 - DNA, 13 bp, Homo sapiens
ctggccctgccca

SEQ ID NO: 1620849 - DNA, 13 bp, Homo sapiens
ctggccctgccgt

SEQ ID NO: 1620850 - DNA, 12 bp, Homo sapiens
ctggccctgcct

SEQ ID NO: 1620851 - DNA, 15 bp, Homo sapiens
ctggccctgcctcat

SEQ ID NO: 1620852 - DNA, 20 bp, Homo sapiens
ctggccctggggatcttccc

SEQ ID NO: 1620853 - DNA, 12 bp, Homo sapiens
ctggcccttcag

SEQ ID NO: 1620854 - DNA, 13 bp, Homo sapiens
ctggcccttcagt

SEQ ID NO: 1620855 - DNA, 17 bp, Homo sapiens
ctggccgagggtcctgg

SEQ ID NO: 1620856 - DNA, 16 bp, Homo sapiens
ctggccgccaccccca

SEQ ID NO: 1620857 - DNA, 18 bp, Homo sapiens
ctggccgccacccccatc

SEQ ID NO: 1620858 - DNA, 20 bp, Homo sapiens
ctggccgccacccccatctt

SEQ ID NO: 1620859 - DNA, 18 bp, Homo sapiens
ctggccgcctccaggagc

SEQ ID NO: 1620860 - DNA, 18 bp, Homo sapiens
ctggccgcgccaaataat

SEQ ID NO: 1620861 - DNA, 15 bp, Homo sapiens
ctggccggtgctggg

SEQ ID NO: 1620862 - DNA, 16 bp, Homo sapiens
ctggccggtgctgggt

SEQ ID NO: 1620863 - DNA, 19 bp, Homo sapiens
ctggccggtgctgggttcc

SEQ ID NO: 1620864 - DNA, 23 bp, Homo sapiens
ctggccggtgctgggttcccact

SEQ ID NO: 1620865 - DNA, 20 bp, Homo sapiens
ctggccggttaacatctttt

SEQ ID NO: 1620866 - DNA, 15 bp, Homo sapiens
ctggccgttcagcct

SEQ ID NO: 1620867 - DNA, 20 bp, Homo sapiens
ctggcctagaccagcagaca

SEQ ID NO: 1620868 - DNA, 14 bp, Homo sapiens
ctggcctaggggcc

SEQ ID NO: 1620869 - DNA, 19 bp, Homo sapiens
ctggcctatccgctgccag

SEQ ID NO: 1620870 - DNA, 22 bp, Homo sapiens
ctggcctcacccacccctgcac

SEQ ID NO: 1620871 - DNA, 16 bp, Homo sapiens
ctggcctcactggctg

SEQ ID NO: 1620872 - DNA, 18 bp, Homo sapiens
ctggcctcactggctggg

SEQ ID NO: 1620873 - DNA, 15 bp, Homo sapiens
ctggcctcagttccc

SEQ ID NO: 1620874 - DNA, 17 bp, Homo sapiens
ctggcctcagttcccag

SEQ ID NO: 1620875 - DNA, 23 bp, Homo sapiens
ctggcctcagttcccagctcccc

SEQ ID NO: 1620876 - DNA, 21 bp, Homo sapiens
ctggcctccaaaatattaaca

SEQ ID NO: 1620877 - DNA, 22 bp, Homo sapiens
ctggcctccagctcccactccc

SEQ ID NO: 1620878 - DNA, 12 bp, Homo sapiens
ctggcctcccac

SEQ ID NO: 1620879 - DNA, 21 bp, Homo sapiens
ctggcctcccctgccaccagg

SEQ ID NO: 1620880 - DNA, 16 bp, Homo sapiens
ctggcctcccttctcc

SEQ ID NO: 1620881 - DNA, 17 bp, Homo sapiens
ctggcctcccttctcct

SEQ ID NO: 1620882 - DNA, 21 bp, Homo sapiens
ctggcctcccttctcctttct

SEQ ID NO: 1620883 - DNA, 15 bp, Homo sapiens
ctggcctccttcccc

SEQ ID NO: 1620884 - DNA, 18 bp, Homo sapiens
ctggcctctctagcacaa

SEQ ID NO: 1620885 - DNA, 17 bp, Homo sapiens
ctggcctctgggcagtg

SEQ ID NO: 1620886 - DNA, 22 bp, Homo sapiens
ctggcctctgggcagtgtggcc

SEQ ID NO: 1620887 - DNA, 20 bp, Homo sapiens
ctggcctctgtgccttcttt

SEQ ID NO: 1620888 - DNA, 21 bp, Homo sapiens
ctggcctgaactgaggagatg

SEQ ID NO: 1620889 - DNA, 19 bp, Homo sapiens
ctggcctgagaggggaagc

SEQ ID NO: 1620890 - DNA, 20 bp, Homo sapiens
ctggcctgagagtcagctct

SEQ ID NO: 1620891 - DNA, 19 bp, Homo sapiens
ctggcctgagctggggcca

SEQ ID NO: 1620892 - DNA, 15 bp, Homo sapiens
ctggcctgctgggaa

SEQ ID NO: 1620893 - DNA, 14 bp, Homo sapiens
ctggcctggctccc

SEQ ID NO: 1620894 - DNA, 13 bp, Homo sapiens
ctggcctgggcca

SEQ ID NO: 1620895 - DNA, 16 bp, Homo sapiens
ctggcctgggccacac

SEQ ID NO: 1620896 - DNA, 16 bp, Homo sapiens
ctggcctggtccctgg

SEQ ID NO: 1620897 - DNA, 17 bp, Homo sapiens
ctggcctggtccctggt

SEQ ID NO: 1620898 - DNA, 18 bp, Homo sapiens
ctggcctgtaatctacca

SEQ ID NO: 1620899 - DNA, 22 bp, Homo sapiens
ctggcctgtggcacagccctga

SEQ ID NO: 1620900 - DNA, 19 bp, Homo sapiens
ctggccttctgaactccat

SEQ ID NO: 1620901 - DNA, 23 bp, Homo sapiens
ctggccttgcccgtcgtgtgctg

SEQ ID NO: 1620902 - DNA, 20 bp, Homo sapiens
ctggccttgtgtcactggct

SEQ ID NO: 1620903 - DNA, 17 bp, Homo sapiens
ctggcctttttcattta

SEQ ID NO: 1620904 - DNA, 19 bp, Homo sapiens
ctggcgacagttttccttc

SEQ ID NO: 1620905 - DNA, 20 bp, Homo sapiens
ctggcgacagttttccttct

SEQ ID NO: 1620906 - DNA, 15 bp, Homo sapiens
ctggcgagttctctt

SEQ ID NO: 1620907 - DNA, 19 bp, Homo sapiens
ctggcgcagccaaggccga

SEQ ID NO: 1620908 - DNA, 17 bp, Homo sapiens
ctggcgccttctcggag

SEQ ID NO: 1620909 - DNA, 20 bp, Homo sapiens
ctggcgccttctcggagctg

SEQ ID NO: 1620910 - DNA, 19 bp, Homo sapiens
ctggcggaggtctctggga

SEQ ID NO: 1620911 - DNA, 22 bp, Homo sapiens
ctggcggaggtctctgggagcc

SEQ ID NO: 1620912 - DNA, 17 bp, Homo sapiens
ctggcggctactcagca

SEQ ID NO: 1620913 - DNA, 20 bp, Homo sapiens
ctggcggctactcagcagcc

SEQ ID NO: 1620914 - DNA, 22 bp, Homo sapiens
ctggcggctactcagcagccct

SEQ ID NO: 1620915 - DNA, 13 bp, Homo sapiens
ctggcggcttcct

SEQ ID NO: 1620916 - DNA, 17 bp, Homo sapiens
ctggcggcttcctgtcc

SEQ ID NO: 1620917 - DNA, 22 bp, Homo sapiens
ctggcgtgctcagacccaacag

SEQ ID NO: 1620918 - DNA, 19 bp, Homo sapiens
ctggcgttctcaagaatct

SEQ ID NO: 1620919 - DNA, 22 bp, Homo sapiens
ctggcgttctcaagaatctaga

SEQ ID NO: 1620920 - DNA, 14 bp, Homo sapiens
ctggctacttccct

SEQ ID NO: 1620921 - DNA, 20 bp, Homo sapiens
ctggctacttcccttcctcc

SEQ ID NO: 1620922 - DNA, 19 bp, Homo sapiens
ctggctagagccgagggga

SEQ ID NO: 1620923 - DNA, 21 bp, Homo sapiens
ctggctagaggccagccccac

SEQ ID NO: 1620924 - DNA, 23 bp, Homo sapiens
ctggctagaggccagccccaccc

SEQ ID NO: 1620925 - DNA, 18 bp, Homo sapiens
ctggctagagtcctcact

SEQ ID NO: 1620926 - DNA, 19 bp, Homo sapiens
ctggctagagtcctcactc

SEQ ID NO: 1620927 - DNA, 15 bp, Homo sapiens
ctggctcactggcag

SEQ ID NO: 1620928 - DNA, 11 bp, Homo sapiens
ctggctcaggt

SEQ ID NO: 1620929 - DNA, 13 bp, Homo sapiens
ctggctcatctct

SEQ ID NO: 1620930 - DNA, 16 bp, Homo sapiens
ctggctccactcttga

SEQ ID NO: 1620931 - DNA, 14 bp, Homo sapiens
ctggctcccaggac

SEQ ID NO: 1620932 - DNA, 15 bp, Homo sapiens
ctggctcccaggaca

SEQ ID NO: 1620933 - DNA, 22 bp, Homo sapiens
ctggctccccacgagtcacctg

SEQ ID NO: 1620934 - DNA, 21 bp, Homo sapiens
ctggctccctcctccaggcct

SEQ ID NO: 1620935 - DNA, 14 bp, Homo sapiens
ctggctccctgccc

SEQ ID NO: 1620936 - DNA, 20 bp, Homo sapiens
ctggctccgtccaggagcct

SEQ ID NO: 1620937 - DNA, 15 bp, Homo sapiens
ctggctcctctgccc

SEQ ID NO: 1620938 - DNA, 22 bp, Homo sapiens
ctggctcggacccaccccaact

SEQ ID NO: 1620939 - DNA, 23 bp, Homo sapiens
ctggctcggacccaccccaactc

SEQ ID NO: 1620940 - DNA, 22 bp, Homo sapiens
ctggctcggggtaaaaagtggc

SEQ ID NO: 1620941 - DNA, 19 bp, Homo sapiens
ctggctctaattcacagtg

SEQ ID NO: 1620942 - DNA, 20 bp, Homo sapiens
ctggctctaattcacagtgc

SEQ ID NO: 1620943 - DNA, 13 bp, Homo sapiens
ctggctctcagag

SEQ ID NO: 1620944 - DNA, 15 bp, Homo sapiens
ctggctctcagagga

SEQ ID NO: 1620945 - DNA, 17 bp, Homo sapiens
ctggctctcagaggaaa

SEQ ID NO: 1620946 - DNA, 15 bp, Homo sapiens
ctggctctccaagtg

SEQ ID NO: 1620947 - DNA, 19 bp, Homo sapiens
ctggctctccaagtgccag

SEQ ID NO: 1620948 - DNA, 22 bp, Homo sapiens
ctggctctccaagtgccagagg

SEQ ID NO: 1620949 - DNA, 20 bp, Homo sapiens
ctggctctcccatttcctga

SEQ ID NO: 1620950 - DNA, 13 bp, Homo sapiens
ctggctctgagaa

SEQ ID NO: 1620951 - DNA, 21 bp, Homo sapiens
ctggctctgagcgcctccatc

SEQ ID NO: 1620952 - DNA, 14 bp, Homo sapiens
ctggctctgccccc

SEQ ID NO: 1620953 - DNA, 16 bp, Homo sapiens
ctggctctgtttgatg

SEQ ID NO: 1620954 - DNA, 20 bp, Homo sapiens
ctggctcttgatacccccct

SEQ ID NO: 1620955 - DNA, 22 bp, Homo sapiens
ctggctcttgatacccccctct

SEQ ID NO: 1620956 - DNA, 13 bp, Homo sapiens
ctggctgaaccct

SEQ ID NO: 1620957 - DNA, 16 bp, Homo sapiens
ctggctgagcccctgg

SEQ ID NO: 1620958 - DNA, 18 bp, Homo sapiens
ctggctgagcccctgggg

SEQ ID NO: 1620959 - DNA, 19 bp, Homo sapiens
ctggctgagcccctgggga

SEQ ID NO: 1620960 - DNA, 17 bp, Homo sapiens
ctggctgaggttcctct

SEQ ID NO: 1620961 - DNA, 20 bp, Homo sapiens
ctggctgaggttcctctgcc

SEQ ID NO: 1620962 - DNA, 22 bp, Homo sapiens
ctggctgaggttcctctgcctg

SEQ ID NO: 1620963 - DNA, 16 bp, Homo sapiens
ctggctgcagcggcag

SEQ ID NO: 1620964 - DNA, 13 bp, Homo sapiens
ctggctgccaggc

SEQ ID NO: 1620965 - DNA, 12 bp, Homo sapiens
ctggctgcccag

SEQ ID NO: 1620966 - DNA, 16 bp, Homo sapiens
ctggctgccccaacct

SEQ ID NO: 1620967 - DNA, 19 bp, Homo sapiens
ctggctgccccaacctgct

SEQ ID NO: 1620968 - DNA, 15 bp, Homo sapiens
ctggctgccctggcc

SEQ ID NO: 1620969 - DNA, 19 bp, Homo sapiens
ctggctgccctggccctga

SEQ ID NO: 1620970 - DNA, 14 bp, Homo sapiens
ctggctgccttaga

SEQ ID NO: 1620971 - DNA, 12 bp, Homo sapiens
ctggctgctgcc

SEQ ID NO: 1620972 - DNA, 14 bp, Homo sapiens
ctggctgctgcccc

SEQ ID NO: 1620973 - DNA, 15 bp, Homo sapiens
ctggctgctgccccc

SEQ ID NO: 1620974 - DNA, 14 bp, Homo sapiens
ctggctggagagct

SEQ ID NO: 1620975 - DNA, 12 bp, Homo sapiens
ctggctggcagg

SEQ ID NO: 1620976 - DNA, 13 bp, Homo sapiens
ctggctggcaggt

SEQ ID NO: 1620977 - DNA, 13 bp, Homo sapiens
ctggctggcctca

SEQ ID NO: 1620978 - DNA, 14 bp, Homo sapiens
ctggctggcctgag

SEQ ID NO: 1620979 - DNA, 15 bp, Homo sapiens
ctggctggctgcagt

SEQ ID NO: 1620980 - DNA, 17 bp, Homo sapiens
ctggctggctgcagtga

SEQ ID NO: 1620981 - DNA, 12 bp, Homo sapiens
ctggctgggcct

SEQ ID NO: 1620982 - DNA, 15 bp, Homo sapiens
ctggctggggcagag

SEQ ID NO: 1620983 - DNA, 19 bp, Homo sapiens
ctggctgtaaggctctaga

SEQ ID NO: 1620984 - DNA, 20 bp, Homo sapiens
ctggctgtctgcctgtattt

SEQ ID NO: 1620985 - DNA, 21 bp, Homo sapiens
ctggctgtctgcctgtatttt

SEQ ID NO: 1620986 - DNA, 19 bp, Homo sapiens
ctggctgtgaatgccaaag

SEQ ID NO: 1620987 - DNA, 17 bp, Homo sapiens
ctggctgtgacacctgg

SEQ ID NO: 1620988 - DNA, 18 bp, Homo sapiens
ctggctgtgacacctggt

SEQ ID NO: 1620989 - DNA, 22 bp, Homo sapiens
ctggctgtgagacgaggcaggg

SEQ ID NO: 1620990 - DNA, 14 bp, Homo sapiens
ctggctgtgagcag

SEQ ID NO: 1620991 - DNA, 15 bp, Homo sapiens
ctggctgtgcccagc

SEQ ID NO: 1620992 - DNA, 18 bp, Homo sapiens
ctggctgtgcccagcagg

SEQ ID NO: 1620993 - DNA, 14 bp, Homo sapiens
ctggctgtgcccct

SEQ ID NO: 1620994 - DNA, 18 bp, Homo sapiens
ctggctgtgcccctgatg

SEQ ID NO: 1620995 - DNA, 19 bp, Homo sapiens
ctggctgtgcccctgatgc

SEQ ID NO: 1620996 - DNA, 16 bp, Homo sapiens
ctggctgtggaggcct

SEQ ID NO: 1620997 - DNA, 14 bp, Homo sapiens
ctggcttagtgcca

SEQ ID NO: 1620998 - DNA, 21 bp, Homo sapiens
ctggcttagtgccacccacct

SEQ ID NO: 1620999 - DNA, 12 bp, Homo sapiens
ctggcttattta

SEQ ID NO: 1621000 - DNA, 20 bp, Homo sapiens
ctggcttcagcccccaccag

SEQ ID NO: 1621001 - DNA, 14 bp, Homo sapiens
ctggcttctctctt

SEQ ID NO: 1621002 - DNA, 15 bp, Homo sapiens
ctggcttctctcttt

SEQ ID NO: 1621003 - DNA, 21 bp, Homo sapiens
ctggcttctctcttttcctcc

SEQ ID NO: 1621004 - DNA, 23 bp, Homo sapiens
ctggcttctctcttttcctcctc

SEQ ID NO: 1621005 - DNA, 14 bp, Homo sapiens
ctggcttctggagc

SEQ ID NO: 1621006 - DNA, 13 bp, Homo sapiens
ctggcttgctcca

SEQ ID NO: 1621007 - DNA, 19 bp, Homo sapiens
ctggcttgctccagggtct

SEQ ID NO: 1621008 - DNA, 14 bp, Homo sapiens
ctggcttggaggct

SEQ ID NO: 1621009 - DNA, 17 bp, Homo sapiens
ctggcttgtaactccac

SEQ ID NO: 1621010 - DNA, 20 bp, Homo sapiens
ctggcttgtaactccaccaa

SEQ ID NO: 1621011 - DNA, 16 bp, Homo sapiens
ctggcttgtttgattt

SEQ ID NO: 1621012 - DNA, 16 bp, Homo sapiens
ctggctttaagccttc

SEQ ID NO: 1621013 - DNA, 12 bp, Homo sapiens
ctggctttctct

SEQ ID NO: 1621014 - DNA, 21 bp, Homo sapiens
ctggctttctctctggcttct

SEQ ID NO: 1621015 - DNA, 23 bp, Homo sapiens
ctggctttctctctggcttctct

SEQ ID NO: 1621016 - DNA, 14 bp, Homo sapiens
ctggctttgagaag

SEQ ID NO: 1621017 - DNA, 13 bp, Homo sapiens
ctggctttgcctc

SEQ ID NO: 1621018 - DNA, 21 bp, Homo sapiens
ctggctttgcctcttctttgt

SEQ ID NO: 1621019 - DNA, 22 bp, Homo sapiens
ctggctttgcctcttctttgtg

SEQ ID NO: 1621020 - DNA, 15 bp, Homo sapiens
ctggctttgctctat

SEQ ID NO: 1621021 - DNA, 19 bp, Homo sapiens
ctggctttgggcaggtctg

SEQ ID NO: 1621022 - DNA, 19 bp, Homo sapiens
ctggcttttcactgctggc

SEQ ID NO: 1621023 - DNA, 22 bp, Homo sapiens
ctggcttttcactgctggctgc

SEQ ID NO: 1621024 - DNA, 21 bp, Homo sapiens
ctggcttttgcctgtaagaaa

SEQ ID NO: 1621025 - DNA, 16 bp, Homo sapiens
ctggctttttctgcca

SEQ ID NO: 1621026 - DNA, 17 bp, Homo sapiens
ctggctttttctgccac

SEQ ID NO: 1621027 - DNA, 18 bp, Homo sapiens
ctggctttttctgccact

SEQ ID NO: 1621028 - DNA, 17 bp, Homo sapiens
ctggcttttttgtgggg

SEQ ID NO: 1621029 - DNA, 23 bp, Homo sapiens
ctgggaaaaactttggaaccaga

SEQ ID NO: 1621030 - DNA, 17 bp, Homo sapiens
ctgggaaagcataaagc

SEQ ID NO: 1621031 - DNA, 16 bp, Homo sapiens
ctgggaaaggacccac

SEQ ID NO: 1621032 - DNA, 21 bp, Homo sapiens
ctgggaaaggacccacccatc

SEQ ID NO: 1621033 - DNA, 12 bp, Homo sapiens
ctgggaaagtta

SEQ ID NO: 1621034 - DNA, 23 bp, Homo sapiens
ctgggaacatcacattcctctgc

SEQ ID NO: 1621035 - DNA, 16 bp, Homo sapiens
ctgggaacatgaccca

SEQ ID NO: 1621036 - DNA, 21 bp, Homo sapiens
ctgggaacatgacccagcctg

SEQ ID NO: 1621037 - DNA, 17 bp, Homo sapiens
ctgggaaccccgcagcc

SEQ ID NO: 1621038 - DNA, 21 bp, Homo sapiens
ctgggaaccccgcagcccgtg

SEQ ID NO: 1621039 - DNA, 19 bp, Homo sapiens
ctgggaagaagcaagggca

SEQ ID NO: 1621040 - DNA, 20 bp, Homo sapiens
ctgggaagataggctctgca

SEQ ID NO: 1621041 - DNA, 19 bp, Homo sapiens
ctgggaagctgtactcaga

SEQ ID NO: 1621042 - DNA, 21 bp, Homo sapiens
ctgggaagctgtactcagagc

SEQ ID NO: 1621043 - DNA, 22 bp, Homo sapiens
ctgggaagcttgagcctccccc

SEQ ID NO: 1621044 - DNA, 20 bp, Homo sapiens
ctgggaaggagggagctgct

SEQ ID NO: 1621045 - DNA, 15 bp, Homo sapiens
ctgggaaggccacct

SEQ ID NO: 1621046 - DNA, 14 bp, Homo sapiens
ctgggaaggctaag

SEQ ID NO: 1621047 - DNA, 20 bp, Homo sapiens
ctgggaagggagagggcctc

SEQ ID NO: 1621048 - DNA, 23 bp, Homo sapiens
ctgggaatggggacacggtgtcc

SEQ ID NO: 1621049 - DNA, 22 bp, Homo sapiens
ctgggaatgtattattctgcag

SEQ ID NO: 1621050 - DNA, 22 bp, Homo sapiens
ctgggacaccattaccaaaata

SEQ ID NO: 1621051 - DNA, 23 bp, Homo sapiens
ctgggacacttaacagatgcaat

SEQ ID NO: 1621052 - DNA, 17 bp, Homo sapiens
ctgggacagctggctgg

SEQ ID NO: 1621053 - DNA, 20 bp, Homo sapiens
ctgggacagctggctgggcc

SEQ ID NO: 1621054 - DNA, 22 bp, Homo sapiens
ctgggacagctggctgggcctt

SEQ ID NO: 1621055 - DNA, 20 bp, Homo sapiens
ctgggacatcaggagactgg

SEQ ID NO: 1621056 - DNA, 22 bp, Homo sapiens
ctgggaccacaggttcatgcca

SEQ ID NO: 1621057 - DNA, 13 bp, Homo sapiens
ctggatcagtcct

SEQ ID NO: 1621058 - DNA, 16 bp, Homo sapiens
ctggatccagcactgg

SEQ ID NO: 1621059 - DNA, 17 bp, Homo sapiens
ctggatccagcactggt

SEQ ID NO: 1621060 - DNA, 21 bp, Homo sapiens
ctggatccatcttgagccaca

SEQ ID NO: 1621061 - DNA, 17 bp, Homo sapiens
ctggatccatgggggga

SEQ ID NO: 1621062 - DNA, 23 bp, Homo sapiens
ctggatccatggggggagaagtg

SEQ ID NO: 1621063 - DNA, 22 bp, Homo sapiens
ctggatcccgaggtatggcaga

SEQ ID NO: 1621064 - DNA, 21 bp, Homo sapiens
ctggatccctgcccttctcaa

SEQ ID NO: 1621065 - DNA, 19 bp, Homo sapiens
ctggatctagaagggacca

SEQ ID NO: 1621066 - DNA, 16 bp, Homo sapiens
ctggatctatccctgc

SEQ ID NO: 1621067 - DNA, 19 bp, Homo sapiens
ctggatctcctgctgcctt

SEQ ID NO: 1621068 - DNA, 20 bp, Homo sapiens
ctggatctgggaccctttcc

SEQ ID NO: 1621069 - DNA, 17 bp, Homo sapiens
ctggatcttctatcatt

SEQ ID NO: 1621070 - DNA, 23 bp, Homo sapiens
ctggatcttgcctaaatcccaag

SEQ ID NO: 1621071 - DNA, 13 bp, Homo sapiens
ctggatgaagatt

SEQ ID NO: 1621072 - DNA, 21 bp, Homo sapiens
ctggatgagaaacagctcagc

SEQ ID NO: 1621073 - DNA, 22 bp, Homo sapiens
ctggatgagaaacagctcagcc

SEQ ID NO: 1621074 - DNA, 23 bp, Homo sapiens
ctggatgagaaacagctcagcca

SEQ ID NO: 1621075 - DNA, 22 bp, Homo sapiens
ctggatgatttcatcttctgga

SEQ ID NO: 1621076 - DNA, 18 bp, Homo sapiens
ctggatgcacagatgcca

SEQ ID NO: 1621077 - DNA, 21 bp, Homo sapiens
ctggatgcacagatgccatgg

SEQ ID NO: 1621078 - DNA, 22 bp, Homo sapiens
ctggatgcacagatgccatggc

SEQ ID NO: 1621079 - DNA, 17 bp, Homo sapiens
ctggatgccaaggagcc

SEQ ID NO: 1621080 - DNA, 18 bp, Homo sapiens
ctggatgccaaggagccc

SEQ ID NO: 1621081 - DNA, 19 bp, Homo sapiens
ctggatgccaaggagcccc

SEQ ID NO: 1621082 - DNA, 20 bp, Homo sapiens
ctggatgccaaggagcccct

SEQ ID NO: 1621083 - DNA, 22 bp, Homo sapiens
ctggatgcctcattatgtcaac

SEQ ID NO: 1621084 - DNA, 17 bp, Homo sapiens
ctggatggaaagacaaa

SEQ ID NO: 1621085 - DNA, 21 bp, Homo sapiens
ctggatggaggaaaaccaagc

SEQ ID NO: 1621086 - DNA, 18 bp, Homo sapiens
ctggatggcacctcaggc

SEQ ID NO: 1621087 - DNA, 20 bp, Homo sapiens
ctggatggcacctcaggctg

SEQ ID NO: 1621088 - DNA, 20 bp, Homo sapiens
ctggatggccgggctgctgc

SEQ ID NO: 1621089 - DNA, 22 bp, Homo sapiens
ctggatgggggtgcaggcagcc

SEQ ID NO: 1621090 - DNA, 15 bp, Homo sapiens
ctggatgtaaatcct

SEQ ID NO: 1621091 - DNA, 19 bp, Homo sapiens
ctggatgtcccctgtccca

SEQ ID NO: 1621092 - DNA, 20 bp, Homo sapiens
ctggatgtcccctgtcccac

SEQ ID NO: 1621093 - DNA, 15 bp, Homo sapiens
ctggatgtctgccaa

SEQ ID NO: 1621094 - DNA, 23 bp, Homo sapiens
ctggattctacaaaaaaccagga

SEQ ID NO: 1621095 - DNA, 18 bp, Homo sapiens
ctggattctgggaggcaa

SEQ ID NO: 1621096 - DNA, 19 bp, Homo sapiens
ctggattctgggaggcaag

SEQ ID NO: 1621097 - DNA, 19 bp, Homo sapiens
ctggattgcagactgttct

SEQ ID NO: 1621098 - DNA, 12 bp, Homo sapiens
ctggattggcca

SEQ ID NO: 1621099 - DNA, 20 bp, Homo sapiens
ctggattggctataacatgt

SEQ ID NO: 1621100 - DNA, 13 bp, Homo sapiens
ctggatttgatga

SEQ ID NO: 1621101 - DNA, 20 bp, Homo sapiens
ctggatttgggagctctgct

SEQ ID NO: 1621102 - DNA, 16 bp, Homo sapiens
ctgctcgtggactgtg

SEQ ID NO: 1621103 - DNA, 18 bp, Homo sapiens
ctgctcgtggactgtgct

SEQ ID NO: 1621104 - DNA, 19 bp, Homo sapiens
ctgctctaacacctgccta

SEQ ID NO: 1621105 - DNA, 23 bp, Homo sapiens
ctgctctagccaggagtctgtgc

SEQ ID NO: 1621106 - DNA, 14 bp, Homo sapiens
ctgctctagctggc

SEQ ID NO: 1621107 - DNA, 16 bp, Homo sapiens
ctgctctagctggcag

SEQ ID NO: 1621108 - DNA, 18 bp, Homo sapiens
ctgctctagctggcagga

SEQ ID NO: 1621109 - DNA, 23 bp, Homo sapiens
ctgctctagtgggacagcccaga

SEQ ID NO: 1621110 - DNA, 15 bp, Homo sapiens
ctgctctattgtagc

SEQ ID NO: 1621111 - DNA, 13 bp, Homo sapiens
ctgctctcagcct

SEQ ID NO: 1621112 - DNA, 16 bp, Homo sapiens
ctgctctcagcctccc

SEQ ID NO: 1621113 - DNA, 19 bp, Homo sapiens
ctgctctccgcgcctaccc

SEQ ID NO: 1621114 - DNA, 12 bp, Homo sapiens
ctgctctccttc

SEQ ID NO: 1621115 - DNA, 13 bp, Homo sapiens
ctgctctccttcc

SEQ ID NO: 1621116 - DNA, 17 bp, Homo sapiens
ctgctctccttcctgga

SEQ ID NO: 1621117 - DNA, 19 bp, Homo sapiens
ctgctctccttcctggagc

SEQ ID NO: 1621118 - DNA, 20 bp, Homo sapiens
ctgctctccttcctggagcc

SEQ ID NO: 1621119 - DNA, 16 bp, Homo sapiens
ctgctctcttcaggag

SEQ ID NO: 1621120 - DNA, 13 bp, Homo sapiens
ctgctctgagaat

SEQ ID NO: 1621121 - DNA, 13 bp, Homo sapiens
ctgctctgagcca

SEQ ID NO: 1621122 - DNA, 16 bp, Homo sapiens
ctgctctgagccacag

SEQ ID NO: 1621123 - DNA, 19 bp, Homo sapiens
ctgctctgccatcttcagg

SEQ ID NO: 1621124 - DNA, 14 bp, Homo sapiens
ctgctctgcccctt

SEQ ID NO: 1621125 - DNA, 23 bp, Homo sapiens
ctgctctgccccttgggcatcca

SEQ ID NO: 1621126 - DNA, 22 bp, Homo sapiens
ctgctctgcccttgttccctag

SEQ ID NO: 1621127 - DNA, 13 bp, Homo sapiens
ctgctctgcctgg

SEQ ID NO: 1621128 - DNA, 15 bp, Homo sapiens
ctgctctgcctggag

SEQ ID NO: 1621129 - DNA, 22 bp, Homo sapiens
ctgctctggaataaagttgcag

SEQ ID NO: 1621130 - DNA, 15 bp, Homo sapiens
ctgctctgggacgtg

SEQ ID NO: 1621131 - DNA, 17 bp, Homo sapiens
ctgctcttagtgcccgc

SEQ ID NO: 1621132 - DNA, 18 bp, Homo sapiens
ctgctcttagtgcccgcc

SEQ ID NO: 1621133 - DNA, 17 bp, Homo sapiens
ctgctcttccaaagctc

SEQ ID NO: 1621134 - DNA, 17 bp, Homo sapiens
ctgctctttctctgcca

SEQ ID NO: 1621135 - DNA, 19 bp, Homo sapiens
ctgctctttctctgccagt

SEQ ID NO: 1621136 - DNA, 20 bp, Homo sapiens
ctgctctttctctgccagtg

SEQ ID NO: 1621137 - DNA, 19 bp, Homo sapiens
ctgctcttttgtgatgaac

SEQ ID NO: 1621138 - DNA, 21 bp, Homo sapiens
ctgctcttttgtgatgaacat

SEQ ID NO: 1621139 - DNA, 13 bp, Homo sapiens
ctgctgaaacaac

SEQ ID NO: 1621140 - DNA, 17 bp, Homo sapiens
ctgctgaagttctgagc

SEQ ID NO: 1621141 - DNA, 23 bp, Homo sapiens
ctgctgaatgatttccaaagaga

SEQ ID NO: 1621142 - DNA, 16 bp, Homo sapiens
ctgctgaatgcctcgc

SEQ ID NO: 1621143 - DNA, 22 bp, Homo sapiens
ctgctgaatgcctcgctccctt

SEQ ID NO: 1621144 - DNA, 20 bp, Homo sapiens
ctgctgacagacactaactt

SEQ ID NO: 1621145 - DNA, 22 bp, Homo sapiens
ctgctgaccaattgtgctgcca

SEQ ID NO: 1621146 - DNA, 19 bp, Homo sapiens
ctgctgacctcactgtcct

SEQ ID NO: 1621147 - DNA, 16 bp, Homo sapiens
ctgctgagagacccaa

SEQ ID NO: 1621148 - DNA, 15 bp, Homo sapiens
ctgctgaggcccagt

SEQ ID NO: 1621149 - DNA, 19 bp, Homo sapiens
ctgctgagggaccttggag

SEQ ID NO: 1621150 - DNA, 21 bp, Homo sapiens
ctgctgagggaccttggagag

SEQ ID NO: 1621151 - DNA, 13 bp, Homo sapiens
ctgctgagtaagg

SEQ ID NO: 1621152 - DNA, 15 bp, Homo sapiens
ctgctgagttggcct

SEQ ID NO: 1621153 - DNA, 16 bp, Homo sapiens
ctgctgagttggcctg

SEQ ID NO: 1621154 - DNA, 18 bp, Homo sapiens
ctgctgatatcaacagct

SEQ ID NO: 1621155 - DNA, 20 bp, Homo sapiens
ctgctgatatcaacagcttc

SEQ ID NO: 1621156 - DNA, 12 bp, Homo sapiens
ctgctgatgcag

SEQ ID NO: 1621157 - DNA, 18 bp, Homo sapiens
ctgctgatgtaggagctg

SEQ ID NO: 1621158 - DNA, 19 bp, Homo sapiens
ctgctgatgtaggagctgg

SEQ ID NO: 1621159 - DNA, 17 bp, Homo sapiens
ctgctgcaccagagtga

SEQ ID NO: 1621160 - DNA, 21 bp, Homo sapiens
ctgctgcaccagagtgaaagg

SEQ ID NO: 1621161 - DNA, 16 bp, Homo sapiens
ctgctgcatagctcta

SEQ ID NO: 1621162 - DNA, 13 bp, Homo sapiens
ctgctgccccagc

SEQ ID NO: 1621163 - DNA, 14 bp, Homo sapiens
ctgctgccccagct

SEQ ID NO: 1621164 - DNA, 16 bp, Homo sapiens
ctgctgccccagctga

SEQ ID NO: 1621165 - DNA, 14 bp, Homo sapiens
ctgctgcccccacc

SEQ ID NO: 1621166 - DNA, 15 bp, Homo sapiens
ctgctgcccccaccc

SEQ ID NO: 1621167 - DNA, 16 bp, Homo sapiens
ctgctgcccctgcagt

SEQ ID NO: 1621168 - DNA, 17 bp, Homo sapiens
ctgctgcccctgcagtt

SEQ ID NO: 1621169 - DNA, 20 bp, Homo sapiens
ctgctgccctcccacagcct

SEQ ID NO: 1621170 - DNA, 15 bp, Homo sapiens
ctgctgccggctctg

SEQ ID NO: 1621171 - DNA, 19 bp, Homo sapiens
ctgctgccggctctgggcc

SEQ ID NO: 1621172 - DNA, 15 bp, Homo sapiens
ctgctgcctctgaaa

SEQ ID NO: 1621173 - DNA, 13 bp, Homo sapiens
ctgctgcctcttt

SEQ ID NO: 1621174 - DNA, 17 bp, Homo sapiens
ctgctgccttttctgga

SEQ ID NO: 1621175 - DNA, 19 bp, Homo sapiens
ctgctgccttttctggagt

SEQ ID NO: 1621176 - DNA, 14 bp, Homo sapiens
ctgctgcggaggag

SEQ ID NO: 1621177 - DNA, 15 bp, Homo sapiens
ctgctgcggctgtgg

SEQ ID NO: 1621178 - DNA, 16 bp, Homo sapiens
ctgctgcggctgtggg

SEQ ID NO: 1621179 - DNA, 17 bp, Homo sapiens
ctgctgcggctgtgggc

SEQ ID NO: 1621180 - DNA, 16 bp, Homo sapiens
ctgctgcgtccccact

SEQ ID NO: 1621181 - DNA, 17 bp, Homo sapiens
ctgctgcgtccccactc

SEQ ID NO: 1621182 - DNA, 14 bp, Homo sapiens
ctgctgctactgct

SEQ ID NO: 1621183 - DNA, 16 bp, Homo sapiens
ctgctgctactgctgc

SEQ ID NO: 1621184 - DNA, 13 bp, Homo sapiens
ctgctgctgcccg

SEQ ID NO: 1621185 - DNA, 14 bp, Homo sapiens
ctgctgctgcccgg

SEQ ID NO: 1621186 - DNA, 20 bp, Homo sapiens
ctgctgctgcgcccttacct

SEQ ID NO: 1621187 - DNA, 16 bp, Homo sapiens
ctgctgctgctgcgcc

SEQ ID NO: 1621188 - DNA, 21 bp, Homo sapiens
ctgctgctgtaactgctgagc

SEQ ID NO: 1621189 - DNA, 22 bp, Homo sapiens
ctgctgctgtaactgctgagcc

SEQ ID NO: 1621190 - DNA, 23 bp, Homo sapiens
ctgctgctgtaactgctgagcca

SEQ ID NO: 1621191 - DNA, 16 bp, Homo sapiens
ctgctggaagcccagc

SEQ ID NO: 1621192 - DNA, 19 bp, Homo sapiens
ctgctggaaggggcagcag

SEQ ID NO: 1621193 - DNA, 21 bp, Homo sapiens
ctgctggaaggggcagcagga

SEQ ID NO: 1621194 - DNA, 22 bp, Homo sapiens
ctgctggagaataaatttggga

SEQ ID NO: 1621195 - DNA, 15 bp, Homo sapiens
ctgctggaggcctca

SEQ ID NO: 1621196 - DNA, 11 bp, Homo sapiens
ctgctggcagg

SEQ ID NO: 1621197 - DNA, 12 bp, Homo sapiens
ctgctggccaaa

SEQ ID NO: 1621198 - DNA, 12 bp, Homo sapiens
ctgctggccagg

SEQ ID NO: 1621199 - DNA, 22 bp, Homo sapiens
ctgctggcccagccaaaccctg

SEQ ID NO: 1621200 - DNA, 12 bp, Homo sapiens
ctgctggcctgg

SEQ ID NO: 1621201 - DNA, 16 bp, Homo sapiens
ctgctggcctggatct

SEQ ID NO: 1621202 - DNA, 12 bp, Homo sapiens
ctgctggctgcc

SEQ ID NO: 1621203 - DNA, 13 bp, Homo sapiens
ctgctggctgcct

SEQ ID NO: 1621204 - DNA, 14 bp, Homo sapiens
ctgctggctgcctt

SEQ ID NO: 1621205 - DNA, 17 bp, Homo sapiens
ctgctgggaaccccgca

SEQ ID NO: 1621206 - DNA, 22 bp, Homo sapiens
ctgctgggaaccccgcagcccg

SEQ ID NO: 1621207 - DNA, 17 bp, Homo sapiens
ctgctgggacccacctc

SEQ ID NO: 1621208 - DNA, 19 bp, Homo sapiens
ctgctgggacccacctccc

SEQ ID NO: 1621209 - DNA, 19 bp, Homo sapiens
ctgctgggactggccaggt

SEQ ID NO: 1621210 - DNA, 22 bp, Homo sapiens
ctgctgggctctccacctcagc

SEQ ID NO: 1621211 - DNA, 23 bp, Homo sapiens
ctgctgggctctccacctcagcc

SEQ ID NO: 1621212 - DNA, 13 bp, Homo sapiens
ctgctgggctctg

SEQ ID NO: 1621213 - DNA, 16 bp, Homo sapiens
ctgctgggctgagtga

SEQ ID NO: 1621214 - DNA, 18 bp, Homo sapiens
ctgctgggctgagtgaca

SEQ ID NO: 1621215 - DNA, 22 bp, Homo sapiens
ctgctgggctgagtgacacaag

SEQ ID NO: 1621216 - DNA, 11 bp, Homo sapiens
ctgctgggctt

SEQ ID NO: 1621217 - DNA, 14 bp, Homo sapiens
ctgctggggaagac

SEQ ID NO: 1621218 - DNA, 17 bp, Homo sapiens
ctgctggggaagacagt

SEQ ID NO: 1621219 - DNA, 21 bp, Homo sapiens
ctgctggggaagacagtggcc

SEQ ID NO: 1621220 - DNA, 19 bp, Homo sapiens
ctgctggggaagggttttc

SEQ ID NO: 1621221 - DNA, 20 bp, Homo sapiens
ctgctggggaagggttttct

SEQ ID NO: 1621222 - DNA, 14 bp, Homo sapiens
ctgctggggatccc

SEQ ID NO: 1621223 - DNA, 12 bp, Homo sapiens
ctgctggggatt

SEQ ID NO: 1621224 - DNA, 14 bp, Homo sapiens
ctgctggggcatgt

SEQ ID NO: 1621225 - DNA, 18 bp, Homo sapiens
ctgctggggcatgtgtgc

SEQ ID NO: 1621226 - DNA, 20 bp, Homo sapiens
ctgctggggcatgtgtgcct

SEQ ID NO: 1621227 - DNA, 15 bp, Homo sapiens
ctgctggtacctgcc

SEQ ID NO: 1621228 - DNA, 18 bp, Homo sapiens
ctgctggtacctgccctc

SEQ ID NO: 1621229 - DNA, 15 bp, Homo sapiens
ctgctggtatttcta

SEQ ID NO: 1621230 - DNA, 16 bp, Homo sapiens
ctgctggtatttctaa

SEQ ID NO: 1621231 - DNA, 19 bp, Homo sapiens
ctgctggttgttgccaggt

SEQ ID NO: 1621232 - DNA, 21 bp, Homo sapiens
ctgctggttttaacaactgtg

SEQ ID NO: 1621233 - DNA, 16 bp, Homo sapiens
ctgctgtaactgctga

SEQ ID NO: 1621234 - DNA, 20 bp, Homo sapiens
ctgctgtaactgctgagcca

SEQ ID NO: 1621235 - DNA, 21 bp, Homo sapiens
ctgctgtccacatgacctcca

SEQ ID NO: 1621236 - DNA, 13 bp, Homo sapiens
ctgctgtcctggt

SEQ ID NO: 1621237 - DNA, 15 bp, Homo sapiens
ctgctgtcctggtgg

SEQ ID NO: 1621238 - DNA, 14 bp, Homo sapiens
ctgctgtcctttta

SEQ ID NO: 1621239 - DNA, 15 bp, Homo sapiens
ctgctgtctctctgg

SEQ ID NO: 1621240 - DNA, 19 bp, Homo sapiens
ctgctgtgaaaactctggt

SEQ ID NO: 1621241 - DNA, 22 bp, Homo sapiens
ctgctgtgaaccctggggcctg

SEQ ID NO: 1621242 - DNA, 9 bp, Homo sapiens
ctgctgtgc

SEQ ID NO: 1621243 - DNA, 17 bp, Homo sapiens
ctgctgtgccatgctgg

SEQ ID NO: 1621244 - DNA, 21 bp, Homo sapiens
ctgcgtttggaggcccctggg

SEQ ID NO: 1621245 - DNA, 13 bp, Homo sapiens
ctgctaaataaac

SEQ ID NO: 1621246 - DNA, 20 bp, Homo sapiens
ctgctaacttggagccccag

SEQ ID NO: 1621247 - DNA, 23 bp, Homo sapiens
ctgctaacttggagccccagtgc

SEQ ID NO: 1621248 - DNA, 17 bp, Homo sapiens
ctgctaagtatttccca

SEQ ID NO: 1621249 - DNA, 16 bp, Homo sapiens
ctgctaagttctccca

SEQ ID NO: 1621250 - DNA, 23 bp, Homo sapiens
ctgctaatcatgtgggtgagcca

SEQ ID NO: 1621251 - DNA, 12 bp, Homo sapiens
ctgctacagcaa

SEQ ID NO: 1621252 - DNA, 12 bp, Homo sapiens
ctgctacctcac

SEQ ID NO: 1621253 - DNA, 14 bp, Homo sapiens
ctgctacctcactg

SEQ ID NO: 1621254 - DNA, 17 bp, Homo sapiens
ctgctacctcactgggg

SEQ ID NO: 1621255 - DNA, 21 bp, Homo sapiens
ctgccattgggaccctccagt

SEQ ID NO: 1621256 - DNA, 23 bp, Homo sapiens
ctgccatttcccttctggacact

SEQ ID NO: 1621257 - DNA, 21 bp, Homo sapiens
ctgccatttgcaccctccgcc

SEQ ID NO: 1621258 - DNA, 17 bp, Homo sapiens
ctgcccaaaaatatggt

SEQ ID NO: 1621259 - DNA, 20 bp, Homo sapiens
ctgcccaacccttccctcac

SEQ ID NO: 1621260 - DNA, 16 bp, Homo sapiens
ctgcccaatgctttgg

SEQ ID NO: 1621261 - DNA, 19 bp, Homo sapiens
ctgcccacagtctttccgt

SEQ ID NO: 1621262 - DNA, 17 bp, Homo sapiens
ctgcccacatttgggct

SEQ ID NO: 1621263 - DNA, 19 bp, Homo sapiens
ctgcccacatttgggctca

SEQ ID NO: 1621264 - DNA, 20 bp, Homo sapiens
ctgcccacatttgggctcag

SEQ ID NO: 1621265 - DNA, 12 bp, Homo sapiens
ctgcccaccccc

SEQ ID NO: 1621266 - DNA, 13 bp, Homo sapiens
ctgcccaccccct

SEQ ID NO: 1621267 - DNA, 19 bp, Homo sapiens
ctgcccacctcggcctccc

SEQ ID NO: 1621268 - DNA, 24 bp, Homo sapiens
ctgcccacttagccgtccatggca

SEQ ID NO: 1621269 - DNA, 23 bp, Homo sapiens
ctgcccagaacccttcctgagac

SEQ ID NO: 1621270 - DNA, 21 bp, Homo sapiens
ctgcccagacccctctggcca

SEQ ID NO: 1621271 - DNA, 18 bp, Homo sapiens
ctgcccaggcagtctttg

SEQ ID NO: 1621272 - DNA, 20 bp, Homo sapiens
ctgcccaggcagtctttgct

SEQ ID NO: 1621273 - DNA, 22 bp, Homo sapiens
ctgcccaggcagtctttgctca

SEQ ID NO: 1621274 - DNA, 16 bp, Homo sapiens
ctgcccaggggtgccc

SEQ ID NO: 1621275 - DNA, 18 bp, Homo sapiens
ctgcccaggggtgccccc

SEQ ID NO: 1621276 - DNA, 22 bp, Homo sapiens
ctgcccaggggtgccccctcct

SEQ ID NO: 1621277 - DNA, 17 bp, Homo sapiens
ctgcccagtcgacccca

SEQ ID NO: 1621278 - DNA, 12 bp, Homo sapiens
ctgcccagtgca

SEQ ID NO: 1621279 - DNA, 22 bp, Homo sapiens
ctgcccagtgcaaaccacttct

SEQ ID NO: 1621280 - DNA, 13 bp, Homo sapiens
ctgcccagttgca

SEQ ID NO: 1621281 - DNA, 18 bp, Homo sapiens
ctgcccatcccagtccct

SEQ ID NO: 1621282 - DNA, 17 bp, Homo sapiens
ctgccccaactcctgga

SEQ ID NO: 1621283 - DNA, 20 bp, Homo sapiens
ctgccccaactcctggaagc

SEQ ID NO: 1621284 - DNA, 15 bp, Homo sapiens
ctgccccaagcagcc

SEQ ID NO: 1621285 - DNA, 19 bp, Homo sapiens
ctgccccaagcagccagcc

SEQ ID NO: 1621286 - DNA, 13 bp, Homo sapiens
ctgccccaagccc

SEQ ID NO: 1621287 - DNA, 14 bp, Homo sapiens
ctgccccaagcccc

SEQ ID NO: 1621288 - DNA, 16 bp, Homo sapiens
ctgccccaagggccca

SEQ ID NO: 1621289 - DNA, 15 bp, Homo sapiens
ctgccccaatcgggt

SEQ ID NO: 1621290 - DNA, 21 bp, Homo sapiens
ctgccccaatcgggtccagag

SEQ ID NO: 1621291 - DNA, 23 bp, Homo sapiens
ctgccccaatcgggtccagagac

SEQ ID NO: 1621292 - DNA, 21 bp, Homo sapiens
ctgccccacataattctgtta

SEQ ID NO: 1621293 - DNA, 16 bp, Homo sapiens
ctgccccaccccacct

SEQ ID NO: 1621294 - DNA, 18 bp, Homo sapiens
ctgccccaccccatccag

SEQ ID NO: 1621295 - DNA, 18 bp, Homo sapiens
ctgccccagcctgtcctt

SEQ ID NO: 1621296 - DNA, 13 bp, Homo sapiens
ctgccccagctct

SEQ ID NO: 1621297 - DNA, 15 bp, Homo sapiens
ctgccccagctctgg

SEQ ID NO: 1621298 - DNA, 16 bp, Homo sapiens
ctgccccagctctggc

SEQ ID NO: 1621299 - DNA, 12 bp, Homo sapiens
ctgccccaggcc

SEQ ID NO: 1621300 - DNA, 17 bp, Homo sapiens
ctgccccaggccctact

SEQ ID NO: 1621301 - DNA, 13 bp, Homo sapiens
ctgccccaggccg

SEQ ID NO: 1621302 - DNA, 19 bp, Homo sapiens
ctgccccaggccggagccc

SEQ ID NO: 1621303 - DNA, 20 bp, Homo sapiens
ctgccccaggccggagccca

SEQ ID NO: 1621304 - DNA, 15 bp, Homo sapiens
ctgccccaggcctga

SEQ ID NO: 1621305 - DNA, 21 bp, Homo sapiens
ctgccccatcattgcacctgc

SEQ ID NO: 1621306 - DNA, 14 bp, Homo sapiens
ctgcccccaggact

SEQ ID NO: 1621307 - DNA, 15 bp, Homo sapiens
ctgcccccaggactg

SEQ ID NO: 1621308 - DNA, 20 bp, Homo sapiens
ctgcccccatctccccaggc

SEQ ID NO: 1621309 - DNA, 21 bp, Homo sapiens
ctgcccccatctccccaggcc

SEQ ID NO: 1621310 - DNA, 22 bp, Homo sapiens
ctgcccccatctccccaggcct

SEQ ID NO: 1621311 - DNA, 23 bp, Homo sapiens
ctgcccccatctccccaggcctc

SEQ ID NO: 1621312 - DNA, 21 bp, Homo sapiens
ctgccccccaaggttctggtt

SEQ ID NO: 1621313 - DNA, 22 bp, Homo sapiens
ctgccccccaaggttctggttc

SEQ ID NO: 1621314 - DNA, 17 bp, Homo sapiens
ctgccccccctaagaga

SEQ ID NO: 1621315 - DNA, 18 bp, Homo sapiens
ctgccccccctaagagac

SEQ ID NO: 1621316 - DNA, 11 bp, Homo sapiens
ctgccccccgc

SEQ ID NO: 1621317 - DNA, 22 bp, Homo sapiens
ctgcccccgcgggttctagacg

SEQ ID NO: 1621318 - DNA, 22 bp, Homo sapiens
ctgcccccgctcccgctcccag

SEQ ID NO: 1621319 - DNA, 16 bp, Homo sapiens
ctgcccccgttccagc

SEQ ID NO: 1621320 - DNA, 20 bp, Homo sapiens
ctgccccctcccccatgggc

SEQ ID NO: 1621321 - DNA, 22 bp, Homo sapiens
ctgccccctcccccatgggctg

SEQ ID NO: 1621322 - DNA, 18 bp, Homo sapiens
ctgccccctgctgccatg

SEQ ID NO: 1621323 - DNA, 13 bp, Homo sapiens
ctgccccctggtg

SEQ ID NO: 1621324 - DNA, 18 bp, Homo sapiens
ctgccccgcccccagtcc

SEQ ID NO: 1621325 - DNA, 13 bp, Homo sapiens
ctgccccgcttcc

SEQ ID NO: 1621326 - DNA, 14 bp, Homo sapiens
ctgccccgcttccc

SEQ ID NO: 1621327 - DNA, 19 bp, Homo sapiens
ctgccccggagctggagga

SEQ ID NO: 1621328 - DNA, 22 bp, Homo sapiens
ctgccccggcccctccccctga

SEQ ID NO: 1621329 - DNA, 21 bp, Homo sapiens
ctgccccgggtccccagctcc

SEQ ID NO: 1621330 - DNA, 23 bp, Homo sapiens
ctgccccgggtccccagctcccc

SEQ ID NO: 1621331 - DNA, 16 bp, Homo sapiens
ctgccccgttccctgt

SEQ ID NO: 1621332 - DNA, 18 bp, Homo sapiens
ctgccccgttccctgtca

SEQ ID NO: 1621333 - DNA, 20 bp, Homo sapiens
ctgccccgttccctgtcaga

SEQ ID NO: 1621334 - DNA, 21 bp, Homo sapiens
ctgccccgttccctgtcagag

SEQ ID NO: 1621335 - DNA, 22 bp, Homo sapiens
ctgccccgttccctgtcagagg

SEQ ID NO: 1621336 - DNA, 23 bp, Homo sapiens
ctgccccgttccctgtcagaggc

SEQ ID NO: 1621337 - DNA, 21 bp, Homo sapiens
ctgcccctaccctggacttgc

SEQ ID NO: 1621338 - DNA, 12 bp, Homo sapiens
ctgcccctagga

SEQ ID NO: 1621339 - DNA, 21 bp, Homo sapiens
ctgcccctaggatgctgcagc

SEQ ID NO: 1621340 - DNA, 14 bp, Homo sapiens
ctgcccctcccttc

SEQ ID NO: 1621341 - DNA, 17 bp, Homo sapiens
ctgcccctggcacctgt

SEQ ID NO: 1621342 - DNA, 23 bp, Homo sapiens
ctgccccttaaacacaggctgtc

SEQ ID NO: 1621343 - DNA, 21 bp, Homo sapiens
ctgccccttaaccccaaggac

SEQ ID NO: 1621344 - DNA, 14 bp, Homo sapiens
ctgccccttgggca

SEQ ID NO: 1621345 - DNA, 21 bp, Homo sapiens
ctgcccgcaccctggcctggt

SEQ ID NO: 1621346 - DNA, 22 bp, Homo sapiens
ctgcccgcaccctggcctggtc

SEQ ID NO: 1621347 - DNA, 22 bp, Homo sapiens
ctgcccggggtggggtgcactc

SEQ ID NO: 1621348 - DNA, 22 bp, Homo sapiens
ctgcccggtggtttgccatgtc

SEQ ID NO: 1621349 - DNA, 16 bp, Homo sapiens
ctgccctaagccccca

SEQ ID NO: 1621350 - DNA, 18 bp, Homo sapiens
ctgccctaagcccccagg

SEQ ID NO: 1621351 - DNA, 20 bp, Homo sapiens
ctgccctaagcccccagggc

SEQ ID NO: 1621352 - DNA, 21 bp, Homo sapiens
ctgccctagagcacactgtag

SEQ ID NO: 1621353 - DNA, 15 bp, Homo sapiens
ctgccctagctgacc

SEQ ID NO: 1621354 - DNA, 20 bp, Homo sapiens
ctgccctatgggcctgccgg

SEQ ID NO: 1621355 - DNA, 12 bp, Homo sapiens
ctgccctcatgg

SEQ ID NO: 1621356 - DNA, 16 bp, Homo sapiens
ctgccctcccacagcc

SEQ ID NO: 1621357 - DNA, 22 bp, Homo sapiens
ctgccctcccctccggactggt

SEQ ID NO: 1621358 - DNA, 15 bp, Homo sapiens
ctgccctcccctgct

SEQ ID NO: 1621359 - DNA, 16 bp, Homo sapiens
ctgccctccctggagc

SEQ ID NO: 1621360 - DNA, 16 bp, Homo sapiens
ctgccctcgtggccag

SEQ ID NO: 1621361 - DNA, 17 bp, Homo sapiens
tcctgtcccttgacctt

SEQ ID NO: 1621362 - DNA, 13 bp, Homo sapiens
tcctgtcctggtc

SEQ ID NO: 1621363 - DNA, 19 bp, Homo sapiens
tcctgtcctttcttgcaga

SEQ ID NO: 1621364 - DNA, 14 bp, Homo sapiens
tcctgtctcagcct

SEQ ID NO: 1621365 - DNA, 18 bp, Homo sapiens
tcctgtctctaaaaagaa

SEQ ID NO: 1621366 - DNA, 13 bp, Homo sapiens
tcctgtctgccag

SEQ ID NO: 1621367 - DNA, 14 bp, Homo sapiens
tcctgtctgccagc

SEQ ID NO: 1621368 - DNA, 16 bp, Homo sapiens
tcctgtctgccagcca

SEQ ID NO: 1621369 - DNA, 17 bp, Homo sapiens
tcctgtctgccagccag

SEQ ID NO: 1621370 - DNA, 20 bp, Homo sapiens
tcctgtcttatggtccagaa

SEQ ID NO: 1621371 - DNA, 23 bp, Homo sapiens
tcctgtcttatggtccagaaact

SEQ ID NO: 1621372 - DNA, 17 bp, Homo sapiens
tcctgtctttaaggaaa

SEQ ID NO: 1621373 - DNA, 19 bp, Homo sapiens
tcctgtctttaaggaaaaa

SEQ ID NO: 1621374 - DNA, 15 bp, Homo sapiens
tcctgtctttctgag

SEQ ID NO: 1621375 - DNA, 18 bp, Homo sapiens
tcctgtgacagtgaaata

SEQ ID NO: 1621376 - DNA, 15 bp, Homo sapiens
tcctgtgacatgtaa

SEQ ID NO: 1621377 - DNA, 23 bp, Homo sapiens
tcctgtgaccccaccttgacggt

SEQ ID NO: 1621378 - DNA, 24 bp, Homo sapiens
tcctgtgccctagatgcacgtggg

SEQ ID NO: 1621379 - DNA, 22 bp, Homo sapiens
tcctgtggaaggcagagaaatc

SEQ ID NO: 1621380 - DNA, 14 bp, Homo sapiens
tcctgtggcagctg

SEQ ID NO: 1621381 - DNA, 16 bp, Homo sapiens
tcctgtggcataaatt

SEQ ID NO: 1621382 - DNA, 20 bp, Homo sapiens
tcctgtggcataaattgcat

SEQ ID NO: 1621383 - DNA, 22 bp, Homo sapiens
tcctgtggccccaccctgggcc

SEQ ID NO: 1621384 - DNA, 14 bp, Homo sapiens
tcctgtgtaacact

SEQ ID NO: 1621385 - DNA, 18 bp, Homo sapiens
tcctgtgtacctctagaa

SEQ ID NO: 1621386 - DNA, 12 bp, Homo sapiens
tcctgtgtcctg

SEQ ID NO: 1621387 - DNA, 22 bp, Homo sapiens
tcctgtgtggagagggaatgtg

SEQ ID NO: 1621388 - DNA, 22 bp, Homo sapiens
tcctgtgtgtccaaaactgcct

SEQ ID NO: 1621389 - DNA, 16 bp, Homo sapiens
tcctgttacttgcttc

SEQ ID NO: 1621390 - DNA, 18 bp, Homo sapiens
tcctgttcagtaataaaa

SEQ ID NO: 1621391 - DNA, 13 bp, Homo sapiens
tcctgttcagtga

SEQ ID NO: 1621392 - DNA, 13 bp, Homo sapiens
tcctgttccctac

SEQ ID NO: 1621393 - DNA, 23 bp, Homo sapiens
tcctgttccttgctagccctggg

SEQ ID NO: 1621394 - DNA, 17 bp, Homo sapiens
tcctgttgctgtcttca

SEQ ID NO: 1621395 - DNA, 19 bp, Homo sapiens
tcctgttgctgtcttcagt

SEQ ID NO: 1621396 - DNA, 21 bp, Homo sapiens
tcctgttggatttgtttaaaa

SEQ ID NO: 1621397 - DNA, 19 bp, Homo sapiens
tcctgttgttgttaatgaa

SEQ ID NO: 1621398 - DNA, 21 bp, Homo sapiens
tcctgttgttgttaatgaaaa

SEQ ID NO: 1621399 - DNA, 14 bp, Homo sapiens
tcctgtttgcaggc

SEQ ID NO: 1621400 - DNA, 23 bp, Homo sapiens
tcctgtttgggaagagcttagaa

SEQ ID NO: 1621401 - DNA, 21 bp, Homo sapiens
tcctgttttgcacagccaaat

SEQ ID NO: 1621402 - DNA, 14 bp, Homo sapiens
tcctgtttttcaca

SEQ ID NO: 1621403 - DNA, 12 bp, Homo sapiens
tccttaaaaatc

SEQ ID NO: 1621404 - DNA, 18 bp, Homo sapiens
tccttaaaaatcacactg

SEQ ID NO: 1621405 - DNA, 18 bp, Homo sapiens
tccttaaaatgtaagatt

SEQ ID NO: 1621406 - DNA, 16 bp, Homo sapiens
tccttaaactgtgtgg

SEQ ID NO: 1621407 - DNA, 22 bp, Homo sapiens
tccttaaatgacttttcttaag

SEQ ID NO: 1621408 - DNA, 14 bp, Homo sapiens
tccttaagccagga

SEQ ID NO: 1621409 - DNA, 17 bp, Homo sapiens
tccttaagctgcagaga

SEQ ID NO: 1621410 - DNA, 17 bp, Homo sapiens
tccttaataaatgaatg

SEQ ID NO: 1621411 - DNA, 18 bp, Homo sapiens
tccttaattcactcccac

SEQ ID NO: 1621412 - DNA, 20 bp, Homo sapiens
tccttacctttttatttgca

SEQ ID NO: 1621413 - DNA, 20 bp, Homo sapiens
tccttacgctttgtcacaca

SEQ ID NO: 1621414 - DNA, 17 bp, Homo sapiens
tccttactctgagccca

SEQ ID NO: 1621415 - DNA, 20 bp, Homo sapiens
tccttactctgagcccaggc

SEQ ID NO: 1621416 - DNA, 22 bp, Homo sapiens
tccttactctgagcccaggccg

SEQ ID NO: 1621417 - DNA, 17 bp, Homo sapiens
tccttagacccgccagg

SEQ ID NO: 1621418 - DNA, 20 bp, Homo sapiens
tccttaggtaatctataact

SEQ ID NO: 1621419 - DNA, 17 bp, Homo sapiens
tccttatccctctcttc

SEQ ID NO: 1621420 - DNA, 18 bp, Homo sapiens
tccttatccctctcttcc

SEQ ID NO: 1621421 - DNA, 16 bp, Homo sapiens
tccttattcttgtggt

SEQ ID NO: 1621422 - DNA, 19 bp, Homo sapiens
tccttattgggacttttct

SEQ ID NO: 1621423 - DNA, 11 bp, Homo sapiens
tccttatttat

SEQ ID NO: 1621424 - DNA, 13 bp, Homo sapiens
tccttatttgcct

SEQ ID NO: 1621425 - DNA, 13 bp, Homo sapiens
tccttattttgta

SEQ ID NO: 1621426 - DNA, 19 bp, Homo sapiens
tccttcaagaactctgggc

SEQ ID NO: 1621427 - DNA, 23 bp, Homo sapiens
tccttcaagaactctgggctgct

SEQ ID NO: 1621428 - DNA, 19 bp, Homo sapiens
tccttcaagttagctcagg

SEQ ID NO: 1621429 - DNA, 19 bp, Homo sapiens
tccttcacaggcagtgcat

SEQ ID NO: 1621430 - DNA, 14 bp, Homo sapiens
tccttcaccagagc

SEQ ID NO: 1621431 - DNA, 20 bp, Homo sapiens
tccttcaccagagcccatgc

SEQ ID NO: 1621432 - DNA, 21 bp, Homo sapiens
tccttcactggcgccttctcg

SEQ ID NO: 1621433 - DNA, 14 bp, Homo sapiens
tccttcactgttcc

SEQ ID NO: 1621434 - DNA, 16 bp, Homo sapiens
tccttcactgttccct

SEQ ID NO: 1621435 - DNA, 20 bp, Homo sapiens
tccttcactgttccctctgg

SEQ ID NO: 1621436 - DNA, 11 bp, Homo sapiens
tccttcagcac

SEQ ID NO: 1621437 - DNA, 15 bp, Homo sapiens
tccttcagccctcac

SEQ ID NO: 1621438 - DNA, 18 bp, Homo sapiens
tccttcagggtttaatag

SEQ ID NO: 1621439 - DNA, 14 bp, Homo sapiens
tccttcattaatga

SEQ ID NO: 1621440 - DNA, 14 bp, Homo sapiens
tccttccacctcag

SEQ ID NO: 1621441 - DNA, 15 bp, Homo sapiens
tccttccagtataac

SEQ ID NO: 1621442 - DNA, 18 bp, Homo sapiens
tccttccagtataaccag

SEQ ID NO: 1621443 - DNA, 22 bp, Homo sapiens
tccttccatcttgtggggccag

SEQ ID NO: 1621444 - DNA, 16 bp, Homo sapiens
tccttcccatgcctgt

SEQ ID NO: 1621445 - DNA, 20 bp, Homo sapiens
tccttccccaacttccctag

SEQ ID NO: 1621446 - DNA, 23 bp, Homo sapiens
tccttccccaacttccctagtcc

SEQ ID NO: 1621447 - DNA, 16 bp, Homo sapiens
tccttcccccagccca

SEQ ID NO: 1621448 - DNA, 20 bp, Homo sapiens
tccttcccccagcccaataa

SEQ ID NO: 1621449 - DNA, 22 bp, Homo sapiens
tccttccccctgtagactagtg

SEQ ID NO: 1621450 - DNA, 16 bp, Homo sapiens
tccttcccctcttctt

SEQ ID NO: 1621451 - DNA, 12 bp, Homo sapiens
tccttcccctgc

SEQ ID NO: 1621452 - DNA, 19 bp, Homo sapiens
tccttcccctgcacctggc

SEQ ID NO: 1621453 - DNA, 21 bp, Homo sapiens
tccttcccctgcacctggcct

SEQ ID NO: 1621454 - DNA, 17 bp, Homo sapiens
tccttccctctcctgct

SEQ ID NO: 1621455 - DNA, 15 bp, Homo sapiens
tccttccctgccact

SEQ ID NO: 1621456 - DNA, 12 bp, Homo sapiens
tccttccctggc

SEQ ID NO: 1621457 - DNA, 20 bp, Homo sapiens
tccttcctgattgtttacag

SEQ ID NO: 1621458 - DNA, 17 bp, Homo sapiens
tccttcctggcctgaga

SEQ ID NO: 1621459 - DNA, 13 bp, Homo sapiens
tccttcctgtctt

SEQ ID NO: 1621460 - DNA, 14 bp, Homo sapiens
tccttcctgtcttc

SEQ ID NO: 1621461 - DNA, 17 bp, Homo sapiens
tccttcctgtcttcctg

SEQ ID NO: 1621462 - DNA, 19 bp, Homo sapiens
tccttcgaaaggccttcag

SEQ ID NO: 1621463 - DNA, 24 bp, Homo sapiens
ctgcaattcaaaagttccaagagt

SEQ ID NO: 1621464 - DNA, 17 bp, Homo sapiens
ctgcaattcccctctgc

SEQ ID NO: 1621465 - DNA, 19 bp, Homo sapiens
ctgcaattgcagctcactg

SEQ ID NO: 1621466 - DNA, 18 bp, Homo sapiens
ctgcacaataaaaatgtt

SEQ ID NO: 1621467 - DNA, 17 bp, Homo sapiens
ctgcacacacagctcct

SEQ ID NO: 1621468 - DNA, 11 bp, Homo sapiens
ctgcacacagg

SEQ ID NO: 1621469 - DNA, 20 bp, Homo sapiens
ctgcacacaggacagcggga

SEQ ID NO: 1621470 - DNA, 16 bp, Homo sapiens
ctgcacagacaagcag

SEQ ID NO: 1621471 - DNA, 21 bp, Homo sapiens
ctgcacagacaagcagccctt

SEQ ID NO: 1621472 - DNA, 22 bp, Homo sapiens
ctgcacagacaagcagcccttg

SEQ ID NO: 1621473 - DNA, 17 bp, Homo sapiens
ctgcacagatatttcca

SEQ ID NO: 1621474 - DNA, 23 bp, Homo sapiens
ctgcacagatggatttgcctgtg

SEQ ID NO: 1621475 - DNA, 13 bp, Homo sapiens
ctgcacaggcaga

SEQ ID NO: 1621476 - DNA, 13 bp, Homo sapiens
ctgcacaggccct

SEQ ID NO: 1621477 - DNA, 15 bp, Homo sapiens
ctgcacaggccctgg

SEQ ID NO: 1621478 - DNA, 13 bp, Homo sapiens
ctgcacagtcaga

SEQ ID NO: 1621479 - DNA, 17 bp, Homo sapiens
ctgcacagtcagaagga

SEQ ID NO: 1621480 - DNA, 14 bp, Homo sapiens
ctgcacagtgactt

SEQ ID NO: 1621481 - DNA, 18 bp, Homo sapiens
ctgcacagtgacttctga

SEQ ID NO: 1621482 - DNA, 19 bp, Homo sapiens
ctgcacagtgacttctgag

SEQ ID NO: 1621483 - DNA, 21 bp, Homo sapiens
ctgcacagtgacttctgagat

SEQ ID NO: 1621484 - DNA, 22 bp, Homo sapiens
ctgcacagtgacttctgagatc

SEQ ID NO: 1621485 - DNA, 21 bp, Homo sapiens
ctgcacatgaaagttttgcaa

SEQ ID NO: 1621486 - DNA, 23 bp, Homo sapiens
ctgcacatgactcgggggtgggg

SEQ ID NO: 1621487 - DNA, 18 bp, Homo sapiens
ctgcacatggacagactt

SEQ ID NO: 1621488 - DNA, 21 bp, Homo sapiens
ctgcacatgtcttgtacatgt

SEQ ID NO: 1621489 - DNA, 22 bp, Homo sapiens
ctgcacattgcctgttctgctt

SEQ ID NO: 1621490 - DNA, 14 bp, Homo sapiens
ctgcaccagagtga

SEQ ID NO: 1621491 - DNA, 22 bp, Homo sapiens
ctgcaccagagtgaaagggcta

SEQ ID NO: 1621492 - DNA, 17 bp, Homo sapiens
ctgcaccaggagacaga

SEQ ID NO: 1621493 - DNA, 19 bp, Homo sapiens
ctgcaccatgctgctgggg

SEQ ID NO: 1621494 - DNA, 21 bp, Homo sapiens
ctgcaccatgctgctggggaa

SEQ ID NO: 1621495 - DNA, 12 bp, Homo sapiens
ctgcacccaccc

SEQ ID NO: 1621496 - DNA, 15 bp, Homo sapiens
ctgcacccacccctg

SEQ ID NO: 1621497 - DNA, 19 bp, Homo sapiens
ctgcacccacccctgccca

SEQ ID NO: 1621498 - DNA, 13 bp, Homo sapiens
ctgcaccccagca

SEQ ID NO: 1621499 - DNA, 23 bp, Homo sapiens
ctgcaccccagcattccagctct

SEQ ID NO: 1621500 - DNA, 17 bp, Homo sapiens
ctgcacccgcctcgacc

SEQ ID NO: 1621501 - DNA, 18 bp, Homo sapiens
ctgcaccctccaccctgt

SEQ ID NO: 1621502 - DNA, 12 bp, Homo sapiens
ctgcaccctgcg

SEQ ID NO: 1621503 - DNA, 19 bp, Homo sapiens
ctgcaccctgcgcctccag

SEQ ID NO: 1621504 - DNA, 21 bp, Homo sapiens
ctgcaccctgcgcctccagag

SEQ ID NO: 1621505 - DNA, 16 bp, Homo sapiens
ctgcaccctggggcct

SEQ ID NO: 1621506 - DNA, 14 bp, Homo sapiens
ctgcacccttccct

SEQ ID NO: 1621507 - DNA, 18 bp, Homo sapiens
ctgcacccttccctcttc

SEQ ID NO: 1621508 - DNA, 17 bp, Homo sapiens
ctgcacctccccccact

SEQ ID NO: 1621509 - DNA, 13 bp, Homo sapiens
ctgcacctgccag

SEQ ID NO: 1621510 - DNA, 18 bp, Homo sapiens
ctgcacctgccagcctgg

SEQ ID NO: 1621511 - DNA, 20 bp, Homo sapiens
ctgcacctgccagcctggct

SEQ ID NO: 1621512 - DNA, 23 bp, Homo sapiens
ctgcacctgctgcgtccccactc

SEQ ID NO: 1621513 - DNA, 23 bp, Homo sapiens
ctgcacctggtgggtggtgtcct

SEQ ID NO: 1621514 - DNA, 14 bp, Homo sapiens
ctgcacctgtgcag

SEQ ID NO: 1621515 - DNA, 12 bp, Homo sapiens
ctgcacgtcatg

SEQ ID NO: 1621516 - DNA, 15 bp, Homo sapiens
ctgcacgtgcgggtg

SEQ ID NO: 1621517 - DNA, 14 bp, Homo sapiens
ctgcactactgaca

SEQ ID NO: 1621518 - DNA, 14 bp, Homo sapiens
ctgcactcaagctt

SEQ ID NO: 1621519 - DNA, 15 bp, Homo sapiens
ctgcactccagcctg

SEQ ID NO: 1621520 - DNA, 16 bp, Homo sapiens
ctgcactccagcctgg

SEQ ID NO: 1621521 - DNA, 20 bp, Homo sapiens
ctgcactccagcctgggcga

SEQ ID NO: 1621522 - DNA, 21 bp, Homo sapiens
ctgcactccagcctgggtcac

SEQ ID NO: 1621523 - DNA, 21 bp, Homo sapiens
ctgcactccatggccaccccg

SEQ ID NO: 1621524 - DNA, 20 bp, Homo sapiens
ctgcactccctcctggagct

SEQ ID NO: 1621525 - DNA, 21 bp, Homo sapiens
ctgcactccctcctggagctc

SEQ ID NO: 1621526 - DNA, 16 bp, Homo sapiens
ctgcactccctggcct

SEQ ID NO: 1621527 - DNA, 11 bp, Homo sapiens
ctgcactgaaa

SEQ ID NO: 1621528 - DNA, 21 bp, Homo sapiens
ctgcactgagagggcaaggaa

SEQ ID NO: 1621529 - DNA, 13 bp, Homo sapiens
ctgcactgcagtg

SEQ ID NO: 1621530 - DNA, 22 bp, Homo sapiens
ctgcactggggagcccgtctca

SEQ ID NO: 1621531 - DNA, 13 bp, Homo sapiens
ctgcactgtaaaa

SEQ ID NO: 1621532 - DNA, 12 bp, Homo sapiens
ctgcactgtgaa

SEQ ID NO: 1621533 - DNA, 20 bp, Homo sapiens
ctgcactgtgaacctgggca

SEQ ID NO: 1621534 - DNA, 15 bp, Homo sapiens
ctgcacttcagacac

SEQ ID NO: 1621535 - DNA, 16 bp, Homo sapiens
ctgcacttcagacacc

SEQ ID NO: 1621536 - DNA, 13 bp, Homo sapiens
ctgcagaacccac

SEQ ID NO: 1621537 - DNA, 19 bp, Homo sapiens
ctgcagaacccccaggtgg

SEQ ID NO: 1621538 - DNA, 20 bp, Homo sapiens
ctgcagaacgtattggtcca

SEQ ID NO: 1621539 - DNA, 17 bp, Homo sapiens
ctgcagaagaagctggt

SEQ ID NO: 1621540 - DNA, 17 bp, Homo sapiens
ctgcagaaggaaagaag

SEQ ID NO: 1621541 - DNA, 19 bp, Homo sapiens
ctgcagaatccctttgcac

SEQ ID NO: 1621542 - DNA, 22 bp, Homo sapiens
ctgcagaatttgggttctgcct

SEQ ID NO: 1621543 - DNA, 23 bp, Homo sapiens
ctgcagacaggctctgaggggca

SEQ ID NO: 1621544 - DNA, 15 bp, Homo sapiens
ctgcagaccatgcca

SEQ ID NO: 1621545 - DNA, 15 bp, Homo sapiens
ctgcagacttcccag

SEQ ID NO: 1621546 - DNA, 16 bp, Homo sapiens
ctgcagacttcccagc

SEQ ID NO: 1621547 - DNA, 18 bp, Homo sapiens
ctgcagacttcccagcta

SEQ ID NO: 1621548 - DNA, 14 bp, Homo sapiens
ctgcagaggaaaga

SEQ ID NO: 1621549 - DNA, 19 bp, Homo sapiens
ctgcagaggaccacagtgg

SEQ ID NO: 1621550 - DNA, 22 bp, Homo sapiens
tttaaacctcacctttgtgggg

SEQ ID NO: 1621551 - DNA, 15 bp, Homo sapiens
tttaaactgtgtaca

SEQ ID NO: 1621552 - DNA, 21 bp, Homo sapiens
tttaaactgtgtacataactg

SEQ ID NO: 1621553 - DNA, 22 bp, Homo sapiens
tttaaactgtgtacataactga

SEQ ID NO: 1621554 - DNA, 15 bp, Homo sapiens
tttaaacttgaaata

SEQ ID NO: 1621555 - DNA, 16 bp, Homo sapiens
tttaaagaaagtgtat

SEQ ID NO: 1621556 - DNA, 12 bp, Homo sapiens
tttaaagaataa

SEQ ID NO: 1621557 - DNA, 15 bp, Homo sapiens
tttaaagaataaagt

SEQ ID NO: 1621558 - DNA, 18 bp, Homo sapiens
tttaaagaatatgacttt

SEQ ID NO: 1621559 - DNA, 23 bp, Homo sapiens
tttaaagagtctagattcaaagg

SEQ ID NO: 1621560 - DNA, 18 bp, Homo sapiens
tttaaagccattctgatt

SEQ ID NO: 1621561 - DNA, 16 bp, Homo sapiens
tttaaagctaaatttt

SEQ ID NO: 1621562 - DNA, 18 bp, Homo sapiens
tttaaaggaataaacttg

SEQ ID NO: 1621563 - DNA, 16 bp, Homo sapiens
tttaaaggggcagaaa

SEQ ID NO: 1621564 - DNA, 23 bp, Homo sapiens
tttaaaggtggattttgtttaaa

SEQ ID NO: 1621565 - DNA, 17 bp, Homo sapiens
tttaaagtgattaaacg

SEQ ID NO: 1621566 - DNA, 20 bp, Homo sapiens
tttaaagttcttattttagt

SEQ ID NO: 1621567 - DNA, 22 bp, Homo sapiens
tttaaagttggtgcatctagaa

SEQ ID NO: 1621568 - DNA, 15 bp, Homo sapiens
tttaaataaaagcac

SEQ ID NO: 1621569 - DNA, 13 bp, Homo sapiens
tttaaataaacac

SEQ ID NO: 1621570 - DNA, 16 bp, Homo sapiens
tttaaataaagaacaa

SEQ ID NO: 1621571 - DNA, 22 bp, Homo sapiens
tttaaataaatagatgttctgt

SEQ ID NO: 1621572 - DNA, 13 bp, Homo sapiens
tttaaatagccta

SEQ ID NO: 1621573 - DNA, 14 bp, Homo sapiens
tttaaatataaata

SEQ ID NO: 1621574 - DNA, 19 bp, Homo sapiens
tttaaatataaatagctaa

SEQ ID NO: 1621575 - DNA, 16 bp, Homo sapiens
tttaaatatatatttt

SEQ ID NO: 1621576 - DNA, 17 bp, Homo sapiens
tttaaatatgaatgaac

SEQ ID NO: 1621577 - DNA, 14 bp, Homo sapiens
tttaaatattttct

SEQ ID NO: 1621578 - DNA, 19 bp, Homo sapiens
tttaaatattttctatttt

SEQ ID NO: 1621579 - DNA, 14 bp, Homo sapiens
tttaaatcttttct

SEQ ID NO: 1621580 - DNA, 16 bp, Homo sapiens
tttaaatgtaaaacat

SEQ ID NO: 1621581 - DNA, 18 bp, Homo sapiens
tttaaatgtaaagatatt

SEQ ID NO: 1621582 - DNA, 19 bp, Homo sapiens
tttaaattcacaatagaaa

SEQ ID NO: 1621583 - DNA, 21 bp, Homo sapiens
tttaaattcacaatagaaact

SEQ ID NO: 1621584 - DNA, 13 bp, Homo sapiens
tttaaatttgatt

SEQ ID NO: 1621585 - DNA, 22 bp, Homo sapiens
tttaaattttaccctttagact

SEQ ID NO: 1621586 - DNA, 14 bp, Homo sapiens
tttaaattttatgt

SEQ ID NO: 1621587 - DNA, 13 bp, Homo sapiens
tttaacaaatcta

SEQ ID NO: 1621588 - DNA, 19 bp, Homo sapiens
tttaacaaatctaatctct

SEQ ID NO: 1621589 - DNA, 22 bp, Homo sapiens
tttaacaaatctaatctcttat

SEQ ID NO: 1621590 - DNA, 21 bp, Homo sapiens
tttaacaatgacaagatgttc

SEQ ID NO: 1621591 - DNA, 13 bp, Homo sapiens
tttaacactttgt

SEQ ID NO: 1621592 - DNA, 18 bp, Homo sapiens
tttaacactttgtattac

SEQ ID NO: 1621593 - DNA, 15 bp, Homo sapiens
tttaacagtcattta

SEQ ID NO: 1621594 - DNA, 21 bp, Homo sapiens
tttaacatacaagaaaatgta

SEQ ID NO: 1621595 - DNA, 15 bp, Homo sapiens
tttaacatacatcta

SEQ ID NO: 1621596 - DNA, 23 bp, Homo sapiens
tttaacatgaacacccttagaaa

SEQ ID NO: 1621597 - DNA, 12 bp, Homo sapiens
tttaacattcct

SEQ ID NO: 1621598 - DNA, 23 bp, Homo sapiens
tttaacattcctcatgaatgtaa

SEQ ID NO: 1621599 - DNA, 14 bp, Homo sapiens
tttaaccaaaacat

SEQ ID NO: 1621600 - DNA, 23 bp, Homo sapiens
tttaacctagatgtttaacaaat

SEQ ID NO: 1621601 - DNA, 16 bp, Homo sapiens
tttaacctatgatatt

SEQ ID NO: 1621602 - DNA, 23 bp, Homo sapiens
tttaacctatgttacaccatctt

SEQ ID NO: 1621603 - DNA, 22 bp, Homo sapiens
tttaacgaatgaagatgtctaa

SEQ ID NO: 1621604 - DNA, 18 bp, Homo sapiens
tttaacgttctgctgctt

SEQ ID NO: 1621605 - DNA, 17 bp, Homo sapiens
tttaactaaattttaaa

SEQ ID NO: 1621606 - DNA, 17 bp, Homo sapiens
tttaactagaatttatt

SEQ ID NO: 1621607 - DNA, 14 bp, Homo sapiens
tttaactgacaagc

SEQ ID NO: 1621608 - DNA, 15 bp, Homo sapiens
tttaactggtgaaga

SEQ ID NO: 1621609 - DNA, 17 bp, Homo sapiens
tttaactggtgaagaga

SEQ ID NO: 1621610 - DNA, 13 bp, Homo sapiens
tttaactgtggat

SEQ ID NO: 1621611 - DNA, 18 bp, Homo sapiens
tttaactgtggatattgt

SEQ ID NO: 1621612 - DNA, 17 bp, Homo sapiens
tttaacttagttttgca

SEQ ID NO: 1621613 - DNA, 19 bp, Homo sapiens
tttaactttttttcttcta

SEQ ID NO: 1621614 - DNA, 22 bp, Homo sapiens
tttaagaaaaaataacacacat

SEQ ID NO: 1621615 - DNA, 18 bp, Homo sapiens
tttaagaaaaacatgtca

SEQ ID NO: 1621616 - DNA, 19 bp, Homo sapiens
tttaagaaaacaccatgga

SEQ ID NO: 1621617 - DNA, 16 bp, Homo sapiens
tttaagaaaatacaat

SEQ ID NO: 1621618 - DNA, 15 bp, Homo sapiens
tttaagaatatctgt

SEQ ID NO: 1621619 - DNA, 22 bp, Homo sapiens
tttaagacagtcccatcaaaac

SEQ ID NO: 1621620 - DNA, 15 bp, Homo sapiens
tttaagataaattat

SEQ ID NO: 1621621 - DNA, 18 bp, Homo sapiens
tttaagataataatatat

SEQ ID NO: 1621622 - DNA, 14 bp, Homo sapiens
tttaagatagtgta

SEQ ID NO: 1621623 - DNA, 18 bp, Homo sapiens
tttaagatatccatcttt

SEQ ID NO: 1621624 - DNA, 22 bp, Homo sapiens
tttaagatatccatctttttct

SEQ ID NO: 1621625 - DNA, 13 bp, Homo sapiens
tttaagatgtgaa

SEQ ID NO: 1621626 - DNA, 14 bp, Homo sapiens
tttaagatgtgaaa

SEQ ID NO: 1621627 - DNA, 23 bp, Homo sapiens
tttaagcagactcagctgctata

SEQ ID NO: 1621628 - DNA, 21 bp, Homo sapiens
tttaagccaaagaaacaagct

SEQ ID NO: 1621629 - DNA, 21 bp, Homo sapiens
tttaagcctaaagattttgat

SEQ ID NO: 1621630 - DNA, 18 bp, Homo sapiens
tttaagcctgcattctta

SEQ ID NO: 1621631 - DNA, 16 bp, Homo sapiens
tttaagccttacaaag

SEQ ID NO: 1621632 - DNA, 12 bp, Homo sapiens
tttaagcctttg

SEQ ID NO: 1621633 - DNA, 21 bp, Homo sapiens
tttaagcctttgttgaactgt

SEQ ID NO: 1621634 - DNA, 15 bp, Homo sapiens
tttaagccttttgtg

SEQ ID NO: 1621635 - DNA, 20 bp, Homo sapiens
tttaagctccttgagtaaaa

SEQ ID NO: 1621636 - DNA, 14 bp, Homo sapiens
tttaagcttcagtt

SEQ ID NO: 1621637 - DNA, 15 bp, Homo sapiens
tttaaggatggatgg

SEQ ID NO: 1621638 - DNA, 18 bp, Homo sapiens
tttaaggatggatggcac

SEQ ID NO: 1621639 - DNA, 19 bp, Homo sapiens
tttaaggatggatggcacc

SEQ ID NO: 1621640 - DNA, 14 bp, Homo sapiens
tttaaggtctgttt

SEQ ID NO: 1621641 - DNA, 18 bp, Homo sapiens
tttaaggttgcacacagt

SEQ ID NO: 1621642 - DNA, 19 bp, Homo sapiens
tttaaggttgcacacagta

SEQ ID NO: 1621643 - DNA, 23 bp, Homo sapiens
tttaagtagtgggcatttcatag

SEQ ID NO: 1621644 - DNA, 23 bp, Homo sapiens
tttaagtatacaggaggatgtga

SEQ ID NO: 1621645 - DNA, 17 bp, Homo sapiens
tttaagtatcttgtgct

SEQ ID NO: 1621646 - DNA, 18 bp, Homo sapiens
tttaagtatttaggtttt

SEQ ID NO: 1621647 - DNA, 14 bp, Homo sapiens
tttaagtatttata

SEQ ID NO: 1621648 - DNA, 20 bp, Homo sapiens
tttaagtcagtatggtctaa

SEQ ID NO: 1621649 - DNA, 20 bp, Homo sapiens
tttaagtgaatacattaacg

SEQ ID NO: 1621650 - DNA, 18 bp, Homo sapiens
tttaagttgtcaaagaag

SEQ ID NO: 1621651 - DNA, 16 bp, Homo sapiens
tttatcagccatgttt

SEQ ID NO: 1621652 - DNA, 19 bp, Homo sapiens
tttatcatgaatgctttta

SEQ ID NO: 1621653 - DNA, 23 bp, Homo sapiens
tttatcatgcatgtcctgtaaag

SEQ ID NO: 1621654 - DNA, 12 bp, Homo sapiens
tttatcattttc

SEQ ID NO: 1621655 - DNA, 21 bp, Homo sapiens
tttatcccaaagttgttgtaa

SEQ ID NO: 1621656 - DNA, 18 bp, Homo sapiens
tttatcccttaagaatga

SEQ ID NO: 1621657 - DNA, 14 bp, Homo sapiens
tttatcctgtattc

SEQ ID NO: 1621658 - DNA, 14 bp, Homo sapiens
tttatctataattt

SEQ ID NO: 1621659 - DNA, 19 bp, Homo sapiens
tttatctataatttaccta

SEQ ID NO: 1621660 - DNA, 15 bp, Homo sapiens
tttatcttattttct

SEQ ID NO: 1621661 - DNA, 21 bp, Homo sapiens
tttatcttgaaggaaaaattc

SEQ ID NO: 1621662 - DNA, 21 bp, Homo sapiens
tttatcttggactgacattta

SEQ ID NO: 1621663 - DNA, 15 bp, Homo sapiens
tttatcttgggactg

SEQ ID NO: 1621664 - DNA, 16 bp, Homo sapiens
tttatctttaccaaaa

SEQ ID NO: 1621665 - DNA, 18 bp, Homo sapiens
tttatctttaccaaaaac

SEQ ID NO: 1621666 - DNA, 20 bp, Homo sapiens
tttatctttaccaaaaacca

SEQ ID NO: 1621667 - DNA, 19 bp, Homo sapiens
tttatctttgattctcctt

SEQ ID NO: 1621668 - DNA, 23 bp, Homo sapiens
tttatcttttgtatatctaagac

SEQ ID NO: 1621669 - DNA, 14 bp, Homo sapiens
tttatgaacattgt

SEQ ID NO: 1621670 - DNA, 15 bp, Homo sapiens
tttatgaacattgta

SEQ ID NO: 1621671 - DNA, 16 bp, Homo sapiens
tttatgaacattgtac

SEQ ID NO: 1621672 - DNA, 21 bp, Homo sapiens
tttatgaacattgtactgttg

SEQ ID NO: 1621673 - DNA, 15 bp, Homo sapiens
tttatgaagttaaca

SEQ ID NO: 1621674 - DNA, 12 bp, Homo sapiens
tttatgacctaa

SEQ ID NO: 1621675 - DNA, 15 bp, Homo sapiens
tttcaagaacctgga

SEQ ID NO: 1621676 - DNA, 20 bp, Homo sapiens
tttcaagacattaaatctat

SEQ ID NO: 1621677 - DNA, 14 bp, Homo sapiens
tttcaagattctaa

SEQ ID NO: 1621678 - DNA, 20 bp, Homo sapiens
tttcaagcacaacccaccac

SEQ ID NO: 1621679 - DNA, 15 bp, Homo sapiens
tttcaaggcactcta

SEQ ID NO: 1621680 - DNA, 17 bp, Homo sapiens
tttcaaggcactctaga

SEQ ID NO: 1621681 - DNA, 21 bp, Homo sapiens
tttcaaggcactctagattcc

SEQ ID NO: 1621682 - DNA, 17 bp, Homo sapiens
tttcaaggccctcagca

SEQ ID NO: 1621683 - DNA, 14 bp, Homo sapiens
tttcaaggccttca

SEQ ID NO: 1621684 - DNA, 15 bp, Homo sapiens
tttcaaggccttcag

SEQ ID NO: 1621685 - DNA, 16 bp, Homo sapiens
tttcaaggccttcagt

SEQ ID NO: 1621686 - DNA, 17 bp, Homo sapiens
tttcaagtatttaagcc

SEQ ID NO: 1621687 - DNA, 23 bp, Homo sapiens
tttcaagtatttaagcctaaaga

SEQ ID NO: 1621688 - DNA, 12 bp, Homo sapiens
tttcaagtgcct

SEQ ID NO: 1621689 - DNA, 15 bp, Homo sapiens
tttcaagtgcctaga

SEQ ID NO: 1621690 - DNA, 21 bp, Homo sapiens
tttcaagtgcctagactgtta

SEQ ID NO: 1621691 - DNA, 22 bp, Homo sapiens
tttcaagtgcctagactgttac

SEQ ID NO: 1621692 - DNA, 23 bp, Homo sapiens
tttcaagtgcctagactgttact

SEQ ID NO: 1621693 - DNA, 23 bp, Homo sapiens
tttcaagtgcctttctgcagttt

SEQ ID NO: 1621694 - DNA, 21 bp, Homo sapiens
tttcaagttattcaaatttgt

SEQ ID NO: 1621695 - DNA, 18 bp, Homo sapiens
tttcaagttttaaagttc

SEQ ID NO: 1621696 - DNA, 22 bp, Homo sapiens
tttcaataaaagataaattatt

SEQ ID NO: 1621697 - DNA, 18 bp, Homo sapiens
tttcaataccagggaagt

SEQ ID NO: 1621698 - DNA, 13 bp, Homo sapiens
tttcaatatattg

SEQ ID NO: 1621699 - DNA, 18 bp, Homo sapiens
tttcaatatattgaactt

SEQ ID NO: 1621700 - DNA, 19 bp, Homo sapiens
tttcaatatattgaacttt

SEQ ID NO: 1621701 - DNA, 13 bp, Homo sapiens
tttcaatcaactt

SEQ ID NO: 1621702 - DNA, 13 bp, Homo sapiens
tttcaatcttcta

SEQ ID NO: 1621703 - DNA, 20 bp, Homo sapiens
tttcaatcttttaaattgca

SEQ ID NO: 1621704 - DNA, 12 bp, Homo sapiens
tttcaattatat

SEQ ID NO: 1621705 - DNA, 14 bp, Homo sapiens
tttcacaaatttgt

SEQ ID NO: 1621706 - DNA, 13 bp, Homo sapiens
tttcacaacagat

SEQ ID NO: 1621707 - DNA, 21 bp, Homo sapiens
tttcacaaggtacaaaatctt

SEQ ID NO: 1621708 - DNA, 20 bp, Homo sapiens
tttcacaccggaaggttttt

SEQ ID NO: 1621709 - DNA, 21 bp, Homo sapiens
tttcacactggtaaatgttac

SEQ ID NO: 1621710 - DNA, 14 bp, Homo sapiens
tttcacagaaaata

SEQ ID NO: 1621711 - DNA, 13 bp, Homo sapiens
tttcacagctcct

SEQ ID NO: 1621712 - DNA, 17 bp, Homo sapiens
tttcacaggtcaataaa

SEQ ID NO: 1621713 - DNA, 18 bp, Homo sapiens
tttcacagtgaagtgcct

SEQ ID NO: 1621714 - DNA, 19 bp, Homo sapiens
tttcacagtgtgtttgtga

SEQ ID NO: 1621715 - DNA, 15 bp, Homo sapiens
tttcacagtttttcc

SEQ ID NO: 1621716 - DNA, 18 bp, Homo sapiens
tttcacatagctgtctag

SEQ ID NO: 1621717 - DNA, 20 bp, Homo sapiens
tttcacatataaatagatga

SEQ ID NO: 1621718 - DNA, 14 bp, Homo sapiens
tttcacatatttgt

SEQ ID NO: 1621719 - DNA, 15 bp, Homo sapiens
tttcacattaatatt

SEQ ID NO: 1621720 - DNA, 20 bp, Homo sapiens
tttcaccaaaatttctacac

SEQ ID NO: 1621721 - DNA, 15 bp, Homo sapiens
tttcaccagaagtta

SEQ ID NO: 1621722 - DNA, 20 bp, Homo sapiens
tttcaccagaatttctaaga

SEQ ID NO: 1621723 - DNA, 22 bp, Homo sapiens
tttcacccctccctttctcccc

SEQ ID NO: 1621724 - DNA, 16 bp, Homo sapiens
tttcacctactttgta

SEQ ID NO: 1621725 - DNA, 20 bp, Homo sapiens
tttcacctactttgtaagtg

SEQ ID NO: 1621726 - DNA, 15 bp, Homo sapiens
tttcacctgctgctt

SEQ ID NO: 1621727 - DNA, 21 bp, Homo sapiens
tttcaccttttcaggaaaata

SEQ ID NO: 1621728 - DNA, 19 bp, Homo sapiens
tttcactatttttatttat

SEQ ID NO: 1621729 - DNA, 14 bp, Homo sapiens
tttcactgctggct

SEQ ID NO: 1621730 - DNA, 18 bp, Homo sapiens
tttcactgctggctgcct

SEQ ID NO: 1621731 - DNA, 17 bp, Homo sapiens
tttcactgtactgcatg

SEQ ID NO: 1621732 - DNA, 16 bp, Homo sapiens
tttcacttacctgaaa

SEQ ID NO: 1621733 - DNA, 20 bp, Homo sapiens
tttcacttacctgaaaagta

SEQ ID NO: 1621734 - DNA, 18 bp, Homo sapiens
tttcacttgaaagatttt

SEQ ID NO: 1621735 - DNA, 16 bp, Homo sapiens
tttcacttgtattgac

SEQ ID NO: 1621736 - DNA, 21 bp, Homo sapiens
tttcactttcacatagatgtc

SEQ ID NO: 1621737 - DNA, 13 bp, Homo sapiens
tttcactttgaaa

SEQ ID NO: 1621738 - DNA, 15 bp, Homo sapiens
tttcactttgaaaag

SEQ ID NO: 1621739 - DNA, 21 bp, Homo sapiens
tttcagaaagcctttcatttt

SEQ ID NO: 1621740 - DNA, 22 bp, Homo sapiens
tttcagaaatacagataaatga

SEQ ID NO: 1621741 - DNA, 21 bp, Homo sapiens
tttcagaaatataacacattt

SEQ ID NO: 1621742 - DNA, 20 bp, Homo sapiens
tttcagaacctcttccccag

SEQ ID NO: 1621743 - DNA, 21 bp, Homo sapiens
tttcagaagtgagctttgctg

SEQ ID NO: 1621744 - DNA, 20 bp, Homo sapiens
tttcagaagttagtttgtat

SEQ ID NO: 1621745 - DNA, 22 bp, Homo sapiens
tttcagaagtttaaatattaag

SEQ ID NO: 1621746 - DNA, 12 bp, Homo sapiens
tttcagacattt

SEQ ID NO: 1621747 - DNA, 10 bp, Homo sapiens
tttcagaccc

SEQ ID NO: 1621748 - DNA, 14 bp, Homo sapiens
tttcagaccccagc

SEQ ID NO: 1621749 - DNA, 21 bp, Homo sapiens
tttcagactttaaaattctaa

SEQ ID NO: 1621750 - DNA, 16 bp, Homo sapiens
tttcagagaccattgc

SEQ ID NO: 1621751 - DNA, 18 bp, Homo sapiens
tttcagagccagcctggc

SEQ ID NO: 1621752 - DNA, 13 bp, Homo sapiens
tttcagagccagt

SEQ ID NO: 1621753 - DNA, 19 bp, Homo sapiens
tttcagagcccccagccct

SEQ ID NO: 1621754 - DNA, 22 bp, Homo sapiens
tttcagagcccccagccctggg

SEQ ID NO: 1621755 - DNA, 20 bp, Homo sapiens
tttcagatgcttctgggaga

SEQ ID NO: 1621756 - DNA, 22 bp, Homo sapiens
tttcagatgtgcaataatttgt

SEQ ID NO: 1621757 - DNA, 18 bp, Homo sapiens
tttcagcattaagctgtt

SEQ ID NO: 1621758 - DNA, 22 bp, Homo sapiens
tttcagccacatgccccaggct

SEQ ID NO: 1621759 - DNA, 14 bp, Homo sapiens
tttcagcctaagag

SEQ ID NO: 1621760 - DNA, 23 bp, Homo sapiens
tttcagcgactccgttggccact

SEQ ID NO: 1621761 - DNA, 17 bp, Homo sapiens
tttcagcttgtttctat

SEQ ID NO: 1621762 - DNA, 19 bp, Homo sapiens
tttcagcttgtttctatac

SEQ ID NO: 1621763 - DNA, 21 bp, Homo sapiens
tttcaggaaaatgtattgatt

SEQ ID NO: 1621764 - DNA, 23 bp, Homo sapiens
tttcaggaaaatgtattgattca

SEQ ID NO: 1621765 - DNA, 17 bp, Homo sapiens
tttcaggcattttgttc

SEQ ID NO: 1621766 - DNA, 15 bp, Homo sapiens
tttcaggccaaggct

SEQ ID NO: 1621767 - DNA, 21 bp, Homo sapiens
tttcaggggtcgtcaccacct

SEQ ID NO: 1621768 - DNA, 21 bp, Homo sapiens
tttcaggttcagtattatgta

SEQ ID NO: 1621769 - DNA, 20 bp, Homo sapiens
tttcagtcccctctctctgg

SEQ ID NO: 1621770 - DNA, 14 bp, Homo sapiens
tttcagtgtacatg

SEQ ID NO: 1621771 - DNA, 11 bp, Homo sapiens
tttcagtgtga

SEQ ID NO: 1621772 - DNA, 22 bp, Homo sapiens
tttcagttctttggattctaaa

SEQ ID NO: 1621773 - DNA, 19 bp, Homo sapiens
tttcagtttttcatttgtt

SEQ ID NO: 1621774 - DNA, 17 bp, Homo sapiens
tttcataaacaagttcg

SEQ ID NO: 1621775 - DNA, 21 bp, Homo sapiens
tttcataatgcagaagtattc

SEQ ID NO: 1621776 - DNA, 17 bp, Homo sapiens
tttcatagtataacttt

SEQ ID NO: 1621777 - DNA, 18 bp, Homo sapiens
tttcatataaatggaatt

SEQ ID NO: 1621778 - DNA, 15 bp, Homo sapiens
tttcatatgctgtat

SEQ ID NO: 1621779 - DNA, 12 bp, Homo sapiens
tttcatcaaaaa

SEQ ID NO: 1621780 - DNA, 19 bp, Homo sapiens
tttcatcccgtatcacagt

SEQ ID NO: 1621781 - DNA, 15 bp, Homo sapiens
tttcatccttcccca

SEQ ID NO: 1621782 - DNA, 19 bp, Homo sapiens
tttcatctaccttttctgg

SEQ ID NO: 1621783 - DNA, 18 bp, Homo sapiens
tttcatctatttctgaga

SEQ ID NO: 1621784 - DNA, 16 bp, Homo sapiens
tttcatctcttgtata

SEQ ID NO: 1621785 - DNA, 22 bp, Homo sapiens
tttcatctgctctccttcctgg

SEQ ID NO: 1621786 - DNA, 14 bp, Homo sapiens
tttcatgaaaatac

SEQ ID NO: 1621787 - DNA, 17 bp, Homo sapiens
tttcatgaaaataccat

SEQ ID NO: 1621788 - DNA, 16 bp, Homo sapiens
tttcatgaatgtgctg

SEQ ID NO: 1621789 - DNA, 16 bp, Homo sapiens
tttcctggaatttttc

SEQ ID NO: 1621790 - DNA, 18 bp, Homo sapiens
tttcctgggcctttgcaa

SEQ ID NO: 1621791 - DNA, 19 bp, Homo sapiens
tttcctggtgccaatttca

SEQ ID NO: 1621792 - DNA, 22 bp, Homo sapiens
tttcctggtgccaatttcaagt

SEQ ID NO: 1621793 - DNA, 15 bp, Homo sapiens
tttcctgtttgggaa

SEQ ID NO: 1621794 - DNA, 14 bp, Homo sapiens
tttccttaaacatg

SEQ ID NO: 1621795 - DNA, 15 bp, Homo sapiens
tttccttaaacatga

SEQ ID NO: 1621796 - DNA, 19 bp, Homo sapiens
tttccttagacccgccagg

SEQ ID NO: 1621797 - DNA, 14 bp, Homo sapiens
tttccttcaggttt

SEQ ID NO: 1621798 - DNA, 15 bp, Homo sapiens
tttccttcaggtttt

SEQ ID NO: 1621799 - DNA, 15 bp, Homo sapiens
tttccttccatccct

SEQ ID NO: 1621800 - DNA, 10 bp, Homo sapiens
tttccttccc

SEQ ID NO: 1621801 - DNA, 13 bp, Homo sapiens
tttccttcccaat

SEQ ID NO: 1621802 - DNA, 19 bp, Homo sapiens
tttccttccctctcctgct

SEQ ID NO: 1621803 - DNA, 18 bp, Homo sapiens
tttccttctcatctgtga

SEQ ID NO: 1621804 - DNA, 14 bp, Homo sapiens
tttccttctgttaa

SEQ ID NO: 1621805 - DNA, 13 bp, Homo sapiens
tttcctttatgtg

SEQ ID NO: 1621806 - DNA, 21 bp, Homo sapiens
tttcctttatgtgaattttta

SEQ ID NO: 1621807 - DNA, 12 bp, Homo sapiens
tttcctttgaac

SEQ ID NO: 1621808 - DNA, 18 bp, Homo sapiens
tttcctttgaacgtgctt

SEQ ID NO: 1621809 - DNA, 19 bp, Homo sapiens
tttcctttgaacgtgcttc

SEQ ID NO: 1621810 - DNA, 21 bp, Homo sapiens
tttcctttgaacgtgcttctt

SEQ ID NO: 1621811 - DNA, 13 bp, Homo sapiens
tttccttttcatt

SEQ ID NO: 1621812 - DNA, 12 bp, Homo sapiens
tttccttttgga

SEQ ID NO: 1621813 - DNA, 21 bp, Homo sapiens
tttcctttttaaggtctttca

SEQ ID NO: 1621814 - DNA, 22 bp, Homo sapiens
tttccttttttaaaaaaatttt

SEQ ID NO: 1621815 - DNA, 17 bp, Homo sapiens
tttccttttttgtctat

SEQ ID NO: 1621816 - DNA, 16 bp, Homo sapiens
tttccttttttgttat

SEQ ID NO: 1621817 - DNA, 16 bp, Homo sapiens
tttcgactggtccagc

SEQ ID NO: 1621818 - DNA, 16 bp, Homo sapiens
tttcgccccctgcctg

SEQ ID NO: 1621819 - DNA, 15 bp, Homo sapiens
tttcgggctgagaag

SEQ ID NO: 1621820 - DNA, 15 bp, Homo sapiens
tttcgtctactgcaa

SEQ ID NO: 1621821 - DNA, 19 bp, Homo sapiens
tttcgtgtagtggaagagc

SEQ ID NO: 1621822 - DNA, 13 bp, Homo sapiens
tttcgttctgctg

SEQ ID NO: 1621823 - DNA, 17 bp, Homo sapiens
tttctaaacaagatttt

SEQ ID NO: 1621824 - DNA, 14 bp, Homo sapiens
tttctaaactgttt

SEQ ID NO: 1621825 - DNA, 14 bp, Homo sapiens
tttctaaataaaaa

SEQ ID NO: 1621826 - DNA, 15 bp, Homo sapiens
ttggtgttcctggaa

SEQ ID NO: 1621827 - DNA, 17 bp, Homo sapiens
ttggtgttcctggaagc

SEQ ID NO: 1621828 - DNA, 19 bp, Homo sapiens
ttggtgttcctggaagcag

SEQ ID NO: 1621829 - DNA, 21 bp, Homo sapiens
ttggtgttcgtttccatcatg

SEQ ID NO: 1621830 - DNA, 12 bp, Homo sapiens
ttggttaaaaat

SEQ ID NO: 1621831 - DNA, 14 bp, Homo sapiens
ttggttagaggaag

SEQ ID NO: 1621832 - DNA, 15 bp, Homo sapiens
ttggttcacctgtga

SEQ ID NO: 1621833 - DNA, 14 bp, Homo sapiens
ttggttctaaggac

SEQ ID NO: 1621834 - DNA, 15 bp, Homo sapiens
ttggttctaatagaa

SEQ ID NO: 1621835 - DNA, 17 bp, Homo sapiens
ttggttctatgctaaac

SEQ ID NO: 1621836 - DNA, 24 bp, Homo sapiens
ttggttgtgccttcccttctctgg

SEQ ID NO: 1621837 - DNA, 22 bp, Homo sapiens
ttggtttaaagaaagtgtattt

SEQ ID NO: 1621838 - DNA, 16 bp, Homo sapiens
ttggtttaatttaaag

SEQ ID NO: 1621839 - DNA, 16 bp, Homo sapiens
ttggtttcctatttcc

SEQ ID NO: 1621840 - DNA, 18 bp, Homo sapiens
ttggttttacacaggaag

SEQ ID NO: 1621841 - DNA, 13 bp, Homo sapiens
ttggttttatggt

SEQ ID NO: 1621842 - DNA, 19 bp, Homo sapiens
ttggttttttataaagtct

SEQ ID NO: 1621843 - DNA, 18 bp, Homo sapiens
ttgtaaaaaaagcaaaaa

SEQ ID NO: 1621844 - DNA, 13 bp, Homo sapiens
ttgtaaaacaatg

SEQ ID NO: 1621845 - DNA, 18 bp, Homo sapiens
ttgtaaaagaaatcatgt

SEQ ID NO: 1621846 - DNA, 22 bp, Homo sapiens
ttgtaaaagaaatcatgtccat

SEQ ID NO: 1621847 - DNA, 23 bp, Homo sapiens
ttgtaaaagaacagtaaacattg

SEQ ID NO: 1621848 - DNA, 14 bp, Homo sapiens
ttgtaaaagatgca

SEQ ID NO: 1621849 - DNA, 17 bp, Homo sapiens
ttgtaaaatagaaaaag

SEQ ID NO: 1621850 - DNA, 18 bp, Homo sapiens
ttgtaaaattgttcctga

SEQ ID NO: 1621851 - DNA, 16 bp, Homo sapiens
ttgtaaactcaaaata

SEQ ID NO: 1621852 - DNA, 15 bp, Homo sapiens
ttgtaaactgtatca

SEQ ID NO: 1621853 - DNA, 17 bp, Homo sapiens
ttgtaaagaaaaatatt

SEQ ID NO: 1621854 - DNA, 23 bp, Homo sapiens
ttgtaaagaaaaatatttaatgt

SEQ ID NO: 1621855 - DNA, 16 bp, Homo sapiens
ttgtaaagatttctgt

SEQ ID NO: 1621856 - DNA, 22 bp, Homo sapiens
ttgtaaagtcggtgattatatt

SEQ ID NO: 1621857 - DNA, 21 bp, Homo sapiens
ttgtaaataaagtctattttt

SEQ ID NO: 1621858 - DNA, 14 bp, Homo sapiens
ttgtaaataagaga

SEQ ID NO: 1621859 - DNA, 11 bp, Homo sapiens
ttgtaaataca

SEQ ID NO: 1621860 - DNA, 14 bp, Homo sapiens
ttgtaaatacacca

SEQ ID NO: 1621861 - DNA, 20 bp, Homo sapiens
ttgtaaatactggactcagg

SEQ ID NO: 1621862 - DNA, 15 bp, Homo sapiens
ttgtaaatcacttgt

SEQ ID NO: 1621863 - DNA, 12 bp, Homo sapiens
ttgtaaatcttt

SEQ ID NO: 1621864 - DNA, 13 bp, Homo sapiens
ttgtaaatgtact

SEQ ID NO: 1621865 - DNA, 14 bp, Homo sapiens
ttgtaaatgtgctt

SEQ ID NO: 1621866 - DNA, 11 bp, Homo sapiens
ttgtaactaca

SEQ ID NO: 1621867 - DNA, 12 bp, Homo sapiens
ttgtaactacaa

SEQ ID NO: 1621868 - DNA, 17 bp, Homo sapiens
ttgtaacttatattgaa

SEQ ID NO: 1621869 - DNA, 21 bp, Homo sapiens
ttgtaagaaataacactgtga

SEQ ID NO: 1621870 - DNA, 13 bp, Homo sapiens
ttgtaagaaggca

SEQ ID NO: 1621871 - DNA, 19 bp, Homo sapiens
ttgtaagaaggcaatatta

SEQ ID NO: 1621872 - DNA, 20 bp, Homo sapiens
ttgtaagaaggcaatattaa

SEQ ID NO: 1621873 - DNA, 24 bp, Homo sapiens
ttgtaagaaggcaatattaaccta

SEQ ID NO: 1621874 - DNA, 21 bp, Homo sapiens
ttgtaagacaaaggttttcct

SEQ ID NO: 1621875 - DNA, 19 bp, Homo sapiens
ttgtaagacaatccatgta

SEQ ID NO: 1621876 - DNA, 15 bp, Homo sapiens
ttgtaagacatttgt

SEQ ID NO: 1621877 - DNA, 13 bp, Homo sapiens
ttgtaagatgctg

SEQ ID NO: 1621878 - DNA, 15 bp, Homo sapiens
ttgtaagatgctggg

SEQ ID NO: 1621879 - DNA, 20 bp, Homo sapiens
ttgtaagatggataatgtgt

SEQ ID NO: 1621880 - DNA, 12 bp, Homo sapiens
ttgtaagccatc

SEQ ID NO: 1621881 - DNA, 16 bp, Homo sapiens
ttgtaagtaacacagt

SEQ ID NO: 1621882 - DNA, 21 bp, Homo sapiens
ttgtaagtgagagagacaaga

SEQ ID NO: 1621883 - DNA, 14 bp, Homo sapiens
ttgtaataaaatgt

SEQ ID NO: 1621884 - DNA, 18 bp, Homo sapiens
ttgtaataaagtatataa

SEQ ID NO: 1621885 - DNA, 13 bp, Homo sapiens
ttgtaatacttta

SEQ ID NO: 1621886 - DNA, 21 bp, Homo sapiens
ttgtaatggatttttgacttt

SEQ ID NO: 1621887 - DNA, 17 bp, Homo sapiens
ttgtaattaaaagcaaa

SEQ ID NO: 1621888 - DNA, 14 bp, Homo sapiens
ttgtaattctaaat

SEQ ID NO: 1621889 - DNA, 22 bp, Homo sapiens
ttgtaatttaaaaagtgctata

SEQ ID NO: 1621890 - DNA, 22 bp, Homo sapiens
ttgtaatttaaacaggcccagc

SEQ ID NO: 1621891 - DNA, 16 bp, Homo sapiens
ttgtaattttaaaagt

SEQ ID NO: 1621892 - DNA, 14 bp, Homo sapiens
ttgtacaaaataaa

SEQ ID NO: 1621893 - DNA, 20 bp, Homo sapiens
ttgtacaaatgtaagcaaag

SEQ ID NO: 1621894 - DNA, 11 bp, Homo sapiens
ttgtacaataa

SEQ ID NO: 1621895 - DNA, 21 bp, Homo sapiens
ttgtacaatggtttattccca

SEQ ID NO: 1621896 - DNA, 17 bp, Homo sapiens
ttgtacagaatatttct

SEQ ID NO: 1621897 - DNA, 21 bp, Homo sapiens
ttgtacagactgttttactgt

SEQ ID NO: 1621898 - DNA, 17 bp, Homo sapiens
ttgtacaggactgtaaa

SEQ ID NO: 1621899 - DNA, 21 bp, Homo sapiens
ttgtacaggactgtaaagatt

SEQ ID NO: 1621900 - DNA, 23 bp, Homo sapiens
ttgtacaggactgtaaagatttg

SEQ ID NO: 1621901 - DNA, 23 bp, Homo sapiens
ttgtacatacgatttaaggtatt

SEQ ID NO: 1621902 - DNA, 18 bp, Homo sapiens
ttgtacatatgtaaaata

SEQ ID NO: 1621903 - DNA, 20 bp, Homo sapiens
ttgtacatgtgtagcctgtg

SEQ ID NO: 1621904 - DNA, 23 bp, Homo sapiens
ttgtacattacactaaattatta

SEQ ID NO: 1621905 - DNA, 20 bp, Homo sapiens
ttgtacatttgggagttttt

SEQ ID NO: 1621906 - DNA, 23 bp, Homo sapiens
ttgtacatttttaaattcttact

SEQ ID NO: 1621907 - DNA, 21 bp, Homo sapiens
ttgtacctgtaggactctcat

SEQ ID NO: 1621908 - DNA, 23 bp, Homo sapiens
ttgtacgaagagtatttttgaca

SEQ ID NO: 1621909 - DNA, 16 bp, Homo sapiens
ttgtactatttaactg

SEQ ID NO: 1621910 - DNA, 19 bp, Homo sapiens
ttgtactatttaactgact

SEQ ID NO: 1621911 - DNA, 22 bp, Homo sapiens
ttgtactatttaactgactatt

SEQ ID NO: 1621912 - DNA, 14 bp, Homo sapiens
ttgtactgaatttt

SEQ ID NO: 1621913 - DNA, 18 bp, Homo sapiens
ttgtactgttgctttaat

SEQ ID NO: 1621914 - DNA, 15 bp, Homo sapiens
ttgtacttaaatggt

SEQ ID NO: 1621915 - DNA, 12 bp, Homo sapiens
ttgtacttctgt

SEQ ID NO: 1621916 - DNA, 19 bp, Homo sapiens
ttgtactttatcatgaatg

SEQ ID NO: 1621917 - DNA, 22 bp, Homo sapiens
ttgtactttctgttaaaatgca

SEQ ID NO: 1621918 - DNA, 18 bp, Homo sapiens
ttgtactttgtggagaga

SEQ ID NO: 1621919 - DNA, 22 bp, Homo sapiens
ttgtagaactcactctgggctg

SEQ ID NO: 1621920 - DNA, 13 bp, Homo sapiens
ttgtagaacttta

SEQ ID NO: 1621921 - DNA, 22 bp, Homo sapiens
ttgtagcagattgtttcctctt

SEQ ID NO: 1621922 - DNA, 22 bp, Homo sapiens
ttgtagccttcctccacatcct

SEQ ID NO: 1621923 - DNA, 15 bp, Homo sapiens
ttgtaggagacttgc

SEQ ID NO: 1621924 - DNA, 16 bp, Homo sapiens
ttgtagtgtgtgctta

SEQ ID NO: 1621925 - DNA, 23 bp, Homo sapiens
ttgtagttaatttattaagtctg

SEQ ID NO: 1621926 - DNA, 12 bp, Homo sapiens
ttgtataaataa

SEQ ID NO: 1621927 - DNA, 20 bp, Homo sapiens
ttgtataaataaatattttt

SEQ ID NO: 1621928 - DNA, 24 bp, Homo sapiens
ttgtataagtcaagcacatgtaat

SEQ ID NO: 1621929 - DNA, 14 bp, Homo sapiens
ttgtatagtgtaaa

SEQ ID NO: 1621930 - DNA, 19 bp, Homo sapiens
ttgtatatattattataat

SEQ ID NO: 1621931 - DNA, 18 bp, Homo sapiens
ttgtatattatggaagat

SEQ ID NO: 1621932 - DNA, 20 bp, Homo sapiens
ttgtatattatggaagattt

SEQ ID NO: 1621933 - DNA, 16 bp, Homo sapiens
ttgtatattgtcagat

SEQ ID NO: 1621934 - DNA, 19 bp, Homo sapiens
ttgtatattgtcagatatt

SEQ ID NO: 1621935 - DNA, 21 bp, Homo sapiens
ttgtatattgtggatgtgttc

SEQ ID NO: 1621936 - DNA, 19 bp, Homo sapiens
ctcgtggccagcccggctg

SEQ ID NO: 1621937 - DNA, 21 bp, Homo sapiens
ctcgtggccttccccagcctc

SEQ ID NO: 1621938 - DNA, 19 bp, Homo sapiens
ctcgtgtatcctggggctc

SEQ ID NO: 1621939 - DNA, 12 bp, Homo sapiens
ctcgtgtgattt

SEQ ID NO: 1621940 - DNA, 16 bp, Homo sapiens
ttgtatcacaaatctt

SEQ ID NO: 1621941 - DNA, 14 bp, Homo sapiens
ttgtatctcttttg

SEQ ID NO: 1621942 - DNA, 19 bp, Homo sapiens
ttgtatctttatgctgtat

SEQ ID NO: 1621943 - DNA, 20 bp, Homo sapiens
ttgtatctttatgctgtatt

SEQ ID NO: 1621944 - DNA, 18 bp, Homo sapiens
ttgtatctttctttctct

SEQ ID NO: 1621945 - DNA, 16 bp, Homo sapiens
ttgtatgagatggtta

SEQ ID NO: 1621946 - DNA, 22 bp, Homo sapiens
ttgtatgagatggttaaaaagg

SEQ ID NO: 1621947 - DNA, 23 bp, Homo sapiens
ttgtatgagatggttaaaaaggc

SEQ ID NO: 1621948 - DNA, 17 bp, Homo sapiens
ttgtatgcagggagcac

SEQ ID NO: 1621949 - DNA, 20 bp, Homo sapiens
ttgtatgcctttaaatctgt

SEQ ID NO: 1621950 - DNA, 13 bp, Homo sapiens
ttgtatgctgccc

SEQ ID NO: 1621951 - DNA, 16 bp, Homo sapiens
ttgtatgtcaaagctt

SEQ ID NO: 1621952 - DNA, 14 bp, Homo sapiens
ttgtattaataaag

SEQ ID NO: 1621953 - DNA, 18 bp, Homo sapiens
ttgtattaataaagcatt

SEQ ID NO: 1621954 - DNA, 21 bp, Homo sapiens
ttgtattagcccgttttcaca

SEQ ID NO: 1621955 - DNA, 15 bp, Homo sapiens
ttgtattaggaaaat

SEQ ID NO: 1621956 - DNA, 12 bp, Homo sapiens
ttgtattcatgt

SEQ ID NO: 1621957 - DNA, 14 bp, Homo sapiens
ttgtattctgtctt

SEQ ID NO: 1621958 - DNA, 22 bp, Homo sapiens
ttgtattcttttccaagctcct

SEQ ID NO: 1621959 - DNA, 17 bp, Homo sapiens
ttgtattgaaaacactt

SEQ ID NO: 1621960 - DNA, 23 bp, Homo sapiens
ttgtattgttaatgcatcatcat

SEQ ID NO: 1621961 - DNA, 18 bp, Homo sapiens
ttgtatttaacagaaatt

SEQ ID NO: 1621962 - DNA, 16 bp, Homo sapiens
ttgtatttatgtgtat

SEQ ID NO: 1621963 - DNA, 14 bp, Homo sapiens
ttgtatttattctt

SEQ ID NO: 1621964 - DNA, 17 bp, Homo sapiens
ttgtatttatttccaga

SEQ ID NO: 1621965 - DNA, 15 bp, Homo sapiens
ttgtatttctatatt

SEQ ID NO: 1621966 - DNA, 19 bp, Homo sapiens
ttgtatttctcttgtcctt

SEQ ID NO: 1621967 - DNA, 14 bp, Homo sapiens
ttgtattttgttaa

SEQ ID NO: 1621968 - DNA, 19 bp, Homo sapiens
ttgtattttgttaaagctg

SEQ ID NO: 1621969 - DNA, 19 bp, Homo sapiens
ttgtattttttatttacat

SEQ ID NO: 1621970 - DNA, 13 bp, Homo sapiens
ttgtcaaagaagc

SEQ ID NO: 1621971 - DNA, 20 bp, Homo sapiens
ttgtcaaagaagcttccaca

SEQ ID NO: 1621972 - DNA, 17 bp, Homo sapiens
ttgtcaagacagtgtca

SEQ ID NO: 1621973 - DNA, 21 bp, Homo sapiens
ttgtcaaggaagaagaaatct

SEQ ID NO: 1621974 - DNA, 23 bp, Homo sapiens
ttgtcaaggatggttttgggact

SEQ ID NO: 1621975 - DNA, 14 bp, Homo sapiens
ttgtcacaataaat

SEQ ID NO: 1621976 - DNA, 18 bp, Homo sapiens
ttgtcactagcagctgca

SEQ ID NO: 1621977 - DNA, 13 bp, Homo sapiens
ttgtcactgaata

SEQ ID NO: 1621978 - DNA, 21 bp, Homo sapiens
ttgtcactttttatgctattt

SEQ ID NO: 1621979 - DNA, 18 bp, Homo sapiens
ttgtcagcaagaggagga

SEQ ID NO: 1621980 - DNA, 16 bp, Homo sapiens
ttgtcagcatctgacc

SEQ ID NO: 1621981 - DNA, 17 bp, Homo sapiens
ttgtcagcatctgacca

SEQ ID NO: 1621982 - DNA, 19 bp, Homo sapiens
ttgtcagcatctgaccatc

SEQ ID NO: 1621983 - DNA, 12 bp, Homo sapiens
ttgtcagctact

SEQ ID NO: 1621984 - DNA, 17 bp, Homo sapiens
ttgtcagtttatcttaa

SEQ ID NO: 1621985 - DNA, 21 bp, Homo sapiens
ttgtcatgaactgtactactc

SEQ ID NO: 1621986 - DNA, 20 bp, Homo sapiens
ttgtcattcaagcctgtgaa

SEQ ID NO: 1621987 - DNA, 15 bp, Homo sapiens
ttgtccaatttgtaa

SEQ ID NO: 1621988 - DNA, 18 bp, Homo sapiens
ttgtccaatttgtaagta

SEQ ID NO: 1621989 - DNA, 23 bp, Homo sapiens
ttgtcccagcctggggctccctc

SEQ ID NO: 1621990 - DNA, 15 bp, Homo sapiens
ttgtccccagggccc

SEQ ID NO: 1621991 - DNA, 14 bp, Homo sapiens
ttgtcccccaactt

SEQ ID NO: 1621992 - DNA, 16 bp, Homo sapiens
ttgtcccccaacttga

SEQ ID NO: 1621993 - DNA, 15 bp, Homo sapiens
ttgtccggtttactt

SEQ ID NO: 1621994 - DNA, 17 bp, Homo sapiens
ttgtccggtttacttta

SEQ ID NO: 1621995 - DNA, 21 bp, Homo sapiens
ttgtccggtttactttaactt

SEQ ID NO: 1621996 - DNA, 13 bp, Homo sapiens
ttgtcctcccctt

SEQ ID NO: 1621997 - DNA, 16 bp, Homo sapiens
ttgtcctccttttcac

SEQ ID NO: 1621998 - DNA, 18 bp, Homo sapiens
ttgtcctcttctgctctt

SEQ ID NO: 1621999 - DNA, 13 bp, Homo sapiens
ttgtcctgccagc

SEQ ID NO: 1622000 - DNA, 15 bp, Homo sapiens
ttgtcctgccagctg

SEQ ID NO: 1622001 - DNA, 17 bp, Homo sapiens
ttgtcctgccagctgcc

SEQ ID NO: 1622002 - DNA, 20 bp, Homo sapiens
ttgtcctgcctgcaatattt

SEQ ID NO: 1622003 - DNA, 15 bp, Homo sapiens
ttgtccttcagagct

SEQ ID NO: 1622004 - DNA, 22 bp, Homo sapiens
ttgtcgaaaagagtcttccaat

SEQ ID NO: 1622005 - DNA, 20 bp, Homo sapiens
ttgtcgggcaccagccagcg

SEQ ID NO: 1622006 - DNA, 15 bp, Homo sapiens
ttgtctaactcagaa

SEQ ID NO: 1622007 - DNA, 15 bp, Homo sapiens
ttgtctatgaagttg

SEQ ID NO: 1622008 - DNA, 16 bp, Homo sapiens
ttgtctatgaagttgc

SEQ ID NO: 1622009 - DNA, 21 bp, Homo sapiens
ttgtctatgaagttgctgttt

SEQ ID NO: 1622010 - DNA, 19 bp, Homo sapiens
ttgtctattctgagccttg

SEQ ID NO: 1622011 - DNA, 13 bp, Homo sapiens
ttgtctattttaa

SEQ ID NO: 1622012 - DNA, 18 bp, Homo sapiens
ttgtctatttttgtctta

SEQ ID NO: 1622013 - DNA, 17 bp, Homo sapiens
ttgtctgaagtcactgc

SEQ ID NO: 1622014 - DNA, 18 bp, Homo sapiens
ttgtctgaagtcactgca

SEQ ID NO: 1622015 - DNA, 21 bp, Homo sapiens
ttgtctgaagtcactgcacag

SEQ ID NO: 1622016 - DNA, 16 bp, Homo sapiens
ttgtctgatttcttag

SEQ ID NO: 1622017 - DNA, 15 bp, Homo sapiens
ttgtctgcgcctgaa

SEQ ID NO: 1622018 - DNA, 13 bp, Homo sapiens
ttgtctgtacagt

SEQ ID NO: 1622019 - DNA, 12 bp, Homo sapiens
ttgtctgtctac

SEQ ID NO: 1622020 - DNA, 23 bp, Homo sapiens
ttgtcttaagatggaaatacagt

SEQ ID NO: 1622021 - DNA, 18 bp, Homo sapiens
ttgtcttatgtgaaaaat

SEQ ID NO: 1622022 - DNA, 15 bp, Homo sapiens
ttgtcttattgacag

SEQ ID NO: 1622023 - DNA, 13 bp, Homo sapiens
ttgtcttgaaaga

SEQ ID NO: 1622024 - DNA, 22 bp, Homo sapiens
ttgtcttgaatgtcttttgaat

SEQ ID NO: 1622025 - DNA, 16 bp, Homo sapiens
ttgtcttgatgttttt

SEQ ID NO: 1622026 - DNA, 15 bp, Homo sapiens
ttgtcttgtaattgt

SEQ ID NO: 1622027 - DNA, 16 bp, Homo sapiens
ttgtcttgtaattgtg

SEQ ID NO: 1622028 - DNA, 22 bp, Homo sapiens
ttgtcttgtacttctgtgttca

SEQ ID NO: 1622029 - DNA, 14 bp, Homo sapiens
ttgtctttgctgta

SEQ ID NO: 1622030 - DNA, 19 bp, Homo sapiens
ttgtctttgctgtactctt

SEQ ID NO: 1622031 - DNA, 19 bp, Homo sapiens
ttgtcttttaatgcttcat

SEQ ID NO: 1622032 - DNA, 22 bp, Homo sapiens
ttgtcttttcaatcttctactt

SEQ ID NO: 1622033 - DNA, 16 bp, Homo sapiens
ttgtcttttttttcct

SEQ ID NO: 1622034 - DNA, 16 bp, Homo sapiens
ttgtgaaacacagctg

SEQ ID NO: 1622035 - DNA, 17 bp, Homo sapiens
ttgtgaaacacagctgt

SEQ ID NO: 1622036 - DNA, 17 bp, Homo sapiens
ttgtgaaatgaaaacat

SEQ ID NO: 1622037 - DNA, 23 bp, Homo sapiens
ttgtgaaatgaaaacatgtaata

SEQ ID NO: 1622038 - DNA, 17 bp, Homo sapiens
ttgtgaactttttgtag

SEQ ID NO: 1622039 - DNA, 22 bp, Homo sapiens
ttgtgaagccatgagttccaga

SEQ ID NO: 1622040 - DNA, 13 bp, Homo sapiens
ttgtgaataatta

SEQ ID NO: 1622041 - DNA, 15 bp, Homo sapiens
ttgtgaataattaca

SEQ ID NO: 1622042 - DNA, 15 bp, Homo sapiens
ttgtgaatacattct

SEQ ID NO: 1622043 - DNA, 22 bp, Homo sapiens
ttgtgaatacattctttgctag

SEQ ID NO: 1622044 - DNA, 15 bp, Homo sapiens
ttgtgacattcgtga

SEQ ID NO: 1622045 - DNA, 17 bp, Homo sapiens
ttgtgaccaatacattt

SEQ ID NO: 1622046 - DNA, 19 bp, Homo sapiens
ttgtgaccaatacatttgt

SEQ ID NO: 1622047 - DNA, 14 bp, Homo sapiens
ttgtgacttcactg

SEQ ID NO: 1622048 - DNA, 17 bp, Homo sapiens
ttgtgacttcactgtat

SEQ ID NO: 1622049 - DNA, 18 bp, Homo sapiens
ttgtgacttcactgtata

SEQ ID NO: 1622050 - DNA, 18 bp, Homo sapiens
ttgtgacttttgctttaa

SEQ ID NO: 1622051 - DNA, 11 bp, Homo sapiens
ttgtgagagcg

SEQ ID NO: 1622052 - DNA, 12 bp, Homo sapiens
ttgtgagatggg

SEQ ID NO: 1622053 - DNA, 12 bp, Homo sapiens
ttgtgagctgga

SEQ ID NO: 1622054 - DNA, 13 bp, Homo sapiens
ttgtgagctggat

SEQ ID NO: 1622055 - DNA, 23 bp, Homo sapiens
ttgttctcagaatcccttaacag

SEQ ID NO: 1622056 - DNA, 20 bp, Homo sapiens
ttgttctctgaattttcaga

SEQ ID NO: 1622057 - DNA, 15 bp, Homo sapiens
ttgttctctgggaga

SEQ ID NO: 1622058 - DNA, 14 bp, Homo sapiens
ttgttctgttgtct

SEQ ID NO: 1622059 - DNA, 14 bp, Homo sapiens
ctctctccaggtca

SEQ ID NO: 1622060 - DNA, 18 bp, Homo sapiens
ctctctccaggtcagcct

SEQ ID NO: 1622061 - DNA, 21 bp, Homo sapiens
ctctctccaggtcagcctgga

SEQ ID NO: 1622062 - DNA, 14 bp, Homo sapiens
ctctctcccaggac

SEQ ID NO: 1622063 - DNA, 21 bp, Homo sapiens
ctctctcccctctgcaacccc

SEQ ID NO: 1622064 - DNA, 13 bp, Homo sapiens
ctctctccctggt

SEQ ID NO: 1622065 - DNA, 15 bp, Homo sapiens
ctctctcctgtactt

SEQ ID NO: 1622066 - DNA, 15 bp, Homo sapiens
ctctctcctttgctg

SEQ ID NO: 1622067 - DNA, 23 bp, Homo sapiens
ctctctcgctcgctcgctctcgc

SEQ ID NO: 1622068 - DNA, 14 bp, Homo sapiens
ctctctctccctcc

SEQ ID NO: 1622069 - DNA, 13 bp, Homo sapiens
ctctctctctcgc

SEQ ID NO: 1622070 - DNA, 15 bp, Homo sapiens
ctctctctctctcgc

SEQ ID NO: 1622071 - DNA, 14 bp, Homo sapiens
ctctctctcttcta

SEQ ID NO: 1622072 - DNA, 10 bp, Homo sapiens
ctctctctga

SEQ ID NO: 1622073 - DNA, 13 bp, Homo sapiens
ctctctctgagga

SEQ ID NO: 1622074 - DNA, 14 bp, Homo sapiens
ctctctctgcctga

SEQ ID NO: 1622075 - DNA, 12 bp, Homo sapiens
ctctctctgggc

SEQ ID NO: 1622076 - DNA, 14 bp, Homo sapiens
ctctctctgggtca

SEQ ID NO: 1622077 - DNA, 14 bp, Homo sapiens
ctctctctgtgggg

SEQ ID NO: 1622078 - DNA, 15 bp, Homo sapiens
ctctctcttcccagc

SEQ ID NO: 1622079 - DNA, 18 bp, Homo sapiens
ctctctcttctgctccac

SEQ ID NO: 1622080 - DNA, 21 bp, Homo sapiens
ctctctcttctgctccaccct

SEQ ID NO: 1622081 - DNA, 18 bp, Homo sapiens
ctctctgagggggtgggg

SEQ ID NO: 1622082 - DNA, 19 bp, Homo sapiens
ctctctgagggggtggggg

SEQ ID NO: 1622083 - DNA, 14 bp, Homo sapiens
ctctctgagtcaaa

SEQ ID NO: 1622084 - DNA, 22 bp, Homo sapiens
ctctctgagtcaaatccagtgg

SEQ ID NO: 1622085 - DNA, 22 bp, Homo sapiens
ctctctgatcttgtgctcagca

SEQ ID NO: 1622086 - DNA, 17 bp, Homo sapiens
ctctctgcagccagccc

SEQ ID NO: 1622087 - DNA, 18 bp, Homo sapiens
ctctctgcagccagccca

SEQ ID NO: 1622088 - DNA, 13 bp, Homo sapiens
ctctctgcagctg

SEQ ID NO: 1622089 - DNA, 15 bp, Homo sapiens
ctctctgcagctgcc

SEQ ID NO: 1622090 - DNA, 11 bp, Homo sapiens
ctctctgccct

SEQ ID NO: 1622091 - DNA, 22 bp, Homo sapiens
ctctctgcctgtgagccagtct

SEQ ID NO: 1622092 - DNA, 13 bp, Homo sapiens
ctctctgctcctt

SEQ ID NO: 1622093 - DNA, 12 bp, Homo sapiens
ctctctgctcta

SEQ ID NO: 1622094 - DNA, 16 bp, Homo sapiens
ctctctgctctagcca

SEQ ID NO: 1622095 - DNA, 17 bp, Homo sapiens
ctctctgctctagccag

SEQ ID NO: 1622096 - DNA, 10 bp, Homo sapiens
ctctctggag

SEQ ID NO: 1622097 - DNA, 13 bp, Homo sapiens
ctctctggcctcc

SEQ ID NO: 1622098 - DNA, 19 bp, Homo sapiens
ctctctggcctcccacccg

SEQ ID NO: 1622099 - DNA, 20 bp, Homo sapiens
ctctctggcctcccacccga

SEQ ID NO: 1622100 - DNA, 14 bp, Homo sapiens
ctctctggctcagg

SEQ ID NO: 1622101 - DNA, 15 bp, Homo sapiens
ctctctggctcaggt

SEQ ID NO: 1622102 - DNA, 18 bp, Homo sapiens
ctctctggctcaggtgtg

SEQ ID NO: 1622103 - DNA, 13 bp, Homo sapiens
ctctctggcttct

SEQ ID NO: 1622104 - DNA, 18 bp, Homo sapiens
ctctctggcttctctctt

SEQ ID NO: 1622105 - DNA, 20 bp, Homo sapiens
ctctctgggactctcctcct

SEQ ID NO: 1622106 - DNA, 22 bp, Homo sapiens
ctctctgggcctgggttccagg

SEQ ID NO: 1622107 - DNA, 19 bp, Homo sapiens
ctctcttatagaatattta

SEQ ID NO: 1622108 - DNA, 22 bp, Homo sapiens
ctctcttcagcccctagtgcta

SEQ ID NO: 1622109 - DNA, 24 bp, Homo sapiens
ctctcttcaggaggccctggtgtc

SEQ ID NO: 1622110 - DNA, 18 bp, Homo sapiens
ctctcttcccttctccct

SEQ ID NO: 1622111 - DNA, 13 bp, Homo sapiens
ctctcttcctgtc

SEQ ID NO: 1622112 - DNA, 12 bp, Homo sapiens
ctctcttctgct

SEQ ID NO: 1622113 - DNA, 16 bp, Homo sapiens
ctctcttctgctccac

SEQ ID NO: 1622114 - DNA, 14 bp, Homo sapiens
ctctcttgcacccg

SEQ ID NO: 1622115 - DNA, 16 bp, Homo sapiens
ctctcttgcacccgcc

SEQ ID NO: 1622116 - DNA, 14 bp, Homo sapiens
ctctcttgcttgag

SEQ ID NO: 1622117 - DNA, 15 bp, Homo sapiens
ctctcttggctattg

SEQ ID NO: 1622118 - DNA, 18 bp, Homo sapiens
ctctctttatacagctgt

SEQ ID NO: 1622119 - DNA, 16 bp, Homo sapiens
ctctctttctccctca

SEQ ID NO: 1622120 - DNA, 16 bp, Homo sapiens
ctctcttttcctcctc

SEQ ID NO: 1622121 - DNA, 21 bp, Homo sapiens
ctctgaaaagcaattgccctg

SEQ ID NO: 1622122 - DNA, 21 bp, Homo sapiens
ctctgaaaatatttttttcta

SEQ ID NO: 1622123 - DNA, 23 bp, Homo sapiens
ctctgaagagtgggtttcacaag

SEQ ID NO: 1622124 - DNA, 19 bp, Homo sapiens
ctctgaagggcatcatgca

SEQ ID NO: 1622125 - DNA, 17 bp, Homo sapiens
ctctgaattttcagaga

SEQ ID NO: 1622126 - DNA, 17 bp, Homo sapiens
ctctgacaagggctgac

SEQ ID NO: 1622127 - DNA, 16 bp, Homo sapiens
ctctgacagtccacag

SEQ ID NO: 1622128 - DNA, 17 bp, Homo sapiens
ctctgacatcccttcct

SEQ ID NO: 1622129 - DNA, 19 bp, Homo sapiens
ctctgacatcccttcctgg

SEQ ID NO: 1622130 - DNA, 20 bp, Homo sapiens
ctctgacatcccttcctgga

SEQ ID NO: 1622131 - DNA, 17 bp, Homo sapiens
ctctgaccacagcccgc

SEQ ID NO: 1622132 - DNA, 22 bp, Homo sapiens
ctctgacccaagtggggcctcc

SEQ ID NO: 1622133 - DNA, 16 bp, Homo sapiens
ctctgaccgattcctt

SEQ ID NO: 1622134 - DNA, 14 bp, Homo sapiens
ctctgacgcttgtg

SEQ ID NO: 1622135 - DNA, 23 bp, Homo sapiens
ctctgacgcttgtgacagtgcct

SEQ ID NO: 1622136 - DNA, 20 bp, Homo sapiens
ctctgagacccttttctcag

SEQ ID NO: 1622137 - DNA, 13 bp, Homo sapiens
ctctgagagtcta

SEQ ID NO: 1622138 - DNA, 15 bp, Homo sapiens
ctctgagagtctaga

SEQ ID NO: 1622139 - DNA, 13 bp, Homo sapiens
ctctgagcagcct

SEQ ID NO: 1622140 - DNA, 19 bp, Homo sapiens
ctctgagcagcctctgcca

SEQ ID NO: 1622141 - DNA, 21 bp, Homo sapiens
ctctgagcagcctctgccagg

SEQ ID NO: 1622142 - DNA, 12 bp, Homo sapiens
ctctgagcccag

SEQ ID NO: 1622143 - DNA, 13 bp, Homo sapiens
ctctgagcccata

SEQ ID NO: 1622144 - DNA, 20 bp, Homo sapiens
ctctgaggctctttctgggc

SEQ ID NO: 1622145 - DNA, 20 bp, Homo sapiens
ctctgaggggaggcacctcc

SEQ ID NO: 1622146 - DNA, 13 bp, Homo sapiens
ctctgaggggtgg

SEQ ID NO: 1622147 - DNA, 20 bp, Homo sapiens
ctctgaggggtgggggtgcc

SEQ ID NO: 1622148 - DNA, 19 bp, Homo sapiens
ctctgaggtgcctgtccca

SEQ ID NO: 1622149 - DNA, 22 bp, Homo sapiens
ctctgaggtgcctgtcccaccc

SEQ ID NO: 1622150 - DNA, 14 bp, Homo sapiens
ctctgagtcaaatc

SEQ ID NO: 1622151 - DNA, 17 bp, Homo sapiens
ctctgagtcaaatccag

SEQ ID NO: 1622152 - DNA, 19 bp, Homo sapiens
ctctgagtcaaatccagtg

SEQ ID NO: 1622153 - DNA, 16 bp, Homo sapiens
ctctgagttctgtact

SEQ ID NO: 1622154 - DNA, 17 bp, Homo sapiens
ctctgagtttaccattt

SEQ ID NO: 1622155 - DNA, 18 bp, Homo sapiens
ctctgagtttaccatttg

SEQ ID NO: 1622156 - DNA, 20 bp, Homo sapiens
ctctgagtttaccatttgta

SEQ ID NO: 1622157 - DNA, 17 bp, Homo sapiens
ctctgatatgggactga

SEQ ID NO: 1622158 - DNA, 17 bp, Homo sapiens
ctctgatccttcttcct

SEQ ID NO: 1622159 - DNA, 19 bp, Homo sapiens
ctctgatctaacaaaataa

SEQ ID NO: 1622160 - DNA, 17 bp, Homo sapiens
ctctgattcacctcttc

SEQ ID NO: 1622161 - DNA, 22 bp, Homo sapiens
ctctgattcacctcttcctctg

SEQ ID NO: 1622162 - DNA, 18 bp, Homo sapiens
ctctgattttcaaagctt

SEQ ID NO: 1622163 - DNA, 22 bp, Homo sapiens
ctctgattttcaaagctttttc

SEQ ID NO: 1622164 - DNA, 19 bp, Homo sapiens
ctctgcaattcccctctgc

SEQ ID NO: 1622165 - DNA, 21 bp, Homo sapiens
ctctgcaattcccctctgctg

SEQ ID NO: 1622166 - DNA, 22 bp, Homo sapiens
ctctgcaattcccctctgctgc

SEQ ID NO: 1622167 - DNA, 23 bp, Homo sapiens
ctctgcaattcccctctgctgct

SEQ ID NO: 1622168 - DNA, 20 bp, Homo sapiens
ctctgcacagacaagcagcc

SEQ ID NO: 1622169 - DNA, 21 bp, Homo sapiens
ctctgcacagacaagcagccc

SEQ ID NO: 1622170 - DNA, 14 bp, Homo sapiens
ttgagcatcaatct

SEQ ID NO: 1622171 - DNA, 16 bp, Homo sapiens
ttgagcatcaatcttg

SEQ ID NO: 1622172 - DNA, 19 bp, Homo sapiens
ttgagcatcaatcttgtta

SEQ ID NO: 1622173 - DNA, 20 bp, Homo sapiens
ttgagcatgcacagctgctt

SEQ ID NO: 1622174 - DNA, 22 bp, Homo sapiens
ttgagccaagcttcaaccctca

SEQ ID NO: 1622175 - DNA, 16 bp, Homo sapiens
ttgagccatccaaaga

SEQ ID NO: 1622176 - DNA, 18 bp, Homo sapiens
ttgagccccaagtcctga

SEQ ID NO: 1622177 - DNA, 19 bp, Homo sapiens
ttgagccccaagtcctgaa

SEQ ID NO: 1622178 - DNA, 23 bp, Homo sapiens
ttgagccccaagtcctgaagagg

SEQ ID NO: 1622179 - DNA, 19 bp, Homo sapiens
ttgagccgggcccctgggc

SEQ ID NO: 1622180 - DNA, 12 bp, Homo sapiens
ttgagcctcccc

SEQ ID NO: 1622181 - DNA, 13 bp, Homo sapiens
ttgagcctccccc

SEQ ID NO: 1622182 - DNA, 15 bp, Homo sapiens
ttgagctctctgccc

SEQ ID NO: 1622183 - DNA, 13 bp, Homo sapiens
ttgagctgccttc

SEQ ID NO: 1622184 - DNA, 15 bp, Homo sapiens
ttgagctgccttccc

SEQ ID NO: 1622185 - DNA, 16 bp, Homo sapiens
ttgagctgccttccct

SEQ ID NO: 1622186 - DNA, 21 bp, Homo sapiens
ttgagctgctttttttgaaac

SEQ ID NO: 1622187 - DNA, 11 bp, Homo sapiens
ttgagctggcc

SEQ ID NO: 1622188 - DNA, 15 bp, Homo sapiens
ttgagcttaatcttt

SEQ ID NO: 1622189 - DNA, 14 bp, Homo sapiens
ttgagctttccatg

SEQ ID NO: 1622190 - DNA, 21 bp, Homo sapiens
ttgagctttccatgttgctgc

SEQ ID NO: 1622191 - DNA, 18 bp, Homo sapiens
ttgaggaagcccaggctc

SEQ ID NO: 1622192 - DNA, 13 bp, Homo sapiens
ttgaggacttctt

SEQ ID NO: 1622193 - DNA, 22 bp, Homo sapiens
ttgaggagaagggggtctctgt

SEQ ID NO: 1622194 - DNA, 12 bp, Homo sapiens
ttgaggagcccc

SEQ ID NO: 1622195 - DNA, 22 bp, Homo sapiens
ttgaggatatattttcactttg

SEQ ID NO: 1622196 - DNA, 15 bp, Homo sapiens
ttgaggattgtggaa

SEQ ID NO: 1622197 - DNA, 18 bp, Homo sapiens
ttgaggattgtggaaaac

SEQ ID NO: 1622198 - DNA, 18 bp, Homo sapiens
ttgaggcaagtgtgggcc

SEQ ID NO: 1622199 - DNA, 15 bp, Homo sapiens
ttgaggctgcagcag

SEQ ID NO: 1622200 - DNA, 12 bp, Homo sapiens
ctcctgctggta

SEQ ID NO: 1622201 - DNA, 14 bp, Homo sapiens
ctcctgctggtacc

SEQ ID NO: 1622202 - DNA, 15 bp, Homo sapiens
ctcctgctggtacct

SEQ ID NO: 1622203 - DNA, 19 bp, Homo sapiens
ctcctggaaaggctcagtc

SEQ ID NO: 1622204 - DNA, 16 bp, Homo sapiens
ctcctggaaccaatcc

SEQ ID NO: 1622205 - DNA, 17 bp, Homo sapiens
ctcctggaagctgtgtc

SEQ ID NO: 1622206 - DNA, 21 bp, Homo sapiens
ctcctggaccttgacagagca

SEQ ID NO: 1622207 - DNA, 22 bp, Homo sapiens
ctcctggaccttgacagagcag

SEQ ID NO: 1622208 - DNA, 16 bp, Homo sapiens
ctcctggactcccctc

SEQ ID NO: 1622209 - DNA, 17 bp, Homo sapiens
ctcctggagctctgtgg

SEQ ID NO: 1622210 - DNA, 18 bp, Homo sapiens
ctcctggcctatccgctg

SEQ ID NO: 1622211 - DNA, 14 bp, Homo sapiens
ctcctggcctcaag

SEQ ID NO: 1622212 - DNA, 13 bp, Homo sapiens
ctcctggcctttt

SEQ ID NO: 1622213 - DNA, 18 bp, Homo sapiens
ctcctggctcaggcccag

SEQ ID NO: 1622214 - DNA, 19 bp, Homo sapiens
ctcctggctcaggcccagc

SEQ ID NO: 1622215 - DNA, 13 bp, Homo sapiens
ctcctggctgtgc

SEQ ID NO: 1622216 - DNA, 15 bp, Homo sapiens
ctcctggctgtgccc

SEQ ID NO: 1622217 - DNA, 16 bp, Homo sapiens
ctcctggctgtgccca

SEQ ID NO: 1622218 - DNA, 22 bp, Homo sapiens
ctcctgggaaggagggagctgc

SEQ ID NO: 1622219 - DNA, 14 bp, Homo sapiens
ctcctgggaaggcc

SEQ ID NO: 1622220 - DNA, 17 bp, Homo sapiens
ctcctgggaaggccacc

SEQ ID NO: 1622221 - DNA, 20 bp, Homo sapiens
ctcctgggaaggccacctcc

SEQ ID NO: 1622222 - DNA, 19 bp, Homo sapiens
ctcctgggcccaagtgatc

SEQ ID NO: 1622223 - DNA, 15 bp, Homo sapiens
ctcctgggccggctg

SEQ ID NO: 1622224 - DNA, 18 bp, Homo sapiens
ctcctgggctatattcct

SEQ ID NO: 1622225 - DNA, 22 bp, Homo sapiens
ctcctgtaacatactggcctgg

SEQ ID NO: 1622226 - DNA, 17 bp, Homo sapiens
ctcctgtactttttcca

SEQ ID NO: 1622227 - DNA, 17 bp, Homo sapiens
ctcctgtagccactggc

SEQ ID NO: 1622228 - DNA, 19 bp, Homo sapiens
ctcctgtccctccatccca

SEQ ID NO: 1622229 - DNA, 23 bp, Homo sapiens
ctcctgtctgccagccagcagcc

SEQ ID NO: 1622230 - DNA, 13 bp, Homo sapiens
ctcctgtctgccc

SEQ ID NO: 1622231 - DNA, 17 bp, Homo sapiens
ctcctgtctgccctctg

SEQ ID NO: 1622232 - DNA, 19 bp, Homo sapiens
ctcctgtctgccctctggg

SEQ ID NO: 1622233 - DNA, 17 bp, Homo sapiens
ctcctgtctggctcgga

SEQ ID NO: 1622234 - DNA, 17 bp, Homo sapiens
ctcctgtcttcagagca

SEQ ID NO: 1622235 - DNA, 17 bp, Homo sapiens
ctcctgtgcaactttcc

SEQ ID NO: 1622236 - DNA, 16 bp, Homo sapiens
ctcctgtgcatgggtg

SEQ ID NO: 1622237 - DNA, 21 bp, Homo sapiens
ctcctgtgcccacatcccagg

SEQ ID NO: 1622238 - DNA, 14 bp, Homo sapiens
ctcctgtgctattt

SEQ ID NO: 1622239 - DNA, 15 bp, Homo sapiens
ctcctgtggcagctg

SEQ ID NO: 1622240 - DNA, 17 bp, Homo sapiens
ctcctgtggcagctgcc

SEQ ID NO: 1622241 - DNA, 13 bp, Homo sapiens
ctcctgtggcccc

SEQ ID NO: 1622242 - DNA, 19 bp, Homo sapiens
ctcctgtggccccaccctg

SEQ ID NO: 1622243 - DNA, 20 bp, Homo sapiens
ctcctgtggccccaccctgg

SEQ ID NO: 1622244 - DNA, 19 bp, Homo sapiens
ctcctgtgttcaagcgatt

SEQ ID NO: 1622245 - DNA, 13 bp, Homo sapiens
ctcctgttctgaa

SEQ ID NO: 1622246 - DNA, 16 bp, Homo sapiens
ctcctgttgccatgga

SEQ ID NO: 1622247 - DNA, 17 bp, Homo sapiens
ctccttaaaaactggcc

SEQ ID NO: 1622248 - DNA, 14 bp, Homo sapiens
ctccttactctgag

SEQ ID NO: 1622249 - DNA, 18 bp, Homo sapiens
ctccttactctgagccca

SEQ ID NO: 1622250 - DNA, 23 bp, Homo sapiens
ctccttactctgagcccaggccg

SEQ ID NO: 1622251 - DNA, 14 bp, Homo sapiens
ctccttagaaaaaa

SEQ ID NO: 1622252 - DNA, 21 bp, Homo sapiens
ctccttagagacatcaaaatc

SEQ ID NO: 1622253 - DNA, 19 bp, Homo sapiens
ctccttatagacacttgct

SEQ ID NO: 1622254 - DNA, 15 bp, Homo sapiens
ctccttcactgttcc

SEQ ID NO: 1622255 - DNA, 12 bp, Homo sapiens
ctccttcagaca

SEQ ID NO: 1622256 - DNA, 13 bp, Homo sapiens
ctccttcagcacg

SEQ ID NO: 1622257 - DNA, 16 bp, Homo sapiens
ctccttcagcacggcg

SEQ ID NO: 1622258 - DNA, 13 bp, Homo sapiens
ctccttcagccct

SEQ ID NO: 1622259 - DNA, 17 bp, Homo sapiens
ctccttcccatcgctgt

SEQ ID NO: 1622260 - DNA, 17 bp, Homo sapiens
ctccttcccatgcctgt

SEQ ID NO: 1622261 - DNA, 20 bp, Homo sapiens
ctccttcccatttctctaca

SEQ ID NO: 1622262 - DNA, 16 bp, Homo sapiens
ctccttcccccagccc

SEQ ID NO: 1622263 - DNA, 18 bp, Homo sapiens
ctccttcccccagcccaa

SEQ ID NO: 1622264 - DNA, 20 bp, Homo sapiens
ctccttcccccagcccaata

SEQ ID NO: 1622265 - DNA, 22 bp, Homo sapiens
ctccttcccccagcccaataaa

SEQ ID NO: 1622266 - DNA, 22 bp, Homo sapiens
ctccttcccctgcacctggcct

SEQ ID NO: 1622267 - DNA, 23 bp, Homo sapiens
ctccttcccctgcacctggcctg

SEQ ID NO: 1622268 - DNA, 13 bp, Homo sapiens
ctccttcccttct

SEQ ID NO: 1622269 - DNA, 16 bp, Homo sapiens
ctccttcccttctctt

SEQ ID NO: 1622270 - DNA, 19 bp, Homo sapiens
ctccttcccttctcttggg

SEQ ID NO: 1622271 - DNA, 22 bp, Homo sapiens
ctccttcctgattgtttacagt

SEQ ID NO: 1622272 - DNA, 23 bp, Homo sapiens
ctccttcctggagcccagaggag

SEQ ID NO: 1622273 - DNA, 12 bp, Homo sapiens
ctccttcctggc

SEQ ID NO: 1622274 - DNA, 14 bp, Homo sapiens
ctccttcctgtctt

SEQ ID NO: 1622275 - DNA, 23 bp, Homo sapiens
ctccttccttacccaaactgttc

SEQ ID NO: 1622276 - DNA, 19 bp, Homo sapiens
ctccttcgtgtctctccca

SEQ ID NO: 1622277 - DNA, 23 bp, Homo sapiens
ctccttgaccctgaaaggaacac

SEQ ID NO: 1622278 - DNA, 17 bp, Homo sapiens
ctccttgagaggagaaa

SEQ ID NO: 1622279 - DNA, 23 bp, Homo sapiens
ctccttgagaggagaaatgcaat

SEQ ID NO: 1622280 - DNA, 22 bp, Homo sapiens
ctccttgatatttgtatttatt

SEQ ID NO: 1622281 - DNA, 16 bp, Homo sapiens
ctccttggccacagac

SEQ ID NO: 1622282 - DNA, 21 bp, Homo sapiens
ctccttgggcactttttaatt

SEQ ID NO: 1622283 - DNA, 21 bp, Homo sapiens
ctccttgggctcctggctgcc

SEQ ID NO: 1622284 - DNA, 18 bp, Homo sapiens
ctccttggggcagggcct

SEQ ID NO: 1622285 - DNA, 19 bp, Homo sapiens
ctccttggggcagggcctg

SEQ ID NO: 1622286 - DNA, 15 bp, Homo sapiens
ctccttggtttgcta

SEQ ID NO: 1622287 - DNA, 17 bp, Homo sapiens
ctccttggtttgctagt

SEQ ID NO: 1622288 - DNA, 22 bp, Homo sapiens
ctccttggtttgctagtatctt

SEQ ID NO: 1622289 - DNA, 22 bp, Homo sapiens
ctccttgtgcaattgtcttttt

SEQ ID NO: 1622290 - DNA, 16 bp, Homo sapiens
ctccttgttagccctt

SEQ ID NO: 1622291 - DNA, 13 bp, Homo sapiens
ctcctttaattgt

SEQ ID NO: 1622292 - DNA, 11 bp, Homo sapiens
ctcctttacca

SEQ ID NO: 1622293 - DNA, 12 bp, Homo sapiens
ctcctttccctt

SEQ ID NO: 1622294 - DNA, 13 bp, Homo sapiens
ctcctttccctta

SEQ ID NO: 1622295 - DNA, 12 bp, Homo sapiens
ctcctttccttc

SEQ ID NO: 1622296 - DNA, 14 bp, Homo sapiens
ctcctttccttccc

SEQ ID NO: 1622297 - DNA, 16 bp, Homo sapiens
ctcctttccttcccag

SEQ ID NO: 1622298 - DNA, 17 bp, Homo sapiens
ctcctttccttcccagg

SEQ ID NO: 1622299 - DNA, 17 bp, Homo sapiens
ttggaactatgaagact

SEQ ID NO: 1622300 - DNA, 22 bp, Homo sapiens
ttggaactctactcaacccatt

SEQ ID NO: 1622301 - DNA, 17 bp, Homo sapiens
ttggaagctaccagagc

SEQ ID NO: 1622302 - DNA, 13 bp, Homo sapiens
ttggaaggatctg

SEQ ID NO: 1622303 - DNA, 20 bp, Homo sapiens
ttggaagggaaaaaaaatgt

SEQ ID NO: 1622304 - DNA, 21 bp, Homo sapiens
ttggaagggtctctctccagg

SEQ ID NO: 1622305 - DNA, 17 bp, Homo sapiens
ttggaagtgttccctga

SEQ ID NO: 1622306 - DNA, 15 bp, Homo sapiens
ttggaataggaataa

SEQ ID NO: 1622307 - DNA, 23 bp, Homo sapiens
ttggaatattaaaaaacttcatg

SEQ ID NO: 1622308 - DNA, 23 bp, Homo sapiens
ttggaatattttatcctgtattc

SEQ ID NO: 1622309 - DNA, 21 bp, Homo sapiens
ttggaatcttcacctcagagt

SEQ ID NO: 1622310 - DNA, 23 bp, Homo sapiens
ttggaatgactggggagggctgc

SEQ ID NO: 1622311 - DNA, 19 bp, Homo sapiens
ttggaatggaactactgta

SEQ ID NO: 1622312 - DNA, 22 bp, Homo sapiens
ttggaatggaactactgtactt

SEQ ID NO: 1622313 - DNA, 23 bp, Homo sapiens
ttggaattagaacccttgcacag

SEQ ID NO: 1622314 - DNA, 15 bp, Homo sapiens
ttggctgttccagac

SEQ ID NO: 1622315 - DNA, 22 bp, Homo sapiens
ttggcttaaagcatcctcctcc

SEQ ID NO: 1622316 - DNA, 21 bp, Homo sapiens
ttggcttccatgatggttatt

SEQ ID NO: 1622317 - DNA, 15 bp, Homo sapiens
ttggcttctcctgtg

SEQ ID NO: 1622318 - DNA, 17 bp, Homo sapiens
ttggcttctcctgtgac

SEQ ID NO: 1622319 - DNA, 19 bp, Homo sapiens
ttggcttctcctgtgaccc

SEQ ID NO: 1622320 - DNA, 16 bp, Homo sapiens
ttggctttatgcaaat

SEQ ID NO: 1622321 - DNA, 20 bp, Homo sapiens
ttggctttatgcaaatacaa

SEQ ID NO: 1622322 - DNA, 19 bp, Homo sapiens
ttggctttcagagccagcc

SEQ ID NO: 1622323 - DNA, 20 bp, Homo sapiens
ttggctttcgatgcgtgtgt

SEQ ID NO: 1622324 - DNA, 21 bp, Homo sapiens
ttggctttgcccacccctcac

SEQ ID NO: 1622325 - DNA, 15 bp, Homo sapiens
ttggctttgtgcttg

SEQ ID NO: 1622326 - DNA, 13 bp, Homo sapiens
ttgggaaaacatg

SEQ ID NO: 1622327 - DNA, 16 bp, Homo sapiens
ttgggaaaacatgtta

SEQ ID NO: 1622328 - DNA, 18 bp, Homo sapiens
ttgggaacactggcctgg

SEQ ID NO: 1622329 - DNA, 16 bp, Homo sapiens
ttgggaagtgtgttta

SEQ ID NO: 1622330 - DNA, 21 bp, Homo sapiens
ttgggacccaaaacacaggaa

SEQ ID NO: 1622331 - DNA, 13 bp, Homo sapiens
ttgggagagactt

SEQ ID NO: 1622332 - DNA, 16 bp, Homo sapiens
ttgggagcactggagt

SEQ ID NO: 1622333 - DNA, 19 bp, Homo sapiens
ttgggagcttgggaatgga

SEQ ID NO: 1622334 - DNA, 16 bp, Homo sapiens
ttgggaggccaaggca

SEQ ID NO: 1622335 - DNA, 17 bp, Homo sapiens
ttgggaggccaaggcag

SEQ ID NO: 1622336 - DNA, 16 bp, Homo sapiens
ttgggaggccgaggcg

SEQ ID NO: 1622337 - DNA, 22 bp, Homo sapiens
ttgggattgggggctggtgcca

SEQ ID NO: 1622338 - DNA, 21 bp, Homo sapiens
ttgggcagagctggctctgag

SEQ ID NO: 1622339 - DNA, 23 bp, Homo sapiens
ttgggcagccagaccagcaggct

SEQ ID NO: 1622340 - DNA, 14 bp, Homo sapiens
ttgggcagttggcc

SEQ ID NO: 1622341 - DNA, 17 bp, Homo sapiens
ttgggccaaggtgtttc

SEQ ID NO: 1622342 - DNA, 18 bp, Homo sapiens
ttgggcccagctgggctc

SEQ ID NO: 1622343 - DNA, 17 bp, Homo sapiens
ttgggcccctgaggagc

SEQ ID NO: 1622344 - DNA, 13 bp, Homo sapiens
ttgggccctgcac

SEQ ID NO: 1622345 - DNA, 15 bp, Homo sapiens
ttgggcctccatgcc

SEQ ID NO: 1622346 - DNA, 21 bp, Homo sapiens
ttgggcctcccataattgctt

SEQ ID NO: 1622347 - DNA, 22 bp, Homo sapiens
ttgggcctccttcccatgcctg

SEQ ID NO: 1622348 - DNA, 20 bp, Homo sapiens
ttgggcctgctccagacctg

SEQ ID NO: 1622349 - DNA, 19 bp, Homo sapiens
ttgggcctggccagtcttc

SEQ ID NO: 1622350 - DNA, 20 bp, Homo sapiens
ttgggcctggccagtcttcc

SEQ ID NO: 1622351 - DNA, 20 bp, Homo sapiens
ttgggctaccctaaagggag

SEQ ID NO: 1622352 - DNA, 16 bp, Homo sapiens
ttgggctataaaatat

SEQ ID NO: 1622353 - DNA, 21 bp, Homo sapiens
ttgggctcagggttggccatt

SEQ ID NO: 1622354 - DNA, 16 bp, Homo sapiens
ttgggctcctggctgc

SEQ ID NO: 1622355 - DNA, 17 bp, Homo sapiens
ttgggctcctggctgcc

SEQ ID NO: 1622356 - DNA, 22 bp, Homo sapiens
ttgggctgacacctaccatgct

SEQ ID NO: 1622357 - DNA, 16 bp, Homo sapiens
ttgggcttccatgcct

SEQ ID NO: 1622358 - DNA, 18 bp, Homo sapiens
ttgggctttgcaggctct

SEQ ID NO: 1622359 - DNA, 18 bp, Homo sapiens
ttggggaagggcctgccc

SEQ ID NO: 1622360 - DNA, 12 bp, Homo sapiens
ttggggactcag

SEQ ID NO: 1622361 - DNA, 22 bp, Homo sapiens
ttggggaggagggggccgggcg

SEQ ID NO: 1622362 - DNA, 23 bp, Homo sapiens
ttggggagggggaagagaaattt

SEQ ID NO: 1622363 - DNA, 19 bp, Homo sapiens
ttggggagttaagacctgg

SEQ ID NO: 1622364 - DNA, 15 bp, Homo sapiens
ttggggattgtacac

SEQ ID NO: 1622365 - DNA, 23 bp, Homo sapiens
ttggggccaccaaagctgcccac

SEQ ID NO: 1622366 - DNA, 16 bp, Homo sapiens
ttggggcctggcttgc

SEQ ID NO: 1622367 - DNA, 16 bp, Homo sapiens
ttgggggacagccttc

SEQ ID NO: 1622368 - DNA, 19 bp, Homo sapiens
ttgggggctcatttttgct

SEQ ID NO: 1622369 - DNA, 16 bp, Homo sapiens
ttgggggctggtgcca

SEQ ID NO: 1622370 - DNA, 19 bp, Homo sapiens
ttgggggggcgtgagaccc

SEQ ID NO: 1622371 - DNA, 17 bp, Homo sapiens
ttgggggttcaggcccg

SEQ ID NO: 1622372 - DNA, 21 bp, Homo sapiens
ttggggtataggtctcatctc

SEQ ID NO: 1622373 - DNA, 22 bp, Homo sapiens
ttggggtccctcaggttccttt

SEQ ID NO: 1622374 - DNA, 16 bp, Homo sapiens
ttggggttgtgttgtc

SEQ ID NO: 1622375 - DNA, 18 bp, Homo sapiens
ttgggtactggagctttt

SEQ ID NO: 1622376 - DNA, 16 bp, Homo sapiens
ttgggtcctgggcagg

SEQ ID NO: 1622377 - DNA, 13 bp, Homo sapiens
ttgggtgaagagc

SEQ ID NO: 1622378 - DNA, 15 bp, Homo sapiens
ttgggtgaagagctt

SEQ ID NO: 1622379 - DNA, 19 bp, Homo sapiens
ttgggtggctcactactga

SEQ ID NO: 1622380 - DNA, 21 bp, Homo sapiens
ttgggtgggattttttccctt

SEQ ID NO: 1622381 - DNA, 22 bp, Homo sapiens
ttgggtgggattttttcccttt

SEQ ID NO: 1622382 - DNA, 21 bp, Homo sapiens
ttgggtgtaacaggtctcctc

SEQ ID NO: 1622383 - DNA, 18 bp, Homo sapiens
ttgggtgtttttcatgtt

SEQ ID NO: 1622384 - DNA, 21 bp, Homo sapiens
ttgggttaaaagatggttgta

SEQ ID NO: 1622385 - DNA, 15 bp, Homo sapiens
ttgggtttttttcct

SEQ ID NO: 1622386 - DNA, 14 bp, Homo sapiens
ttggtaaaaatgct

SEQ ID NO: 1622387 - DNA, 12 bp, Homo sapiens
ttggtaactttt

SEQ ID NO: 1622388 - DNA, 20 bp, Homo sapiens
ttggtaatcccctaaaataa

SEQ ID NO: 1622389 - DNA, 22 bp, Homo sapiens
ttggtaattttttttgtttttt

SEQ ID NO: 1622390 - DNA, 20 bp, Homo sapiens
ttggtacatggccagtgtga

SEQ ID NO: 1622391 - DNA, 22 bp, Homo sapiens
ttggtactactagatgtcttta

SEQ ID NO: 1622392 - DNA, 21 bp, Homo sapiens
ttggtagagaaggagcagaaa

SEQ ID NO: 1622393 - DNA, 16 bp, Homo sapiens
ttggtagcagcctggg

SEQ ID NO: 1622394 - DNA, 22 bp, Homo sapiens
ttggtagccatttggtagatgt

SEQ ID NO: 1622395 - DNA, 15 bp, Homo sapiens
ttggtaggtaaatct

SEQ ID NO: 1622396 - DNA, 16 bp, Homo sapiens
ttggtaggtaaatcta

SEQ ID NO: 1622397 - DNA, 21 bp, Homo sapiens
ttggtagttctgtgcctcccc

SEQ ID NO: 1622398 - DNA, 12 bp, Homo sapiens
ttggtatatttt

SEQ ID NO: 1622399 - DNA, 21 bp, Homo sapiens
ttggtattatataattcaagg

SEQ ID NO: 1622400 - DNA, 17 bp, Homo sapiens
ttggtcaaggccacctc

SEQ ID NO: 1622401 - DNA, 21 bp, Homo sapiens
ttggtcaaggccacctctgcc

SEQ ID NO: 1622402 - DNA, 17 bp, Homo sapiens
ttggtcagagccactct

SEQ ID NO: 1622403 - DNA, 12 bp, Homo sapiens
ttggtcagcttt

SEQ ID NO: 1622404 - DNA, 14 bp, Homo sapiens
ttggtccaaaaaaa

SEQ ID NO: 1622405 - DNA, 20 bp, Homo sapiens
ttggtcctacctattatcct

SEQ ID NO: 1622406 - DNA, 16 bp, Homo sapiens
ttggtctcactacttg

SEQ ID NO: 1622407 - DNA, 17 bp, Homo sapiens
ttggtctcaggcagcac

SEQ ID NO: 1622408 - DNA, 21 bp, Homo sapiens
ttggtctcaggcagcaccaca

SEQ ID NO: 1622409 - DNA, 14 bp, Homo sapiens
ttggtgaacacaca

SEQ ID NO: 1622410 - DNA, 18 bp, Homo sapiens
ttggtgaacacacacgct

SEQ ID NO: 1622411 - DNA, 12 bp, Homo sapiens
ttggtgaataaa

SEQ ID NO: 1622412 - DNA, 21 bp, Homo sapiens
ttggtgaattttcaaggcctt

SEQ ID NO: 1622413 - DNA, 16 bp, Homo sapiens
ttggtgcaacccttac

SEQ ID NO: 1622414 - DNA, 17 bp, Homo sapiens
ttggtgcacagtgattt

SEQ ID NO: 1622415 - DNA, 20 bp, Homo sapiens
ttggtgcctggcctggcaca

SEQ ID NO: 1622416 - DNA, 22 bp, Homo sapiens
ttggtgcctggcctggcacaca

SEQ ID NO: 1622417 - DNA, 17 bp, Homo sapiens
ttggtggagcagccaga

SEQ ID NO: 1622418 - DNA, 17 bp, Homo sapiens
tttctaaataaaaatat

SEQ ID NO: 1622419 - DNA, 14 bp, Homo sapiens
tttctaacagtcct

SEQ ID NO: 1622420 - DNA, 18 bp, Homo sapiens
tttctaacagtccttgct

SEQ ID NO: 1622421 - DNA, 20 bp, Homo sapiens
tttctaaccttgaatgctgc

SEQ ID NO: 1622422 - DNA, 14 bp, Homo sapiens
tttctaagaaaatg

SEQ ID NO: 1622423 - DNA, 15 bp, Homo sapiens
tttctaagaaaatgt

SEQ ID NO: 1622424 - DNA, 13 bp, Homo sapiens
tttctaagagaag

SEQ ID NO: 1622425 - DNA, 16 bp, Homo sapiens
tttctaagagaagtta

SEQ ID NO: 1622426 - DNA, 14 bp, Homo sapiens
tttctaagccctgt

SEQ ID NO: 1622427 - DNA, 18 bp, Homo sapiens
tttctaagtggcgtgtgc

SEQ ID NO: 1622428 - DNA, 18 bp, Homo sapiens
tttctaagtgttcgtctt

SEQ ID NO: 1622429 - DNA, 17 bp, Homo sapiens
tttctaatccttttcct

SEQ ID NO: 1622430 - DNA, 22 bp, Homo sapiens
tttctaattgtaagtgaaatta

SEQ ID NO: 1622431 - DNA, 19 bp, Homo sapiens
tttctacacagtaaaaact

SEQ ID NO: 1622432 - DNA, 17 bp, Homo sapiens
tttctacataattgtga

SEQ ID NO: 1622433 - DNA, 21 bp, Homo sapiens
tttctacccaacggccctgca

SEQ ID NO: 1622434 - DNA, 20 bp, Homo sapiens
tttctaccctagccattcct

SEQ ID NO: 1622435 - DNA, 14 bp, Homo sapiens
tttctacctctttt

SEQ ID NO: 1622436 - DNA, 19 bp, Homo sapiens
tttctagaagcacatgtgt

SEQ ID NO: 1622437 - DNA, 21 bp, Homo sapiens
tttctagaatttatcacactt

SEQ ID NO: 1622438 - DNA, 17 bp, Homo sapiens
tttctagaattttatat

SEQ ID NO: 1622439 - DNA, 21 bp, Homo sapiens
tttctagcaattttctttgtt

SEQ ID NO: 1622440 - DNA, 22 bp, Homo sapiens
tttctagctagaaatatgattt

SEQ ID NO: 1622441 - DNA, 21 bp, Homo sapiens
tttctagtttcagtaaataat

SEQ ID NO: 1622442 - DNA, 20 bp, Homo sapiens
tttctataaatcagtatttt

SEQ ID NO: 1622443 - DNA, 22 bp, Homo sapiens
tttctatatagttccttgcctt

SEQ ID NO: 1622444 - DNA, 17 bp, Homo sapiens
tttctatctgcaaatag

SEQ ID NO: 1622445 - DNA, 13 bp, Homo sapiens
tttctatgacaaa

SEQ ID NO: 1622446 - DNA, 15 bp, Homo sapiens
tttctatgacaaatt

SEQ ID NO: 1622447 - DNA, 20 bp, Homo sapiens
tttctatgtcatttttaatg

SEQ ID NO: 1622448 - DNA, 22 bp, Homo sapiens
tttctatgtcatttttaatgta

SEQ ID NO: 1622449 - DNA, 21 bp, Homo sapiens
tttctattaatatcaactctg

SEQ ID NO: 1622450 - DNA, 17 bp, Homo sapiens
tttctatttataagtga

SEQ ID NO: 1622451 - DNA, 16 bp, Homo sapiens
tttctcaaatctgctt

SEQ ID NO: 1622452 - DNA, 23 bp, Homo sapiens
tttctcacaaaaaggcaaatatt

SEQ ID NO: 1622453 - DNA, 15 bp, Homo sapiens
tttctcacattgctg

SEQ ID NO: 1622454 - DNA, 21 bp, Homo sapiens
tttctcactatatatatttct

SEQ ID NO: 1622455 - DNA, 15 bp, Homo sapiens
tttctcactgaactc

SEQ ID NO: 1622456 - DNA, 19 bp, Homo sapiens
tttctcagaatccaaagat

SEQ ID NO: 1622457 - DNA, 22 bp, Homo sapiens
tttctcagactcaccaactttt

SEQ ID NO: 1622458 - DNA, 17 bp, Homo sapiens
tttctcagatccttgtt

SEQ ID NO: 1622459 - DNA, 20 bp, Homo sapiens
tttctcagattcctttgtat

SEQ ID NO: 1622460 - DNA, 20 bp, Homo sapiens
tttctcagtgttggtatatt

SEQ ID NO: 1622461 - DNA, 17 bp, Homo sapiens
tttctcataaaactgtg

SEQ ID NO: 1622462 - DNA, 17 bp, Homo sapiens
tttctccaatatcagtg

SEQ ID NO: 1622463 - DNA, 13 bp, Homo sapiens
tttctccatatca

SEQ ID NO: 1622464 - DNA, 17 bp, Homo sapiens
tttctcccagcttcaaa

SEQ ID NO: 1622465 - DNA, 18 bp, Homo sapiens
tttctcccagtcatttaa

SEQ ID NO: 1622466 - DNA, 14 bp, Homo sapiens
tttctccccctggg

SEQ ID NO: 1622467 - DNA, 23 bp, Homo sapiens
tttctcccctgcccccaggactg

SEQ ID NO: 1622468 - DNA, 20 bp, Homo sapiens
tttctccggggtctgtgctg

SEQ ID NO: 1622469 - DNA, 12 bp, Homo sapiens
tttctcctgcag

SEQ ID NO: 1622470 - DNA, 11 bp, Homo sapiens
tttctcctgcc

SEQ ID NO: 1622471 - DNA, 14 bp, Homo sapiens
tttctcctgcccca

SEQ ID NO: 1622472 - DNA, 18 bp, Homo sapiens
tttctcctttaattgtaa

SEQ ID NO: 1622473 - DNA, 14 bp, Homo sapiens
tttctccttttcct

SEQ ID NO: 1622474 - DNA, 15 bp, Homo sapiens
tttctccttttccta

SEQ ID NO: 1622475 - DNA, 14 bp, Homo sapiens
tttctcgtgctgca

SEQ ID NO: 1622476 - DNA, 22 bp, Homo sapiens
tttctctaacttcaaggcccat

SEQ ID NO: 1622477 - DNA, 14 bp, Homo sapiens
tttctctacactaa

SEQ ID NO: 1622478 - DNA, 16 bp, Homo sapiens
tttctctattaaaatg

SEQ ID NO: 1622479 - DNA, 15 bp, Homo sapiens
tttctctcctggctc

SEQ ID NO: 1622480 - DNA, 11 bp, Homo sapiens
tttctctctgg

SEQ ID NO: 1622481 - DNA, 14 bp, Homo sapiens
tttctctcttttgt

SEQ ID NO: 1622482 - DNA, 15 bp, Homo sapiens
tttctctgaaagtgt

SEQ ID NO: 1622483 - DNA, 12 bp, Homo sapiens
tttctctgagca

SEQ ID NO: 1622484 - DNA, 23 bp, Homo sapiens
tttctctgccgctacctccctcc

SEQ ID NO: 1622485 - DNA, 9 bp, Homo sapiens
tttctctgg

SEQ ID NO: 1622486 - DNA, 12 bp, Homo sapiens
tttctctgggct

SEQ ID NO: 1622487 - DNA, 19 bp, Homo sapiens
tttctctggtggtcttcct

SEQ ID NO: 1622488 - DNA, 20 bp, Homo sapiens
tttctctggtggtcttcctt

SEQ ID NO: 1622489 - DNA, 14 bp, Homo sapiens
tttctcttcctaaa

SEQ ID NO: 1622490 - DNA, 16 bp, Homo sapiens
tttctcttgagctggc

SEQ ID NO: 1622491 - DNA, 18 bp, Homo sapiens
tttctcttgagctggcct

SEQ ID NO: 1622492 - DNA, 11 bp, Homo sapiens
tttctcttgct

SEQ ID NO: 1622493 - DNA, 20 bp, Homo sapiens
tttctcttttcccctttcct

SEQ ID NO: 1622494 - DNA, 18 bp, Homo sapiens
tttctcttttttaaaaac

SEQ ID NO: 1622495 - DNA, 18 bp, Homo sapiens
tttctgaaaattccagaa

SEQ ID NO: 1622496 - DNA, 22 bp, Homo sapiens
tttctgaaaattccagaaagga

SEQ ID NO: 1622497 - DNA, 13 bp, Homo sapiens
tttctgaaacaca

SEQ ID NO: 1622498 - DNA, 23 bp, Homo sapiens
tttctgaaagatgagtaatttct

SEQ ID NO: 1622499 - DNA, 14 bp, Homo sapiens
tttctgaactgtta

SEQ ID NO: 1622500 - DNA, 19 bp, Homo sapiens
tttctgaaggtagcattct

SEQ ID NO: 1622501 - DNA, 19 bp, Homo sapiens
tttctgaagtacttaaact

SEQ ID NO: 1622502 - DNA, 22 bp, Homo sapiens
tttctgaattcataaaaataac

SEQ ID NO: 1622503 - DNA, 20 bp, Homo sapiens
tttctgaattggaagggaaa

SEQ ID NO: 1622504 - DNA, 19 bp, Homo sapiens
tttctgacccactgatctc

SEQ ID NO: 1622505 - DNA, 15 bp, Homo sapiens
tttctgagaaagact

SEQ ID NO: 1622506 - DNA, 12 bp, Homo sapiens
tttctgagcccg

SEQ ID NO: 1622507 - DNA, 14 bp, Homo sapiens
tttctgcatcagct

SEQ ID NO: 1622508 - DNA, 16 bp, Homo sapiens
tttctgcatgaccaaa

SEQ ID NO: 1622509 - DNA, 21 bp, Homo sapiens
tttctgcccggctacatcagc

SEQ ID NO: 1622510 - DNA, 14 bp, Homo sapiens
tttctgccctggct

SEQ ID NO: 1622511 - DNA, 15 bp, Homo sapiens
tttctgccctggctg

SEQ ID NO: 1622512 - DNA, 13 bp, Homo sapiens
tttctgcctgaga

SEQ ID NO: 1622513 - DNA, 18 bp, Homo sapiens
tttctgcctgagattctt

SEQ ID NO: 1622514 - DNA, 20 bp, Homo sapiens
tttctgcctgagattcttta

SEQ ID NO: 1622515 - DNA, 14 bp, Homo sapiens
tttctgcctggagt

SEQ ID NO: 1622516 - DNA, 18 bp, Homo sapiens
tttctgctaagttctccc

SEQ ID NO: 1622517 - DNA, 15 bp, Homo sapiens
tttctgctctgccat

SEQ ID NO: 1622518 - DNA, 18 bp, Homo sapiens
tttctggaatgtaatcaa

SEQ ID NO: 1622519 - DNA, 14 bp, Homo sapiens
tttctggacattct

SEQ ID NO: 1622520 - DNA, 15 bp, Homo sapiens
tttctggacattctc

SEQ ID NO: 1622521 - DNA, 21 bp, Homo sapiens
tttctggacattctctttgat

SEQ ID NO: 1622522 - DNA, 21 bp, Homo sapiens
tttctggactcccactctttg

SEQ ID NO: 1622523 - DNA, 15 bp, Homo sapiens
tttctggattctggg

SEQ ID NO: 1622524 - DNA, 16 bp, Homo sapiens
tttctggcatatgttt

SEQ ID NO: 1622525 - DNA, 19 bp, Homo sapiens
tttctggccagtgtttaaa

SEQ ID NO: 1622526 - DNA, 16 bp, Homo sapiens
tttctggcctgccttc

SEQ ID NO: 1622527 - DNA, 21 bp, Homo sapiens
tttctggggaaagacactgcc

SEQ ID NO: 1622528 - DNA, 21 bp, Homo sapiens
tttctggggggatatttccta

SEQ ID NO: 1622529 - DNA, 16 bp, Homo sapiens
tttctgggtgtgtcca

SEQ ID NO: 1622530 - DNA, 10 bp, Homo sapiens
tttctggtgc

SEQ ID NO: 1622531 - DNA, 16 bp, Homo sapiens
tttctggtggggctgt

SEQ ID NO: 1622532 - DNA, 15 bp, Homo sapiens
tttctggtggtctgt

SEQ ID NO: 1622533 - DNA, 20 bp, Homo sapiens
tttctggtggtctgttggca

SEQ ID NO: 1622534 - DNA, 21 bp, Homo sapiens
tttctggttgttatgtgatca

SEQ ID NO: 1622535 - DNA, 20 bp, Homo sapiens
ctctttccttggctcccatt

SEQ ID NO: 1622536 - DNA, 16 bp, Homo sapiens
ctctttcgtctactgc

SEQ ID NO: 1622537 - DNA, 16 bp, Homo sapiens
ctctttctatgcccgt

SEQ ID NO: 1622538 - DNA, 23 bp, Homo sapiens
ctctttctattgttaaacaaatg

SEQ ID NO: 1622539 - DNA, 15 bp, Homo sapiens
ctctttctctccttt

SEQ ID NO: 1622540 - DNA, 19 bp, Homo sapiens
ctctttctctcctttcttt

SEQ ID NO: 1622541 - DNA, 12 bp, Homo sapiens
ctctttctctgc

SEQ ID NO: 1622542 - DNA, 13 bp, Homo sapiens
ctctttctctgcc

SEQ ID NO: 1622543 - DNA, 15 bp, Homo sapiens
ctctttctctgccag

SEQ ID NO: 1622544 - DNA, 16 bp, Homo sapiens
ctctttctctgccagt

SEQ ID NO: 1622545 - DNA, 17 bp, Homo sapiens
ctctttctggcctgcct

SEQ ID NO: 1622546 - DNA, 15 bp, Homo sapiens
ctctttctgtcttct

SEQ ID NO: 1622547 - DNA, 18 bp, Homo sapiens
ctctttcttgtttgtcag

SEQ ID NO: 1622548 - DNA, 23 bp, Homo sapiens
ctctttcttgtttgtcagcatct

SEQ ID NO: 1622549 - DNA, 13 bp, Homo sapiens
ctctttgataaca

SEQ ID NO: 1622550 - DNA, 15 bp, Homo sapiens
ctctttgataacaaa

SEQ ID NO: 1622551 - DNA, 17 bp, Homo sapiens
ctctttgataacaaaaa

SEQ ID NO: 1622552 - DNA, 13 bp, Homo sapiens
ctctttgctgcag

SEQ ID NO: 1622553 - DNA, 18 bp, Homo sapiens
ctctttggaaatagcatg

SEQ ID NO: 1622554 - DNA, 21 bp, Homo sapiens
ctctttggcgacctcctttca

SEQ ID NO: 1622555 - DNA, 18 bp, Homo sapiens
ctctttggctcccctgta

SEQ ID NO: 1622556 - DNA, 21 bp, Homo sapiens
ctctttgggcagtgccatgga

SEQ ID NO: 1622557 - DNA, 22 bp, Homo sapiens
ctctttgggcctctcctgccct

SEQ ID NO: 1622558 - DNA, 23 bp, Homo sapiens
ctctttgggggaaacgggctcct

SEQ ID NO: 1622559 - DNA, 21 bp, Homo sapiens
ctctttgggtccattcagatg

SEQ ID NO: 1622560 - DNA, 12 bp, Homo sapiens
ctctttgtaaga

SEQ ID NO: 1622561 - DNA, 23 bp, Homo sapiens
ctctttgtggcagtggccaggca

SEQ ID NO: 1622562 - DNA, 22 bp, Homo sapiens
ctctttgtgggtttttcatctt

SEQ ID NO: 1622563 - DNA, 20 bp, Homo sapiens
ctctttgttctaaagatgga

SEQ ID NO: 1622564 - DNA, 22 bp, Homo sapiens
ctctttgtttatctctgagaca

SEQ ID NO: 1622565 - DNA, 23 bp, Homo sapiens
ctcttttatatttgtaggagaaa

SEQ ID NO: 1622566 - DNA, 17 bp, Homo sapiens
ctcttttatctcctgaa

SEQ ID NO: 1622567 - DNA, 21 bp, Homo sapiens
ctcttttcccctttcctgtcc

SEQ ID NO: 1622568 - DNA, 13 bp, Homo sapiens
ctcttttcctcct

SEQ ID NO: 1622569 - DNA, 14 bp, Homo sapiens
ctcttttctatttt

SEQ ID NO: 1622570 - DNA, 15 bp, Homo sapiens
ctcttttctattttg

SEQ ID NO: 1622571 - DNA, 16 bp, Homo sapiens
ctcttttctcctgcag

SEQ ID NO: 1622572 - DNA, 15 bp, Homo sapiens
ctcttttctgcatca

SEQ ID NO: 1622573 - DNA, 13 bp, Homo sapiens
ctcttttgaaagt

SEQ ID NO: 1622574 - DNA, 14 bp, Homo sapiens
ctcttttgctgtgc

SEQ ID NO: 1622575 - DNA, 21 bp, Homo sapiens
ctcttttgcttgccaaagtac

SEQ ID NO: 1622576 - DNA, 16 bp, Homo sapiens
ctcttttgctttctgt

SEQ ID NO: 1622577 - DNA, 17 bp, Homo sapiens
ctcttttgggtaaaatc

SEQ ID NO: 1622578 - DNA, 18 bp, Homo sapiens
ctcttttgtgatgaacat

SEQ ID NO: 1622579 - DNA, 11 bp, Homo sapiens
ctctttttaag

SEQ ID NO: 1622580 - DNA, 13 bp, Homo sapiens
ctctttttgtttg

SEQ ID NO: 1622581 - DNA, 15 bp, Homo sapiens
ctcttttttaaaaac

SEQ ID NO: 1622582 - DNA, 16 bp, Homo sapiens
ctctttttttgagtga

SEQ ID NO: 1622583 - DNA, 20 bp, Homo sapiens
ctgaaaaaaaaaaagaagaa

SEQ ID NO: 1622584 - DNA, 22 bp, Homo sapiens
ctgaaaaaacacctagctttat

SEQ ID NO: 1622585 - DNA, 15 bp, Homo sapiens
ctgaaaaattccttt

SEQ ID NO: 1622586 - DNA, 20 bp, Homo sapiens
ctgaaaacatttcaaagctg

SEQ ID NO: 1622587 - DNA, 15 bp, Homo sapiens
ctgaaaacccagaga

SEQ ID NO: 1622588 - DNA, 17 bp, Homo sapiens
ctgaaaacccagagagg

SEQ ID NO: 1622589 - DNA, 17 bp, Homo sapiens
ctgaaaacgaaggggcc

SEQ ID NO: 1622590 - DNA, 15 bp, Homo sapiens
ctgaaaactgaatgt

SEQ ID NO: 1622591 - DNA, 17 bp, Homo sapiens
ctgaaaacttagccaga

SEQ ID NO: 1622592 - DNA, 10 bp, Homo sapiens
ctgaaaagaa

SEQ ID NO: 1622593 - DNA, 19 bp, Homo sapiens
ctgaaaagactcagtgttc

SEQ ID NO: 1622594 - DNA, 20 bp, Homo sapiens
ctgaaaagcaattgccctgt

SEQ ID NO: 1622595 - DNA, 17 bp, Homo sapiens
ctgaaaagggcactccc

SEQ ID NO: 1622596 - DNA, 23 bp, Homo sapiens
ctgaaaagggcactcccaaccct

SEQ ID NO: 1622597 - DNA, 22 bp, Homo sapiens
ctgaaaagtgtgtatatatttt

SEQ ID NO: 1622598 - DNA, 21 bp, Homo sapiens
ctgaaaatacaaaaattagct

SEQ ID NO: 1622599 - DNA, 22 bp, Homo sapiens
ctgaaaatatttttttctagct

SEQ ID NO: 1622600 - DNA, 16 bp, Homo sapiens
ctgaaaatcaaagtaa

SEQ ID NO: 1622601 - DNA, 14 bp, Homo sapiens
ctgaaaatgtatgt

SEQ ID NO: 1622602 - DNA, 17 bp, Homo sapiens
ctgaaaatgtcacattc

SEQ ID NO: 1622603 - DNA, 22 bp, Homo sapiens
ctgaaaattccagaaaggatat

SEQ ID NO: 1622604 - DNA, 14 bp, Homo sapiens
ctgaaacacacgag

SEQ ID NO: 1622605 - DNA, 22 bp, Homo sapiens
ctgaaacagaaagttggaaagg

SEQ ID NO: 1622606 - DNA, 21 bp, Homo sapiens
ctgaaacattcacacagggct

SEQ ID NO: 1622607 - DNA, 20 bp, Homo sapiens
ctgaaacattccgaagaggg

SEQ ID NO: 1622608 - DNA, 22 bp, Homo sapiens
ctgaaacattccgaagagggaa

SEQ ID NO: 1622609 - DNA, 15 bp, Homo sapiens
ctgaaaccattttcc

SEQ ID NO: 1622610 - DNA, 19 bp, Homo sapiens
ctgaaactcatagacactg

SEQ ID NO: 1622611 - DNA, 13 bp, Homo sapiens
ctgaaacttccct

SEQ ID NO: 1622612 - DNA, 15 bp, Homo sapiens
ctgaaagaaacagtt

SEQ ID NO: 1622613 - DNA, 19 bp, Homo sapiens
ctgaaagaaacagttaact

SEQ ID NO: 1622614 - DNA, 19 bp, Homo sapiens
ctgaaagaacatggacttg

SEQ ID NO: 1622615 - DNA, 22 bp, Homo sapiens
ctgaaagaggctgaggcctgga

SEQ ID NO: 1622616 - DNA, 17 bp, Homo sapiens
ctgaaagagtctttctt

SEQ ID NO: 1622617 - DNA, 13 bp, Homo sapiens
ctgaaagcagcag

SEQ ID NO: 1622618 - DNA, 16 bp, Homo sapiens
ctgaaagcagcagcta

SEQ ID NO: 1622619 - DNA, 18 bp, Homo sapiens
ctgaaagcagcagctagg

SEQ ID NO: 1622620 - DNA, 11 bp, Homo sapiens
ctgaaagccac

SEQ ID NO: 1622621 - DNA, 14 bp, Homo sapiens
ctgaaagcctcacg

SEQ ID NO: 1622622 - DNA, 20 bp, Homo sapiens
ctgaaagccttagggaagct

SEQ ID NO: 1622623 - DNA, 17 bp, Homo sapiens
ctgaaaggaacactggc

SEQ ID NO: 1622624 - DNA, 16 bp, Homo sapiens
ctgaaaggttaattct

SEQ ID NO: 1622625 - DNA, 16 bp, Homo sapiens
ctgaaagtgacagaga

SEQ ID NO: 1622626 - DNA, 17 bp, Homo sapiens
ctgaaagtgacagagac

SEQ ID NO: 1622627 - DNA, 12 bp, Homo sapiens
ctgaaagtgatg

SEQ ID NO: 1622628 - DNA, 12 bp, Homo sapiens
ctgaaagtgtgt

SEQ ID NO: 1622629 - DNA, 16 bp, Homo sapiens
ctgaaagttttgtaaa

SEQ ID NO: 1622630 - DNA, 23 bp, Homo sapiens
ctgaaagttttgtaaaagaaatc

SEQ ID NO: 1622631 - DNA, 14 bp, Homo sapiens
ctgaaataaatgtt

SEQ ID NO: 1622632 - DNA, 20 bp, Homo sapiens
ctgaaataatatatttcttc

SEQ ID NO: 1622633 - DNA, 21 bp, Homo sapiens
ctgaaataatatatttcttct

SEQ ID NO: 1622634 - DNA, 13 bp, Homo sapiens
ctgaaatccataa

SEQ ID NO: 1622635 - DNA, 23 bp, Homo sapiens
ctgaaatccataaactaagagaa

SEQ ID NO: 1622636 - DNA, 23 bp, Homo sapiens
ctgaaatcttcccatgcattctg

SEQ ID NO: 1622637 - DNA, 18 bp, Homo sapiens
ctgaaatgaccaagacag

SEQ ID NO: 1622638 - DNA, 16 bp, Homo sapiens
ctgaaatgctgcattt

SEQ ID NO: 1622639 - DNA, 23 bp, Homo sapiens
ctgaaattcaggatgctgtgata

SEQ ID NO: 1622640 - DNA, 14 bp, Homo sapiens
ctgaaattccaaag

SEQ ID NO: 1622641 - DNA, 16 bp, Homo sapiens
ctgaaattctcctgga

SEQ ID NO: 1622642 - DNA, 17 bp, Homo sapiens
ctgaaattctcctggag

SEQ ID NO: 1622643 - DNA, 18 bp, Homo sapiens
ctgaaattctcctggagg

SEQ ID NO: 1622644 - DNA, 14 bp, Homo sapiens
ctgaaattgaaaag

SEQ ID NO: 1622645 - DNA, 23 bp, Homo sapiens
ctgaaattgagaatccagtttct

SEQ ID NO: 1622646 - DNA, 22 bp, Homo sapiens
ctgaaattgttttaccagctcc

SEQ ID NO: 1622647 - DNA, 13 bp, Homo sapiens
ctgaaatttcaga

SEQ ID NO: 1622648 - DNA, 22 bp, Homo sapiens
ctgaaattttagaaatattcac

SEQ ID NO: 1622649 - DNA, 19 bp, Homo sapiens
ctgaacaaaacctacacac

SEQ ID NO: 1622650 - DNA, 13 bp, Homo sapiens
ctgaacaagaatt

SEQ ID NO: 1622651 - DNA, 19 bp, Homo sapiens
tttctgtaatgtaaataaa

SEQ ID NO: 1622652 - DNA, 22 bp, Homo sapiens
tttctgtaatgtaaataaacta

SEQ ID NO: 1622653 - DNA, 23 bp, Homo sapiens
tttctgtaattcaggtttttcct

SEQ ID NO: 1622654 - DNA, 14 bp, Homo sapiens
tttctgtaccagtt

SEQ ID NO: 1622655 - DNA, 21 bp, Homo sapiens
tttctgtatatgattctctgt

SEQ ID NO: 1622656 - DNA, 14 bp, Homo sapiens
tttctgtcctgggc

SEQ ID NO: 1622657 - DNA, 14 bp, Homo sapiens
tttctgtctccctt

SEQ ID NO: 1622658 - DNA, 18 bp, Homo sapiens
tttctgtctcccttctct

SEQ ID NO: 1622659 - DNA, 20 bp, Homo sapiens
tttctgtgaaattctcagag

SEQ ID NO: 1622660 - DNA, 16 bp, Homo sapiens
tttctgtgcttggatt

SEQ ID NO: 1622661 - DNA, 22 bp, Homo sapiens
tttctgttcagcgttttgcaag

SEQ ID NO: 1622662 - DNA, 17 bp, Homo sapiens
tttctgttcttacaaat

SEQ ID NO: 1622663 - DNA, 14 bp, Homo sapiens
tttctgttgccaca

SEQ ID NO: 1622664 - DNA, 20 bp, Homo sapiens
tttctgtttcttcttgtgat

SEQ ID NO: 1622665 - DNA, 21 bp, Homo sapiens
tttcttaaataatgcttcaga

SEQ ID NO: 1622666 - DNA, 13 bp, Homo sapiens
tttcttaaatatg

SEQ ID NO: 1622667 - DNA, 15 bp, Homo sapiens
tttcttaaatgggct

SEQ ID NO: 1622668 - DNA, 13 bp, Homo sapiens
tttcttaacttct

SEQ ID NO: 1622669 - DNA, 17 bp, Homo sapiens
tttcttaacttcttgct

SEQ ID NO: 1622670 - DNA, 20 bp, Homo sapiens
tttcttaaggcatactagta

SEQ ID NO: 1622671 - DNA, 21 bp, Homo sapiens
tttcttaagtaatgatactgt

SEQ ID NO: 1622672 - DNA, 13 bp, Homo sapiens
tttcttaccaaaa

SEQ ID NO: 1622673 - DNA, 21 bp, Homo sapiens
tttcttacccagattgtgtac

SEQ ID NO: 1622674 - DNA, 14 bp, Homo sapiens
tttcttatgtgaca

SEQ ID NO: 1622675 - DNA, 16 bp, Homo sapiens
tttcttatgtgacatt

SEQ ID NO: 1622676 - DNA, 17 bp, Homo sapiens
tttcttatgtgacatta

SEQ ID NO: 1622677 - DNA, 13 bp, Homo sapiens
tttcttattgcgc

SEQ ID NO: 1622678 - DNA, 17 bp, Homo sapiens
tttcttcaaacagtata

SEQ ID NO: 1622679 - DNA, 14 bp, Homo sapiens
tttcttcaccaagt

SEQ ID NO: 1622680 - DNA, 19 bp, Homo sapiens
tttcttcaccaagtgcaat

SEQ ID NO: 1622681 - DNA, 16 bp, Homo sapiens
tttcttcacttcaagc

SEQ ID NO: 1622682 - DNA, 15 bp, Homo sapiens
tttcttcatccaact

SEQ ID NO: 1622683 - DNA, 13 bp, Homo sapiens
tttcttccctgct

SEQ ID NO: 1622684 - DNA, 21 bp, Homo sapiens
tttcttccctgctttgcatct

SEQ ID NO: 1622685 - DNA, 20 bp, Homo sapiens
tttcttcctttgaagcttta

SEQ ID NO: 1622686 - DNA, 15 bp, Homo sapiens
tttcttcgtgaacat

SEQ ID NO: 1622687 - DNA, 15 bp, Homo sapiens
tttcttctaaacatt

SEQ ID NO: 1622688 - DNA, 12 bp, Homo sapiens
tttcttctattt

SEQ ID NO: 1622689 - DNA, 20 bp, Homo sapiens
tttcttctctgtgagaaggt

SEQ ID NO: 1622690 - DNA, 19 bp, Homo sapiens
tttcttctcttatcctctc

SEQ ID NO: 1622691 - DNA, 23 bp, Homo sapiens
tttcttctcttatcctctctctc

SEQ ID NO: 1622692 - DNA, 13 bp, Homo sapiens
tttcttcttccct

SEQ ID NO: 1622693 - DNA, 19 bp, Homo sapiens
tttcttcttctaagaagac

SEQ ID NO: 1622694 - DNA, 17 bp, Homo sapiens
tttcttcttttttaagt

SEQ ID NO: 1622695 - DNA, 21 bp, Homo sapiens
tttcttcttttttaagttgtc

SEQ ID NO: 1622696 - DNA, 21 bp, Homo sapiens
tttcttgacaaaacctaactt

SEQ ID NO: 1622697 - DNA, 23 bp, Homo sapiens
tttcttgacaagctgacttggca

SEQ ID NO: 1622698 - DNA, 21 bp, Homo sapiens
tttcttgatcaacatcttttc

SEQ ID NO: 1622699 - DNA, 15 bp, Homo sapiens
tttcttgatcttaaa

SEQ ID NO: 1622700 - DNA, 12 bp, Homo sapiens
tttcttgcctct

SEQ ID NO: 1622701 - DNA, 21 bp, Homo sapiens
tttcttgcctctgtccccttc

SEQ ID NO: 1622702 - DNA, 21 bp, Homo sapiens
tttcttgctggttgtcatttt

SEQ ID NO: 1622703 - DNA, 15 bp, Homo sapiens
tttcttgtaaatgtt

SEQ ID NO: 1622704 - DNA, 20 bp, Homo sapiens
tttcttgtagccatggctgg

SEQ ID NO: 1622705 - DNA, 15 bp, Homo sapiens
tttcttgtttgtcag

SEQ ID NO: 1622706 - DNA, 13 bp, Homo sapiens
tttctttaactgc

SEQ ID NO: 1622707 - DNA, 18 bp, Homo sapiens
tttctttatcattgctaa

SEQ ID NO: 1622708 - DNA, 15 bp, Homo sapiens
tttctttcacaaaaa

SEQ ID NO: 1622709 - DNA, 22 bp, Homo sapiens
tttctttcccatgtatttgtta

SEQ ID NO: 1622710 - DNA, 13 bp, Homo sapiens
tttctttctatgt

SEQ ID NO: 1622711 - DNA, 14 bp, Homo sapiens
tttctttctatgta

SEQ ID NO: 1622712 - DNA, 14 bp, Homo sapiens
tttctttctgtctt

SEQ ID NO: 1622713 - DNA, 16 bp, Homo sapiens
tttctttgatcatgaa

SEQ ID NO: 1622714 - DNA, 13 bp, Homo sapiens
tttctttgtttct

SEQ ID NO: 1622715 - DNA, 14 bp, Homo sapiens
tttctttgtttctt

SEQ ID NO: 1622716 - DNA, 22 bp, Homo sapiens
tttcttttgcccttcacagtgt

SEQ ID NO: 1622717 - DNA, 13 bp, Homo sapiens
tttctttttaatt

SEQ ID NO: 1622718 - DNA, 14 bp, Homo sapiens
tttctttttccagt

SEQ ID NO: 1622719 - DNA, 14 bp, Homo sapiens
tttctttttcttct

SEQ ID NO: 1622720 - DNA, 16 bp, Homo sapiens
tttctttttgaatctt

SEQ ID NO: 1622721 - DNA, 19 bp, Homo sapiens
tttctttttgaatctttaa

SEQ ID NO: 1622722 - DNA, 15 bp, Homo sapiens
tttctttttttaact

SEQ ID NO: 1622723 - DNA, 17 bp, Homo sapiens
tttctttttttttaagt

SEQ ID NO: 1622724 - DNA, 18 bp, Homo sapiens
tttctttttttttaagtt

SEQ ID NO: 1622725 - DNA, 15 bp, Homo sapiens
tttgaaaattatgca

SEQ ID NO: 1622726 - DNA, 15 bp, Homo sapiens
tttgaaacaaagtac

SEQ ID NO: 1622727 - DNA, 18 bp, Homo sapiens
tttgaaagaagcaagaca

SEQ ID NO: 1622728 - DNA, 17 bp, Homo sapiens
tttgaaagtagagctag

SEQ ID NO: 1622729 - DNA, 23 bp, Homo sapiens
tttgaaagtagagctagctgcca

SEQ ID NO: 1622730 - DNA, 13 bp, Homo sapiens
tttgaaataaaaa

SEQ ID NO: 1622731 - DNA, 14 bp, Homo sapiens
tttgaaataataaa

SEQ ID NO: 1622732 - DNA, 15 bp, Homo sapiens
tttgaaatgatatga

SEQ ID NO: 1622733 - DNA, 22 bp, Homo sapiens
tttgaacaactaggcttcagca

SEQ ID NO: 1622734 - DNA, 12 bp, Homo sapiens
tttgaacatctc

SEQ ID NO: 1622735 - DNA, 20 bp, Homo sapiens
tttgaacgtgcttctttgta

SEQ ID NO: 1622736 - DNA, 15 bp, Homo sapiens
tttgaactaataaaa

SEQ ID NO: 1622737 - DNA, 20 bp, Homo sapiens
tttgaagacgtggactcctc

SEQ ID NO: 1622738 - DNA, 21 bp, Homo sapiens
tttgaagagttccaagttgaa

SEQ ID NO: 1622739 - DNA, 17 bp, Homo sapiens
tttgaagccttttgttt

SEQ ID NO: 1622740 - DNA, 17 bp, Homo sapiens
tttgaagggcaagaaat

SEQ ID NO: 1622741 - DNA, 18 bp, Homo sapiens
tttgaagtaaattaaaca

SEQ ID NO: 1622742 - DNA, 19 bp, Homo sapiens
tttgaagtaaattaaacat

SEQ ID NO: 1622743 - DNA, 22 bp, Homo sapiens
tttgaagtaggtggcttgagct

SEQ ID NO: 1622744 - DNA, 16 bp, Homo sapiens
tttgaataccattaaa

SEQ ID NO: 1622745 - DNA, 17 bp, Homo sapiens
tttgaatccatgcttgg

SEQ ID NO: 1622746 - DNA, 19 bp, Homo sapiens
tttgaatctttaattaaaa

SEQ ID NO: 1622747 - DNA, 16 bp, Homo sapiens
tttgaattatcagcaa

SEQ ID NO: 1622748 - DNA, 15 bp, Homo sapiens
tttgaatttaaataa

SEQ ID NO: 1622749 - DNA, 11 bp, Homo sapiens
tttgaatttct

SEQ ID NO: 1622750 - DNA, 20 bp, Homo sapiens
tttgacaattcctagataaa

SEQ ID NO: 1622751 - DNA, 17 bp, Homo sapiens
tttgacactatatctgt

SEQ ID NO: 1622752 - DNA, 17 bp, Homo sapiens
tttgacactgaaagttt

SEQ ID NO: 1622753 - DNA, 18 bp, Homo sapiens
tttgacacttcccagtgg

SEQ ID NO: 1622754 - DNA, 22 bp, Homo sapiens
tttgacagaatatgtttcaaac

SEQ ID NO: 1622755 - DNA, 13 bp, Homo sapiens
tttgacagtgttt

SEQ ID NO: 1622756 - DNA, 19 bp, Homo sapiens
tttgaccagatctttctct

SEQ ID NO: 1622757 - DNA, 14 bp, Homo sapiens
tttgacggatgatt

SEQ ID NO: 1622758 - DNA, 19 bp, Homo sapiens
tttgactaacaagaatgta

SEQ ID NO: 1622759 - DNA, 14 bp, Homo sapiens
tttgactaatttta

SEQ ID NO: 1622760 - DNA, 15 bp, Homo sapiens
tttgactatgaatgt

SEQ ID NO: 1622761 - DNA, 16 bp, Homo sapiens
tttgactattctgtat

SEQ ID NO: 1622762 - DNA, 23 bp, Homo sapiens
tttgacttaatgtgattactgct

SEQ ID NO: 1622763 - DNA, 16 bp, Homo sapiens
tttgacttttctgtaa

SEQ ID NO: 1622764 - DNA, 13 bp, Homo sapiens
tttgagaaactgc

SEQ ID NO: 1622765 - DNA, 20 bp, Homo sapiens
tttgagacagagtcttcctc

SEQ ID NO: 1622766 - DNA, 16 bp, Homo sapiens
tttgagaccaggctgg

SEQ ID NO: 1622767 - DNA, 21 bp, Homo sapiens
tttgagagaaatatgaagaac

SEQ ID NO: 1622768 - DNA, 15 bp, Homo sapiens
ctgaacacagtgtct

SEQ ID NO: 1622769 - DNA, 17 bp, Homo sapiens
ctgaacacagtgtctgt

SEQ ID NO: 1622770 - DNA, 17 bp, Homo sapiens
ctgaacacatttctttt

SEQ ID NO: 1622771 - DNA, 11 bp, Homo sapiens
ctgaacaccat

SEQ ID NO: 1622772 - DNA, 18 bp, Homo sapiens
ctgaacaccattgaaggc

SEQ ID NO: 1622773 - DNA, 20 bp, Homo sapiens
ctgaacaccattgaaggctt

SEQ ID NO: 1622774 - DNA, 19 bp, Homo sapiens
ctgaacacttttgttgtaa

SEQ ID NO: 1622775 - DNA, 13 bp, Homo sapiens
ctgaacagctgta

SEQ ID NO: 1622776 - DNA, 18 bp, Homo sapiens
ctgaacattagttgcact

SEQ ID NO: 1622777 - DNA, 20 bp, Homo sapiens
ctgaacattagttgcactaa

SEQ ID NO: 1622778 - DNA, 12 bp, Homo sapiens
ctgaaccaaagc

SEQ ID NO: 1622779 - DNA, 22 bp, Homo sapiens
ctgaaccactgcttctcttttg

SEQ ID NO: 1622780 - DNA, 18 bp, Homo sapiens
ctgaaccccagaggcaga

SEQ ID NO: 1622781 - DNA, 19 bp, Homo sapiens
ctgaaccccagaggcagag

SEQ ID NO: 1622782 - DNA, 19 bp, Homo sapiens
ctgaaccccatgggcttgg

SEQ ID NO: 1622783 - DNA, 15 bp, Homo sapiens
ctgaaccccctccag

SEQ ID NO: 1622784 - DNA, 12 bp, Homo sapiens
ctgaacccctgg

SEQ ID NO: 1622785 - DNA, 14 bp, Homo sapiens
ctgaacccctggcc

SEQ ID NO: 1622786 - DNA, 16 bp, Homo sapiens
ctgaacccctggccag

SEQ ID NO: 1622787 - DNA, 15 bp, Homo sapiens
ctgaaccctgtgctg

SEQ ID NO: 1622788 - DNA, 17 bp, Homo sapiens
ctgaaccgcacagctca

SEQ ID NO: 1622789 - DNA, 23 bp, Homo sapiens
ctgaaccgcacagctcaggaggc

SEQ ID NO: 1622790 - DNA, 20 bp, Homo sapiens
ctgaaccggctttaccaaac

SEQ ID NO: 1622791 - DNA, 17 bp, Homo sapiens
ctgaacctggaaatgat

SEQ ID NO: 1622792 - DNA, 19 bp, Homo sapiens
ctgaacctgggaaagagat

SEQ ID NO: 1622793 - DNA, 20 bp, Homo sapiens
ctgaacctgggaaagagatt

SEQ ID NO: 1622794 - DNA, 22 bp, Homo sapiens
ctgaacctggggtcatcgattc

SEQ ID NO: 1622795 - DNA, 16 bp, Homo sapiens
ctgaaccttccatctc

SEQ ID NO: 1622796 - DNA, 23 bp, Homo sapiens
ctgaacgcagaagaaagggtgga

SEQ ID NO: 1622797 - DNA, 23 bp, Homo sapiens
ctgaacgtttccccgaagagtca

SEQ ID NO: 1622798 - DNA, 20 bp, Homo sapiens
ctgaacgttttcttctttcc

SEQ ID NO: 1622799 - DNA, 23 bp, Homo sapiens
ctgaacgttttcttctttccctg

SEQ ID NO: 1622800 - DNA, 23 bp, Homo sapiens
ctgaactacaagtgtaggccacc

SEQ ID NO: 1622801 - DNA, 16 bp, Homo sapiens
ctgaactattttaaat

SEQ ID NO: 1622802 - DNA, 20 bp, Homo sapiens
ctgaactattttaaataaaa

SEQ ID NO: 1622803 - DNA, 17 bp, Homo sapiens
ctgaactcaagctgcgt

SEQ ID NO: 1622804 - DNA, 17 bp, Homo sapiens
ctgaactccttccccac

SEQ ID NO: 1622805 - DNA, 15 bp, Homo sapiens
ctgaactgacaatga

SEQ ID NO: 1622806 - DNA, 15 bp, Homo sapiens
ctgaactgagcctag

SEQ ID NO: 1622807 - DNA, 12 bp, Homo sapiens
ctgaactgagga

SEQ ID NO: 1622808 - DNA, 13 bp, Homo sapiens
ctgaactgaggcc

SEQ ID NO: 1622809 - DNA, 20 bp, Homo sapiens
ctgaactgtgcatcaaccag

SEQ ID NO: 1622810 - DNA, 20 bp, Homo sapiens
ctgaacttaataactgtgta

SEQ ID NO: 1622811 - DNA, 17 bp, Homo sapiens
ctgaacttgcattgtga

SEQ ID NO: 1622812 - DNA, 18 bp, Homo sapiens
ctgaacttgcattgtgat

SEQ ID NO: 1622813 - DNA, 17 bp, Homo sapiens
ctgaagaagatgagcct

SEQ ID NO: 1622814 - DNA, 12 bp, Homo sapiens
ctgaagaatgaa

SEQ ID NO: 1622815 - DNA, 14 bp, Homo sapiens
ctgaagaatgaaga

SEQ ID NO: 1622816 - DNA, 15 bp, Homo sapiens
ctgaagaattaagat

SEQ ID NO: 1622817 - DNA, 21 bp, Homo sapiens
ctgaagacatgtttcaagaac

SEQ ID NO: 1622818 - DNA, 17 bp, Homo sapiens
ctgaagaccatggattt

SEQ ID NO: 1622819 - DNA, 20 bp, Homo sapiens
ctgaagagagggacaggcac

SEQ ID NO: 1622820 - DNA, 19 bp, Homo sapiens
ctgaagaggcgggccagcc

SEQ ID NO: 1622821 - DNA, 21 bp, Homo sapiens
ctgaagaggcgggccagccag

SEQ ID NO: 1622822 - DNA, 21 bp, Homo sapiens
ctgaagagtatccttccttca

SEQ ID NO: 1622823 - DNA, 15 bp, Homo sapiens
ctgaagatcagaaca

SEQ ID NO: 1622824 - DNA, 18 bp, Homo sapiens
ctgaagattaggcacaca

SEQ ID NO: 1622825 - DNA, 21 bp, Homo sapiens
ctgaagattaggcacacagat

SEQ ID NO: 1622826 - DNA, 20 bp, Homo sapiens
ctgaagatttcagaggctgc

SEQ ID NO: 1622827 - DNA, 23 bp, Homo sapiens
ctgaagcacagcaccgggggaga

SEQ ID NO: 1622828 - DNA, 15 bp, Homo sapiens
ctgaagcagcctctc

SEQ ID NO: 1622829 - DNA, 16 bp, Homo sapiens
ctgaagcagcctctcc

SEQ ID NO: 1622830 - DNA, 21 bp, Homo sapiens
ctgaagccctcccaggtgtta

SEQ ID NO: 1622831 - DNA, 17 bp, Homo sapiens
ctgaagccggacagctg

SEQ ID NO: 1622832 - DNA, 20 bp, Homo sapiens
ctgaagccggacagctgccc

SEQ ID NO: 1622833 - DNA, 22 bp, Homo sapiens
ctgaagccggacagctgcccag

SEQ ID NO: 1622834 - DNA, 15 bp, Homo sapiens
ctgaagcctgcagga

SEQ ID NO: 1622835 - DNA, 23 bp, Homo sapiens
ctgaagcctttgcattttggaga

SEQ ID NO: 1622836 - DNA, 20 bp, Homo sapiens
ctgaagctgctgcagccctg

SEQ ID NO: 1622837 - DNA, 21 bp, Homo sapiens
ctgaagctgctgcagccctgc

SEQ ID NO: 1622838 - DNA, 14 bp, Homo sapiens
ctgaagcttgactc

SEQ ID NO: 1622839 - DNA, 20 bp, Homo sapiens
ctgaagcttgactcccaagt

SEQ ID NO: 1622840 - DNA, 14 bp, Homo sapiens
ctgaagctttacca

SEQ ID NO: 1622841 - DNA, 18 bp, Homo sapiens
ctgaagctttaccagctg

SEQ ID NO: 1622842 - DNA, 14 bp, Homo sapiens
ctgaaggaaaaaca

SEQ ID NO: 1622843 - DNA, 17 bp, Homo sapiens
ctgaaggaaaaacacaa

SEQ ID NO: 1622844 - DNA, 21 bp, Homo sapiens
ctgaaggaaaaacacaagcaa

SEQ ID NO: 1622845 - DNA, 16 bp, Homo sapiens
ctgaaggaatagccag

SEQ ID NO: 1622846 - DNA, 19 bp, Homo sapiens
ctgaaggaatagccagaga

SEQ ID NO: 1622847 - DNA, 20 bp, Homo sapiens
ctgaaggaatagccagagag

SEQ ID NO: 1622848 - DNA, 21 bp, Homo sapiens
ctgaaggaatagccagagagg

SEQ ID NO: 1622849 - DNA, 20 bp, Homo sapiens
ctgaaggacacttcctgcct

SEQ ID NO: 1622850 - DNA, 15 bp, Homo sapiens
ctgaaggcagtggca

SEQ ID NO: 1622851 - DNA, 20 bp, Homo sapiens
ctgaaggcagtggcagggga

SEQ ID NO: 1622852 - DNA, 16 bp, Homo sapiens
ctgaaggggcacacca

SEQ ID NO: 1622853 - DNA, 15 bp, Homo sapiens
ctgaaggtcccctgg

SEQ ID NO: 1622854 - DNA, 13 bp, Homo sapiens
ctgaagtcactgc

SEQ ID NO: 1622855 - DNA, 15 bp, Homo sapiens
ctgaagtcactgcac

SEQ ID NO: 1622856 - DNA, 16 bp, Homo sapiens
ctgaagtcttttctgt

SEQ ID NO: 1622857 - DNA, 14 bp, Homo sapiens
ctgaagtgctcttt

SEQ ID NO: 1622858 - DNA, 13 bp, Homo sapiens
ctgaagtggctgg

SEQ ID NO: 1622859 - DNA, 13 bp, Homo sapiens
ctgaagttctgag

SEQ ID NO: 1622860 - DNA, 20 bp, Homo sapiens
ctgaagttctgagccgggca

SEQ ID NO: 1622861 - DNA, 17 bp, Homo sapiens
ctgaataatgctaccag

SEQ ID NO: 1622862 - DNA, 22 bp, Homo sapiens
ctgaataatggaattatgtata

SEQ ID NO: 1622863 - DNA, 13 bp, Homo sapiens
ctgaataatttct

SEQ ID NO: 1622864 - DNA, 16 bp, Homo sapiens
ctgaataatttcttac

SEQ ID NO: 1622865 - DNA, 16 bp, Homo sapiens
ctgaatacattctgct

SEQ ID NO: 1622866 - DNA, 22 bp, Homo sapiens
ctgaatagctgtcataaaatga

SEQ ID NO: 1622867 - DNA, 19 bp, Homo sapiens
ctgaatagtcttcagagat

SEQ ID NO: 1622868 - DNA, 20 bp, Homo sapiens
ctgaatcatgagcctgctgg

SEQ ID NO: 1622869 - DNA, 21 bp, Homo sapiens
ctgaatcatgagcctgctgga

SEQ ID NO: 1622870 - DNA, 17 bp, Homo sapiens
ctgaatcccgggctaag

SEQ ID NO: 1622871 - DNA, 13 bp, Homo sapiens
ctgaatccgtggt

SEQ ID NO: 1622872 - DNA, 17 bp, Homo sapiens
ctgaatctgctaccaaa

SEQ ID NO: 1622873 - DNA, 14 bp, Homo sapiens
ctgaatgaagcagt

SEQ ID NO: 1622874 - DNA, 16 bp, Homo sapiens
ctgaatgatcctgtct

SEQ ID NO: 1622875 - DNA, 13 bp, Homo sapiens
ctgaatgccccct

SEQ ID NO: 1622876 - DNA, 20 bp, Homo sapiens
ctgaatgcctcgctcccttc

SEQ ID NO: 1622877 - DNA, 20 bp, Homo sapiens
ctgaatgcttctgagagcaa

SEQ ID NO: 1622878 - DNA, 18 bp, Homo sapiens
ctgaatggttccatgcct

SEQ ID NO: 1622879 - DNA, 20 bp, Homo sapiens
ctgaatgtatgtcagtgcta

SEQ ID NO: 1622880 - DNA, 11 bp, Homo sapiens
ctgaatgtatt

SEQ ID NO: 1622881 - DNA, 13 bp, Homo sapiens
ctgaatgtgccta

SEQ ID NO: 1622882 - DNA, 22 bp, Homo sapiens
ctgaatgtttaaagatcatgac

SEQ ID NO: 1622883 - DNA, 22 bp, Homo sapiens
ctgaattaatgacagagccagt

SEQ ID NO: 1622884 - DNA, 17 bp, Homo sapiens
tttgagatctggggagg

SEQ ID NO: 1622885 - DNA, 14 bp, Homo sapiens
tttgagctgccttc

SEQ ID NO: 1622886 - DNA, 15 bp, Homo sapiens
tttgagcttaatctt

SEQ ID NO: 1622887 - DNA, 15 bp, Homo sapiens
tttgaggcaaatcta

SEQ ID NO: 1622888 - DNA, 15 bp, Homo sapiens
tttgaggctgcagcg

SEQ ID NO: 1622889 - DNA, 18 bp, Homo sapiens
tttgagggcccagccagg

SEQ ID NO: 1622890 - DNA, 23 bp, Homo sapiens
tttgagggcccagccaggagcag

SEQ ID NO: 1622891 - DNA, 20 bp, Homo sapiens
tttgaggttttgtaaaactg

SEQ ID NO: 1622892 - DNA, 16 bp, Homo sapiens
tttgagtccctccaaa

SEQ ID NO: 1622893 - DNA, 22 bp, Homo sapiens
tttgagtgacagctttctggga

SEQ ID NO: 1622894 - DNA, 12 bp, Homo sapiens
tttgagttctac

SEQ ID NO: 1622895 - DNA, 16 bp, Homo sapiens
tttgataaaataaatg

SEQ ID NO: 1622896 - DNA, 16 bp, Homo sapiens
tttgataaacattcct

SEQ ID NO: 1622897 - DNA, 13 bp, Homo sapiens
tttgataaagttt

SEQ ID NO: 1622898 - DNA, 13 bp, Homo sapiens
tttgataacaaaa

SEQ ID NO: 1622899 - DNA, 23 bp, Homo sapiens
tttgataacagggattgatttta

SEQ ID NO: 1622900 - DNA, 20 bp, Homo sapiens
tttgatacataaacttttgc

SEQ ID NO: 1622901 - DNA, 21 bp, Homo sapiens
tttgatacataaacttttgca

SEQ ID NO: 1622902 - DNA, 19 bp, Homo sapiens
tttgatagggaactgggga

SEQ ID NO: 1622903 - DNA, 13 bp, Homo sapiens
tttgatatacatt

SEQ ID NO: 1622904 - DNA, 16 bp, Homo sapiens
tttgatatacattgtg

SEQ ID NO: 1622905 - DNA, 17 bp, Homo sapiens
tttgatatccaaagctg

SEQ ID NO: 1622906 - DNA, 13 bp, Homo sapiens
tttgatatgtagt

SEQ ID NO: 1622907 - DNA, 12 bp, Homo sapiens
tttgatcatgaa

SEQ ID NO: 1622908 - DNA, 16 bp, Homo sapiens
tttgatgaaagctgat

SEQ ID NO: 1622909 - DNA, 20 bp, Homo sapiens
tttgatgcccaatatattct

SEQ ID NO: 1622910 - DNA, 18 bp, Homo sapiens
tttgatgctatttatgca

SEQ ID NO: 1622911 - DNA, 19 bp, Homo sapiens
tttgatggagggtggaaat

SEQ ID NO: 1622912 - DNA, 14 bp, Homo sapiens
tttgatggggagaa

SEQ ID NO: 1622913 - DNA, 22 bp, Homo sapiens
tttgatggtggtattgtgacca

SEQ ID NO: 1622914 - DNA, 18 bp, Homo sapiens
tttgatgtacatgtgtag

SEQ ID NO: 1622915 - DNA, 14 bp, Homo sapiens
tttgatgtatatat

SEQ ID NO: 1622916 - DNA, 16 bp, Homo sapiens
tttgatgtatgtgtga

SEQ ID NO: 1622917 - DNA, 17 bp, Homo sapiens
tttgatgtatgtgtgaa

SEQ ID NO: 1622918 - DNA, 19 bp, Homo sapiens
tttgatgtatgtgtgaaac

SEQ ID NO: 1622919 - DNA, 21 bp, Homo sapiens
tttgatgtatgtgtgaaacaa

SEQ ID NO: 1622920 - DNA, 19 bp, Homo sapiens
tttgattaacaatgtattt

SEQ ID NO: 1622921 - DNA, 17 bp, Homo sapiens
tttgattaatgtttctt

SEQ ID NO: 1622922 - DNA, 14 bp, Homo sapiens
tttgattattatgt

SEQ ID NO: 1622923 - DNA, 15 bp, Homo sapiens
tttgattattatgtt

SEQ ID NO: 1622924 - DNA, 16 bp, Homo sapiens
tttgattcaaggctca

SEQ ID NO: 1622925 - DNA, 20 bp, Homo sapiens
tttgattcattttcctgttc

SEQ ID NO: 1622926 - DNA, 13 bp, Homo sapiens
tttgattctcctt

SEQ ID NO: 1622927 - DNA, 10 bp, Homo sapiens
tttgattggc

SEQ ID NO: 1622928 - DNA, 12 bp, Homo sapiens
tttgattggctt

SEQ ID NO: 1622929 - DNA, 13 bp, Homo sapiens
tttgattggcttt

SEQ ID NO: 1622930 - DNA, 14 bp, Homo sapiens
tttgatttcaacat

SEQ ID NO: 1622931 - DNA, 16 bp, Homo sapiens
tttgatttcaacatga

SEQ ID NO: 1622932 - DNA, 12 bp, Homo sapiens
tttgcaaaattt

SEQ ID NO: 1622933 - DNA, 20 bp, Homo sapiens
tttgcaacaggggaggaaaa

SEQ ID NO: 1622934 - DNA, 15 bp, Homo sapiens
tttgcaaccaggaac

SEQ ID NO: 1622935 - DNA, 19 bp, Homo sapiens
tttgcaacctctttgctca

SEQ ID NO: 1622936 - DNA, 20 bp, Homo sapiens
tttgcaactcgaactgcttt

SEQ ID NO: 1622937 - DNA, 20 bp, Homo sapiens
tttgcaataacttctatatt

SEQ ID NO: 1622938 - DNA, 14 bp, Homo sapiens
tttgcaatatttat

SEQ ID NO: 1622939 - DNA, 17 bp, Homo sapiens
tttgcaatgtatttagc

SEQ ID NO: 1622940 - DNA, 14 bp, Homo sapiens
tttgcaatgtcaca

SEQ ID NO: 1622941 - DNA, 19 bp, Homo sapiens
tttgcacaaggaaataaag

SEQ ID NO: 1622942 - DNA, 16 bp, Homo sapiens
tttgcacagctctccg

SEQ ID NO: 1622943 - DNA, 19 bp, Homo sapiens
tttgcacagtgtgtgactt

SEQ ID NO: 1622944 - DNA, 14 bp, Homo sapiens
tttgcacattttgt

SEQ ID NO: 1622945 - DNA, 14 bp, Homo sapiens
tttgcaccaaagac

SEQ ID NO: 1622946 - DNA, 15 bp, Homo sapiens
tttgcaccaaagaca

SEQ ID NO: 1622947 - DNA, 17 bp, Homo sapiens
tttgcaccaaagacatc

SEQ ID NO: 1622948 - DNA, 13 bp, Homo sapiens
tttgcacccctcc

SEQ ID NO: 1622949 - DNA, 18 bp, Homo sapiens
tttgcaccgcctgccctc

SEQ ID NO: 1622950 - DNA, 20 bp, Homo sapiens
tttgcactaaatcagagaca

SEQ ID NO: 1622951 - DNA, 21 bp, Homo sapiens
tttgcactaaatcagagacaa

SEQ ID NO: 1622952 - DNA, 16 bp, Homo sapiens
tttgcactcaaatctt

SEQ ID NO: 1622953 - DNA, 19 bp, Homo sapiens
tttgcactcaaatcttaag

SEQ ID NO: 1622954 - DNA, 14 bp, Homo sapiens
tttgcactctgtaa

SEQ ID NO: 1622955 - DNA, 20 bp, Homo sapiens
tttgcactctgtaattgcac

SEQ ID NO: 1622956 - DNA, 12 bp, Homo sapiens
tttgcactgagg

SEQ ID NO: 1622957 - DNA, 16 bp, Homo sapiens
tttgcactgagggcca

SEQ ID NO: 1622958 - DNA, 22 bp, Homo sapiens
tttgcactgtaaattgctggca

SEQ ID NO: 1622959 - DNA, 19 bp, Homo sapiens
tttgcagaaaagcacctgc

SEQ ID NO: 1622960 - DNA, 22 bp, Homo sapiens
tttgcagaaaagcacctgccga

SEQ ID NO: 1622961 - DNA, 17 bp, Homo sapiens
tttgcagaagagggtgt

SEQ ID NO: 1622962 - DNA, 23 bp, Homo sapiens
tttgcagagtggaaactcagccg

SEQ ID NO: 1622963 - DNA, 16 bp, Homo sapiens
tttgcagcataccaat

SEQ ID NO: 1622964 - DNA, 18 bp, Homo sapiens
tttgcagcataccaatta

SEQ ID NO: 1622965 - DNA, 20 bp, Homo sapiens
tttgcaggattcccttctgg

SEQ ID NO: 1622966 - DNA, 21 bp, Homo sapiens
tttgcaggctctgggctcagg

SEQ ID NO: 1622967 - DNA, 9 bp, Homo sapiens
tttgcagta

SEQ ID NO: 1622968 - DNA, 22 bp, Homo sapiens
tttgcagttggactctcaggga

SEQ ID NO: 1622969 - DNA, 14 bp, Homo sapiens
tttgcatctgaaat

SEQ ID NO: 1622970 - DNA, 21 bp, Homo sapiens
tttgcatgtgaaaatcaaata

SEQ ID NO: 1622971 - DNA, 14 bp, Homo sapiens
tttgcattccagaa

SEQ ID NO: 1622972 - DNA, 12 bp, Homo sapiens
tttgcattgtgt

SEQ ID NO: 1622973 - DNA, 19 bp, Homo sapiens
tttgcatttctcttcctaa

SEQ ID NO: 1622974 - DNA, 22 bp, Homo sapiens
tttgccactaattttagtattc

SEQ ID NO: 1622975 - DNA, 17 bp, Homo sapiens
tttgccaggacatgcaa

SEQ ID NO: 1622976 - DNA, 18 bp, Homo sapiens
tttgccagttttccctgg

SEQ ID NO: 1622977 - DNA, 14 bp, Homo sapiens
tttgccatgtcgct

SEQ ID NO: 1622978 - DNA, 23 bp, Homo sapiens
tttgccccgggatattatagaaa

SEQ ID NO: 1622979 - DNA, 18 bp, Homo sapiens
tttgccggatacaaactg

SEQ ID NO: 1622980 - DNA, 23 bp, Homo sapiens
tttgcctcaactccaggatttag

SEQ ID NO: 1622981 - DNA, 13 bp, Homo sapiens
tttgcctgcaaga

SEQ ID NO: 1622982 - DNA, 20 bp, Homo sapiens
tttgcctgcaagagaatctg

SEQ ID NO: 1622983 - DNA, 23 bp, Homo sapiens
tttgcctggctgtggaggcctga

SEQ ID NO: 1622984 - DNA, 11 bp, Homo sapiens
tttgcctgtgc

SEQ ID NO: 1622985 - DNA, 12 bp, Homo sapiens
tttgcctgtgcc

SEQ ID NO: 1622986 - DNA, 21 bp, Homo sapiens
tttgcgcctcggtatctggct

SEQ ID NO: 1622987 - DNA, 22 bp, Homo sapiens
tttgcgcctcggtatctggctt

SEQ ID NO: 1622988 - DNA, 13 bp, Homo sapiens
tttgcgctgctaa

SEQ ID NO: 1622989 - DNA, 19 bp, Homo sapiens
tttgcgtgggagtgtgtgc

SEQ ID NO: 1622990 - DNA, 18 bp, Homo sapiens
tttgctaaaaaagcatat

SEQ ID NO: 1622991 - DNA, 12 bp, Homo sapiens
tttgctaactgg

SEQ ID NO: 1622992 - DNA, 16 bp, Homo sapiens
tttgctaactgggtta

SEQ ID NO: 1622993 - DNA, 15 bp, Homo sapiens
tttgctaactggtta

SEQ ID NO: 1622994 - DNA, 18 bp, Homo sapiens
tttgctaatgtataatgt

SEQ ID NO: 1622995 - DNA, 16 bp, Homo sapiens
tttgctacaaatttat

SEQ ID NO: 1622996 - DNA, 20 bp, Homo sapiens
tttgctacaaatttatgcat

SEQ ID NO: 1622997 - DNA, 21 bp, Homo sapiens
tttgctacaaatttatgcatt

SEQ ID NO: 1622998 - DNA, 22 bp, Homo sapiens
tttgctacccatttacaaataa

SEQ ID NO: 1622999 - DNA, 21 bp, Homo sapiens
tttgctagttggagtgcttgt

SEQ ID NO: 1623000 - DNA, 16 bp, Homo sapiens
tttgctataatcatta

SEQ ID NO: 1623001 - DNA, 12 bp, Homo sapiens
ctgaattcactc

SEQ ID NO: 1623002 - DNA, 14 bp, Homo sapiens
ctgaattcactcca

SEQ ID NO: 1623003 - DNA, 18 bp, Homo sapiens
ctgaattcactccagtca

SEQ ID NO: 1623004 - DNA, 16 bp, Homo sapiens
ctgaattctatttgct

SEQ ID NO: 1623005 - DNA, 19 bp, Homo sapiens
ctgaattggaagggaaaaa

SEQ ID NO: 1623006 - DNA, 19 bp, Homo sapiens
ctgaattgtatcaatttgt

SEQ ID NO: 1623007 - DNA, 21 bp, Homo sapiens
ctgaattgtatcaatttgttt

SEQ ID NO: 1623008 - DNA, 16 bp, Homo sapiens
ctgaattgtccccagt

SEQ ID NO: 1623009 - DNA, 14 bp, Homo sapiens
ctgaatttatcttt

SEQ ID NO: 1623010 - DNA, 20 bp, Homo sapiens
ctgaatttatctttgataac

SEQ ID NO: 1623011 - DNA, 17 bp, Homo sapiens
ctgaattttataaataa

SEQ ID NO: 1623012 - DNA, 18 bp, Homo sapiens
ctgaattttgcaatgtat

SEQ ID NO: 1623013 - DNA, 24 bp, Homo sapiens
ctgaattttgcaatgtatttagct

SEQ ID NO: 1623014 - DNA, 15 bp, Homo sapiens
ctgaattttgggact

SEQ ID NO: 1623015 - DNA, 14 bp, Homo sapiens
ctgaatttttttgt

SEQ ID NO: 1623016 - DNA, 21 bp, Homo sapiens
ctgacaaacgtccccagcggt

SEQ ID NO: 1623017 - DNA, 18 bp, Homo sapiens
ctgacaaccattaaagtc

SEQ ID NO: 1623018 - DNA, 19 bp, Homo sapiens
ctgacaacttagctcaggt

SEQ ID NO: 1623019 - DNA, 23 bp, Homo sapiens
ctgacaacttagctcaggtgcct

SEQ ID NO: 1623020 - DNA, 12 bp, Homo sapiens
ctgacaagggct

SEQ ID NO: 1623021 - DNA, 20 bp, Homo sapiens
ctgacaagggctgacctgcc

SEQ ID NO: 1623022 - DNA, 13 bp, Homo sapiens
ctgacaataaaga

SEQ ID NO: 1623023 - DNA, 20 bp, Homo sapiens
ctgacaataaagatatttcc

SEQ ID NO: 1623024 - DNA, 13 bp, Homo sapiens
ctgacaatgaagg

SEQ ID NO: 1623025 - DNA, 15 bp, Homo sapiens
ctgacaatgaaggga

SEQ ID NO: 1623026 - DNA, 23 bp, Homo sapiens
ctgacaatggcagctagactgga

SEQ ID NO: 1623027 - DNA, 14 bp, Homo sapiens
ctgacacaccaggc

SEQ ID NO: 1623028 - DNA, 23 bp, Homo sapiens
ctgacacaccaggcgctaattca

SEQ ID NO: 1623029 - DNA, 23 bp, Homo sapiens
ctgacacactaaccaagctgagt

SEQ ID NO: 1623030 - DNA, 15 bp, Homo sapiens
ctgacacctaccatg

SEQ ID NO: 1623031 - DNA, 17 bp, Homo sapiens
ctgacacctaccatgct

SEQ ID NO: 1623032 - DNA, 18 bp, Homo sapiens
ctgacactaccttatcag

SEQ ID NO: 1623033 - DNA, 19 bp, Homo sapiens
ctgacactttaattaccaa

SEQ ID NO: 1623034 - DNA, 14 bp, Homo sapiens
ctgacagaaggact

SEQ ID NO: 1623035 - DNA, 16 bp, Homo sapiens
ctgacagaaggtgcca

SEQ ID NO: 1623036 - DNA, 17 bp, Homo sapiens
ctgacagagctctgggt

SEQ ID NO: 1623037 - DNA, 19 bp, Homo sapiens
ctgacagattgacagggac

SEQ ID NO: 1623038 - DNA, 13 bp, Homo sapiens
ctgacagcctccc

SEQ ID NO: 1623039 - DNA, 17 bp, Homo sapiens
ctgacagcctcccaccc

SEQ ID NO: 1623040 - DNA, 19 bp, Homo sapiens
ctgacagggacatgccctg

SEQ ID NO: 1623041 - DNA, 17 bp, Homo sapiens
ctgacagggagcagccc

SEQ ID NO: 1623042 - DNA, 15 bp, Homo sapiens
ctgacagtttttctg

SEQ ID NO: 1623043 - DNA, 16 bp, Homo sapiens
ctgacagtttttctgt

SEQ ID NO: 1623044 - DNA, 14 bp, Homo sapiens
ctgacatcccttcc

SEQ ID NO: 1623045 - DNA, 15 bp, Homo sapiens
ctgacatcccttcct

SEQ ID NO: 1623046 - DNA, 19 bp, Homo sapiens
ctgacatcccttcctggaa

SEQ ID NO: 1623047 - DNA, 22 bp, Homo sapiens
ctgacatcccttcctggaaaca

SEQ ID NO: 1623048 - DNA, 15 bp, Homo sapiens
ctgacatcttgaatc

SEQ ID NO: 1623049 - DNA, 22 bp, Homo sapiens
ctgacatcttgaatccttccat

SEQ ID NO: 1623050 - DNA, 19 bp, Homo sapiens
ctgacatgtaagaaaatgt

SEQ ID NO: 1623051 - DNA, 22 bp, Homo sapiens
ctgacattcctaagagtggagg

SEQ ID NO: 1623052 - DNA, 21 bp, Homo sapiens
ctgacatttgtttattttttg

SEQ ID NO: 1623053 - DNA, 16 bp, Homo sapiens
ctgaccaaagactgca

SEQ ID NO: 1623054 - DNA, 17 bp, Homo sapiens
ctgaccaaagactgcag

SEQ ID NO: 1623055 - DNA, 15 bp, Homo sapiens
ctgaccaacaggctg

SEQ ID NO: 1623056 - DNA, 18 bp, Homo sapiens
ctgaccaacaggctgttc

SEQ ID NO: 1623057 - DNA, 17 bp, Homo sapiens
ctgaccaagagagaaag

SEQ ID NO: 1623058 - DNA, 19 bp, Homo sapiens
ctgaccaagtgctggccca

SEQ ID NO: 1623059 - DNA, 19 bp, Homo sapiens
ctgaccaattgtgctgcca

SEQ ID NO: 1623060 - DNA, 15 bp, Homo sapiens
ctgaccacacgcggg

SEQ ID NO: 1623061 - DNA, 13 bp, Homo sapiens
ctgaccaccctcc

SEQ ID NO: 1623062 - DNA, 18 bp, Homo sapiens
ctgaccacttgaggcctg

SEQ ID NO: 1623063 - DNA, 19 bp, Homo sapiens
ctgaccacttgaggcctga

SEQ ID NO: 1623064 - DNA, 23 bp, Homo sapiens
ctgaccagagaatgcacctcttg

SEQ ID NO: 1623065 - DNA, 18 bp, Homo sapiens
ctgaccagcggctgctca

SEQ ID NO: 1623066 - DNA, 19 bp, Homo sapiens
ctgaccagcggctgctcaa

SEQ ID NO: 1623067 - DNA, 16 bp, Homo sapiens
ctgaccatccactcta

SEQ ID NO: 1623068 - DNA, 19 bp, Homo sapiens
ctgaccatccactctaccc

SEQ ID NO: 1623069 - DNA, 22 bp, Homo sapiens
ctgaccatccactctaccctcc

SEQ ID NO: 1623070 - DNA, 23 bp, Homo sapiens
ctgaccatccactctaccctccc

SEQ ID NO: 1623071 - DNA, 17 bp, Homo sapiens
ctgaccatctgtgacta

SEQ ID NO: 1623072 - DNA, 19 bp, Homo sapiens
ctgaccatgcgtcaggggc

SEQ ID NO: 1623073 - DNA, 21 bp, Homo sapiens
ctgaccatgctcatctgctgg

SEQ ID NO: 1623074 - DNA, 21 bp, Homo sapiens
ctgacccaactgatcctgctc

SEQ ID NO: 1623075 - DNA, 22 bp, Homo sapiens
ctgacccaactgatcctgctcc

SEQ ID NO: 1623076 - DNA, 12 bp, Homo sapiens
ctgacccagcat

SEQ ID NO: 1623077 - DNA, 13 bp, Homo sapiens
ctgacccagcatc

SEQ ID NO: 1623078 - DNA, 13 bp, Homo sapiens
ctgacccaggccg

SEQ ID NO: 1623079 - DNA, 15 bp, Homo sapiens
ctgacccaggccgca

SEQ ID NO: 1623080 - DNA, 17 bp, Homo sapiens
ctgacccaggccgcagc

SEQ ID NO: 1623081 - DNA, 18 bp, Homo sapiens
ctgacccaggccgcagct

SEQ ID NO: 1623082 - DNA, 21 bp, Homo sapiens
ctgacccaggccgcagctctt

SEQ ID NO: 1623083 - DNA, 13 bp, Homo sapiens
ctgacccagtccc

SEQ ID NO: 1623084 - DNA, 12 bp, Homo sapiens
ctgacccagtgc

SEQ ID NO: 1623085 - DNA, 20 bp, Homo sapiens
ctgacccagtgcccccactg

SEQ ID NO: 1623086 - DNA, 21 bp, Homo sapiens
ctgaccccagaaattctggcc

SEQ ID NO: 1623087 - DNA, 14 bp, Homo sapiens
ctgacccctgcctg

SEQ ID NO: 1623088 - DNA, 16 bp, Homo sapiens
ctgacccctgctcagt

SEQ ID NO: 1623089 - DNA, 19 bp, Homo sapiens
ctgaccctgcttcaaatat

SEQ ID NO: 1623090 - DNA, 14 bp, Homo sapiens
ctgaccctgggcct

SEQ ID NO: 1623091 - DNA, 15 bp, Homo sapiens
ctgacccttccagac

SEQ ID NO: 1623092 - DNA, 16 bp, Homo sapiens
ctgacctaccccagcc

SEQ ID NO: 1623093 - DNA, 22 bp, Homo sapiens
ctgacctacctcaaagggcagt

SEQ ID NO: 1623094 - DNA, 17 bp, Homo sapiens
ctgacctcaagtgatct

SEQ ID NO: 1623095 - DNA, 14 bp, Homo sapiens
ctgacctcacctgg

SEQ ID NO: 1623096 - DNA, 15 bp, Homo sapiens
ctgacctcacctggt

SEQ ID NO: 1623097 - DNA, 20 bp, Homo sapiens
ctgacctcacctggtcctcc

SEQ ID NO: 1623098 - DNA, 20 bp, Homo sapiens
ctgacctccctctaatttat

SEQ ID NO: 1623099 - DNA, 14 bp, Homo sapiens
ctgacctccgccat

SEQ ID NO: 1623100 - DNA, 20 bp, Homo sapiens
ctgacctgaccccattcctg

SEQ ID NO: 1623101 - DNA, 14 bp, Homo sapiens
ctgacctgcactgg

SEQ ID NO: 1623102 - DNA, 14 bp, Homo sapiens
ctgacctgcctctc

SEQ ID NO: 1623103 - DNA, 22 bp, Homo sapiens
ctgacctgcctctcacacacat

SEQ ID NO: 1623104 - DNA, 23 bp, Homo sapiens
ctgacctggtgggagcacctgcc

SEQ ID NO: 1623105 - DNA, 15 bp, Homo sapiens
ctgacctgtcatgcc

SEQ ID NO: 1623106 - DNA, 18 bp, Homo sapiens
ctgacctgtcatgccccc

SEQ ID NO: 1623107 - DNA, 16 bp, Homo sapiens
ctgaccttagcgttct

SEQ ID NO: 1623108 - DNA, 17 bp, Homo sapiens
ctgaccttagcgttctg

SEQ ID NO: 1623109 - DNA, 20 bp, Homo sapiens
ctgaccttagcgttctggac

SEQ ID NO: 1623110 - DNA, 21 bp, Homo sapiens
ctgaccttagcgttctggact

SEQ ID NO: 1623111 - DNA, 18 bp, Homo sapiens
ctgacctttgtcatcttt

SEQ ID NO: 1623112 - DNA, 23 bp, Homo sapiens
ctgacctttgtcatctttcttct

SEQ ID NO: 1623113 - DNA, 12 bp, Homo sapiens
ctgacgattctt

SEQ ID NO: 1623114 - DNA, 14 bp, Homo sapiens
ctgacgccctgcgt

SEQ ID NO: 1623115 - DNA, 22 bp, Homo sapiens
ctgacgccctgcgttggagcca

SEQ ID NO: 1623116 - DNA, 14 bp, Homo sapiens
ctgacgcttccctt

SEQ ID NO: 1623117 - DNA, 22 bp, Homo sapiens
tttgctataatcattagtttta

SEQ ID NO: 1623118 - DNA, 16 bp, Homo sapiens
tttgctatctgggctg

SEQ ID NO: 1623119 - DNA, 17 bp, Homo sapiens
tttgctatgactacatt

SEQ ID NO: 1623120 - DNA, 12 bp, Homo sapiens
tttgctatgtaa

SEQ ID NO: 1623121 - DNA, 23 bp, Homo sapiens
tttgctattgacaagtcatttta

SEQ ID NO: 1623122 - DNA, 20 bp, Homo sapiens
tttgctcaaaattgcttcta

SEQ ID NO: 1623123 - DNA, 12 bp, Homo sapiens
tttgctcaacag

SEQ ID NO: 1623124 - DNA, 19 bp, Homo sapiens
tttgctctaaaatatttat

SEQ ID NO: 1623125 - DNA, 23 bp, Homo sapiens
tttgctctattaagattggaaat

SEQ ID NO: 1623126 - DNA, 17 bp, Homo sapiens
tttgctcttgtttttat

SEQ ID NO: 1623127 - DNA, 18 bp, Homo sapiens
tttgctgaattcatctat

SEQ ID NO: 1623128 - DNA, 20 bp, Homo sapiens
tttgctgaattcatctattt

SEQ ID NO: 1623129 - DNA, 23 bp, Homo sapiens
tttgctgacaaccattaaagtca

SEQ ID NO: 1623130 - DNA, 19 bp, Homo sapiens
tttgctgagttgttctaac

SEQ ID NO: 1623131 - DNA, 21 bp, Homo sapiens
tttgctgatttcccctcttcc

SEQ ID NO: 1623132 - DNA, 17 bp, Homo sapiens
tttgctgctatgaaaat

SEQ ID NO: 1623133 - DNA, 13 bp, Homo sapiens
tttgctgtctttc

SEQ ID NO: 1623134 - DNA, 14 bp, Homo sapiens
tttgctgtgaacaa

SEQ ID NO: 1623135 - DNA, 20 bp, Homo sapiens
tttgcttcataaatgaagca

SEQ ID NO: 1623136 - DNA, 21 bp, Homo sapiens
tttgcttgctcatatgcatgt

SEQ ID NO: 1623137 - DNA, 21 bp, Homo sapiens
tttgctttcggtactgtaata

SEQ ID NO: 1623138 - DNA, 20 bp, Homo sapiens
tttgctttttgcgtacacag

SEQ ID NO: 1623139 - DNA, 17 bp, Homo sapiens
tttggaaaaaactctga

SEQ ID NO: 1623140 - DNA, 18 bp, Homo sapiens
tttggaaaaaactctgaa

SEQ ID NO: 1623141 - DNA, 19 bp, Homo sapiens
tttggaaaaaactctgaag

SEQ ID NO: 1623142 - DNA, 14 bp, Homo sapiens
tttggaaagagacc

SEQ ID NO: 1623143 - DNA, 21 bp, Homo sapiens
tttggaaccagactcttgcct

SEQ ID NO: 1623144 - DNA, 14 bp, Homo sapiens
tttggaaccttgtt

SEQ ID NO: 1623145 - DNA, 14 bp, Homo sapiens
tttggaagttttca

SEQ ID NO: 1623146 - DNA, 15 bp, Homo sapiens
tttggaatattttat

SEQ ID NO: 1623147 - DNA, 15 bp, Homo sapiens
tttggaatgaagaaa

SEQ ID NO: 1623148 - DNA, 13 bp, Homo sapiens
tttggaattagaa

SEQ ID NO: 1623149 - DNA, 19 bp, Homo sapiens
tttggagaacgccagtctc

SEQ ID NO: 1623150 - DNA, 19 bp, Homo sapiens
tttggagactctgtggggc

SEQ ID NO: 1623151 - DNA, 19 bp, Homo sapiens
tttggagagaaatatttta

SEQ ID NO: 1623152 - DNA, 19 bp, Homo sapiens
tttggatctatcacctgtc

SEQ ID NO: 1623153 - DNA, 12 bp, Homo sapiens
tttggatgaagg

SEQ ID NO: 1623154 - DNA, 19 bp, Homo sapiens
tttggatgggagtgagaca

SEQ ID NO: 1623155 - DNA, 21 bp, Homo sapiens
tttggatgggagtgagacaga

SEQ ID NO: 1623156 - DNA, 18 bp, Homo sapiens
tttggattattctttctc

SEQ ID NO: 1623157 - DNA, 14 bp, Homo sapiens
tttggcaacatctt

SEQ ID NO: 1623158 - DNA, 19 bp, Homo sapiens
tttggcaatttcctggccc

SEQ ID NO: 1623159 - DNA, 20 bp, Homo sapiens
tttggcaatttcctggccct

SEQ ID NO: 1623160 - DNA, 14 bp, Homo sapiens
tttggcactctgac

SEQ ID NO: 1623161 - DNA, 15 bp, Homo sapiens
tttggcactctgact

SEQ ID NO: 1623162 - DNA, 22 bp, Homo sapiens
tttggcaggggcagaaaactct

SEQ ID NO: 1623163 - DNA, 14 bp, Homo sapiens
tttggcatctcctg

SEQ ID NO: 1623164 - DNA, 14 bp, Homo sapiens
tttggcattgatct

SEQ ID NO: 1623165 - DNA, 19 bp, Homo sapiens
tttggcccaatctctgcca

SEQ ID NO: 1623166 - DNA, 16 bp, Homo sapiens
tttggccccactttga

SEQ ID NO: 1623167 - DNA, 14 bp, Homo sapiens
tttggccctggagc

SEQ ID NO: 1623168 - DNA, 15 bp, Homo sapiens
tttggccctggagcc

SEQ ID NO: 1623169 - DNA, 22 bp, Homo sapiens
tttggcctggggtgcatctcct

SEQ ID NO: 1623170 - DNA, 12 bp, Homo sapiens
tttggcctgttt

SEQ ID NO: 1623171 - DNA, 14 bp, Homo sapiens
tttggccttaagaa

SEQ ID NO: 1623172 - DNA, 16 bp, Homo sapiens
tttggccttaagaact

SEQ ID NO: 1623173 - DNA, 18 bp, Homo sapiens
tttggctcaaataaaatt

SEQ ID NO: 1623174 - DNA, 18 bp, Homo sapiens
tttggctcctctagtaag

SEQ ID NO: 1623175 - DNA, 15 bp, Homo sapiens
tttggctctttcaga

SEQ ID NO: 1623176 - DNA, 18 bp, Homo sapiens
tttggcttctcctgtgac

SEQ ID NO: 1623177 - DNA, 22 bp, Homo sapiens
tttggctttatgtgcaaaatct

SEQ ID NO: 1623178 - DNA, 14 bp, Homo sapiens
tttgggaggccaag

SEQ ID NO: 1623179 - DNA, 23 bp, Homo sapiens
tttgggagtttttatgagaaact

SEQ ID NO: 1623180 - DNA, 23 bp, Homo sapiens
tttgggatattaaaacacaaagt

SEQ ID NO: 1623181 - DNA, 21 bp, Homo sapiens
tttgggcctccatgccccagc

SEQ ID NO: 1623182 - DNA, 22 bp, Homo sapiens
tttggggagggggaagagaaat

SEQ ID NO: 1623183 - DNA, 22 bp, Homo sapiens
tttgggggaaaatttagaaata

SEQ ID NO: 1623184 - DNA, 18 bp, Homo sapiens
tttggggtgcccctctcc

SEQ ID NO: 1623185 - DNA, 16 bp, Homo sapiens
tttgggtactggagct

SEQ ID NO: 1623186 - DNA, 23 bp, Homo sapiens
tttgggtggggggcattgagtat

SEQ ID NO: 1623187 - DNA, 20 bp, Homo sapiens
tttgggtgtttttcatgttt

SEQ ID NO: 1623188 - DNA, 16 bp, Homo sapiens
tttgggttctttctgg

SEQ ID NO: 1623189 - DNA, 18 bp, Homo sapiens
tttgggtttttttccttt

SEQ ID NO: 1623190 - DNA, 14 bp, Homo sapiens
tttggtaaaaatgc

SEQ ID NO: 1623191 - DNA, 20 bp, Homo sapiens
tttggtaaaatacttcttga

SEQ ID NO: 1623192 - DNA, 18 bp, Homo sapiens
tttggtaattttttttgt

SEQ ID NO: 1623193 - DNA, 19 bp, Homo sapiens
tttggtagctgggaaagca

SEQ ID NO: 1623194 - DNA, 22 bp, Homo sapiens
tttggtaggtaaatctagagtt

SEQ ID NO: 1623195 - DNA, 11 bp, Homo sapiens
tttggtcaaat

SEQ ID NO: 1623196 - DNA, 14 bp, Homo sapiens
tttggtccaaaaaa

SEQ ID NO: 1623197 - DNA, 18 bp, Homo sapiens
tttggtcgaggagtaaca

SEQ ID NO: 1623198 - DNA, 16 bp, Homo sapiens
tttggtctgccagaat

SEQ ID NO: 1623199 - DNA, 16 bp, Homo sapiens
tttggtgaacagtttt

SEQ ID NO: 1623200 - DNA, 19 bp, Homo sapiens
tttggtgagagtcaaagct

SEQ ID NO: 1623201 - DNA, 21 bp, Homo sapiens
tttggtgcagaggtttcttga

SEQ ID NO: 1623202 - DNA, 17 bp, Homo sapiens
tttggtgcctatttgaa

SEQ ID NO: 1623203 - DNA, 15 bp, Homo sapiens
tttggtggagataaa

SEQ ID NO: 1623204 - DNA, 20 bp, Homo sapiens
tttggtgggggtagagctga

SEQ ID NO: 1623205 - DNA, 16 bp, Homo sapiens
tttggtgtttgtctgt

SEQ ID NO: 1623206 - DNA, 13 bp, Homo sapiens
tttggttctaata

SEQ ID NO: 1623207 - DNA, 21 bp, Homo sapiens
tttggtttatattttttcagt

SEQ ID NO: 1623208 - DNA, 22 bp, Homo sapiens
tttggtttgacaattttgtctt

SEQ ID NO: 1623209 - DNA, 20 bp, Homo sapiens
tttggtttgctttggtttat

SEQ ID NO: 1623210 - DNA, 16 bp, Homo sapiens
tttggttttacacagg

SEQ ID NO: 1623211 - DNA, 18 bp, Homo sapiens
tttggttttacacaggaa

SEQ ID NO: 1623212 - DNA, 14 bp, Homo sapiens
tttggttttgttcc

SEQ ID NO: 1623213 - DNA, 19 bp, Homo sapiens
tttggttttgttcccctcc

SEQ ID NO: 1623214 - DNA, 23 bp, Homo sapiens
tttgtaaaaatcttttgaagcat

SEQ ID NO: 1623215 - DNA, 12 bp, Homo sapiens
tttgtaaaacaa

SEQ ID NO: 1623216 - DNA, 17 bp, Homo sapiens
tttgtaaaacaatgcca

SEQ ID NO: 1623217 - DNA, 21 bp, Homo sapiens
tttgtaaaagaacagtaaaca

SEQ ID NO: 1623218 - DNA, 22 bp, Homo sapiens
tttgtaaactcaaaatatttgt

SEQ ID NO: 1623219 - DNA, 18 bp, Homo sapiens
tttgtaaagaaaaatatt

SEQ ID NO: 1623220 - DNA, 18 bp, Homo sapiens
tttgtaaagatttctgtt

SEQ ID NO: 1623221 - DNA, 13 bp, Homo sapiens
tttgtaaatgcat

SEQ ID NO: 1623222 - DNA, 12 bp, Homo sapiens
tttgtaaatgta

SEQ ID NO: 1623223 - DNA, 14 bp, Homo sapiens
tttgtaaatgtact

SEQ ID NO: 1623224 - DNA, 20 bp, Homo sapiens
tttgtaaatgtactggtaat

SEQ ID NO: 1623225 - DNA, 17 bp, Homo sapiens
tttgtaaattaatactt

SEQ ID NO: 1623226 - DNA, 15 bp, Homo sapiens
tttgtaaccatatga

SEQ ID NO: 1623227 - DNA, 21 bp, Homo sapiens
tttgtaactacaaagctttgc

SEQ ID NO: 1623228 - DNA, 17 bp, Homo sapiens
tttgtaagacatttgta

SEQ ID NO: 1623229 - DNA, 18 bp, Homo sapiens
tttgtaagacatttgtat

SEQ ID NO: 1623230 - DNA, 13 bp, Homo sapiens
tttgtaagttatt

SEQ ID NO: 1623231 - DNA, 13 bp, Homo sapiens
tttgtaatacttt

SEQ ID NO: 1623232 - DNA, 16 bp, Homo sapiens
tttgtaatattttcca

SEQ ID NO: 1623233 - DNA, 20 bp, Homo sapiens
ctgacggccagggagaagct

SEQ ID NO: 1623234 - DNA, 21 bp, Homo sapiens
ctgacggccagggagaagctc

SEQ ID NO: 1623235 - DNA, 19 bp, Homo sapiens
ctgacggcgcccccagtgt

SEQ ID NO: 1623236 - DNA, 21 bp, Homo sapiens
ctgacgtctgaagcttgactc

SEQ ID NO: 1623237 - DNA, 22 bp, Homo sapiens
ctgacgtgccttttgcacccct

SEQ ID NO: 1623238 - DNA, 14 bp, Homo sapiens
ctgactactgccca

SEQ ID NO: 1623239 - DNA, 22 bp, Homo sapiens
ctgactagaagggccagtcctg

SEQ ID NO: 1623240 - DNA, 20 bp, Homo sapiens
ctgactagtttaaagatgga

SEQ ID NO: 1623241 - DNA, 19 bp, Homo sapiens
ctgactattcttgatgtaa

SEQ ID NO: 1623242 - DNA, 14 bp, Homo sapiens
ctgactcctgggtg

SEQ ID NO: 1623243 - DNA, 15 bp, Homo sapiens
ctgactcctgggtgg

SEQ ID NO: 1623244 - DNA, 18 bp, Homo sapiens
ctgactcggtttctccaa

SEQ ID NO: 1623245 - DNA, 13 bp, Homo sapiens
ctgactctctgtg

SEQ ID NO: 1623246 - DNA, 16 bp, Homo sapiens
ctgactctctgtgacc

SEQ ID NO: 1623247 - DNA, 17 bp, Homo sapiens
ctgactctgaaatctga

SEQ ID NO: 1623248 - DNA, 14 bp, Homo sapiens
ctgactgaggcctg

SEQ ID NO: 1623249 - DNA, 15 bp, Homo sapiens
ctgactgaggcctgc

SEQ ID NO: 1623250 - DNA, 21 bp, Homo sapiens
ctgactgcaccagcgccccca

SEQ ID NO: 1623251 - DNA, 23 bp, Homo sapiens
ctgactgcaccagcgcccccaga

SEQ ID NO: 1623252 - DNA, 14 bp, Homo sapiens
ctgactgcagcccc

SEQ ID NO: 1623253 - DNA, 20 bp, Homo sapiens
ctgactgccaagccagattc

SEQ ID NO: 1623254 - DNA, 21 bp, Homo sapiens
ctgactgcccgctcctcggga

SEQ ID NO: 1623255 - DNA, 16 bp, Homo sapiens
ctgactggccaaaccc

SEQ ID NO: 1623256 - DNA, 14 bp, Homo sapiens
ctgactgtccagga

SEQ ID NO: 1623257 - DNA, 16 bp, Homo sapiens
ctgactgtggccccct

SEQ ID NO: 1623258 - DNA, 23 bp, Homo sapiens
ctgactgtgttgggcaagacctc

SEQ ID NO: 1623259 - DNA, 22 bp, Homo sapiens
ctgactgttcttggtaactgat

SEQ ID NO: 1623260 - DNA, 12 bp, Homo sapiens
ctgactgtttat

SEQ ID NO: 1623261 - DNA, 17 bp, Homo sapiens
ctgactgtttatttaag

SEQ ID NO: 1623262 - DNA, 21 bp, Homo sapiens
ctgactgtttatttaaggatg

SEQ ID NO: 1623263 - DNA, 24 bp, Homo sapiens
ctgactgtttatttaaggatggat

SEQ ID NO: 1623264 - DNA, 22 bp, Homo sapiens
ctgacttcagtgaatatttttg

SEQ ID NO: 1623265 - DNA, 15 bp, Homo sapiens
ctgacttccctggag

SEQ ID NO: 1623266 - DNA, 16 bp, Homo sapiens
ctgacttctaagtaaa

SEQ ID NO: 1623267 - DNA, 13 bp, Homo sapiens
ctgacttgagtgt

SEQ ID NO: 1623268 - DNA, 14 bp, Homo sapiens
ctgacttgagtgtt

SEQ ID NO: 1623269 - DNA, 21 bp, Homo sapiens
ctgacttgagtgttccttttt

SEQ ID NO: 1623270 - DNA, 16 bp, Homo sapiens
ctgacttgctgtgtga

SEQ ID NO: 1623271 - DNA, 12 bp, Homo sapiens
ctgactttactt

SEQ ID NO: 1623272 - DNA, 15 bp, Homo sapiens
ctgactttacttgtg

SEQ ID NO: 1623273 - DNA, 14 bp, Homo sapiens
ctgactttgcttgc

SEQ ID NO: 1623274 - DNA, 15 bp, Homo sapiens
ctgactttgcttgct

SEQ ID NO: 1623275 - DNA, 16 bp, Homo sapiens
ctgactttgcttgctt

SEQ ID NO: 1623276 - DNA, 14 bp, Homo sapiens
ctgactttggtttt

SEQ ID NO: 1623277 - DNA, 18 bp, Homo sapiens
ctgactttggtttttcca

SEQ ID NO: 1623278 - DNA, 17 bp, Homo sapiens
ctgacttttccaaataa

SEQ ID NO: 1623279 - DNA, 23 bp, Homo sapiens
ctgacttttccaaataaacattt

SEQ ID NO: 1623280 - DNA, 16 bp, Homo sapiens
ctgactttttcccccc

SEQ ID NO: 1623281 - DNA, 17 bp, Homo sapiens
ctgactttttcccccca

SEQ ID NO: 1623282 - DNA, 12 bp, Homo sapiens
ctgagaaaaaaa

SEQ ID NO: 1623283 - DNA, 22 bp, Homo sapiens
ctgagaaaatgtaaggattctg

SEQ ID NO: 1623284 - DNA, 18 bp, Homo sapiens
ctgagaaacccaccagcc

SEQ ID NO: 1623285 - DNA, 19 bp, Homo sapiens
ctgagaaacccaccagcct

SEQ ID NO: 1623286 - DNA, 20 bp, Homo sapiens
ctgagaaagactattcaaac

SEQ ID NO: 1623287 - DNA, 22 bp, Homo sapiens
ctgagaaagactattcaaacag

SEQ ID NO: 1623288 - DNA, 16 bp, Homo sapiens
ctgagaaagctcaaag

SEQ ID NO: 1623289 - DNA, 18 bp, Homo sapiens
ctgagaacacgttgccag

SEQ ID NO: 1623290 - DNA, 22 bp, Homo sapiens
ctgagaactgaattttgggact

SEQ ID NO: 1623291 - DNA, 21 bp, Homo sapiens
ctgagaaggaacagggaacat

SEQ ID NO: 1623292 - DNA, 17 bp, Homo sapiens
ctgagaaggcgaggaga

SEQ ID NO: 1623293 - DNA, 17 bp, Homo sapiens
ctgagaatgtaagaact

SEQ ID NO: 1623294 - DNA, 21 bp, Homo sapiens
ctgagaattgttgagatactt

SEQ ID NO: 1623295 - DNA, 14 bp, Homo sapiens
tttgtctatgaagt

SEQ ID NO: 1623296 - DNA, 15 bp, Homo sapiens
tttgtctatgaagtt

SEQ ID NO: 1623297 - DNA, 21 bp, Homo sapiens
tttgtctatgaagttgctgtt

SEQ ID NO: 1623298 - DNA, 19 bp, Homo sapiens
tttgtctcttagaaatact

SEQ ID NO: 1623299 - DNA, 12 bp, Homo sapiens
tttgtctgaaca

SEQ ID NO: 1623300 - DNA, 18 bp, Homo sapiens
tttgtctgtttgtttcaa

SEQ ID NO: 1623301 - DNA, 14 bp, Homo sapiens
tttgtcttaagtgt

SEQ ID NO: 1623302 - DNA, 12 bp, Homo sapiens
tttgtcttgtac

SEQ ID NO: 1623303 - DNA, 14 bp, Homo sapiens
tttgtctttaaaca

SEQ ID NO: 1623304 - DNA, 17 bp, Homo sapiens
tttgtcttttaatgctt

SEQ ID NO: 1623305 - DNA, 14 bp, Homo sapiens
tttgtgaaagacat

SEQ ID NO: 1623306 - DNA, 16 bp, Homo sapiens
tttgtgaatctttgtg

SEQ ID NO: 1623307 - DNA, 15 bp, Homo sapiens
tttgtgaattaggct

SEQ ID NO: 1623308 - DNA, 12 bp, Homo sapiens
tttgtgatgaat

SEQ ID NO: 1623309 - DNA, 21 bp, Homo sapiens
tttgtgcaaaagcttcaaatt

SEQ ID NO: 1623310 - DNA, 13 bp, Homo sapiens
tttgtgcattctg

SEQ ID NO: 1623311 - DNA, 12 bp, Homo sapiens
tttgtgcctttg

SEQ ID NO: 1623312 - DNA, 21 bp, Homo sapiens
tttgtgctagaaattttcaag

SEQ ID NO: 1623313 - DNA, 17 bp, Homo sapiens
tttgtggagtttgtatt

SEQ ID NO: 1623314 - DNA, 12 bp, Homo sapiens
tttgtggctggg

SEQ ID NO: 1623315 - DNA, 12 bp, Homo sapiens
tttgtgggactg

SEQ ID NO: 1623316 - DNA, 11 bp, Homo sapiens
tttgtggggag

SEQ ID NO: 1623317 - DNA, 19 bp, Homo sapiens
tttgtggtaatctacacca

SEQ ID NO: 1623318 - DNA, 14 bp, Homo sapiens
tttgtgtacagtgt

SEQ ID NO: 1623319 - DNA, 12 bp, Homo sapiens
tttgtgtagtat

SEQ ID NO: 1623320 - DNA, 15 bp, Homo sapiens
tttgtgtattctgtg

SEQ ID NO: 1623321 - DNA, 11 bp, Homo sapiens
tttgtgtcctc

SEQ ID NO: 1623322 - DNA, 16 bp, Homo sapiens
tttgtgtcctccagga

SEQ ID NO: 1623323 - DNA, 19 bp, Homo sapiens
tttgtgtcctccaggagct

SEQ ID NO: 1623324 - DNA, 18 bp, Homo sapiens
tttgtgtctggtgcagaa

SEQ ID NO: 1623325 - DNA, 14 bp, Homo sapiens
tttgtgtgattgaa

SEQ ID NO: 1623326 - DNA, 13 bp, Homo sapiens
tttgtgtgtctta

SEQ ID NO: 1623327 - DNA, 15 bp, Homo sapiens
tttgtgtgttgtctt

SEQ ID NO: 1623328 - DNA, 19 bp, Homo sapiens
tttgtgtgttgtcttgaaa

SEQ ID NO: 1623329 - DNA, 12 bp, Homo sapiens
tttgtgttctgt

SEQ ID NO: 1623330 - DNA, 14 bp, Homo sapiens
tttgtgttcttctt

SEQ ID NO: 1623331 - DNA, 15 bp, Homo sapiens
tttgtgtttattctt

SEQ ID NO: 1623332 - DNA, 16 bp, Homo sapiens
tttgtgtttattcttg

SEQ ID NO: 1623333 - DNA, 22 bp, Homo sapiens
tttgtgtttattcttgatgaaa

SEQ ID NO: 1623334 - DNA, 15 bp, Homo sapiens
tttgtgtttccattt

SEQ ID NO: 1623335 - DNA, 12 bp, Homo sapiens
tttgtgtttcta

SEQ ID NO: 1623336 - DNA, 18 bp, Homo sapiens
tttgtgtttgattggctt

SEQ ID NO: 1623337 - DNA, 19 bp, Homo sapiens
tttgtgttttcttgtaaat

SEQ ID NO: 1623338 - DNA, 21 bp, Homo sapiens
tttgttaaaactggcatctga

SEQ ID NO: 1623339 - DNA, 23 bp, Homo sapiens
tttgttactgattcaattataat

SEQ ID NO: 1623340 - DNA, 15 bp, Homo sapiens
tttgttacttcctta

SEQ ID NO: 1623341 - DNA, 17 bp, Homo sapiens
tttgttatagaatactt

SEQ ID NO: 1623342 - DNA, 16 bp, Homo sapiens
tttgttattgttttgt

SEQ ID NO: 1623343 - DNA, 20 bp, Homo sapiens
tttgttatttacactggtct

SEQ ID NO: 1623344 - DNA, 18 bp, Homo sapiens
tttgttcaatgttccatt

SEQ ID NO: 1623345 - DNA, 18 bp, Homo sapiens
tttgttcataataaaagt

SEQ ID NO: 1623346 - DNA, 21 bp, Homo sapiens
tttgttccacttgtttgcact

SEQ ID NO: 1623347 - DNA, 19 bp, Homo sapiens
tttgttcccctcctccact

SEQ ID NO: 1623348 - DNA, 21 bp, Homo sapiens
tttgttctctgaattttcaga

SEQ ID NO: 1623349 - DNA, 21 bp, Homo sapiens
tttgttctctgggagaaaatc

SEQ ID NO: 1623350 - DNA, 12 bp, Homo sapiens
tttgttctgttt

SEQ ID NO: 1623351 - DNA, 15 bp, Homo sapiens
tttgttgaaattatg

SEQ ID NO: 1623352 - DNA, 15 bp, Homo sapiens
ctgagcatcctggtt

SEQ ID NO: 1623353 - DNA, 20 bp, Homo sapiens
ctgagcatgatgggaatagg

SEQ ID NO: 1623354 - DNA, 20 bp, Homo sapiens
ctgagcatggggcgctccca

SEQ ID NO: 1623355 - DNA, 22 bp, Homo sapiens
ctgagcattcgctgtacccttt

SEQ ID NO: 1623356 - DNA, 18 bp, Homo sapiens
ctgagccagggaacagcc

SEQ ID NO: 1623357 - DNA, 22 bp, Homo sapiens
ctgagccagtgctttaatggca

SEQ ID NO: 1623358 - DNA, 14 bp, Homo sapiens
ctgagccatgagga

SEQ ID NO: 1623359 - DNA, 15 bp, Homo sapiens
ctgagcccaggagct

SEQ ID NO: 1623360 - DNA, 13 bp, Homo sapiens
ctgagcccaggcc

SEQ ID NO: 1623361 - DNA, 16 bp, Homo sapiens
ctgagcccaggccgtt

SEQ ID NO: 1623362 - DNA, 11 bp, Homo sapiens
ctgagcccata

SEQ ID NO: 1623363 - DNA, 13 bp, Homo sapiens
ctgagccccccat

SEQ ID NO: 1623364 - DNA, 22 bp, Homo sapiens
ctgagcccccccaacactgtgc

SEQ ID NO: 1623365 - DNA, 17 bp, Homo sapiens
ctgagcccccggctagt

SEQ ID NO: 1623366 - DNA, 16 bp, Homo sapiens
ctgagcctagctacct

SEQ ID NO: 1623367 - DNA, 22 bp, Homo sapiens
ctgagcctcaaccttctggggg

SEQ ID NO: 1623368 - DNA, 12 bp, Homo sapiens
ctgagcctctgc

SEQ ID NO: 1623369 - DNA, 19 bp, Homo sapiens
ctgagcctgaggccttcca

SEQ ID NO: 1623370 - DNA, 16 bp, Homo sapiens
ctgagcctggctggca

SEQ ID NO: 1623371 - DNA, 13 bp, Homo sapiens
ctgagcctgttca

SEQ ID NO: 1623372 - DNA, 17 bp, Homo sapiens
ctgagccttcagtcttg

SEQ ID NO: 1623373 - DNA, 15 bp, Homo sapiens
ctgagccttgtaatt

SEQ ID NO: 1623374 - DNA, 15 bp, Homo sapiens
ctgagcgcctccatc

SEQ ID NO: 1623375 - DNA, 22 bp, Homo sapiens
ctgagcgcctccatccaaggcc

SEQ ID NO: 1623376 - DNA, 21 bp, Homo sapiens
ctgagcggcgcagagccctcc

SEQ ID NO: 1623377 - DNA, 13 bp, Homo sapiens
ctgagctatttca

SEQ ID NO: 1623378 - DNA, 23 bp, Homo sapiens
ctgagctcaaatctctgttactc

SEQ ID NO: 1623379 - DNA, 17 bp, Homo sapiens
ctgagctcccacctccc

SEQ ID NO: 1623380 - DNA, 13 bp, Homo sapiens
ctgagctcctgct

SEQ ID NO: 1623381 - DNA, 21 bp, Homo sapiens
ctgagctcggggggctctgcc

SEQ ID NO: 1623382 - DNA, 12 bp, Homo sapiens
ctgagctctcca

SEQ ID NO: 1623383 - DNA, 17 bp, Homo sapiens
ctgagctctccaggcca

SEQ ID NO: 1623384 - DNA, 12 bp, Homo sapiens
ctgagctgggga

SEQ ID NO: 1623385 - DNA, 12 bp, Homo sapiens
ctgagctgtaat

SEQ ID NO: 1623386 - DNA, 20 bp, Homo sapiens
ctgagctgtcgctgcctcca

SEQ ID NO: 1623387 - DNA, 22 bp, Homo sapiens
ctgagctgtgttttgtctgagc

SEQ ID NO: 1623388 - DNA, 18 bp, Homo sapiens
ctgagcttagccttgtgc

SEQ ID NO: 1623389 - DNA, 20 bp, Homo sapiens
ctgagcttagccttgtgccc

SEQ ID NO: 1623390 - DNA, 23 bp, Homo sapiens
ctgagcttagccttgtgccctgc

SEQ ID NO: 1623391 - DNA, 15 bp, Homo sapiens
ctgagcttctctgtg

SEQ ID NO: 1623392 - DNA, 15 bp, Homo sapiens
ctgagcttgagctcc

SEQ ID NO: 1623393 - DNA, 16 bp, Homo sapiens
ctgagcttgagctccc

SEQ ID NO: 1623394 - DNA, 23 bp, Homo sapiens
ctgagcttgagctcccctggagc

SEQ ID NO: 1623395 - DNA, 16 bp, Homo sapiens
ctgagctttggggaca

SEQ ID NO: 1623396 - DNA, 21 bp, Homo sapiens
ctgagctttggggacagttgg

SEQ ID NO: 1623397 - DNA, 18 bp, Homo sapiens
ctgagcttttcatggaag

SEQ ID NO: 1623398 - DNA, 22 bp, Homo sapiens
ctgagcttttgatgccaggtgc

SEQ ID NO: 1623399 - DNA, 23 bp, Homo sapiens
ctgagcttttgatgccaggtgca

SEQ ID NO: 1623400 - DNA, 23 bp, Homo sapiens
ctgaggaagaacggggctcttct

SEQ ID NO: 1623401 - DNA, 20 bp, Homo sapiens
ctgaggaagcacagcagcat

SEQ ID NO: 1623402 - DNA, 20 bp, Homo sapiens
ctgaggaatcaacagggcag

SEQ ID NO: 1623403 - DNA, 11 bp, Homo sapiens
ctgaggacaga

SEQ ID NO: 1623404 - DNA, 16 bp, Homo sapiens
ctgaggacagaggccg

SEQ ID NO: 1623405 - DNA, 22 bp, Homo sapiens
ctgaggacctctcagcatagcc

SEQ ID NO: 1623406 - DNA, 23 bp, Homo sapiens
ctgaggacctctcagcatagcct

SEQ ID NO: 1623407 - DNA, 22 bp, Homo sapiens
ctgaggagaagctgatccagtt

SEQ ID NO: 1623408 - DNA, 20 bp, Homo sapiens
ctgaggagatgaccagggat

SEQ ID NO: 1623409 - DNA, 21 bp, Homo sapiens
ctgaggagatgaccagggatg

SEQ ID NO: 1623410 - DNA, 17 bp, Homo sapiens
ttttaaataaaagcagc

SEQ ID NO: 1623411 - DNA, 17 bp, Homo sapiens
ttttaaataaaagtgat

SEQ ID NO: 1623412 - DNA, 13 bp, Homo sapiens
ttttaaatcaagg

SEQ ID NO: 1623413 - DNA, 18 bp, Homo sapiens
ttttaaatctaaatctat

SEQ ID NO: 1623414 - DNA, 12 bp, Homo sapiens
ttttaaatctgc

SEQ ID NO: 1623415 - DNA, 19 bp, Homo sapiens
ttttaaatgcataaatgca

SEQ ID NO: 1623416 - DNA, 22 bp, Homo sapiens
ttttaaatgtgtgagtgcatgt

SEQ ID NO: 1623417 - DNA, 13 bp, Homo sapiens
ttttaacacttaa

SEQ ID NO: 1623418 - DNA, 19 bp, Homo sapiens
ttttaacacttaaatttct

SEQ ID NO: 1623419 - DNA, 14 bp, Homo sapiens
ttttaacactttgt

SEQ ID NO: 1623420 - DNA, 18 bp, Homo sapiens
ttttaacactttgtatta

SEQ ID NO: 1623421 - DNA, 22 bp, Homo sapiens
ttttaaccggtaagagtttcag

SEQ ID NO: 1623422 - DNA, 15 bp, Homo sapiens
ttttaactacataaa

SEQ ID NO: 1623423 - DNA, 16 bp, Homo sapiens
ttttaactagaattta

SEQ ID NO: 1623424 - DNA, 16 bp, Homo sapiens
ttttaactttaataca

SEQ ID NO: 1623425 - DNA, 14 bp, Homo sapiens
ttttaagaaaacat

SEQ ID NO: 1623426 - DNA, 12 bp, Homo sapiens
ttttaagaaaca

SEQ ID NO: 1623427 - DNA, 11 bp, Homo sapiens
ttttaagaaat

SEQ ID NO: 1623428 - DNA, 19 bp, Homo sapiens
ttttaagaaatctggccca

SEQ ID NO: 1623429 - DNA, 13 bp, Homo sapiens
ttttaagaatatc

SEQ ID NO: 1623430 - DNA, 16 bp, Homo sapiens
ttttaagaatatctgt

SEQ ID NO: 1623431 - DNA, 21 bp, Homo sapiens
ttttaagataataatatatgt

SEQ ID NO: 1623432 - DNA, 14 bp, Homo sapiens
ttttaagatagtgt

SEQ ID NO: 1623433 - DNA, 15 bp, Homo sapiens
ttttaagcaaaatat

SEQ ID NO: 1623434 - DNA, 12 bp, Homo sapiens
ttttaagctgtt

SEQ ID NO: 1623435 - DNA, 23 bp, Homo sapiens
ttttaaggataaatcataaagtc

SEQ ID NO: 1623436 - DNA, 21 bp, Homo sapiens
ttttaaggtctttcagtactt

SEQ ID NO: 1623437 - DNA, 23 bp, Homo sapiens
ttttaaggtctttcagtactttt

SEQ ID NO: 1623438 - DNA, 17 bp, Homo sapiens
ttttaaggtttgcaaat

SEQ ID NO: 1623439 - DNA, 16 bp, Homo sapiens
ttttaagtaagacttt

SEQ ID NO: 1623440 - DNA, 18 bp, Homo sapiens
ttttaagtatttatatat

SEQ ID NO: 1623441 - DNA, 19 bp, Homo sapiens
ttttaagtatttatatatt

SEQ ID NO: 1623442 - DNA, 23 bp, Homo sapiens
ttttaagtgccttggatgagaag

SEQ ID NO: 1623443 - DNA, 14 bp, Homo sapiens
ttttaagttgctga

SEQ ID NO: 1623444 - DNA, 20 bp, Homo sapiens
ttttaagtttctctgcagaa

SEQ ID NO: 1623445 - DNA, 13 bp, Homo sapiens
ttttaagtttgca

SEQ ID NO: 1623446 - DNA, 23 bp, Homo sapiens
ttttaataaaaatacacatgaaa

SEQ ID NO: 1623447 - DNA, 13 bp, Homo sapiens
ttttaataagaac

SEQ ID NO: 1623448 - DNA, 18 bp, Homo sapiens
ttttaataagaacagatc

SEQ ID NO: 1623449 - DNA, 20 bp, Homo sapiens
ttttaataagtaattccttc

SEQ ID NO: 1623450 - DNA, 12 bp, Homo sapiens
ttttaatagcac

SEQ ID NO: 1623451 - DNA, 16 bp, Homo sapiens
ttttaatagcctgtca

SEQ ID NO: 1623452 - DNA, 21 bp, Homo sapiens
ttttaatagtcattccaaata

SEQ ID NO: 1623453 - DNA, 22 bp, Homo sapiens
ttttaatatgcttaaaataagc

SEQ ID NO: 1623454 - DNA, 19 bp, Homo sapiens
ttttaatattactgtcttt

SEQ ID NO: 1623455 - DNA, 16 bp, Homo sapiens
ttttaatgcagttgct

SEQ ID NO: 1623456 - DNA, 13 bp, Homo sapiens
ttttaatggaaag

SEQ ID NO: 1623457 - DNA, 23 bp, Homo sapiens
ttttaatggaaagttgtatccat

SEQ ID NO: 1623458 - DNA, 19 bp, Homo sapiens
ttttaatgtatctatttgt

SEQ ID NO: 1623459 - DNA, 13 bp, Homo sapiens
ttttaatgtgaag

SEQ ID NO: 1623460 - DNA, 22 bp, Homo sapiens
ttttaattaatgaaatatctgt

SEQ ID NO: 1623461 - DNA, 21 bp, Homo sapiens
ttttaattactgctataaata

SEQ ID NO: 1623462 - DNA, 17 bp, Homo sapiens
ttttaattattattctt

SEQ ID NO: 1623463 - DNA, 18 bp, Homo sapiens
ttttaattgaaattaact

SEQ ID NO: 1623464 - DNA, 19 bp, Homo sapiens
ttttaattgaaattaactt

SEQ ID NO: 1623465 - DNA, 23 bp, Homo sapiens
ttttaatttatgagtttttgata

SEQ ID NO: 1623466 - DNA, 21 bp, Homo sapiens
ttttaatttatttatactatt

SEQ ID NO: 1623467 - DNA, 11 bp, Homo sapiens
ttttaatttca

SEQ ID NO: 1623468 - DNA, 15 bp, Homo sapiens
ttttaatttcaggaa

SEQ ID NO: 1623469 - DNA, 20 bp, Homo sapiens
ttttaatttgatgaaagctg

SEQ ID NO: 1623470 - DNA, 17 bp, Homo sapiens
ttctgcctctctaggac

SEQ ID NO: 1623471 - DNA, 15 bp, Homo sapiens
ttctgcctgagattc

SEQ ID NO: 1623472 - DNA, 19 bp, Homo sapiens
ttctgcctgccagctgcac

SEQ ID NO: 1623473 - DNA, 14 bp, Homo sapiens
ttctgcctggagac

SEQ ID NO: 1623474 - DNA, 14 bp, Homo sapiens
ttctgcctgttata

SEQ ID NO: 1623475 - DNA, 23 bp, Homo sapiens
ttctgcctttgatgttacagatt

SEQ ID NO: 1623476 - DNA, 22 bp, Homo sapiens
ttctgcctttggggacttttct

SEQ ID NO: 1623477 - DNA, 16 bp, Homo sapiens
ttctgccttttcactg

SEQ ID NO: 1623478 - DNA, 15 bp, Homo sapiens
ttctgcgctgtgtac

SEQ ID NO: 1623479 - DNA, 17 bp, Homo sapiens
ttctgctacttcactgt

SEQ ID NO: 1623480 - DNA, 16 bp, Homo sapiens
ttctgctccacccttg

SEQ ID NO: 1623481 - DNA, 13 bp, Homo sapiens
ttctgctcctgct

SEQ ID NO: 1623482 - DNA, 17 bp, Homo sapiens
ttctgctcctgcttttc

SEQ ID NO: 1623483 - DNA, 13 bp, Homo sapiens
ttctgctctgcca

SEQ ID NO: 1623484 - DNA, 14 bp, Homo sapiens
ttctgctctggaat

SEQ ID NO: 1623485 - DNA, 17 bp, Homo sapiens
ttctgctctggaataaa

SEQ ID NO: 1623486 - DNA, 18 bp, Homo sapiens
ttctgctcttccaaagct

SEQ ID NO: 1623487 - DNA, 15 bp, Homo sapiens
ttctgctcttttcct

SEQ ID NO: 1623488 - DNA, 14 bp, Homo sapiens
ttctgctgaccaaa

SEQ ID NO: 1623489 - DNA, 17 bp, Homo sapiens
ttctgctgcccctgcag

SEQ ID NO: 1623490 - DNA, 13 bp, Homo sapiens
ttctgctgccctc

SEQ ID NO: 1623491 - DNA, 14 bp, Homo sapiens
ttctgctgccctct

SEQ ID NO: 1623492 - DNA, 16 bp, Homo sapiens
ttctgcttcaataaat

SEQ ID NO: 1623493 - DNA, 19 bp, Homo sapiens
ttctgcttcaataaatctt

SEQ ID NO: 1623494 - DNA, 15 bp, Homo sapiens
ttctgcttgtcatcc

SEQ ID NO: 1623495 - DNA, 18 bp, Homo sapiens
ttctgcttgtgacattaa

SEQ ID NO: 1623496 - DNA, 15 bp, Homo sapiens
ttctgctttcatctt

SEQ ID NO: 1623497 - DNA, 21 bp, Homo sapiens
ttctgcttttaccatgcccct

SEQ ID NO: 1623498 - DNA, 23 bp, Homo sapiens
ttctggaactgtctgaatattct

SEQ ID NO: 1623499 - DNA, 15 bp, Homo sapiens
ttctggaatgtaatc

SEQ ID NO: 1623500 - DNA, 14 bp, Homo sapiens
ttctggaatttgtt

SEQ ID NO: 1623501 - DNA, 17 bp, Homo sapiens
ttctggaatttgttcaa

SEQ ID NO: 1623502 - DNA, 22 bp, Homo sapiens
ttctggaatttgttcaagtttt

SEQ ID NO: 1623503 - DNA, 13 bp, Homo sapiens
ttctggacattct

SEQ ID NO: 1623504 - DNA, 19 bp, Homo sapiens
ttctggacccttataaaat

SEQ ID NO: 1623505 - DNA, 22 bp, Homo sapiens
ttctggactcccactctttgaa

SEQ ID NO: 1623506 - DNA, 18 bp, Homo sapiens
ttctggagtgattctaga

SEQ ID NO: 1623507 - DNA, 20 bp, Homo sapiens
ttctggagtgattctagagg

SEQ ID NO: 1623508 - DNA, 23 bp, Homo sapiens
ttctggatccatggggggagaag

SEQ ID NO: 1623509 - DNA, 19 bp, Homo sapiens
ttctggattagaatgccgg

SEQ ID NO: 1623510 - DNA, 23 bp, Homo sapiens
ttctggatttttttttctttata

SEQ ID NO: 1623511 - DNA, 20 bp, Homo sapiens
ttctggcataactaaaatta

SEQ ID NO: 1623512 - DNA, 18 bp, Homo sapiens
ttctggccagtgtttaaa

SEQ ID NO: 1623513 - DNA, 15 bp, Homo sapiens
ttctggcccagccaa

SEQ ID NO: 1623514 - DNA, 14 bp, Homo sapiens
ttctggccggtgct

SEQ ID NO: 1623515 - DNA, 18 bp, Homo sapiens
ctccagaatctgctgttg

SEQ ID NO: 1623516 - DNA, 15 bp, Homo sapiens
ctccagacccctggc

SEQ ID NO: 1623517 - DNA, 18 bp, Homo sapiens
ctccagaccctgcctgag

SEQ ID NO: 1623518 - DNA, 14 bp, Homo sapiens
ctccagacctgatc

SEQ ID NO: 1623519 - DNA, 14 bp, Homo sapiens
ctccagagccagcc

SEQ ID NO: 1623520 - DNA, 15 bp, Homo sapiens
ctccagagccagcct

SEQ ID NO: 1623521 - DNA, 18 bp, Homo sapiens
ctccagagccagcctggg

SEQ ID NO: 1623522 - DNA, 19 bp, Homo sapiens
ctccagagccagcctggga

SEQ ID NO: 1623523 - DNA, 23 bp, Homo sapiens
ctccagagggacagggtggaccc

SEQ ID NO: 1623524 - DNA, 20 bp, Homo sapiens
ctccagaggggctcaggtca

SEQ ID NO: 1623525 - DNA, 16 bp, Homo sapiens
ctccagagtctgagcc

SEQ ID NO: 1623526 - DNA, 18 bp, Homo sapiens
ctccagagtctgagcccc

SEQ ID NO: 1623527 - DNA, 23 bp, Homo sapiens
ctccagagtctgagcccccggct

SEQ ID NO: 1623528 - DNA, 17 bp, Homo sapiens
ctccagataactctctt

SEQ ID NO: 1623529 - DNA, 18 bp, Homo sapiens
ctccagataactctcttt

SEQ ID NO: 1623530 - DNA, 22 bp, Homo sapiens
ctccagataactctctttcctt

SEQ ID NO: 1623531 - DNA, 13 bp, Homo sapiens
ctccagatagaga

SEQ ID NO: 1623532 - DNA, 21 bp, Homo sapiens
ctccagatagagaaatagtga

SEQ ID NO: 1623533 - DNA, 13 bp, Homo sapiens
ctccagattctga

SEQ ID NO: 1623534 - DNA, 15 bp, Homo sapiens
ctccagattctgatg

SEQ ID NO: 1623535 - DNA, 16 bp, Homo sapiens
ctccagattctgatgc

SEQ ID NO: 1623536 - DNA, 19 bp, Homo sapiens
ctccagattctgatgcata

SEQ ID NO: 1623537 - DNA, 16 bp, Homo sapiens
ctccagcaacacagcc

SEQ ID NO: 1623538 - DNA, 20 bp, Homo sapiens
ctccagcaacacagcctggg

SEQ ID NO: 1623539 - DNA, 18 bp, Homo sapiens
ctccagcaactgcccttc

SEQ ID NO: 1623540 - DNA, 20 bp, Homo sapiens
ctccagcaactgcccttcca

SEQ ID NO: 1623541 - DNA, 16 bp, Homo sapiens
ctccagcagcacacct

SEQ ID NO: 1623542 - DNA, 13 bp, Homo sapiens
ctccagcatccag

SEQ ID NO: 1623543 - DNA, 15 bp, Homo sapiens
ctccagcatccagcc

SEQ ID NO: 1623544 - DNA, 19 bp, Homo sapiens
ctccagcatccagcctgtg

SEQ ID NO: 1623545 - DNA, 21 bp, Homo sapiens
ctccagcatccagcctgtgtg

SEQ ID NO: 1623546 - DNA, 11 bp, Homo sapiens
ctccagccagc

SEQ ID NO: 1623547 - DNA, 24 bp, Homo sapiens
ctccagccagcaatgatgtccaga

SEQ ID NO: 1623548 - DNA, 13 bp, Homo sapiens
ctccagcccacgt

SEQ ID NO: 1623549 - DNA, 14 bp, Homo sapiens
ctccagccccatgt

SEQ ID NO: 1623550 - DNA, 16 bp, Homo sapiens
ctccagcccctcttgg

SEQ ID NO: 1623551 - DNA, 18 bp, Homo sapiens
ctccagcccctcttggag

SEQ ID NO: 1623552 - DNA, 21 bp, Homo sapiens
ctccagcccctcttggagaag

SEQ ID NO: 1623553 - DNA, 22 bp, Homo sapiens
ctccagcccctcttggagaagt

SEQ ID NO: 1623554 - DNA, 11 bp, Homo sapiens
ctccagccctg

SEQ ID NO: 1623555 - DNA, 12 bp, Homo sapiens
ctccagccctgt

SEQ ID NO: 1623556 - DNA, 14 bp, Homo sapiens
ctccagccctgtcc

SEQ ID NO: 1623557 - DNA, 16 bp, Homo sapiens
ctccagccgctggcaa

SEQ ID NO: 1623558 - DNA, 14 bp, Homo sapiens
ctccagcctccctg

SEQ ID NO: 1623559 - DNA, 15 bp, Homo sapiens
ctccagcctccctgt

SEQ ID NO: 1623560 - DNA, 16 bp, Homo sapiens
ctccagcctccctgtc

SEQ ID NO: 1623561 - DNA, 21 bp, Homo sapiens
ctccagcctccctgtctccag

SEQ ID NO: 1623562 - DNA, 22 bp, Homo sapiens
ctccagcctccctgtctccagc

SEQ ID NO: 1623563 - DNA, 16 bp, Homo sapiens
ctccagcctctcccgg

SEQ ID NO: 1623564 - DNA, 21 bp, Homo sapiens
ctccagcctctcccggctgcc

SEQ ID NO: 1623565 - DNA, 14 bp, Homo sapiens
ctccagcctgagca

SEQ ID NO: 1623566 - DNA, 17 bp, Homo sapiens
ctccagcctgagtgaca

SEQ ID NO: 1623567 - DNA, 19 bp, Homo sapiens
ctccagcctgagtgacaga

SEQ ID NO: 1623568 - DNA, 12 bp, Homo sapiens
ctccagcctggg

SEQ ID NO: 1623569 - DNA, 14 bp, Homo sapiens
ctccagcctgggca

SEQ ID NO: 1623570 - DNA, 21 bp, Homo sapiens
ctccagcctggggaccccact

SEQ ID NO: 1623571 - DNA, 21 bp, Homo sapiens
ctccagcgatggtgctgccca

SEQ ID NO: 1623572 - DNA, 13 bp, Homo sapiens
ctccagcggccct

SEQ ID NO: 1623573 - DNA, 18 bp, Homo sapiens
ctccagcgtcagctgctc

SEQ ID NO: 1623574 - DNA, 23 bp, Homo sapiens
ctccagcgtcagctgctccctgg

SEQ ID NO: 1623575 - DNA, 23 bp, Homo sapiens
ctccagctaaacaccaacccctg

SEQ ID NO: 1623576 - DNA, 21 bp, Homo sapiens
ctccagctcgtgtgtcctcat

SEQ ID NO: 1623577 - DNA, 11 bp, Homo sapiens
ctccagctgcc

SEQ ID NO: 1623578 - DNA, 15 bp, Homo sapiens
ctccagctgcctggg

SEQ ID NO: 1623579 - DNA, 20 bp, Homo sapiens
ctccagctgctctgtcttct

SEQ ID NO: 1623580 - DNA, 15 bp, Homo sapiens
ctccagctgggctct

SEQ ID NO: 1623581 - DNA, 19 bp, Homo sapiens
ctccagctgggctctgcaa

SEQ ID NO: 1623582 - DNA, 18 bp, Homo sapiens
ctccagcttcggagggcc

SEQ ID NO: 1623583 - DNA, 11 bp, Homo sapiens
ctccaggaagg

SEQ ID NO: 1623584 - DNA, 20 bp, Homo sapiens
ctccaggaaggtagcccagc

SEQ ID NO: 1623585 - DNA, 22 bp, Homo sapiens
ctccaggaaggtagcccagcac

SEQ ID NO: 1623586 - DNA, 16 bp, Homo sapiens
ctccaggagagagcca

SEQ ID NO: 1623587 - DNA, 14 bp, Homo sapiens
ctccaggcaggcca

SEQ ID NO: 1623588 - DNA, 15 bp, Homo sapiens
ctccaggcaggccag

SEQ ID NO: 1623589 - DNA, 23 bp, Homo sapiens
ttctgttccaacctcctgctctg

SEQ ID NO: 1623590 - DNA, 17 bp, Homo sapiens
ttctgttcttacaaatg

SEQ ID NO: 1623591 - DNA, 17 bp, Homo sapiens
ttctgttgatcccactt

SEQ ID NO: 1623592 - DNA, 24 bp, Homo sapiens
ttctgttgatcccacttcactgtg

SEQ ID NO: 1623593 - DNA, 13 bp, Homo sapiens
ttctgttgtctgc

SEQ ID NO: 1623594 - DNA, 15 bp, Homo sapiens
ttctgttgttccatt

SEQ ID NO: 1623595 - DNA, 18 bp, Homo sapiens
ttctgttgttccatttta

SEQ ID NO: 1623596 - DNA, 20 bp, Homo sapiens
ttctgttgttccattttatg

SEQ ID NO: 1623597 - DNA, 18 bp, Homo sapiens
ttctgtttatggccacat

SEQ ID NO: 1623598 - DNA, 20 bp, Homo sapiens
ttctgtttattcttccagaa

SEQ ID NO: 1623599 - DNA, 17 bp, Homo sapiens
ttctgtttcaaagcaca

SEQ ID NO: 1623600 - DNA, 22 bp, Homo sapiens
ttctgttttcttctcagtcttt

SEQ ID NO: 1623601 - DNA, 15 bp, Homo sapiens
ttcttaaaaaaataa

SEQ ID NO: 1623602 - DNA, 17 bp, Homo sapiens
ttcttaaaaaaataaaa

SEQ ID NO: 1623603 - DNA, 21 bp, Homo sapiens
ttcttaaaaggcccatagcag

SEQ ID NO: 1623604 - DNA, 15 bp, Homo sapiens
ttcttaaaagtactt

SEQ ID NO: 1623605 - DNA, 13 bp, Homo sapiens
ttcttaaagagtt

SEQ ID NO: 1623606 - DNA, 14 bp, Homo sapiens
ttcttaaaggcctg

SEQ ID NO: 1623607 - DNA, 13 bp, Homo sapiens
ttcttaaatggaa

SEQ ID NO: 1623608 - DNA, 14 bp, Homo sapiens
ttcttaaatggaat

SEQ ID NO: 1623609 - DNA, 20 bp, Homo sapiens
ttcttaaatggaattatttt

SEQ ID NO: 1623610 - DNA, 16 bp, Homo sapiens
ttcttaacaaactctt

SEQ ID NO: 1623611 - DNA, 17 bp, Homo sapiens
ttcttaacaaactcttc

SEQ ID NO: 1623612 - DNA, 16 bp, Homo sapiens
ttcttaagaaatgcca

SEQ ID NO: 1623613 - DNA, 21 bp, Homo sapiens
ttcttaagccctttgctctgg

SEQ ID NO: 1623614 - DNA, 23 bp, Homo sapiens
ttcttaagccctttgctctggag

SEQ ID NO: 1623615 - DNA, 14 bp, Homo sapiens
ttcttaatcatttt

SEQ ID NO: 1623616 - DNA, 20 bp, Homo sapiens
ttcttacaattgcactgctg

SEQ ID NO: 1623617 - DNA, 12 bp, Homo sapiens
ttcttactctgg

SEQ ID NO: 1623618 - DNA, 21 bp, Homo sapiens
ttcttagactacatttagaga

SEQ ID NO: 1623619 - DNA, 19 bp, Homo sapiens
ttcttagctgtaacttaac

SEQ ID NO: 1623620 - DNA, 16 bp, Homo sapiens
ttcttagctttgaaac

SEQ ID NO: 1623621 - DNA, 17 bp, Homo sapiens
ttcttagctttgaaact

SEQ ID NO: 1623622 - DNA, 17 bp, Homo sapiens
ttcttaggtttactgtg

SEQ ID NO: 1623623 - DNA, 19 bp, Homo sapiens
ttcttaggtttactgtgaa

SEQ ID NO: 1623624 - DNA, 24 bp, Homo sapiens
ttcttagtccagttgtgttgacac

SEQ ID NO: 1623625 - DNA, 22 bp, Homo sapiens
ttcttagttcatatatcaagaa

SEQ ID NO: 1623626 - DNA, 16 bp, Homo sapiens
ttcttatatatgtgaa

SEQ ID NO: 1623627 - DNA, 23 bp, Homo sapiens
ttcttatgccatgttaatttcat

SEQ ID NO: 1623628 - DNA, 13 bp, Homo sapiens
ttcttatgtgaca

SEQ ID NO: 1623629 - DNA, 19 bp, Homo sapiens
ttcttatgtgacattaaca

SEQ ID NO: 1623630 - DNA, 19 bp, Homo sapiens
ctccagtgctcagctgtgg

SEQ ID NO: 1623631 - DNA, 21 bp, Homo sapiens
ctccagtgctcagctgtggct

SEQ ID NO: 1623632 - DNA, 18 bp, Homo sapiens
ctccagtgctggatttga

SEQ ID NO: 1623633 - DNA, 22 bp, Homo sapiens
ctccagtgtgggcttgaccagg

SEQ ID NO: 1623634 - DNA, 14 bp, Homo sapiens
ctccagttgattat

SEQ ID NO: 1623635 - DNA, 17 bp, Homo sapiens
ctccagttgggactcag

SEQ ID NO: 1623636 - DNA, 19 bp, Homo sapiens
ctccagttgggactcagga

SEQ ID NO: 1623637 - DNA, 14 bp, Homo sapiens
ctccagtttcccca

SEQ ID NO: 1623638 - DNA, 17 bp, Homo sapiens
ctccagtttgcacctgt

SEQ ID NO: 1623639 - DNA, 21 bp, Homo sapiens
ctccagtttgcacctgtcccc

SEQ ID NO: 1623640 - DNA, 20 bp, Homo sapiens
ctccagtttttgtttttgca

SEQ ID NO: 1623641 - DNA, 21 bp, Homo sapiens
ctccagtttttgtttttgcat

SEQ ID NO: 1623642 - DNA, 12 bp, Homo sapiens
ctccatacagcc

SEQ ID NO: 1623643 - DNA, 16 bp, Homo sapiens
ctccatacagcctcta

SEQ ID NO: 1623644 - DNA, 15 bp, Homo sapiens
ctccatactcaagct

SEQ ID NO: 1623645 - DNA, 18 bp, Homo sapiens
ctccatactgggctaagg

SEQ ID NO: 1623646 - DNA, 15 bp, Homo sapiens
ctccatatcagctct

SEQ ID NO: 1623647 - DNA, 20 bp, Homo sapiens
ctccatatcagctctctgca

SEQ ID NO: 1623648 - DNA, 19 bp, Homo sapiens
ctccatatttgatttctaa

SEQ ID NO: 1623649 - DNA, 22 bp, Homo sapiens
ctccatcaccctcttcctgtga

SEQ ID NO: 1623650 - DNA, 15 bp, Homo sapiens
ctccatccatccttc

SEQ ID NO: 1623651 - DNA, 23 bp, Homo sapiens
ctccatccccctttaccctcttt

SEQ ID NO: 1623652 - DNA, 12 bp, Homo sapiens
ctccatccctct

SEQ ID NO: 1623653 - DNA, 15 bp, Homo sapiens
ctccatccctctaat

SEQ ID NO: 1623654 - DNA, 16 bp, Homo sapiens
ctccatccctgaaatt

SEQ ID NO: 1623655 - DNA, 16 bp, Homo sapiens
ctccatctcaaaacaa

SEQ ID NO: 1623656 - DNA, 19 bp, Homo sapiens
ctccatctcaaaacaaaac

SEQ ID NO: 1623657 - DNA, 19 bp, Homo sapiens
ctccatctctcatcctcca

SEQ ID NO: 1623658 - DNA, 14 bp, Homo sapiens
ctccatctcttctg

SEQ ID NO: 1623659 - DNA, 12 bp, Homo sapiens
ctccatcttatt

SEQ ID NO: 1623660 - DNA, 22 bp, Homo sapiens
ctccatcttggtagttctgtgc

SEQ ID NO: 1623661 - DNA, 16 bp, Homo sapiens
ctccatctttctacag

SEQ ID NO: 1623662 - DNA, 15 bp, Homo sapiens
ctccatgactggctg

SEQ ID NO: 1623663 - DNA, 15 bp, Homo sapiens
ctccatgcacctccc

SEQ ID NO: 1623664 - DNA, 16 bp, Homo sapiens
ctccatgccccagctc

SEQ ID NO: 1623665 - DNA, 19 bp, Homo sapiens
ctccatgccccagctctgg

SEQ ID NO: 1623666 - DNA, 21 bp, Homo sapiens
ctccatgctcctcacctgtct

SEQ ID NO: 1623667 - DNA, 15 bp, Homo sapiens
ctccatgctgcaaag

SEQ ID NO: 1623668 - DNA, 18 bp, Homo sapiens
ctccatggcagcagccag

SEQ ID NO: 1623669 - DNA, 22 bp, Homo sapiens
ctccatggcagcagccagggac

SEQ ID NO: 1623670 - DNA, 15 bp, Homo sapiens
ctccatggccacccc

SEQ ID NO: 1623671 - DNA, 14 bp, Homo sapiens
ctccattactgtga

SEQ ID NO: 1623672 - DNA, 15 bp, Homo sapiens
ctccattactgtgat

SEQ ID NO: 1623673 - DNA, 16 bp, Homo sapiens
ctccattactgtgatt

SEQ ID NO: 1623674 - DNA, 21 bp, Homo sapiens
ctccattagaaaattttgtaa

SEQ ID NO: 1623675 - DNA, 14 bp, Homo sapiens
ctccattcatcctt

SEQ ID NO: 1623676 - DNA, 21 bp, Homo sapiens
ctccattcctggagcccgagg

SEQ ID NO: 1623677 - DNA, 14 bp, Homo sapiens
ctccattctgacca

SEQ ID NO: 1623678 - DNA, 20 bp, Homo sapiens
ctccattctgaccatttcag

SEQ ID NO: 1623679 - DNA, 17 bp, Homo sapiens
ctccattggtgttgaca

SEQ ID NO: 1623680 - DNA, 23 bp, Homo sapiens
ctccatttcccaaagtcctctgc

SEQ ID NO: 1623681 - DNA, 13 bp, Homo sapiens
ctccatttctgtc

SEQ ID NO: 1623682 - DNA, 18 bp, Homo sapiens
ctccatttgctcttcaga

SEQ ID NO: 1623683 - DNA, 16 bp, Homo sapiens
ctccattttcaagctg

SEQ ID NO: 1623684 - DNA, 22 bp, Homo sapiens
ctcccaaaagctagaacactgc

SEQ ID NO: 1623685 - DNA, 17 bp, Homo sapiens
ctcccaaagctcagact

SEQ ID NO: 1623686 - DNA, 22 bp, Homo sapiens
ctcccaaagtgctgagattaca

SEQ ID NO: 1623687 - DNA, 15 bp, Homo sapiens
ctcccaaagtgctgg

SEQ ID NO: 1623688 - DNA, 16 bp, Homo sapiens
ctcccaaagtgctggg

SEQ ID NO: 1623689 - DNA, 23 bp, Homo sapiens
ctcccaacaacatgaaactgcct

SEQ ID NO: 1623690 - DNA, 18 bp, Homo sapiens
ctcccaacagaggcctcc

SEQ ID NO: 1623691 - DNA, 14 bp, Homo sapiens
ctcccaacagcgct

SEQ ID NO: 1623692 - DNA, 22 bp, Homo sapiens
ctcccaacccattcactacagg

SEQ ID NO: 1623693 - DNA, 16 bp, Homo sapiens
ctcccaacctcaatgc

SEQ ID NO: 1623694 - DNA, 22 bp, Homo sapiens
ctcccaacctcaatgccctgcc

SEQ ID NO: 1623695 - DNA, 14 bp, Homo sapiens
ctcccaagaaacct

SEQ ID NO: 1623696 - DNA, 18 bp, Homo sapiens
ctcccaagcgttcctggc

SEQ ID NO: 1623697 - DNA, 22 bp, Homo sapiens
ctcccaaggagccattctgtgt

SEQ ID NO: 1623698 - DNA, 21 bp, Homo sapiens
ctcccaaggggcccaaattct

SEQ ID NO: 1623699 - DNA, 22 bp, Homo sapiens
ctcccaaggggcccaaattctt

SEQ ID NO: 1623700 - DNA, 18 bp, Homo sapiens
ctcccaagtcccaccctc

SEQ ID NO: 1623701 - DNA, 19 bp, Homo sapiens
ctcccaagtcccaccctct

SEQ ID NO: 1623702 - DNA, 19 bp, Homo sapiens
ctcccaagtttccatagca

SEQ ID NO: 1623703 - DNA, 13 bp, Homo sapiens
ctcccaatcagct

SEQ ID NO: 1623704 - DNA, 14 bp, Homo sapiens
ctcccaatcagctt

SEQ ID NO: 1623705 - DNA, 19 bp, Homo sapiens
ctcccaatcctctctcccc

SEQ ID NO: 1623706 - DNA, 15 bp, Homo sapiens
ttctttaaggagata

SEQ ID NO: 1623707 - DNA, 20 bp, Homo sapiens
ttctttactatgtttctcag

SEQ ID NO: 1623708 - DNA, 19 bp, Homo sapiens
ttctttacttctcacttca

SEQ ID NO: 1623709 - DNA, 16 bp, Homo sapiens
ttctttagatgccaaa

SEQ ID NO: 1623710 - DNA, 14 bp, Homo sapiens
ttctttataaactt

SEQ ID NO: 1623711 - DNA, 19 bp, Homo sapiens
ttctttccaaaacatttct

SEQ ID NO: 1623712 - DNA, 17 bp, Homo sapiens
ttctttccattatgatt

SEQ ID NO: 1623713 - DNA, 13 bp, Homo sapiens
ttctttccccaga

SEQ ID NO: 1623714 - DNA, 24 bp, Homo sapiens
ttctttccccagaggctcccaatc

SEQ ID NO: 1623715 - DNA, 16 bp, Homo sapiens
ttctttcctctttctg

SEQ ID NO: 1623716 - DNA, 20 bp, Homo sapiens
ttctttcctctttctgctct

SEQ ID NO: 1623717 - DNA, 16 bp, Homo sapiens
ttctttccttcccaat

SEQ ID NO: 1623718 - DNA, 14 bp, Homo sapiens
ttctttctatgtag

SEQ ID NO: 1623719 - DNA, 20 bp, Homo sapiens
ttctttctcataaaactgtg

SEQ ID NO: 1623720 - DNA, 17 bp, Homo sapiens
ttctttctgtctccctt

SEQ ID NO: 1623721 - DNA, 13 bp, Homo sapiens
ttctttctttgtt

SEQ ID NO: 1623722 - DNA, 17 bp, Homo sapiens
ttctttgatcatgaata

SEQ ID NO: 1623723 - DNA, 12 bp, Homo sapiens
ttctttgcctct

SEQ ID NO: 1623724 - DNA, 13 bp, Homo sapiens
ttctttgctagtt

SEQ ID NO: 1623725 - DNA, 23 bp, Homo sapiens
ttctttgctgcagtcatctactt

SEQ ID NO: 1623726 - DNA, 16 bp, Homo sapiens
ttctttggagttaaaa

SEQ ID NO: 1623727 - DNA, 20 bp, Homo sapiens
ttctttggagttaaaatgca

SEQ ID NO: 1623728 - DNA, 21 bp, Homo sapiens
ttctttggattctaaatacat

SEQ ID NO: 1623729 - DNA, 16 bp, Homo sapiens
ttctttggtaattttt

SEQ ID NO: 1623730 - DNA, 19 bp, Homo sapiens
ttctttggtaggtaaatct

SEQ ID NO: 1623731 - DNA, 13 bp, Homo sapiens
ttctttgtaatga

SEQ ID NO: 1623732 - DNA, 12 bp, Homo sapiens
ttctttgtgcct

SEQ ID NO: 1623733 - DNA, 16 bp, Homo sapiens
ttctttgtgcctttgg

SEQ ID NO: 1623734 - DNA, 19 bp, Homo sapiens
ttctttgtgtagctttgct

SEQ ID NO: 1623735 - DNA, 18 bp, Homo sapiens
ttctttgtgtagtatctt

SEQ ID NO: 1623736 - DNA, 16 bp, Homo sapiens
ttctttgttacaggca

SEQ ID NO: 1623737 - DNA, 11 bp, Homo sapiens
ttctttgttct

SEQ ID NO: 1623738 - DNA, 13 bp, Homo sapiens
ttctttgtttcct

SEQ ID NO: 1623739 - DNA, 13 bp, Homo sapiens
ttctttgtttctt

SEQ ID NO: 1623740 - DNA, 13 bp, Homo sapiens
ttcttttagagag

SEQ ID NO: 1623741 - DNA, 14 bp, Homo sapiens
ttcttttatatctg

SEQ ID NO: 1623742 - DNA, 19 bp, Homo sapiens
ttcttttatatctgtaaat

SEQ ID NO: 1623743 - DNA, 17 bp, Homo sapiens
ttcttttcagcttgttt

SEQ ID NO: 1623744 - DNA, 22 bp, Homo sapiens
ttcttttcagcttgtttctata

SEQ ID NO: 1623745 - DNA, 21 bp, Homo sapiens
ctcccaccttggcctcccaga

SEQ ID NO: 1623746 - DNA, 14 bp, Homo sapiens
ctcccactcagaac

SEQ ID NO: 1623747 - DNA, 17 bp, Homo sapiens
ctcccactccctttcca

SEQ ID NO: 1623748 - DNA, 14 bp, Homo sapiens
ctcccactcctgct

SEQ ID NO: 1623749 - DNA, 16 bp, Homo sapiens
ctcccagaaacatctc

SEQ ID NO: 1623750 - DNA, 20 bp, Homo sapiens
ctcccagaaacatctctggc

SEQ ID NO: 1623751 - DNA, 23 bp, Homo sapiens
ctcccagcaagacctcatctgtg

SEQ ID NO: 1623752 - DNA, 17 bp, Homo sapiens
ctcccagcagctcaacc

SEQ ID NO: 1623753 - DNA, 15 bp, Homo sapiens
ctcccagcccattgc

SEQ ID NO: 1623754 - DNA, 22 bp, Homo sapiens
ctcccagcccattgctgccaag

SEQ ID NO: 1623755 - DNA, 19 bp, Homo sapiens
ctcccagcccctgcccctc

SEQ ID NO: 1623756 - DNA, 15 bp, Homo sapiens
ctcccagcctcttgc

SEQ ID NO: 1623757 - DNA, 15 bp, Homo sapiens
ctcccagcggcctcc

SEQ ID NO: 1623758 - DNA, 17 bp, Homo sapiens
ctcccagcttcaaatgc

SEQ ID NO: 1623759 - DNA, 18 bp, Homo sapiens
ctcccaggaactgggcca

SEQ ID NO: 1623760 - DNA, 12 bp, Homo sapiens
ctcccaggacac

SEQ ID NO: 1623761 - DNA, 18 bp, Homo sapiens
ctcccaggaggtgcttga

SEQ ID NO: 1623762 - DNA, 18 bp, Homo sapiens
ctcccaggcaagcagctg

SEQ ID NO: 1623763 - DNA, 17 bp, Homo sapiens
ctcccaggccaggctcc

SEQ ID NO: 1623764 - DNA, 22 bp, Homo sapiens
ctcccaggccaggctccttcct

SEQ ID NO: 1623765 - DNA, 17 bp, Homo sapiens
ctcccaggcgccccttc

SEQ ID NO: 1623766 - DNA, 20 bp, Homo sapiens
ctcccaggcgccccttcccc

SEQ ID NO: 1623767 - DNA, 19 bp, Homo sapiens
ctcccagggccagggccct

SEQ ID NO: 1623768 - DNA, 22 bp, Homo sapiens
ctcccagggccagggccctgca

SEQ ID NO: 1623769 - DNA, 17 bp, Homo sapiens
ctcccaggggagccagc

SEQ ID NO: 1623770 - DNA, 19 bp, Homo sapiens
ctcccaggggagccagctg

SEQ ID NO: 1623771 - DNA, 23 bp, Homo sapiens
ctcccaggggagccagctgcttg

SEQ ID NO: 1623772 - DNA, 13 bp, Homo sapiens
ctcccaggggtct

SEQ ID NO: 1623773 - DNA, 16 bp, Homo sapiens
ctcccaggggtctccc

SEQ ID NO: 1623774 - DNA, 19 bp, Homo sapiens
ctcccaggggtctccctgg

SEQ ID NO: 1623775 - DNA, 20 bp, Homo sapiens
ctcccaggggtctccctggc

SEQ ID NO: 1623776 - DNA, 22 bp, Homo sapiens
ctcccaggggtctccctggctc

SEQ ID NO: 1623777 - DNA, 22 bp, Homo sapiens
ctcccaggtgttaacattccaa

SEQ ID NO: 1623778 - DNA, 17 bp, Homo sapiens
ctcccaggttgacacca

SEQ ID NO: 1623779 - DNA, 15 bp, Homo sapiens
ctcccagtgccttct

SEQ ID NO: 1623780 - DNA, 17 bp, Homo sapiens
ctcccagtgccttctgg

SEQ ID NO: 1623781 - DNA, 19 bp, Homo sapiens
ctcccagtgggagcttccc

SEQ ID NO: 1623782 - DNA, 16 bp, Homo sapiens
ctcccatcacttccct

SEQ ID NO: 1623783 - DNA, 13 bp, Homo sapiens
ctcccatcctggg

SEQ ID NO: 1623784 - DNA, 16 bp, Homo sapiens
ctcccatcctggggca

SEQ ID NO: 1623785 - DNA, 17 bp, Homo sapiens
ctcccatcctggggcag

SEQ ID NO: 1623786 - DNA, 16 bp, Homo sapiens
ctcccatctccttccc

SEQ ID NO: 1623787 - DNA, 17 bp, Homo sapiens
ctcccatctccttcccc

SEQ ID NO: 1623788 - DNA, 21 bp, Homo sapiens
ctcccatctccttcccccagc

SEQ ID NO: 1623789 - DNA, 13 bp, Homo sapiens
ctcccatctgatt

SEQ ID NO: 1623790 - DNA, 15 bp, Homo sapiens
ctcccatctgattta

SEQ ID NO: 1623791 - DNA, 12 bp, Homo sapiens
ctcccatctggg

SEQ ID NO: 1623792 - DNA, 13 bp, Homo sapiens
ctcccatctggga

SEQ ID NO: 1623793 - DNA, 15 bp, Homo sapiens
ctcccatctgggagt

SEQ ID NO: 1623794 - DNA, 16 bp, Homo sapiens
ctcccatgaccatact

SEQ ID NO: 1623795 - DNA, 22 bp, Homo sapiens
ctcccatgggggcacttgagtt

SEQ ID NO: 1623796 - DNA, 14 bp, Homo sapiens
ctcccattcctgaa

SEQ ID NO: 1623797 - DNA, 17 bp, Homo sapiens
ctcccattcctgaagaa

SEQ ID NO: 1623798 - DNA, 15 bp, Homo sapiens
ctccccaaaatatta

SEQ ID NO: 1623799 - DNA, 13 bp, Homo sapiens
ctccccaaagcca

SEQ ID NO: 1623800 - DNA, 13 bp, Homo sapiens
ctccccaagactg

SEQ ID NO: 1623801 - DNA, 20 bp, Homo sapiens
ctccccacactccactctga

SEQ ID NO: 1623802 - DNA, 13 bp, Homo sapiens
ctccccacccgct

SEQ ID NO: 1623803 - DNA, 23 bp, Homo sapiens
ctccccaccttcaattcctgggc

SEQ ID NO: 1623804 - DNA, 18 bp, Homo sapiens
ctccccacgagggctggc

SEQ ID NO: 1623805 - DNA, 24 bp, Homo sapiens
ctccccacgagtcacctgcaagcc

SEQ ID NO: 1623806 - DNA, 12 bp, Homo sapiens
ctccccactcta

SEQ ID NO: 1623807 - DNA, 13 bp, Homo sapiens
ctccccagagctg

SEQ ID NO: 1623808 - DNA, 22 bp, Homo sapiens
ctccccagagctgtgccagcag

SEQ ID NO: 1623809 - DNA, 23 bp, Homo sapiens
ctccccagagctgtgccagcagg

SEQ ID NO: 1623810 - DNA, 14 bp, Homo sapiens
ctccccagcccaga

SEQ ID NO: 1623811 - DNA, 15 bp, Homo sapiens
ctccccagcccagag

SEQ ID NO: 1623812 - DNA, 17 bp, Homo sapiens
ctccccagcccagagac

SEQ ID NO: 1623813 - DNA, 14 bp, Homo sapiens
ctccccagctcttc

SEQ ID NO: 1623814 - DNA, 22 bp, Homo sapiens
ctccccagctcttctcttccta

SEQ ID NO: 1623815 - DNA, 18 bp, Homo sapiens
ctccccaggactcaccct

SEQ ID NO: 1623816 - DNA, 17 bp, Homo sapiens
ctccccaggcctccagc

SEQ ID NO: 1623817 - DNA, 11 bp, Homo sapiens
ctccccagggg

SEQ ID NO: 1623818 - DNA, 16 bp, Homo sapiens
ctccccaggtccagct

SEQ ID NO: 1623819 - DNA, 19 bp, Homo sapiens
ctccccaggtccagctctg

SEQ ID NO: 1623820 - DNA, 11 bp, Homo sapiens
ctccccagtgc

SEQ ID NO: 1623821 - DNA, 20 bp, Homo sapiens
ctccccagtgcctgccactc

SEQ ID NO: 1623822 - DNA, 21 bp, Homo sapiens
ctccccagtgcctgccactct

SEQ ID NO: 1623823 - DNA, 16 bp, Homo sapiens
ctccccagtgtatgtc

SEQ ID NO: 1623824 - DNA, 12 bp, Homo sapiens
ctccccatggag

SEQ ID NO: 1623825 - DNA, 22 bp, Homo sapiens
ttgaagacaatttgatacataa

SEQ ID NO: 1623826 - DNA, 23 bp, Homo sapiens
ttgaagacaatttgatacataat

SEQ ID NO: 1623827 - DNA, 19 bp, Homo sapiens
ttgaagaggggagctcagt

SEQ ID NO: 1623828 - DNA, 20 bp, Homo sapiens
ttgaagatcgttagtatcta

SEQ ID NO: 1623829 - DNA, 18 bp, Homo sapiens
ttgaagcagtcttgctct

SEQ ID NO: 1623830 - DNA, 19 bp, Homo sapiens
ttgaagcatgctctgtaag

SEQ ID NO: 1623831 - DNA, 16 bp, Homo sapiens
ttgaagcatttcaaag

SEQ ID NO: 1623832 - DNA, 18 bp, Homo sapiens
ttgaagccgactctggcc

SEQ ID NO: 1623833 - DNA, 19 bp, Homo sapiens
ttgaagccgactctggccc

SEQ ID NO: 1623834 - DNA, 17 bp, Homo sapiens
ttgaagcctaaatttgt

SEQ ID NO: 1623835 - DNA, 15 bp, Homo sapiens
ttgaagccttttgtt

SEQ ID NO: 1623836 - DNA, 18 bp, Homo sapiens
ttgaagctaaaaggaaaa

SEQ ID NO: 1623837 - DNA, 23 bp, Homo sapiens
ttgaagctctggtgacaccagcc

SEQ ID NO: 1623838 - DNA, 14 bp, Homo sapiens
ttgaaggaaacagt

SEQ ID NO: 1623839 - DNA, 13 bp, Homo sapiens
ttgaaggaagagg

SEQ ID NO: 1623840 - DNA, 16 bp, Homo sapiens
ttgaaggaagagggac

SEQ ID NO: 1623841 - DNA, 20 bp, Homo sapiens
ttgaaggccctgctgagtca

SEQ ID NO: 1623842 - DNA, 17 bp, Homo sapiens
ttgaagggccagagcca

SEQ ID NO: 1623843 - DNA, 13 bp, Homo sapiens
ttgaagggtcctg

SEQ ID NO: 1623844 - DNA, 15 bp, Homo sapiens
ttgaagtaaactttt

SEQ ID NO: 1623845 - DNA, 16 bp, Homo sapiens
ttgaagtaatgaattt

SEQ ID NO: 1623846 - DNA, 15 bp, Homo sapiens
ttgaagtcacccggc

SEQ ID NO: 1623847 - DNA, 23 bp, Homo sapiens
ttgaagttgggtgtttccagaat

SEQ ID NO: 1623848 - DNA, 23 bp, Homo sapiens
ttgaagttggtttagctttggaa

SEQ ID NO: 1623849 - DNA, 23 bp, Homo sapiens
ttgaataaactctcccctttctt

SEQ ID NO: 1623850 - DNA, 15 bp, Homo sapiens
ttgaataaagtattc

SEQ ID NO: 1623851 - DNA, 16 bp, Homo sapiens
ttgaatacatttgtat

SEQ ID NO: 1623852 - DNA, 18 bp, Homo sapiens
ttgaatagagaagtgtga

SEQ ID NO: 1623853 - DNA, 13 bp, Homo sapiens
ttgaatataaaaa

SEQ ID NO: 1623854 - DNA, 18 bp, Homo sapiens
ttgaatattcctggactt

SEQ ID NO: 1623855 - DNA, 21 bp, Homo sapiens
ttgaatcctctattaattact

SEQ ID NO: 1623856 - DNA, 23 bp, Homo sapiens
ttgaatctgattggacattttct

SEQ ID NO: 1623857 - DNA, 22 bp, Homo sapiens
ttgaatgactaagaggaaagta

SEQ ID NO: 1623858 - DNA, 16 bp, Homo sapiens
ttgaatgcagaaaaca

SEQ ID NO: 1623859 - DNA, 23 bp, Homo sapiens
ttgaatgcagaagcaaacaagct

SEQ ID NO: 1623860 - DNA, 16 bp, Homo sapiens
ttctaaaggtccacag

SEQ ID NO: 1623861 - DNA, 17 bp, Homo sapiens
ttctaaagttctaagat

SEQ ID NO: 1623862 - DNA, 18 bp, Homo sapiens
ttctaaagttctaagatt

SEQ ID NO: 1623863 - DNA, 18 bp, Homo sapiens
ttctaaatccgacttgaa

SEQ ID NO: 1623864 - DNA, 12 bp, Homo sapiens
ttctaaatgaat

SEQ ID NO: 1623865 - DNA, 13 bp, Homo sapiens
ttctaacagtcct

SEQ ID NO: 1623866 - DNA, 18 bp, Homo sapiens
ttctaaccttgaatgctg

SEQ ID NO: 1623867 - DNA, 22 bp, Homo sapiens
ttctaaccttgaatgctgccag

SEQ ID NO: 1623868 - DNA, 23 bp, Homo sapiens
ttctaaccttgaatgctgccagt

SEQ ID NO: 1623869 - DNA, 24 bp, Homo sapiens
ttctaaccttgaatgctgccagtg

SEQ ID NO: 1623870 - DNA, 16 bp, Homo sapiens
ttctaagaaaagccta

SEQ ID NO: 1623871 - DNA, 17 bp, Homo sapiens
ttctaagaaaatgtagt

SEQ ID NO: 1623872 - DNA, 17 bp, Homo sapiens
ttctaagaagacatttt

SEQ ID NO: 1623873 - DNA, 19 bp, Homo sapiens
ttctaagaagacattttgt

SEQ ID NO: 1623874 - DNA, 12 bp, Homo sapiens
ttctaagactca

SEQ ID NO: 1623875 - DNA, 16 bp, Homo sapiens
ttctaagactcaaatg

SEQ ID NO: 1623876 - DNA, 13 bp, Homo sapiens
ttctaagagaagt

SEQ ID NO: 1623877 - DNA, 16 bp, Homo sapiens
ttctaagattctaatg

SEQ ID NO: 1623878 - DNA, 13 bp, Homo sapiens
ttctaagattctg

SEQ ID NO: 1623879 - DNA, 14 bp, Homo sapiens
ttctaagattctga

SEQ ID NO: 1623880 - DNA, 21 bp, Homo sapiens
ttctaagccagttttcatttt

SEQ ID NO: 1623881 - DNA, 17 bp, Homo sapiens
ttctaagccctgttctc

SEQ ID NO: 1623882 - DNA, 23 bp, Homo sapiens
ttctaagcgcctattgtttgtaa

SEQ ID NO: 1623883 - DNA, 21 bp, Homo sapiens
ttctaagcttatttctaacta

SEQ ID NO: 1623884 - DNA, 23 bp, Homo sapiens
ttctaaggacctgaaattccaaa

SEQ ID NO: 1623885 - DNA, 19 bp, Homo sapiens
ttctaaggcctaggattct

SEQ ID NO: 1623886 - DNA, 20 bp, Homo sapiens
ttctaaggcctaggattcta

SEQ ID NO: 1623887 - DNA, 16 bp, Homo sapiens
ttctaaggctctgaga

SEQ ID NO: 1623888 - DNA, 17 bp, Homo sapiens
ttctaaggctctgagag

SEQ ID NO: 1623889 - DNA, 21 bp, Homo sapiens
ttctaaggtccggtgttctaa

SEQ ID NO: 1623890 - DNA, 16 bp, Homo sapiens
ttctaagtaaaaccac

SEQ ID NO: 1623891 - DNA, 24 bp, Homo sapiens
ttctaagtaaaaccacagcagttg

SEQ ID NO: 1623892 - DNA, 17 bp, Homo sapiens
ttctaagtggcgtgtgc

SEQ ID NO: 1623893 - DNA, 21 bp, Homo sapiens
ttctaagttcatgtttgtaaa

SEQ ID NO: 1623894 - DNA, 12 bp, Homo sapiens
ttctaagtttct

SEQ ID NO: 1623895 - DNA, 18 bp, Homo sapiens
ttctaagtttctaagatt

SEQ ID NO: 1623896 - DNA, 14 bp, Homo sapiens
ttctaataactgca

SEQ ID NO: 1623897 - DNA, 15 bp, Homo sapiens
ttctaataatttcta

SEQ ID NO: 1623898 - DNA, 18 bp, Homo sapiens
ttctaataatttctaatg

SEQ ID NO: 1623899 - DNA, 19 bp, Homo sapiens
ttctaataatttctaatgt

SEQ ID NO: 1623900 - DNA, 18 bp, Homo sapiens
ttctaatagaactcagtt

SEQ ID NO: 1623901 - DNA, 16 bp, Homo sapiens
ttctaatcacagtgtt

SEQ ID NO: 1623902 - DNA, 19 bp, Homo sapiens
ttctaatcacagtgttgca

SEQ ID NO: 1623903 - DNA, 19 bp, Homo sapiens
ttctaatccttttccttat

SEQ ID NO: 1623904 - DNA, 16 bp, Homo sapiens
ttctaatggaatggtt

SEQ ID NO: 1623905 - DNA, 23 bp, Homo sapiens
ttctaattgtaagtgaaattaag

SEQ ID NO: 1623906 - DNA, 14 bp, Homo sapiens
ttctacaaggactc

SEQ ID NO: 1623907 - DNA, 19 bp, Homo sapiens
ttctacacagtgggaactc

SEQ ID NO: 1623908 - DNA, 22 bp, Homo sapiens
ttctacacagtgggaactctga

SEQ ID NO: 1623909 - DNA, 15 bp, Homo sapiens
ttctacagtggtttt

SEQ ID NO: 1623910 - DNA, 22 bp, Homo sapiens
ttctacataagtaattcaagaa

SEQ ID NO: 1623911 - DNA, 19 bp, Homo sapiens
ttctacataattgtgacca

SEQ ID NO: 1623912 - DNA, 20 bp, Homo sapiens
ttctacattcagattatatg

SEQ ID NO: 1623913 - DNA, 22 bp, Homo sapiens
ttctacatttcacctactttgt

SEQ ID NO: 1623914 - DNA, 19 bp, Homo sapiens
ttctaccaggcaaattcac

SEQ ID NO: 1623915 - DNA, 18 bp, Homo sapiens
ttctacccaacggccctg

SEQ ID NO: 1623916 - DNA, 17 bp, Homo sapiens
ttctaccccaaggccag

SEQ ID NO: 1623917 - DNA, 19 bp, Homo sapiens
ttctaccccaaggccagta

SEQ ID NO: 1623918 - DNA, 15 bp, Homo sapiens
ttctaccctagccat

SEQ ID NO: 1623919 - DNA, 20 bp, Homo sapiens
ttctaccctagccattcctg

SEQ ID NO: 1623920 - DNA, 15 bp, Homo sapiens
ttctccacactccac

SEQ ID NO: 1623921 - DNA, 16 bp, Homo sapiens
ttctccacccaccagt

SEQ ID NO: 1623922 - DNA, 12 bp, Homo sapiens
ttctccacctcc

SEQ ID NO: 1623923 - DNA, 13 bp, Homo sapiens
ttctccacctccc

SEQ ID NO: 1623924 - DNA, 14 bp, Homo sapiens
ttctccacctcccc

SEQ ID NO: 1623925 - DNA, 19 bp, Homo sapiens
ttctccagacccaccacac

SEQ ID NO: 1623926 - DNA, 12 bp, Homo sapiens
ttctccatccct

SEQ ID NO: 1623927 - DNA, 14 bp, Homo sapiens
ttctccatgctgca

SEQ ID NO: 1623928 - DNA, 23 bp, Homo sapiens
ttctccatgctgcaaaggagaag

SEQ ID NO: 1623929 - DNA, 19 bp, Homo sapiens
ttctcccaacaacatgaaa

SEQ ID NO: 1623930 - DNA, 21 bp, Homo sapiens
ttctcccagtgtgagacccca

SEQ ID NO: 1623931 - DNA, 20 bp, Homo sapiens
ttctcccccgacactgctgc

SEQ ID NO: 1623932 - DNA, 21 bp, Homo sapiens
ttctcccccgacactgctgca

SEQ ID NO: 1623933 - DNA, 17 bp, Homo sapiens
ttctccccctgggctct

SEQ ID NO: 1623934 - DNA, 18 bp, Homo sapiens
ttctccccctgggctctg

SEQ ID NO: 1623935 - DNA, 20 bp, Homo sapiens
ttctccccgaggctgcccca

SEQ ID NO: 1623936 - DNA, 22 bp, Homo sapiens
ttctccccgaggctgccccagg

SEQ ID NO: 1623937 - DNA, 23 bp, Homo sapiens
ttctccccgcagcccgcctgccg

SEQ ID NO: 1623938 - DNA, 18 bp, Homo sapiens
ttctcccctgcactgtaa

SEQ ID NO: 1623939 - DNA, 18 bp, Homo sapiens
ttctcccctgcccccagg

SEQ ID NO: 1623940 - DNA, 21 bp, Homo sapiens
ttctcccctgcccccaggact

SEQ ID NO: 1623941 - DNA, 16 bp, Homo sapiens
ttctcccctgcccttc

SEQ ID NO: 1623942 - DNA, 18 bp, Homo sapiens
ttctcccgcctcagcctc

SEQ ID NO: 1623943 - DNA, 13 bp, Homo sapiens
ttctccctcaccc

SEQ ID NO: 1623944 - DNA, 12 bp, Homo sapiens
ttctccctgacc

SEQ ID NO: 1623945 - DNA, 15 bp, Homo sapiens
ttctcccttgccctc

SEQ ID NO: 1623946 - DNA, 17 bp, Homo sapiens
ttctcccttgccctccc

SEQ ID NO: 1623947 - DNA, 14 bp, Homo sapiens
ttctccgccagcct

SEQ ID NO: 1623948 - DNA, 15 bp, Homo sapiens
ttctccgccagcctc

SEQ ID NO: 1623949 - DNA, 19 bp, Homo sapiens
ttctccgccagcctcctct

SEQ ID NO: 1623950 - DNA, 18 bp, Homo sapiens
ttctccggggtctgtgct

SEQ ID NO: 1623951 - DNA, 20 bp, Homo sapiens
ttctccggggtctgtgctgt

SEQ ID NO: 1623952 - DNA, 12 bp, Homo sapiens
ttctcctcccaa

SEQ ID NO: 1623953 - DNA, 21 bp, Homo sapiens
ttctcctgatagtcacctgct

SEQ ID NO: 1623954 - DNA, 12 bp, Homo sapiens
ttctcctgcctc

SEQ ID NO: 1623955 - DNA, 14 bp, Homo sapiens
ttctcctgcctcag

SEQ ID NO: 1623956 - DNA, 16 bp, Homo sapiens
ttctcctgtccctcca

SEQ ID NO: 1623957 - DNA, 22 bp, Homo sapiens
ttctcctgtgaccccaccttga

SEQ ID NO: 1623958 - DNA, 12 bp, Homo sapiens
ttctcctgtgct

SEQ ID NO: 1623959 - DNA, 15 bp, Homo sapiens
ttctccttcagccct

SEQ ID NO: 1623960 - DNA, 14 bp, Homo sapiens
ttctccttctcctt

SEQ ID NO: 1623961 - DNA, 23 bp, Homo sapiens
ttctccttgatatcattcagcat

SEQ ID NO: 1623962 - DNA, 19 bp, Homo sapiens
ttctccttggtttgctagt

SEQ ID NO: 1623963 - DNA, 21 bp, Homo sapiens
ttctccttgttgttggttgtt

SEQ ID NO: 1623964 - DNA, 15 bp, Homo sapiens
ttctcctttccttcc

SEQ ID NO: 1623965 - DNA, 13 bp, Homo sapiens
ttctccttttcct

SEQ ID NO: 1623966 - DNA, 12 bp, Homo sapiens
ttctcggagacc

SEQ ID NO: 1623967 - DNA, 17 bp, Homo sapiens
ttctcggagctggccca

SEQ ID NO: 1623968 - DNA, 17 bp, Homo sapiens
ttctcgtgcctccccac

SEQ ID NO: 1623969 - DNA, 20 bp, Homo sapiens
ttctcgtgctgcatccctgt

SEQ ID NO: 1623970 - DNA, 20 bp, Homo sapiens
ttctctacagacttctccag

SEQ ID NO: 1623971 - DNA, 20 bp, Homo sapiens
ttctctacccatctccccca

SEQ ID NO: 1623972 - DNA, 21 bp, Homo sapiens
ttctctacccatctcccccat

SEQ ID NO: 1623973 - DNA, 22 bp, Homo sapiens
ttctctagctctctaggcctct

SEQ ID NO: 1623974 - DNA, 18 bp, Homo sapiens
ttctctattttcataatc

SEQ ID NO: 1623975 - DNA, 16 bp, Homo sapiens
ttctctcagctcccag

SEQ ID NO: 1623976 - DNA, 13 bp, Homo sapiens
ttctctcatctct

SEQ ID NO: 1623977 - DNA, 23 bp, Homo sapiens
ttctctcatctcttagctcccct

SEQ ID NO: 1623978 - DNA, 14 bp, Homo sapiens
ttctctcctcccca

SEQ ID NO: 1623979 - DNA, 15 bp, Homo sapiens
ttctctcctccccaa

SEQ ID NO: 1623980 - DNA, 17 bp, Homo sapiens
ttctctcctccccaaat

SEQ ID NO: 1623981 - DNA, 12 bp, Homo sapiens
ttctctctccac

SEQ ID NO: 1623982 - DNA, 20 bp, Homo sapiens
ctcatggcttttgctttccc

SEQ ID NO: 1623983 - DNA, 15 bp, Homo sapiens
ctcatgggtggcact

SEQ ID NO: 1623984 - DNA, 11 bp, Homo sapiens
ctcatgtaaca

SEQ ID NO: 1623985 - DNA, 12 bp, Homo sapiens
ctcatgtaacat

SEQ ID NO: 1623986 - DNA, 16 bp, Homo sapiens
ctcatgtacataccct

SEQ ID NO: 1623987 - DNA, 12 bp, Homo sapiens
ctcatgtggctg

SEQ ID NO: 1623988 - DNA, 14 bp, Homo sapiens
ctcatgtggctgga

SEQ ID NO: 1623989 - DNA, 16 bp, Homo sapiens
ctcatgtgtgcaacag

SEQ ID NO: 1623990 - DNA, 21 bp, Homo sapiens
ctcatgttttttccttttcac

SEQ ID NO: 1623991 - DNA, 17 bp, Homo sapiens
ctcattaaaagaatatc

SEQ ID NO: 1623992 - DNA, 13 bp, Homo sapiens
ctcattaatagct

SEQ ID NO: 1623993 - DNA, 15 bp, Homo sapiens
ctcattaatagctgc

SEQ ID NO: 1623994 - DNA, 15 bp, Homo sapiens
ctcattacagttctt

SEQ ID NO: 1623995 - DNA, 17 bp, Homo sapiens
ctcattaggttttgctt

SEQ ID NO: 1623996 - DNA, 17 bp, Homo sapiens
ctcattatgttgatact

SEQ ID NO: 1623997 - DNA, 15 bp, Homo sapiens
ctcattcaaaagttg

SEQ ID NO: 1623998 - DNA, 15 bp, Homo sapiens
ctcattcagtattaa

SEQ ID NO: 1623999 - DNA, 17 bp, Homo sapiens
ctcattcagtattaaag

SEQ ID NO: 1624000 - DNA, 19 bp, Homo sapiens
ctcattcagtattaaaggg

SEQ ID NO: 1624001 - DNA, 15 bp, Homo sapiens
ctcattccagaggaa

SEQ ID NO: 1624002 - DNA, 21 bp, Homo sapiens
ctcattcccaacgtgcaaagc

SEQ ID NO: 1624003 - DNA, 17 bp, Homo sapiens
ctcattcgcctttgtct

SEQ ID NO: 1624004 - DNA, 22 bp, Homo sapiens
ctcattcgcctttgtcttgtac

SEQ ID NO: 1624005 - DNA, 18 bp, Homo sapiens
ctcattctgaattaatta

SEQ ID NO: 1624006 - DNA, 19 bp, Homo sapiens
ctcattctttgaacatgaa

SEQ ID NO: 1624007 - DNA, 14 bp, Homo sapiens
ctcattgcctcctg

SEQ ID NO: 1624008 - DNA, 15 bp, Homo sapiens
ctcattgcctcctgt

SEQ ID NO: 1624009 - DNA, 19 bp, Homo sapiens
ctcattgctgagcctctgc

SEQ ID NO: 1624010 - DNA, 14 bp, Homo sapiens
ctcatttcacccct

SEQ ID NO: 1624011 - DNA, 21 bp, Homo sapiens
ctcatttgagataaagtcaaa

SEQ ID NO: 1624012 - DNA, 20 bp, Homo sapiens
ctcatttggtctgccagaat

SEQ ID NO: 1624013 - DNA, 22 bp, Homo sapiens
ctcatttggtctgccagaatac

SEQ ID NO: 1624014 - DNA, 14 bp, Homo sapiens
ctcattttctggtt

SEQ ID NO: 1624015 - DNA, 13 bp, Homo sapiens
ctccaaacctcca

SEQ ID NO: 1624016 - DNA, 14 bp, Homo sapiens
ctccaaacctccag

SEQ ID NO: 1624017 - DNA, 15 bp, Homo sapiens
ctccaaacctgtctt

SEQ ID NO: 1624018 - DNA, 22 bp, Homo sapiens
ctccaaactgaagcagcctctc

SEQ ID NO: 1624019 - DNA, 15 bp, Homo sapiens
ctccaaactgattaa

SEQ ID NO: 1624020 - DNA, 20 bp, Homo sapiens
ctccaaagagccttcagaat

SEQ ID NO: 1624021 - DNA, 20 bp, Homo sapiens
ctccaaaggggctgctgggg

SEQ ID NO: 1624022 - DNA, 19 bp, Homo sapiens
ctccaacatcacagcccag

SEQ ID NO: 1624023 - DNA, 22 bp, Homo sapiens
ctccaaccaaataagacttcca

SEQ ID NO: 1624024 - DNA, 15 bp, Homo sapiens
ctccaaccactgtgc

SEQ ID NO: 1624025 - DNA, 19 bp, Homo sapiens
ctccaaccactgtgccact

SEQ ID NO: 1624026 - DNA, 15 bp, Homo sapiens
ctccaaccccccagc

SEQ ID NO: 1624027 - DNA, 17 bp, Homo sapiens
ctccaaccccccagcac

SEQ ID NO: 1624028 - DNA, 18 bp, Homo sapiens
ctccaaccccccagcact

SEQ ID NO: 1624029 - DNA, 20 bp, Homo sapiens
ctccaaccccccagcactga

SEQ ID NO: 1624030 - DNA, 23 bp, Homo sapiens
ctccaaccccccagcactgagga

SEQ ID NO: 1624031 - DNA, 20 bp, Homo sapiens
ctccaacgcccctgtggcca

SEQ ID NO: 1624032 - DNA, 21 bp, Homo sapiens
ctccaactcctttcagccaca

SEQ ID NO: 1624033 - DNA, 22 bp, Homo sapiens
ctccaactcctttcagccacat

SEQ ID NO: 1624034 - DNA, 23 bp, Homo sapiens
ctccaagaatggaagcctgaact

SEQ ID NO: 1624035 - DNA, 12 bp, Homo sapiens
ctccaagattct

SEQ ID NO: 1624036 - DNA, 13 bp, Homo sapiens
ctccaagattcta

SEQ ID NO: 1624037 - DNA, 14 bp, Homo sapiens
ctccaagattctag

SEQ ID NO: 1624038 - DNA, 16 bp, Homo sapiens
ctccaagattctagat

SEQ ID NO: 1624039 - DNA, 17 bp, Homo sapiens
ctccaagattctagatg

SEQ ID NO: 1624040 - DNA, 13 bp, Homo sapiens
ctccaagcatcac

SEQ ID NO: 1624041 - DNA, 14 bp, Homo sapiens
ctccaagcatttca

SEQ ID NO: 1624042 - DNA, 15 bp, Homo sapiens
ctccaagcatttcat

SEQ ID NO: 1624043 - DNA, 22 bp, Homo sapiens
ctccaagcatttcatgaaaaag

SEQ ID NO: 1624044 - DNA, 17 bp, Homo sapiens
ctccaagccccatcttc

SEQ ID NO: 1624045 - DNA, 15 bp, Homo sapiens
ctccaaggactaagg

SEQ ID NO: 1624046 - DNA, 19 bp, Homo sapiens
ctccaaggactaaggcctc

SEQ ID NO: 1624047 - DNA, 19 bp, Homo sapiens
ctccaaggaggggctgtaa

SEQ ID NO: 1624048 - DNA, 20 bp, Homo sapiens
ctccaagggcttctgcaccc

SEQ ID NO: 1624049 - DNA, 20 bp, Homo sapiens
ctccaaggggaatcagaact

SEQ ID NO: 1624050 - DNA, 22 bp, Homo sapiens
ctccaagggtttcgactggtcc

SEQ ID NO: 1624051 - DNA, 23 bp, Homo sapiens
ctccaagggtttcgactggtcca

SEQ ID NO: 1624052 - DNA, 18 bp, Homo sapiens
ctccaaggtgatgttgta

SEQ ID NO: 1624053 - DNA, 22 bp, Homo sapiens
ctccaagtgccagaggtgggca

SEQ ID NO: 1624054 - DNA, 16 bp, Homo sapiens
ctccaatatcagtgct

SEQ ID NO: 1624055 - DNA, 17 bp, Homo sapiens
ctccaatgcattggcct

SEQ ID NO: 1624056 - DNA, 20 bp, Homo sapiens
ctccaatgcattggcctctg

SEQ ID NO: 1624057 - DNA, 22 bp, Homo sapiens
ctccaatgcattggcctctgta

SEQ ID NO: 1624058 - DNA, 18 bp, Homo sapiens
ctccaatggggccagcac

SEQ ID NO: 1624059 - DNA, 19 bp, Homo sapiens
ctccaatggggccagcact

SEQ ID NO: 1624060 - DNA, 14 bp, Homo sapiens
ctccacacagcagt

SEQ ID NO: 1624061 - DNA, 22 bp, Homo sapiens
ctccacacagcagtgtcccctg

SEQ ID NO: 1624062 - DNA, 15 bp, Homo sapiens
ctccacacatctttc

SEQ ID NO: 1624063 - DNA, 17 bp, Homo sapiens
ctccacacatctttctt

SEQ ID NO: 1624064 - DNA, 20 bp, Homo sapiens
ctccacaccctctcccagga

SEQ ID NO: 1624065 - DNA, 13 bp, Homo sapiens
ctccacacctgaa

SEQ ID NO: 1624066 - DNA, 12 bp, Homo sapiens
ctccacaccttt

SEQ ID NO: 1624067 - DNA, 14 bp, Homo sapiens
ctccacactccact

SEQ ID NO: 1624068 - DNA, 15 bp, Homo sapiens
ctccacactccactg

SEQ ID NO: 1624069 - DNA, 16 bp, Homo sapiens
ctccacactccactga

SEQ ID NO: 1624070 - DNA, 14 bp, Homo sapiens
ctccacactgacca

SEQ ID NO: 1624071 - DNA, 14 bp, Homo sapiens
ctccacagagagga

SEQ ID NO: 1624072 - DNA, 16 bp, Homo sapiens
ctccacagagaggagg

SEQ ID NO: 1624073 - DNA, 21 bp, Homo sapiens
ctccacagccccaacctccca

SEQ ID NO: 1624074 - DNA, 15 bp, Homo sapiens
ctccacagccgcagc

SEQ ID NO: 1624075 - DNA, 20 bp, Homo sapiens
ctccacagcgagggcagctg

SEQ ID NO: 1624076 - DNA, 22 bp, Homo sapiens
ctccacagcgagggcagctgct

SEQ ID NO: 1624077 - DNA, 15 bp, Homo sapiens
ctccacagctacctc

SEQ ID NO: 1624078 - DNA, 14 bp, Homo sapiens
ctccacagctgcag

SEQ ID NO: 1624079 - DNA, 12 bp, Homo sapiens
ctccacagtgct

SEQ ID NO: 1624080 - DNA, 22 bp, Homo sapiens
ctccacatcctttctaaacaag

SEQ ID NO: 1624081 - DNA, 16 bp, Homo sapiens
ctccacatctgcctta

SEQ ID NO: 1624082 - DNA, 15 bp, Homo sapiens
ctccaccaccactgg

SEQ ID NO: 1624083 - DNA, 23 bp, Homo sapiens
ctccaccaccactggccaccagg

SEQ ID NO: 1624084 - DNA, 10 bp, Homo sapiens
ctccaccagc

SEQ ID NO: 1624085 - DNA, 22 bp, Homo sapiens
ctccaccagcctgctgacagac

SEQ ID NO: 1624086 - DNA, 15 bp, Homo sapiens
ctccaccatccccac

SEQ ID NO: 1624087 - DNA, 17 bp, Homo sapiens
ctccaccatccccaccc

SEQ ID NO: 1624088 - DNA, 21 bp, Homo sapiens
ctccacccataataagagaat

SEQ ID NO: 1624089 - DNA, 18 bp, Homo sapiens
ctccaccccacagaacct

SEQ ID NO: 1624090 - DNA, 16 bp, Homo sapiens
ctccaccccccagaac

SEQ ID NO: 1624091 - DNA, 20 bp, Homo sapiens
ctccacccccgccacggcca

SEQ ID NO: 1624092 - DNA, 23 bp, Homo sapiens
ctccacccccgccacggccaccc

SEQ ID NO: 1624093 - DNA, 21 bp, Homo sapiens
ctccaccctccggccagcgag

SEQ ID NO: 1624094 - DNA, 13 bp, Homo sapiens
ctccaccctgcat

SEQ ID NO: 1624095 - DNA, 20 bp, Homo sapiens
ctccaccctgcattttcctc

SEQ ID NO: 1624096 - DNA, 14 bp, Homo sapiens
ctccaccctgtccc

SEQ ID NO: 1624097 - DNA, 15 bp, Homo sapiens
ctccaccctgtcccc

SEQ ID NO: 1624098 - DNA, 23 bp, Homo sapiens
ctccaccctgtcccccagctctg

SEQ ID NO: 1624099 - DNA, 18 bp, Homo sapiens
ttctctctccagggtgct

SEQ ID NO: 1624100 - DNA, 13 bp, Homo sapiens
ttctctctctctc

SEQ ID NO: 1624101 - DNA, 15 bp, Homo sapiens
ttctctctctctcac

SEQ ID NO: 1624102 - DNA, 21 bp, Homo sapiens
ttctctctgcctgtgagccag

SEQ ID NO: 1624103 - DNA, 15 bp, Homo sapiens
ttctctctggcttct

SEQ ID NO: 1624104 - DNA, 10 bp, Homo sapiens
ttctctcttt

SEQ ID NO: 1624105 - DNA, 18 bp, Homo sapiens
ttctctctttatacagct

SEQ ID NO: 1624106 - DNA, 14 bp, Homo sapiens
ttctctcttttcct

SEQ ID NO: 1624107 - DNA, 14 bp, Homo sapiens
ttctctgcaacact

SEQ ID NO: 1624108 - DNA, 12 bp, Homo sapiens
ttctctgccagt

SEQ ID NO: 1624109 - DNA, 13 bp, Homo sapiens
ttctctgccagtg

SEQ ID NO: 1624110 - DNA, 21 bp, Homo sapiens
ttctctgccgctacctccctc

SEQ ID NO: 1624111 - DNA, 21 bp, Homo sapiens
ttctctgcttacccttcacct

SEQ ID NO: 1624112 - DNA, 17 bp, Homo sapiens
ttctctgggctgaatgt

SEQ ID NO: 1624113 - DNA, 19 bp, Homo sapiens
ttctctggtggtcttcctt

SEQ ID NO: 1624114 - DNA, 21 bp, Homo sapiens
ttctctgtaagtgtagctcaa

SEQ ID NO: 1624115 - DNA, 18 bp, Homo sapiens
ttctctgtcctacttctg

SEQ ID NO: 1624116 - DNA, 16 bp, Homo sapiens
ttctctgtgctctgaa

SEQ ID NO: 1624117 - DNA, 16 bp, Homo sapiens
ttctctgtgtctaaga

SEQ ID NO: 1624118 - DNA, 16 bp, Homo sapiens
ttctctgttgtcaaac

SEQ ID NO: 1624119 - DNA, 22 bp, Homo sapiens
ttctcttagaaaaggtgataaa

SEQ ID NO: 1624120 - DNA, 18 bp, Homo sapiens
ttctcttagctactgtat

SEQ ID NO: 1624121 - DNA, 21 bp, Homo sapiens
ttctcttaggtggctctggga

SEQ ID NO: 1624122 - DNA, 18 bp, Homo sapiens
ttctcttatcctctctct

SEQ ID NO: 1624123 - DNA, 22 bp, Homo sapiens
ttctcttccccttcctgtttca

SEQ ID NO: 1624124 - DNA, 13 bp, Homo sapiens
ttctcttcctaaa

SEQ ID NO: 1624125 - DNA, 17 bp, Homo sapiens
ttctcttcgctgtgatg

SEQ ID NO: 1624126 - DNA, 12 bp, Homo sapiens
ttctcttctagg

SEQ ID NO: 1624127 - DNA, 18 bp, Homo sapiens
ttctcttgagtcacactg

SEQ ID NO: 1624128 - DNA, 13 bp, Homo sapiens
ttctcttgcattg

SEQ ID NO: 1624129 - DNA, 14 bp, Homo sapiens
ttctctttaaaata

SEQ ID NO: 1624130 - DNA, 18 bp, Homo sapiens
ttctctttaccttctaaa

SEQ ID NO: 1624131 - DNA, 19 bp, Homo sapiens
ttctctttaccttctaaaa

SEQ ID NO: 1624132 - DNA, 13 bp, Homo sapiens
ttctctttccttg

SEQ ID NO: 1624133 - DNA, 22 bp, Homo sapiens
ttctctttccttggctcccatt

SEQ ID NO: 1624134 - DNA, 11 bp, Homo sapiens
ttctctttgat

SEQ ID NO: 1624135 - DNA, 15 bp, Homo sapiens
ttctctttggaaata

SEQ ID NO: 1624136 - DNA, 23 bp, Homo sapiens
ttctctttggaaatagcatgaca

SEQ ID NO: 1624137 - DNA, 12 bp, Homo sapiens
ttctctttgggt

SEQ ID NO: 1624138 - DNA, 20 bp, Homo sapiens
ttctcttttcccctttcctg

SEQ ID NO: 1624139 - DNA, 22 bp, Homo sapiens
ttctcttttcccctttcctgtc

SEQ ID NO: 1624140 - DNA, 17 bp, Homo sapiens
ttctcttttctttctgt

SEQ ID NO: 1624141 - DNA, 13 bp, Homo sapiens
ttctgaaaactga

SEQ ID NO: 1624142 - DNA, 17 bp, Homo sapiens
ttctgaaaactgaatgt

SEQ ID NO: 1624143 - DNA, 16 bp, Homo sapiens
ttctgaaaattccaga

SEQ ID NO: 1624144 - DNA, 15 bp, Homo sapiens
ttctgaaacacacga

SEQ ID NO: 1624145 - DNA, 23 bp, Homo sapiens
ttctgaacaatggggactttgtt

SEQ ID NO: 1624146 - DNA, 21 bp, Homo sapiens
ttctgaaccagaattacatgt

SEQ ID NO: 1624147 - DNA, 15 bp, Homo sapiens
ttctgaactccattt

SEQ ID NO: 1624148 - DNA, 16 bp, Homo sapiens
ttctgaactctgacag

SEQ ID NO: 1624149 - DNA, 22 bp, Homo sapiens
ttctgaactgttacaacttgta

SEQ ID NO: 1624150 - DNA, 15 bp, Homo sapiens
ttccttttgatgggg

SEQ ID NO: 1624151 - DNA, 20 bp, Homo sapiens
ttccttttgatggggagaaa

SEQ ID NO: 1624152 - DNA, 21 bp, Homo sapiens
ttccttttgatggggagaaag

SEQ ID NO: 1624153 - DNA, 20 bp, Homo sapiens
ttccttttggaacatttctt

SEQ ID NO: 1624154 - DNA, 17 bp, Homo sapiens
ttccttttgtgtacagt

SEQ ID NO: 1624155 - DNA, 15 bp, Homo sapiens
ttcctttttgacact

SEQ ID NO: 1624156 - DNA, 16 bp, Homo sapiens
ttcctttttgacactg

SEQ ID NO: 1624157 - DNA, 18 bp, Homo sapiens
ttcctttttgacactgaa

SEQ ID NO: 1624158 - DNA, 14 bp, Homo sapiens
ttcctttttttgta

SEQ ID NO: 1624159 - DNA, 20 bp, Homo sapiens
ttcgaaaagcactttgaaaa

SEQ ID NO: 1624160 - DNA, 12 bp, Homo sapiens
ttcgaaaggcct

SEQ ID NO: 1624161 - DNA, 15 bp, Homo sapiens
ttcgaaaggccttca

SEQ ID NO: 1624162 - DNA, 22 bp, Homo sapiens
ttcgaagccttgcctaaattta

SEQ ID NO: 1624163 - DNA, 18 bp, Homo sapiens
ttcgactggtccagctct

SEQ ID NO: 1624164 - DNA, 19 bp, Homo sapiens
ttcgactggtccagctctg

SEQ ID NO: 1624165 - DNA, 22 bp, Homo sapiens
ttcgactggtccagctctgaca

SEQ ID NO: 1624166 - DNA, 18 bp, Homo sapiens
ttcgagaccaacctgacc

SEQ ID NO: 1624167 - DNA, 16 bp, Homo sapiens
ttcgagaccagcctgg

SEQ ID NO: 1624168 - DNA, 20 bp, Homo sapiens
ttcgatacaccgggcctgga

SEQ ID NO: 1624169 - DNA, 23 bp, Homo sapiens
ttcgatacccaggaccaagccac

SEQ ID NO: 1624170 - DNA, 18 bp, Homo sapiens
ttcgatctcattcagtat

SEQ ID NO: 1624171 - DNA, 16 bp, Homo sapiens
ttcgccccctgcctgc

SEQ ID NO: 1624172 - DNA, 17 bp, Homo sapiens
ttcgccccctgcctgcc

SEQ ID NO: 1624173 - DNA, 14 bp, Homo sapiens
ttcgccttaaactc

SEQ ID NO: 1624174 - DNA, 14 bp, Homo sapiens
ttcgctgctctagc

SEQ ID NO: 1624175 - DNA, 20 bp, Homo sapiens
ttcgctggactattgtgcca

SEQ ID NO: 1624176 - DNA, 23 bp, Homo sapiens
ttcgctggactattgtgccaact

SEQ ID NO: 1624177 - DNA, 18 bp, Homo sapiens
ttcgctgtcccctcagcg

SEQ ID NO: 1624178 - DNA, 20 bp, Homo sapiens
ttcggaaggggttcctcaaa

SEQ ID NO: 1624179 - DNA, 17 bp, Homo sapiens
ttcggacagacatatgg

SEQ ID NO: 1624180 - DNA, 12 bp, Homo sapiens
ttcgggctgtgc

SEQ ID NO: 1624181 - DNA, 17 bp, Homo sapiens
ttcggggaactcctgga

SEQ ID NO: 1624182 - DNA, 18 bp, Homo sapiens
ttcggggaagctgcacat

SEQ ID NO: 1624183 - DNA, 16 bp, Homo sapiens
ttcggtttctgagcat

SEQ ID NO: 1624184 - DNA, 13 bp, Homo sapiens
ttcgtaacacagc

SEQ ID NO: 1624185 - DNA, 16 bp, Homo sapiens
ttcgtaatagctcaga

SEQ ID NO: 1624186 - DNA, 12 bp, Homo sapiens
ttcgtctactgc

SEQ ID NO: 1624187 - DNA, 13 bp, Homo sapiens
ttcgtcttctaat

SEQ ID NO: 1624188 - DNA, 19 bp, Homo sapiens
ttcgtgctgtgctctggca

SEQ ID NO: 1624189 - DNA, 21 bp, Homo sapiens
ttcgtgtctctcccaccccgg

SEQ ID NO: 1624190 - DNA, 14 bp, Homo sapiens
ttctaaaaaaagaa

SEQ ID NO: 1624191 - DNA, 18 bp, Homo sapiens
ttctaaaaattgtgatca

SEQ ID NO: 1624192 - DNA, 19 bp, Homo sapiens
ttctaaaacaataaagatt

SEQ ID NO: 1624193 - DNA, 12 bp, Homo sapiens
ttctaaaagcca

SEQ ID NO: 1624194 - DNA, 15 bp, Homo sapiens
ttctaaaagtttcta

SEQ ID NO: 1624195 - DNA, 22 bp, Homo sapiens
ttctaaaatcttatagttctag

SEQ ID NO: 1624196 - DNA, 16 bp, Homo sapiens
ttctaaacaagatttt

SEQ ID NO: 1624197 - DNA, 16 bp, Homo sapiens
ttctaaagattctata

SEQ ID NO: 1624198 - DNA, 23 bp, Homo sapiens
ttctaaagattctatagttctag

SEQ ID NO: 1624199 - DNA, 23 bp, Homo sapiens
ttctaaaggtaccaaacaaggaa

SEQ ID NO: 1624200 - DNA, 18 bp, Homo sapiens
tgatccatccatctccag

SEQ ID NO: 1624201 - DNA, 23 bp, Homo sapiens
tgatcccaccccctcctccccca

SEQ ID NO: 1624202 - DNA, 19 bp, Homo sapiens
tgatccctgaacccctggc

SEQ ID NO: 1624203 - DNA, 21 bp, Homo sapiens
tgatccctgaacccctggcca

SEQ ID NO: 1624204 - DNA, 23 bp, Homo sapiens
tgatccctgaacccctggccagc

SEQ ID NO: 1624205 - DNA, 19 bp, Homo sapiens
tgatccctgtgttgtctct

SEQ ID NO: 1624206 - DNA, 20 bp, Homo sapiens
tgatccctgtgttgtctcta

SEQ ID NO: 1624207 - DNA, 19 bp, Homo sapiens
tgatccgcctacctcagcc

SEQ ID NO: 1624208 - DNA, 12 bp, Homo sapiens
tgatccgcctgc

SEQ ID NO: 1624209 - DNA, 17 bp, Homo sapiens
tgatccgcctgcctctg

SEQ ID NO: 1624210 - DNA, 21 bp, Homo sapiens
tgatccgcctgcctctgcctc

SEQ ID NO: 1624211 - DNA, 17 bp, Homo sapiens
tgatcctccaacttcat

SEQ ID NO: 1624212 - DNA, 21 bp, Homo sapiens
tgatcctgcggagaacaccct

SEQ ID NO: 1624213 - DNA, 20 bp, Homo sapiens
tgatcctgctccagcagcac

SEQ ID NO: 1624214 - DNA, 17 bp, Homo sapiens
tgatcctggaggcccag

SEQ ID NO: 1624215 - DNA, 18 bp, Homo sapiens
tgatcctgttctgcgctg

SEQ ID NO: 1624216 - DNA, 18 bp, Homo sapiens
tgatccttccacctcagt

SEQ ID NO: 1624217 - DNA, 16 bp, Homo sapiens
tgatccttcccctctt

SEQ ID NO: 1624218 - DNA, 15 bp, Homo sapiens
tgatccttggtgctg

SEQ ID NO: 1624219 - DNA, 17 bp, Homo sapiens
tgatccttggtgctgtg

SEQ ID NO: 1624220 - DNA, 20 bp, Homo sapiens
tgatccttggtgctgtgtgc

SEQ ID NO: 1624221 - DNA, 17 bp, Homo sapiens
tgatctaataaacttta

SEQ ID NO: 1624222 - DNA, 22 bp, Homo sapiens
tgatctagtccttgtcttgtaa

SEQ ID NO: 1624223 - DNA, 14 bp, Homo sapiens
tgatctattgctca

SEQ ID NO: 1624224 - DNA, 15 bp, Homo sapiens
tgatctcaagtatat

SEQ ID NO: 1624225 - DNA, 19 bp, Homo sapiens
tgatctcagctcactgcaa

SEQ ID NO: 1624226 - DNA, 12 bp, Homo sapiens
tgatctcaggga

SEQ ID NO: 1624227 - DNA, 14 bp, Homo sapiens
tgatctcagggaag

SEQ ID NO: 1624228 - DNA, 15 bp, Homo sapiens
tgatctcagggcaga

SEQ ID NO: 1624229 - DNA, 16 bp, Homo sapiens
tgatctccatatgtta

SEQ ID NO: 1624230 - DNA, 18 bp, Homo sapiens
tgatctcggatgaccaaa

SEQ ID NO: 1624231 - DNA, 18 bp, Homo sapiens
tgatctctactaccacaa

SEQ ID NO: 1624232 - DNA, 16 bp, Homo sapiens
tgatctctcttgtcct

SEQ ID NO: 1624233 - DNA, 23 bp, Homo sapiens
tgatctgcccacctcggcctccc

SEQ ID NO: 1624234 - DNA, 22 bp, Homo sapiens
cctactgcactttcccccttcc

SEQ ID NO: 1624235 - DNA, 12 bp, Homo sapiens
cctactgcccac

SEQ ID NO: 1624236 - DNA, 14 bp, Homo sapiens
cctactgtcctcag

SEQ ID NO: 1624237 - DNA, 13 bp, Homo sapiens
cctactgtgtctt

SEQ ID NO: 1624238 - DNA, 13 bp, Homo sapiens
cctactgttctaa

SEQ ID NO: 1624239 - DNA, 16 bp, Homo sapiens
cctactgttctaaagc

SEQ ID NO: 1624240 - DNA, 17 bp, Homo sapiens
cctacttctgactttac

SEQ ID NO: 1624241 - DNA, 15 bp, Homo sapiens
cctactttgactttt

SEQ ID NO: 1624242 - DNA, 21 bp, Homo sapiens
cctactttgactttttgcatt

SEQ ID NO: 1624243 - DNA, 22 bp, Homo sapiens
cctagaaattgaacaaaaatgt

SEQ ID NO: 1624244 - DNA, 23 bp, Homo sapiens
cctagaaccaagcttcagagcct

SEQ ID NO: 1624245 - DNA, 22 bp, Homo sapiens
cctagaagaaccaaatacctca

SEQ ID NO: 1624246 - DNA, 19 bp, Homo sapiens
cctagaagtctccctgcac

SEQ ID NO: 1624247 - DNA, 19 bp, Homo sapiens
cctagaagttactgaatgc

SEQ ID NO: 1624248 - DNA, 11 bp, Homo sapiens
cctagaatgtc

SEQ ID NO: 1624249 - DNA, 16 bp, Homo sapiens
cctagacaacctttct

SEQ ID NO: 1624250 - DNA, 18 bp, Homo sapiens
cctagacaacctttctgt

SEQ ID NO: 1624251 - DNA, 23 bp, Homo sapiens
cctagacaacctttctgtagcct

SEQ ID NO: 1624252 - DNA, 13 bp, Homo sapiens
cctagaccagcag

SEQ ID NO: 1624253 - DNA, 16 bp, Homo sapiens
cctagaccctcctcct

SEQ ID NO: 1624254 - DNA, 14 bp, Homo sapiens
cctagactgttact

SEQ ID NO: 1624255 - DNA, 19 bp, Homo sapiens
cctagagacagtgatgcct

SEQ ID NO: 1624256 - DNA, 15 bp, Homo sapiens
cctagagagaataaa

SEQ ID NO: 1624257 - DNA, 17 bp, Homo sapiens
cctagaggcgagccagg

SEQ ID NO: 1624258 - DNA, 17 bp, Homo sapiens
cctagaggtgggcagct

SEQ ID NO: 1624259 - DNA, 17 bp, Homo sapiens
cctagatccacacacag

SEQ ID NO: 1624260 - DNA, 18 bp, Homo sapiens
cctagatctgcaggctgc

SEQ ID NO: 1624261 - DNA, 22 bp, Homo sapiens
cctagatctgcaggctgcacct

SEQ ID NO: 1624262 - DNA, 20 bp, Homo sapiens
cctagatgcacgtggggccc

SEQ ID NO: 1624263 - DNA, 22 bp, Homo sapiens
cctagatgtttaacaaatctaa

SEQ ID NO: 1624264 - DNA, 23 bp, Homo sapiens
cctagattaggtagactttgctt

SEQ ID NO: 1624265 - DNA, 17 bp, Homo sapiens
cctagcagcccaccctg

SEQ ID NO: 1624266 - DNA, 13 bp, Homo sapiens
cctagcagcctca

SEQ ID NO: 1624267 - DNA, 13 bp, Homo sapiens
cctagcaggcaca

SEQ ID NO: 1624268 - DNA, 14 bp, Homo sapiens
cctagcaggcacag

SEQ ID NO: 1624269 - DNA, 17 bp, Homo sapiens
cctagcaggcacaggac

SEQ ID NO: 1624270 - DNA, 12 bp, Homo sapiens
cctagcagtgaa

SEQ ID NO: 1624271 - DNA, 21 bp, Homo sapiens
cctagccacctcccaccccac

SEQ ID NO: 1624272 - DNA, 15 bp, Homo sapiens
cctagccattcctgg

SEQ ID NO: 1624273 - DNA, 13 bp, Homo sapiens
cctagccctggga

SEQ ID NO: 1624274 - DNA, 15 bp, Homo sapiens
cctagccctgggaca

SEQ ID NO: 1624275 - DNA, 13 bp, Homo sapiens
ttccctgctgaat

SEQ ID NO: 1624276 - DNA, 13 bp, Homo sapiens
ttccctgcttcca

SEQ ID NO: 1624277 - DNA, 22 bp, Homo sapiens
ttccctggaaaccttccaccca

SEQ ID NO: 1624278 - DNA, 20 bp, Homo sapiens
ttccctggaactcctggcct

SEQ ID NO: 1624279 - DNA, 23 bp, Homo sapiens
ttccctggaagctctccgagctc

SEQ ID NO: 1624280 - DNA, 18 bp, Homo sapiens
ttccctggacaggcagcc

SEQ ID NO: 1624281 - DNA, 18 bp, Homo sapiens
ttccctggaggagaagta

SEQ ID NO: 1624282 - DNA, 23 bp, Homo sapiens
ttccctggcttgtaactccacca

SEQ ID NO: 1624283 - DNA, 11 bp, Homo sapiens
ttccctgggag

SEQ ID NO: 1624284 - DNA, 12 bp, Homo sapiens
ttccctgggagg

SEQ ID NO: 1624285 - DNA, 15 bp, Homo sapiens
ttcccttattcctaa

SEQ ID NO: 1624286 - DNA, 20 bp, Homo sapiens
ttcccttattgcctcccagg

SEQ ID NO: 1624287 - DNA, 11 bp, Homo sapiens
ttcccttccaa

SEQ ID NO: 1624288 - DNA, 14 bp, Homo sapiens
ttcccttccaaaga

SEQ ID NO: 1624289 - DNA, 18 bp, Homo sapiens
ttcccttcccagaccagg

SEQ ID NO: 1624290 - DNA, 15 bp, Homo sapiens
ttcccttcctcttcc

SEQ ID NO: 1624291 - DNA, 13 bp, Homo sapiens
ttcccttctccct

SEQ ID NO: 1624292 - DNA, 19 bp, Homo sapiens
ttcccttctctggtctcct

SEQ ID NO: 1624293 - DNA, 14 bp, Homo sapiens
ttcccttgaaactt

SEQ ID NO: 1624294 - DNA, 14 bp, Homo sapiens
ttcccttgagccct

SEQ ID NO: 1624295 - DNA, 22 bp, Homo sapiens
ttcccttgcaggggtcccccct

SEQ ID NO: 1624296 - DNA, 12 bp, Homo sapiens
ttcccttggcct

SEQ ID NO: 1624297 - DNA, 14 bp, Homo sapiens
ttcccttggcctca

SEQ ID NO: 1624298 - DNA, 14 bp, Homo sapiens
ttcccttggctgtt

SEQ ID NO: 1624299 - DNA, 17 bp, Homo sapiens
ttcccttgtgtcaagac

SEQ ID NO: 1624300 - DNA, 15 bp, Homo sapiens
ttccctttccttcca

SEQ ID NO: 1624301 - DNA, 19 bp, Homo sapiens
ttcccttttacatactgct

SEQ ID NO: 1624302 - DNA, 21 bp, Homo sapiens
ttcccttttacatactgctgt

SEQ ID NO: 1624303 - DNA, 22 bp, Homo sapiens
ttccgaagaagatgctccagca

SEQ ID NO: 1624304 - DNA, 12 bp, Homo sapiens
ttccgacatccc

SEQ ID NO: 1624305 - DNA, 16 bp, Homo sapiens
ttccgatcaacattta

SEQ ID NO: 1624306 - DNA, 17 bp, Homo sapiens
ttccgatcaacatttat

SEQ ID NO: 1624307 - DNA, 22 bp, Homo sapiens
ttccgcccccgccccacagggc

SEQ ID NO: 1624308 - DNA, 22 bp, Homo sapiens
ttccgctttgaaagaagcaaga

SEQ ID NO: 1624309 - DNA, 21 bp, Homo sapiens
ttccgtcaccacgactggcca

SEQ ID NO: 1624310 - DNA, 17 bp, Homo sapiens
ttccgttgtacatgttc

SEQ ID NO: 1624311 - DNA, 15 bp, Homo sapiens
ttcctaaacataatt

SEQ ID NO: 1624312 - DNA, 16 bp, Homo sapiens
ttcctaaacataattg

SEQ ID NO: 1624313 - DNA, 14 bp, Homo sapiens
ttcctaacacagca

SEQ ID NO: 1624314 - DNA, 17 bp, Homo sapiens
ttcctaacctgtcagaa

SEQ ID NO: 1624315 - DNA, 16 bp, Homo sapiens
ctcagggtccagaccc

SEQ ID NO: 1624316 - DNA, 17 bp, Homo sapiens
ctcagggtccagaccct

SEQ ID NO: 1624317 - DNA, 17 bp, Homo sapiens
ctcaggtacggagaaga

SEQ ID NO: 1624318 - DNA, 19 bp, Homo sapiens
ctcaggtgatcaaaataaa

SEQ ID NO: 1624319 - DNA, 18 bp, Homo sapiens
ctcaggtgccactccctg

SEQ ID NO: 1624320 - DNA, 23 bp, Homo sapiens
ctcaggtgccactccctgagctt

SEQ ID NO: 1624321 - DNA, 13 bp, Homo sapiens
ctcaggtgcctta

SEQ ID NO: 1624322 - DNA, 22 bp, Homo sapiens
ctcaggtggccagcctggatct

SEQ ID NO: 1624323 - DNA, 14 bp, Homo sapiens
ctcaggtgttgcca

SEQ ID NO: 1624324 - DNA, 12 bp, Homo sapiens
ctcaggttccag

SEQ ID NO: 1624325 - DNA, 16 bp, Homo sapiens
ctcaggttccagaaca

SEQ ID NO: 1624326 - DNA, 18 bp, Homo sapiens
ctcaggttccagaacagc

SEQ ID NO: 1624327 - DNA, 13 bp, Homo sapiens
ctcaggttccttt

SEQ ID NO: 1624328 - DNA, 22 bp, Homo sapiens
ctcaggttgtctgaagtcactg

SEQ ID NO: 1624329 - DNA, 16 bp, Homo sapiens
ctcagtaaagcacttg

SEQ ID NO: 1624330 - DNA, 20 bp, Homo sapiens
ctcagtaacatttctgttct

SEQ ID NO: 1624331 - DNA, 16 bp, Homo sapiens
ctcagtagtccctgca

SEQ ID NO: 1624332 - DNA, 22 bp, Homo sapiens
ctcagtatgctttccctgagga

SEQ ID NO: 1624333 - DNA, 18 bp, Homo sapiens
ctcagtctaaggtctcat

SEQ ID NO: 1624334 - DNA, 11 bp, Homo sapiens
ctcagtgcaga

SEQ ID NO: 1624335 - DNA, 14 bp, Homo sapiens
ctcagtgcagcaat

SEQ ID NO: 1624336 - DNA, 22 bp, Homo sapiens
ctcagtgccacttgacattcct

SEQ ID NO: 1624337 - DNA, 23 bp, Homo sapiens
ctcagtgccacttgacattcctt

SEQ ID NO: 1624338 - DNA, 15 bp, Homo sapiens
ctcagtgccttctct

SEQ ID NO: 1624339 - DNA, 16 bp, Homo sapiens
ctcagtgccttctctc

SEQ ID NO: 1624340 - DNA, 15 bp, Homo sapiens
ctcagtggctctggg

SEQ ID NO: 1624341 - DNA, 15 bp, Homo sapiens
ctcagtggggctggc

SEQ ID NO: 1624342 - DNA, 19 bp, Homo sapiens
ctcagtggggctggcatca

SEQ ID NO: 1624343 - DNA, 17 bp, Homo sapiens
ctcagtgtcatttatga

SEQ ID NO: 1624344 - DNA, 18 bp, Homo sapiens
ctcagtgtcatttatgaa

SEQ ID NO: 1624345 - DNA, 15 bp, Homo sapiens
ctcagtgtccagctt

SEQ ID NO: 1624346 - DNA, 21 bp, Homo sapiens
ctcagtgtccagcttccaaag

SEQ ID NO: 1624347 - DNA, 16 bp, Homo sapiens
ctcagtgttagagaaa

SEQ ID NO: 1624348 - DNA, 19 bp, Homo sapiens
ctcagtgttggtatatttt

SEQ ID NO: 1624349 - DNA, 12 bp, Homo sapiens
ctcagtgttttg

SEQ ID NO: 1624350 - DNA, 22 bp, Homo sapiens
ctcagtgttttggactccatct

SEQ ID NO: 1624351 - DNA, 23 bp, Homo sapiens
ctcagtgttttggactccatctc

SEQ ID NO: 1624352 - DNA, 14 bp, Homo sapiens
ctcagttaaaatgt

SEQ ID NO: 1624353 - DNA, 20 bp, Homo sapiens
ctcagttaaaatgtctgttt

SEQ ID NO: 1624354 - DNA, 17 bp, Homo sapiens
ctcagttatgtagtttc

SEQ ID NO: 1624355 - DNA, 18 bp, Homo sapiens
ctcagttcccagctcccc

SEQ ID NO: 1624356 - DNA, 15 bp, Homo sapiens
ctcagttcccttggc

SEQ ID NO: 1624357 - DNA, 17 bp, Homo sapiens
ctcagttcccttggcct

SEQ ID NO: 1624358 - DNA, 18 bp, Homo sapiens
ctcagttcccttggcctc

SEQ ID NO: 1624359 - DNA, 16 bp, Homo sapiens
ctcagttcgaccaaac

SEQ ID NO: 1624360 - DNA, 15 bp, Homo sapiens
ctcagttctctccct

SEQ ID NO: 1624361 - DNA, 20 bp, Homo sapiens
ctcagttgtgactaactaga

SEQ ID NO: 1624362 - DNA, 17 bp, Homo sapiens
ctcagttgtttgcttct

SEQ ID NO: 1624363 - DNA, 17 bp, Homo sapiens
ctcagtttaatccttct

SEQ ID NO: 1624364 - DNA, 16 bp, Homo sapiens
ctcagtttccctatct

SEQ ID NO: 1624365 - DNA, 15 bp, Homo sapiens
ctcagtttcttgctt

SEQ ID NO: 1624366 - DNA, 17 bp, Homo sapiens
ctcagttttatcatttt

SEQ ID NO: 1624367 - DNA, 14 bp, Homo sapiens
ctcagttttccttc

SEQ ID NO: 1624368 - DNA, 20 bp, Homo sapiens
ctcataagttggaccagagg

SEQ ID NO: 1624369 - DNA, 15 bp, Homo sapiens
ctcataatttataca

SEQ ID NO: 1624370 - DNA, 13 bp, Homo sapiens
ctcataccatctg

SEQ ID NO: 1624371 - DNA, 21 bp, Homo sapiens
ctcatacctctgaccaacagg

SEQ ID NO: 1624372 - DNA, 13 bp, Homo sapiens
ctcatactgtctg

SEQ ID NO: 1624373 - DNA, 17 bp, Homo sapiens
ctcatactgtctgggat

SEQ ID NO: 1624374 - DNA, 18 bp, Homo sapiens
ctcatagaggtgagaaaa

SEQ ID NO: 1624375 - DNA, 12 bp, Homo sapiens
ctcataggacct

SEQ ID NO: 1624376 - DNA, 16 bp, Homo sapiens
ctcataggagactgcg

SEQ ID NO: 1624377 - DNA, 16 bp, Homo sapiens
ctcatcaactgaatga

SEQ ID NO: 1624378 - DNA, 18 bp, Homo sapiens
ctcatcaacttaaaagtc

SEQ ID NO: 1624379 - DNA, 21 bp, Homo sapiens
ctcatcaatcaaataagtatt

SEQ ID NO: 1624380 - DNA, 14 bp, Homo sapiens
ctcatcactggact

SEQ ID NO: 1624381 - DNA, 20 bp, Homo sapiens
ctcatcactggactgcatgg

SEQ ID NO: 1624382 - DNA, 15 bp, Homo sapiens
ctcatcataaaataa

SEQ ID NO: 1624383 - DNA, 23 bp, Homo sapiens
ctcatcatattccaacccagcca

SEQ ID NO: 1624384 - DNA, 14 bp, Homo sapiens
ctcatcatttgtgg

SEQ ID NO: 1624385 - DNA, 12 bp, Homo sapiens
ctcatcattttt

SEQ ID NO: 1624386 - DNA, 13 bp, Homo sapiens
ctcatccacccca

SEQ ID NO: 1624387 - DNA, 19 bp, Homo sapiens
ctcatccaccccatccctc

SEQ ID NO: 1624388 - DNA, 13 bp, Homo sapiens
ctcatccccaggg

SEQ ID NO: 1624389 - DNA, 14 bp, Homo sapiens
ctcatccccagggg

SEQ ID NO: 1624390 - DNA, 15 bp, Homo sapiens
ctcatcccccctgct

SEQ ID NO: 1624391 - DNA, 19 bp, Homo sapiens
ttcctgaagaaccagtccc

SEQ ID NO: 1624392 - DNA, 14 bp, Homo sapiens
ttcctgaagcattt

SEQ ID NO: 1624393 - DNA, 15 bp, Homo sapiens
ttcctgaagcattta

SEQ ID NO: 1624394 - DNA, 13 bp, Homo sapiens
ttcctgaagggaa

SEQ ID NO: 1624395 - DNA, 14 bp, Homo sapiens
ttcctgacccaggc

SEQ ID NO: 1624396 - DNA, 18 bp, Homo sapiens
ttcctgactctcacctgt

SEQ ID NO: 1624397 - DNA, 18 bp, Homo sapiens
ttcctgacttgagtgttc

SEQ ID NO: 1624398 - DNA, 22 bp, Homo sapiens
ttcctgagttaggctttctctt

SEQ ID NO: 1624399 - DNA, 20 bp, Homo sapiens
ttcctgatagcatatgacaa

SEQ ID NO: 1624400 - DNA, 22 bp, Homo sapiens
ttcctgcatcccgatacctcag

SEQ ID NO: 1624401 - DNA, 13 bp, Homo sapiens
ttcctgcccttga

SEQ ID NO: 1624402 - DNA, 21 bp, Homo sapiens
ttcctgcccttgaaccccctc

SEQ ID NO: 1624403 - DNA, 23 bp, Homo sapiens
ttcctgcccttgaaccccctccc

SEQ ID NO: 1624404 - DNA, 17 bp, Homo sapiens
ttcctgcggagtgaaga

SEQ ID NO: 1624405 - DNA, 19 bp, Homo sapiens
ttcctgcggagtgaagagg

SEQ ID NO: 1624406 - DNA, 21 bp, Homo sapiens
ttcctgcgggcttttccccgg

SEQ ID NO: 1624407 - DNA, 16 bp, Homo sapiens
ttcctgcgtcctcctc

SEQ ID NO: 1624408 - DNA, 21 bp, Homo sapiens
ttcctgctccatgactggctg

SEQ ID NO: 1624409 - DNA, 17 bp, Homo sapiens
ttcctgctccctaacct

SEQ ID NO: 1624410 - DNA, 18 bp, Homo sapiens
ttcctgctgcaccctgcg

SEQ ID NO: 1624411 - DNA, 22 bp, Homo sapiens
ttcctgctgcaccctgcgcctc

SEQ ID NO: 1624412 - DNA, 16 bp, Homo sapiens
ttcctgctgctgctac

SEQ ID NO: 1624413 - DNA, 24 bp, Homo sapiens
ttcctgctgctgtaactgctgagc

SEQ ID NO: 1624414 - DNA, 16 bp, Homo sapiens
ttcctgctgtatttcc

SEQ ID NO: 1624415 - DNA, 19 bp, Homo sapiens
ttcctgctgtatttcctgc

SEQ ID NO: 1624416 - DNA, 14 bp, Homo sapiens
ttcctgctgtcctg

SEQ ID NO: 1624417 - DNA, 16 bp, Homo sapiens
ttcctgctgtcctggt

SEQ ID NO: 1624418 - DNA, 21 bp, Homo sapiens
ttcctgctgtcctggtggctg

SEQ ID NO: 1624419 - DNA, 16 bp, Homo sapiens
ttcctgcttcctcaga

SEQ ID NO: 1624420 - DNA, 13 bp, Homo sapiens
ttcctgcttgcca

SEQ ID NO: 1624421 - DNA, 18 bp, Homo sapiens
ttcctggaattgccagct

SEQ ID NO: 1624422 - DNA, 15 bp, Homo sapiens
ttcctggacactcag

SEQ ID NO: 1624423 - DNA, 21 bp, Homo sapiens
ttcctggacatcaccagtcct

SEQ ID NO: 1624424 - DNA, 17 bp, Homo sapiens
ttcctggacctgagtcg

SEQ ID NO: 1624425 - DNA, 22 bp, Homo sapiens
ttcctggagttttgatttggtg

SEQ ID NO: 1624426 - DNA, 14 bp, Homo sapiens
ttcctggattttct

SEQ ID NO: 1624427 - DNA, 20 bp, Homo sapiens
ttcctggattttctttctat

SEQ ID NO: 1624428 - DNA, 18 bp, Homo sapiens
ttcctggcagcctgctgc

SEQ ID NO: 1624429 - DNA, 23 bp, Homo sapiens
ttcctggccccgggctctggcca

SEQ ID NO: 1624430 - DNA, 18 bp, Homo sapiens
ttcctggcctcactggct

SEQ ID NO: 1624431 - DNA, 22 bp, Homo sapiens
ttcctggcctcactggctgggg

SEQ ID NO: 1624432 - DNA, 19 bp, Homo sapiens
ttcctggcctcccttctcc

SEQ ID NO: 1624433 - DNA, 11 bp, Homo sapiens
ttcctgggcct

SEQ ID NO: 1624434 - DNA, 21 bp, Homo sapiens
tgatggggaatccgtgtgtgt

SEQ ID NO: 1624435 - DNA, 12 bp, Homo sapiens
tgatggggagaa

SEQ ID NO: 1624436 - DNA, 19 bp, Homo sapiens
tgatggggagaaagggcaa

SEQ ID NO: 1624437 - DNA, 15 bp, Homo sapiens
tgatgggggagaggg

SEQ ID NO: 1624438 - DNA, 19 bp, Homo sapiens
tgatggttcttcacctcct

SEQ ID NO: 1624439 - DNA, 11 bp, Homo sapiens
tgatgtaaaat

SEQ ID NO: 1624440 - DNA, 16 bp, Homo sapiens
tgatgtaaaatcttgt

SEQ ID NO: 1624441 - DNA, 21 bp, Homo sapiens
tgatgtaaaatcttgtcatgt

SEQ ID NO: 1624442 - DNA, 16 bp, Homo sapiens
tgatgtacagtctgtc

SEQ ID NO: 1624443 - DNA, 17 bp, Homo sapiens
tgatgtacagtctgtca

SEQ ID NO: 1624444 - DNA, 11 bp, Homo sapiens
tgatgtacatg

SEQ ID NO: 1624445 - DNA, 14 bp, Homo sapiens
tgatgtacatgtgt

SEQ ID NO: 1624446 - DNA, 18 bp, Homo sapiens
tgatgtaccatgaaacaa

SEQ ID NO: 1624447 - DNA, 20 bp, Homo sapiens
tgatgtaccatgaaacaaag

SEQ ID NO: 1624448 - DNA, 13 bp, Homo sapiens
tgatgtaggagct

SEQ ID NO: 1624449 - DNA, 16 bp, Homo sapiens
tgatgtagtatgctta

SEQ ID NO: 1624450 - DNA, 13 bp, Homo sapiens
tgatgtatatgtt

SEQ ID NO: 1624451 - DNA, 16 bp, Homo sapiens
tgatgtatatgtttat

SEQ ID NO: 1624452 - DNA, 14 bp, Homo sapiens
tgatgtatgtgtga

SEQ ID NO: 1624453 - DNA, 19 bp, Homo sapiens
tgatgtatgtgtgaaacaa

SEQ ID NO: 1624454 - DNA, 13 bp, Homo sapiens
tgatgtattctag

SEQ ID NO: 1624455 - DNA, 14 bp, Homo sapiens
tgatgtcaaagtgt

SEQ ID NO: 1624456 - DNA, 23 bp, Homo sapiens
tgatgtcaatttctgtgttgcca

SEQ ID NO: 1624457 - DNA, 22 bp, Homo sapiens
tgatgtcatgtacttcctgtgt

SEQ ID NO: 1624458 - DNA, 13 bp, Homo sapiens
tgatgtccagaag

SEQ ID NO: 1624459 - DNA, 23 bp, Homo sapiens
tgatgtccagaagaatattcagg

SEQ ID NO: 1624460 - DNA, 19 bp, Homo sapiens
tgatgtccagggggagaag

SEQ ID NO: 1624461 - DNA, 16 bp, Homo sapiens
tgatgtctcttgtaga

SEQ ID NO: 1624462 - DNA, 17 bp, Homo sapiens
tgatgtctcttgtagaa

SEQ ID NO: 1624463 - DNA, 18 bp, Homo sapiens
tgatgtctcttgtagaag

SEQ ID NO: 1624464 - DNA, 16 bp, Homo sapiens
tgatgttaaaattcca

SEQ ID NO: 1624465 - DNA, 17 bp, Homo sapiens
tgatgttaaaattccat

SEQ ID NO: 1624466 - DNA, 10 bp, Homo sapiens
tgatgttaac

SEQ ID NO: 1624467 - DNA, 12 bp, Homo sapiens
tgatgttaacaa

SEQ ID NO: 1624468 - DNA, 22 bp, Homo sapiens
tgatgttaaccagaataaagtt

SEQ ID NO: 1624469 - DNA, 21 bp, Homo sapiens
tgatgttagaagaagaggaag

SEQ ID NO: 1624470 - DNA, 23 bp, Homo sapiens
tgatgttagaagaagaggaagaa

SEQ ID NO: 1624471 - DNA, 17 bp, Homo sapiens
tgatgttccacctgcca

SEQ ID NO: 1624472 - DNA, 19 bp, Homo sapiens
tgatgttccacctgccaca

SEQ ID NO: 1624473 - DNA, 17 bp, Homo sapiens
tgatgttctaaggctct

SEQ ID NO: 1624474 - DNA, 20 bp, Homo sapiens
tgatgttctaaggctctgag

SEQ ID NO: 1624475 - DNA, 22 bp, Homo sapiens
ccctttttctccacactccact

SEQ ID NO: 1624476 - DNA, 15 bp, Homo sapiens
ccctttttctccagc

SEQ ID NO: 1624477 - DNA, 15 bp, Homo sapiens
ccctttttgaaatca

SEQ ID NO: 1624478 - DNA, 16 bp, Homo sapiens
cccttttttgtccccc

SEQ ID NO: 1624479 - DNA, 18 bp, Homo sapiens
ccctttttttacatttca

SEQ ID NO: 1624480 - DNA, 17 bp, Homo sapiens
ccgaaaatgtttttaaa

SEQ ID NO: 1624481 - DNA, 14 bp, Homo sapiens
ccgaacagggactt

SEQ ID NO: 1624482 - DNA, 17 bp, Homo sapiens
ccgaagccccttggaga

SEQ ID NO: 1624483 - DNA, 21 bp, Homo sapiens
ccgaagctctggctgaaccct

SEQ ID NO: 1624484 - DNA, 18 bp, Homo sapiens
ccgacactgctgcaccag

SEQ ID NO: 1624485 - DNA, 21 bp, Homo sapiens
ccgacagcggccttgaagaca

SEQ ID NO: 1624486 - DNA, 14 bp, Homo sapiens
ccgacagtgccatc

SEQ ID NO: 1624487 - DNA, 13 bp, Homo sapiens
ccgaccaactgcc

SEQ ID NO: 1624488 - DNA, 17 bp, Homo sapiens
ccgaccacttccagggg

SEQ ID NO: 1624489 - DNA, 13 bp, Homo sapiens
ccgaccagagccc

SEQ ID NO: 1624490 - DNA, 17 bp, Homo sapiens
ccgaccagaggagcctt

SEQ ID NO: 1624491 - DNA, 22 bp, Homo sapiens
ccgaccaggctggacaccctct

SEQ ID NO: 1624492 - DNA, 14 bp, Homo sapiens
ccgaccctgccctg

SEQ ID NO: 1624493 - DNA, 14 bp, Homo sapiens
ccgacctcagcctt

SEQ ID NO: 1624494 - DNA, 15 bp, Homo sapiens
ccgacctcagccttc

SEQ ID NO: 1624495 - DNA, 13 bp, Homo sapiens
ccgacctcgtcct

SEQ ID NO: 1624496 - DNA, 21 bp, Homo sapiens
ccgacgccacagcccagccac

SEQ ID NO: 1624497 - DNA, 13 bp, Homo sapiens
ccgacgcccaccc

SEQ ID NO: 1624498 - DNA, 17 bp, Homo sapiens
ccgactaccccagtccc

SEQ ID NO: 1624499 - DNA, 18 bp, Homo sapiens
ccgactctgcacccgcct

SEQ ID NO: 1624500 - DNA, 14 bp, Homo sapiens
ccgactgctttgga

SEQ ID NO: 1624501 - DNA, 16 bp, Homo sapiens
ccgactggctgtgaga

SEQ ID NO: 1624502 - DNA, 23 bp, Homo sapiens
ccgacttgctgttttgttctgtg

SEQ ID NO: 1624503 - DNA, 17 bp, Homo sapiens
ccgacttggagactcct

SEQ ID NO: 1624504 - DNA, 20 bp, Homo sapiens
ccgactttggaatttgcacc

SEQ ID NO: 1624505 - DNA, 12 bp, Homo sapiens
ccgagaaccctg

SEQ ID NO: 1624506 - DNA, 17 bp, Homo sapiens
ccgagaaccctgagcag

SEQ ID NO: 1624507 - DNA, 20 bp, Homo sapiens
ccgagacagaccctctgccg

SEQ ID NO: 1624508 - DNA, 18 bp, Homo sapiens
ccgagagcagtgggcagg

SEQ ID NO: 1624509 - DNA, 20 bp, Homo sapiens
ccgagagcctgctcccccac

SEQ ID NO: 1624510 - DNA, 21 bp, Homo sapiens
ccgagagtagccgagagcctg

SEQ ID NO: 1624511 - DNA, 15 bp, Homo sapiens
ccgagatcacaccac

SEQ ID NO: 1624512 - DNA, 21 bp, Homo sapiens
ccgagatgtgacccaccagtg

SEQ ID NO: 1624513 - DNA, 22 bp, Homo sapiens
ccgagcacatagagctttttaa

SEQ ID NO: 1624514 - DNA, 12 bp, Homo sapiens
ccgagcccagct

SEQ ID NO: 1624515 - DNA, 20 bp, Homo sapiens
ccgagcccagctacattcct

SEQ ID NO: 1624516 - DNA, 21 bp, Homo sapiens
ccgagccctggagagccccat

SEQ ID NO: 1624517 - DNA, 18 bp, Homo sapiens
ccgagctcctcttccatg

SEQ ID NO: 1624518 - DNA, 20 bp, Homo sapiens
ccgagctcgtgtatcctggg

SEQ ID NO: 1624519 - DNA, 23 bp, Homo sapiens
ccgagctcgtgtatcctggggct

SEQ ID NO: 1624520 - DNA, 22 bp, Homo sapiens
ccgagctctggtgctttagtta

SEQ ID NO: 1624521 - DNA, 14 bp, Homo sapiens
ccgagctggaaaac

SEQ ID NO: 1624522 - DNA, 18 bp, Homo sapiens
ccgaggaccaccagcagg

SEQ ID NO: 1624523 - DNA, 14 bp, Homo sapiens
ccgaggatttctgg

SEQ ID NO: 1624524 - DNA, 19 bp, Homo sapiens
ccgaggcaccagtgtcctc

SEQ ID NO: 1624525 - DNA, 16 bp, Homo sapiens
ccgaggcccagcgggc

SEQ ID NO: 1624526 - DNA, 22 bp, Homo sapiens
ccgaggcctaccccgcagacac

SEQ ID NO: 1624527 - DNA, 13 bp, Homo sapiens
ccgaggctgcccc

SEQ ID NO: 1624528 - DNA, 15 bp, Homo sapiens
ccgaggctgccccag

SEQ ID NO: 1624529 - DNA, 22 bp, Homo sapiens
ccgaggggagagagggactcaa

SEQ ID NO: 1624530 - DNA, 16 bp, Homo sapiens
ccgagggtcctggctc

SEQ ID NO: 1624531 - DNA, 16 bp, Homo sapiens
ccgagtggctgccgga

SEQ ID NO: 1624532 - DNA, 17 bp, Homo sapiens
ccgatagagggacggcc

SEQ ID NO: 1624533 - DNA, 18 bp, Homo sapiens
ccgatagagggacggcca

SEQ ID NO: 1624534 - DNA, 18 bp, Homo sapiens
ccgatagggtatttgacc

SEQ ID NO: 1624535 - DNA, 15 bp, Homo sapiens
ccgatattctccctg

SEQ ID NO: 1624536 - DNA, 17 bp, Homo sapiens
ccgatgcaaacattgga

SEQ ID NO: 1624537 - DNA, 19 bp, Homo sapiens
ccgatgccaccggcctgtg

SEQ ID NO: 1624538 - DNA, 17 bp, Homo sapiens
ccgatgctgctttcccc

SEQ ID NO: 1624539 - DNA, 21 bp, Homo sapiens
ccgatgctgctttcccctgtg

SEQ ID NO: 1624540 - DNA, 17 bp, Homo sapiens
ccgatggactcctgacc

SEQ ID NO: 1624541 - DNA, 18 bp, Homo sapiens
ccgatggactcctgacca

SEQ ID NO: 1624542 - DNA, 21 bp, Homo sapiens
ccgcaacccacagctcagctg

SEQ ID NO: 1624543 - DNA, 18 bp, Homo sapiens
ccgcaatgtggagcagca

SEQ ID NO: 1624544 - DNA, 21 bp, Homo sapiens
ccgcaatgtggagcagcagcc

SEQ ID NO: 1624545 - DNA, 14 bp, Homo sapiens
ccgcacagctcagg

SEQ ID NO: 1624546 - DNA, 18 bp, Homo sapiens
ccgcacagctcaggaggc

SEQ ID NO: 1624547 - DNA, 17 bp, Homo sapiens
ccgcacatggtgtgggg

SEQ ID NO: 1624548 - DNA, 16 bp, Homo sapiens
ccgcaccagctgctct

SEQ ID NO: 1624549 - DNA, 21 bp, Homo sapiens
tgattctccttcagccctcac

SEQ ID NO: 1624550 - DNA, 15 bp, Homo sapiens
tgattctctgtggtt

SEQ ID NO: 1624551 - DNA, 15 bp, Homo sapiens
tgattctcttgagat

SEQ ID NO: 1624552 - DNA, 17 bp, Homo sapiens
tgattctgatttcagtt

SEQ ID NO: 1624553 - DNA, 18 bp, Homo sapiens
tgattctgatttcagttt

SEQ ID NO: 1624554 - DNA, 21 bp, Homo sapiens
tgattctggctttaagccttc

SEQ ID NO: 1624555 - DNA, 12 bp, Homo sapiens
tgattcttgtaa

SEQ ID NO: 1624556 - DNA, 17 bp, Homo sapiens
tgattcttgtaaatctt

SEQ ID NO: 1624557 - DNA, 18 bp, Homo sapiens
tgattcttgtaaatcttt

SEQ ID NO: 1624558 - DNA, 20 bp, Homo sapiens
tgattcttgtaaatcttttt

SEQ ID NO: 1624559 - DNA, 21 bp, Homo sapiens
tgattcttgtaaatctttttg

SEQ ID NO: 1624560 - DNA, 22 bp, Homo sapiens
tgattgaaaatagtaaatgctt

SEQ ID NO: 1624561 - DNA, 14 bp, Homo sapiens
tgattgacacacag

SEQ ID NO: 1624562 - DNA, 14 bp, Homo sapiens
tgattgagaaagat

SEQ ID NO: 1624563 - DNA, 15 bp, Homo sapiens
tgattgatgaccctt

SEQ ID NO: 1624564 - DNA, 15 bp, Homo sapiens
tgattgcagaaagga

SEQ ID NO: 1624565 - DNA, 17 bp, Homo sapiens
tgattgcagaaaggaga

SEQ ID NO: 1624566 - DNA, 18 bp, Homo sapiens
tgattgcagaaaggagag

SEQ ID NO: 1624567 - DNA, 14 bp, Homo sapiens
tgattgcagcttta

SEQ ID NO: 1624568 - DNA, 15 bp, Homo sapiens
tgattgctgccaggc

SEQ ID NO: 1624569 - DNA, 19 bp, Homo sapiens
tgattggaatagcttctgg

SEQ ID NO: 1624570 - DNA, 15 bp, Homo sapiens
tgattggattattca

SEQ ID NO: 1624571 - DNA, 17 bp, Homo sapiens
tgattggattattcatt

SEQ ID NO: 1624572 - DNA, 16 bp, Homo sapiens
tgattggcatataatg

SEQ ID NO: 1624573 - DNA, 13 bp, Homo sapiens
tgattggctgcag

SEQ ID NO: 1624574 - DNA, 15 bp, Homo sapiens
tgattggctgcttaa

SEQ ID NO: 1624575 - DNA, 21 bp, Homo sapiens
tgattggctgcttaaactgga

SEQ ID NO: 1624576 - DNA, 16 bp, Homo sapiens
tgattgggaaaacatt

SEQ ID NO: 1624577 - DNA, 18 bp, Homo sapiens
tgattgggaggtgcgtgt

SEQ ID NO: 1624578 - DNA, 23 bp, Homo sapiens
tgattgggtgggattttttccct

SEQ ID NO: 1624579 - DNA, 18 bp, Homo sapiens
tgattggtgattcaaagt

SEQ ID NO: 1624580 - DNA, 17 bp, Homo sapiens
tgattggtgcaaccctt

SEQ ID NO: 1624581 - DNA, 19 bp, Homo sapiens
tgattggtgcaacccttac

SEQ ID NO: 1624582 - DNA, 21 bp, Homo sapiens
tgattggttgtgccttccctt

SEQ ID NO: 1624583 - DNA, 22 bp, Homo sapiens
tgattgtttcttcttcatgctt

SEQ ID NO: 1624584 - DNA, 15 bp, Homo sapiens
tgatttaaaaacaac

SEQ ID NO: 1624585 - DNA, 14 bp, Homo sapiens
tgatttaaaacatg

SEQ ID NO: 1624586 - DNA, 15 bp, Homo sapiens
tgatttaaaacatgt

SEQ ID NO: 1624587 - DNA, 12 bp, Homo sapiens
tgatttagatga

SEQ ID NO: 1624588 - DNA, 21 bp, Homo sapiens
tgatttaggagaagccaggaa

SEQ ID NO: 1624589 - DNA, 15 bp, Homo sapiens
tgatttataaacaga

SEQ ID NO: 1624590 - DNA, 20 bp, Homo sapiens
tgatttataaatgccattta

SEQ ID NO: 1624591 - DNA, 13 bp, Homo sapiens
tgatttatttgga

SEQ ID NO: 1624592 - DNA, 22 bp, Homo sapiens
tgatttatttggagtggaggca

SEQ ID NO: 1624593 - DNA, 16 bp, Homo sapiens
tgatttcacaacagat

SEQ ID NO: 1624594 - DNA, 15 bp, Homo sapiens
ccgcccactgtcctg

SEQ ID NO: 1624595 - DNA, 22 bp, Homo sapiens
ccgcccagctgcacctgccagc

SEQ ID NO: 1624596 - DNA, 13 bp, Homo sapiens
ccgcccccacccc

SEQ ID NO: 1624597 - DNA, 17 bp, Homo sapiens
ccgcccccacccctaca

SEQ ID NO: 1624598 - DNA, 16 bp, Homo sapiens
ccgcccccaccccttc

SEQ ID NO: 1624599 - DNA, 13 bp, Homo sapiens
ccgcccccagtcc

SEQ ID NO: 1624600 - DNA, 15 bp, Homo sapiens
ccgcccccgcctggg

SEQ ID NO: 1624601 - DNA, 12 bp, Homo sapiens
ccgccccctcct

SEQ ID NO: 1624602 - DNA, 15 bp, Homo sapiens
ccgcccctcccacgc

SEQ ID NO: 1624603 - DNA, 11 bp, Homo sapiens
ccgcccctgag

SEQ ID NO: 1624604 - DNA, 12 bp, Homo sapiens
ccgcccctgagg

SEQ ID NO: 1624605 - DNA, 22 bp, Homo sapiens
ccgcccctgggctaccatctgc

SEQ ID NO: 1624606 - DNA, 17 bp, Homo sapiens
ccgcccctgtggccctg

SEQ ID NO: 1624607 - DNA, 13 bp, Homo sapiens
ccgcccgcacgtc

SEQ ID NO: 1624608 - DNA, 15 bp, Homo sapiens
ccgcccggcagcccc

SEQ ID NO: 1624609 - DNA, 14 bp, Homo sapiens
ccgcccgggcccag

SEQ ID NO: 1624610 - DNA, 15 bp, Homo sapiens
ccgcccgggcccaga

SEQ ID NO: 1624611 - DNA, 13 bp, Homo sapiens
ccgccctcctcgg

SEQ ID NO: 1624612 - DNA, 22 bp, Homo sapiens
ccgccctcctcgggccgaggcc

SEQ ID NO: 1624613 - DNA, 13 bp, Homo sapiens
ccgccctgagaga

SEQ ID NO: 1624614 - DNA, 19 bp, Homo sapiens
ccgccctgagcatcctggt

SEQ ID NO: 1624615 - DNA, 19 bp, Homo sapiens
ccgccctgctcctccctgg

SEQ ID NO: 1624616 - DNA, 21 bp, Homo sapiens
ccgccctgctcctccctggct

SEQ ID NO: 1624617 - DNA, 14 bp, Homo sapiens
ccgccgccaggact

SEQ ID NO: 1624618 - DNA, 14 bp, Homo sapiens
ccgccgccgccgct

SEQ ID NO: 1624619 - DNA, 12 bp, Homo sapiens
ccgccgcgcgcc

SEQ ID NO: 1624620 - DNA, 15 bp, Homo sapiens
ccgccgcgcgcccct

SEQ ID NO: 1624621 - DNA, 21 bp, Homo sapiens
ccgcctactgtccctctcagt

SEQ ID NO: 1624622 - DNA, 16 bp, Homo sapiens
ccgcctagtttactgt

SEQ ID NO: 1624623 - DNA, 13 bp, Homo sapiens
ccgcctcagcctc

SEQ ID NO: 1624624 - DNA, 13 bp, Homo sapiens
ccgcctccacact

SEQ ID NO: 1624625 - DNA, 21 bp, Homo sapiens
ccgcctccactctagttctag

SEQ ID NO: 1624626 - DNA, 22 bp, Homo sapiens
ccgcctccactctagttctaga

SEQ ID NO: 1624627 - DNA, 23 bp, Homo sapiens
ccgcctccactctagttctagat

SEQ ID NO: 1624628 - DNA, 13 bp, Homo sapiens
ccgcctccaggag

SEQ ID NO: 1624629 - DNA, 15 bp, Homo sapiens
ccgcctcccacggca

SEQ ID NO: 1624630 - DNA, 20 bp, Homo sapiens
ccgcctcgacctccccaccc

SEQ ID NO: 1624631 - DNA, 21 bp, Homo sapiens
ccgcctcgtgccagcagcctc

SEQ ID NO: 1624632 - DNA, 20 bp, Homo sapiens
ccgcctctcccgtcagggcc

SEQ ID NO: 1624633 - DNA, 16 bp, Homo sapiens
ccgcctgccctcatgg

SEQ ID NO: 1624634 - DNA, 22 bp, Homo sapiens
ccgcctgccctcccgcaccttc

SEQ ID NO: 1624635 - DNA, 14 bp, Homo sapiens
ccgcctgccgtgca

SEQ ID NO: 1624636 - DNA, 21 bp, Homo sapiens
ccgcctgccgtgcatggctcc

SEQ ID NO: 1624637 - DNA, 12 bp, Homo sapiens
ccgcctgcctcc

SEQ ID NO: 1624638 - DNA, 19 bp, Homo sapiens
ccgcctgcctcctggctca

SEQ ID NO: 1624639 - DNA, 22 bp, Homo sapiens
ccgcctgctccctgcacccatg

SEQ ID NO: 1624640 - DNA, 16 bp, Homo sapiens
ccgcctgctcctcact

SEQ ID NO: 1624641 - DNA, 22 bp, Homo sapiens
ccgcctgctcctcactggagga

SEQ ID NO: 1624642 - DNA, 14 bp, Homo sapiens
ccgcctggccagga

SEQ ID NO: 1624643 - DNA, 22 bp, Homo sapiens
ccgcctgggcaccgggaccccc

SEQ ID NO: 1624644 - DNA, 16 bp, Homo sapiens
ccgccttcctcctcca

SEQ ID NO: 1624645 - DNA, 17 bp, Homo sapiens
ccgccttggccttgcag

SEQ ID NO: 1624646 - DNA, 22 bp, Homo sapiens
ccgccttggccttgcagctggc

SEQ ID NO: 1624647 - DNA, 23 bp, Homo sapiens
ccgcctttacaagggagaagaca

SEQ ID NO: 1624648 - DNA, 15 bp, Homo sapiens
ccgcgaactgggttc

SEQ ID NO: 1624649 - DNA, 12 bp, Homo sapiens
ccgcgcaggctc

SEQ ID NO: 1624650 - DNA, 22 bp, Homo sapiens
ccgcgccaaataatgtctctgt

SEQ ID NO: 1624651 - DNA, 16 bp, Homo sapiens
ccgcgcccgcgccctc

SEQ ID NO: 1624652 - DNA, 14 bp, Homo sapiens
ccgcgcgcccaccc

SEQ ID NO: 1624653 - DNA, 13 bp, Homo sapiens
ccgcgcgcccctg

SEQ ID NO: 1624654 - DNA, 18 bp, Homo sapiens
ccgcgcgcgtccccctgc

SEQ ID NO: 1624655 - DNA, 20 bp, Homo sapiens
ccgcgctcgcccagcaggag

SEQ ID NO: 1624656 - DNA, 12 bp, Homo sapiens
ccgcggccaggc

SEQ ID NO: 1624657 - DNA, 12 bp, Homo sapiens
ccgcggtgctct

SEQ ID NO: 1624658 - DNA, 14 bp, Homo sapiens
ccgcggtgctctgg

SEQ ID NO: 1624659 - DNA, 16 bp, Homo sapiens
ccgcggtgctctggcg

SEQ ID NO: 1624660 - DNA, 17 bp, Homo sapiens
ccgcggtgctctggcgg

SEQ ID NO: 1624661 - DNA, 22 bp, Homo sapiens
ccgcggtgctgactgaggcctg

SEQ ID NO: 1624662 - DNA, 16 bp, Homo sapiens
ccgcgtccctgccccg

SEQ ID NO: 1624663 - DNA, 18 bp, Homo sapiens
ccgcgtgacggacatcca

SEQ ID NO: 1624664 - DNA, 15 bp, Homo sapiens
tgcaaatgttttgaa

SEQ ID NO: 1624665 - DNA, 12 bp, Homo sapiens
tgcaaattattc

SEQ ID NO: 1624666 - DNA, 13 bp, Homo sapiens
tgcaaattattct

SEQ ID NO: 1624667 - DNA, 19 bp, Homo sapiens
tgcaaattattctagtcaa

SEQ ID NO: 1624668 - DNA, 12 bp, Homo sapiens
tgcaaatttcat

SEQ ID NO: 1624669 - DNA, 12 bp, Homo sapiens
tgcaacaaaata

SEQ ID NO: 1624670 - DNA, 13 bp, Homo sapiens
tgcaacagacaag

SEQ ID NO: 1624671 - DNA, 17 bp, Homo sapiens
tgcaacaggggaggaaa

SEQ ID NO: 1624672 - DNA, 21 bp, Homo sapiens
tgcaacaggggaggaaaaaag

SEQ ID NO: 1624673 - DNA, 19 bp, Homo sapiens
tgcaacagggggcaaagat

SEQ ID NO: 1624674 - DNA, 24 bp, Homo sapiens
tgcaacagggtatggactatctgt

SEQ ID NO: 1624675 - DNA, 15 bp, Homo sapiens
tgcaacatctctgaa

SEQ ID NO: 1624676 - DNA, 15 bp, Homo sapiens
tgcaaccactgcaac

SEQ ID NO: 1624677 - DNA, 17 bp, Homo sapiens
tgcaacccttacccctt

SEQ ID NO: 1624678 - DNA, 13 bp, Homo sapiens
tgcaacctccgcc

SEQ ID NO: 1624679 - DNA, 21 bp, Homo sapiens
tgcaacctctgcctcccaggt

SEQ ID NO: 1624680 - DNA, 16 bp, Homo sapiens
tgcaacggcttagact

SEQ ID NO: 1624681 - DNA, 21 bp, Homo sapiens
tgcaacggtctcctgactggt

SEQ ID NO: 1624682 - DNA, 22 bp, Homo sapiens
tgcaacggtctcctgactggtg

SEQ ID NO: 1624683 - DNA, 13 bp, Homo sapiens
tgcaactagccaa

SEQ ID NO: 1624684 - DNA, 16 bp, Homo sapiens
tgcaactcaaggactt

SEQ ID NO: 1624685 - DNA, 20 bp, Homo sapiens
tgcaactgctcagctctggt

SEQ ID NO: 1624686 - DNA, 21 bp, Homo sapiens
tgcaactgctcagctctggtc

SEQ ID NO: 1624687 - DNA, 20 bp, Homo sapiens
tgcaacttcccagcaacaat

SEQ ID NO: 1624688 - DNA, 19 bp, Homo sapiens
tgcaacttccgcctcctgt

SEQ ID NO: 1624689 - DNA, 21 bp, Homo sapiens
tgcaacttccgctgaggggtc

SEQ ID NO: 1624690 - DNA, 21 bp, Homo sapiens
tgcaacttctttttattttct

SEQ ID NO: 1624691 - DNA, 22 bp, Homo sapiens
tgcaagacctagtcccctttcc

SEQ ID NO: 1624692 - DNA, 19 bp, Homo sapiens
tgcaagactcgaataaaat

SEQ ID NO: 1624693 - DNA, 14 bp, Homo sapiens
tgcaagagccttgg

SEQ ID NO: 1624694 - DNA, 14 bp, Homo sapiens
tgcaagatgtgaat

SEQ ID NO: 1624695 - DNA, 18 bp, Homo sapiens
tgcaagatgtgaattatt

SEQ ID NO: 1624696 - DNA, 16 bp, Homo sapiens
tgcaagcacagccctt

SEQ ID NO: 1624697 - DNA, 15 bp, Homo sapiens
tgcaagcagaggacc

SEQ ID NO: 1624698 - DNA, 16 bp, Homo sapiens
tgcaagcagaggacca

SEQ ID NO: 1624699 - DNA, 19 bp, Homo sapiens
tgcaagccccagggcctgg

SEQ ID NO: 1624700 - DNA, 20 bp, Homo sapiens
tgcaagccccagggcctggg

SEQ ID NO: 1624701 - DNA, 23 bp, Homo sapiens
tgcaagccccagggcctgggggc

SEQ ID NO: 1624702 - DNA, 12 bp, Homo sapiens
tgcaaggaagga

SEQ ID NO: 1624703 - DNA, 19 bp, Homo sapiens
tgcaaggaaggaaagaaag

SEQ ID NO: 1624704 - DNA, 13 bp, Homo sapiens
tgcaaggaccagg

SEQ ID NO: 1624705 - DNA, 15 bp, Homo sapiens
tgcaaggaccaggac

SEQ ID NO: 1624706 - DNA, 13 bp, Homo sapiens
tgcaagggcccag

SEQ ID NO: 1624707 - DNA, 14 bp, Homo sapiens
tgcaagggcccaga

SEQ ID NO: 1624708 - DNA, 15 bp, Homo sapiens
tgcaagggcccagag

SEQ ID NO: 1624709 - DNA, 16 bp, Homo sapiens
tgcaagggcccagagt

SEQ ID NO: 1624710 - DNA, 16 bp, Homo sapiens
tgcaaggtaaaatttt

SEQ ID NO: 1624711 - DNA, 18 bp, Homo sapiens
tgcaaggtactctggtga

SEQ ID NO: 1624712 - DNA, 16 bp, Homo sapiens
tgcaaggtggcctctg

SEQ ID NO: 1624713 - DNA, 20 bp, Homo sapiens
ccgctttgtgattccatgga

SEQ ID NO: 1624714 - DNA, 13 bp, Homo sapiens
ccgcttttgttct

SEQ ID NO: 1624715 - DNA, 20 bp, Homo sapiens
ccggaaacaaaatccttttc

SEQ ID NO: 1624716 - DNA, 11 bp, Homo sapiens
ccggaaagaag

SEQ ID NO: 1624717 - DNA, 21 bp, Homo sapiens
ccggaaggaggccaaccagcc

SEQ ID NO: 1624718 - DNA, 18 bp, Homo sapiens
ccggacagctgcccagac

SEQ ID NO: 1624719 - DNA, 21 bp, Homo sapiens
ccggacagctgcccagacaca

SEQ ID NO: 1624720 - DNA, 16 bp, Homo sapiens
ccggactctgatctct

SEQ ID NO: 1624721 - DNA, 18 bp, Homo sapiens
ccggactggtgccctcct

SEQ ID NO: 1624722 - DNA, 21 bp, Homo sapiens
ccggagattggacggcctgat

SEQ ID NO: 1624723 - DNA, 16 bp, Homo sapiens
ccggagcacagccctg

SEQ ID NO: 1624724 - DNA, 18 bp, Homo sapiens
ccggagcacagccctggg

SEQ ID NO: 1624725 - DNA, 20 bp, Homo sapiens
ccggagcacagccctgggag

SEQ ID NO: 1624726 - DNA, 21 bp, Homo sapiens
ccggagcacagccctgggagg

SEQ ID NO: 1624727 - DNA, 20 bp, Homo sapiens
ccggaggagcatgcgcagag

SEQ ID NO: 1624728 - DNA, 22 bp, Homo sapiens
ccggaggagcatgcgcagaggc

SEQ ID NO: 1624729 - DNA, 23 bp, Homo sapiens
ccggaggagcatgcgcagaggcc

SEQ ID NO: 1624730 - DNA, 14 bp, Homo sapiens
ccggatctgggctg

SEQ ID NO: 1624731 - DNA, 13 bp, Homo sapiens
ccggatttctaac

SEQ ID NO: 1624732 - DNA, 20 bp, Homo sapiens
ccggcaagcgcttctgctga

SEQ ID NO: 1624733 - DNA, 21 bp, Homo sapiens
ccggcaagcgcttctgctgaa

SEQ ID NO: 1624734 - DNA, 19 bp, Homo sapiens
ccggcacagggtctgctct

SEQ ID NO: 1624735 - DNA, 20 bp, Homo sapiens
ccggcacctacatccccagg

SEQ ID NO: 1624736 - DNA, 20 bp, Homo sapiens
ccggcagcgggcggagggga

SEQ ID NO: 1624737 - DNA, 11 bp, Homo sapiens
ccggcagggcg

SEQ ID NO: 1624738 - DNA, 23 bp, Homo sapiens
ccggcatctcccctagctcacca

SEQ ID NO: 1624739 - DNA, 23 bp, Homo sapiens
ccggcatgagactcagtgcagat

SEQ ID NO: 1624740 - DNA, 19 bp, Homo sapiens
ccggccagcgggcacaggg

SEQ ID NO: 1624741 - DNA, 15 bp, Homo sapiens
ccggccagctctgga

SEQ ID NO: 1624742 - DNA, 13 bp, Homo sapiens
ccggccaggccgc

SEQ ID NO: 1624743 - DNA, 13 bp, Homo sapiens
ccggcccagtgcc

SEQ ID NO: 1624744 - DNA, 18 bp, Homo sapiens
ccggcccagtgccactgc

SEQ ID NO: 1624745 - DNA, 12 bp, Homo sapiens
ccggccccagcc

SEQ ID NO: 1624746 - DNA, 13 bp, Homo sapiens
ccggccccagcca

SEQ ID NO: 1624747 - DNA, 15 bp, Homo sapiens
ccggccccagccaga

SEQ ID NO: 1624748 - DNA, 16 bp, Homo sapiens
ccggccccggccccag

SEQ ID NO: 1624749 - DNA, 13 bp, Homo sapiens
ccggccctggctt

SEQ ID NO: 1624750 - DNA, 20 bp, Homo sapiens
ccggccgcgccgccgccgcg

SEQ ID NO: 1624751 - DNA, 15 bp, Homo sapiens
ccggccgctccacca

SEQ ID NO: 1624752 - DNA, 19 bp, Homo sapiens
ccggccggccctggcttgg

SEQ ID NO: 1624753 - DNA, 16 bp, Homo sapiens
ccggccggcctggcac

SEQ ID NO: 1624754 - DNA, 13 bp, Homo sapiens
ccggcctcagggc

SEQ ID NO: 1624755 - DNA, 14 bp, Homo sapiens
ccggcctcagggcg

SEQ ID NO: 1624756 - DNA, 15 bp, Homo sapiens
ccggcctctctggcc

SEQ ID NO: 1624757 - DNA, 18 bp, Homo sapiens
ccggcctctctggcctcc

SEQ ID NO: 1624758 - DNA, 20 bp, Homo sapiens
ccggcctctctggcctccca

SEQ ID NO: 1624759 - DNA, 16 bp, Homo sapiens
ccggcctcttccaccc

SEQ ID NO: 1624760 - DNA, 18 bp, Homo sapiens
ccggcctcttccacccat

SEQ ID NO: 1624761 - DNA, 13 bp, Homo sapiens
ccggcctggcacc

SEQ ID NO: 1624762 - DNA, 13 bp, Homo sapiens
ccggcgccgggca

SEQ ID NO: 1624763 - DNA, 15 bp, Homo sapiens
ccggcgctgcaggta

SEQ ID NO: 1624764 - DNA, 19 bp, Homo sapiens
ccggcggcccaagcccgac

SEQ ID NO: 1624765 - DNA, 15 bp, Homo sapiens
ccggcggccctgctg

SEQ ID NO: 1624766 - DNA, 13 bp, Homo sapiens
ccggcggcctctc

SEQ ID NO: 1624767 - DNA, 19 bp, Homo sapiens
ccggcgggtgacagctccg

SEQ ID NO: 1624768 - DNA, 15 bp, Homo sapiens
ccggcgtcttgccca

SEQ ID NO: 1624769 - DNA, 20 bp, Homo sapiens
ccggcgtcttgcccagcagc

SEQ ID NO: 1624770 - DNA, 16 bp, Homo sapiens
ccggctcgtgtattta

SEQ ID NO: 1624771 - DNA, 18 bp, Homo sapiens
ccggctcgtgtatttatt

SEQ ID NO: 1624772 - DNA, 19 bp, Homo sapiens
ccggctcgtgtatttatta

SEQ ID NO: 1624773 - DNA, 23 bp, Homo sapiens
ccggctctgggcctgagggtcca

SEQ ID NO: 1624774 - DNA, 19 bp, Homo sapiens
ccggctgagccccccatgc

SEQ ID NO: 1624775 - DNA, 14 bp, Homo sapiens
ccggctgcctgccg

SEQ ID NO: 1624776 - DNA, 15 bp, Homo sapiens
ccggctgtgattgct

SEQ ID NO: 1624777 - DNA, 18 bp, Homo sapiens
ccggctgtgattgctgcc

SEQ ID NO: 1624778 - DNA, 18 bp, Homo sapiens
ccgggaccacagctgctg

SEQ ID NO: 1624779 - DNA, 17 bp, Homo sapiens
tgcacagatatttccat

SEQ ID NO: 1624780 - DNA, 23 bp, Homo sapiens
tgcacagatgccatggcctgtgc

SEQ ID NO: 1624781 - DNA, 21 bp, Homo sapiens
tgcacagcatttgctttcctc

SEQ ID NO: 1624782 - DNA, 13 bp, Homo sapiens
tgcacagctgctt

SEQ ID NO: 1624783 - DNA, 15 bp, Homo sapiens
tgcacagctgcttgt

SEQ ID NO: 1624784 - DNA, 13 bp, Homo sapiens
tgcacagctgtcc

SEQ ID NO: 1624785 - DNA, 15 bp, Homo sapiens
tgcacaggccctggg

SEQ ID NO: 1624786 - DNA, 16 bp, Homo sapiens
tgcacaggccctgggg

SEQ ID NO: 1624787 - DNA, 16 bp, Homo sapiens
tgcacaggcctctgcc

SEQ ID NO: 1624788 - DNA, 21 bp, Homo sapiens
tgcacaggcctctgcctgctg

SEQ ID NO: 1624789 - DNA, 20 bp, Homo sapiens
tgcacagtatttgtaattaa

SEQ ID NO: 1624790 - DNA, 23 bp, Homo sapiens
tgcacagtatttgtaattaaaag

SEQ ID NO: 1624791 - DNA, 19 bp, Homo sapiens
tgcacagtgacttctgaga

SEQ ID NO: 1624792 - DNA, 19 bp, Homo sapiens
tgcacagtgatttttttct

SEQ ID NO: 1624793 - DNA, 15 bp, Homo sapiens
tgcacagtgcatctc

SEQ ID NO: 1624794 - DNA, 16 bp, Homo sapiens
tgcacagtgcatctca

SEQ ID NO: 1624795 - DNA, 18 bp, Homo sapiens
tgcacataaactctttta

SEQ ID NO: 1624796 - DNA, 22 bp, Homo sapiens
tgcacataagcttccattttaa

SEQ ID NO: 1624797 - DNA, 20 bp, Homo sapiens
tgcacatacgggctttaata

SEQ ID NO: 1624798 - DNA, 14 bp, Homo sapiens
tgcacatatggact

SEQ ID NO: 1624799 - DNA, 15 bp, Homo sapiens
tgcacatatggactc

SEQ ID NO: 1624800 - DNA, 13 bp, Homo sapiens
tgcacatgaaagt

SEQ ID NO: 1624801 - DNA, 13 bp, Homo sapiens
tgcacatgtttcc

SEQ ID NO: 1624802 - DNA, 17 bp, Homo sapiens
tgcacatgtttcctcta

SEQ ID NO: 1624803 - DNA, 12 bp, Homo sapiens
tgcacattgcct

SEQ ID NO: 1624804 - DNA, 14 bp, Homo sapiens
tgcacattgcctgt

SEQ ID NO: 1624805 - DNA, 19 bp, Homo sapiens
tgcacattgcctgttctgc

SEQ ID NO: 1624806 - DNA, 21 bp, Homo sapiens
tgcacatttctggattgtggt

SEQ ID NO: 1624807 - DNA, 18 bp, Homo sapiens
tgcacatttctttgcatt

SEQ ID NO: 1624808 - DNA, 11 bp, Homo sapiens
tgcaccaaaga

SEQ ID NO: 1624809 - DNA, 12 bp, Homo sapiens
tgcaccaaagac

SEQ ID NO: 1624810 - DNA, 17 bp, Homo sapiens
tgcaccaactcacctgg

SEQ ID NO: 1624811 - DNA, 15 bp, Homo sapiens
tgcaccaagaaagct

SEQ ID NO: 1624812 - DNA, 21 bp, Homo sapiens
tgcaccagagtgaaagggcta

SEQ ID NO: 1624813 - DNA, 10 bp, Homo sapiens
tgcaccagga

SEQ ID NO: 1624814 - DNA, 18 bp, Homo sapiens
tgcaccaggactggctgt

SEQ ID NO: 1624815 - DNA, 13 bp, Homo sapiens
tgcaccaggagac

SEQ ID NO: 1624816 - DNA, 14 bp, Homo sapiens
tgcaccaggagaca

SEQ ID NO: 1624817 - DNA, 15 bp, Homo sapiens
tgcaccatctgcttg

SEQ ID NO: 1624818 - DNA, 23 bp, Homo sapiens
tgcaccatgctgctggggaagac

SEQ ID NO: 1624819 - DNA, 13 bp, Homo sapiens
tgcacccacccct

SEQ ID NO: 1624820 - DNA, 15 bp, Homo sapiens
tgcacccacccctgc

SEQ ID NO: 1624821 - DNA, 21 bp, Homo sapiens
tgcacccacccctgcccaggc

SEQ ID NO: 1624822 - DNA, 16 bp, Homo sapiens
tgcacccacctgtttt

SEQ ID NO: 1624823 - DNA, 20 bp, Homo sapiens
tgcacccactaatgtgtcat

SEQ ID NO: 1624824 - DNA, 15 bp, Homo sapiens
tgcacccactcacca

SEQ ID NO: 1624825 - DNA, 13 bp, Homo sapiens
tgcacccagaaca

SEQ ID NO: 1624826 - DNA, 14 bp, Homo sapiens
tgcacccagaacag

SEQ ID NO: 1624827 - DNA, 18 bp, Homo sapiens
tgcaccccaaagctttcc

SEQ ID NO: 1624828 - DNA, 12 bp, Homo sapiens
tgcaccccagca

SEQ ID NO: 1624829 - DNA, 15 bp, Homo sapiens
tgcaccccagcattc

SEQ ID NO: 1624830 - DNA, 13 bp, Homo sapiens
tgcacccctccca

SEQ ID NO: 1624831 - DNA, 14 bp, Homo sapiens
tgcacccctcccat

SEQ ID NO: 1624832 - DNA, 17 bp, Homo sapiens
ccggtcgggcagccagc

SEQ ID NO: 1624833 - DNA, 13 bp, Homo sapiens
ccggtgctctgtg

SEQ ID NO: 1624834 - DNA, 15 bp, Homo sapiens
ccggtgctgcaggag

SEQ ID NO: 1624835 - DNA, 16 bp, Homo sapiens
ccggtgctgcaggagt

SEQ ID NO: 1624836 - DNA, 22 bp, Homo sapiens
ccggtgggacccccgtggggca

SEQ ID NO: 1624837 - DNA, 15 bp, Homo sapiens
ccggtgtgcctgcag

SEQ ID NO: 1624838 - DNA, 16 bp, Homo sapiens
ccggtgtgcctgcagc

SEQ ID NO: 1624839 - DNA, 12 bp, Homo sapiens
ccggtgttctaa

SEQ ID NO: 1624840 - DNA, 14 bp, Homo sapiens
ccggtgttctaaga

SEQ ID NO: 1624841 - DNA, 15 bp, Homo sapiens
ccggtgttctaagat

SEQ ID NO: 1624842 - DNA, 19 bp, Homo sapiens
ccggttcagacccctgcct

SEQ ID NO: 1624843 - DNA, 20 bp, Homo sapiens
ccggttcttccagtggtttg

SEQ ID NO: 1624844 - DNA, 18 bp, Homo sapiens
ccggttgccactctcctc

SEQ ID NO: 1624845 - DNA, 20 bp, Homo sapiens
ccggtttcgaagttgatgca

SEQ ID NO: 1624846 - DNA, 15 bp, Homo sapiens
ccgtaatcccagcta

SEQ ID NO: 1624847 - DNA, 13 bp, Homo sapiens
ccgtaccccaccc

SEQ ID NO: 1624848 - DNA, 15 bp, Homo sapiens
ccgtagactaggaag

SEQ ID NO: 1624849 - DNA, 15 bp, Homo sapiens
ccgtaggcagcctct

SEQ ID NO: 1624850 - DNA, 15 bp, Homo sapiens
ccgtagggagtacct

SEQ ID NO: 1624851 - DNA, 20 bp, Homo sapiens
ccgtaggggctcctgagtgt

SEQ ID NO: 1624852 - DNA, 18 bp, Homo sapiens
ccgtagggtggcactggg

SEQ ID NO: 1624853 - DNA, 19 bp, Homo sapiens
ccgtagggtggcactggga

SEQ ID NO: 1624854 - DNA, 14 bp, Homo sapiens
ccgtatcacagtgt

SEQ ID NO: 1624855 - DNA, 19 bp, Homo sapiens
ccgtcaccacgactggcca

SEQ ID NO: 1624856 - DNA, 17 bp, Homo sapiens
ccgtcacccctgtttct

SEQ ID NO: 1624857 - DNA, 17 bp, Homo sapiens
ccgtcagccaaatgtaa

SEQ ID NO: 1624858 - DNA, 13 bp, Homo sapiens
ccgtcagggagag

SEQ ID NO: 1624859 - DNA, 15 bp, Homo sapiens
ccgtcatgttcctca

SEQ ID NO: 1624860 - DNA, 17 bp, Homo sapiens
ccgtcatgttcctcaaa

SEQ ID NO: 1624861 - DNA, 16 bp, Homo sapiens
ccgtcattgctgctgc

SEQ ID NO: 1624862 - DNA, 13 bp, Homo sapiens
ccgtccacccagg

SEQ ID NO: 1624863 - DNA, 14 bp, Homo sapiens
ccgtccacccaggc

SEQ ID NO: 1624864 - DNA, 17 bp, Homo sapiens
ccgtccacccaggctgc

SEQ ID NO: 1624865 - DNA, 24 bp, Homo sapiens
ccgtccacccaggctgcactgcag

SEQ ID NO: 1624866 - DNA, 15 bp, Homo sapiens
ccgtccacccttcca

SEQ ID NO: 1624867 - DNA, 22 bp, Homo sapiens
ccgtccagccgccattgccacc

SEQ ID NO: 1624868 - DNA, 16 bp, Homo sapiens
ccgtccaggagcctgg

SEQ ID NO: 1624869 - DNA, 18 bp, Homo sapiens
ccgtccaggagcctgtgc

SEQ ID NO: 1624870 - DNA, 17 bp, Homo sapiens
ccgtccaggccccaccg

SEQ ID NO: 1624871 - DNA, 21 bp, Homo sapiens
ccgtccaggggagatggggag

SEQ ID NO: 1624872 - DNA, 21 bp, Homo sapiens
ccgtccatatcagaactgtgc

SEQ ID NO: 1624873 - DNA, 14 bp, Homo sapiens
ccgtccctcccagg

SEQ ID NO: 1624874 - DNA, 20 bp, Homo sapiens
ccgtccctttttctccacac

SEQ ID NO: 1624875 - DNA, 14 bp, Homo sapiens
ccgtcctcccgggc

SEQ ID NO: 1624876 - DNA, 13 bp, Homo sapiens
ccgtcctgcctgt

SEQ ID NO: 1624877 - DNA, 14 bp, Homo sapiens
ccgtcctgcctgtg

SEQ ID NO: 1624878 - DNA, 15 bp, Homo sapiens
ccgtcctgcctgtgg

SEQ ID NO: 1624879 - DNA, 17 bp, Homo sapiens
ccgtcgcgctggacagc

SEQ ID NO: 1624880 - DNA, 12 bp, Homo sapiens
ccgtctcctccc

SEQ ID NO: 1624881 - DNA, 13 bp, Homo sapiens
ccgtctcctccct

SEQ ID NO: 1624882 - DNA, 14 bp, Homo sapiens
ccgtctctactaaa

SEQ ID NO: 1624883 - DNA, 14 bp, Homo sapiens
ccgtctctgtcctc

SEQ ID NO: 1624884 - DNA, 22 bp, Homo sapiens
ccgtctgactccagagtctgag

SEQ ID NO: 1624885 - DNA, 16 bp, Homo sapiens
ccgtctggcccaccag

SEQ ID NO: 1624886 - DNA, 17 bp, Homo sapiens
ccgtctggcccaccagg

SEQ ID NO: 1624887 - DNA, 20 bp, Homo sapiens
ccgtctggggttcagcccct

SEQ ID NO: 1624888 - DNA, 21 bp, Homo sapiens
ccgtctggggttcagcccctc

SEQ ID NO: 1624889 - DNA, 22 bp, Homo sapiens
ccgtcttagaagtggaccagga

SEQ ID NO: 1624890 - DNA, 17 bp, Homo sapiens
ccgtcttcaatctctgt

SEQ ID NO: 1624891 - DNA, 20 bp, Homo sapiens
ccgtcttccctagaccttgg

SEQ ID NO: 1624892 - DNA, 19 bp, Homo sapiens
ccgtctttcttttatactg

SEQ ID NO: 1624893 - DNA, 16 bp, Homo sapiens
ccgtcttttcctgttt

SEQ ID NO: 1624894 - DNA, 17 bp, Homo sapiens
ccgtgaagcagtgcctc

SEQ ID NO: 1624895 - DNA, 12 bp, Homo sapiens
tgcactgtgaac

SEQ ID NO: 1624896 - DNA, 18 bp, Homo sapiens
tgcactgtgaaggaccct

SEQ ID NO: 1624897 - DNA, 21 bp, Homo sapiens
tgcactgtggtttcagatgtg

SEQ ID NO: 1624898 - DNA, 22 bp, Homo sapiens
tgcacttacacttataaaataa

SEQ ID NO: 1624899 - DNA, 15 bp, Homo sapiens
tgcacttacttgctt

SEQ ID NO: 1624900 - DNA, 14 bp, Homo sapiens
tgcactttccccct

SEQ ID NO: 1624901 - DNA, 16 bp, Homo sapiens
tgcactttcccccttc

SEQ ID NO: 1624902 - DNA, 18 bp, Homo sapiens
tgcactttcccccttccc

SEQ ID NO: 1624903 - DNA, 22 bp, Homo sapiens
tgcactttcccccttcccgcct

SEQ ID NO: 1624904 - DNA, 16 bp, Homo sapiens
tgcagaaaagcacctg

SEQ ID NO: 1624905 - DNA, 20 bp, Homo sapiens
tgcagaaaagcacctgccga

SEQ ID NO: 1624906 - DNA, 13 bp, Homo sapiens
tgcagaaagcatc

SEQ ID NO: 1624907 - DNA, 14 bp, Homo sapiens
tgcagaaaggagag

SEQ ID NO: 1624908 - DNA, 22 bp, Homo sapiens
tgcagaacccccaggtggcctg

SEQ ID NO: 1624909 - DNA, 14 bp, Homo sapiens
tgcagaactaaact

SEQ ID NO: 1624910 - DNA, 16 bp, Homo sapiens
tgcagaagaaggcatc

SEQ ID NO: 1624911 - DNA, 17 bp, Homo sapiens
tgcagaagaaggcatcg

SEQ ID NO: 1624912 - DNA, 14 bp, Homo sapiens
tgcagaagcatatt

SEQ ID NO: 1624913 - DNA, 22 bp, Homo sapiens
tgcagaagcatattttgctggt

SEQ ID NO: 1624914 - DNA, 14 bp, Homo sapiens
tgcagaagccaagg

SEQ ID NO: 1624915 - DNA, 17 bp, Homo sapiens
tgcagaagccaagggaa

SEQ ID NO: 1624916 - DNA, 21 bp, Homo sapiens
tgcagaagccaagggaagaca

SEQ ID NO: 1624917 - DNA, 14 bp, Homo sapiens
tgcagaagggagga

SEQ ID NO: 1624918 - DNA, 16 bp, Homo sapiens
tgcagaatacttgact

SEQ ID NO: 1624919 - DNA, 21 bp, Homo sapiens
tgcagaatacttgactcattt

SEQ ID NO: 1624920 - DNA, 20 bp, Homo sapiens
tgcagaatgtaagtgggccc

SEQ ID NO: 1624921 - DNA, 18 bp, Homo sapiens
tgcagacaaagccctgtc

SEQ ID NO: 1624922 - DNA, 20 bp, Homo sapiens
tgcagacaaagccctgtcct

SEQ ID NO: 1624923 - DNA, 22 bp, Homo sapiens
tgcagacaggctctgaggggca

SEQ ID NO: 1624924 - DNA, 14 bp, Homo sapiens
tgcagacagtctgt

SEQ ID NO: 1624925 - DNA, 23 bp, Homo sapiens
tgcagacagtctgttatgcactg

SEQ ID NO: 1624926 - DNA, 15 bp, Homo sapiens
tgcagaccatgccag

SEQ ID NO: 1624927 - DNA, 14 bp, Homo sapiens
tgcagacctcatgc

SEQ ID NO: 1624928 - DNA, 22 bp, Homo sapiens
tgcagacctcatgcccagctct

SEQ ID NO: 1624929 - DNA, 14 bp, Homo sapiens
tgcagactagaatt

SEQ ID NO: 1624930 - DNA, 17 bp, Homo sapiens
tgcagactagaattcta

SEQ ID NO: 1624931 - DNA, 20 bp, Homo sapiens
tgcagactcctcagatctga

SEQ ID NO: 1624932 - DNA, 18 bp, Homo sapiens
tgcagactgttagctttt

SEQ ID NO: 1624933 - DNA, 16 bp, Homo sapiens
tgcagacttcccagct

SEQ ID NO: 1624934 - DNA, 17 bp, Homo sapiens
tgcagagatttcctcca

SEQ ID NO: 1624935 - DNA, 19 bp, Homo sapiens
tgcagagatttcctccatg

SEQ ID NO: 1624936 - DNA, 16 bp, Homo sapiens
tgcagagccttctcag

SEQ ID NO: 1624937 - DNA, 17 bp, Homo sapiens
tgcagagccttctcaga

SEQ ID NO: 1624938 - DNA, 15 bp, Homo sapiens
tgcagaggaccacag

SEQ ID NO: 1624939 - DNA, 14 bp, Homo sapiens
tgcagaggcctggg

SEQ ID NO: 1624940 - DNA, 17 bp, Homo sapiens
tgcagaggcctggggga

SEQ ID NO: 1624941 - DNA, 19 bp, Homo sapiens
tgcagaggctatgggaaga

SEQ ID NO: 1624942 - DNA, 13 bp, Homo sapiens
tgcagaggggaaa

SEQ ID NO: 1624943 - DNA, 22 bp, Homo sapiens
tgcagaggggctttctggagag

SEQ ID NO: 1624944 - DNA, 19 bp, Homo sapiens
tgcagagggtactttaaga

SEQ ID NO: 1624945 - DNA, 15 bp, Homo sapiens
tgcagaggtaccctg

SEQ ID NO: 1624946 - DNA, 19 bp, Homo sapiens
tgcagaggtaccctgggtg

SEQ ID NO: 1624947 - DNA, 14 bp, Homo sapiens
tgcagaggtctgtg

SEQ ID NO: 1624948 - DNA, 17 bp, Homo sapiens
tgcagaggtctgtgctg

SEQ ID NO: 1624949 - DNA, 18 bp, Homo sapiens
tgcagaggtctgtgctga

SEQ ID NO: 1624950 - DNA, 19 bp, Homo sapiens
tgcagaggtctgtgctgag

SEQ ID NO: 1624951 - DNA, 15 bp, Homo sapiens
tgcagagtaagtatt

SEQ ID NO: 1624952 - DNA, 19 bp, Homo sapiens
tgcagagtatttctaaagt

SEQ ID NO: 1624953 - DNA, 14 bp, Homo sapiens
tgcagagtgcccag

SEQ ID NO: 1624954 - DNA, 16 bp, Homo sapiens
tgcagatatctgcatg

SEQ ID NO: 1624955 - DNA, 21 bp, Homo sapiens
tgcagatcttccgtggtcaga

SEQ ID NO: 1624956 - DNA, 18 bp, Homo sapiens
tgcagatgagcagtcaca

SEQ ID NO: 1624957 - DNA, 15 bp, Homo sapiens
tgcagatgcaattgt

SEQ ID NO: 1624958 - DNA, 22 bp, Homo sapiens
tgcagatgggtgatatataatg

SEQ ID NO: 1624959 - DNA, 16 bp, Homo sapiens
tgcagattcctgggcc

SEQ ID NO: 1624960 - DNA, 21 bp, Homo sapiens
tgcagattcctgggcctgtcc

SEQ ID NO: 1624961 - DNA, 22 bp, Homo sapiens
tgcagattcctgggcctgtccc

SEQ ID NO: 1624962 - DNA, 23 bp, Homo sapiens
tgcagattcctgggcctgtcccc

SEQ ID NO: 1624963 - DNA, 18 bp, Homo sapiens
tgcagcaaacactccacc

SEQ ID NO: 1624964 - DNA, 19 bp, Homo sapiens
tgcagcaaacactccaccc

SEQ ID NO: 1624965 - DNA, 22 bp, Homo sapiens
tgcagcaaacactccaccctcc

SEQ ID NO: 1624966 - DNA, 21 bp, Homo sapiens
tgcagcacatgcgggctcgcc

SEQ ID NO: 1624967 - DNA, 17 bp, Homo sapiens
tgcagcaccgaggggcc

SEQ ID NO: 1624968 - DNA, 20 bp, Homo sapiens
tgcagcaccgaggggccttt

SEQ ID NO: 1624969 - DNA, 21 bp, Homo sapiens
tgcagcaccgaggggcctttg

SEQ ID NO: 1624970 - DNA, 19 bp, Homo sapiens
tgcagcacctccaggcctg

SEQ ID NO: 1624971 - DNA, 14 bp, Homo sapiens
tgcagcagcccagc

SEQ ID NO: 1624972 - DNA, 19 bp, Homo sapiens
tgcagcagcccagcttcct

SEQ ID NO: 1624973 - DNA, 18 bp, Homo sapiens
tgcagcaggtgctgggct

SEQ ID NO: 1624974 - DNA, 20 bp, Homo sapiens
tgcagcaggtgctgggctgg

SEQ ID NO: 1624975 - DNA, 18 bp, Homo sapiens
tgcagcagtgagtctctt

SEQ ID NO: 1624976 - DNA, 22 bp, Homo sapiens
tgcagcagtgagtctcttcaga

SEQ ID NO: 1624977 - DNA, 19 bp, Homo sapiens
tgcagcatgacctgtgacc

SEQ ID NO: 1624978 - DNA, 23 bp, Homo sapiens
tgcagcatgacctgtgaccagca

SEQ ID NO: 1624979 - DNA, 14 bp, Homo sapiens
tgcagcatgagact

SEQ ID NO: 1624980 - DNA, 19 bp, Homo sapiens
tgcagcatgagactttctg

SEQ ID NO: 1624981 - DNA, 21 bp, Homo sapiens
tgcagcatgttgctgaggagt

SEQ ID NO: 1624982 - DNA, 21 bp, Homo sapiens
tgcagcatttactatgcacaa

SEQ ID NO: 1624983 - DNA, 22 bp, Homo sapiens
tgcagcatttactatgcacaac

SEQ ID NO: 1624984 - DNA, 12 bp, Homo sapiens
tgcagccagccc

SEQ ID NO: 1624985 - DNA, 21 bp, Homo sapiens
tgcagccagcccagcccagct

SEQ ID NO: 1624986 - DNA, 19 bp, Homo sapiens
tgcagcccatgcccacctg

SEQ ID NO: 1624987 - DNA, 21 bp, Homo sapiens
tgcagccccgcgcctccttcc

SEQ ID NO: 1624988 - DNA, 18 bp, Homo sapiens
tgcagccggcacagggtc

SEQ ID NO: 1624989 - DNA, 17 bp, Homo sapiens
tgcagcctccacttccc

SEQ ID NO: 1624990 - DNA, 17 bp, Homo sapiens
tgcagcctccgcctccc

SEQ ID NO: 1624991 - DNA, 16 bp, Homo sapiens
tgcagcctcctcctga

SEQ ID NO: 1624992 - DNA, 19 bp, Homo sapiens
tgcagcctcctcctgacca

SEQ ID NO: 1624993 - DNA, 22 bp, Homo sapiens
tgcagcctgctctagtgggaca

SEQ ID NO: 1624994 - DNA, 13 bp, Homo sapiens
tgcagcctgtggc

SEQ ID NO: 1624995 - DNA, 17 bp, Homo sapiens
tgcagcctgtggcttgg

SEQ ID NO: 1624996 - DNA, 23 bp, Homo sapiens
tgcagcgcccggtgctctgtgtc

SEQ ID NO: 1624997 - DNA, 19 bp, Homo sapiens
tgcagctcaagggctggca

SEQ ID NO: 1624998 - DNA, 13 bp, Homo sapiens
tgcagctcactgc

SEQ ID NO: 1624999 - DNA, 22 bp, Homo sapiens
tgcagctgaaattgaaaagtta

SEQ ID NO: 1625000 - DNA, 15 bp, Homo sapiens
tgcagctgacctctg

SEQ ID NO: 1625001 - DNA, 16 bp, Homo sapiens
tgcagctgatgttgga

SEQ ID NO: 1625002 - DNA, 18 bp, Homo sapiens
tgcagctgctccccaggc

SEQ ID NO: 1625003 - DNA, 13 bp, Homo sapiens
tgcagctgtgaga

SEQ ID NO: 1625004 - DNA, 14 bp, Homo sapiens
tgcagctgtgagaa

SEQ ID NO: 1625005 - DNA, 22 bp, Homo sapiens
tgcagctgtggcagagttacag

SEQ ID NO: 1625006 - DNA, 19 bp, Homo sapiens
tgcagctgtttcaaagttg

SEQ ID NO: 1625007 - DNA, 21 bp, Homo sapiens
tgcagcttttggttaatatgt

SEQ ID NO: 1625008 - DNA, 16 bp, Homo sapiens
tgcaggaacgagcact

SEQ ID NO: 1625009 - DNA, 14 bp, Homo sapiens
cctaagtggctgct

SEQ ID NO: 1625010 - DNA, 15 bp, Homo sapiens
cctaagtggctgctg

SEQ ID NO: 1625011 - DNA, 23 bp, Homo sapiens
cctaagtgtttactatgtgccag

SEQ ID NO: 1625012 - DNA, 19 bp, Homo sapiens
cctaatccaggcagatcca

SEQ ID NO: 1625013 - DNA, 20 bp, Homo sapiens
cctaatccaggcagatccag

SEQ ID NO: 1625014 - DNA, 20 bp, Homo sapiens
cctaatggctatttttgaag

SEQ ID NO: 1625015 - DNA, 15 bp, Homo sapiens
cctaatgtatctagt

SEQ ID NO: 1625016 - DNA, 19 bp, Homo sapiens
cctaatgtttatgagccag

SEQ ID NO: 1625017 - DNA, 23 bp, Homo sapiens
cctaattatgaatccaacgtgta

SEQ ID NO: 1625018 - DNA, 11 bp, Homo sapiens
cctaattattg

SEQ ID NO: 1625019 - DNA, 20 bp, Homo sapiens
cctaatttctcctcccttcc

SEQ ID NO: 1625020 - DNA, 18 bp, Homo sapiens
cctaattttaaataattt

SEQ ID NO: 1625021 - DNA, 19 bp, Homo sapiens
cctacaagagcagcctgtg

SEQ ID NO: 1625022 - DNA, 15 bp, Homo sapiens
cctacaagctggcac

SEQ ID NO: 1625023 - DNA, 21 bp, Homo sapiens
cctacacacataccttcatgt

SEQ ID NO: 1625024 - DNA, 21 bp, Homo sapiens
cctacacacgtaccttcatgt

SEQ ID NO: 1625025 - DNA, 14 bp, Homo sapiens
cctacacactgtca

SEQ ID NO: 1625026 - DNA, 15 bp, Homo sapiens
cctacacactgtcat

SEQ ID NO: 1625027 - DNA, 13 bp, Homo sapiens
cctacacccctgt

SEQ ID NO: 1625028 - DNA, 15 bp, Homo sapiens
cctacacccctgtgc

SEQ ID NO: 1625029 - DNA, 14 bp, Homo sapiens
cctacacctccctc

SEQ ID NO: 1625030 - DNA, 15 bp, Homo sapiens
cctacagacctggct

SEQ ID NO: 1625031 - DNA, 17 bp, Homo sapiens
cctacagacctggctct

SEQ ID NO: 1625032 - DNA, 17 bp, Homo sapiens
cctacagactccatctc

SEQ ID NO: 1625033 - DNA, 14 bp, Homo sapiens
cctacagatgaact

SEQ ID NO: 1625034 - DNA, 19 bp, Homo sapiens
cctacagcctagggcagac

SEQ ID NO: 1625035 - DNA, 16 bp, Homo sapiens
cctacagcctgcacac

SEQ ID NO: 1625036 - DNA, 20 bp, Homo sapiens
cctacagctttgatccctga

SEQ ID NO: 1625037 - DNA, 15 bp, Homo sapiens
cctacagttttaact

SEQ ID NO: 1625038 - DNA, 19 bp, Homo sapiens
cctacagttttaactgtgg

SEQ ID NO: 1625039 - DNA, 20 bp, Homo sapiens
cctacagttttaactgtgga

SEQ ID NO: 1625040 - DNA, 13 bp, Homo sapiens
cctaccacagtgt

SEQ ID NO: 1625041 - DNA, 17 bp, Homo sapiens
cctaccagatgccagtc

SEQ ID NO: 1625042 - DNA, 19 bp, Homo sapiens
cctaccagcgcccgctggg

SEQ ID NO: 1625043 - DNA, 20 bp, Homo sapiens
cctaccagcgcccgctgggc

SEQ ID NO: 1625044 - DNA, 23 bp, Homo sapiens
cctaccagcgcccgctgggctga

SEQ ID NO: 1625045 - DNA, 12 bp, Homo sapiens
cctaccccacac

SEQ ID NO: 1625046 - DNA, 14 bp, Homo sapiens
cctaccccaccacg

SEQ ID NO: 1625047 - DNA, 23 bp, Homo sapiens
cctaccccttggaaatgtctgct

SEQ ID NO: 1625048 - DNA, 17 bp, Homo sapiens
cctaccgagtctcttct

SEQ ID NO: 1625049 - DNA, 22 bp, Homo sapiens
cctaccgctggccctgccgttt

SEQ ID NO: 1625050 - DNA, 16 bp, Homo sapiens
cctacctcagcctaga

SEQ ID NO: 1625051 - DNA, 15 bp, Homo sapiens
cctacctctggtgat

SEQ ID NO: 1625052 - DNA, 14 bp, Homo sapiens
cctacctgtgcctg

SEQ ID NO: 1625053 - DNA, 16 bp, Homo sapiens
cctacctgtgcctgac

SEQ ID NO: 1625054 - DNA, 17 bp, Homo sapiens
cctacctgttcagtgtc

SEQ ID NO: 1625055 - DNA, 16 bp, Homo sapiens
cctaccttgcctcctt

SEQ ID NO: 1625056 - DNA, 17 bp, Homo sapiens
cctacggagtcagccag

SEQ ID NO: 1625057 - DNA, 22 bp, Homo sapiens
cctacgggcgctgcagcctccc

SEQ ID NO: 1625058 - DNA, 22 bp, Homo sapiens
cctacgtttgcaccgcctgccc

SEQ ID NO: 1625059 - DNA, 24 bp, Homo sapiens
cctactacccattgttcccttcct

SEQ ID NO: 1625060 - DNA, 19 bp, Homo sapiens
cctactaggagaggggggc

SEQ ID NO: 1625061 - DNA, 18 bp, Homo sapiens
cctactcacacttcagct

SEQ ID NO: 1625062 - DNA, 16 bp, Homo sapiens
cctactccaaaatgtt

SEQ ID NO: 1625063 - DNA, 15 bp, Homo sapiens
cctactccactgccc

SEQ ID NO: 1625064 - DNA, 17 bp, Homo sapiens
cctactccactgccctg

SEQ ID NO: 1625065 - DNA, 15 bp, Homo sapiens
cctactcccctgggc

SEQ ID NO: 1625066 - DNA, 12 bp, Homo sapiens
cctactccctct

SEQ ID NO: 1625067 - DNA, 13 bp, Homo sapiens
cctactccctgca

SEQ ID NO: 1625068 - DNA, 20 bp, Homo sapiens
tgcagtcggcatgccaggac

SEQ ID NO: 1625069 - DNA, 21 bp, Homo sapiens
tgcagtcggcatgccaggacc

SEQ ID NO: 1625070 - DNA, 14 bp, Homo sapiens
tgcagtgagccatg

SEQ ID NO: 1625071 - DNA, 16 bp, Homo sapiens
tgcagtgatacatgta

SEQ ID NO: 1625072 - DNA, 23 bp, Homo sapiens
tgcagtgccttggggaatttcct

SEQ ID NO: 1625073 - DNA, 16 bp, Homo sapiens
tgcagtgcttccaagg

SEQ ID NO: 1625074 - DNA, 15 bp, Homo sapiens
tgcagtggcctggcc

SEQ ID NO: 1625075 - DNA, 18 bp, Homo sapiens
tgcagtggcgcattctag

SEQ ID NO: 1625076 - DNA, 17 bp, Homo sapiens
tgcagtggctcacgcct

SEQ ID NO: 1625077 - DNA, 21 bp, Homo sapiens
tgcagtgtggagttcaccttg

SEQ ID NO: 1625078 - DNA, 23 bp, Homo sapiens
tgcagttaacaggatattagaca

SEQ ID NO: 1625079 - DNA, 21 bp, Homo sapiens
tgcagttacaaattataatgt

SEQ ID NO: 1625080 - DNA, 23 bp, Homo sapiens
tgcagttacaaattataatgtat

SEQ ID NO: 1625081 - DNA, 21 bp, Homo sapiens
tgcagttacactaaaaggtga

SEQ ID NO: 1625082 - DNA, 16 bp, Homo sapiens
tgcagttcagaatggc

SEQ ID NO: 1625083 - DNA, 17 bp, Homo sapiens
tgcagttctagtttgca

SEQ ID NO: 1625084 - DNA, 14 bp, Homo sapiens
tgcagttgataaga

SEQ ID NO: 1625085 - DNA, 18 bp, Homo sapiens
tgcagttggactctcagg

SEQ ID NO: 1625086 - DNA, 19 bp, Homo sapiens
tgcagttggactctcaggg

SEQ ID NO: 1625087 - DNA, 15 bp, Homo sapiens
tgcagttgtgatttc

SEQ ID NO: 1625088 - DNA, 18 bp, Homo sapiens
tgcagtttaagagcagaa

SEQ ID NO: 1625089 - DNA, 14 bp, Homo sapiens
tgcagtttcctgga

SEQ ID NO: 1625090 - DNA, 14 bp, Homo sapiens
tgcagtttcttttc

SEQ ID NO: 1625091 - DNA, 16 bp, Homo sapiens
tgcagtttggccctgg

SEQ ID NO: 1625092 - DNA, 22 bp, Homo sapiens
tgcagtttggccctggagccag

SEQ ID NO: 1625093 - DNA, 21 bp, Homo sapiens
tgcagttttaatacttgtaat

SEQ ID NO: 1625094 - DNA, 15 bp, Homo sapiens
tgcagtttttcagga

SEQ ID NO: 1625095 - DNA, 17 bp, Homo sapiens
tgcataagttaacttcc

SEQ ID NO: 1625096 - DNA, 19 bp, Homo sapiens
tgcataataagctaaagag

SEQ ID NO: 1625097 - DNA, 18 bp, Homo sapiens
tgcatacttcctggattt

SEQ ID NO: 1625098 - DNA, 21 bp, Homo sapiens
tgcatacttcctggattttct

SEQ ID NO: 1625099 - DNA, 22 bp, Homo sapiens
tgcatactttgtattttgatta

SEQ ID NO: 1625100 - DNA, 18 bp, Homo sapiens
tgcatagaacaaaagatt

SEQ ID NO: 1625101 - DNA, 22 bp, Homo sapiens
tgcatagcagatggtttccaca

SEQ ID NO: 1625102 - DNA, 18 bp, Homo sapiens
tgcatagcgtcctgccct

SEQ ID NO: 1625103 - DNA, 20 bp, Homo sapiens
tgcatagcgtcctgccctgc

SEQ ID NO: 1625104 - DNA, 15 bp, Homo sapiens
tgcatagctctattt

SEQ ID NO: 1625105 - DNA, 16 bp, Homo sapiens
tgcataggtctggaag

SEQ ID NO: 1625106 - DNA, 20 bp, Homo sapiens
tgcataggttagatatagag

SEQ ID NO: 1625107 - DNA, 21 bp, Homo sapiens
tgcatagtaccaatcatttta

SEQ ID NO: 1625108 - DNA, 22 bp, Homo sapiens
tgcatagtaccaatcattttaa

SEQ ID NO: 1625109 - DNA, 15 bp, Homo sapiens
tgcatatatatatgt

SEQ ID NO: 1625110 - DNA, 15 bp, Homo sapiens
tgcatatcacccttc

SEQ ID NO: 1625111 - DNA, 20 bp, Homo sapiens
tgcatatcctggtgtctagt

SEQ ID NO: 1625112 - DNA, 17 bp, Homo sapiens
tgcatatcgctgggctc

SEQ ID NO: 1625113 - DNA, 17 bp, Homo sapiens
tgcatatctgcctcccc

SEQ ID NO: 1625114 - DNA, 14 bp, Homo sapiens
tgcatattcaatgt

SEQ ID NO: 1625115 - DNA, 20 bp, Homo sapiens
tgcatattgtattactagaa

SEQ ID NO: 1625116 - DNA, 22 bp, Homo sapiens
tgcatatttattgcattgctgg

SEQ ID NO: 1625117 - DNA, 23 bp, Homo sapiens
tgcatatttgccacaaaacctgt

SEQ ID NO: 1625118 - DNA, 16 bp, Homo sapiens
tgcatattttgagaaa

SEQ ID NO: 1625119 - DNA, 13 bp, Homo sapiens
tgcatcagaaagc

SEQ ID NO: 1625120 - DNA, 13 bp, Homo sapiens
tgcatcagctgct

SEQ ID NO: 1625121 - DNA, 19 bp, Homo sapiens
tgcatcagctgctgaaaca

SEQ ID NO: 1625122 - DNA, 13 bp, Homo sapiens
tgcatcatatatt

SEQ ID NO: 1625123 - DNA, 13 bp, Homo sapiens
tgccaagccagat

SEQ ID NO: 1625124 - DNA, 23 bp, Homo sapiens
tgccaagctccaagccccatctt

SEQ ID NO: 1625125 - DNA, 18 bp, Homo sapiens
tgccaaggcagaggcctg

SEQ ID NO: 1625126 - DNA, 22 bp, Homo sapiens
tgccaaggcagaggcctgggct

SEQ ID NO: 1625127 - DNA, 21 bp, Homo sapiens
tgccaaggccagagtggcctg

SEQ ID NO: 1625128 - DNA, 17 bp, Homo sapiens
tgccaagggccccaggg

SEQ ID NO: 1625129 - DNA, 18 bp, Homo sapiens
tgccaagggccccagggg

SEQ ID NO: 1625130 - DNA, 20 bp, Homo sapiens
tgccaagggccccaggggca

SEQ ID NO: 1625131 - DNA, 21 bp, Homo sapiens
tgccaagggccccaggggcag

SEQ ID NO: 1625132 - DNA, 17 bp, Homo sapiens
tgccaagtcctagctcc

SEQ ID NO: 1625133 - DNA, 18 bp, Homo sapiens
tgccaagttgctgtcact

SEQ ID NO: 1625134 - DNA, 11 bp, Homo sapiens
tgccaataaag

SEQ ID NO: 1625135 - DNA, 15 bp, Homo sapiens
tgccaattgctaccg

SEQ ID NO: 1625136 - DNA, 14 bp, Homo sapiens
tgccaatttcctct

SEQ ID NO: 1625137 - DNA, 23 bp, Homo sapiens
tgccaatttcctctccactgctg

SEQ ID NO: 1625138 - DNA, 17 bp, Homo sapiens
tgccaatttttgccttc

SEQ ID NO: 1625139 - DNA, 17 bp, Homo sapiens
tgccacaaccagccagg

SEQ ID NO: 1625140 - DNA, 23 bp, Homo sapiens
tgccacaatgcagttctgagcac

SEQ ID NO: 1625141 - DNA, 22 bp, Homo sapiens
tgccacacaaggatagatgctg

SEQ ID NO: 1625142 - DNA, 20 bp, Homo sapiens
tgccacacagagtggtcttt

SEQ ID NO: 1625143 - DNA, 13 bp, Homo sapiens
tgccacaccctcc

SEQ ID NO: 1625144 - DNA, 14 bp, Homo sapiens
tgccacaccctccc

SEQ ID NO: 1625145 - DNA, 18 bp, Homo sapiens
tgccacaccctccccatt

SEQ ID NO: 1625146 - DNA, 20 bp, Homo sapiens
tgccacaccctccccattca

SEQ ID NO: 1625147 - DNA, 15 bp, Homo sapiens
tgccacacctggcct

SEQ ID NO: 1625148 - DNA, 16 bp, Homo sapiens
tgccacacctggcctt

SEQ ID NO: 1625149 - DNA, 21 bp, Homo sapiens
tgccacactcagtcccccacc

SEQ ID NO: 1625150 - DNA, 16 bp, Homo sapiens
tgccacactgatggct

SEQ ID NO: 1625151 - DNA, 16 bp, Homo sapiens
tgccacacttcaggct

SEQ ID NO: 1625152 - DNA, 22 bp, Homo sapiens
tgccacacttcaggctcttctc

SEQ ID NO: 1625153 - DNA, 21 bp, Homo sapiens
tgccacataccaggcaacctc

SEQ ID NO: 1625154 - DNA, 22 bp, Homo sapiens
tgccacatcaaacctttgagta

SEQ ID NO: 1625155 - DNA, 18 bp, Homo sapiens
tgccaccaacactgctca

SEQ ID NO: 1625156 - DNA, 13 bp, Homo sapiens
tgccaccacccac

SEQ ID NO: 1625157 - DNA, 16 bp, Homo sapiens
tgccaccacccacccc

SEQ ID NO: 1625158 - DNA, 17 bp, Homo sapiens
tgccaccaccctgcccc

SEQ ID NO: 1625159 - DNA, 18 bp, Homo sapiens
tgccaccacgtctgccag

SEQ ID NO: 1625160 - DNA, 23 bp, Homo sapiens
tgccaccacgtctgccaggccca

SEQ ID NO: 1625161 - DNA, 14 bp, Homo sapiens
tgccaccaggagaa

SEQ ID NO: 1625162 - DNA, 17 bp, Homo sapiens
tgccaccaggccacctc

SEQ ID NO: 1625163 - DNA, 17 bp, Homo sapiens
tgccacccaccagggcg

SEQ ID NO: 1625164 - DNA, 15 bp, Homo sapiens
tgccacccccagttc

SEQ ID NO: 1625165 - DNA, 17 bp, Homo sapiens
tgccaccccttcctccc

SEQ ID NO: 1625166 - DNA, 22 bp, Homo sapiens
tgccacccgtaggcagcctctc

SEQ ID NO: 1625167 - DNA, 12 bp, Homo sapiens
tgccaccctacc

SEQ ID NO: 1625168 - DNA, 14 bp, Homo sapiens
tgccaccctacctg

SEQ ID NO: 1625169 - DNA, 22 bp, Homo sapiens
tgccaccggcctgtgggtctct

SEQ ID NO: 1625170 - DNA, 13 bp, Homo sapiens
tgccacctggcaa

SEQ ID NO: 1625171 - DNA, 15 bp, Homo sapiens
tgccacgcctggaag

SEQ ID NO: 1625172 - DNA, 19 bp, Homo sapiens
tgccactaaactacattgt

SEQ ID NO: 1625173 - DNA, 18 bp, Homo sapiens
tgccactaattttagtat

SEQ ID NO: 1625174 - DNA, 21 bp, Homo sapiens
tgccactaccccttgattttc

SEQ ID NO: 1625175 - DNA, 21 bp, Homo sapiens
tgccactcactaggcccccac

SEQ ID NO: 1625176 - DNA, 17 bp, Homo sapiens
tgccactcctccctccg

SEQ ID NO: 1625177 - DNA, 18 bp, Homo sapiens
tgccactctctgggactc

SEQ ID NO: 1625178 - DNA, 20 bp, Homo sapiens
tgccactctctgggactctc

SEQ ID NO: 1625179 - DNA, 19 bp, Homo sapiens
tgccactgactgcagggac

SEQ ID NO: 1625180 - DNA, 17 bp, Homo sapiens
tgccactgccaggcacc

SEQ ID NO: 1625181 - DNA, 20 bp, Homo sapiens
tgccactgccaggcacctgg

SEQ ID NO: 1625182 - DNA, 22 bp, Homo sapiens
tgccactgccttcgcttcttgc

SEQ ID NO: 1625183 - DNA, 19 bp, Homo sapiens
tgccactggggaaaactcc

SEQ ID NO: 1625184 - DNA, 14 bp, Homo sapiens
tgccacttaatgta

SEQ ID NO: 1625185 - DNA, 18 bp, Homo sapiens
tgccacttaatgtatgtt

SEQ ID NO: 1625186 - DNA, 18 bp, Homo sapiens
tgactagggattcaggct

SEQ ID NO: 1625187 - DNA, 21 bp, Homo sapiens
tgactagggattcaggctgct

SEQ ID NO: 1625188 - DNA, 13 bp, Homo sapiens
tgactataaagct

SEQ ID NO: 1625189 - DNA, 16 bp, Homo sapiens
tgactataaagctgtt

SEQ ID NO: 1625190 - DNA, 17 bp, Homo sapiens
tgactataaagctgtta

SEQ ID NO: 1625191 - DNA, 16 bp, Homo sapiens
tgactatcaaactgaa

SEQ ID NO: 1625192 - DNA, 22 bp, Homo sapiens
tgactatcaaactgaagccaga

SEQ ID NO: 1625193 - DNA, 14 bp, Homo sapiens
tgactatgacataa

SEQ ID NO: 1625194 - DNA, 20 bp, Homo sapiens
tgactattgaagttgcagat

SEQ ID NO: 1625195 - DNA, 14 bp, Homo sapiens
tgactcaacatgtt

SEQ ID NO: 1625196 - DNA, 23 bp, Homo sapiens
tgactcaacatgttactgaccag

SEQ ID NO: 1625197 - DNA, 11 bp, Homo sapiens
tgactcaccca

SEQ ID NO: 1625198 - DNA, 13 bp, Homo sapiens
ccctgctctctga

SEQ ID NO: 1625199 - DNA, 21 bp, Homo sapiens
ccctgctgaacacagtgtctg

SEQ ID NO: 1625200 - DNA, 12 bp, Homo sapiens
ccctgctgccca

SEQ ID NO: 1625201 - DNA, 13 bp, Homo sapiens
ccctgctgctggt

SEQ ID NO: 1625202 - DNA, 13 bp, Homo sapiens
ccctgctgtctct

SEQ ID NO: 1625203 - DNA, 18 bp, Homo sapiens
ccctgctgtctctctggg

SEQ ID NO: 1625204 - DNA, 20 bp, Homo sapiens
ccctgctgtctctctgggct

SEQ ID NO: 1625205 - DNA, 17 bp, Homo sapiens
ccctgctgtgccatgct

SEQ ID NO: 1625206 - DNA, 13 bp, Homo sapiens
ccctgctgtttat

SEQ ID NO: 1625207 - DNA, 16 bp, Homo sapiens
ccctgcttccaggaaa

SEQ ID NO: 1625208 - DNA, 12 bp, Homo sapiens
ccctgcttctgc

SEQ ID NO: 1625209 - DNA, 13 bp, Homo sapiens
ccctgcttctgct

SEQ ID NO: 1625210 - DNA, 19 bp, Homo sapiens
ccctgcttctgctgccctg

SEQ ID NO: 1625211 - DNA, 20 bp, Homo sapiens
ccctgcttctgctgccctga

SEQ ID NO: 1625212 - DNA, 21 bp, Homo sapiens
ccctgcttgcacacttcccca

SEQ ID NO: 1625213 - DNA, 17 bp, Homo sapiens
ccctgctttgggctgcc

SEQ ID NO: 1625214 - DNA, 19 bp, Homo sapiens
ccctgctttgggctgccct

SEQ ID NO: 1625215 - DNA, 21 bp, Homo sapiens
ccctggaaacccacctctctg

SEQ ID NO: 1625216 - DNA, 15 bp, Homo sapiens
ccctggaaaccttcc

SEQ ID NO: 1625217 - DNA, 16 bp, Homo sapiens
ccctggaaaccttcca

SEQ ID NO: 1625218 - DNA, 12 bp, Homo sapiens
ccctggaagccg

SEQ ID NO: 1625219 - DNA, 19 bp, Homo sapiens
ccctggaagctctccgagc

SEQ ID NO: 1625220 - DNA, 19 bp, Homo sapiens
ccctggaagctggaagact

SEQ ID NO: 1625221 - DNA, 18 bp, Homo sapiens
ccctggaattcagcaccc

SEQ ID NO: 1625222 - DNA, 14 bp, Homo sapiens
ccctggacaggcag

SEQ ID NO: 1625223 - DNA, 15 bp, Homo sapiens
ccctggacaggcagc

SEQ ID NO: 1625224 - DNA, 19 bp, Homo sapiens
ccctggaccaccagcccca

SEQ ID NO: 1625225 - DNA, 19 bp, Homo sapiens
ccctggaccagcctcctgt

SEQ ID NO: 1625226 - DNA, 10 bp, Homo sapiens
ccctggagag

SEQ ID NO: 1625227 - DNA, 15 bp, Homo sapiens
ccctggagcaggagc

SEQ ID NO: 1625228 - DNA, 13 bp, Homo sapiens
ccctggagccaga

SEQ ID NO: 1625229 - DNA, 15 bp, Homo sapiens
ccctggagccagcag

SEQ ID NO: 1625230 - DNA, 23 bp, Homo sapiens
ccctggagccagggcagaggaat

SEQ ID NO: 1625231 - DNA, 14 bp, Homo sapiens
ccctggagccatcc

SEQ ID NO: 1625232 - DNA, 17 bp, Homo sapiens
ccctggagccatccctt

SEQ ID NO: 1625233 - DNA, 13 bp, Homo sapiens
ccctggagctgtc

SEQ ID NO: 1625234 - DNA, 19 bp, Homo sapiens
ccctggagctgtccttcat

SEQ ID NO: 1625235 - DNA, 22 bp, Homo sapiens
ccctggaggcacgcaccactgc

SEQ ID NO: 1625236 - DNA, 23 bp, Homo sapiens
ccctggaggcacgcaccactgct

SEQ ID NO: 1625237 - DNA, 19 bp, Homo sapiens
ccctggaggcactgaagtg

SEQ ID NO: 1625238 - DNA, 23 bp, Homo sapiens
ccctggaggggacttccacacct

SEQ ID NO: 1625239 - DNA, 18 bp, Homo sapiens
ccctggaggtctccaggg

SEQ ID NO: 1625240 - DNA, 19 bp, Homo sapiens
ccctggaggtctccagggg

SEQ ID NO: 1625241 - DNA, 21 bp, Homo sapiens
ccctggaggtctccaggggcc

SEQ ID NO: 1625242 - DNA, 15 bp, Homo sapiens
ccctggatgggcatt

SEQ ID NO: 1625243 - DNA, 22 bp, Homo sapiens
ccctggatgtcccctgtcccac

SEQ ID NO: 1625244 - DNA, 20 bp, Homo sapiens
ccctggatgtgtggggcatg

SEQ ID NO: 1625245 - DNA, 18 bp, Homo sapiens
ccctggcagacacaaccc

SEQ ID NO: 1625246 - DNA, 20 bp, Homo sapiens
ccctggcaggatgaccctgc

SEQ ID NO: 1625247 - DNA, 22 bp, Homo sapiens
ccctggcagggacctgagagca

SEQ ID NO: 1625248 - DNA, 22 bp, Homo sapiens
ccctggccactaaagcttcaga

SEQ ID NO: 1625249 - DNA, 23 bp, Homo sapiens
ccctggccactaaagcttcagac

SEQ ID NO: 1625250 - DNA, 17 bp, Homo sapiens
ccctggccctgaggtgt

SEQ ID NO: 1625251 - DNA, 20 bp, Homo sapiens
ccctggccctgcccagccca

SEQ ID NO: 1625252 - DNA, 15 bp, Homo sapiens
ccctggccgccccct

SEQ ID NO: 1625253 - DNA, 11 bp, Homo sapiens
ccctggcctcc

SEQ ID NO: 1625254 - DNA, 15 bp, Homo sapiens
ccctggcctctgtgc

SEQ ID NO: 1625255 - DNA, 18 bp, Homo sapiens
ccctggcctctgtgcctt

SEQ ID NO: 1625256 - DNA, 19 bp, Homo sapiens
ccctggcctgaactgagga

SEQ ID NO: 1625257 - DNA, 20 bp, Homo sapiens
ccctggcctgaactgaggag

SEQ ID NO: 1625258 - DNA, 13 bp, Homo sapiens
ccctggcctggtc

SEQ ID NO: 1625259 - DNA, 23 bp, Homo sapiens
ccctggcctggtccctggtcctt

SEQ ID NO: 1625260 - DNA, 17 bp, Homo sapiens
ccctggctcccacaggc

SEQ ID NO: 1625261 - DNA, 16 bp, Homo sapiens
ccctggctccctcctc

SEQ ID NO: 1625262 - DNA, 18 bp, Homo sapiens
ccctggctccctcctcca

SEQ ID NO: 1625263 - DNA, 18 bp, Homo sapiens
ccctggctgccctggccc

SEQ ID NO: 1625264 - DNA, 13 bp, Homo sapiens
ccctggctgctgc

SEQ ID NO: 1625265 - DNA, 18 bp, Homo sapiens
ccctggctgctgccccca

SEQ ID NO: 1625266 - DNA, 22 bp, Homo sapiens
ccctggctgctgcccccacccc

SEQ ID NO: 1625267 - DNA, 15 bp, Homo sapiens
ccctggctgtgagca

SEQ ID NO: 1625268 - DNA, 21 bp, Homo sapiens
ccctggctgtgagcagcctcc

SEQ ID NO: 1625269 - DNA, 22 bp, Homo sapiens
ccctggctgttctgtggttcct

SEQ ID NO: 1625270 - DNA, 15 bp, Homo sapiens
ccctggcttggaggc

SEQ ID NO: 1625271 - DNA, 16 bp, Homo sapiens
ccctggctttgcctct

SEQ ID NO: 1625272 - DNA, 17 bp, Homo sapiens
ccctggctttgcctctt

SEQ ID NO: 1625273 - DNA, 22 bp, Homo sapiens
ccctggctttgcctcttctttg

SEQ ID NO: 1625274 - DNA, 22 bp, Homo sapiens
ccctgggaagcctgtgccagca

SEQ ID NO: 1625275 - DNA, 23 bp, Homo sapiens
ccctgggacatcaggagactggg

SEQ ID NO: 1625276 - DNA, 17 bp, Homo sapiens
ccctgggagccagtcct

SEQ ID NO: 1625277 - DNA, 14 bp, Homo sapiens
ccctgggagggagg

SEQ ID NO: 1625278 - DNA, 21 bp, Homo sapiens
ccctgggagggaggtggtcct

SEQ ID NO: 1625279 - DNA, 15 bp, Homo sapiens
ccctgggatgtccac

SEQ ID NO: 1625280 - DNA, 21 bp, Homo sapiens
ccctgggcatcttctggcttg

SEQ ID NO: 1625281 - DNA, 14 bp, Homo sapiens
ccctgggccccacc

SEQ ID NO: 1625282 - DNA, 20 bp, Homo sapiens
ccctgggccccaccacctag

SEQ ID NO: 1625283 - DNA, 16 bp, Homo sapiens
ccctgggccctgggct

SEQ ID NO: 1625284 - DNA, 18 bp, Homo sapiens
ccctgggccctgggctgg

SEQ ID NO: 1625285 - DNA, 18 bp, Homo sapiens
ccctgggctaccatctgc

SEQ ID NO: 1625286 - DNA, 13 bp, Homo sapiens
ccctgggctccac

SEQ ID NO: 1625287 - DNA, 22 bp, Homo sapiens
ccctgggctccacacagcagtg

SEQ ID NO: 1625288 - DNA, 15 bp, Homo sapiens
ccctgggctgatgga

SEQ ID NO: 1625289 - DNA, 24 bp, Homo sapiens
ccctgggctgatggaagatggtcc

SEQ ID NO: 1625290 - DNA, 13 bp, Homo sapiens
ccctgggctggaa

SEQ ID NO: 1625291 - DNA, 15 bp, Homo sapiens
ccctgggctgtgcta

SEQ ID NO: 1625292 - DNA, 20 bp, Homo sapiens
ccctgggcttggcctgctgt

SEQ ID NO: 1625293 - DNA, 21 bp, Homo sapiens
ccctgggcttggcctgctgtg

SEQ ID NO: 1625294 - DNA, 18 bp, Homo sapiens
ccctggggaaggagccag

SEQ ID NO: 1625295 - DNA, 15 bp, Homo sapiens
ccctggggaccagga

SEQ ID NO: 1625296 - DNA, 22 bp, Homo sapiens
ccctggggagcttttgcccaca

SEQ ID NO: 1625297 - DNA, 21 bp, Homo sapiens
ccctggggatcttcccacagg

SEQ ID NO: 1625298 - DNA, 23 bp, Homo sapiens
ccctggggatcttcccacaggag

SEQ ID NO: 1625299 - DNA, 17 bp, Homo sapiens
ccctggggcctggacct

SEQ ID NO: 1625300 - DNA, 20 bp, Homo sapiens
tgagaagagggcctgtggga

SEQ ID NO: 1625301 - DNA, 21 bp, Homo sapiens
tgagaagagggcctgtgggag

SEQ ID NO: 1625302 - DNA, 13 bp, Homo sapiens
tgagaagccaagc

SEQ ID NO: 1625303 - DNA, 15 bp, Homo sapiens
tgagaagccttcagc

SEQ ID NO: 1625304 - DNA, 13 bp, Homo sapiens
tgagaaggaacag

SEQ ID NO: 1625305 - DNA, 20 bp, Homo sapiens
tgagaaggcagtagttttca

SEQ ID NO: 1625306 - DNA, 16 bp, Homo sapiens
tgagaaggcgaggaga

SEQ ID NO: 1625307 - DNA, 17 bp, Homo sapiens
tgagaaggcgaggagag

SEQ ID NO: 1625308 - DNA, 22 bp, Homo sapiens
tgagaaggttactgagtgagtt

SEQ ID NO: 1625309 - DNA, 18 bp, Homo sapiens
tgagaaggtttattgtta

SEQ ID NO: 1625310 - DNA, 20 bp, Homo sapiens
tgagaaggtttattgttaat

SEQ ID NO: 1625311 - DNA, 11 bp, Homo sapiens
tgagaagtact

SEQ ID NO: 1625312 - DNA, 16 bp, Homo sapiens
tgagaagttctcagaa

SEQ ID NO: 1625313 - DNA, 17 bp, Homo sapiens
tgagaataagagagtca

SEQ ID NO: 1625314 - DNA, 20 bp, Homo sapiens
tgagaataagttcatacaat

SEQ ID NO: 1625315 - DNA, 18 bp, Homo sapiens
tgagaatataccttattt

SEQ ID NO: 1625316 - DNA, 22 bp, Homo sapiens
ccctggtccagtcgggaggagc

SEQ ID NO: 1625317 - DNA, 15 bp, Homo sapiens
ccctggtcctgactt

SEQ ID NO: 1625318 - DNA, 23 bp, Homo sapiens
ccctggtcctggcctccttcccc

SEQ ID NO: 1625319 - DNA, 16 bp, Homo sapiens
ccctggtccttcactg

SEQ ID NO: 1625320 - DNA, 22 bp, Homo sapiens
ccctggtccttcactggcgcct

SEQ ID NO: 1625321 - DNA, 16 bp, Homo sapiens
ccctggtccttccagg

SEQ ID NO: 1625322 - DNA, 14 bp, Homo sapiens
ccctggtgcctctg

SEQ ID NO: 1625323 - DNA, 16 bp, Homo sapiens
ccctggtgctgccaca

SEQ ID NO: 1625324 - DNA, 17 bp, Homo sapiens
ccctggtgctgccacac

SEQ ID NO: 1625325 - DNA, 19 bp, Homo sapiens
ccctggtggacagtcctgg

SEQ ID NO: 1625326 - DNA, 20 bp, Homo sapiens
ccctggtggacagtcctggg

SEQ ID NO: 1625327 - DNA, 20 bp, Homo sapiens
ccctggtggagaaagcactg

SEQ ID NO: 1625328 - DNA, 17 bp, Homo sapiens
ccctggtgggctgttca

SEQ ID NO: 1625329 - DNA, 18 bp, Homo sapiens
ccctggtgggctgttcag

SEQ ID NO: 1625330 - DNA, 20 bp, Homo sapiens
ccctggtggggtgtgcatgc

SEQ ID NO: 1625331 - DNA, 16 bp, Homo sapiens
ccctggttagctgaca

SEQ ID NO: 1625332 - DNA, 17 bp, Homo sapiens
ccctggttagctgacag

SEQ ID NO: 1625333 - DNA, 20 bp, Homo sapiens
ccctggttagctgacagtca

SEQ ID NO: 1625334 - DNA, 19 bp, Homo sapiens
ccctggttatattctcacg

SEQ ID NO: 1625335 - DNA, 14 bp, Homo sapiens
ccctggttcctgct

SEQ ID NO: 1625336 - DNA, 20 bp, Homo sapiens
ccctggttcctgctgtcctg

SEQ ID NO: 1625337 - DNA, 16 bp, Homo sapiens
ccctgtacccagctcc

SEQ ID NO: 1625338 - DNA, 17 bp, Homo sapiens
ccctgtacccagctcct

SEQ ID NO: 1625339 - DNA, 19 bp, Homo sapiens
ccctgtaccttttgaggag

SEQ ID NO: 1625340 - DNA, 18 bp, Homo sapiens
ccctgtactgttctgtgt

SEQ ID NO: 1625341 - DNA, 15 bp, Homo sapiens
ccctgtagctcagtc

SEQ ID NO: 1625342 - DNA, 13 bp, Homo sapiens
ccctgtagctctg

SEQ ID NO: 1625343 - DNA, 13 bp, Homo sapiens
ccctgtagggaaa

SEQ ID NO: 1625344 - DNA, 16 bp, Homo sapiens
ccctgtcacgctcatg

SEQ ID NO: 1625345 - DNA, 17 bp, Homo sapiens
ccctgtcagaggctaag

SEQ ID NO: 1625346 - DNA, 20 bp, Homo sapiens
ccctgtcatccagctcactc

SEQ ID NO: 1625347 - DNA, 22 bp, Homo sapiens
ccctgtcatttttaacagcatg

SEQ ID NO: 1625348 - DNA, 14 bp, Homo sapiens
ccctgtccaaactg

SEQ ID NO: 1625349 - DNA, 16 bp, Homo sapiens
ccctgtcccaccaact

SEQ ID NO: 1625350 - DNA, 20 bp, Homo sapiens
ccctgtcccaccaactctgc

SEQ ID NO: 1625351 - DNA, 23 bp, Homo sapiens
ccctgtcccagggccctcccagc

SEQ ID NO: 1625352 - DNA, 18 bp, Homo sapiens
ccctgtcccattctagat

SEQ ID NO: 1625353 - DNA, 13 bp, Homo sapiens
ccctgtcccccag

SEQ ID NO: 1625354 - DNA, 15 bp, Homo sapiens
ccctgtcccccagct

SEQ ID NO: 1625355 - DNA, 17 bp, Homo sapiens
ccctgtcccccagctct

SEQ ID NO: 1625356 - DNA, 13 bp, Homo sapiens
ccctgtccctcta

SEQ ID NO: 1625357 - DNA, 14 bp, Homo sapiens
ccctgtcctcctcg

SEQ ID NO: 1625358 - DNA, 15 bp, Homo sapiens
ccctgtcctcctcgg

SEQ ID NO: 1625359 - DNA, 16 bp, Homo sapiens
ccctgtcctcctcgga

SEQ ID NO: 1625360 - DNA, 15 bp, Homo sapiens
ccctgtcgagacact

SEQ ID NO: 1625361 - DNA, 15 bp, Homo sapiens
ccctgtctccagctg

SEQ ID NO: 1625362 - DNA, 19 bp, Homo sapiens
ccctgtctccagctgcctg

SEQ ID NO: 1625363 - DNA, 18 bp, Homo sapiens
ccctgtctcccggctccc

SEQ ID NO: 1625364 - DNA, 19 bp, Homo sapiens
ccctgtctgtgtcccagcc

SEQ ID NO: 1625365 - DNA, 21 bp, Homo sapiens
ccctgtgaaacgtcccacact

SEQ ID NO: 1625366 - DNA, 17 bp, Homo sapiens
ccctgtgacatggtgcc

SEQ ID NO: 1625367 - DNA, 13 bp, Homo sapiens
ccctgtgcctggg

SEQ ID NO: 1625368 - DNA, 18 bp, Homo sapiens
ccctgtgcctgggccctg

SEQ ID NO: 1625369 - DNA, 19 bp, Homo sapiens
ccctgtgctgatcctgctg

SEQ ID NO: 1625370 - DNA, 20 bp, Homo sapiens
ccctgtgctgatcctgctga

SEQ ID NO: 1625371 - DNA, 13 bp, Homo sapiens
ccctgtgctggtg

SEQ ID NO: 1625372 - DNA, 14 bp, Homo sapiens
ccctgtgctggtgt

SEQ ID NO: 1625373 - DNA, 16 bp, Homo sapiens
ccctgtggagtccagc

SEQ ID NO: 1625374 - DNA, 17 bp, Homo sapiens
ccctgtggagtccagct

SEQ ID NO: 1625375 - DNA, 19 bp, Homo sapiens
ccctgtggagtccagctct

SEQ ID NO: 1625376 - DNA, 20 bp, Homo sapiens
ccctgtggagtccagctcta

SEQ ID NO: 1625377 - DNA, 22 bp, Homo sapiens
ccctgtggagtccagctctact

SEQ ID NO: 1625378 - DNA, 14 bp, Homo sapiens
ccctgtggccaact

SEQ ID NO: 1625379 - DNA, 20 bp, Homo sapiens
ccctgtggccaactgcaaaa

SEQ ID NO: 1625380 - DNA, 14 bp, Homo sapiens
ccctgtggccctgg

SEQ ID NO: 1625381 - DNA, 21 bp, Homo sapiens
ccctgtgggcttatgtctctg

SEQ ID NO: 1625382 - DNA, 15 bp, Homo sapiens
ccctgtggggatctc

SEQ ID NO: 1625383 - DNA, 23 bp, Homo sapiens
ccctgtggggatctcaggggctg

SEQ ID NO: 1625384 - DNA, 14 bp, Homo sapiens
ccctgtggggcagg

SEQ ID NO: 1625385 - DNA, 19 bp, Homo sapiens
ccctgtgtcctccaccatg

SEQ ID NO: 1625386 - DNA, 13 bp, Homo sapiens
ccctgtgtgcagg

SEQ ID NO: 1625387 - DNA, 20 bp, Homo sapiens
ccctgtgttagtaaaggggc

SEQ ID NO: 1625388 - DNA, 13 bp, Homo sapiens
ccctgtgttgtct

SEQ ID NO: 1625389 - DNA, 17 bp, Homo sapiens
ccctgtgttgtctctag

SEQ ID NO: 1625390 - DNA, 21 bp, Homo sapiens
ccctgtgttgtctctagagca

SEQ ID NO: 1625391 - DNA, 23 bp, Homo sapiens
ccctgtgttgtctctagagcagg

SEQ ID NO: 1625392 - DNA, 18 bp, Homo sapiens
ccctgttctcctgtccct

SEQ ID NO: 1625393 - DNA, 23 bp, Homo sapiens
ccctgttttagtttctgaactct

SEQ ID NO: 1625394 - DNA, 15 bp, Homo sapiens
ccctgttttctgttt

SEQ ID NO: 1625395 - DNA, 14 bp, Homo sapiens
cccttaactccaag

SEQ ID NO: 1625396 - DNA, 20 bp, Homo sapiens
cccttaagccaaactcaggc

SEQ ID NO: 1625397 - DNA, 20 bp, Homo sapiens
cccttaagggttgaaggcag

SEQ ID NO: 1625398 - DNA, 18 bp, Homo sapiens
cccttaatattgaggctg

SEQ ID NO: 1625399 - DNA, 21 bp, Homo sapiens
cccttacagccctaagtggct

SEQ ID NO: 1625400 - DNA, 12 bp, Homo sapiens
cccttacccatc

SEQ ID NO: 1625401 - DNA, 21 bp, Homo sapiens
cccttaccctcccaccactcc

SEQ ID NO: 1625402 - DNA, 13 bp, Homo sapiens
cccttaccttccc

SEQ ID NO: 1625403 - DNA, 22 bp, Homo sapiens
cccttactatgatctcaggagc

SEQ ID NO: 1625404 - DNA, 20 bp, Homo sapiens
cccttacttgcttctctagc

SEQ ID NO: 1625405 - DNA, 17 bp, Homo sapiens
cccttagcctccctgaa

SEQ ID NO: 1625406 - DNA, 16 bp, Homo sapiens
cccttagcctctccca

SEQ ID NO: 1625407 - DNA, 17 bp, Homo sapiens
cccttagcctctcccac

SEQ ID NO: 1625408 - DNA, 18 bp, Homo sapiens
cccttagcctctcccacc

SEQ ID NO: 1625409 - DNA, 22 bp, Homo sapiens
cccttatgcccggcgccgggca

SEQ ID NO: 1625410 - DNA, 19 bp, Homo sapiens
cccttatgcggttaatttt

SEQ ID NO: 1625411 - DNA, 18 bp, Homo sapiens
cccttcaaccattcccca

SEQ ID NO: 1625412 - DNA, 20 bp, Homo sapiens
cccttcaagacgaggggcag

SEQ ID NO: 1625413 - DNA, 15 bp, Homo sapiens
cccttcactgccatg

SEQ ID NO: 1625414 - DNA, 15 bp, Homo sapiens
tgagcaccctctgga

SEQ ID NO: 1625415 - DNA, 21 bp, Homo sapiens
tgagcaccgtgtcaagctgct

SEQ ID NO: 1625416 - DNA, 20 bp, Homo sapiens
tgagcacctcccagcccctg

SEQ ID NO: 1625417 - DNA, 12 bp, Homo sapiens
tgagcagaacag

SEQ ID NO: 1625418 - DNA, 14 bp, Homo sapiens
tgagcagaacaggt

SEQ ID NO: 1625419 - DNA, 16 bp, Homo sapiens
tgagcagaacaggtag

SEQ ID NO: 1625420 - DNA, 15 bp, Homo sapiens
tgagcagccgccagc

SEQ ID NO: 1625421 - DNA, 19 bp, Homo sapiens
tgagcagcctctgccaggc

SEQ ID NO: 1625422 - DNA, 15 bp, Homo sapiens
tgagcaggattttaa

SEQ ID NO: 1625423 - DNA, 20 bp, Homo sapiens
tgagcaggcagggctgggcc

SEQ ID NO: 1625424 - DNA, 19 bp, Homo sapiens
tgagcagggtcaagcctct

SEQ ID NO: 1625425 - DNA, 12 bp, Homo sapiens
tgagcagtggct

SEQ ID NO: 1625426 - DNA, 15 bp, Homo sapiens
tgagcataatgctcc

SEQ ID NO: 1625427 - DNA, 19 bp, Homo sapiens
tgagcatcaatcttgttac

SEQ ID NO: 1625428 - DNA, 15 bp, Homo sapiens
tgagcatcagagggc

SEQ ID NO: 1625429 - DNA, 19 bp, Homo sapiens
tgagcatgacagcctgcag

SEQ ID NO: 1625430 - DNA, 21 bp, Homo sapiens
tgagcatgacagcctgcagca

SEQ ID NO: 1625431 - DNA, 17 bp, Homo sapiens
tgagcatgcacagctgc

SEQ ID NO: 1625432 - DNA, 18 bp, Homo sapiens
tgagcatgcacagctgct

SEQ ID NO: 1625433 - DNA, 18 bp, Homo sapiens
tgagcatgtaaaagcgga

SEQ ID NO: 1625434 - DNA, 18 bp, Homo sapiens
tgagcatgtttgcctaga

SEQ ID NO: 1625435 - DNA, 23 bp, Homo sapiens
tgagccaaccttaaacctcttct

SEQ ID NO: 1625436 - DNA, 19 bp, Homo sapiens
tgagccaagcttcaaccct

SEQ ID NO: 1625437 - DNA, 15 bp, Homo sapiens
tgagccaaggacagg

SEQ ID NO: 1625438 - DNA, 23 bp, Homo sapiens
tgagccaaggacagggctggctc

SEQ ID NO: 1625439 - DNA, 24 bp, Homo sapiens
tgagccacagaccacctgcttctg

SEQ ID NO: 1625440 - DNA, 20 bp, Homo sapiens
tgagccaccatgcctggccc

SEQ ID NO: 1625441 - DNA, 15 bp, Homo sapiens
tgagccactgagcct

SEQ ID NO: 1625442 - DNA, 17 bp, Homo sapiens
tgagccactgagcctgg

SEQ ID NO: 1625443 - DNA, 21 bp, Homo sapiens
tgagccagccaggccctgcca

SEQ ID NO: 1625444 - DNA, 23 bp, Homo sapiens
tgagccagggaacagccccaggg

SEQ ID NO: 1625445 - DNA, 17 bp, Homo sapiens
tgagccagtcccagggg

SEQ ID NO: 1625446 - DNA, 18 bp, Homo sapiens
tgagccagtcccaggggc

SEQ ID NO: 1625447 - DNA, 21 bp, Homo sapiens
tgagccagttgtcctatggac

SEQ ID NO: 1625448 - DNA, 14 bp, Homo sapiens
tgagccatgaggag

SEQ ID NO: 1625449 - DNA, 20 bp, Homo sapiens
tgagccatgaggagcgtgga

SEQ ID NO: 1625450 - DNA, 21 bp, Homo sapiens
tgagccatgatcgagccactg

SEQ ID NO: 1625451 - DNA, 22 bp, Homo sapiens
tgagccatgatttcccactgca

SEQ ID NO: 1625452 - DNA, 21 bp, Homo sapiens
tgagcccaccagggacacctc

SEQ ID NO: 1625453 - DNA, 19 bp, Homo sapiens
tgagcccactgcccacccc

SEQ ID NO: 1625454 - DNA, 12 bp, Homo sapiens
tgagcccaggag

SEQ ID NO: 1625455 - DNA, 14 bp, Homo sapiens
tgagcccaggccgt

SEQ ID NO: 1625456 - DNA, 17 bp, Homo sapiens
tgagccccaagtcctga

SEQ ID NO: 1625457 - DNA, 21 bp, Homo sapiens
tgagccccaagtcctgaagag

SEQ ID NO: 1625458 - DNA, 15 bp, Homo sapiens
tgagccccagtgctg

SEQ ID NO: 1625459 - DNA, 13 bp, Homo sapiens
tgagccccccatg

SEQ ID NO: 1625460 - DNA, 20 bp, Homo sapiens
tgagcccccccaacactgtg

SEQ ID NO: 1625461 - DNA, 20 bp, Homo sapiens
tgagccccctgcacccaccc

SEQ ID NO: 1625462 - DNA, 21 bp, Homo sapiens
tgagcccctaccccacaccag

SEQ ID NO: 1625463 - DNA, 13 bp, Homo sapiens
tgagcccgggctg

SEQ ID NO: 1625464 - DNA, 16 bp, Homo sapiens
tgagcccgggctgcct

SEQ ID NO: 1625465 - DNA, 17 bp, Homo sapiens
tgagcccgggctgcctg

SEQ ID NO: 1625466 - DNA, 19 bp, Homo sapiens
tgagccctactccctgcag

SEQ ID NO: 1625467 - DNA, 23 bp, Homo sapiens
tgagccctactccctgcagatgc

SEQ ID NO: 1625468 - DNA, 12 bp, Homo sapiens
tgagccctggct

SEQ ID NO: 1625469 - DNA, 21 bp, Homo sapiens
tgagccgagattgcgccactg

SEQ ID NO: 1625470 - DNA, 20 bp, Homo sapiens
tgagccgcatcttctccatc

SEQ ID NO: 1625471 - DNA, 15 bp, Homo sapiens
tgagccgggcccctg

SEQ ID NO: 1625472 - DNA, 16 bp, Homo sapiens
tgagccgggcccctgg

SEQ ID NO: 1625473 - DNA, 16 bp, Homo sapiens
tgagcctacagatgaa

SEQ ID NO: 1625474 - DNA, 16 bp, Homo sapiens
tgagcctagccctggg

SEQ ID NO: 1625475 - DNA, 17 bp, Homo sapiens
tgagcctagccctggga

SEQ ID NO: 1625476 - DNA, 18 bp, Homo sapiens
tgagcctcaaccttctgg

SEQ ID NO: 1625477 - DNA, 14 bp, Homo sapiens
tgagcctctgctcc

SEQ ID NO: 1625478 - DNA, 17 bp, Homo sapiens
tgagcctctgctcccca

SEQ ID NO: 1625479 - DNA, 15 bp, Homo sapiens
tgagcctgcagggaa

SEQ ID NO: 1625480 - DNA, 13 bp, Homo sapiens
tgagcctgctgga

SEQ ID NO: 1625481 - DNA, 12 bp, Homo sapiens
tgagcctggccc

SEQ ID NO: 1625482 - DNA, 13 bp, Homo sapiens
tgagcctggctgg

SEQ ID NO: 1625483 - DNA, 15 bp, Homo sapiens
tgagcctggtcctgg

SEQ ID NO: 1625484 - DNA, 15 bp, Homo sapiens
tgagccttgcagata

SEQ ID NO: 1625485 - DNA, 13 bp, Homo sapiens
tgagccttgtaat

SEQ ID NO: 1625486 - DNA, 18 bp, Homo sapiens
tgagcgccccgcccccac

SEQ ID NO: 1625487 - DNA, 20 bp, Homo sapiens
tgagcgccccgcccccaccc

SEQ ID NO: 1625488 - DNA, 22 bp, Homo sapiens
tgagcgccccgcccccacccct

SEQ ID NO: 1625489 - DNA, 18 bp, Homo sapiens
tgagcgctcctgccgcag

SEQ ID NO: 1625490 - DNA, 20 bp, Homo sapiens
tgagcgctggctccctgggc

SEQ ID NO: 1625491 - DNA, 18 bp, Homo sapiens
tgagctataatgtttccc

SEQ ID NO: 1625492 - DNA, 14 bp, Homo sapiens
tgagctatgtatta

SEQ ID NO: 1625493 - DNA, 15 bp, Homo sapiens
tgagctatgtattaa

SEQ ID NO: 1625494 - DNA, 15 bp, Homo sapiens
tgagctatttcatct

SEQ ID NO: 1625495 - DNA, 20 bp, Homo sapiens
tgagctcaaatctctgttac

SEQ ID NO: 1625496 - DNA, 18 bp, Homo sapiens
tgagctcagacccccact

SEQ ID NO: 1625497 - DNA, 22 bp, Homo sapiens
tgagctcagacccccactctca

SEQ ID NO: 1625498 - DNA, 15 bp, Homo sapiens
tgagctcatgagggc

SEQ ID NO: 1625499 - DNA, 13 bp, Homo sapiens
tgagctccacctc

SEQ ID NO: 1625500 - DNA, 14 bp, Homo sapiens
tgagctccacctct

SEQ ID NO: 1625501 - DNA, 20 bp, Homo sapiens
tgagctcccacctcccttcc

SEQ ID NO: 1625502 - DNA, 22 bp, Homo sapiens
tgagctcccacctcccttccca

SEQ ID NO: 1625503 - DNA, 15 bp, Homo sapiens
tgagctcctgctgcg

SEQ ID NO: 1625504 - DNA, 14 bp, Homo sapiens
tgagctctccaggc

SEQ ID NO: 1625505 - DNA, 15 bp, Homo sapiens
tgagctctccaggcc

SEQ ID NO: 1625506 - DNA, 18 bp, Homo sapiens
tgagctctccaggccagg

SEQ ID NO: 1625507 - DNA, 13 bp, Homo sapiens
tgagctctctgcc

SEQ ID NO: 1625508 - DNA, 15 bp, Homo sapiens
tgagctctgaaatct

SEQ ID NO: 1625509 - DNA, 14 bp, Homo sapiens
tgagctcttccctt

SEQ ID NO: 1625510 - DNA, 17 bp, Homo sapiens
tgagctgagatcgtgcc

SEQ ID NO: 1625511 - DNA, 14 bp, Homo sapiens
tgagctgcagaaac

SEQ ID NO: 1625512 - DNA, 15 bp, Homo sapiens
tgagctgcagaaacg

SEQ ID NO: 1625513 - DNA, 20 bp, Homo sapiens
tgagctgcctgtaacttgag

SEQ ID NO: 1625514 - DNA, 15 bp, Homo sapiens
tgagctgccttccct

SEQ ID NO: 1625515 - DNA, 17 bp, Homo sapiens
tgagctgccttccctag

SEQ ID NO: 1625516 - DNA, 12 bp, Homo sapiens
tgagctggaagg

SEQ ID NO: 1625517 - DNA, 21 bp, Homo sapiens
tgagctggaaggagtgagagg

SEQ ID NO: 1625518 - DNA, 20 bp, Homo sapiens
tgagctggatagacttggga

SEQ ID NO: 1625519 - DNA, 10 bp, Homo sapiens
tgagctggcc

SEQ ID NO: 1625520 - DNA, 12 bp, Homo sapiens
tgagctgggaag

SEQ ID NO: 1625521 - DNA, 19 bp, Homo sapiens
tgagctggggactcaggga

SEQ ID NO: 1625522 - DNA, 12 bp, Homo sapiens
tgagctggggcc

SEQ ID NO: 1625523 - DNA, 12 bp, Homo sapiens
tgagctgtcact

SEQ ID NO: 1625524 - DNA, 15 bp, Homo sapiens
tgagctgtgttcttg

SEQ ID NO: 1625525 - DNA, 15 bp, Homo sapiens
tgagcttaaacagaa

SEQ ID NO: 1625526 - DNA, 21 bp, Homo sapiens
tgagcttagccttgtgccctg

SEQ ID NO: 1625527 - DNA, 21 bp, Homo sapiens
tgagcttcaatataagaagca

SEQ ID NO: 1625528 - DNA, 15 bp, Homo sapiens
tgagcttctctgtga

SEQ ID NO: 1625529 - DNA, 19 bp, Homo sapiens
ccctttcagatgtcttctg

SEQ ID NO: 1625530 - DNA, 17 bp, Homo sapiens
ccctttcagtatgtccc

SEQ ID NO: 1625531 - DNA, 22 bp, Homo sapiens
ccctttcagtatgtccccataa

SEQ ID NO: 1625532 - DNA, 20 bp, Homo sapiens
ccctttccaacctcacttcc

SEQ ID NO: 1625533 - DNA, 9 bp, Homo sapiens
ccctttcct

SEQ ID NO: 1625534 - DNA, 14 bp, Homo sapiens
ccctttcctcctca

SEQ ID NO: 1625535 - DNA, 17 bp, Homo sapiens
ccctttcctcctcaggc

SEQ ID NO: 1625536 - DNA, 13 bp, Homo sapiens
ccctttcctgcgg

SEQ ID NO: 1625537 - DNA, 18 bp, Homo sapiens
ccctttccttccatccct

SEQ ID NO: 1625538 - DNA, 18 bp, Homo sapiens
ccctttccttccttccct

SEQ ID NO: 1625539 - DNA, 13 bp, Homo sapiens
ccctttctctctc

SEQ ID NO: 1625540 - DNA, 17 bp, Homo sapiens
ccctttctctctccacc

SEQ ID NO: 1625541 - DNA, 14 bp, Homo sapiens
ccctttcttggcca

SEQ ID NO: 1625542 - DNA, 18 bp, Homo sapiens
ccctttgagatctgggga

SEQ ID NO: 1625543 - DNA, 19 bp, Homo sapiens
ccctttgagatctggggag

SEQ ID NO: 1625544 - DNA, 16 bp, Homo sapiens
ccctttgcactgtaat

SEQ ID NO: 1625545 - DNA, 13 bp, Homo sapiens
ccctttgctcccg

SEQ ID NO: 1625546 - DNA, 12 bp, Homo sapiens
ccctttgctctg

SEQ ID NO: 1625547 - DNA, 23 bp, Homo sapiens
ccctttgctgtgaggctgtcctg

SEQ ID NO: 1625548 - DNA, 23 bp, Homo sapiens
ccctttggagatgctgagggtgt

SEQ ID NO: 1625549 - DNA, 16 bp, Homo sapiens
ccctttggtttgacaa

SEQ ID NO: 1625550 - DNA, 22 bp, Homo sapiens
ccctttggtttgacaattttgt

SEQ ID NO: 1625551 - DNA, 16 bp, Homo sapiens
cccttttgcctggctg

SEQ ID NO: 1625552 - DNA, 23 bp, Homo sapiens
cccttttgtgggtttctctgtgc

SEQ ID NO: 1625553 - DNA, 19 bp, Homo sapiens
tgaggagacagaaagcctc

SEQ ID NO: 1625554 - DNA, 16 bp, Homo sapiens
tgaggagatgaccagg

SEQ ID NO: 1625555 - DNA, 14 bp, Homo sapiens
tgaggagccccagc

SEQ ID NO: 1625556 - DNA, 19 bp, Homo sapiens
tgaggagccctgaggacct

SEQ ID NO: 1625557 - DNA, 21 bp, Homo sapiens
tgaggagcggactcacttgat

SEQ ID NO: 1625558 - DNA, 14 bp, Homo sapiens
tgaggagctgctgg

SEQ ID NO: 1625559 - DNA, 17 bp, Homo sapiens
tgaggagctgctggctt

SEQ ID NO: 1625560 - DNA, 15 bp, Homo sapiens
tgaggagctggaggg

SEQ ID NO: 1625561 - DNA, 18 bp, Homo sapiens
tgaggagctggaggggtg

SEQ ID NO: 1625562 - DNA, 18 bp, Homo sapiens
tgaggaggaggacacagc

SEQ ID NO: 1625563 - DNA, 16 bp, Homo sapiens
tgaggagggatgtggg

SEQ ID NO: 1625564 - DNA, 16 bp, Homo sapiens
tgaggagtaaaattca

SEQ ID NO: 1625565 - DNA, 16 bp, Homo sapiens
tgaggagtgtgagaat

SEQ ID NO: 1625566 - DNA, 15 bp, Homo sapiens
tgaggatacagctct

SEQ ID NO: 1625567 - DNA, 19 bp, Homo sapiens
tgaggatacagctcttctc

SEQ ID NO: 1625568 - DNA, 22 bp, Homo sapiens
tgaggatgattattttcaaggc

SEQ ID NO: 1625569 - DNA, 13 bp, Homo sapiens
tgaggatggagag

SEQ ID NO: 1625570 - DNA, 14 bp, Homo sapiens
tgaggattccaaaa

SEQ ID NO: 1625571 - DNA, 15 bp, Homo sapiens
tgaggattgtggaaa

SEQ ID NO: 1625572 - DNA, 13 bp, Homo sapiens
tgaggatttcaag

SEQ ID NO: 1625573 - DNA, 16 bp, Homo sapiens
tgaggatttcaagcct

SEQ ID NO: 1625574 - DNA, 14 bp, Homo sapiens
tgaggcaagagaat

SEQ ID NO: 1625575 - DNA, 15 bp, Homo sapiens
tgaggcaagtgtggg

SEQ ID NO: 1625576 - DNA, 16 bp, Homo sapiens
tgaggcaagtgtgggc

SEQ ID NO: 1625577 - DNA, 20 bp, Homo sapiens
tgaggcaataaaaatcatag

SEQ ID NO: 1625578 - DNA, 23 bp, Homo sapiens
tgaggcagacagcagctcaggca

SEQ ID NO: 1625579 - DNA, 18 bp, Homo sapiens
tgaggcagggcaaatgac

SEQ ID NO: 1625580 - DNA, 21 bp, Homo sapiens
tgaggcatgactaatgctttt

SEQ ID NO: 1625581 - DNA, 22 bp, Homo sapiens
tgaggccaaacgttttgaacta

SEQ ID NO: 1625582 - DNA, 23 bp, Homo sapiens
tgaggccaccagtaaaagacatt

SEQ ID NO: 1625583 - DNA, 16 bp, Homo sapiens
tgaggccacccagagg

SEQ ID NO: 1625584 - DNA, 23 bp, Homo sapiens
tgaggccagggctgatggtctta

SEQ ID NO: 1625585 - DNA, 15 bp, Homo sapiens
tgaggcccagtgcat

SEQ ID NO: 1625586 - DNA, 23 bp, Homo sapiens
tgaggccccgatggactcctgac

SEQ ID NO: 1625587 - DNA, 18 bp, Homo sapiens
tgaggccgctagaggcct

SEQ ID NO: 1625588 - DNA, 22 bp, Homo sapiens
tgaggccgctagaggcctgagg

SEQ ID NO: 1625589 - DNA, 18 bp, Homo sapiens
tgaggcctcatccctcgg

SEQ ID NO: 1625590 - DNA, 22 bp, Homo sapiens
tgaggcctccagcttcaggcag

SEQ ID NO: 1625591 - DNA, 12 bp, Homo sapiens
tgaggcctggac

SEQ ID NO: 1625592 - DNA, 20 bp, Homo sapiens
tgaggcctggactttcctgc

SEQ ID NO: 1625593 - DNA, 12 bp, Homo sapiens
tgaggcctgggc

SEQ ID NO: 1625594 - DNA, 13 bp, Homo sapiens
tgaggcctgggcc

SEQ ID NO: 1625595 - DNA, 22 bp, Homo sapiens
tgaggcctgggccgctgccacg

SEQ ID NO: 1625596 - DNA, 15 bp, Homo sapiens
tgaggcggcagctgg

SEQ ID NO: 1625597 - DNA, 16 bp, Homo sapiens
tgaggcggcagctggg

SEQ ID NO: 1625598 - DNA, 17 bp, Homo sapiens
tgaggctctttctgggc

SEQ ID NO: 1625599 - DNA, 23 bp, Homo sapiens
tgaggctgacatgctcacacatt

SEQ ID NO: 1625600 - DNA, 18 bp, Homo sapiens
tgaggctgagactgcggg

SEQ ID NO: 1625601 - DNA, 19 bp, Homo sapiens
tgaggctgcagcaggtgct

SEQ ID NO: 1625602 - DNA, 12 bp, Homo sapiens
tgaggctgggaa

SEQ ID NO: 1625603 - DNA, 21 bp, Homo sapiens
tgaggctgtgcacctattctg

SEQ ID NO: 1625604 - DNA, 11 bp, Homo sapiens
tgaggctgtgg

SEQ ID NO: 1625605 - DNA, 14 bp, Homo sapiens
tgaggcttccaggc

SEQ ID NO: 1625606 - DNA, 17 bp, Homo sapiens
tgaggcttctccttctc

SEQ ID NO: 1625607 - DNA, 21 bp, Homo sapiens
tgagggaaatctgtaaagcca

SEQ ID NO: 1625608 - DNA, 16 bp, Homo sapiens
tgagggaacagacagg

SEQ ID NO: 1625609 - DNA, 20 bp, Homo sapiens
tgagggaacagacaggagaa

SEQ ID NO: 1625610 - DNA, 15 bp, Homo sapiens
tgagggaagcgaagg

SEQ ID NO: 1625611 - DNA, 17 bp, Homo sapiens
tgagggacagagcccca

SEQ ID NO: 1625612 - DNA, 19 bp, Homo sapiens
tgagggaccttggagagct

SEQ ID NO: 1625613 - DNA, 20 bp, Homo sapiens
tgagggaccttggagagctc

SEQ ID NO: 1625614 - DNA, 20 bp, Homo sapiens
tgagggagctgggagaccct

SEQ ID NO: 1625615 - DNA, 14 bp, Homo sapiens
tgagggaggaggcc

SEQ ID NO: 1625616 - DNA, 19 bp, Homo sapiens
tgagggaggaggccacctc

SEQ ID NO: 1625617 - DNA, 21 bp, Homo sapiens
tgagggagggggcgctcagga

SEQ ID NO: 1625618 - DNA, 17 bp, Homo sapiens
tgagggatcactgccaa

SEQ ID NO: 1625619 - DNA, 17 bp, Homo sapiens
tgagggccagggaccca

SEQ ID NO: 1625620 - DNA, 19 bp, Homo sapiens
tgagggccagggacccagg

SEQ ID NO: 1625621 - DNA, 23 bp, Homo sapiens
tgagggccagggacccaggtgtg

SEQ ID NO: 1625622 - DNA, 13 bp, Homo sapiens
tgagggcccagcc

SEQ ID NO: 1625623 - DNA, 17 bp, Homo sapiens
tgagggcccagccagga

SEQ ID NO: 1625624 - DNA, 21 bp, Homo sapiens
tgagggcccagccaggagcag

SEQ ID NO: 1625625 - DNA, 15 bp, Homo sapiens
tgagggcccctctgc

SEQ ID NO: 1625626 - DNA, 17 bp, Homo sapiens
tgagggcccctctgccc

SEQ ID NO: 1625627 - DNA, 21 bp, Homo sapiens
tgagggcccctctgcccagct

SEQ ID NO: 1625628 - DNA, 15 bp, Homo sapiens
tgagggccctgtgga

SEQ ID NO: 1625629 - DNA, 21 bp, Homo sapiens
tgagggcctgctggaggcctc

SEQ ID NO: 1625630 - DNA, 17 bp, Homo sapiens
tgagggctctgtttgtg

SEQ ID NO: 1625631 - DNA, 21 bp, Homo sapiens
tgagggctctgtttgtgggac

SEQ ID NO: 1625632 - DNA, 15 bp, Homo sapiens
tgaggggaggcacct

SEQ ID NO: 1625633 - DNA, 20 bp, Homo sapiens
tgaggggaggcacctccagg

SEQ ID NO: 1625634 - DNA, 17 bp, Homo sapiens
tgaggggcaacgaagaa

SEQ ID NO: 1625635 - DNA, 15 bp, Homo sapiens
tgaggggcaggtcta

SEQ ID NO: 1625636 - DNA, 17 bp, Homo sapiens
tgaggggcatctgcccc

SEQ ID NO: 1625637 - DNA, 14 bp, Homo sapiens
tgaggggctcctgg

SEQ ID NO: 1625638 - DNA, 16 bp, Homo sapiens
tgaggggctttctctt

SEQ ID NO: 1625639 - DNA, 18 bp, Homo sapiens
tgagggggtgggggtgct

SEQ ID NO: 1625640 - DNA, 22 bp, Homo sapiens
tgaggggtccctagcagcccac

SEQ ID NO: 1625641 - DNA, 17 bp, Homo sapiens
tgagggtccacctggag

SEQ ID NO: 1625642 - DNA, 19 bp, Homo sapiens
tgagggtccacctggagag

SEQ ID NO: 1625643 - DNA, 17 bp, Homo sapiens
tgagttctttcatctcc

SEQ ID NO: 1625644 - DNA, 17 bp, Homo sapiens
tgagttgacttctgaca

SEQ ID NO: 1625645 - DNA, 14 bp, Homo sapiens
tgagttggctggga

SEQ ID NO: 1625646 - DNA, 16 bp, Homo sapiens
tgagttggctgggaat

SEQ ID NO: 1625647 - DNA, 19 bp, Homo sapiens
tgagtttaccatttgtaat

SEQ ID NO: 1625648 - DNA, 19 bp, Homo sapiens
tgagtttccagcctgctag

SEQ ID NO: 1625649 - DNA, 11 bp, Homo sapiens
tgagtttccta

SEQ ID NO: 1625650 - DNA, 13 bp, Homo sapiens
tgagtttcttaga

SEQ ID NO: 1625651 - DNA, 22 bp, Homo sapiens
tgagttttgggaagttaaaggg

SEQ ID NO: 1625652 - DNA, 18 bp, Homo sapiens
tgagttttgtgtttgttg

SEQ ID NO: 1625653 - DNA, 19 bp, Homo sapiens
tgagtttttatggggctga

SEQ ID NO: 1625654 - DNA, 18 bp, Homo sapiens
tgagtttttgatagcttt

SEQ ID NO: 1625655 - DNA, 13 bp, Homo sapiens
tgataaaatcata

SEQ ID NO: 1625656 - DNA, 17 bp, Homo sapiens
tgataaacattcctgtt

SEQ ID NO: 1625657 - DNA, 13 bp, Homo sapiens
tgataaactcaga

SEQ ID NO: 1625658 - DNA, 14 bp, Homo sapiens
tgataaactttgct

SEQ ID NO: 1625659 - DNA, 16 bp, Homo sapiens
tgataaagaggcatct

SEQ ID NO: 1625660 - DNA, 20 bp, Homo sapiens
tgataaagcctcaaggtttt

SEQ ID NO: 1625661 - DNA, 16 bp, Homo sapiens
tgataaagtttctcag

SEQ ID NO: 1625662 - DNA, 18 bp, Homo sapiens
tgataaagtttctcagat

SEQ ID NO: 1625663 - DNA, 21 bp, Homo sapiens
tgataaagtttctcagatcct

SEQ ID NO: 1625664 - DNA, 16 bp, Homo sapiens
tgataacaacctttta

SEQ ID NO: 1625665 - DNA, 20 bp, Homo sapiens
tgataacaaccttttacatt

SEQ ID NO: 1625666 - DNA, 21 bp, Homo sapiens
tgataacagggattgatttta

SEQ ID NO: 1625667 - DNA, 15 bp, Homo sapiens
tgataacttggggag

SEQ ID NO: 1625668 - DNA, 19 bp, Homo sapiens
tgataacttggggaggcaa

SEQ ID NO: 1625669 - DNA, 14 bp, Homo sapiens
tgataagaggaatt

SEQ ID NO: 1625670 - DNA, 16 bp, Homo sapiens
tgataagggaaaagat

SEQ ID NO: 1625671 - DNA, 18 bp, Homo sapiens
tgataagggaaaagataa

SEQ ID NO: 1625672 - DNA, 13 bp, Homo sapiens
tcttcccacagga

SEQ ID NO: 1625673 - DNA, 21 bp, Homo sapiens
tcttcccactttcatctacct

SEQ ID NO: 1625674 - DNA, 22 bp, Homo sapiens
tcttcccagtgaatccctggga

SEQ ID NO: 1625675 - DNA, 17 bp, Homo sapiens
tcttcccatcactggag

SEQ ID NO: 1625676 - DNA, 22 bp, Homo sapiens
tcttcccatgtcccaccctccc

SEQ ID NO: 1625677 - DNA, 18 bp, Homo sapiens
tcttcccccatgtgcctg

SEQ ID NO: 1625678 - DNA, 16 bp, Homo sapiens
tcttcccgatgaggga

SEQ ID NO: 1625679 - DNA, 23 bp, Homo sapiens
tcttcccgctccccacctaccca

SEQ ID NO: 1625680 - DNA, 14 bp, Homo sapiens
tcttccctacctca

SEQ ID NO: 1625681 - DNA, 16 bp, Homo sapiens
tcttccctctctgcag

SEQ ID NO: 1625682 - DNA, 14 bp, Homo sapiens
tcttccctctgggc

SEQ ID NO: 1625683 - DNA, 22 bp, Homo sapiens
tcttccctgctttgcatctttg

SEQ ID NO: 1625684 - DNA, 16 bp, Homo sapiens
tcttcccttaactcca

SEQ ID NO: 1625685 - DNA, 16 bp, Homo sapiens
tcttcccttagcctct

SEQ ID NO: 1625686 - DNA, 17 bp, Homo sapiens
tcttcccttagcctctc

SEQ ID NO: 1625687 - DNA, 18 bp, Homo sapiens
tcttcccttattcctaat

SEQ ID NO: 1625688 - DNA, 21 bp, Homo sapiens
tcttcccttattcctaatggc

SEQ ID NO: 1625689 - DNA, 21 bp, Homo sapiens
tcttcccttcccagaccagga

SEQ ID NO: 1625690 - DNA, 19 bp, Homo sapiens
tcttcccttttacatactg

SEQ ID NO: 1625691 - DNA, 18 bp, Homo sapiens
tcttcctagatctgcagg

SEQ ID NO: 1625692 - DNA, 21 bp, Homo sapiens
tcttcctagatctgcaggctg

SEQ ID NO: 1625693 - DNA, 21 bp, Homo sapiens
tcttcctagttttctcctccc

SEQ ID NO: 1625694 - DNA, 17 bp, Homo sapiens
tcttcctatccctctcc

SEQ ID NO: 1625695 - DNA, 17 bp, Homo sapiens
tcttcctatttcagaag

SEQ ID NO: 1625696 - DNA, 20 bp, Homo sapiens
tcttcctatttcagaagttt

SEQ ID NO: 1625697 - DNA, 21 bp, Homo sapiens
tcttcctccctgggggcccca

SEQ ID NO: 1625698 - DNA, 14 bp, Homo sapiens
tcttcctctggttc

SEQ ID NO: 1625699 - DNA, 19 bp, Homo sapiens
tcttcctcttagcctctgg

SEQ ID NO: 1625700 - DNA, 12 bp, Homo sapiens
tcttcctgctgc

SEQ ID NO: 1625701 - DNA, 13 bp, Homo sapiens
tcttcctgctgct

SEQ ID NO: 1625702 - DNA, 22 bp, Homo sapiens
tcttcctgtgaagtttaattgt

SEQ ID NO: 1625703 - DNA, 15 bp, Homo sapiens
tcttcctgtgtcctg

SEQ ID NO: 1625704 - DNA, 12 bp, Homo sapiens
tcttccttaaat

SEQ ID NO: 1625705 - DNA, 22 bp, Homo sapiens
tcttccttctaccccaaggcca

SEQ ID NO: 1625706 - DNA, 23 bp, Homo sapiens
tcttccttgaagaactgcaggcc

SEQ ID NO: 1625707 - DNA, 15 bp, Homo sapiens
tcttccttgtgagga

SEQ ID NO: 1625708 - DNA, 18 bp, Homo sapiens
tcttcgaagccttgccta

SEQ ID NO: 1625709 - DNA, 20 bp, Homo sapiens
tcttcgatcaagctacttta

SEQ ID NO: 1625710 - DNA, 13 bp, Homo sapiens
tcttcgctgctct

SEQ ID NO: 1625711 - DNA, 22 bp, Homo sapiens
tcttcgctgctctagctggcag

SEQ ID NO: 1625712 - DNA, 19 bp, Homo sapiens
tcttcgctggactattgtg

SEQ ID NO: 1625713 - DNA, 19 bp, Homo sapiens
tcttcggggaactcctgga

SEQ ID NO: 1625714 - DNA, 16 bp, Homo sapiens
tcttctaaaacttgta

SEQ ID NO: 1625715 - DNA, 22 bp, Homo sapiens
tcttctaaacattttttcttca

SEQ ID NO: 1625716 - DNA, 18 bp, Homo sapiens
tcttctaaagcagacttt

SEQ ID NO: 1625717 - DNA, 16 bp, Homo sapiens
tcttctaacacaaaat

SEQ ID NO: 1625718 - DNA, 16 bp, Homo sapiens
tcttctaagaagacat

SEQ ID NO: 1625719 - DNA, 20 bp, Homo sapiens
tcttctaagaagacattttg

SEQ ID NO: 1625720 - DNA, 15 bp, Homo sapiens
tcttctaattgctgt

SEQ ID NO: 1625721 - DNA, 20 bp, Homo sapiens
tcttctaatttcaaaaatat

SEQ ID NO: 1625722 - DNA, 13 bp, Homo sapiens
tcttctactttta

SEQ ID NO: 1625723 - DNA, 22 bp, Homo sapiens
tcttctagatgattttttgaaa

SEQ ID NO: 1625724 - DNA, 23 bp, Homo sapiens
tcttctagatgattttttgaaag

SEQ ID NO: 1625725 - DNA, 21 bp, Homo sapiens
tcttctagatggaccccagca

SEQ ID NO: 1625726 - DNA, 23 bp, Homo sapiens
tcttctagctgcagatgcctctg

SEQ ID NO: 1625727 - DNA, 21 bp, Homo sapiens
tcttctagtatttttttctta

SEQ ID NO: 1625728 - DNA, 19 bp, Homo sapiens
tcttctagtgatgatggtt

SEQ ID NO: 1625729 - DNA, 14 bp, Homo sapiens
tcttctatcattcc

SEQ ID NO: 1625730 - DNA, 10 bp, Homo sapiens
tcttctatta

SEQ ID NO: 1625731 - DNA, 19 bp, Homo sapiens
tcttctattaatcaagaga

SEQ ID NO: 1625732 - DNA, 15 bp, Homo sapiens
tcttctattttattc

SEQ ID NO: 1625733 - DNA, 16 bp, Homo sapiens
tcttctattttattcc

SEQ ID NO: 1625734 - DNA, 20 bp, Homo sapiens
tcttctatttttatcatgaa

SEQ ID NO: 1625735 - DNA, 15 bp, Homo sapiens
tcttctcaagttcta

SEQ ID NO: 1625736 - DNA, 21 bp, Homo sapiens
tcttctcaagttctaagattc

SEQ ID NO: 1625737 - DNA, 15 bp, Homo sapiens
tcttctcatttcacc

SEQ ID NO: 1625738 - DNA, 18 bp, Homo sapiens
tcttctcatttcacccct

SEQ ID NO: 1625739 - DNA, 22 bp, Homo sapiens
tcttctcatttcacccctccct

SEQ ID NO: 1625740 - DNA, 13 bp, Homo sapiens
tcttctcctttca

SEQ ID NO: 1625741 - DNA, 18 bp, Homo sapiens
tcttctctccagctgact

SEQ ID NO: 1625742 - DNA, 15 bp, Homo sapiens
tcttctctctggctc

SEQ ID NO: 1625743 - DNA, 13 bp, Homo sapiens
tcttctctttagt

SEQ ID NO: 1625744 - DNA, 19 bp, Homo sapiens
tcttctgaactcaaactga

SEQ ID NO: 1625745 - DNA, 18 bp, Homo sapiens
tcttctgaagatcagaac

SEQ ID NO: 1625746 - DNA, 15 bp, Homo sapiens
tcttctgaagatgga

SEQ ID NO: 1625747 - DNA, 16 bp, Homo sapiens
tcttctgaagattctt

SEQ ID NO: 1625748 - DNA, 17 bp, Homo sapiens
tcttctgaataaagcaa

SEQ ID NO: 1625749 - DNA, 17 bp, Homo sapiens
tcttctgcaagcctcat

SEQ ID NO: 1625750 - DNA, 20 bp, Homo sapiens
tcttctgcaagcctcatgcc

SEQ ID NO: 1625751 - DNA, 22 bp, Homo sapiens
tcttctgccctaacctgacaga

SEQ ID NO: 1625752 - DNA, 11 bp, Homo sapiens
tcttctgctcc

SEQ ID NO: 1625753 - DNA, 20 bp, Homo sapiens
tcttctgctccacccttggc

SEQ ID NO: 1625754 - DNA, 23 bp, Homo sapiens
tcttctgctccacccttggcctg

SEQ ID NO: 1625755 - DNA, 15 bp, Homo sapiens
tcttctgctcttttc

SEQ ID NO: 1625756 - DNA, 17 bp, Homo sapiens
tcttctgctcttttcct

SEQ ID NO: 1625757 - DNA, 14 bp, Homo sapiens
tcttctggaatatt

SEQ ID NO: 1625758 - DNA, 17 bp, Homo sapiens
tcttctggacttggtct

SEQ ID NO: 1625759 - DNA, 11 bp, Homo sapiens
tcttctggctt

SEQ ID NO: 1625760 - DNA, 11 bp, Homo sapiens
tcttctgggca

SEQ ID NO: 1625761 - DNA, 21 bp, Homo sapiens
tcttctggggcaggctgggcc

SEQ ID NO: 1625762 - DNA, 20 bp, Homo sapiens
tcttctgggtagtcccctgt

SEQ ID NO: 1625763 - DNA, 14 bp, Homo sapiens
tcttctgtattttt

SEQ ID NO: 1625764 - DNA, 22 bp, Homo sapiens
tcttctgtatttttttttctaa

SEQ ID NO: 1625765 - DNA, 12 bp, Homo sapiens
tcttctgtccct

SEQ ID NO: 1625766 - DNA, 13 bp, Homo sapiens
tcttctgtccctg

SEQ ID NO: 1625767 - DNA, 13 bp, Homo sapiens
tcttctgtggacc

SEQ ID NO: 1625768 - DNA, 14 bp, Homo sapiens
tcttcttcagaaga

SEQ ID NO: 1625769 - DNA, 22 bp, Homo sapiens
tcttcttccaaatgcagttcat

SEQ ID NO: 1625770 - DNA, 22 bp, Homo sapiens
tcttcttccctccctatctaac

SEQ ID NO: 1625771 - DNA, 22 bp, Homo sapiens
tcttcttcccttaactccaaga

SEQ ID NO: 1625772 - DNA, 12 bp, Homo sapiens
tcttcttctaag

SEQ ID NO: 1625773 - DNA, 14 bp, Homo sapiens
tcttcttctaagaa

SEQ ID NO: 1625774 - DNA, 21 bp, Homo sapiens
tcttcttctaagaagacattt

SEQ ID NO: 1625775 - DNA, 14 bp, Homo sapiens
tcttcttctgaaga

SEQ ID NO: 1625776 - DNA, 20 bp, Homo sapiens
tcttcttgctatatgattta

SEQ ID NO: 1625777 - DNA, 14 bp, Homo sapiens
tcttcttggcagct

SEQ ID NO: 1625778 - DNA, 16 bp, Homo sapiens
tcttctttagatgcca

SEQ ID NO: 1625779 - DNA, 19 bp, Homo sapiens
tcttctttagatgccaaac

SEQ ID NO: 1625780 - DNA, 15 bp, Homo sapiens
tcttctttccctgga

SEQ ID NO: 1625781 - DNA, 13 bp, Homo sapiens
tcttctttctgag

SEQ ID NO: 1625782 - DNA, 20 bp, Homo sapiens
tcttctttgtgcctttggcc

SEQ ID NO: 1625783 - DNA, 19 bp, Homo sapiens
tcttctttttgcttcaaaa

SEQ ID NO: 1625784 - DNA, 15 bp, Homo sapiens
tcttcttttttaagt

SEQ ID NO: 1625785 - DNA, 15 bp, Homo sapiens
tcttgaaaagttcag

SEQ ID NO: 1625786 - DNA, 17 bp, Homo sapiens
tcttgaaaagttcaggg

SEQ ID NO: 1625787 - DNA, 21 bp, Homo sapiens
tcttgaaaggtccaaatgttt

SEQ ID NO: 1625788 - DNA, 12 bp, Homo sapiens
ccccctgctgcc

SEQ ID NO: 1625789 - DNA, 14 bp, Homo sapiens
ccccctgctgctgc

SEQ ID NO: 1625790 - DNA, 18 bp, Homo sapiens
ccccctggatgtcccctg

SEQ ID NO: 1625791 - DNA, 20 bp, Homo sapiens
ccccctggatgtcccctgtc

SEQ ID NO: 1625792 - DNA, 19 bp, Homo sapiens
ccccctggggcttctcctg

SEQ ID NO: 1625793 - DNA, 20 bp, Homo sapiens
ccccctggggcttctcctga

SEQ ID NO: 1625794 - DNA, 21 bp, Homo sapiens
ccccctggggcttctcctgac

SEQ ID NO: 1625795 - DNA, 23 bp, Homo sapiens
ccccctggggtgggatctgagct

SEQ ID NO: 1625796 - DNA, 21 bp, Homo sapiens
ccccctggtggacagtcctgg

SEQ ID NO: 1625797 - DNA, 23 bp, Homo sapiens
ccccctggtggacagtcctggga

SEQ ID NO: 1625798 - DNA, 14 bp, Homo sapiens
ccccctgtggcggc

SEQ ID NO: 1625799 - DNA, 14 bp, Homo sapiens
cccccttcagtgcc

SEQ ID NO: 1625800 - DNA, 23 bp, Homo sapiens
cccccttcagtgcccaccaacat

SEQ ID NO: 1625801 - DNA, 12 bp, Homo sapiens
cccccttcccat

SEQ ID NO: 1625802 - DNA, 16 bp, Homo sapiens
cccccttctctgctcc

SEQ ID NO: 1625803 - DNA, 19 bp, Homo sapiens
cccccttgccctccgcctg

SEQ ID NO: 1625804 - DNA, 22 bp, Homo sapiens
ccccctttcagatgtcttctgc

SEQ ID NO: 1625805 - DNA, 14 bp, Homo sapiens
ccccgacccgggtc

SEQ ID NO: 1625806 - DNA, 21 bp, Homo sapiens
ccccgacgccacagcccagcc

SEQ ID NO: 1625807 - DNA, 13 bp, Homo sapiens
ccccgacggctgt

SEQ ID NO: 1625808 - DNA, 13 bp, Homo sapiens
ccccgactgcctg

SEQ ID NO: 1625809 - DNA, 14 bp, Homo sapiens
ccccgacttcctga

SEQ ID NO: 1625810 - DNA, 16 bp, Homo sapiens
ccccgacttcctgact

SEQ ID NO: 1625811 - DNA, 17 bp, Homo sapiens
ccccgaggagctgggcc

SEQ ID NO: 1625812 - DNA, 14 bp, Homo sapiens
ccccgaggctgccc

SEQ ID NO: 1625813 - DNA, 16 bp, Homo sapiens
ccccgatgctgacctc

SEQ ID NO: 1625814 - DNA, 20 bp, Homo sapiens
ccccgatgctgacctcacct

SEQ ID NO: 1625815 - DNA, 20 bp, Homo sapiens
ccccgatggactcctgacca

SEQ ID NO: 1625816 - DNA, 13 bp, Homo sapiens
ccccgatgtcccc

SEQ ID NO: 1625817 - DNA, 13 bp, Homo sapiens
ccccgcacagcca

SEQ ID NO: 1625818 - DNA, 15 bp, Homo sapiens
ccccgcacagccacc

SEQ ID NO: 1625819 - DNA, 13 bp, Homo sapiens
ccccgcagcaccc

SEQ ID NO: 1625820 - DNA, 17 bp, Homo sapiens
tcttgagctggcctctc

SEQ ID NO: 1625821 - DNA, 23 bp, Homo sapiens
tcttgagctggcctctctagcac

SEQ ID NO: 1625822 - DNA, 18 bp, Homo sapiens
tcttgaggtaggagaggc

SEQ ID NO: 1625823 - DNA, 13 bp, Homo sapiens
tcttgagtttgtc

SEQ ID NO: 1625824 - DNA, 20 bp, Homo sapiens
tcttgagtttgtcgctcatg

SEQ ID NO: 1625825 - DNA, 22 bp, Homo sapiens
tcttgatacccccctctgtctt

SEQ ID NO: 1625826 - DNA, 17 bp, Homo sapiens
tcttgatcaacatcttt

SEQ ID NO: 1625827 - DNA, 17 bp, Homo sapiens
tcttgatcagtagtttg

SEQ ID NO: 1625828 - DNA, 19 bp, Homo sapiens
tcttgatctctcttgtcct

SEQ ID NO: 1625829 - DNA, 14 bp, Homo sapiens
tcttgatgtaaaat

SEQ ID NO: 1625830 - DNA, 16 bp, Homo sapiens
tcttgatgtaaaatct

SEQ ID NO: 1625831 - DNA, 13 bp, Homo sapiens
tcttgatgtcatg

SEQ ID NO: 1625832 - DNA, 16 bp, Homo sapiens
tcttgatgttgcttag

SEQ ID NO: 1625833 - DNA, 17 bp, Homo sapiens
tcttgattcctggctct

SEQ ID NO: 1625834 - DNA, 20 bp, Homo sapiens
tcttgcacagtcactgctct

SEQ ID NO: 1625835 - DNA, 16 bp, Homo sapiens
tcttgcagcatttact

SEQ ID NO: 1625836 - DNA, 22 bp, Homo sapiens
tcttgcagcatttactatgcac

SEQ ID NO: 1625837 - DNA, 20 bp, Homo sapiens
tcttgcagtggcttttcatg

SEQ ID NO: 1625838 - DNA, 16 bp, Homo sapiens
tcttgcatctgggcca

SEQ ID NO: 1625839 - DNA, 12 bp, Homo sapiens
tcttgccagcca

SEQ ID NO: 1625840 - DNA, 20 bp, Homo sapiens
tcttgccagccagaagcctc

SEQ ID NO: 1625841 - DNA, 14 bp, Homo sapiens
tcttgccatcactg

SEQ ID NO: 1625842 - DNA, 20 bp, Homo sapiens
tcttgcccagcagctcaaga

SEQ ID NO: 1625843 - DNA, 15 bp, Homo sapiens
tcttgcccatcctga

SEQ ID NO: 1625844 - DNA, 18 bp, Homo sapiens
tcttgcccgcacccctcc

SEQ ID NO: 1625845 - DNA, 13 bp, Homo sapiens
tcttgcccttccc

SEQ ID NO: 1625846 - DNA, 13 bp, Homo sapiens
tcttgcctaggcc

SEQ ID NO: 1625847 - DNA, 16 bp, Homo sapiens
tcttgcctaggccaaa

SEQ ID NO: 1625848 - DNA, 14 bp, Homo sapiens
tcttgcctccaggt

SEQ ID NO: 1625849 - DNA, 14 bp, Homo sapiens
tcttgcctctgtgc

SEQ ID NO: 1625850 - DNA, 21 bp, Homo sapiens
tcttgcctgaactcctgccat

SEQ ID NO: 1625851 - DNA, 20 bp, Homo sapiens
tcttgctaccagtatttaga

SEQ ID NO: 1625852 - DNA, 16 bp, Homo sapiens
tcttgctatttgagca

SEQ ID NO: 1625853 - DNA, 13 bp, Homo sapiens
tcttgctctgcca

SEQ ID NO: 1625854 - DNA, 17 bp, Homo sapiens
tcttgctgatggctgct

SEQ ID NO: 1625855 - DNA, 14 bp, Homo sapiens
tcttgctgcttcta

SEQ ID NO: 1625856 - DNA, 18 bp, Homo sapiens
tcttgctggattaatgtt

SEQ ID NO: 1625857 - DNA, 11 bp, Homo sapiens
tcttgctggct

SEQ ID NO: 1625858 - DNA, 19 bp, Homo sapiens
tcttgctggctctgagaat

SEQ ID NO: 1625859 - DNA, 18 bp, Homo sapiens
tcttgcttccctaatcta

SEQ ID NO: 1625860 - DNA, 18 bp, Homo sapiens
tcttgcttctttctagaa

SEQ ID NO: 1625861 - DNA, 16 bp, Homo sapiens
tcttgcttggaagcca

SEQ ID NO: 1625862 - DNA, 17 bp, Homo sapiens
tcttgctttcacaaata

SEQ ID NO: 1625863 - DNA, 20 bp, Homo sapiens
tcttggaactgtcccagcta

SEQ ID NO: 1625864 - DNA, 21 bp, Homo sapiens
tcttggaagacttaattctga

SEQ ID NO: 1625865 - DNA, 20 bp, Homo sapiens
tcttggaagctgtttggaaa

SEQ ID NO: 1625866 - DNA, 12 bp, Homo sapiens
tcttggagaagt

SEQ ID NO: 1625867 - DNA, 12 bp, Homo sapiens
tcttggagctga

SEQ ID NO: 1625868 - DNA, 13 bp, Homo sapiens
tcttggagctgag

SEQ ID NO: 1625869 - DNA, 19 bp, Homo sapiens
tcttggagctttttcaaaa

SEQ ID NO: 1625870 - DNA, 15 bp, Homo sapiens
tcttggagtgcattt

SEQ ID NO: 1625871 - DNA, 20 bp, Homo sapiens
tcttggagtgcatttgactc

SEQ ID NO: 1625872 - DNA, 23 bp, Homo sapiens
tcttggcagcttaacattgactt

SEQ ID NO: 1625873 - DNA, 19 bp, Homo sapiens
tcttggcattggaattcta

SEQ ID NO: 1625874 - DNA, 22 bp, Homo sapiens
tcttggcccctgtgtgagttga

SEQ ID NO: 1625875 - DNA, 14 bp, Homo sapiens
tcttggcctcccaa

SEQ ID NO: 1625876 - DNA, 16 bp, Homo sapiens
tcttggctatttctgt

SEQ ID NO: 1625877 - DNA, 19 bp, Homo sapiens
tcttggctatttctgtgtc

SEQ ID NO: 1625878 - DNA, 17 bp, Homo sapiens
tcttggctgacccctct

SEQ ID NO: 1625879 - DNA, 23 bp, Homo sapiens
tcttggctgtgagcaactgcgac

SEQ ID NO: 1625880 - DNA, 21 bp, Homo sapiens
tcttggctgttctagacacag

SEQ ID NO: 1625881 - DNA, 16 bp, Homo sapiens
tcttggcttaatcatt

SEQ ID NO: 1625882 - DNA, 18 bp, Homo sapiens
tcttggcttaatcatttt

SEQ ID NO: 1625883 - DNA, 21 bp, Homo sapiens
tcttgggaactccactctcct

SEQ ID NO: 1625884 - DNA, 20 bp, Homo sapiens
tcttgggatagtgttctgct

SEQ ID NO: 1625885 - DNA, 20 bp, Homo sapiens
tcttgggcagagctggctct

SEQ ID NO: 1625886 - DNA, 19 bp, Homo sapiens
tcttgggctactggcagct

SEQ ID NO: 1625887 - DNA, 20 bp, Homo sapiens
tcttggggactaacccaatg

SEQ ID NO: 1625888 - DNA, 22 bp, Homo sapiens
tcttggggactaacccaatgcc

SEQ ID NO: 1625889 - DNA, 23 bp, Homo sapiens
tcttggggccactttcagagccc

SEQ ID NO: 1625890 - DNA, 18 bp, Homo sapiens
tcttggggcccagtgcat

SEQ ID NO: 1625891 - DNA, 15 bp, Homo sapiens
tcttggggctgatga

SEQ ID NO: 1625892 - DNA, 16 bp, Homo sapiens
tcttgggggaaaatac

SEQ ID NO: 1625893 - DNA, 19 bp, Homo sapiens
tcttgggggggtggccgct

SEQ ID NO: 1625894 - DNA, 19 bp, Homo sapiens
tcttgggtgtattctctgt

SEQ ID NO: 1625895 - DNA, 15 bp, Homo sapiens
tcttgggttcctgta

SEQ ID NO: 1625896 - DNA, 16 bp, Homo sapiens
tcttggtagttctgtg

SEQ ID NO: 1625897 - DNA, 19 bp, Homo sapiens
tcttggtagttctgtgcct

SEQ ID NO: 1625898 - DNA, 17 bp, Homo sapiens
tcttggtcagatttgaa

SEQ ID NO: 1625899 - DNA, 20 bp, Homo sapiens
tcttggttttccctttgcct

SEQ ID NO: 1625900 - DNA, 15 bp, Homo sapiens
tcttgtaaatctttt

SEQ ID NO: 1625901 - DNA, 16 bp, Homo sapiens
tcttgtaaatgtttct

SEQ ID NO: 1625902 - DNA, 22 bp, Homo sapiens
tcttgtaagtcatctacttaat

SEQ ID NO: 1625903 - DNA, 14 bp, Homo sapiens
tcttgtacatgtgt

SEQ ID NO: 1625904 - DNA, 17 bp, Homo sapiens
tcttgtacatgtgtagc

SEQ ID NO: 1625905 - DNA, 16 bp, Homo sapiens
tcttgtaccatagaaa

SEQ ID NO: 1625906 - DNA, 21 bp, Homo sapiens
tcttgtaccatagaaaaatgt

SEQ ID NO: 1625907 - DNA, 19 bp, Homo sapiens
cccctcctctagctgtggg

SEQ ID NO: 1625908 - DNA, 15 bp, Homo sapiens
cccctcctctcccat

SEQ ID NO: 1625909 - DNA, 18 bp, Homo sapiens
cccctcctctcccatccc

SEQ ID NO: 1625910 - DNA, 23 bp, Homo sapiens
cccctcctcttcccttagcctct

SEQ ID NO: 1625911 - DNA, 16 bp, Homo sapiens
cccctcctgctgggcg

SEQ ID NO: 1625912 - DNA, 11 bp, Homo sapiens
cccctcctggc

SEQ ID NO: 1625913 - DNA, 13 bp, Homo sapiens
cccctcctggctg

SEQ ID NO: 1625914 - DNA, 21 bp, Homo sapiens
cccctccttggctttatgcaa

SEQ ID NO: 1625915 - DNA, 17 bp, Homo sapiens
cccctcgaccctgtgca

SEQ ID NO: 1625916 - DNA, 23 bp, Homo sapiens
cccctcgaccctgtgcaggagct

SEQ ID NO: 1625917 - DNA, 14 bp, Homo sapiens
cccctcgctgctgc

SEQ ID NO: 1625918 - DNA, 18 bp, Homo sapiens
cccctcgctgctgctact

SEQ ID NO: 1625919 - DNA, 15 bp, Homo sapiens
cccctcggagaagag

SEQ ID NO: 1625920 - DNA, 18 bp, Homo sapiens
cccctcgggggcctgtgg

SEQ ID NO: 1625921 - DNA, 20 bp, Homo sapiens
cccctcggggtgtcagaaat

SEQ ID NO: 1625922 - DNA, 21 bp, Homo sapiens
cccctcgtcctgtcccagagg

SEQ ID NO: 1625923 - DNA, 22 bp, Homo sapiens
cccctctcagaacatactgatt

SEQ ID NO: 1625924 - DNA, 20 bp, Homo sapiens
cccctctccaggcgccggcg

SEQ ID NO: 1625925 - DNA, 19 bp, Homo sapiens
cccctctccttcctgtgtg

SEQ ID NO: 1625926 - DNA, 13 bp, Homo sapiens
cccctctctttct

SEQ ID NO: 1625927 - DNA, 17 bp, Homo sapiens
cccctctgcacccagaa

SEQ ID NO: 1625928 - DNA, 13 bp, Homo sapiens
cccctctgctgcc

SEQ ID NO: 1625929 - DNA, 23 bp, Homo sapiens
cccctctgctgccggctctgggc

SEQ ID NO: 1625930 - DNA, 13 bp, Homo sapiens
cccctctgctgtc

SEQ ID NO: 1625931 - DNA, 16 bp, Homo sapiens
cccctctgctgtcctg

SEQ ID NO: 1625932 - DNA, 13 bp, Homo sapiens
cccctctgcttct

SEQ ID NO: 1625933 - DNA, 14 bp, Homo sapiens
cccctctgcttctc

SEQ ID NO: 1625934 - DNA, 13 bp, Homo sapiens
cccctctggccag

SEQ ID NO: 1625935 - DNA, 20 bp, Homo sapiens
tcttgtttgtcagcatctga

SEQ ID NO: 1625936 - DNA, 16 bp, Homo sapiens
tcttgttttgaaaata

SEQ ID NO: 1625937 - DNA, 17 bp, Homo sapiens
tcttgtttttattaatt

SEQ ID NO: 1625938 - DNA, 21 bp, Homo sapiens
tcttgtttttattaatttata

SEQ ID NO: 1625939 - DNA, 13 bp, Homo sapiens
tcttgtttttcca

SEQ ID NO: 1625940 - DNA, 18 bp, Homo sapiens
tcttgttttttttttcca

SEQ ID NO: 1625941 - DNA, 18 bp, Homo sapiens
tctttaaaaactcactta

SEQ ID NO: 1625942 - DNA, 15 bp, Homo sapiens
tctttaaaagagaga

SEQ ID NO: 1625943 - DNA, 16 bp, Homo sapiens
tctttaaaatatttgt

SEQ ID NO: 1625944 - DNA, 23 bp, Homo sapiens
tctttaaacagcaactacagaag

SEQ ID NO: 1625945 - DNA, 21 bp, Homo sapiens
tctttaaaccactaaaataca

SEQ ID NO: 1625946 - DNA, 14 bp, Homo sapiens
tctttaaactatgt

SEQ ID NO: 1625947 - DNA, 21 bp, Homo sapiens
tctttaaagggatggcaagat

SEQ ID NO: 1625948 - DNA, 14 bp, Homo sapiens
tctttaaatagata

SEQ ID NO: 1625949 - DNA, 16 bp, Homo sapiens
tctttaacatacatct

SEQ ID NO: 1625950 - DNA, 22 bp, Homo sapiens
tctttaacatacatctaagtca

SEQ ID NO: 1625951 - DNA, 11 bp, Homo sapiens
tctttaacttt

SEQ ID NO: 1625952 - DNA, 13 bp, Homo sapiens
tctttaaggagat

SEQ ID NO: 1625953 - DNA, 16 bp, Homo sapiens
tctttaaggagataga

SEQ ID NO: 1625954 - DNA, 24 bp, Homo sapiens
tctttaataacaaggagatttctt

SEQ ID NO: 1625955 - DNA, 23 bp, Homo sapiens
tctttaatcattttgcctctttt

SEQ ID NO: 1625956 - DNA, 17 bp, Homo sapiens
tctttaatgttgtccag

SEQ ID NO: 1625957 - DNA, 19 bp, Homo sapiens
tctttacctgtatacagtg

SEQ ID NO: 1625958 - DNA, 16 bp, Homo sapiens
tctttactatgtttct

SEQ ID NO: 1625959 - DNA, 21 bp, Homo sapiens
tctttactcccttcctggcct

SEQ ID NO: 1625960 - DNA, 17 bp, Homo sapiens
tctttactcggcgtgct

SEQ ID NO: 1625961 - DNA, 14 bp, Homo sapiens
tctttactgcactc

SEQ ID NO: 1625962 - DNA, 15 bp, Homo sapiens
tctttactgcactca

SEQ ID NO: 1625963 - DNA, 12 bp, Homo sapiens
tctttacttatc

SEQ ID NO: 1625964 - DNA, 20 bp, Homo sapiens
tctttacttccatctgtttg

SEQ ID NO: 1625965 - DNA, 21 bp, Homo sapiens
tctttagcatttttatgcaga

SEQ ID NO: 1625966 - DNA, 20 bp, Homo sapiens
tctttaggccaggcttgcct

SEQ ID NO: 1625967 - DNA, 14 bp, Homo sapiens
tctttagtactcaa

SEQ ID NO: 1625968 - DNA, 20 bp, Homo sapiens
tctttagtactcaatgtttc

SEQ ID NO: 1625969 - DNA, 12 bp, Homo sapiens
tctttagttttt

SEQ ID NO: 1625970 - DNA, 14 bp, Homo sapiens
tctttatacagctg

SEQ ID NO: 1625971 - DNA, 14 bp, Homo sapiens
tctttatattttgg

SEQ ID NO: 1625972 - DNA, 14 bp, Homo sapiens
tctttattaaaaca

SEQ ID NO: 1625973 - DNA, 15 bp, Homo sapiens
tctttcaattcttca

SEQ ID NO: 1625974 - DNA, 15 bp, Homo sapiens
tctttcacaaaaaag

SEQ ID NO: 1625975 - DNA, 14 bp, Homo sapiens
tctttcacagctcc

SEQ ID NO: 1625976 - DNA, 19 bp, Homo sapiens
tctttcacaggcatcagga

SEQ ID NO: 1625977 - DNA, 14 bp, Homo sapiens
tctttcacttgaaa

SEQ ID NO: 1625978 - DNA, 12 bp, Homo sapiens
tctttcagcatt

SEQ ID NO: 1625979 - DNA, 17 bp, Homo sapiens
tctttcatagtataact

SEQ ID NO: 1625980 - DNA, 22 bp, Homo sapiens
tctttcatagtataactttaaa

SEQ ID NO: 1625981 - DNA, 15 bp, Homo sapiens
tctttccaaattaaa

SEQ ID NO: 1625982 - DNA, 14 bp, Homo sapiens
tctttccagaggag

SEQ ID NO: 1625983 - DNA, 23 bp, Homo sapiens
tctttccaggctatgtataaaat

SEQ ID NO: 1625984 - DNA, 13 bp, Homo sapiens
tctttcccaggac

SEQ ID NO: 1625985 - DNA, 18 bp, Homo sapiens
tctttcccatggggaggg

SEQ ID NO: 1625986 - DNA, 14 bp, Homo sapiens
tctttccccagcag

SEQ ID NO: 1625987 - DNA, 22 bp, Homo sapiens
tctttccccagcagtttctgtc

SEQ ID NO: 1625988 - DNA, 11 bp, Homo sapiens
tctttccctgg

SEQ ID NO: 1625989 - DNA, 15 bp, Homo sapiens
tctttccggccaagg

SEQ ID NO: 1625990 - DNA, 22 bp, Homo sapiens
tctttccgtttttttttctttt

SEQ ID NO: 1625991 - DNA, 14 bp, Homo sapiens
tctttcctatttca

SEQ ID NO: 1625992 - DNA, 15 bp, Homo sapiens
tctttcctcacattt

SEQ ID NO: 1625993 - DNA, 15 bp, Homo sapiens
tctttcctccccctg

SEQ ID NO: 1625994 - DNA, 17 bp, Homo sapiens
tctttcctctttctgct

SEQ ID NO: 1625995 - DNA, 18 bp, Homo sapiens
tctttcctgttgttgtta

SEQ ID NO: 1625996 - DNA, 15 bp, Homo sapiens
tctttccttccatca

SEQ ID NO: 1625997 - DNA, 17 bp, Homo sapiens
tctttccttccatcaaa

SEQ ID NO: 1625998 - DNA, 20 bp, Homo sapiens
tctttccttgaaaataaaaa

SEQ ID NO: 1625999 - DNA, 16 bp, Homo sapiens
tctttctaactttctt

SEQ ID NO: 1626000 - DNA, 15 bp, Homo sapiens
tctttctagaggtgc

SEQ ID NO: 1626001 - DNA, 15 bp, Homo sapiens
tctttctatgcccgt

SEQ ID NO: 1626002 - DNA, 12 bp, Homo sapiens
tctttctatgta

SEQ ID NO: 1626003 - DNA, 14 bp, Homo sapiens
tctttctcataaaa

SEQ ID NO: 1626004 - DNA, 16 bp, Homo sapiens
tctttctcataaaact

SEQ ID NO: 1626005 - DNA, 12 bp, Homo sapiens
tctttctctcct

SEQ ID NO: 1626006 - DNA, 15 bp, Homo sapiens
tctttctctcctttc

SEQ ID NO: 1626007 - DNA, 10 bp, Homo sapiens
tctttctctg

SEQ ID NO: 1626008 - DNA, 15 bp, Homo sapiens
tctttctctgccagt

SEQ ID NO: 1626009 - DNA, 16 bp, Homo sapiens
tctttctctgccagtg

SEQ ID NO: 1626010 - DNA, 11 bp, Homo sapiens
tctttctctgg

SEQ ID NO: 1626011 - DNA, 14 bp, Homo sapiens
tctttctctggtgg

SEQ ID NO: 1626012 - DNA, 17 bp, Homo sapiens
tctttctgtctcccttc

SEQ ID NO: 1626013 - DNA, 19 bp, Homo sapiens
tctttctgtctcccttctc

SEQ ID NO: 1626014 - DNA, 17 bp, Homo sapiens
tctttctgttgaaaagc

SEQ ID NO: 1626015 - DNA, 13 bp, Homo sapiens
tctttcttcctct

SEQ ID NO: 1626016 - DNA, 19 bp, Homo sapiens
tctttcttcttttttaagt

SEQ ID NO: 1626017 - DNA, 15 bp, Homo sapiens
tctttcttgtttgtc

SEQ ID NO: 1626018 - DNA, 14 bp, Homo sapiens
tctttctttcttaa

SEQ ID NO: 1626019 - DNA, 18 bp, Homo sapiens
tctttctttgcaccaaag

SEQ ID NO: 1626020 - DNA, 19 bp, Homo sapiens
tctttctttgcaccaaaga

SEQ ID NO: 1626021 - DNA, 18 bp, Homo sapiens
tctttctttgtttctttc

SEQ ID NO: 1626022 - DNA, 23 bp, Homo sapiens
tctttctttgtttctttcttcct

SEQ ID NO: 1626023 - DNA, 21 bp, Homo sapiens
tctttgaaatagtctgtgtga

SEQ ID NO: 1626024 - DNA, 12 bp, Homo sapiens
tctttgaaatat

SEQ ID NO: 1626025 - DNA, 22 bp, Homo sapiens
tctttgacaattcctagataaa

SEQ ID NO: 1626026 - DNA, 13 bp, Homo sapiens
tctttgactgaaa

SEQ ID NO: 1626027 - DNA, 14 bp, Homo sapiens
ccccttccatgtgg

SEQ ID NO: 1626028 - DNA, 13 bp, Homo sapiens
ccccttcccattt

SEQ ID NO: 1626029 - DNA, 12 bp, Homo sapiens
ccccttccccct

SEQ ID NO: 1626030 - DNA, 16 bp, Homo sapiens
ccccttcccgccttcc

SEQ ID NO: 1626031 - DNA, 16 bp, Homo sapiens
ccccttccctggcagg

SEQ ID NO: 1626032 - DNA, 19 bp, Homo sapiens
ccccttcctcttgtctgat

SEQ ID NO: 1626033 - DNA, 10 bp, Homo sapiens
ccccttcctg

SEQ ID NO: 1626034 - DNA, 16 bp, Homo sapiens
ccccttctctcatctc

SEQ ID NO: 1626035 - DNA, 14 bp, Homo sapiens
ccccttctctcctc

SEQ ID NO: 1626036 - DNA, 19 bp, Homo sapiens
ccccttctctcctccccaa

SEQ ID NO: 1626037 - DNA, 18 bp, Homo sapiens
ccccttctggccggtgct

SEQ ID NO: 1626038 - DNA, 21 bp, Homo sapiens
ccccttgcccagggctcagcc

SEQ ID NO: 1626039 - DNA, 12 bp, Homo sapiens
ccccttgccctc

SEQ ID NO: 1626040 - DNA, 17 bp, Homo sapiens
ccccttgccctccgcct

SEQ ID NO: 1626041 - DNA, 16 bp, Homo sapiens
ccccttgggcatccac

SEQ ID NO: 1626042 - DNA, 20 bp, Homo sapiens
ccccttgtttgtcccttcta

SEQ ID NO: 1626043 - DNA, 17 bp, Homo sapiens
cccctttactcagccca

SEQ ID NO: 1626044 - DNA, 13 bp, Homo sapiens
cccctttcctgtc

SEQ ID NO: 1626045 - DNA, 18 bp, Homo sapiens
cccctttggtttgacaat

SEQ ID NO: 1626046 - DNA, 22 bp, Homo sapiens
ccccttttcggccccatgtatc

SEQ ID NO: 1626047 - DNA, 15 bp, Homo sapiens
ccccttttgcctggc

SEQ ID NO: 1626048 - DNA, 20 bp, Homo sapiens
ccccttttgcctggctgtgg

SEQ ID NO: 1626049 - DNA, 14 bp, Homo sapiens
cccgacagcctggc

SEQ ID NO: 1626050 - DNA, 15 bp, Homo sapiens
cccgacagcctggca

SEQ ID NO: 1626051 - DNA, 21 bp, Homo sapiens
tctttggttctaaggacctga

SEQ ID NO: 1626052 - DNA, 23 bp, Homo sapiens
tctttgtaatgtcaccaccttcc

SEQ ID NO: 1626053 - DNA, 19 bp, Homo sapiens
tctttgtaccaaaatttta

SEQ ID NO: 1626054 - DNA, 22 bp, Homo sapiens
tctttgtataaataaatatttt

SEQ ID NO: 1626055 - DNA, 17 bp, Homo sapiens
tctttgtcccctgggtc

SEQ ID NO: 1626056 - DNA, 15 bp, Homo sapiens
tctttgtgcctttgg

SEQ ID NO: 1626057 - DNA, 19 bp, Homo sapiens
tctttgtgggagggtaaga

SEQ ID NO: 1626058 - DNA, 16 bp, Homo sapiens
tctttgtggggaagag

SEQ ID NO: 1626059 - DNA, 14 bp, Homo sapiens
tctttgtgtagtat

SEQ ID NO: 1626060 - DNA, 16 bp, Homo sapiens
tctttgttacttcctt

SEQ ID NO: 1626061 - DNA, 17 bp, Homo sapiens
tctttgttacttcctta

SEQ ID NO: 1626062 - DNA, 19 bp, Homo sapiens
tctttgtttcctggcaata

SEQ ID NO: 1626063 - DNA, 20 bp, Homo sapiens
tctttgtttctttttacagc

SEQ ID NO: 1626064 - DNA, 23 bp, Homo sapiens
tctttgtttctttttacagcatt

SEQ ID NO: 1626065 - DNA, 19 bp, Homo sapiens
tctttgttttattttaata

SEQ ID NO: 1626066 - DNA, 18 bp, Homo sapiens
tcttttaaaaattcaaat

SEQ ID NO: 1626067 - DNA, 13 bp, Homo sapiens
tcttttaaagacc

SEQ ID NO: 1626068 - DNA, 13 bp, Homo sapiens
tcttttaaagact

SEQ ID NO: 1626069 - DNA, 21 bp, Homo sapiens
tcttttaaagtgttacttttt

SEQ ID NO: 1626070 - DNA, 23 bp, Homo sapiens
tcttttaaagtgttactttttgt

SEQ ID NO: 1626071 - DNA, 22 bp, Homo sapiens
tcttttaagatcttgttaaaga

SEQ ID NO: 1626072 - DNA, 18 bp, Homo sapiens
tcttttagacaactagat

SEQ ID NO: 1626073 - DNA, 12 bp, Homo sapiens
tcttttagagag

SEQ ID NO: 1626074 - DNA, 20 bp, Homo sapiens
tcttttaggacaattactgt

SEQ ID NO: 1626075 - DNA, 18 bp, Homo sapiens
tcttttagttttagttgc

SEQ ID NO: 1626076 - DNA, 22 bp, Homo sapiens
tcttttataattctcattaaaa

SEQ ID NO: 1626077 - DNA, 18 bp, Homo sapiens
tcttttatactcagcttt

SEQ ID NO: 1626078 - DNA, 14 bp, Homo sapiens
tcttttatagagca

SEQ ID NO: 1626079 - DNA, 14 bp, Homo sapiens
tcttttatatctgt

SEQ ID NO: 1626080 - DNA, 15 bp, Homo sapiens
tcttttatatctgta

SEQ ID NO: 1626081 - DNA, 23 bp, Homo sapiens
tcttttatatctgtaaatttaac

SEQ ID NO: 1626082 - DNA, 14 bp, Homo sapiens
tcttttatatttgt

SEQ ID NO: 1626083 - DNA, 17 bp, Homo sapiens
tcttttatttagggcct

SEQ ID NO: 1626084 - DNA, 18 bp, Homo sapiens
tcttttattttggaacta

SEQ ID NO: 1626085 - DNA, 15 bp, Homo sapiens
tcttttcaattatat

SEQ ID NO: 1626086 - DNA, 13 bp, Homo sapiens
tcttttcacatta

SEQ ID NO: 1626087 - DNA, 17 bp, Homo sapiens
tcttttccaagctcctt

SEQ ID NO: 1626088 - DNA, 19 bp, Homo sapiens
tcttttcccttaaatacag

SEQ ID NO: 1626089 - DNA, 14 bp, Homo sapiens
tcttttcctcctcc

SEQ ID NO: 1626090 - DNA, 23 bp, Homo sapiens
tcttttctaaatgttattacttg

SEQ ID NO: 1626091 - DNA, 22 bp, Homo sapiens
tcttttctaagtggcgtgtgca

SEQ ID NO: 1626092 - DNA, 12 bp, Homo sapiens
tcttttctaccc

SEQ ID NO: 1626093 - DNA, 18 bp, Homo sapiens
tcttttctaccctagcca

SEQ ID NO: 1626094 - DNA, 19 bp, Homo sapiens
tcttttctaccctagccat

SEQ ID NO: 1626095 - DNA, 11 bp, Homo sapiens
tcttttctaga

SEQ ID NO: 1626096 - DNA, 18 bp, Homo sapiens
tcttttctagtctgagct

SEQ ID NO: 1626097 - DNA, 19 bp, Homo sapiens
tcttttgaatccatgcttg

SEQ ID NO: 1626098 - DNA, 16 bp, Homo sapiens
tcttttgattatgttt

SEQ ID NO: 1626099 - DNA, 13 bp, Homo sapiens
tcttttgcaattg

SEQ ID NO: 1626100 - DNA, 13 bp, Homo sapiens
tcttttgcttttg

SEQ ID NO: 1626101 - DNA, 19 bp, Homo sapiens
tcttttggaagttttgcta

SEQ ID NO: 1626102 - DNA, 14 bp, Homo sapiens
tcttttgggtaaaa

SEQ ID NO: 1626103 - DNA, 21 bp, Homo sapiens
tcttttgtaattgtgtaaaaa

SEQ ID NO: 1626104 - DNA, 20 bp, Homo sapiens
tcttttgtgatgaacatatt

SEQ ID NO: 1626105 - DNA, 11 bp, Homo sapiens
tctttttaatt

SEQ ID NO: 1626106 - DNA, 20 bp, Homo sapiens
tctttttctgaactccattt

SEQ ID NO: 1626107 - DNA, 14 bp, Homo sapiens
tctttttctggact

SEQ ID NO: 1626108 - DNA, 17 bp, Homo sapiens
tctttttgctctaaaat

SEQ ID NO: 1626109 - DNA, 13 bp, Homo sapiens
tctttttgcttct

SEQ ID NO: 1626110 - DNA, 22 bp, Homo sapiens
tctttttgggagagacttgttt

SEQ ID NO: 1626111 - DNA, 14 bp, Homo sapiens
tctttttgtacttt

SEQ ID NO: 1626112 - DNA, 21 bp, Homo sapiens
tcttttttaaccggtaagagt

SEQ ID NO: 1626113 - DNA, 23 bp, Homo sapiens
tcttttttaaccggtaagagttt

SEQ ID NO: 1626114 - DNA, 13 bp, Homo sapiens
tcttttttcaaaa

SEQ ID NO: 1626115 - DNA, 14 bp, Homo sapiens
tcttttttctatct

SEQ ID NO: 1626116 - DNA, 19 bp, Homo sapiens
tcttttttctatctgccaa

SEQ ID NO: 1626117 - DNA, 17 bp, Homo sapiens
tctttttttaactggtg

SEQ ID NO: 1626118 - DNA, 18 bp, Homo sapiens
tctttttttaactggtga

SEQ ID NO: 1626119 - DNA, 16 bp, Homo sapiens
tctttttttctctaga

SEQ ID NO: 1626120 - DNA, 15 bp, Homo sapiens
tctttttttctttgg

SEQ ID NO: 1626121 - DNA, 13 bp, Homo sapiens
tctttttttttcc

SEQ ID NO: 1626122 - DNA, 23 bp, Homo sapiens
tctttttttttttttaaagacag

SEQ ID NO: 1626123 - DNA, 16 bp, Homo sapiens
tgaaaaaaaacagtgg

SEQ ID NO: 1626124 - DNA, 14 bp, Homo sapiens
tgaaaaaaaagttt

SEQ ID NO: 1626125 - DNA, 15 bp, Homo sapiens
tgaaaaaaaagtttt

SEQ ID NO: 1626126 - DNA, 21 bp, Homo sapiens
tgaaaaaaattgaaataaata

SEQ ID NO: 1626127 - DNA, 14 bp, Homo sapiens
tgaaaaaagaaaat

SEQ ID NO: 1626128 - DNA, 20 bp, Homo sapiens
tgaaaaaagaaaatggctaa

SEQ ID NO: 1626129 - DNA, 16 bp, Homo sapiens
tgaaaaaagcagttct

SEQ ID NO: 1626130 - DNA, 17 bp, Homo sapiens
tgaaaaaagcagttctt

SEQ ID NO: 1626131 - DNA, 18 bp, Homo sapiens
tgaaaaaaggacaatttc

SEQ ID NO: 1626132 - DNA, 12 bp, Homo sapiens
tgaaaaaatata

SEQ ID NO: 1626133 - DNA, 9 bp, Homo sapiens
tgaaaaaga

SEQ ID NO: 1626134 - DNA, 18 bp, Homo sapiens
tgaaaaagaaactgaata

SEQ ID NO: 1626135 - DNA, 22 bp, Homo sapiens
tgaaaaagacctttggagcaaa

SEQ ID NO: 1626136 - DNA, 21 bp, Homo sapiens
tgaaaaagcagctaccaggtg

SEQ ID NO: 1626137 - DNA, 16 bp, Homo sapiens
tgaaaaagctgcttct

SEQ ID NO: 1626138 - DNA, 22 bp, Homo sapiens
tgaaaaagctgcttcttattaa

SEQ ID NO: 1626139 - DNA, 16 bp, Homo sapiens
tgaaaaaggaaatatt

SEQ ID NO: 1626140 - DNA, 18 bp, Homo sapiens
tgaaaaaggaataaattg

SEQ ID NO: 1626141 - DNA, 15 bp, Homo sapiens
tgaaaaagtttgttt

SEQ ID NO: 1626142 - DNA, 16 bp, Homo sapiens
tgaaaaagttttacaa

SEQ ID NO: 1626143 - DNA, 23 bp, Homo sapiens
tgaaaaatactttaattcatgaa

SEQ ID NO: 1626144 - DNA, 11 bp, Homo sapiens
tgaaaaatata

SEQ ID NO: 1626145 - DNA, 17 bp, Homo sapiens
tgaaaaatcagatgaat

SEQ ID NO: 1626146 - DNA, 12 bp, Homo sapiens
cccggcagcccc

SEQ ID NO: 1626147 - DNA, 13 bp, Homo sapiens
cccggcagcccct

SEQ ID NO: 1626148 - DNA, 15 bp, Homo sapiens
cccggcaggcctgag

SEQ ID NO: 1626149 - DNA, 18 bp, Homo sapiens
cccggcaggcctgagaat

SEQ ID NO: 1626150 - DNA, 18 bp, Homo sapiens
cccggccacacccagcgg

SEQ ID NO: 1626151 - DNA, 19 bp, Homo sapiens
cccggccacagctgctgga

SEQ ID NO: 1626152 - DNA, 15 bp, Homo sapiens
cccggccacatgccg

SEQ ID NO: 1626153 - DNA, 13 bp, Homo sapiens
cccggccagcggg

SEQ ID NO: 1626154 - DNA, 18 bp, Homo sapiens
cccggccagcgggcacag

SEQ ID NO: 1626155 - DNA, 22 bp, Homo sapiens
cccggccagcgggcacagggca

SEQ ID NO: 1626156 - DNA, 11 bp, Homo sapiens
cccggccagct

SEQ ID NO: 1626157 - DNA, 16 bp, Homo sapiens
cccggccagctctgga

SEQ ID NO: 1626158 - DNA, 16 bp, Homo sapiens
cccggccccagccaga

SEQ ID NO: 1626159 - DNA, 18 bp, Homo sapiens
cccggccccggccccagc

SEQ ID NO: 1626160 - DNA, 19 bp, Homo sapiens
cccggccggccctggcttg

SEQ ID NO: 1626161 - DNA, 14 bp, Homo sapiens
cccggccggcctgg

SEQ ID NO: 1626162 - DNA, 12 bp, Homo sapiens
cccggcctcagg

SEQ ID NO: 1626163 - DNA, 14 bp, Homo sapiens
cccggcctcagggc

SEQ ID NO: 1626164 - DNA, 19 bp, Homo sapiens
cccggcctccactccccca

SEQ ID NO: 1626165 - DNA, 15 bp, Homo sapiens
cccggcctcttccac

SEQ ID NO: 1626166 - DNA, 16 bp, Homo sapiens
tgaaaagttggaagga

SEQ ID NO: 1626167 - DNA, 21 bp, Homo sapiens
tgaaaataaaaagatcacttt

SEQ ID NO: 1626168 - DNA, 13 bp, Homo sapiens
tgaaaatactttt

SEQ ID NO: 1626169 - DNA, 21 bp, Homo sapiens
tgaaaatagtgtaagaactgt

SEQ ID NO: 1626170 - DNA, 22 bp, Homo sapiens
tgaaaatagtgtaagaactgta

SEQ ID NO: 1626171 - DNA, 18 bp, Homo sapiens
tgaaaatatctgctcaaa

SEQ ID NO: 1626172 - DNA, 16 bp, Homo sapiens
tgaaaatattctactg

SEQ ID NO: 1626173 - DNA, 17 bp, Homo sapiens
tgaaaatatttgtatca

SEQ ID NO: 1626174 - DNA, 21 bp, Homo sapiens
tgaaaatatttgtatcacaaa

SEQ ID NO: 1626175 - DNA, 19 bp, Homo sapiens
tgaaaatatttttttctag

SEQ ID NO: 1626176 - DNA, 17 bp, Homo sapiens
tgaaaatgcaaagctga

SEQ ID NO: 1626177 - DNA, 14 bp, Homo sapiens
tgaaaatggtttca

SEQ ID NO: 1626178 - DNA, 18 bp, Homo sapiens
tgaaaatggtttcaagtt

SEQ ID NO: 1626179 - DNA, 20 bp, Homo sapiens
tgaaaatggtttcaagttat

SEQ ID NO: 1626180 - DNA, 17 bp, Homo sapiens
tgaaaatgtgctatact

SEQ ID NO: 1626181 - DNA, 21 bp, Homo sapiens
tgaaaatgtgctatactgcat

SEQ ID NO: 1626182 - DNA, 22 bp, Homo sapiens
tgaaaattcatagtaagattga

SEQ ID NO: 1626183 - DNA, 13 bp, Homo sapiens
tgaaaattgaaaa

SEQ ID NO: 1626184 - DNA, 19 bp, Homo sapiens
tgaaaattgcctttctgtg

SEQ ID NO: 1626185 - DNA, 23 bp, Homo sapiens
tgaaaattggacagattgcctgt

SEQ ID NO: 1626186 - DNA, 22 bp, Homo sapiens
tgaaaattgtttagtgatatta

SEQ ID NO: 1626187 - DNA, 13 bp, Homo sapiens
tgaaaattttact

SEQ ID NO: 1626188 - DNA, 18 bp, Homo sapiens
tgaaacaaagtactcttt

SEQ ID NO: 1626189 - DNA, 20 bp, Homo sapiens
tgaaacaaagtactctttaa

SEQ ID NO: 1626190 - DNA, 22 bp, Homo sapiens
tgaaacaaagtactctttaaca

SEQ ID NO: 1626191 - DNA, 14 bp, Homo sapiens
tgaaacaaattaat

SEQ ID NO: 1626192 - DNA, 15 bp, Homo sapiens
tgaaacaacttggaa

SEQ ID NO: 1626193 - DNA, 16 bp, Homo sapiens
tgaaacaacttggaaa

SEQ ID NO: 1626194 - DNA, 21 bp, Homo sapiens
tgaaacaatgcctacagctgt

SEQ ID NO: 1626195 - DNA, 21 bp, Homo sapiens
tgaaacacacgagcaaaccca

SEQ ID NO: 1626196 - DNA, 13 bp, Homo sapiens
tgaaacacagctg

SEQ ID NO: 1626197 - DNA, 15 bp, Homo sapiens
tgaaacacagctgtt

SEQ ID NO: 1626198 - DNA, 23 bp, Homo sapiens
tgaaacactcagttgttcaataa

SEQ ID NO: 1626199 - DNA, 15 bp, Homo sapiens
tgaaacagaaagttg

SEQ ID NO: 1626200 - DNA, 23 bp, Homo sapiens
tgaaacagattcaggccagccca

SEQ ID NO: 1626201 - DNA, 14 bp, Homo sapiens
tgaaacagatttca

SEQ ID NO: 1626202 - DNA, 17 bp, Homo sapiens
tgaaacagttgctgtga

SEQ ID NO: 1626203 - DNA, 20 bp, Homo sapiens
tgaaacatgcacattttgta

SEQ ID NO: 1626204 - DNA, 21 bp, Homo sapiens
tgaaacattcacacagggctc

SEQ ID NO: 1626205 - DNA, 20 bp, Homo sapiens
tgaaacattccgaagaggga

SEQ ID NO: 1626206 - DNA, 23 bp, Homo sapiens
tgaaacattgagggaacacaaat

SEQ ID NO: 1626207 - DNA, 14 bp, Homo sapiens
tgaaaccattttcc

SEQ ID NO: 1626208 - DNA, 16 bp, Homo sapiens
tgaaacctacacactg

SEQ ID NO: 1626209 - DNA, 18 bp, Homo sapiens
tgaaacctagtactgccc

SEQ ID NO: 1626210 - DNA, 19 bp, Homo sapiens
tgaaacctagtactgcccc

SEQ ID NO: 1626211 - DNA, 18 bp, Homo sapiens
tgaaacctgttaaaacaa

SEQ ID NO: 1626212 - DNA, 20 bp, Homo sapiens
tgaaaccttattttttccca

SEQ ID NO: 1626213 - DNA, 20 bp, Homo sapiens
tgaaacctttagggcagctt

SEQ ID NO: 1626214 - DNA, 22 bp, Homo sapiens
tgaaacctttagggcagcttgc

SEQ ID NO: 1626215 - DNA, 20 bp, Homo sapiens
tgaaacgctcctttgtgtgt

SEQ ID NO: 1626216 - DNA, 17 bp, Homo sapiens
tgaaacggaagctcata

SEQ ID NO: 1626217 - DNA, 19 bp, Homo sapiens
tgaaacggaggcagatgga

SEQ ID NO: 1626218 - DNA, 15 bp, Homo sapiens
tgaaactaatcttaa

SEQ ID NO: 1626219 - DNA, 20 bp, Homo sapiens
tgaaactcctgattttgtag

SEQ ID NO: 1626220 - DNA, 22 bp, Homo sapiens
tgaaactgaaggtcaataaatt

SEQ ID NO: 1626221 - DNA, 20 bp, Homo sapiens
tgaaactgagtataatcaat

SEQ ID NO: 1626222 - DNA, 20 bp, Homo sapiens
tgaaacttgtttcactgaaa

SEQ ID NO: 1626223 - DNA, 22 bp, Homo sapiens
tgaaactttgggaaaacatgtt

SEQ ID NO: 1626224 - DNA, 20 bp, Homo sapiens
tgaaagaacatggacttgta

SEQ ID NO: 1626225 - DNA, 11 bp, Homo sapiens
tgaaagaactt

SEQ ID NO: 1626226 - DNA, 20 bp, Homo sapiens
tgaaagaattatttttgtgt

SEQ ID NO: 1626227 - DNA, 17 bp, Homo sapiens
tgaaagacatcaatgaa

SEQ ID NO: 1626228 - DNA, 19 bp, Homo sapiens
tgaaagacatcaatgaaac

SEQ ID NO: 1626229 - DNA, 17 bp, Homo sapiens
tgaaagaccttctccaa

SEQ ID NO: 1626230 - DNA, 16 bp, Homo sapiens
tgaaagagaaccagtt

SEQ ID NO: 1626231 - DNA, 18 bp, Homo sapiens
tgaaagagaaccagtttc

SEQ ID NO: 1626232 - DNA, 15 bp, Homo sapiens
tgaaagagtctttct

SEQ ID NO: 1626233 - DNA, 16 bp, Homo sapiens
tgaaagagttaagaat

SEQ ID NO: 1626234 - DNA, 14 bp, Homo sapiens
tgaaagattttatt

SEQ ID NO: 1626235 - DNA, 20 bp, Homo sapiens
tgaaagattttattgtataa

SEQ ID NO: 1626236 - DNA, 13 bp, Homo sapiens
tgaaagattttta

SEQ ID NO: 1626237 - DNA, 15 bp, Homo sapiens
tgaaagcacatgaat

SEQ ID NO: 1626238 - DNA, 14 bp, Homo sapiens
tgaaagcagcagct

SEQ ID NO: 1626239 - DNA, 21 bp, Homo sapiens
tgaaagcaggatgaattttct

SEQ ID NO: 1626240 - DNA, 17 bp, Homo sapiens
tgaaagccaacaactct

SEQ ID NO: 1626241 - DNA, 22 bp, Homo sapiens
tgaaagccttagggaagctggc

SEQ ID NO: 1626242 - DNA, 15 bp, Homo sapiens
tgaaagctactcata

SEQ ID NO: 1626243 - DNA, 21 bp, Homo sapiens
tgaaagctgattactgtcaat

SEQ ID NO: 1626244 - DNA, 11 bp, Homo sapiens
tgaaagctgtg

SEQ ID NO: 1626245 - DNA, 19 bp, Homo sapiens
tgaaagcttcaaagtttat

SEQ ID NO: 1626246 - DNA, 18 bp, Homo sapiens
tgaaaggcaaacatttga

SEQ ID NO: 1626247 - DNA, 17 bp, Homo sapiens
tgaaaggcattctctga

SEQ ID NO: 1626248 - DNA, 13 bp, Homo sapiens
tgaaagggaaact

SEQ ID NO: 1626249 - DNA, 16 bp, Homo sapiens
tgaaagggaaactggg

SEQ ID NO: 1626250 - DNA, 20 bp, Homo sapiens
tgaaaggggacacctgtaca

SEQ ID NO: 1626251 - DNA, 22 bp, Homo sapiens
tgaaaggggacacctgtacatt

SEQ ID NO: 1626252 - DNA, 15 bp, Homo sapiens
tgaaaggtactatat

SEQ ID NO: 1626253 - DNA, 18 bp, Homo sapiens
tgaaaggtactatatttg

SEQ ID NO: 1626254 - DNA, 19 bp, Homo sapiens
tgaaaggtactatatttgc

SEQ ID NO: 1626255 - DNA, 15 bp, Homo sapiens
tgaaaggtttacatt

SEQ ID NO: 1626256 - DNA, 21 bp, Homo sapiens
tgaaagtagagctagctgcca

SEQ ID NO: 1626257 - DNA, 19 bp, Homo sapiens
tgaaagtcacggctgcgca

SEQ ID NO: 1626258 - DNA, 15 bp, Homo sapiens
tgaaagtcagatgcc

SEQ ID NO: 1626259 - DNA, 16 bp, Homo sapiens
tgaaagtgacagagac

SEQ ID NO: 1626260 - DNA, 18 bp, Homo sapiens
tgaaagttttcagaacct

SEQ ID NO: 1626261 - DNA, 14 bp, Homo sapiens
tgaaagttttgtaa

SEQ ID NO: 1626262 - DNA, 17 bp, Homo sapiens
tgaaagttttgtaaaag

SEQ ID NO: 1626263 - DNA, 22 bp, Homo sapiens
tgaaagttttgtaaaagaaatc

SEQ ID NO: 1626264 - DNA, 17 bp, Homo sapiens
ccctagtcccttcccct

SEQ ID NO: 1626265 - DNA, 19 bp, Homo sapiens
ccctagttagcatccaggc

SEQ ID NO: 1626266 - DNA, 17 bp, Homo sapiens
ccctatacctgagcctc

SEQ ID NO: 1626267 - DNA, 19 bp, Homo sapiens
ccctatactgtagtattct

SEQ ID NO: 1626268 - DNA, 13 bp, Homo sapiens
ccctatagagagg

SEQ ID NO: 1626269 - DNA, 14 bp, Homo sapiens
ccctatccacccag

SEQ ID NO: 1626270 - DNA, 16 bp, Homo sapiens
ccctatccacccagcc

SEQ ID NO: 1626271 - DNA, 19 bp, Homo sapiens
ccctatccacccagcccat

SEQ ID NO: 1626272 - DNA, 17 bp, Homo sapiens
ccctatctaaccctccc

SEQ ID NO: 1626273 - DNA, 15 bp, Homo sapiens
ccctatctcctgaca

SEQ ID NO: 1626274 - DNA, 20 bp, Homo sapiens
ccctatctcctgacagaagg

SEQ ID NO: 1626275 - DNA, 14 bp, Homo sapiens
ccctatctgtattc

SEQ ID NO: 1626276 - DNA, 14 bp, Homo sapiens
ccctatgctggtag

SEQ ID NO: 1626277 - DNA, 15 bp, Homo sapiens
ccctatgctggtaga

SEQ ID NO: 1626278 - DNA, 21 bp, Homo sapiens
ccctattctatccatctcctg

SEQ ID NO: 1626279 - DNA, 11 bp, Homo sapiens
ccctatttcta

SEQ ID NO: 1626280 - DNA, 17 bp, Homo sapiens
tgaaatagtctgtgtga

SEQ ID NO: 1626281 - DNA, 15 bp, Homo sapiens
tgaaatatctgtatt

SEQ ID NO: 1626282 - DNA, 17 bp, Homo sapiens
tgaaatattcagaaatt

SEQ ID NO: 1626283 - DNA, 15 bp, Homo sapiens
tgaaatcaaatgtat

SEQ ID NO: 1626284 - DNA, 16 bp, Homo sapiens
tgaaatccataaacta

SEQ ID NO: 1626285 - DNA, 20 bp, Homo sapiens
tgaaatccatatatatgaaa

SEQ ID NO: 1626286 - DNA, 17 bp, Homo sapiens
tgaaatccgtgaagtca

SEQ ID NO: 1626287 - DNA, 13 bp, Homo sapiens
tgaaatcctggaa

SEQ ID NO: 1626288 - DNA, 19 bp, Homo sapiens
tgaaatctgctagaaagtt

SEQ ID NO: 1626289 - DNA, 19 bp, Homo sapiens
tgaaatcttcccatgcatt

SEQ ID NO: 1626290 - DNA, 22 bp, Homo sapiens
tgaaatcttcccatgcattctg

SEQ ID NO: 1626291 - DNA, 13 bp, Homo sapiens
tgaaatgaaaggg

SEQ ID NO: 1626292 - DNA, 18 bp, Homo sapiens
tgaaatgaaagggaaact

SEQ ID NO: 1626293 - DNA, 13 bp, Homo sapiens
tgaaatgctcttt

SEQ ID NO: 1626294 - DNA, 19 bp, Homo sapiens
tgaaatgctgaaaattgcc

SEQ ID NO: 1626295 - DNA, 13 bp, Homo sapiens
tgaaatgctgcat

SEQ ID NO: 1626296 - DNA, 17 bp, Homo sapiens
tgaaatgctgcatttta

SEQ ID NO: 1626297 - DNA, 16 bp, Homo sapiens
tgaaatggctggggcc

SEQ ID NO: 1626298 - DNA, 15 bp, Homo sapiens
tgaaatgggagatgg

SEQ ID NO: 1626299 - DNA, 19 bp, Homo sapiens
tgaaatgggagatggtcag

SEQ ID NO: 1626300 - DNA, 22 bp, Homo sapiens
tgaaatggttgtcacctctctc

SEQ ID NO: 1626301 - DNA, 12 bp, Homo sapiens
tgaaatgtgaat

SEQ ID NO: 1626302 - DNA, 13 bp, Homo sapiens
tgaaattaaaaat

SEQ ID NO: 1626303 - DNA, 19 bp, Homo sapiens
tgaaattacgggtacctga

SEQ ID NO: 1626304 - DNA, 20 bp, Homo sapiens
tgaaattactacaaaatttg

SEQ ID NO: 1626305 - DNA, 23 bp, Homo sapiens
tgaaattagggcccaattaataa

SEQ ID NO: 1626306 - DNA, 19 bp, Homo sapiens
tgaaattatgtatgtttac

SEQ ID NO: 1626307 - DNA, 21 bp, Homo sapiens
tgaaattatgtatgtttacat

SEQ ID NO: 1626308 - DNA, 23 bp, Homo sapiens
tgaaattcaggatgctgtgatac

SEQ ID NO: 1626309 - DNA, 12 bp, Homo sapiens
tgaaattccaaa

SEQ ID NO: 1626310 - DNA, 14 bp, Homo sapiens
tgaaattccaaagt

SEQ ID NO: 1626311 - DNA, 16 bp, Homo sapiens
tgaaattccaaagtct

SEQ ID NO: 1626312 - DNA, 15 bp, Homo sapiens
tgaaattccagatga

SEQ ID NO: 1626313 - DNA, 13 bp, Homo sapiens
tgaaattctcaga

SEQ ID NO: 1626314 - DNA, 17 bp, Homo sapiens
tgaaattcttatgttga

SEQ ID NO: 1626315 - DNA, 13 bp, Homo sapiens
tgaaattcttcct

SEQ ID NO: 1626316 - DNA, 18 bp, Homo sapiens
tgaaattgaaaagttatt

SEQ ID NO: 1626317 - DNA, 17 bp, Homo sapiens
tgaaattgcatactttg

SEQ ID NO: 1626318 - DNA, 22 bp, Homo sapiens
tgaaattgtctagcagagcagg

SEQ ID NO: 1626319 - DNA, 18 bp, Homo sapiens
tgaaattgtttaagtgtt

SEQ ID NO: 1626320 - DNA, 21 bp, Homo sapiens
tgaaattgttttaccagctcc

SEQ ID NO: 1626321 - DNA, 22 bp, Homo sapiens
tgaaatttcagattcccagagc

SEQ ID NO: 1626322 - DNA, 18 bp, Homo sapiens
tgaaattttagaaatatt

SEQ ID NO: 1626323 - DNA, 18 bp, Homo sapiens
tgaaattttatatgctta

SEQ ID NO: 1626324 - DNA, 22 bp, Homo sapiens
tgaaattttatatgcttactga

SEQ ID NO: 1626325 - DNA, 18 bp, Homo sapiens
tgaacaaaaatgtttcca

SEQ ID NO: 1626326 - DNA, 18 bp, Homo sapiens
tgaacaaaacctacacac

SEQ ID NO: 1626327 - DNA, 20 bp, Homo sapiens
tgaacaaagctcaaagtatg

SEQ ID NO: 1626328 - DNA, 22 bp, Homo sapiens
tgaacaaattctttagtactca

SEQ ID NO: 1626329 - DNA, 18 bp, Homo sapiens
tgaacaagatttccctaa

SEQ ID NO: 1626330 - DNA, 21 bp, Homo sapiens
tgaacaattgtcgaaaagagt

SEQ ID NO: 1626331 - DNA, 12 bp, Homo sapiens
tgaacacacaca

SEQ ID NO: 1626332 - DNA, 14 bp, Homo sapiens
tgaacacactgtgt

SEQ ID NO: 1626333 - DNA, 15 bp, Homo sapiens
tgaacacactgtgtc

SEQ ID NO: 1626334 - DNA, 13 bp, Homo sapiens
tgaacacatgtgt

SEQ ID NO: 1626335 - DNA, 18 bp, Homo sapiens
tgaacactggcaacaaca

SEQ ID NO: 1626336 - DNA, 13 bp, Homo sapiens
tgaacactgtgac

SEQ ID NO: 1626337 - DNA, 13 bp, Homo sapiens
tgaacagcataag

SEQ ID NO: 1626338 - DNA, 15 bp, Homo sapiens
tgaacagctggtgcc

SEQ ID NO: 1626339 - DNA, 21 bp, Homo sapiens
tgaacagcttgccagggatgg

SEQ ID NO: 1626340 - DNA, 23 bp, Homo sapiens
tgaacaggaatccttactgatat

SEQ ID NO: 1626341 - DNA, 19 bp, Homo sapiens
tgaacaggggctggtatta

SEQ ID NO: 1626342 - DNA, 18 bp, Homo sapiens
tgaacatctcttgaaacc

SEQ ID NO: 1626343 - DNA, 18 bp, Homo sapiens
tgaacatgggagctcttg

SEQ ID NO: 1626344 - DNA, 21 bp, Homo sapiens
tgaacatgtgccttttctgaa

SEQ ID NO: 1626345 - DNA, 12 bp, Homo sapiens
tgaacatgttta

SEQ ID NO: 1626346 - DNA, 20 bp, Homo sapiens
tgaacatgtttaatgggtat

SEQ ID NO: 1626347 - DNA, 15 bp, Homo sapiens
tgaacatgtttacag

SEQ ID NO: 1626348 - DNA, 12 bp, Homo sapiens
tgaacattgtac

SEQ ID NO: 1626349 - DNA, 20 bp, Homo sapiens
tgaacattgtactgttgctt

SEQ ID NO: 1626350 - DNA, 22 bp, Homo sapiens
tgaacatttatcaatcagtata

SEQ ID NO: 1626351 - DNA, 16 bp, Homo sapiens
tgaacattttgtggag

SEQ ID NO: 1626352 - DNA, 17 bp, Homo sapiens
tgaaccaaaaatagaaa

SEQ ID NO: 1626353 - DNA, 20 bp, Homo sapiens
tgaaccaaaaatagaaatta

SEQ ID NO: 1626354 - DNA, 13 bp, Homo sapiens
tgaaccactgctt

SEQ ID NO: 1626355 - DNA, 22 bp, Homo sapiens
tgaaccataaattcaactttgt

SEQ ID NO: 1626356 - DNA, 15 bp, Homo sapiens
tgaaccccatgggct

SEQ ID NO: 1626357 - DNA, 13 bp, Homo sapiens
tgaaccccctccc

SEQ ID NO: 1626358 - DNA, 17 bp, Homo sapiens
tgaacccctggccagct

SEQ ID NO: 1626359 - DNA, 18 bp, Homo sapiens
tgaaccctagctgtgtca

SEQ ID NO: 1626360 - DNA, 21 bp, Homo sapiens
tgaaccctggggcctgactgc

SEQ ID NO: 1626361 - DNA, 14 bp, Homo sapiens
tgaaccctgtgctg

SEQ ID NO: 1626362 - DNA, 23 bp, Homo sapiens
tgaacctattttcatttgtacaa

SEQ ID NO: 1626363 - DNA, 12 bp, Homo sapiens
tgaacctgcaag

SEQ ID NO: 1626364 - DNA, 15 bp, Homo sapiens
tgaacctggaaatga

SEQ ID NO: 1626365 - DNA, 16 bp, Homo sapiens
tgaacctggaaatgat

SEQ ID NO: 1626366 - DNA, 17 bp, Homo sapiens
tgaacctggaaatgatg

SEQ ID NO: 1626367 - DNA, 17 bp, Homo sapiens
tgaacctgggaggcaga

SEQ ID NO: 1626368 - DNA, 15 bp, Homo sapiens
tgaacgagcagccca

SEQ ID NO: 1626369 - DNA, 21 bp, Homo sapiens
tgaacgatatgtagcagaaag

SEQ ID NO: 1626370 - DNA, 14 bp, Homo sapiens
tgaacggccttgct

SEQ ID NO: 1626371 - DNA, 13 bp, Homo sapiens
tgaacggggagaa

SEQ ID NO: 1626372 - DNA, 15 bp, Homo sapiens
tgaacggggagaaaa

SEQ ID NO: 1626373 - DNA, 14 bp, Homo sapiens
tgaacgtgcttctt

SEQ ID NO: 1626374 - DNA, 16 bp, Homo sapiens
tgaacgttttcttctt

SEQ ID NO: 1626375 - DNA, 17 bp, Homo sapiens
tgaacgttttcttcttt

SEQ ID NO: 1626376 - DNA, 21 bp, Homo sapiens
tgaactaaaataaaaatgaaa

SEQ ID NO: 1626377 - DNA, 16 bp, Homo sapiens
tgaactataaaaagca

SEQ ID NO: 1626378 - DNA, 12 bp, Homo sapiens
tgaactattgag

SEQ ID NO: 1626379 - DNA, 21 bp, Homo sapiens
tgaactatttattaaaaacat

SEQ ID NO: 1626380 - DNA, 17 bp, Homo sapiens
tgaactatttctacaca

SEQ ID NO: 1626381 - DNA, 20 bp, Homo sapiens
tgaactatttctacacagtg

SEQ ID NO: 1626382 - DNA, 19 bp, Homo sapiens
tgaactattttaaataaaa

SEQ ID NO: 1626383 - DNA, 12 bp, Homo sapiens
ccctcctccagt

SEQ ID NO: 1626384 - DNA, 13 bp, Homo sapiens
ccctcctctccca

SEQ ID NO: 1626385 - DNA, 14 bp, Homo sapiens
ccctcctctcccat

SEQ ID NO: 1626386 - DNA, 17 bp, Homo sapiens
ccctcctctcccatccc

SEQ ID NO: 1626387 - DNA, 15 bp, Homo sapiens
ccctcctctgagcag

SEQ ID NO: 1626388 - DNA, 16 bp, Homo sapiens
ccctcctctgccacct

SEQ ID NO: 1626389 - DNA, 22 bp, Homo sapiens
ccctcctcttcccttagcctct

SEQ ID NO: 1626390 - DNA, 12 bp, Homo sapiens
ccctcctgagca

SEQ ID NO: 1626391 - DNA, 15 bp, Homo sapiens
ccctcctgcaggctg

SEQ ID NO: 1626392 - DNA, 17 bp, Homo sapiens
ccctcctgctcctccct

SEQ ID NO: 1626393 - DNA, 18 bp, Homo sapiens
ccctcctgctcctccctg

SEQ ID NO: 1626394 - DNA, 15 bp, Homo sapiens
ccctcctgctgggcg

SEQ ID NO: 1626395 - DNA, 22 bp, Homo sapiens
ccctgagctcggtggacccagg

SEQ ID NO: 1626396 - DNA, 13 bp, Homo sapiens
ccctgagctttgg

SEQ ID NO: 1626397 - DNA, 15 bp, Homo sapiens
ccctgaggacctctc

SEQ ID NO: 1626398 - DNA, 16 bp, Homo sapiens
ccctgaggacctctca

SEQ ID NO: 1626399 - DNA, 14 bp, Homo sapiens
ccctgaggactgga

SEQ ID NO: 1626400 - DNA, 18 bp, Homo sapiens
ccctgaggactggagacc

SEQ ID NO: 1626401 - DNA, 19 bp, Homo sapiens
ccctgaggagccaggccgg

SEQ ID NO: 1626402 - DNA, 12 bp, Homo sapiens
ccctgaggccta

SEQ ID NO: 1626403 - DNA, 16 bp, Homo sapiens
ccctgaggcctagact

SEQ ID NO: 1626404 - DNA, 19 bp, Homo sapiens
ccctgaggtgtgggggctg

SEQ ID NO: 1626405 - DNA, 20 bp, Homo sapiens
ccctgaggtgtgggggctgc

SEQ ID NO: 1626406 - DNA, 22 bp, Homo sapiens
ccctgaggtgtgggggctgcag

SEQ ID NO: 1626407 - DNA, 13 bp, Homo sapiens
ccctgagtcctgg

SEQ ID NO: 1626408 - DNA, 23 bp, Homo sapiens
ccctgagtcctggtttcctggca

SEQ ID NO: 1626409 - DNA, 15 bp, Homo sapiens
ccctgagtctgggca

SEQ ID NO: 1626410 - DNA, 18 bp, Homo sapiens
ccctgagtgggctgggcc

SEQ ID NO: 1626411 - DNA, 14 bp, Homo sapiens
ccctgagtgtccca

SEQ ID NO: 1626412 - DNA, 16 bp, Homo sapiens
ccctgagttggagctc

SEQ ID NO: 1626413 - DNA, 17 bp, Homo sapiens
ccctgatagaagattgt

SEQ ID NO: 1626414 - DNA, 16 bp, Homo sapiens
ccctgatgcagcctgt

SEQ ID NO: 1626415 - DNA, 20 bp, Homo sapiens
ccctgatgtgtcctcaggga

SEQ ID NO: 1626416 - DNA, 23 bp, Homo sapiens
ccctgcaaccaattgaaaagtgt

SEQ ID NO: 1626417 - DNA, 23 bp, Homo sapiens
ccctgcaacttccgctgaggggt

SEQ ID NO: 1626418 - DNA, 14 bp, Homo sapiens
ccctgcacaggcac

SEQ ID NO: 1626419 - DNA, 14 bp, Homo sapiens
ccctgcacccaccc

SEQ ID NO: 1626420 - DNA, 15 bp, Homo sapiens
ccctgcacccacccc

SEQ ID NO: 1626421 - DNA, 16 bp, Homo sapiens
ccctgcacccacccct

SEQ ID NO: 1626422 - DNA, 20 bp, Homo sapiens
ccctgcacccacccctgccc

SEQ ID NO: 1626423 - DNA, 12 bp, Homo sapiens
ccctgcaccctg

SEQ ID NO: 1626424 - DNA, 14 bp, Homo sapiens
ccctgcacctgctg

SEQ ID NO: 1626425 - DNA, 17 bp, Homo sapiens
ccctgcacctggcctgg

SEQ ID NO: 1626426 - DNA, 13 bp, Homo sapiens
ccctgcacgtcat

SEQ ID NO: 1626427 - DNA, 15 bp, Homo sapiens
ccctgcacgtcatgg

SEQ ID NO: 1626428 - DNA, 17 bp, Homo sapiens
ccctgcactccctcctg

SEQ ID NO: 1626429 - DNA, 13 bp, Homo sapiens
ccctgcactggag

SEQ ID NO: 1626430 - DNA, 20 bp, Homo sapiens
ccctgcactgtaaaatgtgg

SEQ ID NO: 1626431 - DNA, 17 bp, Homo sapiens
ccctgcagagcacacag

SEQ ID NO: 1626432 - DNA, 14 bp, Homo sapiens
ccctgcagccagct

SEQ ID NO: 1626433 - DNA, 22 bp, Homo sapiens
ccctgcagcccaaaacccaggg

SEQ ID NO: 1626434 - DNA, 18 bp, Homo sapiens
ccctgcaggacttgccac

SEQ ID NO: 1626435 - DNA, 20 bp, Homo sapiens
ccctgcagttggcagaaagg

SEQ ID NO: 1626436 - DNA, 20 bp, Homo sapiens
ccctgcagtttggccctgga

SEQ ID NO: 1626437 - DNA, 22 bp, Homo sapiens
ccctgcagtttggccctggagc

SEQ ID NO: 1626438 - DNA, 23 bp, Homo sapiens
ccctgcagtttggccctggagcc

SEQ ID NO: 1626439 - DNA, 22 bp, Homo sapiens
ccctgcattggcctggcctcca

SEQ ID NO: 1626440 - DNA, 14 bp, Homo sapiens
ccctgcattttcct

SEQ ID NO: 1626441 - DNA, 16 bp, Homo sapiens
ccctgcattttcctct

SEQ ID NO: 1626442 - DNA, 14 bp, Homo sapiens
ccctgccaccaggc

SEQ ID NO: 1626443 - DNA, 17 bp, Homo sapiens
ccctgccacctccctga

SEQ ID NO: 1626444 - DNA, 19 bp, Homo sapiens
ccctgccatcttcccagca

SEQ ID NO: 1626445 - DNA, 13 bp, Homo sapiens
ccctgcccaggca

SEQ ID NO: 1626446 - DNA, 16 bp, Homo sapiens
ccctgccccaccccac

SEQ ID NO: 1626447 - DNA, 14 bp, Homo sapiens
ccctgccccagagg

SEQ ID NO: 1626448 - DNA, 23 bp, Homo sapiens
ccctgccccagaggtcgcagcta

SEQ ID NO: 1626449 - DNA, 23 bp, Homo sapiens
ccctgcccccaggactgggccac

SEQ ID NO: 1626450 - DNA, 19 bp, Homo sapiens
ccctgcccccatctcccca

SEQ ID NO: 1626451 - DNA, 22 bp, Homo sapiens
ccctgcccccatctccccaggc

SEQ ID NO: 1626452 - DNA, 21 bp, Homo sapiens
ccctgccccccagcctctggc

SEQ ID NO: 1626453 - DNA, 21 bp, Homo sapiens
ccctgccccccctaagagaca

SEQ ID NO: 1626454 - DNA, 12 bp, Homo sapiens
ccctgccccggg

SEQ ID NO: 1626455 - DNA, 18 bp, Homo sapiens
ccctgccccgttgcttcc

SEQ ID NO: 1626456 - DNA, 10 bp, Homo sapiens
ccctgcccct

SEQ ID NO: 1626457 - DNA, 15 bp, Homo sapiens
ccctgcccctaggat

SEQ ID NO: 1626458 - DNA, 17 bp, Homo sapiens
ccctgcccctcccttca

SEQ ID NO: 1626459 - DNA, 15 bp, Homo sapiens
ccctgcccgctccca

SEQ ID NO: 1626460 - DNA, 16 bp, Homo sapiens
ccctgcccgctcccaa

SEQ ID NO: 1626461 - DNA, 17 bp, Homo sapiens
ccctgcccgctcccaac

SEQ ID NO: 1626462 - DNA, 22 bp, Homo sapiens
ccctgcccggtggtttgccatg

SEQ ID NO: 1626463 - DNA, 16 bp, Homo sapiens
ccctgccctagctcca

SEQ ID NO: 1626464 - DNA, 17 bp, Homo sapiens
ccctgccctagctccac

SEQ ID NO: 1626465 - DNA, 15 bp, Homo sapiens
ccctgccctcccaag

SEQ ID NO: 1626466 - DNA, 19 bp, Homo sapiens
ccctgccctcccctgctcc

SEQ ID NO: 1626467 - DNA, 20 bp, Homo sapiens
ccctgccctcccctgctccc

SEQ ID NO: 1626468 - DNA, 14 bp, Homo sapiens
ccctgccctcgtgg

SEQ ID NO: 1626469 - DNA, 17 bp, Homo sapiens
ccctgccctcgtggcca

SEQ ID NO: 1626470 - DNA, 18 bp, Homo sapiens
ccctgccctcgtggccag

SEQ ID NO: 1626471 - DNA, 17 bp, Homo sapiens
ccctgccctctccttcc

SEQ ID NO: 1626472 - DNA, 12 bp, Homo sapiens
ccctgccctgca

SEQ ID NO: 1626473 - DNA, 14 bp, Homo sapiens
ccctgccctggtcc

SEQ ID NO: 1626474 - DNA, 22 bp, Homo sapiens
ccctgcccttcctcctgatgga

SEQ ID NO: 1626475 - DNA, 16 bp, Homo sapiens
ccctgcccttctcaag

SEQ ID NO: 1626476 - DNA, 13 bp, Homo sapiens
ccctgccgcctca

SEQ ID NO: 1626477 - DNA, 22 bp, Homo sapiens
ccctgccggaatgaactgtccg

SEQ ID NO: 1626478 - DNA, 16 bp, Homo sapiens
ccctgcctcatccacc

SEQ ID NO: 1626479 - DNA, 22 bp, Homo sapiens
ccctgcctccaccgagccagct

SEQ ID NO: 1626480 - DNA, 23 bp, Homo sapiens
ccctgcctccaccgagccagctt

SEQ ID NO: 1626481 - DNA, 23 bp, Homo sapiens
ccctgcctcctgccaccccttcc

SEQ ID NO: 1626482 - DNA, 16 bp, Homo sapiens
ccctgcctgagcccag

SEQ ID NO: 1626483 - DNA, 13 bp, Homo sapiens
ccctgcctgagga

SEQ ID NO: 1626484 - DNA, 13 bp, Homo sapiens
ccctgcctgccat

SEQ ID NO: 1626485 - DNA, 12 bp, Homo sapiens
ccctgcctgccc

SEQ ID NO: 1626486 - DNA, 23 bp, Homo sapiens
ccctgcctgttggcaggcccact

SEQ ID NO: 1626487 - DNA, 21 bp, Homo sapiens
ccctgcgaaggggccctggtc

SEQ ID NO: 1626488 - DNA, 16 bp, Homo sapiens
ccctgcgcctccagag

SEQ ID NO: 1626489 - DNA, 17 bp, Homo sapiens
ccctgcgcctccagagg

SEQ ID NO: 1626490 - DNA, 15 bp, Homo sapiens
ccctgcgcctgtgat

SEQ ID NO: 1626491 - DNA, 20 bp, Homo sapiens
ccctgcggcctccacacctg

SEQ ID NO: 1626492 - DNA, 22 bp, Homo sapiens
ccctgcgtcctgacgccctgcg

SEQ ID NO: 1626493 - DNA, 17 bp, Homo sapiens
ccctgcgtgggggccag

SEQ ID NO: 1626494 - DNA, 16 bp, Homo sapiens
ccctgctacctgttct

SEQ ID NO: 1626495 - DNA, 17 bp, Homo sapiens
ccctgctactcctgtgc

SEQ ID NO: 1626496 - DNA, 14 bp, Homo sapiens
ccctgctccaccag

SEQ ID NO: 1626497 - DNA, 19 bp, Homo sapiens
ccctgctccaccagcagca

SEQ ID NO: 1626498 - DNA, 20 bp, Homo sapiens
ccctgctccaccagcagcat

SEQ ID NO: 1626499 - DNA, 17 bp, Homo sapiens
ccctgctcccattcctc

SEQ ID NO: 1626500 - DNA, 13 bp, Homo sapiens
ccctgctcctccc

SEQ ID NO: 1626501 - DNA, 20 bp, Homo sapiens
ccctgctcctccctggctgc

SEQ ID NO: 1626502 - DNA, 22 bp, Homo sapiens
ccctgctcctccctggctgccc

SEQ ID NO: 1626503 - DNA, 19 bp, Homo sapiens
tgaaggcagtggcagggga

SEQ ID NO: 1626504 - DNA, 16 bp, Homo sapiens
tgaaggccacttgagt

SEQ ID NO: 1626505 - DNA, 15 bp, Homo sapiens
tgaaggccctgctga

SEQ ID NO: 1626506 - DNA, 23 bp, Homo sapiens
tgaaggctctcacccccatccct

SEQ ID NO: 1626507 - DNA, 18 bp, Homo sapiens
tgaagggaaacaaagaag

SEQ ID NO: 1626508 - DNA, 22 bp, Homo sapiens
tgaagggaaaggatattttctt

SEQ ID NO: 1626509 - DNA, 15 bp, Homo sapiens
tgaagggaagagaca

SEQ ID NO: 1626510 - DNA, 22 bp, Homo sapiens
tcttaatgttactcagatataa

SEQ ID NO: 1626511 - DNA, 18 bp, Homo sapiens
tcttaattactttcagaa

SEQ ID NO: 1626512 - DNA, 16 bp, Homo sapiens
tcttaattagacctag

SEQ ID NO: 1626513 - DNA, 12 bp, Homo sapiens
tcttaattatta

SEQ ID NO: 1626514 - DNA, 14 bp, Homo sapiens
tcttaattctttgt

SEQ ID NO: 1626515 - DNA, 19 bp, Homo sapiens
tcttaattttttttaatgt

SEQ ID NO: 1626516 - DNA, 16 bp, Homo sapiens
tcttacaattgcactg

SEQ ID NO: 1626517 - DNA, 22 bp, Homo sapiens
tcttacaattgcactgctgttc

SEQ ID NO: 1626518 - DNA, 16 bp, Homo sapiens
tcttacagagccttga

SEQ ID NO: 1626519 - DNA, 20 bp, Homo sapiens
tcttacagcacatcacctct

SEQ ID NO: 1626520 - DNA, 15 bp, Homo sapiens
tcttacatgttttct

SEQ ID NO: 1626521 - DNA, 20 bp, Homo sapiens
tcttacccagattgtgtaca

SEQ ID NO: 1626522 - DNA, 22 bp, Homo sapiens
tcttacccagattgtgtacata

SEQ ID NO: 1626523 - DNA, 23 bp, Homo sapiens
tcttacccagattgtgtacatag

SEQ ID NO: 1626524 - DNA, 17 bp, Homo sapiens
tcttaccgtagcctccg

SEQ ID NO: 1626525 - DNA, 18 bp, Homo sapiens
tcttacctactattggcc

SEQ ID NO: 1626526 - DNA, 19 bp, Homo sapiens
tcttacctcccactaaagg

SEQ ID NO: 1626527 - DNA, 21 bp, Homo sapiens
tcttacctgttatttatcaat

SEQ ID NO: 1626528 - DNA, 20 bp, Homo sapiens
tcttaccttgaactgaaggc

SEQ ID NO: 1626529 - DNA, 19 bp, Homo sapiens
tcttactaaggcctttggt

SEQ ID NO: 1626530 - DNA, 15 bp, Homo sapiens
tcttactctttccta

SEQ ID NO: 1626531 - DNA, 18 bp, Homo sapiens
tcttactgtacctgttcc

SEQ ID NO: 1626532 - DNA, 13 bp, Homo sapiens
tcttacttgtctg

SEQ ID NO: 1626533 - DNA, 13 bp, Homo sapiens
tcttactttgctt

SEQ ID NO: 1626534 - DNA, 20 bp, Homo sapiens
tcttagaaaaggtgataaaa

SEQ ID NO: 1626535 - DNA, 13 bp, Homo sapiens
tcttagaaatact

SEQ ID NO: 1626536 - DNA, 17 bp, Homo sapiens
tcttagaagtgttgtaa

SEQ ID NO: 1626537 - DNA, 14 bp, Homo sapiens
tcttagactacatt

SEQ ID NO: 1626538 - DNA, 16 bp, Homo sapiens
tcttagacttttccaa

SEQ ID NO: 1626539 - DNA, 12 bp, Homo sapiens
tcttagatgtat

SEQ ID NO: 1626540 - DNA, 12 bp, Homo sapiens
tcttagattctc

SEQ ID NO: 1626541 - DNA, 16 bp, Homo sapiens
tcttagcaataaatgc

SEQ ID NO: 1626542 - DNA, 17 bp, Homo sapiens
tcttagcctctggatct

SEQ ID NO: 1626543 - DNA, 12 bp, Homo sapiens
tcttagctctgg

SEQ ID NO: 1626544 - DNA, 15 bp, Homo sapiens
tcttagctctggacg

SEQ ID NO: 1626545 - DNA, 19 bp, Homo sapiens
tcttagctctggacgtgaa

SEQ ID NO: 1626546 - DNA, 15 bp, Homo sapiens
tcttagctgtctgct

SEQ ID NO: 1626547 - DNA, 23 bp, Homo sapiens
tcttagctgtctgctcagacaga

SEQ ID NO: 1626548 - DNA, 15 bp, Homo sapiens
tcttaggaagagaaa

SEQ ID NO: 1626549 - DNA, 14 bp, Homo sapiens
tctgtagggctgga

SEQ ID NO: 1626550 - DNA, 16 bp, Homo sapiens
tctgtagggctggacc

SEQ ID NO: 1626551 - DNA, 22 bp, Homo sapiens
tctgtaggtttctctcttccct

SEQ ID NO: 1626552 - DNA, 19 bp, Homo sapiens
tctgtagtactccttaaga

SEQ ID NO: 1626553 - DNA, 19 bp, Homo sapiens
tctgtagtattttttaaat

SEQ ID NO: 1626554 - DNA, 13 bp, Homo sapiens
tctgtagtggccc

SEQ ID NO: 1626555 - DNA, 19 bp, Homo sapiens
tctgtataagttgaaggaa

SEQ ID NO: 1626556 - DNA, 15 bp, Homo sapiens
tctgtatataaaata

SEQ ID NO: 1626557 - DNA, 21 bp, Homo sapiens
tctgtatataagttgctgtgt

SEQ ID NO: 1626558 - DNA, 19 bp, Homo sapiens
tctgtatatgattctctgt

SEQ ID NO: 1626559 - DNA, 21 bp, Homo sapiens
tctgtatccgtgaattgcttt

SEQ ID NO: 1626560 - DNA, 19 bp, Homo sapiens
tctgtatcggagacagtga

SEQ ID NO: 1626561 - DNA, 13 bp, Homo sapiens
tctgtatggtcag

SEQ ID NO: 1626562 - DNA, 23 bp, Homo sapiens
tctgtattaatccccatcattac

SEQ ID NO: 1626563 - DNA, 13 bp, Homo sapiens
tctgtatttcctt

SEQ ID NO: 1626564 - DNA, 23 bp, Homo sapiens
tctgtattttatttagacaagag

SEQ ID NO: 1626565 - DNA, 20 bp, Homo sapiens
tctgtcaaatgtttccttaa

SEQ ID NO: 1626566 - DNA, 20 bp, Homo sapiens
tctgtcatcactccctggat

SEQ ID NO: 1626567 - DNA, 17 bp, Homo sapiens
tctgtccaaaggaggct

SEQ ID NO: 1626568 - DNA, 23 bp, Homo sapiens
tctgtccaaaggaggctggcagg

SEQ ID NO: 1626569 - DNA, 18 bp, Homo sapiens
tctgtccacatccccaga

SEQ ID NO: 1626570 - DNA, 12 bp, Homo sapiens
tctgtccaggcc

SEQ ID NO: 1626571 - DNA, 16 bp, Homo sapiens
tctgtccaggccactg

SEQ ID NO: 1626572 - DNA, 20 bp, Homo sapiens
tctgtccagggccctgagct

SEQ ID NO: 1626573 - DNA, 21 bp, Homo sapiens
tctgtccccttctctcatctc

SEQ ID NO: 1626574 - DNA, 14 bp, Homo sapiens
tctgtcccttgctg

SEQ ID NO: 1626575 - DNA, 15 bp, Homo sapiens
tctgtcccttgctgt

SEQ ID NO: 1626576 - DNA, 13 bp, Homo sapiens
tctgtcccttttc

SEQ ID NO: 1626577 - DNA, 20 bp, Homo sapiens
tctgtccgttcacatgtgtg

SEQ ID NO: 1626578 - DNA, 20 bp, Homo sapiens
tctgtccgtttactccaagg

SEQ ID NO: 1626579 - DNA, 11 bp, Homo sapiens
tctgtcctact

SEQ ID NO: 1626580 - DNA, 18 bp, Homo sapiens
tctgtcctacttctgact

SEQ ID NO: 1626581 - DNA, 14 bp, Homo sapiens
tctgtcctctgtag

SEQ ID NO: 1626582 - DNA, 15 bp, Homo sapiens
tctgtcctcttggcc

SEQ ID NO: 1626583 - DNA, 16 bp, Homo sapiens
tctgtcctcttggcca

SEQ ID NO: 1626584 - DNA, 13 bp, Homo sapiens
tctgtcctgtgac

SEQ ID NO: 1626585 - DNA, 21 bp, Homo sapiens
tctgtccttttggcactgaga

SEQ ID NO: 1626586 - DNA, 14 bp, Homo sapiens
tctgtctaggactg

SEQ ID NO: 1626587 - DNA, 23 bp, Homo sapiens
tctgtctaggactgcagtgtgga

SEQ ID NO: 1626588 - DNA, 22 bp, Homo sapiens
tctgtctccctcccctctcaga

SEQ ID NO: 1626589 - DNA, 19 bp, Homo sapiens
tctgtctcgatgcctgatt

SEQ ID NO: 1626590 - DNA, 21 bp, Homo sapiens
tctgtctctaaccattcaaat

SEQ ID NO: 1626591 - DNA, 14 bp, Homo sapiens
tctgtctctatatt

SEQ ID NO: 1626592 - DNA, 12 bp, Homo sapiens
tctgtctggcac

SEQ ID NO: 1626593 - DNA, 15 bp, Homo sapiens
tctgtctttgtggga

SEQ ID NO: 1626594 - DNA, 17 bp, Homo sapiens
tctgtgaaattctcaga

SEQ ID NO: 1626595 - DNA, 16 bp, Homo sapiens
tctgtgaacatgttaa

SEQ ID NO: 1626596 - DNA, 17 bp, Homo sapiens
tctgtgaacgatttaga

SEQ ID NO: 1626597 - DNA, 19 bp, Homo sapiens
tctgtgaagaggaacagtg

SEQ ID NO: 1626598 - DNA, 22 bp, Homo sapiens
tctgtgaagaggaacagtgtgg

SEQ ID NO: 1626599 - DNA, 15 bp, Homo sapiens
tctgtgaattgcctg

SEQ ID NO: 1626600 - DNA, 16 bp, Homo sapiens
tctgtgacacatcgtt

SEQ ID NO: 1626601 - DNA, 16 bp, Homo sapiens
tctgtgacatcctgct

SEQ ID NO: 1626602 - DNA, 14 bp, Homo sapiens
tctgtgacgcagac

SEQ ID NO: 1626603 - DNA, 17 bp, Homo sapiens
tctgtgactataaagct

SEQ ID NO: 1626604 - DNA, 19 bp, Homo sapiens
tctgtgactataaagctgt

SEQ ID NO: 1626605 - DNA, 13 bp, Homo sapiens
tctgtgactggat

SEQ ID NO: 1626606 - DNA, 20 bp, Homo sapiens
tctgtgactggatcttctat

SEQ ID NO: 1626607 - DNA, 23 bp, Homo sapiens
tctgtgagaaggtttattgttaa

SEQ ID NO: 1626608 - DNA, 16 bp, Homo sapiens
tctgtgatccttggtg

SEQ ID NO: 1626609 - DNA, 16 bp, Homo sapiens
tctgtgatgatcctca

SEQ ID NO: 1626610 - DNA, 12 bp, Homo sapiens
tctgtgattggc

SEQ ID NO: 1626611 - DNA, 14 bp, Homo sapiens
tctgtgattggctg

SEQ ID NO: 1626612 - DNA, 16 bp, Homo sapiens
tctgtgattggctggt

SEQ ID NO: 1626613 - DNA, 15 bp, Homo sapiens
tctgtgcattcatgc

SEQ ID NO: 1626614 - DNA, 17 bp, Homo sapiens
tctgtgcattcatgcaa

SEQ ID NO: 1626615 - DNA, 15 bp, Homo sapiens
tctgtgccccatgcc

SEQ ID NO: 1626616 - DNA, 18 bp, Homo sapiens
tctgtgccctccaaagag

SEQ ID NO: 1626617 - DNA, 20 bp, Homo sapiens
tctgtgcctccccccagacc

SEQ ID NO: 1626618 - DNA, 17 bp, Homo sapiens
tctgtgcctgaatattt

SEQ ID NO: 1626619 - DNA, 18 bp, Homo sapiens
tctgtgccttcttttgat

SEQ ID NO: 1626620 - DNA, 22 bp, Homo sapiens
tctgtgccttcttttgattatg

SEQ ID NO: 1626621 - DNA, 14 bp, Homo sapiens
tctgtgcctttcta

SEQ ID NO: 1626622 - DNA, 21 bp, Homo sapiens
tctgtgctagggaaacttccc

SEQ ID NO: 1626623 - DNA, 19 bp, Homo sapiens
tctgtgctggagatgtttt

SEQ ID NO: 1626624 - DNA, 21 bp, Homo sapiens
tctgtgctggagatgttttag

SEQ ID NO: 1626625 - DNA, 14 bp, Homo sapiens
tctgtgctgtgcct

SEQ ID NO: 1626626 - DNA, 18 bp, Homo sapiens
tctgtgctgtgcctgcta

SEQ ID NO: 1626627 - DNA, 20 bp, Homo sapiens
tctgtgctgtgcctgctaga

SEQ ID NO: 1626628 - DNA, 21 bp, Homo sapiens
tctgtgcttcgactactgctc

SEQ ID NO: 1626629 - DNA, 22 bp, Homo sapiens
tctgtggagctgccacagagaa

SEQ ID NO: 1626630 - DNA, 23 bp, Homo sapiens
tctgtggagctgccacagagaag

SEQ ID NO: 1626631 - DNA, 17 bp, Homo sapiens
tctgtggagggttgcca

SEQ ID NO: 1626632 - DNA, 17 bp, Homo sapiens
tctgtggagttcctgct

SEQ ID NO: 1626633 - DNA, 18 bp, Homo sapiens
tctgtggagttcctgctc

SEQ ID NO: 1626634 - DNA, 15 bp, Homo sapiens
tctgtggattctata

SEQ ID NO: 1626635 - DNA, 14 bp, Homo sapiens
tctgtggcctgtgt

SEQ ID NO: 1626636 - DNA, 23 bp, Homo sapiens
tctgtggcctgtgtccagcagct

SEQ ID NO: 1626637 - DNA, 17 bp, Homo sapiens
tctgtgggcactggtgg

SEQ ID NO: 1626638 - DNA, 20 bp, Homo sapiens
tctgtgggctacatgctggg

SEQ ID NO: 1626639 - DNA, 21 bp, Homo sapiens
tctgtggggaggggttgtttt

SEQ ID NO: 1626640 - DNA, 22 bp, Homo sapiens
tctgtgggggtcatcagggagg

SEQ ID NO: 1626641 - DNA, 19 bp, Homo sapiens
tctgtggttttttttgaat

SEQ ID NO: 1626642 - DNA, 20 bp, Homo sapiens
tctgtgtaacatccaagcca

SEQ ID NO: 1626643 - DNA, 16 bp, Homo sapiens
tctgtgtaatctctga

SEQ ID NO: 1626644 - DNA, 21 bp, Homo sapiens
tctgtgtaccacttcctgagg

SEQ ID NO: 1626645 - DNA, 16 bp, Homo sapiens
tctgtgtctaagattc

SEQ ID NO: 1626646 - DNA, 14 bp, Homo sapiens
tctgtgtgcagcaa

SEQ ID NO: 1626647 - DNA, 19 bp, Homo sapiens
tctgtgtgtgtgtatgtgg

SEQ ID NO: 1626648 - DNA, 21 bp, Homo sapiens
tctgtgtgtgtgtatgtgggg

SEQ ID NO: 1626649 - DNA, 15 bp, Homo sapiens
tctgtgtgtttatgt

SEQ ID NO: 1626650 - DNA, 19 bp, Homo sapiens
tctgtgtgtttatgtgtgt

SEQ ID NO: 1626651 - DNA, 13 bp, Homo sapiens
tctgtgttgaaca

SEQ ID NO: 1626652 - DNA, 14 bp, Homo sapiens
tctgtgttgccaag

SEQ ID NO: 1626653 - DNA, 13 bp, Homo sapiens
tctgtgtttataa

SEQ ID NO: 1626654 - DNA, 17 bp, Homo sapiens
tctgtgtttattcaaac

SEQ ID NO: 1626655 - DNA, 14 bp, Homo sapiens
tctgtgtttctgga

SEQ ID NO: 1626656 - DNA, 17 bp, Homo sapiens
tctgtgtttctggagtg

SEQ ID NO: 1626657 - DNA, 18 bp, Homo sapiens
tctgtgttttgaaagaat

SEQ ID NO: 1626658 - DNA, 16 bp, Homo sapiens
tctgtgtttttgaaat

SEQ ID NO: 1626659 - DNA, 13 bp, Homo sapiens
tctgttaaaatgc

SEQ ID NO: 1626660 - DNA, 14 bp, Homo sapiens
tctgttaaaatgca

SEQ ID NO: 1626661 - DNA, 15 bp, Homo sapiens
tctgttacccaggct

SEQ ID NO: 1626662 - DNA, 14 bp, Homo sapiens
tctgttagggcctt

SEQ ID NO: 1626663 - DNA, 21 bp, Homo sapiens
tctgttatgcactgtggtttc

SEQ ID NO: 1626664 - DNA, 15 bp, Homo sapiens
tctcttattctaata

SEQ ID NO: 1626665 - DNA, 14 bp, Homo sapiens
tctcttcaatctct

SEQ ID NO: 1626666 - DNA, 16 bp, Homo sapiens
tctcttcaatctctgg

SEQ ID NO: 1626667 - DNA, 23 bp, Homo sapiens
tctcttcagcccctagtgctatt

SEQ ID NO: 1626668 - DNA, 13 bp, Homo sapiens
tctcttcaggttc

SEQ ID NO: 1626669 - DNA, 15 bp, Homo sapiens
tctcttcaggttctt

SEQ ID NO: 1626670 - DNA, 23 bp, Homo sapiens
tctcttccaaccatttatcttga

SEQ ID NO: 1626671 - DNA, 18 bp, Homo sapiens
tctcttccccttccctta

SEQ ID NO: 1626672 - DNA, 17 bp, Homo sapiens
tctcttccctgcgcctg

SEQ ID NO: 1626673 - DNA, 13 bp, Homo sapiens
tctcttcccttcc

SEQ ID NO: 1626674 - DNA, 15 bp, Homo sapiens
tctcttcccttccca

SEQ ID NO: 1626675 - DNA, 15 bp, Homo sapiens
tctcttcgctgtgat

SEQ ID NO: 1626676 - DNA, 13 bp, Homo sapiens
tctcttctccact

SEQ ID NO: 1626677 - DNA, 16 bp, Homo sapiens
tctcttctccactgga

SEQ ID NO: 1626678 - DNA, 12 bp, Homo sapiens
tctcttctctcc

SEQ ID NO: 1626679 - DNA, 15 bp, Homo sapiens
tctcttctctccagc

SEQ ID NO: 1626680 - DNA, 23 bp, Homo sapiens
tctcttctctccagctgactaaa

SEQ ID NO: 1626681 - DNA, 14 bp, Homo sapiens
tctcttctgctcca

SEQ ID NO: 1626682 - DNA, 17 bp, Homo sapiens
tctcttcttgctatatg

SEQ ID NO: 1626683 - DNA, 18 bp, Homo sapiens
tctcttcttttggcttcc

SEQ ID NO: 1626684 - DNA, 20 bp, Homo sapiens
tctcttgaaaagttcaggga

SEQ ID NO: 1626685 - DNA, 21 bp, Homo sapiens
tctcttgagcatcaatcttgt

SEQ ID NO: 1626686 - DNA, 23 bp, Homo sapiens
tctcttgagcatcaatcttgtta

SEQ ID NO: 1626687 - DNA, 16 bp, Homo sapiens
tctcttgagctggcct

SEQ ID NO: 1626688 - DNA, 17 bp, Homo sapiens
tctcttgagctggcctc

SEQ ID NO: 1626689 - DNA, 18 bp, Homo sapiens
tctcttgaggccaggagt

SEQ ID NO: 1626690 - DNA, 13 bp, Homo sapiens
tctcttgagggag

SEQ ID NO: 1626691 - DNA, 13 bp, Homo sapiens
tctcttgcattgt

SEQ ID NO: 1626692 - DNA, 21 bp, Homo sapiens
tctcttgccatttgtagcttt

SEQ ID NO: 1626693 - DNA, 20 bp, Homo sapiens
tctcttgggaagtgtgttta

SEQ ID NO: 1626694 - DNA, 20 bp, Homo sapiens
tctcttgggggccgggggga

SEQ ID NO: 1626695 - DNA, 22 bp, Homo sapiens
tctcttgggggccggggggaaa

SEQ ID NO: 1626696 - DNA, 16 bp, Homo sapiens
tctcttggtttccttc

SEQ ID NO: 1626697 - DNA, 19 bp, Homo sapiens
tctcttggtttccttcctt

SEQ ID NO: 1626698 - DNA, 14 bp, Homo sapiens
tctcttgtaccata

SEQ ID NO: 1626699 - DNA, 17 bp, Homo sapiens
tctcttgtaccatagaa

SEQ ID NO: 1626700 - DNA, 13 bp, Homo sapiens
tctcttgtcctct

SEQ ID NO: 1626701 - DNA, 18 bp, Homo sapiens
tctcttgtcctcttctgc

SEQ ID NO: 1626702 - DNA, 22 bp, Homo sapiens
tctctttaaaaaagactgaaca

SEQ ID NO: 1626703 - DNA, 18 bp, Homo sapiens
tctctttaaaaggaaaga

SEQ ID NO: 1626704 - DNA, 21 bp, Homo sapiens
tctctttaccttctaaaagcc

SEQ ID NO: 1626705 - DNA, 17 bp, Homo sapiens
tctctttagtataattg

SEQ ID NO: 1626706 - DNA, 23 bp, Homo sapiens
tctctttagtataattgacctac

SEQ ID NO: 1626707 - DNA, 16 bp, Homo sapiens
tctctttatacagctg

SEQ ID NO: 1626708 - DNA, 12 bp, Homo sapiens
tctctttccctt

SEQ ID NO: 1626709 - DNA, 13 bp, Homo sapiens
tctctttccttga

SEQ ID NO: 1626710 - DNA, 15 bp, Homo sapiens
tctctttccttgagc

SEQ ID NO: 1626711 - DNA, 12 bp, Homo sapiens
tctctttctctg

SEQ ID NO: 1626712 - DNA, 14 bp, Homo sapiens
tctctttctctggt

SEQ ID NO: 1626713 - DNA, 12 bp, Homo sapiens
tctctttctgtc

SEQ ID NO: 1626714 - DNA, 14 bp, Homo sapiens
tctctttggaaata

SEQ ID NO: 1626715 - DNA, 21 bp, Homo sapiens
tctcttttcccctttcctgtc

SEQ ID NO: 1626716 - DNA, 15 bp, Homo sapiens
tctcttttcctcctc

SEQ ID NO: 1626717 - DNA, 13 bp, Homo sapiens
tctcttttctttc

SEQ ID NO: 1626718 - DNA, 21 bp, Homo sapiens
tctcttttctttctgtcttgt

SEQ ID NO: 1626719 - DNA, 16 bp, Homo sapiens
tctgaaaaacattcca

SEQ ID NO: 1626720 - DNA, 21 bp, Homo sapiens
tctgaaaagcaattgccctgt

SEQ ID NO: 1626721 - DNA, 22 bp, Homo sapiens
tctgaaaagcaattgccctgta

SEQ ID NO: 1626722 - DNA, 16 bp, Homo sapiens
tctgaaaagcagttca

SEQ ID NO: 1626723 - DNA, 11 bp, Homo sapiens
tctgaaaatat

SEQ ID NO: 1626724 - DNA, 17 bp, Homo sapiens
tctgaaaatattctact

SEQ ID NO: 1626725 - DNA, 13 bp, Homo sapiens
tctgaaaatattt

SEQ ID NO: 1626726 - DNA, 20 bp, Homo sapiens
tctgaaaatatttttttcta

SEQ ID NO: 1626727 - DNA, 21 bp, Homo sapiens
tctgaaaatatttttttctag

SEQ ID NO: 1626728 - DNA, 22 bp, Homo sapiens
tctgaaaatatttttttctagc

SEQ ID NO: 1626729 - DNA, 16 bp, Homo sapiens
tctgaaaatgtatgtg

SEQ ID NO: 1626730 - DNA, 14 bp, Homo sapiens
tctgaaacacacga

SEQ ID NO: 1626731 - DNA, 16 bp, Homo sapiens
tctgaaacagaaagtt

SEQ ID NO: 1626732 - DNA, 22 bp, Homo sapiens
tctgaaacagaaagttggaaag

SEQ ID NO: 1626733 - DNA, 14 bp, Homo sapiens
tctgaaacagagaa

SEQ ID NO: 1626734 - DNA, 15 bp, Homo sapiens
tctgaaacagagaac

SEQ ID NO: 1626735 - DNA, 11 bp, Homo sapiens
tctgaaactgg

SEQ ID NO: 1626736 - DNA, 12 bp, Homo sapiens
tctgaaactggc

SEQ ID NO: 1626737 - DNA, 14 bp, Homo sapiens
tctgaaagccacgt

SEQ ID NO: 1626738 - DNA, 21 bp, Homo sapiens
tctgaaaggagacattgctct

SEQ ID NO: 1626739 - DNA, 19 bp, Homo sapiens
tctgaaataaaatgccata

SEQ ID NO: 1626740 - DNA, 12 bp, Homo sapiens
tctggctgagcc

SEQ ID NO: 1626741 - DNA, 19 bp, Homo sapiens
tctggctgagcccctgggg

SEQ ID NO: 1626742 - DNA, 21 bp, Homo sapiens
tctggctggctaactggaagc

SEQ ID NO: 1626743 - DNA, 20 bp, Homo sapiens
tctggctgggtcaccagaaa

SEQ ID NO: 1626744 - DNA, 22 bp, Homo sapiens
tctggctgtaaggctctagatc

SEQ ID NO: 1626745 - DNA, 17 bp, Homo sapiens
tctggcttagtgccacc

SEQ ID NO: 1626746 - DNA, 15 bp, Homo sapiens
tctggcttccctgga

SEQ ID NO: 1626747 - DNA, 18 bp, Homo sapiens
tctggcttccctggaagc

SEQ ID NO: 1626748 - DNA, 16 bp, Homo sapiens
tctggctttaagaatg

SEQ ID NO: 1626749 - DNA, 17 bp, Homo sapiens
tctggctttaagccttc

SEQ ID NO: 1626750 - DNA, 17 bp, Homo sapiens
tctggctttttctgcca

SEQ ID NO: 1626751 - DNA, 19 bp, Homo sapiens
tctgggaagcttgagcctc

SEQ ID NO: 1626752 - DNA, 21 bp, Homo sapiens
tctgggaagcttgagcctccc

SEQ ID NO: 1626753 - DNA, 16 bp, Homo sapiens
tctgggacctcagttt

SEQ ID NO: 1626754 - DNA, 21 bp, Homo sapiens
tctgggacctgccaggcaggg

SEQ ID NO: 1626755 - DNA, 22 bp, Homo sapiens
tctgggacctgccaggcagggg

SEQ ID NO: 1626756 - DNA, 21 bp, Homo sapiens
tctgggactctcctcctcccc

SEQ ID NO: 1626757 - DNA, 18 bp, Homo sapiens
tctgggagcccagaaccc

SEQ ID NO: 1626758 - DNA, 15 bp, Homo sapiens
tctgggagtcacaca

SEQ ID NO: 1626759 - DNA, 17 bp, Homo sapiens
tctgggagtcacacagt

SEQ ID NO: 1626760 - DNA, 18 bp, Homo sapiens
tctgggataagtaagttt

SEQ ID NO: 1626761 - DNA, 23 bp, Homo sapiens
tctgggatatatggaggattctt

SEQ ID NO: 1626762 - DNA, 21 bp, Homo sapiens
tctgggatatggctgcccagg

SEQ ID NO: 1626763 - DNA, 15 bp, Homo sapiens
tctgggatgtagaac

SEQ ID NO: 1626764 - DNA, 23 bp, Homo sapiens
tctgggatgtagaacttcaagaa

SEQ ID NO: 1626765 - DNA, 15 bp, Homo sapiens
tctgggatgtcacag

SEQ ID NO: 1626766 - DNA, 19 bp, Homo sapiens
tctgggatgtcacagtcca

SEQ ID NO: 1626767 - DNA, 13 bp, Homo sapiens
tctgggcagtgtg

SEQ ID NO: 1626768 - DNA, 19 bp, Homo sapiens
tctgggcagtgtggcctct

SEQ ID NO: 1626769 - DNA, 23 bp, Homo sapiens
tctgggccaagttcctctagtgc

SEQ ID NO: 1626770 - DNA, 19 bp, Homo sapiens
tctgggccagaagtcctcc

SEQ ID NO: 1626771 - DNA, 13 bp, Homo sapiens
tctgggcctgagg

SEQ ID NO: 1626772 - DNA, 12 bp, Homo sapiens
tctgggcctgtt

SEQ ID NO: 1626773 - DNA, 20 bp, Homo sapiens
tctgggcggcgggcggctgg

SEQ ID NO: 1626774 - DNA, 12 bp, Homo sapiens
tctgggctcagg

SEQ ID NO: 1626775 - DNA, 16 bp, Homo sapiens
tctgggctcagggctg

SEQ ID NO: 1626776 - DNA, 17 bp, Homo sapiens
tctgggctcagggctgg

SEQ ID NO: 1626777 - DNA, 22 bp, Homo sapiens
tctgggctgctacccagaaatc

SEQ ID NO: 1626778 - DNA, 21 bp, Homo sapiens
tctgggctgtaacgtggcact

SEQ ID NO: 1626779 - DNA, 16 bp, Homo sapiens
tctgggctgtggggcc

SEQ ID NO: 1626780 - DNA, 22 bp, Homo sapiens
tctggggaaagacactgcctgg

SEQ ID NO: 1626781 - DNA, 22 bp, Homo sapiens
tctggggaaaggggacaaggaa

SEQ ID NO: 1626782 - DNA, 23 bp, Homo sapiens
tctggggacagcttcctcacacc

SEQ ID NO: 1626783 - DNA, 13 bp, Homo sapiens
tctggggagagcg
